United States Patent 7,901,882 (ANALYSIS OF METHYLATION USING NUCLEIC ACID ARRAYS) - sequence listing, part 18

SEQ ID NO: 658523 - DNA, 25 bp, Rattus norvegicus
gatcgctgcgatcaggacactaccc

SEQ ID NO: 658524 - DNA, 25 bp, Rattus norvegicus
gacactaccctctgagcggagttga

SEQ ID NO: 658525 - DNA, 25 bp, Rattus norvegicus
tgcctgtcggtggaacgtaccgaga

SEQ ID NO: 658526 - DNA, 25 bp, Rattus norvegicus
ttccgccgattgttgcggtgcctgt

SEQ ID NO: 658527 - DNA, 25 bp, Rattus norvegicus
tccgccaacggttcctttcgtgctg

SEQ ID NO: 658528 - DNA, 25 bp, Rattus norvegicus
ctgcttggcatctcgcgcagtcttc

SEQ ID NO: 658529 - DNA, 25 bp, Rattus norvegicus
cccgcgctctatggtgctgtaatca

SEQ ID NO: 658530 - DNA, 25 bp, Rattus norvegicus
cgctggggtaaaattgcgtcagttt

SEQ ID NO: 658531 - DNA, 25 bp, Rattus norvegicus
tttcgcctaaatctgaatcagggcc

SEQ ID NO: 658532 - DNA, 25 bp, Rattus norvegicus
tgtgcttgtttgcatacggtgcgcc

SEQ ID NO: 658533 - DNA, 25 bp, Rattus norvegicus
cggactcggcttcagcatccttttc

SEQ ID NO: 658534 - DNA, 25 bp, Rattus norvegicus
ctcctggttccctacatgaatattc

SEQ ID NO: 658535 - DNA, 25 bp, Rattus norvegicus
atattcatgaaagcgtggggcgtgc

SEQ ID NO: 658536 - DNA, 25 bp, Rattus norvegicus
ggcatggaaagaaccctagcagcca

SEQ ID NO: 658537 - DNA, 25 bp, Rattus norvegicus
tcaacaggaaagtttgcgagggcct

SEQ ID NO: 658538 - DNA, 25 bp, Rattus norvegicus
tctgtgcagtgagccagaagaaagc

SEQ ID NO: 658539 - DNA, 25 bp, Rattus norvegicus
gtcgccagtcctcagtctgttcctt

SEQ ID NO: 658540 - DNA, 25 bp, Rattus norvegicus
gcggtttcctctctaggcagtcatc

SEQ ID NO: 658541 - DNA, 25 bp, Rattus norvegicus
tcctgatctcggccagctccaaaga

SEQ ID NO: 658542 - DNA, 25 bp, Rattus norvegicus
gtcagccgacgatggcacattacag

SEQ ID NO: 658543 - DNA, 25 bp, Rattus norvegicus
atgcagatggacaaggccagtgaaa

SEQ ID NO: 658544 - DNA, 25 bp, Rattus norvegicus
gcgcagatgcagatggacaaggcca

SEQ ID NO: 658545 - DNA, 25 bp, Rattus norvegicus
aacacgaagctgtgggcgcagatgc

SEQ ID NO: 658546 - DNA, 25 bp, Rattus norvegicus
tcctgaacacgaagctgtgggcgca

SEQ ID NO: 658547 - DNA, 25 bp, Rattus norvegicus
ggctcatcctgaacacgaagctgtg

SEQ ID NO: 658548 - DNA, 25 bp, Rattus norvegicus
tgcggctcatcctgaacacgaagct

SEQ ID NO: 658549 - DNA, 25 bp, Rattus norvegicus
agcctgcggctcatcctgaacacga

SEQ ID NO: 658550 - DNA, 25 bp, Rattus norvegicus
ggcagcctgcggctcatcctgaaca

SEQ ID NO: 658551 - DNA, 25 bp, Rattus norvegicus
cagtcccggctagtgatgcggaccc

SEQ ID NO: 658552 - DNA, 25 bp, Rattus norvegicus
ttacagtcccggctagtgatgcgga

SEQ ID NO: 658553 - DNA, 25 bp, Rattus norvegicus
tggcacattacagtcccggctagtg

SEQ ID NO: 658554 - DNA, 25 bp, Rattus norvegicus
cgatggcacattacagtcccggcta

SEQ ID NO: 658555 - DNA, 25 bp, Rattus norvegicus
cgatgacggtgatggtcaggctact

SEQ ID NO: 658556 - DNA, 25 bp, Rattus norvegicus
caaggccagtgaaaagagcatccgc

SEQ ID NO: 658557 - DNA, 25 bp, Rattus norvegicus
agagcatccgcatcacagccacgga

SEQ ID NO: 658558 - DNA, 25 bp, Rattus norvegicus
gagccgctgtaccaggctgctgctt

SEQ ID NO: 658559 - DNA, 25 bp, Rattus norvegicus
atggtcaggctactgggagcacata

SEQ ID NO: 658560 - DNA, 25 bp, Rattus norvegicus
ctgtgctggctccttcaggtgtcac

SEQ ID NO: 658561 - DNA, 25 bp, Rattus norvegicus
tgatgaggatgctgtgctggctcct

SEQ ID NO: 658562 - DNA, 25 bp, Rattus norvegicus
ccgaacaggaacaggaggccaaggc

SEQ ID NO: 658563 - DNA, 25 bp, Rattus norvegicus
gtatgctgcgttgcaccaccgcatc

SEQ ID NO: 658564 - DNA, 25 bp, Rattus norvegicus
caggccaactgtatgctgcgttgca

SEQ ID NO: 658565 - DNA, 25 bp, Rattus norvegicus
agctccaaagacacaggccaactgt

SEQ ID NO: 658566 - DNA, 25 bp, Rattus norvegicus
ggcgtcaaggtcttcctgatctcgg

SEQ ID NO: 658567 - DNA, 25 bp, Rattus norvegicus
gaggaccagggcgtcaaggtcttcc

SEQ ID NO: 658568 - DNA, 25 bp, Rattus norvegicus
gagcacatagcagcggagccgctgt

SEQ ID NO: 658569 - DNA, 25 bp, Rattus norvegicus
ttaagattccttgttcccaagcaaa

SEQ ID NO: 658570 - DNA, 25 bp, Rattus norvegicus
caatcccagacgaatccccaaatga

SEQ ID NO: 658571 - DNA, 25 bp, Rattus norvegicus
acgagatcccgggtcttgagcagga

SEQ ID NO: 658572 - DNA, 25 bp, Rattus norvegicus
agatcccgggtcttgagcaggatcc

SEQ ID NO: 658573 - DNA, 25 bp, Rattus norvegicus
atcccgggtcttgagcaggatccca

SEQ ID NO: 658574 - DNA, 25 bp, Rattus norvegicus
tcccgggtcttgagcaggatcccag

SEQ ID NO: 658575 - DNA, 25 bp, Rattus norvegicus
gagcaggatcccaggtcgacacgta

SEQ ID NO: 658576 - DNA, 25 bp, Rattus norvegicus
ggtaagggacattcgtgcggttaca

SEQ ID NO: 658577 - DNA, 25 bp, Rattus norvegicus
taagggacattcgtgcggttacaca

SEQ ID NO: 658578 - DNA, 25 bp, Rattus norvegicus
aagggacattcgtgcggttacacat

SEQ ID NO: 658579 - DNA, 25 bp, Rattus norvegicus
ggtcacactccaatcccagacgaat

SEQ ID NO: 658580 - DNA, 25 bp, Rattus norvegicus
atcaccactggctgcaagcacaagc

SEQ ID NO: 658581 - DNA, 25 bp, Rattus norvegicus
aactcatcaccactggctgcaagca

SEQ ID NO: 658582 - DNA, 25 bp, Rattus norvegicus
agattccttgttcccaagcaaaatt

SEQ ID NO: 658583 - DNA, 25 bp, Rattus norvegicus
cgatctcttagaccctcgccgggta

SEQ ID NO: 658584 - DNA, 25 bp, Rattus norvegicus
ggtattcctggagcgggtgacactc

SEQ ID NO: 658585 - DNA, 25 bp, Rattus norvegicus
aggcccactcgaaggcttacctggc

SEQ ID NO: 658586 - DNA, 25 bp, Rattus norvegicus
gccctagacacgcaggggcttcgcg

SEQ ID NO: 658587 - DNA, 25 bp, Rattus norvegicus
gacctgaccagctccgggaaaggcc

SEQ ID NO: 658588 - DNA, 25 bp, Rattus norvegicus
cttacctggccctggcgtagcaaca

SEQ ID NO: 658589 - DNA, 25 bp, Rattus norvegicus
cggagcctagcgctcctaacgcgga

SEQ ID NO: 658590 - DNA, 25 bp, Rattus norvegicus
tccaggccaggtcgtaggtcggcct

SEQ ID NO: 658591 - DNA, 25 bp, Rattus norvegicus
tgcagcccatgcaagagcttccatg

SEQ ID NO: 658592 - DNA, 25 bp, Rattus norvegicus
gcttccatggaagagtcaacggaca

SEQ ID NO: 658593 - DNA, 25 bp, Rattus norvegicus
cttcccatggcacccggtagtcagg

SEQ ID NO: 658594 - DNA, 25 bp, Rattus norvegicus
gggaggctggccaagatccctgcca

SEQ ID NO: 658595 - DNA, 25 bp, Rattus norvegicus
ggaaggctctcaagaccacgatctc

SEQ ID NO: 658596 - DNA, 25 bp, Rattus norvegicus
aggtgcaggcgatgccaattcggcc

SEQ ID NO: 658597 - DNA, 25 bp, Rattus norvegicus
ggtgaaaagccacaaccgatcctca

SEQ ID NO: 658598 - DNA, 25 bp, Rattus norvegicus
ctgaacgcgaaaggcccaggcactt

SEQ ID NO: 658599 - DNA, 25 bp, Rattus norvegicus
gcccaggcactttcgggaattcaca

SEQ ID NO: 658600 - DNA, 25 bp, Rattus norvegicus
aattcacagtgtgcgaccttggtac

SEQ ID NO: 658601 - DNA, 25 bp, Rattus norvegicus
tgaccgctagtggaggcatcttcct

SEQ ID NO: 658602 - DNA, 25 bp, Rattus norvegicus
gccggctccaaaatgaccgctagtg

SEQ ID NO: 658603 - DNA, 25 bp, Rattus norvegicus
agcggagctgaacgcgaaaggccca

SEQ ID NO: 658604 - DNA, 25 bp, Rattus norvegicus
agtgacgtcgacgtgacccgccctt

SEQ ID NO: 658605 - DNA, 25 bp, Rattus norvegicus
ccctggaacggagcttcgtggagct

SEQ ID NO: 658606 - DNA, 25 bp, Rattus norvegicus
ggtcctcggccagcgaaagtctcac

SEQ ID NO: 658607 - DNA, 25 bp, Rattus norvegicus
ttcaaaatgaaaacacacacagccc

SEQ ID NO: 658608 - DNA, 25 bp, Rattus norvegicus
tcagcctctctctcgcggtgaaaag

SEQ ID NO: 658609 - DNA, 25 bp, Rattus norvegicus
tagtggaggcatcttcctcccgctt

SEQ ID NO: 658610 - DNA, 25 bp, Rattus norvegicus
ggccagcgaaagtctcacaggcccg

SEQ ID NO: 658611 - DNA, 25 bp, Rattus norvegicus
tatttgggacgtccgaaactcgagc

SEQ ID NO: 658612 - DNA, 25 bp, Rattus norvegicus
gctcaggccgcatgcgcaagtgcac

SEQ ID NO: 658613 - DNA, 25 bp, Rattus norvegicus
cggtgccgcggttcatgaatattga

SEQ ID NO: 658614 - DNA, 25 bp, Rattus norvegicus
tgaatattgattacgcaccggggcg

SEQ ID NO: 658615 - DNA, 25 bp, Rattus norvegicus
tctaatctgccgtcgttcgctgctc

SEQ ID NO: 658616 - DNA, 25 bp, Rattus norvegicus
tccggatcccgagaccgattcgacg

SEQ ID NO: 658617 - DNA, 25 bp, Rattus norvegicus
cagaggactcgccttcagaaggtaa

SEQ ID NO: 658618 - DNA, 25 bp, Rattus norvegicus
ctaggctcccaggtgtctcttccaa

SEQ ID NO: 658619 - DNA, 25 bp, Rattus norvegicus
ggtgtctcttccaacccggtgaaga

SEQ ID NO: 658620 - DNA, 25 bp, Rattus norvegicus
taacccaggcgggtgaggtgcacct

SEQ ID NO: 658621 - DNA, 25 bp, Rattus norvegicus
tgcacctcggctgcttgcgatttgg

SEQ ID NO: 658622 - DNA, 25 bp, Rattus norvegicus
ccgggctcatctgaggcgccattgc

SEQ ID NO: 658623 - DNA, 25 bp, Rattus norvegicus
ggcgactagccagtcagtgccggca

SEQ ID NO: 658624 - DNA, 25 bp, Rattus norvegicus
tccgaaactcgagcacggggcttgc

SEQ ID NO: 658625 - DNA, 25 bp, Rattus norvegicus
gatctggagaatgagaccggtgcca

SEQ ID NO: 658626 - DNA, 25 bp, Rattus norvegicus
gcccactgcctgtccggaaggagtc

SEQ ID NO: 658627 - DNA, 25 bp, Rattus norvegicus
ctgcctgtccggaaggagtcgcaga

SEQ ID NO: 658628 - DNA, 25 bp, Rattus norvegicus
gtcgcagagagagaaagtcgtaaac

SEQ ID NO: 658629 - DNA, 25 bp, Rattus norvegicus
aagtcgtaaacgcaggcgctgtgag

SEQ ID NO: 658630 - DNA, 25 bp, Rattus norvegicus
gggcttctgggtaaagatggattcc

SEQ ID NO: 658631 - DNA, 25 bp, Rattus norvegicus
gatggattcctacgatctgtttcgc

SEQ ID NO: 658632 - DNA, 25 bp, Rattus norvegicus
ctacgatctgtttcgccggctcgga

SEQ ID NO: 658633 - DNA, 25 bp, Rattus norvegicus
agttcgacgtgaagcggttctcagc

SEQ ID NO: 658634 - DNA, 25 bp, Rattus norvegicus
gcggttctcagcagacgctactcga

SEQ ID NO: 658635 - DNA, 25 bp, Rattus norvegicus
agcagacgctactcgattccaggta

SEQ ID NO: 658636 - DNA, 25 bp, Rattus norvegicus
gctactcgattccaggtactttctg

SEQ ID NO: 658637 - DNA, 25 bp, Rattus norvegicus
tctgtacgcagggagccgagtgacc

SEQ ID NO: 658638 - DNA, 25 bp, Rattus norvegicus
gtactttctgtacgcagggagccga

SEQ ID NO: 658639 - DNA, 25 bp, Rattus norvegicus
tgaacgtttccagggcttttgcttc

SEQ ID NO: 658640 - DNA, 25 bp, Rattus norvegicus
tctagtggaccaggcgtgggcacac

SEQ ID NO: 658641 - DNA, 25 bp, Rattus norvegicus
cgtaagctaagcatggggccagcga

SEQ ID NO: 658642 - DNA, 25 bp, Rattus norvegicus
gggcatctgttctcagcgtaagcta

SEQ ID NO: 658643 - DNA, 25 bp, Rattus norvegicus
ctggtgttgggcatctgttctcagc

SEQ ID NO: 658644 - DNA, 25 bp, Rattus norvegicus
ctgctctgaagcgactctgcgcgtg

SEQ ID NO: 658645 - DNA, 25 bp, Rattus norvegicus
cagggcactcagaactgaacgtttc

SEQ ID NO: 658646 - DNA, 25 bp, Rattus norvegicus
ggtccacactccgaggcagggcact

SEQ ID NO: 658647 - DNA, 25 bp, Rattus norvegicus
agctttctcctcttggcggtccaca

SEQ ID NO: 658648 - DNA, 25 bp, Rattus norvegicus
cccttgcttgagctttctcctcttg

SEQ ID NO: 658649 - DNA, 25 bp, Rattus norvegicus
agaacctagggagcacggtgtcacc

SEQ ID NO: 658650 - DNA, 25 bp, Rattus norvegicus
ccagctggggagtaaagagaaccta

SEQ ID NO: 658651 - DNA, 25 bp, Rattus norvegicus
tcccgacctgcggaccagctgggga

SEQ ID NO: 658652 - DNA, 25 bp, Rattus norvegicus
cttttctgtggcgtcctggtgttgg

SEQ ID NO: 658653 - DNA, 25 bp, Rattus norvegicus
ccctctgcgcctgtgggtaggctct

SEQ ID NO: 658654 - DNA, 25 bp, Rattus norvegicus
tcgcttggtgactccgtctgtccgt

SEQ ID NO: 658655 - DNA, 25 bp, Rattus norvegicus
cgcaggcgcaagagaaatcgccttt

SEQ ID NO: 658656 - DNA, 25 bp, Rattus norvegicus
atcgcctttcccagtggcgcgagga

SEQ ID NO: 658657 - DNA, 25 bp, Rattus norvegicus
cgaggaacccatacccatacgcatg

SEQ ID NO: 658658 - DNA, 25 bp, Rattus norvegicus
tgccgtttctttaggcgggccagtg

SEQ ID NO: 658659 - DNA, 25 bp, Rattus norvegicus
cgacacgtgatctggaaccggctgt

SEQ ID NO: 658660 - DNA, 25 bp, Rattus norvegicus
ccagccgctcatgtacgtgaaagtg

SEQ ID NO: 658661 - DNA, 25 bp, Rattus norvegicus
tccaggtatgagtcgtcgccctttc

SEQ ID NO: 658662 - DNA, 25 bp, Rattus norvegicus
aggccttcaccttctcgagatgctg

SEQ ID NO: 658663 - DNA, 25 bp, Rattus norvegicus
atgctgcccttatcttccgtcaaga

SEQ ID NO: 658664 - DNA, 25 bp, Rattus norvegicus
aagaacaacttccacggcctcgcgg

SEQ ID NO: 658665 - DNA, 25 bp, Rattus norvegicus
ccatcatggcggacgcggccagtca

SEQ ID NO: 658666 - DNA, 25 bp, Rattus norvegicus
cgtgaaagtgctcatccaggtatga

SEQ ID NO: 658667 - DNA, 25 bp, Rattus norvegicus
gctcagagcgccaggagctctcgga

SEQ ID NO: 658668 - DNA, 25 bp, Rattus norvegicus
actgcgccgcaagagcctgcagtgg

SEQ ID NO: 658669 - DNA, 25 bp, Rattus norvegicus
caggagctctcggagctggtcaaga

SEQ ID NO: 658670 - DNA, 25 bp, Rattus norvegicus
actactgcgccgcaagagcctgcag

SEQ ID NO: 658671 - DNA, 25 bp, Rattus norvegicus
cccggtggagcacccactactgcgc

SEQ ID NO: 658672 - DNA, 25 bp, Rattus norvegicus
agtgggcccgcaagctgagccgcaa

SEQ ID NO: 658673 - DNA, 25 bp, Rattus norvegicus
agcagcgactcagcctgtaccggcg

SEQ ID NO: 658674 - DNA, 25 bp, Rattus norvegicus
gcccgcaagctgagccgcaagagca

SEQ ID NO: 658675 - DNA, 25 bp, Rattus norvegicus
agctgagccgcaagagcagcaagca

SEQ ID NO: 658676 - DNA, 25 bp, Rattus norvegicus
aggcggggaaggcacccatgaccac

SEQ ID NO: 658677 - DNA, 25 bp, Rattus norvegicus
tgaccacagactggatcacccagca

SEQ ID NO: 658678 - DNA, 25 bp, Rattus norvegicus
gactggatcacccagcagcgactca

SEQ ID NO: 658679 - DNA, 25 bp, Rattus norvegicus
tgtaccggcgctcagagcgccagga

SEQ ID NO: 658680 - DNA, 25 bp, Rattus norvegicus
tggcagcacccatggccgtcacggg

SEQ ID NO: 658681 - DNA, 25 bp, Rattus norvegicus
tcaagccgcagcgtgggcgaccagt

SEQ ID NO: 658682 - DNA, 25 bp, Rattus norvegicus
aggcttctcttctctgcaagcgggg

SEQ ID NO: 658683 - DNA, 25 bp, Rattus norvegicus
ggtccccactcgtcgccggctgagc

SEQ ID NO: 658684 - DNA, 25 bp, Rattus norvegicus
tcgtcgccggctgagccccccgcca

SEQ ID NO: 658685 - DNA, 25 bp, Rattus norvegicus
cccggaggcctggtcaagccgcagc

SEQ ID NO: 658686 - DNA, 25 bp, Rattus norvegicus
ttctcttctctgcaagcgggggcgg

SEQ ID NO: 658687 - DNA, 25 bp, Rattus norvegicus
agcgtgggcgaccagtgtgcagccc

SEQ ID NO: 658688 - DNA, 25 bp, Rattus norvegicus
cgaccagtgtgcagcccggcgtcct

SEQ ID NO: 658689 - DNA, 25 bp, Rattus norvegicus
cccggcgtcctcaccgagcaggatc

SEQ ID NO: 658690 - DNA, 25 bp, Rattus norvegicus
ctcaccgagcaggatcgccggctgg

SEQ ID NO: 658691 - DNA, 25 bp, Rattus norvegicus
agcaggatcgccggctgggaccgaa

SEQ ID NO: 658692 - DNA, 25 bp, Rattus norvegicus
gcttctcttctctgcaagcgggggc

SEQ ID NO: 658693 - DNA, 25 bp, Rattus norvegicus
accgagcaggatcgccggctgggac

SEQ ID NO: 658694 - DNA, 25 bp, Rattus norvegicus
aagccgcagcgtgggcgaccagtgt

SEQ ID NO: 658695 - DNA, 25 bp, Rattus norvegicus
cgcctaccgggagcctatttcttct

SEQ ID NO: 658696 - DNA, 25 bp, Rattus norvegicus
ggcttcctggtgtaccctgacctca

SEQ ID NO: 658697 - DNA, 25 bp, Rattus norvegicus
gtacatcactttctctggcttcctg

SEQ ID NO: 658698 - DNA, 25 bp, Rattus norvegicus
gcgcctacagcaaccacggcaagta

SEQ ID NO: 658699 - DNA, 25 bp, Rattus norvegicus
gatcatgatggctatggcgcctaca

SEQ ID NO: 658700 - DNA, 25 bp, Rattus norvegicus
cttcgacaaggtatacgtgaacatc

SEQ ID NO: 658701 - DNA, 25 bp, Rattus norvegicus
ggctgcttagccacgatcatgatgg

SEQ ID NO: 658702 - DNA, 25 bp, Rattus norvegicus
ccatgatttacgacgatggcgcttc

SEQ ID NO: 658703 - DNA, 25 bp, Rattus norvegicus
cgacgaggtgcaggccatgatttac

SEQ ID NO: 658704 - DNA, 25 bp, Rattus norvegicus
ttctccttcacgctgggcaagctgc

SEQ ID NO: 658705 - DNA, 25 bp, Rattus norvegicus
agagtgccatgctgcagctcgacta

SEQ ID NO: 658706 - DNA, 25 bp, Rattus norvegicus
ggcgccacctttagcggctacctgg

SEQ ID NO: 658707 - DNA, 25 bp, Rattus norvegicus
gctggtaaacataggcggcgacttc

SEQ ID NO: 658708 - DNA, 25 bp, Rattus norvegicus
tgaagctgatgaagaaccgcgacga

SEQ ID NO: 658709 - DNA, 25 bp, Rattus norvegicus
cctggctgcagcagacgccatgttc

SEQ ID NO: 658710 - DNA, 25 bp, Rattus norvegicus
ctctggctcctgagctaagctttta

SEQ ID NO: 658711 - DNA, 25 bp, Rattus norvegicus
tcgatggacggtttccttggagacc

SEQ ID NO: 658712 - DNA, 25 bp, Rattus norvegicus
gcgcggtcagattgcacagggttat

SEQ ID NO: 658713 - DNA, 25 bp, Rattus norvegicus
acagggttatggacttccttgtgcc

SEQ ID NO: 658714 - DNA, 25 bp, Rattus norvegicus
tatccgcacatactcacggcgcttg

SEQ ID NO: 658715 - DNA, 25 bp, Rattus norvegicus
tgctgcaacagcactgagggtcgcc

SEQ ID NO: 658716 - DNA, 25 bp, Rattus norvegicus
tctatgtgcaaggtgtgcctctgcc

SEQ ID NO: 658717 - DNA, 25 bp, Rattus norvegicus
tctcggcctgctgttctttgctcac

SEQ ID NO: 658718 - DNA, 25 bp, Rattus norvegicus
gccatgttccttagggtgccgacta

SEQ ID NO: 658719 - DNA, 25 bp, Rattus norvegicus
tccggatctgaacattggcatgaaa

SEQ ID NO: 658720 - DNA, 25 bp, Rattus norvegicus
caatgaatcttcttccgggcggaca

SEQ ID NO: 658721 - DNA, 25 bp, Rattus norvegicus
ggcgttctgggttctaagttctaca

SEQ ID NO: 658722 - DNA, 25 bp, Rattus norvegicus
ccgtgaggttctacgtagccctatt

SEQ ID NO: 658723 - DNA, 25 bp, Rattus norvegicus
agcagcgtcgggtagaagagcaccc

SEQ ID NO: 658724 - DNA, 25 bp, Rattus norvegicus
ggatcccgggacaggaaccatggct

SEQ ID NO: 658725 - DNA, 25 bp, Rattus norvegicus
ggcgcgtcatgctcctcagcggcag

SEQ ID NO: 658726 - DNA, 25 bp, Rattus norvegicus
ccggaacactgtgtagagcagcgtc

SEQ ID NO: 658727 - DNA, 25 bp, Rattus norvegicus
ccgggacaggaaccatggctccaaa

SEQ ID NO: 658728 - DNA, 25 bp, Rattus norvegicus
atgcctcccgactctccgaagctga

SEQ ID NO: 658729 - DNA, 25 bp, Rattus norvegicus
agagctgcgggccacctgatgcctc

SEQ ID NO: 658730 - DNA, 25 bp, Rattus norvegicus
ccaccgcgagaaggacgcagaggac

SEQ ID NO: 658731 - DNA, 25 bp, Rattus norvegicus
tcgcggtcagccaccgcgagaagga

SEQ ID NO: 658732 - DNA, 25 bp, Rattus norvegicus
ccacccgcttcggagctcgcggtca

SEQ ID NO: 658733 - DNA, 25 bp, Rattus norvegicus
acactgtgtagagcagcgtcgggta

SEQ ID NO: 658734 - DNA, 25 bp, Rattus norvegicus
tcgatgcggtggtaccaatcgcggt

SEQ ID NO: 658735 - DNA, 25 bp, Rattus norvegicus
cccagcagcactgtgtggtcgatgc

SEQ ID NO: 658736 - DNA, 25 bp, Rattus norvegicus
catggctccaaaggagaggcgccgc

SEQ ID NO: 658737 - DNA, 25 bp, Rattus norvegicus
cactctccaggcctcgagggcttgg

SEQ ID NO: 658738 - DNA, 25 bp, Rattus norvegicus
attcagcctcagcagcgaggcagcg

SEQ ID NO: 658739 - DNA, 25 bp, Rattus norvegicus
agagcggctgctcatccacttcccg

SEQ ID NO: 658740 - DNA, 25 bp, Rattus norvegicus
taggtgccggaagtgccgccatttt

SEQ ID NO: 658741 - DNA, 25 bp, Rattus norvegicus
tgccgccattttggggtgttctgct

SEQ ID NO: 658742 - DNA, 25 bp, Rattus norvegicus
gagtcctcctctttgggtccgctgt

SEQ ID NO: 658743 - DNA, 25 bp, Rattus norvegicus
ccattttggggtgttctgctctggc

SEQ ID NO: 658744 - DNA, 25 bp, Rattus norvegicus
cagcggcaggctcaggtgcagccgc

SEQ ID NO: 658745 - DNA, 25 bp, Rattus norvegicus
cactccggggacaaggccgcggact

SEQ ID NO: 658746 - DNA, 25 bp, Rattus norvegicus
acaaggccgcggactgctcggaatt

SEQ ID NO: 658747 - DNA, 25 bp, Rattus norvegicus
actgctcggaattcggggcccattc

SEQ ID NO: 658748 - DNA, 25 bp, Rattus norvegicus
ggatcccttgccctttgccttcact

SEQ ID NO: 658749 - DNA, 25 bp, Rattus norvegicus
gagggcttggttcctgcaccgcacc

SEQ ID NO: 658750 - DNA, 25 bp, Rattus norvegicus
gaattcggggcccattcgcgtccgc

SEQ ID NO: 658751 - DNA, 25 bp, Rattus norvegicus
ttctgtcgcgtcaggaatcgcgggt

SEQ ID NO: 658752 - DNA, 25 bp, Rattus norvegicus
agtccagtgactcggcaggagaaga

SEQ ID NO: 658753 - DNA, 25 bp, Rattus norvegicus
tgccgacgcccgagagtccagtgac

SEQ ID NO: 658754 - DNA, 25 bp, Rattus norvegicus
aggaaatgaatctgctgccgacgcc

SEQ ID NO: 658755 - DNA, 25 bp, Rattus norvegicus
tgcgcactcccagtttcggcctttt

SEQ ID NO: 658756 - DNA, 25 bp, Rattus norvegicus
cagggccaattctgtcgcgtcagga

SEQ ID NO: 658757 - DNA, 25 bp, Rattus norvegicus
ctcggcaacgcggacagggccaatt

SEQ ID NO: 658758 - DNA, 25 bp, Rattus norvegicus
tcccagcggcagattcgctcggcaa

SEQ ID NO: 658759 - DNA, 25 bp, Rattus norvegicus
ctcggtttggttcgtggagtcccag

SEQ ID NO: 658760 - DNA, 25 bp, Rattus norvegicus
cctcacaaactggagcaaccggcga

SEQ ID NO: 658761 - DNA, 25 bp, Rattus norvegicus
cgccttttccggtcctgcagcgagt

SEQ ID NO: 658762 - DNA, 25 bp, Rattus norvegicus
tgcatttcccgaaagacgccgcggc

SEQ ID NO: 658763 - DNA, 25 bp, Rattus norvegicus
tccgccacgctaaaaactgcatttc

SEQ ID NO: 658764 - DNA, 25 bp, Rattus norvegicus
ttcggccttttcatgcaggaaatga

SEQ ID NO: 658765 - DNA, 25 bp, Rattus norvegicus
gtgcgtggctgccaaaccgctccgt

SEQ ID NO: 658766 - DNA, 25 bp, Rattus norvegicus
ggcctgagggtccagcgaccactca

SEQ ID NO: 658767 - DNA, 25 bp, Rattus norvegicus
ccactcaccgtgcagcggcagaggt

SEQ ID NO: 658768 - DNA, 25 bp, Rattus norvegicus
gcagcggcagcagatgcagcgctcc

SEQ ID NO: 658769 - DNA, 25 bp, Rattus norvegicus
gccgggccatccagctgcagtcttg

SEQ ID NO: 658770 - DNA, 25 bp, Rattus norvegicus
gtgcagccacgtcacagggacagtc

SEQ ID NO: 658771 - DNA, 25 bp, Rattus norvegicus
agggacagtccggaacctgacgcgc

SEQ ID NO: 658772 - DNA, 25 bp, Rattus norvegicus
taggacggaagtgggtaccctcatg

SEQ ID NO: 658773 - DNA, 25 bp, Rattus norvegicus
taccctcatgggcatcgcttttagc

SEQ ID NO: 658774 - DNA, 25 bp, Rattus norvegicus
gggcatcgcttttagccaagctaaa

SEQ ID NO: 658775 - DNA, 25 bp, Rattus norvegicus
taaactaggttgagggcggcaccca

SEQ ID NO: 658776 - DNA, 25 bp, Rattus norvegicus
cacccatgcggggaccgggatcaac

SEQ ID NO: 658777 - DNA, 25 bp, Rattus norvegicus
ttccttctgagaatgcagtgccggc

SEQ ID NO: 658778 - DNA, 25 bp, Rattus norvegicus
ggacttgagtatggctgctgccttc

SEQ ID NO: 658779 - DNA, 25 bp, Rattus norvegicus
ggcctcgagcactcgcgagtccctt

SEQ ID NO: 658780 - DNA, 25 bp, Rattus norvegicus
cttccaggcttgctgggctcgagat

SEQ ID NO: 658781 - DNA, 25 bp, Rattus norvegicus
gacggttgcgaagcgcgagcgtcct

SEQ ID NO: 658782 - DNA, 25 bp, Rattus norvegicus
ctcgtgcccgagggctgtgagtcac

SEQ ID NO: 658783 - DNA, 25 bp, Rattus norvegicus
ttggagcgaaggctgtgacaaagcc

SEQ ID NO: 658784 - DNA, 25 bp, Rattus norvegicus
tcccttccaggcttgctgggctcga

SEQ ID NO: 658785 - DNA, 25 bp, Rattus norvegicus
cgagtcccttccaggcttgctgggc

SEQ ID NO: 658786 - DNA, 25 bp, Rattus norvegicus
tcgcgagtcccttccaggcttgctg

SEQ ID NO: 658787 - DNA, 25 bp, Rattus norvegicus
aagcgcgagcgtcctggggactcgc

SEQ ID NO: 658788 - DNA, 25 bp, Rattus norvegicus
cccgagcaagatggcgctgcggccg

SEQ ID NO: 658789 - DNA, 25 bp, Rattus norvegicus
tcttcggctgacagctgctggcgcg

SEQ ID NO: 658790 - DNA, 25 bp, Rattus norvegicus
agtgcctgtcttcggctgacagctg

SEQ ID NO: 658791 - DNA, 25 bp, Rattus norvegicus
cggaagtgcctgtcttcggctgaca

SEQ ID NO: 658792 - DNA, 25 bp, Rattus norvegicus
aggctgtgacaaagccggaggaacc

SEQ ID NO: 658793 - DNA, 25 bp, Rattus norvegicus
gccatagcattaacctgtcgcccgg

SEQ ID NO: 658794 - DNA, 25 bp, Rattus norvegicus
cactgatcgcctgcagagcccgcca

SEQ ID NO: 658795 - DNA, 25 bp, Rattus norvegicus
tggcgcaccgctggggcatccagaa

SEQ ID NO: 658796 - DNA, 25 bp, Rattus norvegicus
cgccggccatagcattaacctgtcg

SEQ ID NO: 658797 - DNA, 25 bp, Rattus norvegicus
cttaccagttcagcggcgaggtgct

SEQ ID NO: 658798 - DNA, 25 bp, Rattus norvegicus
agctcacttaccagttcagcggcga

SEQ ID NO: 658799 - DNA, 25 bp, Rattus norvegicus
gtcaagaagaagctcacttaccagt

SEQ ID NO: 658800 - DNA, 25 bp, Rattus norvegicus
caagacgggcgaggtgaagaaagtc

SEQ ID NO: 658801 - DNA, 25 bp, Rattus norvegicus
gcgcgctgcgcaactacggcaagac

SEQ ID NO: 658802 - DNA, 25 bp, Rattus norvegicus
acctaccagaagatggcgcgcgcgc

SEQ ID NO: 658803 - DNA, 25 bp, Rattus norvegicus
cgcaagaagatgacctaccagaaga

SEQ ID NO: 658804 - DNA, 25 bp, Rattus norvegicus
ccagaagggaaaccgcaagaagatg

SEQ ID NO: 658805 - DNA, 25 bp, Rattus norvegicus
gctgcgcaactacggcaagacgggc

SEQ ID NO: 658806 - DNA, 25 bp, Rattus norvegicus
ctggggcatccagaagggaaaccgc

SEQ ID NO: 658807 - DNA, 25 bp, Rattus norvegicus
tactctccgaggaacctgccaggcc

SEQ ID NO: 658808 - DNA, 25 bp, Rattus norvegicus
caaaaataaggcgtgcgcacgcacg

SEQ ID NO: 658809 - DNA, 25 bp, Rattus norvegicus
ggctacgcacacacctatcgctgtg

SEQ ID NO: 658810 - DNA, 25 bp, Rattus norvegicus
cgttgaacaaaaataaggcgtgcgc

SEQ ID NO: 658811 - DNA, 25 bp, Rattus norvegicus
tcactttctcagcaggctccacgcc

SEQ ID NO: 658812 - DNA, 25 bp, Rattus norvegicus
ttcagggccgcctcagagacccttt

SEQ ID NO: 658813 - DNA, 25 bp, Rattus norvegicus
tcctggaaccgcttttcctctcagg

SEQ ID NO: 658814 - DNA, 25 bp, Rattus norvegicus
tcaaagacccacacagggctccaga

SEQ ID NO: 658815 - DNA, 25 bp, Rattus norvegicus
gcgctccctacctactctccgagga

SEQ ID NO: 658816 - DNA, 25 bp, Rattus norvegicus
cggacgtctccgaaccgcgaagcgc

SEQ ID NO: 658817 - DNA, 25 bp, Rattus norvegicus
agcgcccgtcgcttcctagcccagc

SEQ ID NO: 658818 - DNA, 25 bp, Rattus norvegicus
ggaaagtcggctacgcacacaccta

SEQ ID NO: 658819 - DNA, 25 bp, Rattus norvegicus
acacctatcgctgtgggagtgggaa

SEQ ID NO: 658820 - DNA, 25 bp, Rattus norvegicus
ggctccagaccgcacgcgctcccta

SEQ ID NO: 658821 - DNA, 25 bp, Rattus norvegicus
gaaggctgcacttccggcaagtgtc

SEQ ID NO: 658822 - DNA, 25 bp, Rattus norvegicus
tgctgcacagcctacaacggtgatg

SEQ ID NO: 658823 - DNA, 25 bp, Rattus norvegicus
ttccgggctcttgctgcacagccta

SEQ ID NO: 658824 - DNA, 25 bp, Rattus norvegicus
ctgcagcaggtaccgcccaaggcgt

SEQ ID NO: 658825 - DNA, 25 bp, Rattus norvegicus
cggcaagtgtccttacgaatgcatc

SEQ ID NO: 658826 - DNA, 25 bp, Rattus norvegicus
cagaaaaatggcgaaggctgcactt

SEQ ID NO: 658827 - DNA, 25 bp, Rattus norvegicus
tctctcgcaacccacagaaaaatgg

SEQ ID NO: 658828 - DNA, 25 bp, Rattus norvegicus
tgtttgcattccctcccaaattccg

SEQ ID NO: 658829 - DNA, 25 bp, Rattus norvegicus
aagccttttctgtttgcattccctc

SEQ ID NO: 658830 - DNA, 25 bp, Rattus norvegicus
gtcgcgttacagtctcaccctcgtt

SEQ ID NO: 658831 - DNA, 25 bp, Rattus norvegicus
tttctgcccggaaggtcgcgttaca

SEQ ID NO: 658832 - DNA, 25 bp, Rattus norvegicus
gtagacgaagaggtaagcgcctcta

SEQ ID NO: 658833 - DNA, 25 bp, Rattus norvegicus
tcggcccagactccatccagggaaa

SEQ ID NO: 658834 - DNA, 25 bp, Rattus norvegicus
ttacgaatgcatccgggcggctgca

SEQ ID NO: 658835 - DNA, 25 bp, Rattus norvegicus
caggtagcttggcacagacaacttc

SEQ ID NO: 658836 - DNA, 25 bp, Rattus norvegicus
ctcttccggagtaacgtgtggagcg

SEQ ID NO: 658837 - DNA, 25 bp, Rattus norvegicus
cacctcttccggagtaacgtgtgga

SEQ ID NO: 658838 - DNA, 25 bp, Rattus norvegicus
gctccacctcttccggagtaacgtg

SEQ ID NO: 658839 - DNA, 25 bp, Rattus norvegicus
aacttcgcgccaaactctcctaggg

SEQ ID NO: 658840 - DNA, 25 bp, Rattus norvegicus
ttcgcgccaaactctcctagggctg

SEQ ID NO: 658841 - DNA, 25 bp, Rattus norvegicus
tagcttggcacagacaacttcgcgc

SEQ ID NO: 658842 - DNA, 25 bp, Rattus norvegicus
cgtcgcaggtagcttggcacagaca

SEQ ID NO: 658843 - DNA, 25 bp, Rattus norvegicus
cgccgtcgtcgcaggtagcttggca

SEQ ID NO: 658844 - DNA, 25 bp, Rattus norvegicus
gccaaactctcctagggctgcttta

SEQ ID NO: 658845 - DNA, 25 bp, Rattus norvegicus
caaactctcctagggctgctttact

SEQ ID NO: 658846 - DNA, 25 bp, Rattus norvegicus
gccccctcgggattgccacagtagg

SEQ ID NO: 658847 - DNA, 25 bp, Rattus norvegicus
gattgccacagtagggggctgtccc

SEQ ID NO: 658848 - DNA, 25 bp, Rattus norvegicus
ggcacagacaacttcgcgccaaact

SEQ ID NO: 658849 - DNA, 25 bp, Rattus norvegicus
cgcgcccgttctgaagccctagaag

SEQ ID NO: 658850 - DNA, 25 bp, Rattus norvegicus
gtggctctagctcgctttctggtcc

SEQ ID NO: 658851 - DNA, 25 bp, Rattus norvegicus
ccctgagaggacacggtgagtgctt

SEQ ID NO: 658852 - DNA, 25 bp, Rattus norvegicus
cagccaagggaaatggggcgtccac

SEQ ID NO: 658853 - DNA, 25 bp, Rattus norvegicus
gcgtttctacagaccagccaaggga

SEQ ID NO: 658854 - DNA, 25 bp, Rattus norvegicus
ggccatctcatctcctacgctaatt

SEQ ID NO: 658855 - DNA, 25 bp, Rattus norvegicus
ccacgctggaggagtaaatcatctc

SEQ ID NO: 658856 - DNA, 25 bp, Rattus norvegicus
tctggtcctccgactcctgaagttg

SEQ ID NO: 658857 - DNA, 25 bp, Rattus norvegicus
acccgggagtggtagaactgcacat

SEQ ID NO: 658858 - DNA, 25 bp, Rattus norvegicus
agcagatcctatggctcgtatcccg

SEQ ID NO: 658859 - DNA, 25 bp, Rattus norvegicus
accttagactattggctccggcttc

SEQ ID NO: 658860 - DNA, 25 bp, Rattus norvegicus
ctgaagttggcaatgggacggactc

SEQ ID NO: 658861 - DNA, 25 bp, Rattus norvegicus
tgccactgagcgcaaggccatctca

SEQ ID NO: 658862 - DNA, 25 bp, Rattus norvegicus
tgcacatcgagcgtgaccagattcc

SEQ ID NO: 658863 - DNA, 25 bp, Rattus norvegicus
tcccggctgtgacgtcatgtttcag

SEQ ID NO: 658864 - DNA, 25 bp, Rattus norvegicus
gcacgtagggttctggcgttcaaca

SEQ ID NO: 658865 - DNA, 25 bp, Rattus norvegicus
ggcccgagcaagagcgaaatccaga

SEQ ID NO: 658866 - DNA, 25 bp, Rattus norvegicus
tcgcgaggaaatttgggccaaccca

SEQ ID NO: 658867 - DNA, 25 bp, Rattus norvegicus
tcagacccattgtggagctcccggc

SEQ ID NO: 658868 - DNA, 25 bp, Rattus norvegicus
tctgggccctaaccatttactcgtc

SEQ ID NO: 658869 - DNA, 25 bp, Rattus norvegicus
cgcccgacgttcattggcccagata

SEQ ID NO: 658870 - DNA, 25 bp, Rattus norvegicus
tcactctactcgtaggcgggtcagg

SEQ ID NO: 658871 - DNA, 25 bp, Rattus norvegicus
ctttttaagaggcttcgcgcaattc

SEQ ID NO: 658872 - DNA, 25 bp, Rattus norvegicus
tcgcgcaattcccaccaacaaggtg

SEQ ID NO: 658873 - DNA, 25 bp, Rattus norvegicus
acgtctcctgtcctctagggtctga

SEQ ID NO: 658874 - DNA, 25 bp, Rattus norvegicus
ctttcttgtggtttctagcgctggg

SEQ ID NO: 658875 - DNA, 25 bp, Rattus norvegicus
gcccagatatggtcgaatcactcta

SEQ ID NO: 658876 - DNA, 25 bp, Rattus norvegicus
gtcatgtttcagtcccgcccgacgt

SEQ ID NO: 658877 - DNA, 25 bp, Rattus norvegicus
tcactagaagctcgggcagcaattc

SEQ ID NO: 658878 - DNA, 25 bp, Rattus norvegicus
ctcactcactagaagctcgggcagc

SEQ ID NO: 658879 - DNA, 25 bp, Rattus norvegicus
ggggcggcttcaactccagcagtac

SEQ ID NO: 658880 - DNA, 25 bp, Rattus norvegicus
gggagaagacccaagacgcttgctc

SEQ ID NO: 658881 - DNA, 25 bp, Rattus norvegicus
cgggcagcaattcctactcgagagg

SEQ ID NO: 658882 - DNA, 25 bp, Rattus norvegicus
tggggcctgaagtcccaccctcgag

SEQ ID NO: 658883 - DNA, 25 bp, Rattus norvegicus
gtcgctgcaggactcgcctcctggg

SEQ ID NO: 658884 - DNA, 25 bp, Rattus norvegicus
cctgagactggtcgctgcaggactc

SEQ ID NO: 658885 - DNA, 25 bp, Rattus norvegicus
aaagtttgtccctgagactggtcgc

SEQ ID NO: 658886 - DNA, 25 bp, Rattus norvegicus
cgcacacggtaagcggcgtcgcagc

SEQ ID NO: 658887 - DNA, 25 bp, Rattus norvegicus
cctgctctgcgcacacggtaagcgg

SEQ ID NO: 658888 - DNA, 25 bp, Rattus norvegicus
gggaatcctccgctgatcctctggg

SEQ ID NO: 658889 - DNA, 25 bp, Rattus norvegicus
ccagcagtactggaggcagcagcaa

SEQ ID NO: 658890 - DNA, 25 bp, Rattus norvegicus
tcctactcgagaggggacattggtg

SEQ ID NO: 658891 - DNA, 25 bp, Rattus norvegicus
gcgttctcgcgaacccggcaggtct

SEQ ID NO: 658892 - DNA, 25 bp, Rattus norvegicus
catagccctttcaaacggaccaata

SEQ ID NO: 658893 - DNA, 25 bp, Rattus norvegicus
tgcgcgcgttccctttaaggccgca

SEQ ID NO: 658894 - DNA, 25 bp, Rattus norvegicus
agcggttttaaacggcttagagcag

SEQ ID NO: 658895 - DNA, 25 bp, Rattus norvegicus
ccctcggttctgacccagcggaggt

SEQ ID NO: 658896 - DNA, 25 bp, Rattus norvegicus
tggacggtgggcctcacttgttcgc

SEQ ID NO: 658897 - DNA, 25 bp, Rattus norvegicus
tcacttgttcgcctggaccctgagg

SEQ ID NO: 658898 - DNA, 25 bp, Rattus norvegicus
caataaagggacgataggcggttct

SEQ ID NO: 658899 - DNA, 25 bp, Rattus norvegicus
ataggcggttctccgaggaccaata

SEQ ID NO: 658900 - DNA, 25 bp, Rattus norvegicus
taaacaacgaggacactgcggggtg

SEQ ID NO: 658901 - DNA, 25 bp, Rattus norvegicus
ggcgcgtgcccatagccctttcaaa

SEQ ID NO: 658902 - DNA, 25 bp, Rattus norvegicus
tgcggcggctcaagcggttttaaac

SEQ ID NO: 658903 - DNA, 25 bp, Rattus norvegicus
ctggaccctgaggatccggcgtcgc

SEQ ID NO: 658904 - DNA, 25 bp, Rattus norvegicus
ctccgaggaccaataaacaacgagg

SEQ ID NO: 658905 - DNA, 25 bp, Rattus norvegicus
tcgacctcgccctgctagggtagcg

SEQ ID NO: 658906 - DNA, 25 bp, Rattus norvegicus
aggcggttcccagcagctgacttac

SEQ ID NO: 658907 - DNA, 25 bp, Rattus norvegicus
cctttaagcgttctgtgtgcgtgca

SEQ ID NO: 658908 - DNA, 25 bp, Rattus norvegicus
aagcgttctgtgtgcgtgcaaagga

SEQ ID NO: 658909 - DNA, 25 bp, Rattus norvegicus
cgggcactcttgacagcggtgctcc

SEQ ID NO: 658910 - DNA, 25 bp, Rattus norvegicus
gcactcttgacagcggtgctcctgt

SEQ ID NO: 658911 - DNA, 25 bp, Rattus norvegicus
ccgccctgtaggaggcggttcccag

SEQ ID NO: 658912 - DNA, 25 bp, Rattus norvegicus
ttcccagcagctgacttaccaatgc

SEQ ID NO: 658913 - DNA, 25 bp, Rattus norvegicus
agctgacttaccaatgccgctgcct

SEQ ID NO: 658914 - DNA, 25 bp, Rattus norvegicus
gcctgctaccgggtattcctgctga

SEQ ID NO: 658915 - DNA, 25 bp, Rattus norvegicus
accgggtattcctgctgatcctgca

SEQ ID NO: 658916 - DNA, 25 bp, Rattus norvegicus
tattcctgctgatcctgcacggaca

SEQ ID NO: 658917 - DNA, 25 bp, Rattus norvegicus
acatatattagggtcgacctcgccc

SEQ ID NO: 658918 - DNA, 25 bp, Rattus norvegicus
cctgcacggacatatattagggtcg

SEQ ID NO: 658919 - DNA, 25 bp, Rattus norvegicus
tctgagctagcgttcgaaggatccg

SEQ ID NO: 658920 - DNA, 25 bp, Rattus norvegicus
cacaaagtttgcagagccgagggtc

SEQ ID NO: 658921 - DNA, 25 bp, Rattus norvegicus
tcgcggggtgcatactgacgactgc

SEQ ID NO: 658922 - DNA, 25 bp, Rattus norvegicus
tgcatactgacgactgccagcctgg

SEQ ID NO: 658923 - DNA, 25 bp, Rattus norvegicus
actgacgactgccagcctgggttcg

SEQ ID NO: 658924 - DNA, 25 bp, Rattus norvegicus
ctgggttcgggggatcccagcctct

SEQ ID NO: 658925 - DNA, 25 bp, Rattus norvegicus
ggtcgcagggcacccgcacaaagtt

SEQ ID NO: 658926 - DNA, 25 bp, Rattus norvegicus
catcccgtaccgagcgtcccggttg

SEQ ID NO: 658927 - DNA, 25 bp, Rattus norvegicus
ctgttgcgtggctcgcggcttctgc

SEQ ID NO: 658928 - DNA, 25 bp, Rattus norvegicus
ctggcccggattcccactcacctgg

SEQ ID NO: 658929 - DNA, 25 bp, Rattus norvegicus
actcacctggacgtactcgcaaacc

SEQ ID NO: 658930 - DNA, 25 bp, Rattus norvegicus
ctgctcctcgctgcggcgttgtcct

SEQ ID NO: 658931 - DNA, 25 bp, Rattus norvegicus
gcccagcttctgagctagcgttcga

SEQ ID NO: 658932 - DNA, 25 bp, Rattus norvegicus
tccggcccagcttctgagctagcgt

SEQ ID NO: 658933 - DNA, 25 bp, Rattus norvegicus
gccgagctttgacaggcgtggcaaa

SEQ ID NO: 658934 - DNA, 25 bp, Rattus norvegicus
agggcgatacggacctagaatttca

SEQ ID NO: 658935 - DNA, 25 bp, Rattus norvegicus
tttcagaggtccaatagtttcctgc

SEQ ID NO: 658936 - DNA, 25 bp, Rattus norvegicus
cctgcgtctggaaaagcggaaccca

SEQ ID NO: 658937 - DNA, 25 bp, Rattus norvegicus
agcggaacccaacctactcactttg

SEQ ID NO: 658938 - DNA, 25 bp, Rattus norvegicus
actcactttgggtagcgacggtcag

SEQ ID NO: 658939 - DNA, 25 bp, Rattus norvegicus
acggtcagtcggacagttcggctgt

SEQ ID NO: 658940 - DNA, 25 bp, Rattus norvegicus
ttcggctgtctagcctcacaggcga

SEQ ID NO: 658941 - DNA, 25 bp, Rattus norvegicus
tcacaggcgatcactttggcaggtg

SEQ ID NO: 658942 - DNA, 25 bp, Rattus norvegicus
aaagccatgtttggaccgggcagca

SEQ ID NO: 658943 - DNA, 25 bp, Rattus norvegicus
gagccggatgtttgccgagctttga

SEQ ID NO: 658944 - DNA, 25 bp, Rattus norvegicus
tggcaaagggagcattacccgaacg

SEQ ID NO: 658945 - DNA, 25 bp, Rattus norvegicus
tacccgaacgcggtgagctgcaaag

SEQ ID NO: 658946 - DNA, 25 bp, Rattus norvegicus
caagccggaagttggtagaaggtat

SEQ ID NO: 658947 - DNA, 25 bp, Rattus norvegicus
ctaaaaaagctgtcggactggtgtc

SEQ ID NO: 658948 - DNA, 25 bp, Rattus norvegicus
cggcagtgacagcacaggtcgcaga

SEQ ID NO: 658949 - DNA, 25 bp, Rattus norvegicus
ggtcgcagagagatacctcacgcta

SEQ ID NO: 658950 - DNA, 25 bp, Rattus norvegicus
gactggtgtcgactggttttcttca

SEQ ID NO: 658951 - DNA, 25 bp, Rattus norvegicus
tccctaagacagcaaccagtcgctg

SEQ ID NO: 658952 - DNA, 25 bp, Rattus norvegicus
gcgccgccatcgttagtgtttgttt

SEQ ID NO: 658953 - DNA, 25 bp, Rattus norvegicus
tgttttcatccgcttcagtgcaggc

SEQ ID NO: 658954 - DNA, 25 bp, Rattus norvegicus
ctacggaaaggtggcgatcagcgtt

SEQ ID NO: 658955 - DNA, 25 bp, Rattus norvegicus
cgccaccgacgacctatttagtatt

SEQ ID NO: 658956 - DNA, 25 bp, Rattus norvegicus
tgtacctcaaagtcttcacgaaagg

SEQ ID NO: 658957 - DNA, 25 bp, Rattus norvegicus
aggctaggcttcgtgtggaatgttc

SEQ ID NO: 658958 - DNA, 25 bp, Rattus norvegicus
tcgcggtagccgagattctgaaaac

SEQ ID NO: 658959 - DNA, 25 bp, Rattus norvegicus
tgcgccgggtaattcggtagctacg

SEQ ID NO: 658960 - DNA, 25 bp, Rattus norvegicus
ggggaaatgtagctgtctaacttca

SEQ ID NO: 658961 - DNA, 25 bp, Rattus norvegicus
tgggcgctcttcctttgatgtctgg

SEQ ID NO: 658962 - DNA, 25 bp, Rattus norvegicus
tccgccgaaggcaggaggagacctt

SEQ ID NO: 658963 - DNA, 25 bp, Rattus norvegicus
ttcgatgatcttttgcagcgtcttc

SEQ ID NO: 658964 - DNA, 25 bp, Rattus norvegicus
ttgcagcgtcttctaggttgatgtc

SEQ ID NO: 658965 - DNA, 25 bp, Rattus norvegicus
tctaggttgatgtctccagagcggc

SEQ ID NO: 658966 - DNA, 25 bp, Rattus norvegicus
cggtgccaggtcctggactgagtta

SEQ ID NO: 658967 - DNA, 25 bp, Rattus norvegicus
ctggactgagttatccgggagaccc

SEQ ID NO: 658968 - DNA, 25 bp, Rattus norvegicus
ctgggaggcccggtccggcatcctt

SEQ ID NO: 658969 - DNA, 25 bp, Rattus norvegicus
ctttcttccgctggtcggtcgagcg

SEQ ID NO: 658970 - DNA, 25 bp, Rattus norvegicus
tggctccgtgcgctcgttggccttc

SEQ ID NO: 658971 - DNA, 25 bp, Rattus norvegicus
gcactcggctgcagttccttgaacg

SEQ ID NO: 658972 - DNA, 25 bp, Rattus norvegicus
tccttgaacgattgcttgggcgctc

SEQ ID NO: 658973 - DNA, 25 bp, Rattus norvegicus
gctctggccgctttcttccgctggt

SEQ ID NO: 658974 - DNA, 25 bp, Rattus norvegicus
tgggcgttcgtgtgttcgatgatct

SEQ ID NO: 658975 - DNA, 25 bp, Rattus norvegicus
tgggaccaaaccctcaaaatcagga

SEQ ID NO: 658976 - DNA, 25 bp, Rattus norvegicus
gaggctcgtgccaccttcagtctca

SEQ ID NO: 658977 - DNA, 25 bp, Rattus norvegicus
ttcagtctcacagctagtgcgcgtc

SEQ ID NO: 658978 - DNA, 25 bp, Rattus norvegicus
tcttttgccaggttagatgctcgcc

SEQ ID NO: 658979 - DNA, 25 bp, Rattus norvegicus
cgacggctccagtcttttggctgcc

SEQ ID NO: 658980 - DNA, 25 bp, Rattus norvegicus
cagaagcacgttgctagaatccgcc

SEQ ID NO: 658981 - DNA, 25 bp, Rattus norvegicus
cacaccaggggcctgttgggaccaa

SEQ ID NO: 658982 - DNA, 25 bp, Rattus norvegicus
tcaggattaaactgcaggcgggaca

SEQ ID NO: 658983 - DNA, 25 bp, Rattus norvegicus
gcgtgaaaacacttcggggtccaga

SEQ ID NO: 658984 - DNA, 25 bp, Rattus norvegicus
atagccaagcttggccgcctggttc

SEQ ID NO: 658985 - DNA, 25 bp, Rattus norvegicus
gaggctaatcctccctggcgactgt

SEQ ID NO: 658986 - DNA, 25 bp, Rattus norvegicus
ccatctctcgggaagggtgtaagca

SEQ ID NO: 658987 - DNA, 25 bp, Rattus norvegicus
agcgctgaactcattctcggtgtcg

SEQ ID NO: 658988 - DNA, 25 bp, Rattus norvegicus
tcaagggtgccctacactccaggtg

SEQ ID NO: 658989 - DNA, 25 bp, Rattus norvegicus
cctctacttcgtcctcaaggctgta

SEQ ID NO: 658990 - DNA, 25 bp, Rattus norvegicus
tctgcagacaaaggccgcggcggcc

SEQ ID NO: 658991 - DNA, 25 bp, Rattus norvegicus
gtcctattcagcaaccgccgcgttc

SEQ ID NO: 658992 - DNA, 25 bp, Rattus norvegicus
ctcaaggctgtagacacgcttgtcc

SEQ ID NO: 658993 - DNA, 25 bp, Rattus norvegicus
cccagtcggggttcttagtagctgt

SEQ ID NO: 658994 - DNA, 25 bp, Rattus norvegicus
tgctgctgcatgctccgggcgccga

SEQ ID NO: 658995 - DNA, 25 bp, Rattus norvegicus
gcgtccaccatctgcagacaaaggc

SEQ ID NO: 658996 - DNA, 25 bp, Rattus norvegicus
tcgtagcggtccagcggcaccaggt

SEQ ID NO: 658997 - DNA, 25 bp, Rattus norvegicus
cagatccactgcaggttggcggcga

SEQ ID NO: 658998 - DNA, 25 bp, Rattus norvegicus
cttcgcacagatccactgcaggttg

SEQ ID NO: 658999 - DNA, 25 bp, Rattus norvegicus
taggccataggccttcgcacagatc

SEQ ID NO: 659000 - DNA, 25 bp, Rattus norvegicus
ctctagtaccatcccggaaccggat

SEQ ID NO: 659001 - DNA, 25 bp, Rattus norvegicus
cggtcgcatccaaaaccagtgcgtc

SEQ ID NO: 659002 - DNA, 25 bp, Rattus norvegicus
tagtagctgtggacacaccctcggc

SEQ ID NO: 659003 - DNA, 25 bp, Rattus norvegicus
cagagcagccgtcgggtcaggaccc

SEQ ID NO: 659004 - DNA, 25 bp, Rattus norvegicus
ttggctgctcttcaaggcgccggaa

SEQ ID NO: 659005 - DNA, 25 bp, Rattus norvegicus
agcagccgtcgggtcaggacccaca

SEQ ID NO: 659006 - DNA, 25 bp, Rattus norvegicus
gctgctcttcaaggcgccggaagat

SEQ ID NO: 659007 - DNA, 25 bp, Rattus norvegicus
ttcaaggcgccggaagatgaagccc

SEQ ID NO: 659008 - DNA, 25 bp, Rattus norvegicus
gcgccggaagatgaagccccaaagc

SEQ ID NO: 659009 - DNA, 25 bp, Rattus norvegicus
cccggagcctccagcacgctctagc

SEQ ID NO: 659010 - DNA, 25 bp, Rattus norvegicus
tccagcacgctctagccggtggagt

SEQ ID NO: 659011 - DNA, 25 bp, Rattus norvegicus
cagcacgctctagccggtggagtca

SEQ ID NO: 659012 - DNA, 25 bp, Rattus norvegicus
acgctctagccggtggagtcatctg

SEQ ID NO: 659013 - DNA, 25 bp, Rattus norvegicus
tctagccggtggagtcatctgtccg

SEQ ID NO: 659014 - DNA, 25 bp, Rattus norvegicus
gccggtggagtcatctgtccgcgac

SEQ ID NO: 659015 - DNA, 25 bp, Rattus norvegicus
gggtcaggacccacactccctcact

SEQ ID NO: 659016 - DNA, 25 bp, Rattus norvegicus
ctcccgttggctgctcttcaaggcg

SEQ ID NO: 659017 - DNA, 25 bp, Rattus norvegicus
gctcccgcacacaagttcgtggtta

SEQ ID NO: 659018 - DNA, 25 bp, Rattus norvegicus
gccctgccctgacggcttttctgta

SEQ ID NO: 659019 - DNA, 25 bp, Rattus norvegicus
agccacggacacaggcggtatctcc

SEQ ID NO: 659020 - DNA, 25 bp, Rattus norvegicus
cacgtttcttgatgggtgccttgca

SEQ ID NO: 659021 - DNA, 25 bp, Rattus norvegicus
gcgctcccgagtagtcacacacaaa

SEQ ID NO: 659022 - DNA, 25 bp, Rattus norvegicus
tactagtgtctactcgcgctcccga

SEQ ID NO: 659023 - DNA, 25 bp, Rattus norvegicus
cactggcacaggcaagcagctacta

SEQ ID NO: 659024 - DNA, 25 bp, Rattus norvegicus
ttcaaaggcgcactggtatccaggc

SEQ ID NO: 659025 - DNA, 25 bp, Rattus norvegicus
tggttacgaccacccaagccctatg

SEQ ID NO: 659026 - DNA, 25 bp, Rattus norvegicus
ttcgttgagagtccagcatttgctc

SEQ ID NO: 659027 - DNA, 25 bp, Rattus norvegicus
gcgcgctctccattcttgacaatgc

SEQ ID NO: 659028 - DNA, 25 bp, Rattus norvegicus
attcgtcgactatcgcagaggcttc

SEQ ID NO: 659029 - DNA, 25 bp, Rattus norvegicus
ctcgacagaagtcagcccacggctg

SEQ ID NO: 659030 - DNA, 25 bp, Rattus norvegicus
gcgctggcatgctcacacgttcaaa

SEQ ID NO: 659031 - DNA, 25 bp, Rattus norvegicus
ccactcccaggtgccggggaagcag

SEQ ID NO: 659032 - DNA, 25 bp, Rattus norvegicus
aaccttgtcgcaagcccgtcgaggc

SEQ ID NO: 659033 - DNA, 25 bp, Rattus norvegicus
tctgccggtctcaaaccttgtcgca

SEQ ID NO: 659034 - DNA, 25 bp, Rattus norvegicus
aagcagcctccgctccaggaagtgc

SEQ ID NO: 659035 - DNA, 25 bp, Rattus norvegicus
accgcctgtgcctggcgcttggata

SEQ ID NO: 659036 - DNA, 25 bp, Rattus norvegicus
cggaggccgactccgagtcgctgct

SEQ ID NO: 659037 - DNA, 25 bp, Rattus norvegicus
gcggagccttgtccggctccggatc

SEQ ID NO: 659038 - DNA, 25 bp, Rattus norvegicus
cctcttggttaagcgccgcggagcc

SEQ ID NO: 659039 - DNA, 25 bp, Rattus norvegicus
gaagcgcactaccagccggtgccag

SEQ ID NO: 659040 - DNA, 25 bp, Rattus norvegicus
cgggaagcgcctcttggttaagcgc

SEQ ID NO: 659041 - DNA, 25 bp, Rattus norvegicus
tcacctgtgcccaaagagccgcagc

SEQ ID NO: 659042 - DNA, 25 bp, Rattus norvegicus
gatacccacgctgggacagcctgtc

SEQ ID NO: 659043 - DNA, 25 bp, Rattus norvegicus
tgcctggcgcttggatacccacgct

SEQ ID NO: 659044 - DNA, 25 bp, Rattus norvegicus
gctccaggaagtgccgacagccgcg

SEQ ID NO: 659045 - DNA, 25 bp, Rattus norvegicus
ccttacctgtatgacacctgctttc

SEQ ID NO: 659046 - DNA, 25 bp, Rattus norvegicus
aggcaccggggtgtcaccttagaga

SEQ ID NO: 659047 - DNA, 25 bp, Rattus norvegicus
ccaagccggagccttgtagctgtcg

SEQ ID NO: 659048 - DNA, 25 bp, Rattus norvegicus
gagcctgaggtctaaccaagccgga

SEQ ID NO: 659049 - DNA, 25 bp, Rattus norvegicus
ccctggggagactgtgtccttggaa

SEQ ID NO: 659050 - DNA, 25 bp, Rattus norvegicus
gcccggaccaagcaaagaggctctg

SEQ ID NO: 659051 - DNA, 25 bp, Rattus norvegicus
aagttcagtctcgagcgcgcccaag

SEQ ID NO: 659052 - DNA, 25 bp, Rattus norvegicus
cgtcgtgaacacaccgctgctagtt

SEQ ID NO: 659053 - DNA, 25 bp, Rattus norvegicus
agagacactcgccaagccgtagggt

SEQ ID NO: 659054 - DNA, 25 bp, Rattus norvegicus
caccgctgctagttcagtgctgatc

SEQ ID NO: 659055 - DNA, 25 bp, Rattus norvegicus
tggagaacccgccaaagttcagtct

SEQ ID NO: 659056 - DNA, 25 bp, Rattus norvegicus
acctgctttcgaaggtgcatctggc

SEQ ID NO: 659057 - DNA, 25 bp, Rattus norvegicus
tgcatctggctgaatcgctcttcta

SEQ ID NO: 659058 - DNA, 25 bp, Rattus norvegicus
cgctcttctaccagaggtcccgaag

SEQ ID NO: 659059 - DNA, 25 bp, Rattus norvegicus
tttattggtgagagcagagacgctc

SEQ ID NO: 659060 - DNA, 25 bp, Rattus norvegicus
gccggctccactctctggaaggaga

SEQ ID NO: 659061 - DNA, 25 bp, Rattus norvegicus
gcagagacgctcctggccaatgata

SEQ ID NO: 659062 - DNA, 25 bp, Rattus norvegicus
tcctggccaatgataagaggctgca

SEQ ID NO: 659063 - DNA, 25 bp, Rattus norvegicus
ataagaggctgcaagccaccgcccg

SEQ ID NO: 659064 - DNA, 25 bp, Rattus norvegicus
tgcgtctctccttggcgcttcggct

SEQ ID NO: 659065 - DNA, 25 bp, Rattus norvegicus
gtcctgctcgcttcgtgcttcagtt

SEQ ID NO: 659066 - DNA, 25 bp, Rattus norvegicus
acgtggcttagtctgcctcttgggc

SEQ ID NO: 659067 - DNA, 25 bp, Rattus norvegicus
tcagttacgtggcttagtctgcctc

SEQ ID NO: 659068 - DNA, 25 bp, Rattus norvegicus
tcccgcttgtttattggtgagagca

SEQ ID NO: 659069 - DNA, 25 bp, Rattus norvegicus
cttgggcgccgcctcgccaaggaat

SEQ ID NO: 659070 - DNA, 25 bp, Rattus norvegicus
ctcgccaaggaatcccgcttgttta

SEQ ID NO: 659071 - DNA, 25 bp, Rattus norvegicus
tccactctctggaaggagaggtccc

SEQ ID NO: 659072 - DNA, 25 bp, Rattus norvegicus
cttcgtgcttcagttacgtggctta

SEQ ID NO: 659073 - DNA, 25 bp, Rattus norvegicus
gcccagcccgaataccaaggtgcgg

SEQ ID NO: 659074 - DNA, 25 bp, Rattus norvegicus
ctggcgtcccggtggcacgcgctaa

SEQ ID NO: 659075 - DNA, 25 bp, Rattus norvegicus
tgaactctgacctgctgtcactttc

SEQ ID NO: 659076 - DNA, 25 bp, Rattus norvegicus
tgtcggtgggccctgaactctgacc

SEQ ID NO: 659077 - DNA, 25 bp, Rattus norvegicus
acctggctacttgtcggtgggccct

SEQ ID NO: 659078 - DNA, 25 bp, Rattus norvegicus
tgaggagcatggtacctggctactt

SEQ ID NO: 659079 - DNA, 25 bp, Rattus norvegicus
gcggtcccgtaccactcagtcacga

SEQ ID NO: 659080 - DNA, 25 bp, Rattus norvegicus
cccgaatcacgtgcgcggtcccgta

SEQ ID NO: 659081 - DNA, 25 bp, Rattus norvegicus
cgaataccaaggtgcggcagcgcca

SEQ ID NO: 659082 - DNA, 25 bp, Rattus norvegicus
ctaaacactggctcgcggagaccca

SEQ ID NO: 659083 - DNA, 25 bp, Rattus norvegicus
acggtgctaaacactggctcgcgga

SEQ ID NO: 659084 - DNA, 25 bp, Rattus norvegicus
ggctccaaaacggtgctaaacactg

SEQ ID NO: 659085 - DNA, 25 bp, Rattus norvegicus
ggcctcggctccaaaacggtgctaa

SEQ ID NO: 659086 - DNA, 25 bp, Rattus norvegicus
gtgcagactctctgcgtgcgcgcca

SEQ ID NO: 659087 - DNA, 25 bp, Rattus norvegicus
tccgactcattcaggtctcccaagt

SEQ ID NO: 659088 - DNA, 25 bp, Rattus norvegicus
agcaccgtgggctttcagccgactc

SEQ ID NO: 659089 - DNA, 25 bp, Rattus norvegicus
cggcgccgaaagcaccgtgggcttt

SEQ ID NO: 659090 - DNA, 25 bp, Rattus norvegicus
gaaaggttccaagacggcgtccatc

SEQ ID NO: 659091 - DNA, 25 bp, Rattus norvegicus
gatcccgggaacagcctgtcggccg

SEQ ID NO: 659092 - DNA, 25 bp, Rattus norvegicus
aggtctcccaagtccaggaagctgg

SEQ ID NO: 659093 - DNA, 25 bp, Rattus norvegicus
ccgcattgttgaggaaatccgactc

SEQ ID NO: 659094 - DNA, 25 bp, Rattus norvegicus
agaccctttcgttcttaccgcattg

SEQ ID NO: 659095 - DNA, 25 bp, Rattus norvegicus
tgtcactttccggagtctgaaaccg

SEQ ID NO: 659096 - DNA, 25 bp, Rattus norvegicus
tccaggaagctggatcccgggaaca

SEQ ID NO: 659097 - DNA, 25 bp, Rattus norvegicus
agcttctgtcactttccggagtctg

SEQ ID NO: 659098 - DNA, 25 bp, Rattus norvegicus
ctgccgagtcgcagagatctctcta

SEQ ID NO: 659099 - DNA, 25 bp, Rattus norvegicus
cgcagctggcttccatggggagccc

SEQ ID NO: 659100 - DNA, 25 bp, Rattus norvegicus
agatctctctaggtctcttcctccg

SEQ ID NO: 659101 - DNA, 25 bp, Rattus norvegicus
cagacagcaagcagcgggccgtgcc

SEQ ID NO: 659102 - DNA, 25 bp, Rattus norvegicus
agctcctccttggtggtttaggcgc

SEQ ID NO: 659103 - DNA, 25 bp, Rattus norvegicus
cggttttgagctcctccttggtggt

SEQ ID NO: 659104 - DNA, 25 bp, Rattus norvegicus
agatagcgcggttttgagctcctcc

SEQ ID NO: 659105 - DNA, 25 bp, Rattus norvegicus
gccgtgccgccaaggtttctaggaa

SEQ ID NO: 659106 - DNA, 25 bp, Rattus norvegicus
ttgcatcagacagcaagcagcgggc

SEQ ID NO: 659107 - DNA, 25 bp, Rattus norvegicus
ccgcgttgcaaactgttgcatcaga

SEQ ID NO: 659108 - DNA, 25 bp, Rattus norvegicus
tcccagaaccgcgttgcaaactgtt

SEQ ID NO: 659109 - DNA, 25 bp, Rattus norvegicus
gcaccgcaggcctccactcccagaa

SEQ ID NO: 659110 - DNA, 25 bp, Rattus norvegicus
tggtgaaaagattcccgccgcggga

SEQ ID NO: 659111 - DNA, 25 bp, Rattus norvegicus
cccgcacatctggtgaaaagattcc

SEQ ID NO: 659112 - DNA, 25 bp, Rattus norvegicus
gcgatctgccaaaaggtcttcgcgc

SEQ ID NO: 659113 - DNA, 25 bp, Rattus norvegicus
caggcgcgatctgccaaaaggtctt

SEQ ID NO: 659114 - DNA, 25 bp, Rattus norvegicus
ccaaggtttctaggaagatagcgcg

SEQ ID NO: 659115 - DNA, 25 bp, Rattus norvegicus
tggaactccggatccctttccgctg

SEQ ID NO: 659116 - DNA, 25 bp, Rattus norvegicus
cgcagtctggtctgggactggattc

SEQ ID NO: 659117 - DNA, 25 bp, Rattus norvegicus
gtaggcagagcggacagaaaactcc

SEQ ID NO: 659118 - DNA, 25 bp, Rattus norvegicus
cagaaaactccatgcgcgagcggca

SEQ ID NO: 659119 - DNA, 25 bp, Rattus norvegicus
ccctctgctggctacgacgtgcaaa

SEQ ID NO: 659120 - DNA, 25 bp, Rattus norvegicus
acccgccgctggtcaaatggaactc

SEQ ID NO: 659121 - DNA, 25 bp, Rattus norvegicus
tcccttctcaggatcgcgcagtctg

SEQ ID NO: 659122 - DNA, 25 bp, Rattus norvegicus
aaggacgctgctccaaaacacccgg

SEQ ID NO: 659123 - DNA, 25 bp, Rattus norvegicus
acacccggcttatcagctgagcgga

SEQ ID NO: 659124 - DNA, 25 bp, Rattus norvegicus
cggaggctgcaggaatctacccaaa

SEQ ID NO: 659125 - DNA, 25 bp, Rattus norvegicus
aggaatctacccaaatccaccggcg

SEQ ID NO: 659126 - DNA, 25 bp, Rattus norvegicus
ttgcctcccggatgccgggacagaa

SEQ ID NO: 659127 - DNA, 25 bp, Rattus norvegicus
tacgacgtgcaaatccggagccagg

SEQ ID NO: 659128 - DNA, 25 bp, Rattus norvegicus
gactggattccaggagaggcgtccc

SEQ ID NO: 659129 - DNA, 25 bp, Rattus norvegicus
cgcgcggaagcagctctgcatcttc

SEQ ID NO: 659130 - DNA, 25 bp, Rattus norvegicus
gtgcttggccgggaagagcctctct

SEQ ID NO: 659131 - DNA, 25 bp, Rattus norvegicus
cgtcgctaagccctcgggccaggga

SEQ ID NO: 659132 - DNA, 25 bp, Rattus norvegicus
agcctcggtgacgtcgctaagccct

SEQ ID NO: 659133 - DNA, 25 bp, Rattus norvegicus
tgcagtgaaggtgacaccacccacc

SEQ ID NO: 659134 - DNA, 25 bp, Rattus norvegicus
ccgttactctccgttgcagtgaagg

SEQ ID NO: 659135 - DNA, 25 bp, Rattus norvegicus
cgcatctccaactcgccgcatcttg

SEQ ID NO: 659136 - DNA, 25 bp, Rattus norvegicus
tggcttgctacgcacgcatctccaa

SEQ ID NO: 659137 - DNA, 25 bp, Rattus norvegicus
aagtccacttggcttgctacgcacg

SEQ ID NO: 659138 - DNA, 25 bp, Rattus norvegicus
ctccgttgcagtgaaggtgacacca

SEQ ID NO: 659139 - DNA, 25 bp, Rattus norvegicus
cagctcaggttttcctccctccgtg

SEQ ID NO: 659140 - DNA, 25 bp, Rattus norvegicus
gtaccgggagccgtactccagctgc

SEQ ID NO: 659141 - DNA, 25 bp, Rattus norvegicus
tactccagctgcgagggtgcttggc

SEQ ID NO: 659142 - DNA, 25 bp, Rattus norvegicus
tggcgcactgctacccgcgcggaag

SEQ ID NO: 659143 - DNA, 25 bp, Rattus norvegicus
ctgctccagtggctccgggaaggcc

SEQ ID NO: 659144 - DNA, 25 bp, Rattus norvegicus
ccaggcaaccaggacccggacagaa

SEQ ID NO: 659145 - DNA, 25 bp, Rattus norvegicus
cagaggaagatcagcgctggaccgc

SEQ ID NO: 659146 - DNA, 25 bp, Rattus norvegicus
gaccctgcgaaggaccagaggaaga

SEQ ID NO: 659147 - DNA, 25 bp, Rattus norvegicus
atctcggaccctgcgaaggaccaga

SEQ ID NO: 659148 - DNA, 25 bp, Rattus norvegicus
tcgggctgcgggctccatctcggac

SEQ ID NO: 659149 - DNA, 25 bp, Rattus norvegicus
ccctcgaggcagcatggctgtctgt

SEQ ID NO: 659150 - DNA, 25 bp, Rattus norvegicus
accaggacccggacagaatcccgag

SEQ ID NO: 659151 - DNA, 25 bp, Rattus norvegicus
gcggttgtgcctagtccatctgaaa

SEQ ID NO: 659152 - DNA, 25 bp, Rattus norvegicus
tccatctgaaaagacacgtggcgtg

SEQ ID NO: 659153 - DNA, 25 bp, Rattus norvegicus
agcaggcagcggtcacacagggtcc

SEQ ID NO: 659154 - DNA, 25 bp, Rattus norvegicus
gtcccggccgaataggaagaagcca

SEQ ID NO: 659155 - DNA, 25 bp, Rattus norvegicus
gaagaagccaaccactagcagcagc

SEQ ID NO: 659156 - DNA, 25 bp, Rattus norvegicus
ttgcggctcccgtacgggtctccat

SEQ ID NO: 659157 - DNA, 25 bp, Rattus norvegicus
ccactgcgccggaaataggtgaagt

SEQ ID NO: 659158 - DNA, 25 bp, Rattus norvegicus
taggtgaagtataccgatgcacgcc

SEQ ID NO: 659159 - DNA, 25 bp, Rattus norvegicus
cactcggagccgtcggctgcgcaga

SEQ ID NO: 659160 - DNA, 25 bp, Rattus norvegicus
gtataccgatgcacgccgggagttg

SEQ ID NO: 659161 - DNA, 25 bp, Rattus norvegicus
aatgcgtaatgagcgcccgtgggta

SEQ ID NO: 659162 - DNA, 25 bp, Rattus norvegicus
ttctttggtaggtgttccgctgttg

SEQ ID NO: 659163 - DNA, 25 bp, Rattus norvegicus
cagccgcgccggaaatgcgtaatga

SEQ ID NO: 659164 - DNA, 25 bp, Rattus norvegicus
aggagctgtaccctcgctgccactg

SEQ ID NO: 659165 - DNA, 25 bp, Rattus norvegicus
ttggccgcccgtcactgaaggggca

SEQ ID NO: 659166 - DNA, 25 bp, Rattus norvegicus
cgcccgaacccgtgaaggtcactgg

SEQ ID NO: 659167 - DNA, 25 bp, Rattus norvegicus
aagatcttctcctcctgcacgaaca

SEQ ID NO: 659168 - DNA, 25 bp, Rattus norvegicus
agccgaagcaccttgcccgcaaaga

SEQ ID NO: 659169 - DNA, 25 bp, Rattus norvegicus
tgcgcagatgtgcagccgaagcacc

SEQ ID NO: 659170 - DNA, 25 bp, Rattus norvegicus
ttgtggttcacaggcagactcaccg

SEQ ID NO: 659171 - DNA, 25 bp, Rattus norvegicus
gcctagggccggaagcaggaaggag

SEQ ID NO: 659172 - DNA, 25 bp, Rattus norvegicus
gcgttcaagggttccgcgcgtctaa

SEQ ID NO: 659173 - DNA, 25 bp, Rattus norvegicus
tccgcgcgtctaagtagtcctgggc

SEQ ID NO: 659174 - DNA, 25 bp, Rattus norvegicus
ctgggctgcggaagttgagcaactt

SEQ ID NO: 659175 - DNA, 25 bp, Rattus norvegicus
ttgagcaacttggaggcgggcctag

SEQ ID NO: 659176 - DNA, 25 bp, Rattus norvegicus
ccaggagtacgtgactcgtcatcca

SEQ ID NO: 659177 - DNA, 25 bp, Rattus norvegicus
actcgtcatccagccgccacggccc

SEQ ID NO: 659178 - DNA, 25 bp, Rattus norvegicus
ccgctgccagcagtgctgtcggccg

SEQ ID NO: 659179 - DNA, 25 bp, Rattus norvegicus
ggcttctgggcctacgctaccagga

SEQ ID NO: 659180 - DNA, 25 bp, Rattus norvegicus
tgggcctacgctaccaggagtacgt

SEQ ID NO: 659181 - DNA, 25 bp, Rattus norvegicus
gttccgcgcgtctaagtagtcctgg

SEQ ID NO: 659182 - DNA, 25 bp, Rattus norvegicus
cgctaccaggagtacgtgactcgtc

SEQ ID NO: 659183 - DNA, 25 bp, Rattus norvegicus
agtacgtgactcgtcatccagccgc

SEQ ID NO: 659184 - DNA, 25 bp, Rattus norvegicus
ctacgctaccaggagtacgtgactc

SEQ ID NO: 659185 - DNA, 25 bp, Rattus norvegicus
tcctggccagactcggctttggaag

SEQ ID NO: 659186 - DNA, 25 bp, Rattus norvegicus
agggttgcttgcgtcttacctgaga

SEQ ID NO: 659187 - DNA, 25 bp, Rattus norvegicus
gtcttacctgagaccgcggcacctg

SEQ ID NO: 659188 - DNA, 25 bp, Rattus norvegicus
tggccctgaccctggctgcgagacg

SEQ ID NO: 659189 - DNA, 25 bp, Rattus norvegicus
ccactcctggccgttgggcagcgag

SEQ ID NO: 659190 - DNA, 25 bp, Rattus norvegicus
cacttgccgcgtcgatcaggtccat

SEQ ID NO: 659191 - DNA, 25 bp, Rattus norvegicus
cgatcaggtccatctgcagcatctc

SEQ ID NO: 659192 - DNA, 25 bp, Rattus norvegicus
ggacgagtccatttcgcggccgcaa

SEQ ID NO: 659193 - DNA, 25 bp, Rattus norvegicus
gcagagacagaagcactgggccgct

SEQ ID NO: 659194 - DNA, 25 bp, Rattus norvegicus
ggaggccggatccttacgccgccag

SEQ ID NO: 659195 - DNA, 25 bp, Rattus norvegicus
cttggtaacggccagtgacctcacc

SEQ ID NO: 659196 - DNA, 25 bp, Rattus norvegicus
ccagtgacctcacccgggttgtaag

SEQ ID NO: 659197 - DNA, 25 bp, Rattus norvegicus
cctctctcagcacagggttgcttgc

SEQ ID NO: 659198 - DNA, 25 bp, Rattus norvegicus
aaaggttgagcgtggtaggcctctt

SEQ ID NO: 659199 - DNA, 25 bp, Rattus norvegicus
tctcgtcagcatagaggggtcgtga

SEQ ID NO: 659200 - DNA, 25 bp, Rattus norvegicus
gcgggccacacagggcaaaaatgct

SEQ ID NO: 659201 - DNA, 25 bp, Rattus norvegicus
aaatgctgtgtcagtagccgcaggc

SEQ ID NO: 659202 - DNA, 25 bp, Rattus norvegicus
gggagtccgctcaatgttaccacca

SEQ ID NO: 659203 - DNA, 25 bp, Rattus norvegicus
ttaccaccacgcaagatagggtccc

SEQ ID NO: 659204 - DNA, 25 bp, Rattus norvegicus
tccatcggttgatgcccactgacga

SEQ ID NO: 659205 - DNA, 25 bp, Rattus norvegicus
tcgaggatgtagacgcagcgcacac

SEQ ID NO: 659206 - DNA, 25 bp, Rattus norvegicus
ccgtagtcctttgcggaaccagtgc

SEQ ID NO: 659207 - DNA, 25 bp, Rattus norvegicus
agtgcccgcccagcggcctataatg

SEQ ID NO: 659208 - DNA, 25 bp, Rattus norvegicus
ggagcctgaatcgtctctgtgattg

SEQ ID NO: 659209 - DNA, 25 bp, Rattus norvegicus
tccctctgttccattggtcggcagc

SEQ ID NO: 659210 - DNA, 25 bp, Rattus norvegicus
ttcccaccatgtgtggtccgggctt

SEQ ID NO: 659211 - DNA, 25 bp, Rattus norvegicus
ttcgcgtctcctacgcaaataggga

SEQ ID NO: 659212 - DNA, 25 bp, Rattus norvegicus
ggatctcctacgcatttcgcgtctc

SEQ ID NO: 659213 - DNA, 25 bp, Rattus norvegicus
tgaattcaagttccggctcagcgtc

SEQ ID NO: 659214 - DNA, 25 bp, Rattus norvegicus
cgtgcggcagggatcagatcaccga

SEQ ID NO: 659215 - DNA, 25 bp, Rattus norvegicus
atcaccgaggttccgggaggcgtct

SEQ ID NO: 659216 - DNA, 25 bp, Rattus norvegicus
ggctgccacgaactgaattcaagtt

SEQ ID NO: 659217 - DNA, 25 bp, Rattus norvegicus
ttcaagttccggctcagcgtcgcca

SEQ ID NO: 659218 - DNA, 25 bp, Rattus norvegicus
ccagtcccgggccacttaccgagcg

SEQ ID NO: 659219 - DNA, 25 bp, Rattus norvegicus
gaagcatttcctgacacgcctacga

SEQ ID NO: 659220 - DNA, 25 bp, Rattus norvegicus
cctgacacgcctacgaacagtctta

SEQ ID NO: 659221 - DNA, 25 bp, Rattus norvegicus
acgaacagtcttaaagggccagctc

SEQ ID NO: 659222 - DNA, 25 bp, Rattus norvegicus
gtcttaaagggccagctctcagggc

SEQ ID NO: 659223 - DNA, 25 bp, Rattus norvegicus
aagggccagctctcagggcctttcc

SEQ ID NO: 659224 - DNA, 25 bp, Rattus norvegicus
ggcctttcccacttcgcggccgtca

SEQ ID NO: 659225 - DNA, 25 bp, Rattus norvegicus
gcgggcccagaagcatttcctgaca

SEQ ID NO: 659226 - DNA, 25 bp, Rattus norvegicus
cgcggctgccacgaactgaattcaa

SEQ ID NO: 659227 - DNA, 25 bp, Rattus norvegicus
ccgagaccatgtcctcctcctcatc

SEQ ID NO: 659228 - DNA, 25 bp, Rattus norvegicus
cctccggataataggagtcatggtc

SEQ ID NO: 659229 - DNA, 25 bp, Rattus norvegicus
taggagtcatggtcgtgttattaca

SEQ ID NO: 659230 - DNA, 25 bp, Rattus norvegicus
ggtcgtgttattacaggtcatattc

SEQ ID NO: 659231 - DNA, 25 bp, Rattus norvegicus
ggtcatattcttagtcgtcctcgga

SEQ ID NO: 659232 - DNA, 25 bp, Rattus norvegicus
agtcgtcctcggaatcctgggtctc

SEQ ID NO: 659233 - DNA, 25 bp, Rattus norvegicus
tcttcgtcctcctccgagaccatgt

SEQ ID NO: 659234 - DNA, 25 bp, Rattus norvegicus
gtcttccctctcctccggataatag

SEQ ID NO: 659235 - DNA, 25 bp, Rattus norvegicus
tcctcgctctcgtggtcatcgtaca

SEQ ID NO: 659236 - DNA, 25 bp, Rattus norvegicus
tggtcatcgtacaccactttgttga

SEQ ID NO: 659237 - DNA, 25 bp, Rattus norvegicus
acaccactttgttgacggcacggcg

SEQ ID NO: 659238 - DNA, 25 bp, Rattus norvegicus
agctcagccgggtcttgggcgccac

SEQ ID NO: 659239 - DNA, 25 bp, Rattus norvegicus
ggtcttgggcgccacctcagcctgg

SEQ ID NO: 659240 - DNA, 25 bp, Rattus norvegicus
gaatcctgggtctcctcggcgtcgc

SEQ ID NO: 659241 - DNA, 25 bp, Rattus norvegicus
atgagtaccgcccagggcccttagg

SEQ ID NO: 659242 - DNA, 25 bp, Rattus norvegicus
tcgagcggaaccatggcttccactc

SEQ ID NO: 659243 - DNA, 25 bp, Rattus norvegicus
aggcagaaggggcacccaccacgtc

SEQ ID NO: 659244 - DNA, 25 bp, Rattus norvegicus
cccgaatggcagaacagagctcgga

SEQ ID NO: 659245 - DNA, 25 bp, Rattus norvegicus
agagctcggaccatcggcatcgcct

SEQ ID NO: 659246 - DNA, 25 bp, Rattus norvegicus
acacctcggcgcaggggctcagcga

SEQ ID NO: 659247 - DNA, 25 bp, Rattus norvegicus
tgccgggagtttcgagcggaaccat

SEQ ID NO: 659248 - DNA, 25 bp, Rattus norvegicus
gtggggctccatcctatgcagaccc

SEQ ID NO: 659249 - DNA, 25 bp, Rattus norvegicus
cctgcgtgccgccagcctgaggtga

SEQ ID NO: 659250 - DNA, 25 bp, Rattus norvegicus
cccttagggaggaaccagtgtgtct

SEQ ID NO: 659251 - DNA, 25 bp, Rattus norvegicus
gaaccagtgtgtctgcccggtgctt

SEQ ID NO: 659252 - DNA, 25 bp, Rattus norvegicus
tgcccggtgcttgctgcttacttgc

SEQ ID NO: 659253 - DNA, 25 bp, Rattus norvegicus
gcttacttgcgggtctgattctttg

SEQ ID NO: 659254 - DNA, 25 bp, Rattus norvegicus
tgattctttgcgtcggatcctgggc

SEQ ID NO: 659255 - DNA, 25 bp, Rattus norvegicus
ggtacgacttcctgctcgctgtccc

SEQ ID NO: 659256 - DNA, 25 bp, Rattus norvegicus
ccgttcacccgcctgggctctagcg

SEQ ID NO: 659257 - DNA, 25 bp, Rattus norvegicus
gcctgggctctagcgtcctggctga

SEQ ID NO: 659258 - DNA, 25 bp, Rattus norvegicus
ggctctagcgtcctggctgaggcag

SEQ ID NO: 659259 - DNA, 25 bp, Rattus norvegicus
gcagagacctggtgttcacacccgg

SEQ ID NO: 659260 - DNA, 25 bp, Rattus norvegicus
agagacctggtgttcacacccggcg

SEQ ID NO: 659261 - DNA, 25 bp, Rattus norvegicus
acctggtgttcacacccggcggtgc

SEQ ID NO: 659262 - DNA, 25 bp, Rattus norvegicus
ggcggtgccctcaggtacacctgct

SEQ ID NO: 659263 - DNA, 25 bp, Rattus norvegicus
tcaggtacacctgctgcacggccct

SEQ ID NO: 659264 - DNA, 25 bp, Rattus norvegicus
cacggccctccgctgcacttgcaac

SEQ ID NO: 659265 - DNA, 25 bp, Rattus norvegicus
cccggtacgacttcctgctcgctgt

SEQ ID NO: 659266 - DNA, 25 bp, Rattus norvegicus
cccagcgcgtgccacgtccggctct

SEQ ID NO: 659267 - DNA, 25 bp, Rattus norvegicus
tctgggcgaggtggggcgattaccc

SEQ ID NO: 659268 - DNA, 25 bp, Rattus norvegicus
cgctgcacttgcaacgctgcccaag

SEQ ID NO: 659269 - DNA, 25 bp, Rattus norvegicus
tgtcatccgagtgctctataaggga

SEQ ID NO: 659270 - DNA, 25 bp, Rattus norvegicus
acggcctgcctagcgcgggaaaccg

SEQ ID NO: 659271 - DNA, 25 bp, Rattus norvegicus
gcgctctcatttacgcagcagtttg

SEQ ID NO: 659272 - DNA, 25 bp, Rattus norvegicus
tacgcagcagtttgtaaattctgtg

SEQ ID NO: 659273 - DNA, 25 bp, Rattus norvegicus
aattctgtgggcgaatgctgccacc

SEQ ID NO: 659274 - DNA, 25 bp, Rattus norvegicus
gaatgctgccaccagtttaccgctg

SEQ ID NO: 659275 - DNA, 25 bp, Rattus norvegicus
ctcagcgctacggacacacagaatc

SEQ ID NO: 659276 - DNA, 25 bp, Rattus norvegicus
cgctacggacacacagaatctctta

SEQ ID NO: 659277 - DNA, 25 bp, Rattus norvegicus
cagaatctcttatctgtgtcttaca

SEQ ID NO: 659278 - DNA, 25 bp, Rattus norvegicus
gtgtcttacaacgatgtcatccgag

SEQ ID NO: 659279 - DNA, 25 bp, Rattus norvegicus
gtggcccgaaaaaccagcaactctg

SEQ ID NO: 659280 - DNA, 25 bp, Rattus norvegicus
gaagaaagcaagatgcgacctgacc

SEQ ID NO: 659281 - DNA, 25 bp, Rattus norvegicus
aaccagcaactctgggaagaaagca

SEQ ID NO: 659282 - DNA, 25 bp, Rattus norvegicus
gacctgaccctatacagacggcctg

SEQ ID NO: 659283 - DNA, 25 bp, Rattus norvegicus
tctgctcccggttcatcgtgtaaca

SEQ ID NO: 659284 - DNA, 25 bp, Rattus norvegicus
gctctgctagtagcggtgtcccagc

SEQ ID NO: 659285 - DNA, 25 bp, Rattus norvegicus
ctgccaccggctagctcggcattga

SEQ ID NO: 659286 - DNA, 25 bp, Rattus norvegicus
agctcggcattgaagcggccaccgc

SEQ ID NO: 659287 - DNA, 25 bp, Rattus norvegicus
agggtactccgtgaggctccggcct

SEQ ID NO: 659288 - DNA, 25 bp, Rattus norvegicus
gctcaggaaaagacaacactgtggt

SEQ ID NO: 659289 - DNA, 25 bp, Rattus norvegicus
caacactgtggtgagcgagccaccc

SEQ ID NO: 659290 - DNA, 25 bp, Rattus norvegicus
tccagaccgaggatggagccgacgc

SEQ ID NO: 659291 - DNA, 25 bp, Rattus norvegicus
gcaggccaccaggtatcagccgggc

SEQ ID NO: 659292 - DNA, 25 bp, Rattus norvegicus
ctcctctggcgagggcagcaaactt

SEQ ID NO: 659293 - DNA, 25 bp, Rattus norvegicus
cagcaaacttgggatgagcgtcagc

SEQ ID NO: 659294 - DNA, 25 bp, Rattus norvegicus
ccggggctccctttctgctgcggaa

SEQ ID NO: 659295 - DNA, 25 bp, Rattus norvegicus
gaacgcgcttgggtgtctgctcccg

SEQ ID NO: 659296 - DNA, 25 bp, Rattus norvegicus
tcgtgtaacagtctgctagacgccg

SEQ ID NO: 659297 - DNA, 25 bp, Rattus norvegicus
tgcatcccacaagtacatctagtta

SEQ ID NO: 659298 - DNA, 25 bp, Rattus norvegicus
gccgctgccttcgttatgccagcta

SEQ ID NO: 659299 - DNA, 25 bp, Rattus norvegicus
ccaaattcgattgcagccgctgcct

SEQ ID NO: 659300 - DNA, 25 bp, Rattus norvegicus
gtgcgcgcaccacccaaattcgatt

SEQ ID NO: 659301 - DNA, 25 bp, Rattus norvegicus
atctagttacatccacggctgctta

SEQ ID NO: 659302 - DNA, 25 bp, Rattus norvegicus
aggcacacagcttctgggcactcca

SEQ ID NO: 659303 - DNA, 25 bp, Rattus norvegicus
tatgaggacaggagaggcacacagc

SEQ ID NO: 659304 - DNA, 25 bp, Rattus norvegicus
ttcgtgctggctctggtatgaggac

SEQ ID NO: 659305 - DNA, 25 bp, Rattus norvegicus
ttccgccatgtgttcgtgctggctc

SEQ ID NO: 659306 - DNA, 25 bp, Rattus norvegicus
gccacgatggaaaaggatggagcct

SEQ ID NO: 659307 - DNA, 25 bp, Rattus norvegicus
catagccgcagagccacgatggaaa

SEQ ID NO: 659308 - DNA, 25 bp, Rattus norvegicus
ccactgctcgaacatagccgcagag

SEQ ID NO: 659309 - DNA, 25 bp, Rattus norvegicus
gagtaggcctttcccaccgtgtgcc

SEQ ID NO: 659310 - DNA, 25 bp, Rattus norvegicus
atccacggctgcttacgtgcgcgca

SEQ ID NO: 659311 - DNA, 25 bp, Rattus norvegicus
tgggtaacatttgacgcgcctccgg

SEQ ID NO: 659312 - DNA, 25 bp, Rattus norvegicus
tcacttgcctgtgccgacacatgca

SEQ ID NO: 659313 - DNA, 25 bp, Rattus norvegicus
gggtcacttgcctgtgccgacacat

SEQ ID NO: 659314 - DNA, 25 bp, Rattus norvegicus
atccttgcactgtgtggggtcactt

SEQ ID NO: 659315 - DNA, 25 bp, Rattus norvegicus
caccagcatccttgcactgtgtggg

SEQ ID NO: 659316 - DNA, 25 bp, Rattus norvegicus
ctgtgatcgcgctgggcgccacgct

SEQ ID NO: 659317 - DNA, 25 bp, Rattus norvegicus
ttctttcggtgcctgtgatcgcgct

SEQ ID NO: 659318 - DNA, 25 bp, Rattus norvegicus
accatggttctttcggtgcctgtga

SEQ ID NO: 659319 - DNA, 25 bp, Rattus norvegicus
cgggaagcaggcaccatggttcttt

SEQ ID NO: 659320 - DNA, 25 bp, Rattus norvegicus
cgccctcggagtctagagagcggct

SEQ ID NO: 659321 - DNA, 25 bp, Rattus norvegicus
ccgtgagcccgacccggagaaagcg

SEQ ID NO: 659322 - DNA, 25 bp, Rattus norvegicus
atttgacgcgcctccgggtcagcct

SEQ ID NO: 659323 - DNA, 25 bp, Rattus norvegicus
aggagtgggtaacatttgacgcgcc

SEQ ID NO: 659324 - DNA, 25 bp, Rattus norvegicus
agcctccgcctctgacgtccttaca

SEQ ID NO: 659325 - DNA, 25 bp, Rattus norvegicus
accacatctcgttgagggtcgggga

SEQ ID NO: 659326 - DNA, 25 bp, Rattus norvegicus
taccttaggaaccagaacttcttca

SEQ ID NO: 659327 - DNA, 25 bp, Rattus norvegicus
aacttcttcagccactcctgcttga

SEQ ID NO: 659328 - DNA, 25 bp, Rattus norvegicus
cttgaagcgccggatgcggcgtccc

SEQ ID NO: 659329 - DNA, 25 bp, Rattus norvegicus
gcgtcccgtggcagaggacaacttg

SEQ ID NO: 659330 - DNA, 25 bp, Rattus norvegicus
agggttcgtcggttgccgtcatcac

SEQ ID NO: 659331 - DNA, 25 bp, Rattus norvegicus
cggttgccgtcatcacgtcattgga

SEQ ID NO: 659332 - DNA, 25 bp, Rattus norvegicus
tcacgtcattggagacagattcgtc

SEQ ID NO: 659333 - DNA, 25 bp, Rattus norvegicus
ggagacagattcgtctgcagaatcc

SEQ ID NO: 659334 - DNA, 25 bp, Rattus norvegicus
tgcagaatccacttcctggtcgtcg

SEQ ID NO: 659335 - DNA, 25 bp, Rattus norvegicus
atggcaccacatctcgttgagggtc

SEQ ID NO: 659336 - DNA, 25 bp, Rattus norvegicus
gcaccgtgtactggcggcacacatg

SEQ ID NO: 659337 - DNA, 25 bp, Rattus norvegicus
tggcggcacacatggcaccacatct

SEQ ID NO: 659338 - DNA, 25 bp, Rattus norvegicus
acgtgcgtgaggactgcaccgtgta

SEQ ID NO: 659339 - DNA, 25 bp, Rattus norvegicus
aggaaagatccagaacccggtcgcg

SEQ ID NO: 659340 - DNA, 25 bp, Rattus norvegicus
agccgcttgtcttcgcgtagccata

SEQ ID NO: 659341 - DNA, 25 bp, Rattus norvegicus
tgccgaactgtgtatccggaggatc

SEQ ID NO: 659342 - DNA, 25 bp, Rattus norvegicus
cgctactgtggcttctgccgaactg

SEQ ID NO: 659343 - DNA, 25 bp, Rattus norvegicus
gggaggtcatactgcaggatcactg

SEQ ID NO: 659344 - DNA, 25 bp, Rattus norvegicus
ggaggtctcatcatgggaggtcata

SEQ ID NO: 659345 - DNA, 25 bp, Rattus norvegicus
tactaccagtcgctgtcgcggtacc

SEQ ID NO: 659346 - DNA, 25 bp, Rattus norvegicus
ggcgaccgcggagacatactaccag

SEQ ID NO: 659347 - DNA, 25 bp, Rattus norvegicus
ccgagacatcggttaagggcgaccg

SEQ ID NO: 659348 - DNA, 25 bp, Rattus norvegicus
catgcagcccgtggcagtcctgaaa

SEQ ID NO: 659349 - DNA, 25 bp, Rattus norvegicus
ggcaatactcgccatcgctgtactc

SEQ ID NO: 659350 - DNA, 25 bp, Rattus norvegicus
atcagatggtctcgatcccggtccc

SEQ ID NO: 659351 - DNA, 25 bp, Rattus norvegicus
gccaccagctcaagtacaggcaata

SEQ ID NO: 659352 - DNA, 25 bp, Rattus norvegicus
catagccggcggcagaggatcagat

SEQ ID NO: 659353 - DNA, 25 bp, Rattus norvegicus
ttgatcttgggcagccagcgcttac

SEQ ID NO: 659354 - DNA, 25 bp, Rattus norvegicus
gcagcagacgggaactcagggtcca

SEQ ID NO: 659355 - DNA, 25 bp, Rattus norvegicus
gtcggcggcgatcacgttcatctcg

SEQ ID NO: 659356 - DNA, 25 bp, Rattus norvegicus
tggtgcacatgtcggcggcgatcac

SEQ ID NO: 659357 - DNA, 25 bp, Rattus norvegicus
acacggcgagcgttggtgcacatgt

SEQ ID NO: 659358 - DNA, 25 bp, Rattus norvegicus
cagccagcgcttacggacacggcga

SEQ ID NO: 659359 - DNA, 25 bp, Rattus norvegicus
gtcgttccgcatagatgcgctgctc

SEQ ID NO: 659360 - DNA, 25 bp, Rattus norvegicus
tccacgccctctggaagcatggact

SEQ ID NO: 659361 - DNA, 25 bp, Rattus norvegicus
ggtacatctccacgccctctggaag

SEQ ID NO: 659362 - DNA, 25 bp, Rattus norvegicus
atgacgctacggtacatctccacgc

SEQ ID NO: 659363 - DNA, 25 bp, Rattus norvegicus
aggctggcagcggacgcacccatga

SEQ ID NO: 659364 - DNA, 25 bp, Rattus norvegicus
agatgcgctgctcaaacacctggga

SEQ ID NO: 659365 - DNA, 25 bp, Rattus norvegicus
agcatggacttgatcttgggcagcc

SEQ ID NO: 659366 - DNA, 25 bp, Rattus norvegicus
cggacgcacccatgacgctacggta

SEQ ID NO: 659367 - DNA, 25 bp, Rattus norvegicus
tggccacacccctgctcctcggctc

SEQ ID NO: 659368 - DNA, 25 bp, Rattus norvegicus
gtcacccaccttcgcggcggggagc

SEQ ID NO: 659369 - DNA, 25 bp, Rattus norvegicus
ccggccgtcacccaccttcgcggcg

SEQ ID NO: 659370 - DNA, 25 bp, Rattus norvegicus
ccgttcgaccgcgtgtgtggcccgc

SEQ ID NO: 659371 - DNA, 25 bp, Rattus norvegicus
tgcccctcctgagagccgggatgcg

SEQ ID NO: 659372 - DNA, 25 bp, Rattus norvegicus
cagagtgtgtgtgtgactcactccc

SEQ ID NO: 659373 - DNA, 25 bp, Rattus norvegicus
ccgggactgggcaagcagagtgtgt

SEQ ID NO: 659374 - DNA, 25 bp, Rattus norvegicus
tcggccttgggaccgtgctgggccc

SEQ ID NO: 659375 - DNA, 25 bp, Rattus norvegicus
agtagctcggccttgggaccgtgct

SEQ ID NO: 659376 - DNA, 25 bp, Rattus norvegicus
tgtgcagtagctcggccttgggacc

SEQ ID NO: 659377 - DNA, 25 bp, Rattus norvegicus
actgtgcagtagctcggccttggga

SEQ ID NO: 659378 - DNA, 25 bp, Rattus norvegicus
gaggactgtgcagtagctcggcctt

SEQ ID NO: 659379 - DNA, 25 bp, Rattus norvegicus
cttcagaggactgtgcagtagctcg

SEQ ID NO: 659380 - DNA, 25 bp, Rattus norvegicus
cgcgcacaggggaccgcaggggaca

SEQ ID NO: 659381 - DNA, 25 bp, Rattus norvegicus
atagatgaaaggcacgccctccctc

SEQ ID NO: 659382 - DNA, 25 bp, Rattus norvegicus
caggtcgcagagagacatgcagtcc

SEQ ID NO: 659383 - DNA, 25 bp, Rattus norvegicus
cacgccgcaaccaagtcttaaaata

SEQ ID NO: 659384 - DNA, 25 bp, Rattus norvegicus
cctgtctacgcgttctcttagcgaa

SEQ ID NO: 659385 - DNA, 25 bp, Rattus norvegicus
cgaggaaaaggctacagtggaacaa

SEQ ID NO: 659386 - DNA, 25 bp, Rattus norvegicus
agcgtcttccgaagccatgttcacg

SEQ ID NO: 659387 - DNA, 25 bp, Rattus norvegicus
tgttcacgttcatggccacggtggc

SEQ ID NO: 659388 - DNA, 25 bp, Rattus norvegicus
aagtttcagcgccagcggaagcgcg

SEQ ID NO: 659389 - DNA, 25 bp, Rattus norvegicus
ccctgcttggaccaccatcttagta

SEQ ID NO: 659390 - DNA, 25 bp, Rattus norvegicus
cactggaaaacggaagaaagcggcg

SEQ ID NO: 659391 - DNA, 25 bp, Rattus norvegicus
cgtgctggaaagttgtggcatttgc

SEQ ID NO: 659392 - DNA, 25 bp, Rattus norvegicus
ggcatttgcgcaagcccatccgagg

SEQ ID NO: 659393 - DNA, 25 bp, Rattus norvegicus
cggcgaccaggtccctgcaactagg

SEQ ID NO: 659394 - DNA, 25 bp, Rattus norvegicus
caccatcttagtagtacaggaaatg

SEQ ID NO: 659395 - DNA, 25 bp, Rattus norvegicus
cctaacgcgcgtgcgccagagttca

SEQ ID NO: 659396 - DNA, 25 bp, Rattus norvegicus
ctccgcaagtacaagcggggacctc

SEQ ID NO: 659397 - DNA, 25 bp, Rattus norvegicus
acctcgcggaggcagcgttcagaat

SEQ ID NO: 659398 - DNA, 25 bp, Rattus norvegicus
gttcagaatcccagtaggcaacttc

SEQ ID NO: 659399 - DNA, 25 bp, Rattus norvegicus
gtggcctcacgtcaccactgggctg

SEQ ID NO: 659400 - DNA, 25 bp, Rattus norvegicus
aaccctgggtcgctagcagcctaac

SEQ ID NO: 659401 - DNA, 25 bp, Rattus norvegicus
gcaagggcacgtgaccgcttctagc

SEQ ID NO: 659402 - DNA, 25 bp, Rattus norvegicus
agcggtgctacagcccgactctact

SEQ ID NO: 659403 - DNA, 25 bp, Rattus norvegicus
gacactcccgtcagcggtgctacag

SEQ ID NO: 659404 - DNA, 25 bp, Rattus norvegicus
cactgcgctcgtgaacctggaggcc

SEQ ID NO: 659405 - DNA, 25 bp, Rattus norvegicus
gtcaccaggtcactgtcggcactgc

SEQ ID NO: 659406 - DNA, 25 bp, Rattus norvegicus
tgcagctccgccatggtcaccaggt

SEQ ID NO: 659407 - DNA, 25 bp, Rattus norvegicus
gcctcacgcggtcttggattcaaca

SEQ ID NO: 659408 - DNA, 25 bp, Rattus norvegicus
tctgcacgtggccagcccgagtcag

SEQ ID NO: 659409 - DNA, 25 bp, Rattus norvegicus
tccagagtccctgctggagaggagc

SEQ ID NO: 659410 - DNA, 25 bp, Rattus norvegicus
tgcactgacttggtttccctctctc

SEQ ID NO: 659411 - DNA, 25 bp, Rattus norvegicus
cctcacaaagtaggggagtgtcctc

SEQ ID NO: 659412 - DNA, 25 bp, Rattus norvegicus
cgtaagtcgactgccggcagccact

SEQ ID NO: 659413 - DNA, 25 bp, Rattus norvegicus
cctcctccgggctttatctctttga

SEQ ID NO: 659414 - DNA, 25 bp, Rattus norvegicus
cccggcagcgacttgagtccagctt

SEQ ID NO: 659415 - DNA, 25 bp, Rattus norvegicus
gcagtttcttttatcgcagggtctc

SEQ ID NO: 659416 - DNA, 25 bp, Rattus norvegicus
ctgtcttccgcgcttggttctcggt

SEQ ID NO: 659417 - DNA, 25 bp, Rattus norvegicus
ttcttagcccgaggattgcgcggtg

SEQ ID NO: 659418 - DNA, 25 bp, Rattus norvegicus
tgcgcggtgtaaacttgggagtttc

SEQ ID NO: 659419 - DNA, 25 bp, Rattus norvegicus
ctggccagaccttttgtgtgggtgc

SEQ ID NO: 659420 - DNA, 25 bp, Rattus norvegicus
gcaaagccggtgacactccagagtc

SEQ ID NO: 659421 - DNA, 25 bp, Rattus norvegicus
ctcggcacggagatgaggatagatc

SEQ ID NO: 659422 - DNA, 25 bp, Rattus norvegicus
cgccattggcttgtgcgtggcacta

SEQ ID NO: 659423 - DNA, 25 bp, Rattus norvegicus
agaccagtacgcacagaggggctca

SEQ ID NO: 659424 - DNA, 25 bp, Rattus norvegicus
cgctaccagggtcccacgaagacga

SEQ ID NO: 659425 - DNA, 25 bp, Rattus norvegicus
tcccgcgcagggaatgataacacgg

SEQ ID NO: 659426 - DNA, 25 bp, Rattus norvegicus
gataacacgggtgctcgagcaaatc

SEQ ID NO: 659427 - DNA, 25 bp, Rattus norvegicus
tcgagcaaatctaggagcgttctcc

SEQ ID NO: 659428 - DNA, 25 bp, Rattus norvegicus
gccgcgcccaagctagattccgagt

SEQ ID NO: 659429 - DNA, 25 bp, Rattus norvegicus
tctcggtacagctccagacaacaca

SEQ ID NO: 659430 - DNA, 25 bp, Rattus norvegicus
cagaatggctgcacctgacccggga

SEQ ID NO: 659431 - DNA, 25 bp, Rattus norvegicus
agaagtccgtgacccgagcatgcta

SEQ ID NO: 659432 - DNA, 25 bp, Rattus norvegicus
tcgcagcagaacttggtggccgctt

SEQ ID NO: 659433 - DNA, 25 bp, Rattus norvegicus
aggggctcagtggttgaatcctacc

SEQ ID NO: 659434 - DNA, 25 bp, Rattus norvegicus
atcctacctggcagagactcggccg

SEQ ID NO: 659435 - DNA, 25 bp, Rattus norvegicus
tgggcttcagaatcgcacagcgttg

SEQ ID NO: 659436 - DNA, 25 bp, Rattus norvegicus
ccgagcatgctatgggtcactaagt

SEQ ID NO: 659437 - DNA, 25 bp, Rattus norvegicus
cgtatcctggtgcaatccgggaatg

SEQ ID NO: 659438 - DNA, 25 bp, Rattus norvegicus
gcgcttttaagttggcgtcttcagc

SEQ ID NO: 659439 - DNA, 25 bp, Rattus norvegicus
agcttggctctgtccctttgctctc

SEQ ID NO: 659440 - DNA, 25 bp, Rattus norvegicus
tcagtccagaagctcaacggccttg

SEQ ID NO: 659441 - DNA, 25 bp, Rattus norvegicus
atcacagactcctcgttcaaacggc

SEQ ID NO: 659442 - DNA, 25 bp, Rattus norvegicus
tagcacaacactgggctgccctttg

SEQ ID NO: 659443 - DNA, 25 bp, Rattus norvegicus
agcttggctccaagaaggacccata

SEQ ID NO: 659444 - DNA, 25 bp, Rattus norvegicus
gacctactccatcctagcggcgagg

SEQ ID NO: 659445 - DNA, 25 bp, Rattus norvegicus
gggaccctgattttctgcccttcca

SEQ ID NO: 659446 - DNA, 25 bp, Rattus norvegicus
tgtctaactgtctcacccgctgcgg

SEQ ID NO: 659447 - DNA, 25 bp, Rattus norvegicus
tacccaactgggaggcaactctctg

SEQ ID NO: 659448 - DNA, 25 bp, Rattus norvegicus
agcaacctggctcagggccgtagtc

SEQ ID NO: 659449 - DNA, 25 bp, Rattus norvegicus
gctggcattctagaacgggcgtatc

SEQ ID NO: 659450 - DNA, 25 bp, Rattus norvegicus
ccaacccgtgtttgactgcgcagct

SEQ ID NO: 659451 - DNA, 25 bp, Rattus norvegicus
ggcacctcagaaaacccgagtcctg

SEQ ID NO: 659452 - DNA, 25 bp, Rattus norvegicus
gccaggcatgaacgctgagacttgc

SEQ ID NO: 659453 - DNA, 25 bp, Rattus norvegicus
ctagaatcgccgacaacgcagcgtg

SEQ ID NO: 659454 - DNA, 25 bp, Rattus norvegicus
atctccgggctctgcactagaatcg

SEQ ID NO: 659455 - DNA, 25 bp, Rattus norvegicus
tccgtgcaccgcaggtaagaagctg

SEQ ID NO: 659456 - DNA, 25 bp, Rattus norvegicus
tactagaagcttctcccgcggcacg

SEQ ID NO: 659457 - DNA, 25 bp, Rattus norvegicus
gcccgggcacagaacaccgtgactt

SEQ ID NO: 659458 - DNA, 25 bp, Rattus norvegicus
tctctacttgcagaggggcgcctgc

SEQ ID NO: 659459 - DNA, 25 bp, Rattus norvegicus
ctttaacaagttccagccgcagccg

SEQ ID NO: 659460 - DNA, 25 bp, Rattus norvegicus
caccgctggaaagcaacgctggggc

SEQ ID NO: 659461 - DNA, 25 bp, Rattus norvegicus
acaacttttctgtcggccgcggcca

SEQ ID NO: 659462 - DNA, 25 bp, Rattus norvegicus
cccaggaggcgacaagttcggtaca

SEQ ID NO: 659463 - DNA, 25 bp, Rattus norvegicus
atggacgcctactacagcccggtgt

SEQ ID NO: 659464 - DNA, 25 bp, Rattus norvegicus
tgcgtctcttactgcgagtcgccgg

SEQ ID NO: 659465 - DNA, 25 bp, Rattus norvegicus
gtctcagagcgctagggcctgactc

SEQ ID NO: 659466 - DNA, 25 bp, Rattus norvegicus
ttcgattcgatgcacgcaggttttc

SEQ ID NO: 659467 - DNA, 25 bp, Rattus norvegicus
ttgggacctccaacagctcatccgg

SEQ ID NO: 659468 - DNA, 25 bp, Rattus norvegicus
ttcgttgagcgcaatttgggacctc

SEQ ID NO: 659469 - DNA, 25 bp, Rattus norvegicus
atgcgtttttatgaaagggctcaac

SEQ ID NO: 659470 - DNA, 25 bp, Rattus norvegicus
tacctctgaggttgcggctcagctg

SEQ ID NO: 659471 - DNA, 25 bp, Rattus norvegicus
cttgcagtcttacgggtacctctga

SEQ ID NO: 659472 - DNA, 25 bp, Rattus norvegicus
cagggctttaggctccgcaatcctc

SEQ ID NO: 659473 - DNA, 25 bp, Rattus norvegicus
cggtgctaggaaaaaccagggctca

SEQ ID NO: 659474 - DNA, 25 bp, Rattus norvegicus
tgctcactgggtaaagaccggcggt

SEQ ID NO: 659475 - DNA, 25 bp, Rattus norvegicus
cctcgggaactgctcactgggtaaa

SEQ ID NO: 659476 - DNA, 25 bp, Rattus norvegicus
atttctggtctgctctcaacgcggc

SEQ ID NO: 659477 - DNA, 25 bp, Rattus norvegicus
gccaggctccctacggtttttcagc

SEQ ID NO: 659478 - DNA, 25 bp, Rattus norvegicus
gctcatccggaatgcagcgctctgg

SEQ ID NO: 659479 - DNA, 25 bp, Rattus norvegicus
tttgaaccgggttgtctgttgtctg

SEQ ID NO: 659480 - DNA, 25 bp, Rattus norvegicus
ccggcctgggattaaggcacgagtt

SEQ ID NO: 659481 - DNA, 25 bp, Rattus norvegicus
cagggacagtatggaagcgctaatt

SEQ ID NO: 659482 - DNA, 25 bp, Rattus norvegicus
accttagtgcccgaggcaggaggca

SEQ ID NO: 659483 - DNA, 25 bp, Rattus norvegicus
ccgcaaccttagtgcccgaggcagg

SEQ ID NO: 659484 - DNA, 25 bp, Rattus norvegicus
gtctgcggatgctcccgcaacctta

SEQ ID NO: 659485 - DNA, 25 bp, Rattus norvegicus
ttgtctgttgtctgcggatgctccc

SEQ ID NO: 659486 - DNA, 25 bp, Rattus norvegicus
tggaaaacctccgtagcagctggga

SEQ ID NO: 659487 - DNA, 25 bp, Rattus norvegicus
ttagtggctgaaatggaaaacctcc

SEQ ID NO: 659488 - DNA, 25 bp, Rattus norvegicus
caagtggcgttgttttagtggctga

SEQ ID NO: 659489 - DNA, 25 bp, Rattus norvegicus
tggaagcgctaatttcccgaacctc

SEQ ID NO: 659490 - DNA, 25 bp, Rattus norvegicus
ttttttctgggagcgctgcgcgcaa

SEQ ID NO: 659491 - DNA, 25 bp, Rattus norvegicus
gcacgagttggttgcgctaacagtg

SEQ ID NO: 659492 - DNA, 25 bp, Rattus norvegicus
ctgcgcgcaagtggcgttgttttag

SEQ ID NO: 659493 - DNA, 25 bp, Rattus norvegicus
ctgctggacaggaggagtcagcaca

SEQ ID NO: 659494 - DNA, 25 bp, Rattus norvegicus
cagagctgcggtgctcttgcagccc

SEQ ID NO: 659495 - DNA, 25 bp, Rattus norvegicus
gcgctcacctcggaaccggccgcct

SEQ ID NO: 659496 - DNA, 25 bp, Rattus norvegicus
gagccacggccgtgtcggatcgcgc

SEQ ID NO: 659497 - DNA, 25 bp, Rattus norvegicus
gccgccagcaccaggtaagccagag

SEQ ID NO: 659498 - DNA, 25 bp, Rattus norvegicus
cagcaccaggtaagccagagccagc

SEQ ID NO: 659499 - DNA, 25 bp, Rattus norvegicus
gggaacgctgcgccggcctccagtt

SEQ ID NO: 659500 - DNA, 25 bp, Rattus norvegicus
ccctgctggacaggaggagtcagca

SEQ ID NO: 659501 - DNA, 25 bp, Rattus norvegicus
gaggagtcagcacacgtgagcaacc

SEQ ID NO: 659502 - DNA, 25 bp, Rattus norvegicus
aggagtcagcacacgtgagcaaccc

SEQ ID NO: 659503 - DNA, 25 bp, Rattus norvegicus
cggaggaactgccagggcgcaccaa

SEQ ID NO: 659504 - DNA, 25 bp, Rattus norvegicus
gcagagctgcggtgctcttgcagcc

SEQ ID NO: 659505 - DNA, 25 bp, Rattus norvegicus
gaggaactgccagggcgcaccaagc

SEQ ID NO: 659506 - DNA, 25 bp, Rattus norvegicus
catgcggagcggtaacgctgcgccc

SEQ ID NO: 659507 - DNA, 25 bp, Rattus norvegicus
tcatcggccaggcacacgaagtgtg

SEQ ID NO: 659508 - DNA, 25 bp, Rattus norvegicus
cccacacggctgcaagctcggatga

SEQ ID NO: 659509 - DNA, 25 bp, Rattus norvegicus
gcagcccgcctagccgcttatatag

SEQ ID NO: 659510 - DNA, 25 bp, Rattus norvegicus
gtggcatcaccgcttggtagctaga

SEQ ID NO: 659511 - DNA, 25 bp, Rattus norvegicus
ggatctcatcgaaggtcaccggctg

SEQ ID NO: 659512 - DNA, 25 bp, Rattus norvegicus
gctagaagagatgcccatgagctcg

SEQ ID NO: 659513 - DNA, 25 bp, Rattus norvegicus
tggccttttcctcctccatcgggga

SEQ ID NO: 659514 - DNA, 25 bp, Rattus norvegicus
tcagtttgcagctaccgagcggctc

SEQ ID NO: 659515 - DNA, 25 bp, Rattus norvegicus
ggagtccaggctgttcctcagtttg

SEQ ID NO: 659516 - DNA, 25 bp, Rattus norvegicus
ctccggatgcttccgctgttgctcg

SEQ ID NO: 659517 - DNA, 25 bp, Rattus norvegicus
gccgggctacagtcccagagagtga

SEQ ID NO: 659518 - DNA, 25 bp, Rattus norvegicus
gctcaccgcagagttcgtactggga

SEQ ID NO: 659519 - DNA, 25 bp, Rattus norvegicus
ggcattccaagctctgcaggaacga

SEQ ID NO: 659520 - DNA, 25 bp, Rattus norvegicus
gcaggaacgacttcttggccttttc

SEQ ID NO: 659521 - DNA, 25 bp, Rattus norvegicus
tgaagcagccggatgcagacgaaca

SEQ ID NO: 659522 - DNA, 25 bp, Rattus norvegicus
tctgcagagccgcacaaagggccgc

SEQ ID NO: 659523 - DNA, 25 bp, Rattus norvegicus
gcgcgcagcatctcaatgaagcagc

SEQ ID NO: 659524 - DNA, 25 bp, Rattus norvegicus
aatgcagcaaggaaccctgaggtgg

SEQ ID NO: 659525 - DNA, 25 bp, Rattus norvegicus
tgctcggggaatgcagcaaggaacc

SEQ ID NO: 659526 - DNA, 25 bp, Rattus norvegicus
gcccgccagctgctcggggaatgca

SEQ ID NO: 659527 - DNA, 25 bp, Rattus norvegicus
gcagacactgcccactcagcctggc

SEQ ID NO: 659528 - DNA, 25 bp, Rattus norvegicus
aagacctacctttagcggctgtggc

SEQ ID NO: 659529 - DNA, 25 bp, Rattus norvegicus
gcacaagccggagaggaaagaccta

SEQ ID NO: 659530 - DNA, 25 bp, Rattus norvegicus
ctacagagaagttgctgggctggcc

SEQ ID NO: 659531 - DNA, 25 bp, Rattus norvegicus
cccgctacagagaagttgctgggct

SEQ ID NO: 659532 - DNA, 25 bp, Rattus norvegicus
ccaccctgcgccaggagttgggcag

SEQ ID NO: 659533 - DNA, 25 bp, Rattus norvegicus
gcggagccaccctgcgccaggagtt

SEQ ID NO: 659534 - DNA, 25 bp, Rattus norvegicus
tgcagacgaacatccaggcagctct

SEQ ID NO: 659535 - DNA, 25 bp, Rattus norvegicus
tggtttagctcacacttcaggaaga

SEQ ID NO: 659536 - DNA, 25 bp, Rattus norvegicus
caccacacctggaaggccctgaaga

SEQ ID NO: 659537 - DNA, 25 bp, Rattus norvegicus
tgctcgcgcccacccagtataggaa

SEQ ID NO: 659538 - DNA, 25 bp, Rattus norvegicus
cgccgctctttgaacgctttaggtc

SEQ ID NO: 659539 - DNA, 25 bp, Rattus norvegicus
ccgcccgcatagtcatattcatgtg

SEQ ID NO: 659540 - DNA, 25 bp, Rattus norvegicus
tgtggccattggtgacttccctttc

SEQ ID NO: 659541 - DNA, 25 bp, Rattus norvegicus
cgctcagcgctgcattttcgtatta

SEQ ID NO: 659542 - DNA, 25 bp, Rattus norvegicus
ttcgtattaagacagtggctcgctc

SEQ ID NO: 659543 - DNA, 25 bp, Rattus norvegicus
tactcagcgtttggctccgcccata

SEQ ID NO: 659544 - DNA, 25 bp, Rattus norvegicus
ataggctttacgtcgcgccaccgaa

SEQ ID NO: 659545 - DNA, 25 bp, Rattus norvegicus
agcgcaggaatctctcattggcaga

SEQ ID NO: 659546 - DNA, 25 bp, Rattus norvegicus
aggcatcccgcacgactaaagaagg

SEQ ID NO: 659547 - DNA, 25 bp, Rattus norvegicus
tggccagtgatacccaacatggttt

SEQ ID NO: 659548 - DNA, 25 bp, Rattus norvegicus
cggagcttgtgtttacgcctttgta

SEQ ID NO: 659549 - DNA, 25 bp, Rattus norvegicus
cctgaagcacacaggcgcaaagtca

SEQ ID NO: 659550 - DNA, 25 bp, Rattus norvegicus
ggaaccagacctgaagcacacaggc

SEQ ID NO: 659551 - DNA, 25 bp, Rattus norvegicus
tactacggggcccagctggctggat

SEQ ID NO: 659552 - DNA, 25 bp, Rattus norvegicus
atccggtgtactacggggcccagct

SEQ ID NO: 659553 - DNA, 25 bp, Rattus norvegicus
actccactgggcatccggtgtacta

SEQ ID NO: 659554 - DNA, 25 bp, Rattus norvegicus
gcgcaaagtcagaccacgcaaactc

SEQ ID NO: 659555 - DNA, 25 bp, Rattus norvegicus
gctccttggagcgtcgattctggaa

SEQ ID NO: 659556 - DNA, 25 bp, Rattus norvegicus
tagctgcttcatcctccgctccttg

SEQ ID NO: 659557 - DNA, 25 bp, Rattus norvegicus
gcacccagcgcgcttagctgcttca

SEQ ID NO: 659558 - DNA, 25 bp, Rattus norvegicus
cgcatccggcgaggactgcggaaaa

SEQ ID NO: 659559 - DNA, 25 bp, Rattus norvegicus
tagggatgagttcgcccggctccaa

SEQ ID NO: 659560 - DNA, 25 bp, Rattus norvegicus
ccttggagcgtcgattctggaacca

SEQ ID NO: 659561 - DNA, 25 bp, Rattus norvegicus
gtcagaccacgcaaactccactggg

SEQ ID NO: 659562 - DNA, 25 bp, Rattus norvegicus
caccagaggccgcatccggcgagga

SEQ ID NO: 659563 - DNA, 25 bp, Rattus norvegicus
aagggcagtctacccgcttcttcgg

SEQ ID NO: 659564 - DNA, 25 bp, Rattus norvegicus
aaagattcgcgaagggcagtctacc

SEQ ID NO: 659565 - DNA, 25 bp, Rattus norvegicus
aagcccagaccgcaaaaagattcgc

SEQ ID NO: 659566 - DNA, 25 bp, Rattus norvegicus
ctgtggtacaaagtcgattaaaaag

SEQ ID NO: 659567 - DNA, 25 bp, Rattus norvegicus
gcctttagcccagcatgtctccgaa

SEQ ID NO: 659568 - DNA, 25 bp, Rattus norvegicus
gagttatgtacagcaagcccagacc

SEQ ID NO: 659569 - DNA, 25 bp, Rattus norvegicus
gggcttccggctattgagttatgta

SEQ ID NO: 659570 - DNA, 25 bp, Rattus norvegicus
cgcgccctccgcgaatgctttttgg

SEQ ID NO: 659571 - DNA, 25 bp, Rattus norvegicus
ctggtagctgcagtcacgtcgccga

SEQ ID NO: 659572 - DNA, 25 bp, Rattus norvegicus
gagaagtctcggatggagccgcttc

SEQ ID NO: 659573 - DNA, 25 bp, Rattus norvegicus
agagcggattcttctgtgggaaacg

SEQ ID NO: 659574 - DNA, 25 bp, Rattus norvegicus
ccaaagcctcgcagagcgcggaaaa

SEQ ID NO: 659575 - DNA, 25 bp, Rattus norvegicus
tgccgcgggaaagcgagtgaccaaa

SEQ ID NO: 659576 - DNA, 25 bp, Rattus norvegicus
cccgaagccaaggaggatggatctc

SEQ ID NO: 659577 - DNA, 25 bp, Rattus norvegicus
tgcggctgcagatagaagacttttc

SEQ ID NO: 659578 - DNA, 25 bp, Rattus norvegicus
atgtcctgctcgctccgcgctgggg

SEQ ID NO: 659579 - DNA, 25 bp, Rattus norvegicus
ttccgcagcgcagcgtgctctgggc

SEQ ID NO: 659580 - DNA, 25 bp, Rattus norvegicus
cagaattccgcagcgcagcgtgctc

SEQ ID NO: 659581 - DNA, 25 bp, Rattus norvegicus
cttcgtgctggcagaattccgcagc

SEQ ID NO: 659582 - DNA, 25 bp, Rattus norvegicus
cgtgactctgcttcgtgctggcaga

SEQ ID NO: 659583 - DNA, 25 bp, Rattus norvegicus
ctcggctcgtgactctgcttcgtgc

SEQ ID NO: 659584 - DNA, 25 bp, Rattus norvegicus
ctcccggcgctgacgatgtcctgct

SEQ ID NO: 659585 - DNA, 25 bp, Rattus norvegicus
tcatcaaatccttgtggggcgaggg

SEQ ID NO: 659586 - DNA, 25 bp, Rattus norvegicus
cctcctatctcatcaaatccttgtg

SEQ ID NO: 659587 - DNA, 25 bp, Rattus norvegicus
gctgctgacgtagcagcccggagcc

SEQ ID NO: 659588 - DNA, 25 bp, Rattus norvegicus
cctctcgcggctgctgacgtagcag

SEQ ID NO: 659589 - DNA, 25 bp, Rattus norvegicus
aagacttttcttcagccgcagcggc

SEQ ID NO: 659590 - DNA, 25 bp, Rattus norvegicus
cctcccacgcgtggaagcggagctg

SEQ ID NO: 659591 - DNA, 25 bp, Rattus norvegicus
ctgggccggagcaagatagcagctc

SEQ ID NO: 659592 - DNA, 25 bp, Rattus norvegicus
gtcagtactcgtctctttaccctcg

SEQ ID NO: 659593 - DNA, 25 bp, Rattus norvegicus
cggagtgtctcggagtcagtactcg

SEQ ID NO: 659594 - DNA, 25 bp, Rattus norvegicus
atcttggggaggtcgcctctggaac

SEQ ID NO: 659595 - DNA, 25 bp, Rattus norvegicus
aagatagcagctcgaaccggccgcg

SEQ ID NO: 659596 - DNA, 25 bp, Rattus norvegicus
ggctgataagccaacctgggccgga

SEQ ID NO: 659597 - DNA, 25 bp, Rattus norvegicus
agcaaagcggaaaggctgataagcc

SEQ ID NO: 659598 - DNA, 25 bp, Rattus norvegicus
gagccaccacgctcagcaaagcgga

SEQ ID NO: 659599 - DNA, 25 bp, Rattus norvegicus
tgacgacccagtgcgtagtggccaa

SEQ ID NO: 659600 - DNA, 25 bp, Rattus norvegicus
tggatcttcccgtcctccgtgacga

SEQ ID NO: 659601 - DNA, 25 bp, Rattus norvegicus
tggccgctacctgctgttggatctt

SEQ ID NO: 659602 - DNA, 25 bp, Rattus norvegicus
ccagatctgagcgtaggaagcctcg

SEQ ID NO: 659603 - DNA, 25 bp, Rattus norvegicus
cacggtggaaggctgagaagttccc

SEQ ID NO: 659604 - DNA, 25 bp, Rattus norvegicus
aacggaagctactccttgccgtccg

SEQ ID NO: 659605 - DNA, 25 bp, Rattus norvegicus
taatcgccagagagagctcgaagcc

SEQ ID NO: 659606 - DNA, 25 bp, Rattus norvegicus
agcggtcgaccgcactattacgccg

SEQ ID NO: 659607 - DNA, 25 bp, Rattus norvegicus
gcctccacggaacttatctaagcgg

SEQ ID NO: 659608 - DNA, 25 bp, Rattus norvegicus
accgtcggcatgctgagcgccaagt

SEQ ID NO: 659609 - DNA, 25 bp, Rattus norvegicus
cgtagttgcggtacagctcctccac

SEQ ID NO: 659610 - DNA, 25 bp, Rattus norvegicus
tggcccacttgctccgtggcatcgg

SEQ ID NO: 659611 - DNA, 25 bp, Rattus norvegicus
tttccatttcatcaacagccgggca

SEQ ID NO: 659612 - DNA, 25 bp, Rattus norvegicus
ccgacagtttcgatctcttgaggaa

SEQ ID NO: 659613 - DNA, 25 bp, Rattus norvegicus
ttctgcctccagaaccgacagtttc

SEQ ID NO: 659614 - DNA, 25 bp, Rattus norvegicus
tgcatcctactctctctagaccttg

SEQ ID NO: 659615 - DNA, 25 bp, Rattus norvegicus
acgtctacgcggagactggcgcgtc

SEQ ID NO: 659616 - DNA, 25 bp, Rattus norvegicus
gttcctatccaagtccgggcaattg

SEQ ID NO: 659617 - DNA, 25 bp, Rattus norvegicus
cgcgcaccactaatcgccagagaga

SEQ ID NO: 659618 - DNA, 25 bp, Rattus norvegicus
ggcaattgggcctcgcccacacttt

SEQ ID NO: 659619 - DNA, 25 bp, Rattus norvegicus
ccggggattccgcaggagctgggcc

SEQ ID NO: 659620 - DNA, 25 bp, Rattus norvegicus
ctgacctcggcagaagaacggcagg

SEQ ID NO: 659621 - DNA, 25 bp, Rattus norvegicus
gcggccgaagccacgcaccacctga

SEQ ID NO: 659622 - DNA, 25 bp, Rattus norvegicus
gcaccacctgacctcggcagaagaa

SEQ ID NO: 659623 - DNA, 25 bp, Rattus norvegicus
accacctgacctcggcagaagaacg

SEQ ID NO: 659624 - DNA, 25 bp, Rattus norvegicus
acctgacctcggcagaagaacggca

SEQ ID NO: 659625 - DNA, 25 bp, Rattus norvegicus
cctgacctcggcagaagaacggcag

SEQ ID NO: 659626 - DNA, 25 bp, Rattus norvegicus
tgacctcggcagaagaacggcaggc

SEQ ID NO: 659627 - DNA, 25 bp, Rattus norvegicus
acctcggcagaagaacggcaggctc

SEQ ID NO: 659628 - DNA, 25 bp, Rattus norvegicus
cctcggcagaagaacggcaggctcc

SEQ ID NO: 659629 - DNA, 25 bp, Rattus norvegicus
ggcaggctcctcatgacgctgacct

SEQ ID NO: 659630 - DNA, 25 bp, Rattus norvegicus
ctccgtgcctgcgacggagccgccg

SEQ ID NO: 659631 - DNA, 25 bp, Rattus norvegicus
ggagccgccgtgagtgcggcactcc

SEQ ID NO: 659632 - DNA, 25 bp, Rattus norvegicus
accagccggggattccgcaggagct

SEQ ID NO: 659633 - DNA, 25 bp, Rattus norvegicus
atcggtgagtgagcggcttcgaact

SEQ ID NO: 659634 - DNA, 25 bp, Rattus norvegicus
cggcttcgaacttgagttccggcgg

SEQ ID NO: 659635 - DNA, 25 bp, Rattus norvegicus
gttgtgaagcctctgcgtgtgcgat

SEQ ID NO: 659636 - DNA, 25 bp, Rattus norvegicus
cacgtcttccctcgggtccaggact

SEQ ID NO: 659637 - DNA, 25 bp, Rattus norvegicus
gcttcccacagacgggagtggccat

SEQ ID NO: 659638 - DNA, 25 bp, Rattus norvegicus
tttggcgtcggagacacttgatctc

SEQ ID NO: 659639 - DNA, 25 bp, Rattus norvegicus
cccaagggacaaggacgtgtcgctg

SEQ ID NO: 659640 - DNA, 25 bp, Rattus norvegicus
agtgagcggcttcgaacttgagttc

SEQ ID NO: 659641 - DNA, 25 bp, Rattus norvegicus
aagcctctgcgtgtgcgatcggtga

SEQ ID NO: 659642 - DNA, 25 bp, Rattus norvegicus
ttctagtcggttgtgaagcctctgc

SEQ ID NO: 659643 - DNA, 25 bp, Rattus norvegicus
ggagctttctagtcggttgtgaagc

SEQ ID NO: 659644 - DNA, 25 bp, Rattus norvegicus
atctcggagtgctgcgtgtataggc

SEQ ID NO: 659645 - DNA, 25 bp, Rattus norvegicus
acttgatctcggagtgctgcgtgta

SEQ ID NO: 659646 - DNA, 25 bp, Rattus norvegicus
ggcctcgcttcccacagacgggagt

SEQ ID NO: 659647 - DNA, 25 bp, Rattus norvegicus
gagagtggtttctcagctgagtacc

SEQ ID NO: 659648 - DNA, 25 bp, Rattus norvegicus
tgcagaaggatgactccaggccctc

SEQ ID NO: 659649 - DNA, 25 bp, Rattus norvegicus
cccagatcacgccaggagagttatt

SEQ ID NO: 659650 - DNA, 25 bp, Rattus norvegicus
catccgatgcggaggttccttaacc

SEQ ID NO: 659651 - DNA, 25 bp, Rattus norvegicus
actatggatcccacgctccgcagga

SEQ ID NO: 659652 - DNA, 25 bp, Rattus norvegicus
caccggggcaactagtctctgtcta

SEQ ID NO: 659653 - DNA, 25 bp, Rattus norvegicus
tcgcagtgagctgtcccgagcttct

SEQ ID NO: 659654 - DNA, 25 bp, Rattus norvegicus
aacgcctgccacacagtcgcagtga

SEQ ID NO: 659655 - DNA, 25 bp, Rattus norvegicus
gcgcagaggaaatcccggcctaatg

SEQ ID NO: 659656 - DNA, 25 bp, Rattus norvegicus
catgagccctgggaaccgtgagtct

SEQ ID NO: 659657 - DNA, 25 bp, Rattus norvegicus
agtacacctggtccttgtctcagtc

SEQ ID NO: 659658 - DNA, 25 bp, Rattus norvegicus
tcctgcaggaccctttgtaagtaca

SEQ ID NO: 659659 - DNA, 25 bp, Rattus norvegicus
tgctgacaagcaaaacgcgggcttc

SEQ ID NO: 659660 - DNA, 25 bp, Rattus norvegicus
acccattacgttcagggcggcctgc

SEQ ID NO: 659661 - DNA, 25 bp, Rattus norvegicus
agccgaatgtgaccgcccgagctct

SEQ ID NO: 659662 - DNA, 25 bp, Rattus norvegicus
agccggcgccgcacaaagctccgcc

SEQ ID NO: 659663 - DNA, 25 bp, Rattus norvegicus
tccgcccgcgcacacacgacaacag

SEQ ID NO: 659664 - DNA, 25 bp, Rattus norvegicus
acgacaacagcacccagtgcgtcgg

SEQ ID NO: 659665 - DNA, 25 bp, Rattus norvegicus
tgcgtcggcccacacaatagcgcgg

SEQ ID NO: 659666 - DNA, 25 bp, Rattus norvegicus
gggtccgcccttcgcgcacacccac

SEQ ID NO: 659667 - DNA, 25 bp, Rattus norvegicus
cccggcgctcggtgaagcgcgtcac

SEQ ID NO: 659668 - DNA, 25 bp, Rattus norvegicus
ccgcggtgctgctcagcagcaggca

SEQ ID NO: 659669 - DNA, 25 bp, Rattus norvegicus
ctccgctgcccagcgacgttgctgc

SEQ ID NO: 659670 - DNA, 25 bp, Rattus norvegicus
tcccaggccaaagagctcagccaag

SEQ ID NO: 659671 - DNA, 25 bp, Rattus norvegicus
ggccaaagagctcagccaagttctg

SEQ ID NO: 659672 - DNA, 25 bp, Rattus norvegicus
tcagccaagttctgcacgcttccag

SEQ ID NO: 659673 - DNA, 25 bp, Rattus norvegicus
ttccagccgaatgtgaccgcccgag

SEQ ID NO: 659674 - DNA, 25 bp, Rattus norvegicus
ttctgcacgcttccagccgaatgtg

SEQ ID NO: 659675 - DNA, 25 bp, Rattus norvegicus
aacttctggcggtgcgcgtcagcgt

SEQ ID NO: 659676 - DNA, 25 bp, Rattus norvegicus
gcagtagcagaagccgcaatcgcgg

SEQ ID NO: 659677 - DNA, 25 bp, Rattus norvegicus
tcgtcgggttcacactcgtcacacg

SEQ ID NO: 659678 - DNA, 25 bp, Rattus norvegicus
acactcgtcacacgtgccgtcggga

SEQ ID NO: 659679 - DNA, 25 bp, Rattus norvegicus
cactccggaggccatgtggctgcag

SEQ ID NO: 659680 - DNA, 25 bp, Rattus norvegicus
ggcctagcagcttgcgtactctccg

SEQ ID NO: 659681 - DNA, 25 bp, Rattus norvegicus
gaacgcagtctcttctcggggagca

SEQ ID NO: 659682 - DNA, 25 bp, Rattus norvegicus
tcggcctccgttgccgggcaaaatc

SEQ ID NO: 659683 - DNA, 25 bp, Rattus norvegicus
ttgccgggcaaaatcgcggccgccg

SEQ ID NO: 659684 - DNA, 25 bp, Rattus norvegicus
agcggcctcctttcacttcctgagt

SEQ ID NO: 659685 - DNA, 25 bp, Rattus norvegicus
acttcctgagtcacttaaagcggca

SEQ ID NO: 659686 - DNA, 25 bp, Rattus norvegicus
taaagcggcaaggacccttttctgc

SEQ ID NO: 659687 - DNA, 25 bp, Rattus norvegicus
tttctgcgttttcccgcggggctga

SEQ ID NO: 659688 - DNA, 25 bp, Rattus norvegicus
cgcgtctgcagctgctgaggcctga

SEQ ID NO: 659689 - DNA, 25 bp, Rattus norvegicus
agtgccagctttcgccgagctcggg

SEQ ID NO: 659690 - DNA, 25 bp, Rattus norvegicus
tagcgtccgagactgcaccgggcac

SEQ ID NO: 659691 - DNA, 25 bp, Rattus norvegicus
aggtcgcttagcgtccgagactgca

SEQ ID NO: 659692 - DNA, 25 bp, Rattus norvegicus
ctgcgccgtgccttcaggtcgctta

SEQ ID NO: 659693 - DNA, 25 bp, Rattus norvegicus
atctggagagttgctgcgccgtgcc

SEQ ID NO: 659694 - DNA, 25 bp, Rattus norvegicus
tgtttaaagggacagagcgccgacc

SEQ ID NO: 659695 - DNA, 25 bp, Rattus norvegicus
ggactttctccgacctcgcccagca

SEQ ID NO: 659696 - DNA, 25 bp, Rattus norvegicus
caagttggccgtacctgcgggcacc

SEQ ID NO: 659697 - DNA, 25 bp, Rattus norvegicus
gaaacggcgcgacgcgcgccaagtt

SEQ ID NO: 659698 - DNA, 25 bp, Rattus norvegicus
agcgcgcccggagtgccagctttcg

SEQ ID NO: 659699 - DNA, 25 bp, Rattus norvegicus
ccagaggccagtgtcatcggggctt

SEQ ID NO: 659700 - DNA, 25 bp, Rattus norvegicus
tctgatgcgcagacgcgctgcctct

SEQ ID NO: 659701 - DNA, 25 bp, Rattus norvegicus
cgcgggccgaatctgatgcgcagac

SEQ ID NO: 659702 - DNA, 25 bp, Rattus norvegicus
acgcgcgccaagttggccgtacctg

SEQ ID NO: 659703 - DNA, 25 bp, Rattus norvegicus
cgagcatcctggcttcagtcacaac

SEQ ID NO: 659704 - DNA, 25 bp, Rattus norvegicus
tcatggcagcatgcgaccaatcagc

SEQ ID NO: 659705 - DNA, 25 bp, Rattus norvegicus
cactgctcctggctgttggctgagc

SEQ ID NO: 659706 - DNA, 25 bp, Rattus norvegicus
gcccgctggttccttgttggctctc

SEQ ID NO: 659707 - DNA, 25 bp, Rattus norvegicus
ctgcggctatagaaggccagcggct

SEQ ID NO: 659708 - DNA, 25 bp, Rattus norvegicus
ctttagaatgtcctggtgctgcggc

SEQ ID NO: 659709 - DNA, 25 bp, Rattus norvegicus
cgtcttggagagctttagaatgtcc

SEQ ID NO: 659710 - DNA, 25 bp, Rattus norvegicus
tgcggtggcaaatctgggttttctt

SEQ ID NO: 659711 - DNA, 25 bp, Rattus norvegicus
ttcagtcacaactcgcggccgcttg

SEQ ID NO: 659712 - DNA, 25 bp, Rattus norvegicus
aacacggtctggctcttcactgcgc

SEQ ID NO: 659713 - DNA, 25 bp, Rattus norvegicus
tccttcagaggaggcaacacggtct

SEQ ID NO: 659714 - DNA, 25 bp, Rattus norvegicus
cccgcgcttggactccttcagagga

SEQ ID NO: 659715 - DNA, 25 bp, Rattus norvegicus
tcgcggtccctctgtaaaccattct

SEQ ID NO: 659716 - DNA, 25 bp, Rattus norvegicus
ctggcctcacagacgcttgactttt

SEQ ID NO: 659717 - DNA, 25 bp, Rattus norvegicus
ccagccaagctgctgcttgggcttc

SEQ ID NO: 659718 - DNA, 25 bp, Rattus norvegicus
gccgccactctggatcggatgccga

SEQ ID NO: 659719 - DNA, 25 bp, Rattus norvegicus
cacaggcacgggtgccgtcggcaaa

SEQ ID NO: 659720 - DNA, 25 bp, Rattus norvegicus
atcggtccattgtaccaggtccacc

SEQ ID NO: 659721 - DNA, 25 bp, Rattus norvegicus
atgccgagggagtcgatcttccggc

SEQ ID NO: 659722 - DNA, 25 bp, Rattus norvegicus
gcagcgcccggaaagttttcaggga

SEQ ID NO: 659723 - DNA, 25 bp, Rattus norvegicus
taggcggttggaactgcgtccacag

SEQ ID NO: 659724 - DNA, 25 bp, Rattus norvegicus
gttgatgccgtagcgtacacaggca

SEQ ID NO: 659725 - DNA, 25 bp, Rattus norvegicus
ccctgtatctgctctgggttgatgc

SEQ ID NO: 659726 - DNA, 25 bp, Rattus norvegicus
caaggtagtaggacagggcctcgcc

SEQ ID NO: 659727 - DNA, 25 bp, Rattus norvegicus
accacgtcggtgaggttaggcagcc

SEQ ID NO: 659728 - DNA, 25 bp, Rattus norvegicus
tcctctgatcgccagggctcgggca

SEQ ID NO: 659729 - DNA, 25 bp, Rattus norvegicus
tccgcctggctgaggttggtcagct

SEQ ID NO: 659730 - DNA, 25 bp, Rattus norvegicus
tagcagcgagcccaaagccagcagc

SEQ ID NO: 659731 - DNA, 25 bp, Rattus norvegicus
tgagagtttttctgggtacctgtgg

SEQ ID NO: 659732 - DNA, 25 bp, Rattus norvegicus
tgcgaccagcgcgaccttgcaggag

SEQ ID NO: 659733 - DNA, 25 bp, Rattus norvegicus
ctccggcggggctaaaccttgcaat

SEQ ID NO: 659734 - DNA, 25 bp, Rattus norvegicus
ggctaaaccttgcaatccctcttcg

SEQ ID NO: 659735 - DNA, 25 bp, Rattus norvegicus
tgacggccactcgtggtacgggtct

SEQ ID NO: 659736 - DNA, 25 bp, Rattus norvegicus
cgaagcacagacacaggtggcggcc

SEQ ID NO: 659737 - DNA, 25 bp, Rattus norvegicus
gagcgtgttcctgcagccctgcgac

SEQ ID NO: 659738 - DNA, 25 bp, Rattus norvegicus
gaccttgcaggagccggtgtaagat

SEQ ID NO: 659739 - DNA, 25 bp, Rattus norvegicus
aaagccaggacgtggattagcgccc

SEQ ID NO: 659740 - DNA, 25 bp, Rattus norvegicus
cgccgaggcgctaagggcttaccca

SEQ ID NO: 659741 - DNA, 25 bp, Rattus norvegicus
gagaggctgcccgttaaataccgct

SEQ ID NO: 659742 - DNA, 25 bp, Rattus norvegicus
actgtctccagaccgtgcccgggag

SEQ ID NO: 659743 - DNA, 25 bp, Rattus norvegicus
caaccgaggggtgagagtttttctg

SEQ ID NO: 659744 - DNA, 25 bp, Rattus norvegicus
ccacgccatggcatcaaccgagggg

SEQ ID NO: 659745 - DNA, 25 bp, Rattus norvegicus
gtcgatactgcccttgaccatcttg

SEQ ID NO: 659746 - DNA, 25 bp, Rattus norvegicus
gatactgcccttgaccatcttgagg

SEQ ID NO: 659747 - DNA, 25 bp, Rattus norvegicus
cttgtcgaacatgcggtcgatactg

SEQ ID NO: 659748 - DNA, 25 bp, Rattus norvegicus
ctgtggcctccgaggggaacgccgc

SEQ ID NO: 659749 - DNA, 25 bp, Rattus norvegicus
cttgaccatcttgagggccatcgcg

SEQ ID NO: 659750 - DNA, 25 bp, Rattus norvegicus
atggggtcgaggaggctgctccaag

SEQ ID NO: 659751 - DNA, 25 bp, Rattus norvegicus
aacatgcggtcgatactgcccttga

SEQ ID NO: 659752 - DNA, 25 bp, Rattus norvegicus
gcaggttcttgtcgaacatgcggtc

SEQ ID NO: 659753 - DNA, 25 bp, Rattus norvegicus
atcctgcaggttcttgtcgaacatg

SEQ ID NO: 659754 - DNA, 25 bp, Rattus norvegicus
ccagatcctgcaggttcttgtcgaa

SEQ ID NO: 659755 - DNA, 25 bp, Rattus norvegicus
tcgtcctccttgtggttgcggatgc

SEQ ID NO: 659756 - DNA, 25 bp, Rattus norvegicus
tcacctcgtcctccttgtggttgcg

SEQ ID NO: 659757 - DNA, 25 bp, Rattus norvegicus
ctccaaggcgggccagaggctatag

SEQ ID NO: 659758 - DNA, 25 bp, Rattus norvegicus
tgaccatcttgagggccatcgcggc

SEQ ID NO: 659759 - DNA, 25 bp, Rattus norvegicus
gccttgcatgagatggctccgccca

SEQ ID NO: 659760 - DNA, 25 bp, Rattus norvegicus
gctgtcaagcgcaaggagactgttg

SEQ ID NO: 659761 - DNA, 25 bp, Rattus norvegicus
agactgcccgctttgcagactaata

SEQ ID NO: 659762 - DNA, 25 bp, Rattus norvegicus
gcgaggctctctcagatcttgcttc

SEQ ID NO: 659763 - DNA, 25 bp, Rattus norvegicus
cctgactggagagctagaccttcta

SEQ ID NO: 659764 - DNA, 25 bp, Rattus norvegicus
tagtgcacgctcctcacctgactgg

SEQ ID NO: 659765 - DNA, 25 bp, Rattus norvegicus
tccgggaaagctcgcaactagacta

SEQ ID NO: 659766 - DNA, 25 bp, Rattus norvegicus
taccagcggcaggttacagcgaagc

SEQ ID NO: 659767 - DNA, 25 bp, Rattus norvegicus
ctgccgaagcccaggaagtaacgta

SEQ ID NO: 659768 - DNA, 25 bp, Rattus norvegicus
tgagacagtcccaggcttcgaccgc

SEQ ID NO: 659769 - DNA, 25 bp, Rattus norvegicus
gactaatagcgttcttgtggaccac

SEQ ID NO: 659770 - DNA, 25 bp, Rattus norvegicus
ctgagcggagttagaaccatgtctg

SEQ ID NO: 659771 - DNA, 25 bp, Rattus norvegicus
tgtggaccacttagacgtagaacgt

SEQ ID NO: 659772 - DNA, 25 bp, Rattus norvegicus
catgcagcagcaccttgagacagtc

SEQ ID NO: 659773 - DNA, 25 bp, Rattus norvegicus
accatggcggacagccgggacccag

SEQ ID NO: 659774 - DNA, 25 bp, Rattus norvegicus
cagctctgcagctccgcaatcctac

SEQ ID NO: 659775 - DNA, 25 bp, Rattus norvegicus
gggcctgactgacgcgattgcctac

SEQ ID NO: 659776 - DNA, 25 bp, Rattus norvegicus
ctcagagcctcacgagaacttggga

SEQ ID NO: 659777 - DNA, 25 bp, Rattus norvegicus
cagtgttcctcagagcctcacgaga

SEQ ID NO: 659778 - DNA, 25 bp, Rattus norvegicus
ggtatccagtgttcctcagagcctc

SEQ ID NO: 659779 - DNA, 25 bp, Rattus norvegicus
cctcaggtatccagtgttcctcaga

SEQ ID NO: 659780 - DNA, 25 bp, Rattus norvegicus
ccagcgaccagatgaagcagtggaa

SEQ ID NO: 659781 - DNA, 25 bp, Rattus norvegicus
gggacccagccagcgaccagatgaa

SEQ ID NO: 659782 - DNA, 25 bp, Rattus norvegicus
gcaatcctacaccatggcggacagc

SEQ ID NO: 659783 - DNA, 25 bp, Rattus norvegicus
tgcctcacgttctgcagctctgcag

SEQ ID NO: 659784 - DNA, 25 bp, Rattus norvegicus
tcttgcctcacgttctgcagctctg

SEQ ID NO: 659785 - DNA, 25 bp, Rattus norvegicus
gtggagaccgtgctcgtccggccct

SEQ ID NO: 659786 - DNA, 25 bp, Rattus norvegicus
ccagccagcgaccagatgaagcagt

SEQ ID NO: 659787 - DNA, 25 bp, Rattus norvegicus
gtcaaggcgttgtccctctatagca

SEQ ID NO: 659788 - DNA, 25 bp, Rattus norvegicus
gacttgaccttggactccgggtatg

SEQ ID NO: 659789 - DNA, 25 bp, Rattus norvegicus
tcgtcttccaagtccaactcgcagg

SEQ ID NO: 659790 - DNA, 25 bp, Rattus norvegicus
aactcgcaggcgctcaactcttcgg

SEQ ID NO: 659791 - DNA, 25 bp, Rattus norvegicus
gtgctactccggctccatgaacagc

SEQ ID NO: 659792 - DNA, 25 bp, Rattus norvegicus
tgaacagccgccacaacagctggga

SEQ ID NO: 659793 - DNA, 25 bp, Rattus norvegicus
tgaacacagtgctgcccgaggatcc

SEQ ID NO: 659794 - DNA, 25 bp, Rattus norvegicus
aggatcccgaagtggccgacctctt

SEQ ID NO: 659795 - DNA, 25 bp, Rattus norvegicus
ctctatagcatgagcgctggcgatg

SEQ ID NO: 659796 - DNA, 25 bp, Rattus norvegicus
tgcacgccaagtgtacccgcttcga

SEQ ID NO: 659797 - DNA, 25 bp, Rattus norvegicus
gagcctagagctggtttccgtcctc

SEQ ID NO: 659798 - DNA, 25 bp, Rattus norvegicus
gccgggacgtacagctccacattga

SEQ ID NO: 659799 - DNA, 25 bp, Rattus norvegicus
ctcccggagctagaggagttccctt

SEQ ID NO: 659800 - DNA, 25 bp, Rattus norvegicus
tcgctcagcctttcgtcttccaagt

SEQ ID NO: 659801 - DNA, 25 bp, Rattus norvegicus
cactactgtggagcagcgtgccatt

SEQ ID NO: 659802 - DNA, 25 bp, Rattus norvegicus
ctgccacgcaggctgacaggtttgc

SEQ ID NO: 659803 - DNA, 25 bp, Rattus norvegicus
accggaaagtgctcgagaagccagc

SEQ ID NO: 659804 - DNA, 25 bp, Rattus norvegicus
ccgagtgtctgagtatccgggacca

SEQ ID NO: 659805 - DNA, 25 bp, Rattus norvegicus
ggaccttccaaagcttcgacgctta

SEQ ID NO: 659806 - DNA, 25 bp, Rattus norvegicus
acgggaatccgctcaagtggcagca

SEQ ID NO: 659807 - DNA, 25 bp, Rattus norvegicus
gttatgacgtaacacgccaggcgcc

SEQ ID NO: 659808 - DNA, 25 bp, Rattus norvegicus
acctcaggcagtcgcacaatgaatg

SEQ ID NO: 659809 - DNA, 25 bp, Rattus norvegicus
gccctttccaaggagtacctgcgtc

SEQ ID NO: 659810 - DNA, 25 bp, Rattus norvegicus
cgagccagtgttacgagcccgtaaa

SEQ ID NO: 659811 - DNA, 25 bp, Rattus norvegicus
agaaacttccgtcctcgagccagtg

SEQ ID NO: 659812 - DNA, 25 bp, Rattus norvegicus
gggcatcagcccgtacagaaacttc

SEQ ID NO: 659813 - DNA, 25 bp, Rattus norvegicus
tccgggaccaggaatgttttatctg

SEQ ID NO: 659814 - DNA, 25 bp, Rattus norvegicus
gggaccttcctgctatgggaccttc

SEQ ID NO: 659815 - DNA, 25 bp, Rattus norvegicus
aatctgcttcatggcctcggtctgg

SEQ ID NO: 659816 - DNA, 25 bp, Rattus norvegicus
gacttggccagcctgcgctctgaaa

SEQ ID NO: 659817 - DNA, 25 bp, Rattus norvegicus
ctgagctgctcctagtgggacaaga

SEQ ID NO: 659818 - DNA, 25 bp, Rattus norvegicus
ttctgggcaagaagctccatccacc

SEQ ID NO: 659819 - DNA, 25 bp, Rattus norvegicus
cgttgcgaacagagacgtgcgctcc

SEQ ID NO: 659820 - DNA, 25 bp, Rattus norvegicus
tccgaagtttcttgtcgatcacgcc

SEQ ID NO: 659821 - DNA, 25 bp, Rattus norvegicus
gaggccttgagcgagtccttctagc

SEQ ID NO: 659822 - DNA, 25 bp, Rattus norvegicus
ggcacccgttgccttgcaagaacga

SEQ ID NO: 659823 - DNA, 25 bp, Rattus norvegicus
aaggcaacggtctccatcggggcaa

SEQ ID NO: 659824 - DNA, 25 bp, Rattus norvegicus
tgaaaacgtgggaccagagcgatcc

SEQ ID NO: 659825 - DNA, 25 bp, Rattus norvegicus
cggtcccgacgatttgctgccgctt

SEQ ID NO: 659826 - DNA, 25 bp, Rattus norvegicus
tccatccaccgcagagaccggagta

SEQ ID NO: 659827 - DNA, 25 bp, Rattus norvegicus
gtcgatcacgccgagaatctgcttc

SEQ ID NO: 659828 - DNA, 25 bp, Rattus norvegicus
gccgagggcatctttagaccgagaa

SEQ ID NO: 659829 - DNA, 25 bp, Rattus norvegicus
gcatctcgtcgtctccgctgagcga

SEQ ID NO: 659830 - DNA, 25 bp, Rattus norvegicus
cgagatggcaacttcggccctggtc

SEQ ID NO: 659831 - DNA, 25 bp, Rattus norvegicus
ggcgggatctctgttctccagagca

SEQ ID NO: 659832 - DNA, 25 bp, Rattus norvegicus
tgttctccagagcaccgccttctag

SEQ ID NO: 659833 - DNA, 25 bp, Rattus norvegicus
gcctgtggaatctccgaactcctag

SEQ ID NO: 659834 - DNA, 25 bp, Rattus norvegicus
gaactcctagacacggggccttggc

SEQ ID NO: 659835 - DNA, 25 bp, Rattus norvegicus
cacgcagcctcccattcaaaagatg

SEQ ID NO: 659836 - DNA, 25 bp, Rattus norvegicus
ccattcaaaagatgccgaaggggcg

SEQ ID NO: 659837 - DNA, 25 bp, Rattus norvegicus
tttccgtcgctctacgaccggggca

SEQ ID NO: 659838 - DNA, 25 bp, Rattus norvegicus
tacgaccggggcatctcgtcgtctc

SEQ ID NO: 659839 - DNA, 25 bp, Rattus norvegicus
ccgctgagcgactttaacatctgga

SEQ ID NO: 659840 - DNA, 25 bp, Rattus norvegicus
tggccatccggtctggcctctattc

SEQ ID NO: 659841 - DNA, 25 bp, Rattus norvegicus
ggtctggcctctattccctacgagc

SEQ ID NO: 659842 - DNA, 25 bp, Rattus norvegicus
acatctggaagaagctctttgtgcc

SEQ ID NO: 659843 - DNA, 25 bp, Rattus norvegicus
aactggaggaagctgtaaactggga

SEQ ID NO: 659844 - DNA, 25 bp, Rattus norvegicus
tcgcgggtgactctggagacaccga

SEQ ID NO: 659845 - DNA, 25 bp, Rattus norvegicus
gaaaatagaccttcgcgagagagga

SEQ ID NO: 659846 - DNA, 25 bp, Rattus norvegicus
aggttaagtcttgagcagcggcagc

SEQ ID NO: 659847 - DNA, 25 bp, Rattus norvegicus
ttgagcagcggcagctgtcgcagcc

SEQ ID NO: 659848 - DNA, 25 bp, Rattus norvegicus
agctgggtgattcgctctctctctt

SEQ ID NO: 659849 - DNA, 25 bp, Rattus norvegicus
tctctctttggcgtttgaagggagc

SEQ ID NO: 659850 - DNA, 25 bp, Rattus norvegicus
gagtccaggcagctagccagccacg

SEQ ID NO: 659851 - DNA, 25 bp, Rattus norvegicus
tcctcggccatcgaaaggaagagcc

SEQ ID NO: 659852 - DNA, 25 bp, Rattus norvegicus
gaagagcctggacccgtctgagtaa

SEQ ID NO: 659853 - DNA, 25 bp, Rattus norvegicus
ctgagtaagtgtggcgcttctctcc

SEQ ID NO: 659854 - DNA, 25 bp, Rattus norvegicus
cagcatgcccttggtccctcggtgt

SEQ ID NO: 659855 - DNA, 25 bp, Rattus norvegicus
ccctcggtgtcgcaggggttctctt

SEQ ID NO: 659856 - DNA, 25 bp, Rattus norvegicus
gttctctttcctcgcgggtgactct

SEQ ID NO: 659857 - DNA, 25 bp, Rattus norvegicus
cgcacggaccaaaatgcctgacttc

SEQ ID NO: 659858 - DNA, 25 bp, Rattus norvegicus
acaaatgactaggtgggaaaccgcg

SEQ ID NO: 659859 - DNA, 25 bp, Rattus norvegicus
caaatgactaggtgggaaaccgcgg

SEQ ID NO: 659860 - DNA, 25 bp, Rattus norvegicus
cgtggtggcgcacggaccaaaatgc

SEQ ID NO: 659861 - DNA, 25 bp, Rattus norvegicus
tggtggcgcacggaccaaaatgcct

SEQ ID NO: 659862 - DNA, 25 bp, Rattus norvegicus
ggcgcacggaccaaaatgcctgact

SEQ ID NO: 659863 - DNA, 25 bp, Rattus norvegicus
cacggaccaaaatgcctgacttcca

SEQ ID NO: 659864 - DNA, 25 bp, Rattus norvegicus
ggaccaaaatgcctgacttccaaga

SEQ ID NO: 659865 - DNA, 25 bp, Rattus norvegicus
ccaaaatgcctgacttccaagaccg

SEQ ID NO: 659866 - DNA, 25 bp, Rattus norvegicus
aatgcctgacttccaagaccggtcg

SEQ ID NO: 659867 - DNA, 25 bp, Rattus norvegicus
tgcctgacttccaagaccggtcgtc

SEQ ID NO: 659868 - DNA, 25 bp, Rattus norvegicus
ctgacttccaagaccggtcgtccct

SEQ ID NO: 659869 - DNA, 25 bp, Rattus norvegicus
cttttctaagcttcgagcaagttcg

SEQ ID NO: 659870 - DNA, 25 bp, Rattus norvegicus
gtggcgcacggaccaaaatgcctga

SEQ ID NO: 659871 - DNA, 25 bp, Rattus norvegicus
gaccggcatgcaactctggcgagaa

SEQ ID NO: 659872 - DNA, 25 bp, Rattus norvegicus
tgatccggagacaccttttacaaac

SEQ ID NO: 659873 - DNA, 25 bp, Rattus norvegicus
ttgtgatccggagacaccttttaca

SEQ ID NO: 659874 - DNA, 25 bp, Rattus norvegicus
tgagaaaattgtgatccggagacac

SEQ ID NO: 659875 - DNA, 25 bp, Rattus norvegicus
agaagttgtgagaaaattgtgatcc

SEQ ID NO: 659876 - DNA, 25 bp, Rattus norvegicus
cggcatgcaactctggcgagaagtt

SEQ ID NO: 659877 - DNA, 25 bp, Rattus norvegicus
cttcgggtgaggaccggcatgcaac

SEQ ID NO: 659878 - DNA, 25 bp, Rattus norvegicus
ttgattcgggcgatttcctgatggg

SEQ ID NO: 659879 - DNA, 25 bp, Rattus norvegicus
ctcggaaagttgattcgggcgattt

SEQ ID NO: 659880 - DNA, 25 bp, Rattus norvegicus
cgctagctcggaaagttgattcggg

SEQ ID NO: 659881 - DNA, 25 bp, Rattus norvegicus
gctgcgctagctcggaaagttgatt

SEQ ID NO: 659882 - DNA, 25 bp, Rattus norvegicus
tcccgctgcgctagctcggaaagtt

SEQ ID NO: 659883 - DNA, 25 bp, Rattus norvegicus
gagtgtcgatctcccgctgcgctag

SEQ ID NO: 659884 - DNA, 25 bp, Rattus norvegicus
gcatgcaactctggcgagaagttgt

SEQ ID NO: 659885 - DNA, 25 bp, Rattus norvegicus
ttcatgaagcggaagtccacgcgcc

SEQ ID NO: 659886 - DNA, 25 bp, Rattus norvegicus
aagttgttgtacttggtgcgggcca

SEQ ID NO: 659887 - DNA, 25 bp, Rattus norvegicus
tgagcagctcgttcatgaagcggaa

SEQ ID NO: 659888 - DNA, 25 bp, Rattus norvegicus
gtggatcccgtagatgagcagctcg

SEQ ID NO: 659889 - DNA, 25 bp, Rattus norvegicus
agaggttctcactggtccgcaggct

SEQ ID NO: 659890 - DNA, 25 bp, Rattus norvegicus
cttgacatacacgtcgaagttgttg

SEQ ID NO: 659891 - DNA, 25 bp, Rattus norvegicus
gccagcgggtcttgacatacacgtc

SEQ ID NO: 659892 - DNA, 25 bp, Rattus norvegicus
gataaagccgtagagccagcgggtc

SEQ ID NO: 659893 - DNA, 25 bp, Rattus norvegicus
gtagagcagaaagcggataaagccg

SEQ ID NO: 659894 - DNA, 25 bp, Rattus norvegicus
ctgcagctgaagtagagcagaaagc

SEQ ID NO: 659895 - DNA, 25 bp, Rattus norvegicus
gcccaggtactgcaggcagaagagc

SEQ ID NO: 659896 - DNA, 25 bp, Rattus norvegicus
tggaagcgcagcagcacacgcacgc

SEQ ID NO: 659897 - DNA, 25 bp, Rattus norvegicus
actgacagtttgagctggaagcgca

SEQ ID NO: 659898 - DNA, 25 bp, Rattus norvegicus
ctcactggtccgcaggctgcgtgta

SEQ ID NO: 659899 - DNA, 25 bp, Rattus norvegicus
gtagaggcctcacgaggaaaaagga

SEQ ID NO: 659900 - DNA, 25 bp, Rattus norvegicus
gagacaggcgcccagggaatgccga

SEQ ID NO: 659901 - DNA, 25 bp, Rattus norvegicus
cgcagtgagtgagtgaacttcggtc

SEQ ID NO: 659902 - DNA, 25 bp, Rattus norvegicus
cagtgagtgagtgaacttcggtccc

SEQ ID NO: 659903 - DNA, 25 bp, Rattus norvegicus
cccgggagacctcattctcggagag

SEQ ID NO: 659904 - DNA, 25 bp, Rattus norvegicus
aggagcaaggacaccttaccgcacc

SEQ ID NO: 659905 - DNA, 25 bp, Rattus norvegicus
acctcattctcggagaggccggagc

SEQ ID NO: 659906 - DNA, 25 bp, Rattus norvegicus
gaatgccgagctccaggatcgctga

SEQ ID NO: 659907 - DNA, 25 bp, Rattus norvegicus
ccaggatcgctgagaagaaagagtg

SEQ ID NO: 659908 - DNA, 25 bp, Rattus norvegicus
gggctgcggcacgatatcactataa

SEQ ID NO: 659909 - DNA, 25 bp, Rattus norvegicus
tgcggcacgatatcactataataaa

SEQ ID NO: 659910 - DNA, 25 bp, Rattus norvegicus
tacaagccgggtagaggcctcacga

SEQ ID NO: 659911 - DNA, 25 bp, Rattus norvegicus
tcacgaggaaaaaggagcaaggaca

SEQ ID NO: 659912 - DNA, 25 bp, Rattus norvegicus
cactataataaaaaaggctggcggg

SEQ ID NO: 659913 - DNA, 25 bp, Rattus norvegicus
tgttctgcgggataacggccgccct

SEQ ID NO: 659914 - DNA, 25 bp, Rattus norvegicus
ggtagcgactccagggtcagcaacc

SEQ ID NO: 659915 - DNA, 25 bp, Rattus norvegicus
cggctgcttgcacaggttagttatg

SEQ ID NO: 659916 - DNA, 25 bp, Rattus norvegicus
tgcccgcgatcacgatggcatcaga

SEQ ID NO: 659917 - DNA, 25 bp, Rattus norvegicus
cccattacttgattaggtccctgta

SEQ ID NO: 659918 - DNA, 25 bp, Rattus norvegicus
gtaaggcctggatgcccagatccca

SEQ ID NO: 659919 - DNA, 25 bp, Rattus norvegicus
tctagacctgggcaggagtaaggcc

SEQ ID NO: 659920 - DNA, 25 bp, Rattus norvegicus
tccgcaatcggcctagctgaggctt

SEQ ID NO: 659921 - DNA, 25 bp, Rattus norvegicus
gtggcctttccacagcgctagacca

SEQ ID NO: 659922 - DNA, 25 bp, Rattus norvegicus
atcctggacctaggcccgacaggga

SEQ ID NO: 659923 - DNA, 25 bp, Rattus norvegicus
gagggctctggtcatcctggaccta

SEQ ID NO: 659924 - DNA, 25 bp, Rattus norvegicus
gttctacctgtccatgagggctctg

SEQ ID NO: 659925 - DNA, 25 bp, Rattus norvegicus
tcagaaggttgaaggcctcctcgcg

SEQ ID NO: 659926 - DNA, 25 bp, Rattus norvegicus
tccctgtagtccacgaaggataaga

SEQ ID NO: 659927 - DNA, 25 bp, Rattus norvegicus
gcgcagaaccgctgccaagcgctta

SEQ ID NO: 659928 - DNA, 25 bp, Rattus norvegicus
ctcattgacaaagaaagcacgtagc

SEQ ID NO: 659929 - DNA, 25 bp, Rattus norvegicus
cagagcggcgcctcattgacaaaga

SEQ ID NO: 659930 - DNA, 25 bp, Rattus norvegicus
aatgctactgcagctcagagcggcg

SEQ ID NO: 659931 - DNA, 25 bp, Rattus norvegicus
ggctccagccgcgaatgctactgca

SEQ ID NO: 659932 - DNA, 25 bp, Rattus norvegicus
tggatcgctggactccggctccagc

SEQ ID NO: 659933 - DNA, 25 bp, Rattus norvegicus
tcggttcactggatcgctggactcc

SEQ ID NO: 659934 - DNA, 25 bp, Rattus norvegicus
gggtctctgtccctgtcggttcact

SEQ ID NO: 659935 - DNA, 25 bp, Rattus norvegicus
atgctgcacctcgagcgcgaggcta

SEQ ID NO: 659936 - DNA, 25 bp, Rattus norvegicus
gactgttcatacatccaggccgctg

SEQ ID NO: 659937 - DNA, 25 bp, Rattus norvegicus
tcctgcagagccatagggactgttc

SEQ ID NO: 659938 - DNA, 25 bp, Rattus norvegicus
aaagcacgtagcaccggagcgggct

SEQ ID NO: 659939 - DNA, 25 bp, Rattus norvegicus
gctgccaagcgcttacccgagtcgg

SEQ ID NO: 659940 - DNA, 25 bp, Rattus norvegicus
gccagcagcaagagtcccagcagca

SEQ ID NO: 659941 - DNA, 25 bp, Rattus norvegicus
ggaaagcacgcgcagtcctcgcgtc

SEQ ID NO: 659942 - DNA, 25 bp, Rattus norvegicus
cgagatcctgcgacgacgccgagct

SEQ ID NO: 659943 - DNA, 25 bp, Rattus norvegicus
gcttctctggctgccgatcgcaggg

SEQ ID NO: 659944 - DNA, 25 bp, Rattus norvegicus
cttaacttcatagaggcccgcgctc

SEQ ID NO: 659945 - DNA, 25 bp, Rattus norvegicus
gacccggagccaagcgcttcagcag

SEQ ID NO: 659946 - DNA, 25 bp, Rattus norvegicus
tgccatcttgtcctggcggctgaga

SEQ ID NO: 659947 - DNA, 25 bp, Rattus norvegicus
cggctgagaggaaacggcgaaacac

SEQ ID NO: 659948 - DNA, 25 bp, Rattus norvegicus
gcacgttggtgttcgctcccatcaa

SEQ ID NO: 659949 - DNA, 25 bp, Rattus norvegicus
acgaggtctccgtagtgacggccta

SEQ ID NO: 659950 - DNA, 25 bp, Rattus norvegicus
ggcctagagccaccgagctgaaaga

SEQ ID NO: 659951 - DNA, 25 bp, Rattus norvegicus
caaaacttcggttgctgggaagagc

SEQ ID NO: 659952 - DNA, 25 bp, Rattus norvegicus
ggaagagccgttgcgcaaccttggc

SEQ ID NO: 659953 - DNA, 25 bp, Rattus norvegicus
caaccttggcttgtgggaaggcccg

SEQ ID NO: 659954 - DNA, 25 bp, Rattus norvegicus
ccatcaatgaaaggaacgaggtctc

SEQ ID NO: 659955 - DNA, 25 bp, Rattus norvegicus
aagggccctggggatctagtgaatc

SEQ ID NO: 659956 - DNA, 25 bp, Rattus norvegicus
gaggtctcccagattttgacttttc

SEQ ID NO: 659957 - DNA, 25 bp, Rattus norvegicus
tggcgacttctctctctggcctgtg

SEQ ID NO: 659958 - DNA, 25 bp, Rattus norvegicus
aggccaatcggctggatctttccgg

SEQ ID NO: 659959 - DNA, 25 bp, Rattus norvegicus
gtggcgttcacacgaagtatttgac

SEQ ID NO: 659960 - DNA, 25 bp, Rattus norvegicus
actccagccctgttcgcgtgaggaa

SEQ ID NO: 659961 - DNA, 25 bp, Rattus norvegicus
tcgttgcactttcttcggtcgggac

SEQ ID NO: 659962 - DNA, 25 bp, Rattus norvegicus
tgaggccatgtcaggagacgcagcc

SEQ ID NO: 659963 - DNA, 25 bp, Rattus norvegicus
ggcccgtgtgtacgttgtaatcctc

SEQ ID NO: 659964 - DNA, 25 bp, Rattus norvegicus
ccggaagtgaatacggaagcgactc

SEQ ID NO: 659965 - DNA, 25 bp, Rattus norvegicus
ctgcgcttgtgcacctccaataatc

SEQ ID NO: 659966 - DNA, 25 bp, Rattus norvegicus
cgtgacgttagctcacgcgctgagc

SEQ ID NO: 659967 - DNA, 25 bp, Rattus norvegicus
ttccggccgtcctcagaaatctgga

SEQ ID NO: 659968 - DNA, 25 bp, Rattus norvegicus
agctgagacgttgcttcgccctgtt

SEQ ID NO: 659969 - DNA, 25 bp, Rattus norvegicus
ccaggagaggcccagaaaccggaga

SEQ ID NO: 659970 - DNA, 25 bp, Rattus norvegicus
tgacccgtggctcgaagtcgctcac

SEQ ID NO: 659971 - DNA, 25 bp, Rattus norvegicus
ggaaccgcgcccagatttcgttgta

SEQ ID NO: 659972 - DNA, 25 bp, Rattus norvegicus
taaacagcagctttggtcggcgagg

SEQ ID NO: 659973 - DNA, 25 bp, Rattus norvegicus
aggcgccatgttgtcattgggaaaa

SEQ ID NO: 659974 - DNA, 25 bp, Rattus norvegicus
cgaagtcgctcacgccacacaggga

SEQ ID NO: 659975 - DNA, 25 bp, Rattus norvegicus
tcattgggaaaagcggagacgcgcc

SEQ ID NO: 659976 - DNA, 25 bp, Rattus norvegicus
tgtttttgtgtggaaaggctgacgc

SEQ ID NO: 659977 - DNA, 25 bp, Rattus norvegicus
ggctgagcctcatcatgtttttgtg

SEQ ID NO: 659978 - DNA, 25 bp, Rattus norvegicus
gcgctcccgctgtcacgaaggggct

SEQ ID NO: 659979 - DNA, 25 bp, Rattus norvegicus
caagctcccatacggacaggcgggc

SEQ ID NO: 659980 - DNA, 25 bp, Rattus norvegicus
cggcctggagagtgagcctcaccca

SEQ ID NO: 659981 - DNA, 25 bp, Rattus norvegicus
cccagatttcgttgtaaacagcagc

SEQ ID NO: 659982 - DNA, 25 bp, Rattus norvegicus
acgccacacagggaggcgccatgtt

SEQ ID NO: 659983 - DNA, 25 bp, Rattus norvegicus
ctcccgaactgtggccatgacagca

SEQ ID NO: 659984 - DNA, 25 bp, Rattus norvegicus
ccacccatgaggagaaagcggatcc

SEQ ID NO: 659985 - DNA, 25 bp, Rattus norvegicus
aaagcggatcctcgcggccgctcag

SEQ ID NO: 659986 - DNA, 25 bp, Rattus norvegicus
cagagctgacaggtccagcgccgct

SEQ ID NO: 659987 - DNA, 25 bp, Rattus norvegicus
tgccttctcccgaactgtggccatg

SEQ ID NO: 659988 - DNA, 25 bp, Rattus norvegicus
tggccatgacagcagcgggctagac

SEQ ID NO: 659989 - DNA, 25 bp, Rattus norvegicus
acagcagcgggctagacccggtcct

SEQ ID NO: 659990 - DNA, 25 bp, Rattus norvegicus
tagcgatcacgtgttacccaggccg

SEQ ID NO: 659991 - DNA, 25 bp, Rattus norvegicus
gcaggcgctgcccaggtaaaaagta

SEQ ID NO: 659992 - DNA, 25 bp, Rattus norvegicus
acttggccggcggtggcctttccag

SEQ ID NO: 659993 - DNA, 25 bp, Rattus norvegicus
ccgctgcccacccatgaggagaaag

SEQ ID NO: 659994 - DNA, 25 bp, Rattus norvegicus
gtggcctttccagtactcgtcagta

SEQ ID NO: 659995 - DNA, 25 bp, Rattus norvegicus
gctgcccaggtaaaaagtacttggc

SEQ ID NO: 659996 - DNA, 25 bp, Rattus norvegicus
tccagtactcgtcagtactagcccg

SEQ ID NO: 659997 - DNA, 25 bp, Rattus norvegicus
ttaccatgtggcagtccagcaccga

SEQ ID NO: 659998 - DNA, 25 bp, Rattus norvegicus
cgcggagcttaaactttaccatgtg

SEQ ID NO: 659999 - DNA, 25 bp, Rattus norvegicus
agtccagcaccgagaggtgactgca

SEQ ID NO: 660000 - DNA, 25 bp, Rattus norvegicus
caggcgtgaatcctgcaccatgcgc

SEQ ID NO: 660001 - DNA, 25 bp, Rattus norvegicus
atcaccggccaggagttgtccaacg

SEQ ID NO: 660002 - DNA, 25 bp, Rattus norvegicus
ggagttgtccaacgcctctcccaag

SEQ ID NO: 660003 - DNA, 25 bp, Rattus norvegicus
tctcccaagagcgaagaagggcgcc

SEQ ID NO: 660004 - DNA, 25 bp, Rattus norvegicus
gcctccgctcggacttcaggatagc

SEQ ID NO: 660005 - DNA, 25 bp, Rattus norvegicus
cccatgttgttggatttcccaggat

SEQ ID NO: 660006 - DNA, 25 bp, Rattus norvegicus
tggatttcccaggatgcatctcccg

SEQ ID NO: 660007 - DNA, 25 bp, Rattus norvegicus
ccctagcggtgacgagagggcctac

SEQ ID NO: 660008 - DNA, 25 bp, Rattus norvegicus
acgagagggcctacgcgcccgagca

SEQ ID NO: 660009 - DNA, 25 bp, Rattus norvegicus
gaagaagggcgcctcgaaggctccc

SEQ ID NO: 660010 - DNA, 25 bp, Rattus norvegicus
cccagataccgaggtcagcgcggag

SEQ ID NO: 660011 - DNA, 25 bp, Rattus norvegicus
ctctcggagacagtcggagcctagc

SEQ ID NO: 660012 - DNA, 25 bp, Rattus norvegicus
agctgttacccggaatctgcggagg

SEQ ID NO: 660013 - DNA, 25 bp, Rattus norvegicus
tctgcggaggagagatccggacact

SEQ ID NO: 660014 - DNA, 25 bp, Rattus norvegicus
gagcgcctgggaacaaaagctgtta

SEQ ID NO: 660015 - DNA, 25 bp, Rattus norvegicus
acactggcccaggtagacgcaactc

SEQ ID NO: 660016 - DNA, 25 bp, Rattus norvegicus
tagacgcaactctcgccagcgctga

SEQ ID NO: 660017 - DNA, 25 bp, Rattus norvegicus
acaggcagctaggtgctggaatgcc

SEQ ID NO: 660018 - DNA, 25 bp, Rattus norvegicus
ggaatgccaccgttgagacaccgtc

SEQ ID NO: 660019 - DNA, 25 bp, Rattus norvegicus
ctgggcgggagtctaattatctgct

SEQ ID NO: 660020 - DNA, 25 bp, Rattus norvegicus
ctgtgtcgcgtacgcgtctggctct

SEQ ID NO: 660021 - DNA, 25 bp, Rattus norvegicus
agcctagccctttcaggctccaagg

SEQ ID NO: 660022 - DNA, 25 bp, Rattus norvegicus
aggctccaaggcgacactggcgcgc

SEQ ID NO: 660023 - DNA, 25 bp, Rattus norvegicus
tttatctatcggatccaaggcgccc

SEQ ID NO: 660024 - DNA, 25 bp, Rattus norvegicus
ccaaggtggtttggtccctgtgtcg

SEQ ID NO: 660025 - DNA, 25 bp, Rattus norvegicus
tatcgggcaatcagcgggctaattc

SEQ ID NO: 660026 - DNA, 25 bp, Rattus norvegicus
gcgcgcgcacacaaatacacggatg

SEQ ID NO: 660027 - DNA, 25 bp, Rattus norvegicus
atacacggatgccaggtgacctgcc

SEQ ID NO: 660028 - DNA, 25 bp, Rattus norvegicus
cacgcccggtctcggtttgatggag

SEQ ID NO: 660029 - DNA, 25 bp, Rattus norvegicus
tcggtttgatggagacgccaaaagc

SEQ ID NO: 660030 - DNA, 25 bp, Rattus norvegicus
aagcaaaatatctcgcctgcggggc

SEQ ID NO: 660031 - DNA, 25 bp, Rattus norvegicus
ccaggcgaacacaaaggagaggcta

SEQ ID NO: 660032 - DNA, 25 bp, Rattus norvegicus
taattcgtgtcagggccggtctcct

SEQ ID NO: 660033 - DNA, 25 bp, Rattus norvegicus
cccagccgctgataaaattgaagtg

SEQ ID NO: 660034 - DNA, 25 bp, Rattus norvegicus
ttagccagcggccatctcctatgct

SEQ ID NO: 660035 - DNA, 25 bp, Rattus norvegicus
atctcctatgctgtcccggtcctga

SEQ ID NO: 660036 - DNA, 25 bp, Rattus norvegicus
ggtcctgacgaccatttagccagca

SEQ ID NO: 660037 - DNA, 25 bp, Rattus norvegicus
tttagccagcatccgtagtgggacg

SEQ ID NO: 660038 - DNA, 25 bp, Rattus norvegicus
ccaaggctgcgaggccaggcgaaca

SEQ ID NO: 660039 - DNA, 25 bp, Rattus norvegicus
tgcgactccggataagtcccgacgc

SEQ ID NO: 660040 - DNA, 25 bp, Rattus norvegicus
aggagcggtaccacacggtgttacg

SEQ ID NO: 660041 - DNA, 25 bp, Rattus norvegicus
acgctcatggtgaaggcctggctgc

SEQ ID NO: 660042 - DNA, 25 bp, Rattus norvegicus
acctggtcttcctcgctgatatcga

SEQ ID NO: 660043 - DNA, 25 bp, Rattus norvegicus
ggtcccgcaacgtgcacctggtctt

SEQ ID NO: 660044 - DNA, 25 bp, Rattus norvegicus
acctcatgggctcggtcccgggcat

SEQ ID NO: 660045 - DNA, 25 bp, Rattus norvegicus
tgttacgcacaaccgcttccgggtc

SEQ ID NO: 660046 - DNA, 25 bp, Rattus norvegicus
cacgcgccgagacccaggttaggag

SEQ ID NO: 660047 - DNA, 25 bp, Rattus norvegicus
ctgcggaagacgctccgctccagaa

SEQ ID NO: 660048 - DNA, 25 bp, Rattus norvegicus
gggtcgacatctgcgactccggata

SEQ ID NO: 660049 - DNA, 25 bp, Rattus norvegicus
cgcggaaagttctgggtcgacatct

SEQ ID NO: 660050 - DNA, 25 bp, Rattus norvegicus
gcgaacttcgcagacaccgttccgg

SEQ ID NO: 660051 - DNA, 25 bp, Rattus norvegicus
ggagagcgcgctcccacctcatggg

SEQ ID NO: 660052 - DNA, 25 bp, Rattus norvegicus
ctgatatcgatgaaggccgggacgc

SEQ ID NO: 660053 - DNA, 25 bp, Rattus norvegicus
tggcacccagagaacagagacggtt

SEQ ID NO: 660054 - DNA, 25 bp, Rattus norvegicus
tggtgcggtagagctcaactttcct

SEQ ID NO: 660055 - DNA, 25 bp, Rattus norvegicus
tcttctccaagtcagtgcgcgtgcg

SEQ ID NO: 660056 - DNA, 25 bp, Rattus norvegicus
ctgaggggtgttcttctccaagtca

SEQ ID NO: 660057 - DNA, 25 bp, Rattus norvegicus
gcttgacctattctgcgcaggcgca

SEQ ID NO: 660058 - DNA, 25 bp, Rattus norvegicus
cggtctcagccgaaggcttgaccta

SEQ ID NO: 660059 - DNA, 25 bp, Rattus norvegicus
gccgtcaatgacgtcagggtccgcg

SEQ ID NO: 660060 - DNA, 25 bp, Rattus norvegicus
tcaacattatccgagcacgcgcgct

SEQ ID NO: 660061 - DNA, 25 bp, Rattus norvegicus
actccagagtaggaggtccggctct

SEQ ID NO: 660062 - DNA, 25 bp, Rattus norvegicus
ggcccgcgcgaaacatccaggaatt

SEQ ID NO: 660063 - DNA, 25 bp, Rattus norvegicus
caacacggtgaagcctcgcagcatc

SEQ ID NO: 660064 - DNA, 25 bp, Rattus norvegicus
acatgccgccgtagatgggtcgctt

SEQ ID NO: 660065 - DNA, 25 bp, Rattus norvegicus
ccgctaacccggcatgtggagacac

SEQ ID NO: 660066 - DNA, 25 bp, Rattus norvegicus
gacggttgcagatgaagcgatctcg

SEQ ID NO: 660067 - DNA, 25 bp, Rattus norvegicus
tctaagatgagaagattaaaatttc

SEQ ID NO: 660068 - DNA, 25 bp, Rattus norvegicus
aggaaacccagaagtcaaaagagag

SEQ ID NO: 660069 - DNA, 25 bp, Rattus norvegicus
gccaggaaacccagaagtcaaaaga

SEQ ID NO: 660070 - DNA, 25 bp, Rattus norvegicus
aataagtcgtggtcgtcgtcgtctt

SEQ ID NO: 660071 - DNA, 25 bp, Rattus norvegicus
agaataagtcgtggtcgtcgtcgtc

SEQ ID NO: 660072 - DNA, 25 bp, Rattus norvegicus
aggtgtagaataagtcgtggtcgtc

SEQ ID NO: 660073 - DNA, 25 bp, Rattus norvegicus
ttctctcttttacaggtgtagaata

SEQ ID NO: 660074 - DNA, 25 bp, Rattus norvegicus
cactgaattttctaagatgagaaga

SEQ ID NO: 660075 - DNA, 25 bp, Rattus norvegicus
tctaggttaaaacacaaatacactg

SEQ ID NO: 660076 - DNA, 25 bp, Rattus norvegicus
ctacaaaggatattaccttttctag

SEQ ID NO: 660077 - DNA, 25 bp, Rattus norvegicus
ccctgtctacaaaggatattacctt

SEQ ID NO: 660078 - DNA, 25 bp, Rattus norvegicus
gatgaaaccctgtctacaaaggata

SEQ ID NO: 660079 - DNA, 25 bp, Rattus norvegicus
ggtgagatgaaaccctgtctacaaa

SEQ ID NO: 660080 - DNA, 25 bp, Rattus norvegicus
tacaggtgtagaataagtcgtggtc

SEQ ID NO: 660081 - DNA, 25 bp, Rattus norvegicus
cagccctgggcagattgctttctta

SEQ ID NO: 660082 - DNA, 25 bp, Rattus norvegicus
agccgccaggctgtgctcagccaga

SEQ ID NO: 660083 - DNA, 25 bp, Rattus norvegicus
ttcaactgtcaacagcctcggggtg

SEQ ID NO: 660084 - DNA, 25 bp, Rattus norvegicus
tcggaaggcttaatcgtgtttattc

SEQ ID NO: 660085 - DNA, 25 bp, Rattus norvegicus
gctggcggcttcagccactgacaaa

SEQ ID NO: 660086 - DNA, 25 bp, Rattus norvegicus
ctaaggcagcggctaacccagtgac

SEQ ID NO: 660087 - DNA, 25 bp, Rattus norvegicus
gctttcttagaaacgctgggagaga

SEQ ID NO: 660088 - DNA, 25 bp, Rattus norvegicus
tcagccagatgcaattgacagccgc

SEQ ID NO: 660089 - DNA, 25 bp, Rattus norvegicus
tgacagccgcgggatgaaaagaccg

SEQ ID NO: 660090 - DNA, 25 bp, Rattus norvegicus
aagaccgggttgagatcttcgctcc

SEQ ID NO: 660091 - DNA, 25 bp, Rattus norvegicus
cccttccgtctagatgcgatgatgt

SEQ ID NO: 660092 - DNA, 25 bp, Rattus norvegicus
tgcgatgatgttttcacctggaatg

SEQ ID NO: 660093 - DNA, 25 bp, Rattus norvegicus
acctggaatgattatgcgccttcta

SEQ ID NO: 660094 - DNA, 25 bp, Rattus norvegicus
tagtccggctcttgaggctcgtgac

SEQ ID NO: 660095 - DNA, 25 bp, Rattus norvegicus
ccgattccgaatccgggtgcaagcc

SEQ ID NO: 660096 - DNA, 25 bp, Rattus norvegicus
tcttcgtgttcagccaacatccttg

SEQ ID NO: 660097 - DNA, 25 bp, Rattus norvegicus
tgagcgcctgacagtcccaggctgc

SEQ ID NO: 660098 - DNA, 25 bp, Rattus norvegicus
agcttggagcccgattccgaatccg

SEQ ID NO: 660099 - DNA, 25 bp, Rattus norvegicus
attgggaagcttggagcccgattcc

SEQ ID NO: 660100 - DNA, 25 bp, Rattus norvegicus
cccgcaggtttaattgggaagcttg

SEQ ID NO: 660101 - DNA, 25 bp, Rattus norvegicus
acatccttggctgttgtttcccgca

SEQ ID NO: 660102 - DNA, 25 bp, Rattus norvegicus
acgctaagtttcttcgtgttcagcc

SEQ ID NO: 660103 - DNA, 25 bp, Rattus norvegicus
cgcactaagaccattgaaacgctaa

SEQ ID NO: 660104 - DNA, 25 bp, Rattus norvegicus
gcagcaagtggagaacgcactaaga

SEQ ID NO: 660105 - DNA, 25 bp, Rattus norvegicus
gttaaaaccgctgtgcagcaagtgg

SEQ ID NO: 660106 - DNA, 25 bp, Rattus norvegicus
cgaatccgtgtgagttaaaaccgct

SEQ ID NO: 660107 - DNA, 25 bp, Rattus norvegicus
acgattctggattcacgaatccgtg

SEQ ID NO: 660108 - DNA, 25 bp, Rattus norvegicus
tggctgttgtttcccgcaggtttaa

SEQ ID NO: 660109 - DNA, 25 bp, Rattus norvegicus
gatcctggacttcctcctgtcgcag

SEQ ID NO: 660110 - DNA, 25 bp, Rattus norvegicus
gcggtagtagctccgcgacttggcc

SEQ ID NO: 660111 - DNA, 25 bp, Rattus norvegicus
aaggtaaggattccgcgcagcacga

SEQ ID NO: 660112 - DNA, 25 bp, Rattus norvegicus
cctccatccgcaaccaaggtaagga

SEQ ID NO: 660113 - DNA, 25 bp, Rattus norvegicus
cgtcatccggccaggccaggatgtt

SEQ ID NO: 660114 - DNA, 25 bp, Rattus norvegicus
ttctccggccagttcaccggtacag

SEQ ID NO: 660115 - DNA, 25 bp, Rattus norvegicus
agccggcttccacgtgtgtcccgga

SEQ ID NO: 660116 - DNA, 25 bp, Rattus norvegicus
tctagcgtcgagagtccgcaggatc

SEQ ID NO: 660117 - DNA, 25 bp, Rattus norvegicus
agcggagagccgtccgcatccgaac

SEQ ID NO: 660118 - DNA, 25 bp, Rattus norvegicus
acgtgcgggacctgaacgcgctgct

SEQ ID NO: 660119 - DNA, 25 bp, Rattus norvegicus
cttcatcaaacaggagcccagctgg

SEQ ID NO: 660120 - DNA, 25 bp, Rattus norvegicus
ccgagccgcacgaggagcagtgcct

SEQ ID NO: 660121 - DNA, 25 bp, Rattus norvegicus
agcagtgcctgagcgccttcacctt

SEQ ID NO: 660122 - DNA, 25 bp, Rattus norvegicus
gcacctgggccaagtctagcgtcga

SEQ ID NO: 660123 - DNA, 25 bp, Rattus norvegicus
ccgacggtaagcgttgcggcccctg

SEQ ID NO: 660124 - DNA, 25 bp, Rattus norvegicus
gtttggcttggtggcttcccgtctg

SEQ ID NO: 660125 - DNA, 25 bp, Rattus norvegicus
catgccgcgtgacccgcccgggttg

SEQ ID NO: 660126 - DNA, 25 bp, Rattus norvegicus
cacgctcccgggacgcatgccgcgt

SEQ ID NO: 660127 - DNA, 25 bp, Rattus norvegicus
taaggagtcggctcctgccgcgtcc

SEQ ID NO: 660128 - DNA, 25 bp, Rattus norvegicus
accaactaaggagtcggctcctgcc

SEQ ID NO: 660129 - DNA, 25 bp, Rattus norvegicus
atagaccaactaaggagtcggctcc

SEQ ID NO: 660130 - DNA, 25 bp, Rattus norvegicus
tgcacgatagaccaactaaggagtc

SEQ ID NO: 660131 - DNA, 25 bp, Rattus norvegicus
gagtcgggagcaaccggcggccgac

SEQ ID NO: 660132 - DNA, 25 bp, Rattus norvegicus
ggctgcagagccattgcacgataga

SEQ ID NO: 660133 - DNA, 25 bp, Rattus norvegicus
ggcttcccgtctgcacttggtcttc

SEQ ID NO: 660134 - DNA, 25 bp, Rattus norvegicus
tgcacttggtcttccgctccgccag

SEQ ID NO: 660135 - DNA, 25 bp, Rattus norvegicus
gagccattgcacgatagaccaacta

SEQ ID NO: 660136 - DNA, 25 bp, Rattus norvegicus
gcttggtggcttcccgtctgcactt

SEQ ID NO: 660137 - DNA, 25 bp, Rattus norvegicus
ccttgcctaggaaggcctcatgatc

SEQ ID NO: 660138 - DNA, 25 bp, Rattus norvegicus
cgaaggtcttggaatcctccttgcc

SEQ ID NO: 660139 - DNA, 25 bp, Rattus norvegicus
ccgggcttagctgatcgaaggtctt

SEQ ID NO: 660140 - DNA, 25 bp, Rattus norvegicus
accgcgcgccatagtcgcgagcaaa

SEQ ID NO: 660141 - DNA, 25 bp, Rattus norvegicus
cctcatgatcgtactggaagctctg

SEQ ID NO: 660142 - DNA, 25 bp, Rattus norvegicus
ttctcgcctcccgtgggaagctatc

SEQ ID NO: 660143 - DNA, 25 bp, Rattus norvegicus
tctccttgctctcgtccgggcttag

SEQ ID NO: 660144 - DNA, 25 bp, Rattus norvegicus
cactttcgctttgcgctcgtggtcc

SEQ ID NO: 660145 - DNA, 25 bp, Rattus norvegicus
ctggcgcgatttcactttcgctttg

SEQ ID NO: 660146 - DNA, 25 bp, Rattus norvegicus
gccctaagaccaactggcgcgattt

SEQ ID NO: 660147 - DNA, 25 bp, Rattus norvegicus
ctttgtgcctctgagcctagctctg

SEQ ID NO: 660148 - DNA, 25 bp, Rattus norvegicus
tgagtaccggttagcaactttgtgc

SEQ ID NO: 660149 - DNA, 25 bp, Rattus norvegicus
cctccacgcggggtctgagtaccgg

SEQ ID NO: 660150 - DNA, 25 bp, Rattus norvegicus
tcgcccagctctgaatcgggccgaa

SEQ ID NO: 660151 - DNA, 25 bp, Rattus norvegicus
cagcgctggcgtggatattaaggaa

SEQ ID NO: 660152 - DNA, 25 bp, Rattus norvegicus
cctcgcgtagaacccggctgtcaga

SEQ ID NO: 660153 - DNA, 25 bp, Rattus norvegicus
atcgttgacatttaaactctggggc

SEQ ID NO: 660154 - DNA, 25 bp, Rattus norvegicus
accctcttttcttatcgttgacatt

SEQ ID NO: 660155 - DNA, 25 bp, Rattus norvegicus
ttaaggaaagttagcgcctgccgga

SEQ ID NO: 660156 - DNA, 25 bp, Rattus norvegicus
ctggcgtggatattaaggaaagtta

SEQ ID NO: 660157 - DNA, 25 bp, Rattus norvegicus
cccggcaaccaatgagggcagcgct

SEQ ID NO: 660158 - DNA, 25 bp, Rattus norvegicus
gaacccaactctggccgccgtgacg

SEQ ID NO: 660159 - DNA, 25 bp, Rattus norvegicus
tgcggagctgaacccaactctggcc

SEQ ID NO: 660160 - DNA, 25 bp, Rattus norvegicus
atctgcggagctgaacccaactctg

SEQ ID NO: 660161 - DNA, 25 bp, Rattus norvegicus
catttaaactctggggcaggtcctc

SEQ ID NO: 660162 - DNA, 25 bp, Rattus norvegicus
gcaggtcctcgcgtagaacccggct

SEQ ID NO: 660163 - DNA, 25 bp, Rattus norvegicus
aaactctggggcaggtcctcgcgta

SEQ ID NO: 660164 - DNA, 25 bp, Rattus norvegicus
ccggagagctaatctgcggagctga

SEQ ID NO: 660165 - DNA, 25 bp, Rattus norvegicus
tagcgattctcactgagctagaatg

SEQ ID NO: 660166 - DNA, 25 bp, Rattus norvegicus
gagcttcccttcggaagacctaata

SEQ ID NO: 660167 - DNA, 25 bp, Rattus norvegicus
ccttcggaagacctaataattagcg

SEQ ID NO: 660168 - DNA, 25 bp, Rattus norvegicus
cggaagacctaataattagcgattc

SEQ ID NO: 660169 - DNA, 25 bp, Rattus norvegicus
acctaataattagcgattctcactg

SEQ ID NO: 660170 - DNA, 25 bp, Rattus norvegicus
aattagcgattctcactgagctaga

SEQ ID NO: 660171 - DNA, 25 bp, Rattus norvegicus
tctcactgagctagaatgcgggctc

SEQ ID NO: 660172 - DNA, 25 bp, Rattus norvegicus
tcactgagctagaatgcgggctcgg

SEQ ID NO: 660173 - DNA, 25 bp, Rattus norvegicus
cgggttactaccagcgcggagttct

SEQ ID NO: 660174 - DNA, 25 bp, Rattus norvegicus
gggttactaccagcgcggagttctc

SEQ ID NO: 660175 - DNA, 25 bp, Rattus norvegicus
actaccagcgcggagttctctgctt

SEQ ID NO: 660176 - DNA, 25 bp, Rattus norvegicus
taccagcgcggagttctctgcttca

SEQ ID NO: 660177 - DNA, 25 bp, Rattus norvegicus
accagcgcggagttctctgcttcag

SEQ ID NO: 660178 - DNA, 25 bp, Rattus norvegicus
taataattagcgattctcactgagc

SEQ ID NO: 660179 - DNA, 25 bp, Rattus norvegicus
agtttcccccgaggttgtgtagatg

SEQ ID NO: 660180 - DNA, 25 bp, Rattus norvegicus
ccttcagagctaggcagcgcgcaaa

SEQ ID NO: 660181 - DNA, 25 bp, Rattus norvegicus
ttcgtggaagcacccagcggaaggt

SEQ ID NO: 660182 - DNA, 25 bp, Rattus norvegicus
cccagcgtgtgatttgagcttccct

SEQ ID NO: 660183 - DNA, 25 bp, Rattus norvegicus
cgcagaattcgtggaagcacccagc

SEQ ID NO: 660184 - DNA, 25 bp, Rattus norvegicus
aagaatgctgcccttcagagctagg

SEQ ID NO: 660185 - DNA, 25 bp, Rattus norvegicus
cgggacgaaagaatgctgcccttca

SEQ ID NO: 660186 - DNA, 25 bp, Rattus norvegicus
cccaagaggagcacgggacgaaaga

SEQ ID NO: 660187 - DNA, 25 bp, Rattus norvegicus
cgaagtcaaagtcttgggcttcgtt

SEQ ID NO: 660188 - DNA, 25 bp, Rattus norvegicus
tatcatcgaagtcaaagtcttgggc

SEQ ID NO: 660189 - DNA, 25 bp, Rattus norvegicus
tgtgtgtcccatatcatcgaagtca

SEQ ID NO: 660190 - DNA, 25 bp, Rattus norvegicus
gtgtagatgtgtgtcccatatcatc

SEQ ID NO: 660191 - DNA, 25 bp, Rattus norvegicus
cacccagcggaaggtcgggcgactt

SEQ ID NO: 660192 - DNA, 25 bp, Rattus norvegicus
cgtgtgatttgagcttcccttcgga

SEQ ID NO: 660193 - DNA, 25 bp, Rattus norvegicus
aggatctcacaccgctgccctgtgg

SEQ ID NO: 660194 - DNA, 25 bp, Rattus norvegicus
tcctgccgtgggatcctggcgtctc

SEQ ID NO: 660195 - DNA, 25 bp, Rattus norvegicus
atccgcttgttcctgcaacgggagg

SEQ ID NO: 660196 - DNA, 25 bp, Rattus norvegicus
tccctgtcgacccagctccgagacc

SEQ ID NO: 660197 - DNA, 25 bp, Rattus norvegicus
tttcggttccttccacatccgcttg

SEQ ID NO: 660198 - DNA, 25 bp, Rattus norvegicus
tctcagagacgtgaagtgtgcagtg

SEQ ID NO: 660199 - DNA, 25 bp, Rattus norvegicus
ctctctttggggtctcagagacgtg

SEQ ID NO: 660200 - DNA, 25 bp, Rattus norvegicus
atcgagactgctcctgccgtgggat

SEQ ID NO: 660201 - DNA, 25 bp, Rattus norvegicus
cgagacccgggtgccattatctttt

SEQ ID NO: 660202 - DNA, 25 bp, Rattus norvegicus
tggcagccatcgagactgctcctgc

SEQ ID NO: 660203 - DNA, 25 bp, Rattus norvegicus
tgccagcgctggcagccatcgagac

SEQ ID NO: 660204 - DNA, 25 bp, Rattus norvegicus
cccaggcgcagtcggccgtagcaag

SEQ ID NO: 660205 - DNA, 25 bp, Rattus norvegicus
cgccgcctagcgctagccaagtagg

SEQ ID NO: 660206 - DNA, 25 bp, Rattus norvegicus
cgctagccaagtaggcctcctgctg

SEQ ID NO: 660207 - DNA, 25 bp, Rattus norvegicus
ggcctcgctgagttctcggcctgga

SEQ ID NO: 660208 - DNA, 25 bp, Rattus norvegicus
gcctaggcatcgttgtgccaccatc

SEQ ID NO: 660209 - DNA, 25 bp, Rattus norvegicus
tcttcaggcctaggcatcgttgtgc

SEQ ID NO: 660210 - DNA, 25 bp, Rattus norvegicus
ccctcttcaggcctaggcatcgttg

SEQ ID NO: 660211 - DNA, 25 bp, Rattus norvegicus
tggaggccctcttcaggcctaggca

SEQ ID NO: 660212 - DNA, 25 bp, Rattus norvegicus
ttctcggcctggaggccctcttcag

SEQ ID NO: 660213 - DNA, 25 bp, Rattus norvegicus
tgagttctcggcctggaggccctct

SEQ ID NO: 660214 - DNA, 25 bp, Rattus norvegicus
gggaaatgggcaggctcgagaggcc

SEQ ID NO: 660215 - DNA, 25 bp, Rattus norvegicus
agaaaaggccaagggtgcgggaatg

SEQ ID NO: 660216 - DNA, 25 bp, Rattus norvegicus
tggcttcgggaagcagaaaagagaa

SEQ ID NO: 660217 - DNA, 25 bp, Rattus norvegicus
tcaggcctaggcatcgttgtgccac

SEQ ID NO: 660218 - DNA, 25 bp, Rattus norvegicus
gcagtgcgtccgctcggctgagcac

SEQ ID NO: 660219 - DNA, 25 bp, Rattus norvegicus
aggcatcgttgtgccaccatcgccg

SEQ ID NO: 660220 - DNA, 25 bp, Rattus norvegicus
cggctgagcacggtggcttcgggaa

SEQ ID NO: 660221 - DNA, 25 bp, Rattus norvegicus
gcatttgcatgttgcggagtgatta

SEQ ID NO: 660222 - DNA, 25 bp, Rattus norvegicus
ctcatttcccgctctggttcaggcg

SEQ ID NO: 660223 - DNA, 25 bp, Rattus norvegicus
atgacagaggtcaggcttcgctaat

SEQ ID NO: 660224 - DNA, 25 bp, Rattus norvegicus
aggatgatgacagaggtcaggcttc

SEQ ID NO: 660225 - DNA, 25 bp, Rattus norvegicus
ggaagtgttttgctggaggatgatg

SEQ ID NO: 660226 - DNA, 25 bp, Rattus norvegicus
gttcaggcgcaggaggaagtgtttt

SEQ ID NO: 660227 - DNA, 25 bp, Rattus norvegicus
ttcccgctctggttcaggcgcagga

SEQ ID NO: 660228 - DNA, 25 bp, Rattus norvegicus
gcgaaccgtggctcggcctcatttc

SEQ ID NO: 660229 - DNA, 25 bp, Rattus norvegicus
aaaagcgaaccgtggctcggcctca

SEQ ID NO: 660230 - DNA, 25 bp, Rattus norvegicus
agtgattagtgggtttgaaaagcga

SEQ ID NO: 660231 - DNA, 25 bp, Rattus norvegicus
agcaatattttgtgtgggagcgagc

SEQ ID NO: 660232 - DNA, 25 bp, Rattus norvegicus
cgctgctttgcataaagcaatattt

SEQ ID NO: 660233 - DNA, 25 bp, Rattus norvegicus
cccggcgctgctttgcataaagcaa

SEQ ID NO: 660234 - DNA, 25 bp, Rattus norvegicus
tttgaaaagcgaaccgtggctcggc

SEQ ID NO: 660235 - DNA, 25 bp, Rattus norvegicus
gggtgttgcgctgctaattctctca

SEQ ID NO: 660236 - DNA, 25 bp, Rattus norvegicus
caggtcttcacgatcaagggtgttg

SEQ ID NO: 660237 - DNA, 25 bp, Rattus norvegicus
ctgtattaggaacccgcagcggtgc

SEQ ID NO: 660238 - DNA, 25 bp, Rattus norvegicus
ccggcagacgggctctgtattagga

SEQ ID NO: 660239 - DNA, 25 bp, Rattus norvegicus
ttccgccgatgcgactgctactgca

SEQ ID NO: 660240 - DNA, 25 bp, Rattus norvegicus
gggcaacctcctgtttccgccgatg

SEQ ID NO: 660241 - DNA, 25 bp, Rattus norvegicus
ttcagtctcttttccttggcccggc

SEQ ID NO: 660242 - DNA, 25 bp, Rattus norvegicus
gcgaagcaatgcaggtggtacacga

SEQ ID NO: 660243 - DNA, 25 bp, Rattus norvegicus
gccgcttgcaaaccacgcaggcgaa

SEQ ID NO: 660244 - DNA, 25 bp, Rattus norvegicus
tgtcttccatgaggtagaactcgtc

SEQ ID NO: 660245 - DNA, 25 bp, Rattus norvegicus
tgaggtcctggctcccaagccaagg

SEQ ID NO: 660246 - DNA, 25 bp, Rattus norvegicus
agagtttccctcctcgcccgtgagg

SEQ ID NO: 660247 - DNA, 25 bp, Rattus norvegicus
cccagcctctagacctgagagtttc

SEQ ID NO: 660248 - DNA, 25 bp, Rattus norvegicus
gccggcctgcgtctttcttcagtct

SEQ ID NO: 660249 - DNA, 25 bp, Rattus norvegicus
gagcccaaactttctacttccagcg

SEQ ID NO: 660250 - DNA, 25 bp, Rattus norvegicus
gagcgctgagctccgatttggaaac

SEQ ID NO: 660251 - DNA, 25 bp, Rattus norvegicus
ctctccgagggagttccgagccaat

SEQ ID NO: 660252 - DNA, 25 bp, Rattus norvegicus
ttcagcgcctccaaaagctcacggt

SEQ ID NO: 660253 - DNA, 25 bp, Rattus norvegicus
tacttccagcgaaagcccgcgtcgg

SEQ ID NO: 660254 - DNA, 25 bp, Rattus norvegicus
tggctctgcaccagcgcaagtgcgg

SEQ ID NO: 660255 - DNA, 25 bp, Rattus norvegicus
tttggaaacaaacgccctagctctc

SEQ ID NO: 660256 - DNA, 25 bp, Rattus norvegicus
cctctccgagagcagctaggctgca

SEQ ID NO: 660257 - DNA, 25 bp, Rattus norvegicus
tgcccgcagcgccaaagggtcatcg

SEQ ID NO: 660258 - DNA, 25 bp, Rattus norvegicus
agctcacggtcagccgaaaaggacg

SEQ ID NO: 660259 - DNA, 25 bp, Rattus norvegicus
aaaggacgaagaggctcctccgtgc

SEQ ID NO: 660260 - DNA, 25 bp, Rattus norvegicus
agccaccggcgatgcttttgtccag

SEQ ID NO: 660261 - DNA, 25 bp, Rattus norvegicus
cgctccggctttgtgcaagatcctc

SEQ ID NO: 660262 - DNA, 25 bp, Rattus norvegicus
caagtgcggctgaacctctccgaga

SEQ ID NO: 660263 - DNA, 25 bp, Rattus norvegicus
gtcacaaagtgacaaggctgccaca

SEQ ID NO: 660264 - DNA, 25 bp, Rattus norvegicus
acgcctgtcacttctcatcgaattg

SEQ ID NO: 660265 - DNA, 25 bp, Rattus norvegicus
gtcacttctcatcgaattgaggccc

SEQ ID NO: 660266 - DNA, 25 bp, Rattus norvegicus
aaggggagacgagtgcagttcattc

SEQ ID NO: 660267 - DNA, 25 bp, Rattus norvegicus
gtgcagttcattctcgtctgagtga

SEQ ID NO: 660268 - DNA, 25 bp, Rattus norvegicus
ctcgtctgagtgatctacaaatagg

SEQ ID NO: 660269 - DNA, 25 bp, Rattus norvegicus
tgatctacaaatagggacggaaagg

SEQ ID NO: 660270 - DNA, 25 bp, Rattus norvegicus
acggtcccgtttgtcgtgacgatgc

SEQ ID NO: 660271 - DNA, 25 bp, Rattus norvegicus
tgacgatgcaatttcccggagcgga

SEQ ID NO: 660272 - DNA, 25 bp, Rattus norvegicus
ccggagcggagcactgtcacaaagt

SEQ ID NO: 660273 - DNA, 25 bp, Rattus norvegicus
agtgacaaggctgccacaagcgccc

SEQ ID NO: 660274 - DNA, 25 bp, Rattus norvegicus
cgactgatcttttcaattagccttc

SEQ ID NO: 660275 - DNA, 25 bp, Rattus norvegicus
ttagccttccatgcatgatccggag

SEQ ID NO: 660276 - DNA, 25 bp, Rattus norvegicus
tccatgcatgatccggagcgacttc

SEQ ID NO: 660277 - DNA, 25 bp, Rattus norvegicus
tagcttccagaggagaggcaaggct

SEQ ID NO: 660278 - DNA, 25 bp, Rattus norvegicus
ccgcacctctagcttccagaggaga

SEQ ID NO: 660279 - DNA, 25 bp, Rattus norvegicus
agagccgcacctctagcttccagag

SEQ ID NO: 660280 - DNA, 25 bp, Rattus norvegicus
ccatcgcaggcacgcgaccgtcggt

SEQ ID NO: 660281 - DNA, 25 bp, Rattus norvegicus
ccagagttccgattgggtcatttta

SEQ ID NO: 660282 - DNA, 25 bp, Rattus norvegicus
ctccgaatgtgtggcttccgaggcg

SEQ ID NO: 660283 - DNA, 25 bp, Rattus norvegicus
cagctccgaatgtgtggcttccgag

SEQ ID NO: 660284 - DNA, 25 bp, Rattus norvegicus
ccctcagctccgaatgtgtggcttc

SEQ ID NO: 660285 - DNA, 25 bp, Rattus norvegicus
ggtaccctcagctccgaatgtgtgg

SEQ ID NO: 660286 - DNA, 25 bp, Rattus norvegicus
gcgggtaccctcagctccgaatgtg

SEQ ID NO: 660287 - DNA, 25 bp, Rattus norvegicus
gcggcagccacctgcggcgcgggta

SEQ ID NO: 660288 - DNA, 25 bp, Rattus norvegicus
tgggtcattttaggggcttcaagat

SEQ ID NO: 660289 - DNA, 25 bp, Rattus norvegicus
cgattgggtcattttaggggcttca

SEQ ID NO: 660290 - DNA, 25 bp, Rattus norvegicus
gctgctgtccatcgcaggcacgcga

SEQ ID NO: 660291 - DNA, 25 bp, Rattus norvegicus
gttgtctgcgaaagcccgcggctaa

SEQ ID NO: 660292 - DNA, 25 bp, Rattus norvegicus
cccgcaagcgagagcgaatttcttt

SEQ ID NO: 660293 - DNA, 25 bp, Rattus norvegicus
agtggcagtccctgtcactgcaccg

SEQ ID NO: 660294 - DNA, 25 bp, Rattus norvegicus
gtcgaaggttctggcccgcccgagc

SEQ ID NO: 660295 - DNA, 25 bp, Rattus norvegicus
tgcacacacaaagcggagcccgggt

SEQ ID NO: 660296 - DNA, 25 bp, Rattus norvegicus
cccgcgaccctgaggttggcggact

SEQ ID NO: 660297 - DNA, 25 bp, Rattus norvegicus
tggcggactgaacactagaggaccc

SEQ ID NO: 660298 - DNA, 25 bp, Rattus norvegicus
gacccggggagagcagatttgtttc

SEQ ID NO: 660299 - DNA, 25 bp, Rattus norvegicus
agcgaatttctttgcgtagctgccc

SEQ ID NO: 660300 - DNA, 25 bp, Rattus norvegicus
ttctttgcgtagctgcccttcttcc

SEQ ID NO: 660301 - DNA, 25 bp, Rattus norvegicus
tctccgggtttctcaggaaggtggc

SEQ ID NO: 660302 - DNA, 25 bp, Rattus norvegicus
agtcggagatctgtttactagaaag

SEQ ID NO: 660303 - DNA, 25 bp, Rattus norvegicus
atctgtttactagaaagtcccaggg

SEQ ID NO: 660304 - DNA, 25 bp, Rattus norvegicus
ctccttctccgggtttctcaggaag

SEQ ID NO: 660305 - DNA, 25 bp, Rattus norvegicus
tgctgccaacatcgccggcagtggc

SEQ ID NO: 660306 - DNA, 25 bp, Rattus norvegicus
gtgcccatcgggtactcagcgccta

SEQ ID NO: 660307 - DNA, 25 bp, Rattus norvegicus
cttcggaggcttctgtcccagacca

SEQ ID NO: 660308 - DNA, 25 bp, Rattus norvegicus
agtgtccttagtgctgccaacatcg

SEQ ID NO: 660309 - DNA, 25 bp, Rattus norvegicus
ctgcctgtatgcttggagatgccag

SEQ ID NO: 660310 - DNA, 25 bp, Rattus norvegicus
caccgaggatggcaacgacgtcaga

SEQ ID NO: 660311 - DNA, 25 bp, Rattus norvegicus
atgccagggcgcttcggaggcttct

SEQ ID NO: 660312 - DNA, 25 bp, Rattus norvegicus
ggagtgagtctagtgtccttagtgc

SEQ ID NO: 660313 - DNA, 25 bp, Rattus norvegicus
ttacggcggtcttcagtcggtgccc

SEQ ID NO: 660314 - DNA, 25 bp, Rattus norvegicus
caacgacgtcagagcccgtgtttta

SEQ ID NO: 660315 - DNA, 25 bp, Rattus norvegicus
ttaagatgcggcaccgaggatggca

SEQ ID NO: 660316 - DNA, 25 bp, Rattus norvegicus
cagaccaggggttaagatgcggcac

SEQ ID NO: 660317 - DNA, 25 bp, Rattus norvegicus
ggcttctgtcccagaccaggggtta

SEQ ID NO: 660318 - DNA, 25 bp, Rattus norvegicus
tcagagcccgtgttttacggcggtc

SEQ ID NO: 660319 - DNA, 25 bp, Rattus norvegicus
gagaccgcgtgcaccataaagagga

SEQ ID NO: 660320 - DNA, 25 bp, Rattus norvegicus
gcggcctcccacattcaagtgtcat

SEQ ID NO: 660321 - DNA, 25 bp, Rattus norvegicus
attcaagtgtcatccgcagagtcca

SEQ ID NO: 660322 - DNA, 25 bp, Rattus norvegicus
gcagagtccactcacagccgtgcgg

SEQ ID NO: 660323 - DNA, 25 bp, Rattus norvegicus
ccggtccacctgagctgctacggtt

SEQ ID NO: 660324 - DNA, 25 bp, Rattus norvegicus
gggctccggaagcactgtatctgca

SEQ ID NO: 660325 - DNA, 25 bp, Rattus norvegicus
agctgctacggttctcagtcgggct

SEQ ID NO: 660326 - DNA, 25 bp, Rattus norvegicus
agcactgtatctgcacaggccaagc

SEQ ID NO: 660327 - DNA, 25 bp, Rattus norvegicus
ccataaagaggagcctggaggtgcc

SEQ ID NO: 660328 - DNA, 25 bp, Rattus norvegicus
ggccaagctcggtactccacactat

SEQ ID NO: 660329 - DNA, 25 bp, Rattus norvegicus
cccgcgtagacaccgagaggacggc

SEQ ID NO: 660330 - DNA, 25 bp, Rattus norvegicus
tagacaccgagaggacggcgaatgc

SEQ ID NO: 660331 - DNA, 25 bp, Rattus norvegicus
aatgcggctagagagaccgcgtgca

SEQ ID NO: 660332 - DNA, 25 bp, Rattus norvegicus
tgcacaggccaagctcggtactcca

SEQ ID NO: 660333 - DNA, 25 bp, Rattus norvegicus
taaagtagttttcggcgggagatgc

SEQ ID NO: 660334 - DNA, 25 bp, Rattus norvegicus
cggcgacgcccagaaaagcagcttc

SEQ ID NO: 660335 - DNA, 25 bp, Rattus norvegicus
cgatcggcagccaatgaaatggata

SEQ ID NO: 660336 - DNA, 25 bp, Rattus norvegicus
acgtgctgacgtcagccgatcggca

SEQ ID NO: 660337 - DNA, 25 bp, Rattus norvegicus
ggaaaacgaccgacgtgctgacgtc

SEQ ID NO: 660338 - DNA, 25 bp, Rattus norvegicus
caatgaaatggatagctgaggaagc

SEQ ID NO: 660339 - DNA, 25 bp, Rattus norvegicus
ggatccgacgtcaacggataaagta

SEQ ID NO: 660340 - DNA, 25 bp, Rattus norvegicus
accggagtggaggatccgacgtcaa

SEQ ID NO: 660341 - DNA, 25 bp, Rattus norvegicus
tgtcgcggtcacttctaggtgagtg

SEQ ID NO: 660342 - DNA, 25 bp, Rattus norvegicus
tcagccaagttgtcgcggtcacttc

SEQ ID NO: 660343 - DNA, 25 bp, Rattus norvegicus
gcctggaagccaactcagccaagtt

SEQ ID NO: 660344 - DNA, 25 bp, Rattus norvegicus
tttggagcgcctggaagccaactca

SEQ ID NO: 660345 - DNA, 25 bp, Rattus norvegicus
ctggcttgggtttgaatttgtggct

SEQ ID NO: 660346 - DNA, 25 bp, Rattus norvegicus
tgcctctggcgccaaactgcgagac

SEQ ID NO: 660347 - DNA, 25 bp, Rattus norvegicus
ggcgattgaagcatccgaccgtcca

SEQ ID NO: 660348 - DNA, 25 bp, Rattus norvegicus
tgctggggagaacacgttagcctcc

SEQ ID NO: 660349 - DNA, 25 bp, Rattus norvegicus
gtgcttaggaacttggctccgcctc

SEQ ID NO: 660350 - DNA, 25 bp, Rattus norvegicus
acgacctgacactcgagcctagaca

SEQ ID NO: 660351 - DNA, 25 bp, Rattus norvegicus
accgtccagaggagtagcattgctc

SEQ ID NO: 660352 - DNA, 25 bp, Rattus norvegicus
ctggcgccaggtcatcaagaagcaa

SEQ ID NO: 660353 - DNA, 25 bp, Rattus norvegicus
atggggacacgccaaacagacgttc

SEQ ID NO: 660354 - DNA, 25 bp, Rattus norvegicus
cgcctgggcctcaagacagggatgc

SEQ ID NO: 660355 - DNA, 25 bp, Rattus norvegicus
tggtagccacacaaggcatccagtt

SEQ ID NO: 660356 - DNA, 25 bp, Rattus norvegicus
tgcacacgccctggtgcacctggta

SEQ ID NO: 660357 - DNA, 25 bp, Rattus norvegicus
cctcaaggacgagccacagttgctg

SEQ ID NO: 660358 - DNA, 25 bp, Rattus norvegicus
gatgaccctgtctactccgaggaag

SEQ ID NO: 660359 - DNA, 25 bp, Rattus norvegicus
tgtttctccggctggtgatgaccct

SEQ ID NO: 660360 - DNA, 25 bp, Rattus norvegicus
gcagcgcccggaactctgtaacaga

SEQ ID NO: 660361 - DNA, 25 bp, Rattus norvegicus
cctctgtcgtcatttcctgtgggtc

SEQ ID NO: 660362 - DNA, 25 bp, Rattus norvegicus
gggcactgctcgattcagcgaccta

SEQ ID NO: 660363 - DNA, 25 bp, Rattus norvegicus
gctgttctcgcttaccgtgggcact

SEQ ID NO: 660364 - DNA, 25 bp, Rattus norvegicus
gcgtttgaaagatgccagacccggc

SEQ ID NO: 660365 - DNA, 25 bp, Rattus norvegicus
gggtcgagactacgaaccgctttgc

SEQ ID NO: 660366 - DNA, 25 bp, Rattus norvegicus
caaactcgctcttccggtttctcgg

SEQ ID NO: 660367 - DNA, 25 bp, Rattus norvegicus
tagctctcgcgttagtaccaaactc

SEQ ID NO: 660368 - DNA, 25 bp, Rattus norvegicus
gttaaccgcatccttctagctctcg

SEQ ID NO: 660369 - DNA, 25 bp, Rattus norvegicus
ttaacgctctgcgtagttaaccgca

SEQ ID NO: 660370 - DNA, 25 bp, Rattus norvegicus
cacagatggacgaagggagaccacc

SEQ ID NO: 660371 - DNA, 25 bp, Rattus norvegicus
cagtggggacatcggttctttgcaa

SEQ ID NO: 660372 - DNA, 25 bp, Rattus norvegicus
ggcctggaactaacgacatgacttc

SEQ ID NO: 660373 - DNA, 25 bp, Rattus norvegicus
gtcggtcaagcaaggcctggaacta

SEQ ID NO: 660374 - DNA, 25 bp, Rattus norvegicus
gcctaccggccggagcgaaggcaaa

SEQ ID NO: 660375 - DNA, 25 bp, Rattus norvegicus
ccttcacccaagcactgtgagtgag

SEQ ID NO: 660376 - DNA, 25 bp, Rattus norvegicus
gcgagcgtgcaaccctagaagggaa

SEQ ID NO: 660377 - DNA, 25 bp, Rattus norvegicus
gacaaccagggtgtttgtgagaacc

SEQ ID NO: 660378 - DNA, 25 bp, Rattus norvegicus
catggctggaggctgcgctccgcaa

SEQ ID NO: 660379 - DNA, 25 bp, Rattus norvegicus
ggctgcgctccgcaaccttgaggag

SEQ ID NO: 660380 - DNA, 25 bp, Rattus norvegicus
cgcaaccttgaggagccgtgcggtt

SEQ ID NO: 660381 - DNA, 25 bp, Rattus norvegicus
gcctgagccactaagccgcggggct

SEQ ID NO: 660382 - DNA, 25 bp, Rattus norvegicus
agaaactgcggagcgccgcgtccta

SEQ ID NO: 660383 - DNA, 25 bp, Rattus norvegicus
cggactgctgaaggaagccagcgca

SEQ ID NO: 660384 - DNA, 25 bp, Rattus norvegicus
tgaaggaagccagcgcacgcggaca

SEQ ID NO: 660385 - DNA, 25 bp, Rattus norvegicus
tgctctgcttcttcgccctggggct

SEQ ID NO: 660386 - DNA, 25 bp, Rattus norvegicus
ttgacggccgtaccggagggtctca

SEQ ID NO: 660387 - DNA, 25 bp, Rattus norvegicus
agcgccttcacccaagcactgtgag

SEQ ID NO: 660388 - DNA, 25 bp, Rattus norvegicus
taccggagggtctcagcgccttcac

SEQ ID NO: 660389 - DNA, 25 bp, Rattus norvegicus
gccgtttgaacttggcgggcctgat

SEQ ID NO: 660390 - DNA, 25 bp, Rattus norvegicus
tcctcaagctttgtcgtcgacctca

SEQ ID NO: 660391 - DNA, 25 bp, Rattus norvegicus
acaaggcctagtgctggcgctgatt

SEQ ID NO: 660392 - DNA, 25 bp, Rattus norvegicus
gcgttgaccgagtgcttgttgccgc

SEQ ID NO: 660393 - DNA, 25 bp, Rattus norvegicus
gctgacgctgtcagtccggagcctt

SEQ ID NO: 660394 - DNA, 25 bp, Rattus norvegicus
gtcgtcgacctcatagtggattctc

SEQ ID NO: 660395 - DNA, 25 bp, Rattus norvegicus
gccggccctgctcgggccgtttgaa

SEQ ID NO: 660396 - DNA, 25 bp, Rattus norvegicus
agcgtcgctatgacaacaaggccta

SEQ ID NO: 660397 - DNA, 25 bp, Rattus norvegicus
cccttgcggtgtacaagcgtcgcta

SEQ ID NO: 660398 - DNA, 25 bp, Rattus norvegicus
gccaagctttgcaagccgggacaaa

SEQ ID NO: 660399 - DNA, 25 bp, Rattus norvegicus
cctggaagccaagctttgcaagccg

SEQ ID NO: 660400 - DNA, 25 bp, Rattus norvegicus
cggagccttccagtcctacctggaa

SEQ ID NO: 660401 - DNA, 25 bp, Rattus norvegicus
tgtcagtccggagccttccagtcct

SEQ ID NO: 660402 - DNA, 25 bp, Rattus norvegicus
tcatagtggattctcagggcccagg

SEQ ID NO: 660403 - DNA, 25 bp, Rattus norvegicus
ctccgagctggcgtcggagcgactc

SEQ ID NO: 660404 - DNA, 25 bp, Rattus norvegicus
ccggatctgttcagtgcagcctctc

SEQ ID NO: 660405 - DNA, 25 bp, Rattus norvegicus
cgtcggagcgactcgtgtcgctgct

SEQ ID NO: 660406 - DNA, 25 bp, Rattus norvegicus
aggtcagcccttcgcgccaacagag

SEQ ID NO: 660407 - DNA, 25 bp, Rattus norvegicus
ttcgcgccaacagagccagcaagag

SEQ ID NO: 660408 - DNA, 25 bp, Rattus norvegicus
agagccagcaagaggtctccgcccg

SEQ ID NO: 660409 - DNA, 25 bp, Rattus norvegicus
agcaagaggtctccgcccgcggatt

SEQ ID NO: 660410 - DNA, 25 bp, Rattus norvegicus
cccacgagcttccatggggccgggc

SEQ ID NO: 660411 - DNA, 25 bp, Rattus norvegicus
tgccgccctccgaccctgaacttcc

SEQ ID NO: 660412 - DNA, 25 bp, Rattus norvegicus
aaaccgaggacatccggatctgttc

SEQ ID NO: 660413 - DNA, 25 bp, Rattus norvegicus
accgctgcagggactccgagctggc

SEQ ID NO: 660414 - DNA, 25 bp, Rattus norvegicus
aggacatccggatctgttcagtgca

SEQ ID NO: 660415 - DNA, 25 bp, Rattus norvegicus
gaggccaccgctgcagggactccga

SEQ ID NO: 660416 - DNA, 25 bp, Rattus norvegicus
ttcagtgcagcctctccgtcgggca

SEQ ID NO: 660417 - DNA, 25 bp, Rattus norvegicus
cgccgcactccgaatggcgcgaggg

SEQ ID NO: 660418 - DNA, 25 bp, Rattus norvegicus
ccactgccgcacgagtggtgctgct

SEQ ID NO: 660419 - DNA, 25 bp, Rattus norvegicus
tgagaccctcggaaaggggcagcca

SEQ ID NO: 660420 - DNA, 25 bp, Rattus norvegicus
tcccagcctgagaccctcggaaagg

SEQ ID NO: 660421 - DNA, 25 bp, Rattus norvegicus
catccggaaggtgaccagggcgctc

SEQ ID NO: 660422 - DNA, 25 bp, Rattus norvegicus
acccagtctgcgctcgcagggtggc

SEQ ID NO: 660423 - DNA, 25 bp, Rattus norvegicus
ttgacacggggctccacccagtctg

SEQ ID NO: 660424 - DNA, 25 bp, Rattus norvegicus
caacctgtcttgacacggggctcca

SEQ ID NO: 660425 - DNA, 25 bp, Rattus norvegicus
tgcgggcctccgcaacctgtcttga

SEQ ID NO: 660426 - DNA, 25 bp, Rattus norvegicus
cagaggtgcccagcctccttccgca

SEQ ID NO: 660427 - DNA, 25 bp, Rattus norvegicus
actatggcggcacgccgaccgggaa

SEQ ID NO: 660428 - DNA, 25 bp, Rattus norvegicus
accagctaagcctcgagggatgcga

SEQ ID NO: 660429 - DNA, 25 bp, Rattus norvegicus
ggggcgtacaccagctaagcctcga

SEQ ID NO: 660430 - DNA, 25 bp, Rattus norvegicus
cgcacgagtggtgctgctctgcaga

SEQ ID NO: 660431 - DNA, 25 bp, Rattus norvegicus
ctgccacgaccctgctgtgggagct

SEQ ID NO: 660432 - DNA, 25 bp, Rattus norvegicus
caggccgtggaacggactacagttc

SEQ ID NO: 660433 - DNA, 25 bp, Rattus norvegicus
tgctctacgtgagagtcgccggttc

SEQ ID NO: 660434 - DNA, 25 bp, Rattus norvegicus
tggccagactactccggacggttaa

SEQ ID NO: 660435 - DNA, 25 bp, Rattus norvegicus
tcacgtaacggcctcgggcgtctgc

SEQ ID NO: 660436 - DNA, 25 bp, Rattus norvegicus
ctctgcggctccgaaacggttagcg

SEQ ID NO: 660437 - DNA, 25 bp, Rattus norvegicus
cggttagcggctagtaaacaacagc

SEQ ID NO: 660438 - DNA, 25 bp, Rattus norvegicus
ttctcggccgagacccaagaaaagc

SEQ ID NO: 660439 - DNA, 25 bp, Rattus norvegicus
ggaacgcgcgtcctgtcacactcag

SEQ ID NO: 660440 - DNA, 25 bp, Rattus norvegicus
tgggagctgccctgatccgctagcc

SEQ ID NO: 660441 - DNA, 25 bp, Rattus norvegicus
gggactcgagacgacctgccacgac

SEQ ID NO: 660442 - DNA, 25 bp, Rattus norvegicus
tgtcctctgtctcggcgctgcatac

SEQ ID NO: 660443 - DNA, 25 bp, Rattus norvegicus
tcacactcagggcaagcacggcgag

SEQ ID NO: 660444 - DNA, 25 bp, Rattus norvegicus
ctccggacggttaacctcgaatgag

SEQ ID NO: 660445 - DNA, 25 bp, Rattus norvegicus
accctgttggaaccttcgctgctgc

SEQ ID NO: 660446 - DNA, 25 bp, Rattus norvegicus
catttatttatcttcgggtggagtc

SEQ ID NO: 660447 - DNA, 25 bp, Rattus norvegicus
ctgcggtaccatgaggcgccggtaa

SEQ ID NO: 660448 - DNA, 25 bp, Rattus norvegicus
ttcatcagcacagtggccgggctca

SEQ ID NO: 660449 - DNA, 25 bp, Rattus norvegicus
gagtcgacatctacaccccacgggg

SEQ ID NO: 660450 - DNA, 25 bp, Rattus norvegicus
tttatcttcgggtggagtcgacatc

SEQ ID NO: 660451 - DNA, 25 bp, Rattus norvegicus
ctgctgtcatttatttatcttcggg

SEQ ID NO: 660452 - DNA, 25 bp, Rattus norvegicus
ggtcaaacctgctgtcatttattta

SEQ ID NO: 660453 - DNA, 25 bp, Rattus norvegicus
cgttgggtcaaacctgctgtcattt

SEQ ID NO: 660454 - DNA, 25 bp, Rattus norvegicus
ccggagagacgttgggtcaaacctg

SEQ ID NO: 660455 - DNA, 25 bp, Rattus norvegicus
tgcagcagacttctcaagcagctgg

SEQ ID NO: 660456 - DNA, 25 bp, Rattus norvegicus
tgctgcttatgcagcagacttctca

SEQ ID NO: 660457 - DNA, 25 bp, Rattus norvegicus
ttggaaccttcgctgctgcttatgc

SEQ ID NO: 660458 - DNA, 25 bp, Rattus norvegicus
cttcgggtggagtcgacatctacac

SEQ ID NO: 660459 - DNA, 25 bp, Rattus norvegicus
aggcgatcagccttgggttttgttg

SEQ ID NO: 660460 - DNA, 25 bp, Rattus norvegicus
gtcactgaagttaacttcctggcga

SEQ ID NO: 660461 - DNA, 25 bp, Rattus norvegicus
cccggcgcactgtcactgaagttaa

SEQ ID NO: 660462 - DNA, 25 bp, Rattus norvegicus
gacacctggtgtccaggcttcagcc

SEQ ID NO: 660463 - DNA, 25 bp, Rattus norvegicus
ttggtaccggagtcccatagcctga

SEQ ID NO: 660464 - DNA, 25 bp, Rattus norvegicus
cttgtggcccaaggactaggcgatc

SEQ ID NO: 660465 - DNA, 25 bp, Rattus norvegicus
tgcagggcgcgtgaaaccacagcgc

SEQ ID NO: 660466 - DNA, 25 bp, Rattus norvegicus
tattacagatcacttatgtggtccc

SEQ ID NO: 660467 - DNA, 25 bp, Rattus norvegicus
cacacaaagtgattttaaggtatcc

SEQ ID NO: 660468 - DNA, 25 bp, Rattus norvegicus
acactcgtatgaattaagaactatc

SEQ ID NO: 660469 - DNA, 25 bp, Rattus norvegicus
tttgcgtcatttaaacactcgtatg

SEQ ID NO: 660470 - DNA, 25 bp, Rattus norvegicus
gacatcttgggttttgcgtcattta

SEQ ID NO: 660471 - DNA, 25 bp, Rattus norvegicus
aactaaactcattggacatcttggg

SEQ ID NO: 660472 - DNA, 25 bp, Rattus norvegicus
tgatggagactaacggcgacacctg

SEQ ID NO: 660473 - DNA, 25 bp, Rattus norvegicus
accatatagggagctgggctaacac

SEQ ID NO: 660474 - DNA, 25 bp, Rattus norvegicus
cccgaccatatagggagctgggcta

SEQ ID NO: 660475 - DNA, 25 bp, Rattus norvegicus
agcggcgtgcgctgactgccgctct

SEQ ID NO: 660476 - DNA, 25 bp, Rattus norvegicus
tctgtttccctaagcagcggcgtgc

SEQ ID NO: 660477 - DNA, 25 bp, Rattus norvegicus
cctccttctcccgattcagccatgg

SEQ ID NO: 660478 - DNA, 25 bp, Rattus norvegicus
tcagccatggctcccggagcgtgcg

SEQ ID NO: 660479 - DNA, 25 bp, Rattus norvegicus
ggcgccgcacattcgcacattcggt

SEQ ID NO: 660480 - DNA, 25 bp, Rattus norvegicus
agcctcgggcgcttctgtttcccta

SEQ ID NO: 660481 - DNA, 25 bp, Rattus norvegicus
tgggctaacacttgactgcactgca

SEQ ID NO: 660482 - DNA, 25 bp, Rattus norvegicus
actgcactgcagagcgccaatgcca

SEQ ID NO: 660483 - DNA, 25 bp, Rattus norvegicus
gagcgccaatgccaggcgagcagcc

SEQ ID NO: 660484 - DNA, 25 bp, Rattus norvegicus
acggactccgcggacagcgcaacgc

SEQ ID NO: 660485 - DNA, 25 bp, Rattus norvegicus
ttcgcacattcggtggagacgcgcg

SEQ ID NO: 660486 - DNA, 25 bp, Rattus norvegicus
aagtgcgcggcagccacggactccg

SEQ ID NO: 660487 - DNA, 25 bp, Rattus norvegicus
tgtctccaaggccaggttgtcgcct

SEQ ID NO: 660488 - DNA, 25 bp, Rattus norvegicus
tagccacgcagccagcaaacaaggg

SEQ ID NO: 660489 - DNA, 25 bp, Rattus norvegicus
agcgtgcaccctgggacgtagccac

SEQ ID NO: 660490 - DNA, 25 bp, Rattus norvegicus
ggttgtcgcctttgcggttcactta

SEQ ID NO: 660491 - DNA, 25 bp, Rattus norvegicus
gtggaaggcactgcgaccgcttcac

SEQ ID NO: 660492 - DNA, 25 bp, Rattus norvegicus
caaacagcccgtctggcaggcgcgt

SEQ ID NO: 660493 - DNA, 25 bp, Rattus norvegicus
gcggtcagatctcaggccgcgcagt

SEQ ID NO: 660494 - DNA, 25 bp, Rattus norvegicus
acactaccagtttgacccagcggtc

SEQ ID NO: 660495 - DNA, 25 bp, Rattus norvegicus
ggttcacttagacctagcccaaaca

SEQ ID NO: 660496 - DNA, 25 bp, Rattus norvegicus
tgtctatcagtccattgcacacctc

SEQ ID NO: 660497 - DNA, 25 bp, Rattus norvegicus
ccattggtccggatgactgtctatc

SEQ ID NO: 660498 - DNA, 25 bp, Rattus norvegicus
taatttggcgctgcggttttctgcc

SEQ ID NO: 660499 - DNA, 25 bp, Rattus norvegicus
ttcatcaatccaggcaggaaccgcg

SEQ ID NO: 660500 - DNA, 25 bp, Rattus norvegicus
gccgcgcagtgacggttcatcaatc

SEQ ID NO: 660501 - DNA, 25 bp, Rattus norvegicus
aaatgttggagctgcgcctagaccc

SEQ ID NO: 660502 - DNA, 25 bp, Rattus norvegicus
ggagagtctcctgctacgagaaaga

SEQ ID NO: 660503 - DNA, 25 bp, Rattus norvegicus
gcggagccttacctcgatgttgcca

SEQ ID NO: 660504 - DNA, 25 bp, Rattus norvegicus
tgttgccaacggtgcgggcacaacc

SEQ ID NO: 660505 - DNA, 25 bp, Rattus norvegicus
tcagtccctgctggactaatgcccg

SEQ ID NO: 660506 - DNA, 25 bp, Rattus norvegicus
agctctggtcatggtcccgagccgt

SEQ ID NO: 660507 - DNA, 25 bp, Rattus norvegicus
ttcggcgaactaggcactgggatcg

SEQ ID NO: 660508 - DNA, 25 bp, Rattus norvegicus
ctgaagctcggtagctccctggtca

SEQ ID NO: 660509 - DNA, 25 bp, Rattus norvegicus
acactgggccacatcgcgtcggagt

SEQ ID NO: 660510 - DNA, 25 bp, Rattus norvegicus
ggtaggcggaaaccgcacagcctta

SEQ ID NO: 660511 - DNA, 25 bp, Rattus norvegicus
gcacagccttaagggtaggggccca

SEQ ID NO: 660512 - DNA, 25 bp, Rattus norvegicus
tgggccctgacagccggtaatttgc

SEQ ID NO: 660513 - DNA, 25 bp, Rattus norvegicus
tttgcttttacggtgagcgcttccc

SEQ ID NO: 660514 - DNA, 25 bp, Rattus norvegicus
atcgcggagtttagtctagagttac

SEQ ID NO: 660515 - DNA, 25 bp, Rattus norvegicus
tgtcgggcatctcccggtttaaatg

SEQ ID NO: 660516 - DNA, 25 bp, Rattus norvegicus
ccggtgaacccagtgtcctgaagtc

SEQ ID NO: 660517 - DNA, 25 bp, Rattus norvegicus
atcaggctcggttctacaaggcgca

SEQ ID NO: 660518 - DNA, 25 bp, Rattus norvegicus
gcaccaagggactgtgtcgcaactg

SEQ ID NO: 660519 - DNA, 25 bp, Rattus norvegicus
gtggatcctcaagtccttcgctgtg

SEQ ID NO: 660520 - DNA, 25 bp, Rattus norvegicus
ggaccgcgtctctccattggtcagg

SEQ ID NO: 660521 - DNA, 25 bp, Rattus norvegicus
cggtatgcactttcttgacaacttc

SEQ ID NO: 660522 - DNA, 25 bp, Rattus norvegicus
cctggggactccttgtacacacaca

SEQ ID NO: 660523 - DNA, 25 bp, Rattus norvegicus
cgggcagcaaagcactcgaggtacc

SEQ ID NO: 660524 - DNA, 25 bp, Rattus norvegicus
gcggattctgtcctaccagcctcag

SEQ ID NO: 660525 - DNA, 25 bp, Rattus norvegicus
ccaattccgaagtcctcagcagtca

SEQ ID NO: 660526 - DNA, 25 bp, Rattus norvegicus
ggggctctgactccaacaacagtgc

SEQ ID NO: 660527 - DNA, 25 bp, Rattus norvegicus
tgcttagagcaccaggaccgtgttt

SEQ ID NO: 660528 - DNA, 25 bp, Rattus norvegicus
cgcgctcccgcaaatggaaacggta

SEQ ID NO: 660529 - DNA, 25 bp, Rattus norvegicus
ggcctttctcgctcagatctcttga

SEQ ID NO: 660530 - DNA, 25 bp, Rattus norvegicus
ccgctgcttgttcctcgcttacgga

SEQ ID NO: 660531 - DNA, 25 bp, Rattus norvegicus
gctgcttgttcctcgcttacggaca

SEQ ID NO: 660532 - DNA, 25 bp, Rattus norvegicus
tgttcctcgcttacggacacttcca

SEQ ID NO: 660533 - DNA, 25 bp, Rattus norvegicus
tcgcttacggacacttccacttatc

SEQ ID NO: 660534 - DNA, 25 bp, Rattus norvegicus
ggacacttccacttatccttttcca

SEQ ID NO: 660535 - DNA, 25 bp, Rattus norvegicus
gctcagggatctcccagtcccggtc

SEQ ID NO: 660536 - DNA, 25 bp, Rattus norvegicus
ggtggcctttctcgctcagatctct

SEQ ID NO: 660537 - DNA, 25 bp, Rattus norvegicus
cgctcagatctcttgagatggaacc

SEQ ID NO: 660538 - DNA, 25 bp, Rattus norvegicus
ctcttgagatggaaccgcaacctta

SEQ ID NO: 660539 - DNA, 25 bp, Rattus norvegicus
gagatggaaccgcaaccttaaggtc

SEQ ID NO: 660540 - DNA, 25 bp, Rattus norvegicus
gcaaccttaaggtccttcctccagc

SEQ ID NO: 660541 - DNA, 25 bp, Rattus norvegicus
ggccagccggctgctcagggatctc

SEQ ID NO: 660542 - DNA, 25 bp, Rattus norvegicus
ttccacgcagggtggcctttctcgc

SEQ ID NO: 660543 - DNA, 25 bp, Rattus norvegicus
cccaaccaatggagctgctggcgcg

SEQ ID NO: 660544 - DNA, 25 bp, Rattus norvegicus
cccttggggcttctgatgcgcccag

SEQ ID NO: 660545 - DNA, 25 bp, Rattus norvegicus
gcgtcccaaccaatggagctgctgg

SEQ ID NO: 660546 - DNA, 25 bp, Rattus norvegicus
aggagacggtctggagtcccccgct

SEQ ID NO: 660547 - DNA, 25 bp, Rattus norvegicus
ggtcaggtggactcccgcagtctcc

SEQ ID NO: 660548 - DNA, 25 bp, Rattus norvegicus
agaccggtgtctgcgtcgcggtccc

SEQ ID NO: 660549 - DNA, 25 bp, Rattus norvegicus
gcgcctgtcactggagcgggcacct

SEQ ID NO: 660550 - DNA, 25 bp, Rattus norvegicus
gccaccgcctctaatccgcccttaa

SEQ ID NO: 660551 - DNA, 25 bp, Rattus norvegicus
taatccgcccttaagtagtctccgc

SEQ ID NO: 660552 - DNA, 25 bp, Rattus norvegicus
ccttaagtagtctccgcctgcgtca

SEQ ID NO: 660553 - DNA, 25 bp, Rattus norvegicus
tccgcctgcgtcacgccaggtcggc

SEQ ID NO: 660554 - DNA, 25 bp, Rattus norvegicus
gagctggacagcacctccgtgccgt

SEQ ID NO: 660555 - DNA, 25 bp, Rattus norvegicus
atgcgcccaggtaatctcacctggc

SEQ ID NO: 660556 - DNA, 25 bp, Rattus norvegicus
tctgatgcgcccaggtaatctcacc

SEQ ID NO: 660557 - DNA, 25 bp, Rattus norvegicus
gcaagctaccgccagggtgccacag

SEQ ID NO: 660558 - DNA, 25 bp, Rattus norvegicus
cagggtgccacagcgccgggcacaa

SEQ ID NO: 660559 - DNA, 25 bp, Rattus norvegicus
ctccaaagctttcaggcagcggctg

SEQ ID NO: 660560 - DNA, 25 bp, Rattus norvegicus
gaactctgcgttgatctgggacacg

SEQ ID NO: 660561 - DNA, 25 bp, Rattus norvegicus
tctcatggttcctcccggaacctga

SEQ ID NO: 660562 - DNA, 25 bp, Rattus norvegicus
ccgggcacaagggagcctaagttct

SEQ ID NO: 660563 - DNA, 25 bp, Rattus norvegicus
cagcggctgcaagctaccgccaggg

SEQ ID NO: 660564 - DNA, 25 bp, Rattus norvegicus
gcggcgattctccaaagctttcagg

SEQ ID NO: 660565 - DNA, 25 bp, Rattus norvegicus
ccagaggctcgtagcggcgattctc

SEQ ID NO: 660566 - DNA, 25 bp, Rattus norvegicus
tcacctccgaagcagaccagaggct

SEQ ID NO: 660567 - DNA, 25 bp, Rattus norvegicus
gcggtcacctccgaagcagaccaga

SEQ ID NO: 660568 - DNA, 25 bp, Rattus norvegicus
attttcttgggctgcgcaggagccg

SEQ ID NO: 660569 - DNA, 25 bp, Rattus norvegicus
ggccacgattttcttgggctgcgca

SEQ ID NO: 660570 - DNA, 25 bp, Rattus norvegicus
gcctaagttctcatggttcctcccg

SEQ ID NO: 660571 - DNA, 25 bp, Rattus norvegicus
gcgctggtcattcaatgtctggctc

SEQ ID NO: 660572 - DNA, 25 bp, Rattus norvegicus
gtggccgaacgcacgctgccgctgt

SEQ ID NO: 660573 - DNA, 25 bp, Rattus norvegicus
tggccgcaccacgacgaatggaact

SEQ ID NO: 660574 - DNA, 25 bp, Rattus norvegicus
cgtagccgatgcagtggccgcacca

SEQ ID NO: 660575 - DNA, 25 bp, Rattus norvegicus
ttgcgccggaggaacgtccaccggc

SEQ ID NO: 660576 - DNA, 25 bp, Rattus norvegicus
agctgttgcccgtggccgaacgcac

SEQ ID NO: 660577 - DNA, 25 bp, Rattus norvegicus
gctgtccagcaaccacacggcgtcc

SEQ ID NO: 660578 - DNA, 25 bp, Rattus norvegicus
ggcgcgttgacctttcaccctagca

SEQ ID NO: 660579 - DNA, 25 bp, Rattus norvegicus
tagcaaccgccatcacgtgcttgcg

SEQ ID NO: 660580 - DNA, 25 bp, Rattus norvegicus
ccgaatccgctagtctttccaggta

SEQ ID NO: 660581 - DNA, 25 bp, Rattus norvegicus
gaatggaactgcaccagccacgcgg

SEQ ID NO: 660582 - DNA, 25 bp, Rattus norvegicus
cccgagcgctggtcattcaatgtct

SEQ ID NO: 660583 - DNA, 25 bp, Rattus norvegicus
agccacgcggctgagctgttgcccg

SEQ ID NO: 660584 - DNA, 25 bp, Rattus norvegicus
atccgctagtctttccaggtaccac

SEQ ID NO: 660585 - DNA, 25 bp, Rattus norvegicus
gggattcattccacctcgcacgcag

SEQ ID NO: 660586 - DNA, 25 bp, Rattus norvegicus
tcttacgatctttgggccggtgctc

SEQ ID NO: 660587 - DNA, 25 bp, Rattus norvegicus
ttgagtttaccgctctgacgaagca

SEQ ID NO: 660588 - DNA, 25 bp, Rattus norvegicus
ctgacgaagcacatgcaaggagcta

SEQ ID NO: 660589 - DNA, 25 bp, Rattus norvegicus
aggcctgaccctcccgggattcatt

SEQ ID NO: 660590 - DNA, 25 bp, Rattus norvegicus
gcggggctcagctcttttgagttta

SEQ ID NO: 660591 - DNA, 25 bp, Rattus norvegicus
tccgcactcacctggagctggcaag

SEQ ID NO: 660592 - DNA, 25 bp, Rattus norvegicus
caagcgccagacagggacgcatctc

SEQ ID NO: 660593 - DNA, 25 bp, Rattus norvegicus
ggacgcatctcagtgccagagtttc

SEQ ID NO: 660594 - DNA, 25 bp, Rattus norvegicus
tgccagagtttcaccaagacggaaa

SEQ ID NO: 660595 - DNA, 25 bp, Rattus norvegicus
gtcggcacggcgactgactaagtgc

SEQ ID NO: 660596 - DNA, 25 bp, Rattus norvegicus
tccagcgctctctgattgcggtccg

SEQ ID NO: 660597 - DNA, 25 bp, Rattus norvegicus
cggctggaaacagcttcttacgatc

SEQ ID NO: 660598 - DNA, 25 bp, Rattus norvegicus
taaggtcgtggcaccctgtttggat

SEQ ID NO: 660599 - DNA, 25 bp, Rattus norvegicus
tcctcgcccgggtgtttgctgcgct

SEQ ID NO: 660600 - DNA, 25 bp, Rattus norvegicus
tacagtggccgcgtcgggaaacagc

SEQ ID NO: 660601 - DNA, 25 bp, Rattus norvegicus
ctccggagtttcctacagtggccgc

SEQ ID NO: 660602 - DNA, 25 bp, Rattus norvegicus
cgtcgggaaacagccttgcccagga

SEQ ID NO: 660603 - DNA, 25 bp, Rattus norvegicus
ttgcccaggagtaaagagatcgccc

SEQ ID NO: 660604 - DNA, 25 bp, Rattus norvegicus
cccactcattacctgatcagggctg

SEQ ID NO: 660605 - DNA, 25 bp, Rattus norvegicus
cattacctgatcagggctgcgaccc

SEQ ID NO: 660606 - DNA, 25 bp, Rattus norvegicus
caagaagtggctccggagtttccta

SEQ ID NO: 660607 - DNA, 25 bp, Rattus norvegicus
gggctgcgaccctcattctgagctc

SEQ ID NO: 660608 - DNA, 25 bp, Rattus norvegicus
gcgaccctcattctgagctcagtga

SEQ ID NO: 660609 - DNA, 25 bp, Rattus norvegicus
agtgagcgtgcgtgcggtcaccaca

SEQ ID NO: 660610 - DNA, 25 bp, Rattus norvegicus
ggcggcagtacctacacacgcggtc

SEQ ID NO: 660611 - DNA, 25 bp, Rattus norvegicus
tagtgggcccgaacagcagattgcc

SEQ ID NO: 660612 - DNA, 25 bp, Rattus norvegicus
gtcctgtggcggcagtacctacaca

SEQ ID NO: 660613 - DNA, 25 bp, Rattus norvegicus
aacacactcgcgaccgggaggctgt

SEQ ID NO: 660614 - DNA, 25 bp, Rattus norvegicus
tccgtttgcagcaggttcctctgta

SEQ ID NO: 660615 - DNA, 25 bp, Rattus norvegicus
cgaccgggaggctgtctgcacgcac

SEQ ID NO: 660616 - DNA, 25 bp, Rattus norvegicus
tacaacaaacacactcgcgaccggg

SEQ ID NO: 660617 - DNA, 25 bp, Rattus norvegicus
agcaggttcctctgtacaacaaaca

SEQ ID NO: 660618 - DNA, 25 bp, Rattus norvegicus
atcacgatttgaccgccagagtcca

SEQ ID NO: 660619 - DNA, 25 bp, Rattus norvegicus
tgatcactgcaaaaaaacccacggt

SEQ ID NO: 660620 - DNA, 25 bp, Rattus norvegicus
cgcccatagttgatcactgcaaaaa

SEQ ID NO: 660621 - DNA, 25 bp, Rattus norvegicus
gcacgacgcccatagttgatcactg

SEQ ID NO: 660622 - DNA, 25 bp, Rattus norvegicus
ttctcatcacgatttgaccgccaga

SEQ ID NO: 660623 - DNA, 25 bp, Rattus norvegicus
tctacgcgcacgacgcccatagttg

SEQ ID NO: 660624 - DNA, 25 bp, Rattus norvegicus
gagtccagcgctgcacctttctcca

SEQ ID NO: 660625 - DNA, 25 bp, Rattus norvegicus
tccatccgtttgcagcaggttcctc

SEQ ID NO: 660626 - DNA, 25 bp, Rattus norvegicus
aggctgtctgcacgcacgaccgcgg

SEQ ID NO: 660627 - DNA, 25 bp, Rattus norvegicus
ccgcagaggaaatcactcccttcta

SEQ ID NO: 660628 - DNA, 25 bp, Rattus norvegicus
ggcccgcagaggaaatcactccctt

SEQ ID NO: 660629 - DNA, 25 bp, Rattus norvegicus
tgccctggcccgcagaggaaatcac

SEQ ID NO: 660630 - DNA, 25 bp, Rattus norvegicus
gttacttaccttcgggagcagcggc

SEQ ID NO: 660631 - DNA, 25 bp, Rattus norvegicus
cctgcagttacttaccttcgggagc

SEQ ID NO: 660632 - DNA, 25 bp, Rattus norvegicus
gacttactcccgaggccaagacctg

SEQ ID NO: 660633 - DNA, 25 bp, Rattus norvegicus
gcagttacttaccttcgggagcagc

SEQ ID NO: 660634 - DNA, 25 bp, Rattus norvegicus
cactcccttctacgccgacttactc

SEQ ID NO: 660635 - DNA, 25 bp, Rattus norvegicus
ccgaggccaagacctgggaagcatc

SEQ ID NO: 660636 - DNA, 25 bp, Rattus norvegicus
gccaagacctgggaagcatccctac

SEQ ID NO: 660637 - DNA, 25 bp, Rattus norvegicus
tgggaagcatccctactccgctcgg

SEQ ID NO: 660638 - DNA, 25 bp, Rattus norvegicus
tgctgcctcggtgggctgtttatcc

SEQ ID NO: 660639 - DNA, 25 bp, Rattus norvegicus
tgtttatcccctgaggtccataccg

SEQ ID NO: 660640 - DNA, 25 bp, Rattus norvegicus
gaggaaatcactcccttctacgccg

SEQ ID NO: 660641 - DNA, 25 bp, Rattus norvegicus
tcgtactgtcagagcccggcaagag

SEQ ID NO: 660642 - DNA, 25 bp, Rattus norvegicus
ctcatcgtactgtcagagcccggca

SEQ ID NO: 660643 - DNA, 25 bp, Rattus norvegicus
tggggcagctcatcgtactgtcaga

SEQ ID NO: 660644 - DNA, 25 bp, Rattus norvegicus
gccgtaatggggcagctcatcgtac

SEQ ID NO: 660645 - DNA, 25 bp, Rattus norvegicus
gtgagggtctccgtacatggaagca

SEQ ID NO: 660646 - DNA, 25 bp, Rattus norvegicus
tctccgtacatggaagcaggaaccc

SEQ ID NO: 660647 - DNA, 25 bp, Rattus norvegicus
gcagatcccatgctggctggcatga

SEQ ID NO: 660648 - DNA, 25 bp, Rattus norvegicus
gcgtcgttgacagcagatcccatgc

SEQ ID NO: 660649 - DNA, 25 bp, Rattus norvegicus
ttcaaggcgtcgttgacagcagatc

SEQ ID NO: 660650 - DNA, 25 bp, Rattus norvegicus
gtctctcttcaaggcgtcgttgaca

SEQ ID NO: 660651 - DNA, 25 bp, Rattus norvegicus
agatcgcgtccttgtctctcttcaa

SEQ ID NO: 660652 - DNA, 25 bp, Rattus norvegicus
tttacccgtagatcgcgtccttgtc

SEQ ID NO: 660653 - DNA, 25 bp, Rattus norvegicus
tcccatgctggctggcatgacattg

SEQ ID NO: 660654 - DNA, 25 bp, Rattus norvegicus
gtccatcccgccgtaatggggcagc

SEQ ID NO: 660655 - DNA, 25 bp, Rattus norvegicus
acctcgcagcacattcgccacgggg

SEQ ID NO: 660656 - DNA, 25 bp, Rattus norvegicus
cgctcgtgtcccgactttcgaaatc

SEQ ID NO: 660657 - DNA, 25 bp, Rattus norvegicus
tgcgaatgccgtttcctctccaggc

SEQ ID NO: 660658 - DNA, 25 bp, Rattus norvegicus
agcgcggctgcgaatgccgtttcct

SEQ ID NO: 660659 - DNA, 25 bp, Rattus norvegicus
ttaccggctgacgaggcccgcgtca

SEQ ID NO: 660660 - DNA, 25 bp, Rattus norvegicus
actgatttcgcggacgcctccctga

SEQ ID NO: 660661 - DNA, 25 bp, Rattus norvegicus
gaccttcactgatttcgcggacgcc

SEQ ID NO: 660662 - DNA, 25 bp, Rattus norvegicus
gggctctcggttctgaccttcactg

SEQ ID NO: 660663 - DNA, 25 bp, Rattus norvegicus
tcccgactttcgaaatcggcgtgtc

SEQ ID NO: 660664 - DNA, 25 bp, Rattus norvegicus
tcacccaggtcggaggagggctctc

SEQ ID NO: 660665 - DNA, 25 bp, Rattus norvegicus
cctgtcctcacccaggtcggaggag

SEQ ID NO: 660666 - DNA, 25 bp, Rattus norvegicus
ggggcaagctcagaccctgtcctca

SEQ ID NO: 660667 - DNA, 25 bp, Rattus norvegicus
tccagtcagggtccaaaggagaggc

SEQ ID NO: 660668 - DNA, 25 bp, Rattus norvegicus
gctggcctccagtcagggtccaaag

SEQ ID NO: 660669 - DNA, 25 bp, Rattus norvegicus
tcctacggcggagacacatcccggg

SEQ ID NO: 660670 - DNA, 25 bp, Rattus norvegicus
gcggcgggagaacgaaatgacggaa

SEQ ID NO: 660671 - DNA, 25 bp, Rattus norvegicus
agtcgtggtggccatagcccgtcct

SEQ ID NO: 660672 - DNA, 25 bp, Rattus norvegicus
tagcccgtcctacggcggagacaca

SEQ ID NO: 660673 - DNA, 25 bp, Rattus norvegicus
cggagcctctgatatgcagcgagtg

SEQ ID NO: 660674 - DNA, 25 bp, Rattus norvegicus
aagcctgcttctccagggggacgac

SEQ ID NO: 660675 - DNA, 25 bp, Rattus norvegicus
atcagcaagcctgcttctccagggg

SEQ ID NO: 660676 - DNA, 25 bp, Rattus norvegicus
cggagcaaatcagcaagcctgcttc

SEQ ID NO: 660677 - DNA, 25 bp, Rattus norvegicus
ggaccggagcaaatcagcaagcctg

SEQ ID NO: 660678 - DNA, 25 bp, Rattus norvegicus
ctctgatatgcagcgagtgcggtcg

SEQ ID NO: 660679 - DNA, 25 bp, Rattus norvegicus
cctctgatatgcagcgagtgcggtc

SEQ ID NO: 660680 - DNA, 25 bp, Rattus norvegicus
gcagcgcggagcctctgatatgcag

SEQ ID NO: 660681 - DNA, 25 bp, Rattus norvegicus
gcgcggagcctctgatatgcagcga

SEQ ID NO: 660682 - DNA, 25 bp, Rattus norvegicus
tggccatagcccgtcctacggcgga

SEQ ID NO: 660683 - DNA, 25 bp, Rattus norvegicus
gagagcccgcggctcatttccatgc

SEQ ID NO: 660684 - DNA, 25 bp, Rattus norvegicus
ccttgagagcgaggatgtcagtttc

SEQ ID NO: 660685 - DNA, 25 bp, Rattus norvegicus
tgtcctcgccggctccttgagagcg

SEQ ID NO: 660686 - DNA, 25 bp, Rattus norvegicus
ctgaggcttttcagccgggaaatcc

SEQ ID NO: 660687 - DNA, 25 bp, Rattus norvegicus
ctgtgctgggacaggcgaacactga

SEQ ID NO: 660688 - DNA, 25 bp, Rattus norvegicus
ctgcggtactcaggcctccacggag

SEQ ID NO: 660689 - DNA, 25 bp, Rattus norvegicus
cgcccgcgcacagagtggtgatgca

SEQ ID NO: 660690 - DNA, 25 bp, Rattus norvegicus
ggctcatttccatgcctgtcgcata

SEQ ID NO: 660691 - DNA, 25 bp, Rattus norvegicus
tttccggctggccagcattcctggg

SEQ ID NO: 660692 - DNA, 25 bp, Rattus norvegicus
gggcccttctcaatggggtttcaga

SEQ ID NO: 660693 - DNA, 25 bp, Rattus norvegicus
ttaattgcttcaaagggcccttctc

SEQ ID NO: 660694 - DNA, 25 bp, Rattus norvegicus
gccgccgtgaaacgcgctttaattg

SEQ ID NO: 660695 - DNA, 25 bp, Rattus norvegicus
ggatgtcagtttccaccaccctctt

SEQ ID NO: 660696 - DNA, 25 bp, Rattus norvegicus
cctgtcgcatactgcctccgttgtg

SEQ ID NO: 660697 - DNA, 25 bp, Rattus norvegicus
tgatagatgcccgatgtgtcggacc

SEQ ID NO: 660698 - DNA, 25 bp, Rattus norvegicus
tgaggcgtccaccatggtgaggccc

SEQ ID NO: 660699 - DNA, 25 bp, Rattus norvegicus
tagcagtcggaggtctccgagaccg

SEQ ID NO: 660700 - DNA, 25 bp, Rattus norvegicus
attttcgcctctctgcttggggaag

SEQ ID NO: 660701 - DNA, 25 bp, Rattus norvegicus
gtgcattttcgcctctctgcttggg

SEQ ID NO: 660702 - DNA, 25 bp, Rattus norvegicus
cctttccattcgtgcattttcgcct

SEQ ID NO: 660703 - DNA, 25 bp, Rattus norvegicus
ccgatgtgtcggaccattttcttta

SEQ ID NO: 660704 - DNA, 25 bp, Rattus norvegicus
aagtgagccctggtctggttgagcc

SEQ ID NO: 660705 - DNA, 25 bp, Rattus norvegicus
tctgacaacgagtaagtgagccctg

SEQ ID NO: 660706 - DNA, 25 bp, Rattus norvegicus
agacggcgacttctgacaacgagta

SEQ ID NO: 660707 - DNA, 25 bp, Rattus norvegicus
cgaggagacggcgacttctgacaac

SEQ ID NO: 660708 - DNA, 25 bp, Rattus norvegicus
cgctccgggtgaggcgtccaccatg

SEQ ID NO: 660709 - DNA, 25 bp, Rattus norvegicus
tccatctcctgagcggatcacggtg

SEQ ID NO: 660710 - DNA, 25 bp, Rattus norvegicus
cccgcccgggaggtgatagatgccc

SEQ ID NO: 660711 - DNA, 25 bp, Rattus norvegicus
tgtgcacgtggctactgcggcataa

SEQ ID NO: 660712 - DNA, 25 bp, Rattus norvegicus
tgtcattacattcagcccgcagctg

SEQ ID NO: 660713 - DNA, 25 bp, Rattus norvegicus
gggccttggtccctctgtcattaca

SEQ ID NO: 660714 - DNA, 25 bp, Rattus norvegicus
cacggctacgagtcccggaaccttg

SEQ ID NO: 660715 - DNA, 25 bp, Rattus norvegicus
actgcggcataagcgtgcccttctc

SEQ ID NO: 660716 - DNA, 25 bp, Rattus norvegicus
tggactacttcccaggggagtggac

SEQ ID NO: 660717 - DNA, 25 bp, Rattus norvegicus
ggtgagtgttctcgtggactacttc

SEQ ID NO: 660718 - DNA, 25 bp, Rattus norvegicus
acgttctggacaccttggaggcgct

SEQ ID NO: 660719 - DNA, 25 bp, Rattus norvegicus
agctcgggcccgaaactagcatgga

SEQ ID NO: 660720 - DNA, 25 bp, Rattus norvegicus
tttgggccaaacgaccatgagaggg

SEQ ID NO: 660721 - DNA, 25 bp, Rattus norvegicus
tttagagtgacgaacagctttgggc

SEQ ID NO: 660722 - DNA, 25 bp, Rattus norvegicus
tccggcgggatttttagagtgacga

SEQ ID NO: 660723 - DNA, 25 bp, Rattus norvegicus
cccggccaggttgtgtgtaccaggc

SEQ ID NO: 660724 - DNA, 25 bp, Rattus norvegicus
ccttggcgtgatgacgctggtttcc

SEQ ID NO: 660725 - DNA, 25 bp, Rattus norvegicus
gagcaccctcagctcttcttcgaat

SEQ ID NO: 660726 - DNA, 25 bp, Rattus norvegicus
gctctccgaggagcggtagctactc

SEQ ID NO: 660727 - DNA, 25 bp, Rattus norvegicus
ttcgaatcctgaccccattactcgg

SEQ ID NO: 660728 - DNA, 25 bp, Rattus norvegicus
gtggagcaccctcagctcttcttcg

SEQ ID NO: 660729 - DNA, 25 bp, Rattus norvegicus
cagactggaggaaacgtggagcacc

SEQ ID NO: 660730 - DNA, 25 bp, Rattus norvegicus
tgatgttatcatcagactggaggaa

SEQ ID NO: 660731 - DNA, 25 bp, Rattus norvegicus
accaaccacctgacaggcgctgatg

SEQ ID NO: 660732 - DNA, 25 bp, Rattus norvegicus
aaactttgtgcgagcgcgctcccta

SEQ ID NO: 660733 - DNA, 25 bp, Rattus norvegicus
cgcacccgcaggcacaaactttgtg

SEQ ID NO: 660734 - DNA, 25 bp, Rattus norvegicus
ggtagctactcaccgcggagcctct

SEQ ID NO: 660735 - DNA, 25 bp, Rattus norvegicus
ccgtctcacctggagcggtgggatc

SEQ ID NO: 660736 - DNA, 25 bp, Rattus norvegicus
cctgacaggcgctgatgttatcatc

SEQ ID NO: 660737 - DNA, 25 bp, Rattus norvegicus
tctcgccttgcccagggttcccatg

SEQ ID NO: 660738 - DNA, 25 bp, Rattus norvegicus
cattactcggtagcgccccaagggc

SEQ ID NO: 660739 - DNA, 25 bp, Rattus norvegicus
acgcgcctccctggatctgcgtagg

SEQ ID NO: 660740 - DNA, 25 bp, Rattus norvegicus
tctactccaggtagttcgaggaccg

SEQ ID NO: 660741 - DNA, 25 bp, Rattus norvegicus
ctgggttctgcctgcaaccgtgtcc

SEQ ID NO: 660742 - DNA, 25 bp, Rattus norvegicus
gggcactccaccactcgactctgcg

SEQ ID NO: 660743 - DNA, 25 bp, Rattus norvegicus
cggcggtgacatcacagctctggcg

SEQ ID NO: 660744 - DNA, 25 bp, Rattus norvegicus
caggcgcctctactccaggtagttc

SEQ ID NO: 660745 - DNA, 25 bp, Rattus norvegicus
ctccaggtagttcgaggaccgggat

SEQ ID NO: 660746 - DNA, 25 bp, Rattus norvegicus
cgggaggctgccggcccagaacaaa

SEQ ID NO: 660747 - DNA, 25 bp, Rattus norvegicus
ccagaacaaaggctgcagcggcgac

SEQ ID NO: 660748 - DNA, 25 bp, Rattus norvegicus
cctccctggatctgcgtagggagcg

SEQ ID NO: 660749 - DNA, 25 bp, Rattus norvegicus
ctggcggcggtgacatcacagctct

SEQ ID NO: 660750 - DNA, 25 bp, Rattus norvegicus
ttctgcctgcaaccgtgtccgggtg

SEQ ID NO: 660751 - DNA, 25 bp, Rattus norvegicus
tgtccgggtgccagaagggcttacg

SEQ ID NO: 660752 - DNA, 25 bp, Rattus norvegicus
agcacatcacttcctcggcgtctcg

SEQ ID NO: 660753 - DNA, 25 bp, Rattus norvegicus
tcaacttttccgtggggacgatggc

SEQ ID NO: 660754 - DNA, 25 bp, Rattus norvegicus
cccgtaccttcagagttgggcaatg

SEQ ID NO: 660755 - DNA, 25 bp, Rattus norvegicus
gccaccgcctcctctgtgaagatga

SEQ ID NO: 660756 - DNA, 25 bp, Rattus norvegicus
acgatggctggacgtctaggtactg

SEQ ID NO: 660757 - DNA, 25 bp, Rattus norvegicus
tctaggtactgactggctccactga

SEQ ID NO: 660758 - DNA, 25 bp, Rattus norvegicus
gctccactgacattcgagcgtcata

SEQ ID NO: 660759 - DNA, 25 bp, Rattus norvegicus
gagcgtcatacacttcccttcgaag

SEQ ID NO: 660760 - DNA, 25 bp, Rattus norvegicus
ccgcctcctctgtgaagatgaaaga

SEQ ID NO: 660761 - DNA, 25 bp, Rattus norvegicus
ggctgcttcaaggaacgctgttgcc

SEQ ID NO: 660762 - DNA, 25 bp, Rattus norvegicus
tcaaggaacgctgttgccctggcaa

SEQ ID NO: 660763 - DNA, 25 bp, Rattus norvegicus
ttgccctggcaactagaagcgcgcg

SEQ ID NO: 660764 - DNA, 25 bp, Rattus norvegicus
tcacagtctcgcgataggtgtaaag

SEQ ID NO: 660765 - DNA, 25 bp, Rattus norvegicus
ccggaagttgcgagaagactgctga

SEQ ID NO: 660766 - DNA, 25 bp, Rattus norvegicus
gcgcgcggatcacagtctcgcgata

SEQ ID NO: 660767 - DNA, 25 bp, Rattus norvegicus
ctggctaacgagaagggagcacttg

SEQ ID NO: 660768 - DNA, 25 bp, Rattus norvegicus
cagaagctcagctggggtccaatcc

SEQ ID NO: 660769 - DNA, 25 bp, Rattus norvegicus
acacataggtggctgcgaaggaccc

SEQ ID NO: 660770 - DNA, 25 bp, Rattus norvegicus
gattgtcgtgacctagcagggaccg

SEQ ID NO: 660771 - DNA, 25 bp, Rattus norvegicus
tgaactggcggtacagctgcgcctc

SEQ ID NO: 660772 - DNA, 25 bp, Rattus norvegicus
caaggctgtctggaccagttctgta

SEQ ID NO: 660773 - DNA, 25 bp, Rattus norvegicus
gctgagcgccaggactccagaagct

SEQ ID NO: 660774 - DNA, 25 bp, Rattus norvegicus
tgcttcagtgtagtgatcgtagctg

SEQ ID NO: 660775 - DNA, 25 bp, Rattus norvegicus
gagcacttggctgaagctatatttc

SEQ ID NO: 660776 - DNA, 25 bp, Rattus norvegicus
gctccggacctctctggctaacgag

SEQ ID NO: 660777 - DNA, 25 bp, Rattus norvegicus
ggcccgtcagcagccacatggaggc

SEQ ID NO: 660778 - DNA, 25 bp, Rattus norvegicus
ctaaccagccgtcctcgagatgggg

SEQ ID NO: 660779 - DNA, 25 bp, Rattus norvegicus
ggtgacacccagctgccgttgtgcc

SEQ ID NO: 660780 - DNA, 25 bp, Rattus norvegicus
tcttggcttggacggattgtcgtga

SEQ ID NO: 660781 - DNA, 25 bp, Rattus norvegicus
caaggcccactctcacctgctcaga

SEQ ID NO: 660782 - DNA, 25 bp, Rattus norvegicus
tacggctcggacttccaggatctgc

SEQ ID NO: 660783 - DNA, 25 bp, Rattus norvegicus
ggcgatttacggctcggacttccag

SEQ ID NO: 660784 - DNA, 25 bp, Rattus norvegicus
agctgcaggccctggaggcgattta

SEQ ID NO: 660785 - DNA, 25 bp, Rattus norvegicus
agagacaggaccacgagctgcaggc

SEQ ID NO: 660786 - DNA, 25 bp, Rattus norvegicus
gctattcacagagacaggaccacga

SEQ ID NO: 660787 - DNA, 25 bp, Rattus norvegicus
ctgagccgcaggagagctattcaca

SEQ ID NO: 660788 - DNA, 25 bp, Rattus norvegicus
gagaatcaccgctacctcgcctagg

SEQ ID NO: 660789 - DNA, 25 bp, Rattus norvegicus
cccgttttcagagcgcctacgcaga

SEQ ID NO: 660790 - DNA, 25 bp, Rattus norvegicus
tctcgggctggaggtcccgttttca

SEQ ID NO: 660791 - DNA, 25 bp, Rattus norvegicus
acttccaggatctgcggccggatgc

SEQ ID NO: 660792 - DNA, 25 bp, Rattus norvegicus
tgctcagagccacaccgctaggcca

SEQ ID NO: 660793 - DNA, 25 bp, Rattus norvegicus
ttctggcctaggctacgcccaaggc

SEQ ID NO: 660794 - DNA, 25 bp, Rattus norvegicus
ctaggccagtcctcagctcgaggtc

SEQ ID NO: 660795 - DNA, 25 bp, Rattus norvegicus
cattggctcgagtccatggccctca

SEQ ID NO: 660796 - DNA, 25 bp, Rattus norvegicus
tccttacctagctccggttgccttg

SEQ ID NO: 660797 - DNA, 25 bp, Rattus norvegicus
gttgccagtcttccgtcaatcctta

SEQ ID NO: 660798 - DNA, 25 bp, Rattus norvegicus
ggaacttccgcttttgttgccagtc

SEQ ID NO: 660799 - DNA, 25 bp, Rattus norvegicus
ttcaaccggaagtctcgcttgtggt

SEQ ID NO: 660800 - DNA, 25 bp, Rattus norvegicus
gcaggttccgactccgtcagcagaa

SEQ ID NO: 660801 - DNA, 25 bp, Rattus norvegicus
gggagaaacgctacccgagctgacc

SEQ ID NO: 660802 - DNA, 25 bp, Rattus norvegicus
cagctccgtcaggaactgcaacaca

SEQ ID NO: 660803 - DNA, 25 bp, Rattus norvegicus
ctggaagagcctggtcagctccgtc

SEQ ID NO: 660804 - DNA, 25 bp, Rattus norvegicus
cgatgaccggcacttctggaagagc

SEQ ID NO: 660805 - DNA, 25 bp, Rattus norvegicus
tgatgaacacgctgcccgatgaccg

SEQ ID NO: 660806 - DNA, 25 bp, Rattus norvegicus
agctgcttacacttcttcagggtga

SEQ ID NO: 660807 - DNA, 25 bp, Rattus norvegicus
tggacgtctgacacacttagggccc

SEQ ID NO: 660808 - DNA, 25 bp, Rattus norvegicus
agaagccttctgaggttcaaccgga

SEQ ID NO: 660809 - DNA, 25 bp, Rattus norvegicus
ctcaccttgtagaggacgacggtcc

SEQ ID NO: 660810 - DNA, 25 bp, Rattus norvegicus
tggagcctagaccacgtgccaatga

SEQ ID NO: 660811 - DNA, 25 bp, Rattus norvegicus
tgcctcccagtaggctttgcgcttc

SEQ ID NO: 660812 - DNA, 25 bp, Rattus norvegicus
acgtgaattcttcttccaaggctgc

SEQ ID NO: 660813 - DNA, 25 bp, Rattus norvegicus
ccggcgcctaagactccagtagaca

SEQ ID NO: 660814 - DNA, 25 bp, Rattus norvegicus
tgggctctacacctaggaatccttc

SEQ ID NO: 660815 - DNA, 25 bp, Rattus norvegicus
gtcggccttgtcactgggctctaca

SEQ ID NO: 660816 - DNA, 25 bp, Rattus norvegicus
ctctgtcggtcactaggaactggtc

SEQ ID NO: 660817 - DNA, 25 bp, Rattus norvegicus
cccagcttccgacagaggcgagaca

SEQ ID NO: 660818 - DNA, 25 bp, Rattus norvegicus
ggtgataaactcaagcctcccgctc

SEQ ID NO: 660819 - DNA, 25 bp, Rattus norvegicus
cctggctttccatcccaagaggtga

SEQ ID NO: 660820 - DNA, 25 bp, Rattus norvegicus
gcttctgaacctcattcggcgtcca

SEQ ID NO: 660821 - DNA, 25 bp, Rattus norvegicus
tgtcagtcctcacaagcaaacagct

SEQ ID NO: 660822 - DNA, 25 bp, Rattus norvegicus
ccgccgcatgtccttcggaaatatg

SEQ ID NO: 660823 - DNA, 25 bp, Rattus norvegicus
tccaatcggtctgggccgggactac

SEQ ID NO: 660824 - DNA, 25 bp, Rattus norvegicus
ctccgacccaggacaaggagggtca

SEQ ID NO: 660825 - DNA, 25 bp, Rattus norvegicus
cccagatctcagaggccacagaaac

SEQ ID NO: 660826 - DNA, 25 bp, Rattus norvegicus
gaggccacagaaacaccacacctta

SEQ ID NO: 660827 - DNA, 25 bp, Rattus norvegicus
cagagtgtccaaagacctcacctca

SEQ ID NO: 660828 - DNA, 25 bp, Rattus norvegicus
ggcctgggacaagccacgtgcgtcc

SEQ ID NO: 660829 - DNA, 25 bp, Rattus norvegicus
accaagtcgtgcagtaggtccgtgg

SEQ ID NO: 660830 - DNA, 25 bp, Rattus norvegicus
ggaggtcccggctctctttcctggc

SEQ ID NO: 660831 - DNA, 25 bp, Rattus norvegicus
cactcgcctttccaatcggtctggg

SEQ ID NO: 660832 - DNA, 25 bp, Rattus norvegicus
ctcgctgcagcctgttcttccggga

SEQ ID NO: 660833 - DNA, 25 bp, Rattus norvegicus
gtcgggatattctcaagaccaagtc

SEQ ID NO: 660834 - DNA, 25 bp, Rattus norvegicus
gcccttcagtgtcttgggctgggtt

SEQ ID NO: 660835 - DNA, 25 bp, Rattus norvegicus
tgggaggggcgtctctcctccgacc

SEQ ID NO: 660836 - DNA, 25 bp, Rattus norvegicus
tgttcttccgggaccgcagattccg

SEQ ID NO: 660837 - DNA, 25 bp, Rattus norvegicus
cagttacacccggaggccaaagcgt

SEQ ID NO: 660838 - DNA, 25 bp, Rattus norvegicus
tctcagcctccgagtcgtgatgcca

SEQ ID NO: 660839 - DNA, 25 bp, Rattus norvegicus
ctccgagtcgtgatgccagggctct

SEQ ID NO: 660840 - DNA, 25 bp, Rattus norvegicus
gtcgtgatgccagggctctgcgcca

SEQ ID NO: 660841 - DNA, 25 bp, Rattus norvegicus
tgccagggctctgcgccagggtcca

SEQ ID NO: 660842 - DNA, 25 bp, Rattus norvegicus
agggtccagggtgacgaacactcgg

SEQ ID NO: 660843 - DNA, 25 bp, Rattus norvegicus
gacttggcgcccacactcgattggg

SEQ ID NO: 660844 - DNA, 25 bp, Rattus norvegicus
cgcccacactcgattgggaagaagg

SEQ ID NO: 660845 - DNA, 25 bp, Rattus norvegicus
gacaaactccagctgttaagaagag

SEQ ID NO: 660846 - DNA, 25 bp, Rattus norvegicus
ccagctgttaagaagaggagccttc

SEQ ID NO: 660847 - DNA, 25 bp, Rattus norvegicus
aagaggagccttcagactccgcagg

SEQ ID NO: 660848 - DNA, 25 bp, Rattus norvegicus
agactccgcagggaggcgaaacgca

SEQ ID NO: 660849 - DNA, 25 bp, Rattus norvegicus
cgcagggaggcgaaacgcaccacaa

SEQ ID NO: 660850 - DNA, 25 bp, Rattus norvegicus
aggcgaaacgcaccacaactcacgg

SEQ ID NO: 660851 - DNA, 25 bp, Rattus norvegicus
cgcgcggtattgtttccaaaatacg

SEQ ID NO: 660852 - DNA, 25 bp, Rattus norvegicus
aaacagctgatgaggccccgccctt

SEQ ID NO: 660853 - DNA, 25 bp, Rattus norvegicus
ccggaggaggtacgacccaactctg

SEQ ID NO: 660854 - DNA, 25 bp, Rattus norvegicus
gaggaggtacgacccaactctgctt

SEQ ID NO: 660855 - DNA, 25 bp, Rattus norvegicus
ggaggtacgacccaactctgcttgg

SEQ ID NO: 660856 - DNA, 25 bp, Rattus norvegicus
aggtacgacccaactctgcttggcc

SEQ ID NO: 660857 - DNA, 25 bp, Rattus norvegicus
cagcgactgctgtgggcgtgagctg

SEQ ID NO: 660858 - DNA, 25 bp, Rattus norvegicus
ggcgcgggaggaggccaccgcgcac

SEQ ID NO: 660859 - DNA, 25 bp, Rattus norvegicus
cgcaccgcgcggtattgtttccaaa

SEQ ID NO: 660860 - DNA, 25 bp, Rattus norvegicus
caccgcgcggtattgtttccaaaat

SEQ ID NO: 660861 - DNA, 25 bp, Rattus norvegicus
tattgtttccaaaatacgcccgctc

SEQ ID NO: 660862 - DNA, 25 bp, Rattus norvegicus
ggcatcccgcaaacagctgatgagg

SEQ ID NO: 660863 - DNA, 25 bp, Rattus norvegicus
atcccgcaaacagctgatgaggccc

SEQ ID NO: 660864 - DNA, 25 bp, Rattus norvegicus
ccgggcatcccgcaaacagctgatg

SEQ ID NO: 660865 - DNA, 25 bp, Rattus norvegicus
gccaagttgttgcagctgggtgctc

SEQ ID NO: 660866 - DNA, 25 bp, Rattus norvegicus
ttatgcaccgcgcagcgcgggctta

SEQ ID NO: 660867 - DNA, 25 bp, Rattus norvegicus
gtaaggaccggagccaagttgttgc

SEQ ID NO: 660868 - DNA, 25 bp, Rattus norvegicus
caagaacttggaatgcaggatggcg

SEQ ID NO: 660869 - DNA, 25 bp, Rattus norvegicus
ttggcactccgaggaaaaaggtctg

SEQ ID NO: 660870 - DNA, 25 bp, Rattus norvegicus
agggaagctcagacagttggcactc

SEQ ID NO: 660871 - DNA, 25 bp, Rattus norvegicus
cggtcttcgcagctccagagttagc

SEQ ID NO: 660872 - DNA, 25 bp, Rattus norvegicus
ggagtacgggataacggtcttcgca

SEQ ID NO: 660873 - DNA, 25 bp, Rattus norvegicus
ggattcgggcgagtgattttgttta

SEQ ID NO: 660874 - DNA, 25 bp, Rattus norvegicus
tagtttctttgagacggattcgggc

SEQ ID NO: 660875 - DNA, 25 bp, Rattus norvegicus
aatttgaaagttggcggccctggcg

SEQ ID NO: 660876 - DNA, 25 bp, Rattus norvegicus
ctgcgtccggagacgttaaatttga

SEQ ID NO: 660877 - DNA, 25 bp, Rattus norvegicus
gccacgctacgtctgcgtccggaga

SEQ ID NO: 660878 - DNA, 25 bp, Rattus norvegicus
cttaaacccgggatgcactacaatc

SEQ ID NO: 660879 - DNA, 25 bp, Rattus norvegicus
atcccaaagtgagctggggcgcacg

SEQ ID NO: 660880 - DNA, 25 bp, Rattus norvegicus
gccagctcctcctgacagcagcggc

SEQ ID NO: 660881 - DNA, 25 bp, Rattus norvegicus
agcctggacacaaccgggggctcca

SEQ ID NO: 660882 - DNA, 25 bp, Rattus norvegicus
tgctccgcagcctggacacaaccgg

SEQ ID NO: 660883 - DNA, 25 bp, Rattus norvegicus
gccctgatcgattggccagaggaag

SEQ ID NO: 660884 - DNA, 25 bp, Rattus norvegicus
gatctaatggagaaatcccaaagtg

SEQ ID NO: 660885 - DNA, 25 bp, Rattus norvegicus
tgcctgaggatctaatggagaaatc

SEQ ID NO: 660886 - DNA, 25 bp, Rattus norvegicus
aggtcgctgcctgaggatctaatgg

SEQ ID NO: 660887 - DNA, 25 bp, Rattus norvegicus
gccctacaggagcaggtcgctgcct

SEQ ID NO: 660888 - DNA, 25 bp, Rattus norvegicus
gttggagctgctcgcgccctacagg

SEQ ID NO: 660889 - DNA, 25 bp, Rattus norvegicus
caacgttggagctgctcgcgcccta

SEQ ID NO: 660890 - DNA, 25 bp, Rattus norvegicus
aaattgccaggcaacgttggagctg

SEQ ID NO: 660891 - DNA, 25 bp, Rattus norvegicus
gacgatatcaaaattgccaggcaac

SEQ ID NO: 660892 - DNA, 25 bp, Rattus norvegicus
gagcggctgtcgcttgctccgcagc

SEQ ID NO: 660893 - DNA, 25 bp, Rattus norvegicus
gtgcggttcccaacgtcctggactc

SEQ ID NO: 660894 - DNA, 25 bp, Rattus norvegicus
agcaatttaacgagccgattgcaca

SEQ ID NO: 660895 - DNA, 25 bp, Rattus norvegicus
gccgattgcacaacagccgattagt

SEQ ID NO: 660896 - DNA, 25 bp, Rattus norvegicus
cacaacagccgattagtagataatc

SEQ ID NO: 660897 - DNA, 25 bp, Rattus norvegicus
agtagataatccaagtcctggcttg

SEQ ID NO: 660898 - DNA, 25 bp, Rattus norvegicus
tccaagtcctggcttggcgccgtgg

SEQ ID NO: 660899 - DNA, 25 bp, Rattus norvegicus
cttcccgcttggcaggtgggtgccc

SEQ ID NO: 660900 - DNA, 25 bp, Rattus norvegicus
ccgagcggggattacgactccctag

SEQ ID NO: 660901 - DNA, 25 bp, Rattus norvegicus
cacacggcaggtcctaggggccttt

SEQ ID NO: 660902 - DNA, 25 bp, Rattus norvegicus
gctcggcgacacacctcggcgtgag

SEQ ID NO: 660903 - DNA, 25 bp, Rattus norvegicus
acaagggcgacctccgaagcggcgc

SEQ ID NO: 660904 - DNA, 25 bp, Rattus norvegicus
ctgcggctcagcaggcacccgagtt

SEQ ID NO: 660905 - DNA, 25 bp, Rattus norvegicus
cacccgagttcgctcagtcgctagg

SEQ ID NO: 660906 - DNA, 25 bp, Rattus norvegicus
ctggactccagccagtcgcagaatc

SEQ ID NO: 660907 - DNA, 25 bp, Rattus norvegicus
tgcccgcctgcatggcctcaaggaa

SEQ ID NO: 660908 - DNA, 25 bp, Rattus norvegicus
gcggaaagagcgcaccaagaactcc

SEQ ID NO: 660909 - DNA, 25 bp, Rattus norvegicus
ttgttgcttctgactcccgctcaag

SEQ ID NO: 660910 - DNA, 25 bp, Rattus norvegicus
ggacgtcttgcttttcctccctggc

SEQ ID NO: 660911 - DNA, 25 bp, Rattus norvegicus
tgtagccgagtctcctgcagttccc

SEQ ID NO: 660912 - DNA, 25 bp, Rattus norvegicus
aagctcggcctcctcaactcttggg

SEQ ID NO: 660913 - DNA, 25 bp, Rattus norvegicus
ctcaaggaaggtgcgcgtacccgct

SEQ ID NO: 660914 - DNA, 25 bp, Rattus norvegicus
ttggagcagcgccactcaccggtac

SEQ ID NO: 660915 - DNA, 25 bp, Rattus norvegicus
cggcagtcgatgatgctgcggtcca

SEQ ID NO: 660916 - DNA, 25 bp, Rattus norvegicus
gctccaacagcagtcgcacgaaacg

SEQ ID NO: 660917 - DNA, 25 bp, Rattus norvegicus
cagctgcacggcgtctaagtggcct

SEQ ID NO: 660918 - DNA, 25 bp, Rattus norvegicus
cccgacgcctagatacctggcttta

SEQ ID NO: 660919 - DNA, 25 bp, Rattus norvegicus
ggatcgccgctgtactgcaccagca

SEQ ID NO: 660920 - DNA, 25 bp, Rattus norvegicus
gcccgggaagtccaaaagctccgca

SEQ ID NO: 660921 - DNA, 25 bp, Rattus norvegicus
gaaggatacttctgccggaacccta

SEQ ID NO: 660922 - DNA, 25 bp, Rattus norvegicus
gctgtccgcaacatgccgttccagg

SEQ ID NO: 660923 - DNA, 25 bp, Rattus norvegicus
gggcaccgtcaccacgacgattctt

SEQ ID NO: 660924 - DNA, 25 bp, Rattus norvegicus
cgattcttggccacctctttttgca

SEQ ID NO: 660925 - DNA, 25 bp, Rattus norvegicus
actgaagctgtatccgccattttgg

SEQ ID NO: 660926 - DNA, 25 bp, Rattus norvegicus
agcggccggaagcagctctcttcag

SEQ ID NO: 660927 - DNA, 25 bp, Rattus norvegicus
caggctcagctcagaggtcatttta

SEQ ID NO: 660928 - DNA, 25 bp, Rattus norvegicus
gctgcctgtcgtattcccgtgatcc

SEQ ID NO: 660929 - DNA, 25 bp, Rattus norvegicus
ccagctgttctgcatcttgcggagc

SEQ ID NO: 660930 - DNA, 25 bp, Rattus norvegicus
tcacctgcggtagttctcgaagctc

SEQ ID NO: 660931 - DNA, 25 bp, Rattus norvegicus
tcctgtagaaggaacggtgccagca

SEQ ID NO: 660932 - DNA, 25 bp, Rattus norvegicus
accgcgcccaccttgcaggtgtaga

SEQ ID NO: 660933 - DNA, 25 bp, Rattus norvegicus
aaatcccaaagctgccgcggtccgg

SEQ ID NO: 660934 - DNA, 25 bp, Rattus norvegicus
ccgggtcctcacactacgaagtagt

SEQ ID NO: 660935 - DNA, 25 bp, Rattus norvegicus
cgaagagtcccggagtcgttgaatc

SEQ ID NO: 660936 - DNA, 25 bp, Rattus norvegicus
tacagtctcatctggcagccggtgg

SEQ ID NO: 660937 - DNA, 25 bp, Rattus norvegicus
tggcggccaagaccaacaagaagtg

SEQ ID NO: 660938 - DNA, 25 bp, Rattus norvegicus
aacaagaagtgggtccggctagcca

SEQ ID NO: 660939 - DNA, 25 bp, Rattus norvegicus
cccaagcgggactttgcagcaggac

SEQ ID NO: 660940 - DNA, 25 bp, Rattus norvegicus
gtttgatcttcccagcaccgtgcag

SEQ ID NO: 660941 - DNA, 25 bp, Rattus norvegicus
gtactggccgtctactacagtctca

SEQ ID NO: 660942 - DNA, 25 bp, Rattus norvegicus
ctagccacggtgttcgcctacgtgc

SEQ ID NO: 660943 - DNA, 25 bp, Rattus norvegicus
tcgttgaatctctccgtgttgggga

SEQ ID NO: 660944 - DNA, 25 bp, Rattus norvegicus
caacgatagccagcttgcctcggga

SEQ ID NO: 660945 - DNA, 25 bp, Rattus norvegicus
cctcgggagccggtaatgcacaacc

SEQ ID NO: 660946 - DNA, 25 bp, Rattus norvegicus
tgcacaaccggatcttcagccaagg

SEQ ID NO: 660947 - DNA, 25 bp, Rattus norvegicus
ttcagccaagggaccacgattcgcc

SEQ ID NO: 660948 - DNA, 25 bp, Rattus norvegicus
ggactccgggtttgatcttcccagc

SEQ ID NO: 660949 - DNA, 25 bp, Rattus norvegicus
aggcggattcgcattcttcgcaaga

SEQ ID NO: 660950 - DNA, 25 bp, Rattus norvegicus
ttgcacaggcggattcgcattcttc

SEQ ID NO: 660951 - DNA, 25 bp, Rattus norvegicus
cgcattcttcgcaagattttttcca

SEQ ID NO: 660952 - DNA, 25 bp, Rattus norvegicus
ttgctggcgttgcacaggcggattc

SEQ ID NO: 660953 - DNA, 25 bp, Rattus norvegicus
gattttttccatcctctcacgcctg

SEQ ID NO: 660954 - DNA, 25 bp, Rattus norvegicus
agcgctacctggcacacggctgtgt

SEQ ID NO: 660955 - DNA, 25 bp, Rattus norvegicus
tcgatacatctggatctgctggttc

SEQ ID NO: 660956 - DNA, 25 bp, Rattus norvegicus
ggtgctccacgagcgctacctggca

SEQ ID NO: 660957 - DNA, 25 bp, Rattus norvegicus
cctggcacacggctgtgtggcccaa

SEQ ID NO: 660958 - DNA, 25 bp, Rattus norvegicus
tctttcaacgcctgctgccctgtgg

SEQ ID NO: 660959 - DNA, 25 bp, Rattus norvegicus
tgctgccctgtggtgtcattaagtt

SEQ ID NO: 660960 - DNA, 25 bp, Rattus norvegicus
gtcattaagtttcgatacatctgga

SEQ ID NO: 660961 - DNA, 25 bp, Rattus norvegicus
acatctggatctgctggttcgcggc

SEQ ID NO: 660962 - DNA, 25 bp, Rattus norvegicus
cctgtggtgtcattaagtttcgata

SEQ ID NO: 660963 - DNA, 25 bp, Rattus norvegicus
acagacttccgtacaacagggccgc

SEQ ID NO: 660964 - DNA, 25 bp, Rattus norvegicus
gccgaggcacaggagacagacttcc

SEQ ID NO: 660965 - DNA, 25 bp, Rattus norvegicus
accttccgtacagcatggcgactca

SEQ ID NO: 660966 - DNA, 25 bp, Rattus norvegicus
ggccgcccacagacttggaacagtg

SEQ ID NO: 660967 - DNA, 25 bp, Rattus norvegicus
ccttttgaaagcgtggcggcagact

SEQ ID NO: 660968 - DNA, 25 bp, Rattus norvegicus
cagactctactgagggctgggcagt

SEQ ID NO: 660969 - DNA, 25 bp, Rattus norvegicus
tgctgcggagcatcatttgaaaagg

SEQ ID NO: 660970 - DNA, 25 bp, Rattus norvegicus
cgcccgactacgatggccagttcta

SEQ ID NO: 660971 - DNA, 25 bp, Rattus norvegicus
gcgctgctaatatccgccttgcact

SEQ ID NO: 660972 - DNA, 25 bp, Rattus norvegicus
ccttgcacttccagggtcgagccaa

SEQ ID NO: 660973 - DNA, 25 bp, Rattus norvegicus
caccatccggggctctgtggactat

SEQ ID NO: 660974 - DNA, 25 bp, Rattus norvegicus
attcgatgccgagctgcggcttgtc

SEQ ID NO: 660975 - DNA, 25 bp, Rattus norvegicus
ccagttctaagacggtgtgcgacgc

SEQ ID NO: 660976 - DNA, 25 bp, Rattus norvegicus
ggtgggtgtccataccgtcaccatc

SEQ ID NO: 660977 - DNA, 25 bp, Rattus norvegicus
aaacgagggccaatcacagcgctcc

SEQ ID NO: 660978 - DNA, 25 bp, Rattus norvegicus
tgcttctggaaacaggcgaccgagc

SEQ ID NO: 660979 - DNA, 25 bp, Rattus norvegicus
ggaatcttacctttgtgcttctgga

SEQ ID NO: 660980 - DNA, 25 bp, Rattus norvegicus
taacaagagagaaggttcggtcagc

SEQ ID NO: 660981 - DNA, 25 bp, Rattus norvegicus
gcgaccgagcagctgtaacaagaga

SEQ ID NO: 660982 - DNA, 25 bp, Rattus norvegicus
ggcagcggtatttcggcttctccga

SEQ ID NO: 660983 - DNA, 25 bp, Rattus norvegicus
ggcttctccgagcagatcacacaga

SEQ ID NO: 660984 - DNA, 25 bp, Rattus norvegicus
tctgtctcactagggcacgcggcaa

SEQ ID NO: 660985 - DNA, 25 bp, Rattus norvegicus
gatcacacagatcgcagtcttacta

SEQ ID NO: 660986 - DNA, 25 bp, Rattus norvegicus
agtcttactatttagcgacgccatg

SEQ ID NO: 660987 - DNA, 25 bp, Rattus norvegicus
agcgacgccatgacttcccagacga

SEQ ID NO: 660988 - DNA, 25 bp, Rattus norvegicus
tctgcgctcacccttttaccaaaaa

SEQ ID NO: 660989 - DNA, 25 bp, Rattus norvegicus
acggtgatccggaatcttacctttg

SEQ ID NO: 660990 - DNA, 25 bp, Rattus norvegicus
ttcggtcagcacgagcgaccgcagc

SEQ ID NO: 660991 - DNA, 25 bp, Rattus norvegicus
cgccctccagggttgggagctgacc

SEQ ID NO: 660992 - DNA, 25 bp, Rattus norvegicus
ggggaatcgaagttgtcagaccgcc

SEQ ID NO: 660993 - DNA, 25 bp, Rattus norvegicus
catcggggagcactgcgcgcctcga

SEQ ID NO: 660994 - DNA, 25 bp, Rattus norvegicus
ggggttccagccgccggattccagc

SEQ ID NO: 660995 - DNA, 25 bp, Rattus norvegicus
cctctaagtgacagcgggacccggt

SEQ ID NO: 660996 - DNA, 25 bp, Rattus norvegicus
atcgaagttgtcagaccgcctctaa

SEQ ID NO: 660997 - DNA, 25 bp, Rattus norvegicus
gggaccggttcgaacagcgagtgtg

SEQ ID NO: 660998 - DNA, 25 bp, Rattus norvegicus
agcactgcgcgcctcgaggtgacag

SEQ ID NO: 660999 - DNA, 25 bp, Rattus norvegicus
acggacggacgacaagaagcaggtg

SEQ ID NO: 661000 - DNA, 25 bp, Rattus norvegicus
gcggactagcaaaagggagaggacc

SEQ ID NO: 661001 - DNA, 25 bp, Rattus norvegicus
aacgagctaggtaggcggactagca

SEQ ID NO: 661002 - DNA, 25 bp, Rattus norvegicus
cgctcgtcccggtgagctaggagct

SEQ ID NO: 661003 - DNA, 25 bp, Rattus norvegicus
cggattccagcccggtcagggcctg

SEQ ID NO: 661004 - DNA, 25 bp, Rattus norvegicus
gtcagaccgcctctaagtgacagcg

SEQ ID NO: 661005 - DNA, 25 bp, Rattus norvegicus
ccttggaacgcctcctgtctgctta

SEQ ID NO: 661006 - DNA, 25 bp, Rattus norvegicus
ctagaggcctatctttcgatgctga

SEQ ID NO: 661007 - DNA, 25 bp, Rattus norvegicus
gcgtccagcggactgctgctcatga

SEQ ID NO: 661008 - DNA, 25 bp, Rattus norvegicus
ctgctcatgatcgagcggggcatcc

SEQ ID NO: 661009 - DNA, 25 bp, Rattus norvegicus
gtctgcttaccgcaacaagtttgga

SEQ ID NO: 661010 - DNA, 25 bp, Rattus norvegicus
cgggacagatcctaagcctagaggc

SEQ ID NO: 661011 - DNA, 25 bp, Rattus norvegicus
tcctcgtaagtgaccgctaccgctt

SEQ ID NO: 661012 - DNA, 25 bp, Rattus norvegicus
ggcctgctctaactggaaacgcgtg

SEQ ID NO: 661013 - DNA, 25 bp, Rattus norvegicus
tgctggcaggcgtcttgaacaacgt

SEQ ID NO: 661014 - DNA, 25 bp, Rattus norvegicus
aacaacgtggatgtccgcctcaaga

SEQ ID NO: 661015 - DNA, 25 bp, Rattus norvegicus
gccgtccatgctgatgttcgcagta

SEQ ID NO: 661016 - DNA, 25 bp, Rattus norvegicus
tcaagttcctgtttgtgcgagaccc

SEQ ID NO: 661017 - DNA, 25 bp, Rattus norvegicus
atccgagagtaccagcagcgctatg

SEQ ID NO: 661018 - DNA, 25 bp, Rattus norvegicus
aggagattcgctaccgtctgcagca

SEQ ID NO: 661019 - DNA, 25 bp, Rattus norvegicus
gtgactccggcacttgctgcagttc

SEQ ID NO: 661020 - DNA, 25 bp, Rattus norvegicus
aaggatctaccctagtgggccggtg

SEQ ID NO: 661021 - DNA, 25 bp, Rattus norvegicus
ggcacgtgttcgtataatgacaacg

SEQ ID NO: 661022 - DNA, 25 bp, Rattus norvegicus
cgcaacccggtgctggtactatgca

SEQ ID NO: 661023 - DNA, 25 bp, Rattus norvegicus
tcgcgcaagcgtgaacttgggcagc

SEQ ID NO: 661024 - DNA, 25 bp, Rattus norvegicus
ccgaccgggtcaggatcaaggtctt

SEQ ID NO: 661025 - DNA, 25 bp, Rattus norvegicus
gtgacaggacctacgctttccgctc

SEQ ID NO: 661026 - DNA, 25 bp, Rattus norvegicus
ctcaagccgcgcctctaaggatcta

SEQ ID NO: 661027 - DNA, 25 bp, Rattus norvegicus
tctccactcagcttcacgcgaggtg

SEQ ID NO: 661028 - DNA, 25 bp, Rattus norvegicus
ggagaatcaccctcgtttggatgca

SEQ ID NO: 661029 - DNA, 25 bp, Rattus norvegicus
ggctccaattcttcgttcctacaga

SEQ ID NO: 661030 - DNA, 25 bp, Rattus norvegicus
atgcggttataatgggctccaattc

SEQ ID NO: 661031 - DNA, 25 bp, Rattus norvegicus
tgacaacgggattttgcgtctttta

SEQ ID NO: 661032 - DNA, 25 bp, Rattus norvegicus
ccagcgagcagcgattaagccgttc

SEQ ID NO: 661033 - DNA, 25 bp, Rattus norvegicus
agttccgatcccagccactggctta

SEQ ID NO: 661034 - DNA, 25 bp, Rattus norvegicus
atgctgttatgtggcgaagtgtccc

SEQ ID NO: 661035 - DNA, 25 bp, Rattus norvegicus
cccgggctgcctacggtatattgtg

SEQ ID NO: 661036 - DNA, 25 bp, Rattus norvegicus
ctctggtcccacagctttgtccgga

SEQ ID NO: 661037 - DNA, 25 bp, Rattus norvegicus
gagagccgcacctagagctcctaga

SEQ ID NO: 661038 - DNA, 25 bp, Rattus norvegicus
agcactttgcagagaccacctacta

SEQ ID NO: 661039 - DNA, 25 bp, Rattus norvegicus
acctactacttcgagggcggcttgc

SEQ ID NO: 661040 - DNA, 25 bp, Rattus norvegicus
ggtgcggccctattactttgacttc

SEQ ID NO: 661041 - DNA, 25 bp, Rattus norvegicus
actggcttactacgaggccgctgtc

SEQ ID NO: 661042 - DNA, 25 bp, Rattus norvegicus
gcacgtcttcagcaccgagttccga

SEQ ID NO: 661043 - DNA, 25 bp, Rattus norvegicus
ccgaagcggcttgccatgctgttat

SEQ ID NO: 661044 - DNA, 25 bp, Rattus norvegicus
ctgaggcactctctgcgcaagccga

SEQ ID NO: 661045 - DNA, 25 bp, Rattus norvegicus
ggtcgcagcttgttgcacgtcttca

SEQ ID NO: 661046 - DNA, 25 bp, Rattus norvegicus
tgagctttagcgacgagcactttgc

SEQ ID NO: 661047 - DNA, 25 bp, Rattus norvegicus
ttccggaacgcacgagcaccaacgg

SEQ ID NO: 661048 - DNA, 25 bp, Rattus norvegicus
cccagacaagtcaagcaggtgctct

SEQ ID NO: 661049 - DNA, 25 bp, Rattus norvegicus
cgtgcggcattgagcatgcgcatca

SEQ ID NO: 661050 - DNA, 25 bp, Rattus norvegicus
agcatgcgcatcactctggcggtta

SEQ ID NO: 661051 - DNA, 25 bp, Rattus norvegicus
tctggcggttagatttgaatacttc

SEQ ID NO: 661052 - DNA, 25 bp, Rattus norvegicus
ctccattcccgactggggctggttt

SEQ ID NO: 661053 - DNA, 25 bp, Rattus norvegicus
atgttgtgaggtgacgtccaatgcg

SEQ ID NO: 661054 - DNA, 25 bp, Rattus norvegicus
gtttctgttctctgcgcggtgcact

SEQ ID NO: 661055 - DNA, 25 bp, Rattus norvegicus
ctgtggcgggttagaacgctctttt

SEQ ID NO: 661056 - DNA, 25 bp, Rattus norvegicus
gctcttttttgttctggggtcctga

SEQ ID NO: 661057 - DNA, 25 bp, Rattus norvegicus
gcttgggttttgtctgagcgctgaa

SEQ ID NO: 661058 - DNA, 25 bp, Rattus norvegicus
ggcgatctcagaaaggccctgcagc

SEQ ID NO: 661059 - DNA, 25 bp, Rattus norvegicus
cttcgcctggaacgccgcgttttgc

SEQ ID NO: 661060 - DNA, 25 bp, Rattus norvegicus
ttgaatacttcacggacagtggcgg

SEQ ID NO: 661061 - DNA, 25 bp, Rattus norvegicus
ctgtccgtcagcagaagcggaagta

SEQ ID NO: 661062 - DNA, 25 bp, Rattus norvegicus
ccgacgctaactgacgcactgaatt

SEQ ID NO: 661063 - DNA, 25 bp, Rattus norvegicus
gagcaaggcgaccaaccgaccgacg

SEQ ID NO: 661064 - DNA, 25 bp, Rattus norvegicus
ctctacgcctagaaaccggagaaag

SEQ ID NO: 661065 - DNA, 25 bp, Rattus norvegicus
tcggcatctcgagccaactcaaggc

SEQ ID NO: 661066 - DNA, 25 bp, Rattus norvegicus
aactcaaggccagtgctcccacagt

SEQ ID NO: 661067 - DNA, 25 bp, Rattus norvegicus
ctgacaggagctgcgaagtgtgttt

SEQ ID NO: 661068 - DNA, 25 bp, Rattus norvegicus
tgtggttaggagaactgaaactttc

SEQ ID NO: 661069 - DNA, 25 bp, Rattus norvegicus
tgaggcgttcccagaagtgtggtta

SEQ ID NO: 661070 - DNA, 25 bp, Rattus norvegicus
cactgaattcgttgtggagagaacc

SEQ ID NO: 661071 - DNA, 25 bp, Rattus norvegicus
ggatttctgaaagtcgcgcgcccat

SEQ ID NO: 661072 - DNA, 25 bp, Rattus norvegicus
ttcaaagccgtcaggcctgtccgtc

SEQ ID NO: 661073 - DNA, 25 bp, Rattus norvegicus
catcgcgtatctgcgcctgggcaaa

SEQ ID NO: 661074 - DNA, 25 bp, Rattus norvegicus
tgtgcagaaccgactgccggaagga

SEQ ID NO: 661075 - DNA, 25 bp, Rattus norvegicus
ttgggtccgtttccatcgttgactg

SEQ ID NO: 661076 - DNA, 25 bp, Rattus norvegicus
ccaccacggattcacgctgtcaatg

SEQ ID NO: 661077 - DNA, 25 bp, Rattus norvegicus
cgcaagagaccaactcagaccctta

SEQ ID NO: 661078 - DNA, 25 bp, Rattus norvegicus
ctgcagcccgcgtgagaaacaggag

SEQ ID NO: 661079 - DNA, 25 bp, Rattus norvegicus
catcgttgactgtagaggacacaca

SEQ ID NO: 661080 - DNA, 25 bp, Rattus norvegicus
ggacacacaggaatcccaggccggc

SEQ ID NO: 661081 - DNA, 25 bp, Rattus norvegicus
atgatcttgacgtccttaatccgcg

SEQ ID NO: 661082 - DNA, 25 bp, Rattus norvegicus
tagacatagtgtacctgcagcccgc

SEQ ID NO: 661083 - DNA, 25 bp, Rattus norvegicus
cgaaacccacgacggtccgcaagag

SEQ ID NO: 661084 - DNA, 25 bp, Rattus norvegicus
caggagcgaaccgagagagtcatga

SEQ ID NO: 661085 - DNA, 25 bp, Rattus norvegicus
agagtcatgagccaggtcctccatc

SEQ ID NO: 661086 - DNA, 25 bp, Rattus norvegicus
ggcacagacagacgccctgccaagg

SEQ ID NO: 661087 - DNA, 25 bp, Rattus norvegicus
catcccagtgcagtcgggcttctgc

SEQ ID NO: 661088 - DNA, 25 bp, Rattus norvegicus
ccggcggcagtaccaagtaacagtc

SEQ ID NO: 661089 - DNA, 25 bp, Rattus norvegicus
attcgatctgacgtcctcctgaagg

SEQ ID NO: 661090 - DNA, 25 bp, Rattus norvegicus
agtccggcccaagcccgccgcccag

SEQ ID NO: 661091 - DNA, 25 bp, Rattus norvegicus
tgtctccactgtggctgcgccgtgc

SEQ ID NO: 661092 - DNA, 25 bp, Rattus norvegicus
tcctcctgaaggtgtctccactgtg

SEQ ID NO: 661093 - DNA, 25 bp, Rattus norvegicus
tctgacgtcctcctgaaggtgtctc

SEQ ID NO: 661094 - DNA, 25 bp, Rattus norvegicus
ggcaagaattcgatctgacgtcctc

SEQ ID NO: 661095 - DNA, 25 bp, Rattus norvegicus
cggctgcagtggcaagaattcgatc

SEQ ID NO: 661096 - DNA, 25 bp, Rattus norvegicus
acaggcacatgcgaagggctcggct

SEQ ID NO: 661097 - DNA, 25 bp, Rattus norvegicus
ccggaaacccggttcagcgctgcgc

SEQ ID NO: 661098 - DNA, 25 bp, Rattus norvegicus
gcccaaacctccgatcgccgccctc

SEQ ID NO: 661099 - DNA, 25 bp, Rattus norvegicus
gctctagcctgtcccgcccaaacct

SEQ ID NO: 661100 - DNA, 25 bp, Rattus norvegicus
gtcggacggcttcgctctagcctgt

SEQ ID NO: 661101 - DNA, 25 bp, Rattus norvegicus
cagcgccctggtcagaccagtcgga

SEQ ID NO: 661102 - DNA, 25 bp, Rattus norvegicus
agaccagtcggacggcttcgctcta

SEQ ID NO: 661103 - DNA, 25 bp, Rattus norvegicus
agtcacggaagtccggcggcttgca

SEQ ID NO: 661104 - DNA, 25 bp, Rattus norvegicus
gtgcaacgggttagagcagcgattc

SEQ ID NO: 661105 - DNA, 25 bp, Rattus norvegicus
cacgcttctggtagtcacggaagtc

SEQ ID NO: 661106 - DNA, 25 bp, Rattus norvegicus
gaccacacgcgtatcacgcttctgg

SEQ ID NO: 661107 - DNA, 25 bp, Rattus norvegicus
attcagtgccagcttcgtcgcccag

SEQ ID NO: 661108 - DNA, 25 bp, Rattus norvegicus
taggcctcccttctacaattcagtg

SEQ ID NO: 661109 - DNA, 25 bp, Rattus norvegicus
ggacacaacgcctgctagctgctgc

SEQ ID NO: 661110 - DNA, 25 bp, Rattus norvegicus
cttctggacacaacgcctgctagct

SEQ ID NO: 661111 - DNA, 25 bp, Rattus norvegicus
aatgtcgtggccacgccaggcctcg

SEQ ID NO: 661112 - DNA, 25 bp, Rattus norvegicus
ctttcctttttagcaatgtcgtggc

SEQ ID NO: 661113 - DNA, 25 bp, Rattus norvegicus
tctcaccaagctacaggacctgggc

SEQ ID NO: 661114 - DNA, 25 bp, Rattus norvegicus
agcgctgtgcaaatccggccctaca

SEQ ID NO: 661115 - DNA, 25 bp, Rattus norvegicus
agcgattcggagcacagcgctgtgc

SEQ ID NO: 661116 - DNA, 25 bp, Rattus norvegicus
ttagagcagcgattcggagcacagc

SEQ ID NO: 661117 - DNA, 25 bp, Rattus norvegicus
ctgctcatcagcactcagatccgta

SEQ ID NO: 661118 - DNA, 25 bp, Rattus norvegicus
cgacagcgattctgagggattttcc

SEQ ID NO: 661119 - DNA, 25 bp, Rattus norvegicus
ccctcccttgggtatcaggctcagg

SEQ ID NO: 661120 - DNA, 25 bp, Rattus norvegicus
tgttaccctgtgatctgcgcgtgct

SEQ ID NO: 661121 - DNA, 25 bp, Rattus norvegicus
tggcacccagccaagagcgcagatg

SEQ ID NO: 661122 - DNA, 25 bp, Rattus norvegicus
gcgcagatgatgcacggacttaatc

SEQ ID NO: 661123 - DNA, 25 bp, Rattus norvegicus
cacggacttaatctgcagggccata

SEQ ID NO: 661124 - DNA, 25 bp, Rattus norvegicus
tgcgacaaccagcagctacacttga

SEQ ID NO: 661125 - DNA, 25 bp, Rattus norvegicus
acaaaccctgggacgcaagactgcg

SEQ ID NO: 661126 - DNA, 25 bp, Rattus norvegicus
cgtctagcctaacttcgtgcactta

SEQ ID NO: 661127 - DNA, 25 bp, Rattus norvegicus
gacacgcagtcttcgcttctcttta

SEQ ID NO: 661128 - DNA, 25 bp, Rattus norvegicus
agtccctagcgcagttttccttctg

SEQ ID NO: 661129 - DNA, 25 bp, Rattus norvegicus
gacgccatggctactactgctagtg

SEQ ID NO: 661130 - DNA, 25 bp, Rattus norvegicus
tttcctgatggtgcagcaaccgacc

SEQ ID NO: 661131 - DNA, 25 bp, Rattus norvegicus
aaccggcatgatcccgaagcctcgg

SEQ ID NO: 661132 - DNA, 25 bp, Rattus norvegicus
ggattcttttcgacctgagactgga

SEQ ID NO: 661133 - DNA, 25 bp, Rattus norvegicus
ctgctataaagcctcaaccggcatg

SEQ ID NO: 661134 - DNA, 25 bp, Rattus norvegicus
tcgtgcaaggaaaccgtgaggctgc

SEQ ID NO: 661135 - DNA, 25 bp, Rattus norvegicus
tgtgtatgagcgtgggcgcctacac

SEQ ID NO: 661136 - DNA, 25 bp, Rattus norvegicus
gaagatgcttctaccggtctggatc

SEQ ID NO: 661137 - DNA, 25 bp, Rattus norvegicus
cccttaggtcgtggctctgctataa

SEQ ID NO: 661138 - DNA, 25 bp, Rattus norvegicus
tgggcagcgtctatgccctcaagca

SEQ ID NO: 661139 - DNA, 25 bp, Rattus norvegicus
tcaagcaccatgcagctccttcttg

SEQ ID NO: 661140 - DNA, 25 bp, Rattus norvegicus
tcttgctctactggcgctggcttac

SEQ ID NO: 661141 - DNA, 25 bp, Rattus norvegicus
ctctactgaaggtaccctggggtga

SEQ ID NO: 661142 - DNA, 25 bp, Rattus norvegicus
gatccacggtccttttcgcaccttg

SEQ ID NO: 661143 - DNA, 25 bp, Rattus norvegicus
ctgcgcatggttcgtgcaaggaaac

SEQ ID NO: 661144 - DNA, 25 bp, Rattus norvegicus
cgcctacacgtgtccgcgggaggct

SEQ ID NO: 661145 - DNA, 25 bp, Rattus norvegicus
ggctgtagactgtacgcacagtgga

SEQ ID NO: 661146 - DNA, 25 bp, Rattus norvegicus
ccgactccgctaccgccagcgccta

SEQ ID NO: 661147 - DNA, 25 bp, Rattus norvegicus
cccgactcaggtctgactggctgta

SEQ ID NO: 661148 - DNA, 25 bp, Rattus norvegicus
gggttactagttccgagccagccca

SEQ ID NO: 661149 - DNA, 25 bp, Rattus norvegicus
cctagaggagcggagagtcagaatt

SEQ ID NO: 661150 - DNA, 25 bp, Rattus norvegicus
acgactcccagcatacccgactccg

SEQ ID NO: 661151 - DNA, 25 bp, Rattus norvegicus
cagtggagaatggactacgactccc

SEQ ID NO: 661152 - DNA, 25 bp, Rattus norvegicus
tacgcacagtggagaatggactacg

SEQ ID NO: 661153 - DNA, 25 bp, Rattus norvegicus
tctgactggctgtagactgtacgca

SEQ ID NO: 661154 - DNA, 25 bp, Rattus norvegicus
gctaagcctcctgggatggcgtacc

SEQ ID NO: 661155 - DNA, 25 bp, Rattus norvegicus
caagagcgctaagcctcctgggatg

SEQ ID NO: 661156 - DNA, 25 bp, Rattus norvegicus
cgagccagcccaacaagagcgctaa

SEQ ID NO: 661157 - DNA, 25 bp, Rattus norvegicus
agttccgagccagcccaacaagagc

SEQ ID NO: 661158 - DNA, 25 bp, Rattus norvegicus
agagtcagaattcccggcgctgggc

SEQ ID NO: 661159 - DNA, 25 bp, Rattus norvegicus
ccaaaactgtaacctggcgctggtg

SEQ ID NO: 661160 - DNA, 25 bp, Rattus norvegicus
tctcaggtcacaagcaccctcggaa

SEQ ID NO: 661161 - DNA, 25 bp, Rattus norvegicus
gcaggggttaatgccagtcccgccc

SEQ ID NO: 661162 - DNA, 25 bp, Rattus norvegicus
aagaggcagccaatcgtccgcgcac

SEQ ID NO: 661163 - DNA, 25 bp, Rattus norvegicus
tttggcggacatccgctctgtgttg

SEQ ID NO: 661164 - DNA, 25 bp, Rattus norvegicus
cgccactacccgagctgatcaggtg

SEQ ID NO: 661165 - DNA, 25 bp, Rattus norvegicus
gatcaggtgcgtctcttgtgtctcc

SEQ ID NO: 661166 - DNA, 25 bp, Rattus norvegicus
aggcccgcactgtgaaggtgactcc

SEQ ID NO: 661167 - DNA, 25 bp, Rattus norvegicus
cgcaggccagcatctctacggtctg

SEQ ID NO: 661168 - DNA, 25 bp, Rattus norvegicus
ctacggtctgcgtatggctcctttg

SEQ ID NO: 661169 - DNA, 25 bp, Rattus norvegicus
tccagggcactgagaccgagctgcc

SEQ ID NO: 661170 - DNA, 25 bp, Rattus norvegicus
gagccgcctgcttgaaccgctttac

SEQ ID NO: 661171 - DNA, 25 bp, Rattus norvegicus
aagcttcagtcagcaacggggccac

SEQ ID NO: 661172 - DNA, 25 bp, Rattus norvegicus
gccggcttttgtgttggacaccgaa

SEQ ID NO: 661173 - DNA, 25 bp, Rattus norvegicus
cacgcatttgatgcccagctccgga

SEQ ID NO: 661174 - DNA, 25 bp, Rattus norvegicus
aatctgtccaagctgggcacgcccg

SEQ ID NO: 661175 - DNA, 25 bp, Rattus norvegicus
gctgacaatctgtccaagctgggca

SEQ ID NO: 661176 - DNA, 25 bp, Rattus norvegicus
cgcagccggacgctgacaatctgtc

SEQ ID NO: 661177 - DNA, 25 bp, Rattus norvegicus
atttgatgcccagctccggaggggc

SEQ ID NO: 661178 - DNA, 25 bp, Rattus norvegicus
accagcacgcatttgatgcccagct

SEQ ID NO: 661179 - DNA, 25 bp, Rattus norvegicus
tgcccaccgcgccatcgcccaccag

SEQ ID NO: 661180 - DNA, 25 bp, Rattus norvegicus
gatgaggctgctcttgcccaccgcg

SEQ ID NO: 661181 - DNA, 25 bp, Rattus norvegicus
ctgacgatgaggctgctcttgccca

SEQ ID NO: 661182 - DNA, 25 bp, Rattus norvegicus
tgtagctgacgatgaggctgctctt

SEQ ID NO: 661183 - DNA, 25 bp, Rattus norvegicus
ccattgcaggtgtagctgacgatga

SEQ ID NO: 661184 - DNA, 25 bp, Rattus norvegicus
gggtatccattgcaggtgtagctga

SEQ ID NO: 661185 - DNA, 25 bp, Rattus norvegicus
atagcgcgaggggtatccattgcag

SEQ ID NO: 661186 - DNA, 25 bp, Rattus norvegicus
gcaggttccgcagccggacgctgac

SEQ ID NO: 661187 - DNA, 25 bp, Rattus norvegicus
agcatcgctacctggagagcgcccg

SEQ ID NO: 661188 - DNA, 25 bp, Rattus norvegicus
acgggtcacctctgggcctacactg

SEQ ID NO: 661189 - DNA, 25 bp, Rattus norvegicus
ctgggcctacactgagcgagcagtc

SEQ ID NO: 661190 - DNA, 25 bp, Rattus norvegicus
gcgagcagtcttccgataccacgtg

SEQ ID NO: 661191 - DNA, 25 bp, Rattus norvegicus
ataccacgtgcaacgtgaggctcgg

SEQ ID NO: 661192 - DNA, 25 bp, Rattus norvegicus
tgtctggcgcacctacctggacatg

SEQ ID NO: 661193 - DNA, 25 bp, Rattus norvegicus
cctggacatgaaccgctttgacctg

SEQ ID NO: 661194 - DNA, 25 bp, Rattus norvegicus
tttgacctggccaaagagtattgtc

SEQ ID NO: 661195 - DNA, 25 bp, Rattus norvegicus
caaagagtattgtcgcgagcggcca

SEQ ID NO: 661196 - DNA, 25 bp, Rattus norvegicus
cgagcggccagattgcctagacaca

SEQ ID NO: 661197 - DNA, 25 bp, Rattus norvegicus
gccagattgcctagacacagtcctg

SEQ ID NO: 661198 - DNA, 25 bp, Rattus norvegicus
cagtcctggcccgagaggctgattt

SEQ ID NO: 661199 - DNA, 25 bp, Rattus norvegicus
gctttcgtcagcatcgctacctgga

SEQ ID NO: 661200 - DNA, 25 bp, Rattus norvegicus
gagaggctgatttctgctttcgtca

SEQ ID NO: 661201 - DNA, 25 bp, Rattus norvegicus
agtatcctcgtctctacccgggtgc

SEQ ID NO: 661202 - DNA, 25 bp, Rattus norvegicus
ggcgctgcttgctaagcgggaaacc

SEQ ID NO: 661203 - DNA, 25 bp, Rattus norvegicus
agcagtgtctctcaaggcttaagtg

SEQ ID NO: 661204 - DNA, 25 bp, Rattus norvegicus
cagccatgtggcagcaacagtttgc

SEQ ID NO: 661205 - DNA, 25 bp, Rattus norvegicus
acgcgccggcctcatttcaatgtga

SEQ ID NO: 661206 - DNA, 25 bp, Rattus norvegicus
cggcgcctcagtgactagagtagtt

SEQ ID NO: 661207 - DNA, 25 bp, Rattus norvegicus
gtccgagaatctgcggcgcctcagt

SEQ ID NO: 661208 - DNA, 25 bp, Rattus norvegicus
cactcctaaaagcagggccaaggtc

SEQ ID NO: 661209 - DNA, 25 bp, Rattus norvegicus
gggcctttctgtcggttcactccta

SEQ ID NO: 661210 - DNA, 25 bp, Rattus norvegicus
ctctgaaaccgttcgtcttgggcct

SEQ ID NO: 661211 - DNA, 25 bp, Rattus norvegicus
tgtgccaggtccagatcgctgtccc

SEQ ID NO: 661212 - DNA, 25 bp, Rattus norvegicus
cgggaagctgctgcattaaattgta

SEQ ID NO: 661213 - DNA, 25 bp, Rattus norvegicus
ataacaccgcgctggaggtctcgga

SEQ ID NO: 661214 - DNA, 25 bp, Rattus norvegicus
aatcgatttattgaccggcaggtgc

SEQ ID NO: 661215 - DNA, 25 bp, Rattus norvegicus
cgagcagcggagttttcgagaaagc

SEQ ID NO: 661216 - DNA, 25 bp, Rattus norvegicus
caacgagcgcggtatgctggccaat

SEQ ID NO: 661217 - DNA, 25 bp, Rattus norvegicus
ccggcatcttccagttgcggctgca

SEQ ID NO: 661218 - DNA, 25 bp, Rattus norvegicus
ggccgcaggtaatgtcccgcgtcct

SEQ ID NO: 661219 - DNA, 25 bp, Rattus norvegicus
gagcgacatcccaacaagcagattc

SEQ ID NO: 661220 - DNA, 25 bp, Rattus norvegicus
gcgtcccgagaggaatcagcttttc

SEQ ID NO: 661221 - DNA, 25 bp, Rattus norvegicus
cctggattacctaccgaggcatcga

SEQ ID NO: 661222 - DNA, 25 bp, Rattus norvegicus
ggacacgtacttagagcagccaccg

SEQ ID NO: 661223 - DNA, 25 bp, Rattus norvegicus
cctaggatttgctccaggacacgta

SEQ ID NO: 661224 - DNA, 25 bp, Rattus norvegicus
agcccgcttgagaccctaggatttg

SEQ ID NO: 661225 - DNA, 25 bp, Rattus norvegicus
ggtgcagtgtactcccgcactagcc

SEQ ID NO: 661226 - DNA, 25 bp, Rattus norvegicus
gccaaagcctcttgggtgcagtgta

SEQ ID NO: 661227 - DNA, 25 bp, Rattus norvegicus
ccgtggccaagagccgcagccaaag

SEQ ID NO: 661228 - DNA, 25 bp, Rattus norvegicus
gcttttcaggaactcggttggcaga

SEQ ID NO: 661229 - DNA, 25 bp, Rattus norvegicus
ctgcctggactcagagcacaattgc

SEQ ID NO: 661230 - DNA, 25 bp, Rattus norvegicus
tgcgcctcgcgctggacgctcggat

SEQ ID NO: 661231 - DNA, 25 bp, Rattus norvegicus
tggacgctcggattccgctcactgc

SEQ ID NO: 661232 - DNA, 25 bp, Rattus norvegicus
cctgcggccaggtgagtatctaact

SEQ ID NO: 661233 - DNA, 25 bp, Rattus norvegicus
attccgctcactgcctggactcaga

SEQ ID NO: 661234 - DNA, 25 bp, Rattus norvegicus
ttagcttggcccgagctgcgcctcg

SEQ ID NO: 661235 - DNA, 25 bp, Rattus norvegicus
caggacgcttagcttggcccgagct

SEQ ID NO: 661236 - DNA, 25 bp, Rattus norvegicus
agagttaatcagttctaggtggggt

SEQ ID NO: 661237 - DNA, 25 bp, Rattus norvegicus
gcgccgaaagagttaatcagttcta

SEQ ID NO: 661238 - DNA, 25 bp, Rattus norvegicus
tcacacagcgccgaaagagttaatc

SEQ ID NO: 661239 - DNA, 25 bp, Rattus norvegicus
ggggcgacatcacacagcgccgaaa

SEQ ID NO: 661240 - DNA, 25 bp, Rattus norvegicus
ctaactaactcctcagccacagggg

SEQ ID NO: 661241 - DNA, 25 bp, Rattus norvegicus
cggccaggtgagtatctaactaact

SEQ ID NO: 661242 - DNA, 25 bp, Rattus norvegicus
cagagcacaattgcgtttcctgcgg

SEQ ID NO: 661243 - DNA, 25 bp, Rattus norvegicus
gtggtcgccagacactagagggcgc

SEQ ID NO: 661244 - DNA, 25 bp, Rattus norvegicus
ttgttacagctcgacttcctgtttg

SEQ ID NO: 661245 - DNA, 25 bp, Rattus norvegicus
ttccactgtggcctagaccggattg

SEQ ID NO: 661246 - DNA, 25 bp, Rattus norvegicus
actgtggcctagaccggattgggca

SEQ ID NO: 661247 - DNA, 25 bp, Rattus norvegicus
gcccgccagggtcagccctccacct

SEQ ID NO: 661248 - DNA, 25 bp, Rattus norvegicus
gccctctgctctttgttacagctcg

SEQ ID NO: 661249 - DNA, 25 bp, Rattus norvegicus
ctgctctttgttacagctcgacttc

SEQ ID NO: 661250 - DNA, 25 bp, Rattus norvegicus
acagctcgacttcctgtttgtggtc

SEQ ID NO: 661251 - DNA, 25 bp, Rattus norvegicus
cgacttcctgtttgtggtcgccgac

SEQ ID NO: 661252 - DNA, 25 bp, Rattus norvegicus
ggaagccgctgaaggccacgagttt

SEQ ID NO: 661253 - DNA, 25 bp, Rattus norvegicus
cgctgaaggccacgagtttctcggg

SEQ ID NO: 661254 - DNA, 25 bp, Rattus norvegicus
ggccacgagtttctcggggacactc

SEQ ID NO: 661255 - DNA, 25 bp, Rattus norvegicus
ttctcggggacactcccactgggtc

SEQ ID NO: 661256 - DNA, 25 bp, Rattus norvegicus
gagtttctcggggacactcccactg

SEQ ID NO: 661257 - DNA, 25 bp, Rattus norvegicus
gcgcggttaaccgagaagcaacatc

SEQ ID NO: 661258 - DNA, 25 bp, Rattus norvegicus
gcccggcaccatgaagcaggagtcc

SEQ ID NO: 661259 - DNA, 25 bp, Rattus norvegicus
cggcggagacaacggtcagaccatt

SEQ ID NO: 661260 - DNA, 25 bp, Rattus norvegicus
tcactcctgctaggtctgccatgga

SEQ ID NO: 661261 - DNA, 25 bp, Rattus norvegicus
gactttgcctacagcgacagccgtg

SEQ ID NO: 661262 - DNA, 25 bp, Rattus norvegicus
caagccctgtggattttcgggtacg

SEQ ID NO: 661263 - DNA, 25 bp, Rattus norvegicus
cactcagctggaacgaccgatcggt

SEQ ID NO: 661264 - DNA, 25 bp, Rattus norvegicus
ccaatcaccgggacagctggaggca

SEQ ID NO: 661265 - DNA, 25 bp, Rattus norvegicus
gccgaaccaatcagcacgcgcgttg

SEQ ID NO: 661266 - DNA, 25 bp, Rattus norvegicus
gggaaaccttctccgccgttgcatc

SEQ ID NO: 661267 - DNA, 25 bp, Rattus norvegicus
gcacccttgctgcatgccagttctg

SEQ ID NO: 661268 - DNA, 25 bp, Rattus norvegicus
gtacccgcagcctgacgcaatctta

SEQ ID NO: 661269 - DNA, 25 bp, Rattus norvegicus
tcagaccattgacagggccttgcgg

SEQ ID NO: 661270 - DNA, 25 bp, Rattus norvegicus
tagtgtggaagcctgactttgccta

SEQ ID NO: 661271 - DNA, 25 bp, Rattus norvegicus
gcgcgcggcccaagtgagtcaaaac

SEQ ID NO: 661272 - DNA, 25 bp, Rattus norvegicus
tagcacataaacgtcggccgaaagc

SEQ ID NO: 661273 - DNA, 25 bp, Rattus norvegicus
gcgctcatagaacgcaggagctgta

SEQ ID NO: 661274 - DNA, 25 bp, Rattus norvegicus
acgcaggagctgtaagtgacaacga

SEQ ID NO: 661275 - DNA, 25 bp, Rattus norvegicus
cgtcggccgaaagccgaagaactgg

SEQ ID NO: 661276 - DNA, 25 bp, Rattus norvegicus
ccaagtgagtcaaaacgcgtctctc

SEQ ID NO: 661277 - DNA, 25 bp, Rattus norvegicus
tgggcacatagcacataaacgtcgg

SEQ ID NO: 661278 - DNA, 25 bp, Rattus norvegicus
ccagcaccgggctgggcacatagca

SEQ ID NO: 661279 - DNA, 25 bp, Rattus norvegicus
tcacctgtgtctcctaccgaagcca

SEQ ID NO: 661280 - DNA, 25 bp, Rattus norvegicus
tgtaagtgacaacgagagcggcttc

SEQ ID NO: 661281 - DNA, 25 bp, Rattus norvegicus
acaagaccggcgctcatagaacgca

SEQ ID NO: 661282 - DNA, 25 bp, Rattus norvegicus
ctacttcggggttctgcggcgctgt

SEQ ID NO: 661283 - DNA, 25 bp, Rattus norvegicus
caaaacgcgtctctcggtgcgagga

SEQ ID NO: 661284 - DNA, 25 bp, Rattus norvegicus
aacgagagcggcttcaccgcgggcc

SEQ ID NO: 661285 - DNA, 25 bp, Rattus norvegicus
tgacccgaggcccaggactgttccg

SEQ ID NO: 661286 - DNA, 25 bp, Rattus norvegicus
ctcagcgctccgctggccaagaggg

SEQ ID NO: 661287 - DNA, 25 bp, Rattus norvegicus
gagcgcaccggcaatggccagccag

SEQ ID NO: 661288 - DNA, 25 bp, Rattus norvegicus
ctgccctcgatattcccacggctgg

SEQ ID NO: 661289 - DNA, 25 bp, Rattus norvegicus
tggcctctcggtccttcgccaagca

SEQ ID NO: 661290 - DNA, 25 bp, Rattus norvegicus
acacgaaaggtctaacaagtgcggc

SEQ ID NO: 661291 - DNA, 25 bp, Rattus norvegicus
ggtctaacaagtgcggcttctgccc

SEQ ID NO: 661292 - DNA, 25 bp, Rattus norvegicus
ccaccttggaagattcggggaatgt

SEQ ID NO: 661293 - DNA, 25 bp, Rattus norvegicus
tccatgccgagtcacgtgacgcgct

SEQ ID NO: 661294 - DNA, 25 bp, Rattus norvegicus
gcccaggactgttccgggtaatggc

SEQ ID NO: 661295 - DNA, 25 bp, Rattus norvegicus
cggcctcgcctcacgtaacgcgtca

SEQ ID NO: 661296 - DNA, 25 bp, Rattus norvegicus
gtaacgcgtcatcctcatcttcccg

SEQ ID NO: 661297 - DNA, 25 bp, Rattus norvegicus
tggccgagacccaccttggaagatt

SEQ ID NO: 661298 - DNA, 25 bp, Rattus norvegicus
ctgttccgggtaatggccgcccgag

SEQ ID NO: 661299 - DNA, 25 bp, Rattus norvegicus
gaccgtagcggcactgtcggtggac

SEQ ID NO: 661300 - DNA, 25 bp, Rattus norvegicus
tggacacgggctagcgactagcagt

SEQ ID NO: 661301 - DNA, 25 bp, Rattus norvegicus
gtacaagctgcacggggccgaccgt

SEQ ID NO: 661302 - DNA, 25 bp, Rattus norvegicus
cagatagtatagatgagggtctccc

SEQ ID NO: 661303 - DNA, 25 bp, Rattus norvegicus
ccgaccaatctgcactcagatagta

SEQ ID NO: 661304 - DNA, 25 bp, Rattus norvegicus
tttcggcaatcttcgccagtcccag

SEQ ID NO: 661305 - DNA, 25 bp, Rattus norvegicus
gtcgcctttcggcaatcttcgccag

SEQ ID NO: 661306 - DNA, 25 bp, Rattus norvegicus
ttgctcactccagcgatgacatcct

SEQ ID NO: 661307 - DNA, 25 bp, Rattus norvegicus
ctgcttgctcactccagcgatgaca

SEQ ID NO: 661308 - DNA, 25 bp, Rattus norvegicus
gagatctgcttgctcactccagcga

SEQ ID NO: 661309 - DNA, 25 bp, Rattus norvegicus
tttcctcccgcgagatctgcttgct

SEQ ID NO: 661310 - DNA, 25 bp, Rattus norvegicus
gcgacatttcctcccgcgagatctg

SEQ ID NO: 661311 - DNA, 25 bp, Rattus norvegicus
agtaacctttcttaggcggttgcag

SEQ ID NO: 661312 - DNA, 25 bp, Rattus norvegicus
cacgggctagcgactagcagtgagc

SEQ ID NO: 661313 - DNA, 25 bp, Rattus norvegicus
cggctgattcattccgggcacgagc

SEQ ID NO: 661314 - DNA, 25 bp, Rattus norvegicus
gccaccgtggtattgtcgctttaag

SEQ ID NO: 661315 - DNA, 25 bp, Rattus norvegicus
tattgtcgctttaaggccggcggca

SEQ ID NO: 661316 - DNA, 25 bp, Rattus norvegicus
gcacgagcgccaagctttgacgtta

SEQ ID NO: 661317 - DNA, 25 bp, Rattus norvegicus
aagctttgacgttagcgcctgcgca

SEQ ID NO: 661318 - DNA, 25 bp, Rattus norvegicus
gcagggcgcggcctcactccggatt

SEQ ID NO: 661319 - DNA, 25 bp, Rattus norvegicus
actccggattggctggtgtcggtcc

SEQ ID NO: 661320 - DNA, 25 bp, Rattus norvegicus
ggcctcagtaatgacagcggttgtc

SEQ ID NO: 661321 - DNA, 25 bp, Rattus norvegicus
gctcccgtcacggtgatggggtctc

SEQ ID NO: 661322 - DNA, 25 bp, Rattus norvegicus
cctccacgttactgcgggacgaaga

SEQ ID NO: 661323 - DNA, 25 bp, Rattus norvegicus
gacgaagagctcgaggagatcaaga

SEQ ID NO: 661324 - DNA, 25 bp, Rattus norvegicus
caagaaggagactggctgtgagttc

SEQ ID NO: 661325 - DNA, 25 bp, Rattus norvegicus
ggtgcctacggctggcctcagtaat

SEQ ID NO: 661326 - DNA, 25 bp, Rattus norvegicus
ggccgcaggagaaacagtgccctct

SEQ ID NO: 661327 - DNA, 25 bp, Rattus norvegicus
cgagcaaggtgctgtccaatcagca

SEQ ID NO: 661328 - DNA, 25 bp, Rattus norvegicus
gcgttctttccctacgggcgctcca

SEQ ID NO: 661329 - DNA, 25 bp, Rattus norvegicus
ggcggacaggagaaggagcgaagat

SEQ ID NO: 661330 - DNA, 25 bp, Rattus norvegicus
ccgcggggagcggaatacttgtcct

SEQ ID NO: 661331 - DNA, 25 bp, Rattus norvegicus
agcggaatacttgtcctggactgtg

SEQ ID NO: 661332 - DNA, 25 bp, Rattus norvegicus
acttgtcctggactgtgtgaggtga

SEQ ID NO: 661333 - DNA, 25 bp, Rattus norvegicus
gccgtctgtctaccgggcgacgagc

SEQ ID NO: 661334 - DNA, 25 bp, Rattus norvegicus
tttccattagcagccgggtcctctc

SEQ ID NO: 661335 - DNA, 25 bp, Rattus norvegicus
tagcggcgagcctgatgagagagcc

SEQ ID NO: 661336 - DNA, 25 bp, Rattus norvegicus
gggctttccattagcagccgggtcc

SEQ ID NO: 661337 - DNA, 25 bp, Rattus norvegicus
cgctccacgcccttccttgtgccct

SEQ ID NO: 661338 - DNA, 25 bp, Rattus norvegicus
gcgcgcgagcaaggtgctgtccaat

SEQ ID NO: 661339 - DNA, 25 bp, Rattus norvegicus
acgagcagccggtggggcggcacaa

SEQ ID NO: 661340 - DNA, 25 bp, Rattus norvegicus
tgctgtccaatcagcaccatgaggc

SEQ ID NO: 661341 - DNA, 25 bp, Rattus norvegicus
tgtcgccgagcaccgcgtagcaact

SEQ ID NO: 661342 - DNA, 25 bp, Rattus norvegicus
tagcaactcgcgcaatgaaacaccg

SEQ ID NO: 661343 - DNA, 25 bp, Rattus norvegicus
aatgaaacaccgcacatctctccgg

SEQ ID NO: 661344 - DNA, 25 bp, Rattus norvegicus
gcaggtcgacaggtgacgccttcac

SEQ ID NO: 661345 - DNA, 25 bp, Rattus norvegicus
acctcagacccggaagacccgagag

SEQ ID NO: 661346 - DNA, 25 bp, Rattus norvegicus
gagtgtcccactccatggaggaaga

SEQ ID NO: 661347 - DNA, 25 bp, Rattus norvegicus
ggtgtatcacaagagccactacagg

SEQ ID NO: 661348 - DNA, 25 bp, Rattus norvegicus
cactacaggactgggtctcgacgac

SEQ ID NO: 661349 - DNA, 25 bp, Rattus norvegicus
actgggtctcgacgacagggagacc

SEQ ID NO: 661350 - DNA, 25 bp, Rattus norvegicus
ccgcgcggcgaaagagtcgccattt

SEQ ID NO: 661351 - DNA, 25 bp, Rattus norvegicus
cgaggtgcacagtgtcgccgagcac

SEQ ID NO: 661352 - DNA, 25 bp, Rattus norvegicus
cggcgaaagagtcgccatttttcga

SEQ ID NO: 661353 - DNA, 25 bp, Rattus norvegicus
tcgataggtcccaggcgaggtgcac

SEQ ID NO: 661354 - DNA, 25 bp, Rattus norvegicus
gccgaggaacttcgataggtcccag

SEQ ID NO: 661355 - DNA, 25 bp, Rattus norvegicus
cgcgcatgcgcggtcgcctttgtgt

SEQ ID NO: 661356 - DNA, 25 bp, Rattus norvegicus
atacggaagacagcggcagcgacga

SEQ ID NO: 661357 - DNA, 25 bp, Rattus norvegicus
gcagcgacgagaacctggatcaggt

SEQ ID NO: 661358 - DNA, 25 bp, Rattus norvegicus
gttgtccggtcctctgctgtagtcc

SEQ ID NO: 661359 - DNA, 25 bp, Rattus norvegicus
caccatggtaaagaagcggaaaggc

SEQ ID NO: 661360 - DNA, 25 bp, Rattus norvegicus
gtcctctgctgtagtcccttcctgt

SEQ ID NO: 661361 - DNA, 25 bp, Rattus norvegicus
cttcctgtctctccgctgaatctta

SEQ ID NO: 661362 - DNA, 25 bp, Rattus norvegicus
cgctgaatcttaggccctgggaacc

SEQ ID NO: 661363 - DNA, 25 bp, Rattus norvegicus
gatcggggcgtcatgacttaaggcc

SEQ ID NO: 661364 - DNA, 25 bp, Rattus norvegicus
cgtcatgacttaaggccgggagatt

SEQ ID NO: 661365 - DNA, 25 bp, Rattus norvegicus
acttaaggccgggagattcaggctg

SEQ ID NO: 661366 - DNA, 25 bp, Rattus norvegicus
ctgggcgagataggaagtatcgccc

SEQ ID NO: 661367 - DNA, 25 bp, Rattus norvegicus
gatcgactcggatacggaagacagc

SEQ ID NO: 661368 - DNA, 25 bp, Rattus norvegicus
ggaaaggccgtgtcgtgatcgactc

SEQ ID NO: 661369 - DNA, 25 bp, Rattus norvegicus
tccgcgggcatacctgggtaactgt

SEQ ID NO: 661370 - DNA, 25 bp, Rattus norvegicus
atcagagccgggtagtcttaccctg

SEQ ID NO: 661371 - DNA, 25 bp, Rattus norvegicus
cctcgtcgctgctcgaggactcgga

SEQ ID NO: 661372 - DNA, 25 bp, Rattus norvegicus
gtagctgagcgcttgggcgtctaaa

SEQ ID NO: 661373 - DNA, 25 bp, Rattus norvegicus
agagggacccaggacgacctctcgc

SEQ ID NO: 661374 - DNA, 25 bp, Rattus norvegicus
cggcaacgtgcagctggaaaccagc

SEQ ID NO: 661375 - DNA, 25 bp, Rattus norvegicus
gacgacctgctgagcgacagcgaga

SEQ ID NO: 661376 - DNA, 25 bp, Rattus norvegicus
tcactgtgacaagcgaggaggatgt

SEQ ID NO: 661377 - DNA, 25 bp, Rattus norvegicus
cggtgatcccgcagctcactgtgac

SEQ ID NO: 661378 - DNA, 25 bp, Rattus norvegicus
ggacaagtgcctaacgggctcccgc

SEQ ID NO: 661379 - DNA, 25 bp, Rattus norvegicus
tgcgcctgctcttcgaagcgcgctg

SEQ ID NO: 661380 - DNA, 25 bp, Rattus norvegicus
gttgccacggtttccctctcctgag

SEQ ID NO: 661381 - DNA, 25 bp, Rattus norvegicus
aaaggggcgcgtgagcttttctctc

SEQ ID NO: 661382 - DNA, 25 bp, Rattus norvegicus
gtcgggagatgaccctgcccggaca

SEQ ID NO: 661383 - DNA, 25 bp, Rattus norvegicus
ttccctgtgcgcagctatggggcca

SEQ ID NO: 661384 - DNA, 25 bp, Rattus norvegicus
gctcaggtcgcctcctgtaggacct

SEQ ID NO: 661385 - DNA, 25 bp, Rattus norvegicus
atcctgcgggaagaggctcaaggtc

SEQ ID NO: 661386 - DNA, 25 bp, Rattus norvegicus
aaagaagggcctgggacactcaact

SEQ ID NO: 661387 - DNA, 25 bp, Rattus norvegicus
gaggcgacagcacccagtgcaccta

SEQ ID NO: 661388 - DNA, 25 bp, Rattus norvegicus
ccagtgcacctacccggaagatgta

SEQ ID NO: 661389 - DNA, 25 bp, Rattus norvegicus
tttcgctcccatcagtcgtttcatg

SEQ ID NO: 661390 - DNA, 25 bp, Rattus norvegicus
ttctcccagacaaacgagctggctc

SEQ ID NO: 661391 - DNA, 25 bp, Rattus norvegicus
cctgggtggcaccaaggtgaaacgc

SEQ ID NO: 661392 - DNA, 25 bp, Rattus norvegicus
caaggtgaaacgctgggtggcacca

SEQ ID NO: 661393 - DNA, 25 bp, Rattus norvegicus
tggcaccaaggggaccagggactct

SEQ ID NO: 661394 - DNA, 25 bp, Rattus norvegicus
cgcttactccgggacaggcgtcctg

SEQ ID NO: 661395 - DNA, 25 bp, Rattus norvegicus
aactgccgagaggaagatgccgtgc

SEQ ID NO: 661396 - DNA, 25 bp, Rattus norvegicus
cccttacacctgtgaagcgacagca

SEQ ID NO: 661397 - DNA, 25 bp, Rattus norvegicus
cagggagcgaagcaggtcctccgta

SEQ ID NO: 661398 - DNA, 25 bp, Rattus norvegicus
gcggctcgctgaagaacatgaatca

SEQ ID NO: 661399 - DNA, 25 bp, Rattus norvegicus
gaagcaggtcctccgtagcggcagc

SEQ ID NO: 661400 - DNA, 25 bp, Rattus norvegicus
cgaggttagcgctcggctttcgaca

SEQ ID NO: 661401 - DNA, 25 bp, Rattus norvegicus
ttagcgctcggctttcgacaccggg

SEQ ID NO: 661402 - DNA, 25 bp, Rattus norvegicus
cggcggctcgctgaagaacatgaat

SEQ ID NO: 661403 - DNA, 25 bp, Rattus norvegicus
aagaacatgaatcagcggcggcggc

SEQ ID NO: 661404 - DNA, 25 bp, Rattus norvegicus
ctgtggaaggagcacggtggcccag

SEQ ID NO: 661405 - DNA, 25 bp, Rattus norvegicus
actcctcgctgctgacggcggtggc

SEQ ID NO: 661406 - DNA, 25 bp, Rattus norvegicus
gggctgataagtggcacggctgagg

SEQ ID NO: 661407 - DNA, 25 bp, Rattus norvegicus
ctggaaggccgaagctaggacgcag

SEQ ID NO: 661408 - DNA, 25 bp, Rattus norvegicus
tgtgggctgacagacctccggccgc

SEQ ID NO: 661409 - DNA, 25 bp, Rattus norvegicus
ccaactttctcgcgtccggggctgg

SEQ ID NO: 661410 - DNA, 25 bp, Rattus norvegicus
tcggctttcgacaccggggctgcgc

SEQ ID NO: 661411 - DNA, 25 bp, Rattus norvegicus
cggctcgcgagcctgtgatttcgag

SEQ ID NO: 661412 - DNA, 25 bp, Rattus norvegicus
acagtcgcctagcaggggcaacgtt

SEQ ID NO: 661413 - DNA, 25 bp, Rattus norvegicus
tatgccggtaggtgtgagcattctt

SEQ ID NO: 661414 - DNA, 25 bp, Rattus norvegicus
ggcaaaatggctgctggaaacagtc

SEQ ID NO: 661415 - DNA, 25 bp, Rattus norvegicus
cggacgacaagttctcggcaaaatg

SEQ ID NO: 661416 - DNA, 25 bp, Rattus norvegicus
cgggccctcactgtctgagcgcttt

SEQ ID NO: 661417 - DNA, 25 bp, Rattus norvegicus
acagcctatcgcaggccgaggttca

SEQ ID NO: 661418 - DNA, 25 bp, Rattus norvegicus
cagtatcatgaattcggcgcgaggc

SEQ ID NO: 661419 - DNA, 25 bp, Rattus norvegicus
cttcgagcaccgtgccaggtgatta

SEQ ID NO: 661420 - DNA, 25 bp, Rattus norvegicus
gtcactttcggtgccgcttcgagca

SEQ ID NO: 661421 - DNA, 25 bp, Rattus norvegicus
cccttgcgcgtgcaagtcactttcg

SEQ ID NO: 661422 - DNA, 25 bp, Rattus norvegicus
aaggaggtctagtgaccacgctccc

SEQ ID NO: 661423 - DNA, 25 bp, Rattus norvegicus
gagcattcttggtttcgggaccctg

SEQ ID NO: 661424 - DNA, 25 bp, Rattus norvegicus
ttgtcacgcgctccgttagtcctca

SEQ ID NO: 661425 - DNA, 25 bp, Rattus norvegicus
ggaacccaagggtcctgacgctgct

SEQ ID NO: 661426 - DNA, 25 bp, Rattus norvegicus
ggcacgttctgcgtgacggtttcta

SEQ ID NO: 661427 - DNA, 25 bp, Rattus norvegicus
tcccttgagcgagttgcgcatgtca

SEQ ID NO: 661428 - DNA, 25 bp, Rattus norvegicus
aggctgtgcagcctttggtcccttg

SEQ ID NO: 661429 - DNA, 25 bp, Rattus norvegicus
cgttccgcagagagagagcttcgca

SEQ ID NO: 661430 - DNA, 25 bp, Rattus norvegicus
aacggcttgaccagcgttccgcaga

SEQ ID NO: 661431 - DNA, 25 bp, Rattus norvegicus
ccacttgtgtatttgaacggcttga

SEQ ID NO: 661432 - DNA, 25 bp, Rattus norvegicus
gcgtcgcttcaatagtggcccgatt

SEQ ID NO: 661433 - DNA, 25 bp, Rattus norvegicus
gtgttggaacagcatggcacgttct

SEQ ID NO: 661434 - DNA, 25 bp, Rattus norvegicus
aggctgttctgctgaagcggacaca

SEQ ID NO: 661435 - DNA, 25 bp, Rattus norvegicus
tactaaaacgtgtacaggctgcggc

SEQ ID NO: 661436 - DNA, 25 bp, Rattus norvegicus
gtgtcgctccgagaactaactagga

SEQ ID NO: 661437 - DNA, 25 bp, Rattus norvegicus
actaggaacatcgacgccggagacc

SEQ ID NO: 661438 - DNA, 25 bp, Rattus norvegicus
cacggtgtgcgaacccttcagaata

SEQ ID NO: 661439 - DNA, 25 bp, Rattus norvegicus
aggcatttcccgcaggcctaccgtg

SEQ ID NO: 661440 - DNA, 25 bp, Rattus norvegicus
cacacagatccggaggcagacgcga

SEQ ID NO: 661441 - DNA, 25 bp, Rattus norvegicus
gaggcactgggtgcgagttcctaaa

SEQ ID NO: 661442 - DNA, 25 bp, Rattus norvegicus
cagcggaccctgactcgagggctac

SEQ ID NO: 661443 - DNA, 25 bp, Rattus norvegicus
aggagatcggccgtaccttgtagta

SEQ ID NO: 661444 - DNA, 25 bp, Rattus norvegicus
aacgtcgaactggatattctccggc

SEQ ID NO: 661445 - DNA, 25 bp, Rattus norvegicus
tattctccggcaaggagcggatgtc

SEQ ID NO: 661446 - DNA, 25 bp, Rattus norvegicus
cgagcggatgtagttgtccacgaca

SEQ ID NO: 661447 - DNA, 25 bp, Rattus norvegicus
ttgtagagcgtctccgggatccact

SEQ ID NO: 661448 - DNA, 25 bp, Rattus norvegicus
cctccgtagcgaacccgtgtgtgag

SEQ ID NO: 661449 - DNA, 25 bp, Rattus norvegicus
gacgaacgcagagcacgaccgaacc

SEQ ID NO: 661450 - DNA, 25 bp, Rattus norvegicus
gagagcctcacattcccaacagaag

SEQ ID NO: 661451 - DNA, 25 bp, Rattus norvegicus
agaacgagcccagttccgtccaggc

SEQ ID NO: 661452 - DNA, 25 bp, Rattus norvegicus
gatggccagtagcactcgcacaaga

SEQ ID NO: 661453 - DNA, 25 bp, Rattus norvegicus
tactgcacgtgcatgcctgcgctcg

SEQ ID NO: 661454 - DNA, 25 bp, Rattus norvegicus
agctctcattactgcacgtgcatgc

SEQ ID NO: 661455 - DNA, 25 bp, Rattus norvegicus
ctctcattactgcacgtgcatgcct

SEQ ID NO: 661456 - DNA, 25 bp, Rattus norvegicus
cagctctcattactgcacgtgcatg

SEQ ID NO: 661457 - DNA, 25 bp, Rattus norvegicus
cgctcgcagctcattactgcacatg

SEQ ID NO: 661458 - DNA, 25 bp, Rattus norvegicus
tgctcgcagctctcattactgcacg

SEQ ID NO: 661459 - DNA, 25 bp, Rattus norvegicus
ctgcacgtgcatgcctgtgctcgca

SEQ ID NO: 661460 - DNA, 25 bp, Rattus norvegicus
gcagctctcattactgcactgcatg

SEQ ID NO: 661461 - DNA, 25 bp, Rattus norvegicus
gctcgcagctctcattactgcactg

SEQ ID NO: 661462 - DNA, 25 bp, Rattus norvegicus
tgcgctcgcagctcattactgcaca

SEQ ID NO: 661463 - DNA, 25 bp, Rattus norvegicus
cattactgcacgtgcatgcctgcgc

SEQ ID NO: 661464 - DNA, 25 bp, Rattus norvegicus
cgcagctctcattactgcacgtgca

SEQ ID NO: 661465 - DNA, 25 bp, Rattus norvegicus
tctcattactgcacgtgcatgcctg

SEQ ID NO: 661466 - DNA, 25 bp, Rattus norvegicus
atgcacgtgcatgcctgcgctcgca

SEQ ID NO: 661467 - DNA, 25 bp, Rattus norvegicus
ctcgcattggatcgggccagcgcga

SEQ ID NO: 661468 - DNA, 25 bp, Rattus norvegicus
tctgcgttcacggttcattccttgg

SEQ ID NO: 661469 - DNA, 25 bp, Rattus norvegicus
tcacggttcattccttggttccgcc

SEQ ID NO: 661470 - DNA, 25 bp, Rattus norvegicus
taggcaccagccgcccaatcgggaa

SEQ ID NO: 661471 - DNA, 25 bp, Rattus norvegicus
atcgggaaccgatctgccacagacc

SEQ ID NO: 661472 - DNA, 25 bp, Rattus norvegicus
gggaaccgatctgccacagaccgca

SEQ ID NO: 661473 - DNA, 25 bp, Rattus norvegicus
cccaggccctagttcgcgttttgag

SEQ ID NO: 661474 - DNA, 25 bp, Rattus norvegicus
cctggtgccaccatagctactgctg

SEQ ID NO: 661475 - DNA, 25 bp, Rattus norvegicus
gtgccaccatagctactgctgcggc

SEQ ID NO: 661476 - DNA, 25 bp, Rattus norvegicus
agctgaaacggtcgatcgcgatgcc

SEQ ID NO: 661477 - DNA, 25 bp, Rattus norvegicus
atcgcgatgcccgagggctctgtga

SEQ ID NO: 661478 - DNA, 25 bp, Rattus norvegicus
gtgggctgagaacgagctcccaaga

SEQ ID NO: 661479 - DNA, 25 bp, Rattus norvegicus
gaggctctcgcattggatcgggcca

SEQ ID NO: 661480 - DNA, 25 bp, Rattus norvegicus
aacgagctcccaagactggggtgtg

SEQ ID NO: 661481 - DNA, 25 bp, Rattus norvegicus
accggtagccgtacattttcgtgtg

SEQ ID NO: 661482 - DNA, 25 bp, Rattus norvegicus
gttttcaagacccagcacagctccg

SEQ ID NO: 661483 - DNA, 25 bp, Rattus norvegicus
ctccgggacctcagattacgagtgc

SEQ ID NO: 661484 - DNA, 25 bp, Rattus norvegicus
cacagctccgacgttagtcatagtg

SEQ ID NO: 661485 - DNA, 25 bp, Rattus norvegicus
ccgcttgtcgcacttccaagaggga

SEQ ID NO: 661486 - DNA, 25 bp, Rattus norvegicus
cttcgtggtgcagttgtagttttca

SEQ ID NO: 661487 - DNA, 25 bp, Rattus norvegicus
tggcggacgtgtccttagctcacga

SEQ ID NO: 661488 - DNA, 25 bp, Rattus norvegicus
tgtgtacccttctctagctggcgga

SEQ ID NO: 661489 - DNA, 25 bp, Rattus norvegicus
ttacgagtgcatgagtgccggaacc

SEQ ID NO: 661490 - DNA, 25 bp, Rattus norvegicus
agctactgcgaaagagcagcgcgga

SEQ ID NO: 661491 - DNA, 25 bp, Rattus norvegicus
gagtggactctcaggcagcagctac

SEQ ID NO: 661492 - DNA, 25 bp, Rattus norvegicus
gttacaagagttcccggcggctgct

SEQ ID NO: 661493 - DNA, 25 bp, Rattus norvegicus
acgctgtacggagggcgttacaaga

SEQ ID NO: 661494 - DNA, 25 bp, Rattus norvegicus
agtcatagtgccgttcttaaagcca

SEQ ID NO: 661495 - DNA, 25 bp, Rattus norvegicus
gagtctgactggtccttcccgtagg

SEQ ID NO: 661496 - DNA, 25 bp, Rattus norvegicus
tagcacgagcctgagtgctcagccg

SEQ ID NO: 661497 - DNA, 25 bp, Rattus norvegicus
tactgtgtgaaggtgaaaaaggatg

SEQ ID NO: 661498 - DNA, 25 bp, Rattus norvegicus
ccgcctcggccaagtcagaaaagta

SEQ ID NO: 661499 - DNA, 25 bp, Rattus norvegicus
gctggagaagccaggaagccgcctc

SEQ ID NO: 661500 - DNA, 25 bp, Rattus norvegicus
tccaattgtttctgccgctggagaa

SEQ ID NO: 661501 - DNA, 25 bp, Rattus norvegicus
ccgtaggacgcgctttccaattgtt

SEQ ID NO: 661502 - DNA, 25 bp, Rattus norvegicus
tgcagcagggcctcggagtctgact

SEQ ID NO: 661503 - DNA, 25 bp, Rattus norvegicus
tccagacgcaggtgttgctgcagca

SEQ ID NO: 661504 - DNA, 25 bp, Rattus norvegicus
acacaagccttgctccagacgcagg

SEQ ID NO: 661505 - DNA, 25 bp, Rattus norvegicus
aggatgagagctagcacgagcctga

SEQ ID NO: 661506 - DNA, 25 bp, Rattus norvegicus
tgcaccatttgcgacaccagggctg

SEQ ID NO: 661507 - DNA, 25 bp, Rattus norvegicus
cctgcccaactagcagtgctgtttg

SEQ ID NO: 661508 - DNA, 25 bp, Rattus norvegicus
gcctgatcctccagttcgcgcagat

SEQ ID NO: 661509 - DNA, 25 bp, Rattus norvegicus
tattcagaagcgatctcaggtcctt

SEQ ID NO: 661510 - DNA, 25 bp, Rattus norvegicus
gaactcgtggaagcggtacgcctct

SEQ ID NO: 661511 - DNA, 25 bp, Rattus norvegicus
ccaccaagctcggagtgtagcctga

SEQ ID NO: 661512 - DNA, 25 bp, Rattus norvegicus
ttacctgatgaaagtggtcttgccc

SEQ ID NO: 661513 - DNA, 25 bp, Rattus norvegicus
gtactggcccaccagcaggatcatg

SEQ ID NO: 661514 - DNA, 25 bp, Rattus norvegicus
tcatgggcttgttttcgaagtcggc

SEQ ID NO: 661515 - DNA, 25 bp, Rattus norvegicus
tcctccagcgctggcgagtggaact

SEQ ID NO: 661516 - DNA, 25 bp, Rattus norvegicus
gcagcaccttgcgttggtagagtga

SEQ ID NO: 661517 - DNA, 25 bp, Rattus norvegicus
accgcgcttcagtcagaaccctaga

SEQ ID NO: 661518 - DNA, 25 bp, Rattus norvegicus
gtcagaaccctagaaccgcgtcgct

SEQ ID NO: 661519 - DNA, 25 bp, Rattus norvegicus
tcgctcactctaggcgccggagaag

SEQ ID NO: 661520 - DNA, 25 bp, Rattus norvegicus
tgccgcaacgaccaatcatcagtcg

SEQ ID NO: 661521 - DNA, 25 bp, Rattus norvegicus
tcatcagtcgctgcgtcacgggagc

SEQ ID NO: 661522 - DNA, 25 bp, Rattus norvegicus
cgggagcgcgctcattattcagaag

SEQ ID NO: 661523 - DNA, 25 bp, Rattus norvegicus
tgccactctccagcttggcgcgagg

SEQ ID NO: 661524 - DNA, 25 bp, Rattus norvegicus
gcacaagagagaaacgaacgttcac

SEQ ID NO: 661525 - DNA, 25 bp, Rattus norvegicus
acgaacgttcacaaatggactgtcc

SEQ ID NO: 661526 - DNA, 25 bp, Rattus norvegicus
tggactgtccttccttgcgatcgcg

SEQ ID NO: 661527 - DNA, 25 bp, Rattus norvegicus
cccgggtggacagtcctatcacgtc

SEQ ID NO: 661528 - DNA, 25 bp, Rattus norvegicus
ggtggacagtcctatcacgtccgcc

SEQ ID NO: 661529 - DNA, 25 bp, Rattus norvegicus
cggagcccacccacactgtcagacg

SEQ ID NO: 661530 - DNA, 25 bp, Rattus norvegicus
caggcagtcaatctgcagtggaagc

SEQ ID NO: 661531 - DNA, 25 bp, Rattus norvegicus
ctgcagtggaagcttctccaggatc

SEQ ID NO: 661532 - DNA, 25 bp, Rattus norvegicus
aagcttctccaggatcggcaccggc

SEQ ID NO: 661533 - DNA, 25 bp, Rattus norvegicus
gatcggcaccggctcaaaagcgtca

SEQ ID NO: 661534 - DNA, 25 bp, Rattus norvegicus
gctcaaaagcgtcatgcatggctgc

SEQ ID NO: 661535 - DNA, 25 bp, Rattus norvegicus
tcatgcatggctgcgggagcttcgc

SEQ ID NO: 661536 - DNA, 25 bp, Rattus norvegicus
tctctgacaacctgcgtccggagcc

SEQ ID NO: 661537 - DNA, 25 bp, Rattus norvegicus
acggcatcggtacgtgccacttgga

SEQ ID NO: 661538 - DNA, 25 bp, Rattus norvegicus
caggcgtcttcctttctcgctgcta

SEQ ID NO: 661539 - DNA, 25 bp, Rattus norvegicus
gccacttggatctatccgcagcaaa

SEQ ID NO: 661540 - DNA, 25 bp, Rattus norvegicus
agcaaacacgggtgctggacctgca

SEQ ID NO: 661541 - DNA, 25 bp, Rattus norvegicus
ggacctgcaccaagaaacgacaatg

SEQ ID NO: 661542 - DNA, 25 bp, Rattus norvegicus
aaacgacaatgggaacggctgcgcc

SEQ ID NO: 661543 - DNA, 25 bp, Rattus norvegicus
taacaggagacacctgaagccacgc

SEQ ID NO: 661544 - DNA, 25 bp, Rattus norvegicus
catcttcacggccatagagcgccta

SEQ ID NO: 661545 - DNA, 25 bp, Rattus norvegicus
agagcgcctaccaaaagcattgagc

SEQ ID NO: 661546 - DNA, 25 bp, Rattus norvegicus
cattgagccttcttccggctagcta

SEQ ID NO: 661547 - DNA, 25 bp, Rattus norvegicus
actctcttccggctttgctctgtgg

SEQ ID NO: 661548 - DNA, 25 bp, Rattus norvegicus
gattatccgggtccttgaaactgcg

SEQ ID NO: 661549 - DNA, 25 bp, Rattus norvegicus
ccggtaactttgagcctattgcgca

SEQ ID NO: 661550 - DNA, 25 bp, Rattus norvegicus
tccagactcagtagcgactccaaca

SEQ ID NO: 661551 - DNA, 25 bp, Rattus norvegicus
acccgcgctcgcctgagacgcgctc

SEQ ID NO: 661552 - DNA, 25 bp, Rattus norvegicus
agacgcgctcccagggcttccgccc

SEQ ID NO: 661553 - DNA, 25 bp, Rattus norvegicus
taggaacgccctgtgacatcatcaa

SEQ ID NO: 661554 - DNA, 25 bp, Rattus norvegicus
ctgtgacatcatcaaaccgcgcgca

SEQ ID NO: 661555 - DNA, 25 bp, Rattus norvegicus
gacatcatcaaaccgcgcgcacgtt

SEQ ID NO: 661556 - DNA, 25 bp, Rattus norvegicus
actcctcgcgccagttccagaggtg

SEQ ID NO: 661557 - DNA, 25 bp, Rattus norvegicus
cagttccagaggtgcgttggagcca

SEQ ID NO: 661558 - DNA, 25 bp, Rattus norvegicus
ttggagccatggctgccgccaaccc

SEQ ID NO: 661559 - DNA, 25 bp, Rattus norvegicus
tgccgccaacccgtgggacccagcg

SEQ ID NO: 661560 - DNA, 25 bp, Rattus norvegicus
ccgcgccgagtgcagctgggttact

SEQ ID NO: 661561 - DNA, 25 bp, Rattus norvegicus
gctgggttactgctgaaccacttgg

SEQ ID NO: 661562 - DNA, 25 bp, Rattus norvegicus
tactgctgaaccacttggtggcttc

SEQ ID NO: 661563 - DNA, 25 bp, Rattus norvegicus
tcagggatagtcactgaggtacgtg

SEQ ID NO: 661564 - DNA, 25 bp, Rattus norvegicus
ttggtggcttcagggatagtcactg

SEQ ID NO: 661565 - DNA, 25 bp, Rattus norvegicus
gcccagcccacttgtctcagaattg

SEQ ID NO: 661566 - DNA, 25 bp, Rattus norvegicus
ctgtcttaggattggccaaggtttg

SEQ ID NO: 661567 - DNA, 25 bp, Rattus norvegicus
cctgttgggcgtttgctcgtacccg

SEQ ID NO: 661568 - DNA, 25 bp, Rattus norvegicus
cagtctgtggttcctgcagtgcttg

SEQ ID NO: 661569 - DNA, 25 bp, Rattus norvegicus
ctaggcgtttgctcgcacccaggcg

SEQ ID NO: 661570 - DNA, 25 bp, Rattus norvegicus
cacccaggcgggagcgtctggaaaa

SEQ ID NO: 661571 - DNA, 25 bp, Rattus norvegicus
tgtctcagaattggcggaggctcca

SEQ ID NO: 661572 - DNA, 25 bp, Rattus norvegicus
tctcaggattggctaaggtttggca

SEQ ID NO: 661573 - DNA, 25 bp, Rattus norvegicus
cccacctgtcttaggattggccaag

SEQ ID NO: 661574 - DNA, 25 bp, Rattus norvegicus
tcctgcagtgcttgtggctgggtct

SEQ ID NO: 661575 - DNA, 25 bp, Rattus norvegicus
ctggacgccggccagggatgcttcc

SEQ ID NO: 661576 - DNA, 25 bp, Rattus norvegicus
atgcttccgccggaccgctgtacgg

SEQ ID NO: 661577 - DNA, 25 bp, Rattus norvegicus
gaacgagacgaggttgcccagccca

SEQ ID NO: 661578 - DNA, 25 bp, Rattus norvegicus
cccactagtctcaggattggctaag

SEQ ID NO: 661579 - DNA, 25 bp, Rattus norvegicus
gttcagcaggaacggcacgaattcc

SEQ ID NO: 661580 - DNA, 25 bp, Rattus norvegicus
attccttccgcagaggccgaagtgc

SEQ ID NO: 661581 - DNA, 25 bp, Rattus norvegicus
tgcgctcagagcagccacttcggag

SEQ ID NO: 661582 - DNA, 25 bp, Rattus norvegicus
cacttcggagctatcctgaggaaga

SEQ ID NO: 661583 - DNA, 25 bp, Rattus norvegicus
ggaagcacattccaggcaggtttga

SEQ ID NO: 661584 - DNA, 25 bp, Rattus norvegicus
gcgtgtccgcactgttacctccgaa

SEQ ID NO: 661585 - DNA, 25 bp, Rattus norvegicus
cgcgcagcagcgactctaaaacggc

SEQ ID NO: 661586 - DNA, 25 bp, Rattus norvegicus
tgtccaaccagctaggcctgcaggg

SEQ ID NO: 661587 - DNA, 25 bp, Rattus norvegicus
aggcgcctttccctgactgcttggc

SEQ ID NO: 661588 - DNA, 25 bp, Rattus norvegicus
cttggccgctggagcaatgtgatga

SEQ ID NO: 661589 - DNA, 25 bp, Rattus norvegicus
atgagatggaactgcggcgagctct

SEQ ID NO: 661590 - DNA, 25 bp, Rattus norvegicus
ggctgctctgctccctcaggaagtt

SEQ ID NO: 661591 - DNA, 25 bp, Rattus norvegicus
ccaggcgctctgaggctactgcgca

SEQ ID NO: 661592 - DNA, 25 bp, Rattus norvegicus
gtccgggaagatctgtccaaccagc

SEQ ID NO: 661593 - DNA, 25 bp, Rattus norvegicus
gagtgtaaggtcgagtccacccttg

SEQ ID NO: 661594 - DNA, 25 bp, Rattus norvegicus
ttaaggcattttcgcgccatttcgc

SEQ ID NO: 661595 - DNA, 25 bp, Rattus norvegicus
caggtctccgacataacgttatctc

SEQ ID NO: 661596 - DNA, 25 bp, Rattus norvegicus
aattttccacaatcgcgggaggccg

SEQ ID NO: 661597 - DNA, 25 bp, Rattus norvegicus
tctgcaaattttccacaatcgcggg

SEQ ID NO: 661598 - DNA, 25 bp, Rattus norvegicus
gtccacccttgacctctgcaaattt

SEQ ID NO: 661599 - DNA, 25 bp, Rattus norvegicus
gcgccatttcgcttgaaggagtgta

SEQ ID NO: 661600 - DNA, 25 bp, Rattus norvegicus
caacgacttttaaggcattttcgcg

SEQ ID NO: 661601 - DNA, 25 bp, Rattus norvegicus
ttcctttaacttccagccggacatg

SEQ ID NO: 661602 - DNA, 25 bp, Rattus norvegicus
tccaagtcttcttaagtaaactcga

SEQ ID NO: 661603 - DNA, 25 bp, Rattus norvegicus
tggcggtggaaaattccaagtcttc

SEQ ID NO: 661604 - DNA, 25 bp, Rattus norvegicus
aggactgcataactggcggtggaaa

SEQ ID NO: 661605 - DNA, 25 bp, Rattus norvegicus
ccagcgcacggaccaacgactttta

SEQ ID NO: 661606 - DNA, 25 bp, Rattus norvegicus
cgttatctcggaaaataggactgca

SEQ ID NO: 661607 - DNA, 25 bp, Rattus norvegicus
acccgagcgcggcttagacggccgg

SEQ ID NO: 661608 - DNA, 25 bp, Rattus norvegicus
cctcggatgccgtccgcgtctaaag

SEQ ID NO: 661609 - DNA, 25 bp, Rattus norvegicus
acctgccctggcagcgcgcaccgcc

SEQ ID NO: 661610 - DNA, 25 bp, Rattus norvegicus
atgccgtccgcgtctaaaggcggcg

SEQ ID NO: 661611 - DNA, 25 bp, Rattus norvegicus
ctgcgggtattgctgcggattgccc

SEQ ID NO: 661612 - DNA, 25 bp, Rattus norvegicus
cgggccgctgctctggtaccagccc

SEQ ID NO: 661613 - DNA, 25 bp, Rattus norvegicus
ggcgactactgcagcgcccgctgac

SEQ ID NO: 661614 - DNA, 25 bp, Rattus norvegicus
ggcgggcccgccaccgcctgcccat

SEQ ID NO: 661615 - DNA, 25 bp, Rattus norvegicus
caggagtcaccgctgagcaggcggg

SEQ ID NO: 661616 - DNA, 25 bp, Rattus norvegicus
tcagggtccgcacccgcaggagtca

SEQ ID NO: 661617 - DNA, 25 bp, Rattus norvegicus
ctggggtccagctcagggtccgcac

SEQ ID NO: 661618 - DNA, 25 bp, Rattus norvegicus
gacgcaggatctctggcggagggct

SEQ ID NO: 661619 - DNA, 25 bp, Rattus norvegicus
cccgcaagccgtacagcctagccca

SEQ ID NO: 661620 - DNA, 25 bp, Rattus norvegicus
caccgctcccatcgccgctgcggcg

SEQ ID NO: 661621 - DNA, 25 bp, Rattus norvegicus
ggcggctggaacaacgactgctgcc

SEQ ID NO: 661622 - DNA, 25 bp, Rattus norvegicus
tcccgctctgtggtcgtcctgagaa

SEQ ID NO: 661623 - DNA, 25 bp, Rattus norvegicus
gctcaacgtcctaggctcacctgct

SEQ ID NO: 661624 - DNA, 25 bp, Rattus norvegicus
ctgctccctccgttcggccgcagac

SEQ ID NO: 661625 - DNA, 25 bp, Rattus norvegicus
gccggacgcccaaggtctgatccag

SEQ ID NO: 661626 - DNA, 25 bp, Rattus norvegicus
cccaaggtctgatccaggcgggctc

SEQ ID NO: 661627 - DNA, 25 bp, Rattus norvegicus
ctggcgagcctagcccagtcacggt

SEQ ID NO: 661628 - DNA, 25 bp, Rattus norvegicus
cctagcccagtcacggtggcggctg

SEQ ID NO: 661629 - DNA, 25 bp, Rattus norvegicus
ggaacaacgactgctgcccggtgcc

SEQ ID NO: 661630 - DNA, 25 bp, Rattus norvegicus
cagctcagtctagttggtggtcacc

SEQ ID NO: 661631 - DNA, 25 bp, Rattus norvegicus
ttggtggtcaccctggcccaggtcc

SEQ ID NO: 661632 - DNA, 25 bp, Rattus norvegicus
gcccaagatcataccgctgccacag

SEQ ID NO: 661633 - DNA, 25 bp, Rattus norvegicus
gtggtcgtcctgagaaccgcccggc

SEQ ID NO: 661634 - DNA, 25 bp, Rattus norvegicus
tctagttggtggtcaccctggccca

SEQ ID NO: 661635 - DNA, 25 bp, Rattus norvegicus
cagagacgacacttttacgacggcc

SEQ ID NO: 661636 - DNA, 25 bp, Rattus norvegicus
gaggctccgggctgacgtccatcct

SEQ ID NO: 661637 - DNA, 25 bp, Rattus norvegicus
gcgctagccgaagaagactcacgga

SEQ ID NO: 661638 - DNA, 25 bp, Rattus norvegicus
gagaggacaaaaggcgctagccgaa

SEQ ID NO: 661639 - DNA, 25 bp, Rattus norvegicus
accctgagcggcttccggtcggctt

SEQ ID NO: 661640 - DNA, 25 bp, Rattus norvegicus
ccctgaagtcaggtttgtcgcagca

SEQ ID NO: 661641 - DNA, 25 bp, Rattus norvegicus
aacgcccgcagttcccgatcccagg

SEQ ID NO: 661642 - DNA, 25 bp, Rattus norvegicus
cgacgcgccagagacgacactttta

SEQ ID NO: 661643 - DNA, 25 bp, Rattus norvegicus
ctcttcgtccgccatcttaagggaa

SEQ ID NO: 661644 - DNA, 25 bp, Rattus norvegicus
tagcggaaacctgtggccgacccga

SEQ ID NO: 661645 - DNA, 25 bp, Rattus norvegicus
aggctgccagctagcggaaacctgt

SEQ ID NO: 661646 - DNA, 25 bp, Rattus norvegicus
cgatcccaggctgccagctagcgga

SEQ ID NO: 661647 - DNA, 25 bp, Rattus norvegicus
tcgtccgccatcttaagggaaacga

SEQ ID NO: 661648 - DNA, 25 bp, Rattus norvegicus
tttgtcgcagcaccctgagcggctt

SEQ ID NO: 661649 - DNA, 25 bp, Rattus norvegicus
cctgcttttggagcactacggcctg

SEQ ID NO: 661650 - DNA, 25 bp, Rattus norvegicus
tacggcctggctgggccgtccacgc

SEQ ID NO: 661651 - DNA, 25 bp, Rattus norvegicus
agcactacggcctggctgggccgtc

SEQ ID NO: 661652 - DNA, 25 bp, Rattus norvegicus
ttttggagcactacggcctggctgg

SEQ ID NO: 661653 - DNA, 25 bp, Rattus norvegicus
ctgcttttggagcactacggcctgg

SEQ ID NO: 661654 - DNA, 25 bp, Rattus norvegicus
gccctgcttttggagcactacggcc

SEQ ID NO: 661655 - DNA, 25 bp, Rattus norvegicus
cgatggcgagaatgctggccgtccg

SEQ ID NO: 661656 - DNA, 25 bp, Rattus norvegicus
gccgccctgcttttggagcactacg

SEQ ID NO: 661657 - DNA, 25 bp, Rattus norvegicus
ggccgccctgcttttggagcactac

SEQ ID NO: 661658 - DNA, 25 bp, Rattus norvegicus
ctggccgccctgcttttggagcact

SEQ ID NO: 661659 - DNA, 25 bp, Rattus norvegicus
cgctggccgccctgcttttggagca

SEQ ID NO: 661660 - DNA, 25 bp, Rattus norvegicus
cgccctgcttttggagcactacggc

SEQ ID NO: 661661 - DNA, 25 bp, Rattus norvegicus
gcttttggagcactacggcctggct

SEQ ID NO: 661662 - DNA, 25 bp, Rattus norvegicus
gctgcgccgcgatggcgagaatgct

SEQ ID NO: 661663 - DNA, 25 bp, Rattus norvegicus
gagttcttcagcaccggaagtactg

SEQ ID NO: 661664 - DNA, 25 bp, Rattus norvegicus
gcggggtcaaatggcttaagtgtct

SEQ ID NO: 661665 - DNA, 25 bp, Rattus norvegicus
tagttcccgaagagaggctgcgatg

SEQ ID NO: 661666 - DNA, 25 bp, Rattus norvegicus
gctgcgatggcgagctcgacaaccc

SEQ ID NO: 661667 - DNA, 25 bp, Rattus norvegicus
ctccggcacttagcagaggagctgc

SEQ ID NO: 661668 - DNA, 25 bp, Rattus norvegicus
cttctgcctcgagtacggggtgagt

SEQ ID NO: 661669 - DNA, 25 bp, Rattus norvegicus
tgccggaaacgagatgagttcttca

SEQ ID NO: 661670 - DNA, 25 bp, Rattus norvegicus
tcctctagagcagctccggcactta

SEQ ID NO: 661671 - DNA, 25 bp, Rattus norvegicus
gaaggcggactcactacattgggga

SEQ ID NO: 661672 - DNA, 25 bp, Rattus norvegicus
gtcagggctcctctcacatgtcttt

SEQ ID NO: 661673 - DNA, 25 bp, Rattus norvegicus
acatgtcttttgcttcccgggtggt

SEQ ID NO: 661674 - DNA, 25 bp, Rattus norvegicus
gtccggccttcctcaagtcggcgaa

SEQ ID NO: 661675 - DNA, 25 bp, Rattus norvegicus
ggtgagttgtgggaatctgcaaccc

SEQ ID NO: 661676 - DNA, 25 bp, Rattus norvegicus
gcccaggagacagccgaggaattta

SEQ ID NO: 661677 - DNA, 25 bp, Rattus norvegicus
cggtagtccgagctctcaaagcaca

SEQ ID NO: 661678 - DNA, 25 bp, Rattus norvegicus
cacttccgggcaaatcgctgtcagc

SEQ ID NO: 661679 - DNA, 25 bp, Rattus norvegicus
acccttgtgcggctagcgatcgctt

SEQ ID NO: 661680 - DNA, 25 bp, Rattus norvegicus
aggcatcgctcacgtacccttgtgc

SEQ ID NO: 661681 - DNA, 25 bp, Rattus norvegicus
gcgcacgtaatagccgcggtggata

SEQ ID NO: 661682 - DNA, 25 bp, Rattus norvegicus
tcttcgccttgagccgagacacgtc

SEQ ID NO: 661683 - DNA, 25 bp, Rattus norvegicus
accgcgagagactttttgacatttt

SEQ ID NO: 661684 - DNA, 25 bp, Rattus norvegicus
tcacccggcttcatctgctcataga

SEQ ID NO: 661685 - DNA, 25 bp, Rattus norvegicus
ctgcagcatgatttgcccgaaggca

SEQ ID NO: 661686 - DNA, 25 bp, Rattus norvegicus
caaccgccgaaagtgctgcagcatg

SEQ ID NO: 661687 - DNA, 25 bp, Rattus norvegicus
tagaactcgttcaggtccagggcgc

SEQ ID NO: 661688 - DNA, 25 bp, Rattus norvegicus
gttccagtccatgcaggggtgagtt

SEQ ID NO: 661689 - DNA, 25 bp, Rattus norvegicus
tccacgtccggaaagagttccagtc

SEQ ID NO: 661690 - DNA, 25 bp, Rattus norvegicus
gcccgcagctttcagacgaaaataa

SEQ ID NO: 661691 - DNA, 25 bp, Rattus norvegicus
ggcgcccgctgcgagaagaaaccga

SEQ ID NO: 661692 - DNA, 25 bp, Rattus norvegicus
gccgcgtctctctcaactagcttgt

SEQ ID NO: 661693 - DNA, 25 bp, Rattus norvegicus
tgggcttcgagcacagctccacagc

SEQ ID NO: 661694 - DNA, 25 bp, Rattus norvegicus
cggctgccaagttccggctttgttt

SEQ ID NO: 661695 - DNA, 25 bp, Rattus norvegicus
gtcggcagtcggtcaaaatgccata

SEQ ID NO: 661696 - DNA, 25 bp, Rattus norvegicus
ccaaggcgtcatgaggactctctcc

SEQ ID NO: 661697 - DNA, 25 bp, Rattus norvegicus
gcagtcgtgggtctgctgagaacaa

SEQ ID NO: 661698 - DNA, 25 bp, Rattus norvegicus
agccggaagtctggcctctcctagc

SEQ ID NO: 661699 - DNA, 25 bp, Rattus norvegicus
cccaggacgcatgcgcgatgttacc

SEQ ID NO: 661700 - DNA, 25 bp, Rattus norvegicus
gctctgtggaatgtcctcgctcggt

SEQ ID NO: 661701 - DNA, 25 bp, Rattus norvegicus
cagggcaaaagattcacgctacgtg

SEQ ID NO: 661702 - DNA, 25 bp, Rattus norvegicus
cccagaaatgattcacgagctgctc

SEQ ID NO: 661703 - DNA, 25 bp, Rattus norvegicus
tttcacctggaacaagcggagtggc

SEQ ID NO: 661704 - DNA, 25 bp, Rattus norvegicus
atgccatagaccctgccaaggcgtc

SEQ ID NO: 661705 - DNA, 25 bp, Rattus norvegicus
ttcgcttgcagcactacctggcatc

SEQ ID NO: 661706 - DNA, 25 bp, Rattus norvegicus
tgtagccactgagctccgggaagac

SEQ ID NO: 661707 - DNA, 25 bp, Rattus norvegicus
agctcgctcagcttcgcttgcagca

SEQ ID NO: 661708 - DNA, 25 bp, Rattus norvegicus
actacctggcatcccggcgggaggt

SEQ ID NO: 661709 - DNA, 25 bp, Rattus norvegicus
aggtccctcgcgctggatctagagg

SEQ ID NO: 661710 - DNA, 25 bp, Rattus norvegicus
cctcgcgctggatctagaggtctct

SEQ ID NO: 661711 - DNA, 25 bp, Rattus norvegicus
ctagaggtctctgcacgctgcccag

SEQ ID NO: 661712 - DNA, 25 bp, Rattus norvegicus
cgtttccatggtagcatggacgtcg

SEQ ID NO: 661713 - DNA, 25 bp, Rattus norvegicus
gtcacgcagtatcaggccgcccatt

SEQ ID NO: 661714 - DNA, 25 bp, Rattus norvegicus
gccgcccattcgctgctgttgtctg

SEQ ID NO: 661715 - DNA, 25 bp, Rattus norvegicus
gccactcaggaaattctatggatga

SEQ ID NO: 661716 - DNA, 25 bp, Rattus norvegicus
tggctgagaagaagtgcccgcccgt

SEQ ID NO: 661717 - DNA, 25 bp, Rattus norvegicus
acacggcggcgcgtttccatggtag

SEQ ID NO: 661718 - DNA, 25 bp, Rattus norvegicus
ttttcccgtcacgtcacgcagtatc

SEQ ID NO: 661719 - DNA, 25 bp, Rattus norvegicus
ccagcctagcactccgcgggagttt

SEQ ID NO: 661720 - DNA, 25 bp, Rattus norvegicus
aggtgagccgctctcctgactttta

SEQ ID NO: 661721 - DNA, 25 bp, Rattus norvegicus
tccatggcgaccgaggccgggacca

SEQ ID NO: 661722 - DNA, 25 bp, Rattus norvegicus
accaggcggcctggcagcgttgcca

SEQ ID NO: 661723 - DNA, 25 bp, Rattus norvegicus
tgccatggagacaactccggagctg

SEQ ID NO: 661724 - DNA, 25 bp, Rattus norvegicus
agcttctatgcgaggccggagccgc

SEQ ID NO: 661725 - DNA, 25 bp, Rattus norvegicus
cgcgctgggacctaaggaaatactc

SEQ ID NO: 661726 - DNA, 25 bp, Rattus norvegicus
cgtgcgggcccaccttgaacaaggt

SEQ ID NO: 661727 - DNA, 25 bp, Rattus norvegicus
cttgctcatcgtgatcggcgatatc

SEQ ID NO: 661728 - DNA, 25 bp, Rattus norvegicus
tcggcgatatcggtacagagagtca

SEQ ID NO: 661729 - DNA, 25 bp, Rattus norvegicus
tgacttttacgcagcactccatccg

SEQ ID NO: 661730 - DNA, 25 bp, Rattus norvegicus
ggcctttaagaaccgcgcgcactct

SEQ ID NO: 661731 - DNA, 25 bp, Rattus norvegicus
aggaaatactccttgctcatcgtga

SEQ ID NO: 661732 - DNA, 25 bp, Rattus norvegicus
actccgcgggagtttccatggcgac

SEQ ID NO: 661733 - DNA, 25 bp, Rattus norvegicus
caccaatccgcagagggcgcgcacc

SEQ ID NO: 661734 - DNA, 25 bp, Rattus norvegicus
tgccggcagcgacacctgacagcgg

SEQ ID NO: 661735 - DNA, 25 bp, Rattus norvegicus
cggcccaatcaaagcgcgacttctt

SEQ ID NO: 661736 - DNA, 25 bp, Rattus norvegicus
ccggcaacagtcaggctgcgttggc

SEQ ID NO: 661737 - DNA, 25 bp, Rattus norvegicus
ctctctctcggtgccgggtcacgaa

SEQ ID NO: 661738 - DNA, 25 bp, Rattus norvegicus
aagcgcgacttctttgcggtcccac

SEQ ID NO: 661739 - DNA, 25 bp, Rattus norvegicus
cggttgcgcctctctccgaagctgt

SEQ ID NO: 661740 - DNA, 25 bp, Rattus norvegicus
gacattgaggcctctcggttgcgcc

SEQ ID NO: 661741 - DNA, 25 bp, Rattus norvegicus
ctacgctgacattgaggcctctcgg

SEQ ID NO: 661742 - DNA, 25 bp, Rattus norvegicus
tcgctctccctacgctgacattgag

SEQ ID NO: 661743 - DNA, 25 bp, Rattus norvegicus
agactgcactcgtttctgcccgccc

SEQ ID NO: 661744 - DNA, 25 bp, Rattus norvegicus
atcccgccctcccatccagactgca

SEQ ID NO: 661745 - DNA, 25 bp, Rattus norvegicus
tctcggtgccgggtcacgaatcccg

SEQ ID NO: 661746 - DNA, 25 bp, Rattus norvegicus
ggcgcgcaccggcaacagtcaggct

SEQ ID NO: 661747 - DNA, 25 bp, Rattus norvegicus
tacatggaggacgtaactcagattg

SEQ ID NO: 661748 - DNA, 25 bp, Rattus norvegicus
agtgagcgtcttctctgaccagggc

SEQ ID NO: 661749 - DNA, 25 bp, Rattus norvegicus
gtgcgctgccatccgcaaaggcttc

SEQ ID NO: 661750 - DNA, 25 bp, Rattus norvegicus
gtactctctgggagtgagcgtcttc

SEQ ID NO: 661751 - DNA, 25 bp, Rattus norvegicus
ctcagattgtggtggaacccgagcc

SEQ ID NO: 661752 - DNA, 25 bp, Rattus norvegicus
ccttcttcgctgtgtgcgacgggca

SEQ ID NO: 661753 - DNA, 25 bp, Rattus norvegicus
gcggcacagtttgcccgggagcact

SEQ ID NO: 661754 - DNA, 25 bp, Rattus norvegicus
cccgggagcacttgtggggtttcat

SEQ ID NO: 661755 - DNA, 25 bp, Rattus norvegicus
agcagaaaggcttcacctcgtccga

SEQ ID NO: 661756 - DNA, 25 bp, Rattus norvegicus
cgcctcggaattccgcgggctgcgt

SEQ ID NO: 661757 - DNA, 25 bp, Rattus norvegicus
ttgtggggtttcatcaagaagcaga

SEQ ID NO: 661758 - DNA, 25 bp, Rattus norvegicus
gcgagtgtgtctcccgcctcggaat

SEQ ID NO: 661759 - DNA, 25 bp, Rattus norvegicus
gcatcgtcgaagataaacaatagtt

SEQ ID NO: 661760 - DNA, 25 bp, Rattus norvegicus
taaacaatagttggccggcgagcgg

SEQ ID NO: 661761 - DNA, 25 bp, Rattus norvegicus
tgcctcctcgccagtcggtggggaa

SEQ ID NO: 661762 - DNA, 25 bp, Rattus norvegicus
cgacgcagcgtgacgcagccaatcg

SEQ ID NO: 661763 - DNA, 25 bp, Rattus norvegicus
tccactatctaacaggcctggctgc

SEQ ID NO: 661764 - DNA, 25 bp, Rattus norvegicus
gggctctcccatctcggttctctgg

SEQ ID NO: 661765 - DNA, 25 bp, Rattus norvegicus
atgcgcttcagctgccttgcgctgc

SEQ ID NO: 661766 - DNA, 25 bp, Rattus norvegicus
cgcctccgcctcagacgtgttggaa

SEQ ID NO: 661767 - DNA, 25 bp, Rattus norvegicus
tggaactgacggacgaaaacttcga

SEQ ID NO: 661768 - DNA, 25 bp, Rattus norvegicus
aaaacttcgagagtcgcgtctccga

SEQ ID NO: 661769 - DNA, 25 bp, Rattus norvegicus
ccgacacgggctcagctgggctcat

SEQ ID NO: 661770 - DNA, 25 bp, Rattus norvegicus
gcgggcgttcgcttaagcgtccgcc

SEQ ID NO: 661771 - DNA, 25 bp, Rattus norvegicus
aggccactttgtggggtcatggccc

SEQ ID NO: 661772 - DNA, 25 bp, Rattus norvegicus
ccaatcggcagttaccagctggttc

SEQ ID NO: 661773 - DNA, 25 bp, Rattus norvegicus
tgggctcatgctagtcgagttcttc

SEQ ID NO: 661774 - DNA, 25 bp, Rattus norvegicus
ttgggacctcggcagcaggtctgcc

SEQ ID NO: 661775 - DNA, 25 bp, Rattus norvegicus
ggcgactcactttctaccttctctt

SEQ ID NO: 661776 - DNA, 25 bp, Rattus norvegicus
cgtggcactgcactccacgtgtttc

SEQ ID NO: 661777 - DNA, 25 bp, Rattus norvegicus
ggagactttgtcagtcagtacccta

SEQ ID NO: 661778 - DNA, 25 bp, Rattus norvegicus
gtaccctaaactgtcccacatgagg

SEQ ID NO: 661779 - DNA, 25 bp, Rattus norvegicus
cacatgaggtcactttgcccggtca

SEQ ID NO: 661780 - DNA, 25 bp, Rattus norvegicus
ctcgcccgccagaagaacatgaaga

SEQ ID NO: 661781 - DNA, 25 bp, Rattus norvegicus
gtttctacaggcaggacccagcgct

SEQ ID NO: 661782 - DNA, 25 bp, Rattus norvegicus
catgaagaagcagagcgactcggtt

SEQ ID NO: 661783 - DNA, 25 bp, Rattus norvegicus
acgtgtttccctctgcccaatgaga

SEQ ID NO: 661784 - DNA, 25 bp, Rattus norvegicus
gggcctgcaacgtcggcccgaacga

SEQ ID NO: 661785 - DNA, 25 bp, Rattus norvegicus
gccgtcgccatgacccgtgagtgct

SEQ ID NO: 661786 - DNA, 25 bp, Rattus norvegicus
gagtgctgggaccttttcctctctc

SEQ ID NO: 661787 - DNA, 25 bp, Rattus norvegicus
cttctcttcttaggcggtaaccagc

SEQ ID NO: 661788 - DNA, 25 bp, Rattus norvegicus
acgtgacccggcctagtttctacag

SEQ ID NO: 661789 - DNA, 25 bp, Rattus norvegicus
ctttaaatgcgctcgccacttcggg

SEQ ID NO: 661790 - DNA, 25 bp, Rattus norvegicus
ccgttggattctcctggatgcggtc

SEQ ID NO: 661791 - DNA, 25 bp, Rattus norvegicus
tacgtcagtacagctccacccgtgg

SEQ ID NO: 661792 - DNA, 25 bp, Rattus norvegicus
tttgttcttctccagtctttcgccg

SEQ ID NO: 661793 - DNA, 25 bp, Rattus norvegicus
gccgtgctcagtccaagtcttcagt

SEQ ID NO: 661794 - DNA, 25 bp, Rattus norvegicus
agagcctttcgttgtgctcctttta

SEQ ID NO: 661795 - DNA, 25 bp, Rattus norvegicus
atcttgccacatccggctccaggtg

SEQ ID NO: 661796 - DNA, 25 bp, Rattus norvegicus
cagtagtgggaactagcgcgtatcc

SEQ ID NO: 661797 - DNA, 25 bp, Rattus norvegicus
gcgaactgaaacctagccggcgacg

SEQ ID NO: 661798 - DNA, 25 bp, Rattus norvegicus
gcgccaccctgctcgagtagagcta

SEQ ID NO: 661799 - DNA, 25 bp, Rattus norvegicus
gggcttccaccgtgctccatatact

SEQ ID NO: 661800 - DNA, 25 bp, Rattus norvegicus
cctggcctgacggtgtctctttaaa

SEQ ID NO: 661801 - DNA, 25 bp, Rattus norvegicus
tggcttctcaggagccgcgaactga

SEQ ID NO: 661802 - DNA, 25 bp, Rattus norvegicus
cagtcttttgctgcctcacccattg

SEQ ID NO: 661803 - DNA, 25 bp, Rattus norvegicus
attgtgggaaattggaggaacgcta

SEQ ID NO: 661804 - DNA, 25 bp, Rattus norvegicus
ccgtagactgaatgggcggctgctt

SEQ ID NO: 661805 - DNA, 25 bp, Rattus norvegicus
gtaggcaactttcccgccttcaagc

SEQ ID NO: 661806 - DNA, 25 bp, Rattus norvegicus
tgcgcgtcttcgtaggcaactttcc

SEQ ID NO: 661807 - DNA, 25 bp, Rattus norvegicus
agggccagactaaaatttgcgcgtc

SEQ ID NO: 661808 - DNA, 25 bp, Rattus norvegicus
gcgggccgcttaaagggccagacta

SEQ ID NO: 661809 - DNA, 25 bp, Rattus norvegicus
gaggaacgctaagcgggccgcttaa

SEQ ID NO: 661810 - DNA, 25 bp, Rattus norvegicus
cgcgactgacagaaacaacttccgg

SEQ ID NO: 661811 - DNA, 25 bp, Rattus norvegicus
tttgccctacactactgcgcgactg

SEQ ID NO: 661812 - DNA, 25 bp, Rattus norvegicus
ggattgaatctcaacaacgaagagc

SEQ ID NO: 661813 - DNA, 25 bp, Rattus norvegicus
cggctgccgcagagattctgtaaaa

SEQ ID NO: 661814 - DNA, 25 bp, Rattus norvegicus
tcatgagtgcgcttgggaccgacat

SEQ ID NO: 661815 - DNA, 25 bp, Rattus norvegicus
caacttccggcagcggtagaggaac

SEQ ID NO: 661816 - DNA, 25 bp, Rattus norvegicus
gaccgacatggtgacggctgccgca

SEQ ID NO: 661817 - DNA, 25 bp, Rattus norvegicus
tgcaggtgtactcgctgtcgtccag

SEQ ID NO: 661818 - DNA, 25 bp, Rattus norvegicus
acgggtggaggaagcaatcatcaca

SEQ ID NO: 661819 - DNA, 25 bp, Rattus norvegicus
atcacaaaacagcagtactgagccc

SEQ ID NO: 661820 - DNA, 25 bp, Rattus norvegicus
gcaggaggaagagccaatcaggata

SEQ ID NO: 661821 - DNA, 25 bp, Rattus norvegicus
ccgattagcaggaggaagagccaat

SEQ ID NO: 661822 - DNA, 25 bp, Rattus norvegicus
gtcagcgcggcggaaccgattagca

SEQ ID NO: 661823 - DNA, 25 bp, Rattus norvegicus
gccggcccttagcacctgcaccatc

SEQ ID NO: 661824 - DNA, 25 bp, Rattus norvegicus
tgctgccgctcatcaacctgctcag

SEQ ID NO: 661825 - DNA, 25 bp, Rattus norvegicus
tgcagctgtactctcgctccagact

SEQ ID NO: 661826 - DNA, 25 bp, Rattus norvegicus
tgtcgtccagcagccgcacagtgca

SEQ ID NO: 661827 - DNA, 25 bp, Rattus norvegicus
ccaacttagccgagtctggggagcc

SEQ ID NO: 661828 - DNA, 25 bp, Rattus norvegicus
tagctctggctacccgcccaaggtt

SEQ ID NO: 661829 - DNA, 25 bp, Rattus norvegicus
ccaatcaggataaggaacggggatg

SEQ ID NO: 661830 - DNA, 25 bp, Rattus norvegicus
gccgcacagtgcagctgtactctcg

SEQ ID NO: 661831 - DNA, 25 bp, Rattus norvegicus
tgctggtagtcatcgttgtccttgc

SEQ ID NO: 661832 - DNA, 25 bp, Rattus norvegicus
atcgaccagaaggaggccgactacg

SEQ ID NO: 661833 - DNA, 25 bp, Rattus norvegicus
gcaatccggcgctgcccgcaggtgt

SEQ ID NO: 661834 - DNA, 25 bp, Rattus norvegicus
agccaccggcctcatggtgggtttc

SEQ ID NO: 661835 - DNA, 25 bp, Rattus norvegicus
gcctgccgtccttcgtgctggtggt

SEQ ID NO: 661836 - DNA, 25 bp, Rattus norvegicus
gttgtccttgccttcaactactgga

SEQ ID NO: 661837 - DNA, 25 bp, Rattus norvegicus
gccttcaactactggagcatctcct

SEQ ID NO: 661838 - DNA, 25 bp, Rattus norvegicus
tcccgccacgttctgcttcaagagg

SEQ ID NO: 661839 - DNA, 25 bp, Rattus norvegicus
cgttctgcttcaagaggaggtggcc

SEQ ID NO: 661840 - DNA, 25 bp, Rattus norvegicus
tgcagggccaggtccagcgcaccga

SEQ ID NO: 661841 - DNA, 25 bp, Rattus norvegicus
cctggagaagcgcaattcggacctt

SEQ ID NO: 661842 - DNA, 25 bp, Rattus norvegicus
gcgcaattcggaccttttactcttg

SEQ ID NO: 661843 - DNA, 25 bp, Rattus norvegicus
ggtggacacgcataagaaacagatc

SEQ ID NO: 661844 - DNA, 25 bp, Rattus norvegicus
accttttactcttggtggacacgca

SEQ ID NO: 661845 - DNA, 25 bp, Rattus norvegicus
tgccgttgctccgaagctcagtcct

SEQ ID NO: 661846 - DNA, 25 bp, Rattus norvegicus
tcccttggtccaaacgctgccgttg

SEQ ID NO: 661847 - DNA, 25 bp, Rattus norvegicus
agcgggaaagacaccacctattgcg

SEQ ID NO: 661848 - DNA, 25 bp, Rattus norvegicus
agccgagccttcagcggttccagca

SEQ ID NO: 661849 - DNA, 25 bp, Rattus norvegicus
gtcgtcacagtgaaggtaattccct

SEQ ID NO: 661850 - DNA, 25 bp, Rattus norvegicus
cacctattgcgcagttgggaccatc

SEQ ID NO: 661851 - DNA, 25 bp, Rattus norvegicus
ttggttctcttttacccgctgccgc

SEQ ID NO: 661852 - DNA, 25 bp, Rattus norvegicus
tgcctcttcacggaagtaaaagttg

SEQ ID NO: 661853 - DNA, 25 bp, Rattus norvegicus
tccctaaggcggcagaaacttttgc

SEQ ID NO: 661854 - DNA, 25 bp, Rattus norvegicus
gtcaggaattcgcactggtgagttc

SEQ ID NO: 661855 - DNA, 25 bp, Rattus norvegicus
ggccctaaagccctgtgctcatttt

SEQ ID NO: 661856 - DNA, 25 bp, Rattus norvegicus
cagtctgactcctcgggccctaaag

SEQ ID NO: 661857 - DNA, 25 bp, Rattus norvegicus
gggtttccgctagaaaagtgagcta

SEQ ID NO: 661858 - DNA, 25 bp, Rattus norvegicus
accgtctctttcacaggtccgagga

SEQ ID NO: 661859 - DNA, 25 bp, Rattus norvegicus
cccatatggaaagtcgtgagacccg

SEQ ID NO: 661860 - DNA, 25 bp, Rattus norvegicus
tgctctcaggcctggaacctaactg

SEQ ID NO: 661861 - DNA, 25 bp, Rattus norvegicus
aacgcgactcgctctcttccataga

SEQ ID NO: 661862 - DNA, 25 bp, Rattus norvegicus
agactcctggggtgagcagaagttc

SEQ ID NO: 661863 - DNA, 25 bp, Rattus norvegicus
tatgattgtgaaggccggtagcttc

SEQ ID NO: 661864 - DNA, 25 bp, Rattus norvegicus
gggtctcccatgtgtcagtaactta

SEQ ID NO: 661865 - DNA, 25 bp, Rattus norvegicus
actttcctagttcgggtctcccatg

SEQ ID NO: 661866 - DNA, 25 bp, Rattus norvegicus
ctgtcgccgaaacaagccgagcaga

SEQ ID NO: 661867 - DNA, 25 bp, Rattus norvegicus
acgcggacacgttctctatggagga

SEQ ID NO: 661868 - DNA, 25 bp, Rattus norvegicus
tcggcccacgtgctatcttcgcagt

SEQ ID NO: 661869 - DNA, 25 bp, Rattus norvegicus
gctcttcaccgagggtctgctctca

SEQ ID NO: 661870 - DNA, 25 bp, Rattus norvegicus
ctggttccctcagctggacggccat

SEQ ID NO: 661871 - DNA, 25 bp, Rattus norvegicus
cgagcagatcgggaactcagtttca

SEQ ID NO: 661872 - DNA, 25 bp, Rattus norvegicus
ttcgcagtccagaacctgtcgccga

SEQ ID NO: 661873 - DNA, 25 bp, Rattus norvegicus
tccttccggtagaggcgcccgaatg

SEQ ID NO: 661874 - DNA, 25 bp, Rattus norvegicus
cgccaaggaaagcacttggagactg

SEQ ID NO: 661875 - DNA, 25 bp, Rattus norvegicus
aagcacttggagactgcccgcagcc

SEQ ID NO: 661876 - DNA, 25 bp, Rattus norvegicus
agggcctccagctctcggtgcagct

SEQ ID NO: 661877 - DNA, 25 bp, Rattus norvegicus
agggatccgcaccagcagcatgggt

SEQ ID NO: 661878 - DNA, 25 bp, Rattus norvegicus
ccagcagcatgggtagaactcgctc

SEQ ID NO: 661879 - DNA, 25 bp, Rattus norvegicus
gtagaactcgctccatggcgccggc

SEQ ID NO: 661880 - DNA, 25 bp, Rattus norvegicus
agccatcttggcccggacgttcctt

SEQ ID NO: 661881 - DNA, 25 bp, Rattus norvegicus
aggcgcccgaatgcgtcacggacct

SEQ ID NO: 661882 - DNA, 25 bp, Rattus norvegicus
gcgtcacggacctgcgcggtgtttt

SEQ ID NO: 661883 - DNA, 25 bp, Rattus norvegicus
cgcggtgttttggaccttgtgactc

SEQ ID NO: 661884 - DNA, 25 bp, Rattus norvegicus
tggaccttgtgactctcacgtgaac

SEQ ID NO: 661885 - DNA, 25 bp, Rattus norvegicus
tcacgtgaaccgagagcggtcctgc

SEQ ID NO: 661886 - DNA, 25 bp, Rattus norvegicus
gaggcagcacttccgggccctggct

SEQ ID NO: 661887 - DNA, 25 bp, Rattus norvegicus
catcaccggctaggagactggtgac

SEQ ID NO: 661888 - DNA, 25 bp, Rattus norvegicus
tggctgctagatcggggactatata

SEQ ID NO: 661889 - DNA, 25 bp, Rattus norvegicus
ctgagttcggattggctgctagatc

SEQ ID NO: 661890 - DNA, 25 bp, Rattus norvegicus
ttctgtcgtcctgctgaccggaccg

SEQ ID NO: 661891 - DNA, 25 bp, Rattus norvegicus
gactatataagagtgcgcgcccagg

SEQ ID NO: 661892 - DNA, 25 bp, Rattus norvegicus
caggctggctctcatttctgtcgtc

SEQ ID NO: 661893 - DNA, 25 bp, Rattus norvegicus
ccgtgatctttctggtgcttgtctc

SEQ ID NO: 661894 - DNA, 25 bp, Rattus norvegicus
ctggccgtcgtgcttgccattcaga

SEQ ID NO: 661895 - DNA, 25 bp, Rattus norvegicus
tgccattcagagtgagtgcctcttc

SEQ ID NO: 661896 - DNA, 25 bp, Rattus norvegicus
ccctctcttggcgttaagatttgat

SEQ ID NO: 661897 - DNA, 25 bp, Rattus norvegicus
cttcccgacgggattgtccagggct

SEQ ID NO: 661898 - DNA, 25 bp, Rattus norvegicus
tccagggctgcgtctctcgggaaag

SEQ ID NO: 661899 - DNA, 25 bp, Rattus norvegicus
gctcgctcggtgaccgtgatctttc

SEQ ID NO: 661900 - DNA, 25 bp, Rattus norvegicus
ggtgacggccaccagatctgagttc

SEQ ID NO: 661901 - DNA, 25 bp, Rattus norvegicus
cgcaggttgctcaggcgtcttccca

SEQ ID NO: 661902 - DNA, 25 bp, Rattus norvegicus
acccgagcgcactcggctctttccg

SEQ ID NO: 661903 - DNA, 25 bp, Rattus norvegicus
caccgtcagaacaaaagtggccgtc

SEQ ID NO: 661904 - DNA, 25 bp, Rattus norvegicus
cacactggaggcttgcgagctagga

SEQ ID NO: 661905 - DNA, 25 bp, Rattus norvegicus
gcctcagcccgtcgcctcacgcact

SEQ ID NO: 661906 - DNA, 25 bp, Rattus norvegicus
gcgccttcgacccttccacccgagc

SEQ ID NO: 661907 - DNA, 25 bp, Rattus norvegicus
tgctcaggcgtcttcccagtccgat

SEQ ID NO: 661908 - DNA, 25 bp, Rattus norvegicus
ggcgtcttcccagtccgatgtcaca

SEQ ID NO: 661909 - DNA, 25 bp, Rattus norvegicus
tgtcacactggaggcttgcgagcta

SEQ ID NO: 661910 - DNA, 25 bp, Rattus norvegicus
cggatcagcgccgactccgcgccca

SEQ ID NO: 661911 - DNA, 25 bp, Rattus norvegicus
gcccaggggcctaggctcgagccca

SEQ ID NO: 661912 - DNA, 25 bp, Rattus norvegicus
gtgccgcctttctgacaccgtcaga

SEQ ID NO: 661913 - DNA, 25 bp, Rattus norvegicus
acaaaagtggccgtctgctttgcgc

SEQ ID NO: 661914 - DNA, 25 bp, Rattus norvegicus
ccgatgtcacactggaggcttgcga

SEQ ID NO: 661915 - DNA, 25 bp, Rattus norvegicus
tcactacggcgcctccttttgggtc

SEQ ID NO: 661916 - DNA, 25 bp, Rattus norvegicus
cgatctccagcgtgccgctctgcca

SEQ ID NO: 661917 - DNA, 25 bp, Rattus norvegicus
tccgtcttcgccttcgcctcgatct

SEQ ID NO: 661918 - DNA, 25 bp, Rattus norvegicus
cttgctccctcacagggtggcgttc

SEQ ID NO: 661919 - DNA, 25 bp, Rattus norvegicus
gcctccttttgggtcacgctggcca

SEQ ID NO: 661920 - DNA, 25 bp, Rattus norvegicus
atcacgggtgccttcacgctcttct

SEQ ID NO: 661921 - DNA, 25 bp, Rattus norvegicus
gctctgctcatcacgggtgccttca

SEQ ID NO: 661922 - DNA, 25 bp, Rattus norvegicus
tggaggtctagctctgctcatcacg

SEQ ID NO: 661923 - DNA, 25 bp, Rattus norvegicus
tccgctctatggaggtctagctctg

SEQ ID NO: 661924 - DNA, 25 bp, Rattus norvegicus
tctatgcccgctccgctctatggag

SEQ ID NO: 661925 - DNA, 25 bp, Rattus norvegicus
atcgccaatgcgctgctctctatgc

SEQ ID NO: 661926 - DNA, 25 bp, Rattus norvegicus
cttctggatcatcgccaatgcgctg

SEQ ID NO: 661927 - DNA, 25 bp, Rattus norvegicus
tggcgttctgcttctggatcatcgc

SEQ ID NO: 661928 - DNA, 25 bp, Rattus norvegicus
tcacgctggccaccggtgagtaccg

SEQ ID NO: 661929 - DNA, 25 bp, Rattus norvegicus
ggaggtcgccacttcctccctagtg

SEQ ID NO: 661930 - DNA, 25 bp, Rattus norvegicus
agccaggcgcgctgcctctttgtct

SEQ ID NO: 661931 - DNA, 25 bp, Rattus norvegicus
ggggcctcaggtcgtcctaacagaa

SEQ ID NO: 661932 - DNA, 25 bp, Rattus norvegicus
acagaacttgtctgtggaggagcga

SEQ ID NO: 661933 - DNA, 25 bp, Rattus norvegicus
gaggagcgagaagacccggaaccca

SEQ ID NO: 661934 - DNA, 25 bp, Rattus norvegicus
actcggcgcgcctagtcagtcaggc

SEQ ID NO: 661935 - DNA, 25 bp, Rattus norvegicus
tcagtcaggcttgcgcgcgctttcc

SEQ ID NO: 661936 - DNA, 25 bp, Rattus norvegicus
gcgtcccggacaaacggcttctggc

SEQ ID NO: 661937 - DNA, 25 bp, Rattus norvegicus
aagctgtgctcgctcgggagcaatg

SEQ ID NO: 661938 - DNA, 25 bp, Rattus norvegicus
agtggatgctcggaaagtgcttttc

SEQ ID NO: 661939 - DNA, 25 bp, Rattus norvegicus
cggaaagtgcttttcgcaggcggcc

SEQ ID NO: 661940 - DNA, 25 bp, Rattus norvegicus
gccgatttatagtctggctcgctcc

SEQ ID NO: 661941 - DNA, 25 bp, Rattus norvegicus
ttcctccctagtgtctgaccggggc

SEQ ID NO: 661942 - DNA, 25 bp, Rattus norvegicus
gcgtcggctccagcgccgatttata

SEQ ID NO: 661943 - DNA, 25 bp, Rattus norvegicus
tgacggctaaaagctgagtcccagc

SEQ ID NO: 661944 - DNA, 25 bp, Rattus norvegicus
ccgtgtcagggacgaagcttctgtt

SEQ ID NO: 661945 - DNA, 25 bp, Rattus norvegicus
tcagggacgaagcttctgttagcca

SEQ ID NO: 661946 - DNA, 25 bp, Rattus norvegicus
acgaagcttctgttagccagaaata

SEQ ID NO: 661947 - DNA, 25 bp, Rattus norvegicus
tctgttagccagaaatactgacggc

SEQ ID NO: 661948 - DNA, 25 bp, Rattus norvegicus
tactgacggctaaaagctgagtccc

SEQ ID NO: 661949 - DNA, 25 bp, Rattus norvegicus
ggctaaaagctgagtcccagccaag

SEQ ID NO: 661950 - DNA, 25 bp, Rattus norvegicus
gtccctccctaaatctcagacctca

SEQ ID NO: 661951 - DNA, 25 bp, Rattus norvegicus
gcactcacccggtcgctgctggcag

SEQ ID NO: 661952 - DNA, 25 bp, Rattus norvegicus
ggtctcgacccgaatgaggcggtgc

SEQ ID NO: 661953 - DNA, 25 bp, Rattus norvegicus
gcggacacagacgagcccccagagt

SEQ ID NO: 661954 - DNA, 25 bp, Rattus norvegicus
ctcgaagtcgcggtctcgctgcagc

SEQ ID NO: 661955 - DNA, 25 bp, Rattus norvegicus
gctgcagccggtaggcggctaggat

SEQ ID NO: 661956 - DNA, 25 bp, Rattus norvegicus
ccagaaatactgacggctaaaagct

SEQ ID NO: 661957 - DNA, 25 bp, Rattus norvegicus
ctccaccgtctcacctgcgggcagg

SEQ ID NO: 661958 - DNA, 25 bp, Rattus norvegicus
tacatgaggtgcagctgtgagggca

SEQ ID NO: 661959 - DNA, 25 bp, Rattus norvegicus
aggcaagcaccccacgtcaggcgtg

SEQ ID NO: 661960 - DNA, 25 bp, Rattus norvegicus
gggcagcggaggctccaccgtctca

SEQ ID NO: 661961 - DNA, 25 bp, Rattus norvegicus
agctgccgccacgtacatgaggtgc

SEQ ID NO: 661962 - DNA, 25 bp, Rattus norvegicus
cccacgtcaggcgtggcgatgctgt

SEQ ID NO: 661963 - DNA, 25 bp, Rattus norvegicus
cacgtacatgaggtgcagctgtgag

SEQ ID NO: 661964 - DNA, 25 bp, Rattus norvegicus
acgaaggcagctgccgccacgtaca

SEQ ID NO: 661965 - DNA, 25 bp, Rattus norvegicus
gcagctgccgccacgtacatgaggt

SEQ ID NO: 661966 - DNA, 25 bp, Rattus norvegicus
gagcacgaaggcagctgccgccacg

SEQ ID NO: 661967 - DNA, 25 bp, Rattus norvegicus
tgccgccacgtacatgaggtgcagc

SEQ ID NO: 661968 - DNA, 25 bp, Rattus norvegicus
ccgccacgtacatgaggtgcagctg

SEQ ID NO: 661969 - DNA, 25 bp, Rattus norvegicus
cccacagcccacaaagaacaggagc

SEQ ID NO: 661970 - DNA, 25 bp, Rattus norvegicus
ccacgtacatgaggtgcagctgtga

SEQ ID NO: 661971 - DNA, 25 bp, Rattus norvegicus
tttagttcgtgcctcccggacaggc

SEQ ID NO: 661972 - DNA, 25 bp, Rattus norvegicus
agcccggcccattggctgccaggaa

SEQ ID NO: 661973 - DNA, 25 bp, Rattus norvegicus
aggcactcacccgagagccgatgta

SEQ ID NO: 661974 - DNA, 25 bp, Rattus norvegicus
caatgcctgcctagccgagacgatt

SEQ ID NO: 661975 - DNA, 25 bp, Rattus norvegicus
gctggctgtccaatgcctgcctagc

SEQ ID NO: 661976 - DNA, 25 bp, Rattus norvegicus
gacccacaagaaggctggctgtcca

SEQ ID NO: 661977 - DNA, 25 bp, Rattus norvegicus
tcagcagcctcgaagacccacaaga

SEQ ID NO: 661978 - DNA, 25 bp, Rattus norvegicus
tcccggacaggctcgggtcagcagc

SEQ ID NO: 661979 - DNA, 25 bp, Rattus norvegicus
cgctgcttttgtagccgcgcccaga

SEQ ID NO: 661980 - DNA, 25 bp, Rattus norvegicus
acaaggtcctagtcgccaagctcgc

SEQ ID NO: 661981 - DNA, 25 bp, Rattus norvegicus
ctctgtgtgcacaaggtcctagtcg

SEQ ID NO: 661982 - DNA, 25 bp, Rattus norvegicus
tctgctgctgctctgtgtgcacaag

SEQ ID NO: 661983 - DNA, 25 bp, Rattus norvegicus
gagagccgatgtagtgcaccgcctc

SEQ ID NO: 661984 - DNA, 25 bp, Rattus norvegicus
cattggctgccaggaacaggtggcc

SEQ ID NO: 661985 - DNA, 25 bp, Rattus norvegicus
tgtagcagctctgcacgtggtgagc

SEQ ID NO: 661986 - DNA, 25 bp, Rattus norvegicus
tcctagtcatggctccggactccgg

SEQ ID NO: 661987 - DNA, 25 bp, Rattus norvegicus
cccgacggacaatttttgaagctgc

SEQ ID NO: 661988 - DNA, 25 bp, Rattus norvegicus
aatttttgaagctgctgcctgtgga

SEQ ID NO: 661989 - DNA, 25 bp, Rattus norvegicus
ctcgccgatgaggatctcgttgccc

SEQ ID NO: 661990 - DNA, 25 bp, Rattus norvegicus
cggacggctttgtgcagttagactt

SEQ ID NO: 661991 - DNA, 25 bp, Rattus norvegicus
agttagacttgcagtgcgctagccc

SEQ ID NO: 661992 - DNA, 25 bp, Rattus norvegicus
ggaggatcagtatggaccgcttgca

SEQ ID NO: 661993 - DNA, 25 bp, Rattus norvegicus
caagacccagttagtgcgggccgtg

SEQ ID NO: 661994 - DNA, 25 bp, Rattus norvegicus
caaccggccggtgtcgcgaggacac

SEQ ID NO: 661995 - DNA, 25 bp, Rattus norvegicus
gagacggccgactccctaagggagc

SEQ ID NO: 661996 - DNA, 25 bp, Rattus norvegicus
tccctggtgtggttctcctagtcat

SEQ ID NO: 661997 - DNA, 25 bp, Rattus norvegicus
tgtgttatccgctcgccttagccgc

SEQ ID NO: 661998 - DNA, 25 bp, Rattus norvegicus
gaccgcttgcaaccggtgtcctgtc

SEQ ID NO: 661999 - DNA, 25 bp, Rattus norvegicus
tgggcgttgacaccctctggccgca

SEQ ID NO: 662000 - DNA, 25 bp, Rattus norvegicus
ctggctcggtgcgactcggtccgat

SEQ ID NO: 662001 - DNA, 25 bp, Rattus norvegicus
gactcggtccgatcggtctccgcgt

SEQ ID NO: 662002 - DNA, 25 bp, Rattus norvegicus
ggtctccgcgtgacctgaacgcgcg

SEQ ID NO: 662003 - DNA, 25 bp, Rattus norvegicus
cggttggctgcatataaggccggct

SEQ ID NO: 662004 - DNA, 25 bp, Rattus norvegicus
ggctgcatataaggccggctcggtt

SEQ ID NO: 662005 - DNA, 25 bp, Rattus norvegicus
tcggttctgggcgttgacaccctct

SEQ ID NO: 662006 - DNA, 25 bp, Rattus norvegicus
cgcgctgcgctatcgtcctgcaggg

SEQ ID NO: 662007 - DNA, 25 bp, Rattus norvegicus
agccgcctcaggtgcgtcatctttc

SEQ ID NO: 662008 - DNA, 25 bp, Rattus norvegicus
ctcaggtgcgtcatctttctgaaaa

SEQ ID NO: 662009 - DNA, 25 bp, Rattus norvegicus
ctttctgaaaagttctgtggagcgg

SEQ ID NO: 662010 - DNA, 25 bp, Rattus norvegicus
cgccaggccttctgcgattgctgaa

SEQ ID NO: 662011 - DNA, 25 bp, Rattus norvegicus
tctgcgattgctgaaccgctgggtg

SEQ ID NO: 662012 - DNA, 25 bp, Rattus norvegicus
atataaggccggctcggttctgggc

SEQ ID NO: 662013 - DNA, 25 bp, Rattus norvegicus
catttaagaacagcggcgtgtcgtc

SEQ ID NO: 662014 - DNA, 25 bp, Rattus norvegicus
ggccaccacgactcgaagtttatta

SEQ ID NO: 662015 - DNA, 25 bp, Rattus norvegicus
tcgaagtttattaaagcgcgaaagc

SEQ ID NO: 662016 - DNA, 25 bp, Rattus norvegicus
tcgtcgctcacctcgtccgagaagt

SEQ ID NO: 662017 - DNA, 25 bp, Rattus norvegicus
cctcgtccgagaagtcgaaggcgct

SEQ ID NO: 662018 - DNA, 25 bp, Rattus norvegicus
aggagaacgagacccgctactgtcg

SEQ ID NO: 662019 - DNA, 25 bp, Rattus norvegicus
tcgtcggccaccacgactcgaagtt

SEQ ID NO: 662020 - DNA, 25 bp, Rattus norvegicus
gcgtgtcgtctttcctcagcaggga

SEQ ID NO: 662021 - DNA, 25 bp, Rattus norvegicus
tcagcagggatttgaggcgcttcca

SEQ ID NO: 662022 - DNA, 25 bp, Rattus norvegicus
atttgaggcgcttccacgcgccggg

SEQ ID NO: 662023 - DNA, 25 bp, Rattus norvegicus
gcgtccctgcccatcgtgaggagaa

SEQ ID NO: 662024 - DNA, 25 bp, Rattus norvegicus
tgcccatcgtgaggagaacgagacc

SEQ ID NO: 662025 - DNA, 25 bp, Rattus norvegicus
ctttccggggcttccgagtcatcgt

SEQ ID NO: 662026 - DNA, 25 bp, Rattus norvegicus
cgaaggcgctggtgtcatttaagaa

SEQ ID NO: 662027 - DNA, 25 bp, Rattus norvegicus
acatgaatgttcctgtgccaccgcc

SEQ ID NO: 662028 - DNA, 25 bp, Rattus norvegicus
cggaaaagattcaggcggttagctc

SEQ ID NO: 662029 - DNA, 25 bp, Rattus norvegicus
cggttagctctacgctcggcgctct

SEQ ID NO: 662030 - DNA, 25 bp, Rattus norvegicus
tcggcgctctaaccgttcttccagg

SEQ ID NO: 662031 - DNA, 25 bp, Rattus norvegicus
ctgtgaaacctaacctgcacgcgca

SEQ ID NO: 662032 - DNA, 25 bp, Rattus norvegicus
gcgggctttcctgactggcagtaac

SEQ ID NO: 662033 - DNA, 25 bp, Rattus norvegicus
ttcgtcacttccgtgtgccaaggcg

SEQ ID NO: 662034 - DNA, 25 bp, Rattus norvegicus
ccaaggcggctttcgtccgactaga

SEQ ID NO: 662035 - DNA, 25 bp, Rattus norvegicus
tccgactagacgctcgaacttgtta

SEQ ID NO: 662036 - DNA, 25 bp, Rattus norvegicus
taggttcctacgtcttgcctttggc

SEQ ID NO: 662037 - DNA, 25 bp, Rattus norvegicus
aggttctcgcttaaattggacacaa

SEQ ID NO: 662038 - DNA, 25 bp, Rattus norvegicus
cccagtgcagggacatgaatgttcc

SEQ ID NO: 662039 - DNA, 25 bp, Rattus norvegicus
tcaagctcagagttcgtactgacta

SEQ ID NO: 662040 - DNA, 25 bp, Rattus norvegicus
ctgactaatttagcggttcgtgtta

SEQ ID NO: 662041 - DNA, 25 bp, Rattus norvegicus
aaagcgtctaggctgcatcgggaca

SEQ ID NO: 662042 - DNA, 25 bp, Rattus norvegicus
ccactgtagtttctgctgcgccagc

SEQ ID NO: 662043 - DNA, 25 bp, Rattus norvegicus
cccgcccgagttcggtgttgggcag

SEQ ID NO: 662044 - DNA, 25 bp, Rattus norvegicus
tgtagtttctgctgcgccagcgctg

SEQ ID NO: 662045 - DNA, 25 bp, Rattus norvegicus
gtctaggctgcatcgggacagtcgc

SEQ ID NO: 662046 - DNA, 25 bp, Rattus norvegicus
cccacggtgtcgctcagccgggtaa

SEQ ID NO: 662047 - DNA, 25 bp, Rattus norvegicus
gctcagccgggtaagacgcatccca

SEQ ID NO: 662048 - DNA, 25 bp, Rattus norvegicus
gggtaagacgcatcccacaacgttg

SEQ ID NO: 662049 - DNA, 25 bp, Rattus norvegicus
aagacgcatcccacaacgttgtcac

SEQ ID NO: 662050 - DNA, 25 bp, Rattus norvegicus
acaacgttgtcacccttccacagcc

SEQ ID NO: 662051 - DNA, 25 bp, Rattus norvegicus
agcctctcgctgtcacccgtcctgt

SEQ ID NO: 662052 - DNA, 25 bp, Rattus norvegicus
gcgctccagcgccactgtagtttct

SEQ ID NO: 662053 - DNA, 25 bp, Rattus norvegicus
ctgcatcgggacagtcgcgggtcac

SEQ ID NO: 662054 - DNA, 25 bp, Rattus norvegicus
taagaaaagcgtctaggctgcatcg

SEQ ID NO: 662055 - DNA, 25 bp, Rattus norvegicus
ctggagaacagcgtttaccggcgga

SEQ ID NO: 662056 - DNA, 25 bp, Rattus norvegicus
ccgcctcttttctacatgctggttg

SEQ ID NO: 662057 - DNA, 25 bp, Rattus norvegicus
ttctacatgctggttggcgaagctg

SEQ ID NO: 662058 - DNA, 25 bp, Rattus norvegicus
gctggttggcgaagctgacctccaa

SEQ ID NO: 662059 - DNA, 25 bp, Rattus norvegicus
ttggcgaagctgacctccaagggcg

SEQ ID NO: 662060 - DNA, 25 bp, Rattus norvegicus
agctgacctccaagggcggtgccgc

SEQ ID NO: 662061 - DNA, 25 bp, Rattus norvegicus
ccggggccagtttgctcctgggatt

SEQ ID NO: 662062 - DNA, 25 bp, Rattus norvegicus
ccagtttgctcctgggattggctga

SEQ ID NO: 662063 - DNA, 25 bp, Rattus norvegicus
tttgctcctgggattggctgacgtg

SEQ ID NO: 662064 - DNA, 25 bp, Rattus norvegicus
ggtaggaagtggtagccgtcaatca

SEQ ID NO: 662065 - DNA, 25 bp, Rattus norvegicus
tagccgtcaatcacgagggagactc

SEQ ID NO: 662066 - DNA, 25 bp, Rattus norvegicus
agggagactccaaacagtgagcctg

SEQ ID NO: 662067 - DNA, 25 bp, Rattus norvegicus
caaacagtgagcctggagctggaga

SEQ ID NO: 662068 - DNA, 25 bp, Rattus norvegicus
gggtccgcctcttttctacatgctg

SEQ ID NO: 662069 - DNA, 25 bp, Rattus norvegicus
tgcccatcttttgtgtcttaccgga

SEQ ID NO: 662070 - DNA, 25 bp, Rattus norvegicus
cggcacagtggcaggctctgatatt

SEQ ID NO: 662071 - DNA, 25 bp, Rattus norvegicus
ctgcttccaggcttttcttggggtc

SEQ ID NO: 662072 - DNA, 25 bp, Rattus norvegicus
accgagtgtgatgcagggaaccacc

SEQ ID NO: 662073 - DNA, 25 bp, Rattus norvegicus
tctgtttaggtacagcggctctaac

SEQ ID NO: 662074 - DNA, 25 bp, Rattus norvegicus
ccaaagccctggagatttcggtgcg

SEQ ID NO: 662075 - DNA, 25 bp, Rattus norvegicus
cccatgagctgggatggaaactaga

SEQ ID NO: 662076 - DNA, 25 bp, Rattus norvegicus
ccggggatcagggataggaacccat

SEQ ID NO: 662077 - DNA, 25 bp, Rattus norvegicus
tcccggcaagtaagtgtatctcgtc

SEQ ID NO: 662078 - DNA, 25 bp, Rattus norvegicus
aagaggtgctcagccttcccggcaa

SEQ ID NO: 662079 - DNA, 25 bp, Rattus norvegicus
caaccaggattaggaccagggagcg

SEQ ID NO: 662080 - DNA, 25 bp, Rattus norvegicus
gcggagtaaccggtgaagtgtcaaa

SEQ ID NO: 662081 - DNA, 25 bp, Rattus norvegicus
cccgctgggcttgttttctgtttag

SEQ ID NO: 662082 - DNA, 25 bp, Rattus norvegicus
ccctgaagccagacacctgcgagtg

SEQ ID NO: 662083 - DNA, 25 bp, Rattus norvegicus
tttcaggatagatcgcaaggcgcga

SEQ ID NO: 662084 - DNA, 25 bp, Rattus norvegicus
gaaaagtttcttcctggcagggctg

SEQ ID NO: 662085 - DNA, 25 bp, Rattus norvegicus
ccctaggctgcaaggaaaagtttct

SEQ ID NO: 662086 - DNA, 25 bp, Rattus norvegicus
tcattgctctcccaagccgtacggt

SEQ ID NO: 662087 - DNA, 25 bp, Rattus norvegicus
tccctatgagaggtaagacagtctc

SEQ ID NO: 662088 - DNA, 25 bp, Rattus norvegicus
tgtctgttttttaaagcaggcttcc

SEQ ID NO: 662089 - DNA, 25 bp, Rattus norvegicus
ttccatctgatcctgacaagcttta

SEQ ID NO: 662090 - DNA, 25 bp, Rattus norvegicus
cgtcttgatcggcttttccatctga

SEQ ID NO: 662091 - DNA, 25 bp, Rattus norvegicus
ccgagaccgtgggattgctctttct

SEQ ID NO: 662092 - DNA, 25 bp, Rattus norvegicus
gctagagcggaccagtttcaggata

SEQ ID NO: 662093 - DNA, 25 bp, Rattus norvegicus
acaccatttgccgagcagcggtttg

SEQ ID NO: 662094 - DNA, 25 bp, Rattus norvegicus
actcggagatggatcgaattacacc

SEQ ID NO: 662095 - DNA, 25 bp, Rattus norvegicus
tgcgtgctttgttctctgactgaaa

SEQ ID NO: 662096 - DNA, 25 bp, Rattus norvegicus
gctctttctgcacaccgtcttgatc

SEQ ID NO: 662097 - DNA, 25 bp, Rattus norvegicus
taacggatcgcgatttgaaaaggcc

SEQ ID NO: 662098 - DNA, 25 bp, Rattus norvegicus
aggtggatgccctacgaagccgccg

SEQ ID NO: 662099 - DNA, 25 bp, Rattus norvegicus
tccatctctggaggtggatgcccta

SEQ ID NO: 662100 - DNA, 25 bp, Rattus norvegicus
agctatagcagctccatctctggag

SEQ ID NO: 662101 - DNA, 25 bp, Rattus norvegicus
tccgtgagctatagcagctccatct

SEQ ID NO: 662102 - DNA, 25 bp, Rattus norvegicus
ccggatctcgcgagagcggacgagg

SEQ ID NO: 662103 - DNA, 25 bp, Rattus norvegicus
gagcggtaacggatcgcgatttgaa

SEQ ID NO: 662104 - DNA, 25 bp, Rattus norvegicus
tccgagcgctacaatggcgacggcc

SEQ ID NO: 662105 - DNA, 25 bp, Rattus norvegicus
gccgcgcttagggctccgagcgcta

SEQ ID NO: 662106 - DNA, 25 bp, Rattus norvegicus
gggcttgtcggcatcggccatcccg

SEQ ID NO: 662107 - DNA, 25 bp, Rattus norvegicus
cctcgggcttgtcggcatcggccat

SEQ ID NO: 662108 - DNA, 25 bp, Rattus norvegicus
tctcgccgcggctcagccggttgct

SEQ ID NO: 662109 - DNA, 25 bp, Rattus norvegicus
tgctgcgcggcggtttctccggctc

SEQ ID NO: 662110 - DNA, 25 bp, Rattus norvegicus
gcgtttggatccgtgagctatagca

SEQ ID NO: 662111 - DNA, 25 bp, Rattus norvegicus
gaccctgcggtctctgtctctaaga

SEQ ID NO: 662112 - DNA, 25 bp, Rattus norvegicus
tcacgtccgcgcaaagcctaagctg

SEQ ID NO: 662113 - DNA, 25 bp, Rattus norvegicus
ctcctgtagggagcctgggtttgaa

SEQ ID NO: 662114 - DNA, 25 bp, Rattus norvegicus
tttgaactgataacggtgagcctgg

SEQ ID NO: 662115 - DNA, 25 bp, Rattus norvegicus
ctcgagccctttgcggaaggccgct

SEQ ID NO: 662116 - DNA, 25 bp, Rattus norvegicus
ggccggcttactcatcgctttctgc

SEQ ID NO: 662117 - DNA, 25 bp, Rattus norvegicus
gctttctgcatttaccttccagccg

SEQ ID NO: 662118 - DNA, 25 bp, Rattus norvegicus
acccacccttggtgcagtcgtggct

SEQ ID NO: 662119 - DNA, 25 bp, Rattus norvegicus
ggcaggaatgcgaacacccaccctt

SEQ ID NO: 662120 - DNA, 25 bp, Rattus norvegicus
tgcaggctacgacctgtacaggtga

SEQ ID NO: 662121 - DNA, 25 bp, Rattus norvegicus
atgacgcttctctgcgtttcgtgcg

SEQ ID NO: 662122 - DNA, 25 bp, Rattus norvegicus
gctcgagcggaagatgacgcttctc

SEQ ID NO: 662123 - DNA, 25 bp, Rattus norvegicus
ctgtctctaagagggctcgagcgga

SEQ ID NO: 662124 - DNA, 25 bp, Rattus norvegicus
atgccctgctcggaagaccctgcgg

SEQ ID NO: 662125 - DNA, 25 bp, Rattus norvegicus
cagtgtgccggctgccagtcgctcg

SEQ ID NO: 662126 - DNA, 25 bp, Rattus norvegicus
cccgcaggaagtggaaggagttgtt

SEQ ID NO: 662127 - DNA, 25 bp, Rattus norvegicus
ccacgttggtgtgcagcacgtggct

SEQ ID NO: 662128 - DNA, 25 bp, Rattus norvegicus
gaagaccacgttggtgtgcagcacg

SEQ ID NO: 662129 - DNA, 25 bp, Rattus norvegicus
gcgcgtcacgcttgaagaccacgtt

SEQ ID NO: 662130 - DNA, 25 bp, Rattus norvegicus
tcgcggccatagtaggggaagatca

SEQ ID NO: 662131 - DNA, 25 bp, Rattus norvegicus
tcacgcttgaagaccacgttggtgt

SEQ ID NO: 662132 - DNA, 25 bp, Rattus norvegicus
cttcctcgcggccatagtaggggaa

SEQ ID NO: 662133 - DNA, 25 bp, Rattus norvegicus
ggaagatcatctgctggccctgcgc

SEQ ID NO: 662134 - DNA, 25 bp, Rattus norvegicus
gcgtagctcttcctcgcggccatag

SEQ ID NO: 662135 - DNA, 25 bp, Rattus norvegicus
ccatagtaggggaagatcatctgct

SEQ ID NO: 662136 - DNA, 25 bp, Rattus norvegicus
ggaaggagttgttgcgtagctgatc

SEQ ID NO: 662137 - DNA, 25 bp, Rattus norvegicus
ggccctgcgcgtcacgcttgaagac

SEQ ID NO: 662138 - DNA, 25 bp, Rattus norvegicus
cttgatcgggtgcttgcgtagctct

SEQ ID NO: 662139 - DNA, 25 bp, Rattus norvegicus
gtggctgcctgtggcacccacagtc

SEQ ID NO: 662140 - DNA, 25 bp, Rattus norvegicus
ccgcctcgtctcttggcgcgattgg

SEQ ID NO: 662141 - DNA, 25 bp, Rattus norvegicus
cgattggctctggtctcctttaggc

SEQ ID NO: 662142 - DNA, 25 bp, Rattus norvegicus
ccatggctcgtgtaggactcgagga

SEQ ID NO: 662143 - DNA, 25 bp, Rattus norvegicus
agggtgaaagccagcgcgacctcca

SEQ ID NO: 662144 - DNA, 25 bp, Rattus norvegicus
tgctcccgctgtcctgctacaggga

SEQ ID NO: 662145 - DNA, 25 bp, Rattus norvegicus
tgggtcctaccgctttcttctctcg

SEQ ID NO: 662146 - DNA, 25 bp, Rattus norvegicus
agacactcagggctcccgggatgct

SEQ ID NO: 662147 - DNA, 25 bp, Rattus norvegicus
cgggatgctgaaaggctcgcagtcc

SEQ ID NO: 662148 - DNA, 25 bp, Rattus norvegicus
cgaggaccgttcgattccagctggc

SEQ ID NO: 662149 - DNA, 25 bp, Rattus norvegicus
gccggctgcctacaatgtcttaatg

SEQ ID NO: 662150 - DNA, 25 bp, Rattus norvegicus
atggcactaattgcgcgcggtgacg

SEQ ID NO: 662151 - DNA, 25 bp, Rattus norvegicus
cccactggactagcggcttggactt

SEQ ID NO: 662152 - DNA, 25 bp, Rattus norvegicus
ccagctgcagatgctcgagacaacc

SEQ ID NO: 662153 - DNA, 25 bp, Rattus norvegicus
tgtctggacttccagcccgcgagca

SEQ ID NO: 662154 - DNA, 25 bp, Rattus norvegicus
agcgcccttaccaaagagctgggtc

SEQ ID NO: 662155 - DNA, 25 bp, Rattus norvegicus
tccggcgtccaggaatcacgggcgc

SEQ ID NO: 662156 - DNA, 25 bp, Rattus norvegicus
actgggtgtactcacgcagcgccct

SEQ ID NO: 662157 - DNA, 25 bp, Rattus norvegicus
aaaccgagcagggagcgaacacgca

SEQ ID NO: 662158 - DNA, 25 bp, Rattus norvegicus
cgctcaggtctaccggtgagacgcc

SEQ ID NO: 662159 - DNA, 25 bp, Rattus norvegicus
aggagactcgaaggccggtcccgat

SEQ ID NO: 662160 - DNA, 25 bp, Rattus norvegicus
agcaacccgctgtctggacttccag

SEQ ID NO: 662161 - DNA, 25 bp, Rattus norvegicus
ccgcagttacgagagcgcggctgtt

SEQ ID NO: 662162 - DNA, 25 bp, Rattus norvegicus
tcggttgagaagtcgtccgcagtta

SEQ ID NO: 662163 - DNA, 25 bp, Rattus norvegicus
ccgcctcccacaagatcggttgaga

SEQ ID NO: 662164 - DNA, 25 bp, Rattus norvegicus
gagcagcggtttcctccaatcgccg

SEQ ID NO: 662165 - DNA, 25 bp, Rattus norvegicus
cccgccactagacgagcagcggttt

SEQ ID NO: 662166 - DNA, 25 bp, Rattus norvegicus
ggccgtgagactgcagtcacctcca

SEQ ID NO: 662167 - DNA, 25 bp, Rattus norvegicus
cgagaagagccctttcgaccagcta

SEQ ID NO: 662168 - DNA, 25 bp, Rattus norvegicus
cgagctgcagatggacgtgctgccc

SEQ ID NO: 662169 - DNA, 25 bp, Rattus norvegicus
cgcccgtctctgcaaaaggtgtatt

SEQ ID NO: 662170 - DNA, 25 bp, Rattus norvegicus
gctgagttgcttccaccatggcgga

SEQ ID NO: 662171 - DNA, 25 bp, Rattus norvegicus
accatggcggagatggcagagcttt

SEQ ID NO: 662172 - DNA, 25 bp, Rattus norvegicus
ctgttttcgctgatggttgtcaatc

SEQ ID NO: 662173 - DNA, 25 bp, Rattus norvegicus
ctgtacgaagaaagcaacgagctgc

SEQ ID NO: 662174 - DNA, 25 bp, Rattus norvegicus
tgtcaatcgactgaccgaagagctc

SEQ ID NO: 662175 - DNA, 25 bp, Rattus norvegicus
cgcggacctagaaggcgacgagttt

SEQ ID NO: 662176 - DNA, 25 bp, Rattus norvegicus
tgattgggaggacgactatgacttc

SEQ ID NO: 662177 - DNA, 25 bp, Rattus norvegicus
gacttccctgaagaggagcgctgga

SEQ ID NO: 662178 - DNA, 25 bp, Rattus norvegicus
agccaacaaggtgttcctgcgaacg

SEQ ID NO: 662179 - DNA, 25 bp, Rattus norvegicus
cgaccagctagcttttatcgaagag

SEQ ID NO: 662180 - DNA, 25 bp, Rattus norvegicus
cagagctttgcgagctgtacgaaga

SEQ ID NO: 662181 - DNA, 25 bp, Rattus norvegicus
tggccaagaatcaacccgagcgggg

SEQ ID NO: 662182 - DNA, 25 bp, Rattus norvegicus
gcttttcgccgctgagctcagacgg

SEQ ID NO: 662183 - DNA, 25 bp, Rattus norvegicus
ggcctttcagcccaggcggcctgcc

SEQ ID NO: 662184 - DNA, 25 bp, Rattus norvegicus
ctctagtcggtgtgcgcagagccgt

SEQ ID NO: 662185 - DNA, 25 bp, Rattus norvegicus
tgcgcagagccgtgggccgctttct

SEQ ID NO: 662186 - DNA, 25 bp, Rattus norvegicus
agaatcaacccgagcggggatggcc

SEQ ID NO: 662187 - DNA, 25 bp, Rattus norvegicus
agccgtgggccgctttctccatggc

SEQ ID NO: 662188 - DNA, 25 bp, Rattus norvegicus
gcgcagtaggaaatggagacgttca

SEQ ID NO: 662189 - DNA, 25 bp, Rattus norvegicus
gagggatcatctgggacggaagccg

SEQ ID NO: 662190 - DNA, 25 bp, Rattus norvegicus
cgtccgcttcacaccgccggctaga

SEQ ID NO: 662191 - DNA, 25 bp, Rattus norvegicus
ccgccggctagacgccgactcggct

SEQ ID NO: 662192 - DNA, 25 bp, Rattus norvegicus
actcggctacgccactggctgggga

SEQ ID NO: 662193 - DNA, 25 bp, Rattus norvegicus
gcggctctagctcaaggcggtggag

SEQ ID NO: 662194 - DNA, 25 bp, Rattus norvegicus
ggcggggatggccaagaatcaaccc

SEQ ID NO: 662195 - DNA, 25 bp, Rattus norvegicus
accctgcagcgtggaaccgggccaa

SEQ ID NO: 662196 - DNA, 25 bp, Rattus norvegicus
ggtcgtagtcctcctcatcatcgca

SEQ ID NO: 662197 - DNA, 25 bp, Rattus norvegicus
tcatcctccatgtcagacatcttgg

SEQ ID NO: 662198 - DNA, 25 bp, Rattus norvegicus
agaagcgtcactcccgattctccta

SEQ ID NO: 662199 - DNA, 25 bp, Rattus norvegicus
gattctcctagtcttccggtctctc

SEQ ID NO: 662200 - DNA, 25 bp, Rattus norvegicus
ctcctggagaagagagagctcattc

SEQ ID NO: 662201 - DNA, 25 bp, Rattus norvegicus
ctcattccggaaccaatgcgctcga

SEQ ID NO: 662202 - DNA, 25 bp, Rattus norvegicus
cgctcgaccctgagacgatttacta

SEQ ID NO: 662203 - DNA, 25 bp, Rattus norvegicus
agacgatttactacggcgcccaaag

SEQ ID NO: 662204 - DNA, 25 bp, Rattus norvegicus
aaagggagcgcacagtcggctcttc

SEQ ID NO: 662205 - DNA, 25 bp, Rattus norvegicus
ttcctgcgcgacagttggtgtctta

SEQ ID NO: 662206 - DNA, 25 bp, Rattus norvegicus
cttagcaactaagcgtagcaactgg

SEQ ID NO: 662207 - DNA, 25 bp, Rattus norvegicus
tagcaactgggaaatcgggcgctgc

SEQ ID NO: 662208 - DNA, 25 bp, Rattus norvegicus
cagagagaagatgagaaccggccgc

SEQ ID NO: 662209 - DNA, 25 bp, Rattus norvegicus
tcaaggcgtgcttagtgcccagttt

SEQ ID NO: 662210 - DNA, 25 bp, Rattus norvegicus
ctaagaaccacgtgaaaggggcctg

SEQ ID NO: 662211 - DNA, 25 bp, Rattus norvegicus
ctccaaggagactgcgcgcctgtca

SEQ ID NO: 662212 - DNA, 25 bp, Rattus norvegicus
gcctgtcagccgcaatttgtttaag

SEQ ID NO: 662213 - DNA, 25 bp, Rattus norvegicus
ccctactgcttaaccgggctagctg

SEQ ID NO: 662214 - DNA, 25 bp, Rattus norvegicus
caacgaatgcgcctagtgtcttcta

SEQ ID NO: 662215 - DNA, 25 bp, Rattus norvegicus
ttgtccgacgcatagggccactcat

SEQ ID NO: 662216 - DNA, 25 bp, Rattus norvegicus
tgcccagtttttggcgctcacgtgc

SEQ ID NO: 662217 - DNA, 25 bp, Rattus norvegicus
tcatgcgtgcagatacctacaggga

SEQ ID NO: 662218 - DNA, 25 bp, Rattus norvegicus
tacagggacctatgcgagaccattc

SEQ ID NO: 662219 - DNA, 25 bp, Rattus norvegicus
ttctcgatgtaacccggccaaaaga

SEQ ID NO: 662220 - DNA, 25 bp, Rattus norvegicus
ccaaaagatgaacccggcagccctg

SEQ ID NO: 662221 - DNA, 25 bp, Rattus norvegicus
ttgcgggaagctaagactaagaacc

SEQ ID NO: 662222 - DNA, 25 bp, Rattus norvegicus
tgtcttctaccgaccacttgtccga

SEQ ID NO: 662223 - DNA, 25 bp, Rattus norvegicus
cggaaaacgggcatcacagcagaga

SEQ ID NO: 662224 - DNA, 25 bp, Rattus norvegicus
tcacagcagagagccgacggttcct

SEQ ID NO: 662225 - DNA, 25 bp, Rattus norvegicus
gacggttcctttgggacagttcaca

SEQ ID NO: 662226 - DNA, 25 bp, Rattus norvegicus
acagttcacagaggaaaggaaggcg

SEQ ID NO: 662227 - DNA, 25 bp, Rattus norvegicus
ggggattcaccctctgagcatgcgc

SEQ ID NO: 662228 - DNA, 25 bp, Rattus norvegicus
gtcagcttcgccttggccctggcaa

SEQ ID NO: 662229 - DNA, 25 bp, Rattus norvegicus
ccgccctctggtgtcctgcggaaag

SEQ ID NO: 662230 - DNA, 25 bp, Rattus norvegicus
tgtcctgcggaaagcactccgggcg

SEQ ID NO: 662231 - DNA, 25 bp, Rattus norvegicus
ccgtacggaccgagagttcgtcgtg

SEQ ID NO: 662232 - DNA, 25 bp, Rattus norvegicus
gtggtgcaggttggccttccctcaa

SEQ ID NO: 662233 - DNA, 25 bp, Rattus norvegicus
ggccttccctcaagtccggtagctg

SEQ ID NO: 662234 - DNA, 25 bp, Rattus norvegicus
aagtccggtagctggggccagacac

SEQ ID NO: 662235 - DNA, 25 bp, Rattus norvegicus
cagcgaaggtcttactgcgggcgaa

SEQ ID NO: 662236 - DNA, 25 bp, Rattus norvegicus
cagacaccggacaggcccagcgaag

SEQ ID NO: 662237 - DNA, 25 bp, Rattus norvegicus
agacgcttacctacgcccaggtaga

SEQ ID NO: 662238 - DNA, 25 bp, Rattus norvegicus
cgctgaaaacaagcgctgtggcatc

SEQ ID NO: 662239 - DNA, 25 bp, Rattus norvegicus
ctgggccacccaagctgacaagggc

SEQ ID NO: 662240 - DNA, 25 bp, Rattus norvegicus
ggtcgtcagctcgtcagcacctgct

SEQ ID NO: 662241 - DNA, 25 bp, Rattus norvegicus
acctcctccaggacgtgcggttctt

SEQ ID NO: 662242 - DNA, 25 bp, Rattus norvegicus
tgcggttcttcctgcaactggccaa

SEQ ID NO: 662243 - DNA, 25 bp, Rattus norvegicus
gcaccatcctgcatgtcttcttgga

SEQ ID NO: 662244 - DNA, 25 bp, Rattus norvegicus
ttcttggagcaagcgcgcaagaccc

SEQ ID NO: 662245 - DNA, 25 bp, Rattus norvegicus
cgagcgtcgtttgccgagaactaga

SEQ ID NO: 662246 - DNA, 25 bp, Rattus norvegicus
tgtttcgcgacgagacgcttaccta

SEQ ID NO: 662247 - DNA, 25 bp, Rattus norvegicus
tagaccggcgcagcaaccaagtagc

SEQ ID NO: 662248 - DNA, 25 bp, Rattus norvegicus
gcgctgcatgatcacctgggactgc

SEQ ID NO: 662249 - DNA, 25 bp, Rattus norvegicus
tcttcatgggcaatgagccggccta

SEQ ID NO: 662250 - DNA, 25 bp, Rattus norvegicus
acaagcccttcctgctgtttcgcga

SEQ ID NO: 662251 - DNA, 25 bp, Rattus norvegicus
cttcaggccgccaagacaaaggagc

SEQ ID NO: 662252 - DNA, 25 bp, Rattus norvegicus
ctcggctactgagaatggcaggctc

SEQ ID NO: 662253 - DNA, 25 bp, Rattus norvegicus
aatggcaggctctctcccttcgaga

SEQ ID NO: 662254 - DNA, 25 bp, Rattus norvegicus
ttggggtgcgtgtgctaagttctcc

SEQ ID NO: 662255 - DNA, 25 bp, Rattus norvegicus
gctgttatcgccgaaacccgagcgc

SEQ ID NO: 662256 - DNA, 25 bp, Rattus norvegicus
cacacagagcgcttcgctgcacagg

SEQ ID NO: 662257 - DNA, 25 bp, Rattus norvegicus
ctgcacagggcgctattttccgaaa

SEQ ID NO: 662258 - DNA, 25 bp, Rattus norvegicus
aagtctccggggcaaatctcggcta

SEQ ID NO: 662259 - DNA, 25 bp, Rattus norvegicus
ttttccgaaaatgccgcgtctggtc

SEQ ID NO: 662260 - DNA, 25 bp, Rattus norvegicus
gccgcgtctggtcggcgcccaaaat

SEQ ID NO: 662261 - DNA, 25 bp, Rattus norvegicus
ataagccatttctagcgttccgcca

SEQ ID NO: 662262 - DNA, 25 bp, Rattus norvegicus
cggcggaatgatccactgggtgacc

SEQ ID NO: 662263 - DNA, 25 bp, Rattus norvegicus
tgaccgacgaaactcgcggcttctt

SEQ ID NO: 662264 - DNA, 25 bp, Rattus norvegicus
ctcccttcgagagtgtccggtctac

SEQ ID NO: 662265 - DNA, 25 bp, Rattus norvegicus
aagaggggatgatctgcgctgcttt

SEQ ID NO: 662266 - DNA, 25 bp, Rattus norvegicus
aggagttacggttctcacttgaagc

SEQ ID NO: 662267 - DNA, 25 bp, Rattus norvegicus
gaggcgcgacccgtcgcacgcaatg

SEQ ID NO: 662268 - DNA, 25 bp, Rattus norvegicus
ctccagctgctggtcatccgggaga

SEQ ID NO: 662269 - DNA, 25 bp, Rattus norvegicus
gaaggcgtcctccagctgctggtca

SEQ ID NO: 662270 - DNA, 25 bp, Rattus norvegicus
ggaggctcgttctccttctggtggt

SEQ ID NO: 662271 - DNA, 25 bp, Rattus norvegicus
ctgcgctgctttgcgtctgagaacg

SEQ ID NO: 662272 - DNA, 25 bp, Rattus norvegicus
gttgtccctccctaccggacagaga

SEQ ID NO: 662273 - DNA, 25 bp, Rattus norvegicus
ctccgtgacgtttagaggcgcgacc

SEQ ID NO: 662274 - DNA, 25 bp, Rattus norvegicus
cgcacgcaatgcgaatcgggaagag

SEQ ID NO: 662275 - DNA, 25 bp, Rattus norvegicus
ttgcgtctgagaacggaggctcgtt

SEQ ID NO: 662276 - DNA, 25 bp, Rattus norvegicus
atgggcgcttcggtcccgcacaggc

SEQ ID NO: 662277 - DNA, 25 bp, Rattus norvegicus
cccggaagtgctgcatgggcgcttc

SEQ ID NO: 662278 - DNA, 25 bp, Rattus norvegicus
tgctcacccttctggagagggccac

SEQ ID NO: 662279 - DNA, 25 bp, Rattus norvegicus
cagagctgcggttttccctggtgtt

SEQ ID NO: 662280 - DNA, 25 bp, Rattus norvegicus
tggcacgggccaccgaacaaggaca

SEQ ID NO: 662281 - DNA, 25 bp, Rattus norvegicus
ctatcggaaagcgtctccggaggcg

SEQ ID NO: 662282 - DNA, 25 bp, Rattus norvegicus
gcggcctgcagccatctatcggaaa

SEQ ID NO: 662283 - DNA, 25 bp, Rattus norvegicus
cattctcctcaaggggcggactccg

SEQ ID NO: 662284 - DNA, 25 bp, Rattus norvegicus
ggctccgtaccattctcctcaaggg

SEQ ID NO: 662285 - DNA, 25 bp, Rattus norvegicus
tcagaactaactcagctccagcgct

SEQ ID NO: 662286 - DNA, 25 bp, Rattus norvegicus
gtgtcacgtgaagggcgcgtttact

SEQ ID NO: 662287 - DNA, 25 bp, Rattus norvegicus
cctggtgttgctggcttcagcttcc

SEQ ID NO: 662288 - DNA, 25 bp, Rattus norvegicus
cgtctgtgagaacttgttccgcttt

SEQ ID NO: 662289 - DNA, 25 bp, Rattus norvegicus
tgttccgctttaatgaccggatccc

SEQ ID NO: 662290 - DNA, 25 bp, Rattus norvegicus
cgctagcagcagaagtcgagtcttt

SEQ ID NO: 662291 - DNA, 25 bp, Rattus norvegicus
cgagtctttcataattgtgcgacca

SEQ ID NO: 662292 - DNA, 25 bp, Rattus norvegicus
ataattgtgcgaccagctccgccgg

SEQ ID NO: 662293 - DNA, 25 bp, Rattus norvegicus
gcaggcacagcgataggagccaatc

SEQ ID NO: 662294 - DNA, 25 bp, Rattus norvegicus
ctcattgtggcacgtgccgccatga

SEQ ID NO: 662295 - DNA, 25 bp, Rattus norvegicus
aggccggcgtacgagatggaaccta

SEQ ID NO: 662296 - DNA, 25 bp, Rattus norvegicus
ccggcgtacgagatggaacctacct

SEQ ID NO: 662297 - DNA, 25 bp, Rattus norvegicus
cgtacgagatggaacctacctggca

SEQ ID NO: 662298 - DNA, 25 bp, Rattus norvegicus
gcaggcacactcgtgggtggtgtcc

SEQ ID NO: 662299 - DNA, 25 bp, Rattus norvegicus
aggtgcctccgttctggcagggtga

SEQ ID NO: 662300 - DNA, 25 bp, Rattus norvegicus
ctgcagggcacgtagggcagctcgc

SEQ ID NO: 662301 - DNA, 25 bp, Rattus norvegicus
agggcagctcgcagtggggaccagt

SEQ ID NO: 662302 - DNA, 25 bp, Rattus norvegicus
cacggcaggcacagcgataggagcc

SEQ ID NO: 662303 - DNA, 25 bp, Rattus norvegicus
ggcacagcgataggagccaatctca

SEQ ID NO: 662304 - DNA, 25 bp, Rattus norvegicus
ggagccaatctcattgtggcacgtg

SEQ ID NO: 662305 - DNA, 25 bp, Rattus norvegicus
acagcgataggagccaatctcattg

SEQ ID NO: 662306 - DNA, 25 bp, Rattus norvegicus
caatctcattgtggcacgtgccgcc

SEQ ID NO: 662307 - DNA, 25 bp, Rattus norvegicus
cccacgggcgggcagctaggcgcag

SEQ ID NO: 662308 - DNA, 25 bp, Rattus norvegicus
gagcgtgcagcgagtgcagcaaccc

SEQ ID NO: 662309 - DNA, 25 bp, Rattus norvegicus
ggcagtctttctagctgcgtaaacc

SEQ ID NO: 662310 - DNA, 25 bp, Rattus norvegicus
tggcagtctttctagctgcgtaaac

SEQ ID NO: 662311 - DNA, 25 bp, Rattus norvegicus
tggggactgtcagctcctggcagtc

SEQ ID NO: 662312 - DNA, 25 bp, Rattus norvegicus
gtgcagcgagtgcagcaaccccatc

SEQ ID NO: 662313 - DNA, 25 bp, Rattus norvegicus
ctgtggggactgtcagctcctggca

SEQ ID NO: 662314 - DNA, 25 bp, Rattus norvegicus
actctgtggggactgtcagctcctg

SEQ ID NO: 662315 - DNA, 25 bp, Rattus norvegicus
ggactctgtggggactgtcagctcc

SEQ ID NO: 662316 - DNA, 25 bp, Rattus norvegicus
ccgcggaacgctgggccgggactct

SEQ ID NO: 662317 - DNA, 25 bp, Rattus norvegicus
gacctctagggtgcagccccgactt

SEQ ID NO: 662318 - DNA, 25 bp, Rattus norvegicus
gcagcacccggacctctagggtgca

SEQ ID NO: 662319 - DNA, 25 bp, Rattus norvegicus
tggcagcacccggacctctagggtg

SEQ ID NO: 662320 - DNA, 25 bp, Rattus norvegicus
gcagtctttctagctgcgtaaaccc

SEQ ID NO: 662321 - DNA, 25 bp, Rattus norvegicus
atccaagcacgtacgtggcggggtt

SEQ ID NO: 662322 - DNA, 25 bp, Rattus norvegicus
gccggggctcttcttgcagaaccag

SEQ ID NO: 662323 - DNA, 25 bp, Rattus norvegicus
atccgtggcgtcactgcgctctcat

SEQ ID NO: 662324 - DNA, 25 bp, Rattus norvegicus
tctcttctggaacttcatcctgctc

SEQ ID NO: 662325 - DNA, 25 bp, Rattus norvegicus
cttctccaggctgggcggcctcatc

SEQ ID NO: 662326 - DNA, 25 bp, Rattus norvegicus
cactgccggggctcttcttgcagaa

SEQ ID NO: 662327 - DNA, 25 bp, Rattus norvegicus
tagcttcgaagagaggcagcgatga

SEQ ID NO: 662328 - DNA, 25 bp, Rattus norvegicus
aggctgggcatgaagtagcttcgaa

SEQ ID NO: 662329 - DNA, 25 bp, Rattus norvegicus
tcaaaacgccggaagtgactacgga

SEQ ID NO: 662330 - DNA, 25 bp, Rattus norvegicus
ttcttattcaaaacgccggaagtga

SEQ ID NO: 662331 - DNA, 25 bp, Rattus norvegicus
tctcggcgcgaataaagatttctta

SEQ ID NO: 662332 - DNA, 25 bp, Rattus norvegicus
tgctcgtactatctcggcgcgaata

SEQ ID NO: 662333 - DNA, 25 bp, Rattus norvegicus
ggaacttcatcctgctcgtactatc

SEQ ID NO: 662334 - DNA, 25 bp, Rattus norvegicus
gcgctctcatccaagcacgtacgtg

SEQ ID NO: 662335 - DNA, 25 bp, Rattus norvegicus
cctagctgatgacgtttggaaacgc

SEQ ID NO: 662336 - DNA, 25 bp, Rattus norvegicus
gctctccacgtctccgtagttaagt

SEQ ID NO: 662337 - DNA, 25 bp, Rattus norvegicus
gggagcattagagcctggccgccac

SEQ ID NO: 662338 - DNA, 25 bp, Rattus norvegicus
gccgaacacattcgtcccttctgga

SEQ ID NO: 662339 - DNA, 25 bp, Rattus norvegicus
gagcacccttcggtcctgatcctga

SEQ ID NO: 662340 - DNA, 25 bp, Rattus norvegicus
ctcacctgagcgtgggattttcatc

SEQ ID NO: 662341 - DNA, 25 bp, Rattus norvegicus
tgggattttcatcttgctctccacg

SEQ ID NO: 662342 - DNA, 25 bp, Rattus norvegicus
ttttaaatcgtgagcgccaagcgcg

SEQ ID NO: 662343 - DNA, 25 bp, Rattus norvegicus
gccaagcgcggtaactgccgcgtga

SEQ ID NO: 662344 - DNA, 25 bp, Rattus norvegicus
ccgcccaggcggctgattaaaaact

SEQ ID NO: 662345 - DNA, 25 bp, Rattus norvegicus
ctgattaaaaactgtgccggcggga

SEQ ID NO: 662346 - DNA, 25 bp, Rattus norvegicus
tgccggcgggaagtccttcattgaa

SEQ ID NO: 662347 - DNA, 25 bp, Rattus norvegicus
gctgcagcggtgacctagctgatga

SEQ ID NO: 662348 - DNA, 25 bp, Rattus norvegicus
ttcattgaagtctaagcaagtgagc

SEQ ID NO: 662349 - DNA, 25 bp, Rattus norvegicus
tccgatggtccaaagtctgtgagca

SEQ ID NO: 662350 - DNA, 25 bp, Rattus norvegicus
ctgcgattaccacgcggtgctgctc

SEQ ID NO: 662351 - DNA, 25 bp, Rattus norvegicus
tctttctgggtacagaccatgtctc

SEQ ID NO: 662352 - DNA, 25 bp, Rattus norvegicus
gcgcttgccttcttccgggcataca

SEQ ID NO: 662353 - DNA, 25 bp, Rattus norvegicus
ggtgctgctcactgccggactccag

SEQ ID NO: 662354 - DNA, 25 bp, Rattus norvegicus
tgagcagcggagtgctgcgattacc

SEQ ID NO: 662355 - DNA, 25 bp, Rattus norvegicus
accatgtctccgatggtccaaagtc

SEQ ID NO: 662356 - DNA, 25 bp, Rattus norvegicus
tcgacgcgctctttctgggtacaga

SEQ ID NO: 662357 - DNA, 25 bp, Rattus norvegicus
ctacaggaggcgtctcgacgcgctc

SEQ ID NO: 662358 - DNA, 25 bp, Rattus norvegicus
gcacaaactacaggaggcgtctcga

SEQ ID NO: 662359 - DNA, 25 bp, Rattus norvegicus
catacttcgcacaaactacaggagg

SEQ ID NO: 662360 - DNA, 25 bp, Rattus norvegicus
acgatgcttccagttcatacttcgc

SEQ ID NO: 662361 - DNA, 25 bp, Rattus norvegicus
ttcttccgggcatacacgatgcttc

SEQ ID NO: 662362 - DNA, 25 bp, Rattus norvegicus
cggactccagcaatccacagcggtt

SEQ ID NO: 662363 - DNA, 25 bp, Rattus norvegicus
gtacatggggacagtggctatcacc

SEQ ID NO: 662364 - DNA, 25 bp, Rattus norvegicus
gcgcggctaccagatcaggacatgc

SEQ ID NO: 662365 - DNA, 25 bp, Rattus norvegicus
agcatgtcaagcttcgggtcccggt

SEQ ID NO: 662366 - DNA, 25 bp, Rattus norvegicus
gcgtcccaactgatgagcaaggctg

SEQ ID NO: 662367 - DNA, 25 bp, Rattus norvegicus
tcggtactccttcagcagcatgttc

SEQ ID NO: 662368 - DNA, 25 bp, Rattus norvegicus
gcggcatgcagattcggtactcctt

SEQ ID NO: 662369 - DNA, 25 bp, Rattus norvegicus
ttacagcctccaggtttgggcgcca

SEQ ID NO: 662370 - DNA, 25 bp, Rattus norvegicus
cgatcctcctccgaaagcagagctg

SEQ ID NO: 662371 - DNA, 25 bp, Rattus norvegicus
atactccggctgcagagcatgcttg

SEQ ID NO: 662372 - DNA, 25 bp, Rattus norvegicus
agctctcccggtattgcaaagtcag

SEQ ID NO: 662373 - DNA, 25 bp, Rattus norvegicus
accgcgcgggatatgtccctgcaaa

SEQ ID NO: 662374 - DNA, 25 bp, Rattus norvegicus
tctggttctaaacggaccctctcta

SEQ ID NO: 662375 - DNA, 25 bp, Rattus norvegicus
cagctccctgtgacgcattgtggtc

SEQ ID NO: 662376 - DNA, 25 bp, Rattus norvegicus
tggtgcgctcagctcctaactgcct

SEQ ID NO: 662377 - DNA, 25 bp, Rattus norvegicus
ttggtccaaaaagcgtaaaatcagc

SEQ ID NO: 662378 - DNA, 25 bp, Rattus norvegicus
caatgctttgcacttggggccggca

SEQ ID NO: 662379 - DNA, 25 bp, Rattus norvegicus
ctcaggccctttcggcgggtcagat

SEQ ID NO: 662380 - DNA, 25 bp, Rattus norvegicus
cgccggcccgtcattggttaatatt

SEQ ID NO: 662381 - DNA, 25 bp, Rattus norvegicus
catgttttcttactgctgaggcttc

SEQ ID NO: 662382 - DNA, 25 bp, Rattus norvegicus
ccagagcttggcctgagctgtcaaa

SEQ ID NO: 662383 - DNA, 25 bp, Rattus norvegicus
ctcgttagcgcaggggatccgaaca

SEQ ID NO: 662384 - DNA, 25 bp, Rattus norvegicus
agggcaggacatgtgagatagtcac

SEQ ID NO: 662385 - DNA, 25 bp, Rattus norvegicus
tagtcacagttttccagagatcagg

SEQ ID NO: 662386 - DNA, 25 bp, Rattus norvegicus
gacaagatctaaccagtcgcgcgtg

SEQ ID NO: 662387 - DNA, 25 bp, Rattus norvegicus
atctgcgctcgctcaagagcctgga

SEQ ID NO: 662388 - DNA, 25 bp, Rattus norvegicus
ctctcccgaacgtgtcaatgctttg

SEQ ID NO: 662389 - DNA, 25 bp, Rattus norvegicus
tcaagagcctggaacccgaggacga

SEQ ID NO: 662390 - DNA, 25 bp, Rattus norvegicus
tactgctgaggcttccgacaccttc

SEQ ID NO: 662391 - DNA, 25 bp, Rattus norvegicus
agccatggcggatgtgactgcccgc

SEQ ID NO: 662392 - DNA, 25 bp, Rattus norvegicus
tctcacttttatcgtgcgtcccgga

SEQ ID NO: 662393 - DNA, 25 bp, Rattus norvegicus
caatggaattcgtgacccggatgta

SEQ ID NO: 662394 - DNA, 25 bp, Rattus norvegicus
ccggatgtactatcgtccacaaact

SEQ ID NO: 662395 - DNA, 25 bp, Rattus norvegicus
ctccgcccagaagtcttgcgtaata

SEQ ID NO: 662396 - DNA, 25 bp, Rattus norvegicus
tacaaagcggtacgtgtggtctcgg

SEQ ID NO: 662397 - DNA, 25 bp, Rattus norvegicus
gcgtaatagccggaaagtctcactt

SEQ ID NO: 662398 - DNA, 25 bp, Rattus norvegicus
tcccgtacgtttgtcctgcgtggta

SEQ ID NO: 662399 - DNA, 25 bp, Rattus norvegicus
acctgttgggccagagcggtttgca

SEQ ID NO: 662400 - DNA, 25 bp, Rattus norvegicus
tttgcacaggcggttcgcaccgtga

SEQ ID NO: 662401 - DNA, 25 bp, Rattus norvegicus
tgtgcctagtcggtcaatggaattc

SEQ ID NO: 662402 - DNA, 25 bp, Rattus norvegicus
tggaaccctgagttcccggagcacc

SEQ ID NO: 662403 - DNA, 25 bp, Rattus norvegicus
cccgcagtttgcagtacgagtacaa

SEQ ID NO: 662404 - DNA, 25 bp, Rattus norvegicus
tcgcaccgtgaggaagagtggaacc

SEQ ID NO: 662405 - DNA, 25 bp, Rattus norvegicus
gcagaacccactggccactatagga

SEQ ID NO: 662406 - DNA, 25 bp, Rattus norvegicus
aattcccgcagtcctttggtccgtg

SEQ ID NO: 662407 - DNA, 25 bp, Rattus norvegicus
cgcatccttcatggtgactgtttta

SEQ ID NO: 662408 - DNA, 25 bp, Rattus norvegicus
ggctctgcagtaccagcgcatcctt

SEQ ID NO: 662409 - DNA, 25 bp, Rattus norvegicus
attgcattgctctccacccgggtac

SEQ ID NO: 662410 - DNA, 25 bp, Rattus norvegicus
tggcatgtccacagcctatctagtc

SEQ ID NO: 662411 - DNA, 25 bp, Rattus norvegicus
ggactcctgatcttggcggcccagt

SEQ ID NO: 662412 - DNA, 25 bp, Rattus norvegicus
actgtggcttaggacgcacttcaaa

SEQ ID NO: 662413 - DNA, 25 bp, Rattus norvegicus
cccggcagctaagaagcctgtgacc

SEQ ID NO: 662414 - DNA, 25 bp, Rattus norvegicus
cgcgggacagtccagaactaccagt

SEQ ID NO: 662415 - DNA, 25 bp, Rattus norvegicus
atcctccgtaactggaagcctcgcg

SEQ ID NO: 662416 - DNA, 25 bp, Rattus norvegicus
cctaggaatagacgtgcccgctgtt

SEQ ID NO: 662417 - DNA, 25 bp, Rattus norvegicus
taggacccagcgaccagattatgca

SEQ ID NO: 662418 - DNA, 25 bp, Rattus norvegicus
ccgggtacagacaggctctgcgttc

SEQ ID NO: 662419 - DNA, 25 bp, Rattus norvegicus
gcgcgttacgctacctagcatgcta

SEQ ID NO: 662420 - DNA, 25 bp, Rattus norvegicus
tgggacgtccctaaatggctgcagc

SEQ ID NO: 662421 - DNA, 25 bp, Rattus norvegicus
acggccgcctgtattccgagagctc

SEQ ID NO: 662422 - DNA, 25 bp, Rattus norvegicus
aatcagtgccgcttcgtgacgggcc

SEQ ID NO: 662423 - DNA, 25 bp, Rattus norvegicus
ccagaggccgatatgttcccgagga

SEQ ID NO: 662424 - DNA, 25 bp, Rattus norvegicus
gcactttctactccttggcctagcg

SEQ ID NO: 662425 - DNA, 25 bp, Rattus norvegicus
cagcagcttctgcagagaggcatga

SEQ ID NO: 662426 - DNA, 25 bp, Rattus norvegicus
gtgcagaggcgctctcctcagaatc

SEQ ID NO: 662427 - DNA, 25 bp, Rattus norvegicus
caggaccaagaaggcctcgtgcaga

SEQ ID NO: 662428 - DNA, 25 bp, Rattus norvegicus
caaacaagttaggttgcgcgccctc

SEQ ID NO: 662429 - DNA, 25 bp, Rattus norvegicus
cgctctccggtgttttcgtatggga

SEQ ID NO: 662430 - DNA, 25 bp, Rattus norvegicus
ctagcatgctaacaggcagcccgca

SEQ ID NO: 662431 - DNA, 25 bp, Rattus norvegicus
ggtcactctctaggcgcccttgaca

SEQ ID NO: 662432 - DNA, 25 bp, Rattus norvegicus
gcggatgagcactttgtcttagcca

SEQ ID NO: 662433 - DNA, 25 bp, Rattus norvegicus
tgcgatgccgatcgccatgggacta

SEQ ID NO: 662434 - DNA, 25 bp, Rattus norvegicus
tggtgctggacgaaagcagcgcatc

SEQ ID NO: 662435 - DNA, 25 bp, Rattus norvegicus
ctcgagtacttaagcccgggcgtga

SEQ ID NO: 662436 - DNA, 25 bp, Rattus norvegicus
acccatggccgtgtgcttcttgcga

SEQ ID NO: 662437 - DNA, 25 bp, Rattus norvegicus
ggcgccttcctgctctatccttgta

SEQ ID NO: 662438 - DNA, 25 bp, Rattus norvegicus
agcagcgcatctgtggccgaactcc

SEQ ID NO: 662439 - DNA, 25 bp, Rattus norvegicus
acctgtgccctggaacgcactgctg

SEQ ID NO: 662440 - DNA, 25 bp, Rattus norvegicus
tggccttctgtcgtagccacgtgcg

SEQ ID NO: 662441 - DNA, 25 bp, Rattus norvegicus
actgtcgcccgttcttggccttctg

SEQ ID NO: 662442 - DNA, 25 bp, Rattus norvegicus
agcgcacactgctgctcgactgtcg

SEQ ID NO: 662443 - DNA, 25 bp, Rattus norvegicus
ccgggcgtgatgaagagcacccaga

SEQ ID NO: 662444 - DNA, 25 bp, Rattus norvegicus
aggggccagccctcgagtacttaag

SEQ ID NO: 662445 - DNA, 25 bp, Rattus norvegicus
atccttgtatggtgacccgaggggc

SEQ ID NO: 662446 - DNA, 25 bp, Rattus norvegicus
ctagcagcactgcaacacgagatgc

SEQ ID NO: 662447 - DNA, 25 bp, Rattus norvegicus
atggaccatcaggagccctactcgg

SEQ ID NO: 662448 - DNA, 25 bp, Rattus norvegicus
tcgggataaaccagcgccgggtctc

SEQ ID NO: 662449 - DNA, 25 bp, Rattus norvegicus
acgcaccggttctcttcggtatgta

SEQ ID NO: 662450 - DNA, 25 bp, Rattus norvegicus
gtatgtattcttcccagaacgccga

SEQ ID NO: 662451 - DNA, 25 bp, Rattus norvegicus
cccagtcagttctgtgcgtcctgca

SEQ ID NO: 662452 - DNA, 25 bp, Rattus norvegicus
tcccgggacagcagtgggacaactt

SEQ ID NO: 662453 - DNA, 25 bp, Rattus norvegicus
tgggacaacttggaaaacttctctg

SEQ ID NO: 662454 - DNA, 25 bp, Rattus norvegicus
ttccgtcaggctacggtgcttcaga

SEQ ID NO: 662455 - DNA, 25 bp, Rattus norvegicus
tggcgctatctcctgcgtaccgtga

SEQ ID NO: 662456 - DNA, 25 bp, Rattus norvegicus
gaaggcaagtggaccctcgggataa

SEQ ID NO: 662457 - DNA, 25 bp, Rattus norvegicus
atcgttccctctggacatgtccggc

SEQ ID NO: 662458 - DNA, 25 bp, Rattus norvegicus
agaccgatggctggtcctgggtatc

SEQ ID NO: 662459 - DNA, 25 bp, Rattus norvegicus
taccgtgagtttggccagcatcgtt

SEQ ID NO: 662460 - DNA, 25 bp, Rattus norvegicus
tcagagccatctgcacctcctgggg

SEQ ID NO: 662461 - DNA, 25 bp, Rattus norvegicus
gcgggtggccacatgttaccttcca

SEQ ID NO: 662462 - DNA, 25 bp, Rattus norvegicus
ccgaactgcttgaggacggcaatga

SEQ ID NO: 662463 - DNA, 25 bp, Rattus norvegicus
atggcgcacagctccataccctgga

SEQ ID NO: 662464 - DNA, 25 bp, Rattus norvegicus
cataccctggatgcccatggcgagc

SEQ ID NO: 662465 - DNA, 25 bp, Rattus norvegicus
agcagtgagcagaaccggtcgtgat

SEQ ID NO: 662466 - DNA, 25 bp, Rattus norvegicus
tggagcccggactcaactttccaaa

SEQ ID NO: 662467 - DNA, 25 bp, Rattus norvegicus
ctcctgggaccagtgtgagccagca

SEQ ID NO: 662468 - DNA, 25 bp, Rattus norvegicus
ctcattggcctaggtgcagcgacca

SEQ ID NO: 662469 - DNA, 25 bp, Rattus norvegicus
gtgcagcgaccactctgggactcgt

SEQ ID NO: 662470 - DNA, 25 bp, Rattus norvegicus
agctccagactgaacctggcgcgtc

SEQ ID NO: 662471 - DNA, 25 bp, Rattus norvegicus
gcggtttctccacccgctggaggga

SEQ ID NO: 662472 - DNA, 25 bp, Rattus norvegicus
tacgccaacgctgcagtctggtttg

SEQ ID NO: 662473 - DNA, 25 bp, Rattus norvegicus
ttagccaccaaacttcgaggcgcgg

SEQ ID NO: 662474 - DNA, 25 bp, Rattus norvegicus
ccatggacatgggttccaagatgcc

SEQ ID NO: 662475 - DNA, 25 bp, Rattus norvegicus
tgagaaatggcgacccctgccggcc

SEQ ID NO: 662476 - DNA, 25 bp, Rattus norvegicus
tgacccgaactgtcgggtgccgagc

SEQ ID NO: 662477 - DNA, 25 bp, Rattus norvegicus
actcaggcgactccgaacgatcgca

SEQ ID NO: 662478 - DNA, 25 bp, Rattus norvegicus
tcaggcgactccgaacgatcgcagg

SEQ ID NO: 662479 - DNA, 25 bp, Rattus norvegicus
gcgactccgaacgatcgcaggggcc

SEQ ID NO: 662480 - DNA, 25 bp, Rattus norvegicus
tcgcaggggcccgagaggtgaacgc

SEQ ID NO: 662481 - DNA, 25 bp, Rattus norvegicus
ccaacccaggtcctgcagcggccgg

SEQ ID NO: 662482 - DNA, 25 bp, Rattus norvegicus
ccggtcaaatgagcccagcggcctt

SEQ ID NO: 662483 - DNA, 25 bp, Rattus norvegicus
cagcggccttgagaaatggcgaccc

SEQ ID NO: 662484 - DNA, 25 bp, Rattus norvegicus
gcaagggtatggaggcagtcagggc

SEQ ID NO: 662485 - DNA, 25 bp, Rattus norvegicus
cagcggccggtcaaatgagcccagc

SEQ ID NO: 662486 - DNA, 25 bp, Rattus norvegicus
gcccagcggccttgagaaatggcga

SEQ ID NO: 662487 - DNA, 25 bp, Rattus norvegicus
tcaaatgagcccagcggccttgaga

SEQ ID NO: 662488 - DNA, 25 bp, Rattus norvegicus
gtactccggtccctcacagcgtggc

SEQ ID NO: 662489 - DNA, 25 bp, Rattus norvegicus
gctccggagtgctaggtcgaccgcc

SEQ ID NO: 662490 - DNA, 25 bp, Rattus norvegicus
gtggctctgcaaaccggcccgacag

SEQ ID NO: 662491 - DNA, 25 bp, Rattus norvegicus
ggccgtgcatccttctgtagccttc

SEQ ID NO: 662492 - DNA, 25 bp, Rattus norvegicus
acagtgcggacagttcggaccagca

SEQ ID NO: 662493 - DNA, 25 bp, Rattus norvegicus
gctcagacggcagacagtgcggaca

SEQ ID NO: 662494 - DNA, 25 bp, Rattus norvegicus
agcgtgcgcgtcatgagttcggacc

SEQ ID NO: 662495 - DNA, 25 bp, Rattus norvegicus
agcgaatgccaggtgctccacgcgc

SEQ ID NO: 662496 - DNA, 25 bp, Rattus norvegicus
cagtcccaggcttaggcccagcaga

SEQ ID NO: 662497 - DNA, 25 bp, Rattus norvegicus
gctgccacagctcggggcaggctca

SEQ ID NO: 662498 - DNA, 25 bp, Rattus norvegicus
ctcacggtgccatagagggagtcca

SEQ ID NO: 662499 - DNA, 25 bp, Rattus norvegicus
agaggaatcgtctcacggtgccata

SEQ ID NO: 662500 - DNA, 25 bp, Rattus norvegicus
ttaagctgaaccacggagaggaatc

SEQ ID NO: 662501 - DNA, 25 bp, Rattus norvegicus
cccagcagaggcaccatgaggtcga

SEQ ID NO: 662502 - DNA, 25 bp, Rattus norvegicus
ttctgtcccgggcaccggagcgaat

SEQ ID NO: 662503 - DNA, 25 bp, Rattus norvegicus
accgcgtccactcggcttctcgaag

SEQ ID NO: 662504 - DNA, 25 bp, Rattus norvegicus
caccacctctggtcgggaaggcagt

SEQ ID NO: 662505 - DNA, 25 bp, Rattus norvegicus
gaagactctccgtgcacgcaggcca

SEQ ID NO: 662506 - DNA, 25 bp, Rattus norvegicus
gcaggccacgcccactaacccttcc

SEQ ID NO: 662507 - DNA, 25 bp, Rattus norvegicus
ccgtttctccgccaccgcgtccact

SEQ ID NO: 662508 - DNA, 25 bp, Rattus norvegicus
agagaagactctccgtgcacgcagg

SEQ ID NO: 662509 - DNA, 25 bp, Rattus norvegicus
ggcttctcgaagacctagacccgca

SEQ ID NO: 662510 - DNA, 25 bp, Rattus norvegicus
gcaaccctcaccttcggcaagagtg

SEQ ID NO: 662511 - DNA, 25 bp, Rattus norvegicus
ctcaccttcggcaagagtgctggga

SEQ ID NO: 662512 - DNA, 25 bp, Rattus norvegicus
cttcggcaagagtgctgggaacctg

SEQ ID NO: 662513 - DNA, 25 bp, Rattus norvegicus
gtgctgggaacctgcgaacacctca

SEQ ID NO: 662514 - DNA, 25 bp, Rattus norvegicus
ctcaccacctctggtcgggaaggca

SEQ ID NO: 662515 - DNA, 25 bp, Rattus norvegicus
acacaccagaagagaagactctccg

SEQ ID NO: 662516 - DNA, 25 bp, Rattus norvegicus
ccacgaaaccgacacacaccagaag

SEQ ID NO: 662517 - DNA, 25 bp, Rattus norvegicus
aggggtcattttctcgggtctgtga

SEQ ID NO: 662518 - DNA, 25 bp, Rattus norvegicus
gctgctccggctccaacatggcggc

SEQ ID NO: 662519 - DNA, 25 bp, Rattus norvegicus
cccgcactgtgtagcgcgccggcag

SEQ ID NO: 662520 - DNA, 25 bp, Rattus norvegicus
ccttgggacccggactgaaagcgtg

SEQ ID NO: 662521 - DNA, 25 bp, Rattus norvegicus
cccggactgaaagcgtgcgcaggca

SEQ ID NO: 662522 - DNA, 25 bp, Rattus norvegicus
cgtgcgcaggcaggggtcattttct

SEQ ID NO: 662523 - DNA, 25 bp, Rattus norvegicus
ctcccattcgggtcgggccagctgt

SEQ ID NO: 662524 - DNA, 25 bp, Rattus norvegicus
aggtccaggctctaggaacgcgaga

SEQ ID NO: 662525 - DNA, 25 bp, Rattus norvegicus
ccaggctctaggaacgcgagaagtc

SEQ ID NO: 662526 - DNA, 25 bp, Rattus norvegicus
ctctaggaacgcgagaagtcgtcgg

SEQ ID NO: 662527 - DNA, 25 bp, Rattus norvegicus
aagtcgtcgggcctctgatcccgtt

SEQ ID NO: 662528 - DNA, 25 bp, Rattus norvegicus
tgatcccgttctcccattcgggtcg

SEQ ID NO: 662529 - DNA, 25 bp, Rattus norvegicus
cggttccagagacaggcagagtcgc

SEQ ID NO: 662530 - DNA, 25 bp, Rattus norvegicus
cattttctcgggtctgtgaggtcca

SEQ ID NO: 662531 - DNA, 25 bp, Rattus norvegicus
ttggtactctcatataaggactgtc

SEQ ID NO: 662532 - DNA, 25 bp, Rattus norvegicus
gcccatttagtctgcggagcctgga

SEQ ID NO: 662533 - DNA, 25 bp, Rattus norvegicus
gcgctgaatccgatgcctcgtcctg

SEQ ID NO: 662534 - DNA, 25 bp, Rattus norvegicus
aagtcggtcttttgctcagtgatcg

SEQ ID NO: 662535 - DNA, 25 bp, Rattus norvegicus
attaccggaatgtggctagaacttc

SEQ ID NO: 662536 - DNA, 25 bp, Rattus norvegicus
cctggcaaccaggacatttggtaga

SEQ ID NO: 662537 - DNA, 25 bp, Rattus norvegicus
atttggagctggaccttttctagga

SEQ ID NO: 662538 - DNA, 25 bp, Rattus norvegicus
gaagtaagctatctcctccggggct

SEQ ID NO: 662539 - DNA, 25 bp, Rattus norvegicus
gggctcgttttcttccagtgttaga

SEQ ID NO: 662540 - DNA, 25 bp, Rattus norvegicus
tgatttatgtgacctgcagctgccc

SEQ ID NO: 662541 - DNA, 25 bp, Rattus norvegicus
cccaacagctggtctgtctaaagtg

SEQ ID NO: 662542 - DNA, 25 bp, Rattus norvegicus
tctaaagtgtcggtgaccaggtcca

SEQ ID NO: 662543 - DNA, 25 bp, Rattus norvegicus
cacctgcacgggcagcagttctttg

SEQ ID NO: 662544 - DNA, 25 bp, Rattus norvegicus
tcagtgatcggctaatcttaaaggc

SEQ ID NO: 662545 - DNA, 25 bp, Rattus norvegicus
tccgccattgcaaacgctcagcatg

SEQ ID NO: 662546 - DNA, 25 bp, Rattus norvegicus
ccgctctgagtctgcgcgagccaag

SEQ ID NO: 662547 - DNA, 25 bp, Rattus norvegicus
ggatcaaatgccagagcgctctctg

SEQ ID NO: 662548 - DNA, 25 bp, Rattus norvegicus
acggaatggcgcgaggatcaaatgc

SEQ ID NO: 662549 - DNA, 25 bp, Rattus norvegicus
acgctcagcatgcagtagatattga

SEQ ID NO: 662550 - DNA, 25 bp, Rattus norvegicus
gacacttgcagcgtcctctcagaca

SEQ ID NO: 662551 - DNA, 25 bp, Rattus norvegicus
cgaaagccactagcacggacacttg

SEQ ID NO: 662552 - DNA, 25 bp, Rattus norvegicus
tgccagccaaggaccactccagagg

SEQ ID NO: 662553 - DNA, 25 bp, Rattus norvegicus
gcaaccgattcgcttgccagccaag

SEQ ID NO: 662554 - DNA, 25 bp, Rattus norvegicus
ttttctgagtcgtcgccagcttgtc

SEQ ID NO: 662555 - DNA, 25 bp, Rattus norvegicus
tgctcaggccaggtccagctttttc

SEQ ID NO: 662556 - DNA, 25 bp, Rattus norvegicus
tggagagaacccaacgtgctcaggc

SEQ ID NO: 662557 - DNA, 25 bp, Rattus norvegicus
tcctgcaagccgtgcaaggacgagc

SEQ ID NO: 662558 - DNA, 25 bp, Rattus norvegicus
tagatattgagctacggaatggcgc

SEQ ID NO: 662559 - DNA, 25 bp, Rattus norvegicus
gcccgttgctgggagacaaagtccc

SEQ ID NO: 662560 - DNA, 25 bp, Rattus norvegicus
cctggtgtggcaaacccactgagga

SEQ ID NO: 662561 - DNA, 25 bp, Rattus norvegicus
cccactgaggaagcagcgctgagga

SEQ ID NO: 662562 - DNA, 25 bp, Rattus norvegicus
agcgctgaggagaaagcgctcctga

SEQ ID NO: 662563 - DNA, 25 bp, Rattus norvegicus
cacctgaacgacacttaccgaaaga

SEQ ID NO: 662564 - DNA, 25 bp, Rattus norvegicus
acatttccgaggttgtccatgacga

SEQ ID NO: 662565 - DNA, 25 bp, Rattus norvegicus
tccatgacgagaaaaagcgcgcagc

SEQ ID NO: 662566 - DNA, 25 bp, Rattus norvegicus
aaggcggccagcgattcgaattccc

SEQ ID NO: 662567 - DNA, 25 bp, Rattus norvegicus
cgcgcagccgcacttgtaatgtcga

SEQ ID NO: 662568 - DNA, 25 bp, Rattus norvegicus
ttgtaatgtcgagcgttggcagcgc

SEQ ID NO: 662569 - DNA, 25 bp, Rattus norvegicus
cagcgcgcctgactattggtttccg

SEQ ID NO: 662570 - DNA, 25 bp, Rattus norvegicus
ctgactattggtttccgctgcggga

SEQ ID NO: 662571 - DNA, 25 bp, Rattus norvegicus
ttggccaatcgctgcgcccgttgct

SEQ ID NO: 662572 - DNA, 25 bp, Rattus norvegicus
cgctgcgggaaagttggccaatcgc

SEQ ID NO: 662573 - DNA, 25 bp, Rattus norvegicus
cgcgcccagactttgcttgtactca

SEQ ID NO: 662574 - DNA, 25 bp, Rattus norvegicus
agacttaactcttcgctggcgcggg

SEQ ID NO: 662575 - DNA, 25 bp, Rattus norvegicus
tcaagccagtttggccacagtggtc

SEQ ID NO: 662576 - DNA, 25 bp, Rattus norvegicus
cagtggtcaatttcgcctttccgga

SEQ ID NO: 662577 - DNA, 25 bp, Rattus norvegicus
gttctttttgcgagcgtcctgtgga

SEQ ID NO: 662578 - DNA, 25 bp, Rattus norvegicus
cctgtggatattgaggagcgccgta

SEQ ID NO: 662579 - DNA, 25 bp, Rattus norvegicus
agcgccgtatctacaggagacaaga

SEQ ID NO: 662580 - DNA, 25 bp, Rattus norvegicus
atcacttaggctacgcgtgttccga

SEQ ID NO: 662581 - DNA, 25 bp, Rattus norvegicus
agacccagtcgcataggctagcgga

SEQ ID NO: 662582 - DNA, 25 bp, Rattus norvegicus
gagctcgcgagcctaatgcacccga

SEQ ID NO: 662583 - DNA, 25 bp, Rattus norvegicus
gcactgcttgtgcaaggctaactga

SEQ ID NO: 662584 - DNA, 25 bp, Rattus norvegicus
accggagagggtcgttcatatttgg

SEQ ID NO: 662585 - DNA, 25 bp, Rattus norvegicus
ttgtctctaatgtcccgatgccttg

SEQ ID NO: 662586 - DNA, 25 bp, Rattus norvegicus
ctgggaggcgagtttgtcaacaatc

SEQ ID NO: 662587 - DNA, 25 bp, Rattus norvegicus
gcagccaggacaaatggcggacatc

SEQ ID NO: 662588 - DNA, 25 bp, Rattus norvegicus
gctcagcactgtgtcgatgtggacg

SEQ ID NO: 662589 - DNA, 25 bp, Rattus norvegicus
ccggccggtggctctgtcccagaga

SEQ ID NO: 662590 - DNA, 25 bp, Rattus norvegicus
cttacaactgttacgattcatcttc

SEQ ID NO: 662591 - DNA, 25 bp, Rattus norvegicus
ggcggacatcgctcttgttcagacc

SEQ ID NO: 662592 - DNA, 25 bp, Rattus norvegicus
gagcttcgtgcagccaggacaaatg

SEQ ID NO: 662593 - DNA, 25 bp, Rattus norvegicus
cactgacaggagcttcgtgcagcca

SEQ ID NO: 662594 - DNA, 25 bp, Rattus norvegicus
gtctggtctggagaaggcactgaca

SEQ ID NO: 662595 - DNA, 25 bp, Rattus norvegicus
acgattcatcttccgtctggtctgg

SEQ ID NO: 662596 - DNA, 25 bp, Rattus norvegicus
cccgcaaatggttatcttacaactg

SEQ ID NO: 662597 - DNA, 25 bp, Rattus norvegicus
agaggcggaagaccacccgcaaatg

SEQ ID NO: 662598 - DNA, 25 bp, Rattus norvegicus
tttgcaaacgattaccgagaggcgg

SEQ ID NO: 662599 - DNA, 25 bp, Rattus norvegicus
catctcttggcgctgcgacagtccg

SEQ ID NO: 662600 - DNA, 25 bp, Rattus norvegicus
cacggacagcgctcagcactgtgtc

SEQ ID NO: 662601 - DNA, 25 bp, Rattus norvegicus
ggtcacccggtgcatcgaaattcca

SEQ ID NO: 662602 - DNA, 25 bp, Rattus norvegicus
gcatttgagtaaaccgcgctacagg

SEQ ID NO: 662603 - DNA, 25 bp, Rattus norvegicus
gcccaaccggaaaagcccagtctga

SEQ ID NO: 662604 - DNA, 25 bp, Rattus norvegicus
ccagagcgctcagccgttgggtcac

SEQ ID NO: 662605 - DNA, 25 bp, Rattus norvegicus
aagttgcagtgatgcgctacccggc

SEQ ID NO: 662606 - DNA, 25 bp, Rattus norvegicus
cacctgagtgactcgggacgcgtca

SEQ ID NO: 662607 - DNA, 25 bp, Rattus norvegicus
agcggcaagacggtcacgatggctc

SEQ ID NO: 662608 - DNA, 25 bp, Rattus norvegicus
gtcgccacagtttctcatccctttt

SEQ ID NO: 662609 - DNA, 25 bp, Rattus norvegicus
ttccctctctgatgtcggaggaaga

SEQ ID NO: 662610 - DNA, 25 bp, Rattus norvegicus
ggccgcagcgtgataccaaaaattg

SEQ ID NO: 662611 - DNA, 25 bp, Rattus norvegicus
ttggcgaagaactcaaatgaatgta

SEQ ID NO: 662612 - DNA, 25 bp, Rattus norvegicus
atccatcttggatttcccgacctgc

SEQ ID NO: 662613 - DNA, 25 bp, Rattus norvegicus
cccgaaggcccgagagcagcggcaa

SEQ ID NO: 662614 - DNA, 25 bp, Rattus norvegicus
ccagtctgagactcgggttcctctc

SEQ ID NO: 662615 - DNA, 25 bp, Rattus norvegicus
gattcctaggtaattccacaccgcg

SEQ ID NO: 662616 - DNA, 25 bp, Rattus norvegicus
tttgtccggagagaactgccagatc

SEQ ID NO: 662617 - DNA, 25 bp, Rattus norvegicus
gctgctatccgcactctggaatgga

SEQ ID NO: 662618 - DNA, 25 bp, Rattus norvegicus
tctcgcggagctgctgctcattcca

SEQ ID NO: 662619 - DNA, 25 bp, Rattus norvegicus
tcattccagcaagccgtcgagggtt

SEQ ID NO: 662620 - DNA, 25 bp, Rattus norvegicus
tcgtcttagtggaaccggtgggcac

SEQ ID NO: 662621 - DNA, 25 bp, Rattus norvegicus
ttcccattaccacgggcgctctgag

SEQ ID NO: 662622 - DNA, 25 bp, Rattus norvegicus
gagagcacccaactttgagcctgta

SEQ ID NO: 662623 - DNA, 25 bp, Rattus norvegicus
ctgtaagaaaagcagctcaggtctg

SEQ ID NO: 662624 - DNA, 25 bp, Rattus norvegicus
gcgtggcatgcaccgagaactttac

SEQ ID NO: 662625 - DNA, 25 bp, Rattus norvegicus
gcgagtcacagaccgaggattccta

SEQ ID NO: 662626 - DNA, 25 bp, Rattus norvegicus
cgcgaaccggtaagtagctgcaaga

SEQ ID NO: 662627 - DNA, 25 bp, Rattus norvegicus
aagagttggttactgccgttcgcgc

SEQ ID NO: 662628 - DNA, 25 bp, Rattus norvegicus
ctcaacactatctggcctggccgta

SEQ ID NO: 662629 - DNA, 25 bp, Rattus norvegicus
gatgcagtccctgagctcgggcttt

SEQ ID NO: 662630 - DNA, 25 bp, Rattus norvegicus
ctgcgggtttttctccctactctca

SEQ ID NO: 662631 - DNA, 25 bp, Rattus norvegicus
ctgtcggtctatggcttccctcctt

SEQ ID NO: 662632 - DNA, 25 bp, Rattus norvegicus
atcggcttctagttccgcccaggtc

SEQ ID NO: 662633 - DNA, 25 bp, Rattus norvegicus
ccctcccgaattaatgtgttggctc

SEQ ID NO: 662634 - DNA, 25 bp, Rattus norvegicus
accttcccttcgaatcggcttctag

SEQ ID NO: 662635 - DNA, 25 bp, Rattus norvegicus
caagctctattttttccctcgtagg

SEQ ID NO: 662636 - DNA, 25 bp, Rattus norvegicus
cggcttccgtgtcaagatggctgcc

SEQ ID NO: 662637 - DNA, 25 bp, Rattus norvegicus
tgccctgtgtctcctgtgctgggtc

SEQ ID NO: 662638 - DNA, 25 bp, Rattus norvegicus
gctttggacgaggacggtcaatgac

SEQ ID NO: 662639 - DNA, 25 bp, Rattus norvegicus
cggtcaatgacgtaagtgctctgta

SEQ ID NO: 662640 - DNA, 25 bp, Rattus norvegicus
tggcgcttctcaggctctcagggcc

SEQ ID NO: 662641 - DNA, 25 bp, Rattus norvegicus
gcaggatagtttcgcccgcggaccc

SEQ ID NO: 662642 - DNA, 25 bp, Rattus norvegicus
aggtccggccctttcaatcttgttg

SEQ ID NO: 662643 - DNA, 25 bp, Rattus norvegicus
agccctactgccgtgcacattgtga

SEQ ID NO: 662644 - DNA, 25 bp, Rattus norvegicus
ctggctaggcctcggtttccctgtt

SEQ ID NO: 662645 - DNA, 25 bp, Rattus norvegicus
tgcacattgtgacgcgcgcttctag

SEQ ID NO: 662646 - DNA, 25 bp, Rattus norvegicus
ttccctgttggtgaaagcgggatcc

SEQ ID NO: 662647 - DNA, 25 bp, Rattus norvegicus
gggatccggcctgtctcaccttcgt

SEQ ID NO: 662648 - DNA, 25 bp, Rattus norvegicus
tctcctaaagctagcggcgcgcgca

SEQ ID NO: 662649 - DNA, 25 bp, Rattus norvegicus
agaaggacaggcagagcacgcagta

SEQ ID NO: 662650 - DNA, 25 bp, Rattus norvegicus
aagaacgcgaggagctcagaagtta

SEQ ID NO: 662651 - DNA, 25 bp, Rattus norvegicus
agcacgaaccggaagcctggctagg

SEQ ID NO: 662652 - DNA, 25 bp, Rattus norvegicus
ttgcctcatgttatccacggtgcgg

SEQ ID NO: 662653 - DNA, 25 bp, Rattus norvegicus
agcacgcagtagagaccgaccttga

SEQ ID NO: 662654 - DNA, 25 bp, Rattus norvegicus
accttgacgtagaacctggctgtgc

SEQ ID NO: 662655 - DNA, 25 bp, Rattus norvegicus
tgtgcggttcagctgcacaagcagc

SEQ ID NO: 662656 - DNA, 25 bp, Rattus norvegicus
tcagaagttaggaaagcggaagcgc

SEQ ID NO: 662657 - DNA, 25 bp, Rattus norvegicus
actcctgtgctggagttgggacttg

SEQ ID NO: 662658 - DNA, 25 bp, Rattus norvegicus
gtcgcacccggtcttttccagagca

SEQ ID NO: 662659 - DNA, 25 bp, Rattus norvegicus
ttgccacgttccactcctgtgctgg

SEQ ID NO: 662660 - DNA, 25 bp, Rattus norvegicus
aggccagggtttgccacgttccact

SEQ ID NO: 662661 - DNA, 25 bp, Rattus norvegicus
cgcgggctttccaggtcagtgtccc

SEQ ID NO: 662662 - DNA, 25 bp, Rattus norvegicus
tcagcgcacgctcgtccttcttttg

SEQ ID NO: 662663 - DNA, 25 bp, Rattus norvegicus
caagatggggccaggctctcagcgc

SEQ ID NO: 662664 - DNA, 25 bp, Rattus norvegicus
ccaccagccaggttgtgcggggcaa

SEQ ID NO: 662665 - DNA, 25 bp, Rattus norvegicus
agggaacagcgatctacctgccttc

SEQ ID NO: 662666 - DNA, 25 bp, Rattus norvegicus
ccggccagggaacagcgatctacct

SEQ ID NO: 662667 - DNA, 25 bp, Rattus norvegicus
gagctgcaagggactcgtgcaccgt

SEQ ID NO: 662668 - DNA, 25 bp, Rattus norvegicus
cgcatcgtcgggacagtctcgtgca

SEQ ID NO: 662669 - DNA, 25 bp, Rattus norvegicus
ttttccagagcagaggcttgggcgc

SEQ ID NO: 662670 - DNA, 25 bp, Rattus norvegicus
cccgtctgtcatcgtaggcgacctg

SEQ ID NO: 662671 - DNA, 25 bp, Rattus norvegicus
ctctgtacttgccatgccggtttgc

SEQ ID NO: 662672 - DNA, 25 bp, Rattus norvegicus
ttaagcacgtgcaacgggagcagcc

SEQ ID NO: 662673 - DNA, 25 bp, Rattus norvegicus
gcagattcacagaggccggggcctc

SEQ ID NO: 662674 - DNA, 25 bp, Rattus norvegicus
tggccctgcaaaggaccggacgtgt

SEQ ID NO: 662675 - DNA, 25 bp, Rattus norvegicus
cggacgtgtggatcacctttcctca

SEQ ID NO: 662676 - DNA, 25 bp, Rattus norvegicus
tccataactcagacagggaccgtcc

SEQ ID NO: 662677 - DNA, 25 bp, Rattus norvegicus
tccgcgccgagcaggtactgaacaa

SEQ ID NO: 662678 - DNA, 25 bp, Rattus norvegicus
aacctagagtgagccaagggccgca

SEQ ID NO: 662679 - DNA, 25 bp, Rattus norvegicus
tatgcgcacgcgcttcaactgcttg

SEQ ID NO: 662680 - DNA, 25 bp, Rattus norvegicus
cttcaactgcttgggcgcaactctg

SEQ ID NO: 662681 - DNA, 25 bp, Rattus norvegicus
gcaactctgcgcaagacctggcctg

SEQ ID NO: 662682 - DNA, 25 bp, Rattus norvegicus
gctcagttctcactggggctctttc

SEQ ID NO: 662683 - DNA, 25 bp, Rattus norvegicus
tgcgcacgcgcaactctctgtactt

SEQ ID NO: 662684 - DNA, 25 bp, Rattus norvegicus
tttgcgtacctttgcgcagcgatcg

SEQ ID NO: 662685 - DNA, 25 bp, Rattus norvegicus
acgctaccatgcgaagtgacccgca

SEQ ID NO: 662686 - DNA, 25 bp, Rattus norvegicus
ccacctcaggttttcactttttgct

SEQ ID NO: 662687 - DNA, 25 bp, Rattus norvegicus
gttttcactttttgctccagaggga

SEQ ID NO: 662688 - DNA, 25 bp, Rattus norvegicus
gaaaataataaaaacgctaccatgc

SEQ ID NO: 662689 - DNA, 25 bp, Rattus norvegicus
catgcgaagtgacccgcactgtgcg

SEQ ID NO: 662690 - DNA, 25 bp, Rattus norvegicus
ctctgtgggcgctgaagaaggaact

SEQ ID NO: 662691 - DNA, 25 bp, Rattus norvegicus
ccaggcccgtgaccctggctccctc

SEQ ID NO: 662692 - DNA, 25 bp, Rattus norvegicus
ctctgctggccactctgtgtgaccg

SEQ ID NO: 662693 - DNA, 25 bp, Rattus norvegicus
tggccactctgtgtgaccgcagctc

SEQ ID NO: 662694 - DNA, 25 bp, Rattus norvegicus
cactccaaggcacctagtcgcggga

SEQ ID NO: 662695 - DNA, 25 bp, Rattus norvegicus
caaggcacctagtcgcgggagtcac

SEQ ID NO: 662696 - DNA, 25 bp, Rattus norvegicus
cctagtcgcgggagtcacgcaaagc

SEQ ID NO: 662697 - DNA, 25 bp, Rattus norvegicus
ctatctggcccgcagctgcacctcg

SEQ ID NO: 662698 - DNA, 25 bp, Rattus norvegicus
ctccagagggagaacgaagcgagaa

SEQ ID NO: 662699 - DNA, 25 bp, Rattus norvegicus
cacggagggactggaacctgaattt

SEQ ID NO: 662700 - DNA, 25 bp, Rattus norvegicus
tgtcagcgggtcacgatgtcattca

SEQ ID NO: 662701 - DNA, 25 bp, Rattus norvegicus
tcacgatgtcattcaggtcacctgc

SEQ ID NO: 662702 - DNA, 25 bp, Rattus norvegicus
gtcattcaggtcacctgcgcacctt

SEQ ID NO: 662703 - DNA, 25 bp, Rattus norvegicus
gcgacgcaggcgcactgagtttccc

SEQ ID NO: 662704 - DNA, 25 bp, Rattus norvegicus
agatccctgagcacgtgggttgtgc

SEQ ID NO: 662705 - DNA, 25 bp, Rattus norvegicus
ttgtgctgtccggtacgcgcacgga

SEQ ID NO: 662706 - DNA, 25 bp, Rattus norvegicus
acctgaattttgctggtgttcttcg

SEQ ID NO: 662707 - DNA, 25 bp, Rattus norvegicus
tgttcttcgtgggtcgcagactagc

SEQ ID NO: 662708 - DNA, 25 bp, Rattus norvegicus
gcagactagctaaggccatggcacc

SEQ ID NO: 662709 - DNA, 25 bp, Rattus norvegicus
ctaaggccatggcaccagcgggaat

SEQ ID NO: 662710 - DNA, 25 bp, Rattus norvegicus
ggcaccagcgggaatcctgaacgga

SEQ ID NO: 662711 - DNA, 25 bp, Rattus norvegicus
tcctgaacggaaaagtggtctccgc

SEQ ID NO: 662712 - DNA, 25 bp, Rattus norvegicus
ccctgagcacgtgggttgtgctgtc

SEQ ID NO: 662713 - DNA, 25 bp, Rattus norvegicus
ggccgttgcccagtctttgcagtta

SEQ ID NO: 662714 - DNA, 25 bp, Rattus norvegicus
atcggttccatgacgcgcaccttcg

SEQ ID NO: 662715 - DNA, 25 bp, Rattus norvegicus
ggcgcctcctgcatgacttagacgt

SEQ ID NO: 662716 - DNA, 25 bp, Rattus norvegicus
gactctgaacatgcagggcacgaca

SEQ ID NO: 662717 - DNA, 25 bp, Rattus norvegicus
cccgttcttgaccaaacatgacaga

SEQ ID NO: 662718 - DNA, 25 bp, Rattus norvegicus
tttaccacttcgtcacctgtcggcg

SEQ ID NO: 662719 - DNA, 25 bp, Rattus norvegicus
catctctctggcgtggttgttaata

SEQ ID NO: 662720 - DNA, 25 bp, Rattus norvegicus
tccggcggcgaatacagactagagc

SEQ ID NO: 662721 - DNA, 25 bp, Rattus norvegicus
ccgccatgttggtgaggagaaatca

SEQ ID NO: 662722 - DNA, 25 bp, Rattus norvegicus
gcggaggaatctcacttgcccttta

SEQ ID NO: 662723 - DNA, 25 bp, Rattus norvegicus
cggcagtttcctccaatggccaatg

SEQ ID NO: 662724 - DNA, 25 bp, Rattus norvegicus
ccgcagtgtgcgtattaaaagcccg

SEQ ID NO: 662725 - DNA, 25 bp, Rattus norvegicus
cgcagccatacagcgtgccgcagtg

SEQ ID NO: 662726 - DNA, 25 bp, Rattus norvegicus
tctgtgtcgctcactagtaaccgtg

SEQ ID NO: 662727 - DNA, 25 bp, Rattus norvegicus
tcggagcaacgcagccgccaggtca

SEQ ID NO: 662728 - DNA, 25 bp, Rattus norvegicus
taggcgcagacagtgccacaccacg

SEQ ID NO: 662729 - DNA, 25 bp, Rattus norvegicus
tggcgagctcgacccagacgctcgt

SEQ ID NO: 662730 - DNA, 25 bp, Rattus norvegicus
cgcagcatcctaagcggtggcgagc

SEQ ID NO: 662731 - DNA, 25 bp, Rattus norvegicus
agttctccgaggctctgcctggcca

SEQ ID NO: 662732 - DNA, 25 bp, Rattus norvegicus
gcagcgcatccaggagttctccgag

SEQ ID NO: 662733 - DNA, 25 bp, Rattus norvegicus
ccattctgagagagcgtgctggtcc

SEQ ID NO: 662734 - DNA, 25 bp, Rattus norvegicus
acgacgtgccaatgcgccattctga

SEQ ID NO: 662735 - DNA, 25 bp, Rattus norvegicus
tgtcgcagcttgcacagacgacgtg

SEQ ID NO: 662736 - DNA, 25 bp, Rattus norvegicus
ctcctccaggatctgtcgcagcttg

SEQ ID NO: 662737 - DNA, 25 bp, Rattus norvegicus
gccagtggtgcttccagtagctcac

SEQ ID NO: 662738 - DNA, 25 bp, Rattus norvegicus
agcgggacaccaggtgcatcctctc

SEQ ID NO: 662739 - DNA, 25 bp, Rattus norvegicus
tgtccagaatctggcgcagtaagcc

SEQ ID NO: 662740 - DNA, 25 bp, Rattus norvegicus
cagtagctcactgcgcaggtgacta

SEQ ID NO: 662741 - DNA, 25 bp, Rattus norvegicus
cttcgccatgtacaccttcgtggtg

SEQ ID NO: 662742 - DNA, 25 bp, Rattus norvegicus
ttcgctactactgcagctacatctg

SEQ ID NO: 662743 - DNA, 25 bp, Rattus norvegicus
gcccagggcagacaccaggataatc

SEQ ID NO: 662744 - DNA, 25 bp, Rattus norvegicus
ccgtcccttggactacggcttgtgg

SEQ ID NO: 662745 - DNA, 25 bp, Rattus norvegicus
ggagagccagcgcttttgtttttta

SEQ ID NO: 662746 - DNA, 25 bp, Rattus norvegicus
atagcagcgtctacgccgaggtctc

SEQ ID NO: 662747 - DNA, 25 bp, Rattus norvegicus
tggccaccggctactggaagaggct

SEQ ID NO: 662748 - DNA, 25 bp, Rattus norvegicus
aggttcaacctgatgctgggcgaga

SEQ ID NO: 662749 - DNA, 25 bp, Rattus norvegicus
tgcctttcgggagactaggtaagcc

SEQ ID NO: 662750 - DNA, 25 bp, Rattus norvegicus
gtaagcctttccctcgtggccgctg

SEQ ID NO: 662751 - DNA, 25 bp, Rattus norvegicus
gctgcgcgcatgaatcggagagcca

SEQ ID NO: 662752 - DNA, 25 bp, Rattus norvegicus
cgcgagctcgccctagaagatctaa

SEQ ID NO: 662753 - DNA, 25 bp, Rattus norvegicus
cagacagcgggactgagactgaagc

SEQ ID NO: 662754 - DNA, 25 bp, Rattus norvegicus
agacctaaaccggtagctggattcg

SEQ ID NO: 662755 - DNA, 25 bp, Rattus norvegicus
cgtggactccttcaactacgcagtg

SEQ ID NO: 662756 - DNA, 25 bp, Rattus norvegicus
ccttcaactacgcagtgctggaggg

SEQ ID NO: 662757 - DNA, 25 bp, Rattus norvegicus
aaaaggcggcgttgcaggacctgac

SEQ ID NO: 662758 - DNA, 25 bp, Rattus norvegicus
ccattcctgcggtccacgagtggag

SEQ ID NO: 662759 - DNA, 25 bp, Rattus norvegicus
tgcaggtgagtggagcgcactctct

SEQ ID NO: 662760 - DNA, 25 bp, Rattus norvegicus
gactccttcaactacgcagtgctgg

SEQ ID NO: 662761 - DNA, 25 bp, Rattus norvegicus
ggcgcacgtggactccttcaactac

SEQ ID NO: 662762 - DNA, 25 bp, Rattus norvegicus
ggcccagcctaaagcatttaaccga

SEQ ID NO: 662763 - DNA, 25 bp, Rattus norvegicus
gcgggcccagcctaaagcatttaac

SEQ ID NO: 662764 - DNA, 25 bp, Rattus norvegicus
agaagcatggatgtcgacagccggt

SEQ ID NO: 662765 - DNA, 25 bp, Rattus norvegicus
gctcgcagaagcatggatgtcgaca

SEQ ID NO: 662766 - DNA, 25 bp, Rattus norvegicus
gagtggagtcgtagctccggtttcc

SEQ ID NO: 662767 - DNA, 25 bp, Rattus norvegicus
ggtccacgagtggagtcgtagctcc

SEQ ID NO: 662768 - DNA, 25 bp, Rattus norvegicus
tggagcgcactctctgctccggagc

SEQ ID NO: 662769 - DNA, 25 bp, Rattus norvegicus
cactgtctctgtgccgtatgttttc

SEQ ID NO: 662770 - DNA, 25 bp, Rattus norvegicus
tgaagtgtggcagtttgctttctcc

SEQ ID NO: 662771 - DNA, 25 bp, Rattus norvegicus
ggatgctctgttggcgcacggcaca

SEQ ID NO: 662772 - DNA, 25 bp, Rattus norvegicus
ggcgcacggcacatctttccttctg

SEQ ID NO: 662773 - DNA, 25 bp, Rattus norvegicus
gcacatctttccttctgcatgaccg

SEQ ID NO: 662774 - DNA, 25 bp, Rattus norvegicus
cgctctgtggcccacgtatgcgtga

SEQ ID NO: 662775 - DNA, 25 bp, Rattus norvegicus
cacgtatgcgtgaagtgtggcagtt

SEQ ID NO: 662776 - DNA, 25 bp, Rattus norvegicus
agtttgctttctccgctgctcgaga

SEQ ID NO: 662777 - DNA, 25 bp, Rattus norvegicus
cccatcttggtctgcgatgcgtaac

SEQ ID NO: 662778 - DNA, 25 bp, Rattus norvegicus
ggtctgcgatgcgtaacagaaaata

SEQ ID NO: 662779 - DNA, 25 bp, Rattus norvegicus
agaaaatacaactgcaccgtctgtg

SEQ ID NO: 662780 - DNA, 25 bp, Rattus norvegicus
actgcaccgtctgtggccgcagtga

SEQ ID NO: 662781 - DNA, 25 bp, Rattus norvegicus
atcgacactgtctctgtgccgtatg

SEQ ID NO: 662782 - DNA, 25 bp, Rattus norvegicus
ggccgcagtgactccatcgacactg

SEQ ID NO: 662783 - DNA, 25 bp, Rattus norvegicus
aggcaggtctcttctccctgactga

SEQ ID NO: 662784 - DNA, 25 bp, Rattus norvegicus
gggcgccgccatgacaacctaatac

SEQ ID NO: 662785 - DNA, 25 bp, Rattus norvegicus
cgccatgacaacctaataccggaaa

SEQ ID NO: 662786 - DNA, 25 bp, Rattus norvegicus
gccgcctcccggataggcagtgagc

SEQ ID NO: 662787 - DNA, 25 bp, Rattus norvegicus
ctaataccggaaaaggcaggtctct

SEQ ID NO: 662788 - DNA, 25 bp, Rattus norvegicus
accggaagagtaagccaggaggtct

SEQ ID NO: 662789 - DNA, 25 bp, Rattus norvegicus
tctcggcgaccggaagagtaagcca

SEQ ID NO: 662790 - DNA, 25 bp, Rattus norvegicus
ggaactctcggcgaccggaagagta

SEQ ID NO: 662791 - DNA, 25 bp, Rattus norvegicus
aaggttgagcctatgtgggttgaat

SEQ ID NO: 662792 - DNA, 25 bp, Rattus norvegicus
gacacagctatgaaggttgagccta

SEQ ID NO: 662793 - DNA, 25 bp, Rattus norvegicus
cgcaggacacagctatgaaggttga

SEQ ID NO: 662794 - DNA, 25 bp, Rattus norvegicus
tgagccggaaggcaacgcaggacac

SEQ ID NO: 662795 - DNA, 25 bp, Rattus norvegicus
ctcccggataggcagtgagccggaa

SEQ ID NO: 662796 - DNA, 25 bp, Rattus norvegicus
tccctgactgatcggcgcctgaatt

SEQ ID NO: 662797 - DNA, 25 bp, Rattus norvegicus
tgtaggaacccgtttcgctgctgtc

SEQ ID NO: 662798 - DNA, 25 bp, Rattus norvegicus
ttggccagcgcagacaggataaccc

SEQ ID NO: 662799 - DNA, 25 bp, Rattus norvegicus
cgccgcggggaaactaatgacccat

SEQ ID NO: 662800 - DNA, 25 bp, Rattus norvegicus
aatgacccatggctctctctcagcg

SEQ ID NO: 662801 - DNA, 25 bp, Rattus norvegicus
agccacagctgggaacgcaagcctg

SEQ ID NO: 662802 - DNA, 25 bp, Rattus norvegicus
gcaagcctgttctcgtgactcctga

SEQ ID NO: 662803 - DNA, 25 bp, Rattus norvegicus
ctggccaagggcaagtcccagtaca

SEQ ID NO: 662804 - DNA, 25 bp, Rattus norvegicus
ctcgtggacgtctggaccaatcagc

SEQ ID NO: 662805 - DNA, 25 bp, Rattus norvegicus
accagcctgtggttgcgtcatatgg

SEQ ID NO: 662806 - DNA, 25 bp, Rattus norvegicus
cgcgttttcttctctcgcctgctga

SEQ ID NO: 662807 - DNA, 25 bp, Rattus norvegicus
tagagagttcctccgtgctgttccc

SEQ ID NO: 662808 - DNA, 25 bp, Rattus norvegicus
tgcgactgtgactcgagcctgtttc

SEQ ID NO: 662809 - DNA, 25 bp, Rattus norvegicus
cggcacccgtgcaaaggtcctttct

SEQ ID NO: 662810 - DNA, 25 bp, Rattus norvegicus
ttcggccctcagtttcctttggtga

SEQ ID NO: 662811 - DNA, 25 bp, Rattus norvegicus
tcggccggcccaaatcgatcgcgat

SEQ ID NO: 662812 - DNA, 25 bp, Rattus norvegicus
gacccaggccgcgaatgggcagatc

SEQ ID NO: 662813 - DNA, 25 bp, Rattus norvegicus
agcctggaccctaggagtccttctc

SEQ ID NO: 662814 - DNA, 25 bp, Rattus norvegicus
tgtccttcctgaccgtgcgactggg

SEQ ID NO: 662815 - DNA, 25 bp, Rattus norvegicus
gcgatgcgccctggccctataaatc

SEQ ID NO: 662816 - DNA, 25 bp, Rattus norvegicus
cgcgacttcatattcgcagagaatt

SEQ ID NO: 662817 - DNA, 25 bp, Rattus norvegicus
gtcccgtttgctaagcgcgacttca

SEQ ID NO: 662818 - DNA, 25 bp, Rattus norvegicus
cgcgggatccgaccctccttattat

SEQ ID NO: 662819 - DNA, 25 bp, Rattus norvegicus
taaatagagatctcagccgagcggc

SEQ ID NO: 662820 - DNA, 25 bp, Rattus norvegicus
acggtccgactggtggctaaataga

SEQ ID NO: 662821 - DNA, 25 bp, Rattus norvegicus
ggagactgcacctcacggtccgact

SEQ ID NO: 662822 - DNA, 25 bp, Rattus norvegicus
tgtgggccctccaaacggagactgc

SEQ ID NO: 662823 - DNA, 25 bp, Rattus norvegicus
gtgccgtatcccttccaacgcggtg

SEQ ID NO: 662824 - DNA, 25 bp, Rattus norvegicus
tataaatcgctttcctcgcgcctga

SEQ ID NO: 662825 - DNA, 25 bp, Rattus norvegicus
ctctaagggcctgcaggtaagcggc

SEQ ID NO: 662826 - DNA, 25 bp, Rattus norvegicus
ccgcaggactgaccgcacgtgcata

SEQ ID NO: 662827 - DNA, 25 bp, Rattus norvegicus
ccgcacgtgcataccggagagggat

SEQ ID NO: 662828 - DNA, 25 bp, Rattus norvegicus
tggggaccgatccatcaacgtcttt

SEQ ID NO: 662829 - DNA, 25 bp, Rattus norvegicus
gatccatcaacgtcttttacccttg

SEQ ID NO: 662830 - DNA, 25 bp, Rattus norvegicus
ccttgaaaaggtggaagaaatgcgc

SEQ ID NO: 662831 - DNA, 25 bp, Rattus norvegicus
ggggccctacaggtcttcagcgcca

SEQ ID NO: 662832 - DNA, 25 bp, Rattus norvegicus
ttgctgtagcggtccgcagagaccg

SEQ ID NO: 662833 - DNA, 25 bp, Rattus norvegicus
cctccggtttgtcttcgtgcgcgca

SEQ ID NO: 662834 - DNA, 25 bp, Rattus norvegicus
ctcagttggtcctcagaaaggcacg

SEQ ID NO: 662835 - DNA, 25 bp, Rattus norvegicus
tagtgctcctctgccctttctctaa

SEQ ID NO: 662836 - DNA, 25 bp, Rattus norvegicus
atctccctgcgcgtgcgtctcagtt

SEQ ID NO: 662837 - DNA, 25 bp, Rattus norvegicus
gcgcttggtgcacctagtgctcctc

SEQ ID NO: 662838 - DNA, 25 bp, Rattus norvegicus
aggcacgcgcctcgccttaaacgtg

SEQ ID NO: 662839 - DNA, 25 bp, Rattus norvegicus
cgggactgcggtctccgactccgag

SEQ ID NO: 662840 - DNA, 25 bp, Rattus norvegicus
ttaattcgaggcttccgaaccctca

SEQ ID NO: 662841 - DNA, 25 bp, Rattus norvegicus
gaggcttccgaaccctcaagccatt

SEQ ID NO: 662842 - DNA, 25 bp, Rattus norvegicus
cctcaagccatttcttccctccaaa

SEQ ID NO: 662843 - DNA, 25 bp, Rattus norvegicus
ttccctccaaacttcccggctgcag

SEQ ID NO: 662844 - DNA, 25 bp, Rattus norvegicus
tgcagcggagggcttctgagcctcg

SEQ ID NO: 662845 - DNA, 25 bp, Rattus norvegicus
ttctgagcctcggaagtaggccctg

SEQ ID NO: 662846 - DNA, 25 bp, Rattus norvegicus
ctgagcctcggaagtaggccctgcc

SEQ ID NO: 662847 - DNA, 25 bp, Rattus norvegicus
agcctcggaagtaggccctgccttc

SEQ ID NO: 662848 - DNA, 25 bp, Rattus norvegicus
aggccctgccttcccggagggcgtg

SEQ ID NO: 662849 - DNA, 25 bp, Rattus norvegicus
cttcccagtgggctgcggattcacg

SEQ ID NO: 662850 - DNA, 25 bp, Rattus norvegicus
tgcggtctccgactccgaggctcag

SEQ ID NO: 662851 - DNA, 25 bp, Rattus norvegicus
gtctccgactccgaggctcaggccc

SEQ ID NO: 662852 - DNA, 25 bp, Rattus norvegicus
ccggagggcgtggaaccgggctcag

SEQ ID NO: 662853 - DNA, 25 bp, Rattus norvegicus
gtcatagagcgcacctcacagaaga

SEQ ID NO: 662854 - DNA, 25 bp, Rattus norvegicus
gccgtgttacagagcgcacctcaca

SEQ ID NO: 662855 - DNA, 25 bp, Rattus norvegicus
gaagagcactcgagccgcgtcatag

SEQ ID NO: 662856 - DNA, 25 bp, Rattus norvegicus
gagccacgtcatagagcgcacctca

SEQ ID NO: 662857 - DNA, 25 bp, Rattus norvegicus
acagagcgcacctcacagaagagca

SEQ ID NO: 662858 - DNA, 25 bp, Rattus norvegicus
gccgtgtcaaagagcgcactgcaca

SEQ ID NO: 662859 - DNA, 25 bp, Rattus norvegicus
cagaagagcatgtgagccgtgttac

SEQ ID NO: 662860 - DNA, 25 bp, Rattus norvegicus
gagccgcgtcatagagtgcaccaca

SEQ ID NO: 662861 - DNA, 25 bp, Rattus norvegicus
agaagagcactcgagccgcgtcata

SEQ ID NO: 662862 - DNA, 25 bp, Rattus norvegicus
aagagcacgcgagccacgtcataga

SEQ ID NO: 662863 - DNA, 25 bp, Rattus norvegicus
agagcgcacctcacagaagagcatg

SEQ ID NO: 662864 - DNA, 25 bp, Rattus norvegicus
catgtgagccgtgttacagagcgca

SEQ ID NO: 662865 - DNA, 25 bp, Rattus norvegicus
gccgcgtcatagagtgcaccacaca

SEQ ID NO: 662866 - DNA, 25 bp, Rattus norvegicus
gccgcgtcatagagtgcaccgcaca

SEQ ID NO: 662867 - DNA, 25 bp, Rattus norvegicus
cccgaggcgttgagaatggagaatt

SEQ ID NO: 662868 - DNA, 25 bp, Rattus norvegicus
attggctttcgcgactttgaaattc

SEQ ID NO: 662869 - DNA, 25 bp, Rattus norvegicus
attcaccaataggaaagcggggagg

SEQ ID NO: 662870 - DNA, 25 bp, Rattus norvegicus
gcgggataacaggaaatggacactt

SEQ ID NO: 662871 - DNA, 25 bp, Rattus norvegicus
ggacactttgctgttgcctccacct

SEQ ID NO: 662872 - DNA, 25 bp, Rattus norvegicus
aatttcggagaaggcccgccctatg

SEQ ID NO: 662873 - DNA, 25 bp, Rattus norvegicus
ccctatggtcgggtcacttccgcag

SEQ ID NO: 662874 - DNA, 25 bp, Rattus norvegicus
agcttctggaggctgccgaccacac

SEQ ID NO: 662875 - DNA, 25 bp, Rattus norvegicus
cgtctggacgctcctattggctttc

SEQ ID NO: 662876 - DNA, 25 bp, Rattus norvegicus
tgtgacccgggtccagcgtccttaa

SEQ ID NO: 662877 - DNA, 25 bp, Rattus norvegicus
accatgactctaccgtgacagtttc

SEQ ID NO: 662878 - DNA, 25 bp, Rattus norvegicus
cgtccttaacctatctgagcccggg

SEQ ID NO: 662879 - DNA, 25 bp, Rattus norvegicus
tctttcttcaaagggcgcgccttgt

SEQ ID NO: 662880 - DNA, 25 bp, Rattus norvegicus
cgcgccttgttctggtacgagagcc

SEQ ID NO: 662881 - DNA, 25 bp, Rattus norvegicus
aacaggggcgatcggccgccacttt

SEQ ID NO: 662882 - DNA, 25 bp, Rattus norvegicus
cttcggctttgggacacacggtcag

SEQ ID NO: 662883 - DNA, 25 bp, Rattus norvegicus
ttgggacacacggtcagggcctctt

SEQ ID NO: 662884 - DNA, 25 bp, Rattus norvegicus
ctccacccttgccagcgcgcctgcc

SEQ ID NO: 662885 - DNA, 25 bp, Rattus norvegicus
cagcctcttgcccactggagactag

SEQ ID NO: 662886 - DNA, 25 bp, Rattus norvegicus
gactagaactgacccggtgagaggc

SEQ ID NO: 662887 - DNA, 25 bp, Rattus norvegicus
cactttcccagtccaccttaagagg

SEQ ID NO: 662888 - DNA, 25 bp, Rattus norvegicus
tccaccttaagaggaccaagtagcc

SEQ ID NO: 662889 - DNA, 25 bp, Rattus norvegicus
cttaagaggaccaagtagccagcct

SEQ ID NO: 662890 - DNA, 25 bp, Rattus norvegicus
ccgctccgacctcagaaaaacaagt

SEQ ID NO: 662891 - DNA, 25 bp, Rattus norvegicus
ccgacctcagaaaaacaagtttgcg

SEQ ID NO: 662892 - DNA, 25 bp, Rattus norvegicus
acaagtttgcgcaaagtggtgcgcg

SEQ ID NO: 662893 - DNA, 25 bp, Rattus norvegicus
gccgaccttcggctttgggacacac

SEQ ID NO: 662894 - DNA, 25 bp, Rattus norvegicus
ctggagactagaactgacccggtga

SEQ ID NO: 662895 - DNA, 25 bp, Rattus norvegicus
caggctccgcacactgccgctcagc

SEQ ID NO: 662896 - DNA, 25 bp, Rattus norvegicus
cagatgcagaattgaggcccagaga

SEQ ID NO: 662897 - DNA, 25 bp, Rattus norvegicus
gttacagatgcagaattgaggccca

SEQ ID NO: 662898 - DNA, 25 bp, Rattus norvegicus
atgtcgacagatccctgtaacgggg

SEQ ID NO: 662899 - DNA, 25 bp, Rattus norvegicus
gccgctcagctaatgtcgacagatc

SEQ ID NO: 662900 - DNA, 25 bp, Rattus norvegicus
tgtgcaggtaagcaccctcagctcc

SEQ ID NO: 662901 - DNA, 25 bp, Rattus norvegicus
gtttctgtgcaggtaagcaccctca

SEQ ID NO: 662902 - DNA, 25 bp, Rattus norvegicus
ccgcgtcctgtttctgtgcaggtaa

SEQ ID NO: 662903 - DNA, 25 bp, Rattus norvegicus
ctctccgcgtcctgtttctgtgcag

SEQ ID NO: 662904 - DNA, 25 bp, Rattus norvegicus
ccgctgctgttctgcctgctgctct

SEQ ID NO: 662905 - DNA, 25 bp, Rattus norvegicus
gcagccgcggcccatggagcccgcc

SEQ ID NO: 662906 - DNA, 25 bp, Rattus norvegicus
gctcaccgccgatctccctccttgc

SEQ ID NO: 662907 - DNA, 25 bp, Rattus norvegicus
ggccttagtcgttcgcccgcgccgc

SEQ ID NO: 662908 - DNA, 25 bp, Rattus norvegicus
cagctaatgtcgacagatccctgta

SEQ ID NO: 662909 - DNA, 25 bp, Rattus norvegicus
ggacgccgcacgctttaagttcctc

SEQ ID NO: 662910 - DNA, 25 bp, Rattus norvegicus
ttgtcttgaatggtgaaggtcccta

SEQ ID NO: 662911 - DNA, 25 bp, Rattus norvegicus
agccggccttgtctctcttaagacg

SEQ ID NO: 662912 - DNA, 25 bp, Rattus norvegicus
cccaggaaagtctaagccggccttg

SEQ ID NO: 662913 - DNA, 25 bp, Rattus norvegicus
cacaggcctgtttacaccgggagaa

SEQ ID NO: 662914 - DNA, 25 bp, Rattus norvegicus
cacgggctcggctaggtttaattca

SEQ ID NO: 662915 - DNA, 25 bp, Rattus norvegicus
ctcggaagccgaacctttagccagt

SEQ ID NO: 662916 - DNA, 25 bp, Rattus norvegicus
acccgggctcggaacggatcatcct

SEQ ID NO: 662917 - DNA, 25 bp, Rattus norvegicus
gagcgctgctgtcatctcaggagca

SEQ ID NO: 662918 - DNA, 25 bp, Rattus norvegicus
acagccacgggaacctggaagccga

SEQ ID NO: 662919 - DNA, 25 bp, Rattus norvegicus
ctcagctggcgcgaactcgaggaca

SEQ ID NO: 662920 - DNA, 25 bp, Rattus norvegicus
ctctcggcctagtggttttaactga

SEQ ID NO: 662921 - DNA, 25 bp, Rattus norvegicus
ttcaattcgggaccgtagctccttc

SEQ ID NO: 662922 - DNA, 25 bp, Rattus norvegicus
cgctcttagatcacaatccaaggta

SEQ ID NO: 662923 - DNA, 25 bp, Rattus norvegicus
gccttcccgcgcctgtaggagcttg

SEQ ID NO: 662924 - DNA, 25 bp, Rattus norvegicus
caggacgaggccaagttttctcggc

SEQ ID NO: 662925 - DNA, 25 bp, Rattus norvegicus
ggcacagtgcatgggcgaacctcac

SEQ ID NO: 662926 - DNA, 25 bp, Rattus norvegicus
tggtaactcaaaagcctctcagttg

SEQ ID NO: 662927 - DNA, 25 bp, Rattus norvegicus
tggcgtcaccatggctactccagga

SEQ ID NO: 662928 - DNA, 25 bp, Rattus norvegicus
acttgagtcccggagacgggtgtca

SEQ ID NO: 662929 - DNA, 25 bp, Rattus norvegicus
gagaacagactgctacccgagagcg

SEQ ID NO: 662930 - DNA, 25 bp, Rattus norvegicus
caggcgagggttcatagcttgttga

SEQ ID NO: 662931 - DNA, 25 bp, Rattus norvegicus
gtaggagcttgcgtcaccatggtaa

SEQ ID NO: 662932 - DNA, 25 bp, Rattus norvegicus
agttggctttactgacccttcgagg

SEQ ID NO: 662933 - DNA, 25 bp, Rattus norvegicus
acccttcgagggtcctcgggtcatg

SEQ ID NO: 662934 - DNA, 25 bp, Rattus norvegicus
gcacatccttcaccatggcaactga

SEQ ID NO: 662935 - DNA, 25 bp, Rattus norvegicus
aactgaatatgggttgctagggcca

SEQ ID NO: 662936 - DNA, 25 bp, Rattus norvegicus
tgctcgacccttagggctgcggacc

SEQ ID NO: 662937 - DNA, 25 bp, Rattus norvegicus
tgcagcctgcaaaatgccgccgctt

SEQ ID NO: 662938 - DNA, 25 bp, Rattus norvegicus
ccgccgctaacggaaatgcagcctg

SEQ ID NO: 662939 - DNA, 25 bp, Rattus norvegicus
agtcggcagccagcacctagattcc

SEQ ID NO: 662940 - DNA, 25 bp, Rattus norvegicus
ccggattcgcttccacagaggccta

SEQ ID NO: 662941 - DNA, 25 bp, Rattus norvegicus
ggatggctcagattcccgccggatt

SEQ ID NO: 662942 - DNA, 25 bp, Rattus norvegicus
caggcgcagcctcacgttaagtcca

SEQ ID NO: 662943 - DNA, 25 bp, Rattus norvegicus
ccgaggctgcggaaccgaaaccact

SEQ ID NO: 662944 - DNA, 25 bp, Rattus norvegicus
tgacgcagtttaaggctaccgaggc

SEQ ID NO: 662945 - DNA, 25 bp, Rattus norvegicus
cccgggcacacattgacgcagttta

SEQ ID NO: 662946 - DNA, 25 bp, Rattus norvegicus
tgccgccgcttgtgaagctacttcc

SEQ ID NO: 662947 - DNA, 25 bp, Rattus norvegicus
caaggtcgcgctctgcgtgcaaaca

SEQ ID NO: 662948 - DNA, 25 bp, Rattus norvegicus
agcccgcgacttctcaccatggtgg

SEQ ID NO: 662949 - DNA, 25 bp, Rattus norvegicus
gctagactcaggtttccggccttga

SEQ ID NO: 662950 - DNA, 25 bp, Rattus norvegicus
aaaccactgtggctccgggagacga

SEQ ID NO: 662951 - DNA, 25 bp, Rattus norvegicus
agcatgcaccgcgtgttcccacgtg

SEQ ID NO: 662952 - DNA, 25 bp, Rattus norvegicus
ggttcccttttcaggttctgctgca

SEQ ID NO: 662953 - DNA, 25 bp, Rattus norvegicus
aaggagccgccatttctgcagcgtc

SEQ ID NO: 662954 - DNA, 25 bp, Rattus norvegicus
cgctgttagcgctgaaggaagtaga

SEQ ID NO: 662955 - DNA, 25 bp, Rattus norvegicus
ttctgctgcacgtgctcttcgagca

SEQ ID NO: 662956 - DNA, 25 bp, Rattus norvegicus
aagtttgactaatggccgcgcgccg

SEQ ID NO: 662957 - DNA, 25 bp, Rattus norvegicus
gcccagcggactcggaagtttgact

SEQ ID NO: 662958 - DNA, 25 bp, Rattus norvegicus
cagtgtgcgtctgggtttgcattca

SEQ ID NO: 662959 - DNA, 25 bp, Rattus norvegicus
aatccctccgaagacctagtaatgg

SEQ ID NO: 662960 - DNA, 25 bp, Rattus norvegicus
aagaatgatctccaggctctgcggc

SEQ ID NO: 662961 - DNA, 25 bp, Rattus norvegicus
tccgcctcccggcacatgggtaaaa

SEQ ID NO: 662962 - DNA, 25 bp, Rattus norvegicus
agttcatcagggagcctttcgttcc

SEQ ID NO: 662963 - DNA, 25 bp, Rattus norvegicus
cagcgggaaaccgacaaagttcatc

SEQ ID NO: 662964 - DNA, 25 bp, Rattus norvegicus
atcagcttgctgttgccgcaggtga

SEQ ID NO: 662965 - DNA, 25 bp, Rattus norvegicus
cctgactctgtgaagcggcttgagc

SEQ ID NO: 662966 - DNA, 25 bp, Rattus norvegicus
gaaccaagccggactcgagcgtacc

SEQ ID NO: 662967 - DNA, 25 bp, Rattus norvegicus
gactcgagcgtacctgactctgtga

SEQ ID NO: 662968 - DNA, 25 bp, Rattus norvegicus
aacggataggcgagaaccaagccgg

SEQ ID NO: 662969 - DNA, 25 bp, Rattus norvegicus
cggcttgagccgaagctgctgttcg

SEQ ID NO: 662970 - DNA, 25 bp, Rattus norvegicus
gctgctgttcggagacctctccatg

SEQ ID NO: 662971 - DNA, 25 bp, Rattus norvegicus
accgcctgcgacagacacaaggtca

SEQ ID NO: 662972 - DNA, 25 bp, Rattus norvegicus
ccatgttctgccgagggagtcgccg

SEQ ID NO: 662973 - DNA, 25 bp, Rattus norvegicus
cttgccctcttttggaaaccgcaga

SEQ ID NO: 662974 - DNA, 25 bp, Rattus norvegicus
accgcagaaaaaccctctgttctca

SEQ ID NO: 662975 - DNA, 25 bp, Rattus norvegicus
ctcactcgggtcagccagcggacat

SEQ ID NO: 662976 - DNA, 25 bp, Rattus norvegicus
ggtcagccagcggacattgctcagc

SEQ ID NO: 662977 - DNA, 25 bp, Rattus norvegicus
attgctcagcgctgccatgttctgc

SEQ ID NO: 662978 - DNA, 25 bp, Rattus norvegicus
cacaaggtcagattggggacaccca

SEQ ID NO: 662979 - DNA, 25 bp, Rattus norvegicus
cgcccacgaactgcgggtccttatg

SEQ ID NO: 662980 - DNA, 25 bp, Rattus norvegicus
tagcacgctggttgcgcctttcatc

SEQ ID NO: 662981 - DNA, 25 bp, Rattus norvegicus
cgggtccttatgtttcccgcacagg

SEQ ID NO: 662982 - DNA, 25 bp, Rattus norvegicus
atgtttcccgcacaggacgctctgc

SEQ ID NO: 662983 - DNA, 25 bp, Rattus norvegicus
ccgcggtgggctccacttgaaagag

SEQ ID NO: 662984 - DNA, 25 bp, Rattus norvegicus
cacttgaaagaggagccgctgctgc

SEQ ID NO: 662985 - DNA, 25 bp, Rattus norvegicus
ctccgtgcgctcctggatgcagagc

SEQ ID NO: 662986 - DNA, 25 bp, Rattus norvegicus
tccaaccgacctagcacgctggttg

SEQ ID NO: 662987 - DNA, 25 bp, Rattus norvegicus
cgcggcgcagaggtaagcgctccaa

SEQ ID NO: 662988 - DNA, 25 bp, Rattus norvegicus
ggtaagcgctccaaccgacctagca

SEQ ID NO: 662989 - DNA, 25 bp, Rattus norvegicus
ctggttgcgcctttcatcctgcacg

SEQ ID NO: 662990 - DNA, 25 bp, Rattus norvegicus
agacgcccacagtctcggcgggacg

SEQ ID NO: 662991 - DNA, 25 bp, Rattus norvegicus
agcgcgggcatcctggactccagca

SEQ ID NO: 662992 - DNA, 25 bp, Rattus norvegicus
cacgaactgcgggtccttatgtttc

SEQ ID NO: 662993 - DNA, 25 bp, Rattus norvegicus
agtacgaagcagataaaggctcgga

SEQ ID NO: 662994 - DNA, 25 bp, Rattus norvegicus
ggagcctgtaccctctcagagccgg

SEQ ID NO: 662995 - DNA, 25 bp, Rattus norvegicus
aaggctcggagcctgtaccctctca

SEQ ID NO: 662996 - DNA, 25 bp, Rattus norvegicus
acccgggacagtggggagagagaga

SEQ ID NO: 662997 - DNA, 25 bp, Rattus norvegicus
cgaagcagataaaggctcggagcct

SEQ ID NO: 662998 - DNA, 25 bp, Rattus norvegicus
gctcggagcctgtaccctctcagag

SEQ ID NO: 662999 - DNA, 25 bp, Rattus norvegicus
cggctgctgaccagaggggaggtcc

SEQ ID NO: 663000 - DNA, 25 bp, Rattus norvegicus
ggaggtccgggctttcatctactcc

SEQ ID NO: 663001 - DNA, 25 bp, Rattus norvegicus
aggtccgggctttcatctactcccg

SEQ ID NO: 663002 - DNA, 25 bp, Rattus norvegicus
gggctttcatctactcccggcgggc

SEQ ID NO: 663003 - DNA, 25 bp, Rattus norvegicus
gctttcatctactcccggcgggcgg

SEQ ID NO: 663004 - DNA, 25 bp, Rattus norvegicus
ggcgtgtttattcccctggcggagc

SEQ ID NO: 663005 - DNA, 25 bp, Rattus norvegicus
agccgcttccgagcgcgctggcctc

SEQ ID NO: 663006 - DNA, 25 bp, Rattus norvegicus
gcagctgtctggagactgagcgggt

SEQ ID NO: 663007 - DNA, 25 bp, Rattus norvegicus
gataggaacctacacaccacaccgt

SEQ ID NO: 663008 - DNA, 25 bp, Rattus norvegicus
accacaccgtcatggccgctgagag

SEQ ID NO: 663009 - DNA, 25 bp, Rattus norvegicus
tagggcgactaaaccctcagaagga

SEQ ID NO: 663010 - DNA, 25 bp, Rattus norvegicus
actacggcagcctgcgagggactct

SEQ ID NO: 663011 - DNA, 25 bp, Rattus norvegicus
ccacgccacgtcctttatagaagcg

SEQ ID NO: 663012 - DNA, 25 bp, Rattus norvegicus
cccaggccaacaacggaagcaataa

SEQ ID NO: 663013 - DNA, 25 bp, Rattus norvegicus
cggaagcaataacgataggaaccta

SEQ ID NO: 663014 - DNA, 25 bp, Rattus norvegicus
ccaagggctatgtagggtcatccgc

SEQ ID NO: 663015 - DNA, 25 bp, Rattus norvegicus
gcaatcttcccggtggccggccaag

SEQ ID NO: 663016 - DNA, 25 bp, Rattus norvegicus
tacgagacgcaatcttcccggtggc

SEQ ID NO: 663017 - DNA, 25 bp, Rattus norvegicus
tgttacgatcgtcagtacgagacgc

SEQ ID NO: 663018 - DNA, 25 bp, Rattus norvegicus
agcacggtgcgtctttgttacgatc

SEQ ID NO: 663019 - DNA, 25 bp, Rattus norvegicus
cctcagaaggaaagcacggtgcgtc

SEQ ID NO: 663020 - DNA, 25 bp, Rattus norvegicus
ttatagaagcgactacggcagcctg

SEQ ID NO: 663021 - DNA, 25 bp, Rattus norvegicus
caggctatgcccgtagctgcggcag

SEQ ID NO: 663022 - DNA, 25 bp, Rattus norvegicus
gcggatgtagccgaggctctgtaca

SEQ ID NO: 663023 - DNA, 25 bp, Rattus norvegicus
tagtggtgcaacagaagagccttgc

SEQ ID NO: 663024 - DNA, 25 bp, Rattus norvegicus
cagccctgccctcaatagtggtgca

SEQ ID NO: 663025 - DNA, 25 bp, Rattus norvegicus
ccctctggctatcgccgtcggggat

SEQ ID NO: 663026 - DNA, 25 bp, Rattus norvegicus
gctgtcgtgggcatcaacgctttca

SEQ ID NO: 663027 - DNA, 25 bp, Rattus norvegicus
gccctggctctcaacaaagcagcta

SEQ ID NO: 663028 - DNA, 25 bp, Rattus norvegicus
caaagcagctatggcagtggtcttg

SEQ ID NO: 663029 - DNA, 25 bp, Rattus norvegicus
tagcttcctcaatggctccactgca

SEQ ID NO: 663030 - DNA, 25 bp, Rattus norvegicus
tgcaacctcacctttcgccagtgag

SEQ ID NO: 663031 - DNA, 25 bp, Rattus norvegicus
gagccttgcgctgccagattgatta

SEQ ID NO: 663032 - DNA, 25 bp, Rattus norvegicus
aggagctcctcctgaaacgggcggc

SEQ ID NO: 663033 - DNA, 25 bp, Rattus norvegicus
tgccagattgattaacagccaactc

SEQ ID NO: 663034 - DNA, 25 bp, Rattus norvegicus
cgttcttgtcttcgcaggagctcct

SEQ ID NO: 663035 - DNA, 25 bp, Rattus norvegicus
cgccggaatccgaggtcttaggaga

SEQ ID NO: 663036 - DNA, 25 bp, Rattus norvegicus
gaaggatcggcagtcgcactgtgcc

SEQ ID NO: 663037 - DNA, 25 bp, Rattus norvegicus
gcgtcaggcccagcactgaggcgct

SEQ ID NO: 663038 - DNA, 25 bp, Rattus norvegicus
ccagaccgacggaaggcgcaaaggc

SEQ ID NO: 663039 - DNA, 25 bp, Rattus norvegicus
gcgcaaaggcggtcacagcgagcaa

SEQ ID NO: 663040 - DNA, 25 bp, Rattus norvegicus
atctgcaaagccaccgcacattcgg

SEQ ID NO: 663041 - DNA, 25 bp, Rattus norvegicus
ccacatagcgggaaggatcggcagt

SEQ ID NO: 663042 - DNA, 25 bp, Rattus norvegicus
gccaccgcacattcggttgactgcg

SEQ ID NO: 663043 - DNA, 25 bp, Rattus norvegicus
tcgcactgtgccgagactctcggtg

SEQ ID NO: 663044 - DNA, 25 bp, Rattus norvegicus
ctctcggtgggttcttttcttcctg

SEQ ID NO: 663045 - DNA, 25 bp, Rattus norvegicus
gttcttttcttcctgcgggcgtctg

SEQ ID NO: 663046 - DNA, 25 bp, Rattus norvegicus
ccactcgccggaatccgaggtctta

SEQ ID NO: 663047 - DNA, 25 bp, Rattus norvegicus
gccctggaacccagcctcaccggta

SEQ ID NO: 663048 - DNA, 25 bp, Rattus norvegicus
ggcggtcacagcgagcaagagaccc

SEQ ID NO: 663049 - DNA, 25 bp, Rattus norvegicus
cgcagcgggttccttatctagagtc

SEQ ID NO: 663050 - DNA, 25 bp, Rattus norvegicus
tcagatcacgttgaggaaggccgcc

SEQ ID NO: 663051 - DNA, 25 bp, Rattus norvegicus
tggtccttcctttgcgccaactgag

SEQ ID NO: 663052 - DNA, 25 bp, Rattus norvegicus
cactttacgcactttaggggcagca

SEQ ID NO: 663053 - DNA, 25 bp, Rattus norvegicus
atccactcggggactctgcctttta

SEQ ID NO: 663054 - DNA, 25 bp, Rattus norvegicus
ccgtgtttgtctgatgctgccttga

SEQ ID NO: 663055 - DNA, 25 bp, Rattus norvegicus
gcgtctctagccgacagctgtacta

SEQ ID NO: 663056 - DNA, 25 bp, Rattus norvegicus
tgcttccagcgtctgagcttcagga

SEQ ID NO: 663057 - DNA, 25 bp, Rattus norvegicus
ttgcggtagtccagccaatgcttcc

SEQ ID NO: 663058 - DNA, 25 bp, Rattus norvegicus
gcgagtgccagtctctttccggaaa

SEQ ID NO: 663059 - DNA, 25 bp, Rattus norvegicus
agagcggtgggttctgcaaaaatcc

SEQ ID NO: 663060 - DNA, 25 bp, Rattus norvegicus
tctgctcgcgccagttaccaggtct

SEQ ID NO: 663061 - DNA, 25 bp, Rattus norvegicus
tgcccaggttagctgtcggtacgca

SEQ ID NO: 663062 - DNA, 25 bp, Rattus norvegicus
ttacactgcgaactggaatccactc

SEQ ID NO: 663063 - DNA, 25 bp, Rattus norvegicus
gctcggtaagcgttcgcgcctgccg

SEQ ID NO: 663064 - DNA, 25 bp, Rattus norvegicus
tcccggaaacgtgcgggacacagac

SEQ ID NO: 663065 - DNA, 25 bp, Rattus norvegicus
cttctcctcgccatggaggcgaggc

SEQ ID NO: 663066 - DNA, 25 bp, Rattus norvegicus
cgggacacagacaggctggaacttt

SEQ ID NO: 663067 - DNA, 25 bp, Rattus norvegicus
gagacgcccgcctggcgtcagcgaa

SEQ ID NO: 663068 - DNA, 25 bp, Rattus norvegicus
cttgtgcatcctggccgggtggaca

SEQ ID NO: 663069 - DNA, 25 bp, Rattus norvegicus
gagcgcctccggcttgtgcatcctg

SEQ ID NO: 663070 - DNA, 25 bp, Rattus norvegicus
cccggatcctgtcctggaggagcgc

SEQ ID NO: 663071 - DNA, 25 bp, Rattus norvegicus
cccagcgccgggctcggtaagcgtt

SEQ ID NO: 663072 - DNA, 25 bp, Rattus norvegicus
actcacgggggcatcttgcacagac

SEQ ID NO: 663073 - DNA, 25 bp, Rattus norvegicus
ccttacagcccaggccgcgttggga

SEQ ID NO: 663074 - DNA, 25 bp, Rattus norvegicus
atgacgaagcgccttacagcccagg

SEQ ID NO: 663075 - DNA, 25 bp, Rattus norvegicus
ctctcaacggccaatgacgaagcgc

SEQ ID NO: 663076 - DNA, 25 bp, Rattus norvegicus
tggaactttgcggacgtcctcctcg

SEQ ID NO: 663077 - DNA, 25 bp, Rattus norvegicus
ccctgcggaattgttcgtgttgacc

SEQ ID NO: 663078 - DNA, 25 bp, Rattus norvegicus
agggaaattgcacgaggcccgagcc

SEQ ID NO: 663079 - DNA, 25 bp, Rattus norvegicus
tcacattggaggtgcgagggaaatt

SEQ ID NO: 663080 - DNA, 25 bp, Rattus norvegicus
ctcacccaggcgagagttcacattg

SEQ ID NO: 663081 - DNA, 25 bp, Rattus norvegicus
ggtgctcacttgaagcccgtcctca

SEQ ID NO: 663082 - DNA, 25 bp, Rattus norvegicus
cgctctcaggtgtgtgtaaagggca

SEQ ID NO: 663083 - DNA, 25 bp, Rattus norvegicus
gttgaccgagcgctaccgacagtac

SEQ ID NO: 663084 - DNA, 25 bp, Rattus norvegicus
aaaatgcctcctgcagtggaccctg

SEQ ID NO: 663085 - DNA, 25 bp, Rattus norvegicus
gatccgcctgccaagtccaaggtcg

SEQ ID NO: 663086 - DNA, 25 bp, Rattus norvegicus
cgcaggcgctagctgtcatgttgcg

SEQ ID NO: 663087 - DNA, 25 bp, Rattus norvegicus
gcgcaaggcgcaagaggccatcaga

SEQ ID NO: 663088 - DNA, 25 bp, Rattus norvegicus
agactgcaggaactacggtgcgaga

SEQ ID NO: 663089 - DNA, 25 bp, Rattus norvegicus
ggccatcagagagcaccaggagctg

SEQ ID NO: 663090 - DNA, 25 bp, Rattus norvegicus
ggccagacagcaagagctccgccta

SEQ ID NO: 663091 - DNA, 25 bp, Rattus norvegicus
tcccgatatggattgtgcacagcgc

SEQ ID NO: 663092 - DNA, 25 bp, Rattus norvegicus
acgccgtgaaggcacgctgtccctg

SEQ ID NO: 663093 - DNA, 25 bp, Rattus norvegicus
tcttgacgccgtgaaggcacgctgt

SEQ ID NO: 663094 - DNA, 25 bp, Rattus norvegicus
caccacagtcccgatatggattgtg

SEQ ID NO: 663095 - DNA, 25 bp, Rattus norvegicus
cgatatggattgtgcacagcgccca

SEQ ID NO: 663096 - DNA, 25 bp, Rattus norvegicus
tggattgtgcacagcgcccatccgc

SEQ ID NO: 663097 - DNA, 25 bp, Rattus norvegicus
cgggcatctgctgtagcccgggtga

SEQ ID NO: 663098 - DNA, 25 bp, Rattus norvegicus
gctccctcttgacgccgtgaaggca

SEQ ID NO: 663099 - DNA, 25 bp, Rattus norvegicus
actgacccatttctcttgcagatgg

SEQ ID NO: 663100 - DNA, 25 bp, Rattus norvegicus
tgctgctcaggccactgacccattt

SEQ ID NO: 663101 - DNA, 25 bp, Rattus norvegicus
acccatttctcttgcagatggctgc

SEQ ID NO: 663102 - DNA, 25 bp, Rattus norvegicus
agccgtcgggtttgctgctcaggcc

SEQ ID NO: 663103 - DNA, 25 bp, Rattus norvegicus
agtctgccttctccgagcgctgagc

SEQ ID NO: 663104 - DNA, 25 bp, Rattus norvegicus
ccgcctgcgaccctgagtctgcctt

SEQ ID NO: 663105 - DNA, 25 bp, Rattus norvegicus
agctgcgtggcgttgctctgctccc

SEQ ID NO: 663106 - DNA, 25 bp, Rattus norvegicus
tttatcctaccctgctacgttccaa

SEQ ID NO: 663107 - DNA, 25 bp, Rattus norvegicus
ctggcccgtccagctgcgtggcgtt

SEQ ID NO: 663108 - DNA, 25 bp, Rattus norvegicus
tgaggcggaaaaaaccctctcgaca

SEQ ID NO: 663109 - DNA, 25 bp, Rattus norvegicus
cctctcgacactcgggctcggccac

SEQ ID NO: 663110 - DNA, 25 bp, Rattus norvegicus
tcggccacgcagctctctgaaggaa

SEQ ID NO: 663111 - DNA, 25 bp, Rattus norvegicus
ccacgcagctctctgaaggaagggc

SEQ ID NO: 663112 - DNA, 25 bp, Rattus norvegicus
cagctctctgaaggaagggctgtgt

SEQ ID NO: 663113 - DNA, 25 bp, Rattus norvegicus
tgggcgcacctataggggcgccatc

SEQ ID NO: 663114 - DNA, 25 bp, Rattus norvegicus
cctgctacgttccaactctcgaccc

SEQ ID NO: 663115 - DNA, 25 bp, Rattus norvegicus
ctccatctccggtcctgattcctca

SEQ ID NO: 663116 - DNA, 25 bp, Rattus norvegicus
tggccttgtgcgcaccatcgctgca

SEQ ID NO: 663117 - DNA, 25 bp, Rattus norvegicus
cttgtgcgcaccatcgctgcagcag

SEQ ID NO: 663118 - DNA, 25 bp, Rattus norvegicus
agggctgtgtgagctcaggcgtcct

SEQ ID NO: 663119 - DNA, 25 bp, Rattus norvegicus
ttccgctggcgttggtactggagcc

SEQ ID NO: 663120 - DNA, 25 bp, Rattus norvegicus
tccacaacctacttccggccagcgg

SEQ ID NO: 663121 - DNA, 25 bp, Rattus norvegicus
aatatacagactcccgcatcaaccg

SEQ ID NO: 663122 - DNA, 25 bp, Rattus norvegicus
ggtaagtcaatatacagactcccgc

SEQ ID NO: 663123 - DNA, 25 bp, Rattus norvegicus
gccgcaccaggtaagtcaatataca

SEQ ID NO: 663124 - DNA, 25 bp, Rattus norvegicus
agtccctggccgcaccaggtaagtc

SEQ ID NO: 663125 - DNA, 25 bp, Rattus norvegicus
gagggtagcgccctaactccagtcc

SEQ ID NO: 663126 - DNA, 25 bp, Rattus norvegicus
tgaaacccacgagggtagcgcccta

SEQ ID NO: 663127 - DNA, 25 bp, Rattus norvegicus
cactcacctgaaacccacgagggta

SEQ ID NO: 663128 - DNA, 25 bp, Rattus norvegicus
tcctttccggccgtccactcacctg

SEQ ID NO: 663129 - DNA, 25 bp, Rattus norvegicus
gatcagagtgaaggcagcaagccga

SEQ ID NO: 663130 - DNA, 25 bp, Rattus norvegicus
ggaagcaccgccttggcgcacgcag

SEQ ID NO: 663131 - DNA, 25 bp, Rattus norvegicus
gtagcaggccgggaagcaccgcctt

SEQ ID NO: 663132 - DNA, 25 bp, Rattus norvegicus
ctctccttccgctggcgttggtact

SEQ ID NO: 663133 - DNA, 25 bp, Rattus norvegicus
gaagctcagacaccggcgctagctg

SEQ ID NO: 663134 - DNA, 25 bp, Rattus norvegicus
agtccggcgcagaagctcagacacc

SEQ ID NO: 663135 - DNA, 25 bp, Rattus norvegicus
aagaggtgacataatccgggccgca

SEQ ID NO: 663136 - DNA, 25 bp, Rattus norvegicus
gacccgccaatcctggacgtgggtg

SEQ ID NO: 663137 - DNA, 25 bp, Rattus norvegicus
tcactgcctcagagtccggcgcaga

SEQ ID NO: 663138 - DNA, 25 bp, Rattus norvegicus
tgtatcacttactcactgcctcaga

SEQ ID NO: 663139 - DNA, 25 bp, Rattus norvegicus
cagaggaagaacctagaggggcacc

SEQ ID NO: 663140 - DNA, 25 bp, Rattus norvegicus
acatggtgaccagaggaagaaccta

SEQ ID NO: 663141 - DNA, 25 bp, Rattus norvegicus
cgctgcaacggacatggtgaccaga

SEQ ID NO: 663142 - DNA, 25 bp, Rattus norvegicus
cagaaagcgctgcaacggacatggt

SEQ ID NO: 663143 - DNA, 25 bp, Rattus norvegicus
cccagctcccggtaccctagcagcg

SEQ ID NO: 663144 - DNA, 25 bp, Rattus norvegicus
agcgtccatgacatcatcggcctca

SEQ ID NO: 663145 - DNA, 25 bp, Rattus norvegicus
tgcgccggttgaagcgtccatgaca

SEQ ID NO: 663146 - DNA, 25 bp, Rattus norvegicus
cctttggtcgctgagcgctggcccg

SEQ ID NO: 663147 - DNA, 25 bp, Rattus norvegicus
aggtgccaaggtactgccactcctc

SEQ ID NO: 663148 - DNA, 25 bp, Rattus norvegicus
cagaaagcaacgcagagccgagtta

SEQ ID NO: 663149 - DNA, 25 bp, Rattus norvegicus
ctggctccggctcccagagaaaagg

SEQ ID NO: 663150 - DNA, 25 bp, Rattus norvegicus
cccagagaaaaggaaatgctgacgt

SEQ ID NO: 663151 - DNA, 25 bp, Rattus norvegicus
gaaatgctgacgtttgacagaaagc

SEQ ID NO: 663152 - DNA, 25 bp, Rattus norvegicus
tttgacagaaagcaacgcagagccg

SEQ ID NO: 663153 - DNA, 25 bp, Rattus norvegicus
gcagcgccacacagacgaattcgcg

SEQ ID NO: 663154 - DNA, 25 bp, Rattus norvegicus
acgcagagccgagttacaaggaaag

SEQ ID NO: 663155 - DNA, 25 bp, Rattus norvegicus
ttacaaggaaagttggcgcgtacga

SEQ ID NO: 663156 - DNA, 25 bp, Rattus norvegicus
ttggcgcgtacgaaagttctccctc

SEQ ID NO: 663157 - DNA, 25 bp, Rattus norvegicus
gaaagttctccctcaccgactgtta

SEQ ID NO: 663158 - DNA, 25 bp, Rattus norvegicus
actgttaccgcgctgccaggtgcca

SEQ ID NO: 663159 - DNA, 25 bp, Rattus norvegicus
tgccaggtgccaaggtactgccact

SEQ ID NO: 663160 - DNA, 25 bp, Rattus norvegicus
gccactcctccctgtccgcgccgga

SEQ ID NO: 663161 - DNA, 25 bp, Rattus norvegicus
agtcgcgatgcgacggcctaccaaa

SEQ ID NO: 663162 - DNA, 25 bp, Rattus norvegicus
cgagctcctcgtaagcacaggaaaa

SEQ ID NO: 663163 - DNA, 25 bp, Rattus norvegicus
gcgtgcgcaaagctgtcaccggcta

SEQ ID NO: 663164 - DNA, 25 bp, Rattus norvegicus
cgcaaagctgtcaccggctagcgca

SEQ ID NO: 663165 - DNA, 25 bp, Rattus norvegicus
ggacgtcagtgcatgcgcacaagtc

SEQ ID NO: 663166 - DNA, 25 bp, Rattus norvegicus
caccatgacaacagacagcctagca

SEQ ID NO: 663167 - DNA, 25 bp, Rattus norvegicus
agtgcatgcgcacaagtcgcgatgc

SEQ ID NO: 663168 - DNA, 25 bp, Rattus norvegicus
atgcgacggcctaccaaagcccagg

SEQ ID NO: 663169 - DNA, 25 bp, Rattus norvegicus
agcccaggaactctgaaaaaacgca

SEQ ID NO: 663170 - DNA, 25 bp, Rattus norvegicus
tctgaaaaaacgcattcctccgacc

SEQ ID NO: 663171 - DNA, 25 bp, Rattus norvegicus
gaggatcaggccgatgagcaaaacc

SEQ ID NO: 663172 - DNA, 25 bp, Rattus norvegicus
acaggaaaaggacgtcagtgcatgc

SEQ ID NO: 663173 - DNA, 25 bp, Rattus norvegicus
aggccgatgagcaaaaccgccgcca

SEQ ID NO: 663174 - DNA, 25 bp, Rattus norvegicus
acagacagcctagcagcaacgccag

SEQ ID NO: 663175 - DNA, 25 bp, Rattus norvegicus
gagacccgaacgcaagcagctattg

SEQ ID NO: 663176 - DNA, 25 bp, Rattus norvegicus
cgacagacgttctacgccgtgcaca

SEQ ID NO: 663177 - DNA, 25 bp, Rattus norvegicus
acagcatcctgctagccggtaacca

SEQ ID NO: 663178 - DNA, 25 bp, Rattus norvegicus
cgtgacgctcttggcccgaagctct

SEQ ID NO: 663179 - DNA, 25 bp, Rattus norvegicus
tgcgaccgcacgctttaaacgcggc

SEQ ID NO: 663180 - DNA, 25 bp, Rattus norvegicus
gccgtgcacaacttagagacccgaa

SEQ ID NO: 663181 - DNA, 25 bp, Rattus norvegicus
ggaagaagccacgacctactgcgct

SEQ ID NO: 663182 - DNA, 25 bp, Rattus norvegicus
gcgcacaaagcttcccgcgaaattg

SEQ ID NO: 663183 - DNA, 25 bp, Rattus norvegicus
cgcgaaattgacgttgcgccggccg

SEQ ID NO: 663184 - DNA, 25 bp, Rattus norvegicus
gggtctttttcattgcgcctgcgcc

SEQ ID NO: 663185 - DNA, 25 bp, Rattus norvegicus
ttcattggttatttggccgcggcgc

SEQ ID NO: 663186 - DNA, 25 bp, Rattus norvegicus
ctttaaattgggcatcgtgcggctc

SEQ ID NO: 663187 - DNA, 25 bp, Rattus norvegicus
caggcccggccatgaccgactttaa

SEQ ID NO: 663188 - DNA, 25 bp, Rattus norvegicus
agttgccggggttcatcctctccct

SEQ ID NO: 663189 - DNA, 25 bp, Rattus norvegicus
tttctgggcattctggaccgtaacc

SEQ ID NO: 663190 - DNA, 25 bp, Rattus norvegicus
ccggcaaagcgtttctgggcattct

SEQ ID NO: 663191 - DNA, 25 bp, Rattus norvegicus
gcattctggaccgtaacccgcgctt

SEQ ID NO: 663192 - DNA, 25 bp, Rattus norvegicus
ttgtagcagaggatccgcgcgctga

SEQ ID NO: 663193 - DNA, 25 bp, Rattus norvegicus
cagacagggccggaaaccgagctac

SEQ ID NO: 663194 - DNA, 25 bp, Rattus norvegicus
cttcaggtttcagacagggccggaa

SEQ ID NO: 663195 - DNA, 25 bp, Rattus norvegicus
gcggccttagccgagcttcaggttt

SEQ ID NO: 663196 - DNA, 25 bp, Rattus norvegicus
cgggttgaagacagccgcggcctta

SEQ ID NO: 663197 - DNA, 25 bp, Rattus norvegicus
ccgacacgggtctgcaattggtcag

SEQ ID NO: 663198 - DNA, 25 bp, Rattus norvegicus
cttcttggctctccgagggttgtag

SEQ ID NO: 663199 - DNA, 25 bp, Rattus norvegicus
cctcaggcagcagtcgcagtgattg

SEQ ID NO: 663200 - DNA, 25 bp, Rattus norvegicus
gtaacccgcgcttgcaatggccgcg

SEQ ID NO: 663201 - DNA, 25 bp, Rattus norvegicus
gcggcttccacctccgggttgaaga

SEQ ID NO: 663202 - DNA, 25 bp, Rattus norvegicus
cggaagtgccttcccggcaaagcgt

SEQ ID NO: 663203 - DNA, 25 bp, Rattus norvegicus
cggtagcgaaggagaacagaccaca

SEQ ID NO: 663204 - DNA, 25 bp, Rattus norvegicus
ctttctgcacttgcccgtgggctag

SEQ ID NO: 663205 - DNA, 25 bp, Rattus norvegicus
acgggcgcgcctgctttaaaagctt

SEQ ID NO: 663206 - DNA, 25 bp, Rattus norvegicus
tcggaacagttccacagtgcagggc

SEQ ID NO: 663207 - DNA, 25 bp, Rattus norvegicus
cacccggggagatctgttctggatc

SEQ ID NO: 663208 - DNA, 25 bp, Rattus norvegicus
tgaggccgcttgcaaccaaagtcgc

SEQ ID NO: 663209 - DNA, 25 bp, Rattus norvegicus
tcgcagcaggagtcggtgacactcc

SEQ ID NO: 663210 - DNA, 25 bp, Rattus norvegicus
cgcgtgaactagcattcggacctct

SEQ ID NO: 663211 - DNA, 25 bp, Rattus norvegicus
ctttcgttcaattgcggagagtgtg

SEQ ID NO: 663212 - DNA, 25 bp, Rattus norvegicus
tgaggacactgaagcgccaccttgc

SEQ ID NO: 663213 - DNA, 25 bp, Rattus norvegicus
attctaactctaggcggcggcaggc

SEQ ID NO: 663214 - DNA, 25 bp, Rattus norvegicus
atacacccggctcagatggattcta

SEQ ID NO: 663215 - DNA, 25 bp, Rattus norvegicus
cgtgcaggtgaatggccggatacac

SEQ ID NO: 663216 - DNA, 25 bp, Rattus norvegicus
ggcgcatccctctcccaggttagga

SEQ ID NO: 663217 - DNA, 25 bp, Rattus norvegicus
gcaaacgttcttcaaggagccgttc

SEQ ID NO: 663218 - DNA, 25 bp, Rattus norvegicus
ctgcacagagctgcagaggattcag

SEQ ID NO: 663219 - DNA, 25 bp, Rattus norvegicus
attcagaccgacttgggagccgcta

SEQ ID NO: 663220 - DNA, 25 bp, Rattus norvegicus
gacatcacacctccgggtcctaagg

SEQ ID NO: 663221 - DNA, 25 bp, Rattus norvegicus
tcctaaggtctctcagtgtcgcggg

SEQ ID NO: 663222 - DNA, 25 bp, Rattus norvegicus
tctggacgccgcatacctgacggag

SEQ ID NO: 663223 - DNA, 25 bp, Rattus norvegicus
tcgcgtgaattacagggcctctagc

SEQ ID NO: 663224 - DNA, 25 bp, Rattus norvegicus
gccgttcgaaacaatcctccgcaag

SEQ ID NO: 663225 - DNA, 25 bp, Rattus norvegicus
ccacggccaaaggtgccagcgaggc

SEQ ID NO: 663226 - DNA, 25 bp, Rattus norvegicus
ggttgtcgagcaccgtcctttcaga

SEQ ID NO: 663227 - DNA, 25 bp, Rattus norvegicus
tggggctccactcgcgtgaattaca

SEQ ID NO: 663228 - DNA, 25 bp, Rattus norvegicus
tggggatgtcacaatggggtcttcc

SEQ ID NO: 663229 - DNA, 25 bp, Rattus norvegicus
aggcttaagagaaaacccgtctgtg

SEQ ID NO: 663230 - DNA, 25 bp, Rattus norvegicus
ggaagccatatcagaccacgccctg

SEQ ID NO: 663231 - DNA, 25 bp, Rattus norvegicus
atgtgaccggccgtgtgtcaacggc

SEQ ID NO: 663232 - DNA, 25 bp, Rattus norvegicus
cagcccggtgttccaggcccaagga

SEQ ID NO: 663233 - DNA, 25 bp, Rattus norvegicus
caaattgcttcggtagactaggcga

SEQ ID NO: 663234 - DNA, 25 bp, Rattus norvegicus
ctgaggccaaggaatgtgaccggcc

SEQ ID NO: 663235 - DNA, 25 bp, Rattus norvegicus
caggctcggccgcagctgaggccaa

SEQ ID NO: 663236 - DNA, 25 bp, Rattus norvegicus
ttttcgctattgctgctgccactgc

SEQ ID NO: 663237 - DNA, 25 bp, Rattus norvegicus
cgcggtgcggagagcaaattgcttc

SEQ ID NO: 663238 - DNA, 25 bp, Rattus norvegicus
gcccaaggaaggtgcccggcatgaa

SEQ ID NO: 663239 - DNA, 25 bp, Rattus norvegicus
gaaggagaggcagcaccgaccctgc

SEQ ID NO: 663240 - DNA, 25 bp, Rattus norvegicus
ccagagctccgcctggatatggacc

SEQ ID NO: 663241 - DNA, 25 bp, Rattus norvegicus
accctggcattgagcgggcttaccg

SEQ ID NO: 663242 - DNA, 25 bp, Rattus norvegicus
tccgcgctaagaccctggcattgag

SEQ ID NO: 663243 - DNA, 25 bp, Rattus norvegicus
actaggcgaggctcatccgcgctaa

SEQ ID NO: 663244 - DNA, 25 bp, Rattus norvegicus
gctgccgctgctcttttcgctattg

SEQ ID NO: 663245 - DNA, 25 bp, Rattus norvegicus
gcgctcacgttgtccaggtagttgg

SEQ ID NO: 663246 - DNA, 25 bp, Rattus norvegicus
gtctgctgtgcacgcctcggctgct

SEQ ID NO: 663247 - DNA, 25 bp, Rattus norvegicus
cagctgctggcactgctcgtctgct

SEQ ID NO: 663248 - DNA, 25 bp, Rattus norvegicus
gcgccacgtactcggagcgcagctg

SEQ ID NO: 663249 - DNA, 25 bp, Rattus norvegicus
caggcattgcgccacgtactcggag

SEQ ID NO: 663250 - DNA, 25 bp, Rattus norvegicus
gggccttcgcatccgcagaagagca

SEQ ID NO: 663251 - DNA, 25 bp, Rattus norvegicus
cggcttcgctcgcagcggtccaagg

SEQ ID NO: 663252 - DNA, 25 bp, Rattus norvegicus
catgaggcctggaaggcaaagagac

SEQ ID NO: 663253 - DNA, 25 bp, Rattus norvegicus
caaggcctgcgtaggcgcgcagaca

SEQ ID NO: 663254 - DNA, 25 bp, Rattus norvegicus
ggcttcgcactcttcgcgccggttt

SEQ ID NO: 663255 - DNA, 25 bp, Rattus norvegicus
agaggccgcccagcgtacctacaag

SEQ ID NO: 663256 - DNA, 25 bp, Rattus norvegicus
aacgcgcgcgctcacgttgtccagg

SEQ ID NO: 663257 - DNA, 25 bp, Rattus norvegicus
tggcactgctcgtctgctgtgcacg

SEQ ID NO: 663258 - DNA, 25 bp, Rattus norvegicus
ccagcgtacctacaaggcctgcgta

SEQ ID NO: 663259 - DNA, 25 bp, Rattus norvegicus
ttgagcgctttgtcgcagcagagca

SEQ ID NO: 663260 - DNA, 25 bp, Rattus norvegicus
tcagcctggagcttgagcctgaagg

SEQ ID NO: 663261 - DNA, 25 bp, Rattus norvegicus
tacgcaagtgtggtgcgctcagcct

SEQ ID NO: 663262 - DNA, 25 bp, Rattus norvegicus
gcgcttcatcactgaccctggtgta

SEQ ID NO: 663263 - DNA, 25 bp, Rattus norvegicus
tcaatctgtactgctgcgctgcgga

SEQ ID NO: 663264 - DNA, 25 bp, Rattus norvegicus
agcggcgtgtgctcatcaatctgta

SEQ ID NO: 663265 - DNA, 25 bp, Rattus norvegicus
ccgctggtgcactgatgtctttgag

SEQ ID NO: 663266 - DNA, 25 bp, Rattus norvegicus
tcaatcgttttgtgcctggccacca

SEQ ID NO: 663267 - DNA, 25 bp, Rattus norvegicus
cacttacggtgtgggcgtgctcaat

SEQ ID NO: 663268 - DNA, 25 bp, Rattus norvegicus
tgctcttcggccaggcacctggtgt

SEQ ID NO: 663269 - DNA, 25 bp, Rattus norvegicus
gcagcccagaaaacacgggcacgtc

SEQ ID NO: 663270 - DNA, 25 bp, Rattus norvegicus
cgcggtgcaggaagctctaggcaat

SEQ ID NO: 663271 - DNA, 25 bp, Rattus norvegicus
ccatcctcaagggagcagtgctctt

SEQ ID NO: 663272 - DNA, 25 bp, Rattus norvegicus
tggtcccgcacgatgtgggcctcac

SEQ ID NO: 663273 - DNA, 25 bp, Rattus norvegicus
tctaggagttaagcaatcatctttc

SEQ ID NO: 663274 - DNA, 25 bp, Rattus norvegicus
tctccaaggaggcagtcgccatggc

SEQ ID NO: 663275 - DNA, 25 bp, Rattus norvegicus
gccatggcagcgagatgcgtctcga

SEQ ID NO: 663276 - DNA, 25 bp, Rattus norvegicus
acaggagcttctgctcttggtctcc

SEQ ID NO: 663277 - DNA, 25 bp, Rattus norvegicus
tctttcctactcaactggatctggg

SEQ ID NO: 663278 - DNA, 25 bp, Rattus norvegicus
ctgcggcagttttgtctaggagtta

SEQ ID NO: 663279 - DNA, 25 bp, Rattus norvegicus
agctatgtgggaaccgctgctggaa

SEQ ID NO: 663280 - DNA, 25 bp, Rattus norvegicus
gatcgacgtcacctcagcagcacga

SEQ ID NO: 663281 - DNA, 25 bp, Rattus norvegicus
ttccatatcacgtgagcgcggaggc

SEQ ID NO: 663282 - DNA, 25 bp, Rattus norvegicus
gaccaatgcgctgtctctgagattc

SEQ ID NO: 663283 - DNA, 25 bp, Rattus norvegicus
ggggctaggacacttcagaccaatg

SEQ ID NO: 663284 - DNA, 25 bp, Rattus norvegicus
ctccttcattggcttgaggggcgtg

SEQ ID NO: 663285 - DNA, 25 bp, Rattus norvegicus
acggagccaggaggacccatctcac

SEQ ID NO: 663286 - DNA, 25 bp, Rattus norvegicus
acccgttccctattcctgataagca

SEQ ID NO: 663287 - DNA, 25 bp, Rattus norvegicus
gctcgctccgccctcccaatcctgc

SEQ ID NO: 663288 - DNA, 25 bp, Rattus norvegicus
gccgggagaggtcatcgatgcgcac

SEQ ID NO: 663289 - DNA, 25 bp, Rattus norvegicus
cgctgcttgcgctcggcctgctgga

SEQ ID NO: 663290 - DNA, 25 bp, Rattus norvegicus
tggcaccgctcaccgctgcttgcgc

SEQ ID NO: 663291 - DNA, 25 bp, Rattus norvegicus
ccaatcctgcgtccgcaggtgagtg

SEQ ID NO: 663292 - DNA, 25 bp, Rattus norvegicus
agacgctaacgagcagctcgctccg

SEQ ID NO: 663293 - DNA, 25 bp, Rattus norvegicus
cggagacgctaacgagcagctcgct

SEQ ID NO: 663294 - DNA, 25 bp, Rattus norvegicus
tgccggagacgctaacgagcagctc

SEQ ID NO: 663295 - DNA, 25 bp, Rattus norvegicus
tagctgccggagacgctaacgagca

SEQ ID NO: 663296 - DNA, 25 bp, Rattus norvegicus
cggtagctgccggagacgctaacga

SEQ ID NO: 663297 - DNA, 25 bp, Rattus norvegicus
ctttgcagccgagcgcggtagctgc

SEQ ID NO: 663298 - DNA, 25 bp, Rattus norvegicus
gaaccctttgcagccgagcgcggta

SEQ ID NO: 663299 - DNA, 25 bp, Rattus norvegicus
cacgttcgcccgaaccctttgcagc

SEQ ID NO: 663300 - DNA, 25 bp, Rattus norvegicus
gcagccctggcaccgctcaccgctg

SEQ ID NO: 663301 - DNA, 25 bp, Rattus norvegicus
cagcctcaagagaccttctcggata

SEQ ID NO: 663302 - DNA, 25 bp, Rattus norvegicus
cggggactaagaagacggacttcag

SEQ ID NO: 663303 - DNA, 25 bp, Rattus norvegicus
cggacttcagacaaagcggcgcttg

SEQ ID NO: 663304 - DNA, 25 bp, Rattus norvegicus
ttgggcccgagaagcagacgcttca

SEQ ID NO: 663305 - DNA, 25 bp, Rattus norvegicus
taccttgagatcaagcctccagcct

SEQ ID NO: 663306 - DNA, 25 bp, Rattus norvegicus
agaccttctcggataccgcgtccga

SEQ ID NO: 663307 - DNA, 25 bp, Rattus norvegicus
ggcagaaatcgagaacgcggtccga

SEQ ID NO: 663308 - DNA, 25 bp, Rattus norvegicus
ccgaagttgggcctaggcgattatc

SEQ ID NO: 663309 - DNA, 25 bp, Rattus norvegicus
gcctaggcgattatccggatcccta

SEQ ID NO: 663310 - DNA, 25 bp, Rattus norvegicus
tccggatccctaaacaccggctatg

SEQ ID NO: 663311 - DNA, 25 bp, Rattus norvegicus
tcgactcgggcaccaagaactctga

SEQ ID NO: 663312 - DNA, 25 bp, Rattus norvegicus
agaactctgacgctggaccaaccgg

SEQ ID NO: 663313 - DNA, 25 bp, Rattus norvegicus
gaccaaccgggtcgtcgacagagcg

SEQ ID NO: 663314 - DNA, 25 bp, Rattus norvegicus
gcagacgcttcataccttgagatca

SEQ ID NO: 663315 - DNA, 25 bp, Rattus norvegicus
ggatgatccgcgacttctcccggaa

SEQ ID NO: 663316 - DNA, 25 bp, Rattus norvegicus
ggcattggcgcatagcaaaacgcta

SEQ ID NO: 663317 - DNA, 25 bp, Rattus norvegicus
gcctggtccgacagaaagtcgtacc

SEQ ID NO: 663318 - DNA, 25 bp, Rattus norvegicus
gtcgtaccacagactggtctcggtg

SEQ ID NO: 663319 - DNA, 25 bp, Rattus norvegicus
cgctgaacacgtcctgcgaggcgta

SEQ ID NO: 663320 - DNA, 25 bp, Rattus norvegicus
ccagccagccgttggaagcagtgaa

SEQ ID NO: 663321 - DNA, 25 bp, Rattus norvegicus
agcagtgaagtcgtccatgcccagc

SEQ ID NO: 663322 - DNA, 25 bp, Rattus norvegicus
cagcgccttctctttcaggatgatg

SEQ ID NO: 663323 - DNA, 25 bp, Rattus norvegicus
aggatgatgcccttgaccggcaggc

SEQ ID NO: 663324 - DNA, 25 bp, Rattus norvegicus
tgctggaaccaagcgatgagaagcc

SEQ ID NO: 663325 - DNA, 25 bp, Rattus norvegicus
gtggaggccactccgtacttgcgct

SEQ ID NO: 663326 - DNA, 25 bp, Rattus norvegicus
cgacgccaggatggcgcgcttgttt

SEQ ID NO: 663327 - DNA, 25 bp, Rattus norvegicus
aatctcgcccttgcgtaggtccggg

SEQ ID NO: 663328 - DNA, 25 bp, Rattus norvegicus
cgcttgtttttcaggatggtgctca

SEQ ID NO: 663329 - DNA, 25 bp, Rattus norvegicus
caaagcgccgcggttgaatgactgc

SEQ ID NO: 663330 - DNA, 25 bp, Rattus norvegicus
tgatggtaaacgtcgagggctcctt

SEQ ID NO: 663331 - DNA, 25 bp, Rattus norvegicus
cggttgaatgactgcagctgctctc

SEQ ID NO: 663332 - DNA, 25 bp, Rattus norvegicus
ggtgcatcttcgtctccgccattca

SEQ ID NO: 663333 - DNA, 25 bp, Rattus norvegicus
agtcacggaacttttcaacgctcgg

SEQ ID NO: 663334 - DNA, 25 bp, Rattus norvegicus
caacgctcggtctgtaaaccggaca

SEQ ID NO: 663335 - DNA, 25 bp, Rattus norvegicus
aaaccggacagggaacgcagagctc

SEQ ID NO: 663336 - DNA, 25 bp, Rattus norvegicus
cgcagagctcacagcaaacttggca

SEQ ID NO: 663337 - DNA, 25 bp, Rattus norvegicus
caaacttggcaaacgtcctaggctc

SEQ ID NO: 663338 - DNA, 25 bp, Rattus norvegicus
acgtcctaggctcaagcagagtgta

SEQ ID NO: 663339 - DNA, 25 bp, Rattus norvegicus
gcagagtgtagcaccgacccttacc

SEQ ID NO: 663340 - DNA, 25 bp, Rattus norvegicus
gacccttaccggtgaccgtgcactg

SEQ ID NO: 663341 - DNA, 25 bp, Rattus norvegicus
tctctgcggcctaggggcgttgaca

SEQ ID NO: 663342 - DNA, 25 bp, Rattus norvegicus
ccggtgaccgtgcactgatggtaaa

SEQ ID NO: 663343 - DNA, 25 bp, Rattus norvegicus
ggcgcagcgtttctacgtctctcca

SEQ ID NO: 663344 - DNA, 25 bp, Rattus norvegicus
atctgctggcctgcggaacctacca

SEQ ID NO: 663345 - DNA, 25 bp, Rattus norvegicus
ttgagggttgccagcatctgctggc

SEQ ID NO: 663346 - DNA, 25 bp, Rattus norvegicus
gcccggttgagggttgccagcatct

SEQ ID NO: 663347 - DNA, 25 bp, Rattus norvegicus
cttactgcggactcggtggaatggt

SEQ ID NO: 663348 - DNA, 25 bp, Rattus norvegicus
tggacaccgagcttactgcggactc

SEQ ID NO: 663349 - DNA, 25 bp, Rattus norvegicus
gcaggcagtggacaccgagcttact

SEQ ID NO: 663350 - DNA, 25 bp, Rattus norvegicus
attggttctgcctcgatggcgggca

SEQ ID NO: 663351 - DNA, 25 bp, Rattus norvegicus
cacgtatctattggttctgcctcga

SEQ ID NO: 663352 - DNA, 25 bp, Rattus norvegicus
ggagttccgcgcacgtatctattgg

SEQ ID NO: 663353 - DNA, 25 bp, Rattus norvegicus
tctaatatgggtcggcagtgactga

SEQ ID NO: 663354 - DNA, 25 bp, Rattus norvegicus
accggaagtctaatatgggtcggca

SEQ ID NO: 663355 - DNA, 25 bp, Rattus norvegicus
tctacgtctctccataccggaagtc

SEQ ID NO: 663356 - DNA, 25 bp, Rattus norvegicus
ctgcggaacctaccagctgcgagcg

SEQ ID NO: 663357 - DNA, 25 bp, Rattus norvegicus
cttcttggtaagttcgcagcctggg

SEQ ID NO: 663358 - DNA, 25 bp, Rattus norvegicus
ctggccgcaagcaacgacctgtggc

SEQ ID NO: 663359 - DNA, 25 bp, Rattus norvegicus
tctgcacagtcgaacgcggtcaacc

SEQ ID NO: 663360 - DNA, 25 bp, Rattus norvegicus
cgcagcgggactcagttaggccaat

SEQ ID NO: 663361 - DNA, 25 bp, Rattus norvegicus
ctggacagaaagaacctcggagtgc

SEQ ID NO: 663362 - DNA, 25 bp, Rattus norvegicus
agagcgtttgcccaggctggacaga

SEQ ID NO: 663363 - DNA, 25 bp, Rattus norvegicus
gcatccagcacctttagcaagcagg

SEQ ID NO: 663364 - DNA, 25 bp, Rattus norvegicus
ggcagttccttgaaccgcatccagc

SEQ ID NO: 663365 - DNA, 25 bp, Rattus norvegicus
cccttcatctgggagggctctgcac

SEQ ID NO: 663366 - DNA, 25 bp, Rattus norvegicus
cgctcggtgccagagaagatcctga

SEQ ID NO: 663367 - DNA, 25 bp, Rattus norvegicus
agccgagtgctcctaggatttcgca

SEQ ID NO: 663368 - DNA, 25 bp, Rattus norvegicus
tgctctgtgctcactgaggttgttc

SEQ ID NO: 663369 - DNA, 25 bp, Rattus norvegicus
gcggtcaacctgtttcctagtctgg

SEQ ID NO: 663370 - DNA, 25 bp, Rattus norvegicus
cctgaaccggattaggggagaatgc

SEQ ID NO: 663371 - DNA, 25 bp, Rattus norvegicus
cctattggacaaaagctctggcgcc

SEQ ID NO: 663372 - DNA, 25 bp, Rattus norvegicus
ttggacaaaagctctggcgcccgcc

SEQ ID NO: 663373 - DNA, 25 bp, Rattus norvegicus
ctagccatctcggattggctggttg

SEQ ID NO: 663374 - DNA, 25 bp, Rattus norvegicus
attggctggttgcacgttggcgcaa

SEQ ID NO: 663375 - DNA, 25 bp, Rattus norvegicus
tgcacgttggcgcaacggaaaaggc

SEQ ID NO: 663376 - DNA, 25 bp, Rattus norvegicus
ccggcgagtctgcggactccgaagt

SEQ ID NO: 663377 - DNA, 25 bp, Rattus norvegicus
ttgttcgcgcgctagcggtgcccgc

SEQ ID NO: 663378 - DNA, 25 bp, Rattus norvegicus
cacggtcgtcgttgttcgcgcgcta

SEQ ID NO: 663379 - DNA, 25 bp, Rattus norvegicus
gtctgggagcctattggacaaaagc

SEQ ID NO: 663380 - DNA, 25 bp, Rattus norvegicus
tctcaccggtcctgagtgcctgtca

SEQ ID NO: 663381 - DNA, 25 bp, Rattus norvegicus
tcagggccggcagagagcttgagac

SEQ ID NO: 663382 - DNA, 25 bp, Rattus norvegicus
gcgcggtctcttcggctcgagtctg

SEQ ID NO: 663383 - DNA, 25 bp, Rattus norvegicus
cctgagtgcctgtcattggatggcg

SEQ ID NO: 663384 - DNA, 25 bp, Rattus norvegicus
ctcgagtctgggagcctattggaca

SEQ ID NO: 663385 - DNA, 25 bp, Rattus norvegicus
gcttcattgtgtgcagtgcgcaggc

SEQ ID NO: 663386 - DNA, 25 bp, Rattus norvegicus
cggagtcagctttcgtgcggcgaac

SEQ ID NO: 663387 - DNA, 25 bp, Rattus norvegicus
agcaccgacgcagaagcagcggctc

SEQ ID NO: 663388 - DNA, 25 bp, Rattus norvegicus
gacgcagaagcagcggctcctccat

SEQ ID NO: 663389 - DNA, 25 bp, Rattus norvegicus
agcccgaggtgacctccgggtgaca

SEQ ID NO: 663390 - DNA, 25 bp, Rattus norvegicus
tgacagcccgcgcagccttttgtgc

SEQ ID NO: 663391 - DNA, 25 bp, Rattus norvegicus
ggcgcgctgccctcagcatcccgga

SEQ ID NO: 663392 - DNA, 25 bp, Rattus norvegicus
gatgcccgggcaagtcccgccttct

SEQ ID NO: 663393 - DNA, 25 bp, Rattus norvegicus
gcgcctctcattcatgccgcggggg

SEQ ID NO: 663394 - DNA, 25 bp, Rattus norvegicus
ctgagctggcggtagcgactgctta

SEQ ID NO: 663395 - DNA, 25 bp, Rattus norvegicus
cgcgtccgtgagagtccgagccgct

SEQ ID NO: 663396 - DNA, 25 bp, Rattus norvegicus
aactgctagcgagccgcgtccgtga

SEQ ID NO: 663397 - DNA, 25 bp, Rattus norvegicus
ctttcgtgcggcgaactgctagcga

SEQ ID NO: 663398 - DNA, 25 bp, Rattus norvegicus
cgcgcagccttttgtgccggtgtgt

SEQ ID NO: 663399 - DNA, 25 bp, Rattus norvegicus
gtgaggcgtcccatttgcgagatag

SEQ ID NO: 663400 - DNA, 25 bp, Rattus norvegicus
tccaaaagtgcgagaagacctcatc

SEQ ID NO: 663401 - DNA, 25 bp, Rattus norvegicus
gtctccttgggacagctggaggaat

SEQ ID NO: 663402 - DNA, 25 bp, Rattus norvegicus
ttctgccggtctccttgggacagct

SEQ ID NO: 663403 - DNA, 25 bp, Rattus norvegicus
tggctgggcttctgccggtctcctt

SEQ ID NO: 663404 - DNA, 25 bp, Rattus norvegicus
accgcggcgcagacaaagccggcga

SEQ ID NO: 663405 - DNA, 25 bp, Rattus norvegicus
cccatttgcgagataggagagcgca

SEQ ID NO: 663406 - DNA, 25 bp, Rattus norvegicus
acctcatctgcctcgcagggcgggg

SEQ ID NO: 663407 - DNA, 25 bp, Rattus norvegicus
agaagacctcatctgcctcgcaggg

SEQ ID NO: 663408 - DNA, 25 bp, Rattus norvegicus
gcgcggcgctccaaaagtgcgagaa

SEQ ID NO: 663409 - DNA, 25 bp, Rattus norvegicus
aagggcggcagtgtctaggtaaact

SEQ ID NO: 663410 - DNA, 25 bp, Rattus norvegicus
ggtcttgtaccaggagcaaaccgcg

SEQ ID NO: 663411 - DNA, 25 bp, Rattus norvegicus
ttggagcagtcgcttcgccgggaat

SEQ ID NO: 663412 - DNA, 25 bp, Rattus norvegicus
tgtgcggacctttgggtcttgtacc

SEQ ID NO: 663413 - DNA, 25 bp, Rattus norvegicus
accgaatcctgcgtctccggcgtgt

SEQ ID NO: 663414 - DNA, 25 bp, Rattus norvegicus
cagggcacacgcagtctccgcgcgc

SEQ ID NO: 663415 - DNA, 25 bp, Rattus norvegicus
ccagagcgaatcttatgggacaggc

SEQ ID NO: 663416 - DNA, 25 bp, Rattus norvegicus
cgaatcttatgggacaggctggaca

SEQ ID NO: 663417 - DNA, 25 bp, Rattus norvegicus
gacaggctggacaccttcgcacgca

SEQ ID NO: 663418 - DNA, 25 bp, Rattus norvegicus
tggacaccttcgcacgcagctgggt

SEQ ID NO: 663419 - DNA, 25 bp, Rattus norvegicus
accttcgcacgcagctgggtcgtgg

SEQ ID NO: 663420 - DNA, 25 bp, Rattus norvegicus
tgtagcggcccgagcagtctccact

SEQ ID NO: 663421 - DNA, 25 bp, Rattus norvegicus
gcagtctccactcccggagggcgga

SEQ ID NO: 663422 - DNA, 25 bp, Rattus norvegicus
tcgactgctggagaccgaatcctgc

SEQ ID NO: 663423 - DNA, 25 bp, Rattus norvegicus
tgcgtctccggcgtgtctgccgagc

SEQ ID NO: 663424 - DNA, 25 bp, Rattus norvegicus
gctcgccagtggtggccgtagactc

SEQ ID NO: 663425 - DNA, 25 bp, Rattus norvegicus
cagtggtggccgtagactcgccaga

SEQ ID NO: 663426 - DNA, 25 bp, Rattus norvegicus
ctggctttcgactgctggagaccga

SEQ ID NO: 663427 - DNA, 25 bp, Rattus norvegicus
cacacgtcgcagaaggttcggccga

SEQ ID NO: 663428 - DNA, 25 bp, Rattus norvegicus
acgctcaggatgtcgcggaaagtca

SEQ ID NO: 663429 - DNA, 25 bp, Rattus norvegicus
cggaaagtcatctcacggcgcagcc

SEQ ID NO: 663430 - DNA, 25 bp, Rattus norvegicus
cggggtccttcgaaagtgacgctca

SEQ ID NO: 663431 - DNA, 25 bp, Rattus norvegicus
gacggccgccgagccatttacttcg

SEQ ID NO: 663432 - DNA, 25 bp, Rattus norvegicus
atgaccagcaggttgcccgccacag

SEQ ID NO: 663433 - DNA, 25 bp, Rattus norvegicus
ccaccgccaggttcacgatgaaata

SEQ ID NO: 663434 - DNA, 25 bp, Rattus norvegicus
ggcccagaagcctagaacctccata

SEQ ID NO: 663435 - DNA, 25 bp, Rattus norvegicus
gtacttgagcgagtggcgcacaccc

SEQ ID NO: 663436 - DNA, 25 bp, Rattus norvegicus
cgtaccggtccacagagatggtgca

SEQ ID NO: 663437 - DNA, 25 bp, Rattus norvegicus
agcggccttgcgctctgtcataatg

SEQ ID NO: 663438 - DNA, 25 bp, Rattus norvegicus
caccgcccaaagcagagccagaatg

SEQ ID NO: 663439 - DNA, 25 bp, Rattus norvegicus
tccatagtggctgagaagggcaaca

SEQ ID NO: 663440 - DNA, 25 bp, Rattus norvegicus
tagcggtcccacagataccaccagg

SEQ ID NO: 663441 - DNA, 25 bp, Rattus norvegicus
gcgactcctggagggaccgaatccc

SEQ ID NO: 663442 - DNA, 25 bp, Rattus norvegicus
ctgaagccaggcgtcagcgagcatt

SEQ ID NO: 663443 - DNA, 25 bp, Rattus norvegicus
tcagagcagcagacggagtctgagc

SEQ ID NO: 663444 - DNA, 25 bp, Rattus norvegicus
cccgcgttgtcagagcagcagacgg

SEQ ID NO: 663445 - DNA, 25 bp, Rattus norvegicus
agccattggtgagcatcacgctccg

SEQ ID NO: 663446 - DNA, 25 bp, Rattus norvegicus
ccgcgagaagccattggtgagcatc

SEQ ID NO: 663447 - DNA, 25 bp, Rattus norvegicus
agcggtgactcatcccaccgcgaga

SEQ ID NO: 663448 - DNA, 25 bp, Rattus norvegicus
ttactgtgcctctccgggacttgag

SEQ ID NO: 663449 - DNA, 25 bp, Rattus norvegicus
ctgctgcgcgactcctggagggacc

SEQ ID NO: 663450 - DNA, 25 bp, Rattus norvegicus
gagcattcagccttcctcccgtcga

SEQ ID NO: 663451 - DNA, 25 bp, Rattus norvegicus
tcccgtcgacaagctcggcttactg

SEQ ID NO: 663452 - DNA, 25 bp, Rattus norvegicus
tgcctctccgggacttgaggccgcg

SEQ ID NO: 663453 - DNA, 25 bp, Rattus norvegicus
acaagctcggcttactgtgcctctc

SEQ ID NO: 663454 - DNA, 25 bp, Rattus norvegicus
gcgtcagcgagcattcagccttcct

SEQ ID NO: 663455 - DNA, 25 bp, Rattus norvegicus
gtgtctgcgggctcagtccattctc

SEQ ID NO: 663456 - DNA, 25 bp, Rattus norvegicus
tgggccaagcctgcctaacgtctgc

SEQ ID NO: 663457 - DNA, 25 bp, Rattus norvegicus
ccattggccgccgtgaggtcacgtg

SEQ ID NO: 663458 - DNA, 25 bp, Rattus norvegicus
tcctcgtgttgtccctgggccaagc

SEQ ID NO: 663459 - DNA, 25 bp, Rattus norvegicus
gacgcgcgtccctctctggagagga

SEQ ID NO: 663460 - DNA, 25 bp, Rattus norvegicus
attctccggctctgtcctcgtgttg

SEQ ID NO: 663461 - DNA, 25 bp, Rattus norvegicus
ggaagggatgtctgtcccttccacc

SEQ ID NO: 663462 - DNA, 25 bp, Rattus norvegicus
cgataaatagtcagagccggagtgg

SEQ ID NO: 663463 - DNA, 25 bp, Rattus norvegicus
gggctcagtccattctccggctctg

SEQ ID NO: 663464 - DNA, 25 bp, Rattus norvegicus
ccagagtctcctcagcggcggaggt

SEQ ID NO: 663465 - DNA, 25 bp, Rattus norvegicus
gcgatgtccttaagcccagagtctc

SEQ ID NO: 663466 - DNA, 25 bp, Rattus norvegicus
ggcagcggcgatgtccttaagccca

SEQ ID NO: 663467 - DNA, 25 bp, Rattus norvegicus
tcccttcgctttaatggcggccaca

SEQ ID NO: 663468 - DNA, 25 bp, Rattus norvegicus
caatcagggacacgataaatagtca

SEQ ID NO: 663469 - DNA, 25 bp, Rattus norvegicus
acaatgctgtggcttcgtgtcggcc

SEQ ID NO: 663470 - DNA, 25 bp, Rattus norvegicus
ccagcatttcttctcggcgggccag

SEQ ID NO: 663471 - DNA, 25 bp, Rattus norvegicus
caagctctgcctttatctgccgatc

SEQ ID NO: 663472 - DNA, 25 bp, Rattus norvegicus
ttggtcctcaccctgggagccagag

SEQ ID NO: 663473 - DNA, 25 bp, Rattus norvegicus
agccagagggcgcactacagtccga

SEQ ID NO: 663474 - DNA, 25 bp, Rattus norvegicus
cctcccttcaagacagacaatgctg

SEQ ID NO: 663475 - DNA, 25 bp, Rattus norvegicus
gggagtactttcctgccactgcact

SEQ ID NO: 663476 - DNA, 25 bp, Rattus norvegicus
tgcacttagtgtcgaccgcagaaaa

SEQ ID NO: 663477 - DNA, 25 bp, Rattus norvegicus
ccgcagaaaaggtcttaagggatca

SEQ ID NO: 663478 - DNA, 25 bp, Rattus norvegicus
agcacgagctccaggccacaacttt

SEQ ID NO: 663479 - DNA, 25 bp, Rattus norvegicus
ctacccgagaaaaacgagtgggctg

SEQ ID NO: 663480 - DNA, 25 bp, Rattus norvegicus
agggagacaggaccaccggcacctt

SEQ ID NO: 663481 - DNA, 25 bp, Rattus norvegicus
cccgcgcactgtgtcttgcctgtgt

SEQ ID NO: 663482 - DNA, 25 bp, Rattus norvegicus
cttaagggatcagagccgcagcacg

SEQ ID NO: 663483 - DNA, 25 bp, Rattus norvegicus
gatgcagggctcaccacctggggag

SEQ ID NO: 663484 - DNA, 25 bp, Rattus norvegicus
tcacctgcctgcagctcgctgggct

SEQ ID NO: 663485 - DNA, 25 bp, Rattus norvegicus
cgaggttggagcagcggcatctaaa

SEQ ID NO: 663486 - DNA, 25 bp, Rattus norvegicus
gcggcatctaaaattactccgtgtc

SEQ ID NO: 663487 - DNA, 25 bp, Rattus norvegicus
aaaattactccgtgtcgcctccgca

SEQ ID NO: 663488 - DNA, 25 bp, Rattus norvegicus
tccgtgtcgcctccgcaaagaggga

SEQ ID NO: 663489 - DNA, 25 bp, Rattus norvegicus
gcaaagagggaaggaaaccagactg

SEQ ID NO: 663490 - DNA, 25 bp, Rattus norvegicus
aaccagactggaaacagcaccgcca

SEQ ID NO: 663491 - DNA, 25 bp, Rattus norvegicus
gggcgagctgcaagtcacgcagcac

SEQ ID NO: 663492 - DNA, 25 bp, Rattus norvegicus
cagcagcgagcgctcgggacacgcg

SEQ ID NO: 663493 - DNA, 25 bp, Rattus norvegicus
gcctcgtgggctcggttagcaaccc

SEQ ID NO: 663494 - DNA, 25 bp, Rattus norvegicus
tgcaagtcacgcagcacgcggagcc

SEQ ID NO: 663495 - DNA, 25 bp, Rattus norvegicus
cggcccggctctcacctgcctgcag

SEQ ID NO: 663496 - DNA, 25 bp, Rattus norvegicus
ctcggttagcaacccgggctgccgg

SEQ ID NO: 663497 - DNA, 25 bp, Rattus norvegicus
tcaggacccacgtaaaataactggc

SEQ ID NO: 663498 - DNA, 25 bp, Rattus norvegicus
ggcgctgtggacaacctcccgtcgg

SEQ ID NO: 663499 - DNA, 25 bp, Rattus norvegicus
ctgcgcgtggcgctgtggacaacct

SEQ ID NO: 663500 - DNA, 25 bp, Rattus norvegicus
cttcgtcgcccacggtcaggaccca

SEQ ID NO: 663501 - DNA, 25 bp, Rattus norvegicus
acccacgtaaaataactggctctgg

SEQ ID NO: 663502 - DNA, 25 bp, Rattus norvegicus
taactggctctgggaagcagcctca

SEQ ID NO: 663503 - DNA, 25 bp, Rattus norvegicus
agggccaggtctcgccgctggcttc

SEQ ID NO: 663504 - DNA, 25 bp, Rattus norvegicus
gttaggcgcgctcgcacggctcgct

SEQ ID NO: 663505 - DNA, 25 bp, Rattus norvegicus
ggctcgctcaacagccaacgactgg

SEQ ID NO: 663506 - DNA, 25 bp, Rattus norvegicus
ccaacgactggctgtacgaaggcca

SEQ ID NO: 663507 - DNA, 25 bp, Rattus norvegicus
ctgtacgaaggccagcccggcggaa

SEQ ID NO: 663508 - DNA, 25 bp, Rattus norvegicus
cgcaccggaagtggtgtcaccagga

SEQ ID NO: 663509 - DNA, 25 bp, Rattus norvegicus
gtgtcaccaggaaattatgtcatcg

SEQ ID NO: 663510 - DNA, 25 bp, Rattus norvegicus
tatgtcatcgaatcccgcttccagg

SEQ ID NO: 663511 - DNA, 25 bp, Rattus norvegicus
ttagtaagagcctcgctgactggtc

SEQ ID NO: 663512 - DNA, 25 bp, Rattus norvegicus
acggtctggcgcatggccaaatcta

SEQ ID NO: 663513 - DNA, 25 bp, Rattus norvegicus
tgtcactatccaggacccgccagtg

SEQ ID NO: 663514 - DNA, 25 bp, Rattus norvegicus
cgctgtttcccggactgtcactatc

SEQ ID NO: 663515 - DNA, 25 bp, Rattus norvegicus
gtttgcggaccctccaagtcacttc

SEQ ID NO: 663516 - DNA, 25 bp, Rattus norvegicus
gatagaaggctcacaaccgctgcgc

SEQ ID NO: 663517 - DNA, 25 bp, Rattus norvegicus
tggctctagagttcggccctcaaga

SEQ ID NO: 663518 - DNA, 25 bp, Rattus norvegicus
gagccgtcgctcttagctgtcgtca

SEQ ID NO: 663519 - DNA, 25 bp, Rattus norvegicus
tggcagtcgagctctagcctgtcga

SEQ ID NO: 663520 - DNA, 25 bp, Rattus norvegicus
tgactggtcaccaaggcgcccaatg

SEQ ID NO: 663521 - DNA, 25 bp, Rattus norvegicus
cggggtcagacactccttagtaaga

SEQ ID NO: 663522 - DNA, 25 bp, Rattus norvegicus
gtcagacacggtttccgcagcctta

SEQ ID NO: 663523 - DNA, 25 bp, Rattus norvegicus
tccctttccgacttgaggtcagaca

SEQ ID NO: 663524 - DNA, 25 bp, Rattus norvegicus
tgtggcccagggagctaagccaatc

SEQ ID NO: 663525 - DNA, 25 bp, Rattus norvegicus
gcgcagctcggaagcacgcattttc

SEQ ID NO: 663526 - DNA, 25 bp, Rattus norvegicus
ttttcccgctgactaccgctttgtg

SEQ ID NO: 663527 - DNA, 25 bp, Rattus norvegicus
cttaggaagtttctgcgccacggaa

SEQ ID NO: 663528 - DNA, 25 bp, Rattus norvegicus
ggccatgccagccaatgcgagtgca

SEQ ID NO: 663529 - DNA, 25 bp, Rattus norvegicus
tcacctggtgaggttcacgcccatg

SEQ ID NO: 663530 - DNA, 25 bp, Rattus norvegicus
tcgcagcggtatgtgtcgaagcctt

SEQ ID NO: 663531 - DNA, 25 bp, Rattus norvegicus
atccatgctctgtaggttcacgccg

SEQ ID NO: 663532 - DNA, 25 bp, Rattus norvegicus
gatgtcccagcaggcctcattgatg

SEQ ID NO: 663533 - DNA, 25 bp, Rattus norvegicus
gagggcctccagcaccttcttcagg

SEQ ID NO: 663534 - DNA, 25 bp, Rattus norvegicus
cttcttcaggatggagccctggatc

SEQ ID NO: 663535 - DNA, 25 bp, Rattus norvegicus
tcaggcgtgcctcaaacatggtggc

SEQ ID NO: 663536 - DNA, 25 bp, Rattus norvegicus
tcctctagaaccaatcgtatccgtg

SEQ ID NO: 663537 - DNA, 25 bp, Rattus norvegicus
cgtatccgtggtttgagcaaggccc

SEQ ID NO: 663538 - DNA, 25 bp, Rattus norvegicus
gcaggcacttaatgagcgcagctcg

SEQ ID NO: 663539 - DNA, 25 bp, Rattus norvegicus
agcgagcggccgctgtagaaacagc

SEQ ID NO: 663540 - DNA, 25 bp, Rattus norvegicus
gctgtagaaacagcggctccgctct

SEQ ID NO: 663541 - DNA, 25 bp, Rattus norvegicus
agcggctccgctctcacggcaaggg

SEQ ID NO: 663542 - DNA, 25 bp, Rattus norvegicus
agaggccgtgcacactgagccgacc

SEQ ID NO: 663543 - DNA, 25 bp, Rattus norvegicus
tgctcactctgggtgacgtcgcgcc

SEQ ID NO: 663544 - DNA, 25 bp, Rattus norvegicus
cccagcatgaccgagctacggcaga

SEQ ID NO: 663545 - DNA, 25 bp, Rattus norvegicus
accgagctacggcagagggctgtcc

SEQ ID NO: 663546 - DNA, 25 bp, Rattus norvegicus
gcgaggacgcacctccggaggacaa

SEQ ID NO: 663547 - DNA, 25 bp, Rattus norvegicus
ctccggaggacaaggtagaggcctc

SEQ ID NO: 663548 - DNA, 25 bp, Rattus norvegicus
aggtagaggcctccttgaatacgga

SEQ ID NO: 663549 - DNA, 25 bp, Rattus norvegicus
cctccttgaatacggaggggcgcgc

SEQ ID NO: 663550 - DNA, 25 bp, Rattus norvegicus
tctgacctttgtcacggccctgggc

SEQ ID NO: 663551 - DNA, 25 bp, Rattus norvegicus
gttctttgctcatggggacagccgc

SEQ ID NO: 663552 - DNA, 25 bp, Rattus norvegicus
gggtcggcgagcgttctttgctcat

SEQ ID NO: 663553 - DNA, 25 bp, Rattus norvegicus
cactagctagcgctggcggaggctt

SEQ ID NO: 663554 - DNA, 25 bp, Rattus norvegicus
gtcttggtgcctccaggggcgcacc

SEQ ID NO: 663555 - DNA, 25 bp, Rattus norvegicus
actcacttgtcttggtgcctccagg

SEQ ID NO: 663556 - DNA, 25 bp, Rattus norvegicus
cacccggcactcacttgtcttggtg

SEQ ID NO: 663557 - DNA, 25 bp, Rattus norvegicus
ccgagctctggggacactagctagc

SEQ ID NO: 663558 - DNA, 25 bp, Rattus norvegicus
aatctcgtggaacagacgcgccgtg

SEQ ID NO: 663559 - DNA, 25 bp, Rattus norvegicus
tcaatcccagtgtccggaggcagga

SEQ ID NO: 663560 - DNA, 25 bp, Rattus norvegicus
agaacctcagtcctcaatcccagtg

SEQ ID NO: 663561 - DNA, 25 bp, Rattus norvegicus
ttgtccgcacgctttctaccgcgcc

SEQ ID NO: 663562 - DNA, 25 bp, Rattus norvegicus
tctagtggggaattcaaacccaaga

SEQ ID NO: 663563 - DNA, 25 bp, Rattus norvegicus
taggtatctagtggggaattcaaac

SEQ ID NO: 663564 - DNA, 25 bp, Rattus norvegicus
acactggcccgggattaggtatcta

SEQ ID NO: 663565 - DNA, 25 bp, Rattus norvegicus
tctcagcgcgacactggcccgggat

SEQ ID NO: 663566 - DNA, 25 bp, Rattus norvegicus
caggtttccgagttgtgccccagaa

SEQ ID NO: 663567 - DNA, 25 bp, Rattus norvegicus
gagcccagattacagtcacctttca

SEQ ID NO: 663568 - DNA, 25 bp, Rattus norvegicus
ggcctgacgtcacgcccggttctgt

SEQ ID NO: 663569 - DNA, 25 bp, Rattus norvegicus
ggctccagctcctccgttttctttg

SEQ ID NO: 663570 - DNA, 25 bp, Rattus norvegicus
tctctacccggtatttccgtggctg

SEQ ID NO: 663571 - DNA, 25 bp, Rattus norvegicus
atttccgtggctgtcctggtcacgc

SEQ ID NO: 663572 - DNA, 25 bp, Rattus norvegicus
gtcacgctgctcagtaggaccgagg

SEQ ID NO: 663573 - DNA, 25 bp, Rattus norvegicus
ccgcggccgactaagccgagagtct

SEQ ID NO: 663574 - DNA, 25 bp, Rattus norvegicus
aagccgagagtctgcgcctcgccag

SEQ ID NO: 663575 - DNA, 25 bp, Rattus norvegicus
gtttcagctgccctaaactgccagc

SEQ ID NO: 663576 - DNA, 25 bp, Rattus norvegicus
gtggcagcactgagcccagattaca

SEQ ID NO: 663577 - DNA, 25 bp, Rattus norvegicus
tcacctttcaaaccggtttcagctg

SEQ ID NO: 663578 - DNA, 25 bp, Rattus norvegicus
gcgcgagtcaccagtgccagcgcga

SEQ ID NO: 663579 - DNA, 25 bp, Rattus norvegicus
ttctgtcctggccaatcggtgcccg

SEQ ID NO: 663580 - DNA, 25 bp, Rattus norvegicus
ctcccttaggtgaccggtggcagca

SEQ ID NO: 663581 - DNA, 25 bp, Rattus norvegicus
ctcttgcggtcaggccggtgagtga

SEQ ID NO: 663582 - DNA, 25 bp, Rattus norvegicus
gcgcagagtttattccacgggtttc

SEQ ID NO: 663583 - DNA, 25 bp, Rattus norvegicus
tcaacgacttcctttgaaacctcgc

SEQ ID NO: 663584 - DNA, 25 bp, Rattus norvegicus
tgaaacctcgctttttccataacaa

SEQ ID NO: 663585 - DNA, 25 bp, Rattus norvegicus
ctcgctttttccataacaaagatgg

SEQ ID NO: 663586 - DNA, 25 bp, Rattus norvegicus
ataacaaagatggagccgacgcttc

SEQ ID NO: 663587 - DNA, 25 bp, Rattus norvegicus
aagatggagccgacgcttccggttc

SEQ ID NO: 663588 - DNA, 25 bp, Rattus norvegicus
acgcttccggttccgggctcttgcg

SEQ ID NO: 663589 - DNA, 25 bp, Rattus norvegicus
tccggttccgggctcttgcggtcag

SEQ ID NO: 663590 - DNA, 25 bp, Rattus norvegicus
ttctgaggaatggttgcgggtttta

SEQ ID NO: 663591 - DNA, 25 bp, Rattus norvegicus
tttagttcagtcctggagggcgtga

SEQ ID NO: 663592 - DNA, 25 bp, Rattus norvegicus
gcgtgagaagggagcaaggaagcga

SEQ ID NO: 663593 - DNA, 25 bp, Rattus norvegicus
ggaggagcgcagagtttattccacg

SEQ ID NO: 663594 - DNA, 25 bp, Rattus norvegicus
ttgcgggttttagttcagtcctgga

SEQ ID NO: 663595 - DNA, 25 bp, Rattus norvegicus
agcgggccatgctcctcggcctcct

SEQ ID NO: 663596 - DNA, 25 bp, Rattus norvegicus
gcggcaccatgcagcgggccatgct

SEQ ID NO: 663597 - DNA, 25 bp, Rattus norvegicus
ggccacgcgcactggctgaggtacc

SEQ ID NO: 663598 - DNA, 25 bp, Rattus norvegicus
actggctgaggtaccgcccgctggc

SEQ ID NO: 663599 - DNA, 25 bp, Rattus norvegicus
gcctcggggctgctccgtgacgtca

SEQ ID NO: 663600 - DNA, 25 bp, Rattus norvegicus
ctgctccgtgacgtcagggctgagc

SEQ ID NO: 663601 - DNA, 25 bp, Rattus norvegicus
ctgcccttcataagagccaggcctg

SEQ ID NO: 663602 - DNA, 25 bp, Rattus norvegicus
ttcataagagccaggcctgcgccca

SEQ ID NO: 663603 - DNA, 25 bp, Rattus norvegicus
ggcctgcgcccaccgcgccacagct

SEQ ID NO: 663604 - DNA, 25 bp, Rattus norvegicus
agctgctctgcggagcccgcacccg

SEQ ID NO: 663605 - DNA, 25 bp, Rattus norvegicus
gagctcctcctacatgcagctggcg

SEQ ID NO: 663606 - DNA, 25 bp, Rattus norvegicus
ctcctacatgcagctggcgagcggc

SEQ ID NO: 663607 - DNA, 25 bp, Rattus norvegicus
tgcagctggcgagcggcaccatgca

SEQ ID NO: 663608 - DNA, 25 bp, Rattus norvegicus
ctggtgagtgggctttcagaacctc

SEQ ID NO: 663609 - DNA, 25 bp, Rattus norvegicus
cgggccttggatgcgcttccctgct

SEQ ID NO: 663610 - DNA, 25 bp, Rattus norvegicus
gcgaccagaggtaatgaaagctttc

SEQ ID NO: 663611 - DNA, 25 bp, Rattus norvegicus
agctgctgccttcttacgagttgcg

SEQ ID NO: 663612 - DNA, 25 bp, Rattus norvegicus
tggccaggctcgctgtcaagaatcc

SEQ ID NO: 663613 - DNA, 25 bp, Rattus norvegicus
cactctaggcgctgcagtcgcggac

SEQ ID NO: 663614 - DNA, 25 bp, Rattus norvegicus
tcttcgctggctagcctgctcgctg

SEQ ID NO: 663615 - DNA, 25 bp, Rattus norvegicus
tttggagtgagagaatgcgaccaga

SEQ ID NO: 663616 - DNA, 25 bp, Rattus norvegicus
cgctgtcaagaatccgccgtgggga

SEQ ID NO: 663617 - DNA, 25 bp, Rattus norvegicus
atgacagcacaggtgaggttggcca

SEQ ID NO: 663618 - DNA, 25 bp, Rattus norvegicus
cggcttctccgcgaatgacagcaca

SEQ ID NO: 663619 - DNA, 25 bp, Rattus norvegicus
ccgagaacttgctggacggaccgcc

SEQ ID NO: 663620 - DNA, 25 bp, Rattus norvegicus
agcaggtgaagatggccgagaactt

SEQ ID NO: 663621 - DNA, 25 bp, Rattus norvegicus
gctgtttccgcgagcaggtgaagat

SEQ ID NO: 663622 - DNA, 25 bp, Rattus norvegicus
cagtcgcggacacagctgctgcctt

SEQ ID NO: 663623 - DNA, 25 bp, Rattus norvegicus
cacgaagtcgccgtcatggatgcag

SEQ ID NO: 663624 - DNA, 25 bp, Rattus norvegicus
tccgttcttgctacagccgctagga

SEQ ID NO: 663625 - DNA, 25 bp, Rattus norvegicus
tggacgccaggcagtcttcaacctc

SEQ ID NO: 663626 - DNA, 25 bp, Rattus norvegicus
actgcgtaccgcctatggctctgtg

SEQ ID NO: 663627 - DNA, 25 bp, Rattus norvegicus
caggcgcgtggcttccttaaacaga

SEQ ID NO: 663628 - DNA, 25 bp, Rattus norvegicus
tgactctttgattggctacactttg

SEQ ID NO: 663629 - DNA, 25 bp, Rattus norvegicus
acaaccaggagggacctgcgtctcc

SEQ ID NO: 663630 - DNA, 25 bp, Rattus norvegicus
tgctccgctgctgacaactccatgg

SEQ ID NO: 663631 - DNA, 25 bp, Rattus norvegicus
taggcgcgccaaaaaagaacttcga

SEQ ID NO: 663632 - DNA, 25 bp, Rattus norvegicus
gaacttcgagcgaggtcggagttta

SEQ ID NO: 663633 - DNA, 25 bp, Rattus norvegicus
cggagtttaccctgtggtgttgtgc

SEQ ID NO: 663634 - DNA, 25 bp, Rattus norvegicus
cgggcgactccgaagacggaatgtc

SEQ ID NO: 663635 - DNA, 25 bp, Rattus norvegicus
aatgtctgcgtaaccctgcgtggga

SEQ ID NO: 663636 - DNA, 25 bp, Rattus norvegicus
agcctggcgacttccgtttatctga

SEQ ID NO: 663637 - DNA, 25 bp, Rattus norvegicus
tgccagtggcttctgagttctcgat

SEQ ID NO: 663638 - DNA, 25 bp, Rattus norvegicus
tcaggccacctgtataagcggaaag

SEQ ID NO: 663639 - DNA, 25 bp, Rattus norvegicus
ctgggtgtcgtgaaaacgtcgtgaa

SEQ ID NO: 663640 - DNA, 25 bp, Rattus norvegicus
ccttggcggttcaggccacctgtat

SEQ ID NO: 663641 - DNA, 25 bp, Rattus norvegicus
tataagcggaaagtgccagtgtgtg

SEQ ID NO: 663642 - DNA, 25 bp, Rattus norvegicus
tacggccttggaaccgctcgatttc

SEQ ID NO: 663643 - DNA, 25 bp, Rattus norvegicus
agttctcgattcttggactccgaga

SEQ ID NO: 663644 - DNA, 25 bp, Rattus norvegicus
ggactccgagaaggctgcaaggcca

SEQ ID NO: 663645 - DNA, 25 bp, Rattus norvegicus
agcgcaaccagctcggtaagtacga

SEQ ID NO: 663646 - DNA, 25 bp, Rattus norvegicus
gggctcggcgctctgtcgcgacact

SEQ ID NO: 663647 - DNA, 25 bp, Rattus norvegicus
tcgcgacactcagcccgtgttctgg

SEQ ID NO: 663648 - DNA, 25 bp, Rattus norvegicus
cccgtgttctgggaagttacgagca

SEQ ID NO: 663649 - DNA, 25 bp, Rattus norvegicus
tacgagcagccagggcgttcgatct

SEQ ID NO: 663650 - DNA, 25 bp, Rattus norvegicus
ttagtatggagctatccgtacggcc

SEQ ID NO: 663651 - DNA, 25 bp, Rattus norvegicus
cctcctgggcgatgtggcccagctt

SEQ ID NO: 663652 - DNA, 25 bp, Rattus norvegicus
ttgtggtgcagcgtgagcacgctca

SEQ ID NO: 663653 - DNA, 25 bp, Rattus norvegicus
cggagcacaggttcgctaagagcgt

SEQ ID NO: 663654 - DNA, 25 bp, Rattus norvegicus
ttcgctaagagcgtgcagcaggttg

SEQ ID NO: 663655 - DNA, 25 bp, Rattus norvegicus
tgctgccgtcccagtgcagaacgga

SEQ ID NO: 663656 - DNA, 25 bp, Rattus norvegicus
tgcagcaggttgtggctaccgtcga

SEQ ID NO: 663657 - DNA, 25 bp, Rattus norvegicus
tgaggtcgagctcatgcagcccggt

SEQ ID NO: 663658 - DNA, 25 bp, Rattus norvegicus
ctaccgtcgaggatgcgcagcgtgc

SEQ ID NO: 663659 - DNA, 25 bp, Rattus norvegicus
tccaggctgcggttcgctaggttca

SEQ ID NO: 663660 - DNA, 25 bp, Rattus norvegicus
cccagtgcagaacggagatgcggtt

SEQ ID NO: 663661 - DNA, 25 bp, Rattus norvegicus
cttgctgcaggagaggttgagaaac

SEQ ID NO: 663662 - DNA, 25 bp, Rattus norvegicus
gcaagctcaggctgctcctcgaaag

SEQ ID NO: 663663 - DNA, 25 bp, Rattus norvegicus
ggttcccggccagcgacagcaagct

SEQ ID NO: 663664 - DNA, 25 bp, Rattus norvegicus
agctctgggaagcatgcgaaggtcc

SEQ ID NO: 663665 - DNA, 25 bp, Rattus norvegicus
gagcgctcacctgctatggagaccc

SEQ ID NO: 663666 - DNA, 25 bp, Rattus norvegicus
gcacgtggacagctgcttccttaga

SEQ ID NO: 663667 - DNA, 25 bp, Rattus norvegicus
gtgcgggttccagtttggcgatcca

SEQ ID NO: 663668 - DNA, 25 bp, Rattus norvegicus
gatccagagcgctcacctgctatgg

SEQ ID NO: 663669 - DNA, 25 bp, Rattus norvegicus
gcgacagccagtgcgagctcccgga

SEQ ID NO: 663670 - DNA, 25 bp, Rattus norvegicus
gtctgcagcccgcacgtggacagct

SEQ ID NO: 663671 - DNA, 25 bp, Rattus norvegicus
tggacagctgcttccttagaggccg

SEQ ID NO: 663672 - DNA, 25 bp, Rattus norvegicus
agctgcttccttagaggccgccttg

SEQ ID NO: 663673 - DNA, 25 bp, Rattus norvegicus
tgcttccttagaggccgccttgggc

SEQ ID NO: 663674 - DNA, 25 bp, Rattus norvegicus
acggcacaagggtacagtgggtcga

SEQ ID NO: 663675 - DNA, 25 bp, Rattus norvegicus
ggacctcgcgacagccagtgcgagc

SEQ ID NO: 663676 - DNA, 25 bp, Rattus norvegicus
ccacagcgtcgcggagcaggctagc

SEQ ID NO: 663677 - DNA, 25 bp, Rattus norvegicus
ttccagtttggcgatccagagcgct

SEQ ID NO: 663678 - DNA, 25 bp, Rattus norvegicus
ccgcccagcgcccaaacacagtccg

SEQ ID NO: 663679 - DNA, 25 bp, Rattus norvegicus
gccatgtcctcggtagcggccaaag

SEQ ID NO: 663680 - DNA, 25 bp, Rattus norvegicus
tttggccacgcccatatctgtcatc

SEQ ID NO: 663681 - DNA, 25 bp, Rattus norvegicus
cacgcccatatctgtcatcctgggg

SEQ ID NO: 663682 - DNA, 25 bp, Rattus norvegicus
caactcagtcttggcgtcaggaggc

SEQ ID NO: 663683 - DNA, 25 bp, Rattus norvegicus
agccgcgctctcctacagtggctgg

SEQ ID NO: 663684 - DNA, 25 bp, Rattus norvegicus
ctctcctacagtggctggacgcgct

SEQ ID NO: 663685 - DNA, 25 bp, Rattus norvegicus
gcccgggcctaagtgtgaccctgac

SEQ ID NO: 663686 - DNA, 25 bp, Rattus norvegicus
tgaccctgaggccaagacctagcgc

SEQ ID NO: 663687 - DNA, 25 bp, Rattus norvegicus
cgctgaggagcgaggccatgtcctc

SEQ ID NO: 663688 - DNA, 25 bp, Rattus norvegicus
taagtgtgaccctgaccctgaggcc

SEQ ID NO: 663689 - DNA, 25 bp, Rattus norvegicus
ctcggtagcggccaaagtaaggtga

SEQ ID NO: 663690 - DNA, 25 bp, Rattus norvegicus
ggaggagccgccttttggccacgcc

SEQ ID NO: 663691 - DNA, 25 bp, Rattus norvegicus
tagcgcgacctcaggcaccgtacgg

SEQ ID NO: 663692 - DNA, 25 bp, Rattus norvegicus
ggccaagacctagcgcgacctcagg

SEQ ID NO: 663693 - DNA, 25 bp, Rattus norvegicus
cagaagcccagtcgctgctccaggt

SEQ ID NO: 663694 - DNA, 25 bp, Rattus norvegicus
cccaggctgccacaaaagacacttg

SEQ ID NO: 663695 - DNA, 25 bp, Rattus norvegicus
caaaagacacttggcccgagggctc

SEQ ID NO: 663696 - DNA, 25 bp, Rattus norvegicus
gctggactgtctcgagaatgagccc

SEQ ID NO: 663697 - DNA, 25 bp, Rattus norvegicus
tcgcggcccagctaacgcagaacgt

SEQ ID NO: 663698 - DNA, 25 bp, Rattus norvegicus
ccctgaggaagacgacagcagcagc

SEQ ID NO: 663699 - DNA, 25 bp, Rattus norvegicus
ccctgcttgaggctgtgtgtcagca

SEQ ID NO: 663700 - DNA, 25 bp, Rattus norvegicus
ctccaggtccctcggacagagcttt

SEQ ID NO: 663701 - DNA, 25 bp, Rattus norvegicus
ggtcacctctctgttccttggccgg

SEQ ID NO: 663702 - DNA, 25 bp, Rattus norvegicus
cacgacaccggttggagctgcgaac

SEQ ID NO: 663703 - DNA, 25 bp, Rattus norvegicus
agcacttggctggagacttcttgaa

SEQ ID NO: 663704 - DNA, 25 bp, Rattus norvegicus
gcagctcgggacgaagcctccctag

SEQ ID NO: 663705 - DNA, 25 bp, Rattus norvegicus
aacgctgggctactccgacacgaga

SEQ ID NO: 663706 - DNA, 25 bp, Rattus norvegicus
gtccggagcacagtcttaccctcaa

SEQ ID NO: 663707 - DNA, 25 bp, Rattus norvegicus
tttggcctgaagcagagacccaccc

SEQ ID NO: 663708 - DNA, 25 bp, Rattus norvegicus
ctgtccgcaggtcgaccatggtggc

SEQ ID NO: 663709 - DNA, 25 bp, Rattus norvegicus
acccgctgtcttctagtgttgctgc

SEQ ID NO: 663710 - DNA, 25 bp, Rattus norvegicus
ggcctcattccggagctgggccgca

SEQ ID NO: 663711 - DNA, 25 bp, Rattus norvegicus
ccgcaagaagttcgccggggcatcc

SEQ ID NO: 663712 - DNA, 25 bp, Rattus norvegicus
ttcggacgacgtcctcagcgagttt

SEQ ID NO: 663713 - DNA, 25 bp, Rattus norvegicus
aggctgctcagcatgtttggcctga

SEQ ID NO: 663714 - DNA, 25 bp, Rattus norvegicus
aacgtgggtgactcacgtcggccct

SEQ ID NO: 663715 - DNA, 25 bp, Rattus norvegicus
tatatgctcgacctgtaccgccggc

SEQ ID NO: 663716 - DNA, 25 bp, Rattus norvegicus
cgtgcgcagcttccatcacgaaggt

SEQ ID NO: 663717 - DNA, 25 bp, Rattus norvegicus
agactcagtgggcagcccgggcctc

SEQ ID NO: 663718 - DNA, 25 bp, Rattus norvegicus
tccgctagcacagtggacggtcctt

SEQ ID NO: 663719 - DNA, 25 bp, Rattus norvegicus
tggacggtccttcggcttctgtacc

SEQ ID NO: 663720 - DNA, 25 bp, Rattus norvegicus
agcgagtttgagttgaggctgctca

SEQ ID NO: 663721 - DNA, 25 bp, Rattus norvegicus
cctgtgagatagctcggctctctga

SEQ ID NO: 663722 - DNA, 25 bp, Rattus norvegicus
tgcagtttcccaaggcaacggcccg

SEQ ID NO: 663723 - DNA, 25 bp, Rattus norvegicus
gttgccaaagcaaccgcctgcagtt

SEQ ID NO: 663724 - DNA, 25 bp, Rattus norvegicus
ggagaggccaactcgcctcagcgtc

SEQ ID NO: 663725 - DNA, 25 bp, Rattus norvegicus
ggagcagtggctgggtttctcaccc

SEQ ID NO: 663726 - DNA, 25 bp, Rattus norvegicus
gggacgcagaaaccgcctgtcatgg

SEQ ID NO: 663727 - DNA, 25 bp, Rattus norvegicus
cggccaggaataccgggacgcagaa

SEQ ID NO: 663728 - DNA, 25 bp, Rattus norvegicus
gtcatgggctgcacacggctctcct

SEQ ID NO: 663729 - DNA, 25 bp, Rattus norvegicus
ccatcaccagcgtccagttggaggc

SEQ ID NO: 663730 - DNA, 25 bp, Rattus norvegicus
tggggacactcacaatttcagcatc

SEQ ID NO: 663731 - DNA, 25 bp, Rattus norvegicus
tcacggcccggttctaggtcaggta

SEQ ID NO: 663732 - DNA, 25 bp, Rattus norvegicus
atgctcattgccaaggccgcagccg

SEQ ID NO: 663733 - DNA, 25 bp, Rattus norvegicus
ggcaggcaatgtgcgcatgctcatt

SEQ ID NO: 663734 - DNA, 25 bp, Rattus norvegicus
agcaaccgccttcacagaggtctga

SEQ ID NO: 663735 - DNA, 25 bp, Rattus norvegicus
gcggctcgcactgccgggctctgct

SEQ ID NO: 663736 - DNA, 25 bp, Rattus norvegicus
aggtgccgctgcgttcccgcttgct

SEQ ID NO: 663737 - DNA, 25 bp, Rattus norvegicus
tgcgttcccgcttgctgtcgctgac

SEQ ID NO: 663738 - DNA, 25 bp, Rattus norvegicus
tgctgtcgctgacccagcgcgcaaa

SEQ ID NO: 663739 - DNA, 25 bp, Rattus norvegicus
gtcgctgacccagcgcgcaaagttg

SEQ ID NO: 663740 - DNA, 25 bp, Rattus norvegicus
tgacccagcgcgcaaagttgggcag

SEQ ID NO: 663741 - DNA, 25 bp, Rattus norvegicus
agcgcgcaaagttgggcagggagct

SEQ ID NO: 663742 - DNA, 25 bp, Rattus norvegicus
gaccggagcgtgtcactcgcgcgct

SEQ ID NO: 663743 - DNA, 25 bp, Rattus norvegicus
ctctgtgcacagaggatgtgctgaa

SEQ ID NO: 663744 - DNA, 25 bp, Rattus norvegicus
ctgtgcacagaggatgtgctgaatg

SEQ ID NO: 663745 - DNA, 25 bp, Rattus norvegicus
aggatgtgctgaatggtgcgcttcc

SEQ ID NO: 663746 - DNA, 25 bp, Rattus norvegicus
atgtgctgaatggtgcgcttccagg

SEQ ID NO: 663747 - DNA, 25 bp, Rattus norvegicus
cggcggccgagcaggatcaggcggc

SEQ ID NO: 663748 - DNA, 25 bp, Rattus norvegicus
tgtgctgaatggtgcgcttccaggc

SEQ ID NO: 663749 - DNA, 25 bp, Rattus norvegicus
atggcaggctgctgtgccttcgcgt

SEQ ID NO: 663750 - DNA, 25 bp, Rattus norvegicus
gcacaggttgctagctgcctgggta

SEQ ID NO: 663751 - DNA, 25 bp, Rattus norvegicus
caaattcgtcaagtgggatgatgta

SEQ ID NO: 663752 - DNA, 25 bp, Rattus norvegicus
cctcaagaagggcaccaaattcgtc

SEQ ID NO: 663753 - DNA, 25 bp, Rattus norvegicus
tgtgcgtgtccgacagcctcaagaa

SEQ ID NO: 663754 - DNA, 25 bp, Rattus norvegicus
caactcaagcccgtgtgcgtgtccg

SEQ ID NO: 663755 - DNA, 25 bp, Rattus norvegicus
acgccttgcaactcaagcccgtgtg

SEQ ID NO: 663756 - DNA, 25 bp, Rattus norvegicus
tcagcccggagtgcacgccttgcaa

SEQ ID NO: 663757 - DNA, 25 bp, Rattus norvegicus
agcccagatggctggggctcagccc

SEQ ID NO: 663758 - DNA, 25 bp, Rattus norvegicus
tgaaccgagagccaagcccgcttgc

SEQ ID NO: 663759 - DNA, 25 bp, Rattus norvegicus
gagcctgctgaaccgagagccaagc

SEQ ID NO: 663760 - DNA, 25 bp, Rattus norvegicus
agcggaggcaagagcctgctgaacc

SEQ ID NO: 663761 - DNA, 25 bp, Rattus norvegicus
ccttcgcgtgtagtcccgcttacta

SEQ ID NO: 663762 - DNA, 25 bp, Rattus norvegicus
gtcccgcttactaagcggcgcgggc

SEQ ID NO: 663763 - DNA, 25 bp, Rattus norvegicus
gcgggatttcggttcggctttatca

SEQ ID NO: 663764 - DNA, 25 bp, Rattus norvegicus
agaagaaggatgactgcgcctcgta

SEQ ID NO: 663765 - DNA, 25 bp, Rattus norvegicus
gcgcctcgtagtttctgatccggaa

SEQ ID NO: 663766 - DNA, 25 bp, Rattus norvegicus
ctgatccggaaatagtttttcagca

SEQ ID NO: 663767 - DNA, 25 bp, Rattus norvegicus
cgcgcgcgaagcgtgttctttgtac

SEQ ID NO: 663768 - DNA, 25 bp, Rattus norvegicus
tctttgtacgggagtggagaactac

SEQ ID NO: 663769 - DNA, 25 bp, Rattus norvegicus
taaggagcccgcctctaaaagagaa

SEQ ID NO: 663770 - DNA, 25 bp, Rattus norvegicus
aagaagctgagctgtggaaaacctc

SEQ ID NO: 663771 - DNA, 25 bp, Rattus norvegicus
tgtggaaaacctcggcttgggctcc

SEQ ID NO: 663772 - DNA, 25 bp, Rattus norvegicus
gctttggctcacttacccgctcaga

SEQ ID NO: 663773 - DNA, 25 bp, Rattus norvegicus
ttccggtccggctcctctaaggagc

SEQ ID NO: 663774 - DNA, 25 bp, Rattus norvegicus
ttaggcaaccgggaggatcctcgcg

SEQ ID NO: 663775 - DNA, 25 bp, Rattus norvegicus
cggctttatcagttcgggctctgtg

SEQ ID NO: 663776 - DNA, 25 bp, Rattus norvegicus
ggcttctccggatcgcaggatcctg

SEQ ID NO: 663777 - DNA, 25 bp, Rattus norvegicus
ctcctgtgtagggtctccacaaagg

SEQ ID NO: 663778 - DNA, 25 bp, Rattus norvegicus
tcagcaggacttagggcacccggat

SEQ ID NO: 663779 - DNA, 25 bp, Rattus norvegicus
cggcctcagcaggacttagggcacc

SEQ ID NO: 663780 - DNA, 25 bp, Rattus norvegicus
gccaggcggcctcagcaggacttag

SEQ ID NO: 663781 - DNA, 25 bp, Rattus norvegicus
gatgcacacggccaggcggcctcag

SEQ ID NO: 663782 - DNA, 25 bp, Rattus norvegicus
tgtagggtctccacaaagggtgccg

SEQ ID NO: 663783 - DNA, 25 bp, Rattus norvegicus
caggacttagggcacccggatgtcg

SEQ ID NO: 663784 - DNA, 25 bp, Rattus norvegicus
gcgactcctgtgtagggtctccaca

SEQ ID NO: 663785 - DNA, 25 bp, Rattus norvegicus
agttccggagcgactcctgtgtagg

SEQ ID NO: 663786 - DNA, 25 bp, Rattus norvegicus
tggcctctgtaggaggaagccctcg

SEQ ID NO: 663787 - DNA, 25 bp, Rattus norvegicus
aggaaaccgagtggcctctgtagga

SEQ ID NO: 663788 - DNA, 25 bp, Rattus norvegicus
caggtgccacgtctccgggttttgg

SEQ ID NO: 663789 - DNA, 25 bp, Rattus norvegicus
cagtgcgcaggtgccacgtctccgg

SEQ ID NO: 663790 - DNA, 25 bp, Rattus norvegicus
caaagggtgccgctggatgcacacg

SEQ ID NO: 663791 - DNA, 25 bp, Rattus norvegicus
ctacccaacaatcatctgctactgg

SEQ ID NO: 663792 - DNA, 25 bp, Rattus norvegicus
gcgctagaaatagctcggctcgacg

SEQ ID NO: 663793 - DNA, 25 bp, Rattus norvegicus
ttctgcgctagaaatagctcggctc

SEQ ID NO: 663794 - DNA, 25 bp, Rattus norvegicus
cgttcaccctcttctgcgctagaaa

SEQ ID NO: 663795 - DNA, 25 bp, Rattus norvegicus
ggacgttcaccctcttctgcgctag

SEQ ID NO: 663796 - DNA, 25 bp, Rattus norvegicus
tttcctctgcctacccggacgttca

SEQ ID NO: 663797 - DNA, 25 bp, Rattus norvegicus
caatcatctgctactgggtttcctc

SEQ ID NO: 663798 - DNA, 25 bp, Rattus norvegicus
taggagaaggcgctttgggtcccgc

SEQ ID NO: 663799 - DNA, 25 bp, Rattus norvegicus
cgcctcgaagtgacaggtaggagaa

SEQ ID NO: 663800 - DNA, 25 bp, Rattus norvegicus
gcgactcgcctcgaagtgacaggta

SEQ ID NO: 663801 - DNA, 25 bp, Rattus norvegicus
ccagcagcgactcgcctcgaagtga

SEQ ID NO: 663802 - DNA, 25 bp, Rattus norvegicus
cgcaaacaggctctcacaggcgcgc

SEQ ID NO: 663803 - DNA, 25 bp, Rattus norvegicus
ggctaaggagccgcgccgcaaacag

SEQ ID NO: 663804 - DNA, 25 bp, Rattus norvegicus
tgctactgggtttcctctgcctacc

SEQ ID NO: 663805 - DNA, 25 bp, Rattus norvegicus
ggagcgcccaaacctgcaagctaga

SEQ ID NO: 663806 - DNA, 25 bp, Rattus norvegicus
ctctttgtaaaggtaattcggtgcg

SEQ ID NO: 663807 - DNA, 25 bp, Rattus norvegicus
gcgggcacaggagcgcccaaacctg

SEQ ID NO: 663808 - DNA, 25 bp, Rattus norvegicus
aacctgcaagctagagtttggacgc

SEQ ID NO: 663809 - DNA, 25 bp, Rattus norvegicus
agtttggacgcgcatcccttcccgg

SEQ ID NO: 663810 - DNA, 25 bp, Rattus norvegicus
ggcgtgtgtgttcccagctgatcac

SEQ ID NO: 663811 - DNA, 25 bp, Rattus norvegicus
gtgttcccagctgatcacagagcag

SEQ ID NO: 663812 - DNA, 25 bp, Rattus norvegicus
tcacagagcaggctgagatctcctt

SEQ ID NO: 663813 - DNA, 25 bp, Rattus norvegicus
agatctccttgacccggggagctga

SEQ ID NO: 663814 - DNA, 25 bp, Rattus norvegicus
aagggccgctgtggtcacaacgagt

SEQ ID NO: 663815 - DNA, 25 bp, Rattus norvegicus
acaacgagtcggagctgcaggtgtt

SEQ ID NO: 663816 - DNA, 25 bp, Rattus norvegicus
gttctgggtagatcgcgcctacaca

SEQ ID NO: 663817 - DNA, 25 bp, Rattus norvegicus
gcgcctacacactcaaaatgctctt

SEQ ID NO: 663818 - DNA, 25 bp, Rattus norvegicus
gaatctacccgcatgttcctggacc

SEQ ID NO: 663819 - DNA, 25 bp, Rattus norvegicus
ggtacctcatctgcttttccgctgc

SEQ ID NO: 663820 - DNA, 25 bp, Rattus norvegicus
tacatctgttctatcgctccgagcg

SEQ ID NO: 663821 - DNA, 25 bp, Rattus norvegicus
ttctatcgctccgagcgccatgttc

SEQ ID NO: 663822 - DNA, 25 bp, Rattus norvegicus
gcgccatgttcctgctctccactgg

SEQ ID NO: 663823 - DNA, 25 bp, Rattus norvegicus
tctccactggcgcacgctggggaac

SEQ ID NO: 663824 - DNA, 25 bp, Rattus norvegicus
ctggcgcacgctggggaactactac

SEQ ID NO: 663825 - DNA, 25 bp, Rattus norvegicus
ttccgctgctgctacatctgttcta

SEQ ID NO: 663826 - DNA, 25 bp, Rattus norvegicus
agtcgcggtacctcatctgcttttc

SEQ ID NO: 663827 - DNA, 25 bp, Rattus norvegicus
ctgtcagcagtgaagtcgcggtacc

SEQ ID NO: 663828 - DNA, 25 bp, Rattus norvegicus
ctgcctacctggtggctggctgtca

SEQ ID NO: 663829 - DNA, 25 bp, Rattus norvegicus
cggtgcgcctgcctacctggtggct

SEQ ID NO: 663830 - DNA, 25 bp, Rattus norvegicus
gcaagcaccccttttggagccgcta

SEQ ID NO: 663831 - DNA, 25 bp, Rattus norvegicus
ctcatctgcttttccgctgctgcta

SEQ ID NO: 663832 - DNA, 25 bp, Rattus norvegicus
gcagccctgcgcatcttggcaagca

SEQ ID NO: 663833 - DNA, 25 bp, Rattus norvegicus
tggagcctcaactcccgccctggca

SEQ ID NO: 663834 - DNA, 25 bp, Rattus norvegicus
ctgtgtccccggtgccgcagtgagc

SEQ ID NO: 663835 - DNA, 25 bp, Rattus norvegicus
gctttcccaacagtctgtgcgcatt

SEQ ID NO: 663836 - DNA, 25 bp, Rattus norvegicus
agtctgtgcgcatttccgcggggcc

SEQ ID NO: 663837 - DNA, 25 bp, Rattus norvegicus
atagccgccactgcggacaaaaagt

SEQ ID NO: 663838 - DNA, 25 bp, Rattus norvegicus
gggtggcacagtccgggcaagccgg

SEQ ID NO: 663839 - DNA, 25 bp, Rattus norvegicus
ctcatagccgccactgcggacaaaa

SEQ ID NO: 663840 - DNA, 25 bp, Rattus norvegicus
ggcggcctcctgagtcactgcggat

SEQ ID NO: 663841 - DNA, 25 bp, Rattus norvegicus
cctcctgagtcactgcggatgcggg

SEQ ID NO: 663842 - DNA, 25 bp, Rattus norvegicus
cggggcactggagcctcaactcccg

SEQ ID NO: 663843 - DNA, 25 bp, Rattus norvegicus
tcaactcccgccctggcaagcggcg

SEQ ID NO: 663844 - DNA, 25 bp, Rattus norvegicus
tcccaacagtctgtgcgcatttccg

SEQ ID NO: 663845 - DNA, 25 bp, Rattus norvegicus
ccaacagtctgtgcgcatttccgcg

SEQ ID NO: 663846 - DNA, 25 bp, Rattus norvegicus
ccgccactgcggacaaaaagtgggg

SEQ ID NO: 663847 - DNA, 25 bp, Rattus norvegicus
tccacacggagaggcacatcaacac

SEQ ID NO: 663848 - DNA, 25 bp, Rattus norvegicus
tccacacggagaggcacatcagtac

SEQ ID NO: 663849 - DNA, 25 bp, Rattus norvegicus
cagtaccgccatccacacggagagg

SEQ ID NO: 663850 - DNA, 25 bp, Rattus norvegicus
acatggagaggcacatcagtaccgc

SEQ ID NO: 663851 - DNA, 25 bp, Rattus norvegicus
tcagtaccgccatccacatggagag

SEQ ID NO: 663852 - DNA, 25 bp, Rattus norvegicus
acacggagaggcacatcagtaccgc

SEQ ID NO: 663853 - DNA, 25 bp, Rattus norvegicus
cacggagaggcacatcagtaccgcc

SEQ ID NO: 663854 - DNA, 25 bp, Rattus norvegicus
caacactgccatccacacggagagg

SEQ ID NO: 663855 - DNA, 25 bp, Rattus norvegicus
ggagaggcacatcaacactgccatc

SEQ ID NO: 663856 - DNA, 25 bp, Rattus norvegicus
tcagtaccgccatccacacggagag

SEQ ID NO: 663857 - DNA, 25 bp, Rattus norvegicus
atcagtaccgccatccacacggaga

SEQ ID NO: 663858 - DNA, 25 bp, Rattus norvegicus
ggagaggcacatcagtaccgccatc

SEQ ID NO: 663859 - DNA, 25 bp, Rattus norvegicus
acacggagaggcacatcaacaccgc

SEQ ID NO: 663860 - DNA, 25 bp, Rattus norvegicus
acggagaggcacatcagtaccgcca

SEQ ID NO: 663861 - DNA, 25 bp, Rattus norvegicus
acctggacgccagccggagataacc

SEQ ID NO: 663862 - DNA, 25 bp, Rattus norvegicus
tcccggggaagtttgcaaacacagc

SEQ ID NO: 663863 - DNA, 25 bp, Rattus norvegicus
ggaaccgctgggagcaaggcagcca

SEQ ID NO: 663864 - DNA, 25 bp, Rattus norvegicus
gtacgccggcctcaagcatatccga

SEQ ID NO: 663865 - DNA, 25 bp, Rattus norvegicus
ttcccagactaaaacctggacgcca

SEQ ID NO: 663866 - DNA, 25 bp, Rattus norvegicus
tgcaaacacagctgttccagaactg

SEQ ID NO: 663867 - DNA, 25 bp, Rattus norvegicus
ctaagcctttatacggcgcgggaag

SEQ ID NO: 663868 - DNA, 25 bp, Rattus norvegicus
gcgggctgtctcttctaagccttta

SEQ ID NO: 663869 - DNA, 25 bp, Rattus norvegicus
caaacactacttagagcgggctgtc

SEQ ID NO: 663870 - DNA, 25 bp, Rattus norvegicus
gttgcacccgcaaacactacttaga

SEQ ID NO: 663871 - DNA, 25 bp, Rattus norvegicus
gagcacgcagttgcacccgcaaaca

SEQ ID NO: 663872 - DNA, 25 bp, Rattus norvegicus
agatgtgggagcacgcagttgcacc

SEQ ID NO: 663873 - DNA, 25 bp, Rattus norvegicus
tcaagcatatccgagggccaagggg

SEQ ID NO: 663874 - DNA, 25 bp, Rattus norvegicus
ctgttccagaactggggaaccgctg

SEQ ID NO: 663875 - DNA, 25 bp, Rattus norvegicus
tctgatcgcttctttgaggcgctcc

SEQ ID NO: 663876 - DNA, 25 bp, Rattus norvegicus
ttaatattcataaggggcgtggcgc

SEQ ID NO: 663877 - DNA, 25 bp, Rattus norvegicus
cctctcgggtgaagagtcagggtca

SEQ ID NO: 663878 - DNA, 25 bp, Rattus norvegicus
cagggtcagggagccttgtactcaa

SEQ ID NO: 663879 - DNA, 25 bp, Rattus norvegicus
agagactcctaccttggctcgcagg

SEQ ID NO: 663880 - DNA, 25 bp, Rattus norvegicus
cggctctaatatactccgtggattg

SEQ ID NO: 663881 - DNA, 25 bp, Rattus norvegicus
ttggagcatgcacgactggaaaaca

SEQ ID NO: 663882 - DNA, 25 bp, Rattus norvegicus
aagccctttcaagagccgcgcgttc

SEQ ID NO: 663883 - DNA, 25 bp, Rattus norvegicus
cgcgcgttccagaaggcaaagagcc

SEQ ID NO: 663884 - DNA, 25 bp, Rattus norvegicus
gcccggcctccttttattattctga

SEQ ID NO: 663885 - DNA, 25 bp, Rattus norvegicus
gcgcagccttttattccctttcgga

SEQ ID NO: 663886 - DNA, 25 bp, Rattus norvegicus
tcaacacgcggaacaaggcgcatgc

SEQ ID NO: 663887 - DNA, 25 bp, Rattus norvegicus
cgccggctgcaggtaacacaatgac

SEQ ID NO: 663888 - DNA, 25 bp, Rattus norvegicus
ggcgcatgcgcgattgttaatattc

SEQ ID NO: 663889 - DNA, 25 bp, Rattus norvegicus
gggcccgagcaaacttctcccaaga

SEQ ID NO: 663890 - DNA, 25 bp, Rattus norvegicus
ccacgccctgccttttcgcccggat

SEQ ID NO: 663891 - DNA, 25 bp, Rattus norvegicus
caagaaacttattggggcgtggccg

SEQ ID NO: 663892 - DNA, 25 bp, Rattus norvegicus
gagcaaacttctcccaagaaactta

SEQ ID NO: 663893 - DNA, 25 bp, Rattus norvegicus
ccactactcgcagggcccgggaagg

SEQ ID NO: 663894 - DNA, 25 bp, Rattus norvegicus
gctctggatccctgagttcccggac

SEQ ID NO: 663895 - DNA, 25 bp, Rattus norvegicus
gcgagagcgtccatagccacgccga

SEQ ID NO: 663896 - DNA, 25 bp, Rattus norvegicus
tagccacgccgaacgctgacggtga

SEQ ID NO: 663897 - DNA, 25 bp, Rattus norvegicus
cacaagacgatgcaagcctggccgc

SEQ ID NO: 663898 - DNA, 25 bp, Rattus norvegicus
acgatgcaagcctggccgcgactgg

SEQ ID NO: 663899 - DNA, 25 bp, Rattus norvegicus
acctgcacggtgcacagccgagtcg

SEQ ID NO: 663900 - DNA, 25 bp, Rattus norvegicus
ccgagcgcaccgagagcacctaggg

SEQ ID NO: 663901 - DNA, 25 bp, Rattus norvegicus
cgagagcacctaggggcccgagcaa

SEQ ID NO: 663902 - DNA, 25 bp, Rattus norvegicus
tggggattctgaggacccacgccct

SEQ ID NO: 663903 - DNA, 25 bp, Rattus norvegicus
agggttagtccctttgccacagcga

SEQ ID NO: 663904 - DNA, 25 bp, Rattus norvegicus
ctccctgcacgaagggtggaccctg

SEQ ID NO: 663905 - DNA, 25 bp, Rattus norvegicus
gcggccacatctggggagcccatgt

SEQ ID NO: 663906 - DNA, 25 bp, Rattus norvegicus
tgacaaccttggtgacccggagcca

SEQ ID NO: 663907 - DNA, 25 bp, Rattus norvegicus
agcgcgctcttagcacagcggagaa

SEQ ID NO: 663908 - DNA, 25 bp, Rattus norvegicus
cttttctcaggtggcctaggcgacc

SEQ ID NO: 663909 - DNA, 25 bp, Rattus norvegicus
gacacctggtttgtttggcctctcc

SEQ ID NO: 663910 - DNA, 25 bp, Rattus norvegicus
taaactcgctgctcaaggtcagggc

SEQ ID NO: 663911 - DNA, 25 bp, Rattus norvegicus
ttcgggaccgacagacaccgtgtca

SEQ ID NO: 663912 - DNA, 25 bp, Rattus norvegicus
cagctagtgtcaagacccttcggga

SEQ ID NO: 663913 - DNA, 25 bp, Rattus norvegicus
gacgcgcgcgaactgaatccaactc

SEQ ID NO: 663914 - DNA, 25 bp, Rattus norvegicus
cgacacctgcgcacttaagtagacg

SEQ ID NO: 663915 - DNA, 25 bp, Rattus norvegicus
gcagcgcacaccgtgtcccttgttg

SEQ ID NO: 663916 - DNA, 25 bp, Rattus norvegicus
tcccagttatcctcaaacggtgaca

SEQ ID NO: 663917 - DNA, 25 bp, Rattus norvegicus
cagcaggggactcttaggcaaggac

SEQ ID NO: 663918 - DNA, 25 bp, Rattus norvegicus
ctggagcgctcatccctggtgtctt

SEQ ID NO: 663919 - DNA, 25 bp, Rattus norvegicus
aggcctgtctgcagcactgcctgac

SEQ ID NO: 663920 - DNA, 25 bp, Rattus norvegicus
aggcttccgacacactgcctgagtg

SEQ ID NO: 663921 - DNA, 25 bp, Rattus norvegicus
ccctggtgtcttcctagccggggat

SEQ ID NO: 663922 - DNA, 25 bp, Rattus norvegicus
cgtggatcctgcttaggcctcaggg

SEQ ID NO: 663923 - DNA, 25 bp, Rattus norvegicus
tgagtcacggcgtggatcctgctta

SEQ ID NO: 663924 - DNA, 25 bp, Rattus norvegicus
tggaggtggactacagcgccacagt

SEQ ID NO: 663925 - DNA, 25 bp, Rattus norvegicus
ctcttaggcaaggaccatggcggac

SEQ ID NO: 663926 - DNA, 25 bp, Rattus norvegicus
cacactgcctgagtggatccgcagg

SEQ ID NO: 663927 - DNA, 25 bp, Rattus norvegicus
gggtcctagccgcaggcttccgaca

SEQ ID NO: 663928 - DNA, 25 bp, Rattus norvegicus
cagagggcctcacggggtcctagcc

SEQ ID NO: 663929 - DNA, 25 bp, Rattus norvegicus
cactgcctgactggcgaccagagca

SEQ ID NO: 663930 - DNA, 25 bp, Rattus norvegicus
atggacctgcttgagtgggagaccc

SEQ ID NO: 663931 - DNA, 25 bp, Rattus norvegicus
cgtcatttccgtaggcgctgtagga

SEQ ID NO: 663932 - DNA, 25 bp, Rattus norvegicus
atcgtgctgagctgcaagcctccct

SEQ ID NO: 663933 - DNA, 25 bp, Rattus norvegicus
cagtgggtggttgctgacacctcag

SEQ ID NO: 663934 - DNA, 25 bp, Rattus norvegicus
cacttccaggtgcacgtgatgcggg

SEQ ID NO: 663935 - DNA, 25 bp, Rattus norvegicus
cgactcggggcgaactacgtcattt

SEQ ID NO: 663936 - DNA, 25 bp, Rattus norvegicus
ttttgccacatcatgcgactcgggg

SEQ ID NO: 663937 - DNA, 25 bp, Rattus norvegicus
cgagggactactttttctagactca

SEQ ID NO: 663938 - DNA, 25 bp, Rattus norvegicus
cggatcgctcttcgctgatgcggca

SEQ ID NO: 663939 - DNA, 25 bp, Rattus norvegicus
aattcagggacgcagtgcgcggatc

SEQ ID NO: 663940 - DNA, 25 bp, Rattus norvegicus
tgtccgccttatgtagccttccacg

SEQ ID NO: 663941 - DNA, 25 bp, Rattus norvegicus
agactccggaaacggctgagccctg

SEQ ID NO: 663942 - DNA, 25 bp, Rattus norvegicus
cggaaccgggagcagcgcagactcc

SEQ ID NO: 663943 - DNA, 25 bp, Rattus norvegicus
aactggcaggcagacgagagagctt

SEQ ID NO: 663944 - DNA, 25 bp, Rattus norvegicus
acaccgagtgcctgaggagaaggcc

SEQ ID NO: 663945 - DNA, 25 bp, Rattus norvegicus
ttctctgtgacacatcccggagccg

SEQ ID NO: 663946 - DNA, 25 bp, Rattus norvegicus
tttcattggttgacgtgcacaagtg

SEQ ID NO: 663947 - DNA, 25 bp, Rattus norvegicus
acgtgcacaagtggccggaagtaga

SEQ ID NO: 663948 - DNA, 25 bp, Rattus norvegicus
ttacacaggaagtagtcgctcgccc

SEQ ID NO: 663949 - DNA, 25 bp, Rattus norvegicus
tccctgtagcctgggactgaacagc

SEQ ID NO: 663950 - DNA, 25 bp, Rattus norvegicus
ctgtgccttagtcgcctaggctgta

SEQ ID NO: 663951 - DNA, 25 bp, Rattus norvegicus
cgggagtggcgtaaagccttttcat

SEQ ID NO: 663952 - DNA, 25 bp, Rattus norvegicus
gtcagcgcagagcactcattacaca

SEQ ID NO: 663953 - DNA, 25 bp, Rattus norvegicus
cgggaccatacggagaccgaggcta

SEQ ID NO: 663954 - DNA, 25 bp, Rattus norvegicus
tgaccgcgattcaggacccgggaat

SEQ ID NO: 663955 - DNA, 25 bp, Rattus norvegicus
agccaaggaaactggcgggcccacg

SEQ ID NO: 663956 - DNA, 25 bp, Rattus norvegicus
gctacgagaactccacagccaagga

SEQ ID NO: 663957 - DNA, 25 bp, Rattus norvegicus
gcgcgcgaagcgctacgagaactcc

SEQ ID NO: 663958 - DNA, 25 bp, Rattus norvegicus
aggctgtagccgctcgttaagtgtc

SEQ ID NO: 663959 - DNA, 25 bp, Rattus norvegicus
cccgcctccgtcgtgaagcgacctc

SEQ ID NO: 663960 - DNA, 25 bp, Rattus norvegicus
tgccttggctagaacgcggagagcg

SEQ ID NO: 663961 - DNA, 25 bp, Rattus norvegicus
gcgtgccttggctagaacgcggaga

SEQ ID NO: 663962 - DNA, 25 bp, Rattus norvegicus
tccgggcgtgccttggctagaacgc

SEQ ID NO: 663963 - DNA, 25 bp, Rattus norvegicus
aagtccgggcgtgccttggctagaa

SEQ ID NO: 663964 - DNA, 25 bp, Rattus norvegicus
cctgcgccctgaggctgaagtccgg

SEQ ID NO: 663965 - DNA, 25 bp, Rattus norvegicus
gcctgcgccctgaggctgaagtccg

SEQ ID NO: 663966 - DNA, 25 bp, Rattus norvegicus
tgcgcctgcgccctgaggctgaagt

SEQ ID NO: 663967 - DNA, 25 bp, Rattus norvegicus
cggcgtcgagcccaagcctgcgcct

SEQ ID NO: 663968 - DNA, 25 bp, Rattus norvegicus
aacgtcctcggcgtcgagcccaagc

SEQ ID NO: 663969 - DNA, 25 bp, Rattus norvegicus
gtgaagcgacctcccggctcctcgg

SEQ ID NO: 663970 - DNA, 25 bp, Rattus norvegicus
cgtcgtgaagcgacctcccggctcc

SEQ ID NO: 663971 - DNA, 25 bp, Rattus norvegicus
cggcgctgcctagctgccgggaggc

SEQ ID NO: 663972 - DNA, 25 bp, Rattus norvegicus
gcctccgtcgtgaagcgacctcccg

SEQ ID NO: 663973 - DNA, 25 bp, Rattus norvegicus
actcacctgcgattcatgggccgga

SEQ ID NO: 663974 - DNA, 25 bp, Rattus norvegicus
cgcgttctgggataggaactgtaca

SEQ ID NO: 663975 - DNA, 25 bp, Rattus norvegicus
ataggaactgtacatggaaatcgcc

SEQ ID NO: 663976 - DNA, 25 bp, Rattus norvegicus
acggccaaggctactggcactgcca

SEQ ID NO: 663977 - DNA, 25 bp, Rattus norvegicus
ttaaatccagattggcctatgagcg

SEQ ID NO: 663978 - DNA, 25 bp, Rattus norvegicus
agattggcctatgagcggagctgcc

SEQ ID NO: 663979 - DNA, 25 bp, Rattus norvegicus
ttcatgggccggactctcacggcca

SEQ ID NO: 663980 - DNA, 25 bp, Rattus norvegicus
gatgccatagctcatcacggcccgg

SEQ ID NO: 663981 - DNA, 25 bp, Rattus norvegicus
acctggagttgctaggcggccacac

SEQ ID NO: 663982 - DNA, 25 bp, Rattus norvegicus
gcaccggggtttggcagctgcctac

SEQ ID NO: 663983 - DNA, 25 bp, Rattus norvegicus
cggaagtctgggcaccgcctctttg

SEQ ID NO: 663984 - DNA, 25 bp, Rattus norvegicus
tgggcaccgcctctttggtggccac

SEQ ID NO: 663985 - DNA, 25 bp, Rattus norvegicus
caagcttcgcgttctgggataggaa

SEQ ID NO: 663986 - DNA, 25 bp, Rattus norvegicus
acggccaccttgaccgatgccatag

SEQ ID NO: 663987 - DNA, 25 bp, Rattus norvegicus
cgaccctggcgaggagatctcgatt

SEQ ID NO: 663988 - DNA, 25 bp, Rattus norvegicus
gggaatgcgcatgcgcagaaagatt

SEQ ID NO: 663989 - DNA, 25 bp, Rattus norvegicus
ccggcgtcgtatcctgttctctgcg

SEQ ID NO: 663990 - DNA, 25 bp, Rattus norvegicus
cctttggtgggatctgtcccgtccg

SEQ ID NO: 663991 - DNA, 25 bp, Rattus norvegicus
cttgctgtggctggtctcggccttt

SEQ ID NO: 663992 - DNA, 25 bp, Rattus norvegicus
cagaaagattctgccgctggcgacc

SEQ ID NO: 663993 - DNA, 25 bp, Rattus norvegicus
tttgccggggtcttccttgctgtgg

SEQ ID NO: 663994 - DNA, 25 bp, Rattus norvegicus
gctttagcttcaagcggaccgcgcc

SEQ ID NO: 663995 - DNA, 25 bp, Rattus norvegicus
tgggagcctcttccggctttagctt

SEQ ID NO: 663996 - DNA, 25 bp, Rattus norvegicus
cgacttatctgagttcgattgagga

SEQ ID NO: 663997 - DNA, 25 bp, Rattus norvegicus
gtgctcggctcttcgacttatctga

SEQ ID NO: 663998 - DNA, 25 bp, Rattus norvegicus
cgattgaatcggtgctcggctcttc

SEQ ID NO: 663999 - DNA, 25 bp, Rattus norvegicus
ctggcgaggagatctcgattgaatc

SEQ ID NO: 664000 - DNA, 25 bp, Rattus norvegicus
taaggcccggcgtcgtatcctgttc

SEQ ID NO: 664001 - DNA, 25 bp, Rattus norvegicus
gcagatttccacaaacaatgacatc

SEQ ID NO: 664002 - DNA, 25 bp, Rattus norvegicus
tctgtcctccattggccgctggcgg

SEQ ID NO: 664003 - DNA, 25 bp, Rattus norvegicus
gcccgccgatcctctgtcctccatt

SEQ ID NO: 664004 - DNA, 25 bp, Rattus norvegicus
gacccgggcagctatctgggcaggg

SEQ ID NO: 664005 - DNA, 25 bp, Rattus norvegicus
acaatgacatcaccgggcgcctgcg

SEQ ID NO: 664006 - DNA, 25 bp, Rattus norvegicus
ttccacaaacaatgacatcaccggg

SEQ ID NO: 664007 - DNA, 25 bp, Rattus norvegicus
ccggagctgtgcagatttccacaaa

SEQ ID NO: 664008 - DNA, 25 bp, Rattus norvegicus
cttcccggagctgtgcagatttcca

SEQ ID NO: 664009 - DNA, 25 bp, Rattus norvegicus
tcccttcccggagctgtgcagattt

SEQ ID NO: 664010 - DNA, 25 bp, Rattus norvegicus
aagcggcacgcacggtaattccctt

SEQ ID NO: 664011 - DNA, 25 bp, Rattus norvegicus
tctgaagcggcacgcacggtaattc

SEQ ID NO: 664012 - DNA, 25 bp, Rattus norvegicus
cctctgaagcggcacgcacggtaat

SEQ ID NO: 664013 - DNA, 25 bp, Rattus norvegicus
gctgtgcagatttccacaaacaatg

SEQ ID NO: 664014 - DNA, 25 bp, Rattus norvegicus
aaacaatgacatcaccgggcgcctg

SEQ ID NO: 664015 - DNA, 25 bp, Rattus norvegicus
ccaacaatggggagccacggctgct

SEQ ID NO: 664016 - DNA, 25 bp, Rattus norvegicus
ggattagccgtccatacagctcccg

SEQ ID NO: 664017 - DNA, 25 bp, Rattus norvegicus
cacggctgctttgtgtgcgggatta

SEQ ID NO: 664018 - DNA, 25 bp, Rattus norvegicus
agagcgggtcagcagacgtgctctc

SEQ ID NO: 664019 - DNA, 25 bp, Rattus norvegicus
cgcgcctgctaaataacccggcggg

SEQ ID NO: 664020 - DNA, 25 bp, Rattus norvegicus
ctgcggcggtacatggctcccggaa

SEQ ID NO: 664021 - DNA, 25 bp, Rattus norvegicus
gcgcgctgcagattggcctcgacgt

SEQ ID NO: 664022 - DNA, 25 bp, Rattus norvegicus
ttgctgcggaactcgtcgagcgcgc

SEQ ID NO: 664023 - DNA, 25 bp, Rattus norvegicus
ttacttgctgcggaactcgtcgagc

SEQ ID NO: 664024 - DNA, 25 bp, Rattus norvegicus
cgcgcttcttacttgctgcggaact

SEQ ID NO: 664025 - DNA, 25 bp, Rattus norvegicus
ctggccgcgcttcttacttgctgcg

SEQ ID NO: 664026 - DNA, 25 bp, Rattus norvegicus
ccggtcacacgcggggcctcagttt

SEQ ID NO: 664027 - DNA, 25 bp, Rattus norvegicus
aaggcgtcgagctgccgcctcaggc

SEQ ID NO: 664028 - DNA, 25 bp, Rattus norvegicus
gtgtgcgggattagccgtccataca

SEQ ID NO: 664029 - DNA, 25 bp, Rattus norvegicus
tctcctccagccgagcaagatggtg

SEQ ID NO: 664030 - DNA, 25 bp, Rattus norvegicus
tgagagacacagtccggtccgacgt

SEQ ID NO: 664031 - DNA, 25 bp, Rattus norvegicus
gtccgacgtgaaccgagtacgcagg

SEQ ID NO: 664032 - DNA, 25 bp, Rattus norvegicus
gctggggactaaggtttccgctaca

SEQ ID NO: 664033 - DNA, 25 bp, Rattus norvegicus
gctacaacaggtccgtccacgaaca

SEQ ID NO: 664034 - DNA, 25 bp, Rattus norvegicus
acaaagggcccactccttcacgagg

SEQ ID NO: 664035 - DNA, 25 bp, Rattus norvegicus
cgcgtctcggagtctgcggctacac

SEQ ID NO: 664036 - DNA, 25 bp, Rattus norvegicus
ctgaccaggacaaacgcgcggcggc

SEQ ID NO: 664037 - DNA, 25 bp, Rattus norvegicus
gcagagtctttagccggtccttgtc

SEQ ID NO: 664038 - DNA, 25 bp, Rattus norvegicus
tagccggtccttgtcactttaaatc

SEQ ID NO: 664039 - DNA, 25 bp, Rattus norvegicus
ggccgcttacttatcacccacaatt

SEQ ID NO: 664040 - DNA, 25 bp, Rattus norvegicus
caagatggtgagtgattatgggtct

SEQ ID NO: 664041 - DNA, 25 bp, Rattus norvegicus
tatgggtctgcgctctatccgcctc

SEQ ID NO: 664042 - DNA, 25 bp, Rattus norvegicus
ttaaatccgaaatcccgcgcaggcg

SEQ ID NO: 664043 - DNA, 25 bp, Rattus norvegicus
tgtgcccgcccttcacggagaagct

SEQ ID NO: 664044 - DNA, 25 bp, Rattus norvegicus
gggcctcgctgctttcgaacccgaa

SEQ ID NO: 664045 - DNA, 25 bp, Rattus norvegicus
tacttgcagcttgggcgtgcttcaa

SEQ ID NO: 664046 - DNA, 25 bp, Rattus norvegicus
cccgatccgcgaacatggtgagtta

SEQ ID NO: 664047 - DNA, 25 bp, Rattus norvegicus
aggtgcacagactttccgccaggtt

SEQ ID NO: 664048 - DNA, 25 bp, Rattus norvegicus
cctgcttttgctaccgcgaggaaga

SEQ ID NO: 664049 - DNA, 25 bp, Rattus norvegicus
gcggggaagccatgcactccctcta

SEQ ID NO: 664050 - DNA, 25 bp, Rattus norvegicus
tggccaggtggcgacttccaagtat

SEQ ID NO: 664051 - DNA, 25 bp, Rattus norvegicus
tccctgagagccgtttagagagttc

SEQ ID NO: 664052 - DNA, 25 bp, Rattus norvegicus
gcagatttttccctctcacgcgagg

SEQ ID NO: 664053 - DNA, 25 bp, Rattus norvegicus
acagcactttgaacagccacggtcg

SEQ ID NO: 664054 - DNA, 25 bp, Rattus norvegicus
caatcctgggataagcgctgactca

SEQ ID NO: 664055 - DNA, 25 bp, Rattus norvegicus
agcccgctccgtagataaacaaatc

SEQ ID NO: 664056 - DNA, 25 bp, Rattus norvegicus
tccctctaactggagcgaggtttcc

SEQ ID NO: 664057 - DNA, 25 bp, Rattus norvegicus
agagagactcatcccgtactcaggg

SEQ ID NO: 664058 - DNA, 25 bp, Rattus norvegicus
gggctcagtgccagcacgcttggcc

SEQ ID NO: 664059 - DNA, 25 bp, Rattus norvegicus
acagacggcgggctcagtgccagca

SEQ ID NO: 664060 - DNA, 25 bp, Rattus norvegicus
ttgctacggccagtcccggacggca

SEQ ID NO: 664061 - DNA, 25 bp, Rattus norvegicus
cagggaagttgctacggccagtccc

SEQ ID NO: 664062 - DNA, 25 bp, Rattus norvegicus
atcccgtactcagggaagttgctac

SEQ ID NO: 664063 - DNA, 25 bp, Rattus norvegicus
ggggagcagagagactcatcccgta

SEQ ID NO: 664064 - DNA, 25 bp, Rattus norvegicus
tggcaccacgggtccattcatcgtg

SEQ ID NO: 664065 - DNA, 25 bp, Rattus norvegicus
gtactcagggaagttgctacggcca

SEQ ID NO: 664066 - DNA, 25 bp, Rattus norvegicus
ggcctggcaccacgggtccattcat

SEQ ID NO: 664067 - DNA, 25 bp, Rattus norvegicus
tccgggaaacggtgctgcggcccta

SEQ ID NO: 664068 - DNA, 25 bp, Rattus norvegicus
cacgggtccattcatcgtgggcgcg

SEQ ID NO: 664069 - DNA, 25 bp, Rattus norvegicus
cggcaccctcgtgccggttccgcga

SEQ ID NO: 664070 - DNA, 25 bp, Rattus norvegicus
gaggtgccggcttccgcccaggcct

SEQ ID NO: 664071 - DNA, 25 bp, Rattus norvegicus
ggagggtctacgtctcagccaatga

SEQ ID NO: 664072 - DNA, 25 bp, Rattus norvegicus
tggagtcgtggcactttctgcctcg

SEQ ID NO: 664073 - DNA, 25 bp, Rattus norvegicus
ctttctgcctcggagctggcgaacg

SEQ ID NO: 664074 - DNA, 25 bp, Rattus norvegicus
acccgggccagccattcatcgagtt

SEQ ID NO: 664075 - DNA, 25 bp, Rattus norvegicus
agccattcatcgagttgcctctcct

SEQ ID NO: 664076 - DNA, 25 bp, Rattus norvegicus
tctgcgagcctctagccaatcaggt

SEQ ID NO: 664077 - DNA, 25 bp, Rattus norvegicus
gccattggccaaaaaggagggtcta

SEQ ID NO: 664078 - DNA, 25 bp, Rattus norvegicus
ttcttacctgcagcgggagacgcga

SEQ ID NO: 664079 - DNA, 25 bp, Rattus norvegicus
tcatccggtggcttcccgaaactta

SEQ ID NO: 664080 - DNA, 25 bp, Rattus norvegicus
tcttagcccaacttcggagcgcgcg

SEQ ID NO: 664081 - DNA, 25 bp, Rattus norvegicus
gccgccgaggagacgtgtcactcgc

SEQ ID NO: 664082 - DNA, 25 bp, Rattus norvegicus
ggcccggccaagtttcttacctgca

SEQ ID NO: 664083 - DNA, 25 bp, Rattus norvegicus
gccaagtttcttacctgcagcggga

SEQ ID NO: 664084 - DNA, 25 bp, Rattus norvegicus
tagccaatcaggtcgcggacagtcg

SEQ ID NO: 664085 - DNA, 25 bp, Rattus norvegicus
acttccgcgcgtgcgactggctgcg

SEQ ID NO: 664086 - DNA, 25 bp, Rattus norvegicus
cctctgtcagcgatgcgaacagctg

SEQ ID NO: 664087 - DNA, 25 bp, Rattus norvegicus
atgcgaacagctgacggccgctctt

SEQ ID NO: 664088 - DNA, 25 bp, Rattus norvegicus
gctcttcctggagctctactggccg

SEQ ID NO: 664089 - DNA, 25 bp, Rattus norvegicus
ttcctggagctctactggccgctcg

SEQ ID NO: 664090 - DNA, 25 bp, Rattus norvegicus
gcggaccgcacctctgtcagcgatg

SEQ ID NO: 664091 - DNA, 25 bp, Rattus norvegicus
gcgtctgcttggacgcgcacggacc

SEQ ID NO: 664092 - DNA, 25 bp, Rattus norvegicus
gtccggagaagaagcgaacacgtcc

SEQ ID NO: 664093 - DNA, 25 bp, Rattus norvegicus
gaagcgaacacgtccacggagccga

SEQ ID NO: 664094 - DNA, 25 bp, Rattus norvegicus
acacgtccacggagccgaggagatg

SEQ ID NO: 664095 - DNA, 25 bp, Rattus norvegicus
cgccctgatgacgttggggtgttta

SEQ ID NO: 664096 - DNA, 25 bp, Rattus norvegicus
ttggggtgtttacttccgcgcgtgc

SEQ ID NO: 664097 - DNA, 25 bp, Rattus norvegicus
actgccacgtgcctccatcagccgc

SEQ ID NO: 664098 - DNA, 25 bp, Rattus norvegicus
catagacccggtccggagaagaagc

SEQ ID NO: 664099 - DNA, 25 bp, Rattus norvegicus
atccagctgccagcgaggcagctgc

SEQ ID NO: 664100 - DNA, 25 bp, Rattus norvegicus
tgcgggacaaccacgtcaaggtcga

SEQ ID NO: 664101 - DNA, 25 bp, Rattus norvegicus
gctcttcactcagcggggctgcaaa

SEQ ID NO: 664102 - DNA, 25 bp, Rattus norvegicus
aacgtttcgctcttcactcagcggg

SEQ ID NO: 664103 - DNA, 25 bp, Rattus norvegicus
tcaggctgcaccgaacgtttcgctc

SEQ ID NO: 664104 - DNA, 25 bp, Rattus norvegicus
gcgaatcgaggaagcgccacatctc

SEQ ID NO: 664105 - DNA, 25 bp, Rattus norvegicus
aggggtcgcgatctaacgcttagtc

SEQ ID NO: 664106 - DNA, 25 bp, Rattus norvegicus
ccaggctgaatccagctgccagcga

SEQ ID NO: 664107 - DNA, 25 bp, Rattus norvegicus
gtcgaggtgagatcccggctctcag

SEQ ID NO: 664108 - DNA, 25 bp, Rattus norvegicus
cacgtcaaggtcgaggtgagatccc

SEQ ID NO: 664109 - DNA, 25 bp, Rattus norvegicus
tctaacgcttagtctcgggctcagc

SEQ ID NO: 664110 - DNA, 25 bp, Rattus norvegicus
ttagtctcgggctcagcaagggccc

SEQ ID NO: 664111 - DNA, 25 bp, Rattus norvegicus
cagcaagggccctgggcgcttccga

SEQ ID NO: 664112 - DNA, 25 bp, Rattus norvegicus
ggcacctgcgggacaaccacgtcaa

SEQ ID NO: 664113 - DNA, 25 bp, Rattus norvegicus
aaagcgcgggactgataaaagtacg

SEQ ID NO: 664114 - DNA, 25 bp, Rattus norvegicus
acggtgcccacgcttctgcttcaga

SEQ ID NO: 664115 - DNA, 25 bp, Rattus norvegicus
aaaacgcgcggcttgacggtgccca

SEQ ID NO: 664116 - DNA, 25 bp, Rattus norvegicus
tctcgtgagagcgaaaacgcgcggc

SEQ ID NO: 664117 - DNA, 25 bp, Rattus norvegicus
cggtgacgtacgcaagatctcgtga

SEQ ID NO: 664118 - DNA, 25 bp, Rattus norvegicus
gggaatttattgctcagccagagtc

SEQ ID NO: 664119 - DNA, 25 bp, Rattus norvegicus
agcgcctctcgggtgagacgtgaac

SEQ ID NO: 664120 - DNA, 25 bp, Rattus norvegicus
gcgcacagcggcaaggggaatttat

SEQ ID NO: 664121 - DNA, 25 bp, Rattus norvegicus
cacgcctcgagaaagagcgcgcaca

SEQ ID NO: 664122 - DNA, 25 bp, Rattus norvegicus
gtgccacgcggacaccagcactgta

SEQ ID NO: 664123 - DNA, 25 bp, Rattus norvegicus
gcaaagaagcaacgcggggcctacc

SEQ ID NO: 664124 - DNA, 25 bp, Rattus norvegicus
ttctgcttcagaggaagagcgcctc

SEQ ID NO: 664125 - DNA, 25 bp, Rattus norvegicus
gcaggccagtagcacgccacgtgct

SEQ ID NO: 664126 - DNA, 25 bp, Rattus norvegicus
cgtccatcttggagccgggcaaaga

SEQ ID NO: 664127 - DNA, 25 bp, Rattus norvegicus
ggtttcccagcctagattctcgttc

SEQ ID NO: 664128 - DNA, 25 bp, Rattus norvegicus
gggctcctcctcttcaccagaaaga

SEQ ID NO: 664129 - DNA, 25 bp, Rattus norvegicus
ctcatcccagctgcggacagaggct

SEQ ID NO: 664130 - DNA, 25 bp, Rattus norvegicus
tgcccttttgtcatccgggagctca

SEQ ID NO: 664131 - DNA, 25 bp, Rattus norvegicus
tagccgcagacttggtcccgagcag

SEQ ID NO: 664132 - DNA, 25 bp, Rattus norvegicus
gccgccaggcaattagccctgtcta

SEQ ID NO: 664133 - DNA, 25 bp, Rattus norvegicus
agcggaccttcacaagcggtttaga

SEQ ID NO: 664134 - DNA, 25 bp, Rattus norvegicus
actaacttagggtgtcgtgagaccg

SEQ ID NO: 664135 - DNA, 25 bp, Rattus norvegicus
cgtcccgagggtagacaagtcagcc

SEQ ID NO: 664136 - DNA, 25 bp, Rattus norvegicus
acagcccaggctcactgtggaggga

SEQ ID NO: 664137 - DNA, 25 bp, Rattus norvegicus
ggcgtcgtgaagctctggagtttca

SEQ ID NO: 664138 - DNA, 25 bp, Rattus norvegicus
gatgtccatccgtgccttcggcgtc

SEQ ID NO: 664139 - DNA, 25 bp, Rattus norvegicus
gcgctgcatcgctgccagatgtcca

SEQ ID NO: 664140 - DNA, 25 bp, Rattus norvegicus
cctcacctgggatgtaagtgtctgc

SEQ ID NO: 664141 - DNA, 25 bp, Rattus norvegicus
gcgcgttctggtttccgactcctct

SEQ ID NO: 664142 - DNA, 25 bp, Rattus norvegicus
aagccgcccagcactttctgttgga

SEQ ID NO: 664143 - DNA, 25 bp, Rattus norvegicus
cccagcactttctgttggacgcagc

SEQ ID NO: 664144 - DNA, 25 bp, Rattus norvegicus
ttaggctcggcgctcgattgctcga

SEQ ID NO: 664145 - DNA, 25 bp, Rattus norvegicus
attgctcgagcctggcgacgatagc

SEQ ID NO: 664146 - DNA, 25 bp, Rattus norvegicus
agcctggcgacgatagcacttgcaa

SEQ ID NO: 664147 - DNA, 25 bp, Rattus norvegicus
cgatagcacttgcaacgactctgca

SEQ ID NO: 664148 - DNA, 25 bp, Rattus norvegicus
gcaacgactctgcactcgaggggtc

SEQ ID NO: 664149 - DNA, 25 bp, Rattus norvegicus
gcactcgaggggtcgagcctgaccc

SEQ ID NO: 664150 - DNA, 25 bp, Rattus norvegicus
agcctgacccgttgaggcgtctgcg

SEQ ID NO: 664151 - DNA, 25 bp, Rattus norvegicus
gttcgaaggcagtgctgggcctttc

SEQ ID NO: 664152 - DNA, 25 bp, Rattus norvegicus
cagtgctgggcctttcggtgctgct

SEQ ID NO: 664153 - DNA, 25 bp, Rattus norvegicus
accggcaggtcggtgtcacgtgacc

SEQ ID NO: 664154 - DNA, 25 bp, Rattus norvegicus
tgcatctgaagcagcggcaggaccg

SEQ ID NO: 664155 - DNA, 25 bp, Rattus norvegicus
cgccaaccgggtgtctagactctca

SEQ ID NO: 664156 - DNA, 25 bp, Rattus norvegicus
cagtgaaactaggttcccgacgcta

SEQ ID NO: 664157 - DNA, 25 bp, Rattus norvegicus
gtcttgaaaaccaccctcatggcgg

SEQ ID NO: 664158 - DNA, 25 bp, Rattus norvegicus
cgggccacttttcctctagtcttga

SEQ ID NO: 664159 - DNA, 25 bp, Rattus norvegicus
cggttcccgagaattccagcgcgct

SEQ ID NO: 664160 - DNA, 25 bp, Rattus norvegicus
acctcatgaagaaggcccggcgcga

SEQ ID NO: 664161 - DNA, 25 bp, Rattus norvegicus
aaaggacaagttgcggcgaccctgc

SEQ ID NO: 664162 - DNA, 25 bp, Rattus norvegicus
gaggatctcgttcgataggtactga

SEQ ID NO: 664163 - DNA, 25 bp, Rattus norvegicus
aaggggacctcactcagctcactgg

SEQ ID NO: 664164 - DNA, 25 bp, Rattus norvegicus
agaatatgccttctcagcggctgga

SEQ ID NO: 664165 - DNA, 25 bp, Rattus norvegicus
gctccttctgcgacactttctttta

SEQ ID NO: 664166 - DNA, 25 bp, Rattus norvegicus
gaaatcgacttcctagcaaccagcc

SEQ ID NO: 664167 - DNA, 25 bp, Rattus norvegicus
ccaccaggagccgagcagatgattg

SEQ ID NO: 664168 - DNA, 25 bp, Rattus norvegicus
ccgcagcagcttgcgttaccacaga

SEQ ID NO: 664169 - DNA, 25 bp, Rattus norvegicus
cccgcgtcatggatgtactcacttg

SEQ ID NO: 664170 - DNA, 25 bp, Rattus norvegicus
cccgcgtcatgggtgtactcacttg

SEQ ID NO: 664171 - DNA, 25 bp, Rattus norvegicus
cgtcatggatgtactcacttgcgtg

SEQ ID NO: 664172 - DNA, 25 bp, Rattus norvegicus
gtgtcccgcgtcatggatgtactca

SEQ ID NO: 664173 - DNA, 25 bp, Rattus norvegicus
tactcacttgcgtgtgtgtccagcg

SEQ ID NO: 664174 - DNA, 25 bp, Rattus norvegicus
tcccgcgtcatggatgtactcactt

SEQ ID NO: 664175 - DNA, 25 bp, Rattus norvegicus
ccagcgtcatggatgtacccacttg

SEQ ID NO: 664176 - DNA, 25 bp, Rattus norvegicus
cccgcgtcatggatgtacccactta

SEQ ID NO: 664177 - DNA, 25 bp, Rattus norvegicus
cacttacctgtgtgtgtccagcgtc

SEQ ID NO: 664178 - DNA, 25 bp, Rattus norvegicus
tgtgtcccgcgtcatggatgtactc

SEQ ID NO: 664179 - DNA, 25 bp, Rattus norvegicus
tactcacttgcgtgtgtgtcccgcg

SEQ ID NO: 664180 - DNA, 25 bp, Rattus norvegicus
gtgtcccgcgtcatggatgtaccca

SEQ ID NO: 664181 - DNA, 25 bp, Rattus norvegicus
ccagcgtcatggatgtactcacttg

SEQ ID NO: 664182 - DNA, 25 bp, Rattus norvegicus
cccgcgtcatggatgtacccacttg

SEQ ID NO: 664183 - DNA, 25 bp, Rattus norvegicus
gcagccgccgcttcctgactgtttt

SEQ ID NO: 664184 - DNA, 25 bp, Rattus norvegicus
gcgaaccctggagctctcctatgga

SEQ ID NO: 664185 - DNA, 25 bp, Rattus norvegicus
attctccggcaagatcggcctcgca

SEQ ID NO: 664186 - DNA, 25 bp, Rattus norvegicus
tcaggtaggattctccggcaagatc

SEQ ID NO: 664187 - DNA, 25 bp, Rattus norvegicus
ccgaagatgtcaggtaggattctcc

SEQ ID NO: 664188 - DNA, 25 bp, Rattus norvegicus
tccttacacgaaaaccgaagatgtc

SEQ ID NO: 664189 - DNA, 25 bp, Rattus norvegicus
tgggctcggcgattttccttacacg

SEQ ID NO: 664190 - DNA, 25 bp, Rattus norvegicus
ttgtctatgcactaggcgcctggtc

SEQ ID NO: 664191 - DNA, 25 bp, Rattus norvegicus
gcggatgtctattgtctatgcacta

SEQ ID NO: 664192 - DNA, 25 bp, Rattus norvegicus
taccggcggatgtctattgtctatg

SEQ ID NO: 664193 - DNA, 25 bp, Rattus norvegicus
aggctacgatctggtaccggcggat

SEQ ID NO: 664194 - DNA, 25 bp, Rattus norvegicus
gtcctgaccaggctacgatctggta

SEQ ID NO: 664195 - DNA, 25 bp, Rattus norvegicus
cctatggagtcatgcgtcctgacca

SEQ ID NO: 664196 - DNA, 25 bp, Rattus norvegicus
cctggagctctcctatggagtcatg

SEQ ID NO: 664197 - DNA, 25 bp, Rattus norvegicus
agtgccttctctgccttcgattaca

SEQ ID NO: 664198 - DNA, 25 bp, Rattus norvegicus
tacacagcgttcgagccacacattg

SEQ ID NO: 664199 - DNA, 25 bp, Rattus norvegicus
aagacgctccttctgaccgcgcaga

SEQ ID NO: 664200 - DNA, 25 bp, Rattus norvegicus
tcaagcgcgagcacctgacatcgtc

SEQ ID NO: 664201 - DNA, 25 bp, Rattus norvegicus
agctatgtcttcttgggcagggtcc

SEQ ID NO: 664202 - DNA, 25 bp, Rattus norvegicus
tgcggccatcgcgttatccgacttc

SEQ ID NO: 664203 - DNA, 25 bp, Rattus norvegicus
cttcgcaggacagtcaaagccatta

SEQ ID NO: 664204 - DNA, 25 bp, Rattus norvegicus
catctttgaacacttccggggcgga

SEQ ID NO: 664205 - DNA, 25 bp, Rattus norvegicus
atggacgaaccaccttctgatgtgc

SEQ ID NO: 664206 - DNA, 25 bp, Rattus norvegicus
ggagctggcaagatccaccttctga

SEQ ID NO: 664207 - DNA, 25 bp, Rattus norvegicus
ctgaccagcggttcatccacaggta

SEQ ID NO: 664208 - DNA, 25 bp, Rattus norvegicus
tacgctgctcgctaaccggtcatga

SEQ ID NO: 664209 - DNA, 25 bp, Rattus norvegicus
cggcaagaagtaccagcggctctca

SEQ ID NO: 664210 - DNA, 25 bp, Rattus norvegicus
gcccagcacaaagaatcggtacgta

SEQ ID NO: 664211 - DNA, 25 bp, Rattus norvegicus
gaagatccggcacgtgcctggccgc

SEQ ID NO: 664212 - DNA, 25 bp, Rattus norvegicus
cgtcacccgggctagcgtcacaggt

SEQ ID NO: 664213 - DNA, 25 bp, Rattus norvegicus
cgccgtggccgagaagatccggcac

SEQ ID NO: 664214 - DNA, 25 bp, Rattus norvegicus
ccgggctagcgtcacaggtcagtcg

SEQ ID NO: 664215 - DNA, 25 bp, Rattus norvegicus
cgggatgcagctcttgaatgggtcc

SEQ ID NO: 664216 - DNA, 25 bp, Rattus norvegicus
aaggccgtggtgcagcgcgtcaccc

SEQ ID NO: 664217 - DNA, 25 bp, Rattus norvegicus
cagccgccgccatgaaggccgtggt

SEQ ID NO: 664218 - DNA, 25 bp, Rattus norvegicus
aaggtctgactacacggcgcgtccc

SEQ ID NO: 664219 - DNA, 25 bp, Rattus norvegicus
ggcggagtcgcaaggtctgactaca

SEQ ID NO: 664220 - DNA, 25 bp, Rattus norvegicus
agccactggcggagtcgcaaggtct

SEQ ID NO: 664221 - DNA, 25 bp, Rattus norvegicus
gagctcttccggtgttgccggtaga

SEQ ID NO: 664222 - DNA, 25 bp, Rattus norvegicus
tgaatgggtcctcgcggagctcttc

SEQ ID NO: 664223 - DNA, 25 bp, Rattus norvegicus
cagctcttgaatgggtcctcgcgga

SEQ ID NO: 664224 - DNA, 25 bp, Rattus norvegicus
cgacccgctgttccgagtgagggtt

SEQ ID NO: 664225 - DNA, 25 bp, Rattus norvegicus
ctctgaatcacagccaccaccgtgc

SEQ ID NO: 664226 - DNA, 25 bp, Rattus norvegicus
ttcgaccggagcatgcccctgtatg

SEQ ID NO: 664227 - DNA, 25 bp, Rattus norvegicus
tcctcggactcgctggagttcgacc

SEQ ID NO: 664228 - DNA, 25 bp, Rattus norvegicus
ttcctcctcggactcgctggagttc

SEQ ID NO: 664229 - DNA, 25 bp, Rattus norvegicus
agcgacatgagcctttccacttcct

SEQ ID NO: 664230 - DNA, 25 bp, Rattus norvegicus
ctgagcgacatgagcctttccactt

SEQ ID NO: 664231 - DNA, 25 bp, Rattus norvegicus
ccaccgtgccatggagccaggcaga

SEQ ID NO: 664232 - DNA, 25 bp, Rattus norvegicus
gccgccgcccgactctgaatcacag

SEQ ID NO: 664233 - DNA, 25 bp, Rattus norvegicus
gctggagttcgaccggagcatgccc

SEQ ID NO: 664234 - DNA, 25 bp, Rattus norvegicus
cccggggattgcacaagggcgccgc

SEQ ID NO: 664235 - DNA, 25 bp, Rattus norvegicus
cacagctgggcacgcaggtggagcc

SEQ ID NO: 664236 - DNA, 25 bp, Rattus norvegicus
actcgctggagttcgaccggagcat

SEQ ID NO: 664237 - DNA, 25 bp, Rattus norvegicus
ggaaagcagcgccaagaccttgacc

SEQ ID NO: 664238 - DNA, 25 bp, Rattus norvegicus
ccaagaccttgaccgcctgccggcc

SEQ ID NO: 664239 - DNA, 25 bp, Rattus norvegicus
caacacgccactggttggtccggca

SEQ ID NO: 664240 - DNA, 25 bp, Rattus norvegicus
tctcgatggagacatggacggcaca

SEQ ID NO: 664241 - DNA, 25 bp, Rattus norvegicus
ccgggaagcgtccaggcagttactc

SEQ ID NO: 664242 - DNA, 25 bp, Rattus norvegicus
atcacgctgaacaagggagtcggtg

SEQ ID NO: 664243 - DNA, 25 bp, Rattus norvegicus
gggcagctcgtcgtcacccgcaagt

SEQ ID NO: 664244 - DNA, 25 bp, Rattus norvegicus
agcgcgcgccagtgtttgtaaacaa

SEQ ID NO: 664245 - DNA, 25 bp, Rattus norvegicus
acaaaccggtcacgtggccgcagca

SEQ ID NO: 664246 - DNA, 25 bp, Rattus norvegicus
cgcacagcccgaaccggagcggaaa

SEQ ID NO: 664247 - DNA, 25 bp, Rattus norvegicus
aagaagggctgcacggctgactcta

SEQ ID NO: 664248 - DNA, 25 bp, Rattus norvegicus
agcgcgctcttaaagccacagtctc

SEQ ID NO: 664249 - DNA, 25 bp, Rattus norvegicus
tatcccatcggctcagcacatagca

SEQ ID NO: 664250 - DNA, 25 bp, Rattus norvegicus
agccaatcactggaggacggaactc

SEQ ID NO: 664251 - DNA, 25 bp, Rattus norvegicus
agttactcgctgtggttcccttggc

SEQ ID NO: 664252 - DNA, 25 bp, Rattus norvegicus
ccagacccaagtatctcgatggaga

SEQ ID NO: 664253 - DNA, 25 bp, Rattus norvegicus
gggccttcacctgcgacgacctgtt

SEQ ID NO: 664254 - DNA, 25 bp, Rattus norvegicus
gctgcgacgctactcttgttgccca

SEQ ID NO: 664255 - DNA, 25 bp, Rattus norvegicus
gttgcccagcaacctctggtccgga

SEQ ID NO: 664256 - DNA, 25 bp, Rattus norvegicus
tctggtccggaagtagttctttgtc

SEQ ID NO: 664257 - DNA, 25 bp, Rattus norvegicus
tggcggcggcgcaatgaccacgctc

SEQ ID NO: 664258 - DNA, 25 bp, Rattus norvegicus
gacgctactcttgttgcccagcaac

SEQ ID NO: 664259 - DNA, 25 bp, Rattus norvegicus
tgcgacgacctgttccgcttcaaca

SEQ ID NO: 664260 - DNA, 25 bp, Rattus norvegicus
gttccgcttcaacaacatgtgagtg

SEQ ID NO: 664261 - DNA, 25 bp, Rattus norvegicus
caacatgtgagtgccgcattgggcc

SEQ ID NO: 664262 - DNA, 25 bp, Rattus norvegicus
gccgcattgggccagcctctgtctt

SEQ ID NO: 664263 - DNA, 25 bp, Rattus norvegicus
agcctctgtcttcgcggcgcgggac

SEQ ID NO: 664264 - DNA, 25 bp, Rattus norvegicus
ccgccagagagagctgcgacgctac

SEQ ID NO: 664265 - DNA, 25 bp, Rattus norvegicus
agtagttctttgtcccaccccatgg

SEQ ID NO: 664266 - DNA, 25 bp, Rattus norvegicus
gcaacctctggtccggaagtagttc

SEQ ID NO: 664267 - DNA, 25 bp, Rattus norvegicus
cacaacaaactagatcccggaaccg

SEQ ID NO: 664268 - DNA, 25 bp, Rattus norvegicus
gaaacgccgcgtcgtttccgtagca

SEQ ID NO: 664269 - DNA, 25 bp, Rattus norvegicus
ggctcacccaggtccgtctctaaga

SEQ ID NO: 664270 - DNA, 25 bp, Rattus norvegicus
tttccgtagcaaccgtgtgcgcgtc

SEQ ID NO: 664271 - DNA, 25 bp, Rattus norvegicus
ccggaacttgccaaggcgacctttg

SEQ ID NO: 664272 - DNA, 25 bp, Rattus norvegicus
gaggtcgcttaccttggccacttta

SEQ ID NO: 664273 - DNA, 25 bp, Rattus norvegicus
cagagccagcccacaacaaactaga

SEQ ID NO: 664274 - DNA, 25 bp, Rattus norvegicus
agatacacgcctcaaaatcccgcgg

SEQ ID NO: 664275 - DNA, 25 bp, Rattus norvegicus
ccggacttcagatacacgcctcaaa

SEQ ID NO: 664276 - DNA, 25 bp, Rattus norvegicus
cgccatgattgtagccgcggaacgc

SEQ ID NO: 664277 - DNA, 25 bp, Rattus norvegicus
ttaggaatccgctgtttcccggctg

SEQ ID NO: 664278 - DNA, 25 bp, Rattus norvegicus
tttgaccgcctcaccagtcagggga

SEQ ID NO: 664279 - DNA, 25 bp, Rattus norvegicus
cttggccactttaggaatccgctgt

SEQ ID NO: 664280 - DNA, 25 bp, Rattus norvegicus
cgtcctcagaggagcagcgccgctt

SEQ ID NO: 664281 - DNA, 25 bp, Rattus norvegicus
agcacaagtacttcgagcgcagctt

SEQ ID NO: 664282 - DNA, 25 bp, Rattus norvegicus
cttcaacctgggctcgccggtgtct

SEQ ID NO: 664283 - DNA, 25 bp, Rattus norvegicus
gcgcacttcggcaacccggaggctg

SEQ ID NO: 664284 - DNA, 25 bp, Rattus norvegicus
tcaagatgggcactgcgttctccgc

SEQ ID NO: 664285 - DNA, 25 bp, Rattus norvegicus
gctcgccggtgtctgccgagtcctt

SEQ ID NO: 664286 - DNA, 25 bp, Rattus norvegicus
cgcgccctcaggtacatctgccgca

SEQ ID NO: 664287 - DNA, 25 bp, Rattus norvegicus
cttcgagcgcagcttcaacctgggc

SEQ ID NO: 664288 - DNA, 25 bp, Rattus norvegicus
gtcgcgagcacgagaagcacaagta

SEQ ID NO: 664289 - DNA, 25 bp, Rattus norvegicus
gcaagaagtccacgcccgtgtccta

SEQ ID NO: 664290 - DNA, 25 bp, Rattus norvegicus
cctggtgaagcgcagcaagaagtcc

SEQ ID NO: 664291 - DNA, 25 bp, Rattus norvegicus
agccagtgcgtcgtcgccctttgca

SEQ ID NO: 664292 - DNA, 25 bp, Rattus norvegicus
caagcacggaggtgggacccagcca

SEQ ID NO: 664293 - DNA, 25 bp, Rattus norvegicus
actgagggccgccagggccaagcac

SEQ ID NO: 664294 - DNA, 25 bp, Rattus norvegicus
gccggccgagctcaagatgggcact

SEQ ID NO: 664295 - DNA, 25 bp, Rattus norvegicus
cgcctcagcttaagcggtggctcca

SEQ ID NO: 664296 - DNA, 25 bp, Rattus norvegicus
gtccgcaagtgctcccgggaactgt

SEQ ID NO: 664297 - DNA, 25 bp, Rattus norvegicus
tgctgcgttttccatacgtcaagga

SEQ ID NO: 664298 - DNA, 25 bp, Rattus norvegicus
tccaatctgattgctgcgttttcca

SEQ ID NO: 664299 - DNA, 25 bp, Rattus norvegicus
gtctgcgcagtgacctccaatctga

SEQ ID NO: 664300 - DNA, 25 bp, Rattus norvegicus
caacccggactgttcacgcgctagg

SEQ ID NO: 664301 - DNA, 25 bp, Rattus norvegicus
aagtcactgcatagggtcgcgacgg

SEQ ID NO: 664302 - DNA, 25 bp, Rattus norvegicus
tgcgccgcacaagtcactgcatagg

SEQ ID NO: 664303 - DNA, 25 bp, Rattus norvegicus
ggtccctccctatgtggtccgcaag

SEQ ID NO: 664304 - DNA, 25 bp, Rattus norvegicus
ttcgggagaacatcccgccgcggta

SEQ ID NO: 664305 - DNA, 25 bp, Rattus norvegicus
tacgtcaaggaaagcgaggtccctc

SEQ ID NO: 664306 - DNA, 25 bp, Rattus norvegicus
ggactttttcacatctccgtggctc

SEQ ID NO: 664307 - DNA, 25 bp, Rattus norvegicus
caccttctgcgtggactttttcaca

SEQ ID NO: 664308 - DNA, 25 bp, Rattus norvegicus
tccgtggctccttcgggagaacatc

SEQ ID NO: 664309 - DNA, 25 bp, Rattus norvegicus
cacaggctgtgaactttggatcgcc

SEQ ID NO: 664310 - DNA, 25 bp, Rattus norvegicus
tggaggtcggtcctaatttacactc

SEQ ID NO: 664311 - DNA, 25 bp, Rattus norvegicus
tcttccaccagaagctccgaggttc

SEQ ID NO: 664312 - DNA, 25 bp, Rattus norvegicus
cataatgtcatcagccctggcccga

SEQ ID NO: 664313 - DNA, 25 bp, Rattus norvegicus
ctccgaggttcggtttgcacaggct

SEQ ID NO: 664314 - DNA, 25 bp, Rattus norvegicus
tgtgacagctgtcccacctaggctc

SEQ ID NO: 664315 - DNA, 25 bp, Rattus norvegicus
atagtgggcaaagtggctgacctac

SEQ ID NO: 664316 - DNA, 25 bp, Rattus norvegicus
ctgcggaacaaaacgcgctggtaaa

SEQ ID NO: 664317 - DNA, 25 bp, Rattus norvegicus
cagcctggaatccaactgcggaaca

SEQ ID NO: 664318 - DNA, 25 bp, Rattus norvegicus
aattacttgattagcgtccgtcgga

SEQ ID NO: 664319 - DNA, 25 bp, Rattus norvegicus
gcaaaactccgtggttcaacagcta

SEQ ID NO: 664320 - DNA, 25 bp, Rattus norvegicus
cagcgggcaaacaaggagatttatc

SEQ ID NO: 664321 - DNA, 25 bp, Rattus norvegicus
tctgcagcccgaagatgtcgccatc

SEQ ID NO: 664322 - DNA, 25 bp, Rattus norvegicus
tggatcgcctttcctgaaccgcgga

SEQ ID NO: 664323 - DNA, 25 bp, Rattus norvegicus
caggctctgcgggacaggtatggcc

SEQ ID NO: 664324 - DNA, 25 bp, Rattus norvegicus
gtctccgtaggcaacgctggccttc

SEQ ID NO: 664325 - DNA, 25 bp, Rattus norvegicus
tccctgacccgcaccgcagctagct

SEQ ID NO: 664326 - DNA, 25 bp, Rattus norvegicus
agctagctccgccttctcggagccc

SEQ ID NO: 664327 - DNA, 25 bp, Rattus norvegicus
tcttcaggcggcaaggctccttgtt

SEQ ID NO: 664328 - DNA, 25 bp, Rattus norvegicus
caggcggcaaggctccttgtttacc

SEQ ID NO: 664329 - DNA, 25 bp, Rattus norvegicus
cttgtttacccgcggtgcatgttgg

SEQ ID NO: 664330 - DNA, 25 bp, Rattus norvegicus
cgtaggcaacgctggccttccagct

SEQ ID NO: 664331 - DNA, 25 bp, Rattus norvegicus
gctgccctgtggcaatgccgcgaag

SEQ ID NO: 664332 - DNA, 25 bp, Rattus norvegicus
tggcctacgccaggcgcccgctgca

SEQ ID NO: 664333 - DNA, 25 bp, Rattus norvegicus
cgctgcattcgtgcccttggcgagc

SEQ ID NO: 664334 - DNA, 25 bp, Rattus norvegicus
ccagctactacgaaagggtgggcca

SEQ ID NO: 664335 - DNA, 25 bp, Rattus norvegicus
ctacgaaagggtgggccagctccag

SEQ ID NO: 664336 - DNA, 25 bp, Rattus norvegicus
tactacgaaagggtgggccagctcc

SEQ ID NO: 664337 - DNA, 25 bp, Rattus norvegicus
atcgcttgttttccaccggagactg

SEQ ID NO: 664338 - DNA, 25 bp, Rattus norvegicus
gtcagcccggagtccagctctcaaa

SEQ ID NO: 664339 - DNA, 25 bp, Rattus norvegicus
ctcaaaggctttaggtctcaccacc

SEQ ID NO: 664340 - DNA, 25 bp, Rattus norvegicus
ccggccaccgcttgtgcagttcaaa

SEQ ID NO: 664341 - DNA, 25 bp, Rattus norvegicus
acgtaacttccggtcgctggacgca

SEQ ID NO: 664342 - DNA, 25 bp, Rattus norvegicus
cgccagtctcgttggttacactctc

SEQ ID NO: 664343 - DNA, 25 bp, Rattus norvegicus
agtacccgtccatcattgtcaattg

SEQ ID NO: 664344 - DNA, 25 bp, Rattus norvegicus
gtccactttgttgagcccggcattc

SEQ ID NO: 664345 - DNA, 25 bp, Rattus norvegicus
tggccatttgttgcagttaaccgtg

SEQ ID NO: 664346 - DNA, 25 bp, Rattus norvegicus
tgccgggcagctcgctgttttcact

SEQ ID NO: 664347 - DNA, 25 bp, Rattus norvegicus
cttcctgtcttctcgagtggtgtta

SEQ ID NO: 664348 - DNA, 25 bp, Rattus norvegicus
gacttatagctgttccgattcgtga

SEQ ID NO: 664349 - DNA, 25 bp, Rattus norvegicus
cgttcgcgtaattctgtccgagttc

SEQ ID NO: 664350 - DNA, 25 bp, Rattus norvegicus
ctcagagttcgaaagggcgccctgt

SEQ ID NO: 664351 - DNA, 25 bp, Rattus norvegicus
atgccggtcagcgaacccatgccgg

SEQ ID NO: 664352 - DNA, 25 bp, Rattus norvegicus
tgcgcgtcccaaacctcgacccaga

SEQ ID NO: 664353 - DNA, 25 bp, Rattus norvegicus
gggcagctcacccatgttgcccagg

SEQ ID NO: 664354 - DNA, 25 bp, Rattus norvegicus
gccgccgttgcagtagctgcccatt

SEQ ID NO: 664355 - DNA, 25 bp, Rattus norvegicus
gcagtagctgcccattgcgctgtgc

SEQ ID NO: 664356 - DNA, 25 bp, Rattus norvegicus
ccattgcgctgtgcgggaactgcga

SEQ ID NO: 664357 - DNA, 25 bp, Rattus norvegicus
tgtaggcgggcagctcacccatgtt

SEQ ID NO: 664358 - DNA, 25 bp, Rattus norvegicus
ctcacttgacgagtagcgcgggtcc

SEQ ID NO: 664359 - DNA, 25 bp, Rattus norvegicus
ggcgccgctgactagaacgccagca

SEQ ID NO: 664360 - DNA, 25 bp, Rattus norvegicus
tcacgagccctaggccgcgtcccag

SEQ ID NO: 664361 - DNA, 25 bp, Rattus norvegicus
ggccacgttcacacccgccgacggc

SEQ ID NO: 664362 - DNA, 25 bp, Rattus norvegicus
cgcgatgccggtcagcgaacccatg

SEQ ID NO: 664363 - DNA, 25 bp, Rattus norvegicus
ccgcgtgcagcggtgccagagactt

SEQ ID NO: 664364 - DNA, 25 bp, Rattus norvegicus
cccgctcgctttaagtgatggcacg

SEQ ID NO: 664365 - DNA, 25 bp, Rattus norvegicus
caccgtgctggttgacttcctgcca

SEQ ID NO: 664366 - DNA, 25 bp, Rattus norvegicus
cagcgtggacccagatcgggcaacc

SEQ ID NO: 664367 - DNA, 25 bp, Rattus norvegicus
gcaaccggagcagagtccacgcgaa

SEQ ID NO: 664368 - DNA, 25 bp, Rattus norvegicus
ggacagcacggtcctagacagagga

SEQ ID NO: 664369 - DNA, 25 bp, Rattus norvegicus
agcctccctcggatttctccatgaa

SEQ ID NO: 664370 - DNA, 25 bp, Rattus norvegicus
tttctccatgaagctgggcaggacg

SEQ ID NO: 664371 - DNA, 25 bp, Rattus norvegicus
ttagcctctagaacccgaagcactg

SEQ ID NO: 664372 - DNA, 25 bp, Rattus norvegicus
cggctgccacgtaggccaagcctta

SEQ ID NO: 664373 - DNA, 25 bp, Rattus norvegicus
cccgttgtacttgaggctccgccta

SEQ ID NO: 664374 - DNA, 25 bp, Rattus norvegicus
aggccgcacctggtcggcgaaatcc

SEQ ID NO: 664375 - DNA, 25 bp, Rattus norvegicus
aaatcctcggccgtgcccatcaggt

SEQ ID NO: 664376 - DNA, 25 bp, Rattus norvegicus
atcaggtcgttctgtcccatggcgg

SEQ ID NO: 664377 - DNA, 25 bp, Rattus norvegicus
tgcggcctccacaggaagtacccgg

SEQ ID NO: 664378 - DNA, 25 bp, Rattus norvegicus
gcctaccgcgtcatcacagaatctg

SEQ ID NO: 664379 - DNA, 25 bp, Rattus norvegicus
gccactcgaggaggcacaggcaacc

SEQ ID NO: 664380 - DNA, 25 bp, Rattus norvegicus
gccgccagtccgtgcactgagtaga

SEQ ID NO: 664381 - DNA, 25 bp, Rattus norvegicus
cagaccctctgcctttgcagtaatc

SEQ ID NO: 664382 - DNA, 25 bp, Rattus norvegicus
gtgcctcctcaaccgagccgagagt

SEQ ID NO: 664383 - DNA, 25 bp, Rattus norvegicus
ccctgggtctccttgtcattgtccg

SEQ ID NO: 664384 - DNA, 25 bp, Rattus norvegicus
tctgcgctttggagaagagcactcg

SEQ ID NO: 664385 - DNA, 25 bp, Rattus norvegicus
gctccagctcgtaggtctgcgcttt

SEQ ID NO: 664386 - DNA, 25 bp, Rattus norvegicus
agcccgggcacgtttcatcttgtag

SEQ ID NO: 664387 - DNA, 25 bp, Rattus norvegicus
tgtattgcatgtgctgcagcgactg

SEQ ID NO: 664388 - DNA, 25 bp, Rattus norvegicus
agagtcgatggaatctgccactcga

SEQ ID NO: 664389 - DNA, 25 bp, Rattus norvegicus
agggcctaaggcctccagtcttgga

SEQ ID NO: 664390 - DNA, 25 bp, Rattus norvegicus
caaccgtggtaaggatcgagtcctc

SEQ ID NO: 664391 - DNA, 25 bp, Rattus norvegicus
gccgagctgtactgggcgttgtatt

SEQ ID NO: 664392 - DNA, 25 bp, Rattus norvegicus
cattgtccggtgactcgtcagccga

SEQ ID NO: 664393 - DNA, 25 bp, Rattus norvegicus
cgccggagcaacaaaggggctccga

SEQ ID NO: 664394 - DNA, 25 bp, Rattus norvegicus
gcggtggacgacatccttggtcacc

SEQ ID NO: 664395 - DNA, 25 bp, Rattus norvegicus
tggacgacatccttggtcaccgcct

SEQ ID NO: 664396 - DNA, 25 bp, Rattus norvegicus
ccccggactgtgctgcgatggtaaa

SEQ ID NO: 664397 - DNA, 25 bp, Rattus norvegicus
cgatggtaaaaacggcagcggcgcc

SEQ ID NO: 664398 - DNA, 25 bp, Rattus norvegicus
ctgctcgaggtctgctcgccctcac

SEQ ID NO: 664399 - DNA, 25 bp, Rattus norvegicus
ttcttgcgggctcagcacgcaggcg

SEQ ID NO: 664400 - DNA, 25 bp, Rattus norvegicus
caaaggggctccgatacgcaggcgc

SEQ ID NO: 664401 - DNA, 25 bp, Rattus norvegicus
tctgctcgccctcacccggtgccct

SEQ ID NO: 664402 - DNA, 25 bp, Rattus norvegicus
tcggcgcagcgcacttgttcttgcg

SEQ ID NO: 664403 - DNA, 25 bp, Rattus norvegicus
cagcgcacttgttcttgcgggctca

SEQ ID NO: 664404 - DNA, 25 bp, Rattus norvegicus
cgcacttgttcttgcgggctcagca

SEQ ID NO: 664405 - DNA, 25 bp, Rattus norvegicus
gcacttgttcttgcgggctcagcac

SEQ ID NO: 664406 - DNA, 25 bp, Rattus norvegicus
caacaaaggggctccgatacgcagg

SEQ ID NO: 664407 - DNA, 25 bp, Rattus norvegicus
cccgtctttgtgttggtcagcgaca

SEQ ID NO: 664408 - DNA, 25 bp, Rattus norvegicus
tggtcagcgacatggttccggaccc

SEQ ID NO: 664409 - DNA, 25 bp, Rattus norvegicus
aatgaacgcagccacaaccgttgtg

SEQ ID NO: 664410 - DNA, 25 bp, Rattus norvegicus
ggtccaagatgtccttgactgaaaa

SEQ ID NO: 664411 - DNA, 25 bp, Rattus norvegicus
ggtgtccggaaggtccaagatgtcc

SEQ ID NO: 664412 - DNA, 25 bp, Rattus norvegicus
gccttcttcatcgttggtgtccgga

SEQ ID NO: 664413 - DNA, 25 bp, Rattus norvegicus
ggccaccgagccttcttcatcgttg

SEQ ID NO: 664414 - DNA, 25 bp, Rattus norvegicus
tctgcacagcatccaaggcgctctg

SEQ ID NO: 664415 - DNA, 25 bp, Rattus norvegicus
actcttaaggggcaggctctgcaca

SEQ ID NO: 664416 - DNA, 25 bp, Rattus norvegicus
gctgctgtcgtagaaaggactctta

SEQ ID NO: 664417 - DNA, 25 bp, Rattus norvegicus
tattggaggccctcggtgctggcca

SEQ ID NO: 664418 - DNA, 25 bp, Rattus norvegicus
cgctacttacgggagtattggaggc

SEQ ID NO: 664419 - DNA, 25 bp, Rattus norvegicus
cgttgtggccaagtttcgctactta

SEQ ID NO: 664420 - DNA, 25 bp, Rattus norvegicus
ccgggttacggcctcagcaatgaac

SEQ ID NO: 664421 - DNA, 25 bp, Rattus norvegicus
tgctagagccttgtgacagcgcctc

SEQ ID NO: 664422 - DNA, 25 bp, Rattus norvegicus
aatacaaaccgattgctaagctgcg

SEQ ID NO: 664423 - DNA, 25 bp, Rattus norvegicus
tggcccaggttggagcgagccccac

SEQ ID NO: 664424 - DNA, 25 bp, Rattus norvegicus
atgtgacgtgggtgacaatggccca

SEQ ID NO: 664425 - DNA, 25 bp, Rattus norvegicus
cccagtatgtgacgtgggtgacaat

SEQ ID NO: 664426 - DNA, 25 bp, Rattus norvegicus
ggctttctgcaactctctgctgcct

SEQ ID NO: 664427 - DNA, 25 bp, Rattus norvegicus
agcggctttctgcaactctctgctg

SEQ ID NO: 664428 - DNA, 25 bp, Rattus norvegicus
gctgctcagcggctttctgcaactc

SEQ ID NO: 664429 - DNA, 25 bp, Rattus norvegicus
ccgagctgctcagcggctttctgca

SEQ ID NO: 664430 - DNA, 25 bp, Rattus norvegicus
tccaagcgcacagctgcttgggccg

SEQ ID NO: 664431 - DNA, 25 bp, Rattus norvegicus
agagccttgtgacagcgcctcactc

SEQ ID NO: 664432 - DNA, 25 bp, Rattus norvegicus
ccgggttgctagagccttgtgacag

SEQ ID NO: 664433 - DNA, 25 bp, Rattus norvegicus
tcggacccgggcaaacacaaataca

SEQ ID NO: 664434 - DNA, 25 bp, Rattus norvegicus
tgtgacagcgcctcactccgagctg

SEQ ID NO: 664435 - DNA, 25 bp, Rattus norvegicus
gagccaggtctcgagtccacagatg

SEQ ID NO: 664436 - DNA, 25 bp, Rattus norvegicus
gtcgctgctagatcgcctctgcggt

SEQ ID NO: 664437 - DNA, 25 bp, Rattus norvegicus
ggttcagaggcgtagcaaggtccct

SEQ ID NO: 664438 - DNA, 25 bp, Rattus norvegicus
cctagtagttcagaggcttggttca

SEQ ID NO: 664439 - DNA, 25 bp, Rattus norvegicus
tgcttaccaagctgaatcgtgagtc

SEQ ID NO: 664440 - DNA, 25 bp, Rattus norvegicus
aatcgtgagtcaccagcggcgcaca

SEQ ID NO: 664441 - DNA, 25 bp, Rattus norvegicus
gtccttccttactgcagccagcaaa

SEQ ID NO: 664442 - DNA, 25 bp, Rattus norvegicus
taagatgcctggatctgcccacctg

SEQ ID NO: 664443 - DNA, 25 bp, Rattus norvegicus
ctggtgaccagccaagtccttggaa

SEQ ID NO: 664444 - DNA, 25 bp, Rattus norvegicus
tttctcaacgacagatgcgaccggg

SEQ ID NO: 664445 - DNA, 25 bp, Rattus norvegicus
gtctgtggcaggtaaaacttttctc

SEQ ID NO: 664446 - DNA, 25 bp, Rattus norvegicus
ttatctagtcctccacctaccggga

SEQ ID NO: 664447 - DNA, 25 bp, Rattus norvegicus
tccttgggattctggtctctgctta

SEQ ID NO: 664448 - DNA, 25 bp, Rattus norvegicus
tccacagatggacgagtgggtcgcc

SEQ ID NO: 664449 - DNA, 25 bp, Rattus norvegicus
cgtccaaacgtggaaaatacgagct

SEQ ID NO: 664450 - DNA, 25 bp, Rattus norvegicus
gccgcaatccggaaagttgaagaga

SEQ ID NO: 664451 - DNA, 25 bp, Rattus norvegicus
ctttcgctgcgtggggtttctccag

SEQ ID NO: 664452 - DNA, 25 bp, Rattus norvegicus
tcgttgctcgccgaactcagcgcaa

SEQ ID NO: 664453 - DNA, 25 bp, Rattus norvegicus
actcagcgcaagcaatactattttg

SEQ ID NO: 664454 - DNA, 25 bp, Rattus norvegicus
tactattttgtcacgtccaaacgtg

SEQ ID NO: 664455 - DNA, 25 bp, Rattus norvegicus
ttgcgcgcacctcacggaccattag

SEQ ID NO: 664456 - DNA, 25 bp, Rattus norvegicus
cggtggagaagaccaagccgcaatc

SEQ ID NO: 664457 - DNA, 25 bp, Rattus norvegicus
ttgaccactgcgtggtcgcagccgg

SEQ ID NO: 664458 - DNA, 25 bp, Rattus norvegicus
aagagacactttgccttctgcactc

SEQ ID NO: 664459 - DNA, 25 bp, Rattus norvegicus
tgccttctgcactccaacctttgag

SEQ ID NO: 664460 - DNA, 25 bp, Rattus norvegicus
tgcgcgggaacctgcaaaaccaagc

SEQ ID NO: 664461 - DNA, 25 bp, Rattus norvegicus
cccaagcctagacgtttgaccactg

SEQ ID NO: 664462 - DNA, 25 bp, Rattus norvegicus
acgagctttcttacctttgcgcgca

SEQ ID NO: 664463 - DNA, 25 bp, Rattus norvegicus
acgtacggcgaagtgaaccagcttg

SEQ ID NO: 664464 - DNA, 25 bp, Rattus norvegicus
tgccgagctggattgagactctcta

SEQ ID NO: 664465 - DNA, 25 bp, Rattus norvegicus
tctgtgacaagtacaacgtgccttc

SEQ ID NO: 664466 - DNA, 25 bp, Rattus norvegicus
cctggcatctttgcctgggagattc

SEQ ID NO: 664467 - DNA, 25 bp, Rattus norvegicus
atccgggactacaagcagggcgatc

SEQ ID NO: 664468 - DNA, 25 bp, Rattus norvegicus
ctgtgtgagcaaaatcctggcgcgc

SEQ ID NO: 664469 - DNA, 25 bp, Rattus norvegicus
accctgtgacatcagtaggcaactg

SEQ ID NO: 664470 - DNA, 25 bp, Rattus norvegicus
catccgcctgcgcatcgtggaatta

SEQ ID NO: 664471 - DNA, 25 bp, Rattus norvegicus
tgctcactcctatccggtgcgtctg

SEQ ID NO: 664472 - DNA, 25 bp, Rattus norvegicus
cagagtcgcgctagtgtgaagtaca

SEQ ID NO: 664473 - DNA, 25 bp, Rattus norvegicus
cctgactccgacttttgccagcatg

SEQ ID NO: 664474 - DNA, 25 bp, Rattus norvegicus
gaccaaagtcgcgtaggggcaccaa

SEQ ID NO: 664475 - DNA, 25 bp, Rattus norvegicus
cagaacaggctctatgtgctcagga

SEQ ID NO: 664476 - DNA, 25 bp, Rattus norvegicus
tagcacagctgggtatccgaccctg

SEQ ID NO: 664477 - DNA, 25 bp, Rattus norvegicus
ttcggccagtgcaccggcgcagttt

SEQ ID NO: 664478 - DNA, 25 bp, Rattus norvegicus
aactgggcggctccgttcggccagt

SEQ ID NO: 664479 - DNA, 25 bp, Rattus norvegicus
cttgattttagggacgcgtggctaa

SEQ ID NO: 664480 - DNA, 25 bp, Rattus norvegicus
agtgcaccggcgcagtttccgagtc

SEQ ID NO: 664481 - DNA, 25 bp, Rattus norvegicus
agtttccgagtcctggctcgcggca

SEQ ID NO: 664482 - DNA, 25 bp, Rattus norvegicus
ctcgcggcagtgcttcgaacccttt

SEQ ID NO: 664483 - DNA, 25 bp, Rattus norvegicus
tgcttcgaaccctttgcgcggcttt

SEQ ID NO: 664484 - DNA, 25 bp, Rattus norvegicus
gccatgcgcctagaacacacgcggt

SEQ ID NO: 664485 - DNA, 25 bp, Rattus norvegicus
atgggaacaactgggcggctccgtt

SEQ ID NO: 664486 - DNA, 25 bp, Rattus norvegicus
gcctagaacacacgcggtcagctca

SEQ ID NO: 664487 - DNA, 25 bp, Rattus norvegicus
acacacgcggtcagctcagtttagc

SEQ ID NO: 664488 - DNA, 25 bp, Rattus norvegicus
gctcagtttagctaaggtcgaagtg

SEQ ID NO: 664489 - DNA, 25 bp, Rattus norvegicus
tttagctaaggtcgaagtgggaatc

SEQ ID NO: 664490 - DNA, 25 bp, Rattus norvegicus
ggatgctgaaggaggcttgatttta

SEQ ID NO: 664491 - DNA, 25 bp, Rattus norvegicus
tgggctaggtgacccggcgccatca

SEQ ID NO: 664492 - DNA, 25 bp, Rattus norvegicus
acaagtaattgacggattcgaggcc

SEQ ID NO: 664493 - DNA, 25 bp, Rattus norvegicus
taaaaacgattagcctcgccttgcg

SEQ ID NO: 664494 - DNA, 25 bp, Rattus norvegicus
gccttgcattaccaccggaatgggg

SEQ ID NO: 664495 - DNA, 25 bp, Rattus norvegicus
gaggccttgcattaccaccggaatg

SEQ ID NO: 664496 - DNA, 25 bp, Rattus norvegicus
ttcgaggccttgcattaccaccgga

SEQ ID NO: 664497 - DNA, 25 bp, Rattus norvegicus
tgacggattcgaggccttgcattac

SEQ ID NO: 664498 - DNA, 25 bp, Rattus norvegicus
cactcgtctaatgacaagtaattga

SEQ ID NO: 664499 - DNA, 25 bp, Rattus norvegicus
ggcgacactcgtctaatgacaagta

SEQ ID NO: 664500 - DNA, 25 bp, Rattus norvegicus
ccggcgccatcaaaggctcgaggga

SEQ ID NO: 664501 - DNA, 25 bp, Rattus norvegicus
tttaattccgcggtagagtgggctg

SEQ ID NO: 664502 - DNA, 25 bp, Rattus norvegicus
caccttttaattccgcggtagagtg

SEQ ID NO: 664503 - DNA, 25 bp, Rattus norvegicus
gctctcaaaggccgggcacctttta

SEQ ID NO: 664504 - DNA, 25 bp, Rattus norvegicus
cgtggggcgacactcgtctaatgac

SEQ ID NO: 664505 - DNA, 25 bp, Rattus norvegicus
cgcctgcccgtacataggactcatg

SEQ ID NO: 664506 - DNA, 25 bp, Rattus norvegicus
acctcgcttgtgctcctgacacgga

SEQ ID NO: 664507 - DNA, 25 bp, Rattus norvegicus
tcctgacacggagaagcgctggaat

SEQ ID NO: 664508 - DNA, 25 bp, Rattus norvegicus
ctgaacctgagaagcctgtgtccca

SEQ ID NO: 664509 - DNA, 25 bp, Rattus norvegicus
tgcttccttcaacgccagttgcttc

SEQ ID NO: 664510 - DNA, 25 bp, Rattus norvegicus
ctcgctcagcgtcagcatcttgttg

SEQ ID NO: 664511 - DNA, 25 bp, Rattus norvegicus
gactcatggagttcatattggcgta

SEQ ID NO: 664512 - DNA, 25 bp, Rattus norvegicus
tcagactcggactcaggtgcggtcc

SEQ ID NO: 664513 - DNA, 25 bp, Rattus norvegicus
atgccagccagcgacgggctcattc

SEQ ID NO: 664514 - DNA, 25 bp, Rattus norvegicus
tccagcgcccacataggatgacatg

SEQ ID NO: 664515 - DNA, 25 bp, Rattus norvegicus
tgacatgttcatggagcctgcgctc

SEQ ID NO: 664516 - DNA, 25 bp, Rattus norvegicus
ctgcgctcatgttgccggaaccact

SEQ ID NO: 664517 - DNA, 25 bp, Rattus norvegicus
aggtgttcccttcagctcgctcagg

SEQ ID NO: 664518 - DNA, 25 bp, Rattus norvegicus
ggggcaccttgagaaagcagtcgtt

SEQ ID NO: 664519 - DNA, 25 bp, Rattus norvegicus
ggtggagtcccttcctttgcgtcca

SEQ ID NO: 664520 - DNA, 25 bp, Rattus norvegicus
ggacaagtgccgcaatgacgtgagc

SEQ ID NO: 664521 - DNA, 25 bp, Rattus norvegicus
cccgggcagcccatttgaataatca

SEQ ID NO: 664522 - DNA, 25 bp, Rattus norvegicus
tgaataatcagctcacacttaggtg

SEQ ID NO: 664523 - DNA, 25 bp, Rattus norvegicus
tcgtcaatccgaaggcgcgtaccgc

SEQ ID NO: 664524 - DNA, 25 bp, Rattus norvegicus
tcccaagacctggacctgcaagcag

SEQ ID NO: 664525 - DNA, 25 bp, Rattus norvegicus
tgtggacctcgcagcggacaagtgc

SEQ ID NO: 664526 - DNA, 25 bp, Rattus norvegicus
ggagtcttccgtggacccagagatc

SEQ ID NO: 664527 - DNA, 25 bp, Rattus norvegicus
cagagatctgggatcgggccaccct

SEQ ID NO: 664528 - DNA, 25 bp, Rattus norvegicus
gatcgggccacccttggagaaactc

SEQ ID NO: 664529 - DNA, 25 bp, Rattus norvegicus
gagaaactcaggtctcctgctcccg

SEQ ID NO: 664530 - DNA, 25 bp, Rattus norvegicus
tggagcaccgggttcgtcaatccga

SEQ ID NO: 664531 - DNA, 25 bp, Rattus norvegicus
cgaaggcgcgtaccgccttggtgcc

SEQ ID NO: 664532 - DNA, 25 bp, Rattus norvegicus
cacacttaggtgagaggaagccagg

SEQ ID NO: 664533 - DNA, 25 bp, Rattus norvegicus
ggctgaggtcttgtccctatcacga

SEQ ID NO: 664534 - DNA, 25 bp, Rattus norvegicus
ggtggtgacgtctactgcgctcaca

SEQ ID NO: 664535 - DNA, 25 bp, Rattus norvegicus
actgcgctcacaacgcacttgtgtg

SEQ ID NO: 664536 - DNA, 25 bp, Rattus norvegicus
agcctccttgctgtgacttcgacga

SEQ ID NO: 664537 - DNA, 25 bp, Rattus norvegicus
gcagtctgtcctgtcctgttcgcct

SEQ ID NO: 664538 - DNA, 25 bp, Rattus norvegicus
tccctatcacgatgccggtggtgtc

SEQ ID NO: 664539 - DNA, 25 bp, Rattus norvegicus
gccctcaggctttgacttgttcccg

SEQ ID NO: 664540 - DNA, 25 bp, Rattus norvegicus
gaggttcccgttcagtggcctcctc

SEQ ID NO: 664541 - DNA, 25 bp, Rattus norvegicus
caccactaggggtcggtccatgtgt

SEQ ID NO: 664542 - DNA, 25 bp, Rattus norvegicus
tgtcttcatgtctggcctcacgtgg

SEQ ID NO: 664543 - DNA, 25 bp, Rattus norvegicus
gtgctggcataacgcaggcgctcct

SEQ ID NO: 664544 - DNA, 25 bp, Rattus norvegicus
cttccttgcttgagtcctgtgcgtg

SEQ ID NO: 664545 - DNA, 25 bp, Rattus norvegicus
cgacgctcgcccttgggtacaagca

SEQ ID NO: 664546 - DNA, 25 bp, Rattus norvegicus
tgctttcggcctttgggcagtctgt

SEQ ID NO: 664547 - DNA, 25 bp, Rattus norvegicus
ccgtagccatacctccgcgaagtga

SEQ ID NO: 664548 - DNA, 25 bp, Rattus norvegicus
ctctccgacagagacaggtttggtc

SEQ ID NO: 664549 - DNA, 25 bp, Rattus norvegicus
tttggtcttgattccaggccctgga

SEQ ID NO: 664550 - DNA, 25 bp, Rattus norvegicus
agggacctccgggactctcagagcc

SEQ ID NO: 664551 - DNA, 25 bp, Rattus norvegicus
ttcagcggagggacctccgggactc

SEQ ID NO: 664552 - DNA, 25 bp, Rattus norvegicus
agattcccactacgcagatctcatc

SEQ ID NO: 664553 - DNA, 25 bp, Rattus norvegicus
cccaggatcctgatggtgaaagagt

SEQ ID NO: 664554 - DNA, 25 bp, Rattus norvegicus
agtttaggcgcagagccgtcttgcc

SEQ ID NO: 664555 - DNA, 25 bp, Rattus norvegicus
agagaacttctctgagtttaggcgc

SEQ ID NO: 664556 - DNA, 25 bp, Rattus norvegicus
cacagtgttcaccagagagaacttc

SEQ ID NO: 664557 - DNA, 25 bp, Rattus norvegicus
acctgccgatcgcacacagtgttca

SEQ ID NO: 664558 - DNA, 25 bp, Rattus norvegicus
agagtgggaaaacctgccgatcgca

SEQ ID NO: 664559 - DNA, 25 bp, Rattus norvegicus
gccgtcttgccgaagattcccacta

SEQ ID NO: 664560 - DNA, 25 bp, Rattus norvegicus
cccatgagaagctcgcgcaagctga

SEQ ID NO: 664561 - DNA, 25 bp, Rattus norvegicus
aacgagcttccggataggcccaggt

SEQ ID NO: 664562 - DNA, 25 bp, Rattus norvegicus
gaccggattgctcgtctcttagcga

SEQ ID NO: 664563 - DNA, 25 bp, Rattus norvegicus
gcggcgaccaaacctctaagctagc

SEQ ID NO: 664564 - DNA, 25 bp, Rattus norvegicus
catgtatgcggacgcggcgaccaaa

SEQ ID NO: 664565 - DNA, 25 bp, Rattus norvegicus
ctgcatctttggttccgcatgtatg

SEQ ID NO: 664566 - DNA, 25 bp, Rattus norvegicus
gctagaaaccgagtctgcatctttg

SEQ ID NO: 664567 - DNA, 25 bp, Rattus norvegicus
ttagcgacctgctagaaaccgagtc

SEQ ID NO: 664568 - DNA, 25 bp, Rattus norvegicus
aagagcgtgaagtagaccggattgc

SEQ ID NO: 664569 - DNA, 25 bp, Rattus norvegicus
gcaagcgtgcttccaaagagcgtga

SEQ ID NO: 664570 - DNA, 25 bp, Rattus norvegicus
agactctggtgaccgcggaagcata

SEQ ID NO: 664571 - DNA, 25 bp, Rattus norvegicus
cggtggccttcgtcttcatcttctc

SEQ ID NO: 664572 - DNA, 25 bp, Rattus norvegicus
cttggctttcttcctaacgagcttc

SEQ ID NO: 664573 - DNA, 25 bp, Rattus norvegicus
tctaagctagcattgccggctggcc

SEQ ID NO: 664574 - DNA, 25 bp, Rattus norvegicus
gcccgagccagcaaggaagagactc

SEQ ID NO: 664575 - DNA, 25 bp, Rattus norvegicus
cagtgcatctatgcgctcgtgtgtc

SEQ ID NO: 664576 - DNA, 25 bp, Rattus norvegicus
acaacttggcgaagctggcagcatg

SEQ ID NO: 664577 - DNA, 25 bp, Rattus norvegicus
tcttcgggcgaagcagaccgcaact

SEQ ID NO: 664578 - DNA, 25 bp, Rattus norvegicus
ggacagcgggcatggtaactatcca

SEQ ID NO: 664579 - DNA, 25 bp, Rattus norvegicus
cctggtaggaaacgccctggtcata

SEQ ID NO: 664580 - DNA, 25 bp, Rattus norvegicus
cgccctggtcatattcgtgatccta

SEQ ID NO: 664581 - DNA, 25 bp, Rattus norvegicus
gccgtcgctgatgagctcttcatgc

SEQ ID NO: 664582 - DNA, 25 bp, Rattus norvegicus
tcatgctcagtgtgccatttgtggc

SEQ ID NO: 664583 - DNA, 25 bp, Rattus norvegicus
agtgcttagtgtggacggccttaac

SEQ ID NO: 664584 - DNA, 25 bp, Rattus norvegicus
cggccttaacatgttcacgagtgtc

SEQ ID NO: 664585 - DNA, 25 bp, Rattus norvegicus
acgagtgtcttctgcctcacagtgc

SEQ ID NO: 664586 - DNA, 25 bp, Rattus norvegicus
tcacagtgctcagcgtggatcgcta

SEQ ID NO: 664587 - DNA, 25 bp, Rattus norvegicus
cgtgatcctacgctatgccaaaatg

SEQ ID NO: 664588 - DNA, 25 bp, Rattus norvegicus
cctcttggtccttggttcagcgttc

SEQ ID NO: 664589 - DNA, 25 bp, Rattus norvegicus
agggccgtgagtccatactactgtc

SEQ ID NO: 664590 - DNA, 25 bp, Rattus norvegicus
agcgctcctgttgcacatgtactcg

SEQ ID NO: 664591 - DNA, 25 bp, Rattus norvegicus
tgcagttccaagctcctgtcacttc

SEQ ID NO: 664592 - DNA, 25 bp, Rattus norvegicus
cgagtccagtgtccctctgaagttc

SEQ ID NO: 664593 - DNA, 25 bp, Rattus norvegicus
tgcacaccagctccaagccaaaggg

SEQ ID NO: 664594 - DNA, 25 bp, Rattus norvegicus
ggcgccacggtagcagaactgccta

SEQ ID NO: 664595 - DNA, 25 bp, Rattus norvegicus
tgcctatcggcagcgtctgaaaatc

SEQ ID NO: 664596 - DNA, 25 bp, Rattus norvegicus
ggcaccctcaggatctcgggtattc

SEQ ID NO: 664597 - DNA, 25 bp, Rattus norvegicus
cccgtaaaggcctgcagaaagctgc

SEQ ID NO: 664598 - DNA, 25 bp, Rattus norvegicus
ctgttgctgttgagaccgtgacgca

SEQ ID NO: 664599 - DNA, 25 bp, Rattus norvegicus
ccctgagggagctgtaaaccgatcc

SEQ ID NO: 664600 - DNA, 25 bp, Rattus norvegicus
cgctcaccagaagggagatgacatc

SEQ ID NO: 664601 - DNA, 25 bp, Rattus norvegicus
ccgaggagcgcactgtcatcaaatg

SEQ ID NO: 664602 - DNA, 25 bp, Rattus norvegicus
acctgctgtaactggtgtggttatc

SEQ ID NO: 664603 - DNA, 25 bp, Rattus norvegicus
gtcgcctaggcgacgttgaccgaga

SEQ ID NO: 664604 - DNA, 25 bp, Rattus norvegicus
cagtctttctactggctcccgtagc

SEQ ID NO: 664605 - DNA, 25 bp, Rattus norvegicus
gccgtccaatcagagctcgctcaat

SEQ ID NO: 664606 - DNA, 25 bp, Rattus norvegicus
agagctcgctcaatcggatcttttg

SEQ ID NO: 664607 - DNA, 25 bp, Rattus norvegicus
caatcggatcttttgggctcgcgcc

SEQ ID NO: 664608 - DNA, 25 bp, Rattus norvegicus
accgagcaggtaagtgggcgctcct

SEQ ID NO: 664609 - DNA, 25 bp, Rattus norvegicus
accctgattttgcagccacacttgg

SEQ ID NO: 664610 - DNA, 25 bp, Rattus norvegicus
gaaccgagacgctagcgcctgcgca

SEQ ID NO: 664611 - DNA, 25 bp, Rattus norvegicus
cgggaagctgctaccggcgcctaac

SEQ ID NO: 664612 - DNA, 25 bp, Rattus norvegicus
gcctcctggacgtcggctcttcagg

SEQ ID NO: 664613 - DNA, 25 bp, Rattus norvegicus
tcttcaggcggagcctctaggagga

SEQ ID NO: 664614 - DNA, 25 bp, Rattus norvegicus
gagagaaactcttctggcccgggac

SEQ ID NO: 664615 - DNA, 25 bp, Rattus norvegicus
ttgaccgagaccgagcaggtaagtg

SEQ ID NO: 664616 - DNA, 25 bp, Rattus norvegicus
ccggaagccaccctgattttgcagc

SEQ ID NO: 664617 - DNA, 25 bp, Rattus norvegicus
ctctggcctctgtcccttggagcgg

SEQ ID NO: 664618 - DNA, 25 bp, Rattus norvegicus
gccttggatagccacgggtggtaaa

SEQ ID NO: 664619 - DNA, 25 bp, Rattus norvegicus
gtgctgccgactgggtcgtcttcta

SEQ ID NO: 664620 - DNA, 25 bp, Rattus norvegicus
gtccgctgttcctgcgggcctgagc

SEQ ID NO: 664621 - DNA, 25 bp, Rattus norvegicus
ttgtggcgaccaatccgcggaccct

SEQ ID NO: 664622 - DNA, 25 bp, Rattus norvegicus
gcgcagcaccttcctagccttttgg

SEQ ID NO: 664623 - DNA, 25 bp, Rattus norvegicus
agcaccttcctagccttttggggcg

SEQ ID NO: 664624 - DNA, 25 bp, Rattus norvegicus
ggatcacgtaactcaacggccggaa

SEQ ID NO: 664625 - DNA, 25 bp, Rattus norvegicus
gcccaaactcacgtaggatcacgta

SEQ ID NO: 664626 - DNA, 25 bp, Rattus norvegicus
gggatctgctagctcttctccctgc

SEQ ID NO: 664627 - DNA, 25 bp, Rattus norvegicus
ggtcgtcttctaggctgtcctctgg

SEQ ID NO: 664628 - DNA, 25 bp, Rattus norvegicus
ccacgggtggtaaatccgggatctg

SEQ ID NO: 664629 - DNA, 25 bp, Rattus norvegicus
taaatccgggatctgctagctcttc

SEQ ID NO: 664630 - DNA, 25 bp, Rattus norvegicus
cggaaccgcctttgcagctggaggt

SEQ ID NO: 664631 - DNA, 25 bp, Rattus norvegicus
aaagcctcctctgctgacttgcgag

SEQ ID NO: 664632 - DNA, 25 bp, Rattus norvegicus
tcgttctttccctgcgttgtccatg

SEQ ID NO: 664633 - DNA, 25 bp, Rattus norvegicus
tgtagtcctacgctccaccttaacg

SEQ ID NO: 664634 - DNA, 25 bp, Rattus norvegicus
gttgtccatgtcaccggctgcagct

SEQ ID NO: 664635 - DNA, 25 bp, Rattus norvegicus
agctggaccgcttctcgttctttcc

SEQ ID NO: 664636 - DNA, 25 bp, Rattus norvegicus
tggccttccgggatctgtagtccta

SEQ ID NO: 664637 - DNA, 25 bp, Rattus norvegicus
ccctaagcaactgcgcggggtactc

SEQ ID NO: 664638 - DNA, 25 bp, Rattus norvegicus
gctccaccttaacggcggctgtgtc

SEQ ID NO: 664639 - DNA, 25 bp, Rattus norvegicus
gcggctgtgtcagagaccacaacta

SEQ ID NO: 664640 - DNA, 25 bp, Rattus norvegicus
tccctctagcaggtgccaatacgca

SEQ ID NO: 664641 - DNA, 25 bp, Rattus norvegicus
cctaagggcaagacctctggtgctc

SEQ ID NO: 664642 - DNA, 25 bp, Rattus norvegicus
ggaatcctggtaccctaagcaactg

SEQ ID NO: 664643 - DNA, 25 bp, Rattus norvegicus
aacagcgtgggccactgggaatcct

SEQ ID NO: 664644 - DNA, 25 bp, Rattus norvegicus
tgggaagccttcactcgcttctcgg

SEQ ID NO: 664645 - DNA, 25 bp, Rattus norvegicus
ctcaccacctgtatggcgcggctgt

SEQ ID NO: 664646 - DNA, 25 bp, Rattus norvegicus
ggggacacgtacctgcttacgagct

SEQ ID NO: 664647 - DNA, 25 bp, Rattus norvegicus
ggcgaagtccaacgctcgctgcacg

SEQ ID NO: 664648 - DNA, 25 bp, Rattus norvegicus
tgcttacgagctctcaccacctgta

SEQ ID NO: 664649 - DNA, 25 bp, Rattus norvegicus
tcgctggcatctgcctcctgcggag

SEQ ID NO: 664650 - DNA, 25 bp, Rattus norvegicus
tgcggagctcccaacaatcgcgggg

SEQ ID NO: 664651 - DNA, 25 bp, Rattus norvegicus
gccacggccaggacggccagcagta

SEQ ID NO: 664652 - DNA, 25 bp, Rattus norvegicus
ggacggccagcagtagcatcaagga

SEQ ID NO: 664653 - DNA, 25 bp, Rattus norvegicus
ccatggttccgcaggacagagtcgg

SEQ ID NO: 664654 - DNA, 25 bp, Rattus norvegicus
cgcggctgtggtacgcatcgttgct

SEQ ID NO: 664655 - DNA, 25 bp, Rattus norvegicus
acgcatcgttgctgcccttgttgta

SEQ ID NO: 664656 - DNA, 25 bp, Rattus norvegicus
ctgcccttgttgtactcgcttacgg

SEQ ID NO: 664657 - DNA, 25 bp, Rattus norvegicus
tcgcttacggcgaagtccaacgctc

SEQ ID NO: 664658 - DNA, 25 bp, Rattus norvegicus
cagcagtagcatcaaggagcgcagc

SEQ ID NO: 664659 - DNA, 25 bp, Rattus norvegicus
ctagtgagtctgtgtcctgagttcg

SEQ ID NO: 664660 - DNA, 25 bp, Rattus norvegicus
ccgcggtaagtcctagagggtagca

SEQ ID NO: 664661 - DNA, 25 bp, Rattus norvegicus
caccttgggtacacaggcagcctga

SEQ ID NO: 664662 - DNA, 25 bp, Rattus norvegicus
ccagccactatcactggcaagggta

SEQ ID NO: 664663 - DNA, 25 bp, Rattus norvegicus
cgacgtcggttagagctagtgagtc

SEQ ID NO: 664664 - DNA, 25 bp, Rattus norvegicus
gacaggaacccgtactattggccca

SEQ ID NO: 664665 - DNA, 25 bp, Rattus norvegicus
cgggtcaccttgtcccagaggtaag

SEQ ID NO: 664666 - DNA, 25 bp, Rattus norvegicus
cagccctgcgttcggctctcgggaa

SEQ ID NO: 664667 - DNA, 25 bp, Rattus norvegicus
ccctttgtgctcctaggggccaaga

SEQ ID NO: 664668 - DNA, 25 bp, Rattus norvegicus
gagtggaacggtacatcccgggtca

SEQ ID NO: 664669 - DNA, 25 bp, Rattus norvegicus
aggctcccggagaccaaagagtgga

SEQ ID NO: 664670 - DNA, 25 bp, Rattus norvegicus
ctggagcaaagttggcggccacctt

SEQ ID NO: 664671 - DNA, 25 bp, Rattus norvegicus
aagggtacagctggcctggagcaaa

SEQ ID NO: 664672 - DNA, 25 bp, Rattus norvegicus
tattggcccaggctgcaacttggcg

SEQ ID NO: 664673 - DNA, 25 bp, Rattus norvegicus
agctcaggagcaaggcggctagacc

SEQ ID NO: 664674 - DNA, 25 bp, Rattus norvegicus
ggagataatcttgcgctacttgcta

SEQ ID NO: 664675 - DNA, 25 bp, Rattus norvegicus
gaggccgttctgctgcctggcgcat

SEQ ID NO: 664676 - DNA, 25 bp, Rattus norvegicus
acgctaagcctcttggcgaggtccc

SEQ ID NO: 664677 - DNA, 25 bp, Rattus norvegicus
gcgaccggctccaaggacgctaagc

SEQ ID NO: 664678 - DNA, 25 bp, Rattus norvegicus
cttgctacttgtgggagcaggcgac

SEQ ID NO: 664679 - DNA, 25 bp, Rattus norvegicus
gccgccctaggagatggccttgtca

SEQ ID NO: 664680 - DNA, 25 bp, Rattus norvegicus
ggtgctcagcaaacgctcagcggtg

SEQ ID NO: 664681 - DNA, 25 bp, Rattus norvegicus
tgcaagcccgaggtgctcagcaaac

SEQ ID NO: 664682 - DNA, 25 bp, Rattus norvegicus
aagagctggaccgttgcaagcccga

SEQ ID NO: 664683 - DNA, 25 bp, Rattus norvegicus
ggggcacgatctgtactgccagttg

SEQ ID NO: 664684 - DNA, 25 bp, Rattus norvegicus
cgcggccatcttgtctccagaggaa

SEQ ID NO: 664685 - DNA, 25 bp, Rattus norvegicus
ctgccagttgctggagataatcttg

SEQ ID NO: 664686 - DNA, 25 bp, Rattus norvegicus
tctccagaggaagagctggaccgtt

SEQ ID NO: 664687 - DNA, 25 bp, Rattus norvegicus
tcagagcgaggccaccgggccgtgg

SEQ ID NO: 664688 - DNA, 25 bp, Rattus norvegicus
ctgtcgacgatgatgctcccgtggg

SEQ ID NO: 664689 - DNA, 25 bp, Rattus norvegicus
cctgtcgacgatgatgctcccgtgg

SEQ ID NO: 664690 - DNA, 25 bp, Rattus norvegicus
ggcctgtcgacgatgatgctcccgt

SEQ ID NO: 664691 - DNA, 25 bp, Rattus norvegicus
cccggggcctgtcgacgatgatgct

SEQ ID NO: 664692 - DNA, 25 bp, Rattus norvegicus
tgcagcgcctctgagcagggtaggt

SEQ ID NO: 664693 - DNA, 25 bp, Rattus norvegicus
cggctgcggtcagagcgaggccacc

SEQ ID NO: 664694 - DNA, 25 bp, Rattus norvegicus
aggccgagcaggatgagccctgtcc

SEQ ID NO: 664695 - DNA, 25 bp, Rattus norvegicus
gctgagcacgggttctccaagtggg

SEQ ID NO: 664696 - DNA, 25 bp, Rattus norvegicus
acgggctgagcacgggttctccaag

SEQ ID NO: 664697 - DNA, 25 bp, Rattus norvegicus
tgtcccggggcctgtcgacgatgat

SEQ ID NO: 664698 - DNA, 25 bp, Rattus norvegicus
agcacgggctgagcacgggttctcc

SEQ ID NO: 664699 - DNA, 25 bp, Rattus norvegicus
ccgagcaggatgagccctgtccggc

SEQ ID NO: 664700 - DNA, 25 bp, Rattus norvegicus
caggatgagccctgtccggcgagct

SEQ ID NO: 664701 - DNA, 25 bp, Rattus norvegicus
ggtccactgtgcacctactcgtagg

SEQ ID NO: 664702 - DNA, 25 bp, Rattus norvegicus
cacctactcgtaggcgagctggggc

SEQ ID NO: 664703 - DNA, 25 bp, Rattus norvegicus
cggagaaattcaggtccactgtgca

SEQ ID NO: 664704 - DNA, 25 bp, Rattus norvegicus
cttccttgctcggtagatcgccgcg

SEQ ID NO: 664705 - DNA, 25 bp, Rattus norvegicus
atcagtgttctctttattcccgccc

SEQ ID NO: 664706 - DNA, 25 bp, Rattus norvegicus
tggggcagtctgaaacaggacgcta

SEQ ID NO: 664707 - DNA, 25 bp, Rattus norvegicus
gaggggccttgtggttctccatcag

SEQ ID NO: 664708 - DNA, 25 bp, Rattus norvegicus
ttcctctgtgcaaggagagcccggg

SEQ ID NO: 664709 - DNA, 25 bp, Rattus norvegicus
ccacttccattcctctgtgcaagga

SEQ ID NO: 664710 - DNA, 25 bp, Rattus norvegicus
tgctttccagatgcccacttccatt

SEQ ID NO: 664711 - DNA, 25 bp, Rattus norvegicus
aggacgctagacttgcccgagaaac

SEQ ID NO: 664712 - DNA, 25 bp, Rattus norvegicus
aggtccggccgtctgctttccagat

SEQ ID NO: 664713 - DNA, 25 bp, Rattus norvegicus
ttgcccgagaaacttgcccgcggtc

SEQ ID NO: 664714 - DNA, 25 bp, Rattus norvegicus
ggggaccgagcctggagctccttcc

SEQ ID NO: 664715 - DNA, 25 bp, Rattus norvegicus
agaagccgcagatcggcgagcagta

SEQ ID NO: 664716 - DNA, 25 bp, Rattus norvegicus
agctccgcgagcagggcaggtgccg

SEQ ID NO: 664717 - DNA, 25 bp, Rattus norvegicus
ggctgtgccccgaagccgcagagga

SEQ ID NO: 664718 - DNA, 25 bp, Rattus norvegicus
cagatcggcgagcagtaggcagcgt

SEQ ID NO: 664719 - DNA, 25 bp, Rattus norvegicus
cagaagccgcagatcggcgagcagt

SEQ ID NO: 664720 - DNA, 25 bp, Rattus norvegicus
cgacagcaggctcgggtcctgcagg

SEQ ID NO: 664721 - DNA, 25 bp, Rattus norvegicus
cgggctctgggcgacagcaggctcg

SEQ ID NO: 664722 - DNA, 25 bp, Rattus norvegicus
ttctcactgcgctgctggctgccga

SEQ ID NO: 664723 - DNA, 25 bp, Rattus norvegicus
gatgttctcactgcgctgctggctg

SEQ ID NO: 664724 - DNA, 25 bp, Rattus norvegicus
agatgttctcactgcgctgctggct

SEQ ID NO: 664725 - DNA, 25 bp, Rattus norvegicus
tggagatgttctcactgcgctgctg

SEQ ID NO: 664726 - DNA, 25 bp, Rattus norvegicus
cgtggagatgttctcactgcgctgc

SEQ ID NO: 664727 - DNA, 25 bp, Rattus norvegicus
gacgtggagatgttctcactgcgct

SEQ ID NO: 664728 - DNA, 25 bp, Rattus norvegicus
cgagcagtaggcagcgtgcgcgagc

SEQ ID NO: 664729 - DNA, 25 bp, Rattus norvegicus
actcacggagaatgcgcgtctgccc

SEQ ID NO: 664730 - DNA, 25 bp, Rattus norvegicus
ccttggccagaggtgatgtgactca

SEQ ID NO: 664731 - DNA, 25 bp, Rattus norvegicus
gctaatcaccgcctctcccacaagg

SEQ ID NO: 664732 - DNA, 25 bp, Rattus norvegicus
gtggacacgtccctttgtgcgcgcc

SEQ ID NO: 664733 - DNA, 25 bp, Rattus norvegicus
cggtgctgcgcgcagcgttcagcat

SEQ ID NO: 664734 - DNA, 25 bp, Rattus norvegicus
cgcgcagcgttcagcatgagcggct

SEQ ID NO: 664735 - DNA, 25 bp, Rattus norvegicus
cgttcagcatgagcggctcggtcgc

SEQ ID NO: 664736 - DNA, 25 bp, Rattus norvegicus
gcatgacatggtggtaccggtggct

SEQ ID NO: 664737 - DNA, 25 bp, Rattus norvegicus
caggcctgcagtccgccgcctcgaa

SEQ ID NO: 664738 - DNA, 25 bp, Rattus norvegicus
cgcctcgaaggctacagccaagctg

SEQ ID NO: 664739 - DNA, 25 bp, Rattus norvegicus
cagccaagctgttctggccttggcc

SEQ ID NO: 664740 - DNA, 25 bp, Rattus norvegicus
atgtgactcacggagaatgcgcgtc

SEQ ID NO: 664741 - DNA, 25 bp, Rattus norvegicus
ccagaggtgatgtgactcacggaga

SEQ ID NO: 664742 - DNA, 25 bp, Rattus norvegicus
aaggctacagccaagctgttctggc

SEQ ID NO: 664743 - DNA, 25 bp, Rattus norvegicus
agcttccgtcatgcagcctaggata

SEQ ID NO: 664744 - DNA, 25 bp, Rattus norvegicus
aggatagacccgagcttccgtcatg

SEQ ID NO: 664745 - DNA, 25 bp, Rattus norvegicus
gcctaggatagacccgagctttcgt

SEQ ID NO: 664746 - DNA, 25 bp, Rattus norvegicus
agctttcgtcatgcagcctaggata

SEQ ID NO: 664747 - DNA, 25 bp, Rattus norvegicus
tcgtcatgcagcctaggatagaccc

SEQ ID NO: 664748 - DNA, 25 bp, Rattus norvegicus
acccgagctttcgtcatgcagccta

SEQ ID NO: 664749 - DNA, 25 bp, Rattus norvegicus
tagacccgagcttccgtcatgcagc

SEQ ID NO: 664750 - DNA, 25 bp, Rattus norvegicus
ccgtcatgcagcctaggatagaccc

SEQ ID NO: 664751 - DNA, 25 bp, Rattus norvegicus
agcctaggatagacccgagctttcg

SEQ ID NO: 664752 - DNA, 25 bp, Rattus norvegicus
cgagctttcgtcatgcagcctagga

SEQ ID NO: 664753 - DNA, 25 bp, Rattus norvegicus
gcagcctaggatagacccgagcttt

SEQ ID NO: 664754 - DNA, 25 bp, Rattus norvegicus
tagacccgagctttcatcatgcagc

SEQ ID NO: 664755 - DNA, 25 bp, Rattus norvegicus
ctttcatcatgcagcctaggataga

SEQ ID NO: 664756 - DNA, 25 bp, Rattus norvegicus
catgcagcctaggatagacccgagc

SEQ ID NO: 664757 - DNA, 25 bp, Rattus norvegicus
accagcacagagaagcgcgagggtt

SEQ ID NO: 664758 - DNA, 25 bp, Rattus norvegicus
tgacgtacaacttagcgccggagct

SEQ ID NO: 664759 - DNA, 25 bp, Rattus norvegicus
tgtgctctgtcagtacgaacccggc

SEQ ID NO: 664760 - DNA, 25 bp, Rattus norvegicus
cgaacccggctccacggtcaaagtg

SEQ ID NO: 664761 - DNA, 25 bp, Rattus norvegicus
agaagggatgattccagcccagtcc

SEQ ID NO: 664762 - DNA, 25 bp, Rattus norvegicus
ttgacctccgggacctggccatcgt

SEQ ID NO: 664763 - DNA, 25 bp, Rattus norvegicus
ccttggcgcgaggaaatgacgtaca

SEQ ID NO: 664764 - DNA, 25 bp, Rattus norvegicus
gtttcagaaccgtcccttggcgcga

SEQ ID NO: 664765 - DNA, 25 bp, Rattus norvegicus
ccctttttggagattggcacagcag

SEQ ID NO: 664766 - DNA, 25 bp, Rattus norvegicus
attggcacagcagtgcggctccacc

SEQ ID NO: 664767 - DNA, 25 bp, Rattus norvegicus
agcctccagccgtgagcggaaaata

SEQ ID NO: 664768 - DNA, 25 bp, Rattus norvegicus
ccctcagtccgccaagtctggattg

SEQ ID NO: 664769 - DNA, 25 bp, Rattus norvegicus
gccaagtctggattgctgggctgca

SEQ ID NO: 664770 - DNA, 25 bp, Rattus norvegicus
tggccatcgtccgtgatgacctgcg

SEQ ID NO: 664771 - DNA, 25 bp, Rattus norvegicus
tcgctgttcacagaccagataactt

SEQ ID NO: 664772 - DNA, 25 bp, Rattus norvegicus
ctgggctgcctgagcgctcaaagcg

SEQ ID NO: 664773 - DNA, 25 bp, Rattus norvegicus
cctgagcgctcaaagcggggtacga

SEQ ID NO: 664774 - DNA, 25 bp, Rattus norvegicus
ctcaaagcggggtacgagcctagct

SEQ ID NO: 664775 - DNA, 25 bp, Rattus norvegicus
tacgagcctagctgcgctgctgcag

SEQ ID NO: 664776 - DNA, 25 bp, Rattus norvegicus
aacactgcccaggaatcgggtggtg

SEQ ID NO: 664777 - DNA, 25 bp, Rattus norvegicus
tccagcgggacaggctcagcaacca

SEQ ID NO: 664778 - DNA, 25 bp, Rattus norvegicus
ccgattgtcccgagtgcccgtgcag

SEQ ID NO: 664779 - DNA, 25 bp, Rattus norvegicus
agtgcccgtgcaggccacgcagcag

SEQ ID NO: 664780 - DNA, 25 bp, Rattus norvegicus
cgcgaagcagcttccttgagcctgc

SEQ ID NO: 664781 - DNA, 25 bp, Rattus norvegicus
gctagcccgcgctctcggcttcagt

SEQ ID NO: 664782 - DNA, 25 bp, Rattus norvegicus
tgcgtttctgcgatcgctgttcaca

SEQ ID NO: 664783 - DNA, 25 bp, Rattus norvegicus
agaccagataactttcccgcttgcg

SEQ ID NO: 664784 - DNA, 25 bp, Rattus norvegicus
cggcttcagtttcctgcgtttctgc

SEQ ID NO: 664785 - DNA, 25 bp, Rattus norvegicus
tggagcttcacagttggatcttagc

SEQ ID NO: 664786 - DNA, 25 bp, Rattus norvegicus
tgcctccaatcccagcaggtcgttg

SEQ ID NO: 664787 - DNA, 25 bp, Rattus norvegicus
tccaatcccagcaggtcgttgatgg

SEQ ID NO: 664788 - DNA, 25 bp, Rattus norvegicus
ggccctgttgcctccgctggagctt

SEQ ID NO: 664789 - DNA, 25 bp, Rattus norvegicus
cctccgctggagcttcacagttgga

SEQ ID NO: 664790 - DNA, 25 bp, Rattus norvegicus
cacagttggatcttagcccaggctc

SEQ ID NO: 664791 - DNA, 25 bp, Rattus norvegicus
ggagtcggcaggtctgcctccaatc

SEQ ID NO: 664792 - DNA, 25 bp, Rattus norvegicus
tggatcttagcccaggctccgctgg

SEQ ID NO: 664793 - DNA, 25 bp, Rattus norvegicus
tggaacgcccatccaaaagcccatc

SEQ ID NO: 664794 - DNA, 25 bp, Rattus norvegicus
agggctctactcctggaacgcccat

SEQ ID NO: 664795 - DNA, 25 bp, Rattus norvegicus
tggcgccagggctctactcctggaa

SEQ ID NO: 664796 - DNA, 25 bp, Rattus norvegicus
atggcgaagcttcgaaggcgagagc

SEQ ID NO: 664797 - DNA, 25 bp, Rattus norvegicus
cagcaggtcgttgatggcgaagctt

SEQ ID NO: 664798 - DNA, 25 bp, Rattus norvegicus
ttagcccaggctccgctggagtcgg

SEQ ID NO: 664799 - DNA, 25 bp, Rattus norvegicus
gatgactgactacggttggtctccc

SEQ ID NO: 664800 - DNA, 25 bp, Rattus norvegicus
ggtacgccactacatgtcctgaggg

SEQ ID NO: 664801 - DNA, 25 bp, Rattus norvegicus
agcgaaatgtgcttggccctgatga

SEQ ID NO: 664802 - DNA, 25 bp, Rattus norvegicus
cgtggctggcaagcaccacagcgca

SEQ ID NO: 664803 - DNA, 25 bp, Rattus norvegicus
gtaagcggagccagcgaaatgtgct

SEQ ID NO: 664804 - DNA, 25 bp, Rattus norvegicus
gtggtcgctgtctgcctccaggtac

SEQ ID NO: 664805 - DNA, 25 bp, Rattus norvegicus
actggcgctggagagccaagcgctc

SEQ ID NO: 664806 - DNA, 25 bp, Rattus norvegicus
ttccacgcgttgaggctctgttgac

SEQ ID NO: 664807 - DNA, 25 bp, Rattus norvegicus
cggctaaggtctggttccacgcgtt

SEQ ID NO: 664808 - DNA, 25 bp, Rattus norvegicus
gctcctcccgatcggctaaggtctg

SEQ ID NO: 664809 - DNA, 25 bp, Rattus norvegicus
gtaggcggagacagctcctcccgat

SEQ ID NO: 664810 - DNA, 25 bp, Rattus norvegicus
cgcaaagtgcacgtaggcggagaca

SEQ ID NO: 664811 - DNA, 25 bp, Rattus norvegicus
aacccacccggtgacgcaaagtgca

SEQ ID NO: 664812 - DNA, 25 bp, Rattus norvegicus
ttggccctgatgactgactacggtt

SEQ ID NO: 664813 - DNA, 25 bp, Rattus norvegicus
agtagagttaagcatcctccttcga

SEQ ID NO: 664814 - DNA, 25 bp, Rattus norvegicus
tacttcttcgctctggcacacacgg

SEQ ID NO: 664815 - DNA, 25 bp, Rattus norvegicus
tctacctcatctggcgccatggcga

SEQ ID NO: 664816 - DNA, 25 bp, Rattus norvegicus
gcgaagccattgacggacagtgaga

SEQ ID NO: 664817 - DNA, 25 bp, Rattus norvegicus
agcagatcagtgtgcgtggcatcgc

SEQ ID NO: 664818 - DNA, 25 bp, Rattus norvegicus
cggaagagcttcaacaggcacctgc

SEQ ID NO: 664819 - DNA, 25 bp, Rattus norvegicus
aggcacctgcacttcacgctggtca

SEQ ID NO: 664820 - DNA, 25 bp, Rattus norvegicus
cacacggttcgcgaccacctagtgg

SEQ ID NO: 664821 - DNA, 25 bp, Rattus norvegicus
ggatccgcacgcaacagcattacta

SEQ ID NO: 664822 - DNA, 25 bp, Rattus norvegicus
ctggtccctgttgctctgtggtcat

SEQ ID NO: 664823 - DNA, 25 bp, Rattus norvegicus
cctccttcgaaggacgcgtgcgtac

SEQ ID NO: 664824 - DNA, 25 bp, Rattus norvegicus
gcgccagagacgctgcagcatctca

SEQ ID NO: 664825 - DNA, 25 bp, Rattus norvegicus
agcatctcagcactagaggcttctc

SEQ ID NO: 664826 - DNA, 25 bp, Rattus norvegicus
agaccgagcttaagcagggcgtgcc

SEQ ID NO: 664827 - DNA, 25 bp, Rattus norvegicus
ttgcccgccagacgcaggttctgct

SEQ ID NO: 664828 - DNA, 25 bp, Rattus norvegicus
gccaatcagcgcacgactcccggaa

SEQ ID NO: 664829 - DNA, 25 bp, Rattus norvegicus
gatggaaccgtgtgatgctctcgca

SEQ ID NO: 664830 - DNA, 25 bp, Rattus norvegicus
ccgtgtgatgctctcgcagcagatc

SEQ ID NO: 664831 - DNA, 25 bp, Rattus norvegicus
tctcgcagcagatccctgaaggtgg

SEQ ID NO: 664832 - DNA, 25 bp, Rattus norvegicus
gactacctgccctccaggtgaggga

SEQ ID NO: 664833 - DNA, 25 bp, Rattus norvegicus
ccaggtgagggacccgcgcatgttc

SEQ ID NO: 664834 - DNA, 25 bp, Rattus norvegicus
tgcttcaagctgcagtcggcgtcca

SEQ ID NO: 664835 - DNA, 25 bp, Rattus norvegicus
cggcgcagcgctcatgctccaaggt

SEQ ID NO: 664836 - DNA, 25 bp, Rattus norvegicus
cgctcatgctccaaggtgacgggct

SEQ ID NO: 664837 - DNA, 25 bp, Rattus norvegicus
tgacgggctcggtccgcttcctcat

SEQ ID NO: 664838 - DNA, 25 bp, Rattus norvegicus
tgggagcccactgctggtcacatcc

SEQ ID NO: 664839 - DNA, 25 bp, Rattus norvegicus
cagacgcaggttctgcttcaagctg

SEQ ID NO: 664840 - DNA, 25 bp, Rattus norvegicus
gcagctttccgcaccctggtttcga

SEQ ID NO: 664841 - DNA, 25 bp, Rattus norvegicus
agctgccactcgcttgtgtatgccg

SEQ ID NO: 664842 - DNA, 25 bp, Rattus norvegicus
tcctcagcctggaagaaaacacgtc

SEQ ID NO: 664843 - DNA, 25 bp, Rattus norvegicus
cacccatgggcgtgttatgtagacg

SEQ ID NO: 664844 - DNA, 25 bp, Rattus norvegicus
tcacagtaggcgctgagcaggttgt

SEQ ID NO: 664845 - DNA, 25 bp, Rattus norvegicus
ctggaagaaaacacgtcccacctca

SEQ ID NO: 664846 - DNA, 25 bp, Rattus norvegicus
ttatgtagacgagctgccactcgct

SEQ ID NO: 664847 - DNA, 25 bp, Rattus norvegicus
gtctcacaaagcgatcctcagcctg

SEQ ID NO: 664848 - DNA, 25 bp, Rattus norvegicus
ttttgagtctcacaaagcgatcctc

SEQ ID NO: 664849 - DNA, 25 bp, Rattus norvegicus
ggctgccttctttttgagtctcaca

SEQ ID NO: 664850 - DNA, 25 bp, Rattus norvegicus
gtccttgctgtttttagctcccttc

SEQ ID NO: 664851 - DNA, 25 bp, Rattus norvegicus
gccttcggtatagtccttgctgttt

SEQ ID NO: 664852 - DNA, 25 bp, Rattus norvegicus
ggaactccacccagccttcggtata

SEQ ID NO: 664853 - DNA, 25 bp, Rattus norvegicus
gtgtatgccgtctcggaactccacc

SEQ ID NO: 664854 - DNA, 25 bp, Rattus norvegicus
gtcccacctcacagtaggcgctgag

SEQ ID NO: 664855 - DNA, 25 bp, Rattus norvegicus
tctagctgccctggttaccgttggt

SEQ ID NO: 664856 - DNA, 25 bp, Rattus norvegicus
agcgcagctgacctggcgacctcgg

SEQ ID NO: 664857 - DNA, 25 bp, Rattus norvegicus
ccctatccaagtctcgtgtgctgcg

SEQ ID NO: 664858 - DNA, 25 bp, Rattus norvegicus
cagacacggactccgagggtcgccg

SEQ ID NO: 664859 - DNA, 25 bp, Rattus norvegicus
taaaaatggcgaaatggtgggtagc

SEQ ID NO: 664860 - DNA, 25 bp, Rattus norvegicus
cacgcggacgctggccggctactga

SEQ ID NO: 664861 - DNA, 25 bp, Rattus norvegicus
tctctcacaacgacgagtgcgcgtg

SEQ ID NO: 664862 - DNA, 25 bp, Rattus norvegicus
cctgctgaggtgagcgcagctgacc

SEQ ID NO: 664863 - DNA, 25 bp, Rattus norvegicus
accgttggtgtttgcgaattctctg

SEQ ID NO: 664864 - DNA, 25 bp, Rattus norvegicus
gaattctctgctgcgcctgttccgc

SEQ ID NO: 664865 - DNA, 25 bp, Rattus norvegicus
gcctgacagcagacacggactccga

SEQ ID NO: 664866 - DNA, 25 bp, Rattus norvegicus
gcggctaccgctagtccttccctct

SEQ ID NO: 664867 - DNA, 25 bp, Rattus norvegicus
ctggcgcgcggataaaaatggcgaa

SEQ ID NO: 664868 - DNA, 25 bp, Rattus norvegicus
aagtctcgtgtgctgcgtgcaccgc

SEQ ID NO: 664869 - DNA, 25 bp, Rattus norvegicus
ctgagactctggtatggctctccga

SEQ ID NO: 664870 - DNA, 25 bp, Rattus norvegicus
acctcggccgctctttgtgtctggc

SEQ ID NO: 664871 - DNA, 25 bp, Rattus norvegicus
tccggcagcccggtgcaaagcgatc

SEQ ID NO: 664872 - DNA, 25 bp, Rattus norvegicus
tctacgaacgctgagtccaggatgc

SEQ ID NO: 664873 - DNA, 25 bp, Rattus norvegicus
gaggctccgctctacgaacgctgag

SEQ ID NO: 664874 - DNA, 25 bp, Rattus norvegicus
cgcagcacgaggatgcggactccta

SEQ ID NO: 664875 - DNA, 25 bp, Rattus norvegicus
gagcgccgcagagcactgagactct

SEQ ID NO: 664876 - DNA, 25 bp, Rattus norvegicus
aggaccaccgctaccggtccgagag

SEQ ID NO: 664877 - DNA, 25 bp, Rattus norvegicus
taggataccgcagcgcgcgtacctc

SEQ ID NO: 664878 - DNA, 25 bp, Rattus norvegicus
ctgagttctgtgaggaccaccgcta

SEQ ID NO: 664879 - DNA, 25 bp, Rattus norvegicus
aaagcgatccgggtaggataccgca

SEQ ID NO: 664880 - DNA, 25 bp, Rattus norvegicus
ggcaacccgctctttgagttcgtca

SEQ ID NO: 664881 - DNA, 25 bp, Rattus norvegicus
gaagcacggcgggttcaggcaaccc

SEQ ID NO: 664882 - DNA, 25 bp, Rattus norvegicus
ttcgtcaaagtttggggcggcagct

SEQ ID NO: 664883 - DNA, 25 bp, Rattus norvegicus
cagtcgtggcagttcagagttcagc

SEQ ID NO: 664884 - DNA, 25 bp, Rattus norvegicus
ccgtgtcgatgagtgtgttgtccag

SEQ ID NO: 664885 - DNA, 25 bp, Rattus norvegicus
aatgaaactccacgggcacgcggcg

SEQ ID NO: 664886 - DNA, 25 bp, Rattus norvegicus
taaatgttatagaaggcgcgagtgc

SEQ ID NO: 664887 - DNA, 25 bp, Rattus norvegicus
ccacgcgcgggaatgaaactccacg

SEQ ID NO: 664888 - DNA, 25 bp, Rattus norvegicus
ggggacgttacctccaacatgcctc

SEQ ID NO: 664889 - DNA, 25 bp, Rattus norvegicus
tgttgtccaggtcaaagaagaccgc

SEQ ID NO: 664890 - DNA, 25 bp, Rattus norvegicus
caggtcaaagaagaccgcgcggacc

SEQ ID NO: 664891 - DNA, 25 bp, Rattus norvegicus
acgcgcaaggcggtctggaatacct

SEQ ID NO: 664892 - DNA, 25 bp, Rattus norvegicus
agtctcggggtcacctgacacttcc

SEQ ID NO: 664893 - DNA, 25 bp, Rattus norvegicus
gggtcacctgacacttccaaagctc

SEQ ID NO: 664894 - DNA, 25 bp, Rattus norvegicus
acttccaaagctccggggtcgcagc

SEQ ID NO: 664895 - DNA, 25 bp, Rattus norvegicus
cgcagccgcaagatcacgcgagatt

SEQ ID NO: 664896 - DNA, 25 bp, Rattus norvegicus
acgcgagattcggacactataaatg

SEQ ID NO: 664897 - DNA, 25 bp, Rattus norvegicus
cgtgccttctcttcaggcgacgcgg

SEQ ID NO: 664898 - DNA, 25 bp, Rattus norvegicus
cctgcggagcagtgctgtccaatga

SEQ ID NO: 664899 - DNA, 25 bp, Rattus norvegicus
attctgcaggggaaatccgctccta

SEQ ID NO: 664900 - DNA, 25 bp, Rattus norvegicus
cgccctgaagccctggattctgcag

SEQ ID NO: 664901 - DNA, 25 bp, Rattus norvegicus
cgagtccatcgtttgcgccctgaag

SEQ ID NO: 664902 - DNA, 25 bp, Rattus norvegicus
gagacagtcgcatgcctcggatgta

SEQ ID NO: 664903 - DNA, 25 bp, Rattus norvegicus
tttcgccaggctaagagcgtgtctg

SEQ ID NO: 664904 - DNA, 25 bp, Rattus norvegicus
aagctccgccctacagacctgattg

SEQ ID NO: 664905 - DNA, 25 bp, Rattus norvegicus
tggactccaccgcagcgctaaagca

SEQ ID NO: 664906 - DNA, 25 bp, Rattus norvegicus
tggtcagatacagctggactccacc

SEQ ID NO: 664907 - DNA, 25 bp, Rattus norvegicus
tcctgcatggccagcacagatggtc

SEQ ID NO: 664908 - DNA, 25 bp, Rattus norvegicus
tcggctcttagcaggggctcctgca

SEQ ID NO: 664909 - DNA, 25 bp, Rattus norvegicus
ggtgtcatagtccagtccctcggct

SEQ ID NO: 664910 - DNA, 25 bp, Rattus norvegicus
cacctgtctcagtggcctgtgccaa

SEQ ID NO: 664911 - DNA, 25 bp, Rattus norvegicus
ctcatggtctctggggtcgcttgcc

SEQ ID NO: 664912 - DNA, 25 bp, Rattus norvegicus
ggcctgctctgcagggcctcagttt

SEQ ID NO: 664913 - DNA, 25 bp, Rattus norvegicus
gcgcgaaacggctgggtttcccgca

SEQ ID NO: 664914 - DNA, 25 bp, Rattus norvegicus
cacggagggcttttcctgtagcacc

SEQ ID NO: 664915 - DNA, 25 bp, Rattus norvegicus
ttttcctgtagcaccgcattgggcg

SEQ ID NO: 664916 - DNA, 25 bp, Rattus norvegicus
gccctgccgctggacactgtagaac

SEQ ID NO: 664917 - DNA, 25 bp, Rattus norvegicus
cgtttcttcttggagtcagctggct

SEQ ID NO: 664918 - DNA, 25 bp, Rattus norvegicus
agcgcggaggtctccgtggtcccta

SEQ ID NO: 664919 - DNA, 25 bp, Rattus norvegicus
cgaagcgcacagtcatccctgcgtg

SEQ ID NO: 664920 - DNA, 25 bp, Rattus norvegicus
tcatccctgcgtggctgggccctag

SEQ ID NO: 664921 - DNA, 25 bp, Rattus norvegicus
tgggccctagcccaggcctcatggt

SEQ ID NO: 664922 - DNA, 25 bp, Rattus norvegicus
cctggcttggaagttaatggtcacg

SEQ ID NO: 664923 - DNA, 25 bp, Rattus norvegicus
tcgccggcctggcttggaagttaat

SEQ ID NO: 664924 - DNA, 25 bp, Rattus norvegicus
tttcctgcgggctcgcagtgttggc

SEQ ID NO: 664925 - DNA, 25 bp, Rattus norvegicus
tacactacacgggtgagtcggaccg

SEQ ID NO: 664926 - DNA, 25 bp, Rattus norvegicus
tgtggctgagcgaactcatcgcctg

SEQ ID NO: 664927 - DNA, 25 bp, Rattus norvegicus
ctccgaagcggagaaacgcagagga

SEQ ID NO: 664928 - DNA, 25 bp, Rattus norvegicus
gatctgagcacctcgcgcaagtagg

SEQ ID NO: 664929 - DNA, 25 bp, Rattus norvegicus
ggacgaagccgaacctctgaaccgc

SEQ ID NO: 664930 - DNA, 25 bp, Rattus norvegicus
gtgcaggtggagaccatctcttctg

SEQ ID NO: 664931 - DNA, 25 bp, Rattus norvegicus
actgtccaagcgtagaaattgtggc

SEQ ID NO: 664932 - DNA, 25 bp, Rattus norvegicus
ggccagacctgcgtggtacactaca

SEQ ID NO: 664933 - DNA, 25 bp, Rattus norvegicus
gttggcgcagtctcatacaccctga

SEQ ID NO: 664934 - DNA, 25 bp, Rattus norvegicus
acaccctgaacggtgagcggcctcg

SEQ ID NO: 664935 - DNA, 25 bp, Rattus norvegicus
atgccgcagggagcctactgtccaa

SEQ ID NO: 664936 - DNA, 25 bp, Rattus norvegicus
tattaatgcggcgtctccgaagcgg

SEQ ID NO: 664937 - DNA, 25 bp, Rattus norvegicus
ggagtagccaacaggacgcgccttc

SEQ ID NO: 664938 - DNA, 25 bp, Rattus norvegicus
ctcttctggagacggtgagtagaca

SEQ ID NO: 664939 - DNA, 25 bp, Rattus norvegicus
acctgggtccactcgccctccgcag

SEQ ID NO: 664940 - DNA, 25 bp, Rattus norvegicus
gcagcaagcggtctcaagctgtccc

SEQ ID NO: 664941 - DNA, 25 bp, Rattus norvegicus
tgagcgccggtagccgcagcctgca

SEQ ID NO: 664942 - DNA, 25 bp, Rattus norvegicus
gcgccgcagcaagcggtctcaagct

SEQ ID NO: 664943 - DNA, 25 bp, Rattus norvegicus
cgcagcctgcaagctcggaggacac

SEQ ID NO: 664944 - DNA, 25 bp, Rattus norvegicus
tgcaagctcggaggacacgctgccc

SEQ ID NO: 664945 - DNA, 25 bp, Rattus norvegicus
gctagggcagttccagtgcttggcc

SEQ ID NO: 664946 - DNA, 25 bp, Rattus norvegicus
acgactccggcgcagcttggcgcag

SEQ ID NO: 664947 - DNA, 25 bp, Rattus norvegicus
cgatgatcagcaacctgcggcggtg

SEQ ID NO: 664948 - DNA, 25 bp, Rattus norvegicus
cagcttggcgcagcgcctctgcagt

SEQ ID NO: 664949 - DNA, 25 bp, Rattus norvegicus
tggcgcagcgcctctgcagtcgctg

SEQ ID NO: 664950 - DNA, 25 bp, Rattus norvegicus
gcagcagccgcctgacgatgatcag

SEQ ID NO: 664951 - DNA, 25 bp, Rattus norvegicus
ccgcctgacgatgatcagcaacctg

SEQ ID NO: 664952 - DNA, 25 bp, Rattus norvegicus
gcagttccagtgcttggccggcgcc

SEQ ID NO: 664953 - DNA, 25 bp, Rattus norvegicus
ctatcgattgggtttgcgaagcctc

SEQ ID NO: 664954 - DNA, 25 bp, Rattus norvegicus
agggatctgcgcacaccctcggcag

SEQ ID NO: 664955 - DNA, 25 bp, Rattus norvegicus
tgcgaaggacagctcgcctgacctc

SEQ ID NO: 664956 - DNA, 25 bp, Rattus norvegicus
ttagtggggctttccgcgcagaact

SEQ ID NO: 664957 - DNA, 25 bp, Rattus norvegicus
tccgcgcagaactttgggtataacc

SEQ ID NO: 664958 - DNA, 25 bp, Rattus norvegicus
ctttgggtataaccgcgtggacctg

SEQ ID NO: 664959 - DNA, 25 bp, Rattus norvegicus
accgcgtggacctgcgtgtctgcat

SEQ ID NO: 664960 - DNA, 25 bp, Rattus norvegicus
tgcgtgtctgcatctgcgcgcccga

SEQ ID NO: 664961 - DNA, 25 bp, Rattus norvegicus
cgcccgaggctttgtgtactatcga

SEQ ID NO: 664962 - DNA, 25 bp, Rattus norvegicus
tgcatgtgtctatcgattgggtttg

SEQ ID NO: 664963 - DNA, 25 bp, Rattus norvegicus
ttgggtttgcgaagcctcacccagc

SEQ ID NO: 664964 - DNA, 25 bp, Rattus norvegicus
acccagcctcgcagtgtgtctggct

SEQ ID NO: 664965 - DNA, 25 bp, Rattus norvegicus
cagtgtgtctggctcccgggtgtca

SEQ ID NO: 664966 - DNA, 25 bp, Rattus norvegicus
gtactatcgagtgcatgtgtctatc

SEQ ID NO: 664967 - DNA, 25 bp, Rattus norvegicus
ttcccagtgcaagaagcagacgagt

SEQ ID NO: 664968 - DNA, 25 bp, Rattus norvegicus
cggtgacgcctctgaatgttgcctt

SEQ ID NO: 664969 - DNA, 25 bp, Rattus norvegicus
ctccgcgaactagagggttccgcta

SEQ ID NO: 664970 - DNA, 25 bp, Rattus norvegicus
gggctggaaacacctccgcgaacta

SEQ ID NO: 664971 - DNA, 25 bp, Rattus norvegicus
ctgctgatttgtggactctccgggc

SEQ ID NO: 664972 - DNA, 25 bp, Rattus norvegicus
ggccctggctttagactctggtttc

SEQ ID NO: 664973 - DNA, 25 bp, Rattus norvegicus
tgccttcgctttcggctctgtctgc

SEQ ID NO: 664974 - DNA, 25 bp, Rattus norvegicus
caaaagtgcggcgtcagaagcctcg

SEQ ID NO: 664975 - DNA, 25 bp, Rattus norvegicus
cgggactgcaaacagcggtgacgcc

SEQ ID NO: 664976 - DNA, 25 bp, Rattus norvegicus
ttctgcctaaaagaagcgggactgc

SEQ ID NO: 664977 - DNA, 25 bp, Rattus norvegicus
ccgccatggatgtttgcggcttcta

SEQ ID NO: 664978 - DNA, 25 bp, Rattus norvegicus
gaagagaacctccaagcccgccatg

SEQ ID NO: 664979 - DNA, 25 bp, Rattus norvegicus
ggtgcccaagccatagtagccgttt

SEQ ID NO: 664980 - DNA, 25 bp, Rattus norvegicus
ctcgcaccggaaatagctgctgatt

SEQ ID NO: 664981 - DNA, 25 bp, Rattus norvegicus
ggagccaggagcaccagactgccca

SEQ ID NO: 664982 - DNA, 25 bp, Rattus norvegicus
gtccctggtgactgcagcgaccagc

SEQ ID NO: 664983 - DNA, 25 bp, Rattus norvegicus
gtgactgcagcgaccagcgaccagc

SEQ ID NO: 664984 - DNA, 25 bp, Rattus norvegicus
ccgcggatgctcaacgcgtgccaga

SEQ ID NO: 664985 - DNA, 25 bp, Rattus norvegicus
atgctcaacgcgtgccagaagctgt

SEQ ID NO: 664986 - DNA, 25 bp, Rattus norvegicus
tgccagaagctgtcgcctcacaggg

SEQ ID NO: 664987 - DNA, 25 bp, Rattus norvegicus
aagctgtcgcctcacaggggctgcc

SEQ ID NO: 664988 - DNA, 25 bp, Rattus norvegicus
tgacgccctcactcgacccaccgcg

SEQ ID NO: 664989 - DNA, 25 bp, Rattus norvegicus
aggagcaccagactgcccagatgcg

SEQ ID NO: 664990 - DNA, 25 bp, Rattus norvegicus
agactgcccagatgcgggcgccact

SEQ ID NO: 664991 - DNA, 25 bp, Rattus norvegicus
agatgcgggcgccactctgcctgct

SEQ ID NO: 664992 - DNA, 25 bp, Rattus norvegicus
cacgcagtggacatgctcgccctgt

SEQ ID NO: 664993 - DNA, 25 bp, Rattus norvegicus
cagtggacatgctcgccctgtaccg

SEQ ID NO: 664994 - DNA, 25 bp, Rattus norvegicus
ccgagggttaagcaccgcccagcgt

SEQ ID NO: 664995 - DNA, 25 bp, Rattus norvegicus
tagggtccgctcttccactgtagca

SEQ ID NO: 664996 - DNA, 25 bp, Rattus norvegicus
tgtccacgggcatggccgttacata

SEQ ID NO: 664997 - DNA, 25 bp, Rattus norvegicus
aggcgttccacagcactcggtttcc

SEQ ID NO: 664998 - DNA, 25 bp, Rattus norvegicus
gtacttagccttatcagcctccagg

SEQ ID NO: 664999 - DNA, 25 bp, Rattus norvegicus
cacgcgcaggctcttgacgtactta

SEQ ID NO: 665000 - DNA, 25 bp, Rattus norvegicus
ggacacgggactatcacacaggttg

SEQ ID NO: 665001 - DNA, 25 bp, Rattus norvegicus
tcggcgcacagcgacagtactagga

SEQ ID NO: 665002 - DNA, 25 bp, Rattus norvegicus
aggggacgaacatccactcggcgca

SEQ ID NO: 665003 - DNA, 25 bp, Rattus norvegicus
gggctccgctgcaagcaacgaaaga

SEQ ID NO: 665004 - DNA, 25 bp, Rattus norvegicus
agcgctcactcaggtccgacttgga

SEQ ID NO: 665005 - DNA, 25 bp, Rattus norvegicus
tgctgccctggaaaagcgctcactc

SEQ ID NO: 665006 - DNA, 25 bp, Rattus norvegicus
aatcctcgtgcttcctctgggtcca

SEQ ID NO: 665007 - DNA, 25 bp, Rattus norvegicus
gacacgatgtccgagctagcccttg

SEQ ID NO: 665008 - DNA, 25 bp, Rattus norvegicus
cgggcatttcgctcgatcacagaca

SEQ ID NO: 665009 - DNA, 25 bp, Rattus norvegicus
cagctccaggaagcgccggtaagtt

SEQ ID NO: 665010 - DNA, 25 bp, Rattus norvegicus
cctctccggtctggagggaaagttg

SEQ ID NO: 665011 - DNA, 25 bp, Rattus norvegicus
accggcgatcagcactgggttgcct

SEQ ID NO: 665012 - DNA, 25 bp, Rattus norvegicus
atgcagcccgccatcgttgctcatg

SEQ ID NO: 665013 - DNA, 25 bp, Rattus norvegicus
ccggtaagttttctcctcagggatg

SEQ ID NO: 665014 - DNA, 25 bp, Rattus norvegicus
actcgcccaggaacagctccaggaa

SEQ ID NO: 665015 - DNA, 25 bp, Rattus norvegicus
ctcctcttcgggctccgggtcttgg

SEQ ID NO: 665016 - DNA, 25 bp, Rattus norvegicus
tcctctcgggtgatgcgctccgaca

SEQ ID NO: 665017 - DNA, 25 bp, Rattus norvegicus
tgcaggcacaggtccaggctctcgc

SEQ ID NO: 665018 - DNA, 25 bp, Rattus norvegicus
tagagctgctgcaggcacaggtcca

SEQ ID NO: 665019 - DNA, 25 bp, Rattus norvegicus
cccgctacttaactatttgtagagc

SEQ ID NO: 665020 - DNA, 25 bp, Rattus norvegicus
gggaagaccttgacaagaaggctcc

SEQ ID NO: 665021 - DNA, 25 bp, Rattus norvegicus
agcccaagactggagggaagacctt

SEQ ID NO: 665022 - DNA, 25 bp, Rattus norvegicus
gttttctcctcagggatgcagcccg

SEQ ID NO: 665023 - DNA, 25 bp, Rattus norvegicus
ccggacttcctgattggccggtcgc

SEQ ID NO: 665024 - DNA, 25 bp, Rattus norvegicus
cggtcgcttccgttcgaacggcgcg

SEQ ID NO: 665025 - DNA, 25 bp, Rattus norvegicus
cgccagccgggttgccaggcaacat

SEQ ID NO: 665026 - DNA, 25 bp, Rattus norvegicus
ccaggcaacatcaggagcggcagat

SEQ ID NO: 665027 - DNA, 25 bp, Rattus norvegicus
catcaggagcggcagatgcaaccca

SEQ ID NO: 665028 - DNA, 25 bp, Rattus norvegicus
tgagcccagctggtcgctcggcctt

SEQ ID NO: 665029 - DNA, 25 bp, Rattus norvegicus
gagaccggtcggctcttccgagcga

SEQ ID NO: 665030 - DNA, 25 bp, Rattus norvegicus
cggcagatgcaacccagcggctgct

SEQ ID NO: 665031 - DNA, 25 bp, Rattus norvegicus
cccgcggacctgaggaggtcacagc

SEQ ID NO: 665032 - DNA, 25 bp, Rattus norvegicus
gcagaggctgacagctgatggtccc

SEQ ID NO: 665033 - DNA, 25 bp, Rattus norvegicus
tcctcgctggctgcagaggctgaca

SEQ ID NO: 665034 - DNA, 25 bp, Rattus norvegicus
gaggaatcccgctcctcgctggctg

SEQ ID NO: 665035 - DNA, 25 bp, Rattus norvegicus
cttccgagcgagaggtcccggccgt

SEQ ID NO: 665036 - DNA, 25 bp, Rattus norvegicus
gccgtcccacaatcccgccgggaga

SEQ ID NO: 665037 - DNA, 25 bp, Rattus norvegicus
ttcgtggaatgctttgagcgctgtc

SEQ ID NO: 665038 - DNA, 25 bp, Rattus norvegicus
cgctagagggcgctagaactctgca

SEQ ID NO: 665039 - DNA, 25 bp, Rattus norvegicus
tccgcgatgctcacggaaacccagg

SEQ ID NO: 665040 - DNA, 25 bp, Rattus norvegicus
agttgtgcaggaaagggctgatccc

SEQ ID NO: 665041 - DNA, 25 bp, Rattus norvegicus
cctcccgccgcagataattaactgg

SEQ ID NO: 665042 - DNA, 25 bp, Rattus norvegicus
taaaacgctgatggcggcgcctttg

SEQ ID NO: 665043 - DNA, 25 bp, Rattus norvegicus
ctgcggcggcattgttatggaaagc

SEQ ID NO: 665044 - DNA, 25 bp, Rattus norvegicus
cgcgccgtcagctgcggaaaatagg

SEQ ID NO: 665045 - DNA, 25 bp, Rattus norvegicus
ccgagtctgagagtctacaaaactt

SEQ ID NO: 665046 - DNA, 25 bp, Rattus norvegicus
atcagacaggcaggccggatttttc

SEQ ID NO: 665047 - DNA, 25 bp, Rattus norvegicus
cccagagaaagtgtccgcgatgctc

SEQ ID NO: 665048 - DNA, 25 bp, Rattus norvegicus
ggctgatccctcctaccgactaatg

SEQ ID NO: 665049 - DNA, 25 bp, Rattus norvegicus
gactaatgtcctggaaccgcgcgcc

SEQ ID NO: 665050 - DNA, 25 bp, Rattus norvegicus
tcaatggtggcactggaaacccgcc

SEQ ID NO: 665051 - DNA, 25 bp, Rattus norvegicus
gccgcgaagattaattgcccaatca

SEQ ID NO: 665052 - DNA, 25 bp, Rattus norvegicus
ccgcgggccgcgaagattaattgcc

SEQ ID NO: 665053 - DNA, 25 bp, Rattus norvegicus
agcgttctggctctagctgagcgcg

SEQ ID NO: 665054 - DNA, 25 bp, Rattus norvegicus
cgcgcggctccgacagatggaccga

SEQ ID NO: 665055 - DNA, 25 bp, Rattus norvegicus
cgggcgcataatgaagtgtgcaaaa

SEQ ID NO: 665056 - DNA, 25 bp, Rattus norvegicus
cgggcgccttatcagcgcgagcaga

SEQ ID NO: 665057 - DNA, 25 bp, Rattus norvegicus
tccgacagatggaccgagcccaagg

SEQ ID NO: 665058 - DNA, 25 bp, Rattus norvegicus
ttgcccaatcaagttgtcggcgtgg

SEQ ID NO: 665059 - DNA, 25 bp, Rattus norvegicus
aaagttaatttgctccgcgacgcgc

SEQ ID NO: 665060 - DNA, 25 bp, Rattus norvegicus
ctcgccgcaatcaaaggcgggcgtc

SEQ ID NO: 665061 - DNA, 25 bp, Rattus norvegicus
cagcgatgaggtcgaggtctgcaaa

SEQ ID NO: 665062 - DNA, 25 bp, Rattus norvegicus
gaggtctgcaaacctgcgatctacc

SEQ ID NO: 665063 - DNA, 25 bp, Rattus norvegicus
cccaggcagcgttctggctctagct

SEQ ID NO: 665064 - DNA, 25 bp, Rattus norvegicus
ttaccacgctccttaattgggaggc

SEQ ID NO: 665065 - DNA, 25 bp, Rattus norvegicus
gttgcgcacgccctcaaagtcgtca

SEQ ID NO: 665066 - DNA, 25 bp, Rattus norvegicus
aagtcgtcatcctctggctcctgca

SEQ ID NO: 665067 - DNA, 25 bp, Rattus norvegicus
ctctggctcctgcaggaagaaggtg

SEQ ID NO: 665068 - DNA, 25 bp, Rattus norvegicus
cctgcggggacttttggctgaaaga

SEQ ID NO: 665069 - DNA, 25 bp, Rattus norvegicus
gatgcttttgtaggccacgcggccc

SEQ ID NO: 665070 - DNA, 25 bp, Rattus norvegicus
aatgcacagcgaagtcgggctcctc

SEQ ID NO: 665071 - DNA, 25 bp, Rattus norvegicus
agagctggcccgttggtcaacacaa

SEQ ID NO: 665072 - DNA, 25 bp, Rattus norvegicus
agctccacatcttcctggctgatgc

SEQ ID NO: 665073 - DNA, 25 bp, Rattus norvegicus
gaagctcgcggacggcagctccaca

SEQ ID NO: 665074 - DNA, 25 bp, Rattus norvegicus
cctcccgcatggcagagaggcggtt

SEQ ID NO: 665075 - DNA, 25 bp, Rattus norvegicus
gcttcgggaaaaggcctcccgcatg

SEQ ID NO: 665076 - DNA, 25 bp, Rattus norvegicus
gtcacacgtcagtgcttacgctccg

SEQ ID NO: 665077 - DNA, 25 bp, Rattus norvegicus
caacacaaggttgcggttggaatga

SEQ ID NO: 665078 - DNA, 25 bp, Rattus norvegicus
agtgcttacgctccggcttcgggaa

SEQ ID NO: 665079 - DNA, 25 bp, Rattus norvegicus
tcgtacaaaggaaagtggcagggtc

SEQ ID NO: 665080 - DNA, 25 bp, Rattus norvegicus
taggtcgtacaaaggaaagtggcag

SEQ ID NO: 665081 - DNA, 25 bp, Rattus norvegicus
ctaggtcgtacaaaggaaagtggca

SEQ ID NO: 665082 - DNA, 25 bp, Rattus norvegicus
aagtggcagggtcggttcatcccgc

SEQ ID NO: 665083 - DNA, 25 bp, Rattus norvegicus
acaacggtgagtgggccctgtggga

SEQ ID NO: 665084 - DNA, 25 bp, Rattus norvegicus
gaaagtggcagggtcggttcatccc

SEQ ID NO: 665085 - DNA, 25 bp, Rattus norvegicus
gctaggtcgtacaaaggaaagtggc

SEQ ID NO: 665086 - DNA, 25 bp, Rattus norvegicus
gtgcacccccgggacttccagagga

SEQ ID NO: 665087 - DNA, 25 bp, Rattus norvegicus
ggagacgtctctggccgagtgcacc

SEQ ID NO: 665088 - DNA, 25 bp, Rattus norvegicus
aggagacgtctctggccgagtgcac

SEQ ID NO: 665089 - DNA, 25 bp, Rattus norvegicus
tgcagcagggaaccgcggaggagac

SEQ ID NO: 665090 - DNA, 25 bp, Rattus norvegicus
tccccaacttgggctgcagcaggga

SEQ ID NO: 665091 - DNA, 25 bp, Rattus norvegicus
tgagtgggccctgtgggagggaagc

SEQ ID NO: 665092 - DNA, 25 bp, Rattus norvegicus
aaagtggcagggtcggttcatcccg

SEQ ID NO: 665093 - DNA, 25 bp, Rattus norvegicus
cagctgagcctctgccatgcgggat

SEQ ID NO: 665094 - DNA, 25 bp, Rattus norvegicus
gagagcccacagtccagcctgtcgg

SEQ ID NO: 665095 - DNA, 25 bp, Rattus norvegicus
tgcctgcgtgaaggccgccgagcct

SEQ ID NO: 665096 - DNA, 25 bp, Rattus norvegicus
tggacgccttcttcatttctgatgg

SEQ ID NO: 665097 - DNA, 25 bp, Rattus norvegicus
ttcatttctgatgggcgttcgcggc

SEQ ID NO: 665098 - DNA, 25 bp, Rattus norvegicus
tgcggcaagacgtacgccacgtcgt

SEQ ID NO: 665099 - DNA, 25 bp, Rattus norvegicus
caagtgcccgacgtgtggcaaggcc

SEQ ID NO: 665100 - DNA, 25 bp, Rattus norvegicus
tgtggcaaggcctacgtgtctatgc

SEQ ID NO: 665101 - DNA, 25 bp, Rattus norvegicus
cctggttgctccagggccacatgcg

SEQ ID NO: 665102 - DNA, 25 bp, Rattus norvegicus
cccagcggttatgatggcgagcaga

SEQ ID NO: 665103 - DNA, 25 bp, Rattus norvegicus
tccacaagcactgcgaggctgcctg

SEQ ID NO: 665104 - DNA, 25 bp, Rattus norvegicus
cggcgtccgaggagtacagcgaccc

SEQ ID NO: 665105 - DNA, 25 bp, Rattus norvegicus
gagaagccctttggttgcgcgcact

SEQ ID NO: 665106 - DNA, 25 bp, Rattus norvegicus
gtgaccgacagctactccatggacg

SEQ ID NO: 665107 - DNA, 25 bp, Rattus norvegicus
cgggaggagtgctctctcccggcca

SEQ ID NO: 665108 - DNA, 25 bp, Rattus norvegicus
gggactgccagccaggcgcctattg

SEQ ID NO: 665109 - DNA, 25 bp, Rattus norvegicus
cgactatgcaactctcccgggcaga

SEQ ID NO: 665110 - DNA, 25 bp, Rattus norvegicus
tctgctttaagcacacgcctcttcc

SEQ ID NO: 665111 - DNA, 25 bp, Rattus norvegicus
ctatgcaactctcccgggcagaggg

SEQ ID NO: 665112 - DNA, 25 bp, Rattus norvegicus
gactgccagccaggcgcctattggc

SEQ ID NO: 665113 - DNA, 25 bp, Rattus norvegicus
gccaggcgcctattggccaccacta

SEQ ID NO: 665114 - DNA, 25 bp, Rattus norvegicus
ggccaccactacctcctccaccgcg

SEQ ID NO: 665115 - DNA, 25 bp, Rattus norvegicus
accgcgcttttgcatgcccgggcga

SEQ ID NO: 665116 - DNA, 25 bp, Rattus norvegicus
ccgcgcttttgcatgcccgggcgag

SEQ ID NO: 665117 - DNA, 25 bp, Rattus norvegicus
cgggcgaggaccgaagcacacacct

SEQ ID NO: 665118 - DNA, 25 bp, Rattus norvegicus
gggcgaggaccgaagcacacacctc

SEQ ID NO: 665119 - DNA, 25 bp, Rattus norvegicus
gaccgaagcacacacctccgcgcgc

SEQ ID NO: 665120 - DNA, 25 bp, Rattus norvegicus
tctctcccggccacgactatgcaac

SEQ ID NO: 665121 - DNA, 25 bp, Rattus norvegicus
tcctcgcctctgagggcctgagtca

SEQ ID NO: 665122 - DNA, 25 bp, Rattus norvegicus
ccgccaaggaagcaatatggggcta

SEQ ID NO: 665123 - DNA, 25 bp, Rattus norvegicus
acccggtcaaggtgcagagcctcgt

SEQ ID NO: 665124 - DNA, 25 bp, Rattus norvegicus
acaacgtgccaatcgccgtgctcat

SEQ ID NO: 665125 - DNA, 25 bp, Rattus norvegicus
gcatcgacactgtgcacaacgtgcc

SEQ ID NO: 665126 - DNA, 25 bp, Rattus norvegicus
atccactctggctgcatcgacactg

SEQ ID NO: 665127 - DNA, 25 bp, Rattus norvegicus
cgcgcaaggaggcagcatccactct

SEQ ID NO: 665128 - DNA, 25 bp, Rattus norvegicus
acagcgtgagccgagccactcggtg

SEQ ID NO: 665129 - DNA, 25 bp, Rattus norvegicus
ggggccgatacatcacagcgtgagc

SEQ ID NO: 665130 - DNA, 25 bp, Rattus norvegicus
cgcgtccattaagcgcatcgcgagg

SEQ ID NO: 665131 - DNA, 25 bp, Rattus norvegicus
gtcagcgacccgacgcgtccattaa

SEQ ID NO: 665132 - DNA, 25 bp, Rattus norvegicus
gacctgcaaactcaccctgagtcag

SEQ ID NO: 665133 - DNA, 25 bp, Rattus norvegicus
gcctgagtcaccacgctgtgcgtca

SEQ ID NO: 665134 - DNA, 25 bp, Rattus norvegicus
cctcgtggacacgatcctggtgagc

SEQ ID NO: 665135 - DNA, 25 bp, Rattus norvegicus
tctgtctcagcaaccagcgcaaggg

SEQ ID NO: 665136 - DNA, 25 bp, Rattus norvegicus
gggccgtctcgtgattggctcctcc

SEQ ID NO: 665137 - DNA, 25 bp, Rattus norvegicus
gcaaaccgtcttgcagagccggcct

SEQ ID NO: 665138 - DNA, 25 bp, Rattus norvegicus
gcgcttgcttcaaccgggcaaaccg

SEQ ID NO: 665139 - DNA, 25 bp, Rattus norvegicus
cggctataaggcgacgaccagcgtg

SEQ ID NO: 665140 - DNA, 25 bp, Rattus norvegicus
gcagacgatgggcagccgtgtttcc

SEQ ID NO: 665141 - DNA, 25 bp, Rattus norvegicus
cgtggaccgaaagctgtccaagatc

SEQ ID NO: 665142 - DNA, 25 bp, Rattus norvegicus
caccgagcccgtggaccgaaagctg

SEQ ID NO: 665143 - DNA, 25 bp, Rattus norvegicus
cgagaccgcacgcagagcgtgaaca

SEQ ID NO: 665144 - DNA, 25 bp, Rattus norvegicus
ggaccagtcgttcggctgctgcgaa

SEQ ID NO: 665145 - DNA, 25 bp, Rattus norvegicus
agagcgacgcgtcggaccagtcgtt

SEQ ID NO: 665146 - DNA, 25 bp, Rattus norvegicus
agaatcgcagcgagagcgacgcgtc

SEQ ID NO: 665147 - DNA, 25 bp, Rattus norvegicus
cgcgcacgtgctgtacccggacgtg

SEQ ID NO: 665148 - DNA, 25 bp, Rattus norvegicus
tcaaccgggcaaaccgtcttgcaga

SEQ ID NO: 665149 - DNA, 25 bp, Rattus norvegicus
cgtttatgtttcgtctagtcaccta

SEQ ID NO: 665150 - DNA, 25 bp, Rattus norvegicus
cgcttccaccgcaggtaccgtggga

SEQ ID NO: 665151 - DNA, 25 bp, Rattus norvegicus
cgccgccatattgtctgtgtgagga

SEQ ID NO: 665152 - DNA, 25 bp, Rattus norvegicus
tcagatgacacagaacaagacggcg

SEQ ID NO: 665153 - DNA, 25 bp, Rattus norvegicus
gtcaattaccgaacgctctcagatg

SEQ ID NO: 665154 - DNA, 25 bp, Rattus norvegicus
agcgcaccgagagagtacggcctcc

SEQ ID NO: 665155 - DNA, 25 bp, Rattus norvegicus
gttctgacttaaatgcgcttctctg

SEQ ID NO: 665156 - DNA, 25 bp, Rattus norvegicus
catcgtttgcttgatgggacgttta

SEQ ID NO: 665157 - DNA, 25 bp, Rattus norvegicus
ttcggcagtgtcaaaccatcgtttg

SEQ ID NO: 665158 - DNA, 25 bp, Rattus norvegicus
gtgcaggaaacacgccatcttcggc

SEQ ID NO: 665159 - DNA, 25 bp, Rattus norvegicus
tcgctctctggctaggcgtagtgca

SEQ ID NO: 665160 - DNA, 25 bp, Rattus norvegicus
tcctggccgcctgagaaggcgcaaa

SEQ ID NO: 665161 - DNA, 25 bp, Rattus norvegicus
ctggctgtcagacttcagtttcttg

SEQ ID NO: 665162 - DNA, 25 bp, Rattus norvegicus
gtcgcgcatgcttcgggactagcag

SEQ ID NO: 665163 - DNA, 25 bp, Rattus norvegicus
ccaattccctctgcattttgaaagc

SEQ ID NO: 665164 - DNA, 25 bp, Rattus norvegicus
gcgctaaagccctaggggcgcaaac

SEQ ID NO: 665165 - DNA, 25 bp, Rattus norvegicus
gcgtgacgtcatgcgtacggcgcaa

SEQ ID NO: 665166 - DNA, 25 bp, Rattus norvegicus
acgtagaacgagaggcgctaaagcc

SEQ ID NO: 665167 - DNA, 25 bp, Rattus norvegicus
attttgaaagctcggcgcctacgcg

SEQ ID NO: 665168 - DNA, 25 bp, Rattus norvegicus
gagacagcggaaaacccaccaattc

SEQ ID NO: 665169 - DNA, 25 bp, Rattus norvegicus
agcttcacgcgcaccgcgggagaca

SEQ ID NO: 665170 - DNA, 25 bp, Rattus norvegicus
tcggcagtctgaaaacccgcagcca

SEQ ID NO: 665171 - DNA, 25 bp, Rattus norvegicus
ccaggacgtcctcggcagtctgaaa

SEQ ID NO: 665172 - DNA, 25 bp, Rattus norvegicus
gagggcttcacctccaggacgtcct

SEQ ID NO: 665173 - DNA, 25 bp, Rattus norvegicus
acctttgctaagctcggagggcttc

SEQ ID NO: 665174 - DNA, 25 bp, Rattus norvegicus
ctgccgggagtctttacctttgcta

SEQ ID NO: 665175 - DNA, 25 bp, Rattus norvegicus
tgcatcagctggctgccgggagtct

SEQ ID NO: 665176 - DNA, 25 bp, Rattus norvegicus
cgcctacgcgcgtagtgacgtagaa

SEQ ID NO: 665177 - DNA, 25 bp, Rattus norvegicus
gcaaaactatgacccggcacgcacg

SEQ ID NO: 665178 - DNA, 25 bp, Rattus norvegicus
ctctgcactcgtgaccctaaaattc

SEQ ID NO: 665179 - DNA, 25 bp, Rattus norvegicus
cgcacgcgcgttcccagcagccagc

SEQ ID NO: 665180 - DNA, 25 bp, Rattus norvegicus
ttccactgtcaaaccgcatgcgcgc

SEQ ID NO: 665181 - DNA, 25 bp, Rattus norvegicus
ccaaccctaaaacgcaggtcacgtg

SEQ ID NO: 665182 - DNA, 25 bp, Rattus norvegicus
gcctgcgcgcctgcgcgccacaggc

SEQ ID NO: 665183 - DNA, 25 bp, Rattus norvegicus
caggccgacggcgactatcctgccc

SEQ ID NO: 665184 - DNA, 25 bp, Rattus norvegicus
tcctgccccggctgaactggggtta

SEQ ID NO: 665185 - DNA, 25 bp, Rattus norvegicus
tccggccctcagagggcgacggctc

SEQ ID NO: 665186 - DNA, 25 bp, Rattus norvegicus
ctccgccggccgctggaaccgcggc

SEQ ID NO: 665187 - DNA, 25 bp, Rattus norvegicus
ctcagggaaggcaggtacggaggac

SEQ ID NO: 665188 - DNA, 25 bp, Rattus norvegicus
gccgccagccacgtccgcagaaccg

SEQ ID NO: 665189 - DNA, 25 bp, Rattus norvegicus
agcctccacagccttccactgtcaa

SEQ ID NO: 665190 - DNA, 25 bp, Rattus norvegicus
cgagctccggccttcactctgcact

SEQ ID NO: 665191 - DNA, 25 bp, Rattus norvegicus
gcctcactgagcctatctcggagtc

SEQ ID NO: 665192 - DNA, 25 bp, Rattus norvegicus
gccggggattgcaccatctgacccg

SEQ ID NO: 665193 - DNA, 25 bp, Rattus norvegicus
ccagaggccggggattgcaccatct

SEQ ID NO: 665194 - DNA, 25 bp, Rattus norvegicus
taatctgctgctgacgcccagaggc

SEQ ID NO: 665195 - DNA, 25 bp, Rattus norvegicus
tgagctaatctgctgctgacgccca

SEQ ID NO: 665196 - DNA, 25 bp, Rattus norvegicus
gtaaacctgagctaatctgctgctg

SEQ ID NO: 665197 - DNA, 25 bp, Rattus norvegicus
cggctgatgtaaacctgagctaatc

SEQ ID NO: 665198 - DNA, 25 bp, Rattus norvegicus
cccgcccggctgatgtaaacctgag

SEQ ID NO: 665199 - DNA, 25 bp, Rattus norvegicus
tgctaaagtgctgcggcaccgggac

SEQ ID NO: 665200 - DNA, 25 bp, Rattus norvegicus
agccgcttccgctgctaaagtgctg

SEQ ID NO: 665201 - DNA, 25 bp, Rattus norvegicus
gtcacgtactcaacagcagccgctt

SEQ ID NO: 665202 - DNA, 25 bp, Rattus norvegicus
ggagtcccagcacgcccgtgccaga

SEQ ID NO: 665203 - DNA, 25 bp, Rattus norvegicus
gagcctatctcggagtcccagcacg

SEQ ID NO: 665204 - DNA, 25 bp, Rattus norvegicus
tgacccgcccatgtcgccgagtgtg

SEQ ID NO: 665205 - DNA, 25 bp, Rattus norvegicus
tcaccacgtgtgagccagttgtagc

SEQ ID NO: 665206 - DNA, 25 bp, Rattus norvegicus
tccttagagcacctggggcagggcc

SEQ ID NO: 665207 - DNA, 25 bp, Rattus norvegicus
tagcgcactccttagagcacctggg

SEQ ID NO: 665208 - DNA, 25 bp, Rattus norvegicus
cggtcctagcgcactccttagagca

SEQ ID NO: 665209 - DNA, 25 bp, Rattus norvegicus
tattctagctagtctggcggtccta

SEQ ID NO: 665210 - DNA, 25 bp, Rattus norvegicus
gctcgccgctattctagctagtctg

SEQ ID NO: 665211 - DNA, 25 bp, Rattus norvegicus
tgagccagttgtagcaccacccggc

SEQ ID NO: 665212 - DNA, 25 bp, Rattus norvegicus
gccgagagcagagccacctagtaca

SEQ ID NO: 665213 - DNA, 25 bp, Rattus norvegicus
gcagagccacctagtacagttcttg

SEQ ID NO: 665214 - DNA, 25 bp, Rattus norvegicus
ctagtacagttcttgcatcccgggc

SEQ ID NO: 665215 - DNA, 25 bp, Rattus norvegicus
tacagttcttgcatcccgggcgcgt

SEQ ID NO: 665216 - DNA, 25 bp, Rattus norvegicus
ccgcccagggcggagtcttcctagg

SEQ ID NO: 665217 - DNA, 25 bp, Rattus norvegicus
gaggggcctcgttctccaggctcac

SEQ ID NO: 665218 - DNA, 25 bp, Rattus norvegicus
tcgttctccaggctcaccacgtgtg

SEQ ID NO: 665219 - DNA, 25 bp, Rattus norvegicus
aggatgagcgcacccaccacgaagt

SEQ ID NO: 665220 - DNA, 25 bp, Rattus norvegicus
cggatcggaagctcacgtcgaactc

SEQ ID NO: 665221 - DNA, 25 bp, Rattus norvegicus
agggctagtttttctgcggatcgga

SEQ ID NO: 665222 - DNA, 25 bp, Rattus norvegicus
tcgcttctcctcgtagacgcggaga

SEQ ID NO: 665223 - DNA, 25 bp, Rattus norvegicus
agggtcttcaagctggacttgctcc

SEQ ID NO: 665224 - DNA, 25 bp, Rattus norvegicus
tccacggtctcgttccggaagagga

SEQ ID NO: 665225 - DNA, 25 bp, Rattus norvegicus
ttgagccaggtcacgatgtcctcca

SEQ ID NO: 665226 - DNA, 25 bp, Rattus norvegicus
actgcgtagatgtcgtcagggtcca

SEQ ID NO: 665227 - DNA, 25 bp, Rattus norvegicus
tcgtctccctggaaacagatgcgca

SEQ ID NO: 665228 - DNA, 25 bp, Rattus norvegicus
ttcttctccgccaggttcttaacca

SEQ ID NO: 665229 - DNA, 25 bp, Rattus norvegicus
gctccactgccggtggccatgttac

SEQ ID NO: 665230 - DNA, 25 bp, Rattus norvegicus
cccgctctgaaatcggatgcttctg

SEQ ID NO: 665231 - DNA, 25 bp, Rattus norvegicus
tccgccctcttggaattcttgtata

SEQ ID NO: 665232 - DNA, 25 bp, Rattus norvegicus
ccggggatctgaatgactgcgtaga

SEQ ID NO: 665233 - DNA, 25 bp, Rattus norvegicus
ctggcaaggtgagcgccaagagact

SEQ ID NO: 665234 - DNA, 25 bp, Rattus norvegicus
aggacttggacacacgtgacggggc

SEQ ID NO: 665235 - DNA, 25 bp, Rattus norvegicus
ctctgtcctgggcacagcaagtagc

SEQ ID NO: 665236 - DNA, 25 bp, Rattus norvegicus
gtggccaggcgagactccctgccag

SEQ ID NO: 665237 - DNA, 25 bp, Rattus norvegicus
tagcggcaaatgcagcccaggccaa

SEQ ID NO: 665238 - DNA, 25 bp, Rattus norvegicus
acggggcggacgtccctctgtcctg

SEQ ID NO: 665239 - DNA, 25 bp, Rattus norvegicus
agcgccaagagactcctggaggccc

SEQ ID NO: 665240 - DNA, 25 bp, Rattus norvegicus
caagtgcgtggccaggcgagactcc

SEQ ID NO: 665241 - DNA, 25 bp, Rattus norvegicus
gtccctggtgctgacgctggtccgc

SEQ ID NO: 665242 - DNA, 25 bp, Rattus norvegicus
gcacgcgcgactccagcccagtccc

SEQ ID NO: 665243 - DNA, 25 bp, Rattus norvegicus
gcctctctgcaagcggcacgcgcga

SEQ ID NO: 665244 - DNA, 25 bp, Rattus norvegicus
ctggacgcctagctgcctctctgca

SEQ ID NO: 665245 - DNA, 25 bp, Rattus norvegicus
ttgcggccacggctctggacgccta

SEQ ID NO: 665246 - DNA, 25 bp, Rattus norvegicus
tgggcacagcaagtagcggcaaatg

SEQ ID NO: 665247 - DNA, 25 bp, Rattus norvegicus
tccaagggcacttgagttccgaacc

SEQ ID NO: 665248 - DNA, 25 bp, Rattus norvegicus
gcctccgcgtgtcaaggtaaacttg

SEQ ID NO: 665249 - DNA, 25 bp, Rattus norvegicus
acttgcctgttctggcggagttctc

SEQ ID NO: 665250 - DNA, 25 bp, Rattus norvegicus
ttctccggacccttgcatgcagtgt

SEQ ID NO: 665251 - DNA, 25 bp, Rattus norvegicus
agagcctggcacaagggacccttac

SEQ ID NO: 665252 - DNA, 25 bp, Rattus norvegicus
tccaggaacgcgagtcgagaaagtt

SEQ ID NO: 665253 - DNA, 25 bp, Rattus norvegicus
caaacctgttgtcgggtacctcgtg

SEQ ID NO: 665254 - DNA, 25 bp, Rattus norvegicus
gcgccagcggctcctgaatttttca

SEQ ID NO: 665255 - DNA, 25 bp, Rattus norvegicus
gaatttttcacgcagaggcgggccg

SEQ ID NO: 665256 - DNA, 25 bp, Rattus norvegicus
ccatggcaccagaacactcgggtta

SEQ ID NO: 665257 - DNA, 25 bp, Rattus norvegicus
actcgggttacagccaggagatccc

SEQ ID NO: 665258 - DNA, 25 bp, Rattus norvegicus
gcccttgtagggcatcaatgcatcc

SEQ ID NO: 665259 - DNA, 25 bp, Rattus norvegicus
tgcatcccggcagttcctcttcaaa

SEQ ID NO: 665260 - DNA, 25 bp, Rattus norvegicus
cagaactcgggactcacatccagga

SEQ ID NO: 665261 - DNA, 25 bp, Rattus norvegicus
cctgacagcacgcagcgcacgacgc

SEQ ID NO: 665262 - DNA, 25 bp, Rattus norvegicus
cgcctgcgccgccaagacaatgcgg

SEQ ID NO: 665263 - DNA, 25 bp, Rattus norvegicus
cgcctgcgctgtggtgttcgactgc

SEQ ID NO: 665264 - DNA, 25 bp, Rattus norvegicus
gttcatcgagacctcagccactctg

SEQ ID NO: 665265 - DNA, 25 bp, Rattus norvegicus
tcagccactctgcagcacaacgtga

SEQ ID NO: 665266 - DNA, 25 bp, Rattus norvegicus
tgcagcacaacgtgacagagctctt

SEQ ID NO: 665267 - DNA, 25 bp, Rattus norvegicus
gcacaacgtgacagagctcttcgaa

SEQ ID NO: 665268 - DNA, 25 bp, Rattus norvegicus
cgtgacagagctcttcgaaggtgtg

SEQ ID NO: 665269 - DNA, 25 bp, Rattus norvegicus
tcttcgaaggtgtggtgcgccaact

SEQ ID NO: 665270 - DNA, 25 bp, Rattus norvegicus
ggagacaccttcacctcgacggcgg

SEQ ID NO: 665271 - DNA, 25 bp, Rattus norvegicus
gccagcttgggccagcgtgcccgcc

SEQ ID NO: 665272 - DNA, 25 bp, Rattus norvegicus
ccgcttcctggcacgcctgacagca

SEQ ID NO: 665273 - DNA, 25 bp, Rattus norvegicus
agcgcacgacgccgggcactcaaag

SEQ ID NO: 665274 - DNA, 25 bp, Rattus norvegicus
acagagctcttcgaaggtgtggtgc

SEQ ID NO: 665275 - DNA, 25 bp, Rattus norvegicus
gagagccagcgccttcaacttccat

SEQ ID NO: 665276 - DNA, 25 bp, Rattus norvegicus
cgagcgcagcctcgccatggattcg

SEQ ID NO: 665277 - DNA, 25 bp, Rattus norvegicus
ggtcggcttcaagttgcttagcaac

SEQ ID NO: 665278 - DNA, 25 bp, Rattus norvegicus
tgctcatggcgctgctgcccatctt

SEQ ID NO: 665279 - DNA, 25 bp, Rattus norvegicus
tcgccatggattcggccctcagcga

SEQ ID NO: 665280 - DNA, 25 bp, Rattus norvegicus
ttctccgtctgcgttcgtgctgcgg

SEQ ID NO: 665281 - DNA, 25 bp, Rattus norvegicus
gcagtgcctcttctccgtctgcgtt

SEQ ID NO: 665282 - DNA, 25 bp, Rattus norvegicus
cacgtcacttcctgtttctttaggg

SEQ ID NO: 665283 - DNA, 25 bp, Rattus norvegicus
aggcaagggaacacgtcacttcctg

SEQ ID NO: 665284 - DNA, 25 bp, Rattus norvegicus
ctgcgcctcacggaaaggcaaggga

SEQ ID NO: 665285 - DNA, 25 bp, Rattus norvegicus
cgttcactgcgcctcacggaaaggc

SEQ ID NO: 665286 - DNA, 25 bp, Rattus norvegicus
tcaccgccaccagagggcgatcggg

SEQ ID NO: 665287 - DNA, 25 bp, Rattus norvegicus
tcaagttgcttagcaacatgccgcc

SEQ ID NO: 665288 - DNA, 25 bp, Rattus norvegicus
acacccgagggcattgcgctggcct

SEQ ID NO: 665289 - DNA, 25 bp, Rattus norvegicus
actcggacggtcagcgatccgcgct

SEQ ID NO: 665290 - DNA, 25 bp, Rattus norvegicus
ccttagatttggatgctctgacgca

SEQ ID NO: 665291 - DNA, 25 bp, Rattus norvegicus
tatagtgccgcgagaagtgtgccgc

SEQ ID NO: 665292 - DNA, 25 bp, Rattus norvegicus
cagcttggcgcatgtccagtccgaa

SEQ ID NO: 665293 - DNA, 25 bp, Rattus norvegicus
cccgaagtggttgtccatccttaga

SEQ ID NO: 665294 - DNA, 25 bp, Rattus norvegicus
ggatgccggtgccatccttcctgta

SEQ ID NO: 665295 - DNA, 25 bp, Rattus norvegicus
ccttcctgtagaccacggactcgga

SEQ ID NO: 665296 - DNA, 25 bp, Rattus norvegicus
gctctgacgcattttccggtccaga

SEQ ID NO: 665297 - DNA, 25 bp, Rattus norvegicus
gcccttcttgcaatcggaaatccgg

SEQ ID NO: 665298 - DNA, 25 bp, Rattus norvegicus
tcagtggagcggaagtcattggttt

SEQ ID NO: 665299 - DNA, 25 bp, Rattus norvegicus
cattggttttgtacagccgtaaagc

SEQ ID NO: 665300 - DNA, 25 bp, Rattus norvegicus
ccgcgagagatttgtgccgcagctt

SEQ ID NO: 665301 - DNA, 25 bp, Rattus norvegicus
gaccatcttccggttagcgacaacg

SEQ ID NO: 665302 - DNA, 25 bp, Rattus norvegicus
gtaaagcgcaatctgtcggaccatc

SEQ ID NO: 665303 - DNA, 25 bp, Rattus norvegicus
ccttgcaagcgggaaggaaagcgcc

SEQ ID NO: 665304 - DNA, 25 bp, Rattus norvegicus
cagcgcctggctccagcgagtctgg

SEQ ID NO: 665305 - DNA, 25 bp, Rattus norvegicus
tccgctgccggaagccgttcgccct

SEQ ID NO: 665306 - DNA, 25 bp, Rattus norvegicus
ccgccagctgggctgctcgcctgcg

SEQ ID NO: 665307 - DNA, 25 bp, Rattus norvegicus
ggccgcctccctacgcactgcgggg

SEQ ID NO: 665308 - DNA, 25 bp, Rattus norvegicus
gtgcgccaggaagggccttgcaagc

SEQ ID NO: 665309 - DNA, 25 bp, Rattus norvegicus
agtctgggccgcctccctacgcact

SEQ ID NO: 665310 - DNA, 25 bp, Rattus norvegicus
cacacctggactccgcaggcggtag

SEQ ID NO: 665311 - DNA, 25 bp, Rattus norvegicus
gccaaggccacacctggactccgca

SEQ ID NO: 665312 - DNA, 25 bp, Rattus norvegicus
gaaggaaagcgccacctctctcgcc

SEQ ID NO: 665313 - DNA, 25 bp, Rattus norvegicus
gcgggaaggaaagcgccacctctct

SEQ ID NO: 665314 - DNA, 25 bp, Rattus norvegicus
ttgcaagcgggaaggaaagcgccac

SEQ ID NO: 665315 - DNA, 25 bp, Rattus norvegicus
ccacgggaggagcagcatcctgcgg

SEQ ID NO: 665316 - DNA, 25 bp, Rattus norvegicus
caagcgggaaggaaagcgccacctc

SEQ ID NO: 665317 - DNA, 25 bp, Rattus norvegicus
ggtcttttggctctcccgcgcagca

SEQ ID NO: 665318 - DNA, 25 bp, Rattus norvegicus
tcttgttggctgttcgtggttctaa

SEQ ID NO: 665319 - DNA, 25 bp, Rattus norvegicus
tgctgcgttcgtgttctcgcacagg

SEQ ID NO: 665320 - DNA, 25 bp, Rattus norvegicus
tcccgcgcagcagtttgctgcgttc

SEQ ID NO: 665321 - DNA, 25 bp, Rattus norvegicus
tctcgcacaggcatcgcgttggaca

SEQ ID NO: 665322 - DNA, 25 bp, Rattus norvegicus
catcgcgttggacaggccggcgcct

SEQ ID NO: 665323 - DNA, 25 bp, Rattus norvegicus
cctcgccactcttgttggctgttcg

SEQ ID NO: 665324 - DNA, 25 bp, Rattus norvegicus
cgtggttctaaggaacagaagcatg

SEQ ID NO: 665325 - DNA, 25 bp, Rattus norvegicus
cgagagctgcgagctctgctgctgt

SEQ ID NO: 665326 - DNA, 25 bp, Rattus norvegicus
tgcagtctgcactgagggctcccgc

SEQ ID NO: 665327 - DNA, 25 bp, Rattus norvegicus
aggcctcactgctcggggactgcta

SEQ ID NO: 665328 - DNA, 25 bp, Rattus norvegicus
aggaagaagcggtcgtttctagcga

SEQ ID NO: 665329 - DNA, 25 bp, Rattus norvegicus
cggtcgtttctagcgagcggaatcg

SEQ ID NO: 665330 - DNA, 25 bp, Rattus norvegicus
cgcgcgatgacgtcattgagccgcc

SEQ ID NO: 665331 - DNA, 25 bp, Rattus norvegicus
gcctcaaggagctggtgcctaccct

SEQ ID NO: 665332 - DNA, 25 bp, Rattus norvegicus
ctcagcaccctgaacggcgagatca

SEQ ID NO: 665333 - DNA, 25 bp, Rattus norvegicus
ctctgagtctgaagtcgcgaccgcc

SEQ ID NO: 665334 - DNA, 25 bp, Rattus norvegicus
tgttatcgactacatcagggacctg

SEQ ID NO: 665335 - DNA, 25 bp, Rattus norvegicus
cctgcctcagaaccgcaaagtgagc

SEQ ID NO: 665336 - DNA, 25 bp, Rattus norvegicus
acggctgctactcacgcctcaagga

SEQ ID NO: 665337 - DNA, 25 bp, Rattus norvegicus
ttctgctctacgacatgaacggctg

SEQ ID NO: 665338 - DNA, 25 bp, Rattus norvegicus
caggtgaacgttctgctctacgaca

SEQ ID NO: 665339 - DNA, 25 bp, Rattus norvegicus
tgcccgccttgctggacgaacagca

SEQ ID NO: 665340 - DNA, 25 bp, Rattus norvegicus
tctgtcggagcaaagcgttgccatc

SEQ ID NO: 665341 - DNA, 25 bp, Rattus norvegicus
cccagctgttcgctgaaggcaggca

SEQ ID NO: 665342 - DNA, 25 bp, Rattus norvegicus
catgaaggtcgccagtagcagtgcc

SEQ ID NO: 665343 - DNA, 25 bp, Rattus norvegicus
tctccgcctgtcctcaggatcatga

SEQ ID NO: 665344 - DNA, 25 bp, Rattus norvegicus
caaggtggagatactgcagcatgtt

SEQ ID NO: 665345 - DNA, 25 bp, Rattus norvegicus
tgcggagctatttaacctgagcatc

SEQ ID NO: 665346 - DNA, 25 bp, Rattus norvegicus
ggcccgaggaatgcggagctattta

SEQ ID NO: 665347 - DNA, 25 bp, Rattus norvegicus
tgagcatccccaggtgtacggaggc

SEQ ID NO: 665348 - DNA, 25 bp, Rattus norvegicus
acggccgcgctagacaaacagcggc

SEQ ID NO: 665349 - DNA, 25 bp, Rattus norvegicus
cggcctgggagcgtttccatcagct

SEQ ID NO: 665350 - DNA, 25 bp, Rattus norvegicus
tttccatcagctgggcccgaggaat

SEQ ID NO: 665351 - DNA, 25 bp, Rattus norvegicus
ccgcagcggcctgggagcgtttcca

SEQ ID NO: 665352 - DNA, 25 bp, Rattus norvegicus
ccgaggaatgcggagctatttaacc

SEQ ID NO: 665353 - DNA, 25 bp, Rattus norvegicus
cggagctatttaacctgagcatccc

SEQ ID NO: 665354 - DNA, 25 bp, Rattus norvegicus
cccaggtgtacggaggcgcctggct

SEQ ID NO: 665355 - DNA, 25 bp, Rattus norvegicus
ctggctgtctgggcccgccgacttt

SEQ ID NO: 665356 - DNA, 25 bp, Rattus norvegicus
gccgactttggcacggccgcgctag

SEQ ID NO: 665357 - DNA, 25 bp, Rattus norvegicus
ggcacggccgcgctagacaaacagc

SEQ ID NO: 665358 - DNA, 25 bp, Rattus norvegicus
agcgtttccatcagctgggcccgag

SEQ ID NO: 665359 - DNA, 25 bp, Rattus norvegicus
ctggctgactgctcgtgccgaatct

SEQ ID NO: 665360 - DNA, 25 bp, Rattus norvegicus
tctcccggagaagccggcctcagtt

SEQ ID NO: 665361 - DNA, 25 bp, Rattus norvegicus
ccaggaagaagggttgaggctccca

SEQ ID NO: 665362 - DNA, 25 bp, Rattus norvegicus
tggcttccagatacgagggcgtttt

SEQ ID NO: 665363 - DNA, 25 bp, Rattus norvegicus
cagcttagccaatccgcgggtcgag

SEQ ID NO: 665364 - DNA, 25 bp, Rattus norvegicus
ttcttgagacccgacccaaggcggc

SEQ ID NO: 665365 - DNA, 25 bp, Rattus norvegicus
gcggagacctcgttttcttgagacc

SEQ ID NO: 665366 - DNA, 25 bp, Rattus norvegicus
ggggactgccaggtcctccattccg

SEQ ID NO: 665367 - DNA, 25 bp, Rattus norvegicus
cccaaaggctctggacatagcactg

SEQ ID NO: 665368 - DNA, 25 bp, Rattus norvegicus
caccgctagttgtctttgaattccc

SEQ ID NO: 665369 - DNA, 25 bp, Rattus norvegicus
tccaagaggagtaggctggagaccc

SEQ ID NO: 665370 - DNA, 25 bp, Rattus norvegicus
cggcctcggatctgcgatctgattt

SEQ ID NO: 665371 - DNA, 25 bp, Rattus norvegicus
gggaacttgcaagcgcagtcacttc

SEQ ID NO: 665372 - DNA, 25 bp, Rattus norvegicus
ctgatttcggaaagaccactcccgg

SEQ ID NO: 665373 - DNA, 25 bp, Rattus norvegicus
actacatttctctgaaggcgctctg

SEQ ID NO: 665374 - DNA, 25 bp, Rattus norvegicus
cccgcgctagggactacatttctct

SEQ ID NO: 665375 - DNA, 25 bp, Rattus norvegicus
cgctctggccagttgccatcttgtc

SEQ ID NO: 665376 - DNA, 25 bp, Rattus norvegicus
gccgctgcattttcagaggccaatc

SEQ ID NO: 665377 - DNA, 25 bp, Rattus norvegicus
ccaatcagagggcagagttgttaac

SEQ ID NO: 665378 - DNA, 25 bp, Rattus norvegicus
gagttgttaacttccggctctctga

SEQ ID NO: 665379 - DNA, 25 bp, Rattus norvegicus
ccggctctctgattggtgcatttga

SEQ ID NO: 665380 - DNA, 25 bp, Rattus norvegicus
gaccggtgtctgagttcaaattttc

SEQ ID NO: 665381 - DNA, 25 bp, Rattus norvegicus
ccgtactagttgtgtccgggagccg

SEQ ID NO: 665382 - DNA, 25 bp, Rattus norvegicus
cttaggcgctggcttcttagagttg

SEQ ID NO: 665383 - DNA, 25 bp, Rattus norvegicus
cttagagttggtgcaagctgaagcc

SEQ ID NO: 665384 - DNA, 25 bp, Rattus norvegicus
cgggagccattcctcagttttctga

SEQ ID NO: 665385 - DNA, 25 bp, Rattus norvegicus
gcgggccatgccagcctagacagcg

SEQ ID NO: 665386 - DNA, 25 bp, Rattus norvegicus
agtcgtttcaatgcgcccgcgctag

SEQ ID NO: 665387 - DNA, 25 bp, Rattus norvegicus
aagctgccgtgctggaacatgtcgt

SEQ ID NO: 665388 - DNA, 25 bp, Rattus norvegicus
aacatgtcgtggcagtctggatcca

SEQ ID NO: 665389 - DNA, 25 bp, Rattus norvegicus
tggatccagggtccagtagctgccc

SEQ ID NO: 665390 - DNA, 25 bp, Rattus norvegicus
gcccttgcctggcttgcggtcatca

SEQ ID NO: 665391 - DNA, 25 bp, Rattus norvegicus
gcttgcggtcatcacgaggcacctt

SEQ ID NO: 665392 - DNA, 25 bp, Rattus norvegicus
gtcatcacgaggcaccttgacgaag

SEQ ID NO: 665393 - DNA, 25 bp, Rattus norvegicus
gaagcactcgttgagagacaggtta

SEQ ID NO: 665394 - DNA, 25 bp, Rattus norvegicus
actcgttgagagacaggttatggcg

SEQ ID NO: 665395 - DNA, 25 bp, Rattus norvegicus
cggtaaaatgcaaagcggcccatga

SEQ ID NO: 665396 - DNA, 25 bp, Rattus norvegicus
ctggccggttgtgccggtaaaatgc

SEQ ID NO: 665397 - DNA, 25 bp, Rattus norvegicus
cggcccatgatgtagcggtagatgc

SEQ ID NO: 665398 - DNA, 25 bp, Rattus norvegicus
ggatgctgttttgccagcctggccg

SEQ ID NO: 665399 - DNA, 25 bp, Rattus norvegicus
tgatgtagcggtagatgccactgag

SEQ ID NO: 665400 - DNA, 25 bp, Rattus norvegicus
ttatggcggatgctgttttgccagc

SEQ ID NO: 665401 - DNA, 25 bp, Rattus norvegicus
tgcggccggaagttgatgtccttaa

SEQ ID NO: 665402 - DNA, 25 bp, Rattus norvegicus
agcgctccggccaaagtgcggtgac

SEQ ID NO: 665403 - DNA, 25 bp, Rattus norvegicus
acgagactgcatcgctgggctccac

SEQ ID NO: 665404 - DNA, 25 bp, Rattus norvegicus
ctgggctccacaccgaagctggagt

SEQ ID NO: 665405 - DNA, 25 bp, Rattus norvegicus
tggggagccggcgaacaaaacgatc

SEQ ID NO: 665406 - DNA, 25 bp, Rattus norvegicus
ctttagccaacttcgcgccttcggg

SEQ ID NO: 665407 - DNA, 25 bp, Rattus norvegicus
gggatgtgccctgctctgcactgac

SEQ ID NO: 665408 - DNA, 25 bp, Rattus norvegicus
gctccagtcaatgcgcccttcaggt

SEQ ID NO: 665409 - DNA, 25 bp, Rattus norvegicus
tcaattccctcctgcagtgccggga

SEQ ID NO: 665410 - DNA, 25 bp, Rattus norvegicus
gggactctcacctgggacatctgcg

SEQ ID NO: 665411 - DNA, 25 bp, Rattus norvegicus
atgtccttaaggtcgatggagccgg

SEQ ID NO: 665412 - DNA, 25 bp, Rattus norvegicus
agcgcctgcgccaggtcgaagacca

SEQ ID NO: 665413 - DNA, 25 bp, Rattus norvegicus
cagctggcacagaaggacgccgtcg

SEQ ID NO: 665414 - DNA, 25 bp, Rattus norvegicus
cggcaggaccttgcagtcaatgagc

SEQ ID NO: 665415 - DNA, 25 bp, Rattus norvegicus
cccgctttcgcctgtcagggtggag

SEQ ID NO: 665416 - DNA, 25 bp, Rattus norvegicus
ggaccctggcgacagcgcctgcaga

SEQ ID NO: 665417 - DNA, 25 bp, Rattus norvegicus
aaagtctgcttgacgcgcgccagca

SEQ ID NO: 665418 - DNA, 25 bp, Rattus norvegicus
ggaggcagaagaaagtctgcttgac

SEQ ID NO: 665419 - DNA, 25 bp, Rattus norvegicus
cccgcgaaggctgaagcgtcaggac

SEQ ID NO: 665420 - DNA, 25 bp, Rattus norvegicus
cgaggctcccacgagctctgggtgc

SEQ ID NO: 665421 - DNA, 25 bp, Rattus norvegicus
acactgaggacggacgcagacaagc

SEQ ID NO: 665422 - DNA, 25 bp, Rattus norvegicus
tcacagagcggacactgaggacgga

SEQ ID NO: 665423 - DNA, 25 bp, Rattus norvegicus
cacagactcacagagcggacactga

SEQ ID NO: 665424 - DNA, 25 bp, Rattus norvegicus
aggccggccgaacacagactcacag

SEQ ID NO: 665425 - DNA, 25 bp, Rattus norvegicus
gcaccaagtggcttgcagcaggccg

SEQ ID NO: 665426 - DNA, 25 bp, Rattus norvegicus
tctcccgagtctaaggcaccaagtg

SEQ ID NO: 665427 - DNA, 25 bp, Rattus norvegicus
gaggcccaggatccttctcccgagt

SEQ ID NO: 665428 - DNA, 25 bp, Rattus norvegicus
agtcctcctcgtcgcggaacgggat

SEQ ID NO: 665429 - DNA, 25 bp, Rattus norvegicus
tagccctgtccagtcgccaccgccg

SEQ ID NO: 665430 - DNA, 25 bp, Rattus norvegicus
gcgaccttgcttagccctgtccagt

SEQ ID NO: 665431 - DNA, 25 bp, Rattus norvegicus
ctggcaccatcaggcgccgcgttta

SEQ ID NO: 665432 - DNA, 25 bp, Rattus norvegicus
caacggcagcttgttgcggccgcgt

SEQ ID NO: 665433 - DNA, 25 bp, Rattus norvegicus
acggcccgcgggacaacggcagctt

SEQ ID NO: 665434 - DNA, 25 bp, Rattus norvegicus
tcctcctaccctctcggtcatgtgg

SEQ ID NO: 665435 - DNA, 25 bp, Rattus norvegicus
ggcccggagcctgcagtctgatgga

SEQ ID NO: 665436 - DNA, 25 bp, Rattus norvegicus
ttcacagctgccttactggcccagg

SEQ ID NO: 665437 - DNA, 25 bp, Rattus norvegicus
agcgctaggttcacagctgccttac

SEQ ID NO: 665438 - DNA, 25 bp, Rattus norvegicus
tggaaagcgctaggttcacagctgc

SEQ ID NO: 665439 - DNA, 25 bp, Rattus norvegicus
tcagcgcctggaaagcgctaggttc

SEQ ID NO: 665440 - DNA, 25 bp, Rattus norvegicus
gcgcacgcccagctcagcgcctgga

SEQ ID NO: 665441 - DNA, 25 bp, Rattus norvegicus
tgatggagaaccaggggccgagcgt

SEQ ID NO: 665442 - DNA, 25 bp, Rattus norvegicus
caaagccctagtgtgcggggcccac

SEQ ID NO: 665443 - DNA, 25 bp, Rattus norvegicus
cctcgggggacaccatggtgccaca

SEQ ID NO: 665444 - DNA, 25 bp, Rattus norvegicus
gaggcccggtgatcaccctgcgacg

SEQ ID NO: 665445 - DNA, 25 bp, Rattus norvegicus
acgccgcgcacttgcgtagggcgct

SEQ ID NO: 665446 - DNA, 25 bp, Rattus norvegicus
cggccgccgcgtctctcacctgccg

SEQ ID NO: 665447 - DNA, 25 bp, Rattus norvegicus
ctcacctgccgcttgtctgagagca

SEQ ID NO: 665448 - DNA, 25 bp, Rattus norvegicus
acgcgccgttctgggacttccggca

SEQ ID NO: 665449 - DNA, 25 bp, Rattus norvegicus
acctgccgcttgtctgagagcactg

SEQ ID NO: 665450 - DNA, 25 bp, Rattus norvegicus
cgcttgtctgagagcactgcctctg

SEQ ID NO: 665451 - DNA, 25 bp, Rattus norvegicus
tctgagagcactgcctctgccagct

SEQ ID NO: 665452 - DNA, 25 bp, Rattus norvegicus
gcagcactcgatccgcctcggggga

SEQ ID NO: 665453 - DNA, 25 bp, Rattus norvegicus
atggtgccacagacctcttccgaca

SEQ ID NO: 665454 - DNA, 25 bp, Rattus norvegicus
ttccgacactcgcactactacttca

SEQ ID NO: 665455 - DNA, 25 bp, Rattus norvegicus
gttctgggacttccggcaagcctgc

SEQ ID NO: 665456 - DNA, 25 bp, Rattus norvegicus
ttcgaccaggtaccgcagcactcga

SEQ ID NO: 665457 - DNA, 25 bp, Rattus norvegicus
tccgctggttcgtctacgactactc

SEQ ID NO: 665458 - DNA, 25 bp, Rattus norvegicus
gcaccaaggacagtgctgtcgcctt

SEQ ID NO: 665459 - DNA, 25 bp, Rattus norvegicus
caacatggccgcgaagtcggatgga

SEQ ID NO: 665460 - DNA, 25 bp, Rattus norvegicus
gccacgctacgagctgcgggactgc

SEQ ID NO: 665461 - DNA, 25 bp, Rattus norvegicus
cgctgctcgtgttcttctccgacgg

SEQ ID NO: 665462 - DNA, 25 bp, Rattus norvegicus
ggcggcctcctactacctgcagggt

SEQ ID NO: 665463 - DNA, 25 bp, Rattus norvegicus
actacctgcagggtcagagcaccta

SEQ ID NO: 665464 - DNA, 25 bp, Rattus norvegicus
ggtcagagcacctacttcggcctca

SEQ ID NO: 665465 - DNA, 25 bp, Rattus norvegicus
tgccctcactggtcgtgcagctgct

SEQ ID NO: 665466 - DNA, 25 bp, Rattus norvegicus
tgcagctgctcagcttccgctggtt

SEQ ID NO: 665467 - DNA, 25 bp, Rattus norvegicus
tacgactactcggagcccacaggga

SEQ ID NO: 665468 - DNA, 25 bp, Rattus norvegicus
agcaccaaggacagcgacatagtcg

SEQ ID NO: 665469 - DNA, 25 bp, Rattus norvegicus
cgacatagtcggagccgccatcagc

SEQ ID NO: 665470 - DNA, 25 bp, Rattus norvegicus
tgctgtcgccttccggaccaaagaa

SEQ ID NO: 665471 - DNA, 25 bp, Rattus norvegicus
acctcaattgtgctttgcgggccgg

SEQ ID NO: 665472 - DNA, 25 bp, Rattus norvegicus
ggacactccgcgttgattgaatgca

SEQ ID NO: 665473 - DNA, 25 bp, Rattus norvegicus
tttaggagcctccagagccatccgg

SEQ ID NO: 665474 - DNA, 25 bp, Rattus norvegicus
tgccacattcctaggggaggggtcc

SEQ ID NO: 665475 - DNA, 25 bp, Rattus norvegicus
tggggaagtcacagtccacaatttg

SEQ ID NO: 665476 - DNA, 25 bp, Rattus norvegicus
gtgttccttgagaagtcccgctggc

SEQ ID NO: 665477 - DNA, 25 bp, Rattus norvegicus
caggactagggtatctggcacctaa

SEQ ID NO: 665478 - DNA, 25 bp, Rattus norvegicus
tacatctatgcatccgctagccggc

SEQ ID NO: 665479 - DNA, 25 bp, Rattus norvegicus
gcccagagtggcttctaaggatacc

SEQ ID NO: 665480 - DNA, 25 bp, Rattus norvegicus
tgactcggcgtttcctaagttcctg

SEQ ID NO: 665481 - DNA, 25 bp, Rattus norvegicus
tcgaggatcacgttacccgccgaga

SEQ ID NO: 665482 - DNA, 25 bp, Rattus norvegicus
gagtcctacggagcccaatgccaca

SEQ ID NO: 665483 - DNA, 25 bp, Rattus norvegicus
cacaatttggactctaaccgggttg

SEQ ID NO: 665484 - DNA, 25 bp, Rattus norvegicus
cagactgcagctcgcgtaggaaata

SEQ ID NO: 665485 - DNA, 25 bp, Rattus norvegicus
agtggccgtcagtaacgcaagaccc

SEQ ID NO: 665486 - DNA, 25 bp, Rattus norvegicus
ggccgtcagtaacgcaagacccgtc

SEQ ID NO: 665487 - DNA, 25 bp, Rattus norvegicus
tgaggcagcgtagaggctgaagacg

SEQ ID NO: 665488 - DNA, 25 bp, Rattus norvegicus
gctgaagacgggcaccgccgcaatc

SEQ ID NO: 665489 - DNA, 25 bp, Rattus norvegicus
tgaagacgggcaccgccgcaatcgc

SEQ ID NO: 665490 - DNA, 25 bp, Rattus norvegicus
gggcaccgccgcaatcgcgatcggt

SEQ ID NO: 665491 - DNA, 25 bp, Rattus norvegicus
tggccgtcagtaacgcaagacccgt

SEQ ID NO: 665492 - DNA, 25 bp, Rattus norvegicus
accgccgcaatcgcgatcggtcggg

SEQ ID NO: 665493 - DNA, 25 bp, Rattus norvegicus
caatcgcgatcggtcggggtcgcga

SEQ ID NO: 665494 - DNA, 25 bp, Rattus norvegicus
tcgcgagtggccgtcagtaacgcaa

SEQ ID NO: 665495 - DNA, 25 bp, Rattus norvegicus
gcttccggcttgaggcagcgtagag

SEQ ID NO: 665496 - DNA, 25 bp, Rattus norvegicus
gcgagtggccgtcagtaacgcaaga

SEQ ID NO: 665497 - DNA, 25 bp, Rattus norvegicus
cgagtggccgtcagtaacgcaagac

SEQ ID NO: 665498 - DNA, 25 bp, Rattus norvegicus
gagtggccgtcagtaacgcaagacc

SEQ ID NO: 665499 - DNA, 25 bp, Rattus norvegicus
aaagcggcggcgacacggagaacat

SEQ ID NO: 665500 - DNA, 25 bp, Rattus norvegicus
ggacactagcgagtcaaaatgcctc

SEQ ID NO: 665501 - DNA, 25 bp, Rattus norvegicus
ccgtatgctaatcgtggtgacagtt

SEQ ID NO: 665502 - DNA, 25 bp, Rattus norvegicus
gctaatcgtggtgacagtttgccta

SEQ ID NO: 665503 - DNA, 25 bp, Rattus norvegicus
tcgtggtgacagtttgcctagtgta

SEQ ID NO: 665504 - DNA, 25 bp, Rattus norvegicus
gcgaaagtcgccgtgactaagatgc

SEQ ID NO: 665505 - DNA, 25 bp, Rattus norvegicus
gtagggacactagcgagtcaaaatg

SEQ ID NO: 665506 - DNA, 25 bp, Rattus norvegicus
gtcaaaatgcctcgtggactccgta

SEQ ID NO: 665507 - DNA, 25 bp, Rattus norvegicus
atgcctcgtggactccgtatggaga

SEQ ID NO: 665508 - DNA, 25 bp, Rattus norvegicus
tcagtgggtcagagaacatgtgtcc

SEQ ID NO: 665509 - DNA, 25 bp, Rattus norvegicus
tgggtcagagaacatgtgtccgtgt

SEQ ID NO: 665510 - DNA, 25 bp, Rattus norvegicus
gtctgggcgaaagtcgccgtgacta

SEQ ID NO: 665511 - DNA, 25 bp, Rattus norvegicus
ccgtgactaagatgcgagggcgctt

SEQ ID NO: 665512 - DNA, 25 bp, Rattus norvegicus
gacagtttgcctagtgtagggacac

SEQ ID NO: 665513 - DNA, 25 bp, Rattus norvegicus
cttccaggtgcgacccggtttgcct

SEQ ID NO: 665514 - DNA, 25 bp, Rattus norvegicus
actggagtattcgtcgcctgccacg

SEQ ID NO: 665515 - DNA, 25 bp, Rattus norvegicus
gctcattttattgaccgccggctcc

SEQ ID NO: 665516 - DNA, 25 bp, Rattus norvegicus
tacccagcatgggatgctcatttta

SEQ ID NO: 665517 - DNA, 25 bp, Rattus norvegicus
tgcctcggaaaaagtacccagcatg

SEQ ID NO: 665518 - DNA, 25 bp, Rattus norvegicus
ttcggattgacttgcctcggaaaaa

SEQ ID NO: 665519 - DNA, 25 bp, Rattus norvegicus
ggaagaccattctggcactggagta

SEQ ID NO: 665520 - DNA, 25 bp, Rattus norvegicus
ccttgcggacagaggggcctgtcat

SEQ ID NO: 665521 - DNA, 25 bp, Rattus norvegicus
tacaccacctgtcttccaggtgcga

SEQ ID NO: 665522 - DNA, 25 bp, Rattus norvegicus
tctgccgaggactacaggcgctgag

SEQ ID NO: 665523 - DNA, 25 bp, Rattus norvegicus
gccaaggtctctgccgaggactaca

SEQ ID NO: 665524 - DNA, 25 bp, Rattus norvegicus
acaagtccgccaaggtctctgccga

SEQ ID NO: 665525 - DNA, 25 bp, Rattus norvegicus
tgaccgccggctccggaagaccatt

SEQ ID NO: 665526 - DNA, 25 bp, Rattus norvegicus
aggggcctgtcattcggattgactt

SEQ ID NO: 665527 - DNA, 25 bp, Rattus norvegicus
tccttccctaggtctgggcgtggac

SEQ ID NO: 665528 - DNA, 25 bp, Rattus norvegicus
cagacgttcaacgatagctgtgagc

SEQ ID NO: 665529 - DNA, 25 bp, Rattus norvegicus
ccgaaaagccgcgatttcctgctgc

SEQ ID NO: 665530 - DNA, 25 bp, Rattus norvegicus
aggtagctgggagcgacgccattac

SEQ ID NO: 665531 - DNA, 25 bp, Rattus norvegicus
atccaggtagctgggagcgacgcca

SEQ ID NO: 665532 - DNA, 25 bp, Rattus norvegicus
ggcatgtgagaaaggcgcgatgtga

SEQ ID NO: 665533 - DNA, 25 bp, Rattus norvegicus
caacgatagctgtgagcggcggcac

SEQ ID NO: 665534 - DNA, 25 bp, Rattus norvegicus
gagcggcgacagacgttcaacgata

SEQ ID NO: 665535 - DNA, 25 bp, Rattus norvegicus
tctgcagcctggactggcgcatggc

SEQ ID NO: 665536 - DNA, 25 bp, Rattus norvegicus
accatctgcagcctggactggcgca

SEQ ID NO: 665537 - DNA, 25 bp, Rattus norvegicus
gacggcacaccatctgcagcctgga

SEQ ID NO: 665538 - DNA, 25 bp, Rattus norvegicus
agccgcgatttcctgctgctgaacc

SEQ ID NO: 665539 - DNA, 25 bp, Rattus norvegicus
agttcgggtcgcgatccaggccctc

SEQ ID NO: 665540 - DNA, 25 bp, Rattus norvegicus
tgggcacagccgagcgacggcacac

SEQ ID NO: 665541 - DNA, 25 bp, Rattus norvegicus
gggtggaatcctcactgacagcttc

SEQ ID NO: 665542 - DNA, 25 bp, Rattus norvegicus
ggcgaccaggttgaagacaactacc

SEQ ID NO: 665543 - DNA, 25 bp, Rattus norvegicus
gacgacgtctacgaggatgtctccc

SEQ ID NO: 665544 - DNA, 25 bp, Rattus norvegicus
cccggacgatgacgacgtctacgag

SEQ ID NO: 665545 - DNA, 25 bp, Rattus norvegicus
acgcatgacatcgaggcactggccc

SEQ ID NO: 665546 - DNA, 25 bp, Rattus norvegicus
gctgactgacatcacgcatgacatc

SEQ ID NO: 665547 - DNA, 25 bp, Rattus norvegicus
agaccttccaccagctgctgactga

SEQ ID NO: 665548 - DNA, 25 bp, Rattus norvegicus
agaggccggaggagcagaccttcca

SEQ ID NO: 665549 - DNA, 25 bp, Rattus norvegicus
ctgcgtctgccgtgcgcagttatga

SEQ ID NO: 665550 - DNA, 25 bp, Rattus norvegicus
agcatgagctccacgtctgcgtctg

SEQ ID NO: 665551 - DNA, 25 bp, Rattus norvegicus
tcaagcgcagcatgagctccacgtc

SEQ ID NO: 665552 - DNA, 25 bp, Rattus norvegicus
cttcggccgcatcaagcgcagcatg

SEQ ID NO: 665553 - DNA, 25 bp, Rattus norvegicus
ggaatcctcactgacagcttcggcc

SEQ ID NO: 665554 - DNA, 25 bp, Rattus norvegicus
gacaactacctgtagctccgcggca

SEQ ID NO: 665555 - DNA, 25 bp, Rattus norvegicus
aggatcgtcctaggggcaaccgatc

SEQ ID NO: 665556 - DNA, 25 bp, Rattus norvegicus
cagtgagcaccaccgggttgccgct

SEQ ID NO: 665557 - DNA, 25 bp, Rattus norvegicus
cgcttgcactttacggttgcggctc

SEQ ID NO: 665558 - DNA, 25 bp, Rattus norvegicus
cactttacggttgcggctctcagac

SEQ ID NO: 665559 - DNA, 25 bp, Rattus norvegicus
caaagtcgccggtaaaggcggctct

SEQ ID NO: 665560 - DNA, 25 bp, Rattus norvegicus
taaaggcggctctgacccgctcgga

SEQ ID NO: 665561 - DNA, 25 bp, Rattus norvegicus
gagcgccaacgcagcctccgtagcc

SEQ ID NO: 665562 - DNA, 25 bp, Rattus norvegicus
gctaaggcgcccagatggccagtga

SEQ ID NO: 665563 - DNA, 25 bp, Rattus norvegicus
gtagcccgcaagtcttcgtcgcttg

SEQ ID NO: 665564 - DNA, 25 bp, Rattus norvegicus
ttcgtcgcttgctccgggctctcga

SEQ ID NO: 665565 - DNA, 25 bp, Rattus norvegicus
cgataacgtgcagacctccggggca

SEQ ID NO: 665566 - DNA, 25 bp, Rattus norvegicus
aacgtgcagacctccggggcaagga

SEQ ID NO: 665567 - DNA, 25 bp, Rattus norvegicus
ccagatggccagtgagcaccaccgg

SEQ ID NO: 665568 - DNA, 25 bp, Rattus norvegicus
tggcgaggaaaaaaggatcgtccta

SEQ ID NO: 665569 - DNA, 25 bp, Rattus norvegicus
gtcgggccattgtgcggtgcattgt

SEQ ID NO: 665570 - DNA, 25 bp, Rattus norvegicus
ccgccggtccgagtgccgggcttgt

SEQ ID NO: 665571 - DNA, 25 bp, Rattus norvegicus
ggagcagcgcgacggcctcccgccc

SEQ ID NO: 665572 - DNA, 25 bp, Rattus norvegicus
gaccctcgccggcactcactgcgct

SEQ ID NO: 665573 - DNA, 25 bp, Rattus norvegicus
gccggcactcactgcgctcgggacc

SEQ ID NO: 665574 - DNA, 25 bp, Rattus norvegicus
cgggctccgccaggcccgctcaggc

SEQ ID NO: 665575 - DNA, 25 bp, Rattus norvegicus
gtgccgcgggctctctatggtcccg

SEQ ID NO: 665576 - DNA, 25 bp, Rattus norvegicus
gctagagaggcccagccggcgcgcg

SEQ ID NO: 665577 - DNA, 25 bp, Rattus norvegicus
ctcggccgtcgacatgggcgccgcc

SEQ ID NO: 665578 - DNA, 25 bp, Rattus norvegicus
gtgggcaccgtcacacctgctgctg

SEQ ID NO: 665579 - DNA, 25 bp, Rattus norvegicus
tcacacctgctgctgcgggcgtctt

SEQ ID NO: 665580 - DNA, 25 bp, Rattus norvegicus
tgctgcgggcgtcttttctgcttct

SEQ ID NO: 665581 - DNA, 25 bp, Rattus norvegicus
ctatccggggcccggctagcgcaga

SEQ ID NO: 665582 - DNA, 25 bp, Rattus norvegicus
ggctctctatggtcccgcccgcccg

SEQ ID NO: 665583 - DNA, 25 bp, Rattus norvegicus
cttcagaggcccaataaagttattg

SEQ ID NO: 665584 - DNA, 25 bp, Rattus norvegicus
ctcagtgatatctctgaccacccgg

SEQ ID NO: 665585 - DNA, 25 bp, Rattus norvegicus
ttgcccagcctcagtgatatctctg

SEQ ID NO: 665586 - DNA, 25 bp, Rattus norvegicus
catcctttgcccagcctcagtgata

SEQ ID NO: 665587 - DNA, 25 bp, Rattus norvegicus
cggcgtcgttgctctgcgagccgca

SEQ ID NO: 665588 - DNA, 25 bp, Rattus norvegicus
taatcccggcgtcgttgctctgcga

SEQ ID NO: 665589 - DNA, 25 bp, Rattus norvegicus
gcccagcgtaatcccggcgtcgttg

SEQ ID NO: 665590 - DNA, 25 bp, Rattus norvegicus
ccgagccgggttgctaaggaagtga

SEQ ID NO: 665591 - DNA, 25 bp, Rattus norvegicus
gttattgaaattgacgcggttgcta

SEQ ID NO: 665592 - DNA, 25 bp, Rattus norvegicus
ggctgctcacttcagaggcccaata

SEQ ID NO: 665593 - DNA, 25 bp, Rattus norvegicus
ccatcggcgggctgctcacttcaga

SEQ ID NO: 665594 - DNA, 25 bp, Rattus norvegicus
tgggaagcgccctggcacactcggt

SEQ ID NO: 665595 - DNA, 25 bp, Rattus norvegicus
ggaacctgggaagcgccctggcaca

SEQ ID NO: 665596 - DNA, 25 bp, Rattus norvegicus
aattgacgcggttgctaaggaagtg

SEQ ID NO: 665597 - DNA, 25 bp, Rattus norvegicus
gacgatccgccttacttagcgccgg

SEQ ID NO: 665598 - DNA, 25 bp, Rattus norvegicus
gctttgttgcatcgcggccgcgcac

SEQ ID NO: 665599 - DNA, 25 bp, Rattus norvegicus
ataagaactggtgggcggatttcca

SEQ ID NO: 665600 - DNA, 25 bp, Rattus norvegicus
gggcggatttccagaagcgtaagaa

SEQ ID NO: 665601 - DNA, 25 bp, Rattus norvegicus
aacgcagttagcaccctcggggtca

SEQ ID NO: 665602 - DNA, 25 bp, Rattus norvegicus
gcgccttcactcttggcgttctcag

SEQ ID NO: 665603 - DNA, 25 bp, Rattus norvegicus
cagttcggcccgaggtgaccggcaa

SEQ ID NO: 665604 - DNA, 25 bp, Rattus norvegicus
tcgaggcgacgctggaaccctggcc

SEQ ID NO: 665605 - DNA, 25 bp, Rattus norvegicus
gttgcccgccaggactcgaggcgac

SEQ ID NO: 665606 - DNA, 25 bp, Rattus norvegicus
aggcgcacggactacatgtcccggc

SEQ ID NO: 665607 - DNA, 25 bp, Rattus norvegicus
cgttctcagccacatgcagggaata

SEQ ID NO: 665608 - DNA, 25 bp, Rattus norvegicus
gcagcataatagacgcgccggagct

SEQ ID NO: 665609 - DNA, 25 bp, Rattus norvegicus
ttagcgccggcaaagtggcgccgcc

SEQ ID NO: 665610 - DNA, 25 bp, Rattus norvegicus
agctgtacagggctcatgcgctacg

SEQ ID NO: 665611 - DNA, 25 bp, Rattus norvegicus
cgtcgaagggaagctgcgtttcgcc

SEQ ID NO: 665612 - DNA, 25 bp, Rattus norvegicus
gccgcattccttagccatcgcgggg

SEQ ID NO: 665613 - DNA, 25 bp, Rattus norvegicus
gcacgcatccgagcgtcgaagggaa

SEQ ID NO: 665614 - DNA, 25 bp, Rattus norvegicus
cgcatccgagcgtcgaagggaagct

SEQ ID NO: 665615 - DNA, 25 bp, Rattus norvegicus
attccttagccatcgcggggctgcc

SEQ ID NO: 665616 - DNA, 25 bp, Rattus norvegicus
cgtggttatgcggagccgccgcatt

SEQ ID NO: 665617 - DNA, 25 bp, Rattus norvegicus
agcggaggccggacccgtgacctct

SEQ ID NO: 665618 - DNA, 25 bp, Rattus norvegicus
ccgtttcccagcagcgcgggaaagc

SEQ ID NO: 665619 - DNA, 25 bp, Rattus norvegicus
tctccgtttcccagcagcgcgggaa

SEQ ID NO: 665620 - DNA, 25 bp, Rattus norvegicus
cccgccactagtccgctctccgttt

SEQ ID NO: 665621 - DNA, 25 bp, Rattus norvegicus
gtttcgccatctcggcccgccacta

SEQ ID NO: 665622 - DNA, 25 bp, Rattus norvegicus
gaagctgcgtttcgccatctcggcc

SEQ ID NO: 665623 - DNA, 25 bp, Rattus norvegicus
agggaagctgcgtttcgccatctcg

SEQ ID NO: 665624 - DNA, 25 bp, Rattus norvegicus
ctgccaccgtgggcgactgacgcag

SEQ ID NO: 665625 - DNA, 25 bp, Rattus norvegicus
tgcaaacggcgtggccgcggcacaa

SEQ ID NO: 665626 - DNA, 25 bp, Rattus norvegicus
tttaacccttgcgcgtgctctccgg

SEQ ID NO: 665627 - DNA, 25 bp, Rattus norvegicus
gatgtgtcccttcaccaggggtccc

SEQ ID NO: 665628 - DNA, 25 bp, Rattus norvegicus
cgacaccctagtttcttctccaagg

SEQ ID NO: 665629 - DNA, 25 bp, Rattus norvegicus
gtttcttctccaagggtgcacatga

SEQ ID NO: 665630 - DNA, 25 bp, Rattus norvegicus
cccgggtacttgaagctaggcgcac

SEQ ID NO: 665631 - DNA, 25 bp, Rattus norvegicus
tgcacatgagatgggctgtcggtcc

SEQ ID NO: 665632 - DNA, 25 bp, Rattus norvegicus
agcgacaggaacctaccaaagtggg

SEQ ID NO: 665633 - DNA, 25 bp, Rattus norvegicus
gaacctaccaaagtgggctcaactg

SEQ ID NO: 665634 - DNA, 25 bp, Rattus norvegicus
tgggctcaactgtgcaaaccgcgtc

SEQ ID NO: 665635 - DNA, 25 bp, Rattus norvegicus
caacgcgatgtgtcccttcaccagg

SEQ ID NO: 665636 - DNA, 25 bp, Rattus norvegicus
gctgccagcgaacgtctacctcccg

SEQ ID NO: 665637 - DNA, 25 bp, Rattus norvegicus
tgaagctaggcgcacctctaggacg

SEQ ID NO: 665638 - DNA, 25 bp, Rattus norvegicus
caactgtgcaaaccgcgtctcaact

SEQ ID NO: 665639 - DNA, 25 bp, Rattus norvegicus
ggctcccagaggctgcggacttcaa

SEQ ID NO: 665640 - DNA, 25 bp, Rattus norvegicus
agagcttggaggaagatcccttcgg

SEQ ID NO: 665641 - DNA, 25 bp, Rattus norvegicus
ctcccagaggctgcggacttcaagt

SEQ ID NO: 665642 - DNA, 25 bp, Rattus norvegicus
actcctgggtagagctctcttaagg

SEQ ID NO: 665643 - DNA, 25 bp, Rattus norvegicus
aaaggaggcgatgggaactgggctc

SEQ ID NO: 665644 - DNA, 25 bp, Rattus norvegicus
atgggaactgggctcgcccctggct

SEQ ID NO: 665645 - DNA, 25 bp, Rattus norvegicus
tgcactcctgggtagagctctctta

SEQ ID NO: 665646 - DNA, 25 bp, Rattus norvegicus
tggacgcgccgctgtgcactcctgg

SEQ ID NO: 665647 - DNA, 25 bp, Rattus norvegicus
ctgggtagagctctcttaagggaga

SEQ ID NO: 665648 - DNA, 25 bp, Rattus norvegicus
ggtagagctctcttaagggagaaga

SEQ ID NO: 665649 - DNA, 25 bp, Rattus norvegicus
ctctcttaagggagaagagcttgga

SEQ ID NO: 665650 - DNA, 25 bp, Rattus norvegicus
gaagagcttggaggaagatcccttc

SEQ ID NO: 665651 - DNA, 25 bp, Rattus norvegicus
gaagatcccttcggggcgcgcagcc

SEQ ID NO: 665652 - DNA, 25 bp, Rattus norvegicus
ctgtgcactcctgggtagagctctc

SEQ ID NO: 665653 - DNA, 25 bp, Rattus norvegicus
tgacgcttgacggaagtgggacggg

SEQ ID NO: 665654 - DNA, 25 bp, Rattus norvegicus
cgtgtggccgttagtgacgcttgac

SEQ ID NO: 665655 - DNA, 25 bp, Rattus norvegicus
ttagtgacgcttgacggaagtggga

SEQ ID NO: 665656 - DNA, 25 bp, Rattus norvegicus
cgttagtgacgcttgacggaagtgg

SEQ ID NO: 665657 - DNA, 25 bp, Rattus norvegicus
ccgttagtgacgcttgacggaagtg

SEQ ID NO: 665658 - DNA, 25 bp, Rattus norvegicus
tggccgttagtgacgcttgacggaa

SEQ ID NO: 665659 - DNA, 25 bp, Rattus norvegicus
gcaggcggccgggaccgcgtgtggc

SEQ ID NO: 665660 - DNA, 25 bp, Rattus norvegicus
gaagtgcgatggcaggcggccggga

SEQ ID NO: 665661 - DNA, 25 bp, Rattus norvegicus
aaaggaagtgcgatggcaggcggcc

SEQ ID NO: 665662 - DNA, 25 bp, Rattus norvegicus
cagaaaggaagtgcgatggcaggcg

SEQ ID NO: 665663 - DNA, 25 bp, Rattus norvegicus
tagtgacgcttgacggaagtgggac

SEQ ID NO: 665664 - DNA, 25 bp, Rattus norvegicus
ccgccgcagaaaggaagtgcgatgg

SEQ ID NO: 665665 - DNA, 25 bp, Rattus norvegicus
gccgcagaaaggaagtgcgatggca

SEQ ID NO: 665666 - DNA, 25 bp, Rattus norvegicus
ccgcgtgtggccgttagtgacgctt

SEQ ID NO: 665667 - DNA, 25 bp, Rattus norvegicus
ggacaaacagatcttccgcctcggc

SEQ ID NO: 665668 - DNA, 25 bp, Rattus norvegicus
gcacgccgactcaaggtgcggtcct

SEQ ID NO: 665669 - DNA, 25 bp, Rattus norvegicus
gtcctcctccggacaaacagatctt

SEQ ID NO: 665670 - DNA, 25 bp, Rattus norvegicus
tgcggtcctcctccggacaaacaga

SEQ ID NO: 665671 - DNA, 25 bp, Rattus norvegicus
tcggcttcagaagatagaatggggc

SEQ ID NO: 665672 - DNA, 25 bp, Rattus norvegicus
caaggtgcggtcctcctccggacaa

SEQ ID NO: 665673 - DNA, 25 bp, Rattus norvegicus
actcaaggtgcggtcctcctccgga

SEQ ID NO: 665674 - DNA, 25 bp, Rattus norvegicus
gaagggaaggcgcacgccgactcaa

SEQ ID NO: 665675 - DNA, 25 bp, Rattus norvegicus
atctgcatggactctgcagggaagg

SEQ ID NO: 665676 - DNA, 25 bp, Rattus norvegicus
gcacaatctgcatggactctgcagg

SEQ ID NO: 665677 - DNA, 25 bp, Rattus norvegicus
ctgggcgcgcacaatctgcatggac

SEQ ID NO: 665678 - DNA, 25 bp, Rattus norvegicus
attaagaatactgcccagacctggg

SEQ ID NO: 665679 - DNA, 25 bp, Rattus norvegicus
acaaacagatcttccgcctcggctt

SEQ ID NO: 665680 - DNA, 25 bp, Rattus norvegicus
gcgcgcacaatctgcatggactctg

SEQ ID NO: 665681 - DNA, 25 bp, Rattus norvegicus
aggaggctctgagcccaacaagccc

SEQ ID NO: 665682 - DNA, 25 bp, Rattus norvegicus
cccgcgcgctaatgactgttgacaa

SEQ ID NO: 665683 - DNA, 25 bp, Rattus norvegicus
gctgtcgtcaccactgcagaggggc

SEQ ID NO: 665684 - DNA, 25 bp, Rattus norvegicus
caccactgcagaggggcgccctgag

SEQ ID NO: 665685 - DNA, 25 bp, Rattus norvegicus
ctggggacccgcctctctcgggagt

SEQ ID NO: 665686 - DNA, 25 bp, Rattus norvegicus
cgcctctctcgggagtctcagtcga

SEQ ID NO: 665687 - DNA, 25 bp, Rattus norvegicus
ctctcgggagtctcagtcgagggct

SEQ ID NO: 665688 - DNA, 25 bp, Rattus norvegicus
ttctaagcaggaggaggctctgagc

SEQ ID NO: 665689 - DNA, 25 bp, Rattus norvegicus
tccctccggatcgaagccggcggcc

SEQ ID NO: 665690 - DNA, 25 bp, Rattus norvegicus
gttcgctaacgagcaggggccccag

SEQ ID NO: 665691 - DNA, 25 bp, Rattus norvegicus
cgcgcgctaatgactgttgacaacg

SEQ ID NO: 665692 - DNA, 25 bp, Rattus norvegicus
ctaatgactgttgacaacgcgcgca

SEQ ID NO: 665693 - DNA, 25 bp, Rattus norvegicus
atgactgttgacaacgcgcgcaggg

SEQ ID NO: 665694 - DNA, 25 bp, Rattus norvegicus
gacccgaccgctgatgggggttcta

SEQ ID NO: 665695 - DNA, 25 bp, Rattus norvegicus
caggacctcggcgatccgctggtat

SEQ ID NO: 665696 - DNA, 25 bp, Rattus norvegicus
agtcgccgtaggtgcgcaggcacca

SEQ ID NO: 665697 - DNA, 25 bp, Rattus norvegicus
ccttggagcgcacccagaactggaa

SEQ ID NO: 665698 - DNA, 25 bp, Rattus norvegicus
gagcccgtcttgaccggcacataca

SEQ ID NO: 665699 - DNA, 25 bp, Rattus norvegicus
gcgggatcccacctgtaaaagcggc

SEQ ID NO: 665700 - DNA, 25 bp, Rattus norvegicus
tgcgcaggcaccagtcccggaactg

SEQ ID NO: 665701 - DNA, 25 bp, Rattus norvegicus
actgtcttggttttggccgagtcgc

SEQ ID NO: 665702 - DNA, 25 bp, Rattus norvegicus
ctgcgtgtcactgtcttggttttgg

SEQ ID NO: 665703 - DNA, 25 bp, Rattus norvegicus
ccgctggtatttgctgcgtgtcact

SEQ ID NO: 665704 - DNA, 25 bp, Rattus norvegicus
gaactggaacttgcctttctcgccc

SEQ ID NO: 665705 - DNA, 25 bp, Rattus norvegicus
ctgcccaggcggaagcccttggagc

SEQ ID NO: 665706 - DNA, 25 bp, Rattus norvegicus
cacttggcccatcttgggttcccgg

SEQ ID NO: 665707 - DNA, 25 bp, Rattus norvegicus
ttgaccggcacatacaccacttggc

SEQ ID NO: 665708 - DNA, 25 bp, Rattus norvegicus
tagcagcagcgtcggcttcggcatc

SEQ ID NO: 665709 - DNA, 25 bp, Rattus norvegicus
gctgcgcttccgcagccgcactttc

SEQ ID NO: 665710 - DNA, 25 bp, Rattus norvegicus
agctgctgcatgtcgccacgcacgg

SEQ ID NO: 665711 - DNA, 25 bp, Rattus norvegicus
acgcccaggcgaggcccacctgcgc

SEQ ID NO: 665712 - DNA, 25 bp, Rattus norvegicus
agctggttcagctgctgcatgtcgc

SEQ ID NO: 665713 - DNA, 25 bp, Rattus norvegicus
cgcagccgcactttcgccacactcc

SEQ ID NO: 665714 - DNA, 25 bp, Rattus norvegicus
ttcagctgctgcatgtcgccacgca

SEQ ID NO: 665715 - DNA, 25 bp, Rattus norvegicus
ccacgcacggcctcgggcaccgggt

SEQ ID NO: 665716 - DNA, 25 bp, Rattus norvegicus
ggcaccgggtcctgcgtgcaatgca

SEQ ID NO: 665717 - DNA, 25 bp, Rattus norvegicus
accgggtcctgcgtgcaatgcagcc

SEQ ID NO: 665718 - DNA, 25 bp, Rattus norvegicus
ctgcgtgcaatgcagccggcccatg

SEQ ID NO: 665719 - DNA, 25 bp, Rattus norvegicus
aagtgcgtcggcccattcctgagcc

SEQ ID NO: 665720 - DNA, 25 bp, Rattus norvegicus
tcctcctcccgggtctcgctgcgct

SEQ ID NO: 665721 - DNA, 25 bp, Rattus norvegicus
cgatctcgtgacagcgcacgcgcgg

SEQ ID NO: 665722 - DNA, 25 bp, Rattus norvegicus
atgcagccggcccatggtgccagga

SEQ ID NO: 665723 - DNA, 25 bp, Rattus norvegicus
taagcggcccaagtaaacgtagcgc

SEQ ID NO: 665724 - DNA, 25 bp, Rattus norvegicus
cctggaggctcctggatctttgcgg

SEQ ID NO: 665725 - DNA, 25 bp, Rattus norvegicus
cgcccggcccaaggcgtattcgtcg

SEQ ID NO: 665726 - DNA, 25 bp, Rattus norvegicus
cctcgcagccgaagcccgcgtggac

SEQ ID NO: 665727 - DNA, 25 bp, Rattus norvegicus
tccctggaggctcctggatctttgc

SEQ ID NO: 665728 - DNA, 25 bp, Rattus norvegicus
cgtggacgctctcgcctgagcgccc

SEQ ID NO: 665729 - DNA, 25 bp, Rattus norvegicus
actaagccgggtggcccactggcgc

SEQ ID NO: 665730 - DNA, 25 bp, Rattus norvegicus
cccaagtaaacgtagcgcggcgatc

SEQ ID NO: 665731 - DNA, 25 bp, Rattus norvegicus
cgcccctcggggactgggacctgat

SEQ ID NO: 665732 - DNA, 25 bp, Rattus norvegicus
cacagccagcctcgcgacaggtgag

SEQ ID NO: 665733 - DNA, 25 bp, Rattus norvegicus
ggcgcgaccgcagcgccgcgccaca

SEQ ID NO: 665734 - DNA, 25 bp, Rattus norvegicus
atcggcgccggagattcgcgagccc

SEQ ID NO: 665735 - DNA, 25 bp, Rattus norvegicus
caagtaaacgtagcgcggcgatcgg

SEQ ID NO: 665736 - DNA, 25 bp, Rattus norvegicus
aggttccctggaggctcctggatct

SEQ ID NO: 665737 - DNA, 25 bp, Rattus norvegicus
gtgaccggcgaaatcttggctttgc

SEQ ID NO: 665738 - DNA, 25 bp, Rattus norvegicus
aaatcttggctttgcggctgggccc

SEQ ID NO: 665739 - DNA, 25 bp, Rattus norvegicus
tccgacggtttgaacgagacgaaga

SEQ ID NO: 665740 - DNA, 25 bp, Rattus norvegicus
acgagacgaagacagaaccggagcc

SEQ ID NO: 665741 - DNA, 25 bp, Rattus norvegicus
cggcagcagtcaggaattcacggga

SEQ ID NO: 665742 - DNA, 25 bp, Rattus norvegicus
gaattcacgggaggcggctcctcgt

SEQ ID NO: 665743 - DNA, 25 bp, Rattus norvegicus
tgaccacgtgcccaacagggcttgc

SEQ ID NO: 665744 - DNA, 25 bp, Rattus norvegicus
gctgcctagtggtgaccggcgaaat

SEQ ID NO: 665745 - DNA, 25 bp, Rattus norvegicus
cccgggcatgccagctgtcgatcaa

SEQ ID NO: 665746 - DNA, 25 bp, Rattus norvegicus
gtcattggtcgtaactgaccacgtg

SEQ ID NO: 665747 - DNA, 25 bp, Rattus norvegicus
gctcgcgggccagtctctataaaag

SEQ ID NO: 665748 - DNA, 25 bp, Rattus norvegicus
acccttagtgtaggacgcgtcgttg

SEQ ID NO: 665749 - DNA, 25 bp, Rattus norvegicus
taggacgcgtcgttgcataatgggt

SEQ ID NO: 665750 - DNA, 25 bp, Rattus norvegicus
cagctgtcgatcaaggactcggccc

SEQ ID NO: 665751 - DNA, 25 bp, Rattus norvegicus
gcgtgcaacttctgttccgccctga

SEQ ID NO: 665752 - DNA, 25 bp, Rattus norvegicus
cctaccgcatccaagcacgtgagtg

SEQ ID NO: 665753 - DNA, 25 bp, Rattus norvegicus
tgtcagcctgcttagaacccttctc

SEQ ID NO: 665754 - DNA, 25 bp, Rattus norvegicus
tctgaaaccggaaactgtcagcctg

SEQ ID NO: 665755 - DNA, 25 bp, Rattus norvegicus
ccacaactgcgaggtccgcgtctga

SEQ ID NO: 665756 - DNA, 25 bp, Rattus norvegicus
gacaccaagtgcagctccagtctct

SEQ ID NO: 665757 - DNA, 25 bp, Rattus norvegicus
gcctgtcactcgcaagacaccaagt

SEQ ID NO: 665758 - DNA, 25 bp, Rattus norvegicus
tctggctttttctggacgctgcgac

SEQ ID NO: 665759 - DNA, 25 bp, Rattus norvegicus
cagcggtcttactcaaggcctaata

SEQ ID NO: 665760 - DNA, 25 bp, Rattus norvegicus
ctgagctacactcgcagcggtctta

SEQ ID NO: 665761 - DNA, 25 bp, Rattus norvegicus
cttggccaaggacatacagaggtag

SEQ ID NO: 665762 - DNA, 25 bp, Rattus norvegicus
ctctgctccacaaggggaaacgcta

SEQ ID NO: 665763 - DNA, 25 bp, Rattus norvegicus
tgaacgcccgcaaaagctcgcaaga

SEQ ID NO: 665764 - DNA, 25 bp, Rattus norvegicus
tctcgcccgcggtgttctaacggaa

SEQ ID NO: 665765 - DNA, 25 bp, Rattus norvegicus
cacggctcgctacttccactgcggc

SEQ ID NO: 665766 - DNA, 25 bp, Rattus norvegicus
gctccgtctcctctaatttttctga

SEQ ID NO: 665767 - DNA, 25 bp, Rattus norvegicus
taatttttctgaccctcgtcgccgc

SEQ ID NO: 665768 - DNA, 25 bp, Rattus norvegicus
gcgcacgcgcaatccctcccgcctc

SEQ ID NO: 665769 - DNA, 25 bp, Rattus norvegicus
gactggtccaccagatcgtctgctc

SEQ ID NO: 665770 - DNA, 25 bp, Rattus norvegicus
tggtccaccagatcgtctgctctcg

SEQ ID NO: 665771 - DNA, 25 bp, Rattus norvegicus
cagatcgtctgctctcgcgcgcagg

SEQ ID NO: 665772 - DNA, 25 bp, Rattus norvegicus
ccagccgaggcgacgccagagcgcc

SEQ ID NO: 665773 - DNA, 25 bp, Rattus norvegicus
caggtaagggagtgacccggtcctg

SEQ ID NO: 665774 - DNA, 25 bp, Rattus norvegicus
ggcccacgggcttcgggatccacag

SEQ ID NO: 665775 - DNA, 25 bp, Rattus norvegicus
tcgggatccacagcgccgcacgtgt

SEQ ID NO: 665776 - DNA, 25 bp, Rattus norvegicus
agcgccgcacgtgttccgtgggcct

SEQ ID NO: 665777 - DNA, 25 bp, Rattus norvegicus
cggcgccgcatttgtggccgcgccc

SEQ ID NO: 665778 - DNA, 25 bp, Rattus norvegicus
ccctagacccgtagccctgcgagct

SEQ ID NO: 665779 - DNA, 25 bp, Rattus norvegicus
tcgaagtcccagtacgctgcgctcg

SEQ ID NO: 665780 - DNA, 25 bp, Rattus norvegicus
taggagttggtcagaaccgcgctcc

SEQ ID NO: 665781 - DNA, 25 bp, Rattus norvegicus
aatctaaggatgtgctgcggggatc

SEQ ID NO: 665782 - DNA, 25 bp, Rattus norvegicus
cccggtaatctaaggatgtgctgcg

SEQ ID NO: 665783 - DNA, 25 bp, Rattus norvegicus
cccgcacctacccttgatgctgatg

SEQ ID NO: 665784 - DNA, 25 bp, Rattus norvegicus
gcagcagagccagccgccacccttc

SEQ ID NO: 665785 - DNA, 25 bp, Rattus norvegicus
ttcgcctcgaagtcccagtacgctg

SEQ ID NO: 665786 - DNA, 25 bp, Rattus norvegicus
tgcctgacgccatcttcgcctcgaa

SEQ ID NO: 665787 - DNA, 25 bp, Rattus norvegicus
cagttctagcaacccggtgcgcgga

SEQ ID NO: 665788 - DNA, 25 bp, Rattus norvegicus
cggagcgcagttctagcaacccggt

SEQ ID NO: 665789 - DNA, 25 bp, Rattus norvegicus
ccagagtgagcaacacccgctgcca

SEQ ID NO: 665790 - DNA, 25 bp, Rattus norvegicus
gcgtcctccgccagagtgagcaaca

SEQ ID NO: 665791 - DNA, 25 bp, Rattus norvegicus
cttgatgctgatgccgagcccgccg

SEQ ID NO: 665792 - DNA, 25 bp, Rattus norvegicus
actgaagagacgctccccggtaatc

SEQ ID NO: 665793 - DNA, 25 bp, Rattus norvegicus
tcctgggaaacacgccggatttgga

SEQ ID NO: 665794 - DNA, 25 bp, Rattus norvegicus
tccacatccggaagtctggagcttc

SEQ ID NO: 665795 - DNA, 25 bp, Rattus norvegicus
ctggccgcgagagaagtattgtttt

SEQ ID NO: 665796 - DNA, 25 bp, Rattus norvegicus
gccctatggactggccgcgagagaa

SEQ ID NO: 665797 - DNA, 25 bp, Rattus norvegicus
ctaagccggactgtggagcggcctt

SEQ ID NO: 665798 - DNA, 25 bp, Rattus norvegicus
gcttctggtgctaagccggactgtg

SEQ ID NO: 665799 - DNA, 25 bp, Rattus norvegicus
ctatcccggcgcttcctgtggggct

SEQ ID NO: 665800 - DNA, 25 bp, Rattus norvegicus
gcactggatccaaggtcacgcggct

SEQ ID NO: 665801 - DNA, 25 bp, Rattus norvegicus
ctccataagcgcgaggctctgcaga

SEQ ID NO: 665802 - DNA, 25 bp, Rattus norvegicus
gaggggcctgctgctccataagcgc

SEQ ID NO: 665803 - DNA, 25 bp, Rattus norvegicus
tcgcgacagactgcgctccgcgatg

SEQ ID NO: 665804 - DNA, 25 bp, Rattus norvegicus
tgttttcgcggcttcggggctgaaa

SEQ ID NO: 665805 - DNA, 25 bp, Rattus norvegicus
gcaggcagctccaggataggacgca

SEQ ID NO: 665806 - DNA, 25 bp, Rattus norvegicus
cttccgcgtgcgttggtctgcacgc

SEQ ID NO: 665807 - DNA, 25 bp, Rattus norvegicus
ctgctgccatagtgtggcgaggccc

SEQ ID NO: 665808 - DNA, 25 bp, Rattus norvegicus
tgaagtcgagcgtgctgtgccttgc

SEQ ID NO: 665809 - DNA, 25 bp, Rattus norvegicus
tggggaggcgatcgcgggagactga

SEQ ID NO: 665810 - DNA, 25 bp, Rattus norvegicus
cctgtgccatgcctggggaggcgat

SEQ ID NO: 665811 - DNA, 25 bp, Rattus norvegicus
tgtggcgaggccctgtgccatgcct

SEQ ID NO: 665812 - DNA, 25 bp, Rattus norvegicus
atagtgtggcgaggccctgtgccat

SEQ ID NO: 665813 - DNA, 25 bp, Rattus norvegicus
ctgccatagtgtggcgaggccctgt

SEQ ID NO: 665814 - DNA, 25 bp, Rattus norvegicus
tgccttgctgctgccatagtgtggc

SEQ ID NO: 665815 - DNA, 25 bp, Rattus norvegicus
ctgtgccttgctgctgccatagtgt

SEQ ID NO: 665816 - DNA, 25 bp, Rattus norvegicus
tgctgtgccttgctgctgccatagt

SEQ ID NO: 665817 - DNA, 25 bp, Rattus norvegicus
cgtgctgtgccttgctgctgccata

SEQ ID NO: 665818 - DNA, 25 bp, Rattus norvegicus
aagtcgagcgtgctgtgccttgctg

SEQ ID NO: 665819 - DNA, 25 bp, Rattus norvegicus
ccttgctgctgccatagtgtggcga

SEQ ID NO: 665820 - DNA, 25 bp, Rattus norvegicus
agcgtgctgtgccttgctgctgcca

SEQ ID NO: 665821 - DNA, 25 bp, Rattus norvegicus
gccaaggcccagcagtactggcagc

SEQ ID NO: 665822 - DNA, 25 bp, Rattus norvegicus
cccagaccaagatcgtgctgctttt

SEQ ID NO: 665823 - DNA, 25 bp, Rattus norvegicus
cgcggccctgagtgtctggcacgac

SEQ ID NO: 665824 - DNA, 25 bp, Rattus norvegicus
agggcgtgttcttcccttcacaccg

SEQ ID NO: 665825 - DNA, 25 bp, Rattus norvegicus
aagatcgtgctgcttttcccgctgg

SEQ ID NO: 665826 - DNA, 25 bp, Rattus norvegicus
cgtgctgcttttcccgctggacaag

SEQ ID NO: 665827 - DNA, 25 bp, Rattus norvegicus
ttcccgctggacaagcggcagcagc

SEQ ID NO: 665828 - DNA, 25 bp, Rattus norvegicus
gcaagggcgtgttcttcccttcaca

SEQ ID NO: 665829 - DNA, 25 bp, Rattus norvegicus
atgaaaaggatcctggtgctgctgc

SEQ ID NO: 665830 - DNA, 25 bp, Rattus norvegicus
cccagcagtactggcagccgctgta

SEQ ID NO: 665831 - DNA, 25 bp, Rattus norvegicus
tactggcagccgctgtatgcgcacc

SEQ ID NO: 665832 - DNA, 25 bp, Rattus norvegicus
tgtatgcgcacctgctgacccaacg

SEQ ID NO: 665833 - DNA, 25 bp, Rattus norvegicus
gacccaacgcgaggcctgcggcgaa

SEQ ID NO: 665834 - DNA, 25 bp, Rattus norvegicus
gacgtgcttcccagccacggtggcg

SEQ ID NO: 665835 - DNA, 25 bp, Rattus norvegicus
ctgtactggtgagcgactcgccatc

SEQ ID NO: 665836 - DNA, 25 bp, Rattus norvegicus
ctactttcgcgatctgctggtggca

SEQ ID NO: 665837 - DNA, 25 bp, Rattus norvegicus
aggcagcaccctgtcgcgctacttt

SEQ ID NO: 665838 - DNA, 25 bp, Rattus norvegicus
ttccgtctgaatgtggcaggcagca

SEQ ID NO: 665839 - DNA, 25 bp, Rattus norvegicus
agctgctgtttgaggccctgacagt

SEQ ID NO: 665840 - DNA, 25 bp, Rattus norvegicus
gatccacccggagcagtggcctgta

SEQ ID NO: 665841 - DNA, 25 bp, Rattus norvegicus
cgcgcaccctatcaagcatggagtt

SEQ ID NO: 665842 - DNA, 25 bp, Rattus norvegicus
tgctgaagagctcgaatctgatgcc

SEQ ID NO: 665843 - DNA, 25 bp, Rattus norvegicus
caggcttcaccaaggcaggcttcgc

SEQ ID NO: 665844 - DNA, 25 bp, Rattus norvegicus
ccgagttgctgtggtagtggatcaa

SEQ ID NO: 665845 - DNA, 25 bp, Rattus norvegicus
ggctgccttcattgaaccgagttgc

SEQ ID NO: 665846 - DNA, 25 bp, Rattus norvegicus
ccgggcgcactgaacactgaaggtg

SEQ ID NO: 665847 - DNA, 25 bp, Rattus norvegicus
ggttatccgcccagaaggcccatta

SEQ ID NO: 665848 - DNA, 25 bp, Rattus norvegicus
tggcacaaggccaccttccgtctga

SEQ ID NO: 665849 - DNA, 25 bp, Rattus norvegicus
ttgcggttaccaggccgcccaggct

SEQ ID NO: 665850 - DNA, 25 bp, Rattus norvegicus
ccactcacgtcctgaaaaagcgcgt

SEQ ID NO: 665851 - DNA, 25 bp, Rattus norvegicus
cgccatggctcagaggcttgcaagg

SEQ ID NO: 665852 - DNA, 25 bp, Rattus norvegicus
gcacgccatggctcagaggcttgca

SEQ ID NO: 665853 - DNA, 25 bp, Rattus norvegicus
agcgcacgccatggctcagaggctt

SEQ ID NO: 665854 - DNA, 25 bp, Rattus norvegicus
agtgagcagcccagcgcacgccatg

SEQ ID NO: 665855 - DNA, 25 bp, Rattus norvegicus
aggcacacagtgagcagcccagcgc

SEQ ID NO: 665856 - DNA, 25 bp, Rattus norvegicus
aagcaggcacacagtgagcagccca

SEQ ID NO: 665857 - DNA, 25 bp, Rattus norvegicus
cccaagcaggcacacagtgagcagc

SEQ ID NO: 665858 - DNA, 25 bp, Rattus norvegicus
gcaggcgcagagtgtcgcgtcggct

SEQ ID NO: 665859 - DNA, 25 bp, Rattus norvegicus
tgaaaaagcgcgtgtcccgcggcag

SEQ ID NO: 665860 - DNA, 25 bp, Rattus norvegicus
aggcttgcaaggctgcgggttgcgg

SEQ ID NO: 665861 - DNA, 25 bp, Rattus norvegicus
ctcacgtcctgaaaaagcgcgtgtc

SEQ ID NO: 665862 - DNA, 25 bp, Rattus norvegicus
cgtcctgaaaaagcgcgtgtcccgc

SEQ ID NO: 665863 - DNA, 25 bp, Rattus norvegicus
atgacgatctgcgaggagtcgagca

SEQ ID NO: 665864 - DNA, 25 bp, Rattus norvegicus
gcgagggctcgatcccgctccgccc

SEQ ID NO: 665865 - DNA, 25 bp, Rattus norvegicus
cggcgttgcgaagagcagcacgtca

SEQ ID NO: 665866 - DNA, 25 bp, Rattus norvegicus
acatcgggcgcggtggagatgatga

SEQ ID NO: 665867 - DNA, 25 bp, Rattus norvegicus
ttacgcgccaaatcctttttgccgc

SEQ ID NO: 665868 - DNA, 25 bp, Rattus norvegicus
gctgcctgcaaagtccgggccactt

SEQ ID NO: 665869 - DNA, 25 bp, Rattus norvegicus
ccatggcactcacggcccgcgtggc

SEQ ID NO: 665870 - DNA, 25 bp, Rattus norvegicus
gggctacggccatggcactcacggc

SEQ ID NO: 665871 - DNA, 25 bp, Rattus norvegicus
atctgcgaggagtcgagcagccgca

SEQ ID NO: 665872 - DNA, 25 bp, Rattus norvegicus
agatgatgacgatctgcgaggagtc

SEQ ID NO: 665873 - DNA, 25 bp, Rattus norvegicus
cacgtcaggatctcgagggccagcg

SEQ ID NO: 665874 - DNA, 25 bp, Rattus norvegicus
agcagcacgtcaggatctcgagggc

SEQ ID NO: 665875 - DNA, 25 bp, Rattus norvegicus
gcgaagagcagcacgtcaggatctc

SEQ ID NO: 665876 - DNA, 25 bp, Rattus norvegicus
tgcctgcaaagtccgggccactttt

SEQ ID NO: 665877 - DNA, 25 bp, Rattus norvegicus
gccatagcaccggagcactgggtcg

SEQ ID NO: 665878 - DNA, 25 bp, Rattus norvegicus
aagccctttatcacggccagcgcag

SEQ ID NO: 665879 - DNA, 25 bp, Rattus norvegicus
cggggcagccatagcaccggagcac

SEQ ID NO: 665880 - DNA, 25 bp, Rattus norvegicus
agcagcttgttgacagcctggagaa

SEQ ID NO: 665881 - DNA, 25 bp, Rattus norvegicus
cgcagcagcttgttgacagcctgga

SEQ ID NO: 665882 - DNA, 25 bp, Rattus norvegicus
gccagcgcagcgtggtaacggcgct

SEQ ID NO: 665883 - DNA, 25 bp, Rattus norvegicus
ttccggaagccctttatcacggcca

SEQ ID NO: 665884 - DNA, 25 bp, Rattus norvegicus
agtccagggccctactcacacagcc

SEQ ID NO: 665885 - DNA, 25 bp, Rattus norvegicus
taaccgaagtccagggccctactca

SEQ ID NO: 665886 - DNA, 25 bp, Rattus norvegicus
caggtaggcccgtccctcagcccta

SEQ ID NO: 665887 - DNA, 25 bp, Rattus norvegicus
gcctcgaactcgcaagcccaggtag

SEQ ID NO: 665888 - DNA, 25 bp, Rattus norvegicus
ggcagccatagcaccggagcactgg

SEQ ID NO: 665889 - DNA, 25 bp, Rattus norvegicus
aactcgcaagcccaggtaggcccgt

SEQ ID NO: 665890 - DNA, 25 bp, Rattus norvegicus
agcctggagaagagcccgtagctgc

SEQ ID NO: 665891 - DNA, 25 bp, Rattus norvegicus
ctacgctggtctccgatcgagtcgg

SEQ ID NO: 665892 - DNA, 25 bp, Rattus norvegicus
cagctccaagatggcgcaggcgatc

SEQ ID NO: 665893 - DNA, 25 bp, Rattus norvegicus
tttttattggctgttccgcgtggcg

SEQ ID NO: 665894 - DNA, 25 bp, Rattus norvegicus
agcgcgccgggcttttttattggct

SEQ ID NO: 665895 - DNA, 25 bp, Rattus norvegicus
cctaaccaccaagatcttccggaga

SEQ ID NO: 665896 - DNA, 25 bp, Rattus norvegicus
gagatccactgtgccctccgggcta

SEQ ID NO: 665897 - DNA, 25 bp, Rattus norvegicus
tccgggctagggtgtagtcctacta

SEQ ID NO: 665898 - DNA, 25 bp, Rattus norvegicus
agtcctactaagtccagagcaggga

SEQ ID NO: 665899 - DNA, 25 bp, Rattus norvegicus
agtaaacagggcacccaccgtgctc

SEQ ID NO: 665900 - DNA, 25 bp, Rattus norvegicus
cccaccgcggttttcacaatgcttg

SEQ ID NO: 665901 - DNA, 25 bp, Rattus norvegicus
gtctccagccggacagcagggaaag

SEQ ID NO: 665902 - DNA, 25 bp, Rattus norvegicus
tagagttggaactacaaggggactg

SEQ ID NO: 665903 - DNA, 25 bp, Rattus norvegicus
ataatggggtgcgtgttgcagaacc

SEQ ID NO: 665904 - DNA, 25 bp, Rattus norvegicus
gcagctgagtctggaagtgaccaca

SEQ ID NO: 665905 - DNA, 25 bp, Rattus norvegicus
tggcaacatcgccagcgtgcataag

SEQ ID NO: 665906 - DNA, 25 bp, Rattus norvegicus
aatacctcaaggatcaccgctgccg

SEQ ID NO: 665907 - DNA, 25 bp, Rattus norvegicus
ccagcgtgcataaggaggagaaccc

SEQ ID NO: 665908 - DNA, 25 bp, Rattus norvegicus
tgccaagggcttctcacgacacaaa

SEQ ID NO: 665909 - DNA, 25 bp, Rattus norvegicus
ggcgagcccacttggcagagcacca

SEQ ID NO: 665910 - DNA, 25 bp, Rattus norvegicus
ttggcagagcaccaacacgctcaca

SEQ ID NO: 665911 - DNA, 25 bp, Rattus norvegicus
cgctcacacgggcaactacaagttc

SEQ ID NO: 665912 - DNA, 25 bp, Rattus norvegicus
gacaaggacctgcaaacccggcggc

SEQ ID NO: 665913 - DNA, 25 bp, Rattus norvegicus
gcaggctgtgccaagggcttctcac

SEQ ID NO: 665914 - DNA, 25 bp, Rattus norvegicus
cagctcgtggtgctggcaacatcgc

SEQ ID NO: 665915 - DNA, 25 bp, Rattus norvegicus
ttctcacgacacaaatacctcaagg

SEQ ID NO: 665916 - DNA, 25 bp, Rattus norvegicus
ctcgaaggacaaggacctgcaaacc

SEQ ID NO: 665917 - DNA, 25 bp, Rattus norvegicus
gcaacagctcgtggtgctggcaaca

SEQ ID NO: 665918 - DNA, 25 bp, Rattus norvegicus
caactacaagttccgctgcgcaggc

SEQ ID NO: 665919 - DNA, 25 bp, Rattus norvegicus
cgaatcagaggatgagcgtctgtta

SEQ ID NO: 665920 - DNA, 25 bp, Rattus norvegicus
catccaaccgggacacgcttgcgga

SEQ ID NO: 665921 - DNA, 25 bp, Rattus norvegicus
tgagcgtctgttaatccttcatgaa

SEQ ID NO: 665922 - DNA, 25 bp, Rattus norvegicus
ccggaagttgtgaacgttcttgagc

SEQ ID NO: 665923 - DNA, 25 bp, Rattus norvegicus
aaacaaaacagggtgggcgcacatc

SEQ ID NO: 665924 - DNA, 25 bp, Rattus norvegicus
ccttcatgaatttccgggcgacggt

SEQ ID NO: 665925 - DNA, 25 bp, Rattus norvegicus
cgacggttgtaagcgctaaagttgg

SEQ ID NO: 665926 - DNA, 25 bp, Rattus norvegicus
gcatgctcctcggttcgatccacta

SEQ ID NO: 665927 - DNA, 25 bp, Rattus norvegicus
gatccactatgatcgcgcatgcgca

SEQ ID NO: 665928 - DNA, 25 bp, Rattus norvegicus
agcgacggctgctacacgtccgcgg

SEQ ID NO: 665929 - DNA, 25 bp, Rattus norvegicus
ctctggattcgaggaaggcaatggc

SEQ ID NO: 665930 - DNA, 25 bp, Rattus norvegicus
ggcaatggctatttctgcttctgta

SEQ ID NO: 665931 - DNA, 25 bp, Rattus norvegicus
ctgcttctgtatctacgtccggtga

SEQ ID NO: 665932 - DNA, 25 bp, Rattus norvegicus
ctgtgtacagagtctgcgcatgctc

SEQ ID NO: 665933 - DNA, 25 bp, Rattus norvegicus
cttcgggacacggaggaaatgctaa

SEQ ID NO: 665934 - DNA, 25 bp, Rattus norvegicus
cagcgacttcgggacacggaggaaa

SEQ ID NO: 665935 - DNA, 25 bp, Rattus norvegicus
agcagcaaccatgtcggtgttcggg

SEQ ID NO: 665936 - DNA, 25 bp, Rattus norvegicus
aaccatgtcggtgttcgggaagctg

SEQ ID NO: 665937 - DNA, 25 bp, Rattus norvegicus
catgtcggtgttcgggaagctgttc

SEQ ID NO: 665938 - DNA, 25 bp, Rattus norvegicus
cccaggaggccatacagcgacttcg

SEQ ID NO: 665939 - DNA, 25 bp, Rattus norvegicus
cggaggaaatgctaagcaagaaaca

SEQ ID NO: 665940 - DNA, 25 bp, Rattus norvegicus
ccatacagcgacttcgggacacgga

SEQ ID NO: 665941 - DNA, 25 bp, Rattus norvegicus
cgggacacggaggaaatgctaagca

SEQ ID NO: 665942 - DNA, 25 bp, Rattus norvegicus
agaagaagatcgagcaggagctgac

SEQ ID NO: 665943 - DNA, 25 bp, Rattus norvegicus
gagctgacggctgccaagaagcacg

SEQ ID NO: 665944 - DNA, 25 bp, Rattus norvegicus
cggctgccaagaagcacggcaccaa

SEQ ID NO: 665945 - DNA, 25 bp, Rattus norvegicus
aagcacggcaccaaaaataagcgcg

SEQ ID NO: 665946 - DNA, 25 bp, Rattus norvegicus
aggaggccatacagcgacttcggga

SEQ ID NO: 665947 - DNA, 25 bp, Rattus norvegicus
accatggtaaggagagaggacagcc

SEQ ID NO: 665948 - DNA, 25 bp, Rattus norvegicus
gctcgggctgcaaccatggtaagga

SEQ ID NO: 665949 - DNA, 25 bp, Rattus norvegicus
ccgcactcttgcaaggctagtgggg

SEQ ID NO: 665950 - DNA, 25 bp, Rattus norvegicus
cggaccgcactcttgcaaggctagt

SEQ ID NO: 665951 - DNA, 25 bp, Rattus norvegicus
accagcggaccgcactcttgcaagg

SEQ ID NO: 665952 - DNA, 25 bp, Rattus norvegicus
tcaagttaatccttctgagtggaac

SEQ ID NO: 665953 - DNA, 25 bp, Rattus norvegicus
gccgctctcaagttaatccttctga

SEQ ID NO: 665954 - DNA, 25 bp, Rattus norvegicus
gcgtcgccgctctcaagttaatcct

SEQ ID NO: 665955 - DNA, 25 bp, Rattus norvegicus
caaggcactgctggcgctaggcgcc

SEQ ID NO: 665956 - DNA, 25 bp, Rattus norvegicus
tctaggttcagacaaggcactgctg

SEQ ID NO: 665957 - DNA, 25 bp, Rattus norvegicus
gacagccggaaacgcagggcctgcc

SEQ ID NO: 665958 - DNA, 25 bp, Rattus norvegicus
actcggcgctgcagccctagctggg

SEQ ID NO: 665959 - DNA, 25 bp, Rattus norvegicus
actcccgggctgctctgaggggaca

SEQ ID NO: 665960 - DNA, 25 bp, Rattus norvegicus
cccagctctaggttcagacaaggca

SEQ ID NO: 665961 - DNA, 25 bp, Rattus norvegicus
gttggagtcttttgtgctcgcgccc

SEQ ID NO: 665962 - DNA, 25 bp, Rattus norvegicus
gcgccgaagctctggacctttccaa

SEQ ID NO: 665963 - DNA, 25 bp, Rattus norvegicus
tggacctttccaaagcccggcgcga

SEQ ID NO: 665964 - DNA, 25 bp, Rattus norvegicus
cccacgcgtctggagaggcaggctc

SEQ ID NO: 665965 - DNA, 25 bp, Rattus norvegicus
tggctggatccgacccggacgacga

SEQ ID NO: 665966 - DNA, 25 bp, Rattus norvegicus
caggccgagtgcagaggtctgtcca

SEQ ID NO: 665967 - DNA, 25 bp, Rattus norvegicus
tgcagaggtctgtccagcactctcc

SEQ ID NO: 665968 - DNA, 25 bp, Rattus norvegicus
gtcgcgactcttagcgcgtgtgctc

SEQ ID NO: 665969 - DNA, 25 bp, Rattus norvegicus
cgtgtgctcgggctcctcacgtggc

SEQ ID NO: 665970 - DNA, 25 bp, Rattus norvegicus
ggcgggctattccttgtgccttttc

SEQ ID NO: 665971 - DNA, 25 bp, Rattus norvegicus
ctggccttctggcattcgcagctcg

SEQ ID NO: 665972 - DNA, 25 bp, Rattus norvegicus
tggcattcgcagctcgcctctggtc

SEQ ID NO: 665973 - DNA, 25 bp, Rattus norvegicus
tgcccgctcggaagttggagtcttt

SEQ ID NO: 665974 - DNA, 25 bp, Rattus norvegicus
agctcgcctctggtcggccgtacgg

SEQ ID NO: 665975 - DNA, 25 bp, Rattus norvegicus
ttcggcagtgatgaaaagtcagacc

SEQ ID NO: 665976 - DNA, 25 bp, Rattus norvegicus
ttgcctaggaaagtccggcgcgctt

SEQ ID NO: 665977 - DNA, 25 bp, Rattus norvegicus
tggcgcgagttactaggcgactccc

SEQ ID NO: 665978 - DNA, 25 bp, Rattus norvegicus
accttacgtgcttctcgtggcgcga

SEQ ID NO: 665979 - DNA, 25 bp, Rattus norvegicus
tctcaaacgttggaagtgcgcctgc

SEQ ID NO: 665980 - DNA, 25 bp, Rattus norvegicus
ggagtcagcgtagctcctaccgata

SEQ ID NO: 665981 - DNA, 25 bp, Rattus norvegicus
gcgcgcttgtgctttcagcagtttc

SEQ ID NO: 665982 - DNA, 25 bp, Rattus norvegicus
ccgccctgaggagaactgggtaaga

SEQ ID NO: 665983 - DNA, 25 bp, Rattus norvegicus
ccgaaacgccgatcacagtagcaga

SEQ ID NO: 665984 - DNA, 25 bp, Rattus norvegicus
ggacgactcaacgtgttttccattc

SEQ ID NO: 665985 - DNA, 25 bp, Rattus norvegicus
ttcaaaccgtttcagaggacgactc

SEQ ID NO: 665986 - DNA, 25 bp, Rattus norvegicus
atcaggcaaaccgaactaggcattc

SEQ ID NO: 665987 - DNA, 25 bp, Rattus norvegicus
ccacgagaactgaggcggtaatgtt

SEQ ID NO: 665988 - DNA, 25 bp, Rattus norvegicus
agcaccgcgctaggctcttgcatca

SEQ ID NO: 665989 - DNA, 25 bp, Rattus norvegicus
tctcctacagaaaaaggcttcgata

SEQ ID NO: 665990 - DNA, 25 bp, Rattus norvegicus
caacccgtgcgcctcctgccagtgc

SEQ ID NO: 665991 - DNA, 25 bp, Rattus norvegicus
ggcccgttcagcagtcttcaacgtc

SEQ ID NO: 665992 - DNA, 25 bp, Rattus norvegicus
agcagtcttcaacgtctctctccta

SEQ ID NO: 665993 - DNA, 25 bp, Rattus norvegicus
gtcttcaacgtctctctcctacaga

SEQ ID NO: 665994 - DNA, 25 bp, Rattus norvegicus
acgtctctctcctacagaaaaaggc

SEQ ID NO: 665995 - DNA, 25 bp, Rattus norvegicus
cctacagaaaaaggcttcgataaag

SEQ ID NO: 665996 - DNA, 25 bp, Rattus norvegicus
ttcgataaagaaggtggcacggccc

SEQ ID NO: 665997 - DNA, 25 bp, Rattus norvegicus
ccaccttcgccctgcgtggccaccc

SEQ ID NO: 665998 - DNA, 25 bp, Rattus norvegicus
cgcccgcctgctgcaacccgtgcgc

SEQ ID NO: 665999 - DNA, 25 bp, Rattus norvegicus
cgtggcccgttcagcagtcttcaac

SEQ ID NO: 666000 - DNA, 25 bp, Rattus norvegicus
cgtttcttcggcagcgcctgcactt

SEQ ID NO: 666001 - DNA, 25 bp, Rattus norvegicus
agtgccgtttcttcggcagcgcctg

SEQ ID NO: 666002 - DNA, 25 bp, Rattus norvegicus
acccgcgacagctgcaagccgcctg

SEQ ID NO: 666003 - DNA, 25 bp, Rattus norvegicus
tgacaacaaacccaggacgggagcc

SEQ ID NO: 666004 - DNA, 25 bp, Rattus norvegicus
cagcccgcgctaccgctcagggcgc

SEQ ID NO: 666005 - DNA, 25 bp, Rattus norvegicus
gggactcgtagtccgaggccgcttc

SEQ ID NO: 666006 - DNA, 25 bp, Rattus norvegicus
gtccgaggccgcttcccacttctga

SEQ ID NO: 666007 - DNA, 25 bp, Rattus norvegicus
ccacttctgactctcggcggcgtgt

SEQ ID NO: 666008 - DNA, 25 bp, Rattus norvegicus
tcggcggcgtgtggactccagtccc

SEQ ID NO: 666009 - DNA, 25 bp, Rattus norvegicus
gccaggccaagcgattctaggggtc

SEQ ID NO: 666010 - DNA, 25 bp, Rattus norvegicus
aggccaagcgattctaggggtcccg

SEQ ID NO: 666011 - DNA, 25 bp, Rattus norvegicus
ccgaggccgccacctaaataagacg

SEQ ID NO: 666012 - DNA, 25 bp, Rattus norvegicus
ccaagggccggtctctccgcgagga

SEQ ID NO: 666013 - DNA, 25 bp, Rattus norvegicus
cgcaggtccgtactgacaacaaacc

SEQ ID NO: 666014 - DNA, 25 bp, Rattus norvegicus
tctccgcgaggagcacgctgccgga

SEQ ID NO: 666015 - DNA, 25 bp, Rattus norvegicus
caacaaacccaggacgggagccgag

SEQ ID NO: 666016 - DNA, 25 bp, Rattus norvegicus
cacctaaataagacgcaggtccgta

SEQ ID NO: 666017 - DNA, 25 bp, Rattus norvegicus
tccggactgcgtctaagaggacgcg

SEQ ID NO: 666018 - DNA, 25 bp, Rattus norvegicus
gcgcactaagtgtgaactagctcta

SEQ ID NO: 666019 - DNA, 25 bp, Rattus norvegicus
actagctctagtcgctgtagtcggg

SEQ ID NO: 666020 - DNA, 25 bp, Rattus norvegicus
gctcgggaccggctgccatcttagc

SEQ ID NO: 666021 - DNA, 25 bp, Rattus norvegicus
gctgccatcttagcggagggactga

SEQ ID NO: 666022 - DNA, 25 bp, Rattus norvegicus
gtcccggtaaacacccgcaggcaga

SEQ ID NO: 666023 - DNA, 25 bp, Rattus norvegicus
cgcaggcagactggggtcatttctg

SEQ ID NO: 666024 - DNA, 25 bp, Rattus norvegicus
catttctgtggcttggagggagctt

SEQ ID NO: 666025 - DNA, 25 bp, Rattus norvegicus
cttggatgaaaaggcatggagaatg

SEQ ID NO: 666026 - DNA, 25 bp, Rattus norvegicus
agtgttgcgttcgagtcgagaccta

SEQ ID NO: 666027 - DNA, 25 bp, Rattus norvegicus
gtcgagacctaaagccggggctgct

SEQ ID NO: 666028 - DNA, 25 bp, Rattus norvegicus
aaagccggggctgctcttcccacag

SEQ ID NO: 666029 - DNA, 25 bp, Rattus norvegicus
actgctagtgcttggcctaggcgcc

SEQ ID NO: 666030 - DNA, 25 bp, Rattus norvegicus
caggtcgagctgaactgctagtgct

SEQ ID NO: 666031 - DNA, 25 bp, Rattus norvegicus
caccgtaggcgtaggcgctttacgt

SEQ ID NO: 666032 - DNA, 25 bp, Rattus norvegicus
aactcggctgagtgttggcgattcg

SEQ ID NO: 666033 - DNA, 25 bp, Rattus norvegicus
ccaaagactgtcgtccctgggattc

SEQ ID NO: 666034 - DNA, 25 bp, Rattus norvegicus
gattcgaactctgcgggcttgactg

SEQ ID NO: 666035 - DNA, 25 bp, Rattus norvegicus
tagcgccgtcttcactcttggaatc

SEQ ID NO: 666036 - DNA, 25 bp, Rattus norvegicus
tccgctctgtgaagtagatacggcc

SEQ ID NO: 666037 - DNA, 25 bp, Rattus norvegicus
cgctttacgtgcgttgcctttcctc

SEQ ID NO: 666038 - DNA, 25 bp, Rattus norvegicus
cgtttcctgaagtctggcaaatatc

SEQ ID NO: 666039 - DNA, 25 bp, Rattus norvegicus
ccagccaggctgcaacgtttcctga

SEQ ID NO: 666040 - DNA, 25 bp, Rattus norvegicus
cactttggtcagtgttgagagaccc

SEQ ID NO: 666041 - DNA, 25 bp, Rattus norvegicus
cgattacagtttagcactttggtca

SEQ ID NO: 666042 - DNA, 25 bp, Rattus norvegicus
tctgtccgagatggtgagtgtccac

SEQ ID NO: 666043 - DNA, 25 bp, Rattus norvegicus
tctggcaaatatcaggcaccgtagg

SEQ ID NO: 666044 - DNA, 25 bp, Rattus norvegicus
cgccctccggctcgattacagttta

SEQ ID NO: 666045 - DNA, 25 bp, Rattus norvegicus
agcaagatcccggtgagtctctagc

SEQ ID NO: 666046 - DNA, 25 bp, Rattus norvegicus
ctaatgctaagcttggtgaaggcgc

SEQ ID NO: 666047 - DNA, 25 bp, Rattus norvegicus
ccgaccgctgtaaggaggtgcagca

SEQ ID NO: 666048 - DNA, 25 bp, Rattus norvegicus
tgggcctcacacagagctctgtccg

SEQ ID NO: 666049 - DNA, 25 bp, Rattus norvegicus
ccctttaaggaatgttgtgacctga

SEQ ID NO: 666050 - DNA, 25 bp, Rattus norvegicus
tcacaaaactgtgacgcgccctgta

SEQ ID NO: 666051 - DNA, 25 bp, Rattus norvegicus
caagcttgccgatcgtgacgtcaca

SEQ ID NO: 666052 - DNA, 25 bp, Rattus norvegicus
tcctgaggagccaaagacaagcttg

SEQ ID NO: 666053 - DNA, 25 bp, Rattus norvegicus
cgcctggcttcacagtcctgaggag

SEQ ID NO: 666054 - DNA, 25 bp, Rattus norvegicus
gagactagaagaaggcgacaaccgc

SEQ ID NO: 666055 - DNA, 25 bp, Rattus norvegicus
ttactcggcagcgtagagactagaa

SEQ ID NO: 666056 - DNA, 25 bp, Rattus norvegicus
tgaaggcgctgtgaattactcggca

SEQ ID NO: 666057 - DNA, 25 bp, Rattus norvegicus
tcgttaccaccttcgttctctaatg

SEQ ID NO: 666058 - DNA, 25 bp, Rattus norvegicus
tccactcctaggtgatcatcgagcg

SEQ ID NO: 666059 - DNA, 25 bp, Rattus norvegicus
gagcccgcagaccttgagactacta

SEQ ID NO: 666060 - DNA, 25 bp, Rattus norvegicus
gaaatccatcgttccgcggatcccg

SEQ ID NO: 666061 - DNA, 25 bp, Rattus norvegicus
tccgactctggacactgggacacgc

SEQ ID NO: 666062 - DNA, 25 bp, Rattus norvegicus
tccctagggtaatggggctcacaca

SEQ ID NO: 666063 - DNA, 25 bp, Rattus norvegicus
gacgcgggtcagtctctacagaatc

SEQ ID NO: 666064 - DNA, 25 bp, Rattus norvegicus
cagaatcgcgcgcttgtgtccacct

SEQ ID NO: 666065 - DNA, 25 bp, Rattus norvegicus
ctccaattcactgaggcaggcagag

SEQ ID NO: 666066 - DNA, 25 bp, Rattus norvegicus
gcggaccgccctactgtagtcaatg

SEQ ID NO: 666067 - DNA, 25 bp, Rattus norvegicus
gtagtcaatggcctcacctctcttc

SEQ ID NO: 666068 - DNA, 25 bp, Rattus norvegicus
tcggaaatgaactcggccaaactgg

SEQ ID NO: 666069 - DNA, 25 bp, Rattus norvegicus
ctggaacgaaacaaggccgccctca

SEQ ID NO: 666070 - DNA, 25 bp, Rattus norvegicus
tgcggaagagcctcaagacttgcgt

SEQ ID NO: 666071 - DNA, 25 bp, Rattus norvegicus
gtacctctgacgagcgagcaccgta

SEQ ID NO: 666072 - DNA, 25 bp, Rattus norvegicus
gcgtgccacactgtagtacctctga

SEQ ID NO: 666073 - DNA, 25 bp, Rattus norvegicus
ctctgacttgccgaggagcaggagt

SEQ ID NO: 666074 - DNA, 25 bp, Rattus norvegicus
gtgggcacagggcaacttttcctgg

SEQ ID NO: 666075 - DNA, 25 bp, Rattus norvegicus
taccgagagttagcgcgccgggctt

SEQ ID NO: 666076 - DNA, 25 bp, Rattus norvegicus
cttgcaagtttgcagggcgctcaca

SEQ ID NO: 666077 - DNA, 25 bp, Rattus norvegicus
tggacaccaaacatttcctgccgct

SEQ ID NO: 666078 - DNA, 25 bp, Rattus norvegicus
ggacttttgcaacaactcgccgagc

SEQ ID NO: 666079 - DNA, 25 bp, Rattus norvegicus
ggaacccttggcagtcgcaaacttg

SEQ ID NO: 666080 - DNA, 25 bp, Rattus norvegicus
gccgaagagggaaggctgcttcacc

SEQ ID NO: 666081 - DNA, 25 bp, Rattus norvegicus
ttgtgtgtccgtgcagacaatggcc

SEQ ID NO: 666082 - DNA, 25 bp, Rattus norvegicus
aaggaccagggtcctcgcgcggcta

SEQ ID NO: 666083 - DNA, 25 bp, Rattus norvegicus
tcctgcagggagctctgaaggacca

SEQ ID NO: 666084 - DNA, 25 bp, Rattus norvegicus
cagggcctcgactctcctgcaggga

SEQ ID NO: 666085 - DNA, 25 bp, Rattus norvegicus
cccatgtgtccaccggggtgctcag

SEQ ID NO: 666086 - DNA, 25 bp, Rattus norvegicus
tgagttagtagcagacatggacacc

SEQ ID NO: 666087 - DNA, 25 bp, Rattus norvegicus
ccaccgcgaggtcacttgagaacta

SEQ ID NO: 666088 - DNA, 25 bp, Rattus norvegicus
acgccgcctgggtgagtcactgtac

SEQ ID NO: 666089 - DNA, 25 bp, Rattus norvegicus
actggattaaatcgcggggccaccg

SEQ ID NO: 666090 - DNA, 25 bp, Rattus norvegicus
tgagaactaccactagggcggggtc

SEQ ID NO: 666091 - DNA, 25 bp, Rattus norvegicus
accggaagtgactgctaacattccc

SEQ ID NO: 666092 - DNA, 25 bp, Rattus norvegicus
cctccaattgcgctaccagtaggcg

SEQ ID NO: 666093 - DNA, 25 bp, Rattus norvegicus
taccagtaggcgacaggccgccgta

SEQ ID NO: 666094 - DNA, 25 bp, Rattus norvegicus
tgggaaccacaacgaccaagtcctg

SEQ ID NO: 666095 - DNA, 25 bp, Rattus norvegicus
acttcgcgtggctattggccagggc

SEQ ID NO: 666096 - DNA, 25 bp, Rattus norvegicus
tttcctattggtcgcgtctgctctc

SEQ ID NO: 666097 - DNA, 25 bp, Rattus norvegicus
agggacgcgctgtgatttcctattg

SEQ ID NO: 666098 - DNA, 25 bp, Rattus norvegicus
ctcctattggttgccagagggacgc

SEQ ID NO: 666099 - DNA, 25 bp, Rattus norvegicus
ctgcagcgaaacagaaacacgactg

SEQ ID NO: 666100 - DNA, 25 bp, Rattus norvegicus
tgagtcccgccctctgtcatttggg

SEQ ID NO: 666101 - DNA, 25 bp, Rattus norvegicus
ctccctattggttgccctaagccgg

SEQ ID NO: 666102 - DNA, 25 bp, Rattus norvegicus
attgagacgtcaccaaggccagccc

SEQ ID NO: 666103 - DNA, 25 bp, Rattus norvegicus
ccgccttccaggcttgcttgggtgc

SEQ ID NO: 666104 - DNA, 25 bp, Rattus norvegicus
acgctgaaaggcaagcgagacccga

SEQ ID NO: 666105 - DNA, 25 bp, Rattus norvegicus
aaagagcattcgacgcctgcgattg

SEQ ID NO: 666106 - DNA, 25 bp, Rattus norvegicus
gacgtcgcgttatttgcatatgaca

SEQ ID NO: 666107 - DNA, 25 bp, Rattus norvegicus
ccctaagccggtaggccatgacgtc

SEQ ID NO: 666108 - DNA, 25 bp, Rattus norvegicus
agctgcgttcttggctccctattgg

SEQ ID NO: 666109 - DNA, 25 bp, Rattus norvegicus
cgttctttgtctgtctccgccggcg

SEQ ID NO: 666110 - DNA, 25 bp, Rattus norvegicus
gcacaactacctcagcgcagcggtt

SEQ ID NO: 666111 - DNA, 25 bp, Rattus norvegicus
cggtatgcagctccggttgtgagca

SEQ ID NO: 666112 - DNA, 25 bp, Rattus norvegicus
tgaagcgttcggatttgtgccctga

SEQ ID NO: 666113 - DNA, 25 bp, Rattus norvegicus
tgtgacgtcacaatcagctgttgaa

SEQ ID NO: 666114 - DNA, 25 bp, Rattus norvegicus
cgggatgcagccacccgctggcaag

SEQ ID NO: 666115 - DNA, 25 bp, Rattus norvegicus
gcaccagggcagcttcatttaccag

SEQ ID NO: 666116 - DNA, 25 bp, Rattus norvegicus
agcgccagttcaactactgagcgcc

SEQ ID NO: 666117 - DNA, 25 bp, Rattus norvegicus
cgtgccagcgccagttcaactactg

SEQ ID NO: 666118 - DNA, 25 bp, Rattus norvegicus
atttaccagccgtgccagcgccagt

SEQ ID NO: 666119 - DNA, 25 bp, Rattus norvegicus
agggcagcttcatttaccagccgtg

SEQ ID NO: 666120 - DNA, 25 bp, Rattus norvegicus
ttcgcgccggcccaagcaccagggc

SEQ ID NO: 666121 - DNA, 25 bp, Rattus norvegicus
caacggcagaatcgcgcccgggaga

SEQ ID NO: 666122 - DNA, 25 bp, Rattus norvegicus
agtgctaaagtgttgcaacggcaga

SEQ ID NO: 666123 - DNA, 25 bp, Rattus norvegicus
gcgccacacactgagtgctaaagtg

SEQ ID NO: 666124 - DNA, 25 bp, Rattus norvegicus
gccgagcgccacacactgagtgcta

SEQ ID NO: 666125 - DNA, 25 bp, Rattus norvegicus
tgcagagagcccgacagcgcgccga

SEQ ID NO: 666126 - DNA, 25 bp, Rattus norvegicus
ctatgccggctcgagctgtgctgct

SEQ ID NO: 666127 - DNA, 25 bp, Rattus norvegicus
gccgggagcctagggccctgcacca

SEQ ID NO: 666128 - DNA, 25 bp, Rattus norvegicus
gcttcatttaccagccgtgccagcg

SEQ ID NO: 666129 - DNA, 25 bp, Rattus norvegicus
acccggcagggcctcagggagccgg

SEQ ID NO: 666130 - DNA, 25 bp, Rattus norvegicus
cccaacatggcgacggggacacgag

SEQ ID NO: 666131 - DNA, 25 bp, Rattus norvegicus
ccaacatggcgacggggacacgagc

SEQ ID NO: 666132 - DNA, 25 bp, Rattus norvegicus
tccggccgagcttgcacggccgccc

SEQ ID NO: 666133 - DNA, 25 bp, Rattus norvegicus
gccgagcttgcacggccgcccgcgc

SEQ ID NO: 666134 - DNA, 25 bp, Rattus norvegicus
cccttacgggccagcgtcgccgtcg

SEQ ID NO: 666135 - DNA, 25 bp, Rattus norvegicus
acgggccagcgtcgccgtcgcctca

SEQ ID NO: 666136 - DNA, 25 bp, Rattus norvegicus
ccgggccgtgcgtgcccagcgccct

SEQ ID NO: 666137 - DNA, 25 bp, Rattus norvegicus
tgcccagcgccctcggcgcgtccgt

SEQ ID NO: 666138 - DNA, 25 bp, Rattus norvegicus
cggcgcgtccgtccgcccttcctcg

SEQ ID NO: 666139 - DNA, 25 bp, Rattus norvegicus
ccttcctcgttgtgtgcccgtctgt

SEQ ID NO: 666140 - DNA, 25 bp, Rattus norvegicus
ttcctcgttgtgtgcccgtctgtcc

SEQ ID NO: 666141 - DNA, 25 bp, Rattus norvegicus
tgtgtgcccgtctgtccggccgtcg

SEQ ID NO: 666142 - DNA, 25 bp, Rattus norvegicus
gttgtgtgcccgtctgtccggccgt

SEQ ID NO: 666143 - DNA, 25 bp, Rattus norvegicus
agctggtgatgctcatgtagtctac

SEQ ID NO: 666144 - DNA, 25 bp, Rattus norvegicus
ctcgtcctcgggcagcctcgggaag

SEQ ID NO: 666145 - DNA, 25 bp, Rattus norvegicus
ctcgggaagctggtgatgctcatgt

SEQ ID NO: 666146 - DNA, 25 bp, Rattus norvegicus
tggtgatgctcatgtagtctactgg

SEQ ID NO: 666147 - DNA, 25 bp, Rattus norvegicus
tgctcatgtagtctactggtgagta

SEQ ID NO: 666148 - DNA, 25 bp, Rattus norvegicus
atgtagtctactggtgagtaggcgc

SEQ ID NO: 666149 - DNA, 25 bp, Rattus norvegicus
gcgcctagggcgctctcctggctag

SEQ ID NO: 666150 - DNA, 25 bp, Rattus norvegicus
gggcgctctcctggctagcctcgtt

SEQ ID NO: 666151 - DNA, 25 bp, Rattus norvegicus
tcctggctagcctcgttctctgccg

SEQ ID NO: 666152 - DNA, 25 bp, Rattus norvegicus
ttctctgccgccatcctcgccctaa

SEQ ID NO: 666153 - DNA, 25 bp, Rattus norvegicus
cagcagcgcagagcctgccggaagt

SEQ ID NO: 666154 - DNA, 25 bp, Rattus norvegicus
tgagctcctggacagccgggagggg

SEQ ID NO: 666155 - DNA, 25 bp, Rattus norvegicus
tgagtaggcgcctagggcgctctcc

SEQ ID NO: 666156 - DNA, 25 bp, Rattus norvegicus
cagcctcgggaagctggtgatgctc

SEQ ID NO: 666157 - DNA, 25 bp, Rattus norvegicus
ctctctgcagcgctaccgcgagctg

SEQ ID NO: 666158 - DNA, 25 bp, Rattus norvegicus
ccggcacccgcagcgaccgcaacgg

SEQ ID NO: 666159 - DNA, 25 bp, Rattus norvegicus
cgcaacggcggccaaggtgctcaga

SEQ ID NO: 666160 - DNA, 25 bp, Rattus norvegicus
ggcggccaaggtgctcagaacttga

SEQ ID NO: 666161 - DNA, 25 bp, Rattus norvegicus
gccaaggtgctcagaacttgacgtg

SEQ ID NO: 666162 - DNA, 25 bp, Rattus norvegicus
aaggtgctcagaacttgacgtgatg

SEQ ID NO: 666163 - DNA, 25 bp, Rattus norvegicus
tcagaacttgacgtgatggggcttc

SEQ ID NO: 666164 - DNA, 25 bp, Rattus norvegicus
agaacttgacgtgatggggcttccc

SEQ ID NO: 666165 - DNA, 25 bp, Rattus norvegicus
acttgacgtgatggggcttcccgag

SEQ ID NO: 666166 - DNA, 25 bp, Rattus norvegicus
cccgccgccggaggtcagacgctcg

SEQ ID NO: 666167 - DNA, 25 bp, Rattus norvegicus
cagcgctaccgcgagctgcaccggc

SEQ ID NO: 666168 - DNA, 25 bp, Rattus norvegicus
caccggcgttctgtggaggagccac

SEQ ID NO: 666169 - DNA, 25 bp, Rattus norvegicus
actcctgagggcgccagtgagcaga

SEQ ID NO: 666170 - DNA, 25 bp, Rattus norvegicus
gcttcccgaggagcggcgcaagagc

SEQ ID NO: 666171 - DNA, 25 bp, Rattus norvegicus
gcagggcttcggtccgacccagtgc

SEQ ID NO: 666172 - DNA, 25 bp, Rattus norvegicus
gggtcccagccaccgcgtctgtccg

SEQ ID NO: 666173 - DNA, 25 bp, Rattus norvegicus
gcttcggtccgacccagtgcgcctg

SEQ ID NO: 666174 - DNA, 25 bp, Rattus norvegicus
ccgcggcgttccaatcgctctcaga

SEQ ID NO: 666175 - DNA, 25 bp, Rattus norvegicus
cacacgccgttacccaggctcaggg

SEQ ID NO: 666176 - DNA, 25 bp, Rattus norvegicus
caagctcaaactccacacgccgtta

SEQ ID NO: 666177 - DNA, 25 bp, Rattus norvegicus
agctgctcgccaagctcaaactcca

SEQ ID NO: 666178 - DNA, 25 bp, Rattus norvegicus
gacttactcgctcgttgtccagctg

SEQ ID NO: 666179 - DNA, 25 bp, Rattus norvegicus
cgacttactcgctcgttgtccagct

SEQ ID NO: 666180 - DNA, 25 bp, Rattus norvegicus
cgccgtcgccgagccccgacttact

SEQ ID NO: 666181 - DNA, 25 bp, Rattus norvegicus
ccaaggaaacttgaccctcgccagc

SEQ ID NO: 666182 - DNA, 25 bp, Rattus norvegicus
cggcgttccaatcgctctcagaccc

SEQ ID NO: 666183 - DNA, 25 bp, Rattus norvegicus
tcgcccgggtcccagccaccgcgtc

SEQ ID NO: 666184 - DNA, 25 bp, Rattus norvegicus
cgccgttacccaggctcagggggca

SEQ ID NO: 666185 - DNA, 25 bp, Rattus norvegicus
tggccatgatgacgcacctcaacga

SEQ ID NO: 666186 - DNA, 25 bp, Rattus norvegicus
gcacctcaacgaggctgcagtgctg

SEQ ID NO: 666187 - DNA, 25 bp, Rattus norvegicus
tgcagtgctgcacaacctgcgccag

SEQ ID NO: 666188 - DNA, 25 bp, Rattus norvegicus
ggacatggccatgatgacgcacctc

SEQ ID NO: 666189 - DNA, 25 bp, Rattus norvegicus
ctcgctggatgatctacgtgagccc

SEQ ID NO: 666190 - DNA, 25 bp, Rattus norvegicus
gtgtgacacatctcctcggaaggtg

SEQ ID NO: 666191 - DNA, 25 bp, Rattus norvegicus
acaacctgcgccagcgttatgctcg

SEQ ID NO: 666192 - DNA, 25 bp, Rattus norvegicus
cgacttactggaggacatggccatg

SEQ ID NO: 666193 - DNA, 25 bp, Rattus norvegicus
ccgcttcgacttactggaggacatg

SEQ ID NO: 666194 - DNA, 25 bp, Rattus norvegicus
aacggaaatgcagcccatgaaccca

SEQ ID NO: 666195 - DNA, 25 bp, Rattus norvegicus
gcgtgaaacggaaatgcagcccatg

SEQ ID NO: 666196 - DNA, 25 bp, Rattus norvegicus
tctcctcggaaggtgctgacagtgc

SEQ ID NO: 666197 - DNA, 25 bp, Rattus norvegicus
gcgttatgctcgctggatgatctac

SEQ ID NO: 666198 - DNA, 25 bp, Rattus norvegicus
ctgacagtgcgtgaaacggaaatgc

SEQ ID NO: 666199 - DNA, 25 bp, Rattus norvegicus
tccgacaaacaggaagcaagcggtc

SEQ ID NO: 666200 - DNA, 25 bp, Rattus norvegicus
ggcggcggaggactctatatcgccc

SEQ ID NO: 666201 - DNA, 25 bp, Rattus norvegicus
aagccgcgtcgatttctacggggcg

SEQ ID NO: 666202 - DNA, 25 bp, Rattus norvegicus
aacaggaagcaagcggtcccgaagc

SEQ ID NO: 666203 - DNA, 25 bp, Rattus norvegicus
atgtctcctcgtccgacaaacagga

SEQ ID NO: 666204 - DNA, 25 bp, Rattus norvegicus
agcaggatgttacccggtcgcggcc

SEQ ID NO: 666205 - DNA, 25 bp, Rattus norvegicus
ccgcagctgcagcaggatgttaccc

SEQ ID NO: 666206 - DNA, 25 bp, Rattus norvegicus
ccgcagcggcctggaaaggcctctt

SEQ ID NO: 666207 - DNA, 25 bp, Rattus norvegicus
gtccggacggcacacaggacagcgc

SEQ ID NO: 666208 - DNA, 25 bp, Rattus norvegicus
tggctgacagcgtccggacggcaca

SEQ ID NO: 666209 - DNA, 25 bp, Rattus norvegicus
gggcttattatacgcgccatcaata

SEQ ID NO: 666210 - DNA, 25 bp, Rattus norvegicus
tcggcccagggcttattatacgcgc

SEQ ID NO: 666211 - DNA, 25 bp, Rattus norvegicus
aggatctagaaactcggcccagggc

SEQ ID NO: 666212 - DNA, 25 bp, Rattus norvegicus
tcccgaagccgcgtcgatttctacg

SEQ ID NO: 666213 - DNA, 25 bp, Rattus norvegicus
tgcagccacggccacccgctcattc

SEQ ID NO: 666214 - DNA, 25 bp, Rattus norvegicus
ccttcggggcctggcgcaccatggt

SEQ ID NO: 666215 - DNA, 25 bp, Rattus norvegicus
gcaccatggtgcaggggcagcagca

SEQ ID NO: 666216 - DNA, 25 bp, Rattus norvegicus
ggcagcagcacgcacacgaggccga

SEQ ID NO: 666217 - DNA, 25 bp, Rattus norvegicus
cacacgaggccgagcgggataagca

SEQ ID NO: 666218 - DNA, 25 bp, Rattus norvegicus
ataagcagccggaaaggcatagagc

SEQ ID NO: 666219 - DNA, 25 bp, Rattus norvegicus
gccggaaaggcatagagctcgtgtc

SEQ ID NO: 666220 - DNA, 25 bp, Rattus norvegicus
ggccacccgctcattctccgagccg

SEQ ID NO: 666221 - DNA, 25 bp, Rattus norvegicus
tccgagccgcggctggttcttccgg

SEQ ID NO: 666222 - DNA, 25 bp, Rattus norvegicus
gttcttccggggatacgcacaacga

SEQ ID NO: 666223 - DNA, 25 bp, Rattus norvegicus
tccggggatacgcacaacgacgcct

SEQ ID NO: 666224 - DNA, 25 bp, Rattus norvegicus
ggatacgcacaacgacgcctgcgcg

SEQ ID NO: 666225 - DNA, 25 bp, Rattus norvegicus
tgtcctgtcagtgccgccgcagcag

SEQ ID NO: 666226 - DNA, 25 bp, Rattus norvegicus
agagctcgtgtcctgtcagtgccgc

SEQ ID NO: 666227 - DNA, 25 bp, Rattus norvegicus
aagctgaagcagttcgatgcctacc

SEQ ID NO: 666228 - DNA, 25 bp, Rattus norvegicus
gcagttcgatgcctaccctaagact

SEQ ID NO: 666229 - DNA, 25 bp, Rattus norvegicus
aagcagttcgatgcctaccctaaga

SEQ ID NO: 666230 - DNA, 25 bp, Rattus norvegicus
gagggagctgtcctcgcttttggcc

SEQ ID NO: 666231 - DNA, 25 bp, Rattus norvegicus
acagcgaggggcgtgaccccgactt

SEQ ID NO: 666232 - DNA, 25 bp, Rattus norvegicus
ctgaagcagttcgatgcctacccta

SEQ ID NO: 666233 - DNA, 25 bp, Rattus norvegicus
gttcgatgcctaccctaagactctg

SEQ ID NO: 666234 - DNA, 25 bp, Rattus norvegicus
cgatgcctaccctaagactctggag

SEQ ID NO: 666235 - DNA, 25 bp, Rattus norvegicus
tgcctaccctaagactctggaggac

SEQ ID NO: 666236 - DNA, 25 bp, Rattus norvegicus
actctggaggacttccgggtcaaga

SEQ ID NO: 666237 - DNA, 25 bp, Rattus norvegicus
tctggaggacttccgggtcaagacc

SEQ ID NO: 666238 - DNA, 25 bp, Rattus norvegicus
aggacttccgggtcaagacctgcgg

SEQ ID NO: 666239 - DNA, 25 bp, Rattus norvegicus
gcgccacgggtaggtctcggcacgg

SEQ ID NO: 666240 - DNA, 25 bp, Rattus norvegicus
ctcggcacgggcagggttgcaagga

SEQ ID NO: 666241 - DNA, 25 bp, Rattus norvegicus
cacctccctggcggcgtcctgggct

SEQ ID NO: 666242 - DNA, 25 bp, Rattus norvegicus
cttcctcgctcttgccggagggcgg

SEQ ID NO: 666243 - DNA, 25 bp, Rattus norvegicus
cagacagcccgcgaccatgagcctg

SEQ ID NO: 666244 - DNA, 25 bp, Rattus norvegicus
ccctcccttcctcgctcttgccgga

SEQ ID NO: 666245 - DNA, 25 bp, Rattus norvegicus
ctctcttgtcgctgagctcccctcc

SEQ ID NO: 666246 - DNA, 25 bp, Rattus norvegicus
ttcctcgctcttgccggagggcgga

SEQ ID NO: 666247 - DNA, 25 bp, Rattus norvegicus
cggagccgggcccgctccattgtgg

SEQ ID NO: 666248 - DNA, 25 bp, Rattus norvegicus
cccgcagccgggatgcagcgggcgt

SEQ ID NO: 666249 - DNA, 25 bp, Rattus norvegicus
ctcccgggacatgtgcgctggtcca

SEQ ID NO: 666250 - DNA, 25 bp, Rattus norvegicus
cccgggacatgtgcgctggtccaga

SEQ ID NO: 666251 - DNA, 25 bp, Rattus norvegicus
ggacatgtgcgctggtccagacagc

SEQ ID NO: 666252 - DNA, 25 bp, Rattus norvegicus
acatgtgcgctggtccagacagccc

SEQ ID NO: 666253 - DNA, 25 bp, Rattus norvegicus
atgtgcgctggtccagacagcccgc

SEQ ID NO: 666254 - DNA, 25 bp, Rattus norvegicus
cagcgcagcggctcccgggacatgt

SEQ ID NO: 666255 - DNA, 25 bp, Rattus norvegicus
acgccgagttgcttgcgtgagccca

SEQ ID NO: 666256 - DNA, 25 bp, Rattus norvegicus
cccagcaccagaaagatggccactg

SEQ ID NO: 666257 - DNA, 25 bp, Rattus norvegicus
atagactcggattcgccctcccgtg

SEQ ID NO: 666258 - DNA, 25 bp, Rattus norvegicus
ccaagtgcacgaagggacaagtctc

SEQ ID NO: 666259 - DNA, 25 bp, Rattus norvegicus
acaagtctcaggtcaaggggctccg

SEQ ID NO: 666260 - DNA, 25 bp, Rattus norvegicus
aaccacgcacacacgcacttggaga

SEQ ID NO: 666261 - DNA, 25 bp, Rattus norvegicus
agcacttatacctgcatagactcgg

SEQ ID NO: 666262 - DNA, 25 bp, Rattus norvegicus
gccattcggtgatgcgcttagcata

SEQ ID NO: 666263 - DNA, 25 bp, Rattus norvegicus
cttagcatatttgcggacgacgttg

SEQ ID NO: 666264 - DNA, 25 bp, Rattus norvegicus
acgacgttgtcctcgctgaagacga

SEQ ID NO: 666265 - DNA, 25 bp, Rattus norvegicus
cggttgacggtgaagcagttctgct

SEQ ID NO: 666266 - DNA, 25 bp, Rattus norvegicus
cgcgttgcgcaatggactgcttgta

SEQ ID NO: 666267 - DNA, 25 bp, Rattus norvegicus
ggggctcctaacctagccgcagcga

SEQ ID NO: 666268 - DNA, 25 bp, Rattus norvegicus
actgcttgtacaggacccgctggcc

SEQ ID NO: 666269 - DNA, 25 bp, Rattus norvegicus
ttggcctgtggaatgcaccgggcaa

SEQ ID NO: 666270 - DNA, 25 bp, Rattus norvegicus
ggtcctcttgcatcgtgtgcgtccc

SEQ ID NO: 666271 - DNA, 25 bp, Rattus norvegicus
agtctggccaggtcggtgtacctga

SEQ ID NO: 666272 - DNA, 25 bp, Rattus norvegicus
cgagccgcgcaggtaagagcgctcc

SEQ ID NO: 666273 - DNA, 25 bp, Rattus norvegicus
catggacgtacacacccgctggaaa

SEQ ID NO: 666274 - DNA, 25 bp, Rattus norvegicus
tgcaccgggcaagacaacgaatacc

SEQ ID NO: 666275 - DNA, 25 bp, Rattus norvegicus
gccgtatctctggtcctcttgcatc

SEQ ID NO: 666276 - DNA, 25 bp, Rattus norvegicus
tgactccctgaagttgttgcgctcc

SEQ ID NO: 666277 - DNA, 25 bp, Rattus norvegicus
gtgcagagcttcctatgactccctg

SEQ ID NO: 666278 - DNA, 25 bp, Rattus norvegicus
tggcgcaggacctcattccagcgga

SEQ ID NO: 666279 - DNA, 25 bp, Rattus norvegicus
gatcgacagcctccgcggtgtctgc

SEQ ID NO: 666280 - DNA, 25 bp, Rattus norvegicus
atctaagacccgtgtgggccatcgg

SEQ ID NO: 666281 - DNA, 25 bp, Rattus norvegicus
ctgaggcgggaagaatctaagaccc

SEQ ID NO: 666282 - DNA, 25 bp, Rattus norvegicus
cgcgaagccgtagcgccgctgtcat

SEQ ID NO: 666283 - DNA, 25 bp, Rattus norvegicus
tcacgagtggcgtcacgggtgttct

SEQ ID NO: 666284 - DNA, 25 bp, Rattus norvegicus
agccacaatgggcagaccgcctgtg

SEQ ID NO: 666285 - DNA, 25 bp, Rattus norvegicus
tggcgcctcggagccacaatgggca

SEQ ID NO: 666286 - DNA, 25 bp, Rattus norvegicus
acacatgggcaggaagctctcggcc

SEQ ID NO: 666287 - DNA, 25 bp, Rattus norvegicus
cgccttaagctcaggagtgcccgga

SEQ ID NO: 666288 - DNA, 25 bp, Rattus norvegicus
tccagctgtggtgagcccgccttaa

SEQ ID NO: 666289 - DNA, 25 bp, Rattus norvegicus
aatagttcccacagcgcgacttcgg

SEQ ID NO: 666290 - DNA, 25 bp, Rattus norvegicus
ctacagcgagaacagcaatagttcc

SEQ ID NO: 666291 - DNA, 25 bp, Rattus norvegicus
acacacccaacttctacagcgagaa

SEQ ID NO: 666292 - DNA, 25 bp, Rattus norvegicus
ttcggcttccctgaggggtagccca

SEQ ID NO: 666293 - DNA, 25 bp, Rattus norvegicus
tttggctgctgcgacttcggcttcc

SEQ ID NO: 666294 - DNA, 25 bp, Rattus norvegicus
ggtcgcagactccagggctgagtct

SEQ ID NO: 666295 - DNA, 25 bp, Rattus norvegicus
cctctgtgacggtggcaacagcaca

SEQ ID NO: 666296 - DNA, 25 bp, Rattus norvegicus
tctgtgacgcggctcctctgtgacg

SEQ ID NO: 666297 - DNA, 25 bp, Rattus norvegicus
cgcttaaagccaacgatgtcttccc

SEQ ID NO: 666298 - DNA, 25 bp, Rattus norvegicus
agcttgcgcggcaccagaacccaga

SEQ ID NO: 666299 - DNA, 25 bp, Rattus norvegicus
gttcccgcttaaagccaacgatgtc

SEQ ID NO: 666300 - DNA, 25 bp, Rattus norvegicus
agaccgcggagcgtgaacagcgccc

SEQ ID NO: 666301 - DNA, 25 bp, Rattus norvegicus
ctcccacttcggcacgcagactcca

SEQ ID NO: 666302 - DNA, 25 bp, Rattus norvegicus
gaggccaccaagtgctggccgcttc

SEQ ID NO: 666303 - DNA, 25 bp, Rattus norvegicus
cccattctgcgtgcaggcgtttaca

SEQ ID NO: 666304 - DNA, 25 bp, Rattus norvegicus
ggcaccagaacccagacccgagtta

SEQ ID NO: 666305 - DNA, 25 bp, Rattus norvegicus
ccggagcccactgcagccaacacct

SEQ ID NO: 666306 - DNA, 25 bp, Rattus norvegicus
ccgctaccgacgtcacctggtggga

SEQ ID NO: 666307 - DNA, 25 bp, Rattus norvegicus
ccgacgtcacctggtgggagacgca

SEQ ID NO: 666308 - DNA, 25 bp, Rattus norvegicus
ccgcgaccctttgtgtagggcgctc

SEQ ID NO: 666309 - DNA, 25 bp, Rattus norvegicus
ctccgctgccgcttcacaaaatggc

SEQ ID NO: 666310 - DNA, 25 bp, Rattus norvegicus
gtgcaggcgtttacaccgcaatccc

SEQ ID NO: 666311 - DNA, 25 bp, Rattus norvegicus
tgctcccggaagtaattgcgccgcg

SEQ ID NO: 666312 - DNA, 25 bp, Rattus norvegicus
tcgcagcagcatgttcccagcaaca

SEQ ID NO: 666313 - DNA, 25 bp, Rattus norvegicus
ttgcgccgcgctccggaaacgatac

SEQ ID NO: 666314 - DNA, 25 bp, Rattus norvegicus
catctgcgtcgcttgcaagtcttca

SEQ ID NO: 666315 - DNA, 25 bp, Rattus norvegicus
ccttcgcagggccacagaggtagcc

SEQ ID NO: 666316 - DNA, 25 bp, Rattus norvegicus
agaggtagccgccaacgacgctcgc

SEQ ID NO: 666317 - DNA, 25 bp, Rattus norvegicus
gggtggcttctgtcccggaatctac

SEQ ID NO: 666318 - DNA, 25 bp, Rattus norvegicus
tgtcccggaatctacggaaccctgc

SEQ ID NO: 666319 - DNA, 25 bp, Rattus norvegicus
ggcggctaggccctcactatccgag

SEQ ID NO: 666320 - DNA, 25 bp, Rattus norvegicus
cccagctgcttcgaccgcgtgaaga

SEQ ID NO: 666321 - DNA, 25 bp, Rattus norvegicus
ctcaccctagatgccggtggctgtg

SEQ ID NO: 666322 - DNA, 25 bp, Rattus norvegicus
ccgcgtgaagatgggctttgtcatg

SEQ ID NO: 666323 - DNA, 25 bp, Rattus norvegicus
cctagctttcggtgtgagacgtcga

SEQ ID NO: 666324 - DNA, 25 bp, Rattus norvegicus
gttcggcaccttctcctgtctcagg

SEQ ID NO: 666325 - DNA, 25 bp, Rattus norvegicus
tccacagtgactttgccagaattga

SEQ ID NO: 666326 - DNA, 25 bp, Rattus norvegicus
actgcccggtgttctagactggaga

SEQ ID NO: 666327 - DNA, 25 bp, Rattus norvegicus
tcagcacgggctctcgcgagaaact

SEQ ID NO: 666328 - DNA, 25 bp, Rattus norvegicus
ggcgtctaggcccaaacgaatctaa

SEQ ID NO: 666329 - DNA, 25 bp, Rattus norvegicus
tgttaagtcactaggcccaggccgc

SEQ ID NO: 666330 - DNA, 25 bp, Rattus norvegicus
cgacgccctatacctgtgcggattt

SEQ ID NO: 666331 - DNA, 25 bp, Rattus norvegicus
ccagggagaagtgaccgaccttgcc

SEQ ID NO: 666332 - DNA, 25 bp, Rattus norvegicus
gaacccacggaggtccctgacacta

SEQ ID NO: 666333 - DNA, 25 bp, Rattus norvegicus
agatctttatctgcccgagaaccca

SEQ ID NO: 666334 - DNA, 25 bp, Rattus norvegicus
cccggcctcgaaaaggacagatctt

SEQ ID NO: 666335 - DNA, 25 bp, Rattus norvegicus
ggaaggctgaccactactagcagtc

SEQ ID NO: 666336 - DNA, 25 bp, Rattus norvegicus
tgattgcgccacagatgatcccatt

SEQ ID NO: 666337 - DNA, 25 bp, Rattus norvegicus
gactatggcccaatctcgtgcaatg

SEQ ID NO: 666338 - DNA, 25 bp, Rattus norvegicus
tctcactacggctccggcgactatg

SEQ ID NO: 666339 - DNA, 25 bp, Rattus norvegicus
gaatgacggcctcccaggccaatca

SEQ ID NO: 666340 - DNA, 25 bp, Rattus norvegicus
cagtccttctgtcggttggtctgga

SEQ ID NO: 666341 - DNA, 25 bp, Rattus norvegicus
ggacttggtgttcccgcttcaggga

SEQ ID NO: 666342 - DNA, 25 bp, Rattus norvegicus
ttggtgttcccgcttcagggagatg

SEQ ID NO: 666343 - DNA, 25 bp, Rattus norvegicus
ggctgcgtcactcggtggtggagat

SEQ ID NO: 666344 - DNA, 25 bp, Rattus norvegicus
tcacgtggtgcgcagcgcgcacagt

SEQ ID NO: 666345 - DNA, 25 bp, Rattus norvegicus
gcgcgcacagtccttctgtcggttg

SEQ ID NO: 666346 - DNA, 25 bp, Rattus norvegicus
tccttctgtcggttggtctggagcg

SEQ ID NO: 666347 - DNA, 25 bp, Rattus norvegicus
tggccactgcgggaccctggctcag

SEQ ID NO: 666348 - DNA, 25 bp, Rattus norvegicus
ctggctcagtcctgttctccgactg

SEQ ID NO: 666349 - DNA, 25 bp, Rattus norvegicus
ggctcagtcctgttctccgactggc

SEQ ID NO: 666350 - DNA, 25 bp, Rattus norvegicus
gagcgccgcccaatcactgcggcta

SEQ ID NO: 666351 - DNA, 25 bp, Rattus norvegicus
ggctacccgcgggaatgacggcctc

SEQ ID NO: 666352 - DNA, 25 bp, Rattus norvegicus
agtgcggacttggtgttcccgcttc

SEQ ID NO: 666353 - DNA, 25 bp, Rattus norvegicus
tgaataaagtatgagatcccaagtg

SEQ ID NO: 666354 - DNA, 25 bp, Rattus norvegicus
atgctacttgagaaaactatattcc

SEQ ID NO: 666355 - DNA, 25 bp, Rattus norvegicus
aggctggcagtcctgtgaagacaca

SEQ ID NO: 666356 - DNA, 25 bp, Rattus norvegicus
agacagccaggactcaataactatg

SEQ ID NO: 666357 - DNA, 25 bp, Rattus norvegicus
aggccactttttcacccagagacag

SEQ ID NO: 666358 - DNA, 25 bp, Rattus norvegicus
tcctgttgctgataggagagctacc

SEQ ID NO: 666359 - DNA, 25 bp, Rattus norvegicus
taactgtccctgacactgccgtgct

SEQ ID NO: 666360 - DNA, 25 bp, Rattus norvegicus
gcaccgtagctccatcttaatgcta

SEQ ID NO: 666361 - DNA, 25 bp, Rattus norvegicus
ggcctgtataccagcaccgtagctc

SEQ ID NO: 666362 - DNA, 25 bp, Rattus norvegicus
gcagcctcccagtatggcctgtata

SEQ ID NO: 666363 - DNA, 25 bp, Rattus norvegicus
agttcttattcttaccaaggcagcc

SEQ ID NO: 666364 - DNA, 25 bp, Rattus norvegicus
cccaagtgtataataagaggctggc

SEQ ID NO: 666365 - DNA, 25 bp, Rattus norvegicus
gaattgttaccatcccaaataaatg

SEQ ID NO: 666366 - DNA, 25 bp, Rattus norvegicus
taggagagctaccttaccgaggcca

SEQ ID NO: 666367 - DNA, 25 bp, Rattus norvegicus
tcaccctttgtttcgcagttacgcg

SEQ ID NO: 666368 - DNA, 25 bp, Rattus norvegicus
tggcaaccctgaagagctcctattg

SEQ ID NO: 666369 - DNA, 25 bp, Rattus norvegicus
accagcttttcaggcagtaatgatg

SEQ ID NO: 666370 - DNA, 25 bp, Rattus norvegicus
ggggagtccatagataccagctttt

SEQ ID NO: 666371 - DNA, 25 bp, Rattus norvegicus
cctacaagtcacgtgaagtctgagc

SEQ ID NO: 666372 - DNA, 25 bp, Rattus norvegicus
tggagggctccaagaatccggaaac

SEQ ID NO: 666373 - DNA, 25 bp, Rattus norvegicus
cgaagctcctcaggccggaaatgga

SEQ ID NO: 666374 - DNA, 25 bp, Rattus norvegicus
gggtgagccgagcttacctctaaca

SEQ ID NO: 666375 - DNA, 25 bp, Rattus norvegicus
ttctgcgtctgcacgggaatgaggt

SEQ ID NO: 666376 - DNA, 25 bp, Rattus norvegicus
cagcctgaggcgctgtgttcaaagc

SEQ ID NO: 666377 - DNA, 25 bp, Rattus norvegicus
cgccgcatcctggtagcgaaactgc

SEQ ID NO: 666378 - DNA, 25 bp, Rattus norvegicus
gcctcgggtagaatggcctgcagct

SEQ ID NO: 666379 - DNA, 25 bp, Rattus norvegicus
tcctattggaggagacatcgttgcc

SEQ ID NO: 666380 - DNA, 25 bp, Rattus norvegicus
agacccgctgaagggcagaacccgc

SEQ ID NO: 666381 - DNA, 25 bp, Rattus norvegicus
caacagtggtggaatacgatggcga

SEQ ID NO: 666382 - DNA, 25 bp, Rattus norvegicus
ccatccaggcgcatcgctggcaaaa

SEQ ID NO: 666383 - DNA, 25 bp, Rattus norvegicus
ccaggcgcatcgctggcaaaagagt

SEQ ID NO: 666384 - DNA, 25 bp, Rattus norvegicus
agggttcgggcttctagcgtccgca

SEQ ID NO: 666385 - DNA, 25 bp, Rattus norvegicus
ttctagcgtccgcaggacagggacc

SEQ ID NO: 666386 - DNA, 25 bp, Rattus norvegicus
aagaaggccgcactaccgagctcga

SEQ ID NO: 666387 - DNA, 25 bp, Rattus norvegicus
ccctatgccggaactgacttggcag

SEQ ID NO: 666388 - DNA, 25 bp, Rattus norvegicus
gacttggcagttctcctcgcccaga

SEQ ID NO: 666389 - DNA, 25 bp, Rattus norvegicus
ggcagttctcctcgcccagacagga

SEQ ID NO: 666390 - DNA, 25 bp, Rattus norvegicus
agacaggagcggcaccggaagtccc

SEQ ID NO: 666391 - DNA, 25 bp, Rattus norvegicus
caaacaccaccggagagctacggtt

SEQ ID NO: 666392 - DNA, 25 bp, Rattus norvegicus
cccaactgcaaggttccggccaggg

SEQ ID NO: 666393 - DNA, 25 bp, Rattus norvegicus
tgtcctttgcaacagtggtggaata

SEQ ID NO: 666394 - DNA, 25 bp, Rattus norvegicus
caggggcggagtgtcctttgcaaca

SEQ ID NO: 666395 - DNA, 25 bp, Rattus norvegicus
tcgaaagcgtgcaccccacggaggg

SEQ ID NO: 666396 - DNA, 25 bp, Rattus norvegicus
ttctggaaggcacgcgaaggtagcc

SEQ ID NO: 666397 - DNA, 25 bp, Rattus norvegicus
aggcacgcgaaggtagccttgtgtc

SEQ ID NO: 666398 - DNA, 25 bp, Rattus norvegicus
cacgcgaaggtagccttgtgtcgca

SEQ ID NO: 666399 - DNA, 25 bp, Rattus norvegicus
gaaggtagccttgtgtcgcagtgtc

SEQ ID NO: 666400 - DNA, 25 bp, Rattus norvegicus
cccgccgccgtcgaaagcgtgcacc

SEQ ID NO: 666401 - DNA, 25 bp, Rattus norvegicus
cgtcggccaccacgcggcgggaact

SEQ ID NO: 666402 - DNA, 25 bp, Rattus norvegicus
gcgggaactcgaggccccattggcc

SEQ ID NO: 666403 - DNA, 25 bp, Rattus norvegicus
cccattggccacacagagggcgtgc

SEQ ID NO: 666404 - DNA, 25 bp, Rattus norvegicus
cattggccacacagagggcgtgccg

SEQ ID NO: 666405 - DNA, 25 bp, Rattus norvegicus
tgccgggactcgtgcgccaacggtc

SEQ ID NO: 666406 - DNA, 25 bp, Rattus norvegicus
actcgtgcgccaacggtccgggcct

SEQ ID NO: 666407 - DNA, 25 bp, Rattus norvegicus
atcgagaacggtgggagagccaggc

SEQ ID NO: 666408 - DNA, 25 bp, Rattus norvegicus
aggtagccttgtgtcgcagtgtccc

SEQ ID NO: 666409 - DNA, 25 bp, Rattus norvegicus
agctcctgagcgtcttgaagaccgc

SEQ ID NO: 666410 - DNA, 25 bp, Rattus norvegicus
caattcgtgtcttagcgggtacgtg

SEQ ID NO: 666411 - DNA, 25 bp, Rattus norvegicus
cggagccggagctacaattcgtgtc

SEQ ID NO: 666412 - DNA, 25 bp, Rattus norvegicus
agaccgcgcaggctgtcgctacgtc

SEQ ID NO: 666413 - DNA, 25 bp, Rattus norvegicus
ccactggacgagagcaccgagagac

SEQ ID NO: 666414 - DNA, 25 bp, Rattus norvegicus
ggcatttctgcgcagctcctgagcg

SEQ ID NO: 666415 - DNA, 25 bp, Rattus norvegicus
cagctcagttcttagggccagtggg

SEQ ID NO: 666416 - DNA, 25 bp, Rattus norvegicus
gcgcctgctcctgggcagctcagtt

SEQ ID NO: 666417 - DNA, 25 bp, Rattus norvegicus
tagagtctcgtgttcgtggtttcgc

SEQ ID NO: 666418 - DNA, 25 bp, Rattus norvegicus
caagctttcggtcaaaggcgaggta

SEQ ID NO: 666419 - DNA, 25 bp, Rattus norvegicus
tacgggtctgaacgccaagctttcg

SEQ ID NO: 666420 - DNA, 25 bp, Rattus norvegicus
ctcacgttagcccaggctacgggtc

SEQ ID NO: 666421 - DNA, 25 bp, Rattus norvegicus
cttaggccgcccgaacaataggaga

SEQ ID NO: 666422 - DNA, 25 bp, Rattus norvegicus
cagacagacggacggctcccggaag

SEQ ID NO: 666423 - DNA, 25 bp, Rattus norvegicus
gggcgctcacatggccaccggaggc

SEQ ID NO: 666424 - DNA, 25 bp, Rattus norvegicus
gcgcagcgcagaggccgagtggaca

SEQ ID NO: 666425 - DNA, 25 bp, Rattus norvegicus
agcgaccctggcacctgggctgtgt

SEQ ID NO: 666426 - DNA, 25 bp, Rattus norvegicus
cccgggttcccttgccttctgcctg

SEQ ID NO: 666427 - DNA, 25 bp, Rattus norvegicus
agctcccggccctccatccgcaggc

SEQ ID NO: 666428 - DNA, 25 bp, Rattus norvegicus
cggccagggcgcaggaacagctccc

SEQ ID NO: 666429 - DNA, 25 bp, Rattus norvegicus
ccctccgatgctgccggcccttccc

SEQ ID NO: 666430 - DNA, 25 bp, Rattus norvegicus
tcagcggtggggtctcccggatcct

SEQ ID NO: 666431 - DNA, 25 bp, Rattus norvegicus
acgctctcagcggtggggtctcccg

SEQ ID NO: 666432 - DNA, 25 bp, Rattus norvegicus
tccgaggctagatctcgggcagccc

SEQ ID NO: 666433 - DNA, 25 bp, Rattus norvegicus
ctcctccgaggctagatctcgggca

SEQ ID NO: 666434 - DNA, 25 bp, Rattus norvegicus
accctggcacctgggctgtgtgtgt

SEQ ID NO: 666435 - DNA, 25 bp, Rattus norvegicus
acagaggcggtcgagcgccgggcac

SEQ ID NO: 666436 - DNA, 25 bp, Rattus norvegicus
gggtggcacgcgtcaagaccctcct

SEQ ID NO: 666437 - DNA, 25 bp, Rattus norvegicus
ttctccgcgcaagcaaggctcacgg

SEQ ID NO: 666438 - DNA, 25 bp, Rattus norvegicus
ccagggctaccgtgagcccggcaaa

SEQ ID NO: 666439 - DNA, 25 bp, Rattus norvegicus
aagcaaggctcacgggtccctcagc

SEQ ID NO: 666440 - DNA, 25 bp, Rattus norvegicus
aacttttggcatcgctgcagcccgg

SEQ ID NO: 666441 - DNA, 25 bp, Rattus norvegicus
cgcgcagggaaagcaagcgcagccc

SEQ ID NO: 666442 - DNA, 25 bp, Rattus norvegicus
cgccggaaccggtaccataaatatg

SEQ ID NO: 666443 - DNA, 25 bp, Rattus norvegicus
ccataaatatgcagagcggaggctc

SEQ ID NO: 666444 - DNA, 25 bp, Rattus norvegicus
gccctgcacgctaggacgtcggagt

SEQ ID NO: 666445 - DNA, 25 bp, Rattus norvegicus
cgagacatgcaaccggcccggaagc

SEQ ID NO: 666446 - DNA, 25 bp, Rattus norvegicus
cctcctggtgatgggcaccgaactc

SEQ ID NO: 666447 - DNA, 25 bp, Rattus norvegicus
ggcaccgaactcacccaagtacgtg

SEQ ID NO: 666448 - DNA, 25 bp, Rattus norvegicus
agtacgtgtgaccaacgccattttc

SEQ ID NO: 666449 - DNA, 25 bp, Rattus norvegicus
cctcaccgagcaaacttttggcatc

SEQ ID NO: 666450 - DNA, 25 bp, Rattus norvegicus
acgccattttcctctgccagggcta

SEQ ID NO: 666451 - DNA, 25 bp, Rattus norvegicus
ggtgagagtcctggccgcattcgcc

SEQ ID NO: 666452 - DNA, 25 bp, Rattus norvegicus
gctgatgactctgggccgccagcca

SEQ ID NO: 666453 - DNA, 25 bp, Rattus norvegicus
cctgcctcggggctgatgactctgg

SEQ ID NO: 666454 - DNA, 25 bp, Rattus norvegicus
ttccgatgacaacctggacggtgag

SEQ ID NO: 666455 - DNA, 25 bp, Rattus norvegicus
gctggtggagttccgatgacaacct

SEQ ID NO: 666456 - DNA, 25 bp, Rattus norvegicus
caacatctcgggctggtggagttcc

SEQ ID NO: 666457 - DNA, 25 bp, Rattus norvegicus
ggcgaagccgctccaacatctcggg

SEQ ID NO: 666458 - DNA, 25 bp, Rattus norvegicus
caaaagcaaggaacgggccaaggct

SEQ ID NO: 666459 - DNA, 25 bp, Rattus norvegicus
gcaacggcggcaagaaaggtgtcct

SEQ ID NO: 666460 - DNA, 25 bp, Rattus norvegicus
caccacgggcaaggtgggtggcaac

SEQ ID NO: 666461 - DNA, 25 bp, Rattus norvegicus
ttcactaaggcaccctcgatggagg

SEQ ID NO: 666462 - DNA, 25 bp, Rattus norvegicus
gtccagcgtctcttcttcactaagg

SEQ ID NO: 666463 - DNA, 25 bp, Rattus norvegicus
ttcgccacctggtccactccgtcca

SEQ ID NO: 666464 - DNA, 25 bp, Rattus norvegicus
gccgccagccagaacgtacccagcc

SEQ ID NO: 666465 - DNA, 25 bp, Rattus norvegicus
agaggactagaaggagcggttccca

SEQ ID NO: 666466 - DNA, 25 bp, Rattus norvegicus
tttgtccacatgtctgtttgcgtcg

SEQ ID NO: 666467 - DNA, 25 bp, Rattus norvegicus
catgcctcgtgtccgtttgtccaca

SEQ ID NO: 666468 - DNA, 25 bp, Rattus norvegicus
tgggcctacgtgcagtgtctgcatg

SEQ ID NO: 666469 - DNA, 25 bp, Rattus norvegicus
acctggcccttcttgggcctacgtg

SEQ ID NO: 666470 - DNA, 25 bp, Rattus norvegicus
cgaatgagcagtgcccggcttaacc

SEQ ID NO: 666471 - DNA, 25 bp, Rattus norvegicus
tagggaaagccagtcatctccatcc

SEQ ID NO: 666472 - DNA, 25 bp, Rattus norvegicus
ctcagagtagggaaagccagtcatc

SEQ ID NO: 666473 - DNA, 25 bp, Rattus norvegicus
tgtgatggcgccctcctcagagtag

SEQ ID NO: 666474 - DNA, 25 bp, Rattus norvegicus
cggaccaaaagcgatcgatgtgatg

SEQ ID NO: 666475 - DNA, 25 bp, Rattus norvegicus
agcggttcccacctctcggaggaca

SEQ ID NO: 666476 - DNA, 25 bp, Rattus norvegicus
tctgatcgtgtaaaggagaggacta

SEQ ID NO: 666477 - DNA, 25 bp, Rattus norvegicus
ccttttttctctctgatcgtgtaaa

SEQ ID NO: 666478 - DNA, 25 bp, Rattus norvegicus
tctcggaggacaacggaccaaaagc

SEQ ID NO: 666479 - DNA, 25 bp, Rattus norvegicus
ctaaactttttcctgtcccagaatg

SEQ ID NO: 666480 - DNA, 25 bp, Rattus norvegicus
ccaacatggagtctgggagcagagt

SEQ ID NO: 666481 - DNA, 25 bp, Rattus norvegicus
gagcacaaagccgagcgcgcacgct

SEQ ID NO: 666482 - DNA, 25 bp, Rattus norvegicus
acgtcaggtcgcgaggtgctttcca

SEQ ID NO: 666483 - DNA, 25 bp, Rattus norvegicus
ctccgggccgagttcggagcacaaa

SEQ ID NO: 666484 - DNA, 25 bp, Rattus norvegicus
ctggcgacgcgaagaaagtttgtgc

SEQ ID NO: 666485 - DNA, 25 bp, Rattus norvegicus
aaggaaagtctgtctccgaggcatc

SEQ ID NO: 666486 - DNA, 25 bp, Rattus norvegicus
agtgcacgttgctaaccgcccgcag

SEQ ID NO: 666487 - DNA, 25 bp, Rattus norvegicus
gtttggtttcaaaagtgcacgttgc

SEQ ID NO: 666488 - DNA, 25 bp, Rattus norvegicus
gaggggtcggctcccaaagatccca

SEQ ID NO: 666489 - DNA, 25 bp, Rattus norvegicus
cgcggacaacttggaaagtttcttg

SEQ ID NO: 666490 - DNA, 25 bp, Rattus norvegicus
tgtcagacccggcaggtacccggcg

SEQ ID NO: 666491 - DNA, 25 bp, Rattus norvegicus
ctttccagccgcgagctgtcaggcg

SEQ ID NO: 666492 - DNA, 25 bp, Rattus norvegicus
caagagtcagtctgcgcggagtacc

SEQ ID NO: 666493 - DNA, 25 bp, Rattus norvegicus
ttagcgcttctgaagaccgcgcacg

SEQ ID NO: 666494 - DNA, 25 bp, Rattus norvegicus
acgtgccctacgagttttatgattc

SEQ ID NO: 666495 - DNA, 25 bp, Rattus norvegicus
gtggttctgcccttgctggattaga

SEQ ID NO: 666496 - DNA, 25 bp, Rattus norvegicus
agcgagcggagctcctaccatcctt

SEQ ID NO: 666497 - DNA, 25 bp, Rattus norvegicus
gcagctagccaacggggccctcaag

SEQ ID NO: 666498 - DNA, 25 bp, Rattus norvegicus
attagatgaagaagacgacgtgccc

SEQ ID NO: 666499 - DNA, 25 bp, Rattus norvegicus
cggagcaggatgcaaggccacctct

SEQ ID NO: 666500 - DNA, 25 bp, Rattus norvegicus
tacttgtcgctccagggtacgagtc

SEQ ID NO: 666501 - DNA, 25 bp, Rattus norvegicus
ctgggcagcgaaccgtcaaatctcg

SEQ ID NO: 666502 - DNA, 25 bp, Rattus norvegicus
tcaaatctcggctttccttagaggg

SEQ ID NO: 666503 - DNA, 25 bp, Rattus norvegicus
ccttagaggggctgtgcctcactca

SEQ ID NO: 666504 - DNA, 25 bp, Rattus norvegicus
ttacctagcgcctgacggaaactta

SEQ ID NO: 666505 - DNA, 25 bp, Rattus norvegicus
gtgccacggtatctcacagcctaga

SEQ ID NO: 666506 - DNA, 25 bp, Rattus norvegicus
caggatctggagtagttagcgcttc

SEQ ID NO: 666507 - DNA, 25 bp, Rattus norvegicus
cagcagcaccagcaaggaggggcgg

SEQ ID NO: 666508 - DNA, 25 bp, Rattus norvegicus
tacgcatgcgcaaagtacctgctta

SEQ ID NO: 666509 - DNA, 25 bp, Rattus norvegicus
ctgctagataggtacccgcaggggc

SEQ ID NO: 666510 - DNA, 25 bp, Rattus norvegicus
agggtgacaacctcaggaggtccca

SEQ ID NO: 666511 - DNA, 25 bp, Rattus norvegicus
cgcatgcgcaaagtacctgcttacg

SEQ ID NO: 666512 - DNA, 25 bp, Rattus norvegicus
caggcctctggagcgaggctcgacc

SEQ ID NO: 666513 - DNA, 25 bp, Rattus norvegicus
cgggccgtcaatctacagcagcagc

SEQ ID NO: 666514 - DNA, 25 bp, Rattus norvegicus
tgtggccatcggtccgcagatcaca

SEQ ID NO: 666515 - DNA, 25 bp, Rattus norvegicus
atcggtccgcagatcacagaggagc

SEQ ID NO: 666516 - DNA, 25 bp, Rattus norvegicus
cgcagatcacagaggagcgacaccc

SEQ ID NO: 666517 - DNA, 25 bp, Rattus norvegicus
ggcgctcactcacctgaagctctag

SEQ ID NO: 666518 - DNA, 25 bp, Rattus norvegicus
tcactcacctgaagctctagcgcgg

SEQ ID NO: 666519 - DNA, 25 bp, Rattus norvegicus
cctgaagctctagcgcgggccgtca

SEQ ID NO: 666520 - DNA, 25 bp, Rattus norvegicus
aacctcaggaggtcccagagacgga

SEQ ID NO: 666521 - DNA, 25 bp, Rattus norvegicus
acagcgaaccacatccggggaaatg

SEQ ID NO: 666522 - DNA, 25 bp, Rattus norvegicus
catccggggaaatgtcttcgacttc

SEQ ID NO: 666523 - DNA, 25 bp, Rattus norvegicus
cgttcctgaaacaataaatccaagg

SEQ ID NO: 666524 - DNA, 25 bp, Rattus norvegicus
tccaaggtcacctctgcagactggg

SEQ ID NO: 666525 - DNA, 25 bp, Rattus norvegicus
cgccgaataactgcgcatgcgcggc

SEQ ID NO: 666526 - DNA, 25 bp, Rattus norvegicus
tgcagactgggcgtcaccacagagg

SEQ ID NO: 666527 - DNA, 25 bp, Rattus norvegicus
cgttagtctagttccaggttccgcg

SEQ ID NO: 666528 - DNA, 25 bp, Rattus norvegicus
tagttccaggttccgcgctgccgca

SEQ ID NO: 666529 - DNA, 25 bp, Rattus norvegicus
cggatctgggacagcgaaccacatc

SEQ ID NO: 666530 - DNA, 25 bp, Rattus norvegicus
gaaactcccgccgaataactgcgca

SEQ ID NO: 666531 - DNA, 25 bp, Rattus norvegicus
ctgcctcctggagcgcatgcgtact

SEQ ID NO: 666532 - DNA, 25 bp, Rattus norvegicus
tgcgtactgtggttcaacgttctcg

SEQ ID NO: 666533 - DNA, 25 bp, Rattus norvegicus
cgtcaccacagagggtggtcttccc

SEQ ID NO: 666534 - DNA, 25 bp, Rattus norvegicus
gctgccgcagctacttccgaaactc

SEQ ID NO: 666535 - DNA, 25 bp, Rattus norvegicus
gcactcaccacccagagaagagaag

SEQ ID NO: 666536 - DNA, 25 bp, Rattus norvegicus
gggctctacaaagccggcctgcgtg

SEQ ID NO: 666537 - DNA, 25 bp, Rattus norvegicus
ttccacaaactgcagatgtcgccgc

SEQ ID NO: 666538 - DNA, 25 bp, Rattus norvegicus
tccaactctgcagaggagcgccgca

SEQ ID NO: 666539 - DNA, 25 bp, Rattus norvegicus
gcagcaacttgttctggtcctccaa

SEQ ID NO: 666540 - DNA, 25 bp, Rattus norvegicus
tggccagctcgttcagcagcaactt

SEQ ID NO: 666541 - DNA, 25 bp, Rattus norvegicus
tgctccgagcggtatttggccagct

SEQ ID NO: 666542 - DNA, 25 bp, Rattus norvegicus
gacagcgtcacgtccaactcgtgct

SEQ ID NO: 666543 - DNA, 25 bp, Rattus norvegicus
tcactgagcacggagcagctgtcct

SEQ ID NO: 666544 - DNA, 25 bp, Rattus norvegicus
agctcctcctgcgaaggctcactga

SEQ ID NO: 666545 - DNA, 25 bp, Rattus norvegicus
ccgatctgcagcttggcggctgcca

SEQ ID NO: 666546 - DNA, 25 bp, Rattus norvegicus
cttcttgaccttgccgctgagctcg

SEQ ID NO: 666547 - DNA, 25 bp, Rattus norvegicus
ctccagagtctcacccagaggggca

SEQ ID NO: 666548 - DNA, 25 bp, Rattus norvegicus
ggtccttcatatcgtccatctcagc

SEQ ID NO: 666549 - DNA, 25 bp, Rattus norvegicus
ttccagcggctcctcatcacgtcag

SEQ ID NO: 666550 - DNA, 25 bp, Rattus norvegicus
ccggactggaggtgccctgtcgccc

SEQ ID NO: 666551 - DNA, 25 bp, Rattus norvegicus
ctcctcatcacgtcagcctctgctt

SEQ ID NO: 666552 - DNA, 25 bp, Rattus norvegicus
ccgccgcgaccagcctcagctgctc

SEQ ID NO: 666553 - DNA, 25 bp, Rattus norvegicus
gctgctcgttcacctcaagaggctc

SEQ ID NO: 666554 - DNA, 25 bp, Rattus norvegicus
tcagcctctgcttcggcctcagctt

SEQ ID NO: 666555 - DNA, 25 bp, Rattus norvegicus
accagcgccaacaaggccaagctgg

SEQ ID NO: 666556 - DNA, 25 bp, Rattus norvegicus
tcagctgctcgttcacctcaagagg

SEQ ID NO: 666557 - DNA, 25 bp, Rattus norvegicus
tgctcgttcacctcaagaggctcac

SEQ ID NO: 666558 - DNA, 25 bp, Rattus norvegicus
gttcacctcaagaggctcaccagcg

SEQ ID NO: 666559 - DNA, 25 bp, Rattus norvegicus
tgcttcggcctcagcttctacctcc

SEQ ID NO: 666560 - DNA, 25 bp, Rattus norvegicus
tcaagaggctcaccagcgccaacaa

SEQ ID NO: 666561 - DNA, 25 bp, Rattus norvegicus
cacttccgccgcgaccagcctcagc

SEQ ID NO: 666562 - DNA, 25 bp, Rattus norvegicus
agaggctcaccagcgccaacaaggc

SEQ ID NO: 666563 - DNA, 25 bp, Rattus norvegicus
cccatcctatagaaccgtaaactga

SEQ ID NO: 666564 - DNA, 25 bp, Rattus norvegicus
agggtccgtggcacctctcgtgcat

SEQ ID NO: 666565 - DNA, 25 bp, Rattus norvegicus
agtgtactgaactcctcctgcctct

SEQ ID NO: 666566 - DNA, 25 bp, Rattus norvegicus
agtctcacgcctccggagtgtactg

SEQ ID NO: 666567 - DNA, 25 bp, Rattus norvegicus
tctctgtccgctgccgtagggtccg

SEQ ID NO: 666568 - DNA, 25 bp, Rattus norvegicus
acctggcacgcggtcggctcttggt

SEQ ID NO: 666569 - DNA, 25 bp, Rattus norvegicus
agggatccgcgaggcaacagcgacc

SEQ ID NO: 666570 - DNA, 25 bp, Rattus norvegicus
ctttagctgggcatgacaaacgacc

SEQ ID NO: 666571 - DNA, 25 bp, Rattus norvegicus
ggtgctgagcctgcgcgaactccgc

SEQ ID NO: 666572 - DNA, 25 bp, Rattus norvegicus
tcaaagggccggagccagcatccat

SEQ ID NO: 666573 - DNA, 25 bp, Rattus norvegicus
cgcggacctcaaagggccggagcca

SEQ ID NO: 666574 - DNA, 25 bp, Rattus norvegicus
cgtggacggcaggagagaatattcc

SEQ ID NO: 666575 - DNA, 25 bp, Rattus norvegicus
gcccaggagcctagaagcccggcgt

SEQ ID NO: 666576 - DNA, 25 bp, Rattus norvegicus
gtaggatagaccctgagtctcacgc

SEQ ID NO: 666577 - DNA, 25 bp, Rattus norvegicus
cgctgctttcgggatctgcagactc

SEQ ID NO: 666578 - DNA, 25 bp, Rattus norvegicus
ttataagcctctgggcctactgcgc

SEQ ID NO: 666579 - DNA, 25 bp, Rattus norvegicus
agaggacctccattcagcgagcttc

SEQ ID NO: 666580 - DNA, 25 bp, Rattus norvegicus
ccactacctctgaagatgtccagca

SEQ ID NO: 666581 - DNA, 25 bp, Rattus norvegicus
cgcaatgactaggtgctcgtcctca

SEQ ID NO: 666582 - DNA, 25 bp, Rattus norvegicus
gtccagcacttttttctctcggaaa

SEQ ID NO: 666583 - DNA, 25 bp, Rattus norvegicus
cactagggcctggtccattgcgcaa

SEQ ID NO: 666584 - DNA, 25 bp, Rattus norvegicus
tttctctaagaaggagcacacgtcc

SEQ ID NO: 666585 - DNA, 25 bp, Rattus norvegicus
cagactcgttcgctgctgcaggacg

SEQ ID NO: 666586 - DNA, 25 bp, Rattus norvegicus
tccgagtctggtctctgcatggcta

SEQ ID NO: 666587 - DNA, 25 bp, Rattus norvegicus
cacccggcgctgctaagtcaagtac

SEQ ID NO: 666588 - DNA, 25 bp, Rattus norvegicus
ccgaaggcgagtccattcagtttta

SEQ ID NO: 666589 - DNA, 25 bp, Rattus norvegicus
ctccgcccttatgtttctccgaaag

SEQ ID NO: 666590 - DNA, 25 bp, Rattus norvegicus
accgcttagcaggttgctccgagtc

SEQ ID NO: 666591 - DNA, 25 bp, Rattus norvegicus
tgaaagtctggagcctagggaaccc

SEQ ID NO: 666592 - DNA, 25 bp, Rattus norvegicus
gcggcgcgcagaaatcaagtttgaa

SEQ ID NO: 666593 - DNA, 25 bp, Rattus norvegicus
atgaacctcggactctaaagatcta

SEQ ID NO: 666594 - DNA, 25 bp, Rattus norvegicus
ccggaaatgggagaagatgaacctc

SEQ ID NO: 666595 - DNA, 25 bp, Rattus norvegicus
cgcagcaacccgtctccggaaatgg

SEQ ID NO: 666596 - DNA, 25 bp, Rattus norvegicus
gtctgcctccgcttttcttctcaaa

SEQ ID NO: 666597 - DNA, 25 bp, Rattus norvegicus
aaatcgcctacttgagctcgccttc

SEQ ID NO: 666598 - DNA, 25 bp, Rattus norvegicus
caggttcagctcctggcacagggcc

SEQ ID NO: 666599 - DNA, 25 bp, Rattus norvegicus
cgccgctcacctctaggctgtagtt

SEQ ID NO: 666600 - DNA, 25 bp, Rattus norvegicus
actcctcagagaccctcgtaggtgg

SEQ ID NO: 666601 - DNA, 25 bp, Rattus norvegicus
cgcctcaaaacaaatgggtgggttg

SEQ ID NO: 666602 - DNA, 25 bp, Rattus norvegicus
tgagcttcggtttcccgcctcaaaa

SEQ ID NO: 666603 - DNA, 25 bp, Rattus norvegicus
aacccgggagcagcgtaagactctg

SEQ ID NO: 666604 - DNA, 25 bp, Rattus norvegicus
ctaaagatctagctcggaccctgcc

SEQ ID NO: 666605 - DNA, 25 bp, Rattus norvegicus
cgcaggagaccactcgaggcgcgat

SEQ ID NO: 666606 - DNA, 25 bp, Rattus norvegicus
tggcccttctcgacagcggagcgcg

SEQ ID NO: 666607 - DNA, 25 bp, Rattus norvegicus
ccgacgagtttgcagacctcgctgc

SEQ ID NO: 666608 - DNA, 25 bp, Rattus norvegicus
ccagagctcggaggaaaaatccacc

SEQ ID NO: 666609 - DNA, 25 bp, Rattus norvegicus
ggccatgatcaccaactggatgtcc

SEQ ID NO: 666610 - DNA, 25 bp, Rattus norvegicus
gctcagaacctggtggcccttctcg

SEQ ID NO: 666611 - DNA, 25 bp, Rattus norvegicus
cgtgctaagcaccatggccatgatc

SEQ ID NO: 666612 - DNA, 25 bp, Rattus norvegicus
tggtgggcctcaataccacccggct

SEQ ID NO: 666613 - DNA, 25 bp, Rattus norvegicus
acgctggaccgcagcaccggcgtaa

SEQ ID NO: 666614 - DNA, 25 bp, Rattus norvegicus
accggcgtaagtgcgcccgccttga

SEQ ID NO: 666615 - DNA, 25 bp, Rattus norvegicus
tacagcctagcagcgactccagctg

SEQ ID NO: 666616 - DNA, 25 bp, Rattus norvegicus
ccgcactctggcgtttcggggcgat

SEQ ID NO: 666617 - DNA, 25 bp, Rattus norvegicus
tttcggggcgatgcttcttgcgccc

SEQ ID NO: 666618 - DNA, 25 bp, Rattus norvegicus
catttcctgggcagattgcgtcggc

SEQ ID NO: 666619 - DNA, 25 bp, Rattus norvegicus
cgggaaagacccgtgagtgacagca

SEQ ID NO: 666620 - DNA, 25 bp, Rattus norvegicus
tcattccaatagtaccggcggccta

SEQ ID NO: 666621 - DNA, 25 bp, Rattus norvegicus
cgtgcaacgtgtgactacgggtccc

SEQ ID NO: 666622 - DNA, 25 bp, Rattus norvegicus
ttgcgcatggctcaacagtggggcc

SEQ ID NO: 666623 - DNA, 25 bp, Rattus norvegicus
acctgctcggaggaatggcgccgcc

SEQ ID NO: 666624 - DNA, 25 bp, Rattus norvegicus
cttcccggagcggaagtctgcgtgt

SEQ ID NO: 666625 - DNA, 25 bp, Rattus norvegicus
cttggagccacttcccggagcggaa

SEQ ID NO: 666626 - DNA, 25 bp, Rattus norvegicus
agcccattctggcaagtggcgtgtg

SEQ ID NO: 666627 - DNA, 25 bp, Rattus norvegicus
agactgacctttgccgggagcccat

SEQ ID NO: 666628 - DNA, 25 bp, Rattus norvegicus
gggaccgtcgagactgacctttgcc

SEQ ID NO: 666629 - DNA, 25 bp, Rattus norvegicus
gagtgacagcacgtccggccagtca

SEQ ID NO: 666630 - DNA, 25 bp, Rattus norvegicus
gtcgattccaagtgggtcccggcgc

SEQ ID NO: 666631 - DNA, 25 bp, Rattus norvegicus
aaggccctgccaagcgggaccgtcg

SEQ ID NO: 666632 - DNA, 25 bp, Rattus norvegicus
cggttcgaacgccacgactggactc

SEQ ID NO: 666633 - DNA, 25 bp, Rattus norvegicus
gtgccctgtgttgctatgtaaccta

SEQ ID NO: 666634 - DNA, 25 bp, Rattus norvegicus
ctgtggacgaaagttacttgcgatg

SEQ ID NO: 666635 - DNA, 25 bp, Rattus norvegicus
tggctccgataaagcccgctgaacg

SEQ ID NO: 666636 - DNA, 25 bp, Rattus norvegicus
ccgctgaacggaatctgcggctgtc

SEQ ID NO: 666637 - DNA, 25 bp, Rattus norvegicus
cttccgggtcacaagggatcacttc

SEQ ID NO: 666638 - DNA, 25 bp, Rattus norvegicus
gggatcacttccgttgcggcggcac

SEQ ID NO: 666639 - DNA, 25 bp, Rattus norvegicus
cgctacgggttacagcggcttcctg

SEQ ID NO: 666640 - DNA, 25 bp, Rattus norvegicus
cttgcgatggcagtctgcgttccga

SEQ ID NO: 666641 - DNA, 25 bp, Rattus norvegicus
ttccgaggagactgggacctttgcc

SEQ ID NO: 666642 - DNA, 25 bp, Rattus norvegicus
ctagagttcttcagggccaaggccc

SEQ ID NO: 666643 - DNA, 25 bp, Rattus norvegicus
tgtaacctagggcatctcgcgtttc

SEQ ID NO: 666644 - DNA, 25 bp, Rattus norvegicus
ggtcggtctcctcctccgcaaagag

SEQ ID NO: 666645 - DNA, 25 bp, Rattus norvegicus
gcgaggaaaccgtggctccgataaa

SEQ ID NO: 666646 - DNA, 25 bp, Rattus norvegicus
ccgggccctcgctagagttcttcag

SEQ ID NO: 666647 - DNA, 25 bp, Rattus norvegicus
caccggtgcttagctcaggtagcta

SEQ ID NO: 666648 - DNA, 25 bp, Rattus norvegicus
cccgccgcggccttttgttgggatg

SEQ ID NO: 666649 - DNA, 25 bp, Rattus norvegicus
gcgtctgcgggcagtgctagccacc

SEQ ID NO: 666650 - DNA, 25 bp, Rattus norvegicus
gcagtgctagccaccggtgcttagc

SEQ ID NO: 666651 - DNA, 25 bp, Rattus norvegicus
tgctagccaccggtgcttagctcag

SEQ ID NO: 666652 - DNA, 25 bp, Rattus norvegicus
tagccaccggtgcttagctcaggta

SEQ ID NO: 666653 - DNA, 25 bp, Rattus norvegicus
gccaccggtgcttagctcaggtagc

SEQ ID NO: 666654 - DNA, 25 bp, Rattus norvegicus
agctcaggtagctagggtggaaccc

SEQ ID NO: 666655 - DNA, 25 bp, Rattus norvegicus
ctcaggtagctagggtggaacccta

SEQ ID NO: 666656 - DNA, 25 bp, Rattus norvegicus
ctccctttctctcggtctgtctctc

SEQ ID NO: 666657 - DNA, 25 bp, Rattus norvegicus
cggtctgtctctcccggcccggaat

SEQ ID NO: 666658 - DNA, 25 bp, Rattus norvegicus
gccctgcccactctccggcgcggcc

SEQ ID NO: 666659 - DNA, 25 bp, Rattus norvegicus
ccggtgcttagctcaggtagctagg

SEQ ID NO: 666660 - DNA, 25 bp, Rattus norvegicus
tctcccggcccggaatccagccggc

SEQ ID NO: 666661 - DNA, 25 bp, Rattus norvegicus
ctgagcagggtgactcatgctcctg

SEQ ID NO: 666662 - DNA, 25 bp, Rattus norvegicus
tcatgctcctgcatacatggctaca

SEQ ID NO: 666663 - DNA, 25 bp, Rattus norvegicus
tgcatacatggctacacccacacga

SEQ ID NO: 666664 - DNA, 25 bp, Rattus norvegicus
atggctacacccacacgagcaaatc

SEQ ID NO: 666665 - DNA, 25 bp, Rattus norvegicus
cgagcaaatcccacgctctgacgga

SEQ ID NO: 666666 - DNA, 25 bp, Rattus norvegicus
aatcccacgctctgacggagccata

SEQ ID NO: 666667 - DNA, 25 bp, Rattus norvegicus
tctgacggagccatactcacggctg

SEQ ID NO: 666668 - DNA, 25 bp, Rattus norvegicus
acggagccatactcacggctgcaca

SEQ ID NO: 666669 - DNA, 25 bp, Rattus norvegicus
ggctgcacacccgtgcgtgcaaatc

SEQ ID NO: 666670 - DNA, 25 bp, Rattus norvegicus
cgtgcgtgcaaatcccgcactcgga

SEQ ID NO: 666671 - DNA, 25 bp, Rattus norvegicus
gtgcaaatcccgcactcggactcag

SEQ ID NO: 666672 - DNA, 25 bp, Rattus norvegicus
cccgcactcggactcagccacacgc

SEQ ID NO: 666673 - DNA, 25 bp, Rattus norvegicus
acacgcacggctgcacacccactcg

SEQ ID NO: 666674 - DNA, 25 bp, Rattus norvegicus
cgtggtgcggcaaccctgccgccca

SEQ ID NO: 666675 - DNA, 25 bp, Rattus norvegicus
gctcatcatcggctggtacatcttc

SEQ ID NO: 666676 - DNA, 25 bp, Rattus norvegicus
tacccgctatactcaggctcgattc

SEQ ID NO: 666677 - DNA, 25 bp, Rattus norvegicus
gacgatcgcgaccaacgcggtaaga

SEQ ID NO: 666678 - DNA, 25 bp, Rattus norvegicus
gcccagccgggaacaaagactcagg

SEQ ID NO: 666679 - DNA, 25 bp, Rattus norvegicus
aatgccgcggtggtactatttgtcc

SEQ ID NO: 666680 - DNA, 25 bp, Rattus norvegicus
gccgcgatccctgtgtaccaaaatg

SEQ ID NO: 666681 - DNA, 25 bp, Rattus norvegicus
ggacccttagtccatatcgcgattg

SEQ ID NO: 666682 - DNA, 25 bp, Rattus norvegicus
ggcacttgtgtgctgcgagacttta

SEQ ID NO: 666683 - DNA, 25 bp, Rattus norvegicus
acatcttccgcgtgctgctgcaggt

SEQ ID NO: 666684 - DNA, 25 bp, Rattus norvegicus
ctttcggaaccatggccgcagtggc

SEQ ID NO: 666685 - DNA, 25 bp, Rattus norvegicus
atccatagacctcggcgaacccttg

SEQ ID NO: 666686 - DNA, 25 bp, Rattus norvegicus
ccagcagcggactccgagatccata

SEQ ID NO: 666687 - DNA, 25 bp, Rattus norvegicus
cactaaggtggcaggagggtactta

SEQ ID NO: 666688 - DNA, 25 bp, Rattus norvegicus
gcaggtgagtatatacccgggcttt

SEQ ID NO: 666689 - DNA, 25 bp, Rattus norvegicus
aggccaagcagcgcctaaggtgacc

SEQ ID NO: 666690 - DNA, 25 bp, Rattus norvegicus
cgctgaccttggaggccagagtgac

SEQ ID NO: 666691 - DNA, 25 bp, Rattus norvegicus
aggccagagtgacagctaggaaccc

SEQ ID NO: 666692 - DNA, 25 bp, Rattus norvegicus
cgccagacaagggtgagtccgtacc

SEQ ID NO: 666693 - DNA, 25 bp, Rattus norvegicus
agggctaacatggcggcgcaaccgc

SEQ ID NO: 666694 - DNA, 25 bp, Rattus norvegicus
gagtgcctctcaccctgcccaggcg

SEQ ID NO: 666695 - DNA, 25 bp, Rattus norvegicus
ggcgacgctacgatacctgcgagcc

SEQ ID NO: 666696 - DNA, 25 bp, Rattus norvegicus
tgccggcctccaccttagctcgcca

SEQ ID NO: 666697 - DNA, 25 bp, Rattus norvegicus
cccttcgtcttctagtgaagcggtc

SEQ ID NO: 666698 - DNA, 25 bp, Rattus norvegicus
tcttctagtgaagcggtccaaggac

SEQ ID NO: 666699 - DNA, 25 bp, Rattus norvegicus
ccgtccaaaattgggctgtccgccg

SEQ ID NO: 666700 - DNA, 25 bp, Rattus norvegicus
ccaaaattgggctgtccgccgcgga

SEQ ID NO: 666701 - DNA, 25 bp, Rattus norvegicus
gcccaggcgggcgacgctacgatac

SEQ ID NO: 666702 - DNA, 25 bp, Rattus norvegicus
ggggaggtcacctgacgccagacaa

SEQ ID NO: 666703 - DNA, 25 bp, Rattus norvegicus
gcagcctgaccgctacatcaaaagg

SEQ ID NO: 666704 - DNA, 25 bp, Rattus norvegicus
atcgtatacggcgagaatggccctg

SEQ ID NO: 666705 - DNA, 25 bp, Rattus norvegicus
tgctcgttagtcaaggtatccgtcg

SEQ ID NO: 666706 - DNA, 25 bp, Rattus norvegicus
gcttgtttgctgtgctcgttagtca

SEQ ID NO: 666707 - DNA, 25 bp, Rattus norvegicus
tgcggcatctgcgagcttgtttgct

SEQ ID NO: 666708 - DNA, 25 bp, Rattus norvegicus
gaatggccctggagacggtgccaaa

SEQ ID NO: 666709 - DNA, 25 bp, Rattus norvegicus
gccgtggaacccgtattatcgtata

SEQ ID NO: 666710 - DNA, 25 bp, Rattus norvegicus
aatctgtttacttcctgtggccgtg

SEQ ID NO: 666711 - DNA, 25 bp, Rattus norvegicus
gcgaccggcattctgggtaataatc

SEQ ID NO: 666712 - DNA, 25 bp, Rattus norvegicus
cctgcgaatgtctgtaccggaaacg

SEQ ID NO: 666713 - DNA, 25 bp, Rattus norvegicus
cgctcctgcgggagaaaccatcttc

SEQ ID NO: 666714 - DNA, 25 bp, Rattus norvegicus
tagcgctgcgtagttccgcaagccg

SEQ ID NO: 666715 - DNA, 25 bp, Rattus norvegicus
caaaaggcccgcgtagcgctgcgta

SEQ ID NO: 666716 - DNA, 25 bp, Rattus norvegicus
cggtgccaaaggacctgcggcatct

SEQ ID NO: 666717 - DNA, 25 bp, Rattus norvegicus
cgtgggcgaacttttaagctaccag

SEQ ID NO: 666718 - DNA, 25 bp, Rattus norvegicus
ttacggcagcgctttcttttacggc

SEQ ID NO: 666719 - DNA, 25 bp, Rattus norvegicus
tcttttacggcagtgtggcgagagc

SEQ ID NO: 666720 - DNA, 25 bp, Rattus norvegicus
cggccacgcgctcttttactctatt

SEQ ID NO: 666721 - DNA, 25 bp, Rattus norvegicus
ctctattggttctgaggcctggcgc

SEQ ID NO: 666722 - DNA, 25 bp, Rattus norvegicus
cctggcgctttacggcagtgtggca

SEQ ID NO: 666723 - DNA, 25 bp, Rattus norvegicus
ggcagtgtggcaggaaaagcctcta

SEQ ID NO: 666724 - DNA, 25 bp, Rattus norvegicus
aggaaaagcctctaagcggcccgtg

SEQ ID NO: 666725 - DNA, 25 bp, Rattus norvegicus
aggcaaccagggtacactgtgctga

SEQ ID NO: 666726 - DNA, 25 bp, Rattus norvegicus
tccggaaccatggacgtgggcgaac

SEQ ID NO: 666727 - DNA, 25 bp, Rattus norvegicus
agctaccaggtaggtgcagttggca

SEQ ID NO: 666728 - DNA, 25 bp, Rattus norvegicus
ggccggagagctcctcatcctcgtt

SEQ ID NO: 666729 - DNA, 25 bp, Rattus norvegicus
ctcatcctcgttggcgtcgcaagga

SEQ ID NO: 666730 - DNA, 25 bp, Rattus norvegicus
actgtgctgattgggtccggaacca

SEQ ID NO: 666731 - DNA, 25 bp, Rattus norvegicus
acgtctccggacacggtgagttcgc

SEQ ID NO: 666732 - DNA, 25 bp, Rattus norvegicus
tcccagcctgggcaaaactttgatg

SEQ ID NO: 666733 - DNA, 25 bp, Rattus norvegicus
tggtgctcgaacctgcgccgactga

SEQ ID NO: 666734 - DNA, 25 bp, Rattus norvegicus
gaccagttgcgagtaccgctttaaa

SEQ ID NO: 666735 - DNA, 25 bp, Rattus norvegicus
tgataaatcaagctgcggatccctc

SEQ ID NO: 666736 - DNA, 25 bp, Rattus norvegicus
tggccttccgcgcaagcgaagagtc

SEQ ID NO: 666737 - DNA, 25 bp, Rattus norvegicus
tggcacttttcctgcaactcggcgg

SEQ ID NO: 666738 - DNA, 25 bp, Rattus norvegicus
tgggacaaccacgtctccggacacg

SEQ ID NO: 666739 - DNA, 25 bp, Rattus norvegicus
ccgctccaacttggcggtcgtggtg

SEQ ID NO: 666740 - DNA, 25 bp, Rattus norvegicus
ggatacacacacctctgcgaccata

SEQ ID NO: 666741 - DNA, 25 bp, Rattus norvegicus
tgcgaccatacagatgtctccagcc

SEQ ID NO: 666742 - DNA, 25 bp, Rattus norvegicus
acagatgtctccagccgcggacaca

SEQ ID NO: 666743 - DNA, 25 bp, Rattus norvegicus
gcgcgaactcgctcacgcggataca

SEQ ID NO: 666744 - DNA, 25 bp, Rattus norvegicus
ctcccgcgcgggagaccagttgcga

SEQ ID NO: 666745 - DNA, 25 bp, Rattus norvegicus
aggcacctacgagtgccgcgtgatc

SEQ ID NO: 666746 - DNA, 25 bp, Rattus norvegicus
tcccgcgtgtgctttgcttgcttat

SEQ ID NO: 666747 - DNA, 25 bp, Rattus norvegicus
tctgcccgaggcctgcagcctgtag

SEQ ID NO: 666748 - DNA, 25 bp, Rattus norvegicus
cctacctgcgagtgcagcccgggga

SEQ ID NO: 666749 - DNA, 25 bp, Rattus norvegicus
gtcaaagcctacctgcgagtgcagc

SEQ ID NO: 666750 - DNA, 25 bp, Rattus norvegicus
gcaccacaaggtcaaagcctacctg

SEQ ID NO: 666751 - DNA, 25 bp, Rattus norvegicus
gcaaggcccggcaccacaaggtcaa

SEQ ID NO: 666752 - DNA, 25 bp, Rattus norvegicus
aggtggtgggcagcaacatctccca

SEQ ID NO: 666753 - DNA, 25 bp, Rattus norvegicus
atcgacttcagcgacggcaaggccc

SEQ ID NO: 666754 - DNA, 25 bp, Rattus norvegicus
agtgccgcgtgatcgacttcagcga

SEQ ID NO: 666755 - DNA, 25 bp, Rattus norvegicus
tgaagcccacggacgaaggcaccta

SEQ ID NO: 666756 - DNA, 25 bp, Rattus norvegicus
gggcagcaacatctcccacaagctt

SEQ ID NO: 666757 - DNA, 25 bp, Rattus norvegicus
tcccacaagcttcggctgtcgcggg

SEQ ID NO: 666758 - DNA, 25 bp, Rattus norvegicus
gatcgcttctcacggtgcctctgtc

SEQ ID NO: 666759 - DNA, 25 bp, Rattus norvegicus
attatatgtatgtccgagcgccttc

SEQ ID NO: 666760 - DNA, 25 bp, Rattus norvegicus
agcgctcgcatcctcttaaaatgga

SEQ ID NO: 666761 - DNA, 25 bp, Rattus norvegicus
gcagcgctcgcatcctcttaaaatg

SEQ ID NO: 666762 - DNA, 25 bp, Rattus norvegicus
taacttctacggcagcgctcgcatc

SEQ ID NO: 666763 - DNA, 25 bp, Rattus norvegicus
ttgattcgcgaaccgcatgccctgg

SEQ ID NO: 666764 - DNA, 25 bp, Rattus norvegicus
cgtgcgcgtcgacctattatatgta

SEQ ID NO: 666765 - DNA, 25 bp, Rattus norvegicus
cctgcgtatacgtatgtggttgatt

SEQ ID NO: 666766 - DNA, 25 bp, Rattus norvegicus
cgcgtcgacctattatatgtatgtc

SEQ ID NO: 666767 - DNA, 25 bp, Rattus norvegicus
atactgtctacaggcctggcggctg

SEQ ID NO: 666768 - DNA, 25 bp, Rattus norvegicus
tacgtatgtggttgattcgcgaacc

SEQ ID NO: 666769 - DNA, 25 bp, Rattus norvegicus
aggctcacgcaatactgtctacagg

SEQ ID NO: 666770 - DNA, 25 bp, Rattus norvegicus
tggggtgcacatttgcgcccactcc

SEQ ID NO: 666771 - DNA, 25 bp, Rattus norvegicus
cctcttaaaatggaaaggctcacgc

SEQ ID NO: 666772 - DNA, 25 bp, Rattus norvegicus
atggaaaggctcacgcaatactgtc

SEQ ID NO: 666773 - DNA, 25 bp, Rattus norvegicus
gcagcgccggcgaggccttcatcat

SEQ ID NO: 666774 - DNA, 25 bp, Rattus norvegicus
catccgctccgatgagttgtagctc

SEQ ID NO: 666775 - DNA, 25 bp, Rattus norvegicus
ccacgtcatccgctccgatgagttg

SEQ ID NO: 666776 - DNA, 25 bp, Rattus norvegicus
tacgcctggaacaacggccatcaga

SEQ ID NO: 666777 - DNA, 25 bp, Rattus norvegicus
accgcgcgctgtacgcctggaacaa

SEQ ID NO: 666778 - DNA, 25 bp, Rattus norvegicus
acaaccctaaagaccgcgcgctgta

SEQ ID NO: 666779 - DNA, 25 bp, Rattus norvegicus
ccatgctggactacaaccctaaaga

SEQ ID NO: 666780 - DNA, 25 bp, Rattus norvegicus
aatactctcacatctccatgctgga

SEQ ID NO: 666781 - DNA, 25 bp, Rattus norvegicus
cttccagaacaaatactctcacatc

SEQ ID NO: 666782 - DNA, 25 bp, Rattus norvegicus
ggcgaggccttcatcatctgcggca

SEQ ID NO: 666783 - DNA, 25 bp, Rattus norvegicus
gcggcaccctctacgtcaccaacgg

SEQ ID NO: 666784 - DNA, 25 bp, Rattus norvegicus
accaaggtccactatgcctaccaaa

SEQ ID NO: 666785 - DNA, 25 bp, Rattus norvegicus
acgcctcgacctacgagtacattga

SEQ ID NO: 666786 - DNA, 25 bp, Rattus norvegicus
tcgacctacgagtacattgacatcc

SEQ ID NO: 666787 - DNA, 25 bp, Rattus norvegicus
gcttaagcgagccagcagcgacgca

SEQ ID NO: 666788 - DNA, 25 bp, Rattus norvegicus
acgcaggacccatcgtctccgtgtg

SEQ ID NO: 666789 - DNA, 25 bp, Rattus norvegicus
cctaaggattcgcttctggacgctc

SEQ ID NO: 666790 - DNA, 25 bp, Rattus norvegicus
gcctccagcaccctagacggaaatg

SEQ ID NO: 666791 - DNA, 25 bp, Rattus norvegicus
acgaaaaagtagtgcgtcgcgccgc

SEQ ID NO: 666792 - DNA, 25 bp, Rattus norvegicus
ggcgcgagtggttaaagcgcttttc

SEQ ID NO: 666793 - DNA, 25 bp, Rattus norvegicus
agcgcttttcggtgttcgaggacct

SEQ ID NO: 666794 - DNA, 25 bp, Rattus norvegicus
ctggatttgttctctcggcctgttc

SEQ ID NO: 666795 - DNA, 25 bp, Rattus norvegicus
gcctgttcggttcgaagtcctctca

SEQ ID NO: 666796 - DNA, 25 bp, Rattus norvegicus
gtgctgcctcctaagggtcgttttc

SEQ ID NO: 666797 - DNA, 25 bp, Rattus norvegicus
tcctccttctcagagtcggcgttgg

SEQ ID NO: 666798 - DNA, 25 bp, Rattus norvegicus
gtcggcgttggaaaagaagctctca

SEQ ID NO: 666799 - DNA, 25 bp, Rattus norvegicus
tctggacgctcctaaacggctgagc

SEQ ID NO: 666800 - DNA, 25 bp, Rattus norvegicus
ctcagcagagtgtgcagaccctatc

SEQ ID NO: 666801 - DNA, 25 bp, Rattus norvegicus
cctgctggacacagggcgacctcgg

SEQ ID NO: 666802 - DNA, 25 bp, Rattus norvegicus
tcgcggcgcgaacttatagcccagg

SEQ ID NO: 666803 - DNA, 25 bp, Rattus norvegicus
acagctcggacgcagcgggacactc

SEQ ID NO: 666804 - DNA, 25 bp, Rattus norvegicus
caagctagcggcgacagctcggacg

SEQ ID NO: 666805 - DNA, 25 bp, Rattus norvegicus
tcggccatggccaagctagcggcga

SEQ ID NO: 666806 - DNA, 25 bp, Rattus norvegicus
gctcaggcactcaccctcggccatg

SEQ ID NO: 666807 - DNA, 25 bp, Rattus norvegicus
cactcgggcgcggatcaccagtgcg

SEQ ID NO: 666808 - DNA, 25 bp, Rattus norvegicus
ccaaggccaccgaacatgagacgcg

SEQ ID NO: 666809 - DNA, 25 bp, Rattus norvegicus
cagatcagaccaaggccaccgaaca

SEQ ID NO: 666810 - DNA, 25 bp, Rattus norvegicus
gcgtgcgatgaacacccagatcaga

SEQ ID NO: 666811 - DNA, 25 bp, Rattus norvegicus
catctggagcgtgcgatgaacaccc

SEQ ID NO: 666812 - DNA, 25 bp, Rattus norvegicus
ggcgacctcggaacagacatctgga

SEQ ID NO: 666813 - DNA, 25 bp, Rattus norvegicus
acttatagcccagggcgaccgggcg

SEQ ID NO: 666814 - DNA, 25 bp, Rattus norvegicus
ctcggaacagacatctggagcgtgc

SEQ ID NO: 666815 - DNA, 25 bp, Rattus norvegicus
ctagcttctttggagagagtgcgga

SEQ ID NO: 666816 - DNA, 25 bp, Rattus norvegicus
acccagactgaggaggcgaaaggga

SEQ ID NO: 666817 - DNA, 25 bp, Rattus norvegicus
gagcggggaactcccaactcagcct

SEQ ID NO: 666818 - DNA, 25 bp, Rattus norvegicus
ggaactgtctaacgctgcccagcgc

SEQ ID NO: 666819 - DNA, 25 bp, Rattus norvegicus
ggccaccggaactgtctaacgctgc

SEQ ID NO: 666820 - DNA, 25 bp, Rattus norvegicus
ccgaggccaccggaactgtctaacg

SEQ ID NO: 666821 - DNA, 25 bp, Rattus norvegicus
ggccctttgtgcgacgcctcgccct

SEQ ID NO: 666822 - DNA, 25 bp, Rattus norvegicus
agcctcctcccgaggggcagccaga

SEQ ID NO: 666823 - DNA, 25 bp, Rattus norvegicus
agcgcgagcggggaactcccaactc

SEQ ID NO: 666824 - DNA, 25 bp, Rattus norvegicus
ctctggctctcctagcttctttgga

SEQ ID NO: 666825 - DNA, 25 bp, Rattus norvegicus
gcgaagctctggctctcctagcttc

SEQ ID NO: 666826 - DNA, 25 bp, Rattus norvegicus
ggcagtctctgtcccgcgaagctct

SEQ ID NO: 666827 - DNA, 25 bp, Rattus norvegicus
ctggcagtctctgtcccgcgaagct

SEQ ID NO: 666828 - DNA, 25 bp, Rattus norvegicus
tgacaggagcccgacgttcagccca

SEQ ID NO: 666829 - DNA, 25 bp, Rattus norvegicus
agacacggctttggggctctagata

SEQ ID NO: 666830 - DNA, 25 bp, Rattus norvegicus
cgacagcctagagcagcatctccga

SEQ ID NO: 666831 - DNA, 25 bp, Rattus norvegicus
tactaatgataaagcgcccgacagc

SEQ ID NO: 666832 - DNA, 25 bp, Rattus norvegicus
gcgccggcggaagtactaatgataa

SEQ ID NO: 666833 - DNA, 25 bp, Rattus norvegicus
gaaacttctcacgatgggcgccggc

SEQ ID NO: 666834 - DNA, 25 bp, Rattus norvegicus
aggaaacatccacgccacaggaaac

SEQ ID NO: 666835 - DNA, 25 bp, Rattus norvegicus
tggcactgaccggagaggaaacatc

SEQ ID NO: 666836 - DNA, 25 bp, Rattus norvegicus
tagatttgggtggatggcactgacc

SEQ ID NO: 666837 - DNA, 25 bp, Rattus norvegicus
acacgcgggatgtcaatagatttgg

SEQ ID NO: 666838 - DNA, 25 bp, Rattus norvegicus
gtcgagcagacagcccggaacacgc

SEQ ID NO: 666839 - DNA, 25 bp, Rattus norvegicus
aaaagcacactacttgaggccctcc

SEQ ID NO: 666840 - DNA, 25 bp, Rattus norvegicus
gctttggggctctagatactcagga

SEQ ID NO: 666841 - DNA, 25 bp, Rattus norvegicus
tttgtaggcgaaagacacggctttg

SEQ ID NO: 666842 - DNA, 25 bp, Rattus norvegicus
tactcaggaggcgaaaagcacacta

SEQ ID NO: 666843 - DNA, 25 bp, Rattus norvegicus
catctgatgggttcgagctgagctt

SEQ ID NO: 666844 - DNA, 25 bp, Rattus norvegicus
tggcgcggtaagcatttcagttcta

SEQ ID NO: 666845 - DNA, 25 bp, Rattus norvegicus
acactgcggtgttcgagaagggtct

SEQ ID NO: 666846 - DNA, 25 bp, Rattus norvegicus
acgcccactgtctgcgcaaaggtga

SEQ ID NO: 666847 - DNA, 25 bp, Rattus norvegicus
cttctggagtacacgaaaggagata

SEQ ID NO: 666848 - DNA, 25 bp, Rattus norvegicus
atcgctggtaggctgcgacatctga

SEQ ID NO: 666849 - DNA, 25 bp, Rattus norvegicus
aagggtcttgcgcagtcctgcactg

SEQ ID NO: 666850 - DNA, 25 bp, Rattus norvegicus
ttccacctcagcctgctaggcgagt

SEQ ID NO: 666851 - DNA, 25 bp, Rattus norvegicus
taggcgagtcacctcggctctgcgc

SEQ ID NO: 666852 - DNA, 25 bp, Rattus norvegicus
ggcctccaagtcacctttaatcatg

SEQ ID NO: 666853 - DNA, 25 bp, Rattus norvegicus
ctttaatcatgaaaacccaggagcc

SEQ ID NO: 666854 - DNA, 25 bp, Rattus norvegicus
aggacgcgggcttgatcctcccaca

SEQ ID NO: 666855 - DNA, 25 bp, Rattus norvegicus
acctgcgagctatggatcttctgga

SEQ ID NO: 666856 - DNA, 25 bp, Rattus norvegicus
tcagttctactcctgcaggggacgc

SEQ ID NO: 666857 - DNA, 25 bp, Rattus norvegicus
cctgccgtgtcgaaagtggtacagc

SEQ ID NO: 666858 - DNA, 25 bp, Rattus norvegicus
cggctgcagaggcaaatcgccctgc

SEQ ID NO: 666859 - DNA, 25 bp, Rattus norvegicus
gaggatgcgcactttcccgcgtaga

SEQ ID NO: 666860 - DNA, 25 bp, Rattus norvegicus
cccgcgtagagaacgggacttgctg

SEQ ID NO: 666861 - DNA, 25 bp, Rattus norvegicus
agctgggactgactcgactcctggt

SEQ ID NO: 666862 - DNA, 25 bp, Rattus norvegicus
cccagtggctgcatatgcgggactt

SEQ ID NO: 666863 - DNA, 25 bp, Rattus norvegicus
atatgcgggacttcgaccggttgct

SEQ ID NO: 666864 - DNA, 25 bp, Rattus norvegicus
aatcgccctgcgcaaccagcgggag

SEQ ID NO: 666865 - DNA, 25 bp, Rattus norvegicus
cctgccagatactcggatggagacc

SEQ ID NO: 666866 - DNA, 25 bp, Rattus norvegicus
gtgacacgcacgctttctcagggtc

SEQ ID NO: 666867 - DNA, 25 bp, Rattus norvegicus
ctttctcagggtcgagggagacttc

SEQ ID NO: 666868 - DNA, 25 bp, Rattus norvegicus
ttgtcccaagcctcccgtgctggta

SEQ ID NO: 666869 - DNA, 25 bp, Rattus norvegicus
gcaaatccctggttgccctggcagc

SEQ ID NO: 666870 - DNA, 25 bp, Rattus norvegicus
agggagacttcctgactagagaaca

SEQ ID NO: 666871 - DNA, 25 bp, Rattus norvegicus
gctccaggcttcgagatttatttga

SEQ ID NO: 666872 - DNA, 25 bp, Rattus norvegicus
cttctgccgggtgtgagcgaaccca

SEQ ID NO: 666873 - DNA, 25 bp, Rattus norvegicus
attcctgggctctgaagtggacgca

SEQ ID NO: 666874 - DNA, 25 bp, Rattus norvegicus
caaatccggggagaatgcggtccac

SEQ ID NO: 666875 - DNA, 25 bp, Rattus norvegicus
tcactgacgggtggaaggactgacc

SEQ ID NO: 666876 - DNA, 25 bp, Rattus norvegicus
tgggcgccctgtgagagtcactgac

SEQ ID NO: 666877 - DNA, 25 bp, Rattus norvegicus
ttgcttgaacggagctcagccggcc

SEQ ID NO: 666878 - DNA, 25 bp, Rattus norvegicus
ccctggcagtcggaagttgcttgaa

SEQ ID NO: 666879 - DNA, 25 bp, Rattus norvegicus
tggggaattatttgacgccaccgcc

SEQ ID NO: 666880 - DNA, 25 bp, Rattus norvegicus
cagtggtcccttcggctggggaatt

SEQ ID NO: 666881 - DNA, 25 bp, Rattus norvegicus
tgacgctgtccactcggttccatca

SEQ ID NO: 666882 - DNA, 25 bp, Rattus norvegicus
cgatgtgggtaatcgcgcttcgcgc

SEQ ID NO: 666883 - DNA, 25 bp, Rattus norvegicus
ggtctggagtggtgaccgcaaatcc

SEQ ID NO: 666884 - DNA, 25 bp, Rattus norvegicus
cggttccatcagaagtctcgggtca

SEQ ID NO: 666885 - DNA, 25 bp, Rattus norvegicus
caggtgcttccaggttttgggcaaa

SEQ ID NO: 666886 - DNA, 25 bp, Rattus norvegicus
ttaggcgtcgttcagggactttatc

SEQ ID NO: 666887 - DNA, 25 bp, Rattus norvegicus
tggcgactcgggcagtgaattagaa

SEQ ID NO: 666888 - DNA, 25 bp, Rattus norvegicus
cgggcagtgaattagaatgcagttc

SEQ ID NO: 666889 - DNA, 25 bp, Rattus norvegicus
ttagaatgcagttccacatggtgcc

SEQ ID NO: 666890 - DNA, 25 bp, Rattus norvegicus
atgcagttccacatggtgccgctgg

SEQ ID NO: 666891 - DNA, 25 bp, Rattus norvegicus
agcctggcaggtgcttccaggtttt

SEQ ID NO: 666892 - DNA, 25 bp, Rattus norvegicus
gttcagggactttatccgcgcaccg

SEQ ID NO: 666893 - DNA, 25 bp, Rattus norvegicus
ccaggttttgggcaaacgatactca

SEQ ID NO: 666894 - DNA, 25 bp, Rattus norvegicus
ctcaaggacgtctttctttctcgtc

SEQ ID NO: 666895 - DNA, 25 bp, Rattus norvegicus
cctcgtccctcgtccttagagagta

SEQ ID NO: 666896 - DNA, 25 bp, Rattus norvegicus
cttagagagtacaaggatgagtgca

SEQ ID NO: 666897 - DNA, 25 bp, Rattus norvegicus
atgagtgcaagggaaccttttaggc

SEQ ID NO: 666898 - DNA, 25 bp, Rattus norvegicus
tgggcaaacgatactcaaggacgtc

SEQ ID NO: 666899 - DNA, 25 bp, Rattus norvegicus
acattcattatcagcgcggcggcgc

SEQ ID NO: 666900 - DNA, 25 bp, Rattus norvegicus
tctgtcgcacttccgaaaccttctg

SEQ ID NO: 666901 - DNA, 25 bp, Rattus norvegicus
cccgtcgagggagacattcattatc

SEQ ID NO: 666902 - DNA, 25 bp, Rattus norvegicus
tcctgaaatcggaaggcgagccctg

SEQ ID NO: 666903 - DNA, 25 bp, Rattus norvegicus
tctcgactttgagcaccgccagggc

SEQ ID NO: 666904 - DNA, 25 bp, Rattus norvegicus
gcgcactgcgacgatctcgactttg

SEQ ID NO: 666905 - DNA, 25 bp, Rattus norvegicus
tccaacaagtcccaggccaaggtga

SEQ ID NO: 666906 - DNA, 25 bp, Rattus norvegicus
gtggccacctctgtgtccaacaagt

SEQ ID NO: 666907 - DNA, 25 bp, Rattus norvegicus
cgcagcaagctgaccaacgtggcca

SEQ ID NO: 666908 - DNA, 25 bp, Rattus norvegicus
agatagcggcccttgctgccttgac

SEQ ID NO: 666909 - DNA, 25 bp, Rattus norvegicus
agacttctttgacccgggccagcct

SEQ ID NO: 666910 - DNA, 25 bp, Rattus norvegicus
ggtcccaccgagagccagacttctt

SEQ ID NO: 666911 - DNA, 25 bp, Rattus norvegicus
cgccagcttcgcgtagctgttctga

SEQ ID NO: 666912 - DNA, 25 bp, Rattus norvegicus
ggctggaacgtgacaaacgccattc

SEQ ID NO: 666913 - DNA, 25 bp, Rattus norvegicus
ctcaaggccgtgtccaagttcagtc

SEQ ID NO: 666914 - DNA, 25 bp, Rattus norvegicus
gtatgtggccatagctaacgcgtgc

SEQ ID NO: 666915 - DNA, 25 bp, Rattus norvegicus
cgtggtcaatgtggcccagatcatc

SEQ ID NO: 666916 - DNA, 25 bp, Rattus norvegicus
gcggcaacctcatgtacaacagttt

SEQ ID NO: 666917 - DNA, 25 bp, Rattus norvegicus
gctgccctgcgccttcctgaagaat

SEQ ID NO: 666918 - DNA, 25 bp, Rattus norvegicus
tctcttccaggaaggcagtcgtgcc

SEQ ID NO: 666919 - DNA, 25 bp, Rattus norvegicus
ctggtccatcatagccacggcggtg

SEQ ID NO: 666920 - DNA, 25 bp, Rattus norvegicus
ccatcggcatcatcgtgttcagcta

SEQ ID NO: 666921 - DNA, 25 bp, Rattus norvegicus
ggtcttcacgctgctcatggccatc

SEQ ID NO: 666922 - DNA, 25 bp, Rattus norvegicus
ccgtcgaagtgctggagaagtctct

SEQ ID NO: 666923 - DNA, 25 bp, Rattus norvegicus
cgccgtggtcaacatcttcctggtg

SEQ ID NO: 666924 - DNA, 25 bp, Rattus norvegicus
tgcagcagcccagcgaattccactg

SEQ ID NO: 666925 - DNA, 25 bp, Rattus norvegicus
gttcagctacacgtcgcagatcttc

SEQ ID NO: 666926 - DNA, 25 bp, Rattus norvegicus
ccaggtcttcttcgatgtggccatc

SEQ ID NO: 666927 - DNA, 25 bp, Rattus norvegicus
gtgcctctggtgctggacaacggat

SEQ ID NO: 666928 - DNA, 25 bp, Rattus norvegicus
acctcggcgtctcctcgcaggtgag

SEQ ID NO: 666929 - DNA, 25 bp, Rattus norvegicus
cttccgggccctgagactcagtcgg

SEQ ID NO: 666930 - DNA, 25 bp, Rattus norvegicus
cgggaccggctctagccaagatgga

SEQ ID NO: 666931 - DNA, 25 bp, Rattus norvegicus
agccaagatggaggcgaacgtgttc

SEQ ID NO: 666932 - DNA, 25 bp, Rattus norvegicus
gaacgtgttccggttccgagatgcc

SEQ ID NO: 666933 - DNA, 25 bp, Rattus norvegicus
atccggtactggaagccgggccagt

SEQ ID NO: 666934 - DNA, 25 bp, Rattus norvegicus
aacggatcgttccaggctcgggccg

SEQ ID NO: 666935 - DNA, 25 bp, Rattus norvegicus
gaagcctcgagcctctgcgctggat

SEQ ID NO: 666936 - DNA, 25 bp, Rattus norvegicus
ccttcgaccgcaatgtgcctgtcaa

SEQ ID NO: 666937 - DNA, 25 bp, Rattus norvegicus
tgtgcctgtcaacctggaactgcag

SEQ ID NO: 666938 - DNA, 25 bp, Rattus norvegicus
gaactgctgctggactacagcttcc

SEQ ID NO: 666939 - DNA, 25 bp, Rattus norvegicus
tggactacagcttccagcacctcgg

SEQ ID NO: 666940 - DNA, 25 bp, Rattus norvegicus
gctctgctccggatccggtactgga

SEQ ID NO: 666941 - DNA, 25 bp, Rattus norvegicus
cgcaataaatcatcgcggggtaatt

SEQ ID NO: 666942 - DNA, 25 bp, Rattus norvegicus
gctcacttcccgttcccactgccga

SEQ ID NO: 666943 - DNA, 25 bp, Rattus norvegicus
aggatccgcccgctaatcaccactc

SEQ ID NO: 666944 - DNA, 25 bp, Rattus norvegicus
ccgctccacgttcctaattaaatct

SEQ ID NO: 666945 - DNA, 25 bp, Rattus norvegicus
cgttcctaattaaatctccttcctg

SEQ ID NO: 666946 - DNA, 25 bp, Rattus norvegicus
gtttacccacttacaggatcctctg

SEQ ID NO: 666947 - DNA, 25 bp, Rattus norvegicus
ccacttacaggatcctctgcgagga

SEQ ID NO: 666948 - DNA, 25 bp, Rattus norvegicus
tacaggatcctctgcgaggatggga

SEQ ID NO: 666949 - DNA, 25 bp, Rattus norvegicus
gctgccggggaaagcaaccgcaata

SEQ ID NO: 666950 - DNA, 25 bp, Rattus norvegicus
cggggaaagcaaccgcaataaatca

SEQ ID NO: 666951 - DNA, 25 bp, Rattus norvegicus
atcatcgcggggtaattttcagggg

SEQ ID NO: 666952 - DNA, 25 bp, Rattus norvegicus
tcgcagtttcacgtggcgcgctcac

SEQ ID NO: 666953 - DNA, 25 bp, Rattus norvegicus
gcagtttcacgtggcgcgctcactt

SEQ ID NO: 666954 - DNA, 25 bp, Rattus norvegicus
aattttcaggggtcgcagtttcacg

SEQ ID NO: 666955 - DNA, 25 bp, Rattus norvegicus
ccctagagcctgtgggtcggtctcg

SEQ ID NO: 666956 - DNA, 25 bp, Rattus norvegicus
gagtggcgccgcattcctctctgca

SEQ ID NO: 666957 - DNA, 25 bp, Rattus norvegicus
acaaacctgacccagggcgggatct

SEQ ID NO: 666958 - DNA, 25 bp, Rattus norvegicus
ctggtgtccctgtggacaaacctga

SEQ ID NO: 666959 - DNA, 25 bp, Rattus norvegicus
tacagaacaccagacgccctgggca

SEQ ID NO: 666960 - DNA, 25 bp, Rattus norvegicus
ctgggtggtgaagctacagaacacc

SEQ ID NO: 666961 - DNA, 25 bp, Rattus norvegicus
ctgtctgccagggttacaaggctgg

SEQ ID NO: 666962 - DNA, 25 bp, Rattus norvegicus
ggtctgtctgggctactgtctgcca

SEQ ID NO: 666963 - DNA, 25 bp, Rattus norvegicus
ccagggctgcaatgagtggattttg

SEQ ID NO: 666964 - DNA, 25 bp, Rattus norvegicus
cattggcaggttgtcgaccagggct

SEQ ID NO: 666965 - DNA, 25 bp, Rattus norvegicus
cccacgtctcgccttcggatgggga

SEQ ID NO: 666966 - DNA, 25 bp, Rattus norvegicus
gagttgggccactgtctcccacgtc

SEQ ID NO: 666967 - DNA, 25 bp, Rattus norvegicus
ccaagggagggtggcttaagataat

SEQ ID NO: 666968 - DNA, 25 bp, Rattus norvegicus
tctctgcactctgcggatccggcag

SEQ ID NO: 666969 - DNA, 25 bp, Rattus norvegicus
tccaggctatctgaggaaggagctg

SEQ ID NO: 666970 - DNA, 25 bp, Rattus norvegicus
gcttagaacggaaagccgatgcttg

SEQ ID NO: 666971 - DNA, 25 bp, Rattus norvegicus
gagcccaatagtgccaggcgctgtt

SEQ ID NO: 666972 - DNA, 25 bp, Rattus norvegicus
tggaagacccggagcccaatagtgc

SEQ ID NO: 666973 - DNA, 25 bp, Rattus norvegicus
ctctgtggaagacccggagcccaat

SEQ ID NO: 666974 - DNA, 25 bp, Rattus norvegicus
cggcctgtgaatcgccctctgtgga

SEQ ID NO: 666975 - DNA, 25 bp, Rattus norvegicus
accaggtgcggcctgtgaatcgccc

SEQ ID NO: 666976 - DNA, 25 bp, Rattus norvegicus
ttcttgctgtcagaggcgcccacca

SEQ ID NO: 666977 - DNA, 25 bp, Rattus norvegicus
aagggctcctgttcttgctgtcaga

SEQ ID NO: 666978 - DNA, 25 bp, Rattus norvegicus
ttacactgctcataaagggctcctg

SEQ ID NO: 666979 - DNA, 25 bp, Rattus norvegicus
cgcccatgtgattacactgctcata

SEQ ID NO: 666980 - DNA, 25 bp, Rattus norvegicus
caggcgctgtttccctccaggctat

SEQ ID NO: 666981 - DNA, 25 bp, Rattus norvegicus
ggaaagccgatgcttgcgcgcccat

SEQ ID NO: 666982 - DNA, 25 bp, Rattus norvegicus
gcttgcgcgcccatgtgattacact

SEQ ID NO: 666983 - DNA, 25 bp, Rattus norvegicus
ggccttgcgtctgcggattttgctt

SEQ ID NO: 666984 - DNA, 25 bp, Rattus norvegicus
gccatggttgcctcctgtacaggag

SEQ ID NO: 666985 - DNA, 25 bp, Rattus norvegicus
cgccatggttgcctcctgtacagga

SEQ ID NO: 666986 - DNA, 25 bp, Rattus norvegicus
ggcgccatggttgcctcctgtacag

SEQ ID NO: 666987 - DNA, 25 bp, Rattus norvegicus
ctgggcgccatggttgcctcctgta

SEQ ID NO: 666988 - DNA, 25 bp, Rattus norvegicus
ttgcttgcccgctggttgaaccacg

SEQ ID NO: 666989 - DNA, 25 bp, Rattus norvegicus
tttgcttgcccgctggttgaaccac

SEQ ID NO: 666990 - DNA, 25 bp, Rattus norvegicus
cggattttgcttgcccgctggttga

SEQ ID NO: 666991 - DNA, 25 bp, Rattus norvegicus
tgcggattttgcttgcccgctggtt

SEQ ID NO: 666992 - DNA, 25 bp, Rattus norvegicus
tctgcggattttgcttgcccgctgg

SEQ ID NO: 666993 - DNA, 25 bp, Rattus norvegicus
cgtctgcggattttgcttgcccgct

SEQ ID NO: 666994 - DNA, 25 bp, Rattus norvegicus
cttgcgtctgcggattttgcttgcc

SEQ ID NO: 666995 - DNA, 25 bp, Rattus norvegicus
cctgctgggccttgcgtctgcggat

SEQ ID NO: 666996 - DNA, 25 bp, Rattus norvegicus
tgcgtctgcggattttgcttgcccg

SEQ ID NO: 666997 - DNA, 25 bp, Rattus norvegicus
ccaccgcagccaagtggatcggttc

SEQ ID NO: 666998 - DNA, 25 bp, Rattus norvegicus
tataaaaatctcaggcgaccaccgc

SEQ ID NO: 666999 - DNA, 25 bp, Rattus norvegicus
atcggttctgggcaccgccatggct

SEQ ID NO: 667000 - DNA, 25 bp, Rattus norvegicus
ttccggagcagtcggacctggaacc

SEQ ID NO: 667001 - DNA, 25 bp, Rattus norvegicus
gctgcgagttgttagacgaccttcc

SEQ ID NO: 667002 - DNA, 25 bp, Rattus norvegicus
ctgggatgccttcttacggcgcgag

SEQ ID NO: 667003 - DNA, 25 bp, Rattus norvegicus
acaccgacgaggtgcgtgaggttct

SEQ ID NO: 667004 - DNA, 25 bp, Rattus norvegicus
caatagcgcgggctggtttgattca

SEQ ID NO: 667005 - DNA, 25 bp, Rattus norvegicus
cgtcgggcacctactttccggagca

SEQ ID NO: 667006 - DNA, 25 bp, Rattus norvegicus
gacctggaacctccggcgttggagc

SEQ ID NO: 667007 - DNA, 25 bp, Rattus norvegicus
gccacgcgtgtcgaggctcatttcc

SEQ ID NO: 667008 - DNA, 25 bp, Rattus norvegicus
cccgtacggctgcaaggatgcacta

SEQ ID NO: 667009 - DNA, 25 bp, Rattus norvegicus
caaggatgcactacgccagcagctg

SEQ ID NO: 667010 - DNA, 25 bp, Rattus norvegicus
gttcggatcctctcacgactgctcg

SEQ ID NO: 667011 - DNA, 25 bp, Rattus norvegicus
atcgcaccatggtgggcgcctcata

SEQ ID NO: 667012 - DNA, 25 bp, Rattus norvegicus
tagtcagtgccgatggcgatggcca

SEQ ID NO: 667013 - DNA, 25 bp, Rattus norvegicus
gtacagccagtagtcagtgccgatg

SEQ ID NO: 667014 - DNA, 25 bp, Rattus norvegicus
agatgtgcgcgctggagtacagcca

SEQ ID NO: 667015 - DNA, 25 bp, Rattus norvegicus
tcgtccatggtcaggttggtgccgt

SEQ ID NO: 667016 - DNA, 25 bp, Rattus norvegicus
acccgccacagtcccgaatgggtga

SEQ ID NO: 667017 - DNA, 25 bp, Rattus norvegicus
caggggtcgtaccttcgatgcaaca

SEQ ID NO: 667018 - DNA, 25 bp, Rattus norvegicus
tttgtgtctcgcgtggagccagcgc

SEQ ID NO: 667019 - DNA, 25 bp, Rattus norvegicus
ctcccgccttcaggttctttgtgtc

SEQ ID NO: 667020 - DNA, 25 bp, Rattus norvegicus
tgctgcacccgtgtccactcgggga

SEQ ID NO: 667021 - DNA, 25 bp, Rattus norvegicus
gtgcgagcctagagtttgtggaatc

SEQ ID NO: 667022 - DNA, 25 bp, Rattus norvegicus
tgtgtttcattgtgtctgtgcgcga

SEQ ID NO: 667023 - DNA, 25 bp, Rattus norvegicus
atcgctccgctttcgggttgcgcgc

SEQ ID NO: 667024 - DNA, 25 bp, Rattus norvegicus
gcgtgagtttctgtgtgtttcattg

SEQ ID NO: 667025 - DNA, 25 bp, Rattus norvegicus
acgtacatagttttgcgcacgcgca

SEQ ID NO: 667026 - DNA, 25 bp, Rattus norvegicus
cctctcctgcgaggccggaaggcgt

SEQ ID NO: 667027 - DNA, 25 bp, Rattus norvegicus
cgctatcaccgcgtacagattatag

SEQ ID NO: 667028 - DNA, 25 bp, Rattus norvegicus
ggaacaccggaaggcgaccctcatc

SEQ ID NO: 667029 - DNA, 25 bp, Rattus norvegicus
tctgccggacgtccctcgatcttga

SEQ ID NO: 667030 - DNA, 25 bp, Rattus norvegicus
gccggaaggcgtctatctgtcagcc

SEQ ID NO: 667031 - DNA, 25 bp, Rattus norvegicus
tctccgttaagaaggtgcggctgca

SEQ ID NO: 667032 - DNA, 25 bp, Rattus norvegicus
ccgcggctctccgttaagaaggtgc

SEQ ID NO: 667033 - DNA, 25 bp, Rattus norvegicus
tcattcttcgctcgcaggcctcagg

SEQ ID NO: 667034 - DNA, 25 bp, Rattus norvegicus
ttcccacgctaggaccacgtacata

SEQ ID NO: 667035 - DNA, 25 bp, Rattus norvegicus
ctagccactgtggaacaccggaagg

SEQ ID NO: 667036 - DNA, 25 bp, Rattus norvegicus
cggaaacgccctagccactgtggaa

SEQ ID NO: 667037 - DNA, 25 bp, Rattus norvegicus
tacagattatagtcctggctcgtgc

SEQ ID NO: 667038 - DNA, 25 bp, Rattus norvegicus
cgtctatctgtcagcctctgccgga

SEQ ID NO: 667039 - DNA, 25 bp, Rattus norvegicus
gagggctgggcaccactcctctgcg

SEQ ID NO: 667040 - DNA, 25 bp, Rattus norvegicus
gccaatatggccgcgcggcatcacg

SEQ ID NO: 667041 - DNA, 25 bp, Rattus norvegicus
atcacgtgggccaaggagaggcact

SEQ ID NO: 667042 - DNA, 25 bp, Rattus norvegicus
gagaggcactcaaagactatccaga

SEQ ID NO: 667043 - DNA, 25 bp, Rattus norvegicus
actatccagagcgagctgtgggtca

SEQ ID NO: 667044 - DNA, 25 bp, Rattus norvegicus
cgagctgtgggtcacgtgatccaca

SEQ ID NO: 667045 - DNA, 25 bp, Rattus norvegicus
acgtgatccacagtgggcggtgtta

SEQ ID NO: 667046 - DNA, 25 bp, Rattus norvegicus
ggcggagtcttcttcgtgacctttc

SEQ ID NO: 667047 - DNA, 25 bp, Rattus norvegicus
gagtcttcttcgtgacctttcaccc

SEQ ID NO: 667048 - DNA, 25 bp, Rattus norvegicus
tgcgcccttgggaccagtgaaattc

SEQ ID NO: 667049 - DNA, 25 bp, Rattus norvegicus
tgggaccagtgaaattctggaaacc

SEQ ID NO: 667050 - DNA, 25 bp, Rattus norvegicus
tctggaaacccggtaaggcacggca

SEQ ID NO: 667051 - DNA, 25 bp, Rattus norvegicus
aacctgagtagatgcggcgacgtga

SEQ ID NO: 667052 - DNA, 25 bp, Rattus norvegicus
atgcggcgacgtgactttcggcttg

SEQ ID NO: 667053 - DNA, 25 bp, Rattus norvegicus
tctgctggtagttgctcgccatcca

SEQ ID NO: 667054 - DNA, 25 bp, Rattus norvegicus
ccagtggctccttcttcacgtcgaa

SEQ ID NO: 667055 - DNA, 25 bp, Rattus norvegicus
tggacgacaccgaaccagccggctg

SEQ ID NO: 667056 - DNA, 25 bp, Rattus norvegicus
ctcgttctccaggtgatgtttctgc

SEQ ID NO: 667057 - DNA, 25 bp, Rattus norvegicus
cgccatccagtagaggtcctcgaga

SEQ ID NO: 667058 - DNA, 25 bp, Rattus norvegicus
tgcctcgggattcatctgctggtag

SEQ ID NO: 667059 - DNA, 25 bp, Rattus norvegicus
ctacggaagccgtcgaagctctgca

SEQ ID NO: 667060 - DNA, 25 bp, Rattus norvegicus
ctccgcggccatcgctaaaagcgag

SEQ ID NO: 667061 - DNA, 25 bp, Rattus norvegicus
cgggcccagctcatcgtgagtcaca

SEQ ID NO: 667062 - DNA, 25 bp, Rattus norvegicus
gtcagagaagcggtcctccacacta

SEQ ID NO: 667063 - DNA, 25 bp, Rattus norvegicus
ggcggatcacctcgtccttggtgaa

SEQ ID NO: 667064 - DNA, 25 bp, Rattus norvegicus
cgcgtttatacctgcacgactgggc

SEQ ID NO: 667065 - DNA, 25 bp, Rattus norvegicus
gatgtttctgctggacgcgtttata

SEQ ID NO: 667066 - DNA, 25 bp, Rattus norvegicus
ctcgagatgggtcttctgttcagtc

SEQ ID NO: 667067 - DNA, 25 bp, Rattus norvegicus
agcctctttccacgagcgctgacgt

SEQ ID NO: 667068 - DNA, 25 bp, Rattus norvegicus
acatggcgtcccagagactaagtcc

SEQ ID NO: 667069 - DNA, 25 bp, Rattus norvegicus
ttccgattgaatggtgagtgtgccc

SEQ ID NO: 667070 - DNA, 25 bp, Rattus norvegicus
ttttctttcctcagatcgaagcgga

SEQ ID NO: 667071 - DNA, 25 bp, Rattus norvegicus
tcatgtgcgggttgtttcatcttcc

SEQ ID NO: 667072 - DNA, 25 bp, Rattus norvegicus
cggccgacatgagcggggaccatct

SEQ ID NO: 667073 - DNA, 25 bp, Rattus norvegicus
tgcaaggcaaaaccggctctgtctc

SEQ ID NO: 667074 - DNA, 25 bp, Rattus norvegicus
ccatatgctaataaaggggcggaac

SEQ ID NO: 667075 - DNA, 25 bp, Rattus norvegicus
tgggaggagccaaggccatatgcta

SEQ ID NO: 667076 - DNA, 25 bp, Rattus norvegicus
cccgaagcaaggcagaaagcatagg

SEQ ID NO: 667077 - DNA, 25 bp, Rattus norvegicus
ctctgagaacgccagcccgaagcaa

SEQ ID NO: 667078 - DNA, 25 bp, Rattus norvegicus
agagccggcgtaccgcctctgagaa

SEQ ID NO: 667079 - DNA, 25 bp, Rattus norvegicus
gctgacgtcggcgacgtcccattta

SEQ ID NO: 667080 - DNA, 25 bp, Rattus norvegicus
gtcccatttaaaagcggccgcgcag

SEQ ID NO: 667081 - DNA, 25 bp, Rattus norvegicus
ttggagacgcgccagatcacatgga

SEQ ID NO: 667082 - DNA, 25 bp, Rattus norvegicus
tcagccctcgcaaaagacgtctgtg

SEQ ID NO: 667083 - DNA, 25 bp, Rattus norvegicus
ggtgggcaccgtcatgactttgttc

SEQ ID NO: 667084 - DNA, 25 bp, Rattus norvegicus
tctactccaagaagtcgcagcggcc

SEQ ID NO: 667085 - DNA, 25 bp, Rattus norvegicus
agcggtccacgcgagaggcctcgaa

SEQ ID NO: 667086 - DNA, 25 bp, Rattus norvegicus
ctgcagggcctcttcccgagaagac

SEQ ID NO: 667087 - DNA, 25 bp, Rattus norvegicus
gaagacaccctcgaaggccaatcta

SEQ ID NO: 667088 - DNA, 25 bp, Rattus norvegicus
accttccaggtcaagttggagacgc

SEQ ID NO: 667089 - DNA, 25 bp, Rattus norvegicus
ggccaatctaggatcggtctgctca

SEQ ID NO: 667090 - DNA, 25 bp, Rattus norvegicus
atggagccgcggtgcggacaaaatc

SEQ ID NO: 667091 - DNA, 25 bp, Rattus norvegicus
caaaatcgaggggtccagtaagtgc

SEQ ID NO: 667092 - DNA, 25 bp, Rattus norvegicus
cagtaagtgcgttccagtccggcct

SEQ ID NO: 667093 - DNA, 25 bp, Rattus norvegicus
ttgggcaaactttcgggcctcgcgc

SEQ ID NO: 667094 - DNA, 25 bp, Rattus norvegicus
cagcggccagaacggaagaccttcc

SEQ ID NO: 667095 - DNA, 25 bp, Rattus norvegicus
cgaggacgagctgcaccaactgact

SEQ ID NO: 667096 - DNA, 25 bp, Rattus norvegicus
tgcccgcccgcgttctctgtgtggg

SEQ ID NO: 667097 - DNA, 25 bp, Rattus norvegicus
gagcggaccttacccggagcgcatg

SEQ ID NO: 667098 - DNA, 25 bp, Rattus norvegicus
tgacgtcgccgggagcggaccttac

SEQ ID NO: 667099 - DNA, 25 bp, Rattus norvegicus
tgcaccaactgactgggcggccgct

SEQ ID NO: 667100 - DNA, 25 bp, Rattus norvegicus
acagacaccggggactgacagctgt

SEQ ID NO: 667101 - DNA, 25 bp, Rattus norvegicus
acagacggggagacacacagacacc

SEQ ID NO: 667102 - DNA, 25 bp, Rattus norvegicus
aggcgctcgcaaacacacaggggct

SEQ ID NO: 667103 - DNA, 25 bp, Rattus norvegicus
gcgggaaggcgctcgcaaacacaca

SEQ ID NO: 667104 - DNA, 25 bp, Rattus norvegicus
cctgacctggactcccgggcgtgga

SEQ ID NO: 667105 - DNA, 25 bp, Rattus norvegicus
tgtggacacaggcacccacggccag

SEQ ID NO: 667106 - DNA, 25 bp, Rattus norvegicus
tttcaccagaggcaccggtgccagc

SEQ ID NO: 667107 - DNA, 25 bp, Rattus norvegicus
gagtcctgacgttcatttcaccaga

SEQ ID NO: 667108 - DNA, 25 bp, Rattus norvegicus
ccgctcgggtaagctcggtggaact

SEQ ID NO: 667109 - DNA, 25 bp, Rattus norvegicus
ctggggcaccctggtctcgatgcct

SEQ ID NO: 667110 - DNA, 25 bp, Rattus norvegicus
gccgcgtgcaaacacgaggttaaga

SEQ ID NO: 667111 - DNA, 25 bp, Rattus norvegicus
cccttgactgacttgttcttcgcca

SEQ ID NO: 667112 - DNA, 25 bp, Rattus norvegicus
cctggagtttgctcacagcgcagct

SEQ ID NO: 667113 - DNA, 25 bp, Rattus norvegicus
tgcagggcgctaaattccaggaggc

SEQ ID NO: 667114 - DNA, 25 bp, Rattus norvegicus
cagctccaagctgacgcccgaaggg

SEQ ID NO: 667115 - DNA, 25 bp, Rattus norvegicus
attagcataaacttggggccgcgcc

SEQ ID NO: 667116 - DNA, 25 bp, Rattus norvegicus
gggctctgcacggattagcataaac

SEQ ID NO: 667117 - DNA, 25 bp, Rattus norvegicus
acggcgcacagccacacgaggagac

SEQ ID NO: 667118 - DNA, 25 bp, Rattus norvegicus
cctgcccgcgcaaaggatggtgtcg

SEQ ID NO: 667119 - DNA, 25 bp, Rattus norvegicus
gaaaggtttccacgggcactgccag

SEQ ID NO: 667120 - DNA, 25 bp, Rattus norvegicus
tgttacttcgctggaaaggtttcca

SEQ ID NO: 667121 - DNA, 25 bp, Rattus norvegicus
cagcgcagctggaaaatgttacttc

SEQ ID NO: 667122 - DNA, 25 bp, Rattus norvegicus
ttccaggaggcttcccaaacacgcg

SEQ ID NO: 667123 - DNA, 25 bp, Rattus norvegicus
tgcgagggtccagccgccctcctgc

SEQ ID NO: 667124 - DNA, 25 bp, Rattus norvegicus
ccagccaccgggcacggcttccgga

SEQ ID NO: 667125 - DNA, 25 bp, Rattus norvegicus
cgttcctcgagagccagcgggcgca

SEQ ID NO: 667126 - DNA, 25 bp, Rattus norvegicus
ttgttgcgccctgcgttcctcgaga

SEQ ID NO: 667127 - DNA, 25 bp, Rattus norvegicus
gcgtgcctggcgcttgttgcgccct

SEQ ID NO: 667128 - DNA, 25 bp, Rattus norvegicus
ctgtcacgggagagggtcatggccc

SEQ ID NO: 667129 - DNA, 25 bp, Rattus norvegicus
cagctggtccggcttcgcggtgcag

SEQ ID NO: 667130 - DNA, 25 bp, Rattus norvegicus
cattcccatgatgcccagccaccgg

SEQ ID NO: 667131 - DNA, 25 bp, Rattus norvegicus
actcggccgtgccattcccatgatg

SEQ ID NO: 667132 - DNA, 25 bp, Rattus norvegicus
gaactcggccgtgccattcccatga

SEQ ID NO: 667133 - DNA, 25 bp, Rattus norvegicus
cgcgcagcctccgagtcccgcgggt

SEQ ID NO: 667134 - DNA, 25 bp, Rattus norvegicus
acaaggagggtcgccgcgcagcctc

SEQ ID NO: 667135 - DNA, 25 bp, Rattus norvegicus
gccgtgtccaacttggcgacgcgcg

SEQ ID NO: 667136 - DNA, 25 bp, Rattus norvegicus
gcgacgcgcgcgacctccagcaccc

SEQ ID NO: 667137 - DNA, 25 bp, Rattus norvegicus
tgctgatcagactgaagcccgtttc

SEQ ID NO: 667138 - DNA, 25 bp, Rattus norvegicus
cattggtcatctgggctgctgatca

SEQ ID NO: 667139 - DNA, 25 bp, Rattus norvegicus
tgcaaacagacgcaggacgcggagc

SEQ ID NO: 667140 - DNA, 25 bp, Rattus norvegicus
gacgcggagcggagcaacttctccg

SEQ ID NO: 667141 - DNA, 25 bp, Rattus norvegicus
tctgccggggtcaggcaggaaaata

SEQ ID NO: 667142 - DNA, 25 bp, Rattus norvegicus
tacctaaaatggctcctgcagcagc

SEQ ID NO: 667143 - DNA, 25 bp, Rattus norvegicus
agtttagctcagacaccctgcaagg

SEQ ID NO: 667144 - DNA, 25 bp, Rattus norvegicus
gggctcgctccattgtgctcgtatt

SEQ ID NO: 667145 - DNA, 25 bp, Rattus norvegicus
ggctgcccaaaacacaggctcattg

SEQ ID NO: 667146 - DNA, 25 bp, Rattus norvegicus
tcaagcttgcttgcaggagcgagtg

SEQ ID NO: 667147 - DNA, 25 bp, Rattus norvegicus
tgctcgtatttgcatggatgtgatc

SEQ ID NO: 667148 - DNA, 25 bp, Rattus norvegicus
tgattggtcgatatcggaaaagccc

SEQ ID NO: 667149 - DNA, 25 bp, Rattus norvegicus
gatgtgatcgcagcgctgattggtc

SEQ ID NO: 667150 - DNA, 25 bp, Rattus norvegicus
cgccattgggcttcggctgcccaaa

SEQ ID NO: 667151 - DNA, 25 bp, Rattus norvegicus
ggccgttcgcacactcagacgcgta

SEQ ID NO: 667152 - DNA, 25 bp, Rattus norvegicus
aggatctgcggggtattcgcctctt

SEQ ID NO: 667153 - DNA, 25 bp, Rattus norvegicus
tctgcggggtattcgcctcttcgcc

SEQ ID NO: 667154 - DNA, 25 bp, Rattus norvegicus
cacccagctgagcatcgtcttcagg

SEQ ID NO: 667155 - DNA, 25 bp, Rattus norvegicus
ccagctgagcatcgtcttcaggcta

SEQ ID NO: 667156 - DNA, 25 bp, Rattus norvegicus
tgagcatcgtcttcaggctaccctg

SEQ ID NO: 667157 - DNA, 25 bp, Rattus norvegicus
atcgtcttcaggctaccctgcgggg

SEQ ID NO: 667158 - DNA, 25 bp, Rattus norvegicus
gggctcggggccgttcgcacactca

SEQ ID NO: 667159 - DNA, 25 bp, Rattus norvegicus
gttcgcacactcagacgcgtacaca

SEQ ID NO: 667160 - DNA, 25 bp, Rattus norvegicus
gacgcgtacacacatcgctcttgca

SEQ ID NO: 667161 - DNA, 25 bp, Rattus norvegicus
atcgctcttgcacccacaggatctg

SEQ ID NO: 667162 - DNA, 25 bp, Rattus norvegicus
cccacaggatctgcggggtattcgc

SEQ ID NO: 667163 - DNA, 25 bp, Rattus norvegicus
ctccgcctcggccacgcacacacac

SEQ ID NO: 667164 - DNA, 25 bp, Rattus norvegicus
tggcacacgcccgtggctgccactc

SEQ ID NO: 667165 - DNA, 25 bp, Rattus norvegicus
tagcctgaagacgatgctcagctgg

SEQ ID NO: 667166 - DNA, 25 bp, Rattus norvegicus
cctgaagacgatgctcagctgggtg

SEQ ID NO: 667167 - DNA, 25 bp, Rattus norvegicus
ggcgaagaggcgaataccccgcaga

SEQ ID NO: 667168 - DNA, 25 bp, Rattus norvegicus
gcagccacgggcgtgtgccaggcgc

SEQ ID NO: 667169 - DNA, 25 bp, Rattus norvegicus
ccgcagggtagcctgaagacgatgc

SEQ ID NO: 667170 - DNA, 25 bp, Rattus norvegicus
gggtagcctgaagacgatgctcagc

SEQ ID NO: 667171 - DNA, 25 bp, Rattus norvegicus
cagatcctgtgggtgcaagagcgat

SEQ ID NO: 667172 - DNA, 25 bp, Rattus norvegicus
tgcaagagcgatgtgtgtacgcgtc

SEQ ID NO: 667173 - DNA, 25 bp, Rattus norvegicus
aagagcgatgtgtgtacgcgtctga

SEQ ID NO: 667174 - DNA, 25 bp, Rattus norvegicus
tgtgtacgcgtctgagtgtgcgaac

SEQ ID NO: 667175 - DNA, 25 bp, Rattus norvegicus
acgcgtctgagtgtgcgaacggccc

SEQ ID NO: 667176 - DNA, 25 bp, Rattus norvegicus
tgagtgtgcgaacggccccgagccc

SEQ ID NO: 667177 - DNA, 25 bp, Rattus norvegicus
gagcccgcgagtggcagccacgggc

SEQ ID NO: 667178 - DNA, 25 bp, Rattus norvegicus
cagggtagcctgaagacgatgctca

SEQ ID NO: 667179 - DNA, 25 bp, Rattus norvegicus
gctcgggcgcaaatcctgatctcag

SEQ ID NO: 667180 - DNA, 25 bp, Rattus norvegicus
gagagggtagccgtttcgcgtcttc

SEQ ID NO: 667181 - DNA, 25 bp, Rattus norvegicus
agctagcgccctgttggcggatccc

SEQ ID NO: 667182 - DNA, 25 bp, Rattus norvegicus
actctgccggcagccatcgagctag

SEQ ID NO: 667183 - DNA, 25 bp, Rattus norvegicus
agagtccatcctcgtactctgccgg

SEQ ID NO: 667184 - DNA, 25 bp, Rattus norvegicus
ggagggagagtccatcctcgtactc

SEQ ID NO: 667185 - DNA, 25 bp, Rattus norvegicus
cgtcctccttcacctgcgggagagg

SEQ ID NO: 667186 - DNA, 25 bp, Rattus norvegicus
actgacttgcgtgtggctctttccc

SEQ ID NO: 667187 - DNA, 25 bp, Rattus norvegicus
cttttcagagtgctgactgacttgc

SEQ ID NO: 667188 - DNA, 25 bp, Rattus norvegicus
ccctttttccttttcagagtgctga

SEQ ID NO: 667189 - DNA, 25 bp, Rattus norvegicus
cgggcgcaaatcctgatctcagttg

SEQ ID NO: 667190 - DNA, 25 bp, Rattus norvegicus
tagcgccctgttggcggatcccagc

SEQ ID NO: 667191 - DNA, 25 bp, Rattus norvegicus
ctgatctcagttgcgcctccctttt

SEQ ID NO: 667192 - DNA, 25 bp, Rattus norvegicus
gcagccatcgagctagcgccctgtt

SEQ ID NO: 667193 - DNA, 25 bp, Rattus norvegicus
atagcgagtctttgccggctgcata

SEQ ID NO: 667194 - DNA, 25 bp, Rattus norvegicus
ctcagcttactttgcgtcaaaggta

SEQ ID NO: 667195 - DNA, 25 bp, Rattus norvegicus
gccaatctgctgaggacgagcctcc

SEQ ID NO: 667196 - DNA, 25 bp, Rattus norvegicus
tcctccgtcagcgtgtcacatgaca

SEQ ID NO: 667197 - DNA, 25 bp, Rattus norvegicus
gactccggaggcgaatgaacgtctc

SEQ ID NO: 667198 - DNA, 25 bp, Rattus norvegicus
ggcgaatgaacgtctcagcttactt

SEQ ID NO: 667199 - DNA, 25 bp, Rattus norvegicus
tgcgtcaaaggtaattaagcgtgtc

SEQ ID NO: 667200 - DNA, 25 bp, Rattus norvegicus
ttaagcgtgtcagggttacataacc

SEQ ID NO: 667201 - DNA, 25 bp, Rattus norvegicus
gttacataaccatcttttcggactg

SEQ ID NO: 667202 - DNA, 25 bp, Rattus norvegicus
tttcggactgattcagaccttttca

SEQ ID NO: 667203 - DNA, 25 bp, Rattus norvegicus
cttttcactaaatcgggccgtctca

SEQ ID NO: 667204 - DNA, 25 bp, Rattus norvegicus
cgtgtggtaatagcgagtctttgcc

SEQ ID NO: 667205 - DNA, 25 bp, Rattus norvegicus
cggctgcatagtcggtttcacaccc

SEQ ID NO: 667206 - DNA, 25 bp, Rattus norvegicus
ggccgtctcagatcgtgtggtaata

SEQ ID NO: 667207 - DNA, 25 bp, Rattus norvegicus
acgatctggcggtggattagcccgt

SEQ ID NO: 667208 - DNA, 25 bp, Rattus norvegicus
gtctcctctctcttcggcagcccga

SEQ ID NO: 667209 - DNA, 25 bp, Rattus norvegicus
ggagattcaggacttcagattattg

SEQ ID NO: 667210 - DNA, 25 bp, Rattus norvegicus
cgtagcggaaggagattcaggactt

SEQ ID NO: 667211 - DNA, 25 bp, Rattus norvegicus
tctggcggtggattagcccgtcgta

SEQ ID NO: 667212 - DNA, 25 bp, Rattus norvegicus
actccgacgatctggcggtggatta

SEQ ID NO: 667213 - DNA, 25 bp, Rattus norvegicus
gggctccactccgacgatctggcgg

SEQ ID NO: 667214 - DNA, 25 bp, Rattus norvegicus
tcacggatctgtgcttcataaccac

SEQ ID NO: 667215 - DNA, 25 bp, Rattus norvegicus
gaggttttcacggatctgtgcttca

SEQ ID NO: 667216 - DNA, 25 bp, Rattus norvegicus
ctcacgtaagaagtgaggttttcac

SEQ ID NO: 667217 - DNA, 25 bp, Rattus norvegicus
tacctgctgctgcagagggtagccg

SEQ ID NO: 667218 - DNA, 25 bp, Rattus norvegicus
tcggatcatgtacctgctgctgcag

SEQ ID NO: 667219 - DNA, 25 bp, Rattus norvegicus
ggccatccgcagaccagggcggtac

SEQ ID NO: 667220 - DNA, 25 bp, Rattus norvegicus
cccgtcgtagcggaaggagattcag

SEQ ID NO: 667221 - DNA, 25 bp, Rattus norvegicus
tgggtgttcctaggctcctctacct

SEQ ID NO: 667222 - DNA, 25 bp, Rattus norvegicus
ctagtcaaaggtcccggtctcggct

SEQ ID NO: 667223 - DNA, 25 bp, Rattus norvegicus
ccggtcacttatagcgtaggccagc

SEQ ID NO: 667224 - DNA, 25 bp, Rattus norvegicus
cgcaccattgtgtggctgactcggc

SEQ ID NO: 667225 - DNA, 25 bp, Rattus norvegicus
acctcagctagcctccgggagaaca

SEQ ID NO: 667226 - DNA, 25 bp, Rattus norvegicus
gccatgccgcgcgtctacataggac

SEQ ID NO: 667227 - DNA, 25 bp, Rattus norvegicus
gtctacataggacgcctgagctaca

SEQ ID NO: 667228 - DNA, 25 bp, Rattus norvegicus
atccagcgctttttcagcggctacg

SEQ ID NO: 667229 - DNA, 25 bp, Rattus norvegicus
gcctcctcgaaatcgacctcaaaaa

SEQ ID NO: 667230 - DNA, 25 bp, Rattus norvegicus
cctcaaaaatgggtgagtcgggtct

SEQ ID NO: 667231 - DNA, 25 bp, Rattus norvegicus
ctcaggtacggtttcgtggagttcg

SEQ ID NO: 667232 - DNA, 25 bp, Rattus norvegicus
gacgccgtttacgagctgaacagca

SEQ ID NO: 667233 - DNA, 25 bp, Rattus norvegicus
tacggaagccgcagtgagtcctacc

SEQ ID NO: 667234 - DNA, 25 bp, Rattus norvegicus
ggaccgcgatggctacagctacgga

SEQ ID NO: 667235 - DNA, 25 bp, Rattus norvegicus
ctgcggcacctgctatgggttgggt

SEQ ID NO: 667236 - DNA, 25 bp, Rattus norvegicus
caccaggctcccacggtcgctcggt

SEQ ID NO: 667237 - DNA, 25 bp, Rattus norvegicus
accgccagccttgcaggtaagcacg

SEQ ID NO: 667238 - DNA, 25 bp, Rattus norvegicus
cagccttgcaggtaagcacggggca

SEQ ID NO: 667239 - DNA, 25 bp, Rattus norvegicus
aagcacggggcagtgatctcgggct

SEQ ID NO: 667240 - DNA, 25 bp, Rattus norvegicus
ggtgctcccaggacgccacacccgg

SEQ ID NO: 667241 - DNA, 25 bp, Rattus norvegicus
aggcccttttccagctcctgcggca

SEQ ID NO: 667242 - DNA, 25 bp, Rattus norvegicus
agcgagcccactggaactgtccgca

SEQ ID NO: 667243 - DNA, 25 bp, Rattus norvegicus
cggcaaccgccagccttgcaggtaa

SEQ ID NO: 667244 - DNA, 25 bp, Rattus norvegicus
ctgtccgcatccagagccgcgggga

SEQ ID NO: 667245 - DNA, 25 bp, Rattus norvegicus
tggaactgtccgcatccagagccgc

SEQ ID NO: 667246 - DNA, 25 bp, Rattus norvegicus
ctctgtagatccagggccgtggcgc

SEQ ID NO: 667247 - DNA, 25 bp, Rattus norvegicus
gcgagcgagcccactggaactgtcc

SEQ ID NO: 667248 - DNA, 25 bp, Rattus norvegicus
ccacacccgggtcctggcccgcacg

SEQ ID NO: 667249 - DNA, 25 bp, Rattus norvegicus
ggagatgatgatggcctcgccatgc

SEQ ID NO: 667250 - DNA, 25 bp, Rattus norvegicus
tctggcctcaggtaaggagaggtcg

SEQ ID NO: 667251 - DNA, 25 bp, Rattus norvegicus
gctggagatgatgatggcctcgcca

SEQ ID NO: 667252 - DNA, 25 bp, Rattus norvegicus
cggccttggatacctggcggcctct

SEQ ID NO: 667253 - DNA, 25 bp, Rattus norvegicus
tctggagacccctaggccaaccttg

SEQ ID NO: 667254 - DNA, 25 bp, Rattus norvegicus
taggccaaccttgtgggaatcccga

SEQ ID NO: 667255 - DNA, 25 bp, Rattus norvegicus
caaccttgtgggaatcccgaggtcg

SEQ ID NO: 667256 - DNA, 25 bp, Rattus norvegicus
ccgaggtcggtagaggtaaactgag

SEQ ID NO: 667257 - DNA, 25 bp, Rattus norvegicus
atcgcaccgcgacggaagtcgctcg

SEQ ID NO: 667258 - DNA, 25 bp, Rattus norvegicus
gtcgtcatcgcaccgcgacggaagt

SEQ ID NO: 667259 - DNA, 25 bp, Rattus norvegicus
cttctgtcgctctgtcgtcatcgca

SEQ ID NO: 667260 - DNA, 25 bp, Rattus norvegicus
tggcacagcccttctgtcgctctgt

SEQ ID NO: 667261 - DNA, 25 bp, Rattus norvegicus
ctcgagttccctgccacctggcaca

SEQ ID NO: 667262 - DNA, 25 bp, Rattus norvegicus
ccgccaggtcgttgggctggctgga

SEQ ID NO: 667263 - DNA, 25 bp, Rattus norvegicus
gcagacacgctgacgcctcagagca

SEQ ID NO: 667264 - DNA, 25 bp, Rattus norvegicus
gctccgcctctcgtctctagtacgc

SEQ ID NO: 667265 - DNA, 25 bp, Rattus norvegicus
acaagacctgcagacacgctgacgc

SEQ ID NO: 667266 - DNA, 25 bp, Rattus norvegicus
tgcgacaagacctgcagacacgctg

SEQ ID NO: 667267 - DNA, 25 bp, Rattus norvegicus
gaacgtgcgacaagacctgcagaca

SEQ ID NO: 667268 - DNA, 25 bp, Rattus norvegicus
ctgggaacgtgcgacaagacctgca

SEQ ID NO: 667269 - DNA, 25 bp, Rattus norvegicus
ttcctgggaacgtgcgacaagacct

SEQ ID NO: 667270 - DNA, 25 bp, Rattus norvegicus
ctaggcagctgcagttcctgggaac

SEQ ID NO: 667271 - DNA, 25 bp, Rattus norvegicus
ctccctaggcagctgcagttcctgg

SEQ ID NO: 667272 - DNA, 25 bp, Rattus norvegicus
tcagtgcgctccctaggcagctgca

SEQ ID NO: 667273 - DNA, 25 bp, Rattus norvegicus
gaaagtggttcagtgcgctccctag

SEQ ID NO: 667274 - DNA, 25 bp, Rattus norvegicus
ataggaaagtggttcagtgcgctcc

SEQ ID NO: 667275 - DNA, 25 bp, Rattus norvegicus
cgccgacgcacttggcgggagatag

SEQ ID NO: 667276 - DNA, 25 bp, Rattus norvegicus
ctctcgtctctagtacgcctggccc

SEQ ID NO: 667277 - DNA, 25 bp, Rattus norvegicus
ttttcttgttagcattccgggaagc

SEQ ID NO: 667278 - DNA, 25 bp, Rattus norvegicus
tcgttgtctctttggggattcggcg

SEQ ID NO: 667279 - DNA, 25 bp, Rattus norvegicus
actcgttgtctctttggggattcgg

SEQ ID NO: 667280 - DNA, 25 bp, Rattus norvegicus
ggactcgttgtctctttggggattc

SEQ ID NO: 667281 - DNA, 25 bp, Rattus norvegicus
cctccgcgggatgtgaggctgggga

SEQ ID NO: 667282 - DNA, 25 bp, Rattus norvegicus
tccgggaagcacaaagcccctgggc

SEQ ID NO: 667283 - DNA, 25 bp, Rattus norvegicus
tagcattccgggaagcacaaagccc

SEQ ID NO: 667284 - DNA, 25 bp, Rattus norvegicus
ttagcattccgggaagcacaaagcc

SEQ ID NO: 667285 - DNA, 25 bp, Rattus norvegicus
ttcttgttagcattccgggaagcac

SEQ ID NO: 667286 - DNA, 25 bp, Rattus norvegicus
ttcttttcttgttagcattccggga

SEQ ID NO: 667287 - DNA, 25 bp, Rattus norvegicus
gcgttcttttcttgttagcattccg

SEQ ID NO: 667288 - DNA, 25 bp, Rattus norvegicus
tggcgttcttttcttgttagcattc

SEQ ID NO: 667289 - DNA, 25 bp, Rattus norvegicus
tgctggcgttcttttcttgttagca

SEQ ID NO: 667290 - DNA, 25 bp, Rattus norvegicus
cttgttagcattccgggaagcacaa

SEQ ID NO: 667291 - DNA, 25 bp, Rattus norvegicus
aaggaaagctgttgcccgcggtgtc

SEQ ID NO: 667292 - DNA, 25 bp, Rattus norvegicus
ggctcgactttgctggcgttctttt

SEQ ID NO: 667293 - DNA, 25 bp, Rattus norvegicus
tcgttcaagagtggctcgactttgc

SEQ ID NO: 667294 - DNA, 25 bp, Rattus norvegicus
tgggagacacttgtcgttcaagagt

SEQ ID NO: 667295 - DNA, 25 bp, Rattus norvegicus
cagctggaggcccattactgggtag

SEQ ID NO: 667296 - DNA, 25 bp, Rattus norvegicus
tcgtctcccgcctaattgctgggtg

SEQ ID NO: 667297 - DNA, 25 bp, Rattus norvegicus
aggtccatcgtctcccgcctaattg

SEQ ID NO: 667298 - DNA, 25 bp, Rattus norvegicus
gccctgggtgaggtccatcgtctcc

SEQ ID NO: 667299 - DNA, 25 bp, Rattus norvegicus
gccacgttagaagctctagggaccc

SEQ ID NO: 667300 - DNA, 25 bp, Rattus norvegicus
cgcgcgccacgttagaagctctagg

SEQ ID NO: 667301 - DNA, 25 bp, Rattus norvegicus
tcagcaagcgtgagatggggatccc

SEQ ID NO: 667302 - DNA, 25 bp, Rattus norvegicus
cttctccttgggtcagcaagcgtga

SEQ ID NO: 667303 - DNA, 25 bp, Rattus norvegicus
tttcgcccttctccttgggtcagca

SEQ ID NO: 667304 - DNA, 25 bp, Rattus norvegicus
cccattactgggtagggagaatgtc

SEQ ID NO: 667305 - DNA, 25 bp, Rattus norvegicus
ctcaggacggcgacggtaaaggcca

SEQ ID NO: 667306 - DNA, 25 bp, Rattus norvegicus
aaaggaacgagctgtgagagtccgc

SEQ ID NO: 667307 - DNA, 25 bp, Rattus norvegicus
gtgagagtccgctcgtccttacctc

SEQ ID NO: 667308 - DNA, 25 bp, Rattus norvegicus
tcctagcggagcaccaaccacagta

SEQ ID NO: 667309 - DNA, 25 bp, Rattus norvegicus
acagtaccaactcgcccatttacaa

SEQ ID NO: 667310 - DNA, 25 bp, Rattus norvegicus
ccatttacaaagacgcaggcgcagc

SEQ ID NO: 667311 - DNA, 25 bp, Rattus norvegicus
agtcggtcctccgagccagcaagcg

SEQ ID NO: 667312 - DNA, 25 bp, Rattus norvegicus
ctctgccaggcaggaagagtctctg

SEQ ID NO: 667313 - DNA, 25 bp, Rattus norvegicus
caggaagagtctctgcggcatctca

SEQ ID NO: 667314 - DNA, 25 bp, Rattus norvegicus
agtctctgcggcatctcagtccacg

SEQ ID NO: 667315 - DNA, 25 bp, Rattus norvegicus
atggcacccgctccggctgtgctga

SEQ ID NO: 667316 - DNA, 25 bp, Rattus norvegicus
ccggctgtgctgacccggcttcagt

SEQ ID NO: 667317 - DNA, 25 bp, Rattus norvegicus
ccgcagtcagcgagcctcaggacgg

SEQ ID NO: 667318 - DNA, 25 bp, Rattus norvegicus
acccggcttcagtgtgcaggtgagc

SEQ ID NO: 667319 - DNA, 25 bp, Rattus norvegicus
caaggcctgtcccttccctggattg

SEQ ID NO: 667320 - DNA, 25 bp, Rattus norvegicus
tccctggattgggagctagcgtctc

SEQ ID NO: 667321 - DNA, 25 bp, Rattus norvegicus
atgcaggtgtcgtccaatcaaggcc

SEQ ID NO: 667322 - DNA, 25 bp, Rattus norvegicus
cccatggcgcctgggattctatgca

SEQ ID NO: 667323 - DNA, 25 bp, Rattus norvegicus
gccgtttactaattggccgtcacta

SEQ ID NO: 667324 - DNA, 25 bp, Rattus norvegicus
tgctgagcattaattgggccgttta

SEQ ID NO: 667325 - DNA, 25 bp, Rattus norvegicus
cacccagggacagtcacaggctcta

SEQ ID NO: 667326 - DNA, 25 bp, Rattus norvegicus
acagggtcggtcacacagatccatc

SEQ ID NO: 667327 - DNA, 25 bp, Rattus norvegicus
gcgctgctacacatgttcctatctg

SEQ ID NO: 667328 - DNA, 25 bp, Rattus norvegicus
gtcacggtgccagtcatttatcctc

SEQ ID NO: 667329 - DNA, 25 bp, Rattus norvegicus
gcattcattcacaagccgacgcgca

SEQ ID NO: 667330 - DNA, 25 bp, Rattus norvegicus
gtcagctcgacagcttcccgtaaga

SEQ ID NO: 667331 - DNA, 25 bp, Rattus norvegicus
tagatcacgggcagaagtcagctcg

SEQ ID NO: 667332 - DNA, 25 bp, Rattus norvegicus
tgaaacttagttcggacgccagacg

SEQ ID NO: 667333 - DNA, 25 bp, Rattus norvegicus
cgctcatgcagctgtgggctttccc

SEQ ID NO: 667334 - DNA, 25 bp, Rattus norvegicus
acaatccctcctggaaccgcaagga

SEQ ID NO: 667335 - DNA, 25 bp, Rattus norvegicus
tggaaccgcaaggacctcacagact

SEQ ID NO: 667336 - DNA, 25 bp, Rattus norvegicus
ttctttccggcccttcttcttggca

SEQ ID NO: 667337 - DNA, 25 bp, Rattus norvegicus
ccttgggctcggctttggggactat

SEQ ID NO: 667338 - DNA, 25 bp, Rattus norvegicus
caggggactcctcttcctggaccgt

SEQ ID NO: 667339 - DNA, 25 bp, Rattus norvegicus
ctccgagtcggatcgcgggacctcg

SEQ ID NO: 667340 - DNA, 25 bp, Rattus norvegicus
gctcgggctcatcctccaagggcgg

SEQ ID NO: 667341 - DNA, 25 bp, Rattus norvegicus
tgcgcacagcgtagctgtggtaacc

SEQ ID NO: 667342 - DNA, 25 bp, Rattus norvegicus
gtaaccgcggtacagtgccacctca

SEQ ID NO: 667343 - DNA, 25 bp, Rattus norvegicus
ggctgcagcgcctcgatggccatgt

SEQ ID NO: 667344 - DNA, 25 bp, Rattus norvegicus
atggccatgtgctccgaagccggac

SEQ ID NO: 667345 - DNA, 25 bp, Rattus norvegicus
gcagaccgtcctttgacgatcccgg

SEQ ID NO: 667346 - DNA, 25 bp, Rattus norvegicus
ccggactcagcagaccgtcctttga

SEQ ID NO: 667347 - DNA, 25 bp, Rattus norvegicus
gccctgcaccgttctttaacacgta

SEQ ID NO: 667348 - DNA, 25 bp, Rattus norvegicus
gacgcgcggccctgaaatagagccc

SEQ ID NO: 667349 - DNA, 25 bp, Rattus norvegicus
ctgtcccggctgatacctcgccgtc

SEQ ID NO: 667350 - DNA, 25 bp, Rattus norvegicus
cagcgctgggctgaaacgaatcgcg

SEQ ID NO: 667351 - DNA, 25 bp, Rattus norvegicus
cgtcacgcaggcgagtccgcacagg

SEQ ID NO: 667352 - DNA, 25 bp, Rattus norvegicus
cacgagggtctccagagcctgggcc

SEQ ID NO: 667353 - DNA, 25 bp, Rattus norvegicus
agccagcgcacgagggtctccagag

SEQ ID NO: 667354 - DNA, 25 bp, Rattus norvegicus
gcgtcgtgcccgaaccctctctacc

SEQ ID NO: 667355 - DNA, 25 bp, Rattus norvegicus
gcgacctcgctgcaggaaggtcgcc

SEQ ID NO: 667356 - DNA, 25 bp, Rattus norvegicus
gaatgagcagcacctcagcacctgg

SEQ ID NO: 667357 - DNA, 25 bp, Rattus norvegicus
ctggggaatgagcagcacctcagca

SEQ ID NO: 667358 - DNA, 25 bp, Rattus norvegicus
gcagggaccacgaagggcagcacct

SEQ ID NO: 667359 - DNA, 25 bp, Rattus norvegicus
attgcctcgtttcggatttccaaag

SEQ ID NO: 667360 - DNA, 25 bp, Rattus norvegicus
taacacgtacaaacgttattgcctc

SEQ ID NO: 667361 - DNA, 25 bp, Rattus norvegicus
ctgagctcagctcgctcttgaggaa

SEQ ID NO: 667362 - DNA, 25 bp, Rattus norvegicus
ctgccatcccgtagggcacgctttg

SEQ ID NO: 667363 - DNA, 25 bp, Rattus norvegicus
tggagccactgtgccattgctgtgc

SEQ ID NO: 667364 - DNA, 25 bp, Rattus norvegicus
cagtgcgcctcgtgtgaacagccct

SEQ ID NO: 667365 - DNA, 25 bp, Rattus norvegicus
ttgaggaagctcaagcggctgcgct

SEQ ID NO: 667366 - DNA, 25 bp, Rattus norvegicus
cgaagcccgagcgtttgtcgttctt

SEQ ID NO: 667367 - DNA, 25 bp, Rattus norvegicus
ctggaacgttcgctcacaccgaagc

SEQ ID NO: 667368 - DNA, 25 bp, Rattus norvegicus
ccctcgtagcgaaggccgctggaac

SEQ ID NO: 667369 - DNA, 25 bp, Rattus norvegicus
cgaccgtaaccgtggcgcaggttgt

SEQ ID NO: 667370 - DNA, 25 bp, Rattus norvegicus
cacattgtggcggtacttgccctcc

SEQ ID NO: 667371 - DNA, 25 bp, Rattus norvegicus
tggtgcccttgaccagcacattgtg

SEQ ID NO: 667372 - DNA, 25 bp, Rattus norvegicus
accttgttgctcttgagcggcagca

SEQ ID NO: 667373 - DNA, 25 bp, Rattus norvegicus
atgctccaccttctggcgaaccttg

SEQ ID NO: 667374 - DNA, 25 bp, Rattus norvegicus
tgagcgtcgcagtcgacccagcagt

SEQ ID NO: 667375 - DNA, 25 bp, Rattus norvegicus
ttgaagtcaccaagccaacggcatt

SEQ ID NO: 667376 - DNA, 25 bp, Rattus norvegicus
ctttccatcacggttaagcggagtc

SEQ ID NO: 667377 - DNA, 25 bp, Rattus norvegicus
gccgggagctgtctcggcttttacc

SEQ ID NO: 667378 - DNA, 25 bp, Rattus norvegicus
tgccaaccacaaactctgagaaaag

SEQ ID NO: 667379 - DNA, 25 bp, Rattus norvegicus
gaaggccgcgcaagttcgcactcca

SEQ ID NO: 667380 - DNA, 25 bp, Rattus norvegicus
ggcctggcgaacacgacgtcccagt

SEQ ID NO: 667381 - DNA, 25 bp, Rattus norvegicus
gcactagagtcgtactgcgcctgcg

SEQ ID NO: 667382 - DNA, 25 bp, Rattus norvegicus
caacacggccagaggtaactgcgca

SEQ ID NO: 667383 - DNA, 25 bp, Rattus norvegicus
agcacgtgcgtcttaagtcatttcc

SEQ ID NO: 667384 - DNA, 25 bp, Rattus norvegicus
tttagggcgtgcctacttcctcttc

SEQ ID NO: 667385 - DNA, 25 bp, Rattus norvegicus
ctatcacgtgaattggcggcttgtc

SEQ ID NO: 667386 - DNA, 25 bp, Rattus norvegicus
ggcggcttgtcttgcaactgtagaa

SEQ ID NO: 667387 - DNA, 25 bp, Rattus norvegicus
ggcataatcggcctccttcttgtcc

SEQ ID NO: 667388 - DNA, 25 bp, Rattus norvegicus
aactgtagaaccatcgctgctcccg

SEQ ID NO: 667389 - DNA, 25 bp, Rattus norvegicus
cagctggtggcccatctcggcgctg

SEQ ID NO: 667390 - DNA, 25 bp, Rattus norvegicus
cttcagctcgcagaaggtagagcgg

SEQ ID NO: 667391 - DNA, 25 bp, Rattus norvegicus
gccatgtgatgctgggcgccagcga

SEQ ID NO: 667392 - DNA, 25 bp, Rattus norvegicus
accaactgcagctggtggcccatct

SEQ ID NO: 667393 - DNA, 25 bp, Rattus norvegicus
caggctccgcgaggccatgtgatgc

SEQ ID NO: 667394 - DNA, 25 bp, Rattus norvegicus
cgctggagagcgatgcagccaagcc

SEQ ID NO: 667395 - DNA, 25 bp, Rattus norvegicus
cgatgcagccaagccggtggaagcc

SEQ ID NO: 667396 - DNA, 25 bp, Rattus norvegicus
cccgacgcgcccgaggcagccagcc

SEQ ID NO: 667397 - DNA, 25 bp, Rattus norvegicus
cattggcccaaggagagcctggttc

SEQ ID NO: 667398 - DNA, 25 bp, Rattus norvegicus
cccaaggagagcctggttctgtacc

SEQ ID NO: 667399 - DNA, 25 bp, Rattus norvegicus
gagagcctggttctgtaccactgga

SEQ ID NO: 667400 - DNA, 25 bp, Rattus norvegicus
tggttctgtaccactggacccaatc

SEQ ID NO: 667401 - DNA, 25 bp, Rattus norvegicus
tggacccaatccttcagctcgcaga

SEQ ID NO: 667402 - DNA, 25 bp, Rattus norvegicus
gatcgcgggctgtcatggcgacccc

SEQ ID NO: 667403 - DNA, 25 bp, Rattus norvegicus
cttgttgctgaggtagctttcgggc

SEQ ID NO: 667404 - DNA, 25 bp, Rattus norvegicus
tcgctgcagagtgcaagtctacatc

SEQ ID NO: 667405 - DNA, 25 bp, Rattus norvegicus
gcgcgtctccctctagtggccataa

SEQ ID NO: 667406 - DNA, 25 bp, Rattus norvegicus
accgacacatccctctgggagcatg

SEQ ID NO: 667407 - DNA, 25 bp, Rattus norvegicus
ttcgcccgagctggtaccgacacat

SEQ ID NO: 667408 - DNA, 25 bp, Rattus norvegicus
gagcgtcccgcggagaaaccacgca

SEQ ID NO: 667409 - DNA, 25 bp, Rattus norvegicus
cacacgttgaggacgttgcgcttgt

SEQ ID NO: 667410 - DNA, 25 bp, Rattus norvegicus
ggagcctgatgtactcacacgttga

SEQ ID NO: 667411 - DNA, 25 bp, Rattus norvegicus
atccaactagcttcttgggacgcgg

SEQ ID NO: 667412 - DNA, 25 bp, Rattus norvegicus
gcggctgtcaagacagggctccctc

SEQ ID NO: 667413 - DNA, 25 bp, Rattus norvegicus
gagtgtcactcgctttcccaaggtc

SEQ ID NO: 667414 - DNA, 25 bp, Rattus norvegicus
caaatactagatgcgagtgtcactc

SEQ ID NO: 667415 - DNA, 25 bp, Rattus norvegicus
cggcaactcgatcctcctatcggga

SEQ ID NO: 667416 - DNA, 25 bp, Rattus norvegicus
cctatcgggatgctcaaatactaga

SEQ ID NO: 667417 - DNA, 25 bp, Rattus norvegicus
ctgtcagcggctccgaggtctctgg

SEQ ID NO: 667418 - DNA, 25 bp, Rattus norvegicus
cttggaacgctgtcagcggctccga

SEQ ID NO: 667419 - DNA, 25 bp, Rattus norvegicus
aagtaggggccttggaacgctgtca

SEQ ID NO: 667420 - DNA, 25 bp, Rattus norvegicus
cgccgaggggccagagatagggaca

SEQ ID NO: 667421 - DNA, 25 bp, Rattus norvegicus
tgagtgcccacgagcccgtgtgtgc

SEQ ID NO: 667422 - DNA, 25 bp, Rattus norvegicus
ccggtgagtgcccacgagcccgtgt

SEQ ID NO: 667423 - DNA, 25 bp, Rattus norvegicus
gctcctgccgctgtgacccgcgctc

SEQ ID NO: 667424 - DNA, 25 bp, Rattus norvegicus
gctctgccagccgaggctcctgccg

SEQ ID NO: 667425 - DNA, 25 bp, Rattus norvegicus
agtgcgggtctgttctgcgcgctct

SEQ ID NO: 667426 - DNA, 25 bp, Rattus norvegicus
ctacacgcgcccagaacgtcacttc

SEQ ID NO: 667427 - DNA, 25 bp, Rattus norvegicus
tcccagatgggcaccgcctacacgc

SEQ ID NO: 667428 - DNA, 25 bp, Rattus norvegicus
actcatgcgcactcccagatgggca

SEQ ID NO: 667429 - DNA, 25 bp, Rattus norvegicus
gccgcaaagatcactcatgcgcact

SEQ ID NO: 667430 - DNA, 25 bp, Rattus norvegicus
aagatcactcatgcgcactcccaga

SEQ ID NO: 667431 - DNA, 25 bp, Rattus norvegicus
gaggcctcgggactcacccagctag

SEQ ID NO: 667432 - DNA, 25 bp, Rattus norvegicus
agccctttttgctcgcgacctgcag

SEQ ID NO: 667433 - DNA, 25 bp, Rattus norvegicus
cctgcagcggtgctgacttaaaatc

SEQ ID NO: 667434 - DNA, 25 bp, Rattus norvegicus
cgtagcgctggcatatgccgaacta

SEQ ID NO: 667435 - DNA, 25 bp, Rattus norvegicus
gccgaactatggagaaaaatgactc

SEQ ID NO: 667436 - DNA, 25 bp, Rattus norvegicus
tcgcctggtcgccagaaccctgggt

SEQ ID NO: 667437 - DNA, 25 bp, Rattus norvegicus
attgtaaacaatggcggcccggcct

SEQ ID NO: 667438 - DNA, 25 bp, Rattus norvegicus
agcctcatagagtgttggatccgcc

SEQ ID NO: 667439 - DNA, 25 bp, Rattus norvegicus
cccaggttacgtcatcaagaggccc

SEQ ID NO: 667440 - DNA, 25 bp, Rattus norvegicus
cttcgcaaggcacccaggttacgtc

SEQ ID NO: 667441 - DNA, 25 bp, Rattus norvegicus
ttctcaagccggaaacagggcccgc

SEQ ID NO: 667442 - DNA, 25 bp, Rattus norvegicus
gtcgcctcagaaacgggacgaattc

SEQ ID NO: 667443 - DNA, 25 bp, Rattus norvegicus
tccctgcgcgatggctaactgccgg

SEQ ID NO: 667444 - DNA, 25 bp, Rattus norvegicus
cccagctagcgagggagaagacgcc

SEQ ID NO: 667445 - DNA, 25 bp, Rattus norvegicus
tagccgcgtcgcctaggcaacggct

SEQ ID NO: 667446 - DNA, 25 bp, Rattus norvegicus
gaacgtctgcgggtgtcgctcttcg

SEQ ID NO: 667447 - DNA, 25 bp, Rattus norvegicus
actgaagagaacgtctgcgggtgtc

SEQ ID NO: 667448 - DNA, 25 bp, Rattus norvegicus
gtagcaaggaactgaagagaacgtc

SEQ ID NO: 667449 - DNA, 25 bp, Rattus norvegicus
tcgcggagtagcaaggaactgaaga

SEQ ID NO: 667450 - DNA, 25 bp, Rattus norvegicus
ctgttattttatgagggttggtcgc

SEQ ID NO: 667451 - DNA, 25 bp, Rattus norvegicus
tctggagcctcactcgaaagttttc

SEQ ID NO: 667452 - DNA, 25 bp, Rattus norvegicus
ttacgcagctctggagcctcactcg

SEQ ID NO: 667453 - DNA, 25 bp, Rattus norvegicus
gcttttattcttacgcagctctgga

SEQ ID NO: 667454 - DNA, 25 bp, Rattus norvegicus
cgctttcggcttttattcttacgca

SEQ ID NO: 667455 - DNA, 25 bp, Rattus norvegicus
agctggtcctgcgacgccctctgac

SEQ ID NO: 667456 - DNA, 25 bp, Rattus norvegicus
ccttagcgcgagctacgcgggagtt

SEQ ID NO: 667457 - DNA, 25 bp, Rattus norvegicus
ttcggtagccgcgtcgcctaggcaa

SEQ ID NO: 667458 - DNA, 25 bp, Rattus norvegicus
tgggtgcgctttcggcttttattct

SEQ ID NO: 667459 - DNA, 25 bp, Rattus norvegicus
aggttctggacgctccctgccacat

SEQ ID NO: 667460 - DNA, 25 bp, Rattus norvegicus
ccatgctcactttgggcttgttgaa

SEQ ID NO: 667461 - DNA, 25 bp, Rattus norvegicus
gggtcacttcccgagggctttcaga

SEQ ID NO: 667462 - DNA, 25 bp, Rattus norvegicus
ggctttcagaaactgcggcccgcca

SEQ ID NO: 667463 - DNA, 25 bp, Rattus norvegicus
cccacttggcagacggcgaggctaa

SEQ ID NO: 667464 - DNA, 25 bp, Rattus norvegicus
ggcagcagccgaacccgaaggccga

SEQ ID NO: 667465 - DNA, 25 bp, Rattus norvegicus
tggaggcactcccaggttcgcataa

SEQ ID NO: 667466 - DNA, 25 bp, Rattus norvegicus
agcagcagccgaacccgaaggccga

SEQ ID NO: 667467 - DNA, 25 bp, Rattus norvegicus
gcagcccaggacagaacccggacaa

SEQ ID NO: 667468 - DNA, 25 bp, Rattus norvegicus
tcgacatcccggaagcaagctaagg

SEQ ID NO: 667469 - DNA, 25 bp, Rattus norvegicus
cttctagggcaaaagcggtcagggc

SEQ ID NO: 667470 - DNA, 25 bp, Rattus norvegicus
gccacgctcttttttaccgggctgc

SEQ ID NO: 667471 - DNA, 25 bp, Rattus norvegicus
gctaagacttagagaggaccgggca

SEQ ID NO: 667472 - DNA, 25 bp, Rattus norvegicus
tcccaggttcgcataagcagcagcc

SEQ ID NO: 667473 - DNA, 25 bp, Rattus norvegicus
agtgaccgcatccacgcagagcgtg

SEQ ID NO: 667474 - DNA, 25 bp, Rattus norvegicus
ccctggggtcatcagggctctaacc

SEQ ID NO: 667475 - DNA, 25 bp, Rattus norvegicus
ctgaggtctggaaagaaacacgcca

SEQ ID NO: 667476 - DNA, 25 bp, Rattus norvegicus
gtcttagtacaatcgagaaactgag

SEQ ID NO: 667477 - DNA, 25 bp, Rattus norvegicus
gcagagcgtgcacttaacactgttc

SEQ ID NO: 667478 - DNA, 25 bp, Rattus norvegicus
cacttggagagcgagagtgaccgca

SEQ ID NO: 667479 - DNA, 25 bp, Rattus norvegicus
tggacaaggcccgtacccacttgga

SEQ ID NO: 667480 - DNA, 25 bp, Rattus norvegicus
atgatggtagattgccaggtgagtt

SEQ ID NO: 667481 - DNA, 25 bp, Rattus norvegicus
ccctaaaaggccgtgagcgcggcga

SEQ ID NO: 667482 - DNA, 25 bp, Rattus norvegicus
agcagcgaggccctaaaaggccgtg

SEQ ID NO: 667483 - DNA, 25 bp, Rattus norvegicus
ctcagcgtcccgcaaggaaggaggt

SEQ ID NO: 667484 - DNA, 25 bp, Rattus norvegicus
gtctagtcctcagcgtcccgcaagg

SEQ ID NO: 667485 - DNA, 25 bp, Rattus norvegicus
gaccgtggacaccaggcggacgtcc

SEQ ID NO: 667486 - DNA, 25 bp, Rattus norvegicus
gttccaaccagtcttagtacaatcg

SEQ ID NO: 667487 - DNA, 25 bp, Rattus norvegicus
ctgatctctcctcgggtgcgatcct

SEQ ID NO: 667488 - DNA, 25 bp, Rattus norvegicus
cgttgggagagctcagagcccgccc

SEQ ID NO: 667489 - DNA, 25 bp, Rattus norvegicus
gggcgcactgaaacccgcactcgga

SEQ ID NO: 667490 - DNA, 25 bp, Rattus norvegicus
gcacggcggcgctcatcctgtgcat

SEQ ID NO: 667491 - DNA, 25 bp, Rattus norvegicus
gcggcgctcatcctgtgcatcctgt

SEQ ID NO: 667492 - DNA, 25 bp, Rattus norvegicus
cggtcttcgatgctttggagtcgga

SEQ ID NO: 667493 - DNA, 25 bp, Rattus norvegicus
agcgaggcgagttccgcagaaagta

SEQ ID NO: 667494 - DNA, 25 bp, Rattus norvegicus
ttccgcagaaagtaccgcttctccg

SEQ ID NO: 667495 - DNA, 25 bp, Rattus norvegicus
gaaagtaccgcttctccgccgacga

SEQ ID NO: 667496 - DNA, 25 bp, Rattus norvegicus
ccgccgacgactaccgcgagttgga

SEQ ID NO: 667497 - DNA, 25 bp, Rattus norvegicus
gacgactaccgcgagttggagcgcc

SEQ ID NO: 667498 - DNA, 25 bp, Rattus norvegicus
ccagtggcgcttcgcgggctctttc

SEQ ID NO: 667499 - DNA, 25 bp, Rattus norvegicus
agtcctgatctctcctcgggtgcga

SEQ ID NO: 667500 - DNA, 25 bp, Rattus norvegicus
atcacggtcatcaccaccatcggtg

SEQ ID NO: 667501 - DNA, 25 bp, Rattus norvegicus
ggccggtcctattatgcagcgcatg

SEQ ID NO: 667502 - DNA, 25 bp, Rattus norvegicus
ccaaggacattgaggacgtgtttta

SEQ ID NO: 667503 - DNA, 25 bp, Rattus norvegicus
gttcccgagtgagttagctttgcca

SEQ ID NO: 667504 - DNA, 25 bp, Rattus norvegicus
gtgttttacaaatacggcgctatcc

SEQ ID NO: 667505 - DNA, 25 bp, Rattus norvegicus
ggcgctatccgcgacatcgacctga

SEQ ID NO: 667506 - DNA, 25 bp, Rattus norvegicus
cctggactcagcaggattggtaata

SEQ ID NO: 667507 - DNA, 25 bp, Rattus norvegicus
cgagcgtacttctcagcacccgtta

SEQ ID NO: 667508 - DNA, 25 bp, Rattus norvegicus
cgcactgaaatggaatagccgcttc

SEQ ID NO: 667509 - DNA, 25 bp, Rattus norvegicus
ccgagctgataaaggcgccattttg

SEQ ID NO: 667510 - DNA, 25 bp, Rattus norvegicus
gcctcttttcgagtccgcgcttttc

SEQ ID NO: 667511 - DNA, 25 bp, Rattus norvegicus
ctgccgcatctacgtgggtaaccta

SEQ ID NO: 667512 - DNA, 25 bp, Rattus norvegicus
ggctccgaggccttaacataatggg

SEQ ID NO: 667513 - DNA, 25 bp, Rattus norvegicus
gggtaacctacctccagacatccga

SEQ ID NO: 667514 - DNA, 25 bp, Rattus norvegicus
cgcccttcgccttcgttgagttcga

SEQ ID NO: 667515 - DNA, 25 bp, Rattus norvegicus
agacttcgtggcgttgcagagagac

SEQ ID NO: 667516 - DNA, 25 bp, Rattus norvegicus
gtctgaacgcgctggtacggtgtct

SEQ ID NO: 667517 - DNA, 25 bp, Rattus norvegicus
gtctgctgctagcagccaagcgctg

SEQ ID NO: 667518 - DNA, 25 bp, Rattus norvegicus
cggccacacgtgtctgctgagaaca

SEQ ID NO: 667519 - DNA, 25 bp, Rattus norvegicus
gctgccttcgcgcacttcgagggct

SEQ ID NO: 667520 - DNA, 25 bp, Rattus norvegicus
agggctggaccttcttccacgccta

SEQ ID NO: 667521 - DNA, 25 bp, Rattus norvegicus
tacgtagccttcagcttcctctaca

SEQ ID NO: 667522 - DNA, 25 bp, Rattus norvegicus
ttcctctacatcctgctggggctca

SEQ ID NO: 667523 - DNA, 25 bp, Rattus norvegicus
ggggctcacagtcattggtgctttc

SEQ ID NO: 667524 - DNA, 25 bp, Rattus norvegicus
tggtgctttcctcaacctggtggtc

SEQ ID NO: 667525 - DNA, 25 bp, Rattus norvegicus
tcctgcgattccttgccagcgctga

SEQ ID NO: 667526 - DNA, 25 bp, Rattus norvegicus
ccctttcatccgctggagacctggg

SEQ ID NO: 667527 - DNA, 25 bp, Rattus norvegicus
gaagaagccgccctacgtagccttc

SEQ ID NO: 667528 - DNA, 25 bp, Rattus norvegicus
cagctctccgccgtgctagcgtgtt

SEQ ID NO: 667529 - DNA, 25 bp, Rattus norvegicus
agtagatggcgagcgcctcgaagga

SEQ ID NO: 667530 - DNA, 25 bp, Rattus norvegicus
agtaggatcgagagggcagcggagc

SEQ ID NO: 667531 - DNA, 25 bp, Rattus norvegicus
tccctggcttcaggacccggagaca

SEQ ID NO: 667532 - DNA, 25 bp, Rattus norvegicus
tggcttcaggacccggagacaaccc

SEQ ID NO: 667533 - DNA, 25 bp, Rattus norvegicus
tcacctgcgtcctcatcatcgaagg

SEQ ID NO: 667534 - DNA, 25 bp, Rattus norvegicus
ctgcgtcctcatcatcgaaggagtt

SEQ ID NO: 667535 - DNA, 25 bp, Rattus norvegicus
gtcctcatcatcgaaggagttcatg

SEQ ID NO: 667536 - DNA, 25 bp, Rattus norvegicus
cctcatcatcgaaggagttcatgca

SEQ ID NO: 667537 - DNA, 25 bp, Rattus norvegicus
tcatcgaaggagttcatgcacggga

SEQ ID NO: 667538 - DNA, 25 bp, Rattus norvegicus
ttcatgcacgggaagtagatggcga

SEQ ID NO: 667539 - DNA, 25 bp, Rattus norvegicus
gcttgggcagcttggccgccccatt

SEQ ID NO: 667540 - DNA, 25 bp, Rattus norvegicus
attcttgacgcggagtacggcgcgc

SEQ ID NO: 667541 - DNA, 25 bp, Rattus norvegicus
agagggccggacactggcggcgctt

SEQ ID NO: 667542 - DNA, 25 bp, Rattus norvegicus
cgaaggagttcatgcacgggaagta

SEQ ID NO: 667543 - DNA, 25 bp, Rattus norvegicus
tttgtgactttcaaaaattgaaatg

SEQ ID NO: 667544 - DNA, 25 bp, Rattus norvegicus
ggagccatccctctgggcctgtcaa

SEQ ID NO: 667545 - DNA, 25 bp, Rattus norvegicus
ctgggcctgtcaaccttgttcattc

SEQ ID NO: 667546 - DNA, 25 bp, Rattus norvegicus
tccgggaaggacgtagtcgctgccc

SEQ ID NO: 667547 - DNA, 25 bp, Rattus norvegicus
ccttgttcattctttgtgactttca

SEQ ID NO: 667548 - DNA, 25 bp, Rattus norvegicus
tctggagaccactgggccgcggact

SEQ ID NO: 667549 - DNA, 25 bp, Rattus norvegicus
cgggcctgcgtgtctggagaccact

SEQ ID NO: 667550 - DNA, 25 bp, Rattus norvegicus
tctctcttagcgctccgtacggggt

SEQ ID NO: 667551 - DNA, 25 bp, Rattus norvegicus
cggggcttctctcttagcgctccgt

SEQ ID NO: 667552 - DNA, 25 bp, Rattus norvegicus
tccctacagtcctccgcggtgagtg

SEQ ID NO: 667553 - DNA, 25 bp, Rattus norvegicus
ggaagcgcctttgctccctacagtc

SEQ ID NO: 667554 - DNA, 25 bp, Rattus norvegicus
tgcccttcgatcttcccggaagcgc

SEQ ID NO: 667555 - DNA, 25 bp, Rattus norvegicus
gacgtagtcgctgcccttcgatctt

SEQ ID NO: 667556 - DNA, 25 bp, Rattus norvegicus
aattgaaatgtagtcgaaggcgggc

SEQ ID NO: 667557 - DNA, 25 bp, Rattus norvegicus
tgggctcaagcccttaggtaggtcc

SEQ ID NO: 667558 - DNA, 25 bp, Rattus norvegicus
aggcctcgccgtactggccattgcg

SEQ ID NO: 667559 - DNA, 25 bp, Rattus norvegicus
gcgtactggccgttgcggaaactct

SEQ ID NO: 667560 - DNA, 25 bp, Rattus norvegicus
ctcttccacagagtctgagagtttg

SEQ ID NO: 667561 - DNA, 25 bp, Rattus norvegicus
ccggcaaacagggaccacctgcgtt

SEQ ID NO: 667562 - DNA, 25 bp, Rattus norvegicus
ctgagcagtgcgcaacagcttccgg

SEQ ID NO: 667563 - DNA, 25 bp, Rattus norvegicus
gatgcgtgcccttaaggcccgcagc

SEQ ID NO: 667564 - DNA, 25 bp, Rattus norvegicus
ggccattgcggaagttctggttgcc

SEQ ID NO: 667565 - DNA, 25 bp, Rattus norvegicus
gctgttccacagagtccgagacttt

SEQ ID NO: 667566 - DNA, 25 bp, Rattus norvegicus
gggactaacgcgtttccaagctctg

SEQ ID NO: 667567 - DNA, 25 bp, Rattus norvegicus
tttccaagctctggggtgcgcaaca

SEQ ID NO: 667568 - DNA, 25 bp, Rattus norvegicus
ggtgcgcaacagcttccacccggaa

SEQ ID NO: 667569 - DNA, 25 bp, Rattus norvegicus
ttaaggcccactgcagccggccttg

SEQ ID NO: 667570 - DNA, 25 bp, Rattus norvegicus
agctacggctgcgtgcctttaaggc

SEQ ID NO: 667571 - DNA, 25 bp, Rattus norvegicus
ctcctctcgcttccggtaggggcgg

SEQ ID NO: 667572 - DNA, 25 bp, Rattus norvegicus
cgtgcaagctcctgccgggcggaga

SEQ ID NO: 667573 - DNA, 25 bp, Rattus norvegicus
gtagaccccggcgtgcaagctcctg

SEQ ID NO: 667574 - DNA, 25 bp, Rattus norvegicus
gcgcgaacttgctcagggtagaccc

SEQ ID NO: 667575 - DNA, 25 bp, Rattus norvegicus
aaggcgcgaacttgctcagggtaga

SEQ ID NO: 667576 - DNA, 25 bp, Rattus norvegicus
actgaggaacccaccgcgcaggtga

SEQ ID NO: 667577 - DNA, 25 bp, Rattus norvegicus
gtgcaactgaggaacccaccgcgca

SEQ ID NO: 667578 - DNA, 25 bp, Rattus norvegicus
ggagaccgtgcaactgaggaaccca

SEQ ID NO: 667579 - DNA, 25 bp, Rattus norvegicus
gccatggagaccgtgcaactgagga

SEQ ID NO: 667580 - DNA, 25 bp, Rattus norvegicus
ctcccagaggatggagcattgaggc

SEQ ID NO: 667581 - DNA, 25 bp, Rattus norvegicus
tgactcacgccgatcagcccggcct

SEQ ID NO: 667582 - DNA, 25 bp, Rattus norvegicus
tgtaccacgtgactcacgccgatca

SEQ ID NO: 667583 - DNA, 25 bp, Rattus norvegicus
gcccgccactgtaccacgtgactca

SEQ ID NO: 667584 - DNA, 25 bp, Rattus norvegicus
cattgaggcagtctgggcggctgct

SEQ ID NO: 667585 - DNA, 25 bp, Rattus norvegicus
tggacacgcagctgaagagcttgct

SEQ ID NO: 667586 - DNA, 25 bp, Rattus norvegicus
atcgaagtagaactcgcgcgccgcc

SEQ ID NO: 667587 - DNA, 25 bp, Rattus norvegicus
acagctcgtccagcacatgcaagtg

SEQ ID NO: 667588 - DNA, 25 bp, Rattus norvegicus
tggccgaaggcgaagacgcacagct

SEQ ID NO: 667589 - DNA, 25 bp, Rattus norvegicus
ccagggttctccatggtgagccaga

SEQ ID NO: 667590 - DNA, 25 bp, Rattus norvegicus
tgaaccaggcgatgcagaagtactc

SEQ ID NO: 667591 - DNA, 25 bp, Rattus norvegicus
ggcgcgacgacacctcgaagctgaa

SEQ ID NO: 667592 - DNA, 25 bp, Rattus norvegicus
cgacacgatgtcgatgaggttgagc

SEQ ID NO: 667593 - DNA, 25 bp, Rattus norvegicus
atagaagggcagcaccgacacgatg

SEQ ID NO: 667594 - DNA, 25 bp, Rattus norvegicus
cgccggccagcagtgtgagatagaa

SEQ ID NO: 667595 - DNA, 25 bp, Rattus norvegicus
tgtaccacctttcctaggtctccga

SEQ ID NO: 667596 - DNA, 25 bp, Rattus norvegicus
cgcatgaggcgaaacacttgtacca

SEQ ID NO: 667597 - DNA, 25 bp, Rattus norvegicus
gccagcttgagcacgcggaagatgc

SEQ ID NO: 667598 - DNA, 25 bp, Rattus norvegicus
cacgtcggagatctcgtcgggacac

SEQ ID NO: 667599 - DNA, 25 bp, Rattus norvegicus
ctgaggccgcatcgatcgctgccgg

SEQ ID NO: 667600 - DNA, 25 bp, Rattus norvegicus
ttacctgcctcgacctccagggatt

SEQ ID NO: 667601 - DNA, 25 bp, Rattus norvegicus
acctccagggattccagcgcgctgt

SEQ ID NO: 667602 - DNA, 25 bp, Rattus norvegicus
tccagggattccagcgcgctgttac

SEQ ID NO: 667603 - DNA, 25 bp, Rattus norvegicus
ccagggattccagcgcgctgttacc

SEQ ID NO: 667604 - DNA, 25 bp, Rattus norvegicus
gattccagcgcgctgttaccccaag

SEQ ID NO: 667605 - DNA, 25 bp, Rattus norvegicus
cgctgttaccccaagtcgccgcccg

SEQ ID NO: 667606 - DNA, 25 bp, Rattus norvegicus
cgcccgggctgttttctgccctgag

SEQ ID NO: 667607 - DNA, 25 bp, Rattus norvegicus
cccgggctgttttctgccctgaggc

SEQ ID NO: 667608 - DNA, 25 bp, Rattus norvegicus
cgggctgttttctgccctgaggccc

SEQ ID NO: 667609 - DNA, 25 bp, Rattus norvegicus
ccgctgcgcctcactactgcggagg

SEQ ID NO: 667610 - DNA, 25 bp, Rattus norvegicus
ctgcgcctcactactgcggaggccc

SEQ ID NO: 667611 - DNA, 25 bp, Rattus norvegicus
cggctgaggccgcatcgatcgctgc

SEQ ID NO: 667612 - DNA, 25 bp, Rattus norvegicus
ctgtgttcccgtcccccgcggctga

SEQ ID NO: 667613 - DNA, 25 bp, Rattus norvegicus
cattcgcagggactccgaagctctg

SEQ ID NO: 667614 - DNA, 25 bp, Rattus norvegicus
tggtctcagagatcccttcacctgc

SEQ ID NO: 667615 - DNA, 25 bp, Rattus norvegicus
caaaggatatggttctgcgtcaggc

SEQ ID NO: 667616 - DNA, 25 bp, Rattus norvegicus
taaggaaaatttggtctcagagatc

SEQ ID NO: 667617 - DNA, 25 bp, Rattus norvegicus
tatggttctgcgtcaggctctcgag

SEQ ID NO: 667618 - DNA, 25 bp, Rattus norvegicus
agcgtgcgtccctggaactccacga

SEQ ID NO: 667619 - DNA, 25 bp, Rattus norvegicus
aggctttcgcattcgcagggactcc

SEQ ID NO: 667620 - DNA, 25 bp, Rattus norvegicus
ggctgctcggacagcatgcgaccct

SEQ ID NO: 667621 - DNA, 25 bp, Rattus norvegicus
cctggaactccacgaggctttcgca

SEQ ID NO: 667622 - DNA, 25 bp, Rattus norvegicus
tcacttccggctagccagctgattc

SEQ ID NO: 667623 - DNA, 25 bp, Rattus norvegicus
ctcgctggctgctcggacagcatgc

SEQ ID NO: 667624 - DNA, 25 bp, Rattus norvegicus
gacggtccaggctcgggctctgcct

SEQ ID NO: 667625 - DNA, 25 bp, Rattus norvegicus
ccagtgagcggttaaggaaaatttg

SEQ ID NO: 667626 - DNA, 25 bp, Rattus norvegicus
ggctagccagctgattctccagctc

SEQ ID NO: 667627 - DNA, 25 bp, Rattus norvegicus
ctcaggggacacgtcgaggaaatcc

SEQ ID NO: 667628 - DNA, 25 bp, Rattus norvegicus
cccacacgaggcacgttgaggtctc

SEQ ID NO: 667629 - DNA, 25 bp, Rattus norvegicus
ccctgcacctctgagaaactgtgct

SEQ ID NO: 667630 - DNA, 25 bp, Rattus norvegicus
aaactgtgctccaccatgtgacgca

SEQ ID NO: 667631 - DNA, 25 bp, Rattus norvegicus
atgtgacgcagtgccagccctgtca

SEQ ID NO: 667632 - DNA, 25 bp, Rattus norvegicus
gcgctccatgtactcgacggccaaa

SEQ ID NO: 667633 - DNA, 25 bp, Rattus norvegicus
tcgacggccaaaactgcctgcttca

SEQ ID NO: 667634 - DNA, 25 bp, Rattus norvegicus
actcagtgcgcacccggctagagaa

SEQ ID NO: 667635 - DNA, 25 bp, Rattus norvegicus
gcccaacacgtgtgccctcagggga

SEQ ID NO: 667636 - DNA, 25 bp, Rattus norvegicus
gtcgaggaaatccacaatctggttc

SEQ ID NO: 667637 - DNA, 25 bp, Rattus norvegicus
aatctggttcacgaagcgcttcacc

SEQ ID NO: 667638 - DNA, 25 bp, Rattus norvegicus
tcaccagctcgaagttctgtggacg

SEQ ID NO: 667639 - DNA, 25 bp, Rattus norvegicus
cagtgaacaccaatcccacacgagg

SEQ ID NO: 667640 - DNA, 25 bp, Rattus norvegicus
gagaactgcaccagcccaacacgtg

SEQ ID NO: 667641 - DNA, 25 bp, Rattus norvegicus
cagtggtgctgcacagcttcacgca

SEQ ID NO: 667642 - DNA, 25 bp, Rattus norvegicus
ctgtccagtggtgctgcacagcttc

SEQ ID NO: 667643 - DNA, 25 bp, Rattus norvegicus
acagctgtccagtggtgctgcacag

SEQ ID NO: 667644 - DNA, 25 bp, Rattus norvegicus
cagagcgcaggcagcgcggagccgc

SEQ ID NO: 667645 - DNA, 25 bp, Rattus norvegicus
tgctgcacagcttcacgcagctcga

SEQ ID NO: 667646 - DNA, 25 bp, Rattus norvegicus
cctgacagctgtccagtggtgctgc

SEQ ID NO: 667647 - DNA, 25 bp, Rattus norvegicus
cgtccctgacagctgtccagtggtg

SEQ ID NO: 667648 - DNA, 25 bp, Rattus norvegicus
tgggcgtccctgacagctgtccagt

SEQ ID NO: 667649 - DNA, 25 bp, Rattus norvegicus
gcgccgagccgttgtttcccggctc

SEQ ID NO: 667650 - DNA, 25 bp, Rattus norvegicus
tgggccgaggcgtccgggcccatag

SEQ ID NO: 667651 - DNA, 25 bp, Rattus norvegicus
agtcgtccatggtgcagcgcatgtg

SEQ ID NO: 667652 - DNA, 25 bp, Rattus norvegicus
caccgggagtcgtccatggtgcagc

SEQ ID NO: 667653 - DNA, 25 bp, Rattus norvegicus
cgcgccaccgggagtcgtccatggt

SEQ ID NO: 667654 - DNA, 25 bp, Rattus norvegicus
tggaggtgggtgaaccgaggtctaa

SEQ ID NO: 667655 - DNA, 25 bp, Rattus norvegicus
ccacatcccgcgaatagcgggtatc

SEQ ID NO: 667656 - DNA, 25 bp, Rattus norvegicus
gcgagcgtggttcccgtctgtaaac

SEQ ID NO: 667657 - DNA, 25 bp, Rattus norvegicus
taacccaagtcctaagcgatccctg

SEQ ID NO: 667658 - DNA, 25 bp, Rattus norvegicus
ctaagcgatccctggcagctggtcc

SEQ ID NO: 667659 - DNA, 25 bp, Rattus norvegicus
agctcctgcggtcccattgagcttg

SEQ ID NO: 667660 - DNA, 25 bp, Rattus norvegicus
ggtcccattgagcttggggaatccc

SEQ ID NO: 667661 - DNA, 25 bp, Rattus norvegicus
acctttcccggagcgcgtcttgcta

SEQ ID NO: 667662 - DNA, 25 bp, Rattus norvegicus
agcgcgtcttgctagtctcgctccg

SEQ ID NO: 667663 - DNA, 25 bp, Rattus norvegicus
ctcgaatgttcgctccggcccagtg

SEQ ID NO: 667664 - DNA, 25 bp, Rattus norvegicus
tcaccaccgggcggcccagagaaaa

SEQ ID NO: 667665 - DNA, 25 bp, Rattus norvegicus
gaatagcgggtatctctggcttctc

SEQ ID NO: 667666 - DNA, 25 bp, Rattus norvegicus
gtgcttgtgtgttgactttctgacc

SEQ ID NO: 667667 - DNA, 25 bp, Rattus norvegicus
gcgctttcgcgtcacctctcttttt

SEQ ID NO: 667668 - DNA, 25 bp, Rattus norvegicus
cgtcacctctctttttgtgtgtgtg

SEQ ID NO: 667669 - DNA, 25 bp, Rattus norvegicus
tctcgaactcgaaggggcgcacgct

SEQ ID NO: 667670 - DNA, 25 bp, Rattus norvegicus
atactggatcgccaggccggtcatg

SEQ ID NO: 667671 - DNA, 25 bp, Rattus norvegicus
catagatctcaataccgcgggcgcg

SEQ ID NO: 667672 - DNA, 25 bp, Rattus norvegicus
acttcggccactcggtcttgaggtc

SEQ ID NO: 667673 - DNA, 25 bp, Rattus norvegicus
acgatgaccaagacgcgcggcactc

SEQ ID NO: 667674 - DNA, 25 bp, Rattus norvegicus
ttcggcctcgctgaaggccacgttc

SEQ ID NO: 667675 - DNA, 25 bp, Rattus norvegicus
ggccacgttcatggcatactggatc

SEQ ID NO: 667676 - DNA, 25 bp, Rattus norvegicus
atgtcctcgcggttcgagaaggcgc

SEQ ID NO: 667677 - DNA, 25 bp, Rattus norvegicus
cccaggggaaagacgctctgcactt

SEQ ID NO: 667678 - DNA, 25 bp, Rattus norvegicus
ctgcacttggctagaatactggatc

SEQ ID NO: 667679 - DNA, 25 bp, Rattus norvegicus
tactggatcacaccaacgcgcgtgg

SEQ ID NO: 667680 - DNA, 25 bp, Rattus norvegicus
cgttcagacccacgtccaggctgtg

SEQ ID NO: 667681 - DNA, 25 bp, Rattus norvegicus
ggaactgcctcatggtctcgaactc

SEQ ID NO: 667682 - DNA, 25 bp, Rattus norvegicus
tggaggaggcccacaaggaactgcc

SEQ ID NO: 667683 - DNA, 25 bp, Rattus norvegicus
aattcggctacagctggagtcgggc

SEQ ID NO: 667684 - DNA, 25 bp, Rattus norvegicus
cctaggagtgatgaaagaccgagac

SEQ ID NO: 667685 - DNA, 25 bp, Rattus norvegicus
ttgccctccgttgtccctaggagtg

SEQ ID NO: 667686 - DNA, 25 bp, Rattus norvegicus
tacacgagacacttcccagaggaga

SEQ ID NO: 667687 - DNA, 25 bp, Rattus norvegicus
cgacacttcgggcagccggaatgct

SEQ ID NO: 667688 - DNA, 25 bp, Rattus norvegicus
agctgcaggctggaattcggctaca

SEQ ID NO: 667689 - DNA, 25 bp, Rattus norvegicus
agctgcatttaacctggagcgggcg

SEQ ID NO: 667690 - DNA, 25 bp, Rattus norvegicus
gagcccaagcggcagctgcatttaa

SEQ ID NO: 667691 - DNA, 25 bp, Rattus norvegicus
tgccagacagctagggcgagcccaa

SEQ ID NO: 667692 - DNA, 25 bp, Rattus norvegicus
cttgccctaagtggggaatgccaga

SEQ ID NO: 667693 - DNA, 25 bp, Rattus norvegicus
ccagcctcctgggtagttggaccag

SEQ ID NO: 667694 - DNA, 25 bp, Rattus norvegicus
ggctacagaacgacgggcccagcct

SEQ ID NO: 667695 - DNA, 25 bp, Rattus norvegicus
gacagctcagaggtgcggctacaga

SEQ ID NO: 667696 - DNA, 25 bp, Rattus norvegicus
agccggaatgctctggaatcctaca

SEQ ID NO: 667697 - DNA, 25 bp, Rattus norvegicus
aagagcctgcccctgacgcagatgc

SEQ ID NO: 667698 - DNA, 25 bp, Rattus norvegicus
gatgatcgggtagcaacttccatgc

SEQ ID NO: 667699 - DNA, 25 bp, Rattus norvegicus
tgatcgggtagcaacttccatgccc

SEQ ID NO: 667700 - DNA, 25 bp, Rattus norvegicus
agccctcgttccttggtgtgcgtag

SEQ ID NO: 667701 - DNA, 25 bp, Rattus norvegicus
tcgttccttggtgtgcgtagtgcca

SEQ ID NO: 667702 - DNA, 25 bp, Rattus norvegicus
ccttggtgtgcgtagtgccagatgt

SEQ ID NO: 667703 - DNA, 25 bp, Rattus norvegicus
cgtagtgccagatgtggcggccttc

SEQ ID NO: 667704 - DNA, 25 bp, Rattus norvegicus
ccttcggcagcgactggcgttggct

SEQ ID NO: 667705 - DNA, 25 bp, Rattus norvegicus
actggcgttggctgcgcactcccat

SEQ ID NO: 667706 - DNA, 25 bp, Rattus norvegicus
ttggctgcgcactcccatcacggtg

SEQ ID NO: 667707 - DNA, 25 bp, Rattus norvegicus
atcacggtgcccgtgagcctgctgc

SEQ ID NO: 667708 - DNA, 25 bp, Rattus norvegicus
tgctgcgcgctgacgcgctcttcta

SEQ ID NO: 667709 - DNA, 25 bp, Rattus norvegicus
cggccacggccacccaacgcccaag

SEQ ID NO: 667710 - DNA, 25 bp, Rattus norvegicus
cccggaatacagcacgcggccacgg

SEQ ID NO: 667711 - DNA, 25 bp, Rattus norvegicus
gggaaacctccgaggagcaacagca

SEQ ID NO: 667712 - DNA, 25 bp, Rattus norvegicus
aaccagtggcccgagcggacgcgca

SEQ ID NO: 667713 - DNA, 25 bp, Rattus norvegicus
cagcagcggcgcaaacaggcagaca

SEQ ID NO: 667714 - DNA, 25 bp, Rattus norvegicus
gcagacaggcgccatggttccaaca

SEQ ID NO: 667715 - DNA, 25 bp, Rattus norvegicus
gacaggcgccatggttccaacagca

SEQ ID NO: 667716 - DNA, 25 bp, Rattus norvegicus
ggcgccatggttccaacagcacaaa

SEQ ID NO: 667717 - DNA, 25 bp, Rattus norvegicus
cgcaaacaggcagacaggcgccatg

SEQ ID NO: 667718 - DNA, 25 bp, Rattus norvegicus
agcacaaaccagtggcccgagcgga

SEQ ID NO: 667719 - DNA, 25 bp, Rattus norvegicus
tgctgcgccaggcaagctggaaacc

SEQ ID NO: 667720 - DNA, 25 bp, Rattus norvegicus
caggcaagctggaaaccacgggcgt

SEQ ID NO: 667721 - DNA, 25 bp, Rattus norvegicus
agcgtgccctcaggctccgaactga

SEQ ID NO: 667722 - DNA, 25 bp, Rattus norvegicus
ggctccgaactgaccccgatctgtg

SEQ ID NO: 667723 - DNA, 25 bp, Rattus norvegicus
cggggacccgcccacagcgtgccct

SEQ ID NO: 667724 - DNA, 25 bp, Rattus norvegicus
ggttccaacagcacaaaccagtggc

SEQ ID NO: 667725 - DNA, 25 bp, Rattus norvegicus
cctgcgcatgtgcatagtttatttc

SEQ ID NO: 667726 - DNA, 25 bp, Rattus norvegicus
agtttcagaagtccaccgcctaggc

SEQ ID NO: 667727 - DNA, 25 bp, Rattus norvegicus
ccggctgaagctccgtgtgtcttcc

SEQ ID NO: 667728 - DNA, 25 bp, Rattus norvegicus
cagttccgcagctacgtgtgggacc

SEQ ID NO: 667729 - DNA, 25 bp, Rattus norvegicus
tgtgggaccctttgctgattctgtc

SEQ ID NO: 667730 - DNA, 25 bp, Rattus norvegicus
ctgtcgcagatcgtgctcatgcaga

SEQ ID NO: 667731 - DNA, 25 bp, Rattus norvegicus
acagtctactatggctctctgggcc

SEQ ID NO: 667732 - DNA, 25 bp, Rattus norvegicus
tgtgccttacttccgtttgccttca

SEQ ID NO: 667733 - DNA, 25 bp, Rattus norvegicus
ggctattttcatgggcccacttgga

SEQ ID NO: 667734 - DNA, 25 bp, Rattus norvegicus
cgcttccttcgctgatagccgtgtg

SEQ ID NO: 667735 - DNA, 25 bp, Rattus norvegicus
gtgtgccgcagctattcagcctctc

SEQ ID NO: 667736 - DNA, 25 bp, Rattus norvegicus
tcttccgctccatggtcctgtctgt

SEQ ID NO: 667737 - DNA, 25 bp, Rattus norvegicus
gcaagatccacggttttgtgcctta

SEQ ID NO: 667738 - DNA, 25 bp, Rattus norvegicus
gcagcccgtccctggaccagatgtt

SEQ ID NO: 667739 - DNA, 25 bp, Rattus norvegicus
agctgaggtaatccaagaacccggg

SEQ ID NO: 667740 - DNA, 25 bp, Rattus norvegicus
agggaattctttgcctcttgcctcc

SEQ ID NO: 667741 - DNA, 25 bp, Rattus norvegicus
gcaagtacgggtcccggcgttcaga

SEQ ID NO: 667742 - DNA, 25 bp, Rattus norvegicus
gatgcgtgcgggaacttttcgcccg

SEQ ID NO: 667743 - DNA, 25 bp, Rattus norvegicus
agtcgaagagcatcaagtgtgcgtg

SEQ ID NO: 667744 - DNA, 25 bp, Rattus norvegicus
cgctgctctggagtcgaagagcatc

SEQ ID NO: 667745 - DNA, 25 bp, Rattus norvegicus
cgtaaccgcgaccagggtgatcgag

SEQ ID NO: 667746 - DNA, 25 bp, Rattus norvegicus
cttctggagaagtgtgcgcgtaacc

SEQ ID NO: 667747 - DNA, 25 bp, Rattus norvegicus
tcgaccgaggcaatgcacttgactc

SEQ ID NO: 667748 - DNA, 25 bp, Rattus norvegicus
ggtccttaggccagctgaggtaatc

SEQ ID NO: 667749 - DNA, 25 bp, Rattus norvegicus
ctctggagcacctcgaagtgttggc

SEQ ID NO: 667750 - DNA, 25 bp, Rattus norvegicus
ctggacgtctggcatctctggagca

SEQ ID NO: 667751 - DNA, 25 bp, Rattus norvegicus
agcgcacccagcgagccagaaggcg

SEQ ID NO: 667752 - DNA, 25 bp, Rattus norvegicus
aatgcacttgactcgctgggcggca

SEQ ID NO: 667753 - DNA, 25 bp, Rattus norvegicus
gccacctttagtgggcgcaggcgct

SEQ ID NO: 667754 - DNA, 25 bp, Rattus norvegicus
tgcgtgggccctcaagccagctctt

SEQ ID NO: 667755 - DNA, 25 bp, Rattus norvegicus
cactccttcacgctgggtcggcaat

SEQ ID NO: 667756 - DNA, 25 bp, Rattus norvegicus
ctgggtcggcaatctctagcattcg

SEQ ID NO: 667757 - DNA, 25 bp, Rattus norvegicus
caatctctagcattcgaggaccaac

SEQ ID NO: 667758 - DNA, 25 bp, Rattus norvegicus
ggacggcaccggaagttctttctca

SEQ ID NO: 667759 - DNA, 25 bp, Rattus norvegicus
gcttcctattggatggccaccttta

SEQ ID NO: 667760 - DNA, 25 bp, Rattus norvegicus
ctgccatgccgctgggtttatcgtt

SEQ ID NO: 667761 - DNA, 25 bp, Rattus norvegicus
ggtttatcgttgctgttgctggtgc

SEQ ID NO: 667762 - DNA, 25 bp, Rattus norvegicus
acgcgacagcctgcgagaggaactc

SEQ ID NO: 667763 - DNA, 25 bp, Rattus norvegicus
gaggaactcgttatcactccgctgc

SEQ ID NO: 667764 - DNA, 25 bp, Rattus norvegicus
cacattccagttccgcacgcgttgg

SEQ ID NO: 667765 - DNA, 25 bp, Rattus norvegicus
acgcgttgggattccgatctgcagc

SEQ ID NO: 667766 - DNA, 25 bp, Rattus norvegicus
tctcacccgcgcttcctattggatg

SEQ ID NO: 667767 - DNA, 25 bp, Rattus norvegicus
gatcgagaaaaccactcagacgcgg

SEQ ID NO: 667768 - DNA, 25 bp, Rattus norvegicus
gtcacggcgccgctttccggtgact

SEQ ID NO: 667769 - DNA, 25 bp, Rattus norvegicus
tagcaaccctcggagcacccgcatc

SEQ ID NO: 667770 - DNA, 25 bp, Rattus norvegicus
gcggcagttcggttcccatagcaac

SEQ ID NO: 667771 - DNA, 25 bp, Rattus norvegicus
actcagacgcggctcctaggcggca

SEQ ID NO: 667772 - DNA, 25 bp, Rattus norvegicus
gtgccctacaccaaagatcgagaaa

SEQ ID NO: 667773 - DNA, 25 bp, Rattus norvegicus
cgacgtcgtgccctacaccaaagat

SEQ ID NO: 667774 - DNA, 25 bp, Rattus norvegicus
ttttctcccagagatccggaagccc

SEQ ID NO: 667775 - DNA, 25 bp, Rattus norvegicus
cagccgtttttctcccagagatccg

SEQ ID NO: 667776 - DNA, 25 bp, Rattus norvegicus
gccctcgtcctttgactgaatggac

SEQ ID NO: 667777 - DNA, 25 bp, Rattus norvegicus
cgccgctttccggtgactgagtcga

SEQ ID NO: 667778 - DNA, 25 bp, Rattus norvegicus
tttgactgaatggacccgaacaccc

SEQ ID NO: 667779 - DNA, 25 bp, Rattus norvegicus
tggctcgggcgctcccgtgacgtca

SEQ ID NO: 667780 - DNA, 25 bp, Rattus norvegicus
ctttccggtgactgagtcgagctga

SEQ ID NO: 667781 - DNA, 25 bp, Rattus norvegicus
tctccgtgccagcacctctgggatg

SEQ ID NO: 667782 - DNA, 25 bp, Rattus norvegicus
gtacacacgtggacccttcctttga

SEQ ID NO: 667783 - DNA, 25 bp, Rattus norvegicus
tgaccctttaatggtcggcgtcgtc

SEQ ID NO: 667784 - DNA, 25 bp, Rattus norvegicus
gcgtcgtccaaaggccaccaatctg

SEQ ID NO: 667785 - DNA, 25 bp, Rattus norvegicus
tctgccacctattcgttagttaatg

SEQ ID NO: 667786 - DNA, 25 bp, Rattus norvegicus
aatggcagccttcttcaccaatcgg

SEQ ID NO: 667787 - DNA, 25 bp, Rattus norvegicus
tcaccaatcggctatccgaagtacg

SEQ ID NO: 667788 - DNA, 25 bp, Rattus norvegicus
gccgtccaatcgcagtgcattactg

SEQ ID NO: 667789 - DNA, 25 bp, Rattus norvegicus
tgcattactgggtggcctagcagtt

SEQ ID NO: 667790 - DNA, 25 bp, Rattus norvegicus
gcagagcaatcctgggcgtcccatt

SEQ ID NO: 667791 - DNA, 25 bp, Rattus norvegicus
gggcgtcccattggctggatcaaac

SEQ ID NO: 667792 - DNA, 25 bp, Rattus norvegicus
tggatcaaacccaagcgagcctctg

SEQ ID NO: 667793 - DNA, 25 bp, Rattus norvegicus
cgcagcaggagggttacaattcaaa

SEQ ID NO: 667794 - DNA, 25 bp, Rattus norvegicus
ttacaattcaaacgcgggcggcggc

SEQ ID NO: 667795 - DNA, 25 bp, Rattus norvegicus
cccaggtgccttcgcttgatgggcg

SEQ ID NO: 667796 - DNA, 25 bp, Rattus norvegicus
ccttcgcttgatgggcggccggctc

SEQ ID NO: 667797 - DNA, 25 bp, Rattus norvegicus
ggctcaccctgcgaccgccctgttc

SEQ ID NO: 667798 - DNA, 25 bp, Rattus norvegicus
cgccaggcgcaagtgcaggccattt

SEQ ID NO: 667799 - DNA, 25 bp, Rattus norvegicus
aagtgcaggccatttgccaagagtc

SEQ ID NO: 667800 - DNA, 25 bp, Rattus norvegicus
gccatttgccaagagtcgcccactg

SEQ ID NO: 667801 - DNA, 25 bp, Rattus norvegicus
gagtcgcccactgccagcgccagct

SEQ ID NO: 667802 - DNA, 25 bp, Rattus norvegicus
agcgccagctgctggtagccagccg

SEQ ID NO: 667803 - DNA, 25 bp, Rattus norvegicus
gtagccagccggctgagaacccgca

SEQ ID NO: 667804 - DNA, 25 bp, Rattus norvegicus
ctgagaacccgcagagcaggtcgaa

SEQ ID NO: 667805 - DNA, 25 bp, Rattus norvegicus
acccgcagagcaggtcgaacttcgc

SEQ ID NO: 667806 - DNA, 25 bp, Rattus norvegicus
caggtcgaacttcgcccggcactga

SEQ ID NO: 667807 - DNA, 25 bp, Rattus norvegicus
ggcactgagccacccaagcctccgg

SEQ ID NO: 667808 - DNA, 25 bp, Rattus norvegicus
cttctttccatacccagcggctccg

SEQ ID NO: 667809 - DNA, 25 bp, Rattus norvegicus
tagcatgggaatgcacagaggagac

SEQ ID NO: 667810 - DNA, 25 bp, Rattus norvegicus
acagaggagactgtcccagtgtctt

SEQ ID NO: 667811 - DNA, 25 bp, Rattus norvegicus
tcccagtgtcttcagatgcccctta

SEQ ID NO: 667812 - DNA, 25 bp, Rattus norvegicus
ccttatccctcgcaaccacattgac

SEQ ID NO: 667813 - DNA, 25 bp, Rattus norvegicus
cgcaaccacattgacctctcgaccc

SEQ ID NO: 667814 - DNA, 25 bp, Rattus norvegicus
ggaatgcacagaggagactgtccca

SEQ ID NO: 667815 - DNA, 25 bp, Rattus norvegicus
attcctgcttcccatcctggggaga

SEQ ID NO: 667816 - DNA, 25 bp, Rattus norvegicus
tcctgcttcccatcctggggagagg

SEQ ID NO: 667817 - DNA, 25 bp, Rattus norvegicus
gcttcccatcctggggagagggtct

SEQ ID NO: 667818 - DNA, 25 bp, Rattus norvegicus
atgggaatgcacagaggagactgtc

SEQ ID NO: 667819 - DNA, 25 bp, Rattus norvegicus
cggtccgtgcagatagcatgggaat

SEQ ID NO: 667820 - DNA, 25 bp, Rattus norvegicus
tccgtgcagatagcatgggaatgca

SEQ ID NO: 667821 - DNA, 25 bp, Rattus norvegicus
tgcagatagcatgggaatgcacaga

SEQ ID NO: 667822 - DNA, 25 bp, Rattus norvegicus
tgcacagaggagactgtcccagtgt

SEQ ID NO: 667823 - DNA, 25 bp, Rattus norvegicus
tgcaactgcgccgtcagtcaccgtg

SEQ ID NO: 667824 - DNA, 25 bp, Rattus norvegicus
agtcaccgtgctgcaactgcgccgt

SEQ ID NO: 667825 - DNA, 25 bp, Rattus norvegicus
cgtgctgcaactgcgccagtcagtc

SEQ ID NO: 667826 - DNA, 25 bp, Rattus norvegicus
gcgccagtcagtcaccgtgctgcaa

SEQ ID NO: 667827 - DNA, 25 bp, Rattus norvegicus
accgtgctgcaactgcgccgtcagt

SEQ ID NO: 667828 - DNA, 25 bp, Rattus norvegicus
agtcaccgtgctgcaactgcgccag

SEQ ID NO: 667829 - DNA, 25 bp, Rattus norvegicus
gtgctgcaactgcgccgtcagtcac

SEQ ID NO: 667830 - DNA, 25 bp, Rattus norvegicus
gcaactgcgccagtcagtcactttg

SEQ ID NO: 667831 - DNA, 25 bp, Rattus norvegicus
agtcactttgctgcaactgcgccag

SEQ ID NO: 667832 - DNA, 25 bp, Rattus norvegicus
gccagtcagtcaccgtgctgcaact

SEQ ID NO: 667833 - DNA, 25 bp, Rattus norvegicus
gcaactgcgccagtcagtcaccgtg

SEQ ID NO: 667834 - DNA, 25 bp, Rattus norvegicus
aactgcgccgtcagtcaccgtgctg

SEQ ID NO: 667835 - DNA, 25 bp, Rattus norvegicus
tttgctgcaactgcgccagtcagtc

SEQ ID NO: 667836 - DNA, 25 bp, Rattus norvegicus
cgtcagtcaccgtgctgcaactgcg

SEQ ID NO: 667837 - DNA, 25 bp, Rattus norvegicus
cgccctgaacgcacttgggaccggg

SEQ ID NO: 667838 - DNA, 25 bp, Rattus norvegicus
ctgcctgggcggagagcctcttaaa

SEQ ID NO: 667839 - DNA, 25 bp, Rattus norvegicus
cctgggcggagagcctcttaaagcc

SEQ ID NO: 667840 - DNA, 25 bp, Rattus norvegicus
tgggcggagagcctcttaaagccgc

SEQ ID NO: 667841 - DNA, 25 bp, Rattus norvegicus
ttaaagccgcggaccgctgcaccaa

SEQ ID NO: 667842 - DNA, 25 bp, Rattus norvegicus
gagcccgccctgaacgcacttggga

SEQ ID NO: 667843 - DNA, 25 bp, Rattus norvegicus
ccctgaacgcacttgggaccgggtg

SEQ ID NO: 667844 - DNA, 25 bp, Rattus norvegicus
gattctaacagctccgagagaggga

SEQ ID NO: 667845 - DNA, 25 bp, Rattus norvegicus
gaagtcttggctcgccgggctaccc

SEQ ID NO: 667846 - DNA, 25 bp, Rattus norvegicus
gctcgccgggctaccctccgcgttc

SEQ ID NO: 667847 - DNA, 25 bp, Rattus norvegicus
accctccgcgttcctcccgcacgca

SEQ ID NO: 667848 - DNA, 25 bp, Rattus norvegicus
gcgttcctcccgcacgcaggggccc

SEQ ID NO: 667849 - DNA, 25 bp, Rattus norvegicus
cgggattctaacagctccgagagag

SEQ ID NO: 667850 - DNA, 25 bp, Rattus norvegicus
ggaccgctgcaccaaatcccgggag

SEQ ID NO: 667851 - DNA, 25 bp, Rattus norvegicus
ctggctttgacattttcactgcttg

SEQ ID NO: 667852 - DNA, 25 bp, Rattus norvegicus
ttcactgcttgctgcagatgagaga

SEQ ID NO: 667853 - DNA, 25 bp, Rattus norvegicus
cagatgagagaaacgcggaaactta

SEQ ID NO: 667854 - DNA, 25 bp, Rattus norvegicus
cggaaacttatataggcacccagcg

SEQ ID NO: 667855 - DNA, 25 bp, Rattus norvegicus
aatccctagggtttccgtgtgcgag

SEQ ID NO: 667856 - DNA, 25 bp, Rattus norvegicus
tccgtgtgcgagacgcagattctga

SEQ ID NO: 667857 - DNA, 25 bp, Rattus norvegicus
ctggtgaccagcacactacgcaggt

SEQ ID NO: 667858 - DNA, 25 bp, Rattus norvegicus
tcgaggttgagcacgctggtgacca

SEQ ID NO: 667859 - DNA, 25 bp, Rattus norvegicus
tcttcatctagaggctcgaggttga

SEQ ID NO: 667860 - DNA, 25 bp, Rattus norvegicus
cgccggctacctgtagagatcttca

SEQ ID NO: 667861 - DNA, 25 bp, Rattus norvegicus
tgcgagcctagtttagaggtgccgc

SEQ ID NO: 667862 - DNA, 25 bp, Rattus norvegicus
cgactctactgaaacaagggtgcga

SEQ ID NO: 667863 - DNA, 25 bp, Rattus norvegicus
gcatctcctaggtcctctggctttg

SEQ ID NO: 667864 - DNA, 25 bp, Rattus norvegicus
tcggcgtcgccattagcatctccta

SEQ ID NO: 667865 - DNA, 25 bp, Rattus norvegicus
ctaggctggacgtcagtcagtcgga

SEQ ID NO: 667866 - DNA, 25 bp, Rattus norvegicus
tccgctgggcttgaaaacgaatctc

SEQ ID NO: 667867 - DNA, 25 bp, Rattus norvegicus
ccagtgggagaaatggctgctgcgt

SEQ ID NO: 667868 - DNA, 25 bp, Rattus norvegicus
cgtgaaaccggtcgcagcggttagt

SEQ ID NO: 667869 - DNA, 25 bp, Rattus norvegicus
tcgcagcggttagtgcatacagttt

SEQ ID NO: 667870 - DNA, 25 bp, Rattus norvegicus
cagcggttagtgcatacagtttcca

SEQ ID NO: 667871 - DNA, 25 bp, Rattus norvegicus
ttagtgcatacagtttccaccagtg

SEQ ID NO: 667872 - DNA, 25 bp, Rattus norvegicus
tgcatacagtttccaccagtggaag

SEQ ID NO: 667873 - DNA, 25 bp, Rattus norvegicus
accagtggaaggtggatttcgactc

SEQ ID NO: 667874 - DNA, 25 bp, Rattus norvegicus
tggaaggtggatttcgactccgctg

SEQ ID NO: 667875 - DNA, 25 bp, Rattus norvegicus
ttcgactccgctgggcttgaaaacg

SEQ ID NO: 667876 - DNA, 25 bp, Rattus norvegicus
aaaacgaatctcagccttccgcgtc

SEQ ID NO: 667877 - DNA, 25 bp, Rattus norvegicus
tgaaaacgaatctcagccttccgcg

SEQ ID NO: 667878 - DNA, 25 bp, Rattus norvegicus
attggctaggctggacgtcagtcag

SEQ ID NO: 667879 - DNA, 25 bp, Rattus norvegicus
gtcaggcagtgaaaactcgggtaca

SEQ ID NO: 667880 - DNA, 25 bp, Rattus norvegicus
tccatccggatgttggctccgtgca

SEQ ID NO: 667881 - DNA, 25 bp, Rattus norvegicus
agcacacaccgtgggcgaaactctc

SEQ ID NO: 667882 - DNA, 25 bp, Rattus norvegicus
tctccactagaaatacctgaccggg

SEQ ID NO: 667883 - DNA, 25 bp, Rattus norvegicus
ctcgggtacagaagccagactggcc

SEQ ID NO: 667884 - DNA, 25 bp, Rattus norvegicus
cccagctgtggccaaggctgaccaa

SEQ ID NO: 667885 - DNA, 25 bp, Rattus norvegicus
cgcgtgatagcgaagacccagctgt

SEQ ID NO: 667886 - DNA, 25 bp, Rattus norvegicus
ctgcctctgcttctgtttgaccttc

SEQ ID NO: 667887 - DNA, 25 bp, Rattus norvegicus
ttcggaactgctggatgcgcaaata

SEQ ID NO: 667888 - DNA, 25 bp, Rattus norvegicus
aggcagcacgttttgttcatagagc

SEQ ID NO: 667889 - DNA, 25 bp, Rattus norvegicus
gcagaagagaacacccaggcggcta

SEQ ID NO: 667890 - DNA, 25 bp, Rattus norvegicus
gatgatgtgcatgtcagcggtccca

SEQ ID NO: 667891 - DNA, 25 bp, Rattus norvegicus
ggacccatgtcctctccgttgatga

SEQ ID NO: 667892 - DNA, 25 bp, Rattus norvegicus
gccaagacgtagatgcccgcaccag

SEQ ID NO: 667893 - DNA, 25 bp, Rattus norvegicus
ccaggatgaaatcgattgcctcccg

SEQ ID NO: 667894 - DNA, 25 bp, Rattus norvegicus
caggaaccgcagcaccgaagcgcaa

SEQ ID NO: 667895 - DNA, 25 bp, Rattus norvegicus
cgcagcaccgaagcgcaaaggatct

SEQ ID NO: 667896 - DNA, 25 bp, Rattus norvegicus
ccgaagcgcaaaggatctggggaac

SEQ ID NO: 667897 - DNA, 25 bp, Rattus norvegicus
cgcaaaggatctggggaactggtaa

SEQ ID NO: 667898 - DNA, 25 bp, Rattus norvegicus
atctggggaactggtaaacatcctc

SEQ ID NO: 667899 - DNA, 25 bp, Rattus norvegicus
ggaactggtaaacatcctccaccga

SEQ ID NO: 667900 - DNA, 25 bp, Rattus norvegicus
ggtaaacatcctccaccgatgcttc

SEQ ID NO: 667901 - DNA, 25 bp, Rattus norvegicus
accgatgcttccttccgcagatgcc

SEQ ID NO: 667902 - DNA, 25 bp, Rattus norvegicus
actgtctccactgctcctgctgctg

SEQ ID NO: 667903 - DNA, 25 bp, Rattus norvegicus
tgctgctcctatcctgggcgtcccg

SEQ ID NO: 667904 - DNA, 25 bp, Rattus norvegicus
cgtcccgggacgaagcagctccgga

SEQ ID NO: 667905 - DNA, 25 bp, Rattus norvegicus
tccggaccaggatgaaatcgattgc

SEQ ID NO: 667906 - DNA, 25 bp, Rattus norvegicus
agcagctccggaccaggatgaaatc

SEQ ID NO: 667907 - DNA, 25 bp, Rattus norvegicus
ccgaggttccaagcacgataatact

SEQ ID NO: 667908 - DNA, 25 bp, Rattus norvegicus
ccgcagaggtgactcggatcttgca

SEQ ID NO: 667909 - DNA, 25 bp, Rattus norvegicus
gggcacctgccagaagcgctaggaa

SEQ ID NO: 667910 - DNA, 25 bp, Rattus norvegicus
tctgggcggctcaaaaccactcttt

SEQ ID NO: 667911 - DNA, 25 bp, Rattus norvegicus
accactctttggacgtgcaactaga

SEQ ID NO: 667912 - DNA, 25 bp, Rattus norvegicus
tttgcctgatgcgaaaccgaggttc

SEQ ID NO: 667913 - DNA, 25 bp, Rattus norvegicus
ctgctgcgtgacgagtttggatctc

SEQ ID NO: 667914 - DNA, 25 bp, Rattus norvegicus
tatggcgacaaccacaagcgcattc

SEQ ID NO: 667915 - DNA, 25 bp, Rattus norvegicus
ttcctgcctagtggcttgaggtctc

SEQ ID NO: 667916 - DNA, 25 bp, Rattus norvegicus
agtctctgctgtagggcatacggtc

SEQ ID NO: 667917 - DNA, 25 bp, Rattus norvegicus
cccacctggttttagtgagccacgc

SEQ ID NO: 667918 - DNA, 25 bp, Rattus norvegicus
gggtccagccgcctttataagtctg

SEQ ID NO: 667919 - DNA, 25 bp, Rattus norvegicus
aagcccgactgctgtctggacaaga

SEQ ID NO: 667920 - DNA, 25 bp, Rattus norvegicus
gggacactcggaaccaatcatcttg

SEQ ID NO: 667921 - DNA, 25 bp, Rattus norvegicus
gttcgtaggctactctgcgtttctc

SEQ ID NO: 667922 - DNA, 25 bp, Rattus norvegicus
ccgcaaaagtcgtgatggcagtacg

SEQ ID NO: 667923 - DNA, 25 bp, Rattus norvegicus
ggtcaaatggttctgccgcaaaagt

SEQ ID NO: 667924 - DNA, 25 bp, Rattus norvegicus
cgagagtgcacagaacgctagacta

SEQ ID NO: 667925 - DNA, 25 bp, Rattus norvegicus
cgtttctcagactttggtatgcgtg

SEQ ID NO: 667926 - DNA, 25 bp, Rattus norvegicus
gcgcagatactcttgtttgttcgta

SEQ ID NO: 667927 - DNA, 25 bp, Rattus norvegicus
ctgagttccgctggttgcgcagata

SEQ ID NO: 667928 - DNA, 25 bp, Rattus norvegicus
cggatgcattctctcgcctgagttc

SEQ ID NO: 667929 - DNA, 25 bp, Rattus norvegicus
tgattggtacagtgggaagcgctcc

SEQ ID NO: 667930 - DNA, 25 bp, Rattus norvegicus
caccagacccggagcattatgattg

SEQ ID NO: 667931 - DNA, 25 bp, Rattus norvegicus
agtccgcttcgagcaggtaagaacc

SEQ ID NO: 667932 - DNA, 25 bp, Rattus norvegicus
ggtaccaacgcatgcgcagcgcaga

SEQ ID NO: 667933 - DNA, 25 bp, Rattus norvegicus
cgaggtccttcagaggcggtaccaa

SEQ ID NO: 667934 - DNA, 25 bp, Rattus norvegicus
ccggaagacacagccttagtgaata

SEQ ID NO: 667935 - DNA, 25 bp, Rattus norvegicus
gtgacgtcacgcaggtcccatccta

SEQ ID NO: 667936 - DNA, 25 bp, Rattus norvegicus
ctgccggatgatacgaccatggttg

SEQ ID NO: 667937 - DNA, 25 bp, Rattus norvegicus
ccatggttgcaacaagtggtccacc

SEQ ID NO: 667938 - DNA, 25 bp, Rattus norvegicus
cggacaagcaggacccacacagatg

SEQ ID NO: 667939 - DNA, 25 bp, Rattus norvegicus
gcccattccgcagatgcacagactg

SEQ ID NO: 667940 - DNA, 25 bp, Rattus norvegicus
ttccagaaaagaacagggacgcctg

SEQ ID NO: 667941 - DNA, 25 bp, Rattus norvegicus
ggtgagtgatcacgaccctttgctc

SEQ ID NO: 667942 - DNA, 25 bp, Rattus norvegicus
tttgctcctcccagaggcgtgaatc

SEQ ID NO: 667943 - DNA, 25 bp, Rattus norvegicus
cctcggatgaggagccaatggtaca

SEQ ID NO: 667944 - DNA, 25 bp, Rattus norvegicus
gctgtcactaacctgagcctctggc

SEQ ID NO: 667945 - DNA, 25 bp, Rattus norvegicus
ttgcggagtttcagaaggtctctca

SEQ ID NO: 667946 - DNA, 25 bp, Rattus norvegicus
tctcagaggactcagaaccgtcgtc

SEQ ID NO: 667947 - DNA, 25 bp, Rattus norvegicus
ggactactttctctcgtggcggatg

SEQ ID NO: 667948 - DNA, 25 bp, Rattus norvegicus
tcgtcgggcccaaaaggactctaga

SEQ ID NO: 667949 - DNA, 25 bp, Rattus norvegicus
agggacccgctgtttccaagccaca

SEQ ID NO: 667950 - DNA, 25 bp, Rattus norvegicus
aaggattcgcgactcggagcagctc

SEQ ID NO: 667951 - DNA, 25 bp, Rattus norvegicus
cccttcaggtgtatcaaagtcgcag

SEQ ID NO: 667952 - DNA, 25 bp, Rattus norvegicus
aaagtcgcagcgcagcgggaagttc

SEQ ID NO: 667953 - DNA, 25 bp, Rattus norvegicus
cgggaagttcagcttcgaatatgtc

SEQ ID NO: 667954 - DNA, 25 bp, Rattus norvegicus
ttcgaatatgtctcagcaggctttg

SEQ ID NO: 667955 - DNA, 25 bp, Rattus norvegicus
gcaggctttgtgaataaattagttt

SEQ ID NO: 667956 - DNA, 25 bp, Rattus norvegicus
ttattttcctctaacacgctacgga

SEQ ID NO: 667957 - DNA, 25 bp, Rattus norvegicus
tctaacacgctacggaggtggagct

SEQ ID NO: 667958 - DNA, 25 bp, Rattus norvegicus
cggcgctggagctcagtatgcaaat

SEQ ID NO: 667959 - DNA, 25 bp, Rattus norvegicus
cagtatgcaaatgtatgcagatatc

SEQ ID NO: 667960 - DNA, 25 bp, Rattus norvegicus
gcagatatcgaaatgaggctgccta

SEQ ID NO: 667961 - DNA, 25 bp, Rattus norvegicus
aggctgcctaaggattcgcgactcg

SEQ ID NO: 667962 - DNA, 25 bp, Rattus norvegicus
aggtgtatcaaagtcgcagcgcagc

SEQ ID NO: 667963 - DNA, 25 bp, Rattus norvegicus
ggccgtcgcgagtttgagtcctcgc

SEQ ID NO: 667964 - DNA, 25 bp, Rattus norvegicus
gagaaagttcagaatgtgctgtccc

SEQ ID NO: 667965 - DNA, 25 bp, Rattus norvegicus
acccggctggagaaagttcagaatg

SEQ ID NO: 667966 - DNA, 25 bp, Rattus norvegicus
tccgcgacccggctggagaaagttc

SEQ ID NO: 667967 - DNA, 25 bp, Rattus norvegicus
ctcagccttttctggtcccacccgg

SEQ ID NO: 667968 - DNA, 25 bp, Rattus norvegicus
accggtccgctcagccttttctggt

SEQ ID NO: 667969 - DNA, 25 bp, Rattus norvegicus
gtgttcaccggtccgctcagccttt

SEQ ID NO: 667970 - DNA, 25 bp, Rattus norvegicus
gctgggagctgaactccttttaggg

SEQ ID NO: 667971 - DNA, 25 bp, Rattus norvegicus
tcgcgagtttgagtcctcgcgcggt

SEQ ID NO: 667972 - DNA, 25 bp, Rattus norvegicus
gggcttgcctttattccttccgcgc

SEQ ID NO: 667973 - DNA, 25 bp, Rattus norvegicus
agcctgttcgtctcgggtctctgct

SEQ ID NO: 667974 - DNA, 25 bp, Rattus norvegicus
cccggttccccgctttgtatgatca

SEQ ID NO: 667975 - DNA, 25 bp, Rattus norvegicus
tttgtatgatcaccctcccggcttc

SEQ ID NO: 667976 - DNA, 25 bp, Rattus norvegicus
tcgtttcctgctcccgccgtgttca

SEQ ID NO: 667977 - DNA, 25 bp, Rattus norvegicus
gcagacattgtcatccagtttggtg

SEQ ID NO: 667978 - DNA, 25 bp, Rattus norvegicus
agcggatccattcggtgtagctgtt

SEQ ID NO: 667979 - DNA, 25 bp, Rattus norvegicus
cgggctcgaagcagacattgtcatc

SEQ ID NO: 667980 - DNA, 25 bp, Rattus norvegicus
cttcacccgcgtgtacgggctcgaa

SEQ ID NO: 667981 - DNA, 25 bp, Rattus norvegicus
gagcgcggtgacaccgctcaccttc

SEQ ID NO: 667982 - DNA, 25 bp, Rattus norvegicus
gtgatcgatgactccttcgcgcgcg

SEQ ID NO: 667983 - DNA, 25 bp, Rattus norvegicus
gcgagacgtgatcgatgactccttc

SEQ ID NO: 667984 - DNA, 25 bp, Rattus norvegicus
acttgccgcgagacgtgatcgatga

SEQ ID NO: 667985 - DNA, 25 bp, Rattus norvegicus
aaagctacaccgaagacttgccgcg

SEQ ID NO: 667986 - DNA, 25 bp, Rattus norvegicus
caacgccggcttttcacctccagga

SEQ ID NO: 667987 - DNA, 25 bp, Rattus norvegicus
ttccatttgtgattcctgcatgccc

SEQ ID NO: 667988 - DNA, 25 bp, Rattus norvegicus
cgcccacttccatttgtgattcctg

SEQ ID NO: 667989 - DNA, 25 bp, Rattus norvegicus
gatccattcggtgtagctgttgccc

SEQ ID NO: 667990 - DNA, 25 bp, Rattus norvegicus
cattgtcatccagtttggtgtcgcg

SEQ ID NO: 667991 - DNA, 25 bp, Rattus norvegicus
ctctcagcctctccacctggcttcg

SEQ ID NO: 667992 - DNA, 25 bp, Rattus norvegicus
tgggacacgtgtcaggaagccagca

SEQ ID NO: 667993 - DNA, 25 bp, Rattus norvegicus
gcctctccacctggcttcgcctctc

SEQ ID NO: 667994 - DNA, 25 bp, Rattus norvegicus
ttcgcctctccaccgggcttcgtcc

SEQ ID NO: 667995 - DNA, 25 bp, Rattus norvegicus
cgcgcacatggtcccctgtcaaatt

SEQ ID NO: 667996 - DNA, 25 bp, Rattus norvegicus
atggtcccctgtcaaattccgggcg

SEQ ID NO: 667997 - DNA, 25 bp, Rattus norvegicus
ctccgtgggacacgtgtcaggaagc

SEQ ID NO: 667998 - DNA, 25 bp, Rattus norvegicus
acacgtgtcaggaagccagcagcgc

SEQ ID NO: 667999 - DNA, 25 bp, Rattus norvegicus
acgtgtcaggaagccagcagcgccg

SEQ ID NO: 668000 - DNA, 25 bp, Rattus norvegicus
cagcagcgccgcaggtcccgtgtaa

SEQ ID NO: 668001 - DNA, 25 bp, Rattus norvegicus
agcgccgcaggtcccgtgtaaccat

SEQ ID NO: 668002 - DNA, 25 bp, Rattus norvegicus
ccgcaggtcccgtgtaaccatggaa

SEQ ID NO: 668003 - DNA, 25 bp, Rattus norvegicus
cgtgtaaccatggaaacggaggcca

SEQ ID NO: 668004 - DNA, 25 bp, Rattus norvegicus
caggtcccgtgtaaccatggaaacg

SEQ ID NO: 668005 - DNA, 25 bp, Rattus norvegicus
ccgaggttcggctcacactgagatc

SEQ ID NO: 668006 - DNA, 25 bp, Rattus norvegicus
tgtgatccgggcgagcagagtccat

SEQ ID NO: 668007 - DNA, 25 bp, Rattus norvegicus
gcgagcagagtccattcagcacctt

SEQ ID NO: 668008 - DNA, 25 bp, Rattus norvegicus
agcagagtccattcagcaccttgga

SEQ ID NO: 668009 - DNA, 25 bp, Rattus norvegicus
caccttggacagagccagcggattt

SEQ ID NO: 668010 - DNA, 25 bp, Rattus norvegicus
acagagccagcggatttgtccgagg

SEQ ID NO: 668011 - DNA, 25 bp, Rattus norvegicus
ttgtccgaggtggtagtacttcatc

SEQ ID NO: 668012 - DNA, 25 bp, Rattus norvegicus
gtggtagtacttcatccaggtattc

SEQ ID NO: 668013 - DNA, 25 bp, Rattus norvegicus
ccaggtattcttttcctcgctgtca

SEQ ID NO: 668014 - DNA, 25 bp, Rattus norvegicus
ttcttttcctcgctgtcaagccaac

SEQ ID NO: 668015 - DNA, 25 bp, Rattus norvegicus
agcgtcttttccgaggttcggctca

SEQ ID NO: 668016 - DNA, 25 bp, Rattus norvegicus
tcggctcacactgagatcggggctg

SEQ ID NO: 668017 - DNA, 25 bp, Rattus norvegicus
agagagtcagattttggagcggagc

SEQ ID NO: 668018 - DNA, 25 bp, Rattus norvegicus
cctcgctgtcaagccaacccggtgt

SEQ ID NO: 668019 - DNA, 25 bp, Rattus norvegicus
ctggtagcctaacagggagtggaga

SEQ ID NO: 668020 - DNA, 25 bp, Rattus norvegicus
gcggctggaccgagccaccaatcag

SEQ ID NO: 668021 - DNA, 25 bp, Rattus norvegicus
ctggaccgagccaccaatcagcggg

SEQ ID NO: 668022 - DNA, 25 bp, Rattus norvegicus
gagccaccaatcagcggggcgcgca

SEQ ID NO: 668023 - DNA, 25 bp, Rattus norvegicus
ccaggcgagcgaggttgtgtccact

SEQ ID NO: 668024 - DNA, 25 bp, Rattus norvegicus
cctgggtggcctggtagcctaacag

SEQ ID NO: 668025 - DNA, 25 bp, Rattus norvegicus
agggattggggataaactagactcg

SEQ ID NO: 668026 - DNA, 25 bp, Rattus norvegicus
attggggataaactagactcgggct

SEQ ID NO: 668027 - DNA, 25 bp, Rattus norvegicus
ataaactagactcgggctgggagcc

SEQ ID NO: 668028 - DNA, 25 bp, Rattus norvegicus
gagcgagccgctgcgctgtcctcca

SEQ ID NO: 668029 - DNA, 25 bp, Rattus norvegicus
tccagcctctcttccgggagttcag

SEQ ID NO: 668030 - DNA, 25 bp, Rattus norvegicus
tctcttccgggagttcagggacttg

SEQ ID NO: 668031 - DNA, 25 bp, Rattus norvegicus
cttccgggagttcagggacttgcgt

SEQ ID NO: 668032 - DNA, 25 bp, Rattus norvegicus
cacctgggtggcctggtagcctaac

SEQ ID NO: 668033 - DNA, 25 bp, Rattus norvegicus
atcccggcaaggaaaaggcgcgtcg

SEQ ID NO: 668034 - DNA, 25 bp, Rattus norvegicus
cggcgctgtctgaccaatcgaagct

SEQ ID NO: 668035 - DNA, 25 bp, Rattus norvegicus
tgatgagaccgggttccctcagctc

SEQ ID NO: 668036 - DNA, 25 bp, Rattus norvegicus
ccgcctggcaggctttgatgagacc

SEQ ID NO: 668037 - DNA, 25 bp, Rattus norvegicus
ccaagggaagaggacgacttgcgcc

SEQ ID NO: 668038 - DNA, 25 bp, Rattus norvegicus
tgcgccatgggagcaaagcctgcgt

SEQ ID NO: 668039 - DNA, 25 bp, Rattus norvegicus
ccaccgctgctttggggcagacgag

SEQ ID NO: 668040 - DNA, 25 bp, Rattus norvegicus
ggaccaggagcgtgacaacaatgtg

SEQ ID NO: 668041 - DNA, 25 bp, Rattus norvegicus
caatgtgactccactgccggggatc

SEQ ID NO: 668042 - DNA, 25 bp, Rattus norvegicus
tccgagagctttgtgtggaccctga

SEQ ID NO: 668043 - DNA, 25 bp, Rattus norvegicus
gactgagaagttgtgggaccgcata

SEQ ID NO: 668044 - DNA, 25 bp, Rattus norvegicus
gcataacttcggcttcaccttcgtc

SEQ ID NO: 668045 - DNA, 25 bp, Rattus norvegicus
tcccttcagtgcgagagaaaaagcc

SEQ ID NO: 668046 - DNA, 25 bp, Rattus norvegicus
ccggcttggagaaggaaaccgcctg

SEQ ID NO: 668047 - DNA, 25 bp, Rattus norvegicus
cggaccgggttgctcccgactgtgt

SEQ ID NO: 668048 - DNA, 25 bp, Rattus norvegicus
tttgcgcctctcttccataggatcc

SEQ ID NO: 668049 - DNA, 25 bp, Rattus norvegicus
tgagcttgctgcgtttcttatctgc

SEQ ID NO: 668050 - DNA, 25 bp, Rattus norvegicus
cgtttcttatctgcgcgcttctgct

SEQ ID NO: 668051 - DNA, 25 bp, Rattus norvegicus
ttctgctctcgcatctccatggctt

SEQ ID NO: 668052 - DNA, 25 bp, Rattus norvegicus
ctctcgcatctccatggcttctttg

SEQ ID NO: 668053 - DNA, 25 bp, Rattus norvegicus
catggcttctttgcgcatctgtttg

SEQ ID NO: 668054 - DNA, 25 bp, Rattus norvegicus
ctcttccataggatccttggccttc

SEQ ID NO: 668055 - DNA, 25 bp, Rattus norvegicus
cataggatccttggccttcccgggg

SEQ ID NO: 668056 - DNA, 25 bp, Rattus norvegicus
ctgagggatcgtgatcgggtacact

SEQ ID NO: 668057 - DNA, 25 bp, Rattus norvegicus
cgtgatcgggtacactcagatagac

SEQ ID NO: 668058 - DNA, 25 bp, Rattus norvegicus
cactcagatagaccgaagcagcttc

SEQ ID NO: 668059 - DNA, 25 bp, Rattus norvegicus
cttccgaaggctcgggcgaagaagt

SEQ ID NO: 668060 - DNA, 25 bp, Rattus norvegicus
aagcagcttccgaaggctcgggcga

SEQ ID NO: 668061 - DNA, 25 bp, Rattus norvegicus
gcattttgtgattattcgctgagcc

SEQ ID NO: 668062 - DNA, 25 bp, Rattus norvegicus
gccatcgccattacctactggcaaa

SEQ ID NO: 668063 - DNA, 25 bp, Rattus norvegicus
ctactggcaaaatgacggcggtgtg

SEQ ID NO: 668064 - DNA, 25 bp, Rattus norvegicus
tgccgcgtttgtatgctctgagagc

SEQ ID NO: 668065 - DNA, 25 bp, Rattus norvegicus
tctgagagcggcacaacaaaagacc

SEQ ID NO: 668066 - DNA, 25 bp, Rattus norvegicus
cctgtcctgagttcctctgcagatc

SEQ ID NO: 668067 - DNA, 25 bp, Rattus norvegicus
agatcccagacctaaaagcattttg

SEQ ID NO: 668068 - DNA, 25 bp, Rattus norvegicus
gattattcgctgagcccaccgggca

SEQ ID NO: 668069 - DNA, 25 bp, Rattus norvegicus
attcgctgagcccaccgggcaacgg

SEQ ID NO: 668070 - DNA, 25 bp, Rattus norvegicus
cgggcaacgggactatttatctcct

SEQ ID NO: 668071 - DNA, 25 bp, Rattus norvegicus
gactatttatctcctgcagctctga

SEQ ID NO: 668072 - DNA, 25 bp, Rattus norvegicus
tttatctcctgcagctctgagccca

SEQ ID NO: 668073 - DNA, 25 bp, Rattus norvegicus
cgcgggctttgtggccgcgcttaat

SEQ ID NO: 668074 - DNA, 25 bp, Rattus norvegicus
tgagttcctctgcagatcccagacc

SEQ ID NO: 668075 - DNA, 25 bp, Rattus norvegicus
ctctggctagagaaaaagcgaggaa

SEQ ID NO: 668076 - DNA, 25 bp, Rattus norvegicus
acgattttcgagacgaatcggcacg

SEQ ID NO: 668077 - DNA, 25 bp, Rattus norvegicus
tcacgtgtcccagcaacgcaagaga

SEQ ID NO: 668078 - DNA, 25 bp, Rattus norvegicus
cagcaacgcaagagagctcgcgctc

SEQ ID NO: 668079 - DNA, 25 bp, Rattus norvegicus
ctcgcgctctctctggctagagaaa

SEQ ID NO: 668080 - DNA, 25 bp, Rattus norvegicus
agcgaggaagagagactcggaatca

SEQ ID NO: 668081 - DNA, 25 bp, Rattus norvegicus
gacggagctgaacgtccctacgagg

SEQ ID NO: 668082 - DNA, 25 bp, Rattus norvegicus
cttacccaaagtcgggagcagctgg

SEQ ID NO: 668083 - DNA, 25 bp, Rattus norvegicus
tcccagagccggctcagcactgaga

SEQ ID NO: 668084 - DNA, 25 bp, Rattus norvegicus
ggctcagcactgagaccggcgtcct

SEQ ID NO: 668085 - DNA, 25 bp, Rattus norvegicus
accggcgtcctctggcggcagagaa

SEQ ID NO: 668086 - DNA, 25 bp, Rattus norvegicus
ggcggcagagaaagagttctactta

SEQ ID NO: 668087 - DNA, 25 bp, Rattus norvegicus
agagttctacttacgattttcgaga

SEQ ID NO: 668088 - DNA, 25 bp, Rattus norvegicus
ctcggaatcagtccgggagagaaga

SEQ ID NO: 668089 - DNA, 25 bp, Rattus norvegicus
ggctgtcagatctcctaacttcgca

SEQ ID NO: 668090 - DNA, 25 bp, Rattus norvegicus
gagcagcctatgcaggtcctctggt

SEQ ID NO: 668091 - DNA, 25 bp, Rattus norvegicus
ccctgcttgagattggcagagcctc

SEQ ID NO: 668092 - DNA, 25 bp, Rattus norvegicus
gtcgacgacgacaccgctgtcaata

SEQ ID NO: 668093 - DNA, 25 bp, Rattus norvegicus
tgatggcccgcccatcgaagtctcg

SEQ ID NO: 668094 - DNA, 25 bp, Rattus norvegicus
agccgagacaggaaacagccctatc

SEQ ID NO: 668095 - DNA, 25 bp, Rattus norvegicus
ccactgcagaggaggcaaaagtccc

SEQ ID NO: 668096 - DNA, 25 bp, Rattus norvegicus
tccggactcagctacacacgcagtt

SEQ ID NO: 668097 - DNA, 25 bp, Rattus norvegicus
acgcagttcttcagatcggtcctga

SEQ ID NO: 668098 - DNA, 25 bp, Rattus norvegicus
ctgcttctgaagatgcgggcccaga

SEQ ID NO: 668099 - DNA, 25 bp, Rattus norvegicus
ctgccgagtccgaagacaacagaga

SEQ ID NO: 668100 - DNA, 25 bp, Rattus norvegicus
gtccctgacaccgaagccgagtctg

SEQ ID NO: 668101 - DNA, 25 bp, Rattus norvegicus
gtccctggagcctcagcgatgtcag

SEQ ID NO: 668102 - DNA, 25 bp, Rattus norvegicus
attggcagaccattccgcgaggctg

SEQ ID NO: 668103 - DNA, 25 bp, Rattus norvegicus
agctgttacagatgaacctggaggc

SEQ ID NO: 668104 - DNA, 25 bp, Rattus norvegicus
ttcaaccaggccatggacgacttca

SEQ ID NO: 668105 - DNA, 25 bp, Rattus norvegicus
tgtcagcgcctacgaggacagctcg

SEQ ID NO: 668106 - DNA, 25 bp, Rattus norvegicus
ggatgccaccatagaccagctgtta

SEQ ID NO: 668107 - DNA, 25 bp, Rattus norvegicus
aacagcggcgcggtggatgccacca

SEQ ID NO: 668108 - DNA, 25 bp, Rattus norvegicus
tgagtgcgtgctgcgtgccaacagc

SEQ ID NO: 668109 - DNA, 25 bp, Rattus norvegicus
tacgacatcattgagtgcgtgctgc

SEQ ID NO: 668110 - DNA, 25 bp, Rattus norvegicus
gacgacttcaagacgatgtttccta

SEQ ID NO: 668111 - DNA, 25 bp, Rattus norvegicus
gtgcgccgcctggagttcaaccagg

SEQ ID NO: 668112 - DNA, 25 bp, Rattus norvegicus
accagcctgtttcgcaggagcagca

SEQ ID NO: 668113 - DNA, 25 bp, Rattus norvegicus
ctccgcaagatgaccagcctgtttc

SEQ ID NO: 668114 - DNA, 25 bp, Rattus norvegicus
tggaaacattctcccacagcggctc

SEQ ID NO: 668115 - DNA, 25 bp, Rattus norvegicus
cggcttctcggtttgttggaaacat

SEQ ID NO: 668116 - DNA, 25 bp, Rattus norvegicus
gtttcctaacatggactacgacatc

SEQ ID NO: 668117 - DNA, 25 bp, Rattus norvegicus
cttgtatcgataagccggcaagcta

SEQ ID NO: 668118 - DNA, 25 bp, Rattus norvegicus
ttctgctctgtatcgggaatacgtc

SEQ ID NO: 668119 - DNA, 25 bp, Rattus norvegicus
tgagggaccggccatcgcccttctg

SEQ ID NO: 668120 - DNA, 25 bp, Rattus norvegicus
cattcagggatgagggaccggccat

SEQ ID NO: 668121 - DNA, 25 bp, Rattus norvegicus
cgcagtcccgggcattcagggatga

SEQ ID NO: 668122 - DNA, 25 bp, Rattus norvegicus
tattgatctgccgtcgcagtcccgg

SEQ ID NO: 668123 - DNA, 25 bp, Rattus norvegicus
ggtgttccgacgagtattgatctgc

SEQ ID NO: 668124 - DNA, 25 bp, Rattus norvegicus
gtccacattaaaccaccttgtatcg

SEQ ID NO: 668125 - DNA, 25 bp, Rattus norvegicus
cgggaatacgtcaggaccgtccaca

SEQ ID NO: 668126 - DNA, 25 bp, Rattus norvegicus
ggcaagctaaaatacacccgccatg

SEQ ID NO: 668127 - DNA, 25 bp, Rattus norvegicus
acccgccatggtgtgattgatcgct

SEQ ID NO: 668128 - DNA, 25 bp, Rattus norvegicus
tggtgtgattgatcgctgcgtatta

SEQ ID NO: 668129 - DNA, 25 bp, Rattus norvegicus
cgctgcgtattaaccgaggttatta

SEQ ID NO: 668130 - DNA, 25 bp, Rattus norvegicus
gtcaggaccgtccacattaaaccac

SEQ ID NO: 668131 - DNA, 25 bp, Rattus norvegicus
gtgcacagcagcttccttggtcgtc

SEQ ID NO: 668132 - DNA, 25 bp, Rattus norvegicus
cgccactgctaaccagagagcctgg

SEQ ID NO: 668133 - DNA, 25 bp, Rattus norvegicus
ccaagctaggcctgaccaggaaccg

SEQ ID NO: 668134 - DNA, 25 bp, Rattus norvegicus
ccaggaaccgcaaaaacgctctcta

SEQ ID NO: 668135 - DNA, 25 bp, Rattus norvegicus
gaaccagcccagaccaagaactaga

SEQ ID NO: 668136 - DNA, 25 bp, Rattus norvegicus
agaactagacacagactacagcttg

SEQ ID NO: 668137 - DNA, 25 bp, Rattus norvegicus
actacagcttggactgggacccgtt

SEQ ID NO: 668138 - DNA, 25 bp, Rattus norvegicus
acccgttcggccctagcgagcaata

SEQ ID NO: 668139 - DNA, 25 bp, Rattus norvegicus
ctgtcgagccggtttccagaacccg

SEQ ID NO: 668140 - DNA, 25 bp, Rattus norvegicus
cagaacccgtattccgggtgccaag

SEQ ID NO: 668141 - DNA, 25 bp, Rattus norvegicus
tgccaagcgggttagctcacccgca

SEQ ID NO: 668142 - DNA, 25 bp, Rattus norvegicus
ggccctgaagctagcgtgcacagca

SEQ ID NO: 668143 - DNA, 25 bp, Rattus norvegicus
gcttccttggtcgtcggatccgata

SEQ ID NO: 668144 - DNA, 25 bp, Rattus norvegicus
aatacgcggaccctcaccgaggacg

SEQ ID NO: 668145 - DNA, 25 bp, Rattus norvegicus
caccgcgttgccgtcggaaccaaga

SEQ ID NO: 668146 - DNA, 25 bp, Rattus norvegicus
aatgacccagccactcagttcgagg

SEQ ID NO: 668147 - DNA, 25 bp, Rattus norvegicus
gttcgaggctcgacagcgctcctct

SEQ ID NO: 668148 - DNA, 25 bp, Rattus norvegicus
tcctcacagacctgtcaggactgca

SEQ ID NO: 668149 - DNA, 25 bp, Rattus norvegicus
ggagctcgctccagtgaactgcgga

SEQ ID NO: 668150 - DNA, 25 bp, Rattus norvegicus
tcggttaacacctcgggccgcactg

SEQ ID NO: 668151 - DNA, 25 bp, Rattus norvegicus
tcgcgccaccgagagacaccttggg

SEQ ID NO: 668152 - DNA, 25 bp, Rattus norvegicus
acaccttgggccttgtcttgaagtc

SEQ ID NO: 668153 - DNA, 25 bp, Rattus norvegicus
cttgaagtcgccttcgaagctgaac

SEQ ID NO: 668154 - DNA, 25 bp, Rattus norvegicus
tgtccacgctgcttaatccacggcg

SEQ ID NO: 668155 - DNA, 25 bp, Rattus norvegicus
ggaaccaagatggtgaccgcccgca

SEQ ID NO: 668156 - DNA, 25 bp, Rattus norvegicus
gccggctttggcgtcatcatcaata

SEQ ID NO: 668157 - DNA, 25 bp, Rattus norvegicus
cggtgcacgtgtttccagggcaaaa

SEQ ID NO: 668158 - DNA, 25 bp, Rattus norvegicus
aagctgaacatcttcgccgcctatc

SEQ ID NO: 668159 - DNA, 25 bp, Rattus norvegicus
cggatccacggagtgcgttagcaaa

SEQ ID NO: 668160 - DNA, 25 bp, Rattus norvegicus
gccgaactccggtcgtaggatgtta

SEQ ID NO: 668161 - DNA, 25 bp, Rattus norvegicus
aggaccgcgggcaacatcagagcac

SEQ ID NO: 668162 - DNA, 25 bp, Rattus norvegicus
cgtctcgctggacttggaatccttc

SEQ ID NO: 668163 - DNA, 25 bp, Rattus norvegicus
ctcctccatgctttacagaaaatcc

SEQ ID NO: 668164 - DNA, 25 bp, Rattus norvegicus
gctcggagccaagccacgttcggat

SEQ ID NO: 668165 - DNA, 25 bp, Rattus norvegicus
cgttagcaaatcaccagtctccggg

SEQ ID NO: 668166 - DNA, 25 bp, Rattus norvegicus
ggcgattcaaccgaggctggtcctg

SEQ ID NO: 668167 - DNA, 25 bp, Rattus norvegicus
agacgcacccggctctagatggtca

SEQ ID NO: 668168 - DNA, 25 bp, Rattus norvegicus
tctagatggtcaccgcactcagccg

SEQ ID NO: 668169 - DNA, 25 bp, Rattus norvegicus
cgagctcatgcaggcagcgcgccgt

SEQ ID NO: 668170 - DNA, 25 bp, Rattus norvegicus
caggcgccagcacgcacatggaagc

SEQ ID NO: 668171 - DNA, 25 bp, Rattus norvegicus
tagcctcgcggccagagacgcatgg

SEQ ID NO: 668172 - DNA, 25 bp, Rattus norvegicus
gccgatcggtggcacacagcgagcc

SEQ ID NO: 668173 - DNA, 25 bp, Rattus norvegicus
gtctgtccgtctgcccgtgggctgc

SEQ ID NO: 668174 - DNA, 25 bp, Rattus norvegicus
aggatcgcaccgcaccgggtggaca

SEQ ID NO: 668175 - DNA, 25 bp, Rattus norvegicus
gcttacaaaggagggaaaatgcggc

SEQ ID NO: 668176 - DNA, 25 bp, Rattus norvegicus
tgcgctggaccagtttcgcgaagtt

SEQ ID NO: 668177 - DNA, 25 bp, Rattus norvegicus
ctggaccagtttcgcgaagttgccc

SEQ ID NO: 668178 - DNA, 25 bp, Rattus norvegicus
tcgcccagatgtgcgacctcattga

SEQ ID NO: 668179 - DNA, 25 bp, Rattus norvegicus
ctcattgaaccgcagccggccgaga

SEQ ID NO: 668180 - DNA, 25 bp, Rattus norvegicus
ccggccgagaagatcggcaagatga

SEQ ID NO: 668181 - DNA, 25 bp, Rattus norvegicus
atcggcaagatgaagaagttgagga

SEQ ID NO: 668182 - DNA, 25 bp, Rattus norvegicus
agaagttgaggagaactttgtccga

SEQ ID NO: 668183 - DNA, 25 bp, Rattus norvegicus
tttgtccgagagtttcagccgcatc

SEQ ID NO: 668184 - DNA, 25 bp, Rattus norvegicus
tttcagccgcatcggtgagtgtggt

SEQ ID NO: 668185 - DNA, 25 bp, Rattus norvegicus
tcggggccaacaaggatcgcaccgc

SEQ ID NO: 668186 - DNA, 25 bp, Rattus norvegicus
ccgcgcggctctggcttacaaagga

SEQ ID NO: 668187 - DNA, 25 bp, Rattus norvegicus
ttctggaccagcaatccgcagcacg

SEQ ID NO: 668188 - DNA, 25 bp, Rattus norvegicus
ccgcgcttcatgaaccgcaagtttc

SEQ ID NO: 668189 - DNA, 25 bp, Rattus norvegicus
ggcacgggcgagaaccagatctccc

SEQ ID NO: 668190 - DNA, 25 bp, Rattus norvegicus
gccgagcttggaactttgtgccgta

SEQ ID NO: 668191 - DNA, 25 bp, Rattus norvegicus
agggctactgctgcttctttggctg

SEQ ID NO: 668192 - DNA, 25 bp, Rattus norvegicus
cagtacaacggcgaacggggcatct

SEQ ID NO: 668193 - DNA, 25 bp, Rattus norvegicus
ccacacgaatcaggaggacgccggc

SEQ ID NO: 668194 - DNA, 25 bp, Rattus norvegicus
ccagttctacccgttggtgaaggtg

SEQ ID NO: 668195 - DNA, 25 bp, Rattus norvegicus
tgctcagccgagctcaagttcttcc

SEQ ID NO: 668196 - DNA, 25 bp, Rattus norvegicus
catgtacgcgcctgtgtgcaccgta

SEQ ID NO: 668197 - DNA, 25 bp, Rattus norvegicus
acgctcaagtgcgagaagttccctg

SEQ ID NO: 668198 - DNA, 25 bp, Rattus norvegicus
gaagttccctgtgcacggcgcagga

SEQ ID NO: 668199 - DNA, 25 bp, Rattus norvegicus
tccctccttgctgccggagttctgg

SEQ ID NO: 668200 - DNA, 25 bp, Rattus norvegicus
tgggccagaacacttccgacaaagg

SEQ ID NO: 668201 - DNA, 25 bp, Rattus norvegicus
ctggtttcgtgtcgctcttccgcat

SEQ ID NO: 668202 - DNA, 25 bp, Rattus norvegicus
atcggagtcttcagtgtgctctaca

SEQ ID NO: 668203 - DNA, 25 bp, Rattus norvegicus
gcatcggagtcttcagtgtgctcta

SEQ ID NO: 668204 - DNA, 25 bp, Rattus norvegicus
tggtgcgcatcggagtcttcagtgt

SEQ ID NO: 668205 - DNA, 25 bp, Rattus norvegicus
agagaaactggaaaagctcatggtg

SEQ ID NO: 668206 - DNA, 25 bp, Rattus norvegicus
gcatgacggcaccaagacagagaaa

SEQ ID NO: 668207 - DNA, 25 bp, Rattus norvegicus
ctttcctgctggctggtttcgtgtc

SEQ ID NO: 668208 - DNA, 25 bp, Rattus norvegicus
acctctttcctgctggctggtttcg

SEQ ID NO: 668209 - DNA, 25 bp, Rattus norvegicus
ggcacctctttcctgctggctggtt

SEQ ID NO: 668210 - DNA, 25 bp, Rattus norvegicus
atcggcacctctttcctgctggctg

SEQ ID NO: 668211 - DNA, 25 bp, Rattus norvegicus
tctgttcatcggcacctctttcctg

SEQ ID NO: 668212 - DNA, 25 bp, Rattus norvegicus
gtctatctgttcatcggcacctctt

SEQ ID NO: 668213 - DNA, 25 bp, Rattus norvegicus
cttcgtctatctgttcatcggcacc

SEQ ID NO: 668214 - DNA, 25 bp, Rattus norvegicus
gacagagaaactggaaaagctcatg

SEQ ID NO: 668215 - DNA, 25 bp, Rattus norvegicus
tcgctggaacccgaactcggaggct

SEQ ID NO: 668216 - DNA, 25 bp, Rattus norvegicus
cccgctgaatagctgcagaggccgg

SEQ ID NO: 668217 - DNA, 25 bp, Rattus norvegicus
gccagctctgctgacgccacatagg

SEQ ID NO: 668218 - DNA, 25 bp, Rattus norvegicus
ataggccgagatcacctcagcagcg

SEQ ID NO: 668219 - DNA, 25 bp, Rattus norvegicus
cggtgcaatcacagagcgccttcgc

SEQ ID NO: 668220 - DNA, 25 bp, Rattus norvegicus
tcggccaccacgctggtccagagat

SEQ ID NO: 668221 - DNA, 25 bp, Rattus norvegicus
acgcggtccttcctagtctgcggtt

SEQ ID NO: 668222 - DNA, 25 bp, Rattus norvegicus
ggcgtggtcattcttggagccctca

SEQ ID NO: 668223 - DNA, 25 bp, Rattus norvegicus
tggagccctcactttcttcgccgtg

SEQ ID NO: 668224 - DNA, 25 bp, Rattus norvegicus
ggccacggtagaggccgcttcctca

SEQ ID NO: 668225 - DNA, 25 bp, Rattus norvegicus
ctcaggtccctttgttgctcaagga

SEQ ID NO: 668226 - DNA, 25 bp, Rattus norvegicus
ctcaagtacctagctggaggcgtga

SEQ ID NO: 668227 - DNA, 25 bp, Rattus norvegicus
tcctgatctcggctgtcgcgatggt

SEQ ID NO: 668228 - DNA, 25 bp, Rattus norvegicus
ggctgcagatgccagtcctgatctc

SEQ ID NO: 668229 - DNA, 25 bp, Rattus norvegicus
tgcgctcctaccttcgccttgccag

SEQ ID NO: 668230 - DNA, 25 bp, Rattus norvegicus
acacgccgtactgcatttccaaatg

SEQ ID NO: 668231 - DNA, 25 bp, Rattus norvegicus
gccagctgccagcttcctttgcctc

SEQ ID NO: 668232 - DNA, 25 bp, Rattus norvegicus
cctccatggcgtctgcagggtaggc

SEQ ID NO: 668233 - DNA, 25 bp, Rattus norvegicus
cgcagtggagaggaaagatctgttt

SEQ ID NO: 668234 - DNA, 25 bp, Rattus norvegicus
agatctgtttagaaagaggcggaca

SEQ ID NO: 668235 - DNA, 25 bp, Rattus norvegicus
tcggcggccactcgggacacgctag

SEQ ID NO: 668236 - DNA, 25 bp, Rattus norvegicus
tcgggacacgctaggcgctcaccgg

SEQ ID NO: 668237 - DNA, 25 bp, Rattus norvegicus
tcgtctccacgtaaacacacggcgg

SEQ ID NO: 668238 - DNA, 25 bp, Rattus norvegicus
gattcagttcgcgtaacacgccgta

SEQ ID NO: 668239 - DNA, 25 bp, Rattus norvegicus
tgcaaaagcaacagcggcctcataa

SEQ ID NO: 668240 - DNA, 25 bp, Rattus norvegicus
ggcctcataacgagaagccgcagtg

SEQ ID NO: 668241 - DNA, 25 bp, Rattus norvegicus
tcataacgagaagccgcagtggaag

SEQ ID NO: 668242 - DNA, 25 bp, Rattus norvegicus
tcctcccgggattcagttcgcgtaa

SEQ ID NO: 668243 - DNA, 25 bp, Rattus norvegicus
gacgtccatagcagtctctagccgc

SEQ ID NO: 668244 - DNA, 25 bp, Rattus norvegicus
gtctaccgcgagctttggtaccgga

SEQ ID NO: 668245 - DNA, 25 bp, Rattus norvegicus
taaaaggtgtctaccgcgagctttg

SEQ ID NO: 668246 - DNA, 25 bp, Rattus norvegicus
gaagtaaaaggtgtctaccgcgagc

SEQ ID NO: 668247 - DNA, 25 bp, Rattus norvegicus
tattccttccttggcgtgtaggggc

SEQ ID NO: 668248 - DNA, 25 bp, Rattus norvegicus
cctcctattccttccttggcgtgta

SEQ ID NO: 668249 - DNA, 25 bp, Rattus norvegicus
gaagtcagtcattacttccgccctc

SEQ ID NO: 668250 - DNA, 25 bp, Rattus norvegicus
gcgcagtcaatgacgtcacctctgc

SEQ ID NO: 668251 - DNA, 25 bp, Rattus norvegicus
ggcacaccgcgcagtcaatgacgtc

SEQ ID NO: 668252 - DNA, 25 bp, Rattus norvegicus
aggatttaggcacaccgcgcagtca

SEQ ID NO: 668253 - DNA, 25 bp, Rattus norvegicus
agactagcgaggatttaggcacacc

SEQ ID NO: 668254 - DNA, 25 bp, Rattus norvegicus
gctcctgaagactagcgaggattta

SEQ ID NO: 668255 - DNA, 25 bp, Rattus norvegicus
ctgggctcctgaagactagcgagga

SEQ ID NO: 668256 - DNA, 25 bp, Rattus norvegicus
accgcgagctttggtaccggacgcg

SEQ ID NO: 668257 - DNA, 25 bp, Rattus norvegicus
atcgattgttcgtgtctgagcctcc

SEQ ID NO: 668258 - DNA, 25 bp, Rattus norvegicus
ctcttgcgcatctttggagcactcc

SEQ ID NO: 668259 - DNA, 25 bp, Rattus norvegicus
gtcacgacgctcctggcatagcctg

SEQ ID NO: 668260 - DNA, 25 bp, Rattus norvegicus
tgagcctccctcacggaataccaga

SEQ ID NO: 668261 - DNA, 25 bp, Rattus norvegicus
tcagcccatcgtttgcttctgcctg

SEQ ID NO: 668262 - DNA, 25 bp, Rattus norvegicus
tctgccctccggatgacgttaaaga

SEQ ID NO: 668263 - DNA, 25 bp, Rattus norvegicus
ggattttaatccttggctcggccag

SEQ ID NO: 668264 - DNA, 25 bp, Rattus norvegicus
tccttcgctagtttgctgctgcttc

SEQ ID NO: 668265 - DNA, 25 bp, Rattus norvegicus
tccggcaacagccagcgactttcta

SEQ ID NO: 668266 - DNA, 25 bp, Rattus norvegicus
ttctactctaagtgcccatggcggg

SEQ ID NO: 668267 - DNA, 25 bp, Rattus norvegicus
tctcccggtgcgtgctatgaatcgg

SEQ ID NO: 668268 - DNA, 25 bp, Rattus norvegicus
atgaatcgggctaaggcaggcttcc

SEQ ID NO: 668269 - DNA, 25 bp, Rattus norvegicus
atgcccttggcacggaatctgtgtg

SEQ ID NO: 668270 - DNA, 25 bp, Rattus norvegicus
cgctctttcggctcgggaatcgatt

SEQ ID NO: 668271 - DNA, 25 bp, Rattus norvegicus
aggttgcgcaggctcagttgtgtcc

SEQ ID NO: 668272 - DNA, 25 bp, Rattus norvegicus
gcgcaggctcagttgtgtcccgcct

SEQ ID NO: 668273 - DNA, 25 bp, Rattus norvegicus
tccctgtggcgctcggaagcctgca

SEQ ID NO: 668274 - DNA, 25 bp, Rattus norvegicus
agatcgctgagctttggcggctaaa

SEQ ID NO: 668275 - DNA, 25 bp, Rattus norvegicus
cctccctctggcgtttatgagctcg

SEQ ID NO: 668276 - DNA, 25 bp, Rattus norvegicus
agcccgcgaggcgaatgtccgtgat

SEQ ID NO: 668277 - DNA, 25 bp, Rattus norvegicus
ccttagatcagtctcgcagagcctc

SEQ ID NO: 668278 - DNA, 25 bp, Rattus norvegicus
gcagtccttagatcagtctcgcaga

SEQ ID NO: 668279 - DNA, 25 bp, Rattus norvegicus
taaagaacttagcagtccttagatc

SEQ ID NO: 668280 - DNA, 25 bp, Rattus norvegicus
gggatggaggcaagtaaagaactta

SEQ ID NO: 668281 - DNA, 25 bp, Rattus norvegicus
acgcaaacactaggagctgtgggcc

SEQ ID NO: 668282 - DNA, 25 bp, Rattus norvegicus
agcacgggacagaacgcaaacacta

SEQ ID NO: 668283 - DNA, 25 bp, Rattus norvegicus
tttggcggctaaagcagcacgggac

SEQ ID NO: 668284 - DNA, 25 bp, Rattus norvegicus
tatgagctcgctttggtcgcaaggc

SEQ ID NO: 668285 - DNA, 25 bp, Rattus norvegicus
aagcctgcttcaggtttgcggctga

SEQ ID NO: 668286 - DNA, 25 bp, Rattus norvegicus
tcggctctggccgaggcagtctcga

SEQ ID NO: 668287 - DNA, 25 bp, Rattus norvegicus
cacgaatttgcaagcctcccggttt

SEQ ID NO: 668288 - DNA, 25 bp, Rattus norvegicus
gggtttctcgcgctcacgaatttgc

SEQ ID NO: 668289 - DNA, 25 bp, Rattus norvegicus
acagcatcctgtctaccctacgggg

SEQ ID NO: 668290 - DNA, 25 bp, Rattus norvegicus
gcccttccgcgtctcttgctagtgt

SEQ ID NO: 668291 - DNA, 25 bp, Rattus norvegicus
cagtctcgagctgcctagttcacgc

SEQ ID NO: 668292 - DNA, 25 bp, Rattus norvegicus
taagtctctgcttcccggctcggct

SEQ ID NO: 668293 - DNA, 25 bp, Rattus norvegicus
cgggagaagtaaccgtaagtctctg

SEQ ID NO: 668294 - DNA, 25 bp, Rattus norvegicus
cagatctgtggaattcacgcgaccc

SEQ ID NO: 668295 - DNA, 25 bp, Rattus norvegicus
cgcggcagaggaagacctgcagatc

SEQ ID NO: 668296 - DNA, 25 bp, Rattus norvegicus
accatgcgctggacttgagcgagcg

SEQ ID NO: 668297 - DNA, 25 bp, Rattus norvegicus
tttgcggctgaaaagcttccgggtc

SEQ ID NO: 668298 - DNA, 25 bp, Rattus norvegicus
gcacacggcacgaccatgcgctgga

SEQ ID NO: 668299 - DNA, 25 bp, Rattus norvegicus
cggagtcagccgaacgagaccattc

SEQ ID NO: 668300 - DNA, 25 bp, Rattus norvegicus
acaagctgcagaaaggggtcccgaa

SEQ ID NO: 668301 - DNA, 25 bp, Rattus norvegicus
ccattcggttgtaggccgaggaccg

SEQ ID NO: 668302 - DNA, 25 bp, Rattus norvegicus
gtcccgaacgcacggagtcagccga

SEQ ID NO: 668303 - DNA, 25 bp, Rattus norvegicus
gaagaagagtccacagggcgagatc

SEQ ID NO: 668304 - DNA, 25 bp, Rattus norvegicus
cttgctcttccagtcgccgaggtgg

SEQ ID NO: 668305 - DNA, 25 bp, Rattus norvegicus
ggcctgaagcccacctgcagcatgt

SEQ ID NO: 668306 - DNA, 25 bp, Rattus norvegicus
ccgaggaccgcttgaccattaaagt

SEQ ID NO: 668307 - DNA, 25 bp, Rattus norvegicus
accacgtcgtcctccatgtggaaga

SEQ ID NO: 668308 - DNA, 25 bp, Rattus norvegicus
ctctggccagtggagaagagcttcg

SEQ ID NO: 668309 - DNA, 25 bp, Rattus norvegicus
aagcaggtgagcgttcggcctctct

SEQ ID NO: 668310 - DNA, 25 bp, Rattus norvegicus
agggcgagatcctctgtcatcactg

SEQ ID NO: 668311 - DNA, 25 bp, Rattus norvegicus
aggcggcttcggcactgctaccttc

SEQ ID NO: 668312 - DNA, 25 bp, Rattus norvegicus
tgcagcatgtgcaagaccacgtcgt

SEQ ID NO: 668313 - DNA, 25 bp, Rattus norvegicus
ggcatattcgaccaccacgtccaga

SEQ ID NO: 668314 - DNA, 25 bp, Rattus norvegicus
agatggcctccagtgacgggaaacc

SEQ ID NO: 668315 - DNA, 25 bp, Rattus norvegicus
attggacacaaaggagcaccgctgg

SEQ ID NO: 668316 - DNA, 25 bp, Rattus norvegicus
tggcccatactgctctctcattgga

SEQ ID NO: 668317 - DNA, 25 bp, Rattus norvegicus
gggtcgatcctccagccaatcctaa

SEQ ID NO: 668318 - DNA, 25 bp, Rattus norvegicus
tctcgctctccggaaacaatcgtcg

SEQ ID NO: 668319 - DNA, 25 bp, Rattus norvegicus
tccagacagctgtgtgtgactcgcg

SEQ ID NO: 668320 - DNA, 25 bp, Rattus norvegicus
cccaaggttcaactctcgccggaga

SEQ ID NO: 668321 - DNA, 25 bp, Rattus norvegicus
tgaccgctgtcactctcggatcgct

SEQ ID NO: 668322 - DNA, 25 bp, Rattus norvegicus
ccgggaaaggtgtcagcgaacacta

SEQ ID NO: 668323 - DNA, 25 bp, Rattus norvegicus
tccggtcatcgcgttacctgcagca

SEQ ID NO: 668324 - DNA, 25 bp, Rattus norvegicus
cgagcattcgtgaaggccaccgtca

SEQ ID NO: 668325 - DNA, 25 bp, Rattus norvegicus
ggctaagcgatcactgctccacatt

SEQ ID NO: 668326 - DNA, 25 bp, Rattus norvegicus
gcggcacatcgctcgtcgaagtctc

SEQ ID NO: 668327 - DNA, 25 bp, Rattus norvegicus
gaaacactgcgccactacaagcaaa

SEQ ID NO: 668328 - DNA, 25 bp, Rattus norvegicus
ctgctcaggtagcggaaaggacccg

SEQ ID NO: 668329 - DNA, 25 bp, Rattus norvegicus
gaacccgcctttgcctgctcaggta

SEQ ID NO: 668330 - DNA, 25 bp, Rattus norvegicus
tagcgcagggaacccgcctttgcct

SEQ ID NO: 668331 - DNA, 25 bp, Rattus norvegicus
ctacaagcaaacaagccctggcgca

SEQ ID NO: 668332 - DNA, 25 bp, Rattus norvegicus
ggacacgaaacactgcgccactaca

SEQ ID NO: 668333 - DNA, 25 bp, Rattus norvegicus
tgaagcaggcactagggacacgaaa

SEQ ID NO: 668334 - DNA, 25 bp, Rattus norvegicus
cctaggactgtggaactcactggga

SEQ ID NO: 668335 - DNA, 25 bp, Rattus norvegicus
cgttccacaccttcctaggactgtg

SEQ ID NO: 668336 - DNA, 25 bp, Rattus norvegicus
tggcttgtcctttccggttctctcc

SEQ ID NO: 668337 - DNA, 25 bp, Rattus norvegicus
ggcgacttctggcttgtcctttccg

SEQ ID NO: 668338 - DNA, 25 bp, Rattus norvegicus
tagcagagccgttgcggcgacttct

SEQ ID NO: 668339 - DNA, 25 bp, Rattus norvegicus
gcccgggtcgctgcatttcaaaata

SEQ ID NO: 668340 - DNA, 25 bp, Rattus norvegicus
ctctgcttctcacaggcgcgcctag

SEQ ID NO: 668341 - DNA, 25 bp, Rattus norvegicus
tggaggacagaccagcgctagcgac

SEQ ID NO: 668342 - DNA, 25 bp, Rattus norvegicus
cctctctgcacagacggcgccggct

SEQ ID NO: 668343 - DNA, 25 bp, Rattus norvegicus
ggttccgtgctctcagcccttaccg

SEQ ID NO: 668344 - DNA, 25 bp, Rattus norvegicus
cagggcccgcagagcacgacgctga

SEQ ID NO: 668345 - DNA, 25 bp, Rattus norvegicus
cagagcacgacgctgaggaccagca

SEQ ID NO: 668346 - DNA, 25 bp, Rattus norvegicus
gaggaccagcaaggcgcacgcgcac

SEQ ID NO: 668347 - DNA, 25 bp, Rattus norvegicus
ctaccgaatactcaccacgcgattg

SEQ ID NO: 668348 - DNA, 25 bp, Rattus norvegicus
tactcaccacgcgattgtctcgctt

SEQ ID NO: 668349 - DNA, 25 bp, Rattus norvegicus
cgaacgcgcgtgaacccacagggaa

SEQ ID NO: 668350 - DNA, 25 bp, Rattus norvegicus
cgcgcgtgaacccacagggaaagca

SEQ ID NO: 668351 - DNA, 25 bp, Rattus norvegicus
tgaacccacagggaaagcaggccgg

SEQ ID NO: 668352 - DNA, 25 bp, Rattus norvegicus
aaagcaggccggagaagaagccgaa

SEQ ID NO: 668353 - DNA, 25 bp, Rattus norvegicus
cgcaagtcttcttaccgcctctatg

SEQ ID NO: 668354 - DNA, 25 bp, Rattus norvegicus
aagcggcccgccgcaagtcttctta

SEQ ID NO: 668355 - DNA, 25 bp, Rattus norvegicus
tgaaatccttcatgagcctctcccg

SEQ ID NO: 668356 - DNA, 25 bp, Rattus norvegicus
tttcaacccgtgcaaaagcaaccgc

SEQ ID NO: 668357 - DNA, 25 bp, Rattus norvegicus
tgagaggagactgcccttgtgtcac

SEQ ID NO: 668358 - DNA, 25 bp, Rattus norvegicus
ttgtgtcacgaccaccgaacctctg

SEQ ID NO: 668359 - DNA, 25 bp, Rattus norvegicus
tctgcccgatattccgggacggctg

SEQ ID NO: 668360 - DNA, 25 bp, Rattus norvegicus
cccaaagtctggaggccaggtccca

SEQ ID NO: 668361 - DNA, 25 bp, Rattus norvegicus
cgttcagttgtttagggatgaccca

SEQ ID NO: 668362 - DNA, 25 bp, Rattus norvegicus
agtaagccttcccatcccacggagg

SEQ ID NO: 668363 - DNA, 25 bp, Rattus norvegicus
gaggccttagtctgggctggacctt

SEQ ID NO: 668364 - DNA, 25 bp, Rattus norvegicus
gaacggtccacaggcgtttacctgc

SEQ ID NO: 668365 - DNA, 25 bp, Rattus norvegicus
gcagagtctctctcggctcctttga

SEQ ID NO: 668366 - DNA, 25 bp, Rattus norvegicus
cggctcctttgagagctttcctaaa

SEQ ID NO: 668367 - DNA, 25 bp, Rattus norvegicus
tctgctctgtcttcgcactcaatga

SEQ ID NO: 668368 - DNA, 25 bp, Rattus norvegicus
tttagctagctaaaccgggctggtc

SEQ ID NO: 668369 - DNA, 25 bp, Rattus norvegicus
gatttcgctgctgggctccctctct

SEQ ID NO: 668370 - DNA, 25 bp, Rattus norvegicus
cacgtgggccgagcggcgtcccaac

SEQ ID NO: 668371 - DNA, 25 bp, Rattus norvegicus
cctcgcgggcctcagggcccatcgt

SEQ ID NO: 668372 - DNA, 25 bp, Rattus norvegicus
tcccatcagccgaggtgaggcacct

SEQ ID NO: 668373 - DNA, 25 bp, Rattus norvegicus
ttaatcccatcagccgaggtgaggc

SEQ ID NO: 668374 - DNA, 25 bp, Rattus norvegicus
gagttaatcccatcagccgaggtga

SEQ ID NO: 668375 - DNA, 25 bp, Rattus norvegicus
cctagagttaatcccatcagccgag

SEQ ID NO: 668376 - DNA, 25 bp, Rattus norvegicus
cggccctagagttaatcccatcagc

SEQ ID NO: 668377 - DNA, 25 bp, Rattus norvegicus
tgcggccctagagttaatcccatca

SEQ ID NO: 668378 - DNA, 25 bp, Rattus norvegicus
tgggctccctctctctgcggcccta

SEQ ID NO: 668379 - DNA, 25 bp, Rattus norvegicus
ctgggatttcgctgctgggctccct

SEQ ID NO: 668380 - DNA, 25 bp, Rattus norvegicus
tctcctgggatttcgctgctgggct

SEQ ID NO: 668381 - DNA, 25 bp, Rattus norvegicus
tccctctcctgggatttcgctgctg

SEQ ID NO: 668382 - DNA, 25 bp, Rattus norvegicus
ctctgcggccctagagttaatccca

SEQ ID NO: 668383 - DNA, 25 bp, Rattus norvegicus
gaatcggctgcctctcaagttggtg

SEQ ID NO: 668384 - DNA, 25 bp, Rattus norvegicus
tatgtttgtcttttgtgagggcagg

SEQ ID NO: 668385 - DNA, 25 bp, Rattus norvegicus
ctgcctctcaagttggtgttattta

SEQ ID NO: 668386 - DNA, 25 bp, Rattus norvegicus
tgcgtcccgaaccaggctggggaat

SEQ ID NO: 668387 - DNA, 25 bp, Rattus norvegicus
ggccgaggtattgcgtcccgaacca

SEQ ID NO: 668388 - DNA, 25 bp, Rattus norvegicus
gtagcgcttggcgtcacctgctctc

SEQ ID NO: 668389 - DNA, 25 bp, Rattus norvegicus
tgcgacctcctaccgtagcgcttgg

SEQ ID NO: 668390 - DNA, 25 bp, Rattus norvegicus
agctagactgcgacctcctaccgta

SEQ ID NO: 668391 - DNA, 25 bp, Rattus norvegicus
cttcttggcacaaagctagactgcg

SEQ ID NO: 668392 - DNA, 25 bp, Rattus norvegicus
ttaggacttcaggtgcttcttggca

SEQ ID NO: 668393 - DNA, 25 bp, Rattus norvegicus
gccgcagccaatgtgttaggacttc

SEQ ID NO: 668394 - DNA, 25 bp, Rattus norvegicus
cggtgccacacacagggatccgcct

SEQ ID NO: 668395 - DNA, 25 bp, Rattus norvegicus
gagcttgtctcctcccggtgccaca

SEQ ID NO: 668396 - DNA, 25 bp, Rattus norvegicus
caagttggtgttatttatgtttgtc

SEQ ID NO: 668397 - DNA, 25 bp, Rattus norvegicus
gggaccctcggcagaacctacctga

SEQ ID NO: 668398 - DNA, 25 bp, Rattus norvegicus
cagcccgatgcctagcaaactcaga

SEQ ID NO: 668399 - DNA, 25 bp, Rattus norvegicus
gaacctacctgagcgccaagaaccg

SEQ ID NO: 668400 - DNA, 25 bp, Rattus norvegicus
cgccaagaaccgctcgcccagaagc

SEQ ID NO: 668401 - DNA, 25 bp, Rattus norvegicus
aagcgccagcccgatgcctagcaaa

SEQ ID NO: 668402 - DNA, 25 bp, Rattus norvegicus
ggcagaacctacctgagcgccaaga

SEQ ID NO: 668403 - DNA, 25 bp, Rattus norvegicus
ccgatgcctagcaaactcagagcca

SEQ ID NO: 668404 - DNA, 25 bp, Rattus norvegicus
tgcctagcaaactcagagccaccag

SEQ ID NO: 668405 - DNA, 25 bp, Rattus norvegicus
tagcaaactcagagccaccagccgg

SEQ ID NO: 668406 - DNA, 25 bp, Rattus norvegicus
ctcagagccaccagccggcccatgg

SEQ ID NO: 668407 - DNA, 25 bp, Rattus norvegicus
gcccgccgtctggtttgggcctgac

SEQ ID NO: 668408 - DNA, 25 bp, Rattus norvegicus
ccgccgtctggtttgggcctgaccg

SEQ ID NO: 668409 - DNA, 25 bp, Rattus norvegicus
gcctgaccgggctgcaccggacgct

SEQ ID NO: 668410 - DNA, 25 bp, Rattus norvegicus
gaaccgctcgcccagaagcgccagc

SEQ ID NO: 668411 - DNA, 25 bp, Rattus norvegicus
ctccgaagcgtatgactggttacta

SEQ ID NO: 668412 - DNA, 25 bp, Rattus norvegicus
tgtcccaagtcgctcttcagagaga

SEQ ID NO: 668413 - DNA, 25 bp, Rattus norvegicus
agcctcttcgaaacgtcacacagta

SEQ ID NO: 668414 - DNA, 25 bp, Rattus norvegicus
cggattccggaagagttggcgttca

SEQ ID NO: 668415 - DNA, 25 bp, Rattus norvegicus
cgtgacagccctgcagacttaatta

SEQ ID NO: 668416 - DNA, 25 bp, Rattus norvegicus
cacagtaactgcacggtttcagcca

SEQ ID NO: 668417 - DNA, 25 bp, Rattus norvegicus
tggacctacacattctcagcctgga

SEQ ID NO: 668418 - DNA, 25 bp, Rattus norvegicus
ccaatgttctcgttcggatcgcagc

SEQ ID NO: 668419 - DNA, 25 bp, Rattus norvegicus
tagataccaacacgcagccggaagc

SEQ ID NO: 668420 - DNA, 25 bp, Rattus norvegicus
gggcccagcaggtctgcaatagata

SEQ ID NO: 668421 - DNA, 25 bp, Rattus norvegicus
ttcaggcttggaacccgaatccagg

SEQ ID NO: 668422 - DNA, 25 bp, Rattus norvegicus
ggcgcgctgttcaacttcaggcttg

SEQ ID NO: 668423 - DNA, 25 bp, Rattus norvegicus
tggcacctggttctggcacgaacta

SEQ ID NO: 668424 - DNA, 25 bp, Rattus norvegicus
aggctacccgctcctggtcatgaga

SEQ ID NO: 668425 - DNA, 25 bp, Rattus norvegicus
acgaaacgggctgccttcatcctga

SEQ ID NO: 668426 - DNA, 25 bp, Rattus norvegicus
gcggtcgagcgagagcaagtgcgct

SEQ ID NO: 668427 - DNA, 25 bp, Rattus norvegicus
ctaggatccgtagggttggtgagga

SEQ ID NO: 668428 - DNA, 25 bp, Rattus norvegicus
tgccctcctaggctggcggtggcta

SEQ ID NO: 668429 - DNA, 25 bp, Rattus norvegicus
atcctgatgccctcctaggctggcg

SEQ ID NO: 668430 - DNA, 25 bp, Rattus norvegicus
aacgggctgccttcatcctgatgcc

SEQ ID NO: 668431 - DNA, 25 bp, Rattus norvegicus
cgcatcacgaaacgggctgccttca

SEQ ID NO: 668432 - DNA, 25 bp, Rattus norvegicus
cgctgcgcatcacgaaacgggctgc

SEQ ID NO: 668433 - DNA, 25 bp, Rattus norvegicus
gctggcgctgcgcatcacgaaacgg

SEQ ID NO: 668434 - DNA, 25 bp, Rattus norvegicus
accaggccggcgttgcccagcgagc

SEQ ID NO: 668435 - DNA, 25 bp, Rattus norvegicus
agaacagctcgacctccctggggac

SEQ ID NO: 668436 - DNA, 25 bp, Rattus norvegicus
ctgtagcgggagaacagctcgacct

SEQ ID NO: 668437 - DNA, 25 bp, Rattus norvegicus
caagtgcgctgtgggctcagggtcc

SEQ ID NO: 668438 - DNA, 25 bp, Rattus norvegicus
gagaacagctcgacctccctgggga

SEQ ID NO: 668439 - DNA, 25 bp, Rattus norvegicus
tgagacagcacatcctgctggcgcg

SEQ ID NO: 668440 - DNA, 25 bp, Rattus norvegicus
tgggagctgtcagtgtcaagctcag

SEQ ID NO: 668441 - DNA, 25 bp, Rattus norvegicus
gagagaggaagtgatcgctccggga

SEQ ID NO: 668442 - DNA, 25 bp, Rattus norvegicus
aggaagtgatcgctccgggaggagc

SEQ ID NO: 668443 - DNA, 25 bp, Rattus norvegicus
aggagcgctagcctagccgcgcagc

SEQ ID NO: 668444 - DNA, 25 bp, Rattus norvegicus
agcgctagcctagccgcgcagcgtg

SEQ ID NO: 668445 - DNA, 25 bp, Rattus norvegicus
cgcgcagcgtgagacagcacatcct

SEQ ID NO: 668446 - DNA, 25 bp, Rattus norvegicus
gcgcagcgtgagacagcacatcctg

SEQ ID NO: 668447 - DNA, 25 bp, Rattus norvegicus
gcagcgtgagacagcacatcctgct

SEQ ID NO: 668448 - DNA, 25 bp, Rattus norvegicus
cgtgagacagcacatcctgctggcg

SEQ ID NO: 668449 - DNA, 25 bp, Rattus norvegicus
agacagcacatcctgctggcgcggg

SEQ ID NO: 668450 - DNA, 25 bp, Rattus norvegicus
cccgcagcccgggtgctgggagctg

SEQ ID NO: 668451 - DNA, 25 bp, Rattus norvegicus
ctgggagctgtcagtgtcaagctca

SEQ ID NO: 668452 - DNA, 25 bp, Rattus norvegicus
agcgtgagacagcacatcctgctgg

SEQ ID NO: 668453 - DNA, 25 bp, Rattus norvegicus
ttacaactgtgtctgaaaccgcctc

SEQ ID NO: 668454 - DNA, 25 bp, Rattus norvegicus
ctggaatgtcgcttacaactgtgtc

SEQ ID NO: 668455 - DNA, 25 bp, Rattus norvegicus
cacctgtctggaatgtcgcttacaa

SEQ ID NO: 668456 - DNA, 25 bp, Rattus norvegicus
ggcagtcgcgtccacctgtctggaa

SEQ ID NO: 668457 - DNA, 25 bp, Rattus norvegicus
agctaatggcagtcgcgtccacctg

SEQ ID NO: 668458 - DNA, 25 bp, Rattus norvegicus
caagaattccgagctaatggcagtc

SEQ ID NO: 668459 - DNA, 25 bp, Rattus norvegicus
ttggcctggcaagaattccgagcta

SEQ ID NO: 668460 - DNA, 25 bp, Rattus norvegicus
ctgggttcaggctcccagcgacctg

SEQ ID NO: 668461 - DNA, 25 bp, Rattus norvegicus
ttcggagcatcccagcgggtccaag

SEQ ID NO: 668462 - DNA, 25 bp, Rattus norvegicus
cttcggtgcagagtcagggttgcca

SEQ ID NO: 668463 - DNA, 25 bp, Rattus norvegicus
cagacgttgccttcggtgcagagtc

SEQ ID NO: 668464 - DNA, 25 bp, Rattus norvegicus
ccacgaggtggcagacgttgccttc

SEQ ID NO: 668465 - DNA, 25 bp, Rattus norvegicus
ctgcagcgacaagggaggaccacga

SEQ ID NO: 668466 - DNA, 25 bp, Rattus norvegicus
aactgtgtctgaaaccgcctcgctc

SEQ ID NO: 668467 - DNA, 25 bp, Rattus norvegicus
tctggttggattgcactagggaccc

SEQ ID NO: 668468 - DNA, 25 bp, Rattus norvegicus
tgcgggagccgtcagcccattggct

SEQ ID NO: 668469 - DNA, 25 bp, Rattus norvegicus
cacttcccgtccaggcagaggtggg

SEQ ID NO: 668470 - DNA, 25 bp, Rattus norvegicus
cctgctgtctggttggattgcacta

SEQ ID NO: 668471 - DNA, 25 bp, Rattus norvegicus
aggcagctttgagacctgctgtctg

SEQ ID NO: 668472 - DNA, 25 bp, Rattus norvegicus
cggggtacaggcagctttgagacct

SEQ ID NO: 668473 - DNA, 25 bp, Rattus norvegicus
gccgccatgcttcggccggggtaca

SEQ ID NO: 668474 - DNA, 25 bp, Rattus norvegicus
cacatctactacaccggctggaccc

SEQ ID NO: 668475 - DNA, 25 bp, Rattus norvegicus
cgcagctgcaaggtggaaccccaca

SEQ ID NO: 668476 - DNA, 25 bp, Rattus norvegicus
gtacccacgcggccacaagtgcagt

SEQ ID NO: 668477 - DNA, 25 bp, Rattus norvegicus
ccgtagcaagatccggccgcggtac

SEQ ID NO: 668478 - DNA, 25 bp, Rattus norvegicus
agcaaagtttccgtagcaagatccg

SEQ ID NO: 668479 - DNA, 25 bp, Rattus norvegicus
ccaagtgggagtgccctgctagcaa

SEQ ID NO: 668480 - DNA, 25 bp, Rattus norvegicus
gtgccctgctagcaaagtttccgta

SEQ ID NO: 668481 - DNA, 25 bp, Rattus norvegicus
tccacggttcattctgcccgcaagg

SEQ ID NO: 668482 - DNA, 25 bp, Rattus norvegicus
ttattagctattttttgtggtcatg

SEQ ID NO: 668483 - DNA, 25 bp, Rattus norvegicus
ccacggttcattctgcccgcaaggg

SEQ ID NO: 668484 - DNA, 25 bp, Rattus norvegicus
caattattattgtgttccgttgggg

SEQ ID NO: 668485 - DNA, 25 bp, Rattus norvegicus
agctattttttgtggtcatgttttt

SEQ ID NO: 668486 - DNA, 25 bp, Rattus norvegicus
cctttgttattagctattttttgtg

SEQ ID NO: 668487 - DNA, 25 bp, Rattus norvegicus
cgcgtcctttgttattagctatttt

SEQ ID NO: 668488 - DNA, 25 bp, Rattus norvegicus
tcgcgtcctttgttattagctattt

SEQ ID NO: 668489 - DNA, 25 bp, Rattus norvegicus
ttcgcgtcctttgttattagctatt

SEQ ID NO: 668490 - DNA, 25 bp, Rattus norvegicus
ttttcgcgtcctttgttattagcta

SEQ ID NO: 668491 - DNA, 25 bp, Rattus norvegicus
cggttcattctgcccgcaagggtat

SEQ ID NO: 668492 - DNA, 25 bp, Rattus norvegicus
acggttcattctgcccgcaagggta

SEQ ID NO: 668493 - DNA, 25 bp, Rattus norvegicus
cacggttcattctgcccgcaagggt

SEQ ID NO: 668494 - DNA, 25 bp, Rattus norvegicus
tcaattattattgtgttccgttggg

SEQ ID NO: 668495 - DNA, 25 bp, Rattus norvegicus
gatggtacgacgctgccctacccag

SEQ ID NO: 668496 - DNA, 25 bp, Rattus norvegicus
aaagcacgcgtagcgcgcccggacg

SEQ ID NO: 668497 - DNA, 25 bp, Rattus norvegicus
tccgcttataaggtgggttgtcgcc

SEQ ID NO: 668498 - DNA, 25 bp, Rattus norvegicus
tgtcgccggtgccacgtgatctcac

SEQ ID NO: 668499 - DNA, 25 bp, Rattus norvegicus
cgcgccctgctgagggcgtatcttc

SEQ ID NO: 668500 - DNA, 25 bp, Rattus norvegicus
gctgagggcgtatcttccaacggcc

SEQ ID NO: 668501 - DNA, 25 bp, Rattus norvegicus
cgccagtccgctcgtggtctggtga

SEQ ID NO: 668502 - DNA, 25 bp, Rattus norvegicus
gggcggcccatatgacgtatgcaca

SEQ ID NO: 668503 - DNA, 25 bp, Rattus norvegicus
atgacgtatgcacacgccaccgggg

SEQ ID NO: 668504 - DNA, 25 bp, Rattus norvegicus
agtcagatggtacgacgctgcccta

SEQ ID NO: 668505 - DNA, 25 bp, Rattus norvegicus
ctgcaatgcgctgccggacctcggt

SEQ ID NO: 668506 - DNA, 25 bp, Rattus norvegicus
gccggacctcggtttctgagataaa

SEQ ID NO: 668507 - DNA, 25 bp, Rattus norvegicus
ggtttctgagataaagcggtccgcg

SEQ ID NO: 668508 - DNA, 25 bp, Rattus norvegicus
tggctcgcgagtcagatggtacgac

SEQ ID NO: 668509 - DNA, 25 bp, Rattus norvegicus
gaccacaaagttggaagcctcagta

SEQ ID NO: 668510 - DNA, 25 bp, Rattus norvegicus
tgtcttgaaccagcgaactgttttg

SEQ ID NO: 668511 - DNA, 25 bp, Rattus norvegicus
tgtagccggtcctcctgtcttgaac

SEQ ID NO: 668512 - DNA, 25 bp, Rattus norvegicus
aatgctgggacaccgaaggtcctcc

SEQ ID NO: 668513 - DNA, 25 bp, Rattus norvegicus
cctcagtactagtgaggcgccgata

SEQ ID NO: 668514 - DNA, 25 bp, Rattus norvegicus
cgctcagagatcgaccacaaagttg

SEQ ID NO: 668515 - DNA, 25 bp, Rattus norvegicus
cttctcggacatagcgcagcgccaa

SEQ ID NO: 668516 - DNA, 25 bp, Rattus norvegicus
gacaggctgcttcttctcggacata

SEQ ID NO: 668517 - DNA, 25 bp, Rattus norvegicus
tccaggagacccaagtcgacaggct

SEQ ID NO: 668518 - DNA, 25 bp, Rattus norvegicus
cgcgggaaactcctcgaactcgtcg

SEQ ID NO: 668519 - DNA, 25 bp, Rattus norvegicus
agactcagagagcaggcccgacgcc

SEQ ID NO: 668520 - DNA, 25 bp, Rattus norvegicus
ttgaagcgacggctaccgggactcc

SEQ ID NO: 668521 - DNA, 25 bp, Rattus norvegicus
cctggttcctcccagcgacaaggaa

SEQ ID NO: 668522 - DNA, 25 bp, Rattus norvegicus
cgccggcgcaaccatagagactaga

SEQ ID NO: 668523 - DNA, 25 bp, Rattus norvegicus
cgcgaatgtagctgcgggcgaaact

SEQ ID NO: 668524 - DNA, 25 bp, Rattus norvegicus
gatatgtaaacgcacggatcgcgtt

SEQ ID NO: 668525 - DNA, 25 bp, Rattus norvegicus
cgcacggatcgcgttacaggttcgc

SEQ ID NO: 668526 - DNA, 25 bp, Rattus norvegicus
ttacaggttcgcgtgttaaactgca

SEQ ID NO: 668527 - DNA, 25 bp, Rattus norvegicus
gcgtgttaaactgcacctcttgtta

SEQ ID NO: 668528 - DNA, 25 bp, Rattus norvegicus
tgcacctcttgttaaaagggaagga

SEQ ID NO: 668529 - DNA, 25 bp, Rattus norvegicus
gaacaagggagccacttaaaaatga

SEQ ID NO: 668530 - DNA, 25 bp, Rattus norvegicus
ggagccacttaaaaatgaattcaga

SEQ ID NO: 668531 - DNA, 25 bp, Rattus norvegicus
atgaattcagagttactgaaccggc

SEQ ID NO: 668532 - DNA, 25 bp, Rattus norvegicus
tcagagttactgaaccggcacccgg

SEQ ID NO: 668533 - DNA, 25 bp, Rattus norvegicus
ttactgaaccggcacccgggactca

SEQ ID NO: 668534 - DNA, 25 bp, Rattus norvegicus
cacccgggactcaagaagttaagcg

SEQ ID NO: 668535 - DNA, 25 bp, Rattus norvegicus
ctgggtaaaagaagagggcgcgaat

SEQ ID NO: 668536 - DNA, 25 bp, Rattus norvegicus
actcaagaagttaagcgtggcgggc

SEQ ID NO: 668537 - DNA, 25 bp, Rattus norvegicus
tctgggctgagcttgtagttgctta

SEQ ID NO: 668538 - DNA, 25 bp, Rattus norvegicus
gtctgaaagcagacgcgcaactttc

SEQ ID NO: 668539 - DNA, 25 bp, Rattus norvegicus
gctgagcttgtagttgcttaaggta

SEQ ID NO: 668540 - DNA, 25 bp, Rattus norvegicus
cgaagaactccgcaagcagcgcaca

SEQ ID NO: 668541 - DNA, 25 bp, Rattus norvegicus
cgcaagcagcgcacacgccagtaga

SEQ ID NO: 668542 - DNA, 25 bp, Rattus norvegicus
acacgccagtagaagcggtgcgcct

SEQ ID NO: 668543 - DNA, 25 bp, Rattus norvegicus
ccagtagaagcggtgcgcctgtgac

SEQ ID NO: 668544 - DNA, 25 bp, Rattus norvegicus
cgactgaccaatagggaggcgctgc

SEQ ID NO: 668545 - DNA, 25 bp, Rattus norvegicus
gaccaatagggaggcgctgcccttt

SEQ ID NO: 668546 - DNA, 25 bp, Rattus norvegicus
ttggagacaaaccattcgactcgtg

SEQ ID NO: 668547 - DNA, 25 bp, Rattus norvegicus
cattcgactcgtggcgtctgcatca

SEQ ID NO: 668548 - DNA, 25 bp, Rattus norvegicus
cgtggcgtctgcatcaagtctgaaa

SEQ ID NO: 668549 - DNA, 25 bp, Rattus norvegicus
ggcgtctgcatcaagtctgaaagca

SEQ ID NO: 668550 - DNA, 25 bp, Rattus norvegicus
ttgcttaaggtaggcgaagaactcc

SEQ ID NO: 668551 - DNA, 25 bp, Rattus norvegicus
gggctgtgcgctagcctggccttac

SEQ ID NO: 668552 - DNA, 25 bp, Rattus norvegicus
ccaccaccacggctcgccctacgcg

SEQ ID NO: 668553 - DNA, 25 bp, Rattus norvegicus
tttcccactgaacctccgggctgtg

SEQ ID NO: 668554 - DNA, 25 bp, Rattus norvegicus
tcgcccgcgtgtgtttcccactgaa

SEQ ID NO: 668555 - DNA, 25 bp, Rattus norvegicus
gtgcgctcccgattgcctggcgcct

SEQ ID NO: 668556 - DNA, 25 bp, Rattus norvegicus
aggccgcctaggcagctagcttcgc

SEQ ID NO: 668557 - DNA, 25 bp, Rattus norvegicus
tgagaggccgcctaggcagctagct

SEQ ID NO: 668558 - DNA, 25 bp, Rattus norvegicus
agtcctaccacaacagcagcgcggc

SEQ ID NO: 668559 - DNA, 25 bp, Rattus norvegicus
agcacagcccttacctccagtccta

SEQ ID NO: 668560 - DNA, 25 bp, Rattus norvegicus
ctacatgagccactcgcagcacagc

SEQ ID NO: 668561 - DNA, 25 bp, Rattus norvegicus
aaccaccgatcgctcgccgcctacc

SEQ ID NO: 668562 - DNA, 25 bp, Rattus norvegicus
ggaggcaactcctacaaccaccgat

SEQ ID NO: 668563 - DNA, 25 bp, Rattus norvegicus
tcgggcggaggcaactcctacaacc

SEQ ID NO: 668564 - DNA, 25 bp, Rattus norvegicus
tagcctggccttacggtccgcactg

SEQ ID NO: 668565 - DNA, 25 bp, Synthetic oligonucleotide
ccttgtattggaacaaacattggcg

SEQ ID NO: 668566 - DNA, 25 bp, Artificial sequence
  Synthetic oligonucleotide
tatgccgatttaccagaaccggagt

SEQ ID NO: 668567 - DNA, 25 bp, Artificial sequence
  Synthetic oligonucleotide
tcttctaaaaaatttgtcagccagt

SEQ ID NO: 668568 - DNA, 25 bp, Artificial sequence
  Synthetic oligonucleotide
tcttctaaaaaaattgtcagccagt

SEQ ID NO: 668569 - DNA, 25 bp, Artificial sequence
  Synthetic oligonucleotide
acaaaggcggcattagagatgcttg

SEQ ID NO: 668570 - DNA, 25 bp, Artificial sequence
  Synthetic oligonucleotide
acaaaggcggcaatagagatgcttg

SEQ ID NO: 668571 - DNA, 25 bp, Artificial sequence
  Synthetic oligonucleotide
agcattttagaacatgaacagctaa

SEQ ID NO: 668572 - DNA, 25 bp, Artificial sequence
  Synthetic oligonucleotide
agcattttagaagatgaacagctaa

SEQ ID NO: 668573 - DNA, 25 bp, Artificial sequence
  Synthetic oligonucleotide
gtcggtgatgtttcggccgcaacag

SEQ ID NO: 668574 - DNA, 25 bp, Artificial sequence
  Synthetic oligonucleotide
gtcggtgatgttacggccgcaacag

SEQ ID NO: 668575 - DNA, 25 bp, Artificial sequence
  Synthetic oligonucleotide
tatgccgatttagcagaaccggagt

SEQ ID NO: 668576 - DNA, 25 bp, Artificial sequence
  Synthetic oligonucleotide
gttataaaaaactatgtgagcggat

SEQ ID NO: 668577 - DNA, 25 bp, Artificial sequence
  Synthetic oligonucleotide
aatcgaagcgggccatcaggcttat

SEQ ID NO: 668578 - DNA, 25 bp, Artificial sequence
  Synthetic oligonucleotide
ccttgtattggatcaaacattggcg

SEQ ID NO: 668579 - DNA, 25 bp, Artificial sequence
  Synthetic oligonucleotide
ggccttgtcctgcttgaagcgatgg

SEQ ID NO: 668580 - DNA, 25 bp, Artificial sequence
  Synthetic oligonucleotide
ggccttgtcctggttgaagcgatgg

SEQ ID NO: 668581 - DNA, 25 bp, Artificial sequence
  Synthetic oligonucleotide
gatttgaagctggtgctatctgaaa

SEQ ID NO: 668582 - DNA, 25 bp, Artificial sequence
  Synthetic oligonucleotide
gatttgaagctgctgctatctgaaa

SEQ ID NO: 668583 - DNA, 25 bp, Artificial sequence
  Synthetic oligonucleotide
gttataaaaaacaatgtgagcggat

SEQ ID NO: 668584 - DNA, 25 bp, Artificial sequence
  Synthetic oligonucleotide
agtagaacggctgtttcagcggact

SEQ ID NO: 668585 - DNA, 25 bp, Artificial sequence
  Synthetic oligonucleotide
atttatctcatcattagaagaggat

SEQ ID NO: 668586 - DNA, 25 bp, Artificial sequence
  Synthetic oligonucleotide
atttatctcatctttagaagaggat

SEQ ID NO: 668587 - DNA, 25 bp, Artificial sequence
  Synthetic oligonucleotide
tgattatgttgatttcagaagaccg

SEQ ID NO: 668588 - DNA, 25 bp, Artificial sequence
  Synthetic oligonucleotide
tgattatgttgaattcagaagaccg

SEQ ID NO: 668589 - DNA, 25 bp, Artificial sequence
  Synthetic oligonucleotide
tgaaacctatgaagtcacgacattc

SEQ ID NO: 668590 - DNA, 25 bp, Artificial sequence
  Synthetic oligonucleotide
tgaaacctatgatgtcacgacattc

SEQ ID NO: 668591 - DNA, 25 bp, Artificial sequence
  Synthetic oligonucleotide
caaagagcacggcaccattattgtg

SEQ ID NO: 668592 - DNA, 25 bp, Artificial sequence
  Synthetic oligonucleotide
agtttttatcaatgcacttcccgtg

SEQ ID NO: 668593 - DNA, 25 bp, Artificial sequence
  Synthetic oligonucleotide
agtagaacggctctttcagcggact

SEQ ID NO: 668594 - DNA, 25 bp, Artificial sequence
  Synthetic oligonucleotide
agtttttatcaaagcacttcccgtg

SEQ ID NO: 668595 - DNA, 25 bp, Artificial sequence
  Synthetic oligonucleotide
agatgtcgatatggcgacagatgcg

SEQ ID NO: 668596 - DNA, 25 bp, Artificial sequence
  Synthetic oligonucleotide
agatgtcgatatcgcgacagatgcg

SEQ ID NO: 668597 - DNA, 25 bp, Artificial sequence
  Synthetic oligonucleotide
cgcagttcgtgacagctatatgaaa

SEQ ID NO: 668598 - DNA, 25 bp, Artificial sequence
  Synthetic oligonucleotide
cgcagttcgtgagagctatatgaaa

SEQ ID NO: 668599 - DNA, 25 bp, Artificial sequence
  Synthetic oligonucleotide
aatcaagaccgtcttgaagatcttt

SEQ ID NO: 668600 - DNA, 25 bp, Artificial sequence
  Synthetic oligonucleotide
aatcgaagcggggcatcaggcttat

SEQ ID NO: 668601 - DNA, 25 bp, Artificial sequence
  Synthetic oligonucleotide
ggccaaaagcggattttatgccgta

SEQ ID NO: 668602 - DNA, 25 bp, Artificial sequence
  Synthetic oligonucleotide
caaagagcacgggaccattattgtg

SEQ ID NO: 668603 - DNA, 25 bp, Artificial sequence
  Synthetic oligonucleotide
taggaatcacatcctatccgagcgt

SEQ ID NO: 668604 - DNA, 25 bp, Artificial sequence
  Synthetic oligonucleotide
ttccgtttagacagaatacatatca

SEQ ID NO: 668605 - DNA, 25 bp, Artificial sequence
  Synthetic oligonucleotide
aggtttactattttatgataaatgg

SEQ ID NO: 668606 - DNA, 25 bp, Artificial sequence
  Synthetic oligonucleotide
aggtttactattatatgataaatgg

SEQ ID NO: 668607 - DNA, 25 bp, Artificial sequence
  Synthetic oligonucleotide
aagacgaaaaaagccttccggcgca

SEQ ID NO: 668608 - DNA, 25 bp, Artificial sequence
  Synthetic oligonucleotide
aagacgaaaaaacccttccggcgca

SEQ ID NO: 668609 - DNA, 25 bp, Artificial sequence
  Synthetic oligonucleotide
agtttcttttcctaacggatgctga

SEQ ID NO: 668610 - DNA, 25 bp, Artificial sequence
  Synthetic oligonucleotide
cggattttgttattgatatctcgga

SEQ ID NO: 668611 - DNA, 25 bp, Artificial sequence
  Synthetic oligonucleotide
gatgtgcttgggcgcgaacaatgag

SEQ ID NO: 668612 - DNA, 25 bp, Artificial sequence
  Synthetic oligonucleotide
caaagaaacaaagcctcaacgccta

SEQ ID NO: 668613 - DNA, 25 bp, Artificial sequence
  Synthetic oligonucleotide
taggaatcacatgctatccgagcgt

SEQ ID NO: 668614 - DNA, 25 bp, Artificial sequence
  Synthetic oligonucleotide
gtatcattgcgagagaactggggaa

SEQ ID NO: 668615 - DNA, 25 bp, Artificial sequence
  Synthetic oligonucleotide
gtatcattgcgacagaactggggaa

SEQ ID NO: 668616 - DNA, 25 bp, Artificial sequence
  Synthetic oligonucleotide
aaaagggacatgaaatccatttcat

SEQ ID NO: 668617 - DNA, 25 bp, Artificial sequence
  Synthetic oligonucleotide
aaaagggacatgtaatccatttcat

SEQ ID NO: 668618 - DNA, 25 bp, Artificial sequence
  Synthetic oligonucleotide
ttccgtttagactgaatacatatca

SEQ ID NO: 668619 - DNA, 25 bp, Artificial sequence
  Synthetic oligonucleotide
gatgtgcttgggggcgaacaatgag

SEQ ID NO: 668620 - DNA, 25 bp, Artificial sequence
  Synthetic oligonucleotide
gcaattcggtcatttgtcactgtca

SEQ ID NO: 668621 - DNA, 25 bp, Artificial sequence
  Synthetic oligonucleotide
cgaatgggtataatgaaatcgttga

SEQ ID NO: 668622 - DNA, 25 bp, Artificial sequence
  Synthetic oligonucleotide
ttatcccgtcaaaggattccgtttc

SEQ ID NO: 668623 - DNA, 25 bp, Artificial sequence
  Synthetic oligonucleotide
ttatcccgtcaatggattccgtttc

SEQ ID NO: 668624 - DNA, 25 bp, Artificial sequence
  Synthetic oligonucleotide
acgcttccagacggcggcctaataa

SEQ ID NO: 668625 - DNA, 25 bp, Artificial sequence
  Synthetic oligonucleotide
agtttcttttccaaacggatgctga

SEQ ID NO: 668626 - DNA, 25 bp, Artificial sequence
  Synthetic oligonucleotide
gctttacggtaaagaagcgggcgtg

SEQ ID NO: 668627 - DNA, 25 bp, Artificial sequence
  Synthetic oligonucleotide
cggattttgttaatgatatctcgga

SEQ ID NO: 668628 - DNA, 25 bp, Artificial sequence
  Synthetic oligonucleotide
cgaatgggtatattgaaatcgttga

SEQ ID NO: 668629 - DNA, 25 bp, Artificial sequence
  Synthetic oligonucleotide
aagaagcgatctattccgccggaat

SEQ ID NO: 668630 - DNA, 25 bp, Artificial sequence
  Synthetic oligonucleotide
gcaattcggtcaattgtcactgtca

SEQ ID NO: 668631 - DNA, 25 bp, Artificial sequence
  Synthetic oligonucleotide
gccatccggatcacggcaatgcggc

SEQ ID NO: 668632 - DNA, 25 bp, Artificial sequence
  Synthetic oligonucleotide
aagaagcgatcttttccgccggaat

SEQ ID NO: 668633 - DNA, 25 bp, Artificial sequence
  Synthetic oligonucleotide
aatcaagaccgtgttgaagatcttt

SEQ ID NO: 668634 - DNA, 25 bp, Artificial sequence
  Synthetic oligonucleotide
gccatccggatctcggcaatgcggc

SEQ ID NO: 668635 - DNA, 25 bp, Artificial sequence
  Synthetic oligonucleotide
caaagaaacaaaccctcaacgccta

SEQ ID NO: 668636 - DNA, 25 bp, Artificial sequence
  Synthetic oligonucleotide
gctttacggtaatgaagcgggcgtg

SEQ ID NO: 668637 - DNA, 25 bp, Artificial sequence
  Synthetic oligonucleotide
ggcaaaacgaaaccgaagctgcttt

SEQ ID NO: 668638 - DNA, 25 bp, Artificial sequence
  Synthetic oligonucleotide
gagaaaaaaattgaaacgatttata

SEQ ID NO: 668639 - DNA, 25 bp, Artificial sequence
  Synthetic oligonucleotide
gagcgcgtgtatgtgaagaaaaaca

SEQ ID NO: 668640 - DNA, 25 bp, Artificial sequence
  Synthetic oligonucleotide
gagcgcgtgtatctgaagaaaaaca

SEQ ID NO: 668641 - DNA, 25 bp, Artificial sequence
  Synthetic oligonucleotide
aaagagaaacatcgaattttaccag

SEQ ID NO: 668642 - DNA, 25 bp, Artificial sequence
  Synthetic oligonucleotide
aaagagaaacatggaattttaccag

SEQ ID NO: 668643 - DNA, 25 bp, Artificial sequence
  Synthetic oligonucleotide
gtcatccatgtgaccaacttcagaa

SEQ ID NO: 668644 - DNA, 25 bp, Artificial sequence
  Synthetic oligonucleotide
gagaaaaaaattcaaacgatttata

SEQ ID NO: 668645 - DNA, 25 bp, Artificial sequence
  Synthetic oligonucleotide
gtgcaggatgtcatccgtgtgttcc

SEQ ID NO: 668646 - DNA, 25 bp, Artificial sequence
  Synthetic oligonucleotide
gtgcaggatgtcttccgtgtgttcc

SEQ ID NO: 668647 - DNA, 25 bp, Artificial sequence
  Synthetic oligonucleotide
ggtccggagaaaacgacagcctgcg

SEQ ID NO: 668648 - DNA, 25 bp, Artificial sequence
  Synthetic oligonucleotide
ggtccggagaaatcgacagcctgcg

SEQ ID NO: 668649 - DNA, 25 bp, Artificial sequence
  Synthetic oligonucleotide
aaatatggcttgcaagaccaagtct

SEQ ID NO: 668650 - DNA, 25 bp, Artificial sequence
  Synthetic oligonucleotide
attttcatgaagatgaggttaatca

SEQ ID NO: 668651 - DNA, 25 bp, Artificial sequence
  Synthetic oligonucleotide
ggccaaaagcggtttttatgccgta

SEQ ID NO: 668652 - DNA, 25 bp, Artificial sequence
  Synthetic oligonucleotide
aaatatggcttggaagaccaagtct

SEQ ID NO: 668653 - DNA, 25 bp, Artificial sequence
  Synthetic oligonucleotide
gtcatccatgtgtccaacttcagaa

SEQ ID NO: 668654 - DNA, 25 bp, Artificial sequence
  Synthetic oligonucleotide
ttatccatgctcactatgctctccc

SEQ ID NO: 668655 - DNA, 25 bp, Artificial sequence
  Synthetic oligonucleotide
ttaagtatcctcggtatgatttgac

SEQ ID NO: 668656 - DNA, 25 bp, Artificial sequence
  Synthetic oligonucleotide
ttaagtatcctccgtatgatttgac

SEQ ID NO: 668657 - DNA, 25 bp, Artificial sequence
  Synthetic oligonucleotide
ggcaaaacgaaagcgaagctgcttt

SEQ ID NO: 668658 - DNA, 25 bp, Artificial sequence
  Synthetic oligonucleotide
ccgtctcctcagggcttgcggctga

SEQ ID NO: 668659 - DNA, 25 bp, Artificial sequence
  Synthetic oligonucleotide
attttcatgaagttgaggttaatca

SEQ ID NO: 668660 - DNA, 25 bp, Artificial sequence
  Synthetic oligonucleotide
aaatcgctgaggaggcggaacggga

SEQ ID NO: 668661 - DNA, 25 bp, Artificial sequence
  Synthetic oligonucleotide
aaatcgctgaggtggcggaacggga

SEQ ID NO: 668662 - DNA, 25 bp, Artificial sequence
  Synthetic oligonucleotide
ttatccatgctctctatgctctccc

SEQ ID NO: 668663 - DNA, 25 bp, Artificial sequence
  Synthetic oligonucleotide
gcgcctatcttggaaaacaaatgct

SEQ ID NO: 668664 - DNA, 25 bp, Artificial sequence
  Synthetic oligonucleotide
cggtgttaggttatgatccgtctct

SEQ ID NO: 668665 - DNA, 25 bp, Artificial sequence
  Synthetic oligonucleotide
ccgtctcctcagcgcttgcggctga

SEQ ID NO: 668666 - DNA, 25 bp, Artificial sequence
  Synthetic oligonucleotide
tccgttttgctattgagtcatcaga

SEQ ID NO: 668667 - DNA, 25 bp, Artificial sequence
  Synthetic oligonucleotide
tccgttttgctaatgagtcatcaga

SEQ ID NO: 668668 - DNA, 25 bp, Artificial sequence
  Synthetic oligonucleotide
cggtgttaggttttgatccgtctct

SEQ ID NO: 668669 - DNA, 25 bp, Artificial sequence
  Synthetic oligonucleotide
gcgcctatcttgcaaaacaaatgct

SEQ ID NO: 668670 - DNA, 25 bp, Artificial sequence
  Synthetic oligonucleotide
tcggcattgttagcactttgcatgg

SEQ ID NO: 668671 - DNA, 25 bp, Artificial sequence
  Synthetic oligonucleotide
tcggcattgttaccactttgcatgg

SEQ ID NO: 668672 - DNA, 25 bp, Artificial sequence
  Synthetic oligonucleotide
ttaaaaataatagccagtccggctc

SEQ ID NO: 668673 - DNA, 25 bp, Artificial sequence
  Synthetic oligonucleotide
aggaacaaagactaggctacagtgc

SEQ ID NO: 668674 - DNA, 25 bp, Artificial sequence
  Synthetic oligonucleotide
aggggcatatggttttcatatcgct

SEQ ID NO: 668675 - DNA, 25 bp, Artificial sequence
  Synthetic oligonucleotide
cagccgccttttatctattacatgt

SEQ ID NO: 668676 - DNA, 25 bp, Artificial sequence
  Synthetic oligonucleotide
aggggcatatggatttcatatcgct

SEQ ID NO: 668677 - DNA, 25 bp, Artificial sequence
  Synthetic oligonucleotide
ccggcaaataaagcggcgagcgcta

SEQ ID NO: 668678 - DNA, 25 bp, Artificial sequence
  Synthetic oligonucleotide
taaacaaacattctcctgccgagca

SEQ ID NO: 668679 - DNA, 25 bp, Artificial sequence
  Synthetic oligonucleotide
ttaaaaataatacccagtccggctc

SEQ ID NO: 668680 - DNA, 25 bp, Artificial sequence
  Synthetic oligonucleotide
attcactaaacgtgcgatgatatca

SEQ ID NO: 668681 - DNA, 25 bp, Artificial sequence
  Synthetic oligonucleotide
attcactaaacgagcgatgatatca

SEQ ID NO: 668682 - DNA, 25 bp, Artificial sequence
  Synthetic oligonucleotide
aaacatcgttctgcccatcggaatc

SEQ ID NO: 668683 - DNA, 25 bp, Artificial sequence
  Synthetic oligonucleotide
aaacatcgttctccccatcggaatc

SEQ ID NO: 668684 - DNA, 25 bp, Artificial sequence
  Synthetic oligonucleotide
aagcaaagacaatatgatgacgcag

SEQ ID NO: 668685 - DNA, 25 bp, Artificial sequence
  Synthetic oligonucleotide
ccggcaaataaaccggcgagcgcta

SEQ ID NO: 668686 - DNA, 25 bp, Artificial sequence
  Synthetic oligonucleotide
tctgcatattgatatgaaccaagcc

SEQ ID NO: 668687 - DNA, 25 bp, Artificial sequence
  Synthetic oligonucleotide
aagcaaagacaaaatgatgacgcag

SEQ ID NO: 668688 - DNA, 25 bp, Artificial sequence
  Synthetic oligonucleotide
aaaagaaaacaggaaacgtgcttaa

SEQ ID NO: 668689 - DNA, 25 bp, Artificial sequence
  Synthetic oligonucleotide
ccttccattagaaagcgtttatatt

SEQ ID NO: 668690 - DNA, 25 bp, Artificial sequence
  Synthetic oligonucleotide
atctaatttctccaagcatcacaca

SEQ ID NO: 668691 - DNA, 25 bp, Artificial sequence
  Synthetic oligonucleotide
ttgccgctccgaataaaataaaaaa

SEQ ID NO: 668692 - DNA, 25 bp, Artificial sequence
  Synthetic oligonucleotide
aggaacaaagacaaggctacagtgc

SEQ ID NO: 668693 - DNA, 25 bp, Artificial sequence
  Synthetic oligonucleotide
tctgcatattgaaatgaaccaagcc

SEQ ID NO: 668694 - DNA, 25 bp, Artificial sequence
  Synthetic oligonucleotide
taaacaaacattgtcctgccgagca

SEQ ID NO: 668695 - DNA, 25 bp, Artificial sequence
  Synthetic oligonucleotide
gtgtaatacctgaaaaaccgccctc

SEQ ID NO: 668696 - DNA, 25 bp, Artificial sequence
  Synthetic oligonucleotide
gtgtaatacctgtaaaaccgccctc

SEQ ID NO: 668697 - DNA, 25 bp, Artificial sequence
  Synthetic oligonucleotide
atagaggggctgatgtggaaaaggg

SEQ ID NO: 668698 - DNA, 25 bp, Artificial sequence
  Synthetic oligonucleotide
atagaggggctgttgtggaaaaggg

SEQ ID NO: 668699 - DNA, 25 bp, Artificial sequence
  Synthetic oligonucleotide
ataaaaaaaatccgaatgttcaaca

SEQ ID NO: 668700 - DNA, 25 bp, Artificial sequence
  Synthetic oligonucleotide
ataaaaaaaatcggaatgttcaaca

SEQ ID NO: 668701 - DNA, 25 bp, Artificial sequence
  Synthetic oligonucleotide
ttgccgctccgattaaaataaaaaa

SEQ ID NO: 668702 - DNA, 25 bp, Artificial sequence
  Synthetic oligonucleotide
ttacagaaagtagaaggcggaaaaa

SEQ ID NO: 668703 - DNA, 25 bp, Artificial sequence
  Synthetic oligonucleotide
cggatttttattttcatcaagcgta

SEQ ID NO: 668704 - DNA, 25 bp, Artificial sequence
  Synthetic oligonucleotide
aaaagaaaacagcaaacgtgcttaa

SEQ ID NO: 668705 - DNA, 25 bp, Artificial sequence
  Synthetic oligonucleotide
cggatttttattatcatcaagcgta

SEQ ID NO: 668706 - DNA, 25 bp, Artificial sequence
  Synthetic oligonucleotide
ccttccattagatagcgtttatatt

SEQ ID NO: 668707 - DNA, 25 bp, Artificial sequence
  Synthetic oligonucleotide
cagccgccttttttctattacatgt

SEQ ID NO: 668708 - DNA, 25 bp, Artificial sequence
  Synthetic oligonucleotide
gagcacatcgtgtacatcgcttacc

SEQ ID NO: 668709 - DNA, 25 bp, Artificial sequence
  Synthetic oligonucleotide
aagggactaccctaaataaggatga

SEQ ID NO: 668710 - DNA, 25 bp, Artificial sequence
  Synthetic oligonucleotide
atggggatcaatcgagttaatcacg

SEQ ID NO: 668711 - DNA, 25 bp, Artificial sequence
  Synthetic oligonucleotide
ttacagaaagtacaaggcggaaaaa

SEQ ID NO: 668712 - DNA, 25 bp, Artificial sequence
  Synthetic oligonucleotide
cggcagtatcatgattactgctctt

SEQ ID NO: 668713 - DNA, 25 bp, Artificial sequence
  Synthetic oligonucleotide
cggcagtatcatcattactgctctt

SEQ ID NO: 668714 - DNA, 25 bp, Artificial sequence
  Synthetic oligonucleotide
acgcttccagaccgcggcctaataa

SEQ ID NO: 668715 - DNA, 25 bp, Artificial sequence
  Synthetic oligonucleotide
tgccgatccgtcattactctgggtg

SEQ ID NO: 668716 - DNA, 25 bp, Artificial sequence
  Synthetic oligonucleotide
tgccgatccgtctttactctgggtg

SEQ ID NO: 668717 - DNA, 25 bp, Artificial sequence
  Synthetic oligonucleotide
aagggactacccaaaataaggatga

SEQ ID NO: 668718 - DNA, 25 bp, Artificial sequence
  Synthetic oligonucleotide
caaaatggtgacgccccgttccatt

SEQ ID NO: 668719 - DNA, 25 bp, Artificial sequence
  Synthetic oligonucleotide
cagcgtatacatggcttctttatag

SEQ ID NO: 668720 - DNA, 25 bp, Artificial sequence
  Synthetic oligonucleotide
aaaatcgattaaacttgccgctaca

SEQ ID NO: 668721 - DNA, 25 bp, Artificial sequence
  Synthetic oligonucleotide
aaaatcgattaatcttgccgctaca

SEQ ID NO: 668722 - DNA, 25 bp, Artificial sequence
  Synthetic oligonucleotide
cgtagcgccttttgcagcgtatccg

SEQ ID NO: 668723 - DNA, 25 bp, Artificial sequence
  Synthetic oligonucleotide
cgtagcgcctttagcagcgtatccg

SEQ ID NO: 668724 - DNA, 25 bp, Artificial sequence
  Synthetic oligonucleotide
gagcacatcgtgaacatcgcttacc

SEQ ID NO: 668725 - DNA, 25 bp, Artificial sequence
  Synthetic oligonucleotide
ctttttctgaatcaggtcgtttttc

SEQ ID NO: 668726 - DNA, 25 bp, Artificial sequence
  Synthetic oligonucleotide
cagcgtatacatcgcttctttatag

SEQ ID NO: 668727 - DNA, 25 bp, Artificial sequence
  Synthetic oligonucleotide
caaaatggtgaccccccgttccatt

SEQ ID NO: 668728 - DNA, 25 bp, Artificial sequence
  Synthetic oligonucleotide
atctatatcctcatttgtgtaggaa

SEQ ID NO: 668729 - DNA, 25 bp, Artificial sequence
  Synthetic oligonucleotide
atctatatcctcttttgtgtaggaa

SEQ ID NO: 668730 - DNA, 25 bp, Artificial sequence
  Synthetic oligonucleotide
caccaattcatttttcggcaccaca

SEQ ID NO: 668731 - DNA, 25 bp, Artificial sequence
  Synthetic oligonucleotide
caccaattcattattcggcaccaca

SEQ ID NO: 668732 - DNA, 25 bp, Artificial sequence
  Synthetic oligonucleotide
atggggatcaatggagttaatcacg

SEQ ID NO: 668733 - DNA, 25 bp, Artificial sequence
  Synthetic oligonucleotide
ctttttctgaatgaggtcgtttttc

SEQ ID NO: 668734 - DNA, 25 bp, Artificial sequence
  Synthetic oligonucleotide
tttcatgtcaggggttaaactgtca

SEQ ID NO: 668735 - DNA, 25 bp, Artificial sequence
  Synthetic oligonucleotide
gcttaaaacagcggaaatgatttca

SEQ ID NO: 668736 - DNA, 25 bp, Artificial sequence
  Synthetic oligonucleotide
gaaaattcatgaggcgacaggtctt

SEQ ID NO: 668737 - DNA, 25 bp, Artificial sequence
  Synthetic oligonucleotide
gaatcatgatctttacgcaaccgga

SEQ ID NO: 668738 - DNA, 25 bp, Artificial sequence
  Synthetic oligonucleotide
gaatcatgatctatacgcaaccgga

SEQ ID NO: 668739 - DNA, 25 bp, Artificial sequence
  Synthetic oligonucleotide
ggttcaatttaccactgcctatcgg

SEQ ID NO: 668740 - DNA, 25 bp, Artificial sequence
  Synthetic oligonucleotide
ggttcaatttacgactgcctatcgg

SEQ ID NO: 668741 - DNA, 25 bp, Artificial sequence
  Synthetic oligonucleotide
tgctttgatcgcccatgacaagaaa

SEQ ID NO: 668742 - DNA, 25 bp, Artificial sequence
  Synthetic oligonucleotide
tgctttgatcgcgcatgacaagaaa

SEQ ID NO: 668743 - DNA, 25 bp, Artificial sequence
  Synthetic oligonucleotide
tatcattgattacacggggggataa

SEQ ID NO: 668744 - DNA, 25 bp, Artificial sequence
  Synthetic oligonucleotide
tatcattgattagacggggggataa

SEQ ID NO: 668745 - DNA, 25 bp, Artificial sequence
  Synthetic oligonucleotide
ttcaatccggccgtttagggggaga

SEQ ID NO: 668746 - DNA, 25 bp, Artificial sequence
  Synthetic oligonucleotide
catgaagattgaacagcttgtgtat

SEQ ID NO: 668747 - DNA, 25 bp, Artificial sequence
  Synthetic oligonucleotide
ttcaatccggccctttagggggaga

SEQ ID NO: 668748 - DNA, 25 bp, Artificial sequence
  Synthetic oligonucleotide
tttcatgtcaggcgttaaactgtca

SEQ ID NO: 668749 - DNA, 25 bp, Artificial sequence
  Synthetic oligonucleotide
gcttcagatacgccatgattcttat

SEQ ID NO: 668750 - DNA, 25 bp, Artificial sequence
  Synthetic oligonucleotide
gcttcagatacggcatgattcttat

SEQ ID NO: 668751 - DNA, 25 bp, Artificial sequence
  Synthetic oligonucleotide
gcatcaggaggtgatgttcggcatg

SEQ ID NO: 668752 - DNA, 25 bp, Artificial sequence
  Synthetic oligonucleotide
gcatcaggaggtcatgttcggcatg

SEQ ID NO: 668753 - DNA, 25 bp, Artificial sequence
  Synthetic oligonucleotide
tcgcttgcacagcgtccgtcttccg

SEQ ID NO: 668754 - DNA, 25 bp, Artificial sequence
  Synthetic oligonucleotide
tcgcttgcacagggtccgtcttccg

SEQ ID NO: 668755 - DNA, 25 bp, Artificial sequence
  Synthetic oligonucleotide
atctaatttctcgaagcatcacaca

SEQ ID NO: 668756 - DNA, 25 bp, Artificial sequence
  Synthetic oligonucleotide
tctcccaggagcaagaggagcggag

SEQ ID NO: 668757 - DNA, 25 bp, Artificial sequence
  Synthetic oligonucleotide
acgtatctgaataagctaacatgta

SEQ ID NO: 668758 - DNA, 25 bp, Artificial sequence
  Synthetic oligonucleotide
agaaaagcagcaaggacatccggat

SEQ ID NO: 668759 - DNA, 25 bp, Artificial sequence
  Synthetic oligonucleotide
catgaagattgatcagcttgtgtat

SEQ ID NO: 668760 - DNA, 25 bp, Artificial sequence
  Synthetic oligonucleotide
tcgaattccgtgtccttcttcgggg

SEQ ID NO: 668761 - DNA, 25 bp, Artificial sequence
  Synthetic oligonucleotide
gcccgcatattacgcgcagataaaa

SEQ ID NO: 668762 - DNA, 25 bp, Artificial sequence
  Synthetic oligonucleotide
gcccgcatattaggcgcagataaaa

SEQ ID NO: 668763 - DNA, 25 bp, Artificial sequence
  Synthetic oligonucleotide
acggtcagtttgggtaaagaagaag

SEQ ID NO: 668764 - DNA, 25 bp, Artificial sequence
  Synthetic oligonucleotide
acggtcagtttgcgtaaagaagaag

SEQ ID NO: 668765 - DNA, 25 bp, Artificial sequence
  Synthetic oligonucleotide
tgcgatttgacacaagcggaactct

SEQ ID NO: 668766 - DNA, 25 bp, Artificial sequence
  Synthetic oligonucleotide
tgcgatttgacagaagcggaactct

SEQ ID NO: 668767 - DNA, 25 bp, Artificial sequence
  Synthetic oligonucleotide
gcgaagtttgtctaacaggaaaaaa

SEQ ID NO: 668768 - DNA, 25 bp, Artificial sequence
  Synthetic oligonucleotide
gcgaagtttgtcaaacaggaaaaaa

SEQ ID NO: 668769 - DNA, 25 bp, Artificial sequence
  Synthetic oligonucleotide
agtgatgatgtcgagatcggaatgg

SEQ ID NO: 668770 - DNA, 25 bp, Artificial sequence
  Synthetic oligonucleotide
agtgatgatgtccagatcggaatgg

SEQ ID NO: 668771 - DNA, 25 bp, Artificial sequence
  Synthetic oligonucleotide
gaaaattcatgacgcgacaggtctt

SEQ ID NO: 668772 - DNA, 25 bp, Artificial sequence
  Synthetic oligonucleotide
atgtataatgctgacgttcttgctt

SEQ ID NO: 668773 - DNA, 25 bp, Artificial sequence
  Synthetic oligonucleotide
agaaaagcagcatggacatccggat

SEQ ID NO: 668774 - DNA, 25 bp, Artificial sequence
  Synthetic oligonucleotide
tcgaattccgtgaccttcttcgggg

SEQ ID NO: 668775 - DNA, 25 bp, Artificial sequence
  Synthetic oligonucleotide
cggaaattcttgagcgcacacttga

SEQ ID NO: 668776 - DNA, 25 bp, Artificial sequence
  Synthetic oligonucleotide
cggaaattcttgtgcgcacacttga

SEQ ID NO: 668777 - DNA, 25 bp, Artificial sequence
  Synthetic oligonucleotide
tgtattccattccgctcgccacaaa

SEQ ID NO: 668778 - DNA, 25 bp, Artificial sequence
  Synthetic oligonucleotide
tgtattccattcggctcgccacaaa

SEQ ID NO: 668779 - DNA, 25 bp, Artificial sequence
  Synthetic oligonucleotide
aaccggatgtctgggcattaatccg

SEQ ID NO: 668780 - DNA, 25 bp, Artificial sequence
  Synthetic oligonucleotide
aaccggatgtctcggcattaatccg

SEQ ID NO: 668781 - DNA, 25 bp, Artificial sequence
  Synthetic oligonucleotide
tttttttgcgcgtcccgctgaccgc

SEQ ID NO: 668782 - DNA, 25 bp, Artificial sequence
  Synthetic oligonucleotide
tttttttgcgcgacccgctgaccgc

SEQ ID NO: 668783 - DNA, 25 bp, Artificial sequence
  Synthetic oligonucleotide
gtgcactgatcggtgccaatgcact

SEQ ID NO: 668784 - DNA, 25 bp, Artificial sequence
  Synthetic oligonucleotide
gtgcactgatcgctgccaatgcact

SEQ ID NO: 668785 - DNA, 25 bp, Artificial sequence
  Synthetic oligonucleotide
atgtataatgctcacgttcttgctt

SEQ ID NO: 668786 - DNA, 25 bp, Artificial sequence
  Synthetic oligonucleotide
cgactgaagatgataaaagcatgga

SEQ ID NO: 668787 - DNA, 25 bp, Artificial sequence
  Synthetic oligonucleotide
ggcagaacgaactccacattttgac

SEQ ID NO: 668788 - DNA, 25 bp, Artificial sequence
  Synthetic oligonucleotide
tctcccaggagctagaggagcggag

SEQ ID NO: 668789 - DNA, 25 bp, Artificial sequence
  Synthetic oligonucleotide
accgcgtggaagtatggggcaggaa

SEQ ID NO: 668790 - DNA, 25 bp, Artificial sequence
  Synthetic oligonucleotide
gatgtcaaacgaaacaattaaatta

SEQ ID NO: 668791 - DNA, 25 bp, Artificial sequence
  Synthetic oligonucleotide
gatgtcaaacgatacaattaaatta

SEQ ID NO: 668792 - DNA, 25 bp, Artificial sequence
  Synthetic oligonucleotide
ggaccagaaaagtagaaggaaagta

SEQ ID NO: 668793 - DNA, 25 bp, Artificial sequence
  Synthetic oligonucleotide
ggaccagaaaagaagaaggaaagta

SEQ ID NO: 668794 - DNA, 25 bp, Artificial sequence
  Synthetic oligonucleotide
tcatgcataaatttaatacaagaga

SEQ ID NO: 668795 - DNA, 25 bp, Artificial sequence
  Synthetic oligonucleotide
tcatgcataaatataatacaagaga

SEQ ID NO: 668796 - DNA, 25 bp, Artificial sequence
  Synthetic oligonucleotide
ctcttgatatctctttagaggaagc

SEQ ID NO: 668797 - DNA, 25 bp, Artificial sequence
  Synthetic oligonucleotide
ctcttgatatctgtttagaggaagc

SEQ ID NO: 668798 - DNA, 25 bp, Artificial sequence
  Synthetic oligonucleotide
gcttaaaacagccgaaatgatttca

SEQ ID NO: 668799 - DNA, 25 bp, Artificial sequence
  Synthetic oligonucleotide
gcgatgtgctatttgtattggtttg

SEQ ID NO: 668800 - DNA, 25 bp, Artificial sequence
  Synthetic oligonucleotide
ggcagaacgaacaccacattttgac

SEQ ID NO: 668801 - DNA, 25 bp, Artificial sequence
  Synthetic oligonucleotide
cgactgaagatgttaaaagcatgga

SEQ ID NO: 668802 - DNA, 25 bp, Artificial sequence
  Synthetic oligonucleotide
aagtgaatcacccttatggagaaaa

SEQ ID NO: 668803 - DNA, 25 bp, Artificial sequence
  Synthetic oligonucleotide
aagtgaatcaccgttatggagaaaa

SEQ ID NO: 668804 - DNA, 25 bp, Artificial sequence
  Synthetic oligonucleotide
cgaggctgactgaagaactgggcga

SEQ ID NO: 668805 - DNA, 25 bp, Artificial sequence
  Synthetic oligonucleotide
cgaggctgactgtagaactgggcga

SEQ ID NO: 668806 - DNA, 25 bp, Artificial sequence
  Synthetic oligonucleotide
ttaaagaaggattttttagcccgct

SEQ ID NO: 668807 - DNA, 25 bp, Artificial sequence
  Synthetic oligonucleotide
ttaaagaaggatattttagcccgct

SEQ ID NO: 668808 - DNA, 25 bp, Artificial sequence
  Synthetic oligonucleotide
acatacaggctgaagtagaccgtta

SEQ ID NO: 668809 - DNA, 25 bp, Artificial sequence
  Synthetic oligonucleotide
acatacaggctgtagtagaccgtta

SEQ ID NO: 668810 - DNA, 25 bp, Artificial sequence
  Synthetic oligonucleotide
ggaggtttcgttgagtgagtgataa

SEQ ID NO: 668811 - DNA, 25 bp, Artificial sequence
  Synthetic oligonucleotide
ggaggtttcgttcagtgagtgataa

SEQ ID NO: 668812 - DNA, 25 bp, Artificial sequence
  Synthetic oligonucleotide
acgtatctgaattagctaacatgta

SEQ ID NO: 668813 - DNA, 25 bp, Artificial sequence
  Synthetic oligonucleotide
gcgatgtgctatatgtattggtttg

SEQ ID NO: 668814 - DNA, 25 bp, Artificial sequence
  Synthetic oligonucleotide
tcatgaccagaaccttgacgcacca

SEQ ID NO: 668815 - DNA, 25 bp, Artificial sequence
  Synthetic oligonucleotide
caactattttgacgatgttgagatt

SEQ ID NO: 668816 - DNA, 25 bp, Artificial sequence
  Synthetic oligonucleotide
tgcgatactgatgatgaaattttca

SEQ ID NO: 668817 - DNA, 25 bp, Artificial sequence
  Synthetic oligonucleotide
tgcgatactgatcatgaaattttca

SEQ ID NO: 668818 - DNA, 25 bp, Artificial sequence
  Synthetic oligonucleotide
gatcggagccatcatcgcgccaaat

SEQ ID NO: 668819 - DNA, 25 bp, Artificial sequence
  Synthetic oligonucleotide
gatcggagccatgatcgcgccaaat

SEQ ID NO: 668820 - DNA, 25 bp, Artificial sequence
  Synthetic oligonucleotide
tttaaaagagctgacatctttaaca

SEQ ID NO: 668821 - DNA, 25 bp, Artificial sequence
  Synthetic oligonucleotide
tttaaaagagctcacatctttaaca

SEQ ID NO: 668822 - DNA, 25 bp, Artificial sequence
  Synthetic oligonucleotide
accgcgtggaagaatggggcaggaa

SEQ ID NO: 668823 - DNA, 25 bp, Artificial sequence
  Synthetic oligonucleotide
catagaccatacatacgatcagcaa

SEQ ID NO: 668824 - DNA, 25 bp, Artificial sequence
  Synthetic oligonucleotide
caactattttgaggatgttgagatt

SEQ ID NO: 668825 - DNA, 25 bp, Artificial sequence
  Synthetic oligonucleotide
tcatgaccagaagcttgacgcacca

SEQ ID NO: 668826 - DNA, 25 bp, Artificial sequence
  Synthetic oligonucleotide
tccagttgtcggtacaaccggtttc

SEQ ID NO: 668827 - DNA, 25 bp, Artificial sequence
  Synthetic oligonucleotide
tccagttgtcggaacaaccggtttc

SEQ ID NO: 668828 - DNA, 25 bp, Artificial sequence
  Synthetic oligonucleotide
agtacatacaaaaattgcattagag

SEQ ID NO: 668829 - DNA, 25 bp, Artificial sequence
  Synthetic oligonucleotide
agtacatacaaatattgcattagag

SEQ ID NO: 668830 - DNA, 25 bp, Artificial sequence
  Synthetic oligonucleotide
tgtcttgattgatttaacaacgccc

SEQ ID NO: 668831 - DNA, 25 bp, Artificial sequence
  Synthetic oligonucleotide
tgtcttgattgaattaacaacgccc

SEQ ID NO: 668832 - DNA, 25 bp, Artificial sequence
  Synthetic oligonucleotide
agatatccatgcctgttttacagaa

SEQ ID NO: 668833 - DNA, 25 bp, Artificial sequence
  Synthetic oligonucleotide
agatatccatgcgtgttttacagaa

SEQ ID NO: 668834 - DNA, 25 bp, Artificial sequence
  Synthetic oligonucleotide
tgtgatgcctgtagagtcagatgct

SEQ ID NO: 668835 - DNA, 25 bp, Artificial sequence
  Synthetic oligonucleotide
tgtgatgcctgttgagtcagatgct

SEQ ID NO: 668836 - DNA, 25 bp, Artificial sequence
  Synthetic oligonucleotide
catagaccatacttacgatcagcaa

SEQ ID NO: 668837 - DNA, 25 bp, Artificial sequence
  Synthetic oligonucleotide
gcggcagccaactggatcggagaag

SEQ ID NO: 668838 - DNA, 25 bp, Artificial sequence
  Synthetic oligonucleotide
attccgagacccgccgttgtatttg

SEQ ID NO: 668839 - DNA, 25 bp, Artificial sequence
  Synthetic oligonucleotide
acggtatcaattgccggaaagtgct

SEQ ID NO: 668840 - DNA, 25 bp, Artificial sequence
  Synthetic oligonucleotide
gatatgctgatttgggatattgacc

SEQ ID NO: 668841 - DNA, 25 bp, Artificial sequence
  Synthetic oligonucleotide
tttcttatttgaatatagatacaat

SEQ ID NO: 668842 - DNA, 25 bp, Artificial sequence
  Synthetic oligonucleotide
aaagaaggcgatgttcttgccgttt

SEQ ID NO: 668843 - DNA, 25 bp, Artificial sequence
  Synthetic oligonucleotide
aaagaaggcgatcttcttgccgttt

SEQ ID NO: 668844 - DNA, 25 bp, Artificial sequence
  Synthetic oligonucleotide
acggtatcaattcccggaaagtgct

SEQ ID NO: 668845 - DNA, 25 bp, Artificial sequence
  Synthetic oligonucleotide
gcttatggatacagcatggccaaca

SEQ ID NO: 668846 - DNA, 25 bp, Artificial sequence
  Synthetic oligonucleotide
gcttatggatactgcatggccaaca

SEQ ID NO: 668847 - DNA, 25 bp, Artificial sequence
  Synthetic oligonucleotide
gatatgctgattagggatattgacc

SEQ ID NO: 668848 - DNA, 25 bp, Artificial sequence
  Synthetic oligonucleotide
attccgagaccccccgttgtatttg

SEQ ID NO: 668849 - DNA, 25 bp, Artificial sequence
  Synthetic oligonucleotide
gaggctcatttagtcgtgaagcgag

SEQ ID NO: 668850 - DNA, 25 bp, Artificial sequence
  Synthetic oligonucleotide
gaggctcatttactcgtgaagcgag

SEQ ID NO: 668851 - DNA, 25 bp, Artificial sequence
  Synthetic oligonucleotide
gatattgtaaaagttgatctgccat

SEQ ID NO: 668852 - DNA, 25 bp, Artificial sequence
  Synthetic oligonucleotide
gatattgtaaaacttgatctgccat

SEQ ID NO: 668853 - DNA, 25 bp, Artificial sequence
  Synthetic oligonucleotide
gtaaagcaataaaagaaacgccgat

SEQ ID NO: 668854 - DNA, 25 bp, Artificial sequence
  Synthetic oligonucleotide
tttcttatttgattatagatacaat

SEQ ID NO: 668855 - DNA, 25 bp, Artificial sequence
  Synthetic oligonucleotide
gcggcagccaacaggatcggagaag

SEQ ID NO: 668856 - DNA, 25 bp, Artificial sequence
  Synthetic oligonucleotide
tggagagattcatattcatttgtat

SEQ ID NO: 668857 - DNA, 25 bp, Artificial sequence
  Synthetic oligonucleotide
tagatacgaagatatcaatgacttt

SEQ ID NO: 668858 - DNA, 25 bp, Artificial sequence
  Synthetic oligonucleotide
tagatacgaagaaatcaatgacttt

SEQ ID NO: 668859 - DNA, 25 bp, Artificial sequence
  Synthetic oligonucleotide
gtaaagcaataatagaaacgccgat

SEQ ID NO: 668860 - DNA, 25 bp, Artificial sequence
  Synthetic oligonucleotide
aaaattatcgaagctgtgaaagaaa

SEQ ID NO: 668861 - DNA, 25 bp, Artificial sequence
  Synthetic oligonucleotide
tcgatatatattttcctaaatattc

SEQ ID NO: 668862 - DNA, 25 bp, Artificial sequence
  Synthetic oligonucleotide
ttttgccttcatctgattctatgaa

SEQ ID NO: 668863 - DNA, 25 bp, Artificial sequence
  Synthetic oligonucleotide
tcggaacacattcagctgctgggtg

SEQ ID NO: 668864 - DNA, 25 bp, Artificial sequence
  Synthetic oligonucleotide
atcggctcgcaaatctttgatacgg

SEQ ID NO: 668865 - DNA, 25 bp, Artificial sequence
  Synthetic oligonucleotide
atcggctcgcaattctttgatacgg

SEQ ID NO: 668866 - DNA, 25 bp, Artificial sequence
  Synthetic oligonucleotide
ttagcagcggaaaaaatcttcaaaa

SEQ ID NO: 668867 - DNA, 25 bp, Artificial sequence
  Synthetic oligonucleotide
ttagcagcggaataaatcttcaaaa

SEQ ID NO: 668868 - DNA, 25 bp, Artificial sequence
  Synthetic oligonucleotide
tggagagattcaaattcatttgtat

SEQ ID NO: 668869 - DNA, 25 bp, Artificial sequence
  Synthetic oligonucleotide
aatcttggaggaggtttcggcattc

SEQ ID NO: 668870 - DNA, 25 bp, Artificial sequence
  Synthetic oligonucleotide
aatcttggaggacgtttcggcattc

SEQ ID NO: 668871 - DNA, 25 bp, Artificial sequence
  Synthetic oligonucleotide
gatgatgaaccggttcatgccactg

SEQ ID NO: 668872 - DNA, 25 bp, Artificial sequence
  Synthetic oligonucleotide
attcgtcctgcggtttaccaagcta

SEQ ID NO: 668873 - DNA, 25 bp, Artificial sequence
  Synthetic oligonucleotide
aaaattatcgaacctgtgaaagaaa

SEQ ID NO: 668874 - DNA, 25 bp, Artificial sequence
  Synthetic oligonucleotide
ggttttgacattccggaaatttgga

SEQ ID NO: 668875 - DNA, 25 bp, Artificial sequence
  Synthetic oligonucleotide
ggttttgacattgcggaaatttgga

SEQ ID NO: 668876 - DNA, 25 bp, Artificial sequence
  Synthetic oligonucleotide
cgttctctcgtgcgagacgcaggca

SEQ ID NO: 668877 - DNA, 25 bp, Artificial sequence
  Synthetic oligonucleotide
cgttctctcgtgggagacgcaggca

SEQ ID NO: 668878 - DNA, 25 bp, Artificial sequence
  Synthetic oligonucleotide
acggttggctctcaaaaagaagtgc

SEQ ID NO: 668879 - DNA, 25 bp, Artificial sequence
  Synthetic oligonucleotide
acggttggctctgaaaaagaagtgc

SEQ ID NO: 668880 - DNA, 25 bp, Artificial sequence
  Synthetic oligonucleotide
caatatgtggctctagacggaggca

SEQ ID NO: 668881 - DNA, 25 bp, Artificial sequence
  Synthetic oligonucleotide
caatatgtggctgtagacggaggca

SEQ ID NO: 668882 - DNA, 25 bp, Artificial sequence
  Synthetic oligonucleotide
attcgtcctgcgctttaccaagcta

SEQ ID NO: 668883 - DNA, 25 bp, Artificial sequence
  Synthetic oligonucleotide
gatgatgaaccgcttcatgccactg

SEQ ID NO: 668884 - DNA, 25 bp, Artificial sequence
  Synthetic oligonucleotide
tcagcagcaaaacggccgctgccag

SEQ ID NO: 668885 - DNA, 25 bp, Artificial sequence
  Synthetic oligonucleotide
acgatgaagaaatcgctctcgatcc

SEQ ID NO: 668886 - DNA, 25 bp, Artificial sequence
  Synthetic oligonucleotide
acgatgaagaaaacgctctcgatcc

SEQ ID NO: 668887 - DNA, 25 bp, Artificial sequence
  Synthetic oligonucleotide
cacaagcagctggatagtgctgctt

SEQ ID NO: 668888 - DNA, 25 bp, Artificial sequence
  Synthetic oligonucleotide
tcgatatatattatcctaaatattc

SEQ ID NO: 668889 - DNA, 25 bp, Artificial sequence
  Synthetic oligonucleotide
tattggtcacggataccgttgtggc

SEQ ID NO: 668890 - DNA, 25 bp, Artificial sequence
  Synthetic oligonucleotide
tattggtcacggttaccgttgtggc

SEQ ID NO: 668891 - DNA, 25 bp, Artificial sequence
  Synthetic oligonucleotide
cattcatttcatgaagcactttttg

SEQ ID NO: 668892 - DNA, 25 bp, Artificial sequence
  Synthetic oligonucleotide
cattcatttcatcaagcactttttg

SEQ ID NO: 668893 - DNA, 25 bp, Artificial sequence
  Synthetic oligonucleotide
ctgacaaatcagcacccagtgttac

SEQ ID NO: 668894 - DNA, 25 bp, Artificial sequence
  Synthetic oligonucleotide
ctgacaaatcaggacccagtgttac

SEQ ID NO: 668895 - DNA, 25 bp, Artificial sequence
  Synthetic oligonucleotide
caactgcggcatccgcgagactgac

SEQ ID NO: 668896 - DNA, 25 bp, Artificial sequence
  Synthetic oligonucleotide
cattcaatccggtgccttttttggc

SEQ ID NO: 668897 - DNA, 25 bp, Artificial sequence
  Synthetic oligonucleotide
tcagcagcaaaagggccgctgccag

SEQ ID NO: 668898 - DNA, 25 bp, Artificial sequence
  Synthetic oligonucleotide
tttcatctgtgatgccgctgatatt

SEQ ID NO: 668899 - DNA, 25 bp, Artificial sequence
  Synthetic oligonucleotide
aaattttcttcaaagcagtttgacc

SEQ ID NO: 668900 - DNA, 25 bp, Artificial sequence
  Synthetic oligonucleotide
aaattttcttcatagcagtttgacc

SEQ ID NO: 668901 - DNA, 25 bp, Artificial sequence
  Synthetic oligonucleotide
cacaagcagctgcatagtgctgctt

SEQ ID NO: 668902 - DNA, 25 bp, Artificial sequence
  Synthetic oligonucleotide
gaatcatgaaaaatacagttccgtt

SEQ ID NO: 668903 - DNA, 25 bp, Artificial sequence
  Synthetic oligonucleotide
agataaagagattcaggtttcattt

SEQ ID NO: 668904 - DNA, 25 bp, Artificial sequence
  Synthetic oligonucleotide
agataaagagatacaggtttcattt

SEQ ID NO: 668905 - DNA, 25 bp, Artificial sequence
  Synthetic oligonucleotide
taaagctcgggagattcgttttccc

SEQ ID NO: 668906 - DNA, 25 bp, Artificial sequence
  Synthetic oligonucleotide
taaagctcgggacattcgttttccc

SEQ ID NO: 668907 - DNA, 25 bp, Artificial sequence
  Synthetic oligonucleotide
ggtataatagccgcgacaaggagag

SEQ ID NO: 668908 - DNA, 25 bp, Artificial sequence
  Synthetic oligonucleotide
ggtataatagccccgacaaggagag

SEQ ID NO: 668909 - DNA, 25 bp, Artificial sequence
  Synthetic oligonucleotide
tcggaacacattgagctgctgggtg

SEQ ID NO: 668910 - DNA, 25 bp, Artificial sequence
  Synthetic oligonucleotide
caactgcggcatgcgcgagactgac

SEQ ID NO: 668911 - DNA, 25 bp, Artificial sequence
  Synthetic oligonucleotide
ccgcattttcgttaccgattttgtc

SEQ ID NO: 668912 - DNA, 25 bp, Artificial sequence
  Synthetic oligonucleotide
tatctttcgcttaatctagctggtc

SEQ ID NO: 668913 - DNA, 25 bp, Artificial sequence
  Synthetic oligonucleotide
tatctttcgctttatctagctggtc

SEQ ID NO: 668914 - DNA, 25 bp, Artificial sequence
  Synthetic oligonucleotide
cccagtcaatgtcagcgtttttcat

SEQ ID NO: 668915 - DNA, 25 bp, Artificial sequence
  Synthetic oligonucleotide
cccagtcaatgtgagcgtttttcat

SEQ ID NO: 668916 - DNA, 25 bp, Artificial sequence
  Synthetic oligonucleotide
gggagacaagctgattcttttggct

SEQ ID NO: 668917 - DNA, 25 bp, Artificial sequence
  Synthetic oligonucleotide
gggagacaagctcattcttttggct

SEQ ID NO: 668918 - DNA, 25 bp, Artificial sequence
  Synthetic oligonucleotide
tgacgtttaaatcagaagctgcgtc

SEQ ID NO: 668919 - DNA, 25 bp, Artificial sequence
  Synthetic oligonucleotide
tgacgtttaaatgagaagctgcgtc

SEQ ID NO: 668920 - DNA, 25 bp, Artificial sequence
  Synthetic oligonucleotide
tttcgatgtcagctttattatcagg

SEQ ID NO: 668921 - DNA, 25 bp, Artificial sequence
  Synthetic oligonucleotide
tttcgatgtcaggtttattatcagg

SEQ ID NO: 668922 - DNA, 25 bp, Artificial sequence
  Synthetic oligonucleotide
tagcaaactcttgtttgatttttgc

SEQ ID NO: 668923 - DNA, 25 bp, Artificial sequence
  Synthetic oligonucleotide
cattcaatccggagccttttttggc

SEQ ID NO: 668924 - DNA, 25 bp, Artificial sequence
  Synthetic oligonucleotide
ccgcattttcgtaaccgattttgtc

SEQ ID NO: 668925 - DNA, 25 bp, Artificial sequence
  Synthetic oligonucleotide
ttttgccttcatgtgattctatgaa

SEQ ID NO: 668926 - DNA, 25 bp, Artificial sequence
  Synthetic oligonucleotide
atgtcgtgacaacctcttggttggc

SEQ ID NO: 668927 - DNA, 25 bp, Artificial sequence
  Synthetic oligonucleotide
atgtcgtgacaagctcttggttggc

SEQ ID NO: 668928 - DNA, 25 bp, Artificial sequence
  Synthetic oligonucleotide
catcctccgagatcgcttcgtcaga

SEQ ID NO: 668929 - DNA, 25 bp, Artificial sequence
  Synthetic oligonucleotide
catcctccgagaacgcttcgtcaga

SEQ ID NO: 668930 - DNA, 25 bp, Artificial sequence
  Synthetic oligonucleotide
acgccttaatcaatccagttaaagc

SEQ ID NO: 668931 - DNA, 25 bp, Artificial sequence
  Synthetic oligonucleotide
acgccttaatcattccagttaaagc

SEQ ID NO: 668932 - DNA, 25 bp, Artificial sequence
  Synthetic oligonucleotide
atacttcaaacggtgctgtaacata

SEQ ID NO: 668933 - DNA, 25 bp, Artificial sequence
  Synthetic oligonucleotide
atacttcaaacgctgctgtaacata

SEQ ID NO: 668934 - DNA, 25 bp, Artificial sequence
  Synthetic oligonucleotide
ctttaacaccggctgtcatcagtgc

SEQ ID NO: 668935 - DNA, 25 bp, Artificial sequence
  Synthetic oligonucleotide
ctttaacaccgggtgtcatcagtgc

SEQ ID NO: 668936 - DNA, 25 bp, Artificial sequence
  Synthetic oligonucleotide
tttcatctgtgaagccgctgatatt

SEQ ID NO: 668937 - DNA, 25 bp, Artificial sequence
  Synthetic oligonucleotide
tagcaaactcttctttgatttttgc

SEQ ID NO: 668938 - DNA, 25 bp, Artificial sequence
  Synthetic oligonucleotide
agaatataggcaggcgccttcagtc

SEQ ID NO: 668939 - DNA, 25 bp, Artificial sequence
  Synthetic oligonucleotide
ggatttaagcatatgttatatagaa

SEQ ID NO: 668940 - DNA, 25 bp, Artificial sequence
  Synthetic oligonucleotide
ggatttaagcatttgttatatagaa

SEQ ID NO: 668941 - DNA, 25 bp, Artificial sequence
  Synthetic oligonucleotide
tccggatctggttgagatcgtagaa

SEQ ID NO: 668942 - DNA, 25 bp, Artificial sequence
  Synthetic oligonucleotide
atccattgatgtcgatggattaaca

SEQ ID NO: 668943 - DNA, 25 bp, Artificial sequence
  Synthetic oligonucleotide
aactgtcgaggaattcattgttaat

SEQ ID NO: 668944 - DNA, 25 bp, Artificial sequence
  Synthetic oligonucleotide
aactgtcgaggatttcattgttaat

SEQ ID NO: 668945 - DNA, 25 bp, Artificial sequence
  Synthetic oligonucleotide
tccttttccgctcgtgcgctataca

SEQ ID NO: 668946 - DNA, 25 bp, Artificial sequence
  Synthetic oligonucleotide
tccttttccgctggtgcgctataca

SEQ ID NO: 668947 - DNA, 25 bp, Artificial sequence
  Synthetic oligonucleotide
tgtggccgcaaaacatgttctagaa

SEQ ID NO: 668948 - DNA, 25 bp, Artificial sequence
  Synthetic oligonucleotide
tgtggccgcaaatcatgttctagaa

SEQ ID NO: 668949 - DNA, 25 bp, Artificial sequence
  Synthetic oligonucleotide
cattatagtggacacatcgccgagt

SEQ ID NO: 668950 - DNA, 25 bp, Artificial sequence
  Synthetic oligonucleotide
cattatagtggagacatcgccgagt

SEQ ID NO: 668951 - DNA, 25 bp, Artificial sequence
  Synthetic oligonucleotide
atggctgccattcacacaccgacgg

SEQ ID NO: 668952 - DNA, 25 bp, Artificial sequence
  Synthetic oligonucleotide
cccgacgactttatttcaccatgtg

SEQ ID NO: 668953 - DNA, 25 bp, Artificial sequence
  Synthetic oligonucleotide
ccttctcagaagccggatcagagac

SEQ ID NO: 668954 - DNA, 25 bp, Artificial sequence
  Synthetic oligonucleotide
agaatataggcacgcgccttcagtc

SEQ ID NO: 668955 - DNA, 25 bp, Artificial sequence
  Synthetic oligonucleotide
agatgggtaagatttttcggtattc

SEQ ID NO: 668956 - DNA, 25 bp, Artificial sequence
  Synthetic oligonucleotide
agatgggtaagaattttcggtattc

SEQ ID NO: 668957 - DNA, 25 bp, Artificial sequence
  Synthetic oligonucleotide
ttatttcttccgatctggtttctct

SEQ ID NO: 668958 - DNA, 25 bp, Artificial sequence
  Synthetic oligonucleotide
ttatttcttccgttctggtttctct

SEQ ID NO: 668959 - DNA, 25 bp, Artificial sequence
  Synthetic oligonucleotide
cctgatctgctcccggacaacatga

SEQ ID NO: 668960 - DNA, 25 bp, Artificial sequence
  Synthetic oligonucleotide
cctgatctgctcgcggacaacatga

SEQ ID NO: 668961 - DNA, 25 bp, Artificial sequence
  Synthetic oligonucleotide
ttaaataaagattcgcatatcccga

SEQ ID NO: 668962 - DNA, 25 bp, Artificial sequence
  Synthetic oligonucleotide
ttaaataaagatacgcatatcccga

SEQ ID NO: 668963 - DNA, 25 bp, Artificial sequence
  Synthetic oligonucleotide
atatttttagctgacttaggaatcg

SEQ ID NO: 668964 - DNA, 25 bp, Artificial sequence
  Synthetic oligonucleotide
atatttttagctcacttaggaatcg

SEQ ID NO: 668965 - DNA, 25 bp, Artificial sequence
  Synthetic oligonucleotide
atggctgccattgacacaccgacgg

SEQ ID NO: 668966 - DNA, 25 bp, Artificial sequence
  Synthetic oligonucleotide
cccgacgactttttttcaccatgtg

SEQ ID NO: 668967 - DNA, 25 bp, Artificial sequence
  Synthetic oligonucleotide
gctgcttaacgcgcaggtcgaaaaa

SEQ ID NO: 668968 - DNA, 25 bp, Artificial sequence
  Synthetic oligonucleotide
ggacaaactgaacgggccattgaac

SEQ ID NO: 668969 - DNA, 25 bp, Artificial sequence
  Synthetic oligonucleotide
agctaaaaatgatgagtatttcaaa

SEQ ID NO: 668970 - DNA, 25 bp, Artificial sequence
  Synthetic oligonucleotide
gaatcatgaaaattacagttccgtt

SEQ ID NO: 668971 - DNA, 25 bp, Artificial sequence
  Synthetic oligonucleotide
agctaaaaatgaagagtatttcaaa

SEQ ID NO: 668972 - DNA, 25 bp, Artificial sequence
  Synthetic oligonucleotide
gatggggacgagctatgatgtaggt

SEQ ID NO: 668973 - DNA, 25 bp, Artificial sequence
  Synthetic oligonucleotide
gatggggacgaggtatgatgtaggt

SEQ ID NO: 668974 - DNA, 25 bp, Artificial sequence
  Synthetic oligonucleotide
cacgattttagataaagagatccag

SEQ ID NO: 668975 - DNA, 25 bp, Artificial sequence
  Synthetic oligonucleotide
cacgattttagaaaaagagatccag

SEQ ID NO: 668976 - DNA, 25 bp, Artificial sequence
  Synthetic oligonucleotide
aaatggattatgcgatacagcctat

SEQ ID NO: 668977 - DNA, 25 bp, Artificial sequence
  Synthetic oligonucleotide
aaatggattatgggatacagcctat

SEQ ID NO: 668978 - DNA, 25 bp, Artificial sequence
  Synthetic oligonucleotide
aatgagagagcttgttgccattaac

SEQ ID NO: 668979 - DNA, 25 bp, Artificial sequence
  Synthetic oligonucleotide
agaccctgatgacctggtcgacatc

SEQ ID NO: 668980 - DNA, 25 bp, Artificial sequence
  Synthetic oligonucleotide
agtcaagatgactaaagttggtgag

SEQ ID NO: 668981 - DNA, 25 bp, Artificial sequence
  Synthetic oligonucleotide
gctgcttaacgcccaggtcgaaaaa

SEQ ID NO: 668982 - DNA, 25 bp, Artificial sequence
  Synthetic oligonucleotide
agtcaagatgacaaaagttggtgag

SEQ ID NO: 668983 - DNA, 25 bp, Artificial sequence
  Synthetic oligonucleotide
ggatgaaaccacggaccaagtgctg

SEQ ID NO: 668984 - DNA, 25 bp, Artificial sequence
  Synthetic oligonucleotide
ggatgaaaccaccgaccaagtgctg

SEQ ID NO: 668985 - DNA, 25 bp, Artificial sequence
  Synthetic oligonucleotide
cgctgtcattgtagaaggtgcaggc

SEQ ID NO: 668986 - DNA, 25 bp, Artificial sequence
  Synthetic oligonucleotide
cgctgtcattgttgaaggtgcaggc

SEQ ID NO: 668987 - DNA, 25 bp, Artificial sequence
  Synthetic oligonucleotide
aattgatgtcagtagctatccgggc

SEQ ID NO: 668988 - DNA, 25 bp, Artificial sequence
  Synthetic oligonucleotide
aattgatgtcagaagctatccgggc

SEQ ID NO: 668989 - DNA, 25 bp, Artificial sequence
  Synthetic oligonucleotide
agaacctgatacggaaaaggtggtc

SEQ ID NO: 668990 - DNA, 25 bp, Artificial sequence
  Synthetic oligonucleotide
agaacctgataccgaaaaggtggtc

SEQ ID NO: 668991 - DNA, 25 bp, Artificial sequence
  Synthetic oligonucleotide
agacggatttgttgaaaatatcgtc

SEQ ID NO: 668992 - DNA, 25 bp, Artificial sequence
  Synthetic oligonucleotide
agacggatttgtagaaaatatcgtc

SEQ ID NO: 668993 - DNA, 25 bp, Artificial sequence
  Synthetic oligonucleotide
aatgagagagctagttgccattaac

SEQ ID NO: 668994 - DNA, 25 bp, Artificial sequence
  Synthetic oligonucleotide
ccttctcagaaggcggatcagagac

SEQ ID NO: 668995 - DNA, 25 bp, Artificial sequence
  Synthetic oligonucleotide
atccattgatgtggatggattaaca

SEQ ID NO: 668996 - DNA, 25 bp, Artificial sequence
  Synthetic oligonucleotide
agaccctgatgagctggtcgacatc

SEQ ID NO: 668997 - DNA, 25 bp, Artificial sequence
  Synthetic oligonucleotide
aagagcagggaagaactgcggatgg

SEQ ID NO: 668998 - DNA, 25 bp, Artificial sequence
  Synthetic oligonucleotide
gaaatcggaggtctggatgctctct

SEQ ID NO: 668999 - DNA, 25 bp, Artificial sequence
  Synthetic oligonucleotide
gaaatcggaggtgtggatgctctct

SEQ ID NO: 669000 - DNA, 25 bp, Artificial sequence
  Synthetic oligonucleotide
aaatatggtacacctctttacgtat

SEQ ID NO: 669001 - DNA, 25 bp, Artificial sequence
  Synthetic oligonucleotide
aaatatggtacagctctttacgtat

SEQ ID NO: 669002 - DNA, 25 bp, Artificial sequence
  Synthetic oligonucleotide
ttaatacgtgagggtgctaaaagct

SEQ ID NO: 669003 - DNA, 25 bp, Artificial sequence
  Synthetic oligonucleotide
ttaatacgtgagcgtgctaaaagct

SEQ ID NO: 669004 - DNA, 25 bp, Artificial sequence
  Synthetic oligonucleotide
tttatttctgcacggctgaaagcac

SEQ ID NO: 669005 - DNA, 25 bp, Artificial sequence
  Synthetic oligonucleotide
gcgagcaaagcaatctcatcagtcg

SEQ ID NO: 669006 - DNA, 25 bp, Artificial sequence
  Synthetic oligonucleotide
ctcgctgaggaagagggactttctt

SEQ ID NO: 669007 - DNA, 25 bp, Artificial sequence
  Synthetic oligonucleotide
ctcgctgaggaacagggactttctt

SEQ ID NO: 669008 - DNA, 25 bp, Artificial sequence
  Synthetic oligonucleotide
tccggaggagaggtatatacggctg

SEQ ID NO: 669009 - DNA, 25 bp, Artificial sequence
  Synthetic oligonucleotide
tccggaggagagctatatacggctg

SEQ ID NO: 669010 - DNA, 25 bp, Artificial sequence
  Synthetic oligonucleotide
tttccggcagaacgcatccactttc

SEQ ID NO: 669011 - DNA, 25 bp, Artificial sequence
  Synthetic oligonucleotide
cacggcacaagcagacaaaatcaac

SEQ ID NO: 669012 - DNA, 25 bp, Artificial sequence
  Synthetic oligonucleotide
cgcatcggctgctttgtggtggata

SEQ ID NO: 669013 - DNA, 25 bp, Artificial sequence
  Synthetic oligonucleotide
cgcatcggctgcattgtggtggata

SEQ ID NO: 669014 - DNA, 25 bp, Artificial sequence
  Synthetic oligonucleotide
atcgcgcttcttcaagacctatgta

SEQ ID NO: 669015 - DNA, 25 bp, Artificial sequence
  Synthetic oligonucleotide
atcgcgcttcttgaagacctatgta

SEQ ID NO: 669016 - DNA, 25 bp, Artificial sequence
  Synthetic oligonucleotide
cactccatcgatcttcttcttcgga

SEQ ID NO: 669017 - DNA, 25 bp, Artificial sequence
  Synthetic oligonucleotide
cactccatcgatgttcttcttcgga

SEQ ID NO: 669018 - DNA, 25 bp, Artificial sequence
  Synthetic oligonucleotide
tttccggcagaaggcatccactttc

SEQ ID NO: 669019 - DNA, 25 bp, Artificial sequence
  Synthetic oligonucleotide
gtagaagcgcattcgcatgactaca

SEQ ID NO: 669020 - DNA, 25 bp, Artificial sequence
  Synthetic oligonucleotide
aagagcagggaacaactgcggatgg

SEQ ID NO: 669021 - DNA, 25 bp, Artificial sequence
  Synthetic oligonucleotide
caggaagattcaaagtttggtttcg

SEQ ID NO: 669022 - DNA, 25 bp, Artificial sequence
  Synthetic oligonucleotide
tccggatctggtagagatcgtagaa

SEQ ID NO: 669023 - DNA, 25 bp, Artificial sequence
  Synthetic oligonucleotide
caggaagattcatagtttggtttcg

SEQ ID NO: 669024 - DNA, 25 bp, Artificial sequence
  Synthetic oligonucleotide
gcaatgggtttatttgccgctgttc

SEQ ID NO: 669025 - DNA, 25 bp, Artificial sequence
  Synthetic oligonucleotide
ggacaaactgaaggggccattgaac

SEQ ID NO: 669026 - DNA, 25 bp, Artificial sequence
  Synthetic oligonucleotide
tttatttctgcagggctgaaagcac

SEQ ID NO: 669027 - DNA, 25 bp, Artificial sequence
  Synthetic oligonucleotide
gtagaagcgcatacgcatgactaca

SEQ ID NO: 669028 - DNA, 25 bp, Artificial sequence
  Synthetic oligonucleotide
acgacgcctagttatgaattaagct

SEQ ID NO: 669029 - DNA, 25 bp, Artificial sequence
  Synthetic oligonucleotide
ccgtacttatggccgctgattccct

SEQ ID NO: 669030 - DNA, 25 bp, Artificial sequence
  Synthetic oligonucleotide
ccgtacttatgggcgctgattccct

SEQ ID NO: 669031 - DNA, 25 bp, Artificial sequence
  Synthetic oligonucleotide
aattatgccatgccaagcatcaaat

SEQ ID NO: 669032 - DNA, 25 bp, Artificial sequence
  Synthetic oligonucleotide
cacggcacaagctgacaaaatcaac

SEQ ID NO: 669033 - DNA, 25 bp, Artificial sequence
  Synthetic oligonucleotide
tcatataaaagggctcgtcatcgga

SEQ ID NO: 669034 - DNA, 25 bp, Artificial sequence
  Synthetic oligonucleotide
gcgagcaaagcattctcatcagtcg

SEQ ID NO: 669035 - DNA, 25 bp, Artificial sequence
  Synthetic oligonucleotide
gcgctgtggcaggttcttgtccgca

SEQ ID NO: 669036 - DNA, 25 bp, Artificial sequence
  Synthetic oligonucleotide
gagccgtcttgtcctcatgatactc

SEQ ID NO: 669037 - DNA, 25 bp, Artificial sequence
  Synthetic oligonucleotide
aattatgccatggcaagcatcaaat

SEQ ID NO: 669038 - DNA, 25 bp, Artificial sequence
  Synthetic oligonucleotide
acgacgcctagtaatgaattaagct

SEQ ID NO: 669039 - DNA, 25 bp, Artificial sequence
  Synthetic oligonucleotide
attctgtacgtctcacttgcggcga

SEQ ID NO: 669040 - DNA, 25 bp, Artificial sequence
  Synthetic oligonucleotide
attctgtacgtcacacttgcggcga

SEQ ID NO: 669041 - DNA, 25 bp, Artificial sequence
  Synthetic oligonucleotide
attgcgattgagctcgggctttttt

SEQ ID NO: 669042 - DNA, 25 bp, Artificial sequence
  Synthetic oligonucleotide
attgcgattgaggtcgggctttttt

SEQ ID NO: 669043 - DNA, 25 bp, Artificial sequence
  Synthetic oligonucleotide
gcaatgggtttaattgccgctgttc

SEQ ID NO: 669044 - DNA, 25 bp, Artificial sequence
  Synthetic oligonucleotide
gagccgtcttgtgctcatgatactc

SEQ ID NO: 669045 - DNA, 25 bp, Artificial sequence
  Synthetic oligonucleotide
attatgaagggacagtccataaaac

SEQ ID NO: 669046 - DNA, 25 bp, Artificial sequence
  Synthetic oligonucleotide
ccataagcggagtaagagggaatga

SEQ ID NO: 669047 - DNA, 25 bp, Artificial sequence
  Synthetic oligonucleotide
tcatataaaaggcctcgtcatcgga

SEQ ID NO: 669048 - DNA, 25 bp, Artificial sequence
  Synthetic oligonucleotide
ccataagcggagaaagagggaatga

SEQ ID NO: 669049 - DNA, 25 bp, Artificial sequence
  Synthetic oligonucleotide
gcgctgtggcagcttcttgtccgca

SEQ ID NO: 669050 - DNA, 25 bp, Artificial sequence
  Synthetic oligonucleotide
attatgaagggagagtccataaaac

SEQ ID NO: 669051 - DNA, 25 bp, Artificial sequence
  Synthetic oligonucleotide
tgaaactgactgaagagtatgataa

SEQ ID NO: 669052 - DNA, 25 bp, Artificial sequence
  Synthetic oligonucleotide
tgaaactgactgtagagtatgataa

SEQ ID NO: 669053 - DNA, 25 bp, Artificial sequence
  Synthetic oligonucleotide
aatcgcttaagggagcctaccaatt

SEQ ID NO: 669054 - DNA, 25 bp, Artificial sequence
  Synthetic oligonucleotide
ggcgcaaaagtatgacccagcatcg

SEQ ID NO: 669055 - DNA, 25 bp, Artificial sequence
  Synthetic oligonucleotide
ggcgcaaaagtaagacccagcatcg

SEQ ID NO: 669056 - DNA, 25 bp, Artificial sequence
  Synthetic oligonucleotide
aatcgcttaaggcagcctaccaatt

SEQ ID NO: 669057 - DNA, 25 bp, Artificial sequence
  Synthetic oligonucleotide
ccccaaggcgcccgcggaaggcctg

SEQ ID NO: 669058 - DNA, 25 bp, Artificial sequence
  Synthetic oligonucleotide
gggcttcaccgtagccggcacgggc

SEQ ID NO: 669059 - DNA, 25 bp, Artificial sequence
  Synthetic oligonucleotide
caccgtagccggcacgggcgcccgg

SEQ ID NO: 669060 - DNA, 25 bp, Artificial sequence
  Synthetic oligonucleotide
agccggcacgggcgcccggcagatg

SEQ ID NO: 669061 - DNA, 25 bp, Artificial sequence
  Synthetic oligonucleotide
cttccctggctctttcttccgccgc

SEQ ID NO: 669062 - DNA, 25 bp, Artificial sequence
  Synthetic oligonucleotide
ccggtgggcttcaccgtagccggca

SEQ ID NO: 669063 - DNA, 25 bp, Artificial sequence
  Synthetic oligonucleotide
aggcctgccggtgggcttcaccgta

SEQ ID NO: 669064 - DNA, 25 bp, Artificial sequence
  Synthetic oligonucleotide
cgcggaaggcctgccggtgggcttc

SEQ ID NO: 669065 - DNA, 25 bp, Artificial sequence
  Synthetic oligonucleotide
ggcgcccgcggaaggcctgccggtg

SEQ ID NO: 669066 - DNA, 25 bp, Artificial sequence
  Synthetic oligonucleotide
tcatgctcgaccagggcaaggaatg

SEQ ID NO: 669067 - DNA, 25 bp, Artificial sequence
  Synthetic oligonucleotide
cgcctttcctcgccgacagcctggc

SEQ ID NO: 669068 - DNA, 25 bp, Artificial sequence
  Synthetic oligonucleotide
caggacttctacagccgcgaccagg

SEQ ID NO: 669069 - DNA, 25 bp, Artificial sequence
  Synthetic oligonucleotide
caccgccaggacttctacagccgcg

SEQ ID NO: 669070 - DNA, 25 bp, Artificial sequence
  Synthetic oligonucleotide
gaaagccaccgccaggacttctaca

SEQ ID NO: 669071 - DNA, 25 bp, Artificial sequence
  Synthetic oligonucleotide
tggaccgaaagccaccgccaggact

SEQ ID NO: 669072 - DNA, 25 bp, Artificial sequence
  Synthetic oligonucleotide
aggaatggaccgaaagccaccgcca

SEQ ID NO: 669073 - DNA, 25 bp, Artificial sequence
  Synthetic oligonucleotide
agccgcgaccagggctcgcaggtga

SEQ ID NO: 669074 - DNA, 25 bp, Artificial sequence
  Synthetic oligonucleotide
tcgaccagggcaaggaatggaccga

SEQ ID NO: 669075 - DNA, 25 bp, Artificial sequence
  Synthetic oligonucleotide
accagggctcgcaggtgatgcccct

SEQ ID NO: 669076 - DNA, 25 bp, Artificial sequence
  Synthetic oligonucleotide
ctccggtcatgctcgaccagggcaa

SEQ ID NO: 669077 - DNA, 25 bp, Artificial sequence
  Synthetic oligonucleotide
cggccgctccggtcatgctcgacca

SEQ ID NO: 669078 - DNA, 25 bp, Artificial sequence
  Synthetic oligonucleotide
ccctggcggccgctccggtcatgct

SEQ ID NO: 669079 - DNA, 25 bp, Artificial sequence
  Synthetic oligonucleotide
tcggcgaggtctacggggtgttcgc

SEQ ID NO: 669080 - DNA, 25 bp, Artificial sequence
  Synthetic oligonucleotide
tccgccgccctggcggccgctccgg

SEQ ID NO: 669081 - DNA, 25 bp, Artificial sequence
  Synthetic oligonucleotide
tttcttccgccgccctggcggccgc

SEQ ID NO: 669082 - DNA, 25 bp, Artificial sequence
  Synthetic oligonucleotide
tggctctttcttccgccgccctggc

SEQ ID NO: 669083 - DNA, 25 bp, Artificial sequence
  Synthetic oligonucleotide
agggcaaggaatggaccgaaagcca

SEQ ID NO: 669084 - DNA, 25 bp, Artificial sequence
  Synthetic oligonucleotide
agccggatggaacgcctttcctcgc

SEQ ID NO: 669085 - DNA, 25 bp, Artificial sequence
  Synthetic oligonucleotide
ggctatttgcccaaccccaaggcgc

SEQ ID NO: 669086 - DNA, 25 bp, Artificial sequence
  Synthetic oligonucleotide
cgctacggctatttgcccaacccca

SEQ ID NO: 669087 - DNA, 25 bp, Artificial sequence
  Synthetic oligonucleotide
cctggcccgctacggctatttgccc

SEQ ID NO: 669088 - DNA, 25 bp, Artificial sequence
  Synthetic oligonucleotide
ccgacagcctggcccgctacggcta

SEQ ID NO: 669089 - DNA, 25 bp, Artificial sequence
  Synthetic oligonucleotide
tcctcgccgacagcctggcccgcta

SEQ ID NO: 669090 - DNA, 25 bp, Artificial sequence
  Synthetic oligonucleotide
gcccggcagatggtcggcatgacct

SEQ ID NO: 669091 - DNA, 25 bp, Artificial sequence
  Synthetic oligonucleotide
ttctacagccgcgaccagggctcgc

SEQ ID NO: 669092 - DNA, 25 bp, Artificial sequence
  Synthetic oligonucleotide
cagatggtcggcatgacctgttcgg

SEQ ID NO: 669093 - DNA, 25 bp, Artificial sequence
  Synthetic oligonucleotide
tgcccaaccccaaggcgcccgcgga

SEQ ID NO: 669094 - DNA, 25 bp, Artificial sequence
  Synthetic oligonucleotide
gcgacagccggatggaacgcctttc

SEQ ID NO: 669095 - DNA, 25 bp, Artificial sequence
  Synthetic oligonucleotide
ggcgttgcgacagccggatggaacg

SEQ ID NO: 669096 - DNA, 25 bp, Artificial sequence
  Synthetic oligonucleotide
gctcaaggcgttgcgacagccggat

SEQ ID NO: 669097 - DNA, 25 bp, Artificial sequence
  Synthetic oligonucleotide
tgccctggctcaaggcgttgcgaca

SEQ ID NO: 669098 - DNA, 25 bp, Artificial sequence
  Synthetic oligonucleotide
tgcccctgccctggctcaaggcgtt

SEQ ID NO: 669099 - DNA, 25 bp, Artificial sequence
  Synthetic oligonucleotide
aggtgatgcccctgccctggctcaa

SEQ ID NO: 669100 - DNA, 25 bp, Artificial sequence
  Synthetic oligonucleotide
gctcgcaggtgatgcccctgccctg

SEQ ID NO: 669101 - DNA, 25 bp, Artificial sequence
  Synthetic oligonucleotide
atggaacgcctttcctcgccgacag

SEQ ID NO: 669102 - DNA, 25 bp, Artificial sequence
  Synthetic oligonucleotide
ggacgcggtatcgatgatcttcaac

SEQ ID NO: 669103 - DNA, 25 bp, Artificial sequence
  Synthetic oligonucleotide
tacctgattcccgacaacatcaagg

SEQ ID NO: 669104 - DNA, 25 bp, Artificial sequence
  Synthetic oligonucleotide
ccgccctacctgattcccgacaaca

SEQ ID NO: 669105 - DNA, 25 bp, Artificial sequence
  Synthetic oligonucleotide
accgcgccgccctacctgattcccg

SEQ ID NO: 669106 - DNA, 25 bp, Artificial sequence
  Synthetic oligonucleotide
atcggcaccgcgccgccctacctga

SEQ ID NO: 669107 - DNA, 25 bp, Artificial sequence
  Synthetic oligonucleotide
ctggatatcggcaccgcgccgccct

SEQ ID NO: 669108 - DNA, 25 bp, Artificial sequence
  Synthetic oligonucleotide
accgggctggatatcggcaccgcgc

SEQ ID NO: 669109 - DNA, 25 bp, Artificial sequence
  Synthetic oligonucleotide
cgccttaccgggctggatatcggca

SEQ ID NO: 669110 - DNA, 25 bp, Artificial sequence
  Synthetic oligonucleotide
cttcaaccgccttaccgggctggat

SEQ ID NO: 669111 - DNA, 25 bp, Artificial sequence
  Synthetic oligonucleotide
atcacacgctgatcgagcgcgcgct

SEQ ID NO: 669112 - DNA, 25 bp, Artificial sequence
  Synthetic oligonucleotide
ggtatcgatgatcttcaaccgcctt

SEQ ID NO: 669113 - DNA, 25 bp, Artificial sequence
  Synthetic oligonucleotide
atcaaggcggccgatgcgccggtgc

SEQ ID NO: 669114 - DNA, 25 bp, Artificial sequence
  Synthetic oligonucleotide
gcggctggacgcggtatcgatgatc

SEQ ID NO: 669115 - DNA, 25 bp, Artificial sequence
  Synthetic oligonucleotide
gaccggcgcggctggacgcggtatc

SEQ ID NO: 669116 - DNA, 25 bp, Artificial sequence
  Synthetic oligonucleotide
cctggggaccggcgcggctggacgc

SEQ ID NO: 669117 - DNA, 25 bp, Artificial sequence
  Synthetic oligonucleotide
aggacacctggggaccggcgcggct

SEQ ID NO: 669118 - DNA, 25 bp, Artificial sequence
  Synthetic oligonucleotide
ctgcccaaggacacctggggaccgg

SEQ ID NO: 669119 - DNA, 25 bp, Artificial sequence
  Synthetic oligonucleotide
cgcgcgctgcccaaggacacctggg

SEQ ID NO: 669120 - DNA, 25 bp, Artificial sequence
  Synthetic oligonucleotide
atcgagcgcgcgctgcccaaggaca

SEQ ID NO: 669121 - DNA, 25 bp, Artificial sequence
  Synthetic oligonucleotide
acgggcgcccggcagatggtcggca

SEQ ID NO: 669122 - DNA, 25 bp, Artificial sequence
  Synthetic oligonucleotide
gatgatcttcaaccgccttaccggg

SEQ ID NO: 669123 - DNA, 25 bp, Artificial sequence
  Synthetic oligonucleotide
cagaacaagacccagtggcccggct

SEQ ID NO: 669124 - DNA, 25 bp, Artificial sequence
  Synthetic oligonucleotide
gcaatgtcggcgaggtctacggggt

SEQ ID NO: 669125 - DNA, 25 bp, Artificial sequence
  Synthetic oligonucleotide
tggcgcgcaatgtcggcgaggtcta

SEQ ID NO: 669126 - DNA, 25 bp, Artificial sequence
  Synthetic oligonucleotide
tcggcctggcgcgcaatgtcggcga

SEQ ID NO: 669127 - DNA, 25 bp, Artificial sequence
  Synthetic oligonucleotide
acctgctcggcctggcgcgcaatgt

SEQ ID NO: 669128 - DNA, 25 bp, Artificial sequence
  Synthetic oligonucleotide
gcaacgacctgctcggcctggcgcg

SEQ ID NO: 669129 - DNA, 25 bp, Artificial sequence
  Synthetic oligonucleotide
ccaacggcaacgacctgctcggcct

SEQ ID NO: 669130 - DNA, 25 bp, Artificial sequence
  Synthetic oligonucleotide
tcgccgccaacggcaacgacctgct

SEQ ID NO: 669131 - DNA, 25 bp, Artificial sequence
  Synthetic oligonucleotide
ccggcttcgccgccaacggcaacga

SEQ ID NO: 669132 - DNA, 25 bp, Artificial sequence
  Synthetic oligonucleotide
attcccgacaacatcaaggcggccg

SEQ ID NO: 669133 - DNA, 25 bp, Artificial sequence
  Synthetic oligonucleotide
aagacccagtggcccggcttcgccg

SEQ ID NO: 669134 - DNA, 25 bp, Artificial sequence
  Synthetic oligonucleotide
cgacaacatcaaggcggccgatgcg

SEQ ID NO: 669135 - DNA, 25 bp, Artificial sequence
  Synthetic oligonucleotide
gcgcggcagaacaagacccagtggc

SEQ ID NO: 669136 - DNA, 25 bp, Artificial sequence
  Synthetic oligonucleotide
aacgcggcgcggcagaacaagaccc

SEQ ID NO: 669137 - DNA, 25 bp, Artificial sequence
  Synthetic oligonucleotide
ctgtggaacgcggcgcggcagaaca

SEQ ID NO: 669138 - DNA, 25 bp, Artificial sequence
  Synthetic oligonucleotide
ccgttcctgtggaacgcggcgcggc

SEQ ID NO: 669139 - DNA, 25 bp, Artificial sequence
  Synthetic oligonucleotide
cgctatccgttcctgtggaacgcgg

SEQ ID NO: 669140 - DNA, 25 bp, Artificial sequence
  Synthetic oligonucleotide
ccggtgcgctatccgttcctgtgga

SEQ ID NO: 669141 - DNA, 25 bp, Artificial sequence
  Synthetic oligonucleotide
gatgcgccggtgcgctatccgttcc

SEQ ID NO: 669142 - DNA, 25 bp, Artificial sequence
  Synthetic oligonucleotide
gcggccgatgcgccggtgcgctatc

SEQ ID NO: 669143 - DNA, 25 bp, Artificial sequence
  Synthetic oligonucleotide
agccctatcacacgctgatcgagcg

SEQ ID NO: 669144 - DNA, 25 bp, Artificial sequence
  Synthetic oligonucleotide
cagtggcccggcttcgccgccaacg

SEQ ID NO: 669145 - DNA, 25 bp, Artificial sequence
  Synthetic oligonucleotide
gggcactgcctatcggatcgacggc

SEQ ID NO: 669146 - DNA, 25 bp, Artificial sequence
  Synthetic oligonucleotide
gccgacctcgatcgggccgtgggac

SEQ ID NO: 669147 - DNA, 25 bp, Artificial sequence
  Synthetic oligonucleotide
tcctcgccgacctcgatcgggccgt

SEQ ID NO: 669148 - DNA, 25 bp, Artificial sequence
  Synthetic oligonucleotide
aggcattcctcgccgacctcgatcg

SEQ ID NO: 669149 - DNA, 25 bp, Artificial sequence
  Synthetic oligonucleotide
acttccaggcattcctcgccgacct

SEQ ID NO: 669150 - DNA, 25 bp, Artificial sequence
  Synthetic oligonucleotide
tcgtcgacttccaggcattcctcgc

SEQ ID NO: 669151 - DNA, 25 bp, Artificial sequence
  Synthetic oligonucleotide
cggcgatcgtcgacttccaggcatt

SEQ ID NO: 669152 - DNA, 25 bp, Artificial sequence
  Synthetic oligonucleotide
gcggtccggcgatcgtcgacttcca

SEQ ID NO: 669153 - DNA, 25 bp, Artificial sequence
  Synthetic oligonucleotide
tcgacggcggtccggcgatcgtcga

SEQ ID NO: 669154 - DNA, 25 bp, Artificial sequence
  Synthetic oligonucleotide
cgctgatcgagcgcgcgctgcccaa

SEQ ID NO: 669155 - DNA, 25 bp, Artificial sequence
  Synthetic oligonucleotide
tgcctatcggatcgacggcggtccg

SEQ ID NO: 669156 - DNA, 25 bp, Artificial sequence
  Synthetic oligonucleotide
cgtgggaccgctgaccagcgatgac

SEQ ID NO: 669157 - DNA, 25 bp, Artificial sequence
  Synthetic oligonucleotide
ggtgaagggcactgcctatcggatc

SEQ ID NO: 669158 - DNA, 25 bp, Artificial sequence
  Synthetic oligonucleotide
gatcgaggtgaagggcactgcctat

SEQ ID NO: 669159 - DNA, 25 bp, Artificial sequence
  Synthetic oligonucleotide
cggcagatcgaggtgaagggcactg

SEQ ID NO: 669160 - DNA, 25 bp, Artificial sequence
  Synthetic oligonucleotide
ccatacccggcagatcgaggtgaag

SEQ ID NO: 669161 - DNA, 25 bp, Artificial sequence
  Synthetic oligonucleotide
gcctgccatacccggcagatcgagg

SEQ ID NO: 669162 - DNA, 25 bp, Artificial sequence
  Synthetic oligonucleotide
tgttcggcctgccatacccggcaga

SEQ ID NO: 669163 - DNA, 25 bp, Artificial sequence
  Synthetic oligonucleotide
atgacctgttcggcctgccataccc

SEQ ID NO: 669164 - DNA, 25 bp, Artificial sequence
  Synthetic oligonucleotide
gtcggcatgacctgttcggcctgcc

SEQ ID NO: 669165 - DNA, 25 bp, Artificial sequence
  Synthetic oligonucleotide
atcggatcgacggcggtccggcgat

SEQ ID NO: 669166 - DNA, 25 bp, Artificial sequence
  Synthetic oligonucleotide
atcctcggggccaatccgcctcccg

SEQ ID NO: 669167 - DNA, 25 bp, Artificial sequence
  Synthetic oligonucleotide
ggtacgagccctatcacacgctgat

SEQ ID NO: 669168 - DNA, 25 bp, Artificial sequence
  Synthetic oligonucleotide
aggaatggtacgagccctatcacac

SEQ ID NO: 669169 - DNA, 25 bp, Artificial sequence
  Synthetic oligonucleotide
cggtgaaggaatggtacgagcccta

SEQ ID NO: 669170 - DNA, 25 bp, Artificial sequence
  Synthetic oligonucleotide
ctcgcggcggtgaaggaatggtacg

SEQ ID NO: 669171 - DNA, 25 bp, Artificial sequence
  Synthetic oligonucleotide
gctctgctcgcggcggtgaaggaat

SEQ ID NO: 669172 - DNA, 25 bp, Artificial sequence
  Synthetic oligonucleotide
gcgacgctctgctcgcggcggtgaa

SEQ ID NO: 669173 - DNA, 25 bp, Artificial sequence
  Synthetic oligonucleotide
gtgcgcgcgacgctctgctcgcggc

SEQ ID NO: 669174 - DNA, 25 bp, Artificial sequence
  Synthetic oligonucleotide
ctcccggtgcgcgcgacgctctgct

SEQ ID NO: 669175 - DNA, 25 bp, Artificial sequence
  Synthetic oligonucleotide
ctcgatcgggccgtgggaccgctga

SEQ ID NO: 669176 - DNA, 25 bp, Artificial sequence
  Synthetic oligonucleotide
gggccaatccgcctcccggtgcgcg

SEQ ID NO: 669177 - DNA, 25 bp, Artificial sequence
  Synthetic oligonucleotide
cgggccgtgggaccgctgaccagcg

SEQ ID NO: 669178 - DNA, 25 bp, Artificial sequence
  Synthetic oligonucleotide
agccgatcctcggggccaatccgcc

SEQ ID NO: 669179 - DNA, 25 bp, Artificial sequence
  Synthetic oligonucleotide
tcgccaagccgatcctcggggccaa

SEQ ID NO: 669180 - DNA, 25 bp, Artificial sequence
  Synthetic oligonucleotide
acgccttcgccaagccgatcctcgg

SEQ ID NO: 669181 - DNA, 25 bp, Artificial sequence
  Synthetic oligonucleotide
ccttcgacgccttcgccaagccgat

SEQ ID NO: 669182 - DNA, 25 bp, Artificial sequence
  Synthetic oligonucleotide
acgccgccttcgacgccttcgccaa

SEQ ID NO: 669183 - DNA, 25 bp, Artificial sequence
  Synthetic oligonucleotide
gcgatgacgccgccttcgacgcctt

SEQ ID NO: 669184 - DNA, 25 bp, Artificial sequence
  Synthetic oligonucleotide
tgaccagcgatgacgccgccttcga

SEQ ID NO: 669185 - DNA, 25 bp, Artificial sequence
  Synthetic oligonucleotide
gaccgctgaccagcgatgacgccgc

SEQ ID NO: 669186 - DNA, 25 bp, Artificial sequence
  Synthetic oligonucleotide
gtaacgcagtaagcgcctatcgcat

SEQ ID NO: 669187 - DNA, 25 bp, Artificial sequence
  Synthetic oligonucleotide
atccgcctcccggtgcgcgcgacgc

SEQ ID NO: 669188 - DNA, 25 bp, Artificial sequence
  Synthetic oligonucleotide
ttcgcgcaagcgcgcatgcatggcc

SEQ ID NO: 669189 - DNA, 25 bp, Artificial sequence
  Synthetic oligonucleotide
gcgcctatcgcatgccagcacggcc

SEQ ID NO: 669190 - DNA, 25 bp, Artificial sequence
  Synthetic oligonucleotide
aatagacgatgaggccgacctcgcc

SEQ ID NO: 669191 - DNA, 25 bp, Artificial sequence
  Synthetic oligonucleotide
cgatgaggccgacctcgccgccctg

SEQ ID NO: 669192 - DNA, 25 bp, Artificial sequence
  Synthetic oligonucleotide
ggccgacctcgccgccctgctccgc

SEQ ID NO: 669193 - DNA, 25 bp, Artificial sequence
  Synthetic oligonucleotide
cctcgccgccctgctccgcgaccag

SEQ ID NO: 669194 - DNA, 25 bp, Artificial sequence
  Synthetic oligonucleotide
gccctgctccgcgaccagttcgcgc

SEQ ID NO: 669195 - DNA, 25 bp, Artificial sequence
  Synthetic oligonucleotide
gtccatgcggacaatagacgatgag

SEQ ID NO: 669196 - DNA, 25 bp, Artificial sequence
  Synthetic oligonucleotide
gaccagttcgcgcaagcgcgcatgc

SEQ ID NO: 669197 - DNA, 25 bp, Artificial sequence
  Synthetic oligonucleotide
cgtccggtccatgcggacaatagac

SEQ ID NO: 669198 - DNA, 25 bp, Artificial sequence
  Synthetic oligonucleotide
caagcgcgcatgcatggcctcgagc

SEQ ID NO: 669199 - DNA, 25 bp, Artificial sequence
  Synthetic oligonucleotide
gcatgcatggcctcgagcactgcca

SEQ ID NO: 669200 - DNA, 25 bp, Artificial sequence
  Synthetic oligonucleotide
atggcctcgagcactgccaggtcgt

SEQ ID NO: 669201 - DNA, 25 bp, Artificial sequence
  Synthetic oligonucleotide
tcgagcactgccaggtcgtaatagc

SEQ ID NO: 669202 - DNA, 25 bp, Artificial sequence
  Synthetic oligonucleotide
actgccaggtcgtaatagccacggg

SEQ ID NO: 669203 - DNA, 25 bp, Artificial sequence
  Synthetic oligonucleotide
caggtcgtaatagccacgggcgatg

SEQ ID NO: 669204 - DNA, 25 bp, Artificial sequence
  Synthetic oligonucleotide
ctccgcgaccagttcgcgcaagcgc

SEQ ID NO: 669205 - DNA, 25 bp, Artificial sequence
  Synthetic oligonucleotide
tgccgcagcatacccggcttcggct

SEQ ID NO: 669206 - DNA, 25 bp, Artificial sequence
  Synthetic oligonucleotide
cgacgaaccagatacccgacagatc

SEQ ID NO: 669207 - DNA, 25 bp, Artificial sequence
  Synthetic oligonucleotide
accagatacccgacagatcgacccc

SEQ ID NO: 669208 - DNA, 25 bp, Artificial sequence
  Synthetic oligonucleotide
tacccgacagatcgaccccgtagtg

SEQ ID NO: 669209 - DNA, 25 bp, Artificial sequence
  Synthetic oligonucleotide
gacagatcgaccccgtagtgctcgc

SEQ ID NO: 669210 - DNA, 25 bp, Artificial sequence
  Synthetic oligonucleotide
tcgaccccgtagtgctcgccgatct

SEQ ID NO: 669211 - DNA, 25 bp, Artificial sequence
  Synthetic oligonucleotide
cgtagtgctcgccgatctgccgcag

SEQ ID NO: 669212 - DNA, 25 bp, Artificial sequence
  Synthetic oligonucleotide
cggacaatagacgatgaggccgacc

SEQ ID NO: 669213 - DNA, 25 bp, Artificial sequence
  Synthetic oligonucleotide
cgatctgccgcagcatacccggctt

SEQ ID NO: 669214 - DNA, 25 bp, Artificial sequence
  Synthetic oligonucleotide
ggcgatgccggactggttggtagcc

SEQ ID NO: 669215 - DNA, 25 bp, Artificial sequence
  Synthetic oligonucleotide
agcatacccggcttcggcttgcggc

SEQ ID NO: 669216 - DNA, 25 bp, Artificial sequence
  Synthetic oligonucleotide
ccggcttcggcttgcggcagtcgca

SEQ ID NO: 669217 - DNA, 25 bp, Artificial sequence
  Synthetic oligonucleotide
tcggcttgcggcagtcgcaaccgtc

SEQ ID NO: 669218 - DNA, 25 bp, Artificial sequence
  Synthetic oligonucleotide
tgcggcagtcgcaaccgtcgtccgg

SEQ ID NO: 669219 - DNA, 25 bp, Artificial sequence
  Synthetic oligonucleotide
agtcgcaaccgtcgtccggtccatg

SEQ ID NO: 669220 - DNA, 25 bp, Artificial sequence
  Synthetic oligonucleotide
aaccgtcgtccggtccatgcggaca

SEQ ID NO: 669221 - DNA, 25 bp, Artificial sequence
  Synthetic oligonucleotide
gctcgccgatctgccgcagcatacc

SEQ ID NO: 669222 - DNA, 25 bp, Artificial sequence
  Synthetic oligonucleotide
aatcagcagggaacgggacatcgat

SEQ ID NO: 669223 - DNA, 25 bp, Artificial sequence
  Synthetic oligonucleotide
tcttgatgtaatcgtcggagtcgag

SEQ ID NO: 669224 - DNA, 25 bp, Artificial sequence
  Synthetic oligonucleotide
tgtaatcgtcggagtcgaggttgat

SEQ ID NO: 669225 - DNA, 25 bp, Artificial sequence
  Synthetic oligonucleotide
cgtcggagtcgaggttgatgactcc

SEQ ID NO: 669226 - DNA, 25 bp, Artificial sequence
  Synthetic oligonucleotide
agtcgaggttgatgactccatcgcg

SEQ ID NO: 669227 - DNA, 25 bp, Artificial sequence
  Synthetic oligonucleotide
ggttgatgactccatcgcggtcgag

SEQ ID NO: 669228 - DNA, 25 bp, Artificial sequence
  Synthetic oligonucleotide
gactccatcgcggtcgagaatcagc

SEQ ID NO: 669229 - DNA, 25 bp, Artificial sequence
  Synthetic oligonucleotide
gtaatagccacgggcgatgccggac

SEQ ID NO: 669230 - DNA, 25 bp, Artificial sequence
  Synthetic oligonucleotide
gtcgagaatcagcagggaacgggac

SEQ ID NO: 669231 - DNA, 25 bp, Artificial sequence
  Synthetic oligonucleotide
ggatccactcgtcgagggtcttgat

SEQ ID NO: 669232 - DNA, 25 bp, Artificial sequence
  Synthetic oligonucleotide
cagggaacgggacatcgatgcgcag

SEQ ID NO: 669233 - DNA, 25 bp, Artificial sequence
  Synthetic oligonucleotide
acgggacatcgatgcgcagttggcc

SEQ ID NO: 669234 - DNA, 25 bp, Artificial sequence
  Synthetic oligonucleotide
catcgatgcgcagttggccatgaac

SEQ ID NO: 669235 - DNA, 25 bp, Artificial sequence
  Synthetic oligonucleotide
tgcgcagttggccatgaacggaaag

SEQ ID NO: 669236 - DNA, 25 bp, Artificial sequence
  Synthetic oligonucleotide
gttggccatgaacggaaaggatcga

SEQ ID NO: 669237 - DNA, 25 bp, Artificial sequence
  Synthetic oligonucleotide
catgaacggaaaggatcgattctac

SEQ ID NO: 669238 - DNA, 25 bp, Artificial sequence
  Synthetic oligonucleotide
atcgcggtcgagaatcagcagggaa

SEQ ID NO: 669239 - DNA, 25 bp, Artificial sequence
  Synthetic oligonucleotide
tggctcaggcgggcgatggcctcga

SEQ ID NO: 669240 - DNA, 25 bp, Artificial sequence
  Synthetic oligonucleotide
aggtcaccgatgctgtcgccgacga

SEQ ID NO: 669241 - DNA, 25 bp, Artificial sequence
  Synthetic oligonucleotide
tgccggactggttggtagccaccgc

SEQ ID NO: 669242 - DNA, 25 bp, Artificial sequence
  Synthetic oligonucleotide
actggttggtagccaccgcgacggt

SEQ ID NO: 669243 - DNA, 25 bp, Artificial sequence
  Synthetic oligonucleotide
tggtagccaccgcgacggtccagcc

SEQ ID NO: 669244 - DNA, 25 bp, Artificial sequence
  Synthetic oligonucleotide
ccaccgcgacggtccagccggcctg

SEQ ID NO: 669245 - DNA, 25 bp, Artificial sequence
  Synthetic oligonucleotide
cgacggtccagccggcctggctcag

SEQ ID NO: 669246 - DNA, 25 bp, Artificial sequence
  Synthetic oligonucleotide
cgagggtcttgatgtaatcgtcgga

SEQ ID NO: 669247 - DNA, 25 bp, Artificial sequence
  Synthetic oligonucleotide
ccggcctggctcaggcgggcgatgg

SEQ ID NO: 669248 - DNA, 25 bp, Artificial sequence
  Synthetic oligonucleotide
actcgtcgagggtcttgatgtaatc

SEQ ID NO: 669249 - DNA, 25 bp, Artificial sequence
  Synthetic oligonucleotide
caggcgggcgatggcctcgatcgag

SEQ ID NO: 669250 - DNA, 25 bp, Artificial sequence
  Synthetic oligonucleotide
gggcgatggcctcgatcgagctggg

SEQ ID NO: 669251 - DNA, 25 bp, Artificial sequence
  Synthetic oligonucleotide
tggcctcgatcgagctggggatggg

SEQ ID NO: 669252 - DNA, 25 bp, Artificial sequence
  Synthetic oligonucleotide
tcgatcgagctggggatggggatcc

SEQ ID NO: 669253 - DNA, 25 bp, Artificial sequence
  Synthetic oligonucleotide
gagctggggatggggatccactcgt

SEQ ID NO: 669254 - DNA, 25 bp, Artificial sequence
  Synthetic oligonucleotide
ggatggggatccactcgtcgagggt

SEQ ID NO: 669255 - DNA, 25 bp, Artificial sequence
  Synthetic oligonucleotide
gccacgggcgatgccggactggttg

SEQ ID NO: 669256 - DNA, 25 bp, Artificial sequence
  Synthetic oligonucleotide
gtccagccggcctggctcaggcggg

SEQ ID NO: 669257 - DNA, 25 bp, Artificial sequence
  Synthetic oligonucleotide
ttggcacgcagcagtgggtgtctcg

SEQ ID NO: 669258 - DNA, 25 bp, Artificial sequence
  Synthetic oligonucleotide
tggatcaccggagtaacgcagtaag

SEQ ID NO: 669259 - DNA, 25 bp, Artificial sequence
  Synthetic oligonucleotide
ggcgggtggatcaccggagtaacgc

SEQ ID NO: 669260 - DNA, 25 bp, Artificial sequence
  Synthetic oligonucleotide
ccccttggcgggtggatcaccggag

SEQ ID NO: 669261 - DNA, 25 bp, Artificial sequence
  Synthetic oligonucleotide
cgtgcgaaccccttggcgggtggat

SEQ ID NO: 669262 - DNA, 25 bp, Artificial sequence
  Synthetic oligonucleotide
cggagtacgtgcgaaccccttggcg

SEQ ID NO: 669263 - DNA, 25 bp, Artificial sequence
  Synthetic oligonucleotide
gtgtctcggagtacgtgcgaacccc

SEQ ID NO: 669264 - DNA, 25 bp, Artificial sequence
  Synthetic oligonucleotide
aataatggcaatggaatggcaatcc

SEQ ID NO: 669265 - DNA, 25 bp, Artificial sequence
  Synthetic oligonucleotide
cgcagcagtgggtgtctcggagtac

SEQ ID NO: 669266 - DNA, 25 bp, Artificial sequence
  Synthetic oligonucleotide
cagtaagcgcctatcgcatgccagc

SEQ ID NO: 669267 - DNA, 25 bp, Artificial sequence
  Synthetic oligonucleotide
agtcatttggcacgcagcagtgggt

SEQ ID NO: 669268 - DNA, 25 bp, Artificial sequence
  Synthetic oligonucleotide
ccagggagtcatttggcacgcagca

SEQ ID NO: 669269 - DNA, 25 bp, Artificial sequence
  Synthetic oligonucleotide
cccaggccagggagtcatttggcac

SEQ ID NO: 669270 - DNA, 25 bp, Artificial sequence
  Synthetic oligonucleotide
ggcaatcccaggccagggagtcatt

SEQ ID NO: 669271 - DNA, 25 bp, Artificial sequence
  Synthetic oligonucleotide
tggaatggcaatcccaggccaggga

SEQ ID NO: 669272 - DNA, 25 bp, Artificial sequence
  Synthetic oligonucleotide
tgtcgccgacgaaccagatacccga

SEQ ID NO: 669273 - DNA, 25 bp, Artificial sequence
  Synthetic oligonucleotide
cagtgggtgtctcggagtacgtgcg

SEQ ID NO: 669274 - DNA, 25 bp, Artificial sequence
  Synthetic oligonucleotide
caggtggagcgggcgtgacgacggg

SEQ ID NO: 669275 - DNA, 25 bp, Artificial sequence
  Synthetic oligonucleotide
gcttgtccctcgcttccctggctct

SEQ ID NO: 669276 - DNA, 25 bp, Artificial sequence
  Synthetic oligonucleotide
tttcaagcttgtccctcgcttccct

SEQ ID NO: 669277 - DNA, 25 bp, Artificial sequence
  Synthetic oligonucleotide
tgcacctttcaagcttgtccctcgc

SEQ ID NO: 669278 - DNA, 25 bp, Artificial sequence
  Synthetic oligonucleotide
agacactgcacctttcaagcttgtc

SEQ ID NO: 669279 - DNA, 25 bp, Artificial sequence
  Synthetic oligonucleotide
tgaaaaagacactgcacctttcaag

SEQ ID NO: 669280 - DNA, 25 bp, Artificial sequence
  Synthetic oligonucleotide
aacgcctgaaaaagacactgcacct

SEQ ID NO: 669281 - DNA, 25 bp, Artificial sequence
  Synthetic oligonucleotide
accggagtaacgcagtaagcgccta

SEQ ID NO: 669282 - DNA, 25 bp, Artificial sequence
  Synthetic oligonucleotide
gagcgggcgtgacgacggggagttc

SEQ ID NO: 669283 - DNA, 25 bp, Artificial sequence
  Synthetic oligonucleotide
cggaaaggatcgattctacctcagc

SEQ ID NO: 669284 - DNA, 25 bp, Artificial sequence
  Synthetic oligonucleotide
caccacaggtggagcgggcgtgacg

SEQ ID NO: 669285 - DNA, 25 bp, Artificial sequence
  Synthetic oligonucleotide
tgtttccaccacaggtggagcgggc

SEQ ID NO: 669286 - DNA, 25 bp, Artificial sequence
  Synthetic oligonucleotide
cggccgtgtttccaccacaggtgga

SEQ ID NO: 669287 - DNA, 25 bp, Artificial sequence
  Synthetic oligonucleotide
gccgaccggccgtgtttccaccaca

SEQ ID NO: 669288 - DNA, 25 bp, Artificial sequence
  Synthetic oligonucleotide
gccagcacggccgaccggccgtgtt

SEQ ID NO: 669289 - DNA, 25 bp, Artificial sequence
  Synthetic oligonucleotide
atcgcatgccagcacggccgaccgg

SEQ ID NO: 669290 - DNA, 25 bp, Artificial sequence
  Synthetic oligonucleotide
agattcaataatggcaatggaatgg

SEQ ID NO: 669291 - DNA, 25 bp, Artificial sequence
  Synthetic oligonucleotide
ccgtgaaacgcctgaaaaagacact

SEQ ID NO: 669292 - DNA, 25 bp, Artificial sequence
  Synthetic oligonucleotide
caataccggctgacaatcgacggcc

SEQ ID NO: 669293 - DNA, 25 bp, Artificial sequence
  Synthetic oligonucleotide
tcgaatatcagggtgccctctggca

SEQ ID NO: 669294 - DNA, 25 bp, Artificial sequence
  Synthetic oligonucleotide
atcagggtgccctctggcaagggct

SEQ ID NO: 669295 - DNA, 25 bp, Artificial sequence
  Synthetic oligonucleotide
gtgccctctggcaagggcttgccca

SEQ ID NO: 669296 - DNA, 25 bp, Artificial sequence
  Synthetic oligonucleotide
tctggcaagggcttgcccagcgtac

SEQ ID NO: 669297 - DNA, 25 bp, Artificial sequence
  Synthetic oligonucleotide
aagggcttgcccagcgtacgtacac

SEQ ID NO: 669298 - DNA, 25 bp, Artificial sequence
  Synthetic oligonucleotide
ttgcccagcgtacgtacaccttttc

SEQ ID NO: 669299 - DNA, 25 bp, Artificial sequence
  Synthetic oligonucleotide
tggcaatggaatggcaatcccaggc

SEQ ID NO: 669300 - DNA, 25 bp, Artificial sequence
  Synthetic oligonucleotide
ctttaccaataccggctgacaatcg

SEQ ID NO: 669301 - DNA, 25 bp, Artificial sequence
  Synthetic oligonucleotide
ggcgactgccgccagatcgtcgaat

SEQ ID NO: 669302 - DNA, 25 bp, Artificial sequence
  Synthetic oligonucleotide
cggctgacaatcgacggcccgcgcc

SEQ ID NO: 669303 - DNA, 25 bp, Artificial sequence
  Synthetic oligonucleotide
acaatcgacggcccgcgccgcctcc

SEQ ID NO: 669304 - DNA, 25 bp, Artificial sequence
  Synthetic oligonucleotide
gacggcccgcgccgcctccaggtca

SEQ ID NO: 669305 - DNA, 25 bp, Artificial sequence
  Synthetic oligonucleotide
ccgcgccgcctccaggtcaccgatg

SEQ ID NO: 669306 - DNA, 25 bp, Artificial sequence
  Synthetic oligonucleotide
cgcctccaggtcaccgatgctgtcg

SEQ ID NO: 669307 - DNA, 25 bp, Artificial sequence
  Synthetic oligonucleotide
ccctcgcttccctggctctttcttc

SEQ ID NO: 669308 - DNA, 25 bp, Artificial sequence
  Synthetic oligonucleotide
tccggtctttaccaataccggctga

SEQ ID NO: 669309 - DNA, 25 bp, Artificial sequence
  Synthetic oligonucleotide
cagccggagcatcgcggatggatcg

SEQ ID NO: 669310 - DNA, 25 bp, Artificial sequence
  Synthetic oligonucleotide
tgtactagattcaataatggcaatg

SEQ ID NO: 669311 - DNA, 25 bp, Artificial sequence
  Synthetic oligonucleotide
acaatctgtactagattcaataatg

SEQ ID NO: 669312 - DNA, 25 bp, Artificial sequence
  Synthetic oligonucleotide
cgctggacaatctgtactagattca

SEQ ID NO: 669313 - DNA, 25 bp, Artificial sequence
  Synthetic oligonucleotide
cccctacgctggacaatctgtacta

SEQ ID NO: 669314 - DNA, 25 bp, Artificial sequence
  Synthetic oligonucleotide
acgagccccctacgctggacaatct

SEQ ID NO: 669315 - DNA, 25 bp, Artificial sequence
  Synthetic oligonucleotide
ggatcgacgagccccctacgctgga

SEQ ID NO: 669316 - DNA, 25 bp, Artificial sequence
  Synthetic oligonucleotide
cagatcgtcgaatatcagggtgccc

SEQ ID NO: 669317 - DNA, 25 bp, Artificial sequence
  Synthetic oligonucleotide
agcatcgcggatggatcgacgagcc

SEQ ID NO: 669318 - DNA, 25 bp, Artificial sequence
  Synthetic oligonucleotide
tgccgccagatcgtcgaatatcagg

SEQ ID NO: 669319 - DNA, 25 bp, Artificial sequence
  Synthetic oligonucleotide
ctcagccagccggagcatcgcggat

SEQ ID NO: 669320 - DNA, 25 bp, Artificial sequence
  Synthetic oligonucleotide
attctacctcagccagccggagcat

SEQ ID NO: 669321 - DNA, 25 bp, Artificial sequence
  Synthetic oligonucleotide
ggatcgattctacctcagccagccg

SEQ ID NO: 669322 - DNA, 25 bp, Artificial sequence
  Synthetic oligonucleotide
tactgaagtaatgcgctggcgactg

SEQ ID NO: 669323 - DNA, 25 bp, Artificial sequence
  Synthetic oligonucleotide
agtaatgcgctggcgactgccgcca

SEQ ID NO: 669324 - DNA, 25 bp, Artificial sequence
  Synthetic oligonucleotide
tgcgctggcgactgccgccagatcg

SEQ ID NO: 669325 - DNA, 25 bp, Artificial sequence
  Synthetic oligonucleotide
ccgatgctgtcgccgacgaaccaga

SEQ ID NO: 669326 - DNA, 25 bp, Artificial sequence
  Synthetic oligonucleotide
gcggatggatcgacgagccccctac

SEQ ID NO: 669327 - DNA, 25 bp, Artificial sequence
  Synthetic oligonucleotide
gcaccctggccggcctgatcgcctt

SEQ ID NO: 669328 - DNA, 25 bp, Artificial sequence
  Synthetic oligonucleotide
tgccgatcaccctgtttggctggca

SEQ ID NO: 669329 - DNA, 25 bp, Artificial sequence
  Synthetic oligonucleotide
tgcagttgccgatcaccctgtttgg

SEQ ID NO: 669330 - DNA, 25 bp, Artificial sequence
  Synthetic oligonucleotide
cctggtgcagttgccgatcaccctg

SEQ ID NO: 669331 - DNA, 25 bp, Artificial sequence
  Synthetic oligonucleotide
caactacctggtgcagttgccgatc

SEQ ID NO: 669332 - DNA, 25 bp, Artificial sequence
  Synthetic oligonucleotide
cgccagcaactacctggtgcagttg

SEQ ID NO: 669333 - DNA, 25 bp, Artificial sequence
  Synthetic oligonucleotide
catcatcgccagcaactacctggtg

SEQ ID NO: 669334 - DNA, 25 bp, Artificial sequence
  Synthetic oligonucleotide
tcttcatcatcatcgccagcaacta

SEQ ID NO: 669335 - DNA, 25 bp, Artificial sequence
  Synthetic oligonucleotide
tccacatcttcatcatcatcgccag

SEQ ID NO: 669336 - DNA, 25 bp, Artificial sequence
  Synthetic oligonucleotide
tcgccttccacatcttcatcatcat

SEQ ID NO: 669337 - DNA, 25 bp, Artificial sequence
  Synthetic oligonucleotide
tcaccccatcgcgcaaaaaggacag

SEQ ID NO: 669338 - DNA, 25 bp, Artificial sequence
  Synthetic oligonucleotide
tggccggcctgatcgccttccacat

SEQ ID NO: 669339 - DNA, 25 bp, Artificial sequence
  Synthetic oligonucleotide
ggctggcacaccacctggggcgcct

SEQ ID NO: 669340 - DNA, 25 bp, Artificial sequence
  Synthetic oligonucleotide
ggcgcggcaccctggccggcctgat

SEQ ID NO: 669341 - DNA, 25 bp, Artificial sequence
  Synthetic oligonucleotide
cggcctggcgcggcaccctggccgg

SEQ ID NO: 669342 - DNA, 25 bp, Artificial sequence
  Synthetic oligonucleotide
ctccggcggcctggcgcggcaccct

SEQ ID NO: 669343 - DNA, 25 bp, Artificial sequence
  Synthetic oligonucleotide
ctcttctccggcggcctggcgcggc

SEQ ID NO: 669344 - DNA, 25 bp, Artificial sequence
  Synthetic oligonucleotide
gtcagcctcttctccggcggcctgg

SEQ ID NO: 669345 - DNA, 25 bp, Artificial sequence
  Synthetic oligonucleotide
gcacatgtcagcctcttctccggcg

SEQ ID NO: 669346 - DNA, 25 bp, Artificial sequence
  Synthetic oligonucleotide
aggacagcacatgtcagcctcttct

SEQ ID NO: 669347 - DNA, 25 bp, Artificial sequence
  Synthetic oligonucleotide
gcaaaaaggacagcacatgtcagcc

SEQ ID NO: 669348 - DNA, 25 bp, Artificial sequence
  Synthetic oligonucleotide
cctacgtggtctcggtgttgttcca

SEQ ID NO: 669349 - DNA, 25 bp, Artificial sequence
  Synthetic oligonucleotide
gcctgatcgccttccacatcttcat

SEQ ID NO: 669350 - DNA, 25 bp, Artificial sequence
  Synthetic oligonucleotide
accgtgcgcttgctgggcaagggcc

SEQ ID NO: 669351 - DNA, 25 bp, Artificial sequence
  Synthetic oligonucleotide
ggcgcgcagcatagctggtcgcccc

SEQ ID NO: 669352 - DNA, 25 bp, Artificial sequence
  Synthetic oligonucleotide
cgttgatcgcctcctacgtggtctc

SEQ ID NO: 669353 - DNA, 25 bp, Artificial sequence
  Synthetic oligonucleotide
tcccggcgttgatcgcctcctacgt

SEQ ID NO: 669354 - DNA, 25 bp, Artificial sequence
  Synthetic oligonucleotide
tcatgatcccggcgttgatcgcctc

SEQ ID NO: 669355 - DNA, 25 bp, Artificial sequence
  Synthetic oligonucleotide
cccgggtcatgatcccggcgttgat

SEQ ID NO: 669356 - DNA, 25 bp, Artificial sequence
  Synthetic oligonucleotide
tcatcgcccgggtcatgatcccggc

SEQ ID NO: 669357 - DNA, 25 bp, Artificial sequence
  Synthetic oligonucleotide
ggctggtcatcgcccgggtcatgat

SEQ ID NO: 669358 - DNA, 25 bp, Artificial sequence
  Synthetic oligonucleotide
ctgcccggctggtcatcgcccgggt

SEQ ID NO: 669359 - DNA, 25 bp, Artificial sequence
  Synthetic oligonucleotide
agggccctgcccggctggtcatcgc

SEQ ID NO: 669360 - DNA, 25 bp, Artificial sequence
  Synthetic oligonucleotide
atcaccctgtttggctggcacacca

SEQ ID NO: 669361 - DNA, 25 bp, Artificial sequence
  Synthetic oligonucleotide
cgcttgctgggcaagggccctgccc

SEQ ID NO: 669362 - DNA, 25 bp, Artificial sequence
  Synthetic oligonucleotide
ctgtttggctggcacaccacctggg

SEQ ID NO: 669363 - DNA, 25 bp, Artificial sequence
  Synthetic oligonucleotide
gacctcaccgtgcgcttgctgggca

SEQ ID NO: 669364 - DNA, 25 bp, Artificial sequence
  Synthetic oligonucleotide
gctaccgacctcaccgtgcgcttgc

SEQ ID NO: 669365 - DNA, 25 bp, Artificial sequence
  Synthetic oligonucleotide
ttcctggctaccgacctcaccgtgc

SEQ ID NO: 669366 - DNA, 25 bp, Artificial sequence
  Synthetic oligonucleotide
gttcatcttcctggctaccgacctc

SEQ ID NO: 669367 - DNA, 25 bp, Artificial sequence
  Synthetic oligonucleotide
tttccgttcatcttcctggctaccg

SEQ ID NO: 669368 - DNA, 25 bp, Artificial sequence
  Synthetic oligonucleotide
ttcagctttccgttcatcttcctgg

SEQ ID NO: 669369 - DNA, 25 bp, Artificial sequence
  Synthetic oligonucleotide
ggcgccttcagctttccgttcatct

SEQ ID NO: 669370 - DNA, 25 bp, Artificial sequence
  Synthetic oligonucleotide
acctggggcgccttcagctttccgt

SEQ ID NO: 669371 - DNA, 25 bp, Artificial sequence
  Synthetic oligonucleotide
cacaccacctggggcgccttcagct

SEQ ID NO: 669372 - DNA, 25 bp, Artificial sequence
  Synthetic oligonucleotide
gttccctcaccccatcgcgcaaaaa

SEQ ID NO: 669373 - DNA, 25 bp, Artificial sequence
  Synthetic oligonucleotide
tgggcaagggccctgcccggctggt

SEQ ID NO: 669374 - DNA, 25 bp, Artificial sequence
  Synthetic oligonucleotide
actggccaggtacaggatctgccga

SEQ ID NO: 669375 - DNA, 25 bp, Artificial sequence
  Synthetic oligonucleotide
tgcggaaggcgtcggcctgcgcttt

SEQ ID NO: 669376 - DNA, 25 bp, Artificial sequence
  Synthetic oligonucleotide
agtcgatgcggaaggcgtcggcctg

SEQ ID NO: 669377 - DNA, 25 bp, Artificial sequence
  Synthetic oligonucleotide
cgtgcgagtcgatgcggaaggcgtc

SEQ ID NO: 669378 - DNA, 25 bp, Artificial sequence
  Synthetic oligonucleotide
ggaagtcgtgcgagtcgatgcggaa

SEQ ID NO: 669379 - DNA, 25 bp, Artificial sequence
  Synthetic oligonucleotide
gcagatggaagtcgtgcgagtcgat

SEQ ID NO: 669380 - DNA, 25 bp, Artificial sequence
  Synthetic oligonucleotide
gatcctgcagatggaagtcgtgcga

SEQ ID NO: 669381 - DNA, 25 bp, Artificial sequence
  Synthetic oligonucleotide
cgcgccgatcctgcagatggaagtc

SEQ ID NO: 669382 - DNA, 25 bp, Artificial sequence
  Synthetic oligonucleotide
gatcgacgcgccgatcctgcagatg

SEQ ID NO: 669383 - DNA, 25 bp, Artificial sequence
  Synthetic oligonucleotide
tctgccgatcgacgcgccgatcctg

SEQ ID NO: 669384 - DNA, 25 bp, Artificial sequence
  Synthetic oligonucleotide
catcgcgcaaaaaggacagcacatg

SEQ ID NO: 669385 - DNA, 25 bp, Artificial sequence
  Synthetic oligonucleotide
caggtacaggatctgccgatcgacg

SEQ ID NO: 669386 - DNA, 25 bp, Artificial sequence
  Synthetic oligonucleotide
tgcgctttctcagcgaagcctgaac

SEQ ID NO: 669387 - DNA, 25 bp, Artificial sequence
  Synthetic oligonucleotide
gtcgttactggccaggtacaggatc

SEQ ID NO: 669388 - DNA, 25 bp, Artificial sequence
  Synthetic oligonucleotide
ggcagtgtcgttactggccaggtac

SEQ ID NO: 669389 - DNA, 25 bp, Artificial sequence
  Synthetic oligonucleotide
ccaacaggcagtgtcgttactggcc

SEQ ID NO: 669390 - DNA, 25 bp, Artificial sequence
  Synthetic oligonucleotide
cagctcccaacaggcagtgtcgtta

SEQ ID NO: 669391 - DNA, 25 bp, Artificial sequence
  Synthetic oligonucleotide
tgacccagctcccaacaggcagtgt

SEQ ID NO: 669392 - DNA, 25 bp, Artificial sequence
  Synthetic oligonucleotide
cggatctgacccagctcccaacagg

SEQ ID NO: 669393 - DNA, 25 bp, Artificial sequence
  Synthetic oligonucleotide
aacacccggatctgacccagctccc

SEQ ID NO: 669394 - DNA, 25 bp, Artificial sequence
  Synthetic oligonucleotide
atgtcaaacacccggatctgaccca

SEQ ID NO: 669395 - DNA, 25 bp, Artificial sequence
  Synthetic oligonucleotide
gggtctatgtcaaacacccggatct

SEQ ID NO: 669396 - DNA, 25 bp, Artificial sequence
  Synthetic oligonucleotide
caggatctgccgatcgacgcgccga

SEQ ID NO: 669397 - DNA, 25 bp, Artificial sequence
  Synthetic oligonucleotide
tgatcacagagtgggcgaaaccgct

SEQ ID NO: 669398 - DNA, 25 bp, Artificial sequence
  Synthetic oligonucleotide
ggcatgggttccctcaccccatcgc

SEQ ID NO: 669399 - DNA, 25 bp, Artificial sequence
  Synthetic oligonucleotide
tgccgggcatgggttccctcacccc

SEQ ID NO: 669400 - DNA, 25 bp, Artificial sequence
  Synthetic oligonucleotide
gcatggtgccgggcatgggttccct

SEQ ID NO: 669401 - DNA, 25 bp, Artificial sequence
  Synthetic oligonucleotide
cgctcggcatggtgccgggcatggg

SEQ ID NO: 669402 - DNA, 25 bp, Artificial sequence
  Synthetic oligonucleotide
gcgcgccgctcggcatggtgccggg

SEQ ID NO: 669403 - DNA, 25 bp, Artificial sequence
  Synthetic oligonucleotide
tagaatgcgcgccgctcggcatggt

SEQ ID NO: 669404 - DNA, 25 bp, Artificial sequence
  Synthetic oligonucleotide
atcggctagaatgcgcgccgctcgg

SEQ ID NO: 669405 - DNA, 25 bp, Artificial sequence
  Synthetic oligonucleotide
ccggttatcggctagaatgcgcgcc

SEQ ID NO: 669406 - DNA, 25 bp, Artificial sequence
  Synthetic oligonucleotide
accgctgccggttatcggctagaat

SEQ ID NO: 669407 - DNA, 25 bp, Artificial sequence
  Synthetic oligonucleotide
aaggcgtcggcctgcgctttctcag

SEQ ID NO: 669408 - DNA, 25 bp, Artificial sequence
  Synthetic oligonucleotide
cagagtgggcgaaaccgctgccggt

SEQ ID NO: 669409 - DNA, 25 bp, Artificial sequence
  Synthetic oligonucleotide
tcggcctgcgctttctcagcgaagc

SEQ ID NO: 669410 - DNA, 25 bp, Artificial sequence
  Synthetic oligonucleotide
agccactgatcacagagtgggcgaa

SEQ ID NO: 669411 - DNA, 25 bp, Artificial sequence
  Synthetic oligonucleotide
ggcatgagccactgatcacagagtg

SEQ ID NO: 669412 - DNA, 25 bp, Artificial sequence
  Synthetic oligonucleotide
aaccccaggcatgagccactgatca

SEQ ID NO: 669413 - DNA, 25 bp, Artificial sequence
  Synthetic oligonucleotide
acgtggaaccccaggcatgagccac

SEQ ID NO: 669414 - DNA, 25 bp, Artificial sequence
  Synthetic oligonucleotide
tgttccacgtggaaccccaggcatg

SEQ ID NO: 669415 - DNA, 25 bp, Artificial sequence
  Synthetic oligonucleotide
cggtgatgttccacgtggaacccca

SEQ ID NO: 669416 - DNA, 25 bp, Artificial sequence
  Synthetic oligonucleotide
gcctgaacggtgatgttccacgtgg

SEQ ID NO: 669417 - DNA, 25 bp, Artificial sequence
  Synthetic oligonucleotide
agcgaagcctgaacggtgatgttcc

SEQ ID NO: 669418 - DNA, 25 bp, Artificial sequence
  Synthetic oligonucleotide
tttctcagcgaagcctgaacggtga

SEQ ID NO: 669419 - DNA, 25 bp, Artificial sequence
  Synthetic oligonucleotide
tggtctcggtgttgttccaggaagc

SEQ ID NO: 669420 - DNA, 25 bp, Artificial sequence
  Synthetic oligonucleotide
ggcgaaaccgctgccggttatcggc

SEQ ID NO: 669421 - DNA, 25 bp, Artificial sequence
  Synthetic oligonucleotide
catgctactcaacggcatcctgaag

SEQ ID NO: 669422 - DNA, 25 bp, Artificial sequence
  Synthetic oligonucleotide
cgaggcaatctggaggaagggcgca

SEQ ID NO: 669423 - DNA, 25 bp, Artificial sequence
  Synthetic oligonucleotide
gcttatcgaggcaatctggaggaag

SEQ ID NO: 669424 - DNA, 25 bp, Artificial sequence
  Synthetic oligonucleotide
cttgaggcttatcgaggcaatctgg

SEQ ID NO: 669425 - DNA, 25 bp, Artificial sequence
  Synthetic oligonucleotide
caacgcttgaggcttatcgaggcaa

SEQ ID NO: 669426 - DNA, 25 bp, Artificial sequence
  Synthetic oligonucleotide
cgcagagcaacgcttgaggcttatc

SEQ ID NO: 669427 - DNA, 25 bp, Artificial sequence
  Synthetic oligonucleotide
ggcggccgcagagcaacgcttgagg

SEQ ID NO: 669428 - DNA, 25 bp, Artificial sequence
  Synthetic oligonucleotide
tgccggggcggccgcagagcaacgc

SEQ ID NO: 669429 - DNA, 25 bp, Artificial sequence
  Synthetic oligonucleotide
agatgctgccggggcggccgcagag

SEQ ID NO: 669430 - DNA, 25 bp, Artificial sequence
  Synthetic oligonucleotide
tcctgaagatgctgccggggcggcc

SEQ ID NO: 669431 - DNA, 25 bp, Artificial sequence
  Synthetic oligonucleotide
ccacggtggactacggagtgaagct

SEQ ID NO: 669432 - DNA, 25 bp, Artificial sequence
  Synthetic oligonucleotide
actcaacggcatcctgaagatgctg

SEQ ID NO: 669433 - DNA, 25 bp, Artificial sequence
  Synthetic oligonucleotide
gggcgcaacggccgtgaccgttgcg

SEQ ID NO: 669434 - DNA, 25 bp, Artificial sequence
  Synthetic oligonucleotide
ctacggcatgctactcaacggcatc

SEQ ID NO: 669435 - DNA, 25 bp, Artificial sequence
  Synthetic oligonucleotide
gccgctctacggcatgctactcaac

SEQ ID NO: 669436 - DNA, 25 bp, Artificial sequence
  Synthetic oligonucleotide
tgttcgtgccgctctacggcatgct

SEQ ID NO: 669437 - DNA, 25 bp, Artificial sequence
  Synthetic oligonucleotide
ttctgctgttcgtgccgctctacgg

SEQ ID NO: 669438 - DNA, 25 bp, Artificial sequence
  Synthetic oligonucleotide
tcagccttctgctgttcgtgccgct

SEQ ID NO: 669439 - DNA, 25 bp, Artificial sequence
  Synthetic oligonucleotide
tgagtatcagccttctgctgttcgt

SEQ ID NO: 669440 - DNA, 25 bp, Artificial sequence
  Synthetic oligonucleotide
tgaagctgagtatcagccttctgct

SEQ ID NO: 669441 - DNA, 25 bp, Artificial sequence
  Synthetic oligonucleotide
acggagtgaagctgagtatcagcct

SEQ ID NO: 669442 - DNA, 25 bp, Artificial sequence
  Synthetic oligonucleotide
tcgcctcctacgtggtctcggtgtt

SEQ ID NO: 669443 - DNA, 25 bp, Artificial sequence
  Synthetic oligonucleotide
acggcatcctgaagatgctgccggg

SEQ ID NO: 669444 - DNA, 25 bp, Artificial sequence
  Synthetic oligonucleotide
gcggccgtgagcagcgtcagggcat

SEQ ID NO: 669445 - DNA, 25 bp, Artificial sequence
  Synthetic oligonucleotide
tgggaacgcccagccctgtccgcac

SEQ ID NO: 669446 - DNA, 25 bp, Artificial sequence
  Synthetic oligonucleotide
gctgaatgggaacgcccagccctgt

SEQ ID NO: 669447 - DNA, 25 bp, Artificial sequence
  Synthetic oligonucleotide
cacgcgctgaatgggaacgcccagc

SEQ ID NO: 669448 - DNA, 25 bp, Artificial sequence
  Synthetic oligonucleotide
tgcgccacgcgctgaatgggaacgc

SEQ ID NO: 669449 - DNA, 25 bp, Artificial sequence
  Synthetic oligonucleotide
aggatgtgcgccacgcgctgaatgg

SEQ ID NO: 669450 - DNA, 25 bp, Artificial sequence
  Synthetic oligonucleotide
gtgaccaggatgtgcgccacgcgct

SEQ ID NO: 669451 - DNA, 25 bp, Artificial sequence
  Synthetic oligonucleotide
ccgagcgtgaccaggatgtgcgcca

SEQ ID NO: 669452 - DNA, 25 bp, Artificial sequence
  Synthetic oligonucleotide
tcgccgccgagcgtgaccaggatgt

SEQ ID NO: 669453 - DNA, 25 bp, Artificial sequence
  Synthetic oligonucleotide
agggcatcgccgccgagcgtgacca

SEQ ID NO: 669454 - DNA, 25 bp, Artificial sequence
  Synthetic oligonucleotide
aatctggaggaagggcgcaacggcc

SEQ ID NO: 669455 - DNA, 25 bp, Artificial sequence
  Synthetic oligonucleotide
gtgagcagcgtcagggcatcgccgc

SEQ ID NO: 669456 - DNA, 25 bp, Artificial sequence
  Synthetic oligonucleotide
gaggaagggcgcaacggccgtgacc

SEQ ID NO: 669457 - DNA, 25 bp, Artificial sequence
  Synthetic oligonucleotide
cggtgcgcggccgtgagcagcgtca

SEQ ID NO: 669458 - DNA, 25 bp, Artificial sequence
  Synthetic oligonucleotide
gtagcccggtgcgcggccgtgagca

SEQ ID NO: 669459 - DNA, 25 bp, Artificial sequence
  Synthetic oligonucleotide
aggtggtagcccggtgcgcggccgt

SEQ ID NO: 669460 - DNA, 25 bp, Artificial sequence
  Synthetic oligonucleotide
tcaggaggtggtagcccggtgcgcg

SEQ ID NO: 669461 - DNA, 25 bp, Artificial sequence
  Synthetic oligonucleotide
cttcattcaggaggtggtagcccgg

SEQ ID NO: 669462 - DNA, 25 bp, Artificial sequence
  Synthetic oligonucleotide
gcccttcttcattcaggaggtggta

SEQ ID NO: 669463 - DNA, 25 bp, Artificial sequence
  Synthetic oligonucleotide
ccgttgcgcccttcttcattcagga

SEQ ID NO: 669464 - DNA, 25 bp, Artificial sequence
  Synthetic oligonucleotide
ccgtgaccgttgcgcccttcttcat

SEQ ID NO: 669465 - DNA, 25 bp, Artificial sequence
  Synthetic oligonucleotide
caacggccgtgaccgttgcgccctt

SEQ ID NO: 669466 - DNA, 25 bp, Artificial sequence
  Synthetic oligonucleotide
gaaatcgccacggtggactacggag

SEQ ID NO: 669467 - DNA, 25 bp, Artificial sequence
  Synthetic oligonucleotide
agcgtcagggcatcgccgccgagcg

SEQ ID NO: 669468 - DNA, 25 bp, Artificial sequence
  Synthetic oligonucleotide
ttcaacaccttcgtcgcacggatat

SEQ ID NO: 669469 - DNA, 25 bp, Artificial sequence
  Synthetic oligonucleotide
acatccaggtattcgaccgcctccg

SEQ ID NO: 669470 - DNA, 25 bp, Artificial sequence
  Synthetic oligonucleotide
tcctcgacatccaggtattcgaccg

SEQ ID NO: 669471 - DNA, 25 bp, Artificial sequence
  Synthetic oligonucleotide
ggcagatcctcgacatccaggtatt

SEQ ID NO: 669472 - DNA, 25 bp, Artificial sequence
  Synthetic oligonucleotide
tgctcgggcagatcctcgacatcca

SEQ ID NO: 669473 - DNA, 25 bp, Artificial sequence
  Synthetic oligonucleotide
cctatgtgctcgggcagatcctcga

SEQ ID NO: 669474 - DNA, 25 bp, Artificial sequence
  Synthetic oligonucleotide
tcctcgcctatgtgctcgggcagat

SEQ ID NO: 669475 - DNA, 25 bp, Artificial sequence
  Synthetic oligonucleotide
aagcttcctcgcctatgtgctcggg

SEQ ID NO: 669476 - DNA, 25 bp, Artificial sequence
  Synthetic oligonucleotide
cctggcaagcttcctcgcctatgtg

SEQ ID NO: 669477 - DNA, 25 bp, Artificial sequence
  Synthetic oligonucleotide
ggatatccctggcaagcttcctcgc

SEQ ID NO: 669478 - DNA, 25 bp, Artificial sequence
  Synthetic oligonucleotide
tggactacggagtgaagctgagtat

SEQ ID NO: 669479 - DNA, 25 bp, Artificial sequence
  Synthetic oligonucleotide
accttcgtcgcacggatatccctgg

SEQ ID NO: 669480 - DNA, 25 bp, Artificial sequence
  Synthetic oligonucleotide
gcctccgtcgttcccggcactggtg

SEQ ID NO: 669481 - DNA, 25 bp, Artificial sequence
  Synthetic oligonucleotide
ctggagttcaacaccttcgtcgcac

SEQ ID NO: 669482 - DNA, 25 bp, Artificial sequence
  Synthetic oligonucleotide
gcgctgctggagttcaacaccttcg

SEQ ID NO: 669483 - DNA, 25 bp, Artificial sequence
  Synthetic oligonucleotide
ttctccgcgctgctggagttcaaca

SEQ ID NO: 669484 - DNA, 25 bp, Artificial sequence
  Synthetic oligonucleotide
cgtggtttctccgcgctgctggagt

SEQ ID NO: 669485 - DNA, 25 bp, Artificial sequence
  Synthetic oligonucleotide
cgttccgtggtttctccgcgctgct

SEQ ID NO: 669486 - DNA, 25 bp, Artificial sequence
  Synthetic oligonucleotide
agcggcgttccgtggtttctccgcg

SEQ ID NO: 669487 - DNA, 25 bp, Artificial sequence
  Synthetic oligonucleotide
caggaagcggcgttccgtggtttct

SEQ ID NO: 669488 - DNA, 25 bp, Artificial sequence
  Synthetic oligonucleotide
ttgttccaggaagcggcgttccgtg

SEQ ID NO: 669489 - DNA, 25 bp, Artificial sequence
  Synthetic oligonucleotide
cggtgttgttccaggaagcggcgtt

SEQ ID NO: 669490 - DNA, 25 bp, Artificial sequence
  Synthetic oligonucleotide
gtcgcacggatatccctggcaagct

SEQ ID NO: 669491 - DNA, 25 bp, Artificial sequence
  Synthetic oligonucleotide
tgctggacaccttcaccttcttctt

SEQ ID NO: 669492 - DNA, 25 bp, Artificial sequence
  Synthetic oligonucleotide
ctgggtggaaatcgccacggtggac

SEQ ID NO: 669493 - DNA, 25 bp, Artificial sequence
  Synthetic oligonucleotide
gcagcactgggtggaaatcgccacg

SEQ ID NO: 669494 - DNA, 25 bp, Artificial sequence
  Synthetic oligonucleotide
tcatggcgcagcactgggtggaaat

SEQ ID NO: 669495 - DNA, 25 bp, Artificial sequence
  Synthetic oligonucleotide
aatccgttcatggcgcagcactggg

SEQ ID NO: 669496 - DNA, 25 bp, Artificial sequence
  Synthetic oligonucleotide
agcgacaatccgttcatggcgcagc

SEQ ID NO: 669497 - DNA, 25 bp, Artificial sequence
  Synthetic oligonucleotide
tggcgtagcgacaatccgttcatgg

SEQ ID NO: 669498 - DNA, 25 bp, Artificial sequence
  Synthetic oligonucleotide
gcgttctggcgtagcgacaatccgt

SEQ ID NO: 669499 - DNA, 25 bp, Artificial sequence
  Synthetic oligonucleotide
ttcgtggcgttctggcgtagcgaca

SEQ ID NO: 669500 - DNA, 25 bp, Artificial sequence
  Synthetic oligonucleotide
ttcttcttcgtggcgttctggcgta

SEQ ID NO: 669501 - DNA, 25 bp, Artificial sequence
  Synthetic oligonucleotide
caggtattcgaccgcctccgtcgtt

SEQ ID NO: 669502 - DNA, 25 bp, Artificial sequence
  Synthetic oligonucleotide
gacaccttcaccttcttcttcgtgg

SEQ ID NO: 669503 - DNA, 25 bp, Artificial sequence
  Synthetic oligonucleotide
tcgaccgcctccgtcgttcccggca

SEQ ID NO: 669504 - DNA, 25 bp, Artificial sequence
  Synthetic oligonucleotide
gcaacctgctggacaccttcacctt

SEQ ID NO: 669505 - DNA, 25 bp, Artificial sequence
  Synthetic oligonucleotide
tcctcggcaacctgctggacacctt

SEQ ID NO: 669506 - DNA, 25 bp, Artificial sequence
  Synthetic oligonucleotide
cgaccatcctcggcaacctgctgga

SEQ ID NO: 669507 - DNA, 25 bp, Artificial sequence
  Synthetic oligonucleotide
cgcctcgaccatcctcggcaacctg

SEQ ID NO: 669508 - DNA, 25 bp, Artificial sequence
  Synthetic oligonucleotide
gccagtcgcctcgaccatcctcggc

SEQ ID NO: 669509 - DNA, 25 bp, Artificial sequence
  Synthetic oligonucleotide
gaccgcgccagtcgcctcgaccatc

SEQ ID NO: 669510 - DNA, 25 bp, Artificial sequence
  Synthetic oligonucleotide
ctggtggaccgcgccagtcgcctcg

SEQ ID NO: 669511 - DNA, 25 bp, Artificial sequence
  Synthetic oligonucleotide
ccggcactggtggaccgcgccagtc

SEQ ID NO: 669512 - DNA, 25 bp, Artificial sequence
  Synthetic oligonucleotide
tcgttcccggcactggtggaccgcg

SEQ ID NO: 669513 - DNA, 25 bp, Artificial sequence
  Synthetic oligonucleotide
cgcgacctctccgacaccggggtct

SEQ ID NO: 669514 - DNA, 25 bp, Artificial sequence
  Synthetic oligonucleotide
ttcaccttcttcttcgtggcgttct

SEQ ID NO: 669515 - DNA, 25 bp, Artificial sequence
  Synthetic oligonucleotide
tgcgcctggatctggccgcctgaaa

SEQ ID NO: 669516 - DNA, 25 bp, Artificial sequence
  Synthetic oligonucleotide
gctggaggaagcgctggcttccggc

SEQ ID NO: 669517 - DNA, 25 bp, Artificial sequence
  Synthetic oligonucleotide
ggaggtgctggaggaagcgctggct

SEQ ID NO: 669518 - DNA, 25 bp, Artificial sequence
  Synthetic oligonucleotide
aggcatggaggtgctggaggaagcg

SEQ ID NO: 669519 - DNA, 25 bp, Artificial sequence
  Synthetic oligonucleotide
ggtcgaaggcatggaggtgctggag

SEQ ID NO: 669520 - DNA, 25 bp, Artificial sequence
  Synthetic oligonucleotide
cgcgaggtcgaaggcatggaggtgc

SEQ ID NO: 669521 - DNA, 25 bp, Artificial sequence
  Synthetic oligonucleotide
acatccgcgaggtcgaaggcatgga

SEQ ID NO: 669522 - DNA, 25 bp, Artificial sequence
  Synthetic oligonucleotide
tgagatacatccgcgaggtcgaagg

SEQ ID NO: 669523 - DNA, 25 bp, Artificial sequence
  Synthetic oligonucleotide
agtcgctgagatacatccgcgaggt

SEQ ID NO: 669524 - DNA, 25 bp, Artificial sequence
  Synthetic oligonucleotide
ctgaaaagtcgctgagatacatccg

SEQ ID NO: 669525 - DNA, 25 bp, Artificial sequence
  Synthetic oligonucleotide
tggaaaagctggtcggacaaagcct

SEQ ID NO: 669526 - DNA, 25 bp, Artificial sequence
  Synthetic oligonucleotide
ggatctggccgcctgaaaagtcgct

SEQ ID NO: 669527 - DNA, 25 bp, Artificial sequence
  Synthetic oligonucleotide
tccggcgatggcctggtcggcatta

SEQ ID NO: 669528 - DNA, 25 bp, Artificial sequence
  Synthetic oligonucleotide
agtgcctgcgcctggatctggccgc

SEQ ID NO: 669529 - DNA, 25 bp, Artificial sequence
  Synthetic oligonucleotide
ccgaaagtgcctgcgcctggatctg

SEQ ID NO: 669530 - DNA, 25 bp, Artificial sequence
  Synthetic oligonucleotide
ccctcaccgaaagtgcctgcgcctg

SEQ ID NO: 669531 - DNA, 25 bp, Artificial sequence
  Synthetic oligonucleotide
gccggaccctcaccgaaagtgcctg

SEQ ID NO: 669532 - DNA, 25 bp, Artificial sequence
  Synthetic oligonucleotide
gatattggccggaccctcaccgaaa

SEQ ID NO: 669533 - DNA, 25 bp, Artificial sequence
  Synthetic oligonucleotide
ctgatggatattggccggaccctca

SEQ ID NO: 669534 - DNA, 25 bp, Artificial sequence
  Synthetic oligonucleotide
aaagcctgatggatattggccggac

SEQ ID NO: 669535 - DNA, 25 bp, Artificial sequence
  Synthetic oligonucleotide
tcggacaaagcctgatggatattgg

SEQ ID NO: 669536 - DNA, 25 bp, Artificial sequence
  Synthetic oligonucleotide
gacaccggggtctatgtcaaacacc

SEQ ID NO: 669537 - DNA, 25 bp, Artificial sequence
  Synthetic oligonucleotide
ggccgcctgaaaagtcgctgagata

SEQ ID NO: 669538 - DNA, 25 bp, Artificial sequence
  Synthetic oligonucleotide
acttctattgctcctacgccaagcc

SEQ ID NO: 669539 - DNA, 25 bp, Artificial sequence
  Synthetic oligonucleotide
gttgctgaagaagcaacgcgtgcaa

SEQ ID NO: 669540 - DNA, 25 bp, Artificial sequence
  Synthetic oligonucleotide
ggacgagttgctgaagaagcaacgc

SEQ ID NO: 669541 - DNA, 25 bp, Artificial sequence
  Synthetic oligonucleotide
ggcagtggacgagttgctgaagaag

SEQ ID NO: 669542 - DNA, 25 bp, Artificial sequence
  Synthetic oligonucleotide
gctgaaggcagtggacgagttgctg

SEQ ID NO: 669543 - DNA, 25 bp, Artificial sequence
  Synthetic oligonucleotide
gcccaagctgaaggcagtggacgag

SEQ ID NO: 669544 - DNA, 25 bp, Artificial sequence
  Synthetic oligonucleotide
tcgtccgcccaagctgaaggcagtg

SEQ ID NO: 669545 - DNA, 25 bp, Artificial sequence
  Synthetic oligonucleotide
ttctatcgtccgcccaagctgaagg

SEQ ID NO: 669546 - DNA, 25 bp, Artificial sequence
  Synthetic oligonucleotide
gatcatcttctatcgtccgcccaag

SEQ ID NO: 669547 - DNA, 25 bp, Artificial sequence
  Synthetic oligonucleotide
caagccgatcatcttctatcgtccg

SEQ ID NO: 669548 - DNA, 25 bp, Artificial sequence
  Synthetic oligonucleotide
ggaagcgctggcttccggcgatggc

SEQ ID NO: 669549 - DNA, 25 bp, Artificial sequence
  Synthetic oligonucleotide
attgctcctacgccaagccgatcat

SEQ ID NO: 669550 - DNA, 25 bp, Artificial sequence
  Synthetic oligonucleotide
ctggcttccggcgatggcctggtcg

SEQ ID NO: 669551 - DNA, 25 bp, Artificial sequence
  Synthetic oligonucleotide
tcaaccacttctattgctcctacgc

SEQ ID NO: 669552 - DNA, 25 bp, Artificial sequence
  Synthetic oligonucleotide
aagtactcaaccacttctattgctc

SEQ ID NO: 669553 - DNA, 25 bp, Artificial sequence
  Synthetic oligonucleotide
actgggaagtactcaaccacttcta

SEQ ID NO: 669554 - DNA, 25 bp, Artificial sequence
  Synthetic oligonucleotide
tgggaaactgggaagtactcaacca

SEQ ID NO: 669555 - DNA, 25 bp, Artificial sequence
  Synthetic oligonucleotide
tcacctgggaaactgggaagtactc

SEQ ID NO: 669556 - DNA, 25 bp, Artificial sequence
  Synthetic oligonucleotide
taccagtcacctgggaaactgggaa

SEQ ID NO: 669557 - DNA, 25 bp, Artificial sequence
  Synthetic oligonucleotide
ggcattaccagtcacctgggaaact

SEQ ID NO: 669558 - DNA, 25 bp, Artificial sequence
  Synthetic oligonucleotide
ctggtcggcattaccagtcacctgg

SEQ ID NO: 669559 - DNA, 25 bp, Artificial sequence
  Synthetic oligonucleotide
gatggcctggtcggcattaccagtc

SEQ ID NO: 669560 - DNA, 25 bp, Artificial sequence
  Synthetic oligonucleotide
cgaactggaaaagctggtcggacaa

SEQ ID NO: 669561 - DNA, 25 bp, Artificial sequence
  Synthetic oligonucleotide
cctacgccaagccgatcatcttcta

SEQ ID NO: 669562 - DNA, 25 bp, Artificial sequence
  Synthetic oligonucleotide
gtacaatgcgcgttcgagtcgagcg

SEQ ID NO: 669563 - DNA, 25 bp, Artificial sequence
  Synthetic oligonucleotide
ggccctacgcctgttcgcgttattg

SEQ ID NO: 669564 - DNA, 25 bp, Artificial sequence
  Synthetic oligonucleotide
tggtgggggccctacgcctgttcgc

SEQ ID NO: 669565 - DNA, 25 bp, Artificial sequence
  Synthetic oligonucleotide
tgccctggtggtgggggccctacgc

SEQ ID NO: 669566 - DNA, 25 bp, Artificial sequence
  Synthetic oligonucleotide
tcaaaggtgccctggtggtgggggc

SEQ ID NO: 669567 - DNA, 25 bp, Artificial sequence
  Synthetic oligonucleotide
gaaattcaaaggtgccctggtggtg

SEQ ID NO: 669568 - DNA, 25 bp, Artificial sequence
  Synthetic oligonucleotide
gtggagaaattcaaaggtgccctgg

SEQ ID NO: 669569 - DNA, 25 bp, Artificial sequence
  Synthetic oligonucleotide
tgtttcgtggagaaattcaaaggtg

SEQ ID NO: 669570 - DNA, 25 bp, Artificial sequence
  Synthetic oligonucleotide
gaggagtgtttcgtggagaaattca

SEQ ID NO: 669571 - DNA, 25 bp, Artificial sequence
  Synthetic oligonucleotide
tcgagcgaggagtgtttcgtggaga

SEQ ID NO: 669572 - DNA, 25 bp, Artificial sequence
  Synthetic oligonucleotide
agctggtcggacaaagcctgatgga

SEQ ID NO: 669573 - DNA, 25 bp, Artificial sequence
  Synthetic oligonucleotide
tgcgcgttcgagtcgagcgaggagt

SEQ ID NO: 669574 - DNA, 25 bp, Artificial sequence
  Synthetic oligonucleotide
cgttattgccctggcgtgccgtgca

SEQ ID NO: 669575 - DNA, 25 bp, Artificial sequence
  Synthetic oligonucleotide
cctggcgtacaatgcgcgttcgagt

SEQ ID NO: 669576 - DNA, 25 bp, Artificial sequence
  Synthetic oligonucleotide
attcttcctggcgtacaatgcgcgt

SEQ ID NO: 669577 - DNA, 25 bp, Artificial sequence
  Synthetic oligonucleotide
cctcgcattcttcctggcgtacaat

SEQ ID NO: 669578 - DNA, 25 bp, Artificial sequence
  Synthetic oligonucleotide
tgccgccctcgcattcttcctggcg

SEQ ID NO: 669579 - DNA, 25 bp, Artificial sequence
  Synthetic oligonucleotide
ttggctgccgccctcgcattcttcc

SEQ ID NO: 669580 - DNA, 25 bp, Artificial sequence
  Synthetic oligonucleotide
cgcttccttggctgccgccctcgca

SEQ ID NO: 669581 - DNA, 25 bp, Artificial sequence
  Synthetic oligonucleotide
tcgccccgcttccttggctgccgcc

SEQ ID NO: 669582 - DNA, 25 bp, Artificial sequence
  Synthetic oligonucleotide
agctggtcgccccgcttccttggct

SEQ ID NO: 669583 - DNA, 25 bp, Artificial sequence
  Synthetic oligonucleotide
cagcatagctggtcgccccgcttcc

SEQ ID NO: 669584 - DNA, 25 bp, Artificial sequence
  Synthetic oligonucleotide
ttcgagtcgagcgaggagtgtttcg

SEQ ID NO: 669585 - DNA, 25 bp, Artificial sequence
  Synthetic oligonucleotide
gaaattgccgaatcgatcccgcgag

SEQ ID NO: 669586 - DNA, 25 bp, Artificial sequence
  Synthetic oligonucleotide
tgaaaccgaactggaaaagctggtc

SEQ ID NO: 669587 - DNA, 25 bp, Artificial sequence
  Synthetic oligonucleotide
ttgtctgaaaccgaactggaaaagc

SEQ ID NO: 669588 - DNA, 25 bp, Artificial sequence
  Synthetic oligonucleotide
ccccgagttgtctgaaaccgaactg

SEQ ID NO: 669589 - DNA, 25 bp, Artificial sequence
  Synthetic oligonucleotide
agtgcttccccgagttgtctgaaac

SEQ ID NO: 669590 - DNA, 25 bp, Artificial sequence
  Synthetic oligonucleotide
tgtccaagtgcttccccgagttgtc

SEQ ID NO: 669591 - DNA, 25 bp, Artificial sequence
  Synthetic oligonucleotide
tcaacctgtccaagtgcttccccga

SEQ ID NO: 669592 - DNA, 25 bp, Artificial sequence
  Synthetic oligonucleotide
tgcggatcaacctgtccaagtgctt

SEQ ID NO: 669593 - DNA, 25 bp, Artificial sequence
  Synthetic oligonucleotide
aggtagtgcggatcaacctgtccaa

SEQ ID NO: 669594 - DNA, 25 bp, Artificial sequence
  Synthetic oligonucleotide
cccgcgaggtagtgcggatcaacct

SEQ ID NO: 669595 - DNA, 25 bp, Artificial sequence
  Synthetic oligonucleotide
acgcctgttcgcgttattgccctgg

SEQ ID NO: 669596 - DNA, 25 bp, Artificial sequence
  Synthetic oligonucleotide
tgccgaatcgatcccgcgaggtagt

SEQ ID NO: 669597 - DNA, 25 bp, Artificial sequence
  Synthetic oligonucleotide
gttcgcgttattgccctggcgtgcc

SEQ ID NO: 669598 - DNA, 25 bp, Artificial sequence
  Synthetic oligonucleotide
gatgtggaaattgccgaatcgatcc

SEQ ID NO: 669599 - DNA, 25 bp, Artificial sequence
  Synthetic oligonucleotide
gctggctgatgtggaaattgccgaa

SEQ ID NO: 669600 - DNA, 25 bp, Artificial sequence
  Synthetic oligonucleotide
gcataggctggctgatgtggaaatt

SEQ ID NO: 669601 - DNA, 25 bp, Artificial sequence
  Synthetic oligonucleotide
ggggccggcataggctggctgatgt

SEQ ID NO: 669602 - DNA, 25 bp, Artificial sequence
  Synthetic oligonucleotide
gcgtcggggccggcataggctggct

SEQ ID NO: 669603 - DNA, 25 bp, Artificial sequence
  Synthetic oligonucleotide
tgcaaggcgtcggggccggcatagg

SEQ ID NO: 669604 - DNA, 25 bp, Artificial sequence
  Synthetic oligonucleotide
gtgccgtgcaaggcgtcggggccgg

SEQ ID NO: 669605 - DNA, 25 bp, Artificial sequence
  Synthetic oligonucleotide
ctggcgtgccgtgcaaggcgtcggg

SEQ ID NO: 669606 - DNA, 25 bp, Artificial sequence
  Synthetic oligonucleotide
ttgccctggcgtgccgtgcaaggcg

SEQ ID NO: 669607 - DNA, 25 bp, Artificial sequence
  Synthetic oligonucleotide
gtgcaattgggcaatcgcgtcgcac

SEQ ID NO: 669608 - DNA, 25 bp, Artificial sequence
  Synthetic oligonucleotide
atcgatcccgcgaggtagtgcggat

SEQ ID NO: 669609 - DNA, 25 bp, Artificial sequence
  Synthetic oligonucleotide
gtggagcatgaagcgcttcaagaac

SEQ ID NO: 669610 - DNA, 25 bp, Artificial sequence
  Synthetic oligonucleotide
cgcctttttcatatccgggtactat

SEQ ID NO: 669611 - DNA, 25 bp, Artificial sequence
  Synthetic oligonucleotide
cggaagacgcctttttcatatccgg

SEQ ID NO: 669612 - DNA, 25 bp, Artificial sequence
  Synthetic oligonucleotide
ggcgtcggaagacgcctttttcata

SEQ ID NO: 669613 - DNA, 25 bp, Artificial sequence
  Synthetic oligonucleotide
tattgaggaaagggcgtcggaagac

SEQ ID NO: 669614 - DNA, 25 bp, Artificial sequence
  Synthetic oligonucleotide
aaatggtattgaggaaagggcgtcg

SEQ ID NO: 669615 - DNA, 25 bp, Artificial sequence
  Synthetic oligonucleotide
gcgagaaaaaatggtattgaggaaa

SEQ ID NO: 669616 - DNA, 25 bp, Artificial sequence
  Synthetic oligonucleotide
cggatggcgagaaaaaatggtattg

SEQ ID NO: 669617 - DNA, 25 bp, Artificial sequence
  Synthetic oligonucleotide
accgcccggatggcgagaaaaaatg

SEQ ID NO: 669618 - DNA, 25 bp, Artificial sequence
  Synthetic oligonucleotide
caagaaccgcccggatggcgagaaa

SEQ ID NO: 669619 - DNA, 25 bp, Artificial sequence
  Synthetic oligonucleotide
aagaagcaacgcgtgcaattgggca

SEQ ID NO: 669620 - DNA, 25 bp, Artificial sequence
  Synthetic oligonucleotide
catgaagcgcttcaagaaccgcccg

SEQ ID NO: 669621 - DNA, 25 bp, Artificial sequence
  Synthetic oligonucleotide
ggtactatgctcagctctgccgcct

SEQ ID NO: 669622 - DNA, 25 bp, Artificial sequence
  Synthetic oligonucleotide
gtacatgtggagcatgaagcgcttc

SEQ ID NO: 669623 - DNA, 25 bp, Artificial sequence
  Synthetic oligonucleotide
cagccagtacatgtggagcatgaag

SEQ ID NO: 669624 - DNA, 25 bp, Artificial sequence
  Synthetic oligonucleotide
ctatcccagccagtacatgtggagc

SEQ ID NO: 669625 - DNA, 25 bp, Artificial sequence
  Synthetic oligonucleotide
acgagcctatcccagccagtacatg

SEQ ID NO: 669626 - DNA, 25 bp, Artificial sequence
  Synthetic oligonucleotide
gtatgtacgagcctatcccagccag

SEQ ID NO: 669627 - DNA, 25 bp, Artificial sequence
  Synthetic oligonucleotide
ggcgaagtatgtacgagcctatccc

SEQ ID NO: 669628 - DNA, 25 bp, Artificial sequence
  Synthetic oligonucleotide
cgagttggcgaagtatgtacgagcc

SEQ ID NO: 669629 - DNA, 25 bp, Artificial sequence
  Synthetic oligonucleotide
tgagccgcgagttggcgaagtatgt

SEQ ID NO: 669630 - DNA, 25 bp, Artificial sequence
  Synthetic oligonucleotide
cagccatgagccgcgagttggcgaa

SEQ ID NO: 669631 - DNA, 25 bp, Artificial sequence
  Synthetic oligonucleotide
gcgcttcaagaaccgcccggatggc

SEQ ID NO: 669632 - DNA, 25 bp, Artificial sequence
  Synthetic oligonucleotide
tacccacgaaccccgctcaagtgcc

SEQ ID NO: 669633 - DNA, 25 bp, Artificial sequence
  Synthetic oligonucleotide
gtccgcacttcgatcctttccaagg

SEQ ID NO: 669634 - DNA, 25 bp, Artificial sequence
  Synthetic oligonucleotide
cagacacgcgacctctccgacaccg

SEQ ID NO: 669635 - DNA, 25 bp, Artificial sequence
  Synthetic oligonucleotide
atggcgcagacacgcgacctctccg

SEQ ID NO: 669636 - DNA, 25 bp, Artificial sequence
  Synthetic oligonucleotide
agctgatggcgcagacacgcgacct

SEQ ID NO: 669637 - DNA, 25 bp, Artificial sequence
  Synthetic oligonucleotide
tctacggggtgttcgccaccttcca

SEQ ID NO: 669638 - DNA, 25 bp, Artificial sequence
  Synthetic oligonucleotide
cgttatttggcgagctgatggcgca

SEQ ID NO: 669639 - DNA, 25 bp, Artificial sequence
  Synthetic oligonucleotide
tatcagtcacccgttatttggcgag

SEQ ID NO: 669640 - DNA, 25 bp, Artificial sequence
  Synthetic oligonucleotide
aatccgtatcagtcacccgttattt

SEQ ID NO: 669641 - DNA, 25 bp, Artificial sequence
  Synthetic oligonucleotide
gtgccgaatccgtatcagtcacccg

SEQ ID NO: 669642 - DNA, 25 bp, Artificial sequence
  Synthetic oligonucleotide
tttcatatccgggtactatgctcag

SEQ ID NO: 669643 - DNA, 25 bp, Artificial sequence
  Synthetic oligonucleotide
cgaaccccgctcaagtgccgaatcc

SEQ ID NO: 669644 - DNA, 25 bp, Artificial sequence
  Synthetic oligonucleotide
atccgggtactatgctcagctctgc

SEQ ID NO: 669645 - DNA, 25 bp, Artificial sequence
  Synthetic oligonucleotide
cgacaatacccacgaaccccgctca

SEQ ID NO: 669646 - DNA, 25 bp, Artificial sequence
  Synthetic oligonucleotide
tggataatcaacgacaatacccacg

SEQ ID NO: 669647 - DNA, 25 bp, Artificial sequence
  Synthetic oligonucleotide
actcgatggataatcaacgacaata

SEQ ID NO: 669648 - DNA, 25 bp, Artificial sequence
  Synthetic oligonucleotide
cgagggactcgatggataatcaacg

SEQ ID NO: 669649 - DNA, 25 bp, Artificial sequence
  Synthetic oligonucleotide
aggtcccgagggactcgatggataa

SEQ ID NO: 669650 - DNA, 25 bp, Artificial sequence
  Synthetic oligonucleotide
ctccgcaggtcccgagggactcgat

SEQ ID NO: 669651 - DNA, 25 bp, Artificial sequence
  Synthetic oligonucleotide
ccgcctcctccgcaggtcccgaggg

SEQ ID NO: 669652 - DNA, 25 bp, Artificial sequence
  Synthetic oligonucleotide
agctctgccgcctcctccgcaggtc

SEQ ID NO: 669653 - DNA, 25 bp, Artificial sequence
  Synthetic oligonucleotide
atgctcagctctgccgcctcctccg

SEQ ID NO: 669654 - DNA, 25 bp, Artificial sequence
  Synthetic oligonucleotide
cctggaagtgtctgtagcagccatg

SEQ ID NO: 669655 - DNA, 25 bp, Artificial sequence
  Synthetic oligonucleotide
cgctcaagtgccgaatccgtatcag

SEQ ID NO: 669656 - DNA, 25 bp, Artificial sequence
  Synthetic oligonucleotide
gaagtgaagaaaggcggttgcgtag

SEQ ID NO: 669657 - DNA, 25 bp, Artificial sequence
  Synthetic oligonucleotide
tgtagcagccatgagccgcgagttg

SEQ ID NO: 669658 - DNA, 25 bp, Artificial sequence
  Synthetic oligonucleotide
gcaccactgcattgatcagcaagtt

SEQ ID NO: 669659 - DNA, 25 bp, Artificial sequence
  Synthetic oligonucleotide
acctgggcaccactgcattgatcag

SEQ ID NO: 669660 - DNA, 25 bp, Artificial sequence
  Synthetic oligonucleotide
tgccctacctgggcaccactgcatt

SEQ ID NO: 669661 - DNA, 25 bp, Artificial sequence
  Synthetic oligonucleotide
tcttcgtgccctacctgggcaccac

SEQ ID NO: 669662 - DNA, 25 bp, Artificial sequence
  Synthetic oligonucleotide
ctgggctcttcgtgccctacctggg

SEQ ID NO: 669663 - DNA, 25 bp, Artificial sequence
  Synthetic oligonucleotide
gtaccgctgggctcttcgtgcccta

SEQ ID NO: 669664 - DNA, 25 bp, Artificial sequence
  Synthetic oligonucleotide
cgcgcgtaccgctgggctcttcgtg

SEQ ID NO: 669665 - DNA, 25 bp, Artificial sequence
  Synthetic oligonucleotide
cgagcccgcgcgtaccgctgggctc

SEQ ID NO: 669666 - DNA, 25 bp, Artificial sequence
  Synthetic oligonucleotide
tgatcagcaagttcgtcccgcagtt

SEQ ID NO: 669667 - DNA, 25 bp, Artificial sequence
  Synthetic oligonucleotide
gcggttgcgtagggattcccgccga

SEQ ID NO: 669668 - DNA, 25 bp, Artificial sequence
  Synthetic oligonucleotide
gcaagttcgtcccgcagttgctttc

SEQ ID NO: 669669 - DNA, 25 bp, Artificial sequence
  Synthetic oligonucleotide
atcaaggaagtgaagaaaggcggtt

SEQ ID NO: 669670 - DNA, 25 bp, Artificial sequence
  Synthetic oligonucleotide
agtgtcatcaaggaagtgaagaaag

SEQ ID NO: 669671 - DNA, 25 bp, Artificial sequence
  Synthetic oligonucleotide
atcctcagtgtcatcaaggaagtga

SEQ ID NO: 669672 - DNA, 25 bp, Artificial sequence
  Synthetic oligonucleotide
gagggtatcctcagtgtcatcaagg

SEQ ID NO: 669673 - DNA, 25 bp, Artificial sequence
  Synthetic oligonucleotide
actccggagggtatcctcagtgtca

SEQ ID NO: 669674 - DNA, 25 bp, Artificial sequence
  Synthetic oligonucleotide
ccttccactccggagggtatcctca

SEQ ID NO: 669675 - DNA, 25 bp, Artificial sequence
  Synthetic oligonucleotide
gtcgcaccttccactccggagggta

SEQ ID NO: 669676 - DNA, 25 bp, Artificial sequence
  Synthetic oligonucleotide
aatcgcgtcgcaccttccactccgg

SEQ ID NO: 669677 - DNA, 25 bp, Artificial sequence
  Synthetic oligonucleotide
ttgggcaatcgcgtcgcaccttcca

SEQ ID NO: 669678 - DNA, 25 bp, Artificial sequence
  Synthetic oligonucleotide
tctccgacaccggggtctatgtcaa

SEQ ID NO: 669679 - DNA, 25 bp, Artificial sequence
  Synthetic oligonucleotide
cgaccccgagcccgcgcgtaccgct

SEQ ID NO: 669680 - DNA, 25 bp, Artificial sequence
  Synthetic oligonucleotide
gcctgcccgatggtagcggttacaa

SEQ ID NO: 669681 - DNA, 25 bp, Artificial sequence
  Synthetic oligonucleotide
caacgcgtgcaattgggcaatcgcg

SEQ ID NO: 669682 - DNA, 25 bp, Artificial sequence
  Synthetic oligonucleotide
caaggacctggaagtgtctgtagca

SEQ ID NO: 669683 - DNA, 25 bp, Artificial sequence
  Synthetic oligonucleotide
gtacgacaaggacctggaagtgtct

SEQ ID NO: 669684 - DNA, 25 bp, Artificial sequence
  Synthetic oligonucleotide
ggacatgtacgacaaggacctggaa

SEQ ID NO: 669685 - DNA, 25 bp, Artificial sequence
  Synthetic oligonucleotide
tccggcggacatgtacgacaaggac

SEQ ID NO: 669686 - DNA, 25 bp, Artificial sequence
  Synthetic oligonucleotide
agcggctccggcggacatgtacgac

SEQ ID NO: 669687 - DNA, 25 bp, Artificial sequence
  Synthetic oligonucleotide
tcctcgaagcggctccggcggacat

SEQ ID NO: 669688 - DNA, 25 bp, Artificial sequence
  Synthetic oligonucleotide
aggtgatcctcgaagcggctccggc

SEQ ID NO: 669689 - DNA, 25 bp, Artificial sequence
  Synthetic oligonucleotide
gttacaaggtgatcctcgaagcggc

SEQ ID NO: 669690 - DNA, 25 bp, Artificial sequence
  Synthetic oligonucleotide
ctgcattgatcagcaagttcgtccc

SEQ ID NO: 669691 - DNA, 25 bp, Artificial sequence
  Synthetic oligonucleotide
ccgatggtagcggttacaaggtgat

SEQ ID NO: 669692 - DNA, 25 bp, Artificial sequence
  Synthetic oligonucleotide
agtgtctgtagcagccatgagccgc

SEQ ID NO: 669693 - DNA, 25 bp, Artificial sequence
  Synthetic oligonucleotide
cggtgcgcctgcccgatggtagcgg

SEQ ID NO: 669694 - DNA, 25 bp, Artificial sequence
  Synthetic oligonucleotide
tccatgcggtgcgcctgcccgatgg

SEQ ID NO: 669695 - DNA, 25 bp, Artificial sequence
  Synthetic oligonucleotide
gtgttcttccatgcggtgcgcctgc

SEQ ID NO: 669696 - DNA, 25 bp, Artificial sequence
  Synthetic oligonucleotide
cgtggagtgttcttccatgcggtgc

SEQ ID NO: 669697 - DNA, 25 bp, Artificial sequence
  Synthetic oligonucleotide
aggcgcgtggagtgttcttccatgc

SEQ ID NO: 669698 - DNA, 25 bp, Artificial sequence
  Synthetic oligonucleotide
cggcaaggcgcgtggagtgttcttc

SEQ ID NO: 669699 - DNA, 25 bp, Artificial sequence
  Synthetic oligonucleotide
ttcacgcggcaaggcgcgtggagtg

SEQ ID NO: 669700 - DNA, 25 bp, Artificial sequence
  Synthetic oligonucleotide
ttgctttcacgcggcaaggcgcgtg

SEQ ID NO: 669701 - DNA, 25 bp, Artificial sequence
  Synthetic oligonucleotide
cgcagttgctttcacgcggcaaggc

SEQ ID NO: 669702 - DNA, 25 bp, Artificial sequence
  Synthetic oligonucleotide
tcgtcccgcagttgctttcacgcgg

SEQ ID NO: 669703 - DNA, 25 bp, Artificial sequence
  Synthetic oligonucleotide
gtagcggttacaaggtgatcctcga

SEQ ID NO: 669704 - DNA, 25 bp, Artificial sequence
  Synthetic oligonucleotide
agggtatccgagaggtgccggcagc

SEQ ID NO: 669705 - DNA, 25 bp, Artificial sequence
  Synthetic oligonucleotide
atggcctcggccaggcgctcgccga

SEQ ID NO: 669706 - DNA, 25 bp, Artificial sequence
  Synthetic oligonucleotide
ctctcgatggcctcggccaggcgct

SEQ ID NO: 669707 - DNA, 25 bp, Artificial sequence
  Synthetic oligonucleotide
gtagcggctctcgatggcctcggcc

SEQ ID NO: 669708 - DNA, 25 bp, Artificial sequence
  Synthetic oligonucleotide
tacctggtagcggctctcgatggcc

SEQ ID NO: 669709 - DNA, 25 bp, Artificial sequence
  Synthetic oligonucleotide
gatctttacctggtagcggctctcg

SEQ ID NO: 669710 - DNA, 25 bp, Artificial sequence
  Synthetic oligonucleotide
ctcgatgatctttacctggtagcgg

SEQ ID NO: 669711 - DNA, 25 bp, Artificial sequence
  Synthetic oligonucleotide
gctgcgctcgatgatctttacctgg

SEQ ID NO: 669712 - DNA, 25 bp, Artificial sequence
  Synthetic oligonucleotide
cagcgggctgcgctcgatgatcttt

SEQ ID NO: 669713 - DNA, 25 bp, Artificial sequence
  Synthetic oligonucleotide
ggcagcgcagcgggctgcgctcgat

SEQ ID NO: 669714 - DNA, 25 bp, Artificial sequence
  Synthetic oligonucleotide
ttttcctccagcagcaggtcgcggt

SEQ ID NO: 669715 - DNA, 25 bp, Artificial sequence
  Synthetic oligonucleotide
tccgagaggtgccggcagcgcagcg

SEQ ID NO: 669716 - DNA, 25 bp, Artificial sequence
  Synthetic oligonucleotide
tcgccgacattgccgccgccggcga

SEQ ID NO: 669717 - DNA, 25 bp, Artificial sequence
  Synthetic oligonucleotide
ctgtccagggtatccgagaggtgcc

SEQ ID NO: 669718 - DNA, 25 bp, Artificial sequence
  Synthetic oligonucleotide
tggtgctgtccagggtatccgagag

SEQ ID NO: 669719 - DNA, 25 bp, Artificial sequence
  Synthetic oligonucleotide
gcacgatggtgctgtccagggtatc

SEQ ID NO: 669720 - DNA, 25 bp, Artificial sequence
  Synthetic oligonucleotide
cgttgagcacgatggtgctgtccag

SEQ ID NO: 669721 - DNA, 25 bp, Artificial sequence
  Synthetic oligonucleotide
cgctgccgttgagcacgatggtgct

SEQ ID NO: 669722 - DNA, 25 bp, Artificial sequence
  Synthetic oligonucleotide
tcggaagcgctgccgttgagcacga

SEQ ID NO: 669723 - DNA, 25 bp, Artificial sequence
  Synthetic oligonucleotide
tcgcggtcggaagcgctgccgttga

SEQ ID NO: 669724 - DNA, 25 bp, Artificial sequence
  Synthetic oligonucleotide
agcaggtcgcggtcggaagcgctgc

SEQ ID NO: 669725 - DNA, 25 bp, Artificial sequence
  Synthetic oligonucleotide
cgtcgccatgggctaccacttcgat

SEQ ID NO: 669726 - DNA, 25 bp, Artificial sequence
  Synthetic oligonucleotide
aggtgccggcagcgcagcgggctgc

SEQ ID NO: 669727 - DNA, 25 bp, Artificial sequence
  Synthetic oligonucleotide
tctcgcccattaccgcgcggatatg

SEQ ID NO: 669728 - DNA, 25 bp, Artificial sequence
  Synthetic oligonucleotide
accgtgtcgccctggggaatgatcg

SEQ ID NO: 669729 - DNA, 25 bp, Artificial sequence
  Synthetic oligonucleotide
tcgatcaccgtgtcgccctggggaa

SEQ ID NO: 669730 - DNA, 25 bp, Artificial sequence
  Synthetic oligonucleotide
tcggcctcgatcaccgtgtcgccct

SEQ ID NO: 669731 - DNA, 25 bp, Artificial sequence
  Synthetic oligonucleotide
tcgtcgtcggcctcgatcaccgtgt

SEQ ID NO: 669732 - DNA, 25 bp, Artificial sequence
  Synthetic oligonucleotide
aagacttcgtcgtcggcctcgatca

SEQ ID NO: 669733 - DNA, 25 bp, Artificial sequence
  Synthetic oligonucleotide
atgaagaagacttcgtcgtcggcct

SEQ ID NO: 669734 - DNA, 25 bp, Artificial sequence
  Synthetic oligonucleotide
gcggcgatgaagaagacttcgtcgt

SEQ ID NO: 669735 - DNA, 25 bp, Artificial sequence
  Synthetic oligonucleotide
gccttggcggcgatgaagaagactt

SEQ ID NO: 669736 - DNA, 25 bp, Artificial sequence
  Synthetic oligonucleotide
gatatgggccttggcggcgatgaag

SEQ ID NO: 669737 - DNA, 25 bp, Artificial sequence
  Synthetic oligonucleotide
tcggccaggcgctcgccgacattgc

SEQ ID NO: 669738 - DNA, 25 bp, Artificial sequence
  Synthetic oligonucleotide
cattaccgcgcggatatgggccttg

SEQ ID NO: 669739 - DNA, 25 bp, Artificial sequence
  Synthetic oligonucleotide
aggcgctcgccgacattgccgccgc

SEQ ID NO: 669740 - DNA, 25 bp, Artificial sequence
  Synthetic oligonucleotide
tgcgcatctcgcccattaccgcgcg

SEQ ID NO: 669741 - DNA, 25 bp, Artificial sequence
  Synthetic oligonucleotide
cgagcctgcgcatctcgcccattac

SEQ ID NO: 669742 - DNA, 25 bp, Artificial sequence
  Synthetic oligonucleotide
tgtcgtcgagcctgcgcatctcgcc

SEQ ID NO: 669743 - DNA, 25 bp, Artificial sequence
  Synthetic oligonucleotide
tgtagctgtcgtcgagcctgcgcat

SEQ ID NO: 669744 - DNA, 25 bp, Artificial sequence
  Synthetic oligonucleotide
tccgcttgtagctgtcgtcgagcct

SEQ ID NO: 669745 - DNA, 25 bp, Artificial sequence
  Synthetic oligonucleotide
tgatgatccgcttgtagctgtcgtc

SEQ ID NO: 669746 - DNA, 25 bp, Artificial sequence
  Synthetic oligonucleotide
cggcgatgatgatccgcttgtagct

SEQ ID NO: 669747 - DNA, 25 bp, Artificial sequence
  Synthetic oligonucleotide
cgccgccggcgatgatgatccgctt

SEQ ID NO: 669748 - DNA, 25 bp, Artificial sequence
  Synthetic oligonucleotide
acattgccgccgccggcgatgatga

SEQ ID NO: 669749 - DNA, 25 bp, Artificial sequence
  Synthetic oligonucleotide
cgatgttttcctccagcagcaggtc

SEQ ID NO: 669750 - DNA, 25 bp, Artificial sequence
  Synthetic oligonucleotide
cgcgcggatatgggccttggcggcg

SEQ ID NO: 669751 - DNA, 25 bp, Artificial sequence
  Synthetic oligonucleotide
tcgatgtcgccgcggcgaacgtggg

SEQ ID NO: 669752 - DNA, 25 bp, Artificial sequence
  Synthetic oligonucleotide
atgtcgatctcgccgccttgcacca

SEQ ID NO: 669753 - DNA, 25 bp, Artificial sequence
  Synthetic oligonucleotide
atggcgatgtcgatctcgccgcctt

SEQ ID NO: 669754 - DNA, 25 bp, Artificial sequence
  Synthetic oligonucleotide
gggctgatggcgatgtcgatctcgc

SEQ ID NO: 669755 - DNA, 25 bp, Artificial sequence
  Synthetic oligonucleotide
agttgcgggctgatggcgatgtcga

SEQ ID NO: 669756 - DNA, 25 bp, Artificial sequence
  Synthetic oligonucleotide
gtcgccagttgcgggctgatggcga

SEQ ID NO: 669757 - DNA, 25 bp, Artificial sequence
  Synthetic oligonucleotide
ccgatggtcgccagttgcgggctga

SEQ ID NO: 669758 - DNA, 25 bp, Artificial sequence
  Synthetic oligonucleotide
agggtgccgatggtcgccagttgcg

SEQ ID NO: 669759 - DNA, 25 bp, Artificial sequence
  Synthetic oligonucleotide
gccagcagggtgccgatggtcgcca

SEQ ID NO: 669760 - DNA, 25 bp, Artificial sequence
  Synthetic oligonucleotide
acgtgggccagcagggtgccgatgg

SEQ ID NO: 669761 - DNA, 25 bp, Artificial sequence
  Synthetic oligonucleotide
tccagcagcaggtcgcggtcggaag

SEQ ID NO: 669762 - DNA, 25 bp, Artificial sequence
  Synthetic oligonucleotide
tcgccgcggcgaacgtgggccagca

SEQ ID NO: 669763 - DNA, 25 bp, Artificial sequence
  Synthetic oligonucleotide
tgcaccaggtcgacataggccgggt

SEQ ID NO: 669764 - DNA, 25 bp, Artificial sequence
  Synthetic oligonucleotide
acgctctcgatgtcgccgcggcgaa

SEQ ID NO: 669765 - DNA, 25 bp, Artificial sequence
  Synthetic oligonucleotide
gagtgtacgctctcgatgtcgccgc

SEQ ID NO: 669766 - DNA, 25 bp, Artificial sequence
  Synthetic oligonucleotide
cgcagcgagtgtacgctctcgatgt

SEQ ID NO: 669767 - DNA, 25 bp, Artificial sequence
  Synthetic oligonucleotide
ccgcggcgcagcgagtgtacgctct

SEQ ID NO: 669768 - DNA, 25 bp, Artificial sequence
  Synthetic oligonucleotide
ggctgcgccgcggcgcagcgagtgt

SEQ ID NO: 669769 - DNA, 25 bp, Artificial sequence
  Synthetic oligonucleotide
cgcttcggctgcgccgcggcgcagc

SEQ ID NO: 669770 - DNA, 25 bp, Artificial sequence
  Synthetic oligonucleotide
ttcgatcgcttcggctgcgccgcgg

SEQ ID NO: 669771 - DNA, 25 bp, Artificial sequence
  Synthetic oligonucleotide
taccacttcgatcgcttcggctgcg

SEQ ID NO: 669772 - DNA, 25 bp, Artificial sequence
  Synthetic oligonucleotide
cgcccagccctgtccgcacttcgat

SEQ ID NO: 669773 - DNA, 25 bp, Artificial sequence
  Synthetic oligonucleotide
cggcgaacgtgggccagcagggtgc

SEQ ID NO: 669774 - DNA, 25 bp, Artificial sequence
  Synthetic oligonucleotide
gcttggccagcagcgaggacatgat

SEQ ID NO: 669775 - DNA, 25 bp, Artificial sequence
  Synthetic oligonucleotide
tctcgccgatgttttcctccagcag

SEQ ID NO: 669776 - DNA, 25 bp, Artificial sequence
  Synthetic oligonucleotide
cgtcggtctcgccgatgttttcctc

SEQ ID NO: 669777 - DNA, 25 bp, Artificial sequence
  Synthetic oligonucleotide
ggaacacgtcggtctcgccgatgtt

SEQ ID NO: 669778 - DNA, 25 bp, Artificial sequence
  Synthetic oligonucleotide
gggcgaggaacacgtcggtctcgcc

SEQ ID NO: 669779 - DNA, 25 bp, Artificial sequence
  Synthetic oligonucleotide
tggtcagggcgaggaacacgtcggt

SEQ ID NO: 669780 - DNA, 25 bp, Artificial sequence
  Synthetic oligonucleotide
cgtcgttggtcagggcgaggaacac

SEQ ID NO: 669781 - DNA, 25 bp, Artificial sequence
  Synthetic oligonucleotide
ctcgtcgtcgttggtcagggcgagg

SEQ ID NO: 669782 - DNA, 25 bp, Artificial sequence
  Synthetic oligonucleotide
gttggcctcgtcgtcgttggtcagg

SEQ ID NO: 669783 - DNA, 25 bp, Artificial sequence
  Synthetic oligonucleotide
catgatgttggcctcgtcgtcgttg

SEQ ID NO: 669784 - DNA, 25 bp, Artificial sequence
  Synthetic oligonucleotide
atctcgccgccttgcaccaggtcga

SEQ ID NO: 669785 - DNA, 25 bp, Artificial sequence
  Synthetic oligonucleotide
ccagcagcgaggacatgatgttggc

SEQ ID NO: 669786 - DNA, 25 bp, Artificial sequence
  Synthetic oligonucleotide
ccgccttgcaccaggtcgacatagg

SEQ ID NO: 669787 - DNA, 25 bp, Artificial sequence
  Synthetic oligonucleotide
cgagccgcttggccagcagcgagga

SEQ ID NO: 669788 - DNA, 25 bp, Artificial sequence
  Synthetic oligonucleotide
ctcgcgccgagccgcttggccagca

SEQ ID NO: 669789 - DNA, 25 bp, Artificial sequence
  Synthetic oligonucleotide
actttgctcgcgccgagccgcttgg

SEQ ID NO: 669790 - DNA, 25 bp, Artificial sequence
  Synthetic oligonucleotide
gtcatcactttgctcgcgccgagcc

SEQ ID NO: 669791 - DNA, 25 bp, Artificial sequence
  Synthetic oligonucleotide
atcagggtcatcactttgctcgcgc

SEQ ID NO: 669792 - DNA, 25 bp, Artificial sequence
  Synthetic oligonucleotide
ttgttgatcagggtcatcactttgc

SEQ ID NO: 669793 - DNA, 25 bp, Artificial sequence
  Synthetic oligonucleotide
gccgggttgttgatcagggtcatca

SEQ ID NO: 669794 - DNA, 25 bp, Artificial sequence
  Synthetic oligonucleotide
gacataggccgggttgttgatcagg

SEQ ID NO: 669795 - DNA, 25 bp, Artificial sequence
  Synthetic oligonucleotide
caggtcgacataggccgggttgttg

SEQ ID NO: 669796 - DNA, 25 bp, Artificial sequence
  Synthetic oligonucleotide
atgatcggccggttgcggcggtaga

SEQ ID NO: 669797 - DNA, 25 bp, Artificial sequence
  Synthetic oligonucleotide
gcgaggacatgatgttggcctcgtc

SEQ ID NO: 669798 - DNA, 25 bp, Artificial sequence
  Synthetic oligonucleotide
ttggtctcgtcgctattggtcaccg

SEQ ID NO: 669799 - DNA, 25 bp, Artificial sequence
  Synthetic oligonucleotide
ccgtggggaacgaggccttgccttg

SEQ ID NO: 669800 - DNA, 25 bp, Artificial sequence
  Synthetic oligonucleotide
cgcagcaccgtggggaacgaggcct

SEQ ID NO: 669801 - DNA, 25 bp, Artificial sequence
  Synthetic oligonucleotide
gcctggcgcagcaccgtggggaacg

SEQ ID NO: 669802 - DNA, 25 bp, Artificial sequence
  Synthetic oligonucleotide
gcgccggcctggcgcagcaccgtgg

SEQ ID NO: 669803 - DNA, 25 bp, Artificial sequence
  Synthetic oligonucleotide
tcgtcggcgccggcctggcgcagca

SEQ ID NO: 669804 - DNA, 25 bp, Artificial sequence
  Synthetic oligonucleotide
tcggcgtcgtcggcgccggcctggc

SEQ ID NO: 669805 - DNA, 25 bp, Artificial sequence
  Synthetic oligonucleotide
agcatgtcggcgtcgtcggcgccgg

SEQ ID NO: 669806 - DNA, 25 bp, Artificial sequence
  Synthetic oligonucleotide
gccaccagcatgtcggcgtcgtcgg

SEQ ID NO: 669807 - DNA, 25 bp, Artificial sequence
  Synthetic oligonucleotide
ggtcaccgccaccagcatgtcggcg

SEQ ID NO: 669808 - DNA, 25 bp, Artificial sequence
  Synthetic oligonucleotide
tcgccctggggaatgatcggccggt

SEQ ID NO: 669809 - DNA, 25 bp, Artificial sequence
  Synthetic oligonucleotide
ctcgtcgctattggtcaccgccacc

SEQ ID NO: 669810 - DNA, 25 bp, Artificial sequence
  Synthetic oligonucleotide
tgccttgcacggtgcggatgtcgag

SEQ ID NO: 669811 - DNA, 25 bp, Artificial sequence
  Synthetic oligonucleotide
accatgttggtctcgtcgctattgg

SEQ ID NO: 669812 - DNA, 25 bp, Artificial sequence
  Synthetic oligonucleotide
caggcgaccatgttggtctcgtcgc

SEQ ID NO: 669813 - DNA, 25 bp, Artificial sequence
  Synthetic oligonucleotide
cctggcaggcgaccatgttggtctc

SEQ ID NO: 669814 - DNA, 25 bp, Artificial sequence
  Synthetic oligonucleotide
aggcgacctggcaggcgaccatgtt

SEQ ID NO: 669815 - DNA, 25 bp, Artificial sequence
  Synthetic oligonucleotide
gggtgtaggcgacctggcaggcgac

SEQ ID NO: 669816 - DNA, 25 bp, Artificial sequence
  Synthetic oligonucleotide
tgaacagggtgtaggcgacctggca

SEQ ID NO: 669817 - DNA, 25 bp, Artificial sequence
  Synthetic oligonucleotide
gggtgttgaacagggtgtaggcgac

SEQ ID NO: 669818 - DNA, 25 bp, Artificial sequence
  Synthetic oligonucleotide
tggtcggggtgttgaacagggtgta

SEQ ID NO: 669819 - DNA, 25 bp, Artificial sequence
  Synthetic oligonucleotide
gatcttggtcggggtgttgaacagg

SEQ ID NO: 669820 - DNA, 25 bp, Artificial sequence
  Synthetic oligonucleotide
gctattggtcaccgccaccagcatg

SEQ ID NO: 669821 - DNA, 25 bp, Artificial sequence
  Synthetic oligonucleotide
tcgaccacggtgatgtcgttggctt

SEQ ID NO: 669822 - DNA, 25 bp, Artificial sequence
  Synthetic oligonucleotide
ggccggcaccgaggatgatgatttt

SEQ ID NO: 669823 - DNA, 25 bp, Artificial sequence
  Synthetic oligonucleotide
cgacctggccggcaccgaggatgat

SEQ ID NO: 669824 - DNA, 25 bp, Artificial sequence
  Synthetic oligonucleotide
tgccgccgacctggccggcaccgag

SEQ ID NO: 669825 - DNA, 25 bp, Artificial sequence
  Synthetic oligonucleotide
cagtgtgccgccgacctggccggca

SEQ ID NO: 669826 - DNA, 25 bp, Artificial sequence
  Synthetic oligonucleotide
ctcggccagtgtgccgccgacctgg

SEQ ID NO: 669827 - DNA, 25 bp, Artificial sequence
  Synthetic oligonucleotide
aggtgctcggccagtgtgccgccga

SEQ ID NO: 669828 - DNA, 25 bp, Artificial sequence
  Synthetic oligonucleotide
ctggccaggtgctcggccagtgtgc

SEQ ID NO: 669829 - DNA, 25 bp, Artificial sequence
  Synthetic oligonucleotide
gcttcgctggccaggtgctcggcca

SEQ ID NO: 669830 - DNA, 25 bp, Artificial sequence
  Synthetic oligonucleotide
cgttggcttcgctggccaggtgctc

SEQ ID NO: 669831 - DNA, 25 bp, Artificial sequence
  Synthetic oligonucleotide
ggaacgaggccttgccttgcacggt

SEQ ID NO: 669832 - DNA, 25 bp, Artificial sequence
  Synthetic oligonucleotide
cacggtgatgtcgttggcttcgctg

SEQ ID NO: 669833 - DNA, 25 bp, Artificial sequence
  Synthetic oligonucleotide
aggccttgccttgcacggtgcggat

SEQ ID NO: 669834 - DNA, 25 bp, Artificial sequence
  Synthetic oligonucleotide
tcggtgtcgaccacggtgatgtcgt

SEQ ID NO: 669835 - DNA, 25 bp, Artificial sequence
  Synthetic oligonucleotide
gtcgccgtcggtgtcgaccacggtg

SEQ ID NO: 669836 - DNA, 25 bp, Artificial sequence
  Synthetic oligonucleotide
caggcggtcgccgtcggtgtcgacc

SEQ ID NO: 669837 - DNA, 25 bp, Artificial sequence
  Synthetic oligonucleotide
gtcgcgcaggcggtcgccgtcggtg

SEQ ID NO: 669838 - DNA, 25 bp, Artificial sequence
  Synthetic oligonucleotide
gccgaggtcgcgcaggcggtcgccg

SEQ ID NO: 669839 - DNA, 25 bp, Artificial sequence
  Synthetic oligonucleotide
ggcggtcgccgaggtcgcgcaggcg

SEQ ID NO: 669840 - DNA, 25 bp, Artificial sequence
  Synthetic oligonucleotide
tgtcgaggcggtcgccgaggtcgcg

SEQ ID NO: 669841 - DNA, 25 bp, Artificial sequence
  Synthetic oligonucleotide
tgcggatgtcgaggcggtcgccgag

SEQ ID NO: 669842 - DNA, 25 bp, Artificial sequence
  Synthetic oligonucleotide
gcacggtgcggatgtcgaggcggtc

SEQ ID NO: 669843 - DNA, 25 bp, Artificial sequence
  Synthetic oligonucleotide
cggctcgcggacgcgggcgatcttg

SEQ ID NO: 669844 - DNA, 25 bp, Artificial sequence
  Synthetic oligonucleotide
gatgtcgttggcttcgctggccagg

SEQ ID NO: 669845 - DNA, 25 bp, Artificial sequence
  Synthetic oligonucleotide
ctcgcgcagctggcgcagctcctgc

SEQ ID NO: 669846 - DNA, 25 bp, Artificial sequence
  Synthetic oligonucleotide
gcgggcgatcttggtcggggtgttg

SEQ ID NO: 669847 - DNA, 25 bp, Artificial sequence
  Synthetic oligonucleotide
gaccaactgcgccttgccctcggcg

SEQ ID NO: 669848 - DNA, 25 bp, Artificial sequence
  Synthetic oligonucleotide
gatcccgaccaactgcgccttgccc

SEQ ID NO: 669849 - DNA, 25 bp, Artificial sequence
  Synthetic oligonucleotide
ggccttgatcccgaccaactgcgcc

SEQ ID NO: 669850 - DNA, 25 bp, Artificial sequence
  Synthetic oligonucleotide
gtagtaggccttgatcccgaccaac

SEQ ID NO: 669851 - DNA, 25 bp, Artificial sequence
  Synthetic oligonucleotide
gccgccgtagtaggccttgatcccg

SEQ ID NO: 669852 - DNA, 25 bp, Artificial sequence
  Synthetic oligonucleotide
cagagggccgccgtagtaggccttg

SEQ ID NO: 669853 - DNA, 25 bp, Artificial sequence
  Synthetic oligonucleotide
ccctaccagagggccgccgtagtag

SEQ ID NO: 669854 - DNA, 25 bp, Artificial sequence
  Synthetic oligonucleotide
ctcctgccctaccagagggccgccg

SEQ ID NO: 669855 - DNA, 25 bp, Artificial sequence
  Synthetic oligonucleotide
ttgccctcggcgaagtcgatgactt

SEQ ID NO: 669856 - DNA, 25 bp, Artificial sequence
  Synthetic oligonucleotide
cagctggcgcagctcctgccctacc

SEQ ID NO: 669857 - DNA, 25 bp, Artificial sequence
  Synthetic oligonucleotide
tcggcgaagtcgatgacttgcagcg

SEQ ID NO: 669858 - DNA, 25 bp, Artificial sequence
  Synthetic oligonucleotide
atgtgctcgcgcagctggcgcagct

SEQ ID NO: 669859 - DNA, 25 bp, Artificial sequence
  Synthetic oligonucleotide
ttcggcatgtgctcgcgcagctggc

SEQ ID NO: 669860 - DNA, 25 bp, Artificial sequence
  Synthetic oligonucleotide
ccacgttcggcatgtgctcgcgcag

SEQ ID NO: 669861 - DNA, 25 bp, Artificial sequence
  Synthetic oligonucleotide
gggtatccacgttcggcatgtgctc

SEQ ID NO: 669862 - DNA, 25 bp, Artificial sequence
  Synthetic oligonucleotide
cgacgcgggtatccacgttcggcat

SEQ ID NO: 669863 - DNA, 25 bp, Artificial sequence
  Synthetic oligonucleotide
tcgcggcgacgcgggtatccacgtt

SEQ ID NO: 669864 - DNA, 25 bp, Artificial sequence
  Synthetic oligonucleotide
cggtagatcgcggcgacgcgggtat

SEQ ID NO: 669865 - DNA, 25 bp, Artificial sequence
  Synthetic oligonucleotide
ttgcggcggtagatcgcggcgacgc

SEQ ID NO: 669866 - DNA, 25 bp, Artificial sequence
  Synthetic oligonucleotide
ggccggttgcggcggtagatcgcgg

SEQ ID NO: 669867 - DNA, 25 bp, Artificial sequence
  Synthetic oligonucleotide
gacttggcgtcgccatgggctacca

SEQ ID NO: 669868 - DNA, 25 bp, Artificial sequence
  Synthetic oligonucleotide
gcgcagctcctgccctaccagaggg

SEQ ID NO: 669869 - DNA, 25 bp, Artificial sequence
  Synthetic oligonucleotide
cctgctccgggctgatcagcacgtc

SEQ ID NO: 669870 - DNA, 25 bp, Artificial sequence
  Synthetic oligonucleotide
tggggaatgatcggccggttgcggc

SEQ ID NO: 669871 - DNA, 25 bp, Artificial sequence
  Synthetic oligonucleotide
gtaggccggctcgcggacgcgggcg

SEQ ID NO: 669872 - DNA, 25 bp, Artificial sequence
  Synthetic oligonucleotide
gtcaggtaggccggctcgcggacgc

SEQ ID NO: 669873 - DNA, 25 bp, Artificial sequence
  Synthetic oligonucleotide
gtacgggtcaggtaggccggctcgc

SEQ ID NO: 669874 - DNA, 25 bp, Artificial sequence
  Synthetic oligonucleotide
tgtcgaacagcccggtacgggtcag

SEQ ID NO: 669875 - DNA, 25 bp, Artificial sequence
  Synthetic oligonucleotide
cctcgttgtcgaacagcccggtacg

SEQ ID NO: 669876 - DNA, 25 bp, Artificial sequence
  Synthetic oligonucleotide
ggatcgcctcgttgtcgaacagccc

SEQ ID NO: 669877 - DNA, 25 bp, Artificial sequence
  Synthetic oligonucleotide
caccgggatcgcctcgttgtcgaac

SEQ ID NO: 669878 - DNA, 25 bp, Artificial sequence
  Synthetic oligonucleotide
cacgtccaccgggatcgcctcgttg

SEQ ID NO: 669879 - DNA, 25 bp, Artificial sequence
  Synthetic oligonucleotide
tgcgccttgccctcggcgaagtcga

SEQ ID NO: 669880 - DNA, 25 bp, Artificial sequence
  Synthetic oligonucleotide
ccgggctgatcagcacgtccaccgg

SEQ ID NO: 669881 - DNA, 25 bp, Artificial sequence
  Synthetic oligonucleotide
gcggacgcgggcgatcttggtcggg

SEQ ID NO: 669882 - DNA, 25 bp, Artificial sequence
  Synthetic oligonucleotide
tgaccacctgctccgggctgatcag

SEQ ID NO: 669883 - DNA, 25 bp, Artificial sequence
  Synthetic oligonucleotide
agttggtgaccacctgctccgggct

SEQ ID NO: 669884 - DNA, 25 bp, Artificial sequence
  Synthetic oligonucleotide
tgatgtagttggtgaccacctgctc

SEQ ID NO: 669885 - DNA, 25 bp, Artificial sequence
  Synthetic oligonucleotide
ggcgcttgatgtagttggtgaccac

SEQ ID NO: 669886 - DNA, 25 bp, Artificial sequence
  Synthetic oligonucleotide
cgatcaggcgcttgatgtagttggt

SEQ ID NO: 669887 - DNA, 25 bp, Artificial sequence
  Synthetic oligonucleotide
ggtgttcgatcaggcgcttgatgta

SEQ ID NO: 669888 - DNA, 25 bp, Artificial sequence
  Synthetic oligonucleotide
gcgccggggtgttcgatcaggcgct

SEQ ID NO: 669889 - DNA, 25 bp, Artificial sequence
  Synthetic oligonucleotide
tgcagcgcgccggggtgttcgatca

SEQ ID NO: 669890 - DNA, 25 bp, Artificial sequence
  Synthetic oligonucleotide
atgacttgcagcgcgccggggtgtt

SEQ ID NO: 669891 - DNA, 25 bp, Artificial sequence
  Synthetic oligonucleotide
aagtcgatgacttgcagcgcgccgg

SEQ ID NO: 669892 - DNA, 25 bp, Artificial sequence
  Synthetic oligonucleotide
tgatcagcacgtccaccgggatcgc

SEQ ID NO: 669893 - DNA, 25 bp, Artificial sequence
  Synthetic oligonucleotide
ttgtaaaagtgtcgtcggggcgtgc

SEQ ID NO: 669894 - DNA, 25 bp, Artificial sequence
  Synthetic oligonucleotide
gaactccggccggcgggtggcgaga

SEQ ID NO: 669895 - DNA, 25 bp, Artificial sequence
  Synthetic oligonucleotide
ccgtctgccggaactccggccggcg

SEQ ID NO: 669896 - DNA, 25 bp, Artificial sequence
  Synthetic oligonucleotide
agcacgcccgacccgtctgccggaa

SEQ ID NO: 669897 - DNA, 25 bp, Artificial sequence
  Synthetic oligonucleotide
tcgatgagcacgcccgacccgtctg

SEQ ID NO: 669898 - DNA, 25 bp, Artificial sequence
  Synthetic oligonucleotide
cagcgctcgatgagcacgcccgacc

SEQ ID NO: 669899 - DNA, 25 bp, Artificial sequence
  Synthetic oligonucleotide
ttctgccagcgctcgatgagcacgc

SEQ ID NO: 669900 - DNA, 25 bp, Artificial sequence
  Synthetic oligonucleotide
aaccgttctgccagcgctcgatgag

SEQ ID NO: 669901 - DNA, 25 bp, Artificial sequence
  Synthetic oligonucleotide
gctcgaaccgttctgccagcgctcg

SEQ ID NO: 669902 - DNA, 25 bp, Artificial sequence
  Synthetic oligonucleotide
gggcgtgctcgaaccgttctgccag

SEQ ID NO: 669903 - DNA, 25 bp, Artificial sequence
  Synthetic oligonucleotide
cgttcgggatgcaggctacatcgtt

SEQ ID NO: 669904 - DNA, 25 bp, Artificial sequence
  Synthetic oligonucleotide
aagtgtcgtcggggcgtgctcgaac

SEQ ID NO: 669905 - DNA, 25 bp, Artificial sequence
  Synthetic oligonucleotide
gcgagaacgcgctgcgcaagccttg

SEQ ID NO: 669906 - DNA, 25 bp, Artificial sequence
  Synthetic oligonucleotide
caggtctttgtaaaagtgtcgtcgg

SEQ ID NO: 669907 - DNA, 25 bp, Artificial sequence
  Synthetic oligonucleotide
tggaacaggtctttgtaaaagtgtc

SEQ ID NO: 669908 - DNA, 25 bp, Artificial sequence
  Synthetic oligonucleotide
atgtgtggaacaggtctttgtaaaa

SEQ ID NO: 669909 - DNA, 25 bp, Artificial sequence
  Synthetic oligonucleotide
ctacgaatgtgtggaacaggtcttt

SEQ ID NO: 669910 - DNA, 25 bp, Artificial sequence
  Synthetic oligonucleotide
agttgcctacgaatgtgtggaacag

SEQ ID NO: 669911 - DNA, 25 bp, Artificial sequence
  Synthetic oligonucleotide
gacagaagttgcctacgaatgtgtg

SEQ ID NO: 669912 - DNA, 25 bp, Artificial sequence
  Synthetic oligonucleotide
catcgttgacagaagttgcctacga

SEQ ID NO: 669913 - DNA, 25 bp, Artificial sequence
  Synthetic oligonucleotide
aggctacatcgttgacagaagttgc

SEQ ID NO: 669914 - DNA, 25 bp, Artificial sequence
  Synthetic oligonucleotide
catgggctaccacttcgatcgcttc

SEQ ID NO: 669915 - DNA, 25 bp, Artificial sequence
  Synthetic oligonucleotide
tcgtcggggcgtgctcgaaccgttc

SEQ ID NO: 669916 - DNA, 25 bp, Artificial sequence
  Synthetic oligonucleotide
gcaggaacaccgtcatttccttttc

SEQ ID NO: 669917 - DNA, 25 bp, Artificial sequence
  Synthetic oligonucleotide
ctgctcccaggcctgccgggcgccc

SEQ ID NO: 669918 - DNA, 25 bp, Artificial sequence
  Synthetic oligonucleotide
caggccctgctcccaggcctgccgg

SEQ ID NO: 669919 - DNA, 25 bp, Artificial sequence
  Synthetic oligonucleotide
agttgccaggccctgctcccaggcc

SEQ ID NO: 669920 - DNA, 25 bp, Artificial sequence
  Synthetic oligonucleotide
cgcggcagttgccaggccctgctcc

SEQ ID NO: 669921 - DNA, 25 bp, Artificial sequence
  Synthetic oligonucleotide
atgcgtcgcggcagttgccaggccc

SEQ ID NO: 669922 - DNA, 25 bp, Artificial sequence
  Synthetic oligonucleotide
gtcgccatgcgtcgcggcagttgcc

SEQ ID NO: 669923 - DNA, 25 bp, Artificial sequence
  Synthetic oligonucleotide
tgcttgtcgccatgcgtcgcggcag

SEQ ID NO: 669924 - DNA, 25 bp, Artificial sequence
  Synthetic oligonucleotide
tcggcctgcttgtcgccatgcgtcg

SEQ ID NO: 669925 - DNA, 25 bp, Artificial sequence
  Synthetic oligonucleotide
ccttttcggcctgcttgtcgccatg

SEQ ID NO: 669926 - DNA, 25 bp, Artificial sequence
  Synthetic oligonucleotide
cggccggcgggtggcgagaacgcgc

SEQ ID NO: 669927 - DNA, 25 bp, Artificial sequence
  Synthetic oligonucleotide
acaccgtcatttccttttcggcctg

SEQ ID NO: 669928 - DNA, 25 bp, Artificial sequence
  Synthetic oligonucleotide
gcgggtggcgagaacgcgctgcgca

SEQ ID NO: 669929 - DNA, 25 bp, Artificial sequence
  Synthetic oligonucleotide
gcttgcgcaggaacaccgtcatttc

SEQ ID NO: 669930 - DNA, 25 bp, Artificial sequence
  Synthetic oligonucleotide
tgtcgagcttgcgcaggaacaccgt

SEQ ID NO: 669931 - DNA, 25 bp, Artificial sequence
  Synthetic oligonucleotide
tcgccctgtcgagcttgcgcaggaa

SEQ ID NO: 669932 - DNA, 25 bp, Artificial sequence
  Synthetic oligonucleotide
aggttctcgccctgtcgagcttgcg

SEQ ID NO: 669933 - DNA, 25 bp, Artificial sequence
  Synthetic oligonucleotide
acgctcaggttctcgccctgtcgag

SEQ ID NO: 669934 - DNA, 25 bp, Artificial sequence
  Synthetic oligonucleotide
ggccggacgctcaggttctcgccct

SEQ ID NO: 669935 - DNA, 25 bp, Artificial sequence
  Synthetic oligonucleotide
agccttggccggacgctcaggttct

SEQ ID NO: 669936 - DNA, 25 bp, Artificial sequence
  Synthetic oligonucleotide
tgcgcaagccttggccggacgctca

SEQ ID NO: 669937 - DNA, 25 bp, Artificial sequence
  Synthetic oligonucleotide
acgcgctgcgcaagccttggccgga

SEQ ID NO: 669938 - DNA, 25 bp, Artificial sequence
  Synthetic oligonucleotide
tgttgggcgttcgggatgcaggcta

SEQ ID NO: 669939 - DNA, 25 bp, Artificial sequence
  Synthetic oligonucleotide
tcatttccttttcggcctgcttgtc

SEQ ID NO: 669940 - DNA, 25 bp, Artificial sequence
  Synthetic oligonucleotide
aggcgctcctgtacggattcgagca

SEQ ID NO: 669941 - DNA, 25 bp, Artificial sequence
  Synthetic oligonucleotide
ttgctcgtatgggtattcgacatag

SEQ ID NO: 669942 - DNA, 25 bp, Artificial sequence
  Synthetic oligonucleotide
aatcgcttgctcgtatgggtattcg

SEQ ID NO: 669943 - DNA, 25 bp, Artificial sequence
  Synthetic oligonucleotide
gtagagaatcgcttgctcgtatggg

SEQ ID NO: 669944 - DNA, 25 bp, Artificial sequence
  Synthetic oligonucleotide
gtgaacgtagagaatcgcttgctcg

SEQ ID NO: 669945 - DNA, 25 bp, Artificial sequence
  Synthetic oligonucleotide
gttccggtgaacgtagagaatcgct

SEQ ID NO: 669946 - DNA, 25 bp, Artificial sequence
  Synthetic oligonucleotide
ggaggcgttccggtgaacgtagaga

SEQ ID NO: 669947 - DNA, 25 bp, Artificial sequence
  Synthetic oligonucleotide
attggcggaggcgttccggtgaacg

SEQ ID NO: 669948 - DNA, 25 bp, Artificial sequence
  Synthetic oligonucleotide
atctcattggcggaggcgttccggt

SEQ ID NO: 669949 - DNA, 25 bp, Artificial sequence
  Synthetic oligonucleotide
tcgagcatctcattggcggaggcgt

SEQ ID NO: 669950 - DNA, 25 bp, Artificial sequence
  Synthetic oligonucleotide
ggatgcaggctacatcgttgacaga

SEQ ID NO: 669951 - DNA, 25 bp, Artificial sequence
  Synthetic oligonucleotide
tcctgtacggattcgagcatctcat

SEQ ID NO: 669952 - DNA, 25 bp, Artificial sequence
  Synthetic oligonucleotide
acataggacgggactgaacgctctt

SEQ ID NO: 669953 - DNA, 25 bp, Artificial sequence
  Synthetic oligonucleotide
gccctgaggcgctcctgtacggatt

SEQ ID NO: 669954 - DNA, 25 bp, Artificial sequence
  Synthetic oligonucleotide
aggagagccctgaggcgctcctgta

SEQ ID NO: 669955 - DNA, 25 bp, Artificial sequence
  Synthetic oligonucleotide
aggccgaggagagccctgaggcgct

SEQ ID NO: 669956 - DNA, 25 bp, Artificial sequence
  Synthetic oligonucleotide
ggaggaggccgaggagagccctgag

SEQ ID NO: 669957 - DNA, 25 bp, Artificial sequence
  Synthetic oligonucleotide
aggcatggaggaggccgaggagagc

SEQ ID NO: 669958 - DNA, 25 bp, Artificial sequence
  Synthetic oligonucleotide
ttccaaggcatggaggaggccgagg

SEQ ID NO: 669959 - DNA, 25 bp, Artificial sequence
  Synthetic oligonucleotide
gatcctttccaaggcatggaggagg

SEQ ID NO: 669960 - DNA, 25 bp, Artificial sequence
  Synthetic oligonucleotide
acttcgatcctttccaaggcatgga

SEQ ID NO: 669961 - DNA, 25 bp, Artificial sequence
  Synthetic oligonucleotide
tcacccgttatttggcgagctgatg

SEQ ID NO: 669962 - DNA, 25 bp, Artificial sequence
  Synthetic oligonucleotide
acggattcgagcatctcattggcgg

SEQ ID NO: 669963 - DNA, 25 bp, Artificial sequence
  Synthetic oligonucleotide
tcaggtgtcgcgttcgggctttgac

SEQ ID NO: 669964 - DNA, 25 bp, Artificial sequence
  Synthetic oligonucleotide
atggggtgttgggcgttcgggatgc

SEQ ID NO: 669965 - DNA, 25 bp, Artificial sequence
  Synthetic oligonucleotide
cgctcaatggggtgttgggcgttcg

SEQ ID NO: 669966 - DNA, 25 bp, Artificial sequence
  Synthetic oligonucleotide
agtggtcgctcaatggggtgttggg

SEQ ID NO: 669967 - DNA, 25 bp, Artificial sequence
  Synthetic oligonucleotide
gccggcagtggtcgctcaatggggt

SEQ ID NO: 669968 - DNA, 25 bp, Artificial sequence
  Synthetic oligonucleotide
tagagggccggcagtggtcgctcaa

SEQ ID NO: 669969 - DNA, 25 bp, Artificial sequence
  Synthetic oligonucleotide
cgaagctagagggccggcagtggtc

SEQ ID NO: 669970 - DNA, 25 bp, Artificial sequence
  Synthetic oligonucleotide
atgagtcgaagctagagggccggca

SEQ ID NO: 669971 - DNA, 25 bp, Artificial sequence
  Synthetic oligonucleotide
gaagcgatgagtcgaagctagaggg

SEQ ID NO: 669972 - DNA, 25 bp, Artificial sequence
  Synthetic oligonucleotide
ttgaccgaagcgatgagtcgaagct

SEQ ID NO: 669973 - DNA, 25 bp, Artificial sequence
  Synthetic oligonucleotide
tatgggtattcgacataggacggga

SEQ ID NO: 669974 - DNA, 25 bp, Artificial sequence
  Synthetic oligonucleotide
tcgcgttcgggctttgaccgaagcg

SEQ ID NO: 669975 - DNA, 25 bp, Artificial sequence
  Synthetic oligonucleotide
tattcgacataggacgggactgaac

SEQ ID NO: 669976 - DNA, 25 bp, Artificial sequence
  Synthetic oligonucleotide
ttgaagtcaggtgtcgcgttcgggc

SEQ ID NO: 669977 - DNA, 25 bp, Artificial sequence
  Synthetic oligonucleotide
aagtagttgaagtcaggtgtcgcgt

SEQ ID NO: 669978 - DNA, 25 bp, Artificial sequence
  Synthetic oligonucleotide
cggaaaagtagttgaagtcaggtgt

SEQ ID NO: 669979 - DNA, 25 bp, Artificial sequence
  Synthetic oligonucleotide
tggctccggaaaagtagttgaagtc

SEQ ID NO: 669980 - DNA, 25 bp, Artificial sequence
  Synthetic oligonucleotide
gacatgttggctccggaaaagtagt

SEQ ID NO: 669981 - DNA, 25 bp, Artificial sequence
  Synthetic oligonucleotide
tgcttcgacatgttggctccggaaa

SEQ ID NO: 669982 - DNA, 25 bp, Artificial sequence
  Synthetic oligonucleotide
cgctcttgcttcgacatgttggctc

SEQ ID NO: 669983 - DNA, 25 bp, Artificial sequence
  Synthetic oligonucleotide
actgaacgctcttgcttcgacatgt

SEQ ID NO: 669984 - DNA, 25 bp, Artificial sequence
  Synthetic oligonucleotide
gacgggactgaacgctcttgcttcg

SEQ ID NO: 669985 - DNA, 25 bp, Artificial sequence
  Synthetic oligonucleotide
gcgcccgcgagatcgccggcagcct

SEQ ID NO: 669986 - DNA, 25 bp, Artificial sequence
  Synthetic oligonucleotide
cgggctttgaccgaagcgatgagtc

SEQ ID NO: 669987 - DNA, 25 bp, Artificial sequence
  Synthetic oligonucleotide
agggcgtgcctcagaagaacgtcag

SEQ ID NO: 669988 - DNA, 25 bp, Artificial sequence
  Synthetic oligonucleotide
ttgtcgaccaggaacagcagcacgt

SEQ ID NO: 669989 - DNA, 25 bp, Artificial sequence
  Synthetic oligonucleotide
tatttcttgtcgaccaggaacagca

SEQ ID NO: 669990 - DNA, 25 bp, Artificial sequence
  Synthetic oligonucleotide
cggatgtatttcttgtcgaccagga

SEQ ID NO: 669991 - DNA, 25 bp, Artificial sequence
  Synthetic oligonucleotide
acgtctcggatgtatttcttgtcga

SEQ ID NO: 669992 - DNA, 25 bp, Artificial sequence
  Synthetic oligonucleotide
cgctcgacgtctcggatgtatttct

SEQ ID NO: 669993 - DNA, 25 bp, Artificial sequence
  Synthetic oligonucleotide
aacagtcgctcgacgtctcggatgt

SEQ ID NO: 669994 - DNA, 25 bp, Artificial sequence
  Synthetic oligonucleotide
gcctggaacagtcgctcgacgtctc

SEQ ID NO: 669995 - DNA, 25 bp, Artificial sequence
  Synthetic oligonucleotide
aggccggcctggaacagtcgctcga

SEQ ID NO: 669996 - DNA, 25 bp, Artificial sequence
  Synthetic oligonucleotide
aacgtcaggccggcctggaacagtc

SEQ ID NO: 669997 - DNA, 25 bp, Artificial sequence
  Synthetic oligonucleotide
ccaggcctgccgggcgcccgcgaga

SEQ ID NO: 669998 - DNA, 25 bp, Artificial sequence
  Synthetic oligonucleotide
tgcctcagaagaacgtcaggccggc

SEQ ID NO: 669999 - DNA, 25 bp, Artificial sequence
  Synthetic oligonucleotide
agcacgtggtcgccgctctcgatgc

SEQ ID NO: 670000 - DNA, 25 bp, Artificial sequence
  Synthetic oligonucleotide
gcgatagggcgtgcctcagaagaac

SEQ ID NO: 670001 - DNA, 25 bp, Artificial sequence
  Synthetic oligonucleotide
ccgttcgcgatagggcgtgcctcag

SEQ ID NO: 670002 - DNA, 25 bp, Artificial sequence
  Synthetic oligonucleotide
ctatcgccgttcgcgatagggcgtg

SEQ ID NO: 670003 - DNA, 25 bp, Artificial sequence
  Synthetic oligonucleotide
gaagccctatcgccgttcgcgatag

SEQ ID NO: 670004 - DNA, 25 bp, Artificial sequence
  Synthetic oligonucleotide
taggccgaagccctatcgccgttcg

SEQ ID NO: 670005 - DNA, 25 bp, Artificial sequence
  Synthetic oligonucleotide
gttcgtaggccgaagccctatcgcc

SEQ ID NO: 670006 - DNA, 25 bp, Artificial sequence
  Synthetic oligonucleotide
cttggtgttcgtaggccgaagccct

SEQ ID NO: 670007 - DNA, 25 bp, Artificial sequence
  Synthetic oligonucleotide
ggcacgcggccccttggtgttcgta

SEQ ID NO: 670008 - DNA, 25 bp, Artificial sequence
  Synthetic oligonucleotide
cgaaggaggcacgcggccccttggt

SEQ ID NO: 670009 - DNA, 25 bp, Artificial sequence
  Synthetic oligonucleotide
agaagaacgtcaggccggcctggaa

SEQ ID NO: 670010 - DNA, 25 bp, Artificial sequence
  Synthetic oligonucleotide
cgcaccagcgcgccgatggtggtgc

SEQ ID NO: 670011 - DNA, 25 bp, Artificial sequence
  Synthetic oligonucleotide
ttgctcgacttggcgtcgccatggg

SEQ ID NO: 670012 - DNA, 25 bp, Artificial sequence
  Synthetic oligonucleotide
tcaccttgctcgacttggcgtcgcc

SEQ ID NO: 670013 - DNA, 25 bp, Artificial sequence
  Synthetic oligonucleotide
gaccgatcaccttgctcgacttggc

SEQ ID NO: 670014 - DNA, 25 bp, Artificial sequence
  Synthetic oligonucleotide
tcgagcgaccgatcaccttgctcga

SEQ ID NO: 670015 - DNA, 25 bp, Artificial sequence
  Synthetic oligonucleotide
cgttgatcgagcgaccgatcacctt

SEQ ID NO: 670016 - DNA, 25 bp, Artificial sequence
  Synthetic oligonucleotide
tgatctcgttgatcgagcgaccgat

SEQ ID NO: 670017 - DNA, 25 bp, Artificial sequence
  Synthetic oligonucleotide
gcagcttgatctcgttgatcgagcg

SEQ ID NO: 670018 - DNA, 25 bp, Artificial sequence
  Synthetic oligonucleotide
ccggcggcagcttgatctcgttgat

SEQ ID NO: 670019 - DNA, 25 bp, Artificial sequence
  Synthetic oligonucleotide
tggtgcccggcggcagcttgatctc

SEQ ID NO: 670020 - DNA, 25 bp, Artificial sequence
  Synthetic oligonucleotide
accaggaacagcagcacgtggtcgc

SEQ ID NO: 670021 - DNA, 25 bp, Artificial sequence
  Synthetic oligonucleotide
agcgcgccgatggtggtgcccggcg

SEQ ID NO: 670022 - DNA, 25 bp, Artificial sequence
  Synthetic oligonucleotide
aacagcagcacgtggtcgccgctct

SEQ ID NO: 670023 - DNA, 25 bp, Artificial sequence
  Synthetic oligonucleotide
tcgtcgcgcaccagcgcgccgatgg

SEQ ID NO: 670024 - DNA, 25 bp, Artificial sequence
  Synthetic oligonucleotide
acttcctcgtcgcgcaccagcgcgc

SEQ ID NO: 670025 - DNA, 25 bp, Artificial sequence
  Synthetic oligonucleotide
atcagcacttcctcgtcgcgcacca

SEQ ID NO: 670026 - DNA, 25 bp, Artificial sequence
  Synthetic oligonucleotide
tgggcgatcagcacttcctcgtcgc

SEQ ID NO: 670027 - DNA, 25 bp, Artificial sequence
  Synthetic oligonucleotide
tcgccatgggcgatcagcacttcct

SEQ ID NO: 670028 - DNA, 25 bp, Artificial sequence
  Synthetic oligonucleotide
gggtgtcgccatgggcgatcagcac

SEQ ID NO: 670029 - DNA, 25 bp, Artificial sequence
  Synthetic oligonucleotide
cgatgcgggtgtcgccatgggcgat

SEQ ID NO: 670030 - DNA, 25 bp, Artificial sequence
  Synthetic oligonucleotide
cgctctcgatgcgggtgtcgccatg

SEQ ID NO: 670031 - DNA, 25 bp, Artificial sequence
  Synthetic oligonucleotide
tggtcgccgctctcgatgcgggtgt

SEQ ID NO: 670032 - DNA, 25 bp, Artificial sequence
  Synthetic oligonucleotide
gagggattcggccgttgcgaaggag

SEQ ID NO: 670033 - DNA, 25 bp, Artificial sequence
  Synthetic oligonucleotide
ccgatggtggtgcccggcggcagct

SEQ ID NO: 670034 - DNA, 25 bp, Artificial sequence
  Synthetic oligonucleotide
aatacttcgggtcctgctctacgca

SEQ ID NO: 670035 - DNA, 25 bp, Artificial sequence
  Synthetic oligonucleotide
ccgttgcgaaggaggcacgcggccc

SEQ ID NO: 670036 - DNA, 25 bp, Artificial sequence
  Synthetic oligonucleotide
cgcgtccaggtagcccttgcccagg

SEQ ID NO: 670037 - DNA, 25 bp, Artificial sequence
  Synthetic oligonucleotide
gtcgcccgcgtccaggtagcccttg

SEQ ID NO: 670038 - DNA, 25 bp, Artificial sequence
  Synthetic oligonucleotide
ttcggcgtcgcccgcgtccaggtag

SEQ ID NO: 670039 - DNA, 25 bp, Artificial sequence
  Synthetic oligonucleotide
cgcgcgttcggcgtcgcccgcgtcc

SEQ ID NO: 670040 - DNA, 25 bp, Artificial sequence
  Synthetic oligonucleotide
ttccgccgcgcgttcggcgtcgccc

SEQ ID NO: 670041 - DNA, 25 bp, Artificial sequence
  Synthetic oligonucleotide
ggaggtgttccgccgcgcgttcggc

SEQ ID NO: 670042 - DNA, 25 bp, Artificial sequence
  Synthetic oligonucleotide
agcgctggaggtgttccgccgcgcg

SEQ ID NO: 670043 - DNA, 25 bp, Artificial sequence
  Synthetic oligonucleotide
ctacgcagcgctggaggtgttccgc

SEQ ID NO: 670044 - DNA, 25 bp, Artificial sequence
  Synthetic oligonucleotide
agcccttgcccaggccgaagcgcag

SEQ ID NO: 670045 - DNA, 25 bp, Artificial sequence
  Synthetic oligonucleotide
tcgggtcctgctctacgcagcgctg

SEQ ID NO: 670046 - DNA, 25 bp, Artificial sequence
  Synthetic oligonucleotide
ttgcccaggccgaagcgcagcagcg

SEQ ID NO: 670047 - DNA, 25 bp, Artificial sequence
  Synthetic oligonucleotide
cggcggaatacttcgggtcctgctc

SEQ ID NO: 670048 - DNA, 25 bp, Artificial sequence
  Synthetic oligonucleotide
tccagccggcggaatacttcgggtc

SEQ ID NO: 670049 - DNA, 25 bp, Artificial sequence
  Synthetic oligonucleotide
gcagcttccagccggcggaatactt

SEQ ID NO: 670050 - DNA, 25 bp, Artificial sequence
  Synthetic oligonucleotide
gcccagcagcttccagccggcggaa

SEQ ID NO: 670051 - DNA, 25 bp, Artificial sequence
  Synthetic oligonucleotide
cgccttgcccagcagcttccagccg

SEQ ID NO: 670052 - DNA, 25 bp, Artificial sequence
  Synthetic oligonucleotide
ctggcgcgccttgcccagcagcttc

SEQ ID NO: 670053 - DNA, 25 bp, Artificial sequence
  Synthetic oligonucleotide
gcagcctggcgcgccttgcccagca

SEQ ID NO: 670054 - DNA, 25 bp, Artificial sequence
  Synthetic oligonucleotide
tcgccggcagcctggcgcgccttgc

SEQ ID NO: 670055 - DNA, 25 bp, Artificial sequence
  Synthetic oligonucleotide
gcgagatcgccggcagcctggcgcg

SEQ ID NO: 670056 - DNA, 25 bp, Artificial sequence
  Synthetic oligonucleotide
gccctgtccgcacttcgatcctttc

SEQ ID NO: 670057 - DNA, 25 bp, Artificial sequence
  Synthetic oligonucleotide
cctgctctacgcagcgctggaggtg

SEQ ID NO: 670058 - DNA, 25 bp, Artificial sequence
  Synthetic oligonucleotide
catcatcctgccctcttccaacgat

SEQ ID NO: 670059 - DNA, 25 bp, Artificial sequence
  Synthetic oligonucleotide
ctgccgggcgcccgcgagatcgccg

SEQ ID NO: 670060 - DNA, 25 bp, Artificial sequence
  Synthetic oligonucleotide
ggaacagagggattcggccgttgcg

SEQ ID NO: 670061 - DNA, 25 bp, Artificial sequence
  Synthetic oligonucleotide
ttgcacggaacagagggattcggcc

SEQ ID NO: 670062 - DNA, 25 bp, Artificial sequence
  Synthetic oligonucleotide
caggctttgcacggaacagagggat

SEQ ID NO: 670063 - DNA, 25 bp, Artificial sequence
  Synthetic oligonucleotide
tccggccaggctttgcacggaacag

SEQ ID NO: 670064 - DNA, 25 bp, Artificial sequence
  Synthetic oligonucleotide
cccggctccggccaggctttgcacg

SEQ ID NO: 670065 - DNA, 25 bp, Artificial sequence
  Synthetic oligonucleotide
cattgtgcccggctccggccaggct

SEQ ID NO: 670066 - DNA, 25 bp, Artificial sequence
  Synthetic oligonucleotide
tgtcggccattgtgcccggctccgg

SEQ ID NO: 670067 - DNA, 25 bp, Artificial sequence
  Synthetic oligonucleotide
aacgatgtcggccattgtgcccggc

SEQ ID NO: 670068 - DNA, 25 bp, Artificial sequence
  Synthetic oligonucleotide
caggtagcccttgcccaggccgaag

SEQ ID NO: 670069 - DNA, 25 bp, Artificial sequence
  Synthetic oligonucleotide
cctgccctcttccaacgatgtcggc

SEQ ID NO: 670070 - DNA, 25 bp, Artificial sequence
  Synthetic oligonucleotide
ttcggccgttgcgaaggaggcacgc

SEQ ID NO: 670071 - DNA, 25 bp, Artificial sequence
  Synthetic oligonucleotide
cttcgatcatcatcctgccctcttc

SEQ ID NO: 670072 - DNA, 25 bp, Artificial sequence
  Synthetic oligonucleotide
ccagaccttcgatcatcatcctgcc

SEQ ID NO: 670073 - DNA, 25 bp, Artificial sequence
  Synthetic oligonucleotide
tcttttccagaccttcgatcatcat

SEQ ID NO: 670074 - DNA, 25 bp, Artificial sequence
  Synthetic oligonucleotide
gccagcatcttttccagaccttcga

SEQ ID NO: 670075 - DNA, 25 bp, Artificial sequence
  Synthetic oligonucleotide
cctttggccagcatcttttccagac

SEQ ID NO: 670076 - DNA, 25 bp, Artificial sequence
  Synthetic oligonucleotide
tccacgcctttggccagcatctttt

SEQ ID NO: 670077 - DNA, 25 bp, Artificial sequence
  Synthetic oligonucleotide
gcattgtccacgcctttggccagca

SEQ ID NO: 670078 - DNA, 25 bp, Artificial sequence
  Synthetic oligonucleotide
agcagcgcattgtccacgcctttgg

SEQ ID NO: 670079 - DNA, 25 bp, Artificial sequence
  Synthetic oligonucleotide
gaagcgcagcagcgcattgtccacg

SEQ ID NO: 670080 - DNA, 25 bp, Artificial sequence
  Synthetic oligonucleotide
aggccgaagcgcagcagcgcattgt

SEQ ID NO: 670081 - DNA, 25 bp, Artificial sequence
  Synthetic oligonucleotide
ctcttccaacgatgtcggccattgt

SEQ ID NO: 670082 - DNA, 25 bp, Artificial sequence
  Synthetic oligonucleotide
agctgcttctcgatgaggatgcgca

SEQ ID NO: 670083 - DNA, 25 bp, Artificial sequence
  Synthetic oligonucleotide
tgccggtgggaagcatgccgatgcc

SEQ ID NO: 670084 - DNA, 25 bp, Artificial sequence
  Synthetic oligonucleotide
ccttgctgccggtgggaagcatgcc

SEQ ID NO: 670085 - DNA, 25 bp, Artificial sequence
  Synthetic oligonucleotide
aggggtccttgctgccggtgggaag

SEQ ID NO: 670086 - DNA, 25 bp, Artificial sequence
  Synthetic oligonucleotide
gcgcgtaggggtccttgctgccggt

SEQ ID NO: 670087 - DNA, 25 bp, Artificial sequence
  Synthetic oligonucleotide
ggcgcagcgcgtaggggtccttgct

SEQ ID NO: 670088 - DNA, 25 bp, Artificial sequence
  Synthetic oligonucleotide
cagcgcggcgcagcgcgtaggggtc

SEQ ID NO: 670089 - DNA, 25 bp, Artificial sequence
  Synthetic oligonucleotide
ccagcgcagcgcggcgcagcgcgta

SEQ ID NO: 670090 - DNA, 25 bp, Artificial sequence
  Synthetic oligonucleotide
agcacgcccagcgcagcgcggcgca

SEQ ID NO: 670091 - DNA, 25 bp, Artificial sequence
  Synthetic oligonucleotide
atgcgcagcacgcccagcgcagcgc

SEQ ID NO: 670092 - DNA, 25 bp, Artificial sequence
  Synthetic oligonucleotide
ttgaccttgtcgccgtattgctcga

SEQ ID NO: 670093 - DNA, 25 bp, Artificial sequence
  Synthetic oligonucleotide
ttctcgatgaggatgcgcagcacgc

SEQ ID NO: 670094 - DNA, 25 bp, Artificial sequence
  Synthetic oligonucleotide
atgccgaagataccgaccagggtat

SEQ ID NO: 670095 - DNA, 25 bp, Artificial sequence
  Synthetic oligonucleotide
aggtcgagctgcttctcgatgagga

SEQ ID NO: 670096 - DNA, 25 bp, Artificial sequence
  Synthetic oligonucleotide
aggtccaggtcgagctgcttctcga

SEQ ID NO: 670097 - DNA, 25 bp, Artificial sequence
  Synthetic oligonucleotide
gctaccaggtccaggtcgagctgct

SEQ ID NO: 670098 - DNA, 25 bp, Artificial sequence
  Synthetic oligonucleotide
accgcggctaccaggtccaggtcga

SEQ ID NO: 670099 - DNA, 25 bp, Artificial sequence
  Synthetic oligonucleotide
cgttgaccgcggctaccaggtccag

SEQ ID NO: 670100 - DNA, 25 bp, Artificial sequence
  Synthetic oligonucleotide
acggcggcgttgaccgcggctacca

SEQ ID NO: 670101 - DNA, 25 bp, Artificial sequence
  Synthetic oligonucleotide
tgctcgacggcggcgttgaccgcgg

SEQ ID NO: 670102 - DNA, 25 bp, Artificial sequence
  Synthetic oligonucleotide
ccgtattgctcgacggcggcgttga

SEQ ID NO: 670103 - DNA, 25 bp, Artificial sequence
  Synthetic oligonucleotide
gcttccaccagcaggctggcatcca

SEQ ID NO: 670104 - DNA, 25 bp, Artificial sequence
  Synthetic oligonucleotide
atgaggatgcgcagcacgcccagcg

SEQ ID NO: 670105 - DNA, 25 bp, Artificial sequence
  Synthetic oligonucleotide
agggtcgagggtagctcggcgccgg

SEQ ID NO: 670106 - DNA, 25 bp, Artificial sequence
  Synthetic oligonucleotide
acgtcttccgcttcgccgccgtggg

SEQ ID NO: 670107 - DNA, 25 bp, Artificial sequence
  Synthetic oligonucleotide
agggcgacgtcttccgcttcgccgc

SEQ ID NO: 670108 - DNA, 25 bp, Artificial sequence
  Synthetic oligonucleotide
agggccagggcgacgtcttccgctt

SEQ ID NO: 670109 - DNA, 25 bp, Artificial sequence
  Synthetic oligonucleotide
cgttgagggccagggcgacgtcttc

SEQ ID NO: 670110 - DNA, 25 bp, Artificial sequence
  Synthetic oligonucleotide
actgctcgttgagggccagggcgac

SEQ ID NO: 670111 - DNA, 25 bp, Artificial sequence
  Synthetic oligonucleotide
catgtactgctcgttgagggccagg

SEQ ID NO: 670112 - DNA, 25 bp, Artificial sequence
  Synthetic oligonucleotide
cgcggcatgtactgctcgttgaggg

SEQ ID NO: 670113 - DNA, 25 bp, Artificial sequence
  Synthetic oligonucleotide
gcgccgcgcggcatgtactgctcgt

SEQ ID NO: 670114 - DNA, 25 bp, Artificial sequence
  Synthetic oligonucleotide
gcgccggcgccgcgcggcatgtact

SEQ ID NO: 670115 - DNA, 25 bp, Artificial sequence
  Synthetic oligonucleotide
gggaagcatgccgatgccgaagata

SEQ ID NO: 670116 - DNA, 25 bp, Artificial sequence
  Synthetic oligonucleotide
gagggtagctcggcgccggcgccgc

SEQ ID NO: 670117 - DNA, 25 bp, Artificial sequence
  Synthetic oligonucleotide
atgccgatgccgaagataccgacca

SEQ ID NO: 670118 - DNA, 25 bp, Artificial sequence
  Synthetic oligonucleotide
ccggtcagggtcgagggtagctcgg

SEQ ID NO: 670119 - DNA, 25 bp, Artificial sequence
  Synthetic oligonucleotide
gcggcgccggtcagggtcgagggta

SEQ ID NO: 670120 - DNA, 25 bp, Artificial sequence
  Synthetic oligonucleotide
gccacggcggcgccggtcagggtcg

SEQ ID NO: 670121 - DNA, 25 bp, Artificial sequence
  Synthetic oligonucleotide
gccaccgccacggcggcgccggtca

SEQ ID NO: 670122 - DNA, 25 bp, Artificial sequence
  Synthetic oligonucleotide
ttgtcggccaccgccacggcggcgc

SEQ ID NO: 670123 - DNA, 25 bp, Artificial sequence
  Synthetic oligonucleotide
tcgagcttgtcggccaccgccacgg

SEQ ID NO: 670124 - DNA, 25 bp, Artificial sequence
  Synthetic oligonucleotide
agggtatcgagcttgtcggccaccg

SEQ ID NO: 670125 - DNA, 25 bp, Artificial sequence
  Synthetic oligonucleotide
ccgaccagggtatcgagcttgtcgg

SEQ ID NO: 670126 - DNA, 25 bp, Artificial sequence
  Synthetic oligonucleotide
aagataccgaccagggtatcgagct

SEQ ID NO: 670127 - DNA, 25 bp, Artificial sequence
  Synthetic oligonucleotide
gcggccttgaccttgtcgccgtatt

SEQ ID NO: 670128 - DNA, 25 bp, Artificial sequence
  Synthetic oligonucleotide
agctcggcgccggcgccgcgcggca

SEQ ID NO: 670129 - DNA, 25 bp, Artificial sequence
  Synthetic oligonucleotide
gaatattcgacacccgtttgttcgc

SEQ ID NO: 670130 - DNA, 25 bp, Artificial sequence
  Synthetic oligonucleotide
gacggcctgtacgcgctggtcgaag

SEQ ID NO: 670131 - DNA, 25 bp, Artificial sequence
  Synthetic oligonucleotide
ggcctggacggcctgtacgcgctgg

SEQ ID NO: 670132 - DNA, 25 bp, Artificial sequence
  Synthetic oligonucleotide
gcggaaggcctggacggcctgtacg

SEQ ID NO: 670133 - DNA, 25 bp, Artificial sequence
  Synthetic oligonucleotide
caactggcggaaggcctggacggcc

SEQ ID NO: 670134 - DNA, 25 bp, Artificial sequence
  Synthetic oligonucleotide
ttcaggcaactggcggaaggcctgg

SEQ ID NO: 670135 - DNA, 25 bp, Artificial sequence
  Synthetic oligonucleotide
tcggcttcaggcaactggcggaagg

SEQ ID NO: 670136 - DNA, 25 bp, Artificial sequence
  Synthetic oligonucleotide
agggcctcggcttcaggcaactggc

SEQ ID NO: 670137 - DNA, 25 bp, Artificial sequence
  Synthetic oligonucleotide
gcggccagggcctcggcttcaggca

SEQ ID NO: 670138 - DNA, 25 bp, Artificial sequence
  Synthetic oligonucleotide
ttcgccgcggccagggcctcggctt

SEQ ID NO: 670139 - DNA, 25 bp, Artificial sequence
  Synthetic oligonucleotide
ttgtcgccgtattgctcgacggcgg

SEQ ID NO: 670140 - DNA, 25 bp, Artificial sequence
  Synthetic oligonucleotide
tcgacacccgtttgttcgccgcggc

SEQ ID NO: 670141 - DNA, 25 bp, Artificial sequence
  Synthetic oligonucleotide
tcgaagtccagcggcgagcttggct

SEQ ID NO: 670142 - DNA, 25 bp, Artificial sequence
  Synthetic oligonucleotide
tggcgagaatattcgacacccgttt

SEQ ID NO: 670143 - DNA, 25 bp, Artificial sequence
  Synthetic oligonucleotide
cggacttggcgagaatattcgacac

SEQ ID NO: 670144 - DNA, 25 bp, Artificial sequence
  Synthetic oligonucleotide
cgtcctcggacttggcgagaatatt

SEQ ID NO: 670145 - DNA, 25 bp, Artificial sequence
  Synthetic oligonucleotide
aacatcggcgcgcagcatagctggt

SEQ ID NO: 670146 - DNA, 25 bp, Artificial sequence
  Synthetic oligonucleotide
cggcggaacctcgtcctcggacttg

SEQ ID NO: 670147 - DNA, 25 bp, Artificial sequence
  Synthetic oligonucleotide
ttggcgagctgatggcgcagacacg

SEQ ID NO: 670148 - DNA, 25 bp, Artificial sequence
  Synthetic oligonucleotide
ggcatccacgttcggcggaacctcg

SEQ ID NO: 670149 - DNA, 25 bp, Artificial sequence
  Synthetic oligonucleotide
aggctggcatccacgttcggcggaa

SEQ ID NO: 670150 - DNA, 25 bp, Artificial sequence
  Synthetic oligonucleotide
tcggccacgcgcttggcgatcagct

SEQ ID NO: 670151 - DNA, 25 bp, Artificial sequence
  Synthetic oligonucleotide
cgtttgttcgccgcggccagggcct

SEQ ID NO: 670152 - DNA, 25 bp, Artificial sequence
  Synthetic oligonucleotide
acgccttcgtcctcgtagcgcgcgc

SEQ ID NO: 670153 - DNA, 25 bp, Artificial sequence
  Synthetic oligonucleotide
aggccggcggccttgaccttgtcgc

SEQ ID NO: 670154 - DNA, 25 bp, Artificial sequence
  Synthetic oligonucleotide
tcggccaggccggcggccttgacct

SEQ ID NO: 670155 - DNA, 25 bp, Artificial sequence
  Synthetic oligonucleotide
cctgctcggccaggccggcggcctt

SEQ ID NO: 670156 - DNA, 25 bp, Artificial sequence
  Synthetic oligonucleotide
cagcacctgctcggccaggccggcg

SEQ ID NO: 670157 - DNA, 25 bp, Artificial sequence
  Synthetic oligonucleotide
gaagtccagcacctgctcggccagg

SEQ ID NO: 670158 - DNA, 25 bp, Artificial sequence
  Synthetic oligonucleotide
aacacgaagtccagcacctgctcgg

SEQ ID NO: 670159 - DNA, 25 bp, Artificial sequence
  Synthetic oligonucleotide
ggtcgaacacgaagtccagcacctg

SEQ ID NO: 670160 - DNA, 25 bp, Artificial sequence
  Synthetic oligonucleotide
gcaggcggtcgaacacgaagtccag

SEQ ID NO: 670161 - DNA, 25 bp, Artificial sequence
  Synthetic oligonucleotide
cgcgcgcgcaggcggtcgaacacga

SEQ ID NO: 670162 - DNA, 25 bp, Artificial sequence
  Synthetic oligonucleotide
ctgtacgcgctggtcgaagtccagc

SEQ ID NO: 670163 - DNA, 25 bp, Artificial sequence
  Synthetic oligonucleotide
ttcgtcctcgtagcgcgcgcgcagg

SEQ ID NO: 670164 - DNA, 25 bp, Artificial sequence
  Synthetic oligonucleotide
cgctggtcgaagtccagcggcgagc

SEQ ID NO: 670165 - DNA, 25 bp, Artificial sequence
  Synthetic oligonucleotide
acgtccacgccttcgtcctcgtagc

SEQ ID NO: 670166 - DNA, 25 bp, Artificial sequence
  Synthetic oligonucleotide
acggccacgtccacgccttcgtcct

SEQ ID NO: 670167 - DNA, 25 bp, Artificial sequence
  Synthetic oligonucleotide
tggtacacggccacgtccacgcctt

SEQ ID NO: 670168 - DNA, 25 bp, Artificial sequence
  Synthetic oligonucleotide
accgactggtacacggccacgtcca

SEQ ID NO: 670169 - DNA, 25 bp, Artificial sequence
  Synthetic oligonucleotide
gcgcgcaccgactggtacacggcca

SEQ ID NO: 670170 - DNA, 25 bp, Artificial sequence
  Synthetic oligonucleotide
ttgagcgcgcgcaccgactggtaca

SEQ ID NO: 670171 - DNA, 25 bp, Artificial sequence
  Synthetic oligonucleotide
cttggcttgagcgcgcgcaccgact

SEQ ID NO: 670172 - DNA, 25 bp, Artificial sequence
  Synthetic oligonucleotide
ggcgagcttggcttgagcgcgcgca

SEQ ID NO: 670173 - DNA, 25 bp, Artificial sequence
  Synthetic oligonucleotide
tccagcggcgagcttggcttgagcg

SEQ ID NO: 670174 - DNA, 25 bp, Artificial sequence
  Synthetic oligonucleotide
ccgtgggtggcgtagtagtagccgg

SEQ ID NO: 670175 - DNA, 25 bp, Artificial sequence
  Synthetic oligonucleotide
tcgtagcgcgcgcgcaggcggtcga

SEQ ID NO: 670176 - DNA, 25 bp, Artificial sequence
  Synthetic oligonucleotide
cggtgatgaagcgaggcagcagctt

SEQ ID NO: 670177 - DNA, 25 bp, Artificial sequence
  Synthetic oligonucleotide
tgcatggtggtgatcagggcttcct

SEQ ID NO: 670178 - DNA, 25 bp, Artificial sequence
  Synthetic oligonucleotide
ttgtcctgcatggtggtgatcaggg

SEQ ID NO: 670179 - DNA, 25 bp, Artificial sequence
  Synthetic oligonucleotide
ttctggttgtcctgcatggtggtga

SEQ ID NO: 670180 - DNA, 25 bp, Artificial sequence
  Synthetic oligonucleotide
aagtatttctggttgtcctgcatgg

SEQ ID NO: 670181 - DNA, 25 bp, Artificial sequence
  Synthetic oligonucleotide
aggcagaagtatttctggttgtcct

SEQ ID NO: 670182 - DNA, 25 bp, Artificial sequence
  Synthetic oligonucleotide
tccagcaggcagaagtatttctggt

SEQ ID NO: 670183 - DNA, 25 bp, Artificial sequence
  Synthetic oligonucleotide
ttggcgtccagcaggcagaagtatt

SEQ ID NO: 670184 - DNA, 25 bp, Artificial sequence
  Synthetic oligonucleotide
ttgccgttggcgtccagcaggcaga

SEQ ID NO: 670185 - DNA, 25 bp, Artificial sequence
  Synthetic oligonucleotide
gcagcttgccgttggcgtccagcag

SEQ ID NO: 670186 - DNA, 25 bp, Artificial sequence
  Synthetic oligonucleotide
tccgcttcgccgccgtgggtggcgt

SEQ ID NO: 670187 - DNA, 25 bp, Artificial sequence
  Synthetic oligonucleotide
tgaagcgaggcagcagcttgccgtt

SEQ ID NO: 670188 - DNA, 25 bp, Artificial sequence
  Synthetic oligonucleotide
gggcttcctgcgggacctcgaggaa

SEQ ID NO: 670189 - DNA, 25 bp, Artificial sequence
  Synthetic oligonucleotide
tggcgacggtgatgaagcgaggcag

SEQ ID NO: 670190 - DNA, 25 bp, Artificial sequence
  Synthetic oligonucleotide
cgacgttggcgacggtgatgaagcg

SEQ ID NO: 670191 - DNA, 25 bp, Artificial sequence
  Synthetic oligonucleotide
tgctctcgacgttggcgacggtgat

SEQ ID NO: 670192 - DNA, 25 bp, Artificial sequence
  Synthetic oligonucleotide
gcgccttgctctcgacgttggcgac

SEQ ID NO: 670193 - DNA, 25 bp, Artificial sequence
  Synthetic oligonucleotide
tctccggcgccttgctctcgacgtt

SEQ ID NO: 670194 - DNA, 25 bp, Artificial sequence
  Synthetic oligonucleotide
cgatgttctccggcgccttgctctc

SEQ ID NO: 670195 - DNA, 25 bp, Artificial sequence
  Synthetic oligonucleotide
cgctgacgatgttctccggcgcctt

SEQ ID NO: 670196 - DNA, 25 bp, Artificial sequence
  Synthetic oligonucleotide
tcgttaccgctgacgatgttctccg

SEQ ID NO: 670197 - DNA, 25 bp, Artificial sequence
  Synthetic oligonucleotide
caccttctcgttaccgctgacgatg

SEQ ID NO: 670198 - DNA, 25 bp, Artificial sequence
  Synthetic oligonucleotide
gaggcagcagcttgccgttggcgtc

SEQ ID NO: 670199 - DNA, 25 bp, Artificial sequence
  Synthetic oligonucleotide
cactcgaccagtgcagtcacttcgt

SEQ ID NO: 670200 - DNA, 25 bp, Artificial sequence
  Synthetic oligonucleotide
gccagttcggccacgcgcttggcga

SEQ ID NO: 670201 - DNA, 25 bp, Artificial sequence
  Synthetic oligonucleotide
ctcggcggccagttcggccacgcgc

SEQ ID NO: 670202 - DNA, 25 bp, Artificial sequence
  Synthetic oligonucleotide
ctgttgctcggcggccagttcggcc

SEQ ID NO: 670203 - DNA, 25 bp, Artificial sequence
  Synthetic oligonucleotide
cgctgccctgttgctcggcggccag

SEQ ID NO: 670204 - DNA, 25 bp, Artificial sequence
  Synthetic oligonucleotide
acgatggcgctgccctgttgctcgg

SEQ ID NO: 670205 - DNA, 25 bp, Artificial sequence
  Synthetic oligonucleotide
ggcggcacgatggcgctgccctgtt

SEQ ID NO: 670206 - DNA, 25 bp, Artificial sequence
  Synthetic oligonucleotide
caggctcggcggcacgatggcgctg

SEQ ID NO: 670207 - DNA, 25 bp, Artificial sequence
  Synthetic oligonucleotide
gtcgagcaggctcggcggcacgatg

SEQ ID NO: 670208 - DNA, 25 bp, Artificial sequence
  Synthetic oligonucleotide
acttcgtcgagcaggctcggcggca

SEQ ID NO: 670209 - DNA, 25 bp, Artificial sequence
  Synthetic oligonucleotide
ggtggtgatcagggcttcctgcggg

SEQ ID NO: 670210 - DNA, 25 bp, Artificial sequence
  Synthetic oligonucleotide
accagtgcagtcacttcgtcgagca

SEQ ID NO: 670211 - DNA, 25 bp, Artificial sequence
  Synthetic oligonucleotide
tgatcagggcttcctgcgggacctc

SEQ ID NO: 670212 - DNA, 25 bp, Artificial sequence
  Synthetic oligonucleotide
accggccactcgaccagtgcagtca

SEQ ID NO: 670213 - DNA, 25 bp, Artificial sequence
  Synthetic oligonucleotide
agcggcaccggccactcgaccagtg

SEQ ID NO: 670214 - DNA, 25 bp, Artificial sequence
  Synthetic oligonucleotide
cagaccagcggcaccggccactcga

SEQ ID NO: 670215 - DNA, 25 bp, Artificial sequence
  Synthetic oligonucleotide
aaggagcagaccagcggcaccggcc

SEQ ID NO: 670216 - DNA, 25 bp, Artificial sequence
  Synthetic oligonucleotide
tcctcgaaggagcagaccagcggca

SEQ ID NO: 670217 - DNA, 25 bp, Artificial sequence
  Synthetic oligonucleotide
aagcgctcctcgaaggagcagacca

SEQ ID NO: 670218 - DNA, 25 bp, Artificial sequence
  Synthetic oligonucleotide
tcgaggaagcgctcctcgaaggagc

SEQ ID NO: 670219 - DNA, 25 bp, Artificial sequence
  Synthetic oligonucleotide
gggacctcgaggaagcgctcctcga

SEQ ID NO: 670220 - DNA, 25 bp, Artificial sequence
  Synthetic oligonucleotide
tcctgcgggacctcgaggaagcgct

SEQ ID NO: 670221 - DNA, 25 bp, Artificial sequence
  Synthetic oligonucleotide
gcgtcggtgaggcgcgggcgaacca

SEQ ID NO: 670222 - DNA, 25 bp, Artificial sequence
  Synthetic oligonucleotide
gcagtcacttcgtcgagcaggctcg

SEQ ID NO: 670223 - DNA, 25 bp, Artificial sequence
  Synthetic oligonucleotide
tctcggtcgccaggtcacacttgga

SEQ ID NO: 670224 - DNA, 25 bp, Artificial sequence
  Synthetic oligonucleotide
gcgaaccaccttctcgttaccgctg

SEQ ID NO: 670225 - DNA, 25 bp, Artificial sequence
  Synthetic oligonucleotide
cgcctatacgttcggcgatgtaggc

SEQ ID NO: 670226 - DNA, 25 bp, Artificial sequence
  Synthetic oligonucleotide
cattgccgcctatacgttcggcgat

SEQ ID NO: 670227 - DNA, 25 bp, Artificial sequence
  Synthetic oligonucleotide
tctgcgcattgccgcctatacgttc

SEQ ID NO: 670228 - DNA, 25 bp, Artificial sequence
  Synthetic oligonucleotide
aggcgttctgcgcattgccgcctat

SEQ ID NO: 670229 - DNA, 25 bp, Artificial sequence
  Synthetic oligonucleotide
cgcgcgaggcgttctgcgcattgcc

SEQ ID NO: 670230 - DNA, 25 bp, Artificial sequence
  Synthetic oligonucleotide
tgccggcgcgcgaggcgttctgcgc

SEQ ID NO: 670231 - DNA, 25 bp, Artificial sequence
  Synthetic oligonucleotide
acaggatgccggcgcgcgaggcgtt

SEQ ID NO: 670232 - DNA, 25 bp, Artificial sequence
  Synthetic oligonucleotide
acttggacaggatgccggcgcgcga

SEQ ID NO: 670233 - DNA, 25 bp, Artificial sequence
  Synthetic oligonucleotide
tcggcgatgtaggcggccaggccgg

SEQ ID NO: 670234 - DNA, 25 bp, Artificial sequence
  Synthetic oligonucleotide
tcgccaggtcacacttggacaggat

SEQ ID NO: 670235 - DNA, 25 bp, Artificial sequence
  Synthetic oligonucleotide
atgtaggcggccaggccggagacgc

SEQ ID NO: 670236 - DNA, 25 bp, Artificial sequence
  Synthetic oligonucleotide
cgaccatctcggtcgccaggtcaca

SEQ ID NO: 670237 - DNA, 25 bp, Artificial sequence
  Synthetic oligonucleotide
actcgccgaccatctcggtcgccag

SEQ ID NO: 670238 - DNA, 25 bp, Artificial sequence
  Synthetic oligonucleotide
cggggaactcgccgaccatctcggt

SEQ ID NO: 670239 - DNA, 25 bp, Artificial sequence
  Synthetic oligonucleotide
gcatttcggggaactcgccgaccat

SEQ ID NO: 670240 - DNA, 25 bp, Artificial sequence
  Synthetic oligonucleotide
tgccctgcatttcggggaactcgcc

SEQ ID NO: 670241 - DNA, 25 bp, Artificial sequence
  Synthetic oligonucleotide
ggcgatgccctgcatttcggggaac

SEQ ID NO: 670242 - DNA, 25 bp, Artificial sequence
  Synthetic oligonucleotide
gtagccggcgatgccctgcatttcg

SEQ ID NO: 670243 - DNA, 25 bp, Artificial sequence
  Synthetic oligonucleotide
gtagtagtagccggcgatgccctgc

SEQ ID NO: 670244 - DNA, 25 bp, Artificial sequence
  Synthetic oligonucleotide
gtggcgtagtagtagccggcgatgc

SEQ ID NO: 670245 - DNA, 25 bp, Artificial sequence
  Synthetic oligonucleotide
tcggcggcttccaccagcaggctgg

SEQ ID NO: 670246 - DNA, 25 bp, Artificial sequence
  Synthetic oligonucleotide
ggtcacacttggacaggatgccggc

SEQ ID NO: 670247 - DNA, 25 bp, Artificial sequence
  Synthetic oligonucleotide
actacgttgcgcaggcgctcattga

SEQ ID NO: 670248 - DNA, 25 bp, Artificial sequence
  Synthetic oligonucleotide
tcgccgccgtgggtggcgtagtagt

SEQ ID NO: 670249 - DNA, 25 bp, Artificial sequence
  Synthetic oligonucleotide
aactcggcgtcggtgaggcgcgggc

SEQ ID NO: 670250 - DNA, 25 bp, Artificial sequence
  Synthetic oligonucleotide
aagaagaactcggcgtcggtgaggc

SEQ ID NO: 670251 - DNA, 25 bp, Artificial sequence
  Synthetic oligonucleotide
tgcttgaagaagaactcggcgtcgg

SEQ ID NO: 670252 - DNA, 25 bp, Artificial sequence
  Synthetic oligonucleotide
ttgtcctgcttgaagaagaactcgg

SEQ ID NO: 670253 - DNA, 25 bp, Artificial sequence
  Synthetic oligonucleotide
ctgcttcttgtcctgcttgaagaag

SEQ ID NO: 670254 - DNA, 25 bp, Artificial sequence
  Synthetic oligonucleotide
gagcggctgcttcttgtcctgcttg

SEQ ID NO: 670255 - DNA, 25 bp, Artificial sequence
  Synthetic oligonucleotide
gctttcgagcggctgcttcttgtcc

SEQ ID NO: 670256 - DNA, 25 bp, Artificial sequence
  Synthetic oligonucleotide
cattgaagctttcgagcggctgctt

SEQ ID NO: 670257 - DNA, 25 bp, Artificial sequence
  Synthetic oligonucleotide
tacgttcggcgatgtaggcggccag

SEQ ID NO: 670258 - DNA, 25 bp, Artificial sequence
  Synthetic oligonucleotide
tgcgcaggcgctcattgaagctttc

SEQ ID NO: 670259 - DNA, 25 bp, Artificial sequence
  Synthetic oligonucleotide
tgaggcgcgggcgaaccaccttctc

SEQ ID NO: 670260 - DNA, 25 bp, Artificial sequence
  Synthetic oligonucleotide
tggaacactacgttgcgcaggcgct

SEQ ID NO: 670261 - DNA, 25 bp, Artificial sequence
  Synthetic oligonucleotide
tgggcctggaacactacgttgcgca

SEQ ID NO: 670262 - DNA, 25 bp, Artificial sequence
  Synthetic oligonucleotide
ccgagctgggcctggaacactacgt

SEQ ID NO: 670263 - DNA, 25 bp, Artificial sequence
  Synthetic oligonucleotide
acggtgccgagctgggcctggaaca

SEQ ID NO: 670264 - DNA, 25 bp, Artificial sequence
  Synthetic oligonucleotide
tcgaacacggtgccgagctgggcct

SEQ ID NO: 670265 - DNA, 25 bp, Artificial sequence
  Synthetic oligonucleotide
gccttctcgaacacggtgccgagct

SEQ ID NO: 670266 - DNA, 25 bp, Artificial sequence
  Synthetic oligonucleotide
cgctgggccttctcgaacacggtgc

SEQ ID NO: 670267 - DNA, 25 bp, Artificial sequence
  Synthetic oligonucleotide
gagacgcgctgggccttctcgaaca

SEQ ID NO: 670268 - DNA, 25 bp, Artificial sequence
  Synthetic oligonucleotide
aggccggagacgcgctgggccttct

SEQ ID NO: 670269 - DNA, 25 bp, Artificial sequence
  Synthetic oligonucleotide
gcggccaggccggagacgcgctggg

SEQ ID NO: 670270 - DNA, 25 bp, Artificial sequence
  Synthetic oligonucleotide
ggcgctcattgaagctttcgagcgg

SEQ ID NO: 670271 - DNA, 25 bp, Artificial sequence
  Synthetic oligonucleotide
tggagggcgcgcggatgccgttcgg

SEQ ID NO: 670272 - DNA, 25 bp, Artificial sequence
  Synthetic oligonucleotide
tagcggtggccggttcgatcctgca

SEQ ID NO: 670273 - DNA, 25 bp, Artificial sequence
  Synthetic oligonucleotide
ctcgccgtagcggtggccggttcga

SEQ ID NO: 670274 - DNA, 25 bp, Artificial sequence
  Synthetic oligonucleotide
gatgtactcgccgtagcggtggccg

SEQ ID NO: 670275 - DNA, 25 bp, Artificial sequence
  Synthetic oligonucleotide
gccttcgatgtactcgccgtagcgg

SEQ ID NO: 670276 - DNA, 25 bp, Artificial sequence
  Synthetic oligonucleotide
gacggagccttcgatgtactcgccg

SEQ ID NO: 670277 - DNA, 25 bp, Artificial sequence
  Synthetic oligonucleotide
gcgaccgacggagccttcgatgtac

SEQ ID NO: 670278 - DNA, 25 bp, Artificial sequence
  Synthetic oligonucleotide
ctgaaggcgaccgacggagccttcg

SEQ ID NO: 670279 - DNA, 25 bp, Artificial sequence
  Synthetic oligonucleotide
cagccgctgaaggcgaccgacggag

SEQ ID NO: 670280 - DNA, 25 bp, Artificial sequence
  Synthetic oligonucleotide
ttcggccagccgctgaaggcgaccg

SEQ ID NO: 670281 - DNA, 25 bp, Artificial sequence
  Synthetic oligonucleotide
acgtcggcagcgacagccgccagca

SEQ ID NO: 670282 - DNA, 25 bp, Artificial sequence
  Synthetic oligonucleotide
cgcgcggatgccgttcggccagccg

SEQ ID NO: 670283 - DNA, 25 bp, Artificial sequence
  Synthetic oligonucleotide
cctgcagcacttcgtgccgatcctc

SEQ ID NO: 670284 - DNA, 25 bp, Artificial sequence
  Synthetic oligonucleotide
gcgtgatggagggcgcgcggatgcc

SEQ ID NO: 670285 - DNA, 25 bp, Artificial sequence
  Synthetic oligonucleotide
agaccggcgtgatggagggcgcgcg

SEQ ID NO: 670286 - DNA, 25 bp, Artificial sequence
  Synthetic oligonucleotide
aggtgcagaccggcgtgatggaggg

SEQ ID NO: 670287 - DNA, 25 bp, Artificial sequence
  Synthetic oligonucleotide
atggccaggtgcagaccggcgtgat

SEQ ID NO: 670288 - DNA, 25 bp, Artificial sequence
  Synthetic oligonucleotide
tcctcgatggccaggtgcagaccgg

SEQ ID NO: 670289 - DNA, 25 bp, Artificial sequence
  Synthetic oligonucleotide
acgccatcctcgatggccaggtgca

SEQ ID NO: 670290 - DNA, 25 bp, Artificial sequence
  Synthetic oligonucleotide
gccagcacgccatcctcgatggcca

SEQ ID NO: 670291 - DNA, 25 bp, Artificial sequence
  Synthetic oligonucleotide
acagccgccagcacgccatcctcga

SEQ ID NO: 670292 - DNA, 25 bp, Artificial sequence
  Synthetic oligonucleotide
ccagcaggctggcatccacgttcgg

SEQ ID NO: 670293 - DNA, 25 bp, Artificial sequence
  Synthetic oligonucleotide
atgccgttcggccagccgctgaagg

SEQ ID NO: 670294 - DNA, 25 bp, Artificial sequence
  Synthetic oligonucleotide
aagccggaaagcgtgatgaccgacg

SEQ ID NO: 670295 - DNA, 25 bp, Artificial sequence
  Synthetic oligonucleotide
tacgagtcgcgggtcctgcagggga

SEQ ID NO: 670296 - DNA, 25 bp, Artificial sequence
  Synthetic oligonucleotide
ctacccctacgagtcgcgggtcctg

SEQ ID NO: 670297 - DNA, 25 bp, Artificial sequence
  Synthetic oligonucleotide
gaagccggtgcgtacccaggccgac

SEQ ID NO: 670298 - DNA, 25 bp, Artificial sequence
  Synthetic oligonucleotide
ttccagaagccggtgcgtacccagg

SEQ ID NO: 670299 - DNA, 25 bp, Artificial sequence
  Synthetic oligonucleotide
accgccttccagaagccggtgcgta

SEQ ID NO: 670300 - DNA, 25 bp, Artificial sequence
  Synthetic oligonucleotide
tgctgaccgccttccagaagccggt

SEQ ID NO: 670301 - DNA, 25 bp, Artificial sequence
  Synthetic oligonucleotide
ggcaactgctgaccgccttccagaa

SEQ ID NO: 670302 - DNA, 25 bp, Artificial sequence
  Synthetic oligonucleotide
gaaacccggcaactgctgaccgcct

SEQ ID NO: 670303 - DNA, 25 bp, Artificial sequence
  Synthetic oligonucleotide
accgacgaaacccggcaactgctga

SEQ ID NO: 670304 - DNA, 25 bp, Artificial sequence
  Synthetic oligonucleotide
tggccggttcgatcctgcagcactt

SEQ ID NO: 670305 - DNA, 25 bp, Artificial sequence
  Synthetic oligonucleotide
gaaagcgtgatgaccgacgaaaccc

SEQ ID NO: 670306 - DNA, 25 bp, Artificial sequence
  Synthetic oligonucleotide
gttcgatcctgcagcacttcgtgcc

SEQ ID NO: 670307 - DNA, 25 bp, Artificial sequence
  Synthetic oligonucleotide
gcggtcaagccggaaagcgtgatga

SEQ ID NO: 670308 - DNA, 25 bp, Artificial sequence
  Synthetic oligonucleotide
gcggcggcggtcaagccggaaagcg

SEQ ID NO: 670309 - DNA, 25 bp, Artificial sequence
  Synthetic oligonucleotide
gccaaggcggcggcggtcaagccgg

SEQ ID NO: 670310 - DNA, 25 bp, Artificial sequence
  Synthetic oligonucleotide
cacgatgccaaggcggcggcggtca

SEQ ID NO: 670311 - DNA, 25 bp, Artificial sequence
  Synthetic oligonucleotide
gagaagcacgatgccaaggcggcgg

SEQ ID NO: 670312 - DNA, 25 bp, Artificial sequence
  Synthetic oligonucleotide
tcggtgagaagcacgatgccaaggc

SEQ ID NO: 670313 - DNA, 25 bp, Artificial sequence
  Synthetic oligonucleotide
gatcctcggtgagaagcacgatgcc

SEQ ID NO: 670314 - DNA, 25 bp, Artificial sequence
  Synthetic oligonucleotide
cgtgccgatcctcggtgagaagcac

SEQ ID NO: 670315 - DNA, 25 bp, Artificial sequence
  Synthetic oligonucleotide
gcacttcgtgccgatcctcggtgag

SEQ ID NO: 670316 - DNA, 25 bp, Artificial sequence
  Synthetic oligonucleotide
tgagggacgtcggcagcgacagccg

SEQ ID NO: 670317 - DNA, 25 bp, Artificial sequence
  Synthetic oligonucleotide
gtgatgaccgacgaaacccggcaac

SEQ ID NO: 670318 - DNA, 25 bp, Artificial sequence
  Synthetic oligonucleotide
ctacctgaagatcaactcggccaac

SEQ ID NO: 670319 - DNA, 25 bp, Artificial sequence
  Synthetic oligonucleotide
atcggcccgccgaagtggccctggg

SEQ ID NO: 670320 - DNA, 25 bp, Artificial sequence
  Synthetic oligonucleotide
aagaagatcggcccgccgaagtggc

SEQ ID NO: 670321 - DNA, 25 bp, Artificial sequence
  Synthetic oligonucleotide
ctgatcaagaagatcggcccgccga

SEQ ID NO: 670322 - DNA, 25 bp, Artificial sequence
  Synthetic oligonucleotide
gaagacctgatcaagaagatcggcc

SEQ ID NO: 670323 - DNA, 25 bp, Artificial sequence
  Synthetic oligonucleotide
aagctggaagacctgatcaagaaga

SEQ ID NO: 670324 - DNA, 25 bp, Artificial sequence
  Synthetic oligonucleotide
ctgggcaagctggaagacctgatca

SEQ ID NO: 670325 - DNA, 25 bp, Artificial sequence
  Synthetic oligonucleotide
cacgggctgggcaagctggaagacc

SEQ ID NO: 670326 - DNA, 25 bp, Artificial sequence
  Synthetic oligonucleotide
caacttccacgggctgggcaagctg

SEQ ID NO: 670327 - DNA, 25 bp, Artificial sequence
  Synthetic oligonucleotide
tcggccaacttccacgggctgggca

SEQ ID NO: 670328 - DNA, 25 bp, Artificial sequence
  Synthetic oligonucleotide
gcagcgacagccgccagcacgccat

SEQ ID NO: 670329 - DNA, 25 bp, Artificial sequence
  Synthetic oligonucleotide
tgaagatcaactcggccaacttcca

SEQ ID NO: 670330 - DNA, 25 bp, Artificial sequence
  Synthetic oligonucleotide
ggccctgggcggtggacaagcacct

SEQ ID NO: 670331 - DNA, 25 bp, Artificial sequence
  Synthetic oligonucleotide
catggactacctgaagatcaactcg

SEQ ID NO: 670332 - DNA, 25 bp, Artificial sequence
  Synthetic oligonucleotide
gctgggcatggactacctgaagatc

SEQ ID NO: 670333 - DNA, 25 bp, Artificial sequence
  Synthetic oligonucleotide
ccacctgctgggcatggactacctg

SEQ ID NO: 670334 - DNA, 25 bp, Artificial sequence
  Synthetic oligonucleotide
caagttccacctgctgggcatggac

SEQ ID NO: 670335 - DNA, 25 bp, Artificial sequence
  Synthetic oligonucleotide
gaagagcaagttccacctgctgggc

SEQ ID NO: 670336 - DNA, 25 bp, Artificial sequence
  Synthetic oligonucleotide
cccgcagaagagcaagttccacctg

SEQ ID NO: 670337 - DNA, 25 bp, Artificial sequence
  Synthetic oligonucleotide
ccttccacccgcagaagagcaagtt

SEQ ID NO: 670338 - DNA, 25 bp, Artificial sequence
  Synthetic oligonucleotide
tcgccaccttccacccgcagaagag

SEQ ID NO: 670339 - DNA, 25 bp, Artificial sequence
  Synthetic oligonucleotide
gggtgttcgccaccttccacccgca

SEQ ID NO: 670340 - DNA, 25 bp, Artificial sequence
  Synthetic oligonucleotide
atcaactcggccaacttccacgggc

SEQ ID NO: 670341 - DNA, 25 bp, Artificial sequence
  Synthetic oligonucleotide
accgacgaaggtggctgcgtggagt

SEQ ID NO: 670342 - DNA, 25 bp, Artificial sequence
  Synthetic oligonucleotide
ctccgctgagggacgtcggcagcga

SEQ ID NO: 670343 - DNA, 25 bp, Artificial sequence
  Synthetic oligonucleotide
gggacactccgctgagggacgtcgg

SEQ ID NO: 670344 - DNA, 25 bp, Artificial sequence
  Synthetic oligonucleotide
tgctttgggacactccgctgaggga

SEQ ID NO: 670345 - DNA, 25 bp, Artificial sequence
  Synthetic oligonucleotide
acctggtgctttgggacactccgct

SEQ ID NO: 670346 - DNA, 25 bp, Artificial sequence
  Synthetic oligonucleotide
tcaaggacctggtgctttgggacac

SEQ ID NO: 670347 - DNA, 25 bp, Artificial sequence
  Synthetic oligonucleotide
tccggatcaaggacctggtgctttg

SEQ ID NO: 670348 - DNA, 25 bp, Artificial sequence
  Synthetic oligonucleotide
acggcatccggatcaaggacctggt

SEQ ID NO: 670349 - DNA, 25 bp, Artificial sequence
  Synthetic oligonucleotide
gtgccacggcatccggatcaaggac

SEQ ID NO: 670350 - DNA, 25 bp, Artificial sequence
  Synthetic oligonucleotide
gtggagtgccacggcatccggatca

SEQ ID NO: 670351 - DNA, 25 bp, Artificial sequence
  Synthetic oligonucleotide
cccgccgaagtggccctgggcggtg

SEQ ID NO: 670352 - DNA, 25 bp, Artificial sequence
  Synthetic oligonucleotide
gaaggtggctgcgtggagtgccacg

SEQ ID NO: 670353 - DNA, 25 bp, Artificial sequence
  Synthetic oligonucleotide
cgaagtggccctgggcggtggacaa

SEQ ID NO: 670354 - DNA, 25 bp, Artificial sequence
  Synthetic oligonucleotide
cgcaagaccgacgaaggtggctgcg

SEQ ID NO: 670355 - DNA, 25 bp, Artificial sequence
  Synthetic oligonucleotide
ttcgcccgcaagaccgacgaaggtg

SEQ ID NO: 670356 - DNA, 25 bp, Artificial sequence
  Synthetic oligonucleotide
ctgatcttcgcccgcaagaccgacg

SEQ ID NO: 670357 - DNA, 25 bp, Artificial sequence
  Synthetic oligonucleotide
ggcgcgctgatcttcgcccgcaaga

SEQ ID NO: 670358 - DNA, 25 bp, Artificial sequence
  Synthetic oligonucleotide
ggaaaggcgcgctgatcttcgcccg

SEQ ID NO: 670359 - DNA, 25 bp, Artificial sequence
  Synthetic oligonucleotide
tggccaggaaaggcgcgctgatctt

SEQ ID NO: 670360 - DNA, 25 bp, Artificial sequence
  Synthetic oligonucleotide
agcacctggccaggaaaggcgcgct

SEQ ID NO: 670361 - DNA, 25 bp, Artificial sequence
  Synthetic oligonucleotide
tggacaagcacctggccaggaaagg

SEQ ID NO: 670362 - DNA, 25 bp, Artificial sequence
  Synthetic oligonucleotide
gggcggtggacaagcacctggccag

SEQ ID NO: 670363 - DNA, 25 bp, Artificial sequence
  Synthetic oligonucleotide
aggggatctgggcagcggcgccgta

SEQ ID NO: 670364 - DNA, 25 bp, Artificial sequence
  Synthetic oligonucleotide
ggctgcgtggagtgccacggcatcc

SEQ ID NO: 670365 - DNA, 25 bp, Artificial sequence
  Synthetic oligonucleotide
gccaccccgaggaacgacccgcgca

SEQ ID NO: 670366 - DNA, 25 bp, Artificial sequence
  Synthetic oligonucleotide
tcgtcgacattgaccatcacatcgg

SEQ ID NO: 670367 - DNA, 25 bp, Artificial sequence
  Synthetic oligonucleotide
gccgcgtcgtcgacattgaccatca

SEQ ID NO: 670368 - DNA, 25 bp, Artificial sequence
  Synthetic oligonucleotide
cgcaccgccgcgtcgtcgacattga

SEQ ID NO: 670369 - DNA, 25 bp, Artificial sequence
  Synthetic oligonucleotide
ttggcgcgcaccgccgcgtcgtcga

SEQ ID NO: 670370 - DNA, 25 bp, Artificial sequence
  Synthetic oligonucleotide
tagcggttggcgcgcaccgccgcgt

SEQ ID NO: 670371 - DNA, 25 bp, Artificial sequence
  Synthetic oligonucleotide
gcgcatagcggttggcgcgcaccgc

SEQ ID NO: 670372 - DNA, 25 bp, Artificial sequence
  Synthetic oligonucleotide
ccagcagcgcatagcggttggcgcg

SEQ ID NO: 670373 - DNA, 25 bp, Artificial sequence
  Synthetic oligonucleotide
gcttggccagcagcgcatagcggtt

SEQ ID NO: 670374 - DNA, 25 bp, Artificial sequence
  Synthetic oligonucleotide
cgcgcagcttggccagcagcgcata

SEQ ID NO: 670375 - DNA, 25 bp, Artificial sequence
  Synthetic oligonucleotide
tcgcgggtcctgcaggggatctggg

SEQ ID NO: 670376 - DNA, 25 bp, Artificial sequence
  Synthetic oligonucleotide
ccgaggaacgacccgcgcagcttgg

SEQ ID NO: 670377 - DNA, 25 bp, Artificial sequence
  Synthetic oligonucleotide
acatcggcgaagaacgtatccaccg

SEQ ID NO: 670378 - DNA, 25 bp, Artificial sequence
  Synthetic oligonucleotide
agatgtccgccaccccgaggaacga

SEQ ID NO: 670379 - DNA, 25 bp, Artificial sequence
  Synthetic oligonucleotide
cagcgagatgtccgccaccccgagg

SEQ ID NO: 670380 - DNA, 25 bp, Artificial sequence
  Synthetic oligonucleotide
gccgagcagcgagatgtccgccacc

SEQ ID NO: 670381 - DNA, 25 bp, Artificial sequence
  Synthetic oligonucleotide
gctcagccgagcagcgagatgtccg

SEQ ID NO: 670382 - DNA, 25 bp, Artificial sequence
  Synthetic oligonucleotide
ggactggctcagccgagcagcgaga

SEQ ID NO: 670383 - DNA, 25 bp, Artificial sequence
  Synthetic oligonucleotide
gaggcgggactggctcagccgagca

SEQ ID NO: 670384 - DNA, 25 bp, Artificial sequence
  Synthetic oligonucleotide
tcttcgaggcgggactggctcagcc

SEQ ID NO: 670385 - DNA, 25 bp, Artificial sequence
  Synthetic oligonucleotide
gccttttcttcgaggcgggactggc

SEQ ID NO: 670386 - DNA, 25 bp, Artificial sequence
  Synthetic oligonucleotide
cggtgtcgcgaggacgccgggcctt

SEQ ID NO: 670387 - DNA, 25 bp, Artificial sequence
  Synthetic oligonucleotide
aacgacccgcgcagcttggccagca

SEQ ID NO: 670388 - DNA, 25 bp, Artificial sequence
  Synthetic oligonucleotide
gcgatagtcgcgtgccgctgccagc

SEQ ID NO: 670389 - DNA, 25 bp, Artificial sequence
  Synthetic oligonucleotide
gccttctcggcggcttccaccagca

SEQ ID NO: 670390 - DNA, 25 bp, Artificial sequence
  Synthetic oligonucleotide
cccagggccttctcggcggcttcca

SEQ ID NO: 670391 - DNA, 25 bp, Artificial sequence
  Synthetic oligonucleotide
gcgctgcccagggccttctcggcgg

SEQ ID NO: 670392 - DNA, 25 bp, Artificial sequence
  Synthetic oligonucleotide
cgccacggcgctgcccagggccttc

SEQ ID NO: 670393 - DNA, 25 bp, Artificial sequence
  Synthetic oligonucleotide
ggcgttcgccacggcgctgcccagg

SEQ ID NO: 670394 - DNA, 25 bp, Artificial sequence
  Synthetic oligonucleotide
gctttcggcgttcgccacggcgctg

SEQ ID NO: 670395 - DNA, 25 bp, Artificial sequence
  Synthetic oligonucleotide
acttcgctttcggcgttcgccacgg

SEQ ID NO: 670396 - DNA, 25 bp, Artificial sequence
  Synthetic oligonucleotide
ggcgcgacttcgctttcggcgttcg

SEQ ID NO: 670397 - DNA, 25 bp, Artificial sequence
  Synthetic oligonucleotide
tgccagcggcgcgacttcgctttcg

SEQ ID NO: 670398 - DNA, 25 bp, Artificial sequence
  Synthetic oligonucleotide
acattgaccatcacatcggcgaaga

SEQ ID NO: 670399 - DNA, 25 bp, Artificial sequence
  Synthetic oligonucleotide
gtcgcgtgccgctgccagcggcgcg

SEQ ID NO: 670400 - DNA, 25 bp, Artificial sequence
  Synthetic oligonucleotide
accatcacatcggcgaagaacgtat

SEQ ID NO: 670401 - DNA, 25 bp, Artificial sequence
  Synthetic oligonucleotide
gcggcgcgatagtcgcgtgccgctg

SEQ ID NO: 670402 - DNA, 25 bp, Artificial sequence
  Synthetic oligonucleotide
gccagcgcggcgcgatagtcgcgtg

SEQ ID NO: 670403 - DNA, 25 bp, Artificial sequence
  Synthetic oligonucleotide
aggcgggccagcgcggcgcgatagt

SEQ ID NO: 670404 - DNA, 25 bp, Artificial sequence
  Synthetic oligonucleotide
gccgccaggcgggccagcgcggcgc

SEQ ID NO: 670405 - DNA, 25 bp, Artificial sequence
  Synthetic oligonucleotide
cgcaaggccgccaggcgggccagcg

SEQ ID NO: 670406 - DNA, 25 bp, Artificial sequence
  Synthetic oligonucleotide
ggctcgcgcaaggccgccaggcggg

SEQ ID NO: 670407 - DNA, 25 bp, Artificial sequence
  Synthetic oligonucleotide
tccaccggctcgcgcaaggccgcca

SEQ ID NO: 670408 - DNA, 25 bp, Artificial sequence
  Synthetic oligonucleotide
aacgtatccaccggctcgcgcaagg

SEQ ID NO: 670409 - DNA, 25 bp, Artificial sequence
  Synthetic oligonucleotide
gcgaagaacgtatccaccggctcgc

SEQ ID NO: 670410 - DNA, 25 bp, Artificial sequence
  Synthetic oligonucleotide
ctgtagtgaaaaaggcccggtgtcg

SEQ ID NO: 670411 - DNA, 25 bp, Artificial sequence
  Synthetic oligonucleotide
gtgccgctgccagcggcgcgacttc

SEQ ID NO: 670412 - DNA, 25 bp, Artificial sequence
  Synthetic oligonucleotide
agttgctgaagccggccgcggagcg

SEQ ID NO: 670413 - DNA, 25 bp, Artificial sequence
  Synthetic oligonucleotide
aaggcccggtgtcgcgaggacgccg

SEQ ID NO: 670414 - DNA, 25 bp, Artificial sequence
  Synthetic oligonucleotide
ggcctcgccgcccagcagacccaat

SEQ ID NO: 670415 - DNA, 25 bp, Artificial sequence
  Synthetic oligonucleotide
caaggtcggcctcgccgcccagcag

SEQ ID NO: 670416 - DNA, 25 bp, Artificial sequence
  Synthetic oligonucleotide
cgtggacaaggtcggcctcgccgcc

SEQ ID NO: 670417 - DNA, 25 bp, Artificial sequence
  Synthetic oligonucleotide
tacgacgtggacaaggtcggcctcg

SEQ ID NO: 670418 - DNA, 25 bp, Artificial sequence
  Synthetic oligonucleotide
tcggcctacgacgtggacaaggtcg

SEQ ID NO: 670419 - DNA, 25 bp, Artificial sequence
  Synthetic oligonucleotide
tgggctcggcctacgacgtggacaa

SEQ ID NO: 670420 - DNA, 25 bp, Artificial sequence
  Synthetic oligonucleotide
cccggtgggctcggcctacgacgtg

SEQ ID NO: 670421 - DNA, 25 bp, Artificial sequence
  Synthetic oligonucleotide
tggaatccttcccggtgggctcggc

SEQ ID NO: 670422 - DNA, 25 bp, Artificial sequence
  Synthetic oligonucleotide
cagcagacccaattcggcagctatg

SEQ ID NO: 670423 - DNA, 25 bp, Artificial sequence
  Synthetic oligonucleotide
tgaagccggccgcggagcgggtgga

SEQ ID NO: 670424 - DNA, 25 bp, Artificial sequence
  Synthetic oligonucleotide
acccaattcggcagctatgtgctga

SEQ ID NO: 670425 - DNA, 25 bp, Artificial sequence
  Synthetic oligonucleotide
tggaagagttgctgaagccggccgc

SEQ ID NO: 670426 - DNA, 25 bp, Artificial sequence
  Synthetic oligonucleotide
cgaccctggaagagttgctgaagcc

SEQ ID NO: 670427 - DNA, 25 bp, Artificial sequence
  Synthetic oligonucleotide
cggtgccgaccctggaagagttgct

SEQ ID NO: 670428 - DNA, 25 bp, Artificial sequence
  Synthetic oligonucleotide
acggctcggtgccgaccctggaaga

SEQ ID NO: 670429 - DNA, 25 bp, Artificial sequence
  Synthetic oligonucleotide
tgcacaacggctcggtgccgaccct

SEQ ID NO: 670430 - DNA, 25 bp, Artificial sequence
  Synthetic oligonucleotide
gtacctgcacaacggctcggtgccg

SEQ ID NO: 670431 - DNA, 25 bp, Artificial sequence
  Synthetic oligonucleotide
gcgccgtacctgcacaacggctcgg

SEQ ID NO: 670432 - DNA, 25 bp, Artificial sequence
  Synthetic oligonucleotide
gcagcggcgccgtacctgcacaacg

SEQ ID NO: 670433 - DNA, 25 bp, Artificial sequence
  Synthetic oligonucleotide
atctgggcagcggcgccgtacctgc

SEQ ID NO: 670434 - DNA, 25 bp, Artificial sequence
  Synthetic oligonucleotide
gaacctcgtcctcggacttggcgag

SEQ ID NO: 670435 - DNA, 25 bp, Artificial sequence
  Synthetic oligonucleotide
cggccgcggagcgggtggaatcctt

SEQ ID NO: 670436 - DNA, 25 bp, Artificial sequence
  Synthetic oligonucleotide
tgcggccatgagtacggcaccagcc

SEQ ID NO: 670437 - DNA, 25 bp, Artificial sequence
  Synthetic oligonucleotide
gtcctgcaggggatctgggcagcgg

SEQ ID NO: 670438 - DNA, 25 bp, Artificial sequence
  Synthetic oligonucleotide
ctgaaggtcctgtagtgaaaaaggc

SEQ ID NO: 670439 - DNA, 25 bp, Artificial sequence
  Synthetic oligonucleotide
gagtatctgaaggtcctgtagtgaa

SEQ ID NO: 670440 - DNA, 25 bp, Artificial sequence
  Synthetic oligonucleotide
ctgctggagtatctgaaggtcctgt

SEQ ID NO: 670441 - DNA, 25 bp, Artificial sequence
  Synthetic oligonucleotide
cgtgcgctgctggagtatctgaagg

SEQ ID NO: 670442 - DNA, 25 bp, Artificial sequence
  Synthetic oligonucleotide
gagaagcgtgcgctgctggagtatc

SEQ ID NO: 670443 - DNA, 25 bp, Artificial sequence
  Synthetic oligonucleotide
ggccgaggagaagcgtgcgctgctg

SEQ ID NO: 670444 - DNA, 25 bp, Artificial sequence
  Synthetic oligonucleotide
cctgtcggccgaggagaagcgtgcg

SEQ ID NO: 670445 - DNA, 25 bp, Artificial sequence
  Synthetic oligonucleotide
caccagcctgtcggccgaggagaag

SEQ ID NO: 670446 - DNA, 25 bp, Artificial sequence
  Synthetic oligonucleotide
gccgcccagcagacccaattcggca

SEQ ID NO: 670447 - DNA, 25 bp, Artificial sequence
  Synthetic oligonucleotide
catgagtacggcaccagcctgtcgg

SEQ ID NO: 670448 - DNA, 25 bp, Artificial sequence
  Synthetic oligonucleotide
tgaaaaaggcccggtgtcgcgagga

SEQ ID NO: 670449 - DNA, 25 bp, Artificial sequence
  Synthetic oligonucleotide
agccgctgcggccatgagtacggca

SEQ ID NO: 670450 - DNA, 25 bp, Artificial sequence
  Synthetic oligonucleotide
ggcaacagccgctgcggccatgagt

SEQ ID NO: 670451 - DNA, 25 bp, Artificial sequence
  Synthetic oligonucleotide
tgattccggcaacagccgctgcggc

SEQ ID NO: 670452 - DNA, 25 bp, Artificial sequence
  Synthetic oligonucleotide
cagcgtgattccggcaacagccgct

SEQ ID NO: 670453 - DNA, 25 bp, Artificial sequence
  Synthetic oligonucleotide
tgcgagcagcgtgattccggcaaca

SEQ ID NO: 670454 - DNA, 25 bp, Artificial sequence
  Synthetic oligonucleotide
accggctgcgagcagcgtgattccg

SEQ ID NO: 670455 - DNA, 25 bp, Artificial sequence
  Synthetic oligonucleotide
aagaccaccggctgcgagcagcgtg

SEQ ID NO: 670456 - DNA, 25 bp, Artificial sequence
  Synthetic oligonucleotide
gtgctgaagaccaccggctgcgagc

SEQ ID NO: 670457 - DNA, 25 bp, Artificial sequence
  Synthetic oligonucleotide
agctatgtgctgaagaccaccggct

SEQ ID NO: 670458 - DNA, 25 bp, Artificial sequence
  Synthetic oligonucleotide
ttcggcagctatgtgctgaagacca

SEQ ID NO: 670459 - DNA, 25 bp, Artificial sequence
  Synthetic oligonucleotide
tacggcaccagcctgtcggccgagg

SEQ ID NO: 670460 - DNA, 25 bp, Artificial sequence
  Synthetic oligonucleotide
ggtgtggaaggtgccggcgcccact

SEQ ID NO: 670461 - DNA, 25 bp, Artificial sequence
  Synthetic oligonucleotide
agtagttctgcagggcgagaatcag

SEQ ID NO: 670462 - DNA, 25 bp, Artificial sequence
  Synthetic oligonucleotide
ctgcccagtagttctgcagggcgag

SEQ ID NO: 670463 - DNA, 25 bp, Artificial sequence
  Synthetic oligonucleotide
cctgctctgcccagtagttctgcag

SEQ ID NO: 670464 - DNA, 25 bp, Artificial sequence
  Synthetic oligonucleotide
acgcagccctgctctgcccagtagt

SEQ ID NO: 670465 - DNA, 25 bp, Artificial sequence
  Synthetic oligonucleotide
agcaccacgcagccctgctctgccc

SEQ ID NO: 670466 - DNA, 25 bp, Artificial sequence
  Synthetic oligonucleotide
ggctgcagcaccacgcagccctgct

SEQ ID NO: 670467 - DNA, 25 bp, Artificial sequence
  Synthetic oligonucleotide
tcgtagggctgcagcaccacgcagc

SEQ ID NO: 670468 - DNA, 25 bp, Artificial sequence
  Synthetic oligonucleotide
tccatgtcgtagggctgcagcacca

SEQ ID NO: 670469 - DNA, 25 bp, Artificial sequence
  Synthetic oligonucleotide
ccacttccatgtcgtagggctgcag

SEQ ID NO: 670470 - DNA, 25 bp, Artificial sequence
  Synthetic oligonucleotide
cggctcggctggacgtaggcggcgt

SEQ ID NO: 670471 - DNA, 25 bp, Artificial sequence
  Synthetic oligonucleotide
aaggtgccggcgcccacttccatgt

SEQ ID NO: 670472 - DNA, 25 bp, Artificial sequence
  Synthetic oligonucleotide
gaatcaggtcttggaaggtgcgcac

SEQ ID NO: 670473 - DNA, 25 bp, Artificial sequence
  Synthetic oligonucleotide
ggtggcggtgtggaaggtgccggcg

SEQ ID NO: 670474 - DNA, 25 bp, Artificial sequence
  Synthetic oligonucleotide
gaggaaggtggcggtgtggaaggtg

SEQ ID NO: 670475 - DNA, 25 bp, Artificial sequence
  Synthetic oligonucleotide
tggcgcggaggaaggtggcggtgtg

SEQ ID NO: 670476 - DNA, 25 bp, Artificial sequence
  Synthetic oligonucleotide
ggccgatggcgcggaggaaggtggc

SEQ ID NO: 670477 - DNA, 25 bp, Artificial sequence
  Synthetic oligonucleotide
gtctccgggccgatggcgcggagga

SEQ ID NO: 670478 - DNA, 25 bp, Artificial sequence
  Synthetic oligonucleotide
ttccaggtctccgggccgatggcgc

SEQ ID NO: 670479 - DNA, 25 bp, Artificial sequence
  Synthetic oligonucleotide
cggcgttccaggtctccgggccgat

SEQ ID NO: 670480 - DNA, 25 bp, Artificial sequence
  Synthetic oligonucleotide
acgtaggcggcgttccaggtctccg

SEQ ID NO: 670481 - DNA, 25 bp, Artificial sequence
  Synthetic oligonucleotide
tgcaacgacgatcccctctacatgg

SEQ ID NO: 670482 - DNA, 25 bp, Artificial sequence
  Synthetic oligonucleotide
cggcgcccacttccatgtcgtaggg

SEQ ID NO: 670483 - DNA, 25 bp, Artificial sequence
  Synthetic oligonucleotide
tgaggcttcgatacaaaacgcggaa

SEQ ID NO: 670484 - DNA, 25 bp, Artificial sequence
  Synthetic oligonucleotide
atagcactcgatgccgccgacctgc

SEQ ID NO: 670485 - DNA, 25 bp, Artificial sequence
  Synthetic oligonucleotide
gctgcttctggtgcaacgacgatcc

SEQ ID NO: 670486 - DNA, 25 bp, Artificial sequence
  Synthetic oligonucleotide
tgccacgctgcttctggtgcaacga

SEQ ID NO: 670487 - DNA, 25 bp, Artificial sequence
  Synthetic oligonucleotide
gccttatgccacgctgcttctggtg

SEQ ID NO: 670488 - DNA, 25 bp, Artificial sequence
  Synthetic oligonucleotide
cggaaagccttatgccacgctgctt

SEQ ID NO: 670489 - DNA, 25 bp, Artificial sequence
  Synthetic oligonucleotide
aaaccacggaaagccttatgccacg

SEQ ID NO: 670490 - DNA, 25 bp, Artificial sequence
  Synthetic oligonucleotide
ctggaaaaccacggaaagccttatg

SEQ ID NO: 670491 - DNA, 25 bp, Artificial sequence
  Synthetic oligonucleotide
cccgattcccgcgccgcctcgcccg

SEQ ID NO: 670492 - DNA, 25 bp, Artificial sequence
  Synthetic oligonucleotide
agtatacccgattcccgcgccgcct

SEQ ID NO: 670493 - DNA, 25 bp, Artificial sequence
  Synthetic oligonucleotide
tctgcagggcgagaatcaggtcttg

SEQ ID NO: 670494 - DNA, 25 bp, Artificial sequence
  Synthetic oligonucleotide
ttcgatacaaaacgcggaagtatac

SEQ ID NO: 670495 - DNA, 25 bp, Artificial sequence
  Synthetic oligonucleotide
gggcgagaatcaggtcttggaaggt

SEQ ID NO: 670496 - DNA, 25 bp, Artificial sequence
  Synthetic oligonucleotide
ctgtgctgaggcttcgatacaaaac

SEQ ID NO: 670497 - DNA, 25 bp, Artificial sequence
  Synthetic oligonucleotide
aattcacctgtgctgaggcttcgat

SEQ ID NO: 670498 - DNA, 25 bp, Artificial sequence
  Synthetic oligonucleotide
tcacgaaattcacctgtgctgaggc

SEQ ID NO: 670499 - DNA, 25 bp, Artificial sequence
  Synthetic oligonucleotide
tctggctcacgaaattcacctgtgc

SEQ ID NO: 670500 - DNA, 25 bp, Artificial sequence
  Synthetic oligonucleotide
gcgtagtctggctcacgaaattcac

SEQ ID NO: 670501 - DNA, 25 bp, Artificial sequence
  Synthetic oligonucleotide
cggcgggcgtagtctggctcacgaa

SEQ ID NO: 670502 - DNA, 25 bp, Artificial sequence
  Synthetic oligonucleotide
tgcgcacggcgggcgtagtctggct

SEQ ID NO: 670503 - DNA, 25 bp, Artificial sequence
  Synthetic oligonucleotide
tggaaggtgcgcacggcgggcgtag

SEQ ID NO: 670504 - DNA, 25 bp, Artificial sequence
  Synthetic oligonucleotide
aggtcttggaaggtgcgcacggcgg

SEQ ID NO: 670505 - DNA, 25 bp, Artificial sequence
  Synthetic oligonucleotide
gggcggcggctcggctggacgtagg

SEQ ID NO: 670506 - DNA, 25 bp, Artificial sequence
  Synthetic oligonucleotide
cgcggaagtatacccgattcccgcg

SEQ ID NO: 670507 - DNA, 25 bp, Artificial sequence
  Synthetic oligonucleotide
ccagatttcccaacccaggccccag

SEQ ID NO: 670508 - DNA, 25 bp, Artificial sequence
  Synthetic oligonucleotide
atgtcgtggaccagcgggtcgatgc

SEQ ID NO: 670509 - DNA, 25 bp, Artificial sequence
  Synthetic oligonucleotide
aagcggatgtcgtggaccagcgggt

SEQ ID NO: 670510 - DNA, 25 bp, Artificial sequence
  Synthetic oligonucleotide
tcgacgaagcggatgtcgtggacca

SEQ ID NO: 670511 - DNA, 25 bp, Artificial sequence
  Synthetic oligonucleotide
ttgtcctcgacgaagcggatgtcgt

SEQ ID NO: 670512 - DNA, 25 bp, Artificial sequence
  Synthetic oligonucleotide
cccagttgtcctcgacgaagcggat

SEQ ID NO: 670513 - DNA, 25 bp, Artificial sequence
  Synthetic oligonucleotide
gcgactcccagttgtcctcgacgaa

SEQ ID NO: 670514 - DNA, 25 bp, Artificial sequence
  Synthetic oligonucleotide
gggtcggcgactcccagttgtcctc

SEQ ID NO: 670515 - DNA, 25 bp, Artificial sequence
  Synthetic oligonucleotide
cgccgagggtcggcgactcccagtt

SEQ ID NO: 670516 - DNA, 25 bp, Artificial sequence
  Synthetic oligonucleotide
ccccaggcgccgagggtcggcgact

SEQ ID NO: 670517 - DNA, 25 bp, Artificial sequence
  Synthetic oligonucleotide
gctggacgtaggcggcgttccaggt

SEQ ID NO: 670518 - DNA, 25 bp, Artificial sequence
  Synthetic oligonucleotide
tcccaacccaggccccaggcgccga

SEQ ID NO: 670519 - DNA, 25 bp, Artificial sequence
  Synthetic oligonucleotide
gtcgatgccgatggctttcagcgag

SEQ ID NO: 670520 - DNA, 25 bp, Artificial sequence
  Synthetic oligonucleotide
gttcagccagatttcccaacccagg

SEQ ID NO: 670521 - DNA, 25 bp, Artificial sequence
  Synthetic oligonucleotide
ccatgccgttcagccagatttccca

SEQ ID NO: 670522 - DNA, 25 bp, Artificial sequence
  Synthetic oligonucleotide
tgacttccatgccgttcagccagat

SEQ ID NO: 670523 - DNA, 25 bp, Artificial sequence
  Synthetic oligonucleotide
actgggtgacttccatgccgttcag

SEQ ID NO: 670524 - DNA, 25 bp, Artificial sequence
  Synthetic oligonucleotide
aggtgaactgggtgacttccatgcc

SEQ ID NO: 670525 - DNA, 25 bp, Artificial sequence
  Synthetic oligonucleotide
ggaagtaggtgaactgggtgacttc

SEQ ID NO: 670526 - DNA, 25 bp, Artificial sequence
  Synthetic oligonucleotide
acctgctggaagtaggtgaactggg

SEQ ID NO: 670527 - DNA, 25 bp, Artificial sequence
  Synthetic oligonucleotide
ccgccgacctgctggaagtaggtga

SEQ ID NO: 670528 - DNA, 25 bp, Artificial sequence
  Synthetic oligonucleotide
tcgatgccgccgacctgctggaagt

SEQ ID NO: 670529 - DNA, 25 bp, Artificial sequence
  Synthetic oligonucleotide
cccaggccccaggcgccgagggtcg

SEQ ID NO: 670530 - DNA, 25 bp, Artificial sequence
  Synthetic oligonucleotide
ggcttcaggaccacctgaaactggt

SEQ ID NO: 670531 - DNA, 25 bp, Artificial sequence
  Synthetic oligonucleotide
tcggtggggcggcggctcggctgga

SEQ ID NO: 670532 - DNA, 25 bp, Artificial sequence
  Synthetic oligonucleotide
cgaccgtcggtggggcggcggctcg

SEQ ID NO: 670533 - DNA, 25 bp, Artificial sequence
  Synthetic oligonucleotide
cgtagcgaccgtcggtggggcggcg

SEQ ID NO: 670534 - DNA, 25 bp, Artificial sequence
  Synthetic oligonucleotide
tctcgccgtagcgaccgtcggtggg

SEQ ID NO: 670535 - DNA, 25 bp, Artificial sequence
  Synthetic oligonucleotide
tggggttctcgccgtagcgaccgtc

SEQ ID NO: 670536 - DNA, 25 bp, Artificial sequence
  Synthetic oligonucleotide
caggcggttggggttctcgccgtag

SEQ ID NO: 670537 - DNA, 25 bp, Artificial sequence
  Synthetic oligonucleotide
gtgctgcaggcggttggggttctcg

SEQ ID NO: 670538 - DNA, 25 bp, Artificial sequence
  Synthetic oligonucleotide
gtagtagtgctgcaggcggttgggg

SEQ ID NO: 670539 - DNA, 25 bp, Artificial sequence
  Synthetic oligonucleotide
aactggtagtagtgctgcaggcggt

SEQ ID NO: 670540 - DNA, 25 bp, Artificial sequence
  Synthetic oligonucleotide
tggaccagcgggtcgatgccgatgg

SEQ ID NO: 670541 - DNA, 25 bp, Artificial sequence
  Synthetic oligonucleotide
aggaccacctgaaactggtagtagt

SEQ ID NO: 670542 - DNA, 25 bp, Artificial sequence
  Synthetic oligonucleotide
cagcgggtcgatgccgatggctttc

SEQ ID NO: 670543 - DNA, 25 bp, Artificial sequence
  Synthetic oligonucleotide
gggttcggcttcaggaccacctgaa

SEQ ID NO: 670544 - DNA, 25 bp, Artificial sequence
  Synthetic oligonucleotide
ttctccgggttcggcttcaggacca

SEQ ID NO: 670545 - DNA, 25 bp, Artificial sequence
  Synthetic oligonucleotide
tggaagttctccgggttcggcttca

SEQ ID NO: 670546 - DNA, 25 bp, Artificial sequence
  Synthetic oligonucleotide
agctcctggaagttctccgggttcg

SEQ ID NO: 670547 - DNA, 25 bp, Artificial sequence
  Synthetic oligonucleotide
ggtacagctcctggaagttctccgg

SEQ ID NO: 670548 - DNA, 25 bp, Artificial sequence
  Synthetic oligonucleotide
agccgaggtacagctcctggaagtt

SEQ ID NO: 670549 - DNA, 25 bp, Artificial sequence
  Synthetic oligonucleotide
tcagcgagccgaggtacagctcctg

SEQ ID NO: 670550 - DNA, 25 bp, Artificial sequence
  Synthetic oligonucleotide
tggctttcagcgagccgaggtacag

SEQ ID NO: 670551 - DNA, 25 bp, Artificial sequence
  Synthetic oligonucleotide
tgccgatggctttcagcgagccgag

SEQ ID NO: 670552 - DNA, 25 bp, Artificial sequence
  Synthetic oligonucleotide
gacgatcccctctacatggcctacc

SEQ ID NO: 670553 - DNA, 25 bp, Artificial sequence
  Synthetic oligonucleotide
acctgaaactggtagtagtgctgca

SEQ ID NO: 670554 - DNA, 25 bp, Artificial sequence
  Synthetic oligonucleotide
accatttcgccggtcgcgccgaggt

SEQ ID NO: 670555 - DNA, 25 bp, Artificial sequence
  Synthetic oligonucleotide
gccggcttcaacttcgtcgggccga

SEQ ID NO: 670556 - DNA, 25 bp, Artificial sequence
  Synthetic oligonucleotide
gcgcaaggccggcttcaacttcgtc

SEQ ID NO: 670557 - DNA, 25 bp, Artificial sequence
  Synthetic oligonucleotide
ggcgctgcgcaaggccggcttcaac

SEQ ID NO: 670558 - DNA, 25 bp, Artificial sequence
  Synthetic oligonucleotide
tgagcaaggcgctgcgcaaggccgg

SEQ ID NO: 670559 - DNA, 25 bp, Artificial sequence
  Synthetic oligonucleotide
aggccatgagcaaggcgctgcgcaa

SEQ ID NO: 670560 - DNA, 25 bp, Artificial sequence
  Synthetic oligonucleotide
aagccgaggccatgagcaaggcgct

SEQ ID NO: 670561 - DNA, 25 bp, Artificial sequence
  Synthetic oligonucleotide
cccggaagccgaggccatgagcaag

SEQ ID NO: 670562 - DNA, 25 bp, Artificial sequence
  Synthetic oligonucleotide
cgattaccccggaagccgaggccat

SEQ ID NO: 670563 - DNA, 25 bp, Artificial sequence
  Synthetic oligonucleotide
tgccggcgattaccccggaagccga

SEQ ID NO: 670564 - DNA, 25 bp, Artificial sequence
  Synthetic oligonucleotide
ggctggagctggacgacccggctgg

SEQ ID NO: 670565 - DNA, 25 bp, Artificial sequence
  Synthetic oligonucleotide
tcgccggtcgcgccgaggtgccggc

SEQ ID NO: 670566 - DNA, 25 bp, Artificial sequence
  Synthetic oligonucleotide
gggccgaccatctgctacgccttca

SEQ ID NO: 670567 - DNA, 25 bp, Artificial sequence
  Synthetic oligonucleotide
aagatcaaccatttcgccggtcgcg

SEQ ID NO: 670568 - DNA, 25 bp, Artificial sequence
  Synthetic oligonucleotide
agccgaagatcaaccatttcgccgg

SEQ ID NO: 670569 - DNA, 25 bp, Artificial sequence
  Synthetic oligonucleotide
gcggccagccgaagatcaaccattt

SEQ ID NO: 670570 - DNA, 25 bp, Artificial sequence
  Synthetic oligonucleotide
tcgtcggcggccagccgaagatcaa

SEQ ID NO: 670571 - DNA, 25 bp, Artificial sequence
  Synthetic oligonucleotide
ggtccttcgtcggcggccagccgaa

SEQ ID NO: 670572 - DNA, 25 bp, Artificial sequence
  Synthetic oligonucleotide
cctctggtccttcgtcggcggccag

SEQ ID NO: 670573 - DNA, 25 bp, Artificial sequence
  Synthetic oligonucleotide
tgggttcctctggtccttcgtcggc

SEQ ID NO: 670574 - DNA, 25 bp, Artificial sequence
  Synthetic oligonucleotide
ccggctgggttcctctggtccttcg

SEQ ID NO: 670575 - DNA, 25 bp, Artificial sequence
  Synthetic oligonucleotide
tctggtgcaacgacgatcccctcta

SEQ ID NO: 670576 - DNA, 25 bp, Artificial sequence
  Synthetic oligonucleotide
gtcgcgccgaggtgccggcgattac

SEQ ID NO: 670577 - DNA, 25 bp, Artificial sequence
  Synthetic oligonucleotide
actgcgaccgttacgcccaactcgt

SEQ ID NO: 670578 - DNA, 25 bp, Artificial sequence
  Synthetic oligonucleotide
acgtggaacatcggcgcgcagcata

SEQ ID NO: 670579 - DNA, 25 bp, Artificial sequence
  Synthetic oligonucleotide
tgttccacgtggaacatcggcgcgc

SEQ ID NO: 670580 - DNA, 25 bp, Artificial sequence
  Synthetic oligonucleotide
ttcggatgttccacgtggaacatcg

SEQ ID NO: 670581 - DNA, 25 bp, Artificial sequence
  Synthetic oligonucleotide
cacgttcggcggaacctcgtcctcg

SEQ ID NO: 670582 - DNA, 25 bp, Artificial sequence
  Synthetic oligonucleotide
ctgacggatgcgttcggatgttcca

SEQ ID NO: 670583 - DNA, 25 bp, Artificial sequence
  Synthetic oligonucleotide
acgcgcttggcgatcagctcgcggc

SEQ ID NO: 670584 - DNA, 25 bp, Artificial sequence
  Synthetic oligonucleotide
gccgggcgctccctgacggatgcgt

SEQ ID NO: 670585 - DNA, 25 bp, Artificial sequence
  Synthetic oligonucleotide
tcggctagccgggcgctccctgacg

SEQ ID NO: 670586 - DNA, 25 bp, Artificial sequence
  Synthetic oligonucleotide
actcgtcggctagccgggcgctccc

SEQ ID NO: 670587 - DNA, 25 bp, Artificial sequence
  Synthetic oligonucleotide
ttcaacttcgtcgggccgaccatct

SEQ ID NO: 670588 - DNA, 25 bp, Artificial sequence
  Synthetic oligonucleotide
ccgttacgcccaactcgtcggctag

SEQ ID NO: 670589 - DNA, 25 bp, Artificial sequence
  Synthetic oligonucleotide
ttcgtcgggccgaccatctgctacg

SEQ ID NO: 670590 - DNA, 25 bp, Artificial sequence
  Synthetic oligonucleotide
cccaggactgcgaccgttacgccca

SEQ ID NO: 670591 - DNA, 25 bp, Artificial sequence
  Synthetic oligonucleotide
accatacccaggactgcgaccgtta

SEQ ID NO: 670592 - DNA, 25 bp, Artificial sequence
  Synthetic oligonucleotide
gtcatggaccatacccaggactgcg

SEQ ID NO: 670593 - DNA, 25 bp, Artificial sequence
  Synthetic oligonucleotide
ggcatggtcatggaccatacccagg

SEQ ID NO: 670594 - DNA, 25 bp, Artificial sequence
  Synthetic oligonucleotide
gccagcggcatggtcatggaccata

SEQ ID NO: 670595 - DNA, 25 bp, Artificial sequence
  Synthetic oligonucleotide
atgcaggccagcggcatggtcatgg

SEQ ID NO: 670596 - DNA, 25 bp, Artificial sequence
  Synthetic oligonucleotide
gccttcatgcaggccagcggcatgg

SEQ ID NO: 670597 - DNA, 25 bp, Artificial sequence
  Synthetic oligonucleotide
tgctacgccttcatgcaggccagcg

SEQ ID NO: 670598 - DNA, 25 bp, Artificial sequence
  Synthetic oligonucleotide
gaccatctgctacgccttcatgcag

SEQ ID NO: 670599 - DNA, 25 bp, Artificial sequence
  Synthetic oligonucleotide
aggcctggctggagctggacgaccc

SEQ ID NO: 670600 - DNA, 25 bp, Artificial sequence
  Synthetic oligonucleotide
cgcccaactcgtcggctagccgggc

SEQ ID NO: 670601 - DNA, 25 bp, Artificial sequence
  Synthetic oligonucleotide
acgcgctgttcgaacttctgctgct

SEQ ID NO: 670602 - DNA, 25 bp, Artificial sequence
  Synthetic oligonucleotide
agaagcgcgagcgctaccgcgaggt

SEQ ID NO: 670603 - DNA, 25 bp, Artificial sequence
  Synthetic oligonucleotide
tgctgaagaagcgcgagcgctaccg

SEQ ID NO: 670604 - DNA, 25 bp, Artificial sequence
  Synthetic oligonucleotide
tcaccgtgctgaagaagcgcgagcg

SEQ ID NO: 670605 - DNA, 25 bp, Artificial sequence
  Synthetic oligonucleotide
cctggatcaccgtgctgaagaagcg

SEQ ID NO: 670606 - DNA, 25 bp, Artificial sequence
  Synthetic oligonucleotide
gattgtcctggatcaccgtgctgaa

SEQ ID NO: 670607 - DNA, 25 bp, Artificial sequence
  Synthetic oligonucleotide
aggccggattgtcctggatcaccgt

SEQ ID NO: 670608 - DNA, 25 bp, Artificial sequence
  Synthetic oligonucleotide
gcttccaggccggattgtcctggat

SEQ ID NO: 670609 - DNA, 25 bp, Artificial sequence
  Synthetic oligonucleotide
tggagggcttccaggccggattgtc

SEQ ID NO: 670610 - DNA, 25 bp, Artificial sequence
  Synthetic oligonucleotide
tgctgctggagggcttccaggccgg

SEQ ID NO: 670611 - DNA, 25 bp, Artificial sequence
  Synthetic oligonucleotide
agctggacgacccggctgggttcct

SEQ ID NO: 670612 - DNA, 25 bp, Artificial sequence
  Synthetic oligonucleotide
tgttcgaacttctgctgctggaggg

SEQ ID NO: 670613 - DNA, 25 bp, Artificial sequence
  Synthetic oligonucleotide
gcgaggtgctgttcggcttcgacgt

SEQ ID NO: 670614 - DNA, 25 bp, Artificial sequence
  Synthetic oligonucleotide
atcccgacgcgctgttcgaacttct

SEQ ID NO: 670615 - DNA, 25 bp, Artificial sequence
  Synthetic oligonucleotide
agcgcgatcccgacgcgctgttcga

SEQ ID NO: 670616 - DNA, 25 bp, Artificial sequence
  Synthetic oligonucleotide
gtgccgcagcgcgatcccgacgcgc

SEQ ID NO: 670617 - DNA, 25 bp, Artificial sequence
  Synthetic oligonucleotide
gtggggtgtgccgcagcgcgatccc

SEQ ID NO: 670618 - DNA, 25 bp, Artificial sequence
  Synthetic oligonucleotide
tgaggagtggggtgtgccgcagcgc

SEQ ID NO: 670619 - DNA, 25 bp, Artificial sequence
  Synthetic oligonucleotide
ccacgatgaggagtggggtgtgccg

SEQ ID NO: 670620 - DNA, 25 bp, Artificial sequence
  Synthetic oligonucleotide
ggcctaccacgatgaggagtggggt

SEQ ID NO: 670621 - DNA, 25 bp, Artificial sequence
  Synthetic oligonucleotide
ctacatggcctaccacgatgaggag

SEQ ID NO: 670622 - DNA, 25 bp, Artificial sequence
  Synthetic oligonucleotide
tcccctctacatggcctaccacgat

SEQ ID NO: 670623 - DNA, 25 bp, Artificial sequence
  Synthetic oligonucleotide
aacttctgctgctggagggcttcca

SEQ ID NO: 670624 - DNA, 25 bp, Artificial sequence
  Synthetic oligonucleotide
acgaactgatgctcgaccccggcat

SEQ ID NO: 670625 - DNA, 25 bp, Artificial sequence
  Synthetic oligonucleotide
acgcccaggcctggctggagctgga

SEQ ID NO: 670626 - DNA, 25 bp, Artificial sequence
  Synthetic oligonucleotide
gcagaacgcccaggcctggctggag

SEQ ID NO: 670627 - DNA, 25 bp, Artificial sequence
  Synthetic oligonucleotide
tgcgcggcagaacgcccaggcctgg

SEQ ID NO: 670628 - DNA, 25 bp, Artificial sequence
  Synthetic oligonucleotide
aacgctgcgcggcagaacgcccagg

SEQ ID NO: 670629 - DNA, 25 bp, Artificial sequence
  Synthetic oligonucleotide
aagctcaacgctgcgcggcagaacg

SEQ ID NO: 670630 - DNA, 25 bp, Artificial sequence
  Synthetic oligonucleotide
gggccaagctcaacgctgcgcggca

SEQ ID NO: 670631 - DNA, 25 bp, Artificial sequence
  Synthetic oligonucleotide
gcaatcgggccaagctcaacgctgc

SEQ ID NO: 670632 - DNA, 25 bp, Artificial sequence
  Synthetic oligonucleotide
tcattcgcaatcgggccaagctcaa

SEQ ID NO: 670633 - DNA, 25 bp, Artificial sequence
  Synthetic oligonucleotide
cggcatcattcgcaatcgggccaag

SEQ ID NO: 670634 - DNA, 25 bp, Artificial sequence
  Synthetic oligonucleotide
gcgagcgctaccgcgaggtgctgtt

SEQ ID NO: 670635 - DNA, 25 bp, Artificial sequence
  Synthetic oligonucleotide
tgatgctcgaccccggcatcattcg

SEQ ID NO: 670636 - DNA, 25 bp, Artificial sequence
  Synthetic oligonucleotide
gctaccgcgaggtgctgttcggctt

SEQ ID NO: 670637 - DNA, 25 bp, Artificial sequence
  Synthetic oligonucleotide
agatcgacgaactgatgctcgaccc

SEQ ID NO: 670638 - DNA, 25 bp, Artificial sequence
  Synthetic oligonucleotide
acgcggagatcgacgaactgatgct

SEQ ID NO: 670639 - DNA, 25 bp, Artificial sequence
  Synthetic oligonucleotide
tgagcgacgcggagatcgacgaact

SEQ ID NO: 670640 - DNA, 25 bp, Artificial sequence
  Synthetic oligonucleotide
cacagatgagcgacgcggagatcga

SEQ ID NO: 670641 - DNA, 25 bp, Artificial sequence
  Synthetic oligonucleotide
gggtggcacagatgagcgacgcgga

SEQ ID NO: 670642 - DNA, 25 bp, Artificial sequence
  Synthetic oligonucleotide
tgcagcgggtggcacagatgagcga

SEQ ID NO: 670643 - DNA, 25 bp, Artificial sequence
  Synthetic oligonucleotide
tcgacgtgcagcgggtggcacagat

SEQ ID NO: 670644 - DNA, 25 bp, Artificial sequence
  Synthetic oligonucleotide
tcggcttcgacgtgcagcgggtggc

SEQ ID NO: 670645 - DNA, 25 bp, Artificial sequence
  Synthetic oligonucleotide
tgctgttcggcttcgacgtgcagcg

SEQ ID NO: 670646 - DNA, 25 bp, Artificial sequence
  Synthetic oligonucleotide
cgctccctgacggatgcgttcggat

SEQ ID NO: 670647 - DNA, 25 bp, Artificial sequence
  Synthetic oligonucleotide
tcgaccccggcatcattcgcaatcg

SEQ ID NO: 670648 - DNA, 25 bp, Artificial sequence
  Synthetic oligonucleotide
tcggaccgctcttgtcgatctgctg

SEQ ID NO: 670649 - DNA, 25 bp, Artificial sequence
  Synthetic oligonucleotide
accgctggcgtcgaaggcggcctgt

SEQ ID NO: 670650 - DNA, 25 bp, Artificial sequence
  Synthetic oligonucleotide
cgggttaccgctggcgtcgaaggcg

SEQ ID NO: 670651 - DNA, 25 bp, Artificial sequence
  Synthetic oligonucleotide
ctgggtcgggttaccgctggcgtcg

SEQ ID NO: 670652 - DNA, 25 bp, Artificial sequence
  Synthetic oligonucleotide
tggcgaagcccagggcggcctgggt

SEQ ID NO: 670653 - DNA, 25 bp, Artificial sequence
  Synthetic oligonucleotide
acttcttggcgaagcccagggcggc

SEQ ID NO: 670654 - DNA, 25 bp, Artificial sequence
  Synthetic oligonucleotide
gccgcacttcttggcgaagcccagg

SEQ ID NO: 670655 - DNA, 25 bp, Artificial sequence
  Synthetic oligonucleotide
tccacgccgcacttcttggcgaagc

SEQ ID NO: 670656 - DNA, 25 bp, Artificial sequence
  Synthetic oligonucleotide
tgcagatccacgccgcacttcttgg

SEQ ID NO: 670657 - DNA, 25 bp, Artificial sequence
  Synthetic oligonucleotide
tctgctgcagatccacgccgcactt

SEQ ID NO: 670658 - DNA, 25 bp, Artificial sequence
  Synthetic oligonucleotide
ctcgataccgctgaggaaggcttcg

SEQ ID NO: 670659 - DNA, 25 bp, Artificial sequence
  Synthetic oligonucleotide
cgctcttgtcgatctgctgcagatc

SEQ ID NO: 670660 - DNA, 25 bp, Artificial sequence
  Synthetic oligonucleotide
cctgtagcggcggaccgtctaggtt

SEQ ID NO: 670661 - DNA, 25 bp, Artificial sequence
  Synthetic oligonucleotide
gcagcttcggaccgctcttgtcgat

SEQ ID NO: 670662 - DNA, 25 bp, Artificial sequence
  Synthetic oligonucleotide
tgaagcgcagcttcggaccgctctt

SEQ ID NO: 670663 - DNA, 25 bp, Artificial sequence
  Synthetic oligonucleotide
tctggatgaagcgcagcttcggacc

SEQ ID NO: 670664 - DNA, 25 bp, Artificial sequence
  Synthetic oligonucleotide
cgatggtctggatgaagcgcagctt

SEQ ID NO: 670665 - DNA, 25 bp, Artificial sequence
  Synthetic oligonucleotide
tggccggcgatggtctggatgaagc

SEQ ID NO: 670666 - DNA, 25 bp, Artificial sequence
  Synthetic oligonucleotide
gccggttggccggcgatggtctgga

SEQ ID NO: 670667 - DNA, 25 bp, Artificial sequence
  Synthetic oligonucleotide
ccggcggccggttggccggcgatgg

SEQ ID NO: 670668 - DNA, 25 bp, Artificial sequence
  Synthetic oligonucleotide
agcaggccggcggccggttggccgg

SEQ ID NO: 670669 - DNA, 25 bp, Artificial sequence
  Synthetic oligonucleotide
gcccggcagcaggccggcggccggt

SEQ ID NO: 670670 - DNA, 25 bp, Artificial sequence
  Synthetic oligonucleotide
tgtcgatctgctgcagatccacgcc

SEQ ID NO: 670671 - DNA, 25 bp, Artificial sequence
  Synthetic oligonucleotide
agcacggcgagacggcgcggcgccg

SEQ ID NO: 670672 - DNA, 25 bp, Artificial sequence
  Synthetic oligonucleotide
gcccttctcgataccgctgaggaag

SEQ ID NO: 670673 - DNA, 25 bp, Artificial sequence
  Synthetic oligonucleotide
cttgaggcccttctcgataccgctg

SEQ ID NO: 670674 - DNA, 25 bp, Artificial sequence
  Synthetic oligonucleotide
cggcagccttgaggcccttctcgat

SEQ ID NO: 670675 - DNA, 25 bp, Artificial sequence
  Synthetic oligonucleotide
tcagaccggcagccttgaggccctt

SEQ ID NO: 670676 - DNA, 25 bp, Artificial sequence
  Synthetic oligonucleotide
catagctcagaccggcagccttgag

SEQ ID NO: 670677 - DNA, 25 bp, Artificial sequence
  Synthetic oligonucleotide
cagcggcatagctcagaccggcagc

SEQ ID NO: 670678 - DNA, 25 bp, Artificial sequence
  Synthetic oligonucleotide
aacgcgcagcggcatagctcagacc

SEQ ID NO: 670679 - DNA, 25 bp, Artificial sequence
  Synthetic oligonucleotide
catagaaacgcgcagcggcatagct

SEQ ID NO: 670680 - DNA, 25 bp, Artificial sequence
  Synthetic oligonucleotide
gcgccgcatagaaacgcgcagcggc

SEQ ID NO: 670681 - DNA, 25 bp, Artificial sequence
  Synthetic oligonucleotide
ggcgtcgaaggcggcctgtagcggc

SEQ ID NO: 670682 - DNA, 25 bp, Artificial sequence
  Synthetic oligonucleotide
gcgagacggcgcggcgccgcataga

SEQ ID NO: 670683 - DNA, 25 bp, Artificial sequence
  Synthetic oligonucleotide
aaggcggcctgtagcggcggaccgt

SEQ ID NO: 670684 - DNA, 25 bp, Artificial sequence
  Synthetic oligonucleotide
tcgaccagcacggcgagacggcgcg

SEQ ID NO: 670685 - DNA, 25 bp, Artificial sequence
  Synthetic oligonucleotide
agttgctcgaccagcacggcgagac

SEQ ID NO: 670686 - DNA, 25 bp, Artificial sequence
  Synthetic oligonucleotide
acggcgagttgctcgaccagcacgg

SEQ ID NO: 670687 - DNA, 25 bp, Artificial sequence
  Synthetic oligonucleotide
tgctgcacggcgagttgctcgacca

SEQ ID NO: 670688 - DNA, 25 bp, Artificial sequence
  Synthetic oligonucleotide
tcgggctgctgcacggcgagttgct

SEQ ID NO: 670689 - DNA, 25 bp, Artificial sequence
  Synthetic oligonucleotide
gtacggtcgggctgctgcacggcga

SEQ ID NO: 670690 - DNA, 25 bp, Artificial sequence
  Synthetic oligonucleotide
ttgacggtacggtcgggctgctgca

SEQ ID NO: 670691 - DNA, 25 bp, Artificial sequence
  Synthetic oligonucleotide
ctaggttgacggtacggtcgggctg

SEQ ID NO: 670692 - DNA, 25 bp, Artificial sequence
  Synthetic oligonucleotide
agcggcggaccgtctaggttgacgg

SEQ ID NO: 670693 - DNA, 25 bp, Artificial sequence
  Synthetic oligonucleotide
tcaacgaggcctcgacgatgcccgg

SEQ ID NO: 670694 - DNA, 25 bp, Artificial sequence
  Synthetic oligonucleotide
ggcgcggcgccgcatagaaacgcgc

SEQ ID NO: 670695 - DNA, 25 bp, Artificial sequence
  Synthetic oligonucleotide
tcttccagatacgctgccgggctgg

SEQ ID NO: 670696 - DNA, 25 bp, Artificial sequence
  Synthetic oligonucleotide
gacgatgcccggcagcaggccggcg

SEQ ID NO: 670697 - DNA, 25 bp, Artificial sequence
  Synthetic oligonucleotide
tggccacgggattcgcgcccggctt

SEQ ID NO: 670698 - DNA, 25 bp, Artificial sequence
  Synthetic oligonucleotide
aagcggtggccacgggattcgcgcc

SEQ ID NO: 670699 - DNA, 25 bp, Artificial sequence
  Synthetic oligonucleotide
tgtggaagcggtggccacgggattc

SEQ ID NO: 670700 - DNA, 25 bp, Artificial sequence
  Synthetic oligonucleotide
cggattgtggaagcggtggccacgg

SEQ ID NO: 670701 - DNA, 25 bp, Artificial sequence
  Synthetic oligonucleotide
ttgtccggattgtggaagcggtggc

SEQ ID NO: 670702 - DNA, 25 bp, Artificial sequence
  Synthetic oligonucleotide
cgcacattgtccggattgtggaagc

SEQ ID NO: 670703 - DNA, 25 bp, Artificial sequence
  Synthetic oligonucleotide
gaaatacgcacattgtccggattgt

SEQ ID NO: 670704 - DNA, 25 bp, Artificial sequence
  Synthetic oligonucleotide
gggctggaaatacgcacattgtccg

SEQ ID NO: 670705 - DNA, 25 bp, Artificial sequence
  Synthetic oligonucleotide
tcgcgcccggctttctgggcgagga

SEQ ID NO: 670706 - DNA, 25 bp, Artificial sequence
  Synthetic oligonucleotide
agatacgctgccgggctggaaatac

SEQ ID NO: 670707 - DNA, 25 bp, Artificial sequence
  Synthetic oligonucleotide
ccggctttctgggcgaggatctcgc

SEQ ID NO: 670708 - DNA, 25 bp, Artificial sequence
  Synthetic oligonucleotide
cgcaggtcttccagatacgctgccg

SEQ ID NO: 670709 - DNA, 25 bp, Artificial sequence
  Synthetic oligonucleotide
gcgccgcgcaggtcttccagatacg

SEQ ID NO: 670710 - DNA, 25 bp, Artificial sequence
  Synthetic oligonucleotide
acatgagcgccgcgcaggtcttcca

SEQ ID NO: 670711 - DNA, 25 bp, Artificial sequence
  Synthetic oligonucleotide
gccagcacatgagcgccgcgcaggt

SEQ ID NO: 670712 - DNA, 25 bp, Artificial sequence
  Synthetic oligonucleotide
aatcggccagcacatgagcgccgcg

SEQ ID NO: 670713 - DNA, 25 bp, Artificial sequence
  Synthetic oligonucleotide
cggcgaaatcggccagcacatgagc

SEQ ID NO: 670714 - DNA, 25 bp, Artificial sequence
  Synthetic oligonucleotide
gctcgcggcgctcggcgaaatcggc

SEQ ID NO: 670715 - DNA, 25 bp, Artificial sequence
  Synthetic oligonucleotide
cttggcgatcagctcgcggcgctcg

SEQ ID NO: 670716 - DNA, 25 bp, Artificial sequence
  Synthetic oligonucleotide
accggatagcactcgatgccgccga

SEQ ID NO: 670717 - DNA, 25 bp, Artificial sequence
  Synthetic oligonucleotide
gatgcgttcggatgttccacgtgga

SEQ ID NO: 670718 - DNA, 25 bp, Artificial sequence
  Synthetic oligonucleotide
gctgccgggctggaaatacgcacat

SEQ ID NO: 670719 - DNA, 25 bp, Artificial sequence
  Synthetic oligonucleotide
gtcggacgcacgaactcctcgcggc

SEQ ID NO: 670720 - DNA, 25 bp, Artificial sequence
  Synthetic oligonucleotide
ggcgctcggcgaaatcggccagcac

SEQ ID NO: 670721 - DNA, 25 bp, Artificial sequence
  Synthetic oligonucleotide
ttcgttcaacgaggcctcgacgatg

SEQ ID NO: 670722 - DNA, 25 bp, Artificial sequence
  Synthetic oligonucleotide
cggcagttcgttcaacgaggcctcg

SEQ ID NO: 670723 - DNA, 25 bp, Artificial sequence
  Synthetic oligonucleotide
gggaatcggcagttcgttcaacgag

SEQ ID NO: 670724 - DNA, 25 bp, Artificial sequence
  Synthetic oligonucleotide
ccgcttgggaatcggcagttcgttc

SEQ ID NO: 670725 - DNA, 25 bp, Artificial sequence
  Synthetic oligonucleotide
gcgcatccgcttgggaatcggcagt

SEQ ID NO: 670726 - DNA, 25 bp, Artificial sequence
  Synthetic oligonucleotide
tgcccagcgcatccgcttgggaatc

SEQ ID NO: 670727 - DNA, 25 bp, Artificial sequence
  Synthetic oligonucleotide
cgagctgcccagcgcatccgcttgg

SEQ ID NO: 670728 - DNA, 25 bp, Artificial sequence
  Synthetic oligonucleotide
tcgcggcgagctgcccagcgcatcc

SEQ ID NO: 670729 - DNA, 25 bp, Artificial sequence
  Synthetic oligonucleotide
cgggattcgcgcccggctttctggg

SEQ ID NO: 670730 - DNA, 25 bp, Artificial sequence
  Synthetic oligonucleotide
cgcacgaactcctcgcggcgagctg

SEQ ID NO: 670731 - DNA, 25 bp, Artificial sequence
  Synthetic oligonucleotide
aggcctcgacgatgcccggcagcag

SEQ ID NO: 670732 - DNA, 25 bp, Artificial sequence
  Synthetic oligonucleotide
cattgggtcggacgcacgaactcct

SEQ ID NO: 670733 - DNA, 25 bp, Artificial sequence
  Synthetic oligonucleotide
accagccattgggtcggacgcacga

SEQ ID NO: 670734 - DNA, 25 bp, Artificial sequence
  Synthetic oligonucleotide
agcatcaccagccattgggtcggac

SEQ ID NO: 670735 - DNA, 25 bp, Artificial sequence
  Synthetic oligonucleotide
ccgaacagcatcaccagccattggg

SEQ ID NO: 670736 - DNA, 25 bp, Artificial sequence
  Synthetic oligonucleotide
tcgtcgccgaacagcatcaccagcc

SEQ ID NO: 670737 - DNA, 25 bp, Artificial sequence
  Synthetic oligonucleotide
accacatcgtcgccgaacagcatca

SEQ ID NO: 670738 - DNA, 25 bp, Artificial sequence
  Synthetic oligonucleotide
cactcgaccacatcgtcgccgaaca

SEQ ID NO: 670739 - DNA, 25 bp, Artificial sequence
  Synthetic oligonucleotide
atctcgcactcgaccacatcgtcgc

SEQ ID NO: 670740 - DNA, 25 bp, Artificial sequence
  Synthetic oligonucleotide
gcgaggatctcgcactcgaccacat

SEQ ID NO: 670741 - DNA, 25 bp, Artificial sequence
  Synthetic oligonucleotide
ttctgggcgaggatctcgcactcga

SEQ ID NO: 670742 - DNA, 25 bp, Artificial sequence
  Synthetic oligonucleotide
actcctcgcggcgagctgcccagcg

SEQ ID NO: 670743 - DNA, 25 bp, Artificial sequence
  Synthetic oligonucleotide
gctttcgtagaagtcgaacagttcg

SEQ ID NO: 670744 - DNA, 25 bp, Artificial sequence
  Synthetic oligonucleotide
ttgctccacctcgttctggtggaac

SEQ ID NO: 670745 - DNA, 25 bp, Artificial sequence
  Synthetic oligonucleotide
agtggattgctccacctcgttctgg

SEQ ID NO: 670746 - DNA, 25 bp, Artificial sequence
  Synthetic oligonucleotide
gttgaaagtggattgctccacctcg

SEQ ID NO: 670747 - DNA, 25 bp, Artificial sequence
  Synthetic oligonucleotide
ctcgaagttgaaagtggattgctcc

SEQ ID NO: 670748 - DNA, 25 bp, Artificial sequence
  Synthetic oligonucleotide
ggcgtgctcgaagttgaaagtggat

SEQ ID NO: 670749 - DNA, 25 bp, Artificial sequence
  Synthetic oligonucleotide
cacgttggcgtgctcgaagttgaaa

SEQ ID NO: 670750 - DNA, 25 bp, Artificial sequence
  Synthetic oligonucleotide
cttcggcacgttggcgtgctcgaag

SEQ ID NO: 670751 - DNA, 25 bp, Artificial sequence
  Synthetic oligonucleotide
gaacagcttcggcacgttggcgtgc

SEQ ID NO: 670752 - DNA, 25 bp, Artificial sequence
  Synthetic oligonucleotide
cagttcgaacagcttcggcacgttg

SEQ ID NO: 670753 - DNA, 25 bp, Artificial sequence
  Synthetic oligonucleotide
tgaggaccatctcgtaggtcggcaa

SEQ ID NO: 670754 - DNA, 25 bp, Artificial sequence
  Synthetic oligonucleotide
gtagaagtcgaacagttcgaacagc

SEQ ID NO: 670755 - DNA, 25 bp, Artificial sequence
  Synthetic oligonucleotide
tggtggaacacgtcgccataggtga

SEQ ID NO: 670756 - DNA, 25 bp, Artificial sequence
  Synthetic oligonucleotide
ggcttcgctttcgtagaagtcgaac

SEQ ID NO: 670757 - DNA, 25 bp, Artificial sequence
  Synthetic oligonucleotide
gcggttggcttcgctttcgtagaag

SEQ ID NO: 670758 - DNA, 25 bp, Artificial sequence
  Synthetic oligonucleotide
gatcaggcggttggcttcgctttcg

SEQ ID NO: 670759 - DNA, 25 bp, Artificial sequence
  Synthetic oligonucleotide
cagcgcgatcaggcggttggcttcg

SEQ ID NO: 670760 - DNA, 25 bp, Artificial sequence
  Synthetic oligonucleotide
agctccagcgcgatcaggcggttgg

SEQ ID NO: 670761 - DNA, 25 bp, Artificial sequence
  Synthetic oligonucleotide
aacggcagctccagcgcgatcaggc

SEQ ID NO: 670762 - DNA, 25 bp, Artificial sequence
  Synthetic oligonucleotide
tcggcaacggcagctccagcgcgat

SEQ ID NO: 670763 - DNA, 25 bp, Artificial sequence
  Synthetic oligonucleotide
cgtaggtcggcaacggcagctccag

SEQ ID NO: 670764 - DNA, 25 bp, Artificial sequence
  Synthetic oligonucleotide
ccatctcgtaggtcggcaacggcag

SEQ ID NO: 670765 - DNA, 25 bp, Artificial sequence
  Synthetic oligonucleotide
gtcgaacagttcgaacagcttcggc

SEQ ID NO: 670766 - DNA, 25 bp, Artificial sequence
  Synthetic oligonucleotide
agaccgagtccacgccctgcaggta

SEQ ID NO: 670767 - DNA, 25 bp, Artificial sequence
  Synthetic oligonucleotide
tctcgccggtgaccggatagcactc

SEQ ID NO: 670768 - DNA, 25 bp, Artificial sequence
  Synthetic oligonucleotide
gatcagctcgcggcgctcggcgaaa

SEQ ID NO: 670769 - DNA, 25 bp, Artificial sequence
  Synthetic oligonucleotide
taccgctgaggaaggcttcgccgag

SEQ ID NO: 670770 - DNA, 25 bp, Artificial sequence
  Synthetic oligonucleotide
cggtgaccggatagcactcgatgcc

SEQ ID NO: 670771 - DNA, 25 bp, Artificial sequence
  Synthetic oligonucleotide
aggtgatctcgccggtgaccggata

SEQ ID NO: 670772 - DNA, 25 bp, Artificial sequence
  Synthetic oligonucleotide
gctccaggccgtaggtgatctcgcc

SEQ ID NO: 670773 - DNA, 25 bp, Artificial sequence
  Synthetic oligonucleotide
ccaggcgctccaggccgtaggtgat

SEQ ID NO: 670774 - DNA, 25 bp, Artificial sequence
  Synthetic oligonucleotide
tacatggccaggcgctccaggccgt

SEQ ID NO: 670775 - DNA, 25 bp, Artificial sequence
  Synthetic oligonucleotide
tgcaggtacatggccaggcgctcca

SEQ ID NO: 670776 - DNA, 25 bp, Artificial sequence
  Synthetic oligonucleotide
ccacctcgttctggtggaacacgtc

SEQ ID NO: 670777 - DNA, 25 bp, Artificial sequence
  Synthetic oligonucleotide
agtccacgccctgcaggtacatggc

SEQ ID NO: 670778 - DNA, 25 bp, Artificial sequence
  Synthetic oligonucleotide
cgttctggtggaacacgtcgccata

SEQ ID NO: 670779 - DNA, 25 bp, Artificial sequence
  Synthetic oligonucleotide
ggtcgtagaccgagtccacgccctg

SEQ ID NO: 670780 - DNA, 25 bp, Artificial sequence
  Synthetic oligonucleotide
agaccaggtcgtagaccgagtccac

SEQ ID NO: 670781 - DNA, 25 bp, Artificial sequence
  Synthetic oligonucleotide
cggtccagaccaggtcgtagaccga

SEQ ID NO: 670782 - DNA, 25 bp, Artificial sequence
  Synthetic oligonucleotide
ggccgtcggtccagaccaggtcgta

SEQ ID NO: 670783 - DNA, 25 bp, Artificial sequence
  Synthetic oligonucleotide
cgaacgggccgtcggtccagaccag

SEQ ID NO: 670784 - DNA, 25 bp, Artificial sequence
  Synthetic oligonucleotide
cttgccgaacgggccgtcggtccag

SEQ ID NO: 670785 - DNA, 25 bp, Artificial sequence
  Synthetic oligonucleotide
ataggtgaccttgccgaacgggccg

SEQ ID NO: 670786 - DNA, 25 bp, Artificial sequence
  Synthetic oligonucleotide
tcgccataggtgaccttgccgaacg

SEQ ID NO: 670787 - DNA, 25 bp, Artificial sequence
  Synthetic oligonucleotide
aacacgtcgccataggtgaccttgc

SEQ ID NO: 670788 - DNA, 25 bp, Artificial sequence
  Synthetic oligonucleotide
ggccgtaggtgatctcgccggtgac

SEQ ID NO: 670789 - DNA, 25 bp, Artificial sequence
  Synthetic oligonucleotide
cgccctgcaggtacatggccaggcg

SEQ ID NO: 670790 - DNA, 25 bp, Artificial sequence
  Synthetic oligonucleotide
cgaccaggaaatccttggcgctcat

SEQ ID NO: 670791 - DNA, 25 bp, Artificial sequence
  Synthetic oligonucleotide
cgggggtggccatggggaagccgag

SEQ ID NO: 670792 - DNA, 25 bp, Artificial sequence
  Synthetic oligonucleotide
gcaattcgggggtggccatggggaa

SEQ ID NO: 670793 - DNA, 25 bp, Artificial sequence
  Synthetic oligonucleotide
cgtcacgcaattcgggggtggccat

SEQ ID NO: 670794 - DNA, 25 bp, Artificial sequence
  Synthetic oligonucleotide
tacttcgtcacgcaattcgggggtg

SEQ ID NO: 670795 - DNA, 25 bp, Artificial sequence
  Synthetic oligonucleotide
ggccagtacttcgtcacgcaattcg

SEQ ID NO: 670796 - DNA, 25 bp, Artificial sequence
  Synthetic oligonucleotide
cagcttggccagtacttcgtcacgc

SEQ ID NO: 670797 - DNA, 25 bp, Artificial sequence
  Synthetic oligonucleotide
ctccttcagcttggccagtacttcg

SEQ ID NO: 670798 - DNA, 25 bp, Artificial sequence
  Synthetic oligonucleotide
ttcggcctccttcagcttggccagt

SEQ ID NO: 670799 - DNA, 25 bp, Artificial sequence
  Synthetic oligonucleotide
tcatcattcggcctccttcagcttg

SEQ ID NO: 670800 - DNA, 25 bp, Artificial sequence
  Synthetic oligonucleotide
tggccatggggaagccgaggcgcgc

SEQ ID NO: 670801 - DNA, 25 bp, Artificial sequence
  Synthetic oligonucleotide
gaaatccttggcgctcatcattcgg

SEQ ID NO: 670802 - DNA, 25 bp, Artificial sequence
  Synthetic oligonucleotide
tgagggcttttggcggcagctcttc

SEQ ID NO: 670803 - DNA, 25 bp, Artificial sequence
  Synthetic oligonucleotide
ccagttcgaccaggaaatccttggc

SEQ ID NO: 670804 - DNA, 25 bp, Artificial sequence
  Synthetic oligonucleotide
cggtgcccagttcgaccaggaaatc

SEQ ID NO: 670805 - DNA, 25 bp, Artificial sequence
  Synthetic oligonucleotide
gctcttcggtgcccagttcgaccag

SEQ ID NO: 670806 - DNA, 25 bp, Artificial sequence
  Synthetic oligonucleotide
gcggcagctcttcggtgcccagttc

SEQ ID NO: 670807 - DNA, 25 bp, Artificial sequence
  Synthetic oligonucleotide
cttttggcggcagctcttcggtgcc

SEQ ID NO: 670808 - DNA, 25 bp, Artificial sequence
  Synthetic oligonucleotide
tgaggaaggcttcgccgaggctgtt

SEQ ID NO: 670809 - DNA, 25 bp, Artificial sequence
  Synthetic oligonucleotide
gctgttgagggcttttggcggcagc

SEQ ID NO: 670810 - DNA, 25 bp, Artificial sequence
  Synthetic oligonucleotide
cgccgaggctgttgagggcttttgg

SEQ ID NO: 670811 - DNA, 25 bp, Artificial sequence
  Synthetic oligonucleotide
aagccttgaggaccatctcgtaggt

SEQ ID NO: 670812 - DNA, 25 bp, Artificial sequence
  Synthetic oligonucleotide
aggcttcgccgaggctgttgagggc

SEQ ID NO: 670813 - DNA, 25 bp, Artificial sequence
  Synthetic oligonucleotide
ttggcgctcatcattcggcctcctt

SEQ ID NO: 670814 - DNA, 25 bp, Artificial sequence
  Synthetic oligonucleotide
catccagcaggttgaaggtatgcga

SEQ ID NO: 670815 - DNA, 25 bp, Artificial sequence
  Synthetic oligonucleotide
tggggaagccgaggcgcgcgcgggc

SEQ ID NO: 670816 - DNA, 25 bp, Artificial sequence
  Synthetic oligonucleotide
tgaaggtatgcgaagccttgaggac

SEQ ID NO: 670817 - DNA, 25 bp, Artificial sequence
  Synthetic oligonucleotide
gcaggttgaaggtatgcgaagcctt

SEQ ID NO: 670818 - DNA, 25 bp, Artificial sequence
  Synthetic oligonucleotide
gccgcgcatccagcaggttgaaggt

SEQ ID NO: 670819 - DNA, 25 bp, Artificial sequence
  Synthetic oligonucleotide
tggcgcgccgcgcatccagcaggtt

SEQ ID NO: 670820 - DNA, 25 bp, Artificial sequence
  Synthetic oligonucleotide
ccgagatggcgcgccgcgcatccag

SEQ ID NO: 670821 - DNA, 25 bp, Artificial sequence
  Synthetic oligonucleotide
tatgcgaagccttgaggaccatctc

SEQ ID NO: 670822 - DNA, 25 bp, Artificial sequence
  Synthetic oligonucleotide
cggtgaccgagatggcgcgccgcgc

SEQ ID NO: 670823 - DNA, 25 bp, Artificial sequence
  Synthetic oligonucleotide
ggcgctcggtgaccgagatggcgcg

SEQ ID NO: 670824 - DNA, 25 bp, Artificial sequence
  Synthetic oligonucleotide
agcgctggcgctcggtgaccgagat

SEQ ID NO: 670825 - DNA, 25 bp, Artificial sequence
  Synthetic oligonucleotide
gatgtagcgctggcgctcggtgacc

SEQ ID NO: 670826 - DNA, 25 bp, Artificial sequence
  Synthetic oligonucleotide
cgggcctgcaggtagctctgcgcca

SEQ ID NO: 670827 - DNA, 25 bp, Artificial sequence
  Synthetic oligonucleotide
gcgaaggatgtagcgctggcgctcg

SEQ ID NO: 670828 - DNA, 25 bp, Artificial sequence
  Synthetic oligonucleotide
agccgaggcgcgcgcgggcctgcag

SEQ ID NO: 670829 - DNA, 25 bp, Artificial sequence
  Synthetic oligonucleotide
gcgcgcgcgggcctgcaggtagctc

SEQ ID NO: 670830 - DNA, 25 bp, Artificial sequence
  Synthetic oligonucleotide
tgcaggtagctctgcgccacggcgc

SEQ ID NO: 670831 - DNA, 25 bp, Artificial sequence
  Synthetic oligonucleotide
tagctctgcgccacggcgcgggcca

SEQ ID NO: 670832 - DNA, 25 bp, Artificial sequence
  Synthetic oligonucleotide
tgcgccacggcgcgggccagggtac

SEQ ID NO: 670833 - DNA, 25 bp, Artificial sequence
  Synthetic oligonucleotide
acggcgcgggccagggtacgcacgc

SEQ ID NO: 670834 - DNA, 25 bp, Artificial sequence
  Synthetic oligonucleotide
cgggccagggtacgcacgcgaagga

SEQ ID NO: 670835 - DNA, 25 bp, Artificial sequence
  Synthetic oligonucleotide
agggtacgcacgcgaaggatgtagc

SEQ ID NO: 670836 - DNA, 25 bp, Artificial sequence
  Synthetic oligonucleotide
cgcacgcgaaggatgtagcgctggc

SEQ ID NO: 670837 - DNA, 25 bp, Artificial sequence
  Synthetic oligonucleotide
tctatcgcggccagtgcgccgagct

SEQ ID NO: 670838 - DNA, 25 bp, Artificial sequence
  Synthetic oligonucleotide
gtgggtgccggccttcgcggtcaag

SEQ ID NO: 670839 - DNA, 25 bp, Artificial sequence
  Synthetic oligonucleotide
acgagcccggcatctatcgcggcca

SEQ ID NO: 670840 - DNA, 25 bp, Artificial sequence
  Synthetic oligonucleotide
aggtcgacgagcccggcatctatcg

SEQ ID NO: 670841 - DNA, 25 bp, Artificial sequence
  Synthetic oligonucleotide
ggaccaaggtcgacgagcccggcat

SEQ ID NO: 670842 - DNA, 25 bp, Artificial sequence
  Synthetic oligonucleotide
aggcctggaccaaggtcgacgagcc

SEQ ID NO: 670843 - DNA, 25 bp, Artificial sequence
  Synthetic oligonucleotide
caacgaggcctggaccaaggtcgac

SEQ ID NO: 670844 - DNA, 25 bp, Artificial sequence
  Synthetic oligonucleotide
cttcgtcaacgaggcctggaccaag

SEQ ID NO: 670845 - DNA, 25 bp, Artificial sequence
  Synthetic oligonucleotide
cccggcttcgtcaacgaggcctgga

SEQ ID NO: 670846 - DNA, 25 bp, Artificial sequence
  Synthetic oligonucleotide
ccggcatctatcgcggccagtgcgc

SEQ ID NO: 670847 - DNA, 25 bp, Artificial sequence
  Synthetic oligonucleotide
cgccatccccggcttcgtcaacgag

SEQ ID NO: 670848 - DNA, 25 bp, Artificial sequence
  Synthetic oligonucleotide
gcgcgacgccatccccggcttcgtc

SEQ ID NO: 670849 - DNA, 25 bp, Artificial sequence
  Synthetic oligonucleotide
ggtcaagcgcgacgccatccccggc

SEQ ID NO: 670850 - DNA, 25 bp, Artificial sequence
  Synthetic oligonucleotide
tccagcgacgtgatccattcctggt

SEQ ID NO: 670851 - DNA, 25 bp, Artificial sequence
  Synthetic oligonucleotide
gccggccttcgcggtcaagcgcgac

SEQ ID NO: 670852 - DNA, 25 bp, Artificial sequence
  Synthetic oligonucleotide
ttcctggtgggtgccggccttcgcg

SEQ ID NO: 670853 - DNA, 25 bp, Artificial sequence
  Synthetic oligonucleotide
atccattcctggtgggtgccggcct

SEQ ID NO: 670854 - DNA, 25 bp, Artificial sequence
  Synthetic oligonucleotide
gacgtgatccattcctggtgggtgc

SEQ ID NO: 670855 - DNA, 25 bp, Artificial sequence
  Synthetic oligonucleotide
cccaaggccgagttcgaccagtggc

SEQ ID NO: 670856 - DNA, 25 bp, Artificial sequence
  Synthetic oligonucleotide
atcacctccagcgacgtgatccatt

SEQ ID NO: 670857 - DNA, 25 bp, Artificial sequence
  Synthetic oligonucleotide
cttcgcggtcaagcgcgacgccatc

SEQ ID NO: 670858 - DNA, 25 bp, Artificial sequence
  Synthetic oligonucleotide
gtcaagcccaaggccgagttcgacc

SEQ ID NO: 670859 - DNA, 25 bp, Artificial sequence
  Synthetic oligonucleotide
agcaaggagtggaccaaggaagagt

SEQ ID NO: 670860 - DNA, 25 bp, Artificial sequence
  Synthetic oligonucleotide
ggccaggacgtcgagtacttcagca

SEQ ID NO: 670861 - DNA, 25 bp, Artificial sequence
  Synthetic oligonucleotide
aaggaactgaccagcaaggagtgga

SEQ ID NO: 670862 - DNA, 25 bp, Artificial sequence
  Synthetic oligonucleotide
aaggtcaaggaactgaccagcaagg

SEQ ID NO: 670863 - DNA, 25 bp, Artificial sequence
  Synthetic oligonucleotide
gcggcgaaggtcaaggaactgacca

SEQ ID NO: 670864 - DNA, 25 bp, Artificial sequence
  Synthetic oligonucleotide
ggaagaggcggcgaaggtcaaggaa

SEQ ID NO: 670865 - DNA, 25 bp, Artificial sequence
  Synthetic oligonucleotide
agcgcaaggaagaggcggcgaaggt

SEQ ID NO: 670866 - DNA, 25 bp, Artificial sequence
  Synthetic oligonucleotide
tggccaagcgcaaggaagaggcggc

SEQ ID NO: 670867 - DNA, 25 bp, Artificial sequence
  Synthetic oligonucleotide
agtggctggccaagcgcaaggaaga

SEQ ID NO: 670868 - DNA, 25 bp, Artificial sequence
  Synthetic oligonucleotide
gtcgacgtcaagcccaaggccgagt

SEQ ID NO: 670869 - DNA, 25 bp, Artificial sequence
  Synthetic oligonucleotide
ccgagttcgaccagtggctggccaa

SEQ ID NO: 670870 - DNA, 25 bp, Artificial sequence
  Synthetic oligonucleotide
cggccagtgcgccgagctgtgcggc

SEQ ID NO: 670871 - DNA, 25 bp, Artificial sequence
  Synthetic oligonucleotide
ctgaccagcaaggagtggaccaagg

SEQ ID NO: 670872 - DNA, 25 bp, Artificial sequence
  Synthetic oligonucleotide
tcgtggtcgacgtcaagcccaaggc

SEQ ID NO: 670873 - DNA, 25 bp, Artificial sequence
  Synthetic oligonucleotide
tgccgatcgtggtcgacgtcaagcc

SEQ ID NO: 670874 - DNA, 25 bp, Artificial sequence
  Synthetic oligonucleotide
gcttcatgccgatcgtggtcgacgt

SEQ ID NO: 670875 - DNA, 25 bp, Artificial sequence
  Synthetic oligonucleotide
accacggcttcatgccgatcgtggt

SEQ ID NO: 670876 - DNA, 25 bp, Artificial sequence
  Synthetic oligonucleotide
gcaaggaccacggcttcatgccgat

SEQ ID NO: 670877 - DNA, 25 bp, Artificial sequence
  Synthetic oligonucleotide
tgtgcggcaaggaccacggcttcat

SEQ ID NO: 670878 - DNA, 25 bp, Artificial sequence
  Synthetic oligonucleotide
cgagctgtgcggcaaggaccacggc

SEQ ID NO: 670879 - DNA, 25 bp, Artificial sequence
  Synthetic oligonucleotide
gtgcgccgagctgtgcggcaaggac

SEQ ID NO: 670880 - DNA, 25 bp, Artificial sequence
  Synthetic oligonucleotide
tcgaccagtggctggccaagcgcaa

SEQ ID NO: 670881 - DNA, 25 bp, Artificial sequence
  Synthetic oligonucleotide
caccctgatccacatctacgacact

SEQ ID NO: 670882 - DNA, 25 bp, Artificial sequence
  Synthetic oligonucleotide
tggaagtggcagtacaagtacctgg

SEQ ID NO: 670883 - DNA, 25 bp, Artificial sequence
  Synthetic oligonucleotide
accagtggaagtggcagtacaagta

SEQ ID NO: 670884 - DNA, 25 bp, Artificial sequence
  Synthetic oligonucleotide
ccggctaccagtggaagtggcagta

SEQ ID NO: 670885 - DNA, 25 bp, Artificial sequence
  Synthetic oligonucleotide
aggtcaccggctaccagtggaagtg

SEQ ID NO: 670886 - DNA, 25 bp, Artificial sequence
  Synthetic oligonucleotide
acgtgcaggtcaccggctaccagtg

SEQ ID NO: 670887 - DNA, 25 bp, Artificial sequence
  Synthetic oligonucleotide
agctggacgtgcaggtcaccggcta

SEQ ID NO: 670888 - DNA, 25 bp, Artificial sequence
  Synthetic oligonucleotide
agccggagctggacgtgcaggtcac

SEQ ID NO: 670889 - DNA, 25 bp, Artificial sequence
  Synthetic oligonucleotide
cttccgagccggagctggacgtgca

SEQ ID NO: 670890 - DNA, 25 bp, Artificial sequence
  Synthetic oligonucleotide
acgacacttccgagccggagctgga

SEQ ID NO: 670891 - DNA, 25 bp, Artificial sequence
  Synthetic oligonucleotide
gagtacttcagcaacctggccaccc

SEQ ID NO: 670892 - DNA, 25 bp, Artificial sequence
  Synthetic oligonucleotide
gatccacatctacgacacttccgag

SEQ ID NO: 670893 - DNA, 25 bp, Artificial sequence
  Synthetic oligonucleotide
tacctgggccaggacgtcgagtact

SEQ ID NO: 670894 - DNA, 25 bp, Artificial sequence
  Synthetic oligonucleotide
cacccgcaccctgatccacatctac

SEQ ID NO: 670895 - DNA, 25 bp, Artificial sequence
  Synthetic oligonucleotide
gcccgccacccgcaccctgatccac

SEQ ID NO: 670896 - DNA, 25 bp, Artificial sequence
  Synthetic oligonucleotide
tggcggtgcccgccacccgcaccct

SEQ ID NO: 670897 - DNA, 25 bp, Artificial sequence
  Synthetic oligonucleotide
tggtgatggcggtgcccgccacccg

SEQ ID NO: 670898 - DNA, 25 bp, Artificial sequence
  Synthetic oligonucleotide
tcctggtggtgatggcggtgcccgc

SEQ ID NO: 670899 - DNA, 25 bp, Artificial sequence
  Synthetic oligonucleotide
tcgtgatcctggtggtgatggcggt

SEQ ID NO: 670900 - DNA, 25 bp, Artificial sequence
  Synthetic oligonucleotide
tggtcaccccgaaagacgtcgtcgc

SEQ ID NO: 670901 - DNA, 25 bp, Artificial sequence
  Synthetic oligonucleotide
cggtggtgccgttcgtgatcctggt

SEQ ID NO: 670902 - DNA, 25 bp, Artificial sequence
  Synthetic oligonucleotide
tctggacggtggtgccgttcgtgat

SEQ ID NO: 670903 - DNA, 25 bp, Artificial sequence
  Synthetic oligonucleotide
catctacgacacttccgagccggag

SEQ ID NO: 670904 - DNA, 25 bp, Artificial sequence
  Synthetic oligonucleotide
aggcgaaggacgagcattacctgct

SEQ ID NO: 670905 - DNA, 25 bp, Artificial sequence
  Synthetic oligonucleotide
gtgcgcttcctgatcacctccagcg

SEQ ID NO: 670906 - DNA, 25 bp, Artificial sequence
  Synthetic oligonucleotide
accaaggtgcgcttcctgatcacct

SEQ ID NO: 670907 - DNA, 25 bp, Artificial sequence
  Synthetic oligonucleotide
tgggcaccaaggtgcgcttcctgat

SEQ ID NO: 670908 - DNA, 25 bp, Artificial sequence
  Synthetic oligonucleotide
tgccggtgggcaccaaggtgcgctt

SEQ ID NO: 670909 - DNA, 25 bp, Artificial sequence
  Synthetic oligonucleotide
tggtgctgccggtgggcaccaaggt

SEQ ID NO: 670910 - DNA, 25 bp, Artificial sequence
  Synthetic oligonucleotide
agccgctggtgctgccggtgggcac

SEQ ID NO: 670911 - DNA, 25 bp, Artificial sequence
  Synthetic oligonucleotide
tggacgagccgctggtgctgccggt

SEQ ID NO: 670912 - DNA, 25 bp, Artificial sequence
  Synthetic oligonucleotide
tggaggtggacgagccgctggtgct

SEQ ID NO: 670913 - DNA, 25 bp, Artificial sequence
  Synthetic oligonucleotide
acctgctggaggtggacgagccgct

SEQ ID NO: 670914 - DNA, 25 bp, Artificial sequence
  Synthetic oligonucleotide
tggcagtacaagtacctgggccagg

SEQ ID NO: 670915 - DNA, 25 bp, Artificial sequence
  Synthetic oligonucleotide
aggacgagcattacctgctggaggt

SEQ ID NO: 670916 - DNA, 25 bp, Artificial sequence
  Synthetic oligonucleotide
tacaagtacctgggccaggacgtcg

SEQ ID NO: 670917 - DNA, 25 bp, Artificial sequence
  Synthetic oligonucleotide
accggcaggcgaaggacgagcatta

SEQ ID NO: 670918 - DNA, 25 bp, Artificial sequence
  Synthetic oligonucleotide
tccacaaccggcaggcgaaggacga

SEQ ID NO: 670919 - DNA, 25 bp, Artificial sequence
  Synthetic oligonucleotide
atcagatccacaaccggcaggcgaa

SEQ ID NO: 670920 - DNA, 25 bp, Artificial sequence
  Synthetic oligonucleotide
cgcaggatcagatccacaaccggca

SEQ ID NO: 670921 - DNA, 25 bp, Artificial sequence
  Synthetic oligonucleotide
gccaccccgcaggatcagatccaca

SEQ ID NO: 670922 - DNA, 25 bp, Artificial sequence
  Synthetic oligonucleotide
aacctggccaccccgcaggatcaga

SEQ ID NO: 670923 - DNA, 25 bp, Artificial sequence
  Synthetic oligonucleotide
ttcagcaacctggccaccccgcagg

SEQ ID NO: 670924 - DNA, 25 bp, Artificial sequence
  Synthetic oligonucleotide
tgccgttcgtgatcctggtggtgat

SEQ ID NO: 670925 - DNA, 25 bp, Artificial sequence
  Synthetic oligonucleotide
gacgtcgagtacttcagcaacctgg

SEQ ID NO: 670926 - DNA, 25 bp, Artificial sequence
  Synthetic oligonucleotide
ttcctgatcacctccagcgacgtga

SEQ ID NO: 670927 - DNA, 25 bp, Artificial sequence
  Synthetic oligonucleotide
agcattacctgctggaggtggacga

SEQ ID NO: 670928 - DNA, 25 bp, Artificial sequence
  Synthetic oligonucleotide
acgcccgaccaccatgccggcgacc

SEQ ID NO: 670929 - DNA, 25 bp, Artificial sequence
  Synthetic oligonucleotide
agacgtcgtcgcctacaagcagaaa

SEQ ID NO: 670930 - DNA, 25 bp, Artificial sequence
  Synthetic oligonucleotide
tgctgacgaccaaccacaaggacat

SEQ ID NO: 670931 - DNA, 25 bp, Artificial sequence
  Synthetic oligonucleotide
gctgggtgctgacgaccaaccacaa

SEQ ID NO: 670932 - DNA, 25 bp, Artificial sequence
  Synthetic oligonucleotide
tgatgcgctgggtgctgacgaccaa

SEQ ID NO: 670933 - DNA, 25 bp, Artificial sequence
  Synthetic oligonucleotide
agggcctgatgcgctgggtgctgac

SEQ ID NO: 670934 - DNA, 25 bp, Artificial sequence
  Synthetic oligonucleotide
cggccaagggcctgatgcgctgggt

SEQ ID NO: 670935 - DNA, 25 bp, Artificial sequence
  Synthetic oligonucleotide
cggaccggccaagggcctgatgcgc

SEQ ID NO: 670936 - DNA, 25 bp, Artificial sequence
  Synthetic oligonucleotide
ccaccacggaccggccaagggcctg

SEQ ID NO: 670937 - DNA, 25 bp, Artificial sequence
  Synthetic oligonucleotide
ggcgaccaccaccacggaccggcca

SEQ ID NO: 670938 - DNA, 25 bp, Artificial sequence
  Synthetic oligonucleotide
aaccacaaggacatcggcaccctct

SEQ ID NO: 670939 - DNA, 25 bp, Artificial sequence
  Synthetic oligonucleotide
gaccaccatgccggcgaccaccacc

SEQ ID NO: 670940 - DNA, 25 bp, Artificial sequence
  Synthetic oligonucleotide
aaggacatcggcaccctctacctgt

SEQ ID NO: 670941 - DNA, 25 bp, Artificial sequence
  Synthetic oligonucleotide
atcgatacgcccgaccaccatgccg

SEQ ID NO: 670942 - DNA, 25 bp, Artificial sequence
  Synthetic oligonucleotide
tgctgtgatcgatacgcccgaccac

SEQ ID NO: 670943 - DNA, 25 bp, Artificial sequence
  Synthetic oligonucleotide
atgagtgctgtgatcgatacgcccg

SEQ ID NO: 670944 - DNA, 25 bp, Artificial sequence
  Synthetic oligonucleotide
accgccatgagtgctgtgatcgata

SEQ ID NO: 670945 - DNA, 25 bp, Artificial sequence
  Synthetic oligonucleotide
taggagaccgccatgagtgctgtga

SEQ ID NO: 670946 - DNA, 25 bp, Artificial sequence
  Synthetic oligonucleotide
acaacaataggagaccgccatgagt

SEQ ID NO: 670947 - DNA, 25 bp, Artificial sequence
  Synthetic oligonucleotide
gcagaaacaacaataggagaccgcc

SEQ ID NO: 670948 - DNA, 25 bp, Artificial sequence
  Synthetic oligonucleotide
ctacaagcagaaacaacaataggag

SEQ ID NO: 670949 - DNA, 25 bp, Artificial sequence
  Synthetic oligonucleotide
acgatggcgacatggtcaccccgaa

SEQ ID NO: 670950 - DNA, 25 bp, Artificial sequence
  Synthetic oligonucleotide
catgccggcgaccaccaccacggac

SEQ ID NO: 670951 - DNA, 25 bp, Artificial sequence
  Synthetic oligonucleotide
gatggccatggtgatccgcgccgag

SEQ ID NO: 670952 - DNA, 25 bp, Artificial sequence
  Synthetic oligonucleotide
agccggcgttcttcaaccagatgac

SEQ ID NO: 670953 - DNA, 25 bp, Artificial sequence
  Synthetic oligonucleotide
aacatagccggcggcgcgcgccggc

SEQ ID NO: 670954 - DNA, 25 bp, Artificial sequence
  Synthetic oligonucleotide
aaatcctctggacggtggtgccgtt

SEQ ID NO: 670955 - DNA, 25 bp, Artificial sequence
  Synthetic oligonucleotide
tcgtcgagccggcgttcttcaacca

SEQ ID NO: 670956 - DNA, 25 bp, Artificial sequence
  Synthetic oligonucleotide
tgcagatcgtcgagccggcgttctt

SEQ ID NO: 670957 - DNA, 25 bp, Artificial sequence
  Synthetic oligonucleotide
ccggcctgcagatcgtcgagccggc

SEQ ID NO: 670958 - DNA, 25 bp, Artificial sequence
  Synthetic oligonucleotide
tccagcccggcctgcagatcgtcga

SEQ ID NO: 670959 - DNA, 25 bp, Artificial sequence
  Synthetic oligonucleotide
agctgttccagcccggcctgcagat

SEQ ID NO: 670960 - DNA, 25 bp, Artificial sequence
  Synthetic oligonucleotide
cgccgagctgttccagcccggcctg

SEQ ID NO: 670961 - DNA, 25 bp, Artificial sequence
  Synthetic oligonucleotide
acgaccaaccacaaggacatcggca

SEQ ID NO: 670962 - DNA, 25 bp, Artificial sequence
  Synthetic oligonucleotide
catggtgatccgcgccgagctgttc

SEQ ID NO: 670963 - DNA, 25 bp, Artificial sequence
  Synthetic oligonucleotide
cccgaaagacgtcgtcgcctacaag

SEQ ID NO: 670964 - DNA, 25 bp, Artificial sequence
  Synthetic oligonucleotide
cggctcgatggccatggtgatccgc

SEQ ID NO: 670965 - DNA, 25 bp, Artificial sequence
  Synthetic oligonucleotide
tgctcggcggctcgatggccatggt

SEQ ID NO: 670966 - DNA, 25 bp, Artificial sequence
  Synthetic oligonucleotide
tgttcctgctcggcggctcgatggc

SEQ ID NO: 670967 - DNA, 25 bp, Artificial sequence
  Synthetic oligonucleotide
tcatgatgttcctgctcggcggctc

SEQ ID NO: 670968 - DNA, 25 bp, Artificial sequence
  Synthetic oligonucleotide
cagcttcatgatgttcctgctcggc

SEQ ID NO: 670969 - DNA, 25 bp, Artificial sequence
  Synthetic oligonucleotide
gtggttcagcttcatgatgttcctg

SEQ ID NO: 670970 - DNA, 25 bp, Artificial sequence
  Synthetic oligonucleotide
tacctgtggttcagcttcatgatgt

SEQ ID NO: 670971 - DNA, 25 bp, Artificial sequence
  Synthetic oligonucleotide
accctctacctgtggttcagcttca

SEQ ID NO: 670972 - DNA, 25 bp, Artificial sequence
  Synthetic oligonucleotide
atcggcaccctctacctgtggttca

SEQ ID NO: 670973 - DNA, 25 bp, Artificial sequence
  Synthetic oligonucleotide
gatccgcgccgagctgttccagccc

SEQ ID NO: 670974 - DNA, 25 bp, Artificial sequence
  Synthetic oligonucleotide
gcctgccaccaggccgaaggccagg

SEQ ID NO: 670975 - DNA, 25 bp, Artificial sequence
  Synthetic oligonucleotide
cgtcgcctacaagcagaaacaacaa

SEQ ID NO: 670976 - DNA, 25 bp, Artificial sequence
  Synthetic oligonucleotide
aagatcgtcaccgggcccaaggagc

SEQ ID NO: 670977 - DNA, 25 bp, Artificial sequence
  Synthetic oligonucleotide
gttcgaagatcgtcaccgggcccaa

SEQ ID NO: 670978 - DNA, 25 bp, Artificial sequence
  Synthetic oligonucleotide
tgaagggttcgaagatcgtcaccgg

SEQ ID NO: 670979 - DNA, 25 bp, Artificial sequence
  Synthetic oligonucleotide
cggcgctgaagggttcgaagatcgt

SEQ ID NO: 670980 - DNA, 25 bp, Artificial sequence
  Synthetic oligonucleotide
tgttcccggcgctgaagggttcgaa

SEQ ID NO: 670981 - DNA, 25 bp, Artificial sequence
  Synthetic oligonucleotide
cgccgatgttcccggcgctgaaggg

SEQ ID NO: 670982 - DNA, 25 bp, Artificial sequence
  Synthetic oligonucleotide
gcatgccgccgatgttcccggcgct

SEQ ID NO: 670983 - DNA, 25 bp, Artificial sequence
  Synthetic oligonucleotide
gccagggcatgccgccgatgttccc

SEQ ID NO: 670984 - DNA, 25 bp, Artificial sequence
  Synthetic oligonucleotide
ggcccaaggagcaccacctggaagt

SEQ ID NO: 670985 - DNA, 25 bp, Artificial sequence
  Synthetic oligonucleotide
caccaggccgaaggccagggcatgc

SEQ ID NO: 670986 - DNA, 25 bp, Artificial sequence
  Synthetic oligonucleotide
aggagcaccacctggaagtggtctt

SEQ ID NO: 670987 - DNA, 25 bp, Artificial sequence
  Synthetic oligonucleotide
tgcgccgcctgccaccaggccgaag

SEQ ID NO: 670988 - DNA, 25 bp, Artificial sequence
  Synthetic oligonucleotide
caccatctgcgccgcctgccaccag

SEQ ID NO: 670989 - DNA, 25 bp, Artificial sequence
  Synthetic oligonucleotide
ctaccacaccatctgcgccgcctgc

SEQ ID NO: 670990 - DNA, 25 bp, Artificial sequence
  Synthetic oligonucleotide
aaggtctaccacaccatctgcgccg

SEQ ID NO: 670991 - DNA, 25 bp, Artificial sequence
  Synthetic oligonucleotide
ggcgacaaggtctaccacaccatct

SEQ ID NO: 670992 - DNA, 25 bp, Artificial sequence
  Synthetic oligonucleotide
gcgcgcggcgacaaggtctaccaca

SEQ ID NO: 670993 - DNA, 25 bp, Artificial sequence
  Synthetic oligonucleotide
ttggttgcgcgcggcgacaaggtct

SEQ ID NO: 670994 - DNA, 25 bp, Artificial sequence
  Synthetic oligonucleotide
gaagagttggttgcgcgcggcgaca

SEQ ID NO: 670995 - DNA, 25 bp, Artificial sequence
  Synthetic oligonucleotide
accaaggaagagttggttgcgcgcg

SEQ ID NO: 670996 - DNA, 25 bp, Artificial sequence
  Synthetic oligonucleotide
ccgaaggccagggcatgccgccgat

SEQ ID NO: 670997 - DNA, 25 bp, Artificial sequence
  Synthetic oligonucleotide
ggcaagcagctcaacgaggtcgacc

SEQ ID NO: 670998 - DNA, 25 bp, Artificial sequence
  Synthetic oligonucleotide
gcgacatggtcaccccgaaagacgt

SEQ ID NO: 670999 - DNA, 25 bp, Artificial sequence
  Synthetic oligonucleotide
gcaacgacgatggcgacatggtcac

SEQ ID NO: 671000 - DNA, 25 bp, Artificial sequence
  Synthetic oligonucleotide
cctggggcaacgacgatggcgacat

SEQ ID NO: 671001 - DNA, 25 bp, Artificial sequence
  Synthetic oligonucleotide
cgcaacgcctggggcaacgacgatg

SEQ ID NO: 671002 - DNA, 25 bp, Artificial sequence
  Synthetic oligonucleotide
tacgagcgcaacgcctggggcaacg

SEQ ID NO: 671003 - DNA, 25 bp, Artificial sequence
  Synthetic oligonucleotide
atcacctacgagcgcaacgcctggg

SEQ ID NO: 671004 - DNA, 25 bp, Artificial sequence
  Synthetic oligonucleotide
cggtgatcacctacgagcgcaacgc

SEQ ID NO: 671005 - DNA, 25 bp, Artificial sequence
  Synthetic oligonucleotide
tggccgcggtgatcacctacgagcg

SEQ ID NO: 671006 - DNA, 25 bp, Artificial sequence
  Synthetic oligonucleotide
gtcgacctggccgcggtgatcacct

SEQ ID NO: 671007 - DNA, 25 bp, Artificial sequence
  Synthetic oligonucleotide
gtcaccgggcccaaggagcaccacc

SEQ ID NO: 671008 - DNA, 25 bp, Artificial sequence
  Synthetic oligonucleotide
cagctcaacgaggtcgacctggccg

SEQ ID NO: 671009 - DNA, 25 bp, Artificial sequence
  Synthetic oligonucleotide
gagtggaccaaggaagagttggttg

SEQ ID NO: 671010 - DNA, 25 bp, Artificial sequence
  Synthetic oligonucleotide
gccttcggcaagcagctcaacgagg

SEQ ID NO: 671011 - DNA, 25 bp, Artificial sequence
  Synthetic oligonucleotide
atggcggccttcggcaagcagctca

SEQ ID NO: 671012 - DNA, 25 bp, Artificial sequence
  Synthetic oligonucleotide
accgccatggcggccttcggcaagc

SEQ ID NO: 671013 - DNA, 25 bp, Artificial sequence
  Synthetic oligonucleotide
cccggcaccgccatggcggccttcg

SEQ ID NO: 671014 - DNA, 25 bp, Artificial sequence
  Synthetic oligonucleotide
ggcgtgcccggcaccgccatggcgg

SEQ ID NO: 671015 - DNA, 25 bp, Artificial sequence
  Synthetic oligonucleotide
ttcaacggcgtgcccggcaccgcca

SEQ ID NO: 671016 - DNA, 25 bp, Artificial sequence
  Synthetic oligonucleotide
gtggtcttcaacggcgtgcccggca

SEQ ID NO: 671017 - DNA, 25 bp, Artificial sequence
  Synthetic oligonucleotide
tggaagtggtcttcaacggcgtgcc

SEQ ID NO: 671018 - DNA, 25 bp, Artificial sequence
  Synthetic oligonucleotide
accacctggaagtggtcttcaacgg

SEQ ID NO: 671019 - DNA, 25 bp, Artificial sequence
  Synthetic oligonucleotide
aacgaggtcgacctggccgcggtga

SEQ ID NO: 671020 - DNA, 25 bp, Artificial sequence
  Synthetic oligonucleotide
tggacgaagcgggtgagtatgtctt

SEQ ID NO: 671021 - DNA, 25 bp, Artificial sequence
  Synthetic oligonucleotide
tgccggcttcgcgggccacgctgtt

SEQ ID NO: 671022 - DNA, 25 bp, Artificial sequence
  Synthetic oligonucleotide
gcaggtggggcaggcggctggctat

SEQ ID NO: 671023 - DNA, 25 bp, Artificial sequence
  Synthetic oligonucleotide
tgcgatgcaggtggggcaggcggct

SEQ ID NO: 671024 - DNA, 25 bp, Artificial sequence
  Synthetic oligonucleotide
gatggtgcgatgcaggtggggcagg

SEQ ID NO: 671025 - DNA, 25 bp, Artificial sequence
  Synthetic oligonucleotide
cggctggatggtgcgatgcaggtgg

SEQ ID NO: 671026 - DNA, 25 bp, Artificial sequence
  Synthetic oligonucleotide
ccttgcggctggatggtgcgatgca

SEQ ID NO: 671027 - DNA, 25 bp, Artificial sequence
  Synthetic oligonucleotide
ttctcgccttgcggctggatggtgc

SEQ ID NO: 671028 - DNA, 25 bp, Artificial sequence
  Synthetic oligonucleotide
tccgtgttctcgccttgcggctgga

SEQ ID NO: 671029 - DNA, 25 bp, Artificial sequence
  Synthetic oligonucleotide
atgtcttccgtgttctcgccttgcg

SEQ ID NO: 671030 - DNA, 25 bp, Artificial sequence
  Synthetic oligonucleotide
ggcggctggctatcagatcagccag

SEQ ID NO: 671031 - DNA, 25 bp, Artificial sequence
  Synthetic oligonucleotide
aagcgggtgagtatgtcttccgtgt

SEQ ID NO: 671032 - DNA, 25 bp, Artificial sequence
  Synthetic oligonucleotide
tggctatcagatcagccaggtgacc

SEQ ID NO: 671033 - DNA, 25 bp, Artificial sequence
  Synthetic oligonucleotide
taggcgtggacgaagcgggtgagta

SEQ ID NO: 671034 - DNA, 25 bp, Artificial sequence
  Synthetic oligonucleotide
tcgacgtaggcgtggacgaagcggg

SEQ ID NO: 671035 - DNA, 25 bp, Artificial sequence
  Synthetic oligonucleotide
cctgttcgacgtaggcgtggacgaa

SEQ ID NO: 671036 - DNA, 25 bp, Artificial sequence
  Synthetic oligonucleotide
ccggtacctgttcgacgtaggcgtg

SEQ ID NO: 671037 - DNA, 25 bp, Artificial sequence
  Synthetic oligonucleotide
cgagcaggtccggtacctgttcgac

SEQ ID NO: 671038 - DNA, 25 bp, Artificial sequence
  Synthetic oligonucleotide
gcggcgtcgagcaggtccggtacct

SEQ ID NO: 671039 - DNA, 25 bp, Artificial sequence
  Synthetic oligonucleotide
gctgttggcggcgtcgagcaggtcc

SEQ ID NO: 671040 - DNA, 25 bp, Artificial sequence
  Synthetic oligonucleotide
gggccacgctgttggcggcgtcgag

SEQ ID NO: 671041 - DNA, 25 bp, Artificial sequence
  Synthetic oligonucleotide
cgccggctaagacgcgattgtcata

SEQ ID NO: 671042 - DNA, 25 bp, Artificial sequence
  Synthetic oligonucleotide
gtgagtatgtcttccgtgttctcgc

SEQ ID NO: 671043 - DNA, 25 bp, Artificial sequence
  Synthetic oligonucleotide
agttcacggagggcagcggtgttca

SEQ ID NO: 671044 - DNA, 25 bp, Artificial sequence
  Synthetic oligonucleotide
ggcgcgcgccggctaagacgcgatt

SEQ ID NO: 671045 - DNA, 25 bp, Artificial sequence
  Synthetic oligonucleotide
aggagaaacatagccggcggcgcgc

SEQ ID NO: 671046 - DNA, 25 bp, Artificial sequence
  Synthetic oligonucleotide
agaagaggagaaacatagccggcgg

SEQ ID NO: 671047 - DNA, 25 bp, Artificial sequence
  Synthetic oligonucleotide
atggtgaagaagaggagaaacatag

SEQ ID NO: 671048 - DNA, 25 bp, Artificial sequence
  Synthetic oligonucleotide
acggggatggtgaagaagaggagaa

SEQ ID NO: 671049 - DNA, 25 bp, Artificial sequence
  Synthetic oligonucleotide
catacaacggggatggtgaagaaga

SEQ ID NO: 671050 - DNA, 25 bp, Artificial sequence
  Synthetic oligonucleotide
tctcccatacaacggggatggtgaa

SEQ ID NO: 671051 - DNA, 25 bp, Artificial sequence
  Synthetic oligonucleotide
tggggtctcccatacaacggggatg

SEQ ID NO: 671052 - DNA, 25 bp, Artificial sequence
  Synthetic oligonucleotide
tgttcatggggtctcccatacaacg

SEQ ID NO: 671053 - DNA, 25 bp, Artificial sequence
  Synthetic oligonucleotide
gggcaggcggctggctatcagatca

SEQ ID NO: 671054 - DNA, 25 bp, Artificial sequence
  Synthetic oligonucleotide
ggagggcagcggtgttcatggggtc

SEQ ID NO: 671055 - DNA, 25 bp, Artificial sequence
  Synthetic oligonucleotide
cctcgatgccggcttcgcgggccac

SEQ ID NO: 671056 - DNA, 25 bp, Artificial sequence
  Synthetic oligonucleotide
tggatgagttcacggagggcagcgg

SEQ ID NO: 671057 - DNA, 25 bp, Artificial sequence
  Synthetic oligonucleotide
gcctgctggatgagttcacggaggg

SEQ ID NO: 671058 - DNA, 25 bp, Artificial sequence
  Synthetic oligonucleotide
aggtgcgcctgctggatgagttcac

SEQ ID NO: 671059 - DNA, 25 bp, Artificial sequence
  Synthetic oligonucleotide
tcgctgaggtgcgcctgctggatga

SEQ ID NO: 671060 - DNA, 25 bp, Artificial sequence
  Synthetic oligonucleotide
cgggcttcgctgaggtgcgcctgct

SEQ ID NO: 671061 - DNA, 25 bp, Artificial sequence
  Synthetic oligonucleotide
ccgtggcgggcttcgctgaggtgcg

SEQ ID NO: 671062 - DNA, 25 bp, Artificial sequence
  Synthetic oligonucleotide
aggtgaccgtggcgggcttcgctga

SEQ ID NO: 671063 - DNA, 25 bp, Artificial sequence
  Synthetic oligonucleotide
tcagccaggtgaccgtggcgggctt

SEQ ID NO: 671064 - DNA, 25 bp, Artificial sequence
  Synthetic oligonucleotide
tcagatcagccaggtgaccgtggcg

SEQ ID NO: 671065 - DNA, 25 bp, Artificial sequence
  Synthetic oligonucleotide
cagcggtgttcatggggtctcccat

SEQ ID NO: 671066 - DNA, 25 bp, Artificial sequence
  Synthetic oligonucleotide
tggtgggccaccaggttggctacgg

SEQ ID NO: 671067 - DNA, 25 bp, Artificial sequence
  Synthetic oligonucleotide
cttcgcgggccacgctgttggcggc

SEQ ID NO: 671068 - DNA, 25 bp, Artificial sequence
  Synthetic oligonucleotide
gcgatgtagcggtcgttcacttctt

SEQ ID NO: 671069 - DNA, 25 bp, Artificial sequence
  Synthetic oligonucleotide
aagtgggcgatgtagcggtcgttca

SEQ ID NO: 671070 - DNA, 25 bp, Artificial sequence
  Synthetic oligonucleotide
tggccgaagtgggcgatgtagcggt

SEQ ID NO: 671071 - DNA, 25 bp, Artificial sequence
  Synthetic oligonucleotide
gtgcctggccgaagtgggcgatgta

SEQ ID NO: 671072 - DNA, 25 bp, Artificial sequence
  Synthetic oligonucleotide
ggatcagtgcctggccgaagtgggc

SEQ ID NO: 671073 - DNA, 25 bp, Artificial sequence
  Synthetic oligonucleotide
ccagtgggatcagtgcctggccgaa

SEQ ID NO: 671074 - DNA, 25 bp, Artificial sequence
  Synthetic oligonucleotide
tggtgtccagtgggatcagtgcctg

SEQ ID NO: 671075 - DNA, 25 bp, Artificial sequence
  Synthetic oligonucleotide
tacggtggtgtccagtgggatcagt

SEQ ID NO: 671076 - DNA, 25 bp, Artificial sequence
  Synthetic oligonucleotide
tcgttcacttcttccaccaggcggt

SEQ ID NO: 671077 - DNA, 25 bp, Artificial sequence
  Synthetic oligonucleotide
ccaccaggttggctacggtggtgtc

SEQ ID NO: 671078 - DNA, 25 bp, Artificial sequence
  Synthetic oligonucleotide
cacttcttccaccaggcggtgcgcc

SEQ ID NO: 671079 - DNA, 25 bp, Artificial sequence
  Synthetic oligonucleotide
atcaactggtgggccaccaggttgg

SEQ ID NO: 671080 - DNA, 25 bp, Artificial sequence
  Synthetic oligonucleotide
tcgccgatcaactggtgggccacca

SEQ ID NO: 671081 - DNA, 25 bp, Artificial sequence
  Synthetic oligonucleotide
aagggctcgccgatcaactggtggg

SEQ ID NO: 671082 - DNA, 25 bp, Artificial sequence
  Synthetic oligonucleotide
ttggcgaagggctcgccgatcaact

SEQ ID NO: 671083 - DNA, 25 bp, Artificial sequence
  Synthetic oligonucleotide
cagccggttggcgaagggctcgccg

SEQ ID NO: 671084 - DNA, 25 bp, Artificial sequence
  Synthetic oligonucleotide
tcgtccagccggttggcgaagggct

SEQ ID NO: 671085 - DNA, 25 bp, Artificial sequence
  Synthetic oligonucleotide
acggcttcgtccagccggttggcga

SEQ ID NO: 671086 - DNA, 25 bp, Artificial sequence
  Synthetic oligonucleotide
tggtggacggcttcgtccagccggt

SEQ ID NO: 671087 - DNA, 25 bp, Artificial sequence
  Synthetic oligonucleotide
agatgaccaccatgcacggcctgat

SEQ ID NO: 671088 - DNA, 25 bp, Artificial sequence
  Synthetic oligonucleotide
gttggctacggtggtgtccagtggg

SEQ ID NO: 671089 - DNA, 25 bp, Artificial sequence
  Synthetic oligonucleotide
gtggccggcgagcaacgccggcggg

SEQ ID NO: 671090 - DNA, 25 bp, Artificial sequence
  Synthetic oligonucleotide
tccgttcctcgatgccggcttcgcg

SEQ ID NO: 671091 - DNA, 25 bp, Artificial sequence
  Synthetic oligonucleotide
gcttgatccgttcctcgatgccggc

SEQ ID NO: 671092 - DNA, 25 bp, Artificial sequence
  Synthetic oligonucleotide
gcaccggcttgatccgttcctcgat

SEQ ID NO: 671093 - DNA, 25 bp, Artificial sequence
  Synthetic oligonucleotide
ccttcagcaccggcttgatccgttc

SEQ ID NO: 671094 - DNA, 25 bp, Artificial sequence
  Synthetic oligonucleotide
cggcgaccttcagcaccggcttgat

SEQ ID NO: 671095 - DNA, 25 bp, Artificial sequence
  Synthetic oligonucleotide
actgctcggcgaccttcagcaccgg

SEQ ID NO: 671096 - DNA, 25 bp, Artificial sequence
  Synthetic oligonucleotide
ggaagaactgctcggcgaccttcag

SEQ ID NO: 671097 - DNA, 25 bp, Artificial sequence
  Synthetic oligonucleotide
ggtgaggaagaactgctcggcgacc

SEQ ID NO: 671098 - DNA, 25 bp, Artificial sequence
  Synthetic oligonucleotide
ccggcggggtgaggaagaactgctc

SEQ ID NO: 671099 - DNA, 25 bp, Artificial sequence
  Synthetic oligonucleotide
tagcggtcgttcacttcttccacca

SEQ ID NO: 671100 - DNA, 25 bp, Artificial sequence
  Synthetic oligonucleotide
ggcgagcaacgccggcggggtgagg

SEQ ID NO: 671101 - DNA, 25 bp, Artificial sequence
  Synthetic oligonucleotide
ctaagacgcgattgtcataatcgct

SEQ ID NO: 671102 - DNA, 25 bp, Artificial sequence
  Synthetic oligonucleotide
ccgtcgtggccggcgagcaacgccg

SEQ ID NO: 671103 - DNA, 25 bp, Artificial sequence
  Synthetic oligonucleotide
tcgaggccgtcgtggccggcgagca

SEQ ID NO: 671104 - DNA, 25 bp, Artificial sequence
  Synthetic oligonucleotide
agggcgtcgaggccgtcgtggccgg

SEQ ID NO: 671105 - DNA, 25 bp, Artificial sequence
  Synthetic oligonucleotide
tcgagcagggcgtcgaggccgtcgt

SEQ ID NO: 671106 - DNA, 25 bp, Artificial sequence
  Synthetic oligonucleotide
gcttcgtcgagcagggcgtcgaggc

SEQ ID NO: 671107 - DNA, 25 bp, Artificial sequence
  Synthetic oligonucleotide
aggtaggcttcgtcgagcagggcgt

SEQ ID NO: 671108 - DNA, 25 bp, Artificial sequence
  Synthetic oligonucleotide
tgcgccaggtaggcttcgtcgagca

SEQ ID NO: 671109 - DNA, 25 bp, Artificial sequence
  Synthetic oligonucleotide
aggcggtgcgccaggtaggcttcgt

SEQ ID NO: 671110 - DNA, 25 bp, Artificial sequence
  Synthetic oligonucleotide
tccaccaggcggtgcgccaggtagg

SEQ ID NO: 671111 - DNA, 25 bp, Artificial sequence
  Synthetic oligonucleotide
gcaacgccggcggggtgaggaagaa

SEQ ID NO: 671112 - DNA, 25 bp, Artificial sequence
  Synthetic oligonucleotide
tctcggcgatcagccaggcgaatgc

SEQ ID NO: 671113 - DNA, 25 bp, Artificial sequence
  Synthetic oligonucleotide
caacgataaggggaacccgaatgct

SEQ ID NO: 671114 - DNA, 25 bp, Artificial sequence
  Synthetic oligonucleotide
aggtgagccggtccgtcttcgacct

SEQ ID NO: 671115 - DNA, 25 bp, Artificial sequence
  Synthetic oligonucleotide
ctaccgaggtgagccggtccgtctt

SEQ ID NO: 671116 - DNA, 25 bp, Artificial sequence
  Synthetic oligonucleotide
gggcgctaccgaggtgagccggtcc

SEQ ID NO: 671117 - DNA, 25 bp, Artificial sequence
  Synthetic oligonucleotide
ggccccgggcgctaccgaggtgagc

SEQ ID NO: 671118 - DNA, 25 bp, Artificial sequence
  Synthetic oligonucleotide
aacatggccccgggcgctaccgagg

SEQ ID NO: 671119 - DNA, 25 bp, Artificial sequence
  Synthetic oligonucleotide
gacggtcaacatggccccgggcgct

SEQ ID NO: 671120 - DNA, 25 bp, Artificial sequence
  Synthetic oligonucleotide
gcctggacggtcaacatggccccgg

SEQ ID NO: 671121 - DNA, 25 bp, Artificial sequence
  Synthetic oligonucleotide
gaatgccgcctggacggtcaacatg

SEQ ID NO: 671122 - DNA, 25 bp, Artificial sequence
  Synthetic oligonucleotide
ccgtcttcgacctgcacatgaccat

SEQ ID NO: 671123 - DNA, 25 bp, Artificial sequence
  Synthetic oligonucleotide
gatcagccaggcgaatgccgcctgg

SEQ ID NO: 671124 - DNA, 25 bp, Artificial sequence
  Synthetic oligonucleotide
tcgacctgcacatgaccatcttctg

SEQ ID NO: 671125 - DNA, 25 bp, Artificial sequence
  Synthetic oligonucleotide
tttgctctcggcgatcagccaggcg

SEQ ID NO: 671126 - DNA, 25 bp, Artificial sequence
  Synthetic oligonucleotide
gcttccttttgctctcggcgatcag

SEQ ID NO: 671127 - DNA, 25 bp, Artificial sequence
  Synthetic oligonucleotide
ggatgggcttccttttgctctcggc

SEQ ID NO: 671128 - DNA, 25 bp, Artificial sequence
  Synthetic oligonucleotide
gagtctggatgggcttccttttgct

SEQ ID NO: 671129 - DNA, 25 bp, Artificial sequence
  Synthetic oligonucleotide
atccacgagtctggatgggcttcct

SEQ ID NO: 671130 - DNA, 25 bp, Artificial sequence
  Synthetic oligonucleotide
tgcgacatccacgagtctggatggg

SEQ ID NO: 671131 - DNA, 25 bp, Artificial sequence
  Synthetic oligonucleotide
gaatgctgcgacatccacgagtctg

SEQ ID NO: 671132 - DNA, 25 bp, Artificial sequence
  Synthetic oligonucleotide
gaacccgaatgctgcgacatccacg

SEQ ID NO: 671133 - DNA, 25 bp, Artificial sequence
  Synthetic oligonucleotide
gccggcggcgcgcgccggctaagac

SEQ ID NO: 671134 - DNA, 25 bp, Artificial sequence
  Synthetic oligonucleotide
ccaggcgaatgccgcctggacggtc

SEQ ID NO: 671135 - DNA, 25 bp, Artificial sequence
  Synthetic oligonucleotide
gcgatgttctggtcgatgatcgtcc

SEQ ID NO: 671136 - DNA, 25 bp, Artificial sequence
  Synthetic oligonucleotide
gcaccacggtggaaatcctctggac

SEQ ID NO: 671137 - DNA, 25 bp, Artificial sequence
  Synthetic oligonucleotide
acgagagcaccacggtggaaatcct

SEQ ID NO: 671138 - DNA, 25 bp, Artificial sequence
  Synthetic oligonucleotide
acttccacgagagcaccacggtgga

SEQ ID NO: 671139 - DNA, 25 bp, Artificial sequence
  Synthetic oligonucleotide
cggcgcacttccacgagagcaccac

SEQ ID NO: 671140 - DNA, 25 bp, Artificial sequence
  Synthetic oligonucleotide
agcagccggcgcacttccacgagag

SEQ ID NO: 671141 - DNA, 25 bp, Artificial sequence
  Synthetic oligonucleotide
accggccagcagccggcgcacttcc

SEQ ID NO: 671142 - DNA, 25 bp, Artificial sequence
  Synthetic oligonucleotide
cgctccaccggccagcagccggcgc

SEQ ID NO: 671143 - DNA, 25 bp, Artificial sequence
  Synthetic oligonucleotide
caccgccgctccaccggccagcagc

SEQ ID NO: 671144 - DNA, 25 bp, Artificial sequence
  Synthetic oligonucleotide
atcgtccaccgccgctccaccggcc

SEQ ID NO: 671145 - DNA, 25 bp, Artificial sequence
  Synthetic oligonucleotide
gccggtccgtcttcgacctgcacat

SEQ ID NO: 671146 - DNA, 25 bp, Artificial sequence
  Synthetic oligonucleotide
ttctggtcgatgatcgtccaccgcc

SEQ ID NO: 671147 - DNA, 25 bp, Artificial sequence
  Synthetic oligonucleotide
tctgccggcgggataaaaacaacga

SEQ ID NO: 671148 - DNA, 25 bp, Artificial sequence
  Synthetic oligonucleotide
ttcggcgcgatgttctggtcgatga

SEQ ID NO: 671149 - DNA, 25 bp, Artificial sequence
  Synthetic oligonucleotide
ctggtcttcggcgcgatgttctggt

SEQ ID NO: 671150 - DNA, 25 bp, Artificial sequence
  Synthetic oligonucleotide
ggcgtgctggtcttcggcgcgatgt

SEQ ID NO: 671151 - DNA, 25 bp, Artificial sequence
  Synthetic oligonucleotide
gtgatcggcgtgctggtcttcggcg

SEQ ID NO: 671152 - DNA, 25 bp, Artificial sequence
  Synthetic oligonucleotide
gcgtggtgatcggcgtgctggtctt

SEQ ID NO: 671153 - DNA, 25 bp, Artificial sequence
  Synthetic oligonucleotide
ggatctgcgtggtgatcggcgtgct

SEQ ID NO: 671154 - DNA, 25 bp, Artificial sequence
  Synthetic oligonucleotide
tcttctggatctgcgtggtgatcgg

SEQ ID NO: 671155 - DNA, 25 bp, Artificial sequence
  Synthetic oligonucleotide
tgaccatcttctggatctgcgtggt

SEQ ID NO: 671156 - DNA, 25 bp, Artificial sequence
  Synthetic oligonucleotide
tgcacatgaccatcttctggatctg

SEQ ID NO: 671157 - DNA, 25 bp, Artificial sequence
  Synthetic oligonucleotide
tcgatgatcgtccaccgccgctcca

SEQ ID NO: 671158 - DNA, 25 bp, Artificial sequence
  Synthetic oligonucleotide
ccaccattcgcctgcaaagccacgc

SEQ ID NO: 671159 - DNA, 25 bp, Artificial sequence
  Synthetic oligonucleotide
taaggggaacccgaatgctgcgaca

SEQ ID NO: 671160 - DNA, 25 bp, Artificial sequence
  Synthetic oligonucleotide
cagcgacgtttttacgctgcgttgt

SEQ ID NO: 671161 - DNA, 25 bp, Artificial sequence
  Synthetic oligonucleotide
actttccagcgacgtttttacgctg

SEQ ID NO: 671162 - DNA, 25 bp, Artificial sequence
  Synthetic oligonucleotide
atcggcactttccagcgacgttttt

SEQ ID NO: 671163 - DNA, 25 bp, Artificial sequence
  Synthetic oligonucleotide
agaagaatcggcactttccagcgac

SEQ ID NO: 671164 - DNA, 25 bp, Artificial sequence
  Synthetic oligonucleotide
ttttagagaagaatcggcactttcc

SEQ ID NO: 671165 - DNA, 25 bp, Artificial sequence
  Synthetic oligonucleotide
cgcggcttttagagaagaatcggca

SEQ ID NO: 671166 - DNA, 25 bp, Artificial sequence
  Synthetic oligonucleotide
gccgctcgcggcttttagagaagaa

SEQ ID NO: 671167 - DNA, 25 bp, Artificial sequence
  Synthetic oligonucleotide
agccacgccgctcgcggcttttaga

SEQ ID NO: 671168 - DNA, 25 bp, Artificial sequence
  Synthetic oligonucleotide
tacgctgcgttgttatgtcgcagcc

SEQ ID NO: 671169 - DNA, 25 bp, Artificial sequence
  Synthetic oligonucleotide
ttcgcctgcaaagccacgccgctcg

SEQ ID NO: 671170 - DNA, 25 bp, Artificial sequence
  Synthetic oligonucleotide
gcgttgttatgtcgcagccgctgtc

SEQ ID NO: 671171 - DNA, 25 bp, Artificial sequence
  Synthetic oligonucleotide
aggcggccaccattcgcctgcaaag

SEQ ID NO: 671172 - DNA, 25 bp, Artificial sequence
  Synthetic oligonucleotide
atatcaggcggccaccattcgcctg

SEQ ID NO: 671173 - DNA, 25 bp, Artificial sequence
  Synthetic oligonucleotide
gatgatatatcaggcggccaccatt

SEQ ID NO: 671174 - DNA, 25 bp, Artificial sequence
  Synthetic oligonucleotide
gcgaggatgatatatcaggcggcca

SEQ ID NO: 671175 - DNA, 25 bp, Artificial sequence
  Synthetic oligonucleotide
ggttatgcgaggatgatatatcagg

SEQ ID NO: 671176 - DNA, 25 bp, Artificial sequence
  Synthetic oligonucleotide
cttcgtggttatgcgaggatgatat

SEQ ID NO: 671177 - DNA, 25 bp, Artificial sequence
  Synthetic oligonucleotide
aatcgcttcgtggttatgcgaggat

SEQ ID NO: 671178 - DNA, 25 bp, Artificial sequence
  Synthetic oligonucleotide
tgtcataatcgcttcgtggttatgc

SEQ ID NO: 671179 - DNA, 25 bp, Artificial sequence
  Synthetic oligonucleotide
cgcgattgtcataatcgcttcgtgg

SEQ ID NO: 671180 - DNA, 25 bp, Artificial sequence
  Synthetic oligonucleotide
tgcaaagccacgccgctcgcggctt

SEQ ID NO: 671181 - DNA, 25 bp, Artificial sequence
  Synthetic oligonucleotide
ccggcctgccttgctgtgtgccgag

SEQ ID NO: 671182 - DNA, 25 bp, Artificial sequence
  Synthetic oligonucleotide
tggcgtctgccggcgggataaaaac

SEQ ID NO: 671183 - DNA, 25 bp, Artificial sequence
  Synthetic oligonucleotide
gccgttggcgtctgccggcgggata

SEQ ID NO: 671184 - DNA, 25 bp, Artificial sequence
  Synthetic oligonucleotide
cccttggccgttggcgtctgccggc

SEQ ID NO: 671185 - DNA, 25 bp, Artificial sequence
  Synthetic oligonucleotide
tccaccccttggccgttggcgtctg

SEQ ID NO: 671186 - DNA, 25 bp, Artificial sequence
  Synthetic oligonucleotide
cgttgtcttggcggtccaccccttg

SEQ ID NO: 671187 - DNA, 25 bp, Artificial sequence
  Synthetic oligonucleotide
caaagttcgttgtcttggcggtcca

SEQ ID NO: 671188 - DNA, 25 bp, Artificial sequence
  Synthetic oligonucleotide
acggtcaaagttcgttgtcttggcg

SEQ ID NO: 671189 - DNA, 25 bp, Artificial sequence
  Synthetic oligonucleotide
ggtgcgacggtcaaagttcgttgtc

SEQ ID NO: 671190 - DNA, 25 bp, Artificial sequence
  Synthetic oligonucleotide
tgccgaggtgcgacggtcaaagttc

SEQ ID NO: 671191 - DNA, 25 bp, Artificial sequence
  Synthetic oligonucleotide
cgtttttacgctgcgttgttatgtc

SEQ ID NO: 671192 - DNA, 25 bp, Artificial sequence
  Synthetic oligonucleotide
tgccttgctgtgtgccgaggtgcga

SEQ ID NO: 671193 - DNA, 25 bp, Artificial sequence
  Synthetic oligonucleotide
cggtggaaatcctctggacggtggt

SEQ ID NO: 671194 - DNA, 25 bp, Artificial sequence
  Synthetic oligonucleotide
atgaacccggcctgccttgctgtgt

SEQ ID NO: 671195 - DNA, 25 bp, Artificial sequence
  Synthetic oligonucleotide
aacctgatgaacccggcctgccttg

SEQ ID NO: 671196 - DNA, 25 bp, Artificial sequence
  Synthetic oligonucleotide
tgctgaacctgatgaacccggcctg

SEQ ID NO: 671197 - DNA, 25 bp, Artificial sequence
  Synthetic oligonucleotide
tcgaatgctgaacctgatgaacccg

SEQ ID NO: 671198 - DNA, 25 bp, Artificial sequence
  Synthetic oligonucleotide
tcccactcgaatgctgaacctgatg

SEQ ID NO: 671199 - DNA, 25 bp, Artificial sequence
  Synthetic oligonucleotide
ctatactcccactcgaatgctgaac

SEQ ID NO: 671200 - DNA, 25 bp, Artificial sequence
  Synthetic oligonucleotide
cgctgtctatactcccactcgaatg

SEQ ID NO: 671201 - DNA, 25 bp, Artificial sequence
  Synthetic oligonucleotide
cgcagccgctgtctatactcccact

SEQ ID NO: 671202 - DNA, 25 bp, Artificial sequence
  Synthetic oligonucleotide
ttatgtcgcagccgctgtctatact

SEQ ID NO: 671203 - DNA, 25 bp, Artificial sequence
  Synthetic oligonucleotide
gctgtgtgccgaggtgcgacggtca

SEQ ID NO: 671204 - DNA, 25 bp, Artificial sequence
  Synthetic oligonucleotide
cgaccgtgatctgcccaaggatgtg

SEQ ID NO: 671205 - DNA, 25 bp, Artificial sequence
  Synthetic oligonucleotide
gccgcctggtcggccgcctgctgct

SEQ ID NO: 671206 - DNA, 25 bp, Artificial sequence
  Synthetic oligonucleotide
gacgataaggagaacaacatggcaa

SEQ ID NO: 671207 - DNA, 25 bp, Artificial sequence
  Synthetic oligonucleotide
ttgcgggacgataaggagaacaaca

SEQ ID NO: 671208 - DNA, 25 bp, Artificial sequence
  Synthetic oligonucleotide
taccggttgcgggacgataaggaga

SEQ ID NO: 671209 - DNA, 25 bp, Artificial sequence
  Synthetic oligonucleotide
atcactgcgcggaagccgcccgtac

SEQ ID NO: 671210 - DNA, 25 bp, Artificial sequence
  Synthetic oligonucleotide
ttcgatatcactgcgcggaagccgc

SEQ ID NO: 671211 - DNA, 25 bp, Artificial sequence
  Synthetic oligonucleotide
ccctcttcgatatcactgcgcggaa

SEQ ID NO: 671212 - DNA, 25 bp, Artificial sequence
  Synthetic oligonucleotide
cctacaccctcttcgatatcactgc

SEQ ID NO: 671213 - DNA, 25 bp, Artificial sequence
  Synthetic oligonucleotide
cgctggcctacaccctcttcgatat

SEQ ID NO: 671214 - DNA, 25 bp, Artificial sequence
  Synthetic oligonucleotide
acgtgacgctggcctacaccctctt

SEQ ID NO: 671215 - DNA, 25 bp, Artificial sequence
  Synthetic oligonucleotide
tgcggcacgtgacgctggcctacac

SEQ ID NO: 671216 - DNA, 25 bp, Artificial sequence
  Synthetic oligonucleotide
aggatgtgcggcacgtgacgctggc

SEQ ID NO: 671217 - DNA, 25 bp, Artificial sequence
  Synthetic oligonucleotide
aacaacatggcaagccacgaacact

SEQ ID NO: 671218 - DNA, 25 bp, Artificial sequence
  Synthetic oligonucleotide
tgatctgcccaaggatgtgcggcac

SEQ ID NO: 671219 - DNA, 25 bp, Artificial sequence
  Synthetic oligonucleotide
atggcaagccacgaacactattacg

SEQ ID NO: 671220 - DNA, 25 bp, Artificial sequence
  Synthetic oligonucleotide
catcgtcgaccgtgatctgcccaag

SEQ ID NO: 671221 - DNA, 25 bp, Artificial sequence
  Synthetic oligonucleotide
gcgcttcatcgtcgaccgtgatctg

SEQ ID NO: 671222 - DNA, 25 bp, Artificial sequence
  Synthetic oligonucleotide
gccggtgcgcttcatcgtcgaccgt

SEQ ID NO: 671223 - DNA, 25 bp, Artificial sequence
  Synthetic oligonucleotide
cgagatgccggtgcgcttcatcgtc

SEQ ID NO: 671224 - DNA, 25 bp, Artificial sequence
  Synthetic oligonucleotide
gagcatcgagatgccggtgcgcttc

SEQ ID NO: 671225 - DNA, 25 bp, Artificial sequence
  Synthetic oligonucleotide
ggcgagagcatcgagatgccggtgc

SEQ ID NO: 671226 - DNA, 25 bp, Artificial sequence
  Synthetic oligonucleotide
caacccggcgagagcatcgagatgc

SEQ ID NO: 671227 - DNA, 25 bp, Artificial sequence
  Synthetic oligonucleotide
gtgctgcaacccggcgagagcatcg

SEQ ID NO: 671228 - DNA, 25 bp, Artificial sequence
  Synthetic oligonucleotide
cagcaggtgctgcaacccggcgaga

SEQ ID NO: 671229 - DNA, 25 bp, Artificial sequence
  Synthetic oligonucleotide
ttcacccagcaggtgctgcaacccg

SEQ ID NO: 671230 - DNA, 25 bp, Artificial sequence
  Synthetic oligonucleotide
ttctgtttcacccagcaggtgctgc

SEQ ID NO: 671231 - DNA, 25 bp, Artificial sequence
  Synthetic oligonucleotide
gaatgcttctgtttcacccagcagg

SEQ ID NO: 671232 - DNA, 25 bp, Artificial sequence
  Synthetic oligonucleotide
tgcccaaggatgtgcggcacgtgac

SEQ ID NO: 671233 - DNA, 25 bp, Artificial sequence
  Synthetic oligonucleotide
gtgttcggcctgggtacctggttca

SEQ ID NO: 671234 - DNA, 25 bp, Artificial sequence
  Synthetic oligonucleotide
atcatcgcctacatgctgttcggct

SEQ ID NO: 671235 - DNA, 25 bp, Artificial sequence
  Synthetic oligonucleotide
gggctgatcatcgcctacatgctgt

SEQ ID NO: 671236 - DNA, 25 bp, Artificial sequence
  Synthetic oligonucleotide
gtcggcgggctgatcatcgcctaca

SEQ ID NO: 671237 - DNA, 25 bp, Artificial sequence
  Synthetic oligonucleotide
ttcttcgtcggcgggctgatcatcg

SEQ ID NO: 671238 - DNA, 25 bp, Artificial sequence
  Synthetic oligonucleotide
tggatcttcttcgtcggcgggctga

SEQ ID NO: 671239 - DNA, 25 bp, Artificial sequence
  Synthetic oligonucleotide
ggcccgtggatcttcttcgtcggcg

SEQ ID NO: 671240 - DNA, 25 bp, Artificial sequence
  Synthetic oligonucleotide
tcccatggcccgtggatcttcttcg

SEQ ID NO: 671241 - DNA, 25 bp, Artificial sequence
  Synthetic oligonucleotide
aaggaatcccatggcccgtggatct

SEQ ID NO: 671242 - DNA, 25 bp, Artificial sequence
  Synthetic oligonucleotide
ggccacaaggaatcccatggcccgt

SEQ ID NO: 671243 - DNA, 25 bp, Artificial sequence
  Synthetic oligonucleotide
accgccggccacaaggaatcccatg

SEQ ID NO: 671244 - DNA, 25 bp, Artificial sequence
  Synthetic oligonucleotide
gacctcaccgccggccacaaggaat

SEQ ID NO: 671245 - DNA, 25 bp, Artificial sequence
  Synthetic oligonucleotide
ttcaacgacctcaccgccggccaca

SEQ ID NO: 671246 - DNA, 25 bp, Artificial sequence
  Synthetic oligonucleotide
aaggagaacaacatggcaagccacg

SEQ ID NO: 671247 - DNA, 25 bp, Artificial sequence
  Synthetic oligonucleotide
ctgggtacctggttcaacgacctca

SEQ ID NO: 671248 - DNA, 25 bp, Artificial sequence
  Synthetic oligonucleotide
gcctacttccacaagaccgaatgct

SEQ ID NO: 671249 - DNA, 25 bp, Artificial sequence
  Synthetic oligonucleotide
tggtgacggtgttcggcctgggtac

SEQ ID NO: 671250 - DNA, 25 bp, Artificial sequence
  Synthetic oligonucleotide
cctgctggtgacggtgttcggcctg

SEQ ID NO: 671251 - DNA, 25 bp, Artificial sequence
  Synthetic oligonucleotide
catcggcctgctggtgacggtgttc

SEQ ID NO: 671252 - DNA, 25 bp, Artificial sequence
  Synthetic oligonucleotide
gccagcatcggcctgctggtgacgg

SEQ ID NO: 671253 - DNA, 25 bp, Artificial sequence
  Synthetic oligonucleotide
gatcatcgccagcatcggcctgctg

SEQ ID NO: 671254 - DNA, 25 bp, Artificial sequence
  Synthetic oligonucleotide
gtggccgatcatcgccagcatcggc

SEQ ID NO: 671255 - DNA, 25 bp, Artificial sequence
  Synthetic oligonucleotide
agcaagtggccgatcatcgccagca

SEQ ID NO: 671256 - DNA, 25 bp, Artificial sequence
  Synthetic oligonucleotide
gcccagagcaagtggccgatcatcg

SEQ ID NO: 671257 - DNA, 25 bp, Artificial sequence
  Synthetic oligonucleotide
tccccgcccagagcaagtggccgat

SEQ ID NO: 671258 - DNA, 25 bp, Artificial sequence
  Synthetic oligonucleotide
attacgtccccgcccagagcaagtg

SEQ ID NO: 671259 - DNA, 25 bp, Artificial sequence
  Synthetic oligonucleotide
gaacactattacgtccccgcccaga

SEQ ID NO: 671260 - DNA, 25 bp, Artificial sequence
  Synthetic oligonucleotide
agccacgaacactattacgtccccg

SEQ ID NO: 671261 - DNA, 25 bp, Artificial sequence
  Synthetic oligonucleotide
acctggttcaacgacctcaccgccg

SEQ ID NO: 671262 - DNA, 25 bp, Artificial sequence
  Synthetic oligonucleotide
tgatgtgccgcgccctggggatcaa

SEQ ID NO: 671263 - DNA, 25 bp, Artificial sequence
  Synthetic oligonucleotide
gtgaaggtgcagttcatgacctcga

SEQ ID NO: 671264 - DNA, 25 bp, Artificial sequence
  Synthetic oligonucleotide
cgcgaggtgaaggtgcagttcatga

SEQ ID NO: 671265 - DNA, 25 bp, Artificial sequence
  Synthetic oligonucleotide
gtcgggcgcgaggtgaaggtgcagt

SEQ ID NO: 671266 - DNA, 25 bp, Artificial sequence
  Synthetic oligonucleotide
gtggatgtcgggcgcgaggtgaagg

SEQ ID NO: 671267 - DNA, 25 bp, Artificial sequence
  Synthetic oligonucleotide
cagcaggtggatgtcgggcgcgagg

SEQ ID NO: 671268 - DNA, 25 bp, Artificial sequence
  Synthetic oligonucleotide
gcgaacagcaggtggatgtcgggcg

SEQ ID NO: 671269 - DNA, 25 bp, Artificial sequence
  Synthetic oligonucleotide
acagcggcgaacagcaggtggatgt

SEQ ID NO: 671270 - DNA, 25 bp, Artificial sequence
  Synthetic oligonucleotide
gcgcctacagcggcgaacagcaggt

SEQ ID NO: 671271 - DNA, 25 bp, Artificial sequence
  Synthetic oligonucleotide
ccggcagcgcctacagcggcgaaca

SEQ ID NO: 671272 - DNA, 25 bp, Artificial sequence
  Synthetic oligonucleotide
agaccgccggcagcgcctacagcgg

SEQ ID NO: 671273 - DNA, 25 bp, Artificial sequence
  Synthetic oligonucleotide
cggcaagaccgccggcagcgcctac

SEQ ID NO: 671274 - DNA, 25 bp, Artificial sequence
  Synthetic oligonucleotide
ggatcaacggcaagaccgccggcag

SEQ ID NO: 671275 - DNA, 25 bp, Artificial sequence
  Synthetic oligonucleotide
aagaccgaatgcttctgtttcaccc

SEQ ID NO: 671276 - DNA, 25 bp, Artificial sequence
  Synthetic oligonucleotide
ccgcgccctggggatcaacggcaag

SEQ ID NO: 671277 - DNA, 25 bp, Artificial sequence
  Synthetic oligonucleotide
acctcgaacaatatcgacatggtct

SEQ ID NO: 671278 - DNA, 25 bp, Artificial sequence
  Synthetic oligonucleotide
tatgacgtgatgtgccgcgccctgg

SEQ ID NO: 671279 - DNA, 25 bp, Artificial sequence
  Synthetic oligonucleotide
cgctctatgacgtgatgtgccgcgc

SEQ ID NO: 671280 - DNA, 25 bp, Artificial sequence
  Synthetic oligonucleotide
tggtgccgctctatgacgtgatgtg

SEQ ID NO: 671281 - DNA, 25 bp, Artificial sequence
  Synthetic oligonucleotide
tcgccctggtgccgctctatgacgt

SEQ ID NO: 671282 - DNA, 25 bp, Artificial sequence
  Synthetic oligonucleotide
tcggcttcgccctggtgccgctcta

SEQ ID NO: 671283 - DNA, 25 bp, Artificial sequence
  Synthetic oligonucleotide
tcgccttcggcttcgccctggtgcc

SEQ ID NO: 671284 - DNA, 25 bp, Artificial sequence
  Synthetic oligonucleotide
tgatgttcgccttcggcttcgccct

SEQ ID NO: 671285 - DNA, 25 bp, Artificial sequence
  Synthetic oligonucleotide
ccgtgctgatgttcgccttcggctt

SEQ ID NO: 671286 - DNA, 25 bp, Artificial sequence
  Synthetic oligonucleotide
tggtgaccgtgctgatgttcgcctt

SEQ ID NO: 671287 - DNA, 25 bp, Artificial sequence
  Synthetic oligonucleotide
tgctgctggtgaccgtgctgatgtt

SEQ ID NO: 671288 - DNA, 25 bp, Artificial sequence
  Synthetic oligonucleotide
gccgcctgctgctggtgaccgtgct

SEQ ID NO: 671289 - DNA, 25 bp, Artificial sequence
  Synthetic oligonucleotide
tggtcggccgcctgctgctggtgac

SEQ ID NO: 671290 - DNA, 25 bp, Artificial sequence
  Synthetic oligonucleotide
cctggggatcaacggcaagaccgcc

SEQ ID NO: 671291 - DNA, 25 bp, Artificial sequence
  Synthetic oligonucleotide
cagatggtgttctacgcgcgcaacc

SEQ ID NO: 671292 - DNA, 25 bp, Artificial sequence
  Synthetic oligonucleotide
ttcggctggttcggcaacgtcatcc

SEQ ID NO: 671293 - DNA, 25 bp, Artificial sequence
  Synthetic oligonucleotide
gccgcagcctacttccacaagaccg

SEQ ID NO: 671294 - DNA, 25 bp, Artificial sequence
  Synthetic oligonucleotide
gccgaggccgcagcctacttccaca

SEQ ID NO: 671295 - DNA, 25 bp, Artificial sequence
  Synthetic oligonucleotide
gccccggccgaggccgcagcctact

SEQ ID NO: 671296 - DNA, 25 bp, Artificial sequence
  Synthetic oligonucleotide
agcatcgccccggccgaggccgcag

SEQ ID NO: 671297 - DNA, 25 bp, Artificial sequence
  Synthetic oligonucleotide
catcccgagcatcgccccggccgag

SEQ ID NO: 671298 - DNA, 25 bp, Artificial sequence
  Synthetic oligonucleotide
gcaggccatcccgagcatcgccccg

SEQ ID NO: 671299 - DNA, 25 bp, Artificial sequence
  Synthetic oligonucleotide
tgaccgcgcaggccatcccgagcat

SEQ ID NO: 671300 - DNA, 25 bp, Artificial sequence
  Synthetic oligonucleotide
agccgatgaccgcgcaggccatccc

SEQ ID NO: 671301 - DNA, 25 bp, Artificial sequence
  Synthetic oligonucleotide
gcgacaagccgatgaccgcgcaggc

SEQ ID NO: 671302 - DNA, 25 bp, Artificial sequence
  Synthetic oligonucleotide
cccgagcgacaagccgatgaccgcg

SEQ ID NO: 671303 - DNA, 25 bp, Artificial sequence
  Synthetic oligonucleotide
gcgcaacccgagcgacaagccgatg

SEQ ID NO: 671304 - DNA, 25 bp, Artificial sequence
  Synthetic oligonucleotide
gtgcagttcatgacctcgaacaata

SEQ ID NO: 671305 - DNA, 25 bp, Artificial sequence
  Synthetic oligonucleotide
gtgttctacgcgcgcaacccgagcg

SEQ ID NO: 671306 - DNA, 25 bp, Artificial sequence
  Synthetic oligonucleotide
ttcatgacctcgaacaatatcgaca

SEQ ID NO: 671307 - DNA, 25 bp, Artificial sequence
  Synthetic oligonucleotide
gtgaaccagatggtgttctacgcgc

SEQ ID NO: 671308 - DNA, 25 bp, Artificial sequence
  Synthetic oligonucleotide
ggcgcggtgaaccagatggtgttct

SEQ ID NO: 671309 - DNA, 25 bp, Artificial sequence
  Synthetic oligonucleotide
catcccggcgcggtgaaccagatgg

SEQ ID NO: 671310 - DNA, 25 bp, Artificial sequence
  Synthetic oligonucleotide
gtggtgcatcccggcgcggtgaacc

SEQ ID NO: 671311 - DNA, 25 bp, Artificial sequence
  Synthetic oligonucleotide
cagttggtggtgcatcccggcgcgg

SEQ ID NO: 671312 - DNA, 25 bp, Artificial sequence
  Synthetic oligonucleotide
ggcgaccagttggtggtgcatcccg

SEQ ID NO: 671313 - DNA, 25 bp, Artificial sequence
  Synthetic oligonucleotide
tccgccggcgaccagttggtggtgc

SEQ ID NO: 671314 - DNA, 25 bp, Artificial sequence
  Synthetic oligonucleotide
ttccgctccgccggcgaccagttgg

SEQ ID NO: 671315 - DNA, 25 bp, Artificial sequence
  Synthetic oligonucleotide
tgggagttccgctccgccggcgacc

SEQ ID NO: 671316 - DNA, 25 bp, Artificial sequence
  Synthetic oligonucleotide
atggtctgggagttccgctccgccg

SEQ ID NO: 671317 - DNA, 25 bp, Artificial sequence
  Synthetic oligonucleotide
atcgacatggtctgggagttccgct

SEQ ID NO: 671318 - DNA, 25 bp, Artificial sequence
  Synthetic oligonucleotide
aacaatatcgacatggtctgggagt

SEQ ID NO: 671319 - DNA, 25 bp, Artificial sequence
  Synthetic oligonucleotide
ttccacaagaccgaatgcttctgtt

SEQ ID NO: 671320 - DNA, 25 bp, Artificial sequence
  Synthetic oligonucleotide
ctacgcgcgcaacccgagcgacaag

SEQ ID NO: 671321 - DNA, 25 bp, Artificial sequence
  Synthetic oligonucleotide
aggccgaggagtacgtgcacgccta

SEQ ID NO: 671322 - DNA, 25 bp, Artificial sequence
  Synthetic oligonucleotide
accggcttccacggcgcccacgtga

SEQ ID NO: 671323 - DNA, 25 bp, Artificial sequence
  Synthetic oligonucleotide
atgctcaccggcttccacggcgccc

SEQ ID NO: 671324 - DNA, 25 bp, Artificial sequence
  Synthetic oligonucleotide
ttcttcatgctcaccggcttccacg

SEQ ID NO: 671325 - DNA, 25 bp, Artificial sequence
  Synthetic oligonucleotide
tcgaccttcttcatgctcaccggct

SEQ ID NO: 671326 - DNA, 25 bp, Artificial sequence
  Synthetic oligonucleotide
tacggctcgaccttcttcatgctca

SEQ ID NO: 671327 - DNA, 25 bp, Artificial sequence
  Synthetic oligonucleotide
gcatctacggctcgaccttcttcat

SEQ ID NO: 671328 - DNA, 25 bp, Artificial sequence
  Synthetic oligonucleotide
cgccggcatctacggctcgaccttc

SEQ ID NO: 671329 - DNA, 25 bp, Artificial sequence
  Synthetic oligonucleotide
cctcggcgccggcatctacggctcg

SEQ ID NO: 671330 - DNA, 25 bp, Artificial sequence
  Synthetic oligonucleotide
gcctgaccctcggcgccggcatcta

SEQ ID NO: 671331 - DNA, 25 bp, Artificial sequence
  Synthetic oligonucleotide
agctgggcctgaccctcggcgccgg

SEQ ID NO: 671332 - DNA, 25 bp, Artificial sequence
  Synthetic oligonucleotide
acaacgagctgggcctgaccctcgg

SEQ ID NO: 671333 - DNA, 25 bp, Artificial sequence
  Synthetic oligonucleotide
acgcctacaacgagctgggcctgac

SEQ ID NO: 671334 - DNA, 25 bp, Artificial sequence
  Synthetic oligonucleotide
tgaagaagaacaagcgcggcccgct

SEQ ID NO: 671335 - DNA, 25 bp, Artificial sequence
  Synthetic oligonucleotide
aggagtacgtgcacgcctacaacga

SEQ ID NO: 671336 - DNA, 25 bp, Artificial sequence
  Synthetic oligonucleotide
cacgtgaccctcggcgcgctgatcc

SEQ ID NO: 671337 - DNA, 25 bp, Artificial sequence
  Synthetic oligonucleotide
tcctgcaggccgaggagtacgtgca

SEQ ID NO: 671338 - DNA, 25 bp, Artificial sequence
  Synthetic oligonucleotide
tcctgatcctgcaggccgaggagta

SEQ ID NO: 671339 - DNA, 25 bp, Artificial sequence
  Synthetic oligonucleotide
tcgccttcctgatcctgcaggccga

SEQ ID NO: 671340 - DNA, 25 bp, Artificial sequence
  Synthetic oligonucleotide
tggggatcgccttcctgatcctgca

SEQ ID NO: 671341 - DNA, 25 bp, Artificial sequence
  Synthetic oligonucleotide
tgctgctggggatcgccttcctgat

SEQ ID NO: 671342 - DNA, 25 bp, Artificial sequence
  Synthetic oligonucleotide
tgaccgtgctgctggggatcgcctt

SEQ ID NO: 671343 - DNA, 25 bp, Artificial sequence
  Synthetic oligonucleotide
tggcgctgaccgtgctgctggggat

SEQ ID NO: 671344 - DNA, 25 bp, Artificial sequence
  Synthetic oligonucleotide
cctggctggcgctgaccgtgctgct

SEQ ID NO: 671345 - DNA, 25 bp, Artificial sequence
  Synthetic oligonucleotide
tcaaggcctggctggcgctgaccgt

SEQ ID NO: 671346 - DNA, 25 bp, Artificial sequence
  Synthetic oligonucleotide
cccgctcaaggcctggctggcgctg

SEQ ID NO: 671347 - DNA, 25 bp, Artificial sequence
  Synthetic oligonucleotide
agcgcggcccgctcaaggcctggct

SEQ ID NO: 671348 - DNA, 25 bp, Artificial sequence
  Synthetic oligonucleotide
gcctacatgctgttcggctggttcg

SEQ ID NO: 671349 - DNA, 25 bp, Artificial sequence
  Synthetic oligonucleotide
acgtgcacgcctacaacgagctggg

SEQ ID NO: 671350 - DNA, 25 bp, Artificial sequence
  Synthetic oligonucleotide
ttcggcttcgaggccgccagttggt

SEQ ID NO: 671351 - DNA, 25 bp, Artificial sequence
  Synthetic oligonucleotide
tcaaccagatgaccaccatgcacgg

SEQ ID NO: 671352 - DNA, 25 bp, Artificial sequence
  Synthetic oligonucleotide
cgttcttcaaccagatgaccaccat

SEQ ID NO: 671353 - DNA, 25 bp, Artificial sequence
  Synthetic oligonucleotide
gtgatctgaccgccaccgggggaat

SEQ ID NO: 671354 - DNA, 25 bp, Artificial sequence
  Synthetic oligonucleotide
gtctacgtgatctgaccgccaccgg

SEQ ID NO: 671355 - DNA, 25 bp, Artificial sequence
  Synthetic oligonucleotide
catcttcgtctacgtgatctgaccg

SEQ ID NO: 671356 - DNA, 25 bp, Artificial sequence
  Synthetic oligonucleotide
gcctgttcatcttcgtctacgtgat

SEQ ID NO: 671357 - DNA, 25 bp, Artificial sequence
  Synthetic oligonucleotide
ggatcggcctgttcatcttcgtcta

SEQ ID NO: 671358 - DNA, 25 bp, Artificial sequence
  Synthetic oligonucleotide
tggtctggatcggcctgttcatctt

SEQ ID NO: 671359 - DNA, 25 bp, Artificial sequence
  Synthetic oligonucleotide
tcgacgtggtctggatcggcctgtt

SEQ ID NO: 671360 - DNA, 25 bp, Artificial sequence
  Synthetic oligonucleotide
cacttcgtcgacgtggtctggatcg

SEQ ID NO: 671361 - DNA, 25 bp, Artificial sequence
  Synthetic oligonucleotide
tactggcacttcgtcgacgtggtct

SEQ ID NO: 671362 - DNA, 25 bp, Artificial sequence
  Synthetic oligonucleotide
agttggtactggcacttcgtcgacg

SEQ ID NO: 671363 - DNA, 25 bp, Artificial sequence
  Synthetic oligonucleotide
ttccacggcgcccacgtgaccctcg

SEQ ID NO: 671364 - DNA, 25 bp, Artificial sequence
  Synthetic oligonucleotide
ttcgaggccgccagttggtactggc

SEQ ID NO: 671365 - DNA, 25 bp, Artificial sequence
  Synthetic oligonucleotide
ggcgcccacgtgaccctcggcgcgc

SEQ ID NO: 671366 - DNA, 25 bp, Artificial sequence
  Synthetic oligonucleotide
caccacttcggcttcgaggccgcca

SEQ ID NO: 671367 - DNA, 25 bp, Artificial sequence
  Synthetic oligonucleotide
gccgagcaccacttcggcttcgagg

SEQ ID NO: 671368 - DNA, 25 bp, Artificial sequence
  Synthetic oligonucleotide
tcgatgccgagcaccacttcggctt

SEQ ID NO: 671369 - DNA, 25 bp, Artificial sequence
  Synthetic oligonucleotide
gtcacttcgatgccgagcaccactt

SEQ ID NO: 671370 - DNA, 25 bp, Artificial sequence
  Synthetic oligonucleotide
tgcgcggtcacttcgatgccgagca

SEQ ID NO: 671371 - DNA, 25 bp, Artificial sequence
  Synthetic oligonucleotide
gcatcctgcgcggtcacttcgatgc

SEQ ID NO: 671372 - DNA, 25 bp, Artificial sequence
  Synthetic oligonucleotide
tgatccgcatcctgcgcggtcactt

SEQ ID NO: 671373 - DNA, 25 bp, Artificial sequence
  Synthetic oligonucleotide
catgctgatccgcatcctgcgcggt

SEQ ID NO: 671374 - DNA, 25 bp, Artificial sequence
  Synthetic oligonucleotide
tcggcatcatgctgatccgcatcct

SEQ ID NO: 671375 - DNA, 25 bp, Artificial sequence
  Synthetic oligonucleotide
ctgatcctcggcatcatgctgatcc

SEQ ID NO: 671376 - DNA, 25 bp, Artificial sequence
  Synthetic oligonucleotide
ggcgcgctgatcctcggcatcatgc

SEQ ID NO: 671377 - DNA, 25 bp, Artificial sequence
  Synthetic oligonucleotide
accctcggcgcgctgatcctcggca

SEQ ID NO: 671378 - DNA, 25 bp, Artificial sequence
  Synthetic oligonucleotide
acgccctgaagaagaacaagcgcgg

SEQ ID NO: 671379 - DNA, 25 bp, Artificial sequence
  Synthetic oligonucleotide
gccgccagttggtactggcacttcg

SEQ ID NO: 671380 - DNA, 25 bp, Artificial sequence
  Synthetic oligonucleotide
ccgctggggcatgagctggttcatc

SEQ ID NO: 671381 - DNA, 25 bp, Artificial sequence
  Synthetic oligonucleotide
gtccctggctcggcggcgagggtgc

SEQ ID NO: 671382 - DNA, 25 bp, Artificial sequence
  Synthetic oligonucleotide
gccacttcgccggtccctggctcgg

SEQ ID NO: 671383 - DNA, 25 bp, Artificial sequence
  Synthetic oligonucleotide
acgtccgccacttcgccggtccctg

SEQ ID NO: 671384 - DNA, 25 bp, Artificial sequence
  Synthetic oligonucleotide
tgttctacgtccgccacttcgccgg

SEQ ID NO: 671385 - DNA, 25 bp, Artificial sequence
  Synthetic oligonucleotide
gcgcgctgttctacgtccgccactt

SEQ ID NO: 671386 - DNA, 25 bp, Artificial sequence
  Synthetic oligonucleotide
tcttcggcgcgctgttctacgtccg

SEQ ID NO: 671387 - DNA, 25 bp, Artificial sequence
  Synthetic oligonucleotide
ccgccttcttcggcgcgctgttcta

SEQ ID NO: 671388 - DNA, 25 bp, Artificial sequence
  Synthetic oligonucleotide
tcttcgccgccttcttcggcgcgct

SEQ ID NO: 671389 - DNA, 25 bp, Artificial sequence
  Synthetic oligonucleotide
tgatgttcttcgccgccttcttcgg

SEQ ID NO: 671390 - DNA, 25 bp, Artificial sequence
  Synthetic oligonucleotide
ccgaggtgatgttcttcgccgcctt

SEQ ID NO: 671391 - DNA, 25 bp, Artificial sequence
  Synthetic oligonucleotide
tcttctccgaggtgatgttcttcgc

SEQ ID NO: 671392 - DNA, 25 bp, Artificial sequence
  Synthetic oligonucleotide
ggttcatcttctccgaggtgatgtt

SEQ ID NO: 671393 - DNA, 25 bp, Artificial sequence
  Synthetic oligonucleotide
aagaacaagcgcggcccgctcaagg

SEQ ID NO: 671394 - DNA, 25 bp, Artificial sequence
  Synthetic oligonucleotide
gggcatgagctggttcatcttctcc

SEQ ID NO: 671395 - DNA, 25 bp, Artificial sequence
  Synthetic oligonucleotide
aagggcgtggcgcacatgctctggc

SEQ ID NO: 671396 - DNA, 25 bp, Artificial sequence
  Synthetic oligonucleotide
ctcgttccgctggggcatgagctgg

SEQ ID NO: 671397 - DNA, 25 bp, Artificial sequence
  Synthetic oligonucleotide
ggaccgctcgttccgctggggcatg

SEQ ID NO: 671398 - DNA, 25 bp, Artificial sequence
  Synthetic oligonucleotide
gcagatggaccgctcgttccgctgg

SEQ ID NO: 671399 - DNA, 25 bp, Artificial sequence
  Synthetic oligonucleotide
acagcgcgcagatggaccgctcgtt

SEQ ID NO: 671400 - DNA, 25 bp, Artificial sequence
  Synthetic oligonucleotide
gactctacagcgcgcagatggaccg

SEQ ID NO: 671401 - DNA, 25 bp, Artificial sequence
  Synthetic oligonucleotide
gcgccggactctacagcgcgcagat

SEQ ID NO: 671402 - DNA, 25 bp, Artificial sequence
  Synthetic oligonucleotide
gagagtcgcgccggactctacagcg

SEQ ID NO: 671403 - DNA, 25 bp, Artificial sequence
  Synthetic oligonucleotide
atccgcgagagtcgcgccggactct

SEQ ID NO: 671404 - DNA, 25 bp, Artificial sequence
  Synthetic oligonucleotide
acgtcatccgcgagagtcgcgccgg

SEQ ID NO: 671405 - DNA, 25 bp, Artificial sequence
  Synthetic oligonucleotide
cggcaacgtcatccgcgagagtcgc

SEQ ID NO: 671406 - DNA, 25 bp, Artificial sequence
  Synthetic oligonucleotide
tggttcggcaacgtcatccgcgaga

SEQ ID NO: 671407 - DNA, 25 bp, Artificial sequence
  Synthetic oligonucleotide
tcgccggtccctggctcggcggcga

SEQ ID NO: 671408 - DNA, 25 bp, Artificial sequence
  Synthetic oligonucleotide
gagctggttcatcttctccgaggtg

SEQ ID NO: 671409 - DNA, 25 bp, Artificial sequence
  Synthetic oligonucleotide
cgccgagcgcggtgatcgagccgtg

SEQ ID NO: 671410 - DNA, 25 bp, Artificial sequence
  Synthetic oligonucleotide
cccaccacgccctgaagaagaacaa

SEQ ID NO: 671411 - DNA, 25 bp, Artificial sequence
  Synthetic oligonucleotide
ccttcgcccaccacgccctgaagaa

SEQ ID NO: 671412 - DNA, 25 bp, Artificial sequence
  Synthetic oligonucleotide
ccgtgaccttcgcccaccacgccct

SEQ ID NO: 671413 - DNA, 25 bp, Artificial sequence
  Synthetic oligonucleotide
gcttcaccgtgaccttcgcccacca

SEQ ID NO: 671414 - DNA, 25 bp, Artificial sequence
  Synthetic oligonucleotide
cctccagcttcaccgtgaccttcgc

SEQ ID NO: 671415 - DNA, 25 bp, Artificial sequence
  Synthetic oligonucleotide
tggtcacctccagcttcaccgtgac

SEQ ID NO: 671416 - DNA, 25 bp, Artificial sequence
  Synthetic oligonucleotide
tcctgctggtcacctccagcttcac

SEQ ID NO: 671417 - DNA, 25 bp, Artificial sequence
  Synthetic oligonucleotide
acaccatcctgctggtcacctccag

SEQ ID NO: 671418 - DNA, 25 bp, Artificial sequence
  Synthetic oligonucleotide
tgatcaacaccatcctgctggtcac

SEQ ID NO: 671419 - DNA, 25 bp, Artificial sequence
  Synthetic oligonucleotide
tgccgctgatcaacaccatcctgct

SEQ ID NO: 671420 - DNA, 25 bp, Artificial sequence
  Synthetic oligonucleotide
ggaagctgccgctgatcaacaccat

SEQ ID NO: 671421 - DNA, 25 bp, Artificial sequence
  Synthetic oligonucleotide
agccgtggaagctgccgctgatcaa

SEQ ID NO: 671422 - DNA, 25 bp, Artificial sequence
  Synthetic oligonucleotide
cggcgagggtgccaagggcgtggcg

SEQ ID NO: 671423 - DNA, 25 bp, Artificial sequence
  Synthetic oligonucleotide
gcgcggtgatcgagccgtggaagct

SEQ ID NO: 671424 - DNA, 25 bp, Artificial sequence
  Synthetic oligonucleotide
ggtgccaagggcgtggcgcacatgc

SEQ ID NO: 671425 - DNA, 25 bp, Artificial sequence
  Synthetic oligonucleotide
ttcccgccgccgagcgcggtgatcg

SEQ ID NO: 671426 - DNA, 25 bp, Artificial sequence
  Synthetic oligonucleotide
aagctgttcccgccgccgagcgcgg

SEQ ID NO: 671427 - DNA, 25 bp, Artificial sequence
  Synthetic oligonucleotide
gacccgaagctgttcccgccgccga

SEQ ID NO: 671428 - DNA, 25 bp, Artificial sequence
  Synthetic oligonucleotide
gcagaccccggacccgaagctgttc

SEQ ID NO: 671429 - DNA, 25 bp, Artificial sequence
  Synthetic oligonucleotide
ctgctgcagaccccggacccgaagc

SEQ ID NO: 671430 - DNA, 25 bp, Artificial sequence
  Synthetic oligonucleotide
tggccgctgctgcagaccccggacc

SEQ ID NO: 671431 - DNA, 25 bp, Artificial sequence
  Synthetic oligonucleotide
tacagctggccgctgctgcagaccc

SEQ ID NO: 671432 - DNA, 25 bp, Artificial sequence
  Synthetic oligonucleotide
ttccagtacagctggccgctgctgc

SEQ ID NO: 671433 - DNA, 25 bp, Artificial sequence
  Synthetic oligonucleotide
cgaacttccagtacagctggccgct

SEQ ID NO: 671434 - DNA, 25 bp, Artificial sequence
  Synthetic oligonucleotide
ctctggccgaacttccagtacagct

SEQ ID NO: 671435 - DNA, 25 bp, Artificial sequence
  Synthetic oligonucleotide
cacatgctctggccgaacttccagt

SEQ ID NO: 671436 - DNA, 25 bp, Artificial sequence
  Synthetic oligonucleotide
gtggcgcacatgctctggccgaact

SEQ ID NO: 671437 - DNA, 25 bp, Artificial sequence
  Synthetic oligonucleotide
atgctgttcggctggttcggcaacg

SEQ ID NO: 671438 - DNA, 25 bp, Artificial sequence
  Synthetic oligonucleotide
tgatcgagccgtggaagctgccgct

SEQ ID NO: 671439 - DNA, 25 bp, Artificial sequence
  Synthetic oligonucleotide
ccggcgtggtgaccatgatgctgat

SEQ ID NO: 671440 - DNA, 25 bp, Artificial sequence
  Synthetic oligonucleotide
ttcgtggtcggcatcccggtcaccg

SEQ ID NO: 671441 - DNA, 25 bp, Artificial sequence
  Synthetic oligonucleotide
tgctgttccagcacgtgttctggtt

SEQ ID NO: 671442 - DNA, 25 bp, Artificial sequence
  Synthetic oligonucleotide
acccggtgctgttccagcacgtgtt

SEQ ID NO: 671443 - DNA, 25 bp, Artificial sequence
  Synthetic oligonucleotide
gcggcgacccggtgctgttccagca

SEQ ID NO: 671444 - DNA, 25 bp, Artificial sequence
  Synthetic oligonucleotide
ccggcggcggcgacccggtgctgtt

SEQ ID NO: 671445 - DNA, 25 bp, Artificial sequence
  Synthetic oligonucleotide
agcgccgccggcggcggcgacccgg

SEQ ID NO: 671446 - DNA, 25 bp, Artificial sequence
  Synthetic oligonucleotide
tcttcagcgccgccggcggcggcga

SEQ ID NO: 671447 - DNA, 25 bp, Artificial sequence
  Synthetic oligonucleotide
ccagcttcttcagcgccgccggcgg

SEQ ID NO: 671448 - DNA, 25 bp, Artificial sequence
  Synthetic oligonucleotide
tcggcaccagcttcttcagcgccgc

SEQ ID NO: 671449 - DNA, 25 bp, Artificial sequence
  Synthetic oligonucleotide
tccacttcggcaccagcttcttcag

SEQ ID NO: 671450 - DNA, 25 bp, Artificial sequence
  Synthetic oligonucleotide
tggacatccacttcggcaccagctt

SEQ ID NO: 671451 - DNA, 25 bp, Artificial sequence
  Synthetic oligonucleotide
tgctgatggacatccacttcggcac

SEQ ID NO: 671452 - DNA, 25 bp, Artificial sequence
  Synthetic oligonucleotide
cacgtgttctggttcttcggccacc

SEQ ID NO: 671453 - DNA, 25 bp, Artificial sequence
  Synthetic oligonucleotide
tggtgaccatgatgctgatggacat

SEQ ID NO: 671454 - DNA, 25 bp, Artificial sequence
  Synthetic oligonucleotide
ctggttcttcggccaccccgaggtg

SEQ ID NO: 671455 - DNA, 25 bp, Artificial sequence
  Synthetic oligonucleotide
tgctggccggcgtggtgaccatgat

SEQ ID NO: 671456 - DNA, 25 bp, Artificial sequence
  Synthetic oligonucleotide
tgcctgtgctggccggcgtggtgac

SEQ ID NO: 671457 - DNA, 25 bp, Artificial sequence
  Synthetic oligonucleotide
cggtgatgcctgtgctggccggcgt

SEQ ID NO: 671458 - DNA, 25 bp, Artificial sequence
  Synthetic oligonucleotide
tgatcgcggtgatgcctgtgctggc

SEQ ID NO: 671459 - DNA, 25 bp, Artificial sequence
  Synthetic oligonucleotide
tccttttgatcgcggtgatgcctgt

SEQ ID NO: 671460 - DNA, 25 bp, Artificial sequence
  Synthetic oligonucleotide
ccgcgttccttttgatcgcggtgat

SEQ ID NO: 671461 - DNA, 25 bp, Artificial sequence
  Synthetic oligonucleotide
tgatcaccgcgttccttttgatcgc

SEQ ID NO: 671462 - DNA, 25 bp, Artificial sequence
  Synthetic oligonucleotide
cctggctgatcaccgcgttcctttt

SEQ ID NO: 671463 - DNA, 25 bp, Artificial sequence
  Synthetic oligonucleotide
tctggacctggctgatcaccgcgtt

SEQ ID NO: 671464 - DNA, 25 bp, Artificial sequence
  Synthetic oligonucleotide
tgttcgtctggacctggctgatcac

SEQ ID NO: 671465 - DNA, 25 bp, Artificial sequence
  Synthetic oligonucleotide
tgccgctgttcgtctggacctggct

SEQ ID NO: 671466 - DNA, 25 bp, Artificial sequence
  Synthetic oligonucleotide
tgaagatgccgctgttcgtctggac

SEQ ID NO: 671467 - DNA, 25 bp, Artificial sequence
  Synthetic oligonucleotide
ccatgatgctgatggacatccactt

SEQ ID NO: 671468 - DNA, 25 bp, Artificial sequence
  Synthetic oligonucleotide
ttcgcgcgcaagccgctgttcggct

SEQ ID NO: 671469 - DNA, 25 bp, Artificial sequence
  Synthetic oligonucleotide
cacatgttcgtggtcggcatcccgg

SEQ ID NO: 671470 - DNA, 25 bp, Artificial sequence
  Synthetic oligonucleotide
gcgcaccacatgttcgtggtcggca

SEQ ID NO: 671471 - DNA, 25 bp, Artificial sequence
  Synthetic oligonucleotide
gtctgggcgcaccacatgttcgtgg

SEQ ID NO: 671472 - DNA, 25 bp, Artificial sequence
  Synthetic oligonucleotide
ttcgtggtctgggcgcaccacatgt

SEQ ID NO: 671473 - DNA, 25 bp, Artificial sequence
  Synthetic oligonucleotide
tctccttcgtggtctgggcgcacca

SEQ ID NO: 671474 - DNA, 25 bp, Artificial sequence
  Synthetic oligonucleotide
gccttcctctccttcgtggtctggg

SEQ ID NO: 671475 - DNA, 25 bp, Artificial sequence
  Synthetic oligonucleotide
agcatcgccttcctctccttcgtgg

SEQ ID NO: 671476 - DNA, 25 bp, Artificial sequence
  Synthetic oligonucleotide
accgccagcatcgccttcctctcct

SEQ ID NO: 671477 - DNA, 25 bp, Artificial sequence
  Synthetic oligonucleotide
ctacgccaccgccagcatcgccttc

SEQ ID NO: 671478 - DNA, 25 bp, Artificial sequence
  Synthetic oligonucleotide
gatggtctacgccaccgccagcatc

SEQ ID NO: 671479 - DNA, 25 bp, Artificial sequence
  Synthetic oligonucleotide
acacctcgatggtctacgccaccgc

SEQ ID NO: 671480 - DNA, 25 bp, Artificial sequence
  Synthetic oligonucleotide
ttcggctacacctcgatggtctacg

SEQ ID NO: 671481 - DNA, 25 bp, Artificial sequence
  Synthetic oligonucleotide
tccagcacgtgttctggttcttcgg

SEQ ID NO: 671482 - DNA, 25 bp, Artificial sequence
  Synthetic oligonucleotide
cgcaagccgctgttcggctacacct

SEQ ID NO: 671483 - DNA, 25 bp, Artificial sequence
  Synthetic oligonucleotide
ccccgggcatgaccctgatgaagat

SEQ ID NO: 671484 - DNA, 25 bp, Artificial sequence
  Synthetic oligonucleotide
ccgaccttcgcgcgcaagccgctgt

SEQ ID NO: 671485 - DNA, 25 bp, Artificial sequence
  Synthetic oligonucleotide
atcatcccgaccttcgcgcgcaagc

SEQ ID NO: 671486 - DNA, 25 bp, Artificial sequence
  Synthetic oligonucleotide
agtgcgatcatcccgaccttcgcgc

SEQ ID NO: 671487 - DNA, 25 bp, Artificial sequence
  Synthetic oligonucleotide
gcggtcagtgcgatcatcccgacct

SEQ ID NO: 671488 - DNA, 25 bp, Artificial sequence
  Synthetic oligonucleotide
ttcggtgcggtcagtgcgatcatcc

SEQ ID NO: 671489 - DNA, 25 bp, Artificial sequence
  Synthetic oligonucleotide
cccgccttcggtgcggtcagtgcga

SEQ ID NO: 671490 - DNA, 25 bp, Artificial sequence
  Synthetic oligonucleotide
atcctgcccgccttcggtgcggtca

SEQ ID NO: 671491 - DNA, 25 bp, Artificial sequence
  Synthetic oligonucleotide
atcatgatcctgcccgccttcggtg

SEQ ID NO: 671492 - DNA, 25 bp, Artificial sequence
  Synthetic oligonucleotide
tgtacatcatgatcctgcccgcctt

SEQ ID NO: 671493 - DNA, 25 bp, Artificial sequence
  Synthetic oligonucleotide
ccgaggtgtacatcatgatcctgcc

SEQ ID NO: 671494 - DNA, 25 bp, Artificial sequence
  Synthetic oligonucleotide
gccaccccgaggtgtacatcatgat

SEQ ID NO: 671495 - DNA, 25 bp, Artificial sequence
  Synthetic oligonucleotide
tcttcggccaccccgaggtgtacat

SEQ ID NO: 671496 - DNA, 25 bp, Artificial sequence
  Synthetic oligonucleotide
ccgctgttcggctacacctcgatgg

SEQ ID NO: 671497 - DNA, 25 bp, Artificial sequence
  Synthetic oligonucleotide
caactggatgatcccgctgatgatc

SEQ ID NO: 671498 - DNA, 25 bp, Artificial sequence
  Synthetic oligonucleotide
cggccttcggcctgctggtcagcac

SEQ ID NO: 671499 - DNA, 25 bp, Artificial sequence
  Synthetic oligonucleotide
tgccggcggccttcggcctgctggt

SEQ ID NO: 671500 - DNA, 25 bp, Artificial sequence
  Synthetic oligonucleotide
tggctgctgccggcggccttcggcc

SEQ ID NO: 671501 - DNA, 25 bp, Artificial sequence
  Synthetic oligonucleotide
gcttctggctgctgccggcggcctt

SEQ ID NO: 671502 - DNA, 25 bp, Artificial sequence
  Synthetic oligonucleotide
aacttcagcttctggctgctgccgg

SEQ ID NO: 671503 - DNA, 25 bp, Artificial sequence
  Synthetic oligonucleotide
tgaacaacttcagcttctggctgct

SEQ ID NO: 671504 - DNA, 25 bp, Artificial sequence
  Synthetic oligonucleotide
cgcggatgaacaacttcagcttctg

SEQ ID NO: 671505 - DNA, 25 bp, Artificial sequence
  Synthetic oligonucleotide
ccctgccgcggatgaacaacttcag

SEQ ID NO: 671506 - DNA, 25 bp, Artificial sequence
  Synthetic oligonucleotide
acatggccctgccgcggatgaacaa

SEQ ID NO: 671507 - DNA, 25 bp, Artificial sequence
  Synthetic oligonucleotide
gccggacatggccctgccgcggatg

SEQ ID NO: 671508 - DNA, 25 bp, Artificial sequence
  Synthetic oligonucleotide
tcggcgcgccggacatggccctgcc

SEQ ID NO: 671509 - DNA, 25 bp, Artificial sequence
  Synthetic oligonucleotide
tgatgatcggcgcgccggacatggc

SEQ ID NO: 671510 - DNA, 25 bp, Artificial sequence
  Synthetic oligonucleotide
ccctgatgaagatgccgctgttcgt

SEQ ID NO: 671511 - DNA, 25 bp, Artificial sequence
  Synthetic oligonucleotide
gatgatcccgctgatgatcggcgcg

SEQ ID NO: 671512 - DNA, 25 bp, Artificial sequence
  Synthetic oligonucleotide
tcagcaccttgttcatgcccggcgg

SEQ ID NO: 671513 - DNA, 25 bp, Artificial sequence
  Synthetic oligonucleotide
cctggccaactggatgatcccgctg

SEQ ID NO: 671514 - DNA, 25 bp, Artificial sequence
  Synthetic oligonucleotide
cgtcggcctggccaactggatgatc

SEQ ID NO: 671515 - DNA, 25 bp, Artificial sequence
  Synthetic oligonucleotide
cggccttcgtcggcctggccaactg

SEQ ID NO: 671516 - DNA, 25 bp, Artificial sequence
  Synthetic oligonucleotide
tgatgccggccttcgtcggcctggc

SEQ ID NO: 671517 - DNA, 25 bp, Artificial sequence
  Synthetic oligonucleotide
gcgcggtgatgccggccttcgtcgg

SEQ ID NO: 671518 - DNA, 25 bp, Artificial sequence
  Synthetic oligonucleotide
tcttcggcgcggtgatgccggcctt

SEQ ID NO: 671519 - DNA, 25 bp, Artificial sequence
  Synthetic oligonucleotide
catggtcttcggcgcggtgatgccg

SEQ ID NO: 671520 - DNA, 25 bp, Artificial sequence
  Synthetic oligonucleotide
ctgatcatggtcttcggcgcggtga

SEQ ID NO: 671521 - DNA, 25 bp, Artificial sequence
  Synthetic oligonucleotide
gcacggcctgatcatggtcttcggc

SEQ ID NO: 671522 - DNA, 25 bp, Artificial sequence
  Synthetic oligonucleotide
tacccgccgcctggtcggccgcctg

SEQ ID NO: 671523 - DNA, 25 bp, Artificial sequence
  Synthetic oligonucleotide
ggctcggcggcgagggtgccaaggg

SEQ ID NO: 671524 - DNA, 25 bp, Artificial sequence
  Synthetic oligonucleotide
caccatgcacggcctgatcatggtc

SEQ ID NO: 671525 - DNA, 25 bp, Artificial sequence
  Synthetic oligonucleotide
tcccgctgatgatcggcgcgccgga

SEQ ID NO: 671526 - DNA, 25 bp, Artificial sequence
  Synthetic oligonucleotide
acagcgtgaccttcttcatcttcgc

SEQ ID NO: 671527 - DNA, 25 bp, Artificial sequence
  Synthetic oligonucleotide
cgggatcagctcgatcatgggcgcg

SEQ ID NO: 671528 - DNA, 25 bp, Artificial sequence
  Synthetic oligonucleotide
tgcgcgccccgggcatgaccctgat

SEQ ID NO: 671529 - DNA, 25 bp, Artificial sequence
  Synthetic oligonucleotide
tcaacctgcgcgccccgggcatgac

SEQ ID NO: 671530 - DNA, 25 bp, Artificial sequence
  Synthetic oligonucleotide
ccatcctcaacctgcgcgccccggg

SEQ ID NO: 671531 - DNA, 25 bp, Artificial sequence
  Synthetic oligonucleotide
cgccaccatcctcaacctgcgcgcc

SEQ ID NO: 671532 - DNA, 25 bp, Artificial sequence
  Synthetic oligonucleotide
cgtgatcgccaccatcctcaacctg

SEQ ID NO: 671533 - DNA, 25 bp, Artificial sequence
  Synthetic oligonucleotide
gatcaacgtgatcgccaccatcctc

SEQ ID NO: 671534 - DNA, 25 bp, Artificial sequence
  Synthetic oligonucleotide
gggcgcgatcaacgtgatcgccacc

SEQ ID NO: 671535 - DNA, 25 bp, Artificial sequence
  Synthetic oligonucleotide
gatcatgggcgcgatcaacgtgatc

SEQ ID NO: 671536 - DNA, 25 bp, Artificial sequence
  Synthetic oligonucleotide
cagctcgatcatgggcgcgatcaac

SEQ ID NO: 671537 - DNA, 25 bp, Artificial sequence
  Synthetic oligonucleotide
cctggccgggatcagctcgatcatg

SEQ ID NO: 671538 - DNA, 25 bp, Artificial sequence
  Synthetic oligonucleotide
tcttcgccatccacctggccgggat

SEQ ID NO: 671539 - DNA, 25 bp, Artificial sequence
  Synthetic oligonucleotide
tcggcctgctggtcagcaccttgtt

SEQ ID NO: 671540 - DNA, 25 bp, Artificial sequence
  Synthetic oligonucleotide
tgaccttcttcatcttcgccatcca

SEQ ID NO: 671541 - DNA, 25 bp, Artificial sequence
  Synthetic oligonucleotide
tgctggtcagcaccttgttcatgcc

SEQ ID NO: 671542 - DNA, 25 bp, Artificial sequence
  Synthetic oligonucleotide
ccccgcacagcgtgaccttcttcat

SEQ ID NO: 671543 - DNA, 25 bp, Artificial sequence
  Synthetic oligonucleotide
ccttcgccccgcacagcgtgacctt

SEQ ID NO: 671544 - DNA, 25 bp, Artificial sequence
  Synthetic oligonucleotide
cgaccaccttcgccccgcacagcgt

SEQ ID NO: 671545 - DNA, 25 bp, Artificial sequence
  Synthetic oligonucleotide
cgctgtcgaccaccttcgccccgca

SEQ ID NO: 671546 - DNA, 25 bp, Artificial sequence
  Synthetic oligonucleotide
atgcgccgctgtcgaccaccttcgc

SEQ ID NO: 671547 - DNA, 25 bp, Artificial sequence
  Synthetic oligonucleotide
ccttctatgcgccgctgtcgaccac

SEQ ID NO: 671548 - DNA, 25 bp, Artificial sequence
  Synthetic oligonucleotide
gctggaccttctatgcgccgctgtc

SEQ ID NO: 671549 - DNA, 25 bp, Artificial sequence
  Synthetic oligonucleotide
acttcggctggaccttctatgcgcc

SEQ ID NO: 671550 - DNA, 25 bp, Artificial sequence
  Synthetic oligonucleotide
gccccaacttcggctggaccttcta

SEQ ID NO: 671551 - DNA, 25 bp, Artificial sequence
  Synthetic oligonucleotide
cggcggcggccccaacttcggctgg

SEQ ID NO: 671552 - DNA, 25 bp, Artificial sequence
  Synthetic oligonucleotide
tcatgcccggcggcggccccaactt

SEQ ID NO: 671553 - DNA, 25 bp, Artificial sequence
  Synthetic oligonucleotide
ccttgttcatgcccggcggcggccc

SEQ ID NO: 671554 - DNA, 25 bp, Artificial sequence
  Synthetic oligonucleotide
gcatgaccctgatgaagatgccgct

SEQ ID NO: 671555 - DNA, 25 bp, Artificial sequence
  Synthetic oligonucleotide
tcttcatcttcgccatccacctggc

SEQ ID NO: 671556 - DNA, 25 bp, Artificial sequence
  Synthetic oligonucleotide
gcatgccgcgacggatccccgacta

SEQ ID NO: 671557 - DNA, 25 bp, Artificial sequence
  Synthetic oligonucleotide
ccacccagctgctgttcctgttcat

SEQ ID NO: 671558 - DNA, 25 bp, Artificial sequence
  Synthetic oligonucleotide
tcggcaccacccagctgctgttcct

SEQ ID NO: 671559 - DNA, 25 bp, Artificial sequence
  Synthetic oligonucleotide
tcatgttcggcaccacccagctgct

SEQ ID NO: 671560 - DNA, 25 bp, Artificial sequence
  Synthetic oligonucleotide
gcgccttcatgttcggcaccaccca

SEQ ID NO: 671561 - DNA, 25 bp, Artificial sequence
  Synthetic oligonucleotide
cgatcggcgccttcatgttcggcac

SEQ ID NO: 671562 - DNA, 25 bp, Artificial sequence
  Synthetic oligonucleotide
tctcgtcgatcggcgccttcatgtt

SEQ ID NO: 671563 - DNA, 25 bp, Artificial sequence
  Synthetic oligonucleotide
acatggtctcgtcgatcggcgcctt

SEQ ID NO: 671564 - DNA, 25 bp, Artificial sequence
  Synthetic oligonucleotide
acttcaacatggtctcgtcgatcgg

SEQ ID NO: 671565 - DNA, 25 bp, Artificial sequence
  Synthetic oligonucleotide
tcgccgacttcaacatggtctcgtc

SEQ ID NO: 671566 - DNA, 25 bp, Artificial sequence
  Synthetic oligonucleotide
tgcagttcgccgacttcaacatggt

SEQ ID NO: 671567 - DNA, 25 bp, Artificial sequence
  Synthetic oligonucleotide
acaacctgcagttcgccgacttcaa

SEQ ID NO: 671568 - DNA, 25 bp, Artificial sequence
  Synthetic oligonucleotide
ccgactacaacctgcagttcgccga

SEQ ID NO: 671569 - DNA, 25 bp, Artificial sequence
  Synthetic oligonucleotide
ggcaagctgcacttctggatgagct

SEQ ID NO: 671570 - DNA, 25 bp, Artificial sequence
  Synthetic oligonucleotide
cgcgacggatccccgactacaacct

SEQ ID NO: 671571 - DNA, 25 bp, Artificial sequence
  Synthetic oligonucleotide
tgttcatcgtcatcaagtgcatccg

SEQ ID NO: 671572 - DNA, 25 bp, Artificial sequence
  Synthetic oligonucleotide
tcgccggcatgccgcgacggatccc

SEQ ID NO: 671573 - DNA, 25 bp, Artificial sequence
  Synthetic oligonucleotide
tcggcctcgccggcatgccgcgacg

SEQ ID NO: 671574 - DNA, 25 bp, Artificial sequence
  Synthetic oligonucleotide
acttcgtcggcctcgccggcatgcc

SEQ ID NO: 671575 - DNA, 25 bp, Artificial sequence
  Synthetic oligonucleotide
cgatgcacttcgtcggcctcgccgg

SEQ ID NO: 671576 - DNA, 25 bp, Artificial sequence
  Synthetic oligonucleotide
tcttcccgatgcacttcgtcggcct

SEQ ID NO: 671577 - DNA, 25 bp, Artificial sequence
  Synthetic oligonucleotide
tggcgttcttcccgatgcacttcgt

SEQ ID NO: 671578 - DNA, 25 bp, Artificial sequence
  Synthetic oligonucleotide
tgaacctggcgttcttcccgatgca

SEQ ID NO: 671579 - DNA, 25 bp, Artificial sequence
  Synthetic oligonucleotide
tcggcatgaacctggcgttcttccc

SEQ ID NO: 671580 - DNA, 25 bp, Artificial sequence
  Synthetic oligonucleotide
cttcatcggcatgaacctggcgttc

SEQ ID NO: 671581 - DNA, 25 bp, Artificial sequence
  Synthetic oligonucleotide
gatgagcttcatcggcatgaacctg

SEQ ID NO: 671582 - DNA, 25 bp, Artificial sequence
  Synthetic oligonucleotide
ttctggatgagcttcatcggcatga

SEQ ID NO: 671583 - DNA, 25 bp, Artificial sequence
  Synthetic oligonucleotide
ctgcacttctggatgagcttcatcg

SEQ ID NO: 671584 - DNA, 25 bp, Artificial sequence
  Synthetic oligonucleotide
ggatccccgactacaacctgcagtt

SEQ ID NO: 671585 - DNA, 25 bp, Artificial sequence
  Synthetic oligonucleotide
tcgccggcgccctaccacaccttca

SEQ ID NO: 671586 - DNA, 25 bp, Artificial sequence
  Synthetic oligonucleotide
ggtcgatacccgccgcctggtcggc

SEQ ID NO: 671587 - DNA, 25 bp, Artificial sequence
  Synthetic oligonucleotide
tgccaaggtcgatacccgccgcctg

SEQ ID NO: 671588 - DNA, 25 bp, Artificial sequence
  Synthetic oligonucleotide
gagcgatgccaaggtcgatacccgc

SEQ ID NO: 671589 - DNA, 25 bp, Artificial sequence
  Synthetic oligonucleotide
catccacctggccgggatcagctcg

SEQ ID NO: 671590 - DNA, 25 bp, Artificial sequence
  Synthetic oligonucleotide
gtcggcatcccggtcaccggcgagc

SEQ ID NO: 671591 - DNA, 25 bp, Artificial sequence
  Synthetic oligonucleotide
cgtcatgagcgatgccaaggtcgat

SEQ ID NO: 671592 - DNA, 25 bp, Artificial sequence
  Synthetic oligonucleotide
ggagcgcgtcatgagcgatgccaag

SEQ ID NO: 671593 - DNA, 25 bp, Artificial sequence
  Synthetic oligonucleotide
aagtgaggagcgcgtcatgagcgat

SEQ ID NO: 671594 - DNA, 25 bp, Artificial sequence
  Synthetic oligonucleotide
gaggtcaagtgaggagcgcgtcatg

SEQ ID NO: 671595 - DNA, 25 bp, Artificial sequence
  Synthetic oligonucleotide
ccgcccgaggtcaagtgaggagcgc

SEQ ID NO: 671596 - DNA, 25 bp, Artificial sequence
  Synthetic oligonucleotide
agcaccccgcccgaggtcaagtgag

SEQ ID NO: 671597 - DNA, 25 bp, Artificial sequence
  Synthetic oligonucleotide
accttcagcaccccgcccgaggtca

SEQ ID NO: 671598 - DNA, 25 bp, Artificial sequence
  Synthetic oligonucleotide
agctgctgttcctgttcatcgtcat

SEQ ID NO: 671599 - DNA, 25 bp, Artificial sequence
  Synthetic oligonucleotide
gcgccctaccacaccttcagcaccc

SEQ ID NO: 671600 - DNA, 25 bp, Artificial sequence
  Synthetic oligonucleotide
tgttcctgttcatcgtcatcaagtg

SEQ ID NO: 671601 - DNA, 25 bp, Artificial sequence
  Synthetic oligonucleotide
atcccctcgccggcgccctaccaca

SEQ ID NO: 671602 - DNA, 25 bp, Artificial sequence
  Synthetic oligonucleotide
tggagcatcccctcgccggcgccct

SEQ ID NO: 671603 - DNA, 25 bp, Artificial sequence
  Synthetic oligonucleotide
ctggagtggagcatcccctcgccgg

SEQ ID NO: 671604 - DNA, 25 bp, Artificial sequence
  Synthetic oligonucleotide
gagggcctggagtggagcatcccct

SEQ ID NO: 671605 - DNA, 25 bp, Artificial sequence
  Synthetic oligonucleotide
ggcgccgagggcctggagtggagca

SEQ ID NO: 671606 - DNA, 25 bp, Artificial sequence
  Synthetic oligonucleotide
tgggacggcgccgagggcctggagt

SEQ ID NO: 671607 - DNA, 25 bp, Artificial sequence
  Synthetic oligonucleotide
caagccctgggacggcgccgagggc

SEQ ID NO: 671608 - DNA, 25 bp, Artificial sequence
  Synthetic oligonucleotide
cctgccaagccctgggacggcgccg

SEQ ID NO: 671609 - DNA, 25 bp, Artificial sequence
  Synthetic oligonucleotide
ccggcccctgccaagccctgggacg

SEQ ID NO: 671610 - DNA, 25 bp, Artificial sequence
  Synthetic oligonucleotide
ggcaagccggcccctgccaagccct

SEQ ID NO: 671611 - DNA, 25 bp, Artificial sequence
  Synthetic oligonucleotide
cgcggcggcaagccggcccctgcca

SEQ ID NO: 671612 - DNA, 25 bp, Artificial sequence
  Synthetic oligonucleotide
atcaagtgcatccgcggcggcaagc

SEQ ID NO: 671613 - DNA, 25 bp, Artificial sequence
  Synthetic oligonucleotide
tcgtcatcaagtgcatccgcggcgg

SEQ ID NO: 671614 - DNA, 25 bp, Artificial sequence
  Synthetic oligonucleotide
taccacaccttcagcaccccgcccg

SEQ ID NO: 671615 - DNA, 25 bp, Artificial sequence
  Synthetic oligonucleotide
gaaggtgttcaactgggtgaccacc

SEQ ID NO: 671616 - DNA, 25 bp, Artificial sequence
  Synthetic oligonucleotide
atcggcggcttctccggactgatgc

SEQ ID NO: 671617 - DNA, 25 bp, Artificial sequence
  Synthetic oligonucleotide
ttcaccatcggcggcttctccggac

SEQ ID NO: 671618 - DNA, 25 bp, Artificial sequence
  Synthetic oligonucleotide
atcctgttcaccatcggcggcttct

SEQ ID NO: 671619 - DNA, 25 bp, Artificial sequence
  Synthetic oligonucleotide
tcgtcatcctgttcaccatcggcgg

SEQ ID NO: 671620 - DNA, 25 bp, Artificial sequence
  Synthetic oligonucleotide
tggccttcgtcatcctgttcaccat

SEQ ID NO: 671621 - DNA, 25 bp, Artificial sequence
  Synthetic oligonucleotide
tcgccgtggccttcgtcatcctgtt

SEQ ID NO: 671622 - DNA, 25 bp, Artificial sequence
  Synthetic oligonucleotide
tgctgttcgccgtggccttcgtcat

SEQ ID NO: 671623 - DNA, 25 bp, Artificial sequence
  Synthetic oligonucleotide
cgccgatgctgttcgccgtggcctt

SEQ ID NO: 671624 - DNA, 25 bp, Artificial sequence
  Synthetic oligonucleotide
tcgagacgccgatgctgttcgccgt

SEQ ID NO: 671625 - DNA, 25 bp, Artificial sequence
  Synthetic oligonucleotide
tgaccttcgagacgccgatgctgtt

SEQ ID NO: 671626 - DNA, 25 bp, Artificial sequence
  Synthetic oligonucleotide
ttcgctgaccttcgagacgccgatg

SEQ ID NO: 671627 - DNA, 25 bp, Artificial sequence
  Synthetic oligonucleotide
atgtgggagggttcgctgaccttcg

SEQ ID NO: 671628 - DNA, 25 bp, Artificial sequence
  Synthetic oligonucleotide
gcttctccggactgatgctggcgat

SEQ ID NO: 671629 - DNA, 25 bp, Artificial sequence
  Synthetic oligonucleotide
gttcaactgggtgaccaccatgtgg

SEQ ID NO: 671630 - DNA, 25 bp, Artificial sequence
  Synthetic oligonucleotide
gagggttcgctgaccttcgagacgc

SEQ ID NO: 671631 - DNA, 25 bp, Artificial sequence
  Synthetic oligonucleotide
cggggtgaaggtgttcaactgggtg

SEQ ID NO: 671632 - DNA, 25 bp, Artificial sequence
  Synthetic oligonucleotide
tgcccaccggggtgaaggtgttcaa

SEQ ID NO: 671633 - DNA, 25 bp, Artificial sequence
  Synthetic oligonucleotide
cgcggtgcccaccggggtgaaggtg

SEQ ID NO: 671634 - DNA, 25 bp, Artificial sequence
  Synthetic oligonucleotide
ctgatcgcggtgcccaccggggtga

SEQ ID NO: 671635 - DNA, 25 bp, Artificial sequence
  Synthetic oligonucleotide
accatgctgatcgcggtgcccaccg

SEQ ID NO: 671636 - DNA, 25 bp, Artificial sequence
  Synthetic oligonucleotide
tacgccaccatgctgatcgcggtgc

SEQ ID NO: 671637 - DNA, 25 bp, Artificial sequence
  Synthetic oligonucleotide
accctcggcaagctgcacttctgga

SEQ ID NO: 671638 - DNA, 25 bp, Artificial sequence
  Synthetic oligonucleotide
tgcatccgcggcggcaagccggccc

SEQ ID NO: 671639 - DNA, 25 bp, Artificial sequence
  Synthetic oligonucleotide
ttcatgtacgccaccatgctgatcg

SEQ ID NO: 671640 - DNA, 25 bp, Artificial sequence
  Synthetic oligonucleotide
ctgttcttcatgtacgccaccatgc

SEQ ID NO: 671641 - DNA, 25 bp, Artificial sequence
  Synthetic oligonucleotide
ggcgagctgttcttcatgtacgcca

SEQ ID NO: 671642 - DNA, 25 bp, Artificial sequence
  Synthetic oligonucleotide
gtcaccggcgagctgttcttcatgt

SEQ ID NO: 671643 - DNA, 25 bp, Artificial sequence
  Synthetic oligonucleotide
atcccggtcaccggcgagctgttct

SEQ ID NO: 671644 - DNA, 25 bp, Artificial sequence
  Synthetic oligonucleotide
ctgggtgaccaccatgtgggagggt

SEQ ID NO: 671645 - DNA, 25 bp, Artificial sequence
  Synthetic oligonucleotide
ttcgcctcggcttactactggctgc

SEQ ID NO: 671646 - DNA, 25 bp, Artificial sequence
  Synthetic oligonucleotide
atgtacgacgagaccctcggcaagc

SEQ ID NO: 671647 - DNA, 25 bp, Artificial sequence
  Synthetic oligonucleotide
tgctggtgcccggcgcgatcttcgg

SEQ ID NO: 671648 - DNA, 25 bp, Artificial sequence
  Synthetic oligonucleotide
tgcccggcgcgatcttcggcatctt

SEQ ID NO: 671649 - DNA, 25 bp, Artificial sequence
  Synthetic oligonucleotide
ggccacatgtacgacgagaccctcg

SEQ ID NO: 671650 - DNA, 25 bp, Artificial sequence
  Synthetic oligonucleotide
tggaccggccacatgtacgacgaga

SEQ ID NO: 671651 - DNA, 25 bp, Artificial sequence
  Synthetic oligonucleotide
actacgtgctggtgcccggcgcgat

SEQ ID NO: 671652 - DNA, 25 bp, Artificial sequence
  Synthetic oligonucleotide
gcatcttcgcctcggcttactactg

SEQ ID NO: 671653 - DNA, 25 bp, Artificial sequence
  Synthetic oligonucleotide
cgcgatcttcggcatcttcgcctcg

SEQ ID NO: 671654 - DNA, 25 bp, Artificial sequence
  Synthetic oligonucleotide
tcggcttactactggctgccgaagt

SEQ ID NO: 671655 - DNA, 25 bp, Artificial sequence
  Synthetic oligonucleotide
tccggactgatgctggcgatcgccc

SEQ ID NO: 671656 - DNA, 25 bp, Artificial sequence
  Synthetic oligonucleotide
accaccatgtgggagggttcgctga

SEQ ID NO: 671657 - DNA, 25 bp, Artificial sequence
  Synthetic oligonucleotide
tactactggctgccgaagtggaccg

SEQ ID NO: 671658 - DNA, 25 bp, Artificial sequence
  Synthetic oligonucleotide
tggctgccgaagtggaccggccaca

SEQ ID NO: 671659 - DNA, 25 bp, Artificial sequence
  Synthetic oligonucleotide
ccgaagtggaccggccacatgtacg

SEQ ID NO: 671660 - DNA, 25 bp, Artificial sequence
  Synthetic oligonucleotide
tcttcggcatcttcgcctcggctta

SEQ ID NO: 671661 - DNA, 25 bp, Artificial sequence
  Synthetic oligonucleotide
gacttccagtaccacgacacctact

SEQ ID NO: 671662 - DNA, 25 bp, Artificial sequence
  Synthetic oligonucleotide
ctgatgctggcgatcgccccggcag

SEQ ID NO: 671663 - DNA, 25 bp, Artificial sequence
  Synthetic oligonucleotide
ctggcgatcgccccggcagacttcc

SEQ ID NO: 671664 - DNA, 25 bp, Artificial sequence
  Synthetic oligonucleotide
ccggcagacttccagtaccacgaca

SEQ ID NO: 671665 - DNA, 25 bp, Artificial sequence
  Synthetic oligonucleotide
gacgagaccctcggcaagctgcact

SEQ ID NO: 671666 - DNA, 25 bp, Artificial sequence
  Synthetic oligonucleotide
cagtaccacgacacctacttcgtgg

SEQ ID NO: 671667 - DNA, 25 bp, Artificial sequence
  Synthetic oligonucleotide
cacgacacctacttcgtggtcgccc

SEQ ID NO: 671668 - DNA, 25 bp, Artificial sequence
  Synthetic oligonucleotide
cctacttcgtggtcgcccacttcca

SEQ ID NO: 671669 - DNA, 25 bp, Artificial sequence
  Synthetic oligonucleotide
tcgtggtcgcccacttccactacgt

SEQ ID NO: 671670 - DNA, 25 bp, Artificial sequence
  Synthetic oligonucleotide
tcgcccacttccactacgtgctggt

SEQ ID NO: 671671 - DNA, 25 bp, Artificial sequence
  Synthetic oligonucleotide
acttccactacgtgctggtgcccgg

SEQ ID NO: 671672 - DNA, 25 bp, Artificial sequence
  Synthetic oligonucleotide
atcgccccggcagacttccagtacc

SEQ ID NO: 671673 - DNA, 25 bp, Artificial sequence
  Synthetic oligonucleotide
tggcaagacttcccgacgccgaact

SEQ ID NO: 671674 - DNA, 25 bp, Artificial sequence
  Synthetic oligonucleotide
tacactggcaagacttcccgacgcc

SEQ ID NO: 671675 - DNA, 25 bp, Artificial sequence
  Synthetic oligonucleotide
cggaaatacactggcaagacttccc

SEQ ID NO: 671676 - DNA, 25 bp, Artificial sequence
  Synthetic oligonucleotide
agtgtccggaaatacactggcaaga

SEQ ID NO: 671677 - DNA, 25 bp, Artificial sequence
  Synthetic oligonucleotide
gtttccagtgtccggaaatacactg

SEQ ID NO: 671678 - DNA, 25 bp, Artificial sequence
  Synthetic oligonucleotide
gaaagcctaaagcccgatgagtcga

SEQ ID NO: 671679 - DNA, 25 bp, Artificial sequence
  Synthetic oligonucleotide
tttcagccggtttccagtgtccgga

SEQ ID NO: 671680 - DNA, 25 bp, Artificial sequence
  Synthetic oligonucleotide
ctaaagcccgatgagtcgaagagac

SEQ ID NO: 671681 - DNA, 25 bp, Artificial sequence
  Synthetic oligonucleotide
gactgcgtttcagccggtttccagt

SEQ ID NO: 671682 - DNA, 25 bp, Artificial sequence
  Synthetic oligonucleotide
aagagactttcaatagaagagtccg

SEQ ID NO: 671683 - DNA, 25 bp, Artificial sequence
  Synthetic oligonucleotide
atagaagagtccgactgcgtttcag

SEQ ID NO: 671684 - DNA, 25 bp, Artificial sequence
  Synthetic oligonucleotide
gagtcgaagagactttcaatagaag

SEQ ID NO: 671685 - DNA, 25 bp, Artificial sequence
  Synthetic oligonucleotide
ctttcaatagaagagtccgactgcg

SEQ ID NO: 671686 - DNA, 25 bp, Artificial sequence
  Synthetic oligonucleotide
cccgatgagtcgaagagactttcaa

SEQ ID NO: 671687 - DNA, 25 bp, Artificial sequence
  Synthetic oligonucleotide
tttcgggttgcgcccggctgggcgc

SEQ ID NO: 671688 - DNA, 25 bp, Artificial sequence
  Synthetic oligonucleotide
gagtccgactgcgtttcagccggtt

SEQ ID NO: 671689 - DNA, 25 bp, Artificial sequence
  Synthetic oligonucleotide
ccggctgggcgccccatgggagcga

SEQ ID NO: 671690 - DNA, 25 bp, Artificial sequence
  Synthetic oligonucleotide
gcgcgacgccagcagaagcgtcgcc

SEQ ID NO: 671691 - DNA, 25 bp, Artificial sequence
  Synthetic oligonucleotide
atcgcccgcgcgacgccagcagaag

SEQ ID NO: 671692 - DNA, 25 bp, Artificial sequence
  Synthetic oligonucleotide
ggagcgatcgcccgcgcgacgccag

SEQ ID NO: 671693 - DNA, 25 bp, Artificial sequence
  Synthetic oligonucleotide
ccccatgggagcgatcgcccgcgcg

SEQ ID NO: 671694 - DNA, 25 bp, Artificial sequence
  Synthetic oligonucleotide
ctgaccgctcggacaattcttgcag

SEQ ID NO: 671695 - DNA, 25 bp, Artificial sequence
  Synthetic oligonucleotide
gacgtggaaagcctaaagcccgatg

SEQ ID NO: 671696 - DNA, 25 bp, Artificial sequence
  Synthetic oligonucleotide
acgccagcagaagcgtcgccgggaa

SEQ ID NO: 671697 - DNA, 25 bp, Artificial sequence
  Synthetic oligonucleotide
tcaaggccgctgataccagcggcct

SEQ ID NO: 671698 - DNA, 25 bp, Artificial sequence
  Synthetic oligonucleotide
tgggcgccccatgggagcgatcgcc

SEQ ID NO: 671699 - DNA, 25 bp, Artificial sequence
  Synthetic oligonucleotide
acttcccgacgccgaactttgattg

SEQ ID NO: 671700 - DNA, 25 bp, Artificial sequence
  Synthetic oligonucleotide
gttgcgcccggctgggcgccccatg

SEQ ID NO: 671701 - DNA, 25 bp, Artificial sequence
  Synthetic oligonucleotide
ccgctgataccagcggccttttttt

SEQ ID NO: 671702 - DNA, 25 bp, Artificial sequence
  Synthetic oligonucleotide
gtcttctcaaggccgctgataccag

SEQ ID NO: 671703 - DNA, 25 bp, Artificial sequence
  Synthetic oligonucleotide
attcgacgtcttctcaaggccgctg

SEQ ID NO: 671704 - DNA, 25 bp, Artificial sequence
  Synthetic oligonucleotide
gctcctattcgacgtcttctcaagg

SEQ ID NO: 671705 - DNA, 25 bp, Artificial sequence
  Synthetic oligonucleotide
ttgattgctcctattcgacgtcttc

SEQ ID NO: 671706 - DNA, 25 bp, Artificial sequence
  Synthetic oligonucleotide
cgaactttgattgctcctattcgac

SEQ ID NO: 671707 - DNA, 25 bp, Artificial sequence
  Synthetic oligonucleotide
cgacgccgaactttgattgctccta

SEQ ID NO: 671708 - DNA, 25 bp, Artificial sequence
  Synthetic oligonucleotide
agcagaagcgtcgccgggaacgaca

SEQ ID NO: 671709 - DNA, 25 bp, Artificial sequence
  Synthetic oligonucleotide
ccgcatatgatatgcggcgtttttt

SEQ ID NO: 671710 - DNA, 25 bp, Artificial sequence
  Synthetic oligonucleotide
acaattcttgcagaatatgtaaaag

SEQ ID NO: 671711 - DNA, 25 bp, Artificial sequence
  Synthetic oligonucleotide
gaatatgtaaaagactttcgttgga

SEQ ID NO: 671712 - DNA, 25 bp, Artificial sequence
  Synthetic oligonucleotide
cttgcagaatatgtaaaagactttc

SEQ ID NO: 671713 - DNA, 25 bp, Artificial sequence
  Synthetic oligonucleotide
gctcggacaattcttgcagaatatg

SEQ ID NO: 671714 - DNA, 25 bp, Artificial sequence
  Synthetic oligonucleotide
tgccttcctgaccgctcggacaatt

SEQ ID NO: 671715 - DNA, 25 bp, Artificial sequence
  Synthetic oligonucleotide
ttttttgccttcctgaccgctcgga

SEQ ID NO: 671716 - DNA, 25 bp, Artificial sequence
  Synthetic oligonucleotide
tggatatcgggtttttccgatagtg

SEQ ID NO: 671717 - DNA, 25 bp, Artificial sequence
  Synthetic oligonucleotide
atgatatgcggcgttttttttgcct

SEQ ID NO: 671718 - DNA, 25 bp, Artificial sequence
  Synthetic oligonucleotide
tttccgatagtggcaaaaaaatata

SEQ ID NO: 671719 - DNA, 25 bp, Artificial sequence
  Synthetic oligonucleotide
cttgcgccgcatatgatatgcggcg

SEQ ID NO: 671720 - DNA, 25 bp, Artificial sequence
  Synthetic oligonucleotide
agcgtcgccgggaacgacaccacaa

SEQ ID NO: 671721 - DNA, 25 bp, Artificial sequence
  Synthetic oligonucleotide
gaagcgtgagcctgggtaccctgtc

SEQ ID NO: 671722 - DNA, 25 bp, Artificial sequence
  Synthetic oligonucleotide
ggctgaagctcgacggcggcggcgg

SEQ ID NO: 671723 - DNA, 25 bp, Artificial sequence
  Synthetic oligonucleotide
tgagcctgggtaccctgtccttgcg

SEQ ID NO: 671724 - DNA, 25 bp, Artificial sequence
  Synthetic oligonucleotide
cctgtccttgcgccgcatatgatat

SEQ ID NO: 671725 - DNA, 25 bp, Artificial sequence
  Synthetic oligonucleotide
tgggtaccctgtccttgcgccgcat

SEQ ID NO: 671726 - DNA, 25 bp, Artificial sequence
  Synthetic oligonucleotide
atgcggcgttttttttgccttcctg

SEQ ID NO: 671727 - DNA, 25 bp, Artificial sequence
  Synthetic oligonucleotide
tgtcgctggctgtcgacgatattcg

SEQ ID NO: 671728 - DNA, 25 bp, Artificial sequence
  Synthetic oligonucleotide
tgcaagagcgggacgtggaaagcct

SEQ ID NO: 671729 - DNA, 25 bp, Artificial sequence
  Synthetic oligonucleotide
tcgccatgcaagagcgggacgtgga

SEQ ID NO: 671730 - DNA, 25 bp, Artificial sequence
  Synthetic oligonucleotide
tcgatctcgccatgcaagagcggga

SEQ ID NO: 671731 - DNA, 25 bp, Artificial sequence
  Synthetic oligonucleotide
tcttcatcgatctcgccatgcaaga

SEQ ID NO: 671732 - DNA, 25 bp, Artificial sequence
  Synthetic oligonucleotide
gttctgtcttcatcgatctcgccat

SEQ ID NO: 671733 - DNA, 25 bp, Artificial sequence
  Synthetic oligonucleotide
atattcgttctgtcttcatcgatct

SEQ ID NO: 671734 - DNA, 25 bp, Artificial sequence
  Synthetic oligonucleotide
tgtaaaagactttcgttggatatcg

SEQ ID NO: 671735 - DNA, 25 bp, Artificial sequence
  Synthetic oligonucleotide
tggctgtcgacgatattcgttctgt

SEQ ID NO: 671736 - DNA, 25 bp, Artificial sequence
  Synthetic oligonucleotide
gagcgggacgtggaaagcctaaagc

SEQ ID NO: 671737 - DNA, 25 bp, Artificial sequence
  Synthetic oligonucleotide
gataattgtcgctggctgtcgacga

SEQ ID NO: 671738 - DNA, 25 bp, Artificial sequence
  Synthetic oligonucleotide
tcaatggataattgtcgctggctgt

SEQ ID NO: 671739 - DNA, 25 bp, Artificial sequence
  Synthetic oligonucleotide
gccagctcaatggataattgtcgct

SEQ ID NO: 671740 - DNA, 25 bp, Artificial sequence
  Synthetic oligonucleotide
aatcgcgccagctcaatggataatt

SEQ ID NO: 671741 - DNA, 25 bp, Artificial sequence
  Synthetic oligonucleotide
aaatataatcgcgccagctcaatgg

SEQ ID NO: 671742 - DNA, 25 bp, Artificial sequence
  Synthetic oligonucleotide
gcaaaaaaatataatcgcgccagct

SEQ ID NO: 671743 - DNA, 25 bp, Artificial sequence
  Synthetic oligonucleotide
atagtggcaaaaaaatataatcgcg

SEQ ID NO: 671744 - DNA, 25 bp, Artificial sequence
  Synthetic oligonucleotide
tcgacgatattcgttctgtcttcat

SEQ ID NO: 671745 - DNA, 25 bp, Artificial sequence
  Synthetic oligonucleotide
ccacctttcagtccggctacacgcc

SEQ ID NO: 671746 - DNA, 25 bp, Artificial sequence
  Synthetic oligonucleotide
acggcatgctcgggctgaagctcga

SEQ ID NO: 671747 - DNA, 25 bp, Artificial sequence
  Synthetic oligonucleotide
gcgtcgacgcctacggcatgctcgg

SEQ ID NO: 671748 - DNA, 25 bp, Artificial sequence
  Synthetic oligonucleotide
gcttcggcgtcgacgcctacggcat

SEQ ID NO: 671749 - DNA, 25 bp, Artificial sequence
  Synthetic oligonucleotide
tggtcggcttcggcgtcgacgccta

SEQ ID NO: 671750 - DNA, 25 bp, Artificial sequence
  Synthetic oligonucleotide
cggcgtggtcggcttcggcgtcgac

SEQ ID NO: 671751 - DNA, 25 bp, Artificial sequence
  Synthetic oligonucleotide
acacgcccggcgtggtcggcttcgg

SEQ ID NO: 671752 - DNA, 25 bp, Artificial sequence
  Synthetic oligonucleotide
tgctcgggctgaagctcgacggcgg

SEQ ID NO: 671753 - DNA, 25 bp, Artificial sequence
  Synthetic oligonucleotide
ttcagtccggctacacgcccggcgt

SEQ ID NO: 671754 - DNA, 25 bp, Artificial sequence
  Synthetic oligonucleotide
agctcgacggcggcggcggtaccgg

SEQ ID NO: 671755 - DNA, 25 bp, Artificial sequence
  Synthetic oligonucleotide
catcgccacctttcagtccggctac

SEQ ID NO: 671756 - DNA, 25 bp, Artificial sequence
  Synthetic oligonucleotide
aggcttcatcgccacctttcagtcc

SEQ ID NO: 671757 - DNA, 25 bp, Artificial sequence
  Synthetic oligonucleotide
ggcgcaaggcttcatcgccaccttt

SEQ ID NO: 671758 - DNA, 25 bp, Artificial sequence
  Synthetic oligonucleotide
ggaatgggcgcaaggcttcatcgcc

SEQ ID NO: 671759 - DNA, 25 bp, Artificial sequence
  Synthetic oligonucleotide
cagcaaggaatgggcgcaaggcttc

SEQ ID NO: 671760 - DNA, 25 bp, Artificial sequence
  Synthetic oligonucleotide
gcacgacagcaaggaatgggcgcaa

SEQ ID NO: 671761 - DNA, 25 bp, Artificial sequence
  Synthetic oligonucleotide
cttccgggcacgacagcaaggaatg

SEQ ID NO: 671762 - DNA, 25 bp, Artificial sequence
  Synthetic oligonucleotide
ccggctacacgcccggcgtggtcgg

SEQ ID NO: 671763 - DNA, 25 bp, Artificial sequence
  Synthetic oligonucleotide
ctcgccgagcaaggaaggctacgaa

SEQ ID NO: 671764 - DNA, 25 bp, Artificial sequence
  Synthetic oligonucleotide
gcccgatgagttctccagtggcggg

SEQ ID NO: 671765 - DNA, 25 bp, Artificial sequence
  Synthetic oligonucleotide
aaggcgcccgatgagttctccagtg

SEQ ID NO: 671766 - DNA, 25 bp, Artificial sequence
  Synthetic oligonucleotide
acctggagcgccacgtctgcctgcg

SEQ ID NO: 671767 - DNA, 25 bp, Artificial sequence
  Synthetic oligonucleotide
actcgggaagcgtgagcctgggtac

SEQ ID NO: 671768 - DNA, 25 bp, Artificial sequence
  Synthetic oligonucleotide
tccggcaaggcgcccgatgagttct

SEQ ID NO: 671769 - DNA, 25 bp, Artificial sequence
  Synthetic oligonucleotide
ctacgaatccggcaaggcgcccgat

SEQ ID NO: 671770 - DNA, 25 bp, Artificial sequence
  Synthetic oligonucleotide
acgcctacggcatgctcgggctgaa

SEQ ID NO: 671771 - DNA, 25 bp, Artificial sequence
  Synthetic oligonucleotide
gagcaaggaaggctacgaatccggc

SEQ ID NO: 671772 - DNA, 25 bp, Artificial sequence
  Synthetic oligonucleotide
accatgaccgccggcacgcttccgg

SEQ ID NO: 671773 - DNA, 25 bp, Artificial sequence
  Synthetic oligonucleotide
gatcacctcgccgagcaaggaaggc

SEQ ID NO: 671774 - DNA, 25 bp, Artificial sequence
  Synthetic oligonucleotide
cctgccgatcacctcgccgagcaag

SEQ ID NO: 671775 - DNA, 25 bp, Artificial sequence
  Synthetic oligonucleotide
cagcatcctgccgatcacctcgccg

SEQ ID NO: 671776 - DNA, 25 bp, Artificial sequence
  Synthetic oligonucleotide
gcggcaccagcatcctgccgatcac

SEQ ID NO: 671777 - DNA, 25 bp, Artificial sequence
  Synthetic oligonucleotide
gtaccggcggcaccagcatcctgcc

SEQ ID NO: 671778 - DNA, 25 bp, Artificial sequence
  Synthetic oligonucleotide
gcggcggtaccggcggcaccagcat

SEQ ID NO: 671779 - DNA, 25 bp, Artificial sequence
  Synthetic oligonucleotide
gacggcggcggcggtaccggcggca

SEQ ID NO: 671780 - DNA, 25 bp, Artificial sequence
  Synthetic oligonucleotide
aggaaggctacgaatccggcaaggc

SEQ ID NO: 671781 - DNA, 25 bp, Artificial sequence
  Synthetic oligonucleotide
acgctgtaagaaggagcaaccgcaa

SEQ ID NO: 671782 - DNA, 25 bp, Artificial sequence
  Synthetic oligonucleotide
gccgatggcgctggcgctgtgcacc

SEQ ID NO: 671783 - DNA, 25 bp, Artificial sequence
  Synthetic oligonucleotide
ttgacgccgatggcgctggcgctgt

SEQ ID NO: 671784 - DNA, 25 bp, Artificial sequence
  Synthetic oligonucleotide
ttcgccttgacgccgatggcgctgg

SEQ ID NO: 671785 - DNA, 25 bp, Artificial sequence
  Synthetic oligonucleotide
aatctgttcgccttgacgccgatgg

SEQ ID NO: 671786 - DNA, 25 bp, Artificial sequence
  Synthetic oligonucleotide
atgaggaatctgttcgccttgacgc

SEQ ID NO: 671787 - DNA, 25 bp, Artificial sequence
  Synthetic oligonucleotide
accgcaatgaggaatctgttcgcct

SEQ ID NO: 671788 - DNA, 25 bp, Artificial sequence
  Synthetic oligonucleotide
ggcacgcttccgggcacgacagcaa

SEQ ID NO: 671789 - DNA, 25 bp, Artificial sequence
  Synthetic oligonucleotide
taagaaggagcaaccgcaatgagga

SEQ ID NO: 671790 - DNA, 25 bp, Artificial sequence
  Synthetic oligonucleotide
ctgtgcaccgcgtccgccgcctggg

SEQ ID NO: 671791 - DNA, 25 bp, Artificial sequence
  Synthetic oligonucleotide
ttcaccacgctgtaagaaggagcaa

SEQ ID NO: 671792 - DNA, 25 bp, Artificial sequence
  Synthetic oligonucleotide
ccggatttcaccacgctgtaagaag

SEQ ID NO: 671793 - DNA, 25 bp, Artificial sequence
  Synthetic oligonucleotide
gccttgccggatttcaccacgctgt

SEQ ID NO: 671794 - DNA, 25 bp, Artificial sequence
  Synthetic oligonucleotide
tttccggccttgccggatttcacca

SEQ ID NO: 671795 - DNA, 25 bp, Artificial sequence
  Synthetic oligonucleotide
cacgctttccggccttgccggattt

SEQ ID NO: 671796 - DNA, 25 bp, Artificial sequence
  Synthetic oligonucleotide
ccacaacacgctttccggccttgcc

SEQ ID NO: 671797 - DNA, 25 bp, Artificial sequence
  Synthetic oligonucleotide
acgacaccacaacacgctttccggc

SEQ ID NO: 671798 - DNA, 25 bp, Artificial sequence
  Synthetic oligonucleotide
ggagcaaccgcaatgaggaatctgt

SEQ ID NO: 671799 - DNA, 25 bp, Artificial sequence
  Synthetic oligonucleotide
agaaggcttcatcgaaggctccagc

SEQ ID NO: 671800 - DNA, 25 bp, Artificial sequence
  Synthetic oligonucleotide
ccgggaacgacaccacaacacgctt

SEQ ID NO: 671801 - DNA, 25 bp, Artificial sequence
  Synthetic oligonucleotide
acttcaaccatgaccgccggcacgc

SEQ ID NO: 671802 - DNA, 25 bp, Artificial sequence
  Synthetic oligonucleotide
actactacttcaaccatgaccgccg

SEQ ID NO: 671803 - DNA, 25 bp, Artificial sequence
  Synthetic oligonucleotide
cccgcaactactacttcaaccatga

SEQ ID NO: 671804 - DNA, 25 bp, Artificial sequence
  Synthetic oligonucleotide
tgctgacccgcaactactacttcaa

SEQ ID NO: 671805 - DNA, 25 bp, Artificial sequence
  Synthetic oligonucleotide
tccaattgctgacccgcaactacta

SEQ ID NO: 671806 - DNA, 25 bp, Artificial sequence
  Synthetic oligonucleotide
tccagcctccaattgctgacccgca

SEQ ID NO: 671807 - DNA, 25 bp, Artificial sequence
  Synthetic oligonucleotide
tggcgctggcgctgtgcaccgcgtc

SEQ ID NO: 671808 - DNA, 25 bp, Artificial sequence
  Synthetic oligonucleotide
ttcatcgaaggctccagcctccaat

SEQ ID NO: 671809 - DNA, 25 bp, Artificial sequence
  Synthetic oligonucleotide
ctggcgctgtgcaccgcgtccgccg

SEQ ID NO: 671810 - DNA, 25 bp, Artificial sequence
  Synthetic oligonucleotide
agccaaagaaggcttcatcgaaggc

SEQ ID NO: 671811 - DNA, 25 bp, Artificial sequence
  Synthetic oligonucleotide
agggggaagccaaagaaggcttcat

SEQ ID NO: 671812 - DNA, 25 bp, Artificial sequence
  Synthetic oligonucleotide
ccgatgagggggaagccaaagaagg

SEQ ID NO: 671813 - DNA, 25 bp, Artificial sequence
  Synthetic oligonucleotide
cctgggccgatgagggggaagccaa

SEQ ID NO: 671814 - DNA, 25 bp, Artificial sequence
  Synthetic oligonucleotide
tccgccgcctgggccgatgaggggg

SEQ ID NO: 671815 - DNA, 25 bp, Artificial sequence
  Synthetic oligonucleotide
accgcgtccgccgcctgggccgatg

SEQ ID NO: 671816 - DNA, 25 bp, Artificial sequence
  Synthetic oligonucleotide
accgccggcacgcttccgggcacga

SEQ ID NO: 671817 - DNA, 25 bp, Artificial sequence
  Synthetic oligonucleotide
gaaggctccagcctccaattgctga

SEQ ID NO: 671818 - DNA, 25 bp, Artificial sequence
  Synthetic oligonucleotide
tggtcaatgtcgccgaggtcatggc

SEQ ID NO: 671819 - DNA, 25 bp, Artificial sequence
  Synthetic oligonucleotide
ggcgttacctggacgcgaagatccg

SEQ ID NO: 671820 - DNA, 25 bp, Artificial sequence
  Synthetic oligonucleotide
ctcggcatcgccctgctgcccagct

SEQ ID NO: 671821 - DNA, 25 bp, Artificial sequence
  Synthetic oligonucleotide
ggccgacctcggcatcgccctgctg

SEQ ID NO: 671822 - DNA, 25 bp, Artificial sequence
  Synthetic oligonucleotide
cggccaaggccgacctcggcatcgc

SEQ ID NO: 671823 - DNA, 25 bp, Artificial sequence
  Synthetic oligonucleotide
cccaggcggccaaggccgacctcgg

SEQ ID NO: 671824 - DNA, 25 bp, Artificial sequence
  Synthetic oligonucleotide
tcatggcccaggcggccaaggccga

SEQ ID NO: 671825 - DNA, 25 bp, Artificial sequence
  Synthetic oligonucleotide
ctgctgcccagctacgtggcggccg

SEQ ID NO: 671826 - DNA, 25 bp, Artificial sequence
  Synthetic oligonucleotide
atgtcgccgaggtcatggcccaggc

SEQ ID NO: 671827 - DNA, 25 bp, Artificial sequence
  Synthetic oligonucleotide
gcccagctacgtggcggccgcggcg

SEQ ID NO: 671828 - DNA, 25 bp, Artificial sequence
  Synthetic oligonucleotide
ccttcatggtcaatgtcgccgaggt

SEQ ID NO: 671829 - DNA, 25 bp, Artificial sequence
  Synthetic oligonucleotide
agaacaccttcatggtcaatgtcgc

SEQ ID NO: 671830 - DNA, 25 bp, Artificial sequence
  Synthetic oligonucleotide
gcccgcagaacaccttcatggtcaa

SEQ ID NO: 671831 - DNA, 25 bp, Artificial sequence
  Synthetic oligonucleotide
ccgtcagcccgcagaacaccttcat

SEQ ID NO: 671832 - DNA, 25 bp, Artificial sequence
  Synthetic oligonucleotide
agcgcaccgtcagcccgcagaacac

SEQ ID NO: 671833 - DNA, 25 bp, Artificial sequence
  Synthetic oligonucleotide
agggcgagcgcaccgtcagcccgca

SEQ ID NO: 671834 - DNA, 25 bp, Artificial sequence
  Synthetic oligonucleotide
acgagcagggcgagcgcaccgtcag

SEQ ID NO: 671835 - DNA, 25 bp, Artificial sequence
  Synthetic oligonucleotide
ccgaggtcatggcccaggcggccaa

SEQ ID NO: 671836 - DNA, 25 bp, Artificial sequence
  Synthetic oligonucleotide
tgttgcccggccatgccatgcacca

SEQ ID NO: 671837 - DNA, 25 bp, Artificial sequence
  Synthetic oligonucleotide
acgtctgcctgcgcctgcaggaccc

SEQ ID NO: 671838 - DNA, 25 bp, Artificial sequence
  Synthetic oligonucleotide
tgtatccctcgcggcgttacctgga

SEQ ID NO: 671839 - DNA, 25 bp, Artificial sequence
  Synthetic oligonucleotide
tatgcgctgtatccctcgcggcgtt

SEQ ID NO: 671840 - DNA, 25 bp, Artificial sequence
  Synthetic oligonucleotide
ccatctatgcgctgtatccctcgcg

SEQ ID NO: 671841 - DNA, 25 bp, Artificial sequence
  Synthetic oligonucleotide
agcggaccatctatgcgctgtatcc

SEQ ID NO: 671842 - DNA, 25 bp, Artificial sequence
  Synthetic oligonucleotide
tgcaccagcggaccatctatgcgct

SEQ ID NO: 671843 - DNA, 25 bp, Artificial sequence
  Synthetic oligonucleotide
atcgccctgctgcccagctacgtgg

SEQ ID NO: 671844 - DNA, 25 bp, Artificial sequence
  Synthetic oligonucleotide
ccggccatgccatgcaccagcggac

SEQ ID NO: 671845 - DNA, 25 bp, Artificial sequence
  Synthetic oligonucleotide
agggctggatcttcgccgacgagca

SEQ ID NO: 671846 - DNA, 25 bp, Artificial sequence
  Synthetic oligonucleotide
tacgggtgttgcccggccatgccat

SEQ ID NO: 671847 - DNA, 25 bp, Artificial sequence
  Synthetic oligonucleotide
agctgctacgggtgttgcccggcca

SEQ ID NO: 671848 - DNA, 25 bp, Artificial sequence
  Synthetic oligonucleotide
aacggcgagctgctacgggtgttgc

SEQ ID NO: 671849 - DNA, 25 bp, Artificial sequence
  Synthetic oligonucleotide
ctgcgcaacggcgagctgctacggg

SEQ ID NO: 671850 - DNA, 25 bp, Artificial sequence
  Synthetic oligonucleotide
cgcggcgctgcgcaacggcgagctg

SEQ ID NO: 671851 - DNA, 25 bp, Artificial sequence
  Synthetic oligonucleotide
tggcggccgcggcgctgcgcaacgg

SEQ ID NO: 671852 - DNA, 25 bp, Artificial sequence
  Synthetic oligonucleotide
gctacgtggcggccgcggcgctgcg

SEQ ID NO: 671853 - DNA, 25 bp, Artificial sequence
  Synthetic oligonucleotide
atgccatgcaccagcggaccatcta

SEQ ID NO: 671854 - DNA, 25 bp, Artificial sequence
  Synthetic oligonucleotide
gtgctgatcaccggcgagcgccagt

SEQ ID NO: 671855 - DNA, 25 bp, Artificial sequence
  Synthetic oligonucleotide
cagcgcctgggcagcatccacagcg

SEQ ID NO: 671856 - DNA, 25 bp, Artificial sequence
  Synthetic oligonucleotide
gtcgcccagcgcctgggcagcatcc

SEQ ID NO: 671857 - DNA, 25 bp, Artificial sequence
  Synthetic oligonucleotide
gagttcgtcgcccagcgcctgggca

SEQ ID NO: 671858 - DNA, 25 bp, Artificial sequence
  Synthetic oligonucleotide
gactcggagttcgtcgcccagcgcc

SEQ ID NO: 671859 - DNA, 25 bp, Artificial sequence
  Synthetic oligonucleotide
tgcccgactcggagttcgtcgccca

SEQ ID NO: 671860 - DNA, 25 bp, Artificial sequence
  Synthetic oligonucleotide
gccagttgcccgactcggagttcgt

SEQ ID NO: 671861 - DNA, 25 bp, Artificial sequence
  Synthetic oligonucleotide
tcgccgacgagcagggcgagcgcac

SEQ ID NO: 671862 - DNA, 25 bp, Artificial sequence
  Synthetic oligonucleotide
atcaccggcgagcgccagttgcccg

SEQ ID NO: 671863 - DNA, 25 bp, Artificial sequence
  Synthetic oligonucleotide
cacagcgtgctctgcgccagtcccg

SEQ ID NO: 671864 - DNA, 25 bp, Artificial sequence
  Synthetic oligonucleotide
caggatgtgctgatcaccggcgagc

SEQ ID NO: 671865 - DNA, 25 bp, Artificial sequence
  Synthetic oligonucleotide
gaaggccaggatgtgctgatcaccg

SEQ ID NO: 671866 - DNA, 25 bp, Artificial sequence
  Synthetic oligonucleotide
ctcgaggaaggccaggatgtgctga

SEQ ID NO: 671867 - DNA, 25 bp, Artificial sequence
  Synthetic oligonucleotide
gacatgctcgaggaaggccaggatg

SEQ ID NO: 671868 - DNA, 25 bp, Artificial sequence
  Synthetic oligonucleotide
aacccggacatgctcgaggaaggcc

SEQ ID NO: 671869 - DNA, 25 bp, Artificial sequence
  Synthetic oligonucleotide
gagttctccagtggcggggcggcgc

SEQ ID NO: 671870 - DNA, 25 bp, Artificial sequence
  Synthetic oligonucleotide
aactcgcagaaactcttgatcagct

SEQ ID NO: 671871 - DNA, 25 bp, Artificial sequence
  Synthetic oligonucleotide
gcgagcgccagttgcccgactcgga

SEQ ID NO: 671872 - DNA, 25 bp, Artificial sequence
  Synthetic oligonucleotide
acggcgtgccacgctcggtggacga

SEQ ID NO: 671873 - DNA, 25 bp, Artificial sequence
  Synthetic oligonucleotide
acctggacgcgaagatccgcacctg

SEQ ID NO: 671874 - DNA, 25 bp, Artificial sequence
  Synthetic oligonucleotide
tacccggagggctggatcttcgccg

SEQ ID NO: 671875 - DNA, 25 bp, Artificial sequence
  Synthetic oligonucleotide
ccggcctacccggagggctggatct

SEQ ID NO: 671876 - DNA, 25 bp, Artificial sequence
  Synthetic oligonucleotide
gcctgcaggacccggcctacccgga

SEQ ID NO: 671877 - DNA, 25 bp, Artificial sequence
  Synthetic oligonucleotide
gcctgcgcctgcaggacccggccta

SEQ ID NO: 671878 - DNA, 25 bp, Artificial sequence
  Synthetic oligonucleotide
agcgccacgtctgcctgcgcctgca

SEQ ID NO: 671879 - DNA, 25 bp, Artificial sequence
  Synthetic oligonucleotide
tggacgacctggagcgccacgtctg

SEQ ID NO: 671880 - DNA, 25 bp, Artificial sequence
  Synthetic oligonucleotide
ctgggcagcatccacagcgtgctct

SEQ ID NO: 671881 - DNA, 25 bp, Artificial sequence
  Synthetic oligonucleotide
tgccacgctcggtggacgacctgga

SEQ ID NO: 671882 - DNA, 25 bp, Artificial sequence
  Synthetic oligonucleotide
agcatccacagcgtgctctgcgcca

SEQ ID NO: 671883 - DNA, 25 bp, Artificial sequence
  Synthetic oligonucleotide
agcagcacggcgtgccacgctcggt

SEQ ID NO: 671884 - DNA, 25 bp, Artificial sequence
  Synthetic oligonucleotide
cctgcagcagcacggcgtgccacgc

SEQ ID NO: 671885 - DNA, 25 bp, Artificial sequence
  Synthetic oligonucleotide
cggctacctgcagcagcacggcgtg

SEQ ID NO: 671886 - DNA, 25 bp, Artificial sequence
  Synthetic oligonucleotide
cagtcccggctacctgcagcagcac

SEQ ID NO: 671887 - DNA, 25 bp, Artificial sequence
  Synthetic oligonucleotide
ctgcgccagtcccggctacctgcag

SEQ ID NO: 671888 - DNA, 25 bp, Artificial sequence
  Synthetic oligonucleotide
gtgctctgcgccagtcccggctacc

SEQ ID NO: 671889 - DNA, 25 bp, Artificial sequence
  Synthetic oligonucleotide
ggatcttcgccgacgagcagggcga

SEQ ID NO: 671890 - DNA, 25 bp, Artificial sequence
  Synthetic oligonucleotide
gctcggtggacgacctggagcgcca

SEQ ID NO: 671891 - DNA, 25 bp, Artificial sequence
  Synthetic oligonucleotide
ctcgcattttcccaggccggtttcg

SEQ ID NO: 671892 - DNA, 25 bp, Artificial sequence
  Synthetic oligonucleotide
cctcgcggcgttacctggacgcgaa

SEQ ID NO: 671893 - DNA, 25 bp, Artificial sequence
  Synthetic oligonucleotide
accgcatggtcgacgccaaccagca

SEQ ID NO: 671894 - DNA, 25 bp, Artificial sequence
  Synthetic oligonucleotide
tgaccaaccgcatggtcgacgccaa

SEQ ID NO: 671895 - DNA, 25 bp, Artificial sequence
  Synthetic oligonucleotide
cgctgatgaccaaccgcatggtcga

SEQ ID NO: 671896 - DNA, 25 bp, Artificial sequence
  Synthetic oligonucleotide
agtcctcgctgatgaccaaccgcat

SEQ ID NO: 671897 - DNA, 25 bp, Artificial sequence
  Synthetic oligonucleotide
ccgaagagtcctcgctgatgaccaa

SEQ ID NO: 671898 - DNA, 25 bp, Artificial sequence
  Synthetic oligonucleotide
acgccaaccagcaggccatcgagca

SEQ ID NO: 671899 - DNA, 25 bp, Artificial sequence
  Synthetic oligonucleotide
caggccggtttcgccgaagagtcct

SEQ ID NO: 671900 - DNA, 25 bp, Artificial sequence
  Synthetic oligonucleotide
accagcaggccatcgagcaccagca

SEQ ID NO: 671901 - DNA, 25 bp, Artificial sequence
  Synthetic oligonucleotide
tgttttccctcgcattttcccaggc

SEQ ID NO: 671902 - DNA, 25 bp, Artificial sequence
  Synthetic oligonucleotide
actcagtttgttttccctcgcattt

SEQ ID NO: 671903 - DNA, 25 bp, Artificial sequence
  Synthetic oligonucleotide
cgccatactcagtttgttttccctc

SEQ ID NO: 671904 - DNA, 25 bp, Artificial sequence
  Synthetic oligonucleotide
tgctgccgccatactcagtttgttt

SEQ ID NO: 671905 - DNA, 25 bp, Artificial sequence
  Synthetic oligonucleotide
cagcgcaacccggacatgctcgagg

SEQ ID NO: 671906 - DNA, 25 bp, Artificial sequence
  Synthetic oligonucleotide
gatccttgctgccgccatactcagt

SEQ ID NO: 671907 - DNA, 25 bp, Artificial sequence
  Synthetic oligonucleotide
cgccagatccttgctgccgccatac

SEQ ID NO: 671908 - DNA, 25 bp, Artificial sequence
  Synthetic oligonucleotide
gtttcgccgaagagtcctcgctgat

SEQ ID NO: 671909 - DNA, 25 bp, Artificial sequence
  Synthetic oligonucleotide
ggccggggcccgcagcgactcctga

SEQ ID NO: 671910 - DNA, 25 bp, Artificial sequence
  Synthetic oligonucleotide
gcgccatggcttcccccgggtactc

SEQ ID NO: 671911 - DNA, 25 bp, Artificial sequence
  Synthetic oligonucleotide
cagccgcgccatggcttcccccggg

SEQ ID NO: 671912 - DNA, 25 bp, Artificial sequence
  Synthetic oligonucleotide
tggcgccagccgcgccatggcttcc

SEQ ID NO: 671913 - DNA, 25 bp, Artificial sequence
  Synthetic oligonucleotide
agcgcatggcgccagccgcgccatg

SEQ ID NO: 671914 - DNA, 25 bp, Artificial sequence
  Synthetic oligonucleotide
tgatctagcgcatggcgccagccgc

SEQ ID NO: 671915 - DNA, 25 bp, Artificial sequence
  Synthetic oligonucleotide
actcctgatctagcgcatggcgcca

SEQ ID NO: 671916 - DNA, 25 bp, Artificial sequence
  Synthetic oligonucleotide
tggtcgacgccaaccagcaggccat

SEQ ID NO: 671917 - DNA, 25 bp, Artificial sequence
  Synthetic oligonucleotide
gggcccgcagcgactcctgatctag

SEQ ID NO: 671918 - DNA, 25 bp, Artificial sequence
  Synthetic oligonucleotide
cggagacccgccatgaatcgccaga

SEQ ID NO: 671919 - DNA, 25 bp, Artificial sequence
  Synthetic oligonucleotide
ccgcgcaggccggggcccgcagcga

SEQ ID NO: 671920 - DNA, 25 bp, Artificial sequence
  Synthetic oligonucleotide
cctccgccgcgcaggccggggcccg

SEQ ID NO: 671921 - DNA, 25 bp, Artificial sequence
  Synthetic oligonucleotide
tttccgcctccgccgcgcaggccgg

SEQ ID NO: 671922 - DNA, 25 bp, Artificial sequence
  Synthetic oligonucleotide
aggaactttccgcctccgccgcgca

SEQ ID NO: 671923 - DNA, 25 bp, Artificial sequence
  Synthetic oligonucleotide
accagcaggaactttccgcctccgc

SEQ ID NO: 671924 - DNA, 25 bp, Artificial sequence
  Synthetic oligonucleotide
tcgagcaccagcaggaactttccgc

SEQ ID NO: 671925 - DNA, 25 bp, Artificial sequence
  Synthetic oligonucleotide
aggccatcgagcaccagcaggaact

SEQ ID NO: 671926 - DNA, 25 bp, Artificial sequence
  Synthetic oligonucleotide
gcagcgactcctgatctagcgcatg

SEQ ID NO: 671927 - DNA, 25 bp, Artificial sequence
  Synthetic oligonucleotide
tccccaggcattcgcccgcgacgaa

SEQ ID NO: 671928 - DNA, 25 bp, Artificial sequence
  Synthetic oligonucleotide
tgtgcacagtgaaggattgttgtta

SEQ ID NO: 671929 - DNA, 25 bp, Artificial sequence
  Synthetic oligonucleotide
agttactgtgcacagtgaaggattg

SEQ ID NO: 671930 - DNA, 25 bp, Artificial sequence
  Synthetic oligonucleotide
agttcaagttactgtgcacagtgaa

SEQ ID NO: 671931 - DNA, 25 bp, Artificial sequence
  Synthetic oligonucleotide
atgcaaagttcaagttactgtgcac

SEQ ID NO: 671932 - DNA, 25 bp, Artificial sequence
  Synthetic oligonucleotide
actaccatgcaaagttcaagttact

SEQ ID NO: 671933 - DNA, 25 bp, Artificial sequence
  Synthetic oligonucleotide
gacgaaactaccatgcaaagttcaa

SEQ ID NO: 671934 - DNA, 25 bp, Artificial sequence
  Synthetic oligonucleotide
atgaatcgccagatccttgctgccg

SEQ ID NO: 671935 - DNA, 25 bp, Artificial sequence
  Synthetic oligonucleotide
gcattcgcccgcgacgaaactacca

SEQ ID NO: 671936 - DNA, 25 bp, Artificial sequence
  Synthetic oligonucleotide
gttgttattgaggtaatactctctc

SEQ ID NO: 671937 - DNA, 25 bp, Artificial sequence
  Synthetic oligonucleotide
ggaacttccccaggcattcgcccgc

SEQ ID NO: 671938 - DNA, 25 bp, Artificial sequence
  Synthetic oligonucleotide
gcaacaggaacttccccaggcattc

SEQ ID NO: 671939 - DNA, 25 bp, Artificial sequence
  Synthetic oligonucleotide
tctgttgcaacaggaacttccccag

SEQ ID NO: 671940 - DNA, 25 bp, Artificial sequence
  Synthetic oligonucleotide
ggtcgatctgttgcaacaggaactt

SEQ ID NO: 671941 - DNA, 25 bp, Artificial sequence
  Synthetic oligonucleotide
cacctgggtcgatctgttgcaacag

SEQ ID NO: 671942 - DNA, 25 bp, Artificial sequence
  Synthetic oligonucleotide
gatccgcacctgggtcgatctgttg

SEQ ID NO: 671943 - DNA, 25 bp, Artificial sequence
  Synthetic oligonucleotide
cgcgaagatccgcacctgggtcgat

SEQ ID NO: 671944 - DNA, 25 bp, Artificial sequence
  Synthetic oligonucleotide
gcccgcgacgaaactaccatgcaaa

SEQ ID NO: 671945 - DNA, 25 bp, Artificial sequence
  Synthetic oligonucleotide
tccgagcatggcggttaactaatat

SEQ ID NO: 671946 - DNA, 25 bp, Artificial sequence
  Synthetic oligonucleotide
ccgggtactcgggaagcgtgagcct

SEQ ID NO: 671947 - DNA, 25 bp, Artificial sequence
  Synthetic oligonucleotide
tgtcatcggagacccgccatgaatc

SEQ ID NO: 671948 - DNA, 25 bp, Artificial sequence
  Synthetic oligonucleotide
acagggtgtcatcggagacccgcca

SEQ ID NO: 671949 - DNA, 25 bp, Artificial sequence
  Synthetic oligonucleotide
aagtgaacagggtgtcatcggagac

SEQ ID NO: 671950 - DNA, 25 bp, Artificial sequence
  Synthetic oligonucleotide
ctgtcccaagtgaacagggtgtcat

SEQ ID NO: 671951 - DNA, 25 bp, Artificial sequence
  Synthetic oligonucleotide
tggcgcctgtcccaagtgaacaggg

SEQ ID NO: 671952 - DNA, 25 bp, Artificial sequence
  Synthetic oligonucleotide
ctaatatggcgcctgtcccaagtga

SEQ ID NO: 671953 - DNA, 25 bp, Artificial sequence
  Synthetic oligonucleotide
cagtgaaggattgttgttattgagg

SEQ ID NO: 671954 - DNA, 25 bp, Artificial sequence
  Synthetic oligonucleotide
catggcggttaactaatatggcgcc

SEQ ID NO: 671955 - DNA, 25 bp, Artificial sequence
  Synthetic oligonucleotide
aggattgttgttattgaggtaatac

SEQ ID NO: 671956 - DNA, 25 bp, Artificial sequence
  Synthetic oligonucleotide
ctatttttccgagcatggcggttaa

SEQ ID NO: 671957 - DNA, 25 bp, Artificial sequence
  Synthetic oligonucleotide
gtttggctatttttccgagcatggc

SEQ ID NO: 671958 - DNA, 25 bp, Artificial sequence
  Synthetic oligonucleotide
tcgtctgtttggctatttttccgag

SEQ ID NO: 671959 - DNA, 25 bp, Artificial sequence
  Synthetic oligonucleotide
actctctcgtctgtttggctatttt

SEQ ID NO: 671960 - DNA, 25 bp, Artificial sequence
  Synthetic oligonucleotide
gtaatactctctcgtctgtttggct

SEQ ID NO: 671961 - DNA, 25 bp, Artificial sequence
  Synthetic oligonucleotide
attgaggtaatactctctcgtctgt

SEQ ID NO: 671962 - DNA, 25 bp, Artificial sequence
  Synthetic oligonucleotide
cccgccatgaatcgccagatccttg

SEQ ID NO: 671963 - DNA, 25 bp, Artificial sequence
  Synthetic oligonucleotide
ggttaactaatatggcgcctgtccc

SEQ ID NO: 671964 - DNA, 25 bp, Artificial sequence
  Synthetic oligonucleotide
agagccggtagttcatcccggtctc

SEQ ID NO: 671965 - DNA, 25 bp, Artificial sequence
  Synthetic oligonucleotide
accggcggctacagcgcggtggaca

SEQ ID NO: 671966 - DNA, 25 bp, Artificial sequence
  Synthetic oligonucleotide
gacagggtcttttccgaggtgccca

SEQ ID NO: 671967 - DNA, 25 bp, Artificial sequence
  Synthetic oligonucleotide
aggcgcgacagggtcttttccgagg

SEQ ID NO: 671968 - DNA, 25 bp, Artificial sequence
  Synthetic oligonucleotide
ggaacaggcgcgacagggtcttttc

SEQ ID NO: 671969 - DNA, 25 bp, Artificial sequence
  Synthetic oligonucleotide
cgcgctggaacaggcgcgacagggt

SEQ ID NO: 671970 - DNA, 25 bp, Artificial sequence
  Synthetic oligonucleotide
cggtctcgcgctggaacaggcgcga

SEQ ID NO: 671971 - DNA, 25 bp, Artificial sequence
  Synthetic oligonucleotide
ttccgaggtgcccaggcgctgcgcc

SEQ ID NO: 671972 - DNA, 25 bp, Artificial sequence
  Synthetic oligonucleotide
ggtagttcatcccggtctcgcgctg

SEQ ID NO: 671973 - DNA, 25 bp, Artificial sequence
  Synthetic oligonucleotide
ggtgcccaggcgctgcgcccagtcg

SEQ ID NO: 671974 - DNA, 25 bp, Artificial sequence
  Synthetic oligonucleotide
ggcgccagagccggtagttcatccc

SEQ ID NO: 671975 - DNA, 25 bp, Artificial sequence
  Synthetic oligonucleotide
tggcgttggcgccagagccggtagt

SEQ ID NO: 671976 - DNA, 25 bp, Artificial sequence
  Synthetic oligonucleotide
aggcgctggcgttggcgccagagcc

SEQ ID NO: 671977 - DNA, 25 bp, Artificial sequence
  Synthetic oligonucleotide
gcgagcaggcgctggcgttggcgcc

SEQ ID NO: 671978 - DNA, 25 bp, Artificial sequence
  Synthetic oligonucleotide
agcgaggcgagcaggcgctggcgtt

SEQ ID NO: 671979 - DNA, 25 bp, Artificial sequence
  Synthetic oligonucleotide
gcgttgagcgaggcgagcaggcgct

SEQ ID NO: 671980 - DNA, 25 bp, Artificial sequence
  Synthetic oligonucleotide
tccagcgcgttgagcgaggcgagca

SEQ ID NO: 671981 - DNA, 25 bp, Artificial sequence
  Synthetic oligonucleotide
tcatcccggtctcgcgctggaacag

SEQ ID NO: 671982 - DNA, 25 bp, Artificial sequence
  Synthetic oligonucleotide
cgtcgatcagtgcctggcacagccg

SEQ ID NO: 671983 - DNA, 25 bp, Artificial sequence
  Synthetic oligonucleotide
cagggagaaggcgacctccggcagc

SEQ ID NO: 671984 - DNA, 25 bp, Artificial sequence
  Synthetic oligonucleotide
catcggcagggagaaggcgacctcc

SEQ ID NO: 671985 - DNA, 25 bp, Artificial sequence
  Synthetic oligonucleotide
gcgcggcatcggcagggagaaggcg

SEQ ID NO: 671986 - DNA, 25 bp, Artificial sequence
  Synthetic oligonucleotide
gcggctcgcgcggcatcggcaggga

SEQ ID NO: 671987 - DNA, 25 bp, Artificial sequence
  Synthetic oligonucleotide
agcaggcgcggctcgcgcggcatcg

SEQ ID NO: 671988 - DNA, 25 bp, Artificial sequence
  Synthetic oligonucleotide
agccgcagcaggcgcggctcgcgcg

SEQ ID NO: 671989 - DNA, 25 bp, Artificial sequence
  Synthetic oligonucleotide
gtcttttccgaggtgcccaggcgct

SEQ ID NO: 671990 - DNA, 25 bp, Artificial sequence
  Synthetic oligonucleotide
cagtgcctggcacagccgcagcagg

SEQ ID NO: 671991 - DNA, 25 bp, Artificial sequence
  Synthetic oligonucleotide
gtgacgctgtcgccggcctccagcg

SEQ ID NO: 671992 - DNA, 25 bp, Artificial sequence
  Synthetic oligonucleotide
tcggttcgtcgatcagtgcctggca

SEQ ID NO: 671993 - DNA, 25 bp, Artificial sequence
  Synthetic oligonucleotide
tctgggtcggttcgtcgatcagtgc

SEQ ID NO: 671994 - DNA, 25 bp, Artificial sequence
  Synthetic oligonucleotide
tcaggctctgggtcggttcgtcgat

SEQ ID NO: 671995 - DNA, 25 bp, Artificial sequence
  Synthetic oligonucleotide
ccatggtcaggctctgggtcggttc

SEQ ID NO: 671996 - DNA, 25 bp, Artificial sequence
  Synthetic oligonucleotide
cagtcgcccatggtcaggctctggg

SEQ ID NO: 671997 - DNA, 25 bp, Artificial sequence
  Synthetic oligonucleotide
tgcgcccagtcgcccatggtcaggc

SEQ ID NO: 671998 - DNA, 25 bp, Artificial sequence
  Synthetic oligonucleotide
aggcgctgcgcccagtcgcccatgg

SEQ ID NO: 671999 - DNA, 25 bp, Artificial sequence
  Synthetic oligonucleotide
tggcacagccgcagcaggcgcggct

SEQ ID NO: 672000 - DNA, 25 bp, Artificial sequence
  Synthetic oligonucleotide
gatcgtcgactatcccatcgacgtg

SEQ ID NO: 672001 - DNA, 25 bp, Artificial sequence
  Synthetic oligonucleotide
ttcgccgggctcagcgctggcggaa

SEQ ID NO: 672002 - DNA, 25 bp, Artificial sequence
  Synthetic oligonucleotide
gggcccttcgccgggctcagcgctg

SEQ ID NO: 672003 - DNA, 25 bp, Artificial sequence
  Synthetic oligonucleotide
cgcgctgggcccttcgccgggctca

SEQ ID NO: 672004 - DNA, 25 bp, Artificial sequence
  Synthetic oligonucleotide
gccccgcgcgctgggcccttcgccg

SEQ ID NO: 672005 - DNA, 25 bp, Artificial sequence
  Synthetic oligonucleotide
ttctgagccccgcgcgctgggccct

SEQ ID NO: 672006 - DNA, 25 bp, Artificial sequence
  Synthetic oligonucleotide
cgacgtgttctgagccccgcgcgct

SEQ ID NO: 672007 - DNA, 25 bp, Artificial sequence
  Synthetic oligonucleotide
ccggcctccagcgcgttgagcgagg

SEQ ID NO: 672008 - DNA, 25 bp, Artificial sequence
  Synthetic oligonucleotide
cgactatcccatcgacgtgttctga

SEQ ID NO: 672009 - DNA, 25 bp, Artificial sequence
  Synthetic oligonucleotide
ggcggaacagttcgccgggagtgaa

SEQ ID NO: 672010 - DNA, 25 bp, Artificial sequence
  Synthetic oligonucleotide
ccgggtgatcgtcgactatcccatc

SEQ ID NO: 672011 - DNA, 25 bp, Artificial sequence
  Synthetic oligonucleotide
cgaataccgggtgatcgtcgactat

SEQ ID NO: 672012 - DNA, 25 bp, Artificial sequence
  Synthetic oligonucleotide
catcgacgaataccgggtgatcgtc

SEQ ID NO: 672013 - DNA, 25 bp, Artificial sequence
  Synthetic oligonucleotide
aatgacatcgacgaataccgggtga

SEQ ID NO: 672014 - DNA, 25 bp, Artificial sequence
  Synthetic oligonucleotide
gtggacaatgacatcgacgaatacc

SEQ ID NO: 672015 - DNA, 25 bp, Artificial sequence
  Synthetic oligonucleotide
agcgcggtggacaatgacatcgacg

SEQ ID NO: 672016 - DNA, 25 bp, Artificial sequence
  Synthetic oligonucleotide
gtagtccaccggcaactcgcagaaa

SEQ ID NO: 672017 - DNA, 25 bp, Artificial sequence
  Synthetic oligonucleotide
tcccatcgacgtgttctgagccccg

SEQ ID NO: 672018 - DNA, 25 bp, Artificial sequence
  Synthetic oligonucleotide
aaggcggcgatataggccgaggtcg

SEQ ID NO: 672019 - DNA, 25 bp, Artificial sequence
  Synthetic oligonucleotide
tccggcagcagccgcaactggtcca

SEQ ID NO: 672020 - DNA, 25 bp, Artificial sequence
  Synthetic oligonucleotide
gcgccggtgacgctgtcgccggcct

SEQ ID NO: 672021 - DNA, 25 bp, Artificial sequence
  Synthetic oligonucleotide
agggcggcgccggtgacgctgtcgc

SEQ ID NO: 672022 - DNA, 25 bp, Artificial sequence
  Synthetic oligonucleotide
gctgtccagggcggcgccggtgacg

SEQ ID NO: 672023 - DNA, 25 bp, Artificial sequence
  Synthetic oligonucleotide
tagccgctgtccagggcggcgccgg

SEQ ID NO: 672024 - DNA, 25 bp, Artificial sequence
  Synthetic oligonucleotide
agtcgtagccgctgtccagggcggc

SEQ ID NO: 672025 - DNA, 25 bp, Artificial sequence
  Synthetic oligonucleotide
aggtcgagtcgtagccgctgtccag

SEQ ID NO: 672026 - DNA, 25 bp, Artificial sequence
  Synthetic oligonucleotide
gggctcagcgctggcggaacagttc

SEQ ID NO: 672027 - DNA, 25 bp, Artificial sequence
  Synthetic oligonucleotide
cgatataggccgaggtcgagtcgta

SEQ ID NO: 672028 - DNA, 25 bp, Artificial sequence
  Synthetic oligonucleotide
agcgctggcggaacagttcgccggg

SEQ ID NO: 672029 - DNA, 25 bp, Artificial sequence
  Synthetic oligonucleotide
cccttgaaggcggcgatataggccg

SEQ ID NO: 672030 - DNA, 25 bp, Artificial sequence
  Synthetic oligonucleotide
aagagtcccttgaaggcggcgatat

SEQ ID NO: 672031 - DNA, 25 bp, Artificial sequence
  Synthetic oligonucleotide
aagccgaagagtcccttgaaggcgg

SEQ ID NO: 672032 - DNA, 25 bp, Artificial sequence
  Synthetic oligonucleotide
ggagtgaagccgaagagtcccttga

SEQ ID NO: 672033 - DNA, 25 bp, Artificial sequence
  Synthetic oligonucleotide
tcgccgggagtgaagccgaagagtc

SEQ ID NO: 672034 - DNA, 25 bp, Artificial sequence
  Synthetic oligonucleotide
aacagttcgccgggagtgaagccga

SEQ ID NO: 672035 - DNA, 25 bp, Artificial sequence
  Synthetic oligonucleotide
ctgtcgccggcctccagcgcgttga

SEQ ID NO: 672036 - DNA, 25 bp, Artificial sequence
  Synthetic oligonucleotide
aggccgaggtcgagtcgtagccgct

SEQ ID NO: 672037 - DNA, 25 bp, Artificial sequence
  Synthetic oligonucleotide
agaagctgccctcggcggtatgtac

SEQ ID NO: 672038 - DNA, 25 bp, Artificial sequence
  Synthetic oligonucleotide
taggaaagctgtacccaggcgtgcc

SEQ ID NO: 672039 - DNA, 25 bp, Artificial sequence
  Synthetic oligonucleotide
atggcgtaggaaagctgtacccagg

SEQ ID NO: 672040 - DNA, 25 bp, Artificial sequence
  Synthetic oligonucleotide
ccgctgatggcgtaggaaagctgta

SEQ ID NO: 672041 - DNA, 25 bp, Artificial sequence
  Synthetic oligonucleotide
agcacgccgctgatggcgtaggaaa

SEQ ID NO: 672042 - DNA, 25 bp, Artificial sequence
  Synthetic oligonucleotide
acgccgagcacgccgctgatggcgt

SEQ ID NO: 672043 - DNA, 25 bp, Artificial sequence
  Synthetic oligonucleotide
gtatgtacgccgagcacgccgctga

SEQ ID NO: 672044 - DNA, 25 bp, Artificial sequence
  Synthetic oligonucleotide
cgtgttccagttgcgccggaatcca

SEQ ID NO: 672045 - DNA, 25 bp, Artificial sequence
  Synthetic oligonucleotide
tgccctcggcggtatgtacgccgag

SEQ ID NO: 672046 - DNA, 25 bp, Artificial sequence
  Synthetic oligonucleotide
cgtgccggtggcgcgaggtccaaga

SEQ ID NO: 672047 - DNA, 25 bp, Artificial sequence
  Synthetic oligonucleotide
gggcgaagaagctgccctcggcggt

SEQ ID NO: 672048 - DNA, 25 bp, Artificial sequence
  Synthetic oligonucleotide
tgcggcggggcgaagaagctgccct

SEQ ID NO: 672049 - DNA, 25 bp, Artificial sequence
  Synthetic oligonucleotide
gcccgctgcggcggggcgaagaagc

SEQ ID NO: 672050 - DNA, 25 bp, Artificial sequence
  Synthetic oligonucleotide
cagatcgcccgctgcggcggggcga

SEQ ID NO: 672051 - DNA, 25 bp, Artificial sequence
  Synthetic oligonucleotide
ggaatccagatcgcccgctgcggcg

SEQ ID NO: 672052 - DNA, 25 bp, Artificial sequence
  Synthetic oligonucleotide
gcgccggaatccagatcgcccgctg

SEQ ID NO: 672053 - DNA, 25 bp, Artificial sequence
  Synthetic oligonucleotide
agaaggcgacctccggcagcagccg

SEQ ID NO: 672054 - DNA, 25 bp, Artificial sequence
  Synthetic oligonucleotide
tcggcggtatgtacgccgagcacgc

SEQ ID NO: 672055 - DNA, 25 bp, Artificial sequence
  Synthetic oligonucleotide
tcggcgcgcgcgtagaccggccgtg

SEQ ID NO: 672056 - DNA, 25 bp, Artificial sequence
  Synthetic oligonucleotide
agttccgcaggctgtccgttcatcg

SEQ ID NO: 672057 - DNA, 25 bp, Artificial sequence
  Synthetic oligonucleotide
cggtgcagttccgcaggctgtccgt

SEQ ID NO: 672058 - DNA, 25 bp, Artificial sequence
  Synthetic oligonucleotide
aatcgggcggtgcagttccgcaggc

SEQ ID NO: 672059 - DNA, 25 bp, Artificial sequence
  Synthetic oligonucleotide
ggtgggaatcgggcggtgcagttcc

SEQ ID NO: 672060 - DNA, 25 bp, Artificial sequence
  Synthetic oligonucleotide
ggcgagggtgggaatcgggcggtgc

SEQ ID NO: 672061 - DNA, 25 bp, Artificial sequence
  Synthetic oligonucleotide
tggcaggcgggcgagggtgggaatc

SEQ ID NO: 672062 - DNA, 25 bp, Artificial sequence
  Synthetic oligonucleotide
cggccgtggcaggcgggcgagggtg

SEQ ID NO: 672063 - DNA, 25 bp, Artificial sequence
  Synthetic oligonucleotide
aagctgtacccaggcgtgccggtgg

SEQ ID NO: 672064 - DNA, 25 bp, Artificial sequence
  Synthetic oligonucleotide
gcgcgtagaccggccgtggcaggcg

SEQ ID NO: 672065 - DNA, 25 bp, Artificial sequence
  Synthetic oligonucleotide
acccaggcgtgccggtggcgcgagg

SEQ ID NO: 672066 - DNA, 25 bp, Artificial sequence
  Synthetic oligonucleotide
aggctttcggcgcgcgcgtagaccg

SEQ ID NO: 672067 - DNA, 25 bp, Artificial sequence
  Synthetic oligonucleotide
gcgcgcaggctttcggcgcgcgcgt

SEQ ID NO: 672068 - DNA, 25 bp, Artificial sequence
  Synthetic oligonucleotide
gagccggcgcgcaggctttcggcgc

SEQ ID NO: 672069 - DNA, 25 bp, Artificial sequence
  Synthetic oligonucleotide
gtccaagagccggcgcgcaggcttt

SEQ ID NO: 672070 - DNA, 25 bp, Artificial sequence
  Synthetic oligonucleotide
gcgaggtccaagagccggcgcgcag

SEQ ID NO: 672071 - DNA, 25 bp, Artificial sequence
  Synthetic oligonucleotide
ggtggcgcgaggtccaagagccggc

SEQ ID NO: 672072 - DNA, 25 bp, Artificial sequence
  Synthetic oligonucleotide
cacctcgtgttccagttgcgccgga

SEQ ID NO: 672073 - DNA, 25 bp, Artificial sequence
  Synthetic oligonucleotide
tagaccggccgtggcaggcgggcga

SEQ ID NO: 672074 - DNA, 25 bp, Artificial sequence
  Synthetic oligonucleotide
cgcgattcggcgctgtcgccctccg

SEQ ID NO: 672075 - DNA, 25 bp, Artificial sequence
  Synthetic oligonucleotide
actcttgatcagctcgcgcgccagc

SEQ ID NO: 672076 - DNA, 25 bp, Artificial sequence
  Synthetic oligonucleotide
cagaaactcttgatcagctcgcgcg

SEQ ID NO: 672077 - DNA, 25 bp, Artificial sequence
  Synthetic oligonucleotide
ggcggcggcggccagcctggggatg

SEQ ID NO: 672078 - DNA, 25 bp, Artificial sequence
  Synthetic oligonucleotide
accggcaactcgcagaaactcttga

SEQ ID NO: 672079 - DNA, 25 bp, Artificial sequence
  Synthetic oligonucleotide
cctgtcccagcgcaacccggacatg

SEQ ID NO: 672080 - DNA, 25 bp, Artificial sequence
  Synthetic oligonucleotide
ctccgggtagtccaccggcaactcg

SEQ ID NO: 672081 - DNA, 25 bp, Artificial sequence
  Synthetic oligonucleotide
ccagttgcgccggaatccagatcgc

SEQ ID NO: 672082 - DNA, 25 bp, Artificial sequence
  Synthetic oligonucleotide
tcggcgctgtcgccctccgggtagt

SEQ ID NO: 672083 - DNA, 25 bp, Artificial sequence
  Synthetic oligonucleotide
gcgccagcggcgtcacctccagcac

SEQ ID NO: 672084 - DNA, 25 bp, Artificial sequence
  Synthetic oligonucleotide
accagccgcgattcggcgctgtcgc

SEQ ID NO: 672085 - DNA, 25 bp, Artificial sequence
  Synthetic oligonucleotide
acctgcaccagccgcgattcggcgc

SEQ ID NO: 672086 - DNA, 25 bp, Artificial sequence
  Synthetic oligonucleotide
agcagcacctgcaccagccgcgatt

SEQ ID NO: 672087 - DNA, 25 bp, Artificial sequence
  Synthetic oligonucleotide
tggtccagcagcacctgcaccagcc

SEQ ID NO: 672088 - DNA, 25 bp, Artificial sequence
  Synthetic oligonucleotide
cgcaactggtccagcagcacctgca

SEQ ID NO: 672089 - DNA, 25 bp, Artificial sequence
  Synthetic oligonucleotide
agcagccgcaactggtccagcagca

SEQ ID NO: 672090 - DNA, 25 bp, Artificial sequence
  Synthetic oligonucleotide
cgcggcaccggcggctacagcgcgg

SEQ ID NO: 672091 - DNA, 25 bp, Artificial sequence
  Synthetic oligonucleotide
ctgtcgccctccgggtagtccaccg

SEQ ID NO: 672092 - DNA, 25 bp, Artificial sequence
  Synthetic oligonucleotide
gcccaggcgcaggcgtcgccacgga

SEQ ID NO: 672093 - DNA, 25 bp, Artificial sequence
  Synthetic oligonucleotide
ggtgaccacctcgtgttccagttgc

SEQ ID NO: 672094 - DNA, 25 bp, Artificial sequence
  Synthetic oligonucleotide
ggtggaggtgaccacctcgtgttcc

SEQ ID NO: 672095 - DNA, 25 bp, Artificial sequence
  Synthetic oligonucleotide
cggcgcgggtggaggtgaccacctc

SEQ ID NO: 672096 - DNA, 25 bp, Artificial sequence
  Synthetic oligonucleotide
gcatctcggcgcgggtggaggtgac

SEQ ID NO: 672097 - DNA, 25 bp, Artificial sequence
  Synthetic oligonucleotide
aggctgcgcatctcggcgcgggtgg

SEQ ID NO: 672098 - DNA, 25 bp, Artificial sequence
  Synthetic oligonucleotide
atgtacaggctgcgcatctcggcgc

SEQ ID NO: 672099 - DNA, 25 bp, Artificial sequence
  Synthetic oligonucleotide
ccacggatgtacaggctgcgcatct

SEQ ID NO: 672100 - DNA, 25 bp, Artificial sequence
  Synthetic oligonucleotide
tgatcagctcgcgcgccagcggcgt

SEQ ID NO: 672101 - DNA, 25 bp, Artificial sequence
  Synthetic oligonucleotide
gcgcaggcgtcgccacggatgtaca

SEQ ID NO: 672102 - DNA, 25 bp, Artificial sequence
  Synthetic oligonucleotide
gctcgcgcgccagcggcgtcacctc

SEQ ID NO: 672103 - DNA, 25 bp, Artificial sequence
  Synthetic oligonucleotide
gtcggcgcccaggcgcaggcgtcgc

SEQ ID NO: 672104 - DNA, 25 bp, Artificial sequence
  Synthetic oligonucleotide
aacgcgtcggcgcccaggcgcaggc

SEQ ID NO: 672105 - DNA, 25 bp, Artificial sequence
  Synthetic oligonucleotide
cccggcaacgcgtcggcgcccaggc

SEQ ID NO: 672106 - DNA, 25 bp, Artificial sequence
  Synthetic oligonucleotide
ccagcacccggcaacgcgtcggcgc

SEQ ID NO: 672107 - DNA, 25 bp, Artificial sequence
  Synthetic oligonucleotide
tcacctccagcacccggcaacgcgt

SEQ ID NO: 672108 - DNA, 25 bp, Artificial sequence
  Synthetic oligonucleotide
gcggcgtcacctccagcacccggca

SEQ ID NO: 672109 - DNA, 25 bp, Artificial sequence
  Synthetic oligonucleotide
cgacctccggcagcagccgcaactg

SEQ ID NO: 672110 - DNA, 25 bp, Artificial sequence
  Synthetic oligonucleotide
gcgtcgccacggatgtacaggctgc

SEQ ID NO: 672111 - DNA, 25 bp, Artificial sequence
  Synthetic oligonucleotide
ctggctgggcggcacctggggcggc

SEQ ID NO: 672112 - DNA, 25 bp, Artificial sequence
  Synthetic oligonucleotide
ggctacagcgcggtggacaatgaca

SEQ ID NO: 672113 - DNA, 25 bp, Artificial sequence
  Synthetic oligonucleotide
gcagcctgtacgccgccgaactgca

SEQ ID NO: 672114 - DNA, 25 bp, Artificial sequence
  Synthetic oligonucleotide
tcaccagcagcctgtacgccgccga

SEQ ID NO: 672115 - DNA, 25 bp, Artificial sequence
  Synthetic oligonucleotide
gggcttcaccagcagcctgtacgcc

SEQ ID NO: 672116 - DNA, 25 bp, Artificial sequence
  Synthetic oligonucleotide
catcgagggcttcaccagcagcctg

SEQ ID NO: 672117 - DNA, 25 bp, Artificial sequence
  Synthetic oligonucleotide
gggcggcatcgagggcttcaccagc

SEQ ID NO: 672118 - DNA, 25 bp, Artificial sequence
  Synthetic oligonucleotide
ccgccgaactgcagaacgtctggaa

SEQ ID NO: 672119 - DNA, 25 bp, Artificial sequence
  Synthetic oligonucleotide
tgggcggcacctggggcggcatcga

SEQ ID NO: 672120 - DNA, 25 bp, Artificial sequence
  Synthetic oligonucleotide
aactgcagaacgtctggaagcagta

SEQ ID NO: 672121 - DNA, 25 bp, Artificial sequence
  Synthetic oligonucleotide
tctcagctggctgggcggcacctgg

SEQ ID NO: 672122 - DNA, 25 bp, Artificial sequence
  Synthetic oligonucleotide
catcatctcagctggctgggcggca

SEQ ID NO: 672123 - DNA, 25 bp, Artificial sequence
  Synthetic oligonucleotide
gacagccatcatctcagctggctgg

SEQ ID NO: 672124 - DNA, 25 bp, Artificial sequence
  Synthetic oligonucleotide
gaccgcgacagccatcatctcagct

SEQ ID NO: 672125 - DNA, 25 bp, Artificial sequence
  Synthetic oligonucleotide
gccgggcgaccgcgacagccatcat

SEQ ID NO: 672126 - DNA, 25 bp, Artificial sequence
  Synthetic oligonucleotide
cgaactgccgggcgaccgcgacagc

SEQ ID NO: 672127 - DNA, 25 bp, Artificial sequence
  Synthetic oligonucleotide
actacggcgaactgccgggcgaccg

SEQ ID NO: 672128 - DNA, 25 bp, Artificial sequence
  Synthetic oligonucleotide
gcacctggggcggcatcgagggctt

SEQ ID NO: 672129 - DNA, 25 bp, Artificial sequence
  Synthetic oligonucleotide
acgagatcgacgacaactggtcgct

SEQ ID NO: 672130 - DNA, 25 bp, Artificial sequence
  Synthetic oligonucleotide
aagaccgtcgacagcggcgactcgt

SEQ ID NO: 672131 - DNA, 25 bp, Artificial sequence
  Synthetic oligonucleotide
tactacaagaccgtcgacagcggcg

SEQ ID NO: 672132 - DNA, 25 bp, Artificial sequence
  Synthetic oligonucleotide
gcgcactactacaagaccgtcgaca

SEQ ID NO: 672133 - DNA, 25 bp, Artificial sequence
  Synthetic oligonucleotide
cccggcgcgcactactacaagaccg

SEQ ID NO: 672134 - DNA, 25 bp, Artificial sequence
  Synthetic oligonucleotide
ctgaaccccggcgcgcactactaca

SEQ ID NO: 672135 - DNA, 25 bp, Artificial sequence
  Synthetic oligonucleotide
tggtcgctgaaccccggcgcgcact

SEQ ID NO: 672136 - DNA, 25 bp, Artificial sequence
  Synthetic oligonucleotide
tgtacgccgccgaactgcagaacgt

SEQ ID NO: 672137 - DNA, 25 bp, Artificial sequence
  Synthetic oligonucleotide
tcgacgacaactggtcgctgaaccc

SEQ ID NO: 672138 - DNA, 25 bp, Artificial sequence
  Synthetic oligonucleotide
accgtcgcctcggctcgtactacgg

SEQ ID NO: 672139 - DNA, 25 bp, Artificial sequence
  Synthetic oligonucleotide
acacctacgagatcgacgacaactg

SEQ ID NO: 672140 - DNA, 25 bp, Artificial sequence
  Synthetic oligonucleotide
tcgactacacctacgagatcgacga

SEQ ID NO: 672141 - DNA, 25 bp, Artificial sequence
  Synthetic oligonucleotide
ccgacgtcgactacacctacgagat

SEQ ID NO: 672142 - DNA, 25 bp, Artificial sequence
  Synthetic oligonucleotide
actacgccgacgtcgactacaccta

SEQ ID NO: 672143 - DNA, 25 bp, Artificial sequence
  Synthetic oligonucleotide
agcagtactacgccgacgtcgacta

SEQ ID NO: 672144 - DNA, 25 bp, Artificial sequence
  Synthetic oligonucleotide
tctggaagcagtactacgccgacgt

SEQ ID NO: 672145 - DNA, 25 bp, Artificial sequence
  Synthetic oligonucleotide
agaacgtctggaagcagtactacgc

SEQ ID NO: 672146 - DNA, 25 bp, Artificial sequence
  Synthetic oligonucleotide
gacaactggtcgctgaaccccggcg

SEQ ID NO: 672147 - DNA, 25 bp, Artificial sequence
  Synthetic oligonucleotide
agctgggcgaccagttcctcagcaa

SEQ ID NO: 672148 - DNA, 25 bp, Artificial sequence
  Synthetic oligonucleotide
cgcgcatgctgccgcagaccttccg

SEQ ID NO: 672149 - DNA, 25 bp, Artificial sequence
  Synthetic oligonucleotide
gcgagtcgcgcatgctgccgcagac

SEQ ID NO: 672150 - DNA, 25 bp, Artificial sequence
  Synthetic oligonucleotide
ccggcggcgagtcgcgcatgctgcc

SEQ ID NO: 672151 - DNA, 25 bp, Artificial sequence
  Synthetic oligonucleotide
tggtcgccggcggcgagtcgcgcat

SEQ ID NO: 672152 - DNA, 25 bp, Artificial sequence
  Synthetic oligonucleotide
cccggtggtcgccggcggcgagtcg

SEQ ID NO: 672153 - DNA, 25 bp, Artificial sequence
  Synthetic oligonucleotide
tcagcaacccggtggtcgccggcgg

SEQ ID NO: 672154 - DNA, 25 bp, Artificial sequence
  Synthetic oligonucleotide
gctcgtactacggcgaactgccggg

SEQ ID NO: 672155 - DNA, 25 bp, Artificial sequence
  Synthetic oligonucleotide
gcgaccagttcctcagcaacccggt

SEQ ID NO: 672156 - DNA, 25 bp, Artificial sequence
  Synthetic oligonucleotide
ccttccgcggtgtgagcctgaccaa

SEQ ID NO: 672157 - DNA, 25 bp, Artificial sequence
  Synthetic oligonucleotide
agctgaagctgggcgaccagttcct

SEQ ID NO: 672158 - DNA, 25 bp, Artificial sequence
  Synthetic oligonucleotide
acaccgagctgaagctgggcgacca

SEQ ID NO: 672159 - DNA, 25 bp, Artificial sequence
  Synthetic oligonucleotide
ccttcgacaccgagctgaagctggg

SEQ ID NO: 672160 - DNA, 25 bp, Artificial sequence
  Synthetic oligonucleotide
tccgcgccttcgacaccgagctgaa

SEQ ID NO: 672161 - DNA, 25 bp, Artificial sequence
  Synthetic oligonucleotide
tgaagatccgcgccttcgacaccga

SEQ ID NO: 672162 - DNA, 25 bp, Artificial sequence
  Synthetic oligonucleotide
gcggcgctgaagatccgcgccttcg

SEQ ID NO: 672163 - DNA, 25 bp, Artificial sequence
  Synthetic oligonucleotide
ggcggggcggcgctgaagatccgcg

SEQ ID NO: 672164 - DNA, 25 bp, Artificial sequence
  Synthetic oligonucleotide
agttcctcagcaacccggtggtcgc

SEQ ID NO: 672165 - DNA, 25 bp, Artificial sequence
  Synthetic oligonucleotide
tgaccctcacggctggccaggtcag

SEQ ID NO: 672166 - DNA, 25 bp, Artificial sequence
  Synthetic oligonucleotide
gactcgttgctcggccggatcgaca

SEQ ID NO: 672167 - DNA, 25 bp, Artificial sequence
  Synthetic oligonucleotide
gtggccaccgtcgcctcggctcgta

SEQ ID NO: 672168 - DNA, 25 bp, Artificial sequence
  Synthetic oligonucleotide
accagagtggccaccgtcgcctcgg

SEQ ID NO: 672169 - DNA, 25 bp, Artificial sequence
  Synthetic oligonucleotide
actacaaccagagtggccaccgtcg

SEQ ID NO: 672170 - DNA, 25 bp, Artificial sequence
  Synthetic oligonucleotide
ccaagtactacaaccagagtggcca

SEQ ID NO: 672171 - DNA, 25 bp, Artificial sequence
  Synthetic oligonucleotide
gtttcaccaagtactacaaccagag

SEQ ID NO: 672172 - DNA, 25 bp, Artificial sequence
  Synthetic oligonucleotide
aggtcagtttcaccaagtactacaa

SEQ ID NO: 672173 - DNA, 25 bp, Artificial sequence
  Synthetic oligonucleotide
tgctgccgcagaccttccgcggtgt

SEQ ID NO: 672174 - DNA, 25 bp, Artificial sequence
  Synthetic oligonucleotide
tcacggctggccaggtcagtttcac

SEQ ID NO: 672175 - DNA, 25 bp, Artificial sequence
  Synthetic oligonucleotide
cgcagaccttccgcggtgtgagcct

SEQ ID NO: 672176 - DNA, 25 bp, Artificial sequence
  Synthetic oligonucleotide
gaggacctgaccctcacggctggcc

SEQ ID NO: 672177 - DNA, 25 bp, Artificial sequence
  Synthetic oligonucleotide
agtttcgaggacctgaccctcacgg

SEQ ID NO: 672178 - DNA, 25 bp, Artificial sequence
  Synthetic oligonucleotide
acaacagtttcgaggacctgaccct

SEQ ID NO: 672179 - DNA, 25 bp, Artificial sequence
  Synthetic oligonucleotide
tgaccaacaacagtttcgaggacct

SEQ ID NO: 672180 - DNA, 25 bp, Artificial sequence
  Synthetic oligonucleotide
tgagcctgaccaacaacagtttcga

SEQ ID NO: 672181 - DNA, 25 bp, Artificial sequence
  Synthetic oligonucleotide
gcggtgtgagcctgaccaacaacag

SEQ ID NO: 672182 - DNA, 25 bp, Artificial sequence
  Synthetic oligonucleotide
gcctcggctcgtactacggcgaact

SEQ ID NO: 672183 - DNA, 25 bp, Artificial sequence
  Synthetic oligonucleotide
ctggccaggtcagtttcaccaagta

SEQ ID NO: 672184 - DNA, 25 bp, Artificial sequence
  Synthetic oligonucleotide
gcggcaagctggacctgacccgggt

SEQ ID NO: 672185 - DNA, 25 bp, Artificial sequence
  Synthetic oligonucleotide
ctggtacagcgccgacggcaagaac

SEQ ID NO: 672186 - DNA, 25 bp, Artificial sequence
  Synthetic oligonucleotide
cggcggctggtacagcgccgacggc

SEQ ID NO: 672187 - DNA, 25 bp, Artificial sequence
  Synthetic oligonucleotide
cggctacggcggctggtacagcgcc

SEQ ID NO: 672188 - DNA, 25 bp, Artificial sequence
  Synthetic oligonucleotide
acagccccggctacggcggctggta

SEQ ID NO: 672189 - DNA, 25 bp, Artificial sequence
  Synthetic oligonucleotide
gatccggacagccccggctacggcg

SEQ ID NO: 672190 - DNA, 25 bp, Artificial sequence
  Synthetic oligonucleotide
cgggtcgatccggacagccccggct

SEQ ID NO: 672191 - DNA, 25 bp, Artificial sequence
  Synthetic oligonucleotide
cgtcgccctcggcctacccggcctg

SEQ ID NO: 672192 - DNA, 25 bp, Artificial sequence
  Synthetic oligonucleotide
agctggacctgacccgggtcgatcc

SEQ ID NO: 672193 - DNA, 25 bp, Artificial sequence
  Synthetic oligonucleotide
caagaacgccaagcactgggaacgc

SEQ ID NO: 672194 - DNA, 25 bp, Artificial sequence
  Synthetic oligonucleotide
actcgcgcggcaagctggacctgac

SEQ ID NO: 672195 - DNA, 25 bp, Artificial sequence
  Synthetic oligonucleotide
ctcgtactcgcgcggcaagctggac

SEQ ID NO: 672196 - DNA, 25 bp, Artificial sequence
  Synthetic oligonucleotide
ctcggcctcgtactcgcgcggcaag

SEQ ID NO: 672197 - DNA, 25 bp, Artificial sequence
  Synthetic oligonucleotide
gagcgcctcggcctcgtactcgcgc

SEQ ID NO: 672198 - DNA, 25 bp, Artificial sequence
  Synthetic oligonucleotide
cggcctgagcgcctcggcctcgtac

SEQ ID NO: 672199 - DNA, 25 bp, Artificial sequence
  Synthetic oligonucleotide
gcctacccggcctgagcgcctcggc

SEQ ID NO: 672200 - DNA, 25 bp, Artificial sequence
  Synthetic oligonucleotide
gtcgacagcggcgactcgttgctcg

SEQ ID NO: 672201 - DNA, 25 bp, Artificial sequence
  Synthetic oligonucleotide
acctgacccgggtcgatccggacag

SEQ ID NO: 672202 - DNA, 25 bp, Artificial sequence
  Synthetic oligonucleotide
tacgtggtccagggcggtccggcca

SEQ ID NO: 672203 - DNA, 25 bp, Artificial sequence
  Synthetic oligonucleotide
acccaccgcggcaccggcggctaca

SEQ ID NO: 672204 - DNA, 25 bp, Artificial sequence
  Synthetic oligonucleotide
tgggccacccaccgcggcaccggcg

SEQ ID NO: 672205 - DNA, 25 bp, Artificial sequence
  Synthetic oligonucleotide
tgcgctgggccacccaccgcggcac

SEQ ID NO: 672206 - DNA, 25 bp, Artificial sequence
  Synthetic oligonucleotide
tgcgcctgcgctgggccacccaccg

SEQ ID NO: 672207 - DNA, 25 bp, Artificial sequence
  Synthetic oligonucleotide
ctcgctgcgcctgcgctgggccacc

SEQ ID NO: 672208 - DNA, 25 bp, Artificial sequence
  Synthetic oligonucleotide
ggacctctcgctgcgcctgcgctgg

SEQ ID NO: 672209 - DNA, 25 bp, Artificial sequence
  Synthetic oligonucleotide
gccaaggacctctcgctgcgcctgc

SEQ ID NO: 672210 - DNA, 25 bp, Artificial sequence
  Synthetic oligonucleotide
cagcgccgacggcaagaacgccaag

SEQ ID NO: 672211 - DNA, 25 bp, Artificial sequence
  Synthetic oligonucleotide
cagggcggtccggccaaggacctct

SEQ ID NO: 672212 - DNA, 25 bp, Artificial sequence
  Synthetic oligonucleotide
cgacggcaagaacgccaagcactgg

SEQ ID NO: 672213 - DNA, 25 bp, Artificial sequence
  Synthetic oligonucleotide
ctgcagtacgtggtccagggcggtc

SEQ ID NO: 672214 - DNA, 25 bp, Artificial sequence
  Synthetic oligonucleotide
ctcgacctgcagtacgtggtccagg

SEQ ID NO: 672215 - DNA, 25 bp, Artificial sequence
  Synthetic oligonucleotide
cgcgacctcgacctgcagtacgtgg

SEQ ID NO: 672216 - DNA, 25 bp, Artificial sequence
  Synthetic oligonucleotide
tgggaacgcgacctcgacctgcagt

SEQ ID NO: 672217 - DNA, 25 bp, Artificial sequence
  Synthetic oligonucleotide
aagcactgggaacgcgacctcgacc

SEQ ID NO: 672218 - DNA, 25 bp, Artificial sequence
  Synthetic oligonucleotide
acgccaagcactgggaacgcgacct

SEQ ID NO: 672219 - DNA, 25 bp, Artificial sequence
  Synthetic oligonucleotide
tacgacttcgtcgccctcggcctac

SEQ ID NO: 672220 - DNA, 25 bp, Artificial sequence
  Synthetic oligonucleotide
ggtccggccaaggacctctcgctgc

SEQ ID NO: 672221 - DNA, 25 bp, Artificial sequence
  Synthetic oligonucleotide
catttcgcggtcggctacaggcagc

SEQ ID NO: 672222 - DNA, 25 bp, Artificial sequence
  Synthetic oligonucleotide
aggtcaacggcaacacgccgttcga

SEQ ID NO: 672223 - DNA, 25 bp, Artificial sequence
  Synthetic oligonucleotide
tgcagaaggtcaacggcaacacgcc

SEQ ID NO: 672224 - DNA, 25 bp, Artificial sequence
  Synthetic oligonucleotide
cggtgctgcagaaggtcaacggcaa

SEQ ID NO: 672225 - DNA, 25 bp, Artificial sequence
  Synthetic oligonucleotide
tcaccgcggtgctgcagaaggtcaa

SEQ ID NO: 672226 - DNA, 25 bp, Artificial sequence
  Synthetic oligonucleotide
cacaccgtcaccgcggtgctgcaga

SEQ ID NO: 672227 - DNA, 25 bp, Artificial sequence
  Synthetic oligonucleotide
aggcagcacaccgtcaccgcggtgc

SEQ ID NO: 672228 - DNA, 25 bp, Artificial sequence
  Synthetic oligonucleotide
ccctcggcctacccggcctgagcgc

SEQ ID NO: 672229 - DNA, 25 bp, Artificial sequence
  Synthetic oligonucleotide
gcggtcggctacaggcagcacaccg

SEQ ID NO: 672230 - DNA, 25 bp, Artificial sequence
  Synthetic oligonucleotide
cgttcgactacatcaaccagggcga

SEQ ID NO: 672231 - DNA, 25 bp, Artificial sequence
  Synthetic oligonucleotide
agcctgcatttcgcggtcggctaca

SEQ ID NO: 672232 - DNA, 25 bp, Artificial sequence
  Synthetic oligonucleotide
acctacagcctgcatttcgcggtcg

SEQ ID NO: 672233 - DNA, 25 bp, Artificial sequence
  Synthetic oligonucleotide
aacaacacctacagcctgcatttcg

SEQ ID NO: 672234 - DNA, 25 bp, Artificial sequence
  Synthetic oligonucleotide
gatcgacaacaacacctacagcctg

SEQ ID NO: 672235 - DNA, 25 bp, Artificial sequence
  Synthetic oligonucleotide
ggccggatcgacaacaacacctaca

SEQ ID NO: 672236 - DNA, 25 bp, Artificial sequence
  Synthetic oligonucleotide
ttgctcggccggatcgacaacaaca

SEQ ID NO: 672237 - DNA, 25 bp, Artificial sequence
  Synthetic oligonucleotide
tccagtggcggggcggcgctgaaga

SEQ ID NO: 672238 - DNA, 25 bp, Artificial sequence
  Synthetic oligonucleotide
ggctacaggcagcacaccgtcaccg

SEQ ID NO: 672239 - DNA, 25 bp, Artificial sequence
  Synthetic oligonucleotide
actcgcagcagtattccgacttcaa

SEQ ID NO: 672240 - DNA, 25 bp, Artificial sequence
  Synthetic oligonucleotide
acgactacgacttcgtcgccctcgg

SEQ ID NO: 672241 - DNA, 25 bp, Artificial sequence
  Synthetic oligonucleotide
tgcaatacgactacgacttcgtcgc

SEQ ID NO: 672242 - DNA, 25 bp, Artificial sequence
  Synthetic oligonucleotide
ggaagctgcaatacgactacgactt

SEQ ID NO: 672243 - DNA, 25 bp, Artificial sequence
  Synthetic oligonucleotide
agtcctggaagctgcaatacgacta

SEQ ID NO: 672244 - DNA, 25 bp, Artificial sequence
  Synthetic oligonucleotide
acgagaagtcctggaagctgcaata

SEQ ID NO: 672245 - DNA, 25 bp, Artificial sequence
  Synthetic oligonucleotide
gtcccaacgagaagtcctggaagct

SEQ ID NO: 672246 - DNA, 25 bp, Artificial sequence
  Synthetic oligonucleotide
tcaacggtcccaacgagaagtcctg

SEQ ID NO: 672247 - DNA, 25 bp, Artificial sequence
  Synthetic oligonucleotide
acggcaacacgccgttcgactacat

SEQ ID NO: 672248 - DNA, 25 bp, Artificial sequence
  Synthetic oligonucleotide
agcagtattccgacttcaacggtcc

SEQ ID NO: 672249 - DNA, 25 bp, Artificial sequence
  Synthetic oligonucleotide
acacgccgttcgactacatcaacca

SEQ ID NO: 672250 - DNA, 25 bp, Artificial sequence
  Synthetic oligonucleotide
tcgacaactcgcagcagtattccga

SEQ ID NO: 672251 - DNA, 25 bp, Artificial sequence
  Synthetic oligonucleotide
tcttcctcgacaactcgcagcagta

SEQ ID NO: 672252 - DNA, 25 bp, Artificial sequence
  Synthetic oligonucleotide
acagcatcttcctcgacaactcgca

SEQ ID NO: 672253 - DNA, 25 bp, Artificial sequence
  Synthetic oligonucleotide
agggcgacagcatcttcctcgacaa

SEQ ID NO: 672254 - DNA, 25 bp, Artificial sequence
  Synthetic oligonucleotide
tcaaccagggcgacagcatcttcct

SEQ ID NO: 672255 - DNA, 25 bp, Artificial sequence
  Synthetic oligonucleotide
actacatcaaccagggcgacagcat

SEQ ID NO: 672256 - DNA, 25 bp, Artificial sequence
  Synthetic oligonucleotide
agcggcgactcgttgctcggccgga

SEQ ID NO: 672257 - DNA, 25 bp, Artificial sequence
  Synthetic oligonucleotide
tccgacttcaacggtcccaacgaga

SEQ ID NO: 672258 - DNA, 25 bp, Artificial sequence
  Synthetic oligonucleotide
tgatcatcgccctcggcctgctggt

SEQ ID NO: 672259 - DNA, 25 bp, Artificial sequence
  Synthetic oligonucleotide
gtacccatcgggctcaacgccagct

SEQ ID NO: 672260 - DNA, 25 bp, Artificial sequence
  Synthetic oligonucleotide
caccgtggagatgatgatcacgcgc

SEQ ID NO: 672261 - DNA, 25 bp, Artificial sequence
  Synthetic oligonucleotide
catgatcaccgtggagatgatgatc

SEQ ID NO: 672262 - DNA, 25 bp, Artificial sequence
  Synthetic oligonucleotide
cgatgccatgatcaccgtggagatg

SEQ ID NO: 672263 - DNA, 25 bp, Artificial sequence
  Synthetic oligonucleotide
gtggacgatgccatgatcaccgtgg

SEQ ID NO: 672264 - DNA, 25 bp, Artificial sequence
  Synthetic oligonucleotide
ctgctggtggacgatgccatgatca

SEQ ID NO: 672265 - DNA, 25 bp, Artificial sequence
  Synthetic oligonucleotide
atgatcacgcgcctcgaactgggcg

SEQ ID NO: 672266 - DNA, 25 bp, Artificial sequence
  Synthetic oligonucleotide
tcgccctcggcctgctggtggacga

SEQ ID NO: 672267 - DNA, 25 bp, Artificial sequence
  Synthetic oligonucleotide
acgcgcctcgaactgggcgactcgc

SEQ ID NO: 672268 - DNA, 25 bp, Artificial sequence
  Synthetic oligonucleotide
gcgcgctgatcatcgccctcggcct

SEQ ID NO: 672269 - DNA, 25 bp, Artificial sequence
  Synthetic oligonucleotide
ccctcggcgcgctgatcatcgccct

SEQ ID NO: 672270 - DNA, 25 bp, Artificial sequence
  Synthetic oligonucleotide
gggtttccctcggcgcgctgatcat

SEQ ID NO: 672271 - DNA, 25 bp, Artificial sequence
  Synthetic oligonucleotide
atgcagcgggtttccctcggcgcgc

SEQ ID NO: 672272 - DNA, 25 bp, Artificial sequence
  Synthetic oligonucleotide
tcaccatgcagcgggtttccctcgg

SEQ ID NO: 672273 - DNA, 25 bp, Artificial sequence
  Synthetic oligonucleotide
ccgacatcaccatgcagcgggtttc

SEQ ID NO: 672274 - DNA, 25 bp, Artificial sequence
  Synthetic oligonucleotide
aatacaccgacatcaccatgcagcg

SEQ ID NO: 672275 - DNA, 25 bp, Artificial sequence
  Synthetic oligonucleotide
ctcggcctgctggtggacgatgcca

SEQ ID NO: 672276 - DNA, 25 bp, Artificial sequence
  Synthetic oligonucleotide
cacctcgacggccttcccgatgctc

SEQ ID NO: 672277 - DNA, 25 bp, Artificial sequence
  Synthetic oligonucleotide
ctcaatgcgcgcatgcaggagatca

SEQ ID NO: 672278 - DNA, 25 bp, Artificial sequence
  Synthetic oligonucleotide
tggccggcttcgtacccatcgggct

SEQ ID NO: 672279 - DNA, 25 bp, Artificial sequence
  Synthetic oligonucleotide
gtgacggtggccggcttcgtaccca

SEQ ID NO: 672280 - DNA, 25 bp, Artificial sequence
  Synthetic oligonucleotide
gaccctggtgacggtggccggcttc

SEQ ID NO: 672281 - DNA, 25 bp, Artificial sequence
  Synthetic oligonucleotide
tcaccgggaccctggtgacggtggc

SEQ ID NO: 672282 - DNA, 25 bp, Artificial sequence
  Synthetic oligonucleotide
gatgctcaccgggaccctggtgacg

SEQ ID NO: 672283 - DNA, 25 bp, Artificial sequence
  Synthetic oligonucleotide
ggagatgatgatcacgcgcctcgaa

SEQ ID NO: 672284 - DNA, 25 bp, Artificial sequence
  Synthetic oligonucleotide
gacggccttcccgatgctcaccggg

SEQ ID NO: 672285 - DNA, 25 bp, Artificial sequence
  Synthetic oligonucleotide
ggtcttcgtgttcatggaatacacc

SEQ ID NO: 672286 - DNA, 25 bp, Artificial sequence
  Synthetic oligonucleotide
cgcctacacctcgacggccttcccg

SEQ ID NO: 672287 - DNA, 25 bp, Artificial sequence
  Synthetic oligonucleotide
gacctacgcctacacctcgacggcc

SEQ ID NO: 672288 - DNA, 25 bp, Artificial sequence
  Synthetic oligonucleotide
ctcggcgacctacgcctacacctcg

SEQ ID NO: 672289 - DNA, 25 bp, Artificial sequence
  Synthetic oligonucleotide
acacgactcggcgacctacgcctac

SEQ ID NO: 672290 - DNA, 25 bp, Artificial sequence
  Synthetic oligonucleotide
actcgctacacgactcggcgaccta

SEQ ID NO: 672291 - DNA, 25 bp, Artificial sequence
  Synthetic oligonucleotide
tgggcgactcgctacacgactcggc

SEQ ID NO: 672292 - DNA, 25 bp, Artificial sequence
  Synthetic oligonucleotide
tcgaactgggcgactcgctacacga

SEQ ID NO: 672293 - DNA, 25 bp, Artificial sequence
  Synthetic oligonucleotide
cttcccgatgctcaccgggaccctg

SEQ ID NO: 672294 - DNA, 25 bp, Artificial sequence
  Synthetic oligonucleotide
cggcgtgcaccaggtgtcgaaccag

SEQ ID NO: 672295 - DNA, 25 bp, Artificial sequence
  Synthetic oligonucleotide
tcacccgggcgctgttcgaggcggt

SEQ ID NO: 672296 - DNA, 25 bp, Artificial sequence
  Synthetic oligonucleotide
gcggtttcacccgggcgctgttcga

SEQ ID NO: 672297 - DNA, 25 bp, Artificial sequence
  Synthetic oligonucleotide
tgaagaaggcggtcggcggtttcac

SEQ ID NO: 672298 - DNA, 25 bp, Artificial sequence
  Synthetic oligonucleotide
aggtggtgaagaaggcggtcggcgg

SEQ ID NO: 672299 - DNA, 25 bp, Artificial sequence
  Synthetic oligonucleotide
aggcccaggtggtgaagaaggcggt

SEQ ID NO: 672300 - DNA, 25 bp, Artificial sequence
  Synthetic oligonucleotide
cgaaccaggcccaggtggtgaagaa

SEQ ID NO: 672301 - DNA, 25 bp, Artificial sequence
  Synthetic oligonucleotide
tcatggaatacaccgacatcaccat

SEQ ID NO: 672302 - DNA, 25 bp, Artificial sequence
  Synthetic oligonucleotide
tgcaccaggtgtcgaaccaggccca

SEQ ID NO: 672303 - DNA, 25 bp, Artificial sequence
  Synthetic oligonucleotide
aggcggtggtgatcgtcctcatcgt

SEQ ID NO: 672304 - DNA, 25 bp, Artificial sequence
  Synthetic oligonucleotide
tggcgtcggcgtgcaccaggtgtcg

SEQ ID NO: 672305 - DNA, 25 bp, Artificial sequence
  Synthetic oligonucleotide
gccggttggcgtcggcgtgcaccag

SEQ ID NO: 672306 - DNA, 25 bp, Artificial sequence
  Synthetic oligonucleotide
cgaactgccggttggcgtcggcgtg

SEQ ID NO: 672307 - DNA, 25 bp, Artificial sequence
  Synthetic oligonucleotide
caccggcgaactgccggttggcgtc

SEQ ID NO: 672308 - DNA, 25 bp, Artificial sequence
  Synthetic oligonucleotide
gagatcaccggcgaactgccggttg

SEQ ID NO: 672309 - DNA, 25 bp, Artificial sequence
  Synthetic oligonucleotide
catgcaggagatcaccggcgaactg

SEQ ID NO: 672310 - DNA, 25 bp, Artificial sequence
  Synthetic oligonucleotide
ggcgcgatccgcttctacctgccgc

SEQ ID NO: 672311 - DNA, 25 bp, Artificial sequence
  Synthetic oligonucleotide
aggtgtcgaaccaggcccaggtggt

SEQ ID NO: 672312 - DNA, 25 bp, Artificial sequence
  Synthetic oligonucleotide
ggcctgcgcgccgggctggtggtgg

SEQ ID NO: 672313 - DNA, 25 bp, Artificial sequence
  Synthetic oligonucleotide
atcgggctcaacgccagctccgccg

SEQ ID NO: 672314 - DNA, 25 bp, Artificial sequence
  Synthetic oligonucleotide
ggcgatggtcttcgtgttcatggaa

SEQ ID NO: 672315 - DNA, 25 bp, Artificial sequence
  Synthetic oligonucleotide
ggtgctggcgatggtcttcgtgttc

SEQ ID NO: 672316 - DNA, 25 bp, Artificial sequence
  Synthetic oligonucleotide
cccgctggtgctggcgatggtcttc

SEQ ID NO: 672317 - DNA, 25 bp, Artificial sequence
  Synthetic oligonucleotide
ctcgatcccgctggtgctggcgatg

SEQ ID NO: 672318 - DNA, 25 bp, Artificial sequence
  Synthetic oligonucleotide
tggcctgctcgatcccgctggtgct

SEQ ID NO: 672319 - DNA, 25 bp, Artificial sequence
  Synthetic oligonucleotide
tggtggtggcctgctcgatcccgct

SEQ ID NO: 672320 - DNA, 25 bp, Artificial sequence
  Synthetic oligonucleotide
gggcgctgttcgaggcggtggtgat

SEQ ID NO: 672321 - DNA, 25 bp, Artificial sequence
  Synthetic oligonucleotide
agctgaccctgtcccagcgcaaccc

SEQ ID NO: 672322 - DNA, 25 bp, Artificial sequence
  Synthetic oligonucleotide
tgttcgaggcggtggtgatcgtcct

SEQ ID NO: 672323 - DNA, 25 bp, Artificial sequence
  Synthetic oligonucleotide
cagcctggggatgatccccatcgcc

SEQ ID NO: 672324 - DNA, 25 bp, Artificial sequence
  Synthetic oligonucleotide
ttcgtcagcctcggcctgcgcgccg

SEQ ID NO: 672325 - DNA, 25 bp, Artificial sequence
  Synthetic oligonucleotide
gtcagcttcgtcagcctcggcctgc

SEQ ID NO: 672326 - DNA, 25 bp, Artificial sequence
  Synthetic oligonucleotide
tcatcgtcagcttcgtcagcctcgg

SEQ ID NO: 672327 - DNA, 25 bp, Artificial sequence
  Synthetic oligonucleotide
tcgtcctcatcgtcagcttcgtcag

SEQ ID NO: 672328 - DNA, 25 bp, Artificial sequence
  Synthetic oligonucleotide
tggtgatcgtcctcatcgtcagctt

SEQ ID NO: 672329 - DNA, 25 bp, Artificial sequence
  Synthetic oligonucleotide
cgtgttcatggaatacaccgacatc

SEQ ID NO: 672330 - DNA, 25 bp, Artificial sequence
  Synthetic oligonucleotide
cgggctggtggtggcctgctcgatc

SEQ ID NO: 672331 - DNA, 25 bp, Artificial sequence
  Synthetic oligonucleotide
aagttcgtccagcaccagttcttcc

SEQ ID NO: 672332 - DNA, 25 bp, Artificial sequence
  Synthetic oligonucleotide
ggcttcgtacccatcgggctcaacg

SEQ ID NO: 672333 - DNA, 25 bp, Artificial sequence
  Synthetic oligonucleotide
tggtcgacctcaacctgccgcagaa

SEQ ID NO: 672334 - DNA, 25 bp, Artificial sequence
  Synthetic oligonucleotide
aactgctggtcgacctcaacctgcc

SEQ ID NO: 672335 - DNA, 25 bp, Artificial sequence
  Synthetic oligonucleotide
gtccggaactgctggtcgacctcaa

SEQ ID NO: 672336 - DNA, 25 bp, Artificial sequence
  Synthetic oligonucleotide
ccgaccgtccggaactgctggtcga

SEQ ID NO: 672337 - DNA, 25 bp, Artificial sequence
  Synthetic oligonucleotide
cgtcttccgaccgtccggaactgct

SEQ ID NO: 672338 - DNA, 25 bp, Artificial sequence
  Synthetic oligonucleotide
acctgccgcagaacagcagcatcca

SEQ ID NO: 672339 - DNA, 25 bp, Artificial sequence
  Synthetic oligonucleotide
gtccagcaccagttcttcccgtctt

SEQ ID NO: 672340 - DNA, 25 bp, Artificial sequence
  Synthetic oligonucleotide
gcagaacagcagcatccacgagacc

SEQ ID NO: 672341 - DNA, 25 bp, Artificial sequence
  Synthetic oligonucleotide
tgatgaagttcgtccagcaccagtt

SEQ ID NO: 672342 - DNA, 25 bp, Artificial sequence
  Synthetic oligonucleotide
tgttcctgatgaagttcgtccagca

SEQ ID NO: 672343 - DNA, 25 bp, Artificial sequence
  Synthetic oligonucleotide
tgtcgctgttcctgatgaagttcgt

SEQ ID NO: 672344 - DNA, 25 bp, Artificial sequence
  Synthetic oligonucleotide
tcggcgtgtcgctgttcctgatgaa

SEQ ID NO: 672345 - DNA, 25 bp, Artificial sequence
  Synthetic oligonucleotide
tgctgttcggcgtgtcgctgttcct

SEQ ID NO: 672346 - DNA, 25 bp, Artificial sequence
  Synthetic oligonucleotide
accgcgctgctgttcggcgtgtcgc

SEQ ID NO: 672347 - DNA, 25 bp, Artificial sequence
  Synthetic oligonucleotide
ttcctcaccgcgctgctgttcggcg

SEQ ID NO: 672348 - DNA, 25 bp, Artificial sequence
  Synthetic oligonucleotide
gcaccagttcttcccgtcttccgac

SEQ ID NO: 672349 - DNA, 25 bp, Artificial sequence
  Synthetic oligonucleotide
agcgacgctgaaggacgacgaggac

SEQ ID NO: 672350 - DNA, 25 bp, Artificial sequence
  Synthetic oligonucleotide
ggcgaaggcgcgatccgcttctacc

SEQ ID NO: 672351 - DNA, 25 bp, Artificial sequence
  Synthetic oligonucleotide
tacgtcggcgaaggcgcgatccgct

SEQ ID NO: 672352 - DNA, 25 bp, Artificial sequence
  Synthetic oligonucleotide
agcgcctacgtcggcgaaggcgcga

SEQ ID NO: 672353 - DNA, 25 bp, Artificial sequence
  Synthetic oligonucleotide
cactggagcgcctacgtcggcgaag

SEQ ID NO: 672354 - DNA, 25 bp, Artificial sequence
  Synthetic oligonucleotide
atcgaccactggagcgcctacgtcg

SEQ ID NO: 672355 - DNA, 25 bp, Artificial sequence
  Synthetic oligonucleotide
cgaggacatcgaccactggagcgcc

SEQ ID NO: 672356 - DNA, 25 bp, Artificial sequence
  Synthetic oligonucleotide
acctcaacctgccgcagaacagcag

SEQ ID NO: 672357 - DNA, 25 bp, Artificial sequence
  Synthetic oligonucleotide
cgctgaaggacgacgaggacatcga

SEQ ID NO: 672358 - DNA, 25 bp, Artificial sequence
  Synthetic oligonucleotide
cggcgctggacgaccatcttcctca

SEQ ID NO: 672359 - DNA, 25 bp, Artificial sequence
  Synthetic oligonucleotide
cctggaagcgacgctgaaggacgac

SEQ ID NO: 672360 - DNA, 25 bp, Artificial sequence
  Synthetic oligonucleotide
ggaccgcctggaagcgacgctgaag

SEQ ID NO: 672361 - DNA, 25 bp, Artificial sequence
  Synthetic oligonucleotide
gtgatggaccgcctggaagcgacgc

SEQ ID NO: 672362 - DNA, 25 bp, Artificial sequence
  Synthetic oligonucleotide
cagggcggtgatggaccgcctggaa

SEQ ID NO: 672363 - DNA, 25 bp, Artificial sequence
  Synthetic oligonucleotide
cgagaccagggcggtgatggaccgc

SEQ ID NO: 672364 - DNA, 25 bp, Artificial sequence
  Synthetic oligonucleotide
catccacgagaccagggcggtgatg

SEQ ID NO: 672365 - DNA, 25 bp, Artificial sequence
  Synthetic oligonucleotide
cagcagcatccacgagaccagggcg

SEQ ID NO: 672366 - DNA, 25 bp, Artificial sequence
  Synthetic oligonucleotide
ggacgacgaggacatcgaccactgg

SEQ ID NO: 672367 - DNA, 25 bp, Artificial sequence
  Synthetic oligonucleotide
cagtgatcgccgtggcgctgctgct

SEQ ID NO: 672368 - DNA, 25 bp, Artificial sequence
  Synthetic oligonucleotide
tcgccccggtgatcgccgtgcacat

SEQ ID NO: 672369 - DNA, 25 bp, Artificial sequence
  Synthetic oligonucleotide
tgctgttcgccccggtgatcgccgt

SEQ ID NO: 672370 - DNA, 25 bp, Artificial sequence
  Synthetic oligonucleotide
tcgcggtgctgttcgccccggtgat

SEQ ID NO: 672371 - DNA, 25 bp, Artificial sequence
  Synthetic oligonucleotide
ggatcgtcgcggtgctgttcgcccc

SEQ ID NO: 672372 - DNA, 25 bp, Artificial sequence
  Synthetic oligonucleotide
tgtcgtggatcgtcgcggtgctgtt

SEQ ID NO: 672373 - DNA, 25 bp, Artificial sequence
  Synthetic oligonucleotide
tgctgctgtcgtggatcgtcgcggt

SEQ ID NO: 672374 - DNA, 25 bp, Artificial sequence
  Synthetic oligonucleotide
accatcttcctcaccgcgctgctgt

SEQ ID NO: 672375 - DNA, 25 bp, Artificial sequence
  Synthetic oligonucleotide
tcgccgtggcgctgctgctgtcgtg

SEQ ID NO: 672376 - DNA, 25 bp, Artificial sequence
  Synthetic oligonucleotide
gtgcacatcctgccgaagactctca

SEQ ID NO: 672377 - DNA, 25 bp, Artificial sequence
  Synthetic oligonucleotide
tgttcgcagtgatcgccgtggcgct

SEQ ID NO: 672378 - DNA, 25 bp, Artificial sequence
  Synthetic oligonucleotide
tcaccctgttcgcagtgatcgccgt

SEQ ID NO: 672379 - DNA, 25 bp, Artificial sequence
  Synthetic oligonucleotide
tacaccttcaccctgttcgcagtga

SEQ ID NO: 672380 - DNA, 25 bp, Artificial sequence
  Synthetic oligonucleotide
ggcgagtacaccttcaccctgttcg

SEQ ID NO: 672381 - DNA, 25 bp, Artificial sequence
  Synthetic oligonucleotide
tccgccggcgagtacaccttcaccc

SEQ ID NO: 672382 - DNA, 25 bp, Artificial sequence
  Synthetic oligonucleotide
gccagctccgccggcgagtacacct

SEQ ID NO: 672383 - DNA, 25 bp, Artificial sequence
  Synthetic oligonucleotide
ctcaacgccagctccgccggcgagt

SEQ ID NO: 672384 - DNA, 25 bp, Artificial sequence
  Synthetic oligonucleotide
tggcgctgctgctgtcgtggatcgt

SEQ ID NO: 672385 - DNA, 25 bp, Artificial sequence
  Synthetic oligonucleotide
gaagaagggccgcattgccgagcgt

SEQ ID NO: 672386 - DNA, 25 bp, Artificial sequence
  Synthetic oligonucleotide
gaggcgctcaatgcgcgcatgcagg

SEQ ID NO: 672387 - DNA, 25 bp, Artificial sequence
  Synthetic oligonucleotide
atgcgccggcgctggacgaccatct

SEQ ID NO: 672388 - DNA, 25 bp, Artificial sequence
  Synthetic oligonucleotide
ctggcgatgcgccggcgctggacga

SEQ ID NO: 672389 - DNA, 25 bp, Artificial sequence
  Synthetic oligonucleotide
ctgcacctggcgatgcgccggcgct

SEQ ID NO: 672390 - DNA, 25 bp, Artificial sequence
  Synthetic oligonucleotide
agcctgctgcacctggcgatgcgcc

SEQ ID NO: 672391 - DNA, 25 bp, Artificial sequence
  Synthetic oligonucleotide
ttcgacagcctgctgcacctggcga

SEQ ID NO: 672392 - DNA, 25 bp, Artificial sequence
  Synthetic oligonucleotide
gagcgtttcgacagcctgctgcacc

SEQ ID NO: 672393 - DNA, 25 bp, Artificial sequence
  Synthetic oligonucleotide
cggtgatcgccgtgcacatcctgcc

SEQ ID NO: 672394 - DNA, 25 bp, Artificial sequence
  Synthetic oligonucleotide
ggccgcattgccgagcgtttcgaca

SEQ ID NO: 672395 - DNA, 25 bp, Artificial sequence
  Synthetic oligonucleotide
atcgccgtgcacatcctgccgaaga

SEQ ID NO: 672396 - DNA, 25 bp, Artificial sequence
  Synthetic oligonucleotide
cggagcagaagaagggccgcattgc

SEQ ID NO: 672397 - DNA, 25 bp, Artificial sequence
  Synthetic oligonucleotide
acaagtcggagcagaagaagggccg

SEQ ID NO: 672398 - DNA, 25 bp, Artificial sequence
  Synthetic oligonucleotide
tcaagcacaagtcggagcagaagaa

SEQ ID NO: 672399 - DNA, 25 bp, Artificial sequence
  Synthetic oligonucleotide
gactctcaagcacaagtcggagcag

SEQ ID NO: 672400 - DNA, 25 bp, Artificial sequence
  Synthetic oligonucleotide
gccgaagactctcaagcacaagtcg

SEQ ID NO: 672401 - DNA, 25 bp, Artificial sequence
  Synthetic oligonucleotide
atcctgccgaagactctcaagcaca

SEQ ID NO: 672402 - DNA, 25 bp, Artificial sequence
  Synthetic oligonucleotide
tggacgaccatcttcctcaccgcgc

SEQ ID NO: 672403 - DNA, 25 bp, Artificial sequence
  Synthetic oligonucleotide
attgccgagcgtttcgacagcctgc

SEQ ID NO: 672404 - DNA, 25 bp, Artificial sequence
  Synthetic oligonucleotide
cgacccggcgaatcgacggtcttcg

SEQ ID NO: 672405 - DNA, 25 bp, Artificial sequence
  Synthetic oligonucleotide
ttcaccgccgatggcctggacttcc

SEQ ID NO: 672406 - DNA, 25 bp, Artificial sequence
  Synthetic oligonucleotide
ccaaggccggcgacatcccggatat

SEQ ID NO: 672407 - DNA, 25 bp, Artificial sequence
  Synthetic oligonucleotide
acaccaccaaggccggcgacatccc

SEQ ID NO: 672408 - DNA, 25 bp, Artificial sequence
  Synthetic oligonucleotide
tcaaggacaccaccaaggccggcga

SEQ ID NO: 672409 - DNA, 25 bp, Artificial sequence
  Synthetic oligonucleotide
gtctacctcaaggacaccaccaagg

SEQ ID NO: 672410 - DNA, 25 bp, Artificial sequence
  Synthetic oligonucleotide
gtcttcgtctacctcaaggacacca

SEQ ID NO: 672411 - DNA, 25 bp, Artificial sequence
  Synthetic oligonucleotide
acatcccggatatctggtaccaggt

SEQ ID NO: 672412 - DNA, 25 bp, Artificial sequence
  Synthetic oligonucleotide
ggcgaatcgacggtcttcgtctacc

SEQ ID NO: 672413 - DNA, 25 bp, Artificial sequence
  Synthetic oligonucleotide
cggatatctggtaccaggtgcgcaa

SEQ ID NO: 672414 - DNA, 25 bp, Artificial sequence
  Synthetic oligonucleotide
tacacgcgacccggcgaatcgacgg

SEQ ID NO: 672415 - DNA, 25 bp, Artificial sequence
  Synthetic oligonucleotide
aagagctacacgcgacccggcgaat

SEQ ID NO: 672416 - DNA, 25 bp, Artificial sequence
  Synthetic oligonucleotide
tacgtgaagagctacacgcgacccg

SEQ ID NO: 672417 - DNA, 25 bp, Artificial sequence
  Synthetic oligonucleotide
ctggattacgtgaagagctacacgc

SEQ ID NO: 672418 - DNA, 25 bp, Artificial sequence
  Synthetic oligonucleotide
gactcgctggattacgtgaagagct

SEQ ID NO: 672419 - DNA, 25 bp, Artificial sequence
  Synthetic oligonucleotide
gagctggactcgctggattacgtga

SEQ ID NO: 672420 - DNA, 25 bp, Artificial sequence
  Synthetic oligonucleotide
gctcgaggagctggactcgctggat

SEQ ID NO: 672421 - DNA, 25 bp, Artificial sequence
  Synthetic oligonucleotide
tcgacggtcttcgtctacctcaagg

SEQ ID NO: 672422 - DNA, 25 bp, Artificial sequence
  Synthetic oligonucleotide
gaattcccccagggcatccagggac

SEQ ID NO: 672423 - DNA, 25 bp, Artificial sequence
  Synthetic oligonucleotide
tgcgcgcatgcaggagatcaccggc

SEQ ID NO: 672424 - DNA, 25 bp, Artificial sequence
  Synthetic oligonucleotide
gcgtctacgccttcaccgccgatgg

SEQ ID NO: 672425 - DNA, 25 bp, Artificial sequence
  Synthetic oligonucleotide
tcggcagcgtctacgccttcaccgc

SEQ ID NO: 672426 - DNA, 25 bp, Artificial sequence
  Synthetic oligonucleotide
gacgtgttcggcagcgtctacgcct

SEQ ID NO: 672427 - DNA, 25 bp, Artificial sequence
  Synthetic oligonucleotide
ttcggcgacgtgttcggcagcgtct

SEQ ID NO: 672428 - DNA, 25 bp, Artificial sequence
  Synthetic oligonucleotide
gacgagttcggcgacgtgttcggca

SEQ ID NO: 672429 - DNA, 25 bp, Artificial sequence
  Synthetic oligonucleotide
ccggcgacatcccggatatctggta

SEQ ID NO: 672430 - DNA, 25 bp, Artificial sequence
  Synthetic oligonucleotide
cagggcatccagggaccgggtttca

SEQ ID NO: 672431 - DNA, 25 bp, Artificial sequence
  Synthetic oligonucleotide
gaccgcatcgagaagaagctcgagg

SEQ ID NO: 672432 - DNA, 25 bp, Artificial sequence
  Synthetic oligonucleotide
agggcgaattcccccagggcatcca

SEQ ID NO: 672433 - DNA, 25 bp, Artificial sequence
  Synthetic oligonucleotide
acatccagggcgaattcccccaggg

SEQ ID NO: 672434 - DNA, 25 bp, Artificial sequence
  Synthetic oligonucleotide
tatccgacatccagggcgaattccc

SEQ ID NO: 672435 - DNA, 25 bp, Artificial sequence
  Synthetic oligonucleotide
agaagatatccgacatccagggcga

SEQ ID NO: 672436 - DNA, 25 bp, Artificial sequence
  Synthetic oligonucleotide
tgcgcaagaagatatccgacatcca

SEQ ID NO: 672437 - DNA, 25 bp, Artificial sequence
  Synthetic oligonucleotide
accaggtgcgcaagaagatatccga

SEQ ID NO: 672438 - DNA, 25 bp, Artificial sequence
  Synthetic oligonucleotide
tctggtaccaggtgcgcaagaagat

SEQ ID NO: 672439 - DNA, 25 bp, Artificial sequence
  Synthetic oligonucleotide
tttcaacgacgagttcggcgacgtg

SEQ ID NO: 672440 - DNA, 25 bp, Artificial sequence
  Synthetic oligonucleotide
accagtccctggtctggtacctgat

SEQ ID NO: 672441 - DNA, 25 bp, Artificial sequence
  Synthetic oligonucleotide
tgttctcctacctcaacctggggcg

SEQ ID NO: 672442 - DNA, 25 bp, Artificial sequence
  Synthetic oligonucleotide
tgggcgtgttctcctacctcaacct

SEQ ID NO: 672443 - DNA, 25 bp, Artificial sequence
  Synthetic oligonucleotide
tggtgatgggcgtgttctcctacct

SEQ ID NO: 672444 - DNA, 25 bp, Artificial sequence
  Synthetic oligonucleotide
tatcgctggtgatgggcgtgttctc

SEQ ID NO: 672445 - DNA, 25 bp, Artificial sequence
  Synthetic oligonucleotide
tggcggtatcgctggtgatgggcgt

SEQ ID NO: 672446 - DNA, 25 bp, Artificial sequence
  Synthetic oligonucleotide
acctgatggcggtatcgctggtgat

SEQ ID NO: 672447 - DNA, 25 bp, Artificial sequence
  Synthetic oligonucleotide
aagaagctcgaggagctggactcgc

SEQ ID NO: 672448 - DNA, 25 bp, Artificial sequence
  Synthetic oligonucleotide
ccctggtctggtacctgatggcggt

SEQ ID NO: 672449 - DNA, 25 bp, Artificial sequence
  Synthetic oligonucleotide
tggggcgcgaggaggatccctcgtt

SEQ ID NO: 672450 - DNA, 25 bp, Artificial sequence
  Synthetic oligonucleotide
tgcgccaccagtccctggtctggta

SEQ ID NO: 672451 - DNA, 25 bp, Artificial sequence
  Synthetic oligonucleotide
gggccctgcgccaccagtccctggt

SEQ ID NO: 672452 - DNA, 25 bp, Artificial sequence
  Synthetic oligonucleotide
cggactgggccctgcgccaccagtc

SEQ ID NO: 672453 - DNA, 25 bp, Artificial sequence
  Synthetic oligonucleotide
acctgtcggactgggccctgcgcca

SEQ ID NO: 672454 - DNA, 25 bp, Artificial sequence
  Synthetic oligonucleotide
tttcaacctgtcggactgggccctg

SEQ ID NO: 672455 - DNA, 25 bp, Artificial sequence
  Synthetic oligonucleotide
agggcggtttcaacctgtcggactg

SEQ ID NO: 672456 - DNA, 25 bp, Artificial sequence
  Synthetic oligonucleotide
gatgaagggcggtttcaacctgtcg

SEQ ID NO: 672457 - DNA, 25 bp, Artificial sequence
  Synthetic oligonucleotide
tctggtacctgatggcggtatcgct

SEQ ID NO: 672458 - DNA, 25 bp, Artificial sequence
  Synthetic oligonucleotide
catccagacccgctggccgggcgcc

SEQ ID NO: 672459 - DNA, 25 bp, Artificial sequence
  Synthetic oligonucleotide
gccgatggcctggacttccgccagc

SEQ ID NO: 672460 - DNA, 25 bp, Artificial sequence
  Synthetic oligonucleotide
ggtcaccgaccgcatcgagaagaag

SEQ ID NO: 672461 - DNA, 25 bp, Artificial sequence
  Synthetic oligonucleotide
tggagcaggtcaccgaccgcatcga

SEQ ID NO: 672462 - DNA, 25 bp, Artificial sequence
  Synthetic oligonucleotide
acaccctggagcaggtcaccgaccg

SEQ ID NO: 672463 - DNA, 25 bp, Artificial sequence
  Synthetic oligonucleotide
tggacgacaccctggagcaggtcac

SEQ ID NO: 672464 - DNA, 25 bp, Artificial sequence
  Synthetic oligonucleotide
cacggtggacgacaccctggagcag

SEQ ID NO: 672465 - DNA, 25 bp, Artificial sequence
  Synthetic oligonucleotide
gggcgccacggtggacgacaccctg

SEQ ID NO: 672466 - DNA, 25 bp, Artificial sequence
  Synthetic oligonucleotide
cctacctcaacctggggcgcgagga

SEQ ID NO: 672467 - DNA, 25 bp, Artificial sequence
  Synthetic oligonucleotide
gacccgctggccgggcgccacggtg

SEQ ID NO: 672468 - DNA, 25 bp, Artificial sequence
  Synthetic oligonucleotide
tcaacctggggcgcgaggaggatcc

SEQ ID NO: 672469 - DNA, 25 bp, Artificial sequence
  Synthetic oligonucleotide
ccatggtcatccagacccgctggcc

SEQ ID NO: 672470 - DNA, 25 bp, Artificial sequence
  Synthetic oligonucleotide
tcaagaccatggtcatccagacccg

SEQ ID NO: 672471 - DNA, 25 bp, Artificial sequence
  Synthetic oligonucleotide
tcgccatcaagaccatggtcatcca

SEQ ID NO: 672472 - DNA, 25 bp, Artificial sequence
  Synthetic oligonucleotide
cctcgttcgccatcaagaccatggt

SEQ ID NO: 672473 - DNA, 25 bp, Artificial sequence
  Synthetic oligonucleotide
aggatccctcgttcgccatcaagac

SEQ ID NO: 672474 - DNA, 25 bp, Artificial sequence
  Synthetic oligonucleotide
gcgaggaggatccctcgttcgccat

SEQ ID NO: 672475 - DNA, 25 bp, Artificial sequence
  Synthetic oligonucleotide
catcgagaagaagctcgaggagctg

SEQ ID NO: 672476 - DNA, 25 bp, Artificial sequence
  Synthetic oligonucleotide
ctggccgggcgccacggtggacgac

SEQ ID NO: 672477 - DNA, 25 bp, Artificial sequence
  Synthetic oligonucleotide
caacctgcgggtcaacgatcgtttc

SEQ ID NO: 672478 - DNA, 25 bp, Artificial sequence
  Synthetic oligonucleotide
acgccttcaccgccgatggcctgga

SEQ ID NO: 672479 - DNA, 25 bp, Artificial sequence
  Synthetic oligonucleotide
tggccagcatcagccgcgatttcgt

SEQ ID NO: 672480 - DNA, 25 bp, Artificial sequence
  Synthetic oligonucleotide
ccgacctggccagcatcagccgcga

SEQ ID NO: 672481 - DNA, 25 bp, Artificial sequence
  Synthetic oligonucleotide
ggctgtccgacctggccagcatcag

SEQ ID NO: 672482 - DNA, 25 bp, Artificial sequence
  Synthetic oligonucleotide
ttctaccggctgtccgacctggcca

SEQ ID NO: 672483 - DNA, 25 bp, Artificial sequence
  Synthetic oligonucleotide
gatcgtttctaccggctgtccgacc

SEQ ID NO: 672484 - DNA, 25 bp, Artificial sequence
  Synthetic oligonucleotide
gccgcgatttcgtcgacccgccgac

SEQ ID NO: 672485 - DNA, 25 bp, Artificial sequence
  Synthetic oligonucleotide
tgcgggtcaacgatcgtttctaccg

SEQ ID NO: 672486 - DNA, 25 bp, Artificial sequence
  Synthetic oligonucleotide
atttcgtcgacccgccgacctcgct

SEQ ID NO: 672487 - DNA, 25 bp, Artificial sequence
  Synthetic oligonucleotide
ggcggtcaacctgcgggtcaacgat

SEQ ID NO: 672488 - DNA, 25 bp, Artificial sequence
  Synthetic oligonucleotide
ctgcaggcggtcaacctgcgggtca

SEQ ID NO: 672489 - DNA, 25 bp, Artificial sequence
  Synthetic oligonucleotide
aaaggacctgcaggcggtcaacctg

SEQ ID NO: 672490 - DNA, 25 bp, Artificial sequence
  Synthetic oligonucleotide
ttcggaaaaggacctgcaggcggtc

SEQ ID NO: 672491 - DNA, 25 bp, Artificial sequence
  Synthetic oligonucleotide
cttccgttcggaaaaggacctgcag

SEQ ID NO: 672492 - DNA, 25 bp, Artificial sequence
  Synthetic oligonucleotide
gcgcacctccggcaacttccgttcg

SEQ ID NO: 672493 - DNA, 25 bp, Artificial sequence
  Synthetic oligonucleotide
ctcggtgcgcacctccggcaacttc

SEQ ID NO: 672494 - DNA, 25 bp, Artificial sequence
  Synthetic oligonucleotide
tcaacgatcgtttctaccggctgtc

SEQ ID NO: 672495 - DNA, 25 bp, Artificial sequence
  Synthetic oligonucleotide
ggccatcggcctggcggtggcgatg

SEQ ID NO: 672496 - DNA, 25 bp, Artificial sequence
  Synthetic oligonucleotide
ttcggcgaggcgctcaatgcgcgca

SEQ ID NO: 672497 - DNA, 25 bp, Artificial sequence
  Synthetic oligonucleotide
ctcgagttcggcgaggcgctcaatg

SEQ ID NO: 672498 - DNA, 25 bp, Artificial sequence
  Synthetic oligonucleotide
caatatcctcgagttcggcgaggcg

SEQ ID NO: 672499 - DNA, 25 bp, Artificial sequence
  Synthetic oligonucleotide
gggcggcaatatcctcgagttcggc

SEQ ID NO: 672500 - DNA, 25 bp, Artificial sequence
  Synthetic oligonucleotide
gaaggagggcggcaatatcctcgag

SEQ ID NO: 672501 - DNA, 25 bp, Artificial sequence
  Synthetic oligonucleotide
ggcgatgaaggagggcggcaatatc

SEQ ID NO: 672502 - DNA, 25 bp, Artificial sequence
  Synthetic oligonucleotide
gcatcagccgcgatttcgtcgaccc

SEQ ID NO: 672503 - DNA, 25 bp, Artificial sequence
  Synthetic oligonucleotide
cggcctggcggtggcgatgaaggag

SEQ ID NO: 672504 - DNA, 25 bp, Artificial sequence
  Synthetic oligonucleotide
ggccggccccgagcgcatctcggtg

SEQ ID NO: 672505 - DNA, 25 bp, Artificial sequence
  Synthetic oligonucleotide
gagccggccatcggcctggcggtgg

SEQ ID NO: 672506 - DNA, 25 bp, Artificial sequence
  Synthetic oligonucleotide
agggcgagccggccatcggcctggc

SEQ ID NO: 672507 - DNA, 25 bp, Artificial sequence
  Synthetic oligonucleotide
gctacaagggcgagccggccatcgg

SEQ ID NO: 672508 - DNA, 25 bp, Artificial sequence
  Synthetic oligonucleotide
tgttccgctacaagggcgagccggc

SEQ ID NO: 672509 - DNA, 25 bp, Artificial sequence
  Synthetic oligonucleotide
ctcgctgttccgctacaagggcgag

SEQ ID NO: 672510 - DNA, 25 bp, Artificial sequence
  Synthetic oligonucleotide
cgccgacctcgctgttccgctacaa

SEQ ID NO: 672511 - DNA, 25 bp, Artificial sequence
  Synthetic oligonucleotide
tcgacccgccgacctcgctgttccg

SEQ ID NO: 672512 - DNA, 25 bp, Artificial sequence
  Synthetic oligonucleotide
ggcggtggcgatgaaggagggcggc

SEQ ID NO: 672513 - DNA, 25 bp, Artificial sequence
  Synthetic oligonucleotide
cgcctggacatccgctcggtgaaag

SEQ ID NO: 672514 - DNA, 25 bp, Artificial sequence
  Synthetic oligonucleotide
agaacgaggtcatctacctcaactt

SEQ ID NO: 672515 - DNA, 25 bp, Artificial sequence
  Synthetic oligonucleotide
gtgcgcagaacgaggtcatctacct

SEQ ID NO: 672516 - DNA, 25 bp, Artificial sequence
  Synthetic oligonucleotide
tgatcggtgcgcagaacgaggtcat

SEQ ID NO: 672517 - DNA, 25 bp, Artificial sequence
  Synthetic oligonucleotide
tgcagatgatcggtgcgcagaacga

SEQ ID NO: 672518 - DNA, 25 bp, Artificial sequence
  Synthetic oligonucleotide
caaggtgcagatgatcggtgcgcag

SEQ ID NO: 672519 - DNA, 25 bp, Artificial sequence
  Synthetic oligonucleotide
cctgggcaaggtgcagatgatcggt

SEQ ID NO: 672520 - DNA, 25 bp, Artificial sequence
  Synthetic oligonucleotide
gcgcatctcggtgcgcacctccggc

SEQ ID NO: 672521 - DNA, 25 bp, Artificial sequence
  Synthetic oligonucleotide
gacatccgctcggtgaaagacctgg

SEQ ID NO: 672522 - DNA, 25 bp, Artificial sequence
  Synthetic oligonucleotide
tcaacttctctacccgcaagctggc

SEQ ID NO: 672523 - DNA, 25 bp, Artificial sequence
  Synthetic oligonucleotide
aaggtgcgcctggacatccgctcgg

SEQ ID NO: 672524 - DNA, 25 bp, Artificial sequence
  Synthetic oligonucleotide
gtggagaaggtgcgcctggacatcc

SEQ ID NO: 672525 - DNA, 25 bp, Artificial sequence
  Synthetic oligonucleotide
gactacgtggagaaggtgcgcctgg

SEQ ID NO: 672526 - DNA, 25 bp, Artificial sequence
  Synthetic oligonucleotide
ctgcgcgactacgtggagaaggtgc

SEQ ID NO: 672527 - DNA, 25 bp, Artificial sequence
  Synthetic oligonucleotide
cgccagctgcgcgactacgtggaga

SEQ ID NO: 672528 - DNA, 25 bp, Artificial sequence
  Synthetic oligonucleotide
gacttccgccagctgcgcgactacg

SEQ ID NO: 672529 - DNA, 25 bp, Artificial sequence
  Synthetic oligonucleotide
ggcctggacttccgccagctgcgcg

SEQ ID NO: 672530 - DNA, 25 bp, Artificial sequence
  Synthetic oligonucleotide
gaaagacctgggcaaggtgcagatg

SEQ ID NO: 672531 - DNA, 25 bp, Artificial sequence
  Synthetic oligonucleotide
gcgccaggtcgtgcagagcctgcag

SEQ ID NO: 672532 - DNA, 25 bp, Artificial sequence
  Synthetic oligonucleotide
cgcgccgggctggtggtggcctgct

SEQ ID NO: 672533 - DNA, 25 bp, Artificial sequence
  Synthetic oligonucleotide
ggtcgaggccggccccgagcgcatc

SEQ ID NO: 672534 - DNA, 25 bp, Artificial sequence
  Synthetic oligonucleotide
cggcgtggtcgaggccggccccgag

SEQ ID NO: 672535 - DNA, 25 bp, Artificial sequence
  Synthetic oligonucleotide
tgaccccgtccggcgtggtcgaggc

SEQ ID NO: 672536 - DNA, 25 bp, Artificial sequence
  Synthetic oligonucleotide
cagaacgcggtgaccccgtccggcg

SEQ ID NO: 672537 - DNA, 25 bp, Artificial sequence
  Synthetic oligonucleotide
aggcgcagaacgcggtgaccccgtc

SEQ ID NO: 672538 - DNA, 25 bp, Artificial sequence
  Synthetic oligonucleotide
gcctgcaggcgcagaacgcggtgac

SEQ ID NO: 672539 - DNA, 25 bp, Artificial sequence
  Synthetic oligonucleotide
aggtcatctacctcaacttctctac

SEQ ID NO: 672540 - DNA, 25 bp, Artificial sequence
  Synthetic oligonucleotide
aggtcgtgcagagcctgcaggcgca

SEQ ID NO: 672541 - DNA, 25 bp, Artificial sequence
  Synthetic oligonucleotide
tctacctcaacttctctacccgcaa

SEQ ID NO: 672542 - DNA, 25 bp, Artificial sequence
  Synthetic oligonucleotide
tcgaccagcgccaggtcgtgcagag

SEQ ID NO: 672543 - DNA, 25 bp, Artificial sequence
  Synthetic oligonucleotide
tcggtctcgaccagcgccaggtcgt

SEQ ID NO: 672544 - DNA, 25 bp, Artificial sequence
  Synthetic oligonucleotide
ccgccctcggtctcgaccagcgcca

SEQ ID NO: 672545 - DNA, 25 bp, Artificial sequence
  Synthetic oligonucleotide
agctggccgccctcggtctcgacca

SEQ ID NO: 672546 - DNA, 25 bp, Artificial sequence
  Synthetic oligonucleotide
cccgcaagctggccgccctcggtct

SEQ ID NO: 672547 - DNA, 25 bp, Artificial sequence
  Synthetic oligonucleotide
tctctacccgcaagctggccgccct

SEQ ID NO: 672548 - DNA, 25 bp, Artificial sequence
  Synthetic oligonucleotide
ccccgagcgcatctcggtgcgcacc

SEQ ID NO: 672549 - DNA, 25 bp, Artificial sequence
  Synthetic oligonucleotide
tgcagagcctgcaggcgcagaacgc

SEQ ID NO: 672550 - DNA, 25 bp, Artificial sequence
  Synthetic oligonucleotide
ctgctcacgctgatcttcctgccgg

SEQ ID NO: 672551 - DNA, 25 bp, Artificial sequence
  Synthetic oligonucleotide
gccagtataggcagcccggcgtcag

SEQ ID NO: 672552 - DNA, 25 bp, Artificial sequence
  Synthetic oligonucleotide
ccgggacgctgagcgcggcgtaagg

SEQ ID NO: 672553 - DNA, 25 bp, Artificial sequence
  Synthetic oligonucleotide
ccggaaccgggacgctgagcgcggc

SEQ ID NO: 672554 - DNA, 25 bp, Artificial sequence
  Synthetic oligonucleotide
cggattccggaaccgggacgctgag

SEQ ID NO: 672555 - DNA, 25 bp, Artificial sequence
  Synthetic oligonucleotide
gcgctgtacgtcgcctggtaccgga

SEQ ID NO: 672556 - DNA, 25 bp, Artificial sequence
  Synthetic oligonucleotide
ctgccggcgctgtacgtcgcctggt

SEQ ID NO: 672557 - DNA, 25 bp, Artificial sequence
  Synthetic oligonucleotide
gggaagggggcgccgccgtagcaga

SEQ ID NO: 672558 - DNA, 25 bp, Artificial sequence
  Synthetic oligonucleotide
acgctgatcttcctgccggcgctgt

SEQ ID NO: 672559 - DNA, 25 bp, Artificial sequence
  Synthetic oligonucleotide
gggcgccgccgtagcagagtctgtg

SEQ ID NO: 672560 - DNA, 25 bp, Artificial sequence
  Synthetic oligonucleotide
gccacgctgctcacgctgatcttcc

SEQ ID NO: 672561 - DNA, 25 bp, Artificial sequence
  Synthetic oligonucleotide
gtcgccgccacgctgctcacgctga

SEQ ID NO: 672562 - DNA, 25 bp, Artificial sequence
  Synthetic oligonucleotide
ggcatcgtcgccgccacgctgctca

SEQ ID NO: 672563 - DNA, 25 bp, Artificial sequence
  Synthetic oligonucleotide
atcggcggcatcgtcgccgccacgc

SEQ ID NO: 672564 - DNA, 25 bp, Artificial sequence
  Synthetic oligonucleotide
gcgatgatcggcggcatcgtcgccg

SEQ ID NO: 672565 - DNA, 25 bp, Artificial sequence
  Synthetic oligonucleotide
gcctatgcgatgatcggcggcatcg

SEQ ID NO: 672566 - DNA, 25 bp, Artificial sequence
  Synthetic oligonucleotide
ccgatggcctatgcgatgatcggcg

SEQ ID NO: 672567 - DNA, 25 bp, Artificial sequence
  Synthetic oligonucleotide
atcttcctgccggcgctgtacgtcg

SEQ ID NO: 672568 - DNA, 25 bp, Artificial sequence
  Synthetic oligonucleotide
gggccatccgccccgacgccgggca

SEQ ID NO: 672569 - DNA, 25 bp, Artificial sequence
  Synthetic oligonucleotide
cgttgctgccgaccggcacgccgat

SEQ ID NO: 672570 - DNA, 25 bp, Artificial sequence
  Synthetic oligonucleotide
tacggcgacggcggccagtataggc

SEQ ID NO: 672571 - DNA, 25 bp, Artificial sequence
  Synthetic oligonucleotide
cgttgctacggcgacggcggccagt

SEQ ID NO: 672572 - DNA, 25 bp, Artificial sequence
  Synthetic oligonucleotide
tgcccggcgttgctacggcgacggc

SEQ ID NO: 672573 - DNA, 25 bp, Artificial sequence
  Synthetic oligonucleotide
agggtatgcccggcgttgctacggc

SEQ ID NO: 672574 - DNA, 25 bp, Artificial sequence
  Synthetic oligonucleotide
ccgggcagggtatgcccggcgttgc

SEQ ID NO: 672575 - DNA, 25 bp, Artificial sequence
  Synthetic oligonucleotide
gctgagcgcggcgtaaggggaaggg

SEQ ID NO: 672576 - DNA, 25 bp, Artificial sequence
  Synthetic oligonucleotide
ccgccccgacgccgggcagggtatg

SEQ ID NO: 672577 - DNA, 25 bp, Artificial sequence
  Synthetic oligonucleotide
cgcgaagtgttctgggggccgatgg

SEQ ID NO: 672578 - DNA, 25 bp, Artificial sequence
  Synthetic oligonucleotide
gcgggtgggccatccgccccgacgc

SEQ ID NO: 672579 - DNA, 25 bp, Artificial sequence
  Synthetic oligonucleotide
agcggacggcgggtgggccatccgc

SEQ ID NO: 672580 - DNA, 25 bp, Artificial sequence
  Synthetic oligonucleotide
gaaggagagcggacggcgggtgggc

SEQ ID NO: 672581 - DNA, 25 bp, Artificial sequence
  Synthetic oligonucleotide
tgcggggggaaggagagcggacggc

SEQ ID NO: 672582 - DNA, 25 bp, Artificial sequence
  Synthetic oligonucleotide
gagtctgtgcggggggaaggagagc

SEQ ID NO: 672583 - DNA, 25 bp, Artificial sequence
  Synthetic oligonucleotide
tagcagagtctgtgcggggggaagg

SEQ ID NO: 672584 - DNA, 25 bp, Artificial sequence
  Synthetic oligonucleotide
cgccgtagcagagtctgtgcggggg

SEQ ID NO: 672585 - DNA, 25 bp, Artificial sequence
  Synthetic oligonucleotide
ccgacgccgggcagggtatgcccgg

SEQ ID NO: 672586 - DNA, 25 bp, Artificial sequence
  Synthetic oligonucleotide
ttctcgcgctgatcggcatcatcat

SEQ ID NO: 672587 - DNA, 25 bp, Artificial sequence
  Synthetic oligonucleotide
ccagatcgatgccttcgagaaagac

SEQ ID NO: 672588 - DNA, 25 bp, Artificial sequence
  Synthetic oligonucleotide
tggtgacccagatcgatgccttcga

SEQ ID NO: 672589 - DNA, 25 bp, Artificial sequence
  Synthetic oligonucleotide
tgatcctggtgacccagatcgatgc

SEQ ID NO: 672590 - DNA, 25 bp, Artificial sequence
  Synthetic oligonucleotide
actcggtgatcctggtgacccagat

SEQ ID NO: 672591 - DNA, 25 bp, Artificial sequence
  Synthetic oligonucleotide
tccgcaactcggtgatcctggtgac

SEQ ID NO: 672592 - DNA, 25 bp, Artificial sequence
  Synthetic oligonucleotide
tcatcatccgcaactcggtgatcct

SEQ ID NO: 672593 - DNA, 25 bp, Artificial sequence
  Synthetic oligonucleotide
tgggggccgatggcctatgcgatga

SEQ ID NO: 672594 - DNA, 25 bp, Artificial sequence
  Synthetic oligonucleotide
cgctgatcggcatcatcatccgcaa

SEQ ID NO: 672595 - DNA, 25 bp, Artificial sequence
  Synthetic oligonucleotide
gaaagacggcaagacgccctgggaa

SEQ ID NO: 672596 - DNA, 25 bp, Artificial sequence
  Synthetic oligonucleotide
tcgggattctcgcgctgatcggcat

SEQ ID NO: 672597 - DNA, 25 bp, Artificial sequence
  Synthetic oligonucleotide
cgatcctcgggattctcgcgctgat

SEQ ID NO: 672598 - DNA, 25 bp, Artificial sequence
  Synthetic oligonucleotide
tcgtggcgatcctcgggattctcgc

SEQ ID NO: 672599 - DNA, 25 bp, Artificial sequence
  Synthetic oligonucleotide
gggcttcgtggcgatcctcgggatt

SEQ ID NO: 672600 - DNA, 25 bp, Artificial sequence
  Synthetic oligonucleotide
cgccgatgggcttcgtggcgatcct

SEQ ID NO: 672601 - DNA, 25 bp, Artificial sequence
  Synthetic oligonucleotide
ccggcacgccgatgggcttcgtggc

SEQ ID NO: 672602 - DNA, 25 bp, Artificial sequence
  Synthetic oligonucleotide
tgccgaccggcacgccgatgggctt

SEQ ID NO: 672603 - DNA, 25 bp, Artificial sequence
  Synthetic oligonucleotide
tcggcatcatcatccgcaactcggt

SEQ ID NO: 672604 - DNA, 25 bp, Artificial sequence
  Synthetic oligonucleotide
ccaccaccgcacccggccgatcctg

SEQ ID NO: 672605 - DNA, 25 bp, Artificial sequence
  Synthetic oligonucleotide
ataggcagcccggcgtcagggaaaa

SEQ ID NO: 672606 - DNA, 25 bp, Artificial sequence
  Synthetic oligonucleotide
atcgcccgcgaagtgttctgggggc

SEQ ID NO: 672607 - DNA, 25 bp, Artificial sequence
  Synthetic oligonucleotide
atccccatcgcccgcgaagtgttct

SEQ ID NO: 672608 - DNA, 25 bp, Artificial sequence
  Synthetic oligonucleotide
gggatgatccccatcgcccgcgaag

SEQ ID NO: 672609 - DNA, 25 bp, Artificial sequence
  Synthetic oligonucleotide
ggcggccagcctggggatgatcccc

SEQ ID NO: 672610 - DNA, 25 bp, Artificial sequence
  Synthetic oligonucleotide
tgctgacggcggcggcggccagcct

SEQ ID NO: 672611 - DNA, 25 bp, Artificial sequence
  Synthetic oligonucleotide
cgatcctgctgacggcggcggcggc

SEQ ID NO: 672612 - DNA, 25 bp, Artificial sequence
  Synthetic oligonucleotide
cgatgccttcgagaaagacggcaag

SEQ ID NO: 672613 - DNA, 25 bp, Artificial sequence
  Synthetic oligonucleotide
accgcacccggccgatcctgctgac

SEQ ID NO: 672614 - DNA, 25 bp, Artificial sequence
  Synthetic oligonucleotide
cttcgagaaagacggcaagacgccc

SEQ ID NO: 672615 - DNA, 25 bp, Artificial sequence
  Synthetic oligonucleotide
agccacccaccaccgcacccggccg

SEQ ID NO: 672616 - DNA, 25 bp, Artificial sequence
  Synthetic oligonucleotide
ctggaagccacccaccaccgcaccc

SEQ ID NO: 672617 - DNA, 25 bp, Artificial sequence
  Synthetic oligonucleotide
gccgtgctggaagccacccaccacc

SEQ ID NO: 672618 - DNA, 25 bp, Artificial sequence
  Synthetic oligonucleotide
ctgggaagccgtgctggaagccacc

SEQ ID NO: 672619 - DNA, 25 bp, Artificial sequence
  Synthetic oligonucleotide
gacgccctgggaagccgtgctggaa

SEQ ID NO: 672620 - DNA, 25 bp, Artificial sequence
  Synthetic oligonucleotide
cggcaagacgccctgggaagccgtg

SEQ ID NO: 672621 - DNA, 25 bp, Artificial sequence
  Synthetic oligonucleotide
gtgttctgggggccgatggcctatg

SEQ ID NO: 672622 - DNA, 25 bp, Artificial sequence
  Synthetic oligonucleotide
ccggccgatcctgctgacggcggcg

SEQ ID NO: 672623 - DNA, 25 bp, Artificial sequence
  Synthetic oligonucleotide
atccgcttctacctgccgctggacc

SEQ ID NO: 672624 - DNA, 25 bp, Artificial sequence
  Synthetic oligonucleotide
gacggcggccagtataggcagcccg

SEQ ID NO: 672625 - DNA, 25 bp, Artificial sequence
  Synthetic oligonucleotide
ccgccggcgcgcacatccgcccctg

SEQ ID NO: 672626 - DNA, 25 bp, Artificial sequence
  Synthetic oligonucleotide
ccgaagccgccggcgcgcacatccg

SEQ ID NO: 672627 - DNA, 25 bp, Artificial sequence
  Synthetic oligonucleotide
ccgaggccgaagccgccggcgcgca

SEQ ID NO: 672628 - DNA, 25 bp, Artificial sequence
  Synthetic oligonucleotide
aggtcgccgaggccgaagccgccgg

SEQ ID NO: 672629 - DNA, 25 bp, Artificial sequence
  Synthetic oligonucleotide
acatcgaggtcgccgaggccgaagc

SEQ ID NO: 672630 - DNA, 25 bp, Artificial sequence
  Synthetic oligonucleotide
cacatccgcccctgcggccgcttgc

SEQ ID NO: 672631 - DNA, 25 bp, Artificial sequence
  Synthetic oligonucleotide
ggatcctcgaggacatcgaggtcgc

SEQ ID NO: 672632 - DNA, 25 bp, Artificial sequence
  Synthetic oligonucleotide
gcccctgcggccgcttgcgcgtgca

SEQ ID NO: 672633 - DNA, 25 bp, Artificial sequence
  Synthetic oligonucleotide
aacggtgccgcgggatcctcgagga

SEQ ID NO: 672634 - DNA, 25 bp, Artificial sequence
  Synthetic oligonucleotide
acctggaacggtgccgcgggatcct

SEQ ID NO: 672635 - DNA, 25 bp, Artificial sequence
  Synthetic oligonucleotide
agcgttacctggaacggtgccgcgg

SEQ ID NO: 672636 - DNA, 25 bp, Artificial sequence
  Synthetic oligonucleotide
ccggcgagcgttacctggaacggtg

SEQ ID NO: 672637 - DNA, 25 bp, Artificial sequence
  Synthetic oligonucleotide
ccgaagccggcgagcgttacctgga

SEQ ID NO: 672638 - DNA, 25 bp, Artificial sequence
  Synthetic oligonucleotide
cctgaccgaagccggcgagcgttac

SEQ ID NO: 672639 - DNA, 25 bp, Artificial sequence
  Synthetic oligonucleotide
gcctggccctgaccgaagccggcga

SEQ ID NO: 672640 - DNA, 25 bp, Artificial sequence
  Synthetic oligonucleotide
agcctcggcctgcgcgccgggctgg

SEQ ID NO: 672641 - DNA, 25 bp, Artificial sequence
  Synthetic oligonucleotide
acctggtgccgatgatcgcccgcta

SEQ ID NO: 672642 - DNA, 25 bp, Artificial sequence
  Synthetic oligonucleotide
tgatcgagctgaccctgtcccagcg

SEQ ID NO: 672643 - DNA, 25 bp, Artificial sequence
  Synthetic oligonucleotide
acgtggtgatcgagctgaccctgtc

SEQ ID NO: 672644 - DNA, 25 bp, Artificial sequence
  Synthetic oligonucleotide
tccccgacgtggtgatcgagctgac

SEQ ID NO: 672645 - DNA, 25 bp, Artificial sequence
  Synthetic oligonucleotide
cactgttccccgacgtggtgatcga

SEQ ID NO: 672646 - DNA, 25 bp, Artificial sequence
  Synthetic oligonucleotide
acggcgcactgttccccgacgtggt

SEQ ID NO: 672647 - DNA, 25 bp, Artificial sequence
  Synthetic oligonucleotide
cccgctacggcgcactgttccccga

SEQ ID NO: 672648 - DNA, 25 bp, Artificial sequence
  Synthetic oligonucleotide
ggcgcgcacatccgcccctgcggcc

SEQ ID NO: 672649 - DNA, 25 bp, Artificial sequence
  Synthetic oligonucleotide
tgccgatgatcgcccgctacggcgc

SEQ ID NO: 672650 - DNA, 25 bp, Artificial sequence
  Synthetic oligonucleotide
tgcaccgcaccacccggcgcctggc

SEQ ID NO: 672651 - DNA, 25 bp, Artificial sequence
  Synthetic oligonucleotide
agcatcacctggtgccgatgatcgc

SEQ ID NO: 672652 - DNA, 25 bp, Artificial sequence
  Synthetic oligonucleotide
tgggccagcatcacctggtgccgat

SEQ ID NO: 672653 - DNA, 25 bp, Artificial sequence
  Synthetic oligonucleotide
tgggcatgggccagcatcacctggt

SEQ ID NO: 672654 - DNA, 25 bp, Artificial sequence
  Synthetic oligonucleotide
tcgctgatgggcatgggccagcatc

SEQ ID NO: 672655 - DNA, 25 bp, Artificial sequence
  Synthetic oligonucleotide
cgtgcagtcgctgatgggcatgggc

SEQ ID NO: 672656 - DNA, 25 bp, Artificial sequence
  Synthetic oligonucleotide
cttgcgcgtgcagtcgctgatgggc

SEQ ID NO: 672657 - DNA, 25 bp, Artificial sequence
  Synthetic oligonucleotide
cggccgcttgcgcgtgcagtcgctg

SEQ ID NO: 672658 - DNA, 25 bp, Artificial sequence
  Synthetic oligonucleotide
tgatcgcccgctacggcgcactgtt

SEQ ID NO: 672659 - DNA, 25 bp, Artificial sequence
  Synthetic oligonucleotide
gcaaccgaggtaatagtggacacat

SEQ ID NO: 672660 - DNA, 25 bp, Artificial sequence
  Synthetic oligonucleotide
ccagggtggtggacagcggcagctt

SEQ ID NO: 672661 - DNA, 25 bp, Artificial sequence
  Synthetic oligonucleotide
tgttcgccagggtggtggacagcgg

SEQ ID NO: 672662 - DNA, 25 bp, Artificial sequence
  Synthetic oligonucleotide
gcgcgtgttcgccagggtggtggac

SEQ ID NO: 672663 - DNA, 25 bp, Artificial sequence
  Synthetic oligonucleotide
aggcatgcgcgtgttcgccagggtg

SEQ ID NO: 672664 - DNA, 25 bp, Artificial sequence
  Synthetic oligonucleotide
attgcaaggcatgcgcgtgttcgcc

SEQ ID NO: 672665 - DNA, 25 bp, Artificial sequence
  Synthetic oligonucleotide
gacacattgcaaggcatgcgcgtgt

SEQ ID NO: 672666 - DNA, 25 bp, Artificial sequence
  Synthetic oligonucleotide
cccggcgcctggccctgaccgaagc

SEQ ID NO: 672667 - DNA, 25 bp, Artificial sequence
  Synthetic oligonucleotide
gaggtaatagtggacacattgcaag

SEQ ID NO: 672668 - DNA, 25 bp, Artificial sequence
  Synthetic oligonucleotide
gcagcttcacttccgccgcccaggc

SEQ ID NO: 672669 - DNA, 25 bp, Artificial sequence
  Synthetic oligonucleotide
gttttgcaaccgaggtaatagtgga

SEQ ID NO: 672670 - DNA, 25 bp, Artificial sequence
  Synthetic oligonucleotide
gaatctgttttgcaaccgaggtaat

SEQ ID NO: 672671 - DNA, 25 bp, Artificial sequence
  Synthetic oligonucleotide
atttacgaatctgttttgcaaccga

SEQ ID NO: 672672 - DNA, 25 bp, Artificial sequence
  Synthetic oligonucleotide
cgaccaatttacgaatctgttttgc

SEQ ID NO: 672673 - DNA, 25 bp, Artificial sequence
  Synthetic oligonucleotide
aaaatccgaccaatttacgaatctg

SEQ ID NO: 672674 - DNA, 25 bp, Artificial sequence
  Synthetic oligonucleotide
cggcgtcagggaaaatccgaccaat

SEQ ID NO: 672675 - DNA, 25 bp, Artificial sequence
  Synthetic oligonucleotide
cagcccggcgtcagggaaaatccga

SEQ ID NO: 672676 - DNA, 25 bp, Artificial sequence
  Synthetic oligonucleotide
atagtggacacattgcaaggcatgc

SEQ ID NO: 672677 - DNA, 25 bp, Artificial sequence
  Synthetic oligonucleotide
cgcaggtatcgcggctgatctccga

SEQ ID NO: 672678 - DNA, 25 bp, Artificial sequence
  Synthetic oligonucleotide
gccgcgggatcctcgaggacatcga

SEQ ID NO: 672679 - DNA, 25 bp, Artificial sequence
  Synthetic oligonucleotide
gcctgctgcaccgcaccacccggcg

SEQ ID NO: 672680 - DNA, 25 bp, Artificial sequence
  Synthetic oligonucleotide
agacgcgcctgctgcaccgcaccac

SEQ ID NO: 672681 - DNA, 25 bp, Artificial sequence
  Synthetic oligonucleotide
acctgcagacgcgcctgctgcaccg

SEQ ID NO: 672682 - DNA, 25 bp, Artificial sequence
  Synthetic oligonucleotide
aggcgcacctgcagacgcgcctgct

SEQ ID NO: 672683 - DNA, 25 bp, Artificial sequence
  Synthetic oligonucleotide
acctggaggcgcacctgcagacgcg

SEQ ID NO: 672684 - DNA, 25 bp, Artificial sequence
  Synthetic oligonucleotide
tctccgacctggaggcgcacctgca

SEQ ID NO: 672685 - DNA, 25 bp, Artificial sequence
  Synthetic oligonucleotide
tggtggacagcggcagcttcacttc

SEQ ID NO: 672686 - DNA, 25 bp, Artificial sequence
  Synthetic oligonucleotide
tatcgcggctgatctccgacctgga

SEQ ID NO: 672687 - DNA, 25 bp, Artificial sequence
  Synthetic oligonucleotide
acagcggcagcttcacttccgccgc

SEQ ID NO: 672688 - DNA, 25 bp, Artificial sequence
  Synthetic oligonucleotide
ccaccgcgcaggtatcgcggctgat

SEQ ID NO: 672689 - DNA, 25 bp, Artificial sequence
  Synthetic oligonucleotide
acctgtccaccgcgcaggtatcgcg

SEQ ID NO: 672690 - DNA, 25 bp, Artificial sequence
  Synthetic oligonucleotide
ccctggacctgtccaccgcgcaggt

SEQ ID NO: 672691 - DNA, 25 bp, Artificial sequence
  Synthetic oligonucleotide
cccaggccctggacctgtccaccgc

SEQ ID NO: 672692 - DNA, 25 bp, Artificial sequence
  Synthetic oligonucleotide
ccgccgcccaggccctggacctgtc

SEQ ID NO: 672693 - DNA, 25 bp, Artificial sequence
  Synthetic oligonucleotide
tcacttccgccgcccaggccctgga

SEQ ID NO: 672694 - DNA, 25 bp, Artificial sequence
  Synthetic oligonucleotide
gcaccacccggcgcctggccctgac

SEQ ID NO: 672695 - DNA, 25 bp, Artificial sequence
  Synthetic oligonucleotide
ggctgatctccgacctggaggcgca

SEQ ID NO: 672696 - DNA, 25 bp, Artificial sequence
  Synthetic oligonucleotide
acatcggcgatatcgtctacgactg

SEQ ID NO: 672697 - DNA, 25 bp, Artificial sequence
  Synthetic oligonucleotide
acctggtgaacgtcatcggccgcgc

SEQ ID NO: 672698 - DNA, 25 bp, Artificial sequence
  Synthetic oligonucleotide
gctcaagatcgacatcgcccaggac

SEQ ID NO: 672699 - DNA, 25 bp, Artificial sequence
  Synthetic oligonucleotide
gaagatgctcaagatcgacatcgcc

SEQ ID NO: 672700 - DNA, 25 bp, Artificial sequence
  Synthetic oligonucleotide
gcccgggaagatgctcaagatcgac

SEQ ID NO: 672701 - DNA, 25 bp, Artificial sequence
  Synthetic oligonucleotide
gaacgagcccgggaagatgctcaag

SEQ ID NO: 672702 - DNA, 25 bp, Artificial sequence
  Synthetic oligonucleotide
acgactggaacgagcccgggaagat

SEQ ID NO: 672703 - DNA, 25 bp, Artificial sequence
  Synthetic oligonucleotide
catcgcccaggacaaggcgcgccag

SEQ ID NO: 672704 - DNA, 25 bp, Artificial sequence
  Synthetic oligonucleotide
gcgatatcgtctacgactggaacga

SEQ ID NO: 672705 - DNA, 25 bp, Artificial sequence
  Synthetic oligonucleotide
caggacaaggcgcgccagctcgggc

SEQ ID NO: 672706 - DNA, 25 bp, Artificial sequence
  Synthetic oligonucleotide
acccgaacatcggcgatatcgtcta

SEQ ID NO: 672707 - DNA, 25 bp, Artificial sequence
  Synthetic oligonucleotide
acggcaacccgaacatcggcgatat

SEQ ID NO: 672708 - DNA, 25 bp, Artificial sequence
  Synthetic oligonucleotide
tgctcgacggcaacccgaacatcgg

SEQ ID NO: 672709 - DNA, 25 bp, Artificial sequence
  Synthetic oligonucleotide
ccggcgtgctcgacggcaacccgaa

SEQ ID NO: 672710 - DNA, 25 bp, Artificial sequence
  Synthetic oligonucleotide
gcctggccggcgtgctcgacggcaa

SEQ ID NO: 672711 - DNA, 25 bp, Artificial sequence
  Synthetic oligonucleotide
ccatgggcctggccggcgtgctcga

SEQ ID NO: 672712 - DNA, 25 bp, Artificial sequence
  Synthetic oligonucleotide
gagtacgccatgggcctggccggcg

SEQ ID NO: 672713 - DNA, 25 bp, Artificial sequence
  Synthetic oligonucleotide
tcgtctacgactggaacgagcccgg

SEQ ID NO: 672714 - DNA, 25 bp, Artificial sequence
  Synthetic oligonucleotide
catgaacagcgtggtgaccggcagc

SEQ ID NO: 672715 - DNA, 25 bp, Artificial sequence
  Synthetic oligonucleotide
acatctacctggtgaacgtcatcgg

SEQ ID NO: 672716 - DNA, 25 bp, Artificial sequence
  Synthetic oligonucleotide
gcgacgacatctacctggtgaacgt

SEQ ID NO: 672717 - DNA, 25 bp, Artificial sequence
  Synthetic oligonucleotide
aggtgcgcgacgacatctacctggt

SEQ ID NO: 672718 - DNA, 25 bp, Artificial sequence
  Synthetic oligonucleotide
tgacccaggtgcgcgacgacatcta

SEQ ID NO: 672719 - DNA, 25 bp, Artificial sequence
  Synthetic oligonucleotide
gcgcggtgacccaggtgcgcgacga

SEQ ID NO: 672720 - DNA, 25 bp, Artificial sequence
  Synthetic oligonucleotide
ccggcagcgcggtgacccaggtgcg

SEQ ID NO: 672721 - DNA, 25 bp, Artificial sequence
  Synthetic oligonucleotide
gatcgacatcgcccaggacaaggcg

SEQ ID NO: 672722 - DNA, 25 bp, Artificial sequence
  Synthetic oligonucleotide
acagcgtggtgaccggcagcgcggt

SEQ ID NO: 672723 - DNA, 25 bp, Artificial sequence
  Synthetic oligonucleotide
gcagatcgacaaggtccgcgagtac

SEQ ID NO: 672724 - DNA, 25 bp, Artificial sequence
  Synthetic oligonucleotide
gcagatcatgaacagcgtggtgacc

SEQ ID NO: 672725 - DNA, 25 bp, Artificial sequence
  Synthetic oligonucleotide
cgtggcgcagatcatgaacagcgtg

SEQ ID NO: 672726 - DNA, 25 bp, Artificial sequence
  Synthetic oligonucleotide
cgaggacgtggcgcagatcatgaac

SEQ ID NO: 672727 - DNA, 25 bp, Artificial sequence
  Synthetic oligonucleotide
tttcctccgaggacgtggcgcagat

SEQ ID NO: 672728 - DNA, 25 bp, Artificial sequence
  Synthetic oligonucleotide
tcgggctttcctccgaggacgtggc

SEQ ID NO: 672729 - DNA, 25 bp, Artificial sequence
  Synthetic oligonucleotide
gccagctcgggctttcctccgagga

SEQ ID NO: 672730 - DNA, 25 bp, Artificial sequence
  Synthetic oligonucleotide
aaggcgcgccagctcgggctttcct

SEQ ID NO: 672731 - DNA, 25 bp, Artificial sequence
  Synthetic oligonucleotide
tggtgaccggcagcgcggtgaccca

SEQ ID NO: 672732 - DNA, 25 bp, Artificial sequence
  Synthetic oligonucleotide
aacaacttctatggccagctggtga

SEQ ID NO: 672733 - DNA, 25 bp, Artificial sequence
  Synthetic oligonucleotide
gccgcacgcctgcgcgatcgcttgc

SEQ ID NO: 672734 - DNA, 25 bp, Artificial sequence
  Synthetic oligonucleotide
gcgcgtcgccgcacgcctgcgcgat

SEQ ID NO: 672735 - DNA, 25 bp, Artificial sequence
  Synthetic oligonucleotide
tggaggcccgcgagcgcgtcgccgc

SEQ ID NO: 672736 - DNA, 25 bp, Artificial sequence
  Synthetic oligonucleotide
tcaccaaggacctggaggcccgcga

SEQ ID NO: 672737 - DNA, 25 bp, Artificial sequence
  Synthetic oligonucleotide
gatcgtcaccaaggacctggaggcc

SEQ ID NO: 672738 - DNA, 25 bp, Artificial sequence
  Synthetic oligonucleotide
ctggtgatcgtcaccaaggacctgg

SEQ ID NO: 672739 - DNA, 25 bp, Artificial sequence
  Synthetic oligonucleotide
gtccgcgagtacgccatgggcctgg

SEQ ID NO: 672740 - DNA, 25 bp, Artificial sequence
  Synthetic oligonucleotide
ttctatggccagctggtgatcgtca

SEQ ID NO: 672741 - DNA, 25 bp, Artificial sequence
  Synthetic oligonucleotide
tcgcttgcgcaaggactacgtcggc

SEQ ID NO: 672742 - DNA, 25 bp, Artificial sequence
  Synthetic oligonucleotide
ttgcagaacaacttctatggccagc

SEQ ID NO: 672743 - DNA, 25 bp, Artificial sequence
  Synthetic oligonucleotide
cagcagttgcagaacaacttctatg

SEQ ID NO: 672744 - DNA, 25 bp, Artificial sequence
  Synthetic oligonucleotide
ctggaccagcagttgcagaacaact

SEQ ID NO: 672745 - DNA, 25 bp, Artificial sequence
  Synthetic oligonucleotide
ctgccgctggaccagcagttgcaga

SEQ ID NO: 672746 - DNA, 25 bp, Artificial sequence
  Synthetic oligonucleotide
ttctacctgccgctggaccagcagt

SEQ ID NO: 672747 - DNA, 25 bp, Artificial sequence
  Synthetic oligonucleotide
tcgcggcgttgctgccgaccggcac

SEQ ID NO: 672748 - DNA, 25 bp, Artificial sequence
  Synthetic oligonucleotide
tcgaggacatcgaggtcgccgaggc

SEQ ID NO: 672749 - DNA, 25 bp, Artificial sequence
  Synthetic oligonucleotide
ggccagctggtgatcgtcaccaagg

SEQ ID NO: 672750 - DNA, 25 bp, Artificial sequence
  Synthetic oligonucleotide
agccgctggagatggggccgccggt

SEQ ID NO: 672751 - DNA, 25 bp, Artificial sequence
  Synthetic oligonucleotide
cccgcgagcgcgtcgccgcacgcct

SEQ ID NO: 672752 - DNA, 25 bp, Artificial sequence
  Synthetic oligonucleotide
cggaccgcagatcgacaaggtccgc

SEQ ID NO: 672753 - DNA, 25 bp, Artificial sequence
  Synthetic oligonucleotide
ggtcagcggaccgcagatcgacaag

SEQ ID NO: 672754 - DNA, 25 bp, Artificial sequence
  Synthetic oligonucleotide
agtaccgggtcagcggaccgcagat

SEQ ID NO: 672755 - DNA, 25 bp, Artificial sequence
  Synthetic oligonucleotide
gatccagtaccgggtcagcggaccg

SEQ ID NO: 672756 - DNA, 25 bp, Artificial sequence
  Synthetic oligonucleotide
gacggccgatccagtaccgggtcag

SEQ ID NO: 672757 - DNA, 25 bp, Artificial sequence
  Synthetic oligonucleotide
cggtgggacggccgatccagtaccg

SEQ ID NO: 672758 - DNA, 25 bp, Artificial sequence
  Synthetic oligonucleotide
acgcctgcgcgatcgcttgcgcaag

SEQ ID NO: 672759 - DNA, 25 bp, Artificial sequence
  Synthetic oligonucleotide
tggagatggggccgccggtgggacg

SEQ ID NO: 672760 - DNA, 25 bp, Artificial sequence
  Synthetic oligonucleotide
gcgcgatcgcttgcgcaaggactac

SEQ ID NO: 672761 - DNA, 25 bp, Artificial sequence
  Synthetic oligonucleotide
acgtgcagccgctggagatggggcc

SEQ ID NO: 672762 - DNA, 25 bp, Artificial sequence
  Synthetic oligonucleotide
gcacctacgtgcagccgctggagat

SEQ ID NO: 672763 - DNA, 25 bp, Artificial sequence
  Synthetic oligonucleotide
gcatcagcacctacgtgcagccgct

SEQ ID NO: 672764 - DNA, 25 bp, Artificial sequence
  Synthetic oligonucleotide
cgtcggcatcagcacctacgtgcag

SEQ ID NO: 672765 - DNA, 25 bp, Artificial sequence
  Synthetic oligonucleotide
ggactacgtcggcatcagcacctac

SEQ ID NO: 672766 - DNA, 25 bp, Artificial sequence
  Synthetic oligonucleotide
gcgcaaggactacgtcggcatcagc

SEQ ID NO: 672767 - DNA, 25 bp, Artificial sequence
  Synthetic oligonucleotide
gacaaggtccgcgagtacgccatgg

SEQ ID NO: 672768 - DNA, 25 bp, Artificial sequence
  Synthetic oligonucleotide
ggccgccggtgggacggccgatcca

SEQ ID NO: 672769 - DNA, 25 bp, Artificial sequence
  Synthetic oligonucleotide
atcgaagtgggcggcacggtggagg

SEQ ID NO: 672770 - DNA, 25 bp, Artificial sequence
  Synthetic oligonucleotide
tcgccaaggtggtgccgctgatgct

SEQ ID NO: 672771 - DNA, 25 bp, Artificial sequence
  Synthetic oligonucleotide
gcccgatcgccaaggtggtgccgct

SEQ ID NO: 672772 - DNA, 25 bp, Artificial sequence
  Synthetic oligonucleotide
ccgagggcccgatcgccaaggtggt

SEQ ID NO: 672773 - DNA, 25 bp, Artificial sequence
  Synthetic oligonucleotide
gcaaggccgagggcccgatcgccaa

SEQ ID NO: 672774 - DNA, 25 bp, Artificial sequence
  Synthetic oligonucleotide
gagagcggcaaggccgagggcccga

SEQ ID NO: 672775 - DNA, 25 bp, Artificial sequence
  Synthetic oligonucleotide
gtggaggagagcggcaaggccgagg

SEQ ID NO: 672776 - DNA, 25 bp, Artificial sequence
  Synthetic oligonucleotide
gcgccggaggtcaagcgcttcgccg

SEQ ID NO: 672777 - DNA, 25 bp, Artificial sequence
  Synthetic oligonucleotide
gtgggcggcacggtggaggagagcg

SEQ ID NO: 672778 - DNA, 25 bp, Artificial sequence
  Synthetic oligonucleotide
tgatgctgttcctcatggcgacctt

SEQ ID NO: 672779 - DNA, 25 bp, Artificial sequence
  Synthetic oligonucleotide
taccggatcgaagtgggcggcacgg

SEQ ID NO: 672780 - DNA, 25 bp, Artificial sequence
  Synthetic oligonucleotide
gcgaactaccggatcgaagtgggcg

SEQ ID NO: 672781 - DNA, 25 bp, Artificial sequence
  Synthetic oligonucleotide
ctgccggcgaactaccggatcgaag

SEQ ID NO: 672782 - DNA, 25 bp, Artificial sequence
  Synthetic oligonucleotide
gacggcctgccggcgaactaccgga

SEQ ID NO: 672783 - DNA, 25 bp, Artificial sequence
  Synthetic oligonucleotide
ttcgccgacggcctgccggcgaact

SEQ ID NO: 672784 - DNA, 25 bp, Artificial sequence
  Synthetic oligonucleotide
aagcgcttcgccgacggcctgccgg

SEQ ID NO: 672785 - DNA, 25 bp, Artificial sequence
  Synthetic oligonucleotide
gaggtcaagcgcttcgccgacggcc

SEQ ID NO: 672786 - DNA, 25 bp, Artificial sequence
  Synthetic oligonucleotide
ggcacggtggaggagagcggcaagg

SEQ ID NO: 672787 - DNA, 25 bp, Artificial sequence
  Synthetic oligonucleotide
gcagaagctattcctggtggccagc

SEQ ID NO: 672788 - DNA, 25 bp, Artificial sequence
  Synthetic oligonucleotide
ggtggtcgcggcgttgctgccgacc

SEQ ID NO: 672789 - DNA, 25 bp, Artificial sequence
  Synthetic oligonucleotide
tgatcggggtggtcgcggcgttgct

SEQ ID NO: 672790 - DNA, 25 bp, Artificial sequence
  Synthetic oligonucleotide
aggacctggaggcccgcgagcgcgt

SEQ ID NO: 672791 - DNA, 25 bp, Artificial sequence
  Synthetic oligonucleotide
tgaacgtcatcggccgcgccgagga

SEQ ID NO: 672792 - DNA, 25 bp, Artificial sequence
  Synthetic oligonucleotide
tggggctgatcggggtggtcgcggc

SEQ ID NO: 672793 - DNA, 25 bp, Artificial sequence
  Synthetic oligonucleotide
cgccgctggggctgatcggggtggt

SEQ ID NO: 672794 - DNA, 25 bp, Artificial sequence
  Synthetic oligonucleotide
gcgtcgcgccgctggggctgatcgg

SEQ ID NO: 672795 - DNA, 25 bp, Artificial sequence
  Synthetic oligonucleotide
aggtggtgccgctgatgctgttcct

SEQ ID NO: 672796 - DNA, 25 bp, Artificial sequence
  Synthetic oligonucleotide
tcctggtggccagcgtcgcgccgct

SEQ ID NO: 672797 - DNA, 25 bp, Artificial sequence
  Synthetic oligonucleotide
tgccgctgatgctgttcctcatggc

SEQ ID NO: 672798 - DNA, 25 bp, Artificial sequence
  Synthetic oligonucleotide
gttgcagagcgtgcagaagctattc

SEQ ID NO: 672799 - DNA, 25 bp, Artificial sequence
  Synthetic oligonucleotide
gatccagttgcagagcgtgcagaag

SEQ ID NO: 672800 - DNA, 25 bp, Artificial sequence
  Synthetic oligonucleotide
cctgatgatccagttgcagagcgtg

SEQ ID NO: 672801 - DNA, 25 bp, Artificial sequence
  Synthetic oligonucleotide
gaccttcctgatgatccagttgcag

SEQ ID NO: 672802 - DNA, 25 bp, Artificial sequence
  Synthetic oligonucleotide
catggcgaccttcctgatgatccag

SEQ ID NO: 672803 - DNA, 25 bp, Artificial sequence
  Synthetic oligonucleotide
gttcctcatggcgaccttcctgatg

SEQ ID NO: 672804 - DNA, 25 bp, Artificial sequence
  Synthetic oligonucleotide
gagcgtgcagaagctattcctggtg

SEQ ID NO: 672805 - DNA, 25 bp, Artificial sequence
  Synthetic oligonucleotide
tggccagcgtcgcgccgctggggct

SEQ ID NO: 672806 - DNA, 25 bp, Artificial sequence
  Synthetic oligonucleotide
gctcgctggagaccctggagagcct

SEQ ID NO: 672807 - DNA, 25 bp, Artificial sequence
  Synthetic oligonucleotide
aaggcgttcgccaaggtcagctacg

SEQ ID NO: 672808 - DNA, 25 bp, Artificial sequence
  Synthetic oligonucleotide
ccgctcaaggcgttcgccaaggtca

SEQ ID NO: 672809 - DNA, 25 bp, Artificial sequence
  Synthetic oligonucleotide
ctcgatcccgctcaaggcgttcgcc

SEQ ID NO: 672810 - DNA, 25 bp, Artificial sequence
  Synthetic oligonucleotide
cggcacctcgatcccgctcaaggcg

SEQ ID NO: 672811 - DNA, 25 bp, Artificial sequence
  Synthetic oligonucleotide
gcccagcggcacctcgatcccgctc

SEQ ID NO: 672812 - DNA, 25 bp, Artificial sequence
  Synthetic oligonucleotide
tcgtcacgcccagcggcacctcgat

SEQ ID NO: 672813 - DNA, 25 bp, Artificial sequence
  Synthetic oligonucleotide
ttcgccaaggtcagctacgagctgg

SEQ ID NO: 672814 - DNA, 25 bp, Artificial sequence
  Synthetic oligonucleotide
ccctggagagcctgcagatcgtcac

SEQ ID NO: 672815 - DNA, 25 bp, Artificial sequence
  Synthetic oligonucleotide
agagcctgcagatcgtcacgcccag

SEQ ID NO: 672816 - DNA, 25 bp, Artificial sequence
  Synthetic oligonucleotide
gcgcggctcgctggagaccctggag

SEQ ID NO: 672817 - DNA, 25 bp, Artificial sequence
  Synthetic oligonucleotide
tcatcggccgcgccgaggatagcga

SEQ ID NO: 672818 - DNA, 25 bp, Artificial sequence
  Synthetic oligonucleotide
gccgcgccgaggatagcgagcgcgg

SEQ ID NO: 672819 - DNA, 25 bp, Artificial sequence
  Synthetic oligonucleotide
cggctggcgccggaggtcaagcgct

SEQ ID NO: 672820 - DNA, 25 bp, Artificial sequence
  Synthetic oligonucleotide
gctattcctggtggccagcgtcgcg

SEQ ID NO: 672821 - DNA, 25 bp, Artificial sequence
  Synthetic oligonucleotide
tagcgagcgcggctcgctggagacc

SEQ ID NO: 672822 - DNA, 25 bp, Artificial sequence
  Synthetic oligonucleotide
ccgaggatagcgagcgcggctcgct

SEQ ID NO: 672823 - DNA, 25 bp, Artificial sequence
  Synthetic oligonucleotide
tgcagatcgtcacgcccagcggcac

SEQ ID NO: 672824 - DNA, 25 bp, Artificial sequence
  Synthetic oligonucleotide
acgatcacggtgaaggcgtcgctgc

SEQ ID NO: 672825 - DNA, 25 bp, Artificial sequence
  Synthetic oligonucleotide
agatccagcccaccgacctggtcgc

SEQ ID NO: 672826 - DNA, 25 bp, Artificial sequence
  Synthetic oligonucleotide
gcggcgagatccagcccaccgacct

SEQ ID NO: 672827 - DNA, 25 bp, Artificial sequence
  Synthetic oligonucleotide
tggagaccctggagagcctgcagat

SEQ ID NO: 672828 - DNA, 25 bp, Artificial sequence
  Synthetic oligonucleotide
aaggtcagctacgagctggagcagc

SEQ ID NO: 672829 - DNA, 25 bp, Artificial sequence
  Synthetic oligonucleotide
gaaggcgtcgctgcgcggcgagatc

SEQ ID NO: 672830 - DNA, 25 bp, Artificial sequence
  Synthetic oligonucleotide
agcccaccgacctggtcgcccggct

SEQ ID NO: 672831 - DNA, 25 bp, Artificial sequence
  Synthetic oligonucleotide
ccgacctggtcgcccggctggcgcc

SEQ ID NO: 672832 - DNA, 25 bp, Artificial sequence
  Synthetic oligonucleotide
tcgctgcgcggcgagatccagccca

SEQ ID NO: 672833 - DNA, 25 bp, Artificial sequence
  Synthetic oligonucleotide
ggtcgcccggctggcgccggaggtc

SEQ ID NO: 672834 - DNA, 25 bp, Artificial sequence
  Synthetic oligonucleotide
aagccgacgatcacggtgaaggcgt

SEQ ID NO: 672835 - DNA, 25 bp, Artificial sequence
  Synthetic oligonucleotide
accgcaagccgacgatcacggtgaa

SEQ ID NO: 672836 - DNA, 25 bp, Artificial sequence
  Synthetic oligonucleotide
agctacgagctggagcagccgctgg

SEQ ID NO: 672837 - DNA, 25 bp, Artificial sequence
  Synthetic oligonucleotide
gccgcgaccgcaagccgacgatcac

SEQ ID NO: 672838 - DNA, 25 bp, Artificial sequence
  Synthetic oligonucleotide
tgtggcgccgcgaccgcaagccgac

SEQ ID NO: 672839 - DNA, 25 bp, Artificial sequence
  Synthetic oligonucleotide
cgctggtgtggcgccgcgaccgcaa

SEQ ID NO: 672840 - DNA, 25 bp, Artificial sequence
  Synthetic oligonucleotide
gagctggagcagccgctggtgtggc

SEQ ID NO: 672841 - DNA, 25 bp, Artificial sequence
  Synthetic oligonucleotide
gagcagccgctggtgtggcgccgcg

SEQ ID NO: 672842 - DNA, 25 bp, Artificial sequence
  Synthetic oligonucleotide
acggtgaaggcgtcgctgcgcggcg

SEQ ID NO: 672843 - DNA, 25 bp, Artificial sequence
  Synthetic oligonucleotide
cggcgctgctcaagcaactggaggt

SEQ ID NO: 672844 - DNA, 25 bp, Artificial sequence
  Synthetic oligonucleotide
aacggcatcggttacaacgtggcca

SEQ ID NO: 672845 - DNA, 25 bp, Artificial sequence
  Synthetic oligonucleotide
ggcaccaacggcatcggttacaacg

SEQ ID NO: 672846 - DNA, 25 bp, Artificial sequence
  Synthetic oligonucleotide
ctgtggggcaccaacggcatcggtt

SEQ ID NO: 672847 - DNA, 25 bp, Artificial sequence
  Synthetic oligonucleotide
tccctacctgtggggcaccaacggc

SEQ ID NO: 672848 - DNA, 25 bp, Artificial sequence
  Synthetic oligonucleotide
tacgcggttccctacctgtggggca

SEQ ID NO: 672849 - DNA, 25 bp, Artificial sequence
  Synthetic oligonucleotide
caaccagtacgcggttccctacctg

SEQ ID NO: 672850 - DNA, 25 bp, Artificial sequence
  Synthetic oligonucleotide
tcagcgacccgggcaaccagtacgc

SEQ ID NO: 672851 - DNA, 25 bp, Artificial sequence
  Synthetic oligonucleotide
tggaggtcagcgacccgggcaacca

SEQ ID NO: 672852 - DNA, 25 bp, Artificial sequence
  Synthetic oligonucleotide
gacgagatgctgcccgccgccctca

SEQ ID NO: 672853 - DNA, 25 bp, Artificial sequence
  Synthetic oligonucleotide
tgctcaagcaactggaggtcagcga

SEQ ID NO: 672854 - DNA, 25 bp, Artificial sequence
  Synthetic oligonucleotide
gtggccaaggtcaaggaagtcctcg

SEQ ID NO: 672855 - DNA, 25 bp, Artificial sequence
  Synthetic oligonucleotide
tcgatccggcgctgctcaagcaact

SEQ ID NO: 672856 - DNA, 25 bp, Artificial sequence
  Synthetic oligonucleotide
aagaacctcgatccggcgctgctca

SEQ ID NO: 672857 - DNA, 25 bp, Artificial sequence
  Synthetic oligonucleotide
actggaagaacctcgatccggcgct

SEQ ID NO: 672858 - DNA, 25 bp, Artificial sequence
  Synthetic oligonucleotide
tgccgaactggaagaacctcgatcc

SEQ ID NO: 672859 - DNA, 25 bp, Artificial sequence
  Synthetic oligonucleotide
gaggccgttttcagggcattttcgc

SEQ ID NO: 672860 - DNA, 25 bp, Artificial sequence
  Synthetic oligonucleotide
acaagagcaagctgccgaactggaa

SEQ ID NO: 672861 - DNA, 25 bp, Artificial sequence
  Synthetic oligonucleotide
tccagaagctggacaagagcaagct

SEQ ID NO: 672862 - DNA, 25 bp, Artificial sequence
  Synthetic oligonucleotide
gtgccttccagaagctggacaagag

SEQ ID NO: 672863 - DNA, 25 bp, Artificial sequence
  Synthetic oligonucleotide
aagcaactggaggtcagcgacccgg

SEQ ID NO: 672864 - DNA, 25 bp, Artificial sequence
  Synthetic oligonucleotide
tcctcttcgagccggagaacatgaa

SEQ ID NO: 672865 - DNA, 25 bp, Artificial sequence
  Synthetic oligonucleotide
attccattggcaagacactgctggt

SEQ ID NO: 672866 - DNA, 25 bp, Artificial sequence
  Synthetic oligonucleotide
atggacagcggcgacgagatgctgc

SEQ ID NO: 672867 - DNA, 25 bp, Artificial sequence
  Synthetic oligonucleotide
gccttcatggacagcggcgacgaga

SEQ ID NO: 672868 - DNA, 25 bp, Artificial sequence
  Synthetic oligonucleotide
ggcgtggccttcatggacagcggcg

SEQ ID NO: 672869 - DNA, 25 bp, Artificial sequence
  Synthetic oligonucleotide
aagtgcggcgtggccttcatggaca

SEQ ID NO: 672870 - DNA, 25 bp, Artificial sequence
  Synthetic oligonucleotide
tcgccaagtgcggcgtggccttcat

SEQ ID NO: 672871 - DNA, 25 bp, Artificial sequence
  Synthetic oligonucleotide
agaagctcgccaagtgcggcgtggc

SEQ ID NO: 672872 - DNA, 25 bp, Artificial sequence
  Synthetic oligonucleotide
acatgaagaagctcgccaagtgcgg

SEQ ID NO: 672873 - DNA, 25 bp, Artificial sequence
  Synthetic oligonucleotide
atcggttacaacgtggccaaggtca

SEQ ID NO: 672874 - DNA, 25 bp, Artificial sequence
  Synthetic oligonucleotide
tcgagccggagaacatgaagaagct

SEQ ID NO: 672875 - DNA, 25 bp, Artificial sequence
  Synthetic oligonucleotide
tacaacgtggccaaggtcaaggaag

SEQ ID NO: 672876 - DNA, 25 bp, Artificial sequence
  Synthetic oligonucleotide
gggccatcctcttcgagccggagaa

SEQ ID NO: 672877 - DNA, 25 bp, Artificial sequence
  Synthetic oligonucleotide
actcctgggccatcctcttcgagcc

SEQ ID NO: 672878 - DNA, 25 bp, Artificial sequence
  Synthetic oligonucleotide
cgatcgactcctgggccatcctctt

SEQ ID NO: 672879 - DNA, 25 bp, Artificial sequence
  Synthetic oligonucleotide
accagccgatcgactcctgggccat

SEQ ID NO: 672880 - DNA, 25 bp, Artificial sequence
  Synthetic oligonucleotide
tcggcgaccagccgatcgactcctg

SEQ ID NO: 672881 - DNA, 25 bp, Artificial sequence
  Synthetic oligonucleotide
aagtcctcggcgaccagccgatcga

SEQ ID NO: 672882 - DNA, 25 bp, Artificial sequence
  Synthetic oligonucleotide
caaggaagtcctcggcgaccagccg

SEQ ID NO: 672883 - DNA, 25 bp, Artificial sequence
  Synthetic oligonucleotide
caaggtcaaggaagtcctcggcgac

SEQ ID NO: 672884 - DNA, 25 bp, Artificial sequence
  Synthetic oligonucleotide
caagcagatccaggccggtgccttc

SEQ ID NO: 672885 - DNA, 25 bp, Artificial sequence
  Synthetic oligonucleotide
cggagaacatgaagaagctcgccaa

SEQ ID NO: 672886 - DNA, 25 bp, Artificial sequence
  Synthetic oligonucleotide
ggcggagaagaagagcctgcacatc

SEQ ID NO: 672887 - DNA, 25 bp, Artificial sequence
  Synthetic oligonucleotide
aggccggtgccttccagaagctgga

SEQ ID NO: 672888 - DNA, 25 bp, Artificial sequence
  Synthetic oligonucleotide
accaccctcaaggacttcaccaagg

SEQ ID NO: 672889 - DNA, 25 bp, Artificial sequence
  Synthetic oligonucleotide
gctcccaccaccctcaaggacttca

SEQ ID NO: 672890 - DNA, 25 bp, Artificial sequence
  Synthetic oligonucleotide
ttacatcgctcccaccaccctcaag

SEQ ID NO: 672891 - DNA, 25 bp, Artificial sequence
  Synthetic oligonucleotide
gaccgattacatcgctcccaccacc

SEQ ID NO: 672892 - DNA, 25 bp, Artificial sequence
  Synthetic oligonucleotide
aactggaccgattacatcgctccca

SEQ ID NO: 672893 - DNA, 25 bp, Artificial sequence
  Synthetic oligonucleotide
tctataactggaccgattacatcgc

SEQ ID NO: 672894 - DNA, 25 bp, Artificial sequence
  Synthetic oligonucleotide
gcacatctataactggaccgattac

SEQ ID NO: 672895 - DNA, 25 bp, Artificial sequence
  Synthetic oligonucleotide
gacttcaccaaggagagcgggatcg

SEQ ID NO: 672896 - DNA, 25 bp, Artificial sequence
  Synthetic oligonucleotide
gaagaagagcctgcacatctataac

SEQ ID NO: 672897 - DNA, 25 bp, Artificial sequence
  Synthetic oligonucleotide
accaaggagagcgggatcgacgtca

SEQ ID NO: 672898 - DNA, 25 bp, Artificial sequence
  Synthetic oligonucleotide
cgtgcaggcggagaagaagagcctg

SEQ ID NO: 672899 - DNA, 25 bp, Artificial sequence
  Synthetic oligonucleotide
gggccccgtgcaggcggagaagaag

SEQ ID NO: 672900 - DNA, 25 bp, Artificial sequence
  Synthetic oligonucleotide
gatcgcgggccccgtgcaggcggag

SEQ ID NO: 672901 - DNA, 25 bp, Artificial sequence
  Synthetic oligonucleotide
tacggcgatcgcgggccccgtgcag

SEQ ID NO: 672902 - DNA, 25 bp, Artificial sequence
  Synthetic oligonucleotide
tctggctacggcgatcgcgggcccc

SEQ ID NO: 672903 - DNA, 25 bp, Artificial sequence
  Synthetic oligonucleotide
tagccgctctggctacggcgatcgc

SEQ ID NO: 672904 - DNA, 25 bp, Artificial sequence
  Synthetic oligonucleotide
tgctggtagccgctctggctacggc

SEQ ID NO: 672905 - DNA, 25 bp, Artificial sequence
  Synthetic oligonucleotide
agacactgctggtagccgctctggc

SEQ ID NO: 672906 - DNA, 25 bp, Artificial sequence
  Synthetic oligonucleotide
ctacaacccggacaaggtcaaggcg

SEQ ID NO: 672907 - DNA, 25 bp, Artificial sequence
  Synthetic oligonucleotide
gagcctgcacatctataactggacc

SEQ ID NO: 672908 - DNA, 25 bp, Artificial sequence
  Synthetic oligonucleotide
gcaagctggtctccggccactccgg

SEQ ID NO: 672909 - DNA, 25 bp, Artificial sequence
  Synthetic oligonucleotide
gatgctgcccgccgccctcaactat

SEQ ID NO: 672910 - DNA, 25 bp, Artificial sequence
  Synthetic oligonucleotide
ctcggcaagcagatccaggccggtg

SEQ ID NO: 672911 - DNA, 25 bp, Artificial sequence
  Synthetic oligonucleotide
caacttcctcggcaagcagatccag

SEQ ID NO: 672912 - DNA, 25 bp, Artificial sequence
  Synthetic oligonucleotide
gtcgaacaacttcctcggcaagcag

SEQ ID NO: 672913 - DNA, 25 bp, Artificial sequence
  Synthetic oligonucleotide
ggtgccgtcgaacaacttcctcggc

SEQ ID NO: 672914 - DNA, 25 bp, Artificial sequence
  Synthetic oligonucleotide
catcgtggtgccgtcgaacaacttc

SEQ ID NO: 672915 - DNA, 25 bp, Artificial sequence
  Synthetic oligonucleotide
ctatgacatcgtggtgccgtcgaac

SEQ ID NO: 672916 - DNA, 25 bp, Artificial sequence
  Synthetic oligonucleotide
ctccggctatgacatcgtggtgccg

SEQ ID NO: 672917 - DNA, 25 bp, Artificial sequence
  Synthetic oligonucleotide
ctcaaggacttcaccaaggagagcg

SEQ ID NO: 672918 - DNA, 25 bp, Artificial sequence
  Synthetic oligonucleotide
tggtctccggccactccggctatga

SEQ ID NO: 672919 - DNA, 25 bp, Artificial sequence
  Synthetic oligonucleotide
gatccaggccggtgccttccagaag

SEQ ID NO: 672920 - DNA, 25 bp, Artificial sequence
  Synthetic oligonucleotide
tcgagggcaagctggtctccggcca

SEQ ID NO: 672921 - DNA, 25 bp, Artificial sequence
  Synthetic oligonucleotide
gagaccctcgagggcaagctggtct

SEQ ID NO: 672922 - DNA, 25 bp, Artificial sequence
  Synthetic oligonucleotide
tccaacgagaccctcgagggcaagc

SEQ ID NO: 672923 - DNA, 25 bp, Artificial sequence
  Synthetic oligonucleotide
tcgactccaacgagaccctcgaggg

SEQ ID NO: 672924 - DNA, 25 bp, Artificial sequence
  Synthetic oligonucleotide
acgtcttcgactccaacgagaccct

SEQ ID NO: 672925 - DNA, 25 bp, Artificial sequence
  Synthetic oligonucleotide
gctacgacgtcttcgactccaacga

SEQ ID NO: 672926 - DNA, 25 bp, Artificial sequence
  Synthetic oligonucleotide
acgtcagctacgacgtcttcgactc

SEQ ID NO: 672927 - DNA, 25 bp, Artificial sequence
  Synthetic oligonucleotide
ggatcgacgtcagctacgacgtctt

SEQ ID NO: 672928 - DNA, 25 bp, Artificial sequence
  Synthetic oligonucleotide
agagcgggatcgacgtcagctacga

SEQ ID NO: 672929 - DNA, 25 bp, Artificial sequence
  Synthetic oligonucleotide
cggccactccggctatgacatcgtg

SEQ ID NO: 672930 - DNA, 25 bp, Artificial sequence
  Synthetic oligonucleotide
ggtgatcgccaaggtcagcgactac

SEQ ID NO: 672931 - DNA, 25 bp, Artificial sequence
  Synthetic oligonucleotide
atggacaagagcgtcagcgacagcg

SEQ ID NO: 672932 - DNA, 25 bp, Artificial sequence
  Synthetic oligonucleotide
ccgctgatggacaagagcgtcagcg

SEQ ID NO: 672933 - DNA, 25 bp, Artificial sequence
  Synthetic oligonucleotide
gcccgcccgctgatggacaagagcg

SEQ ID NO: 672934 - DNA, 25 bp, Artificial sequence
  Synthetic oligonucleotide
ccgggggcccgcccgctgatggaca

SEQ ID NO: 672935 - DNA, 25 bp, Artificial sequence
  Synthetic oligonucleotide
cgcgataccgggggcccgcccgctg

SEQ ID NO: 672936 - DNA, 25 bp, Artificial sequence
  Synthetic oligonucleotide
gctacgccaacgcgataccgggggc

SEQ ID NO: 672937 - DNA, 25 bp, Artificial sequence
  Synthetic oligonucleotide
acgtcggctacgccaacgcgatacc

SEQ ID NO: 672938 - DNA, 25 bp, Artificial sequence
  Synthetic oligonucleotide
gcgactacgtcggctacgccaacgc

SEQ ID NO: 672939 - DNA, 25 bp, Artificial sequence
  Synthetic oligonucleotide
agcggcgacgagatgctgcccgccg

SEQ ID NO: 672940 - DNA, 25 bp, Artificial sequence
  Synthetic oligonucleotide
tcgccaaggtcagcgactacgtcgg

SEQ ID NO: 672941 - DNA, 25 bp, Artificial sequence
  Synthetic oligonucleotide
acagcgaggaggtgtatccgccgca

SEQ ID NO: 672942 - DNA, 25 bp, Artificial sequence
  Synthetic oligonucleotide
tccggaggtgatcgccaaggtcagc

SEQ ID NO: 672943 - DNA, 25 bp, Artificial sequence
  Synthetic oligonucleotide
ctgcgtccggaggtgatcgccaagg

SEQ ID NO: 672944 - DNA, 25 bp, Artificial sequence
  Synthetic oligonucleotide
tacctgctgcgtccggaggtgatcg

SEQ ID NO: 672945 - DNA, 25 bp, Artificial sequence
  Synthetic oligonucleotide
atcgactacctgctgcgtccggagg

SEQ ID NO: 672946 - DNA, 25 bp, Artificial sequence
  Synthetic oligonucleotide
gcgttcatcgactacctgctgcgtc

SEQ ID NO: 672947 - DNA, 25 bp, Artificial sequence
  Synthetic oligonucleotide
gcctacgcgttcatcgactacctgc

SEQ ID NO: 672948 - DNA, 25 bp, Artificial sequence
  Synthetic oligonucleotide
gataacgcctacgcgttcatcgact

SEQ ID NO: 672949 - DNA, 25 bp, Artificial sequence
  Synthetic oligonucleotide
gccgccgataacgcctacgcgttca

SEQ ID NO: 672950 - DNA, 25 bp, Artificial sequence
  Synthetic oligonucleotide
aggtcagcgactacgtcggctacgc

SEQ ID NO: 672951 - DNA, 25 bp, Artificial sequence
  Synthetic oligonucleotide
cgtgttgccggccaaggtgctgcgc

SEQ ID NO: 672952 - DNA, 25 bp, Artificial sequence
  Synthetic oligonucleotide
tccgcccggtagcgtgaccgggctc

SEQ ID NO: 672953 - DNA, 25 bp, Artificial sequence
  Synthetic oligonucleotide
agttcaaattccgcccggtagcgtg

SEQ ID NO: 672954 - DNA, 25 bp, Artificial sequence
  Synthetic oligonucleotide
caagaccggcaaataagttcaaatt

SEQ ID NO: 672955 - DNA, 25 bp, Artificial sequence
  Synthetic oligonucleotide
cggatcaagaccggcaaataagttc

SEQ ID NO: 672956 - DNA, 25 bp, Artificial sequence
  Synthetic oligonucleotide
tggacccggatcaagaccggcaaat

SEQ ID NO: 672957 - DNA, 25 bp, Artificial sequence
  Synthetic oligonucleotide
cgtacctggacccggatcaagaccg

SEQ ID NO: 672958 - DNA, 25 bp, Artificial sequence
  Synthetic oligonucleotide
cctgcagacccgtacctggacccgg

SEQ ID NO: 672959 - DNA, 25 bp, Artificial sequence
  Synthetic oligonucleotide
gctgcgcctgcagacccgtacctgg

SEQ ID NO: 672960 - DNA, 25 bp, Artificial sequence
  Synthetic oligonucleotide
aagagcgtcagcgacagcgaggagg

SEQ ID NO: 672961 - DNA, 25 bp, Artificial sequence
  Synthetic oligonucleotide
tgccggccaaggtgctgcgcctgca

SEQ ID NO: 672962 - DNA, 25 bp, Artificial sequence
  Synthetic oligonucleotide
tcagcgacagcgaggaggtgtatcc

SEQ ID NO: 672963 - DNA, 25 bp, Artificial sequence
  Synthetic oligonucleotide
ttccgccgtgttgccggccaaggtg

SEQ ID NO: 672964 - DNA, 25 bp, Artificial sequence
  Synthetic oligonucleotide
tctacgtttccgccgtgttgccggc

SEQ ID NO: 672965 - DNA, 25 bp, Artificial sequence
  Synthetic oligonucleotide
acaagctctacgtttccgccgtgtt

SEQ ID NO: 672966 - DNA, 25 bp, Artificial sequence
  Synthetic oligonucleotide
tgctcgacaagctctacgtttccgc

SEQ ID NO: 672967 - DNA, 25 bp, Artificial sequence
  Synthetic oligonucleotide
aggccgtgctcgacaagctctacgt

SEQ ID NO: 672968 - DNA, 25 bp, Artificial sequence
  Synthetic oligonucleotide
cgccgcaggccgtgctcgacaagct

SEQ ID NO: 672969 - DNA, 25 bp, Artificial sequence
  Synthetic oligonucleotide
tgtatccgccgcaggccgtgctcga

SEQ ID NO: 672970 - DNA, 25 bp, Artificial sequence
  Synthetic oligonucleotide
aggaggtgtatccgccgcaggccgt

SEQ ID NO: 672971 - DNA, 25 bp, Artificial sequence
  Synthetic oligonucleotide
attcccgccgatgccaaggccgccg

SEQ ID NO: 672972 - DNA, 25 bp, Artificial sequence
  Synthetic oligonucleotide
caaggtgctgcgcctgcagacccgt

SEQ ID NO: 672973 - DNA, 25 bp, Artificial sequence
  Synthetic oligonucleotide
ctgaccaaggttcgcccctacgtca

SEQ ID NO: 672974 - DNA, 25 bp, Artificial sequence
  Synthetic oligonucleotide
gccaaggccgccgataacgcctacg

SEQ ID NO: 672975 - DNA, 25 bp, Artificial sequence
  Synthetic oligonucleotide
gccaacggcaacatctgcgtcgcct

SEQ ID NO: 672976 - DNA, 25 bp, Artificial sequence
  Synthetic oligonucleotide
atctccgacctggccaacggcaaca

SEQ ID NO: 672977 - DNA, 25 bp, Artificial sequence
  Synthetic oligonucleotide
aagtacatctccgacctggccaacg

SEQ ID NO: 672978 - DNA, 25 bp, Artificial sequence
  Synthetic oligonucleotide
ctcctccaagtacatctccgacctg

SEQ ID NO: 672979 - DNA, 25 bp, Artificial sequence
  Synthetic oligonucleotide
cttccactcctccaagtacatctcc

SEQ ID NO: 672980 - DNA, 25 bp, Artificial sequence
  Synthetic oligonucleotide
cagctacttccactcctccaagtac

SEQ ID NO: 672981 - DNA, 25 bp, Artificial sequence
  Synthetic oligonucleotide
tacgtcagctacttccactcctcca

SEQ ID NO: 672982 - DNA, 25 bp, Artificial sequence
  Synthetic oligonucleotide
ctgcgtcgccttcggctattccggg

SEQ ID NO: 672983 - DNA, 25 bp, Artificial sequence
  Synthetic oligonucleotide
aaggttcgcccctacgtcagctact

SEQ ID NO: 672984 - DNA, 25 bp, Artificial sequence
  Synthetic oligonucleotide
tcggctattccggggacgtcttcca

SEQ ID NO: 672985 - DNA, 25 bp, Artificial sequence
  Synthetic oligonucleotide
gccgaggaagtcctgaccaaggttc

SEQ ID NO: 672986 - DNA, 25 bp, Artificial sequence
  Synthetic oligonucleotide
caagaaggccgaggaagtcctgacc

SEQ ID NO: 672987 - DNA, 25 bp, Artificial sequence
  Synthetic oligonucleotide
ggactacaagaaggccgaggaagtc

SEQ ID NO: 672988 - DNA, 25 bp, Artificial sequence
  Synthetic oligonucleotide
cccgaaggactacaagaaggccgag

SEQ ID NO: 672989 - DNA, 25 bp, Artificial sequence
  Synthetic oligonucleotide
cacccacgacccgaaggactacaag

SEQ ID NO: 672990 - DNA, 25 bp, Artificial sequence
  Synthetic oligonucleotide
atctggggctggaccccaacaccca

SEQ ID NO: 672991 - DNA, 25 bp, Artificial sequence
  Synthetic oligonucleotide
tcaactatctggggctggaccccaa

SEQ ID NO: 672992 - DNA, 25 bp, Artificial sequence
  Synthetic oligonucleotide
ccgccctcaactatctggggctgga

SEQ ID NO: 672993 - DNA, 25 bp, Artificial sequence
  Synthetic oligonucleotide
tgcccgccgccctcaactatctggg

SEQ ID NO: 672994 - DNA, 25 bp, Artificial sequence
  Synthetic oligonucleotide
tcgcccctacgtcagctacttccac

SEQ ID NO: 672995 - DNA, 25 bp, Artificial sequence
  Synthetic oligonucleotide
cgacatccagtacgtgattcccaag

SEQ ID NO: 672996 - DNA, 25 bp, Artificial sequence
  Synthetic oligonucleotide
tgcaacattccattggcaagacact

SEQ ID NO: 672997 - DNA, 25 bp, Artificial sequence
  Synthetic oligonucleotide
tggcgattcccgccgatgccaaggc

SEQ ID NO: 672998 - DNA, 25 bp, Artificial sequence
  Synthetic oligonucleotide
acctgatggcgattcccgccgatgc

SEQ ID NO: 672999 - DNA, 25 bp, Artificial sequence
  Synthetic oligonucleotide
gttcgacctgatggcgattcccgcc

SEQ ID NO: 673000 - DNA, 25 bp, Artificial sequence
  Synthetic oligonucleotide
ctgtggttcgacctgatggcgattc

SEQ ID NO: 673001 - DNA, 25 bp, Artificial sequence
  Synthetic oligonucleotide
gccaacctgtggttcgacctgatgg

SEQ ID NO: 673002 - DNA, 25 bp, Artificial sequence
  Synthetic oligonucleotide
gaaggcgccaacctgtggttcgacc

SEQ ID NO: 673003 - DNA, 25 bp, Artificial sequence
  Synthetic oligonucleotide
cccaaggaaggcgccaacctgtggt

SEQ ID NO: 673004 - DNA, 25 bp, Artificial sequence
  Synthetic oligonucleotide
gcaacatctgcgtcgccttcggcta

SEQ ID NO: 673005 - DNA, 25 bp, Artificial sequence
  Synthetic oligonucleotide
ccagtacgtgattcccaaggaaggc

SEQ ID NO: 673006 - DNA, 25 bp, Artificial sequence
  Synthetic oligonucleotide
gccgatgccaaggccgccgataacg

SEQ ID NO: 673007 - DNA, 25 bp, Artificial sequence
  Synthetic oligonucleotide
gggcatcgacatccagtacgtgatt

SEQ ID NO: 673008 - DNA, 25 bp, Artificial sequence
  Synthetic oligonucleotide
cggcaagggcatcgacatccagtac

SEQ ID NO: 673009 - DNA, 25 bp, Artificial sequence
  Synthetic oligonucleotide
agaggccggcaagggcatcgacatc

SEQ ID NO: 673010 - DNA, 25 bp, Artificial sequence
  Synthetic oligonucleotide
cgccgaagaggccggcaagggcatc

SEQ ID NO: 673011 - DNA, 25 bp, Artificial sequence
  Synthetic oligonucleotide
tgcccgcgccgaagaggccggcaag

SEQ ID NO: 673012 - DNA, 25 bp, Artificial sequence
  Synthetic oligonucleotide
ggccgctgcccgcgccgaagaggcc

SEQ ID NO: 673013 - DNA, 25 bp, Artificial sequence
  Synthetic oligonucleotide
cttccaggccgctgcccgcgccgaa

SEQ ID NO: 673014 - DNA, 25 bp, Artificial sequence
  Synthetic oligonucleotide
ggacgtcttccaggccgctgcccgc

SEQ ID NO: 673015 - DNA, 25 bp, Artificial sequence
  Synthetic oligonucleotide
tccggggacgtcttccaggccgctg

SEQ ID NO: 673016 - DNA, 25 bp, Artificial sequence
  Synthetic oligonucleotide
cgtgattcccaaggaaggcgccaac

SEQ ID NO: 673017 - DNA, 25 bp, Artificial sequence
  Synthetic oligonucleotide
taccaggccaagtcccgcgccgaag

SEQ ID NO: 673018 - DNA, 25 bp, Artificial sequence
  Synthetic oligonucleotide
ccaaggaaggcgccggcagcttctt

SEQ ID NO: 673019 - DNA, 25 bp, Artificial sequence
  Synthetic oligonucleotide
aacattcccaaggaaggcgccggca

SEQ ID NO: 673020 - DNA, 25 bp, Artificial sequence
  Synthetic oligonucleotide
aagtacaacattcccaaggaaggcg

SEQ ID NO: 673021 - DNA, 25 bp, Artificial sequence
  Synthetic oligonucleotide
accgtcaagtacaacattcccaagg

SEQ ID NO: 673022 - DNA, 25 bp, Artificial sequence
  Synthetic oligonucleotide
aaggtcaccgtcaagtacaacattc

SEQ ID NO: 673023 - DNA, 25 bp, Artificial sequence
  Synthetic oligonucleotide
aagaacaaggtcaccgtcaagtaca

SEQ ID NO: 673024 - DNA, 25 bp, Artificial sequence
  Synthetic oligonucleotide
gaggcgaagaacaaggtcaccgtca

SEQ ID NO: 673025 - DNA, 25 bp, Artificial sequence
  Synthetic oligonucleotide
gccgaagaggcgaagaacaaggtca

SEQ ID NO: 673026 - DNA, 25 bp, Artificial sequence
  Synthetic oligonucleotide
acggcaacgcggcggccaccccgct

SEQ ID NO: 673027 - DNA, 25 bp, Artificial sequence
  Synthetic oligonucleotide
ccaagtcccgcgccgaagaggcgaa

SEQ ID NO: 673028 - DNA, 25 bp, Artificial sequence
  Synthetic oligonucleotide
gcttcttcgacatggtcgccattcc

SEQ ID NO: 673029 - DNA, 25 bp, Artificial sequence
  Synthetic oligonucleotide
gacatctaccaggccaagtcccgcg

SEQ ID NO: 673030 - DNA, 25 bp, Artificial sequence
  Synthetic oligonucleotide
tccggcgacatctaccaggccaagt

SEQ ID NO: 673031 - DNA, 25 bp, Artificial sequence
  Synthetic oligonucleotide
ggctactccggcgacatctaccagg

SEQ ID NO: 673032 - DNA, 25 bp, Artificial sequence
  Synthetic oligonucleotide
gccatcggctactccggcgacatct

SEQ ID NO: 673033 - DNA, 25 bp, Artificial sequence
  Synthetic oligonucleotide
tgcgtcgccatcggctactccggcg

SEQ ID NO: 673034 - DNA, 25 bp, Artificial sequence
  Synthetic oligonucleotide
aacatctgcgtcgccatcggctact

SEQ ID NO: 673035 - DNA, 25 bp, Artificial sequence
  Synthetic oligonucleotide
aacggcaacatctgcgtcgccatcg

SEQ ID NO: 673036 - DNA, 25 bp, Artificial sequence
  Synthetic oligonucleotide
ctggccaacggcaacatctgcgtcg

SEQ ID NO: 673037 - DNA, 25 bp, Artificial sequence
  Synthetic oligonucleotide
tcccgcgccgaagaggcgaagaaca

SEQ ID NO: 673038 - DNA, 25 bp, Artificial sequence
  Synthetic oligonucleotide
ctggccttcgtcaacttcctgatga

SEQ ID NO: 673039 - DNA, 25 bp, Artificial sequence
  Synthetic oligonucleotide
ttggcaagacactgctggtagccgc

SEQ ID NO: 673040 - DNA, 25 bp, Artificial sequence
  Synthetic oligonucleotide
ttcagttccccaacggcaacgcggc

SEQ ID NO: 673041 - DNA, 25 bp, Artificial sequence
  Synthetic oligonucleotide
gacgtggttcagttccccaacggca

SEQ ID NO: 673042 - DNA, 25 bp, Artificial sequence
  Synthetic oligonucleotide
gagatcaccgacgtggttcagttcc

SEQ ID NO: 673043 - DNA, 25 bp, Artificial sequence
  Synthetic oligonucleotide
atggccgagatcaccgacgtggttc

SEQ ID NO: 673044 - DNA, 25 bp, Artificial sequence
  Synthetic oligonucleotide
gaaatcatggccgagatcaccgacg

SEQ ID NO: 673045 - DNA, 25 bp, Artificial sequence
  Synthetic oligonucleotide
aagccggaaatcatggccgagatca

SEQ ID NO: 673046 - DNA, 25 bp, Artificial sequence
  Synthetic oligonucleotide
ctgatgaagccggaaatcatggccg

SEQ ID NO: 673047 - DNA, 25 bp, Artificial sequence
  Synthetic oligonucleotide
aaggcgccggcagcttcttcgacat

SEQ ID NO: 673048 - DNA, 25 bp, Artificial sequence
  Synthetic oligonucleotide
ttcgtcaacttcctgatgaagccgg

SEQ ID NO: 673049 - DNA, 25 bp, Artificial sequence
  Synthetic oligonucleotide
ccggcagcttcttcgacatggtcgc

SEQ ID NO: 673050 - DNA, 25 bp, Artificial sequence
  Synthetic oligonucleotide
ggcgccctggccttcgtcaacttcc

SEQ ID NO: 673051 - DNA, 25 bp, Artificial sequence
  Synthetic oligonucleotide
accgagggcgccctggccttcgtca

SEQ ID NO: 673052 - DNA, 25 bp, Artificial sequence
  Synthetic oligonucleotide
gagaacaccgagggcgccctggcct

SEQ ID NO: 673053 - DNA, 25 bp, Artificial sequence
  Synthetic oligonucleotide
gacgccgagaacaccgagggcgccc

SEQ ID NO: 673054 - DNA, 25 bp, Artificial sequence
  Synthetic oligonucleotide
ccgaaggacgccgagaacaccgagg

SEQ ID NO: 673055 - DNA, 25 bp, Artificial sequence
  Synthetic oligonucleotide
gccattccgaaggacgccgagaaca

SEQ ID NO: 673056 - DNA, 25 bp, Artificial sequence
  Synthetic oligonucleotide
atggtcgccattccgaaggacgccg

SEQ ID NO: 673057 - DNA, 25 bp, Artificial sequence
  Synthetic oligonucleotide
tcgacatggtcgccattccgaagga

SEQ ID NO: 673058 - DNA, 25 bp, Artificial sequence
  Synthetic oligonucleotide
tcgaagtacatttccgacctggcca

SEQ ID NO: 673059 - DNA, 25 bp, Artificial sequence
  Synthetic oligonucleotide
aacttcctgatgaagccggaaatca

SEQ ID NO: 673060 - DNA, 25 bp, Artificial sequence
  Synthetic oligonucleotide
gtattcaagccggagaacatccaga

SEQ ID NO: 673061 - DNA, 25 bp, Artificial sequence
  Synthetic oligonucleotide
tccgacctggccaacggcaacatct

SEQ ID NO: 673062 - DNA, 25 bp, Artificial sequence
  Synthetic oligonucleotide
tcgactcgccgaccgagatcctccc

SEQ ID NO: 673063 - DNA, 25 bp, Artificial sequence
  Synthetic oligonucleotide
gcttcctcgactcgccgaccgagat

SEQ ID NO: 673064 - DNA, 25 bp, Artificial sequence
  Synthetic oligonucleotide
cgtcagcttcctcgactcgccgacc

SEQ ID NO: 673065 - DNA, 25 bp, Artificial sequence
  Synthetic oligonucleotide
gtgcggcgtcagcttcctcgactcg

SEQ ID NO: 673066 - DNA, 25 bp, Artificial sequence
  Synthetic oligonucleotide
aagcagtgcggcgtcagcttcctcg

SEQ ID NO: 673067 - DNA, 25 bp, Artificial sequence
  Synthetic oligonucleotide
gaagctgaagcagtgcggcgtcagc

SEQ ID NO: 673068 - DNA, 25 bp, Artificial sequence
  Synthetic oligonucleotide
catccagaagctgaagcagtgcggc

SEQ ID NO: 673069 - DNA, 25 bp, Artificial sequence
  Synthetic oligonucleotide
ccgagatcctcccggcggccctgca

SEQ ID NO: 673070 - DNA, 25 bp, Artificial sequence
  Synthetic oligonucleotide
caagccggagaacatccagaagctg

SEQ ID NO: 673071 - DNA, 25 bp, Artificial sequence
  Synthetic oligonucleotide
tcctcccggcggccctgcattatct

SEQ ID NO: 673072 - DNA, 25 bp, Artificial sequence
  Synthetic oligonucleotide
gacctggtattcaagccggagaaca

SEQ ID NO: 673073 - DNA, 25 bp, Artificial sequence
  Synthetic oligonucleotide
tcctgggacctggtattcaagccgg

SEQ ID NO: 673074 - DNA, 25 bp, Artificial sequence
  Synthetic oligonucleotide
gtggattcctgggacctggtattca

SEQ ID NO: 673075 - DNA, 25 bp, Artificial sequence
  Synthetic oligonucleotide
gcgccggtggattcctgggacctgg

SEQ ID NO: 673076 - DNA, 25 bp, Artificial sequence
  Synthetic oligonucleotide
cgacaacgcgccggtggattcctgg

SEQ ID NO: 673077 - DNA, 25 bp, Artificial sequence
  Synthetic oligonucleotide
ccttcggcgacaacgcgccggtgga

SEQ ID NO: 673078 - DNA, 25 bp, Artificial sequence
  Synthetic oligonucleotide
aaggcggccttcggcgacaacgcgc

SEQ ID NO: 673079 - DNA, 25 bp, Artificial sequence
  Synthetic oligonucleotide
aaggtcaaggcggccttcggcgaca

SEQ ID NO: 673080 - DNA, 25 bp, Artificial sequence
  Synthetic oligonucleotide
ccggacaaggtcaaggcggccttcg

SEQ ID NO: 673081 - DNA, 25 bp, Artificial sequence
  Synthetic oligonucleotide
ggagaacatccagaagctgaagcag

SEQ ID NO: 673082 - DNA, 25 bp, Artificial sequence
  Synthetic oligonucleotide
ctcaaggcggccgaagagctgttcc

SEQ ID NO: 673083 - DNA, 25 bp, Artificial sequence
  Synthetic oligonucleotide
aacgcggcggccaccccgctggtgt

SEQ ID NO: 673084 - DNA, 25 bp, Artificial sequence
  Synthetic oligonucleotide
cactcgtcgaagtacatttccgacc

SEQ ID NO: 673085 - DNA, 25 bp, Artificial sequence
  Synthetic oligonucleotide
tacttccactcgtcgaagtacattt

SEQ ID NO: 673086 - DNA, 25 bp, Artificial sequence
  Synthetic oligonucleotide
cgtcacctacttccactcgtcgaag

SEQ ID NO: 673087 - DNA, 25 bp, Artificial sequence
  Synthetic oligonucleotide
tccctacgtcacctacttccactcg

SEQ ID NO: 673088 - DNA, 25 bp, Artificial sequence
  Synthetic oligonucleotide
gatccgtccctacgtcacctacttc

SEQ ID NO: 673089 - DNA, 25 bp, Artificial sequence
  Synthetic oligonucleotide
ctgaagatccgtccctacgtcacct

SEQ ID NO: 673090 - DNA, 25 bp, Artificial sequence
  Synthetic oligonucleotide
ctgttcctgaagatccgtccctacg

SEQ ID NO: 673091 - DNA, 25 bp, Artificial sequence
  Synthetic oligonucleotide
cgccgaccgagatcctcccggcggc

SEQ ID NO: 673092 - DNA, 25 bp, Artificial sequence
  Synthetic oligonucleotide
gcggccgaagagctgttcctgaaga

SEQ ID NO: 673093 - DNA, 25 bp, Artificial sequence
  Synthetic oligonucleotide
acatttccgacctggccaacggcaa

SEQ ID NO: 673094 - DNA, 25 bp, Artificial sequence
  Synthetic oligonucleotide
aaggaactcaaggcggccgaagagc

SEQ ID NO: 673095 - DNA, 25 bp, Artificial sequence
  Synthetic oligonucleotide
atcccaaggaactcaaggcggccga

SEQ ID NO: 673096 - DNA, 25 bp, Artificial sequence
  Synthetic oligonucleotide
ccgacaatcccaaggaactcaaggc

SEQ ID NO: 673097 - DNA, 25 bp, Artificial sequence
  Synthetic oligonucleotide
cggacaccgacaatcccaaggaact

SEQ ID NO: 673098 - DNA, 25 bp, Artificial sequence
  Synthetic oligonucleotide
acaagccggacaccgacaatcccaa

SEQ ID NO: 673099 - DNA, 25 bp, Artificial sequence
  Synthetic oligonucleotide
tcggctacaagccggacaccgacaa

SEQ ID NO: 673100 - DNA, 25 bp, Artificial sequence
  Synthetic oligonucleotide
ttatctcggctacaagccggacacc

SEQ ID NO: 673101 - DNA, 25 bp, Artificial sequence
  Synthetic oligonucleotide
cctgcattatctcggctacaagccg

SEQ ID NO: 673102 - DNA, 25 bp, Artificial sequence
  Synthetic oligonucleotide
ggcggccctgcattatctcggctac

SEQ ID NO: 673103 - DNA, 25 bp, Artificial sequence
  Synthetic oligonucleotide
gaagagctgttcctgaagatccgtc

SEQ ID NO: 673104 - DNA, 25 bp, Artificial sequence
  Synthetic oligonucleotide
ctgccatgggcgctgcgccaatctg

SEQ ID NO: 673105 - DNA, 25 bp, Artificial sequence
  Synthetic oligonucleotide
agggaacccagctcactcatgtttc

SEQ ID NO: 673106 - DNA, 25 bp, Artificial sequence
  Synthetic oligonucleotide
gccggtagggaacccagctcactca

SEQ ID NO: 673107 - DNA, 25 bp, Artificial sequence
  Synthetic oligonucleotide
caacacgccggtagggaacccagct

SEQ ID NO: 673108 - DNA, 25 bp, Artificial sequence
  Synthetic oligonucleotide
tgtcgctcgcaccggggccgagggc

SEQ ID NO: 673109 - DNA, 25 bp, Artificial sequence
  Synthetic oligonucleotide
ggtcgtgtcgctcgcaccggggccg

SEQ ID NO: 673110 - DNA, 25 bp, Artificial sequence
  Synthetic oligonucleotide
ggggccggtcgtgtcgctcgcaccg

SEQ ID NO: 673111 - DNA, 25 bp, Artificial sequence
  Synthetic oligonucleotide
ccgcgccggggccggtcgtgtcgct

SEQ ID NO: 673112 - DNA, 25 bp, Artificial sequence
  Synthetic oligonucleotide
aatctgccgcgccggggccggtcgt

SEQ ID NO: 673113 - DNA, 25 bp, Artificial sequence
  Synthetic oligonucleotide
tccccaacggcaacgcggcggccac

SEQ ID NO: 673114 - DNA, 25 bp, Artificial sequence
  Synthetic oligonucleotide
tgggcgctgcgccaatctgccgcgc

SEQ ID NO: 673115 - DNA, 25 bp, Artificial sequence
  Synthetic oligonucleotide
catgtttcccggcggaatcgtcggg

SEQ ID NO: 673116 - DNA, 25 bp, Artificial sequence
  Synthetic oligonucleotide
aagacgctgccatgggcgctgcgcc

SEQ ID NO: 673117 - DNA, 25 bp, Artificial sequence
  Synthetic oligonucleotide
cgacgaagacgctgccatgggcgct

SEQ ID NO: 673118 - DNA, 25 bp, Artificial sequence
  Synthetic oligonucleotide
gtatcgacgacgaagacgctgccat

SEQ ID NO: 673119 - DNA, 25 bp, Artificial sequence
  Synthetic oligonucleotide
gacgcagtatcgacgacgaagacgc

SEQ ID NO: 673120 - DNA, 25 bp, Artificial sequence
  Synthetic oligonucleotide
cgaccggacgcagtatcgacgacga

SEQ ID NO: 673121 - DNA, 25 bp, Artificial sequence
  Synthetic oligonucleotide
gcccgacgaccggacgcagtatcga

SEQ ID NO: 673122 - DNA, 25 bp, Artificial sequence
  Synthetic oligonucleotide
ctgggggcccgacgaccggacgcag

SEQ ID NO: 673123 - DNA, 25 bp, Artificial sequence
  Synthetic oligonucleotide
cagacgcttcctcctgggggcccga

SEQ ID NO: 673124 - DNA, 25 bp, Artificial sequence
  Synthetic oligonucleotide
ctgcgccaatctgccgcgccggggc

SEQ ID NO: 673125 - DNA, 25 bp, Artificial sequence
  Synthetic oligonucleotide
catcggcacttgaagaacacgggtc

SEQ ID NO: 673126 - DNA, 25 bp, Artificial sequence
  Synthetic oligonucleotide
cggacatgcaacattccattggcaa

SEQ ID NO: 673127 - DNA, 25 bp, Artificial sequence
  Synthetic oligonucleotide
aggagtcggacatgcaacattccat

SEQ ID NO: 673128 - DNA, 25 bp, Artificial sequence
  Synthetic oligonucleotide
cggaacaggagtcggacatgcaaca

SEQ ID NO: 673129 - DNA, 25 bp, Artificial sequence
  Synthetic oligonucleotide
aaggcccggaacaggagtcggacat

SEQ ID NO: 673130 - DNA, 25 bp, Artificial sequence
  Synthetic oligonucleotide
gtgctgccgtgaaaaggcccggaac

SEQ ID NO: 673131 - DNA, 25 bp, Artificial sequence
  Synthetic oligonucleotide
ggcagggtgctgccgtgaaaaggcc

SEQ ID NO: 673132 - DNA, 25 bp, Artificial sequence
  Synthetic oligonucleotide
cgaacaggcagggtgctgccgtgaa

SEQ ID NO: 673133 - DNA, 25 bp, Artificial sequence
  Synthetic oligonucleotide
cacgggtcgaacaggcagggtgctg

SEQ ID NO: 673134 - DNA, 25 bp, Artificial sequence
  Synthetic oligonucleotide
cccagctcactcatgtttcccggcg

SEQ ID NO: 673135 - DNA, 25 bp, Artificial sequence
  Synthetic oligonucleotide
cacttgaagaacacgggtcgaacag

SEQ ID NO: 673136 - DNA, 25 bp, Artificial sequence
  Synthetic oligonucleotide
tcactcatgtttcccggcggaatcg

SEQ ID NO: 673137 - DNA, 25 bp, Artificial sequence
  Synthetic oligonucleotide
ggcttacatcggcacttgaagaaca

SEQ ID NO: 673138 - DNA, 25 bp, Artificial sequence
  Synthetic oligonucleotide
tgatctgggcttacatcggcacttg

SEQ ID NO: 673139 - DNA, 25 bp, Artificial sequence
  Synthetic oligonucleotide
cccgagtgatctgggcttacatcgg

SEQ ID NO: 673140 - DNA, 25 bp, Artificial sequence
  Synthetic oligonucleotide
atgaaacccgagtgatctgggctta

SEQ ID NO: 673141 - DNA, 25 bp, Artificial sequence
  Synthetic oligonucleotide
gttgtcatgaaacccgagtgatctg

SEQ ID NO: 673142 - DNA, 25 bp, Artificial sequence
  Synthetic oligonucleotide
cgtcgggttgtcatgaaacccgagt

SEQ ID NO: 673143 - DNA, 25 bp, Artificial sequence
  Synthetic oligonucleotide
cggaatcgtcgggttgtcatgaaac

SEQ ID NO: 673144 - DNA, 25 bp, Artificial sequence
  Synthetic oligonucleotide
tcccggcggaatcgtcgggttgtca

SEQ ID NO: 673145 - DNA, 25 bp, Artificial sequence
  Synthetic oligonucleotide
tcttttgcccgttcgtccagacgct

SEQ ID NO: 673146 - DNA, 25 bp, Artificial sequence
  Synthetic oligonucleotide
aagaacacgggtcgaacaggcaggg

SEQ ID NO: 673147 - DNA, 25 bp, Artificial sequence
  Synthetic oligonucleotide
tacccgagcgaagaggtcatgaaga

SEQ ID NO: 673148 - DNA, 25 bp, Artificial sequence
  Synthetic oligonucleotide
tcgtccagacgcttcctcctggggg

SEQ ID NO: 673149 - DNA, 25 bp, Artificial sequence
  Synthetic oligonucleotide
gacccagcgggcgatgacccgcagc

SEQ ID NO: 673150 - DNA, 25 bp, Artificial sequence
  Synthetic oligonucleotide
cggccaagacccagcgggcgatgac

SEQ ID NO: 673151 - DNA, 25 bp, Artificial sequence
  Synthetic oligonucleotide
acctgccggccaagacccagcgggc

SEQ ID NO: 673152 - DNA, 25 bp, Artificial sequence
  Synthetic oligonucleotide
tccccgacctgccggccaagaccca

SEQ ID NO: 673153 - DNA, 25 bp, Artificial sequence
  Synthetic oligonucleotide
tgtataccttccccgacctgccggc

SEQ ID NO: 673154 - DNA, 25 bp, Artificial sequence
  Synthetic oligonucleotide
gaagctgtataccttccccgacctg

SEQ ID NO: 673155 - DNA, 25 bp, Artificial sequence
  Synthetic oligonucleotide
atgaagaagctgtataccttccccg

SEQ ID NO: 673156 - DNA, 25 bp, Artificial sequence
  Synthetic oligonucleotide
cgatgacccgcagctggaccaagat

SEQ ID NO: 673157 - DNA, 25 bp, Artificial sequence
  Synthetic oligonucleotide
agcgaagaggtcatgaagaagctgt

SEQ ID NO: 673158 - DNA, 25 bp, Artificial sequence
  Synthetic oligonucleotide
cccgcagctggaccaagatcaagtc

SEQ ID NO: 673159 - DNA, 25 bp, Artificial sequence
  Synthetic oligonucleotide
gcatctacccgagcgaagaggtcat

SEQ ID NO: 673160 - DNA, 25 bp, Artificial sequence
  Synthetic oligonucleotide
cccgggcatctacccgagcgaagag

SEQ ID NO: 673161 - DNA, 25 bp, Artificial sequence
  Synthetic oligonucleotide
aacgacccgggcatctacccgagcg

SEQ ID NO: 673162 - DNA, 25 bp, Artificial sequence
  Synthetic oligonucleotide
atccgcaacgacccgggcatctacc

SEQ ID NO: 673163 - DNA, 25 bp, Artificial sequence
  Synthetic oligonucleotide
aggcgatccgcaacgacccgggcat

SEQ ID NO: 673164 - DNA, 25 bp, Artificial sequence
  Synthetic oligonucleotide
gtccgaggcgatccgcaacgacccg

SEQ ID NO: 673165 - DNA, 25 bp, Artificial sequence
  Synthetic oligonucleotide
ctggtgtccgaggcgatccgcaacg

SEQ ID NO: 673166 - DNA, 25 bp, Artificial sequence
  Synthetic oligonucleotide
accccgctggtgtccgaggcgatcc

SEQ ID NO: 673167 - DNA, 25 bp, Artificial sequence
  Synthetic oligonucleotide
gcggccaccccgctggtgtccgagg

SEQ ID NO: 673168 - DNA, 25 bp, Artificial sequence
  Synthetic oligonucleotide
gaggtcatgaagaagctgtatacct

SEQ ID NO: 673169 - DNA, 25 bp, Artificial sequence
  Synthetic oligonucleotide
aagccgccggcgctccggcacgaga

SEQ ID NO: 673170 - DNA, 25 bp, Artificial sequence
  Synthetic oligonucleotide
cgggctcaacgacttgggagttgtg

SEQ ID NO: 673171 - DNA, 25 bp, Artificial sequence
  Synthetic oligonucleotide
ttcgactcttttgcccgttcgtcca

SEQ ID NO: 673172 - DNA, 25 bp, Artificial sequence
  Synthetic oligonucleotide
cgaagaggttcgactcttttgcccg

SEQ ID NO: 673173 - DNA, 25 bp, Artificial sequence
  Synthetic oligonucleotide
cccctgcgaagaggttcgactcttt

SEQ ID NO: 673174 - DNA, 25 bp, Artificial sequence
  Synthetic oligonucleotide
cgcgctcccctgcgaagaggttcga

SEQ ID NO: 673175 - DNA, 25 bp, Artificial sequence
  Synthetic oligonucleotide
tccggccgcgctcccctgcgaagag

SEQ ID NO: 673176 - DNA, 25 bp, Artificial sequence
  Synthetic oligonucleotide
gtttcctccggccgcgctcccctgc

SEQ ID NO: 673177 - DNA, 25 bp, Artificial sequence
  Synthetic oligonucleotide
cacgagagaaccggaacgcggccgg

SEQ ID NO: 673178 - DNA, 25 bp, Artificial sequence
  Synthetic oligonucleotide
agcgggcgatgacccgcagctggac

SEQ ID NO: 673179 - DNA, 25 bp, Artificial sequence
  Synthetic oligonucleotide
cggcgctccggcacgagagaaccgg

SEQ ID NO: 673180 - DNA, 25 bp, Artificial sequence
  Synthetic oligonucleotide
gcccgttcgtccagacgcttcctcc

SEQ ID NO: 673181 - DNA, 25 bp, Artificial sequence
  Synthetic oligonucleotide
gcgcctgaagccgccggcgctccgg

SEQ ID NO: 673182 - DNA, 25 bp, Artificial sequence
  Synthetic oligonucleotide
ccggcggcgcctgaagccgccggcg

SEQ ID NO: 673183 - DNA, 25 bp, Artificial sequence
  Synthetic oligonucleotide
aggagcccggcggcgcctgaagccg

SEQ ID NO: 673184 - DNA, 25 bp, Artificial sequence
  Synthetic oligonucleotide
tccgcgaggagcccggcggcgcctg

SEQ ID NO: 673185 - DNA, 25 bp, Artificial sequence
  Synthetic oligonucleotide
aagtgatccgcgaggagcccggcgg

SEQ ID NO: 673186 - DNA, 25 bp, Artificial sequence
  Synthetic oligonucleotide
tccggcaagtgatccgcgaggagcc

SEQ ID NO: 673187 - DNA, 25 bp, Artificial sequence
  Synthetic oligonucleotide
tcaagtccggcaagtgatccgcgag

SEQ ID NO: 673188 - DNA, 25 bp, Artificial sequence
  Synthetic oligonucleotide
ccaagatcaagtccggcaagtgatc

SEQ ID NO: 673189 - DNA, 25 bp, Artificial sequence
  Synthetic oligonucleotide
gctggaccaagatcaagtccggcaa

SEQ ID NO: 673190 - DNA, 25 bp, Artificial sequence
  Synthetic oligonucleotide
tccggcacgagagaaccggaacgcg

SEQ ID NO: 673191 - DNA, 25 bp, Artificial sequence
  Synthetic oligonucleotide
acgcggaccagcagttgcaggtgct

SEQ ID NO: 673192 - DNA, 25 bp, Artificial sequence
  Synthetic oligonucleotide
gacccgctctacatcgatgcctacc

SEQ ID NO: 673193 - DNA, 25 bp, Artificial sequence
  Synthetic oligonucleotide
accgatgacccgctctacatcgatg

SEQ ID NO: 673194 - DNA, 25 bp, Artificial sequence
  Synthetic oligonucleotide
tgctgaccgatgacccgctctacat

SEQ ID NO: 673195 - DNA, 25 bp, Artificial sequence
  Synthetic oligonucleotide
acctgatgctgaccgatgacccgct

SEQ ID NO: 673196 - DNA, 25 bp, Artificial sequence
  Synthetic oligonucleotide
gcaactacctgatgctgaccgatga

SEQ ID NO: 673197 - DNA, 25 bp, Artificial sequence
  Synthetic oligonucleotide
acctcggcaactacctgatgctgac

SEQ ID NO: 673198 - DNA, 25 bp, Artificial sequence
  Synthetic oligonucleotide
cctcaacctcggcaactacctgatg

SEQ ID NO: 673199 - DNA, 25 bp, Artificial sequence
  Synthetic oligonucleotide
aggtgctcctcaacctcggcaacta

SEQ ID NO: 673200 - DNA, 25 bp, Artificial sequence
  Synthetic oligonucleotide
gatcatgatgccgacctggacggcg

SEQ ID NO: 673201 - DNA, 25 bp, Artificial sequence
  Synthetic oligonucleotide
accagcagttgcaggtgctcctcaa

SEQ ID NO: 673202 - DNA, 25 bp, Artificial sequence
  Synthetic oligonucleotide
gcctacctcggctcgctgaagatgg

SEQ ID NO: 673203 - DNA, 25 bp, Artificial sequence
  Synthetic oligonucleotide
tcgcctacgcggaccagcagttgca

SEQ ID NO: 673204 - DNA, 25 bp, Artificial sequence
  Synthetic oligonucleotide
gatcttcgcctacgcggaccagcag

SEQ ID NO: 673205 - DNA, 25 bp, Artificial sequence
  Synthetic oligonucleotide
taccgagatcttcgcctacgcggac

SEQ ID NO: 673206 - DNA, 25 bp, Artificial sequence
  Synthetic oligonucleotide
ccctataccgagatcttcgcctacg

SEQ ID NO: 673207 - DNA, 25 bp, Artificial sequence
  Synthetic oligonucleotide
atcccgccctataccgagatcttcg

SEQ ID NO: 673208 - DNA, 25 bp, Artificial sequence
  Synthetic oligonucleotide
gtggccatcccgccctataccgaga

SEQ ID NO: 673209 - DNA, 25 bp, Artificial sequence
  Synthetic oligonucleotide
agcggacgtggccatcccgccctat

SEQ ID NO: 673210 - DNA, 25 bp, Artificial sequence
  Synthetic oligonucleotide
tggcggaagcggacgtggccatccc

SEQ ID NO: 673211 - DNA, 25 bp, Artificial sequence
  Synthetic oligonucleotide
cagttgcaggtgctcctcaacctcg

SEQ ID NO: 673212 - DNA, 25 bp, Artificial sequence
  Synthetic oligonucleotide
tgggctacccgatggcctacgccat

SEQ ID NO: 673213 - DNA, 25 bp, Artificial sequence
  Synthetic oligonucleotide
ggtagcgtgaccgggctcaacgact

SEQ ID NO: 673214 - DNA, 25 bp, Artificial sequence
  Synthetic oligonucleotide
tcctgctgctgctgatcatgatgcc

SEQ ID NO: 673215 - DNA, 25 bp, Artificial sequence
  Synthetic oligonucleotide
cagaccgtcctgctgctgctgatca

SEQ ID NO: 673216 - DNA, 25 bp, Artificial sequence
  Synthetic oligonucleotide
tcctcgcagaccgtcctgctgctgc

SEQ ID NO: 673217 - DNA, 25 bp, Artificial sequence
  Synthetic oligonucleotide
agccagtcctcgcagaccgtcctgc

SEQ ID NO: 673218 - DNA, 25 bp, Artificial sequence
  Synthetic oligonucleotide
cgctccagccagtcctcgcagaccg

SEQ ID NO: 673219 - DNA, 25 bp, Artificial sequence
  Synthetic oligonucleotide
atcgcccgctccagccagtcctcgc

SEQ ID NO: 673220 - DNA, 25 bp, Artificial sequence
  Synthetic oligonucleotide
tacgccatcgcccgctccagccagt

SEQ ID NO: 673221 - DNA, 25 bp, Artificial sequence
  Synthetic oligonucleotide
ctctacatcgatgcctacctcggct

SEQ ID NO: 673222 - DNA, 25 bp, Artificial sequence
  Synthetic oligonucleotide
acccgatggcctacgccatcgcccg

SEQ ID NO: 673223 - DNA, 25 bp, Artificial sequence
  Synthetic oligonucleotide
atcgatgcctacctcggctcgctga

SEQ ID NO: 673224 - DNA, 25 bp, Artificial sequence
  Synthetic oligonucleotide
tgctggtgggctacccgatggccta

SEQ ID NO: 673225 - DNA, 25 bp, Artificial sequence
  Synthetic oligonucleotide
tctgcctgctggtgggctacccgat

SEQ ID NO: 673226 - DNA, 25 bp, Artificial sequence
  Synthetic oligonucleotide
accctgatctgcctgctggtgggct

SEQ ID NO: 673227 - DNA, 25 bp, Artificial sequence
  Synthetic oligonucleotide
atcagtaccctgatctgcctgctgg

SEQ ID NO: 673228 - DNA, 25 bp, Artificial sequence
  Synthetic oligonucleotide
ggccttcatcagtaccctgatctgc

SEQ ID NO: 673229 - DNA, 25 bp, Artificial sequence
  Synthetic oligonucleotide
aagatggccttcatcagtaccctga

SEQ ID NO: 673230 - DNA, 25 bp, Artificial sequence
  Synthetic oligonucleotide
tcgctgaagatggccttcatcagta

SEQ ID NO: 673231 - DNA, 25 bp, Artificial sequence
  Synthetic oligonucleotide
ctcggctcgctgaagatggccttca

SEQ ID NO: 673232 - DNA, 25 bp, Artificial sequence
  Synthetic oligonucleotide
tcgtgctgaagatcagcctggcgga

SEQ ID NO: 673233 - DNA, 25 bp, Artificial sequence
  Synthetic oligonucleotide
tggcctacgccatcgcccgctccag

SEQ ID NO: 673234 - DNA, 25 bp, Artificial sequence
  Synthetic oligonucleotide
cgagcgccacgtcgcccggccgacc

SEQ ID NO: 673235 - DNA, 25 bp, Artificial sequence
  Synthetic oligonucleotide
tcagcctggcggaagcggacgtggc

SEQ ID NO: 673236 - DNA, 25 bp, Artificial sequence
  Synthetic oligonucleotide
acgacgacagcggcgtggtactgca

SEQ ID NO: 673237 - DNA, 25 bp, Artificial sequence
  Synthetic oligonucleotide
gctggtacgacgacagcggcgtggt

SEQ ID NO: 673238 - DNA, 25 bp, Artificial sequence
  Synthetic oligonucleotide
acatcagctggtacgacgacagcgg

SEQ ID NO: 673239 - DNA, 25 bp, Artificial sequence
  Synthetic oligonucleotide
cggtgtacatcagctggtacgacga

SEQ ID NO: 673240 - DNA, 25 bp, Artificial sequence
  Synthetic oligonucleotide
accagtcggtgtacatcagctggta

SEQ ID NO: 673241 - DNA, 25 bp, Artificial sequence
  Synthetic oligonucleotide
cctgggaccagtcggtgtacatcag

SEQ ID NO: 673242 - DNA, 25 bp, Artificial sequence
  Synthetic oligonucleotide
ggccgacctgggaccagtcggtgta

SEQ ID NO: 673243 - DNA, 25 bp, Artificial sequence
  Synthetic oligonucleotide
gcgtggtactgcagtcatgaaattc

SEQ ID NO: 673244 - DNA, 25 bp, Artificial sequence
  Synthetic oligonucleotide
gccacgtcgcccggccgacctggga

SEQ ID NO: 673245 - DNA, 25 bp, Artificial sequence
  Synthetic oligonucleotide
tactgcagtcatgaaattcgccaac

SEQ ID NO: 673246 - DNA, 25 bp, Artificial sequence
  Synthetic oligonucleotide
aacgccgagcgccacgtcgcccggc

SEQ ID NO: 673247 - DNA, 25 bp, Artificial sequence
  Synthetic oligonucleotide
atggccaacgccgagcgccacgtcg

SEQ ID NO: 673248 - DNA, 25 bp, Artificial sequence
  Synthetic oligonucleotide
gccttcatggccaacgccgagcgcc

SEQ ID NO: 673249 - DNA, 25 bp, Artificial sequence
  Synthetic oligonucleotide
tccaggccttcatggccaacgccga

SEQ ID NO: 673250 - DNA, 25 bp, Artificial sequence
  Synthetic oligonucleotide
tgatcgtccaggccttcatggccaa

SEQ ID NO: 673251 - DNA, 25 bp, Artificial sequence
  Synthetic oligonucleotide
ccgggatgatcgtccaggccttcat

SEQ ID NO: 673252 - DNA, 25 bp, Artificial sequence
  Synthetic oligonucleotide
tggcgtccgggatgatcgtccaggc

SEQ ID NO: 673253 - DNA, 25 bp, Artificial sequence
  Synthetic oligonucleotide
tcaagctggcgtccgggatgatcgt

SEQ ID NO: 673254 - DNA, 25 bp, Artificial sequence
  Synthetic oligonucleotide
actacatcaagctggcgtccgggat

SEQ ID NO: 673255 - DNA, 25 bp, Artificial sequence
  Synthetic oligonucleotide
tcgcccggccgacctgggaccagtc

SEQ ID NO: 673256 - DNA, 25 bp, Artificial sequence
  Synthetic oligonucleotide
cggtcatcggggtgccgttcctgtg

SEQ ID NO: 673257 - DNA, 25 bp, Artificial sequence
  Synthetic oligonucleotide
gatgccgacctggacggcgatcctg

SEQ ID NO: 673258 - DNA, 25 bp, Artificial sequence
  Synthetic oligonucleotide
tcgccatcgtgctgaagatcagcct

SEQ ID NO: 673259 - DNA, 25 bp, Artificial sequence
  Synthetic oligonucleotide
gcccttcgccatcgtgctgaagatc

SEQ ID NO: 673260 - DNA, 25 bp, Artificial sequence
  Synthetic oligonucleotide
cctgctgcccttcgccatcgtgctg

SEQ ID NO: 673261 - DNA, 25 bp, Artificial sequence
  Synthetic oligonucleotide
gttcttcctgctgcccttcgccatc

SEQ ID NO: 673262 - DNA, 25 bp, Artificial sequence
  Synthetic oligonucleotide
ttcctgttcttcctgctgcccttcg

SEQ ID NO: 673263 - DNA, 25 bp, Artificial sequence
  Synthetic oligonucleotide
tggctcttcctgttcttcctgctgc

SEQ ID NO: 673264 - DNA, 25 bp, Artificial sequence
  Synthetic oligonucleotide
tcctgtggctcttcctgttcttcct

SEQ ID NO: 673265 - DNA, 25 bp, Artificial sequence
  Synthetic oligonucleotide
acagcggcgtggtactgcagtcatg

SEQ ID NO: 673266 - DNA, 25 bp, Artificial sequence
  Synthetic oligonucleotide
tcggggtgccgttcctgtggctctt

SEQ ID NO: 673267 - DNA, 25 bp, Artificial sequence
  Synthetic oligonucleotide
tgaagatcagcctggcggaagcgga

SEQ ID NO: 673268 - DNA, 25 bp, Artificial sequence
  Synthetic oligonucleotide
ggcatgcggtcatcggggtgccgtt

SEQ ID NO: 673269 - DNA, 25 bp, Artificial sequence
  Synthetic oligonucleotide
ccgggcggcatgcggtcatcggggt

SEQ ID NO: 673270 - DNA, 25 bp, Artificial sequence
  Synthetic oligonucleotide
tgcccaccgggcggcatgcggtcat

SEQ ID NO: 673271 - DNA, 25 bp, Artificial sequence
  Synthetic oligonucleotide
agcgcatgcccaccgggcggcatgc

SEQ ID NO: 673272 - DNA, 25 bp, Artificial sequence
  Synthetic oligonucleotide
gaaaaagcgcatgcccaccgggcgg

SEQ ID NO: 673273 - DNA, 25 bp, Artificial sequence
  Synthetic oligonucleotide
agcctgaaaaagcgcatgcccaccg

SEQ ID NO: 673274 - DNA, 25 bp, Artificial sequence
  Synthetic oligonucleotide
gccaacagcctgaaaaagcgcatgc

SEQ ID NO: 673275 - DNA, 25 bp, Artificial sequence
  Synthetic oligonucleotide
gaaattcgccaacagcctgaaaaag

SEQ ID NO: 673276 - DNA, 25 bp, Artificial sequence
  Synthetic oligonucleotide
agtcatgaaattcgccaacagcctg

SEQ ID NO: 673277 - DNA, 25 bp, Artificial sequence
  Synthetic oligonucleotide
tgccgttcctgtggctcttcctgtt

SEQ ID NO: 673278 - DNA, 25 bp, Artificial sequence
  Synthetic oligonucleotide
gctggtgttcatcccggcggtgggc

SEQ ID NO: 673279 - DNA, 25 bp, Artificial sequence
  Synthetic oligonucleotide
gaccctgatgatcggcaaggtgctc

SEQ ID NO: 673280 - DNA, 25 bp, Artificial sequence
  Synthetic oligonucleotide
cccgagaccctgatgatcggcaagg

SEQ ID NO: 673281 - DNA, 25 bp, Artificial sequence
  Synthetic oligonucleotide
ggcggccccgagaccctgatgatcg

SEQ ID NO: 673282 - DNA, 25 bp, Artificial sequence
  Synthetic oligonucleotide
ctgctcggcggccccgagaccctga

SEQ ID NO: 673283 - DNA, 25 bp, Artificial sequence
  Synthetic oligonucleotide
ccggaactgctcggcggccccgaga

SEQ ID NO: 673284 - DNA, 25 bp, Artificial sequence
  Synthetic oligonucleotide
gtcatcccggaactgctcggcggcc

SEQ ID NO: 673285 - DNA, 25 bp, Artificial sequence
  Synthetic oligonucleotide
gagttcgtcatcccggaactgctcg

SEQ ID NO: 673286 - DNA, 25 bp, Artificial sequence
  Synthetic oligonucleotide
gtgggcgagttcgtcatcccggaac

SEQ ID NO: 673287 - DNA, 25 bp, Artificial sequence
  Synthetic oligonucleotide
gctgctgatcatgatgccgacctgg

SEQ ID NO: 673288 - DNA, 25 bp, Artificial sequence
  Synthetic oligonucleotide
ttcatcccggcggtgggcgagttcg

SEQ ID NO: 673289 - DNA, 25 bp, Artificial sequence
  Synthetic oligonucleotide
ggtgctctggcaggagttcttcaac

SEQ ID NO: 673290 - DNA, 25 bp, Artificial sequence
  Synthetic oligonucleotide
ctgcatgctggtgttcatcccggcg

SEQ ID NO: 673291 - DNA, 25 bp, Artificial sequence
  Synthetic oligonucleotide
cgccggctgcatgctggtgttcatc

SEQ ID NO: 673292 - DNA, 25 bp, Artificial sequence
  Synthetic oligonucleotide
catcatcgccggctgcatgctggtg

SEQ ID NO: 673293 - DNA, 25 bp, Artificial sequence
  Synthetic oligonucleotide
gaacggcatcatcgccggctgcatg

SEQ ID NO: 673294 - DNA, 25 bp, Artificial sequence
  Synthetic oligonucleotide
tcgaagaacggcatcatcgccggct

SEQ ID NO: 673295 - DNA, 25 bp, Artificial sequence
  Synthetic oligonucleotide
ccgctgtcgaagaacggcatcatcg

SEQ ID NO: 673296 - DNA, 25 bp, Artificial sequence
  Synthetic oligonucleotide
accgtgccgctgtcgaagaacggca

SEQ ID NO: 673297 - DNA, 25 bp, Artificial sequence
  Synthetic oligonucleotide
aagatcaccgtgccgctgtcgaaga

SEQ ID NO: 673298 - DNA, 25 bp, Artificial sequence
  Synthetic oligonucleotide
ccggcggtgggcgagttcgtcatcc

SEQ ID NO: 673299 - DNA, 25 bp, Artificial sequence
  Synthetic oligonucleotide
cggtggtgatgctggcgatcctgat

SEQ ID NO: 673300 - DNA, 25 bp, Artificial sequence
  Synthetic oligonucleotide
caaagaactggagggcaaggtatga

SEQ ID NO: 673301 - DNA, 25 bp, Artificial sequence
  Synthetic oligonucleotide
ccaggccaaagaactggagggcaag

SEQ ID NO: 673302 - DNA, 25 bp, Artificial sequence
  Synthetic oligonucleotide
aagaaccaggccaaagaactggagg

SEQ ID NO: 673303 - DNA, 25 bp, Artificial sequence
  Synthetic oligonucleotide
ttcaacaagaaccaggccaaagaac

SEQ ID NO: 673304 - DNA, 25 bp, Artificial sequence
  Synthetic oligonucleotide
atcctgttcaacaagaaccaggcca

SEQ ID NO: 673305 - DNA, 25 bp, Artificial sequence
  Synthetic oligonucleotide
ccgatcatcctgttcaacaagaacc

SEQ ID NO: 673306 - DNA, 25 bp, Artificial sequence
  Synthetic oligonucleotide
tcatcccgatcatcctgttcaacaa

SEQ ID NO: 673307 - DNA, 25 bp, Artificial sequence
  Synthetic oligonucleotide
tcctgatcatcccgatcatcctgtt

SEQ ID NO: 673308 - DNA, 25 bp, Artificial sequence
  Synthetic oligonucleotide
gatgatcggcaaggtgctctggcag

SEQ ID NO: 673309 - DNA, 25 bp, Artificial sequence
  Synthetic oligonucleotide
tgatgctggcgatcctgatcatccc

SEQ ID NO: 673310 - DNA, 25 bp, Artificial sequence
  Synthetic oligonucleotide
cggcaaggtgctctggcaggagttc

SEQ ID NO: 673311 - DNA, 25 bp, Artificial sequence
  Synthetic oligonucleotide
ccctggcggtggtgatgctggcgat

SEQ ID NO: 673312 - DNA, 25 bp, Artificial sequence
  Synthetic oligonucleotide
cgtccgccctggcggtggtgatgct

SEQ ID NO: 673313 - DNA, 25 bp, Artificial sequence
  Synthetic oligonucleotide
cggtggcgtccgccctggcggtggt

SEQ ID NO: 673314 - DNA, 25 bp, Artificial sequence
  Synthetic oligonucleotide
gactggccggtggcgtccgccctgg

SEQ ID NO: 673315 - DNA, 25 bp, Artificial sequence
  Synthetic oligonucleotide
aaccgcgactggccggtggcgtccg

SEQ ID NO: 673316 - DNA, 25 bp, Artificial sequence
  Synthetic oligonucleotide
ttcaacaaccgcgactggccggtgg

SEQ ID NO: 673317 - DNA, 25 bp, Artificial sequence
  Synthetic oligonucleotide
ggagttcttcaacaaccgcgactgg

SEQ ID NO: 673318 - DNA, 25 bp, Artificial sequence
  Synthetic oligonucleotide
ctggcaggagttcttcaacaaccgc

SEQ ID NO: 673319 - DNA, 25 bp, Artificial sequence
  Synthetic oligonucleotide
aacttcaccagcttctggaagatca

SEQ ID NO: 673320 - DNA, 25 bp, Artificial sequence
  Synthetic oligonucleotide
tggcgatcctgatcatcccgatcat

SEQ ID NO: 673321 - DNA, 25 bp, Artificial sequence
  Synthetic oligonucleotide
aacggcctgctaaacagcgtactga

SEQ ID NO: 673322 - DNA, 25 bp, Artificial sequence
  Synthetic oligonucleotide
ttctggaagatcaccgtgccgctgt

SEQ ID NO: 673323 - DNA, 25 bp, Artificial sequence
  Synthetic oligonucleotide
accatcctcaataccaacatcgcgg

SEQ ID NO: 673324 - DNA, 25 bp, Artificial sequence
  Synthetic oligonucleotide
ccgctgaccatcctcaataccaaca

SEQ ID NO: 673325 - DNA, 25 bp, Artificial sequence
  Synthetic oligonucleotide
agcgagccgctgaccatcctcaata

SEQ ID NO: 673326 - DNA, 25 bp, Artificial sequence
  Synthetic oligonucleotide
gctcatcagcgagccgctgaccatc

SEQ ID NO: 673327 - DNA, 25 bp, Artificial sequence
  Synthetic oligonucleotide
ctggggctcatcagcgagccgctga

SEQ ID NO: 673328 - DNA, 25 bp, Artificial sequence
  Synthetic oligonucleotide
atggggctggggctcatcagcgagc

SEQ ID NO: 673329 - DNA, 25 bp, Artificial sequence
  Synthetic oligonucleotide
gtactgatggggctggggctcatca

SEQ ID NO: 673330 - DNA, 25 bp, Artificial sequence
  Synthetic oligonucleotide
accaacatcgcggtgtacatcggca

SEQ ID NO: 673331 - DNA, 25 bp, Artificial sequence
  Synthetic oligonucleotide
ctgctaaacagcgtactgatggggc

SEQ ID NO: 673332 - DNA, 25 bp, Artificial sequence
  Synthetic oligonucleotide
atcgcggtgtacatcggcatcgtct

SEQ ID NO: 673333 - DNA, 25 bp, Artificial sequence
  Synthetic oligonucleotide
tccaacaacggcctgctaaacagcg

SEQ ID NO: 673334 - DNA, 25 bp, Artificial sequence
  Synthetic oligonucleotide
atcctttccaacaacggcctgctaa

SEQ ID NO: 673335 - DNA, 25 bp, Artificial sequence
  Synthetic oligonucleotide
atgggcatcctttccaacaacggcc

SEQ ID NO: 673336 - DNA, 25 bp, Artificial sequence
  Synthetic oligonucleotide
gcctggatgggcatcctttccaaca

SEQ ID NO: 673337 - DNA, 25 bp, Artificial sequence
  Synthetic oligonucleotide
ggtctatgcctggatgggcatcctt

SEQ ID NO: 673338 - DNA, 25 bp, Artificial sequence
  Synthetic oligonucleotide
gatccgggtctatgcctggatgggc

SEQ ID NO: 673339 - DNA, 25 bp, Artificial sequence
  Synthetic oligonucleotide
gatcctgatccgggtctatgcctgg

SEQ ID NO: 673340 - DNA, 25 bp, Artificial sequence
  Synthetic oligonucleotide
gacggcgatcctgatccgggtctat

SEQ ID NO: 673341 - DNA, 25 bp, Artificial sequence
  Synthetic oligonucleotide
gacctggacggcgatcctgatccgg

SEQ ID NO: 673342 - DNA, 25 bp, Artificial sequence
  Synthetic oligonucleotide
aaacagcgtactgatggggctgggg

SEQ ID NO: 673343 - DNA, 25 bp, Artificial sequence
  Synthetic oligonucleotide
ccaacctggtgaagcacgacccgag

SEQ ID NO: 673344 - DNA, 25 bp, Artificial sequence
  Synthetic oligonucleotide
ttggcggccactcggtgtactacat

SEQ ID NO: 673345 - DNA, 25 bp, Artificial sequence
  Synthetic oligonucleotide
gcgcgtaacttcaccagcttctgga

SEQ ID NO: 673346 - DNA, 25 bp, Artificial sequence
  Synthetic oligonucleotide
ctgggcgcgcgtaacttcaccagct

SEQ ID NO: 673347 - DNA, 25 bp, Artificial sequence
  Synthetic oligonucleotide
ttccgacctgggcgcgcgtaacttc

SEQ ID NO: 673348 - DNA, 25 bp, Artificial sequence
  Synthetic oligonucleotide
ggccgcttccgacctgggcgcgcgt

SEQ ID NO: 673349 - DNA, 25 bp, Artificial sequence
  Synthetic oligonucleotide
gctggaggccgcttccgacctgggc

SEQ ID NO: 673350 - DNA, 25 bp, Artificial sequence
  Synthetic oligonucleotide
gagcctgctggaggccgcttccgac

SEQ ID NO: 673351 - DNA, 25 bp, Artificial sequence
  Synthetic oligonucleotide
gacccgagcctgctggaggccgctt

SEQ ID NO: 673352 - DNA, 25 bp, Artificial sequence
  Synthetic oligonucleotide
ctcaataccaacatcgcggtgtaca

SEQ ID NO: 673353 - DNA, 25 bp, Artificial sequence
  Synthetic oligonucleotide
tggtgaagcacgacccgagcctgct

SEQ ID NO: 673354 - DNA, 25 bp, Artificial sequence
  Synthetic oligonucleotide
accagcttctggaagatcaccgtgc

SEQ ID NO: 673355 - DNA, 25 bp, Artificial sequence
  Synthetic oligonucleotide
tctacgccaacctggtgaagcacga

SEQ ID NO: 673356 - DNA, 25 bp, Artificial sequence
  Synthetic oligonucleotide
tgccgctctacgccaacctggtgaa

SEQ ID NO: 673357 - DNA, 25 bp, Artificial sequence
  Synthetic oligonucleotide
atgatcctgccgctctacgccaacc

SEQ ID NO: 673358 - DNA, 25 bp, Artificial sequence
  Synthetic oligonucleotide
ccgttcatgatcctgccgctctacg

SEQ ID NO: 673359 - DNA, 25 bp, Artificial sequence
  Synthetic oligonucleotide
tacctgccgttcatgatcctgccgc

SEQ ID NO: 673360 - DNA, 25 bp, Artificial sequence
  Synthetic oligonucleotide
tattcctacctgccgttcatgatcc

SEQ ID NO: 673361 - DNA, 25 bp, Artificial sequence
  Synthetic oligonucleotide
atcgtctattcctacctgccgttca

SEQ ID NO: 673362 - DNA, 25 bp, Artificial sequence
  Synthetic oligonucleotide
atcggcatcgtctattcctacctgc

SEQ ID NO: 673363 - DNA, 25 bp, Artificial sequence
  Synthetic oligonucleotide
gtgtacatcggcatcgtctattcct

SEQ ID NO: 673364 - DNA, 25 bp, Artificial sequence
  Synthetic oligonucleotide
aagcacgacccgagcctgctggagg

SEQ ID NO: 673365 - DNA, 25 bp, Artificial sequence
  Synthetic oligonucleotide
gcggccgatcaacatgatgttccag

SEQ ID NO: 673366 - DNA, 25 bp, Artificial sequence
  Synthetic oligonucleotide
gaacatcgccttcggcctcaagcag

SEQ ID NO: 673367 - DNA, 25 bp, Artificial sequence
  Synthetic oligonucleotide
ggcgcagaacatcgccttcggcctc

SEQ ID NO: 673368 - DNA, 25 bp, Artificial sequence
  Synthetic oligonucleotide
agcgtggcgcagaacatcgccttcg

SEQ ID NO: 673369 - DNA, 25 bp, Artificial sequence
  Synthetic oligonucleotide
cacatgagcgtggcgcagaacatcg

SEQ ID NO: 673370 - DNA, 25 bp, Artificial sequence
  Synthetic oligonucleotide
ttcccgcacatgagcgtggcgcaga

SEQ ID NO: 673371 - DNA, 25 bp, Artificial sequence
  Synthetic oligonucleotide
gcgctgttcccgcacatgagcgtgg

SEQ ID NO: 673372 - DNA, 25 bp, Artificial sequence
  Synthetic oligonucleotide
tcctatgcgctgttcccgcacatga

SEQ ID NO: 673373 - DNA, 25 bp, Artificial sequence
  Synthetic oligonucleotide
gttccagtcctatgcgctgttcccg

SEQ ID NO: 673374 - DNA, 25 bp, Artificial sequence
  Synthetic oligonucleotide
cggtgtactacatcaagctggcgtc

SEQ ID NO: 673375 - DNA, 25 bp, Artificial sequence
  Synthetic oligonucleotide
gatcaacatgatgttccagtcctat

SEQ ID NO: 673376 - DNA, 25 bp, Artificial sequence
  Synthetic oligonucleotide
ctcaagcaggacggcctgcccaagg

SEQ ID NO: 673377 - DNA, 25 bp, Artificial sequence
  Synthetic oligonucleotide
ctacgagcggccgatcaacatgatg

SEQ ID NO: 673378 - DNA, 25 bp, Artificial sequence
  Synthetic oligonucleotide
gccgccctacgagcggccgatcaac

SEQ ID NO: 673379 - DNA, 25 bp, Artificial sequence
  Synthetic oligonucleotide
gacctgccgccctacgagcggccga

SEQ ID NO: 673380 - DNA, 25 bp, Artificial sequence
  Synthetic oligonucleotide
atcaccgacctgccgccctacgagc

SEQ ID NO: 673381 - DNA, 25 bp, Artificial sequence
  Synthetic oligonucleotide
caggacatcaccgacctgccgccct

SEQ ID NO: 673382 - DNA, 25 bp, Artificial sequence
  Synthetic oligonucleotide
gatggccaggacatcaccgacctgc

SEQ ID NO: 673383 - DNA, 25 bp, Artificial sequence
  Synthetic oligonucleotide
tcctcgatggccaggacatcaccga

SEQ ID NO: 673384 - DNA, 25 bp, Artificial sequence
  Synthetic oligonucleotide
ggatcttcctcgatggccaggacat

SEQ ID NO: 673385 - DNA, 25 bp, Artificial sequence
  Synthetic oligonucleotide
catgatgttccagtcctatgcgctg

SEQ ID NO: 673386 - DNA, 25 bp, Artificial sequence
  Synthetic oligonucleotide
tcaagctggtgcacatgacccagta

SEQ ID NO: 673387 - DNA, 25 bp, Artificial sequence
  Synthetic oligonucleotide
agcgccagcgggtggccctggctcg

SEQ ID NO: 673388 - DNA, 25 bp, Artificial sequence
  Synthetic oligonucleotide
ggcggccagcgccagcgggtggccc

SEQ ID NO: 673389 - DNA, 25 bp, Artificial sequence
  Synthetic oligonucleotide
ctctccggcggccagcgccagcggg

SEQ ID NO: 673390 - DNA, 25 bp, Artificial sequence
  Synthetic oligonucleotide
caccagctctccggcggccagcgcc

SEQ ID NO: 673391 - DNA, 25 bp, Artificial sequence
  Synthetic oligonucleotide
aagccgcaccagctctccggcggcc

SEQ ID NO: 673392 - DNA, 25 bp, Artificial sequence
  Synthetic oligonucleotide
aagcgcaagccgcaccagctctccg

SEQ ID NO: 673393 - DNA, 25 bp, Artificial sequence
  Synthetic oligonucleotide
tacgccaagcgcaagccgcaccagc

SEQ ID NO: 673394 - DNA, 25 bp, Artificial sequence
  Synthetic oligonucleotide
cccagtacgccaagcgcaagccgca

SEQ ID NO: 673395 - DNA, 25 bp, Artificial sequence
  Synthetic oligonucleotide
tcgccttcggcctcaagcaggacgg

SEQ ID NO: 673396 - DNA, 25 bp, Artificial sequence
  Synthetic oligonucleotide
tggtgcacatgacccagtacgccaa

SEQ ID NO: 673397 - DNA, 25 bp, Artificial sequence
  Synthetic oligonucleotide
ttcggcctcaagcaggacggcctgc

SEQ ID NO: 673398 - DNA, 25 bp, Artificial sequence
  Synthetic oligonucleotide
agatgctcaagctggtgcacatgac

SEQ ID NO: 673399 - DNA, 25 bp, Artificial sequence
  Synthetic oligonucleotide
tggccgagatgctcaagctggtgca

SEQ ID NO: 673400 - DNA, 25 bp, Artificial sequence
  Synthetic oligonucleotide
agcgcgtggccgagatgctcaagct

SEQ ID NO: 673401 - DNA, 25 bp, Artificial sequence
  Synthetic oligonucleotide
tcgacgagcgcgtggccgagatgct

SEQ ID NO: 673402 - DNA, 25 bp, Artificial sequence
  Synthetic oligonucleotide
ccgagatcgacgagcgcgtggccga

SEQ ID NO: 673403 - DNA, 25 bp, Artificial sequence
  Synthetic oligonucleotide
ccaaggccgagatcgacgagcgcgt

SEQ ID NO: 673404 - DNA, 25 bp, Artificial sequence
  Synthetic oligonucleotide
gcctgcccaaggccgagatcgacga

SEQ ID NO: 673405 - DNA, 25 bp, Artificial sequence
  Synthetic oligonucleotide
caggacggcctgcccaaggccgaga

SEQ ID NO: 673406 - DNA, 25 bp, Artificial sequence
  Synthetic oligonucleotide
gcggcccaccgaggggcggatcttc

SEQ ID NO: 673407 - DNA, 25 bp, Artificial sequence
  Synthetic oligonucleotide
acatgacccagtacgccaagcgcaa

SEQ ID NO: 673408 - DNA, 25 bp, Artificial sequence
  Synthetic oligonucleotide
agaaagccctagagggcaaccagca

SEQ ID NO: 673409 - DNA, 25 bp, Artificial sequence
  Synthetic oligonucleotide
aggggcggatcttcctcgatggcca

SEQ ID NO: 673410 - DNA, 25 bp, Artificial sequence
  Synthetic oligonucleotide
gggtaaccaagcagttcgacgagac

SEQ ID NO: 673411 - DNA, 25 bp, Artificial sequence
  Synthetic oligonucleotide
tcgaccgggtaaccaagcagttcga

SEQ ID NO: 673412 - DNA, 25 bp, Artificial sequence
  Synthetic oligonucleotide
taaagatcgaccgggtaaccaagca

SEQ ID NO: 673413 - DNA, 25 bp, Artificial sequence
  Synthetic oligonucleotide
tgctggtaaagatcgaccgggtaac

SEQ ID NO: 673414 - DNA, 25 bp, Artificial sequence
  Synthetic oligonucleotide
aagaggtgctggtaaagatcgaccg

SEQ ID NO: 673415 - DNA, 25 bp, Artificial sequence
  Synthetic oligonucleotide
agccgaaagaggtgctggtaaagat

SEQ ID NO: 673416 - DNA, 25 bp, Artificial sequence
  Synthetic oligonucleotide
accagcagccgaaagaggtgctggt

SEQ ID NO: 673417 - DNA, 25 bp, Artificial sequence
  Synthetic oligonucleotide
agttcgacgagacgctggcggtgga

SEQ ID NO: 673418 - DNA, 25 bp, Artificial sequence
  Synthetic oligonucleotide
ccctagagggcaaccagcagccgaa

SEQ ID NO: 673419 - DNA, 25 bp, Artificial sequence
  Synthetic oligonucleotide
acgagacgctggcggtggacaccgt

SEQ ID NO: 673420 - DNA, 25 bp, Artificial sequence
  Synthetic oligonucleotide
gcctacaagaaagccctagagggca

SEQ ID NO: 673421 - DNA, 25 bp, Artificial sequence
  Synthetic oligonucleotide
ccggtgcctacaagaaagccctaga

SEQ ID NO: 673422 - DNA, 25 bp, Artificial sequence
  Synthetic oligonucleotide
tagcctccggtgcctacaagaaagc

SEQ ID NO: 673423 - DNA, 25 bp, Artificial sequence
  Synthetic oligonucleotide
tggcgatagcctccggtgcctacaa

SEQ ID NO: 673424 - DNA, 25 bp, Artificial sequence
  Synthetic oligonucleotide
ggtaatggcgatagcctccggtgcc

SEQ ID NO: 673425 - DNA, 25 bp, Artificial sequence
  Synthetic oligonucleotide
agttgtggtaatggcgatagcctcc

SEQ ID NO: 673426 - DNA, 25 bp, Artificial sequence
  Synthetic oligonucleotide
cttgggagttgtggtaatggcgata

SEQ ID NO: 673427 - DNA, 25 bp, Artificial sequence
  Synthetic oligonucleotide
caacgacttgggagttgtggtaatg

SEQ ID NO: 673428 - DNA, 25 bp, Artificial sequence
  Synthetic oligonucleotide
agctggacaagagcaagctgccgaa

SEQ ID NO: 673429 - DNA, 25 bp, Artificial sequence
  Synthetic oligonucleotide
agggcaaccagcagccgaaagaggt

SEQ ID NO: 673430 - DNA, 25 bp, Artificial sequence
  Synthetic oligonucleotide
ctgctcggcggctccggctcgggta

SEQ ID NO: 673431 - DNA, 25 bp, Artificial sequence
  Synthetic oligonucleotide
tggctcgttcgctggccaagcggcc

SEQ ID NO: 673432 - DNA, 25 bp, Artificial sequence
  Synthetic oligonucleotide
ttcgagcggcccaccgaggggcgga

SEQ ID NO: 673433 - DNA, 25 bp, Artificial sequence
  Synthetic oligonucleotide
cgccggtttcgagcggcccaccgag

SEQ ID NO: 673434 - DNA, 25 bp, Artificial sequence
  Synthetic oligonucleotide
catgctcgccggtttcgagcggccc

SEQ ID NO: 673435 - DNA, 25 bp, Artificial sequence
  Synthetic oligonucleotide
gttacgcatgctcgccggtttcgag

SEQ ID NO: 673436 - DNA, 25 bp, Artificial sequence
  Synthetic oligonucleotide
accctgttacgcatgctcgccggtt

SEQ ID NO: 673437 - DNA, 25 bp, Artificial sequence
  Synthetic oligonucleotide
aaatccaccctgttacgcatgctcg

SEQ ID NO: 673438 - DNA, 25 bp, Artificial sequence
  Synthetic oligonucleotide
tcgggtaaatccaccctgttacgca

SEQ ID NO: 673439 - DNA, 25 bp, Artificial sequence
  Synthetic oligonucleotide
ccaagcagttcgacgagacgctggc

SEQ ID NO: 673440 - DNA, 25 bp, Artificial sequence
  Synthetic oligonucleotide
ggcggctccggctcgggtaaatcca

SEQ ID NO: 673441 - DNA, 25 bp, Artificial sequence
  Synthetic oligonucleotide
caccgaggggcggatcttcctcgat

SEQ ID NO: 673442 - DNA, 25 bp, Artificial sequence
  Synthetic oligonucleotide
ttcgccctgctcggcggctccggct

SEQ ID NO: 673443 - DNA, 25 bp, Artificial sequence
  Synthetic oligonucleotide
gagatcttcgccctgctcggcggct

SEQ ID NO: 673444 - DNA, 25 bp, Artificial sequence
  Synthetic oligonucleotide
agggcgagatcttcgccctgctcgg

SEQ ID NO: 673445 - DNA, 25 bp, Artificial sequence
  Synthetic oligonucleotide
tcaacaagggcgagatcttcgccct

SEQ ID NO: 673446 - DNA, 25 bp, Artificial sequence
  Synthetic oligonucleotide
tgaccatcaacaagggcgagatctt

SEQ ID NO: 673447 - DNA, 25 bp, Artificial sequence
  Synthetic oligonucleotide
tgtccctgaccatcaacaagggcga

SEQ ID NO: 673448 - DNA, 25 bp, Artificial sequence
  Synthetic oligonucleotide
acaccgtgtccctgaccatcaacaa

SEQ ID NO: 673449 - DNA, 25 bp, Artificial sequence
  Synthetic oligonucleotide
cggtggacaccgtgtccctgaccat

SEQ ID NO: 673450 - DNA, 25 bp, Artificial sequence
  Synthetic oligonucleotide
cgctggcggtggacaccgtgtccct

SEQ ID NO: 673451 - DNA, 25 bp, Artificial sequence
  Synthetic oligonucleotide
ctccggctcgggtaaatccaccctg

SEQ ID NO: 673452 - DNA, 25 bp, Artificial sequence
  Synthetic oligonucleotide
atgcggtgatcgcctgcccgcagct

SEQ ID NO: 673453 - DNA, 25 bp, Artificial sequence
  Synthetic oligonucleotide
tgcgagttcatcggcaacgtcaacc

SEQ ID NO: 673454 - DNA, 25 bp, Artificial sequence
  Synthetic oligonucleotide
atcagcacccgcgccgaggacaagc

SEQ ID NO: 673455 - DNA, 25 bp, Artificial sequence
  Synthetic oligonucleotide
cacggcatcagcacccgcgccgagg

SEQ ID NO: 673456 - DNA, 25 bp, Artificial sequence
  Synthetic oligonucleotide
atcggccacggcatcagcacccgcg

SEQ ID NO: 673457 - DNA, 25 bp, Artificial sequence
  Synthetic oligonucleotide
atctacatcggccacggcatcagca

SEQ ID NO: 673458 - DNA, 25 bp, Artificial sequence
  Synthetic oligonucleotide
acccgatctacatcggccacggcat

SEQ ID NO: 673459 - DNA, 25 bp, Artificial sequence
  Synthetic oligonucleotide
tggagaacccgatctacatcggcca

SEQ ID NO: 673460 - DNA, 25 bp, Artificial sequence
  Synthetic oligonucleotide
cgcagctggagaacccgatctacat

SEQ ID NO: 673461 - DNA, 25 bp, Artificial sequence
  Synthetic oligonucleotide
ccgaggacaagcgcatcacctacgc

SEQ ID NO: 673462 - DNA, 25 bp, Artificial sequence
  Synthetic oligonucleotide
tgatcgcctgcccgcagctggagaa

SEQ ID NO: 673463 - DNA, 25 bp, Artificial sequence
  Synthetic oligonucleotide
acaagcgcatcacctacgcgctgcg

SEQ ID NO: 673464 - DNA, 25 bp, Artificial sequence
  Synthetic oligonucleotide
caggaccatgcggtgatcgcctgcc

SEQ ID NO: 673465 - DNA, 25 bp, Artificial sequence
  Synthetic oligonucleotide
gacgtgcaggaccatgcggtgatcg

SEQ ID NO: 673466 - DNA, 25 bp, Artificial sequence
  Synthetic oligonucleotide
gtggaggacgtgcaggaccatgcgg

SEQ ID NO: 673467 - DNA, 25 bp, Artificial sequence
  Synthetic oligonucleotide
gtgctggtggaggacgtgcaggacc

SEQ ID NO: 673468 - DNA, 25 bp, Artificial sequence
  Synthetic oligonucleotide
gacggcgtgctggtggaggacgtgc

SEQ ID NO: 673469 - DNA, 25 bp, Artificial sequence
  Synthetic oligonucleotide
ctgttcgacggcgtgctggtggagg

SEQ ID NO: 673470 - DNA, 25 bp, Artificial sequence
  Synthetic oligonucleotide
gtcaacctgttcgacggcgtgctgg

SEQ ID NO: 673471 - DNA, 25 bp, Artificial sequence
  Synthetic oligonucleotide
ggcaacgtcaacctgttcgacggcg

SEQ ID NO: 673472 - DNA, 25 bp, Artificial sequence
  Synthetic oligonucleotide
agcgggtggccctggctcgttcgct

SEQ ID NO: 673473 - DNA, 25 bp, Artificial sequence
  Synthetic oligonucleotide
cctgcccgcagctggagaacccgat

SEQ ID NO: 673474 - DNA, 25 bp, Artificial sequence
  Synthetic oligonucleotide
acaacctggaacacgccgggcacaa

SEQ ID NO: 673475 - DNA, 25 bp, Artificial sequence
  Synthetic oligonucleotide
gtgaccgggctcaacgacttgggag

SEQ ID NO: 673476 - DNA, 25 bp, Artificial sequence
  Synthetic oligonucleotide
cctaccttggcggccactcggtgta

SEQ ID NO: 673477 - DNA, 25 bp, Artificial sequence
  Synthetic oligonucleotide
acatcgcctaccttggcggccactc

SEQ ID NO: 673478 - DNA, 25 bp, Artificial sequence
  Synthetic oligonucleotide
tctacgacatcgcctaccttggcgg

SEQ ID NO: 673479 - DNA, 25 bp, Artificial sequence
  Synthetic oligonucleotide
gcaccgtctacgacatcgcctacct

SEQ ID NO: 673480 - DNA, 25 bp, Artificial sequence
  Synthetic oligonucleotide
cccagggcaccgtctacgacatcgc

SEQ ID NO: 673481 - DNA, 25 bp, Artificial sequence
  Synthetic oligonucleotide
actgggcccagggcaccgtctacga

SEQ ID NO: 673482 - DNA, 25 bp, Artificial sequence
  Synthetic oligonucleotide
ggcacaactgggcccagggcaccgt

SEQ ID NO: 673483 - DNA, 25 bp, Artificial sequence
  Synthetic oligonucleotide
acccgcgccgaggacaagcgcatca

SEQ ID NO: 673484 - DNA, 25 bp, Artificial sequence
  Synthetic oligonucleotide
tggaacacgccgggcacaactgggc

SEQ ID NO: 673485 - DNA, 25 bp, Artificial sequence
  Synthetic oligonucleotide
ctggtctgcgagttcatcggcaacg

SEQ ID NO: 673486 - DNA, 25 bp, Artificial sequence
  Synthetic oligonucleotide
agccggacaacctggaacacgccgg

SEQ ID NO: 673487 - DNA, 25 bp, Artificial sequence
  Synthetic oligonucleotide
cgcagaagccggacaacctggaaca

SEQ ID NO: 673488 - DNA, 25 bp, Artificial sequence
  Synthetic oligonucleotide
tcagcgcgcagaagccggacaacct

SEQ ID NO: 673489 - DNA, 25 bp, Artificial sequence
  Synthetic oligonucleotide
tgatgatcagcgcgcagaagccgga

SEQ ID NO: 673490 - DNA, 25 bp, Artificial sequence
  Synthetic oligonucleotide
agaaagtgatgatcagcgcgcagaa

SEQ ID NO: 673491 - DNA, 25 bp, Artificial sequence
  Synthetic oligonucleotide
ggccggagaaagtgatgatcagcgc

SEQ ID NO: 673492 - DNA, 25 bp, Artificial sequence
  Synthetic oligonucleotide
cgctgcggccggagaaagtgatgat

SEQ ID NO: 673493 - DNA, 25 bp, Artificial sequence
  Synthetic oligonucleotide
cctacgcgctgcggccggagaaagt

SEQ ID NO: 673494 - DNA, 25 bp, Artificial sequence
  Synthetic oligonucleotide
gcatcacctacgcgctgcggccgga

SEQ ID NO: 673495 - DNA, 25 bp, Artificial sequence
  Synthetic oligonucleotide
acgccgggcacaactgggcccaggg

SEQ ID NO: 673496 - DNA, 25 bp, Artificial sequence
  Synthetic oligonucleotide
gcgcgctggacaagaagctgcgctc

SEQ ID NO: 673497 - DNA, 25 bp, Artificial sequence
  Synthetic oligonucleotide
ttcatcggcaacgtcaacctgttcg

SEQ ID NO: 673498 - DNA, 25 bp, Artificial sequence
  Synthetic oligonucleotide
atcgagcgcgtcggcgtgacctgcg

SEQ ID NO: 673499 - DNA, 25 bp, Artificial sequence
  Synthetic oligonucleotide
gagatcatcgagcgcgtcggcgtga

SEQ ID NO: 673500 - DNA, 25 bp, Artificial sequence
  Synthetic oligonucleotide
ctggtggagatcatcgagcgcgtcg

SEQ ID NO: 673501 - DNA, 25 bp, Artificial sequence
  Synthetic oligonucleotide
ctggaactggtggagatcatcgagc

SEQ ID NO: 673502 - DNA, 25 bp, Artificial sequence
  Synthetic oligonucleotide
tgcaactggaactggtggagatcat

SEQ ID NO: 673503 - DNA, 25 bp, Artificial sequence
  Synthetic oligonucleotide
cgcagatgcaactggaactggtgga

SEQ ID NO: 673504 - DNA, 25 bp, Artificial sequence
  Synthetic oligonucleotide
tgcgctcgcagatgcaactggaact

SEQ ID NO: 673505 - DNA, 25 bp, Artificial sequence
  Synthetic oligonucleotide
gcgtgacctgcgtgatggtgaccca

SEQ ID NO: 673506 - DNA, 25 bp, Artificial sequence
  Synthetic oligonucleotide
tggacaagaagctgcgctcgcagat

SEQ ID NO: 673507 - DNA, 25 bp, Artificial sequence
  Synthetic oligonucleotide
cctgcgtgatggtgacccacgacca

SEQ ID NO: 673508 - DNA, 25 bp, Artificial sequence
  Synthetic oligonucleotide
cgatgggcgcgctggacaagaagct

SEQ ID NO: 673509 - DNA, 25 bp, Artificial sequence
  Synthetic oligonucleotide
acgagccgatgggcgcgctggacaa

SEQ ID NO: 673510 - DNA, 25 bp, Artificial sequence
  Synthetic oligonucleotide
tgctcgacgagccgatgggcgcgct

SEQ ID NO: 673511 - DNA, 25 bp, Artificial sequence
  Synthetic oligonucleotide
tgctgctgctcgacgagccgatggg

SEQ ID NO: 673512 - DNA, 25 bp, Artificial sequence
  Synthetic oligonucleotide
ccgaagctgctgctgctcgacgagc

SEQ ID NO: 673513 - DNA, 25 bp, Artificial sequence
  Synthetic oligonucleotide
aagcggccgaagctgctgctgctcg

SEQ ID NO: 673514 - DNA, 25 bp, Artificial sequence
  Synthetic oligonucleotide
ctggccaagcggccgaagctgctgc

SEQ ID NO: 673515 - DNA, 25 bp, Artificial sequence
  Synthetic oligonucleotide
gttcgctggccaagcggccgaagct

SEQ ID NO: 673516 - DNA, 25 bp, Artificial sequence
  Synthetic oligonucleotide
gccactcggtgtactacatcaagct

SEQ ID NO: 673517 - DNA, 25 bp, Artificial sequence
  Synthetic oligonucleotide
agaagctgcgctcgcagatgcaact

SEQ ID NO: 673518 - DNA, 25 bp, Artificial sequence
  Synthetic oligonucleotide
tcatgcacctgggctgcatcgagca

SEQ ID NO: 673519 - DNA, 25 bp, Artificial sequence
  Synthetic oligonucleotide
agccgcctggtctgcgagttcatcg

SEQ ID NO: 673520 - DNA, 25 bp, Artificial sequence
  Synthetic oligonucleotide
ccggcgagccgcctggtctgcgagt

SEQ ID NO: 673521 - DNA, 25 bp, Artificial sequence
  Synthetic oligonucleotide
cgagaccccggcgagccgcctggtc

SEQ ID NO: 673522 - DNA, 25 bp, Artificial sequence
  Synthetic oligonucleotide
acatctacgagaccccggcgagccg

SEQ ID NO: 673523 - DNA, 25 bp, Artificial sequence
  Synthetic oligonucleotide
gatggacatctacgagaccccggcg

SEQ ID NO: 673524 - DNA, 25 bp, Artificial sequence
  Synthetic oligonucleotide
cagcccgatggacatctacgagacc

SEQ ID NO: 673525 - DNA, 25 bp, Artificial sequence
  Synthetic oligonucleotide
gatcggcagcccgatggacatctac

SEQ ID NO: 673526 - DNA, 25 bp, Artificial sequence
  Synthetic oligonucleotide
tcgagcagatcggcagcccgatgga

SEQ ID NO: 673527 - DNA, 25 bp, Artificial sequence
  Synthetic oligonucleotide
cgcgtcggcgtgacctgcgtgatgg

SEQ ID NO: 673528 - DNA, 25 bp, Artificial sequence
  Synthetic oligonucleotide
acctgggctgcatcgagcagatcgg

SEQ ID NO: 673529 - DNA, 25 bp, Artificial sequence
  Synthetic oligonucleotide
ggccctggctcgttcgctggccaag

SEQ ID NO: 673530 - DNA, 25 bp, Artificial sequence
  Synthetic oligonucleotide
tcgccatcatgcacctgggctgcat

SEQ ID NO: 673531 - DNA, 25 bp, Artificial sequence
  Synthetic oligonucleotide
agcgcatcgccatcatgcacctggg

SEQ ID NO: 673532 - DNA, 25 bp, Artificial sequence
  Synthetic oligonucleotide
tggcccagcgcatcgccatcatgca

SEQ ID NO: 673533 - DNA, 25 bp, Artificial sequence
  Synthetic oligonucleotide
tgaccatggcccagcgcatcgccat

SEQ ID NO: 673534 - DNA, 25 bp, Artificial sequence
  Synthetic oligonucleotide
aggccatgaccatggcccagcgcat

SEQ ID NO: 673535 - DNA, 25 bp, Artificial sequence
  Synthetic oligonucleotide
aggaagaggccatgaccatggccca

SEQ ID NO: 673536 - DNA, 25 bp, Artificial sequence
  Synthetic oligonucleotide
acgaccaggaagaggccatgaccat

SEQ ID NO: 673537 - DNA, 25 bp, Artificial sequence
  Synthetic oligonucleotide
tgacccacgaccaggaagaggccat

SEQ ID NO: 673538 - DNA, 25 bp, Artificial sequence
  Synthetic oligonucleotide
tgatggtgacccacgaccaggaaga

SEQ ID NO: 673539 - DNA, 25 bp, Artificial sequence
  Synthetic oligonucleotide
gctgcatcgagcagatcggcagccc

SEQ ID NO: 673540 - DNA, 25 bp, Artificial sequence
  Synthetic oligonucleotide
tgaccaagcgcagcgacgaccccga

SEQ ID NO: 673541 - DNA, 25 bp, Artificial sequence
  Synthetic oligonucleotide
caggaaaccgggcgtcagtcgttct

SEQ ID NO: 673542 - DNA, 25 bp, Artificial sequence
  Synthetic oligonucleotide
cggacgccaggaaaccgggcgtcag

SEQ ID NO: 673543 - DNA, 25 bp, Artificial sequence
  Synthetic oligonucleotide
tgggccgctccggacgccaggaaac

SEQ ID NO: 673544 - DNA, 25 bp, Artificial sequence
  Synthetic oligonucleotide
cccggtgggccgctccggacgccag

SEQ ID NO: 673545 - DNA, 25 bp, Artificial sequence
  Synthetic oligonucleotide
gcaggccccggtgggccgctccgga

SEQ ID NO: 673546 - DNA, 25 bp, Artificial sequence
  Synthetic oligonucleotide
ccgttgcaggccccggtgggccgct

SEQ ID NO: 673547 - DNA, 25 bp, Artificial sequence
  Synthetic oligonucleotide
actatccgttgcaggccccggtggg

SEQ ID NO: 673548 - DNA, 25 bp, Artificial sequence
  Synthetic oligonucleotide
gaccccgactatccgttgcaggccc

SEQ ID NO: 673549 - DNA, 25 bp, Artificial sequence
  Synthetic oligonucleotide
agatcaacttccgtcatggcgacgc

SEQ ID NO: 673550 - DNA, 25 bp, Artificial sequence
  Synthetic oligonucleotide
agcgcagcgacgaccccgactatcc

SEQ ID NO: 673551 - DNA, 25 bp, Artificial sequence
  Synthetic oligonucleotide
tcgttctccatcgacgccgccaacg

SEQ ID NO: 673552 - DNA, 25 bp, Artificial sequence
  Synthetic oligonucleotide
tctacctgaccaagcgcagcgacga

SEQ ID NO: 673553 - DNA, 25 bp, Artificial sequence
  Synthetic oligonucleotide
tggagttctacctgaccaagcgcag

SEQ ID NO: 673554 - DNA, 25 bp, Artificial sequence
  Synthetic oligonucleotide
cagagatggagttctacctgaccaa

SEQ ID NO: 673555 - DNA, 25 bp, Artificial sequence
  Synthetic oligonucleotide
tggcgccagagatggagttctacct

SEQ ID NO: 673556 - DNA, 25 bp, Artificial sequence
  Synthetic oligonucleotide
cgatcgtggcgccagagatggagtt

SEQ ID NO: 673557 - DNA, 25 bp, Artificial sequence
  Synthetic oligonucleotide
tggcggccgatcgtggcgccagaga

SEQ ID NO: 673558 - DNA, 25 bp, Artificial sequence
  Synthetic oligonucleotide
aagggctggcggccgatcgtggcgc

SEQ ID NO: 673559 - DNA, 25 bp, Artificial sequence
  Synthetic oligonucleotide
gccgacaagggctggcggccgatcg

SEQ ID NO: 673560 - DNA, 25 bp, Artificial sequence
  Synthetic oligonucleotide
gcgacgaccccgactatccgttgca

SEQ ID NO: 673561 - DNA, 25 bp, Artificial sequence
  Synthetic oligonucleotide
actggtgcgaggcccagggccttga

SEQ ID NO: 673562 - DNA, 25 bp, Artificial sequence
  Synthetic oligonucleotide
atgaacgccgcaacctgcgcctgcc

SEQ ID NO: 673563 - DNA, 25 bp, Artificial sequence
  Synthetic oligonucleotide
ccgcgcagatggagatcaacttccg

SEQ ID NO: 673564 - DNA, 25 bp, Artificial sequence
  Synthetic oligonucleotide
aaggcaccgcgcagatggagatcaa

SEQ ID NO: 673565 - DNA, 25 bp, Artificial sequence
  Synthetic oligonucleotide
cacgaggaaggcaccgcgcagatgg

SEQ ID NO: 673566 - DNA, 25 bp, Artificial sequence
  Synthetic oligonucleotide
tgatccacgaggaaggcaccgcgca

SEQ ID NO: 673567 - DNA, 25 bp, Artificial sequence
  Synthetic oligonucleotide
atacgctgatccacgaggaaggcac

SEQ ID NO: 673568 - DNA, 25 bp, Artificial sequence
  Synthetic oligonucleotide
acctggatacgctgatccacgagga

SEQ ID NO: 673569 - DNA, 25 bp, Artificial sequence
  Synthetic oligonucleotide
gccttgacctggatacgctgatcca

SEQ ID NO: 673570 - DNA, 25 bp, Artificial sequence
  Synthetic oligonucleotide
accgggcgtcagtcgttctccatcg

SEQ ID NO: 673571 - DNA, 25 bp, Artificial sequence
  Synthetic oligonucleotide
gcgaggcccagggccttgacctgga

SEQ ID NO: 673572 - DNA, 25 bp, Artificial sequence
  Synthetic oligonucleotide
cgtcagtcgttctccatcgacgccg

SEQ ID NO: 673573 - DNA, 25 bp, Artificial sequence
  Synthetic oligonucleotide
tgtacgactggtgcgaggcccaggg

SEQ ID NO: 673574 - DNA, 25 bp, Artificial sequence
  Synthetic oligonucleotide
aggacatgtacgactggtgcgaggc

SEQ ID NO: 673575 - DNA, 25 bp, Artificial sequence
  Synthetic oligonucleotide
tgttcgaggacatgtacgactggtg

SEQ ID NO: 673576 - DNA, 25 bp, Artificial sequence
  Synthetic oligonucleotide
acccgctgttcgaggacatgtacga

SEQ ID NO: 673577 - DNA, 25 bp, Artificial sequence
  Synthetic oligonucleotide
agttcgacccgctgttcgaggacat

SEQ ID NO: 673578 - DNA, 25 bp, Artificial sequence
  Synthetic oligonucleotide
ccaacgagttcgacccgctgttcga

SEQ ID NO: 673579 - DNA, 25 bp, Artificial sequence
  Synthetic oligonucleotide
acgccgccaacgagttcgacccgct

SEQ ID NO: 673580 - DNA, 25 bp, Artificial sequence
  Synthetic oligonucleotide
ccatcgacgccgccaacgagttcga

SEQ ID NO: 673581 - DNA, 25 bp, Artificial sequence
  Synthetic oligonucleotide
gcgtgttgaagatgtatgccgacaa

SEQ ID NO: 673582 - DNA, 25 bp, Artificial sequence
  Synthetic oligonucleotide
cccagggccttgacctggatacgct

SEQ ID NO: 673583 - DNA, 25 bp, Artificial sequence
  Synthetic oligonucleotide
actacgtggaagacgacatttacta

SEQ ID NO: 673584 - DNA, 25 bp, Artificial sequence
  Synthetic oligonucleotide
atgtatgccgacaagggctggcggc

SEQ ID NO: 673585 - DNA, 25 bp, Artificial sequence
  Synthetic oligonucleotide
atggtctgccgcccggacgagaatg

SEQ ID NO: 673586 - DNA, 25 bp, Artificial sequence
  Synthetic oligonucleotide
atcgatatggtctgccgcccggacg

SEQ ID NO: 673587 - DNA, 25 bp, Artificial sequence
  Synthetic oligonucleotide
gccgacatcgatatggtctgccgcc

SEQ ID NO: 673588 - DNA, 25 bp, Artificial sequence
  Synthetic oligonucleotide
acccggccgacatcgatatggtctg

SEQ ID NO: 673589 - DNA, 25 bp, Artificial sequence
  Synthetic oligonucleotide
tgctcgacccggccgacatcgatat

SEQ ID NO: 673590 - DNA, 25 bp, Artificial sequence
  Synthetic oligonucleotide
tacgacctgctcgacccggccgaca

SEQ ID NO: 673591 - DNA, 25 bp, Artificial sequence
  Synthetic oligonucleotide
atttactacgacctgctcgacccgg

SEQ ID NO: 673592 - DNA, 25 bp, Artificial sequence
  Synthetic oligonucleotide
ccggacgagaatgccgtgttcctcg

SEQ ID NO: 673593 - DNA, 25 bp, Artificial sequence
  Synthetic oligonucleotide
tggaagacgacatttactacgacct

SEQ ID NO: 673594 - DNA, 25 bp, Artificial sequence
  Synthetic oligonucleotide
gagaatgccgtgttcctcgtcccct

SEQ ID NO: 673595 - DNA, 25 bp, Artificial sequence
  Synthetic oligonucleotide
ccggcgactacgtggaagacgacat

SEQ ID NO: 673596 - DNA, 25 bp, Artificial sequence
  Synthetic oligonucleotide
ccgtcaccggcgactacgtggaaga

SEQ ID NO: 673597 - DNA, 25 bp, Artificial sequence
  Synthetic oligonucleotide
tgcagaccgtcaccggcgactacgt

SEQ ID NO: 673598 - DNA, 25 bp, Artificial sequence
  Synthetic oligonucleotide
gttctgctgcagaccgtcaccggcg

SEQ ID NO: 673599 - DNA, 25 bp, Artificial sequence
  Synthetic oligonucleotide
gagagcgttctgctgcagaccgtca

SEQ ID NO: 673600 - DNA, 25 bp, Artificial sequence
  Synthetic oligonucleotide
ctgccggagagcgttctgctgcaga

SEQ ID NO: 673601 - DNA, 25 bp, Artificial sequence
  Synthetic oligonucleotide
catgcgcctgccggagagcgttctg

SEQ ID NO: 673602 - DNA, 25 bp, Artificial sequence
  Synthetic oligonucleotide
aaaagggcatgcgcctgccggagag

SEQ ID NO: 673603 - DNA, 25 bp, Artificial sequence
  Synthetic oligonucleotide
tcgcggaaaagggcatgcgcctgcc

SEQ ID NO: 673604 - DNA, 25 bp, Artificial sequence
  Synthetic oligonucleotide
acgacatttactacgacctgctcga

SEQ ID NO: 673605 - DNA, 25 bp, Artificial sequence
  Synthetic oligonucleotide
gacaccttcgacaagctcggcaatc

SEQ ID NO: 673606 - DNA, 25 bp, Artificial sequence
  Synthetic oligonucleotide
aacttccgtcatggcgacgccctcg

SEQ ID NO: 673607 - DNA, 25 bp, Artificial sequence
  Synthetic oligonucleotide
tcaagcgcgtgttgaagatgtatgc

SEQ ID NO: 673608 - DNA, 25 bp, Artificial sequence
  Synthetic oligonucleotide
acatcctcaagcgcgtgttgaagat

SEQ ID NO: 673609 - DNA, 25 bp, Artificial sequence
  Synthetic oligonucleotide
cgcgcaacatcctcaagcgcgtgtt

SEQ ID NO: 673610 - DNA, 25 bp, Artificial sequence
  Synthetic oligonucleotide
tgtcgccgcgcaacatcctcaagcg

SEQ ID NO: 673611 - DNA, 25 bp, Artificial sequence
  Synthetic oligonucleotide
tcgagctgtcgccgcgcaacatcct

SEQ ID NO: 673612 - DNA, 25 bp, Artificial sequence
  Synthetic oligonucleotide
atcccatcgagctgtcgccgcgcaa

SEQ ID NO: 673613 - DNA, 25 bp, Artificial sequence
  Synthetic oligonucleotide
tcggcaatcccatcgagctgtcgcc

SEQ ID NO: 673614 - DNA, 25 bp, Artificial sequence
  Synthetic oligonucleotide
tgccgcccggacgagaatgccgtgt

SEQ ID NO: 673615 - DNA, 25 bp, Artificial sequence
  Synthetic oligonucleotide
cttcgacaagctcggcaatcccatc

SEQ ID NO: 673616 - DNA, 25 bp, Artificial sequence
  Synthetic oligonucleotide
ttgaagatgtatgccgacaagggct

SEQ ID NO: 673617 - DNA, 25 bp, Artificial sequence
  Synthetic oligonucleotide
tccacgacaccttcgacaagctcgg

SEQ ID NO: 673618 - DNA, 25 bp, Artificial sequence
  Synthetic oligonucleotide
tggtgatccacgacaccttcgacaa

SEQ ID NO: 673619 - DNA, 25 bp, Artificial sequence
  Synthetic oligonucleotide
ccgcgatggtgatccacgacacctt

SEQ ID NO: 673620 - DNA, 25 bp, Artificial sequence
  Synthetic oligonucleotide
agcccaccgcgatggtgatccacga

SEQ ID NO: 673621 - DNA, 25 bp, Artificial sequence
  Synthetic oligonucleotide
catcgagcccaccgcgatggtgatc

SEQ ID NO: 673622 - DNA, 25 bp, Artificial sequence
  Synthetic oligonucleotide
ctgggccatcgagcccaccgcgatg

SEQ ID NO: 673623 - DNA, 25 bp, Artificial sequence
  Synthetic oligonucleotide
cgtcccctgggccatcgagcccacc

SEQ ID NO: 673624 - DNA, 25 bp, Artificial sequence
  Synthetic oligonucleotide
ttcctcgtcccctgggccatcgagc

SEQ ID NO: 673625 - DNA, 25 bp, Artificial sequence
  Synthetic oligonucleotide
gccgtgttcctcgtcccctgggcca

SEQ ID NO: 673626 - DNA, 25 bp, Artificial sequence
  Synthetic oligonucleotide
acaagctcggcaatcccatcgagct

SEQ ID NO: 673627 - DNA, 25 bp, Artificial sequence
  Synthetic oligonucleotide
atacctcggcgccggtgaacgtcga

SEQ ID NO: 673628 - DNA, 25 bp, Artificial sequence
  Synthetic oligonucleotide
cagcccggagaaccgccgggtcgag

SEQ ID NO: 673629 - DNA, 25 bp, Artificial sequence
  Synthetic oligonucleotide
tgccggactccagcccggagaaccg

SEQ ID NO: 673630 - DNA, 25 bp, Artificial sequence
  Synthetic oligonucleotide
tgcgcgtgccggactccagcccgga

SEQ ID NO: 673631 - DNA, 25 bp, Artificial sequence
  Synthetic oligonucleotide
tcggcctgcgcgtgccggactccag

SEQ ID NO: 673632 - DNA, 25 bp, Artificial sequence
  Synthetic oligonucleotide
gtaccgtcggcctgcgcgtgccgga

SEQ ID NO: 673633 - DNA, 25 bp, Artificial sequence
  Synthetic oligonucleotide
agaaccgtaccgtcggcctgcgcgt

SEQ ID NO: 673634 - DNA, 25 bp, Artificial sequence
  Synthetic oligonucleotide
cgaagagaaccgtaccgtcggcctg

SEQ ID NO: 673635 - DNA, 25 bp, Artificial sequence
  Synthetic oligonucleotide
acgtcgagtggggcgaagagaaccg

SEQ ID NO: 673636 - DNA, 25 bp, Artificial sequence
  Synthetic oligonucleotide
agatggagatcaacttccgtcatgg

SEQ ID NO: 673637 - DNA, 25 bp, Artificial sequence
  Synthetic oligonucleotide
tcggcgccggtgaacgtcgagtggg

SEQ ID NO: 673638 - DNA, 25 bp, Artificial sequence
  Synthetic oligonucleotide
aaccgtctcgccggcgccgacgcca

SEQ ID NO: 673639 - DNA, 25 bp, Artificial sequence
  Synthetic oligonucleotide
tgcccgatacctcggcgccggtgaa

SEQ ID NO: 673640 - DNA, 25 bp, Artificial sequence
  Synthetic oligonucleotide
cttcctgcccgatacctcggcgccg

SEQ ID NO: 673641 - DNA, 25 bp, Artificial sequence
  Synthetic oligonucleotide
ccgccgcttcctgcccgatacctcg

SEQ ID NO: 673642 - DNA, 25 bp, Artificial sequence
  Synthetic oligonucleotide
ctcgttccgccgcttcctgcccgat

SEQ ID NO: 673643 - DNA, 25 bp, Artificial sequence
  Synthetic oligonucleotide
acgtgaactcgttccgccgcttcct

SEQ ID NO: 673644 - DNA, 25 bp, Artificial sequence
  Synthetic oligonucleotide
gcccaacgtgaactcgttccgccgc

SEQ ID NO: 673645 - DNA, 25 bp, Artificial sequence
  Synthetic oligonucleotide
gttcgcgcccaacgtgaactcgttc

SEQ ID NO: 673646 - DNA, 25 bp, Artificial sequence
  Synthetic oligonucleotide
ccgctgttcgcgcccaacgtgaact

SEQ ID NO: 673647 - DNA, 25 bp, Artificial sequence
  Synthetic oligonucleotide
ccggtgaacgtcgagtggggcgaag

SEQ ID NO: 673648 - DNA, 25 bp, Artificial sequence
  Synthetic oligonucleotide
ctgctgtgcggctacatcggcatgg

SEQ ID NO: 673649 - DNA, 25 bp, Artificial sequence
  Synthetic oligonucleotide
gcggctatgaacgccgcaacctgcg

SEQ ID NO: 673650 - DNA, 25 bp, Artificial sequence
  Synthetic oligonucleotide
aaggtcgcggctatgaacgccgcaa

SEQ ID NO: 673651 - DNA, 25 bp, Artificial sequence
  Synthetic oligonucleotide
caggtcaaaggtcgcggctatgaac

SEQ ID NO: 673652 - DNA, 25 bp, Artificial sequence
  Synthetic oligonucleotide
agcgcccaggtcaaaggtcgcggct

SEQ ID NO: 673653 - DNA, 25 bp, Artificial sequence
  Synthetic oligonucleotide
aagccgagcgcccaggtcaaaggtc

SEQ ID NO: 673654 - DNA, 25 bp, Artificial sequence
  Synthetic oligonucleotide
aggcatcaagccgagcgcccaggtc

SEQ ID NO: 673655 - DNA, 25 bp, Artificial sequence
  Synthetic oligonucleotide
gtcgaaggcatcaagccgagcgccc

SEQ ID NO: 673656 - DNA, 25 bp, Artificial sequence
  Synthetic oligonucleotide
ggcatggtcgaaggcatcaagccga

SEQ ID NO: 673657 - DNA, 25 bp, Artificial sequence
  Synthetic oligonucleotide
cgccgggtcgagaaccgtctcgccg

SEQ ID NO: 673658 - DNA, 25 bp, Artificial sequence
  Synthetic oligonucleotide
tgcggctacatcggcatggtcgaag

SEQ ID NO: 673659 - DNA, 25 bp, Artificial sequence
  Synthetic oligonucleotide
gtcgagaaccgtctcgccggcgccg

SEQ ID NO: 673660 - DNA, 25 bp, Artificial sequence
  Synthetic oligonucleotide
gccagcctgctgtgcggctacatcg

SEQ ID NO: 673661 - DNA, 25 bp, Artificial sequence
  Synthetic oligonucleotide
tggctgccagcctgctgtgcggcta

SEQ ID NO: 673662 - DNA, 25 bp, Artificial sequence
  Synthetic oligonucleotide
ggcgctggctgccagcctgctgtgc

SEQ ID NO: 673663 - DNA, 25 bp, Artificial sequence
  Synthetic oligonucleotide
ttacctggcgctggctgccagcctg

SEQ ID NO: 673664 - DNA, 25 bp, Artificial sequence
  Synthetic oligonucleotide
aacccttacctggcgctggctgcca

SEQ ID NO: 673665 - DNA, 25 bp, Artificial sequence
  Synthetic oligonucleotide
acgccaacccttacctggcgctggc

SEQ ID NO: 673666 - DNA, 25 bp, Artificial sequence
  Synthetic oligonucleotide
gcgccgacgccaacccttacctggc

SEQ ID NO: 673667 - DNA, 25 bp, Artificial sequence
  Synthetic oligonucleotide
ctcgccggcgccgacgccaaccctt

SEQ ID NO: 673668 - DNA, 25 bp, Artificial sequence
  Synthetic oligonucleotide
ttcatcccggaagtgctgccgctgt

SEQ ID NO: 673669 - DNA, 25 bp, Artificial sequence
  Synthetic oligonucleotide
tacatcggcatggtcgaaggcatca

SEQ ID NO: 673670 - DNA, 25 bp, Artificial sequence
  Synthetic oligonucleotide
caccatgcgcgaggccgcgctcaag

SEQ ID NO: 673671 - DNA, 25 bp, Artificial sequence
  Synthetic oligonucleotide
gtgctgccgctgttcgcgcccaacg

SEQ ID NO: 673672 - DNA, 25 bp, Artificial sequence
  Synthetic oligonucleotide
ccgatgaccggcgagccgggcagcg

SEQ ID NO: 673673 - DNA, 25 bp, Artificial sequence
  Synthetic oligonucleotide
gccaagccgatgaccggcgagccgg

SEQ ID NO: 673674 - DNA, 25 bp, Artificial sequence
  Synthetic oligonucleotide
ttcatggccaagccgatgaccggcg

SEQ ID NO: 673675 - DNA, 25 bp, Artificial sequence
  Synthetic oligonucleotide
gcgaccttcatggccaagccgatga

SEQ ID NO: 673676 - DNA, 25 bp, Artificial sequence
  Synthetic oligonucleotide
gtcgccgcgaccttcatggccaagc

SEQ ID NO: 673677 - DNA, 25 bp, Artificial sequence
  Synthetic oligonucleotide
cacaacgtcgccgcgaccttcatgg

SEQ ID NO: 673678 - DNA, 25 bp, Artificial sequence
  Synthetic oligonucleotide
ctcaagcacaacgtcgccgcgacct

SEQ ID NO: 673679 - DNA, 25 bp, Artificial sequence
  Synthetic oligonucleotide
cgagccgggcagcgcgatgcacctg

SEQ ID NO: 673680 - DNA, 25 bp, Artificial sequence
  Synthetic oligonucleotide
cgcgaggccgcgctcaagcacaacg

SEQ ID NO: 673681 - DNA, 25 bp, Artificial sequence
  Synthetic oligonucleotide
ggcagcgcgatgcacctgcaccaga

SEQ ID NO: 673682 - DNA, 25 bp, Artificial sequence
  Synthetic oligonucleotide
caagcgcaccatgcgcgaggccgcg

SEQ ID NO: 673683 - DNA, 25 bp, Artificial sequence
  Synthetic oligonucleotide
gtgttcaagcgcaccatgcgcgagg

SEQ ID NO: 673684 - DNA, 25 bp, Artificial sequence
  Synthetic oligonucleotide
tcctggtgttcaagcgcaccatgcg

SEQ ID NO: 673685 - DNA, 25 bp, Artificial sequence
  Synthetic oligonucleotide
accagatcctggtgttcaagcgcac

SEQ ID NO: 673686 - DNA, 25 bp, Artificial sequence
  Synthetic oligonucleotide
ggccgaccagatcctggtgttcaag

SEQ ID NO: 673687 - DNA, 25 bp, Artificial sequence
  Synthetic oligonucleotide
cgacctggccgaccagatcctggtg

SEQ ID NO: 673688 - DNA, 25 bp, Artificial sequence
  Synthetic oligonucleotide
cgccctcgacctggccgaccagatc

SEQ ID NO: 673689 - DNA, 25 bp, Artificial sequence
  Synthetic oligonucleotide
tggcgacgccctcgacctggccgac

SEQ ID NO: 673690 - DNA, 25 bp, Artificial sequence
  Synthetic oligonucleotide
ccgtcatggcgacgccctcgacctg

SEQ ID NO: 673691 - DNA, 25 bp, Artificial sequence
  Synthetic oligonucleotide
gccgcgctcaagcacaacgtcgccg

SEQ ID NO: 673692 - DNA, 25 bp, Artificial sequence
  Synthetic oligonucleotide
tccaatgccgacggcaccatgagcg

SEQ ID NO: 673693 - DNA, 25 bp, Artificial sequence
  Synthetic oligonucleotide
cgccgaccaacaaattcatcgcgga

SEQ ID NO: 673694 - DNA, 25 bp, Artificial sequence
  Synthetic oligonucleotide
cagaagttcatcccggaagtgctgc

SEQ ID NO: 673695 - DNA, 25 bp, Artificial sequence
  Synthetic oligonucleotide
ggcctgcagaagttcatcccggaag

SEQ ID NO: 673696 - DNA, 25 bp, Artificial sequence
  Synthetic oligonucleotide
atcggcggcctgcagaagttcatcc

SEQ ID NO: 673697 - DNA, 25 bp, Artificial sequence
  Synthetic oligonucleotide
accatatcggcggcctgcagaagtt

SEQ ID NO: 673698 - DNA, 25 bp, Artificial sequence
  Synthetic oligonucleotide
tcctgcaccatatcggcggcctgca

SEQ ID NO: 673699 - DNA, 25 bp, Artificial sequence
  Synthetic oligonucleotide
agctgttcctgcaccatatcggcgg

SEQ ID NO: 673700 - DNA, 25 bp, Artificial sequence
  Synthetic oligonucleotide
atgagcgagctgttcctgcaccata

SEQ ID NO: 673701 - DNA, 25 bp, Artificial sequence
  Synthetic oligonucleotide
gaccggcgagccgggcagcgcgatg

SEQ ID NO: 673702 - DNA, 25 bp, Artificial sequence
  Synthetic oligonucleotide
gccgacggcaccatgagcgagctgt

SEQ ID NO: 673703 - DNA, 25 bp, Artificial sequence
  Synthetic oligonucleotide
ccggaagtgctgccgctgttcgcgc

SEQ ID NO: 673704 - DNA, 25 bp, Artificial sequence
  Synthetic oligonucleotide
atcttctccaatgccgacggcacca

SEQ ID NO: 673705 - DNA, 25 bp, Artificial sequence
  Synthetic oligonucleotide
aagaacatcttctccaatgccgacg

SEQ ID NO: 673706 - DNA, 25 bp, Artificial sequence
  Synthetic oligonucleotide
accggcaagaacatcttctccaatg

SEQ ID NO: 673707 - DNA, 25 bp, Artificial sequence
  Synthetic oligonucleotide
gtgaagaccggcaagaacatcttct

SEQ ID NO: 673708 - DNA, 25 bp, Artificial sequence
  Synthetic oligonucleotide
gtcgacgtgaagaccggcaagaaca

SEQ ID NO: 673709 - DNA, 25 bp, Artificial sequence
  Synthetic oligonucleotide
agcatcgtcgacgtgaagaccggca

SEQ ID NO: 673710 - DNA, 25 bp, Artificial sequence
  Synthetic oligonucleotide
caccagagcatcgtcgacgtgaaga

SEQ ID NO: 673711 - DNA, 25 bp, Artificial sequence
  Synthetic oligonucleotide
cacctgcaccagagcatcgtcgacg

SEQ ID NO: 673712 - DNA, 25 bp, Artificial sequence
  Synthetic oligonucleotide
gcgatgcacctgcaccagagcatcg

SEQ ID NO: 673713 - DNA, 25 bp, Artificial sequence
  Synthetic oligonucleotide
ggcaccatgagcgagctgttcctgc

SEQ ID NO: 673714 - DNA, 25 bp, Artificial sequence
  Synthetic oligonucleotide
gacggcttgctcttcactggctcgc

SEQ ID NO: 673715 - DNA, 25 bp, Artificial sequence
  Synthetic oligonucleotide
gagcgagcccggcaccctccacgac

SEQ ID NO: 673716 - DNA, 25 bp, Artificial sequence
  Synthetic oligonucleotide
accggcgagcgagcccggcaccctc

SEQ ID NO: 673717 - DNA, 25 bp, Artificial sequence
  Synthetic oligonucleotide
tagtggaccggcgagcgagcccggc

SEQ ID NO: 673718 - DNA, 25 bp, Artificial sequence
  Synthetic oligonucleotide
tcattatagtggaccggcgagcgag

SEQ ID NO: 673719 - DNA, 25 bp, Artificial sequence
  Synthetic oligonucleotide
gccccgtcattatagtggaccggcg

SEQ ID NO: 673720 - DNA, 25 bp, Artificial sequence
  Synthetic oligonucleotide
cgtcgagccccgtcattatagtgga

SEQ ID NO: 673721 - DNA, 25 bp, Artificial sequence
  Synthetic oligonucleotide
cgtcgaacgtcgagccccgtcatta

SEQ ID NO: 673722 - DNA, 25 bp, Artificial sequence
  Synthetic oligonucleotide
ggctcgccgtcgaacgtcgagcccc

SEQ ID NO: 673723 - DNA, 25 bp, Artificial sequence
  Synthetic oligonucleotide
aattcatcgcggaaaagggcatgcg

SEQ ID NO: 673724 - DNA, 25 bp, Artificial sequence
  Synthetic oligonucleotide
ttgctcttcactggctcgccgtcga

SEQ ID NO: 673725 - DNA, 25 bp, Artificial sequence
  Synthetic oligonucleotide
ccacgactccgaccgcgacgccact

SEQ ID NO: 673726 - DNA, 25 bp, Artificial sequence
  Synthetic oligonucleotide
gcgtcgacggcttgctcttcactgg

SEQ ID NO: 673727 - DNA, 25 bp, Artificial sequence
  Synthetic oligonucleotide
tggacagcgtcgacggcttgctctt

SEQ ID NO: 673728 - DNA, 25 bp, Artificial sequence
  Synthetic oligonucleotide
ccctgctggacagcgtcgacggctt

SEQ ID NO: 673729 - DNA, 25 bp, Artificial sequence
  Synthetic oligonucleotide
aggcagccctgctggacagcgtcga

SEQ ID NO: 673730 - DNA, 25 bp, Artificial sequence
  Synthetic oligonucleotide
tcgaccaggcagccctgctggacag

SEQ ID NO: 673731 - DNA, 25 bp, Artificial sequence
  Synthetic oligonucleotide
agtcgatcgaccaggcagccctgct

SEQ ID NO: 673732 - DNA, 25 bp, Artificial sequence
  Synthetic oligonucleotide
tgggcgagtcgatcgaccaggcagc

SEQ ID NO: 673733 - DNA, 25 bp, Artificial sequence
  Synthetic oligonucleotide
ctgcgctgggcgagtcgatcgacca

SEQ ID NO: 673734 - DNA, 25 bp, Artificial sequence
  Synthetic oligonucleotide
ttcactggctcgccgtcgaacgtcg

SEQ ID NO: 673735 - DNA, 25 bp, Artificial sequence
  Synthetic oligonucleotide
gccggcattccggtcctcggcatct

SEQ ID NO: 673736 - DNA, 25 bp, Artificial sequence
  Synthetic oligonucleotide
ggcggcagcctgcaccagaaggtgc

SEQ ID NO: 673737 - DNA, 25 bp, Artificial sequence
  Synthetic oligonucleotide
ctttcggcggcagcctgcaccagaa

SEQ ID NO: 673738 - DNA, 25 bp, Artificial sequence
  Synthetic oligonucleotide
acgtggctttcggcggcagcctgca

SEQ ID NO: 673739 - DNA, 25 bp, Artificial sequence
  Synthetic oligonucleotide
aatgaacgtggctttcggcggcagc

SEQ ID NO: 673740 - DNA, 25 bp, Artificial sequence
  Synthetic oligonucleotide
ccaggaaatgaacgtggctttcggc

SEQ ID NO: 673741 - DNA, 25 bp, Artificial sequence
  Synthetic oligonucleotide
cggtttccaggaaatgaacgtggct

SEQ ID NO: 673742 - DNA, 25 bp, Artificial sequence
  Synthetic oligonucleotide
tgccgcggtttccaggaaatgaacg

SEQ ID NO: 673743 - DNA, 25 bp, Artificial sequence
  Synthetic oligonucleotide
ggcatctgccgcggtttccaggaaa

SEQ ID NO: 673744 - DNA, 25 bp, Artificial sequence
  Synthetic oligonucleotide
gcccggcaccctccacgactccgac

SEQ ID NO: 673745 - DNA, 25 bp, Artificial sequence
  Synthetic oligonucleotide
attccggtcctcggcatctgccgcg

SEQ ID NO: 673746 - DNA, 25 bp, Artificial sequence
  Synthetic oligonucleotide
caccctccacgactccgaccgcgac

SEQ ID NO: 673747 - DNA, 25 bp, Artificial sequence
  Synthetic oligonucleotide
atcgacgccggcattccggtcctcg

SEQ ID NO: 673748 - DNA, 25 bp, Artificial sequence
  Synthetic oligonucleotide
gccgccatcgacgccggcattccgg

SEQ ID NO: 673749 - DNA, 25 bp, Artificial sequence
  Synthetic oligonucleotide
gtccgcgccgccatcgacgccggca

SEQ ID NO: 673750 - DNA, 25 bp, Artificial sequence
  Synthetic oligonucleotide
gccgctggtccgcgccgccatcgac

SEQ ID NO: 673751 - DNA, 25 bp, Artificial sequence
  Synthetic oligonucleotide
tacgttgccgctggtccgcgccgcc

SEQ ID NO: 673752 - DNA, 25 bp, Artificial sequence
  Synthetic oligonucleotide
cgccactacgttgccgctggtccgc

SEQ ID NO: 673753 - DNA, 25 bp, Artificial sequence
  Synthetic oligonucleotide
ccgcgacgccactacgttgccgctg

SEQ ID NO: 673754 - DNA, 25 bp, Artificial sequence
  Synthetic oligonucleotide
ctccgaccgcgacgccactacgttg

SEQ ID NO: 673755 - DNA, 25 bp, Artificial sequence
  Synthetic oligonucleotide
ggtctcccgctgatcattcctgcgc

SEQ ID NO: 673756 - DNA, 25 bp, Artificial sequence
  Synthetic oligonucleotide
ggtcctcggcatctgccgcggtttc

SEQ ID NO: 673757 - DNA, 25 bp, Artificial sequence
  Synthetic oligonucleotide
tacaggcctattgtgtaaaaaaatg

SEQ ID NO: 673758 - DNA, 25 bp, Artificial sequence
  Synthetic oligonucleotide
atcattcctgcgctgggcgagtcga

SEQ ID NO: 673759 - DNA, 25 bp, Artificial sequence
  Synthetic oligonucleotide
taacatctacaaacaacgggtgtct

SEQ ID NO: 673760 - DNA, 25 bp, Artificial sequence
  Synthetic oligonucleotide
accccataacatctacaaacaacgg

SEQ ID NO: 673761 - DNA, 25 bp, Artificial sequence
  Synthetic oligonucleotide
ggccaaaccccataacatctacaaa

SEQ ID NO: 673762 - DNA, 25 bp, Artificial sequence
  Synthetic oligonucleotide
agctcggccaaaccccataacatct

SEQ ID NO: 673763 - DNA, 25 bp, Artificial sequence
  Synthetic oligonucleotide
acgctaagctcggccaaaccccata

SEQ ID NO: 673764 - DNA, 25 bp, Artificial sequence
  Synthetic oligonucleotide
tgaacaacgctaagctcggccaaac

SEQ ID NO: 673765 - DNA, 25 bp, Artificial sequence
  Synthetic oligonucleotide
aaaaaatgaacaacgctaagctcgg

SEQ ID NO: 673766 - DNA, 25 bp, Artificial sequence
  Synthetic oligonucleotide
caacgggtgtctcatgtctcgcctg

SEQ ID NO: 673767 - DNA, 25 bp, Artificial sequence
  Synthetic oligonucleotide
gcctattgtgtaaaaaaatgaacaa

SEQ ID NO: 673768 - DNA, 25 bp, Artificial sequence
  Synthetic oligonucleotide
gtgtctcatgtctcgcctgccgtta

SEQ ID NO: 673769 - DNA, 25 bp, Artificial sequence
  Synthetic oligonucleotide
caattttttacaggcctattgtgta

SEQ ID NO: 673770 - DNA, 25 bp, Artificial sequence
  Synthetic oligonucleotide
cgtgttcaattttttacaggcctat

SEQ ID NO: 673771 - DNA, 25 bp, Artificial sequence
  Synthetic oligonucleotide
ggagtgcgtgttcaattttttacag

SEQ ID NO: 673772 - DNA, 25 bp, Artificial sequence
  Synthetic oligonucleotide
tgttcaggagtgcgtgttcaatttt

SEQ ID NO: 673773 - DNA, 25 bp, Artificial sequence
  Synthetic oligonucleotide
gaagggtgttcaggagtgcgtgttc

SEQ ID NO: 673774 - DNA, 25 bp, Artificial sequence
  Synthetic oligonucleotide
cgcgtcgaagggtgttcaggagtgc

SEQ ID NO: 673775 - DNA, 25 bp, Artificial sequence
  Synthetic oligonucleotide
aaacctcgcgtcgaagggtgttcag

SEQ ID NO: 673776 - DNA, 25 bp, Artificial sequence
  Synthetic oligonucleotide
gcattttcgccggacgaaaagccga

SEQ ID NO: 673777 - DNA, 25 bp, Artificial sequence
  Synthetic oligonucleotide
ttttcagggcattttcgccggacga

SEQ ID NO: 673778 - DNA, 25 bp, Artificial sequence
  Synthetic oligonucleotide
tgtgtaaaaaaatgaacaacgctaa

SEQ ID NO: 673779 - DNA, 25 bp, Artificial sequence
  Synthetic oligonucleotide
ttcatccctaccatattgccggcga

SEQ ID NO: 673780 - DNA, 25 bp, Artificial sequence
  Synthetic oligonucleotide
aggtgcacgaggtcggaaccttcat

SEQ ID NO: 673781 - DNA, 25 bp, Artificial sequence
  Synthetic oligonucleotide
gctggcggtctcccgctgatcattc

SEQ ID NO: 673782 - DNA, 25 bp, Artificial sequence
  Synthetic oligonucleotide
acggcgctggcggtctcccgctgat

SEQ ID NO: 673783 - DNA, 25 bp, Artificial sequence
  Synthetic oligonucleotide
tcgtcaacggcgctggcggtctccc

SEQ ID NO: 673784 - DNA, 25 bp, Artificial sequence
  Synthetic oligonucleotide
gtgccgtcgtcaacggcgctggcgg

SEQ ID NO: 673785 - DNA, 25 bp, Artificial sequence
  Synthetic oligonucleotide
atctgcgtgccgtcgtcaacggcgc

SEQ ID NO: 673786 - DNA, 25 bp, Artificial sequence
  Synthetic oligonucleotide
acaaatatctgcgtgccgtcgtcaa

SEQ ID NO: 673787 - DNA, 25 bp, Artificial sequence
  Synthetic oligonucleotide
ccggcgacaaatatctgcgtgccgt

SEQ ID NO: 673788 - DNA, 25 bp, Artificial sequence
  Synthetic oligonucleotide
tacaaacaacgggtgtctcatgtct

SEQ ID NO: 673789 - DNA, 25 bp, Artificial sequence
  Synthetic oligonucleotide
cctaccatattgccggcgacaaata

SEQ ID NO: 673790 - DNA, 25 bp, Artificial sequence
  Synthetic oligonucleotide
ccgctgatcattcctgcgctgggcg

SEQ ID NO: 673791 - DNA, 25 bp, Artificial sequence
  Synthetic oligonucleotide
atcggtcttcatccctaccatattg

SEQ ID NO: 673792 - DNA, 25 bp, Artificial sequence
  Synthetic oligonucleotide
aagcagatcggtcttcatccctacc

SEQ ID NO: 673793 - DNA, 25 bp, Artificial sequence
  Synthetic oligonucleotide
tgcaccaagcagatcggtcttcatc

SEQ ID NO: 673794 - DNA, 25 bp, Artificial sequence
  Synthetic oligonucleotide
accgcctgcaccaagcagatcggtc

SEQ ID NO: 673795 - DNA, 25 bp, Artificial sequence
  Synthetic oligonucleotide
ggcgtcaccgcctgcaccaagcaga

SEQ ID NO: 673796 - DNA, 25 bp, Artificial sequence
  Synthetic oligonucleotide
ttaatcggcgtcaccgcctgcacca

SEQ ID NO: 673797 - DNA, 25 bp, Artificial sequence
  Synthetic oligonucleotide
ctgccgttaatcggcgtcaccgcct

SEQ ID NO: 673798 - DNA, 25 bp, Artificial sequence
  Synthetic oligonucleotide
tctcgcctgccgttaatcggcgtca

SEQ ID NO: 673799 - DNA, 25 bp, Artificial sequence
  Synthetic oligonucleotide
tcatgtctcgcctgccgttaatcgg

SEQ ID NO: 673800 - DNA, 25 bp, Artificial sequence
  Synthetic oligonucleotide
atattgccggcgacaaatatctgcg

SEQ ID NO: 673801 - DNA, 25 bp, Artificial sequence
  Synthetic oligonucleotide
aggctttcggtaaggcctgcagcaa

SEQ ID NO: 673802 - DNA, 25 bp, Artificial sequence
  Synthetic oligonucleotide
ggtgtgcaatggcacccggagtggc

SEQ ID NO: 673803 - DNA, 25 bp, Artificial sequence
  Synthetic oligonucleotide
ttggggccggactctcaaccctgag

SEQ ID NO: 673804 - DNA, 25 bp, Artificial sequence
  Synthetic oligonucleotide
cggctgttggggccggactctcaac

SEQ ID NO: 673805 - DNA, 25 bp, Artificial sequence
  Synthetic oligonucleotide
tgagtccggctgttggggccggact

SEQ ID NO: 673806 - DNA, 25 bp, Artificial sequence
  Synthetic oligonucleotide
caacgttgagtccggctgttggggc

SEQ ID NO: 673807 - DNA, 25 bp, Artificial sequence
  Synthetic oligonucleotide
cggggcaacgttgagtccggctgtt

SEQ ID NO: 673808 - DNA, 25 bp, Artificial sequence
  Synthetic oligonucleotide
agagggcggggcaacgttgagtccg

SEQ ID NO: 673809 - DNA, 25 bp, Artificial sequence
  Synthetic oligonucleotide
gcagcaagagggcggggcaacgttg

SEQ ID NO: 673810 - DNA, 25 bp, Artificial sequence
  Synthetic oligonucleotide
tctcaaccctgaggtctttatgact

SEQ ID NO: 673811 - DNA, 25 bp, Artificial sequence
  Synthetic oligonucleotide
tcggtaaggcctgcagcaagagggc

SEQ ID NO: 673812 - DNA, 25 bp, Artificial sequence
  Synthetic oligonucleotide
ccctgaggtctttatgactaccaag

SEQ ID NO: 673813 - DNA, 25 bp, Artificial sequence
  Synthetic oligonucleotide
tcttccaggctttcggtaaggcctg

SEQ ID NO: 673814 - DNA, 25 bp, Artificial sequence
  Synthetic oligonucleotide
tcgctatcttccaggctttcggtaa

SEQ ID NO: 673815 - DNA, 25 bp, Artificial sequence
  Synthetic oligonucleotide
actatctcgctatcttccaggcttt

SEQ ID NO: 673816 - DNA, 25 bp, Artificial sequence
  Synthetic oligonucleotide
accccaactatctcgctatcttcca

SEQ ID NO: 673817 - DNA, 25 bp, Artificial sequence
  Synthetic oligonucleotide
tgacgaaccccaactatctcgctat

SEQ ID NO: 673818 - DNA, 25 bp, Artificial sequence
  Synthetic oligonucleotide
caggttctgacgaaccccaactatc

SEQ ID NO: 673819 - DNA, 25 bp, Artificial sequence
  Synthetic oligonucleotide
gagtggcaggttctgacgaacccca

SEQ ID NO: 673820 - DNA, 25 bp, Artificial sequence
  Synthetic oligonucleotide
cacccggagtggcaggttctgacga

SEQ ID NO: 673821 - DNA, 25 bp, Artificial sequence
  Synthetic oligonucleotide
agcctgcaccagaaggtgcacgagg

SEQ ID NO: 673822 - DNA, 25 bp, Artificial sequence
  Synthetic oligonucleotide
aggcctgcagcaagagggcggggca

SEQ ID NO: 673823 - DNA, 25 bp, Artificial sequence
  Synthetic oligonucleotide
atcaccgaagtggaatgcctgattt

SEQ ID NO: 673824 - DNA, 25 bp, Artificial sequence
  Synthetic oligonucleotide
caaaagccttcgctcttggtgtgca

SEQ ID NO: 673825 - DNA, 25 bp, Artificial sequence
  Synthetic oligonucleotide
agatctcgccgaccaacaaattcat

SEQ ID NO: 673826 - DNA, 25 bp, Artificial sequence
  Synthetic oligonucleotide
gcggcaagatctcgccgaccaacaa

SEQ ID NO: 673827 - DNA, 25 bp, Artificial sequence
  Synthetic oligonucleotide
cgcccgcggcaagatctcgccgacc

SEQ ID NO: 673828 - DNA, 25 bp, Artificial sequence
  Synthetic oligonucleotide
aggcatcgcccgcggcaagatctcg

SEQ ID NO: 673829 - DNA, 25 bp, Artificial sequence
  Synthetic oligonucleotide
tctgacaggcatcgcccgcggcaag

SEQ ID NO: 673830 - DNA, 25 bp, Artificial sequence
  Synthetic oligonucleotide
tccgatctgacaggcatcgcccgcg

SEQ ID NO: 673831 - DNA, 25 bp, Artificial sequence
  Synthetic oligonucleotide
ctgatttccgatctgacaggcatcg

SEQ ID NO: 673832 - DNA, 25 bp, Artificial sequence
  Synthetic oligonucleotide
ccggactctcaaccctgaggtcttt

SEQ ID NO: 673833 - DNA, 25 bp, Artificial sequence
  Synthetic oligonucleotide
gaagtggaatgcctgatttccgatc

SEQ ID NO: 673834 - DNA, 25 bp, Artificial sequence
  Synthetic oligonucleotide
gctcttggtgtgcaatggcacccgg

SEQ ID NO: 673835 - DNA, 25 bp, Artificial sequence
  Synthetic oligonucleotide
cgcaagatcaccgaagtggaatgcc

SEQ ID NO: 673836 - DNA, 25 bp, Artificial sequence
  Synthetic oligonucleotide
aaggaacgcaagatcaccgaagtgg

SEQ ID NO: 673837 - DNA, 25 bp, Artificial sequence
  Synthetic oligonucleotide
tggctgaaggaacgcaagatcaccg

SEQ ID NO: 673838 - DNA, 25 bp, Artificial sequence
  Synthetic oligonucleotide
accagctggctgaaggaacgcaaga

SEQ ID NO: 673839 - DNA, 25 bp, Artificial sequence
  Synthetic oligonucleotide
cagctgaccagctggctgaaggaac

SEQ ID NO: 673840 - DNA, 25 bp, Artificial sequence
  Synthetic oligonucleotide
gttagaccagctgaccagctggctg

SEQ ID NO: 673841 - DNA, 25 bp, Artificial sequence
  Synthetic oligonucleotide
taccaagttagaccagctgaccagc

SEQ ID NO: 673842 - DNA, 25 bp, Artificial sequence
  Synthetic oligonucleotide
tatgactaccaagttagaccagctg

SEQ ID NO: 673843 - DNA, 25 bp, Artificial sequence
  Synthetic oligonucleotide
ggtctttatgactaccaagttagac

SEQ ID NO: 673844 - DNA, 25 bp, Artificial sequence
  Synthetic oligonucleotide
gaatgcctgatttccgatctgacag

SEQ ID NO: 673845 - DNA, 25 bp, Artificial sequence
  Synthetic oligonucleotide
cgaggttcagtacgcgccgcgccat

SEQ ID NO: 673846 - DNA, 25 bp, Artificial sequence
  Synthetic oligonucleotide
caatggcacccggagtggcaggttc

SEQ ID NO: 673847 - DNA, 25 bp, Artificial sequence
  Synthetic oligonucleotide
ccggtatcggcttgccgagcgagtt

SEQ ID NO: 673848 - DNA, 25 bp, Artificial sequence
  Synthetic oligonucleotide
gtgctcgccggtatcggcttgccga

SEQ ID NO: 673849 - DNA, 25 bp, Artificial sequence
  Synthetic oligonucleotide
ggcggagtgctcgccggtatcggct

SEQ ID NO: 673850 - DNA, 25 bp, Artificial sequence
  Synthetic oligonucleotide
cagccgggcggagtgctcgccggta

SEQ ID NO: 673851 - DNA, 25 bp, Artificial sequence
  Synthetic oligonucleotide
gcatgtgcagccgggcggagtgctc

SEQ ID NO: 673852 - DNA, 25 bp, Artificial sequence
  Synthetic oligonucleotide
tgccatgcatgtgcagccgggcgga

SEQ ID NO: 673853 - DNA, 25 bp, Artificial sequence
  Synthetic oligonucleotide
gcgccatgccatgcatgtgcagccg

SEQ ID NO: 673854 - DNA, 25 bp, Artificial sequence
  Synthetic oligonucleotide
tgccgagcgagttccaggtcaattc

SEQ ID NO: 673855 - DNA, 25 bp, Artificial sequence
  Synthetic oligonucleotide
tcagtacgcgccgcgccatgccatg

SEQ ID NO: 673856 - DNA, 25 bp, Artificial sequence
  Synthetic oligonucleotide
gcgagttccaggtcaattccatcca

SEQ ID NO: 673857 - DNA, 25 bp, Artificial sequence
  Synthetic oligonucleotide
gccgctcgaggttcagtacgcgccg

SEQ ID NO: 673858 - DNA, 25 bp, Artificial sequence
  Synthetic oligonucleotide
cgaccagccgctcgaggttcagtac

SEQ ID NO: 673859 - DNA, 25 bp, Artificial sequence
  Synthetic oligonucleotide
gccggccgaccagccgctcgaggtt

SEQ ID NO: 673860 - DNA, 25 bp, Artificial sequence
  Synthetic oligonucleotide
ccgcgagccggccgaccagccgctc

SEQ ID NO: 673861 - DNA, 25 bp, Artificial sequence
  Synthetic oligonucleotide
tggaccaccgcgagccggccgacca

SEQ ID NO: 673862 - DNA, 25 bp, Artificial sequence
  Synthetic oligonucleotide
ccttcatggaccaccgcgagccggc

SEQ ID NO: 673863 - DNA, 25 bp, Artificial sequence
  Synthetic oligonucleotide
tcggaaccttcatggaccaccgcga

SEQ ID NO: 673864 - DNA, 25 bp, Artificial sequence
  Synthetic oligonucleotide
acgaggtcggaaccttcatggacca

SEQ ID NO: 673865 - DNA, 25 bp, Artificial sequence
  Synthetic oligonucleotide
ccaacaaattcatcgcggaaaaggg

SEQ ID NO: 673866 - DNA, 25 bp, Artificial sequence
  Synthetic oligonucleotide
cgcgccgcgccatgccatgcatgtg

SEQ ID NO: 673867 - DNA, 25 bp, Artificial sequence
  Synthetic oligonucleotide
tcgagtagaagcactggcgcctgac

SEQ ID NO: 673868 - DNA, 25 bp, Artificial sequence
  Synthetic oligonucleotide
ccttcgctcttggtgtgcaatggca

SEQ ID NO: 673869 - DNA, 25 bp, Artificial sequence
  Synthetic oligonucleotide
atcggctacaacccggacaaggtca

SEQ ID NO: 673870 - DNA, 25 bp, Artificial sequence
  Synthetic oligonucleotide
gaaggtgcaaaagccttcgctcttg

SEQ ID NO: 673871 - DNA, 25 bp, Artificial sequence
  Synthetic oligonucleotide
gcaagctgccgaactggaagaacct

SEQ ID NO: 673872 - DNA, 25 bp, Artificial sequence
  Synthetic oligonucleotide
gccatctccgtagaaggtgcaaaag

SEQ ID NO: 673873 - DNA, 25 bp, Artificial sequence
  Synthetic oligonucleotide
ggtcgaagccatctccgtagaaggt

SEQ ID NO: 673874 - DNA, 25 bp, Artificial sequence
  Synthetic oligonucleotide
cgggttggtcgaagccatctccgta

SEQ ID NO: 673875 - DNA, 25 bp, Artificial sequence
  Synthetic oligonucleotide
gcctgacgggttggtcgaagccatc

SEQ ID NO: 673876 - DNA, 25 bp, Artificial sequence
  Synthetic oligonucleotide
tcggcttgccgagcgagttccaggt

SEQ ID NO: 673877 - DNA, 25 bp, Artificial sequence
  Synthetic oligonucleotide
agaagcactggcgcctgacgggttg

SEQ ID NO: 673878 - DNA, 25 bp, Artificial sequence
  Synthetic oligonucleotide
accagaaggtgcacgaggtcggaac

SEQ ID NO: 673879 - DNA, 25 bp, Artificial sequence
  Synthetic oligonucleotide
ggccttcgagtagaagcactggcgc

SEQ ID NO: 673880 - DNA, 25 bp, Artificial sequence
  Synthetic oligonucleotide
ggcgccgggccttcgagtagaagca

SEQ ID NO: 673881 - DNA, 25 bp, Artificial sequence
  Synthetic oligonucleotide
tcgtctggcgccgggccttcgagta

SEQ ID NO: 673882 - DNA, 25 bp, Artificial sequence
  Synthetic oligonucleotide
gttgatcgtctggcgccgggccttc

SEQ ID NO: 673883 - DNA, 25 bp, Artificial sequence
  Synthetic oligonucleotide
agggcgttgatcgtctggcgccggg

SEQ ID NO: 673884 - DNA, 25 bp, Artificial sequence
  Synthetic oligonucleotide
atggccagggcgttgatcgtctggc

SEQ ID NO: 673885 - DNA, 25 bp, Artificial sequence
  Synthetic oligonucleotide
ccatccatggccagggcgttgatcg

SEQ ID NO: 673886 - DNA, 25 bp, Artificial sequence
  Synthetic oligonucleotide
tcaattccatccatggccagggcgt

SEQ ID NO: 673887 - DNA, 25 bp, Artificial sequence
  Synthetic oligonucleotide
tccaggtcaattccatccatggcca

SEQ ID NO: 673888 - DNA, 25 bp, Artificial sequence
  Synthetic oligonucleotide
actggcgcctgacgggttggtcgaa

SEQ ID NO: 673889 - DNA, 25 bp, Artificial sequence
  Synthetic oligonucleotide
ccgccctggagctggtcaagaacaa

SEQ ID NO: 673890 - DNA, 25 bp, Artificial sequence
  Synthetic oligonucleotide
ggatgctgtgccgggaacattgttt

SEQ ID NO: 673891 - DNA, 25 bp, Artificial sequence
  Synthetic oligonucleotide
ggcgtcgggatgctgtgccgggaac

SEQ ID NO: 673892 - DNA, 25 bp, Artificial sequence
  Synthetic oligonucleotide
gacaagggcgtcgggatgctgtgcc

SEQ ID NO: 673893 - DNA, 25 bp, Artificial sequence
  Synthetic oligonucleotide
ttcaccgacaagggcgtcgggatgc

SEQ ID NO: 673894 - DNA, 25 bp, Artificial sequence
  Synthetic oligonucleotide
agcgtttcaccgacaagggcgtcgg

SEQ ID NO: 673895 - DNA, 25 bp, Artificial sequence
  Synthetic oligonucleotide
cccgcgagcgtttcaccgacaaggg

SEQ ID NO: 673896 - DNA, 25 bp, Artificial sequence
  Synthetic oligonucleotide
agaagacccgcgagcgtttcaccga

SEQ ID NO: 673897 - DNA, 25 bp, Artificial sequence
  Synthetic oligonucleotide
agaacaagaagacccgcgagcgttt

SEQ ID NO: 673898 - DNA, 25 bp, Artificial sequence
  Synthetic oligonucleotide
gagtggttcggcagccagtactacg

SEQ ID NO: 673899 - DNA, 25 bp, Artificial sequence
  Synthetic oligonucleotide
tggagctggtcaagaacaagaagac

SEQ ID NO: 673900 - DNA, 25 bp, Artificial sequence
  Synthetic oligonucleotide
tgtttccgcaacggtttgatcatgc

SEQ ID NO: 673901 - DNA, 25 bp, Artificial sequence
  Synthetic oligonucleotide
tggtcgccgccctggagctggtcaa

SEQ ID NO: 673902 - DNA, 25 bp, Artificial sequence
  Synthetic oligonucleotide
tcggcatggtcgccgccctggagct

SEQ ID NO: 673903 - DNA, 25 bp, Artificial sequence
  Synthetic oligonucleotide
gcggggtcggcatggtcgccgccct

SEQ ID NO: 673904 - DNA, 25 bp, Artificial sequence
  Synthetic oligonucleotide
aagcgcgcggggtcggcatggtcgc

SEQ ID NO: 673905 - DNA, 25 bp, Artificial sequence
  Synthetic oligonucleotide
tgggcgaagcgcgcggggtcggcat

SEQ ID NO: 673906 - DNA, 25 bp, Artificial sequence
  Synthetic oligonucleotide
cgttggtgggcgaagcgcgcggggt

SEQ ID NO: 673907 - DNA, 25 bp, Artificial sequence
  Synthetic oligonucleotide
accacccgttggtgggcgaagcgcg

SEQ ID NO: 673908 - DNA, 25 bp, Artificial sequence
  Synthetic oligonucleotide
tggccgaccacccgttggtgggcga

SEQ ID NO: 673909 - DNA, 25 bp, Artificial sequence
  Synthetic oligonucleotide
tggtcaagaacaagaagacccgcga

SEQ ID NO: 673910 - DNA, 25 bp, Artificial sequence
  Synthetic oligonucleotide
cgccgctggtgatcgatccgtcgca

SEQ ID NO: 673911 - DNA, 25 bp, Artificial sequence
  Synthetic oligonucleotide
tcgatcagaccgccgccgccgtcct

SEQ ID NO: 673912 - DNA, 25 bp, Artificial sequence
  Synthetic oligonucleotide
aagtgcctcgatcagaccgccgccg

SEQ ID NO: 673913 - DNA, 25 bp, Artificial sequence
  Synthetic oligonucleotide
gcgcgcaagtgcctcgatcagaccg

SEQ ID NO: 673914 - DNA, 25 bp, Artificial sequence
  Synthetic oligonucleotide
ccctggcgcgcaagtgcctcgatca

SEQ ID NO: 673915 - DNA, 25 bp, Artificial sequence
  Synthetic oligonucleotide
tgatcaccctggcgcgcaagtgcct

SEQ ID NO: 673916 - DNA, 25 bp, Artificial sequence
  Synthetic oligonucleotide
atgagttgatcaccctggcgcgcaa

SEQ ID NO: 673917 - DNA, 25 bp, Artificial sequence
  Synthetic oligonucleotide
agatcgatgagttgatcaccctggc

SEQ ID NO: 673918 - DNA, 25 bp, Artificial sequence
  Synthetic oligonucleotide
cgtcgcagatcgatgagttgatcac

SEQ ID NO: 673919 - DNA, 25 bp, Artificial sequence
  Synthetic oligonucleotide
tgtgccgggaacattgtttccgcaa

SEQ ID NO: 673920 - DNA, 25 bp, Artificial sequence
  Synthetic oligonucleotide
tggtgatcgatccgtcgcagatcga

SEQ ID NO: 673921 - DNA, 25 bp, Artificial sequence
  Synthetic oligonucleotide
gaacattgtttccgcaacggtttga

SEQ ID NO: 673922 - DNA, 25 bp, Artificial sequence
  Synthetic oligonucleotide
atctcgccgccgctggtgatcgatc

SEQ ID NO: 673923 - DNA, 25 bp, Artificial sequence
  Synthetic oligonucleotide
atgattatctcgccgccgctggtga

SEQ ID NO: 673924 - DNA, 25 bp, Artificial sequence
  Synthetic oligonucleotide
gacactatgattatctcgccgccgc

SEQ ID NO: 673925 - DNA, 25 bp, Artificial sequence
  Synthetic oligonucleotide
gtgggcgacactatgattatctcgc

SEQ ID NO: 673926 - DNA, 25 bp, Artificial sequence
  Synthetic oligonucleotide
cgcgcggtgggcgacactatgatta

SEQ ID NO: 673927 - DNA, 25 bp, Artificial sequence
  Synthetic oligonucleotide
atcatgcgcgcggtgggcgacacta

SEQ ID NO: 673928 - DNA, 25 bp, Artificial sequence
  Synthetic oligonucleotide
cggtttgatcatgcgcgcggtgggc

SEQ ID NO: 673929 - DNA, 25 bp, Artificial sequence
  Synthetic oligonucleotide
cgcaacggtttgatcatgcgcgcgg

SEQ ID NO: 673930 - DNA, 25 bp, Artificial sequence
  Synthetic oligonucleotide
gaaacgctggcaggagctggccgac

SEQ ID NO: 673931 - DNA, 25 bp, Artificial sequence
  Synthetic oligonucleotide
tcgatccgtcgcagatcgatgagtt

SEQ ID NO: 673932 - DNA, 25 bp, Artificial sequence
  Synthetic oligonucleotide
tcacctccggctacatccccatggg

SEQ ID NO: 673933 - DNA, 25 bp, Artificial sequence
  Synthetic oligonucleotide
ggagctggccgaccacccgttggtg

SEQ ID NO: 673934 - DNA, 25 bp, Artificial sequence
  Synthetic oligonucleotide
gaagtgctcaaccagggcggcgagt

SEQ ID NO: 673935 - DNA, 25 bp, Artificial sequence
  Synthetic oligonucleotide
tcgtcgaagtgctcaaccagggcgg

SEQ ID NO: 673936 - DNA, 25 bp, Artificial sequence
  Synthetic oligonucleotide
acgagatcgtcgaagtgctcaacca

SEQ ID NO: 673937 - DNA, 25 bp, Artificial sequence
  Synthetic oligonucleotide
tgcgcgacgagatcgtcgaagtgct

SEQ ID NO: 673938 - DNA, 25 bp, Artificial sequence
  Synthetic oligonucleotide
tggtggtgcgcgacgagatcgtcga

SEQ ID NO: 673939 - DNA, 25 bp, Artificial sequence
  Synthetic oligonucleotide
gcggggtggtggtgcgcgacgagat

SEQ ID NO: 673940 - DNA, 25 bp, Artificial sequence
  Synthetic oligonucleotide
ccatgggcggggtggtggtgcgcga

SEQ ID NO: 673941 - DNA, 25 bp, Artificial sequence
  Synthetic oligonucleotide
agggcggcgagttctaccacggctt

SEQ ID NO: 673942 - DNA, 25 bp, Artificial sequence
  Synthetic oligonucleotide
ccggctacatccccatgggcggggt

SEQ ID NO: 673943 - DNA, 25 bp, Artificial sequence
  Synthetic oligonucleotide
gcgagttctaccacggcttcaccta

SEQ ID NO: 673944 - DNA, 25 bp, Artificial sequence
  Synthetic oligonucleotide
agggcctcacctccggctacatccc

SEQ ID NO: 673945 - DNA, 25 bp, Artificial sequence
  Synthetic oligonucleotide
tcgccaagggcctcacctccggcta

SEQ ID NO: 673946 - DNA, 25 bp, Artificial sequence
  Synthetic oligonucleotide
tgccgatcgccaagggcctcacctc

SEQ ID NO: 673947 - DNA, 25 bp, Artificial sequence
  Synthetic oligonucleotide
acctgatgccgatcgccaagggcct

SEQ ID NO: 673948 - DNA, 25 bp, Artificial sequence
  Synthetic oligonucleotide
ccccggacctgatgccgatcgccaa

SEQ ID NO: 673949 - DNA, 25 bp, Artificial sequence
  Synthetic oligonucleotide
gcaacgccccggacctgatgccgat

SEQ ID NO: 673950 - DNA, 25 bp, Artificial sequence
  Synthetic oligonucleotide
actacggcaacgccccggacctgat

SEQ ID NO: 673951 - DNA, 25 bp, Artificial sequence
  Synthetic oligonucleotide
agccagtactacggcaacgccccgg

SEQ ID NO: 673952 - DNA, 25 bp, Artificial sequence
  Synthetic oligonucleotide
ttcggcagccagtactacggcaacg

SEQ ID NO: 673953 - DNA, 25 bp, Artificial sequence
  Synthetic oligonucleotide
acatccccatgggcggggtggtggt

SEQ ID NO: 673954 - DNA, 25 bp, Artificial sequence
  Synthetic oligonucleotide
catccgcatcctgcgcgaagagaag

SEQ ID NO: 673955 - DNA, 25 bp, Artificial sequence
  Synthetic oligonucleotide
gccgtcctggcttgagtccctgagc

SEQ ID NO: 673956 - DNA, 25 bp, Artificial sequence
  Synthetic oligonucleotide
tttgcagaaacgctggcaggagctg

SEQ ID NO: 673957 - DNA, 25 bp, Artificial sequence
  Synthetic oligonucleotide
caccgtatttgcagaaacgctggca

SEQ ID NO: 673958 - DNA, 25 bp, Artificial sequence
  Synthetic oligonucleotide
aaacggcaccgtatttgcagaaacg

SEQ ID NO: 673959 - DNA, 25 bp, Artificial sequence
  Synthetic oligonucleotide
aggcggaaacggcaccgtatttgca

SEQ ID NO: 673960 - DNA, 25 bp, Artificial sequence
  Synthetic oligonucleotide
tcgagaaggtgaaggcggaaacggc

SEQ ID NO: 673961 - DNA, 25 bp, Artificial sequence
  Synthetic oligonucleotide
agatcatcgagaaggtgaaggcgga

SEQ ID NO: 673962 - DNA, 25 bp, Artificial sequence
  Synthetic oligonucleotide
aagagaagatcatcgagaaggtgaa

SEQ ID NO: 673963 - DNA, 25 bp, Artificial sequence
  Synthetic oligonucleotide
tcaaccagggcggcgagttctacca

SEQ ID NO: 673964 - DNA, 25 bp, Artificial sequence
  Synthetic oligonucleotide
catcctgcgcgaagagaagatcatc

SEQ ID NO: 673965 - DNA, 25 bp, Artificial sequence
  Synthetic oligonucleotide
ctggcaggagctggccgaccacccg

SEQ ID NO: 673966 - DNA, 25 bp, Artificial sequence
  Synthetic oligonucleotide
ggagaacatccgcatcctgcgcgaa

SEQ ID NO: 673967 - DNA, 25 bp, Artificial sequence
  Synthetic oligonucleotide
tggccctggagaacatccgcatcct

SEQ ID NO: 673968 - DNA, 25 bp, Artificial sequence
  Synthetic oligonucleotide
ccgccgtggccctggagaacatccg

SEQ ID NO: 673969 - DNA, 25 bp, Artificial sequence
  Synthetic oligonucleotide
tggcggccgccgtggccctggagaa

SEQ ID NO: 673970 - DNA, 25 bp, Artificial sequence
  Synthetic oligonucleotide
cccggtggcggccgccgtggccctg

SEQ ID NO: 673971 - DNA, 25 bp, Artificial sequence
  Synthetic oligonucleotide
cggtcacccggtggcggccgccgtg

SEQ ID NO: 673972 - DNA, 25 bp, Artificial sequence
  Synthetic oligonucleotide
tcacctattccggtcacccggtggc

SEQ ID NO: 673973 - DNA, 25 bp, Artificial sequence
  Synthetic oligonucleotide
cacggcttcacctattccggtcacc

SEQ ID NO: 673974 - DNA, 25 bp, Artificial sequence
  Synthetic oligonucleotide
tctaccacggcttcacctattccgg

SEQ ID NO: 673975 - DNA, 25 bp, Artificial sequence
  Synthetic oligonucleotide
gcgcgaagagaagatcatcgagaag

SEQ ID NO: 673976 - DNA, 25 bp, Artificial sequence
  Synthetic oligonucleotide
gggtacgacgtggtggtgccgtcca

SEQ ID NO: 673977 - DNA, 25 bp, Artificial sequence
  Synthetic oligonucleotide
gtcgtctacgacgtctacgacagca

SEQ ID NO: 673978 - DNA, 25 bp, Artificial sequence
  Synthetic oligonucleotide
gggtctaccagaagctcgacaagtc

SEQ ID NO: 673979 - DNA, 25 bp, Artificial sequence
  Synthetic oligonucleotide
aaggccggggtctaccagaagctcg

SEQ ID NO: 673980 - DNA, 25 bp, Artificial sequence
  Synthetic oligonucleotide
cagatcaaggccggggtctaccaga

SEQ ID NO: 673981 - DNA, 25 bp, Artificial sequence
  Synthetic oligonucleotide
gccaagcagatcaaggccggggtct

SEQ ID NO: 673982 - DNA, 25 bp, Artificial sequence
  Synthetic oligonucleotide
ttcctcgccaagcagatcaaggccg

SEQ ID NO: 673983 - DNA, 25 bp, Artificial sequence
  Synthetic oligonucleotide
aactccttcctcgccaagcagatca

SEQ ID NO: 673984 - DNA, 25 bp, Artificial sequence
  Synthetic oligonucleotide
ccgtccaactccttcctcgccaagc

SEQ ID NO: 673985 - DNA, 25 bp, Artificial sequence
  Synthetic oligonucleotide
agctcgacaagtccaagctgccgaa

SEQ ID NO: 673986 - DNA, 25 bp, Artificial sequence
  Synthetic oligonucleotide
gacgtggtggtgccgtccaactcct

SEQ ID NO: 673987 - DNA, 25 bp, Artificial sequence
  Synthetic oligonucleotide
acaagtccaagctgccgaactggaa

SEQ ID NO: 673988 - DNA, 25 bp, Artificial sequence
  Synthetic oligonucleotide
caagtccgggtacgacgtggtggtg

SEQ ID NO: 673989 - DNA, 25 bp, Artificial sequence
  Synthetic oligonucleotide
ctggcgggcaagtccgggtacgacg

SEQ ID NO: 673990 - DNA, 25 bp, Artificial sequence
  Synthetic oligonucleotide
agttgctggcgggcaagtccgggta

SEQ ID NO: 673991 - DNA, 25 bp, Artificial sequence
  Synthetic oligonucleotide
aagccaagttgctggcgggcaagtc

SEQ ID NO: 673992 - DNA, 25 bp, Artificial sequence
  Synthetic oligonucleotide
gtgctggaagccaagttgctggcgg

SEQ ID NO: 673993 - DNA, 25 bp, Artificial sequence
  Synthetic oligonucleotide
aacgaagtgctggaagccaagttgc

SEQ ID NO: 673994 - DNA, 25 bp, Artificial sequence
  Synthetic oligonucleotide
gacagcaacgaagtgctggaagcca

SEQ ID NO: 673995 - DNA, 25 bp, Artificial sequence
  Synthetic oligonucleotide
gtctacgacagcaacgaagtgctgg

SEQ ID NO: 673996 - DNA, 25 bp, Artificial sequence
  Synthetic oligonucleotide
agaccgccgccgccgtcctggcttg

SEQ ID NO: 673997 - DNA, 25 bp, Artificial sequence
  Synthetic oligonucleotide
gtggtgccgtccaactccttcctcg

SEQ ID NO: 673998 - DNA, 25 bp, Artificial sequence
  Synthetic oligonucleotide
gtcagcgacccgggcaacgagcatg

SEQ ID NO: 673999 - DNA, 25 bp, Artificial sequence
  Synthetic oligonucleotide
tccgtagaaggtgcaaaagccttcg

SEQ ID NO: 674000 - DNA, 25 bp, Artificial sequence
  Synthetic oligonucleotide
gccgcaacctgcgcctgccgctgac

SEQ ID NO: 674001 - DNA, 25 bp, Artificial sequence
  Synthetic oligonucleotide
atcggcatcggctacaacccggaca

SEQ ID NO: 674002 - DNA, 25 bp, Artificial sequence
  Synthetic oligonucleotide
gggcaccatcggcatcggctacaac

SEQ ID NO: 674003 - DNA, 25 bp, Artificial sequence
  Synthetic oligonucleotide
catgtggggcaccatcggcatcggc

SEQ ID NO: 674004 - DNA, 25 bp, Artificial sequence
  Synthetic oligonucleotide
ttccctacatgtggggcaccatcgg

SEQ ID NO: 674005 - DNA, 25 bp, Artificial sequence
  Synthetic oligonucleotide
tgcgattccctacatgtggggcacc

SEQ ID NO: 674006 - DNA, 25 bp, Artificial sequence
  Synthetic oligonucleotide
gagcatgcgattccctacatgtggg

SEQ ID NO: 674007 - DNA, 25 bp, Artificial sequence
  Synthetic oligonucleotide
accagaagctcgacaagtccaagct

SEQ ID NO: 674008 - DNA, 25 bp, Artificial sequence
  Synthetic oligonucleotide
gacccgggcaacgagcatgcgattc

SEQ ID NO: 674009 - DNA, 25 bp, Artificial sequence
  Synthetic oligonucleotide
atcaaggtcgtctacgacgtctacg

SEQ ID NO: 674010 - DNA, 25 bp, Artificial sequence
  Synthetic oligonucleotide
tggaagtcagcgacccgggcaacga

SEQ ID NO: 674011 - DNA, 25 bp, Artificial sequence
  Synthetic oligonucleotide
acaccctggaagtcagcgacccggg

SEQ ID NO: 674012 - DNA, 25 bp, Artificial sequence
  Synthetic oligonucleotide
tgatgcacaccctggaagtcagcga

SEQ ID NO: 674013 - DNA, 25 bp, Artificial sequence
  Synthetic oligonucleotide
aggacctgatgcacaccctggaagt

SEQ ID NO: 674014 - DNA, 25 bp, Artificial sequence
  Synthetic oligonucleotide
tgaacaaggacctgatgcacaccct

SEQ ID NO: 674015 - DNA, 25 bp, Artificial sequence
  Synthetic oligonucleotide
agaacctgaacaaggacctgatgca

SEQ ID NO: 674016 - DNA, 25 bp, Artificial sequence
  Synthetic oligonucleotide
actggaagaacctgaacaaggacct

SEQ ID NO: 674017 - DNA, 25 bp, Artificial sequence
  Synthetic oligonucleotide
tgccgaactggaagaacctgaacaa

SEQ ID NO: 674018 - DNA, 25 bp, Artificial sequence
  Synthetic oligonucleotide
ccaagctgccgaactggaagaacct

SEQ ID NO: 674019 - DNA, 25 bp, Artificial sequence
  Synthetic oligonucleotide
ggcaacgagcatgcgattccctaca

SEQ ID NO: 674020 - DNA, 25 bp, Artificial sequence
  Synthetic oligonucleotide
tggccaggctcaccgggtggtgacg

SEQ ID NO: 674021 - DNA, 25 bp, Artificial sequence
  Synthetic oligonucleotide
tacgacgtctacgacagcaacgaag

SEQ ID NO: 674022 - DNA, 25 bp, Artificial sequence
  Synthetic oligonucleotide
tcaacaaaaatggagctaccccgca

SEQ ID NO: 674023 - DNA, 25 bp, Artificial sequence
  Synthetic oligonucleotide
gatacttcaacaaaaatggagctac

SEQ ID NO: 674024 - DNA, 25 bp, Artificial sequence
  Synthetic oligonucleotide
cgcccggatacttcaacaaaaatgg

SEQ ID NO: 674025 - DNA, 25 bp, Artificial sequence
  Synthetic oligonucleotide
cgccaccgcccggatacttcaacaa

SEQ ID NO: 674026 - DNA, 25 bp, Artificial sequence
  Synthetic oligonucleotide
tcggttgcgccaccgcccggatact

SEQ ID NO: 674027 - DNA, 25 bp, Artificial sequence
  Synthetic oligonucleotide
acgcgatcggttgcgccaccgcccg

SEQ ID NO: 674028 - DNA, 25 bp, Artificial sequence
  Synthetic oligonucleotide
tggtgacgcgatcggttgcgccacc

SEQ ID NO: 674029 - DNA, 25 bp, Artificial sequence
  Synthetic oligonucleotide
gagctaccccgcatgatgaaacgtt

SEQ ID NO: 674030 - DNA, 25 bp, Artificial sequence
  Synthetic oligonucleotide
ggctcaccgggtggtgacgcgatcg

SEQ ID NO: 674031 - DNA, 25 bp, Artificial sequence
  Synthetic oligonucleotide
catgatgaaacgtttcggtaagacc

SEQ ID NO: 674032 - DNA, 25 bp, Artificial sequence
  Synthetic oligonucleotide
gtgcgttggccaggctcaccgggtg

SEQ ID NO: 674033 - DNA, 25 bp, Artificial sequence
  Synthetic oligonucleotide
gcgccagtgcgttggccaggctcac

SEQ ID NO: 674034 - DNA, 25 bp, Artificial sequence
  Synthetic oligonucleotide
cagactgcgccagtgcgttggccag

SEQ ID NO: 674035 - DNA, 25 bp, Artificial sequence
  Synthetic oligonucleotide
ttttgccagactgcgccagtgcgtt

SEQ ID NO: 674036 - DNA, 25 bp, Artificial sequence
  Synthetic oligonucleotide
gcggacttttgccagactgcgccag

SEQ ID NO: 674037 - DNA, 25 bp, Artificial sequence
  Synthetic oligonucleotide
ccctgagcggacttttgccagactg

SEQ ID NO: 674038 - DNA, 25 bp, Artificial sequence
  Synthetic oligonucleotide
ttgagtccctgagcggacttttgcc

SEQ ID NO: 674039 - DNA, 25 bp, Artificial sequence
  Synthetic oligonucleotide
cctggcttgagtccctgagcggact

SEQ ID NO: 674040 - DNA, 25 bp, Artificial sequence
  Synthetic oligonucleotide
ccccgcatgatgaaacgtttcggta

SEQ ID NO: 674041 - DNA, 25 bp, Artificial sequence
  Synthetic oligonucleotide
ccgggtggtgacgcgatcggttgcg

SEQ ID NO: 674042 - DNA, 25 bp, Artificial sequence
  Synthetic oligonucleotide
gcggacaacaaggtgctgcacgtgt

SEQ ID NO: 674043 - DNA, 25 bp, Artificial sequence
  Synthetic oligonucleotide
accgggatcaaggtcgtctacgacg

SEQ ID NO: 674044 - DNA, 25 bp, Artificial sequence
  Synthetic oligonucleotide
ctggagaagttcaccaaggaaaccg

SEQ ID NO: 674045 - DNA, 25 bp, Artificial sequence
  Synthetic oligonucleotide
cggacaccctggagaagttcaccaa

SEQ ID NO: 674046 - DNA, 25 bp, Artificial sequence
  Synthetic oligonucleotide
atcgcgccggacaccctggagaagt

SEQ ID NO: 674047 - DNA, 25 bp, Artificial sequence
  Synthetic oligonucleotide
gactacatcgcgccggacaccctgg

SEQ ID NO: 674048 - DNA, 25 bp, Artificial sequence
  Synthetic oligonucleotide
tggtccgactacatcgcgccggaca

SEQ ID NO: 674049 - DNA, 25 bp, Artificial sequence
  Synthetic oligonucleotide
tacaactggtccgactacatcgcgc

SEQ ID NO: 674050 - DNA, 25 bp, Artificial sequence
  Synthetic oligonucleotide
cacgtgtacaactggtccgactaca

SEQ ID NO: 674051 - DNA, 25 bp, Artificial sequence
  Synthetic oligonucleotide
aaaatggagctaccccgcatgatga

SEQ ID NO: 674052 - DNA, 25 bp, Artificial sequence
  Synthetic oligonucleotide
aacaaggtgctgcacgtgtacaact

SEQ ID NO: 674053 - DNA, 25 bp, Artificial sequence
  Synthetic oligonucleotide
gccgccgccgtcctggcttgagtcc

SEQ ID NO: 674054 - DNA, 25 bp, Artificial sequence
  Synthetic oligonucleotide
caggctgcggacaacaaggtgctgc

SEQ ID NO: 674055 - DNA, 25 bp, Artificial sequence
  Synthetic oligonucleotide
tatggcgcaggctgcggacaacaag

SEQ ID NO: 674056 - DNA, 25 bp, Artificial sequence
  Synthetic oligonucleotide
ggccggtatggcgcaggctgcggac

SEQ ID NO: 674057 - DNA, 25 bp, Artificial sequence
  Synthetic oligonucleotide
ctctgtggccggtatggcgcaggct

SEQ ID NO: 674058 - DNA, 25 bp, Artificial sequence
  Synthetic oligonucleotide
ggcgggctctgtggccggtatggcg

SEQ ID NO: 674059 - DNA, 25 bp, Artificial sequence
  Synthetic oligonucleotide
accttggcgggctctgtggccggta

SEQ ID NO: 674060 - DNA, 25 bp, Artificial sequence
  Synthetic oligonucleotide
gccctgaccttggcgggctctgtgg

SEQ ID NO: 674061 - DNA, 25 bp, Artificial sequence
  Synthetic oligonucleotide
cctgctcgccctgaccttggcgggc

SEQ ID NO: 674062 - DNA, 25 bp, Artificial sequence
  Synthetic oligonucleotide
taagaccctgctcgccctgaccttg

SEQ ID NO: 674063 - DNA, 25 bp, Artificial sequence
  Synthetic oligonucleotide
gtgctgcacgtgtacaactggtccg

SEQ ID NO: 674064 - DNA, 25 bp, Artificial sequence
  Synthetic oligonucleotide
tacaagcagttgaacgagaagggcg

SEQ ID NO: 674065 - DNA, 25 bp, Artificial sequence
  Synthetic oligonucleotide
tgggacagcgagggcaacaagatcc

SEQ ID NO: 674066 - DNA, 25 bp, Artificial sequence
  Synthetic oligonucleotide
tatatctgggacagcgagggcaaca

SEQ ID NO: 674067 - DNA, 25 bp, Artificial sequence
  Synthetic oligonucleotide
ggcgtctatatctgggacagcgagg

SEQ ID NO: 674068 - DNA, 25 bp, Artificial sequence
  Synthetic oligonucleotide
gccgaaggcgtctatatctgggaca

SEQ ID NO: 674069 - DNA, 25 bp, Artificial sequence
  Synthetic oligonucleotide
accaaggccgaaggcgtctatatct

SEQ ID NO: 674070 - DNA, 25 bp, Artificial sequence
  Synthetic oligonucleotide
atcatcaccaaggccgaaggcgtct

SEQ ID NO: 674071 - DNA, 25 bp, Artificial sequence
  Synthetic oligonucleotide
gcgcggatcatcaccaaggccgaag

SEQ ID NO: 674072 - DNA, 25 bp, Artificial sequence
  Synthetic oligonucleotide
aagggcgcgcggatcatcaccaagg

SEQ ID NO: 674073 - DNA, 25 bp, Artificial sequence
  Synthetic oligonucleotide
ccgcccacccgccggtggtcgagct

SEQ ID NO: 674074 - DNA, 25 bp, Artificial sequence
  Synthetic oligonucleotide
cagttgaacgagaagggcgcgcgga

SEQ ID NO: 674075 - DNA, 25 bp, Artificial sequence
  Synthetic oligonucleotide
aagatcctcgatgcgatggccggcc

SEQ ID NO: 674076 - DNA, 25 bp, Artificial sequence
  Synthetic oligonucleotide
accgactacaagcagttgaacgaga

SEQ ID NO: 674077 - DNA, 25 bp, Artificial sequence
  Synthetic oligonucleotide
ccgttcaccgactacaagcagttga

SEQ ID NO: 674078 - DNA, 25 bp, Artificial sequence
  Synthetic oligonucleotide
ctgccgccgttcaccgactacaagc

SEQ ID NO: 674079 - DNA, 25 bp, Artificial sequence
  Synthetic oligonucleotide
caccatctgccgccgttcaccgact

SEQ ID NO: 674080 - DNA, 25 bp, Artificial sequence
  Synthetic oligonucleotide
ccgcgaccaccatctgccgccgttc

SEQ ID NO: 674081 - DNA, 25 bp, Artificial sequence
  Synthetic oligonucleotide
gttgagccgcgaccaccatctgccg

SEQ ID NO: 674082 - DNA, 25 bp, Artificial sequence
  Synthetic oligonucleotide
gcaggcgttgagccgcgaccaccat

SEQ ID NO: 674083 - DNA, 25 bp, Artificial sequence
  Synthetic oligonucleotide
tgagtggcaggcgttgagccgcgac

SEQ ID NO: 674084 - DNA, 25 bp, Artificial sequence
  Synthetic oligonucleotide
aacgagaagggcgcgcggatcatca

SEQ ID NO: 674085 - DNA, 25 bp, Artificial sequence
  Synthetic oligonucleotide
gcgaggagctggtccaggccgccac

SEQ ID NO: 674086 - DNA, 25 bp, Artificial sequence
  Synthetic oligonucleotide
cttccagaccgcccacccgccggtg

SEQ ID NO: 674087 - DNA, 25 bp, Artificial sequence
  Synthetic oligonucleotide
cctgttcttccagaccgcccacccg

SEQ ID NO: 674088 - DNA, 25 bp, Artificial sequence
  Synthetic oligonucleotide
tctacaacctgttcttccagaccgc

SEQ ID NO: 674089 - DNA, 25 bp, Artificial sequence
  Synthetic oligonucleotide
tgccgttctacaacctgttcttcca

SEQ ID NO: 674090 - DNA, 25 bp, Artificial sequence
  Synthetic oligonucleotide
gcgagttgccgttctacaacctgtt

SEQ ID NO: 674091 - DNA, 25 bp, Artificial sequence
  Synthetic oligonucleotide
agatgcgcgagttgccgttctacaa

SEQ ID NO: 674092 - DNA, 25 bp, Artificial sequence
  Synthetic oligonucleotide
cccggcagatgcgcgagttgccgtt

SEQ ID NO: 674093 - DNA, 25 bp, Artificial sequence
  Synthetic oligonucleotide
ccgccacccggcagatgcgcgagtt

SEQ ID NO: 674094 - DNA, 25 bp, Artificial sequence
  Synthetic oligonucleotide
agcgagggcaacaagatcctcgatg

SEQ ID NO: 674095 - DNA, 25 bp, Artificial sequence
  Synthetic oligonucleotide
agctggtccaggccgccacccggca

SEQ ID NO: 674096 - DNA, 25 bp, Artificial sequence
  Synthetic oligonucleotide
ggcaacaagatcctcgatgcgatgg

SEQ ID NO: 674097 - DNA, 25 bp, Artificial sequence
  Synthetic oligonucleotide
acggccgcgaggagctggtccaggc

SEQ ID NO: 674098 - DNA, 25 bp, Artificial sequence
  Synthetic oligonucleotide
tcggctacggccgcgaggagctggt

SEQ ID NO: 674099 - DNA, 25 bp, Artificial sequence
  Synthetic oligonucleotide
tcaacgtcggctacggccgcgagga

SEQ ID NO: 674100 - DNA, 25 bp, Artificial sequence
  Synthetic oligonucleotide
gtgcgtcaacgtcggctacggccgc

SEQ ID NO: 674101 - DNA, 25 bp, Artificial sequence
  Synthetic oligonucleotide
ctctggtgcgtcaacgtcggctacg

SEQ ID NO: 674102 - DNA, 25 bp, Artificial sequence
  Synthetic oligonucleotide
gccggcctctggtgcgtcaacgtcg

SEQ ID NO: 674103 - DNA, 25 bp, Artificial sequence
  Synthetic oligonucleotide
gcgatggccggcctctggtgcgtca

SEQ ID NO: 674104 - DNA, 25 bp, Artificial sequence
  Synthetic oligonucleotide
ctcgatgcgatggccggcctctggt

SEQ ID NO: 674105 - DNA, 25 bp, Artificial sequence
  Synthetic oligonucleotide
atcaccaacgccaagacccgtgagt

SEQ ID NO: 674106 - DNA, 25 bp, Artificial sequence
  Synthetic oligonucleotide
tccaggccgccacccggcagatgcg

SEQ ID NO: 674107 - DNA, 25 bp, Artificial sequence
  Synthetic oligonucleotide
tggagaactgcaagcccctcgagca

SEQ ID NO: 674108 - DNA, 25 bp, Artificial sequence
  Synthetic oligonucleotide
agacccgtgagtggcaggcgttgag

SEQ ID NO: 674109 - DNA, 25 bp, Artificial sequence
  Synthetic oligonucleotide
acgtcgcggtgaagcgtgcggagca

SEQ ID NO: 674110 - DNA, 25 bp, Artificial sequence
  Synthetic oligonucleotide
gcggctacgtcgcggtgaagcgtgc

SEQ ID NO: 674111 - DNA, 25 bp, Artificial sequence
  Synthetic oligonucleotide
tcatcagcggctacgtcgcggtgaa

SEQ ID NO: 674112 - DNA, 25 bp, Artificial sequence
  Synthetic oligonucleotide
gcaagttcatcagcggctacgtcgc

SEQ ID NO: 674113 - DNA, 25 bp, Artificial sequence
  Synthetic oligonucleotide
tcggcagcaagttcatcagcggcta

SEQ ID NO: 674114 - DNA, 25 bp, Artificial sequence
  Synthetic oligonucleotide
agtatctcggcagcaagttcatcag

SEQ ID NO: 674115 - DNA, 25 bp, Artificial sequence
  Synthetic oligonucleotide
tcgagcagtatctcggcagcaagtt

SEQ ID NO: 674116 - DNA, 25 bp, Artificial sequence
  Synthetic oligonucleotide
aagcgtgcggagcacgagaatttca

SEQ ID NO: 674117 - DNA, 25 bp, Artificial sequence
  Synthetic oligonucleotide
actgcaagcccctcgagcagtatct

SEQ ID NO: 674118 - DNA, 25 bp, Artificial sequence
  Synthetic oligonucleotide
tgcggagcacgagaatttcaagcgg

SEQ ID NO: 674119 - DNA, 25 bp, Artificial sequence
  Synthetic oligonucleotide
agcgcatggagaactgcaagcccct

SEQ ID NO: 674120 - DNA, 25 bp, Artificial sequence
  Synthetic oligonucleotide
cgctggagcgcatggagaactgcaa

SEQ ID NO: 674121 - DNA, 25 bp, Artificial sequence
  Synthetic oligonucleotide
gaagcggcgctggagcgcatggaga

SEQ ID NO: 674122 - DNA, 25 bp, Artificial sequence
  Synthetic oligonucleotide
acgatcgaagcggcgctggagcgca

SEQ ID NO: 674123 - DNA, 25 bp, Artificial sequence
  Synthetic oligonucleotide
ccgctgacgatcgaagcggcgctgg

SEQ ID NO: 674124 - DNA, 25 bp, Artificial sequence
  Synthetic oligonucleotide
accggcgagtggttcggcagccagt

SEQ ID NO: 674125 - DNA, 25 bp, Artificial sequence
  Synthetic oligonucleotide
tttcggtaagaccctgctcgccctg

SEQ ID NO: 674126 - DNA, 25 bp, Artificial sequence
  Synthetic oligonucleotide
cgcctgccgctgacgatcgaagcgg

SEQ ID NO: 674127 - DNA, 25 bp, Artificial sequence
  Synthetic oligonucleotide
acctgcgcctgccgctgacgatcga

SEQ ID NO: 674128 - DNA, 25 bp, Artificial sequence
  Synthetic oligonucleotide
agcccctcgagcagtatctcggcag

SEQ ID NO: 674129 - DNA, 25 bp, Artificial sequence
  Synthetic oligonucleotide
ttgatcctgaccgggggcggccggc

SEQ ID NO: 674130 - DNA, 25 bp, Artificial sequence
  Synthetic oligonucleotide
cccggacagtcttgaatagaagagg

SEQ ID NO: 674131 - DNA, 25 bp, Artificial sequence
  Synthetic oligonucleotide
agccaaatcaccaacgccaagaccc

SEQ ID NO: 674132 - DNA, 25 bp, Artificial sequence
  Synthetic oligonucleotide
atgaacagccaaatcaccaacgcca

SEQ ID NO: 674133 - DNA, 25 bp, Artificial sequence
  Synthetic oligonucleotide
tgtgacatgaacagccaaatcacca

SEQ ID NO: 674134 - DNA, 25 bp, Artificial sequence
  Synthetic oligonucleotide
aagaggtgtgacatgaacagccaaa

SEQ ID NO: 674135 - DNA, 25 bp, Artificial sequence
  Synthetic oligonucleotide
gaatagaagaggtgtgacatgaaca

SEQ ID NO: 674136 - DNA, 25 bp, Artificial sequence
  Synthetic oligonucleotide
agtcttgaatagaagaggtgtgaca

SEQ ID NO: 674137 - DNA, 25 bp, Artificial sequence
  Synthetic oligonucleotide
ccgctcccggacagtcttgaataga

SEQ ID NO: 674138 - DNA, 25 bp, Artificial sequence
  Synthetic oligonucleotide
gcggtgaagcgtgcggagcacgaga

SEQ ID NO: 674139 - DNA, 25 bp, Artificial sequence
  Synthetic oligonucleotide
gggcggccggcgtggtccgccgctc

SEQ ID NO: 674140 - DNA, 25 bp, Artificial sequence
  Synthetic oligonucleotide
acgccaagacccgtgagtggcaggc

SEQ ID NO: 674141 - DNA, 25 bp, Artificial sequence
  Synthetic oligonucleotide
tcctgctttccgtttgatcctgacc

SEQ ID NO: 674142 - DNA, 25 bp, Artificial sequence
  Synthetic oligonucleotide
aattcctcctgctttccgtttgatc

SEQ ID NO: 674143 - DNA, 25 bp, Artificial sequence
  Synthetic oligonucleotide
agcgggaattcctcctgctttccgt

SEQ ID NO: 674144 - DNA, 25 bp, Artificial sequence
  Synthetic oligonucleotide
cctgggagcgggaattcctcctgct

SEQ ID NO: 674145 - DNA, 25 bp, Artificial sequence
  Synthetic oligonucleotide
tcagctcctgggagcgggaattcct

SEQ ID NO: 674146 - DNA, 25 bp, Artificial sequence
  Synthetic oligonucleotide
gggtaatcagctcctgggagcggga

SEQ ID NO: 674147 - DNA, 25 bp, Artificial sequence
  Synthetic oligonucleotide
tcaagcgggtaatcagctcctggga

SEQ ID NO: 674148 - DNA, 25 bp, Artificial sequence
  Synthetic oligonucleotide
agaatttcaagcgggtaatcagctc

SEQ ID NO: 674149 - DNA, 25 bp, Artificial sequence
  Synthetic oligonucleotide
gcacgagaatttcaagcgggtaatc

SEQ ID NO: 674150 - DNA, 25 bp, Artificial sequence
  Synthetic oligonucleotide
cggcgtggtccgccgctcccggaca

SEQ ID NO: 674151 - DNA, 25 bp, Artificial sequence
  Synthetic oligonucleotide
gccggacgagttcggcgtctgggcc

SEQ ID NO: 674152 - DNA, 25 bp, Artificial sequence
  Synthetic oligonucleotide
ggaaaacgtcgccgccttcatcgcc

SEQ ID NO: 674153 - DNA, 25 bp, Artificial sequence
  Synthetic oligonucleotide
ggcgaggaaaacgtcgccgccttca

SEQ ID NO: 674154 - DNA, 25 bp, Artificial sequence
  Synthetic oligonucleotide
ctcgaagtgggcgaggaaaacgtcg

SEQ ID NO: 674155 - DNA, 25 bp, Artificial sequence
  Synthetic oligonucleotide
gaagattctcgaagtgggcgaggaa

SEQ ID NO: 674156 - DNA, 25 bp, Artificial sequence
  Synthetic oligonucleotide
ggagaagaagattctcgaagtgggc

SEQ ID NO: 674157 - DNA, 25 bp, Artificial sequence
  Synthetic oligonucleotide
gcagttggagaagaagattctcgaa

SEQ ID NO: 674158 - DNA, 25 bp, Artificial sequence
  Synthetic oligonucleotide
cgccgagcagttggagaagaagatt

SEQ ID NO: 674159 - DNA, 25 bp, Artificial sequence
  Synthetic oligonucleotide
ctgggccgccgagcagttggagaag

SEQ ID NO: 674160 - DNA, 25 bp, Artificial sequence
  Synthetic oligonucleotide
catcccgggcatcgtccacatcgcc

SEQ ID NO: 674161 - DNA, 25 bp, Artificial sequence
  Synthetic oligonucleotide
cgagttcggcgtctgggccgccgag

SEQ ID NO: 674162 - DNA, 25 bp, Artificial sequence
  Synthetic oligonucleotide
gagccgatccagggcgccggcggcg

SEQ ID NO: 674163 - DNA, 25 bp, Artificial sequence
  Synthetic oligonucleotide
atgtcgccggacgagttcggcgtct

SEQ ID NO: 674164 - DNA, 25 bp, Artificial sequence
  Synthetic oligonucleotide
ggcgacatgtcgccggacgagttcg

SEQ ID NO: 674165 - DNA, 25 bp, Artificial sequence
  Synthetic oligonucleotide
gagggcggcgacatgtcgccggacg

SEQ ID NO: 674166 - DNA, 25 bp, Artificial sequence
  Synthetic oligonucleotide
tacggcgagggcggcgacatgtcgc

SEQ ID NO: 674167 - DNA, 25 bp, Artificial sequence
  Synthetic oligonucleotide
tactggtacggcgagggcggcgaca

SEQ ID NO: 674168 - DNA, 25 bp, Artificial sequence
  Synthetic oligonucleotide
cagccctactggtacggcgagggcg

SEQ ID NO: 674169 - DNA, 25 bp, Artificial sequence
  Synthetic oligonucleotide
atcgcccagccctactggtacggcg

SEQ ID NO: 674170 - DNA, 25 bp, Artificial sequence
  Synthetic oligonucleotide
gtccacatcgcccagccctactggt

SEQ ID NO: 674171 - DNA, 25 bp, Artificial sequence
  Synthetic oligonucleotide
gggcatcgtccacatcgcccagccc

SEQ ID NO: 674172 - DNA, 25 bp, Artificial sequence
  Synthetic oligonucleotide
cggcgtctgggccgccgagcagttg

SEQ ID NO: 674173 - DNA, 25 bp, Artificial sequence
  Synthetic oligonucleotide
gcgagatcctcgccaagtacgacat

SEQ ID NO: 674174 - DNA, 25 bp, Artificial sequence
  Synthetic oligonucleotide
ggccgtaccggcgagtggttcggca

SEQ ID NO: 674175 - DNA, 25 bp, Artificial sequence
  Synthetic oligonucleotide
tctgcggcttcggccgtaccggcga

SEQ ID NO: 674176 - DNA, 25 bp, Artificial sequence
  Synthetic oligonucleotide
aagtgatctgcggcttcggccgtac

SEQ ID NO: 674177 - DNA, 25 bp, Artificial sequence
  Synthetic oligonucleotide
ccgacgaagtgatctgcggcttcgg

SEQ ID NO: 674178 - DNA, 25 bp, Artificial sequence
  Synthetic oligonucleotide
ggtccgccgctcccggacagtcttg

SEQ ID NO: 674179 - DNA, 25 bp, Artificial sequence
  Synthetic oligonucleotide
acccgccggtggtcgagctggccaa

SEQ ID NO: 674180 - DNA, 25 bp, Artificial sequence
  Synthetic oligonucleotide
tcatcgccgacgaagtgatctgcgg

SEQ ID NO: 674181 - DNA, 25 bp, Artificial sequence
  Synthetic oligonucleotide
tcctgttcatcgccgacgaagtgat

SEQ ID NO: 674182 - DNA, 25 bp, Artificial sequence
  Synthetic oligonucleotide
acgacatcctgttcatcgccgacga

SEQ ID NO: 674183 - DNA, 25 bp, Artificial sequence
  Synthetic oligonucleotide
cgtcgccgccttcatcgccgagccg

SEQ ID NO: 674184 - DNA, 25 bp, Artificial sequence
  Synthetic oligonucleotide
tcctcgccaagtacgacatcctgtt

SEQ ID NO: 674185 - DNA, 25 bp, Artificial sequence
  Synthetic oligonucleotide
gccttcatcgccgagccgatccagg

SEQ ID NO: 674186 - DNA, 25 bp, Artificial sequence
  Synthetic oligonucleotide
aagatccgcgagatcctcgccaagt

SEQ ID NO: 674187 - DNA, 25 bp, Artificial sequence
  Synthetic oligonucleotide
tggccgaagatccgcgagatcctcg

SEQ ID NO: 674188 - DNA, 25 bp, Artificial sequence
  Synthetic oligonucleotide
acctactggccgaagatccgcgaga

SEQ ID NO: 674189 - DNA, 25 bp, Artificial sequence
  Synthetic oligonucleotide
gccggacacctactggccgaagatc

SEQ ID NO: 674190 - DNA, 25 bp, Artificial sequence
  Synthetic oligonucleotide
gtcccgccggacacctactggccga

SEQ ID NO: 674191 - DNA, 25 bp, Artificial sequence
  Synthetic oligonucleotide
gtgatcgtcccgccggacacctact

SEQ ID NO: 674192 - DNA, 25 bp, Artificial sequence
  Synthetic oligonucleotide
ggcggcgtgatcgtcccgccggaca

SEQ ID NO: 674193 - DNA, 25 bp, Artificial sequence
  Synthetic oligonucleotide
ggcgccggcggcgtgatcgtcccgc

SEQ ID NO: 674194 - DNA, 25 bp, Artificial sequence
  Synthetic oligonucleotide
atcgccgagccgatccagggcgccg

SEQ ID NO: 674195 - DNA, 25 bp, Artificial sequence
  Synthetic oligonucleotide
ccaagtacgacatcctgttcatcgc

SEQ ID NO: 674196 - DNA, 25 bp, Artificial sequence
  Synthetic oligonucleotide
tcttcaccggctccggctccgaggc

SEQ ID NO: 674197 - DNA, 25 bp, Artificial sequence
  Synthetic oligonucleotide
cggtggtcgagctggccaaggcgat

SEQ ID NO: 674198 - DNA, 25 bp, Artificial sequence
  Synthetic oligonucleotide
gggcgaccaagggccagccgcagaa

SEQ ID NO: 674199 - DNA, 25 bp, Artificial sequence
  Synthetic oligonucleotide
tcgagctggccaaggcgatcgccga

SEQ ID NO: 674200 - DNA, 25 bp, Artificial sequence
  Synthetic oligonucleotide
actattgggcgaccaagggccagcc

SEQ ID NO: 674201 - DNA, 25 bp, Artificial sequence
  Synthetic oligonucleotide
tccgccactattgggcgaccaaggg

SEQ ID NO: 674202 - DNA, 25 bp, Artificial sequence
  Synthetic oligonucleotide
tatggtccgccactattgggcgacc

SEQ ID NO: 674203 - DNA, 25 bp, Artificial sequence
  Synthetic oligonucleotide
gctgcgtatggtccgccactattgg

SEQ ID NO: 674204 - DNA, 25 bp, Artificial sequence
  Synthetic oligonucleotide
accgtgctgcgtatggtccgccact

SEQ ID NO: 674205 - DNA, 25 bp, Artificial sequence
  Synthetic oligonucleotide
cgaggccaacgacaccgtgctgcgt

SEQ ID NO: 674206 - DNA, 25 bp, Artificial sequence
  Synthetic oligonucleotide
ccaagggccagccgcagaagaaagt

SEQ ID NO: 674207 - DNA, 25 bp, Artificial sequence
  Synthetic oligonucleotide
ccggctccggctccgaggccaacga

SEQ ID NO: 674208 - DNA, 25 bp, Artificial sequence
  Synthetic oligonucleotide
caacgacaccgtgctgcgtatggtc

SEQ ID NO: 674209 - DNA, 25 bp, Artificial sequence
  Synthetic oligonucleotide
acgtgttcttcaccggctccggctc

SEQ ID NO: 674210 - DNA, 25 bp, Artificial sequence
  Synthetic oligonucleotide
tgaaccacgtgttcttcaccggctc

SEQ ID NO: 674211 - DNA, 25 bp, Artificial sequence
  Synthetic oligonucleotide
aaggcatgaaccacgtgttcttcac

SEQ ID NO: 674212 - DNA, 25 bp, Artificial sequence
  Synthetic oligonucleotide
ctccggaaggcatgaaccacgtgtt

SEQ ID NO: 674213 - DNA, 25 bp, Artificial sequence
  Synthetic oligonucleotide
tttccccatcccgggcatcgtccac

SEQ ID NO: 674214 - DNA, 25 bp, Artificial sequence
  Synthetic oligonucleotide
atccagggcgccggcggcgtgatcg

SEQ ID NO: 674215 - DNA, 25 bp, Artificial sequence
  Synthetic oligonucleotide
acgtcgctccggaaggcatgaacca

SEQ ID NO: 674216 - DNA, 25 bp, Artificial sequence
  Synthetic oligonucleotide
tcgccgacgtcgctccggaaggcat

SEQ ID NO: 674217 - DNA, 25 bp, Artificial sequence
  Synthetic oligonucleotide
aggcgatcgccgacgtcgctccgga

SEQ ID NO: 674218 - DNA, 25 bp, Artificial sequence
  Synthetic oligonucleotide
tggccaaggcgatcgccgacgtcgc

SEQ ID NO: 674219 - DNA, 25 bp, Artificial sequence
  Synthetic oligonucleotide
tcgccggcgtcagcctgggcggcat

SEQ ID NO: 674220 - DNA, 25 bp, Artificial sequence
  Synthetic oligonucleotide
gttgcatgagcagggtgatttcccc

SEQ ID NO: 674221 - DNA, 25 bp, Artificial sequence
  Synthetic oligonucleotide
gaaggcgttgcatgagcagggtgat

SEQ ID NO: 674222 - DNA, 25 bp, Artificial sequence
  Synthetic oligonucleotide
cggctccgaggccaacgacaccgtg

SEQ ID NO: 674223 - DNA, 25 bp, Artificial sequence
  Synthetic oligonucleotide
cggcatgaaggcgttgcatgagcag

SEQ ID NO: 674224 - DNA, 25 bp, Artificial sequence
  Synthetic oligonucleotide
gcctgggcggcatgaaggcgttgca

SEQ ID NO: 674225 - DNA, 25 bp, Artificial sequence
  Synthetic oligonucleotide
tgagcagggtgatttccccatcccg

SEQ ID NO: 674226 - DNA, 25 bp, Artificial sequence
  Synthetic oligonucleotide
gcgtcagcctgggcggcatgaaggc

SEQ ID NO: 674227 - DNA, 25 bp, Artificial sequence
  Synthetic oligonucleotide
ccaccgtcgccggcgtcagcctggg

SEQ ID NO: 674228 - DNA, 25 bp, Artificial sequence
  Synthetic oligonucleotide
acggctccaccgtcgccggcgtcag

SEQ ID NO: 674229 - DNA, 25 bp, Artificial sequence
  Synthetic oligonucleotide
gctaccacggctccaccgtcgccgg

SEQ ID NO: 674230 - DNA, 25 bp, Artificial sequence
  Synthetic oligonucleotide
gaacggctaccacggctccaccgtc

SEQ ID NO: 674231 - DNA, 25 bp, Artificial sequence
  Synthetic oligonucleotide
ccgctggaacggctaccacggctcc

SEQ ID NO: 674232 - DNA, 25 bp, Artificial sequence
  Synthetic oligonucleotide
atcggccgctggaacggctaccacg

SEQ ID NO: 674233 - DNA, 25 bp, Artificial sequence
  Synthetic oligonucleotide
gtggtgatcggccgctggaacggct

SEQ ID NO: 674234 - DNA, 25 bp, Artificial sequence
  Synthetic oligonucleotide
aagaaagtggtgatcggccgctgga

SEQ ID NO: 674235 - DNA, 25 bp, Artificial sequence
  Synthetic oligonucleotide
gggtgatttccccatcccgggcatc

SEQ ID NO: 674236 - DNA, 25 bp, Artificial sequence
  Synthetic oligonucleotide
gccagccgcagaagaaagtggtgat

SEQ ID NO: 674237 - DNA, 25 bp, Artificial sequence
  Synthetic oligonucleotide
ccgcagaagaaagtggtgatcggcc

SEQ ID NO: 674238 - DNA, 25 bp, Artificial sequence
  Synthetic oligonucleotide
tctcggtgaacctggccaccacctg

SEQ ID NO: 674239 - DNA, 25 bp, Artificial sequence
  Synthetic oligonucleotide
caggacttcgcgggggtcggcgaag

SEQ ID NO: 674240 - DNA, 25 bp, Artificial sequence
  Synthetic oligonucleotide
tggcgcaggacttcgcgggggtcgg

SEQ ID NO: 674241 - DNA, 25 bp, Artificial sequence
  Synthetic oligonucleotide
accacctggcgcaggacttcgcggg

SEQ ID NO: 674242 - DNA, 25 bp, Artificial sequence
  Synthetic oligonucleotide
tggccaccacctggcgcaggacttc

SEQ ID NO: 674243 - DNA, 25 bp, Artificial sequence
  Synthetic oligonucleotide
tgaacctggccaccacctggcgcag

SEQ ID NO: 674244 - DNA, 25 bp, Artificial sequence
  Synthetic oligonucleotide
ggcggcgacgatggtcagttccatc

SEQ ID NO: 674245 - DNA, 25 bp, Artificial sequence
  Synthetic oligonucleotide
gttccatctcggtgaacctggccac

SEQ ID NO: 674246 - DNA, 25 bp, Artificial sequence
  Synthetic oligonucleotide
ggtcagttccatctcggtgaacctg

SEQ ID NO: 674247 - DNA, 25 bp, Artificial sequence
  Synthetic oligonucleotide
ctcgaaggcggcgacgatggtcagt

SEQ ID NO: 674248 - DNA, 25 bp, Artificial sequence
  Synthetic oligonucleotide
gacgatggtcagttccatctcggtg

SEQ ID NO: 674249 - DNA, 25 bp, Artificial sequence
  Synthetic oligonucleotide
actccagctcgaaggcggcgacgat

SEQ ID NO: 674250 - DNA, 25 bp, Artificial sequence
  Synthetic oligonucleotide
gttgcgcggtcgggcgcttctgcca

SEQ ID NO: 674251 - DNA, 25 bp, Artificial sequence
  Synthetic oligonucleotide
ccatggagagggtgccggggatcgg

SEQ ID NO: 674252 - DNA, 25 bp, Artificial sequence
  Synthetic oligonucleotide
agggttccatggagagggtgccggg

SEQ ID NO: 674253 - DNA, 25 bp, Artificial sequence
  Synthetic oligonucleotide
tctgccagggttccatggagagggt

SEQ ID NO: 674254 - DNA, 25 bp, Artificial sequence
  Synthetic oligonucleotide
ggcgcttctgccagggttccatgga

SEQ ID NO: 674255 - DNA, 25 bp, Artificial sequence
  Synthetic oligonucleotide
tcgaggtcgtcgatggagtacacct

SEQ ID NO: 674256 - DNA, 25 bp, Artificial sequence
  Synthetic oligonucleotide
ccagttcgtgcatggtcatcagcag

SEQ ID NO: 674257 - DNA, 25 bp, Artificial sequence
  Synthetic oligonucleotide
cggtcgggcgcttctgccagggttc

SEQ ID NO: 674258 - DNA, 25 bp, Artificial sequence
  Synthetic oligonucleotide
ggtcggcgaagaacggctcgccttc

SEQ ID NO: 674259 - DNA, 25 bp, Artificial sequence
  Synthetic oligonucleotide
tcagcagttgcgcggtcgggcgctt

SEQ ID NO: 674260 - DNA, 25 bp, Artificial sequence
  Synthetic oligonucleotide
tggtcatcagcagttgcgcggtcgg

SEQ ID NO: 674261 - DNA, 25 bp, Artificial sequence
  Synthetic oligonucleotide
cgtgcatggtcatcagcagttgcgc

SEQ ID NO: 674262 - DNA, 25 bp, Artificial sequence
  Synthetic oligonucleotide
cgccttccagttcgtgcatggtcat

SEQ ID NO: 674263 - DNA, 25 bp, Artificial sequence
  Synthetic oligonucleotide
acggctcgccttccagttcgtgcat

SEQ ID NO: 674264 - DNA, 25 bp, Artificial sequence
  Synthetic oligonucleotide
cgaagaacggctcgccttccagttc

SEQ ID NO: 674265 - DNA, 25 bp, Artificial sequence
  Synthetic oligonucleotide
ggtagaactccagctcgaaggcggc

SEQ ID NO: 674266 - DNA, 25 bp, Artificial sequence
  Synthetic oligonucleotide
tcgtcgatggagtacacctgcaccg

SEQ ID NO: 674267 - DNA, 25 bp, Artificial sequence
  Synthetic oligonucleotide
ttcggcgacgatggcgtcggccggg

SEQ ID NO: 674268 - DNA, 25 bp, Artificial sequence
  Synthetic oligonucleotide
cgacgatggcgtcggccgggatgcc

SEQ ID NO: 674269 - DNA, 25 bp, Artificial sequence
  Synthetic oligonucleotide
ctcgctcggttcagtgagctgaacg

SEQ ID NO: 674270 - DNA, 25 bp, Artificial sequence
  Synthetic oligonucleotide
gagggtgccggggatcgggtagcag

SEQ ID NO: 674271 - DNA, 25 bp, Artificial sequence
  Synthetic oligonucleotide
tggcgtcggccgggatgccctgggc

SEQ ID NO: 674272 - DNA, 25 bp, Artificial sequence
  Synthetic oligonucleotide
ggccgggatgccctgggcgcgggcg

SEQ ID NO: 674273 - DNA, 25 bp, Artificial sequence
  Synthetic oligonucleotide
gatgccctgggcgcgggcgccgtcg

SEQ ID NO: 674274 - DNA, 25 bp, Artificial sequence
  Synthetic oligonucleotide
ctgggcgcgggcgccgtcgatgatg

SEQ ID NO: 674275 - DNA, 25 bp, Artificial sequence
  Synthetic oligonucleotide
gcgggcgccgtcgatgatgtcctgg

SEQ ID NO: 674276 - DNA, 25 bp, Artificial sequence
  Synthetic oligonucleotide
gccgtcgatgatgtcctggaggcac

SEQ ID NO: 674277 - DNA, 25 bp, Artificial sequence
  Synthetic oligonucleotide
gatgatgtcctggaggcactcgacg

SEQ ID NO: 674278 - DNA, 25 bp, Artificial sequence
  Synthetic oligonucleotide
tcctggaggcactcgacgtattcgt

SEQ ID NO: 674279 - DNA, 25 bp, Artificial sequence
  Synthetic oligonucleotide
aggcactcgacgtattcgtcgaggt

SEQ ID NO: 674280 - DNA, 25 bp, Artificial sequence
  Synthetic oligonucleotide
atggagtacacctgcaccgactgcg

SEQ ID NO: 674281 - DNA, 25 bp, Artificial sequence
  Synthetic oligonucleotide
gagatcggcgagcgcggcggttgcg

SEQ ID NO: 674282 - DNA, 25 bp, Artificial sequence
  Synthetic oligonucleotide
cctggtcgatcaggtagaactccag

SEQ ID NO: 674283 - DNA, 25 bp, Artificial sequence
  Synthetic oligonucleotide
cgttctcctggtcgatcaggtagaa

SEQ ID NO: 674284 - DNA, 25 bp, Artificial sequence
  Synthetic oligonucleotide
cgttcacgttctcctggtcgatcag

SEQ ID NO: 674285 - DNA, 25 bp, Artificial sequence
  Synthetic oligonucleotide
gccggccgttcacgttctcctggtc

SEQ ID NO: 674286 - DNA, 25 bp, Artificial sequence
  Synthetic oligonucleotide
gttgcggccggccgttcacgttctc

SEQ ID NO: 674287 - DNA, 25 bp, Artificial sequence
  Synthetic oligonucleotide
tcgacgtattcgtcgaggtcgtcga

SEQ ID NO: 674288 - DNA, 25 bp, Artificial sequence
  Synthetic oligonucleotide
ggcgagcgcggcggttgcggccggc

SEQ ID NO: 674289 - DNA, 25 bp, Artificial sequence
  Synthetic oligonucleotide
tattcgtcgaggtcgtcgatggagt

SEQ ID NO: 674290 - DNA, 25 bp, Artificial sequence
  Synthetic oligonucleotide
ttgccggagatcggcgagcgcggcg

SEQ ID NO: 674291 - DNA, 25 bp, Artificial sequence
  Synthetic oligonucleotide
gacgtttgccggagatcggcgagcg

SEQ ID NO: 674292 - DNA, 25 bp, Artificial sequence
  Synthetic oligonucleotide
actgcggacgtttgccggagatcgg

SEQ ID NO: 674293 - DNA, 25 bp, Artificial sequence
  Synthetic oligonucleotide
gcaccgactgcggacgtttgccgga

SEQ ID NO: 674294 - DNA, 25 bp, Artificial sequence
  Synthetic oligonucleotide
acacctgcaccgactgcggacgttt

SEQ ID NO: 674295 - DNA, 25 bp, Artificial sequence
  Synthetic oligonucleotide
cgatcaggtagaactccagctcgaa

SEQ ID NO: 674296 - DNA, 25 bp, Artificial sequence
  Synthetic oligonucleotide
cgcggcggttgcggccggccgttca

SEQ ID NO: 674297 - DNA, 25 bp, Artificial sequence
  Synthetic oligonucleotide
catgcggggggtaggctatgagtca

SEQ ID NO: 674298 - DNA, 25 bp, Artificial sequence
  Synthetic oligonucleotide
ttccttgaggaactcgctcggttca

SEQ ID NO: 674299 - DNA, 25 bp, Artificial sequence
  Synthetic oligonucleotide
gacctcgggatgttccttgaggaac

SEQ ID NO: 674300 - DNA, 25 bp, Artificial sequence
  Synthetic oligonucleotide
gggatgttccttgaggaactcgctc

SEQ ID NO: 674301 - DNA, 25 bp, Artificial sequence
  Synthetic oligonucleotide
gaggaactcgctcggttcagtgagc

SEQ ID NO: 674302 - DNA, 25 bp, Artificial sequence
  Synthetic oligonucleotide
ggttcagtgagctgaacggcacgct

SEQ ID NO: 674303 - DNA, 25 bp, Artificial sequence
  Synthetic oligonucleotide
tgagctgaacggcacgctggggtac

SEQ ID NO: 674304 - DNA, 25 bp, Artificial sequence
  Synthetic oligonucleotide
gaacggcacgctggggtaccgacat

SEQ ID NO: 674305 - DNA, 25 bp, Artificial sequence
  Synthetic oligonucleotide
cacgctggggtaccgacatgatgca

SEQ ID NO: 674306 - DNA, 25 bp, Artificial sequence
  Synthetic oligonucleotide
gggtaccgacatgatgcaacacctt

SEQ ID NO: 674307 - DNA, 25 bp, Artificial sequence
  Synthetic oligonucleotide
cgacatgatgcaacaccttttttgt

SEQ ID NO: 674308 - DNA, 25 bp, Artificial sequence
  Synthetic oligonucleotide
tgatgcaacaccttttttgttaaaa

SEQ ID NO: 674309 - DNA, 25 bp, Artificial sequence
  Synthetic oligonucleotide
tttttgttaaaaatttcaatcatgc

SEQ ID NO: 674310 - DNA, 25 bp, Artificial sequence
  Synthetic oligonucleotide
gtcgacgaactggacctcgggatgt

SEQ ID NO: 674311 - DNA, 25 bp, Artificial sequence
  Synthetic oligonucleotide
ttcaatcatgcggggggtaggctat

SEQ ID NO: 674312 - DNA, 25 bp, Artificial sequence
  Synthetic oligonucleotide
aaggaggtcgacgaactggacctcg

SEQ ID NO: 674313 - DNA, 25 bp, Artificial sequence
  Synthetic oligonucleotide
ggggtaggctatgagtcaatccgaa

SEQ ID NO: 674314 - DNA, 25 bp, Artificial sequence
  Synthetic oligonucleotide
ggctatgagtcaatccgaaagcctg

SEQ ID NO: 674315 - DNA, 25 bp, Artificial sequence
  Synthetic oligonucleotide
gagtcaatccgaaagcctgtgggat

SEQ ID NO: 674316 - DNA, 25 bp, Artificial sequence
  Synthetic oligonucleotide
atccgaaagcctgtgggatgtcaat

SEQ ID NO: 674317 - DNA, 25 bp, Artificial sequence
  Synthetic oligonucleotide
aagcctgtgggatgtcaatagccgc

SEQ ID NO: 674318 - DNA, 25 bp, Artificial sequence
  Synthetic oligonucleotide
gtgggatgtcaatagccgccaaaaa

SEQ ID NO: 674319 - DNA, 25 bp, Artificial sequence
  Synthetic oligonucleotide
tgtcaatagccgccaaaaacgccct

SEQ ID NO: 674320 - DNA, 25 bp, Artificial sequence
  Synthetic oligonucleotide
tagccgccaaaaacgccctcttgtg

SEQ ID NO: 674321 - DNA, 25 bp, Artificial sequence
  Synthetic oligonucleotide
aaacgccctcttgtggggcgttgag

SEQ ID NO: 674322 - DNA, 25 bp, Artificial sequence
  Synthetic oligonucleotide
cctcttgtggggcgttgaggccgtt

SEQ ID NO: 674323 - DNA, 25 bp, Artificial sequence
  Synthetic oligonucleotide
tgtggggcgttgaggccgttttcag

SEQ ID NO: 674324 - DNA, 25 bp, Artificial sequence
  Synthetic oligonucleotide
gcggattcggcgacgatggcgtcgg

SEQ ID NO: 674325 - DNA, 25 bp, Artificial sequence
  Synthetic oligonucleotide
ttggcgtcggcgccggccacgcggt

SEQ ID NO: 674326 - DNA, 25 bp, Artificial sequence
  Synthetic oligonucleotide
aaaatttcaatcatgcggggggtag

SEQ ID NO: 674327 - DNA, 25 bp, Artificial sequence
  Synthetic oligonucleotide
gcgaacagggaagcgggaaggttga

SEQ ID NO: 674328 - DNA, 25 bp, Artificial sequence
  Synthetic oligonucleotide
gatcgggtagcagatccggtcggcg

SEQ ID NO: 674329 - DNA, 25 bp, Artificial sequence
  Synthetic oligonucleotide
gtagcagatccggtcggcgtcgccg

SEQ ID NO: 674330 - DNA, 25 bp, Artificial sequence
  Synthetic oligonucleotide
gatccggtcggcgtcgccgatgtcg

SEQ ID NO: 674331 - DNA, 25 bp, Artificial sequence
  Synthetic oligonucleotide
gtcggcgtcgccgatgtcgagaccc

SEQ ID NO: 674332 - DNA, 25 bp, Artificial sequence
  Synthetic oligonucleotide
gtcgccgatgtcgagacccaggccg

SEQ ID NO: 674333 - DNA, 25 bp, Artificial sequence
  Synthetic oligonucleotide
gatgtcgagacccaggccggtactc

SEQ ID NO: 674334 - DNA, 25 bp, Artificial sequence
  Synthetic oligonucleotide
agacccaggccggtactctctacgg

SEQ ID NO: 674335 - DNA, 25 bp, Artificial sequence
  Synthetic oligonucleotide
aggccggtactctctacggtggagc

SEQ ID NO: 674336 - DNA, 25 bp, Artificial sequence
  Synthetic oligonucleotide
gtactctctacggtggagccggtga

SEQ ID NO: 674337 - DNA, 25 bp, Artificial sequence
  Synthetic oligonucleotide
ctctacggtggagccggtgatatcg

SEQ ID NO: 674338 - DNA, 25 bp, Artificial sequence
  Synthetic oligonucleotide
ggtggagccggtgatatcgagggcg

SEQ ID NO: 674339 - DNA, 25 bp, Artificial sequence
  Synthetic oligonucleotide
gccggtgatatcgagggcgaacagg

SEQ ID NO: 674340 - DNA, 25 bp, Artificial sequence
  Synthetic oligonucleotide
gaactggacctcgggatgttccttg

SEQ ID NO: 674341 - DNA, 25 bp, Artificial sequence
  Synthetic oligonucleotide
cgagggcgaacagggaagcgggaag

SEQ ID NO: 674342 - DNA, 25 bp, Artificial sequence
  Synthetic oligonucleotide
gccggggatcgggtagcagatccgg

SEQ ID NO: 674343 - DNA, 25 bp, Artificial sequence
  Synthetic oligonucleotide
cagggaagcgggaaggttgatacct

SEQ ID NO: 674344 - DNA, 25 bp, Artificial sequence
  Synthetic oligonucleotide
ctttttcgaagactttgttcagact

SEQ ID NO: 674345 - DNA, 25 bp, Artificial sequence
  Synthetic oligonucleotide
cgaagactttgttcagactgttgcg

SEQ ID NO: 674346 - DNA, 25 bp, Artificial sequence
  Synthetic oligonucleotide
tttgttcagactgttgcgttcgatc

SEQ ID NO: 674347 - DNA, 25 bp, Artificial sequence
  Synthetic oligonucleotide
cagactgttgcgttcgatccgcttg

SEQ ID NO: 674348 - DNA, 25 bp, Artificial sequence
  Synthetic oligonucleotide
gttgcgttcgatccgcttgccgcga

SEQ ID NO: 674349 - DNA, 25 bp, Artificial sequence
  Synthetic oligonucleotide
ttcgatccgcttgccgcgaaccacg

SEQ ID NO: 674350 - DNA, 25 bp, Artificial sequence
  Synthetic oligonucleotide
ccgcttgccgcgaaccacgccattc

SEQ ID NO: 674351 - DNA, 25 bp, Artificial sequence
  Synthetic oligonucleotide
gccgcgaaccacgccattcatgtct

SEQ ID NO: 674352 - DNA, 25 bp, Artificial sequence
  Synthetic oligonucleotide
aaccacgccattcatgtctgcaata

SEQ ID NO: 674353 - DNA, 25 bp, Artificial sequence
  Synthetic oligonucleotide
ccattcatgtctgcaataaggaggt

SEQ ID NO: 674354 - DNA, 25 bp, Artificial sequence
  Synthetic oligonucleotide
atgtctgcaataaggaggtcgacga

SEQ ID NO: 674355 - DNA, 25 bp, Artificial sequence
  Synthetic oligonucleotide
gcaataaggaggtcgacgaactgga

SEQ ID NO: 674356 - DNA, 25 bp, Artificial sequence
  Synthetic oligonucleotide
gatatcgagggcgaacagggaagcg

SEQ ID NO: 674357 - DNA, 25 bp, Artificial sequence
  Synthetic oligonucleotide
tagcaggtaggggttggcgtcggcg

SEQ ID NO: 674358 - DNA, 25 bp, Artificial sequence
  Synthetic oligonucleotide
tccaggccccagctcggcgcgttcg

SEQ ID NO: 674359 - DNA, 25 bp, Artificial sequence
  Synthetic oligonucleotide
ggagttgccttcgatcggcgcgccc

SEQ ID NO: 674360 - DNA, 25 bp, Artificial sequence
  Synthetic oligonucleotide
tgccttcgatcggcgcgcccggctc

SEQ ID NO: 674361 - DNA, 25 bp, Artificial sequence
  Synthetic oligonucleotide
cgatcggcgcgcccggctcgacctt

SEQ ID NO: 674362 - DNA, 25 bp, Artificial sequence
  Synthetic oligonucleotide
gcgcgcccggctcgaccttgttggt

SEQ ID NO: 674363 - DNA, 25 bp, Artificial sequence
  Synthetic oligonucleotide
ccggctcgaccttgttggtcagccc

SEQ ID NO: 674364 - DNA, 25 bp, Artificial sequence
  Synthetic oligonucleotide
cgaccttgttggtcagcccgtgatg

SEQ ID NO: 674365 - DNA, 25 bp, Artificial sequence
  Synthetic oligonucleotide
tgttggtcagcccgtgatgaacgcc

SEQ ID NO: 674366 - DNA, 25 bp, Artificial sequence
  Synthetic oligonucleotide
gtcagcccgtgatgaacgcctgcca

SEQ ID NO: 674367 - DNA, 25 bp, Artificial sequence
  Synthetic oligonucleotide
ccgtgatgaacgcctgccagcaccg

SEQ ID NO: 674368 - DNA, 25 bp, Artificial sequence
  Synthetic oligonucleotide
tgaacgcctgccagcaccgctgcca

SEQ ID NO: 674369 - DNA, 25 bp, Artificial sequence
  Synthetic oligonucleotide
ctgccagcaccgctgccagtagcag

SEQ ID NO: 674370 - DNA, 25 bp, Artificial sequence
  Synthetic oligonucleotide
catctgctcgtaggagttgccttcg

SEQ ID NO: 674371 - DNA, 25 bp, Artificial sequence
  Synthetic oligonucleotide
ctgccagtagcaggtaggggttggc

SEQ ID NO: 674372 - DNA, 25 bp, Artificial sequence
  Synthetic oligonucleotide
gcaggctcggctccatctgctcgta

SEQ ID NO: 674373 - DNA, 25 bp, Artificial sequence
  Synthetic oligonucleotide
taggggttggcgtcggcgccggcca

SEQ ID NO: 674374 - DNA, 25 bp, Artificial sequence
  Synthetic oligonucleotide
tcggcgccggccacgcggtgttcca

SEQ ID NO: 674375 - DNA, 25 bp, Artificial sequence
  Synthetic oligonucleotide
acgcggtgttccaggcgtaccgcgt

SEQ ID NO: 674376 - DNA, 25 bp, Artificial sequence
  Synthetic oligonucleotide
tgttccaggcgtaccgcgtccgggc

SEQ ID NO: 674377 - DNA, 25 bp, Artificial sequence
  Synthetic oligonucleotide
aggcgtaccgcgtccgggctgccgg

SEQ ID NO: 674378 - DNA, 25 bp, Artificial sequence
  Synthetic oligonucleotide
accgcgtccgggctgccggtgggca

SEQ ID NO: 674379 - DNA, 25 bp, Artificial sequence
  Synthetic oligonucleotide
tccgggctgccggtgggcacgcgca

SEQ ID NO: 674380 - DNA, 25 bp, Artificial sequence
  Synthetic oligonucleotide
ctgccggtgggcacgcgcagggcca

SEQ ID NO: 674381 - DNA, 25 bp, Artificial sequence
  Synthetic oligonucleotide
gtgggcacgcgcagggccacggtgc

SEQ ID NO: 674382 - DNA, 25 bp, Artificial sequence
  Synthetic oligonucleotide
acgcgcagggccacggtgcggttgt

SEQ ID NO: 674383 - DNA, 25 bp, Artificial sequence
  Synthetic oligonucleotide
agggccacggtgcggttgtccaggc

SEQ ID NO: 674384 - DNA, 25 bp, Artificial sequence
  Synthetic oligonucleotide
acggtgcggttgtccaggccccagc

SEQ ID NO: 674385 - DNA, 25 bp, Artificial sequence
  Synthetic oligonucleotide
ccggccacgcggtgttccaggcgta

SEQ ID NO: 674386 - DNA, 25 bp, Artificial sequence
  Synthetic oligonucleotide
gcaccgctgccagtagcaggtaggg

SEQ ID NO: 674387 - DNA, 25 bp, Artificial sequence
  Synthetic oligonucleotide
cgaagatgtcgatgtacttcgggtc

SEQ ID NO: 674388 - DNA, 25 bp, Artificial sequence
  Synthetic oligonucleotide
gcgttgaggccgttttcagggcatt

SEQ ID NO: 674389 - DNA, 25 bp, Artificial sequence
  Synthetic oligonucleotide
gacggtatgcaggtaccagttgtac

SEQ ID NO: 674390 - DNA, 25 bp, Artificial sequence
  Synthetic oligonucleotide
atgcaggtaccagttgtactcgagg

SEQ ID NO: 674391 - DNA, 25 bp, Artificial sequence
  Synthetic oligonucleotide
taccagttgtactcgaggtcggaga

SEQ ID NO: 674392 - DNA, 25 bp, Artificial sequence
  Synthetic oligonucleotide
ttgtactcgaggtcggagatcgagt

SEQ ID NO: 674393 - DNA, 25 bp, Artificial sequence
  Synthetic oligonucleotide
tcgaggtcggagatcgagtgctcga

SEQ ID NO: 674394 - DNA, 25 bp, Artificial sequence
  Synthetic oligonucleotide
tcggagatcgagtgctcgaactcct

SEQ ID NO: 674395 - DNA, 25 bp, Artificial sequence
  Synthetic oligonucleotide
atcgagtgctcgaactcctccagct

SEQ ID NO: 674396 - DNA, 25 bp, Artificial sequence
  Synthetic oligonucleotide
tgctcgaactcctccagctcgcttt

SEQ ID NO: 674397 - DNA, 25 bp, Artificial sequence
  Synthetic oligonucleotide
aactcctccagctcgctttccttgc

SEQ ID NO: 674398 - DNA, 25 bp, Artificial sequence
  Synthetic oligonucleotide
ccagctcgctttccttgcaggcgac

SEQ ID NO: 674399 - DNA, 25 bp, Artificial sequence
  Synthetic oligonucleotide
cgctttccttgcaggcgacgaagat

SEQ ID NO: 674400 - DNA, 25 bp, Artificial sequence
  Synthetic oligonucleotide
ctcgtaggagttgccttcgatcggc

SEQ ID NO: 674401 - DNA, 25 bp, Artificial sequence
  Synthetic oligonucleotide
aggcgacgaagatgtcgatgtactt

SEQ ID NO: 674402 - DNA, 25 bp, Artificial sequence
  Synthetic oligonucleotide
ccccagctcggcgcgttcggcacgt

SEQ ID NO: 674403 - DNA, 25 bp, Artificial sequence
  Synthetic oligonucleotide
tgtcgatgtacttcgggtcgatgta

SEQ ID NO: 674404 - DNA, 25 bp, Artificial sequence
  Synthetic oligonucleotide
tgtacttcgggtcgatgtacttcgc

SEQ ID NO: 674405 - DNA, 25 bp, Artificial sequence
  Synthetic oligonucleotide
tcgggtcgatgtacttcgccatgat

SEQ ID NO: 674406 - DNA, 25 bp, Artificial sequence
  Synthetic oligonucleotide
gatgtacttcgccatgatctcgctt

SEQ ID NO: 674407 - DNA, 25 bp, Artificial sequence
  Synthetic oligonucleotide
ttcgccatgatctcgctttcgtcca

SEQ ID NO: 674408 - DNA, 25 bp, Artificial sequence
  Synthetic oligonucleotide
atgatctcgctttcgtccagctcgc

SEQ ID NO: 674409 - DNA, 25 bp, Artificial sequence
  Synthetic oligonucleotide
tcgctttcgtccagctcgcgcaggg

SEQ ID NO: 674410 - DNA, 25 bp, Artificial sequence
  Synthetic oligonucleotide
tcgtccagctcgcgcagggcgtcgc

SEQ ID NO: 674411 - DNA, 25 bp, Artificial sequence
  Synthetic oligonucleotide
gctcgcgcagggcgtcgcgcaggtt

SEQ ID NO: 674412 - DNA, 25 bp, Artificial sequence
  Synthetic oligonucleotide
cagggcgtcgcgcaggttgttcggc

SEQ ID NO: 674413 - DNA, 25 bp, Artificial sequence
  Synthetic oligonucleotide
gtcgcgcaggttgttcggcaggctc

SEQ ID NO: 674414 - DNA, 25 bp, Artificial sequence
  Synthetic oligonucleotide
aggttgttcggcaggctcggctcca

SEQ ID NO: 674415 - DNA, 25 bp, Artificial sequence
  Synthetic oligonucleotide
gttcggcaggctcggctccatctgc

SEQ ID NO: 674416 - DNA, 25 bp, Artificial sequence
  Synthetic oligonucleotide
ccttgcaggcgacgaagatgtcgat

SEQ ID NO: 674417 - DNA, 25 bp, Artificial sequence
  Synthetic oligonucleotide
tcttgaccaggcgcttgagcagcac

SEQ ID NO: 674418 - DNA, 25 bp, Artificial sequence
  Synthetic oligonucleotide
cggttgtccaggccccagctcggcg

SEQ ID NO: 674419 - DNA, 25 bp, Artificial sequence
  Synthetic oligonucleotide
atatgcacgtgcagtccgttcccgg

SEQ ID NO: 674420 - DNA, 25 bp, Artificial sequence
  Synthetic oligonucleotide
cacgtgcagtccgttcccggcctgg

SEQ ID NO: 674421 - DNA, 25 bp, Artificial sequence
  Synthetic oligonucleotide
cccggcctggcccggatagggcttg

SEQ ID NO: 674422 - DNA, 25 bp, Artificial sequence
  Synthetic oligonucleotide
cctggcccggatagggcttggccat

SEQ ID NO: 674423 - DNA, 25 bp, Artificial sequence
  Synthetic oligonucleotide
ccggatagggcttggccatgaaggt

SEQ ID NO: 674424 - DNA, 25 bp, Artificial sequence
  Synthetic oligonucleotide
agggcttggccatgaaggtggtgtc

SEQ ID NO: 674425 - DNA, 25 bp, Artificial sequence
  Synthetic oligonucleotide
tggccatgaaggtggtgtccatctc

SEQ ID NO: 674426 - DNA, 25 bp, Artificial sequence
  Synthetic oligonucleotide
tgaaggtggtgtccatctcgtggtc

SEQ ID NO: 674427 - DNA, 25 bp, Artificial sequence
  Synthetic oligonucleotide
tggtgtccatctcgtggtcgtaggc

SEQ ID NO: 674428 - DNA, 25 bp, Artificial sequence
  Synthetic oligonucleotide
ccatctcgtggtcgtaggcgatgtt

SEQ ID NO: 674429 - DNA, 25 bp, Artificial sequence
  Synthetic oligonucleotide
gtggtcgtaggcgatgttcttgacc

SEQ ID NO: 674430 - DNA, 25 bp, Artificial sequence
  Synthetic oligonucleotide
tcgagcagcgagatatgcacgtgca

SEQ ID NO: 674431 - DNA, 25 bp, Artificial sequence
  Synthetic oligonucleotide
cgatgttcttgaccaggcgcttgag

SEQ ID NO: 674432 - DNA, 25 bp, Artificial sequence
  Synthetic oligonucleotide
tgcttgtcgagcagcgagatatgca

SEQ ID NO: 674433 - DNA, 25 bp, Artificial sequence
  Synthetic oligonucleotide
accaggcgcttgagcagcaccgcgt

SEQ ID NO: 674434 - DNA, 25 bp, Artificial sequence
  Synthetic oligonucleotide
cgcttgagcagcaccgcgtggtcgc

SEQ ID NO: 674435 - DNA, 25 bp, Artificial sequence
  Synthetic oligonucleotide
agcagcaccgcgtggtcgcaggcct

SEQ ID NO: 674436 - DNA, 25 bp, Artificial sequence
  Synthetic oligonucleotide
accgcgtggtcgcaggccttgaggg

SEQ ID NO: 674437 - DNA, 25 bp, Artificial sequence
  Synthetic oligonucleotide
tggtcgcaggccttgagggcgtcgt

SEQ ID NO: 674438 - DNA, 25 bp, Artificial sequence
  Synthetic oligonucleotide
caggccttgagggcgtcgttgacgt

SEQ ID NO: 674439 - DNA, 25 bp, Artificial sequence
  Synthetic oligonucleotide
ttgagggcgtcgttgacgtggttga

SEQ ID NO: 674440 - DNA, 25 bp, Artificial sequence
  Synthetic oligonucleotide
gcgtcgttgacgtggttgaggttga

SEQ ID NO: 674441 - DNA, 25 bp, Artificial sequence
  Synthetic oligonucleotide
ttgacgtggttgaggttgacctcga

SEQ ID NO: 674442 - DNA, 25 bp, Artificial sequence
  Synthetic oligonucleotide
tggttgaggttgacctcgaactgcg

SEQ ID NO: 674443 - DNA, 25 bp, Artificial sequence
  Synthetic oligonucleotide
aggttgacctcgaactgcgccggtg

SEQ ID NO: 674444 - DNA, 25 bp, Artificial sequence
  Synthetic oligonucleotide
acctcgaactgcgccggtgcggatt

SEQ ID NO: 674445 - DNA, 25 bp, Artificial sequence
  Synthetic oligonucleotide
aactgcgccggtgcggattcggcga

SEQ ID NO: 674446 - DNA, 25 bp, Artificial sequence
  Synthetic oligonucleotide
cgtaggcgatgttcttgaccaggcg

SEQ ID NO: 674447 - DNA, 25 bp, Artificial sequence
  Synthetic oligonucleotide
gcagggtctcgagcacaccgccgat

SEQ ID NO: 674448 - DNA, 25 bp, Artificial sequence
  Synthetic oligonucleotide
ctcggcgcgttcggcacgtagaact

SEQ ID NO: 674449 - DNA, 25 bp, Artificial sequence
  Synthetic oligonucleotide
gcgttcggcacgtagaactgcgaac

SEQ ID NO: 674450 - DNA, 25 bp, Artificial sequence
  Synthetic oligonucleotide
ggcacgtagaactgcgaaccgaagc

SEQ ID NO: 674451 - DNA, 25 bp, Artificial sequence
  Synthetic oligonucleotide
tagaactgcgaaccgaagcggcggt

SEQ ID NO: 674452 - DNA, 25 bp, Artificial sequence
  Synthetic oligonucleotide
ctgcgaaccgaagcggcggtaggag

SEQ ID NO: 674453 - DNA, 25 bp, Artificial sequence
  Synthetic oligonucleotide
accgaagcggcggtaggagttgacg

SEQ ID NO: 674454 - DNA, 25 bp, Artificial sequence
  Synthetic oligonucleotide
agcggcggtaggagttgacgttcgg

SEQ ID NO: 674455 - DNA, 25 bp, Artificial sequence
  Synthetic oligonucleotide
ggtaggagttgacgttcgggcagag

SEQ ID NO: 674456 - DNA, 25 bp, Artificial sequence
  Synthetic oligonucleotide
agttgacgttcgggcagaggaaggc

SEQ ID NO: 674457 - DNA, 25 bp, Artificial sequence
  Synthetic oligonucleotide
cgttcgggcagaggaaggccatgga

SEQ ID NO: 674458 - DNA, 25 bp, Artificial sequence
  Synthetic oligonucleotide
gcagaggaaggccatggaggccggc

SEQ ID NO: 674459 - DNA, 25 bp, Artificial sequence
  Synthetic oligonucleotide
gaaggccatggaggccggcagggtc

SEQ ID NO: 674460 - DNA, 25 bp, Artificial sequence
  Synthetic oligonucleotide
agcgagatatgcacgtgcagtccgt

SEQ ID NO: 674461 - DNA, 25 bp, Artificial sequence
  Synthetic oligonucleotide
aggccggcagggtctcgagcacacc

SEQ ID NO: 674462 - DNA, 25 bp, Artificial sequence
  Synthetic oligonucleotide
gccggtgcggattcggcgacgatgg

SEQ ID NO: 674463 - DNA, 25 bp, Artificial sequence
  Synthetic oligonucleotide
gtctcgagcacaccgccgatcgcat

SEQ ID NO: 674464 - DNA, 25 bp, Artificial sequence
  Synthetic oligonucleotide
agcacaccgccgatcgcatggcgca

SEQ ID NO: 674465 - DNA, 25 bp, Artificial sequence
  Synthetic oligonucleotide
ccgccgatcgcatggcgcaatgcgg

SEQ ID NO: 674466 - DNA, 25 bp, Artificial sequence
  Synthetic oligonucleotide
atcgcatggcgcaatgcggcgttct

SEQ ID NO: 674467 - DNA, 25 bp, Artificial sequence
  Synthetic oligonucleotide
tggcgcaatgcggcgttctgctcgg

SEQ ID NO: 674468 - DNA, 25 bp, Artificial sequence
  Synthetic oligonucleotide
aatgcggcgttctgctcgggatcct

SEQ ID NO: 674469 - DNA, 25 bp, Artificial sequence
  Synthetic oligonucleotide
gcgttctgctcgggatcctcgctgg

SEQ ID NO: 674470 - DNA, 25 bp, Artificial sequence
  Synthetic oligonucleotide
tgctcgggatcctcgctggtgaaga

SEQ ID NO: 674471 - DNA, 25 bp, Artificial sequence
  Synthetic oligonucleotide
ggatcctcgctggtgaagatgttgt

SEQ ID NO: 674472 - DNA, 25 bp, Artificial sequence
  Synthetic oligonucleotide
tcgctggtgaagatgttgttgccat

SEQ ID NO: 674473 - DNA, 25 bp, Artificial sequence
  Synthetic oligonucleotide
gtgaagatgttgttgccatgcttgt

SEQ ID NO: 674474 - DNA, 25 bp, Artificial sequence
  Synthetic oligonucleotide
atgttgttgccatgcttgtcgagca

SEQ ID NO: 674475 - DNA, 25 bp, Artificial sequence
  Synthetic oligonucleotide
ttgccatgcttgtcgagcagcgaga

SEQ ID NO: 674476 - DNA, 25 bp, Artificial sequence
  Synthetic oligonucleotide
catggaggccggcagggtctcgagc

SEQ ID NO: 674477 - DNA, 25 bp, Artificial sequence
  Synthetic oligonucleotide
tgatgttcggcgcatccgccagcct

SEQ ID NO: 674478 - DNA, 25 bp, Artificial sequence
  Synthetic oligonucleotide
gctgtgccagcgatgcctttccctg

SEQ ID NO: 674479 - DNA, 25 bp, Artificial sequence
  Synthetic oligonucleotide
gagagtgacattgccttgcctcggt

SEQ ID NO: 674480 - DNA, 25 bp, Artificial sequence
  Synthetic oligonucleotide
tgacattgccttgcctcggtctagc

SEQ ID NO: 674481 - DNA, 25 bp, Artificial sequence
  Synthetic oligonucleotide
tgccttgcctcggtctagccgccct

SEQ ID NO: 674482 - DNA, 25 bp, Artificial sequence
  Synthetic oligonucleotide
ccagcctgatggctgccgacctgcc

SEQ ID NO: 674483 - DNA, 25 bp, Artificial sequence
  Synthetic oligonucleotide
gcctcggtctagccgccctgatgtt

SEQ ID NO: 674484 - DNA, 25 bp, Artificial sequence
  Synthetic oligonucleotide
cggcgcatccgccagcctgatggct

SEQ ID NO: 674485 - DNA, 25 bp, Artificial sequence
  Synthetic oligonucleotide
ccgccctgatgttcggcgcatccgc

SEQ ID NO: 674486 - DNA, 25 bp, Artificial sequence
  Synthetic oligonucleotide
agtgccggggaaattccgtccagtg

SEQ ID NO: 674487 - DNA, 25 bp, Artificial sequence
  Synthetic oligonucleotide
atccgccagcctgatggctgccgac

SEQ ID NO: 674488 - DNA, 25 bp, Artificial sequence
  Synthetic oligonucleotide
gtctagccgccctgatgttcggcgc

SEQ ID NO: 674489 - DNA, 25 bp, Artificial sequence
  Synthetic oligonucleotide
tcccatgagagtgacattgccttgc

SEQ ID NO: 674490 - DNA, 25 bp, Artificial sequence
  Synthetic oligonucleotide
ggagactcccatgagagtgacattg

SEQ ID NO: 674491 - DNA, 25 bp, Artificial sequence
  Synthetic oligonucleotide
aaaacaggagactcccatgagagtg

SEQ ID NO: 674492 - DNA, 25 bp, Artificial sequence
  Synthetic oligonucleotide
gaagtgaaaacaggagactcccatg

SEQ ID NO: 674493 - DNA, 25 bp, Artificial sequence
  Synthetic oligonucleotide
ctaacggaagtgaaaacaggagact

SEQ ID NO: 674494 - DNA, 25 bp, Artificial sequence
  Synthetic oligonucleotide
cgtccagtggtgtttcccgggtgct

SEQ ID NO: 674495 - DNA, 25 bp, Artificial sequence
  Synthetic oligonucleotide
tttccctgattcggaaggcacgaag

SEQ ID NO: 674496 - DNA, 25 bp, Artificial sequence
  Synthetic oligonucleotide
cacgaagagtgccggggaaattccg

SEQ ID NO: 674497 - DNA, 25 bp, Artificial sequence
  Synthetic oligonucleotide
ggaaggcacgaagagtgccggggaa

SEQ ID NO: 674498 - DNA, 25 bp, Artificial sequence
  Synthetic oligonucleotide
gccagcgatgcctttccctgattcg

SEQ ID NO: 674499 - DNA, 25 bp, Artificial sequence
  Synthetic oligonucleotide
gatgcctttccctgattcggaaggc

SEQ ID NO: 674500 - DNA, 25 bp, Artificial sequence
  Synthetic oligonucleotide
gcatgggcgtggcgccggccggcgt

SEQ ID NO: 674501 - DNA, 25 bp, Artificial sequence
  Synthetic oligonucleotide
tgattcggaaggcacgaagagtgcc

SEQ ID NO: 674502 - DNA, 25 bp, Artificial sequence
  Synthetic oligonucleotide
cgggtgctaacggaagtgaaaacag

SEQ ID NO: 674503 - DNA, 25 bp, Artificial sequence
  Synthetic oligonucleotide
tcaccgtgaaattcggcctgaaagg

SEQ ID NO: 674504 - DNA, 25 bp, Artificial sequence
  Synthetic oligonucleotide
cacctgttggtggacctgaaggagc

SEQ ID NO: 674505 - DNA, 25 bp, Artificial sequence
  Synthetic oligonucleotide
caccatcacctgttggtggacctga

SEQ ID NO: 674506 - DNA, 25 bp, Artificial sequence
  Synthetic oligonucleotide
accggccaccatcacctgttggtgg

SEQ ID NO: 674507 - DNA, 25 bp, Artificial sequence
  Synthetic oligonucleotide
ttggtggacctgaaggagcagccgg

SEQ ID NO: 674508 - DNA, 25 bp, Artificial sequence
  Synthetic oligonucleotide
acctgaaggagcagccggcgatgaa

SEQ ID NO: 674509 - DNA, 25 bp, Artificial sequence
  Synthetic oligonucleotide
agcagctcggcatgggccagcggag

SEQ ID NO: 674510 - DNA, 25 bp, Artificial sequence
  Synthetic oligonucleotide
gaaatcgctgtgccagcgatgcctt

SEQ ID NO: 674511 - DNA, 25 bp, Artificial sequence
  Synthetic oligonucleotide
ccggataccggccaccatcacctgt

SEQ ID NO: 674512 - DNA, 25 bp, Artificial sequence
  Synthetic oligonucleotide
cgacatgccggataccggccaccat

SEQ ID NO: 674513 - DNA, 25 bp, Artificial sequence
  Synthetic oligonucleotide
cggcgtcgacatgccggataccggc

SEQ ID NO: 674514 - DNA, 25 bp, Artificial sequence
  Synthetic oligonucleotide
gccggccggcgtcgacatgccggat

SEQ ID NO: 674515 - DNA, 25 bp, Artificial sequence
  Synthetic oligonucleotide
gcgtggcgccggccggcgtcgacat

SEQ ID NO: 674516 - DNA, 25 bp, Artificial sequence
  Synthetic oligonucleotide
tcggcctgaaaggcatgggcgtggc

SEQ ID NO: 674517 - DNA, 25 bp, Artificial sequence
  Synthetic oligonucleotide
tgaaattcggcctgaaaggcatggg

SEQ ID NO: 674518 - DNA, 25 bp, Artificial sequence
  Synthetic oligonucleotide
tgatggctgccgacctgccccggac

SEQ ID NO: 674519 - DNA, 25 bp, Artificial sequence
  Synthetic oligonucleotide
agaccttcaccgtgaaattcggcct

SEQ ID NO: 674520 - DNA, 25 bp, Artificial sequence
  Synthetic oligonucleotide
tcgacaagaccttcaccgtgaaatt

SEQ ID NO: 674521 - DNA, 25 bp, Artificial sequence
  Synthetic oligonucleotide
caaccgtcgacaagaccttcaccgt

SEQ ID NO: 674522 - DNA, 25 bp, Artificial sequence
  Synthetic oligonucleotide
atggtgcaaccgtcgacaagacctt

SEQ ID NO: 674523 - DNA, 25 bp, Artificial sequence
  Synthetic oligonucleotide
cggccgatggtgcaaccgtcgacaa

SEQ ID NO: 674524 - DNA, 25 bp, Artificial sequence
  Synthetic oligonucleotide
tcacgccggccgatggtgcaaccgt

SEQ ID NO: 674525 - DNA, 25 bp, Artificial sequence
  Synthetic oligonucleotide
atttcatcacgccggccgatggtgc

SEQ ID NO: 674526 - DNA, 25 bp, Artificial sequence
  Synthetic oligonucleotide
aagtgtatttcatcacgccggccga

SEQ ID NO: 674527 - DNA, 25 bp, Artificial sequence
  Synthetic oligonucleotide
gggcgaaagtgtatttcatcacgcc

SEQ ID NO: 674528 - DNA, 25 bp, Artificial sequence
  Synthetic oligonucleotide
ccgaaggggcgaaagtgtatttcat

SEQ ID NO: 674529 - DNA, 25 bp, Artificial sequence
  Synthetic oligonucleotide
ctgccccggacgaaggcgcccgaag

SEQ ID NO: 674530 - DNA, 25 bp, Artificial sequence
  Synthetic oligonucleotide
ctgccgacctgccccggacgaaggc

SEQ ID NO: 674531 - DNA, 25 bp, Artificial sequence
  Synthetic oligonucleotide
tgaaaggcatgggcgtggcgccggc

SEQ ID NO: 674532 - DNA, 25 bp, Artificial sequence
  Synthetic oligonucleotide
gcgccgcgctggtggacgtcgtcga

SEQ ID NO: 674533 - DNA, 25 bp, Artificial sequence
  Synthetic oligonucleotide
tgggccagcggagcggccagggata

SEQ ID NO: 674534 - DNA, 25 bp, Artificial sequence
  Synthetic oligonucleotide
aatcgcatgtagtactcctcgggtg

SEQ ID NO: 674535 - DNA, 25 bp, Artificial sequence
  Synthetic oligonucleotide
ggcagaaatcgcatgtagtactcct

SEQ ID NO: 674536 - DNA, 25 bp, Artificial sequence
  Synthetic oligonucleotide
aggcggggcagaaatcgcatgtagt

SEQ ID NO: 674537 - DNA, 25 bp, Artificial sequence
  Synthetic oligonucleotide
atcagcaggcggggcagaaatcgca

SEQ ID NO: 674538 - DNA, 25 bp, Artificial sequence
  Synthetic oligonucleotide
accagcatcagcaggcggggcagaa

SEQ ID NO: 674539 - DNA, 25 bp, Artificial sequence
  Synthetic oligonucleotide
agggataccagcatcagcaggcggg

SEQ ID NO: 674540 - DNA, 25 bp, Artificial sequence
  Synthetic oligonucleotide
gcggccagggataccagcatcagca

SEQ ID NO: 674541 - DNA, 25 bp, Artificial sequence
  Synthetic oligonucleotide
agcggagcggccagggataccagca

SEQ ID NO: 674542 - DNA, 25 bp, Artificial sequence
  Synthetic oligonucleotide
tcggcatgggccagcggagcggcca

SEQ ID NO: 674543 - DNA, 25 bp, Artificial sequence
  Synthetic oligonucleotide
tcgtcgagcagctcggcatgggcca

SEQ ID NO: 674544 - DNA, 25 bp, Artificial sequence
  Synthetic oligonucleotide
tactcctcgggtgggaatgaacgtc

SEQ ID NO: 674545 - DNA, 25 bp, Artificial sequence
  Synthetic oligonucleotide
cgctggtggacgtcgtcgagcagct

SEQ ID NO: 674546 - DNA, 25 bp, Artificial sequence
  Synthetic oligonucleotide
ctcgggtgggaatgaacgtcggtcg

SEQ ID NO: 674547 - DNA, 25 bp, Artificial sequence
  Synthetic oligonucleotide
cgcagggcgccgcgctggtggacgt

SEQ ID NO: 674548 - DNA, 25 bp, Artificial sequence
  Synthetic oligonucleotide
gcgatgcgcagggcgccgcgctggt

SEQ ID NO: 674549 - DNA, 25 bp, Artificial sequence
  Synthetic oligonucleotide
tccagggcgatgcgcagggcgccgc

SEQ ID NO: 674550 - DNA, 25 bp, Artificial sequence
  Synthetic oligonucleotide
gtgccctccagggcgatgcgcaggg

SEQ ID NO: 674551 - DNA, 25 bp, Artificial sequence
  Synthetic oligonucleotide
ggataggtgccctccagggcgatgc

SEQ ID NO: 674552 - DNA, 25 bp, Artificial sequence
  Synthetic oligonucleotide
aacggcggataggtgccctccaggg

SEQ ID NO: 674553 - DNA, 25 bp, Artificial sequence
  Synthetic oligonucleotide
aagttgaacggcggataggtgccct

SEQ ID NO: 674554 - DNA, 25 bp, Artificial sequence
  Synthetic oligonucleotide
ggagcagccggcgatgaacctgccg

SEQ ID NO: 674555 - DNA, 25 bp, Artificial sequence
  Synthetic oligonucleotide
tcggcggtggagccgccgatgtgcg

SEQ ID NO: 674556 - DNA, 25 bp, Artificial sequence
  Synthetic oligonucleotide
gagcttgccaccctgcttgaagttg

SEQ ID NO: 674557 - DNA, 25 bp, Artificial sequence
  Synthetic oligonucleotide
ctgcttgaagttgaacggcggatag

SEQ ID NO: 674558 - DNA, 25 bp, Artificial sequence
  Synthetic oligonucleotide
gccaccctgcttgaagttgaacggc

SEQ ID NO: 674559 - DNA, 25 bp, Artificial sequence
  Synthetic oligonucleotide
tggacgtcgtcgagcagctcggcat

SEQ ID NO: 674560 - DNA, 25 bp, Artificial sequence
  Synthetic oligonucleotide
cctactgggttgcatgcggtctttc

SEQ ID NO: 674561 - DNA, 25 bp, Artificial sequence
  Synthetic oligonucleotide
ggcttcgcagtggaaatcgctgtgc

SEQ ID NO: 674562 - DNA, 25 bp, Artificial sequence
  Synthetic oligonucleotide
taacacgggcttcgcagtggaaatc

SEQ ID NO: 674563 - DNA, 25 bp, Artificial sequence
  Synthetic oligonucleotide
cgctctaacacgggcttcgcagtgg

SEQ ID NO: 674564 - DNA, 25 bp, Artificial sequence
  Synthetic oligonucleotide
gagcgccgctctaacacgggcttcg

SEQ ID NO: 674565 - DNA, 25 bp, Artificial sequence
  Synthetic oligonucleotide
tgcgcgagcgccgctctaacacggg

SEQ ID NO: 674566 - DNA, 25 bp, Artificial sequence
  Synthetic oligonucleotide
gattatgtgcgcgagcgccgctcta

SEQ ID NO: 674567 - DNA, 25 bp, Artificial sequence
  Synthetic oligonucleotide
tgacccggattatgtgcgcgagcgc

SEQ ID NO: 674568 - DNA, 25 bp, Artificial sequence
  Synthetic oligonucleotide
gggcattgacccggattatgtgcgc

SEQ ID NO: 674569 - DNA, 25 bp, Artificial sequence
  Synthetic oligonucleotide
gggttgcgggcattgacccggatta

SEQ ID NO: 674570 - DNA, 25 bp, Artificial sequence
  Synthetic oligonucleotide
tttccaggggttgcgggcattgacc

SEQ ID NO: 674571 - DNA, 25 bp, Artificial sequence
  Synthetic oligonucleotide
cggtctttccaggggttgcgggcat

SEQ ID NO: 674572 - DNA, 25 bp, Artificial sequence
  Synthetic oligonucleotide
atgtagtactcctcgggtgggaatg

SEQ ID NO: 674573 - DNA, 25 bp, Artificial sequence
  Synthetic oligonucleotide
tgggttgcatgcggtctttccaggg

SEQ ID NO: 674574 - DNA, 25 bp, Artificial sequence
  Synthetic oligonucleotide
gcagtggaaatcgctgtgccagcga

SEQ ID NO: 674575 - DNA, 25 bp, Artificial sequence
  Synthetic oligonucleotide
cgcgaacctactgggttgcatgcgg

SEQ ID NO: 674576 - DNA, 25 bp, Artificial sequence
  Synthetic oligonucleotide
gacaatcgcgaacctactgggttgc

SEQ ID NO: 674577 - DNA, 25 bp, Artificial sequence
  Synthetic oligonucleotide
gtcctggacaatcgcgaacctactg

SEQ ID NO: 674578 - DNA, 25 bp, Artificial sequence
  Synthetic oligonucleotide
gcccgcgtcctggacaatcgcgaac

SEQ ID NO: 674579 - DNA, 25 bp, Artificial sequence
  Synthetic oligonucleotide
agccgggcccgcgtcctggacaatc

SEQ ID NO: 674580 - DNA, 25 bp, Artificial sequence
  Synthetic oligonucleotide
cagcttagccgggcccgcgtcctgg

SEQ ID NO: 674581 - DNA, 25 bp, Artificial sequence
  Synthetic oligonucleotide
ttcgttcagcttagccgggcccgcg

SEQ ID NO: 674582 - DNA, 25 bp, Artificial sequence
  Synthetic oligonucleotide
atgctgttcgttcagcttagccggg

SEQ ID NO: 674583 - DNA, 25 bp, Artificial sequence
  Synthetic oligonucleotide
gggcctatgctgttcgttcagctta

SEQ ID NO: 674584 - DNA, 25 bp, Artificial sequence
  Synthetic oligonucleotide
tcggtcgggcctatgctgttcgttc

SEQ ID NO: 674585 - DNA, 25 bp, Artificial sequence
  Synthetic oligonucleotide
tgaacgtcggtcgggcctatgctgt

SEQ ID NO: 674586 - DNA, 25 bp, Artificial sequence
  Synthetic oligonucleotide
tgggaatgaacgtcggtcgggccta

SEQ ID NO: 674587 - DNA, 25 bp, Artificial sequence
  Synthetic oligonucleotide
tgcatgcggtctttccaggggttgc

SEQ ID NO: 674588 - DNA, 25 bp, Artificial sequence
  Synthetic oligonucleotide
ctgggtgcgacggcagggccacttc

SEQ ID NO: 674589 - DNA, 25 bp, Artificial sequence
  Synthetic oligonucleotide
tccaggccgatgttggcctgtgcct

SEQ ID NO: 674590 - DNA, 25 bp, Artificial sequence
  Synthetic oligonucleotide
gccacttccaggccgatgttggcct

SEQ ID NO: 674591 - DNA, 25 bp, Artificial sequence
  Synthetic oligonucleotide
cttctccgccacttccaggccgatg

SEQ ID NO: 674592 - DNA, 25 bp, Artificial sequence
  Synthetic oligonucleotide
gaccagcttctccgccacttccagg

SEQ ID NO: 674593 - DNA, 25 bp, Artificial sequence
  Synthetic oligonucleotide
tacttgaccagcttctccgccactt

SEQ ID NO: 674594 - DNA, 25 bp, Artificial sequence
  Synthetic oligonucleotide
tcgctgtacttgaccagcttctccg

SEQ ID NO: 674595 - DNA, 25 bp, Artificial sequence
  Synthetic oligonucleotide
cgttgtcgctgtacttgaccagctt

SEQ ID NO: 674596 - DNA, 25 bp, Artificial sequence
  Synthetic oligonucleotide
aggtgccgttgtcgctgtacttgac

SEQ ID NO: 674597 - DNA, 25 bp, Artificial sequence
  Synthetic oligonucleotide
acaccgaggtgccgttgtcgctgta

SEQ ID NO: 674598 - DNA, 25 bp, Artificial sequence
  Synthetic oligonucleotide
accgaggacaccgaggtgccgttgt

SEQ ID NO: 674599 - DNA, 25 bp, Artificial sequence
  Synthetic oligonucleotide
gaagttgaccgaggacaccgaggtg

SEQ ID NO: 674600 - DNA, 25 bp, Artificial sequence
  Synthetic oligonucleotide
ttggcctgtgcctcggcggtggagc

SEQ ID NO: 674601 - DNA, 25 bp, Artificial sequence
  Synthetic oligonucleotide
gcgacggcagggccacttcggggaa

SEQ ID NO: 674602 - DNA, 25 bp, Artificial sequence
  Synthetic oligonucleotide
gtggagccgccgatgtgcggggtca

SEQ ID NO: 674603 - DNA, 25 bp, Artificial sequence
  Synthetic oligonucleotide
tgcttgcctgggtgcgacggcaggg

SEQ ID NO: 674604 - DNA, 25 bp, Artificial sequence
  Synthetic oligonucleotide
aggcggtgcttgcctgggtgcgacg

SEQ ID NO: 674605 - DNA, 25 bp, Artificial sequence
  Synthetic oligonucleotide
gcagcaggcggtgcttgcctgggtg

SEQ ID NO: 674606 - DNA, 25 bp, Artificial sequence
  Synthetic oligonucleotide
ggatgtgcagcaggcggtgcttgcc

SEQ ID NO: 674607 - DNA, 25 bp, Artificial sequence
  Synthetic oligonucleotide
tggcgtggatgtgcagcaggcggtg

SEQ ID NO: 674608 - DNA, 25 bp, Artificial sequence
  Synthetic oligonucleotide
ggatgttggcgtggatgtgcagcag

SEQ ID NO: 674609 - DNA, 25 bp, Artificial sequence
  Synthetic oligonucleotide
cgccggggatgttggcgtggatgtg

SEQ ID NO: 674610 - DNA, 25 bp, Artificial sequence
  Synthetic oligonucleotide
tcatcacgccggggatgttggcgtg

SEQ ID NO: 674611 - DNA, 25 bp, Artificial sequence
  Synthetic oligonucleotide
tctcgctcatcacgccggggatgtt

SEQ ID NO: 674612 - DNA, 25 bp, Artificial sequence
  Synthetic oligonucleotide
tgttgatctcgctcatcacgccggg

SEQ ID NO: 674613 - DNA, 25 bp, Artificial sequence
  Synthetic oligonucleotide
gaccttgttgatctcgctcatcacg

SEQ ID NO: 674614 - DNA, 25 bp, Artificial sequence
  Synthetic oligonucleotide
gcagggccacttcggggaagttgac

SEQ ID NO: 674615 - DNA, 25 bp, Artificial sequence
  Synthetic oligonucleotide
ttggatttcggctcgaccgggaaca

SEQ ID NO: 674616 - DNA, 25 bp, Artificial sequence
  Synthetic oligonucleotide
gcggccaggtggtccagctcgacca

SEQ ID NO: 674617 - DNA, 25 bp, Artificial sequence
  Synthetic oligonucleotide
gaccgagagcccggcttcccattgt

SEQ ID NO: 674618 - DNA, 25 bp, Artificial sequence
  Synthetic oligonucleotide
agccggtgagcttgccaccctgctt

SEQ ID NO: 674619 - DNA, 25 bp, Artificial sequence
  Synthetic oligonucleotide
atcgcggcggccaggtggtccagct

SEQ ID NO: 674620 - DNA, 25 bp, Artificial sequence
  Synthetic oligonucleotide
tccttgatcgcggcggccaggtggt

SEQ ID NO: 674621 - DNA, 25 bp, Artificial sequence
  Synthetic oligonucleotide
tgctcgtccttgatcgcggcggcca

SEQ ID NO: 674622 - DNA, 25 bp, Artificial sequence
  Synthetic oligonucleotide
atcaggtgctcgtccttgatcgcgg

SEQ ID NO: 674623 - DNA, 25 bp, Artificial sequence
  Synthetic oligonucleotide
gcgccgatcaggtgctcgtccttga

SEQ ID NO: 674624 - DNA, 25 bp, Artificial sequence
  Synthetic oligonucleotide
atggcggcgccgatcaggtgctcgt

SEQ ID NO: 674625 - DNA, 25 bp, Artificial sequence
  Synthetic oligonucleotide
acgtcgatggcggcgccgatcaggt

SEQ ID NO: 674626 - DNA, 25 bp, Artificial sequence
  Synthetic oligonucleotide
gggaacacgtcgatggcggcgccga

SEQ ID NO: 674627 - DNA, 25 bp, Artificial sequence
  Synthetic oligonucleotide
ccgatgttggcctgtgcctcggcgg

SEQ ID NO: 674628 - DNA, 25 bp, Artificial sequence
  Synthetic oligonucleotide
ttcggctcgaccgggaacacgtcga

SEQ ID NO: 674629 - DNA, 25 bp, Artificial sequence
  Synthetic oligonucleotide
tgtgcctcggcggtggagccgccga

SEQ ID NO: 674630 - DNA, 25 bp, Artificial sequence
  Synthetic oligonucleotide
tcgtcgttggatttcggctcgaccg

SEQ ID NO: 674631 - DNA, 25 bp, Artificial sequence
  Synthetic oligonucleotide
aattcctcgtcgttggatttcggct

SEQ ID NO: 674632 - DNA, 25 bp, Artificial sequence
  Synthetic oligonucleotide
ctggcgaattcctcgtcgttggatt

SEQ ID NO: 674633 - DNA, 25 bp, Artificial sequence
  Synthetic oligonucleotide
agcgggctggcgaattcctcgtcgt

SEQ ID NO: 674634 - DNA, 25 bp, Artificial sequence
  Synthetic oligonucleotide
ccacgcagcgggctggcgaattcct

SEQ ID NO: 674635 - DNA, 25 bp, Artificial sequence
  Synthetic oligonucleotide
gtccaggccacgcagcgggctggcg

SEQ ID NO: 674636 - DNA, 25 bp, Artificial sequence
  Synthetic oligonucleotide
cacccggtccaggccacgcagcggg

SEQ ID NO: 674637 - DNA, 25 bp, Artificial sequence
  Synthetic oligonucleotide
caggatcacccggtccaggccacgc

SEQ ID NO: 674638 - DNA, 25 bp, Artificial sequence
  Synthetic oligonucleotide
cggggtcaggatcacccggtccagg

SEQ ID NO: 674639 - DNA, 25 bp, Artificial sequence
  Synthetic oligonucleotide
atgtgcggggtcaggatcacccggt

SEQ ID NO: 674640 - DNA, 25 bp, Artificial sequence
  Synthetic oligonucleotide
ccgccgatgtgcggggtcaggatca

SEQ ID NO: 674641 - DNA, 25 bp, Artificial sequence
  Synthetic oligonucleotide
gatgccgttgtcggcgaagaccttg

SEQ ID NO: 674642 - DNA, 25 bp, Artificial sequence
  Synthetic oligonucleotide
tcgaccgggaacacgtcgatggcgg

SEQ ID NO: 674643 - DNA, 25 bp, Artificial sequence
  Synthetic oligonucleotide
ccctgccgccgggcaagcacaccct

SEQ ID NO: 674644 - DNA, 25 bp, Artificial sequence
  Synthetic oligonucleotide
ggcgaagaccttgttgatctcgctc

SEQ ID NO: 674645 - DNA, 25 bp, Artificial sequence
  Synthetic oligonucleotide
ggagtcggagaagatcaccgttacc

SEQ ID NO: 674646 - DNA, 25 bp, Artificial sequence
  Synthetic oligonucleotide
gaccgtggagtcggagaagatcacc

SEQ ID NO: 674647 - DNA, 25 bp, Artificial sequence
  Synthetic oligonucleotide
ggagccgaccgtggagtcggagaag

SEQ ID NO: 674648 - DNA, 25 bp, Artificial sequence
  Synthetic oligonucleotide
gccgctggagccgaccgtggagtcg

SEQ ID NO: 674649 - DNA, 25 bp, Artificial sequence
  Synthetic oligonucleotide
accacgtgccgctggagccgaccgt

SEQ ID NO: 674650 - DNA, 25 bp, Artificial sequence
  Synthetic oligonucleotide
acaagaaccacgtgccgctggagcc

SEQ ID NO: 674651 - DNA, 25 bp, Artificial sequence
  Synthetic oligonucleotide
tgggcgacaagaaccacgtgccgct

SEQ ID NO: 674652 - DNA, 25 bp, Artificial sequence
  Synthetic oligonucleotide
tgctggtgggcgacaagaaccacgt

SEQ ID NO: 674653 - DNA, 25 bp, Artificial sequence
  Synthetic oligonucleotide
tgcaactgctggtgggcgacaagaa

SEQ ID NO: 674654 - DNA, 25 bp, Artificial sequence
  Synthetic oligonucleotide
acaccctgcaactgctggtgggcga

SEQ ID NO: 674655 - DNA, 25 bp, Artificial sequence
  Synthetic oligonucleotide
gatcaccgttaccgtcaagtgacgg

SEQ ID NO: 674656 - DNA, 25 bp, Artificial sequence
  Synthetic oligonucleotide
cgccgggcaagcacaccctgcaact

SEQ ID NO: 674657 - DNA, 25 bp, Artificial sequence
  Synthetic oligonucleotide
ttcctttccgccggacgctgcctta

SEQ ID NO: 674658 - DNA, 25 bp, Artificial sequence
  Synthetic oligonucleotide
agatcaccctgccgccgggcaagca

SEQ ID NO: 674659 - DNA, 25 bp, Artificial sequence
  Synthetic oligonucleotide
aaaccgagatcaccctgccgccggg

SEQ ID NO: 674660 - DNA, 25 bp, Artificial sequence
  Synthetic oligonucleotide
gaccgaaaccgagatcaccctgccg

SEQ ID NO: 674661 - DNA, 25 bp, Artificial sequence
  Synthetic oligonucleotide
gggccagaccgaaaccgagatcacc

SEQ ID NO: 674662 - DNA, 25 bp, Artificial sequence
  Synthetic oligonucleotide
cggcaagggccagaccgaaaccgag

SEQ ID NO: 674663 - DNA, 25 bp, Artificial sequence
  Synthetic oligonucleotide
ccacttcggcaagggccagaccgaa

SEQ ID NO: 674664 - DNA, 25 bp, Artificial sequence
  Synthetic oligonucleotide
catccgccacttcggcaagggccag

SEQ ID NO: 674665 - DNA, 25 bp, Artificial sequence
  Synthetic oligonucleotide
cgacaacatccgccacttcggcaag

SEQ ID NO: 674666 - DNA, 25 bp, Artificial sequence
  Synthetic oligonucleotide
cgatgaccgacaacatccgccactt

SEQ ID NO: 674667 - DNA, 25 bp, Artificial sequence
  Synthetic oligonucleotide
cgctgccgatgaccgacaacatccg

SEQ ID NO: 674668 - DNA, 25 bp, Artificial sequence
  Synthetic oligonucleotide
acctgccgctgccgatgaccgacaa

SEQ ID NO: 674669 - DNA, 25 bp, Artificial sequence
  Synthetic oligonucleotide
cgatgaacctgccgctgccgatgac

SEQ ID NO: 674670 - DNA, 25 bp, Artificial sequence
  Synthetic oligonucleotide
gcaagcacaccctgcaactgctggt

SEQ ID NO: 674671 - DNA, 25 bp, Artificial sequence
  Synthetic oligonucleotide
ggtccgagtactcggcatcgacgtc

SEQ ID NO: 674672 - DNA, 25 bp, Artificial sequence
  Synthetic oligonucleotide
agccggcgatgaacctgccgctgcc

SEQ ID NO: 674673 - DNA, 25 bp, Artificial sequence
  Synthetic oligonucleotide
aacgttgatgccgttgtcggcgaag

SEQ ID NO: 674674 - DNA, 25 bp, Artificial sequence
  Synthetic oligonucleotide
gccggaaacgttgatgccgttgtcg

SEQ ID NO: 674675 - DNA, 25 bp, Artificial sequence
  Synthetic oligonucleotide
gtactggccggaaacgttgatgccg

SEQ ID NO: 674676 - DNA, 25 bp, Artificial sequence
  Synthetic oligonucleotide
ttgcaggtactggccggaaacgttg

SEQ ID NO: 674677 - DNA, 25 bp, Artificial sequence
  Synthetic oligonucleotide
tcgttggtttgcaggtactggccgg

SEQ ID NO: 674678 - DNA, 25 bp, Artificial sequence
  Synthetic oligonucleotide
accttctcgttggtttgcaggtact

SEQ ID NO: 674679 - DNA, 25 bp, Artificial sequence
  Synthetic oligonucleotide
tagccgaccttctcgttggtttgca

SEQ ID NO: 674680 - DNA, 25 bp, Artificial sequence
  Synthetic oligonucleotide
actacgtagccgaccttctcgttgg

SEQ ID NO: 674681 - DNA, 25 bp, Artificial sequence
  Synthetic oligonucleotide
tcgatcactacgtagccgaccttct

SEQ ID NO: 674682 - DNA, 25 bp, Artificial sequence
  Synthetic oligonucleotide
cgacgtcgatcactacgtagccgac

SEQ ID NO: 674683 - DNA, 25 bp, Artificial sequence
  Synthetic oligonucleotide
ggagaagatcaccgttaccgtcaag

SEQ ID NO: 674684 - DNA, 25 bp, Artificial sequence
  Synthetic oligonucleotide
agtactcggcatcgacgtcgatcac

SEQ ID NO: 674685 - DNA, 25 bp, Artificial sequence
  Synthetic oligonucleotide
gttgtcggcgaagaccttgttgatc

SEQ ID NO: 674686 - DNA, 25 bp, Artificial sequence
  Synthetic oligonucleotide
agggccaggtccgagtactcggcat

SEQ ID NO: 674687 - DNA, 25 bp, Artificial sequence
  Synthetic oligonucleotide
tttctccagggccaggtccgagtac

SEQ ID NO: 674688 - DNA, 25 bp, Artificial sequence
  Synthetic oligonucleotide
ctggagtttctccagggccaggtcc

SEQ ID NO: 674689 - DNA, 25 bp, Artificial sequence
  Synthetic oligonucleotide
gacctgctggagtttctccagggcc

SEQ ID NO: 674690 - DNA, 25 bp, Artificial sequence
  Synthetic oligonucleotide
accgttgacctgctggagtttctcc

SEQ ID NO: 674691 - DNA, 25 bp, Artificial sequence
  Synthetic oligonucleotide
gatggtaccgttgacctgctggagt

SEQ ID NO: 674692 - DNA, 25 bp, Artificial sequence
  Synthetic oligonucleotide
ggctacggatggtaccgttgacctg

SEQ ID NO: 674693 - DNA, 25 bp, Artificial sequence
  Synthetic oligonucleotide
gcacgcggctacggatggtaccgtt

SEQ ID NO: 674694 - DNA, 25 bp, Artificial sequence
  Synthetic oligonucleotide
agaacagcacgcggctacggatggt

SEQ ID NO: 674695 - DNA, 25 bp, Artificial sequence
  Synthetic oligonucleotide
tgccttagaacagcacgcggctacg

SEQ ID NO: 674696 - DNA, 25 bp, Artificial sequence
  Synthetic oligonucleotide
ggacgctgccttagaacagcacgcg

SEQ ID NO: 674697 - DNA, 25 bp, Artificial sequence
  Synthetic oligonucleotide
tccgccggacgctgccttagaacag

SEQ ID NO: 674698 - DNA, 25 bp, Artificial sequence
  Synthetic oligonucleotide
cggcatcgacgtcgatcactacgta

SEQ ID NO: 674699 - DNA, 25 bp, Artificial sequence
  Synthetic oligonucleotide
gatgcctacgctcggcagcccgtag

SEQ ID NO: 674700 - DNA, 25 bp, Artificial sequence
  Synthetic oligonucleotide
accgcggcgatctgcgagaccaccg

SEQ ID NO: 674701 - DNA, 25 bp, Artificial sequence
  Synthetic oligonucleotide
acgtagaccgcggcgatctgcgaga

SEQ ID NO: 674702 - DNA, 25 bp, Artificial sequence
  Synthetic oligonucleotide
gcgctgacgtagaccgcggcgatct

SEQ ID NO: 674703 - DNA, 25 bp, Artificial sequence
  Synthetic oligonucleotide
gcggaaggcgctgacgtagaccgcg

SEQ ID NO: 674704 - DNA, 25 bp, Artificial sequence
  Synthetic oligonucleotide
cgtcccgcggaaggcgctgacgtag

SEQ ID NO: 674705 - DNA, 25 bp, Artificial sequence
  Synthetic oligonucleotide
cagtggcgtcccgcggaaggcgctg

SEQ ID NO: 674706 - DNA, 25 bp, Artificial sequence
  Synthetic oligonucleotide
accagcagtggcgtcccgcggaagg

SEQ ID NO: 674707 - DNA, 25 bp, Artificial sequence
  Synthetic oligonucleotide
gatctgcaccagcagtggcgtcccg

SEQ ID NO: 674708 - DNA, 25 bp, Artificial sequence
  Synthetic oligonucleotide
gacgaagatctgcaccagcagtggc

SEQ ID NO: 674709 - DNA, 25 bp, Artificial sequence
  Synthetic oligonucleotide
gtacaggacgaagatctgcaccagc

SEQ ID NO: 674710 - DNA, 25 bp, Artificial sequence
  Synthetic oligonucleotide
cccgtagtacaggacgaagatctgc

SEQ ID NO: 674711 - DNA, 25 bp, Artificial sequence
  Synthetic oligonucleotide
gcttcccattgtcccttgtcgatgc

SEQ ID NO: 674712 - DNA, 25 bp, Artificial sequence
  Synthetic oligonucleotide
tacgctcggcagcccgtagtacagg

SEQ ID NO: 674713 - DNA, 25 bp, Artificial sequence
  Synthetic oligonucleotide
gcaccttggtcacccggaccaccgc

SEQ ID NO: 674714 - DNA, 25 bp, Artificial sequence
  Synthetic oligonucleotide
tgaactcgatgcctacgctcggcag

SEQ ID NO: 674715 - DNA, 25 bp, Artificial sequence
  Synthetic oligonucleotide
ccggggtgaactcgatgcctacgct

SEQ ID NO: 674716 - DNA, 25 bp, Artificial sequence
  Synthetic oligonucleotide
cggtgaccggggtgaactcgatgcc

SEQ ID NO: 674717 - DNA, 25 bp, Artificial sequence
  Synthetic oligonucleotide
tgcccgcggtgaccggggtgaactc

SEQ ID NO: 674718 - DNA, 25 bp, Artificial sequence
  Synthetic oligonucleotide
ccaggatgcccgcggtgaccggggt

SEQ ID NO: 674719 - DNA, 25 bp, Artificial sequence
  Synthetic oligonucleotide
tcagcgccaggatgcccgcggtgac

SEQ ID NO: 674720 - DNA, 25 bp, Artificial sequence
  Synthetic oligonucleotide
ttcagggtcagcgccaggatgcccg

SEQ ID NO: 674721 - DNA, 25 bp, Artificial sequence
  Synthetic oligonucleotide
cgacattcagggtcagcgccaggat

SEQ ID NO: 674722 - DNA, 25 bp, Artificial sequence
  Synthetic oligonucleotide
aggccgcgacattcagggtcagcgc

SEQ ID NO: 674723 - DNA, 25 bp, Artificial sequence
  Synthetic oligonucleotide
gagataggccgcgacattcagggtc

SEQ ID NO: 674724 - DNA, 25 bp, Artificial sequence
  Synthetic oligonucleotide
actccgagagataggccgcgacatt

SEQ ID NO: 674725 - DNA, 25 bp, Artificial sequence
  Synthetic oligonucleotide
cggcagcccgtagtacaggacgaag

SEQ ID NO: 674726 - DNA, 25 bp, Artificial sequence
  Synthetic oligonucleotide
aacagcacggtatacatcgcgccct

SEQ ID NO: 674727 - DNA, 25 bp, Artificial sequence
  Synthetic oligonucleotide
tcgagcaatttctgcagcgaattca

SEQ ID NO: 674728 - DNA, 25 bp, Artificial sequence
  Synthetic oligonucleotide
gagccattcgagcaatttctgcagc

SEQ ID NO: 674729 - DNA, 25 bp, Artificial sequence
  Synthetic oligonucleotide
gttggcgagccattcgagcaatttc

SEQ ID NO: 674730 - DNA, 25 bp, Artificial sequence
  Synthetic oligonucleotide
gaccaggttggcgagccattcgagc

SEQ ID NO: 674731 - DNA, 25 bp, Artificial sequence
  Synthetic oligonucleotide
gcagctcgaccaggttggcgagcca

SEQ ID NO: 674732 - DNA, 25 bp, Artificial sequence
  Synthetic oligonucleotide
tcccgagcagctcgaccaggttggc

SEQ ID NO: 674733 - DNA, 25 bp, Artificial sequence
  Synthetic oligonucleotide
aggccatcccgagcagctcgaccag

SEQ ID NO: 674734 - DNA, 25 bp, Artificial sequence
  Synthetic oligonucleotide
aagggccaggccatcccgagcagct

SEQ ID NO: 674735 - DNA, 25 bp, Artificial sequence
  Synthetic oligonucleotide
gcaggaagggccaggccatcccgag

SEQ ID NO: 674736 - DNA, 25 bp, Artificial sequence
  Synthetic oligonucleotide
ctggagcaggaagggccaggccatc

SEQ ID NO: 674737 - DNA, 25 bp, Artificial sequence
  Synthetic oligonucleotide
gcgccctggagcaggaagggccagg

SEQ ID NO: 674738 - DNA, 25 bp, Artificial sequence
  Synthetic oligonucleotide
gcgatctgcgagaccaccggcacct

SEQ ID NO: 674739 - DNA, 25 bp, Artificial sequence
  Synthetic oligonucleotide
acggtatacatcgcgccctggagca

SEQ ID NO: 674740 - DNA, 25 bp, Artificial sequence
  Synthetic oligonucleotide
tgcgagaccaccggcaccttggtca

SEQ ID NO: 674741 - DNA, 25 bp, Artificial sequence
  Synthetic oligonucleotide
gcggcgaacagcacggtatacatcg

SEQ ID NO: 674742 - DNA, 25 bp, Artificial sequence
  Synthetic oligonucleotide
gataccgcggcgaacagcacggtat

SEQ ID NO: 674743 - DNA, 25 bp, Artificial sequence
  Synthetic oligonucleotide
accatcgataccgcggcgaacagca

SEQ ID NO: 674744 - DNA, 25 bp, Artificial sequence
  Synthetic oligonucleotide
ccaggaccatcgataccgcggcgaa

SEQ ID NO: 674745 - DNA, 25 bp, Artificial sequence
  Synthetic oligonucleotide
atcaggcccaggaccatcgataccg

SEQ ID NO: 674746 - DNA, 25 bp, Artificial sequence
  Synthetic oligonucleotide
ccgaggatcaggcccaggaccatcg

SEQ ID NO: 674747 - DNA, 25 bp, Artificial sequence
  Synthetic oligonucleotide
ctgaagccgaggatcaggcccagga

SEQ ID NO: 674748 - DNA, 25 bp, Artificial sequence
  Synthetic oligonucleotide
gcgacgctgaagccgaggatcaggc

SEQ ID NO: 674749 - DNA, 25 bp, Artificial sequence
  Synthetic oligonucleotide
accaccgcgacgctgaagccgagga

SEQ ID NO: 674750 - DNA, 25 bp, Artificial sequence
  Synthetic oligonucleotide
acccggaccaccgcgacgctgaagc

SEQ ID NO: 674751 - DNA, 25 bp, Artificial sequence
  Synthetic oligonucleotide
tggtcacccggaccaccgcgacgct

SEQ ID NO: 674752 - DNA, 25 bp, Artificial sequence
  Synthetic oligonucleotide
ggatcgccccgcgcatggactccga

SEQ ID NO: 674753 - DNA, 25 bp, Artificial sequence
  Synthetic oligonucleotide
tacatcgcgccctggagcaggaagg

SEQ ID NO: 674754 - DNA, 25 bp, Artificial sequence
  Synthetic oligonucleotide
agccagtagatcccggcggcggcga

SEQ ID NO: 674755 - DNA, 25 bp, Artificial sequence
  Synthetic oligonucleotide
gcatggactccgagagataggccgc

SEQ ID NO: 674756 - DNA, 25 bp, Artificial sequence
  Synthetic oligonucleotide
ccagcatcagttcggtcacggtgat

SEQ ID NO: 674757 - DNA, 25 bp, Artificial sequence
  Synthetic oligonucleotide
ggtcgccagcatcagttcggtcacg

SEQ ID NO: 674758 - DNA, 25 bp, Artificial sequence
  Synthetic oligonucleotide
ctccttggtcgccagcatcagttcg

SEQ ID NO: 674759 - DNA, 25 bp, Artificial sequence
  Synthetic oligonucleotide
cgatgacctccttggtcgccagcat

SEQ ID NO: 674760 - DNA, 25 bp, Artificial sequence
  Synthetic oligonucleotide
gtctcggcgatgacctccttggtcg

SEQ ID NO: 674761 - DNA, 25 bp, Artificial sequence
  Synthetic oligonucleotide
tggaaggtctcggcgatgacctcct

SEQ ID NO: 674762 - DNA, 25 bp, Artificial sequence
  Synthetic oligonucleotide
gcggctggaaggtctcggcgatgac

SEQ ID NO: 674763 - DNA, 25 bp, Artificial sequence
  Synthetic oligonucleotide
gcggcagcggctggaaggtctcggc

SEQ ID NO: 674764 - DNA, 25 bp, Artificial sequence
  Synthetic oligonucleotide
gatagagcggcagcggctggaaggt

SEQ ID NO: 674765 - DNA, 25 bp, Artificial sequence
  Synthetic oligonucleotide
cggcgagatagagcggcagcggctg

SEQ ID NO: 674766 - DNA, 25 bp, Artificial sequence
  Synthetic oligonucleotide
cggtcacggtgatcacggagatcag

SEQ ID NO: 674767 - DNA, 25 bp, Artificial sequence
  Synthetic oligonucleotide
tagatcccggcggcggcgagataga

SEQ ID NO: 674768 - DNA, 25 bp, Artificial sequence
  Synthetic oligonucleotide
cggtgatcacggagatcagcgaggt

SEQ ID NO: 674769 - DNA, 25 bp, Artificial sequence
  Synthetic oligonucleotide
gaaagcagccagtagatcccggcgg

SEQ ID NO: 674770 - DNA, 25 bp, Artificial sequence
  Synthetic oligonucleotide
agtgccgaaagcagccagtagatcc

SEQ ID NO: 674771 - DNA, 25 bp, Artificial sequence
  Synthetic oligonucleotide
tcgaagagtgccgaaagcagccagt

SEQ ID NO: 674772 - DNA, 25 bp, Artificial sequence
  Synthetic oligonucleotide
cacacgctcgaagagtgccgaaagc

SEQ ID NO: 674773 - DNA, 25 bp, Artificial sequence
  Synthetic oligonucleotide
tttctgcacacgctcgaagagtgcc

SEQ ID NO: 674774 - DNA, 25 bp, Artificial sequence
  Synthetic oligonucleotide
cagggctttctgcacacgctcgaag

SEQ ID NO: 674775 - DNA, 25 bp, Artificial sequence
  Synthetic oligonucleotide
ggttctccagggctttctgcacacg

SEQ ID NO: 674776 - DNA, 25 bp, Artificial sequence
  Synthetic oligonucleotide
gtcaggcggttctccagggctttct

SEQ ID NO: 674777 - DNA, 25 bp, Artificial sequence
  Synthetic oligonucleotide
ggcgcggtcaggcggttctccaggg

SEQ ID NO: 674778 - DNA, 25 bp, Artificial sequence
  Synthetic oligonucleotide
cgcagcggcgcggtcaggcggttct

SEQ ID NO: 674779 - DNA, 25 bp, Artificial sequence
  Synthetic oligonucleotide
tcagcgccgcagcggcgcggtcagg

SEQ ID NO: 674780 - DNA, 25 bp, Artificial sequence
  Synthetic oligonucleotide
ctcgaccactgtgccgcgcgcggcg

SEQ ID NO: 674781 - DNA, 25 bp, Artificial sequence
  Synthetic oligonucleotide
ccggcggcggcgagatagagcggca

SEQ ID NO: 674782 - DNA, 25 bp, Artificial sequence
  Synthetic oligonucleotide
gggcctgcggggtgatgatgttcca

SEQ ID NO: 674783 - DNA, 25 bp, Artificial sequence
  Synthetic oligonucleotide
gaattcattcaacactccatcgaca

SEQ ID NO: 674784 - DNA, 25 bp, Artificial sequence
  Synthetic oligonucleotide
tgccgaggatcgccccgcgcatgga

SEQ ID NO: 674785 - DNA, 25 bp, Artificial sequence
  Synthetic oligonucleotide
gtcgatgccgaggatcgccccgcgc

SEQ ID NO: 674786 - DNA, 25 bp, Artificial sequence
  Synthetic oligonucleotide
tcccttgtcgatgccgaggatcgcc

SEQ ID NO: 674787 - DNA, 25 bp, Artificial sequence
  Synthetic oligonucleotide
cattgtcccttgtcgatgccgagga

SEQ ID NO: 674788 - DNA, 25 bp, Artificial sequence
  Synthetic oligonucleotide
agcccggcttcccattgtcccttgt

SEQ ID NO: 674789 - DNA, 25 bp, Artificial sequence
  Synthetic oligonucleotide
caggccgaccgagagcccggcttcc

SEQ ID NO: 674790 - DNA, 25 bp, Artificial sequence
  Synthetic oligonucleotide
ccaggtcaggccgaccgagagcccg

SEQ ID NO: 674791 - DNA, 25 bp, Artificial sequence
  Synthetic oligonucleotide
tctggccccaggtcaggccgaccga

SEQ ID NO: 674792 - DNA, 25 bp, Artificial sequence
  Synthetic oligonucleotide
acagggtctggccccaggtcaggcc

SEQ ID NO: 674793 - DNA, 25 bp, Artificial sequence
  Synthetic oligonucleotide
tgttccacagggtctggccccaggt

SEQ ID NO: 674794 - DNA, 25 bp, Artificial sequence
  Synthetic oligonucleotide
tcagttcggtcacggtgatcacgga

SEQ ID NO: 674795 - DNA, 25 bp, Artificial sequence
  Synthetic oligonucleotide
gcggggtgatgatgttccacagggt

SEQ ID NO: 674796 - DNA, 25 bp, Artificial sequence
  Synthetic oligonucleotide
ccccgcgcatggactccgagagata

SEQ ID NO: 674797 - DNA, 25 bp, Artificial sequence
  Synthetic oligonucleotide
ggcgcagggcctgcggggtgatgat

SEQ ID NO: 674798 - DNA, 25 bp, Artificial sequence
  Synthetic oligonucleotide
ccgccaggcgcagggcctgcggggt

SEQ ID NO: 674799 - DNA, 25 bp, Artificial sequence
  Synthetic oligonucleotide
tcggcaccgccaggcgcagggcctg

SEQ ID NO: 674800 - DNA, 25 bp, Artificial sequence
  Synthetic oligonucleotide
acaggctcggcaccgccaggcgcag

SEQ ID NO: 674801 - DNA, 25 bp, Artificial sequence
  Synthetic oligonucleotide
tgttcgacaggctcggcaccgccag

SEQ ID NO: 674802 - DNA, 25 bp, Artificial sequence
  Synthetic oligonucleotide
tcaggctgttcgacaggctcggcac

SEQ ID NO: 674803 - DNA, 25 bp, Artificial sequence
  Synthetic oligonucleotide
ggctgatcaggctgttcgacaggct

SEQ ID NO: 674804 - DNA, 25 bp, Artificial sequence
  Synthetic oligonucleotide
tgatcaggctgatcaggctgttcga

SEQ ID NO: 674805 - DNA, 25 bp, Artificial sequence
  Synthetic oligonucleotide
tgtccttgatcaggctgatcaggct

SEQ ID NO: 674806 - DNA, 25 bp, Artificial sequence
  Synthetic oligonucleotide
gcgaggtgtccttgatcaggctgat

SEQ ID NO: 674807 - DNA, 25 bp, Artificial sequence
  Synthetic oligonucleotide
agatcagcgaggtgtccttgatcag

SEQ ID NO: 674808 - DNA, 25 bp, Artificial sequence
  Synthetic oligonucleotide
tcacggagatcagcgaggtgtcctt

SEQ ID NO: 674809 - DNA, 25 bp, Artificial sequence
  Synthetic oligonucleotide
tgatgatgttccacagggtctggcc

SEQ ID NO: 674810 - DNA, 25 bp, Artificial sequence
  Synthetic oligonucleotide
ttgaggcccttgaggtcttccagcg

SEQ ID NO: 674811 - DNA, 25 bp, Artificial sequence
  Synthetic oligonucleotide
ccggataggtgcgcacgttgacgcc

SEQ ID NO: 674812 - DNA, 25 bp, Artificial sequence
  Synthetic oligonucleotide
ggagatggtgtatggctcgctgaag

SEQ ID NO: 674813 - DNA, 25 bp, Artificial sequence
  Synthetic oligonucleotide
ggcgctggagatggtgtatggctcg

SEQ ID NO: 674814 - DNA, 25 bp, Artificial sequence
  Synthetic oligonucleotide
caactgggcgctggagatggtgtat

SEQ ID NO: 674815 - DNA, 25 bp, Artificial sequence
  Synthetic oligonucleotide
cacgatcaactgggcgctggagatg

SEQ ID NO: 674816 - DNA, 25 bp, Artificial sequence
  Synthetic oligonucleotide
cggcgcgcacgatcaactgggcgct

SEQ ID NO: 674817 - DNA, 25 bp, Artificial sequence
  Synthetic oligonucleotide
tttcgtcggcgcgcacgatcaactg

SEQ ID NO: 674818 - DNA, 25 bp, Artificial sequence
  Synthetic oligonucleotide
ggcgggtttcgtcggcgcgcacgat

SEQ ID NO: 674819 - DNA, 25 bp, Artificial sequence
  Synthetic oligonucleotide
gaactggcgggtttcgtcggcgcgc

SEQ ID NO: 674820 - DNA, 25 bp, Artificial sequence
  Synthetic oligonucleotide
cgacttgaactggcgggtttcgtcg

SEQ ID NO: 674821 - DNA, 25 bp, Artificial sequence
  Synthetic oligonucleotide
tccagcgacttgaactggcgggttt

SEQ ID NO: 674822 - DNA, 25 bp, Artificial sequence
  Synthetic oligonucleotide
tggctcgctgaagtcgaagaccttg

SEQ ID NO: 674823 - DNA, 25 bp, Artificial sequence
  Synthetic oligonucleotide
cccttgaggtcttccagcgacttga

SEQ ID NO: 674824 - DNA, 25 bp, Artificial sequence
  Synthetic oligonucleotide
gctgaagtcgaagaccttgcgccgc

SEQ ID NO: 674825 - DNA, 25 bp, Artificial sequence
  Synthetic oligonucleotide
ccgagcttgaggcccttgaggtctt

SEQ ID NO: 674826 - DNA, 25 bp, Artificial sequence
  Synthetic oligonucleotide
ccgacgccgagcttgaggcccttga

SEQ ID NO: 674827 - DNA, 25 bp, Artificial sequence
  Synthetic oligonucleotide
ccctggccgacgccgagcttgaggc

SEQ ID NO: 674828 - DNA, 25 bp, Artificial sequence
  Synthetic oligonucleotide
ttggtgccctggccgacgccgagct

SEQ ID NO: 674829 - DNA, 25 bp, Artificial sequence
  Synthetic oligonucleotide
gcgtagttggtgccctggccgacgc

SEQ ID NO: 674830 - DNA, 25 bp, Artificial sequence
  Synthetic oligonucleotide
caggtcggcgtagttggtgccctgg

SEQ ID NO: 674831 - DNA, 25 bp, Artificial sequence
  Synthetic oligonucleotide
ttcgccaggtcggcgtagttggtgc

SEQ ID NO: 674832 - DNA, 25 bp, Artificial sequence
  Synthetic oligonucleotide
accgacttcgccaggtcggcgtagt

SEQ ID NO: 674833 - DNA, 25 bp, Artificial sequence
  Synthetic oligonucleotide
ccggccaccgacttcgccaggtcgg

SEQ ID NO: 674834 - DNA, 25 bp, Artificial sequence
  Synthetic oligonucleotide
ttgacgccggccaccgacttcgcca

SEQ ID NO: 674835 - DNA, 25 bp, Artificial sequence
  Synthetic oligonucleotide
cgcacgttgacgccggccaccgact

SEQ ID NO: 674836 - DNA, 25 bp, Artificial sequence
  Synthetic oligonucleotide
aatttctgcagcgaattcattcaac

SEQ ID NO: 674837 - DNA, 25 bp, Artificial sequence
  Synthetic oligonucleotide
aggtcttccagcgacttgaactggc

SEQ ID NO: 674838 - DNA, 25 bp, Artificial sequence
  Synthetic oligonucleotide
aggccggcgaggatgccgctccatt

SEQ ID NO: 674839 - DNA, 25 bp, Artificial sequence
  Synthetic oligonucleotide
ttcggtctcgaagccggtgagcttg

SEQ ID NO: 674840 - DNA, 25 bp, Artificial sequence
  Synthetic oligonucleotide
cccagttcggtctcgaagccggtga

SEQ ID NO: 674841 - DNA, 25 bp, Artificial sequence
  Synthetic oligonucleotide
agttcgcccagttcggtctcgaagc

SEQ ID NO: 674842 - DNA, 25 bp, Artificial sequence
  Synthetic oligonucleotide
gccagcagttcgcccagttcggtct

SEQ ID NO: 674843 - DNA, 25 bp, Artificial sequence
  Synthetic oligonucleotide
tcggcggccagcagttcgcccagtt

SEQ ID NO: 674844 - DNA, 25 bp, Artificial sequence
  Synthetic oligonucleotide
gccagttcggcggccagcagttcgc

SEQ ID NO: 674845 - DNA, 25 bp, Artificial sequence
  Synthetic oligonucleotide
ttgaccgccagttcggcggccagca

SEQ ID NO: 674846 - DNA, 25 bp, Artificial sequence
  Synthetic oligonucleotide
ttcaggcttgaccgccagttcggcg

SEQ ID NO: 674847 - DNA, 25 bp, Artificial sequence
  Synthetic oligonucleotide
gacgaattcaggcttgaccgccagt

SEQ ID NO: 674848 - DNA, 25 bp, Artificial sequence
  Synthetic oligonucleotide
cggtggtgacgaattcaggcttgac

SEQ ID NO: 674849 - DNA, 25 bp, Artificial sequence
  Synthetic oligonucleotide
tccattcggtggtgacgaattcagg

SEQ ID NO: 674850 - DNA, 25 bp, Artificial sequence
  Synthetic oligonucleotide
ggtgtatggctcgctgaagtcgaag

SEQ ID NO: 674851 - DNA, 25 bp, Artificial sequence
  Synthetic oligonucleotide
cgaggatgccgctccattcggtggt

SEQ ID NO: 674852 - DNA, 25 bp, Artificial sequence
  Synthetic oligonucleotide
gggcgcccggataggtgcgcacgtt

SEQ ID NO: 674853 - DNA, 25 bp, Artificial sequence
  Synthetic oligonucleotide
gctctgcaggccggcgaggatgccg

SEQ ID NO: 674854 - DNA, 25 bp, Artificial sequence
  Synthetic oligonucleotide
ttgccgctctgcaggccggcgagga

SEQ ID NO: 674855 - DNA, 25 bp, Artificial sequence
  Synthetic oligonucleotide
tcgtacttgccgctctgcaggccgg

SEQ ID NO: 674856 - DNA, 25 bp, Artificial sequence
  Synthetic oligonucleotide
cgcgatgtcgtacttgccgctctgc

SEQ ID NO: 674857 - DNA, 25 bp, Artificial sequence
  Synthetic oligonucleotide
ttcagcgcgatgtcgtacttgccgc

SEQ ID NO: 674858 - DNA, 25 bp, Artificial sequence
  Synthetic oligonucleotide
acctggttcagcgcgatgtcgtact

SEQ ID NO: 674859 - DNA, 25 bp, Artificial sequence
  Synthetic oligonucleotide
accgagacctggttcagcgcgatgt

SEQ ID NO: 674860 - DNA, 25 bp, Artificial sequence
  Synthetic oligonucleotide
tcgttcaccgagacctggttcagcg

SEQ ID NO: 674861 - DNA, 25 bp, Artificial sequence
  Synthetic oligonucleotide
cgctgctcgttcaccgagacctggt

SEQ ID NO: 674862 - DNA, 25 bp, Artificial sequence
  Synthetic oligonucleotide
ttgcgccgctgctcgttcaccgaga

SEQ ID NO: 674863 - DNA, 25 bp, Artificial sequence
  Synthetic oligonucleotide
aagaccttgcgccgctgctcgttca

SEQ ID NO: 674864 - DNA, 25 bp, Artificial sequence
  Synthetic oligonucleotide
agtcgaagaccttgcgccgctgctc

SEQ ID NO: 674865 - DNA, 25 bp, Artificial sequence
  Synthetic oligonucleotide
tgccgctccattcggtggtgacgaa

SEQ ID NO: 674866 - DNA, 25 bp, Artificial sequence
  Synthetic oligonucleotide
gctggctgacgtccaggccgaacca

SEQ ID NO: 674867 - DNA, 25 bp, Artificial sequence
  Synthetic oligonucleotide
aggtgcgcacgttgacgccggccac

SEQ ID NO: 674868 - DNA, 25 bp, Artificial sequence
  Synthetic oligonucleotide
agcgccgcgttcagcgcctcgccga

SEQ ID NO: 674869 - DNA, 25 bp, Artificial sequence
  Synthetic oligonucleotide
ttctccagcgccgcgttcagcgcct

SEQ ID NO: 674870 - DNA, 25 bp, Artificial sequence
  Synthetic oligonucleotide
ttgatcttctccagcgccgcgttca

SEQ ID NO: 674871 - DNA, 25 bp, Artificial sequence
  Synthetic oligonucleotide
cggccttgatcttctccagcgccgc

SEQ ID NO: 674872 - DNA, 25 bp, Artificial sequence
  Synthetic oligonucleotide
ggccgtcggccttgatcttctccag

SEQ ID NO: 674873 - DNA, 25 bp, Artificial sequence
  Synthetic oligonucleotide
gaagcggccgtcggccttgatcttc

SEQ ID NO: 674874 - DNA, 25 bp, Artificial sequence
  Synthetic oligonucleotide
cttggcgaagcggccgtcggccttg

SEQ ID NO: 674875 - DNA, 25 bp, Artificial sequence
  Synthetic oligonucleotide
cgagagcttggcgaagcggccgtcg

SEQ ID NO: 674876 - DNA, 25 bp, Artificial sequence
  Synthetic oligonucleotide
acttttccgagagcttggcgaagcg

SEQ ID NO: 674877 - DNA, 25 bp, Artificial sequence
  Synthetic oligonucleotide
cgaaccacttttccgagagcttggc

SEQ ID NO: 674878 - DNA, 25 bp, Artificial sequence
  Synthetic oligonucleotide
agcgcctcgccgaacttcggattgt

SEQ ID NO: 674879 - DNA, 25 bp, Artificial sequence
  Synthetic oligonucleotide
tgacgtccaggccgaaccacttttc

SEQ ID NO: 674880 - DNA, 25 bp, Artificial sequence
  Synthetic oligonucleotide
tcgccgaacttcggattgttcttcc

SEQ ID NO: 674881 - DNA, 25 bp, Artificial sequence
  Synthetic oligonucleotide
tcggcggctggctgacgtccaggcc

SEQ ID NO: 674882 - DNA, 25 bp, Artificial sequence
  Synthetic oligonucleotide
tcacttcggcggctggctgacgtcc

SEQ ID NO: 674883 - DNA, 25 bp, Artificial sequence
  Synthetic oligonucleotide
gggaactcacttcggcggctggctg

SEQ ID NO: 674884 - DNA, 25 bp, Artificial sequence
  Synthetic oligonucleotide
tcgggcgggaactcacttcggcggc

SEQ ID NO: 674885 - DNA, 25 bp, Artificial sequence
  Synthetic oligonucleotide
ctctcgggcgcggccgcttcccccg

SEQ ID NO: 674886 - DNA, 25 bp, Artificial sequence
  Synthetic oligonucleotide
cgcgtctctcgggcgcggccgcttc

SEQ ID NO: 674887 - DNA, 25 bp, Artificial sequence
  Synthetic oligonucleotide
gacggccgcgtctctcgggcgcggc

SEQ ID NO: 674888 - DNA, 25 bp, Artificial sequence
  Synthetic oligonucleotide
aaacacgacggccgcgtctctcggg

SEQ ID NO: 674889 - DNA, 25 bp, Artificial sequence
  Synthetic oligonucleotide
atcgacaaacacgacggccgcgtct

SEQ ID NO: 674890 - DNA, 25 bp, Artificial sequence
  Synthetic oligonucleotide
cactccatcgacaaacacgacggcc

SEQ ID NO: 674891 - DNA, 25 bp, Artificial sequence
  Synthetic oligonucleotide
attcaacactccatcgacaaacacg

SEQ ID NO: 674892 - DNA, 25 bp, Artificial sequence
  Synthetic oligonucleotide
tctcgaagccggtgagcttgccacc

SEQ ID NO: 674893 - DNA, 25 bp, Artificial sequence
  Synthetic oligonucleotide
ccaggccgaaccacttttccgagag

SEQ ID NO: 674894 - DNA, 25 bp, Artificial sequence
  Synthetic oligonucleotide
tggcctcgcggatggcgaaggggat

SEQ ID NO: 674895 - DNA, 25 bp, Artificial sequence
  Synthetic oligonucleotide
attccggggcgcccggataggtgcg

SEQ ID NO: 674896 - DNA, 25 bp, Artificial sequence
  Synthetic oligonucleotide
gcaggtattccggggcgcccggata

SEQ ID NO: 674897 - DNA, 25 bp, Artificial sequence
  Synthetic oligonucleotide
aggtcctgcaggtattccggggcgc

SEQ ID NO: 674898 - DNA, 25 bp, Artificial sequence
  Synthetic oligonucleotide
gctggccaggtcctgcaggtattcc

SEQ ID NO: 674899 - DNA, 25 bp, Artificial sequence
  Synthetic oligonucleotide
gcgtttgctggccaggtcctgcagg

SEQ ID NO: 674900 - DNA, 25 bp, Artificial sequence
  Synthetic oligonucleotide
gtcgatgcgtttgctggccaggtcc

SEQ ID NO: 674901 - DNA, 25 bp, Artificial sequence
  Synthetic oligonucleotide
cgccgcgtcgatgcgtttgctggcc

SEQ ID NO: 674902 - DNA, 25 bp, Artificial sequence
  Synthetic oligonucleotide
gttgagcgccgcgtcgatgcgtttg

SEQ ID NO: 674903 - DNA, 25 bp, Artificial sequence
  Synthetic oligonucleotide
ggcggtcgttgagcgccgcgtcgat

SEQ ID NO: 674904 - DNA, 25 bp, Artificial sequence
  Synthetic oligonucleotide
cagcaggcggtcgttgagcgccgcg

SEQ ID NO: 674905 - DNA, 25 bp, Artificial sequence
  Synthetic oligonucleotide
ggggatcagcaggcggtcgttgagc

SEQ ID NO: 674906 - DNA, 25 bp, Artificial sequence
  Synthetic oligonucleotide
gcgttcagcgcctcgccgaacttcg

SEQ ID NO: 674907 - DNA, 25 bp, Artificial sequence
  Synthetic oligonucleotide
gcggatggcgaaggggatcagcagg

SEQ ID NO: 674908 - DNA, 25 bp, Artificial sequence
  Synthetic oligonucleotide
tgcagcgaattcattcaacactcca

SEQ ID NO: 674909 - DNA, 25 bp, Artificial sequence
  Synthetic oligonucleotide
gcagcttggcctcgcggatggcgaa

SEQ ID NO: 674910 - DNA, 25 bp, Artificial sequence
  Synthetic oligonucleotide
tgaccggcagcttggcctcgcggat

SEQ ID NO: 674911 - DNA, 25 bp, Artificial sequence
  Synthetic oligonucleotide
gggcttgaccggcagcttggcctcg

SEQ ID NO: 674912 - DNA, 25 bp, Artificial sequence
  Synthetic oligonucleotide
gcgccgggcttgaccggcagcttgg

SEQ ID NO: 674913 - DNA, 25 bp, Artificial sequence
  Synthetic oligonucleotide
accgccgcgccgggcttgaccggca

SEQ ID NO: 674914 - DNA, 25 bp, Artificial sequence
  Synthetic oligonucleotide
cggtcccaccgccgcgccgggcttg

SEQ ID NO: 674915 - DNA, 25 bp, Artificial sequence
  Synthetic oligonucleotide
ttcgccaccggtcccaccgccgcgc

SEQ ID NO: 674916 - DNA, 25 bp, Artificial sequence
  Synthetic oligonucleotide
gccatgttcgccaccggtcccaccg

SEQ ID NO: 674917 - DNA, 25 bp, Artificial sequence
  Synthetic oligonucleotide
ggaatcgccatgttcgccaccggtc

SEQ ID NO: 674918 - DNA, 25 bp, Artificial sequence
  Synthetic oligonucleotide
ggtagggaatcgccatgttcgccac

SEQ ID NO: 674919 - DNA, 25 bp, Artificial sequence
  Synthetic oligonucleotide
tcttccggtagggaatcgccatgtt

SEQ ID NO: 674920 - DNA, 25 bp, Artificial sequence
  Synthetic oligonucleotide
gattgttcttccggtagggaatcgc

SEQ ID NO: 674921 - DNA, 25 bp, Artificial sequence
  Synthetic oligonucleotide
ggcgaaggggatcagcaggcggtcg

SEQ ID NO: 674922 - DNA, 25 bp, Artificial sequence
  Synthetic oligonucleotide
ttcgatggcgccggcgtgctgtcgc

SEQ ID NO: 674923 - DNA, 25 bp, Artificial sequence
  Synthetic oligonucleotide
cgcgaggtccaggcgaaactgaagg

SEQ ID NO: 674924 - DNA, 25 bp, Artificial sequence
  Synthetic oligonucleotide
gcgaaactgaaggaaaagggcctgc

SEQ ID NO: 674925 - DNA, 25 bp, Artificial sequence
  Synthetic oligonucleotide
actgaaggaaaagggcctgccctgg

SEQ ID NO: 674926 - DNA, 25 bp, Artificial sequence
  Synthetic oligonucleotide
ggaaaagggcctgccctgggagctg

SEQ ID NO: 674927 - DNA, 25 bp, Artificial sequence
  Synthetic oligonucleotide
agggcctgccctgggagctggcaaa

SEQ ID NO: 674928 - DNA, 25 bp, Artificial sequence
  Synthetic oligonucleotide
tgccctgggagctggcaaagagctt

SEQ ID NO: 674929 - DNA, 25 bp, Artificial sequence
  Synthetic oligonucleotide
gggagctggcaaagagcttcgatgg

SEQ ID NO: 674930 - DNA, 25 bp, Artificial sequence
  Synthetic oligonucleotide
gcgccggcagcggaaacgactgtcg

SEQ ID NO: 674931 - DNA, 25 bp, Artificial sequence
  Synthetic oligonucleotide
agagcttcgatggcgccggcgtgct

SEQ ID NO: 674932 - DNA, 25 bp, Artificial sequence
  Synthetic oligonucleotide
gcgctggacctgaccttgcgcgagg

SEQ ID NO: 674933 - DNA, 25 bp, Artificial sequence
  Synthetic oligonucleotide
ggcgccggcgtgctgtcgccgttcg

SEQ ID NO: 674934 - DNA, 25 bp, Artificial sequence
  Synthetic oligonucleotide
ggcgtgctgtcgccgttcgtgaacg

SEQ ID NO: 674935 - DNA, 25 bp, Artificial sequence
  Synthetic oligonucleotide
tgtcgccgttcgtgaacgccgacca

SEQ ID NO: 674936 - DNA, 25 bp, Artificial sequence
  Synthetic oligonucleotide
tcgtgaacgccgaccagtttcccga

SEQ ID NO: 674937 - DNA, 25 bp, Artificial sequence
  Synthetic oligonucleotide
cagtttcccgacccgaccgacatcg

SEQ ID NO: 674938 - DNA, 25 bp, Artificial sequence
  Synthetic oligonucleotide
ccgacccgaccgacatcggcatccg

SEQ ID NO: 674939 - DNA, 25 bp, Artificial sequence
  Synthetic oligonucleotide
cgaccgacatcggcatccgcctgac

SEQ ID NO: 674940 - DNA, 25 bp, Artificial sequence
  Synthetic oligonucleotide
acatcggcatccgcctgaccatcaa

SEQ ID NO: 674941 - DNA, 25 bp, Artificial sequence
  Synthetic oligonucleotide
tggcaaagagcttcgatggcgccgg

SEQ ID NO: 674942 - DNA, 25 bp, Artificial sequence
  Synthetic oligonucleotide
agccgaaccgcgaggaggtcctcga

SEQ ID NO: 674943 - DNA, 25 bp, Artificial sequence
  Synthetic oligonucleotide
gcggctcggtacactacgaggcgga

SEQ ID NO: 674944 - DNA, 25 bp, Artificial sequence
  Synthetic oligonucleotide
cggtacactacgaggcggaaatcgc

SEQ ID NO: 674945 - DNA, 25 bp, Artificial sequence
  Synthetic oligonucleotide
actacgaggcggaaatcgccgtgct

SEQ ID NO: 674946 - DNA, 25 bp, Artificial sequence
  Synthetic oligonucleotide
aggcggaaatcgccgtgctgatcgg

SEQ ID NO: 674947 - DNA, 25 bp, Artificial sequence
  Synthetic oligonucleotide
aaatcgccgtgctgatcggcaagcc

SEQ ID NO: 674948 - DNA, 25 bp, Artificial sequence
  Synthetic oligonucleotide
cgtgctgatcggcaagccgctgtcg

SEQ ID NO: 674949 - DNA, 25 bp, Artificial sequence
  Synthetic oligonucleotide
gatcggcaagccgctgtcgcgcaag

SEQ ID NO: 674950 - DNA, 25 bp, Artificial sequence
  Synthetic oligonucleotide
gcaagccgctgtcgcgcaagccgaa

SEQ ID NO: 674951 - DNA, 25 bp, Artificial sequence
  Synthetic oligonucleotide
accttgcgcgaggtccaggcgaaac

SEQ ID NO: 674952 - DNA, 25 bp, Artificial sequence
  Synthetic oligonucleotide
cgcgcaagccgaaccgcgaggaggt

SEQ ID NO: 674953 - DNA, 25 bp, Artificial sequence
  Synthetic oligonucleotide
gacctgaccttgcgcgaggtccagg

SEQ ID NO: 674954 - DNA, 25 bp, Artificial sequence
  Synthetic oligonucleotide
accgcgaggaggtcctcgacgcgat

SEQ ID NO: 674955 - DNA, 25 bp, Artificial sequence
  Synthetic oligonucleotide
aggaggtcctcgacgcgatctccgg

SEQ ID NO: 674956 - DNA, 25 bp, Artificial sequence
  Synthetic oligonucleotide
gtcctcgacgcgatctccggctatg

SEQ ID NO: 674957 - DNA, 25 bp, Artificial sequence
  Synthetic oligonucleotide
gacgcgatctccggctatgcgccgg

SEQ ID NO: 674958 - DNA, 25 bp, Artificial sequence
  Synthetic oligonucleotide
gatctccggctatgcgccggcgctg

SEQ ID NO: 674959 - DNA, 25 bp, Artificial sequence
  Synthetic oligonucleotide
ggctatgcgccggcgctggacctga

SEQ ID NO: 674960 - DNA, 25 bp, Artificial sequence
  Synthetic oligonucleotide
gcgccggcgctggacctgaccttgc

SEQ ID NO: 674961 - DNA, 25 bp, Artificial sequence
  Synthetic oligonucleotide
ccatcaacggcgaggtgcgccagga

SEQ ID NO: 674962 - DNA, 25 bp, Artificial sequence
  Synthetic oligonucleotide
cgctgtcgcgcaagccgaaccgcga

SEQ ID NO: 674963 - DNA, 25 bp, Artificial sequence
  Synthetic oligonucleotide
gagacccgcgtgctctgaaccgctg

SEQ ID NO: 674964 - DNA, 25 bp, Artificial sequence
  Synthetic oligonucleotide
gcatccgcctgaccatcaacggcga

SEQ ID NO: 674965 - DNA, 25 bp, Artificial sequence
  Synthetic oligonucleotide
ccgctgaacagcggcgacgagttgc

SEQ ID NO: 674966 - DNA, 25 bp, Artificial sequence
  Synthetic oligonucleotide
aacagcggcgacgagttgctgctcg

SEQ ID NO: 674967 - DNA, 25 bp, Artificial sequence
  Synthetic oligonucleotide
gcgacgagttgctgctcgaattgcc

SEQ ID NO: 674968 - DNA, 25 bp, Artificial sequence
  Synthetic oligonucleotide
agttgctgctcgaattgccgggcgc

SEQ ID NO: 674969 - DNA, 25 bp, Artificial sequence
  Synthetic oligonucleotide
tgctcgaattgccgggcgccagccg

SEQ ID NO: 674970 - DNA, 25 bp, Artificial sequence
  Synthetic oligonucleotide
aattgccgggcgccagccgtttcga

SEQ ID NO: 674971 - DNA, 25 bp, Artificial sequence
  Synthetic oligonucleotide
cgggcgccagccgtttcgagacccg

SEQ ID NO: 674972 - DNA, 25 bp, Artificial sequence
  Synthetic oligonucleotide
gtccggggtcgggccgctgaacagc

SEQ ID NO: 674973 - DNA, 25 bp, Artificial sequence
  Synthetic oligonucleotide
cgtttcgagacccgcgtgctctgaa

SEQ ID NO: 674974 - DNA, 25 bp, Artificial sequence
  Synthetic oligonucleotide
cacgccgtccggggtcgggccgctg

SEQ ID NO: 674975 - DNA, 25 bp, Artificial sequence
  Synthetic oligonucleotide
cgcgtgctctgaaccgctgcggccg

SEQ ID NO: 674976 - DNA, 25 bp, Artificial sequence
  Synthetic oligonucleotide
ctctgaaccgctgcggccgccgggt

SEQ ID NO: 674977 - DNA, 25 bp, Artificial sequence
  Synthetic oligonucleotide
aaccgctgcggccgccgggtgcggc

SEQ ID NO: 674978 - DNA, 25 bp, Artificial sequence
  Synthetic oligonucleotide
tgcggccgccgggtgcggccggcct

SEQ ID NO: 674979 - DNA, 25 bp, Artificial sequence
  Synthetic oligonucleotide
cgccgggtgcggccggcctccctag

SEQ ID NO: 674980 - DNA, 25 bp, Artificial sequence
  Synthetic oligonucleotide
gtgcggccggcctccctagcgccgg

SEQ ID NO: 674981 - DNA, 25 bp, Artificial sequence
  Synthetic oligonucleotide
ccggcctccctagcgccggcagcgg

SEQ ID NO: 674982 - DNA, 25 bp, Artificial sequence
  Synthetic oligonucleotide
gcacctgaacatcctcaagccggaa

SEQ ID NO: 674983 - DNA, 25 bp, Artificial sequence
  Synthetic oligonucleotide
ccagccgtttcgagacccgcgtgct

SEQ ID NO: 674984 - DNA, 25 bp, Artificial sequence
  Synthetic oligonucleotide
tgatccagcacatcgccgggcattt

SEQ ID NO: 674985 - DNA, 25 bp, Artificial sequence
  Synthetic oligonucleotide
tgagcctgccgcaggagcgcggctc

SEQ ID NO: 674986 - DNA, 25 bp, Artificial sequence
  Synthetic oligonucleotide
acggcgaggtgcgccaggacggcaa

SEQ ID NO: 674987 - DNA, 25 bp, Artificial sequence
  Synthetic oligonucleotide
aggtgcgccaggacggcaacagccg

SEQ ID NO: 674988 - DNA, 25 bp, Artificial sequence
  Synthetic oligonucleotide
gccaggacggcaacagccgcgacat

SEQ ID NO: 674989 - DNA, 25 bp, Artificial sequence
  Synthetic oligonucleotide
cggcaacagccgcgacatgctcaat

SEQ ID NO: 674990 - DNA, 25 bp, Artificial sequence
  Synthetic oligonucleotide
agccgcgacatgctcaatccgatcg

SEQ ID NO: 674991 - DNA, 25 bp, Artificial sequence
  Synthetic oligonucleotide
gacatgctcaatccgatcgtgccgc

SEQ ID NO: 674992 - DNA, 25 bp, Artificial sequence
  Synthetic oligonucleotide
tcaatccgatcgtgccgctgatcca

SEQ ID NO: 674993 - DNA, 25 bp, Artificial sequence
  Synthetic oligonucleotide
ggtcgggccgctgaacagcggcgac

SEQ ID NO: 674994 - DNA, 25 bp, Artificial sequence
  Synthetic oligonucleotide
tgccgctgatccagcacatcgccgg

SEQ ID NO: 674995 - DNA, 25 bp, Artificial sequence
  Synthetic oligonucleotide
gcctgaccatcaacggcgaggtgcg

SEQ ID NO: 674996 - DNA, 25 bp, Artificial sequence
  Synthetic oligonucleotide
agcacatcgccgggcatttctcgct

SEQ ID NO: 674997 - DNA, 25 bp, Artificial sequence
  Synthetic oligonucleotide
tcgccgggcatttctcgctacaggc

SEQ ID NO: 674998 - DNA, 25 bp, Artificial sequence
  Synthetic oligonucleotide
ggcatttctcgctacaggccggcga

SEQ ID NO: 674999 - DNA, 25 bp, Artificial sequence
  Synthetic oligonucleotide
ttctcgctacaggccggcgatgtgg

SEQ ID NO: 675000 - DNA, 25 bp, Artificial sequence
  Synthetic oligonucleotide
ctacaggccggcgatgtggtgctga

SEQ ID NO: 675001 - DNA, 25 bp, Artificial sequence
  Synthetic oligonucleotide
gccggcgatgtggtgctgaccggca

SEQ ID NO: 675002 - DNA, 25 bp, Artificial sequence
  Synthetic oligonucleotide
gatgtggtgctgaccggcacgccgt

SEQ ID NO: 675003 - DNA, 25 bp, Artificial sequence
  Synthetic oligonucleotide
ggtgctgaccggcacgccgtccggg

SEQ ID NO: 675004 - DNA, 25 bp, Artificial sequence
  Synthetic oligonucleotide
cgatcgtgccgctgatccagcacat

SEQ ID NO: 675005 - DNA, 25 bp, Artificial sequence
  Synthetic oligonucleotide
ttcgaccccaacgggatcatgaatc

SEQ ID NO: 675006 - DNA, 25 bp, Artificial sequence
  Synthetic oligonucleotide
gtcgcaacgcagagggccggtcatc

SEQ ID NO: 675007 - DNA, 25 bp, Artificial sequence
  Synthetic oligonucleotide
actacttgacctacacccgctcgga

SEQ ID NO: 675008 - DNA, 25 bp, Artificial sequence
  Synthetic oligonucleotide
tgacctacacccgctcggaaaccga

SEQ ID NO: 675009 - DNA, 25 bp, Artificial sequence
  Synthetic oligonucleotide
ccgctcggaaaccgaaattgcctat

SEQ ID NO: 675010 - DNA, 25 bp, Artificial sequence
  Synthetic oligonucleotide
ggaaaccgaaattgcctatatgaag

SEQ ID NO: 675011 - DNA, 25 bp, Artificial sequence
  Synthetic oligonucleotide
cgaaattgcctatatgaaggcactg

SEQ ID NO: 675012 - DNA, 25 bp, Artificial sequence
  Synthetic oligonucleotide
tgcctatatgaaggcactgaaggcg

SEQ ID NO: 675013 - DNA, 25 bp, Artificial sequence
  Synthetic oligonucleotide
tatgaaggcactgaaggcggtgttc

SEQ ID NO: 675014 - DNA, 25 bp, Artificial sequence
  Synthetic oligonucleotide
tgaccaagcgcgactacttgaccta

SEQ ID NO: 675015 - DNA, 25 bp, Artificial sequence
  Synthetic oligonucleotide
gcggtgttcgaccccaacgggatca

SEQ ID NO: 675016 - DNA, 25 bp, Artificial sequence
  Synthetic oligonucleotide
tgggcatgaccaagcgcgactactt

SEQ ID NO: 675017 - DNA, 25 bp, Artificial sequence
  Synthetic oligonucleotide
cccaacgggatcatgaatcccggca

SEQ ID NO: 675018 - DNA, 25 bp, Artificial sequence
  Synthetic oligonucleotide
gggatcatgaatcccggcaagatct

SEQ ID NO: 675019 - DNA, 25 bp, Artificial sequence
  Synthetic oligonucleotide
atgaatcccggcaagatcttcgccg

SEQ ID NO: 675020 - DNA, 25 bp, Artificial sequence
  Synthetic oligonucleotide
cccggcaagatcttcgccgagtagc

SEQ ID NO: 675021 - DNA, 25 bp, Artificial sequence
  Synthetic oligonucleotide
aagatcttcgccgagtagcaggtgt

SEQ ID NO: 675022 - DNA, 25 bp, Artificial sequence
  Synthetic oligonucleotide
ttcgccgagtagcaggtgtcgcaac

SEQ ID NO: 675023 - DNA, 25 bp, Artificial sequence
  Synthetic oligonucleotide
cgagtagcaggtgtcgcaacgcaga

SEQ ID NO: 675024 - DNA, 25 bp, Artificial sequence
  Synthetic oligonucleotide
aggagcgcggctcggtacactacga

SEQ ID NO: 675025 - DNA, 25 bp, Artificial sequence
  Synthetic oligonucleotide
ggcactgaaggcggtgttcgacccc

SEQ ID NO: 675026 - DNA, 25 bp, Artificial sequence
  Synthetic oligonucleotide
tgggtgttcgagaccgtcgagaagt

SEQ ID NO: 675027 - DNA, 25 bp, Artificial sequence
  Synthetic oligonucleotide
tgaacatcctcaagccggaaaacct

SEQ ID NO: 675028 - DNA, 25 bp, Artificial sequence
  Synthetic oligonucleotide
tcctcaagccggaaaacctcggcaa

SEQ ID NO: 675029 - DNA, 25 bp, Artificial sequence
  Synthetic oligonucleotide
aacctcggcaaggacgagttcttcg

SEQ ID NO: 675030 - DNA, 25 bp, Artificial sequence
  Synthetic oligonucleotide
ggcaaggacgagttcttcgccaagt

SEQ ID NO: 675031 - DNA, 25 bp, Artificial sequence
  Synthetic oligonucleotide
gacgagttcttcgccaagtgcgcga

SEQ ID NO: 675032 - DNA, 25 bp, Artificial sequence
  Synthetic oligonucleotide
ttcttcgccaagtgcgcgaccgtca

SEQ ID NO: 675033 - DNA, 25 bp, Artificial sequence
  Synthetic oligonucleotide
gccaagtgcgcgaccgtcaacaagt

SEQ ID NO: 675034 - DNA, 25 bp, Artificial sequence
  Synthetic oligonucleotide
tgcgcgaccgtcaacaagtgggtgt

SEQ ID NO: 675035 - DNA, 25 bp, Artificial sequence
  Synthetic oligonucleotide
agcgcgactacttgacctacacccg

SEQ ID NO: 675036 - DNA, 25 bp, Artificial sequence
  Synthetic oligonucleotide
aacaagtgggtgttcgagaccgtcg

SEQ ID NO: 675037 - DNA, 25 bp, Artificial sequence
  Synthetic oligonucleotide
acgcagagggccggtcatccggccc

SEQ ID NO: 675038 - DNA, 25 bp, Artificial sequence
  Synthetic oligonucleotide
ttcgagaccgtcgagaagtacaacg

SEQ ID NO: 675039 - DNA, 25 bp, Artificial sequence
  Synthetic oligonucleotide
accgtcgagaagtacaacggctcga

SEQ ID NO: 675040 - DNA, 25 bp, Artificial sequence
  Synthetic oligonucleotide
gagaagtacaacggctcgatttccg

SEQ ID NO: 675041 - DNA, 25 bp, Artificial sequence
  Synthetic oligonucleotide
tacaacggctcgatttccgccgagc

SEQ ID NO: 675042 - DNA, 25 bp, Artificial sequence
  Synthetic oligonucleotide
gctcgatttccgccgagcatggcgt

SEQ ID NO: 675043 - DNA, 25 bp, Artificial sequence
  Synthetic oligonucleotide
tttccgccgagcatggcgtgggcat

SEQ ID NO: 675044 - DNA, 25 bp, Artificial sequence
  Synthetic oligonucleotide
ccgagcatggcgtgggcatgaccaa

SEQ ID NO: 675045 - DNA, 25 bp, Artificial sequence
  Synthetic oligonucleotide
atggcgtgggcatgaccaagcgcga

SEQ ID NO: 675046 - DNA, 25 bp, Artificial sequence
  Synthetic oligonucleotide
accgtcaacaagtgggtgttcgaga

SEQ ID NO: 675047 - DNA, 25 bp, Artificial sequence
  Synthetic oligonucleotide
tgctgttcatcaagcccggctcctg

SEQ ID NO: 675048 - DNA, 25 bp, Artificial sequence
  Synthetic oligonucleotide
gcaggtgtcgcaacgcagagggccg

SEQ ID NO: 675049 - DNA, 25 bp, Artificial sequence
  Synthetic oligonucleotide
ctgcgtcgggcgcaactacgccgaa

SEQ ID NO: 675050 - DNA, 25 bp, Artificial sequence
  Synthetic oligonucleotide
cgggcgcaactacgccgaacacgcc

SEQ ID NO: 675051 - DNA, 25 bp, Artificial sequence
  Synthetic oligonucleotide
caactacgccgaacacgccaaggaa

SEQ ID NO: 675052 - DNA, 25 bp, Artificial sequence
  Synthetic oligonucleotide
cgccgaacacgccaaggaactgaac

SEQ ID NO: 675053 - DNA, 25 bp, Artificial sequence
  Synthetic oligonucleotide
acacgccaaggaactgaacaacccg

SEQ ID NO: 675054 - DNA, 25 bp, Artificial sequence
  Synthetic oligonucleotide
caacccggttcccaccgagccgctg

SEQ ID NO: 675055 - DNA, 25 bp, Artificial sequence
  Synthetic oligonucleotide
ggttcccaccgagccgctgctgttc

SEQ ID NO: 675056 - DNA, 25 bp, Artificial sequence
  Synthetic oligonucleotide
tgggcaagctggtctgcgtcgggcg

SEQ ID NO: 675057 - DNA, 25 bp, Artificial sequence
  Synthetic oligonucleotide
agccgctgctgttcatcaagcccgg

SEQ ID NO: 675058 - DNA, 25 bp, Artificial sequence
  Synthetic oligonucleotide
tccccctgggcaagctggtctgcgt

SEQ ID NO: 675059 - DNA, 25 bp, Artificial sequence
  Synthetic oligonucleotide
catcaagcccggctcctgcgtggtg

SEQ ID NO: 675060 - DNA, 25 bp, Artificial sequence
  Synthetic oligonucleotide
gcccggctcctgcgtggtgccggtg

SEQ ID NO: 675061 - DNA, 25 bp, Artificial sequence
  Synthetic oligonucleotide
ctcctgcgtggtgccggtgagcggc

SEQ ID NO: 675062 - DNA, 25 bp, Artificial sequence
  Synthetic oligonucleotide
cgtggtgccggtgagcggcgggctg

SEQ ID NO: 675063 - DNA, 25 bp, Artificial sequence
  Synthetic oligonucleotide
tgccggtgagcggcgggctgagcct

SEQ ID NO: 675064 - DNA, 25 bp, Artificial sequence
  Synthetic oligonucleotide
tgagcggcgggctgagcctgccgca

SEQ ID NO: 675065 - DNA, 25 bp, Artificial sequence
  Synthetic oligonucleotide
gcgggctgagcctgccgcaggagcg

SEQ ID NO: 675066 - DNA, 25 bp, Artificial sequence
  Synthetic oligonucleotide
gcagcggaaacgactgtcggtcggc

SEQ ID NO: 675067 - DNA, 25 bp, Artificial sequence
  Synthetic oligonucleotide
caccgagccgctgctgttcatcaag

SEQ ID NO: 675068 - DNA, 25 bp, Artificial sequence
  Synthetic oligonucleotide
gagtcggtaaatgagttaccagcat

SEQ ID NO: 675069 - DNA, 25 bp, Artificial sequence
  Synthetic oligonucleotide
agggccggtcatccggcccttctcg

SEQ ID NO: 675070 - DNA, 25 bp, Artificial sequence
  Synthetic oligonucleotide
ggtcatccggcccttctcgtctgtg

SEQ ID NO: 675071 - DNA, 25 bp, Artificial sequence
  Synthetic oligonucleotide
ccggcccttctcgtctgtggcgggc

SEQ ID NO: 675072 - DNA, 25 bp, Artificial sequence
  Synthetic oligonucleotide
cttctcgtctgtggcgggcgccacg

SEQ ID NO: 675073 - DNA, 25 bp, Artificial sequence
  Synthetic oligonucleotide
tctgtggcgggcgccacggatgcct

SEQ ID NO: 675074 - DNA, 25 bp, Artificial sequence
  Synthetic oligonucleotide
gcgggcgccacggatgcctttccac

SEQ ID NO: 675075 - DNA, 25 bp, Artificial sequence
  Synthetic oligonucleotide
gccacggatgcctttccacccgttc

SEQ ID NO: 675076 - DNA, 25 bp, Artificial sequence
  Synthetic oligonucleotide
atgcctttccacccgttcaggagtc

SEQ ID NO: 675077 - DNA, 25 bp, Artificial sequence
  Synthetic oligonucleotide
agctggtctgcgtcgggcgcaacta

SEQ ID NO: 675078 - DNA, 25 bp, Artificial sequence
  Synthetic oligonucleotide
gttcaggagtcggtaaatgagttac

SEQ ID NO: 675079 - DNA, 25 bp, Artificial sequence
  Synthetic oligonucleotide
tgccgcaggagcgcggctcggtaca

SEQ ID NO: 675080 - DNA, 25 bp, Artificial sequence
  Synthetic oligonucleotide
gtaaatgagttaccagcatcaatat

SEQ ID NO: 675081 - DNA, 25 bp, Artificial sequence
  Synthetic oligonucleotide
gagttaccagcatcaatatatcgac

SEQ ID NO: 675082 - DNA, 25 bp, Artificial sequence
  Synthetic oligonucleotide
ccagcatcaatatatcgacggcacc

SEQ ID NO: 675083 - DNA, 25 bp, Artificial sequence
  Synthetic oligonucleotide
tcaatatatcgacggcaccccgatc

SEQ ID NO: 675084 - DNA, 25 bp, Artificial sequence
  Synthetic oligonucleotide
atatcgacggcaccccgatccactt

SEQ ID NO: 675085 - DNA, 25 bp, Artificial sequence
  Synthetic oligonucleotide
cggcaccccgatccacttccccctg

SEQ ID NO: 675086 - DNA, 25 bp, Artificial sequence
  Synthetic oligonucleotide
cccgatccacttccccctgggcaag

SEQ ID NO: 675087 - DNA, 25 bp, Artificial sequence
  Synthetic oligonucleotide
ccacttccccctgggcaagctggtc

SEQ ID NO: 675088 - DNA, 25 bp, Artificial sequence
  Synthetic oligonucleotide
ccacccgttcaggagtcggtaaatg

SEQ ID NO: 675089 - DNA, 25 bp, Artificial sequence
  Synthetic oligonucleotide
gcggggcgatgaccgcgctaccgag

SEQ ID NO: 675090 - DNA, 25 bp, Artificial sequence
  Synthetic oligonucleotide
agcgcgatccgatgaccctgttcag

SEQ ID NO: 675091 - DNA, 25 bp, Artificial sequence
  Synthetic oligonucleotide
atccgatgaccctgttcagctggaa

SEQ ID NO: 675092 - DNA, 25 bp, Artificial sequence
  Synthetic oligonucleotide
tgaccctgttcagctggaagagcga

SEQ ID NO: 675093 - DNA, 25 bp, Artificial sequence
  Synthetic oligonucleotide
tgttcagctggaagagcgacggcgg

SEQ ID NO: 675094 - DNA, 25 bp, Artificial sequence
  Synthetic oligonucleotide
gctggaagagcgacggcgggccgag

SEQ ID NO: 675095 - DNA, 25 bp, Artificial sequence
  Synthetic oligonucleotide
agagcgacggcgggccgagcctgag

SEQ ID NO: 675096 - DNA, 25 bp, Artificial sequence
  Synthetic oligonucleotide
acggcgggccgagcctgagcggggc

SEQ ID NO: 675097 - DNA, 25 bp, Artificial sequence
  Synthetic oligonucleotide
tccctagcgccggcagcggaaacga

SEQ ID NO: 675098 - DNA, 25 bp, Artificial sequence
  Synthetic oligonucleotide
cctgagcggggcgatgaccgcgcta

SEQ ID NO: 675099 - DNA, 25 bp, Artificial sequence
  Synthetic oligonucleotide
gtctgttgctgagcaaggagcgcga

SEQ ID NO: 675100 - DNA, 25 bp, Artificial sequence
  Synthetic oligonucleotide
cgatgaccgcgctaccgagcgacga

SEQ ID NO: 675101 - DNA, 25 bp, Artificial sequence
  Synthetic oligonucleotide
ccgcgctaccgagcgacgacctgta

SEQ ID NO: 675102 - DNA, 25 bp, Artificial sequence
  Synthetic oligonucleotide
taccgagcgacgacctgtacatgcg

SEQ ID NO: 675103 - DNA, 25 bp, Artificial sequence
  Synthetic oligonucleotide
gcgacgacctgtacatgcgcaacgt

SEQ ID NO: 675104 - DNA, 25 bp, Artificial sequence
  Synthetic oligonucleotide
gacctgtacatgcgcaacgtctcgg

SEQ ID NO: 675105 - DNA, 25 bp, Artificial sequence
  Synthetic oligonucleotide
tacatgcgcaacgtctcggccctca

SEQ ID NO: 675106 - DNA, 25 bp, Artificial sequence
  Synthetic oligonucleotide
cgcaacgtctcggccctcagcgtcg

SEQ ID NO: 675107 - DNA, 25 bp, Artificial sequence
  Synthetic oligonucleotide
cgtctcggccctcagcgtcgacccg

SEQ ID NO: 675108 - DNA, 25 bp, Artificial sequence
  Synthetic oligonucleotide
ggccgagcctgagcggggcgatgac

SEQ ID NO: 675109 - DNA, 25 bp, Artificial sequence
  Synthetic oligonucleotide
caagaagaacaagggcttcgagggc

SEQ ID NO: 675110 - DNA, 25 bp, Artificial sequence
  Synthetic oligonucleotide
acccgcagaccgccgagctgagcac

SEQ ID NO: 675111 - DNA, 25 bp, Artificial sequence
  Synthetic oligonucleotide
agaccgccgagctgagcaccaagag

SEQ ID NO: 675112 - DNA, 25 bp, Artificial sequence
  Synthetic oligonucleotide
ccgagctgagcaccaagagcctggc

SEQ ID NO: 675113 - DNA, 25 bp, Artificial sequence
  Synthetic oligonucleotide
tgagcaccaagagcctggccgaatt

SEQ ID NO: 675114 - DNA, 25 bp, Artificial sequence
  Synthetic oligonucleotide
caagagcctggccgaattcccgctg

SEQ ID NO: 675115 - DNA, 25 bp, Artificial sequence
  Synthetic oligonucleotide
cctggccgaattcccgctgggcaat

SEQ ID NO: 675116 - DNA, 25 bp, Artificial sequence
  Synthetic oligonucleotide
cgaattcccgctgggcaatattggc

SEQ ID NO: 675117 - DNA, 25 bp, Artificial sequence
  Synthetic oligonucleotide
cccgctgggcaatattggcaagaag

SEQ ID NO: 675118 - DNA, 25 bp, Artificial sequence
  Synthetic oligonucleotide
gcaaggagcgcgatccgatgaccct

SEQ ID NO: 675119 - DNA, 25 bp, Artificial sequence
  Synthetic oligonucleotide
tattggcaagaagaacaagggcttc

SEQ ID NO: 675120 - DNA, 25 bp, Artificial sequence
  Synthetic oligonucleotide
tgctgagcaaggagcgcgatccgat

SEQ ID NO: 675121 - DNA, 25 bp, Artificial sequence
  Synthetic oligonucleotide
aacaagggcttcgagggcatcgcct

SEQ ID NO: 675122 - DNA, 25 bp, Artificial sequence
  Synthetic oligonucleotide
ggcttcgagggcatcgcctgggatc

SEQ ID NO: 675123 - DNA, 25 bp, Artificial sequence
  Synthetic oligonucleotide
gagggcatcgcctgggatccgcgcc

SEQ ID NO: 675124 - DNA, 25 bp, Artificial sequence
  Synthetic oligonucleotide
atcgcctgggatccgcgccagcagc

SEQ ID NO: 675125 - DNA, 25 bp, Artificial sequence
  Synthetic oligonucleotide
gggatccgcgccagcagcgtctgtt

SEQ ID NO: 675126 - DNA, 25 bp, Artificial sequence
  Synthetic oligonucleotide
gcgccagcagcgtctgttgctgagc

SEQ ID NO: 675127 - DNA, 25 bp, Artificial sequence
  Synthetic oligonucleotide
agcagcgtctgttgctgagcaagga

SEQ ID NO: 675128 - DNA, 25 bp, Artificial sequence
  Synthetic oligonucleotide
cgacccgcgtaccggccataccctg

SEQ ID NO: 675129 - DNA, 25 bp, Artificial sequence
  Synthetic oligonucleotide
gggcaatattggcaagaagaacaag

SEQ ID NO: 675130 - DNA, 25 bp, Artificial sequence
  Synthetic oligonucleotide
aacctgttctacgtgttccgcaaga

SEQ ID NO: 675131 - DNA, 25 bp, Artificial sequence
  Synthetic oligonucleotide
ggccctcagcgtcgacccgcgtacc

SEQ ID NO: 675132 - DNA, 25 bp, Artificial sequence
  Synthetic oligonucleotide
gcgccgaaggggtggccatcgacga

SEQ ID NO: 675133 - DNA, 25 bp, Artificial sequence
  Synthetic oligonucleotide
aggggtggccatcgacgacgagggc

SEQ ID NO: 675134 - DNA, 25 bp, Artificial sequence
  Synthetic oligonucleotide
ggccatcgacgacgagggcaccatc

SEQ ID NO: 675135 - DNA, 25 bp, Artificial sequence
  Synthetic oligonucleotide
gacgacgagggcaccatctacatgg

SEQ ID NO: 675136 - DNA, 25 bp, Artificial sequence
  Synthetic oligonucleotide
gagggcaccatctacatggtcagcg

SEQ ID NO: 675137 - DNA, 25 bp, Artificial sequence
  Synthetic oligonucleotide
accatctacatggtcagcgagccga

SEQ ID NO: 675138 - DNA, 25 bp, Artificial sequence
  Synthetic oligonucleotide
tacatggtcagcgagccgaacctgt

SEQ ID NO: 675139 - DNA, 25 bp, Artificial sequence
  Synthetic oligonucleotide
gcaagatcccgcgcgccgaaggggt

SEQ ID NO: 675140 - DNA, 25 bp, Artificial sequence
  Synthetic oligonucleotide
gagccgaacctgttctacgtgttcc

SEQ ID NO: 675141 - DNA, 25 bp, Artificial sequence
  Synthetic oligonucleotide
tggacagcaagatcccgcgcgccga

SEQ ID NO: 675142 - DNA, 25 bp, Artificial sequence
  Synthetic oligonucleotide
ttctacgtgttccgcaagaagagcg

SEQ ID NO: 675143 - DNA, 25 bp, Artificial sequence
  Synthetic oligonucleotide
gtgttccgcaagaagagcggcgagc

SEQ ID NO: 675144 - DNA, 25 bp, Artificial sequence
  Synthetic oligonucleotide
cgcaagaagagcggcgagcgcctgg

SEQ ID NO: 675145 - DNA, 25 bp, Artificial sequence
  Synthetic oligonucleotide
aagagcggcgagcgcctggccacca

SEQ ID NO: 675146 - DNA, 25 bp, Artificial sequence
  Synthetic oligonucleotide
cggcgagcgcctggccaccagcgac

SEQ ID NO: 675147 - DNA, 25 bp, Artificial sequence
  Synthetic oligonucleotide
cgcctggccaccagcgacgccgatt

SEQ ID NO: 675148 - DNA, 25 bp, Artificial sequence
  Synthetic oligonucleotide
tccagctcgaccactgtgccgcgcg

SEQ ID NO: 675149 - DNA, 25 bp, Artificial sequence
  Synthetic oligonucleotide
aggtggtccagctcgaccactgtgc

SEQ ID NO: 675150 - DNA, 25 bp, Artificial sequence
  Synthetic oligonucleotide
gtcagcgagccgaacctgttctacg

SEQ ID NO: 675151 - DNA, 25 bp, Artificial sequence
  Synthetic oligonucleotide
gacgagaagggcgagccggtcagct

SEQ ID NO: 675152 - DNA, 25 bp, Artificial sequence
  Synthetic oligonucleotide
gccgcaataccctgaccatcttcca

SEQ ID NO: 675153 - DNA, 25 bp, Artificial sequence
  Synthetic oligonucleotide
gcgtaccggccataccctggtgctg

SEQ ID NO: 675154 - DNA, 25 bp, Artificial sequence
  Synthetic oligonucleotide
cggccataccctggtgctgtcggcc

SEQ ID NO: 675155 - DNA, 25 bp, Artificial sequence
  Synthetic oligonucleotide
taccctggtgctgtcggccgaatcg

SEQ ID NO: 675156 - DNA, 25 bp, Artificial sequence
  Synthetic oligonucleotide
gtgctgtcggccgaatcgcatctgc

SEQ ID NO: 675157 - DNA, 25 bp, Artificial sequence
  Synthetic oligonucleotide
tcggccgaatcgcatctgctgctgg

SEQ ID NO: 675158 - DNA, 25 bp, Artificial sequence
  Synthetic oligonucleotide
cgaatcgcatctgctgctggagctg

SEQ ID NO: 675159 - DNA, 25 bp, Artificial sequence
  Synthetic oligonucleotide
catctgctgctggagctggacgaga

SEQ ID NO: 675160 - DNA, 25 bp, Artificial sequence
  Synthetic oligonucleotide
tcccgcgcgccgaaggggtggccat

SEQ ID NO: 675161 - DNA, 25 bp, Artificial sequence
  Synthetic oligonucleotide
gagctggacgagaagggcgagccgg

SEQ ID NO: 675162 - DNA, 25 bp, Artificial sequence
  Synthetic oligonucleotide
agcgtcgacccgcgtaccggccata

SEQ ID NO: 675163 - DNA, 25 bp, Artificial sequence
  Synthetic oligonucleotide
aagggcgagccggtcagcttcatca

SEQ ID NO: 675164 - DNA, 25 bp, Artificial sequence
  Synthetic oligonucleotide
gagccggtcagcttcatcagcctgc

SEQ ID NO: 675165 - DNA, 25 bp, Artificial sequence
  Synthetic oligonucleotide
gtcagcttcatcagcctgctcggcg

SEQ ID NO: 675166 - DNA, 25 bp, Artificial sequence
  Synthetic oligonucleotide
ttcatcagcctgctcggcggcttca

SEQ ID NO: 675167 - DNA, 25 bp, Artificial sequence
  Synthetic oligonucleotide
agcctgctcggcggcttcaacggcc

SEQ ID NO: 675168 - DNA, 25 bp, Artificial sequence
  Synthetic oligonucleotide
ctcggcggcttcaacggcctggaca

SEQ ID NO: 675169 - DNA, 25 bp, Artificial sequence
  Synthetic oligonucleotide
ggcttcaacggcctggacagcaaga

SEQ ID NO: 675170 - DNA, 25 bp, Artificial sequence
  Synthetic oligonucleotide
aacggcctggacagcaagatcccgc

SEQ ID NO: 675171 - DNA, 25 bp, Artificial sequence
  Synthetic oligonucleotide
ctgctggagctggacgagaagggcg

SEQ ID NO: 675172 - DNA, 25 bp, Artificial sequence
  Synthetic oligonucleotide
tgcattgggacgatcgcgccggcct

SEQ ID NO: 675173 - DNA, 25 bp, Artificial sequence
  Synthetic oligonucleotide
agcagcgcgacgaaagcatctggct

SEQ ID NO: 675174 - DNA, 25 bp, Artificial sequence
  Synthetic oligonucleotide
gctggctgctgccggcgttcgtcgt

SEQ ID NO: 675175 - DNA, 25 bp, Artificial sequence
  Synthetic oligonucleotide
tgctgccggcgttcgtcgtgctcgt

SEQ ID NO: 675176 - DNA, 25 bp, Artificial sequence
  Synthetic oligonucleotide
cggcgttcgtcgtgctcgtcggcgt

SEQ ID NO: 675177 - DNA, 25 bp, Artificial sequence
  Synthetic oligonucleotide
tcgtcgtgctcgtcggcgtggtgct

SEQ ID NO: 675178 - DNA, 25 bp, Artificial sequence
  Synthetic oligonucleotide
tgctcgtcggcgtggtgctgaccat

SEQ ID NO: 675179 - DNA, 25 bp, Artificial sequence
  Synthetic oligonucleotide
tcggcgtggtgctgaccatcgtcat

SEQ ID NO: 675180 - DNA, 25 bp, Artificial sequence
  Synthetic oligonucleotide
tggtgctgaccatcgtcatgcattg

SEQ ID NO: 675181 - DNA, 25 bp, Artificial sequence
  Synthetic oligonucleotide
tccccgtttccgctggctgctgccg

SEQ ID NO: 675182 - DNA, 25 bp, Artificial sequence
  Synthetic oligonucleotide
tcgtcatgcattgggacgatcgcgc

SEQ ID NO: 675183 - DNA, 25 bp, Artificial sequence
  Synthetic oligonucleotide
caagcttccccgtttccgctggctg

SEQ ID NO: 675184 - DNA, 25 bp, Artificial sequence
  Synthetic oligonucleotide
gggacgatcgcgccggcctttggtg

SEQ ID NO: 675185 - DNA, 25 bp, Artificial sequence
  Synthetic oligonucleotide
atcgcgccggcctttggtggaagga

SEQ ID NO: 675186 - DNA, 25 bp, Artificial sequence
  Synthetic oligonucleotide
cggcctttggtggaaggaaagccag

SEQ ID NO: 675187 - DNA, 25 bp, Artificial sequence
  Synthetic oligonucleotide
ttggtggaaggaaagccaggccagc

SEQ ID NO: 675188 - DNA, 25 bp, Artificial sequence
  Synthetic oligonucleotide
gaaggaaagccaggccagccagcag

SEQ ID NO: 675189 - DNA, 25 bp, Artificial sequence
  Synthetic oligonucleotide
aaagccaggccagccagcagcagcg

SEQ ID NO: 675190 - DNA, 25 bp, Artificial sequence
  Synthetic oligonucleotide
aggccagccagcagcagcgcgacga

SEQ ID NO: 675191 - DNA, 25 bp, Artificial sequence
  Synthetic oligonucleotide
atgtcgacccgcagaccgccgagct

SEQ ID NO: 675192 - DNA, 25 bp, Artificial sequence
  Synthetic oligonucleotide
tgaccatcgtcatgcattgggacga

SEQ ID NO: 675193 - DNA, 25 bp, Artificial sequence
  Synthetic oligonucleotide
tggcgacgcccaagaaaacacctgg

SEQ ID NO: 675194 - DNA, 25 bp, Artificial sequence
  Synthetic oligonucleotide
aaacgactgtcggtcggctggccga

SEQ ID NO: 675195 - DNA, 25 bp, Artificial sequence
  Synthetic oligonucleotide
ctgtcggtcggctggccgacgcttc

SEQ ID NO: 675196 - DNA, 25 bp, Artificial sequence
  Synthetic oligonucleotide
gtcggctggccgacgcttcgattga

SEQ ID NO: 675197 - DNA, 25 bp, Artificial sequence
  Synthetic oligonucleotide
tggccgacgcttcgattgacaggcc

SEQ ID NO: 675198 - DNA, 25 bp, Artificial sequence
  Synthetic oligonucleotide
acgcttcgattgacaggccgggggc

SEQ ID NO: 675199 - DNA, 25 bp, Artificial sequence
  Synthetic oligonucleotide
cgattgacaggccgggggcaatgcc

SEQ ID NO: 675200 - DNA, 25 bp, Artificial sequence
  Synthetic oligonucleotide
acaggccgggggcaatgccctttca

SEQ ID NO: 675201 - DNA, 25 bp, Artificial sequence
  Synthetic oligonucleotide
gggggcaatgccctttcatggcgac

SEQ ID NO: 675202 - DNA, 25 bp, Artificial sequence
  Synthetic oligonucleotide
gtttccgctggctgctgccggcgtt

SEQ ID NO: 675203 - DNA, 25 bp, Artificial sequence
  Synthetic oligonucleotide
ctttcatggcgacgcccaagaaaac

SEQ ID NO: 675204 - DNA, 25 bp, Artificial sequence
  Synthetic oligonucleotide
cgcgacgaaagcatctggctgccgg

SEQ ID NO: 675205 - DNA, 25 bp, Artificial sequence
  Synthetic oligonucleotide
gcccaagaaaacacctggccaaaca

SEQ ID NO: 675206 - DNA, 25 bp, Artificial sequence
  Synthetic oligonucleotide
gaaaacacctggccaaacagtcgag

SEQ ID NO: 675207 - DNA, 25 bp, Artificial sequence
  Synthetic oligonucleotide
acctggccaaacagtcgagcctcgc

SEQ ID NO: 675208 - DNA, 25 bp, Artificial sequence
  Synthetic oligonucleotide
ccaaacagtcgagcctcgcccatgt

SEQ ID NO: 675209 - DNA, 25 bp, Artificial sequence
  Synthetic oligonucleotide
agtcgagcctcgcccatgtcccttg

SEQ ID NO: 675210 - DNA, 25 bp, Artificial sequence
  Synthetic oligonucleotide
gcctcgcccatgtcccttgcctcca

SEQ ID NO: 675211 - DNA, 25 bp, Artificial sequence
  Synthetic oligonucleotide
cccatgtcccttgcctccaagcttc

SEQ ID NO: 675212 - DNA, 25 bp, Artificial sequence
  Synthetic oligonucleotide
tgcctccaagcttccccgtttccgc

SEQ ID NO: 675213 - DNA, 25 bp, Artificial sequence
  Synthetic oligonucleotide
aatgccctttcatggcgacgcccaa

SEQ ID NO: 675214 - DNA, 25 bp, Artificial sequence
  Synthetic oligonucleotide
gaaggcgtggcggtgctggagaacg

SEQ ID NO: 675215 - DNA, 25 bp, Artificial sequence
  Synthetic oligonucleotide
gccagcagcagcgcgacgaaagcat

SEQ ID NO: 675216 - DNA, 25 bp, Artificial sequence
  Synthetic oligonucleotide
tgtcgctcaccggcgacgtgctgcg

SEQ ID NO: 675217 - DNA, 25 bp, Artificial sequence
  Synthetic oligonucleotide
tcaccggcgacgtgctgcgcaccat

SEQ ID NO: 675218 - DNA, 25 bp, Artificial sequence
  Synthetic oligonucleotide
cgacgtgctgcgcaccatcccgctg

SEQ ID NO: 675219 - DNA, 25 bp, Artificial sequence
  Synthetic oligonucleotide
gctgcgcaccatcccgctgctcggc

SEQ ID NO: 675220 - DNA, 25 bp, Artificial sequence
  Synthetic oligonucleotide
caccatcccgctgctcggcctgagc

SEQ ID NO: 675221 - DNA, 25 bp, Artificial sequence
  Synthetic oligonucleotide
ccgctgctcggcctgagcaatcccg

SEQ ID NO: 675222 - DNA, 25 bp, Artificial sequence
  Synthetic oligonucleotide
ctcggcctgagcaatcccgaaggcg

SEQ ID NO: 675223 - DNA, 25 bp, Artificial sequence
  Synthetic oligonucleotide
gctggtggagctgtcgctcaccggc

SEQ ID NO: 675224 - DNA, 25 bp, Artificial sequence
  Synthetic oligonucleotide
aatcccgaaggcgtggcggtgctgg

SEQ ID NO: 675225 - DNA, 25 bp, Artificial sequence
  Synthetic oligonucleotide
ggccgctgctggtggagctgtcgct

SEQ ID NO: 675226 - DNA, 25 bp, Artificial sequence
  Synthetic oligonucleotide
gtggcggtgctggagaacggcaacg

SEQ ID NO: 675227 - DNA, 25 bp, Artificial sequence
  Synthetic oligonucleotide
gtgctggagaacggcaacgtcgcgg

SEQ ID NO: 675228 - DNA, 25 bp, Artificial sequence
  Synthetic oligonucleotide
agaacggcaacgtcgcggtgaccga

SEQ ID NO: 675229 - DNA, 25 bp, Artificial sequence
  Synthetic oligonucleotide
gcaacgtcgcggtgaccgacgagcg

SEQ ID NO: 675230 - DNA, 25 bp, Artificial sequence
  Synthetic oligonucleotide
tcgcggtgaccgacgagcgccgcaa

SEQ ID NO: 675231 - DNA, 25 bp, Artificial sequence
  Synthetic oligonucleotide
tgaccgacgagcgccgcaataccct

SEQ ID NO: 675232 - DNA, 25 bp, Artificial sequence
  Synthetic oligonucleotide
acgagcgccgcaataccctgaccat

SEQ ID NO: 675233 - DNA, 25 bp, Artificial sequence
  Synthetic oligonucleotide
ataccctgaccatcttccatgtcga

SEQ ID NO: 675234 - DNA, 25 bp, Artificial sequence
  Synthetic oligonucleotide
ctgagcaatcccgaaggcgtggcgg

SEQ ID NO: 675235 - DNA, 25 bp, Artificial sequence
  Synthetic oligonucleotide
gaagaaacctcggacctggcctaca

SEQ ID NO: 675236 - DNA, 25 bp, Artificial sequence
  Synthetic oligonucleotide
gaaagcatctggctgccgggctatc

SEQ ID NO: 675237 - DNA, 25 bp, Artificial sequence
  Synthetic oligonucleotide
atctggctgccgggctatcgggtgg

SEQ ID NO: 675238 - DNA, 25 bp, Artificial sequence
  Synthetic oligonucleotide
gctgccgggctatcgggtggtgatc

SEQ ID NO: 675239 - DNA, 25 bp, Artificial sequence
  Synthetic oligonucleotide
gggctatcgggtggtgatcgacgcc

SEQ ID NO: 675240 - DNA, 25 bp, Artificial sequence
  Synthetic oligonucleotide
atcgggtggtgatcgacgccaagcc

SEQ ID NO: 675241 - DNA, 25 bp, Artificial sequence
  Synthetic oligonucleotide
tggtgatcgacgccaagccgttgca

SEQ ID NO: 675242 - DNA, 25 bp, Artificial sequence
  Synthetic oligonucleotide
tcgacgccaagccgttgcagggcct

SEQ ID NO: 675243 - DNA, 25 bp, Artificial sequence
  Synthetic oligonucleotide
ccaagccgttgcagggcctggagga

SEQ ID NO: 675244 - DNA, 25 bp, Artificial sequence
  Synthetic oligonucleotide
tggagctgtcgctcaccggcgacgt

SEQ ID NO: 675245 - DNA, 25 bp, Artificial sequence
  Synthetic oligonucleotide
cagggcctggaggaggaagaaacct

SEQ ID NO: 675246 - DNA, 25 bp, Artificial sequence
  Synthetic oligonucleotide
tgaccatcttccatgtcgacccgca

SEQ ID NO: 675247 - DNA, 25 bp, Artificial sequence
  Synthetic oligonucleotide
ctcggacctggcctacaacccggca

SEQ ID NO: 675248 - DNA, 25 bp, Artificial sequence
  Synthetic oligonucleotide
cctggcctacaacccggcaaccagg

SEQ ID NO: 675249 - DNA, 25 bp, Artificial sequence
  Synthetic oligonucleotide
ctacaacccggcaaccaggaccctg

SEQ ID NO: 675250 - DNA, 25 bp, Artificial sequence
  Synthetic oligonucleotide
ccggcaaccaggaccctgttcaccg

SEQ ID NO: 675251 - DNA, 25 bp, Artificial sequence
  Synthetic oligonucleotide
ccctgttcaccgttaccggcaagcg

SEQ ID NO: 675252 - DNA, 25 bp, Artificial sequence
  Synthetic oligonucleotide
tcaccgttaccggcaagcggccgct

SEQ ID NO: 675253 - DNA, 25 bp, Artificial sequence
  Synthetic oligonucleotide
ttaccggcaagcggccgctgctggt

SEQ ID NO: 675254 - DNA, 25 bp, Artificial sequence
  Synthetic oligonucleotide
gcaagcggccgctgctggtggagct

SEQ ID NO: 675255 - DNA, 25 bp, Artificial sequence
  Synthetic oligonucleotide
cgttgcagggcctggaggaggaaga

SEQ ID NO: 675256 - DNA, 25 bp, Artificial sequence
  Synthetic oligonucleotide
aggaacttgatcttgctcttgtcga

SEQ ID NO: 675257 - DNA, 25 bp, Artificial sequence
  Synthetic oligonucleotide
tagccggcggccttcagcgtgtcca

SEQ ID NO: 675258 - DNA, 25 bp, Artificial sequence
  Synthetic oligonucleotide
cggccttcagcgtgtccacggcgtt

SEQ ID NO: 675259 - DNA, 25 bp, Artificial sequence
  Synthetic oligonucleotide
tcagcgtgtccacggcgttctggtg

SEQ ID NO: 675260 - DNA, 25 bp, Artificial sequence
  Synthetic oligonucleotide
tgtccacggcgttctggtggacacc

SEQ ID NO: 675261 - DNA, 25 bp, Artificial sequence
  Synthetic oligonucleotide
cggcgttctggtggacaccttcgag

SEQ ID NO: 675262 - DNA, 25 bp, Artificial sequence
  Synthetic oligonucleotide
tctggtggacaccttcgagaagaag

SEQ ID NO: 675263 - DNA, 25 bp, Artificial sequence
  Synthetic oligonucleotide
tggacaccttcgagaagaaggaact

SEQ ID NO: 675264 - DNA, 25 bp, Artificial sequence
  Synthetic oligonucleotide
ccctggacgcctacggcaaggactg

SEQ ID NO: 675265 - DNA, 25 bp, Artificial sequence
  Synthetic oligonucleotide
agaagaaggaacttgatcttgctct

SEQ ID NO: 675266 - DNA, 25 bp, Artificial sequence
  Synthetic oligonucleotide
aggtactcgatgttggtgtagccgg

SEQ ID NO: 675267 - DNA, 25 bp, Artificial sequence
  Synthetic oligonucleotide
ttgatcttgctcttgtcgagagagg

SEQ ID NO: 675268 - DNA, 25 bp, Artificial sequence
  Synthetic oligonucleotide
ttgctcttgtcgagagaggtcttgc

SEQ ID NO: 675269 - DNA, 25 bp, Artificial sequence
  Synthetic oligonucleotide
ttgtcgagagaggtcttgctcatct

SEQ ID NO: 675270 - DNA, 25 bp, Artificial sequence
  Synthetic oligonucleotide
agagaggtcttgctcatctgcgtaa

SEQ ID NO: 675271 - DNA, 25 bp, Artificial sequence
  Synthetic oligonucleotide
gtcttgctcatctgcgtaaacctgt

SEQ ID NO: 675272 - DNA, 25 bp, Artificial sequence
  Synthetic oligonucleotide
ctcatctgcgtaaacctgttgtccc

SEQ ID NO: 675273 - DNA, 25 bp, Artificial sequence
  Synthetic oligonucleotide
tgcgtaaacctgttgtcccggagga

SEQ ID NO: 675274 - DNA, 25 bp, Artificial sequence
  Synthetic oligonucleotide
acctgttgtcccggaggaagtggct

SEQ ID NO: 675275 - DNA, 25 bp, Artificial sequence
  Synthetic oligonucleotide
ccttcgagaagaaggaacttgatct

SEQ ID NO: 675276 - DNA, 25 bp, Artificial sequence
  Synthetic oligonucleotide
gcgcatcggcgatcctttccttcag

SEQ ID NO: 675277 - DNA, 25 bp, Artificial sequence
  Synthetic oligonucleotide
ttcgcgcagtcgaagacctcttcgg

SEQ ID NO: 675278 - DNA, 25 bp, Artificial sequence
  Synthetic oligonucleotide
cagtcgaagacctcttcggtcagct

SEQ ID NO: 675279 - DNA, 25 bp, Artificial sequence
  Synthetic oligonucleotide
aagacctcttcggtcagctgggtgc

SEQ ID NO: 675280 - DNA, 25 bp, Artificial sequence
  Synthetic oligonucleotide
tcttcggtcagctgggtgcgggagc

SEQ ID NO: 675281 - DNA, 25 bp, Artificial sequence
  Synthetic oligonucleotide
ggtcagctgggtgcgggagcgaatg

SEQ ID NO: 675282 - DNA, 25 bp, Artificial sequence
  Synthetic oligonucleotide
ctgggtgcgggagcgaatgccgatg

SEQ ID NO: 675283 - DNA, 25 bp, Artificial sequence
  Synthetic oligonucleotide
gcgggagcgaatgccgatgaagtgc

SEQ ID NO: 675284 - DNA, 25 bp, Artificial sequence
  Synthetic oligonucleotide
gcgaatgccgatgaagtgcgcatcg

SEQ ID NO: 675285 - DNA, 25 bp, Artificial sequence
  Synthetic oligonucleotide
ttggtgtagccggcggccttcagcg

SEQ ID NO: 675286 - DNA, 25 bp, Artificial sequence
  Synthetic oligonucleotide
tgaagtgcgcatcggcgatcctttc

SEQ ID NO: 675287 - DNA, 25 bp, Artificial sequence
  Synthetic oligonucleotide
tcgatgttggtgtagccggcggcct

SEQ ID NO: 675288 - DNA, 25 bp, Artificial sequence
  Synthetic oligonucleotide
ggcgatcctttccttcagctcgtcg

SEQ ID NO: 675289 - DNA, 25 bp, Artificial sequence
  Synthetic oligonucleotide
cctttccttcagctcgtcgccggaa

SEQ ID NO: 675290 - DNA, 25 bp, Artificial sequence
  Synthetic oligonucleotide
cttcagctcgtcgccggaaagcgcg

SEQ ID NO: 675291 - DNA, 25 bp, Artificial sequence
  Synthetic oligonucleotide
ctcgtcgccggaaagcgcggtcttg

SEQ ID NO: 675292 - DNA, 25 bp, Artificial sequence
  Synthetic oligonucleotide
ccggaaagcgcggtcttgaggtact

SEQ ID NO: 675293 - DNA, 25 bp, Artificial sequence
  Synthetic oligonucleotide
agcgcggtcttgaggtactcgatgt

SEQ ID NO: 675294 - DNA, 25 bp, Artificial sequence
  Synthetic oligonucleotide
ggtcttgaggtactcgatgttggtg

SEQ ID NO: 675295 - DNA, 25 bp, Artificial sequence
  Synthetic oligonucleotide
agtggctggaaagcgaactgcgcga

SEQ ID NO: 675296 - DNA, 25 bp, Artificial sequence
  Synthetic oligonucleotide
tgccgatgaagtgcgcatcggcgat

SEQ ID NO: 675297 - DNA, 25 bp, Artificial sequence
  Synthetic oligonucleotide
atcgaatcgctcaagcccctggtcg

SEQ ID NO: 675298 - DNA, 25 bp, Artificial sequence
  Synthetic oligonucleotide
tgtcccggaggaagtggctggaaag

SEQ ID NO: 675299 - DNA, 25 bp, Artificial sequence
  Synthetic oligonucleotide
ttctcaggacgaccatgaatcattt

SEQ ID NO: 675300 - DNA, 25 bp, Artificial sequence
  Synthetic oligonucleotide
ggacgaccatgaatcatttgagagt

SEQ ID NO: 675301 - DNA, 25 bp, Artificial sequence
  Synthetic oligonucleotide
ccatgaatcatttgagagttcccga

SEQ ID NO: 675302 - DNA, 25 bp, Artificial sequence
  Synthetic oligonucleotide
atcatttgagagttcccgaatgacc

SEQ ID NO: 675303 - DNA, 25 bp, Artificial sequence
  Synthetic oligonucleotide
tgagagttcccgaatgacccgcgaa

SEQ ID NO: 675304 - DNA, 25 bp, Artificial sequence
  Synthetic oligonucleotide
ttcccgaatgacccgcgaagccctg

SEQ ID NO: 675305 - DNA, 25 bp, Artificial sequence
  Synthetic oligonucleotide
aatgacccgcgaagccctgatcgaa

SEQ ID NO: 675306 - DNA, 25 bp, Artificial sequence
  Synthetic oligonucleotide
cgacctgagttgttctcaggacgac

SEQ ID NO: 675307 - DNA, 25 bp, Artificial sequence
  Synthetic oligonucleotide
gccctgatcgaatcgctcaagcccc

SEQ ID NO: 675308 - DNA, 25 bp, Artificial sequence
  Synthetic oligonucleotide
cggttgcgacctgagttgttctcag

SEQ ID NO: 675309 - DNA, 25 bp, Artificial sequence
  Synthetic oligonucleotide
tcgctcaagcccctggtcgagcctg

SEQ ID NO: 675310 - DNA, 25 bp, Artificial sequence
  Synthetic oligonucleotide
agcccctggtcgagcctggcaagct

SEQ ID NO: 675311 - DNA, 25 bp, Artificial sequence
  Synthetic oligonucleotide
tggtcgagcctggcaagctgctcga

SEQ ID NO: 675312 - DNA, 25 bp, Artificial sequence
  Synthetic oligonucleotide
agcctggcaagctgctcgacgacgc

SEQ ID NO: 675313 - DNA, 25 bp, Artificial sequence
  Synthetic oligonucleotide
gcaagctgctcgacgacgccgcctc

SEQ ID NO: 675314 - DNA, 25 bp, Artificial sequence
  Synthetic oligonucleotide
tgctcgacgacgccgcctccctgga

SEQ ID NO: 675315 - DNA, 25 bp, Artificial sequence
  Synthetic oligonucleotide
acgacgccgcctccctggacgccta

SEQ ID NO: 675316 - DNA, 25 bp, Artificial sequence
  Synthetic oligonucleotide
ccgcctccctggacgcctacggcaa

SEQ ID NO: 675317 - DNA, 25 bp, Artificial sequence
  Synthetic oligonucleotide
cgcgaagccctgatcgaatcgctca

SEQ ID NO: 675318 - DNA, 25 bp, Artificial sequence
  Synthetic oligonucleotide
ggcgcccagaggcactaagcgcggg

SEQ ID NO: 675319 - DNA, 25 bp, Artificial sequence
  Synthetic oligonucleotide
gccgaccgcgatcagtttcttcgcg

SEQ ID NO: 675320 - DNA, 25 bp, Artificial sequence
  Synthetic oligonucleotide
tggaaagcgaactgcgcgaagcggg

SEQ ID NO: 675321 - DNA, 25 bp, Artificial sequence
  Synthetic oligonucleotide
gcgaactgcgcgaagcgggtccggc

SEQ ID NO: 675322 - DNA, 25 bp, Artificial sequence
  Synthetic oligonucleotide
gcgcgaagcgggtccggccggcgct

SEQ ID NO: 675323 - DNA, 25 bp, Artificial sequence
  Synthetic oligonucleotide
agcgggtccggccggcgctggccgg

SEQ ID NO: 675324 - DNA, 25 bp, Artificial sequence
  Synthetic oligonucleotide
tccggccggcgctggccggcacccg

SEQ ID NO: 675325 - DNA, 25 bp, Artificial sequence
  Synthetic oligonucleotide
cggcgctggccggcacccgcaactc

SEQ ID NO: 675326 - DNA, 25 bp, Artificial sequence
  Synthetic oligonucleotide
ggccggcacccgcaactcggcgccc

SEQ ID NO: 675327 - DNA, 25 bp, Artificial sequence
  Synthetic oligonucleotide
gagttgttctcaggacgaccatgaa

SEQ ID NO: 675328 - DNA, 25 bp, Artificial sequence
  Synthetic oligonucleotide
caactcggcgcccagaggcactaag

SEQ ID NO: 675329 - DNA, 25 bp, Artificial sequence
  Synthetic oligonucleotide
ggaggaagtggctggaaagcgaact

SEQ ID NO: 675330 - DNA, 25 bp, Artificial sequence
  Synthetic oligonucleotide
cagaggcactaagcgcggggggcgt

SEQ ID NO: 675331 - DNA, 25 bp, Artificial sequence
  Synthetic oligonucleotide
cactaagcgcggggggcgtatgcta

SEQ ID NO: 675332 - DNA, 25 bp, Artificial sequence
  Synthetic oligonucleotide
gcgcggggggcgtatgctagcatgt

SEQ ID NO: 675333 - DNA, 25 bp, Artificial sequence
  Synthetic oligonucleotide
gggcgtatgctagcatgttctccct

SEQ ID NO: 675334 - DNA, 25 bp, Artificial sequence
  Synthetic oligonucleotide
atgctagcatgttctcccttttcct

SEQ ID NO: 675335 - DNA, 25 bp, Artificial sequence
  Synthetic oligonucleotide
gcatgttctcccttttccttgcccg

SEQ ID NO: 675336 - DNA, 25 bp, Artificial sequence
  Synthetic oligonucleotide
cttttccttgcccggttgcgacctg

SEQ ID NO: 675337 - DNA, 25 bp, Artificial sequence
  Synthetic oligonucleotide
cttgcccggttgcgacctgagttgt

SEQ ID NO: 675338 - DNA, 25 bp, Artificial sequence
  Synthetic oligonucleotide
gcacccgcaactcggcgcccagagg

SEQ ID NO: 675339 - DNA, 25 bp, Artificial sequence
  Synthetic oligonucleotide
cggtgtcgtagaagaacacctgcat

SEQ ID NO: 675340 - DNA, 25 bp, Artificial sequence
  Synthetic oligonucleotide
tgggtgccgatcgagccgtagccga

SEQ ID NO: 675341 - DNA, 25 bp, Artificial sequence
  Synthetic oligonucleotide
agcagctcgtgcaggctgccgatct

SEQ ID NO: 675342 - DNA, 25 bp, Artificial sequence
  Synthetic oligonucleotide
tcgtgcaggctgccgatctgcaccg

SEQ ID NO: 675343 - DNA, 25 bp, Artificial sequence
  Synthetic oligonucleotide
aggctgccgatctgcaccgcgttgc

SEQ ID NO: 675344 - DNA, 25 bp, Artificial sequence
  Synthetic oligonucleotide
ccgatctgcaccgcgttgcccagcg

SEQ ID NO: 675345 - DNA, 25 bp, Artificial sequence
  Synthetic oligonucleotide
tgcaccgcgttgcccagcggcagct

SEQ ID NO: 675346 - DNA, 25 bp, Artificial sequence
  Synthetic oligonucleotide
gcgttgcccagcggcagcttggtca

SEQ ID NO: 675347 - DNA, 25 bp, Artificial sequence
  Synthetic oligonucleotide
cccagcggcagcttggtcacggtgt

SEQ ID NO: 675348 - DNA, 25 bp, Artificial sequence
  Synthetic oligonucleotide
tcggacatgcccagcagctcgtgca

SEQ ID NO: 675349 - DNA, 25 bp, Artificial sequence
  Synthetic oligonucleotide
tggtcacggtgtcgtagaagaacac

SEQ ID NO: 675350 - DNA, 25 bp, Artificial sequence
  Synthetic oligonucleotide
acgatgtcggacatgcccagcagct

SEQ ID NO: 675351 - DNA, 25 bp, Artificial sequence
  Synthetic oligonucleotide
cgtagaagaacacctgcatgcccag

SEQ ID NO: 675352 - DNA, 25 bp, Artificial sequence
  Synthetic oligonucleotide
aagaacacctgcatgcccagggcct

SEQ ID NO: 675353 - DNA, 25 bp, Artificial sequence
  Synthetic oligonucleotide
acctgcatgcccagggcctcggcga

SEQ ID NO: 675354 - DNA, 25 bp, Artificial sequence
  Synthetic oligonucleotide
atgcccagggcctcggcgagtaccg

SEQ ID NO: 675355 - DNA, 25 bp, Artificial sequence
  Synthetic oligonucleotide
agggcctcggcgagtaccgagagct

SEQ ID NO: 675356 - DNA, 25 bp, Artificial sequence
  Synthetic oligonucleotide
tcggcgagtaccgagagctgggtgc

SEQ ID NO: 675357 - DNA, 25 bp, Artificial sequence
  Synthetic oligonucleotide
agtaccgagagctgggtgccgatcg

SEQ ID NO: 675358 - DNA, 25 bp, Artificial sequence
  Synthetic oligonucleotide
cagtttcttcgcgcagtcgaagacc

SEQ ID NO: 675359 - DNA, 25 bp, Artificial sequence
  Synthetic oligonucleotide
gcagcttggtcacggtgtcgtagaa

SEQ ID NO: 675360 - DNA, 25 bp, Artificial sequence
  Synthetic oligonucleotide
ttccttctcgccgatcatccactgg

SEQ ID NO: 675361 - DNA, 25 bp, Artificial sequence
  Synthetic oligonucleotide
tcttccatgtcgacccgcagaccgc

SEQ ID NO: 675362 - DNA, 25 bp, Artificial sequence
  Synthetic oligonucleotide
aacctgcacctgaacatcctcaagc

SEQ ID NO: 675363 - DNA, 25 bp, Artificial sequence
  Synthetic oligonucleotide
ccgcgcgcggcgttgatcaggatgc

SEQ ID NO: 675364 - DNA, 25 bp, Artificial sequence
  Synthetic oligonucleotide
gcggcgttgatcaggatgccgccct

SEQ ID NO: 675365 - DNA, 25 bp, Artificial sequence
  Synthetic oligonucleotide
ttgatcaggatgccgcccttcttca

SEQ ID NO: 675366 - DNA, 25 bp, Artificial sequence
  Synthetic oligonucleotide
aggatgccgcccttcttcatcgcgc

SEQ ID NO: 675367 - DNA, 25 bp, Artificial sequence
  Synthetic oligonucleotide
ccgcccttcttcatcgcgcggattt

SEQ ID NO: 675368 - DNA, 25 bp, Artificial sequence
  Synthetic oligonucleotide
ttcttcatcgcgcggatttccttct

SEQ ID NO: 675369 - DNA, 25 bp, Artificial sequence
  Synthetic oligonucleotide
atgcccagcagctcgtgcaggctgc

SEQ ID NO: 675370 - DNA, 25 bp, Artificial sequence
  Synthetic oligonucleotide
gcggatttccttctcgccgatcatc

SEQ ID NO: 675371 - DNA, 25 bp, Artificial sequence
  Synthetic oligonucleotide
actgtgccgcgcgcggcgttgatca

SEQ ID NO: 675372 - DNA, 25 bp, Artificial sequence
  Synthetic oligonucleotide
ctcgccgatcatccactgggtggag

SEQ ID NO: 675373 - DNA, 25 bp, Artificial sequence
  Synthetic oligonucleotide
atcatccactgggtggagggcagtt

SEQ ID NO: 675374 - DNA, 25 bp, Artificial sequence
  Synthetic oligonucleotide
cactgggtggagggcagttcgggaa

SEQ ID NO: 675375 - DNA, 25 bp, Artificial sequence
  Synthetic oligonucleotide
gtggagggcagttcgggaacgtgca

SEQ ID NO: 675376 - DNA, 25 bp, Artificial sequence
  Synthetic oligonucleotide
ggcagttcgggaacgtgcagcgaga

SEQ ID NO: 675377 - DNA, 25 bp, Artificial sequence
  Synthetic oligonucleotide
tcgggaacgtgcagcgagacgatgt

SEQ ID NO: 675378 - DNA, 25 bp, Artificial sequence
  Synthetic oligonucleotide
acgtgcagcgagacgatgtcggaca

SEQ ID NO: 675379 - DNA, 25 bp, Artificial sequence
  Synthetic oligonucleotide
agcgagacgatgtcggacatgccca

SEQ ID NO: 675380 - DNA, 25 bp, Artificial sequence
  Synthetic oligonucleotide
atcgcgcggatttccttctcgccga

SEQ ID NO: 675381 - DNA, 25 bp, Artificial sequence
  Synthetic oligonucleotide
ttcgcgggcggcgttgaggtcgacc

SEQ ID NO: 675382 - DNA, 25 bp, Artificial sequence
  Synthetic oligonucleotide
gagagctgggtgccgatcgagccgt

SEQ ID NO: 675383 - DNA, 25 bp, Artificial sequence
  Synthetic oligonucleotide
ctcagccacagagcgggtgttcgag

SEQ ID NO: 675384 - DNA, 25 bp, Artificial sequence
  Synthetic oligonucleotide
cacagagcgggtgttcgagtagggc

SEQ ID NO: 675385 - DNA, 25 bp, Artificial sequence
  Synthetic oligonucleotide
gcgggtgttcgagtagggcgcgttg

SEQ ID NO: 675386 - DNA, 25 bp, Artificial sequence
  Synthetic oligonucleotide
tgttcgagtagggcgcgttgaacac

SEQ ID NO: 675387 - DNA, 25 bp, Artificial sequence
  Synthetic oligonucleotide
agtagggcgcgttgaacacggcgat

SEQ ID NO: 675388 - DNA, 25 bp, Artificial sequence
  Synthetic oligonucleotide
gcgcgttgaacacggcgataccgcg

SEQ ID NO: 675389 - DNA, 25 bp, Artificial sequence
  Synthetic oligonucleotide
tgaacacggcgataccgcgttcgcg

SEQ ID NO: 675390 - DNA, 25 bp, Artificial sequence
  Synthetic oligonucleotide
ggccagtaccagctcagccacagag

SEQ ID NO: 675391 - DNA, 25 bp, Artificial sequence
  Synthetic oligonucleotide
taccgcgttcgcgggcggcgttgag

SEQ ID NO: 675392 - DNA, 25 bp, Artificial sequence
  Synthetic oligonucleotide
gcctcggccagtaccagctcagcca

SEQ ID NO: 675393 - DNA, 25 bp, Artificial sequence
  Synthetic oligonucleotide
ggcggcgttgaggtcgacctggttg

SEQ ID NO: 675394 - DNA, 25 bp, Artificial sequence
  Synthetic oligonucleotide
gttgaggtcgacctggttggtgccg

SEQ ID NO: 675395 - DNA, 25 bp, Artificial sequence
  Synthetic oligonucleotide
tcgacctggttggtgccgatgcaga

SEQ ID NO: 675396 - DNA, 25 bp, Artificial sequence
  Synthetic oligonucleotide
tggttggtgccgatgcagaagcagc

SEQ ID NO: 675397 - DNA, 25 bp, Artificial sequence
  Synthetic oligonucleotide
gtgccgatgcagaagcagccgaccg

SEQ ID NO: 675398 - DNA, 25 bp, Artificial sequence
  Synthetic oligonucleotide
atgcagaagcagccgaccgcgatca

SEQ ID NO: 675399 - DNA, 25 bp, Artificial sequence
  Synthetic oligonucleotide
aagcagccgaccgcgatcagtttct

SEQ ID NO: 675400 - DNA, 25 bp, Artificial sequence
  Synthetic oligonucleotide
tagccgacgatgccgagcttcttgc

SEQ ID NO: 675401 - DNA, 25 bp, Artificial sequence
  Synthetic oligonucleotide
cggcgataccgcgttcgcgggcggc

SEQ ID NO: 675402 - DNA, 25 bp, Artificial sequence
  Synthetic oligonucleotide
agccgccgcgatggcaggaggcgtt

SEQ ID NO: 675403 - DNA, 25 bp, Artificial sequence
  Synthetic oligonucleotide
gagccgtagccgacgatgccgagct

SEQ ID NO: 675404 - DNA, 25 bp, Artificial sequence
  Synthetic oligonucleotide
acgatgccgagcttcttgccacgga

SEQ ID NO: 675405 - DNA, 25 bp, Artificial sequence
  Synthetic oligonucleotide
cgagcttcttgccacggatctcgaa

SEQ ID NO: 675406 - DNA, 25 bp, Artificial sequence
  Synthetic oligonucleotide
tcttgccacggatctcgaaggaatt

SEQ ID NO: 675407 - DNA, 25 bp, Artificial sequence
  Synthetic oligonucleotide
cacggatctcgaaggaattcgccgc

SEQ ID NO: 675408 - DNA, 25 bp, Artificial sequence
  Synthetic oligonucleotide
tctcgaaggaattcgccgcgctctt

SEQ ID NO: 675409 - DNA, 25 bp, Artificial sequence
  Synthetic oligonucleotide
aggaattcgccgcgctcttgatcca

SEQ ID NO: 675410 - DNA, 25 bp, Artificial sequence
  Synthetic oligonucleotide
tcgccgcgctcttgatccagccgcc

SEQ ID NO: 675411 - DNA, 25 bp, Artificial sequence
  Synthetic oligonucleotide
taccagctcagccacagagcgggtg

SEQ ID NO: 675412 - DNA, 25 bp, Artificial sequence
  Synthetic oligonucleotide
tgatccagccgccgcgatggcagga

SEQ ID NO: 675413 - DNA, 25 bp, Artificial sequence
  Synthetic oligonucleotide
cgcgatcagtttcttcgcgcagtcg

SEQ ID NO: 675414 - DNA, 25 bp, Artificial sequence
  Synthetic oligonucleotide
cgcgatggcaggaggcgttcttttc

SEQ ID NO: 675415 - DNA, 25 bp, Artificial sequence
  Synthetic oligonucleotide
gcaggaggcgttcttttccgggatg

SEQ ID NO: 675416 - DNA, 25 bp, Artificial sequence
  Synthetic oligonucleotide
gcgttcttttccgggatgccgcgca

SEQ ID NO: 675417 - DNA, 25 bp, Artificial sequence
  Synthetic oligonucleotide
ttttccgggatgccgcgcagcagca

SEQ ID NO: 675418 - DNA, 25 bp, Artificial sequence
  Synthetic oligonucleotide
gggatgccgcgcagcagcaggatcg

SEQ ID NO: 675419 - DNA, 25 bp, Artificial sequence
  Synthetic oligonucleotide
ccgcgcagcagcaggatcgcctcgg

SEQ ID NO: 675420 - DNA, 25 bp, Artificial sequence
  Synthetic oligonucleotide
agcagcaggatcgcctcggccagta

SEQ ID NO: 675421 - DNA, 25 bp, Artificial sequence
  Synthetic oligonucleotide
aggatcgcctcggccagtaccagct

SEQ ID NO: 675422 - DNA, 25 bp, Artificial sequence
  Synthetic oligonucleotide
cgctcttgatccagccgccgcgatg

SEQ ID NO: 675423 - DNA, 25 bp, Artificial sequence
  Synthetic oligonucleotide
tcgagaccgactgcccgttctacgc

SEQ ID NO: 675424 - DNA, 25 bp, Artificial sequence
  Synthetic oligonucleotide
tccgacaaggccctggccaaggtcc

SEQ ID NO: 675425 - DNA, 25 bp, Artificial sequence
  Synthetic oligonucleotide
caaggccctggccaaggtcctggcc

SEQ ID NO: 675426 - DNA, 25 bp, Artificial sequence
  Synthetic oligonucleotide
cctggccaaggtcctggcccgtggc

SEQ ID NO: 675427 - DNA, 25 bp, Artificial sequence
  Synthetic oligonucleotide
caaggtcctggcccgtggcgatgta

SEQ ID NO: 675428 - DNA, 25 bp, Artificial sequence
  Synthetic oligonucleotide
ctggcccgtggcgatgtaccacggg

SEQ ID NO: 675429 - DNA, 25 bp, Artificial sequence
  Synthetic oligonucleotide
cgtggcgatgtaccacgggcgttcg

SEQ ID NO: 675430 - DNA, 25 bp, Artificial sequence
  Synthetic oligonucleotide
gatgtaccacgggcgttcgagaccg

SEQ ID NO: 675431 - DNA, 25 bp, Artificial sequence
  Synthetic oligonucleotide
gcgaccatgcgtctggagcgcacgc

SEQ ID NO: 675432 - DNA, 25 bp, Artificial sequence
  Synthetic oligonucleotide
ggcgttcgagaccgactgcccgttc

SEQ ID NO: 675433 - DNA, 25 bp, Artificial sequence
  Synthetic oligonucleotide
accgccttcgagttcttctccgaca

SEQ ID NO: 675434 - DNA, 25 bp, Artificial sequence
  Synthetic oligonucleotide
ccgactgcccgttctacgccctgct

SEQ ID NO: 675435 - DNA, 25 bp, Artificial sequence
  Synthetic oligonucleotide
gcccgttctacgccctgctggagtt

SEQ ID NO: 675436 - DNA, 25 bp, Artificial sequence
  Synthetic oligonucleotide
tctacgccctgctggagttcgaggc

SEQ ID NO: 675437 - DNA, 25 bp, Artificial sequence
  Synthetic oligonucleotide
ccctgctggagttcgaggcgaccac

SEQ ID NO: 675438 - DNA, 25 bp, Artificial sequence
  Synthetic oligonucleotide
ggagttcgaggcgaccaccgaggaa

SEQ ID NO: 675439 - DNA, 25 bp, Artificial sequence
  Synthetic oligonucleotide
tcgaggcgaccaccgaggaagtcgc

SEQ ID NO: 675440 - DNA, 25 bp, Artificial sequence
  Synthetic oligonucleotide
cgaccaccgaggaagtcgccaacga

SEQ ID NO: 675441 - DNA, 25 bp, Artificial sequence
  Synthetic oligonucleotide
cgaggaagtcgccaacgaggcgctg

SEQ ID NO: 675442 - DNA, 25 bp, Artificial sequence
  Synthetic oligonucleotide
accacgggcgttcgagaccgactgc

SEQ ID NO: 675443 - DNA, 25 bp, Artificial sequence
  Synthetic oligonucleotide
tcgactcgatcatgccggtgctgca

SEQ ID NO: 675444 - DNA, 25 bp, Artificial sequence
  Synthetic oligonucleotide
catgcgtctggagcgcacgccgaag

SEQ ID NO: 675445 - DNA, 25 bp, Artificial sequence
  Synthetic oligonucleotide
gtctggagcgcacgccgaagaacct

SEQ ID NO: 675446 - DNA, 25 bp, Artificial sequence
  Synthetic oligonucleotide
agcgcacgccgaagaacctcaccgc

SEQ ID NO: 675447 - DNA, 25 bp, Artificial sequence
  Synthetic oligonucleotide
cgccgaagaacctcaccgctatggt

SEQ ID NO: 675448 - DNA, 25 bp, Artificial sequence
  Synthetic oligonucleotide
agaacctcaccgctatggtcctcgg

SEQ ID NO: 675449 - DNA, 25 bp, Artificial sequence
  Synthetic oligonucleotide
tcaccgctatggtcctcggcacgcc

SEQ ID NO: 675450 - DNA, 25 bp, Artificial sequence
  Synthetic oligonucleotide
ctatggtcctcggcacgcccgactt

SEQ ID NO: 675451 - DNA, 25 bp, Artificial sequence
  Synthetic oligonucleotide
tcctcggcacgcccgacttcgactc

SEQ ID NO: 675452 - DNA, 25 bp, Artificial sequence
  Synthetic oligonucleotide
ttcttctccgacaaggccctggcca

SEQ ID NO: 675453 - DNA, 25 bp, Artificial sequence
  Synthetic oligonucleotide
ccgacttcgactcgatcatgccggt

SEQ ID NO: 675454 - DNA, 25 bp, Artificial sequence
  Synthetic oligonucleotide
ttcgagttcttctccgacaaggccc

SEQ ID NO: 675455 - DNA, 25 bp, Artificial sequence
  Synthetic oligonucleotide
cgatcatgccggtgctgcatgcctt

SEQ ID NO: 675456 - DNA, 25 bp, Artificial sequence
  Synthetic oligonucleotide
tgccggtgctgcatgccttccagag

SEQ ID NO: 675457 - DNA, 25 bp, Artificial sequence
  Synthetic oligonucleotide
tgctgcatgccttccagagcaagct

SEQ ID NO: 675458 - DNA, 25 bp, Artificial sequence
  Synthetic oligonucleotide
tgccttccagagcaagctcgacctg

SEQ ID NO: 675459 - DNA, 25 bp, Artificial sequence
  Synthetic oligonucleotide
ccagagcaagctcgacctgaccgcc

SEQ ID NO: 675460 - DNA, 25 bp, Artificial sequence
  Synthetic oligonucleotide
aagctcgacctgaccgccttcgagt

SEQ ID NO: 675461 - DNA, 25 bp, Artificial sequence
  Synthetic oligonucleotide
gacctgaccgccttcgagttcttct

SEQ ID NO: 675462 - DNA, 25 bp, Artificial sequence
  Synthetic oligonucleotide
aggcgctggccaccttcgagcactg

SEQ ID NO: 675463 - DNA, 25 bp, Artificial sequence
  Synthetic oligonucleotide
gcacgcccgacttcgactcgatcat

SEQ ID NO: 675464 - DNA, 25 bp, Artificial sequence
  Synthetic oligonucleotide
ccggacttcgaggtggtgtggttcg

SEQ ID NO: 675465 - DNA, 25 bp, Artificial sequence
  Synthetic oligonucleotide
aagtcgccaacgaggcgctggccac

SEQ ID NO: 675466 - DNA, 25 bp, Artificial sequence
  Synthetic oligonucleotide
acgacatctcggtcacggtttcccg

SEQ ID NO: 675467 - DNA, 25 bp, Artificial sequence
  Synthetic oligonucleotide
cgggtgcccgccttcctcaaggaca

SEQ ID NO: 675468 - DNA, 25 bp, Artificial sequence
  Synthetic oligonucleotide
cccgccttcctcaaggacatcgacg

SEQ ID NO: 675469 - DNA, 25 bp, Artificial sequence
  Synthetic oligonucleotide
ttcctcaaggacatcgacgccatcg

SEQ ID NO: 675470 - DNA, 25 bp, Artificial sequence
  Synthetic oligonucleotide
aaggacatcgacgccatcgtcgagg

SEQ ID NO: 675471 - DNA, 25 bp, Artificial sequence
  Synthetic oligonucleotide
tcgacgccatcgtcgaggccaacta

SEQ ID NO: 675472 - DNA, 25 bp, Artificial sequence
  Synthetic oligonucleotide
catcgtcgaggccaactacccggac

SEQ ID NO: 675473 - DNA, 25 bp, Artificial sequence
  Synthetic oligonucleotide
cgccgtacaagaacgacatctcggt

SEQ ID NO: 675474 - DNA, 25 bp, Artificial sequence
  Synthetic oligonucleotide
caactacccggacttcgaggtggtg

SEQ ID NO: 675475 - DNA, 25 bp, Artificial sequence
  Synthetic oligonucleotide
actggacgccgtacaagaacgacat

SEQ ID NO: 675476 - DNA, 25 bp, Artificial sequence
  Synthetic oligonucleotide
ttcgaggtggtgtggttcggccaca

SEQ ID NO: 675477 - DNA, 25 bp, Artificial sequence
  Synthetic oligonucleotide
ggtggtgtggttcggccacatcggc

SEQ ID NO: 675478 - DNA, 25 bp, Artificial sequence
  Synthetic oligonucleotide
gtggttcggccacatcggcgacggc

SEQ ID NO: 675479 - DNA, 25 bp, Artificial sequence
  Synthetic oligonucleotide
ggccacatcggcgacggcaacctgc

SEQ ID NO: 675480 - DNA, 25 bp, Artificial sequence
  Synthetic oligonucleotide
acgcctacggcaaggactggaccaa

SEQ ID NO: 675481 - DNA, 25 bp, Artificial sequence
  Synthetic oligonucleotide
ccgatcgagccgtagccgacgatgc

SEQ ID NO: 675482 - DNA, 25 bp, Artificial sequence
  Synthetic oligonucleotide
atcggcgacggcaacctgcacctga

SEQ ID NO: 675483 - DNA, 25 bp, Artificial sequence
  Synthetic oligonucleotide
gacggcaacctgcacctgaacatcc

SEQ ID NO: 675484 - DNA, 25 bp, Artificial sequence
  Synthetic oligonucleotide
cgaggccaactacccggacttcgag

SEQ ID NO: 675485 - DNA, 25 bp, Artificial sequence
  Synthetic oligonucleotide
gccagagcgagcagcagttgcagaa

SEQ ID NO: 675486 - DNA, 25 bp, Artificial sequence
  Synthetic oligonucleotide
tgcgcgagtacatctccgagaccat

SEQ ID NO: 675487 - DNA, 25 bp, Artificial sequence
  Synthetic oligonucleotide
tggccaccttcgagcactgcgtcga

SEQ ID NO: 675488 - DNA, 25 bp, Artificial sequence
  Synthetic oligonucleotide
ccttcgagcactgcgtcgagcaggg

SEQ ID NO: 675489 - DNA, 25 bp, Artificial sequence
  Synthetic oligonucleotide
agcactgcgtcgagcagggctgggt

SEQ ID NO: 675490 - DNA, 25 bp, Artificial sequence
  Synthetic oligonucleotide
gcgtcgagcagggctgggtgctgga

SEQ ID NO: 675491 - DNA, 25 bp, Artificial sequence
  Synthetic oligonucleotide
agcagggctgggtgctggacggggt

SEQ ID NO: 675492 - DNA, 25 bp, Artificial sequence
  Synthetic oligonucleotide
gctgggtgctggacggggtgatgag

SEQ ID NO: 675493 - DNA, 25 bp, Artificial sequence
  Synthetic oligonucleotide
tgctggacggggtgatgagccagag

SEQ ID NO: 675494 - DNA, 25 bp, Artificial sequence
  Synthetic oligonucleotide
acaagaacgacatctcggtcacggt

SEQ ID NO: 675495 - DNA, 25 bp, Artificial sequence
  Synthetic oligonucleotide
tgatgagccagagcgagcagcagtt

SEQ ID NO: 675496 - DNA, 25 bp, Artificial sequence
  Synthetic oligonucleotide
ccaacgaggcgctggccaccttcga

SEQ ID NO: 675497 - DNA, 25 bp, Artificial sequence
  Synthetic oligonucleotide
gcgagcagcagttgcagaacctgtg

SEQ ID NO: 675498 - DNA, 25 bp, Artificial sequence
  Synthetic oligonucleotide
agcagttgcagaacctgtggaagct

SEQ ID NO: 675499 - DNA, 25 bp, Artificial sequence
  Synthetic oligonucleotide
tgcagaacctgtggaagctgcgcga

SEQ ID NO: 675500 - DNA, 25 bp, Artificial sequence
  Synthetic oligonucleotide
acctgtggaagctgcgcgagtacat

SEQ ID NO: 675501 - DNA, 25 bp, Artificial sequence
  Synthetic oligonucleotide
ggaagctgcgcgagtacatctccga

SEQ ID NO: 675502 - DNA, 25 bp, Artificial sequence
  Synthetic oligonucleotide
agtacatctccgagaccatctccca

SEQ ID NO: 675503 - DNA, 25 bp, Artificial sequence
  Synthetic oligonucleotide
agaccatctcccactggacgccgta

SEQ ID NO: 675504 - DNA, 25 bp, Artificial sequence
  Synthetic oligonucleotide
tctcccactggacgccgtacaagaa

SEQ ID NO: 675505 - DNA, 25 bp, Artificial sequence
  Synthetic oligonucleotide
acggggtgatgagccagagcgagca

SEQ ID NO: 675506 - DNA, 25 bp, Artificial sequence
  Synthetic oligonucleotide
acttcaatgccttcgaccgcaccgt

SEQ ID NO: 675507 - DNA, 25 bp, Artificial sequence
  Synthetic oligonucleotide
gcggccgtggcggccaacggcgaag

SEQ ID NO: 675508 - DNA, 25 bp, Artificial sequence
  Synthetic oligonucleotide
gtggcggccaacggcgaagtcgtgg

SEQ ID NO: 675509 - DNA, 25 bp, Artificial sequence
  Synthetic oligonucleotide
ccaacggcgaagtcgtggtggcctt

SEQ ID NO: 675510 - DNA, 25 bp, Artificial sequence
  Synthetic oligonucleotide
gcgaagtcgtggtggccttcgacta

SEQ ID NO: 675511 - DNA, 25 bp, Artificial sequence
  Synthetic oligonucleotide
tcgtggtggccttcgactacatgaa

SEQ ID NO: 675512 - DNA, 25 bp, Artificial sequence
  Synthetic oligonucleotide
tggccttcgactacatgaaccggat

SEQ ID NO: 675513 - DNA, 25 bp, Artificial sequence
  Synthetic oligonucleotide
tcgactacatgaaccggatactcga

SEQ ID NO: 675514 - DNA, 25 bp, Artificial sequence
  Synthetic oligonucleotide
acatgaaccggatactcgacttcaa

SEQ ID NO: 675515 - DNA, 25 bp, Artificial sequence
  Synthetic oligonucleotide
actgcagaccttcgccgaggaaaac

SEQ ID NO: 675516 - DNA, 25 bp, Artificial sequence
  Synthetic oligonucleotide
tactcgacttcaatgccttcgaccg

SEQ ID NO: 675517 - DNA, 25 bp, Artificial sequence
  Synthetic oligonucleotide
cgtaccgggctctccgccgcggccg

SEQ ID NO: 675518 - DNA, 25 bp, Artificial sequence
  Synthetic oligonucleotide
atgccttcgaccgcaccgtagtctg

SEQ ID NO: 675519 - DNA, 25 bp, Artificial sequence
  Synthetic oligonucleotide
tcgaccgcaccgtagtctgccagcc

SEQ ID NO: 675520 - DNA, 25 bp, Artificial sequence
  Synthetic oligonucleotide
gcaccgtagtctgccagccgggcgt

SEQ ID NO: 675521 - DNA, 25 bp, Artificial sequence
  Synthetic oligonucleotide
agtctgccagccgggcgtggttacc

SEQ ID NO: 675522 - DNA, 25 bp, Artificial sequence
  Synthetic oligonucleotide
ccagccgggcgtggttaccaagcaa

SEQ ID NO: 675523 - DNA, 25 bp, Artificial sequence
  Synthetic oligonucleotide
ggcgtggttaccaagcaactgcaga

SEQ ID NO: 675524 - DNA, 25 bp, Artificial sequence
  Synthetic oligonucleotide
gttaccaagcaactgcagaccttcg

SEQ ID NO: 675525 - DNA, 25 bp, Artificial sequence
  Synthetic oligonucleotide
aagcaactgcagaccttcgccgagg

SEQ ID NO: 675526 - DNA, 25 bp, Artificial sequence
  Synthetic oligonucleotide
accggatactcgacttcaatgcctt

SEQ ID NO: 675527 - DNA, 25 bp, Artificial sequence
  Synthetic oligonucleotide
tgttccccaagagcgtcgagcaggt

SEQ ID NO: 675528 - DNA, 25 bp, Artificial sequence
  Synthetic oligonucleotide
ggaccaagcatttcgcccctgcgcc

SEQ ID NO: 675529 - DNA, 25 bp, Artificial sequence
  Synthetic oligonucleotide
agcatttcgcccctgcgccgctggc

SEQ ID NO: 675530 - DNA, 25 bp, Artificial sequence
  Synthetic oligonucleotide
aggactggaccaagcatttcgcccc

SEQ ID NO: 675531 - DNA, 25 bp, Artificial sequence
  Synthetic oligonucleotide
acggcaaggactggaccaagcattt

SEQ ID NO: 675532 - DNA, 25 bp, Artificial sequence
  Synthetic oligonucleotide
tctccgagaccatctcccactggac

SEQ ID NO: 675533 - DNA, 25 bp, Artificial sequence
  Synthetic oligonucleotide
gtcgaggcgaccatgcgtctggagc

SEQ ID NO: 675534 - DNA, 25 bp, Artificial sequence
  Synthetic oligonucleotide
tcgcccctgcgccgctggccatcgt

SEQ ID NO: 675535 - DNA, 25 bp, Artificial sequence
  Synthetic oligonucleotide
ctgcgccgctggccatcgtgttccc

SEQ ID NO: 675536 - DNA, 25 bp, Artificial sequence
  Synthetic oligonucleotide
tccgccgcggccgtggcggccaacg

SEQ ID NO: 675537 - DNA, 25 bp, Artificial sequence
  Synthetic oligonucleotide
catcgtgttccccaagagcgtcgag

SEQ ID NO: 675538 - DNA, 25 bp, Artificial sequence
  Synthetic oligonucleotide
gggctctccgccgcggccgtggcgg

SEQ ID NO: 675539 - DNA, 25 bp, Artificial sequence
  Synthetic oligonucleotide
cccaagagcgtcgagcaggtccagg

SEQ ID NO: 675540 - DNA, 25 bp, Artificial sequence
  Synthetic oligonucleotide
agcgtcgagcaggtccaggcgatcg

SEQ ID NO: 675541 - DNA, 25 bp, Artificial sequence
  Synthetic oligonucleotide
gagcaggtccaggcgatcgtccgct

SEQ ID NO: 675542 - DNA, 25 bp, Artificial sequence
  Synthetic oligonucleotide
gtccaggcgatcgtccgctgggcca

SEQ ID NO: 675543 - DNA, 25 bp, Artificial sequence
  Synthetic oligonucleotide
gtccgctgggccaaccagcacaagg

SEQ ID NO: 675544 - DNA, 25 bp, Artificial sequence
  Synthetic oligonucleotide
aaccagcacaaggtcggtctggtcc

SEQ ID NO: 675545 - DNA, 25 bp, Artificial sequence
  Synthetic oligonucleotide
gcacaaggtcggtctggtcccgtcg

SEQ ID NO: 675546 - DNA, 25 bp, Artificial sequence
  Synthetic oligonucleotide
gcggtcgtaccgggctctccgccgc

SEQ ID NO: 675547 - DNA, 25 bp, Artificial sequence
  Synthetic oligonucleotide
tgggccaaccagcacaaggtcggtc

SEQ ID NO: 675548 - DNA, 25 bp, Artificial sequence
  Synthetic oligonucleotide
cgctggccatcgtgttccccaagag

SEQ ID NO: 675549 - DNA, 25 bp, Artificial sequence
  Synthetic oligonucleotide
acatgcgccagctgttcatcggcgc

SEQ ID NO: 675550 - DNA, 25 bp, Artificial sequence
  Synthetic oligonucleotide
gatgaaggtcgtcaccggcaagggc

SEQ ID NO: 675551 - DNA, 25 bp, Artificial sequence
  Synthetic oligonucleotide
ggtcgtcaccggcaagggcgacctg

SEQ ID NO: 675552 - DNA, 25 bp, Artificial sequence
  Synthetic oligonucleotide
accggcaagggcgacctgctcgagc

SEQ ID NO: 675553 - DNA, 25 bp, Artificial sequence
  Synthetic oligonucleotide
aagggcgacctgctcgagctgaaca

SEQ ID NO: 675554 - DNA, 25 bp, Artificial sequence
  Synthetic oligonucleotide
gacctgctcgagctgaacaaggacc

SEQ ID NO: 675555 - DNA, 25 bp, Artificial sequence
  Synthetic oligonucleotide
ctcgagctgaacaaggacctgatca

SEQ ID NO: 675556 - DNA, 25 bp, Artificial sequence
  Synthetic oligonucleotide
ctgaacaaggacctgatcaagaacg

SEQ ID NO: 675557 - DNA, 25 bp, Artificial sequence
  Synthetic oligonucleotide
aaggacctgatcaagaacgccaccg

SEQ ID NO: 675558 - DNA, 25 bp, Artificial sequence
  Synthetic oligonucleotide
ggccgggatgaaggtcgtcaccggc

SEQ ID NO: 675559 - DNA, 25 bp, Artificial sequence
  Synthetic oligonucleotide
ccaccggctacgacatgcgccagct

SEQ ID NO: 675560 - DNA, 25 bp, Artificial sequence
  Synthetic oligonucleotide
agaacgccaccggctacgacatgcg

SEQ ID NO: 675561 - DNA, 25 bp, Artificial sequence
  Synthetic oligonucleotide
gccagctgttcatcggcgccgaagg

SEQ ID NO: 675562 - DNA, 25 bp, Artificial sequence
  Synthetic oligonucleotide
tgttcatcggcgccgaaggcaccct

SEQ ID NO: 675563 - DNA, 25 bp, Artificial sequence
  Synthetic oligonucleotide
tcggcgccgaaggcaccctgggctt

SEQ ID NO: 675564 - DNA, 25 bp, Artificial sequence
  Synthetic oligonucleotide
tcgccgaggaaaacggcctgtacta

SEQ ID NO: 675565 - DNA, 25 bp, Artificial sequence
  Synthetic oligonucleotide
gcgatcgtccgctgggccaaccagc

SEQ ID NO: 675566 - DNA, 25 bp, Artificial sequence
  Synthetic oligonucleotide
ttcgtggtcgaggcgaccatgcgtc

SEQ ID NO: 675567 - DNA, 25 bp, Artificial sequence
  Synthetic oligonucleotide
ccgaaggcaccctgggcttcgtggt

SEQ ID NO: 675568 - DNA, 25 bp, Artificial sequence
  Synthetic oligonucleotide
gcaccctgggcttcgtggtcgaggc

SEQ ID NO: 675569 - DNA, 25 bp, Artificial sequence
  Synthetic oligonucleotide
tgggcttcgtggtcgaggcgaccat

SEQ ID NO: 675570 - DNA, 25 bp, Artificial sequence
  Synthetic oligonucleotide
tgatcaagaacgccaccggctacga

SEQ ID NO: 675571 - DNA, 25 bp, Artificial sequence
  Synthetic oligonucleotide
atcggcaccaatgccggcgggatca

SEQ ID NO: 675572 - DNA, 25 bp, Artificial sequence
  Synthetic oligonucleotide
tcttccggttccagccagatcggcg

SEQ ID NO: 675573 - DNA, 25 bp, Artificial sequence
  Synthetic oligonucleotide
ggttccagccagatcggcggcaata

SEQ ID NO: 675574 - DNA, 25 bp, Artificial sequence
  Synthetic oligonucleotide
tcgcttcttccggttccagccagat

SEQ ID NO: 675575 - DNA, 25 bp, Artificial sequence
  Synthetic oligonucleotide
gctacgacatgcgccagctgttcat

SEQ ID NO: 675576 - DNA, 25 bp, Artificial sequence
  Synthetic oligonucleotide
gttgacttcgcttcttccggttcca

SEQ ID NO: 675577 - DNA, 25 bp, Artificial sequence
  Synthetic oligonucleotide
gcctgtactacccggttgacttcgc

SEQ ID NO: 675578 - DNA, 25 bp, Artificial sequence
  Synthetic oligonucleotide
agccagatcggcggcaatatcggca

SEQ ID NO: 675579 - DNA, 25 bp, Artificial sequence
  Synthetic oligonucleotide
ggcaatatcggcaccaatgccggcg

SEQ ID NO: 675580 - DNA, 25 bp, Artificial sequence
  Synthetic oligonucleotide
accaatgccggcgggatcaaggtca

SEQ ID NO: 675581 - DNA, 25 bp, Artificial sequence
  Synthetic oligonucleotide
gccggcgggatcaaggtcattcgct

SEQ ID NO: 675582 - DNA, 25 bp, Artificial sequence
  Synthetic oligonucleotide
cattcgctacggcatgacccgtaac

SEQ ID NO: 675583 - DNA, 25 bp, Artificial sequence
  Synthetic oligonucleotide
ctgggtggccgggatgaaggtcgtc

SEQ ID NO: 675584 - DNA, 25 bp, Artificial sequence
  Synthetic oligonucleotide
ccgtaactgggtggccgggatgaag

SEQ ID NO: 675585 - DNA, 25 bp, Artificial sequence
  Synthetic oligonucleotide
gcatgacccgtaactgggtggccgg

SEQ ID NO: 675586 - DNA, 25 bp, Artificial sequence
  Synthetic oligonucleotide
atcggcggcaatatcggcaccaatg

SEQ ID NO: 675587 - DNA, 25 bp, Artificial sequence
  Synthetic oligonucleotide
gctacggcatgacccgtaactgggt

SEQ ID NO: 675588 - DNA, 25 bp, Artificial sequence
  Synthetic oligonucleotide
gggatcaaggtcattcgctacggca

SEQ ID NO: 675589 - DNA, 25 bp, Artificial sequence
  Synthetic oligonucleotide
caaggtcattcgctacggcatgacc

SEQ ID NO: 675590 - DNA, 25 bp, Artificial sequence
  Synthetic oligonucleotide
tcgtgttcctggtgatgtacctgtt

SEQ ID NO: 675591 - DNA, 25 bp, Artificial sequence
  Synthetic oligonucleotide
cctgttcctgcagaacttccgcgcc

SEQ ID NO: 675592 - DNA, 25 bp, Artificial sequence
  Synthetic oligonucleotide
actacagcatcaacgcgcagttcaa

SEQ ID NO: 675593 - DNA, 25 bp, Artificial sequence
  Synthetic oligonucleotide
tcggcgtgctcgccgcgttcggctt

SEQ ID NO: 675594 - DNA, 25 bp, Artificial sequence
  Synthetic oligonucleotide
cctgcagaacttccgcgccacgctg

SEQ ID NO: 675595 - DNA, 25 bp, Artificial sequence
  Synthetic oligonucleotide
gaacttccgcgccacgctgatcccg

SEQ ID NO: 675596 - DNA, 25 bp, Artificial sequence
  Synthetic oligonucleotide
atggtgctggccatcggcttgctgg

SEQ ID NO: 675597 - DNA, 25 bp, Artificial sequence
  Synthetic oligonucleotide
ccgcgccacgctgatcccgaccatc

SEQ ID NO: 675598 - DNA, 25 bp, Artificial sequence
  Synthetic oligonucleotide
cctggtgatgtacctgttcctgcag

SEQ ID NO: 675599 - DNA, 25 bp, Artificial sequence
  Synthetic oligonucleotide
tcctcctcgtgttcctggtgatgta

SEQ ID NO: 675600 - DNA, 25 bp, Artificial sequence
  Synthetic oligonucleotide
cacgctgatcccgaccatcgccgta

SEQ ID NO: 675601 - DNA, 25 bp, Artificial sequence
  Synthetic oligonucleotide
gatgtacctgttcctgcagaacttc

SEQ ID NO: 675602 - DNA, 25 bp, Artificial sequence
  Synthetic oligonucleotide
gcatcaacgcgcagttcaacggcag

SEQ ID NO: 675603 - DNA, 25 bp, Artificial sequence
  Synthetic oligonucleotide
tgctcgccgcgttcggcttctcgat

SEQ ID NO: 675604 - DNA, 25 bp, Artificial sequence
  Synthetic oligonucleotide
ttcggcatggtgctggccatcggct

SEQ ID NO: 675605 - DNA, 25 bp, Artificial sequence
  Synthetic oligonucleotide
accctgaccatgttcggcatggtgc

SEQ ID NO: 675606 - DNA, 25 bp, Artificial sequence
  Synthetic oligonucleotide
atcaacaccctgaccatgttcggca

SEQ ID NO: 675607 - DNA, 25 bp, Artificial sequence
  Synthetic oligonucleotide
ccgccaaggcgatccgccagaccat

SEQ ID NO: 675608 - DNA, 25 bp, Artificial sequence
  Synthetic oligonucleotide
aggcgatcctcctcgtgttcctggt

SEQ ID NO: 675609 - DNA, 25 bp, Artificial sequence
  Synthetic oligonucleotide
ttctcgatcaacaccctgaccatgt

SEQ ID NO: 675610 - DNA, 25 bp, Artificial sequence
  Synthetic oligonucleotide
gctggggaccttcggcgtgctcgcc

SEQ ID NO: 675611 - DNA, 25 bp, Artificial sequence
  Synthetic oligonucleotide
gccgcgttcggcttctcgatcaaca

SEQ ID NO: 675612 - DNA, 25 bp, Artificial sequence
  Synthetic oligonucleotide
gatcccgaccatcgccgtaccggtg

SEQ ID NO: 675613 - DNA, 25 bp, Artificial sequence
  Synthetic oligonucleotide
accatgttcggcatggtgctggcca

SEQ ID NO: 675614 - DNA, 25 bp, Artificial sequence
  Synthetic oligonucleotide
ggaccttcggcgtgctcgccgcgtt

SEQ ID NO: 675615 - DNA, 25 bp, Artificial sequence
  Synthetic oligonucleotide
ggtgctgctggggaccttcggcgtg

SEQ ID NO: 675616 - DNA, 25 bp, Artificial sequence
  Synthetic oligonucleotide
taccggtggtgctgctggggacctt

SEQ ID NO: 675617 - DNA, 25 bp, Artificial sequence
  Synthetic oligonucleotide
tcgccgtaccggtggtgctgctggg

SEQ ID NO: 675618 - DNA, 25 bp, Artificial sequence
  Synthetic oligonucleotide
gaccatcgccgtaccggtggtgctg

SEQ ID NO: 675619 - DNA, 25 bp, Artificial sequence
  Synthetic oligonucleotide
ttcggcttctcgatcaacaccctga

SEQ ID NO: 675620 - DNA, 25 bp, Artificial sequence
  Synthetic oligonucleotide
gcgtccggtatcgcgatcaagctgg

SEQ ID NO: 675621 - DNA, 25 bp, Artificial sequence
  Synthetic oligonucleotide
tccgccagaccatcgccaacctgga

SEQ ID NO: 675622 - DNA, 25 bp, Artificial sequence
  Synthetic oligonucleotide
acgcgctggataccgccaaggcgat

SEQ ID NO: 675623 - DNA, 25 bp, Artificial sequence
  Synthetic oligonucleotide
gcgccaacgcgctggataccgccaa

SEQ ID NO: 675624 - DNA, 25 bp, Artificial sequence
  Synthetic oligonucleotide
gccaccggcgccaacgcgctggata

SEQ ID NO: 675625 - DNA, 25 bp, Artificial sequence
  Synthetic oligonucleotide
aagctggccaccggcgccaacgcgc

SEQ ID NO: 675626 - DNA, 25 bp, Artificial sequence
  Synthetic oligonucleotide
aggcgatccgccagaccatcgccaa

SEQ ID NO: 675627 - DNA, 25 bp, Artificial sequence
  Synthetic oligonucleotide
ggtatcgcgatcaagctggccaccg

SEQ ID NO: 675628 - DNA, 25 bp, Artificial sequence
  Synthetic oligonucleotide
agaccatcgccaacctggaaccgtt

SEQ ID NO: 675629 - DNA, 25 bp, Artificial sequence
  Synthetic oligonucleotide
agcccggcgtccggtatcgcgatca

SEQ ID NO: 675630 - DNA, 25 bp, Artificial sequence
  Synthetic oligonucleotide
ctggccatcggcttgctggtggacg

SEQ ID NO: 675631 - DNA, 25 bp, Artificial sequence
  Synthetic oligonucleotide
gtgatcgtggcgctgatcctcaccc

SEQ ID NO: 675632 - DNA, 25 bp, Artificial sequence
  Synthetic oligonucleotide
aacggcagcccggcgtccggtatcg

SEQ ID NO: 675633 - DNA, 25 bp, Artificial sequence
  Synthetic oligonucleotide
cagttcaacggcagcccggcgtccg

SEQ ID NO: 675634 - DNA, 25 bp, Artificial sequence
  Synthetic oligonucleotide
aacgcgcagttcaacggcagcccgg

SEQ ID NO: 675635 - DNA, 25 bp, Artificial sequence
  Synthetic oligonucleotide
gcgatcaagctggccaccggcgcca

SEQ ID NO: 675636 - DNA, 25 bp, Artificial sequence
  Synthetic oligonucleotide
caccaccccggtggtctcggcctcg

SEQ ID NO: 675637 - DNA, 25 bp, Artificial sequence
  Synthetic oligonucleotide
agaccctcggcgaggcgatcctcct

SEQ ID NO: 675638 - DNA, 25 bp, Artificial sequence
  Synthetic oligonucleotide
tagtgaagaccctcggcgaggcgat

SEQ ID NO: 675639 - DNA, 25 bp, Artificial sequence
  Synthetic oligonucleotide
tgaggtagtgaagaccctcggcgag

SEQ ID NO: 675640 - DNA, 25 bp, Artificial sequence
  Synthetic oligonucleotide
gatccatgaggtagtgaagaccctc

SEQ ID NO: 675641 - DNA, 25 bp, Artificial sequence
  Synthetic oligonucleotide
ggcctcgatccatgaggtagtgaag

SEQ ID NO: 675642 - DNA, 25 bp, Artificial sequence
  Synthetic oligonucleotide
tggataccgccaaggcgatccgcca

SEQ ID NO: 675643 - DNA, 25 bp, Artificial sequence
  Synthetic oligonucleotide
cccggtggtctcggcctcgatccat

SEQ ID NO: 675644 - DNA, 25 bp, Artificial sequence
  Synthetic oligonucleotide
tcggcgaggcgatcctcctcgtgtt

SEQ ID NO: 675645 - DNA, 25 bp, Artificial sequence
  Synthetic oligonucleotide
ggcatgaaggtggtctacccgtacg

SEQ ID NO: 675646 - DNA, 25 bp, Artificial sequence
  Synthetic oligonucleotide
ccgcagggcatgaaggtggtctacc

SEQ ID NO: 675647 - DNA, 25 bp, Artificial sequence
  Synthetic oligonucleotide
ttcatgccgcagggcatgaaggtgg

SEQ ID NO: 675648 - DNA, 25 bp, Artificial sequence
  Synthetic oligonucleotide
aaccgttcatgccgcagggcatgaa

SEQ ID NO: 675649 - DNA, 25 bp, Artificial sequence
  Synthetic oligonucleotide
acctggaaccgttcatgccgcaggg

SEQ ID NO: 675650 - DNA, 25 bp, Artificial sequence
  Synthetic oligonucleotide
tcgccaacctggaaccgttcatgcc

SEQ ID NO: 675651 - DNA, 25 bp, Artificial sequence
  Synthetic oligonucleotide
ggtctcggcctcgatccatgaggta

SEQ ID NO: 675652 - DNA, 25 bp, Artificial sequence
  Synthetic oligonucleotide
ctgatcctcaccccggcgctctgcg

SEQ ID NO: 675653 - DNA, 25 bp, Artificial sequence
  Synthetic oligonucleotide
ggcagttctccatcaccatcgtgtc

SEQ ID NO: 675654 - DNA, 25 bp, Artificial sequence
  Synthetic oligonucleotide
agccgatcgagaaaggcgaccatgg

SEQ ID NO: 675655 - DNA, 25 bp, Artificial sequence
  Synthetic oligonucleotide
tgctcaagccgatcgagaaaggcga

SEQ ID NO: 675656 - DNA, 25 bp, Artificial sequence
  Synthetic oligonucleotide
cgaccatgctcaagccgatcgagaa

SEQ ID NO: 675657 - DNA, 25 bp, Artificial sequence
  Synthetic oligonucleotide
tctgcgcgaccatgctcaagccgat

SEQ ID NO: 675658 - DNA, 25 bp, Artificial sequence
  Synthetic oligonucleotide
aaaggcgaccatggcgagcacaagg

SEQ ID NO: 675659 - DNA, 25 bp, Artificial sequence
  Synthetic oligonucleotide
ctcaccccggcgctctgcgcgacca

SEQ ID NO: 675660 - DNA, 25 bp, Artificial sequence
  Synthetic oligonucleotide
accatggcgagcacaagggcggctt

SEQ ID NO: 675661 - DNA, 25 bp, Artificial sequence
  Synthetic oligonucleotide
gtggcgctgatcctcaccccggcgc

SEQ ID NO: 675662 - DNA, 25 bp, Artificial sequence
  Synthetic oligonucleotide
tctcggtgatcgtggcgctgatcct

SEQ ID NO: 675663 - DNA, 25 bp, Artificial sequence
  Synthetic oligonucleotide
cggccatggccctctcggtgatcgt

SEQ ID NO: 675664 - DNA, 25 bp, Artificial sequence
  Synthetic oligonucleotide
tcgtgtcggccatggccctctcggt

SEQ ID NO: 675665 - DNA, 25 bp, Artificial sequence
  Synthetic oligonucleotide
tcaccatcgtgtcggccatggccct

SEQ ID NO: 675666 - DNA, 25 bp, Artificial sequence
  Synthetic oligonucleotide
tggccctctcggtgatcgtggcgct

SEQ ID NO: 675667 - DNA, 25 bp, Artificial sequence
  Synthetic oligonucleotide
ccggcgctctgcgcgaccatgctca

SEQ ID NO: 675668 - DNA, 25 bp, Artificial sequence
  Synthetic oligonucleotide
cggatgttcctttccaccacccacg

SEQ ID NO: 675669 - DNA, 25 bp, Artificial sequence
  Synthetic oligonucleotide
ggctacgagcggggcgtggcgtcga

SEQ ID NO: 675670 - DNA, 25 bp, Artificial sequence
  Synthetic oligonucleotide
caggcgtccgtcgaaaaggggcaat

SEQ ID NO: 675671 - DNA, 25 bp, Artificial sequence
  Synthetic oligonucleotide
acccacggctacgagcggggcgtgg

SEQ ID NO: 675672 - DNA, 25 bp, Artificial sequence
  Synthetic oligonucleotide
atcgcccaggtccaggtgcagaaca

SEQ ID NO: 675673 - DNA, 25 bp, Artificial sequence
  Synthetic oligonucleotide
gccaggactacagcatcaacgcgca

SEQ ID NO: 675674 - DNA, 25 bp, Artificial sequence
  Synthetic oligonucleotide
tcgagaaaggcgaccatggcgagca

SEQ ID NO: 675675 - DNA, 25 bp, Artificial sequence
  Synthetic oligonucleotide
tcctttccaccacccacggctacga

SEQ ID NO: 675676 - DNA, 25 bp, Artificial sequence
  Synthetic oligonucleotide
tctaccggcagttctccatcaccat

SEQ ID NO: 675677 - DNA, 25 bp, Artificial sequence
  Synthetic oligonucleotide
tcaaccggatgttcctttccaccac

SEQ ID NO: 675678 - DNA, 25 bp, Artificial sequence
  Synthetic oligonucleotide
gctggttcaaccggatgttcctttc

SEQ ID NO: 675679 - DNA, 25 bp, Artificial sequence
  Synthetic oligonucleotide
tcttcggctggttcaaccggatgtt

SEQ ID NO: 675680 - DNA, 25 bp, Artificial sequence
  Synthetic oligonucleotide
gcggcttcttcggctggttcaaccg

SEQ ID NO: 675681 - DNA, 25 bp, Artificial sequence
  Synthetic oligonucleotide
acaagggcggcttcttcggctggtt

SEQ ID NO: 675682 - DNA, 25 bp, Artificial sequence
  Synthetic oligonucleotide
gcgagcacaagggcggcttcttcgg

SEQ ID NO: 675683 - DNA, 25 bp, Artificial sequence
  Synthetic oligonucleotide
tccaccacccacggctacgagcggg

SEQ ID NO: 675684 - DNA, 25 bp, Artificial sequence
  Synthetic oligonucleotide
cgtcgagcgggtgatggccgaggaa

SEQ ID NO: 675685 - DNA, 25 bp, Artificial sequence
  Synthetic oligonucleotide
tctccatcaccatcgtgtcggccat

SEQ ID NO: 675686 - DNA, 25 bp, Artificial sequence
  Synthetic oligonucleotide
ggaggcggcgcgcaagtccatgggc

SEQ ID NO: 675687 - DNA, 25 bp, Artificial sequence
  Synthetic oligonucleotide
cgccaagggaggcggcgcgcaagtc

SEQ ID NO: 675688 - DNA, 25 bp, Artificial sequence
  Synthetic oligonucleotide
gcctgtcgccaagggaggcggcgcg

SEQ ID NO: 675689 - DNA, 25 bp, Artificial sequence
  Synthetic oligonucleotide
aggaaggcctgtcgccaagggaggc

SEQ ID NO: 675690 - DNA, 25 bp, Artificial sequence
  Synthetic oligonucleotide
aagtccatgggccagatccagggcg

SEQ ID NO: 675691 - DNA, 25 bp, Artificial sequence
  Synthetic oligonucleotide
cgggtgatggccgaggaaggcctgt

SEQ ID NO: 675692 - DNA, 25 bp, Artificial sequence
  Synthetic oligonucleotide
atgggccagatccagggcgcgctgg

SEQ ID NO: 675693 - DNA, 25 bp, Artificial sequence
  Synthetic oligonucleotide
ggagaacgtcgagcgggtgatggcc

SEQ ID NO: 675694 - DNA, 25 bp, Artificial sequence
  Synthetic oligonucleotide
gtggtggagaacgtcgagcgggtga

SEQ ID NO: 675695 - DNA, 25 bp, Artificial sequence
  Synthetic oligonucleotide
atcgtggtggtggagaacgtcgagc

SEQ ID NO: 675696 - DNA, 25 bp, Artificial sequence
  Synthetic oligonucleotide
gacgccatcgtggtggtggagaacg

SEQ ID NO: 675697 - DNA, 25 bp, Artificial sequence
  Synthetic oligonucleotide
gtggacgacgccatcgtggtggtgg

SEQ ID NO: 675698 - DNA, 25 bp, Artificial sequence
  Synthetic oligonucleotide
ttgctggtggacgacgccatcgtgg

SEQ ID NO: 675699 - DNA, 25 bp, Artificial sequence
  Synthetic oligonucleotide
atggccgaggaaggcctgtcgccaa

SEQ ID NO: 675700 - DNA, 25 bp, Artificial sequence
  Synthetic oligonucleotide
ctctcggcggtattcctgccgatgg

SEQ ID NO: 675701 - DNA, 25 bp, Artificial sequence
  Synthetic oligonucleotide
gggtgatctaccggcagttctccat

SEQ ID NO: 675702 - DNA, 25 bp, Artificial sequence
  Synthetic oligonucleotide
ccaccggggtgatctaccggcagtt

SEQ ID NO: 675703 - DNA, 25 bp, Artificial sequence
  Synthetic oligonucleotide
gcggctccaccggggtgatctaccg

SEQ ID NO: 675704 - DNA, 25 bp, Artificial sequence
  Synthetic oligonucleotide
ttcttcggcggctccaccggggtga

SEQ ID NO: 675705 - DNA, 25 bp, Artificial sequence
  Synthetic oligonucleotide
ccgatggcgttcttcggcggctcca

SEQ ID NO: 675706 - DNA, 25 bp, Artificial sequence
  Synthetic oligonucleotide
ggcgcgcaagtccatgggccagatc

SEQ ID NO: 675707 - DNA, 25 bp, Artificial sequence
  Synthetic oligonucleotide
ggcggtattcctgccgatggcgttc

SEQ ID NO: 675708 - DNA, 25 bp, Artificial sequence
  Synthetic oligonucleotide
atcggcttgctggtggacgacgcca

SEQ ID NO: 675709 - DNA, 25 bp, Artificial sequence
  Synthetic oligonucleotide
atggtgctctcggcggtattcctgc

SEQ ID NO: 675710 - DNA, 25 bp, Artificial sequence
  Synthetic oligonucleotide
tcgccatggtgctctcggcggtatt

SEQ ID NO: 675711 - DNA, 25 bp, Artificial sequence
  Synthetic oligonucleotide
tcggtatcgccatggtgctctcggc

SEQ ID NO: 675712 - DNA, 25 bp, Artificial sequence
  Synthetic oligonucleotide
cgctggtcggtatcgccatggtgct

SEQ ID NO: 675713 - DNA, 25 bp, Artificial sequence
  Synthetic oligonucleotide
agggcgcgctggtcggtatcgccat

SEQ ID NO: 675714 - DNA, 25 bp, Artificial sequence
  Synthetic oligonucleotide
agatccagggcgcgctggtcggtat

SEQ ID NO: 675715 - DNA, 25 bp, Artificial sequence
  Synthetic oligonucleotide
attcctgccgatggcgttcttcggc

SEQ ID NO: 675716 - DNA, 25 bp, Artificial sequence
  Synthetic oligonucleotide
aactggccaccccgctactgccgca

SEQ ID NO: 675717 - DNA, 25 bp, Artificial sequence
  Synthetic oligonucleotide
gctacatctcctcggagagtaactc

SEQ ID NO: 675718 - DNA, 25 bp, Artificial sequence
  Synthetic oligonucleotide
tctcctcggagagtaactccgacgg

SEQ ID NO: 675719 - DNA, 25 bp, Artificial sequence
  Synthetic oligonucleotide
cggagagtaactccgacggcagcat

SEQ ID NO: 675720 - DNA, 25 bp, Artificial sequence
  Synthetic oligonucleotide
gtaactccgacggcagcatgaccat

SEQ ID NO: 675721 - DNA, 25 bp, Artificial sequence
  Synthetic oligonucleotide
ccgacggcagcatgaccatcaccgt

SEQ ID NO: 675722 - DNA, 25 bp, Artificial sequence
  Synthetic oligonucleotide
tgaccatcaccgtgaccttcgaaca

SEQ ID NO: 675723 - DNA, 25 bp, Artificial sequence
  Synthetic oligonucleotide
tcaccgtgaccttcgaacagggcac

SEQ ID NO: 675724 - DNA, 25 bp, Artificial sequence
  Synthetic oligonucleotide
gtgaccttcgaacagggcaccgacc

SEQ ID NO: 675725 - DNA, 25 bp, Artificial sequence
  Synthetic oligonucleotide
ttcgaacagggcaccgaccccgaca

SEQ ID NO: 675726 - DNA, 25 bp, Artificial sequence
  Synthetic oligonucleotide
acagggcaccgaccccgacatcgcc

SEQ ID NO: 675727 - DNA, 25 bp, Artificial sequence
  Synthetic oligonucleotide
caccgaccccgacatcgcccaggtc

SEQ ID NO: 675728 - DNA, 25 bp, Artificial sequence
  Synthetic oligonucleotide
cccgacatcgcccaggtccaggtgc

SEQ ID NO: 675729 - DNA, 25 bp, Artificial sequence
  Synthetic oligonucleotide
caggtccaggtgcagaacaagctgc

SEQ ID NO: 675730 - DNA, 25 bp, Artificial sequence
  Synthetic oligonucleotide
gtggtttccaccgacggcagcatga

SEQ ID NO: 675731 - DNA, 25 bp, Artificial sequence
  Synthetic oligonucleotide
gccaggggatccgggtgaccaaggc

SEQ ID NO: 675732 - DNA, 25 bp, Artificial sequence
  Synthetic oligonucleotide
caggtgcagaacaagctgcaactgg

SEQ ID NO: 675733 - DNA, 25 bp, Artificial sequence
  Synthetic oligonucleotide
ctcatggtggtcggtgtggtttcca

SEQ ID NO: 675734 - DNA, 25 bp, Artificial sequence
  Synthetic oligonucleotide
aacttcctcatggtggtcggtgtgg

SEQ ID NO: 675735 - DNA, 25 bp, Artificial sequence
  Synthetic oligonucleotide
gtgaagaacttcctcatggtggtcg

SEQ ID NO: 675736 - DNA, 25 bp, Artificial sequence
  Synthetic oligonucleotide
aaggcggtgaagaacttcctcatgg

SEQ ID NO: 675737 - DNA, 25 bp, Artificial sequence
  Synthetic oligonucleotide
cagaacaagctgcaactggccaccc

SEQ ID NO: 675738 - DNA, 25 bp, Artificial sequence
  Synthetic oligonucleotide
ggatccgggtgaccaaggcggtgaa

SEQ ID NO: 675739 - DNA, 25 bp, Artificial sequence
  Synthetic oligonucleotide
agctgcaactggccaccccgctact

SEQ ID NO: 675740 - DNA, 25 bp, Artificial sequence
  Synthetic oligonucleotide
tgcagcgccaggggatccgggtgac

SEQ ID NO: 675741 - DNA, 25 bp, Artificial sequence
  Synthetic oligonucleotide
aggaagtgcagcgccaggggatccg

SEQ ID NO: 675742 - DNA, 25 bp, Artificial sequence
  Synthetic oligonucleotide
tgccgcaggaagtgcagcgccaggg

SEQ ID NO: 675743 - DNA, 25 bp, Artificial sequence
  Synthetic oligonucleotide
cgctactgccgcaggaagtgcagcg

SEQ ID NO: 675744 - DNA, 25 bp, Artificial sequence
  Synthetic oligonucleotide
ccaccccgctactgccgcaggaagt

SEQ ID NO: 675745 - DNA, 25 bp, Artificial sequence
  Synthetic oligonucleotide
acgggatcgacaatctgcgctacat

SEQ ID NO: 675746 - DNA, 25 bp, Artificial sequence
  Synthetic oligonucleotide
ggtgaccaaggcggtgaagaacttc

SEQ ID NO: 675747 - DNA, 25 bp, Artificial sequence
  Synthetic oligonucleotide
ggcggcctgtcgatcctcagtctgc

SEQ ID NO: 675748 - DNA, 25 bp, Artificial sequence
  Synthetic oligonucleotide
atctgcgctacatctcctcggagag

SEQ ID NO: 675749 - DNA, 25 bp, Artificial sequence
  Synthetic oligonucleotide
tacccggccatcgccccgccggcca

SEQ ID NO: 675750 - DNA, 25 bp, Artificial sequence
  Synthetic oligonucleotide
caaccagtacccggccatcgccccg

SEQ ID NO: 675751 - DNA, 25 bp, Artificial sequence
  Synthetic oligonucleotide
ccggtcaaccagtacccggccatcg

SEQ ID NO: 675752 - DNA, 25 bp, Artificial sequence
  Synthetic oligonucleotide
agtctgccggtcaaccagtacccgg

SEQ ID NO: 675753 - DNA, 25 bp, Artificial sequence
  Synthetic oligonucleotide
gccccgccggccatcgccgtgcagg

SEQ ID NO: 675754 - DNA, 25 bp, Artificial sequence
  Synthetic oligonucleotide
ctgtcgatcctcagtctgccggtca

SEQ ID NO: 675755 - DNA, 25 bp, Artificial sequence
  Synthetic oligonucleotide
cggccatcgccgtgcaggtgagcta

SEQ ID NO: 675756 - DNA, 25 bp, Artificial sequence
  Synthetic oligonucleotide
tcgcgggcggcctgtcgatcctcag

SEQ ID NO: 675757 - DNA, 25 bp, Artificial sequence
  Synthetic oligonucleotide
tcatgctcgcgggcggcctgtcgat

SEQ ID NO: 675758 - DNA, 25 bp, Artificial sequence
  Synthetic oligonucleotide
tggtgatcatgctcgcgggcggcct

SEQ ID NO: 675759 - DNA, 25 bp, Artificial sequence
  Synthetic oligonucleotide
tgtccggctcgcaggcgccggcgct

SEQ ID NO: 675760 - DNA, 25 bp, Artificial sequence
  Synthetic oligonucleotide
tcgccttggtgatcatgctcgcggg

SEQ ID NO: 675761 - DNA, 25 bp, Artificial sequence
  Synthetic oligonucleotide
gggtgatcgccttggtgatcatgct

SEQ ID NO: 675762 - DNA, 25 bp, Artificial sequence
  Synthetic oligonucleotide
atcctcagtctgccggtcaaccagt

SEQ ID NO: 675763 - DNA, 25 bp, Artificial sequence
  Synthetic oligonucleotide
acggtgcaggacaccgtggtccagg

SEQ ID NO: 675764 - DNA, 25 bp, Artificial sequence
  Synthetic oligonucleotide
tccaccgacggcagcatgaccaagg

SEQ ID NO: 675765 - DNA, 25 bp, Artificial sequence
  Synthetic oligonucleotide
agatgaacgggatcgacaatctgcg

SEQ ID NO: 675766 - DNA, 25 bp, Artificial sequence
  Synthetic oligonucleotide
agcagcagatgaacgggatcgacaa

SEQ ID NO: 675767 - DNA, 25 bp, Artificial sequence
  Synthetic oligonucleotide
tgatcgagcagcagatgaacgggat

SEQ ID NO: 675768 - DNA, 25 bp, Artificial sequence
  Synthetic oligonucleotide
gtccaggtgatcgagcagcagatga

SEQ ID NO: 675769 - DNA, 25 bp, Artificial sequence
  Synthetic oligonucleotide
gccatcgccccgccggccatcgccg

SEQ ID NO: 675770 - DNA, 25 bp, Artificial sequence
  Synthetic oligonucleotide
caggacaccgtggtccaggtgatcg

SEQ ID NO: 675771 - DNA, 25 bp, Artificial sequence
  Synthetic oligonucleotide
tcgacaatctgcgctacatctcctc

SEQ ID NO: 675772 - DNA, 25 bp, Artificial sequence
  Synthetic oligonucleotide
gccgagacggtgcaggacaccgtgg

SEQ ID NO: 675773 - DNA, 25 bp, Artificial sequence
  Synthetic oligonucleotide
gcctcggccgagacggtgcaggaca

SEQ ID NO: 675774 - DNA, 25 bp, Artificial sequence
  Synthetic oligonucleotide
cccgggcgcctcggccgagacggtg

SEQ ID NO: 675775 - DNA, 25 bp, Artificial sequence
  Synthetic oligonucleotide
tgagctacccgggcgcctcggccga

SEQ ID NO: 675776 - DNA, 25 bp, Artificial sequence
  Synthetic oligonucleotide
tgcaggtgagctacccgggcgcctc

SEQ ID NO: 675777 - DNA, 25 bp, Artificial sequence
  Synthetic oligonucleotide
atcgccgtgcaggtgagctacccgg

SEQ ID NO: 675778 - DNA, 25 bp, Artificial sequence
  Synthetic oligonucleotide
accgtggtccaggtgatcgagcagc

SEQ ID NO: 675779 - DNA, 25 bp, Artificial sequence
  Synthetic oligonucleotide
agaccgcggagcaattcgagaacat

SEQ ID NO: 675780 - DNA, 25 bp, Artificial sequence
  Synthetic oligonucleotide
agaacgtgcagatttcctccggcca

SEQ ID NO: 675781 - DNA, 25 bp, Artificial sequence
  Synthetic oligonucleotide
tgcagatttcctccggccagctcgg

SEQ ID NO: 675782 - DNA, 25 bp, Artificial sequence
  Synthetic oligonucleotide
tttcctccggccagctcggcggctt

SEQ ID NO: 675783 - DNA, 25 bp, Artificial sequence
  Synthetic oligonucleotide
ccggccagctcggcggcttgccggc

SEQ ID NO: 675784 - DNA, 25 bp, Artificial sequence
  Synthetic oligonucleotide
gctcggcggcttgccggcggtcaag

SEQ ID NO: 675785 - DNA, 25 bp, Artificial sequence
  Synthetic oligonucleotide
ggcttgccggcggtcaagggccagc

SEQ ID NO: 675786 - DNA, 25 bp, Artificial sequence
  Synthetic oligonucleotide
cggcggtcaagggccagcagctcaa

SEQ ID NO: 675787 - DNA, 25 bp, Artificial sequence
  Synthetic oligonucleotide
gtcaagggccagcagctcaacgcca

SEQ ID NO: 675788 - DNA, 25 bp, Artificial sequence
  Synthetic oligonucleotide
ggccagcagctcaacgccaccatca

SEQ ID NO: 675789 - DNA, 25 bp, Artificial sequence
  Synthetic oligonucleotide
cagctcaacgccaccatcatcggca

SEQ ID NO: 675790 - DNA, 25 bp, Artificial sequence
  Synthetic oligonucleotide
aacgccaccatcatcggcaagaccc

SEQ ID NO: 675791 - DNA, 25 bp, Artificial sequence
  Synthetic oligonucleotide
accatcatcggcaagacccgcctgc

SEQ ID NO: 675792 - DNA, 25 bp, Artificial sequence
  Synthetic oligonucleotide
atcggcaagacccgcctgcagaccg

SEQ ID NO: 675793 - DNA, 25 bp, Artificial sequence
  Synthetic oligonucleotide
gtcggtgtggtttccaccgacggca

SEQ ID NO: 675794 - DNA, 25 bp, Artificial sequence
  Synthetic oligonucleotide
caatcccgacggttcccaggtgcgc

SEQ ID NO: 675795 - DNA, 25 bp, Artificial sequence
  Synthetic oligonucleotide
gtaggcctgggcggccaggactaca

SEQ ID NO: 675796 - DNA, 25 bp, Artificial sequence
  Synthetic oligonucleotide
gccgatgtaggcctgggcggccagg

SEQ ID NO: 675797 - DNA, 25 bp, Artificial sequence
  Synthetic oligonucleotide
ggacgtcgccgatgtaggcctgggc

SEQ ID NO: 675798 - DNA, 25 bp, Artificial sequence
  Synthetic oligonucleotide
ctgaaggacgtcgccgatgtaggcc

SEQ ID NO: 675799 - DNA, 25 bp, Artificial sequence
  Synthetic oligonucleotide
gtgcgcctgaaggacgtcgccgatg

SEQ ID NO: 675800 - DNA, 25 bp, Artificial sequence
  Synthetic oligonucleotide
aagacccgcctgcagaccgcggagc

SEQ ID NO: 675801 - DNA, 25 bp, Artificial sequence
  Synthetic oligonucleotide
cgacggttcccaggtgcgcctgaag

SEQ ID NO: 675802 - DNA, 25 bp, Artificial sequence
  Synthetic oligonucleotide
gcctgcagaccgcggagcaattcga

SEQ ID NO: 675803 - DNA, 25 bp, Artificial sequence
  Synthetic oligonucleotide
caaggtcaatcccgacggttcccag

SEQ ID NO: 675804 - DNA, 25 bp, Artificial sequence
  Synthetic oligonucleotide
cctgctcaaggtcaatcccgacggt

SEQ ID NO: 675805 - DNA, 25 bp, Artificial sequence
  Synthetic oligonucleotide
agaacatcctgctcaaggtcaatcc

SEQ ID NO: 675806 - DNA, 25 bp, Artificial sequence
  Synthetic oligonucleotide
aattcgagaacatcctgctcaaggt

SEQ ID NO: 675807 - DNA, 25 bp, Artificial sequence
  Synthetic oligonucleotide
cggagcaattcgagaacatcctgct

SEQ ID NO: 675808 - DNA, 25 bp, Artificial sequence
  Synthetic oligonucleotide
gcagcgcgatccaggcgcagaacgt

SEQ ID NO: 675809 - DNA, 25 bp, Artificial sequence
  Synthetic oligonucleotide
ttcccaggtgcgcctgaaggacgtc

SEQ ID NO: 675810 - DNA, 25 bp, Artificial sequence
  Synthetic oligonucleotide
tcgtttccaacatccaggacccact

SEQ ID NO: 675811 - DNA, 25 bp, Artificial sequence
  Synthetic oligonucleotide
aggcgcagaacgtgcagatttcctc

SEQ ID NO: 675812 - DNA, 25 bp, Artificial sequence
  Synthetic oligonucleotide
aagggcgtcggtgacttccaggtgt

SEQ ID NO: 675813 - DNA, 25 bp, Artificial sequence
  Synthetic oligonucleotide
ggaccaagggcgtcggtgacttcca

SEQ ID NO: 675814 - DNA, 25 bp, Artificial sequence
  Synthetic oligonucleotide
tctcgcggaccaagggcgtcggtga

SEQ ID NO: 675815 - DNA, 25 bp, Artificial sequence
  Synthetic oligonucleotide
acccactctcgcggaccaagggcgt

SEQ ID NO: 675816 - DNA, 25 bp, Artificial sequence
  Synthetic oligonucleotide
acttccaggtgttcggctcgcagta

SEQ ID NO: 675817 - DNA, 25 bp, Artificial sequence
  Synthetic oligonucleotide
ccaacatccaggacccactctcgcg

SEQ ID NO: 675818 - DNA, 25 bp, Artificial sequence
  Synthetic oligonucleotide
aggtgttcggctcgcagtactcgat

SEQ ID NO: 675819 - DNA, 25 bp, Artificial sequence
  Synthetic oligonucleotide
actacatcgtttccaacatccagga

SEQ ID NO: 675820 - DNA, 25 bp, Artificial sequence
  Synthetic oligonucleotide
tgtcgaactacatcgtttccaacat

SEQ ID NO: 675821 - DNA, 25 bp, Artificial sequence
  Synthetic oligonucleotide
aagacctgtcgaactacatcgtttc

SEQ ID NO: 675822 - DNA, 25 bp, Artificial sequence
  Synthetic oligonucleotide
ccaaggaagacctgtcgaactacat

SEQ ID NO: 675823 - DNA, 25 bp, Artificial sequence
  Synthetic oligonucleotide
gcatgaccaaggaagacctgtcgaa

SEQ ID NO: 675824 - DNA, 25 bp, Artificial sequence
  Synthetic oligonucleotide
acggcagcatgaccaaggaagacct

SEQ ID NO: 675825 - DNA, 25 bp, Artificial sequence
  Synthetic oligonucleotide
tccaggacccactctcgcggaccaa

SEQ ID NO: 675826 - DNA, 25 bp, Artificial sequence
  Synthetic oligonucleotide
cggccaagctgaacagctaccagct

SEQ ID NO: 675827 - DNA, 25 bp, Artificial sequence
  Synthetic oligonucleotide
ctgggcggccaggactacagcatca

SEQ ID NO: 675828 - DNA, 25 bp, Artificial sequence
  Synthetic oligonucleotide
gacgtgagcagcgcgatccaggcgc

SEQ ID NO: 675829 - DNA, 25 bp, Artificial sequence
  Synthetic oligonucleotide
cccggcgacgtgagcagcgcgatcc

SEQ ID NO: 675830 - DNA, 25 bp, Artificial sequence
  Synthetic oligonucleotide
ctgacccccggcgacgtgagcagcg

SEQ ID NO: 675831 - DNA, 25 bp, Artificial sequence
  Synthetic oligonucleotide
taccagctgacccccggcgacgtga

SEQ ID NO: 675832 - DNA, 25 bp, Artificial sequence
  Synthetic oligonucleotide
tcggtgacttccaggtgttcggctc

SEQ ID NO: 675833 - DNA, 25 bp, Artificial sequence
  Synthetic oligonucleotide
aagctgaacagctaccagctgaccc

SEQ ID NO: 675834 - DNA, 25 bp, Artificial sequence
  Synthetic oligonucleotide
cgatccaggcgcagaacgtgcagat

SEQ ID NO: 675835 - DNA, 25 bp, Artificial sequence
  Synthetic oligonucleotide
tcgacccggccaagctgaacagcta

SEQ ID NO: 675836 - DNA, 25 bp, Artificial sequence
  Synthetic oligonucleotide
atctggctcgacccggccaagctga

SEQ ID NO: 675837 - DNA, 25 bp, Artificial sequence
  Synthetic oligonucleotide
atgcgcatctggctcgacccggcca

SEQ ID NO: 675838 - DNA, 25 bp, Artificial sequence
  Synthetic oligonucleotide
tactcgatgcgcatctggctcgacc

SEQ ID NO: 675839 - DNA, 25 bp, Artificial sequence
  Synthetic oligonucleotide
cgcagtactcgatgcgcatctggct

SEQ ID NO: 675840 - DNA, 25 bp, Artificial sequence
  Synthetic oligonucleotide
tcggctcgcagtactcgatgcgcat

SEQ ID NO: 675841 - DNA, 25 bp, Artificial sequence
  Synthetic oligonucleotide
aacagctaccagctgacccccggcg

SEQ ID NO: 675842 - DNA, 25 bp, Artificial sequence
  Synthetic oligonucleotide
tggcggccctgtacgaaagctggtc

SEQ ID NO: 675843 - DNA, 25 bp, Artificial sequence
  Synthetic oligonucleotide
gttggctactcctggaccggcctgt

SEQ ID NO: 675844 - DNA, 25 bp, Artificial sequence
  Synthetic oligonucleotide
tactcctggaccggcctgtcctacg

SEQ ID NO: 675845 - DNA, 25 bp, Artificial sequence
  Synthetic oligonucleotide
tggaccggcctgtcctacgaggagc

SEQ ID NO: 675846 - DNA, 25 bp, Artificial sequence
  Synthetic oligonucleotide
ggcctgtcctacgaggagcgcttgt

SEQ ID NO: 675847 - DNA, 25 bp, Artificial sequence
  Synthetic oligonucleotide
gtcctacgaggagcgcttgtccggc

SEQ ID NO: 675848 - DNA, 25 bp, Artificial sequence
  Synthetic oligonucleotide
agcgcttgtccggctcgcaggcgcc

SEQ ID NO: 675849 - DNA, 25 bp, Artificial sequence
  Synthetic oligonucleotide
gctcgcaggcgccggcgctgtatgc

SEQ ID NO: 675850 - DNA, 25 bp, Artificial sequence
  Synthetic oligonucleotide
aggcgccggcgctgtatgcgctgtc

SEQ ID NO: 675851 - DNA, 25 bp, Artificial sequence
  Synthetic oligonucleotide
cggcgctgtatgcgctgtcgctgct

SEQ ID NO: 675852 - DNA, 25 bp, Artificial sequence
  Synthetic oligonucleotide
tgtatgcgctgtcgctgctggtggt

SEQ ID NO: 675853 - DNA, 25 bp, Artificial sequence
  Synthetic oligonucleotide
cgctgtcgctgctggtggtgttcct

SEQ ID NO: 675854 - DNA, 25 bp, Artificial sequence
  Synthetic oligonucleotide
cgctgctggtggtgttcctctgcct

SEQ ID NO: 675855 - DNA, 25 bp, Artificial sequence
  Synthetic oligonucleotide
tggtggtgttcctctgcctggcggc

SEQ ID NO: 675856 - DNA, 25 bp, Artificial sequence
  Synthetic oligonucleotide
atgcgcggcctgtccaacgacgtgt

SEQ ID NO: 675857 - DNA, 25 bp, Artificial sequence
  Synthetic oligonucleotide
cggtgatgctggtggtgccgttggg

SEQ ID NO: 675858 - DNA, 25 bp, Artificial sequence
  Synthetic oligonucleotide
gtacgtgcgcaacgacaagggcgag

SEQ ID NO: 675859 - DNA, 25 bp, Artificial sequence
  Synthetic oligonucleotide
ctggcgacgtccatgcgcggcctgt

SEQ ID NO: 675860 - DNA, 25 bp, Artificial sequence
  Synthetic oligonucleotide
tgcgctgctggcgacgtccatgcgc

SEQ ID NO: 675861 - DNA, 25 bp, Artificial sequence
  Synthetic oligonucleotide
tgatcggtgcgctgctggcgacgtc

SEQ ID NO: 675862 - DNA, 25 bp, Artificial sequence
  Synthetic oligonucleotide
tgggcgtgatcggtgcgctgctggc

SEQ ID NO: 675863 - DNA, 25 bp, Artificial sequence
  Synthetic oligonucleotide
tgttcctctgcctggcggccctgta

SEQ ID NO: 675864 - DNA, 25 bp, Artificial sequence
  Synthetic oligonucleotide
gctggtggtgccgttgggcgtgatc

SEQ ID NO: 675865 - DNA, 25 bp, Artificial sequence
  Synthetic oligonucleotide
tctgcctggcggccctgtacgaaag

SEQ ID NO: 675866 - DNA, 25 bp, Artificial sequence
  Synthetic oligonucleotide
cgttctcggtgatgctggtggtgcc

SEQ ID NO: 675867 - DNA, 25 bp, Artificial sequence
  Synthetic oligonucleotide
cgattccgttctcggtgatgctggt

SEQ ID NO: 675868 - DNA, 25 bp, Artificial sequence
  Synthetic oligonucleotide
gctggtcgattccgttctcggtgat

SEQ ID NO: 675869 - DNA, 25 bp, Artificial sequence
  Synthetic oligonucleotide
acgaaagctggtcgattccgttctc

SEQ ID NO: 675870 - DNA, 25 bp, Artificial sequence
  Synthetic oligonucleotide
ccctgtacgaaagctggtcgattcc

SEQ ID NO: 675871 - DNA, 25 bp, Artificial sequence
  Synthetic oligonucleotide
gcaattgccgaaaggcgttggctac

SEQ ID NO: 675872 - DNA, 25 bp, Artificial sequence
  Synthetic oligonucleotide
gtgccgttgggcgtgatcggtgcgc

SEQ ID NO: 675873 - DNA, 25 bp, Artificial sequence
  Synthetic oligonucleotide
ttcgccaccggcaagtgggaatacg

SEQ ID NO: 675874 - DNA, 25 bp, Artificial sequence
  Synthetic oligonucleotide
aaggcgttggctactcctggaccgg

SEQ ID NO: 675875 - DNA, 25 bp, Artificial sequence
  Synthetic oligonucleotide
agctggagcgctacaatggcgtgcc

SEQ ID NO: 675876 - DNA, 25 bp, Artificial sequence
  Synthetic oligonucleotide
cgccgaagctggagcgctacaatgg

SEQ ID NO: 675877 - DNA, 25 bp, Artificial sequence
  Synthetic oligonucleotide
acggttcgccgaagctggagcgcta

SEQ ID NO: 675878 - DNA, 25 bp, Artificial sequence
  Synthetic oligonucleotide
gggaatacggttcgccgaagctgga

SEQ ID NO: 675879 - DNA, 25 bp, Artificial sequence
  Synthetic oligonucleotide
acaatggcgtgccggcgatggagat

SEQ ID NO: 675880 - DNA, 25 bp, Artificial sequence
  Synthetic oligonucleotide
caccggcaagtgggaatacggttcg

SEQ ID NO: 675881 - DNA, 25 bp, Artificial sequence
  Synthetic oligonucleotide
gcgtgccggcgatggagatcctcgg

SEQ ID NO: 675882 - DNA, 25 bp, Artificial sequence
  Synthetic oligonucleotide
aacgccttcgccaccggcaagtggg

SEQ ID NO: 675883 - DNA, 25 bp, Artificial sequence
  Synthetic oligonucleotide
gccgttcaacgccttcgccaccggc

SEQ ID NO: 675884 - DNA, 25 bp, Artificial sequence
  Synthetic oligonucleotide
gatggtgccgttcaacgccttcgcc

SEQ ID NO: 675885 - DNA, 25 bp, Artificial sequence
  Synthetic oligonucleotide
gggcgagatggtgccgttcaacgcc

SEQ ID NO: 675886 - DNA, 25 bp, Artificial sequence
  Synthetic oligonucleotide
cgacaagggcgagatggtgccgttc

SEQ ID NO: 675887 - DNA, 25 bp, Artificial sequence
  Synthetic oligonucleotide
acgaggagcgcttgtccggctcgca

SEQ ID NO: 675888 - DNA, 25 bp, Artificial sequence
  Synthetic oligonucleotide
gcaagtgggaatacggttcgccgaa

SEQ ID NO: 675889 - DNA, 25 bp, Artificial sequence
  Synthetic oligonucleotide
tgagttccggtgacgccatggcggc

SEQ ID NO: 675890 - DNA, 25 bp, Artificial sequence
  Synthetic oligonucleotide
gcctgtccaacgacgtgttcttcca

SEQ ID NO: 675891 - DNA, 25 bp, Artificial sequence
  Synthetic oligonucleotide
cgtcaagcaattgccgaaaggcgtt

SEQ ID NO: 675892 - DNA, 25 bp, Artificial sequence
  Synthetic oligonucleotide
gagatcgtcaagcaattgccgaaag

SEQ ID NO: 675893 - DNA, 25 bp, Artificial sequence
  Synthetic oligonucleotide
gtcgaggagatcgtcaagcaattgc

SEQ ID NO: 675894 - DNA, 25 bp, Artificial sequence
  Synthetic oligonucleotide
gcggcggtcgaggagatcgtcaagc

SEQ ID NO: 675895 - DNA, 25 bp, Artificial sequence
  Synthetic oligonucleotide
agcgctacaatggcgtgccggcgat

SEQ ID NO: 675896 - DNA, 25 bp, Artificial sequence
  Synthetic oligonucleotide
ccggtgacgccatggcggcggtcga

SEQ ID NO: 675897 - DNA, 25 bp, Artificial sequence
  Synthetic oligonucleotide
gccgaaaggcgttggctactcctgg

SEQ ID NO: 675898 - DNA, 25 bp, Artificial sequence
  Synthetic oligonucleotide
ccggcctgagttccggtgacgccat

SEQ ID NO: 675899 - DNA, 25 bp, Artificial sequence
  Synthetic oligonucleotide
cggcgcccggcctgagttccggtga

SEQ ID NO: 675900 - DNA, 25 bp, Artificial sequence
  Synthetic oligonucleotide
ggcgagccggcgcccggcctgagtt

SEQ ID NO: 675901 - DNA, 25 bp, Artificial sequence
  Synthetic oligonucleotide
gatcctcggcgagccggcgcccggc

SEQ ID NO: 675902 - DNA, 25 bp, Artificial sequence
  Synthetic oligonucleotide
atggagatcctcggcgagccggcgc

SEQ ID NO: 675903 - DNA, 25 bp, Artificial sequence
  Synthetic oligonucleotide
cggcgatggagatcctcggcgagcc

SEQ ID NO: 675904 - DNA, 25 bp, Artificial sequence
  Synthetic oligonucleotide
cgccatggcggcggtcgaggagatc

SEQ ID NO: 675905 - DNA, 25 bp, Artificial sequence
  Synthetic oligonucleotide
cctggcgatcttctgggtaccgctg

SEQ ID NO: 675906 - DNA, 25 bp, Artificial sequence
  Synthetic oligonucleotide
gtggtcccgctggcgatctccaccg

SEQ ID NO: 675907 - DNA, 25 bp, Artificial sequence
  Synthetic oligonucleotide
ccgctggcgatctccaccggcgccg

SEQ ID NO: 675908 - DNA, 25 bp, Artificial sequence
  Synthetic oligonucleotide
gcgatctccaccggcgccggctcgg

SEQ ID NO: 675909 - DNA, 25 bp, Artificial sequence
  Synthetic oligonucleotide
tccaccggcgccggctcgggcagcc

SEQ ID NO: 675910 - DNA, 25 bp, Artificial sequence
  Synthetic oligonucleotide
ggcgccggctcgggcagccagcatg

SEQ ID NO: 675911 - DNA, 25 bp, Artificial sequence
  Synthetic oligonucleotide
gctcgggcagccagcatgcgatcgg

SEQ ID NO: 675912 - DNA, 25 bp, Artificial sequence
  Synthetic oligonucleotide
ggcagccagcatgcgatcggtaccg

SEQ ID NO: 675913 - DNA, 25 bp, Artificial sequence
  Synthetic oligonucleotide
cagcatgcgatcggtaccggcgtga

SEQ ID NO: 675914 - DNA, 25 bp, Artificial sequence
  Synthetic oligonucleotide
gcgatcggtaccggcgtgatcggcg

SEQ ID NO: 675915 - DNA, 25 bp, Artificial sequence
  Synthetic oligonucleotide
ggtaccggcgtgatcggcggcatgg

SEQ ID NO: 675916 - DNA, 25 bp, Artificial sequence
  Synthetic oligonucleotide
ggcgtgatcggcggcatggtcactg

SEQ ID NO: 675917 - DNA, 25 bp, Artificial sequence
  Synthetic oligonucleotide
atcggcggcatggtcactgcgaccg

SEQ ID NO: 675918 - DNA, 25 bp, Artificial sequence
  Synthetic oligonucleotide
ggcatggtcactgcgaccgtcctgg

SEQ ID NO: 675919 - DNA, 25 bp, Artificial sequence
  Synthetic oligonucleotide
acgtccatgcgcggcctgtccaacg

SEQ ID NO: 675920 - DNA, 25 bp, Artificial sequence
  Synthetic oligonucleotide
gtcagcacgctgttcaaggacgagg

SEQ ID NO: 675921 - DNA, 25 bp, Artificial sequence
  Synthetic oligonucleotide
tcaggtcgagtcgctggcaatcgag

SEQ ID NO: 675922 - DNA, 25 bp, Artificial sequence
  Synthetic oligonucleotide
tcgcgtgggtgatcgccttggtgat

SEQ ID NO: 675923 - DNA, 25 bp, Artificial sequence
  Synthetic oligonucleotide
agcagcaggcgtccgtcgaaaaggg

SEQ ID NO: 675924 - DNA, 25 bp, Artificial sequence
  Synthetic oligonucleotide
cgtccaagcagcaggcgtccgtcga

SEQ ID NO: 675925 - DNA, 25 bp, Artificial sequence
  Synthetic oligonucleotide
gacgaggcgtccaagcagcaggcgt

SEQ ID NO: 675926 - DNA, 25 bp, Artificial sequence
  Synthetic oligonucleotide
tcactgcgaccgtcctggcgatctt

SEQ ID NO: 675927 - DNA, 25 bp, Artificial sequence
  Synthetic oligonucleotide
acgctgttcaaggacgaggcgtcca

SEQ ID NO: 675928 - DNA, 25 bp, Artificial sequence
  Synthetic oligonucleotide
gaccgtcctggcgatcttctgggta

SEQ ID NO: 675929 - DNA, 25 bp, Artificial sequence
  Synthetic oligonucleotide
gtggcggtcagcacgctgttcaagg

SEQ ID NO: 675930 - DNA, 25 bp, Artificial sequence
  Synthetic oligonucleotide
ttctacgtggcggtcagcacgctgt

SEQ ID NO: 675931 - DNA, 25 bp, Artificial sequence
  Synthetic oligonucleotide
accgctgttctacgtggcggtcagc

SEQ ID NO: 675932 - DNA, 25 bp, Artificial sequence
  Synthetic oligonucleotide
ctgggtaccgctgttctacgtggcg

SEQ ID NO: 675933 - DNA, 25 bp, Artificial sequence
  Synthetic oligonucleotide
gatcttctgggtaccgctgttctac

SEQ ID NO: 675934 - DNA, 25 bp, Artificial sequence
  Synthetic oligonucleotide
tggcgttcatcctcggcgtggtccc

SEQ ID NO: 675935 - DNA, 25 bp, Artificial sequence
  Synthetic oligonucleotide
ttcaaggacgaggcgtccaagcagc

SEQ ID NO: 675936 - DNA, 25 bp, Artificial sequence
  Synthetic oligonucleotide
ccatcggcctgtcggcgaagaacgc

SEQ ID NO: 675937 - DNA, 25 bp, Artificial sequence
  Synthetic oligonucleotide
ctcggcgtggtcccgctggcgatct

SEQ ID NO: 675938 - DNA, 25 bp, Artificial sequence
  Synthetic oligonucleotide
tggagttcgccaaggagctgcacga

SEQ ID NO: 675939 - DNA, 25 bp, Artificial sequence
  Synthetic oligonucleotide
tcatcgtggagttcgccaaggagct

SEQ ID NO: 675940 - DNA, 25 bp, Artificial sequence
  Synthetic oligonucleotide
cattctcatcgtggagttcgccaag

SEQ ID NO: 675941 - DNA, 25 bp, Artificial sequence
  Synthetic oligonucleotide
gaacgccattctcatcgtggagttc

SEQ ID NO: 675942 - DNA, 25 bp, Artificial sequence
  Synthetic oligonucleotide
aggagctgcacgagcagggcaaggg

SEQ ID NO: 675943 - DNA, 25 bp, Artificial sequence
  Synthetic oligonucleotide
gcctgtcggcgaagaacgccattct

SEQ ID NO: 675944 - DNA, 25 bp, Artificial sequence
  Synthetic oligonucleotide
tgcacgagcagggcaagggcatcgt

SEQ ID NO: 675945 - DNA, 25 bp, Artificial sequence
  Synthetic oligonucleotide
tgacgaccatcggcctgtcggcgaa

SEQ ID NO: 675946 - DNA, 25 bp, Artificial sequence
  Synthetic oligonucleotide
gcctgttgacgaccatcggcctgtc

SEQ ID NO: 675947 - DNA, 25 bp, Artificial sequence
  Synthetic oligonucleotide
aggtgggcctgttgacgaccatcgg

SEQ ID NO: 675948 - DNA, 25 bp, Artificial sequence
  Synthetic oligonucleotide
tcttccaggtgggcctgttgacgac

SEQ ID NO: 675949 - DNA, 25 bp, Artificial sequence
  Synthetic oligonucleotide
acgtgttcttccaggtgggcctgtt

SEQ ID NO: 675950 - DNA, 25 bp, Artificial sequence
  Synthetic oligonucleotide
ccaacgacgtgttcttccaggtggg

SEQ ID NO: 675951 - DNA, 25 bp, Artificial sequence
  Synthetic oligonucleotide
ggcgaagaacgccattctcatcgtg

SEQ ID NO: 675952 - DNA, 25 bp, Artificial sequence
  Synthetic oligonucleotide
agcctgccgcatgcgtctgcggccg

SEQ ID NO: 675953 - DNA, 25 bp, Artificial sequence
  Synthetic oligonucleotide
caagtggtacgtgcgcaacgacaag

SEQ ID NO: 675954 - DNA, 25 bp, Artificial sequence
  Synthetic oligonucleotide
cctccctggcgttcatcctcggcgt

SEQ ID NO: 675955 - DNA, 25 bp, Artificial sequence
  Synthetic oligonucleotide
tgatgacctccctggcgttcatcct

SEQ ID NO: 675956 - DNA, 25 bp, Artificial sequence
  Synthetic oligonucleotide
cgatcgtgatgacctccctggcgtt

SEQ ID NO: 675957 - DNA, 25 bp, Artificial sequence
  Synthetic oligonucleotide
tgcggccgatcgtgatgacctccct

SEQ ID NO: 675958 - DNA, 25 bp, Artificial sequence
  Synthetic oligonucleotide
tcgccaaggagctgcacgagcaggg

SEQ ID NO: 675959 - DNA, 25 bp, Artificial sequence
  Synthetic oligonucleotide
ccgcatgcgtctgcggccgatcgtg

SEQ ID NO: 675960 - DNA, 25 bp, Artificial sequence
  Synthetic oligonucleotide
ttcatcctcggcgtggtcccgctgg

SEQ ID NO: 675961 - DNA, 25 bp, Artificial sequence
  Synthetic oligonucleotide
catcgaagcctgccgcatgcgtctg

SEQ ID NO: 675962 - DNA, 25 bp, Artificial sequence
  Synthetic oligonucleotide
ggcggccatcgaagcctgccgcatg

SEQ ID NO: 675963 - DNA, 25 bp, Artificial sequence
  Synthetic oligonucleotide
gtcgaggcggccatcgaagcctgcc

SEQ ID NO: 675964 - DNA, 25 bp, Artificial sequence
  Synthetic oligonucleotide
ggcatcgtcgaggcggccatcgaag

SEQ ID NO: 675965 - DNA, 25 bp, Artificial sequence
  Synthetic oligonucleotide
gcaagggcatcgtcgaggcggccat

SEQ ID NO: 675966 - DNA, 25 bp, Artificial sequence
  Synthetic oligonucleotide
agcagggcaagggcatcgtcgaggc

SEQ ID NO: 675967 - DNA, 25 bp, Artificial sequence
  Synthetic oligonucleotide
gcgtctgcggccgatcgtgatgacc

SEQ ID NO: 675968 - DNA, 25 bp, Artificial sequence
  Synthetic oligonucleotide
atgctcaagccctgggaagagcgtc

SEQ ID NO: 675969 - DNA, 25 bp, Artificial sequence
  Synthetic oligonucleotide
tggagaaggaaagctcttcggtcag

SEQ ID NO: 675970 - DNA, 25 bp, Artificial sequence
  Synthetic oligonucleotide
aggaaagctcttcggtcagctcggt

SEQ ID NO: 675971 - DNA, 25 bp, Artificial sequence
  Synthetic oligonucleotide
gctcttcggtcagctcggtgttcac

SEQ ID NO: 675972 - DNA, 25 bp, Artificial sequence
  Synthetic oligonucleotide
ggtcagctcggtgttcaccgtgacc

SEQ ID NO: 675973 - DNA, 25 bp, Artificial sequence
  Synthetic oligonucleotide
tcggtgttcaccgtgaccggcttca

SEQ ID NO: 675974 - DNA, 25 bp, Artificial sequence
  Synthetic oligonucleotide
ttcaccgtgaccggcttcaacttcg

SEQ ID NO: 675975 - DNA, 25 bp, Artificial sequence
  Synthetic oligonucleotide
gtgaccggcttcaacttcgccggcc

SEQ ID NO: 675976 - DNA, 25 bp, Artificial sequence
  Synthetic oligonucleotide
cggcttcaacttcgccggccgcggc

SEQ ID NO: 675977 - DNA, 25 bp, Artificial sequence
  Synthetic oligonucleotide
aacttcgccggccgcggccagagtt

SEQ ID NO: 675978 - DNA, 25 bp, Artificial sequence
  Synthetic oligonucleotide
gccggccgcggccagagttcgggca

SEQ ID NO: 675979 - DNA, 25 bp, Artificial sequence
  Synthetic oligonucleotide
cgcggccagagttcgggcatggcgt

SEQ ID NO: 675980 - DNA, 25 bp, Artificial sequence
  Synthetic oligonucleotide
cagagttcgggcatggcgttcatca

SEQ ID NO: 675981 - DNA, 25 bp, Artificial sequence
  Synthetic oligonucleotide
tcgggcatggcgttcatcatgctca

SEQ ID NO: 675982 - DNA, 25 bp, Artificial sequence
  Synthetic oligonucleotide
cttcaaggacgcgatggtgttcgcc

SEQ ID NO: 675983 - DNA, 25 bp, Artificial sequence
  Synthetic oligonucleotide
agaacagcgtgttcgaactggccaa

SEQ ID NO: 675984 - DNA, 25 bp, Artificial sequence
  Synthetic oligonucleotide
gcgcaacgacaagggcgagatggtg

SEQ ID NO: 675985 - DNA, 25 bp, Artificial sequence
  Synthetic oligonucleotide
tgcacttcttcagcttcaaggacgc

SEQ ID NO: 675986 - DNA, 25 bp, Artificial sequence
  Synthetic oligonucleotide
cgcagatgcacttcttcagcttcaa

SEQ ID NO: 675987 - DNA, 25 bp, Artificial sequence
  Synthetic oligonucleotide
agcgcgcgcagatgcacttcttcag

SEQ ID NO: 675988 - DNA, 25 bp, Artificial sequence
  Synthetic oligonucleotide
tggccaagcgcgcgcagatgcactt

SEQ ID NO: 675989 - DNA, 25 bp, Artificial sequence
  Synthetic oligonucleotide
atggcgttcatcatgctcaagccct

SEQ ID NO: 675990 - DNA, 25 bp, Artificial sequence
  Synthetic oligonucleotide
gcgtgttcgaactggccaagcgcgc

SEQ ID NO: 675991 - DNA, 25 bp, Artificial sequence
  Synthetic oligonucleotide
ttcatcatgctcaagccctgggaag

SEQ ID NO: 675992 - DNA, 25 bp, Artificial sequence
  Synthetic oligonucleotide
gtggcgagaacagcgtgttcgaact

SEQ ID NO: 675993 - DNA, 25 bp, Artificial sequence
  Synthetic oligonucleotide
tcccggtggcgagaacagcgtgttc

SEQ ID NO: 675994 - DNA, 25 bp, Artificial sequence
  Synthetic oligonucleotide
gagcgtcccggtggcgagaacagcg

SEQ ID NO: 675995 - DNA, 25 bp, Artificial sequence
  Synthetic oligonucleotide
tgggaagagcgtcccggtggcgaga

SEQ ID NO: 675996 - DNA, 25 bp, Artificial sequence
  Synthetic oligonucleotide
aagccctgggaagagcgtcccggtg

SEQ ID NO: 675997 - DNA, 25 bp, Artificial sequence
  Synthetic oligonucleotide
cgatgcgcgaatacctgctggagaa

SEQ ID NO: 675998 - DNA, 25 bp, Artificial sequence
  Synthetic oligonucleotide
tcgaactggccaagcgcgcgcagat

SEQ ID NO: 675999 - DNA, 25 bp, Artificial sequence
  Synthetic oligonucleotide
tgctgatctacgtggtgatcgtggc

SEQ ID NO: 676000 - DNA, 25 bp, Artificial sequence
  Synthetic oligonucleotide
acctgctggagaaggaaagctcttc

SEQ ID NO: 676001 - DNA, 25 bp, Artificial sequence
  Synthetic oligonucleotide
gatgttcacccgcattcccaccgcg

SEQ ID NO: 676002 - DNA, 25 bp, Artificial sequence
  Synthetic oligonucleotide
tgatctggatgttcacccgcattcc

SEQ ID NO: 676003 - DNA, 25 bp, Artificial sequence
  Synthetic oligonucleotide
ccgggatgatctggatgttcacccg

SEQ ID NO: 676004 - DNA, 25 bp, Artificial sequence
  Synthetic oligonucleotide
tcgtggccgggatgatctggatgtt

SEQ ID NO: 676005 - DNA, 25 bp, Artificial sequence
  Synthetic oligonucleotide
gcattcccaccgcgttcctccccga

SEQ ID NO: 676006 - DNA, 25 bp, Artificial sequence
  Synthetic oligonucleotide
tctacgtggtgatcgtggccgggat

SEQ ID NO: 676007 - DNA, 25 bp, Artificial sequence
  Synthetic oligonucleotide
cgcgttcctccccgacgaggaccag

SEQ ID NO: 676008 - DNA, 25 bp, Artificial sequence
  Synthetic oligonucleotide
cgtacctgctgatctacgtggtgat

SEQ ID NO: 676009 - DNA, 25 bp, Artificial sequence
  Synthetic oligonucleotide
gcgcgccgtacctgctgatctacgt

SEQ ID NO: 676010 - DNA, 25 bp, Artificial sequence
  Synthetic oligonucleotide
aagcatcgcgcgccgtacctgctga

SEQ ID NO: 676011 - DNA, 25 bp, Artificial sequence
  Synthetic oligonucleotide
gatcctcaagcatcgcgcgccgtac

SEQ ID NO: 676012 - DNA, 25 bp, Artificial sequence
  Synthetic oligonucleotide
ggcgtcgatcctcaagcatcgcgcg

SEQ ID NO: 676013 - DNA, 25 bp, Artificial sequence
  Synthetic oligonucleotide
ggcgtggcgtcgatcctcaagcatc

SEQ ID NO: 676014 - DNA, 25 bp, Artificial sequence
  Synthetic oligonucleotide
tggtgatcgtggccgggatgatctg

SEQ ID NO: 676015 - DNA, 25 bp, Artificial sequence
  Synthetic oligonucleotide
ccgccgggctccagtgccgagcgta

SEQ ID NO: 676016 - DNA, 25 bp, Artificial sequence
  Synthetic oligonucleotide
aggacgcgatggtgttcgccttcgc

SEQ ID NO: 676017 - DNA, 25 bp, Artificial sequence
  Synthetic oligonucleotide
tggactcgatgcgcgaatacctgct

SEQ ID NO: 676018 - DNA, 25 bp, Artificial sequence
  Synthetic oligonucleotide
tggtggtggactcgatgcgcgaata

SEQ ID NO: 676019 - DNA, 25 bp, Artificial sequence
  Synthetic oligonucleotide
cccaggtggtggtggactcgatgcg

SEQ ID NO: 676020 - DNA, 25 bp, Artificial sequence
  Synthetic oligonucleotide
agcgtacccaggtggtggtggactc

SEQ ID NO: 676021 - DNA, 25 bp, Artificial sequence
  Synthetic oligonucleotide
cacccgcattcccaccgcgttcctc

SEQ ID NO: 676022 - DNA, 25 bp, Artificial sequence
  Synthetic oligonucleotide
gctccagtgccgagcgtacccaggt

SEQ ID NO: 676023 - DNA, 25 bp, Artificial sequence
  Synthetic oligonucleotide
gcgaatacctgctggagaaggaaag

SEQ ID NO: 676024 - DNA, 25 bp, Artificial sequence
  Synthetic oligonucleotide
cagaccccgccgggctccagtgccg

SEQ ID NO: 676025 - DNA, 25 bp, Artificial sequence
  Synthetic oligonucleotide
caggtacagaccccgccgggctcca

SEQ ID NO: 676026 - DNA, 25 bp, Artificial sequence
  Synthetic oligonucleotide
gtactgttcgcccaggtacagaccc

SEQ ID NO: 676027 - DNA, 25 bp, Artificial sequence
  Synthetic oligonucleotide
cagggcgtactgttcgcccaggtac

SEQ ID NO: 676028 - DNA, 25 bp, Artificial sequence
  Synthetic oligonucleotide
gaggaccagggcgtactgttcgccc

SEQ ID NO: 676029 - DNA, 25 bp, Artificial sequence
  Synthetic oligonucleotide
ccccgacgaggaccagggcgtactg

SEQ ID NO: 676030 - DNA, 25 bp, Artificial sequence
  Synthetic oligonucleotide
gtgccgagcgtacccaggtggtggt

SEQ ID NO: 676031 - DNA, 25 bp, Artificial sequence
  Synthetic oligonucleotide
tcaacgatttcatcgaccgtggccg

SEQ ID NO: 676032 - DNA, 25 bp, Artificial sequence
  Synthetic oligonucleotide
tggagatcgacgacgagaaggccag

SEQ ID NO: 676033 - DNA, 25 bp, Artificial sequence
  Synthetic oligonucleotide
tcgacgacgagaaggccagcgccct

SEQ ID NO: 676034 - DNA, 25 bp, Artificial sequence
  Synthetic oligonucleotide
acgagaaggccagcgccctcggcgt

SEQ ID NO: 676035 - DNA, 25 bp, Artificial sequence
  Synthetic oligonucleotide
aggccagcgccctcggcgtgtccct

SEQ ID NO: 676036 - DNA, 25 bp, Artificial sequence
  Synthetic oligonucleotide
gcgccctcggcgtgtcccttgccga

SEQ ID NO: 676037 - DNA, 25 bp, Artificial sequence
  Synthetic oligonucleotide
tcggcgtgtcccttgccgacatcaa

SEQ ID NO: 676038 - DNA, 25 bp, Artificial sequence
  Synthetic oligonucleotide
tgtcccttgccgacatcaacagcac

SEQ ID NO: 676039 - DNA, 25 bp, Artificial sequence
  Synthetic oligonucleotide
ttgccgacatcaacagcaccgtgtc

SEQ ID NO: 676040 - DNA, 25 bp, Artificial sequence
  Synthetic oligonucleotide
gacatcaacagcaccgtgtccatcg

SEQ ID NO: 676041 - DNA, 25 bp, Artificial sequence
  Synthetic oligonucleotide
aacagcaccgtgtccatcgcctggg

SEQ ID NO: 676042 - DNA, 25 bp, Artificial sequence
  Synthetic oligonucleotide
accgtgtccatcgcctggggttcca

SEQ ID NO: 676043 - DNA, 25 bp, Artificial sequence
  Synthetic oligonucleotide
tccatcgcctggggttccagctacg

SEQ ID NO: 676044 - DNA, 25 bp, Artificial sequence
  Synthetic oligonucleotide
cctggggttccagctacgtcaacga

SEQ ID NO: 676045 - DNA, 25 bp, Artificial sequence
  Synthetic oligonucleotide
tcttcagcttcaaggacgcgatggt

SEQ ID NO: 676046 - DNA, 25 bp, Artificial sequence
  Synthetic oligonucleotide
tacctgcagggcaggccggacgcgc

SEQ ID NO: 676047 - DNA, 25 bp, Artificial sequence
  Synthetic oligonucleotide
ctgagcaagtggtacgtgcgcaacg

SEQ ID NO: 676048 - DNA, 25 bp, Artificial sequence
  Synthetic oligonucleotide
gacgacctgagcaagtggtacgtgc

SEQ ID NO: 676049 - DNA, 25 bp, Artificial sequence
  Synthetic oligonucleotide
aacccggacgacctgagcaagtggt

SEQ ID NO: 676050 - DNA, 25 bp, Artificial sequence
  Synthetic oligonucleotide
cggatgaacccggacgacctgagca

SEQ ID NO: 676051 - DNA, 25 bp, Artificial sequence
  Synthetic oligonucleotide
gacgcgcggatgaacccggacgacc

SEQ ID NO: 676052 - DNA, 25 bp, Artificial sequence
  Synthetic oligonucleotide
gttccagctacgtcaacgatttcat

SEQ ID NO: 676053 - DNA, 25 bp, Artificial sequence
  Synthetic oligonucleotide
cagggcaggccggacgcgcggatga

SEQ ID NO: 676054 - DNA, 25 bp, Artificial sequence
  Synthetic oligonucleotide
gctacgtcaacgatttcatcgaccg

SEQ ID NO: 676055 - DNA, 25 bp, Artificial sequence
  Synthetic oligonucleotide
cgggtctacctgcagggcaggccgg

SEQ ID NO: 676056 - DNA, 25 bp, Artificial sequence
  Synthetic oligonucleotide
gtcaagcgggtctacctgcagggca

SEQ ID NO: 676057 - DNA, 25 bp, Artificial sequence
  Synthetic oligonucleotide
tggccgggtcaagcgggtctacctg

SEQ ID NO: 676058 - DNA, 25 bp, Artificial sequence
  Synthetic oligonucleotide
atcgaccgtggccgggtcaagcggg

SEQ ID NO: 676059 - DNA, 25 bp, Artificial sequence
  Synthetic oligonucleotide
atttcatcgaccgtggccgggtcaa

SEQ ID NO: 676060 - DNA, 25 bp, Artificial sequence
  Synthetic oligonucleotide
acgaaccgcagtacaagctggagat

SEQ ID NO: 676061 - DNA, 25 bp, Artificial sequence
  Synthetic oligonucleotide
aggccggacgcgcggatgaacccgg

SEQ ID NO: 676062 - DNA, 25 bp, Artificial sequence
  Synthetic oligonucleotide
taacgccaccggcttcgacctgttc

SEQ ID NO: 676063 - DNA, 25 bp, Artificial sequence
  Synthetic oligonucleotide
acaagctggagatcgacgacgagaa

SEQ ID NO: 676064 - DNA, 25 bp, Artificial sequence
  Synthetic oligonucleotide
cgggtgtcggccacgaagtcctgct

SEQ ID NO: 676065 - DNA, 25 bp, Artificial sequence
  Synthetic oligonucleotide
gaccaggcgggtgtcggccacgaag

SEQ ID NO: 676066 - DNA, 25 bp, Artificial sequence
  Synthetic oligonucleotide
ctccaggaccaggcgggtgtcggcc

SEQ ID NO: 676067 - DNA, 25 bp, Artificial sequence
  Synthetic oligonucleotide
ctgttcctccaggaccaggcgggtg

SEQ ID NO: 676068 - DNA, 25 bp, Artificial sequence
  Synthetic oligonucleotide
acgaagtcctgctccaggcgcgcaa

SEQ ID NO: 676069 - DNA, 25 bp, Artificial sequence
  Synthetic oligonucleotide
caccggcttcgacctgttcctccag

SEQ ID NO: 676070 - DNA, 25 bp, Artificial sequence
  Synthetic oligonucleotide
tcctgctccaggcgcgcaacaagtt

SEQ ID NO: 676071 - DNA, 25 bp, Artificial sequence
  Synthetic oligonucleotide
ctggaactgggtaacgccaccggct

SEQ ID NO: 676072 - DNA, 25 bp, Artificial sequence
  Synthetic oligonucleotide
tcggtactggaactgggtaacgcca

SEQ ID NO: 676073 - DNA, 25 bp, Artificial sequence
  Synthetic oligonucleotide
cgccgccgtcggtactggaactggg

SEQ ID NO: 676074 - DNA, 25 bp, Artificial sequence
  Synthetic oligonucleotide
ccttcgcgccgccgtcggtactgga

SEQ ID NO: 676075 - DNA, 25 bp, Artificial sequence
  Synthetic oligonucleotide
gtgttcgccttcgcgccgccgtcgg

SEQ ID NO: 676076 - DNA, 25 bp, Artificial sequence
  Synthetic oligonucleotide
gcgatggtgttcgccttcgcgccgc

SEQ ID NO: 676077 - DNA, 25 bp, Artificial sequence
  Synthetic oligonucleotide
ttcgacctgttcctccaggaccagg

SEQ ID NO: 676078 - DNA, 25 bp, Artificial sequence
  Synthetic oligonucleotide
agaacccggcgctgcaacgcgtgcg

SEQ ID NO: 676079 - DNA, 25 bp, Artificial sequence
  Synthetic oligonucleotide
gagcggggcgtggcgtcgatcctca

SEQ ID NO: 676080 - DNA, 25 bp, Artificial sequence
  Synthetic oligonucleotide
tgagcgacgaaccgcagtacaagct

SEQ ID NO: 676081 - DNA, 25 bp, Artificial sequence
  Synthetic oligonucleotide
acggcatgagcgacgaaccgcagta

SEQ ID NO: 676082 - DNA, 25 bp, Artificial sequence
  Synthetic oligonucleotide
gccccaacggcatgagcgacgaacc

SEQ ID NO: 676083 - DNA, 25 bp, Artificial sequence
  Synthetic oligonucleotide
gcgtgcgccccaacggcatgagcga

SEQ ID NO: 676084 - DNA, 25 bp, Artificial sequence
  Synthetic oligonucleotide
tcggccacgaagtcctgctccaggc

SEQ ID NO: 676085 - DNA, 25 bp, Artificial sequence
  Synthetic oligonucleotide
cggcgctgcaacgcgtgcgccccaa

SEQ ID NO: 676086 - DNA, 25 bp, Artificial sequence
  Synthetic oligonucleotide
cgcagtacaagctggagatcgacga

SEQ ID NO: 676087 - DNA, 25 bp, Artificial sequence
  Synthetic oligonucleotide
gccgcgcagaacccggcgctgcaac

SEQ ID NO: 676088 - DNA, 25 bp, Artificial sequence
  Synthetic oligonucleotide
atgctcgccgcgcagaacccggcgc

SEQ ID NO: 676089 - DNA, 25 bp, Artificial sequence
  Synthetic oligonucleotide
gttcctcatgctcgccgcgcagaac

SEQ ID NO: 676090 - DNA, 25 bp, Artificial sequence
  Synthetic oligonucleotide
aacaagttcctcatgctcgccgcgc

SEQ ID NO: 676091 - DNA, 25 bp, Artificial sequence
  Synthetic oligonucleotide
gcgcgcaacaagttcctcatgctcg

SEQ ID NO: 676092 - DNA, 25 bp, Artificial sequence
  Synthetic oligonucleotide
tccaggcgcgcaacaagttcctcat

SEQ ID NO: 676093 - DNA, 25 bp, Artificial sequence
  Synthetic oligonucleotide
tgcaacgcgtgcgccccaacggcat

SEQ ID NO: 676094 - DNA, 25 bp, Artificial sequence
  Synthetic oligonucleotide
cttcggcatcaagatggacctcggc

SEQ ID NO: 676095 - DNA, 25 bp, Artificial sequence
  Synthetic oligonucleotide
agccggtcaccatcaaggccaagct

SEQ ID NO: 676096 - DNA, 25 bp, Artificial sequence
  Synthetic oligonucleotide
tcaccatcaaggccaagctgatcgg

SEQ ID NO: 676097 - DNA, 25 bp, Artificial sequence
  Synthetic oligonucleotide
tcaaggccaagctgatcggccaggg

SEQ ID NO: 676098 - DNA, 25 bp, Artificial sequence
  Synthetic oligonucleotide
ccaagctgatcggccagggcgacga

SEQ ID NO: 676099 - DNA, 25 bp, Artificial sequence
  Synthetic oligonucleotide
tgatcggccagggcgacgacccgtg

SEQ ID NO: 676100 - DNA, 25 bp, Artificial sequence
  Synthetic oligonucleotide
cagggcgacgacccgtggggcggct

SEQ ID NO: 676101 - DNA, 25 bp, Artificial sequence
  Synthetic oligonucleotide
ccgtggggcggctaccgtgccggct

SEQ ID NO: 676102 - DNA, 25 bp, Artificial sequence
  Synthetic oligonucleotide
ggcggctaccgtgccggcttcgaag

SEQ ID NO: 676103 - DNA, 25 bp, Artificial sequence
  Synthetic oligonucleotide
taccgtgccggcttcgaaggcagcg

SEQ ID NO: 676104 - DNA, 25 bp, Artificial sequence
  Synthetic oligonucleotide
gctggcaatcgagctcgctctggat

SEQ ID NO: 676105 - DNA, 25 bp, Artificial sequence
  Synthetic oligonucleotide
tcgaaggcagcgccaccctgaagct

SEQ ID NO: 676106 - DNA, 25 bp, Artificial sequence
  Synthetic oligonucleotide
ccattttcgcgtgggtgatcgcctt

SEQ ID NO: 676107 - DNA, 25 bp, Artificial sequence
  Synthetic oligonucleotide
ccaccctgaagctgaaagacttcgg

SEQ ID NO: 676108 - DNA, 25 bp, Artificial sequence
  Synthetic oligonucleotide
cgaaaaacgccggcgatcgccggcg

SEQ ID NO: 676109 - DNA, 25 bp, Artificial sequence
  Synthetic oligonucleotide
gaagtcgagctgctgctctccgtcg

SEQ ID NO: 676110 - DNA, 25 bp, Artificial sequence
  Synthetic oligonucleotide
tcgacgagaagaacccgtcggccga

SEQ ID NO: 676111 - DNA, 25 bp, Artificial sequence
  Synthetic oligonucleotide
cagtaagcggatacctgaaacgaaa

SEQ ID NO: 676112 - DNA, 25 bp, Artificial sequence
  Synthetic oligonucleotide
attcgccagtaagcggatacctgaa

SEQ ID NO: 676113 - DNA, 25 bp, Artificial sequence
  Synthetic oligonucleotide
aaggcattcgccagtaagcggatac

SEQ ID NO: 676114 - DNA, 25 bp, Artificial sequence
  Synthetic oligonucleotide
ccgtcgaaggcattcgccagtaagc

SEQ ID NO: 676115 - DNA, 25 bp, Artificial sequence
  Synthetic oligonucleotide
tgaagctgaaagacttcggcatcaa

SEQ ID NO: 676116 - DNA, 25 bp, Artificial sequence
  Synthetic oligonucleotide
gagctgctgctctccgtcgaaggca

SEQ ID NO: 676117 - DNA, 25 bp, Artificial sequence
  Synthetic oligonucleotide
gaaagacttcggcatcaagatggac

SEQ ID NO: 676118 - DNA, 25 bp, Artificial sequence
  Synthetic oligonucleotide
tcccaggaagtcgagctgctgctct

SEQ ID NO: 676119 - DNA, 25 bp, Artificial sequence
  Synthetic oligonucleotide
cccggcatcccaggaagtcgagctg

SEQ ID NO: 676120 - DNA, 25 bp, Artificial sequence
  Synthetic oligonucleotide
cctcggcccggcatcccaggaagtc

SEQ ID NO: 676121 - DNA, 25 bp, Artificial sequence
  Synthetic oligonucleotide
gatggacctcggcccggcatcccag

SEQ ID NO: 676122 - DNA, 25 bp, Artificial sequence
  Synthetic oligonucleotide
catcaagatggacctcggcccggca

SEQ ID NO: 676123 - DNA, 25 bp, Artificial sequence
  Synthetic oligonucleotide
ccctgaacggcgtgaccaagccggt

SEQ ID NO: 676124 - DNA, 25 bp, Artificial sequence
  Synthetic oligonucleotide
tgctctccgtcgaaggcattcgcca

SEQ ID NO: 676125 - DNA, 25 bp, Artificial sequence
  Synthetic oligonucleotide
ccaacagcgtggacaccaaccatgc

SEQ ID NO: 676126 - DNA, 25 bp, Artificial sequence
  Synthetic oligonucleotide
tgaccaagccggtcaccatcaaggc

SEQ ID NO: 676127 - DNA, 25 bp, Artificial sequence
  Synthetic oligonucleotide
agcacctgcgcagcggtgatttcct

SEQ ID NO: 676128 - DNA, 25 bp, Artificial sequence
  Synthetic oligonucleotide
gtgacaagcacctgcgcagcggtga

SEQ ID NO: 676129 - DNA, 25 bp, Artificial sequence
  Synthetic oligonucleotide
gccgagcgtgacaagcacctgcgca

SEQ ID NO: 676130 - DNA, 25 bp, Artificial sequence
  Synthetic oligonucleotide
accatgccgagcgtgacaagcacct

SEQ ID NO: 676131 - DNA, 25 bp, Artificial sequence
  Synthetic oligonucleotide
gcggtgatttcctcaacgtcagcaa

SEQ ID NO: 676132 - DNA, 25 bp, Artificial sequence
  Synthetic oligonucleotide
gcgtggacaccaaccatgccgagcg

SEQ ID NO: 676133 - DNA, 25 bp, Artificial sequence
  Synthetic oligonucleotide
atttcctcaacgtcagcaagaaccc

SEQ ID NO: 676134 - DNA, 25 bp, Artificial sequence
  Synthetic oligonucleotide
tcaacaccaacagcgtggacaccaa

SEQ ID NO: 676135 - DNA, 25 bp, Artificial sequence
  Synthetic oligonucleotide
gaccatcaacaccaacagcgtggac

SEQ ID NO: 676136 - DNA, 25 bp, Artificial sequence
  Synthetic oligonucleotide
caaggtgaccatcaacaccaacagc

SEQ ID NO: 676137 - DNA, 25 bp, Artificial sequence
  Synthetic oligonucleotide
caaggtcaaggtgaccatcaacacc

SEQ ID NO: 676138 - DNA, 25 bp, Artificial sequence
  Synthetic oligonucleotide
ggccgacaaggtcaaggtgaccatc

SEQ ID NO: 676139 - DNA, 25 bp, Artificial sequence
  Synthetic oligonucleotide
gcggggtcaggtcgagtcgctggca

SEQ ID NO: 676140 - DNA, 25 bp, Artificial sequence
  Synthetic oligonucleotide
acaccaaccatgccgagcgtgacaa

SEQ ID NO: 676141 - DNA, 25 bp, Artificial sequence
  Synthetic oligonucleotide
gaagtgaaggccaacggcgacagcg

SEQ ID NO: 676142 - DNA, 25 bp, Artificial sequence
  Synthetic oligonucleotide
cgccggcgatcgccggcgtttttca

SEQ ID NO: 676143 - DNA, 25 bp, Artificial sequence
  Synthetic oligonucleotide
aacctgaccctgaacggcgtgacca

SEQ ID NO: 676144 - DNA, 25 bp, Artificial sequence
  Synthetic oligonucleotide
caccggcaacctgaccctgaacggc

SEQ ID NO: 676145 - DNA, 25 bp, Artificial sequence
  Synthetic oligonucleotide
cgacatcaccggcaacctgaccctg

SEQ ID NO: 676146 - DNA, 25 bp, Artificial sequence
  Synthetic oligonucleotide
acagcgccgacatcaccggcaacct

SEQ ID NO: 676147 - DNA, 25 bp, Artificial sequence
  Synthetic oligonucleotide
tgcgcagcggtgatttcctcaacgt

SEQ ID NO: 676148 - DNA, 25 bp, Artificial sequence
  Synthetic oligonucleotide
aggccaacggcgacagcgccgacat

SEQ ID NO: 676149 - DNA, 25 bp, Artificial sequence
  Synthetic oligonucleotide
acggcgtgaccaagccggtcaccat

SEQ ID NO: 676150 - DNA, 25 bp, Artificial sequence
  Synthetic oligonucleotide
tccaccgaagtgaaggccaacggcg

SEQ ID NO: 676151 - DNA, 25 bp, Artificial sequence
  Synthetic oligonucleotide
ttcgaatccaccgaagtgaaggcca

SEQ ID NO: 676152 - DNA, 25 bp, Artificial sequence
  Synthetic oligonucleotide
gctaccttcgaatccaccgaagtga

SEQ ID NO: 676153 - DNA, 25 bp, Artificial sequence
  Synthetic oligonucleotide
ccgaccgctaccttcgaatccaccg

SEQ ID NO: 676154 - DNA, 25 bp, Artificial sequence
  Synthetic oligonucleotide
tcagcaagaacccgaccgctacctt

SEQ ID NO: 676155 - DNA, 25 bp, Artificial sequence
  Synthetic oligonucleotide
tcaacgtcagcaagaacccgaccgc

SEQ ID NO: 676156 - DNA, 25 bp, Artificial sequence
  Synthetic oligonucleotide
acggcgacagcgccgacatcaccgg

SEQ ID NO: 676157 - DNA, 25 bp, Artificial sequence
  Synthetic oligonucleotide
gccttgtcgcggcacatctggcgtc

SEQ ID NO: 676158 - DNA, 25 bp, Artificial sequence
  Synthetic oligonucleotide
aggaagagctggaagctgcgctggt

SEQ ID NO: 676159 - DNA, 25 bp, Artificial sequence
  Synthetic oligonucleotide
gagctggaagctgcgctggtcgctg

SEQ ID NO: 676160 - DNA, 25 bp, Artificial sequence
  Synthetic oligonucleotide
gaagctgcgctggtcgctggggttg

SEQ ID NO: 676161 - DNA, 25 bp, Artificial sequence
  Synthetic oligonucleotide
gcgctggtcgctggggttgcgctcg

SEQ ID NO: 676162 - DNA, 25 bp, Artificial sequence
  Synthetic oligonucleotide
gtcgctggggttgcgctcgcggcgg

SEQ ID NO: 676163 - DNA, 25 bp, Artificial sequence
  Synthetic oligonucleotide
tggggttgcgctcgcggcggaccag

SEQ ID NO: 676164 - DNA, 25 bp, Artificial sequence
  Synthetic oligonucleotide
tgcgctcgcggcggaccaggtttct

SEQ ID NO: 676165 - DNA, 25 bp, Artificial sequence
  Synthetic oligonucleotide
gcggaccaggtttcttccctccagc

SEQ ID NO: 676166 - DNA, 25 bp, Artificial sequence
  Synthetic oligonucleotide
aggtttcttccctccagctcgcgga

SEQ ID NO: 676167 - DNA, 25 bp, Artificial sequence
  Synthetic oligonucleotide
ttccctccagctcgcggatcttccg

SEQ ID NO: 676168 - DNA, 25 bp, Artificial sequence
  Synthetic oligonucleotide
ccagctcgcggatcttccgggtgat

SEQ ID NO: 676169 - DNA, 25 bp, Artificial sequence
  Synthetic oligonucleotide
cgcggatcttccgggtgatcagtgc

SEQ ID NO: 676170 - DNA, 25 bp, Artificial sequence
  Synthetic oligonucleotide
tcttccgggtgatcagtgccttgtc

SEQ ID NO: 676171 - DNA, 25 bp, Artificial sequence
  Synthetic oligonucleotide
ctgaaacgaaaaacgccggcgatcg

SEQ ID NO: 676172 - DNA, 25 bp, Artificial sequence
  Synthetic oligonucleotide
aggttcagcccgcgttgttcgtcga

SEQ ID NO: 676173 - DNA, 25 bp, Artificial sequence
  Synthetic oligonucleotide
cgtcgggcggggtcaggtcgagtcg

SEQ ID NO: 676174 - DNA, 25 bp, Artificial sequence
  Synthetic oligonucleotide
tacatggacgtcgggcggggtcagg

SEQ ID NO: 676175 - DNA, 25 bp, Artificial sequence
  Synthetic oligonucleotide
cttcaatacatggacgtcgggcggg

SEQ ID NO: 676176 - DNA, 25 bp, Artificial sequence
  Synthetic oligonucleotide
ataagcttcaatacatggacgtcgg

SEQ ID NO: 676177 - DNA, 25 bp, Artificial sequence
  Synthetic oligonucleotide
tcgtcgataagcttcaatacatgga

SEQ ID NO: 676178 - DNA, 25 bp, Artificial sequence
  Synthetic oligonucleotide
gggtgatcagtgccttgtcgcggca

SEQ ID NO: 676179 - DNA, 25 bp, Artificial sequence
  Synthetic oligonucleotide
agcccgcgttgttcgtcgataagct

SEQ ID NO: 676180 - DNA, 25 bp, Artificial sequence
  Synthetic oligonucleotide
tcagtgccttgtcgcggcacatctg

SEQ ID NO: 676181 - DNA, 25 bp, Artificial sequence
  Synthetic oligonucleotide
tcctgcaggttcagcccgcgttgtt

SEQ ID NO: 676182 - DNA, 25 bp, Artificial sequence
  Synthetic oligonucleotide
cccaggtcctgcaggttcagcccgc

SEQ ID NO: 676183 - DNA, 25 bp, Artificial sequence
  Synthetic oligonucleotide
tggcgtcccaggtcctgcaggttca

SEQ ID NO: 676184 - DNA, 25 bp, Artificial sequence
  Synthetic oligonucleotide
cacatctggcgtcccaggtcctgca

SEQ ID NO: 676185 - DNA, 25 bp, Artificial sequence
  Synthetic oligonucleotide
tcgcggcacatctggcgtcccaggt

SEQ ID NO: 676186 - DNA, 25 bp, Artificial sequence
  Synthetic oligonucleotide
gccagcccctcgtcggtgaggaaga

SEQ ID NO: 676187 - DNA, 25 bp, Artificial sequence
  Synthetic oligonucleotide
cgttgttcgtcgataagcttcaata

SEQ ID NO: 676188 - DNA, 25 bp, Artificial sequence
  Synthetic oligonucleotide
tgttcttaaatatcctcaagcggtt

SEQ ID NO: 676189 - DNA, 25 bp, Artificial sequence
  Synthetic oligonucleotide
tcggtgaggaagagctggaagctgc

SEQ ID NO: 676190 - DNA, 25 bp, Artificial sequence
  Synthetic oligonucleotide
gcactggtcgaggagatgcaccagg

SEQ ID NO: 676191 - DNA, 25 bp, Artificial sequence
  Synthetic oligonucleotide
ggccaggcactggtcgaggagatgc

SEQ ID NO: 676192 - DNA, 25 bp, Artificial sequence
  Synthetic oligonucleotide
gttgcgcggccaggcactggtcgag

SEQ ID NO: 676193 - DNA, 25 bp, Artificial sequence
  Synthetic oligonucleotide
aagcggttgcgcggccaggcactgg

SEQ ID NO: 676194 - DNA, 25 bp, Artificial sequence
  Synthetic oligonucleotide
agatgcaccagggtggcctgttcca

SEQ ID NO: 676195 - DNA, 25 bp, Artificial sequence
  Synthetic oligonucleotide
taaatatcctcaagcggttgcgcgg

SEQ ID NO: 676196 - DNA, 25 bp, Artificial sequence
  Synthetic oligonucleotide
caccagggtggcctgttccaccggg

SEQ ID NO: 676197 - DNA, 25 bp, Artificial sequence
  Synthetic oligonucleotide
aaagaatgttcttaaatatcctcaa

SEQ ID NO: 676198 - DNA, 25 bp, Artificial sequence
  Synthetic oligonucleotide
cttcgaaaagaatgttcttaaatat

SEQ ID NO: 676199 - DNA, 25 bp, Artificial sequence
  Synthetic oligonucleotide
attgtgcttcgaaaagaatgttctt

SEQ ID NO: 676200 - DNA, 25 bp, Artificial sequence
  Synthetic oligonucleotide
tttttcattgtgcttcgaaaagaat

SEQ ID NO: 676201 - DNA, 25 bp, Artificial sequence
  Synthetic oligonucleotide
ccggcgtttttcattgtgcttcgaa

SEQ ID NO: 676202 - DNA, 25 bp, Artificial sequence
  Synthetic oligonucleotide
cgatcgccggcgtttttcattgtgc

SEQ ID NO: 676203 - DNA, 25 bp, Artificial sequence
  Synthetic oligonucleotide
tcctcaagcggttgcgcggccaggc

SEQ ID NO: 676204 - DNA, 25 bp, Artificial sequence
  Synthetic oligonucleotide
cgtcatgcacgcgtgacatgatggc

SEQ ID NO: 676205 - DNA, 25 bp, Artificial sequence
  Synthetic oligonucleotide
tcaccttcgacgagaagaacccgtc

SEQ ID NO: 676206 - DNA, 25 bp, Artificial sequence
  Synthetic oligonucleotide
gtggatggccagcccctcgtcggtg

SEQ ID NO: 676207 - DNA, 25 bp, Artificial sequence
  Synthetic oligonucleotide
atgctggtggatggccagcccctcg

SEQ ID NO: 676208 - DNA, 25 bp, Artificial sequence
  Synthetic oligonucleotide
ctccgcatgctggtggatggccagc

SEQ ID NO: 676209 - DNA, 25 bp, Artificial sequence
  Synthetic oligonucleotide
gatggcctccgcatgctggtggatg

SEQ ID NO: 676210 - DNA, 25 bp, Artificial sequence
  Synthetic oligonucleotide
gtcgaggagatgcaccagggtggcc

SEQ ID NO: 676211 - DNA, 25 bp, Artificial sequence
  Synthetic oligonucleotide
gcacgcgtgacatgatggcctccgc

SEQ ID NO: 676212 - DNA, 25 bp, Artificial sequence
  Synthetic oligonucleotide
ccctcgtcggtgaggaagagctgga

SEQ ID NO: 676213 - DNA, 25 bp, Artificial sequence
  Synthetic oligonucleotide
caactcgtcatgcacgcgtgacatg

SEQ ID NO: 676214 - DNA, 25 bp, Artificial sequence
  Synthetic oligonucleotide
ggcaaacaactcgtcatgcacgcgt

SEQ ID NO: 676215 - DNA, 25 bp, Artificial sequence
  Synthetic oligonucleotide
gagcggggcaaacaactcgtcatgc

SEQ ID NO: 676216 - DNA, 25 bp, Artificial sequence
  Synthetic oligonucleotide
cggggtgagcggggcaaacaactcg

SEQ ID NO: 676217 - DNA, 25 bp, Artificial sequence
  Synthetic oligonucleotide
tgttccaccggggtgagcggggcaa

SEQ ID NO: 676218 - DNA, 25 bp, Artificial sequence
  Synthetic oligonucleotide
ggtggcctgttccaccggggtgagc

SEQ ID NO: 676219 - DNA, 25 bp, Artificial sequence
  Synthetic oligonucleotide
tgacatgatggcctccgcatgctgg

SEQ ID NO: 676220 - DNA, 25 bp, Artificial sequence
  Synthetic oligonucleotide
tgtacgggctgctgctggcggtgat

SEQ ID NO: 676221 - DNA, 25 bp, Artificial sequence
  Synthetic oligonucleotide
atcgtctggcgtttcgtcagcccgc

SEQ ID NO: 676222 - DNA, 25 bp, Artificial sequence
  Synthetic oligonucleotide
tggcgtttcgtcagcccgccgccgc

SEQ ID NO: 676223 - DNA, 25 bp, Artificial sequence
  Synthetic oligonucleotide
ttcgtcagcccgccgccgccggcgc

SEQ ID NO: 676224 - DNA, 25 bp, Artificial sequence
  Synthetic oligonucleotide
agcccgccgccgccggcgccggcca

SEQ ID NO: 676225 - DNA, 25 bp, Artificial sequence
  Synthetic oligonucleotide
ccgccgccggcgccggccaaccacg

SEQ ID NO: 676226 - DNA, 25 bp, Artificial sequence
  Synthetic oligonucleotide
cggcgccggccaaccacggtccgct

SEQ ID NO: 676227 - DNA, 25 bp, Artificial sequence
  Synthetic oligonucleotide
cggccaaccacggtccgctcacgcg

SEQ ID NO: 676228 - DNA, 25 bp, Artificial sequence
  Synthetic oligonucleotide
aaccacggtccgctcacgcgggtag

SEQ ID NO: 676229 - DNA, 25 bp, Artificial sequence
  Synthetic oligonucleotide
ggtccgctcacgcgggtagcgagca

SEQ ID NO: 676230 - DNA, 25 bp, Artificial sequence
  Synthetic oligonucleotide
ctcacgcgggtagcgagcaagcttg

SEQ ID NO: 676231 - DNA, 25 bp, Artificial sequence
  Synthetic oligonucleotide
cgggtagcgagcaagcttggccacc

SEQ ID NO: 676232 - DNA, 25 bp, Artificial sequence
  Synthetic oligonucleotide
agcgagcaagcttggccacctcgcg

SEQ ID NO: 676233 - DNA, 25 bp, Artificial sequence
  Synthetic oligonucleotide
aagcttggccacctcgcgctgtacg

SEQ ID NO: 676234 - DNA, 25 bp, Artificial sequence
  Synthetic oligonucleotide
tccgtgccggcaaccctcagcgggc

SEQ ID NO: 676235 - DNA, 25 bp, Artificial sequence
  Synthetic oligonucleotide
tacctgatttccaccgccgacggcg

SEQ ID NO: 676236 - DNA, 25 bp, Artificial sequence
  Synthetic oligonucleotide
cccgtcggccgacaaggtcaaggtg

SEQ ID NO: 676237 - DNA, 25 bp, Artificial sequence
  Synthetic oligonucleotide
ttcggctggttctccgtgccggcaa

SEQ ID NO: 676238 - DNA, 25 bp, Artificial sequence
  Synthetic oligonucleotide
agcgtgttcggctggttctccgtgc

SEQ ID NO: 676239 - DNA, 25 bp, Artificial sequence
  Synthetic oligonucleotide
ccgatcagcgtgttcggctggttct

SEQ ID NO: 676240 - DNA, 25 bp, Artificial sequence
  Synthetic oligonucleotide
ggcgaaccgatcagcgtgttcggct

SEQ ID NO: 676241 - DNA, 25 bp, Artificial sequence
  Synthetic oligonucleotide
gccacctcgcgctgtacgggctgct

SEQ ID NO: 676242 - DNA, 25 bp, Artificial sequence
  Synthetic oligonucleotide
ttccaccgccgacggcgaaccgatc

SEQ ID NO: 676243 - DNA, 25 bp, Artificial sequence
  Synthetic oligonucleotide
tcgcgctgtacgggctgctgctggc

SEQ ID NO: 676244 - DNA, 25 bp, Artificial sequence
  Synthetic oligonucleotide
gcgggctacctgatttccaccgccg

SEQ ID NO: 676245 - DNA, 25 bp, Artificial sequence
  Synthetic oligonucleotide
atcgtcgcgggctacctgatttcca

SEQ ID NO: 676246 - DNA, 25 bp, Artificial sequence
  Synthetic oligonucleotide
gcggtgatcgtcgcgggctacctga

SEQ ID NO: 676247 - DNA, 25 bp, Artificial sequence
  Synthetic oligonucleotide
ctgctggcggtgatcgtcgcgggct

SEQ ID NO: 676248 - DNA, 25 bp, Artificial sequence
  Synthetic oligonucleotide
gggctgctgctggcggtgatcgtcg

SEQ ID NO: 676249 - DNA, 25 bp, Artificial sequence
  Synthetic oligonucleotide
ttgccctgctggtgcggatcgtctg

SEQ ID NO: 676250 - DNA, 25 bp, Artificial sequence
  Synthetic oligonucleotide
cgccgacggcgaaccgatcagcgtg

SEQ ID NO: 676251 - DNA, 25 bp, Artificial sequence
  Synthetic oligonucleotide
gtattcagcctgttcctgcactggg

SEQ ID NO: 676252 - DNA, 25 bp, Artificial sequence
  Synthetic oligonucleotide
tgcggatcgtctggcgtttcgtcag

SEQ ID NO: 676253 - DNA, 25 bp, Artificial sequence
  Synthetic oligonucleotide
tggtcttcggcctgttcggcctggg

SEQ ID NO: 676254 - DNA, 25 bp, Artificial sequence
  Synthetic oligonucleotide
cgctggtggtcttcggcctgttcgg

SEQ ID NO: 676255 - DNA, 25 bp, Artificial sequence
  Synthetic oligonucleotide
ggcagcgcgctggtggtcttcggcc

SEQ ID NO: 676256 - DNA, 25 bp, Artificial sequence
  Synthetic oligonucleotide
cactggggcagcgcgctggtggtct

SEQ ID NO: 676257 - DNA, 25 bp, Artificial sequence
  Synthetic oligonucleotide
tgttcggcctgggcctgtggatgcg

SEQ ID NO: 676258 - DNA, 25 bp, Artificial sequence
  Synthetic oligonucleotide
agcctgttcctgcactggggcagcg

SEQ ID NO: 676259 - DNA, 25 bp, Artificial sequence
  Synthetic oligonucleotide
gcctgggcctgtggatgcgcgaact

SEQ ID NO: 676260 - DNA, 25 bp, Artificial sequence
  Synthetic oligonucleotide
acggcgtattcagcctgttcctgca

SEQ ID NO: 676261 - DNA, 25 bp, Artificial sequence
  Synthetic oligonucleotide
ccgttacggcgtattcagcctgttc

SEQ ID NO: 676262 - DNA, 25 bp, Artificial sequence
  Synthetic oligonucleotide
ctcatcccgttacggcgtattcagc

SEQ ID NO: 676263 - DNA, 25 bp, Artificial sequence
  Synthetic oligonucleotide
aatacctcatcccgttacggcgtat

SEQ ID NO: 676264 - DNA, 25 bp, Artificial sequence
  Synthetic oligonucleotide
tggcgcaatacctcatcccgttacg

SEQ ID NO: 676265 - DNA, 25 bp, Artificial sequence
  Synthetic oligonucleotide
atgcagtggcgcaatacctcatccc

SEQ ID NO: 676266 - DNA, 25 bp, Artificial sequence
  Synthetic oligonucleotide
ttcctgcactggggcagcgcgctgg

SEQ ID NO: 676267 - DNA, 25 bp, Artificial sequence
  Synthetic oligonucleotide
ccgcgccggcgctgcataaaagcat

SEQ ID NO: 676268 - DNA, 25 bp, Artificial sequence
  Synthetic oligonucleotide
cggcaaccctcagcgggctgcccga

SEQ ID NO: 676269 - DNA, 25 bp, Artificial sequence
  Synthetic oligonucleotide
tggccattgccctgctggtgcggat

SEQ ID NO: 676270 - DNA, 25 bp, Artificial sequence
  Synthetic oligonucleotide
tcctgctggccattgccctgctggt

SEQ ID NO: 676271 - DNA, 25 bp, Artificial sequence
  Synthetic oligonucleotide
tcggcatcctgctggccattgccct

SEQ ID NO: 676272 - DNA, 25 bp, Artificial sequence
  Synthetic oligonucleotide
aaagcatcggcatcctgctggccat

SEQ ID NO: 676273 - DNA, 25 bp, Artificial sequence
  Synthetic oligonucleotide
ttcggcctgttcggcctgggcctgt

SEQ ID NO: 676274 - DNA, 25 bp, Artificial sequence
  Synthetic oligonucleotide
cggcgctgcataaaagcatcggcat

SEQ ID NO: 676275 - DNA, 25 bp, Artificial sequence
  Synthetic oligonucleotide
tgctggtgcggatcgtctggcgttt

SEQ ID NO: 676276 - DNA, 25 bp, Artificial sequence
  Synthetic oligonucleotide
accaccccgcgccggcgctgcataa

SEQ ID NO: 676277 - DNA, 25 bp, Artificial sequence
  Synthetic oligonucleotide
cctggtaccaccccgcgccggcgct

SEQ ID NO: 676278 - DNA, 25 bp, Artificial sequence
  Synthetic oligonucleotide
tgagctattacgacccctggtacca

SEQ ID NO: 676279 - DNA, 25 bp, Artificial sequence
  Synthetic oligonucleotide
gcgaactgagctattacgacccctg

SEQ ID NO: 676280 - DNA, 25 bp, Artificial sequence
  Synthetic oligonucleotide
ggatgcgcgaactgagctattacga

SEQ ID NO: 676281 - DNA, 25 bp, Artificial sequence
  Synthetic oligonucleotide
gcctgtggatgcgcgaactgagcta

SEQ ID NO: 676282 - DNA, 25 bp, Artificial sequence
  Synthetic oligonucleotide
tgcataaaagcatcggcatcctgct

SEQ ID NO: 676283 - DNA, 25 bp, Artificial sequence
  Synthetic oligonucleotide
gccagcacgccttcatcgagttccg

SEQ ID NO: 676284 - DNA, 25 bp, Artificial sequence
  Synthetic oligonucleotide
ctgaagaagacccttgccgcgctgg

SEQ ID NO: 676285 - DNA, 25 bp, Artificial sequence
  Synthetic oligonucleotide
aagacccttgccgcgctggcgctcg

SEQ ID NO: 676286 - DNA, 25 bp, Artificial sequence
  Synthetic oligonucleotide
cttgccgcgctggcgctcggctccg

SEQ ID NO: 676287 - DNA, 25 bp, Artificial sequence
  Synthetic oligonucleotide
gcgctggcgctcggctccgcactgt

SEQ ID NO: 676288 - DNA, 25 bp, Artificial sequence
  Synthetic oligonucleotide
cgctcggctccgcactgttcaccgc

SEQ ID NO: 676289 - DNA, 25 bp, Artificial sequence
  Synthetic oligonucleotide
gctccgcactgttcaccgccggcca

SEQ ID NO: 676290 - DNA, 25 bp, Artificial sequence
  Synthetic oligonucleotide
actgttcaccgccggccaggcaatg

SEQ ID NO: 676291 - DNA, 25 bp, Artificial sequence
  Synthetic oligonucleotide
caccgccggccaggcaatggccgcg

SEQ ID NO: 676292 - DNA, 25 bp, Artificial sequence
  Synthetic oligonucleotide
ccggccaggcaatggccgcggacta

SEQ ID NO: 676293 - DNA, 25 bp, Artificial sequence
  Synthetic oligonucleotide
aggcaatggccgcggactacaagat

SEQ ID NO: 676294 - DNA, 25 bp, Artificial sequence
  Synthetic oligonucleotide
tggccgcggactacaagatcgacaa

SEQ ID NO: 676295 - DNA, 25 bp, Artificial sequence
  Synthetic oligonucleotide
cggactacaagatcgacaaggaagg

SEQ ID NO: 676296 - DNA, 25 bp, Artificial sequence
  Synthetic oligonucleotide
acaagatcgacaaggaaggccagca

SEQ ID NO: 676297 - DNA, 25 bp, Artificial sequence
  Synthetic oligonucleotide
tggttctccgtgccggcaaccctca

SEQ ID NO: 676298 - DNA, 25 bp, Artificial sequence
  Synthetic oligonucleotide
ggctatagctggctgtacggccgct

SEQ ID NO: 676299 - DNA, 25 bp, Artificial sequence
  Synthetic oligonucleotide
gcagcttcaccttcgacgagaagaa

SEQ ID NO: 676300 - DNA, 25 bp, Artificial sequence
  Synthetic oligonucleotide
tcgacggcagcttcaccttcgacga

SEQ ID NO: 676301 - DNA, 25 bp, Artificial sequence
  Synthetic oligonucleotide
acgacttcgacggcagcttcacctt

SEQ ID NO: 676302 - DNA, 25 bp, Artificial sequence
  Synthetic oligonucleotide
gcttcaacgacttcgacggcagctt

SEQ ID NO: 676303 - DNA, 25 bp, Artificial sequence
  Synthetic oligonucleotide
acggccgcttcaacgacttcgacgg

SEQ ID NO: 676304 - DNA, 25 bp, Artificial sequence
  Synthetic oligonucleotide
tcgacaaggaaggccagcacgcctt

SEQ ID NO: 676305 - DNA, 25 bp, Artificial sequence
  Synthetic oligonucleotide
tagctggctgtacggccgcttcaac

SEQ ID NO: 676306 - DNA, 25 bp, Artificial sequence
  Synthetic oligonucleotide
aggaaggccagcacgccttcatcga

SEQ ID NO: 676307 - DNA, 25 bp, Artificial sequence
  Synthetic oligonucleotide
gcacctgggctatagctggctgtac

SEQ ID NO: 676308 - DNA, 25 bp, Artificial sequence
  Synthetic oligonucleotide
catcaagcacctgggctatagctgg

SEQ ID NO: 676309 - DNA, 25 bp, Artificial sequence
  Synthetic oligonucleotide
gttccgcatcaagcacctgggctat

SEQ ID NO: 676310 - DNA, 25 bp, Artificial sequence
  Synthetic oligonucleotide
catcgagttccgcatcaagcacctg

SEQ ID NO: 676311 - DNA, 25 bp, Artificial sequence
  Synthetic oligonucleotide
acgccttcatcgagttccgcatcaa

SEQ ID NO: 676312 - DNA, 25 bp, Artificial sequence
  Synthetic oligonucleotide
ttaaggagaatgtccatgctgaaga

SEQ ID NO: 676313 - DNA, 25 bp, Artificial sequence
  Synthetic oligonucleotide
gctgtacggccgcttcaacgacttc

SEQ ID NO: 676314 - DNA, 25 bp, Artificial sequence
  Synthetic oligonucleotide
gtgaaatccatctctacctggcctg

SEQ ID NO: 676315 - DNA, 25 bp, Artificial sequence
  Synthetic oligonucleotide
tccatgctgaagaagacccttgccg

SEQ ID NO: 676316 - DNA, 25 bp, Artificial sequence
  Synthetic oligonucleotide
ggtcttcgccgtcctccatgccctg

SEQ ID NO: 676317 - DNA, 25 bp, Artificial sequence
  Synthetic oligonucleotide
gctggtggtcttcgccgtcctccat

SEQ ID NO: 676318 - DNA, 25 bp, Artificial sequence
  Synthetic oligonucleotide
tgggcgctggtggtcttcgccgtcc

SEQ ID NO: 676319 - DNA, 25 bp, Artificial sequence
  Synthetic oligonucleotide
ctggcctgggcgctggtggtcttcg

SEQ ID NO: 676320 - DNA, 25 bp, Artificial sequence
  Synthetic oligonucleotide
cctccatgccctggccgccctcaag

SEQ ID NO: 676321 - DNA, 25 bp, Artificial sequence
  Synthetic oligonucleotide
atccatctctacctggcctgggcgc

SEQ ID NO: 676322 - DNA, 25 bp, Artificial sequence
  Synthetic oligonucleotide
tgccctggccgccctcaagcatcac

SEQ ID NO: 676323 - DNA, 25 bp, Artificial sequence
  Synthetic oligonucleotide
tcgcgggtgaaatccatctctacct

SEQ ID NO: 676324 - DNA, 25 bp, Artificial sequence
  Synthetic oligonucleotide
cagacgtcgcgggtgaaatccatct

SEQ ID NO: 676325 - DNA, 25 bp, Artificial sequence
  Synthetic oligonucleotide
accaggcagacgtcgcgggtgaaat

SEQ ID NO: 676326 - DNA, 25 bp, Artificial sequence
  Synthetic oligonucleotide
tgcccgaccaggcagacgtcgcggg

SEQ ID NO: 676327 - DNA, 25 bp, Artificial sequence
  Synthetic oligonucleotide
gcgggctgcccgaccaggcagacgt

SEQ ID NO: 676328 - DNA, 25 bp, Artificial sequence
  Synthetic oligonucleotide
ccctcagcgggctgcccgaccaggc

SEQ ID NO: 676329 - DNA, 25 bp, Artificial sequence
  Synthetic oligonucleotide
ctctacctggcctgggcgctggtgg

SEQ ID NO: 676330 - DNA, 25 bp, Artificial sequence
  Synthetic oligonucleotide
aaagcgcatgctcggtcgctcgtcg

SEQ ID NO: 676331 - DNA, 25 bp, Artificial sequence
  Synthetic oligonucleotide
gcagcgccaccctgaagctgaaaga

SEQ ID NO: 676332 - DNA, 25 bp, Artificial sequence
  Synthetic oligonucleotide
accacgttaaggagaatgtccatgc

SEQ ID NO: 676333 - DNA, 25 bp, Artificial sequence
  Synthetic oligonucleotide
tcaacaaccacgttaaggagaatgt

SEQ ID NO: 676334 - DNA, 25 bp, Artificial sequence
  Synthetic oligonucleotide
gaatgatcaacaaccacgttaagga

SEQ ID NO: 676335 - DNA, 25 bp, Artificial sequence
  Synthetic oligonucleotide
ctcgtcgaatgatcaacaaccacgt

SEQ ID NO: 676336 - DNA, 25 bp, Artificial sequence
  Synthetic oligonucleotide
cgccgtcctccatgccctggccgcc

SEQ ID NO: 676337 - DNA, 25 bp, Artificial sequence
  Synthetic oligonucleotide
catgctcggtcgctcgtcgaatgat

SEQ ID NO: 676338 - DNA, 25 bp, Artificial sequence
  Synthetic oligonucleotide
agaatgtccatgctgaagaagaccc

SEQ ID NO: 676339 - DNA, 25 bp, Artificial sequence
  Synthetic oligonucleotide
accctaaagcgcatgctcggtcgct

SEQ ID NO: 676340 - DNA, 25 bp, Artificial sequence
  Synthetic oligonucleotide
gacccgaccctaaagcgcatgctcg

SEQ ID NO: 676341 - DNA, 25 bp, Artificial sequence
  Synthetic oligonucleotide
gaccgcgacccgaccctaaagcgca

SEQ ID NO: 676342 - DNA, 25 bp, Artificial sequence
  Synthetic oligonucleotide
gcatcacttcgtcgaccgcgacccg

SEQ ID NO: 676343 - DNA, 25 bp, Artificial sequence
  Synthetic oligonucleotide
cctcaagcatcacttcgtcgaccgc

SEQ ID NO: 676344 - DNA, 25 bp, Artificial sequence
  Synthetic oligonucleotide
ggccgccctcaagcatcacttcgtc

SEQ ID NO: 676345 - DNA, 25 bp, Artificial sequence
  Synthetic oligonucleotide
cggtcgctcgtcgaatgatcaacaa

SEQ ID NO: 676346 - DNA, 25 bp, Artificial sequence
  Synthetic oligonucleotide
acggtagccaatacccgctggaagg

SEQ ID NO: 676347 - DNA, 25 bp, Artificial sequence
  Synthetic oligonucleotide
ccgccctgctgcgcctgcgccgcga

SEQ ID NO: 676348 - DNA, 25 bp, Artificial sequence
  Synthetic oligonucleotide
tgctgcgcctgcgccgcgaactggc

SEQ ID NO: 676349 - DNA, 25 bp, Artificial sequence
  Synthetic oligonucleotide
cgcctgcgccgcgaactggccagcg

SEQ ID NO: 676350 - DNA, 25 bp, Artificial sequence
  Synthetic oligonucleotide
cgccgcgaactggccagcggccagt

SEQ ID NO: 676351 - DNA, 25 bp, Artificial sequence
  Synthetic oligonucleotide
gaactggccagcggccagttggagc

SEQ ID NO: 676352 - DNA, 25 bp, Artificial sequence
  Synthetic oligonucleotide
gccagcggccagttggagcgcgccg

SEQ ID NO: 676353 - DNA, 25 bp, Artificial sequence
  Synthetic oligonucleotide
gccagttggagcgcgccggcgacaa

SEQ ID NO: 676354 - DNA, 25 bp, Artificial sequence
  Synthetic oligonucleotide
ttggagcgcgccggcgacaacgcgg

SEQ ID NO: 676355 - DNA, 25 bp, Artificial sequence
  Synthetic oligonucleotide
cgcgccggcgacaacgcggcgaagg

SEQ ID NO: 676356 - DNA, 25 bp, Artificial sequence
  Synthetic oligonucleotide
ggcgacaacgcggcgaaggtctccc

SEQ ID NO: 676357 - DNA, 25 bp, Artificial sequence
  Synthetic oligonucleotide
aacgcggcgaaggtctccctgaagc

SEQ ID NO: 676358 - DNA, 25 bp, Artificial sequence
  Synthetic oligonucleotide
cgaaggtctccctgaagctggagga

SEQ ID NO: 676359 - DNA, 25 bp, Artificial sequence
  Synthetic oligonucleotide
ctccctgaagctggaggacggtagc

SEQ ID NO: 676360 - DNA, 25 bp, Artificial sequence
  Synthetic oligonucleotide
aacccgaacaacgagctgctgcccg

SEQ ID NO: 676361 - DNA, 25 bp, Artificial sequence
  Synthetic oligonucleotide
tccgaggtttccgtcgacgaaggca

SEQ ID NO: 676362 - DNA, 25 bp, Artificial sequence
  Synthetic oligonucleotide
tgccgcctacctgcagtccaaggcg

SEQ ID NO: 676363 - DNA, 25 bp, Artificial sequence
  Synthetic oligonucleotide
catccgcgccgtgttccccaacccg

SEQ ID NO: 676364 - DNA, 25 bp, Artificial sequence
  Synthetic oligonucleotide
cggtcaccatccgcgccgtgttccc

SEQ ID NO: 676365 - DNA, 25 bp, Artificial sequence
  Synthetic oligonucleotide
ccggctcggtcaccatccgcgccgt

SEQ ID NO: 676366 - DNA, 25 bp, Artificial sequence
  Synthetic oligonucleotide
aaggcaccggctcggtcaccatccg

SEQ ID NO: 676367 - DNA, 25 bp, Artificial sequence
  Synthetic oligonucleotide
gaagctggaggacggtagccaatac

SEQ ID NO: 676368 - DNA, 25 bp, Artificial sequence
  Synthetic oligonucleotide
tttccgtcgacgaaggcaccggctc

SEQ ID NO: 676369 - DNA, 25 bp, Artificial sequence
  Synthetic oligonucleotide
tggaggacggtagccaatacccgct

SEQ ID NO: 676370 - DNA, 25 bp, Artificial sequence
  Synthetic oligonucleotide
tcgaattctccgaggtttccgtcga

SEQ ID NO: 676371 - DNA, 25 bp, Artificial sequence
  Synthetic oligonucleotide
gtcgcctcgaattctccgaggtttc

SEQ ID NO: 676372 - DNA, 25 bp, Artificial sequence
  Synthetic oligonucleotide
tggaaggtcgcctcgaattctccga

SEQ ID NO: 676373 - DNA, 25 bp, Artificial sequence
  Synthetic oligonucleotide
acccgctggaaggtcgcctcgaatt

SEQ ID NO: 676374 - DNA, 25 bp, Artificial sequence
  Synthetic oligonucleotide
gccaatacccgctggaaggtcgcct

SEQ ID NO: 676375 - DNA, 25 bp, Artificial sequence
  Synthetic oligonucleotide
acgtcacccagccgtccaccgccct

SEQ ID NO: 676376 - DNA, 25 bp, Artificial sequence
  Synthetic oligonucleotide
tcgacgaaggcaccggctcggtcac

SEQ ID NO: 676377 - DNA, 25 bp, Artificial sequence
  Synthetic oligonucleotide
atcaacctgcgctacaccaaggtgc

SEQ ID NO: 676378 - DNA, 25 bp, Artificial sequence
  Synthetic oligonucleotide
cgtccaccgccctgctgcgcctgcg

SEQ ID NO: 676379 - DNA, 25 bp, Artificial sequence
  Synthetic oligonucleotide
ctccggccgcatcggccgttccgcg

SEQ ID NO: 676380 - DNA, 25 bp, Artificial sequence
  Synthetic oligonucleotide
ccgatctccggccgcatcggccgtt

SEQ ID NO: 676381 - DNA, 25 bp, Artificial sequence
  Synthetic oligonucleotide
ctgtcgccgatctccggccgcatcg

SEQ ID NO: 676382 - DNA, 25 bp, Artificial sequence
  Synthetic oligonucleotide
aaggtgctgtcgccgatctccggcc

SEQ ID NO: 676383 - DNA, 25 bp, Artificial sequence
  Synthetic oligonucleotide
gccgttccgcggtgaccgaaggcgc

SEQ ID NO: 676384 - DNA, 25 bp, Artificial sequence
  Synthetic oligonucleotide
ctgcgctacaccaaggtgctgtcgc

SEQ ID NO: 676385 - DNA, 25 bp, Artificial sequence
  Synthetic oligonucleotide
ccgcggtgaccgaaggcgccctggt

SEQ ID NO: 676386 - DNA, 25 bp, Artificial sequence
  Synthetic oligonucleotide
gcgcggatcaacctgcgctacacca

SEQ ID NO: 676387 - DNA, 25 bp, Artificial sequence
  Synthetic oligonucleotide
gagcaggcgcggatcaacctgcgct

SEQ ID NO: 676388 - DNA, 25 bp, Artificial sequence
  Synthetic oligonucleotide
ggcggtggagcaggcgcggatcaac

SEQ ID NO: 676389 - DNA, 25 bp, Artificial sequence
  Synthetic oligonucleotide
caaggcggcggtggagcaggcgcgg

SEQ ID NO: 676390 - DNA, 25 bp, Artificial sequence
  Synthetic oligonucleotide
gcagtccaaggcggcggtggagcag

SEQ ID NO: 676391 - DNA, 25 bp, Artificial sequence
  Synthetic oligonucleotide
ctacctgcagtccaaggcggcggtg

SEQ ID NO: 676392 - DNA, 25 bp, Artificial sequence
  Synthetic oligonucleotide
tacaccaaggtgctgtcgccgatct

SEQ ID NO: 676393 - DNA, 25 bp, Artificial sequence
  Synthetic oligonucleotide
acgcgatggccaccgtgcaacagct

SEQ ID NO: 676394 - DNA, 25 bp, Artificial sequence
  Synthetic oligonucleotide
aacaacgagctgctgcccggcatgt

SEQ ID NO: 676395 - DNA, 25 bp, Artificial sequence
  Synthetic oligonucleotide
acgtcgacgtcacccagccgtccac

SEQ ID NO: 676396 - DNA, 25 bp, Artificial sequence
  Synthetic oligonucleotide
cgatctacgtcgacgtcacccagcc

SEQ ID NO: 676397 - DNA, 25 bp, Artificial sequence
  Synthetic oligonucleotide
tcgacccgatctacgtcgacgtcac

SEQ ID NO: 676398 - DNA, 25 bp, Artificial sequence
  Synthetic oligonucleotide
aacagctcgacccgatctacgtcga

SEQ ID NO: 676399 - DNA, 25 bp, Artificial sequence
  Synthetic oligonucleotide
ccgcatcggccgttccgcggtgacc

SEQ ID NO: 676400 - DNA, 25 bp, Artificial sequence
  Synthetic oligonucleotide
tggccaccgtgcaacagctcgaccc

SEQ ID NO: 676401 - DNA, 25 bp, Artificial sequence
  Synthetic oligonucleotide
cccagccgtccaccgccctgctgcg

SEQ ID NO: 676402 - DNA, 25 bp, Artificial sequence
  Synthetic oligonucleotide
aggccaacgcgatggccaccgtgca

SEQ ID NO: 676403 - DNA, 25 bp, Artificial sequence
  Synthetic oligonucleotide
aacggccaggccaacgcgatggcca

SEQ ID NO: 676404 - DNA, 25 bp, Artificial sequence
  Synthetic oligonucleotide
tgaccaacggccaggccaacgcgat

SEQ ID NO: 676405 - DNA, 25 bp, Artificial sequence
  Synthetic oligonucleotide
ccctggtgaccaacggccaggccaa

SEQ ID NO: 676406 - DNA, 25 bp, Artificial sequence
  Synthetic oligonucleotide
aaggcgccctggtgaccaacggcca

SEQ ID NO: 676407 - DNA, 25 bp, Artificial sequence
  Synthetic oligonucleotide
tgaccgaaggcgccctggtgaccaa

SEQ ID NO: 676408 - DNA, 25 bp, Artificial sequence
  Synthetic oligonucleotide
ccgtgcaacagctcgacccgatcta

SEQ ID NO: 676409 - DNA, 25 bp, Artificial sequence
  Synthetic oligonucleotide
gcagaaggccgacgccgctccggcg

SEQ ID NO: 676410 - DNA, 25 bp, Artificial sequence
  Synthetic oligonucleotide
ccggcgacaagatcattaccgaagg

SEQ ID NO: 676411 - DNA, 25 bp, Artificial sequence
  Synthetic oligonucleotide
acaagatcattaccgaaggcctgca

SEQ ID NO: 676412 - DNA, 25 bp, Artificial sequence
  Synthetic oligonucleotide
tcattaccgaaggcctgcagttcgt

SEQ ID NO: 676413 - DNA, 25 bp, Artificial sequence
  Synthetic oligonucleotide
ccgaaggcctgcagttcgtgcagcc

SEQ ID NO: 676414 - DNA, 25 bp, Artificial sequence
  Synthetic oligonucleotide
cctgcagttcgtgcagccgggtgtc

SEQ ID NO: 676415 - DNA, 25 bp, Artificial sequence
  Synthetic oligonucleotide
gttcgtgcagccgggtgtcgaggtg

SEQ ID NO: 676416 - DNA, 25 bp, Artificial sequence
  Synthetic oligonucleotide
gcagccgggtgtcgaggtgaagacc

SEQ ID NO: 676417 - DNA, 25 bp, Artificial sequence
  Synthetic oligonucleotide
gggtgtcgaggtgaagaccgtgccg

SEQ ID NO: 676418 - DNA, 25 bp, Artificial sequence
  Synthetic oligonucleotide
tcgaggtgaagaccgtgccggcgaa

SEQ ID NO: 676419 - DNA, 25 bp, Artificial sequence
  Synthetic oligonucleotide
tgaagaccgtgccggcgaagaatgt

SEQ ID NO: 676420 - DNA, 25 bp, Artificial sequence
  Synthetic oligonucleotide
ccgtgccggcgaagaatgtcgcgtc

SEQ ID NO: 676421 - DNA, 25 bp, Artificial sequence
  Synthetic oligonucleotide
cggcgaagaatgtcgcgtccgcgca

SEQ ID NO: 676422 - DNA, 25 bp, Artificial sequence
  Synthetic oligonucleotide
aagaatgtcgcgtccgcgcagaagg

SEQ ID NO: 676423 - DNA, 25 bp, Artificial sequence
  Synthetic oligonucleotide
ttccccaacccgaacaacgagctgc

SEQ ID NO: 676424 - DNA, 25 bp, Artificial sequence
  Synthetic oligonucleotide
agggctgatcaaggggattcgtaat

SEQ ID NO: 676425 - DNA, 25 bp, Artificial sequence
  Synthetic oligonucleotide
taggcccattttcgcgtgggtgatc

SEQ ID NO: 676426 - DNA, 25 bp, Artificial sequence
  Synthetic oligonucleotide
attgataggcccattttcgcgtggg

SEQ ID NO: 676427 - DNA, 25 bp, Artificial sequence
  Synthetic oligonucleotide
tttttcattgataggcccattttcg

SEQ ID NO: 676428 - DNA, 25 bp, Artificial sequence
  Synthetic oligonucleotide
tcgaagtttttcattgataggccca

SEQ ID NO: 676429 - DNA, 25 bp, Artificial sequence
  Synthetic oligonucleotide
gtaatgtcgaagtttttcattgata

SEQ ID NO: 676430 - DNA, 25 bp, Artificial sequence
  Synthetic oligonucleotide
gtcgcgtccgcgcagaaggccgacg

SEQ ID NO: 676431 - DNA, 25 bp, Artificial sequence
  Synthetic oligonucleotide
gatcaaggggattcgtaatgtcgaa

SEQ ID NO: 676432 - DNA, 25 bp, Artificial sequence
  Synthetic oligonucleotide
gtccgcgcagaaggccgacgccgct

SEQ ID NO: 676433 - DNA, 25 bp, Artificial sequence
  Synthetic oligonucleotide
cagcaagggctgatcaaggggattc

SEQ ID NO: 676434 - DNA, 25 bp, Artificial sequence
  Synthetic oligonucleotide
aaccgacagcaagggctgatcaagg

SEQ ID NO: 676435 - DNA, 25 bp, Artificial sequence
  Synthetic oligonucleotide
gcgaaaaccgacagcaagggctgat

SEQ ID NO: 676436 - DNA, 25 bp, Artificial sequence
  Synthetic oligonucleotide
gctccggcgaaaaccgacagcaagg

SEQ ID NO: 676437 - DNA, 25 bp, Artificial sequence
  Synthetic oligonucleotide
gacgccgctccggcgaaaaccgaca

SEQ ID NO: 676438 - DNA, 25 bp, Artificial sequence
  Synthetic oligonucleotide
ttaccgaaggcctgaacgccggcga

SEQ ID NO: 676439 - DNA, 25 bp, Artificial sequence
  Synthetic oligonucleotide
ggattcgtaatgtcgaagtttttca

SEQ ID NO: 676440 - DNA, 25 bp, Artificial sequence
  Synthetic oligonucleotide
caggaaggcgtcaagcagaaggcca

SEQ ID NO: 676441 - DNA, 25 bp, Artificial sequence
  Synthetic oligonucleotide
tgaacgccggcgacaagatcattac

SEQ ID NO: 676442 - DNA, 25 bp, Artificial sequence
  Synthetic oligonucleotide
gtgacccgcgacctcaagggccagg

SEQ ID NO: 676443 - DNA, 25 bp, Artificial sequence
  Synthetic oligonucleotide
caaggcgtgacccgcgacctcaagg

SEQ ID NO: 676444 - DNA, 25 bp, Artificial sequence
  Synthetic oligonucleotide
ccgcagcaaggcgtgacccgcgacc

SEQ ID NO: 676445 - DNA, 25 bp, Artificial sequence
  Synthetic oligonucleotide
cctcgctccgcagcaaggcgtgacc

SEQ ID NO: 676446 - DNA, 25 bp, Artificial sequence
  Synthetic oligonucleotide
tcaagggccaggctaccgcgctggt

SEQ ID NO: 676447 - DNA, 25 bp, Artificial sequence
  Synthetic oligonucleotide
gcagaaggccatcctcgctccgcag

SEQ ID NO: 676448 - DNA, 25 bp, Artificial sequence
  Synthetic oligonucleotide
gccaggctaccgcgctggtggtgaa

SEQ ID NO: 676449 - DNA, 25 bp, Artificial sequence
  Synthetic oligonucleotide
cagttgcaggaaggcgtcaagcaga

SEQ ID NO: 676450 - DNA, 25 bp, Artificial sequence
  Synthetic oligonucleotide
acgcgcagttgcaggaaggcgtcaa

SEQ ID NO: 676451 - DNA, 25 bp, Artificial sequence
  Synthetic oligonucleotide
tcgttcacgcgcagttgcaggaagg

SEQ ID NO: 676452 - DNA, 25 bp, Artificial sequence
  Synthetic oligonucleotide
gcatgttcgttcacgcgcagttgca

SEQ ID NO: 676453 - DNA, 25 bp, Artificial sequence
  Synthetic oligonucleotide
tgcccggcatgttcgttcacgcgca

SEQ ID NO: 676454 - DNA, 25 bp, Artificial sequence
  Synthetic oligonucleotide
gagctgctgcccggcatgttcgttc

SEQ ID NO: 676455 - DNA, 25 bp, Artificial sequence
  Synthetic oligonucleotide
ggccatcctcgctccgcagcaaggc

SEQ ID NO: 676456 - DNA, 25 bp, Artificial sequence
  Synthetic oligonucleotide
gctgcgggtgatcaaggccgaccgg

SEQ ID NO: 676457 - DNA, 25 bp, Artificial sequence
  Synthetic oligonucleotide
cgctggtggtgaacgcgcagaacaa

SEQ ID NO: 676458 - DNA, 25 bp, Artificial sequence
  Synthetic oligonucleotide
tggctggttaccgaaggcctgaacg

SEQ ID NO: 676459 - DNA, 25 bp, Artificial sequence
  Synthetic oligonucleotide
cgacaagtggctggttaccgaaggc

SEQ ID NO: 676460 - DNA, 25 bp, Artificial sequence
  Synthetic oligonucleotide
tgatcggcgacaagtggctggttac

SEQ ID NO: 676461 - DNA, 25 bp, Artificial sequence
  Synthetic oligonucleotide
gaccgggtgatcggcgacaagtggc

SEQ ID NO: 676462 - DNA, 25 bp, Artificial sequence
  Synthetic oligonucleotide
cgcgacctcaagggccaggctaccg

SEQ ID NO: 676463 - DNA, 25 bp, Artificial sequence
  Synthetic oligonucleotide
ggtgatcaaggccgaccgggtgatc

SEQ ID NO: 676464 - DNA, 25 bp, Artificial sequence
  Synthetic oligonucleotide
aaggcctgaacgccggcgacaagat

SEQ ID NO: 676465 - DNA, 25 bp, Artificial sequence
  Synthetic oligonucleotide
aggtcgagctgcgggtgatcaaggc

SEQ ID NO: 676466 - DNA, 25 bp, Artificial sequence
  Synthetic oligonucleotide
agaacaaggtcgagctgcgggtgat

SEQ ID NO: 676467 - DNA, 25 bp, Artificial sequence
  Synthetic oligonucleotide
ccggcttcgaaggcagcgccaccct

SEQ ID NO: 676468 - DNA, 25 bp, Artificial sequence
  Synthetic oligonucleotide
tggtgaacgcgcagaacaaggtcga

SEQ ID NO: 676469 - DNA, 25 bp, Artificial sequence
  Synthetic oligonucleotide
cgagtcgctggcaatcgagctcgct

SEQ ID NO: 676470 - DNA, 25 bp, Artificial sequence
  Synthetic oligonucleotide
ctaccgcgctggtggtgaacgcgca

SEQ ID NO: 676471 - DNA, 25 bp, Artificial sequence
  Synthetic oligonucleotide
aaggccgaccgggtgatcggcgaca

SEQ ID NO: 676472 - DNA, 25 bp, Artificial sequence
  Synthetic oligonucleotide
ttgcctgccttcttcgagccggtgc

SEQ ID NO: 676473 - DNA, 25 bp, Artificial sequence
  Synthetic oligonucleotide
atggcgccgggtggataaccggcca

SEQ ID NO: 676474 - DNA, 25 bp, Artificial sequence
  Synthetic oligonucleotide
ccgggtggataaccggccatcgagc

SEQ ID NO: 676475 - DNA, 25 bp, Artificial sequence
  Synthetic oligonucleotide
ggataaccggccatcgagctaaaac

SEQ ID NO: 676476 - DNA, 25 bp, Artificial sequence
  Synthetic oligonucleotide
ccggccatcgagctaaaacgtttca

SEQ ID NO: 676477 - DNA, 25 bp, Artificial sequence
  Synthetic oligonucleotide
atcgagctaaaacgtttcaggtgtt

SEQ ID NO: 676478 - DNA, 25 bp, Artificial sequence
  Synthetic oligonucleotide
aacgtttcaggtgttttcacgcgag

SEQ ID NO: 676479 - DNA, 25 bp, Artificial sequence
  Synthetic oligonucleotide
tcaggtgttttcacgcgaggctttc

SEQ ID NO: 676480 - DNA, 25 bp, Artificial sequence
  Synthetic oligonucleotide
tgttttcacgcgaggctttcggacg

SEQ ID NO: 676481 - DNA, 25 bp, Artificial sequence
  Synthetic oligonucleotide
cacgcgaggctttcggacgtttaca

SEQ ID NO: 676482 - DNA, 25 bp, Artificial sequence
  Synthetic oligonucleotide
ttcggacgtttacaaacacctatga

SEQ ID NO: 676483 - DNA, 25 bp, Artificial sequence
  Synthetic oligonucleotide
cgtttacaaacacctatgaatgtaa

SEQ ID NO: 676484 - DNA, 25 bp, Artificial sequence
  Synthetic oligonucleotide
caaacacctatgaatgtaagtattt

SEQ ID NO: 676485 - DNA, 25 bp, Artificial sequence
  Synthetic oligonucleotide
cctatgaatgtaagtattttgcctg

SEQ ID NO: 676486 - DNA, 25 bp, Artificial sequence
  Synthetic oligonucleotide
gccagccatgcgtgtactggttccg

SEQ ID NO: 676487 - DNA, 25 bp, Artificial sequence
  Synthetic oligonucleotide
cgctgcatcggccgctttcgctcat

SEQ ID NO: 676488 - DNA, 25 bp, Artificial sequence
  Synthetic oligonucleotide
aacgaacgccagccatgcgtgtact

SEQ ID NO: 676489 - DNA, 25 bp, Artificial sequence
  Synthetic oligonucleotide
ctatgcaacgaacgccagccatgcg

SEQ ID NO: 676490 - DNA, 25 bp, Artificial sequence
  Synthetic oligonucleotide
acaacgctatgcaacgaacgccagc

SEQ ID NO: 676491 - DNA, 25 bp, Artificial sequence
  Synthetic oligonucleotide
tgaggacaacgctatgcaacgaacg

SEQ ID NO: 676492 - DNA, 25 bp, Artificial sequence
  Synthetic oligonucleotide
cgctcatgaggacaacgctatgcaa

SEQ ID NO: 676493 - DNA, 25 bp, Artificial sequence
  Synthetic oligonucleotide
aatgtaagtattttgcctgccttct

SEQ ID NO: 676494 - DNA, 25 bp, Artificial sequence
  Synthetic oligonucleotide
atcggccgctttcgctcatgaggac

SEQ ID NO: 676495 - DNA, 25 bp, Artificial sequence
  Synthetic oligonucleotide
agtattttgcctgccttcttcgagc

SEQ ID NO: 676496 - DNA, 25 bp, Artificial sequence
  Synthetic oligonucleotide
ccttcacgctgcatcggccgctttc

SEQ ID NO: 676497 - DNA, 25 bp, Artificial sequence
  Synthetic oligonucleotide
gcagcgccttcacgctgcatcggcc

SEQ ID NO: 676498 - DNA, 25 bp, Artificial sequence
  Synthetic oligonucleotide
agccggtgcagcgccttcacgctgc

SEQ ID NO: 676499 - DNA, 25 bp, Artificial sequence
  Synthetic oligonucleotide
tcttcgagccggtgcagcgccttca

SEQ ID NO: 676500 - DNA, 25 bp, Artificial sequence
  Synthetic oligonucleotide
tgccttcttcgagccggtgcagcgc

SEQ ID NO: 676501 - DNA, 25 bp, Artificial sequence
  Synthetic oligonucleotide
ggttctgaatatgggccatggcgcc

SEQ ID NO: 676502 - DNA, 25 bp, Artificial sequence
  Synthetic oligonucleotide
cgctttcgctcatgaggacaacgct

SEQ ID NO: 676503 - DNA, 25 bp, Artificial sequence
  Synthetic oligonucleotide
tccgcacatgctggaagaccgccat

SEQ ID NO: 676504 - DNA, 25 bp, Artificial sequence
  Synthetic oligonucleotide
tgggccatggcgccgggtggataac

SEQ ID NO: 676505 - DNA, 25 bp, Artificial sequence
  Synthetic oligonucleotide
atcaggtcgggattcacggggtagt

SEQ ID NO: 676506 - DNA, 25 bp, Artificial sequence
  Synthetic oligonucleotide
gcgggcatcaggtcgggattcacgg

SEQ ID NO: 676507 - DNA, 25 bp, Artificial sequence
  Synthetic oligonucleotide
atcagcgcgggcatcaggtcgggat

SEQ ID NO: 676508 - DNA, 25 bp, Artificial sequence
  Synthetic oligonucleotide
accgccatcagcgcgggcatcaggt

SEQ ID NO: 676509 - DNA, 25 bp, Artificial sequence
  Synthetic oligonucleotide
tcacggggtagttcattggtttggc

SEQ ID NO: 676510 - DNA, 25 bp, Artificial sequence
  Synthetic oligonucleotide
catgctggaagaccgccatcagcgc

SEQ ID NO: 676511 - DNA, 25 bp, Artificial sequence
  Synthetic oligonucleotide
ggtagttcattggtttggccgagta

SEQ ID NO: 676512 - DNA, 25 bp, Artificial sequence
  Synthetic oligonucleotide
tgcgcgtccgcacatgctggaagac

SEQ ID NO: 676513 - DNA, 25 bp, Artificial sequence
  Synthetic oligonucleotide
tctggatgcgcgtccgcacatgctg

SEQ ID NO: 676514 - DNA, 25 bp, Artificial sequence
  Synthetic oligonucleotide
agctcgctctggatgcgcgtccgca

SEQ ID NO: 676515 - DNA, 25 bp, Artificial sequence
  Synthetic oligonucleotide
aatcgagctcgctctggatgcgcgt

SEQ ID NO: 676516 - DNA, 25 bp, Artificial sequence
  Synthetic oligonucleotide
cgccaatgccgcctacctgcagtcc

SEQ ID NO: 676517 - DNA, 25 bp, Artificial sequence
  Synthetic oligonucleotide
acgcgcagaacaaggtcgagctgcg

SEQ ID NO: 676518 - DNA, 25 bp, Artificial sequence
  Synthetic oligonucleotide
ggaagaccgccatcagcgcgggcat

SEQ ID NO: 676519 - DNA, 25 bp, Artificial sequence
  Synthetic oligonucleotide
ctattttgcttattttagttgacct

SEQ ID NO: 676520 - DNA, 25 bp, Artificial sequence
  Synthetic oligonucleotide
agtcaactattttgcttattttagt

SEQ ID NO: 676521 - DNA, 25 bp, Artificial sequence
  Synthetic oligonucleotide
gtttcaggttctgaatatgggccat

SEQ ID NO: 676522 - DNA, 25 bp, Artificial sequence
  Synthetic oligonucleotide
aaccttgtttcaggttctgaatatg

SEQ ID NO: 676523 - DNA, 25 bp, Artificial sequence
  Synthetic oligonucleotide
cttatcaaccttgtttcaggttctg

SEQ ID NO: 676524 - DNA, 25 bp, Artificial sequence
  Synthetic oligonucleotide
gttgaccttatcaaccttgtttcag

SEQ ID NO: 676525 - DNA, 25 bp, Artificial sequence
  Synthetic oligonucleotide
tcgggattcacggggtagttcattg

SEQ ID NO: 676526 - DNA, 25 bp, Artificial sequence
  Synthetic oligonucleotide
tgcttattttagttgaccttatcaa

SEQ ID NO: 676527 - DNA, 25 bp, Artificial sequence
  Synthetic oligonucleotide
gaatatgggccatggcgccgggtgg

SEQ ID NO: 676528 - DNA, 25 bp, Artificial sequence
  Synthetic oligonucleotide
gatccagtcaactattttgcttatt

SEQ ID NO: 676529 - DNA, 25 bp, Artificial sequence
  Synthetic oligonucleotide
gtaaatgtggttgatccagtcaact

SEQ ID NO: 676530 - DNA, 25 bp, Artificial sequence
  Synthetic oligonucleotide
cctaatgtaaatgtggttgatccag

SEQ ID NO: 676531 - DNA, 25 bp, Artificial sequence
  Synthetic oligonucleotide
agtaaacctaatgtaaatgtggttg

SEQ ID NO: 676532 - DNA, 25 bp, Artificial sequence
  Synthetic oligonucleotide
tggccgagtaaacctaatgtaaatg

SEQ ID NO: 676533 - DNA, 25 bp, Artificial sequence
  Synthetic oligonucleotide
tcattggtttggccgagtaaaccta

SEQ ID NO: 676534 - DNA, 25 bp, Artificial sequence
  Synthetic oligonucleotide
attttagttgaccttatcaaccttg

SEQ ID NO: 676535 - DNA, 25 bp, Artificial sequence
  Synthetic oligonucleotide
ccaacctggcttcgacccaggaaca

SEQ ID NO: 676536 - DNA, 25 bp, Artificial sequence
  Synthetic oligonucleotide
gcctgttcaaggaaggcagcgacgt

SEQ ID NO: 676537 - DNA, 25 bp, Artificial sequence
  Synthetic oligonucleotide
tcaaggaaggcagcgacgtcaaggc

SEQ ID NO: 676538 - DNA, 25 bp, Artificial sequence
  Synthetic oligonucleotide
aaggcagcgacgtcaaggccgggca

SEQ ID NO: 676539 - DNA, 25 bp, Artificial sequence
  Synthetic oligonucleotide
gcgacgtcaaggccgggcagcagct

SEQ ID NO: 676540 - DNA, 25 bp, Artificial sequence
  Synthetic oligonucleotide
tcaaggccgggcagcagctctacca

SEQ ID NO: 676541 - DNA, 25 bp, Artificial sequence
  Synthetic oligonucleotide
ccgggcagcagctctaccagatcga

SEQ ID NO: 676542 - DNA, 25 bp, Artificial sequence
  Synthetic oligonucleotide
agcagctctaccagatcgaccccgc

SEQ ID NO: 676543 - DNA, 25 bp, Artificial sequence
  Synthetic oligonucleotide
tctaccagatcgaccccgccaccta

SEQ ID NO: 676544 - DNA, 25 bp, Artificial sequence
  Synthetic oligonucleotide
agatcgaccccgccacctacgaggc

SEQ ID NO: 676545 - DNA, 25 bp, Artificial sequence
  Synthetic oligonucleotide
ccgccacctacgaggccgactacca

SEQ ID NO: 676546 - DNA, 25 bp, Artificial sequence
  Synthetic oligonucleotide
cctacgaggccgactaccagagcgc

SEQ ID NO: 676547 - DNA, 25 bp, Artificial sequence
  Synthetic oligonucleotide
aggccgactaccagagcgcccaggc

SEQ ID NO: 676548 - DNA, 25 bp, Artificial sequence
  Synthetic oligonucleotide
actaccagagcgcccaggccaacct

SEQ ID NO: 676549 - DNA, 25 bp, Artificial sequence
  Synthetic oligonucleotide
tcaagcgcctgttcaaggaaggcag

SEQ ID NO: 676550 - DNA, 25 bp, Artificial sequence
  Synthetic oligonucleotide
tcgccgaccaggccgtgagcaagca

SEQ ID NO: 676551 - DNA, 25 bp, Artificial sequence
  Synthetic oligonucleotide
cgccgacgccaatgccgcctacctg

SEQ ID NO: 676552 - DNA, 25 bp, Artificial sequence
  Synthetic oligonucleotide
gcagtacgccgacgccaatgccgcc

SEQ ID NO: 676553 - DNA, 25 bp, Artificial sequence
  Synthetic oligonucleotide
gtggttgatccagtcaactattttg

SEQ ID NO: 676554 - DNA, 25 bp, Artificial sequence
  Synthetic oligonucleotide
ccatgcgtgtactggttccggccct

SEQ ID NO: 676555 - DNA, 25 bp, Artificial sequence
  Synthetic oligonucleotide
caagcagcagtacgccgacgccaat

SEQ ID NO: 676556 - DNA, 25 bp, Artificial sequence
  Synthetic oligonucleotide
agagcgcccaggccaacctggcttc

SEQ ID NO: 676557 - DNA, 25 bp, Artificial sequence
  Synthetic oligonucleotide
accaggccgtgagcaagcagcagta

SEQ ID NO: 676558 - DNA, 25 bp, Artificial sequence
  Synthetic oligonucleotide
cccaggccaacctggcttcgaccca

SEQ ID NO: 676559 - DNA, 25 bp, Artificial sequence
  Synthetic oligonucleotide
tgctggtcgccgaccaggccgtgag

SEQ ID NO: 676560 - DNA, 25 bp, Artificial sequence
  Synthetic oligonucleotide
acaagctgctggtcgccgaccaggc

SEQ ID NO: 676561 - DNA, 25 bp, Artificial sequence
  Synthetic oligonucleotide
agcgctacaagctgctggtcgccga

SEQ ID NO: 676562 - DNA, 25 bp, Artificial sequence
  Synthetic oligonucleotide
ggcccagcgctacaagctgctggtc

SEQ ID NO: 676563 - DNA, 25 bp, Artificial sequence
  Synthetic oligonucleotide
cgacccaggaacaggcccagcgcta

SEQ ID NO: 676564 - DNA, 25 bp, Artificial sequence
  Synthetic oligonucleotide
tggcttcgacccaggaacaggccca

SEQ ID NO: 676565 - DNA, 25 bp, Artificial sequence
  Synthetic oligonucleotide
ccgtgagcaagcagcagtacgccga

SEQ ID NO: 676566 - DNA, 25 bp, Artificial sequence
  Synthetic oligonucleotide
tgcggaaaaagcgaggcgccgccgc

SEQ ID NO: 676567 - DNA, 25 bp, Artificial sequence
  Synthetic oligonucleotide
gaccctggaagcgcagacggtgacc

SEQ ID NO: 676568 - DNA, 25 bp, Artificial sequence
  Synthetic oligonucleotide
gatcgtgaccctggaagcgcagacg

SEQ ID NO: 676569 - DNA, 25 bp, Artificial sequence
  Synthetic oligonucleotide
ggtcgggatcgtgaccctggaagcg

SEQ ID NO: 676570 - DNA, 25 bp, Artificial sequence
  Synthetic oligonucleotide
gccggaggtcgggatcgtgaccctg

SEQ ID NO: 676571 - DNA, 25 bp, Artificial sequence
  Synthetic oligonucleotide
caaacgccggaggtcgggatcgtga

SEQ ID NO: 676572 - DNA, 25 bp, Artificial sequence
  Synthetic oligonucleotide
ccgccgccggcgcaaacgccggagg

SEQ ID NO: 676573 - DNA, 25 bp, Artificial sequence
  Synthetic oligonucleotide
gaagcgcagacggtgaccctgaata

SEQ ID NO: 676574 - DNA, 25 bp, Artificial sequence
  Synthetic oligonucleotide
aaaagcgaggcgccgccgccggcgc

SEQ ID NO: 676575 - DNA, 25 bp, Artificial sequence
  Synthetic oligonucleotide
cggcgcaaacgccggaggtcgggat

SEQ ID NO: 676576 - DNA, 25 bp, Artificial sequence
  Synthetic oligonucleotide
tccgggtgcggaaaaagcgaggcgc

SEQ ID NO: 676577 - DNA, 25 bp, Artificial sequence
  Synthetic oligonucleotide
tcatcctcaagcgcctgttcaagga

SEQ ID NO: 676578 - DNA, 25 bp, Artificial sequence
  Synthetic oligonucleotide
aggaacaggcccagcgctacaagct

SEQ ID NO: 676579 - DNA, 25 bp, Artificial sequence
  Synthetic oligonucleotide
tgctggtcgcgatttcggccctttc

SEQ ID NO: 676580 - DNA, 25 bp, Artificial sequence
  Synthetic oligonucleotide
cggccctgctggtcgcgatttcggc

SEQ ID NO: 676581 - DNA, 25 bp, Artificial sequence
  Synthetic oligonucleotide
tggttccggccctgctggtcgcgat

SEQ ID NO: 676582 - DNA, 25 bp, Artificial sequence
  Synthetic oligonucleotide
gtgtactggttccggccctgctggt

SEQ ID NO: 676583 - DNA, 25 bp, Artificial sequence
  Synthetic oligonucleotide
gaccaatgcgttccgcatcgccgag

SEQ ID NO: 676584 - DNA, 25 bp, Artificial sequence
  Synthetic oligonucleotide
ggtgcgtccccaggtgaacggcatc

SEQ ID NO: 676585 - DNA, 25 bp, Artificial sequence
  Synthetic oligonucleotide
aggtgaacggcatcatcctcaagcg

SEQ ID NO: 676586 - DNA, 25 bp, Artificial sequence
  Synthetic oligonucleotide
gaggcgccgccgccggcgcaaacgc

SEQ ID NO: 676587 - DNA, 25 bp, Artificial sequence
  Synthetic oligonucleotide
cagacggtgaccctgaataccgagc

SEQ ID NO: 676588 - DNA, 25 bp, Artificial sequence
  Synthetic oligonucleotide
ccgcatcgccgaggtgcgtccccag

SEQ ID NO: 676589 - DNA, 25 bp, Artificial sequence
  Synthetic oligonucleotide
gtccccaggtgaacggcatcatcct

SEQ ID NO: 676590 - DNA, 25 bp, Artificial sequence
  Synthetic oligonucleotide
tgcgttccgcatcgccgaggtgcgt

SEQ ID NO: 676591 - DNA, 25 bp, Artificial sequence
  Synthetic oligonucleotide
cgccgaggtgcgtccccaggtgaac

SEQ ID NO: 676592 - DNA, 25 bp, Artificial sequence
  Synthetic oligonucleotide
ggccggaccaatgcgttccgcatcg

SEQ ID NO: 676593 - DNA, 25 bp, Artificial sequence
  Synthetic oligonucleotide
tgccgggccggaccaatgcgttccg

SEQ ID NO: 676594 - DNA, 25 bp, Artificial sequence
  Synthetic oligonucleotide
ccgagctgccgggccggaccaatgc

SEQ ID NO: 676595 - DNA, 25 bp, Artificial sequence
  Synthetic oligonucleotide
acggcatcatcctcaagcgcctgtt

SEQ ID NO: 676596 - DNA, 25 bp, Artificial sequence
  Synthetic oligonucleotide
ctgaataccgagctgccgggccgga

SEQ ID NO: 676597 - DNA, 25 bp, Artificial sequence
  Synthetic oligonucleotide
gtgaccctgaataccgagctgccgg

SEQ ID NO: 676598 - DNA, 25 bp, Artificial sequence
  Synthetic oligonucleotide
tccaaggtttccaccaagctcgacg

SEQ ID NO: 676599 - DNA, 25 bp, Artificial sequence
  Synthetic oligonucleotide
cgccggctccaaggtttccaccaag

SEQ ID NO: 676600 - DNA, 25 bp, Artificial sequence
  Synthetic oligonucleotide
gatcgtcgccggctccaaggtttcc

SEQ ID NO: 676601 - DNA, 25 bp, Artificial sequence
  Synthetic oligonucleotide
ccaagctcgacgtgctgaacagcct

SEQ ID NO: 676602 - DNA, 25 bp, Artificial sequence
  Synthetic oligonucleotide
tcgacgtgctgaacagcctggccgg

SEQ ID NO: 676603 - DNA, 25 bp, Artificial sequence
  Synthetic oligonucleotide
tgctgaacagcctggccggcatctg

SEQ ID NO: 676604 - DNA, 25 bp, Artificial sequence
  Synthetic oligonucleotide
acagcctggccggcatctgcgacca

SEQ ID NO: 676605 - DNA, 25 bp, Artificial sequence
  Synthetic oligonucleotide
gtttccaccaagctcgacgtgctga

SEQ ID NO: 676606 - DNA, 25 bp, Artificial sequence
  Synthetic oligonucleotide
tggccggcatctgcgaccaactgat

SEQ ID NO: 676607 - DNA, 25 bp, Artificial sequence
  Synthetic oligonucleotide
gcatctgcgaccaactgatcgtcgg

SEQ ID NO: 676608 - DNA, 25 bp, Artificial sequence
  Synthetic oligonucleotide
tgcgaccaactgatcgtcggcggcg

SEQ ID NO: 676609 - DNA, 25 bp, Artificial sequence
  Synthetic oligonucleotide
tgatcgtcggcggcggcatcgccaa

SEQ ID NO: 676610 - DNA, 25 bp, Artificial sequence
  Synthetic oligonucleotide
tcggcggcggcatcgccaacacctt

SEQ ID NO: 676611 - DNA, 25 bp, Artificial sequence
  Synthetic oligonucleotide
gcggcatcgccaacaccttcctcgc

SEQ ID NO: 676612 - DNA, 25 bp, Artificial sequence
  Synthetic oligonucleotide
ccgcggccggacacaaggtcggcaa

SEQ ID NO: 676613 - DNA, 25 bp, Artificial sequence
  Synthetic oligonucleotide
ccaaggtcgccgccgccggcccgct

SEQ ID NO: 676614 - DNA, 25 bp, Artificial sequence
  Synthetic oligonucleotide
tcctcgccgcggccggacacaaggt

SEQ ID NO: 676615 - DNA, 25 bp, Artificial sequence
  Synthetic oligonucleotide
tcgccaacaccttcctcgccgcggc

SEQ ID NO: 676616 - DNA, 25 bp, Artificial sequence
  Synthetic oligonucleotide
acaccttcctcgccgcggccggaca

SEQ ID NO: 676617 - DNA, 25 bp, Artificial sequence
  Synthetic oligonucleotide
ccaactgatcgtcggcggcggcatc

SEQ ID NO: 676618 - DNA, 25 bp, Artificial sequence
  Synthetic oligonucleotide
tgctggccgccgaactggacgcgct

SEQ ID NO: 676619 - DNA, 25 bp, Artificial sequence
  Synthetic oligonucleotide
cgccgaggggtcgacccacggcgtg

SEQ ID NO: 676620 - DNA, 25 bp, Artificial sequence
  Synthetic oligonucleotide
aggggtcgacccacggcgtggccag

SEQ ID NO: 676621 - DNA, 25 bp, Artificial sequence
  Synthetic oligonucleotide
cccgcagaccgccgcgcagttcgcc

SEQ ID NO: 676622 - DNA, 25 bp, Artificial sequence
  Synthetic oligonucleotide
ccggacacaaggtcggcaagtcact

SEQ ID NO: 676623 - DNA, 25 bp, Artificial sequence
  Synthetic oligonucleotide
cgacccacggcgtggccaggttcgc

SEQ ID NO: 676624 - DNA, 25 bp, Artificial sequence
  Synthetic oligonucleotide
acggcgtggccaggttcgccaaggt

SEQ ID NO: 676625 - DNA, 25 bp, Artificial sequence
  Synthetic oligonucleotide
tggccaggttcgccaaggtcgccgc

SEQ ID NO: 676626 - DNA, 25 bp, Artificial sequence
  Synthetic oligonucleotide
aggttcgccaaggtcgccgccgccg

SEQ ID NO: 676627 - DNA, 25 bp, Artificial sequence
  Synthetic oligonucleotide
ccgccggcccgctgctggccgccga

SEQ ID NO: 676628 - DNA, 25 bp, Artificial sequence
  Synthetic oligonucleotide
gcccgctgctggccgccgaactgga

SEQ ID NO: 676629 - DNA, 25 bp, Artificial sequence
  Synthetic oligonucleotide
tggcggcgatcgtcgccggctccaa

SEQ ID NO: 676630 - DNA, 25 bp, Artificial sequence
  Synthetic oligonucleotide
ccgccgaactggacgcgctgggcaa

SEQ ID NO: 676631 - DNA, 25 bp, Artificial sequence
  Synthetic oligonucleotide
aactggacgcgctgggcaaggcgct

SEQ ID NO: 676632 - DNA, 25 bp, Artificial sequence
  Synthetic oligonucleotide
acgcgctgggcaaggcgctgggcaa

SEQ ID NO: 676633 - DNA, 25 bp, Artificial sequence
  Synthetic oligonucleotide
tgggcaaggcgctgggcaacccggc

SEQ ID NO: 676634 - DNA, 25 bp, Artificial sequence
  Synthetic oligonucleotide
ggcgctgggcaacccggcgcggccg

SEQ ID NO: 676635 - DNA, 25 bp, Artificial sequence
  Synthetic oligonucleotide
gggcaacccggcgcggccgatggcg

SEQ ID NO: 676636 - DNA, 25 bp, Artificial sequence
  Synthetic oligonucleotide
ccggcgcggccgatggcggcgatcg

SEQ ID NO: 676637 - DNA, 25 bp, Artificial sequence
  Synthetic oligonucleotide
cggccgatggcggcgatcgtcgccg

SEQ ID NO: 676638 - DNA, 25 bp, Artificial sequence
  Synthetic oligonucleotide
tcgccgccgccggcccgctgctggc

SEQ ID NO: 676639 - DNA, 25 bp, Artificial sequence
  Synthetic oligonucleotide
ttcgccgagctgctgaagacctcga

SEQ ID NO: 676640 - DNA, 25 bp, Artificial sequence
  Synthetic oligonucleotide
tcaaggccatcgccgaggtcgccga

SEQ ID NO: 676641 - DNA, 25 bp, Artificial sequence
  Synthetic oligonucleotide
ccatcgccgaggtcgccgacgacga

SEQ ID NO: 676642 - DNA, 25 bp, Artificial sequence
  Synthetic oligonucleotide
ccgaggtcgccgacgacgacatgat

SEQ ID NO: 676643 - DNA, 25 bp, Artificial sequence
  Synthetic oligonucleotide
tcgccgacgacgacatgatcctcga

SEQ ID NO: 676644 - DNA, 25 bp, Artificial sequence
  Synthetic oligonucleotide
acgacgacatgatcctcgacatcgg

SEQ ID NO: 676645 - DNA, 25 bp, Artificial sequence
  Synthetic oligonucleotide
acatgatcctcgacatcggcccgca

SEQ ID NO: 676646 - DNA, 25 bp, Artificial sequence
  Synthetic oligonucleotide
acatcggcccgcagaccgccgcgca

SEQ ID NO: 676647 - DNA, 25 bp, Artificial sequence
  Synthetic oligonucleotide
tcctcgacatcggcccgcagaccgc

SEQ ID NO: 676648 - DNA, 25 bp, Artificial sequence
  Synthetic oligonucleotide
gcgcagttcgccgagctgctgaaga

SEQ ID NO: 676649 - DNA, 25 bp, Artificial sequence
  Synthetic oligonucleotide
agagcgccgtggcgaccgtcaaggc

SEQ ID NO: 676650 - DNA, 25 bp, Artificial sequence
  Synthetic oligonucleotide
gagctgctgaagacctcgaagacca

SEQ ID NO: 676651 - DNA, 25 bp, Artificial sequence
  Synthetic oligonucleotide
ctgaagacctcgaagaccatcctgt

SEQ ID NO: 676652 - DNA, 25 bp, Artificial sequence
  Synthetic oligonucleotide
acctcgaagaccatcctgtggaacg

SEQ ID NO: 676653 - DNA, 25 bp, Artificial sequence
  Synthetic oligonucleotide
aagaccatcctgtggaacggtccgg

SEQ ID NO: 676654 - DNA, 25 bp, Artificial sequence
  Synthetic oligonucleotide
catcctgtggaacggtccggtcggg

SEQ ID NO: 676655 - DNA, 25 bp, Artificial sequence
  Synthetic oligonucleotide
ggtgttcgagttcgaccagttcggc

SEQ ID NO: 676656 - DNA, 25 bp, Artificial sequence
  Synthetic oligonucleotide
caccgcgccgaggggtcgacccacg

SEQ ID NO: 676657 - DNA, 25 bp, Artificial sequence
  Synthetic oligonucleotide
tcaaaggtaagcgcgtgctgatccg

SEQ ID NO: 676658 - DNA, 25 bp, Artificial sequence
  Synthetic oligonucleotide
gaccgccgcgcagttcgccgagctg

SEQ ID NO: 676659 - DNA, 25 bp, Artificial sequence
  Synthetic oligonucleotide
tcaaggtgccgctgccggtggacgt

SEQ ID NO: 676660 - DNA, 25 bp, Artificial sequence
  Synthetic oligonucleotide
tcggcaagtcactgtacgaggccga

SEQ ID NO: 676661 - DNA, 25 bp, Artificial sequence
  Synthetic oligonucleotide
agtcactgtacgaggccgacctggt

SEQ ID NO: 676662 - DNA, 25 bp, Artificial sequence
  Synthetic oligonucleotide
tgtacgaggccgacctggtcgagac

SEQ ID NO: 676663 - DNA, 25 bp, Artificial sequence
  Synthetic oligonucleotide
aggccgacctggtcgagaccgccaa

SEQ ID NO: 676664 - DNA, 25 bp, Artificial sequence
  Synthetic oligonucleotide
acctggtcgagaccgccaaggccat

SEQ ID NO: 676665 - DNA, 25 bp, Artificial sequence
  Synthetic oligonucleotide
tcgagaccgccaaggccatcgccgc

SEQ ID NO: 676666 - DNA, 25 bp, Artificial sequence
  Synthetic oligonucleotide
ccgccaaggccatcgccgccaaggt

SEQ ID NO: 676667 - DNA, 25 bp, Artificial sequence
  Synthetic oligonucleotide
aggccatcgccgccaaggtcaaggt

SEQ ID NO: 676668 - DNA, 25 bp, Artificial sequence
  Synthetic oligonucleotide
gaccgtcaaggccatcgccgaggtc

SEQ ID NO: 676669 - DNA, 25 bp, Artificial sequence
  Synthetic oligonucleotide
ccaaggtcaaggtgccgctgccggt

SEQ ID NO: 676670 - DNA, 25 bp, Artificial sequence
  Synthetic oligonucleotide
ccgtggcgaccgtcaaggccatcgc

SEQ ID NO: 676671 - DNA, 25 bp, Artificial sequence
  Synthetic oligonucleotide
tgccgctgccggtggacgtggtggt

SEQ ID NO: 676672 - DNA, 25 bp, Artificial sequence
  Synthetic oligonucleotide
tgccggtggacgtggtggtggccaa

SEQ ID NO: 676673 - DNA, 25 bp, Artificial sequence
  Synthetic oligonucleotide
tggacgtggtggtggccaaggaatt

SEQ ID NO: 676674 - DNA, 25 bp, Artificial sequence
  Synthetic oligonucleotide
tggtggtggccaaggaattcgccga

SEQ ID NO: 676675 - DNA, 25 bp, Artificial sequence
  Synthetic oligonucleotide
tggccaaggaattcgccgagagcgc

SEQ ID NO: 676676 - DNA, 25 bp, Artificial sequence
  Synthetic oligonucleotide
aggaattcgccgagagcgccgtggc

SEQ ID NO: 676677 - DNA, 25 bp, Artificial sequence
  Synthetic oligonucleotide
tcgccgagagcgccgtggcgaccgt

SEQ ID NO: 676678 - DNA, 25 bp, Artificial sequence
  Synthetic oligonucleotide
acaaggtcggcaagtcactgtacga

SEQ ID NO: 676679 - DNA, 25 bp, Artificial sequence
  Synthetic oligonucleotide
tcgccgccaaggtcaaggtgccgct

SEQ ID NO: 676680 - DNA, 25 bp, Artificial sequence
  Synthetic oligonucleotide
caaggccgccctgccgaccctcaag

SEQ ID NO: 676681 - DNA, 25 bp, Artificial sequence
  Synthetic oligonucleotide
gaggacctcaacgtgcccgtgaagg

SEQ ID NO: 676682 - DNA, 25 bp, Artificial sequence
  Synthetic oligonucleotide
ctcaacgtgcccgtgaaggacggcc

SEQ ID NO: 676683 - DNA, 25 bp, Artificial sequence
  Synthetic oligonucleotide
gtgcccgtgaaggacggccaggtgc

SEQ ID NO: 676684 - DNA, 25 bp, Artificial sequence
  Synthetic oligonucleotide
gtgaaggacggccaggtgcagagcg

SEQ ID NO: 676685 - DNA, 25 bp, Artificial sequence
  Synthetic oligonucleotide
gacggccaggtgcagagcgatgcac

SEQ ID NO: 676686 - DNA, 25 bp, Artificial sequence
  Synthetic oligonucleotide
caggtgcagagcgatgcacggatca

SEQ ID NO: 676687 - DNA, 25 bp, Artificial sequence
  Synthetic oligonucleotide
cagagcgatgcacggatcaaggccg

SEQ ID NO: 676688 - DNA, 25 bp, Artificial sequence
  Synthetic oligonucleotide
gtgctgatccgcgaggacctcaacg

SEQ ID NO: 676689 - DNA, 25 bp, Artificial sequence
  Synthetic oligonucleotide
acggatcaaggccgccctgccgacc

SEQ ID NO: 676690 - DNA, 25 bp, Artificial sequence
  Synthetic oligonucleotide
tcgacctcaaaggtaagcgcgtgct

SEQ ID NO: 676691 - DNA, 25 bp, Artificial sequence
  Synthetic oligonucleotide
gccctgccgaccctcaagctggccc

SEQ ID NO: 676692 - DNA, 25 bp, Artificial sequence
  Synthetic oligonucleotide
cgaccctcaagctggccctggagaa

SEQ ID NO: 676693 - DNA, 25 bp, Artificial sequence
  Synthetic oligonucleotide
tcaagctggccctggagaagggcgc

SEQ ID NO: 676694 - DNA, 25 bp, Artificial sequence
  Synthetic oligonucleotide
tggccctggagaagggcgcggcggt

SEQ ID NO: 676695 - DNA, 25 bp, Artificial sequence
  Synthetic oligonucleotide
ggagaagggcgcggcggtgatggtc

SEQ ID NO: 676696 - DNA, 25 bp, Artificial sequence
  Synthetic oligonucleotide
gggcgcggcggtgatggtctgctcg

SEQ ID NO: 676697 - DNA, 25 bp, Artificial sequence
  Synthetic oligonucleotide
cggcggtgatggtctgctcgcacct

SEQ ID NO: 676698 - DNA, 25 bp, Artificial sequence
  Synthetic oligonucleotide
gtgatggtctgctcgcacctgggcc

SEQ ID NO: 676699 - DNA, 25 bp, Artificial sequence
  Synthetic oligonucleotide
gatgcacggatcaaggccgccctgc

SEQ ID NO: 676700 - DNA, 25 bp, Artificial sequence
  Synthetic oligonucleotide
caagtacccaaggactgattgtcat

SEQ ID NO: 676701 - DNA, 25 bp, Artificial sequence
  Synthetic oligonucleotide
cgagttcgaccagttcggcgagggc

SEQ ID NO: 676702 - DNA, 25 bp, Artificial sequence
  Synthetic oligonucleotide
accgtatgctcgacgtcgccggaca

SEQ ID NO: 676703 - DNA, 25 bp, Artificial sequence
  Synthetic oligonucleotide
tgctcgacgtcgccggacactacct

SEQ ID NO: 676704 - DNA, 25 bp, Artificial sequence
  Synthetic oligonucleotide
acgtcgccggacactacctgcgcgc

SEQ ID NO: 676705 - DNA, 25 bp, Artificial sequence
  Synthetic oligonucleotide
ccggacactacctgcgcgccgccgt

SEQ ID NO: 676706 - DNA, 25 bp, Artificial sequence
  Synthetic oligonucleotide
actacctgcgcgccgccgtgcctga

SEQ ID NO: 676707 - DNA, 25 bp, Artificial sequence
  Synthetic oligonucleotide
tgcgcgccgccgtgcctgatcaaca

SEQ ID NO: 676708 - DNA, 25 bp, Artificial sequence
  Synthetic oligonucleotide
ccgccgtgcctgatcaacaagtacc

SEQ ID NO: 676709 - DNA, 25 bp, Artificial sequence
  Synthetic oligonucleotide
atccgcgaggacctcaacgtgcccg

SEQ ID NO: 676710 - DNA, 25 bp, Artificial sequence
  Synthetic oligonucleotide
gatcaacaagtacccaaggactgat

SEQ ID NO: 676711 - DNA, 25 bp, Artificial sequence
  Synthetic oligonucleotide
taagcgcgtgctgatccgcgaggac

SEQ ID NO: 676712 - DNA, 25 bp, Artificial sequence
  Synthetic oligonucleotide
cccaaggactgattgtcatgaccgt

SEQ ID NO: 676713 - DNA, 25 bp, Artificial sequence
  Synthetic oligonucleotide
gactgattgtcatgaccgtgttgaa

SEQ ID NO: 676714 - DNA, 25 bp, Artificial sequence
  Synthetic oligonucleotide
ttgtcatgaccgtgttgaagatgac

SEQ ID NO: 676715 - DNA, 25 bp, Artificial sequence
  Synthetic oligonucleotide
tgaccgtgttgaagatgactgacct

SEQ ID NO: 676716 - DNA, 25 bp, Artificial sequence
  Synthetic oligonucleotide
tgttgaagatgactgacctcgacct

SEQ ID NO: 676717 - DNA, 25 bp, Artificial sequence
  Synthetic oligonucleotide
agatgactgacctcgacctcaaagg

SEQ ID NO: 676718 - DNA, 25 bp, Artificial sequence
  Synthetic oligonucleotide
ctgacctcgacctcaaaggtaagcg

SEQ ID NO: 676719 - DNA, 25 bp, Artificial sequence
  Synthetic oligonucleotide
ctgggccgtccgaccgagggcgagt

SEQ ID NO: 676720 - DNA, 25 bp, Artificial sequence
  Synthetic oligonucleotide
tgcctgatcaacaagtacccaagga

SEQ ID NO: 676721 - DNA, 25 bp, Artificial sequence
  Synthetic oligonucleotide
cgacgagctggcgcagaagtacgcc

SEQ ID NO: 676722 - DNA, 25 bp, Artificial sequence
  Synthetic oligonucleotide
gtctgctcgcacctgggccgtccga

SEQ ID NO: 676723 - DNA, 25 bp, Artificial sequence
  Synthetic oligonucleotide
gcgacctggtgctgttcgagaacgt

SEQ ID NO: 676724 - DNA, 25 bp, Artificial sequence
  Synthetic oligonucleotide
tggtgctgttcgagaacgtgcgctt

SEQ ID NO: 676725 - DNA, 25 bp, Artificial sequence
  Synthetic oligonucleotide
tgttcgagaacgtgcgcttcaacaa

SEQ ID NO: 676726 - DNA, 25 bp, Artificial sequence
  Synthetic oligonucleotide
agaacgtgcgcttcaacaagggcga

SEQ ID NO: 676727 - DNA, 25 bp, Artificial sequence
  Synthetic oligonucleotide
tgcgcttcaacaagggcgagaagaa

SEQ ID NO: 676728 - DNA, 25 bp, Artificial sequence
  Synthetic oligonucleotide
tcaacaagggcgagaagaagaacgc

SEQ ID NO: 676729 - DNA, 25 bp, Artificial sequence
  Synthetic oligonucleotide
agggcgagaagaagaacgccgacga

SEQ ID NO: 676730 - DNA, 25 bp, Artificial sequence
  Synthetic oligonucleotide
aggtcaaggcgggcgacctggtgct

SEQ ID NO: 676731 - DNA, 25 bp, Artificial sequence
  Synthetic oligonucleotide
agaacgccgacgagctggcgcagaa

SEQ ID NO: 676732 - DNA, 25 bp, Artificial sequence
  Synthetic oligonucleotide
gcgtcgaggtcaaggcgggcgacct

SEQ ID NO: 676733 - DNA, 25 bp, Artificial sequence
  Synthetic oligonucleotide
ctggcgcagaagtacgccgcgctgt

SEQ ID NO: 676734 - DNA, 25 bp, Artificial sequence
  Synthetic oligonucleotide
cagaagtacgccgcgctgtgcgacg

SEQ ID NO: 676735 - DNA, 25 bp, Artificial sequence
  Synthetic oligonucleotide
tacgccgcgctgtgcgacgtgttcg

SEQ ID NO: 676736 - DNA, 25 bp, Artificial sequence
  Synthetic oligonucleotide
gcgctgtgcgacgtgttcgtgatgg

SEQ ID NO: 676737 - DNA, 25 bp, Artificial sequence
  Synthetic oligonucleotide
tgcgacgtgttcgtgatggatgcct

SEQ ID NO: 676738 - DNA, 25 bp, Artificial sequence
  Synthetic oligonucleotide
gtgttcgtgatggatgccttcggta

SEQ ID NO: 676739 - DNA, 25 bp, Artificial sequence
  Synthetic oligonucleotide
gtgatggatgccttcggtaccgccc

SEQ ID NO: 676740 - DNA, 25 bp, Artificial sequence
  Synthetic oligonucleotide
gatgccttcggtaccgcccaccgcg

SEQ ID NO: 676741 - DNA, 25 bp, Artificial sequence
  Synthetic oligonucleotide
agaagaagaacgccgacgagctggc

SEQ ID NO: 676742 - DNA, 25 bp, Artificial sequence
  Synthetic oligonucleotide
acctgtccaaggccctgggccgcga

SEQ ID NO: 676743 - DNA, 25 bp, Artificial sequence
  Synthetic oligonucleotide
cttcggtaccgcccaccgcgccgag

SEQ ID NO: 676744 - DNA, 25 bp, Artificial sequence
  Synthetic oligonucleotide
cgtccgaccgagggcgagttctccg

SEQ ID NO: 676745 - DNA, 25 bp, Artificial sequence
  Synthetic oligonucleotide
accgagggcgagttctccgccgaga

SEQ ID NO: 676746 - DNA, 25 bp, Artificial sequence
  Synthetic oligonucleotide
gcgagttctccgccgagaacagcct

SEQ ID NO: 676747 - DNA, 25 bp, Artificial sequence
  Synthetic oligonucleotide
ttctccgccgagaacagcctgaagc

SEQ ID NO: 676748 - DNA, 25 bp, Artificial sequence
  Synthetic oligonucleotide
gccgagaacagcctgaagccggtgg

SEQ ID NO: 676749 - DNA, 25 bp, Artificial sequence
  Synthetic oligonucleotide
aacagcctgaagccggtggccgagt

SEQ ID NO: 676750 - DNA, 25 bp, Artificial sequence
  Synthetic oligonucleotide
tgaagccggtggccgagtacctgtc

SEQ ID NO: 676751 - DNA, 25 bp, Artificial sequence
  Synthetic oligonucleotide
aggcgggcgacctggtgctgttcga

SEQ ID NO: 676752 - DNA, 25 bp, Artificial sequence
  Synthetic oligonucleotide
ccgagtacctgtccaaggccctggg

SEQ ID NO: 676753 - DNA, 25 bp, Artificial sequence
  Synthetic oligonucleotide
tcgcacctgggccgtccgaccgagg

SEQ ID NO: 676754 - DNA, 25 bp, Artificial sequence
  Synthetic oligonucleotide
ccaaggccctgggccgcgaagtgcc

SEQ ID NO: 676755 - DNA, 25 bp, Artificial sequence
  Synthetic oligonucleotide
ccctgggccgcgaagtgccgctgct

SEQ ID NO: 676756 - DNA, 25 bp, Artificial sequence
  Synthetic oligonucleotide
gccgcgaagtgccgctgctggccga

SEQ ID NO: 676757 - DNA, 25 bp, Artificial sequence
  Synthetic oligonucleotide
aagtgccgctgctggccgactacct

SEQ ID NO: 676758 - DNA, 25 bp, Artificial sequence
  Synthetic oligonucleotide
cgctgctggccgactacctcgacgg

SEQ ID NO: 676759 - DNA, 25 bp, Artificial sequence
  Synthetic oligonucleotide
tggccgactacctcgacggcgtcga

SEQ ID NO: 676760 - DNA, 25 bp, Artificial sequence
  Synthetic oligonucleotide
actacctcgacggcgtcgaggtcaa

SEQ ID NO: 676761 - DNA, 25 bp, Artificial sequence
  Synthetic oligonucleotide
tcgacggcgtcgaggtcaaggcggg

SEQ ID NO: 676762 - DNA, 25 bp, Artificial sequence
  Synthetic oligonucleotide
cggtggccgagtacctgtccaaggc

SEQ ID NO: 676763 - DNA, 25 bp, Artificial sequence
  Synthetic oligonucleotide
cttcagctcggtgatgatggacggc

SEQ ID NO: 676764 - DNA, 25 bp, Artificial sequence
  Synthetic oligonucleotide
gtcatgcaccaggatcacggcacca

SEQ ID NO: 676765 - DNA, 25 bp, Artificial sequence
  Synthetic oligonucleotide
ctacgactacaacgtccgtgtgacc

SEQ ID NO: 676766 - DNA, 25 bp, Artificial sequence
  Synthetic oligonucleotide
tgccgactacgactacaacgtccgt

SEQ ID NO: 676767 - DNA, 25 bp, Artificial sequence
  Synthetic oligonucleotide
agacccctgccgactacgactacaa

SEQ ID NO: 676768 - DNA, 25 bp, Artificial sequence
  Synthetic oligonucleotide
acggcaagacccctgccgactacga

SEQ ID NO: 676769 - DNA, 25 bp, Artificial sequence
  Synthetic oligonucleotide
gtgaagacggcaagacccctgccga

SEQ ID NO: 676770 - DNA, 25 bp, Artificial sequence
  Synthetic oligonucleotide
cctgcgtgaagacggcaagacccct

SEQ ID NO: 676771 - DNA, 25 bp, Artificial sequence
  Synthetic oligonucleotide
acggctccctgcgtgaagacggcaa

SEQ ID NO: 676772 - DNA, 25 bp, Artificial sequence
  Synthetic oligonucleotide
acgtccgtgtgacccagcagaccgt

SEQ ID NO: 676773 - DNA, 25 bp, Artificial sequence
  Synthetic oligonucleotide
ctcggtgatgatggacggctccctg

SEQ ID NO: 676774 - DNA, 25 bp, Artificial sequence
  Synthetic oligonucleotide
gtgtgacccagcagaccgtggcgtt

SEQ ID NO: 676775 - DNA, 25 bp, Artificial sequence
  Synthetic oligonucleotide
gctgggcttcagctcggtgatgatg

SEQ ID NO: 676776 - DNA, 25 bp, Artificial sequence
  Synthetic oligonucleotide
catccagctgggcttcagctcggtg

SEQ ID NO: 676777 - DNA, 25 bp, Artificial sequence
  Synthetic oligonucleotide
agcgttccatccagctgggcttcag

SEQ ID NO: 676778 - DNA, 25 bp, Artificial sequence
  Synthetic oligonucleotide
tctgccagcgttccatccagctggg

SEQ ID NO: 676779 - DNA, 25 bp, Artificial sequence
  Synthetic oligonucleotide
ccgacgtctgccagcgttccatcca

SEQ ID NO: 676780 - DNA, 25 bp, Artificial sequence
  Synthetic oligonucleotide
ccagtcccgacgtctgccagcgttc

SEQ ID NO: 676781 - DNA, 25 bp, Artificial sequence
  Synthetic oligonucleotide
acggcaccagtcccgacgtctgcca

SEQ ID NO: 676782 - DNA, 25 bp, Artificial sequence
  Synthetic oligonucleotide
aggatcacggcaccagtcccgacgt

SEQ ID NO: 676783 - DNA, 25 bp, Artificial sequence
  Synthetic oligonucleotide
ccccgcgattgggagatacgagaac

SEQ ID NO: 676784 - DNA, 25 bp, Artificial sequence
  Synthetic oligonucleotide
atgatggacggctccctgcgtgaag

SEQ ID NO: 676785 - DNA, 25 bp, Artificial sequence
  Synthetic oligonucleotide
tgggctgcctgggttccctggaaac

SEQ ID NO: 676786 - DNA, 25 bp, Artificial sequence
  Synthetic oligonucleotide
tgctggaccacagccagttgctgac

SEQ ID NO: 676787 - DNA, 25 bp, Artificial sequence
  Synthetic oligonucleotide
gaaggcgtgctggaccacagccagt

SEQ ID NO: 676788 - DNA, 25 bp, Artificial sequence
  Synthetic oligonucleotide
ggcgcggaaggcgtgctggaccaca

SEQ ID NO: 676789 - DNA, 25 bp, Artificial sequence
  Synthetic oligonucleotide
cggcgtcggcgcggaaggcgtgctg

SEQ ID NO: 676790 - DNA, 25 bp, Artificial sequence
  Synthetic oligonucleotide
ggaagacggcgtcggcgcggaaggc

SEQ ID NO: 676791 - DNA, 25 bp, Artificial sequence
  Synthetic oligonucleotide
ccggcgaggaagacggcgtcggcgc

SEQ ID NO: 676792 - DNA, 25 bp, Artificial sequence
  Synthetic oligonucleotide
ggcatggccggcgaggaagacggcg

SEQ ID NO: 676793 - DNA, 25 bp, Artificial sequence
  Synthetic oligonucleotide
ggaaaccggcatggccggcgaggaa

SEQ ID NO: 676794 - DNA, 25 bp, Artificial sequence
  Synthetic oligonucleotide
ctacaacgtccgtgtgacccagcag

SEQ ID NO: 676795 - DNA, 25 bp, Artificial sequence
  Synthetic oligonucleotide
cctgggttccctggaaaccggcatg

SEQ ID NO: 676796 - DNA, 25 bp, Artificial sequence
  Synthetic oligonucleotide
ccggtggtcatgcaccaggatcacg

SEQ ID NO: 676797 - DNA, 25 bp, Artificial sequence
  Synthetic oligonucleotide
ggcgagctgggctgcctgggttccc

SEQ ID NO: 676798 - DNA, 25 bp, Artificial sequence
  Synthetic oligonucleotide
gtggaaggcgagctgggctgcctgg

SEQ ID NO: 676799 - DNA, 25 bp, Artificial sequence
  Synthetic oligonucleotide
gtgtccgtggaaggcgagctgggct

SEQ ID NO: 676800 - DNA, 25 bp, Artificial sequence
  Synthetic oligonucleotide
gcggcgtgtccgtggaaggcgagct

SEQ ID NO: 676801 - DNA, 25 bp, Artificial sequence
  Synthetic oligonucleotide
atgcctgcggcgtgtccgtggaagg

SEQ ID NO: 676802 - DNA, 25 bp, Artificial sequence
  Synthetic oligonucleotide
tcgcccatgcctgcggcgtgtccgt

SEQ ID NO: 676803 - DNA, 25 bp, Artificial sequence
  Synthetic oligonucleotide
tggcgttcgcccatgcctgcggcgt

SEQ ID NO: 676804 - DNA, 25 bp, Artificial sequence
  Synthetic oligonucleotide
agaccgtggcgttcgcccatgcctg

SEQ ID NO: 676805 - DNA, 25 bp, Artificial sequence
  Synthetic oligonucleotide
cccagcagaccgtggcgttcgccca

SEQ ID NO: 676806 - DNA, 25 bp, Artificial sequence
  Synthetic oligonucleotide
ttccctggaaaccggcatggccggc

SEQ ID NO: 676807 - DNA, 25 bp, Artificial sequence
  Synthetic oligonucleotide
acgccgccgaattcggctacggcgt

SEQ ID NO: 676808 - DNA, 25 bp, Artificial sequence
  Synthetic oligonucleotide
gcaccaggatcacggcaccagtccc

SEQ ID NO: 676809 - DNA, 25 bp, Artificial sequence
  Synthetic oligonucleotide
agatgcgcgccatcatggaagcggc

SEQ ID NO: 676810 - DNA, 25 bp, Artificial sequence
  Synthetic oligonucleotide
tcgagcagatgcgcgccatcatgga

SEQ ID NO: 676811 - DNA, 25 bp, Artificial sequence
  Synthetic oligonucleotide
acaacctcgagcagatgcgcgccat

SEQ ID NO: 676812 - DNA, 25 bp, Artificial sequence
  Synthetic oligonucleotide
acgtcaacaacctcgagcagatgcg

SEQ ID NO: 676813 - DNA, 25 bp, Artificial sequence
  Synthetic oligonucleotide
ccttcaacgtcaacaacctcgagca

SEQ ID NO: 676814 - DNA, 25 bp, Artificial sequence
  Synthetic oligonucleotide
tgccggccttcaacgtcaacaacct

SEQ ID NO: 676815 - DNA, 25 bp, Artificial sequence
  Synthetic oligonucleotide
acggcgtgccggccttcaacgtcaa

SEQ ID NO: 676816 - DNA, 25 bp, Artificial sequence
  Synthetic oligonucleotide
atcatggaagcggcggacaagaccg

SEQ ID NO: 676817 - DNA, 25 bp, Artificial sequence
  Synthetic oligonucleotide
ccgaattcggctacggcgtgccggc

SEQ ID NO: 676818 - DNA, 25 bp, Artificial sequence
  Synthetic oligonucleotide
gaagcggcggacaagaccgattcgc

SEQ ID NO: 676819 - DNA, 25 bp, Artificial sequence
  Synthetic oligonucleotide
tggatcacgccgccgaattcggcta

SEQ ID NO: 676820 - DNA, 25 bp, Artificial sequence
  Synthetic oligonucleotide
agatgctggatcacgccgccgaatt

SEQ ID NO: 676821 - DNA, 25 bp, Artificial sequence
  Synthetic oligonucleotide
tgcgccagatgctggatcacgccgc

SEQ ID NO: 676822 - DNA, 25 bp, Artificial sequence
  Synthetic oligonucleotide
cagcatgcgccagatgctggatcac

SEQ ID NO: 676823 - DNA, 25 bp, Artificial sequence
  Synthetic oligonucleotide
actcatcagcatgcgccagatgctg

SEQ ID NO: 676824 - DNA, 25 bp, Artificial sequence
  Synthetic oligonucleotide
catggcactcatcagcatgcgccag

SEQ ID NO: 676825 - DNA, 25 bp, Artificial sequence
  Synthetic oligonucleotide
cgagaaccatggcactcatcagcat

SEQ ID NO: 676826 - DNA, 25 bp, Artificial sequence
  Synthetic oligonucleotide
gagatacgagaaccatggcactcat

SEQ ID NO: 676827 - DNA, 25 bp, Artificial sequence
  Synthetic oligonucleotide
gattgggagatacgagaaccatggc

SEQ ID NO: 676828 - DNA, 25 bp, Artificial sequence
  Synthetic oligonucleotide
tcggctacggcgtgccggccttcaa

SEQ ID NO: 676829 - DNA, 25 bp, Artificial sequence
  Synthetic oligonucleotide
aatacgccggcgcgcccttcctgcg

SEQ ID NO: 676830 - DNA, 25 bp, Artificial sequence
  Synthetic oligonucleotide
gcacatcccggtggtcatgcaccag

SEQ ID NO: 676831 - DNA, 25 bp, Artificial sequence
  Synthetic oligonucleotide
attcccgcacatcccggtggtcatg

SEQ ID NO: 676832 - DNA, 25 bp, Artificial sequence
  Synthetic oligonucleotide
gaagaattcccgcacatcccggtgg

SEQ ID NO: 676833 - DNA, 25 bp, Artificial sequence
  Synthetic oligonucleotide
gcgatcgaagaattcccgcacatcc

SEQ ID NO: 676834 - DNA, 25 bp, Artificial sequence
  Synthetic oligonucleotide
tcgccgcgatcgaagaattcccgca

SEQ ID NO: 676835 - DNA, 25 bp, Artificial sequence
  Synthetic oligonucleotide
tgatcctcgccgcgatcgaagaatt

SEQ ID NO: 676836 - DNA, 25 bp, Artificial sequence
  Synthetic oligonucleotide
gccacctgatcctcgccgcgatcga

SEQ ID NO: 676837 - DNA, 25 bp, Artificial sequence
  Synthetic oligonucleotide
tcctgcgccacctgatcctcgccgc

SEQ ID NO: 676838 - DNA, 25 bp, Artificial sequence
  Synthetic oligonucleotide
gcgccatcatggaagcggcggacaa

SEQ ID NO: 676839 - DNA, 25 bp, Artificial sequence
  Synthetic oligonucleotide
ccggcgcgcccttcctgcgccacct

SEQ ID NO: 676840 - DNA, 25 bp, Artificial sequence
  Synthetic oligonucleotide
ttgctgaccgatccggaagaagccg

SEQ ID NO: 676841 - DNA, 25 bp, Artificial sequence
  Synthetic oligonucleotide
tcgcaaatacgccggcgcgcccttc

SEQ ID NO: 676842 - DNA, 25 bp, Artificial sequence
  Synthetic oligonucleotide
cggtgctcgcaaatacgccggcgcg

SEQ ID NO: 676843 - DNA, 25 bp, Artificial sequence
  Synthetic oligonucleotide
ttccgccggtgctcgcaaatacgcc

SEQ ID NO: 676844 - DNA, 25 bp, Artificial sequence
  Synthetic oligonucleotide
ccaggcttccgccggtgctcgcaaa

SEQ ID NO: 676845 - DNA, 25 bp, Artificial sequence
  Synthetic oligonucleotide
gatcgtccaggcttccgccggtgct

SEQ ID NO: 676846 - DNA, 25 bp, Artificial sequence
  Synthetic oligonucleotide
cccgtgatcgtccaggcttccgccg

SEQ ID NO: 676847 - DNA, 25 bp, Artificial sequence
  Synthetic oligonucleotide
gattcgcccgtgatcgtccaggctt

SEQ ID NO: 676848 - DNA, 25 bp, Artificial sequence
  Synthetic oligonucleotide
aagaccgattcgcccgtgatcgtcc

SEQ ID NO: 676849 - DNA, 25 bp, Artificial sequence
  Synthetic oligonucleotide
gcggacaagaccgattcgcccgtga

SEQ ID NO: 676850 - DNA, 25 bp, Artificial sequence
  Synthetic oligonucleotide
cgcccttcctgcgccacctgatcct

SEQ ID NO: 676851 - DNA, 25 bp, Artificial sequence
  Synthetic oligonucleotide
ctccaccggtgccatccgccgcttc

SEQ ID NO: 676852 - DNA, 25 bp, Artificial sequence
  Synthetic oligonucleotide
accacagccagttgctgaccgatcc

SEQ ID NO: 676853 - DNA, 25 bp, Artificial sequence
  Synthetic oligonucleotide
cgcaagtacttctccaagaccgtcg

SEQ ID NO: 676854 - DNA, 25 bp, Artificial sequence
  Synthetic oligonucleotide
gacccgcgcaagtacttctccaaga

SEQ ID NO: 676855 - DNA, 25 bp, Artificial sequence
  Synthetic oligonucleotide
gagttcgacccgcgcaagtacttct

SEQ ID NO: 676856 - DNA, 25 bp, Artificial sequence
  Synthetic oligonucleotide
cccgagcgagttcgacccgcgcaag

SEQ ID NO: 676857 - DNA, 25 bp, Artificial sequence
  Synthetic oligonucleotide
gcagaacccgagcgagttcgacccg

SEQ ID NO: 676858 - DNA, 25 bp, Artificial sequence
  Synthetic oligonucleotide
cctggcgcagaacccgagcgagttc

SEQ ID NO: 676859 - DNA, 25 bp, Artificial sequence
  Synthetic oligonucleotide
cgcttcctggcgcagaacccgagcg

SEQ ID NO: 676860 - DNA, 25 bp, Artificial sequence
  Synthetic oligonucleotide
tccaagaccgtcgaggccatgcgcg

SEQ ID NO: 676861 - DNA, 25 bp, Artificial sequence
  Synthetic oligonucleotide
cggtgccatccgccgcttcctggcg

SEQ ID NO: 676862 - DNA, 25 bp, Artificial sequence
  Synthetic oligonucleotide
accgtcgaggccatgcgcgacatct

SEQ ID NO: 676863 - DNA, 25 bp, Artificial sequence
  Synthetic oligonucleotide
gcctggcctccaccggtgccatccg

SEQ ID NO: 676864 - DNA, 25 bp, Artificial sequence
  Synthetic oligonucleotide
acctgcgcctggcctccaccggtgc

SEQ ID NO: 676865 - DNA, 25 bp, Artificial sequence
  Synthetic oligonucleotide
acaccgacctgcgcctggcctccac

SEQ ID NO: 676866 - DNA, 25 bp, Artificial sequence
  Synthetic oligonucleotide
acatcgacaccgacctgcgcctggc

SEQ ID NO: 676867 - DNA, 25 bp, Artificial sequence
  Synthetic oligonucleotide
aggtgaacatcgacaccgacctgcg

SEQ ID NO: 676868 - DNA, 25 bp, Artificial sequence
  Synthetic oligonucleotide
tgcgcaaggtgaacatcgacaccga

SEQ ID NO: 676869 - DNA, 25 bp, Artificial sequence
  Synthetic oligonucleotide
acggcgtgcgcaaggtgaacatcga

SEQ ID NO: 676870 - DNA, 25 bp, Artificial sequence
  Synthetic oligonucleotide
tcaagtacggcgtgcgcaaggtgaa

SEQ ID NO: 676871 - DNA, 25 bp, Artificial sequence
  Synthetic oligonucleotide
agggcatcaagtacggcgtgcgcaa

SEQ ID NO: 676872 - DNA, 25 bp, Artificial sequence
  Synthetic oligonucleotide
catccgccgcttcctggcgcagaac

SEQ ID NO: 676873 - DNA, 25 bp, Artificial sequence
  Synthetic oligonucleotide
aacgcttccaagatcaagccgatct

SEQ ID NO: 676874 - DNA, 25 bp, Artificial sequence
  Synthetic oligonucleotide
gaccagttcggcgagggcacccgta

SEQ ID NO: 676875 - DNA, 25 bp, Artificial sequence
  Synthetic oligonucleotide
gcggcgagctggatccgaaggtcaa

SEQ ID NO: 676876 - DNA, 25 bp, Artificial sequence
  Synthetic oligonucleotide
acgctcgcggcgagctggatccgaa

SEQ ID NO: 676877 - DNA, 25 bp, Artificial sequence
  Synthetic oligonucleotide
agcgctacgctcgcggcgagctgga

SEQ ID NO: 676878 - DNA, 25 bp, Artificial sequence
  Synthetic oligonucleotide
tgttccagcgctacgctcgcggcga

SEQ ID NO: 676879 - DNA, 25 bp, Artificial sequence
  Synthetic oligonucleotide
aaggcatgttccagcgctacgctcg

SEQ ID NO: 676880 - DNA, 25 bp, Artificial sequence
  Synthetic oligonucleotide
cctggaaggcatgttccagcgctac

SEQ ID NO: 676881 - DNA, 25 bp, Artificial sequence
  Synthetic oligonucleotide
cgatctccctggaaggcatgttcca

SEQ ID NO: 676882 - DNA, 25 bp, Artificial sequence
  Synthetic oligonucleotide
tacttctccaagaccgtcgaggcca

SEQ ID NO: 676883 - DNA, 25 bp, Artificial sequence
  Synthetic oligonucleotide
tccaagatcaagccgatctccctgg

SEQ ID NO: 676884 - DNA, 25 bp, Artificial sequence
  Synthetic oligonucleotide
gtcgaggaaatcgtcgagggcatca

SEQ ID NO: 676885 - DNA, 25 bp, Artificial sequence
  Synthetic oligonucleotide
gccggcaacgcttccaagatcaagc

SEQ ID NO: 676886 - DNA, 25 bp, Artificial sequence
  Synthetic oligonucleotide
ggcaccgccggcaacgcttccaaga

SEQ ID NO: 676887 - DNA, 25 bp, Artificial sequence
  Synthetic oligonucleotide
gccttcggcaccgccggcaacgctt

SEQ ID NO: 676888 - DNA, 25 bp, Artificial sequence
  Synthetic oligonucleotide
tacgaagccttcggcaccgccggca

SEQ ID NO: 676889 - DNA, 25 bp, Artificial sequence
  Synthetic oligonucleotide
gctcgctacgaagccttcggcaccg

SEQ ID NO: 676890 - DNA, 25 bp, Artificial sequence
  Synthetic oligonucleotide
tgcatcgctcgctacgaagccttcg

SEQ ID NO: 676891 - DNA, 25 bp, Artificial sequence
  Synthetic oligonucleotide
gacatctgcatcgctcgctacgaag

SEQ ID NO: 676892 - DNA, 25 bp, Artificial sequence
  Synthetic oligonucleotide
atgcgcgacatctgcatcgctcgct

SEQ ID NO: 676893 - DNA, 25 bp, Artificial sequence
  Synthetic oligonucleotide
gaggccatgcgcgacatctgcatcg

SEQ ID NO: 676894 - DNA, 25 bp, Artificial sequence
  Synthetic oligonucleotide
atcaagccgatctccctggaaggca

SEQ ID NO: 676895 - DNA, 25 bp, Artificial sequence
  Synthetic oligonucleotide
cctggccatcgccatcggcaccagc

SEQ ID NO: 676896 - DNA, 25 bp, Artificial sequence
  Synthetic oligonucleotide
acaccctgtcgatccagcgcatcaa

SEQ ID NO: 676897 - DNA, 25 bp, Artificial sequence
  Synthetic oligonucleotide
ccggggacaccctgtcgatccagcg

SEQ ID NO: 676898 - DNA, 25 bp, Artificial sequence
  Synthetic oligonucleotide
cgccgaccggggacaccctgtcgat

SEQ ID NO: 676899 - DNA, 25 bp, Artificial sequence
  Synthetic oligonucleotide
tcaccaagccgccgaccggggacac

SEQ ID NO: 676900 - DNA, 25 bp, Artificial sequence
  Synthetic oligonucleotide
caagttcaccaagccgccgaccggg

SEQ ID NO: 676901 - DNA, 25 bp, Artificial sequence
  Synthetic oligonucleotide
gcctacaagttcaccaagccgccga

SEQ ID NO: 676902 - DNA, 25 bp, Artificial sequence
  Synthetic oligonucleotide
cacggcgcctacaagttcaccaagc

SEQ ID NO: 676903 - DNA, 25 bp, Artificial sequence
  Synthetic oligonucleotide
accagccacggcgcctacaagttca

SEQ ID NO: 676904 - DNA, 25 bp, Artificial sequence
  Synthetic oligonucleotide
tcgtcgagggcatcaagtacggcgt

SEQ ID NO: 676905 - DNA, 25 bp, Artificial sequence
  Synthetic oligonucleotide
atcgccatcggcaccagccacggcg

SEQ ID NO: 676906 - DNA, 25 bp, Artificial sequence
  Synthetic oligonucleotide
gcatcaaggaaatccacgcgcgcat

SEQ ID NO: 676907 - DNA, 25 bp, Artificial sequence
  Synthetic oligonucleotide
tcgacgccctggccatcgccatcgg

SEQ ID NO: 676908 - DNA, 25 bp, Artificial sequence
  Synthetic oligonucleotide
ccaaggtcgacgccctggccatcgc

SEQ ID NO: 676909 - DNA, 25 bp, Artificial sequence
  Synthetic oligonucleotide
agaagaccaaggtcgacgccctggc

SEQ ID NO: 676910 - DNA, 25 bp, Artificial sequence
  Synthetic oligonucleotide
tcgtgaagaagaccaaggtcgacgc

SEQ ID NO: 676911 - DNA, 25 bp, Artificial sequence
  Synthetic oligonucleotide
ccgacttcgtgaagaagaccaaggt

SEQ ID NO: 676912 - DNA, 25 bp, Artificial sequence
  Synthetic oligonucleotide
aagccgccgacttcgtgaagaagac

SEQ ID NO: 676913 - DNA, 25 bp, Artificial sequence
  Synthetic oligonucleotide
cggaagaagccgccgacttcgtgaa

SEQ ID NO: 676914 - DNA, 25 bp, Artificial sequence
  Synthetic oligonucleotide
accgatccggaagaagccgccgact

SEQ ID NO: 676915 - DNA, 25 bp, Artificial sequence
  Synthetic oligonucleotide
tccacgcgcgcatcccggacaccca

SEQ ID NO: 676916 - DNA, 25 bp, Artificial sequence
  Synthetic oligonucleotide
atcggcaccagccacggcgcctaca

SEQ ID NO: 676917 - DNA, 25 bp, Artificial sequence
  Synthetic oligonucleotide
cgcaggactggctggcgatcatcaa

SEQ ID NO: 676918 - DNA, 25 bp, Artificial sequence
  Synthetic oligonucleotide
gccagttgctgaccgatccggaaga

SEQ ID NO: 676919 - DNA, 25 bp, Artificial sequence
  Synthetic oligonucleotide
gtgccggtcgaggaaatcgtcgagg

SEQ ID NO: 676920 - DNA, 25 bp, Artificial sequence
  Synthetic oligonucleotide
acggcgtgccggtcgaggaaatcgt

SEQ ID NO: 676921 - DNA, 25 bp, Artificial sequence
  Synthetic oligonucleotide
agacctacggcgtgccggtcgagga

SEQ ID NO: 676922 - DNA, 25 bp, Artificial sequence
  Synthetic oligonucleotide
tcaaagagacctacggcgtgccggt

SEQ ID NO: 676923 - DNA, 25 bp, Artificial sequence
  Synthetic oligonucleotide
gcgagatcaaagagacctacggcgt

SEQ ID NO: 676924 - DNA, 25 bp, Artificial sequence
  Synthetic oligonucleotide
acggcggcgagatcaaagagaccta

SEQ ID NO: 676925 - DNA, 25 bp, Artificial sequence
  Synthetic oligonucleotide
acgagtacggcggcgagatcaaaga

SEQ ID NO: 676926 - DNA, 25 bp, Artificial sequence
  Synthetic oligonucleotide
tcatcaacgagtacggcggcgagat

SEQ ID NO: 676927 - DNA, 25 bp, Artificial sequence
  Synthetic oligonucleotide
tgtcgatccagcgcatcaaggaaat

SEQ ID NO: 676928 - DNA, 25 bp, Artificial sequence
  Synthetic oligonucleotide
actggctggcgatcatcaacgagta

SEQ ID NO: 676929 - DNA, 25 bp, Artificial sequence
  Synthetic oligonucleotide
tccagcgcatcaaggaaatccacgc

SEQ ID NO: 676930 - DNA, 25 bp, Artificial sequence
  Synthetic oligonucleotide
cggtaccgcaggactggctggcgat

SEQ ID NO: 676931 - DNA, 25 bp, Artificial sequence
  Synthetic oligonucleotide
cttcctcggtaccgcaggactggct

SEQ ID NO: 676932 - DNA, 25 bp, Artificial sequence
  Synthetic oligonucleotide
acggctcttcctcggtaccgcagga

SEQ ID NO: 676933 - DNA, 25 bp, Artificial sequence
  Synthetic oligonucleotide
tgatgcacggctcttcctcggtacc

SEQ ID NO: 676934 - DNA, 25 bp, Artificial sequence
  Synthetic oligonucleotide
acctggtgatgcacggctcttcctc

SEQ ID NO: 676935 - DNA, 25 bp, Artificial sequence
  Synthetic oligonucleotide
acacccacctggtgatgcacggctc

SEQ ID NO: 676936 - DNA, 25 bp, Artificial sequence
  Synthetic oligonucleotide
cgcgcatcccggacacccacctggt

SEQ ID NO: 676937 - DNA, 25 bp, Artificial sequence
  Synthetic oligonucleotide
aggaaatccacgcgcgcatcccgga

SEQ ID NO: 676938 - DNA, 25 bp, Artificial sequence
  Synthetic oligonucleotide
ggaaatcgtcgagggcatcaagtac

SEQ ID NO: 676939 - DNA, 25 bp, Artificial sequence
  Synthetic oligonucleotide
tggcgatcatcaacgagtacggcgg

SEQ ID NO: 676940 - DNA, 25 bp, Artificial sequence
  Synthetic oligonucleotide
ccgcctgtagcggcgatggcggtcg

SEQ ID NO: 676941 - DNA, 25 bp, Artificial sequence
  Synthetic oligonucleotide
aaaaggaggtgccccatgcgttccg

SEQ ID NO: 676942 - DNA, 25 bp, Artificial sequence
  Synthetic oligonucleotide
ccgccggacgtgatggtgccgaccg

SEQ ID NO: 676943 - DNA, 25 bp, Artificial sequence
  Synthetic oligonucleotide
atcagtccgccggacgtgatggtgc

SEQ ID NO: 676944 - DNA, 25 bp, Artificial sequence
  Synthetic oligonucleotide
gaggtgatcagtccgccggacgtga

SEQ ID NO: 676945 - DNA, 25 bp, Artificial sequence
  Synthetic oligonucleotide
acctgcgaggtgatcagtccgccgg

SEQ ID NO: 676946 - DNA, 25 bp, Artificial sequence
  Synthetic oligonucleotide
ccgagcacctgcgaggtgatcagtc

SEQ ID NO: 676947 - DNA, 25 bp, Artificial sequence
  Synthetic oligonucleotide
cgacgcccgagcacctgcgaggtga

SEQ ID NO: 676948 - DNA, 25 bp, Artificial sequence
  Synthetic oligonucleotide
ggcggtcgacgcccgagcacctgcg

SEQ ID NO: 676949 - DNA, 25 bp, Artificial sequence
  Synthetic oligonucleotide
atggtgccgaccgagcagaaccgcc

SEQ ID NO: 676950 - DNA, 25 bp, Artificial sequence
  Synthetic oligonucleotide
tgtagcggcgatggcggtcgacgcc

SEQ ID NO: 676951 - DNA, 25 bp, Artificial sequence
  Synthetic oligonucleotide
cgaccgagcagaaccgccagcgggt

SEQ ID NO: 676952 - DNA, 25 bp, Artificial sequence
  Synthetic oligonucleotide
gcctggccgcctgtagcggcgatgg

SEQ ID NO: 676953 - DNA, 25 bp, Artificial sequence
  Synthetic oligonucleotide
gcctgggcctggccgcctgtagcgg

SEQ ID NO: 676954 - DNA, 25 bp, Artificial sequence
  Synthetic oligonucleotide
tgttctgcctgggcctggccgcctg

SEQ ID NO: 676955 - DNA, 25 bp, Artificial sequence
  Synthetic oligonucleotide
tcctgatgttctgcctgggcctggc

SEQ ID NO: 676956 - DNA, 25 bp, Artificial sequence
  Synthetic oligonucleotide
tgccactcctgatgttctgcctggg

SEQ ID NO: 676957 - DNA, 25 bp, Artificial sequence
  Synthetic oligonucleotide
taaccttgccactcctgatgttctg

SEQ ID NO: 676958 - DNA, 25 bp, Artificial sequence
  Synthetic oligonucleotide
gttccgtaaccttgccactcctgat

SEQ ID NO: 676959 - DNA, 25 bp, Artificial sequence
  Synthetic oligonucleotide
cccatgcgttccgtaaccttgccac

SEQ ID NO: 676960 - DNA, 25 bp, Artificial sequence
  Synthetic oligonucleotide
agcattgcgcctttcctgtgacagg

SEQ ID NO: 676961 - DNA, 25 bp, Artificial sequence
  Synthetic oligonucleotide
ggcgatggcggtcgacgcccgagca

SEQ ID NO: 676962 - DNA, 25 bp, Artificial sequence
  Synthetic oligonucleotide
agccggtggaatgcccgtagtgctt

SEQ ID NO: 676963 - DNA, 25 bp, Artificial sequence
  Synthetic oligonucleotide
cgcagtagcattgcgcctttcctgt

SEQ ID NO: 676964 - DNA, 25 bp, Artificial sequence
  Synthetic oligonucleotide
agcgtacgcagtagcattgcgcctt

SEQ ID NO: 676965 - DNA, 25 bp, Artificial sequence
  Synthetic oligonucleotide
ttcgccagcgtacgcagtagcattg

SEQ ID NO: 676966 - DNA, 25 bp, Artificial sequence
  Synthetic oligonucleotide
tggggattcgccagcgtacgcagta

SEQ ID NO: 676967 - DNA, 25 bp, Artificial sequence
  Synthetic oligonucleotide
aaagggctggggattcgccagcgta

SEQ ID NO: 676968 - DNA, 25 bp, Artificial sequence
  Synthetic oligonucleotide
tctacggaaagggctggggattcgc

SEQ ID NO: 676969 - DNA, 25 bp, Artificial sequence
  Synthetic oligonucleotide
ttctgccagtttctacggaaagggc

SEQ ID NO: 676970 - DNA, 25 bp, Artificial sequence
  Synthetic oligonucleotide
gtgcttttctgccagtttctacgga

SEQ ID NO: 676971 - DNA, 25 bp, Artificial sequence
  Synthetic oligonucleotide
gacgtgatggtgccgaccgagcaga

SEQ ID NO: 676972 - DNA, 25 bp, Artificial sequence
  Synthetic oligonucleotide
tggaatgcccgtagtgcttttctgc

SEQ ID NO: 676973 - DNA, 25 bp, Artificial sequence
  Synthetic oligonucleotide
cgacgaaaaaaggaggtgccccatg

SEQ ID NO: 676974 - DNA, 25 bp, Artificial sequence
  Synthetic oligonucleotide
gacaaaagccggtggaatgcccgta

SEQ ID NO: 676975 - DNA, 25 bp, Artificial sequence
  Synthetic oligonucleotide
ccgccggacaaaagccggtggaatg

SEQ ID NO: 676976 - DNA, 25 bp, Artificial sequence
  Synthetic oligonucleotide
cgatccgaccgccggacaaaagccg

SEQ ID NO: 676977 - DNA, 25 bp, Artificial sequence
  Synthetic oligonucleotide
cagcggcgatccgaccgccggacaa

SEQ ID NO: 676978 - DNA, 25 bp, Artificial sequence
  Synthetic oligonucleotide
agcagagcagcggcgatccgaccgc

SEQ ID NO: 676979 - DNA, 25 bp, Artificial sequence
  Synthetic oligonucleotide
tcgagcagcagagcagcggcgatcc

SEQ ID NO: 676980 - DNA, 25 bp, Artificial sequence
  Synthetic oligonucleotide
agcgggtcgagcagcagagcagcgg

SEQ ID NO: 676981 - DNA, 25 bp, Artificial sequence
  Synthetic oligonucleotide
accgccagcgggtcgagcagcagag

SEQ ID NO: 676982 - DNA, 25 bp, Artificial sequence
  Synthetic oligonucleotide
agcagaaccgccagcgggtcgagca

SEQ ID NO: 676983 - DNA, 25 bp, Artificial sequence
  Synthetic oligonucleotide
gcccgtagtgcttttctgccagttt

SEQ ID NO: 676984 - DNA, 25 bp, Artificial sequence
  Synthetic oligonucleotide
atagcgcggcgttctccatcgccgg

SEQ ID NO: 676985 - DNA, 25 bp, Artificial sequence
  Synthetic oligonucleotide
aggtgccccatgcgttccgtaacct

SEQ ID NO: 676986 - DNA, 25 bp, Artificial sequence
  Synthetic oligonucleotide
tacggcatcgccgagcggatctcct

SEQ ID NO: 676987 - DNA, 25 bp, Artificial sequence
  Synthetic oligonucleotide
gacaagtacggcatcgccgagcgga

SEQ ID NO: 676988 - DNA, 25 bp, Artificial sequence
  Synthetic oligonucleotide
gcgatcgacaagtacggcatcgccg

SEQ ID NO: 676989 - DNA, 25 bp, Artificial sequence
  Synthetic oligonucleotide
ctggcggcgatcgacaagtacggca

SEQ ID NO: 676990 - DNA, 25 bp, Artificial sequence
  Synthetic oligonucleotide
cgataccctggcggcgatcgacaag

SEQ ID NO: 676991 - DNA, 25 bp, Artificial sequence
  Synthetic oligonucleotide
gcggcggcgataccctggcggcgat

SEQ ID NO: 676992 - DNA, 25 bp, Artificial sequence
  Synthetic oligonucleotide
tcgccggcggcggcgataccctggc

SEQ ID NO: 676993 - DNA, 25 bp, Artificial sequence
  Synthetic oligonucleotide
gagcggatctcctatatttccaccg

SEQ ID NO: 676994 - DNA, 25 bp, Artificial sequence
  Synthetic oligonucleotide
cggcgttctccatcgccggcggcgg

SEQ ID NO: 676995 - DNA, 25 bp, Artificial sequence
  Synthetic oligonucleotide
atctcctatatttccaccggtggcg

SEQ ID NO: 676996 - DNA, 25 bp, Artificial sequence
  Synthetic oligonucleotide
cgccgatagcgcggcgttctccatc

SEQ ID NO: 676997 - DNA, 25 bp, Artificial sequence
  Synthetic oligonucleotide
tgccatcgccgatagcgcggcgttc

SEQ ID NO: 676998 - DNA, 25 bp, Artificial sequence
  Synthetic oligonucleotide
ggccaatgccatcgccgatagcgcg

SEQ ID NO: 676999 - DNA, 25 bp, Artificial sequence
  Synthetic oligonucleotide
accctggccaatgccatcgccgata

SEQ ID NO: 677000 - DNA, 25 bp, Artificial sequence
  Synthetic oligonucleotide
acccgtaccctggccaatgccatcg

SEQ ID NO: 677001 - DNA, 25 bp, Artificial sequence
  Synthetic oligonucleotide
gagggcacccgtaccctggccaatg

SEQ ID NO: 677002 - DNA, 25 bp, Artificial sequence
  Synthetic oligonucleotide
gaacgaccccgcgattgggagatac

SEQ ID NO: 677003 - DNA, 25 bp, Artificial sequence
  Synthetic oligonucleotide
tcccggacacccacctggtgatgca

SEQ ID NO: 677004 - DNA, 25 bp, Artificial sequence
  Synthetic oligonucleotide
tcggcgagggcacccgtaccctggc

SEQ ID NO: 677005 - DNA, 25 bp, Artificial sequence
  Synthetic oligonucleotide
tctccatcgccggcggcggcgatac

SEQ ID NO: 677006 - DNA, 25 bp, Artificial sequence
  Synthetic oligonucleotide
ccggccgtggaaatcctggagcagc

SEQ ID NO: 677007 - DNA, 25 bp, Artificial sequence
  Synthetic oligonucleotide
tgaggacgacgaaaaaaggaggtgc

SEQ ID NO: 677008 - DNA, 25 bp, Artificial sequence
  Synthetic oligonucleotide
gtcacacctttgaggacgacgaaaa

SEQ ID NO: 677009 - DNA, 25 bp, Artificial sequence
  Synthetic oligonucleotide
tcgggggtcacacctttgaggacga

SEQ ID NO: 677010 - DNA, 25 bp, Artificial sequence
  Synthetic oligonucleotide
cgtcctcgggggtcacacctttgag

SEQ ID NO: 677011 - DNA, 25 bp, Artificial sequence
  Synthetic oligonucleotide
ccattcgccgtcctcgggggtcaca

SEQ ID NO: 677012 - DNA, 25 bp, Artificial sequence
  Synthetic oligonucleotide
cagacggggcaaaccattcgccgtc

SEQ ID NO: 677013 - DNA, 25 bp, Artificial sequence
  Synthetic oligonucleotide
tgacgcagacggggcaaaccattcg

SEQ ID NO: 677014 - DNA, 25 bp, Artificial sequence
  Synthetic oligonucleotide
aagggctgacgcagacggggcaaac

SEQ ID NO: 677015 - DNA, 25 bp, Artificial sequence
  Synthetic oligonucleotide
atcgccgagcggatctcctatattt

SEQ ID NO: 677016 - DNA, 25 bp, Artificial sequence
  Synthetic oligonucleotide
gtggaaatcctggagcagcgcgcca

SEQ ID NO: 677017 - DNA, 25 bp, Artificial sequence
  Synthetic oligonucleotide
cgcgccaagggctgacgcagacggg

SEQ ID NO: 677018 - DNA, 25 bp, Artificial sequence
  Synthetic oligonucleotide
gtcctgccggccgtggaaatcctgg

SEQ ID NO: 677019 - DNA, 25 bp, Artificial sequence
  Synthetic oligonucleotide
gcaaggtcctgccggccgtggaaat

SEQ ID NO: 677020 - DNA, 25 bp, Artificial sequence
  Synthetic oligonucleotide
tcgagggcaaggtcctgccggccgt

SEQ ID NO: 677021 - DNA, 25 bp, Artificial sequence
  Synthetic oligonucleotide
agttcgtcgagggcaaggtcctgcc

SEQ ID NO: 677022 - DNA, 25 bp, Artificial sequence
  Synthetic oligonucleotide
tcctcgagttcgtcgagggcaaggt

SEQ ID NO: 677023 - DNA, 25 bp, Artificial sequence
  Synthetic oligonucleotide
ggcgcgttcctcgagttcgtcgagg

SEQ ID NO: 677024 - DNA, 25 bp, Artificial sequence
  Synthetic oligonucleotide
ggtggcggcgcgttcctcgagttcg

SEQ ID NO: 677025 - DNA, 25 bp, Artificial sequence
  Synthetic oligonucleotide
tccaccggtggcggcgcgttcctcg

SEQ ID NO: 677026 - DNA, 25 bp, Artificial sequence
  Synthetic oligonucleotide
tatatttccaccggtggcggcgcgt

SEQ ID NO: 677027 - DNA, 25 bp, Artificial sequence
  Synthetic oligonucleotide
ggagcagcgcgccaagggctgacgc

SEQ ID NO: 677028 - DNA, 25 bp, Artificial sequence
  Synthetic oligonucleotide
cggccgtcggcgctttctatagcga

SEQ ID NO: 677029 - DNA, 25 bp, Artificial sequence
  Synthetic oligonucleotide
gcctggtgtactgggtcgaaaccga

SEQ ID NO: 677030 - DNA, 25 bp, Artificial sequence
  Synthetic oligonucleotide
gacgaaggcctggtgtactgggtcg

SEQ ID NO: 677031 - DNA, 25 bp, Artificial sequence
  Synthetic oligonucleotide
gagaacgacgaaggcctggtgtact

SEQ ID NO: 677032 - DNA, 25 bp, Artificial sequence
  Synthetic oligonucleotide
cacctggagaacgacgaaggcctgg

SEQ ID NO: 677033 - DNA, 25 bp, Artificial sequence
  Synthetic oligonucleotide
ggcttccacctggagaacgacgaag

SEQ ID NO: 677034 - DNA, 25 bp, Artificial sequence
  Synthetic oligonucleotide
cgcctgggcttccacctggagaacg

SEQ ID NO: 677035 - DNA, 25 bp, Artificial sequence
  Synthetic oligonucleotide
gacggacgcctgggcttccacctgg

SEQ ID NO: 677036 - DNA, 25 bp, Artificial sequence
  Synthetic oligonucleotide
tatagcgacggacgcctgggcttcc

SEQ ID NO: 677037 - DNA, 25 bp, Artificial sequence
  Synthetic oligonucleotide
cgtcgacctgcgcctgaaggacgag

SEQ ID NO: 677038 - DNA, 25 bp, Artificial sequence
  Synthetic oligonucleotide
tcggcgctttctatagcgacggacg

SEQ ID NO: 677039 - DNA, 25 bp, Artificial sequence
  Synthetic oligonucleotide
accgacgacctcatcggtcgcggtt

SEQ ID NO: 677040 - DNA, 25 bp, Artificial sequence
  Synthetic oligonucleotide
aacctgcggccgtcggcgctttcta

SEQ ID NO: 677041 - DNA, 25 bp, Artificial sequence
  Synthetic oligonucleotide
gagcaggaacctgcggccgtcggcg

SEQ ID NO: 677042 - DNA, 25 bp, Artificial sequence
  Synthetic oligonucleotide
acttggagcaggaacctgcggccgt

SEQ ID NO: 677043 - DNA, 25 bp, Artificial sequence
  Synthetic oligonucleotide
tccaccacttggagcaggaacctgc

SEQ ID NO: 677044 - DNA, 25 bp, Artificial sequence
  Synthetic oligonucleotide
acgtggtccaccacttggagcagga

SEQ ID NO: 677045 - DNA, 25 bp, Artificial sequence
  Synthetic oligonucleotide
aggacgacgtggtccaccacttgga

SEQ ID NO: 677046 - DNA, 25 bp, Artificial sequence
  Synthetic oligonucleotide
aggacgaggacgacgtggtccacca

SEQ ID NO: 677047 - DNA, 25 bp, Artificial sequence
  Synthetic oligonucleotide
cctgaaggacgaggacgacgtggtc

SEQ ID NO: 677048 - DNA, 25 bp, Artificial sequence
  Synthetic oligonucleotide
cctgcgcctgaaggacgaggacgac

SEQ ID NO: 677049 - DNA, 25 bp, Artificial sequence
  Synthetic oligonucleotide
ctttctatagcgacggacgcctggg

SEQ ID NO: 677050 - DNA, 25 bp, Artificial sequence
  Synthetic oligonucleotide
accgctcctcgcaaggaacttgaac

SEQ ID NO: 677051 - DNA, 25 bp, Artificial sequence
  Synthetic oligonucleotide
atcactgaacgaccccgcgattggg

SEQ ID NO: 677052 - DNA, 25 bp, Artificial sequence
  Synthetic oligonucleotide
ttctgaatcactgaacgaccccgcg

SEQ ID NO: 677053 - DNA, 25 bp, Artificial sequence
  Synthetic oligonucleotide
ggcaggcttctgaatcactgaacga

SEQ ID NO: 677054 - DNA, 25 bp, Artificial sequence
  Synthetic oligonucleotide
aatcctggagcagcgcgccaagggc

SEQ ID NO: 677055 - DNA, 25 bp, Artificial sequence
  Synthetic oligonucleotide
gcgcctttcctgtgacaggcaaggc

SEQ ID NO: 677056 - DNA, 25 bp, Artificial sequence
  Synthetic oligonucleotide
ccctgcggcaggcttctgaatcact

SEQ ID NO: 677057 - DNA, 25 bp, Artificial sequence
  Synthetic oligonucleotide
gcctgcccctgcggcaggcttctga

SEQ ID NO: 677058 - DNA, 25 bp, Artificial sequence
  Synthetic oligonucleotide
aaccgggcctgcccctgcggcaggc

SEQ ID NO: 677059 - DNA, 25 bp, Artificial sequence
  Synthetic oligonucleotide
aacttgaaccgggcctgcccctgcg

SEQ ID NO: 677060 - DNA, 25 bp, Artificial sequence
  Synthetic oligonucleotide
tactgggtcgaaaccgacgacctca

SEQ ID NO: 677061 - DNA, 25 bp, Artificial sequence
  Synthetic oligonucleotide
tcctcgcaaggaacttgaaccgggc

SEQ ID NO: 677062 - DNA, 25 bp, Artificial sequence
  Synthetic oligonucleotide
gtcgaaaccgacgacctcatcggtc

SEQ ID NO: 677063 - DNA, 25 bp, Artificial sequence
  Synthetic oligonucleotide
gccgcgaccgctcctcgcaaggaac

SEQ ID NO: 677064 - DNA, 25 bp, Artificial sequence
  Synthetic oligonucleotide
gcgcggcgccgcgaccgctcctcgc

SEQ ID NO: 677065 - DNA, 25 bp, Artificial sequence
  Synthetic oligonucleotide
ggcaggggcgcggcgccgcgaccgc

SEQ ID NO: 677066 - DNA, 25 bp, Artificial sequence
  Synthetic oligonucleotide
cgcgccggcaggggcgcggcgccgc

SEQ ID NO: 677067 - DNA, 25 bp, Artificial sequence
  Synthetic oligonucleotide
ctgagtcgcgccggcaggggcgcgg

SEQ ID NO: 677068 - DNA, 25 bp, Artificial sequence
  Synthetic oligonucleotide
ggcgcgctgagtcgcgccggcaggg

SEQ ID NO: 677069 - DNA, 25 bp, Artificial sequence
  Synthetic oligonucleotide
ttgcaaggcgcgctgagtcgcgccg

SEQ ID NO: 677070 - DNA, 25 bp, Artificial sequence
  Synthetic oligonucleotide
atcggtcgcggttgcaaggcgcgct

SEQ ID NO: 677071 - DNA, 25 bp, Artificial sequence
  Synthetic oligonucleotide
gacctcatcggtcgcggttgcaagg

SEQ ID NO: 677072 - DNA, 25 bp, Artificial sequence
  Synthetic oligonucleotide
gcaaggaacttgaaccgggcctgcc

SEQ ID NO: 677073 - DNA, 25 bp, Artificial sequence
  Synthetic oligonucleotide
cgaggtgcggcggagcgttccgcac

SEQ ID NO: 677074 - DNA, 25 bp, Artificial sequence
  Synthetic oligonucleotide
cttcgccgccgcggcgctgctggcc

SEQ ID NO: 677075 - DNA, 25 bp, Artificial sequence
  Synthetic oligonucleotide
cggcggcttcgccgccgcggcgctg

SEQ ID NO: 677076 - DNA, 25 bp, Artificial sequence
  Synthetic oligonucleotide
cctgttcggcggcttcgccgccgcg

SEQ ID NO: 677077 - DNA, 25 bp, Artificial sequence
  Synthetic oligonucleotide
tatcgccctgttcggcggcttcgcc

SEQ ID NO: 677078 - DNA, 25 bp, Artificial sequence
  Synthetic oligonucleotide
tcgcgtatcgccctgttcggcggct

SEQ ID NO: 677079 - DNA, 25 bp, Artificial sequence
  Synthetic oligonucleotide
gaactactcgcgtatcgccctgttc

SEQ ID NO: 677080 - DNA, 25 bp, Artificial sequence
  Synthetic oligonucleotide
ggacatgaactactcgcgtatcgcc

SEQ ID NO: 677081 - DNA, 25 bp, Artificial sequence
  Synthetic oligonucleotide
gaggatggacatgaactactcgcgt

SEQ ID NO: 677082 - DNA, 25 bp, Artificial sequence
  Synthetic oligonucleotide
tccgcacggatggaggatggacatg

SEQ ID NO: 677083 - DNA, 25 bp, Artificial sequence
  Synthetic oligonucleotide
cgccgcggcgctgctggccggctgc

SEQ ID NO: 677084 - DNA, 25 bp, Artificial sequence
  Synthetic oligonucleotide
gcggcggagcgttccgcacggatgg

SEQ ID NO: 677085 - DNA, 25 bp, Artificial sequence
  Synthetic oligonucleotide
cggatggaggatggacatgaactac

SEQ ID NO: 677086 - DNA, 25 bp, Artificial sequence
  Synthetic oligonucleotide
gcccggcgaggtgcggcggagcgtt

SEQ ID NO: 677087 - DNA, 25 bp, Artificial sequence
  Synthetic oligonucleotide
ttgcggcccggcgaggtgcggcgga

SEQ ID NO: 677088 - DNA, 25 bp, Artificial sequence
  Synthetic oligonucleotide
gggccgcttgcggcccggcgaggtg

SEQ ID NO: 677089 - DNA, 25 bp, Artificial sequence
  Synthetic oligonucleotide
ccgcgcgggccgcttgcggcccggc

SEQ ID NO: 677090 - DNA, 25 bp, Artificial sequence
  Synthetic oligonucleotide
aacatcgtcgacctgcgcctgaagg

SEQ ID NO: 677091 - DNA, 25 bp, Artificial sequence
  Synthetic oligonucleotide
tcgcggttgcaaggcgcgctgagtc

SEQ ID NO: 677092 - DNA, 25 bp, Artificial sequence
  Synthetic oligonucleotide
cggccgccgcgcgggccgcttgcgg

SEQ ID NO: 677093 - DNA, 25 bp, Artificial sequence
  Synthetic oligonucleotide
ggccagccggccgccgcgcgggccg

SEQ ID NO: 677094 - DNA, 25 bp, Artificial sequence
  Synthetic oligonucleotide
aggcaaggccagccggccgccgcgc

SEQ ID NO: 677095 - DNA, 25 bp, Artificial sequence
  Synthetic oligonucleotide
tgtgacaggcaaggccagccggccg

SEQ ID NO: 677096 - DNA, 25 bp, Artificial sequence
  Synthetic oligonucleotide
acccgctggacctgcgacagcaagg

SEQ ID NO: 677097 - DNA, 25 bp, Artificial sequence
  Synthetic oligonucleotide
tatatcgacggcagcaagaacatcg

SEQ ID NO: 677098 - DNA, 25 bp, Artificial sequence
  Synthetic oligonucleotide
tggcgctatatcgacggcagcaaga

SEQ ID NO: 677099 - DNA, 25 bp, Artificial sequence
  Synthetic oligonucleotide
atcgaatggcgctatatcgacggca

SEQ ID NO: 677100 - DNA, 25 bp, Artificial sequence
  Synthetic oligonucleotide
gagcgttccgcacggatggaggatg

SEQ ID NO: 677101 - DNA, 25 bp, Artificial sequence
  Synthetic oligonucleotide
gcgctgctggccggctgctccgctt

SEQ ID NO: 677102 - DNA, 25 bp, Artificial sequence
  Synthetic oligonucleotide
gcggtgatcgaatggcgctatatcg

SEQ ID NO: 677103 - DNA, 25 bp, Artificial sequence
  Synthetic oligonucleotide
agcaaggcggtgatcgaatggcgct

SEQ ID NO: 677104 - DNA, 25 bp, Artificial sequence
  Synthetic oligonucleotide
gacggcagcaagaacatcgtcgacc

SEQ ID NO: 677105 - DNA, 25 bp, Artificial sequence
  Synthetic oligonucleotide
tggacctgcgacagcaaggcggtga

SEQ ID NO: 677106 - DNA, 25 bp, Artificial sequence
  Synthetic oligonucleotide
actggacccgctggacctgcgacag

SEQ ID NO: 677107 - DNA, 25 bp, Artificial sequence
  Synthetic oligonucleotide
ggctgctccgcttcctccggcaagc

SEQ ID NO: 677108 - DNA, 25 bp, Artificial sequence
  Synthetic oligonucleotide
cgggcggcaaggactggacccgctg

SEQ ID NO: 677109 - DNA, 25 bp, Artificial sequence
  Synthetic oligonucleotide
ggcaagccgggcggcaaggactgga

SEQ ID NO: 677110 - DNA, 25 bp, Artificial sequence
  Synthetic oligonucleotide
ttcctccggcaagccgggcggcaag

SEQ ID NO: 677111 - DNA, 25 bp, Artificial sequence
  Synthetic oligonucleotide
tccgcttcctccggcaagccgggcg

SEQ ID NO: 677112 - DNA, 25 bp, Artificial sequence
  Synthetic oligonucleotide
ctggccggctgctccgcttcctccg

SEQ ID NO: 677113 - DNA, 25 bp, Artificial sequence
  Synthetic oligonucleotide
gcaaggactggacccgctggacctg

SEQ ID NO: 677114 - DNA, 25 bp, Artificial sequence
  Synthetic oligonucleotide
tgcgacagcaaggcggtgatcgaat

SEQ ID NO: 677115 - DNA, 25 bp, Artificial sequence
  Synthetic oligonucleotide
tttcctgtgacaggcaaggccagcc

SEQ ID NO: 677116 - DNA, 25 bp, Artificial sequence
  Synthetic oligonucleotide
cagcaagaacatcgtcgacctgcgc

SEQ ID NO: 677117 - DNA, 25 bp, Artificial sequence
  Synthetic oligonucleotide
gcgccgctacggcatcagccagttg

SEQ ID NO: 677118 - DNA, 25 bp, Artificial sequence
  Synthetic oligonucleotide
gccctggtcaactacgacaatccgg

SEQ ID NO: 677119 - DNA, 25 bp, Artificial sequence
  Synthetic oligonucleotide
gtcaactacgacaatccgggcaacg

SEQ ID NO: 677120 - DNA, 25 bp, Artificial sequence
  Synthetic oligonucleotide
cgacaatccgggcaacggttaccag

SEQ ID NO: 677121 - DNA, 25 bp, Artificial sequence
  Synthetic oligonucleotide
tccgggcaacggttaccagagccaa

SEQ ID NO: 677122 - DNA, 25 bp, Artificial sequence
  Synthetic oligonucleotide
cggttaccagagccaaccggtagcg

SEQ ID NO: 677123 - DNA, 25 bp, Artificial sequence
  Synthetic oligonucleotide
ccaaccggtagcggtgaacaatgac

SEQ ID NO: 677124 - DNA, 25 bp, Artificial sequence
  Synthetic oligonucleotide
gcgcgcagcgccgctacggcatcag

SEQ ID NO: 677125 - DNA, 25 bp, Artificial sequence
  Synthetic oligonucleotide
gccacttcaactacagcagcagccg

SEQ ID NO: 677126 - DNA, 25 bp, Artificial sequence
  Synthetic oligonucleotide
gtagcggtgaacaatgaccgcgcgc

SEQ ID NO: 677127 - DNA, 25 bp, Artificial sequence
  Synthetic oligonucleotide
tgaacaatgaccgcgcgcagcgccg

SEQ ID NO: 677128 - DNA, 25 bp, Artificial sequence
  Synthetic oligonucleotide
atgaccgcgcgcagcgccgctacgg

SEQ ID NO: 677129 - DNA, 25 bp, Artificial sequence
  Synthetic oligonucleotide
cagagccaaccggtagcggtgaaca

SEQ ID NO: 677130 - DNA, 25 bp, Artificial sequence
  Synthetic oligonucleotide
accctggccctggtcaactacgaca

SEQ ID NO: 677131 - DNA, 25 bp, Artificial sequence
  Synthetic oligonucleotide
cgccacaccctggccctggtcaact

SEQ ID NO: 677132 - DNA, 25 bp, Artificial sequence
  Synthetic oligonucleotide
cgcgatcgccacaccctggccctgg

SEQ ID NO: 677133 - DNA, 25 bp, Artificial sequence
  Synthetic oligonucleotide
cgccagcgcgatcgccacaccctgg

SEQ ID NO: 677134 - DNA, 25 bp, Artificial sequence
  Synthetic oligonucleotide
agcagccgccagcgcgatcgccaca

SEQ ID NO: 677135 - DNA, 25 bp, Artificial sequence
  Synthetic oligonucleotide
tcaactacagcagcagccgccagcg

SEQ ID NO: 677136 - DNA, 25 bp, Artificial sequence
  Synthetic oligonucleotide
acggcagccacttcaactacagcag

SEQ ID NO: 677137 - DNA, 25 bp, Artificial sequence
  Synthetic oligonucleotide
gcgacgacggcagccacttcaacta

SEQ ID NO: 677138 - DNA, 25 bp, Artificial sequence
  Synthetic oligonucleotide
ctacaccttctcgccgtcgaacacc

SEQ ID NO: 677139 - DNA, 25 bp, Artificial sequence
  Synthetic oligonucleotide
ttctcgccgtcgaacaccgtgcgtg

SEQ ID NO: 677140 - DNA, 25 bp, Artificial sequence
  Synthetic oligonucleotide
gcggtgaccttccgcaccggcatgg

SEQ ID NO: 677141 - DNA, 25 bp, Artificial sequence
  Synthetic oligonucleotide
tgcgtggcgacgacggcagccactt

SEQ ID NO: 677142 - DNA, 25 bp, Artificial sequence
  Synthetic oligonucleotide
aacaccgtgcgtggcgacgacggca

SEQ ID NO: 677143 - DNA, 25 bp, Artificial sequence
  Synthetic oligonucleotide
cgtcgaacaccgtgcgtggcgacga

SEQ ID NO: 677144 - DNA, 25 bp, Artificial sequence
  Synthetic oligonucleotide
tacagcagcagccgccagcgcgatc

SEQ ID NO: 677145 - DNA, 25 bp, Artificial sequence
  Synthetic oligonucleotide
cgctgctgaccgaggagctggagca

SEQ ID NO: 677146 - DNA, 25 bp, Artificial sequence
  Synthetic oligonucleotide
cgccggggaagatcatcgccgtagc

SEQ ID NO: 677147 - DNA, 25 bp, Artificial sequence
  Synthetic oligonucleotide
ggctggcgccggggaagatcatcgc

SEQ ID NO: 677148 - DNA, 25 bp, Artificial sequence
  Synthetic oligonucleotide
ggaagatcatcgccgtagccgaccc

SEQ ID NO: 677149 - DNA, 25 bp, Artificial sequence
  Synthetic oligonucleotide
atcatcgccgtagccgacccggtca

SEQ ID NO: 677150 - DNA, 25 bp, Artificial sequence
  Synthetic oligonucleotide
tacgacatcgtgttgcacaagcgct

SEQ ID NO: 677151 - DNA, 25 bp, Artificial sequence
  Synthetic oligonucleotide
cgaggcctacaccttctcgccgtcg

SEQ ID NO: 677152 - DNA, 25 bp, Artificial sequence
  Synthetic oligonucleotide
gccgtgggctggcgccggggaagat

SEQ ID NO: 677153 - DNA, 25 bp, Artificial sequence
  Synthetic oligonucleotide
tggatggccgtgggctggcgccggg

SEQ ID NO: 677154 - DNA, 25 bp, Artificial sequence
  Synthetic oligonucleotide
cggcatggatggccgtgggctggcg

SEQ ID NO: 677155 - DNA, 25 bp, Artificial sequence
  Synthetic oligonucleotide
ccgcaccggcatggatggccgtggg

SEQ ID NO: 677156 - DNA, 25 bp, Artificial sequence
  Synthetic oligonucleotide
gaccttccgcaccggcatggatggc

SEQ ID NO: 677157 - DNA, 25 bp, Artificial sequence
  Synthetic oligonucleotide
caggacgcggtgaccttccgcaccg

SEQ ID NO: 677158 - DNA, 25 bp, Artificial sequence
  Synthetic oligonucleotide
ctggagcaggacgcggtgaccttcc

SEQ ID NO: 677159 - DNA, 25 bp, Artificial sequence
  Synthetic oligonucleotide
tgaccgaggagctggagcaggacgc

SEQ ID NO: 677160 - DNA, 25 bp, Artificial sequence
  Synthetic oligonucleotide
tacggcatcagccagttggagatca

SEQ ID NO: 677161 - DNA, 25 bp, Artificial sequence
  Synthetic oligonucleotide
agtgggcgctgctgaccgaggagct

SEQ ID NO: 677162 - DNA, 25 bp, Artificial sequence
  Synthetic oligonucleotide
gtggccagtgggcgctgctgaccga

SEQ ID NO: 677163 - DNA, 25 bp, Artificial sequence
  Synthetic oligonucleotide
agcggcgtggccagtgggcgctgct

SEQ ID NO: 677164 - DNA, 25 bp, Artificial sequence
  Synthetic oligonucleotide
aggcgcagcggcgtggccagtgggc

SEQ ID NO: 677165 - DNA, 25 bp, Artificial sequence
  Synthetic oligonucleotide
agggcgaggcgcagcggcgtggcca

SEQ ID NO: 677166 - DNA, 25 bp, Artificial sequence
  Synthetic oligonucleotide
ctccgagggcgaggcgcagcggcgt

SEQ ID NO: 677167 - DNA, 25 bp, Artificial sequence
  Synthetic oligonucleotide
ttgcacctccgagggcgaggcgcag

SEQ ID NO: 677168 - DNA, 25 bp, Artificial sequence
  Synthetic oligonucleotide
atcggttgcacctccgagggcgagg

SEQ ID NO: 677169 - DNA, 25 bp, Artificial sequence
  Synthetic oligonucleotide
accgcgatcggttgcacctccgagg

SEQ ID NO: 677170 - DNA, 25 bp, Artificial sequence
  Synthetic oligonucleotide
ggagatcaccgcgatcggttgcacc

SEQ ID NO: 677171 - DNA, 25 bp, Artificial sequence
  Synthetic oligonucleotide
cagttggagatcaccgcgatcggtt

SEQ ID NO: 677172 - DNA, 25 bp, Artificial sequence
  Synthetic oligonucleotide
atcagccagttggagatcaccgcga

SEQ ID NO: 677173 - DNA, 25 bp, Artificial sequence
  Synthetic oligonucleotide
aggagctggagcaggacgcggtgac

SEQ ID NO: 677174 - DNA, 25 bp, Artificial sequence
  Synthetic oligonucleotide
aacccggcctggcactggtacgaca

SEQ ID NO: 677175 - DNA, 25 bp, Artificial sequence
  Synthetic oligonucleotide
tgtaccgcatcgcccagtactgcga

SEQ ID NO: 677176 - DNA, 25 bp, Artificial sequence
  Synthetic oligonucleotide
tggtcgctgtaccgcatcgcccagt

SEQ ID NO: 677177 - DNA, 25 bp, Artificial sequence
  Synthetic oligonucleotide
gacaagtggtcgctgtaccgcatcg

SEQ ID NO: 677178 - DNA, 25 bp, Artificial sequence
  Synthetic oligonucleotide
catggtcgacaagtggtcgctgtac

SEQ ID NO: 677179 - DNA, 25 bp, Artificial sequence
  Synthetic oligonucleotide
cgcgagcatggtcgacaagtggtcg

SEQ ID NO: 677180 - DNA, 25 bp, Artificial sequence
  Synthetic oligonucleotide
gatcgacgcgagcatggtcgacaag

SEQ ID NO: 677181 - DNA, 25 bp, Artificial sequence
  Synthetic oligonucleotide
tcggcggatcgacgcgagcatggtc

SEQ ID NO: 677182 - DNA, 25 bp, Artificial sequence
  Synthetic oligonucleotide
ctcggtcggcggatcgacgcgagca

SEQ ID NO: 677183 - DNA, 25 bp, Artificial sequence
  Synthetic oligonucleotide
ttcggcctcggtcggcggatcgacg

SEQ ID NO: 677184 - DNA, 25 bp, Artificial sequence
  Synthetic oligonucleotide
aagcgcttcggcctcggtcggcgga

SEQ ID NO: 677185 - DNA, 25 bp, Artificial sequence
  Synthetic oligonucleotide
atcgtgttgcacaagcgcttcggcc

SEQ ID NO: 677186 - DNA, 25 bp, Artificial sequence
  Synthetic oligonucleotide
ttgcacaagcgcttcggcctcggtc

SEQ ID NO: 677187 - DNA, 25 bp, Artificial sequence
  Synthetic oligonucleotide
gcctggcactggtacgacatcgtgt

SEQ ID NO: 677188 - DNA, 25 bp, Artificial sequence
  Synthetic oligonucleotide
gtgcccgacggcaagggcggccagg

SEQ ID NO: 677189 - DNA, 25 bp, Artificial sequence
  Synthetic oligonucleotide
accagcaacccggcctggcactggt

SEQ ID NO: 677190 - DNA, 25 bp, Artificial sequence
  Synthetic oligonucleotide
gcctggaccagcaacccggcctggc

SEQ ID NO: 677191 - DNA, 25 bp, Artificial sequence
  Synthetic oligonucleotide
aagtcggcctggaccagcaacccgg

SEQ ID NO: 677192 - DNA, 25 bp, Artificial sequence
  Synthetic oligonucleotide
tcgttcaagtcggcctggaccagca

SEQ ID NO: 677193 - DNA, 25 bp, Artificial sequence
  Synthetic oligonucleotide
gacggctcgttcaagtcggcctgga

SEQ ID NO: 677194 - DNA, 25 bp, Artificial sequence
  Synthetic oligonucleotide
acctgggacggctcgttcaagtcgg

SEQ ID NO: 677195 - DNA, 25 bp, Artificial sequence
  Synthetic oligonucleotide
agcggcacctgggacggctcgttca

SEQ ID NO: 677196 - DNA, 25 bp, Artificial sequence
  Synthetic oligonucleotide
agctacagcggcacctgggacggct

SEQ ID NO: 677197 - DNA, 25 bp, Artificial sequence
  Synthetic oligonucleotide
gtagccgacccggtcaagtccggca

SEQ ID NO: 677198 - DNA, 25 bp, Artificial sequence
  Synthetic oligonucleotide
tgggtgcgggtgccgcgaacctcgg

SEQ ID NO: 677199 - DNA, 25 bp, Artificial sequence
  Synthetic oligonucleotide
acccgtagctacagcggcacctggg

SEQ ID NO: 677200 - DNA, 25 bp, Artificial sequence
  Synthetic oligonucleotide
ccgcagacccgtagctacagcggca

SEQ ID NO: 677201 - DNA, 25 bp, Artificial sequence
  Synthetic oligonucleotide
cactggtacgacatcgtgttgcaca

SEQ ID NO: 677202 - DNA, 25 bp, Artificial sequence
  Synthetic oligonucleotide
gcctggaccgtgctgcgcgacctgg

SEQ ID NO: 677203 - DNA, 25 bp, Artificial sequence
  Synthetic oligonucleotide
catgccggaggacgaggcctacacc

SEQ ID NO: 677204 - DNA, 25 bp, Artificial sequence
  Synthetic oligonucleotide
atccgacatgccggaggacgaggcc

SEQ ID NO: 677205 - DNA, 25 bp, Artificial sequence
  Synthetic oligonucleotide
ggcggtatccgacatgccggaggac

SEQ ID NO: 677206 - DNA, 25 bp, Artificial sequence
  Synthetic oligonucleotide
aatggtggcggtatccgacatgccg

SEQ ID NO: 677207 - DNA, 25 bp, Artificial sequence
  Synthetic oligonucleotide
gcggaaatggtggcggtatccgaca

SEQ ID NO: 677208 - DNA, 25 bp, Artificial sequence
  Synthetic oligonucleotide
tccggcgcggaaatggtggcggtat

SEQ ID NO: 677209 - DNA, 25 bp, Artificial sequence
  Synthetic oligonucleotide
tactggtccggcgcggaaatggtgg

SEQ ID NO: 677210 - DNA, 25 bp, Artificial sequence
  Synthetic oligonucleotide
atgtcctactggtccggcgcggaaa

SEQ ID NO: 677211 - DNA, 25 bp, Artificial sequence
  Synthetic oligonucleotide
cgcggcatgtcctactggtccggcg

SEQ ID NO: 677212 - DNA, 25 bp, Artificial sequence
  Synthetic oligonucleotide
atcttccgcggcatgtcctactggt

SEQ ID NO: 677213 - DNA, 25 bp, Artificial sequence
  Synthetic oligonucleotide
gcagcgatcttccgcggcatgtcct

SEQ ID NO: 677214 - DNA, 25 bp, Artificial sequence
  Synthetic oligonucleotide
acctggcagcgatcttccgcggcat

SEQ ID NO: 677215 - DNA, 25 bp, Artificial sequence
  Synthetic oligonucleotide
tgcgaccagtcggtgcccgacggca

SEQ ID NO: 677216 - DNA, 25 bp, Artificial sequence
  Synthetic oligonucleotide
ccgtgctgcgcgacctggcagcgat

SEQ ID NO: 677217 - DNA, 25 bp, Artificial sequence
  Synthetic oligonucleotide
cagtcggtgcccgacggcaagggcg

SEQ ID NO: 677218 - DNA, 25 bp, Artificial sequence
  Synthetic oligonucleotide
gccgaagcctggaccgtgctgcgcg

SEQ ID NO: 677219 - DNA, 25 bp, Artificial sequence
  Synthetic oligonucleotide
agtcgcgccgaagcctggaccgtgc

SEQ ID NO: 677220 - DNA, 25 bp, Artificial sequence
  Synthetic oligonucleotide
ctgcagagtcgcgccgaagcctgga

SEQ ID NO: 677221 - DNA, 25 bp, Artificial sequence
  Synthetic oligonucleotide
tgtacctgcagagtcgcgccgaagc

SEQ ID NO: 677222 - DNA, 25 bp, Artificial sequence
  Synthetic oligonucleotide
gcaacctgtacctgcagagtcgcgc

SEQ ID NO: 677223 - DNA, 25 bp, Artificial sequence
  Synthetic oligonucleotide
cagctgcaacctgtacctgcagagt

SEQ ID NO: 677224 - DNA, 25 bp, Artificial sequence
  Synthetic oligonucleotide
gcgcttcagctgcaacctgtacctg

SEQ ID NO: 677225 - DNA, 25 bp, Artificial sequence
  Synthetic oligonucleotide
gagccgcgcttcagctgcaacctgt

SEQ ID NO: 677226 - DNA, 25 bp, Artificial sequence
  Synthetic oligonucleotide
ggccaggagccgcgcttcagctgca

SEQ ID NO: 677227 - DNA, 25 bp, Artificial sequence
  Synthetic oligonucleotide
aagggcggccaggagccgcgcttca

SEQ ID NO: 677228 - DNA, 25 bp, Artificial sequence
  Synthetic oligonucleotide
gacggcaagggcggccaggagccgc

SEQ ID NO: 677229 - DNA, 25 bp, Artificial sequence
  Synthetic oligonucleotide
ggaggacgaggcctacaccttctcg

SEQ ID NO: 677230 - DNA, 25 bp, Artificial sequence
  Synthetic oligonucleotide
tgcgcgacctggcagcgatcttccg

SEQ ID NO: 677231 - DNA, 25 bp, Artificial sequence
  Synthetic oligonucleotide
gtcgaccaggggttggcggtgacca

SEQ ID NO: 677232 - DNA, 25 bp, Artificial sequence
  Synthetic oligonucleotide
atggcgcaaggactcgggcaactgg

SEQ ID NO: 677233 - DNA, 25 bp, Artificial sequence
  Synthetic oligonucleotide
ggccgaatggcgcaaggactcgggc

SEQ ID NO: 677234 - DNA, 25 bp, Artificial sequence
  Synthetic oligonucleotide
ctacgaggccgaatggcgcaaggac

SEQ ID NO: 677235 - DNA, 25 bp, Artificial sequence
  Synthetic oligonucleotide
ggtggcctacgaggccgaatggcgc

SEQ ID NO: 677236 - DNA, 25 bp, Artificial sequence
  Synthetic oligonucleotide
aacgcggtggcctacgaggccgaat

SEQ ID NO: 677237 - DNA, 25 bp, Artificial sequence
  Synthetic oligonucleotide
cgccgaacgcggtggcctacgaggc

SEQ ID NO: 677238 - DNA, 25 bp, Artificial sequence
  Synthetic oligonucleotide
atgccgcgccgaacgcggtggccta

SEQ ID NO: 677239 - DNA, 25 bp, Artificial sequence
  Synthetic oligonucleotide
cctgggatgccgcgccgaacgcggt

SEQ ID NO: 677240 - DNA, 25 bp, Artificial sequence
  Synthetic oligonucleotide
tcggcctcctgggatgccgcgccga

SEQ ID NO: 677241 - DNA, 25 bp, Artificial sequence
  Synthetic oligonucleotide
agcctgtcggcctcctgggatgccg

SEQ ID NO: 677242 - DNA, 25 bp, Artificial sequence
  Synthetic oligonucleotide
gtgaccagcctgtcggcctcctggg

SEQ ID NO: 677243 - DNA, 25 bp, Artificial sequence
  Synthetic oligonucleotide
actcgggcaactgggtgcgggtgcc

SEQ ID NO: 677244 - DNA, 25 bp, Artificial sequence
  Synthetic oligonucleotide
ccaggggttggcggtgaccagcctg

SEQ ID NO: 677245 - DNA, 25 bp, Artificial sequence
  Synthetic oligonucleotide
cgggtgccgcgaacctcggcgctcg

SEQ ID NO: 677246 - DNA, 25 bp, Artificial sequence
  Synthetic oligonucleotide
tcaccaaggtcgaccaggggttggc

SEQ ID NO: 677247 - DNA, 25 bp, Artificial sequence
  Synthetic oligonucleotide
caaggctttcaccaaggtcgaccag

SEQ ID NO: 677248 - DNA, 25 bp, Artificial sequence
  Synthetic oligonucleotide
gcggatcaaggctttcaccaaggtc

SEQ ID NO: 677249 - DNA, 25 bp, Artificial sequence
  Synthetic oligonucleotide
gaacgtgcggatcaaggctttcacc

SEQ ID NO: 677250 - DNA, 25 bp, Artificial sequence
  Synthetic oligonucleotide
gccgcagaacgtgcggatcaaggct

SEQ ID NO: 677251 - DNA, 25 bp, Artificial sequence
  Synthetic oligonucleotide
gcgccgccgcagaacgtgcggatca

SEQ ID NO: 677252 - DNA, 25 bp, Artificial sequence
  Synthetic oligonucleotide
gtgcaggcgccgccgcagaacgtgc

SEQ ID NO: 677253 - DNA, 25 bp, Artificial sequence
  Synthetic oligonucleotide
ccgggcgtgcaggcgccgccgcaga

SEQ ID NO: 677254 - DNA, 25 bp, Artificial sequence
  Synthetic oligonucleotide
attccgccgggcgtgcaggcgccgc

SEQ ID NO: 677255 - DNA, 25 bp, Artificial sequence
  Synthetic oligonucleotide
accagcattccgccgggcgtgcagg

SEQ ID NO: 677256 - DNA, 25 bp, Artificial sequence
  Synthetic oligonucleotide
ccggtcaccagcattccgccgggcg

SEQ ID NO: 677257 - DNA, 25 bp, Artificial sequence
  Synthetic oligonucleotide
ctgccgccggtcaccagcattccgc

SEQ ID NO: 677258 - DNA, 25 bp, Artificial sequence
  Synthetic oligonucleotide
ttggcggtgaccagcctgtcggcct

SEQ ID NO: 677259 - DNA, 25 bp, Artificial sequence
  Synthetic oligonucleotide
tacgcgccttgaacgtgatggaggt

SEQ ID NO: 677260 - DNA, 25 bp, Artificial sequence
  Synthetic oligonucleotide
ccagacgattctgggggctgccttg

SEQ ID NO: 677261 - DNA, 25 bp, Artificial sequence
  Synthetic oligonucleotide
tacgatccgcagacccgtagctaca

SEQ ID NO: 677262 - DNA, 25 bp, Artificial sequence
  Synthetic oligonucleotide
accacgccgccgccggcgctggcct

SEQ ID NO: 677263 - DNA, 25 bp, Artificial sequence
  Synthetic oligonucleotide
gggcaagaccacgccgccgccggcg

SEQ ID NO: 677264 - DNA, 25 bp, Artificial sequence
  Synthetic oligonucleotide
tcttgagggcaagaccacgccgccg

SEQ ID NO: 677265 - DNA, 25 bp, Artificial sequence
  Synthetic oligonucleotide
gaccgctcttgagggcaagaccacg

SEQ ID NO: 677266 - DNA, 25 bp, Artificial sequence
  Synthetic oligonucleotide
tgtggagaccgctcttgagggcaag

SEQ ID NO: 677267 - DNA, 25 bp, Artificial sequence
  Synthetic oligonucleotide
cagcagtgtggagaccgctcttgag

SEQ ID NO: 677268 - DNA, 25 bp, Artificial sequence
  Synthetic oligonucleotide
tacgccagcagtgtggagaccgctc

SEQ ID NO: 677269 - DNA, 25 bp, Artificial sequence
  Synthetic oligonucleotide
tcggtctacgccagcagtgtggaga

SEQ ID NO: 677270 - DNA, 25 bp, Artificial sequence
  Synthetic oligonucleotide
gtcggctcggtctacgccagcagtg

SEQ ID NO: 677271 - DNA, 25 bp, Artificial sequence
  Synthetic oligonucleotide
atggaggtcggctcggtctacgcca

SEQ ID NO: 677272 - DNA, 25 bp, Artificial sequence
  Synthetic oligonucleotide
caaggactcgggcaactgggtgcgg

SEQ ID NO: 677273 - DNA, 25 bp, Artificial sequence
  Synthetic oligonucleotide
ccttgaacgtgatggaggtcggctc

SEQ ID NO: 677274 - DNA, 25 bp, Artificial sequence
  Synthetic oligonucleotide
gcaactgggtgcgggtgccgcgaac

SEQ ID NO: 677275 - DNA, 25 bp, Artificial sequence
  Synthetic oligonucleotide
gcgggtacgcgccttgaacgtgatg

SEQ ID NO: 677276 - DNA, 25 bp, Artificial sequence
  Synthetic oligonucleotide
tctggtgcgggtacgcgccttgaac

SEQ ID NO: 677277 - DNA, 25 bp, Artificial sequence
  Synthetic oligonucleotide
tcgctatctggtgcgggtacgcgcc

SEQ ID NO: 677278 - DNA, 25 bp, Artificial sequence
  Synthetic oligonucleotide
tgccggtcgctatctggtgcgggta

SEQ ID NO: 677279 - DNA, 25 bp, Artificial sequence
  Synthetic oligonucleotide
catctatgccggtcgctatctggtg

SEQ ID NO: 677280 - DNA, 25 bp, Artificial sequence
  Synthetic oligonucleotide
gccgggcatctatgccggtcgctat

SEQ ID NO: 677281 - DNA, 25 bp, Artificial sequence
  Synthetic oligonucleotide
gacgtgccgggcatctatgccggtc

SEQ ID NO: 677282 - DNA, 25 bp, Artificial sequence
  Synthetic oligonucleotide
cggtttcgacgtgccgggcatctat

SEQ ID NO: 677283 - DNA, 25 bp, Artificial sequence
  Synthetic oligonucleotide
ggcgctcggtttcgacgtgccgggc

SEQ ID NO: 677284 - DNA, 25 bp, Artificial sequence
  Synthetic oligonucleotide
aacctcggcgctcggtttcgacgtg

SEQ ID NO: 677285 - DNA, 25 bp, Artificial sequence
  Synthetic oligonucleotide
ccgcgaacctcggcgctcggtttcg

SEQ ID NO: 677286 - DNA, 25 bp, Artificial sequence
  Synthetic oligonucleotide
aacggtgcgcgcatcgagctgccgc

SEQ ID NO: 677287 - DNA, 25 bp, Artificial sequence
  Synthetic oligonucleotide
acgtgatggaggtcggctcggtcta

SEQ ID NO: 677288 - DNA, 25 bp, Artificial sequence
  Synthetic oligonucleotide
gtcgaggcccgacccggcgatcgcc

SEQ ID NO: 677289 - DNA, 25 bp, Artificial sequence
  Synthetic oligonucleotide
atcgagctgccgccggtcaccagca

SEQ ID NO: 677290 - DNA, 25 bp, Artificial sequence
  Synthetic oligonucleotide
aggccgcgtgctgaccgtgaccgcc

SEQ ID NO: 677291 - DNA, 25 bp, Artificial sequence
  Synthetic oligonucleotide
gtggtaggccgcgtgctgaccgtga

SEQ ID NO: 677292 - DNA, 25 bp, Artificial sequence
  Synthetic oligonucleotide
ccagtcggtggtaggccgcgtgctg

SEQ ID NO: 677293 - DNA, 25 bp, Artificial sequence
  Synthetic oligonucleotide
cagcgtccagtcggtggtaggccgc

SEQ ID NO: 677294 - DNA, 25 bp, Artificial sequence
  Synthetic oligonucleotide
ggcgcgcagcgtccagtcggtggta

SEQ ID NO: 677295 - DNA, 25 bp, Artificial sequence
  Synthetic oligonucleotide
ggccgaggcgcgcagcgtccagtcg

SEQ ID NO: 677296 - DNA, 25 bp, Artificial sequence
  Synthetic oligonucleotide
acggcaaggccgaggcgcgcagcgt

SEQ ID NO: 677297 - DNA, 25 bp, Artificial sequence
  Synthetic oligonucleotide
tgccgaacggcaaggccgaggcgcg

SEQ ID NO: 677298 - DNA, 25 bp, Artificial sequence
  Synthetic oligonucleotide
tcaacctgccgaacggcaaggccga

SEQ ID NO: 677299 - DNA, 25 bp, Artificial sequence
  Synthetic oligonucleotide
tgctggtcaacctgccgaacggcaa

SEQ ID NO: 677300 - DNA, 25 bp, Artificial sequence
  Synthetic oligonucleotide
atcgcctgctggtcaacctgccgaa

SEQ ID NO: 677301 - DNA, 25 bp, Artificial sequence
  Synthetic oligonucleotide
ccgtgaccgccgcctattcggagac

SEQ ID NO: 677302 - DNA, 25 bp, Artificial sequence
  Synthetic oligonucleotide
gcccgacccggcgatcgcctgctgg

SEQ ID NO: 677303 - DNA, 25 bp, Artificial sequence
  Synthetic oligonucleotide
cgccgcctattcggagacgcctcgg

SEQ ID NO: 677304 - DNA, 25 bp, Artificial sequence
  Synthetic oligonucleotide
cgcgacgtcgaggcccgacccggcg

SEQ ID NO: 677305 - DNA, 25 bp, Artificial sequence
  Synthetic oligonucleotide
cctcgaccgcgacgtcgaggcccga

SEQ ID NO: 677306 - DNA, 25 bp, Artificial sequence
  Synthetic oligonucleotide
gctgaccctcgaccgcgacgtcgag

SEQ ID NO: 677307 - DNA, 25 bp, Artificial sequence
  Synthetic oligonucleotide
cgcgcgctgaccctcgaccgcgacg

SEQ ID NO: 677308 - DNA, 25 bp, Artificial sequence
  Synthetic oligonucleotide
gatggccgcgcgctgaccctcgacc

SEQ ID NO: 677309 - DNA, 25 bp, Artificial sequence
  Synthetic oligonucleotide
gcggtggatggccgcgcgctgaccc

SEQ ID NO: 677310 - DNA, 25 bp, Artificial sequence
  Synthetic oligonucleotide
ctgagcgcggtggatggccgcgcgc

SEQ ID NO: 677311 - DNA, 25 bp, Artificial sequence
  Synthetic oligonucleotide
ggacgcctgagcgcggtggatggcc

SEQ ID NO: 677312 - DNA, 25 bp, Artificial sequence
  Synthetic oligonucleotide
atcggcggacgcctgagcgcggtgg

SEQ ID NO: 677313 - DNA, 25 bp, Artificial sequence
  Synthetic oligonucleotide
aagcagatcggcggacgcctgagcg

SEQ ID NO: 677314 - DNA, 25 bp, Artificial sequence
  Synthetic oligonucleotide
tccggcaagcagatcggcggacgcc

SEQ ID NO: 677315 - DNA, 25 bp, Artificial sequence
  Synthetic oligonucleotide
gtcaagtccggcaagcagatcggcg

SEQ ID NO: 677316 - DNA, 25 bp, Artificial sequence
  Synthetic oligonucleotide
cccggcgatcgcctgctggtcaacc

SEQ ID NO: 677317 - DNA, 25 bp, Artificial sequence
  Synthetic oligonucleotide
atcatgagcatcacccggccggagg

SEQ ID NO: 677318 - DNA, 25 bp, Artificial sequence
  Synthetic oligonucleotide
gacccggtcaagtccggcaagcaga

SEQ ID NO: 677319 - DNA, 25 bp, Artificial sequence
  Synthetic oligonucleotide
atcgacaacggtgcgcgcatcgagc

SEQ ID NO: 677320 - DNA, 25 bp, Artificial sequence
  Synthetic oligonucleotide
gacgccatcgacaacggtgcgcgca

SEQ ID NO: 677321 - DNA, 25 bp, Artificial sequence
  Synthetic oligonucleotide
aagttcgacgccatcgacaacggtg

SEQ ID NO: 677322 - DNA, 25 bp, Artificial sequence
  Synthetic oligonucleotide
gcgagcaagttcgacgccatcgaca

SEQ ID NO: 677323 - DNA, 25 bp, Artificial sequence
  Synthetic oligonucleotide
acaacgcgagcaagttcgacgccat

SEQ ID NO: 677324 - DNA, 25 bp, Artificial sequence
  Synthetic oligonucleotide
gcaacacaacgcgagcaagttcgac

SEQ ID NO: 677325 - DNA, 25 bp, Artificial sequence
  Synthetic oligonucleotide
cgcgctgcaacacaacgcgagcaag

SEQ ID NO: 677326 - DNA, 25 bp, Artificial sequence
  Synthetic oligonucleotide
gatcaccgcgctgcaacacaacgcg

SEQ ID NO: 677327 - DNA, 25 bp, Artificial sequence
  Synthetic oligonucleotide
tttcgagatcaccgcgctgcaacac

SEQ ID NO: 677328 - DNA, 25 bp, Artificial sequence
  Synthetic oligonucleotide
aatcttttcgagatcaccgcgctgc

SEQ ID NO: 677329 - DNA, 25 bp, Artificial sequence
  Synthetic oligonucleotide
ggaggacaatcttttcgagatcacc

SEQ ID NO: 677330 - DNA, 25 bp, Artificial sequence
  Synthetic oligonucleotide
gtgctgaccgtgaccgccgcctatt

SEQ ID NO: 677331 - DNA, 25 bp, Artificial sequence
  Synthetic oligonucleotide
agcatcacccggccggaggacaatc

SEQ ID NO: 677332 - DNA, 25 bp, Artificial sequence
  Synthetic oligonucleotide
tgcgcgcatcgagctgccgccggtc

SEQ ID NO: 677333 - DNA, 25 bp, Artificial sequence
  Synthetic oligonucleotide
ttccgcatcatgagcatcacccggc

SEQ ID NO: 677334 - DNA, 25 bp, Artificial sequence
  Synthetic oligonucleotide
cagcgcttccgcatcatgagcatca

SEQ ID NO: 677335 - DNA, 25 bp, Artificial sequence
  Synthetic oligonucleotide
accacccagcgcttccgcatcatga

SEQ ID NO: 677336 - DNA, 25 bp, Artificial sequence
  Synthetic oligonucleotide
agcctgaccacccagcgcttccgca

SEQ ID NO: 677337 - DNA, 25 bp, Artificial sequence
  Synthetic oligonucleotide
gagcaacagcctgaccacccagcgc

SEQ ID NO: 677338 - DNA, 25 bp, Artificial sequence
  Synthetic oligonucleotide
ctgcagagcaacagcctgaccaccc

SEQ ID NO: 677339 - DNA, 25 bp, Artificial sequence
  Synthetic oligonucleotide
tgggcgctgcagagcaacagcctga

SEQ ID NO: 677340 - DNA, 25 bp, Artificial sequence
  Synthetic oligonucleotide
gggcagtgggcgctgcagagcaaca

SEQ ID NO: 677341 - DNA, 25 bp, Artificial sequence
  Synthetic oligonucleotide
gccccaggggcagtgggcgctgcag

SEQ ID NO: 677342 - DNA, 25 bp, Artificial sequence
  Synthetic oligonucleotide
gcctcggccccaggggcagtgggcg

SEQ ID NO: 677343 - DNA, 25 bp, Artificial sequence
  Synthetic oligonucleotide
gagacgcctcggccccaggggcagt

SEQ ID NO: 677344 - DNA, 25 bp, Artificial sequence
  Synthetic oligonucleotide
tattcggagacgcctcggccccagg

SEQ ID NO: 677345 - DNA, 25 bp, Artificial sequence
  Synthetic oligonucleotide
ccggccggaggacaatcttttcgag

SEQ ID NO: 677346 - DNA, 25 bp, Artificial sequence
  Synthetic oligonucleotide
caacccaagggcctgaagggccgcg

SEQ ID NO: 677347 - DNA, 25 bp, Artificial sequence
  Synthetic oligonucleotide
atccggtcggcgtgctctacggcaa

SEQ ID NO: 677348 - DNA, 25 bp, Artificial sequence
  Synthetic oligonucleotide
agggccatccggtcggcgtgctcta

SEQ ID NO: 677349 - DNA, 25 bp, Artificial sequence
  Synthetic oligonucleotide
tcgcccagggccatccggtcggcgt

SEQ ID NO: 677350 - DNA, 25 bp, Artificial sequence
  Synthetic oligonucleotide
acaccatcgcccagggccatccggt

SEQ ID NO: 677351 - DNA, 25 bp, Artificial sequence
  Synthetic oligonucleotide
cggtcaacaccatcgcccagggcca

SEQ ID NO: 677352 - DNA, 25 bp, Artificial sequence
  Synthetic oligonucleotide
gcggcccggtcaacaccatcgccca

SEQ ID NO: 677353 - DNA, 25 bp, Artificial sequence
  Synthetic oligonucleotide
ccttcggcggcccggtcaacaccat

SEQ ID NO: 677354 - DNA, 25 bp, Artificial sequence
  Synthetic oligonucleotide
agctatgccttcggcggcccggtca

SEQ ID NO: 677355 - DNA, 25 bp, Artificial sequence
  Synthetic oligonucleotide
gcccccagctatgccttcggcggcc

SEQ ID NO: 677356 - DNA, 25 bp, Artificial sequence
  Synthetic oligonucleotide
gagaacgcccccagctatgccttcg

SEQ ID NO: 677357 - DNA, 25 bp, Artificial sequence
  Synthetic oligonucleotide
gcccccgagaacgcccccagctatg

SEQ ID NO: 677358 - DNA, 25 bp, Artificial sequence
  Synthetic oligonucleotide
gcgccagccggtggagatgccggac

SEQ ID NO: 677359 - DNA, 25 bp, Artificial sequence
  Synthetic oligonucleotide
caagggcctgaagggccgcgaggcc

SEQ ID NO: 677360 - DNA, 25 bp, Artificial sequence
  Synthetic oligonucleotide
tacggcaagcgccgcatcggcggcg

SEQ ID NO: 677361 - DNA, 25 bp, Artificial sequence
  Synthetic oligonucleotide
ctcagtccccaacccaagggcctga

SEQ ID NO: 677362 - DNA, 25 bp, Artificial sequence
  Synthetic oligonucleotide
cagatgctcagtccccaacccaagg

SEQ ID NO: 677363 - DNA, 25 bp, Artificial sequence
  Synthetic oligonucleotide
gtcatgcagatgctcagtccccaac

SEQ ID NO: 677364 - DNA, 25 bp, Artificial sequence
  Synthetic oligonucleotide
gcggcgtcatgcagatgctcagtcc

SEQ ID NO: 677365 - DNA, 25 bp, Artificial sequence
  Synthetic oligonucleotide
ttggcgggcggcgtcatgcagatgc

SEQ ID NO: 677366 - DNA, 25 bp, Artificial sequence
  Synthetic oligonucleotide
agcatgttggcgggcggcgtcatgc

SEQ ID NO: 677367 - DNA, 25 bp, Artificial sequence
  Synthetic oligonucleotide
ggagtcagcatgttggcgggcggcg

SEQ ID NO: 677368 - DNA, 25 bp, Artificial sequence
  Synthetic oligonucleotide
accgctggagtcagcatgttggcgg

SEQ ID NO: 677369 - DNA, 25 bp, Artificial sequence
  Synthetic oligonucleotide
ctggtaaccgctggagtcagcatgt

SEQ ID NO: 677370 - DNA, 25 bp, Artificial sequence
  Synthetic oligonucleotide
tcgttcctggtaaccgctggagtca

SEQ ID NO: 677371 - DNA, 25 bp, Artificial sequence
  Synthetic oligonucleotide
accagttcgttcctggtaaccgctg

SEQ ID NO: 677372 - DNA, 25 bp, Artificial sequence
  Synthetic oligonucleotide
ctccggtggaaccagttcgttcctg

SEQ ID NO: 677373 - DNA, 25 bp, Artificial sequence
  Synthetic oligonucleotide
ctgaagggccgcgaggcccccgaga

SEQ ID NO: 677374 - DNA, 25 bp, Artificial sequence
  Synthetic oligonucleotide
aacgccgtaacaggcccgccatgcg

SEQ ID NO: 677375 - DNA, 25 bp, Artificial sequence
  Synthetic oligonucleotide
gggggctgccttgattgtcgtgggt

SEQ ID NO: 677376 - DNA, 25 bp, Artificial sequence
  Synthetic oligonucleotide
cagcaagaagccgcgccagccggtg

SEQ ID NO: 677377 - DNA, 25 bp, Artificial sequence
  Synthetic oligonucleotide
gggtggcagcaagaagccgcgccag

SEQ ID NO: 677378 - DNA, 25 bp, Artificial sequence
  Synthetic oligonucleotide
ccacaagggtggcagcaagaagccg

SEQ ID NO: 677379 - DNA, 25 bp, Artificial sequence
  Synthetic oligonucleotide
cacgggccacaagggtggcagcaag

SEQ ID NO: 677380 - DNA, 25 bp, Artificial sequence
  Synthetic oligonucleotide
accatcacgggccacaagggtggca

SEQ ID NO: 677381 - DNA, 25 bp, Artificial sequence
  Synthetic oligonucleotide
gaacaagaccatcacgggccacaag

SEQ ID NO: 677382 - DNA, 25 bp, Artificial sequence
  Synthetic oligonucleotide
cgtcatgaacaagaccatcacgggc

SEQ ID NO: 677383 - DNA, 25 bp, Artificial sequence
  Synthetic oligonucleotide
aaggaacgtcatgaacaagaccatc

SEQ ID NO: 677384 - DNA, 25 bp, Artificial sequence
  Synthetic oligonucleotide
tgcctgaaggaacgtcatgaacaag

SEQ ID NO: 677385 - DNA, 25 bp, Artificial sequence
  Synthetic oligonucleotide
tttttttgcctgaaggaacgtcatg

SEQ ID NO: 677386 - DNA, 25 bp, Artificial sequence
  Synthetic oligonucleotide
ccatgcgcgggcgtttttttgcctg

SEQ ID NO: 677387 - DNA, 25 bp, Artificial sequence
  Synthetic oligonucleotide
tcggcgtgctctacggcaagcgccg

SEQ ID NO: 677388 - DNA, 25 bp, Artificial sequence
  Synthetic oligonucleotide
cgtaacaggcccgccatgcgcgggc

SEQ ID NO: 677389 - DNA, 25 bp, Artificial sequence
  Synthetic oligonucleotide
tgctctacggcaagcgccgcatcgg

SEQ ID NO: 677390 - DNA, 25 bp, Artificial sequence
  Synthetic oligonucleotide
gccggcaacgccgtaacaggcccgc

SEQ ID NO: 677391 - DNA, 25 bp, Artificial sequence
  Synthetic oligonucleotide
ctgtagccggcaacgccgtaacagg

SEQ ID NO: 677392 - DNA, 25 bp, Artificial sequence
  Synthetic oligonucleotide
gaccggctgtagccggcaacgccgt

SEQ ID NO: 677393 - DNA, 25 bp, Artificial sequence
  Synthetic oligonucleotide
gccgaggaccggctgtagccggcaa

SEQ ID NO: 677394 - DNA, 25 bp, Artificial sequence
  Synthetic oligonucleotide
atctatgccgaggaccggctgtagc

SEQ ID NO: 677395 - DNA, 25 bp, Artificial sequence
  Synthetic oligonucleotide
gccggcatctatgccgaggaccggc

SEQ ID NO: 677396 - DNA, 25 bp, Artificial sequence
  Synthetic oligonucleotide
atcagcgccggcatctatgccgagg

SEQ ID NO: 677397 - DNA, 25 bp, Artificial sequence
  Synthetic oligonucleotide
gcggtgatcagcgccggcatctatg

SEQ ID NO: 677398 - DNA, 25 bp, Artificial sequence
  Synthetic oligonucleotide
ggcggcgcggtgatcagcgccggca

SEQ ID NO: 677399 - DNA, 25 bp, Artificial sequence
  Synthetic oligonucleotide
cgcatcggcggcgcggtgatcagcg

SEQ ID NO: 677400 - DNA, 25 bp, Artificial sequence
  Synthetic oligonucleotide
aagcgccgcatcggcggcgcggtga

SEQ ID NO: 677401 - DNA, 25 bp, Artificial sequence
  Synthetic oligonucleotide
gtgggtggattcacgacgttcttct

SEQ ID NO: 677402 - DNA, 25 bp, Artificial sequence
  Synthetic oligonucleotide
aggcccgccatgcgcgggcgttttt

SEQ ID NO: 677403 - DNA, 25 bp, Artificial sequence
  Synthetic oligonucleotide
gcatgcacggccgattgttggaaag

SEQ ID NO: 677404 - DNA, 25 bp, Artificial sequence
  Synthetic oligonucleotide
cgacgttcttctccggtggaaccag

SEQ ID NO: 677405 - DNA, 25 bp, Artificial sequence
  Synthetic oligonucleotide
ttcgagacgttcatgcgcgaggcgg

SEQ ID NO: 677406 - DNA, 25 bp, Artificial sequence
  Synthetic oligonucleotide
gagggattcgagacgttcatgcgcg

SEQ ID NO: 677407 - DNA, 25 bp, Artificial sequence
  Synthetic oligonucleotide
accatggagggattcgagacgttca

SEQ ID NO: 677408 - DNA, 25 bp, Artificial sequence
  Synthetic oligonucleotide
aagcacaccatggagggattcgaga

SEQ ID NO: 677409 - DNA, 25 bp, Artificial sequence
  Synthetic oligonucleotide
gccttgaagcacaccatggagggat

SEQ ID NO: 677410 - DNA, 25 bp, Artificial sequence
  Synthetic oligonucleotide
atgagtgccttgaagcacaccatgg

SEQ ID NO: 677411 - DNA, 25 bp, Artificial sequence
  Synthetic oligonucleotide
gaggcgatgagtgccttgaagcaca

SEQ ID NO: 677412 - DNA, 25 bp, Artificial sequence
  Synthetic oligonucleotide
tacgcgaggcgatgagtgccttgaa

SEQ ID NO: 677413 - DNA, 25 bp, Artificial sequence
  Synthetic oligonucleotide
cacggtacgcgaggcgatgagtgcc

SEQ ID NO: 677414 - DNA, 25 bp, Artificial sequence
  Synthetic oligonucleotide
agcggcacggtacgcgaggcgatga

SEQ ID NO: 677415 - DNA, 25 bp, Artificial sequence
  Synthetic oligonucleotide
ttggaaagcggcacggtacgcgagg

SEQ ID NO: 677416 - DNA, 25 bp, Artificial sequence
  Synthetic oligonucleotide
atgcgcgaggcggaatcgaaagggc

SEQ ID NO: 677417 - DNA, 25 bp, Artificial sequence
  Synthetic oligonucleotide
acggccgattgttggaaagcggcac

SEQ ID NO: 677418 - DNA, 25 bp, Artificial sequence
  Synthetic oligonucleotide
gaggcggaatcgaaagggctgacct

SEQ ID NO: 677419 - DNA, 25 bp, Artificial sequence
  Synthetic oligonucleotide
tcggccgcatgcacggccgattgtt

SEQ ID NO: 677420 - DNA, 25 bp, Artificial sequence
  Synthetic oligonucleotide
agcgcttcggccgcatgcacggccg

SEQ ID NO: 677421 - DNA, 25 bp, Artificial sequence
  Synthetic oligonucleotide
tgggcaagcgcttcggccgcatgca

SEQ ID NO: 677422 - DNA, 25 bp, Artificial sequence
  Synthetic oligonucleotide
gggttctgggcaagcgcttcggccg

SEQ ID NO: 677423 - DNA, 25 bp, Artificial sequence
  Synthetic oligonucleotide
tgtacggggttctgggcaagcgctt

SEQ ID NO: 677424 - DNA, 25 bp, Artificial sequence
  Synthetic oligonucleotide
tccgtctgtacggggttctgggcaa

SEQ ID NO: 677425 - DNA, 25 bp, Artificial sequence
  Synthetic oligonucleotide
caccatccgtctgtacggggttctg

SEQ ID NO: 677426 - DNA, 25 bp, Artificial sequence
  Synthetic oligonucleotide
cctcaccaccatccgtctgtacggg

SEQ ID NO: 677427 - DNA, 25 bp, Artificial sequence
  Synthetic oligonucleotide
cagggcctcaccaccatccgtctgt

SEQ ID NO: 677428 - DNA, 25 bp, Artificial sequence
  Synthetic oligonucleotide
ctgagtcagggcctcaccaccatcc

SEQ ID NO: 677429 - DNA, 25 bp, Artificial sequence
  Synthetic oligonucleotide
gacaccctgagtcagggcctcacca

SEQ ID NO: 677430 - DNA, 25 bp, Artificial sequence
  Synthetic oligonucleotide
atgagtgacaccctgagtcagggcc

SEQ ID NO: 677431 - DNA, 25 bp, Artificial sequence
  Synthetic oligonucleotide
cgattgttggaaagcggcacggtac

SEQ ID NO: 677432 - DNA, 25 bp, Artificial sequence
  Synthetic oligonucleotide
gacgcgaggatatccgcatcgtgcc

SEQ ID NO: 677433 - DNA, 25 bp, Artificial sequence
  Synthetic oligonucleotide
agccggtggagatgccggactcggt

SEQ ID NO: 677434 - DNA, 25 bp, Artificial sequence
  Synthetic oligonucleotide
attgtcgtgggtggattcacgacgt

SEQ ID NO: 677435 - DNA, 25 bp, Artificial sequence
  Synthetic oligonucleotide
gccttgattgtcgtgggtggattca

SEQ ID NO: 677436 - DNA, 25 bp, Artificial sequence
  Synthetic oligonucleotide
gattctgggggctgccttgattgtc

SEQ ID NO: 677437 - DNA, 25 bp, Artificial sequence
  Synthetic oligonucleotide
gctggcctacctgcgctgcgtggcc

SEQ ID NO: 677438 - DNA, 25 bp, Artificial sequence
  Synthetic oligonucleotide
cttttccagacgattctgggggctg

SEQ ID NO: 677439 - DNA, 25 bp, Artificial sequence
  Synthetic oligonucleotide
ggcggggcttttccagacgattctg

SEQ ID NO: 677440 - DNA, 25 bp, Artificial sequence
  Synthetic oligonucleotide
caagcaggcggggcttttccagacg

SEQ ID NO: 677441 - DNA, 25 bp, Artificial sequence
  Synthetic oligonucleotide
cgggagcaagcaggcggggcttttc

SEQ ID NO: 677442 - DNA, 25 bp, Artificial sequence
  Synthetic oligonucleotide
gtgatcgggagcaagcaggcggggc

SEQ ID NO: 677443 - DNA, 25 bp, Artificial sequence
  Synthetic oligonucleotide
cgttggtgatcgggagcaagcaggc

SEQ ID NO: 677444 - DNA, 25 bp, Artificial sequence
  Synthetic oligonucleotide
tcgtgccgttggtgatcgggagcaa

SEQ ID NO: 677445 - DNA, 25 bp, Artificial sequence
  Synthetic oligonucleotide
acgttcatgcgcgaggcggaatcga

SEQ ID NO: 677446 - DNA, 25 bp, Artificial sequence
  Synthetic oligonucleotide
aggatatccgcatcgtgccgttggt

SEQ ID NO: 677447 - DNA, 25 bp, Artificial sequence
  Synthetic oligonucleotide
ggattcacgacgttcttctccggtg

SEQ ID NO: 677448 - DNA, 25 bp, Artificial sequence
  Synthetic oligonucleotide
tgcgcggacgcgaggatatccgcat

SEQ ID NO: 677449 - DNA, 25 bp, Artificial sequence
  Synthetic oligonucleotide
tggacatgcgcggacgcgaggatat

SEQ ID NO: 677450 - DNA, 25 bp, Artificial sequence
  Synthetic oligonucleotide
agcaactggacatgcgcggacgcga

SEQ ID NO: 677451 - DNA, 25 bp, Artificial sequence
  Synthetic oligonucleotide
ccggcgagcaactggacatgcgcgg

SEQ ID NO: 677452 - DNA, 25 bp, Artificial sequence
  Synthetic oligonucleotide
acctgtccggcgagcaactggacat

SEQ ID NO: 677453 - DNA, 25 bp, Artificial sequence
  Synthetic oligonucleotide
gtaccaacctgtccggcgagcaact

SEQ ID NO: 677454 - DNA, 25 bp, Artificial sequence
  Synthetic oligonucleotide
gtgggcgtaccaacctgtccggcga

SEQ ID NO: 677455 - DNA, 25 bp, Artificial sequence
  Synthetic oligonucleotide
tgttccgtgggcgtaccaacctgtc

SEQ ID NO: 677456 - DNA, 25 bp, Artificial sequence
  Synthetic oligonucleotide
tcgccgtgttccgtgggcgtaccaa

SEQ ID NO: 677457 - DNA, 25 bp, Artificial sequence
  Synthetic oligonucleotide
tgaccttcgccgtgttccgtgggcg

SEQ ID NO: 677458 - DNA, 25 bp, Artificial sequence
  Synthetic oligonucleotide
aagggctgaccttcgccgtgttccg

SEQ ID NO: 677459 - DNA, 25 bp, Artificial sequence
  Synthetic oligonucleotide
gaatcgaaagggctgaccttcgccg

SEQ ID NO: 677460 - DNA, 25 bp, Artificial sequence
  Synthetic oligonucleotide
tccgcatcgtgccgttggtgatcgg

SEQ ID NO: 677461 - DNA, 25 bp, Artificial sequence
  Synthetic oligonucleotide
gccgctacgagcgctcccaccgtgt

SEQ ID NO: 677462 - DNA, 25 bp, Artificial sequence
  Synthetic oligonucleotide
cgaaccagaacaacaaccgcgtcgc

SEQ ID NO: 677463 - DNA, 25 bp, Artificial sequence
  Synthetic oligonucleotide
tgacgccgaaccagaacaacaaccg

SEQ ID NO: 677464 - DNA, 25 bp, Artificial sequence
  Synthetic oligonucleotide
gccgcctgacgccgaaccagaacaa

SEQ ID NO: 677465 - DNA, 25 bp, Artificial sequence
  Synthetic oligonucleotide
gcgtgcgccgcctgacgccgaacca

SEQ ID NO: 677466 - DNA, 25 bp, Artificial sequence
  Synthetic oligonucleotide
aggtgcgcgtgcgccgcctgacgcc

SEQ ID NO: 677467 - DNA, 25 bp, Artificial sequence
  Synthetic oligonucleotide
gctggcaggtgcgcgtgcgccgcct

SEQ ID NO: 677468 - DNA, 25 bp, Artificial sequence
  Synthetic oligonucleotide
ggagcggctggcaggtgcgcgtgcg

SEQ ID NO: 677469 - DNA, 25 bp, Artificial sequence
  Synthetic oligonucleotide
aggcgcggagcggctggcaggtgcg

SEQ ID NO: 677470 - DNA, 25 bp, Artificial sequence
  Synthetic oligonucleotide
tgccggaggcgcggagcggctggca

SEQ ID NO: 677471 - DNA, 25 bp, Artificial sequence
  Synthetic oligonucleotide
tcgacctgccggaggcgcggagcgg

SEQ ID NO: 677472 - DNA, 25 bp, Artificial sequence
  Synthetic oligonucleotide
accgtgtcgacctgccggaggcgcg

SEQ ID NO: 677473 - DNA, 25 bp, Artificial sequence
  Synthetic oligonucleotide
gaagccgcgccagccggtggagatg

SEQ ID NO: 677474 - DNA, 25 bp, Artificial sequence
  Synthetic oligonucleotide
acgagcgctcccaccgtgtcgacct

SEQ ID NO: 677475 - DNA, 25 bp, Artificial sequence
  Synthetic oligonucleotide
gcgtcgccgacaccatgcgggtgga

SEQ ID NO: 677476 - DNA, 25 bp, Artificial sequence
  Synthetic oligonucleotide
ccaccagccgctacgagcgctccca

SEQ ID NO: 677477 - DNA, 25 bp, Artificial sequence
  Synthetic oligonucleotide
acaagtccaccagccgctacgagcg

SEQ ID NO: 677478 - DNA, 25 bp, Artificial sequence
  Synthetic oligonucleotide
tggacgacaagtccaccagccgcta

SEQ ID NO: 677479 - DNA, 25 bp, Artificial sequence
  Synthetic oligonucleotide
ttcgctggacgacaagtccaccagc

SEQ ID NO: 677480 - DNA, 25 bp, Artificial sequence
  Synthetic oligonucleotide
aaggcttcgctggacgacaagtcca

SEQ ID NO: 677481 - DNA, 25 bp, Artificial sequence
  Synthetic oligonucleotide
gcgctgaaggcttcgctggacgaca

SEQ ID NO: 677482 - DNA, 25 bp, Artificial sequence
  Synthetic oligonucleotide
caggaagcgctgaaggcttcgctgg

SEQ ID NO: 677483 - DNA, 25 bp, Artificial sequence
  Synthetic oligonucleotide
gcctggcaggaagcgctgaaggctt

SEQ ID NO: 677484 - DNA, 25 bp, Artificial sequence
  Synthetic oligonucleotide
ggcggtgcctggcaggaagcgctga

SEQ ID NO: 677485 - DNA, 25 bp, Artificial sequence
  Synthetic oligonucleotide
cgtcgacggcggtgcctggcaggaa

SEQ ID NO: 677486 - DNA, 25 bp, Artificial sequence
  Synthetic oligonucleotide
catcgccgtcgacggcggtgcctgg

SEQ ID NO: 677487 - DNA, 25 bp, Artificial sequence
  Synthetic oligonucleotide
atcgacatcgccgtcgacggcggtg

SEQ ID NO: 677488 - DNA, 25 bp, Artificial sequence
  Synthetic oligonucleotide
gctcccaccgtgtcgacctgccgga

SEQ ID NO: 677489 - DNA, 25 bp, Artificial sequence
  Synthetic oligonucleotide
cgctgctgttcgtcgagttcgatgc

SEQ ID NO: 677490 - DNA, 25 bp, Artificial sequence
  Synthetic oligonucleotide
gtgccgagcaactacgatccgcaga

SEQ ID NO: 677491 - DNA, 25 bp, Artificial sequence
  Synthetic oligonucleotide
gtgcgggtgccgagcaactacgatc

SEQ ID NO: 677492 - DNA, 25 bp, Artificial sequence
  Synthetic oligonucleotide
cggcgggtgcgggtgccgagcaact

SEQ ID NO: 677493 - DNA, 25 bp, Artificial sequence
  Synthetic oligonucleotide
cgcggccggcgggtgcgggtgccga

SEQ ID NO: 677494 - DNA, 25 bp, Artificial sequence
  Synthetic oligonucleotide
gaagcgcgcggccggcgggtgcggg

SEQ ID NO: 677495 - DNA, 25 bp, Artificial sequence
  Synthetic oligonucleotide
tcggtggaagcgcgcggccggcggg

SEQ ID NO: 677496 - DNA, 25 bp, Artificial sequence
  Synthetic oligonucleotide
cagatatcggtggaagcgcgcggcc

SEQ ID NO: 677497 - DNA, 25 bp, Artificial sequence
  Synthetic oligonucleotide
attccgcagatatcggtggaagcgc

SEQ ID NO: 677498 - DNA, 25 bp, Artificial sequence
  Synthetic oligonucleotide
cagagcattccgcagatatcggtgg

SEQ ID NO: 677499 - DNA, 25 bp, Artificial sequence
  Synthetic oligonucleotide
cagttccagagcattccgcagatat

SEQ ID NO: 677500 - DNA, 25 bp, Artificial sequence
  Synthetic oligonucleotide
gccagccagttccagagcattccgc

SEQ ID NO: 677501 - DNA, 25 bp, Artificial sequence
  Synthetic oligonucleotide
ttcgatgccagccagttccagagca

SEQ ID NO: 677502 - DNA, 25 bp, Artificial sequence
  Synthetic oligonucleotide
agaacaacaaccgcgtcgccgacac

SEQ ID NO: 677503 - DNA, 25 bp, Artificial sequence
  Synthetic oligonucleotide
tgttcgtcgagttcgatgccagcca

SEQ ID NO: 677504 - DNA, 25 bp, Artificial sequence
  Synthetic oligonucleotide
acaaccgcgtcgccgacaccatgcg

SEQ ID NO: 677505 - DNA, 25 bp, Artificial sequence
  Synthetic oligonucleotide
acaccgcgctgctgttcgtcgagtt

SEQ ID NO: 677506 - DNA, 25 bp, Artificial sequence
  Synthetic oligonucleotide
acccgaacaccgcgctgctgttcgt

SEQ ID NO: 677507 - DNA, 25 bp, Artificial sequence
  Synthetic oligonucleotide
tgcgctacccgaacaccgcgctgct

SEQ ID NO: 677508 - DNA, 25 bp, Artificial sequence
  Synthetic oligonucleotide
ccaagctgcgctacccgaacaccgc

SEQ ID NO: 677509 - DNA, 25 bp, Artificial sequence
  Synthetic oligonucleotide
tcgacgccaagctgcgctacccgaa

SEQ ID NO: 677510 - DNA, 25 bp, Artificial sequence
  Synthetic oligonucleotide
aggtgatcgacgccaagctgcgcta

SEQ ID NO: 677511 - DNA, 25 bp, Artificial sequence
  Synthetic oligonucleotide
tcaccgaggtgatcgacgccaagct

SEQ ID NO: 677512 - DNA, 25 bp, Artificial sequence
  Synthetic oligonucleotide
aggcgatcaccgaggtgatcgacgc

SEQ ID NO: 677513 - DNA, 25 bp, Artificial sequence
  Synthetic oligonucleotide
gggtggaggcgatcaccgaggtgat

SEQ ID NO: 677514 - DNA, 25 bp, Artificial sequence
  Synthetic oligonucleotide
ccatgcgggtggaggcgatcaccga

SEQ ID NO: 677515 - DNA, 25 bp, Artificial sequence
  Synthetic oligonucleotide
ccgacaccatgcgggtggaggcgat

SEQ ID NO: 677516 - DNA, 25 bp, Artificial sequence
  Synthetic oligonucleotide
taccgcatcgactacgcgatcgaca

SEQ ID NO: 677517 - DNA, 25 bp, Artificial sequence
  Synthetic oligonucleotide
gtcgagttcgatgccagccagttcc

SEQ ID NO: 677518 - DNA, 25 bp, Artificial sequence
  Synthetic oligonucleotide
acggtggcgtcgacggccgttcgat

SEQ ID NO: 677519 - DNA, 25 bp, Artificial sequence
  Synthetic oligonucleotide
tacgcgatcgacatcgccgtcgacg

SEQ ID NO: 677520 - DNA, 25 bp, Artificial sequence
  Synthetic oligonucleotide
tccgtccgggctcggtggaccagga

SEQ ID NO: 677521 - DNA, 25 bp, Artificial sequence
  Synthetic oligonucleotide
tgacctgggagttccgtccgggctc

SEQ ID NO: 677522 - DNA, 25 bp, Artificial sequence
  Synthetic oligonucleotide
cggagtgacctgggagttccgtccg

SEQ ID NO: 677523 - DNA, 25 bp, Artificial sequence
  Synthetic oligonucleotide
cggtgaacttccccggagtgacctg

SEQ ID NO: 677524 - DNA, 25 bp, Artificial sequence
  Synthetic oligonucleotide
cggctcggtgaacttccccggagtg

SEQ ID NO: 677525 - DNA, 25 bp, Artificial sequence
  Synthetic oligonucleotide
gcggcggacggctcggtgaacttcc

SEQ ID NO: 677526 - DNA, 25 bp, Artificial sequence
  Synthetic oligonucleotide
ctgctggcggcggacggctcggtga

SEQ ID NO: 677527 - DNA, 25 bp, Artificial sequence
  Synthetic oligonucleotide
tacgccgctgctggcggcggacggc

SEQ ID NO: 677528 - DNA, 25 bp, Artificial sequence
  Synthetic oligonucleotide
gacgatacgccgctgctggcggcgg

SEQ ID NO: 677529 - DNA, 25 bp, Artificial sequence
  Synthetic oligonucleotide
ctacctggacgatacgccgctgctg

SEQ ID NO: 677530 - DNA, 25 bp, Artificial sequence
  Synthetic oligonucleotide
ttcgatctacctggacgatacgccg

SEQ ID NO: 677531 - DNA, 25 bp, Artificial sequence
  Synthetic oligonucleotide
cggtggaccaggaacacattgccgg

SEQ ID NO: 677532 - DNA, 25 bp, Artificial sequence
  Synthetic oligonucleotide
cgtcgacggccgttcgatctacctg

SEQ ID NO: 677533 - DNA, 25 bp, Artificial sequence
  Synthetic oligonucleotide
accaggaacacattgccggtgtgcc

SEQ ID NO: 677534 - DNA, 25 bp, Artificial sequence
  Synthetic oligonucleotide
agttcgacggtggcgtcgacggccg

SEQ ID NO: 677535 - DNA, 25 bp, Artificial sequence
  Synthetic oligonucleotide
aaggcgagttcgacggtggcgtcga

SEQ ID NO: 677536 - DNA, 25 bp, Artificial sequence
  Synthetic oligonucleotide
tgggcgaaggcgagttcgacggtgg

SEQ ID NO: 677537 - DNA, 25 bp, Artificial sequence
  Synthetic oligonucleotide
tggcactgggcgaaggcgagttcga

SEQ ID NO: 677538 - DNA, 25 bp, Artificial sequence
  Synthetic oligonucleotide
ttctcctggcactgggcgaaggcga

SEQ ID NO: 677539 - DNA, 25 bp, Artificial sequence
  Synthetic oligonucleotide
gaagattctcctggcactgggcgaa

SEQ ID NO: 677540 - DNA, 25 bp, Artificial sequence
  Synthetic oligonucleotide
gcgggcgaagattctcctggcactg

SEQ ID NO: 677541 - DNA, 25 bp, Artificial sequence
  Synthetic oligonucleotide
gatcgcgcgggcgaagattctcctg

SEQ ID NO: 677542 - DNA, 25 bp, Artificial sequence
  Synthetic oligonucleotide
tgcgctcgatcgcgcgggcgaagat

SEQ ID NO: 677543 - DNA, 25 bp, Artificial sequence
  Synthetic oligonucleotide
actcggtgcgctcgatcgcgcgggc

SEQ ID NO: 677544 - DNA, 25 bp, Artificial sequence
  Synthetic oligonucleotide
tgccggactcggtgcgctcgatcgc

SEQ ID NO: 677545 - DNA, 25 bp, Artificial sequence
  Synthetic oligonucleotide
tggagatgccggactcggtgcgctc

SEQ ID NO: 677546 - DNA, 25 bp, Artificial sequence
  Synthetic oligonucleotide
cggccgttcgatctacctggacgat

SEQ ID NO: 677547 - DNA, 25 bp, Artificial sequence
  Synthetic oligonucleotide
tgaacaacacccagctctcggcggt

SEQ ID NO: 677548 - DNA, 25 bp, Artificial sequence
  Synthetic oligonucleotide
agcaactacgatccgcagacccgta

SEQ ID NO: 677549 - DNA, 25 bp, Artificial sequence
  Synthetic oligonucleotide
gtcggctaccgcatcgactacgcga

SEQ ID NO: 677550 - DNA, 25 bp, Artificial sequence
  Synthetic oligonucleotide
gacgtggtcggctaccgcatcgact

SEQ ID NO: 677551 - DNA, 25 bp, Artificial sequence
  Synthetic oligonucleotide
aacggtgacgtggtcggctaccgca

SEQ ID NO: 677552 - DNA, 25 bp, Artificial sequence
  Synthetic oligonucleotide
agcaggaaaacggtgacgtggtcgg

SEQ ID NO: 677553 - DNA, 25 bp, Artificial sequence
  Synthetic oligonucleotide
agcgccagcaggaaaacggtgacgt

SEQ ID NO: 677554 - DNA, 25 bp, Artificial sequence
  Synthetic oligonucleotide
ccatccagcgccagcaggaaaacgg

SEQ ID NO: 677555 - DNA, 25 bp, Artificial sequence
  Synthetic oligonucleotide
ggccggccatccagcgccagcagga

SEQ ID NO: 677556 - DNA, 25 bp, Artificial sequence
  Synthetic oligonucleotide
gtcctggccggccatccagcgccag

SEQ ID NO: 677557 - DNA, 25 bp, Artificial sequence
  Synthetic oligonucleotide
tgcgcctgtcctggccggccatcca

SEQ ID NO: 677558 - DNA, 25 bp, Artificial sequence
  Synthetic oligonucleotide
tgcgcctgcgcctgtcctggccggc

SEQ ID NO: 677559 - DNA, 25 bp, Artificial sequence
  Synthetic oligonucleotide
cggcggtgcgcctgcgcctgtcctg

SEQ ID NO: 677560 - DNA, 25 bp, Artificial sequence
  Synthetic oligonucleotide
cgggctcggtggaccaggaacacat

SEQ ID NO: 677561 - DNA, 25 bp, Artificial sequence
  Synthetic oligonucleotide
acacccagctctcggcggtgcgcct

SEQ ID NO: 677562 - DNA, 25 bp, Artificial sequence
  Synthetic oligonucleotide
atcgactacgcgatcgacatcgccg

SEQ ID NO: 677563 - DNA, 25 bp, Artificial sequence
  Synthetic oligonucleotide
gcgcggtgaacaacacccagctctc

SEQ ID NO: 677564 - DNA, 25 bp, Artificial sequence
  Synthetic oligonucleotide
gggtccgcgcggtgaacaacaccca

SEQ ID NO: 677565 - DNA, 25 bp, Artificial sequence
  Synthetic oligonucleotide
cgccctgggtccgcgcggtgaacaa

SEQ ID NO: 677566 - DNA, 25 bp, Artificial sequence
  Synthetic oligonucleotide
gtgacgcgccctgggtccgcgcggt

SEQ ID NO: 677567 - DNA, 25 bp, Artificial sequence
  Synthetic oligonucleotide
tcaagagtgacgcgccctgggtccg

SEQ ID NO: 677568 - DNA, 25 bp, Artificial sequence
  Synthetic oligonucleotide
tcgaactcaagagtgacgcgccctg

SEQ ID NO: 677569 - DNA, 25 bp, Artificial sequence
  Synthetic oligonucleotide
tcggcgtcgaactcaagagtgacgc

SEQ ID NO: 677570 - DNA, 25 bp, Artificial sequence
  Synthetic oligonucleotide
tggcggtcggcgtcgaactcaagag

SEQ ID NO: 677571 - DNA, 25 bp, Artificial sequence
  Synthetic oligonucleotide
acgaactggcggtcggcgtcgaact

SEQ ID NO: 677572 - DNA, 25 bp, Artificial sequence
  Synthetic oligonucleotide
tgtgcccgccgtggaaaacgaactg

SEQ ID NO: 677573 - DNA, 25 bp, Artificial sequence
  Synthetic oligonucleotide
ttgccggtgtgcccgccgtggaaaa

SEQ ID NO: 677574 - DNA, 25 bp, Artificial sequence
  Synthetic oligonucleotide
aacacattgccggtgtgcccgccgt

SEQ ID NO: 677575 - DNA, 25 bp, Artificial sequence
  Synthetic oligonucleotide
agctctcggcggtgcgcctgcgcct

SEQ ID NO: 677576 - DNA, 25 bp, Artificial sequence
  Synthetic oligonucleotide
cactccggttgcttactcgtggggg

SEQ ID NO: 677577 - DNA, 25 bp, Artificial sequence
  Synthetic oligonucleotide
gtttccgtcacgctgaattccgaag

SEQ ID NO: 677578 - DNA, 25 bp, Artificial sequence
  Synthetic oligonucleotide
aacaccactaccaatgtgggagcca

SEQ ID NO: 677579 - DNA, 25 bp, Artificial sequence
  Synthetic oligonucleotide
cactaccaatgtgggagccaccatg

SEQ ID NO: 677580 - DNA, 25 bp, Artificial sequence
  Synthetic oligonucleotide
caatgtgggagccaccatggcctac

SEQ ID NO: 677581 - DNA, 25 bp, Artificial sequence
  Synthetic oligonucleotide
gggagccaccatggcctaccagccg

SEQ ID NO: 677582 - DNA, 25 bp, Artificial sequence
  Synthetic oligonucleotide
accatggcctaccagccggctggta

SEQ ID NO: 677583 - DNA, 25 bp, Artificial sequence
  Synthetic oligonucleotide
gcctaccagccggctggtacgttgt

SEQ ID NO: 677584 - DNA, 25 bp, Artificial sequence
  Synthetic oligonucleotide
cagccggctggtacgttgtcgttct

SEQ ID NO: 677585 - DNA, 25 bp, Artificial sequence
  Synthetic oligonucleotide
gctggtacgttgtcgttctatatca

SEQ ID NO: 677586 - DNA, 25 bp, Artificial sequence
  Synthetic oligonucleotide
acgttgtcgttctatatcactccgg

SEQ ID NO: 677587 - DNA, 25 bp, Artificial sequence
  Synthetic oligonucleotide
atctgctggggcaacaccactacca

SEQ ID NO: 677588 - DNA, 25 bp, Artificial sequence
  Synthetic oligonucleotide
tatatcactccggttgcttactcgt

SEQ ID NO: 677589 - DNA, 25 bp, Artificial sequence
  Synthetic oligonucleotide
acccagatctgctggggcaacacca

SEQ ID NO: 677590 - DNA, 25 bp, Artificial sequence
  Synthetic oligonucleotide
gtctcgttctcccggcctccgtctg

SEQ ID NO: 677591 - DNA, 25 bp, Artificial sequence
  Synthetic oligonucleotide
ttctcccggcctccgtctgtcatgg

SEQ ID NO: 677592 - DNA, 25 bp, Artificial sequence
  Synthetic oligonucleotide
cggcctccgtctgtcatggtcaacc

SEQ ID NO: 677593 - DNA, 25 bp, Artificial sequence
  Synthetic oligonucleotide
ccgtctgtcatggtcaacccgatga

SEQ ID NO: 677594 - DNA, 25 bp, Artificial sequence
  Synthetic oligonucleotide
tgtcatggtcaacccgatgagagca

SEQ ID NO: 677595 - DNA, 25 bp, Artificial sequence
  Synthetic oligonucleotide
ggtcaacccgatgagagcagcagga

SEQ ID NO: 677596 - DNA, 25 bp, Artificial sequence
  Synthetic oligonucleotide
cccgatgagagcagcaggaaacaac

SEQ ID NO: 677597 - DNA, 25 bp, Artificial sequence
  Synthetic oligonucleotide
gagagcagcaggaaacaacgcttcc

SEQ ID NO: 677598 - DNA, 25 bp, Artificial sequence
  Synthetic oligonucleotide
cagcaggaaacaacgcttcccgtcc

SEQ ID NO: 677599 - DNA, 25 bp, Artificial sequence
  Synthetic oligonucleotide
ccgtccctggggttcgacgatgtcg

SEQ ID NO: 677600 - DNA, 25 bp, Artificial sequence
  Synthetic oligonucleotide
tcgttctatatcactccggttgctt

SEQ ID NO: 677601 - DNA, 25 bp, Artificial sequence
  Synthetic oligonucleotide
gcgccatcatccagcgcggcgggac

SEQ ID NO: 677602 - DNA, 25 bp, Artificial sequence
  Synthetic oligonucleotide
cgctgggtgttgcagtacagccagt

SEQ ID NO: 677603 - DNA, 25 bp, Artificial sequence
  Synthetic oligonucleotide
gtgttgcagtacagccagttcaacc

SEQ ID NO: 677604 - DNA, 25 bp, Artificial sequence
  Synthetic oligonucleotide
cagtacagccagttcaaccttgtcg

SEQ ID NO: 677605 - DNA, 25 bp, Artificial sequence
  Synthetic oligonucleotide
agccagttcaaccttgtcggactgg

SEQ ID NO: 677606 - DNA, 25 bp, Artificial sequence
  Synthetic oligonucleotide
tcaaccttgtcggactggcgagctt

SEQ ID NO: 677607 - DNA, 25 bp, Artificial sequence
  Synthetic oligonucleotide
tgtcggactggcgagcttcgatgca

SEQ ID NO: 677608 - DNA, 25 bp, Artificial sequence
  Synthetic oligonucleotide
actggcgagcttcgatgcatcgaac

SEQ ID NO: 677609 - DNA, 25 bp, Artificial sequence
  Synthetic oligonucleotide
gagcttcgatgcatcgaacaatcca

SEQ ID NO: 677610 - DNA, 25 bp, Artificial sequence
  Synthetic oligonucleotide
cgatgcatcgaacaatccatccggc

SEQ ID NO: 677611 - DNA, 25 bp, Artificial sequence
  Synthetic oligonucleotide
atcgaacaatccatccggcgccatc

SEQ ID NO: 677612 - DNA, 25 bp, Artificial sequence
  Synthetic oligonucleotide
tggggcaacaccactaccaatgtgg

SEQ ID NO: 677613 - DNA, 25 bp, Artificial sequence
  Synthetic oligonucleotide
catccggcgccatcatccagcgcgg

SEQ ID NO: 677614 - DNA, 25 bp, Artificial sequence
  Synthetic oligonucleotide
cgatgtcggtcaccgaaacgctgtt

SEQ ID NO: 677615 - DNA, 25 bp, Artificial sequence
  Synthetic oligonucleotide
atcatccagcgcggcgggactgtcg

SEQ ID NO: 677616 - DNA, 25 bp, Artificial sequence
  Synthetic oligonucleotide
cagcgcggcgggactgtcggtttca

SEQ ID NO: 677617 - DNA, 25 bp, Artificial sequence
  Synthetic oligonucleotide
gcgggactgtcggtttcaacgagta

SEQ ID NO: 677618 - DNA, 25 bp, Artificial sequence
  Synthetic oligonucleotide
ctgtcggtttcaacgagtatgtacg

SEQ ID NO: 677619 - DNA, 25 bp, Artificial sequence
  Synthetic oligonucleotide
gtttcaacgagtatgtacgctacgc

SEQ ID NO: 677620 - DNA, 25 bp, Artificial sequence
  Synthetic oligonucleotide
aacgagtatgtacgctacgccgacg

SEQ ID NO: 677621 - DNA, 25 bp, Artificial sequence
  Synthetic oligonucleotide
gtatgtacgctacgccgacggaacc

SEQ ID NO: 677622 - DNA, 25 bp, Artificial sequence
  Synthetic oligonucleotide
tacgctacgccgacggaacccagat

SEQ ID NO: 677623 - DNA, 25 bp, Artificial sequence
  Synthetic oligonucleotide
acgccgacggaacccagatctgctg

SEQ ID NO: 677624 - DNA, 25 bp, Artificial sequence
  Synthetic oligonucleotide
acggaacccagatctgctggggcaa

SEQ ID NO: 677625 - DNA, 25 bp, Artificial sequence
  Synthetic oligonucleotide
acaatccatccggcgccatcatcca

SEQ ID NO: 677626 - DNA, 25 bp, Artificial sequence
  Synthetic oligonucleotide
gcagcctggggggtacctgcctccg

SEQ ID NO: 677627 - DNA, 25 bp, Artificial sequence
  Synthetic oligonucleotide
acgtctcagcgatgtccaggtgcga

SEQ ID NO: 677628 - DNA, 25 bp, Artificial sequence
  Synthetic oligonucleotide
cagcgatgtccaggtgcgagggtcg

SEQ ID NO: 677629 - DNA, 25 bp, Artificial sequence
  Synthetic oligonucleotide
tgtccaggtgcgagggtcggtgttt

SEQ ID NO: 677630 - DNA, 25 bp, Artificial sequence
  Synthetic oligonucleotide
gtgcgagggtcggtgtttatcctgg

SEQ ID NO: 677631 - DNA, 25 bp, Artificial sequence
  Synthetic oligonucleotide
gggtcggtgtttatcctggatggcg

SEQ ID NO: 677632 - DNA, 25 bp, Artificial sequence
  Synthetic oligonucleotide
gtgtttatcctggatggcgtcgaat

SEQ ID NO: 677633 - DNA, 25 bp, Artificial sequence
  Synthetic oligonucleotide
atcctggatggcgtcgaatacgatt

SEQ ID NO: 677634 - DNA, 25 bp, Artificial sequence
  Synthetic oligonucleotide
gatggcgtcgaatacgatttcggaa

SEQ ID NO: 677635 - DNA, 25 bp, Artificial sequence
  Synthetic oligonucleotide
gtcgaatacgatttcggaagaatgc

SEQ ID NO: 677636 - DNA, 25 bp, Artificial sequence
  Synthetic oligonucleotide
tacgatttcggaagaatgcagcctg

SEQ ID NO: 677637 - DNA, 25 bp, Artificial sequence
  Synthetic oligonucleotide
ctggggttcgacgatgtcggtcacc

SEQ ID NO: 677638 - DNA, 25 bp, Artificial sequence
  Synthetic oligonucleotide
aagaatgcagcctggggggtacctg

SEQ ID NO: 677639 - DNA, 25 bp, Artificial sequence
  Synthetic oligonucleotide
atcacgcctgacagggaacgtctca

SEQ ID NO: 677640 - DNA, 25 bp, Artificial sequence
  Synthetic oligonucleotide
tggggggtacctgcctccggaggca

SEQ ID NO: 677641 - DNA, 25 bp, Artificial sequence
  Synthetic oligonucleotide
tacctgcctccggaggcataccatg

SEQ ID NO: 677642 - DNA, 25 bp, Artificial sequence
  Synthetic oligonucleotide
cctccggaggcataccatgatacgc

SEQ ID NO: 677643 - DNA, 25 bp, Artificial sequence
  Synthetic oligonucleotide
gaggcataccatgatacgccattca

SEQ ID NO: 677644 - DNA, 25 bp, Artificial sequence
  Synthetic oligonucleotide
taccatgatacgccattcattgata

SEQ ID NO: 677645 - DNA, 25 bp, Artificial sequence
  Synthetic oligonucleotide
gatacgccattcattgatattcgct

SEQ ID NO: 677646 - DNA, 25 bp, Artificial sequence
  Synthetic oligonucleotide
ccattcattgatattcgcttcgtgg

SEQ ID NO: 677647 - DNA, 25 bp, Artificial sequence
  Synthetic oligonucleotide
attgatattcgcttcgtggacggcg

SEQ ID NO: 677648 - DNA, 25 bp, Artificial sequence
  Synthetic oligonucleotide
tattcgcttcgtggacggcgaccgc

SEQ ID NO: 677649 - DNA, 25 bp, Artificial sequence
  Synthetic oligonucleotide
gcttcgtggacggcgaccgcctgta

SEQ ID NO: 677650 - DNA, 25 bp, Artificial sequence
  Synthetic oligonucleotide
tttcggaagaatgcagcctgggggg

SEQ ID NO: 677651 - DNA, 25 bp, Artificial sequence
  Synthetic oligonucleotide
cagctatgtcgccatggggaggtgg

SEQ ID NO: 677652 - DNA, 25 bp, Artificial sequence
  Synthetic oligonucleotide
aggccgggggtaactggtcgcgctg

SEQ ID NO: 677653 - DNA, 25 bp, Artificial sequence
  Synthetic oligonucleotide
cggtcaccgaaacgctgttttcctg

SEQ ID NO: 677654 - DNA, 25 bp, Artificial sequence
  Synthetic oligonucleotide
aacgctgttttcctggtacggctat

SEQ ID NO: 677655 - DNA, 25 bp, Artificial sequence
  Synthetic oligonucleotide
gttttcctggtacggctatgacacc

SEQ ID NO: 677656 - DNA, 25 bp, Artificial sequence
  Synthetic oligonucleotide
ctggtacggctatgacaccgccagc

SEQ ID NO: 677657 - DNA, 25 bp, Artificial sequence
  Synthetic oligonucleotide
acggctatgacaccgccagcgtggc

SEQ ID NO: 677658 - DNA, 25 bp, Artificial sequence
  Synthetic oligonucleotide
tatgacaccgccagcgtggccagcg

SEQ ID NO: 677659 - DNA, 25 bp, Artificial sequence
  Synthetic oligonucleotide
accgccagcgtggccagcgggatgg

SEQ ID NO: 677660 - DNA, 25 bp, Artificial sequence
  Synthetic oligonucleotide
agcgtggccagcgggatggccgcca

SEQ ID NO: 677661 - DNA, 25 bp, Artificial sequence
  Synthetic oligonucleotide
ggccagcgggatggccgccagctat

SEQ ID NO: 677662 - DNA, 25 bp, Artificial sequence
  Synthetic oligonucleotide
agggaacgtctcagcgatgtccagg

SEQ ID NO: 677663 - DNA, 25 bp, Artificial sequence
  Synthetic oligonucleotide
gccgccagctatgtcgccatgggga

SEQ ID NO: 677664 - DNA, 25 bp, Artificial sequence
  Synthetic oligonucleotide
cctgacagggaacgtctcagcgatg

SEQ ID NO: 677665 - DNA, 25 bp, Artificial sequence
  Synthetic oligonucleotide
tgtcgccatggggaggtggaattga

SEQ ID NO: 677666 - DNA, 25 bp, Artificial sequence
  Synthetic oligonucleotide
catggggaggtggaattgatgaagc

SEQ ID NO: 677667 - DNA, 25 bp, Artificial sequence
  Synthetic oligonucleotide
gaggtggaattgatgaagctgttgt

SEQ ID NO: 677668 - DNA, 25 bp, Artificial sequence
  Synthetic oligonucleotide
gaattgatgaagctgttgttgaaac

SEQ ID NO: 677669 - DNA, 25 bp, Artificial sequence
  Synthetic oligonucleotide
atgaagctgttgttgaaacctttgt

SEQ ID NO: 677670 - DNA, 25 bp, Artificial sequence
  Synthetic oligonucleotide
ctgttgttgaaacctttgttgcagc

SEQ ID NO: 677671 - DNA, 25 bp, Artificial sequence
  Synthetic oligonucleotide
ttgaaacctttgttgcagcagggca

SEQ ID NO: 677672 - DNA, 25 bp, Artificial sequence
  Synthetic oligonucleotide
cctttgttgcagcagggcatcacgc

SEQ ID NO: 677673 - DNA, 25 bp, Artificial sequence
  Synthetic oligonucleotide
ttgcagcagggcatcacgcctgaca

SEQ ID NO: 677674 - DNA, 25 bp, Artificial sequence
  Synthetic oligonucleotide
cagggcatcacgcctgacagggaac

SEQ ID NO: 677675 - DNA, 25 bp, Artificial sequence
  Synthetic oligonucleotide
ttcgacgatgtcggtcaccgaaacg

SEQ ID NO: 677676 - DNA, 25 bp, Artificial sequence
  Synthetic oligonucleotide
gggatggccgccagctatgtcgcca

SEQ ID NO: 677677 - DNA, 25 bp, Artificial sequence
  Synthetic oligonucleotide
ttccgcgacatcaacaaccagtggg

SEQ ID NO: 677678 - DNA, 25 bp, Artificial sequence
  Synthetic oligonucleotide
ggtgcgaccgctagcggccaagttt

SEQ ID NO: 677679 - DNA, 25 bp, Artificial sequence
  Synthetic oligonucleotide
accgctagcggccaagtttatgcgg

SEQ ID NO: 677680 - DNA, 25 bp, Artificial sequence
  Synthetic oligonucleotide
agcggccaagtttatgcggttgtcc

SEQ ID NO: 677681 - DNA, 25 bp, Artificial sequence
  Synthetic oligonucleotide
caagtttatgcggttgtcccaatac

SEQ ID NO: 677682 - DNA, 25 bp, Artificial sequence
  Synthetic oligonucleotide
tatgcggttgtcccaatacatggtt

SEQ ID NO: 677683 - DNA, 25 bp, Artificial sequence
  Synthetic oligonucleotide
gttgtcccaatacatggttattcaa

SEQ ID NO: 677684 - DNA, 25 bp, Artificial sequence
  Synthetic oligonucleotide
ccaatacatggttattcaaaaaact

SEQ ID NO: 677685 - DNA, 25 bp, Artificial sequence
  Synthetic oligonucleotide
catggttattcaaaaaacttggcag

SEQ ID NO: 677686 - DNA, 25 bp, Artificial sequence
  Synthetic oligonucleotide
tattcaaaaaacttggcagaccaat

SEQ ID NO: 677687 - DNA, 25 bp, Artificial sequence
  Synthetic oligonucleotide
aaaaacttggcagaccaattccgcg

SEQ ID NO: 677688 - DNA, 25 bp, Artificial sequence
  Synthetic oligonucleotide
acgggccagcaggcgcaggccgaca

SEQ ID NO: 677689 - DNA, 25 bp, Artificial sequence
  Synthetic oligonucleotide
gaccaattccgcgacatcaacaacc

SEQ ID NO: 677690 - DNA, 25 bp, Artificial sequence
  Synthetic oligonucleotide
tcaagcccaattatcagggtgcgac

SEQ ID NO: 677691 - DNA, 25 bp, Artificial sequence
  Synthetic oligonucleotide
gacatcaacaaccagtggggggcca

SEQ ID NO: 677692 - DNA, 25 bp, Artificial sequence
  Synthetic oligonucleotide
caacaaccagtggggggccaccctg

SEQ ID NO: 677693 - DNA, 25 bp, Artificial sequence
  Synthetic oligonucleotide
ccagtggggggccaccctggcaggg

SEQ ID NO: 677694 - DNA, 25 bp, Artificial sequence
  Synthetic oligonucleotide
gggggccaccctggcagggatcaaa

SEQ ID NO: 677695 - DNA, 25 bp, Artificial sequence
  Synthetic oligonucleotide
caccctggcagggatcaaaccctgg

SEQ ID NO: 677696 - DNA, 25 bp, Artificial sequence
  Synthetic oligonucleotide
ggcagggatcaaaccctgggcggtg

SEQ ID NO: 677697 - DNA, 25 bp, Artificial sequence
  Synthetic oligonucleotide
ggatcaaaccctgggcggtgtcctc

SEQ ID NO: 677698 - DNA, 25 bp, Artificial sequence
  Synthetic oligonucleotide
cctgggcggtgtcctcgacgggcca

SEQ ID NO: 677699 - DNA, 25 bp, Artificial sequence
  Synthetic oligonucleotide
gcggtgtcctcgacgggccagcagg

SEQ ID NO: 677700 - DNA, 25 bp, Artificial sequence
  Synthetic oligonucleotide
tggtcgcgctgggtgttgcagtaca

SEQ ID NO: 677701 - DNA, 25 bp, Artificial sequence
  Synthetic oligonucleotide
ttggcagaccaattccgcgacatca

SEQ ID NO: 677702 - DNA, 25 bp, Artificial sequence
  Synthetic oligonucleotide
cgttccgtggccctgacggccggtg

SEQ ID NO: 677703 - DNA, 25 bp, Artificial sequence
  Synthetic oligonucleotide
ccgccgccggcgctggcctacctgc

SEQ ID NO: 677704 - DNA, 25 bp, Artificial sequence
  Synthetic oligonucleotide
ctgaattccgaagcggtgttaggaa

SEQ ID NO: 677705 - DNA, 25 bp, Artificial sequence
  Synthetic oligonucleotide
tccgaagcggtgttaggaaacgcta

SEQ ID NO: 677706 - DNA, 25 bp, Artificial sequence
  Synthetic oligonucleotide
gcggtgttaggaaacgctactgatt

SEQ ID NO: 677707 - DNA, 25 bp, Artificial sequence
  Synthetic oligonucleotide
ttaggaaacgctactgattttatcg

SEQ ID NO: 677708 - DNA, 25 bp, Artificial sequence
  Synthetic oligonucleotide
aacgctactgattttatcgccaatg

SEQ ID NO: 677709 - DNA, 25 bp, Artificial sequence
  Synthetic oligonucleotide
tactgattttatcgccaatgtgcga

SEQ ID NO: 677710 - DNA, 25 bp, Artificial sequence
  Synthetic oligonucleotide
ttttatcgccaatgtgcgaaccggc

SEQ ID NO: 677711 - DNA, 25 bp, Artificial sequence
  Synthetic oligonucleotide
cgccaatgtgcgaaccggcgatgcg

SEQ ID NO: 677712 - DNA, 25 bp, Artificial sequence
  Synthetic oligonucleotide
atgtgcgaaccggcgatgcgttccg

SEQ ID NO: 677713 - DNA, 25 bp, Artificial sequence
  Synthetic oligonucleotide
tatcagggtgcgaccgctagcggcc

SEQ ID NO: 677714 - DNA, 25 bp, Artificial sequence
  Synthetic oligonucleotide
gcgatgcgttccgtggccctgacgg

SEQ ID NO: 677715 - DNA, 25 bp, Artificial sequence
  Synthetic oligonucleotide
ccaattatcagggtgcgaccgctag

SEQ ID NO: 677716 - DNA, 25 bp, Artificial sequence
  Synthetic oligonucleotide
gtggccctgacggccggtggtacga

SEQ ID NO: 677717 - DNA, 25 bp, Artificial sequence
  Synthetic oligonucleotide
ctgacggccggtggtacgaaatcac

SEQ ID NO: 677718 - DNA, 25 bp, Artificial sequence
  Synthetic oligonucleotide
gccggtggtacgaaatcaccaatgt

SEQ ID NO: 677719 - DNA, 25 bp, Artificial sequence
  Synthetic oligonucleotide
ggtacgaaatcaccaatgtgaccag

SEQ ID NO: 677720 - DNA, 25 bp, Artificial sequence
  Synthetic oligonucleotide
aaatcaccaatgtgaccagtgcaac

SEQ ID NO: 677721 - DNA, 25 bp, Artificial sequence
  Synthetic oligonucleotide
ccaatgtgaccagtgcaacggttat

SEQ ID NO: 677722 - DNA, 25 bp, Artificial sequence
  Synthetic oligonucleotide
tgaccagtgcaacggttatttctat

SEQ ID NO: 677723 - DNA, 25 bp, Artificial sequence
  Synthetic oligonucleotide
gtgcaacggttatttctatcaagcc

SEQ ID NO: 677724 - DNA, 25 bp, Artificial sequence
  Synthetic oligonucleotide
cggttatttctatcaagcccaatta

SEQ ID NO: 677725 - DNA, 25 bp, Artificial sequence
  Synthetic oligonucleotide
tttctatcaagcccaattatcaggg

SEQ ID NO: 677726 - DNA, 25 bp, Artificial sequence
  Synthetic oligonucleotide
agcaggcgcaggccgacatgggaat

SEQ ID NO: 677727 - DNA, 25 bp, Artificial sequence
  Synthetic oligonucleotide
cgaaccggcgatgcgttccgtggcc

SEQ ID NO: 677728 - DNA, 25 bp, Artificial sequence
  Synthetic oligonucleotide
ccagacttcgccgtccagcagtggt

SEQ ID NO: 677729 - DNA, 25 bp, Artificial sequence
  Synthetic oligonucleotide
acgctcatggcacggcggtgccttc

SEQ ID NO: 677730 - DNA, 25 bp, Artificial sequence
  Synthetic oligonucleotide
atggcacggcggtgccttcgccggt

SEQ ID NO: 677731 - DNA, 25 bp, Artificial sequence
  Synthetic oligonucleotide
cggcggtgccttcgccggtgaacaa

SEQ ID NO: 677732 - DNA, 25 bp, Artificial sequence
  Synthetic oligonucleotide
tgccttcgccggtgaacaatgccca

SEQ ID NO: 677733 - DNA, 25 bp, Artificial sequence
  Synthetic oligonucleotide
cgccggtgaacaatgcccagggcta

SEQ ID NO: 677734 - DNA, 25 bp, Artificial sequence
  Synthetic oligonucleotide
tgaacaatgcccagggctatgtctt

SEQ ID NO: 677735 - DNA, 25 bp, Artificial sequence
  Synthetic oligonucleotide
atgcccagggctatgtcttgcatat

SEQ ID NO: 677736 - DNA, 25 bp, Artificial sequence
  Synthetic oligonucleotide
agggctatgtcttgcatatgcagca

SEQ ID NO: 677737 - DNA, 25 bp, Artificial sequence
  Synthetic oligonucleotide
atgtcttgcatatgcagcacggcaa

SEQ ID NO: 677738 - DNA, 25 bp, Artificial sequence
  Synthetic oligonucleotide
tgcatatgcagcacggcaacccaga

SEQ ID NO: 677739 - DNA, 25 bp, Artificial sequence
  Synthetic oligonucleotide
tcctcgacgggccagcaggcgcagg

SEQ ID NO: 677740 - DNA, 25 bp, Artificial sequence
  Synthetic oligonucleotide
cggcaacccagacttcgccgtccag

SEQ ID NO: 677741 - DNA, 25 bp, Artificial sequence
  Synthetic oligonucleotide
tgaccgtctcggggctatacgctca

SEQ ID NO: 677742 - DNA, 25 bp, Artificial sequence
  Synthetic oligonucleotide
ttcgccgtccagcagtggtaccagt

SEQ ID NO: 677743 - DNA, 25 bp, Artificial sequence
  Synthetic oligonucleotide
gtccagcagtggtaccagttgaatt

SEQ ID NO: 677744 - DNA, 25 bp, Artificial sequence
  Synthetic oligonucleotide
cagtggtaccagttgaattccgcca

SEQ ID NO: 677745 - DNA, 25 bp, Artificial sequence
  Synthetic oligonucleotide
taccagttgaattccgccactggcc

SEQ ID NO: 677746 - DNA, 25 bp, Artificial sequence
  Synthetic oligonucleotide
ttgaattccgccactggccagtaca

SEQ ID NO: 677747 - DNA, 25 bp, Artificial sequence
  Synthetic oligonucleotide
tccgccactggccagtacatgcgga

SEQ ID NO: 677748 - DNA, 25 bp, Artificial sequence
  Synthetic oligonucleotide
actggccagtacatgcggatcaagg

SEQ ID NO: 677749 - DNA, 25 bp, Artificial sequence
  Synthetic oligonucleotide
ccagtacatgcggatcaaggccggg

SEQ ID NO: 677750 - DNA, 25 bp, Artificial sequence
  Synthetic oligonucleotide
catgcggatcaaggccgggggtaac

SEQ ID NO: 677751 - DNA, 25 bp, Artificial sequence
  Synthetic oligonucleotide
cgcctgtacctgcactacatccacc

SEQ ID NO: 677752 - DNA, 25 bp, Artificial sequence
  Synthetic oligonucleotide
gcagcacggcaacccagacttcgcc

SEQ ID NO: 677753 - DNA, 25 bp, Artificial sequence
  Synthetic oligonucleotide
ggggcgtcgcgcccaatcagatggg

SEQ ID NO: 677754 - DNA, 25 bp, Artificial sequence
  Synthetic oligonucleotide
cgcaggccgacatgggaatctcggc

SEQ ID NO: 677755 - DNA, 25 bp, Artificial sequence
  Synthetic oligonucleotide
ccgacatgggaatctcggctgttgg

SEQ ID NO: 677756 - DNA, 25 bp, Artificial sequence
  Synthetic oligonucleotide
tgggaatctcggctgttggtcgggc

SEQ ID NO: 677757 - DNA, 25 bp, Artificial sequence
  Synthetic oligonucleotide
tctcggctgttggtcgggccctgaa

SEQ ID NO: 677758 - DNA, 25 bp, Artificial sequence
  Synthetic oligonucleotide
tgttggtcgggccctgaacaatgct

SEQ ID NO: 677759 - DNA, 25 bp, Artificial sequence
  Synthetic oligonucleotide
tcgggccctgaacaatgcttcgacg

SEQ ID NO: 677760 - DNA, 25 bp, Artificial sequence
  Synthetic oligonucleotide
ctgaacaatgcttcgacgccggcca

SEQ ID NO: 677761 - DNA, 25 bp, Artificial sequence
  Synthetic oligonucleotide
aatgcttcgacgccggccaacgcct

SEQ ID NO: 677762 - DNA, 25 bp, Artificial sequence
  Synthetic oligonucleotide
tcgacgccggccaacgccttgagtt

SEQ ID NO: 677763 - DNA, 25 bp, Artificial sequence
  Synthetic oligonucleotide
ccggccaacgccttgagttacctgg

SEQ ID NO: 677764 - DNA, 25 bp, Artificial sequence
  Synthetic oligonucleotide
ggctatacgctcatggcacggcggt

SEQ ID NO: 677765 - DNA, 25 bp, Artificial sequence
  Synthetic oligonucleotide
tacctggggggcgtcgcgcccaatc

SEQ ID NO: 677766 - DNA, 25 bp, Artificial sequence
  Synthetic oligonucleotide
tctcggggctatacgctcatggcac

SEQ ID NO: 677767 - DNA, 25 bp, Artificial sequence
  Synthetic oligonucleotide
tcgcgcccaatcagatgggctgggc

SEQ ID NO: 677768 - DNA, 25 bp, Artificial sequence
  Synthetic oligonucleotide
ccaatcagatgggctgggctggcaa

SEQ ID NO: 677769 - DNA, 25 bp, Artificial sequence
  Synthetic oligonucleotide
agatgggctgggctggcaacgcgat

SEQ ID NO: 677770 - DNA, 25 bp, Artificial sequence
  Synthetic oligonucleotide
gctgggctggcaacgcgatgaatac

SEQ ID NO: 677771 - DNA, 25 bp, Artificial sequence
  Synthetic oligonucleotide
ctggcaacgcgatgaatacggcgga

SEQ ID NO: 677772 - DNA, 25 bp, Artificial sequence
  Synthetic oligonucleotide
acgcgatgaatacggcggacctcga

SEQ ID NO: 677773 - DNA, 25 bp, Artificial sequence
  Synthetic oligonucleotide
tgaatacggcggacctcgattcgct

SEQ ID NO: 677774 - DNA, 25 bp, Artificial sequence
  Synthetic oligonucleotide
cggcggacctcgattcgctgaccgt

SEQ ID NO: 677775 - DNA, 25 bp, Artificial sequence
  Synthetic oligonucleotide
acctcgattcgctgaccgtctcggg

SEQ ID NO: 677776 - DNA, 25 bp, Artificial sequence
  Synthetic oligonucleotide
attcgctgaccgtctcggggctata

SEQ ID NO: 677777 - DNA, 25 bp, Artificial sequence
  Synthetic oligonucleotide
gggtaactggtcgcgctgggtgttg

SEQ ID NO: 677778 - DNA, 25 bp, Artificial sequence
  Synthetic oligonucleotide
cttgagttacctggggggcgtcgcg

SEQ ID NO: 677779 - DNA, 25 bp, Artificial sequence
  Synthetic oligonucleotide
aagacccaagcacccatggccctgg

SEQ ID NO: 677780 - DNA, 25 bp, Artificial sequence
  Synthetic oligonucleotide
gatcaccgaagttggccgtgctatc

SEQ ID NO: 677781 - DNA, 25 bp, Artificial sequence
  Synthetic oligonucleotide
cgaagttggccgtgctatcaatgga

SEQ ID NO: 677782 - DNA, 25 bp, Artificial sequence
  Synthetic oligonucleotide
tggccgtgctatcaatggagcctct

SEQ ID NO: 677783 - DNA, 25 bp, Artificial sequence
  Synthetic oligonucleotide
tgctatcaatggagcctctaccgta

SEQ ID NO: 677784 - DNA, 25 bp, Artificial sequence
  Synthetic oligonucleotide
caatggagcctctaccgtaggcaat

SEQ ID NO: 677785 - DNA, 25 bp, Artificial sequence
  Synthetic oligonucleotide
agcctctaccgtaggcaatgcattg

SEQ ID NO: 677786 - DNA, 25 bp, Artificial sequence
  Synthetic oligonucleotide
taccgtaggcaatgcattggggttc

SEQ ID NO: 677787 - DNA, 25 bp, Artificial sequence
  Synthetic oligonucleotide
aggcaatgcattggggttcttggga

SEQ ID NO: 677788 - DNA, 25 bp, Artificial sequence
  Synthetic oligonucleotide
tgcattggggttcttgggaggtgtt

SEQ ID NO: 677789 - DNA, 25 bp, Artificial sequence
  Synthetic oligonucleotide
tcttgggaggtgtttccaagaccca

SEQ ID NO: 677790 - DNA, 25 bp, Artificial sequence
  Synthetic oligonucleotide
atacttacaacgtgcctcttggaaa

SEQ ID NO: 677791 - DNA, 25 bp, Artificial sequence
  Synthetic oligonucleotide
gtttccaagacccaagcacccatgg

SEQ ID NO: 677792 - DNA, 25 bp, Artificial sequence
  Synthetic oligonucleotide
aggcgcaggctgacatggggatcac

SEQ ID NO: 677793 - DNA, 25 bp, Artificial sequence
  Synthetic oligonucleotide
caagcacccatggccctggatatgg

SEQ ID NO: 677794 - DNA, 25 bp, Artificial sequence
  Synthetic oligonucleotide
cccatggccctggatatggacacgg

SEQ ID NO: 677795 - DNA, 25 bp, Artificial sequence
  Synthetic oligonucleotide
gccctggatatggacacggtgaacg

SEQ ID NO: 677796 - DNA, 25 bp, Artificial sequence
  Synthetic oligonucleotide
gatatggacacggtgaacgaaagcg

SEQ ID NO: 677797 - DNA, 25 bp, Artificial sequence
  Synthetic oligonucleotide
gacacggtgaacgaaagcggatggt

SEQ ID NO: 677798 - DNA, 25 bp, Artificial sequence
  Synthetic oligonucleotide
tgaacgaaagcggatggttctcgat

SEQ ID NO: 677799 - DNA, 25 bp, Artificial sequence
  Synthetic oligonucleotide
gaaagcggatggttctcgataaccc

SEQ ID NO: 677800 - DNA, 25 bp, Artificial sequence
  Synthetic oligonucleotide
ggatggttctcgataacccccaata

SEQ ID NO: 677801 - DNA, 25 bp, Artificial sequence
  Synthetic oligonucleotide
ttctcgataacccccaatacttaca

SEQ ID NO: 677802 - DNA, 25 bp, Artificial sequence
  Synthetic oligonucleotide
taccgccaacggccaggcatattcg

SEQ ID NO: 677803 - DNA, 25 bp, Artificial sequence
  Synthetic oligonucleotide
ggaggtgtttccaagacccaagcac

SEQ ID NO: 677804 - DNA, 25 bp, Artificial sequence
  Synthetic oligonucleotide
agcaatcaatggggttccctcctgg

SEQ ID NO: 677805 - DNA, 25 bp, Artificial sequence
  Synthetic oligonucleotide
gtggacggcgaccgcctgtacctgc

SEQ ID NO: 677806 - DNA, 25 bp, Artificial sequence
  Synthetic oligonucleotide
caggcatattcgatcaccccggtgc

SEQ ID NO: 677807 - DNA, 25 bp, Artificial sequence
  Synthetic oligonucleotide
tattcgatcaccccggtgcaggggt

SEQ ID NO: 677808 - DNA, 25 bp, Artificial sequence
  Synthetic oligonucleotide
atcaccccggtgcaggggtactcga

SEQ ID NO: 677809 - DNA, 25 bp, Artificial sequence
  Synthetic oligonucleotide
ccggtgcaggggtactcgaagacac

SEQ ID NO: 677810 - DNA, 25 bp, Artificial sequence
  Synthetic oligonucleotide
caggggtactcgaagacactggcgg

SEQ ID NO: 677811 - DNA, 25 bp, Artificial sequence
  Synthetic oligonucleotide
tactcgaagacactggcggatcagt

SEQ ID NO: 677812 - DNA, 25 bp, Artificial sequence
  Synthetic oligonucleotide
aagacactggcggatcagttccgtg

SEQ ID NO: 677813 - DNA, 25 bp, Artificial sequence
  Synthetic oligonucleotide
ctggcggatcagttccgtgacctca

SEQ ID NO: 677814 - DNA, 25 bp, Artificial sequence
  Synthetic oligonucleotide
gatcagttccgtgacctcagcaatc

SEQ ID NO: 677815 - DNA, 25 bp, Artificial sequence
  Synthetic oligonucleotide
catggggatcaccgaagttggccgt

SEQ ID NO: 677816 - DNA, 25 bp, Artificial sequence
  Synthetic oligonucleotide
gacctcagcaatcaatggggttccc

SEQ ID NO: 677817 - DNA, 25 bp, Artificial sequence
  Synthetic oligonucleotide
ggctgacatggggatcaccgaagtt

SEQ ID NO: 677818 - DNA, 25 bp, Artificial sequence
  Synthetic oligonucleotide
aatggggttccctcctggcggcagt

SEQ ID NO: 677819 - DNA, 25 bp, Artificial sequence
  Synthetic oligonucleotide
ggttccctcctggcggcagtgaagc

SEQ ID NO: 677820 - DNA, 25 bp, Artificial sequence
  Synthetic oligonucleotide
cctcctggcggcagtgaagccttgg

SEQ ID NO: 677821 - DNA, 25 bp, Artificial sequence
  Synthetic oligonucleotide
ggcggcagtgaagccttgggcgata

SEQ ID NO: 677822 - DNA, 25 bp, Artificial sequence
  Synthetic oligonucleotide
agtgaagccttgggcgatagcgtct

SEQ ID NO: 677823 - DNA, 25 bp, Artificial sequence
  Synthetic oligonucleotide
gccttgggcgatagcgtctaccggt

SEQ ID NO: 677824 - DNA, 25 bp, Artificial sequence
  Synthetic oligonucleotide
ggcgatagcgtctaccggttcgcag

SEQ ID NO: 677825 - DNA, 25 bp, Artificial sequence
  Synthetic oligonucleotide
tagcgtctaccggttcgcaggcgca

SEQ ID NO: 677826 - DNA, 25 bp, Artificial sequence
  Synthetic oligonucleotide
ctaccggttcgcaggcgcaggctga

SEQ ID NO: 677827 - DNA, 25 bp, Artificial sequence
  Synthetic oligonucleotide
gttcgcaggcgcaggctgacatggg

SEQ ID NO: 677828 - DNA, 25 bp, Artificial sequence
  Synthetic oligonucleotide
acaacgtgcctcttggaaacaacaa

SEQ ID NO: 677829 - DNA, 25 bp, Artificial sequence
  Synthetic oligonucleotide
ttccgtgacctcagcaatcaatggg

SEQ ID NO: 677830 - DNA, 25 bp, Artificial sequence
  Synthetic oligonucleotide
gagcgggacaacttccaacggctgg

SEQ ID NO: 677831 - DNA, 25 bp, Artificial sequence
  Synthetic oligonucleotide
tacgacagacaatatcgtggggagc

SEQ ID NO: 677832 - DNA, 25 bp, Artificial sequence
  Synthetic oligonucleotide
agacaatatcgtggggagcgtaacg

SEQ ID NO: 677833 - DNA, 25 bp, Artificial sequence
  Synthetic oligonucleotide
tatcgtggggagcgtaacgaggcga

SEQ ID NO: 677834 - DNA, 25 bp, Artificial sequence
  Synthetic oligonucleotide
gggagcgtaacgaggcgacttgtca

SEQ ID NO: 677835 - DNA, 25 bp, Artificial sequence
  Synthetic oligonucleotide
gtaacgaggcgacttgtcacaggta

SEQ ID NO: 677836 - DNA, 25 bp, Artificial sequence
  Synthetic oligonucleotide
aggcgacttgtcacaggtaagccca

SEQ ID NO: 677837 - DNA, 25 bp, Artificial sequence
  Synthetic oligonucleotide
acttgtcacaggtaagcccaccggg

SEQ ID NO: 677838 - DNA, 25 bp, Artificial sequence
  Synthetic oligonucleotide
cacaggtaagcccaccggggccgtg

SEQ ID NO: 677839 - DNA, 25 bp, Artificial sequence
  Synthetic oligonucleotide
taagcccaccggggccgtgatggag

SEQ ID NO: 677840 - DNA, 25 bp, Artificial sequence
  Synthetic oligonucleotide
ccaccggggccgtgatggagagcgg

SEQ ID NO: 677841 - DNA, 25 bp, Artificial sequence
  Synthetic oligonucleotide
cccccaatacttacaacgtgcctct

SEQ ID NO: 677842 - DNA, 25 bp, Artificial sequence
  Synthetic oligonucleotide
gatggagagcgggacaacttccaac

SEQ ID NO: 677843 - DNA, 25 bp, Artificial sequence
  Synthetic oligonucleotide
ggagtgggtcaggttttatacgaca

SEQ ID NO: 677844 - DNA, 25 bp, Artificial sequence
  Synthetic oligonucleotide
caacttccaacggctggtacgttcg

SEQ ID NO: 677845 - DNA, 25 bp, Artificial sequence
  Synthetic oligonucleotide
ccaacggctggtacgttcgctttgc

SEQ ID NO: 677846 - DNA, 25 bp, Artificial sequence
  Synthetic oligonucleotide
gctggtacgttcgctttgcggatgg

SEQ ID NO: 677847 - DNA, 25 bp, Artificial sequence
  Synthetic oligonucleotide
tacgttcgctttgcggatggtaccc

SEQ ID NO: 677848 - DNA, 25 bp, Artificial sequence
  Synthetic oligonucleotide
cgctttgcggatggtacccagatgg

SEQ ID NO: 677849 - DNA, 25 bp, Artificial sequence
  Synthetic oligonucleotide
gcggatggtacccagatggcagcgg

SEQ ID NO: 677850 - DNA, 25 bp, Artificial sequence
  Synthetic oligonucleotide
gtacccagatggcagcggcaagatc

SEQ ID NO: 677851 - DNA, 25 bp, Artificial sequence
  Synthetic oligonucleotide
agatggcagcggcaagatccgaacc

SEQ ID NO: 677852 - DNA, 25 bp, Artificial sequence
  Synthetic oligonucleotide
cagcggcaagatccgaaccgggcct

SEQ ID NO: 677853 - DNA, 25 bp, Artificial sequence
  Synthetic oligonucleotide
ggcctttcgtttggagctaacgtga

SEQ ID NO: 677854 - DNA, 25 bp, Artificial sequence
  Synthetic oligonucleotide
gggccgtgatggagagcgggacaac

SEQ ID NO: 677855 - DNA, 25 bp, Artificial sequence
  Synthetic oligonucleotide
cgctatcagctgttctttgtgagaa

SEQ ID NO: 677856 - DNA, 25 bp, Artificial sequence
  Synthetic oligonucleotide
tgcctcttggaaacaacaatatcag

SEQ ID NO: 677857 - DNA, 25 bp, Artificial sequence
  Synthetic oligonucleotide
ttggaaacaacaatatcagcggtgt

SEQ ID NO: 677858 - DNA, 25 bp, Artificial sequence
  Synthetic oligonucleotide
acaacaatatcagcggtgtgaacgg

SEQ ID NO: 677859 - DNA, 25 bp, Artificial sequence
  Synthetic oligonucleotide
atatcagcggtgtgaacggccatgt

SEQ ID NO: 677860 - DNA, 25 bp, Artificial sequence
  Synthetic oligonucleotide
gcggtgtgaacggccatgtcgctct

SEQ ID NO: 677861 - DNA, 25 bp, Artificial sequence
  Synthetic oligonucleotide
tgaacggccatgtcgctctgtcgat

SEQ ID NO: 677862 - DNA, 25 bp, Artificial sequence
  Synthetic oligonucleotide
gccatgtcgctctgtcgatggtatt

SEQ ID NO: 677863 - DNA, 25 bp, Artificial sequence
  Synthetic oligonucleotide
tcgctctgtcgatggtattcgacgc

SEQ ID NO: 677864 - DNA, 25 bp, Artificial sequence
  Synthetic oligonucleotide
tgtcgatggtattcgacgccagtac

SEQ ID NO: 677865 - DNA, 25 bp, Artificial sequence
  Synthetic oligonucleotide
ggtattcgacgccagtacccgctat

SEQ ID NO: 677866 - DNA, 25 bp, Artificial sequence
  Synthetic oligonucleotide
gttttatacgacagacaatatcgtg

SEQ ID NO: 677867 - DNA, 25 bp, Artificial sequence
  Synthetic oligonucleotide
agtacccgctatcagctgttctttg

SEQ ID NO: 677868 - DNA, 25 bp, Artificial sequence
  Synthetic oligonucleotide
ggtcaggttttatacgacagacaat

SEQ ID NO: 677869 - DNA, 25 bp, Artificial sequence
  Synthetic oligonucleotide
cagctgttctttgtgagaaatacca

SEQ ID NO: 677870 - DNA, 25 bp, Artificial sequence
  Synthetic oligonucleotide
ttctttgtgagaaataccaacctcc

SEQ ID NO: 677871 - DNA, 25 bp, Artificial sequence
  Synthetic oligonucleotide
tgtgagaaataccaacctcccggag

SEQ ID NO: 677872 - DNA, 25 bp, Artificial sequence
  Synthetic oligonucleotide
ctcccggaggtttggtacaggagct

SEQ ID NO: 677873 - DNA, 25 bp, Artificial sequence
  Synthetic oligonucleotide
gaggtttggtacaggagctgtacca

SEQ ID NO: 677874 - DNA, 25 bp, Artificial sequence
  Synthetic oligonucleotide
tggtacaggagctgtaccaatggaa

SEQ ID NO: 677875 - DNA, 25 bp, Artificial sequence
  Synthetic oligonucleotide
aggagctgtaccaatggaacctgga

SEQ ID NO: 677876 - DNA, 25 bp, Artificial sequence
  Synthetic oligonucleotide
tgtaccaatggaacctggaaggagt

SEQ ID NO: 677877 - DNA, 25 bp, Artificial sequence
  Synthetic oligonucleotide
aatggaacctggaaggagtgggtca

SEQ ID NO: 677878 - DNA, 25 bp, Artificial sequence
  Synthetic oligonucleotide
ctggaaggagtgggtcaggttttat

SEQ ID NO: 677879 - DNA, 25 bp, Artificial sequence
  Synthetic oligonucleotide
aaggagctaccgccaacggccaggc

SEQ ID NO: 677880 - DNA, 25 bp, Artificial sequence
  Synthetic oligonucleotide
gacgccagtacccgctatcagctgt

SEQ ID NO: 677881 - DNA, 25 bp, Artificial sequence
  Synthetic oligonucleotide
cgctcaagaccgaagccgagttcga

SEQ ID NO: 677882 - DNA, 25 bp, Artificial sequence
  Synthetic oligonucleotide
cggcagatgtgcgcgatcaggcctt

SEQ ID NO: 677883 - DNA, 25 bp, Artificial sequence
  Synthetic oligonucleotide
atgtgcgcgatcaggccttggccag

SEQ ID NO: 677884 - DNA, 25 bp, Artificial sequence
  Synthetic oligonucleotide
gcgatcaggccttggccagcgtgca

SEQ ID NO: 677885 - DNA, 25 bp, Artificial sequence
  Synthetic oligonucleotide
aggccttggccagcgtgcaggccaa

SEQ ID NO: 677886 - DNA, 25 bp, Artificial sequence
  Synthetic oligonucleotide
tggccagcgtgcaggccaagcgcct

SEQ ID NO: 677887 - DNA, 25 bp, Artificial sequence
  Synthetic oligonucleotide
gcgtgcaggccaagcgccttctggc

SEQ ID NO: 677888 - DNA, 25 bp, Artificial sequence
  Synthetic oligonucleotide
aggccaagcgccttctggcctatcg

SEQ ID NO: 677889 - DNA, 25 bp, Artificial sequence
  Synthetic oligonucleotide
gcgccttctggcctatcgggaagaa

SEQ ID NO: 677890 - DNA, 25 bp, Artificial sequence
  Synthetic oligonucleotide
ctggcctatcgggaagaaagcaatc

SEQ ID NO: 677891 - DNA, 25 bp, Artificial sequence
  Synthetic oligonucleotide
tatcgggaagaaagcaatccgctca

SEQ ID NO: 677892 - DNA, 25 bp, Artificial sequence
  Synthetic oligonucleotide
tcgccaaggtggaagagatcaagtc

SEQ ID NO: 677893 - DNA, 25 bp, Artificial sequence
  Synthetic oligonucleotide
agcaatccgctcaagaccgaagccg

SEQ ID NO: 677894 - DNA, 25 bp, Artificial sequence
  Synthetic oligonucleotide
gtcagccctgcaaaggccgcggcag

SEQ ID NO: 677895 - DNA, 25 bp, Artificial sequence
  Synthetic oligonucleotide
agaccgaagccgagttcgatgcgat

SEQ ID NO: 677896 - DNA, 25 bp, Artificial sequence
  Synthetic oligonucleotide
aagccgagttcgatgcgatcaaggc

SEQ ID NO: 677897 - DNA, 25 bp, Artificial sequence
  Synthetic oligonucleotide
agttcgatgcgatcaaggccggcgt

SEQ ID NO: 677898 - DNA, 25 bp, Artificial sequence
  Synthetic oligonucleotide
atgcgatcaaggccggcgtcgagcc

SEQ ID NO: 677899 - DNA, 25 bp, Artificial sequence
  Synthetic oligonucleotide
tcaaggccggcgtcgagccggacta

SEQ ID NO: 677900 - DNA, 25 bp, Artificial sequence
  Synthetic oligonucleotide
ccggcgtcgagccggactatggcgc

SEQ ID NO: 677901 - DNA, 25 bp, Artificial sequence
  Synthetic oligonucleotide
tcgagccggactatggcgcctggat

SEQ ID NO: 677902 - DNA, 25 bp, Artificial sequence
  Synthetic oligonucleotide
cggactatggcgcctggatcgccaa

SEQ ID NO: 677903 - DNA, 25 bp, Artificial sequence
  Synthetic oligonucleotide
atggcgcctggatcgccaaggtgga

SEQ ID NO: 677904 - DNA, 25 bp, Artificial sequence
  Synthetic oligonucleotide
caacggccaggcatattcgatcacc

SEQ ID NO: 677905 - DNA, 25 bp, Artificial sequence
  Synthetic oligonucleotide
gaagaaagcaatccgctcaagaccg

SEQ ID NO: 677906 - DNA, 25 bp, Artificial sequence
  Synthetic oligonucleotide
attccggtcgaccaggatggaaaag

SEQ ID NO: 677907 - DNA, 25 bp, Artificial sequence
  Synthetic oligonucleotide
aggttcggtttccgtcacgctgaat

SEQ ID NO: 677908 - DNA, 25 bp, Artificial sequence
  Synthetic oligonucleotide
tacctgcactacatccaccaggtga

SEQ ID NO: 677909 - DNA, 25 bp, Artificial sequence
  Synthetic oligonucleotide
actacatccaccaggtgacctctga

SEQ ID NO: 677910 - DNA, 25 bp, Artificial sequence
  Synthetic oligonucleotide
tccaccaggtgacctctgaagtgat

SEQ ID NO: 677911 - DNA, 25 bp, Artificial sequence
  Synthetic oligonucleotide
aggtgacctctgaagtgatgatgca

SEQ ID NO: 677912 - DNA, 25 bp, Artificial sequence
  Synthetic oligonucleotide
cctctgaagtgatgatgcagtttcc

SEQ ID NO: 677913 - DNA, 25 bp, Artificial sequence
  Synthetic oligonucleotide
aagtgatgatgcagtttcccaggga

SEQ ID NO: 677914 - DNA, 25 bp, Artificial sequence
  Synthetic oligonucleotide
tgatgcagtttcccagggagatcga

SEQ ID NO: 677915 - DNA, 25 bp, Artificial sequence
  Synthetic oligonucleotide
agtttcccagggagatcgagtcaat

SEQ ID NO: 677916 - DNA, 25 bp, Artificial sequence
  Synthetic oligonucleotide
ccagggagatcgagtcaattccggt

SEQ ID NO: 677917 - DNA, 25 bp, Artificial sequence
  Synthetic oligonucleotide
aaggccgcggcagatgtgcgcgatc

SEQ ID NO: 677918 - DNA, 25 bp, Artificial sequence
  Synthetic oligonucleotide
agtcaattccggtcgaccaggatgg

SEQ ID NO: 677919 - DNA, 25 bp, Artificial sequence
  Synthetic oligonucleotide
cctgcaaaggccgcggcagatgtgc

SEQ ID NO: 677920 - DNA, 25 bp, Artificial sequence
  Synthetic oligonucleotide
tcgaccaggatggaaaagtcgaggt

SEQ ID NO: 677921 - DNA, 25 bp, Artificial sequence
  Synthetic oligonucleotide
aggatggaaaagtcgaggtagcgtt

SEQ ID NO: 677922 - DNA, 25 bp, Artificial sequence
  Synthetic oligonucleotide
gaaaagtcgaggtagcgttcagcta

SEQ ID NO: 677923 - DNA, 25 bp, Artificial sequence
  Synthetic oligonucleotide
tcgaggtagcgttcagctatgaaca

SEQ ID NO: 677924 - DNA, 25 bp, Artificial sequence
  Synthetic oligonucleotide
tagcgttcagctatgaacatccaat

SEQ ID NO: 677925 - DNA, 25 bp, Artificial sequence
  Synthetic oligonucleotide
tcagctatgaacatccaatgggata

SEQ ID NO: 677926 - DNA, 25 bp, Artificial sequence
  Synthetic oligonucleotide
atgaacatccaatgggataagtacg

SEQ ID NO: 677927 - DNA, 25 bp, Artificial sequence
  Synthetic oligonucleotide
atccaatgggataagtacgtcagcc

SEQ ID NO: 677928 - DNA, 25 bp, Artificial sequence
  Synthetic oligonucleotide
tgggataagtacgtcagccctgcaa

SEQ ID NO: 677929 - DNA, 25 bp, Artificial sequence
  Synthetic oligonucleotide
aagtacgtcagccctgcaaaggccg

SEQ ID NO: 677930 - DNA, 25 bp, Artificial sequence
  Synthetic oligonucleotide
aggtggaagagatcaagtcacgata

SEQ ID NO: 677931 - DNA, 25 bp, Artificial sequence
  Synthetic oligonucleotide
agatcgagtcaattccggtcgacca

SEQ ID NO: 677932 - DNA, 25 bp, Artificial sequence
  Synthetic oligonucleotide
atggccgctggtacgagatcggcaa

SEQ ID NO: 677933 - DNA, 25 bp, Artificial sequence
  Synthetic oligonucleotide
tcggacacggtgaccggcagcggca

SEQ ID NO: 677934 - DNA, 25 bp, Artificial sequence
  Synthetic oligonucleotide
acggtgaccggcagcggcaccgcct

SEQ ID NO: 677935 - DNA, 25 bp, Artificial sequence
  Synthetic oligonucleotide
accggcagcggcaccgccttcagcg

SEQ ID NO: 677936 - DNA, 25 bp, Artificial sequence
  Synthetic oligonucleotide
agcggcaccgccttcagcgccaatg

SEQ ID NO: 677937 - DNA, 25 bp, Artificial sequence
  Synthetic oligonucleotide
accgccttcagcgccaatgcgcgcg

SEQ ID NO: 677938 - DNA, 25 bp, Artificial sequence
  Synthetic oligonucleotide
ttcagcgccaatgcgcgcgccggcg

SEQ ID NO: 677939 - DNA, 25 bp, Artificial sequence
  Synthetic oligonucleotide
gccaatgcgcgcgccggcgatgcct

SEQ ID NO: 677940 - DNA, 25 bp, Artificial sequence
  Synthetic oligonucleotide
cgcgcgccggcgatgccttcagagg

SEQ ID NO: 677941 - DNA, 25 bp, Artificial sequence
  Synthetic oligonucleotide
ccggcgatgccttcagagggccgga

SEQ ID NO: 677942 - DNA, 25 bp, Artificial sequence
  Synthetic oligonucleotide
atgccttcagagggccggatggccg

SEQ ID NO: 677943 - DNA, 25 bp, Artificial sequence
  Synthetic oligonucleotide
cctggatcgccaaggtggaagagat

SEQ ID NO: 677944 - DNA, 25 bp, Artificial sequence
  Synthetic oligonucleotide
ggccggatggccgctggtacgagat

SEQ ID NO: 677945 - DNA, 25 bp, Artificial sequence
  Synthetic oligonucleotide
cacaggcacggtttccgtcgtcctt

SEQ ID NO: 677946 - DNA, 25 bp, Artificial sequence
  Synthetic oligonucleotide
gctggtacgagatcggcaacgttgc

SEQ ID NO: 677947 - DNA, 25 bp, Artificial sequence
  Synthetic oligonucleotide
acgagatcggcaacgttgccagcgc

SEQ ID NO: 677948 - DNA, 25 bp, Artificial sequence
  Synthetic oligonucleotide
tcggcaacgttgccagcgccactgt

SEQ ID NO: 677949 - DNA, 25 bp, Artificial sequence
  Synthetic oligonucleotide
acgttgccagcgccactgtgctgac

SEQ ID NO: 677950 - DNA, 25 bp, Artificial sequence
  Synthetic oligonucleotide
ccagcgccactgtgctgaccatcaa

SEQ ID NO: 677951 - DNA, 25 bp, Artificial sequence
  Synthetic oligonucleotide
ccactgtgctgaccatcaagcccgc

SEQ ID NO: 677952 - DNA, 25 bp, Artificial sequence
  Synthetic oligonucleotide
tgctgaccatcaagcccgcatatca

SEQ ID NO: 677953 - DNA, 25 bp, Artificial sequence
  Synthetic oligonucleotide
ccatcaagcccgcatatcaaggagc

SEQ ID NO: 677954 - DNA, 25 bp, Artificial sequence
  Synthetic oligonucleotide
agcccgcatatcaaggagctaccgc

SEQ ID NO: 677955 - DNA, 25 bp, Artificial sequence
  Synthetic oligonucleotide
catatcaaggagctaccgccaacgg

SEQ ID NO: 677956 - DNA, 25 bp, Artificial sequence
  Synthetic oligonucleotide
tcagagggccggatggccgctggta

SEQ ID NO: 677957 - DNA, 25 bp, Artificial sequence
  Synthetic oligonucleotide
actaaccctatcaagcccgccgact

SEQ ID NO: 677958 - DNA, 25 bp, Artificial sequence
  Synthetic oligonucleotide
aagagatcaagtcacgatacccgat

SEQ ID NO: 677959 - DNA, 25 bp, Artificial sequence
  Synthetic oligonucleotide
tcaagtcacgatacccgatgcctga

SEQ ID NO: 677960 - DNA, 25 bp, Artificial sequence
  Synthetic oligonucleotide
cacgatacccgatgcctgaatagcc

SEQ ID NO: 677961 - DNA, 25 bp, Artificial sequence
  Synthetic oligonucleotide
acccgatgcctgaatagccgaactc

SEQ ID NO: 677962 - DNA, 25 bp, Artificial sequence
  Synthetic oligonucleotide
tgcctgaatagccgaactccaggct

SEQ ID NO: 677963 - DNA, 25 bp, Artificial sequence
  Synthetic oligonucleotide
aatagccgaactccaggctcgcctg

SEQ ID NO: 677964 - DNA, 25 bp, Artificial sequence
  Synthetic oligonucleotide
gaactccaggctcgcctgggcgtca

SEQ ID NO: 677965 - DNA, 25 bp, Artificial sequence
  Synthetic oligonucleotide
caggctcgcctgggcgtcagccctg

SEQ ID NO: 677966 - DNA, 25 bp, Artificial sequence
  Synthetic oligonucleotide
cgcctgggcgtcagccctgtggttc

SEQ ID NO: 677967 - DNA, 25 bp, Artificial sequence
  Synthetic oligonucleotide
ggcgtcagccctgtggttccgaact

SEQ ID NO: 677968 - DNA, 25 bp, Artificial sequence
  Synthetic oligonucleotide
cttaattcggacacggtgaccggca

SEQ ID NO: 677969 - DNA, 25 bp, Artificial sequence
  Synthetic oligonucleotide
tccgaactaaccctatcaagcccgc

SEQ ID NO: 677970 - DNA, 25 bp, Artificial sequence
  Synthetic oligonucleotide
cgtcgtccttaattcggacacggtg

SEQ ID NO: 677971 - DNA, 25 bp, Artificial sequence
  Synthetic oligonucleotide
ctatcaagcccgccgactgcgggtt

SEQ ID NO: 677972 - DNA, 25 bp, Artificial sequence
  Synthetic oligonucleotide
agcccgccgactgcgggtttttcat

SEQ ID NO: 677973 - DNA, 25 bp, Artificial sequence
  Synthetic oligonucleotide
ccgactgcgggtttttcattatctg

SEQ ID NO: 677974 - DNA, 25 bp, Artificial sequence
  Synthetic oligonucleotide
gcgggtttttcattatctggagaac

SEQ ID NO: 677975 - DNA, 25 bp, Artificial sequence
  Synthetic oligonucleotide
ttttcattatctggagaacgtcatg

SEQ ID NO: 677976 - DNA, 25 bp, Artificial sequence
  Synthetic oligonucleotide
ttatctggagaacgtcatgccttgg

SEQ ID NO: 677977 - DNA, 25 bp, Artificial sequence
  Synthetic oligonucleotide
ggagaacgtcatgccttggtattcc

SEQ ID NO: 677978 - DNA, 25 bp, Artificial sequence
  Synthetic oligonucleotide
cgtcatgccttggtattccacaggc

SEQ ID NO: 677979 - DNA, 25 bp, Artificial sequence
  Synthetic oligonucleotide
gccttggtattccacaggcacggtt

SEQ ID NO: 677980 - DNA, 25 bp, Artificial sequence
  Synthetic oligonucleotide
gtattccacaggcacggtttccgtc

SEQ ID NO: 677981 - DNA, 25 bp, Artificial sequence
  Synthetic oligonucleotide
ggcgaccgcctgtacctgcactaca

SEQ ID NO: 677982 - DNA, 25 bp, Artificial sequence
  Synthetic oligonucleotide
ctgtggttccgaactaaccctatca

SEQ ID NO: 677983 - DNA, 25 bp, Artificial sequence
  Synthetic oligonucleotide
gtcgcgaccagcgatcgccaggcca

SEQ ID NO: 677984 - DNA, 25 bp, Artificial sequence
  Synthetic oligonucleotide
gtcacgctgaattccgaagcggtgt

SEQ ID NO: 677985 - DNA, 25 bp, Artificial sequence
  Synthetic oligonucleotide
ctcgcacgacgctactggaggcgcg

SEQ ID NO: 677986 - DNA, 25 bp, Artificial sequence
  Synthetic oligonucleotide
cgacgctactggaggcgcgcaccgc

SEQ ID NO: 677987 - DNA, 25 bp, Artificial sequence
  Synthetic oligonucleotide
tactggaggcgcgcaccgccgatgc

SEQ ID NO: 677988 - DNA, 25 bp, Artificial sequence
  Synthetic oligonucleotide
aggcgcgcaccgccgatgccgaagg

SEQ ID NO: 677989 - DNA, 25 bp, Artificial sequence
  Synthetic oligonucleotide
gcaccgccgatgccgaagggcgtat

SEQ ID NO: 677990 - DNA, 25 bp, Artificial sequence
  Synthetic oligonucleotide
gccgatgccgaagggcgtatcgcca

SEQ ID NO: 677991 - DNA, 25 bp, Artificial sequence
  Synthetic oligonucleotide
gccgaagggcgtatcgccacggtgg

SEQ ID NO: 677992 - DNA, 25 bp, Artificial sequence
  Synthetic oligonucleotide
agggcgtatcgccacggtggaacgg

SEQ ID NO: 677993 - DNA, 25 bp, Artificial sequence
  Synthetic oligonucleotide
tatcgccacggtggaacgggtcgcg

SEQ ID NO: 677994 - DNA, 25 bp, Artificial sequence
  Synthetic oligonucleotide
aggcccaggccactcgcacgacgct

SEQ ID NO: 677995 - DNA, 25 bp, Artificial sequence
  Synthetic oligonucleotide
gaacgggtcgcgaccagcgatcgcc

SEQ ID NO: 677996 - DNA, 25 bp, Artificial sequence
  Synthetic oligonucleotide
gaaaacgaggcccaggccactcgca

SEQ ID NO: 677997 - DNA, 25 bp, Artificial sequence
  Synthetic oligonucleotide
accagcgatcgccaggccaccgcgc

SEQ ID NO: 677998 - DNA, 25 bp, Artificial sequence
  Synthetic oligonucleotide
gatcgccaggccaccgcgcaacgtc

SEQ ID NO: 677999 - DNA, 25 bp, Artificial sequence
  Synthetic oligonucleotide
caggccaccgcgcaacgtctggacc

SEQ ID NO: 678000 - DNA, 25 bp, Artificial sequence
  Synthetic oligonucleotide
accgcgcaacgtctggaccagctct

SEQ ID NO: 678001 - DNA, 25 bp, Artificial sequence
  Synthetic oligonucleotide
caacgtctggaccagctctcggcct

SEQ ID NO: 678002 - DNA, 25 bp, Artificial sequence
  Synthetic oligonucleotide
tggaccagctctcggcctcgatcgg

SEQ ID NO: 678003 - DNA, 25 bp, Artificial sequence
  Synthetic oligonucleotide
agctctcggcctcgatcggtggcac

SEQ ID NO: 678004 - DNA, 25 bp, Artificial sequence
  Synthetic oligonucleotide
cggcctcgatcggtggcaccgcagc

SEQ ID NO: 678005 - DNA, 25 bp, Artificial sequence
  Synthetic oligonucleotide
cgatcggtggcaccgcagccagcct

SEQ ID NO: 678006 - DNA, 25 bp, Artificial sequence
  Synthetic oligonucleotide
gtggcaccgcagccagcctgcagag

SEQ ID NO: 678007 - DNA, 25 bp, Artificial sequence
  Synthetic oligonucleotide
acggtggaacgggtcgcgaccagcg

SEQ ID NO: 678008 - DNA, 25 bp, Artificial sequence
  Synthetic oligonucleotide
acgcggatgacggcaatggcgccat

SEQ ID NO: 678009 - DNA, 25 bp, Artificial sequence
  Synthetic oligonucleotide
atcagcgaactcgacggcagcctta

SEQ ID NO: 678010 - DNA, 25 bp, Artificial sequence
  Synthetic oligonucleotide
gaactcgacggcagccttaccgccc

SEQ ID NO: 678011 - DNA, 25 bp, Artificial sequence
  Synthetic oligonucleotide
gacggcagccttaccgcccaggcat

SEQ ID NO: 678012 - DNA, 25 bp, Artificial sequence
  Synthetic oligonucleotide
agccttaccgcccaggcatcgcgcc

SEQ ID NO: 678013 - DNA, 25 bp, Artificial sequence
  Synthetic oligonucleotide
accgcccaggcatcgcgccttggcg

SEQ ID NO: 678014 - DNA, 25 bp, Artificial sequence
  Synthetic oligonucleotide
caggcatcgcgccttggcgtactgc

SEQ ID NO: 678015 - DNA, 25 bp, Artificial sequence
  Synthetic oligonucleotide
tcgcgccttggcgtactgcaggcgg

SEQ ID NO: 678016 - DNA, 25 bp, Artificial sequence
  Synthetic oligonucleotide
cttggcgtactgcaggcggcgaccc

SEQ ID NO: 678017 - DNA, 25 bp, Artificial sequence
  Synthetic oligonucleotide
gtactgcaggcggcgacccgtgacg

SEQ ID NO: 678018 - DNA, 25 bp, Artificial sequence
  Synthetic oligonucleotide
aggcggcgacccgtgacgacgcgga

SEQ ID NO: 678019 - DNA, 25 bp, Artificial sequence
  Synthetic oligonucleotide
aggccactcgcacgacgctactgga

SEQ ID NO: 678020 - DNA, 25 bp, Artificial sequence
  Synthetic oligonucleotide
gtgacgacgcggatgacggcaatgg

SEQ ID NO: 678021 - DNA, 25 bp, Artificial sequence
  Synthetic oligonucleotide
tgcagagcgaacagaccgcccgcgc

SEQ ID NO: 678022 - DNA, 25 bp, Artificial sequence
  Synthetic oligonucleotide
atgacggcaatggcgccatggccga

SEQ ID NO: 678023 - DNA, 25 bp, Artificial sequence
  Synthetic oligonucleotide
gcaatggcgccatggccgatgccct

SEQ ID NO: 678024 - DNA, 25 bp, Artificial sequence
  Synthetic oligonucleotide
gcgccatggccgatgccctgcgcgg

SEQ ID NO: 678025 - DNA, 25 bp, Artificial sequence
  Synthetic oligonucleotide
tggccgatgccctgcgcggctggaa

SEQ ID NO: 678026 - DNA, 25 bp, Artificial sequence
  Synthetic oligonucleotide
atgccctgcgcggctggaagaccgt

SEQ ID NO: 678027 - DNA, 25 bp, Artificial sequence
  Synthetic oligonucleotide
tgcgcggctggaagaccgttgcccg

SEQ ID NO: 678028 - DNA, 25 bp, Artificial sequence
  Synthetic oligonucleotide
ctggaagaccgttgcccgggcagcc

SEQ ID NO: 678029 - DNA, 25 bp, Artificial sequence
  Synthetic oligonucleotide
agaccgttgcccgggcagcccagga

SEQ ID NO: 678030 - DNA, 25 bp, Artificial sequence
  Synthetic oligonucleotide
gttgcccgggcagcccaggaggaaa

SEQ ID NO: 678031 - DNA, 25 bp, Artificial sequence
  Synthetic oligonucleotide
gccaccgaaaacgaggcccaggcca

SEQ ID NO: 678032 - DNA, 25 bp, Artificial sequence
  Synthetic oligonucleotide
cgacccgtgacgacgcggatgacgg

SEQ ID NO: 678033 - DNA, 25 bp, Artificial sequence
  Synthetic oligonucleotide
agtgtgtcgaccatggcgtttcagg

SEQ ID NO: 678034 - DNA, 25 bp, Artificial sequence
  Synthetic oligonucleotide
gaagctccaggcgcatgccaacgga

SEQ ID NO: 678035 - DNA, 25 bp, Artificial sequence
  Synthetic oligonucleotide
ccaggcgcatgccaacggacaaaag

SEQ ID NO: 678036 - DNA, 25 bp, Artificial sequence
  Synthetic oligonucleotide
gcatgccaacggacaaaagtatgcg

SEQ ID NO: 678037 - DNA, 25 bp, Artificial sequence
  Synthetic oligonucleotide
caacggacaaaagtatgcggcggga

SEQ ID NO: 678038 - DNA, 25 bp, Artificial sequence
  Synthetic oligonucleotide
acaaaagtatgcggcgggatggcaa

SEQ ID NO: 678039 - DNA, 25 bp, Artificial sequence
  Synthetic oligonucleotide
agtatgcggcgggatggcaactggg

SEQ ID NO: 678040 - DNA, 25 bp, Artificial sequence
  Synthetic oligonucleotide
cggcgggatggcaactggggttcga

SEQ ID NO: 678041 - DNA, 25 bp, Artificial sequence
  Synthetic oligonucleotide
gatggcaactggggttcgacagtgg

SEQ ID NO: 678042 - DNA, 25 bp, Artificial sequence
  Synthetic oligonucleotide
caactggggttcgacagtgggacaa

SEQ ID NO: 678043 - DNA, 25 bp, Artificial sequence
  Synthetic oligonucleotide
gggttcgacagtgggacaagtgtgt

SEQ ID NO: 678044 - DNA, 25 bp, Artificial sequence
  Synthetic oligonucleotide
ccgcagccagcctgcagagcgaaca

SEQ ID NO: 678045 - DNA, 25 bp, Artificial sequence
  Synthetic oligonucleotide
gggacaagtgtgtcgaccatggcgt

SEQ ID NO: 678046 - DNA, 25 bp, Artificial sequence
  Synthetic oligonucleotide
tcaaggcgatgtacagcgtgaagct

SEQ ID NO: 678047 - DNA, 25 bp, Artificial sequence
  Synthetic oligonucleotide
tcgaccatggcgtttcaggcggatc

SEQ ID NO: 678048 - DNA, 25 bp, Artificial sequence
  Synthetic oligonucleotide
catggcgtttcaggcggatcggttt

SEQ ID NO: 678049 - DNA, 25 bp, Artificial sequence
  Synthetic oligonucleotide
gtttcaggcggatcggtttatctgg

SEQ ID NO: 678050 - DNA, 25 bp, Artificial sequence
  Synthetic oligonucleotide
ggcggatcggtttatctggttcgac

SEQ ID NO: 678051 - DNA, 25 bp, Artificial sequence
  Synthetic oligonucleotide
tcggtttatctggttcgacagctcc

SEQ ID NO: 678052 - DNA, 25 bp, Artificial sequence
  Synthetic oligonucleotide
tatctggttcgacagctccagcggg

SEQ ID NO: 678053 - DNA, 25 bp, Artificial sequence
  Synthetic oligonucleotide
gttcgacagctccagcgggacggcg

SEQ ID NO: 678054 - DNA, 25 bp, Artificial sequence
  Synthetic oligonucleotide
cagctccagcgggacggcggtagcg

SEQ ID NO: 678055 - DNA, 25 bp, Artificial sequence
  Synthetic oligonucleotide
cagcgggacggcggtagcgccggtt

SEQ ID NO: 678056 - DNA, 25 bp, Artificial sequence
  Synthetic oligonucleotide
acggcggtagcgccggtttccattg

SEQ ID NO: 678057 - DNA, 25 bp, Artificial sequence
  Synthetic oligonucleotide
gacagtgggacaagtgtgtcgacca

SEQ ID NO: 678058 - DNA, 25 bp, Artificial sequence
  Synthetic oligonucleotide
gtaccgacaccaacagcgcggcgat

SEQ ID NO: 678059 - DNA, 25 bp, Artificial sequence
  Synthetic oligonucleotide
gcgagccataccgctgaaatcagcg

SEQ ID NO: 678060 - DNA, 25 bp, Artificial sequence
  Synthetic oligonucleotide
gcgaacagaccgcccgcgccaacgc

SEQ ID NO: 678061 - DNA, 25 bp, Artificial sequence
  Synthetic oligonucleotide
agaccgcccgcgccaacgccgacag

SEQ ID NO: 678062 - DNA, 25 bp, Artificial sequence
  Synthetic oligonucleotide
cccgcgccaacgccgacagcgccct

SEQ ID NO: 678063 - DNA, 25 bp, Artificial sequence
  Synthetic oligonucleotide
ccaacgccgacagcgccctcgcaca

SEQ ID NO: 678064 - DNA, 25 bp, Artificial sequence
  Synthetic oligonucleotide
cgacagcgccctcgcacagcggatc

SEQ ID NO: 678065 - DNA, 25 bp, Artificial sequence
  Synthetic oligonucleotide
cgccctcgcacagcggatcgacacc

SEQ ID NO: 678066 - DNA, 25 bp, Artificial sequence
  Synthetic oligonucleotide
cgcacagcggatcgacaccgtgcag

SEQ ID NO: 678067 - DNA, 25 bp, Artificial sequence
  Synthetic oligonucleotide
cggatcgacaccgtgcaggcgcgta

SEQ ID NO: 678068 - DNA, 25 bp, Artificial sequence
  Synthetic oligonucleotide
gacaccgtgcaggcgcgtaccgaca

SEQ ID NO: 678069 - DNA, 25 bp, Artificial sequence
  Synthetic oligonucleotide
acagcgtgaagctccaggcgcatgc

SEQ ID NO: 678070 - DNA, 25 bp, Artificial sequence
  Synthetic oligonucleotide
ggcgcgtaccgacaccaacagcgcg

SEQ ID NO: 678071 - DNA, 25 bp, Artificial sequence
  Synthetic oligonucleotide
cgatgtacagcgtgaagctccaggc

SEQ ID NO: 678072 - DNA, 25 bp, Artificial sequence
  Synthetic oligonucleotide
gacaccaacagcgcggcgatccaga

SEQ ID NO: 678073 - DNA, 25 bp, Artificial sequence
  Synthetic oligonucleotide
aacagcgcggcgatccagaccacct

SEQ ID NO: 678074 - DNA, 25 bp, Artificial sequence
  Synthetic oligonucleotide
gcggcgatccagaccacctcccagg

SEQ ID NO: 678075 - DNA, 25 bp, Artificial sequence
  Synthetic oligonucleotide
atccagaccacctcccaggctgtca

SEQ ID NO: 678076 - DNA, 25 bp, Artificial sequence
  Synthetic oligonucleotide
gaccacctcccaggctgtcacctcg

SEQ ID NO: 678077 - DNA, 25 bp, Artificial sequence
  Synthetic oligonucleotide
tcccaggctgtcacctcgctggatg

SEQ ID NO: 678078 - DNA, 25 bp, Artificial sequence
  Synthetic oligonucleotide
gctgtcacctcgctggatggcaacg

SEQ ID NO: 678079 - DNA, 25 bp, Artificial sequence
  Synthetic oligonucleotide
acctcgctggatggcaacgtcaagg

SEQ ID NO: 678080 - DNA, 25 bp, Artificial sequence
  Synthetic oligonucleotide
ctggatggcaacgtcaaggcgatgt

SEQ ID NO: 678081 - DNA, 25 bp, Artificial sequence
  Synthetic oligonucleotide
gcaacgtcaaggcgatgtacagcgt

SEQ ID NO: 678082 - DNA, 25 bp, Artificial sequence
  Synthetic oligonucleotide
ccagcctgcagagcgaacagaccgc

SEQ ID NO: 678083 - DNA, 25 bp, Artificial sequence
  Synthetic oligonucleotide
gtgcaggcgcgtaccgacaccaaca

SEQ ID NO: 678084 - DNA, 25 bp, Artificial sequence
  Synthetic oligonucleotide
accgtagcggcaacgtcggcgcctg

SEQ ID NO: 678085 - DNA, 25 bp, Artificial sequence
  Synthetic oligonucleotide
tacccaggcaatacccacctggtat

SEQ ID NO: 678086 - DNA, 25 bp, Artificial sequence
  Synthetic oligonucleotide
ggcaatacccacctggtatcgccga

SEQ ID NO: 678087 - DNA, 25 bp, Artificial sequence
  Synthetic oligonucleotide
acccacctggtatcgccgataccgg

SEQ ID NO: 678088 - DNA, 25 bp, Artificial sequence
  Synthetic oligonucleotide
ctggtatcgccgataccggccggcg

SEQ ID NO: 678089 - DNA, 25 bp, Artificial sequence
  Synthetic oligonucleotide
tcgccgataccggccggcgaacggc

SEQ ID NO: 678090 - DNA, 25 bp, Artificial sequence
  Synthetic oligonucleotide
ataccggccggcgaacggctggcgt

SEQ ID NO: 678091 - DNA, 25 bp, Artificial sequence
  Synthetic oligonucleotide
gccggcgaacggctggcgttccgcg

SEQ ID NO: 678092 - DNA, 25 bp, Artificial sequence
  Synthetic oligonucleotide
gaacggctggcgttccgcggtcgct

SEQ ID NO: 678093 - DNA, 25 bp, Artificial sequence
  Synthetic oligonucleotide
tggcgttccgcggtcgcttgatcga

SEQ ID NO: 678094 - DNA, 25 bp, Artificial sequence
  Synthetic oligonucleotide
tccgcggtcgcttgatcgaccgtag

SEQ ID NO: 678095 - DNA, 25 bp, Artificial sequence
  Synthetic oligonucleotide
atacaaccagttgatcacccaggag

SEQ ID NO: 678096 - DNA, 25 bp, Artificial sequence
  Synthetic oligonucleotide
tgatcgaccgtagcggcaacgtcgg

SEQ ID NO: 678097 - DNA, 25 bp, Artificial sequence
  Synthetic oligonucleotide
cgctgggcctgttcgcctacccagg

SEQ ID NO: 678098 - DNA, 25 bp, Artificial sequence
  Synthetic oligonucleotide
gcggcaacgtcggcgcctggtcgaa

SEQ ID NO: 678099 - DNA, 25 bp, Artificial sequence
  Synthetic oligonucleotide
acgtcggcgcctggtcgaactgggt

SEQ ID NO: 678100 - DNA, 25 bp, Artificial sequence
  Synthetic oligonucleotide
gcgcctggtcgaactgggtcaccgg

SEQ ID NO: 678101 - DNA, 25 bp, Artificial sequence
  Synthetic oligonucleotide
ggtcgaactgggtcaccggcaccag

SEQ ID NO: 678102 - DNA, 25 bp, Artificial sequence
  Synthetic oligonucleotide
actgggtcaccggcaccagctccag

SEQ ID NO: 678103 - DNA, 25 bp, Artificial sequence
  Synthetic oligonucleotide
tcaccggcaccagctccagcgacgc

SEQ ID NO: 678104 - DNA, 25 bp, Artificial sequence
  Synthetic oligonucleotide
caccagctccagcgacgccagcgaa

SEQ ID NO: 678105 - DNA, 25 bp, Artificial sequence
  Synthetic oligonucleotide
ctccagcgacgccagcgaatacaac

SEQ ID NO: 678106 - DNA, 25 bp, Artificial sequence
  Synthetic oligonucleotide
cgacgccagcgaatacaaccagttg

SEQ ID NO: 678107 - DNA, 25 bp, Artificial sequence
  Synthetic oligonucleotide
gctgaaatcagcgaactcgacggca

SEQ ID NO: 678108 - DNA, 25 bp, Artificial sequence
  Synthetic oligonucleotide
gtcgcttgatcgaccgtagcggcaa

SEQ ID NO: 678109 - DNA, 25 bp, Artificial sequence
  Synthetic oligonucleotide
gcggacaccgcctacaccgagatcc

SEQ ID NO: 678110 - DNA, 25 bp, Artificial sequence
  Synthetic oligonucleotide
tcgtttggagctaacgtgatacagc

SEQ ID NO: 678111 - DNA, 25 bp, Artificial sequence
  Synthetic oligonucleotide
cctacctgcgctgcgtggccggccc

SEQ ID NO: 678112 - DNA, 25 bp, Artificial sequence
  Synthetic oligonucleotide
tgcgctgcgtggccggcccctggcg

SEQ ID NO: 678113 - DNA, 25 bp, Artificial sequence
  Synthetic oligonucleotide
cgtggccggcccctggcgcatcggc

SEQ ID NO: 678114 - DNA, 25 bp, Artificial sequence
  Synthetic oligonucleotide
ccggcccctggcgcatcggcctgga

SEQ ID NO: 678115 - DNA, 25 bp, Artificial sequence
  Synthetic oligonucleotide
ccctggcgcatcggcctggagtggg

SEQ ID NO: 678116 - DNA, 25 bp, Artificial sequence
  Synthetic oligonucleotide
cgcatcggcctggagtgggggttcc

SEQ ID NO: 678117 - DNA, 25 bp, Artificial sequence
  Synthetic oligonucleotide
ctggagtgggggttcccgaccagcg

SEQ ID NO: 678118 - DNA, 25 bp, Artificial sequence
  Synthetic oligonucleotide
gggggttcccgaccagcggcgcagc

SEQ ID NO: 678119 - DNA, 25 bp, Artificial sequence
  Synthetic oligonucleotide
tcccgaccagcggcgcagcggacac

SEQ ID NO: 678120 - DNA, 25 bp, Artificial sequence
  Synthetic oligonucleotide
ttcgcctacccaggcaatacccacc

SEQ ID NO: 678121 - DNA, 25 bp, Artificial sequence
  Synthetic oligonucleotide
ggcgcagcggacaccgcctacaccg

SEQ ID NO: 678122 - DNA, 25 bp, Artificial sequence
  Synthetic oligonucleotide
ggcctgttcgcctacccaggcaata

SEQ ID NO: 678123 - DNA, 25 bp, Artificial sequence
  Synthetic oligonucleotide
accgcctacaccgagatccagcagt

SEQ ID NO: 678124 - DNA, 25 bp, Artificial sequence
  Synthetic oligonucleotide
tacaccgagatccagcagtccgcca

SEQ ID NO: 678125 - DNA, 25 bp, Artificial sequence
  Synthetic oligonucleotide
gagatccagcagtccgccacgcccg

SEQ ID NO: 678126 - DNA, 25 bp, Artificial sequence
  Synthetic oligonucleotide
cagcagtccgccacgcccggcggca

SEQ ID NO: 678127 - DNA, 25 bp, Artificial sequence
  Synthetic oligonucleotide
tccgccacgcccggcggcagcgagg

SEQ ID NO: 678128 - DNA, 25 bp, Artificial sequence
  Synthetic oligonucleotide
acgcccggcggcagcgaggagaccg

SEQ ID NO: 678129 - DNA, 25 bp, Artificial sequence
  Synthetic oligonucleotide
ggcggcagcgaggagaccgcacggg

SEQ ID NO: 678130 - DNA, 25 bp, Artificial sequence
  Synthetic oligonucleotide
agcgaggagaccgcacgggcgctgg

SEQ ID NO: 678131 - DNA, 25 bp, Artificial sequence
  Synthetic oligonucleotide
gagaccgcacgggcgctgggcctgt

SEQ ID NO: 678132 - DNA, 25 bp, Artificial sequence
  Synthetic oligonucleotide
cacgggcgctgggcctgttcgccta

SEQ ID NO: 678133 - DNA, 25 bp, Artificial sequence
  Synthetic oligonucleotide
cagttgatcacccaggagtacgtcg

SEQ ID NO: 678134 - DNA, 25 bp, Artificial sequence
  Synthetic oligonucleotide
accagcggcgcagcggacaccgcct

SEQ ID NO: 678135 - DNA, 25 bp, Artificial sequence
  Synthetic oligonucleotide
gcctactggtccgatatcggccagt

SEQ ID NO: 678136 - DNA, 25 bp, Artificial sequence
  Synthetic oligonucleotide
catggtgcgacaggggcagcggttg

SEQ ID NO: 678137 - DNA, 25 bp, Artificial sequence
  Synthetic oligonucleotide
gcgacaggggcagcggttgtaccag

SEQ ID NO: 678138 - DNA, 25 bp, Artificial sequence
  Synthetic oligonucleotide
gggcagcggttgtaccaggcactga

SEQ ID NO: 678139 - DNA, 25 bp, Artificial sequence
  Synthetic oligonucleotide
cggttgtaccaggcactgaaggctg

SEQ ID NO: 678140 - DNA, 25 bp, Artificial sequence
  Synthetic oligonucleotide
taccaggcactgaaggctgtgccgg

SEQ ID NO: 678141 - DNA, 25 bp, Artificial sequence
  Synthetic oligonucleotide
ggcactgaaggctgtgccggcgaag

SEQ ID NO: 678142 - DNA, 25 bp, Artificial sequence
  Synthetic oligonucleotide
gaaggctgtgccggcgaagacggcg

SEQ ID NO: 678143 - DNA, 25 bp, Artificial sequence
  Synthetic oligonucleotide
tgtgccggcgaagacggcgccgccg

SEQ ID NO: 678144 - DNA, 25 bp, Artificial sequence
  Synthetic oligonucleotide
gcgaagacggcgccgccgaacgcgg

SEQ ID NO: 678145 - DNA, 25 bp, Artificial sequence
  Synthetic oligonucleotide
acggcgccgccgaacgcggcctact

SEQ ID NO: 678146 - DNA, 25 bp, Artificial sequence
  Synthetic oligonucleotide
cagcgaatacaaccagttgatcacc

SEQ ID NO: 678147 - DNA, 25 bp, Artificial sequence
  Synthetic oligonucleotide
aacgcggcctactggtccgatatcg

SEQ ID NO: 678148 - DNA, 25 bp, Artificial sequence
  Synthetic oligonucleotide
gtctacgcgaagaacgacatggtgc

SEQ ID NO: 678149 - DNA, 25 bp, Artificial sequence
  Synthetic oligonucleotide
tggtccgatatcggccagtcgctgg

SEQ ID NO: 678150 - DNA, 25 bp, Artificial sequence
  Synthetic oligonucleotide
gatatcggccagtcgctggaaaccg

SEQ ID NO: 678151 - DNA, 25 bp, Artificial sequence
  Synthetic oligonucleotide
ggccagtcgctggaaaccgccaacg

SEQ ID NO: 678152 - DNA, 25 bp, Artificial sequence
  Synthetic oligonucleotide
tcgctggaaaccgccaacgggctgg

SEQ ID NO: 678153 - DNA, 25 bp, Artificial sequence
  Synthetic oligonucleotide
gaaaccgccaacgggctggcgcagc

SEQ ID NO: 678154 - DNA, 25 bp, Artificial sequence
  Synthetic oligonucleotide
cgccaacgggctggcgcagcaggtg

SEQ ID NO: 678155 - DNA, 25 bp, Artificial sequence
  Synthetic oligonucleotide
cgggctggcgcagcaggtggcgagc

SEQ ID NO: 678156 - DNA, 25 bp, Artificial sequence
  Synthetic oligonucleotide
ggcgcagcaggtggcgagccatacc

SEQ ID NO: 678157 - DNA, 25 bp, Artificial sequence
  Synthetic oligonucleotide
caggtggcgagccataccgctgaaa

SEQ ID NO: 678158 - DNA, 25 bp, Artificial sequence
  Synthetic oligonucleotide
tccattgttaatggacagatgttta

SEQ ID NO: 678159 - DNA, 25 bp, Artificial sequence
  Synthetic oligonucleotide
ccgccgaacgcggcctactggtccg

SEQ ID NO: 678160 - DNA, 25 bp, Artificial sequence
  Synthetic oligonucleotide
tatcgggggcttgcagaagcaggtc

SEQ ID NO: 678161 - DNA, 25 bp, Artificial sequence
  Synthetic oligonucleotide
atcacccaggagtacgtcgagtcgg

SEQ ID NO: 678162 - DNA, 25 bp, Artificial sequence
  Synthetic oligonucleotide
caggagtacgtcgagtcggcgctgg

SEQ ID NO: 678163 - DNA, 25 bp, Artificial sequence
  Synthetic oligonucleotide
tacgtcgagtcggcgctgggccagc

SEQ ID NO: 678164 - DNA, 25 bp, Artificial sequence
  Synthetic oligonucleotide
gagtcggcgctgggccagcagttct

SEQ ID NO: 678165 - DNA, 25 bp, Artificial sequence
  Synthetic oligonucleotide
gcgctgggccagcagttcttctccg

SEQ ID NO: 678166 - DNA, 25 bp, Artificial sequence
  Synthetic oligonucleotide
ggccagcagttcttctccgatatcg

SEQ ID NO: 678167 - DNA, 25 bp, Artificial sequence
  Synthetic oligonucleotide
cagttcttctccgatatcgaacgga

SEQ ID NO: 678168 - DNA, 25 bp, Artificial sequence
  Synthetic oligonucleotide
ttctccgatatcgaacggatgcagg

SEQ ID NO: 678169 - DNA, 25 bp, Artificial sequence
  Synthetic oligonucleotide
gatatcgaacggatgcaggtggata

SEQ ID NO: 678170 - DNA, 25 bp, Artificial sequence
  Synthetic oligonucleotide
cgaacggatgcaggtggatatcggg

SEQ ID NO: 678171 - DNA, 25 bp, Artificial sequence
  Synthetic oligonucleotide
aacgacatggtgcgacaggggcagc

SEQ ID NO: 678172 - DNA, 25 bp, Artificial sequence
  Synthetic oligonucleotide
ggtggatatcgggggcttgcagaag

SEQ ID NO: 678173 - DNA, 25 bp, Artificial sequence
  Synthetic oligonucleotide
gcgaagaacgacatggtgcgacagg

SEQ ID NO: 678174 - DNA, 25 bp, Artificial sequence
  Synthetic oligonucleotide
gggcttgcagaagcaggtcggcgac

SEQ ID NO: 678175 - DNA, 25 bp, Artificial sequence
  Synthetic oligonucleotide
tgcagaagcaggtcggcgacctcgc

SEQ ID NO: 678176 - DNA, 25 bp, Artificial sequence
  Synthetic oligonucleotide
agcaggtcggcgacctcgccgacgt

SEQ ID NO: 678177 - DNA, 25 bp, Artificial sequence
  Synthetic oligonucleotide
tcggcgacctcgccgacgttctgct

SEQ ID NO: 678178 - DNA, 25 bp, Artificial sequence
  Synthetic oligonucleotide
acctcgccgacgttctgctgtacga

SEQ ID NO: 678179 - DNA, 25 bp, Artificial sequence
  Synthetic oligonucleotide
gccgacgttctgctgtacgacccgg

SEQ ID NO: 678180 - DNA, 25 bp, Artificial sequence
  Synthetic oligonucleotide
gttctgctgtacgacccggccaagg

SEQ ID NO: 678181 - DNA, 25 bp, Artificial sequence
  Synthetic oligonucleotide
ctgtacgacccggccaaggtctacg

SEQ ID NO: 678182 - DNA, 25 bp, Artificial sequence
  Synthetic oligonucleotide
gacccggccaaggtctacgcgaaga

SEQ ID NO: 678183 - DNA, 25 bp, Artificial sequence
  Synthetic oligonucleotide
gccaaggtctacgcgaagaacgaca

SEQ ID NO: 678184 - DNA, 25 bp, Artificial sequence
  Synthetic oligonucleotide
cataccgctgaaatcagcgaactcg

SEQ ID NO: 678185 - DNA, 25 bp, Artificial sequence
  Synthetic oligonucleotide
gatgcaggtggatatcgggggcttg

SEQ ID NO: 678186 - DNA, 25 bp, Artificial sequence
  Synthetic oligonucleotide
gggaagtgtcgttttcgattctcta

SEQ ID NO: 678187 - DNA, 25 bp, Artificial sequence
  Synthetic oligonucleotide
catccggctccgtaagaattagagt

SEQ ID NO: 678188 - DNA, 25 bp, Artificial sequence
  Synthetic oligonucleotide
gctccgtaagaattagagtttatgc

SEQ ID NO: 678189 - DNA, 25 bp, Artificial sequence
  Synthetic oligonucleotide
taagaattagagtttatgcctacgc

SEQ ID NO: 678190 - DNA, 25 bp, Artificial sequence
  Synthetic oligonucleotide
ttagagtttatgcctacgcattgcc

SEQ ID NO: 678191 - DNA, 25 bp, Artificial sequence
  Synthetic oligonucleotide
tttatgcctacgcattgcctttgct

SEQ ID NO: 678192 - DNA, 25 bp, Artificial sequence
  Synthetic oligonucleotide
cctacgcattgcctttgctgagagg

SEQ ID NO: 678193 - DNA, 25 bp, Artificial sequence
  Synthetic oligonucleotide
cattgcctttgctgagaggatatgg

SEQ ID NO: 678194 - DNA, 25 bp, Artificial sequence
  Synthetic oligonucleotide
ctttgctgagaggatatggacttcg

SEQ ID NO: 678195 - DNA, 25 bp, Artificial sequence
  Synthetic oligonucleotide
tgagaggatatggacttcgtgttcg

SEQ ID NO: 678196 - DNA, 25 bp, Artificial sequence
  Synthetic oligonucleotide
gatatggacttcgtgttcgaaactc

SEQ ID NO: 678197 - DNA, 25 bp, Artificial sequence
  Synthetic oligonucleotide
attataggagctggccgcatagaca

SEQ ID NO: 678198 - DNA, 25 bp, Artificial sequence
  Synthetic oligonucleotide
ctcggcgggaagtgtcgttttcgat

SEQ ID NO: 678199 - DNA, 25 bp, Artificial sequence
  Synthetic oligonucleotide
cagggtatggaacacatacatccgg

SEQ ID NO: 678200 - DNA, 25 bp, Artificial sequence
  Synthetic oligonucleotide
tgtcgttttcgattctctaagactt

SEQ ID NO: 678201 - DNA, 25 bp, Artificial sequence
  Synthetic oligonucleotide
tttcgattctctaagacttcccttg

SEQ ID NO: 678202 - DNA, 25 bp, Artificial sequence
  Synthetic oligonucleotide
tttagtgcggaactgggcggggcgc

SEQ ID NO: 678203 - DNA, 25 bp, Artificial sequence
  Synthetic oligonucleotide
gcggaactgggcggggcgccagaag

SEQ ID NO: 678204 - DNA, 25 bp, Artificial sequence
  Synthetic oligonucleotide
tgggcggggcgccagaagattgggt

SEQ ID NO: 678205 - DNA, 25 bp, Artificial sequence
  Synthetic oligonucleotide
ggcgccagaagattgggttagggta

SEQ ID NO: 678206 - DNA, 25 bp, Artificial sequence
  Synthetic oligonucleotide
agaagattgggttagggtatctggg

SEQ ID NO: 678207 - DNA, 25 bp, Artificial sequence
  Synthetic oligonucleotide
tagggtatctggggaaccgattata

SEQ ID NO: 678208 - DNA, 25 bp, Artificial sequence
  Synthetic oligonucleotide
tctggggaaccgattataggagctg

SEQ ID NO: 678209 - DNA, 25 bp, Artificial sequence
  Synthetic oligonucleotide
agtggttctcactggattttccata

SEQ ID NO: 678210 - DNA, 25 bp, Artificial sequence
  Synthetic oligonucleotide
cgtgttcgaaactcggcgggaagtg

SEQ ID NO: 678211 - DNA, 25 bp, Artificial sequence
  Synthetic oligonucleotide
ttacttcgactcagtacagtatcga

SEQ ID NO: 678212 - DNA, 25 bp, Artificial sequence
  Synthetic oligonucleotide
gtagcgccggtttccattgttaatg

SEQ ID NO: 678213 - DNA, 25 bp, Artificial sequence
  Synthetic oligonucleotide
tggattttccatatgcggtcacatc

SEQ ID NO: 678214 - DNA, 25 bp, Artificial sequence
  Synthetic oligonucleotide
ttccatatgcggtcacatcagctgc

SEQ ID NO: 678215 - DNA, 25 bp, Artificial sequence
  Synthetic oligonucleotide
tatgcggtcacatcagctgcacctc

SEQ ID NO: 678216 - DNA, 25 bp, Artificial sequence
  Synthetic oligonucleotide
ggtcacatcagctgcacctcctgtt

SEQ ID NO: 678217 - DNA, 25 bp, Artificial sequence
  Synthetic oligonucleotide
atcagctgcacctcctgttctagca

SEQ ID NO: 678218 - DNA, 25 bp, Artificial sequence
  Synthetic oligonucleotide
tgcacctcctgttctagcagttcaa

SEQ ID NO: 678219 - DNA, 25 bp, Artificial sequence
  Synthetic oligonucleotide
tcctgttctagcagttcaagcttgg

SEQ ID NO: 678220 - DNA, 25 bp, Artificial sequence
  Synthetic oligonucleotide
tctagcagttcaagcttggaagaat

SEQ ID NO: 678221 - DNA, 25 bp, Artificial sequence
  Synthetic oligonucleotide
agttcaagcttggaagaataaaatt

SEQ ID NO: 678222 - DNA, 25 bp, Artificial sequence
  Synthetic oligonucleotide
cacatacatccggctccgtaagaat

SEQ ID NO: 678223 - DNA, 25 bp, Artificial sequence
  Synthetic oligonucleotide
aattctttacttcgactcagtacag

SEQ ID NO: 678224 - DNA, 25 bp, Artificial sequence
  Synthetic oligonucleotide
atggaacacatacatccggctccgt

SEQ ID NO: 678225 - DNA, 25 bp, Artificial sequence
  Synthetic oligonucleotide
cgactcagtacagtatcgaggtggg

SEQ ID NO: 678226 - DNA, 25 bp, Artificial sequence
  Synthetic oligonucleotide
agtacagtatcgaggtgggccggga

SEQ ID NO: 678227 - DNA, 25 bp, Artificial sequence
  Synthetic oligonucleotide
agtatcgaggtgggccgggaaactg

SEQ ID NO: 678228 - DNA, 25 bp, Artificial sequence
  Synthetic oligonucleotide
cgaggtgggccgggaaactggacag

SEQ ID NO: 678229 - DNA, 25 bp, Artificial sequence
  Synthetic oligonucleotide
gggccgggaaactggacaggcgcca

SEQ ID NO: 678230 - DNA, 25 bp, Artificial sequence
  Synthetic oligonucleotide
ggaaactggacaggcgccactctga

SEQ ID NO: 678231 - DNA, 25 bp, Artificial sequence
  Synthetic oligonucleotide
ggacaggcgccactctgagtttttc

SEQ ID NO: 678232 - DNA, 25 bp, Artificial sequence
  Synthetic oligonucleotide
gcgccactctgagtttttcagggta

SEQ ID NO: 678233 - DNA, 25 bp, Artificial sequence
  Synthetic oligonucleotide
ctctgagtttttcagggtatggaac

SEQ ID NO: 678234 - DNA, 25 bp, Artificial sequence
  Synthetic oligonucleotide
gtttttcagggtatggaacacatac

SEQ ID NO: 678235 - DNA, 25 bp, Artificial sequence
  Synthetic oligonucleotide
ggagctggccgcatagacatatatc

SEQ ID NO: 678236 - DNA, 25 bp, Artificial sequence
  Synthetic oligonucleotide
gaataaaattctttacttcgactca

SEQ ID NO: 678237 - DNA, 25 bp, Artificial sequence
  Synthetic oligonucleotide
attatgctatgccttcaattccgat

SEQ ID NO: 678238 - DNA, 25 bp, Artificial sequence
  Synthetic oligonucleotide
agtgccaaggcttatgcagcatgca

SEQ ID NO: 678239 - DNA, 25 bp, Artificial sequence
  Synthetic oligonucleotide
aaggcttatgcagcatgcatatacc

SEQ ID NO: 678240 - DNA, 25 bp, Artificial sequence
  Synthetic oligonucleotide
tatgcagcatgcatataccgggctt

SEQ ID NO: 678241 - DNA, 25 bp, Artificial sequence
  Synthetic oligonucleotide
agcatgcatataccgggcttccaag

SEQ ID NO: 678242 - DNA, 25 bp, Artificial sequence
  Synthetic oligonucleotide
catataccgggcttccaagttctta

SEQ ID NO: 678243 - DNA, 25 bp, Artificial sequence
  Synthetic oligonucleotide
ccgggcttccaagttcttatcctgg

SEQ ID NO: 678244 - DNA, 25 bp, Artificial sequence
  Synthetic oligonucleotide
ttccaagttcttatcctggaattcc

SEQ ID NO: 678245 - DNA, 25 bp, Artificial sequence
  Synthetic oligonucleotide
gttcttatcctggaattccagctgc

SEQ ID NO: 678246 - DNA, 25 bp, Artificial sequence
  Synthetic oligonucleotide
atcctggaattccagctgctgttta

SEQ ID NO: 678247 - DNA, 25 bp, Artificial sequence
  Synthetic oligonucleotide
gaattccagctgctgtttattatgc

SEQ ID NO: 678248 - DNA, 25 bp, Artificial sequence
  Synthetic oligonucleotide
gaaccgattataggagctggccgca

SEQ ID NO: 678249 - DNA, 25 bp, Artificial sequence
  Synthetic oligonucleotide
ctgtttattatgctatgccttcaat

SEQ ID NO: 678250 - DNA, 25 bp, Artificial sequence
  Synthetic oligonucleotide
gggtttcactgaggagggagtgcca

SEQ ID NO: 678251 - DNA, 25 bp, Artificial sequence
  Synthetic oligonucleotide
ctatgccttcaattccgataataaa

SEQ ID NO: 678252 - DNA, 25 bp, Artificial sequence
  Synthetic oligonucleotide
cttcaattccgataataaaggcttg

SEQ ID NO: 678253 - DNA, 25 bp, Artificial sequence
  Synthetic oligonucleotide
ttccgataataaaggcttgagttga

SEQ ID NO: 678254 - DNA, 25 bp, Artificial sequence
  Synthetic oligonucleotide
taataaaggcttgagttgatttttg

SEQ ID NO: 678255 - DNA, 25 bp, Artificial sequence
  Synthetic oligonucleotide
aggcttgagttgatttttgggagat

SEQ ID NO: 678256 - DNA, 25 bp, Artificial sequence
  Synthetic oligonucleotide
gagttgatttttgggagataatgct

SEQ ID NO: 678257 - DNA, 25 bp, Artificial sequence
  Synthetic oligonucleotide
atttttgggagataatgctatggct

SEQ ID NO: 678258 - DNA, 25 bp, Artificial sequence
  Synthetic oligonucleotide
gggagataatgctatggcttggcat

SEQ ID NO: 678259 - DNA, 25 bp, Artificial sequence
  Synthetic oligonucleotide
taatgctatggcttggcattcgaaa

SEQ ID NO: 678260 - DNA, 25 bp, Artificial sequence
  Synthetic oligonucleotide
tatggcttggcattcgaaaggttcg

SEQ ID NO: 678261 - DNA, 25 bp, Artificial sequence
  Synthetic oligonucleotide
cagctgctgtttattatgctatgcc

SEQ ID NO: 678262 - DNA, 25 bp, Artificial sequence
  Synthetic oligonucleotide
tgacgtggaatttggcagagtggcg

SEQ ID NO: 678263 - DNA, 25 bp, Artificial sequence
  Synthetic oligonucleotide
ggccgcatagacatatatcgcccag

SEQ ID NO: 678264 - DNA, 25 bp, Artificial sequence
  Synthetic oligonucleotide
atagacatatatcgcccagcgacat

SEQ ID NO: 678265 - DNA, 25 bp, Artificial sequence
  Synthetic oligonucleotide
atatatcgcccagcgacatggggtc

SEQ ID NO: 678266 - DNA, 25 bp, Artificial sequence
  Synthetic oligonucleotide
cgcccagcgacatggggtcagcctg

SEQ ID NO: 678267 - DNA, 25 bp, Artificial sequence
  Synthetic oligonucleotide
cgacatggggtcagcctgccgatag

SEQ ID NO: 678268 - DNA, 25 bp, Artificial sequence
  Synthetic oligonucleotide
gggtcagcctgccgatagctacatt

SEQ ID NO: 678269 - DNA, 25 bp, Artificial sequence
  Synthetic oligonucleotide
gcctgccgatagctacattgcagta

SEQ ID NO: 678270 - DNA, 25 bp, Artificial sequence
  Synthetic oligonucleotide
cgatagctacattgcagtaggcatg

SEQ ID NO: 678271 - DNA, 25 bp, Artificial sequence
  Synthetic oligonucleotide
ctacattgcagtaggcatggcactt

SEQ ID NO: 678272 - DNA, 25 bp, Artificial sequence
  Synthetic oligonucleotide
tgcagtaggcatggcacttgacgtg

SEQ ID NO: 678273 - DNA, 25 bp, Artificial sequence
  Synthetic oligonucleotide
ggagggagtgccaaggcttatgcag

SEQ ID NO: 678274 - DNA, 25 bp, Artificial sequence
  Synthetic oligonucleotide
ggcacttgacgtggaatttggcaga

SEQ ID NO: 678275 - DNA, 25 bp, Artificial sequence
  Synthetic oligonucleotide
cactgaggagggagtgccaaggctt

SEQ ID NO: 678276 - DNA, 25 bp, Artificial sequence
  Synthetic oligonucleotide
tggaatttggcagagtggcggtatc

SEQ ID NO: 678277 - DNA, 25 bp, Artificial sequence
  Synthetic oligonucleotide
tttggcagagtggcggtatctggtg

SEQ ID NO: 678278 - DNA, 25 bp, Artificial sequence
  Synthetic oligonucleotide
agagtggcggtatctggtggtacgg

SEQ ID NO: 678279 - DNA, 25 bp, Artificial sequence
  Synthetic oligonucleotide
cggtatctggtggtacggctaatgc

SEQ ID NO: 678280 - DNA, 25 bp, Artificial sequence
  Synthetic oligonucleotide
ctggtggtacggctaatgcaattat

SEQ ID NO: 678281 - DNA, 25 bp, Artificial sequence
  Synthetic oligonucleotide
gtacggctaatgcaattatttatat

SEQ ID NO: 678282 - DNA, 25 bp, Artificial sequence
  Synthetic oligonucleotide
ctaatgcaattatttatatacgctg

SEQ ID NO: 678283 - DNA, 25 bp, Artificial sequence
  Synthetic oligonucleotide
caattatttatatacgctggggttt

SEQ ID NO: 678284 - DNA, 25 bp, Artificial sequence
  Synthetic oligonucleotide
tttatatacgctggggtttcactga

SEQ ID NO: 678285 - DNA, 25 bp, Artificial sequence
  Synthetic oligonucleotide
tacgctggggtttcactgaggaggg

SEQ ID NO: 678286 - DNA, 25 bp, Artificial sequence
  Synthetic oligonucleotide
caagtcagtggttctcactggattt

SEQ ID NO: 678287 - DNA, 25 bp, Artificial sequence
  Synthetic oligonucleotide
aggcatggcacttgacgtggaattt

SEQ ID NO: 678288 - DNA, 25 bp, Artificial sequence
  Synthetic oligonucleotide
ctatcgagagaatgggaccgccgct

SEQ ID NO: 678289 - DNA, 25 bp, Artificial sequence
  Synthetic oligonucleotide
acgagacagtgcaggccaggtcaga

SEQ ID NO: 678290 - DNA, 25 bp, Artificial sequence
  Synthetic oligonucleotide
cagtgcaggccaggtcagagttgag

SEQ ID NO: 678291 - DNA, 25 bp, Artificial sequence
  Synthetic oligonucleotide
caggccaggtcagagttgagatggg

SEQ ID NO: 678292 - DNA, 25 bp, Artificial sequence
  Synthetic oligonucleotide
aggtcagagttgagatggggctttt

SEQ ID NO: 678293 - DNA, 25 bp, Artificial sequence
  Synthetic oligonucleotide
gagttgagatggggcttttacagtc

SEQ ID NO: 678294 - DNA, 25 bp, Artificial sequence
  Synthetic oligonucleotide
agatggggcttttacagtcatgagt

SEQ ID NO: 678295 - DNA, 25 bp, Artificial sequence
  Synthetic oligonucleotide
ggcttttacagtcatgagtatctat

SEQ ID NO: 678296 - DNA, 25 bp, Artificial sequence
  Synthetic oligonucleotide
tacagtcatgagtatctatggatta

SEQ ID NO: 678297 - DNA, 25 bp, Artificial sequence
  Synthetic oligonucleotide
catgagtatctatggattacgtatc

SEQ ID NO: 678298 - DNA, 25 bp, Artificial sequence
  Synthetic oligonucleotide
tatctatggattacgtatctatcga

SEQ ID NO: 678299 - DNA, 25 bp, Artificial sequence
  Synthetic oligonucleotide
gacgggttgatgcagtttcgaaagg

SEQ ID NO: 678300 - DNA, 25 bp, Artificial sequence
  Synthetic oligonucleotide
acgtatctatcgagagaatgggacc

SEQ ID NO: 678301 - DNA, 25 bp, Artificial sequence
  Synthetic oligonucleotide
gcgggtacttatacagtacgagaca

SEQ ID NO: 678302 - DNA, 25 bp, Artificial sequence
  Synthetic oligonucleotide
agagaatgggaccgccgctgtagat

SEQ ID NO: 678303 - DNA, 25 bp, Artificial sequence
  Synthetic oligonucleotide
tgggaccgccgctgtagatataact

SEQ ID NO: 678304 - DNA, 25 bp, Artificial sequence
  Synthetic oligonucleotide
cgccgctgtagatataactgacagg

SEQ ID NO: 678305 - DNA, 25 bp, Artificial sequence
  Synthetic oligonucleotide
tgtagatataactgacagggcgttg

SEQ ID NO: 678306 - DNA, 25 bp, Artificial sequence
  Synthetic oligonucleotide
tataactgacagggcgttgcgggtt

SEQ ID NO: 678307 - DNA, 25 bp, Artificial sequence
  Synthetic oligonucleotide
tgacagggcgttgcgggttgtatat

SEQ ID NO: 678308 - DNA, 25 bp, Artificial sequence
  Synthetic oligonucleotide
ggcgttgcgggttgtatattccaga

SEQ ID NO: 678309 - DNA, 25 bp, Artificial sequence
  Synthetic oligonucleotide
tgcgggttgtatattccagacgggt

SEQ ID NO: 678310 - DNA, 25 bp, Artificial sequence
  Synthetic oligonucleotide
ttgtatattccagacgggttgatgc

SEQ ID NO: 678311 - DNA, 25 bp, Artificial sequence
  Synthetic oligonucleotide
tctcactggattttccatatgcggt

SEQ ID NO: 678312 - DNA, 25 bp, Artificial sequence
  Synthetic oligonucleotide
tggattacgtatctatcgagagaat

SEQ ID NO: 678313 - DNA, 25 bp, Artificial sequence
  Synthetic oligonucleotide
tggaaatgtcattcagtcaaatgca

SEQ ID NO: 678314 - DNA, 25 bp, Artificial sequence
  Synthetic oligonucleotide
ccggcgctggcctacctgcgctgcg

SEQ ID NO: 678315 - DNA, 25 bp, Artificial sequence
  Synthetic oligonucleotide
gttaatggacagatgtttatcaaga

SEQ ID NO: 678316 - DNA, 25 bp, Artificial sequence
  Synthetic oligonucleotide
ggacagatgtttatcaagaacgccc

SEQ ID NO: 678317 - DNA, 25 bp, Artificial sequence
  Synthetic oligonucleotide
atgtttatcaagaacgccctgattc

SEQ ID NO: 678318 - DNA, 25 bp, Artificial sequence
  Synthetic oligonucleotide
atcaagaacgccctgattcaggacg

SEQ ID NO: 678319 - DNA, 25 bp, Artificial sequence
  Synthetic oligonucleotide
aacgccctgattcaggacggagcga

SEQ ID NO: 678320 - DNA, 25 bp, Artificial sequence
  Synthetic oligonucleotide
cctgattcaggacggagcgatagat

SEQ ID NO: 678321 - DNA, 25 bp, Artificial sequence
  Synthetic oligonucleotide
tcaggacggagcgatagataacgcg

SEQ ID NO: 678322 - DNA, 25 bp, Artificial sequence
  Synthetic oligonucleotide
cggagcgatagataacgcgaaaatt

SEQ ID NO: 678323 - DNA, 25 bp, Artificial sequence
  Synthetic oligonucleotide
gatagataacgcgaaaattggaaat

SEQ ID NO: 678324 - DNA, 25 bp, Artificial sequence
  Synthetic oligonucleotide
acagtacgagacagtgcaggccagg

SEQ ID NO: 678325 - DNA, 25 bp, Artificial sequence
  Synthetic oligonucleotide
gaaaattggaaatgtcattcagtca

SEQ ID NO: 678326 - DNA, 25 bp, Artificial sequence
  Synthetic oligonucleotide
acttatacagtacgagacagtgcag

SEQ ID NO: 678327 - DNA, 25 bp, Artificial sequence
  Synthetic oligonucleotide
tgtcattcagtcaaatgcaatgtcc

SEQ ID NO: 678328 - DNA, 25 bp, Artificial sequence
  Synthetic oligonucleotide
tcagtcaaatgcaatgtccaataac

SEQ ID NO: 678329 - DNA, 25 bp, Artificial sequence
  Synthetic oligonucleotide
aaatgcaatgtccaataacggtatg

SEQ ID NO: 678330 - DNA, 25 bp, Artificial sequence
  Synthetic oligonucleotide
aatgtccaataacggtatgccgata

SEQ ID NO: 678331 - DNA, 25 bp, Artificial sequence
  Synthetic oligonucleotide
caataacggtatgccgatatggagg

SEQ ID NO: 678332 - DNA, 25 bp, Artificial sequence
  Synthetic oligonucleotide
cggtatgccgatatggaggctggat

SEQ ID NO: 678333 - DNA, 25 bp, Artificial sequence
  Synthetic oligonucleotide
tgccgatatggaggctggataaagc

SEQ ID NO: 678334 - DNA, 25 bp, Artificial sequence
  Synthetic oligonucleotide
tatggaggctggataaagcgggtac

SEQ ID NO: 678335 - DNA, 25 bp, Artificial sequence
  Synthetic oligonucleotide
aggctggataaagcgggtacttata

SEQ ID NO: 678336 - DNA, 25 bp, Artificial sequence
  Synthetic oligonucleotide
gataaagcgggtacttatacagtac

SEQ ID NO: 678337 - DNA, 25 bp, Artificial sequence
  Synthetic oligonucleotide
ttgatgcagtttcgaaaggagaagc

SEQ ID NO: 678338 - DNA, 25 bp, Artificial sequence
  Synthetic oligonucleotide
taacgcgaaaattggaaatgtcatt

SEQ ID NO: 678339 - DNA, 25 bp, Artificial sequence
  Synthetic oligonucleotide
agactgtaatagatggagagtttca

SEQ ID NO: 678340 - DNA, 25 bp, Artificial sequence
  Synthetic oligonucleotide
tacttctggaaccttatatgtggtg

SEQ ID NO: 678341 - DNA, 25 bp, Artificial sequence
  Synthetic oligonucleotide
tggaaccttatatgtggtggccaag

SEQ ID NO: 678342 - DNA, 25 bp, Artificial sequence
  Synthetic oligonucleotide
cttatatgtggtggccaaggtatga

SEQ ID NO: 678343 - DNA, 25 bp, Artificial sequence
  Synthetic oligonucleotide
tgtggtggccaaggtatgagtgagt

SEQ ID NO: 678344 - DNA, 25 bp, Artificial sequence
  Synthetic oligonucleotide
tggccaaggtatgagtgagtatggg

SEQ ID NO: 678345 - DNA, 25 bp, Artificial sequence
  Synthetic oligonucleotide
aggtatgagtgagtatggggtcttg

SEQ ID NO: 678346 - DNA, 25 bp, Artificial sequence
  Synthetic oligonucleotide
tgagtgagtatggggtcttggtaag

SEQ ID NO: 678347 - DNA, 25 bp, Artificial sequence
  Synthetic oligonucleotide
agtatggggtcttggtaaggaatgg

SEQ ID NO: 678348 - DNA, 25 bp, Artificial sequence
  Synthetic oligonucleotide
gtcttggtaaggaatggcttggggc

SEQ ID NO: 678349 - DNA, 25 bp, Artificial sequence
  Synthetic oligonucleotide
gtaaggaatggcttggggcagactg

SEQ ID NO: 678350 - DNA, 25 bp, Artificial sequence
  Synthetic oligonucleotide
attccagacgggttgatgcagtttc

SEQ ID NO: 678351 - DNA, 25 bp, Artificial sequence
  Synthetic oligonucleotide
tggggcagactgtaatagatggaga

SEQ ID NO: 678352 - DNA, 25 bp, Artificial sequence
  Synthetic oligonucleotide
gtggccatcactattccatacttct

SEQ ID NO: 678353 - DNA, 25 bp, Artificial sequence
  Synthetic oligonucleotide
taatagatggagagtttcataacct

SEQ ID NO: 678354 - DNA, 25 bp, Artificial sequence
  Synthetic oligonucleotide
atggagagtttcataacctttctct

SEQ ID NO: 678355 - DNA, 25 bp, Artificial sequence
  Synthetic oligonucleotide
agtttcataacctttctcttctgtt

SEQ ID NO: 678356 - DNA, 25 bp, Artificial sequence
  Synthetic oligonucleotide
ataacctttctcttctgttggaaag

SEQ ID NO: 678357 - DNA, 25 bp, Artificial sequence
  Synthetic oligonucleotide
tttctcttctgttggaaagaaatat

SEQ ID NO: 678358 - DNA, 25 bp, Artificial sequence
  Synthetic oligonucleotide
ttctgttggaaagaaatattgaagt

SEQ ID NO: 678359 - DNA, 25 bp, Artificial sequence
  Synthetic oligonucleotide
tggaaagaaatattgaagtcgagac

SEQ ID NO: 678360 - DNA, 25 bp, Artificial sequence
  Synthetic oligonucleotide
gaaatattgaagtcgagacaagtca

SEQ ID NO: 678361 - DNA, 25 bp, Artificial sequence
  Synthetic oligonucleotide
ttgaagtcgagacaagtcagtggtt

SEQ ID NO: 678362 - DNA, 25 bp, Artificial sequence
  Synthetic oligonucleotide
tcgagacaagtcagtggttctcact

SEQ ID NO: 678363 - DNA, 25 bp, Artificial sequence
  Synthetic oligonucleotide
atggcttggggcagactgtaataga

SEQ ID NO: 678364 - DNA, 25 bp, Artificial sequence
  Synthetic oligonucleotide
gcacaataagcgtccggtctgggcc

SEQ ID NO: 678365 - DNA, 25 bp, Artificial sequence
  Synthetic oligonucleotide
cagtttcgaaaggagaagctgccac

SEQ ID NO: 678366 - DNA, 25 bp, Artificial sequence
  Synthetic oligonucleotide
tcgaaaggagaagctgccacgcccg

SEQ ID NO: 678367 - DNA, 25 bp, Artificial sequence
  Synthetic oligonucleotide
ggagaagctgccacgcccggctttg

SEQ ID NO: 678368 - DNA, 25 bp, Artificial sequence
  Synthetic oligonucleotide
ctgccacgcccggctttggcccgaa

SEQ ID NO: 678369 - DNA, 25 bp, Artificial sequence
  Synthetic oligonucleotide
gcccggctttggcccgaacaatgct

SEQ ID NO: 678370 - DNA, 25 bp, Artificial sequence
  Synthetic oligonucleotide
ctttggcccgaacaatgcttccgtc

SEQ ID NO: 678371 - DNA, 25 bp, Artificial sequence
  Synthetic oligonucleotide
cccgaacaatgcttccgtctacgtg

SEQ ID NO: 678372 - DNA, 25 bp, Artificial sequence
  Synthetic oligonucleotide
caatgcttccgtctacgtgattggt

SEQ ID NO: 678373 - DNA, 25 bp, Artificial sequence
  Synthetic oligonucleotide
ttccgtctacgtgattggtgatgag

SEQ ID NO: 678374 - DNA, 25 bp, Artificial sequence
  Synthetic oligonucleotide
ctacgtgattggtgatgagcacaat

SEQ ID NO: 678375 - DNA, 25 bp, Artificial sequence
  Synthetic oligonucleotide
attccatacttctggaaccttatat

SEQ ID NO: 678376 - DNA, 25 bp, Artificial sequence
  Synthetic oligonucleotide
tgatgagcacaataagcgtccggtc

SEQ ID NO: 678377 - DNA, 25 bp, Artificial sequence
  Synthetic oligonucleotide
atcactattccatacttctggaacc

SEQ ID NO: 678378 - DNA, 25 bp, Artificial sequence
  Synthetic oligonucleotide
ataagcgtccggtctgggcccgaat

SEQ ID NO: 678379 - DNA, 25 bp, Artificial sequence
  Synthetic oligonucleotide
tccggtctgggcccgaatgggtgat

SEQ ID NO: 678380 - DNA, 25 bp, Artificial sequence
  Synthetic oligonucleotide
ctgggcccgaatgggtgatggcgtt

SEQ ID NO: 678381 - DNA, 25 bp, Artificial sequence
  Synthetic oligonucleotide
ccgaatgggtgatggcgttgttcaa

SEQ ID NO: 678382 - DNA, 25 bp, Artificial sequence
  Synthetic oligonucleotide
gggtgatggcgttgttcaatggggc

SEQ ID NO: 678383 - DNA, 25 bp, Artificial sequence
  Synthetic oligonucleotide
tggcgttgttcaatggggctacgag

SEQ ID NO: 678384 - DNA, 25 bp, Artificial sequence
  Synthetic oligonucleotide
tgttcaatggggctacgaggattgg

SEQ ID NO: 678385 - DNA, 25 bp, Artificial sequence
  Synthetic oligonucleotide
atggggctacgaggattggtggcca

SEQ ID NO: 678386 - DNA, 25 bp, Artificial sequence
  Synthetic oligonucleotide
ctacgaggattggtggccatcacta

SEQ ID NO: 678387 - DNA, 25 bp, Artificial sequence
  Synthetic oligonucleotide
ggattggtggccatcactattccat

SEQ ID NO: 678388 - DNA, 25 bp, Artificial sequence
  Synthetic oligonucleotide
ccggtttccattgttaatggacaga

SEQ ID NO: 678389 - DNA, 25 bp, Artificial sequence
  Synthetic oligonucleotide
gattggtgatgagcacaataagcgt

SEQ ID NO: 678390 - DNA, 25 bp, Artificial sequence
  Synthetic oligonucleotide
tgatgaaatggcaaacttctttccg

SEQ ID NO: 678391 - DNA, 25 bp, Artificial sequence
  Synthetic oligonucleotide
gcactcggctgcaaagtgaggcttc

SEQ ID NO: 678392 - DNA, 25 bp, Artificial sequence
  Synthetic oligonucleotide
cagtcttaccaaatataaaaaaagc

SEQ ID NO: 678393 - DNA, 25 bp, Artificial sequence
  Synthetic oligonucleotide
cagtcttaccaattataaaaaaagc

SEQ ID NO: 678394 - DNA, 25 bp, Artificial sequence
  Synthetic oligonucleotide
ttagtctttaattaaaaatgccggc

SEQ ID NO: 678395 - DNA, 25 bp, Artificial sequence
  Synthetic oligonucleotide
ttagtctttaataaaaaatgccggc

SEQ ID NO: 678396 - DNA, 25 bp, Artificial sequence
  Synthetic oligonucleotide
cttggcaggcttcatcgatgcgatg

SEQ ID NO: 678397 - DNA, 25 bp, Artificial sequence
  Synthetic oligonucleotide
cttggcaggcttgatcgatgcgatg

SEQ ID NO: 678398 - DNA, 25 bp, Artificial sequence
  Synthetic oligonucleotide
ctgtcagtgtatgcaggtgcacgcc

SEQ ID NO: 678399 - DNA, 25 bp, Artificial sequence
  Synthetic oligonucleotide
ctgtcagtgtatccaggtgcacgcc

SEQ ID NO: 678400 - DNA, 25 bp, Artificial sequence
  Synthetic oligonucleotide
gtgataagtaggcagcattcgtaga

SEQ ID NO: 678401 - DNA, 25 bp, Artificial sequence
  Synthetic oligonucleotide
cagcgcaattatcaatggactgatg

SEQ ID NO: 678402 - DNA, 25 bp, Artificial sequence
  Synthetic oligonucleotide
tgatgaaatggctaacttctttccg

SEQ ID NO: 678403 - DNA, 25 bp, Artificial sequence
  Synthetic oligonucleotide
ataaaatgtcttttcgtttttggca

SEQ ID NO: 678404 - DNA, 25 bp, Artificial sequence
  Synthetic oligonucleotide
aatgattgaatgcccagaaaattgg

SEQ ID NO: 678405 - DNA, 25 bp, Artificial sequence
  Synthetic oligonucleotide
cagcgcaattatgaatggactgatg

SEQ ID NO: 678406 - DNA, 25 bp, Artificial sequence
  Synthetic oligonucleotide
ataaaatgtcttatcgtttttggca

SEQ ID NO: 678407 - DNA, 25 bp, Artificial sequence
  Synthetic oligonucleotide
aatgattgaatggccagaaaattgg

SEQ ID NO: 678408 - DNA, 25 bp, Artificial sequence
  Synthetic oligonucleotide
aatgccataaatatcttcatcgaca

SEQ ID NO: 678409 - DNA, 25 bp, Artificial sequence
  Synthetic oligonucleotide
gcactcggctgctaagtgaggcttc

SEQ ID NO: 678410 - DNA, 25 bp, Artificial sequence
  Synthetic oligonucleotide
gtgataagtagggagcattcgtaga

SEQ ID NO: 678411 - DNA, 25 bp, Artificial sequence
  Synthetic oligonucleotide
ggacaatcatactagatttgttatc

SEQ ID NO: 678412 - DNA, 25 bp, Artificial sequence
  Synthetic oligonucleotide
gagcggctgcatccatgtatacata

SEQ ID NO: 678413 - DNA, 25 bp, Artificial sequence
  Synthetic oligonucleotide
tgactgttacatcatatccctgctg

SEQ ID NO: 678414 - DNA, 25 bp, Artificial sequence
  Synthetic oligonucleotide
tcgtccatccctgaagagagaatgc

SEQ ID NO: 678415 - DNA, 25 bp, Artificial sequence
  Synthetic oligonucleotide
tcgtccatccctcaagagagaatgc

SEQ ID NO: 678416 - DNA, 25 bp, Artificial sequence
  Synthetic oligonucleotide
tcgacaaaattttctcacattcaca

SEQ ID NO: 678417 - DNA, 25 bp, Artificial sequence
  Synthetic oligonucleotide
tcgacaaaatttactcacattcaca

SEQ ID NO: 678418 - DNA, 25 bp, Artificial sequence
  Synthetic oligonucleotide
aatgccataaatttcttcatcgaca

SEQ ID NO: 678419 - DNA, 25 bp, Artificial sequence
  Synthetic oligonucleotide
ttccatatgaattcgccaattctac

SEQ ID NO: 678420 - DNA, 25 bp, Artificial sequence
  Synthetic oligonucleotide
caaagtttgtcagtgaccatcccga

SEQ ID NO: 678421 - DNA, 25 bp, Artificial sequence
  Synthetic oligonucleotide
caaagtttgtcactgaccatcccga

SEQ ID NO: 678422 - DNA, 25 bp, Artificial sequence
  Synthetic oligonucleotide
gggtcattgccattgatatggcagc

SEQ ID NO: 678423 - DNA, 25 bp, Artificial sequence
  Synthetic oligonucleotide
gggtcattgccaatgatatggcagc

SEQ ID NO: 678424 - DNA, 25 bp, Artificial sequence
  Synthetic oligonucleotide
attaaaaatcgtcaaacgggatata

SEQ ID NO: 678425 - DNA, 25 bp, Artificial sequence
  Synthetic oligonucleotide
ttccatatgaatacgccaattctac

SEQ ID NO: 678426 - DNA, 25 bp, Artificial sequence
  Synthetic oligonucleotide
gcaggatgatcagtccggggcgctg

SEQ ID NO: 678427 - DNA, 25 bp, Artificial sequence
  Synthetic oligonucleotide
gatgtattgattccaggggccatgc

SEQ ID NO: 678428 - DNA, 25 bp, Artificial sequence
  Synthetic oligonucleotide
tatttctttatttttgatattgaga

SEQ ID NO: 678429 - DNA, 25 bp, Artificial sequence
  Synthetic oligonucleotide
tatttctttattattgatattgaga

SEQ ID NO: 678430 - DNA, 25 bp, Artificial sequence
  Synthetic oligonucleotide
aattgagtcacgtccgactaaaacc

SEQ ID NO: 678431 - DNA, 25 bp, Artificial sequence
  Synthetic oligonucleotide
aattgagtcacgaccgactaaaacc

SEQ ID NO: 678432 - DNA, 25 bp, Artificial sequence
  Synthetic oligonucleotide
attaaaaatcgtgaaacgggatata

SEQ ID NO: 678433 - DNA, 25 bp, Artificial sequence
  Synthetic oligonucleotide
gtctgcattttcttggagaaattta

SEQ ID NO: 678434 - DNA, 25 bp, Artificial sequence
  Synthetic oligonucleotide
ggacaatcatacaagatttgttatc

SEQ ID NO: 678435 - DNA, 25 bp, Artificial sequence
  Synthetic oligonucleotide
gcaggatgatcactccggggcgctg

SEQ ID NO: 678436 - DNA, 25 bp, Artificial sequence
  Synthetic oligonucleotide
ctctaggcccaaaacgaccttaatg

SEQ ID NO: 678437 - DNA, 25 bp, Artificial sequence
  Synthetic oligonucleotide
ctctaggcccaatacgaccttaatg

SEQ ID NO: 678438 - DNA, 25 bp, Artificial sequence
  Synthetic oligonucleotide
tgaaaacatatcttttgaagtgaat

SEQ ID NO: 678439 - DNA, 25 bp, Artificial sequence
  Synthetic oligonucleotide
tgaaaacatatcatttgaagtgaat

SEQ ID NO: 678440 - DNA, 25 bp, Artificial sequence
  Synthetic oligonucleotide
gatgtattgattgcaggggccatgc

SEQ ID NO: 678441 - DNA, 25 bp, Artificial sequence
  Synthetic oligonucleotide
gtctgcattttcatggagaaattta

SEQ ID NO: 678442 - DNA, 25 bp, Artificial sequence
  Synthetic oligonucleotide
gtatgcctgccaaaagagatgcgga

SEQ ID NO: 678443 - DNA, 25 bp, Artificial sequence
  Synthetic oligonucleotide
aacataacatattgtccttcaaatg

SEQ ID NO: 678444 - DNA, 25 bp, Artificial sequence
  Synthetic oligonucleotide
tgttggcgcccattagctttaattc

SEQ ID NO: 678445 - DNA, 25 bp, Artificial sequence
  Synthetic oligonucleotide
tcaaattctcctttcttttgttccc

SEQ ID NO: 678446 - DNA, 25 bp, Artificial sequence
  Synthetic oligonucleotide
tcaaattctcctatcttttgttccc

SEQ ID NO: 678447 - DNA, 25 bp, Artificial sequence
  Synthetic oligonucleotide
aacgtatgtaataactgttccagct

SEQ ID NO: 678448 - DNA, 25 bp, Artificial sequence
  Synthetic oligonucleotide
tagattccttcacccacagaagaag

SEQ ID NO: 678449 - DNA, 25 bp, Artificial sequence
  Synthetic oligonucleotide
gtatgcctgccataagagatgcgga

SEQ ID NO: 678450 - DNA, 25 bp, Artificial sequence
  Synthetic oligonucleotide
tagattccttcagccacagaagaag

SEQ ID NO: 678451 - DNA, 25 bp, Artificial sequence
  Synthetic oligonucleotide
gcttcttgttcggtttttcttaatg

SEQ ID NO: 678452 - DNA, 25 bp, Artificial sequence
  Synthetic oligonucleotide
gcttcttgttcgctttttcttaatg

SEQ ID NO: 678453 - DNA, 25 bp, Artificial sequence
  Synthetic oligonucleotide
tcagacggaccgtggtaacctgcag

SEQ ID NO: 678454 - DNA, 25 bp, Artificial sequence
  Synthetic oligonucleotide
tcagacggaccgaggtaacctgcag

SEQ ID NO: 678455 - DNA, 25 bp, Artificial sequence
  Synthetic oligonucleotide
ccggttgaaatgcaaatattactcc

SEQ ID NO: 678456 - DNA, 25 bp, Artificial sequence
  Synthetic oligonucleotide
tggcgataatcgctacatttttcgc

SEQ ID NO: 678457 - DNA, 25 bp, Artificial sequence
  Synthetic oligonucleotide
aacgtatgtaattactgttccagct

SEQ ID NO: 678458 - DNA, 25 bp, Artificial sequence
  Synthetic oligonucleotide
gagcggctgcatgcatgtatacata

SEQ ID NO: 678459 - DNA, 25 bp, Artificial sequence
  Synthetic oligonucleotide
ggatggctgcagttaaatctccgta

SEQ ID NO: 678460 - DNA, 25 bp, Artificial sequence
  Synthetic oligonucleotide
ttacgtcttttactgtaacgccttc

SEQ ID NO: 678461 - DNA, 25 bp, Artificial sequence
  Synthetic oligonucleotide
ttacgtcttttagtgtaacgccttc

SEQ ID NO: 678462 - DNA, 25 bp, Artificial sequence
  Synthetic oligonucleotide
gctgcagttcctcttctgtccgttc

SEQ ID NO: 678463 - DNA, 25 bp, Artificial sequence
  Synthetic oligonucleotide
gctgcagttcctgttctgtccgttc

SEQ ID NO: 678464 - DNA, 25 bp, Artificial sequence
  Synthetic oligonucleotide
tgttggcgcccaatagctttaattc

SEQ ID NO: 678465 - DNA, 25 bp, Artificial sequence
  Synthetic oligonucleotide
gacatgctatgaatctttctgcctg

SEQ ID NO: 678466 - DNA, 25 bp, Artificial sequence
  Synthetic oligonucleotide
aacataacatatagtccttcaaatg

SEQ ID NO: 678467 - DNA, 25 bp, Artificial sequence
  Synthetic oligonucleotide
agaagtgccattaaacattacacgc

SEQ ID NO: 678468 - DNA, 25 bp, Artificial sequence
  Synthetic oligonucleotide
tggcgataatcggtacatttttcgc

SEQ ID NO: 678469 - DNA, 25 bp, Artificial sequence
  Synthetic oligonucleotide
atatatcctgtagaataacctgtct

SEQ ID NO: 678470 - DNA, 25 bp, Artificial sequence
  Synthetic oligonucleotide
atatatcctgtacaataacctgtct

SEQ ID NO: 678471 - DNA, 25 bp, Artificial sequence
  Synthetic oligonucleotide
ctttttttgcgagttctcctcctgt

SEQ ID NO: 678472 - DNA, 25 bp, Artificial sequence
  Synthetic oligonucleotide
ctttttttgcgacttctcctcctgt

SEQ ID NO: 678473 - DNA, 25 bp, Artificial sequence
  Synthetic oligonucleotide
gacatgctatgattctttctgcctg

SEQ ID NO: 678474 - DNA, 25 bp, Artificial sequence
  Synthetic oligonucleotide
ttgtgcaggtatgaagacaggtgtt

SEQ ID NO: 678475 - DNA, 25 bp, Artificial sequence
  Synthetic oligonucleotide
ccggttgaaatggaaatattactcc

SEQ ID NO: 678476 - DNA, 25 bp, Artificial sequence
  Synthetic oligonucleotide
tggattttatggctggacattgaga

SEQ ID NO: 678477 - DNA, 25 bp, Artificial sequence
  Synthetic oligonucleotide
cccagattttttctattgatcggga

SEQ ID NO: 678478 - DNA, 25 bp, Artificial sequence
  Synthetic oligonucleotide
cccagattttttgtattgatcggga

SEQ ID NO: 678479 - DNA, 25 bp, Artificial sequence
  Synthetic oligonucleotide
gtttgaacagcgtcgcaatgaagaa

SEQ ID NO: 678480 - DNA, 25 bp, Artificial sequence
  Synthetic oligonucleotide
ggccggatatagaccgcccctactc

SEQ ID NO: 678481 - DNA, 25 bp, Artificial sequence
  Synthetic oligonucleotide
ttgtgcaggtatcaagacaggtgtt

SEQ ID NO: 678482 - DNA, 25 bp, Artificial sequence
  Synthetic oligonucleotide
ggccggatatagtccgcccctactc

SEQ ID NO: 678483 - DNA, 25 bp, Artificial sequence
  Synthetic oligonucleotide
atgatcccggttacagaatttgcat

SEQ ID NO: 678484 - DNA, 25 bp, Artificial sequence
  Synthetic oligonucleotide
atgatcccggtttcagaatttgcat

SEQ ID NO: 678485 - DNA, 25 bp, Artificial sequence
  Synthetic oligonucleotide
acaaggcctgttaccggccggatat

SEQ ID NO: 678486 - DNA, 25 bp, Artificial sequence
  Synthetic oligonucleotide
acaaggcctgtttccggccggatat

SEQ ID NO: 678487 - DNA, 25 bp, Artificial sequence
  Synthetic oligonucleotide
tttcctcggtaaaaagcccgtattc

SEQ ID NO: 678488 - DNA, 25 bp, Artificial sequence
  Synthetic oligonucleotide
tttcctcggtaataagcccgtattc

SEQ ID NO: 678489 - DNA, 25 bp, Artificial sequence
  Synthetic oligonucleotide
gtttgaacagcgacgcaatgaagaa

SEQ ID NO: 678490 - DNA, 25 bp, Artificial sequence
  Synthetic oligonucleotide
ttgcgggatatctgtttttccattt

SEQ ID NO: 678491 - DNA, 25 bp, Artificial sequence
  Synthetic oligonucleotide
caccctataatatgcggaagacatt

SEQ ID NO: 678492 - DNA, 25 bp, Artificial sequence
  Synthetic oligonucleotide
caccctataataagcggaagacatt

SEQ ID NO: 678493 - DNA, 25 bp, Artificial sequence
  Synthetic oligonucleotide
gtgtctgctgcaagggttacaggga

SEQ ID NO: 678494 - DNA, 25 bp, Artificial sequence
  Synthetic oligonucleotide
gtgtctgctgcatgggttacaggga

SEQ ID NO: 678495 - DNA, 25 bp, Artificial sequence
  Synthetic oligonucleotide
cggatttggtctagaaagtatgttc

SEQ ID NO: 678496 - DNA, 25 bp, Artificial sequence
  Synthetic oligonucleotide
tggattttatgggtggacattgaga

SEQ ID NO: 678497 - DNA, 25 bp, Artificial sequence
  Synthetic oligonucleotide
ttgcgggatatcagtttttccattt

SEQ ID NO: 678498 - DNA, 25 bp, Artificial sequence
  Synthetic oligonucleotide
tgactgttacatgatatccctgctg

SEQ ID NO: 678499 - DNA, 25 bp, Artificial sequence
  Synthetic oligonucleotide
aattctgcagcggcagtgaaggcac

SEQ ID NO: 678500 - DNA, 25 bp, Artificial sequence
  Synthetic oligonucleotide
aattctgcagcgccagtgaaggcac

SEQ ID NO: 678501 - DNA, 25 bp, Artificial sequence
  Synthetic oligonucleotide
acatttacggtgccggctctgaatc

SEQ ID NO: 678502 - DNA, 25 bp, Artificial sequence
  Synthetic oligonucleotide
acatttacggtggcggctctgaatc

SEQ ID NO: 678503 - DNA, 25 bp, Artificial sequence
  Synthetic oligonucleotide
gtagtcagaggaaaaacgggtttcc

SEQ ID NO: 678504 - DNA, 25 bp, Artificial sequence
  Synthetic oligonucleotide
gtagtcagaggataaacgggtttcc

SEQ ID NO: 678505 - DNA, 25 bp, Artificial sequence
  Synthetic oligonucleotide
cggatttggtcttgaaagtatgttc

SEQ ID NO: 678506 - DNA, 25 bp, Artificial sequence
  Synthetic oligonucleotide
ggctgatttgccagggctgattgaa

SEQ ID NO: 678507 - DNA, 25 bp, Artificial sequence
  Synthetic oligonucleotide
agcctttaaagaaaagctgacggat

SEQ ID NO: 678508 - DNA, 25 bp, Artificial sequence
  Synthetic oligonucleotide
tagccgctttgcaacaccggctaat

SEQ ID NO: 678509 - DNA, 25 bp, Artificial sequence
  Synthetic oligonucleotide
gctttcagaaaagggcgagccggga

SEQ ID NO: 678510 - DNA, 25 bp, Artificial sequence
  Synthetic oligonucleotide
gctttcagaaaacggcgagccggga

SEQ ID NO: 678511 - DNA, 25 bp, Artificial sequence
  Synthetic oligonucleotide
cattgttcttgaattaaaagtgctt

SEQ ID NO: 678512 - DNA, 25 bp, Artificial sequence
  Synthetic oligonucleotide
cattgttcttgatttaaaagtgctt

SEQ ID NO: 678513 - DNA, 25 bp, Artificial sequence
  Synthetic oligonucleotide
acttgtcgggttcccgagtgtggga

SEQ ID NO: 678514 - DNA, 25 bp, Artificial sequence
  Synthetic oligonucleotide
acttgtcgggttgccgagtgtggga

SEQ ID NO: 678515 - DNA, 25 bp, Artificial sequence
  Synthetic oligonucleotide
gctgtctgttgtctcatctgcaaaa

SEQ ID NO: 678516 - DNA, 25 bp, Artificial sequence
  Synthetic oligonucleotide
gctgtctgttgtgtcatctgcaaaa

SEQ ID NO: 678517 - DNA, 25 bp, Artificial sequence
  Synthetic oligonucleotide
ggactatcacttaacaacgcttgtc

SEQ ID NO: 678518 - DNA, 25 bp, Artificial sequence
  Synthetic oligonucleotide
ggactatcactttacaacgcttgtc

SEQ ID NO: 678519 - DNA, 25 bp, Artificial sequence
  Synthetic oligonucleotide
catggttgaaacggatgacggacgc

SEQ ID NO: 678520 - DNA, 25 bp, Artificial sequence
  Synthetic oligonucleotide
tgtcattgcaagaggcggaagaggc

SEQ ID NO: 678521 - DNA, 25 bp, Artificial sequence
  Synthetic oligonucleotide
gtcaggcttagaaggccgtgatcca

SEQ ID NO: 678522 - DNA, 25 bp, Artificial sequence
  Synthetic oligonucleotide
tgtatttgtgctatcaggagacagc

SEQ ID NO: 678523 - DNA, 25 bp, Artificial sequence
  Synthetic oligonucleotide
taaaatggacatgccggaggctgcg

SEQ ID NO: 678524 - DNA, 25 bp, Artificial sequence
  Synthetic oligonucleotide
taaaatggacatcccggaggctgcg

SEQ ID NO: 678525 - DNA, 25 bp, Artificial sequence
  Synthetic oligonucleotide
gcgtctcactgagcgtccgcaaatt

SEQ ID NO: 678526 - DNA, 25 bp, Artificial sequence
  Synthetic oligonucleotide
gcgtctcactgaccgtccgcaaatt

SEQ ID NO: 678527 - DNA, 25 bp, Artificial sequence
  Synthetic oligonucleotide
catggttgaaaccgatgacggacgc

SEQ ID NO: 678528 - DNA, 25 bp, Artificial sequence
  Synthetic oligonucleotide
tcttacgattaagcaggagctgagc

SEQ ID NO: 678529 - DNA, 25 bp, Artificial sequence
  Synthetic oligonucleotide
ggctgatttgcctgggctgattgaa

SEQ ID NO: 678530 - DNA, 25 bp, Artificial sequence
  Synthetic oligonucleotide
gtcaggcttagatggccgtgatcca

SEQ ID NO: 678531 - DNA, 25 bp, Artificial sequence
  Synthetic oligonucleotide
tgaacggacgagggttattgttcat

SEQ ID NO: 678532 - DNA, 25 bp, Artificial sequence
  Synthetic oligonucleotide
tgaacggacgagcgttattgttcat

SEQ ID NO: 678533 - DNA, 25 bp, Artificial sequence
  Synthetic oligonucleotide
aggcgtcggactcggccaccagttt

SEQ ID NO: 678534 - DNA, 25 bp, Artificial sequence
  Synthetic oligonucleotide
aggcgtcggactgggccaccagttt

SEQ ID NO: 678535 - DNA, 25 bp, Artificial sequence
  Synthetic oligonucleotide
tgtcattgcaagtggcggaagaggc

SEQ ID NO: 678536 - DNA, 25 bp, Artificial sequence
  Synthetic oligonucleotide
tcttacgattaaccaggagctgagc

SEQ ID NO: 678537 - DNA, 25 bp, Artificial sequence
  Synthetic oligonucleotide
aggcggccctgcgggcggtgacgga

SEQ ID NO: 678538 - DNA, 25 bp, Artificial sequence
  Synthetic oligonucleotide
ggatggctgcagataaatctccgta

SEQ ID NO: 678539 - DNA, 25 bp, Artificial sequence
  Synthetic oligonucleotide
tgattttcacggcgcctttgccgat

SEQ ID NO: 678540 - DNA, 25 bp, Artificial sequence
  Synthetic oligonucleotide
tgattttcacggggcctttgccgat

SEQ ID NO: 678541 - DNA, 25 bp, Artificial sequence
  Synthetic oligonucleotide
tgatgatattcggcagaatggatat

SEQ ID NO: 678542 - DNA, 25 bp, Artificial sequence
  Synthetic oligonucleotide
tgatgatattcgccagaatggatat

SEQ ID NO: 678543 - DNA, 25 bp, Artificial sequence
  Synthetic oligonucleotide
tatcatgcgttttgaaatcacgagt

SEQ ID NO: 678544 - DNA, 25 bp, Artificial sequence
  Synthetic oligonucleotide
tatcatgcgtttagaaatcacgagt

SEQ ID NO: 678545 - DNA, 25 bp, Artificial sequence
  Synthetic oligonucleotide
gattgaaattggcttggactagcgg

SEQ ID NO: 678546 - DNA, 25 bp, Artificial sequence
  Synthetic oligonucleotide
gattgaaattgggttggactagcgg

SEQ ID NO: 678547 - DNA, 25 bp, Artificial sequence
  Synthetic oligonucleotide
gtttagaacggaggacattatgttt

SEQ ID NO: 678548 - DNA, 25 bp, Artificial sequence
  Synthetic oligonucleotide
gtttagaacggacgacattatgttt

SEQ ID NO: 678549 - DNA, 25 bp, Artificial sequence
  Synthetic oligonucleotide
caaagtatatgttaaaggcggcgac

SEQ ID NO: 678550 - DNA, 25 bp, Artificial sequence
  Synthetic oligonucleotide
caaagtatatgtaaaaggcggcgac

SEQ ID NO: 678551 - DNA, 25 bp, Artificial sequence
  Synthetic oligonucleotide
tagccgctttgctacaccggctaat

SEQ ID NO: 678552 - DNA, 25 bp, Artificial sequence
  Synthetic oligonucleotide
gattcgcggcgaccatggcatgtcc

SEQ ID NO: 678553 - DNA, 25 bp, Artificial sequence
  Synthetic oligonucleotide
ggtcatcgctgatttaacagagcac

SEQ ID NO: 678554 - DNA, 25 bp, Artificial sequence
  Synthetic oligonucleotide
ggtcatcgctgaattaacagagcac

SEQ ID NO: 678555 - DNA, 25 bp, Artificial sequence
  Synthetic oligonucleotide
gccgggcaccgtagtgacagacgat

SEQ ID NO: 678556 - DNA, 25 bp, Artificial sequence
  Synthetic oligonucleotide
gccgggcaccgttgtgacagacgat

SEQ ID NO: 678557 - DNA, 25 bp, Artificial sequence
  Synthetic oligonucleotide
cgggcgaaatgctgatgatatggtc

SEQ ID NO: 678558 - DNA, 25 bp, Artificial sequence
  Synthetic oligonucleotide
tatggttgcgtttcgccgtgaaaaa

SEQ ID NO: 678559 - DNA, 25 bp, Artificial sequence
  Synthetic oligonucleotide
gattcgcggcgagcatggcatgtcc

SEQ ID NO: 678560 - DNA, 25 bp, Artificial sequence
  Synthetic oligonucleotide
tatggttgcgttacgccgtgaaaaa

SEQ ID NO: 678561 - DNA, 25 bp, Artificial sequence
  Synthetic oligonucleotide
cctgatggattttagatacaaaaaa

SEQ ID NO: 678562 - DNA, 25 bp, Artificial sequence
  Synthetic oligonucleotide
cctgatggatttaagatacaaaaaa

SEQ ID NO: 678563 - DNA, 25 bp, Artificial sequence
  Synthetic oligonucleotide
agacgtcgtttttgaagtagatgaa

SEQ ID NO: 678564 - DNA, 25 bp, Artificial sequence
  Synthetic oligonucleotide
agacgtcgttttagaagtagatgaa

SEQ ID NO: 678565 - DNA, 25 bp, Artificial sequence
  Synthetic oligonucleotide
aggcggccctgccggcggtgacgga

SEQ ID NO: 678566 - DNA, 25 bp, Artificial sequence
  Synthetic oligonucleotide
attcccgatcagagcggtgacaaga

SEQ ID NO: 678567 - DNA, 25 bp, Artificial sequence
  Synthetic oligonucleotide
cgggcgaaatgcagatgatatggtc

SEQ ID NO: 678568 - DNA, 25 bp, Artificial sequence
  Synthetic oligonucleotide
aggtgcataaggcagagaaaatcgt

SEQ ID NO: 678569 - DNA, 25 bp, Artificial sequence
  Synthetic oligonucleotide
agcctttaaagataagctgacggat

SEQ ID NO: 678570 - DNA, 25 bp, Artificial sequence
  Synthetic oligonucleotide
caccatggtaaaagaacaaattatc

SEQ ID NO: 678571 - DNA, 25 bp, Artificial sequence
  Synthetic oligonucleotide
tcatttggaggataggtcaggtgcg

SEQ ID NO: 678572 - DNA, 25 bp, Artificial sequence
  Synthetic oligonucleotide
tcatttggaggaaaggtcaggtgcg

SEQ ID NO: 678573 - DNA, 25 bp, Artificial sequence
  Synthetic oligonucleotide
tcttcaggcggtagctgattctgga

SEQ ID NO: 678574 - DNA, 25 bp, Artificial sequence
  Synthetic oligonucleotide
tcttcaggcggttgctgattctgga

SEQ ID NO: 678575 - DNA, 25 bp, Artificial sequence
  Synthetic oligonucleotide
ttccattcaccagaccattccgctt

SEQ ID NO: 678576 - DNA, 25 bp, Artificial sequence
  Synthetic oligonucleotide
ttccattcaccacaccattccgctt

SEQ ID NO: 678577 - DNA, 25 bp, Artificial sequence
  Synthetic oligonucleotide
aaatgtgacactctctatcagtacg

SEQ ID NO: 678578 - DNA, 25 bp, Artificial sequence
  Synthetic oligonucleotide
aaatgtgacactgtctatcagtacg

SEQ ID NO: 678579 - DNA, 25 bp, Artificial sequence
  Synthetic oligonucleotide
agaagacattcaaacattaatgaat

SEQ ID NO: 678580 - DNA, 25 bp, Artificial sequence
  Synthetic oligonucleotide
agaagacattcatacattaatgaat

SEQ ID NO: 678581 - DNA, 25 bp, Artificial sequence
  Synthetic oligonucleotide
gtttgattttgttgaaaaggttgaa

SEQ ID NO: 678582 - DNA, 25 bp, Artificial sequence
  Synthetic oligonucleotide
gttttataaatagagggatgctgtt

SEQ ID NO: 678583 - DNA, 25 bp, Artificial sequence
  Synthetic oligonucleotide
ttgcttaccgcaccattccggagtg

SEQ ID NO: 678584 - DNA, 25 bp, Artificial sequence
  Synthetic oligonucleotide
tgggtgaaatgaggttgccgattca

SEQ ID NO: 678585 - DNA, 25 bp, Artificial sequence
  Synthetic oligonucleotide
tagactatttaatacatgaacagcc

SEQ ID NO: 678586 - DNA, 25 bp, Artificial sequence
  Synthetic oligonucleotide
tagactatttaaaacatgaacagcc

SEQ ID NO: 678587 - DNA, 25 bp, Artificial sequence
  Synthetic oligonucleotide
tggaaaatgctttagaaggatctgt

SEQ ID NO: 678588 - DNA, 25 bp, Artificial sequence
  Synthetic oligonucleotide
tggaaaatgcttaagaaggatctgt

SEQ ID NO: 678589 - DNA, 25 bp, Artificial sequence
  Synthetic oligonucleotide
gtttgattttgtagaaaaggttgaa

SEQ ID NO: 678590 - DNA, 25 bp, Artificial sequence
  Synthetic oligonucleotide
ccgttgcaggcgaagttgattttgc

SEQ ID NO: 678591 - DNA, 25 bp, Artificial sequence
  Synthetic oligonucleotide
aggtgcataagggagagaaaatcgt

SEQ ID NO: 678592 - DNA, 25 bp, Artificial sequence
  Synthetic oligonucleotide
ttgcttaccgcagcattccggagtg

SEQ ID NO: 678593 - DNA, 25 bp, Artificial sequence
  Synthetic oligonucleotide
cagtcagttcttcttttcaaaacgg

SEQ ID NO: 678594 - DNA, 25 bp, Artificial sequence
  Synthetic oligonucleotide
cagtcagttcttgttttcaaaacgg

SEQ ID NO: 678595 - DNA, 25 bp, Artificial sequence
  Synthetic oligonucleotide
gttatttaggtccagcagctacatt

SEQ ID NO: 678596 - DNA, 25 bp, Artificial sequence
  Synthetic oligonucleotide
gttatttaggtcgagcagctacatt

SEQ ID NO: 678597 - DNA, 25 bp, Artificial sequence
  Synthetic oligonucleotide
gttttataaatacagggatgctgtt

SEQ ID NO: 678598 - DNA, 25 bp, Artificial sequence
  Synthetic oligonucleotide
ccgttgcaggcgtagttgattttgc

SEQ ID NO: 678599 - DNA, 25 bp, Artificial sequence
  Synthetic oligonucleotide
tgatgaagcactgagagaacgcgga

SEQ ID NO: 678600 - DNA, 25 bp, Artificial sequence
  Synthetic oligonucleotide
attcccgatcagtgcggtgacaaga

SEQ ID NO: 678601 - DNA, 25 bp, Artificial sequence
  Synthetic oligonucleotide
tgagcttctgttagaggttgccaat

SEQ ID NO: 678602 - DNA, 25 bp, Artificial sequence
  Synthetic oligonucleotide
tgagcttctgtttgaggttgccaat

SEQ ID NO: 678603 - DNA, 25 bp, Artificial sequence
  Synthetic oligonucleotide
cacaccggaattcccgctgtatgac

SEQ ID NO: 678604 - DNA, 25 bp, Artificial sequence
  Synthetic oligonucleotide
cacaccggaattgccgctgtatgac

SEQ ID NO: 678605 - DNA, 25 bp, Artificial sequence
  Synthetic oligonucleotide
tacacaaaaccgtgtcatgtacacg

SEQ ID NO: 678606 - DNA, 25 bp, Artificial sequence
  Synthetic oligonucleotide
tacacaaaaccgagtcatgtacacg

SEQ ID NO: 678607 - DNA, 25 bp, Artificial sequence
  Synthetic oligonucleotide
agaagtgccatttaacattacacgc

SEQ ID NO: 678608 - DNA, 25 bp, Artificial sequence
  Synthetic oligonucleotide
tgtatttgtgctttcaggagacagc

SEQ ID NO: 678609 - DNA, 25 bp, Artificial sequence
  Synthetic oligonucleotide
attcaagatgacagatttctcacgt

SEQ ID NO: 678610 - DNA, 25 bp, Artificial sequence
  Synthetic oligonucleotide
attcaagatgactgatttctcacgt

SEQ ID NO: 678611 - DNA, 25 bp, Artificial sequence
  Synthetic oligonucleotide
taaacggtttgctagacagatgcgc

SEQ ID NO: 678612 - DNA, 25 bp, Artificial sequence
  Synthetic oligonucleotide
caccatggtaaatgaacaaattatc

SEQ ID NO: 678613 - DNA, 25 bp, Artificial sequence
  Synthetic oligonucleotide
tgatgaagcactcagagaacgcgga

SEQ ID NO: 678614 - DNA, 25 bp, Artificial sequence
  Synthetic oligonucleotide
gaaagaggagacattttatcttgtc

SEQ ID NO: 678615 - DNA, 25 bp, Artificial sequence
  Synthetic oligonucleotide
agatgccgttcataaggtcgattta

SEQ ID NO: 678616 - DNA, 25 bp, Artificial sequence
  Synthetic oligonucleotide
agatgccgttcaaaaggtcgattta

SEQ ID NO: 678617 - DNA, 25 bp, Artificial sequence
  Synthetic oligonucleotide
aaagctgcttgatcgaaaaaaagca

SEQ ID NO: 678618 - DNA, 25 bp, Artificial sequence
  Synthetic oligonucleotide
aaagctgcttgaacgaaaaaaagca

SEQ ID NO: 678619 - DNA, 25 bp, Artificial sequence
  Synthetic oligonucleotide
attgcccgatgctatgagaaaaaca

SEQ ID NO: 678620 - DNA, 25 bp, Artificial sequence
  Synthetic oligonucleotide
taaacggtttgcaagacagatgcgc

SEQ ID NO: 678621 - DNA, 25 bp, Artificial sequence
  Synthetic oligonucleotide
gaaagaggagactttttatcttgtc

SEQ ID NO: 678622 - DNA, 25 bp, Artificial sequence
  Synthetic oligonucleotide
tgggtgaaatgacgttgccgattca

SEQ ID NO: 678623 - DNA, 25 bp, Artificial sequence
  Synthetic oligonucleotide
gtgccaggctctctattttaaaggg

SEQ ID NO: 678624 - DNA, 25 bp, Artificial sequence
  Synthetic oligonucleotide
gtgccaggctctgtattttaaaggg

SEQ ID NO: 678625 - DNA, 25 bp, Artificial sequence
  Synthetic oligonucleotide
tattgattaatcaatgttggctgaa

SEQ ID NO: 678626 - DNA, 25 bp, Artificial sequence
  Synthetic oligonucleotide
tattgattaatctatgttggctgaa

SEQ ID NO: 678627 - DNA, 25 bp, Artificial sequence
  Synthetic oligonucleotide
agatataatcagccttctggaattt

SEQ ID NO: 678628 - DNA, 25 bp, Artificial sequence
  Synthetic oligonucleotide
agatataatcaggcttctggaattt

SEQ ID NO: 678629 - DNA, 25 bp, Artificial sequence
  Synthetic oligonucleotide
attgcccgatgcaatgagaaaaaca

SEQ ID NO: 678630 - DNA, 25 bp, Artificial sequence
  Synthetic oligonucleotide
aaaagagttagtggtcgcagatcta

SEQ ID NO: 678631 - DNA, 25 bp, Artificial sequence
  Synthetic oligonucleotide
tatcaaatatagtccgcgacactct

SEQ ID NO: 678632 - DNA, 25 bp, Artificial sequence
  Synthetic oligonucleotide
taagttgtatcgggccgatttagat

SEQ ID NO: 678633 - DNA, 25 bp, Artificial sequence
  Synthetic oligonucleotide
taagttgtatcgcgccgatttagat

SEQ ID NO: 678634 - DNA, 25 bp, Artificial sequence
  Synthetic oligonucleotide
ataaagtatcgccaatcctgctatc

SEQ ID NO: 678635 - DNA, 25 bp, Artificial sequence
  Synthetic oligonucleotide
ataaagtatcgcgaatcctgctatc

SEQ ID NO: 678636 - DNA, 25 bp, Artificial sequence
  Synthetic oligonucleotide
acatctcggatatcgccttgtttaa

SEQ ID NO: 678637 - DNA, 25 bp, Artificial sequence
  Synthetic oligonucleotide
acatctcggataacgccttgtttaa

SEQ ID NO: 678638 - DNA, 25 bp, Artificial sequence
  Synthetic oligonucleotide
tatcaaatatagaccgcgacactct

SEQ ID NO: 678639 - DNA, 25 bp, Artificial sequence
  Synthetic oligonucleotide
tgttaaaataccctcgcgtttcgaa

SEQ ID NO: 678640 - DNA, 25 bp, Artificial sequence
  Synthetic oligonucleotide
caataagatatacgcgtcgctttca

SEQ ID NO: 678641 - DNA, 25 bp, Artificial sequence
  Synthetic oligonucleotide
aaaagagttagtcgtcgcagatcta

SEQ ID NO: 678642 - DNA, 25 bp, Artificial sequence
  Synthetic oligonucleotide
tactgacgcgaactagttaacagaa

SEQ ID NO: 678643 - DNA, 25 bp, Artificial sequence
  Synthetic oligonucleotide
tactgacgcgaagtagttaacagaa

SEQ ID NO: 678644 - DNA, 25 bp, Artificial sequence
  Synthetic oligonucleotide
caagaagcgcgttttgtaactgatt

SEQ ID NO: 678645 - DNA, 25 bp, Artificial sequence
  Synthetic oligonucleotide
caagaagcgcgtattgtaactgatt

SEQ ID NO: 678646 - DNA, 25 bp, Artificial sequence
  Synthetic oligonucleotide
accgaaagttatcgctcgtttgtta

SEQ ID NO: 678647 - DNA, 25 bp, Artificial sequence
  Synthetic oligonucleotide
accgaaagttatggctcgtttgtta

SEQ ID NO: 678648 - DNA, 25 bp, Artificial sequence
  Synthetic oligonucleotide
tcttaataacgtacgatcgaaggga

SEQ ID NO: 678649 - DNA, 25 bp, Artificial sequence
  Synthetic oligonucleotide
tcttaataacgttcgatcgaaggga

SEQ ID NO: 678650 - DNA, 25 bp, Artificial sequence
  Synthetic oligonucleotide
gatttaatatgtggatccggactag

SEQ ID NO: 678651 - DNA, 25 bp, Artificial sequence
  Synthetic oligonucleotide
tgttaaaataccgtcgcgtttcgaa

SEQ ID NO: 678652 - DNA, 25 bp, Artificial sequence
  Synthetic oligonucleotide
tatcagagtccgacgtaaattccat

SEQ ID NO: 678653 - DNA, 25 bp, Artificial sequence
  Synthetic oligonucleotide
aagtcatagcgtaatcgcaccatta

SEQ ID NO: 678654 - DNA, 25 bp, Artificial sequence
  Synthetic oligonucleotide
gatttaatatgtcgatccggactag

SEQ ID NO: 678655 - DNA, 25 bp, Artificial sequence
  Synthetic oligonucleotide
aagtcatagcgttatcgcaccatta

SEQ ID NO: 678656 - DNA, 25 bp, Artificial sequence
  Synthetic oligonucleotide
aatccacgtaggtattacgtcagtt

SEQ ID NO: 678657 - DNA, 25 bp, Artificial sequence
  Synthetic oligonucleotide
aatccacgtaggaattacgtcagtt

SEQ ID NO: 678658 - DNA, 25 bp, Artificial sequence
  Synthetic oligonucleotide
agccgatcggacggtaataaattta

SEQ ID NO: 678659 - DNA, 25 bp, Artificial sequence
  Synthetic oligonucleotide
agccgatcggaccgtaataaattta

SEQ ID NO: 678660 - DNA, 25 bp, Artificial sequence
  Synthetic oligonucleotide
ttgtactcgaagaaacgcgtatgtt

SEQ ID NO: 678661 - DNA, 25 bp, Artificial sequence
  Synthetic oligonucleotide
ttgtactcgaagtaacgcgtatgtt

SEQ ID NO: 678662 - DNA, 25 bp, Artificial sequence
  Synthetic oligonucleotide
caataagatataggcgtcgctttca

SEQ ID NO: 678663 - DNA, 25 bp, Artificial sequence
  Synthetic oligonucleotide
caattaacatcgcgctaaacatgga

SEQ ID NO: 678664 - DNA, 25 bp, Artificial sequence
  Synthetic oligonucleotide
aacacagggtaaacgtcgtacaaat

SEQ ID NO: 678665 - DNA, 25 bp, Artificial sequence
  Synthetic oligonucleotide
tatcagagtccgtcgtaaattccat

SEQ ID NO: 678666 - DNA, 25 bp, Artificial sequence
  Synthetic oligonucleotide
aaccaataacgtttgccgcattgaa

SEQ ID NO: 678667 - DNA, 25 bp, Artificial sequence
  Synthetic oligonucleotide
aaccaataacgtatgccgcattgaa

SEQ ID NO: 678668 - DNA, 25 bp, Artificial sequence
  Synthetic oligonucleotide
attgaacattgtttcgcgtctttgg

SEQ ID NO: 678669 - DNA, 25 bp, Artificial sequence
  Synthetic oligonucleotide
attgaacattgtatcgcgtctttgg

SEQ ID NO: 678670 - DNA, 25 bp, Artificial sequence
  Synthetic oligonucleotide
aacacagggtaatcgtcgtacaaat

SEQ ID NO: 678671 - DNA, 25 bp, Artificial sequence
  Synthetic oligonucleotide
tttactcggcgtgcgatattactta

SEQ ID NO: 678672 - DNA, 25 bp, Artificial sequence
  Synthetic oligonucleotide
caaatagttcgaggtacgacgattt

SEQ ID NO: 678673 - DNA, 25 bp, Artificial sequence
  Synthetic oligonucleotide
tttactcggcgtccgatattactta

SEQ ID NO: 678674 - DNA, 25 bp, Artificial sequence
  Synthetic oligonucleotide
caattaacatcgggctaaacatgga

SEQ ID NO: 678675 - DNA, 25 bp, Artificial sequence
  Synthetic oligonucleotide
cacattacgcgtagaacgatattgt

SEQ ID NO: 678676 - DNA, 25 bp, Artificial sequence
  Synthetic oligonucleotide
ataatagaatctcgtacgctacctc

SEQ ID NO: 678677 - DNA, 25 bp, Artificial sequence
  Synthetic oligonucleotide
ataatagaatctggtacgctacctc

SEQ ID NO: 678678 - DNA, 25 bp, Artificial sequence
  Synthetic oligonucleotide
atagatgtatacccttcgactgtag

SEQ ID NO: 678679 - DNA, 25 bp, Artificial sequence
  Synthetic oligonucleotide
atagatgtatacgcttcgactgtag

SEQ ID NO: 678680 - DNA, 25 bp, Artificial sequence
  Synthetic oligonucleotide
ttgtctgttctcggttacgactata

SEQ ID NO: 678681 - DNA, 25 bp, Artificial sequence
  Synthetic oligonucleotide
ttgtctgttctccgttacgactata

SEQ ID NO: 678682 - DNA, 25 bp, Artificial sequence
  Synthetic oligonucleotide
ggtatacgcgattatacgcgtttaa

SEQ ID NO: 678683 - DNA, 25 bp, Artificial sequence
  Synthetic oligonucleotide
ggtatacgcgataatacgcgtttaa

SEQ ID NO: 678684 - DNA, 25 bp, Artificial sequence
  Synthetic oligonucleotide
gtttcagtactaaagcgcgtgttta

SEQ ID NO: 678685 - DNA, 25 bp, Artificial sequence
  Synthetic oligonucleotide
tagttttatagcagacgcgcattca

SEQ ID NO: 678686 - DNA, 25 bp, Artificial sequence
  Synthetic oligonucleotide
aagcttcgagtaacgatattctcga

SEQ ID NO: 678687 - DNA, 25 bp, Artificial sequence
  Synthetic oligonucleotide
cacattacgcgttgaacgatattgt

SEQ ID NO: 678688 - DNA, 25 bp, Artificial sequence
  Synthetic oligonucleotide
aagtaatagaacccgatacaggctt

SEQ ID NO: 678689 - DNA, 25 bp, Artificial sequence
  Synthetic oligonucleotide
aagtaatagaacgcgatacaggctt

SEQ ID NO: 678690 - DNA, 25 bp, Artificial sequence
  Synthetic oligonucleotide
aaacagtactagtgtcgcgattatc

SEQ ID NO: 678691 - DNA, 25 bp, Artificial sequence
  Synthetic oligonucleotide
aaacagtactagagtcgcgattatc

SEQ ID NO: 678692 - DNA, 25 bp, Artificial sequence
  Synthetic oligonucleotide
atacaagtatcgtcgttgtgtgaga

SEQ ID NO: 678693 - DNA, 25 bp, Artificial sequence
  Synthetic oligonucleotide
tagaattcgcctatacgagttcctt

SEQ ID NO: 678694 - DNA, 25 bp, Artificial sequence
  Synthetic oligonucleotide
atacaagtatcgacgttgtgtgaga

SEQ ID NO: 678695 - DNA, 25 bp, Artificial sequence
  Synthetic oligonucleotide
atctagtaagttggcgtacttcgaa

SEQ ID NO: 678696 - DNA, 25 bp, Artificial sequence
  Synthetic oligonucleotide
tagttttatagctgacgcgcattca

SEQ ID NO: 678697 - DNA, 25 bp, Artificial sequence
  Synthetic oligonucleotide
aaaagaggagtacgcgtaacatgta

SEQ ID NO: 678698 - DNA, 25 bp, Artificial sequence
  Synthetic oligonucleotide
ttctgacgttacaacggattagtac

SEQ ID NO: 678699 - DNA, 25 bp, Artificial sequence
  Synthetic oligonucleotide
atcaattgtcgccatctaatgcctt

SEQ ID NO: 678700 - DNA, 25 bp, Artificial sequence
  Synthetic oligonucleotide
atcaattgtcgcgatctaatgcctt

SEQ ID NO: 678701 - DNA, 25 bp, Artificial sequence
  Synthetic oligonucleotide
gatacccgttcgtactaatagtgtt

SEQ ID NO: 678702 - DNA, 25 bp, Artificial sequence
  Synthetic oligonucleotide
gatacccgttcgaactaatagtgtt

SEQ ID NO: 678703 - DNA, 25 bp, Artificial sequence
  Synthetic oligonucleotide
gttagttcgtatacgcgcaaaaaac

SEQ ID NO: 678704 - DNA, 25 bp, Artificial sequence
  Synthetic oligonucleotide
gttagttcgtattcgcgcaaaaaac

SEQ ID NO: 678705 - DNA, 25 bp, Artificial sequence
  Synthetic oligonucleotide
aaaagtcgtccaaagtcgatcatag

SEQ ID NO: 678706 - DNA, 25 bp, Artificial sequence
  Synthetic oligonucleotide
aaaagtcgtccatagtcgatcatag

SEQ ID NO: 678707 - DNA, 25 bp, Artificial sequence
  Synthetic oligonucleotide
caaatagttcgacgtacgacgattt

SEQ ID NO: 678708 - DNA, 25 bp, Artificial sequence
  Synthetic oligonucleotide
ttcatttaatcgaccgtcgcaatag

SEQ ID NO: 678709 - DNA, 25 bp, Artificial sequence
  Synthetic oligonucleotide
gtttcagtactatagcgcgtgttta

SEQ ID NO: 678710 - DNA, 25 bp, Artificial sequence
  Synthetic oligonucleotide
aaaagaggagtaggcgtaacatgta

SEQ ID NO: 678711 - DNA, 25 bp, Artificial sequence
  Synthetic oligonucleotide
gaaatatacgaccctagtagatcac

SEQ ID NO: 678712 - DNA, 25 bp, Artificial sequence
  Synthetic oligonucleotide
gaaatatacgacgctagtagatcac

SEQ ID NO: 678713 - DNA, 25 bp, Artificial sequence
  Synthetic oligonucleotide
cttattgtagttggtacgctcacat

SEQ ID NO: 678714 - DNA, 25 bp, Artificial sequence
  Synthetic oligonucleotide
cttattgtagttcgtacgctcacat

SEQ ID NO: 678715 - DNA, 25 bp, Artificial sequence
  Synthetic oligonucleotide
aaatgacgatacaagacgttctcca

SEQ ID NO: 678716 - DNA, 25 bp, Artificial sequence
  Synthetic oligonucleotide
aaatgacgatactagacgttctcca

SEQ ID NO: 678717 - DNA, 25 bp, Artificial sequence
  Synthetic oligonucleotide
aagcttcgagtatcgatattctcga

SEQ ID NO: 678718 - DNA, 25 bp, Artificial sequence
  Synthetic oligonucleotide
ttctgacgttactacggattagtac

SEQ ID NO: 678719 - DNA, 25 bp, Artificial sequence
  Synthetic oligonucleotide
ttcatttaatcgtccgtcgcaatag

SEQ ID NO: 678720 - DNA, 25 bp, Artificial sequence
  Synthetic oligonucleotide
ttttctcgcgcaatacgtatttggt

SEQ ID NO: 678721 - DNA, 25 bp, Artificial sequence
  Synthetic oligonucleotide
agtttgtacgcgatactacattcga

SEQ ID NO: 678722 - DNA, 25 bp, Artificial sequence
  Synthetic oligonucleotide
ttcacacgtaacgcgttaactctaa

SEQ ID NO: 678723 - DNA, 25 bp, Artificial sequence
  Synthetic oligonucleotide
ttcacacgtaacccgttaactctaa

SEQ ID NO: 678724 - DNA, 25 bp, Artificial sequence
  Synthetic oligonucleotide
ggtcactagtatcgtgcgttaatat

SEQ ID NO: 678725 - DNA, 25 bp, Artificial sequence
  Synthetic oligonucleotide
ggtcactagtatggtgcgttaatat

SEQ ID NO: 678726 - DNA, 25 bp, Artificial sequence
  Synthetic oligonucleotide
aatgtctagcgaacgcgtatttttc

SEQ ID NO: 678727 - DNA, 25 bp, Artificial sequence
  Synthetic oligonucleotide
aatgtctagcgatcgcgtatttttc

SEQ ID NO: 678728 - DNA, 25 bp, Artificial sequence
  Synthetic oligonucleotide
taactgcgcgtctagtagttaatca

SEQ ID NO: 678729 - DNA, 25 bp, Artificial sequence
  Synthetic oligonucleotide
atcacttcggtcgacaagaatagta

SEQ ID NO: 678730 - DNA, 25 bp, Artificial sequence
  Synthetic oligonucleotide
ttttctcgcgcattacgtatttggt

SEQ ID NO: 678731 - DNA, 25 bp, Artificial sequence
  Synthetic oligonucleotide
aattgaccgcgagtagtactattca

SEQ ID NO: 678732 - DNA, 25 bp, Artificial sequence
  Synthetic oligonucleotide
aaactagtaacgccgatacctgtat

SEQ ID NO: 678733 - DNA, 25 bp, Artificial sequence
  Synthetic oligonucleotide
aaactagtaacggcgatacctgtat

SEQ ID NO: 678734 - DNA, 25 bp, Artificial sequence
  Synthetic oligonucleotide
cgatttcatcgtaatacgactagga

SEQ ID NO: 678735 - DNA, 25 bp, Artificial sequence
  Synthetic oligonucleotide
cgatttcatcgttatacgactagga

SEQ ID NO: 678736 - DNA, 25 bp, Artificial sequence
  Synthetic oligonucleotide
acttaccagctattacgcgaactaa

SEQ ID NO: 678737 - DNA, 25 bp, Artificial sequence
  Synthetic oligonucleotide
acttaccagctaatacgcgaactaa

SEQ ID NO: 678738 - DNA, 25 bp, Artificial sequence
  Synthetic oligonucleotide
tgaaaatgcgatgcggttaatgcat

SEQ ID NO: 678739 - DNA, 25 bp, Artificial sequence
  Synthetic oligonucleotide
tgaaaatgcgatccggttaatgcat

SEQ ID NO: 678740 - DNA, 25 bp, Artificial sequence
  Synthetic oligonucleotide
tactaatagttcgtacgacattcgc

SEQ ID NO: 678741 - DNA, 25 bp, Artificial sequence
  Synthetic oligonucleotide
taactgcgcgtcaagtagttaatca

SEQ ID NO: 678742 - DNA, 25 bp, Artificial sequence
  Synthetic oligonucleotide
aatagtcttaccgcacgattagctt

SEQ ID NO: 678743 - DNA, 25 bp, Artificial sequence
  Synthetic oligonucleotide
ttccctctaatatgcgtcgtttcta

SEQ ID NO: 678744 - DNA, 25 bp, Artificial sequence
  Synthetic oligonucleotide
gagagacgcgctagtatataagttt

SEQ ID NO: 678745 - DNA, 25 bp, Artificial sequence
  Synthetic oligonucleotide
taatggcgatccgttatagtctaag

SEQ ID NO: 678746 - DNA, 25 bp, Artificial sequence
  Synthetic oligonucleotide
taatggcgatcccttatagtctaag

SEQ ID NO: 678747 - DNA, 25 bp, Artificial sequence
  Synthetic oligonucleotide
aactcatatggtgcgacgattacat

SEQ ID NO: 678748 - DNA, 25 bp, Artificial sequence
  Synthetic oligonucleotide
aactcatatggtccgacgattacat

SEQ ID NO: 678749 - DNA, 25 bp, Artificial sequence
  Synthetic oligonucleotide
tcatataatccgccgtattggaact

SEQ ID NO: 678750 - DNA, 25 bp, Artificial sequence
  Synthetic oligonucleotide
tcatataatccggcgtattggaact

SEQ ID NO: 678751 - DNA, 25 bp, Artificial sequence
  Synthetic oligonucleotide
ttgttgattcctacgcgtaaacagt

SEQ ID NO: 678752 - DNA, 25 bp, Artificial sequence
  Synthetic oligonucleotide
agtttgtacgcgttactacattcga

SEQ ID NO: 678753 - DNA, 25 bp, Artificial sequence
  Synthetic oligonucleotide
aatagtcttaccccacgattagctt

SEQ ID NO: 678754 - DNA, 25 bp, Artificial sequence
  Synthetic oligonucleotide
aattgaccgcgactagtactattca

SEQ ID NO: 678755 - DNA, 25 bp, Artificial sequence
  Synthetic oligonucleotide
aagaacgcgatacgacgtattatac

SEQ ID NO: 678756 - DNA, 25 bp, Artificial sequence
  Synthetic oligonucleotide
aagaacgcgataggacgtattatac

SEQ ID NO: 678757 - DNA, 25 bp, Artificial sequence
  Synthetic oligonucleotide
ctgataaagttacggctcgtaatgt

SEQ ID NO: 678758 - DNA, 25 bp, Artificial sequence
  Synthetic oligonucleotide
ctgataaagttagggctcgtaatgt

SEQ ID NO: 678759 - DNA, 25 bp, Artificial sequence
  Synthetic oligonucleotide
atctagtaagttcgcgtacttcgaa

SEQ ID NO: 678760 - DNA, 25 bp, Artificial sequence
  Synthetic oligonucleotide
tactaatagttcctacgacattcgc

SEQ ID NO: 678761 - DNA, 25 bp, Artificial sequence
  Synthetic oligonucleotide
atctgaatcgtattggacgtgtcta

SEQ ID NO: 678762 - DNA, 25 bp, Artificial sequence
  Synthetic oligonucleotide
atctgaatcgtaatggacgtgtcta

SEQ ID NO: 678763 - DNA, 25 bp, Artificial sequence
  Synthetic oligonucleotide
taattgtatcgacaacgcgtagtag

SEQ ID NO: 678764 - DNA, 25 bp, Artificial sequence
  Synthetic oligonucleotide
ttgttgattccttcgcgtaaacagt

SEQ ID NO: 678765 - DNA, 25 bp, Artificial sequence
  Synthetic oligonucleotide
aaaactacgatctcgcgtatactag

SEQ ID NO: 678766 - DNA, 25 bp, Artificial sequence
  Synthetic oligonucleotide
ttttaggataacggtacgacgcaaa

SEQ ID NO: 678767 - DNA, 25 bp, Artificial sequence
  Synthetic oligonucleotide
ttttaggataaccgtacgacgcaaa

SEQ ID NO: 678768 - DNA, 25 bp, Artificial sequence
  Synthetic oligonucleotide
agttaatagcgaacgttcgtcaagt

SEQ ID NO: 678769 - DNA, 25 bp, Artificial sequence
  Synthetic oligonucleotide
agttaatagcgatcgttcgtcaagt

SEQ ID NO: 678770 - DNA, 25 bp, Artificial sequence
  Synthetic oligonucleotide
tattaaaatctaaacggcgcccgat

SEQ ID NO: 678771 - DNA, 25 bp, Artificial sequence
  Synthetic oligonucleotide
tattaaaatctatacggcgcccgat

SEQ ID NO: 678772 - DNA, 25 bp, Artificial sequence
  Synthetic oligonucleotide
cccaaagcgtaactacgtaatatag

SEQ ID NO: 678773 - DNA, 25 bp, Artificial sequence
  Synthetic oligonucleotide
cccaaagcgtaagtacgtaatatag

SEQ ID NO: 678774 - DNA, 25 bp, Artificial sequence
  Synthetic oligonucleotide
atcacttcggtccacaagaatagta

SEQ ID NO: 678775 - DNA, 25 bp, Artificial sequence
  Synthetic oligonucleotide
tatcttttaccagttcgcgttgagt

SEQ ID NO: 678776 - DNA, 25 bp, Artificial sequence
  Synthetic oligonucleotide
tgtaccatacgagcgttacattcta

SEQ ID NO: 678777 - DNA, 25 bp, Artificial sequence
  Synthetic oligonucleotide
aaaactacgatcacgcgtatactag

SEQ ID NO: 678778 - DNA, 25 bp, Artificial sequence
  Synthetic oligonucleotide
ctagtaagtacgttacgctttgtct

SEQ ID NO: 678779 - DNA, 25 bp, Artificial sequence
  Synthetic oligonucleotide
ctagtaagtacgatacgctttgtct

SEQ ID NO: 678780 - DNA, 25 bp, Artificial sequence
  Synthetic oligonucleotide
tttgcctacgcacgattgtttttca

SEQ ID NO: 678781 - DNA, 25 bp, Artificial sequence
  Synthetic oligonucleotide
tttgcctacgcaggattgtttttca

SEQ ID NO: 678782 - DNA, 25 bp, Artificial sequence
  Synthetic oligonucleotide
tacaaacgatagaacgaccctatca

SEQ ID NO: 678783 - DNA, 25 bp, Artificial sequence
  Synthetic oligonucleotide
tacaaacgatagtacgaccctatca

SEQ ID NO: 678784 - DNA, 25 bp, Artificial sequence
  Synthetic oligonucleotide
taatgatcctacccgactaatacga

SEQ ID NO: 678785 - DNA, 25 bp, Artificial sequence
  Synthetic oligonucleotide
taatgatcctacgcgactaatacga

SEQ ID NO: 678786 - DNA, 25 bp, Artificial sequence
  Synthetic oligonucleotide
tatcttttaccacttcgcgttgagt

SEQ ID NO: 678787 - DNA, 25 bp, Artificial sequence
  Synthetic oligonucleotide
attataccgtcgaactaagtagtgg

SEQ ID NO: 678788 - DNA, 25 bp, Artificial sequence
  Synthetic oligonucleotide
taattgtatcgagaacgcgtagtag

SEQ ID NO: 678789 - DNA, 25 bp, Artificial sequence
  Synthetic oligonucleotide
tttatgatcccggaacgatgataag

SEQ ID NO: 678790 - DNA, 25 bp, Artificial sequence
  Synthetic oligonucleotide
tttatgatcccgcaacgatgataag

SEQ ID NO: 678791 - DNA, 25 bp, Artificial sequence
  Synthetic oligonucleotide
aaaatttatcggtctcacgtacagc

SEQ ID NO: 678792 - DNA, 25 bp, Artificial sequence
  Synthetic oligonucleotide
aaaatttatcggactcacgtacagc

SEQ ID NO: 678793 - DNA, 25 bp, Artificial sequence
  Synthetic oligonucleotide
cacaaaacgcggtatcgagaaatat

SEQ ID NO: 678794 - DNA, 25 bp, Artificial sequence
  Synthetic oligonucleotide
cacaaaacgcggaatcgagaaatat

SEQ ID NO: 678795 - DNA, 25 bp, Artificial sequence
  Synthetic oligonucleotide
actcaatatttaccgcggatatcac

SEQ ID NO: 678796 - DNA, 25 bp, Artificial sequence
  Synthetic oligonucleotide
actcaatatttagcgcggatatcac

SEQ ID NO: 678797 - DNA, 25 bp, Artificial sequence
  Synthetic oligonucleotide
tccttatatcgggcgtatatggtaa

SEQ ID NO: 678798 - DNA, 25 bp, Artificial sequence
  Synthetic oligonucleotide
tataacccgcgttgtaatatcttcg

SEQ ID NO: 678799 - DNA, 25 bp, Artificial sequence
  Synthetic oligonucleotide
tccttatatcggccgtatatggtaa

SEQ ID NO: 678800 - DNA, 25 bp, Artificial sequence
  Synthetic oligonucleotide
attataccgtcgtactaagtagtgg

SEQ ID NO: 678801 - DNA, 25 bp, Artificial sequence
  Synthetic oligonucleotide
gaggatttagcgacgactaattttc

SEQ ID NO: 678802 - DNA, 25 bp, Artificial sequence
  Synthetic oligonucleotide
gaggatttagcgtcgactaattttc

SEQ ID NO: 678803 - DNA, 25 bp, Artificial sequence
  Synthetic oligonucleotide
cttaaactaacgtcgcttaccgata

SEQ ID NO: 678804 - DNA, 25 bp, Artificial sequence
  Synthetic oligonucleotide
cttaaactaacgacgcttaccgata

SEQ ID NO: 678805 - DNA, 25 bp, Artificial sequence
  Synthetic oligonucleotide
gaatttgtcgacacgatactgaaca

SEQ ID NO: 678806 - DNA, 25 bp, Artificial sequence
  Synthetic oligonucleotide
gaatttgtcgactcgatactgaaca

SEQ ID NO: 678807 - DNA, 25 bp, Artificial sequence
  Synthetic oligonucleotide
tgtaccatacgaccgttacattcta

SEQ ID NO: 678808 - DNA, 25 bp, Artificial sequence
  Synthetic oligonucleotide
tagaattcgcctttacgagttcctt

SEQ ID NO: 678809 - DNA, 25 bp, Artificial sequence
  Synthetic oligonucleotide
tataacccgcgtagtaatatcttcg

SEQ ID NO: 678810 - DNA, 25 bp, Artificial sequence
  Synthetic oligonucleotide
cgtttttcacgacccgtatattgta

SEQ ID NO: 678811 - DNA, 25 bp, Artificial sequence
  Synthetic oligonucleotide
tttcgttatcgctcgatagcttatc

SEQ ID NO: 678812 - DNA, 25 bp, Artificial sequence
  Synthetic oligonucleotide
tttcgttatcgcacgatagcttatc

SEQ ID NO: 678813 - DNA, 25 bp, Artificial sequence
  Synthetic oligonucleotide
tactagcgcgattatagtcacactt

SEQ ID NO: 678814 - DNA, 25 bp, Artificial sequence
  Synthetic oligonucleotide
tactagcgcgataatagtcacactt

SEQ ID NO: 678815 - DNA, 25 bp, Artificial sequence
  Synthetic oligonucleotide
tagttgacgtaacgtcgtaagtttg

SEQ ID NO: 678816 - DNA, 25 bp, Artificial sequence
  Synthetic oligonucleotide
tagttgacgtaaggtcgtaagtttg

SEQ ID NO: 678817 - DNA, 25 bp, Artificial sequence
  Synthetic oligonucleotide
aacaagacggttttacgtcaacaca

SEQ ID NO: 678818 - DNA, 25 bp, Artificial sequence
  Synthetic oligonucleotide
aacaagacggttatacgtcaacaca

SEQ ID NO: 678819 - DNA, 25 bp, Artificial sequence
  Synthetic oligonucleotide
tgctctacgtacgttacgagtaaaa

SEQ ID NO: 678820 - DNA, 25 bp, Artificial sequence
  Synthetic oligonucleotide
tgctctacgtaccttacgagtaaaa

SEQ ID NO: 678821 - DNA, 25 bp, Artificial sequence
  Synthetic oligonucleotide
atcattgtacgtggcgtaagtattc

SEQ ID NO: 678822 - DNA, 25 bp, Artificial sequence
  Synthetic oligonucleotide
aaaaagaccgcgtaaagtgtcaatc

SEQ ID NO: 678823 - DNA, 25 bp, Artificial sequence
  Synthetic oligonucleotide
cgtttttcacgagccgtatattgta

SEQ ID NO: 678824 - DNA, 25 bp, Artificial sequence
  Synthetic oligonucleotide
aaatcaataggcgacgtaacatagc

SEQ ID NO: 678825 - DNA, 25 bp, Artificial sequence
  Synthetic oligonucleotide
tttgtccgtatgtcgaaccaataag

SEQ ID NO: 678826 - DNA, 25 bp, Artificial sequence
  Synthetic oligonucleotide
tttgtccgtatgacgaaccaataag

SEQ ID NO: 678827 - DNA, 25 bp, Artificial sequence
  Synthetic oligonucleotide
caagatagtctaatacgcgcataag

SEQ ID NO: 678828 - DNA, 25 bp, Artificial sequence
  Synthetic oligonucleotide
caagatagtctattacgcgcataag

SEQ ID NO: 678829 - DNA, 25 bp, Artificial sequence
  Synthetic oligonucleotide
atcatgggtcgttatacgtaagtag

SEQ ID NO: 678830 - DNA, 25 bp, Artificial sequence
  Synthetic oligonucleotide
atcatgggtcgtaatacgtaagtag

SEQ ID NO: 678831 - DNA, 25 bp, Artificial sequence
  Synthetic oligonucleotide
ctctaccggcttaatacgaatactt

SEQ ID NO: 678832 - DNA, 25 bp, Artificial sequence
  Synthetic oligonucleotide
ctctaccggctttatacgaatactt

SEQ ID NO: 678833 - DNA, 25 bp, Artificial sequence
  Synthetic oligonucleotide
tagttctgcggtaacgatagcaatt

SEQ ID NO: 678834 - DNA, 25 bp, Artificial sequence
  Synthetic oligonucleotide
tagttctgcggttacgatagcaatt

SEQ ID NO: 678835 - DNA, 25 bp, Artificial sequence
  Synthetic oligonucleotide
agttagtgtcggttagacgttatac

SEQ ID NO: 678836 - DNA, 25 bp, Artificial sequence
  Synthetic oligonucleotide
atcattgtacgtcgcgtaagtattc

SEQ ID NO: 678837 - DNA, 25 bp, Artificial sequence
  Synthetic oligonucleotide
attgccccgaacgtacttattatag

SEQ ID NO: 678838 - DNA, 25 bp, Artificial sequence
  Synthetic oligonucleotide
aggactcgtcctatctacgaatatt

SEQ ID NO: 678839 - DNA, 25 bp, Artificial sequence
  Synthetic oligonucleotide
agaatgcgtaacgttacggaatctt

SEQ ID NO: 678840 - DNA, 25 bp, Artificial sequence
  Synthetic oligonucleotide
aggactcgtcctttctacgaatatt

SEQ ID NO: 678841 - DNA, 25 bp, Artificial sequence
  Synthetic oligonucleotide
gagagacgcgcttgtatataagttt

SEQ ID NO: 678842 - DNA, 25 bp, Artificial sequence
  Synthetic oligonucleotide
accatcatacgctatcgtcttaagt

SEQ ID NO: 678843 - DNA, 25 bp, Artificial sequence
  Synthetic oligonucleotide
accatcatacgcaatcgtcttaagt

SEQ ID NO: 678844 - DNA, 25 bp, Artificial sequence
  Synthetic oligonucleotide
gagaatacgcacgatactaaactca

SEQ ID NO: 678845 - DNA, 25 bp, Artificial sequence
  Synthetic oligonucleotide
gagaatacgcaccatactaaactca

SEQ ID NO: 678846 - DNA, 25 bp, Artificial sequence
  Synthetic oligonucleotide
agatctgcgacctttcgtactaata

SEQ ID NO: 678847 - DNA, 25 bp, Artificial sequence
  Synthetic oligonucleotide
agatctgcgaccattcgtactaata

SEQ ID NO: 678848 - DNA, 25 bp, Artificial sequence
  Synthetic oligonucleotide
ttataaaccgagtagatcggatacg

SEQ ID NO: 678849 - DNA, 25 bp, Artificial sequence
  Synthetic oligonucleotide
gattaaatatgaggcgcgaaagatg

SEQ ID NO: 678850 - DNA, 25 bp, Artificial sequence
  Synthetic oligonucleotide
attgccccgaacctacttattatag

SEQ ID NO: 678851 - DNA, 25 bp, Artificial sequence
  Synthetic oligonucleotide
gattaaatatgacgcgcgaaagatg

SEQ ID NO: 678852 - DNA, 25 bp, Artificial sequence
  Synthetic oligonucleotide
cttttgcttatttgcgcgacttagt

SEQ ID NO: 678853 - DNA, 25 bp, Artificial sequence
  Synthetic oligonucleotide
cttttgcttattagcgcgacttagt

SEQ ID NO: 678854 - DNA, 25 bp, Artificial sequence
  Synthetic oligonucleotide
aaggtgaatatgggcgtcgtaaata

SEQ ID NO: 678855 - DNA, 25 bp, Artificial sequence
  Synthetic oligonucleotide
aaggtgaatatgcgcgtcgtaaata

SEQ ID NO: 678856 - DNA, 25 bp, Artificial sequence
  Synthetic oligonucleotide
aatgttcttatagcgcggtcacata

SEQ ID NO: 678857 - DNA, 25 bp, Artificial sequence
  Synthetic oligonucleotide
aatgttcttataccgcggtcacata

SEQ ID NO: 678858 - DNA, 25 bp, Artificial sequence
  Synthetic oligonucleotide
actaatgcgtatttcgatcccctat

SEQ ID NO: 678859 - DNA, 25 bp, Artificial sequence
  Synthetic oligonucleotide
actaatgcgtatatcgatcccctat

SEQ ID NO: 678860 - DNA, 25 bp, Artificial sequence
  Synthetic oligonucleotide
aaggtccgcgaaatagtgacatttt

SEQ ID NO: 678861 - DNA, 25 bp, Artificial sequence
  Synthetic oligonucleotide
aaggtccgcgaattagtgacatttt

SEQ ID NO: 678862 - DNA, 25 bp, Artificial sequence
  Synthetic oligonucleotide
aaatcaataggccacgtaacatagc

SEQ ID NO: 678863 - DNA, 25 bp, Artificial sequence
  Synthetic oligonucleotide
gatctgcgttacgcgttattaaatg

SEQ ID NO: 678864 - DNA, 25 bp, Artificial sequence
  Synthetic oligonucleotide
ttataaaccgagaagatcggatacg

SEQ ID NO: 678865 - DNA, 25 bp, Artificial sequence
  Synthetic oligonucleotide
atattgtaacgctagacgctatacc

SEQ ID NO: 678866 - DNA, 25 bp, Artificial sequence
  Synthetic oligonucleotide
cattattacggtgggtacagattac

SEQ ID NO: 678867 - DNA, 25 bp, Artificial sequence
  Synthetic oligonucleotide
cattattacggtcggtacagattac

SEQ ID NO: 678868 - DNA, 25 bp, Artificial sequence
  Synthetic oligonucleotide
ctgtgttagtacgagcgattgattt

SEQ ID NO: 678869 - DNA, 25 bp, Artificial sequence
  Synthetic oligonucleotide
ctgtgttagtaccagcgattgattt

SEQ ID NO: 678870 - DNA, 25 bp, Artificial sequence
  Synthetic oligonucleotide
tatgcttatctcgcgattagtgatg

SEQ ID NO: 678871 - DNA, 25 bp, Artificial sequence
  Synthetic oligonucleotide
tatgcttatctcccgattagtgatg

SEQ ID NO: 678872 - DNA, 25 bp, Artificial sequence
  Synthetic oligonucleotide
gacataatattccacggacagatag

SEQ ID NO: 678873 - DNA, 25 bp, Artificial sequence
  Synthetic oligonucleotide
gacataatattcgacggacagatag

SEQ ID NO: 678874 - DNA, 25 bp, Artificial sequence
  Synthetic oligonucleotide
gttttgcgtatcgtaacgtattcga

SEQ ID NO: 678875 - DNA, 25 bp, Artificial sequence
  Synthetic oligonucleotide
caaaccttacctcgacgtatactta

SEQ ID NO: 678876 - DNA, 25 bp, Artificial sequence
  Synthetic oligonucleotide
atacactcgcgacagactagataaa

SEQ ID NO: 678877 - DNA, 25 bp, Artificial sequence
  Synthetic oligonucleotide
aaaaagaccgcgaaaagtgtcaatc

SEQ ID NO: 678878 - DNA, 25 bp, Artificial sequence
  Synthetic oligonucleotide
atattgtaacgcaagacgctatacc

SEQ ID NO: 678879 - DNA, 25 bp, Artificial sequence
  Synthetic oligonucleotide
ccatatcttagttcgcgaaccaata

SEQ ID NO: 678880 - DNA, 25 bp, Artificial sequence
  Synthetic oligonucleotide
ctagttgatctacgcgctattgtta

SEQ ID NO: 678881 - DNA, 25 bp, Artificial sequence
  Synthetic oligonucleotide
tgactacgacgtacgtacagtattt

SEQ ID NO: 678882 - DNA, 25 bp, Artificial sequence
  Synthetic oligonucleotide
tgactacgacgttcgtacagtattt

SEQ ID NO: 678883 - DNA, 25 bp, Artificial sequence
  Synthetic oligonucleotide
aatagcttcgcgtaactacagatga

SEQ ID NO: 678884 - DNA, 25 bp, Artificial sequence
  Synthetic oligonucleotide
aatagcttcgcgaaactacagatga

SEQ ID NO: 678885 - DNA, 25 bp, Artificial sequence
  Synthetic oligonucleotide
tattatctatacacgaacgagccga

SEQ ID NO: 678886 - DNA, 25 bp, Artificial sequence
  Synthetic oligonucleotide
tattatctatactcgaacgagccga

SEQ ID NO: 678887 - DNA, 25 bp, Artificial sequence
  Synthetic oligonucleotide
ttagtgttatacccgtaggtttgac

SEQ ID NO: 678888 - DNA, 25 bp, Artificial sequence
  Synthetic oligonucleotide
ttagtgttatacgcgtaggtttgac

SEQ ID NO: 678889 - DNA, 25 bp, Artificial sequence
  Synthetic oligonucleotide
agaatgcgtaaccttacggaatctt

SEQ ID NO: 678890 - DNA, 25 bp, Artificial sequence
  Synthetic oligonucleotide
ttccctctaataagcgtcgtttcta

SEQ ID NO: 678891 - DNA, 25 bp, Artificial sequence
  Synthetic oligonucleotide
atacactcgcgagagactagataaa

SEQ ID NO: 678892 - DNA, 25 bp, Artificial sequence
  Synthetic oligonucleotide
cgctagcgcgaataggtatttatat

SEQ ID NO: 678893 - DNA, 25 bp, Artificial sequence
  Synthetic oligonucleotide
gatctgcgttacccgttattaaatg

SEQ ID NO: 678894 - DNA, 25 bp, Artificial sequence
  Synthetic oligonucleotide
cgtaaaacgcgtaactatcactatg

SEQ ID NO: 678895 - DNA, 25 bp, Artificial sequence
  Synthetic oligonucleotide
cgtaaaacgcgttactatcactatg

SEQ ID NO: 678896 - DNA, 25 bp, Artificial sequence
  Synthetic oligonucleotide
atcctgtgtcgaaccgttaaaatga

SEQ ID NO: 678897 - DNA, 25 bp, Artificial sequence
  Synthetic oligonucleotide
atcctgtgtcgatccgttaaaatga

SEQ ID NO: 678898 - DNA, 25 bp, Artificial sequence
  Synthetic oligonucleotide
caacagtaacgttaaggcgttgata

SEQ ID NO: 678899 - DNA, 25 bp, Artificial sequence
  Synthetic oligonucleotide
caacagtaacgtaaaggcgttgata

SEQ ID NO: 678900 - DNA, 25 bp, Artificial sequence
  Synthetic oligonucleotide
cacaatatgtcgggagatagtatgt

SEQ ID NO: 678901 - DNA, 25 bp, Artificial sequence
  Synthetic oligonucleotide
cacaatatgtcgcgagatagtatgt

SEQ ID NO: 678902 - DNA, 25 bp, Artificial sequence
  Synthetic oligonucleotide
taaatccgttgcgatacggttgata

SEQ ID NO: 678903 - DNA, 25 bp, Artificial sequence
  Synthetic oligonucleotide
taaatccgttgccatacggttgata

SEQ ID NO: 678904 - DNA, 25 bp, Artificial sequence
  Synthetic oligonucleotide
taactgtacgcgttctaagtagtag

SEQ ID NO: 678905 - DNA, 25 bp, Artificial sequence
  Synthetic oligonucleotide
tacccacgctattttagcgaaaaag

SEQ ID NO: 678906 - DNA, 25 bp, Artificial sequence
  Synthetic oligonucleotide
taactgtacgcgatctaagtagtag

SEQ ID NO: 678907 - DNA, 25 bp, Artificial sequence
  Synthetic oligonucleotide
cgctagcgcgaaaaggtatttatat

SEQ ID NO: 678908 - DNA, 25 bp, Artificial sequence
  Synthetic oligonucleotide
actaaccgcacgataagtaagagtt

SEQ ID NO: 678909 - DNA, 25 bp, Artificial sequence
  Synthetic oligonucleotide
actaaccgcacgttaagtaagagtt

SEQ ID NO: 678910 - DNA, 25 bp, Artificial sequence
  Synthetic oligonucleotide
acattgacccgatcgtttaactcta

SEQ ID NO: 678911 - DNA, 25 bp, Artificial sequence
  Synthetic oligonucleotide
acattgacccgaacgtttaactcta

SEQ ID NO: 678912 - DNA, 25 bp, Artificial sequence
  Synthetic oligonucleotide
aattaagtctaccgcgtcacaagat

SEQ ID NO: 678913 - DNA, 25 bp, Artificial sequence
  Synthetic oligonucleotide
aattaagtctacggcgtcacaagat

SEQ ID NO: 678914 - DNA, 25 bp, Artificial sequence
  Synthetic oligonucleotide
ctagttgatctaggcgctattgtta

SEQ ID NO: 678915 - DNA, 25 bp, Artificial sequence
  Synthetic oligonucleotide
tataacaggtaccttacgcagtttg

SEQ ID NO: 678916 - DNA, 25 bp, Artificial sequence
  Synthetic oligonucleotide
tataacaggtacgttacgcagtttg

SEQ ID NO: 678917 - DNA, 25 bp, Artificial sequence
  Synthetic oligonucleotide
ccatatcttagtacgcgaaccaata

SEQ ID NO: 678918 - DNA, 25 bp, Artificial sequence
  Synthetic oligonucleotide
gttttgcgtatcctaacgtattcga

SEQ ID NO: 678919 - DNA, 25 bp, Artificial sequence
  Synthetic oligonucleotide
tacccacgctatattagcgaaaaag

SEQ ID NO: 678920 - DNA, 25 bp, Artificial sequence
  Synthetic oligonucleotide
gatattcagtataacgcgcgtgttt

SEQ ID NO: 678921 - DNA, 25 bp, Artificial sequence
  Synthetic oligonucleotide
cattatatagttcgaccgttcgagt

SEQ ID NO: 678922 - DNA, 25 bp, Artificial sequence
  Synthetic oligonucleotide
cattatatagttggaccgttcgagt

SEQ ID NO: 678923 - DNA, 25 bp, Artificial sequence
  Synthetic oligonucleotide
tgttacgatgcgggattaacatcta

SEQ ID NO: 678924 - DNA, 25 bp, Artificial sequence
  Synthetic oligonucleotide
tgttacgatgcgcgattaacatcta

SEQ ID NO: 678925 - DNA, 25 bp, Artificial sequence
  Synthetic oligonucleotide
ttagttactcgccacgtattaactc

SEQ ID NO: 678926 - DNA, 25 bp, Artificial sequence
  Synthetic oligonucleotide
ttagttactcgcgacgtattaactc

SEQ ID NO: 678927 - DNA, 25 bp, Artificial sequence
  Synthetic oligonucleotide
aaatcttctatccgctacgtcaatc

SEQ ID NO: 678928 - DNA, 25 bp, Artificial sequence
  Synthetic oligonucleotide
aaatcttctatcggctacgtcaatc

SEQ ID NO: 678929 - DNA, 25 bp, Artificial sequence
  Synthetic oligonucleotide
accaccatagatggtcgcaatttaa

SEQ ID NO: 678930 - DNA, 25 bp, Artificial sequence
  Synthetic oligonucleotide
accaccatagatcgtcgcaatttaa

SEQ ID NO: 678931 - DNA, 25 bp, Artificial sequence
  Synthetic oligonucleotide
ctgaaatcgcgctcgattaaaaatg

SEQ ID NO: 678932 - DNA, 25 bp, Artificial sequence
  Synthetic oligonucleotide
actcatctacgggacgtaattcata

SEQ ID NO: 678933 - DNA, 25 bp, Artificial sequence
  Synthetic oligonucleotide
gatattcagtattacgcgcgtgttt

SEQ ID NO: 678934 - DNA, 25 bp, Artificial sequence
  Synthetic oligonucleotide
gagattcgtataggtcgcgaaaata

SEQ ID NO: 678935 - DNA, 25 bp, Artificial sequence
  Synthetic oligonucleotide
atctacatgcgaggcagtacaatta

SEQ ID NO: 678936 - DNA, 25 bp, Artificial sequence
  Synthetic oligonucleotide
atctacatgcgacgcagtacaatta

SEQ ID NO: 678937 - DNA, 25 bp, Artificial sequence
  Synthetic oligonucleotide
agtaaagcgttattgcgaacttcct

SEQ ID NO: 678938 - DNA, 25 bp, Artificial sequence
  Synthetic oligonucleotide
agtaaagcgttaatgcgaacttcct

SEQ ID NO: 678939 - DNA, 25 bp, Artificial sequence
  Synthetic oligonucleotide
catacttacgattagcgcgagaata

SEQ ID NO: 678940 - DNA, 25 bp, Artificial sequence
  Synthetic oligonucleotide
catacttacgataagcgcgagaata

SEQ ID NO: 678941 - DNA, 25 bp, Artificial sequence
  Synthetic oligonucleotide
attagtcgccgtaataaccaccaaa

SEQ ID NO: 678942 - DNA, 25 bp, Artificial sequence
  Synthetic oligonucleotide
attagtcgccgttataaccaccaaa

SEQ ID NO: 678943 - DNA, 25 bp, Artificial sequence
  Synthetic oligonucleotide
gtatctcgttatggacgctgtataa

SEQ ID NO: 678944 - DNA, 25 bp, Artificial sequence
  Synthetic oligonucleotide
gtatctcgttatcgacgctgtataa

SEQ ID NO: 678945 - DNA, 25 bp, Artificial sequence
  Synthetic oligonucleotide
actcatctacggcacgtaattcata

SEQ ID NO: 678946 - DNA, 25 bp, Artificial sequence
  Synthetic oligonucleotide
ctgaaatcgcgcacgattaaaaatg

SEQ ID NO: 678947 - DNA, 25 bp, Artificial sequence
  Synthetic oligonucleotide
ttagtagatagtggctacgtgatgt

SEQ ID NO: 678948 - DNA, 25 bp, Artificial sequence
  Synthetic oligonucleotide
gttatgtagtatacgcgcactactt

SEQ ID NO: 678949 - DNA, 25 bp, Artificial sequence
  Synthetic oligonucleotide
gttatgtagtattcgcgcactactt

SEQ ID NO: 678950 - DNA, 25 bp, Artificial sequence
  Synthetic oligonucleotide
caaaccttacctggacgtatactta

SEQ ID NO: 678951 - DNA, 25 bp, Artificial sequence
  Synthetic oligonucleotide
agttagtgtcggatagacgttatac

SEQ ID NO: 678952 - DNA, 25 bp, Artificial sequence
  Synthetic oligonucleotide
tgtatggttcgaatagtcgaatcga

SEQ ID NO: 678953 - DNA, 25 bp, Artificial sequence
  Synthetic oligonucleotide
tgtatggttcgattagtcgaatcga

SEQ ID NO: 678954 - DNA, 25 bp, Artificial sequence
  Synthetic oligonucleotide
gtctgccgtgcgttaatctatattt

SEQ ID NO: 678955 - DNA, 25 bp, Artificial sequence
  Synthetic oligonucleotide
gtctgccgtgcgataatctatattt

SEQ ID NO: 678956 - DNA, 25 bp, Artificial sequence
  Synthetic oligonucleotide
atactaatcacgggcgtaaaatcct

SEQ ID NO: 678957 - DNA, 25 bp, Artificial sequence
  Synthetic oligonucleotide
atactaatcacgcgcgtaaaatcct

SEQ ID NO: 678958 - DNA, 25 bp, Artificial sequence
  Synthetic oligonucleotide
aactaaacgatatgtcgcgaagaca

SEQ ID NO: 678959 - DNA, 25 bp, Artificial sequence
  Synthetic oligonucleotide
tattacacggttgcgcgttatgata

SEQ ID NO: 678960 - DNA, 25 bp, Artificial sequence
  Synthetic oligonucleotide
ttagtagatagtcgctacgtgatgt

SEQ ID NO: 678961 - DNA, 25 bp, Artificial sequence
  Synthetic oligonucleotide
tattacacggttccgcgttatgata

SEQ ID NO: 678962 - DNA, 25 bp, Artificial sequence
  Synthetic oligonucleotide
actttagtatcgactagcgtagtac

SEQ ID NO: 678963 - DNA, 25 bp, Artificial sequence
  Synthetic oligonucleotide
actttagtatcgtctagcgtagtac

SEQ ID NO: 678964 - DNA, 25 bp, Artificial sequence
  Synthetic oligonucleotide
ttctgttcgcgatcaatcatacgat

SEQ ID NO: 678965 - DNA, 25 bp, Artificial sequence
  Synthetic oligonucleotide
ttctgttcgcgaacaatcatacgat

SEQ ID NO: 678966 - DNA, 25 bp, Artificial sequence
  Synthetic oligonucleotide
agtaattacggcgctactactactt

SEQ ID NO: 678967 - DNA, 25 bp, Artificial sequence
  Synthetic oligonucleotide
agtaattacggccctactactactt

SEQ ID NO: 678968 - DNA, 25 bp, Artificial sequence
  Synthetic oligonucleotide
attatctagtattccgcgagtatgc

SEQ ID NO: 678969 - DNA, 25 bp, Artificial sequence
  Synthetic oligonucleotide
attatctagtataccgcgagtatgc

SEQ ID NO: 678970 - DNA, 25 bp, Artificial sequence
  Synthetic oligonucleotide
catgtattgtcgcgaacgatcatat

SEQ ID NO: 678971 - DNA, 25 bp, Artificial sequence
  Synthetic oligonucleotide
catgtattgtcgggaacgatcatat

SEQ ID NO: 678972 - DNA, 25 bp, Artificial sequence
  Synthetic oligonucleotide
gagattcgtatacgtcgcgaaaata

SEQ ID NO: 678973 - DNA, 25 bp, Artificial sequence
  Synthetic oligonucleotide
gtcttatagtcaggattcgactaga

SEQ ID NO: 678974 - DNA, 25 bp, Artificial sequence
  Synthetic oligonucleotide
gtcttatagtcacgattcgactaga

SEQ ID NO: 678975 - DNA, 25 bp, Artificial sequence
  Synthetic oligonucleotide
cgaataagattactcgcgaacattc

SEQ ID NO: 678976 - DNA, 25 bp, Artificial sequence
  Synthetic oligonucleotide
acataatcgcacccgtttatgtcta

SEQ ID NO: 678977 - DNA, 25 bp, Artificial sequence
  Synthetic oligonucleotide
gcattattcatacgacgcagtactt

SEQ ID NO: 678978 - DNA, 25 bp, Artificial sequence
  Synthetic oligonucleotide
gcattattcataggacgcagtactt

SEQ ID NO: 678979 - DNA, 25 bp, Artificial sequence
  Synthetic oligonucleotide
tattggcgcgtcgttattagaagaa

SEQ ID NO: 678980 - DNA, 25 bp, Artificial sequence
  Synthetic oligonucleotide
tattggcgcgtccttattagaagaa

SEQ ID NO: 678981 - DNA, 25 bp, Artificial sequence
  Synthetic oligonucleotide
tgagtaggacgccttatatgaatca

SEQ ID NO: 678982 - DNA, 25 bp, Artificial sequence
  Synthetic oligonucleotide
tgagtaggacgcgttatatgaatca

SEQ ID NO: 678983 - DNA, 25 bp, Artificial sequence
  Synthetic oligonucleotide
atttacaacgtacgatcgaccatga

SEQ ID NO: 678984 - DNA, 25 bp, Artificial sequence
  Synthetic oligonucleotide
atttacaacgtaggatcgaccatga

SEQ ID NO: 678985 - DNA, 25 bp, Artificial sequence
  Synthetic oligonucleotide
agcaaacgtactttaacggctctaa

SEQ ID NO: 678986 - DNA, 25 bp, Artificial sequence
  Synthetic oligonucleotide
agcaaacgtactataacggctctaa

SEQ ID NO: 678987 - DNA, 25 bp, Artificial sequence
  Synthetic oligonucleotide
acataatcgcacgcgtttatgtcta

SEQ ID NO: 678988 - DNA, 25 bp, Artificial sequence
  Synthetic oligonucleotide
gaaaccacgattgatacgctgtaat

SEQ ID NO: 678989 - DNA, 25 bp, Artificial sequence
  Synthetic oligonucleotide
gaaacacgtatttcgacctcacaat

SEQ ID NO: 678990 - DNA, 25 bp, Artificial sequence
  Synthetic oligonucleotide
cgaataagattagtcgcgaacattc

SEQ ID NO: 678991 - DNA, 25 bp, Artificial sequence
  Synthetic oligonucleotide
gaaacacgtattacgacctcacaat

SEQ ID NO: 678992 - DNA, 25 bp, Artificial sequence
  Synthetic oligonucleotide
tagatttagagccttacgccatcta

SEQ ID NO: 678993 - DNA, 25 bp, Artificial sequence
  Synthetic oligonucleotide
ataaaaggcgttagtcgaagcatca

SEQ ID NO: 678994 - DNA, 25 bp, Artificial sequence
  Synthetic oligonucleotide
ataaaaggcgtttgtcgaagcatca

SEQ ID NO: 678995 - DNA, 25 bp, Artificial sequence
  Synthetic oligonucleotide
gttagaatattcgatcgcgttcgat

SEQ ID NO: 678996 - DNA, 25 bp, Artificial sequence
  Synthetic oligonucleotide
gttagaatattccatcgcgttcgat

SEQ ID NO: 678997 - DNA, 25 bp, Artificial sequence
  Synthetic oligonucleotide
gtatcttatatgctcgcggaaaagt

SEQ ID NO: 678998 - DNA, 25 bp, Artificial sequence
  Synthetic oligonucleotide
aactaaacgataagtcgcgaagaca

SEQ ID NO: 678999 - DNA, 25 bp, Artificial sequence
  Synthetic oligonucleotide
caacagcgcgtaactcgaaaaaaat

SEQ ID NO: 679000 - DNA, 25 bp, Artificial sequence
  Synthetic oligonucleotide
caacagcgcgtatctcgaaaaaaat

SEQ ID NO: 679001 - DNA, 25 bp, Artificial sequence
  Synthetic oligonucleotide
gaaaccacgattcatacgctgtaat

SEQ ID NO: 679002 - DNA, 25 bp, Artificial sequence
  Synthetic oligonucleotide
aataagaacgcgtactcgtcaaaac

SEQ ID NO: 679003 - DNA, 25 bp, Artificial sequence
  Synthetic oligonucleotide
tacataacgcgagtagttagtctgt

SEQ ID NO: 679004 - DNA, 25 bp, Artificial sequence
  Synthetic oligonucleotide
tagatttagagcgttacgccatcta

SEQ ID NO: 679005 - DNA, 25 bp, Artificial sequence
  Synthetic oligonucleotide
attgaacacgtatggcgtaccttta

SEQ ID NO: 679006 - DNA, 25 bp, Artificial sequence
  Synthetic oligonucleotide
tacataacgcgactagttagtctgt

SEQ ID NO: 679007 - DNA, 25 bp, Artificial sequence
  Synthetic oligonucleotide
atcatttcgcgaacgtaaacagaag

SEQ ID NO: 679008 - DNA, 25 bp, Artificial sequence
  Synthetic oligonucleotide
atgtgagtaacgatcgacaaacagt

SEQ ID NO: 679009 - DNA, 25 bp, Artificial sequence
  Synthetic oligonucleotide
atcatttcgcgatcgtaaacagaag

SEQ ID NO: 679010 - DNA, 25 bp, Artificial sequence
  Synthetic oligonucleotide
atgtgagtaacgttcgacaaacagt

SEQ ID NO: 679011 - DNA, 25 bp, Artificial sequence
  Synthetic oligonucleotide
aataagaacgcgaactcgtcaaaac

SEQ ID NO: 679012 - DNA, 25 bp, Artificial sequence
  Synthetic oligonucleotide
gtatcttatatggtcgcggaaaagt

SEQ ID NO: 679013 - DNA, 25 bp, Artificial sequence
  Synthetic oligonucleotide
gataaagtatcgaaacggctctcta

SEQ ID NO: 679014 - DNA, 25 bp, Artificial sequence
  Synthetic oligonucleotide
gataaagtatcgtaacggctctcta

SEQ ID NO: 679015 - DNA, 25 bp, Artificial sequence
  Synthetic oligonucleotide
taattatccgttgcgacgtgactat

SEQ ID NO: 679016 - DNA, 25 bp, Artificial sequence
  Synthetic oligonucleotide
taattatccgttccgacgtgactat

SEQ ID NO: 679017 - DNA, 25 bp, Artificial sequence
  Synthetic oligonucleotide
tcaagatcgatttacgacgccttaa

SEQ ID NO: 679018 - DNA, 25 bp, Artificial sequence
  Synthetic oligonucleotide
tttagcacgtaaaacgcggtttatc

SEQ ID NO: 679019 - DNA, 25 bp, Artificial sequence
  Synthetic oligonucleotide
gattctgattgcgcccataatgtaa

SEQ ID NO: 679020 - DNA, 25 bp, Artificial sequence
  Synthetic oligonucleotide
acgtatcgttaagggtacggatata

SEQ ID NO: 679021 - DNA, 25 bp, Artificial sequence
  Synthetic oligonucleotide
tttagcacgtaatacgcggtttatc

SEQ ID NO: 679022 - DNA, 25 bp, Artificial sequence
  Synthetic oligonucleotide
tgtttggtatcgcgcgttagttatt

SEQ ID NO: 679023 - DNA, 25 bp, Artificial sequence
  Synthetic oligonucleotide
acgtatcgttaacggtacggatata

SEQ ID NO: 679024 - DNA, 25 bp, Artificial sequence
  Synthetic oligonucleotide
tcaagatcgattaacgacgccttaa

SEQ ID NO: 679025 - DNA, 25 bp, Artificial sequence
  Synthetic oligonucleotide
taagtacggcgctagtatatgtatc

SEQ ID NO: 679026 - DNA, 25 bp, Artificial sequence
  Synthetic oligonucleotide
attgaacacgtaaggcgtaccttta

SEQ ID NO: 679027 - DNA, 25 bp, Artificial sequence
  Synthetic oligonucleotide
taagtacggcgcaagtatatgtatc

SEQ ID NO: 679028 - DNA, 25 bp, Artificial sequence
  Synthetic oligonucleotide
gattctgattgcccccataatgtaa

SEQ ID NO: 679029 - DNA, 25 bp, Artificial sequence
  Synthetic oligonucleotide
tgtttggtatcgggcgttagttatt

SEQ ID NO: 679030 - DNA, 25 bp, Artificial sequence
  Synthetic oligonucleotide
aactatcgatacccggaattcacac

SEQ ID NO: 679031 - DNA, 25 bp, Artificial sequence
  Synthetic oligonucleotide
ctcgtgcgacgtaacgtctaattta

SEQ ID NO: 679032 - DNA, 25 bp, Artificial sequence
  Synthetic oligonucleotide
ctcgtgcgacgttacgtctaattta

SEQ ID NO: 679033 - DNA, 25 bp, Artificial sequence
  Synthetic oligonucleotide
aactatcgatacgcggaattcacac

SEQ ID NO: 679034 - DNA, 25 bp, Artificial sequence
  Synthetic oligonucleotide
accgttcgtatgattcggaaaatgg

SEQ ID NO: 679035 - DNA, 25 bp, Artificial sequence
  Synthetic oligonucleotide
ctgattactagtggcgcttgagtta

SEQ ID NO: 679036 - DNA, 25 bp, Artificial sequence
  Synthetic oligonucleotide
accgttcgtatgtttcggaaaatgg

SEQ ID NO: 679037 - DNA, 25 bp, Artificial sequence
  Synthetic oligonucleotide
accaattcgactatggacggatttc

SEQ ID NO: 679038 - DNA, 25 bp, Artificial sequence
  Synthetic oligonucleotide
accaattcgactttggacggatttc

SEQ ID NO: 679039 - DNA, 25 bp, Artificial sequence
  Synthetic oligonucleotide
ccaattgttcgccatagtaatggtc

SEQ ID NO: 679040 - DNA, 25 bp, Artificial sequence
  Synthetic oligonucleotide
ccaattgttcgcgatagtaatggtc

SEQ ID NO: 679041 - DNA, 25 bp, Artificial sequence
  Synthetic oligonucleotide
gaactactagtaacgcgaagtagct

SEQ ID NO: 679042 - DNA, 25 bp, Artificial sequence
  Synthetic oligonucleotide
tgttctttgcgcgaatagacaccta

SEQ ID NO: 679043 - DNA, 25 bp, Artificial sequence
  Synthetic oligonucleotide
tcacttctaatacgatcgctccagt

SEQ ID NO: 679044 - DNA, 25 bp, Artificial sequence
  Synthetic oligonucleotide
tcacttctaataggatcgctccagt

SEQ ID NO: 679045 - DNA, 25 bp, Artificial sequence
  Synthetic oligonucleotide
tgaagttacgcgataaaccatcagc

SEQ ID NO: 679046 - DNA, 25 bp, Artificial sequence
  Synthetic oligonucleotide
atcagtaccgcggataatggttttg

SEQ ID NO: 679047 - DNA, 25 bp, Artificial sequence
  Synthetic oligonucleotide
gaactactagtatcgcgaagtagct

SEQ ID NO: 679048 - DNA, 25 bp, Artificial sequence
  Synthetic oligonucleotide
aaagtcacatatggtcgcttccgat

SEQ ID NO: 679049 - DNA, 25 bp, Artificial sequence
  Synthetic oligonucleotide
aaagtcacatatcgtcgcttccgat

SEQ ID NO: 679050 - DNA, 25 bp, Artificial sequence
  Synthetic oligonucleotide
tgttctttgcgccaatagacaccta

SEQ ID NO: 679051 - DNA, 25 bp, Artificial sequence
  Synthetic oligonucleotide
ctaaatcgataagggtcggtaatcg

SEQ ID NO: 679052 - DNA, 25 bp, Artificial sequence
  Synthetic oligonucleotide
cctgaactatcccctacgatatgaa

SEQ ID NO: 679053 - DNA, 25 bp, Artificial sequence
  Synthetic oligonucleotide
cctgaactatccgctacgatatgaa

SEQ ID NO: 679054 - DNA, 25 bp, Artificial sequence
  Synthetic oligonucleotide
aagtttcgcattggtcgtaaacgga

SEQ ID NO: 679055 - DNA, 25 bp, Artificial sequence
  Synthetic oligonucleotide
aagtttcgcattcgtcgtaaacgga

SEQ ID NO: 679056 - DNA, 25 bp, Artificial sequence
  Synthetic oligonucleotide
ctaatccgatcctagatcgttccaa

SEQ ID NO: 679057 - DNA, 25 bp, Artificial sequence
  Synthetic oligonucleotide
atcagtaccgcgcataatggttttg

SEQ ID NO: 679058 - DNA, 25 bp, Artificial sequence
  Synthetic oligonucleotide
atctcatcgcgcaacactaatcagt

SEQ ID NO: 679059 - DNA, 25 bp, Artificial sequence
  Synthetic oligonucleotide
atctcatcgcgctacactaatcagt

SEQ ID NO: 679060 - DNA, 25 bp, Artificial sequence
  Synthetic oligonucleotide
agacaacgagcgtacaacggaattt

SEQ ID NO: 679061 - DNA, 25 bp, Artificial sequence
  Synthetic oligonucleotide
caatcacgtacgcgtagaaccattt

SEQ ID NO: 679062 - DNA, 25 bp, Artificial sequence
  Synthetic oligonucleotide
ctaaatcgataacggtcggtaatcg

SEQ ID NO: 679063 - DNA, 25 bp, Artificial sequence
  Synthetic oligonucleotide
ctgattactagtcgcgcttgagtta

SEQ ID NO: 679064 - DNA, 25 bp, Artificial sequence
  Synthetic oligonucleotide
tgaagttacgcgttaaaccatcagc

SEQ ID NO: 679065 - DNA, 25 bp, Artificial sequence
  Synthetic oligonucleotide
caatcacgtacgggtagaaccattt

SEQ ID NO: 679066 - DNA, 25 bp, Artificial sequence
  Synthetic oligonucleotide
tactatgacgtcgcgtatatctacg

SEQ ID NO: 679067 - DNA, 25 bp, Artificial sequence
  Synthetic oligonucleotide
tactatgacgtcccgtatatctacg

SEQ ID NO: 679068 - DNA, 25 bp, Artificial sequence
  Synthetic oligonucleotide
ggattattcgtacgatacggtttcg

SEQ ID NO: 679069 - DNA, 25 bp, Artificial sequence
  Synthetic oligonucleotide
ggattattcgtaggatacggtttcg

SEQ ID NO: 679070 - DNA, 25 bp, Artificial sequence
  Synthetic oligonucleotide
acctatagtcgtaaccgcgcatata

SEQ ID NO: 679071 - DNA, 25 bp, Artificial sequence
  Synthetic oligonucleotide
acctatagtcgttaccgcgcatata

SEQ ID NO: 679072 - DNA, 25 bp, Artificial sequence
  Synthetic oligonucleotide
gaacttcgaataccgtcgtagtgtt

SEQ ID NO: 679073 - DNA, 25 bp, Artificial sequence
  Synthetic oligonucleotide
gaacttcgaatagcgtcgtagtgtt

SEQ ID NO: 679074 - DNA, 25 bp, Artificial sequence
  Synthetic oligonucleotide
agacaacgagcgaacaacggaattt

SEQ ID NO: 679075 - DNA, 25 bp, Artificial sequence
  Synthetic oligonucleotide
acttaatagctcctacgcggtatac

SEQ ID NO: 679076 - DNA, 25 bp, Artificial sequence
  Synthetic oligonucleotide
ccctatcgcaattcgtcgattatac

SEQ ID NO: 679077 - DNA, 25 bp, Artificial sequence
  Synthetic oligonucleotide
taaatgtcgtaccggcatagaagca

SEQ ID NO: 679078 - DNA, 25 bp, Artificial sequence
  Synthetic oligonucleotide
taaatgtcgtacgggcatagaagca

SEQ ID NO: 679079 - DNA, 25 bp, Artificial sequence
  Synthetic oligonucleotide
tcaagtcgcgctaaagaatggcata

SEQ ID NO: 679080 - DNA, 25 bp, Artificial sequence
  Synthetic oligonucleotide
tcaagtcgcgcttaagaatggcata

SEQ ID NO: 679081 - DNA, 25 bp, Artificial sequence
  Synthetic oligonucleotide
atcattgaccggttacgtttcagca

SEQ ID NO: 679082 - DNA, 25 bp, Artificial sequence
  Synthetic oligonucleotide
atcattgaccggatacgtttcagca

SEQ ID NO: 679083 - DNA, 25 bp, Artificial sequence
  Synthetic oligonucleotide
tgctttccgcgactaactaagtaca

SEQ ID NO: 679084 - DNA, 25 bp, Artificial sequence
  Synthetic oligonucleotide
tgctttccgcgagtaactaagtaca

SEQ ID NO: 679085 - DNA, 25 bp, Artificial sequence
  Synthetic oligonucleotide
taggtttcgtaccgtcctatcgtta

SEQ ID NO: 679086 - DNA, 25 bp, Artificial sequence
  Synthetic oligonucleotide
tcacttcgcgaccaatagtacattg

SEQ ID NO: 679087 - DNA, 25 bp, Artificial sequence
  Synthetic oligonucleotide
ctaatccgatccaagatcgttccaa

SEQ ID NO: 679088 - DNA, 25 bp, Artificial sequence
  Synthetic oligonucleotide
acttaatagctcgtacgcggtatac

SEQ ID NO: 679089 - DNA, 25 bp, Artificial sequence
  Synthetic oligonucleotide
taacggtgcgcgatataagacattg

SEQ ID NO: 679090 - DNA, 25 bp, Artificial sequence
  Synthetic oligonucleotide
taacggtgcgcgttataagacattg

SEQ ID NO: 679091 - DNA, 25 bp, Artificial sequence
  Synthetic oligonucleotide
agtaaccgggacgtaatacactcaa

SEQ ID NO: 679092 - DNA, 25 bp, Artificial sequence
  Synthetic oligonucleotide
agtaaccgggacctaatacactcaa

SEQ ID NO: 679093 - DNA, 25 bp, Artificial sequence
  Synthetic oligonucleotide
actagagctagaacgtcgtactctt

SEQ ID NO: 679094 - DNA, 25 bp, Artificial sequence
  Synthetic oligonucleotide
atttgcttatcgccgtcgtactcat

SEQ ID NO: 679095 - DNA, 25 bp, Artificial sequence
  Synthetic oligonucleotide
gtcaaacgcgaccatataaacgatg

SEQ ID NO: 679096 - DNA, 25 bp, Artificial sequence
  Synthetic oligonucleotide
actagagctagatcgtcgtactctt

SEQ ID NO: 679097 - DNA, 25 bp, Artificial sequence
  Synthetic oligonucleotide
ggttaacgcgataactacgcacata

SEQ ID NO: 679098 - DNA, 25 bp, Artificial sequence
  Synthetic oligonucleotide
tcacttcgcgacgaatagtacattg

SEQ ID NO: 679099 - DNA, 25 bp, Artificial sequence
  Synthetic oligonucleotide
tcaagagcgtaaatcgacgagacta

SEQ ID NO: 679100 - DNA, 25 bp, Artificial sequence
  Synthetic oligonucleotide
ctacgtcgtgaccattcgttattct

SEQ ID NO: 679101 - DNA, 25 bp, Artificial sequence
  Synthetic oligonucleotide
ggtatccgtatatccggtatagtga

SEQ ID NO: 679102 - DNA, 25 bp, Artificial sequence
  Synthetic oligonucleotide
ggtatccgtataaccggtatagtga

SEQ ID NO: 679103 - DNA, 25 bp, Artificial sequence
  Synthetic oligonucleotide
agctggctagtagtacgcgtataaa

SEQ ID NO: 679104 - DNA, 25 bp, Artificial sequence
  Synthetic oligonucleotide
agctggctagtactacgcgtataaa

SEQ ID NO: 679105 - DNA, 25 bp, Artificial sequence
  Synthetic oligonucleotide
tatttctaccgctcgttagatgagg

SEQ ID NO: 679106 - DNA, 25 bp, Artificial sequence
  Synthetic oligonucleotide
tatttctaccgcacgttagatgagg

SEQ ID NO: 679107 - DNA, 25 bp, Artificial sequence
  Synthetic oligonucleotide
ctttaccgtatattcgcgatgaagg

SEQ ID NO: 679108 - DNA, 25 bp, Artificial sequence
  Synthetic oligonucleotide
ctttaccgtataatcgcgatgaagg

SEQ ID NO: 679109 - DNA, 25 bp, Artificial sequence
  Synthetic oligonucleotide
taggtttcgtacggtcctatcgtta

SEQ ID NO: 679110 - DNA, 25 bp, Artificial sequence
  Synthetic oligonucleotide
taattgttacgtggtgcgaaccctt

SEQ ID NO: 679111 - DNA, 25 bp, Artificial sequence
  Synthetic oligonucleotide
ctacgtcgtgacgattcgttattct

SEQ ID NO: 679112 - DNA, 25 bp, Artificial sequence
  Synthetic oligonucleotide
tcaagagcgtaattcgacgagacta

SEQ ID NO: 679113 - DNA, 25 bp, Artificial sequence
  Synthetic oligonucleotide
agccaagtcgcgtaacaacgttata

SEQ ID NO: 679114 - DNA, 25 bp, Artificial sequence
  Synthetic oligonucleotide
agccaagtcgcgaaacaacgttata

SEQ ID NO: 679115 - DNA, 25 bp, Artificial sequence
  Synthetic oligonucleotide
agtactcgtcgaatcgtgatctagt

SEQ ID NO: 679116 - DNA, 25 bp, Artificial sequence
  Synthetic oligonucleotide
agtactcgtcgattcgtgatctagt

SEQ ID NO: 679117 - DNA, 25 bp, Artificial sequence
  Synthetic oligonucleotide
tccagatctaagggcgcgatttaat

SEQ ID NO: 679118 - DNA, 25 bp, Artificial sequence
  Synthetic oligonucleotide
tccagatctaagcgcgcgatttaat

SEQ ID NO: 679119 - DNA, 25 bp, Artificial sequence
  Synthetic oligonucleotide
tttacccgaccgatcgtacattatg

SEQ ID NO: 679120 - DNA, 25 bp, Artificial sequence
  Synthetic oligonucleotide
tttacccgaccgttcgtacattatg

SEQ ID NO: 679121 - DNA, 25 bp, Artificial sequence
  Synthetic oligonucleotide
ccctatcgcaatacgtcgattatac

SEQ ID NO: 679122 - DNA, 25 bp, Artificial sequence
  Synthetic oligonucleotide
taattgttacgtcgtgcgaaccctt

SEQ ID NO: 679123 - DNA, 25 bp, Artificial sequence
  Synthetic oligonucleotide
caagatccgcgttatacgacgtaat

SEQ ID NO: 679124 - DNA, 25 bp, Artificial sequence
  Synthetic oligonucleotide
gatcacacgctacaccgatttctat

SEQ ID NO: 679125 - DNA, 25 bp, Artificial sequence
  Synthetic oligonucleotide
gatcacacgctagaccgatttctat

SEQ ID NO: 679126 - DNA, 25 bp, Artificial sequence
  Synthetic oligonucleotide
gtgtaatcggcatacgaagtaactc

SEQ ID NO: 679127 - DNA, 25 bp, Artificial sequence
  Synthetic oligonucleotide
gtgtaatcggcaaacgaagtaactc

SEQ ID NO: 679128 - DNA, 25 bp, Artificial sequence
  Synthetic oligonucleotide
tttaccattagtgcgacgccgtaat

SEQ ID NO: 679129 - DNA, 25 bp, Artificial sequence
  Synthetic oligonucleotide
tttaccattagtccgacgccgtaat

SEQ ID NO: 679130 - DNA, 25 bp, Artificial sequence
  Synthetic oligonucleotide
tctaacctcatatctcgcgatatgc

SEQ ID NO: 679131 - DNA, 25 bp, Artificial sequence
  Synthetic oligonucleotide
tctaacctcataactcgcgatatgc

SEQ ID NO: 679132 - DNA, 25 bp, Artificial sequence
  Synthetic oligonucleotide
atcaacacgcgatacaatgatctgc

SEQ ID NO: 679133 - DNA, 25 bp, Artificial sequence
  Synthetic oligonucleotide
agtagcgtctaaggacgtattgcat

SEQ ID NO: 679134 - DNA, 25 bp, Artificial sequence
  Synthetic oligonucleotide
caagatccgcgtaatacgacgtaat

SEQ ID NO: 679135 - DNA, 25 bp, Artificial sequence
  Synthetic oligonucleotide
caaagtgtaggaggccgtatcttaa

SEQ ID NO: 679136 - DNA, 25 bp, Artificial sequence
  Synthetic oligonucleotide
ttcctccgtacgctatctataactc

SEQ ID NO: 679137 - DNA, 25 bp, Artificial sequence
  Synthetic oligonucleotide
ttcctccgtacggtatctataactc

SEQ ID NO: 679138 - DNA, 25 bp, Artificial sequence
  Synthetic oligonucleotide
acaaaaggccgatagatcgttcagt

SEQ ID NO: 679139 - DNA, 25 bp, Artificial sequence
  Synthetic oligonucleotide
acaaaaggccgaaagatcgttcagt

SEQ ID NO: 679140 - DNA, 25 bp, Artificial sequence
  Synthetic oligonucleotide
gtcaaacgcgacgatataaacgatg

SEQ ID NO: 679141 - DNA, 25 bp, Artificial sequence
  Synthetic oligonucleotide
tagtcagtagcgtcgtatgtgtaac

SEQ ID NO: 679142 - DNA, 25 bp, Artificial sequence
  Synthetic oligonucleotide
atcatcgattcttgcgcgaactcta

SEQ ID NO: 679143 - DNA, 25 bp, Artificial sequence
  Synthetic oligonucleotide
atcatcgattctagcgcgaactcta

SEQ ID NO: 679144 - DNA, 25 bp, Artificial sequence
  Synthetic oligonucleotide
tagtcagtagcgacgtatgtgtaac

SEQ ID NO: 679145 - DNA, 25 bp, Artificial sequence
  Synthetic oligonucleotide
atcaacacgcgaaacaatgatctgc

SEQ ID NO: 679146 - DNA, 25 bp, Artificial sequence
  Synthetic oligonucleotide
aatactaacgctatcggacccatac

SEQ ID NO: 679147 - DNA, 25 bp, Artificial sequence
  Synthetic oligonucleotide
catcacatcgaaggtacggttagaa

SEQ ID NO: 679148 - DNA, 25 bp, Artificial sequence
  Synthetic oligonucleotide
ggttaacgcgattactacgcacata

SEQ ID NO: 679149 - DNA, 25 bp, Artificial sequence
  Synthetic oligonucleotide
gatcttaacgcgacgttagttaagc

SEQ ID NO: 679150 - DNA, 25 bp, Artificial sequence
  Synthetic oligonucleotide
gatcttaacgcgtcgttagttaagc

SEQ ID NO: 679151 - DNA, 25 bp, Artificial sequence
  Synthetic oligonucleotide
gaataagcgtcagacgtatgagatg

SEQ ID NO: 679152 - DNA, 25 bp, Artificial sequence
  Synthetic oligonucleotide
gaataagcgtcacacgtatgagatg

SEQ ID NO: 679153 - DNA, 25 bp, Artificial sequence
  Synthetic oligonucleotide
tgtattgtcgcgtacgaatgcatac

SEQ ID NO: 679154 - DNA, 25 bp, Artificial sequence
  Synthetic oligonucleotide
tgtattgtcgcgaacgaatgcatac

SEQ ID NO: 679155 - DNA, 25 bp, Artificial sequence
  Synthetic oligonucleotide
gtttctcgcccgttagtatctgttt

SEQ ID NO: 679156 - DNA, 25 bp, Artificial sequence
  Synthetic oligonucleotide
cctattcgcgaaagtaccaacctta

SEQ ID NO: 679157 - DNA, 25 bp, Artificial sequence
  Synthetic oligonucleotide
aatactaacgctttcggacccatac

SEQ ID NO: 679158 - DNA, 25 bp, Artificial sequence
  Synthetic oligonucleotide
cctattcgcgaatgtaccaacctta

SEQ ID NO: 679159 - DNA, 25 bp, Artificial sequence
  Synthetic oligonucleotide
tacttaccgatttggcgaactcaca

SEQ ID NO: 679160 - DNA, 25 bp, Artificial sequence
  Synthetic oligonucleotide
tacttaccgattaggcgaactcaca

SEQ ID NO: 679161 - DNA, 25 bp, Artificial sequence
  Synthetic oligonucleotide
ttctctactaatacgcggatgcact

SEQ ID NO: 679162 - DNA, 25 bp, Artificial sequence
  Synthetic oligonucleotide
ttctctactaattcgcggatgcact

SEQ ID NO: 679163 - DNA, 25 bp, Artificial sequence
  Synthetic oligonucleotide
ctttcaggtttatcgcgacgaattc

SEQ ID NO: 679164 - DNA, 25 bp, Artificial sequence
  Synthetic oligonucleotide
ctttcaggtttaacgcgacgaattc

SEQ ID NO: 679165 - DNA, 25 bp, Artificial sequence
  Synthetic oligonucleotide
tatggccgccgttctagtaatttga

SEQ ID NO: 679166 - DNA, 25 bp, Artificial sequence
  Synthetic oligonucleotide
tatggccgccgtactagtaatttga

SEQ ID NO: 679167 - DNA, 25 bp, Artificial sequence
  Synthetic oligonucleotide
caaagtgtaggacgccgtatcttaa

SEQ ID NO: 679168 - DNA, 25 bp, Artificial sequence
  Synthetic oligonucleotide
tataaacgaacttgtgtcgcgagca

SEQ ID NO: 679169 - DNA, 25 bp, Artificial sequence
  Synthetic oligonucleotide
gtttctcgcccgatagtatctgttt

SEQ ID NO: 679170 - DNA, 25 bp, Artificial sequence
  Synthetic oligonucleotide
ttagatattctgtcgcgtagtgagc

SEQ ID NO: 679171 - DNA, 25 bp, Artificial sequence
  Synthetic oligonucleotide
cgcatagttcgcgaacgttctaaaa

SEQ ID NO: 679172 - DNA, 25 bp, Artificial sequence
  Synthetic oligonucleotide
gcattcatgacttacgcgacatagt

SEQ ID NO: 679173 - DNA, 25 bp, Artificial sequence
  Synthetic oligonucleotide
gcattcatgactaacgcgacatagt

SEQ ID NO: 679174 - DNA, 25 bp, Artificial sequence
  Synthetic oligonucleotide
atcaagtaatagcggatcggtacct

SEQ ID NO: 679175 - DNA, 25 bp, Artificial sequence
  Synthetic oligonucleotide
atcaagtaataggggatcggtacct

SEQ ID NO: 679176 - DNA, 25 bp, Artificial sequence
  Synthetic oligonucleotide
ataaaggcgttaaacgtgcgaatgg

SEQ ID NO: 679177 - DNA, 25 bp, Artificial sequence
  Synthetic oligonucleotide
ataaaggcgttatacgtgcgaatgg

SEQ ID NO: 679178 - DNA, 25 bp, Artificial sequence
  Synthetic oligonucleotide
tcactacctacgcgacttatctaac

SEQ ID NO: 679179 - DNA, 25 bp, Artificial sequence
  Synthetic oligonucleotide
tcactacctacgggacttatctaac

SEQ ID NO: 679180 - DNA, 25 bp, Artificial sequence
  Synthetic oligonucleotide
agtagcgtctaacgacgtattgcat

SEQ ID NO: 679181 - DNA, 25 bp, Artificial sequence
  Synthetic oligonucleotide
cttacatcgtatcgtaccggttttc

SEQ ID NO: 679182 - DNA, 25 bp, Artificial sequence
  Synthetic oligonucleotide
tgcgcatcactaattcgcggttttt

SEQ ID NO: 679183 - DNA, 25 bp, Artificial sequence
  Synthetic oligonucleotide
catcacatcgaacgtacggttagaa

SEQ ID NO: 679184 - DNA, 25 bp, Artificial sequence
  Synthetic oligonucleotide
ttatatgtcgcgaccttatccgact

SEQ ID NO: 679185 - DNA, 25 bp, Artificial sequence
  Synthetic oligonucleotide
ttatatgtcgcgtccttatccgact

SEQ ID NO: 679186 - DNA, 25 bp, Artificial sequence
  Synthetic oligonucleotide
ttcaatgtacgtatcgacgatgggt

SEQ ID NO: 679187 - DNA, 25 bp, Artificial sequence
  Synthetic oligonucleotide
ttcaatgtacgtttcgacgatgggt

SEQ ID NO: 679188 - DNA, 25 bp, Artificial sequence
  Synthetic oligonucleotide
acactttcgttttcgccgatactct

SEQ ID NO: 679189 - DNA, 25 bp, Artificial sequence
  Synthetic oligonucleotide
acactttcgtttacgccgatactct

SEQ ID NO: 679190 - DNA, 25 bp, Artificial sequence
  Synthetic oligonucleotide
accagactcgcaattcgtagttagt

SEQ ID NO: 679191 - DNA, 25 bp, Artificial sequence
  Synthetic oligonucleotide
accagactcgcatttcgtagttagt

SEQ ID NO: 679192 - DNA, 25 bp, Artificial sequence
  Synthetic oligonucleotide
cttacatcgtatggtaccggttttc

SEQ ID NO: 679193 - DNA, 25 bp, Artificial sequence
  Synthetic oligonucleotide
aactagcgttagtactcgacattcg

SEQ ID NO: 679194 - DNA, 25 bp, Artificial sequence
  Synthetic oligonucleotide
tataaacgaactagtgtcgcgagca

SEQ ID NO: 679195 - DNA, 25 bp, Artificial sequence
  Synthetic oligonucleotide
tgaccttaccgttgcgaataaacgt

SEQ ID NO: 679196 - DNA, 25 bp, Artificial sequence
  Synthetic oligonucleotide
tgaccttaccgtagcgaataaacgt

SEQ ID NO: 679197 - DNA, 25 bp, Artificial sequence
  Synthetic oligonucleotide
tactactacctccacgtaaggtaga

SEQ ID NO: 679198 - DNA, 25 bp, Artificial sequence
  Synthetic oligonucleotide
tactactacctcgacgtaaggtaga

SEQ ID NO: 679199 - DNA, 25 bp, Artificial sequence
  Synthetic oligonucleotide
gcctgtactattcgacgcattatac

SEQ ID NO: 679200 - DNA, 25 bp, Artificial sequence
  Synthetic oligonucleotide
gcctgtactattggacgcattatac

SEQ ID NO: 679201 - DNA, 25 bp, Artificial sequence
  Synthetic oligonucleotide
tggactctacgcagatcgtaaattg

SEQ ID NO: 679202 - DNA, 25 bp, Artificial sequence
  Synthetic oligonucleotide
tggactctacgctgatcgtaaattg

SEQ ID NO: 679203 - DNA, 25 bp, Artificial sequence
  Synthetic oligonucleotide
cgcatagttcgccaacgttctaaaa

SEQ ID NO: 679204 - DNA, 25 bp, Artificial sequence
  Synthetic oligonucleotide
cgtaaatagtatcgcggtatccatg

SEQ ID NO: 679205 - DNA, 25 bp, Artificial sequence
  Synthetic oligonucleotide
tgcgcatcactatttcgcggttttt

SEQ ID NO: 679206 - DNA, 25 bp, Artificial sequence
  Synthetic oligonucleotide
aactagcgttagaactcgacattcg

SEQ ID NO: 679207 - DNA, 25 bp, Artificial sequence
  Synthetic oligonucleotide
tactcatacgttatgacgcgacctt

SEQ ID NO: 679208 - DNA, 25 bp, Artificial sequence
  Synthetic oligonucleotide
tactcatacgttttgacgcgacctt

SEQ ID NO: 679209 - DNA, 25 bp, Artificial sequence
  Synthetic oligonucleotide
cgtgaagacagttcgcgtaaatgta

SEQ ID NO: 679210 - DNA, 25 bp, Artificial sequence
  Synthetic oligonucleotide
cgtgaagacagtacgcgtaaatgta

SEQ ID NO: 679211 - DNA, 25 bp, Artificial sequence
  Synthetic oligonucleotide
actttacgcgatgtacgatcgtttc

SEQ ID NO: 679212 - DNA, 25 bp, Artificial sequence
  Synthetic oligonucleotide
actttacgcgatctacgatcgtttc

SEQ ID NO: 679213 - DNA, 25 bp, Artificial sequence
  Synthetic oligonucleotide
cttgtttacgccgaccttaaacaga

SEQ ID NO: 679214 - DNA, 25 bp, Artificial sequence
  Synthetic oligonucleotide
cttgtttacgcccaccttaaacaga

SEQ ID NO: 679215 - DNA, 25 bp, Artificial sequence
  Synthetic oligonucleotide
atttgcttatcggcgtcgtactcat

SEQ ID NO: 679216 - DNA, 25 bp, Artificial sequence
  Synthetic oligonucleotide
cgtaaatagtatggcggtatccatg

SEQ ID NO: 679217 - DNA, 25 bp, Artificial sequence
  Synthetic oligonucleotide
actctggacgataataccgcattga

SEQ ID NO: 679218 - DNA, 25 bp, Artificial sequence
  Synthetic oligonucleotide
ttcaaccggtcgaaagctttaatcc

SEQ ID NO: 679219 - DNA, 25 bp, Artificial sequence
  Synthetic oligonucleotide
ggctagcgaatttgtagcgatagta

SEQ ID NO: 679220 - DNA, 25 bp, Artificial sequence
  Synthetic oligonucleotide
ggctagcgaattagtagcgatagta

SEQ ID NO: 679221 - DNA, 25 bp, Artificial sequence
  Synthetic oligonucleotide
tgaatacgacgcgtattatggcatc

SEQ ID NO: 679222 - DNA, 25 bp, Artificial sequence
  Synthetic oligonucleotide
tgaatacgacgcctattatggcatc

SEQ ID NO: 679223 - DNA, 25 bp, Artificial sequence
  Synthetic oligonucleotide
aatctcatatggcgtcccgagattt

SEQ ID NO: 679224 - DNA, 25 bp, Artificial sequence
  Synthetic oligonucleotide
aatctcatatggggtcccgagattt

SEQ ID NO: 679225 - DNA, 25 bp, Artificial sequence
  Synthetic oligonucleotide
aaagattagacgggtaatcggcatg

SEQ ID NO: 679226 - DNA, 25 bp, Artificial sequence
  Synthetic oligonucleotide
aaagattagacgcgtaatcggcatg

SEQ ID NO: 679227 - DNA, 25 bp, Artificial sequence
  Synthetic oligonucleotide
tgcacttaaggtggatcggaatatg

SEQ ID NO: 679228 - DNA, 25 bp, Artificial sequence
  Synthetic oligonucleotide
gctcatacggtcgcgtatatctaat

SEQ ID NO: 679229 - DNA, 25 bp, Artificial sequence
  Synthetic oligonucleotide
actctggacgattataccgcattga

SEQ ID NO: 679230 - DNA, 25 bp, Artificial sequence
  Synthetic oligonucleotide
atctacgatcgcgcactaagaatca

SEQ ID NO: 679231 - DNA, 25 bp, Artificial sequence
  Synthetic oligonucleotide
gccatccgcgattagtcctttatat

SEQ ID NO: 679232 - DNA, 25 bp, Artificial sequence
  Synthetic oligonucleotide
gccatccgcgataagtcctttatat

SEQ ID NO: 679233 - DNA, 25 bp, Artificial sequence
  Synthetic oligonucleotide
ctgtaatactctggcgtagtctttc

SEQ ID NO: 679234 - DNA, 25 bp, Artificial sequence
  Synthetic oligonucleotide
ctgtaatactctcgcgtagtctttc

SEQ ID NO: 679235 - DNA, 25 bp, Artificial sequence
  Synthetic oligonucleotide
ataccatattgcgggtgcgtaacaa

SEQ ID NO: 679236 - DNA, 25 bp, Artificial sequence
  Synthetic oligonucleotide
ataccatattgccggtgcgtaacaa

SEQ ID NO: 679237 - DNA, 25 bp, Artificial sequence
  Synthetic oligonucleotide
ctggttgacgcgatatacacttctt

SEQ ID NO: 679238 - DNA, 25 bp, Artificial sequence
  Synthetic oligonucleotide
tcactatcgacggttaaaccttcgt

SEQ ID NO: 679239 - DNA, 25 bp, Artificial sequence
  Synthetic oligonucleotide
caactccgttagggtacgattagaa

SEQ ID NO: 679240 - DNA, 25 bp, Artificial sequence
  Synthetic oligonucleotide
caactccgttagcgtacgattagaa

SEQ ID NO: 679241 - DNA, 25 bp, Artificial sequence
  Synthetic oligonucleotide
agaatttccgcgatgatcggatttg

SEQ ID NO: 679242 - DNA, 25 bp, Artificial sequence
  Synthetic oligonucleotide
tgcacttaaggtcgatcggaatatg

SEQ ID NO: 679243 - DNA, 25 bp, Artificial sequence
  Synthetic oligonucleotide
tagattattggcctcgtactagcac

SEQ ID NO: 679244 - DNA, 25 bp, Artificial sequence
  Synthetic oligonucleotide
tggtgacgataacgcgaatactttg

SEQ ID NO: 679245 - DNA, 25 bp, Artificial sequence
  Synthetic oligonucleotide
tggtgacgataaggcgaatactttg

SEQ ID NO: 679246 - DNA, 25 bp, Artificial sequence
  Synthetic oligonucleotide
gcatataccggccttatatatgctg

SEQ ID NO: 679247 - DNA, 25 bp, Artificial sequence
  Synthetic oligonucleotide
gcatataccggcgttatatatgctg

SEQ ID NO: 679248 - DNA, 25 bp, Artificial sequence
  Synthetic oligonucleotide
ctttatggttacgttatcggtgagc

SEQ ID NO: 679249 - DNA, 25 bp, Artificial sequence
  Synthetic oligonucleotide
ctttatggttaccttatcggtgagc

SEQ ID NO: 679250 - DNA, 25 bp, Artificial sequence
  Synthetic oligonucleotide
ctttgatcggacgtagacgttatac

SEQ ID NO: 679251 - DNA, 25 bp, Artificial sequence
  Synthetic oligonucleotide
ctttgatcggacctagacgttatac

SEQ ID NO: 679252 - DNA, 25 bp, Artificial sequence
  Synthetic oligonucleotide
catagtagtacgtcgctagggttta

SEQ ID NO: 679253 - DNA, 25 bp, Artificial sequence
  Synthetic oligonucleotide
catagtagtacgacgctagggttta

SEQ ID NO: 679254 - DNA, 25 bp, Artificial sequence
  Synthetic oligonucleotide
tgattccctaacccgagtagaaatg

SEQ ID NO: 679255 - DNA, 25 bp, Artificial sequence
  Synthetic oligonucleotide
ttcaaccggtcgtaagctttaatcc

SEQ ID NO: 679256 - DNA, 25 bp, Artificial sequence
  Synthetic oligonucleotide
tagattattggcgtcgtactagcac

SEQ ID NO: 679257 - DNA, 25 bp, Artificial sequence
  Synthetic oligonucleotide
atctacgatcgcccactaagaatca

SEQ ID NO: 679258 - DNA, 25 bp, Artificial sequence
  Synthetic oligonucleotide
gatacttacgcccatagactcaaca

SEQ ID NO: 679259 - DNA, 25 bp, Artificial sequence
  Synthetic oligonucleotide
gatacttacgccgatagactcaaca

SEQ ID NO: 679260 - DNA, 25 bp, Artificial sequence
  Synthetic oligonucleotide
agtcatatacgcggccctatgtaaa

SEQ ID NO: 679261 - DNA, 25 bp, Artificial sequence
  Synthetic oligonucleotide
agtcatatacgccgccctatgtaaa

SEQ ID NO: 679262 - DNA, 25 bp, Artificial sequence
  Synthetic oligonucleotide
ccggttgcgtaaaatgtcgattatc

SEQ ID NO: 679263 - DNA, 25 bp, Artificial sequence
  Synthetic oligonucleotide
ccggttgcgtaatatgtcgattatc

SEQ ID NO: 679264 - DNA, 25 bp, Artificial sequence
  Synthetic oligonucleotide
aatctgcgctaccattaactgacgt

SEQ ID NO: 679265 - DNA, 25 bp, Artificial sequence
  Synthetic oligonucleotide
aatctgcgctacgattaactgacgt

SEQ ID NO: 679266 - DNA, 25 bp, Artificial sequence
  Synthetic oligonucleotide
aaaggccgtcgagtagtaatgtaac

SEQ ID NO: 679267 - DNA, 25 bp, Artificial sequence
  Synthetic oligonucleotide
aaaggccgtcgactagtaatgtaac

SEQ ID NO: 679268 - DNA, 25 bp, Artificial sequence
  Synthetic oligonucleotide
gcttttccgaatcataccgtcttct

SEQ ID NO: 679269 - DNA, 25 bp, Artificial sequence
  Synthetic oligonucleotide
tgattccctaacgcgagtagaaatg

SEQ ID NO: 679270 - DNA, 25 bp, Artificial sequence
  Synthetic oligonucleotide
cctagtgcgttcgacgtataataac

SEQ ID NO: 679271 - DNA, 25 bp, Artificial sequence
  Synthetic oligonucleotide
tcgttattgacgctcgatctacgat

SEQ ID NO: 679272 - DNA, 25 bp, Artificial sequence
  Synthetic oligonucleotide
tcgttattgacggtcgatctacgat

SEQ ID NO: 679273 - DNA, 25 bp, Artificial sequence
  Synthetic oligonucleotide
atacgctattcgaaccgacctagaa

SEQ ID NO: 679274 - DNA, 25 bp, Artificial sequence
  Synthetic oligonucleotide
atacgctattcgtaccgacctagaa

SEQ ID NO: 679275 - DNA, 25 bp, Artificial sequence
  Synthetic oligonucleotide
ctaaactagcgttccgatctgtgtt

SEQ ID NO: 679276 - DNA, 25 bp, Artificial sequence
  Synthetic oligonucleotide
ctaaactagcgtaccgatctgtgtt

SEQ ID NO: 679277 - DNA, 25 bp, Artificial sequence
  Synthetic oligonucleotide
gacgtgcgcgtattatcgtatcatt

SEQ ID NO: 679278 - DNA, 25 bp, Artificial sequence
  Synthetic oligonucleotide
aagagggcgctacgattgattcaaa

SEQ ID NO: 679279 - DNA, 25 bp, Artificial sequence
  Synthetic oligonucleotide
aagagggcgctaggattgattcaaa

SEQ ID NO: 679280 - DNA, 25 bp, Artificial sequence
  Synthetic oligonucleotide
tatcattcggactcgcgaataacct

SEQ ID NO: 679281 - DNA, 25 bp, Artificial sequence
  Synthetic oligonucleotide
gctcatacggtcccgtatatctaat

SEQ ID NO: 679282 - DNA, 25 bp, Artificial sequence
  Synthetic oligonucleotide
cctagtgcgttccacgtataataac

SEQ ID NO: 679283 - DNA, 25 bp, Artificial sequence
  Synthetic oligonucleotide
caaggtaccgatagttccgtctaat

SEQ ID NO: 679284 - DNA, 25 bp, Artificial sequence
  Synthetic oligonucleotide
gacgtgcgcgtaatatcgtatcatt

SEQ ID NO: 679285 - DNA, 25 bp, Artificial sequence
  Synthetic oligonucleotide
gctgttgtaacgatcggtctaaaac

SEQ ID NO: 679286 - DNA, 25 bp, Artificial sequence
  Synthetic oligonucleotide
gctgttgtaacgttcggtctaaaac

SEQ ID NO: 679287 - DNA, 25 bp, Artificial sequence
  Synthetic oligonucleotide
aaaggttcgatcggctattttggca

SEQ ID NO: 679288 - DNA, 25 bp, Artificial sequence
  Synthetic oligonucleotide
aaaggttcgatccgctattttggca

SEQ ID NO: 679289 - DNA, 25 bp, Artificial sequence
  Synthetic oligonucleotide
ctattcgatctaccgtcgttacctt

SEQ ID NO: 679290 - DNA, 25 bp, Artificial sequence
  Synthetic oligonucleotide
ctattcgatctagcgtcgttacctt

SEQ ID NO: 679291 - DNA, 25 bp, Artificial sequence
  Synthetic oligonucleotide
actagtcgcatcggtaatattgctc

SEQ ID NO: 679292 - DNA, 25 bp, Artificial sequence
  Synthetic oligonucleotide
actagtcgcatccgtaatattgctc

SEQ ID NO: 679293 - DNA, 25 bp, Artificial sequence
  Synthetic oligonucleotide
gtttgtgcgtcttgtatcgcgttaa

SEQ ID NO: 679294 - DNA, 25 bp, Artificial sequence
  Synthetic oligonucleotide
ttagatattctgacgcgtagtgagc

SEQ ID NO: 679295 - DNA, 25 bp, Artificial sequence
  Synthetic oligonucleotide
tatcattcggacacgcgaataacct

SEQ ID NO: 679296 - DNA, 25 bp, Artificial sequence
  Synthetic oligonucleotide
aaaacccgctatatgtcgctctaga

SEQ ID NO: 679297 - DNA, 25 bp, Artificial sequence
  Synthetic oligonucleotide
gcttttccgaatgataccgtcttct

SEQ ID NO: 679298 - DNA, 25 bp, Artificial sequence
  Synthetic oligonucleotide
catagaacgagcggtaatggctata

SEQ ID NO: 679299 - DNA, 25 bp, Artificial sequence
  Synthetic oligonucleotide
catagaacgagccgtaatggctata

SEQ ID NO: 679300 - DNA, 25 bp, Artificial sequence
  Synthetic oligonucleotide
gacaaacgggttagtacgtatgcat

SEQ ID NO: 679301 - DNA, 25 bp, Artificial sequence
  Synthetic oligonucleotide
gacaaacgggtttgtacgtatgcat

SEQ ID NO: 679302 - DNA, 25 bp, Artificial sequence
  Synthetic oligonucleotide
tttactgtcacgtcgtatgacctca

SEQ ID NO: 679303 - DNA, 25 bp, Artificial sequence
  Synthetic oligonucleotide
tttactgtcacgacgtatgacctca

SEQ ID NO: 679304 - DNA, 25 bp, Artificial sequence
  Synthetic oligonucleotide
agaagggagcgtagtacgaatcata

SEQ ID NO: 679305 - DNA, 25 bp, Artificial sequence
  Synthetic oligonucleotide
agaagggagcgttgtacgaatcata

SEQ ID NO: 679306 - DNA, 25 bp, Artificial sequence
  Synthetic oligonucleotide
gatactatcgcgcacgtatctttca

SEQ ID NO: 679307 - DNA, 25 bp, Artificial sequence
  Synthetic oligonucleotide
gatactatcgcggacgtatctttca

SEQ ID NO: 679308 - DNA, 25 bp, Artificial sequence
  Synthetic oligonucleotide
tgtaagatacggcgcttacgactta

SEQ ID NO: 679309 - DNA, 25 bp, Artificial sequence
  Synthetic oligonucleotide
cgatcatctaccccgtaatactttc

SEQ ID NO: 679310 - DNA, 25 bp, Artificial sequence
  Synthetic oligonucleotide
tgtaagatacggggcttacgactta

SEQ ID NO: 679311 - DNA, 25 bp, Artificial sequence
  Synthetic oligonucleotide
aaaacccgctatttgtcgctctaga

SEQ ID NO: 679312 - DNA, 25 bp, Artificial sequence
  Synthetic oligonucleotide
gatactaccgcgctattacatttgc

SEQ ID NO: 679313 - DNA, 25 bp, Artificial sequence
  Synthetic oligonucleotide
gatactaccgcggtattacatttgc

SEQ ID NO: 679314 - DNA, 25 bp, Artificial sequence
  Synthetic oligonucleotide
gtcttcatacgttcgacggtatgat

SEQ ID NO: 679315 - DNA, 25 bp, Artificial sequence
  Synthetic oligonucleotide
gtcttcatacgtacgacggtatgat

SEQ ID NO: 679316 - DNA, 25 bp, Artificial sequence
  Synthetic oligonucleotide
ttctactactatggcgctatctagg

SEQ ID NO: 679317 - DNA, 25 bp, Artificial sequence
  Synthetic oligonucleotide
ttctactactatcgcgctatctagg

SEQ ID NO: 679318 - DNA, 25 bp, Artificial sequence
  Synthetic oligonucleotide
aacacttacgcgactagtcgatatc

SEQ ID NO: 679319 - DNA, 25 bp, Artificial sequence
  Synthetic oligonucleotide
aacacttacgcgtctagtcgatatc

SEQ ID NO: 679320 - DNA, 25 bp, Artificial sequence
  Synthetic oligonucleotide
caaggtaccgattgttccgtctaat

SEQ ID NO: 679321 - DNA, 25 bp, Artificial sequence
  Synthetic oligonucleotide
ctggttgacgcgttatacacttctt

SEQ ID NO: 679322 - DNA, 25 bp, Artificial sequence
  Synthetic oligonucleotide
cgatcatctaccgcgtaatactttc

SEQ ID NO: 679323 - DNA, 25 bp, Artificial sequence
  Synthetic oligonucleotide
atttgacgcgatttacagggaccat

SEQ ID NO: 679324 - DNA, 25 bp, Artificial sequence
  Synthetic oligonucleotide
cgatcttcggcgattaacggttata

SEQ ID NO: 679325 - DNA, 25 bp, Artificial sequence
  Synthetic oligonucleotide
atcagactatatacgtccgggtttg

SEQ ID NO: 679326 - DNA, 25 bp, Artificial sequence
  Synthetic oligonucleotide
atcagactatattcgtccgggtttg

SEQ ID NO: 679327 - DNA, 25 bp, Artificial sequence
  Synthetic oligonucleotide
tacaacgatcgactatacgacacca

SEQ ID NO: 679328 - DNA, 25 bp, Artificial sequence
  Synthetic oligonucleotide
atctcagctcgatagaacgggaaat

SEQ ID NO: 679329 - DNA, 25 bp, Artificial sequence
  Synthetic oligonucleotide
aagtagatccgctattgcgacgtaa

SEQ ID NO: 679330 - DNA, 25 bp, Artificial sequence
  Synthetic oligonucleotide
aagtagatccgcaattgcgacgtaa

SEQ ID NO: 679331 - DNA, 25 bp, Artificial sequence
  Synthetic oligonucleotide
ctgatgtcgtacaacggctacatat

SEQ ID NO: 679332 - DNA, 25 bp, Artificial sequence
  Synthetic oligonucleotide
ctgatgtcgtactacggctacatat

SEQ ID NO: 679333 - DNA, 25 bp, Artificial sequence
  Synthetic oligonucleotide
atgcaccgcgatactaaagactcaa

SEQ ID NO: 679334 - DNA, 25 bp, Artificial sequence
  Synthetic oligonucleotide
atgcaccgcgattctaaagactcaa

SEQ ID NO: 679335 - DNA, 25 bp, Artificial sequence
  Synthetic oligonucleotide
tcggctatagggggcgtaattaatt

SEQ ID NO: 679336 - DNA, 25 bp, Artificial sequence
  Synthetic oligonucleotide
attccgagaacgtgcggtaatttgt

SEQ ID NO: 679337 - DNA, 25 bp, Artificial sequence
  Synthetic oligonucleotide
tattgttagtccctcgcaaggttag

SEQ ID NO: 679338 - DNA, 25 bp, Artificial sequence
  Synthetic oligonucleotide
atttgacgcgatatacagggaccat

SEQ ID NO: 679339 - DNA, 25 bp, Artificial sequence
  Synthetic oligonucleotide
acgttacgcgtaaactagtgtcaga

SEQ ID NO: 679340 - DNA, 25 bp, Artificial sequence
  Synthetic oligonucleotide
acgttacgcgtatactagtgtcaga

SEQ ID NO: 679341 - DNA, 25 bp, Artificial sequence
  Synthetic oligonucleotide
acaggtggttcttctacgctctata

SEQ ID NO: 679342 - DNA, 25 bp, Artificial sequence
  Synthetic oligonucleotide
acaggtggttctactacgctctata

SEQ ID NO: 679343 - DNA, 25 bp, Artificial sequence
  Synthetic oligonucleotide
tagcatatcgcgaataacgacgcat

SEQ ID NO: 679344 - DNA, 25 bp, Artificial sequence
  Synthetic oligonucleotide
tagcatatcgcgtataacgacgcat

SEQ ID NO: 679345 - DNA, 25 bp, Artificial sequence
  Synthetic oligonucleotide
ggactattacgaccgaagctcttaa

SEQ ID NO: 679346 - DNA, 25 bp, Artificial sequence
  Synthetic oligonucleotide
ggactattacgagcgaagctcttaa

SEQ ID NO: 679347 - DNA, 25 bp, Artificial sequence
  Synthetic oligonucleotide
gtgacagtaacggaatgcggatata

SEQ ID NO: 679348 - DNA, 25 bp, Artificial sequence
  Synthetic oligonucleotide
gtgacagtaacgcaatgcggatata

SEQ ID NO: 679349 - DNA, 25 bp, Artificial sequence
  Synthetic oligonucleotide
attccgagaacgagcggtaatttgt

SEQ ID NO: 679350 - DNA, 25 bp, Artificial sequence
  Synthetic oligonucleotide
gtcctttaattccggcgtatgactt

SEQ ID NO: 679351 - DNA, 25 bp, Artificial sequence
  Synthetic oligonucleotide
actaggtacgttgggtactagatac

SEQ ID NO: 679352 - DNA, 25 bp, Artificial sequence
  Synthetic oligonucleotide
gtccaacgctacctactacacataa

SEQ ID NO: 679353 - DNA, 25 bp, Artificial sequence
  Synthetic oligonucleotide
gtccaacgctacgtactacacataa

SEQ ID NO: 679354 - DNA, 25 bp, Artificial sequence
  Synthetic oligonucleotide
ggcattcgcgactaatctttacttg

SEQ ID NO: 679355 - DNA, 25 bp, Artificial sequence
  Synthetic oligonucleotide
ggcattcgcgacaaatctttacttg

SEQ ID NO: 679356 - DNA, 25 bp, Artificial sequence
  Synthetic oligonucleotide
ctgatcaatcgccctaacgatgata

SEQ ID NO: 679357 - DNA, 25 bp, Artificial sequence
  Synthetic oligonucleotide
ctgatcaatcgcgctaacgatgata

SEQ ID NO: 679358 - DNA, 25 bp, Artificial sequence
  Synthetic oligonucleotide
atgatcgtcgacccaagtagtaagt

SEQ ID NO: 679359 - DNA, 25 bp, Artificial sequence
  Synthetic oligonucleotide
atgatcgtcgacgcaagtagtaagt

SEQ ID NO: 679360 - DNA, 25 bp, Artificial sequence
  Synthetic oligonucleotide
tcactatcgacgcttaaaccttcgt

SEQ ID NO: 679361 - DNA, 25 bp, Artificial sequence
  Synthetic oligonucleotide
agaatttccgcgttgatcggatttg

SEQ ID NO: 679362 - DNA, 25 bp, Artificial sequence
  Synthetic oligonucleotide
tcggctatagggcgcgtaattaatt

SEQ ID NO: 679363 - DNA, 25 bp, Artificial sequence
  Synthetic oligonucleotide
gtcctttaattcgggcgtatgactt

SEQ ID NO: 679364 - DNA, 25 bp, Artificial sequence
  Synthetic oligonucleotide
atctcagctcgaaagaacgggaaat

SEQ ID NO: 679365 - DNA, 25 bp, Artificial sequence
  Synthetic oligonucleotide
tagtacgtatcaccgtacgctgtaa

SEQ ID NO: 679366 - DNA, 25 bp, Artificial sequence
  Synthetic oligonucleotide
tagtacgtatcagcgtacgctgtaa

SEQ ID NO: 679367 - DNA, 25 bp, Artificial sequence
  Synthetic oligonucleotide
taaagtcgaccccactagtataagc

SEQ ID NO: 679368 - DNA, 25 bp, Artificial sequence
  Synthetic oligonucleotide
taaagtcgacccgactagtataagc

SEQ ID NO: 679369 - DNA, 25 bp, Artificial sequence
  Synthetic oligonucleotide
atactgaacgcggtatcggatttga

SEQ ID NO: 679370 - DNA, 25 bp, Artificial sequence
  Synthetic oligonucleotide
atactgaacgcgctatcggatttga

SEQ ID NO: 679371 - DNA, 25 bp, Artificial sequence
  Synthetic oligonucleotide
ctttcggattacgtacgcgaaacaa

SEQ ID NO: 679372 - DNA, 25 bp, Artificial sequence
  Synthetic oligonucleotide
ctttcggattacctacgcgaaacaa

SEQ ID NO: 679373 - DNA, 25 bp, Artificial sequence
  Synthetic oligonucleotide
catcgtcgacgagcgctaattaaat

SEQ ID NO: 679374 - DNA, 25 bp, Artificial sequence
  Synthetic oligonucleotide
catcgtcgacgaccgctaattaaat

SEQ ID NO: 679375 - DNA, 25 bp, Artificial sequence
  Synthetic oligonucleotide
tattgttagtccgtcgcaaggttag

SEQ ID NO: 679376 - DNA, 25 bp, Artificial sequence
  Synthetic oligonucleotide
actaggtacgttcggtactagatac

SEQ ID NO: 679377 - DNA, 25 bp, Artificial sequence
  Synthetic oligonucleotide
aacaactagaccctacgcgtacatt

SEQ ID NO: 679378 - DNA, 25 bp, Artificial sequence
  Synthetic oligonucleotide
cccttttacgcgaagtaattcgtca

SEQ ID NO: 679379 - DNA, 25 bp, Artificial sequence
  Synthetic oligonucleotide
gaacccatataatcgcgtccaatca

SEQ ID NO: 679380 - DNA, 25 bp, Artificial sequence
  Synthetic oligonucleotide
gaacccatataaacgcgtccaatca

SEQ ID NO: 679381 - DNA, 25 bp, Artificial sequence
  Synthetic oligonucleotide
tttggtctcgcgtacgatatgaaac

SEQ ID NO: 679382 - DNA, 25 bp, Artificial sequence
  Synthetic oligonucleotide
tttggtctcgcgaacgatatgaaac

SEQ ID NO: 679383 - DNA, 25 bp, Artificial sequence
  Synthetic oligonucleotide
aatttagtattgccgtacccgatgg

SEQ ID NO: 679384 - DNA, 25 bp, Artificial sequence
  Synthetic oligonucleotide
aatttagtattggcgtacccgatgg

SEQ ID NO: 679385 - DNA, 25 bp, Artificial sequence
  Synthetic oligonucleotide
caaaaagcgtacgaactaggtcttg

SEQ ID NO: 679386 - DNA, 25 bp, Artificial sequence
  Synthetic oligonucleotide
caaaaagcgtaccaactaggtcttg

SEQ ID NO: 679387 - DNA, 25 bp, Artificial sequence
  Synthetic oligonucleotide
agttacttccgatacgctacgtctt

SEQ ID NO: 679388 - DNA, 25 bp, Artificial sequence
  Synthetic oligonucleotide
agttacttccgaaacgctacgtctt

SEQ ID NO: 679389 - DNA, 25 bp, Artificial sequence
  Synthetic oligonucleotide
cccttttacgcgtagtaattcgtca

SEQ ID NO: 679390 - DNA, 25 bp, Artificial sequence
  Synthetic oligonucleotide
tcagttctagcgcgatataaagcgt

SEQ ID NO: 679391 - DNA, 25 bp, Artificial sequence
  Synthetic oligonucleotide
gaataaccgtgcgtaatagtgagag

SEQ ID NO: 679392 - DNA, 25 bp, Artificial sequence
  Synthetic oligonucleotide
aacaactagaccgtacgcgtacatt

SEQ ID NO: 679393 - DNA, 25 bp, Artificial sequence
  Synthetic oligonucleotide
cgatcttcggcgtttaacggttata

SEQ ID NO: 679394 - DNA, 25 bp, Artificial sequence
  Synthetic oligonucleotide
gaataaccgtgcctaatagtgagag

SEQ ID NO: 679395 - DNA, 25 bp, Artificial sequence
  Synthetic oligonucleotide
tacaacgatcgagtatacgacacca

SEQ ID NO: 679396 - DNA, 25 bp, Artificial sequence
  Synthetic oligonucleotide
tatatatagggccgtatcgcgatga

SEQ ID NO: 679397 - DNA, 25 bp, Artificial sequence
  Synthetic oligonucleotide
tatatatagggcggtatcgcgatga

SEQ ID NO: 679398 - DNA, 25 bp, Artificial sequence
  Synthetic oligonucleotide
gcggaaacgtattgtcgcctattaa

SEQ ID NO: 679399 - DNA, 25 bp, Artificial sequence
  Synthetic oligonucleotide
gcggaaacgtatagtcgcctattaa

SEQ ID NO: 679400 - DNA, 25 bp, Artificial sequence
  Synthetic oligonucleotide
gctaattccgttatacgtgccagta

SEQ ID NO: 679401 - DNA, 25 bp, Artificial sequence
  Synthetic oligonucleotide
gctaattccgttttacgtgccagta

SEQ ID NO: 679402 - DNA, 25 bp, Artificial sequence
  Synthetic oligonucleotide
caatttccccgaacgcgtttattca

SEQ ID NO: 679403 - DNA, 25 bp, Artificial sequence
  Synthetic oligonucleotide
caatttccccgatcgcgtttattca

SEQ ID NO: 679404 - DNA, 25 bp, Artificial sequence
  Synthetic oligonucleotide
tcagttctagcgggatataaagcgt

SEQ ID NO: 679405 - DNA, 25 bp, Artificial sequence
  Synthetic oligonucleotide
agatctggcgtaatacgacacgaat

SEQ ID NO: 679406 - DNA, 25 bp, Artificial sequence
  Synthetic oligonucleotide
tttccgcgcgtgatatagttggatt

SEQ ID NO: 679407 - DNA, 25 bp, Artificial sequence
  Synthetic oligonucleotide
gttgttccgcgtacataagtgagtt

SEQ ID NO: 679408 - DNA, 25 bp, Artificial sequence
  Synthetic oligonucleotide
gttgttccgcgttcataagtgagtt

SEQ ID NO: 679409 - DNA, 25 bp, Artificial sequence
  Synthetic oligonucleotide
ccaagtcgattacgcgtacgaaata

SEQ ID NO: 679410 - DNA, 25 bp, Artificial sequence
  Synthetic oligonucleotide
gtttgtgcgtctagtatcgcgttaa

SEQ ID NO: 679411 - DNA, 25 bp, Artificial sequence
  Synthetic oligonucleotide
ccaagtcgattaggcgtacgaaata

SEQ ID NO: 679412 - DNA, 25 bp, Artificial sequence
  Synthetic oligonucleotide
gattgtcgcgcattagatactgctt

SEQ ID NO: 679413 - DNA, 25 bp, Artificial sequence
  Synthetic oligonucleotide
agatctggcgtattacgacacgaat

SEQ ID NO: 679414 - DNA, 25 bp, Artificial sequence
  Synthetic oligonucleotide
aacgggcgcgattcgtataattgtt

SEQ ID NO: 679415 - DNA, 25 bp, Artificial sequence
  Synthetic oligonucleotide
aacgggcgcgatacgtataattgtt

SEQ ID NO: 679416 - DNA, 25 bp, Artificial sequence
  Synthetic oligonucleotide
gcattatcgtacgataggcgttttg

SEQ ID NO: 679417 - DNA, 25 bp, Artificial sequence
  Synthetic oligonucleotide
gcattatcgtaccataggcgttttg

SEQ ID NO: 679418 - DNA, 25 bp, Artificial sequence
  Synthetic oligonucleotide
aataccatcaccgtacgggctttat

SEQ ID NO: 679419 - DNA, 25 bp, Artificial sequence
  Synthetic oligonucleotide
tttccgcgcgtgttatagttggatt

SEQ ID NO: 679420 - DNA, 25 bp, Artificial sequence
  Synthetic oligonucleotide
gattgtcgcgcaatagatactgctt

SEQ ID NO: 679421 - DNA, 25 bp, Artificial sequence
  Synthetic oligonucleotide
aataccatcaccctacgggctttat

SEQ ID NO: 679422 - DNA, 25 bp, Artificial sequence
  Synthetic oligonucleotide
ggttaagcgttccgatacggataat

SEQ ID NO: 679423 - DNA, 25 bp, Artificial sequence
  Synthetic oligonucleotide
cactcacgtacgtagttagattcca

SEQ ID NO: 679424 - DNA, 25 bp, Artificial sequence
  Synthetic oligonucleotide
cactcacgtacgaagttagattcca

SEQ ID NO: 679425 - DNA, 25 bp, Artificial sequence
  Synthetic oligonucleotide
agtgtacgttcgggacatacaatgt

SEQ ID NO: 679426 - DNA, 25 bp, Artificial sequence
  Synthetic oligonucleotide
ggttaagcgttcggatacggataat

SEQ ID NO: 679427 - DNA, 25 bp, Artificial sequence
  Synthetic oligonucleotide
tttttcagtatccacgcgtgtgtga

SEQ ID NO: 679428 - DNA, 25 bp, Artificial sequence
  Synthetic oligonucleotide
tttttcagtatcgacgcgtgtgtga

SEQ ID NO: 679429 - DNA, 25 bp, Artificial sequence
  Synthetic oligonucleotide
agtgtacgttcgcgacatacaatgt

SEQ ID NO: 679430 - DNA, 25 bp, Artificial sequence
  Synthetic oligonucleotide
attggcctatgcgccgcattcataa

SEQ ID NO: 679431 - DNA, 25 bp, Artificial sequence
  Synthetic oligonucleotide
attggcctatgccccgcattcataa

SEQ ID NO: 679432 - DNA, 25 bp, Artificial sequence
  Synthetic oligonucleotide
tggtgatacggtacgtaagccgtaa

SEQ ID NO: 679433 - DNA, 25 bp, Artificial sequence
  Synthetic oligonucleotide
tggtgatacggttcgtaagccgtaa

SEQ ID NO: 679434 - DNA, 25 bp, Artificial sequence
  Synthetic oligonucleotide
ttacttcgtgactagcgactgttcg

SEQ ID NO: 679435 - DNA, 25 bp, Artificial sequence
  Synthetic oligonucleotide
ttacttcgtgacaagcgactgttcg

SEQ ID NO: 679436 - DNA, 25 bp, Artificial sequence
  Synthetic oligonucleotide
atcgtaaacgtccggacgatcagat

SEQ ID NO: 679437 - DNA, 25 bp, Artificial sequence
  Synthetic oligonucleotide
atcgtaaacgtcgggacgatcagat

SEQ ID NO: 679438 - DNA, 25 bp, Artificial sequence
  Synthetic oligonucleotide
ggtcaaatcgcgtcgtataaggagt

SEQ ID NO: 679439 - DNA, 25 bp, Artificial sequence
  Synthetic oligonucleotide
ggtcaaatcgcgacgtataaggagt

SEQ ID NO: 679440 - DNA, 25 bp, Artificial sequence
  Synthetic oligonucleotide
ttctctcttcgcgaactaggcgaaa

SEQ ID NO: 679441 - DNA, 25 bp, Artificial sequence
  Synthetic oligonucleotide
tcttctacccgcgtatacgacagta

SEQ ID NO: 679442 - DNA, 25 bp, Artificial sequence
  Synthetic oligonucleotide
caaaactctacgggatactccgttg

SEQ ID NO: 679443 - DNA, 25 bp, Artificial sequence
  Synthetic oligonucleotide
caaaactctacgcgatactccgttg

SEQ ID NO: 679444 - DNA, 25 bp, Artificial sequence
  Synthetic oligonucleotide
aaagagaccgtaggctacgccataa

SEQ ID NO: 679445 - DNA, 25 bp, Artificial sequence
  Synthetic oligonucleotide
aaagagaccgtacgctacgccataa

SEQ ID NO: 679446 - DNA, 25 bp, Artificial sequence
  Synthetic oligonucleotide
tcttctacccgcctatacgacagta

SEQ ID NO: 679447 - DNA, 25 bp, Artificial sequence
  Synthetic oligonucleotide
aagctgacacccctcgatactaagt

SEQ ID NO: 679448 - DNA, 25 bp, Artificial sequence
  Synthetic oligonucleotide
gaggtgctaacgatcgcgttaatac

SEQ ID NO: 679449 - DNA, 25 bp, Artificial sequence
  Synthetic oligonucleotide
aagctgacacccgtcgatactaagt

SEQ ID NO: 679450 - DNA, 25 bp, Artificial sequence
  Synthetic oligonucleotide
tatccgtcgcgtaagcctattacac

SEQ ID NO: 679451 - DNA, 25 bp, Artificial sequence
  Synthetic oligonucleotide
tctaagtcgacgcgggataattcga

SEQ ID NO: 679452 - DNA, 25 bp, Artificial sequence
  Synthetic oligonucleotide
gaggtgctaacgttcgcgttaatac

SEQ ID NO: 679453 - DNA, 25 bp, Artificial sequence
  Synthetic oligonucleotide
ttctctcttcgccaactaggcgaaa

SEQ ID NO: 679454 - DNA, 25 bp, Artificial sequence
  Synthetic oligonucleotide
acttcttaaacgcctgtcgcatcct

SEQ ID NO: 679455 - DNA, 25 bp, Artificial sequence
  Synthetic oligonucleotide
gtgaaacgactaggctttagactgg

SEQ ID NO: 679456 - DNA, 25 bp, Artificial sequence
  Synthetic oligonucleotide
gaggtattacgcgtagggaagaagt

SEQ ID NO: 679457 - DNA, 25 bp, Artificial sequence
  Synthetic oligonucleotide
agtctagatacgctcggtaaactcg

SEQ ID NO: 679458 - DNA, 25 bp, Artificial sequence
  Synthetic oligonucleotide
gcaaagcgtatcgctaggagtttac

SEQ ID NO: 679459 - DNA, 25 bp, Artificial sequence
  Synthetic oligonucleotide
gcaaagcgtatccctaggagtttac

SEQ ID NO: 679460 - DNA, 25 bp, Artificial sequence
  Synthetic oligonucleotide
acttcttaaacggctgtcgcatcct

SEQ ID NO: 679461 - DNA, 25 bp, Artificial sequence
  Synthetic oligonucleotide
agtctagatacggtcggtaaactcg

SEQ ID NO: 679462 - DNA, 25 bp, Artificial sequence
  Synthetic oligonucleotide
actgacggtaacggcgttagttgta

SEQ ID NO: 679463 - DNA, 25 bp, Artificial sequence
  Synthetic oligonucleotide
actgacggtaaccgcgttagttgta

SEQ ID NO: 679464 - DNA, 25 bp, Artificial sequence
  Synthetic oligonucleotide
ggctagcaccgacgtaataatacgt

SEQ ID NO: 679465 - DNA, 25 bp, Artificial sequence
  Synthetic oligonucleotide
ggctagcaccgaggtaataatacgt

SEQ ID NO: 679466 - DNA, 25 bp, Artificial sequence
  Synthetic oligonucleotide
tatccgtcgcgttagcctattacac

SEQ ID NO: 679467 - DNA, 25 bp, Artificial sequence
  Synthetic oligonucleotide
atcccagtcgttacgcgatcaaaca

SEQ ID NO: 679468 - DNA, 25 bp, Artificial sequence
  Synthetic oligonucleotide
atcccagtcgtttcgcgatcaaaca

SEQ ID NO: 679469 - DNA, 25 bp, Artificial sequence
  Synthetic oligonucleotide
atcaatgccgaccgtataagctctc

SEQ ID NO: 679470 - DNA, 25 bp, Artificial sequence
  Synthetic oligonucleotide
atcaatgccgacggtataagctctc

SEQ ID NO: 679471 - DNA, 25 bp, Artificial sequence
  Synthetic oligonucleotide
tcgattgtcgcgtagtatccctttg

SEQ ID NO: 679472 - DNA, 25 bp, Artificial sequence
  Synthetic oligonucleotide
tcgattgtcgcgaagtatccctttg

SEQ ID NO: 679473 - DNA, 25 bp, Artificial sequence
  Synthetic oligonucleotide
gtgtaaactaatttcgcgcggatcg

SEQ ID NO: 679474 - DNA, 25 bp, Artificial sequence
  Synthetic oligonucleotide
gtgtaaactaatatcgcgcggatcg

SEQ ID NO: 679475 - DNA, 25 bp, Artificial sequence
  Synthetic oligonucleotide
tgtgtcaatacgacgtccggatcta

SEQ ID NO: 679476 - DNA, 25 bp, Artificial sequence
  Synthetic oligonucleotide
tgtgtcaatacgtcgtccggatcta

SEQ ID NO: 679477 - DNA, 25 bp, Artificial sequence
  Synthetic oligonucleotide
tctaagtcgacgggggataattcga

SEQ ID NO: 679478 - DNA, 25 bp, Artificial sequence
  Synthetic oligonucleotide
tgcttctcggcgggatttaatacac

SEQ ID NO: 679479 - DNA, 25 bp, Artificial sequence
  Synthetic oligonucleotide
gcgtaactattagtcgcgggaagtt

SEQ ID NO: 679480 - DNA, 25 bp, Artificial sequence
  Synthetic oligonucleotide
gtccaacgttcgacggtatactcat

SEQ ID NO: 679481 - DNA, 25 bp, Artificial sequence
  Synthetic oligonucleotide
gtccaacgttcgtcggtatactcat

SEQ ID NO: 679482 - DNA, 25 bp, Artificial sequence
  Synthetic oligonucleotide
atacgattcgcgcatggataacgtg

SEQ ID NO: 679483 - DNA, 25 bp, Artificial sequence
  Synthetic oligonucleotide
atacgattcgcggatggataacgtg

SEQ ID NO: 679484 - DNA, 25 bp, Artificial sequence
  Synthetic oligonucleotide
ttacaatatcgcccatcgttcgacg

SEQ ID NO: 679485 - DNA, 25 bp, Artificial sequence
  Synthetic oligonucleotide
ttacaatatcgcgcatcgttcgacg

SEQ ID NO: 679486 - DNA, 25 bp, Artificial sequence
  Synthetic oligonucleotide
cacgaagacgccgtacttatgaact

SEQ ID NO: 679487 - DNA, 25 bp, Artificial sequence
  Synthetic oligonucleotide
cacgaagacgccctacttatgaact

SEQ ID NO: 679488 - DNA, 25 bp, Artificial sequence
  Synthetic oligonucleotide
cgagtttgtatcggaccgcttgtat

SEQ ID NO: 679489 - DNA, 25 bp, Artificial sequence
  Synthetic oligonucleotide
atgtttgtctcgggttaaggaccgt

SEQ ID NO: 679490 - DNA, 25 bp, Artificial sequence
  Synthetic oligonucleotide
tgcttctcggcgcgatttaatacac

SEQ ID NO: 679491 - DNA, 25 bp, Artificial sequence
  Synthetic oligonucleotide
tcagtggtccggcgtataagttaca

SEQ ID NO: 679492 - DNA, 25 bp, Artificial sequence
  Synthetic oligonucleotide
atagagcgctagttcgcccttgaaa

SEQ ID NO: 679493 - DNA, 25 bp, Artificial sequence
  Synthetic oligonucleotide
atagagcgctagatcgcccttgaaa

SEQ ID NO: 679494 - DNA, 25 bp, Artificial sequence
  Synthetic oligonucleotide
gcgtaactattactcgcgggaagtt

SEQ ID NO: 679495 - DNA, 25 bp, Artificial sequence
  Synthetic oligonucleotide
gaggtattacgcctagggaagaagt

SEQ ID NO: 679496 - DNA, 25 bp, Artificial sequence
  Synthetic oligonucleotide
tgtacttaacggatcgcgtcaagtg

SEQ ID NO: 679497 - DNA, 25 bp, Artificial sequence
  Synthetic oligonucleotide
tgtacttaacggttcgcgtcaagtg

SEQ ID NO: 679498 - DNA, 25 bp, Artificial sequence
  Synthetic oligonucleotide
gaaagaactacgatacgccaacctg

SEQ ID NO: 679499 - DNA, 25 bp, Artificial sequence
  Synthetic oligonucleotide
gaaagaactacgttacgccaacctg

SEQ ID NO: 679500 - DNA, 25 bp, Artificial sequence
  Synthetic oligonucleotide
agtaggcgctatctaaccgtaacag

SEQ ID NO: 679501 - DNA, 25 bp, Artificial sequence
  Synthetic oligonucleotide
tccattcgtaccgttgtatggtagc

SEQ ID NO: 679502 - DNA, 25 bp, Artificial sequence
  Synthetic oligonucleotide
cgagtttgtatccgaccgcttgtat

SEQ ID NO: 679503 - DNA, 25 bp, Artificial sequence
  Synthetic oligonucleotide
ttgcttcgctacaggcgtactagta

SEQ ID NO: 679504 - DNA, 25 bp, Artificial sequence
  Synthetic oligonucleotide
gcgtaacgcctatcgtacagtctaa

SEQ ID NO: 679505 - DNA, 25 bp, Artificial sequence
  Synthetic oligonucleotide
gcgtaacgcctaacgtacagtctaa

SEQ ID NO: 679506 - DNA, 25 bp, Artificial sequence
  Synthetic oligonucleotide
tcggaaccgtagaccgatagactta

SEQ ID NO: 679507 - DNA, 25 bp, Artificial sequence
  Synthetic oligonucleotide
tcggaaccgtagtccgatagactta

SEQ ID NO: 679508 - DNA, 25 bp, Artificial sequence
  Synthetic oligonucleotide
gaaatcctagtcgcgacgtggttta

SEQ ID NO: 679509 - DNA, 25 bp, Artificial sequence
  Synthetic oligonucleotide
gaaatcctagtcccgacgtggttta

SEQ ID NO: 679510 - DNA, 25 bp, Artificial sequence
  Synthetic oligonucleotide
tcctcgcgcgattctaagttacaac

SEQ ID NO: 679511 - DNA, 25 bp, Artificial sequence
  Synthetic oligonucleotide
tcctcgcgcgatactaagttacaac

SEQ ID NO: 679512 - DNA, 25 bp, Artificial sequence
  Synthetic oligonucleotide
attagtgtaataggtcgcgaccacc

SEQ ID NO: 679513 - DNA, 25 bp, Artificial sequence
  Synthetic oligonucleotide
attagtgtaatacgtcgcgaccacc

SEQ ID NO: 679514 - DNA, 25 bp, Artificial sequence
  Synthetic oligonucleotide
atgtttgtctcgcgttaaggaccgt

SEQ ID NO: 679515 - DNA, 25 bp, Artificial sequence
  Synthetic oligonucleotide
ataactcgtacgtgcgataagtccg

SEQ ID NO: 679516 - DNA, 25 bp, Artificial sequence
  Synthetic oligonucleotide
gtgaaacgactacgctttagactgg

SEQ ID NO: 679517 - DNA, 25 bp, Artificial sequence
  Synthetic oligonucleotide
ttgcttcgctactggcgtactagta

SEQ ID NO: 679518 - DNA, 25 bp, Artificial sequence
  Synthetic oligonucleotide
taggaatacgtccttagactggtcg

SEQ ID NO: 679519 - DNA, 25 bp, Artificial sequence
  Synthetic oligonucleotide
taggaatacgtcgttagactggtcg

SEQ ID NO: 679520 - DNA, 25 bp, Artificial sequence
  Synthetic oligonucleotide
atactgtactcgacggtcgaacact

SEQ ID NO: 679521 - DNA, 25 bp, Artificial sequence
  Synthetic oligonucleotide
atactgtactcgtcggtcgaacact

SEQ ID NO: 679522 - DNA, 25 bp, Artificial sequence
  Synthetic oligonucleotide
cgagccgtacgatcgtatgattgaa

SEQ ID NO: 679523 - DNA, 25 bp, Artificial sequence
  Synthetic oligonucleotide
cgagccgtacgaacgtatgattgaa

SEQ ID NO: 679524 - DNA, 25 bp, Artificial sequence
  Synthetic oligonucleotide
cgacaactcgtaacgggtataactc

SEQ ID NO: 679525 - DNA, 25 bp, Artificial sequence
  Synthetic oligonucleotide
cgacaactcgtatcgggtataactc

SEQ ID NO: 679526 - DNA, 25 bp, Artificial sequence
  Synthetic oligonucleotide
tcagtggtccggggtataagttaca

SEQ ID NO: 679527 - DNA, 25 bp, Artificial sequence
  Synthetic oligonucleotide
ataactcgtacgagcgataagtccg

SEQ ID NO: 679528 - DNA, 25 bp, Artificial sequence
  Synthetic oligonucleotide
aatatgacatgctacgtcggcatgc

SEQ ID NO: 679529 - DNA, 25 bp, Artificial sequence
  Synthetic oligonucleotide
cctcatgcgtaaggggattctgata

SEQ ID NO: 679530 - DNA, 25 bp, Artificial sequence
  Synthetic oligonucleotide
gtaagggcggtccacgtaatttcaa

SEQ ID NO: 679531 - DNA, 25 bp, Artificial sequence
  Synthetic oligonucleotide
gtaagggcggtcgacgtaatttcaa

SEQ ID NO: 679532 - DNA, 25 bp, Artificial sequence
  Synthetic oligonucleotide
tgtcccctcgatacgtcgagaattt

SEQ ID NO: 679533 - DNA, 25 bp, Artificial sequence
  Synthetic oligonucleotide
tgtcccctcgattcgtcgagaattt

SEQ ID NO: 679534 - DNA, 25 bp, Artificial sequence
  Synthetic oligonucleotide
ggtgattatacgtccgcaacagaac

SEQ ID NO: 679535 - DNA, 25 bp, Artificial sequence
  Synthetic oligonucleotide
ggtgattatacgaccgcaacagaac

SEQ ID NO: 679536 - DNA, 25 bp, Artificial sequence
  Synthetic oligonucleotide
cagaccccgacgtgtaatgtgtaat

SEQ ID NO: 679537 - DNA, 25 bp, Artificial sequence
  Synthetic oligonucleotide
cagaccccgacgagtaatgtgtaat

SEQ ID NO: 679538 - DNA, 25 bp, Artificial sequence
  Synthetic oligonucleotide
gaatactaacggctccgaaccgata

SEQ ID NO: 679539 - DNA, 25 bp, Artificial sequence
  Synthetic oligonucleotide
tccttccgtaagcacgtattcacca

SEQ ID NO: 679540 - DNA, 25 bp, Artificial sequence
  Synthetic oligonucleotide
ctaagagcgcgattatactagggtc

SEQ ID NO: 679541 - DNA, 25 bp, Artificial sequence
  Synthetic oligonucleotide
aatatgacatgcaacgtcggcatgc

SEQ ID NO: 679542 - DNA, 25 bp, Artificial sequence
  Synthetic oligonucleotide
gtatctgacgattcgccgagaacat

SEQ ID NO: 679543 - DNA, 25 bp, Artificial sequence
  Synthetic oligonucleotide
gtatctgacgatacgccgagaacat

SEQ ID NO: 679544 - DNA, 25 bp, Artificial sequence
  Synthetic oligonucleotide
ttacccatgtcgaatagcggaaagg

SEQ ID NO: 679545 - DNA, 25 bp, Artificial sequence
  Synthetic oligonucleotide
ttacccatgtcgtatagcggaaagg

SEQ ID NO: 679546 - DNA, 25 bp, Artificial sequence
  Synthetic oligonucleotide
cgcataaacgagtcgtatctgcatc

SEQ ID NO: 679547 - DNA, 25 bp, Artificial sequence
  Synthetic oligonucleotide
cgcataaacgagacgtatctgcatc

SEQ ID NO: 679548 - DNA, 25 bp, Artificial sequence
  Synthetic oligonucleotide
caaacatcgacgactaacgggtaac

SEQ ID NO: 679549 - DNA, 25 bp, Artificial sequence
  Synthetic oligonucleotide
caaacatcgacgtctaacgggtaac

SEQ ID NO: 679550 - DNA, 25 bp, Artificial sequence
  Synthetic oligonucleotide
gattaaggttcgcgcgtaacggaaa

SEQ ID NO: 679551 - DNA, 25 bp, Artificial sequence
  Synthetic oligonucleotide
tccttccgtaaggacgtattcacca

SEQ ID NO: 679552 - DNA, 25 bp, Artificial sequence
  Synthetic oligonucleotide
tttgattatcgcgctagttctcccg

SEQ ID NO: 679553 - DNA, 25 bp, Artificial sequence
  Synthetic oligonucleotide
gactgctataatggacccgtctgaa

SEQ ID NO: 679554 - DNA, 25 bp, Artificial sequence
  Synthetic oligonucleotide
tccattcgtacccttgtatggtagc

SEQ ID NO: 679555 - DNA, 25 bp, Artificial sequence
  Synthetic oligonucleotide
ctcggtgcgtaaacgactaacatct

SEQ ID NO: 679556 - DNA, 25 bp, Artificial sequence
  Synthetic oligonucleotide
gattaaggttcgggcgtaacggaaa

SEQ ID NO: 679557 - DNA, 25 bp, Artificial sequence
  Synthetic oligonucleotide
aagtgggttagtccgcgatgtgtaa

SEQ ID NO: 679558 - DNA, 25 bp, Artificial sequence
  Synthetic oligonucleotide
aagtgggttagtgcgcgatgtgtaa

SEQ ID NO: 679559 - DNA, 25 bp, Artificial sequence
  Synthetic oligonucleotide
cggttttatcgactagcgtagagga

SEQ ID NO: 679560 - DNA, 25 bp, Artificial sequence
  Synthetic oligonucleotide
cggttttatcgagtagcgtagagga

SEQ ID NO: 679561 - DNA, 25 bp, Artificial sequence
  Synthetic oligonucleotide
ctctaaatggtttgacgcgctacgt

SEQ ID NO: 679562 - DNA, 25 bp, Artificial sequence
  Synthetic oligonucleotide
ctctaaatggttagacgcgctacgt

SEQ ID NO: 679563 - DNA, 25 bp, Artificial sequence
  Synthetic oligonucleotide
cctcatgcgtaacgggattctgata

SEQ ID NO: 679564 - DNA, 25 bp, Artificial sequence
  Synthetic oligonucleotide
ttatattctcaacgcgcctagtggc

SEQ ID NO: 679565 - DNA, 25 bp, Artificial sequence
  Synthetic oligonucleotide
ctaagagcgcgaatatactagggtc

SEQ ID NO: 679566 - DNA, 25 bp, Artificial sequence
  Synthetic oligonucleotide
tttgattatcgccctagttctcccg

SEQ ID NO: 679567 - DNA, 25 bp, Artificial sequence
  Synthetic oligonucleotide
agcgtccgatcgaacgttgattgat

SEQ ID NO: 679568 - DNA, 25 bp, Artificial sequence
  Synthetic oligonucleotide
agcgtccgatcgtacgttgattgat

SEQ ID NO: 679569 - DNA, 25 bp, Artificial sequence
  Synthetic oligonucleotide
acatctttcgcgggcatagttgctt

SEQ ID NO: 679570 - DNA, 25 bp, Artificial sequence
  Synthetic oligonucleotide
acatctttcgcgcgcatagttgctt

SEQ ID NO: 679571 - DNA, 25 bp, Artificial sequence
  Synthetic oligonucleotide
gacgattacgtctcgacgttgagaa

SEQ ID NO: 679572 - DNA, 25 bp, Artificial sequence
  Synthetic oligonucleotide
gacgattacgtcacgacgttgagaa

SEQ ID NO: 679573 - DNA, 25 bp, Artificial sequence
  Synthetic oligonucleotide
caaaacgtctcgcgttatgcagttc

SEQ ID NO: 679574 - DNA, 25 bp, Artificial sequence
  Synthetic oligonucleotide
caaaacgtctcgggttatgcagttc

SEQ ID NO: 679575 - DNA, 25 bp, Artificial sequence
  Synthetic oligonucleotide
gtcgctgacttcccgacgttattta

SEQ ID NO: 679576 - DNA, 25 bp, Artificial sequence
  Synthetic oligonucleotide
ttatattctcaaggcgcctagtggc

SEQ ID NO: 679577 - DNA, 25 bp, Artificial sequence
  Synthetic oligonucleotide
caacgaggtacgggatagttgttga

SEQ ID NO: 679578 - DNA, 25 bp, Artificial sequence
  Synthetic oligonucleotide
agatgaatcgtacgaacgcggtgaa

SEQ ID NO: 679579 - DNA, 25 bp, Artificial sequence
  Synthetic oligonucleotide
agatgaatcgtaggaacgcggtgaa

SEQ ID NO: 679580 - DNA, 25 bp, Artificial sequence
  Synthetic oligonucleotide
gcaagttgtcgacgctattaatgcc

SEQ ID NO: 679581 - DNA, 25 bp, Artificial sequence
  Synthetic oligonucleotide
gcaagttgtcgaggctattaatgcc

SEQ ID NO: 679582 - DNA, 25 bp, Artificial sequence
  Synthetic oligonucleotide
gagtttttacgcgatggacgatcct

SEQ ID NO: 679583 - DNA, 25 bp, Artificial sequence
  Synthetic oligonucleotide
gagtttttacgccatggacgatcct

SEQ ID NO: 679584 - DNA, 25 bp, Artificial sequence
  Synthetic oligonucleotide
ttcgaatatgtcgttcgcgttgcca

SEQ ID NO: 679585 - DNA, 25 bp, Artificial sequence
  Synthetic oligonucleotide
ttcgaatatgtccttcgcgttgcca

SEQ ID NO: 679586 - DNA, 25 bp, Artificial sequence
  Synthetic oligonucleotide
agaaaacgtcgtatacggactgcct

SEQ ID NO: 679587 - DNA, 25 bp, Artificial sequence
  Synthetic oligonucleotide
gaatactaacgggtccgaaccgata

SEQ ID NO: 679588 - DNA, 25 bp, Artificial sequence
  Synthetic oligonucleotide
caacgaggtacgcgatagttgttga

SEQ ID NO: 679589 - DNA, 25 bp, Artificial sequence
  Synthetic oligonucleotide
agcaacttgacggcgctatactcat

SEQ ID NO: 679590 - DNA, 25 bp, Artificial sequence
  Synthetic oligonucleotide
ccacttgtgtgcgacgtaacagata

SEQ ID NO: 679591 - DNA, 25 bp, Artificial sequence
  Synthetic oligonucleotide
ccacttgtgtgccacgtaacagata

SEQ ID NO: 679592 - DNA, 25 bp, Artificial sequence
  Synthetic oligonucleotide
agtttacgcccgtatactacaacgc

SEQ ID NO: 679593 - DNA, 25 bp, Artificial sequence
  Synthetic oligonucleotide
agtttacgcccgaatactacaacgc

SEQ ID NO: 679594 - DNA, 25 bp, Artificial sequence
  Synthetic oligonucleotide
attgtaatcgtagatcgcggcagac

SEQ ID NO: 679595 - DNA, 25 bp, Artificial sequence
  Synthetic oligonucleotide
attgtaatcgtacatcgcggcagac

SEQ ID NO: 679596 - DNA, 25 bp, Artificial sequence
  Synthetic oligonucleotide
gggacgtatagttacgcgaataacg

SEQ ID NO: 679597 - DNA, 25 bp, Artificial sequence
  Synthetic oligonucleotide
gggacgtatagtaacgcgaataacg

SEQ ID NO: 679598 - DNA, 25 bp, Artificial sequence
  Synthetic oligonucleotide
acgttcgcgtattcgatactggatc

SEQ ID NO: 679599 - DNA, 25 bp, Artificial sequence
  Synthetic oligonucleotide
acgttcgcgtatacgatactggatc

SEQ ID NO: 679600 - DNA, 25 bp, Artificial sequence
  Synthetic oligonucleotide
agaaaacgtcgtttacggactgcct

SEQ ID NO: 679601 - DNA, 25 bp, Artificial sequence
  Synthetic oligonucleotide
gacacttaatcggcgtatggggaat

SEQ ID NO: 679602 - DNA, 25 bp, Artificial sequence
  Synthetic oligonucleotide
gtcgctgacttcgcgacgttattta

SEQ ID NO: 679603 - DNA, 25 bp, Artificial sequence
  Synthetic oligonucleotide
caccccccattaaaacgcgaagtat

SEQ ID NO: 679604 - DNA, 25 bp, Artificial sequence
  Synthetic oligonucleotide
caccccccattataacgcgaagtat

SEQ ID NO: 679605 - DNA, 25 bp, Artificial sequence
  Synthetic oligonucleotide
gactatagcgcgactattggcatga

SEQ ID NO: 679606 - DNA, 25 bp, Artificial sequence
  Synthetic oligonucleotide
gactatagcgcgtctattggcatga

SEQ ID NO: 679607 - DNA, 25 bp, Artificial sequence
  Synthetic oligonucleotide
atctcaagccgagcgtaatagccat

SEQ ID NO: 679608 - DNA, 25 bp, Artificial sequence
  Synthetic oligonucleotide
atctcaagccgaccgtaatagccat

SEQ ID NO: 679609 - DNA, 25 bp, Artificial sequence
  Synthetic oligonucleotide
aaaggtcgcgtattgaggtgacctt

SEQ ID NO: 679610 - DNA, 25 bp, Artificial sequence
  Synthetic oligonucleotide
aaaggtcgcgtaatgaggtgacctt

SEQ ID NO: 679611 - DNA, 25 bp, Artificial sequence
  Synthetic oligonucleotide
tatccacggacgtactaggtaacct

SEQ ID NO: 679612 - DNA, 25 bp, Artificial sequence
  Synthetic oligonucleotide
tactgtgtatcgggtaccaacgttg

SEQ ID NO: 679613 - DNA, 25 bp, Artificial sequence
  Synthetic oligonucleotide
gacacttaatcgccgtatggggaat

SEQ ID NO: 679614 - DNA, 25 bp, Artificial sequence
  Synthetic oligonucleotide
tactgtgtatcgcgtaccaacgttg

SEQ ID NO: 679615 - DNA, 25 bp, Artificial sequence
  Synthetic oligonucleotide
tatcccgtagtacttcgcgagtact

SEQ ID NO: 679616 - DNA, 25 bp, Artificial sequence
  Synthetic oligonucleotide
tatcccgtagtagttcgcgagtact

SEQ ID NO: 679617 - DNA, 25 bp, Artificial sequence
  Synthetic oligonucleotide
agataccgcggtacgtaaatactgc

SEQ ID NO: 679618 - DNA, 25 bp, Artificial sequence
  Synthetic oligonucleotide
agataccgcggttcgtaaatactgc

SEQ ID NO: 679619 - DNA, 25 bp, Artificial sequence
  Synthetic oligonucleotide
tgtgcaacggttcgctaaccgttaa

SEQ ID NO: 679620 - DNA, 25 bp, Artificial sequence
  Synthetic oligonucleotide
tgtgcaacggttggctaaccgttaa

SEQ ID NO: 679621 - DNA, 25 bp, Artificial sequence
  Synthetic oligonucleotide
cacgcacttcgagttacggatgttt

SEQ ID NO: 679622 - DNA, 25 bp, Artificial sequence
  Synthetic oligonucleotide
cacgcacttcgacttacggatgttt

SEQ ID NO: 679623 - DNA, 25 bp, Artificial sequence
  Synthetic oligonucleotide
agcaacttgacgccgctatactcat

SEQ ID NO: 679624 - DNA, 25 bp, Artificial sequence
  Synthetic oligonucleotide
agtaggcgctatgtaaccgtaacag

SEQ ID NO: 679625 - DNA, 25 bp, Artificial sequence
  Synthetic oligonucleotide
tatccacggacgaactaggtaacct

SEQ ID NO: 679626 - DNA, 25 bp, Artificial sequence
  Synthetic oligonucleotide
agcttagtacaagcggtcgctttct

SEQ ID NO: 679627 - DNA, 25 bp, Artificial sequence
  Synthetic oligonucleotide
actggaaccctaggaatcggttatc

SEQ ID NO: 679628 - DNA, 25 bp, Artificial sequence
  Synthetic oligonucleotide
actggaaccctacgaatcggttatc

SEQ ID NO: 679629 - DNA, 25 bp, Artificial sequence
  Synthetic oligonucleotide
gtgtatgtgcgttatgtcgccagat

SEQ ID NO: 679630 - DNA, 25 bp, Artificial sequence
  Synthetic oligonucleotide
gtgtatgtgcgtaatgtcgccagat

SEQ ID NO: 679631 - DNA, 25 bp, Artificial sequence
  Synthetic oligonucleotide
gctagactaagtcgcgcatagagaa

SEQ ID NO: 679632 - DNA, 25 bp, Artificial sequence
  Synthetic oligonucleotide
gctagactaagtggcgcatagagaa

SEQ ID NO: 679633 - DNA, 25 bp, Artificial sequence
  Synthetic oligonucleotide
cctactatatacctcgccttcgaca

SEQ ID NO: 679634 - DNA, 25 bp, Artificial sequence
  Synthetic oligonucleotide
cctactatatacgtcgccttcgaca

SEQ ID NO: 679635 - DNA, 25 bp, Artificial sequence
  Synthetic oligonucleotide
gtaactttaacgcgcgtactgtcac

SEQ ID NO: 679636 - DNA, 25 bp, Artificial sequence
  Synthetic oligonucleotide
gtaactttaacgggcgtactgtcac

SEQ ID NO: 679637 - DNA, 25 bp, Artificial sequence
  Synthetic oligonucleotide
cctatagaccgtgtagcgttgatgt

SEQ ID NO: 679638 - DNA, 25 bp, Artificial sequence
  Synthetic oligonucleotide
acactctcgtacctcggctgaatat

SEQ ID NO: 679639 - DNA, 25 bp, Artificial sequence
  Synthetic oligonucleotide
atagtgatacgtggttcggtggtgt

SEQ ID NO: 679640 - DNA, 25 bp, Artificial sequence
  Synthetic oligonucleotide
agcttagtacaaccggtcgctttct

SEQ ID NO: 679641 - DNA, 25 bp, Artificial sequence
  Synthetic oligonucleotide
aaaatatagcgcccaacgaccttcc

SEQ ID NO: 679642 - DNA, 25 bp, Artificial sequence
  Synthetic oligonucleotide
aaaatatagcgcgcaacgaccttcc

SEQ ID NO: 679643 - DNA, 25 bp, Artificial sequence
  Synthetic oligonucleotide
attcacagtcgttccgtagcagcaa

SEQ ID NO: 679644 - DNA, 25 bp, Artificial sequence
  Synthetic oligonucleotide
attcacagtcgtaccgtagcagcaa

SEQ ID NO: 679645 - DNA, 25 bp, Artificial sequence
  Synthetic oligonucleotide
ggtgttcgaataaacggcgaacgaa

SEQ ID NO: 679646 - DNA, 25 bp, Artificial sequence
  Synthetic oligonucleotide
ggtgttcgaatatacggcgaacgaa

SEQ ID NO: 679647 - DNA, 25 bp, Artificial sequence
  Synthetic oligonucleotide
agaatgttagggagacgcgtctatc

SEQ ID NO: 679648 - DNA, 25 bp, Artificial sequence
  Synthetic oligonucleotide
agaatgttagggtgacgcgtctatc

SEQ ID NO: 679649 - DNA, 25 bp, Artificial sequence
  Synthetic oligonucleotide
ctcggtgcgtaatcgactaacatct

SEQ ID NO: 679650 - DNA, 25 bp, Artificial sequence
  Synthetic oligonucleotide
acactctcgtacgtcggctgaatat

SEQ ID NO: 679651 - DNA, 25 bp, Artificial sequence
  Synthetic oligonucleotide
tgctcttactaacgcgtagccagat

SEQ ID NO: 679652 - DNA, 25 bp, Artificial sequence
  Synthetic oligonucleotide
gaatgccggtaaggtcgtacatcta

SEQ ID NO: 679653 - DNA, 25 bp, Artificial sequence
  Synthetic oligonucleotide
aggattggttcgtaccgtaacgatg

SEQ ID NO: 679654 - DNA, 25 bp, Artificial sequence
  Synthetic oligonucleotide
ggctttcgtctactaacggttcagt

SEQ ID NO: 679655 - DNA, 25 bp, Artificial sequence
  Synthetic oligonucleotide
ggctttcgtctagtaacggttcagt

SEQ ID NO: 679656 - DNA, 25 bp, Artificial sequence
  Synthetic oligonucleotide
ttcagcacgtacgatacgccgtata

SEQ ID NO: 679657 - DNA, 25 bp, Artificial sequence
  Synthetic oligonucleotide
ttcagcacgtaccatacgccgtata

SEQ ID NO: 679658 - DNA, 25 bp, Artificial sequence
  Synthetic oligonucleotide
tgaagcatgtaatacgccggatagg

SEQ ID NO: 679659 - DNA, 25 bp, Artificial sequence
  Synthetic oligonucleotide
tgaagcatgtaaaacgccggatagg

SEQ ID NO: 679660 - DNA, 25 bp, Artificial sequence
  Synthetic oligonucleotide
gactaacgatacgcaaggtttccac

SEQ ID NO: 679661 - DNA, 25 bp, Artificial sequence
  Synthetic oligonucleotide
gactaacgatacccaaggtttccac

SEQ ID NO: 679662 - DNA, 25 bp, Artificial sequence
  Synthetic oligonucleotide
taattttcgcggcaggtaaaggctc

SEQ ID NO: 679663 - DNA, 25 bp, Artificial sequence
  Synthetic oligonucleotide
acaacacgttattcgcgatcccatg

SEQ ID NO: 679664 - DNA, 25 bp, Artificial sequence
  Synthetic oligonucleotide
taattttcgcgggaggtaaaggctc

SEQ ID NO: 679665 - DNA, 25 bp, Artificial sequence
  Synthetic oligonucleotide
tgctcttactaaggcgtagccagat

SEQ ID NO: 679666 - DNA, 25 bp, Artificial sequence
  Synthetic oligonucleotide
tttctcttcgcgctcggtacatgta

SEQ ID NO: 679667 - DNA, 25 bp, Artificial sequence
  Synthetic oligonucleotide
tttctcttcgcggtcggtacatgta

SEQ ID NO: 679668 - DNA, 25 bp, Artificial sequence
  Synthetic oligonucleotide
ccatgtggtaccgcgatatctcttt

SEQ ID NO: 679669 - DNA, 25 bp, Artificial sequence
  Synthetic oligonucleotide
ccatgtggtaccccgatatctcttt

SEQ ID NO: 679670 - DNA, 25 bp, Artificial sequence
  Synthetic oligonucleotide
ggagctcgtattcgagcgttttaag

SEQ ID NO: 679671 - DNA, 25 bp, Artificial sequence
  Synthetic oligonucleotide
ggagctcgtattggagcgttttaag

SEQ ID NO: 679672 - DNA, 25 bp, Artificial sequence
  Synthetic oligonucleotide
ccaaatttgcgcggactattggaac

SEQ ID NO: 679673 - DNA, 25 bp, Artificial sequence
  Synthetic oligonucleotide
ccaaatttgcgccgactattggaac

SEQ ID NO: 679674 - DNA, 25 bp, Artificial sequence
  Synthetic oligonucleotide
atagtgatacgtcgttcggtggtgt

SEQ ID NO: 679675 - DNA, 25 bp, Artificial sequence
  Synthetic oligonucleotide
acccctgatcgaggttacactaaac

SEQ ID NO: 679676 - DNA, 25 bp, Artificial sequence
  Synthetic oligonucleotide
acaacacgttatacgcgatcccatg

SEQ ID NO: 679677 - DNA, 25 bp, Artificial sequence
  Synthetic oligonucleotide
ttgcaggactattcgacgcttagga

SEQ ID NO: 679678 - DNA, 25 bp, Artificial sequence
  Synthetic oligonucleotide
ctatagacgtcgtatcggtccacat

SEQ ID NO: 679679 - DNA, 25 bp, Artificial sequence
  Synthetic oligonucleotide
tggacttcgcgtcgtaatgccaaat

SEQ ID NO: 679680 - DNA, 25 bp, Artificial sequence
  Synthetic oligonucleotide
tggacttcgcgtggtaatgccaaat

SEQ ID NO: 679681 - DNA, 25 bp, Artificial sequence
  Synthetic oligonucleotide
taccagcgcgatatgtacgtacgat

SEQ ID NO: 679682 - DNA, 25 bp, Artificial sequence
  Synthetic oligonucleotide
taccagcgcgatttgtacgtacgat

SEQ ID NO: 679683 - DNA, 25 bp, Artificial sequence
  Synthetic oligonucleotide
tacttaagtcgccaacattcgccgt

SEQ ID NO: 679684 - DNA, 25 bp, Artificial sequence
  Synthetic oligonucleotide
tacttaagtcgcgaacattcgccgt

SEQ ID NO: 679685 - DNA, 25 bp, Artificial sequence
  Synthetic oligonucleotide
ccgaaacgcataggttcgaatatgg

SEQ ID NO: 679686 - DNA, 25 bp, Artificial sequence
  Synthetic oligonucleotide
ccgaaacgcatacgttcgaatatgg

SEQ ID NO: 679687 - DNA, 25 bp, Artificial sequence
  Synthetic oligonucleotide
cgaatacaatcgcgtagcgtatgct

SEQ ID NO: 679688 - DNA, 25 bp, Artificial sequence
  Synthetic oligonucleotide
cctatagaccgtctagcgttgatgt

SEQ ID NO: 679689 - DNA, 25 bp, Artificial sequence
  Synthetic oligonucleotide
ttgcaggactatacgacgcttagga

SEQ ID NO: 679690 - DNA, 25 bp, Artificial sequence
  Synthetic oligonucleotide
gacgttgtcctacgcgaatttctct

SEQ ID NO: 679691 - DNA, 25 bp, Artificial sequence
  Synthetic oligonucleotide
gtggtatatacgaccgacaaagcca

SEQ ID NO: 679692 - DNA, 25 bp, Artificial sequence
  Synthetic oligonucleotide
gtggtatatacgtccgacaaagcca

SEQ ID NO: 679693 - DNA, 25 bp, Artificial sequence
  Synthetic oligonucleotide
gagggattcggccgtacgataattt

SEQ ID NO: 679694 - DNA, 25 bp, Artificial sequence
  Synthetic oligonucleotide
gagggattcggcggtacgataattt

SEQ ID NO: 679695 - DNA, 25 bp, Artificial sequence
  Synthetic oligonucleotide
agactgtacgacggtgtcgataatg

SEQ ID NO: 679696 - DNA, 25 bp, Artificial sequence
  Synthetic oligonucleotide
agactgtacgaccgtgtcgataatg

SEQ ID NO: 679697 - DNA, 25 bp, Artificial sequence
  Synthetic oligonucleotide
cgctaatatcgcctacgttttccga

SEQ ID NO: 679698 - DNA, 25 bp, Artificial sequence
  Synthetic oligonucleotide
cgctaatatcgcgtacgttttccga

SEQ ID NO: 679699 - DNA, 25 bp, Artificial sequence
  Synthetic oligonucleotide
gtctatcgtacggcactatatgtgc

SEQ ID NO: 679700 - DNA, 25 bp, Artificial sequence
  Synthetic oligonucleotide
gtctatcgtacgccactatatgtgc

SEQ ID NO: 679701 - DNA, 25 bp, Artificial sequence
  Synthetic oligonucleotide
cgaatacaatcgggtagcgtatgct

SEQ ID NO: 679702 - DNA, 25 bp, Artificial sequence
  Synthetic oligonucleotide
tactcggtacgaaagacgcgttatg

SEQ ID NO: 679703 - DNA, 25 bp, Artificial sequence
  Synthetic oligonucleotide
acccctgatcgacgttacactaaac

SEQ ID NO: 679704 - DNA, 25 bp, Artificial sequence
  Synthetic oligonucleotide
gagagagggtataccgtcgataaca

SEQ ID NO: 679705 - DNA, 25 bp, Artificial sequence
  Synthetic oligonucleotide
gagagagggtattccgtcgataaca

SEQ ID NO: 679706 - DNA, 25 bp, Artificial sequence
  Synthetic oligonucleotide
tagttttcgcaaccgacccagaaac

SEQ ID NO: 679707 - DNA, 25 bp, Artificial sequence
  Synthetic oligonucleotide
tagttttcgcaagcgacccagaaac

SEQ ID NO: 679708 - DNA, 25 bp, Artificial sequence
  Synthetic oligonucleotide
tgacctacgcatggcgtaatgaaga

SEQ ID NO: 679709 - DNA, 25 bp, Artificial sequence
  Synthetic oligonucleotide
tgacctacgcatcgcgtaatgaaga

SEQ ID NO: 679710 - DNA, 25 bp, Artificial sequence
  Synthetic oligonucleotide
agagtctaagacctcgcgaattgtg

SEQ ID NO: 679711 - DNA, 25 bp, Artificial sequence
  Synthetic oligonucleotide
agagtctaagacgtcgcgaattgtg

SEQ ID NO: 679712 - DNA, 25 bp, Artificial sequence
  Synthetic oligonucleotide
acttgttcgcgtaacggatcgaact

SEQ ID NO: 679713 - DNA, 25 bp, Artificial sequence
  Synthetic oligonucleotide
ctatagacgtcgaatcggtccacat

SEQ ID NO: 679714 - DNA, 25 bp, Artificial sequence
  Synthetic oligonucleotide
tactcggtacgatagacgcgttatg

SEQ ID NO: 679715 - DNA, 25 bp, Artificial sequence
  Synthetic oligonucleotide
gacgttgtcctaggcgaatttctct

SEQ ID NO: 679716 - DNA, 25 bp, Artificial sequence
  Synthetic oligonucleotide
gtacgtcgttcgacgaactctgttt

SEQ ID NO: 679717 - DNA, 25 bp, Artificial sequence
  Synthetic oligonucleotide
gtacgtcgttcgtcgaactctgttt

SEQ ID NO: 679718 - DNA, 25 bp, Artificial sequence
  Synthetic oligonucleotide
tggagctgcgtaagtcgacaaatga

SEQ ID NO: 679719 - DNA, 25 bp, Artificial sequence
  Synthetic oligonucleotide
tggagctgcgtatgtcgacaaatga

SEQ ID NO: 679720 - DNA, 25 bp, Artificial sequence
  Synthetic oligonucleotide
cagacagtaacggacgtactttgtg

SEQ ID NO: 679721 - DNA, 25 bp, Artificial sequence
  Synthetic oligonucleotide
cagacagtaacgcacgtactttgtg

SEQ ID NO: 679722 - DNA, 25 bp, Artificial sequence
  Synthetic oligonucleotide
cgaattcgctcgtatagtgtatcgg

SEQ ID NO: 679723 - DNA, 25 bp, Artificial sequence
  Synthetic oligonucleotide
cgaattcgctcgaatagtgtatcgg

SEQ ID NO: 679724 - DNA, 25 bp, Artificial sequence
  Synthetic oligonucleotide
caagtggttacgttcggtcagttag

SEQ ID NO: 679725 - DNA, 25 bp, Artificial sequence
  Synthetic oligonucleotide
caagtggttacgatcggtcagttag

SEQ ID NO: 679726 - DNA, 25 bp, Artificial sequence
  Synthetic oligonucleotide
agattaatcccggtcgatcctgcta

SEQ ID NO: 679727 - DNA, 25 bp, Artificial sequence
  Synthetic oligonucleotide
acttgttcgcgttacggatcgaact

SEQ ID NO: 679728 - DNA, 25 bp, Artificial sequence
  Synthetic oligonucleotide
gatagaatacgtcacgcggctactt

SEQ ID NO: 679729 - DNA, 25 bp, Artificial sequence
  Synthetic oligonucleotide
tcgaaacgacggtcgtcaaacaagt

SEQ ID NO: 679730 - DNA, 25 bp, Artificial sequence
  Synthetic oligonucleotide
tcgaaacgacggacgtcaaacaagt

SEQ ID NO: 679731 - DNA, 25 bp, Artificial sequence
  Synthetic oligonucleotide
acacgtgtagcgattcgcgaataac

SEQ ID NO: 679732 - DNA, 25 bp, Artificial sequence
  Synthetic oligonucleotide
acacgtgtagcgtttcgcgaataac

SEQ ID NO: 679733 - DNA, 25 bp, Artificial sequence
  Synthetic oligonucleotide
gtattctaccggtcgactgtgcaaa

SEQ ID NO: 679734 - DNA, 25 bp, Artificial sequence
  Synthetic oligonucleotide
gtattctaccggacgactgtgcaaa

SEQ ID NO: 679735 - DNA, 25 bp, Artificial sequence
  Synthetic oligonucleotide
atcgcccgataccgtacgtttatag

SEQ ID NO: 679736 - DNA, 25 bp, Artificial sequence
  Synthetic oligonucleotide
atcgcccgatacggtacgtttatag

SEQ ID NO: 679737 - DNA, 25 bp, Artificial sequence
  Synthetic oligonucleotide
tattttcgtaccgaagcgtggcaga

SEQ ID NO: 679738 - DNA, 25 bp, Artificial sequence
  Synthetic oligonucleotide
tattttcgtacccaagcgtggcaga

SEQ ID NO: 679739 - DNA, 25 bp, Artificial sequence
  Synthetic oligonucleotide
agattaatcccgctcgatcctgcta

SEQ ID NO: 679740 - DNA, 25 bp, Artificial sequence
  Synthetic oligonucleotide
catcatcttatcgcgttgatacgcc

SEQ ID NO: 679741 - DNA, 25 bp, Artificial sequence
  Synthetic oligonucleotide
cctactcgtatcgacacgataggta

SEQ ID NO: 679742 - DNA, 25 bp, Artificial sequence
  Synthetic oligonucleotide
gatagaatacgtgacgcggctactt

SEQ ID NO: 679743 - DNA, 25 bp, Artificial sequence
  Synthetic oligonucleotide
aagtccctagtacacgcgagagtat

SEQ ID NO: 679744 - DNA, 25 bp, Artificial sequence
  Synthetic oligonucleotide
aagtccctagtagacgcgagagtat

SEQ ID NO: 679745 - DNA, 25 bp, Artificial sequence
  Synthetic oligonucleotide
taacttcgcatcccgtagtcttagg

SEQ ID NO: 679746 - DNA, 25 bp, Artificial sequence
  Synthetic oligonucleotide
taacttcgcatcgcgtagtcttagg

SEQ ID NO: 679747 - DNA, 25 bp, Artificial sequence
  Synthetic oligonucleotide
ttttcacgaaccgcgagtaatctgg

SEQ ID NO: 679748 - DNA, 25 bp, Artificial sequence
  Synthetic oligonucleotide
ttttcacgaaccccgagtaatctgg

SEQ ID NO: 679749 - DNA, 25 bp, Artificial sequence
  Synthetic oligonucleotide
gctgttaagcgatcgacgtcataac

SEQ ID NO: 679750 - DNA, 25 bp, Artificial sequence
  Synthetic oligonucleotide
gaatgccggtaacgtcgtacatcta

SEQ ID NO: 679751 - DNA, 25 bp, Artificial sequence
  Synthetic oligonucleotide
cattctacgtcgtaccatctatggc

SEQ ID NO: 679752 - DNA, 25 bp, Artificial sequence
  Synthetic oligonucleotide
catcatcttatcccgttgatacgcc

SEQ ID NO: 679753 - DNA, 25 bp, Artificial sequence
  Synthetic oligonucleotide
atcctgtcggacatacgtctagatg

SEQ ID NO: 679754 - DNA, 25 bp, Artificial sequence
  Synthetic oligonucleotide
tgtgtcgtcgtaacgtacgtttcct

SEQ ID NO: 679755 - DNA, 25 bp, Artificial sequence
  Synthetic oligonucleotide
tgtgtcgtcgtatcgtacgtttcct

SEQ ID NO: 679756 - DNA, 25 bp, Artificial sequence
  Synthetic oligonucleotide
caaaatcgtcgtttaaggccgagac

SEQ ID NO: 679757 - DNA, 25 bp, Artificial sequence
  Synthetic oligonucleotide
caaaatcgtcgtataaggccgagac

SEQ ID NO: 679758 - DNA, 25 bp, Artificial sequence
  Synthetic oligonucleotide
gttactcgtaactcgacgtggcaaa

SEQ ID NO: 679759 - DNA, 25 bp, Artificial sequence
  Synthetic oligonucleotide
gttactcgtaacacgacgtggcaaa

SEQ ID NO: 679760 - DNA, 25 bp, Artificial sequence
  Synthetic oligonucleotide
cttttggaaatttcgcgcgagatcg

SEQ ID NO: 679761 - DNA, 25 bp, Artificial sequence
  Synthetic oligonucleotide
cttttggaaattacgcgcgagatcg

SEQ ID NO: 679762 - DNA, 25 bp, Artificial sequence
  Synthetic oligonucleotide
tgtgtagcgagactatcgtctttgg

SEQ ID NO: 679763 - DNA, 25 bp, Artificial sequence
  Synthetic oligonucleotide
tgtgtagcgagagtatcgtctttgg

SEQ ID NO: 679764 - DNA, 25 bp, Artificial sequence
  Synthetic oligonucleotide
accagagagcgtggacaatatcagt

SEQ ID NO: 679765 - DNA, 25 bp, Artificial sequence
  Synthetic oligonucleotide
ttgccctacggcgtagtacctatat

SEQ ID NO: 679766 - DNA, 25 bp, Artificial sequence
  Synthetic oligonucleotide
accagagagcgtcgacaatatcagt

SEQ ID NO: 679767 - DNA, 25 bp, Artificial sequence
  Synthetic oligonucleotide
atcctgtcggacttacgtctagatg

SEQ ID NO: 679768 - DNA, 25 bp, Artificial sequence
  Synthetic oligonucleotide
taagtctacgccgaaacgctcatga

SEQ ID NO: 679769 - DNA, 25 bp, Artificial sequence
  Synthetic oligonucleotide
taagtctacgcccaaacgctcatga

SEQ ID NO: 679770 - DNA, 25 bp, Artificial sequence
  Synthetic oligonucleotide
tgtgtagactatcttcgcgcgacat

SEQ ID NO: 679771 - DNA, 25 bp, Artificial sequence
  Synthetic oligonucleotide
tgtgtagactatgttcgcgcgacat

SEQ ID NO: 679772 - DNA, 25 bp, Artificial sequence
  Synthetic oligonucleotide
cctaaacgatacggtcgtatcatcg

SEQ ID NO: 679773 - DNA, 25 bp, Artificial sequence
  Synthetic oligonucleotide
cctaaacgataccgtcgtatcatcg

SEQ ID NO: 679774 - DNA, 25 bp, Artificial sequence
  Synthetic oligonucleotide
taggttcgcgtcgtaccttttgtct

SEQ ID NO: 679775 - DNA, 25 bp, Artificial sequence
  Synthetic oligonucleotide
taggttcgcgtcctaccttttgtct

SEQ ID NO: 679776 - DNA, 25 bp, Artificial sequence
  Synthetic oligonucleotide
cctactcgtatccacacgataggta

SEQ ID NO: 679777 - DNA, 25 bp, Artificial sequence
  Synthetic oligonucleotide
cattctacgtcgaaccatctatggc

SEQ ID NO: 679778 - DNA, 25 bp, Artificial sequence
  Synthetic oligonucleotide
ttgccctacggcctagtacctatat

SEQ ID NO: 679779 - DNA, 25 bp, Artificial sequence
  Synthetic oligonucleotide
gcaactggtatttacgccgtatggt

SEQ ID NO: 679780 - DNA, 25 bp, Artificial sequence
  Synthetic oligonucleotide
taatatattcgccgcgactgaccag

SEQ ID NO: 679781 - DNA, 25 bp, Artificial sequence
  Synthetic oligonucleotide
gctgttaagcgaacgacgtcataac

SEQ ID NO: 679782 - DNA, 25 bp, Artificial sequence
  Synthetic oligonucleotide
gttatccgcgatcgaacgaatctgt

SEQ ID NO: 679783 - DNA, 25 bp, Artificial sequence
  Synthetic oligonucleotide
tagaacgcgcgtacaatcaggcatt

SEQ ID NO: 679784 - DNA, 25 bp, Artificial sequence
  Synthetic oligonucleotide
tagaacgcgcgttcaatcaggcatt

SEQ ID NO: 679785 - DNA, 25 bp, Artificial sequence
  Synthetic oligonucleotide
cacgtatcgcaacgtatacgaatcc

SEQ ID NO: 679786 - DNA, 25 bp, Artificial sequence
  Synthetic oligonucleotide
cacgtatcgcaaggtatacgaatcc

SEQ ID NO: 679787 - DNA, 25 bp, Artificial sequence
  Synthetic oligonucleotide
gtttacacgcgcgaactatgcgaaa

SEQ ID NO: 679788 - DNA, 25 bp, Artificial sequence
  Synthetic oligonucleotide
gtttacacgcgccaactatgcgaaa

SEQ ID NO: 679789 - DNA, 25 bp, Artificial sequence
  Synthetic oligonucleotide
ctacacaccgcgaaataggtgatgt

SEQ ID NO: 679790 - DNA, 25 bp, Artificial sequence
  Synthetic oligonucleotide
ccatatcgcgcgaatcaacacaaca

SEQ ID NO: 679791 - DNA, 25 bp, Artificial sequence
  Synthetic oligonucleotide
gcaactggtattaacgccgtatggt

SEQ ID NO: 679792 - DNA, 25 bp, Artificial sequence
  Synthetic oligonucleotide
taatatattcgcggcgactgaccag

SEQ ID NO: 679793 - DNA, 25 bp, Artificial sequence
  Synthetic oligonucleotide
tgttctaacgtaccgctcgcatcta

SEQ ID NO: 679794 - DNA, 25 bp, Artificial sequence
  Synthetic oligonucleotide
tgttctaacgtagcgctcgcatcta

SEQ ID NO: 679795 - DNA, 25 bp, Artificial sequence
  Synthetic oligonucleotide
ttgagatcacgaggcgatattctcc

SEQ ID NO: 679796 - DNA, 25 bp, Artificial sequence
  Synthetic oligonucleotide
ttgagatcacgacgcgatattctcc

SEQ ID NO: 679797 - DNA, 25 bp, Artificial sequence
  Synthetic oligonucleotide
cagttacgctcgtcgtatgttgtca

SEQ ID NO: 679798 - DNA, 25 bp, Artificial sequence
  Synthetic oligonucleotide
cagttacgctcgacgtatgttgtca

SEQ ID NO: 679799 - DNA, 25 bp, Artificial sequence
  Synthetic oligonucleotide
agatcacgcgccgtaatgatgtcta

SEQ ID NO: 679800 - DNA, 25 bp, Artificial sequence
  Synthetic oligonucleotide
agatcacgcgccctaatgatgtcta

SEQ ID NO: 679801 - DNA, 25 bp, Artificial sequence
  Synthetic oligonucleotide
aggattggttcgaaccgtaacgatg

SEQ ID NO: 679802 - DNA, 25 bp, Artificial sequence
  Synthetic oligonucleotide
gactgctataatcgacccgtctgaa

SEQ ID NO: 679803 - DNA, 25 bp, Artificial sequence
  Synthetic oligonucleotide
ctacacaccgcgtaataggtgatgt

SEQ ID NO: 679804 - DNA, 25 bp, Artificial sequence
  Synthetic oligonucleotide
tgaacaggttacgcgtaacctgcat

SEQ ID NO: 679805 - DNA, 25 bp, Artificial sequence
  Synthetic oligonucleotide
ccatatcgcgcgtatcaacacaaca

SEQ ID NO: 679806 - DNA, 25 bp, Artificial sequence
  Synthetic oligonucleotide
catcacgttctatccgcgatcatga

SEQ ID NO: 679807 - DNA, 25 bp, Artificial sequence
  Synthetic oligonucleotide
catcacgttctaaccgcgatcatga

SEQ ID NO: 679808 - DNA, 25 bp, Artificial sequence
  Synthetic oligonucleotide
aattcgccgtagggcattactacct

SEQ ID NO: 679809 - DNA, 25 bp, Artificial sequence
  Synthetic oligonucleotide
aattcgccgtagcgcattactacct

SEQ ID NO: 679810 - DNA, 25 bp, Artificial sequence
  Synthetic oligonucleotide
tcgcagtcgtaagggactaccttaa

SEQ ID NO: 679811 - DNA, 25 bp, Artificial sequence
  Synthetic oligonucleotide
tcgcagtcgtaacggactaccttaa

SEQ ID NO: 679812 - DNA, 25 bp, Artificial sequence
  Synthetic oligonucleotide
tccgatgtcgcgttaatacccacat

SEQ ID NO: 679813 - DNA, 25 bp, Artificial sequence
  Synthetic oligonucleotide
tccgatgtcgcgataatacccacat

SEQ ID NO: 679814 - DNA, 25 bp, Artificial sequence
  Synthetic oligonucleotide
gttatccgcgatggaacgaatctgt

SEQ ID NO: 679815 - DNA, 25 bp, Artificial sequence
  Synthetic oligonucleotide
gaacagagaacgggacgtacaattc

SEQ ID NO: 679816 - DNA, 25 bp, Artificial sequence
  Synthetic oligonucleotide
atagcatagcgctacgagacatggt

SEQ ID NO: 679817 - DNA, 25 bp, Artificial sequence
  Synthetic oligonucleotide
ccttaggtacgttacgcgtgacata

SEQ ID NO: 679818 - DNA, 25 bp, Artificial sequence
  Synthetic oligonucleotide
atagcatagcgcaacgagacatggt

SEQ ID NO: 679819 - DNA, 25 bp, Artificial sequence
  Synthetic oligonucleotide
caatgctagccgacgctaaattctg

SEQ ID NO: 679820 - DNA, 25 bp, Artificial sequence
  Synthetic oligonucleotide
gaacagagaacgcgacgtacaattc

SEQ ID NO: 679821 - DNA, 25 bp, Artificial sequence
  Synthetic oligonucleotide
ccttaggtacgtaacgcgtgacata

SEQ ID NO: 679822 - DNA, 25 bp, Artificial sequence
  Synthetic oligonucleotide
tgaacaggttacccgtaacctgcat

SEQ ID NO: 679823 - DNA, 25 bp, Artificial sequence
  Synthetic oligonucleotide
aggcagcggtcgggttatatatgaa

SEQ ID NO: 679824 - DNA, 25 bp, Artificial sequence
  Synthetic oligonucleotide
aggcagcggtcgcgttatatatgaa

SEQ ID NO: 679825 - DNA, 25 bp, Artificial sequence
  Synthetic oligonucleotide
gttcttgcgtcgaatacgaaaggca

SEQ ID NO: 679826 - DNA, 25 bp, Artificial sequence
  Synthetic oligonucleotide
gttcttgcgtcgtatacgaaaggca

SEQ ID NO: 679827 - DNA, 25 bp, Artificial sequence
  Synthetic oligonucleotide
ttgcatccgcactacgtacagttct

SEQ ID NO: 679828 - DNA, 25 bp, Artificial sequence
  Synthetic oligonucleotide
ttgcatccgcacaacgtacagttct

SEQ ID NO: 679829 - DNA, 25 bp, Artificial sequence
  Synthetic oligonucleotide
caatgctagccgtcgctaaattctg

SEQ ID NO: 679830 - DNA, 25 bp, Artificial sequence
  Synthetic oligonucleotide
ggatactacgatgggtggcatatgc

SEQ ID NO: 679831 - DNA, 25 bp, Artificial sequence
  Synthetic oligonucleotide
tagaaccgtccgttcggtaacttcc

SEQ ID NO: 679832 - DNA, 25 bp, Artificial sequence
  Synthetic oligonucleotide
tagaaccgtccgatcggtaacttcc

SEQ ID NO: 679833 - DNA, 25 bp, Artificial sequence
  Synthetic oligonucleotide
cacttccgatatagcgccttacgga

SEQ ID NO: 679834 - DNA, 25 bp, Artificial sequence
  Synthetic oligonucleotide
gtcagaaggccttgcgcgattatac

SEQ ID NO: 679835 - DNA, 25 bp, Artificial sequence
  Synthetic oligonucleotide
cccattaggatcccgtaccaggtaa

SEQ ID NO: 679836 - DNA, 25 bp, Artificial sequence
  Synthetic oligonucleotide
cccattaggatcgcgtaccaggtaa

SEQ ID NO: 679837 - DNA, 25 bp, Artificial sequence
  Synthetic oligonucleotide
gcataaaacacgtctcgcgtctcgt

SEQ ID NO: 679838 - DNA, 25 bp, Artificial sequence
  Synthetic oligonucleotide
gcataaaacacgactcgcgtctcgt

SEQ ID NO: 679839 - DNA, 25 bp, Artificial sequence
  Synthetic oligonucleotide
agagcataggtcggtagcgcaaaag

SEQ ID NO: 679840 - DNA, 25 bp, Artificial sequence
  Synthetic oligonucleotide
agagcataggtccgtagcgcaaaag

SEQ ID NO: 679841 - DNA, 25 bp, Artificial sequence
  Synthetic oligonucleotide
caatggcgatacccgttaaacgagc

SEQ ID NO: 679842 - DNA, 25 bp, Artificial sequence
  Synthetic oligonucleotide
caatggcgatacgcgttaaacgagc

SEQ ID NO: 679843 - DNA, 25 bp, Artificial sequence
  Synthetic oligonucleotide
ggccaggcgtataacggccataaaa

SEQ ID NO: 679844 - DNA, 25 bp, Artificial sequence
  Synthetic oligonucleotide
agcaatcgacgtttcccgtatacgc

SEQ ID NO: 679845 - DNA, 25 bp, Artificial sequence
  Synthetic oligonucleotide
cgtaagcgtataggaggtcaccgat

SEQ ID NO: 679846 - DNA, 25 bp, Artificial sequence
  Synthetic oligonucleotide
cacttccgatattgcgccttacgga

SEQ ID NO: 679847 - DNA, 25 bp, Artificial sequence
  Synthetic oligonucleotide
aggagctcaggtcgcgtaatacatg

SEQ ID NO: 679848 - DNA, 25 bp, Artificial sequence
  Synthetic oligonucleotide
aggagctcaggtggcgtaatacatg

SEQ ID NO: 679849 - DNA, 25 bp, Artificial sequence
  Synthetic oligonucleotide
tcctcaagcgcgattgtcgtactca

SEQ ID NO: 679850 - DNA, 25 bp, Artificial sequence
  Synthetic oligonucleotide
tcctcaagcgcgtttgtcgtactca

SEQ ID NO: 679851 - DNA, 25 bp, Artificial sequence
  Synthetic oligonucleotide
agtaagcgatcccgtatatagcgcg

SEQ ID NO: 679852 - DNA, 25 bp, Artificial sequence
  Synthetic oligonucleotide
agtaagcgatccggtatatagcgcg

SEQ ID NO: 679853 - DNA, 25 bp, Artificial sequence
  Synthetic oligonucleotide
aatcgttcggtgcgacggtttcaga

SEQ ID NO: 679854 - DNA, 25 bp, Artificial sequence
  Synthetic oligonucleotide
aatcgttcggtgggacggtttcaga

SEQ ID NO: 679855 - DNA, 25 bp, Artificial sequence
  Synthetic oligonucleotide
tttcggcgtataggacgcgcgtatt

SEQ ID NO: 679856 - DNA, 25 bp, Artificial sequence
  Synthetic oligonucleotide
agcaatcgacgtatcccgtatacgc

SEQ ID NO: 679857 - DNA, 25 bp, Artificial sequence
  Synthetic oligonucleotide
accgcacctcgagacgtattttcca

SEQ ID NO: 679858 - DNA, 25 bp, Artificial sequence
  Synthetic oligonucleotide
caagctcgacgcacgatagactcta

SEQ ID NO: 679859 - DNA, 25 bp, Artificial sequence
  Synthetic oligonucleotide
gtgatgagtacttcggtcgtccatg

SEQ ID NO: 679860 - DNA, 25 bp, Artificial sequence
  Synthetic oligonucleotide
cttttatcacgagggtacgcgttgc

SEQ ID NO: 679861 - DNA, 25 bp, Artificial sequence
  Synthetic oligonucleotide
cttttatcacgacggtacgcgttgc

SEQ ID NO: 679862 - DNA, 25 bp, Artificial sequence
  Synthetic oligonucleotide
tgggagtaagtcacgtccgagatct

SEQ ID NO: 679863 - DNA, 25 bp, Artificial sequence
  Synthetic oligonucleotide
tgggagtaagtctcgtccgagatct

SEQ ID NO: 679864 - DNA, 25 bp, Artificial sequence
  Synthetic oligonucleotide
taaaggataccccgacgcttccaga

SEQ ID NO: 679865 - DNA, 25 bp, Artificial sequence
  Synthetic oligonucleotide
taaaggatacccggacgcttccaga

SEQ ID NO: 679866 - DNA, 25 bp, Artificial sequence
  Synthetic oligonucleotide
tcattcgccttatcgcgatcatcgc

SEQ ID NO: 679867 - DNA, 25 bp, Artificial sequence
  Synthetic oligonucleotide
tcattcgccttaacgcgatcatcgc

SEQ ID NO: 679868 - DNA, 25 bp, Artificial sequence
  Synthetic oligonucleotide
gtcagaaggcctagcgcgattatac

SEQ ID NO: 679869 - DNA, 25 bp, Artificial sequence
  Synthetic oligonucleotide
aagtatacgcgcggcatactcccat

SEQ ID NO: 679870 - DNA, 25 bp, Artificial sequence
  Synthetic oligonucleotide
cgtaagcgtatacgaggtcaccgat

SEQ ID NO: 679871 - DNA, 25 bp, Artificial sequence
  Synthetic oligonucleotide
accgcacctcgacacgtattttcca

SEQ ID NO: 679872 - DNA, 25 bp, Artificial sequence
  Synthetic oligonucleotide
tcgtcaagcgagtatcgcgtaagtc

SEQ ID NO: 679873 - DNA, 25 bp, Artificial sequence
  Synthetic oligonucleotide
tcgtcaagcgagaatcgcgtaagtc

SEQ ID NO: 679874 - DNA, 25 bp, Artificial sequence
  Synthetic oligonucleotide
gtgtctataccgctacgcgagctaa

SEQ ID NO: 679875 - DNA, 25 bp, Artificial sequence
  Synthetic oligonucleotide
gtgtctataccggtacgcgagctaa

SEQ ID NO: 679876 - DNA, 25 bp, Artificial sequence
  Synthetic oligonucleotide
cgttatatacgcgcgatacacgcca

SEQ ID NO: 679877 - DNA, 25 bp, Artificial sequence
  Synthetic oligonucleotide
cgttatatacgcccgatacacgcca

SEQ ID NO: 679878 - DNA, 25 bp, Artificial sequence
  Synthetic oligonucleotide
agaacgaatagcccgcgtagacgaa

SEQ ID NO: 679879 - DNA, 25 bp, Artificial sequence
  Synthetic oligonucleotide
agaacgaatagcgcgcgtagacgaa

SEQ ID NO: 679880 - DNA, 25 bp, Artificial sequence
  Synthetic oligonucleotide
ttcacggtttgaacgcgcgttgtac

SEQ ID NO: 679881 - DNA, 25 bp, Artificial sequence
  Synthetic oligonucleotide
aagtatacgcgccgcatactcccat

SEQ ID NO: 679882 - DNA, 25 bp, Artificial sequence
  Synthetic oligonucleotide
ctttcaggtagccctcgaatgccat

SEQ ID NO: 679883 - DNA, 25 bp, Artificial sequence
  Synthetic oligonucleotide
tttcggcgtatacgacgcgcgtatt

SEQ ID NO: 679884 - DNA, 25 bp, Artificial sequence
  Synthetic oligonucleotide
aagcattgcgaacgatacgcccatc

SEQ ID NO: 679885 - DNA, 25 bp, Artificial sequence
  Synthetic oligonucleotide
tctctagcgttattcgcccggtaac

SEQ ID NO: 679886 - DNA, 25 bp, Artificial sequence
  Synthetic oligonucleotide
tctctagcgttaatcgcccggtaac

SEQ ID NO: 679887 - DNA, 25 bp, Artificial sequence
  Synthetic oligonucleotide
actacacgcgatttagctccgagga

SEQ ID NO: 679888 - DNA, 25 bp, Artificial sequence
  Synthetic oligonucleotide
actacacgcgatatagctccgagga

SEQ ID NO: 679889 - DNA, 25 bp, Artificial sequence
  Synthetic oligonucleotide
catatatatacgtcgcgtcggcctc

SEQ ID NO: 679890 - DNA, 25 bp, Artificial sequence
  Synthetic oligonucleotide
catatatatacgacgcgtcggcctc

SEQ ID NO: 679891 - DNA, 25 bp, Artificial sequence
  Synthetic oligonucleotide
tagtcaacggagcgacgtaccgaaa

SEQ ID NO: 679892 - DNA, 25 bp, Artificial sequence
  Synthetic oligonucleotide
tagtcaacggagggacgtaccgaaa

SEQ ID NO: 679893 - DNA, 25 bp, Artificial sequence
  Synthetic oligonucleotide
atgtaaccgggtacgatcagaggca

SEQ ID NO: 679894 - DNA, 25 bp, Artificial sequence
  Synthetic oligonucleotide
tgagtagttaacgcccgatgcactg

SEQ ID NO: 679895 - DNA, 25 bp, Artificial sequence
  Synthetic oligonucleotide
atgtaaccgggttcgatcagaggca

SEQ ID NO: 679896 - DNA, 25 bp, Artificial sequence
  Synthetic oligonucleotide
ctttcaggtagcgctcgaatgccat

SEQ ID NO: 679897 - DNA, 25 bp, Artificial sequence
  Synthetic oligonucleotide
gcacctcggccgaagattaactttg

SEQ ID NO: 679898 - DNA, 25 bp, Artificial sequence
  Synthetic oligonucleotide
gcacctcggccgtagattaactttg

SEQ ID NO: 679899 - DNA, 25 bp, Artificial sequence
  Synthetic oligonucleotide
taggtgttcgcgtattcggcgcttt

SEQ ID NO: 679900 - DNA, 25 bp, Artificial sequence
  Synthetic oligonucleotide
taggtgttcgcgaattcggcgcttt

SEQ ID NO: 679901 - DNA, 25 bp, Artificial sequence
  Synthetic oligonucleotide
accgtgtatgtcccgatacgttagg

SEQ ID NO: 679902 - DNA, 25 bp, Artificial sequence
  Synthetic oligonucleotide
accgtgtatgtcgcgatacgttagg

SEQ ID NO: 679903 - DNA, 25 bp, Artificial sequence
  Synthetic oligonucleotide
gtgaaaatcggccgtaagcactacg

SEQ ID NO: 679904 - DNA, 25 bp, Artificial sequence
  Synthetic oligonucleotide
gtgaaaatcggcggtaagcactacg

SEQ ID NO: 679905 - DNA, 25 bp, Artificial sequence
  Synthetic oligonucleotide
caagctcgacgctcgatagactcta

SEQ ID NO: 679906 - DNA, 25 bp, Artificial sequence
  Synthetic oligonucleotide
tgagtagttaacccccgatgcactg

SEQ ID NO: 679907 - DNA, 25 bp, Artificial sequence
  Synthetic oligonucleotide
agtatacgctagtcggtcggggatt

SEQ ID NO: 679908 - DNA, 25 bp, Artificial sequence
  Synthetic oligonucleotide
ctggttcgagcgtagtacgtgattc

SEQ ID NO: 679909 - DNA, 25 bp, Artificial sequence
  Synthetic oligonucleotide
tttgaagtagattgcgacggccgga

SEQ ID NO: 679910 - DNA, 25 bp, Artificial sequence
  Synthetic oligonucleotide
tttgaagtagatagcgacggccgga

SEQ ID NO: 679911 - DNA, 25 bp, Artificial sequence
  Synthetic oligonucleotide
gtcctccgtatcccgagattcagat

SEQ ID NO: 679912 - DNA, 25 bp, Artificial sequence
  Synthetic oligonucleotide
gtcctccgtatcgcgagattcagat

SEQ ID NO: 679913 - DNA, 25 bp, Artificial sequence
  Synthetic oligonucleotide
tcactttacgcgtcccgatgtcaga

SEQ ID NO: 679914 - DNA, 25 bp, Artificial sequence
  Synthetic oligonucleotide
tcactttacgcgacccgatgtcaga

SEQ ID NO: 679915 - DNA, 25 bp, Artificial sequence
  Synthetic oligonucleotide
ctctagccgttcacgcggattctaa

SEQ ID NO: 679916 - DNA, 25 bp, Artificial sequence
  Synthetic oligonucleotide
ctctagccgttctcgcggattctaa

SEQ ID NO: 679917 - DNA, 25 bp, Artificial sequence
  Synthetic oligonucleotide
gtacttaccgccgcgaataaagagc

SEQ ID NO: 679918 - DNA, 25 bp, Artificial sequence
  Synthetic oligonucleotide
aagcattgcgaaggatacgcccatc

SEQ ID NO: 679919 - DNA, 25 bp, Artificial sequence
  Synthetic oligonucleotide
agtatacgctagacggtcggggatt

SEQ ID NO: 679920 - DNA, 25 bp, Artificial sequence
  Synthetic oligonucleotide
ttcacggtttgatcgcgcgttgtac

SEQ ID NO: 679921 - DNA, 25 bp, Artificial sequence
  Synthetic oligonucleotide
aactgattcgcgataacggtctgcc

SEQ ID NO: 679922 - DNA, 25 bp, Artificial sequence
  Synthetic oligonucleotide
aactgattcgcgttaacggtctgcc

SEQ ID NO: 679923 - DNA, 25 bp, Artificial sequence
  Synthetic oligonucleotide
aagcagtctcgcctatcgttctggt

SEQ ID NO: 679924 - DNA, 25 bp, Artificial sequence
  Synthetic oligonucleotide
aagcagtctcgcgtatcgttctggt

SEQ ID NO: 679925 - DNA, 25 bp, Artificial sequence
  Synthetic oligonucleotide
gattcgatcgcgccgtaagaatcca

SEQ ID NO: 679926 - DNA, 25 bp, Artificial sequence
  Synthetic oligonucleotide
gattcgatcgcggcgtaagaatcca

SEQ ID NO: 679927 - DNA, 25 bp, Artificial sequence
  Synthetic oligonucleotide
acggtacgtacatacgcgttgtctc

SEQ ID NO: 679928 - DNA, 25 bp, Artificial sequence
  Synthetic oligonucleotide
acggtacgtacaaacgcgttgtctc

SEQ ID NO: 679929 - DNA, 25 bp, Artificial sequence
  Synthetic oligonucleotide
ctatgcgtcttatcgcgcggatagt

SEQ ID NO: 679930 - DNA, 25 bp, Artificial sequence
  Synthetic oligonucleotide
ctatgcgtcttaacgcgcggatagt

SEQ ID NO: 679931 - DNA, 25 bp, Artificial sequence
  Synthetic oligonucleotide
gtacttaccgccccgaataaagagc

SEQ ID NO: 679932 - DNA, 25 bp, Artificial sequence
  Synthetic oligonucleotide
tatggtacgtaagtcgcgaggcagt

SEQ ID NO: 679933 - DNA, 25 bp, Artificial sequence
  Synthetic oligonucleotide
gagggctataccgttcgcgttacat

SEQ ID NO: 679934 - DNA, 25 bp, Artificial sequence
  Synthetic oligonucleotide
gagggctatacccttcgcgttacat

SEQ ID NO: 679935 - DNA, 25 bp, Artificial sequence
  Synthetic oligonucleotide
acaacgtaggactccgtcgtttgac

SEQ ID NO: 679936 - DNA, 25 bp, Artificial sequence
  Synthetic oligonucleotide
acaacgtaggacaccgtcgtttgac

SEQ ID NO: 679937 - DNA, 25 bp, Artificial sequence
  Synthetic oligonucleotide
ggtgctcgtaccgacgtataatgca

SEQ ID NO: 679938 - DNA, 25 bp, Artificial sequence
  Synthetic oligonucleotide
ggtgctcgtacccacgtataatgca

SEQ ID NO: 679939 - DNA, 25 bp, Artificial sequence
  Synthetic oligonucleotide
cttagctcatgacgcgctacgcata

SEQ ID NO: 679940 - DNA, 25 bp, Artificial sequence
  Synthetic oligonucleotide
cttagctcatgaggcgctacgcata

SEQ ID NO: 679941 - DNA, 25 bp, Artificial sequence
  Synthetic oligonucleotide
gtgtttatgtaaggcgcgatgctgc

SEQ ID NO: 679942 - DNA, 25 bp, Artificial sequence
  Synthetic oligonucleotide
gtgatgagtactacggtcgtccatg

SEQ ID NO: 679943 - DNA, 25 bp, Artificial sequence
  Synthetic oligonucleotide
tatggtacgtaactcgcgaggcagt

SEQ ID NO: 679944 - DNA, 25 bp, Artificial sequence
  Synthetic oligonucleotide
ccataccgtaagccgacttaatggg

SEQ ID NO: 679945 - DNA, 25 bp, Artificial sequence
  Synthetic oligonucleotide
ccaaatacggtcggtaacagagagc

SEQ ID NO: 679946 - DNA, 25 bp, Artificial sequence
  Synthetic oligonucleotide
ccaaatacggtccgtaacagagagc

SEQ ID NO: 679947 - DNA, 25 bp, Artificial sequence
  Synthetic oligonucleotide
gtcaaatacgtagccgctacaagcc

SEQ ID NO: 679948 - DNA, 25 bp, Artificial sequence
  Synthetic oligonucleotide
gtcaaatacgtacccgctacaagcc

SEQ ID NO: 679949 - DNA, 25 bp, Artificial sequence
  Synthetic oligonucleotide
gctccgttatctaaccgcgtctatc

SEQ ID NO: 679950 - DNA, 25 bp, Artificial sequence
  Synthetic oligonucleotide
gctccgttatcttaccgcgtctatc

SEQ ID NO: 679951 - DNA, 25 bp, Artificial sequence
  Synthetic oligonucleotide
gtggcgtcgcgtttataggtagcaa

SEQ ID NO: 679952 - DNA, 25 bp, Artificial sequence
  Synthetic oligonucleotide
gtggcgtcgcgtatataggtagcaa

SEQ ID NO: 679953 - DNA, 25 bp, Artificial sequence
  Synthetic oligonucleotide
gctaggacgcgttgacgtagattca

SEQ ID NO: 679954 - DNA, 25 bp, Artificial sequence
  Synthetic oligonucleotide
gctaggacgcgtagacgtagattca

SEQ ID NO: 679955 - DNA, 25 bp, Artificial sequence
  Synthetic oligonucleotide
gtgtttatgtaacgcgcgatgctgc

SEQ ID NO: 679956 - DNA, 25 bp, Artificial sequence
  Synthetic oligonucleotide
catcggatgcgttgcggacaaagaa

SEQ ID NO: 679957 - DNA, 25 bp, Artificial sequence
  Synthetic oligonucleotide
aaacctactgcgtacgagtgctagc

SEQ ID NO: 679958 - DNA, 25 bp, Artificial sequence
  Synthetic oligonucleotide
tggagctatcggtcgcctatattgg

SEQ ID NO: 679959 - DNA, 25 bp, Artificial sequence
  Synthetic oligonucleotide
tggagctatcggacgcctatattgg

SEQ ID NO: 679960 - DNA, 25 bp, Artificial sequence
  Synthetic oligonucleotide
ggtcgagagtaatcgcgtagaactc

SEQ ID NO: 679961 - DNA, 25 bp, Artificial sequence
  Synthetic oligonucleotide
ggtcgagagtaaacgcgtagaactc

SEQ ID NO: 679962 - DNA, 25 bp, Artificial sequence
  Synthetic oligonucleotide
accttttcccgataacgcgtgcgaa

SEQ ID NO: 679963 - DNA, 25 bp, Artificial sequence
  Synthetic oligonucleotide
accttttcccgaaaacgcgtgcgaa

SEQ ID NO: 679964 - DNA, 25 bp, Artificial sequence
  Synthetic oligonucleotide
tccccggcgtaccttaagcatctat

SEQ ID NO: 679965 - DNA, 25 bp, Artificial sequence
  Synthetic oligonucleotide
tccccggcgtacgttaagcatctat

SEQ ID NO: 679966 - DNA, 25 bp, Artificial sequence
  Synthetic oligonucleotide
tcaccatccgtcaagcgttcaactc

SEQ ID NO: 679967 - DNA, 25 bp, Artificial sequence
  Synthetic oligonucleotide
accacgccccgtacgattatgaact

SEQ ID NO: 679968 - DNA, 25 bp, Artificial sequence
  Synthetic oligonucleotide
catcggatgcgtagcggacaaagaa

SEQ ID NO: 679969 - DNA, 25 bp, Artificial sequence
  Synthetic oligonucleotide
accacgccccgttcgattatgaact

SEQ ID NO: 679970 - DNA, 25 bp, Artificial sequence
  Synthetic oligonucleotide
caccgacaacgtccgatacaatggt

SEQ ID NO: 679971 - DNA, 25 bp, Artificial sequence
  Synthetic oligonucleotide
caccgacaacgtgcgatacaatggt

SEQ ID NO: 679972 - DNA, 25 bp, Artificial sequence
  Synthetic oligonucleotide
acctctcgtagttgtccgcatcttc

SEQ ID NO: 679973 - DNA, 25 bp, Artificial sequence
  Synthetic oligonucleotide
acctctcgtagtagtccgcatcttc

SEQ ID NO: 679974 - DNA, 25 bp, Artificial sequence
  Synthetic oligonucleotide
ctttggccgtacgcatagtaggact

SEQ ID NO: 679975 - DNA, 25 bp, Artificial sequence
  Synthetic oligonucleotide
ctttggccgtacccatagtaggact

SEQ ID NO: 679976 - DNA, 25 bp, Artificial sequence
  Synthetic oligonucleotide
tgaatggtagcgcgatacagtggga

SEQ ID NO: 679977 - DNA, 25 bp, Artificial sequence
  Synthetic oligonucleotide
tgaatggtagcgggatacagtggga

SEQ ID NO: 679978 - DNA, 25 bp, Artificial sequence
  Synthetic oligonucleotide
ccataccgtaaggcgacttaatggg

SEQ ID NO: 679979 - DNA, 25 bp, Artificial sequence
  Synthetic oligonucleotide
actccgtattcgcgcggattaatcg

SEQ ID NO: 679980 - DNA, 25 bp, Artificial sequence
  Synthetic oligonucleotide
tcaccatccgtctagcgttcaactc

SEQ ID NO: 679981 - DNA, 25 bp, Artificial sequence
  Synthetic oligonucleotide
tacgtcgtaatgactcgcgcatcga

SEQ ID NO: 679982 - DNA, 25 bp, Artificial sequence
  Synthetic oligonucleotide
cgtaattaccgctacggacaagtcc

SEQ ID NO: 679983 - DNA, 25 bp, Artificial sequence
  Synthetic oligonucleotide
cactggataacgaaggcgggaaaga

SEQ ID NO: 679984 - DNA, 25 bp, Artificial sequence
  Synthetic oligonucleotide
cactggataacgtaggcgggaaaga

SEQ ID NO: 679985 - DNA, 25 bp, Artificial sequence
  Synthetic oligonucleotide
gcttatgtcgatacggtacccacct

SEQ ID NO: 679986 - DNA, 25 bp, Artificial sequence
  Synthetic oligonucleotide
gcttatgtcgattcggtacccacct

SEQ ID NO: 679987 - DNA, 25 bp, Artificial sequence
  Synthetic oligonucleotide
tcgacttcgacttgtccgactagag

SEQ ID NO: 679988 - DNA, 25 bp, Artificial sequence
  Synthetic oligonucleotide
tcgacttcgactagtccgactagag

SEQ ID NO: 679989 - DNA, 25 bp, Artificial sequence
  Synthetic oligonucleotide
tgcctacgcccgaatacaaacgcaa

SEQ ID NO: 679990 - DNA, 25 bp, Artificial sequence
  Synthetic oligonucleotide
tgcctacgcccgtatacaaacgcaa

SEQ ID NO: 679991 - DNA, 25 bp, Artificial sequence
  Synthetic oligonucleotide
acaacgttgcgtacgcgatgacaac

SEQ ID NO: 679992 - DNA, 25 bp, Artificial sequence
  Synthetic oligonucleotide
attaggtagtacccggtcttgggag

SEQ ID NO: 679993 - DNA, 25 bp, Artificial sequence
  Synthetic oligonucleotide
tacgtcgtaatgtctcgcgcatcga

SEQ ID NO: 679994 - DNA, 25 bp, Artificial sequence
  Synthetic oligonucleotide
cagccatactatctcgcgagaaagc

SEQ ID NO: 679995 - DNA, 25 bp, Artificial sequence
  Synthetic oligonucleotide
ctcgaggtcgcgaccttaacttgtt

SEQ ID NO: 679996 - DNA, 25 bp, Artificial sequence
  Synthetic oligonucleotide
ctcgaggtcgcgtccttaacttgtt

SEQ ID NO: 679997 - DNA, 25 bp, Artificial sequence
  Synthetic oligonucleotide
acaacaccatatccggacgaggatg

SEQ ID NO: 679998 - DNA, 25 bp, Artificial sequence
  Synthetic oligonucleotide
acaacaccatatgcggacgaggatg

SEQ ID NO: 679999 - DNA, 25 bp, Artificial sequence
  Synthetic oligonucleotide
gtgaagccgttatagtacgggtcag

SEQ ID NO: 680000 - DNA, 25 bp, Artificial sequence
  Synthetic oligonucleotide
gtgaagccgttaaagtacgggtcag

SEQ ID NO: 680001 - DNA, 25 bp, Artificial sequence
  Synthetic oligonucleotide
gtatttacgtcgcacgactgctacg

SEQ ID NO: 680002 - DNA, 25 bp, Artificial sequence
  Synthetic oligonucleotide
gtatttacgtcggacgactgctacg

SEQ ID NO: 680003 - DNA, 25 bp, Artificial sequence
  Synthetic oligonucleotide
ttagtttcgcgataaccgccgctac

SEQ ID NO: 680004 - DNA, 25 bp, Artificial sequence
  Synthetic oligonucleotide
ttagtttcgcgaaaaccgccgctac

SEQ ID NO: 680005 - DNA, 25 bp, Artificial sequence
  Synthetic oligonucleotide
acaacgttgcgttcgcgatgacaac

SEQ ID NO: 680006 - DNA, 25 bp, Artificial sequence
  Synthetic oligonucleotide
gtgttgaacggtatgcgcgataacg

SEQ ID NO: 680007 - DNA, 25 bp, Artificial sequence
  Synthetic oligonucleotide
ggccaggcgtattacggccataaaa

SEQ ID NO: 680008 - DNA, 25 bp, Artificial sequence
  Synthetic oligonucleotide
actccgtattcgggcggattaatcg

SEQ ID NO: 680009 - DNA, 25 bp, Artificial sequence
  Synthetic oligonucleotide
ccaattatccgtcgcgatagttcgg

SEQ ID NO: 680010 - DNA, 25 bp, Artificial sequence
  Synthetic oligonucleotide
ccaattatccgtggcgatagttcgg

SEQ ID NO: 680011 - DNA, 25 bp, Artificial sequence
  Synthetic oligonucleotide
atgaaatacgcgggacataccctcc

SEQ ID NO: 680012 - DNA, 25 bp, Artificial sequence
  Synthetic oligonucleotide
atgaaatacgcgcgacataccctcc

SEQ ID NO: 680013 - DNA, 25 bp, Artificial sequence
  Synthetic oligonucleotide
ctacgttgttgcgaccgtcgatttc

SEQ ID NO: 680014 - DNA, 25 bp, Artificial sequence
  Synthetic oligonucleotide
ctacgttgttgccaccgtcgatttc

SEQ ID NO: 680015 - DNA, 25 bp, Artificial sequence
  Synthetic oligonucleotide
tgccactggaatcgcgcatagactt

SEQ ID NO: 680016 - DNA, 25 bp, Artificial sequence
  Synthetic oligonucleotide
tgccactggaatggcgcatagactt

SEQ ID NO: 680017 - DNA, 25 bp, Artificial sequence
  Synthetic oligonucleotide
attaggtagtacgcggtcttgggag

SEQ ID NO: 680018 - DNA, 25 bp, Artificial sequence
  Synthetic oligonucleotide
tacagacgagcgggtaactagtcct

SEQ ID NO: 680019 - DNA, 25 bp, Artificial sequence
  Synthetic oligonucleotide
cgtaattaccgcaacggacaagtcc

SEQ ID NO: 680020 - DNA, 25 bp, Artificial sequence
  Synthetic oligonucleotide
gtgttgaacggtttgcgcgataacg

SEQ ID NO: 680021 - DNA, 25 bp, Artificial sequence
  Synthetic oligonucleotide
tcaagcctccgttgtcgactagctt

SEQ ID NO: 680022 - DNA, 25 bp, Artificial sequence
  Synthetic oligonucleotide
tcaagcctccgtagtcgactagctt

SEQ ID NO: 680023 - DNA, 25 bp, Artificial sequence
  Synthetic oligonucleotide
ggtaatgtacgaagcgagagatccg

SEQ ID NO: 680024 - DNA, 25 bp, Artificial sequence
  Synthetic oligonucleotide
ggtaatgtacgatgcgagagatccg

SEQ ID NO: 680025 - DNA, 25 bp, Artificial sequence
  Synthetic oligonucleotide
gacgatttcgtgtcggtcctagagt

SEQ ID NO: 680026 - DNA, 25 bp, Artificial sequence
  Synthetic oligonucleotide
gacgatttcgtgacggtcctagagt

SEQ ID NO: 680027 - DNA, 25 bp, Artificial sequence
  Synthetic oligonucleotide
cgggtacgacgcgaagttaattgct

SEQ ID NO: 680028 - DNA, 25 bp, Artificial sequence
  Synthetic oligonucleotide
cgggtacgacgccaagttaattgct

SEQ ID NO: 680029 - DNA, 25 bp, Artificial sequence
  Synthetic oligonucleotide
cagccatactatgtcgcgagaaagc

SEQ ID NO: 680030 - DNA, 25 bp, Artificial sequence
  Synthetic oligonucleotide
tacagacgagcgcgtaactagtcct

SEQ ID NO: 680031 - DNA, 25 bp, Artificial sequence
  Synthetic oligonucleotide
ttggctccgcgttatgactaccgat

SEQ ID NO: 680032 - DNA, 25 bp, Artificial sequence
  Synthetic oligonucleotide
gcttcttacttgcgcgcgaccttta

SEQ ID NO: 680033 - DNA, 25 bp, Artificial sequence
  Synthetic oligonucleotide
ttctgataccggtgtacgcaagacc

SEQ ID NO: 680034 - DNA, 25 bp, Artificial sequence
  Synthetic oligonucleotide
caatgaagcgtagcgttcgcttcct

SEQ ID NO: 680035 - DNA, 25 bp, Artificial sequence
  Synthetic oligonucleotide
caatgaagcgtaccgttcgcttcct

SEQ ID NO: 680036 - DNA, 25 bp, Artificial sequence
  Synthetic oligonucleotide
gtcgcttaggcgaaccgtaaatcac

SEQ ID NO: 680037 - DNA, 25 bp, Artificial sequence
  Synthetic oligonucleotide
gtcgcttaggcgtaccgtaaatcac

SEQ ID NO: 680038 - DNA, 25 bp, Artificial sequence
  Synthetic oligonucleotide
tactgagtcaattcgcgcggggtaa

SEQ ID NO: 680039 - DNA, 25 bp, Artificial sequence
  Synthetic oligonucleotide
tactgagtcaatacgcgcggggtaa

SEQ ID NO: 680040 - DNA, 25 bp, Artificial sequence
  Synthetic oligonucleotide
gtcggtaccgacgcgtttagatgtt

SEQ ID NO: 680041 - DNA, 25 bp, Artificial sequence
  Synthetic oligonucleotide
gtcggtaccgacccgtttagatgtt

SEQ ID NO: 680042 - DNA, 25 bp, Artificial sequence
  Synthetic oligonucleotide
cggtaccggaacgcgactaagaata

SEQ ID NO: 680043 - DNA, 25 bp, Artificial sequence
  Synthetic oligonucleotide
ggtatagctagccgcgtaagctttc

SEQ ID NO: 680044 - DNA, 25 bp, Artificial sequence
  Synthetic oligonucleotide
cggtaccggaacccgactaagaata

SEQ ID NO: 680045 - DNA, 25 bp, Artificial sequence
  Synthetic oligonucleotide
ttggctccgcgtaatgactaccgat

SEQ ID NO: 680046 - DNA, 25 bp, Artificial sequence
  Synthetic oligonucleotide
aaaatgtctacccgacgtcccagag

SEQ ID NO: 680047 - DNA, 25 bp, Artificial sequence
  Synthetic oligonucleotide
aaaatgtctaccggacgtcccagag

SEQ ID NO: 680048 - DNA, 25 bp, Artificial sequence
  Synthetic oligonucleotide
gtcttcaatgcgtacgctcgtcgtt

SEQ ID NO: 680049 - DNA, 25 bp, Artificial sequence
  Synthetic oligonucleotide
gtcttcaatgcgaacgctcgtcgtt

SEQ ID NO: 680050 - DNA, 25 bp, Artificial sequence
  Synthetic oligonucleotide
cttactcgacgttctctagcgtgac

SEQ ID NO: 680051 - DNA, 25 bp, Artificial sequence
  Synthetic oligonucleotide
cttactcgacgtactctagcgtgac

SEQ ID NO: 680052 - DNA, 25 bp, Artificial sequence
  Synthetic oligonucleotide
tattggtacgcgcacgttacggact

SEQ ID NO: 680053 - DNA, 25 bp, Artificial sequence
  Synthetic oligonucleotide
tattggtacgcggacgttacggact

SEQ ID NO: 680054 - DNA, 25 bp, Artificial sequence
  Synthetic oligonucleotide
aaagcgctcggttcgacgttgttgt

SEQ ID NO: 680055 - DNA, 25 bp, Artificial sequence
  Synthetic oligonucleotide
ggtatagctagcggcgtaagctttc

SEQ ID NO: 680056 - DNA, 25 bp, Artificial sequence
  Synthetic oligonucleotide
gagaggacgacggaagtcgaaacaa

SEQ ID NO: 680057 - DNA, 25 bp, Artificial sequence
  Synthetic oligonucleotide
aaagcgctcggtacgacgttgttgt

SEQ ID NO: 680058 - DNA, 25 bp, Artificial sequence
  Synthetic oligonucleotide
tgccagcgtcgcaagtaatatagcg

SEQ ID NO: 680059 - DNA, 25 bp, Artificial sequence
  Synthetic oligonucleotide
tgccagcgtcgctagtaatatagcg

SEQ ID NO: 680060 - DNA, 25 bp, Artificial sequence
  Synthetic oligonucleotide
cacagccgatagtatgcggtatgtc

SEQ ID NO: 680061 - DNA, 25 bp, Artificial sequence
  Synthetic oligonucleotide
cacagccgatagaatgcggtatgtc

SEQ ID NO: 680062 - DNA, 25 bp, Artificial sequence
  Synthetic oligonucleotide
gcctatacccgtcgcttaaaacgac

SEQ ID NO: 680063 - DNA, 25 bp, Artificial sequence
  Synthetic oligonucleotide
gcctatacccgtggcttaaaacgac

SEQ ID NO: 680064 - DNA, 25 bp, Artificial sequence
  Synthetic oligonucleotide
ggtacgctatatctcgcgctcattc

SEQ ID NO: 680065 - DNA, 25 bp, Artificial sequence
  Synthetic oligonucleotide
ggtacgctatatgtcgcgctcattc

SEQ ID NO: 680066 - DNA, 25 bp, Artificial sequence
  Synthetic oligonucleotide
aattcctcgatccacggtcggaatg

SEQ ID NO: 680067 - DNA, 25 bp, Artificial sequence
  Synthetic oligonucleotide
ttctgataccggagtacgcaagacc

SEQ ID NO: 680068 - DNA, 25 bp, Artificial sequence
  Synthetic oligonucleotide
gagaggacgacgcaagtcgaaacaa

SEQ ID NO: 680069 - DNA, 25 bp, Artificial sequence
  Synthetic oligonucleotide
cctcctcgttcgctcgatctgtaaa

SEQ ID NO: 680070 - DNA, 25 bp, Artificial sequence
  Synthetic oligonucleotide
ctatggcgcgtactgaaacgggaat

SEQ ID NO: 680071 - DNA, 25 bp, Artificial sequence
  Synthetic oligonucleotide
ctatggcgcgtagtgaaacgggaat

SEQ ID NO: 680072 - DNA, 25 bp, Artificial sequence
  Synthetic oligonucleotide
cactatgcgtaccgacgatgtgagt

SEQ ID NO: 680073 - DNA, 25 bp, Artificial sequence
  Synthetic oligonucleotide
cactatgcgtacggacgatgtgagt

SEQ ID NO: 680074 - DNA, 25 bp, Artificial sequence
  Synthetic oligonucleotide
gtctggtaagtaccggtcgcgtaat

SEQ ID NO: 680075 - DNA, 25 bp, Artificial sequence
  Synthetic oligonucleotide
gtctggtaagtagcggtcgcgtaat

SEQ ID NO: 680076 - DNA, 25 bp, Artificial sequence
  Synthetic oligonucleotide
gcacctctatgaatgcgcgagctta

SEQ ID NO: 680077 - DNA, 25 bp, Artificial sequence
  Synthetic oligonucleotide
gcacctctatgattgcgcgagctta

SEQ ID NO: 680078 - DNA, 25 bp, Artificial sequence
  Synthetic oligonucleotide
gcagcttatgttccggacgtttgtc

SEQ ID NO: 680079 - DNA, 25 bp, Artificial sequence
  Synthetic oligonucleotide
gcagcttatgttgcggacgtttgtc

SEQ ID NO: 680080 - DNA, 25 bp, Artificial sequence
  Synthetic oligonucleotide
aattcctcgatcgacggtcggaatg

SEQ ID NO: 680081 - DNA, 25 bp, Artificial sequence
  Synthetic oligonucleotide
gttggggcgataagtaccgcataga

SEQ ID NO: 680082 - DNA, 25 bp, Artificial sequence
  Synthetic oligonucleotide
gcttcttacttgggcgcgaccttta

SEQ ID NO: 680083 - DNA, 25 bp, Artificial sequence
  Synthetic oligonucleotide
tccgaaccgcgaggatataactcgt

SEQ ID NO: 680084 - DNA, 25 bp, Artificial sequence
  Synthetic oligonucleotide
cctatagtcccgggattaacggcaa

SEQ ID NO: 680085 - DNA, 25 bp, Artificial sequence
  Synthetic oligonucleotide
ggatactacgatcggtggcatatgc

SEQ ID NO: 680086 - DNA, 25 bp, Artificial sequence
  Synthetic oligonucleotide
aaacctactgcgaacgagtgctagc

SEQ ID NO: 680087 - DNA, 25 bp, Artificial sequence
  Synthetic oligonucleotide
ggctgcacgccgtataggaagaata

SEQ ID NO: 680088 - DNA, 25 bp, Artificial sequence
  Synthetic oligonucleotide
ggctgcacgccgaataggaagaata

SEQ ID NO: 680089 - DNA, 25 bp, Artificial sequence
  Synthetic oligonucleotide
caatattcggacgtgtacgtcgggt

SEQ ID NO: 680090 - DNA, 25 bp, Artificial sequence
  Synthetic oligonucleotide
caatattcggacctgtacgtcgggt

SEQ ID NO: 680091 - DNA, 25 bp, Artificial sequence
  Synthetic oligonucleotide
gaaccttcgagttcgtacgtactgc

SEQ ID NO: 680092 - DNA, 25 bp, Artificial sequence
  Synthetic oligonucleotide
aagtgacgcggtatagtagcggctt

SEQ ID NO: 680093 - DNA, 25 bp, Artificial sequence
  Synthetic oligonucleotide
gttggggcgatatgtaccgcataga

SEQ ID NO: 680094 - DNA, 25 bp, Artificial sequence
  Synthetic oligonucleotide
aagtgacgcggtttagtagcggctt

SEQ ID NO: 680095 - DNA, 25 bp, Artificial sequence
  Synthetic oligonucleotide
gtgagcgtacgcgttatacgtatgg

SEQ ID NO: 680096 - DNA, 25 bp, Artificial sequence
  Synthetic oligonucleotide
gtgagcgtacgccttatacgtatgg

SEQ ID NO: 680097 - DNA, 25 bp, Artificial sequence
  Synthetic oligonucleotide
tatgcgtcgtatagcggacatgtcg

SEQ ID NO: 680098 - DNA, 25 bp, Artificial sequence
  Synthetic oligonucleotide
tatgcgtcgtattgcggacatgtcg

SEQ ID NO: 680099 - DNA, 25 bp, Artificial sequence
  Synthetic oligonucleotide
tcttcacgttaaggaacgccctcag

SEQ ID NO: 680100 - DNA, 25 bp, Artificial sequence
  Synthetic oligonucleotide
tcttcacgttaacgaacgccctcag

SEQ ID NO: 680101 - DNA, 25 bp, Artificial sequence
  Synthetic oligonucleotide
gattgttagcgccttaaccagggtc

SEQ ID NO: 680102 - DNA, 25 bp, Artificial sequence
  Synthetic oligonucleotide
ttcctgatcgcgttacacgactgtc

SEQ ID NO: 680103 - DNA, 25 bp, Artificial sequence
  Synthetic oligonucleotide
cctatagtcccgcgattaacggcaa

SEQ ID NO: 680104 - DNA, 25 bp, Artificial sequence
  Synthetic oligonucleotide
ctggttcgagcgaagtacgtgattc

SEQ ID NO: 680105 - DNA, 25 bp, Artificial sequence
  Synthetic oligonucleotide
gaaccttcgagtacgtacgtactgc

SEQ ID NO: 680106 - DNA, 25 bp, Artificial sequence
  Synthetic oligonucleotide
ctaataactaaccgccgatggcacc

SEQ ID NO: 680107 - DNA, 25 bp, Artificial sequence
  Synthetic oligonucleotide
cctcctcgttcggtcgatctgtaaa

SEQ ID NO: 680108 - DNA, 25 bp, Artificial sequence
  Synthetic oligonucleotide
catgacattccgccccgatattcac

SEQ ID NO: 680109 - DNA, 25 bp, Artificial sequence
  Synthetic oligonucleotide
catgacattccggcccgatattcac

SEQ ID NO: 680110 - DNA, 25 bp, Artificial sequence
  Synthetic oligonucleotide
tggtggcgatacggcgctagaaatt

SEQ ID NO: 680111 - DNA, 25 bp, Artificial sequence
  Synthetic oligonucleotide
tggtggcgataccgcgctagaaatt

SEQ ID NO: 680112 - DNA, 25 bp, Artificial sequence
  Synthetic oligonucleotide
taacgccgcgattctttcgaatggc

SEQ ID NO: 680113 - DNA, 25 bp, Artificial sequence
  Synthetic oligonucleotide
taacgccgcgatactttcgaatggc

SEQ ID NO: 680114 - DNA, 25 bp, Artificial sequence
  Synthetic oligonucleotide
acgacagtactaaaggcggtccaca

SEQ ID NO: 680115 - DNA, 25 bp, Artificial sequence
  Synthetic oligonucleotide
acgacagtactataggcggtccaca

SEQ ID NO: 680116 - DNA, 25 bp, Artificial sequence
  Synthetic oligonucleotide
ccgttgagtgatggcgacgtataga

SEQ ID NO: 680117 - DNA, 25 bp, Artificial sequence
  Synthetic oligonucleotide
tccgaaccgcgacgatataactcgt

SEQ ID NO: 680118 - DNA, 25 bp, Artificial sequence
  Synthetic oligonucleotide
ctaataactaacggccgatggcacc

SEQ ID NO: 680119 - DNA, 25 bp, Artificial sequence
  Synthetic oligonucleotide
gattgttagcgcgttaaccagggtc

SEQ ID NO: 680120 - DNA, 25 bp, Artificial sequence
  Synthetic oligonucleotide
gagtattagtaccagcgcggaaagg

SEQ ID NO: 680121 - DNA, 25 bp, Artificial sequence
  Synthetic oligonucleotide
gagtattagtacgagcgcggaaagg

SEQ ID NO: 680122 - DNA, 25 bp, Artificial sequence
  Synthetic oligonucleotide
ataaaggatatatcgcgcgggtggg

SEQ ID NO: 680123 - DNA, 25 bp, Artificial sequence
  Synthetic oligonucleotide
ataaaggatataacgcgcgggtggg

SEQ ID NO: 680124 - DNA, 25 bp, Artificial sequence
  Synthetic oligonucleotide
gtaggctacggaccggttattatgg

SEQ ID NO: 680125 - DNA, 25 bp, Artificial sequence
  Synthetic oligonucleotide
gtaggctacggagcggttattatgg

SEQ ID NO: 680126 - DNA, 25 bp, Artificial sequence
  Synthetic oligonucleotide
tacgactagtacccgcgatgtcaga

SEQ ID NO: 680127 - DNA, 25 bp, Artificial sequence
  Synthetic oligonucleotide
tacgactagtacgcgcgatgtcaga

SEQ ID NO: 680128 - DNA, 25 bp, Artificial sequence
  Synthetic oligonucleotide
atcagtttatcgcgtacggtacgcg

SEQ ID NO: 680129 - DNA, 25 bp, Artificial sequence
  Synthetic oligonucleotide
atcagtttatcgggtacggtacgcg

SEQ ID NO: 680130 - DNA, 25 bp, Artificial sequence
  Synthetic oligonucleotide
ccgttgagtgatcgcgacgtataga

SEQ ID NO: 680131 - DNA, 25 bp, Artificial sequence
  Synthetic oligonucleotide
tccgaacctatacggcgcatatagc

SEQ ID NO: 680132 - DNA, 25 bp, Artificial sequence
  Synthetic oligonucleotide
actttatccgcgggatagtagcagg

SEQ ID NO: 680133 - DNA, 25 bp, Artificial sequence
  Synthetic oligonucleotide
gaagagcccggttcgtaaagtaagc

SEQ ID NO: 680134 - DNA, 25 bp, Artificial sequence
  Synthetic oligonucleotide
gaagagcccggtacgtaaagtaagc

SEQ ID NO: 680135 - DNA, 25 bp, Artificial sequence
  Synthetic oligonucleotide
gcaacattacgcgtctacgtaggag

SEQ ID NO: 680136 - DNA, 25 bp, Artificial sequence
  Synthetic oligonucleotide
gcaacattacgcctctacgtaggag

SEQ ID NO: 680137 - DNA, 25 bp, Artificial sequence
  Synthetic oligonucleotide
gatttaagcctcgtaacgcgtggag

SEQ ID NO: 680138 - DNA, 25 bp, Artificial sequence
  Synthetic oligonucleotide
gatttaagcctcctaacgcgtggag

SEQ ID NO: 680139 - DNA, 25 bp, Artificial sequence
  Synthetic oligonucleotide
gacatccgcgtagatacgagggttt

SEQ ID NO: 680140 - DNA, 25 bp, Artificial sequence
  Synthetic oligonucleotide
gacatccgcgtacatacgagggttt

SEQ ID NO: 680141 - DNA, 25 bp, Artificial sequence
  Synthetic oligonucleotide
tatggtcgctagttcggtcccacta

SEQ ID NO: 680142 - DNA, 25 bp, Artificial sequence
  Synthetic oligonucleotide
ctatgagcgatggtacgtttgctcc

SEQ ID NO: 680143 - DNA, 25 bp, Artificial sequence
  Synthetic oligonucleotide
tccgaacctatagggcgcatatagc

SEQ ID NO: 680144 - DNA, 25 bp, Artificial sequence
  Synthetic oligonucleotide
tcgttcactacccgtcgagccatta

SEQ ID NO: 680145 - DNA, 25 bp, Artificial sequence
  Synthetic oligonucleotide
agacataatagtggcgcccttgtcg

SEQ ID NO: 680146 - DNA, 25 bp, Artificial sequence
  Synthetic oligonucleotide
agacataatagtcgcgcccttgtcg

SEQ ID NO: 680147 - DNA, 25 bp, Artificial sequence
  Synthetic oligonucleotide
attgtgttcatcgcgctagctcggt

SEQ ID NO: 680148 - DNA, 25 bp, Artificial sequence
  Synthetic oligonucleotide
attgtgttcatcccgctagctcggt

SEQ ID NO: 680149 - DNA, 25 bp, Artificial sequence
  Synthetic oligonucleotide
ctttcctaccgtttcgcgacatctg

SEQ ID NO: 680150 - DNA, 25 bp, Artificial sequence
  Synthetic oligonucleotide
ctttcctaccgtatcgcgacatctg

SEQ ID NO: 680151 - DNA, 25 bp, Artificial sequence
  Synthetic oligonucleotide
atctggaactcccgtacgctaaagg

SEQ ID NO: 680152 - DNA, 25 bp, Artificial sequence
  Synthetic oligonucleotide
atctggaactccggtacgctaaagg

SEQ ID NO: 680153 - DNA, 25 bp, Artificial sequence
  Synthetic oligonucleotide
ccaatttttacgtaccgcgctgcga

SEQ ID NO: 680154 - DNA, 25 bp, Artificial sequence
  Synthetic oligonucleotide
ccaatttttacgaaccgcgctgcga

SEQ ID NO: 680155 - DNA, 25 bp, Artificial sequence
  Synthetic oligonucleotide
tatggtcgctagatcggtcccacta

SEQ ID NO: 680156 - DNA, 25 bp, Artificial sequence
  Synthetic oligonucleotide
agttccccgtctaatcgcggatatc

SEQ ID NO: 680157 - DNA, 25 bp, Artificial sequence
  Synthetic oligonucleotide
ccttgacgtccgtatggtacgtagt

SEQ ID NO: 680158 - DNA, 25 bp, Artificial sequence
  Synthetic oligonucleotide
gcctctccgtttcgcggtaaactta

SEQ ID NO: 680159 - DNA, 25 bp, Artificial sequence
  Synthetic oligonucleotide
catctcaacgcgcaaccgtggataa

SEQ ID NO: 680160 - DNA, 25 bp, Artificial sequence
  Synthetic oligonucleotide
catctcaacgcggaaccgtggataa

SEQ ID NO: 680161 - DNA, 25 bp, Artificial sequence
  Synthetic oligonucleotide
gtttcttcttatccgcgaccgagca

SEQ ID NO: 680162 - DNA, 25 bp, Artificial sequence
  Synthetic oligonucleotide
gtttcttcttatgcgcgaccgagca

SEQ ID NO: 680163 - DNA, 25 bp, Artificial sequence
  Synthetic oligonucleotide
cattgacgcgattccgtcaaaggtc

SEQ ID NO: 680164 - DNA, 25 bp, Artificial sequence
  Synthetic oligonucleotide
cattgacgcgataccgtcaaaggtc

SEQ ID NO: 680165 - DNA, 25 bp, Artificial sequence
  Synthetic oligonucleotide
tgatagtacgctacgcggaccacat

SEQ ID NO: 680166 - DNA, 25 bp, Artificial sequence
  Synthetic oligonucleotide
tgatagtacgcttcgcggaccacat

SEQ ID NO: 680167 - DNA, 25 bp, Artificial sequence
  Synthetic oligonucleotide
ctatgagcgatgctacgtttgctcc

SEQ ID NO: 680168 - DNA, 25 bp, Artificial sequence
  Synthetic oligonucleotide
ttggcttaaaccccgtagctgtgtg

SEQ ID NO: 680169 - DNA, 25 bp, Artificial sequence
  Synthetic oligonucleotide
gcctctccgtttggcggtaaactta

SEQ ID NO: 680170 - DNA, 25 bp, Artificial sequence
  Synthetic oligonucleotide
agttccccgtcttatcgcggatatc

SEQ ID NO: 680171 - DNA, 25 bp, Artificial sequence
  Synthetic oligonucleotide
tgtgatccgacttacgcggaggttt

SEQ ID NO: 680172 - DNA, 25 bp, Artificial sequence
  Synthetic oligonucleotide
tgtgatccgactaacgcggaggttt

SEQ ID NO: 680173 - DNA, 25 bp, Artificial sequence
  Synthetic oligonucleotide
ccttccagtcgcgtaacgtaaatgc

SEQ ID NO: 680174 - DNA, 25 bp, Artificial sequence
  Synthetic oligonucleotide
ccttccagtcgcctaacgtaaatgc

SEQ ID NO: 680175 - DNA, 25 bp, Artificial sequence
  Synthetic oligonucleotide
gtctaggtacgcacgtcatagtgac

SEQ ID NO: 680176 - DNA, 25 bp, Artificial sequence
  Synthetic oligonucleotide
gtctaggtacgctcgtcatagtgac

SEQ ID NO: 680177 - DNA, 25 bp, Artificial sequence
  Synthetic oligonucleotide
aatatggcgagagtagtcgggcttc

SEQ ID NO: 680178 - DNA, 25 bp, Artificial sequence
  Synthetic oligonucleotide
aatatggcgagactagtcgggcttc

SEQ ID NO: 680179 - DNA, 25 bp, Artificial sequence
  Synthetic oligonucleotide
tcgttcactaccggtcgagccatta

SEQ ID NO: 680180 - DNA, 25 bp, Artificial sequence
  Synthetic oligonucleotide
ttggcttaaaccgcgtagctgtgtg

SEQ ID NO: 680181 - DNA, 25 bp, Artificial sequence
  Synthetic oligonucleotide
catgcttacgcgtattcgcgcagaa

SEQ ID NO: 680182 - DNA, 25 bp, Artificial sequence
  Synthetic oligonucleotide
gaatcctagatacgtcgcgtgagca

SEQ ID NO: 680183 - DNA, 25 bp, Artificial sequence
  Synthetic oligonucleotide
caagtaagtgcgacgtacgcgcaat

SEQ ID NO: 680184 - DNA, 25 bp, Artificial sequence
  Synthetic oligonucleotide
caagtaagtgcgtcgtacgcgcaat

SEQ ID NO: 680185 - DNA, 25 bp, Artificial sequence
  Synthetic oligonucleotide
ccgcacatgcgcgattaggtatctt

SEQ ID NO: 680186 - DNA, 25 bp, Artificial sequence
  Synthetic oligonucleotide
ccgcacatgcgccattaggtatctt

SEQ ID NO: 680187 - DNA, 25 bp, Artificial sequence
  Synthetic oligonucleotide
gacacgcgattccacgtcctaattg

SEQ ID NO: 680188 - DNA, 25 bp, Artificial sequence
  Synthetic oligonucleotide
gacacgcgattcgacgtcctaattg

SEQ ID NO: 680189 - DNA, 25 bp, Artificial sequence
  Synthetic oligonucleotide
gcaagaacgtatcacgcgcaaaagc

SEQ ID NO: 680190 - DNA, 25 bp, Artificial sequence
  Synthetic oligonucleotide
gcaagaacgtatgacgcgcaaaagc

SEQ ID NO: 680191 - DNA, 25 bp, Artificial sequence
  Synthetic oligonucleotide
gaatcctagataggtcgcgtgagca

SEQ ID NO: 680192 - DNA, 25 bp, Artificial sequence
  Synthetic oligonucleotide
actttatccgcgcgatagtagcagg

SEQ ID NO: 680193 - DNA, 25 bp, Artificial sequence
  Synthetic oligonucleotide
cgcgctcgaaagtcgtatcatcaag

SEQ ID NO: 680194 - DNA, 25 bp, Artificial sequence
  Synthetic oligonucleotide
taaggggccgctagacgaagtaatc

SEQ ID NO: 680195 - DNA, 25 bp, Artificial sequence
  Synthetic oligonucleotide
taaggggccgcttgacgaagtaatc

SEQ ID NO: 680196 - DNA, 25 bp, Artificial sequence
  Synthetic oligonucleotide
gggatggatagcctaccgtgttaag

SEQ ID NO: 680197 - DNA, 25 bp, Artificial sequence
  Synthetic oligonucleotide
gggatggatagcgtaccgtgttaag

SEQ ID NO: 680198 - DNA, 25 bp, Artificial sequence
  Synthetic oligonucleotide
tgaagtcgtgttcgcgaatagggtc

SEQ ID NO: 680199 - DNA, 25 bp, Artificial sequence
  Synthetic oligonucleotide
tgaagtcgtgttggcgaatagggtc

SEQ ID NO: 680200 - DNA, 25 bp, Artificial sequence
  Synthetic oligonucleotide
ttgcgactcggtagcgcatttgttg

SEQ ID NO: 680201 - DNA, 25 bp, Artificial sequence
  Synthetic oligonucleotide
ttgcgactcggttgcgcatttgttg

SEQ ID NO: 680202 - DNA, 25 bp, Artificial sequence
  Synthetic oligonucleotide
ccttgacgtccgaatggtacgtagt

SEQ ID NO: 680203 - DNA, 25 bp, Artificial sequence
  Synthetic oligonucleotide
ttcctgatcgcgatacacgactgtc

SEQ ID NO: 680204 - DNA, 25 bp, Artificial sequence
  Synthetic oligonucleotide
cgcgctcgaaagacgtatcatcaag

SEQ ID NO: 680205 - DNA, 25 bp, Artificial sequence
  Synthetic oligonucleotide
gttgatgcgtacgtctgacctgtac

SEQ ID NO: 680206 - DNA, 25 bp, Artificial sequence
  Synthetic oligonucleotide
catgcttacgcgaattcgcgcagaa

SEQ ID NO: 680207 - DNA, 25 bp, Artificial sequence
  Synthetic oligonucleotide
gaaccgcgcgttaggctactataag

SEQ ID NO: 680208 - DNA, 25 bp, Artificial sequence
  Synthetic oligonucleotide
atgtgatgcgacggtaataccggca

SEQ ID NO: 680209 - DNA, 25 bp, Artificial sequence
  Synthetic oligonucleotide
ttgggttccgtcctactagtgttgc

SEQ ID NO: 680210 - DNA, 25 bp, Artificial sequence
  Synthetic oligonucleotide
ttgggttccgtcgtactagtgttgc

SEQ ID NO: 680211 - DNA, 25 bp, Artificial sequence
  Synthetic oligonucleotide
ggtcgagtacgtatccgtttcgtga

SEQ ID NO: 680212 - DNA, 25 bp, Artificial sequence
  Synthetic oligonucleotide
gttgatgcgtacctctgacctgtac

SEQ ID NO: 680213 - DNA, 25 bp, Artificial sequence
  Synthetic oligonucleotide
gaaccgcgcgtttggctactataag

SEQ ID NO: 680214 - DNA, 25 bp, Artificial sequence
  Synthetic oligonucleotide
tcttatatacgcccgtctgcaacgc

SEQ ID NO: 680215 - DNA, 25 bp, Artificial sequence
  Synthetic oligonucleotide
tcttatatacgcgcgtctgcaacgc

SEQ ID NO: 680216 - DNA, 25 bp, Artificial sequence
  Synthetic oligonucleotide
gttcgcagtcgtattgcgcgataga

SEQ ID NO: 680217 - DNA, 25 bp, Artificial sequence
  Synthetic oligonucleotide
gttcgcagtcgttttgcgcgataga

SEQ ID NO: 680218 - DNA, 25 bp, Artificial sequence
  Synthetic oligonucleotide
caccaatcgccgattacgtgacatc

SEQ ID NO: 680219 - DNA, 25 bp, Artificial sequence
  Synthetic oligonucleotide
ggtcgagtacgtttccgtttcgtga

SEQ ID NO: 680220 - DNA, 25 bp, Artificial sequence
  Synthetic oligonucleotide
caccaatcgccgtttacgtgacatc

SEQ ID NO: 680221 - DNA, 25 bp, Artificial sequence
  Synthetic oligonucleotide
ccgttccgttcgcgagtaataacac

SEQ ID NO: 680222 - DNA, 25 bp, Artificial sequence
  Synthetic oligonucleotide
gacctattaacgtccggacagggta

SEQ ID NO: 680223 - DNA, 25 bp, Artificial sequence
  Synthetic oligonucleotide
gacctattaacgaccggacagggta

SEQ ID NO: 680224 - DNA, 25 bp, Artificial sequence
  Synthetic oligonucleotide
gctcagctatacgagcggaacattc

SEQ ID NO: 680225 - DNA, 25 bp, Artificial sequence
  Synthetic oligonucleotide
gctcagctataccagcggaacattc

SEQ ID NO: 680226 - DNA, 25 bp, Artificial sequence
  Synthetic oligonucleotide
acaggacgcgtatgcatagatgtcc

SEQ ID NO: 680227 - DNA, 25 bp, Artificial sequence
  Synthetic oligonucleotide
acaggacgcgtaagcatagatgtcc

SEQ ID NO: 680228 - DNA, 25 bp, Artificial sequence
  Synthetic oligonucleotide
ccgttccgttcgggagtaataacac

SEQ ID NO: 680229 - DNA, 25 bp, Artificial sequence
  Synthetic oligonucleotide
atgtgatgcgaccgtaataccggca

SEQ ID NO: 680230 - DNA, 25 bp, Artificial sequence
  Synthetic oligonucleotide
gcatataggtatccgtcgaccggac

SEQ ID NO: 680231 - DNA, 25 bp, Artificial sequence
  Synthetic oligonucleotide
aacggtctcttagcgcggaaacgac

SEQ ID NO: 680232 - DNA, 25 bp, Artificial sequence
  Synthetic oligonucleotide
gtaatccgtataccggcaagtgccc

SEQ ID NO: 680233 - DNA, 25 bp, Artificial sequence
  Synthetic oligonucleotide
gtaatccgtatagcggcaagtgccc

SEQ ID NO: 680234 - DNA, 25 bp, Artificial sequence
  Synthetic oligonucleotide
tggcttacgacccttgccttgacct

SEQ ID NO: 680235 - DNA, 25 bp, Artificial sequence
  Synthetic oligonucleotide
tggcttacgaccgttgccttgacct

SEQ ID NO: 680236 - DNA, 25 bp, Artificial sequence
  Synthetic oligonucleotide
aatacccgccgtacgactagctgca

SEQ ID NO: 680237 - DNA, 25 bp, Artificial sequence
  Synthetic oligonucleotide
aacggtctcttaccgcggaaacgac

SEQ ID NO: 680238 - DNA, 25 bp, Artificial sequence
  Synthetic oligonucleotide
gcatataggtatgcgtcgaccggac

SEQ ID NO: 680239 - DNA, 25 bp, Artificial sequence
  Synthetic oligonucleotide
ttgtctcgcgtagtccaaagcaccg

SEQ ID NO: 680240 - DNA, 25 bp, Artificial sequence
  Synthetic oligonucleotide
aatacccgccgttcgactagctgca

SEQ ID NO: 680241 - DNA, 25 bp, Artificial sequence
  Synthetic oligonucleotide
ctcaacctacgtccgacgtcatcct

SEQ ID NO: 680242 - DNA, 25 bp, Artificial sequence
  Synthetic oligonucleotide
ctcaacctacgtgcgacgtcatcct

SEQ ID NO: 680243 - DNA, 25 bp, Artificial sequence
  Synthetic oligonucleotide
gcatgtctgcgccaatagggtcaac

SEQ ID NO: 680244 - DNA, 25 bp, Artificial sequence
  Synthetic oligonucleotide
gcatgtctgcgcgaatagggtcaac

SEQ ID NO: 680245 - DNA, 25 bp, Artificial sequence
  Synthetic oligonucleotide
gactctctacgcgcgtctaggtttc

SEQ ID NO: 680246 - DNA, 25 bp, Artificial sequence
  Synthetic oligonucleotide
gactctctacgcccgtctaggtttc

SEQ ID NO: 680247 - DNA, 25 bp, Artificial sequence
  Synthetic oligonucleotide
accgtggtgtattcggtcggattcc

SEQ ID NO: 680248 - DNA, 25 bp, Artificial sequence
  Synthetic oligonucleotide
accgtggtgtatacggtcggattcc

SEQ ID NO: 680249 - DNA, 25 bp, Artificial sequence
  Synthetic oligonucleotide
tctttgcgcgtaagacgcaggctac

SEQ ID NO: 680250 - DNA, 25 bp, Artificial sequence
  Synthetic oligonucleotide
tctttgcgcgtatgacgcaggctac

SEQ ID NO: 680251 - DNA, 25 bp, Artificial sequence
  Synthetic oligonucleotide
tagactcgcgtttgacggttagcgg

SEQ ID NO: 680252 - DNA, 25 bp, Artificial sequence
  Synthetic oligonucleotide
gtagtcaagcgccggtacgagaaga

SEQ ID NO: 680253 - DNA, 25 bp, Artificial sequence
  Synthetic oligonucleotide
tagactcgcgttagacggttagcgg

SEQ ID NO: 680254 - DNA, 25 bp, Artificial sequence
  Synthetic oligonucleotide
acgtgagttcgagtagtcgctcgtg

SEQ ID NO: 680255 - DNA, 25 bp, Artificial sequence
  Synthetic oligonucleotide
gttaggagcgcctatcgagtcgtct

SEQ ID NO: 680256 - DNA, 25 bp, Artificial sequence
  Synthetic oligonucleotide
gtagtcaagcgcgggtacgagaaga

SEQ ID NO: 680257 - DNA, 25 bp, Artificial sequence
  Synthetic oligonucleotide
gtgggacgcaagcggatagttacag

SEQ ID NO: 680258 - DNA, 25 bp, Artificial sequence
  Synthetic oligonucleotide
ttgaagttcgcgcggctagtcagtc

SEQ ID NO: 680259 - DNA, 25 bp, Artificial sequence
  Synthetic oligonucleotide
ctcatttacgacgcggtatacgggg

SEQ ID NO: 680260 - DNA, 25 bp, Artificial sequence
  Synthetic oligonucleotide
ctcatttacgacccggtatacgggg

SEQ ID NO: 680261 - DNA, 25 bp, Artificial sequence
  Synthetic oligonucleotide
gttacaggcgtattagacgccgtgc

SEQ ID NO: 680262 - DNA, 25 bp, Artificial sequence
  Synthetic oligonucleotide
gttacaggcgtaatagacgccgtgc

SEQ ID NO: 680263 - DNA, 25 bp, Artificial sequence
  Synthetic oligonucleotide
accgattcgacttcgtgcgttcagg

SEQ ID NO: 680264 - DNA, 25 bp, Artificial sequence
  Synthetic oligonucleotide
accgattcgactacgtgcgttcagg

SEQ ID NO: 680265 - DNA, 25 bp, Artificial sequence
  Synthetic oligonucleotide
ttgaagttcgcggggctagtcagtc

SEQ ID NO: 680266 - DNA, 25 bp, Artificial sequence
  Synthetic oligonucleotide
tcgtaatcgtccgtcggtaggcatc

SEQ ID NO: 680267 - DNA, 25 bp, Artificial sequence
  Synthetic oligonucleotide
ttgtctcgcgtactccaaagcaccg

SEQ ID NO: 680268 - DNA, 25 bp, Artificial sequence
  Synthetic oligonucleotide
acgtgagttcgactagtcgctcgtg

SEQ ID NO: 680269 - DNA, 25 bp, Artificial sequence
  Synthetic oligonucleotide
ctcgggcgtgttcggtacctttaca

SEQ ID NO: 680270 - DNA, 25 bp, Artificial sequence
  Synthetic oligonucleotide
ctcgggcgtgttgggtacctttaca

SEQ ID NO: 680271 - DNA, 25 bp, Artificial sequence
  Synthetic oligonucleotide
aatcgatacgctggtacggagccac

SEQ ID NO: 680272 - DNA, 25 bp, Artificial sequence
  Synthetic oligonucleotide
aatcgatacgctcgtacggagccac

SEQ ID NO: 680273 - DNA, 25 bp, Artificial sequence
  Synthetic oligonucleotide
tcttcattatatggcgggcgcccag

SEQ ID NO: 680274 - DNA, 25 bp, Artificial sequence
  Synthetic oligonucleotide
tcttcattatatcgcgggcgcccag

SEQ ID NO: 680275 - DNA, 25 bp, Artificial sequence
  Synthetic oligonucleotide
gacctgcggtaccagttagcatacg

SEQ ID NO: 680276 - DNA, 25 bp, Artificial sequence
  Synthetic oligonucleotide
gacctgcggtacgagttagcatacg

SEQ ID NO: 680277 - DNA, 25 bp, Artificial sequence
  Synthetic oligonucleotide
tcgtgggatactccgtacgatggag

SEQ ID NO: 680278 - DNA, 25 bp, Artificial sequence
  Synthetic oligonucleotide
tcgtgggatactgcgtacgatggag

SEQ ID NO: 680279 - DNA, 25 bp, Artificial sequence
  Synthetic oligonucleotide
tcgtaatcgtccctcggtaggcatc

SEQ ID NO: 680280 - DNA, 25 bp, Artificial sequence
  Synthetic oligonucleotide
cacgcaaacctatcgccgatggtca

SEQ ID NO: 680281 - DNA, 25 bp, Artificial sequence
  Synthetic oligonucleotide
gcacccttctatggcgagcctgtta

SEQ ID NO: 680282 - DNA, 25 bp, Artificial sequence
  Synthetic oligonucleotide
gctcatctatgtgtcgcgaacggga

SEQ ID NO: 680283 - DNA, 25 bp, Artificial sequence
  Synthetic oligonucleotide
caaaggctacgtcgcgcatgattcg

SEQ ID NO: 680284 - DNA, 25 bp, Artificial sequence
  Synthetic oligonucleotide
caaaggctacgtggcgcatgattcg

SEQ ID NO: 680285 - DNA, 25 bp, Artificial sequence
  Synthetic oligonucleotide
gcctagaacgtatcgacgcaagacc

SEQ ID NO: 680286 - DNA, 25 bp, Artificial sequence
  Synthetic oligonucleotide
gcctagaacgtaacgacgcaagacc

SEQ ID NO: 680287 - DNA, 25 bp, Artificial sequence
  Synthetic oligonucleotide
tacatgcacgaaggtctcgacaccg

SEQ ID NO: 680288 - DNA, 25 bp, Artificial sequence
  Synthetic oligonucleotide
tacatgcacgaacgtctcgacaccg

SEQ ID NO: 680289 - DNA, 25 bp, Artificial sequence
  Synthetic oligonucleotide
aagcgtgccgggggaattatcgcat

SEQ ID NO: 680290 - DNA, 25 bp, Artificial sequence
  Synthetic oligonucleotide
aagcgtgccgggcgaattatcgcat

SEQ ID NO: 680291 - DNA, 25 bp, Artificial sequence
  Synthetic oligonucleotide
tttacgctaacgaccgcgtacggac

SEQ ID NO: 680292 - DNA, 25 bp, Artificial sequence
  Synthetic oligonucleotide
cggaatcgtcgtaaacgcctagctg

SEQ ID NO: 680293 - DNA, 25 bp, Artificial sequence
  Synthetic oligonucleotide
tttacgctaacgtccgcgtacggac

SEQ ID NO: 680294 - DNA, 25 bp, Artificial sequence
  Synthetic oligonucleotide
cacgcaaacctaacgccgatggtca

SEQ ID NO: 680295 - DNA, 25 bp, Artificial sequence
  Synthetic oligonucleotide
gtgcctaccgtcccataagcatggt

SEQ ID NO: 680296 - DNA, 25 bp, Artificial sequence
  Synthetic oligonucleotide
gtgcctaccgtcgcataagcatggt

SEQ ID NO: 680297 - DNA, 25 bp, Artificial sequence
  Synthetic oligonucleotide
ttcgggtcctagggatacggttgac

SEQ ID NO: 680298 - DNA, 25 bp, Artificial sequence
  Synthetic oligonucleotide
ttcgggtcctagcgatacggttgac

SEQ ID NO: 680299 - DNA, 25 bp, Artificial sequence
  Synthetic oligonucleotide
tgttctcgcgctagtcgtaaccagg

SEQ ID NO: 680300 - DNA, 25 bp, Artificial sequence
  Synthetic oligonucleotide
tgttctcgcgcttgtcgtaaccagg

SEQ ID NO: 680301 - DNA, 25 bp, Artificial sequence
  Synthetic oligonucleotide
cgaggccgacgtgcgatcttttcaa

SEQ ID NO: 680302 - DNA, 25 bp, Artificial sequence
  Synthetic oligonucleotide
ctggcgcgtacggcgactataatct

SEQ ID NO: 680303 - DNA, 25 bp, Artificial sequence
  Synthetic oligonucleotide
tctccgttgtctcgcgacatgacct

SEQ ID NO: 680304 - DNA, 25 bp, Artificial sequence
  Synthetic oligonucleotide
cggaatcgtcgttaacgcctagctg

SEQ ID NO: 680305 - DNA, 25 bp, Artificial sequence
  Synthetic oligonucleotide
cgtgtcgatcggcgctttaacttgc

SEQ ID NO: 680306 - DNA, 25 bp, Artificial sequence
  Synthetic oligonucleotide
gtgggacgcaaggggatagttacag

SEQ ID NO: 680307 - DNA, 25 bp, Artificial sequence
  Synthetic oligonucleotide
gcagcatcgcacgatatacgggtca

SEQ ID NO: 680308 - DNA, 25 bp, Artificial sequence
  Synthetic oligonucleotide
gcagcatcgcaccatatacgggtca

SEQ ID NO: 680309 - DNA, 25 bp, Artificial sequence
  Synthetic oligonucleotide
gtgcgcgtacgaggctatacatacg

SEQ ID NO: 680310 - DNA, 25 bp, Artificial sequence
  Synthetic oligonucleotide
gtgcgcgtacgacgctatacatacg

SEQ ID NO: 680311 - DNA, 25 bp, Artificial sequence
  Synthetic oligonucleotide
catttcccgtaaggcgcaatggtcc

SEQ ID NO: 680312 - DNA, 25 bp, Artificial sequence
  Synthetic oligonucleotide
catttcccgtaacgcgcaatggtcc

SEQ ID NO: 680313 - DNA, 25 bp, Artificial sequence
  Synthetic oligonucleotide
gcgctgattagtcgcgcgatgaagt

SEQ ID NO: 680314 - DNA, 25 bp, Artificial sequence
  Synthetic oligonucleotide
gcgctgattagtggcgcgatgaagt

SEQ ID NO: 680315 - DNA, 25 bp, Artificial sequence
  Synthetic oligonucleotide
agaggtcggtaccatgcgtagtgtg

SEQ ID NO: 680316 - DNA, 25 bp, Artificial sequence
  Synthetic oligonucleotide
gctcatctatgtctcgcgaacggga

SEQ ID NO: 680317 - DNA, 25 bp, Artificial sequence
  Synthetic oligonucleotide
cgtgtcgatcggggctttaacttgc

SEQ ID NO: 680318 - DNA, 25 bp, Artificial sequence
  Synthetic oligonucleotide
ctggcgcgtacgccgactataatct

SEQ ID NO: 680319 - DNA, 25 bp, Artificial sequence
  Synthetic oligonucleotide
tgtggatcgataggcggactcccat

SEQ ID NO: 680320 - DNA, 25 bp, Artificial sequence
  Synthetic oligonucleotide
tgtggatcgatacgcggactcccat

SEQ ID NO: 680321 - DNA, 25 bp, Artificial sequence
  Synthetic oligonucleotide
gggtcacgctaggccgattaagtca

SEQ ID NO: 680322 - DNA, 25 bp, Artificial sequence
  Synthetic oligonucleotide
gggtcacgctagcccgattaagtca

SEQ ID NO: 680323 - DNA, 25 bp, Artificial sequence
  Synthetic oligonucleotide
ctggtgacgcggactaatgacgtgt

SEQ ID NO: 680324 - DNA, 25 bp, Artificial sequence
  Synthetic oligonucleotide
ctggtgacgcggtctaatgacgtgt

SEQ ID NO: 680325 - DNA, 25 bp, Artificial sequence
  Synthetic oligonucleotide
caactaatgtcttggcgcgacccca

SEQ ID NO: 680326 - DNA, 25 bp, Artificial sequence
  Synthetic oligonucleotide
caactaatgtctaggcgcgacccca

SEQ ID NO: 680327 - DNA, 25 bp, Artificial sequence
  Synthetic oligonucleotide
gcacccttctatcgcgagcctgtta

SEQ ID NO: 680328 - DNA, 25 bp, Artificial sequence
  Synthetic oligonucleotide
gttaggagcgccaatcgagtcgtct

SEQ ID NO: 680329 - DNA, 25 bp, Artificial sequence
  Synthetic oligonucleotide
agaggtcggtacgatgcgtagtgtg

SEQ ID NO: 680330 - DNA, 25 bp, Artificial sequence
  Synthetic oligonucleotide
ccacgatactaaggacgcgacccta

SEQ ID NO: 680331 - DNA, 25 bp, Artificial sequence
  Synthetic oligonucleotide
ctgctcccgtactatcgtgtgaacg

SEQ ID NO: 680332 - DNA, 25 bp, Artificial sequence
  Synthetic oligonucleotide
ctaatctcgtaaggtgctcacggcc

SEQ ID NO: 680333 - DNA, 25 bp, Artificial sequence
  Synthetic oligonucleotide
ctgcactcggcgggacataaccatt

SEQ ID NO: 680334 - DNA, 25 bp, Artificial sequence
  Synthetic oligonucleotide
ctgcactcggcgcgacataaccatt

SEQ ID NO: 680335 - DNA, 25 bp, Artificial sequence
  Synthetic oligonucleotide
cttttagcgacgcgttgatggtccc

SEQ ID NO: 680336 - DNA, 25 bp, Artificial sequence
  Synthetic oligonucleotide
cttttagcgacgggttgatggtccc

SEQ ID NO: 680337 - DNA, 25 bp, Artificial sequence
  Synthetic oligonucleotide
tccggaacacgcggtatcgaactca

SEQ ID NO: 680338 - DNA, 25 bp, Artificial sequence
  Synthetic oligonucleotide
tccggaacacgccgtatcgaactca

SEQ ID NO: 680339 - DNA, 25 bp, Artificial sequence
  Synthetic oligonucleotide
ttgagttacgctcgagcgatggacg

SEQ ID NO: 680340 - DNA, 25 bp, Artificial sequence
  Synthetic oligonucleotide
ttgagttacgctggagcgatggacg

SEQ ID NO: 680341 - DNA, 25 bp, Artificial sequence
  Synthetic oligonucleotide
aggcaccgcgacccgtatgattact

SEQ ID NO: 680342 - DNA, 25 bp, Artificial sequence
  Synthetic oligonucleotide
gctgtacgattcccgcataacgggt

SEQ ID NO: 680343 - DNA, 25 bp, Artificial sequence
  Synthetic oligonucleotide
aggcaccgcgacgcgtatgattact

SEQ ID NO: 680344 - DNA, 25 bp, Artificial sequence
  Synthetic oligonucleotide
ccacgatactaacgacgcgacccta

SEQ ID NO: 680345 - DNA, 25 bp, Artificial sequence
  Synthetic oligonucleotide
ccccttgttcgtacgcgattgaggt

SEQ ID NO: 680346 - DNA, 25 bp, Artificial sequence
  Synthetic oligonucleotide
ccccttgttcgttcgcgattgaggt

SEQ ID NO: 680347 - DNA, 25 bp, Artificial sequence
  Synthetic oligonucleotide
gtcgtgatagcgtcgcgcacatatg

SEQ ID NO: 680348 - DNA, 25 bp, Artificial sequence
  Synthetic oligonucleotide
gtcgtgatagcgacgcgcacatatg

SEQ ID NO: 680349 - DNA, 25 bp, Artificial sequence
  Synthetic oligonucleotide
aggccaaccgcgcgttagatgaaag

SEQ ID NO: 680350 - DNA, 25 bp, Artificial sequence
  Synthetic oligonucleotide
aggccaaccgcgggttagatgaaag

SEQ ID NO: 680351 - DNA, 25 bp, Artificial sequence
  Synthetic oligonucleotide
agggcaatatcgggacgggaaagga

SEQ ID NO: 680352 - DNA, 25 bp, Artificial sequence
  Synthetic oligonucleotide
agggcaatatcgcgacgggaaagga

SEQ ID NO: 680353 - DNA, 25 bp, Artificial sequence
  Synthetic oligonucleotide
tcccaagttaccgcccgtagctctt

SEQ ID NO: 680354 - DNA, 25 bp, Artificial sequence
  Synthetic oligonucleotide
gctgtacgattcgcgcataacgggt

SEQ ID NO: 680355 - DNA, 25 bp, Artificial sequence
  Synthetic oligonucleotide
atatgtcacgatatacgcgcgcggc

SEQ ID NO: 680356 - DNA, 25 bp, Artificial sequence
  Synthetic oligonucleotide
cctatgcctagttcgtcgaccccaa

SEQ ID NO: 680357 - DNA, 25 bp, Artificial sequence
  Synthetic oligonucleotide
gtcaggcgcacgttcgaaacgcaat

SEQ ID NO: 680358 - DNA, 25 bp, Artificial sequence
  Synthetic oligonucleotide
ccgcatctcgcgcgaatagcactat

SEQ ID NO: 680359 - DNA, 25 bp, Artificial sequence
  Synthetic oligonucleotide
gtttcgggcatatcacgcgctactg

SEQ ID NO: 680360 - DNA, 25 bp, Artificial sequence
  Synthetic oligonucleotide
gtttcgggcataacacgcgctactg

SEQ ID NO: 680361 - DNA, 25 bp, Artificial sequence
  Synthetic oligonucleotide
taggcccgtcacccgtagaaacaac

SEQ ID NO: 680362 - DNA, 25 bp, Artificial sequence
  Synthetic oligonucleotide
taggcccgtcacgcgtagaaacaac

SEQ ID NO: 680363 - DNA, 25 bp, Artificial sequence
  Synthetic oligonucleotide
acagagatgcggcttcggtagccaa

SEQ ID NO: 680364 - DNA, 25 bp, Artificial sequence
  Synthetic oligonucleotide
acagagatgcgggttcggtagccaa

SEQ ID NO: 680365 - DNA, 25 bp, Artificial sequence
  Synthetic oligonucleotide
ggaaggtcgtatagacgctgcagtc

SEQ ID NO: 680366 - DNA, 25 bp, Artificial sequence
  Synthetic oligonucleotide
ctaatctcgtaacgtgctcacggcc

SEQ ID NO: 680367 - DNA, 25 bp, Artificial sequence
  Synthetic oligonucleotide
atatgtcacgatttacgcgcgcggc

SEQ ID NO: 680368 - DNA, 25 bp, Artificial sequence
  Synthetic oligonucleotide
tctccgttgtctggcgacatgacct

SEQ ID NO: 680369 - DNA, 25 bp, Artificial sequence
  Synthetic oligonucleotide
ccctatggtacctaacgcgttggct

SEQ ID NO: 680370 - DNA, 25 bp, Artificial sequence
  Synthetic oligonucleotide
ccctatggtaccaaacgcgttggct

SEQ ID NO: 680371 - DNA, 25 bp, Artificial sequence
  Synthetic oligonucleotide
cagacgttagacgcgacgtcgtcaa

SEQ ID NO: 680372 - DNA, 25 bp, Artificial sequence
  Synthetic oligonucleotide
cagacgttagacccgacgtcgtcaa

SEQ ID NO: 680373 - DNA, 25 bp, Artificial sequence
  Synthetic oligonucleotide
ctgtggacccgcgattcgtgatttc

SEQ ID NO: 680374 - DNA, 25 bp, Artificial sequence
  Synthetic oligonucleotide
ctgtggacccgccattcgtgatttc

SEQ ID NO: 680375 - DNA, 25 bp, Artificial sequence
  Synthetic oligonucleotide
agaagcacacgtaacgcggtgcttg

SEQ ID NO: 680376 - DNA, 25 bp, Artificial sequence
  Synthetic oligonucleotide
agaagcacacgttacgcggtgcttg

SEQ ID NO: 680377 - DNA, 25 bp, Artificial sequence
  Synthetic oligonucleotide
ccaatcacggataaccgggtgtctc

SEQ ID NO: 680378 - DNA, 25 bp, Artificial sequence
  Synthetic oligonucleotide
ccaatcacggattaccgggtgtctc

SEQ ID NO: 680379 - DNA, 25 bp, Artificial sequence
  Synthetic oligonucleotide
ggaaggtcgtattgacgctgcagtc

SEQ ID NO: 680380 - DNA, 25 bp, Artificial sequence
  Synthetic oligonucleotide
aatcgccccgtccgattcgttgtac

SEQ ID NO: 680381 - DNA, 25 bp, Artificial sequence
  Synthetic oligonucleotide
ctgctcccgtacaatcgtgtgaacg

SEQ ID NO: 680382 - DNA, 25 bp, Artificial sequence
  Synthetic oligonucleotide
tctgatgtaacgtagcgcggcctca

SEQ ID NO: 680383 - DNA, 25 bp, Artificial sequence
  Synthetic oligonucleotide
tctgatgtaacgaagcgcggcctca

SEQ ID NO: 680384 - DNA, 25 bp, Artificial sequence
  Synthetic oligonucleotide
gtatggcgctattcgaacctgtgcg

SEQ ID NO: 680385 - DNA, 25 bp, Artificial sequence
  Synthetic oligonucleotide
gtatggcgctatacgaacctgtgcg

SEQ ID NO: 680386 - DNA, 25 bp, Artificial sequence
  Synthetic oligonucleotide
cggtgtatatcgcgtccggcatagt

SEQ ID NO: 680387 - DNA, 25 bp, Artificial sequence
  Synthetic oligonucleotide
cggtgtatatcgggtccggcatagt

SEQ ID NO: 680388 - DNA, 25 bp, Artificial sequence
  Synthetic oligonucleotide
ctaccggactagttccgcggaatag

SEQ ID NO: 680389 - DNA, 25 bp, Artificial sequence
  Synthetic oligonucleotide
ctaccggactagatccgcggaatag

SEQ ID NO: 680390 - DNA, 25 bp, Artificial sequence
  Synthetic oligonucleotide
agcagccgtcggttctcgtgataga

SEQ ID NO: 680391 - DNA, 25 bp, Artificial sequence
  Synthetic oligonucleotide
cattactgttatcggaccgcgaggg

SEQ ID NO: 680392 - DNA, 25 bp, Artificial sequence
  Synthetic oligonucleotide
aatcgccccgtcggattcgttgtac

SEQ ID NO: 680393 - DNA, 25 bp, Artificial sequence
  Synthetic oligonucleotide
cttagcgcgtaagggtcgtacaagc

SEQ ID NO: 680394 - DNA, 25 bp, Artificial sequence
  Synthetic oligonucleotide
aggccaaggtcgtcgtacgcttatg

SEQ ID NO: 680395 - DNA, 25 bp, Artificial sequence
  Synthetic oligonucleotide
aggccaaggtcgacgtacgcttatg

SEQ ID NO: 680396 - DNA, 25 bp, Artificial sequence
  Synthetic oligonucleotide
ttagagacgggacgtatcggtaccc

SEQ ID NO: 680397 - DNA, 25 bp, Artificial sequence
  Synthetic oligonucleotide
ttagagacgggaggtatcggtaccc

SEQ ID NO: 680398 - DNA, 25 bp, Artificial sequence
  Synthetic oligonucleotide
cattggacgcgatccgtagttacgg

SEQ ID NO: 680399 - DNA, 25 bp, Artificial sequence
  Synthetic oligonucleotide
cattggacgcgaaccgtagttacgg

SEQ ID NO: 680400 - DNA, 25 bp, Artificial sequence
  Synthetic oligonucleotide
cccatacgtaggttggccgtgacat

SEQ ID NO: 680401 - DNA, 25 bp, Artificial sequence
  Synthetic oligonucleotide
cccatacgtaggatggccgtgacat

SEQ ID NO: 680402 - DNA, 25 bp, Artificial sequence
  Synthetic oligonucleotide
cgaatggcgaattcggacgttgcct

SEQ ID NO: 680403 - DNA, 25 bp, Artificial sequence
  Synthetic oligonucleotide
cgaatggcgaatacggacgttgcct

SEQ ID NO: 680404 - DNA, 25 bp, Artificial sequence
  Synthetic oligonucleotide
agcagccgtcggatctcgtgataga

SEQ ID NO: 680405 - DNA, 25 bp, Artificial sequence
  Synthetic oligonucleotide
tcgtattcgtcaatccgcgtgccga

SEQ ID NO: 680406 - DNA, 25 bp, Artificial sequence
  Synthetic oligonucleotide
ccgcatctcgcgggaatagcactat

SEQ ID NO: 680407 - DNA, 25 bp, Artificial sequence
  Synthetic oligonucleotide
tcccaagttaccccccgtagctctt

SEQ ID NO: 680408 - DNA, 25 bp, Artificial sequence
  Synthetic oligonucleotide
atcaagcgcgatacggcaaggcgat

SEQ ID NO: 680409 - DNA, 25 bp, Artificial sequence
  Synthetic oligonucleotide
atcaagcgcgattcggcaaggcgat

SEQ ID NO: 680410 - DNA, 25 bp, Artificial sequence
  Synthetic oligonucleotide
acatcatcttacgagcggcagaggc

SEQ ID NO: 680411 - DNA, 25 bp, Artificial sequence
  Synthetic oligonucleotide
acatcatcttaccagcggcagaggc

SEQ ID NO: 680412 - DNA, 25 bp, Artificial sequence
  Synthetic oligonucleotide
gcccatgtactgctacgcgtatcag

SEQ ID NO: 680413 - DNA, 25 bp, Artificial sequence
  Synthetic oligonucleotide
gcccatgtactggtacgcgtatcag

SEQ ID NO: 680414 - DNA, 25 bp, Artificial sequence
  Synthetic oligonucleotide
cgaacgatagcgctaaccgagccat

SEQ ID NO: 680415 - DNA, 25 bp, Artificial sequence
  Synthetic oligonucleotide
cgaacgatagcggtaaccgagccat

SEQ ID NO: 680416 - DNA, 25 bp, Artificial sequence
  Synthetic oligonucleotide
cattactgttatgggaccgcgaggg

SEQ ID NO: 680417 - DNA, 25 bp, Artificial sequence
  Synthetic oligonucleotide
ctccaaagactatcgcgctccaacg

SEQ ID NO: 680418 - DNA, 25 bp, Artificial sequence
  Synthetic oligonucleotide
cgaggccgacgtccgatcttttcaa

SEQ ID NO: 680419 - DNA, 25 bp, Artificial sequence
  Synthetic oligonucleotide
tcgtattcgtcattccgcgtgccga

SEQ ID NO: 680420 - DNA, 25 bp, Artificial sequence
  Synthetic oligonucleotide
tgcctaccgtgcgttcgaagacgta

SEQ ID NO: 680421 - DNA, 25 bp, Artificial sequence
  Synthetic oligonucleotide
tgcctaccgtgccttcgaagacgta

SEQ ID NO: 680422 - DNA, 25 bp, Artificial sequence
  Synthetic oligonucleotide
aagggaataacgtcggacgcccatg

SEQ ID NO: 680423 - DNA, 25 bp, Artificial sequence
  Synthetic oligonucleotide
aagggaataacgacggacgcccatg

SEQ ID NO: 680424 - DNA, 25 bp, Artificial sequence
  Synthetic oligonucleotide
tgggaacgaagtaacgcggtcacga

SEQ ID NO: 680425 - DNA, 25 bp, Artificial sequence
  Synthetic oligonucleotide
tgggaacgaagttacgcggtcacga

SEQ ID NO: 680426 - DNA, 25 bp, Artificial sequence
  Synthetic oligonucleotide
agccctgacccgttacgaggtagta

SEQ ID NO: 680427 - DNA, 25 bp, Artificial sequence
  Synthetic oligonucleotide
agccctgacccgatacgaggtagta

SEQ ID NO: 680428 - DNA, 25 bp, Artificial sequence
  Synthetic oligonucleotide
cttagcgcgtaacggtcgtacaagc

SEQ ID NO: 680429 - DNA, 25 bp, Artificial sequence
  Synthetic oligonucleotide
ctccaaagactaacgcgctccaacg

SEQ ID NO: 680430 - DNA, 25 bp, Artificial sequence
  Synthetic oligonucleotide
ccggccattggtacgcgaaagagtt

SEQ ID NO: 680431 - DNA, 25 bp, Artificial sequence
  Synthetic oligonucleotide
cgaaggtaactcgcgaagtacgcca

SEQ ID NO: 680432 - DNA, 25 bp, Artificial sequence
  Synthetic oligonucleotide
cgaattcggatacggtctagcgcct

SEQ ID NO: 680433 - DNA, 25 bp, Artificial sequence
  Synthetic oligonucleotide
cgaattcggatagggtctagcgcct

SEQ ID NO: 680434 - DNA, 25 bp, Artificial sequence
  Synthetic oligonucleotide
ctgtgtccgcattagtccgatgcct

SEQ ID NO: 680435 - DNA, 25 bp, Artificial sequence
  Synthetic oligonucleotide
ctgtgtccgcataagtccgatgcct

SEQ ID NO: 680436 - DNA, 25 bp, Artificial sequence
  Synthetic oligonucleotide
agttgatatcgcaagtgcggggctg

SEQ ID NO: 680437 - DNA, 25 bp, Artificial sequence
  Synthetic oligonucleotide
agttgatatcgctagtgcggggctg

SEQ ID NO: 680438 - DNA, 25 bp, Artificial sequence
  Synthetic oligonucleotide
ggctaaggaccgttatgcgtggcaa

SEQ ID NO: 680439 - DNA, 25 bp, Artificial sequence
  Synthetic oligonucleotide
ggctaaggaccgatatgcgtggcaa

SEQ ID NO: 680440 - DNA, 25 bp, Artificial sequence
  Synthetic oligonucleotide
gttagacgcgcgtattaggctccct

SEQ ID NO: 680441 - DNA, 25 bp, Artificial sequence
  Synthetic oligonucleotide
ggatagactctatcgcggcactagc

SEQ ID NO: 680442 - DNA, 25 bp, Artificial sequence
  Synthetic oligonucleotide
ccggccattggttcgcgaaagagtt

SEQ ID NO: 680443 - DNA, 25 bp, Artificial sequence
  Synthetic oligonucleotide
acaaaagtacgcgctcgtcagagcg

SEQ ID NO: 680444 - DNA, 25 bp, Artificial sequence
  Synthetic oligonucleotide
gagtggtagtcggcgtacgattgca

SEQ ID NO: 680445 - DNA, 25 bp, Artificial sequence
  Synthetic oligonucleotide
gagtggtagtcgccgtacgattgca

SEQ ID NO: 680446 - DNA, 25 bp, Artificial sequence
  Synthetic oligonucleotide
cgcacacttcgagccgtattcgtag

SEQ ID NO: 680447 - DNA, 25 bp, Artificial sequence
  Synthetic oligonucleotide
cgcacacttcgacccgtattcgtag

SEQ ID NO: 680448 - DNA, 25 bp, Artificial sequence
  Synthetic oligonucleotide
cgttttgcggataggtcggcggtaa

SEQ ID NO: 680449 - DNA, 25 bp, Artificial sequence
  Synthetic oligonucleotide
cgttttgcggattggtcggcggtaa

SEQ ID NO: 680450 - DNA, 25 bp, Artificial sequence
  Synthetic oligonucleotide
tgccactatcgcacgccgacgattt

SEQ ID NO: 680451 - DNA, 25 bp, Artificial sequence
  Synthetic oligonucleotide
tgccactatcgctcgccgacgattt

SEQ ID NO: 680452 - DNA, 25 bp, Artificial sequence
  Synthetic oligonucleotide
agcgtgtattatggcgcccccaagt

SEQ ID NO: 680453 - DNA, 25 bp, Artificial sequence
  Synthetic oligonucleotide
agcgtgtattatcgcgcccccaagt

SEQ ID NO: 680454 - DNA, 25 bp, Artificial sequence
  Synthetic oligonucleotide
gttagacgcgcgaattaggctccct

SEQ ID NO: 680455 - DNA, 25 bp, Artificial sequence
  Synthetic oligonucleotide
acaccgccggtcctcacaaaatgag

SEQ ID NO: 680456 - DNA, 25 bp, Artificial sequence
  Synthetic oligonucleotide
ttgtaatacggacccgctaggtcgg

SEQ ID NO: 680457 - DNA, 25 bp, Artificial sequence
  Synthetic oligonucleotide
ttgtaatacggagccgctaggtcgg

SEQ ID NO: 680458 - DNA, 25 bp, Artificial sequence
  Synthetic oligonucleotide
atcagatacgtccgttaccgcccac

SEQ ID NO: 680459 - DNA, 25 bp, Artificial sequence
  Synthetic oligonucleotide
atcagatacgtcggttaccgcccac

SEQ ID NO: 680460 - DNA, 25 bp, Artificial sequence
  Synthetic oligonucleotide
ggacaccgtgcgatagacgatgttg

SEQ ID NO: 680461 - DNA, 25 bp, Artificial sequence
  Synthetic oligonucleotide
ggacaccgtgcgttagacgatgttg

SEQ ID NO: 680462 - DNA, 25 bp, Artificial sequence
  Synthetic oligonucleotide
aacacccgccgttcgaactctagtc

SEQ ID NO: 680463 - DNA, 25 bp, Artificial sequence
  Synthetic oligonucleotide
aacacccgccgtacgaactctagtc

SEQ ID NO: 680464 - DNA, 25 bp, Artificial sequence
  Synthetic oligonucleotide
tacatgccggtcgtttaggtgctgg

SEQ ID NO: 680465 - DNA, 25 bp, Artificial sequence
  Synthetic oligonucleotide
tacatgccggtcctttaggtgctgg

SEQ ID NO: 680466 - DNA, 25 bp, Artificial sequence
  Synthetic oligonucleotide
ggatagactctaacgcggcactagc

SEQ ID NO: 680467 - DNA, 25 bp, Artificial sequence
  Synthetic oligonucleotide
ttggggcgtaacggacgctcattgt

SEQ ID NO: 680468 - DNA, 25 bp, Artificial sequence
  Synthetic oligonucleotide
aacagtcgtcgttacacgcctaccc

SEQ ID NO: 680469 - DNA, 25 bp, Artificial sequence
  Synthetic oligonucleotide
acaccgccggtcgtcacaaaatgag

SEQ ID NO: 680470 - DNA, 25 bp, Artificial sequence
  Synthetic oligonucleotide
tgctgaagtacggttcgtctcagcg

SEQ ID NO: 680471 - DNA, 25 bp, Artificial sequence
  Synthetic oligonucleotide
tgctgaagtacgcttcgtctcagcg

SEQ ID NO: 680472 - DNA, 25 bp, Artificial sequence
  Synthetic oligonucleotide
atgctgcgattactacccgcggagt

SEQ ID NO: 680473 - DNA, 25 bp, Artificial sequence
  Synthetic oligonucleotide
atgctgcgattagtacccgcggagt

SEQ ID NO: 680474 - DNA, 25 bp, Artificial sequence
  Synthetic oligonucleotide
ttgggcatatgcggttccgacggaa

SEQ ID NO: 680475 - DNA, 25 bp, Artificial sequence
  Synthetic oligonucleotide
ttgggcatatgccgttccgacggaa

SEQ ID NO: 680476 - DNA, 25 bp, Artificial sequence
  Synthetic oligonucleotide
cggtagtcgcgtggtaacgagacaa

SEQ ID NO: 680477 - DNA, 25 bp, Artificial sequence
  Synthetic oligonucleotide
cggtagtcgcgtcgtaacgagacaa

SEQ ID NO: 680478 - DNA, 25 bp, Artificial sequence
  Synthetic oligonucleotide
acaaaagtacgccctcgtcagagcg

SEQ ID NO: 680479 - DNA, 25 bp, Artificial sequence
  Synthetic oligonucleotide
ttggggcgtaaccgacgctcattgt

SEQ ID NO: 680480 - DNA, 25 bp, Artificial sequence
  Synthetic oligonucleotide
agtttccgcacgaacggtctctacg

SEQ ID NO: 680481 - DNA, 25 bp, Artificial sequence
  Synthetic oligonucleotide
atatctcgtacgagcgttctgcccg

SEQ ID NO: 680482 - DNA, 25 bp, Artificial sequence
  Synthetic oligonucleotide
atatctcgtacgtgcgttctgcccg

SEQ ID NO: 680483 - DNA, 25 bp, Artificial sequence
  Synthetic oligonucleotide
ctcatgcggcgttctcttaccgatc

SEQ ID NO: 680484 - DNA, 25 bp, Artificial sequence
  Synthetic oligonucleotide
ctcatgcggcgtactcttaccgatc

SEQ ID NO: 680485 - DNA, 25 bp, Artificial sequence
  Synthetic oligonucleotide
cataccacgtgacgcggtattgacc

SEQ ID NO: 680486 - DNA, 25 bp, Artificial sequence
  Synthetic oligonucleotide
cataccacgtgaggcggtattgacc

SEQ ID NO: 680487 - DNA, 25 bp, Artificial sequence
  Synthetic oligonucleotide
gagacgcgcgagcatagacagattc

SEQ ID NO: 680488 - DNA, 25 bp, Artificial sequence
  Synthetic oligonucleotide
gagacgcgcgaggatagacagattc

SEQ ID NO: 680489 - DNA, 25 bp, Artificial sequence
  Synthetic oligonucleotide
gagtgaattacggcggaccagctga

SEQ ID NO: 680490 - DNA, 25 bp, Artificial sequence
  Synthetic oligonucleotide
gagtgaattacgccggaccagctga

SEQ ID NO: 680491 - DNA, 25 bp, Artificial sequence
  Synthetic oligonucleotide
tttgccccgcgtcgtctataacctg

SEQ ID NO: 680492 - DNA, 25 bp, Artificial sequence
  Synthetic oligonucleotide
gtaggacatgttacgagcgacgtgc

SEQ ID NO: 680493 - DNA, 25 bp, Artificial sequence
  Synthetic oligonucleotide
ccctacgtctcgaacgcgaatttgc

SEQ ID NO: 680494 - DNA, 25 bp, Artificial sequence
  Synthetic oligonucleotide
agtttccgcacgtacggtctctacg

SEQ ID NO: 680495 - DNA, 25 bp, Artificial sequence
  Synthetic oligonucleotide
gcatcaactcggaacgtcgcagaag

SEQ ID NO: 680496 - DNA, 25 bp, Artificial sequence
  Synthetic oligonucleotide
gcatcaactcggtacgtcgcagaag

SEQ ID NO: 680497 - DNA, 25 bp, Artificial sequence
  Synthetic oligonucleotide
tgtgttgcgcgatacgacttccgct

SEQ ID NO: 680498 - DNA, 25 bp, Artificial sequence
  Synthetic oligonucleotide
tgtgttgcgcgaaacgacttccgct

SEQ ID NO: 680499 - DNA, 25 bp, Artificial sequence
  Synthetic oligonucleotide
ctcaccatagtcgtaccggcttgtg

SEQ ID NO: 680500 - DNA, 25 bp, Artificial sequence
  Synthetic oligonucleotide
cctatgcctagtacgtcgaccccaa

SEQ ID NO: 680501 - DNA, 25 bp, Artificial sequence
  Synthetic oligonucleotide
acgcagatcggcgtatcgctatgga

SEQ ID NO: 680502 - DNA, 25 bp, Artificial sequence
  Synthetic oligonucleotide
tcttcagatacgggcccgtctatgg

SEQ ID NO: 680503 - DNA, 25 bp, Artificial sequence
  Synthetic oligonucleotide
acgcagatcggcctatcgctatgga

SEQ ID NO: 680504 - DNA, 25 bp, Artificial sequence
  Synthetic oligonucleotide
gtaggacatgtttcgagcgacgtgc

SEQ ID NO: 680505 - DNA, 25 bp, Artificial sequence
  Synthetic oligonucleotide
tcaaccaacggcacgtacgtagtcc

SEQ ID NO: 680506 - DNA, 25 bp, Artificial sequence
  Synthetic oligonucleotide
ctcaccatagtcctaccggcttgtg

SEQ ID NO: 680507 - DNA, 25 bp, Artificial sequence
  Synthetic oligonucleotide
aacagtcgtcgtaacacgcctaccc

SEQ ID NO: 680508 - DNA, 25 bp, Artificial sequence
  Synthetic oligonucleotide
gaagatcgagtatcgcgctcaggtg

SEQ ID NO: 680509 - DNA, 25 bp, Artificial sequence
  Synthetic oligonucleotide
gaagatcgagtaacgcgctcaggtg

SEQ ID NO: 680510 - DNA, 25 bp, Artificial sequence
  Synthetic oligonucleotide
acaggcgttaccgcgcgtaatgttc

SEQ ID NO: 680511 - DNA, 25 bp, Artificial sequence
  Synthetic oligonucleotide
acaggcgttaccccgcgtaatgttc

SEQ ID NO: 680512 - DNA, 25 bp, Artificial sequence
  Synthetic oligonucleotide
ctcgtccctaccgatagcgtatcac

SEQ ID NO: 680513 - DNA, 25 bp, Artificial sequence
  Synthetic oligonucleotide
ctcgtccctacccatagcgtatcac

SEQ ID NO: 680514 - DNA, 25 bp, Artificial sequence
  Synthetic oligonucleotide
agcctgaccgttttgccgccaattg

SEQ ID NO: 680515 - DNA, 25 bp, Artificial sequence
  Synthetic oligonucleotide
agcctgaccgttatgccgccaattg

SEQ ID NO: 680516 - DNA, 25 bp, Artificial sequence
  Synthetic oligonucleotide
aagcggccggtacgctaatacccat

SEQ ID NO: 680517 - DNA, 25 bp, Artificial sequence
  Synthetic oligonucleotide
ctgatcacgatagcccccgtgttag

SEQ ID NO: 680518 - DNA, 25 bp, Artificial sequence
  Synthetic oligonucleotide
aagcggccggtaggctaatacccat

SEQ ID NO: 680519 - DNA, 25 bp, Artificial sequence
  Synthetic oligonucleotide
tcaaccaacggctcgtacgtagtcc

SEQ ID NO: 680520 - DNA, 25 bp, Artificial sequence
  Synthetic oligonucleotide
gcgggtcgtactataccgggcaatt

SEQ ID NO: 680521 - DNA, 25 bp, Artificial sequence
  Synthetic oligonucleotide
gcgggtcgtactttaccgggcaatt

SEQ ID NO: 680522 - DNA, 25 bp, Artificial sequence
  Synthetic oligonucleotide
agacattcggtcttcgcgttagccc

SEQ ID NO: 680523 - DNA, 25 bp, Artificial sequence
  Synthetic oligonucleotide
agacattcggtcatcgcgttagccc

SEQ ID NO: 680524 - DNA, 25 bp, Artificial sequence
  Synthetic oligonucleotide
atagtctgcgtacgagacgccgtac

SEQ ID NO: 680525 - DNA, 25 bp, Artificial sequence
  Synthetic oligonucleotide
atagtctgcgtaggagacgccgtac

SEQ ID NO: 680526 - DNA, 25 bp, Artificial sequence
  Synthetic oligonucleotide
ccttgtcgacgcattactacccctc

SEQ ID NO: 680527 - DNA, 25 bp, Artificial sequence
  Synthetic oligonucleotide
ccttgtcgacgctttactacccctc

SEQ ID NO: 680528 - DNA, 25 bp, Artificial sequence
  Synthetic oligonucleotide
ccctacgtctcgtacgcgaatttgc

SEQ ID NO: 680529 - DNA, 25 bp, Artificial sequence
  Synthetic oligonucleotide
tttgccccgcgtggtctataacctg

SEQ ID NO: 680530 - DNA, 25 bp, Artificial sequence
  Synthetic oligonucleotide
ctgatcacgataccccccgtgttag

SEQ ID NO: 680531 - DNA, 25 bp, Artificial sequence
  Synthetic oligonucleotide
ataatccgggtcacgcgtagggtag

SEQ ID NO: 680532 - DNA, 25 bp, Artificial sequence
  Synthetic oligonucleotide
acaccgcgcgaaatagcgtccatct

SEQ ID NO: 680533 - DNA, 25 bp, Artificial sequence
  Synthetic oligonucleotide
acaccgcgcgaattagcgtccatct

SEQ ID NO: 680534 - DNA, 25 bp, Artificial sequence
  Synthetic oligonucleotide
acagccttagcgttacgggcaagtg

SEQ ID NO: 680535 - DNA, 25 bp, Artificial sequence
  Synthetic oligonucleotide
acagccttagcgatacgggcaagtg

SEQ ID NO: 680536 - DNA, 25 bp, Artificial sequence
  Synthetic oligonucleotide
gcaggctcggcgtaacactgattca

SEQ ID NO: 680537 - DNA, 25 bp, Artificial sequence
  Synthetic oligonucleotide
gcaggctcggcgaaacactgattca

SEQ ID NO: 680538 - DNA, 25 bp, Artificial sequence
  Synthetic oligonucleotide
acaagctacgcgcacggttacgagt

SEQ ID NO: 680539 - DNA, 25 bp, Artificial sequence
  Synthetic oligonucleotide
acaagctacgcggacggttacgagt

SEQ ID NO: 680540 - DNA, 25 bp, Artificial sequence
  Synthetic oligonucleotide
actcaagcgctatatgacggccctg

SEQ ID NO: 680541 - DNA, 25 bp, Artificial sequence
  Synthetic oligonucleotide
actcaagcgctaaatgacggccctg

SEQ ID NO: 680542 - DNA, 25 bp, Artificial sequence
  Synthetic oligonucleotide
acagatttacgaacgtcccctgggg

SEQ ID NO: 680543 - DNA, 25 bp, Artificial sequence
  Synthetic oligonucleotide
gaggggtacgtatgtcgcgaatgtg

SEQ ID NO: 680544 - DNA, 25 bp, Artificial sequence
  Synthetic oligonucleotide
tgcttatgcgcgataccgttgtcgc

SEQ ID NO: 680545 - DNA, 25 bp, Artificial sequence
  Synthetic oligonucleotide
ataatccgggtctcgcgtagggtag

SEQ ID NO: 680546 - DNA, 25 bp, Artificial sequence
  Synthetic oligonucleotide
gaacctccgaaccacctagcgatct

SEQ ID NO: 680547 - DNA, 25 bp, Artificial sequence
  Synthetic oligonucleotide
gaacctccgaacgacctagcgatct

SEQ ID NO: 680548 - DNA, 25 bp, Artificial sequence
  Synthetic oligonucleotide
ccctaataggtaggcgggaagctca

SEQ ID NO: 680549 - DNA, 25 bp, Artificial sequence
  Synthetic oligonucleotide
ccctaataggtacgcgggaagctca

SEQ ID NO: 680550 - DNA, 25 bp, Artificial sequence
  Synthetic oligonucleotide
atgccaagctatggccggtagtctc

SEQ ID NO: 680551 - DNA, 25 bp, Artificial sequence
  Synthetic oligonucleotide
atgccaagctatcgccggtagtctc

SEQ ID NO: 680552 - DNA, 25 bp, Artificial sequence
  Synthetic oligonucleotide
gtgtgatagcgccagctatctggtg

SEQ ID NO: 680553 - DNA, 25 bp, Artificial sequence
  Synthetic oligonucleotide
gtgtgatagcgcgagctatctggtg

SEQ ID NO: 680554 - DNA, 25 bp, Artificial sequence
  Synthetic oligonucleotide
acagatttacgatcgtcccctgggg

SEQ ID NO: 680555 - DNA, 25 bp, Artificial sequence
  Synthetic oligonucleotide
gaggggtacgtaagtcgcgaatgtg

SEQ ID NO: 680556 - DNA, 25 bp, Artificial sequence
  Synthetic oligonucleotide
tcaggggcgcgtcacgtatagtatc

SEQ ID NO: 680557 - DNA, 25 bp, Artificial sequence
  Synthetic oligonucleotide
cgtcacaaacgcccgataggagaga

SEQ ID NO: 680558 - DNA, 25 bp, Artificial sequence
  Synthetic oligonucleotide
cgaaggtaactcccgaagtacgcca

SEQ ID NO: 680559 - DNA, 25 bp, Artificial sequence
  Synthetic oligonucleotide
cgtcacaaacgcgcgataggagaga

SEQ ID NO: 680560 - DNA, 25 bp, Artificial sequence
  Synthetic oligonucleotide
caaacagtcatctcgcgaacgccac

SEQ ID NO: 680561 - DNA, 25 bp, Artificial sequence
  Synthetic oligonucleotide
gagtacattacccccgcgtacgcta

SEQ ID NO: 680562 - DNA, 25 bp, Artificial sequence
  Synthetic oligonucleotide
gagtacattaccgccgcgtacgcta

SEQ ID NO: 680563 - DNA, 25 bp, Artificial sequence
  Synthetic oligonucleotide
cgttcgtgcgtttagaccgtgctga

SEQ ID NO: 680564 - DNA, 25 bp, Artificial sequence
  Synthetic oligonucleotide
cgttcgtgcgttaagaccgtgctga

SEQ ID NO: 680565 - DNA, 25 bp, Artificial sequence
  Synthetic oligonucleotide
gtgcgtatagcgccattcgtgtgga

SEQ ID NO: 680566 - DNA, 25 bp, Artificial sequence
  Synthetic oligonucleotide
gtgcgtatagcggcattcgtgtgga

SEQ ID NO: 680567 - DNA, 25 bp, Artificial sequence
  Synthetic oligonucleotide
gcgaatcgcgtaggtaacgatcacc

SEQ ID NO: 680568 - DNA, 25 bp, Artificial sequence
  Synthetic oligonucleotide
tgtactgggttaaccgcgtgatccc

SEQ ID NO: 680569 - DNA, 25 bp, Artificial sequence
  Synthetic oligonucleotide
gcgaatcgcgtacgtaacgatcacc

SEQ ID NO: 680570 - DNA, 25 bp, Artificial sequence
  Synthetic oligonucleotide
tcaggggcgcgtgacgtatagtatc

SEQ ID NO: 680571 - DNA, 25 bp, Artificial sequence
  Synthetic oligonucleotide
cgtatggttgcgtctacgtcgggaa

SEQ ID NO: 680572 - DNA, 25 bp, Artificial sequence
  Synthetic oligonucleotide
cgtatggttgcgactacgtcgggaa

SEQ ID NO: 680573 - DNA, 25 bp, Artificial sequence
  Synthetic oligonucleotide
gtaagggaattaggcgtcgtcggag

SEQ ID NO: 680574 - DNA, 25 bp, Artificial sequence
  Synthetic oligonucleotide
gtaagggaattacgcgtcgtcggag

SEQ ID NO: 680575 - DNA, 25 bp, Artificial sequence
  Synthetic oligonucleotide
tctagctccgacgtacctaagtcgc

SEQ ID NO: 680576 - DNA, 25 bp, Artificial sequence
  Synthetic oligonucleotide
tctagctccgacctacctaagtcgc

SEQ ID NO: 680577 - DNA, 25 bp, Artificial sequence
  Synthetic oligonucleotide
cgtagtgtccgcgcaaaacacccaa

SEQ ID NO: 680578 - DNA, 25 bp, Artificial sequence
  Synthetic oligonucleotide
cgtagtgtccgcccaaaacacccaa

SEQ ID NO: 680579 - DNA, 25 bp, Artificial sequence
  Synthetic oligonucleotide
tgcttatgcgcgttaccgttgtcgc

SEQ ID NO: 680580 - DNA, 25 bp, Artificial sequence
  Synthetic oligonucleotide
caaacagtcatcacgcgaacgccac

SEQ ID NO: 680581 - DNA, 25 bp, Artificial sequence
  Synthetic oligonucleotide
tgtactgggttatccgcgtgatccc

SEQ ID NO: 680582 - DNA, 25 bp, Artificial sequence
  Synthetic oligonucleotide
agcggtaattggcctcgcgtcaaag

SEQ ID NO: 680583 - DNA, 25 bp, Artificial sequence
  Synthetic oligonucleotide
tgtgctaaaccgaccgcgcatagtc

SEQ ID NO: 680584 - DNA, 25 bp, Artificial sequence
  Synthetic oligonucleotide
tctaacggtccggcgtaatctaccg

SEQ ID NO: 680585 - DNA, 25 bp, Artificial sequence
  Synthetic oligonucleotide
tctaacggtccgccgtaatctaccg

SEQ ID NO: 680586 - DNA, 25 bp, Artificial sequence
  Synthetic oligonucleotide
ggcagcgattccccgatcactttct

SEQ ID NO: 680587 - DNA, 25 bp, Artificial sequence
  Synthetic oligonucleotide
ggcagcgattccgcgatcactttct

SEQ ID NO: 680588 - DNA, 25 bp, Artificial sequence
  Synthetic oligonucleotide
ccctaggttagctcgcgtacaacgt

SEQ ID NO: 680589 - DNA, 25 bp, Artificial sequence
  Synthetic oligonucleotide
ccctaggttagcacgcgtacaacgt

SEQ ID NO: 680590 - DNA, 25 bp, Artificial sequence
  Synthetic oligonucleotide
catagtcgcgcgaccaaaaaggcga

SEQ ID NO: 680591 - DNA, 25 bp, Artificial sequence
  Synthetic oligonucleotide
catagtcgcgcgtccaaaaaggcga

SEQ ID NO: 680592 - DNA, 25 bp, Artificial sequence
  Synthetic oligonucleotide
tgtgctaaaccgtccgcgcatagtc

SEQ ID NO: 680593 - DNA, 25 bp, Artificial sequence
  Synthetic oligonucleotide
gcacggacccgcgagtaatagcttt

SEQ ID NO: 680594 - DNA, 25 bp, Artificial sequence
  Synthetic oligonucleotide
tacaggctacgcgcgaaactcaagc

SEQ ID NO: 680595 - DNA, 25 bp, Artificial sequence
  Synthetic oligonucleotide
tggtatcggcgtgaatcgtgtggtg

SEQ ID NO: 680596 - DNA, 25 bp, Artificial sequence
  Synthetic oligonucleotide
tggtatcggcgtcaatcgtgtggtg

SEQ ID NO: 680597 - DNA, 25 bp, Artificial sequence
  Synthetic oligonucleotide
tcgaggggtaacgtaccgctcttac

SEQ ID NO: 680598 - DNA, 25 bp, Artificial sequence
  Synthetic oligonucleotide
tcgaggggtaacctaccgctcttac

SEQ ID NO: 680599 - DNA, 25 bp, Artificial sequence
  Synthetic oligonucleotide
gatatgcatgtcgggttcgaggtgc

SEQ ID NO: 680600 - DNA, 25 bp, Artificial sequence
  Synthetic oligonucleotide
gatatgcatgtccggttcgaggtgc

SEQ ID NO: 680601 - DNA, 25 bp, Artificial sequence
  Synthetic oligonucleotide
tcctcctcgtaagccgcaaagtgga

SEQ ID NO: 680602 - DNA, 25 bp, Artificial sequence
  Synthetic oligonucleotide
tcctcctcgtaacccgcaaagtgga

SEQ ID NO: 680603 - DNA, 25 bp, Artificial sequence
  Synthetic oligonucleotide
tcttcagatacgcgcccgtctatgg

SEQ ID NO: 680604 - DNA, 25 bp, Artificial sequence
  Synthetic oligonucleotide
gtcaggcgcacgatcgaaacgcaat

SEQ ID NO: 680605 - DNA, 25 bp, Artificial sequence
  Synthetic oligonucleotide
tacaggctacgcccgaaactcaagc

SEQ ID NO: 680606 - DNA, 25 bp, Artificial sequence
  Synthetic oligonucleotide
ggggtcatcgtggggtaagatgatg

SEQ ID NO: 680607 - DNA, 25 bp, Artificial sequence
  Synthetic oligonucleotide
gcacggacccgccagtaatagcttt

SEQ ID NO: 680608 - DNA, 25 bp, Artificial sequence
  Synthetic oligonucleotide
tccagttcgtagggtcgcgttgaca

SEQ ID NO: 680609 - DNA, 25 bp, Artificial sequence
  Synthetic oligonucleotide
gaattacgcaaccctagtggctcgc

SEQ ID NO: 680610 - DNA, 25 bp, Artificial sequence
  Synthetic oligonucleotide
gaattacgcaacgctagtggctcgc

SEQ ID NO: 680611 - DNA, 25 bp, Artificial sequence
  Synthetic oligonucleotide
ccattagttcgatagcgcagcaggc

SEQ ID NO: 680612 - DNA, 25 bp, Artificial sequence
  Synthetic oligonucleotide
ccattagttcgaaagcgcagcaggc

SEQ ID NO: 680613 - DNA, 25 bp, Artificial sequence
  Synthetic oligonucleotide
gcatttatagtgcgtcggtcgcctg

SEQ ID NO: 680614 - DNA, 25 bp, Artificial sequence
  Synthetic oligonucleotide
agcggtaattgggctcgcgtcaaag

SEQ ID NO: 680615 - DNA, 25 bp, Artificial sequence
  Synthetic oligonucleotide
ggggtcatcgtgcggtaagatgatg

SEQ ID NO: 680616 - DNA, 25 bp, Artificial sequence
  Synthetic oligonucleotide
acgccttttggagtacgcgcacctt

SEQ ID NO: 680617 - DNA, 25 bp, Artificial sequence
  Synthetic oligonucleotide
acgccttttggactacgcgcacctt

SEQ ID NO: 680618 - DNA, 25 bp, Artificial sequence
  Synthetic oligonucleotide
aacgtgtccgcggtcggtatctcta

SEQ ID NO: 680619 - DNA, 25 bp, Artificial sequence
  Synthetic oligonucleotide
tccagttcgtagcgtcgcgttgaca

SEQ ID NO: 680620 - DNA, 25 bp, Artificial sequence
  Synthetic oligonucleotide
gcatttatagtgggtcggtcgcctg

SEQ ID NO: 680621 - DNA, 25 bp, Artificial sequence
  Synthetic oligonucleotide
aacgtgtccgcgctcggtatctcta

SEQ ID NO: 680622 - DNA, 25 bp, Artificial sequence
  Synthetic oligonucleotide
cccccgtagcgtcgtacgaacatta

SEQ ID NO: 680623 - DNA, 25 bp, Artificial sequence
  Synthetic oligonucleotide
gcttacgttcgcgataacgcgttgc

SEQ ID NO: 680624 - DNA, 25 bp, Artificial sequence
  Synthetic oligonucleotide
gcttacgttcgccataacgcgttgc

SEQ ID NO: 680625 - DNA, 25 bp, Artificial sequence
  Synthetic oligonucleotide
ggttttcagatacgcgtcggtaggg

SEQ ID NO: 680626 - DNA, 25 bp, Artificial sequence
  Synthetic oligonucleotide
gtcacttaccgtcgaacgatggctg

SEQ ID NO: 680627 - DNA, 25 bp, Artificial sequence
  Synthetic oligonucleotide
gtcacttaccgtggaacgatggctg

SEQ ID NO: 680628 - DNA, 25 bp, Artificial sequence
  Synthetic oligonucleotide
cccccgtagcgtggtacgaacatta

SEQ ID NO: 680629 - DNA, 25 bp, Artificial sequence
  Synthetic oligonucleotide
ggttttcagataggcgtcggtaggg

SEQ ID NO: 680630 - DNA, 25 bp, Artificial sequence
  Synthetic oligonucleotide
tgcgcgcgacgatacgtcactctga

SEQ ID NO: 680631 - DNA, 25 bp, Artificial sequence
  Synthetic oligonucleotide
atcgggtaatgtaccgcgaccgtgc

SEQ ID NO: 680632 - DNA, 25 bp, Artificial sequence
  Synthetic oligonucleotide
atcgggtaatgttccgcgaccgtgc

SEQ ID NO: 680633 - DNA, 25 bp, Artificial sequence
  Synthetic oligonucleotide
agcacggacgcgctcgtatgtacgt

SEQ ID NO: 680634 - DNA, 25 bp, Artificial sequence
  Synthetic oligonucleotide
agcacggacgcggtcgtatgtacgt

SEQ ID NO: 680635 - DNA, 25 bp, Artificial sequence
  Synthetic oligonucleotide
ggcgtgtacgtaccgctcctaaggt

SEQ ID NO: 680636 - DNA, 25 bp, Artificial sequence
  Synthetic oligonucleotide
cctcttaaactcaagcgcgaggggg

SEQ ID NO: 680637 - DNA, 25 bp, Artificial sequence
  Synthetic oligonucleotide
tgcgcgcgacgaaacgtcactctga

SEQ ID NO: 680638 - DNA, 25 bp, Artificial sequence
  Synthetic oligonucleotide
cctcttaaactctagcgcgaggggg

SEQ ID NO: 680639 - DNA, 25 bp, Artificial sequence
  Synthetic oligonucleotide
gttcgcacgcgatatctcgaggacg

SEQ ID NO: 680640 - DNA, 25 bp, Artificial sequence
  Synthetic oligonucleotide
ggcgtgtacgtagcgctcctaaggt

SEQ ID NO: 680641 - DNA, 25 bp, Artificial sequence
  Synthetic oligonucleotide
gttcgcacgcgaaatctcgaggacg

SEQ ID NO: 680642 - DNA, 25 bp, Artificial sequence
  Synthetic oligonucleotide
tgctcttggatcgcggttaagcgcc

SEQ ID NO: 680643 - DNA, 25 bp, Artificial sequence
  Synthetic oligonucleotide
tgctcttggatcccggttaagcgcc

SEQ ID NO: 680644 - DNA, 25 bp, Artificial sequence
  Synthetic oligonucleotide
ggagagacgcgcgctaagttgctct

SEQ ID NO: 680645 - DNA, 25 bp, Artificial sequence
  Synthetic oligonucleotide
ggagagacgcgccctaagttgctct

SEQ ID NO: 680646 - DNA, 25 bp, Artificial sequence
  Synthetic oligonucleotide
gcggaggcgaaccgtataccatgca

SEQ ID NO: 680647 - DNA, 25 bp, Artificial sequence
  Synthetic oligonucleotide
gcggaggcgaacggtataccatgca

SEQ ID NO: 680648 - DNA, 25 bp, Artificial sequence
  Synthetic oligonucleotide
acaagccggtacacgtcgtgcatcg

SEQ ID NO: 680649 - DNA, 25 bp, Artificial sequence
  Synthetic oligonucleotide
acaagccggtactcgtcgtgcatcg

SEQ ID NO: 680650 - DNA, 25 bp, Artificial sequence
  Synthetic oligonucleotide
gaatgccatgtcccgcctacgccat

SEQ ID NO: 680651 - DNA, 25 bp, Artificial sequence
  Synthetic oligonucleotide
tacctctaggttggcgagcttcggg

SEQ ID NO: 680652 - DNA, 25 bp, Artificial sequence
  Synthetic oligonucleotide
atgccccgccgaacgtactctagtc

SEQ ID NO: 680653 - DNA, 25 bp, Artificial sequence
  Synthetic oligonucleotide
gaatgccatgtcgcgcctacgccat

SEQ ID NO: 680654 - DNA, 25 bp, Artificial sequence
  Synthetic oligonucleotide
gccatccgcacggtatacggggttt

SEQ ID NO: 680655 - DNA, 25 bp, Artificial sequence
  Synthetic oligonucleotide
tcgcgcatagcgggtcctacagatc

SEQ ID NO: 680656 - DNA, 25 bp, Artificial sequence
  Synthetic oligonucleotide
atgccccgccgatcgtactctagtc

SEQ ID NO: 680657 - DNA, 25 bp, Artificial sequence
  Synthetic oligonucleotide
caaccagcccgtagtacgctatccg

SEQ ID NO: 680658 - DNA, 25 bp, Artificial sequence
  Synthetic oligonucleotide
aggagctcgcgttcctatcggttcg

SEQ ID NO: 680659 - DNA, 25 bp, Artificial sequence
  Synthetic oligonucleotide
aggagctcgcgtacctatcggttcg

SEQ ID NO: 680660 - DNA, 25 bp, Artificial sequence
  Synthetic oligonucleotide
gtgccccgcgataggtagccgtaat

SEQ ID NO: 680661 - DNA, 25 bp, Artificial sequence
  Synthetic oligonucleotide
gtgccccgcgattggtagccgtaat

SEQ ID NO: 680662 - DNA, 25 bp, Artificial sequence
  Synthetic oligonucleotide
ctctcctacgtccgctagcggatgt

SEQ ID NO: 680663 - DNA, 25 bp, Artificial sequence
  Synthetic oligonucleotide
ctctcctacgtcggctagcggatgt

SEQ ID NO: 680664 - DNA, 25 bp, Artificial sequence
  Synthetic oligonucleotide
atcctcacggtacgcgttaggcctc

SEQ ID NO: 680665 - DNA, 25 bp, Artificial sequence
  Synthetic oligonucleotide
caaccagcccgttgtacgctatccg

SEQ ID NO: 680666 - DNA, 25 bp, Artificial sequence
  Synthetic oligonucleotide
gccatccgcacgctatacggggttt

SEQ ID NO: 680667 - DNA, 25 bp, Artificial sequence
  Synthetic oligonucleotide
actcactagcgaggttcggagctgc

SEQ ID NO: 680668 - DNA, 25 bp, Artificial sequence
  Synthetic oligonucleotide
ttctagcgttaatcgggccgccacg

SEQ ID NO: 680669 - DNA, 25 bp, Artificial sequence
  Synthetic oligonucleotide
ttctagcgttaaacgggccgccacg

SEQ ID NO: 680670 - DNA, 25 bp, Artificial sequence
  Synthetic oligonucleotide
tgctcataacggatcgccgcgcttg

SEQ ID NO: 680671 - DNA, 25 bp, Artificial sequence
  Synthetic oligonucleotide
tgctcataacggttcgccgcgcttg

SEQ ID NO: 680672 - DNA, 25 bp, Artificial sequence
  Synthetic oligonucleotide
atgctctggcgagctcgtaagcgct

SEQ ID NO: 680673 - DNA, 25 bp, Artificial sequence
  Synthetic oligonucleotide
tcctaccatgcctcgcgtacggaga

SEQ ID NO: 680674 - DNA, 25 bp, Artificial sequence
  Synthetic oligonucleotide
tcctaccatgccacgcgtacggaga

SEQ ID NO: 680675 - DNA, 25 bp, Artificial sequence
  Synthetic oligonucleotide
gcttcgtcgtacaccgacgctgaac

SEQ ID NO: 680676 - DNA, 25 bp, Artificial sequence
  Synthetic oligonucleotide
gcttcgtcgtactccgacgctgaac

SEQ ID NO: 680677 - DNA, 25 bp, Artificial sequence
  Synthetic oligonucleotide
actcactagcgacgttcggagctgc

SEQ ID NO: 680678 - DNA, 25 bp, Artificial sequence
  Synthetic oligonucleotide
atcctcacggtaggcgttaggcctc

SEQ ID NO: 680679 - DNA, 25 bp, Artificial sequence
  Synthetic oligonucleotide
ttcccgcctattcgcgactccctag

SEQ ID NO: 680680 - DNA, 25 bp, Artificial sequence
  Synthetic oligonucleotide
cggcgtcgtatagtgccgcatgttc

SEQ ID NO: 680681 - DNA, 25 bp, Artificial sequence
  Synthetic oligonucleotide
ccgtccacgcgttagtcgaactgtc

SEQ ID NO: 680682 - DNA, 25 bp, Artificial sequence
  Synthetic oligonucleotide
gagctgtgagcgcgcgtacttttgg

SEQ ID NO: 680683 - DNA, 25 bp, Artificial sequence
  Synthetic oligonucleotide
gagctgtgagcgggcgtacttttgg

SEQ ID NO: 680684 - DNA, 25 bp, Artificial sequence
  Synthetic oligonucleotide
tcccgacgaggcgacgatagtgaca

SEQ ID NO: 680685 - DNA, 25 bp, Artificial sequence
  Synthetic oligonucleotide
tcccgacgaggccacgatagtgaca

SEQ ID NO: 680686 - DNA, 25 bp, Artificial sequence
  Synthetic oligonucleotide
aggaacatacgaggcgcacggtagc

SEQ ID NO: 680687 - DNA, 25 bp, Artificial sequence
  Synthetic oligonucleotide
aggaacatacgacgcgcacggtagc

SEQ ID NO: 680688 - DNA, 25 bp, Artificial sequence
  Synthetic oligonucleotide
agagttgccgtaccgtgatcggagc

SEQ ID NO: 680689 - DNA, 25 bp, Artificial sequence
  Synthetic oligonucleotide
agagttgccgtagcgtgatcggagc

SEQ ID NO: 680690 - DNA, 25 bp, Artificial sequence
  Synthetic oligonucleotide
ccgtaccgcgcgtagtatatcgagc

SEQ ID NO: 680691 - DNA, 25 bp, Artificial sequence
  Synthetic oligonucleotide
ctttggacgcgcccgataggcaatg

SEQ ID NO: 680692 - DNA, 25 bp, Artificial sequence
  Synthetic oligonucleotide
ccgtaccgcgcgaagtatatcgagc

SEQ ID NO: 680693 - DNA, 25 bp, Artificial sequence
  Synthetic oligonucleotide
ttcccgcctattggcgactccctag

SEQ ID NO: 680694 - DNA, 25 bp, Artificial sequence
  Synthetic oligonucleotide
gaccgataacgtcgcgttcccacgt

SEQ ID NO: 680695 - DNA, 25 bp, Artificial sequence
  Synthetic oligonucleotide
gaccgataacgtggcgttcccacgt

SEQ ID NO: 680696 - DNA, 25 bp, Artificial sequence
  Synthetic oligonucleotide
ccgttaaatcgtccgaccgggctct

SEQ ID NO: 680697 - DNA, 25 bp, Artificial sequence
  Synthetic oligonucleotide
ccgttaaatcgtgcgaccgggctct

SEQ ID NO: 680698 - DNA, 25 bp, Artificial sequence
  Synthetic oligonucleotide
taaccgcgcgcatttacctccaccg

SEQ ID NO: 680699 - DNA, 25 bp, Artificial sequence
  Synthetic oligonucleotide
taaccgcgcgcaattacctccaccg

SEQ ID NO: 680700 - DNA, 25 bp, Artificial sequence
  Synthetic oligonucleotide
tgggggataggcccgatcgaagaag

SEQ ID NO: 680701 - DNA, 25 bp, Artificial sequence
  Synthetic oligonucleotide
agcagtcgaacgcctaccggtttgg

SEQ ID NO: 680702 - DNA, 25 bp, Artificial sequence
  Synthetic oligonucleotide
gaaggagtcgcgggcgtattcgtca

SEQ ID NO: 680703 - DNA, 25 bp, Artificial sequence
  Synthetic oligonucleotide
ctttggacgcgcgcgataggcaatg

SEQ ID NO: 680704 - DNA, 25 bp, Artificial sequence
  Synthetic oligonucleotide
agccaccggtgtaacgtcgacacga

SEQ ID NO: 680705 - DNA, 25 bp, Artificial sequence
  Synthetic oligonucleotide
tcgcgacgctgcgcgattaaggcta

SEQ ID NO: 680706 - DNA, 25 bp, Artificial sequence
  Synthetic oligonucleotide
tcgcgacgctgcccgattaaggcta

SEQ ID NO: 680707 - DNA, 25 bp, Artificial sequence
  Synthetic oligonucleotide
gcgactaacgcgcctaggcttagag

SEQ ID NO: 680708 - DNA, 25 bp, Artificial sequence
  Synthetic oligonucleotide
gcgactaacgcggctaggcttagag

SEQ ID NO: 680709 - DNA, 25 bp, Artificial sequence
  Synthetic oligonucleotide
gttcaccgcgagacttagctcgacc

SEQ ID NO: 680710 - DNA, 25 bp, Artificial sequence
  Synthetic oligonucleotide
gttcaccgcgagtcttagctcgacc

SEQ ID NO: 680711 - DNA, 25 bp, Artificial sequence
  Synthetic oligonucleotide
gcgtcctggggttcgtcgacattca

SEQ ID NO: 680712 - DNA, 25 bp, Artificial sequence
  Synthetic oligonucleotide
gcgtcctggggtacgtcgacattca

SEQ ID NO: 680713 - DNA, 25 bp, Artificial sequence
  Synthetic oligonucleotide
gtgctccgcacccattagtaagcgc

SEQ ID NO: 680714 - DNA, 25 bp, Artificial sequence
  Synthetic oligonucleotide
gtgctccgcaccgattagtaagcgc

SEQ ID NO: 680715 - DNA, 25 bp, Artificial sequence
  Synthetic oligonucleotide
ccgtccacgcgtaagtcgaactgtc

SEQ ID NO: 680716 - DNA, 25 bp, Artificial sequence
  Synthetic oligonucleotide
ccatggcgatacgcgaccgatccaa

SEQ ID NO: 680717 - DNA, 25 bp, Artificial sequence
  Synthetic oligonucleotide
tacctctaggttcgcgagcttcggg

SEQ ID NO: 680718 - DNA, 25 bp, Artificial sequence
  Synthetic oligonucleotide
agccaccggtgttacgtcgacacga

SEQ ID NO: 680719 - DNA, 25 bp, Artificial sequence
  Synthetic oligonucleotide
tgcacccgaccatcccgatctccat

SEQ ID NO: 680720 - DNA, 25 bp, Artificial sequence
  Synthetic oligonucleotide
tgcacccgaccaacccgatctccat

SEQ ID NO: 680721 - DNA, 25 bp, Artificial sequence
  Synthetic oligonucleotide
cccacgatagctcgcgtaccgtagt

SEQ ID NO: 680722 - DNA, 25 bp, Artificial sequence
  Synthetic oligonucleotide
cccacgatagctggcgtaccgtagt

SEQ ID NO: 680723 - DNA, 25 bp, Artificial sequence
  Synthetic oligonucleotide
cttcgctccgaacgcggtactagtg

SEQ ID NO: 680724 - DNA, 25 bp, Artificial sequence
  Synthetic oligonucleotide
cttcgctccgaaggcggtactagtg

SEQ ID NO: 680725 - DNA, 25 bp, Artificial sequence
  Synthetic oligonucleotide
cggcgtcgtatactgccgcatgttc

SEQ ID NO: 680726 - DNA, 25 bp, Artificial sequence
  Synthetic oligonucleotide
agcagtcgaacggctaccggtttgg

SEQ ID NO: 680727 - DNA, 25 bp, Artificial sequence
  Synthetic oligonucleotide
tcgcgcatagcgcgtcctacagatc

SEQ ID NO: 680728 - DNA, 25 bp, Artificial sequence
  Synthetic oligonucleotide
ccatggcgatacccgaccgatccaa

SEQ ID NO: 680729 - DNA, 25 bp, Artificial sequence
  Synthetic oligonucleotide
cccaccgatcgacgttcgctaaagc

SEQ ID NO: 680730 - DNA, 25 bp, Artificial sequence
  Synthetic oligonucleotide
cggctagatagccgctcgtcacaga

SEQ ID NO: 680731 - DNA, 25 bp, Artificial sequence
  Synthetic oligonucleotide
ctgccgcgtatcgtacgggctcatt

SEQ ID NO: 680732 - DNA, 25 bp, Artificial sequence
  Synthetic oligonucleotide
ctgccgcgtatcctacgggctcatt

SEQ ID NO: 680733 - DNA, 25 bp, Artificial sequence
  Synthetic oligonucleotide
cccttacggacctcgatactggctc

SEQ ID NO: 680734 - DNA, 25 bp, Artificial sequence
  Synthetic oligonucleotide
cccttacggaccacgatactggctc

SEQ ID NO: 680735 - DNA, 25 bp, Artificial sequence
  Synthetic oligonucleotide
cgccgcgtatcgtacggagatctga

SEQ ID NO: 680736 - DNA, 25 bp, Artificial sequence
  Synthetic oligonucleotide
cgccgcgtatcgaacggagatctga

SEQ ID NO: 680737 - DNA, 25 bp, Artificial sequence
  Synthetic oligonucleotide
gcgttaccatacccgccgaagctga

SEQ ID NO: 680738 - DNA, 25 bp, Artificial sequence
  Synthetic oligonucleotide
gcgttaccatacgcgccgaagctga

SEQ ID NO: 680739 - DNA, 25 bp, Artificial sequence
  Synthetic oligonucleotide
ctgatgccgaccccgtaaaaaggcc

SEQ ID NO: 680740 - DNA, 25 bp, Artificial sequence
  Synthetic oligonucleotide
ctcacgcgtacgcgcgattatgggt

SEQ ID NO: 680741 - DNA, 25 bp, Artificial sequence
  Synthetic oligonucleotide
cccaccgatcgaggttcgctaaagc

SEQ ID NO: 680742 - DNA, 25 bp, Artificial sequence
  Synthetic oligonucleotide
acgctgtaccgtacgcgcacaaagg

SEQ ID NO: 680743 - DNA, 25 bp, Artificial sequence
  Synthetic oligonucleotide
caacaaacggtaatacggcgcgcgg

SEQ ID NO: 680744 - DNA, 25 bp, Artificial sequence
  Synthetic oligonucleotide
caacaaacggtattacggcgcgcgg

SEQ ID NO: 680745 - DNA, 25 bp, Artificial sequence
  Synthetic oligonucleotide
gagatgccgtacccgatacatggcc

SEQ ID NO: 680746 - DNA, 25 bp, Artificial sequence
  Synthetic oligonucleotide
gagatgccgtacgcgatacatggcc

SEQ ID NO: 680747 - DNA, 25 bp, Artificial sequence
  Synthetic oligonucleotide
gcaatgctagtcgcgcgtaggggta

SEQ ID NO: 680748 - DNA, 25 bp, Artificial sequence
  Synthetic oligonucleotide
gcaatgctagtcccgcgtaggggta

SEQ ID NO: 680749 - DNA, 25 bp, Artificial sequence
  Synthetic oligonucleotide
tgcggggcgcgaggtgtatatgtct

SEQ ID NO: 680750 - DNA, 25 bp, Artificial sequence
  Synthetic oligonucleotide
tgcggggcgcgacgtgtatatgtct

SEQ ID NO: 680751 - DNA, 25 bp, Artificial sequence
  Synthetic oligonucleotide
cccctgagtaacgccggacttctca

SEQ ID NO: 680752 - DNA, 25 bp, Artificial sequence
  Synthetic oligonucleotide
ctgataacgcgtaagcgggaccctc

SEQ ID NO: 680753 - DNA, 25 bp, Artificial sequence
  Synthetic oligonucleotide
ctgatgccgaccgcgtaaaaaggcc

SEQ ID NO: 680754 - DNA, 25 bp, Artificial sequence
  Synthetic oligonucleotide
ccacgtgtacgaacgcgcgctaaca

SEQ ID NO: 680755 - DNA, 25 bp, Artificial sequence
  Synthetic oligonucleotide
acgcttcgactttcgcgagacctgg

SEQ ID NO: 680756 - DNA, 25 bp, Artificial sequence
  Synthetic oligonucleotide
atgctctggcgacctcgtaagcgct

SEQ ID NO: 680757 - DNA, 25 bp, Artificial sequence
  Synthetic oligonucleotide
cgcctttagactctccgcggtaacc

SEQ ID NO: 680758 - DNA, 25 bp, Artificial sequence
  Synthetic oligonucleotide
cgcctttagactgtccgcggtaacc

SEQ ID NO: 680759 - DNA, 25 bp, Artificial sequence
  Synthetic oligonucleotide
cgacagtataccgcgggcgcttttc

SEQ ID NO: 680760 - DNA, 25 bp, Artificial sequence
  Synthetic oligonucleotide
cgacagtataccccgggcgcttttc

SEQ ID NO: 680761 - DNA, 25 bp, Artificial sequence
  Synthetic oligonucleotide
gtaatcatagcgcttcgcgctggcc

SEQ ID NO: 680762 - DNA, 25 bp, Artificial sequence
  Synthetic oligonucleotide
gtaatcatagcggttcgcgctggcc

SEQ ID NO: 680763 - DNA, 25 bp, Artificial sequence
  Synthetic oligonucleotide
gggtgcgcgtcttgacgactatcag

SEQ ID NO: 680764 - DNA, 25 bp, Artificial sequence
  Synthetic oligonucleotide
gggtgcgcgtctagacgactatcag

SEQ ID NO: 680765 - DNA, 25 bp, Artificial sequence
  Synthetic oligonucleotide
ctcacgcgtacgggcgattatgggt

SEQ ID NO: 680766 - DNA, 25 bp, Artificial sequence
  Synthetic oligonucleotide
cgggcaacttattcccgcgtgtcac

SEQ ID NO: 680767 - DNA, 25 bp, Artificial sequence
  Synthetic oligonucleotide
cggctagatagcggctcgtcacaga

SEQ ID NO: 680768 - DNA, 25 bp, Artificial sequence
  Synthetic oligonucleotide
ccacgtgtacgatcgcgcgctaaca

SEQ ID NO: 680769 - DNA, 25 bp, Artificial sequence
  Synthetic oligonucleotide
cacacttacgcggggtatcacgcct

SEQ ID NO: 680770 - DNA, 25 bp, Artificial sequence
  Synthetic oligonucleotide
cacacttacgcgcggtatcacgcct

SEQ ID NO: 680771 - DNA, 25 bp, Artificial sequence
  Synthetic oligonucleotide
ctcctaccgtctttacgctggggtc

SEQ ID NO: 680772 - DNA, 25 bp, Artificial sequence
  Synthetic oligonucleotide
ctcctaccgtctatacgctggggtc

SEQ ID NO: 680773 - DNA, 25 bp, Artificial sequence
  Synthetic oligonucleotide
gtgggtggtataaagcgcgcctcca

SEQ ID NO: 680774 - DNA, 25 bp, Artificial sequence
  Synthetic oligonucleotide
gtgggtggtatatagcgcgcctcca

SEQ ID NO: 680775 - DNA, 25 bp, Artificial sequence
  Synthetic oligonucleotide
ccacgttaacgttgggcgagacagg

SEQ ID NO: 680776 - DNA, 25 bp, Artificial sequence
  Synthetic oligonucleotide
ccacgttaacgtagggcgagacagg

SEQ ID NO: 680777 - DNA, 25 bp, Artificial sequence
  Synthetic oligonucleotide
acgctgtaccgttcgcgcacaaagg

SEQ ID NO: 680778 - DNA, 25 bp, Artificial sequence
  Synthetic oligonucleotide
cgggcaacttatacccgcgtgtcac

SEQ ID NO: 680779 - DNA, 25 bp, Artificial sequence
  Synthetic oligonucleotide
cggcttccgacggtattcggtagca

SEQ ID NO: 680780 - DNA, 25 bp, Artificial sequence
  Synthetic oligonucleotide
cccctgagtaaccccggacttctca

SEQ ID NO: 680781 - DNA, 25 bp, Artificial sequence
  Synthetic oligonucleotide
gccatctaactcccgcgtagtgacc

SEQ ID NO: 680782 - DNA, 25 bp, Artificial sequence
  Synthetic oligonucleotide
cgacacgacgcgactaggttgacgt

SEQ ID NO: 680783 - DNA, 25 bp, Artificial sequence
  Synthetic oligonucleotide
cgacacgacgcgtctaggttgacgt

SEQ ID NO: 680784 - DNA, 25 bp, Artificial sequence
  Synthetic oligonucleotide
gagccggatcgccgaacgtatccta

SEQ ID NO: 680785 - DNA, 25 bp, Artificial sequence
  Synthetic oligonucleotide
tacccttaacggttcgccgcgatgc

SEQ ID NO: 680786 - DNA, 25 bp, Artificial sequence
  Synthetic oligonucleotide
acgcttcgacttacgcgagacctgg

SEQ ID NO: 680787 - DNA, 25 bp, Artificial sequence
  Synthetic oligonucleotide
cgactttcgcgcgtactgaagcgag

SEQ ID NO: 680788 - DNA, 25 bp, Artificial sequence
  Synthetic oligonucleotide
cgactttcgcgcctactgaagcgag

SEQ ID NO: 680789 - DNA, 25 bp, Artificial sequence
  Synthetic oligonucleotide
ttgttctacgacgtcggacacgggg

SEQ ID NO: 680790 - DNA, 25 bp, Artificial sequence
  Synthetic oligonucleotide
aagctacggggtgtatcgcggacga

SEQ ID NO: 680791 - DNA, 25 bp, Artificial sequence
  Synthetic oligonucleotide
cggcttccgacgctattcggtagca

SEQ ID NO: 680792 - DNA, 25 bp, Artificial sequence
  Synthetic oligonucleotide
aagctacggggtctatcgcggacga

SEQ ID NO: 680793 - DNA, 25 bp, Artificial sequence
  Synthetic oligonucleotide
tggatacgcgctacgatgtacgggc

SEQ ID NO: 680794 - DNA, 25 bp, Artificial sequence
  Synthetic oligonucleotide
tggatacgcgcttcgatgtacgggc

SEQ ID NO: 680795 - DNA, 25 bp, Artificial sequence
  Synthetic oligonucleotide
ttcccaacgatgggcgtcgacagct

SEQ ID NO: 680796 - DNA, 25 bp, Artificial sequence
  Synthetic oligonucleotide
ttcccaacgatgcgcgtcgacagct

SEQ ID NO: 680797 - DNA, 25 bp, Artificial sequence
  Synthetic oligonucleotide
ccggtcagctcgcgcgatataatgc

SEQ ID NO: 680798 - DNA, 25 bp, Artificial sequence
  Synthetic oligonucleotide
ccggtcagctcgggcgatataatgc

SEQ ID NO: 680799 - DNA, 25 bp, Artificial sequence
  Synthetic oligonucleotide
tcgatccgggccctacgtaacttgg

SEQ ID NO: 680800 - DNA, 25 bp, Artificial sequence
  Synthetic oligonucleotide
tcgatccgggccgtacgtaacttgg

SEQ ID NO: 680801 - DNA, 25 bp, Artificial sequence
  Synthetic oligonucleotide
ggagcctatccgggacatatgtcgc

SEQ ID NO: 680802 - DNA, 25 bp, Artificial sequence
  Synthetic oligonucleotide
ggagcctatccgcgacatatgtcgc

SEQ ID NO: 680803 - DNA, 25 bp, Artificial sequence
  Synthetic oligonucleotide
ttgttctacgacctcggacacgggg

SEQ ID NO: 680804 - DNA, 25 bp, Artificial sequence
  Synthetic oligonucleotide
agtagccgtcgaacgtaggagcggt

SEQ ID NO: 680805 - DNA, 25 bp, Artificial sequence
  Synthetic oligonucleotide
gaaggagtcgcgcgcgtattcgtca

SEQ ID NO: 680806 - DNA, 25 bp, Artificial sequence
  Synthetic oligonucleotide
tacccttaacggatcgccgcgatgc

SEQ ID NO: 680807 - DNA, 25 bp, Artificial sequence
  Synthetic oligonucleotide
ctgataacgcgttagcgggaccctc

SEQ ID NO: 680808 - DNA, 25 bp, Artificial sequence
  Synthetic oligonucleotide
atgggatcgcgctagagtggctagc

SEQ ID NO: 680809 - DNA, 25 bp, Artificial sequence
  Synthetic oligonucleotide
atgggatcgcgcaagagtggctagc

SEQ ID NO: 680810 - DNA, 25 bp, Artificial sequence
  Synthetic oligonucleotide
gcagcaggtacggcaatacgcctca

SEQ ID NO: 680811 - DNA, 25 bp, Artificial sequence
  Synthetic oligonucleotide
gcagcaggtacgccaatacgcctca

SEQ ID NO: 680812 - DNA, 25 bp, Artificial sequence
  Synthetic oligonucleotide
atcggtccgtcgctagtactggagg

SEQ ID NO: 680813 - DNA, 25 bp, Artificial sequence
  Synthetic oligonucleotide
atcggtccgtcggtagtactggagg

SEQ ID NO: 680814 - DNA, 25 bp, Artificial sequence
  Synthetic oligonucleotide
cctcaacgacgctagcgtacccaag

SEQ ID NO: 680815 - DNA, 25 bp, Artificial sequence
  Synthetic oligonucleotide
gccatctaactcgcgcgtagtgacc

SEQ ID NO: 680816 - DNA, 25 bp, Artificial sequence
  Synthetic oligonucleotide
agtagccgtcgatcgtaggagcggt

SEQ ID NO: 680817 - DNA, 25 bp, Artificial sequence
  Synthetic oligonucleotide
tgggggataggcgcgatcgaagaag

SEQ ID NO: 680818 - DNA, 25 bp, Artificial sequence
  Synthetic oligonucleotide
caggacgggctattacgcgccaaac

SEQ ID NO: 680819 - DNA, 25 bp, Artificial sequence
  Synthetic oligonucleotide
caggacgggctaatacgcgccaaac

SEQ ID NO: 680820 - DNA, 25 bp, Artificial sequence
  Synthetic oligonucleotide
cggaattcgtaccccgtaccgtgac

SEQ ID NO: 680821 - DNA, 25 bp, Artificial sequence
  Synthetic oligonucleotide
cggaattcgtacgccgtaccgtgac

SEQ ID NO: 680822 - DNA, 25 bp, Artificial sequence
  Synthetic oligonucleotide
acacacatatagcgggtcgagcgcc

SEQ ID NO: 680823 - DNA, 25 bp, Artificial sequence
  Synthetic oligonucleotide
acacacatatagggggtcgagcgcc

SEQ ID NO: 680824 - DNA, 25 bp, Artificial sequence
  Synthetic oligonucleotide
ccacagctagcgaaccggactcaca

SEQ ID NO: 680825 - DNA, 25 bp, Artificial sequence
  Synthetic oligonucleotide
ccacagctagcgtaccggactcaca

SEQ ID NO: 680826 - DNA, 25 bp, Artificial sequence
  Synthetic oligonucleotide
cgctagtacgcgtccgatcttcacg

SEQ ID NO: 680827 - DNA, 25 bp, Artificial sequence
  Synthetic oligonucleotide
cgctagtacgcgaccgatcttcacg

SEQ ID NO: 680828 - DNA, 25 bp, Artificial sequence
  Synthetic oligonucleotide
cctcaacgacgcaagcgtacccaag

SEQ ID NO: 680829 - DNA, 25 bp, Artificial sequence
  Synthetic oligonucleotide
cacaatcgcgctttcagtcggctgg

SEQ ID NO: 680830 - DNA, 25 bp, Artificial sequence
  Synthetic oligonucleotide
gcagcagcggttacgctagggctaa

SEQ ID NO: 680831 - DNA, 25 bp, Artificial sequence
  Synthetic oligonucleotide
gtgcctacccgttcggatatcgtcg

SEQ ID NO: 680832 - DNA, 25 bp, Artificial sequence
  Synthetic oligonucleotide
gtgcctacccgtacggatatcgtcg

SEQ ID NO: 680833 - DNA, 25 bp, Artificial sequence
  Synthetic oligonucleotide
agcaccattgactaccgcgcgccaa

SEQ ID NO: 680834 - DNA, 25 bp, Artificial sequence
  Synthetic oligonucleotide
agcaccattgacaaccgcgcgccaa

SEQ ID NO: 680835 - DNA, 25 bp, Artificial sequence
  Synthetic oligonucleotide
cggtgccgttagacggtaactgcac

SEQ ID NO: 680836 - DNA, 25 bp, Artificial sequence
  Synthetic oligonucleotide
cggtgccgttagtcggtaactgcac

SEQ ID NO: 680837 - DNA, 25 bp, Artificial sequence
  Synthetic oligonucleotide
gggtatcgtaaggcgtagtcgagcc

SEQ ID NO: 680838 - DNA, 25 bp, Artificial sequence
  Synthetic oligonucleotide
gggtatcgtaagccgtagtcgagcc

SEQ ID NO: 680839 - DNA, 25 bp, Artificial sequence
  Synthetic oligonucleotide
tctccgcgtccgacgagtaaaacgc

SEQ ID NO: 680840 - DNA, 25 bp, Artificial sequence
  Synthetic oligonucleotide
agctgccgtacgttcggaggacgta

SEQ ID NO: 680841 - DNA, 25 bp, Artificial sequence
  Synthetic oligonucleotide
cacaatcgcgctatcagtcggctgg

SEQ ID NO: 680842 - DNA, 25 bp, Artificial sequence
  Synthetic oligonucleotide
cttgccgacgcgatatacggagagc

SEQ ID NO: 680843 - DNA, 25 bp, Artificial sequence
  Synthetic oligonucleotide
tgcgcccgactaaccgcgatgttga

SEQ ID NO: 680844 - DNA, 25 bp, Artificial sequence
  Synthetic oligonucleotide
tgcgcccgactatccgcgatgttga

SEQ ID NO: 680845 - DNA, 25 bp, Artificial sequence
  Synthetic oligonucleotide
ggtctacgccgttacgctggactgt

SEQ ID NO: 680846 - DNA, 25 bp, Artificial sequence
  Synthetic oligonucleotide
ggtctacgccgtaacgctggactgt

SEQ ID NO: 680847 - DNA, 25 bp, Artificial sequence
  Synthetic oligonucleotide
aagggcggtgctacgtcgtcggata

SEQ ID NO: 680848 - DNA, 25 bp, Artificial sequence
  Synthetic oligonucleotide
aagggcggtgcttcgtcgtcggata

SEQ ID NO: 680849 - DNA, 25 bp, Artificial sequence
  Synthetic oligonucleotide
ctggtgtactaccggtcggatgtgc

SEQ ID NO: 680850 - DNA, 25 bp, Artificial sequence
  Synthetic oligonucleotide
ctggtgtactacgggtcggatgtgc

SEQ ID NO: 680851 - DNA, 25 bp, Artificial sequence
  Synthetic oligonucleotide
gcggagtaacgtgtcgcggaaatcg

SEQ ID NO: 680852 - DNA, 25 bp, Artificial sequence
  Synthetic oligonucleotide
cgcggtaagtcgccttacgcagatg

SEQ ID NO: 680853 - DNA, 25 bp, Artificial sequence
  Synthetic oligonucleotide
tctccgcgtccgtcgagtaaaacgc

SEQ ID NO: 680854 - DNA, 25 bp, Artificial sequence
  Synthetic oligonucleotide
ggttgggcggtaaatcgagagcacc

SEQ ID NO: 680855 - DNA, 25 bp, Artificial sequence
  Synthetic oligonucleotide
tgggagcgtgagggacgatgtacct

SEQ ID NO: 680856 - DNA, 25 bp, Artificial sequence
  Synthetic oligonucleotide
tgggagcgtgagcgacgatgtacct

SEQ ID NO: 680857 - DNA, 25 bp, Artificial sequence
  Synthetic oligonucleotide
ctgctcataccgagtcgcgtacgca

SEQ ID NO: 680858 - DNA, 25 bp, Artificial sequence
  Synthetic oligonucleotide
ctgctcataccgtgtcgcgtacgca

SEQ ID NO: 680859 - DNA, 25 bp, Artificial sequence
  Synthetic oligonucleotide
acccgaccgacgggtgatcgatatg

SEQ ID NO: 680860 - DNA, 25 bp, Artificial sequence
  Synthetic oligonucleotide
acccgaccgacgcgtgatcgatatg

SEQ ID NO: 680861 - DNA, 25 bp, Artificial sequence
  Synthetic oligonucleotide
acgagagtccggttatgcggctcgt

SEQ ID NO: 680862 - DNA, 25 bp, Artificial sequence
  Synthetic oligonucleotide
acgagagtccggatatgcggctcgt

SEQ ID NO: 680863 - DNA, 25 bp, Artificial sequence
  Synthetic oligonucleotide
atacgattgcgccttgtagggcggc

SEQ ID NO: 680864 - DNA, 25 bp, Artificial sequence
  Synthetic oligonucleotide
atacgattgcgcgttgtagggcggc

SEQ ID NO: 680865 - DNA, 25 bp, Artificial sequence
  Synthetic oligonucleotide
agctgccgtacgatcggaggacgta

SEQ ID NO: 680866 - DNA, 25 bp, Artificial sequence
  Synthetic oligonucleotide
aggatgtcgtgccttagcgagctgc

SEQ ID NO: 680867 - DNA, 25 bp, Artificial sequence
  Synthetic oligonucleotide
gcagcagcggtttcgctagggctaa

SEQ ID NO: 680868 - DNA, 25 bp, Artificial sequence
  Synthetic oligonucleotide
ggttgggcggtatatcgagagcacc

SEQ ID NO: 680869 - DNA, 25 bp, Artificial sequence
  Synthetic oligonucleotide
atcgcgctcgcaacgtgcgacaatg

SEQ ID NO: 680870 - DNA, 25 bp, Artificial sequence
  Synthetic oligonucleotide
atcgcgctcgcatcgtgcgacaatg

SEQ ID NO: 680871 - DNA, 25 bp, Artificial sequence
  Synthetic oligonucleotide
gttaccgtatacccccggatgagcc

SEQ ID NO: 680872 - DNA, 25 bp, Artificial sequence
  Synthetic oligonucleotide
gttaccgtatacgcccggatgagcc

SEQ ID NO: 680873 - DNA, 25 bp, Artificial sequence
  Synthetic oligonucleotide
agtcggcggcccgttacgtgataga

SEQ ID NO: 680874 - DNA, 25 bp, Artificial sequence
  Synthetic oligonucleotide
agtcggcggccccttacgtgataga

SEQ ID NO: 680875 - DNA, 25 bp, Artificial sequence
  Synthetic oligonucleotide
ttacggacgcgtcgtacctcacggt

SEQ ID NO: 680876 - DNA, 25 bp, Artificial sequence
  Synthetic oligonucleotide
ttacggacgcgtggtacctcacggt

SEQ ID NO: 680877 - DNA, 25 bp, Artificial sequence
  Synthetic oligonucleotide
cttgccgacgcgttatacggagagc

SEQ ID NO: 680878 - DNA, 25 bp, Artificial sequence
  Synthetic oligonucleotide
aggatgtcgtgcgttagcgagctgc

SEQ ID NO: 680879 - DNA, 25 bp, Artificial sequence
  Synthetic oligonucleotide
gtagtcgacgttacgtcgccagagc

SEQ ID NO: 680880 - DNA, 25 bp, Artificial sequence
  Synthetic oligonucleotide
gcggagtaacgtctcgcggaaatcg

SEQ ID NO: 680881 - DNA, 25 bp, Artificial sequence
  Synthetic oligonucleotide
cgccgtggcgcatcctagtaaaagc

SEQ ID NO: 680882 - DNA, 25 bp, Artificial sequence
  Synthetic oligonucleotide
cgccgtggcgcaacctagtaaaagc

SEQ ID NO: 680883 - DNA, 25 bp, Artificial sequence
  Synthetic oligonucleotide
tgacggctacgagccgcgtccaaaa

SEQ ID NO: 680884 - DNA, 25 bp, Artificial sequence
  Synthetic oligonucleotide
tgacggctacgacccgcgtccaaaa

SEQ ID NO: 680885 - DNA, 25 bp, Artificial sequence
  Synthetic oligonucleotide
cgaacctgcggcctgtcgttttggt

SEQ ID NO: 680886 - DNA, 25 bp, Artificial sequence
  Synthetic oligonucleotide
cgaacctgcggcgtgtcgttttggt

SEQ ID NO: 680887 - DNA, 25 bp, Artificial sequence
  Synthetic oligonucleotide
tgaggccggacttatgcggagttcg

SEQ ID NO: 680888 - DNA, 25 bp, Artificial sequence
  Synthetic oligonucleotide
tgaggccggactaatgcggagttcg

SEQ ID NO: 680889 - DNA, 25 bp, Artificial sequence
  Synthetic oligonucleotide
actgaacgggcgacgtgtactgcgt

SEQ ID NO: 680890 - DNA, 25 bp, Artificial sequence
  Synthetic oligonucleotide
tggagttaacgtaccgcgggacgga

SEQ ID NO: 680891 - DNA, 25 bp, Artificial sequence
  Synthetic oligonucleotide
gtagtcgacgtttcgtcgccagagc

SEQ ID NO: 680892 - DNA, 25 bp, Artificial sequence
  Synthetic oligonucleotide
cctgtgcgatcgggttaggtatcgg

SEQ ID NO: 680893 - DNA, 25 bp, Artificial sequence
  Synthetic oligonucleotide
ggtactgcgaatggttcccgcttcc

SEQ ID NO: 680894 - DNA, 25 bp, Artificial sequence
  Synthetic oligonucleotide
ggtactgcgaatcgttcccgcttcc

SEQ ID NO: 680895 - DNA, 25 bp, Artificial sequence
  Synthetic oligonucleotide
ctgtgcaacgcgagatcgctagtcc

SEQ ID NO: 680896 - DNA, 25 bp, Artificial sequence
  Synthetic oligonucleotide
ctgtgcaacgcgtgatcgctagtcc

SEQ ID NO: 680897 - DNA, 25 bp, Artificial sequence
  Synthetic oligonucleotide
cggaataacgcgcgcattacggtcc

SEQ ID NO: 680898 - DNA, 25 bp, Artificial sequence
  Synthetic oligonucleotide
cggaataacgcgggcattacggtcc

SEQ ID NO: 680899 - DNA, 25 bp, Artificial sequence
  Synthetic oligonucleotide
gccatgatctagctgcgcggtatgc

SEQ ID NO: 680900 - DNA, 25 bp, Artificial sequence
  Synthetic oligonucleotide
gccatgatctaggtgcgcggtatgc

SEQ ID NO: 680901 - DNA, 25 bp, Artificial sequence
  Synthetic oligonucleotide
tgtgctgcgctatgtcggaagaggc

SEQ ID NO: 680902 - DNA, 25 bp, Artificial sequence
  Synthetic oligonucleotide
gagccggatcgcggaacgtatccta

SEQ ID NO: 680903 - DNA, 25 bp, Artificial sequence
  Synthetic oligonucleotide
actgaacgggcgtcgtgtactgcgt

SEQ ID NO: 680904 - DNA, 25 bp, Artificial sequence
  Synthetic oligonucleotide
cgaagatagtcgccccgaaccttgc

SEQ ID NO: 680905 - DNA, 25 bp, Artificial sequence
  Synthetic oligonucleotide
aacgcgttacgctacgacggtcagc

SEQ ID NO: 680906 - DNA, 25 bp, Artificial sequence
  Synthetic oligonucleotide
aacgcgttacgcaacgacggtcagc

SEQ ID NO: 680907 - DNA, 25 bp, Artificial sequence
  Synthetic oligonucleotide
acactggcgcgtcgactacgcatct

SEQ ID NO: 680908 - DNA, 25 bp, Artificial sequence
  Synthetic oligonucleotide
acactggcgcgtggactacgcatct

SEQ ID NO: 680909 - DNA, 25 bp, Artificial sequence
  Synthetic oligonucleotide
tctacccccgtttagcgaggctctg

SEQ ID NO: 680910 - DNA, 25 bp, Artificial sequence
  Synthetic oligonucleotide
tctacccccgttaagcgaggctctg

SEQ ID NO: 680911 - DNA, 25 bp, Artificial sequence
  Synthetic oligonucleotide
gcatcaggtgcgtcggttaagaccg

SEQ ID NO: 680912 - DNA, 25 bp, Artificial sequence
  Synthetic oligonucleotide
gcatcaggtgcgacggttaagaccg

SEQ ID NO: 680913 - DNA, 25 bp, Artificial sequence
  Synthetic oligonucleotide
ttggttgggtagtcgtgcgtacccg

SEQ ID NO: 680914 - DNA, 25 bp, Artificial sequence
  Synthetic oligonucleotide
ttggttgggtagacgtgcgtacccg

SEQ ID NO: 680915 - DNA, 25 bp, Artificial sequence
  Synthetic oligonucleotide
tggagttaacgttccgcgggacgga

SEQ ID NO: 680916 - DNA, 25 bp, Artificial sequence
  Synthetic oligonucleotide
ccgcccttaggccaaacgcttcgaa

SEQ ID NO: 680917 - DNA, 25 bp, Artificial sequence
  Synthetic oligonucleotide
tgtgctgcgctaagtcggaagaggc

SEQ ID NO: 680918 - DNA, 25 bp, Artificial sequence
  Synthetic oligonucleotide
cgaagatagtcggcccgaaccttgc

SEQ ID NO: 680919 - DNA, 25 bp, Artificial sequence
  Synthetic oligonucleotide
gtcagagcgagattacgcggtaggc

SEQ ID NO: 680920 - DNA, 25 bp, Artificial sequence
  Synthetic oligonucleotide
gtcagagcgagaatacgcggtaggc

SEQ ID NO: 680921 - DNA, 25 bp, Artificial sequence
  Synthetic oligonucleotide
tttctgttcgcgacgactcgcctcg

SEQ ID NO: 680922 - DNA, 25 bp, Artificial sequence
  Synthetic oligonucleotide
tttctgttcgcgtcgactcgcctcg

SEQ ID NO: 680923 - DNA, 25 bp, Artificial sequence
  Synthetic oligonucleotide
ttgacgtacgtccgagcgcatcgct

SEQ ID NO: 680924 - DNA, 25 bp, Artificial sequence
  Synthetic oligonucleotide
ttgacgtacgtcggagcgcatcgct

SEQ ID NO: 680925 - DNA, 25 bp, Artificial sequence
  Synthetic oligonucleotide
acagtgccgagacgttacgacggct

SEQ ID NO: 680926 - DNA, 25 bp, Artificial sequence
  Synthetic oligonucleotide
acagtgccgagaggttacgacggct

SEQ ID NO: 680927 - DNA, 25 bp, Artificial sequence
  Synthetic oligonucleotide
cctgtgcgatcgcgttaggtatcgg

SEQ ID NO: 680928 - DNA, 25 bp, Artificial sequence
  Synthetic oligonucleotide
ccgcccttaggcgaaacgcttcgaa

SEQ ID NO: 680929 - DNA, 25 bp, Artificial sequence
  Synthetic oligonucleotide
acggcttgcgcgtacgagcttaagc

SEQ ID NO: 680930 - DNA, 25 bp, Artificial sequence
  Synthetic oligonucleotide
ccggtcgatacaaaccgcgtcgtgt

SEQ ID NO: 680931 - DNA, 25 bp, Artificial sequence
  Synthetic oligonucleotide
tccccttaagcccttgcggggcata

SEQ ID NO: 680932 - DNA, 25 bp, Artificial sequence
  Synthetic oligonucleotide
ggttttgcgtgttacgcgaccgcag

SEQ ID NO: 680933 - DNA, 25 bp, Artificial sequence
  Synthetic oligonucleotide
ggttttgcgtgtaacgcgaccgcag

SEQ ID NO: 680934 - DNA, 25 bp, Artificial sequence
  Synthetic oligonucleotide
gcgtccacccgcgctcttaaaagtg

SEQ ID NO: 680935 - DNA, 25 bp, Artificial sequence
  Synthetic oligonucleotide
gcgtccacccgccctcttaaaagtg

SEQ ID NO: 680936 - DNA, 25 bp, Artificial sequence
  Synthetic oligonucleotide
cgctctacgcgcgggtataaaaggg

SEQ ID NO: 680937 - DNA, 25 bp, Artificial sequence
  Synthetic oligonucleotide
cgctctacgcgccggtataaaaggg

SEQ ID NO: 680938 - DNA, 25 bp, Artificial sequence
  Synthetic oligonucleotide
cgcttacggccgatatacgggccaa

SEQ ID NO: 680939 - DNA, 25 bp, Artificial sequence
  Synthetic oligonucleotide
cgcttacggccgttatacgggccaa

SEQ ID NO: 680940 - DNA, 25 bp, Artificial sequence
  Synthetic oligonucleotide
tccgtttcgccggtctacgcaggtt

SEQ ID NO: 680941 - DNA, 25 bp, Artificial sequence
  Synthetic oligonucleotide
acaggagccgtactacgtcgcttgg

SEQ ID NO: 680942 - DNA, 25 bp, Artificial sequence
  Synthetic oligonucleotide
cgcggtaagtcggcttacgcagatg

SEQ ID NO: 680943 - DNA, 25 bp, Artificial sequence
  Synthetic oligonucleotide
acggcttgcgcgaacgagcttaagc

SEQ ID NO: 680944 - DNA, 25 bp, Artificial sequence
  Synthetic oligonucleotide
cccggtcgtccgagcctaattagac

SEQ ID NO: 680945 - DNA, 25 bp, Artificial sequence
  Synthetic oligonucleotide
cccggtcgtccgtgcctaattagac

SEQ ID NO: 680946 - DNA, 25 bp, Artificial sequence
  Synthetic oligonucleotide
tttcccattctaggccgcggacagg

SEQ ID NO: 680947 - DNA, 25 bp, Artificial sequence
  Synthetic oligonucleotide
tttcccattctacgccgcggacagg

SEQ ID NO: 680948 - DNA, 25 bp, Artificial sequence
  Synthetic oligonucleotide
ggtagccgagatgcgtatggtgtcc

SEQ ID NO: 680949 - DNA, 25 bp, Artificial sequence
  Synthetic oligonucleotide
ggtagccgagatccgtatggtgtcc

SEQ ID NO: 680950 - DNA, 25 bp, Artificial sequence
  Synthetic oligonucleotide
atcgaacgggcgctatacgccatcg

SEQ ID NO: 680951 - DNA, 25 bp, Artificial sequence
  Synthetic oligonucleotide
atcgaacgggcggtatacgccatcg

SEQ ID NO: 680952 - DNA, 25 bp, Artificial sequence
  Synthetic oligonucleotide
ccggtcgatacataccgcgtcgtgt

SEQ ID NO: 680953 - DNA, 25 bp, Artificial sequence
  Synthetic oligonucleotide
acaggagccgtagtacgtcgcttgg

SEQ ID NO: 680954 - DNA, 25 bp, Artificial sequence
  Synthetic oligonucleotide
agccgggcctagggcgtatttcgat

SEQ ID NO: 680955 - DNA, 25 bp, Artificial sequence
  Synthetic oligonucleotide
tggacgaccgtaggggagtgcattg

SEQ ID NO: 680956 - DNA, 25 bp, Artificial sequence
  Synthetic oligonucleotide
ggttatgcgctatcggtatgcggcc

SEQ ID NO: 680957 - DNA, 25 bp, Artificial sequence
  Synthetic oligonucleotide
ggttatgcgctaacggtatgcggcc

SEQ ID NO: 680958 - DNA, 25 bp, Artificial sequence
  Synthetic oligonucleotide
ccagctatcgcgggaagagcttcgt

SEQ ID NO: 680959 - DNA, 25 bp, Artificial sequence
  Synthetic oligonucleotide
ccagctatcgcgcgaagagcttcgt

SEQ ID NO: 680960 - DNA, 25 bp, Artificial sequence
  Synthetic oligonucleotide
cagctgggtctaggcgtagaagacc

SEQ ID NO: 680961 - DNA, 25 bp, Artificial sequence
  Synthetic oligonucleotide
cagctgggtctacgcgtagaagacc

SEQ ID NO: 680962 - DNA, 25 bp, Artificial sequence
  Synthetic oligonucleotide
taagccgccggtacgctagcttgct

SEQ ID NO: 680963 - DNA, 25 bp, Artificial sequence
  Synthetic oligonucleotide
taagccgccggttcgctagcttgct

SEQ ID NO: 680964 - DNA, 25 bp, Artificial sequence
  Synthetic oligonucleotide
cagtcttacgcgtcgtgattggccg

SEQ ID NO: 680965 - DNA, 25 bp, Artificial sequence
  Synthetic oligonucleotide
tggacgaccgtacgggagtgcattg

SEQ ID NO: 680966 - DNA, 25 bp, Artificial sequence
  Synthetic oligonucleotide
agccgggcctagcgcgtatttcgat

SEQ ID NO: 680967 - DNA, 25 bp, Artificial sequence
  Synthetic oligonucleotide
tccccttaagccgttgcggggcata

SEQ ID NO: 680968 - DNA, 25 bp, Artificial sequence
  Synthetic oligonucleotide
cataaccgaccggaagcgtagcgac

SEQ ID NO: 680969 - DNA, 25 bp, Artificial sequence
  Synthetic oligonucleotide
cataaccgaccgcaagcgtagcgac

SEQ ID NO: 680970 - DNA, 25 bp, Artificial sequence
  Synthetic oligonucleotide
gcccattccgaaggcgtactgagct

SEQ ID NO: 680971 - DNA, 25 bp, Artificial sequence
  Synthetic oligonucleotide
gcccattccgaacgcgtactgagct

SEQ ID NO: 680972 - DNA, 25 bp, Artificial sequence
  Synthetic oligonucleotide
gcctttctaacgtctcgcgtcaggg

SEQ ID NO: 680973 - DNA, 25 bp, Artificial sequence
  Synthetic oligonucleotide
gcctttctaacgactcgcgtcaggg

SEQ ID NO: 680974 - DNA, 25 bp, Artificial sequence
  Synthetic oligonucleotide
ggtcttcggtaaggtcgcacgcgta

SEQ ID NO: 680975 - DNA, 25 bp, Artificial sequence
  Synthetic oligonucleotide
ggtcttcggtaacgtcgcacgcgta

SEQ ID NO: 680976 - DNA, 25 bp, Artificial sequence
  Synthetic oligonucleotide
tccccatgcgtagcggctattgcac

SEQ ID NO: 680977 - DNA, 25 bp, Artificial sequence
  Synthetic oligonucleotide
tccccatgcgtaccggctattgcac

SEQ ID NO: 680978 - DNA, 25 bp, Artificial sequence
  Synthetic oligonucleotide
cagtcttacgcgacgtgattggccg

SEQ ID NO: 680979 - DNA, 25 bp, Artificial sequence
  Synthetic oligonucleotide
cacggagacgctacgcatcgcagat

SEQ ID NO: 680980 - DNA, 25 bp, Artificial sequence
  Synthetic oligonucleotide
accgaaatcgttaccgcggacgtgc

SEQ ID NO: 680981 - DNA, 25 bp, Artificial sequence
  Synthetic oligonucleotide
gacgtacgccgcgataagtcgaagg

SEQ ID NO: 680982 - DNA, 25 bp, Artificial sequence
  Synthetic oligonucleotide
gacgtacgccgccataagtcgaagg

SEQ ID NO: 680983 - DNA, 25 bp, Artificial sequence
  Synthetic oligonucleotide
cacaccgatctacggcccgattgca

SEQ ID NO: 680984 - DNA, 25 bp, Artificial sequence
  Synthetic oligonucleotide
cacaccgatctagggcccgattgca

SEQ ID NO: 680985 - DNA, 25 bp, Artificial sequence
  Synthetic oligonucleotide
ggaaggcgatacgggaacgtggttc

SEQ ID NO: 680986 - DNA, 25 bp, Artificial sequence
  Synthetic oligonucleotide
ggaaggcgataccggaacgtggttc

SEQ ID NO: 680987 - DNA, 25 bp, Artificial sequence
  Synthetic oligonucleotide
tagaccgcgctcggcgtattcatgc

SEQ ID NO: 680988 - DNA, 25 bp, Artificial sequence
  Synthetic oligonucleotide
tagaccgcgctccgcgtattcatgc

SEQ ID NO: 680989 - DNA, 25 bp, Artificial sequence
  Synthetic oligonucleotide
ccctacgtacccttcgcgtgcaagt

SEQ ID NO: 680990 - DNA, 25 bp, Artificial sequence
  Synthetic oligonucleotide
accgaaatcgtttccgcggacgtgc

SEQ ID NO: 680991 - DNA, 25 bp, Artificial sequence
  Synthetic oligonucleotide
cacggagacgcttcgcatcgcagat

SEQ ID NO: 680992 - DNA, 25 bp, Artificial sequence
  Synthetic oligonucleotide
ccctacgtacccatcgcgtgcaagt

SEQ ID NO: 680993 - DNA, 25 bp, Artificial sequence
  Synthetic oligonucleotide
cccctattacgcgcgacgtggtctt

SEQ ID NO: 680994 - DNA, 25 bp, Artificial sequence
  Synthetic oligonucleotide
cccctattacgcccgacgtggtctt

SEQ ID NO: 680995 - DNA, 25 bp, Artificial sequence
  Synthetic oligonucleotide
ctcgcatgcgaggttaccgtacctg

SEQ ID NO: 680996 - DNA, 25 bp, Artificial sequence
  Synthetic oligonucleotide
ctcgcatgcgagcttaccgtacctg

SEQ ID NO: 680997 - DNA, 25 bp, Artificial sequence
  Synthetic oligonucleotide
atcccttgtcccgcgatagcccaag

SEQ ID NO: 680998 - DNA, 25 bp, Artificial sequence
  Synthetic oligonucleotide
atcccttgtcccccgatagcccaag

SEQ ID NO: 680999 - DNA, 25 bp, Artificial sequence
  Synthetic oligonucleotide
acgtgctcacgtgcgctagacacac

SEQ ID NO: 681000 - DNA, 25 bp, Artificial sequence
  Synthetic oligonucleotide
tcagggcgacctacgcgtttgatgc

SEQ ID NO: 681001 - DNA, 25 bp, Artificial sequence
  Synthetic oligonucleotide
tccgtttcgccgctctacgcaggtt

SEQ ID NO: 681002 - DNA, 25 bp, Artificial sequence
  Synthetic oligonucleotide
acgtgctcacgtccgctagacacac

SEQ ID NO: 681003 - DNA, 25 bp, Artificial sequence
  Synthetic oligonucleotide
actccggtcgcgtcctacttgcctt

SEQ ID NO: 681004 - DNA, 25 bp, Artificial sequence
  Synthetic oligonucleotide
cgcccgcgcacgaactacgtattag

SEQ ID NO: 681005 - DNA, 25 bp, Artificial sequence
  Synthetic oligonucleotide
tcagggcgaccttcgcgtttgatgc

SEQ ID NO: 681006 - DNA, 25 bp, Artificial sequence
  Synthetic oligonucleotide
actccggtcgcgacctacttgcctt

SEQ ID NO: 681007 - DNA, 25 bp, Artificial sequence
  Synthetic oligonucleotide
cgcccgcgcacgtactacgtattag

SEQ ID NO: 681008 - DNA, 25 bp, Artificial sequence
  Synthetic oligonucleotide
tgatcggccgtacgcaactagggca

SEQ ID NO: 681009 - DNA, 25 bp, Artificial sequence
  Synthetic oligonucleotide
cgaggtcgttcgggcgtagcatact

SEQ ID NO: 681010 - DNA, 25 bp, Artificial sequence
  Synthetic oligonucleotide
cgaggtcgttcgcgcgtagcatact

SEQ ID NO: 681011 - DNA, 25 bp, Artificial sequence
  Synthetic oligonucleotide
gagcggtatcggtacccgatcacct

SEQ ID NO: 681012 - DNA, 25 bp, Artificial sequence
  Synthetic oligonucleotide
gagcggtatcggaacccgatcacct

SEQ ID NO: 681013 - DNA, 25 bp, Artificial sequence
  Synthetic oligonucleotide
aagtgccgcggttttgtcgccgcat

SEQ ID NO: 681014 - DNA, 25 bp, Artificial sequence
  Synthetic oligonucleotide
aagtgccgcggtattgtcgccgcat

SEQ ID NO: 681015 - DNA, 25 bp, Artificial sequence
  Synthetic oligonucleotide
cgagcgtcgacgaatgaggcagtga

SEQ ID NO: 681016 - DNA, 25 bp, Artificial sequence
  Synthetic oligonucleotide
cgagcgtcgacgtatgaggcagtga

SEQ ID NO: 681017 - DNA, 25 bp, Artificial sequence
  Synthetic oligonucleotide
caccctcgacgggtacctacatagc

SEQ ID NO: 681018 - DNA, 25 bp, Artificial sequence
  Synthetic oligonucleotide
gctaaccgtctccacccgtgtgatg

SEQ ID NO: 681019 - DNA, 25 bp, Artificial sequence
  Synthetic oligonucleotide
caccctcgacggctacctacatagc

SEQ ID NO: 681020 - DNA, 25 bp, Artificial sequence
  Synthetic oligonucleotide
gctaaccgtctcgacccgtgtgatg

SEQ ID NO: 681021 - DNA, 25 bp, Artificial sequence
  Synthetic oligonucleotide
ggaagtcgtgcacgacgtactcgct

SEQ ID NO: 681022 - DNA, 25 bp, Artificial sequence
  Synthetic oligonucleotide
ggaagtcgtgcaggacgtactcgct

SEQ ID NO: 681023 - DNA, 25 bp, Artificial sequence
  Synthetic oligonucleotide
cgcagcccgatagtcgatcacacac

SEQ ID NO: 681024 - DNA, 25 bp, Artificial sequence
  Synthetic oligonucleotide
cgcagcccgatactcgatcacacac

SEQ ID NO: 681025 - DNA, 25 bp, Artificial sequence
  Synthetic oligonucleotide
gggagtcgcgtcgttgataagcgag

SEQ ID NO: 681026 - DNA, 25 bp, Artificial sequence
  Synthetic oligonucleotide
tccagccggggtcgtctataaagcg

SEQ ID NO: 681027 - DNA, 25 bp, Artificial sequence
  Synthetic oligonucleotide
tccagccggggtggtctataaagcg

SEQ ID NO: 681028 - DNA, 25 bp, Artificial sequence
  Synthetic oligonucleotide
gggagtcgcgtccttgataagcgag

SEQ ID NO: 681029 - DNA, 25 bp, Artificial sequence
  Synthetic oligonucleotide
tgatcggccgtaggcaactagggca

SEQ ID NO: 681030 - DNA, 25 bp, Artificial sequence
  Synthetic oligonucleotide
atctaacgacggtctcgcagccccg

SEQ ID NO: 681031 - DNA, 25 bp, Artificial sequence
  Synthetic oligonucleotide
cgctcgcgtccgttaaacgaaccgg

SEQ ID NO: 681032 - DNA, 25 bp, Artificial sequence
  Synthetic oligonucleotide
agcggtgccgtagtccgatcgctgt

SEQ ID NO: 681033 - DNA, 25 bp, Artificial sequence
  Synthetic oligonucleotide
agcggtgccgtactccgatcgctgt

SEQ ID NO: 681034 - DNA, 25 bp, Artificial sequence
  Synthetic oligonucleotide
gtctgcgtcgtaaggcgcgctctag

SEQ ID NO: 681035 - DNA, 25 bp, Artificial sequence
  Synthetic oligonucleotide
gtctgcgtcgtatggcgcgctctag

SEQ ID NO: 681036 - DNA, 25 bp, Artificial sequence
  Synthetic oligonucleotide
gcactccggtcgacaacggtacgca

SEQ ID NO: 681037 - DNA, 25 bp, Artificial sequence
  Synthetic oligonucleotide
ccaagctatcgcccgacgtggttgg

SEQ ID NO: 681038 - DNA, 25 bp, Artificial sequence
  Synthetic oligonucleotide
cgctcgcgtccgataaacgaaccgg

SEQ ID NO: 681039 - DNA, 25 bp, Artificial sequence
  Synthetic oligonucleotide
ttgtcccgcgaggcataccccgatc

SEQ ID NO: 681040 - DNA, 25 bp, Artificial sequence
  Synthetic oligonucleotide
atctaacgacggactcgcagccccg

SEQ ID NO: 681041 - DNA, 25 bp, Artificial sequence
  Synthetic oligonucleotide
ccaagctatcgcgcgacgtggttgg

SEQ ID NO: 681042 - DNA, 25 bp, Artificial sequence
  Synthetic oligonucleotide
agctctggcgtccgaacgagcgatc

SEQ ID NO: 681043 - DNA, 25 bp, Artificial sequence
  Synthetic oligonucleotide
agctctggcgtcggaacgagcgatc

SEQ ID NO: 681044 - DNA, 25 bp, Artificial sequence
  Synthetic oligonucleotide
gccgtgacgcgccttggatcgtaca

SEQ ID NO: 681045 - DNA, 25 bp, Artificial sequence
  Synthetic oligonucleotide
gccgtgacgcgcgttggatcgtaca

SEQ ID NO: 681046 - DNA, 25 bp, Artificial sequence
  Synthetic oligonucleotide
taccgggtcgcgaatacacccgtcg

SEQ ID NO: 681047 - DNA, 25 bp, Artificial sequence
  Synthetic oligonucleotide
gagggctcagtagcggtcggacgaa

SEQ ID NO: 681048 - DNA, 25 bp, Artificial sequence
  Synthetic oligonucleotide
ttgtcccgcgagccataccccgatc

SEQ ID NO: 681049 - DNA, 25 bp, Artificial sequence
  Synthetic oligonucleotide
gagaacacgcgcgacgtagcgagtc

SEQ ID NO: 681050 - DNA, 25 bp, Artificial sequence
  Synthetic oligonucleotide
gagaacacgcgccacgtagcgagtc

SEQ ID NO: 681051 - DNA, 25 bp, Artificial sequence
  Synthetic oligonucleotide
acgacgacgggaggtacgctgtcgt

SEQ ID NO: 681052 - DNA, 25 bp, Artificial sequence
  Synthetic oligonucleotide
gcactccggtcgtcaacggtacgca

SEQ ID NO: 681053 - DNA, 25 bp, Artificial sequence
  Synthetic oligonucleotide
gagggctcagtaccggtcggacgaa

SEQ ID NO: 681054 - DNA, 25 bp, Artificial sequence
  Synthetic oligonucleotide
acccgagcgctccgtattgggaacg

SEQ ID NO: 681055 - DNA, 25 bp, Artificial sequence
  Synthetic oligonucleotide
acgacgacgggacgtacgctgtcgt

SEQ ID NO: 681056 - DNA, 25 bp, Artificial sequence
  Synthetic oligonucleotide
cacgccgcgctacgctgatataccc

SEQ ID NO: 681057 - DNA, 25 bp, Artificial sequence
  Synthetic oligonucleotide
ctagcatcacgactacgcgcgggtc

SEQ ID NO: 681058 - DNA, 25 bp, Artificial sequence
  Synthetic oligonucleotide
ctagcatcacgagtacgcgcgggtc

SEQ ID NO: 681059 - DNA, 25 bp, Artificial sequence
  Synthetic oligonucleotide
cgacaatcgagccctacgcgtacgc

SEQ ID NO: 681060 - DNA, 25 bp, Artificial sequence
  Synthetic oligonucleotide
cgacaatcgagcgctacgcgtacgc

SEQ ID NO: 681061 - DNA, 25 bp, Artificial sequence
  Synthetic oligonucleotide
cgtaccatcgtccggtcgttcggac

SEQ ID NO: 681062 - DNA, 25 bp, Artificial sequence
  Synthetic oligonucleotide
cgtaccatcgtcgggtcgttcggac

SEQ ID NO: 681063 - DNA, 25 bp, Artificial sequence
  Synthetic oligonucleotide
tggtccctagtagggtgcgggagct

SEQ ID NO: 681064 - DNA, 25 bp, Artificial sequence
  Synthetic oligonucleotide
tggtccctagtacggtgcgggagct

SEQ ID NO: 681065 - DNA, 25 bp, Artificial sequence
  Synthetic oligonucleotide
cacgccgcgctaggctgatataccc

SEQ ID NO: 681066 - DNA, 25 bp, Artificial sequence
  Synthetic oligonucleotide
gaggcttcgacccgtagcgcaactg

SEQ ID NO: 681067 - DNA, 25 bp, Artificial sequence
  Synthetic oligonucleotide
cgtcctcgccgattacgcagaaggc

SEQ ID NO: 681068 - DNA, 25 bp, Artificial sequence
  Synthetic oligonucleotide
acccgagcgctcggtattgggaacg

SEQ ID NO: 681069 - DNA, 25 bp, Artificial sequence
  Synthetic oligonucleotide
ccctaagtacgagcgtcgcccggat

SEQ ID NO: 681070 - DNA, 25 bp, Artificial sequence
  Synthetic oligonucleotide
ccctaagtacgaccgtcgcccggat

SEQ ID NO: 681071 - DNA, 25 bp, Artificial sequence
  Synthetic oligonucleotide
gccaactagcgcggttccggatcag

SEQ ID NO: 681072 - DNA, 25 bp, Artificial sequence
  Synthetic oligonucleotide
gccaactagcgccgttccggatcag

SEQ ID NO: 681073 - DNA, 25 bp, Artificial sequence
  Synthetic oligonucleotide
ccccccgttataccgccggctgtat

SEQ ID NO: 681074 - DNA, 25 bp, Artificial sequence
  Synthetic oligonucleotide
ccccccgttatagcgccggctgtat

SEQ ID NO: 681075 - DNA, 25 bp, Artificial sequence
  Synthetic oligonucleotide
cgcttccgcgtaccggataccacag

SEQ ID NO: 681076 - DNA, 25 bp, Artificial sequence
  Synthetic oligonucleotide
cgcttccgcgtagcggataccacag

SEQ ID NO: 681077 - DNA, 25 bp, Artificial sequence
  Synthetic oligonucleotide
cgtcctcgccgaatacgcagaaggc

SEQ ID NO: 681078 - DNA, 25 bp, Artificial sequence
  Synthetic oligonucleotide
gaggcttcgaccggtagcgcaactg

SEQ ID NO: 681079 - DNA, 25 bp, Artificial sequence
  Synthetic oligonucleotide
tcaccataaccacgtcgcgtggcgg

SEQ ID NO: 681080 - DNA, 25 bp, Artificial sequence
  Synthetic oligonucleotide
tcatgcgaaccgaacgacggcgcga

SEQ ID NO: 681081 - DNA, 25 bp, Artificial sequence
  Synthetic oligonucleotide
tcatgcgaaccgtacgacggcgcga

SEQ ID NO: 681082 - DNA, 25 bp, Artificial sequence
  Synthetic oligonucleotide
ggcagctacgtcgaacccgaatccc

SEQ ID NO: 681083 - DNA, 25 bp, Artificial sequence
  Synthetic oligonucleotide
ggcagctacgtccaacccgaatccc

SEQ ID NO: 681084 - DNA, 25 bp, Artificial sequence
  Synthetic oligonucleotide
ctaggcgcgacgtggtaccttaccg

SEQ ID NO: 681085 - DNA, 25 bp, Artificial sequence
  Synthetic oligonucleotide
ctaggcgcgacgaggtaccttaccg

SEQ ID NO: 681086 - DNA, 25 bp, Artificial sequence
  Synthetic oligonucleotide
cggatgacgcggtccagttgtggac

SEQ ID NO: 681087 - DNA, 25 bp, Artificial sequence
  Synthetic oligonucleotide
cggatgacgcggaccagttgtggac

SEQ ID NO: 681088 - DNA, 25 bp, Artificial sequence
  Synthetic oligonucleotide
tcggcccgaagttcgctcgtgactg

SEQ ID NO: 681089 - DNA, 25 bp, Artificial sequence
  Synthetic oligonucleotide
tcggcccgaagtacgctcgtgactg

SEQ ID NO: 681090 - DNA, 25 bp, Artificial sequence
  Synthetic oligonucleotide
cccctaccgtaagtagccggctgtg

SEQ ID NO: 681091 - DNA, 25 bp, Artificial sequence
  Synthetic oligonucleotide
ggtgccagtctaggcgacgagttcc

SEQ ID NO: 681092 - DNA, 25 bp, Artificial sequence
  Synthetic oligonucleotide
cgtcgagtacacccgtccggagttg

SEQ ID NO: 681093 - DNA, 25 bp, Artificial sequence
  Synthetic oligonucleotide
tcaccataaccaggtcgcgtggcgg

SEQ ID NO: 681094 - DNA, 25 bp, Artificial sequence
  Synthetic oligonucleotide
tcgggggtgcgatcgaccggctatt

SEQ ID NO: 681095 - DNA, 25 bp, Artificial sequence
  Synthetic oligonucleotide
tcgggggtgcgaacgaccggctatt

SEQ ID NO: 681096 - DNA, 25 bp, Artificial sequence
  Synthetic oligonucleotide
atccccttagcgaacgcgggcgtct

SEQ ID NO: 681097 - DNA, 25 bp, Artificial sequence
  Synthetic oligonucleotide
atccccttagcgtacgcgggcgtct

SEQ ID NO: 681098 - DNA, 25 bp, Artificial sequence
  Synthetic oligonucleotide
ggcatgccgcgaggtacgtacggat

SEQ ID NO: 681099 - DNA, 25 bp, Artificial sequence
  Synthetic oligonucleotide
ggcatgccgcgacgtacgtacggat

SEQ ID NO: 681100 - DNA, 25 bp, Artificial sequence
  Synthetic oligonucleotide
tcgagggttatgggcgatcggcagc

SEQ ID NO: 681101 - DNA, 25 bp, Artificial sequence
  Synthetic oligonucleotide
cccctaccgtaactagccggctgtg

SEQ ID NO: 681102 - DNA, 25 bp, Artificial sequence
  Synthetic oligonucleotide
ttcgcgtagtccggtcgtacggcct

SEQ ID NO: 681103 - DNA, 25 bp, Artificial sequence
  Synthetic oligonucleotide
ggtgccagtctacgcgacgagttcc

SEQ ID NO: 681104 - DNA, 25 bp, Artificial sequence
  Synthetic oligonucleotide
ctgaggattatcgcgcggcgatcgc

SEQ ID NO: 681105 - DNA, 25 bp, Artificial sequence
  Synthetic oligonucleotide
ggtatctcggacccgtagtcggcgt

SEQ ID NO: 681106 - DNA, 25 bp, Artificial sequence
  Synthetic oligonucleotide
ggtatctcggacgcgtagtcggcgt

SEQ ID NO: 681107 - DNA, 25 bp, Artificial sequence
  Synthetic oligonucleotide
cagcagcgttcggactacatcgggc

SEQ ID NO: 681108 - DNA, 25 bp, Artificial sequence
  Synthetic oligonucleotide
cagcagcgttcgcactacatcgggc

SEQ ID NO: 681109 - DNA, 25 bp, Artificial sequence
  Synthetic oligonucleotide
gcaagcctatgctcgcgcgctagtg

SEQ ID NO: 681110 - DNA, 25 bp, Artificial sequence
  Synthetic oligonucleotide
gcaagcctatgcacgcgcgctagtg

SEQ ID NO: 681111 - DNA, 25 bp, Artificial sequence
  Synthetic oligonucleotide
gtcatctatggcccgcgctcgagga

SEQ ID NO: 681112 - DNA, 25 bp, Artificial sequence
  Synthetic oligonucleotide
gtcatctatggcgcgcgctcgagga

SEQ ID NO: 681113 - DNA, 25 bp, Artificial sequence
  Synthetic oligonucleotide
acctcgcgtcgttctagcgcgcaag

SEQ ID NO: 681114 - DNA, 25 bp, Artificial sequence
  Synthetic oligonucleotide
acctcgcgtcgtactagcgcgcaag

SEQ ID NO: 681115 - DNA, 25 bp, Artificial sequence
  Synthetic oligonucleotide
ggctagacgtagaaccgggatccgc

SEQ ID NO: 681116 - DNA, 25 bp, Artificial sequence
  Synthetic oligonucleotide
agccgctctcgcctaccgtcatcct

SEQ ID NO: 681117 - DNA, 25 bp, Artificial sequence
  Synthetic oligonucleotide
ggctagacgtagtaccgggatccgc

SEQ ID NO: 681118 - DNA, 25 bp, Artificial sequence
  Synthetic oligonucleotide
ctgaggattatcccgcggcgatcgc

SEQ ID NO: 681119 - DNA, 25 bp, Artificial sequence
  Synthetic oligonucleotide
tacgggcgtgacgtccgatccagca

SEQ ID NO: 681120 - DNA, 25 bp, Artificial sequence
  Synthetic oligonucleotide
tacgggcgtgacctccgatccagca

SEQ ID NO: 681121 - DNA, 25 bp, Artificial sequence
  Synthetic oligonucleotide
atgaggcgtacgggcgttctcccga

SEQ ID NO: 681122 - DNA, 25 bp, Artificial sequence
  Synthetic oligonucleotide
atgaggcgtacgcgcgttctcccga

SEQ ID NO: 681123 - DNA, 25 bp, Artificial sequence
  Synthetic oligonucleotide
ctccctcccgtagcgcatagcctgt

SEQ ID NO: 681124 - DNA, 25 bp, Artificial sequence
  Synthetic oligonucleotide
ctccctcccgtaccgcatagcctgt

SEQ ID NO: 681125 - DNA, 25 bp, Artificial sequence
  Synthetic oligonucleotide
tgtcactcggtaggagcgtgccgtc

SEQ ID NO: 681126 - DNA, 25 bp, Artificial sequence
  Synthetic oligonucleotide
tgtcactcggtacgagcgtgccgtc

SEQ ID NO: 681127 - DNA, 25 bp, Artificial sequence
  Synthetic oligonucleotide
cgtcgagtacacgcgtccggagttg

SEQ ID NO: 681128 - DNA, 25 bp, Artificial sequence
  Synthetic oligonucleotide
taccgggtcgcgtatacacccgtcg

SEQ ID NO: 681129 - DNA, 25 bp, Artificial sequence
  Synthetic oligonucleotide
agccgctctcgcgtaccgtcatcct

SEQ ID NO: 681130 - DNA, 25 bp, Artificial sequence
  Synthetic oligonucleotide
ctcggacacgacggtaacgcgtacc

SEQ ID NO: 681131 - DNA, 25 bp, Artificial sequence
  Synthetic oligonucleotide
ttcgcgtagtcccgtcgtacggcct

SEQ ID NO: 681132 - DNA, 25 bp, Artificial sequence
  Synthetic oligonucleotide
gcgggtctcaattggcgcgatggag

SEQ ID NO: 681133 - DNA, 25 bp, Artificial sequence
  Synthetic oligonucleotide
gcgggtctcaataggcgcgatggag

SEQ ID NO: 681134 - DNA, 25 bp, Artificial sequence
  Synthetic oligonucleotide
cggggaacgtcgagaccggttcaga

SEQ ID NO: 681135 - DNA, 25 bp, Artificial sequence
  Synthetic oligonucleotide
cggggaacgtcgtgaccggttcaga

SEQ ID NO: 681136 - DNA, 25 bp, Artificial sequence
  Synthetic oligonucleotide
ctacccttggcgagacgcgtcttcc

SEQ ID NO: 681137 - DNA, 25 bp, Artificial sequence
  Synthetic oligonucleotide
ctacccttggcgtgacgcgtcttcc

SEQ ID NO: 681138 - DNA, 25 bp, Artificial sequence
  Synthetic oligonucleotide
cgtccaacaccggtcgcatcgacgt

SEQ ID NO: 681139 - DNA, 25 bp, Artificial sequence
  Synthetic oligonucleotide
cgtccaacaccgctcgcatcgacgt

SEQ ID NO: 681140 - DNA, 25 bp, Artificial sequence
  Synthetic oligonucleotide
cgctggacccgtttcgcaccttcca

SEQ ID NO: 681141 - DNA, 25 bp, Artificial sequence
  Synthetic oligonucleotide
cggcctactgtcgcgacacacggtt

SEQ ID NO: 681142 - DNA, 25 bp, Artificial sequence
  Synthetic oligonucleotide
ctcggacacgaccgtaacgcgtacc

SEQ ID NO: 681143 - DNA, 25 bp, Artificial sequence
  Synthetic oligonucleotide
tccagtatacgcggaacccccgcct

SEQ ID NO: 681144 - DNA, 25 bp, Artificial sequence
  Synthetic oligonucleotide
ccatgtgcgtgcggcggtagcatga

SEQ ID NO: 681145 - DNA, 25 bp, Artificial sequence
  Synthetic oligonucleotide
ccatgtgcgtgccgcggtagcatga

SEQ ID NO: 681146 - DNA, 25 bp, Artificial sequence
  Synthetic oligonucleotide
accaagccgcttgggtacgtctggc

SEQ ID NO: 681147 - DNA, 25 bp, Artificial sequence
  Synthetic oligonucleotide
accaagccgcttcggtacgtctggc

SEQ ID NO: 681148 - DNA, 25 bp, Artificial sequence
  Synthetic oligonucleotide
ccccacgtccgcgatacacaagcga

SEQ ID NO: 681149 - DNA, 25 bp, Artificial sequence
  Synthetic oligonucleotide
ccccacgtccgccatacacaagcga

SEQ ID NO: 681150 - DNA, 25 bp, Artificial sequence
  Synthetic oligonucleotide
gcagtattggacggtcgcggctcag

SEQ ID NO: 681151 - DNA, 25 bp, Artificial sequence
  Synthetic oligonucleotide
gcagtattggaccgtcgcggctcag

SEQ ID NO: 681152 - DNA, 25 bp, Artificial sequence
  Synthetic oligonucleotide
gggtcgctcgtcgcgtacggagtaa

SEQ ID NO: 681153 - DNA, 25 bp, Artificial sequence
  Synthetic oligonucleotide
agcggatacgatcgacgcatggccg

SEQ ID NO: 681154 - DNA, 25 bp, Artificial sequence
  Synthetic oligonucleotide
cgctggacccgtatcgcaccttcca

SEQ ID NO: 681155 - DNA, 25 bp, Artificial sequence
  Synthetic oligonucleotide
gcggacacgaccgctacgtttcagc

SEQ ID NO: 681156 - DNA, 25 bp, Artificial sequence
  Synthetic oligonucleotide
cacctcataccggacgcgttcggtc

SEQ ID NO: 681157 - DNA, 25 bp, Artificial sequence
  Synthetic oligonucleotide
gccgtacgcgttacgacgtggcgta

SEQ ID NO: 681158 - DNA, 25 bp, Artificial sequence
  Synthetic oligonucleotide
cggtgccataccgcgccgacatcaa

SEQ ID NO: 681159 - DNA, 25 bp, Artificial sequence
  Synthetic oligonucleotide
cggtgccataccccgccgacatcaa

SEQ ID NO: 681160 - DNA, 25 bp, Artificial sequence
  Synthetic oligonucleotide
gtacagttacgagcgcggaccgtgc

SEQ ID NO: 681161 - DNA, 25 bp, Artificial sequence
  Synthetic oligonucleotide
gtacagttacgaccgcggaccgtgc

SEQ ID NO: 681162 - DNA, 25 bp, Artificial sequence
  Synthetic oligonucleotide
gccctgtacttcccggtcgcttcct

SEQ ID NO: 681163 - DNA, 25 bp, Artificial sequence
  Synthetic oligonucleotide
gccctgtacttcgcggtcgcttcct

SEQ ID NO: 681164 - DNA, 25 bp, Artificial sequence
  Synthetic oligonucleotide
gtgcccactacgacgcgctacctca

SEQ ID NO: 681165 - DNA, 25 bp, Artificial sequence
  Synthetic oligonucleotide
gtgcccactacgtcgcgctacctca

SEQ ID NO: 681166 - DNA, 25 bp, Artificial sequence
  Synthetic oligonucleotide
cggcctactgtcccgacacacggtt

SEQ ID NO: 681167 - DNA, 25 bp, Artificial sequence
  Synthetic oligonucleotide
ttcgctggcgtcgcgactacgtcac

SEQ ID NO: 681168 - DNA, 25 bp, Artificial sequence
  Synthetic oligonucleotide
agcggatacgatggacgcatggccg

SEQ ID NO: 681169 - DNA, 25 bp, Artificial sequence
  Synthetic oligonucleotide
gcggacacgacccctacgtttcagc

SEQ ID NO: 681170 - DNA, 25 bp, Artificial sequence
  Synthetic oligonucleotide
tcgcgtccgcggtcgtcaaaaggac

SEQ ID NO: 681171 - DNA, 25 bp, Artificial sequence
  Synthetic oligonucleotide
tcgcgtccgcggacgtcaaaaggac

SEQ ID NO: 681172 - DNA, 25 bp, Artificial sequence
  Synthetic oligonucleotide
gtcgtgcagtcgaccggtacttgcg

SEQ ID NO: 681173 - DNA, 25 bp, Artificial sequence
  Synthetic oligonucleotide
gtcgtgcagtcgtccggtacttgcg

SEQ ID NO: 681174 - DNA, 25 bp, Artificial sequence
  Synthetic oligonucleotide
aggaatcgtcacgcgtaccgtgccg

SEQ ID NO: 681175 - DNA, 25 bp, Artificial sequence
  Synthetic oligonucleotide
aggaatcgtcacccgtaccgtgccg

SEQ ID NO: 681176 - DNA, 25 bp, Artificial sequence
  Synthetic oligonucleotide
ctggagtataccgggcggtcgcatc

SEQ ID NO: 681177 - DNA, 25 bp, Artificial sequence
  Synthetic oligonucleotide
ctggagtatacccggcggtcgcatc

SEQ ID NO: 681178 - DNA, 25 bp, Artificial sequence
  Synthetic oligonucleotide
tccagtatacgccgaacccccgcct

SEQ ID NO: 681179 - DNA, 25 bp, Artificial sequence
  Synthetic oligonucleotide
ttcgctggcgtcccgactacgtcac

SEQ ID NO: 681180 - DNA, 25 bp, Artificial sequence
  Synthetic oligonucleotide
acgggtgtacgtagacgcgagtcgc

SEQ ID NO: 681181 - DNA, 25 bp, Artificial sequence
  Synthetic oligonucleotide
gggtcgctcgtcccgtacggagtaa

SEQ ID NO: 681182 - DNA, 25 bp, Artificial sequence
  Synthetic oligonucleotide
cgcatctcgccatgacgcggaaacg

SEQ ID NO: 681183 - DNA, 25 bp, Artificial sequence
  Synthetic oligonucleotide
cgcatctcgccaagacgcggaaacg

SEQ ID NO: 681184 - DNA, 25 bp, Artificial sequence
  Synthetic oligonucleotide
tcgccttaggacccgcgtactggag

SEQ ID NO: 681185 - DNA, 25 bp, Artificial sequence
  Synthetic oligonucleotide
tcgccttaggacgcgcgtactggag

SEQ ID NO: 681186 - DNA, 25 bp, Artificial sequence
  Synthetic oligonucleotide
accgggggcggtatgtcgatcgatg

SEQ ID NO: 681187 - DNA, 25 bp, Artificial sequence
  Synthetic oligonucleotide
accgggggcggtttgtcgatcgatg

SEQ ID NO: 681188 - DNA, 25 bp, Artificial sequence
  Synthetic oligonucleotide
agtcgcagcgtcggactaggctacg

SEQ ID NO: 681189 - DNA, 25 bp, Artificial sequence
  Synthetic oligonucleotide
agtcgcagcgtccgactaggctacg

SEQ ID NO: 681190 - DNA, 25 bp, Artificial sequence
  Synthetic oligonucleotide
agagaccgtgccctagcgagctctg

SEQ ID NO: 681191 - DNA, 25 bp, Artificial sequence
  Synthetic oligonucleotide
tgggaaactaacgcgcggcaagggc

SEQ ID NO: 681192 - DNA, 25 bp, Artificial sequence
  Synthetic oligonucleotide
acgggtgtacgttgacgcgagtcgc

SEQ ID NO: 681193 - DNA, 25 bp, Artificial sequence
  Synthetic oligonucleotide
cgttggtatccgagcgtcgacgcag

SEQ ID NO: 681194 - DNA, 25 bp, Artificial sequence
  Synthetic oligonucleotide
ggcgcgtatcgcagttacgggtctg

SEQ ID NO: 681195 - DNA, 25 bp, Artificial sequence
  Synthetic oligonucleotide
ggcgcgtatcgctgttacgggtctg

SEQ ID NO: 681196 - DNA, 25 bp, Artificial sequence
  Synthetic oligonucleotide
ttcttggcgttatgcggaccgcccc

SEQ ID NO: 681197 - DNA, 25 bp, Artificial sequence
  Synthetic oligonucleotide
ttcttggcgttaagcggaccgcccc

SEQ ID NO: 681198 - DNA, 25 bp, Artificial sequence
  Synthetic oligonucleotide
acggtccgcgcgtatgatcagtcgg

SEQ ID NO: 681199 - DNA, 25 bp, Artificial sequence
  Synthetic oligonucleotide
acggtccgcgcgaatgatcagtcgg

SEQ ID NO: 681200 - DNA, 25 bp, Artificial sequence
  Synthetic oligonucleotide
ggcctgcgcgccgtgttatgaggaa

SEQ ID NO: 681201 - DNA, 25 bp, Artificial sequence
  Synthetic oligonucleotide
ggcctgcgcgccctgttatgaggaa

SEQ ID NO: 681202 - DNA, 25 bp, Artificial sequence
  Synthetic oligonucleotide
gtccgcttcgaccccgcatgacaga

SEQ ID NO: 681203 - DNA, 25 bp, Artificial sequence
  Synthetic oligonucleotide
gtccgcttcgacgccgcatgacaga

SEQ ID NO: 681204 - DNA, 25 bp, Artificial sequence
  Synthetic oligonucleotide
agagaccgtgccgtagcgagctctg

SEQ ID NO: 681205 - DNA, 25 bp, Artificial sequence
  Synthetic oligonucleotide
ggacataacgcgcgccgatcaacgg

SEQ ID NO: 681206 - DNA, 25 bp, Artificial sequence
  Synthetic oligonucleotide
gcgttcgtccgtcgtagcgtgcaga

SEQ ID NO: 681207 - DNA, 25 bp, Artificial sequence
  Synthetic oligonucleotide
gcgttcgtccgtggtagcgtgcaga

SEQ ID NO: 681208 - DNA, 25 bp, Artificial sequence
  Synthetic oligonucleotide
tcgatcgtacacggcaacgacgggc

SEQ ID NO: 681209 - DNA, 25 bp, Artificial sequence
  Synthetic oligonucleotide
tcgatcgtacaccgcaacgacgggc

SEQ ID NO: 681210 - DNA, 25 bp, Artificial sequence
  Synthetic oligonucleotide
cggccccatcgatcgtacgcctagt

SEQ ID NO: 681211 - DNA, 25 bp, Artificial sequence
  Synthetic oligonucleotide
cggccccatcgaacgtacgcctagt

SEQ ID NO: 681212 - DNA, 25 bp, Artificial sequence
  Synthetic oligonucleotide
gacgaagacctatctcgcggtccgc

SEQ ID NO: 681213 - DNA, 25 bp, Artificial sequence
  Synthetic oligonucleotide
gacgaagacctaactcgcggtccgc

SEQ ID NO: 681214 - DNA, 25 bp, Artificial sequence
  Synthetic oligonucleotide
ggggcgttcggactatcggttcagg

SEQ ID NO: 681215 - DNA, 25 bp, Artificial sequence
  Synthetic oligonucleotide
ggggcgttcggagtatcggttcagg

SEQ ID NO: 681216 - DNA, 25 bp, Artificial sequence
  Synthetic oligonucleotide
tgggaaactaacccgcggcaagggc

SEQ ID NO: 681217 - DNA, 25 bp, Artificial sequence
  Synthetic oligonucleotide
tcgccaggacgcaatacgctgagcg

SEQ ID NO: 681218 - DNA, 25 bp, Artificial sequence
  Synthetic oligonucleotide
tcgagggttatgcgcgatcggcagc

SEQ ID NO: 681219 - DNA, 25 bp, Artificial sequence
  Synthetic oligonucleotide
ggacataacgcgggccgatcaacgg

SEQ ID NO: 681220 - DNA, 25 bp, Artificial sequence
  Synthetic oligonucleotide
gcttgcggtcgaccgtatgttcccg

SEQ ID NO: 681221 - DNA, 25 bp, Artificial sequence
  Synthetic oligonucleotide
gcttgcggtcgagcgtatgttcccg

SEQ ID NO: 681222 - DNA, 25 bp, Artificial sequence
  Synthetic oligonucleotide
tggcgttcgcggcgtacctttccgt

SEQ ID NO: 681223 - DNA, 25 bp, Artificial sequence
  Synthetic oligonucleotide
tggcgttcgcggggtacctttccgt

SEQ ID NO: 681224 - DNA, 25 bp, Artificial sequence
  Synthetic oligonucleotide
gcacgttacggcgcggttgcgatac

SEQ ID NO: 681225 - DNA, 25 bp, Artificial sequence
  Synthetic oligonucleotide
gcacgttacggcccggttgcgatac

SEQ ID NO: 681226 - DNA, 25 bp, Artificial sequence
  Synthetic oligonucleotide
gggcgacgcgtagtgacggaaacca

SEQ ID NO: 681227 - DNA, 25 bp, Artificial sequence
  Synthetic oligonucleotide
gggcgacgcgtactgacggaaacca

SEQ ID NO: 681228 - DNA, 25 bp, Artificial sequence
  Synthetic oligonucleotide
cgttggtatccgtgcgtcgacgcag

SEQ ID NO: 681229 - DNA, 25 bp, Artificial sequence
  Synthetic oligonucleotide
tcgccaggacgctatacgctgagcg

SEQ ID NO: 681230 - DNA, 25 bp, Artificial sequence
  Synthetic oligonucleotide
aggaccttaggcccgacggctactc

SEQ ID NO: 681231 - DNA, 25 bp, Artificial sequence
  Synthetic oligonucleotide
ctgaggtcgcgctcttacggtgacc

SEQ ID NO: 681232 - DNA, 25 bp, Artificial sequence
  Synthetic oligonucleotide
aggtcctagcgttcggcgacccaca

SEQ ID NO: 681233 - DNA, 25 bp, Artificial sequence
  Synthetic oligonucleotide
ggattcgttccgactcgcgagtccc

SEQ ID NO: 681234 - DNA, 25 bp, Artificial sequence
  Synthetic oligonucleotide
ggattcgttccgtctcgcgagtccc

SEQ ID NO: 681235 - DNA, 25 bp, Artificial sequence
  Synthetic oligonucleotide
tggtgggtccgcgtatcgaagcgtg

SEQ ID NO: 681236 - DNA, 25 bp, Artificial sequence
  Synthetic oligonucleotide
tggtgggtccgcctatcgaagcgtg

SEQ ID NO: 681237 - DNA, 25 bp, Artificial sequence
  Synthetic oligonucleotide
gcgactgatatcgcaggcgcccaac

SEQ ID NO: 681238 - DNA, 25 bp, Artificial sequence
  Synthetic oligonucleotide
gcgactgatatcccaggcgcccaac

SEQ ID NO: 681239 - DNA, 25 bp, Artificial sequence
  Synthetic oligonucleotide
gagggcatcggacgcgaatggttgg

SEQ ID NO: 681240 - DNA, 25 bp, Artificial sequence
  Synthetic oligonucleotide
gagggcatcggaggcgaatggttgg

SEQ ID NO: 681241 - DNA, 25 bp, Artificial sequence
  Synthetic oligonucleotide
ggcttggtatgcggcgtcaggagca

SEQ ID NO: 681242 - DNA, 25 bp, Artificial sequence
  Synthetic oligonucleotide
agcggtacggcgcgcgttaatgtcg

SEQ ID NO: 681243 - DNA, 25 bp, Artificial sequence
  Synthetic oligonucleotide
ggcttggtatgccgcgtcaggagca

SEQ ID NO: 681244 - DNA, 25 bp, Artificial sequence
  Synthetic oligonucleotide
aggaccttaggcgcgacggctactc

SEQ ID NO: 681245 - DNA, 25 bp, Artificial sequence
  Synthetic oligonucleotide
tacgcgggtcaccggtacggtcttg

SEQ ID NO: 681246 - DNA, 25 bp, Artificial sequence
  Synthetic oligonucleotide
tacgcgggtcacgggtacggtcttg

SEQ ID NO: 681247 - DNA, 25 bp, Artificial sequence
  Synthetic oligonucleotide
aggcgcagcccgcgtaagtatgacg

SEQ ID NO: 681248 - DNA, 25 bp, Artificial sequence
  Synthetic oligonucleotide
aggcgcagcccgggtaagtatgacg

SEQ ID NO: 681249 - DNA, 25 bp, Artificial sequence
  Synthetic oligonucleotide
ttcgcccggtcgctgcgtattctcc

SEQ ID NO: 681250 - DNA, 25 bp, Artificial sequence
  Synthetic oligonucleotide
ttcgcccggtcggtgcgtattctcc

SEQ ID NO: 681251 - DNA, 25 bp, Artificial sequence
  Synthetic oligonucleotide
cgcactccgacgacttacgggtgtc

SEQ ID NO: 681252 - DNA, 25 bp, Artificial sequence
  Synthetic oligonucleotide
ttgcggcgcttaccggtaggacgct

SEQ ID NO: 681253 - DNA, 25 bp, Artificial sequence
  Synthetic oligonucleotide
atttggccgcgacgtaacccacggc

SEQ ID NO: 681254 - DNA, 25 bp, Artificial sequence
  Synthetic oligonucleotide
agcggtacggcgggcgttaatgtcg

SEQ ID NO: 681255 - DNA, 25 bp, Artificial sequence
  Synthetic oligonucleotide
gcgcggtctgatacgtcgcgaactc

SEQ ID NO: 681256 - DNA, 25 bp, Artificial sequence
  Synthetic oligonucleotide
atttggccgcgaggtaacccacggc

SEQ ID NO: 681257 - DNA, 25 bp, Artificial sequence
  Synthetic oligonucleotide
gcgtctgcgcaattcatcgggctcg

SEQ ID NO: 681258 - DNA, 25 bp, Artificial sequence
  Synthetic oligonucleotide
gcgtctgcgcaaatcatcgggctcg

SEQ ID NO: 681259 - DNA, 25 bp, Artificial sequence
  Synthetic oligonucleotide
tgaccggtactcgacgtagcccacc

SEQ ID NO: 681260 - DNA, 25 bp, Artificial sequence
  Synthetic oligonucleotide
tgaccggtactccacgtagcccacc

SEQ ID NO: 681261 - DNA, 25 bp, Artificial sequence
  Synthetic oligonucleotide
cctccagctcgttgcgctaacggct

SEQ ID NO: 681262 - DNA, 25 bp, Artificial sequence
  Synthetic oligonucleotide
cctccagctcgtagcgctaacggct

SEQ ID NO: 681263 - DNA, 25 bp, Artificial sequence
  Synthetic oligonucleotide
tcccagggtacgttcgtacgccgag

SEQ ID NO: 681264 - DNA, 25 bp, Artificial sequence
  Synthetic oligonucleotide
tcccagggtacgatcgtacgccgag

SEQ ID NO: 681265 - DNA, 25 bp, Artificial sequence
  Synthetic oligonucleotide
cgtaactaccgaggaacgcgggctc

SEQ ID NO: 681266 - DNA, 25 bp, Artificial sequence
  Synthetic oligonucleotide
aggtcctagcgtacggcgacccaca

SEQ ID NO: 681267 - DNA, 25 bp, Artificial sequence
  Synthetic oligonucleotide
gcgcggtctgattcgtcgcgaactc

SEQ ID NO: 681268 - DNA, 25 bp, Artificial sequence
  Synthetic oligonucleotide
ctgaggtcgcgcacttacggtgacc

SEQ ID NO: 681269 - DNA, 25 bp, Artificial sequence
  Synthetic oligonucleotide
accgaccggtatctcgcgtgtcgga

SEQ ID NO: 681270 - DNA, 25 bp, Artificial sequence
  Synthetic oligonucleotide
accgaccggtatgtcgcgtgtcgga

SEQ ID NO: 681271 - DNA, 25 bp, Artificial sequence
  Synthetic oligonucleotide
atgtctgacctaaccgcgccggcca

SEQ ID NO: 681272 - DNA, 25 bp, Artificial sequence
  Synthetic oligonucleotide
atgtctgacctatccgcgccggcca

SEQ ID NO: 681273 - DNA, 25 bp, Artificial sequence
  Synthetic oligonucleotide
gtagggcggcggttaccgtggtatg

SEQ ID NO: 681274 - DNA, 25 bp, Artificial sequence
  Synthetic oligonucleotide
gtagggcggcggataccgtggtatg

SEQ ID NO: 681275 - DNA, 25 bp, Artificial sequence
  Synthetic oligonucleotide
aatcggcgtgcgttcgaccgcacag

SEQ ID NO: 681276 - DNA, 25 bp, Artificial sequence
  Synthetic oligonucleotide
aatcggcgtgcgatcgaccgcacag

SEQ ID NO: 681277 - DNA, 25 bp, Artificial sequence
  Synthetic oligonucleotide
caacctgtacgatccgggaaggggc

SEQ ID NO: 681278 - DNA, 25 bp, Artificial sequence
  Synthetic oligonucleotide
caacctgtacgaaccgggaaggggc

SEQ ID NO: 681279 - DNA, 25 bp, Artificial sequence
  Synthetic oligonucleotide
cgtaactaccgacgaacgcgggctc

SEQ ID NO: 681280 - DNA, 25 bp, Artificial sequence
  Synthetic oligonucleotide
gactgaagttcgggtaggctcgggc

SEQ ID NO: 681281 - DNA, 25 bp, Artificial sequence
  Synthetic oligonucleotide
caagggaaatcgccgcacggcctct

SEQ ID NO: 681282 - DNA, 25 bp, Artificial sequence
  Synthetic oligonucleotide
gtcgtaccgcgccactataggtccc

SEQ ID NO: 681283 - DNA, 25 bp, Artificial sequence
  Synthetic oligonucleotide
gtcgtaccgcgcgactataggtccc

SEQ ID NO: 681284 - DNA, 25 bp, Artificial sequence
  Synthetic oligonucleotide
gggctgtacgtcccgccaactcatg

SEQ ID NO: 681285 - DNA, 25 bp, Artificial sequence
  Synthetic oligonucleotide
gggctgtacgtcgcgccaactcatg

SEQ ID NO: 681286 - DNA, 25 bp, Artificial sequence
  Synthetic oligonucleotide
gctggtatcgccggctagtagccca

SEQ ID NO: 681287 - DNA, 25 bp, Artificial sequence
  Synthetic oligonucleotide
gctggtatcgcccgctagtagccca

SEQ ID NO: 681288 - DNA, 25 bp, Artificial sequence
  Synthetic oligonucleotide
tacgcgcgtaagagcggttcggtcc

SEQ ID NO: 681289 - DNA, 25 bp, Artificial sequence
  Synthetic oligonucleotide
tacgcgcgtaagtgcggttcggtcc

SEQ ID NO: 681290 - DNA, 25 bp, Artificial sequence
  Synthetic oligonucleotide
tcaggcacgtcccgacgtattgccg

SEQ ID NO: 681291 - DNA, 25 bp, Artificial sequence
  Synthetic oligonucleotide
gggtgactagcgcgcgtaatggcac

SEQ ID NO: 681292 - DNA, 25 bp, Artificial sequence
  Synthetic oligonucleotide
gactgaagttcgcgtaggctcgggc

SEQ ID NO: 681293 - DNA, 25 bp, Artificial sequence
  Synthetic oligonucleotide
cccggtaggtatcgcgaacctgacc

SEQ ID NO: 681294 - DNA, 25 bp, Artificial sequence
  Synthetic oligonucleotide
agggttcggcccaatcgtagagcgg

SEQ ID NO: 681295 - DNA, 25 bp, Artificial sequence
  Synthetic oligonucleotide
agggttcggccctatcgtagagcgg

SEQ ID NO: 681296 - DNA, 25 bp, Artificial sequence
  Synthetic oligonucleotide
ccatccacagcgtagcgcgttccga

SEQ ID NO: 681297 - DNA, 25 bp, Artificial sequence
  Synthetic oligonucleotide
ccatccacagcgaagcgcgttccga

SEQ ID NO: 681298 - DNA, 25 bp, Artificial sequence
  Synthetic oligonucleotide
ggcgggtgactcgcgtcgttcgttt

SEQ ID NO: 681299 - DNA, 25 bp, Artificial sequence
  Synthetic oligonucleotide
ggcgggtgactcccgtcgttcgttt

SEQ ID NO: 681300 - DNA, 25 bp, Artificial sequence
  Synthetic oligonucleotide
tccggcatagccgacggtcaacacc

SEQ ID NO: 681301 - DNA, 25 bp, Artificial sequence
  Synthetic oligonucleotide
tccggcatagcccacggtcaacacc

SEQ ID NO: 681302 - DNA, 25 bp, Artificial sequence
  Synthetic oligonucleotide
gccgtacgcgtttcgacgtggcgta

SEQ ID NO: 681303 - DNA, 25 bp, Artificial sequence
  Synthetic oligonucleotide
ttgcggcgcttagcggtaggacgct

SEQ ID NO: 681304 - DNA, 25 bp, Artificial sequence
  Synthetic oligonucleotide
tcaggcacgtccggacgtattgccg

SEQ ID NO: 681305 - DNA, 25 bp, Artificial sequence
  Synthetic oligonucleotide
agacgccgataggggtccgttggac

SEQ ID NO: 681306 - DNA, 25 bp, Artificial sequence
  Synthetic oligonucleotide
ggcccttcgcgcaaggtaggcagat

SEQ ID NO: 681307 - DNA, 25 bp, Artificial sequence
  Synthetic oligonucleotide
ggcccttcgcgctaggtaggcagat

SEQ ID NO: 681308 - DNA, 25 bp, Artificial sequence
  Synthetic oligonucleotide
acgaagtatcgcccgggcgtacgtc

SEQ ID NO: 681309 - DNA, 25 bp, Artificial sequence
  Synthetic oligonucleotide
acgaagtatcgcgcgggcgtacgtc

SEQ ID NO: 681310 - DNA, 25 bp, Artificial sequence
  Synthetic oligonucleotide
ccggcacgataccgactggctaacg

SEQ ID NO: 681311 - DNA, 25 bp, Artificial sequence
  Synthetic oligonucleotide
ccggcacgatacggactggctaacg

SEQ ID NO: 681312 - DNA, 25 bp, Artificial sequence
  Synthetic oligonucleotide
aagcgaagccgtagtcgcgctgcct

SEQ ID NO: 681313 - DNA, 25 bp, Artificial sequence
  Synthetic oligonucleotide
aagcgaagccgttgtcgcgctgcct

SEQ ID NO: 681314 - DNA, 25 bp, Artificial sequence
  Synthetic oligonucleotide
acatcctccgcgacgggtaggagct

SEQ ID NO: 681315 - DNA, 25 bp, Artificial sequence
  Synthetic oligonucleotide
acatcctccgcgtcgggtaggagct

SEQ ID NO: 681316 - DNA, 25 bp, Artificial sequence
  Synthetic oligonucleotide
gggtgactagcgggcgtaatggcac

SEQ ID NO: 681317 - DNA, 25 bp, Artificial sequence
  Synthetic oligonucleotide
tttgccttcgtccaccgcgaggcgt

SEQ ID NO: 681318 - DNA, 25 bp, Artificial sequence
  Synthetic oligonucleotide
cgcactccgacgtcttacgggtgtc

SEQ ID NO: 681319 - DNA, 25 bp, Artificial sequence
  Synthetic oligonucleotide
agacgccgatagcggtccgttggac

SEQ ID NO: 681320 - DNA, 25 bp, Artificial sequence
  Synthetic oligonucleotide
acctgctcgcgctccgtagaaggga

SEQ ID NO: 681321 - DNA, 25 bp, Artificial sequence
  Synthetic oligonucleotide
acctgctcgcgcaccgtagaaggga

SEQ ID NO: 681322 - DNA, 25 bp, Artificial sequence
  Synthetic oligonucleotide
gattgcgccgacgtctatccgtcgc

SEQ ID NO: 681323 - DNA, 25 bp, Artificial sequence
  Synthetic oligonucleotide
gattgcgccgacctctatccgtcgc

SEQ ID NO: 681324 - DNA, 25 bp, Artificial sequence
  Synthetic oligonucleotide
caggagcgcgcattggtccgatcgt

SEQ ID NO: 681325 - DNA, 25 bp, Artificial sequence
  Synthetic oligonucleotide
caggagcgcgcaatggtccgatcgt

SEQ ID NO: 681326 - DNA, 25 bp, Artificial sequence
  Synthetic oligonucleotide
gtggcactcttacgacgcggcttcc

SEQ ID NO: 681327 - DNA, 25 bp, Artificial sequence
  Synthetic oligonucleotide
gtggcactcttaggacgcggcttcc

SEQ ID NO: 681328 - DNA, 25 bp, Artificial sequence
  Synthetic oligonucleotide
cccggtaggtatggcgaacctgacc

SEQ ID NO: 681329 - DNA, 25 bp, Artificial sequence
  Synthetic oligonucleotide
tttgccttcgtcgaccgcgaggcgt

SEQ ID NO: 681330 - DNA, 25 bp, Artificial sequence
  Synthetic oligonucleotide
agccaatgcctaacgcgcccatggg

SEQ ID NO: 681331 - DNA, 25 bp, Artificial sequence
  Synthetic oligonucleotide
agtgccacgcgtggatagcgtggag

SEQ ID NO: 681332 - DNA, 25 bp, Artificial sequence
  Synthetic oligonucleotide
gcccagaatccgcgcgacaggaagt

SEQ ID NO: 681333 - DNA, 25 bp, Artificial sequence
  Synthetic oligonucleotide
ccgctgactagaacggcgcagccta

SEQ ID NO: 681334 - DNA, 25 bp, Artificial sequence
  Synthetic oligonucleotide
ccgctgactagatcggcgcagccta

SEQ ID NO: 681335 - DNA, 25 bp, Artificial sequence
  Synthetic oligonucleotide
gaaccattacgcacggcgacaccgc

SEQ ID NO: 681336 - DNA, 25 bp, Artificial sequence
  Synthetic oligonucleotide
gaaccattacgctcggcgacaccgc

SEQ ID NO: 681337 - DNA, 25 bp, Artificial sequence
  Synthetic oligonucleotide
cacaccgctacgacggacagctcga

SEQ ID NO: 681338 - DNA, 25 bp, Artificial sequence
  Synthetic oligonucleotide
cacaccgctacgtcggacagctcga

SEQ ID NO: 681339 - DNA, 25 bp, Artificial sequence
  Synthetic oligonucleotide
gtaagccccgtcccgtacggatcca

SEQ ID NO: 681340 - DNA, 25 bp, Artificial sequence
  Synthetic oligonucleotide
gtaagccccgtcgcgtacggatcca

SEQ ID NO: 681341 - DNA, 25 bp, Artificial sequence
  Synthetic oligonucleotide
ccacacatcggtcgcgcacgggaat

SEQ ID NO: 681342 - DNA, 25 bp, Artificial sequence
  Synthetic oligonucleotide
tcgtcagggcgtactcgcacagctc

SEQ ID NO: 681343 - DNA, 25 bp, Artificial sequence
  Synthetic oligonucleotide
cccagcacgcgtagtaccggggtta

SEQ ID NO: 681344 - DNA, 25 bp, Artificial sequence
  Synthetic oligonucleotide
agccaatgcctatcgcgcccatggg

SEQ ID NO: 681345 - DNA, 25 bp, Artificial sequence
  Synthetic oligonucleotide
ccgagtttaactgcgcgcggccatc

SEQ ID NO: 681346 - DNA, 25 bp, Artificial sequence
  Synthetic oligonucleotide
ccgagtttaactccgcgcggccatc

SEQ ID NO: 681347 - DNA, 25 bp, Artificial sequence
  Synthetic oligonucleotide
cctcgtccgcgttgcgttggcagta

SEQ ID NO: 681348 - DNA, 25 bp, Artificial sequence
  Synthetic oligonucleotide
cctcgtccgcgtagcgttggcagta

SEQ ID NO: 681349 - DNA, 25 bp, Artificial sequence
  Synthetic oligonucleotide
ctgtgaaccgaccgcgaatgcacgg

SEQ ID NO: 681350 - DNA, 25 bp, Artificial sequence
  Synthetic oligonucleotide
ctgtgaaccgacggcgaatgcacgg

SEQ ID NO: 681351 - DNA, 25 bp, Artificial sequence
  Synthetic oligonucleotide
acggagttacgcgacctacgcgtcc

SEQ ID NO: 681352 - DNA, 25 bp, Artificial sequence
  Synthetic oligonucleotide
acggagttacgccacctacgcgtcc

SEQ ID NO: 681353 - DNA, 25 bp, Artificial sequence
  Synthetic oligonucleotide
agtgccacgcgtcgatagcgtggag

SEQ ID NO: 681354 - DNA, 25 bp, Artificial sequence
  Synthetic oligonucleotide
tcgtcagggcgttctcgcacagctc

SEQ ID NO: 681355 - DNA, 25 bp, Artificial sequence
  Synthetic oligonucleotide
aagcagtgtaccaccggcggggact

SEQ ID NO: 681356 - DNA, 25 bp, Artificial sequence
  Synthetic oligonucleotide
cacctcataccgcacgcgttcggtc

SEQ ID NO: 681357 - DNA, 25 bp, Artificial sequence
  Synthetic oligonucleotide
caagggaaatcggcgcacggcctct

SEQ ID NO: 681358 - DNA, 25 bp, Artificial sequence
  Synthetic oligonucleotide
gtcacagggtcgggtcgaatgctcg

SEQ ID NO: 681359 - DNA, 25 bp, Artificial sequence
  Synthetic oligonucleotide
gcccagaatccgggcgacaggaagt

SEQ ID NO: 681360 - DNA, 25 bp, Artificial sequence
  Synthetic oligonucleotide
gcttgtccgtggtacgcgaacgtgc

SEQ ID NO: 681361 - DNA, 25 bp, Artificial sequence
  Synthetic oligonucleotide
gcttgtccgtggaacgcgaacgtgc

SEQ ID NO: 681362 - DNA, 25 bp, Artificial sequence
  Synthetic oligonucleotide
gctggagacctacgtaccgcaccac

SEQ ID NO: 681363 - DNA, 25 bp, Artificial sequence
  Synthetic oligonucleotide
gctggagacctaggtaccgcaccac

SEQ ID NO: 681364 - DNA, 25 bp, Artificial sequence
  Synthetic oligonucleotide
ggccatgcgcgtataaccgggtagg

SEQ ID NO: 681365 - DNA, 25 bp, Artificial sequence
  Synthetic oligonucleotide
ggccatgcgcgtttaaccgggtagg

SEQ ID NO: 681366 - DNA, 25 bp, Artificial sequence
  Synthetic oligonucleotide
aaacaccgttacgaccgcgcctggc

SEQ ID NO: 681367 - DNA, 25 bp, Artificial sequence
  Synthetic oligonucleotide
cagatgcgccgttgggtaagtcccg

SEQ ID NO: 681368 - DNA, 25 bp, Artificial sequence
  Synthetic oligonucleotide
aaacaccgttaccaccgcgcctggc

SEQ ID NO: 681369 - DNA, 25 bp, Artificial sequence
  Synthetic oligonucleotide
aagcagtgtacctccggcggggact

SEQ ID NO: 681370 - DNA, 25 bp, Artificial sequence
  Synthetic oligonucleotide
ggctcgcgttagcggatgcaaaccg

SEQ ID NO: 681371 - DNA, 25 bp, Artificial sequence
  Synthetic oligonucleotide
ggctcgcgttaggggatgcaaaccg

SEQ ID NO: 681372 - DNA, 25 bp, Artificial sequence
  Synthetic oligonucleotide
gcactcacgtcgcacgtcccatcac

SEQ ID NO: 681373 - DNA, 25 bp, Artificial sequence
  Synthetic oligonucleotide
gcactcacgtcggacgtcccatcac

SEQ ID NO: 681374 - DNA, 25 bp, Artificial sequence
  Synthetic oligonucleotide
cgcttatagcgttcgtcgcccgtgc

SEQ ID NO: 681375 - DNA, 25 bp, Artificial sequence
  Synthetic oligonucleotide
cgcttatagcgtacgtcgcccgtgc

SEQ ID NO: 681376 - DNA, 25 bp, Artificial sequence
  Synthetic oligonucleotide
gggcattaacgaggtccgccgctca

SEQ ID NO: 681377 - DNA, 25 bp, Artificial sequence
  Synthetic oligonucleotide
gggcattaacgacgtccgccgctca

SEQ ID NO: 681378 - DNA, 25 bp, Artificial sequence
  Synthetic oligonucleotide
cccagcacgcgttgtaccggggtta

SEQ ID NO: 681379 - DNA, 25 bp, Artificial sequence
  Synthetic oligonucleotide
cagatgcgccgtagggtaagtcccg

SEQ ID NO: 681380 - DNA, 25 bp, Artificial sequence
  Synthetic oligonucleotide
gaatcgaggtccgtagcgcagcgca

SEQ ID NO: 681381 - DNA, 25 bp, Artificial sequence
  Synthetic oligonucleotide
ctctgctatgcccaccgttcacggg

SEQ ID NO: 681382 - DNA, 25 bp, Artificial sequence
  Synthetic oligonucleotide
agcatggacgtatcgcgcgtctccc

SEQ ID NO: 681383 - DNA, 25 bp, Artificial sequence
  Synthetic oligonucleotide
agcatggacgtaacgcgcgtctccc

SEQ ID NO: 681384 - DNA, 25 bp, Artificial sequence
  Synthetic oligonucleotide
gggagacgacgttgcgcgatgctct

SEQ ID NO: 681385 - DNA, 25 bp, Artificial sequence
  Synthetic oligonucleotide
gggagacgacgtagcgcgatgctct

SEQ ID NO: 681386 - DNA, 25 bp, Artificial sequence
  Synthetic oligonucleotide
tggaagtcgagcgtgatcggggcct

SEQ ID NO: 681387 - DNA, 25 bp, Artificial sequence
  Synthetic oligonucleotide
tggaagtcgagcctgatcggggcct

SEQ ID NO: 681388 - DNA, 25 bp, Artificial sequence
  Synthetic oligonucleotide
tcccgtcacgcgctatcgtaggtgc

SEQ ID NO: 681389 - DNA, 25 bp, Artificial sequence
  Synthetic oligonucleotide
tcccgtcacgcggtatcgtaggtgc

SEQ ID NO: 681390 - DNA, 25 bp, Artificial sequence
  Synthetic oligonucleotide
ccggaagtccggtcgtacgaagcga

SEQ ID NO: 681391 - DNA, 25 bp, Artificial sequence
  Synthetic oligonucleotide
ctctgctatgccgaccgttcacggg

SEQ ID NO: 681392 - DNA, 25 bp, Artificial sequence
  Synthetic oligonucleotide
gaatcgaggtccctagcgcagcgca

SEQ ID NO: 681393 - DNA, 25 bp, Artificial sequence
  Synthetic oligonucleotide
aatcagcgagtaaccgcgggggcac

SEQ ID NO: 681394 - DNA, 25 bp, Artificial sequence
  Synthetic oligonucleotide
tgcaaccgtaaccgccgaagccggt

SEQ ID NO: 681395 - DNA, 25 bp, Artificial sequence
  Synthetic oligonucleotide
tgcaaccgtaacggccgaagccggt

SEQ ID NO: 681396 - DNA, 25 bp, Artificial sequence
  Synthetic oligonucleotide
ccgagcgggtctggtacgacggtaa

SEQ ID NO: 681397 - DNA, 25 bp, Artificial sequence
  Synthetic oligonucleotide
ccgagcgggtctcgtacgacggtaa

SEQ ID NO: 681398 - DNA, 25 bp, Artificial sequence
  Synthetic oligonucleotide
cggacccgcgacccctatatcctga

SEQ ID NO: 681399 - DNA, 25 bp, Artificial sequence
  Synthetic oligonucleotide
cggacccgcgacgcctatatcctga

SEQ ID NO: 681400 - DNA, 25 bp, Artificial sequence
  Synthetic oligonucleotide
gaacgccgcaaacggctagtccacg

SEQ ID NO: 681401 - DNA, 25 bp, Artificial sequence
  Synthetic oligonucleotide
gaacgccgcaaagggctagtccacg

SEQ ID NO: 681402 - DNA, 25 bp, Artificial sequence
  Synthetic oligonucleotide
aatcagcgagtatccgcgggggcac

SEQ ID NO: 681403 - DNA, 25 bp, Artificial sequence
  Synthetic oligonucleotide
ccacacatcggtggcgcacgggaat

SEQ ID NO: 681404 - DNA, 25 bp, Artificial sequence
  Synthetic oligonucleotide
gtcacagggtcgcgtcgaatgctcg

SEQ ID NO: 681405 - DNA, 25 bp, Artificial sequence
  Synthetic oligonucleotide
ccggaagtccggacgtacgaagcga

SEQ ID NO: 681406 - DNA, 25 bp, Artificial sequence
  Synthetic oligonucleotide
ggtacgccgacgcgtacttcggcta

SEQ ID NO: 681407 - DNA, 25 bp, Artificial sequence
  Synthetic oligonucleotide
cgcacttctacgggcgtcgaccagt

SEQ ID NO: 681408 - DNA, 25 bp, Artificial sequence
  Synthetic oligonucleotide
cgcacttctacgcgcgtcgaccagt

SEQ ID NO: 681409 - DNA, 25 bp, Artificial sequence
  Synthetic oligonucleotide
ggtacgccgacgggtacttcggcta

SEQ ID NO: 681410 - DNA, 25 bp, Artificial sequence
  Synthetic oligonucleotide
ggctcgtaacgccacgttgctggtg

SEQ ID NO: 681411 - DNA, 25 bp, Artificial sequence
  Synthetic oligonucleotide
ggctcgtaacgcgacgttgctggtg

SEQ ID NO: 681412 - DNA, 25 bp, Artificial sequence
  Synthetic oligonucleotide
tcggcataagccggccgtaggcaga

SEQ ID NO: 681413 - DNA, 25 bp, Artificial sequence
  Synthetic oligonucleotide
tcggcataagcccgccgtaggcaga

SEQ ID NO: 681414 - DNA, 25 bp, Artificial sequence
  Synthetic oligonucleotide
caccacgtaccggtacgaccctagc

SEQ ID NO: 681415 - DNA, 25 bp, Artificial sequence
  Synthetic oligonucleotide
caccacgtaccgctacgaccctagc

SEQ ID NO: 681416 - DNA, 25 bp, Artificial sequence
  Synthetic oligonucleotide
tgctagggtccgcaacgttgccgca

SEQ ID NO: 681417 - DNA, 25 bp, Artificial sequence
  Synthetic oligonucleotide
tgctagggtccggaacgttgccgca

SEQ ID NO: 681418 - DNA, 25 bp, Artificial sequence
  Synthetic oligonucleotide
ggtgggcctagcccggtttcccaaa

SEQ ID NO: 681419 - DNA, 25 bp, Artificial sequence
  Synthetic oligonucleotide
ggaccccgtatactcgggcctatcg

SEQ ID NO: 681420 - DNA, 25 bp, Artificial sequence
  Synthetic oligonucleotide
gtccgcacattacgcgcccgctaac

SEQ ID NO: 681421 - DNA, 25 bp, Artificial sequence
  Synthetic oligonucleotide
ctgagccgagcccactatcttccgg

SEQ ID NO: 681422 - DNA, 25 bp, Artificial sequence
  Synthetic oligonucleotide
gtccgcacattaggcgcccgctaac

SEQ ID NO: 681423 - DNA, 25 bp, Artificial sequence
  Synthetic oligonucleotide
ggtgggcctagcgcggtttcccaaa

SEQ ID NO: 681424 - DNA, 25 bp, Artificial sequence
  Synthetic oligonucleotide
gtgggcagttatatcgcgcgacccg

SEQ ID NO: 681425 - DNA, 25 bp, Artificial sequence
  Synthetic oligonucleotide
gtgggcagttatttcgcgcgacccg

SEQ ID NO: 681426 - DNA, 25 bp, Artificial sequence
  Synthetic oligonucleotide
gtagaacgttgttcccgcgcgtggg

SEQ ID NO: 681427 - DNA, 25 bp, Artificial sequence
  Synthetic oligonucleotide
gtagaacgttgtacccgcgcgtggg

SEQ ID NO: 681428 - DNA, 25 bp, Artificial sequence
  Synthetic oligonucleotide
ggaccccgtatagtcgggcctatcg

SEQ ID NO: 681429 - DNA, 25 bp, Artificial sequence
  Synthetic oligonucleotide
ctgagccgagccgactatcttccgg

SEQ ID NO: 681430 - DNA, 25 bp, Artificial sequence
  Synthetic oligonucleotide
cggtccgcggttggcggaatgatcg

SEQ ID NO: 681431 - DNA, 25 bp, Artificial sequence
  Synthetic oligonucleotide
gtgctgtcggacctgcgagcgttgc

SEQ ID NO: 681432 - DNA, 25 bp, Artificial sequence
  Synthetic oligonucleotide
agaggtgtccggcgtcataccccgc

SEQ ID NO: 681433 - DNA, 25 bp, Artificial sequence
  Synthetic oligonucleotide
agaggtgtccggggtcataccccgc

SEQ ID NO: 681434 - DNA, 25 bp, Artificial sequence
  Synthetic oligonucleotide
cggtccgcggttcgcggaatgatcg

SEQ ID NO: 681435 - DNA, 25 bp, Artificial sequence
  Synthetic oligonucleotide
tcagtgagcgggacgtacgggtgcc

SEQ ID NO: 681436 - DNA, 25 bp, Artificial sequence
  Synthetic oligonucleotide
tcagtgagcgggtcgtacgggtgcc

SEQ ID NO: 681437 - DNA, 25 bp, Artificial sequence
  Synthetic oligonucleotide
gtgctgtcggacgtgcgagcgttgc

SEQ ID NO: 681438 - DNA, 25 bp, Artificial sequence
  Synthetic oligonucleotide
ccggcctcgcgccttgacatcgcta

SEQ ID NO: 681439 - DNA, 25 bp, Artificial sequence
  Synthetic oligonucleotide
aggtcgcgaccacggtacgagtggc

SEQ ID NO: 681440 - DNA, 25 bp, Artificial sequence
  Synthetic oligonucleotide
ccggcctcgcgcgttgacatcgcta

SEQ ID NO: 681441 - DNA, 25 bp, Artificial sequence
  Synthetic oligonucleotide
ttggggcgcgtacgatgtcgccgct

SEQ ID NO: 681442 - DNA, 25 bp, Artificial sequence
  Synthetic oligonucleotide
ttggggcgcgtaggatgtcgccgct

SEQ ID NO: 681443 - DNA, 25 bp, Artificial sequence
  Synthetic oligonucleotide
gctcctgcgtcgggctataggggtg

SEQ ID NO: 681444 - DNA, 25 bp, Artificial sequence
  Synthetic oligonucleotide
gctcctgcgtcgcgctataggggtg

SEQ ID NO: 681445 - DNA, 25 bp, Artificial sequence
  Synthetic oligonucleotide
cttaggcgccataggatcgcccggc

SEQ ID NO: 681446 - DNA, 25 bp, Artificial sequence
  Synthetic oligonucleotide
tctggacgtacgtccgcgtcgggtg

SEQ ID NO: 681447 - DNA, 25 bp, Artificial sequence
  Synthetic oligonucleotide
aggtcgcgaccagggtacgagtggc

SEQ ID NO: 681448 - DNA, 25 bp, Artificial sequence
  Synthetic oligonucleotide
gcctgccggagccttacgcgtacct

SEQ ID NO: 681449 - DNA, 25 bp, Artificial sequence
  Synthetic oligonucleotide
gcctgccggagcgttacgcgtacct

SEQ ID NO: 681450 - DNA, 25 bp, Artificial sequence
  Synthetic oligonucleotide
tcgcggcgtcgttcgtcggtctgga

SEQ ID NO: 681451 - DNA, 25 bp, Artificial sequence
  Synthetic oligonucleotide
gggtaggcggtccgcactaggtcga

SEQ ID NO: 681452 - DNA, 25 bp, Artificial sequence
  Synthetic oligonucleotide
cttaggcgccattggatcgcccggc

SEQ ID NO: 681453 - DNA, 25 bp, Artificial sequence
  Synthetic oligonucleotide
tctggacgtacgaccgcgtcgggtg

SEQ ID NO: 681454 - DNA, 25 bp, Artificial sequence
  Synthetic oligonucleotide
gggtaggcggtcggcactaggtcga

SEQ ID NO: 681455 - DNA, 25 bp, Artificial sequence
  Synthetic oligonucleotide
gaatgccgtacgtcgcgccccctgt

SEQ ID NO: 681456 - DNA, 25 bp, Artificial sequence
  Synthetic oligonucleotide
tgacccctagcggaagccgtctgcc

SEQ ID NO: 681457 - DNA, 25 bp, Artificial sequence
  Synthetic oligonucleotide
tgacccctagcgcaagccgtctgcc

SEQ ID NO: 681458 - DNA, 25 bp, Artificial sequence
  Synthetic oligonucleotide
tcgcccctctacccgccgatgccta

SEQ ID NO: 681459 - DNA, 25 bp, Artificial sequence
  Synthetic oligonucleotide
tcgcccctctacgcgccgatgccta

SEQ ID NO: 681460 - DNA, 25 bp, Artificial sequence
  Synthetic oligonucleotide
cggcaaaggcgcggtatcgcgcgat

SEQ ID NO: 681461 - DNA, 25 bp, Artificial sequence
  Synthetic oligonucleotide
cggcaaaggcgccgtatcgcgcgat

SEQ ID NO: 681462 - DNA, 25 bp, Artificial sequence
  Synthetic oligonucleotide
cacgtcgtacggttcgcggcagtgc

SEQ ID NO: 681463 - DNA, 25 bp, Artificial sequence
  Synthetic oligonucleotide
cacgtcgtacggatcgcggcagtgc

SEQ ID NO: 681464 - DNA, 25 bp, Artificial sequence
  Synthetic oligonucleotide
agcccccccgcgaatcgggatgatg

SEQ ID NO: 681465 - DNA, 25 bp, Artificial sequence
  Synthetic oligonucleotide
ggatgccgcgagtctaagcgcccct

SEQ ID NO: 681466 - DNA, 25 bp, Artificial sequence
  Synthetic oligonucleotide
gactcgatagccccgcgcgagctac

SEQ ID NO: 681467 - DNA, 25 bp, Artificial sequence
  Synthetic oligonucleotide
tcgcggcgtcgtacgtcggtctgga

SEQ ID NO: 681468 - DNA, 25 bp, Artificial sequence
  Synthetic oligonucleotide
gaatgccgtacgacgcgccccctgt

SEQ ID NO: 681469 - DNA, 25 bp, Artificial sequence
  Synthetic oligonucleotide
ggatgccgcgagactaagcgcccct

SEQ ID NO: 681470 - DNA, 25 bp, Artificial sequence
  Synthetic oligonucleotide
tgctccgggtacctcgagcgcagag

SEQ ID NO: 681471 - DNA, 25 bp, Artificial sequence
  Synthetic oligonucleotide
tgctccgggtacgtcgagcgcagag

SEQ ID NO: 681472 - DNA, 25 bp, Artificial sequence
  Synthetic oligonucleotide
cgctgtccgacgtacgactgccagc

SEQ ID NO: 681473 - DNA, 25 bp, Artificial sequence
  Synthetic oligonucleotide
cgctgtccgacgaacgactgccagc

SEQ ID NO: 681474 - DNA, 25 bp, Artificial sequence
  Synthetic oligonucleotide
tgcggttcgcgcgtacgactccgag

SEQ ID NO: 681475 - DNA, 25 bp, Artificial sequence
  Synthetic oligonucleotide
tgcggttcgcgcctacgactccgag

SEQ ID NO: 681476 - DNA, 25 bp, Artificial sequence
  Synthetic oligonucleotide
gtgcgagtcgtaccgcgaccttgcc

SEQ ID NO: 681477 - DNA, 25 bp, Artificial sequence
  Synthetic oligonucleotide
gtgcgagtcgtagcgcgaccttgcc

SEQ ID NO: 681478 - DNA, 25 bp, Artificial sequence
  Synthetic oligonucleotide
agcccccccgcgtatcgggatgatg

SEQ ID NO: 681479 - DNA, 25 bp, Artificial sequence
  Synthetic oligonucleotide
agccgctacggtcccgacgtaggca

SEQ ID NO: 681480 - DNA, 25 bp, Artificial sequence
  Synthetic oligonucleotide
gcgagaacgcggtaacgcccgtgac

SEQ ID NO: 681481 - DNA, 25 bp, Artificial sequence
  Synthetic oligonucleotide
tgcgccttaccgcgtcggtgttgcc

SEQ ID NO: 681482 - DNA, 25 bp, Artificial sequence
  Synthetic oligonucleotide
tgcgccttaccgggtcggtgttgcc

SEQ ID NO: 681483 - DNA, 25 bp, Artificial sequence
  Synthetic oligonucleotide
gagcccgcgcgtaataacgcccgga

SEQ ID NO: 681484 - DNA, 25 bp, Artificial sequence
  Synthetic oligonucleotide
gagcccgcgcgttataacgcccgga

SEQ ID NO: 681485 - DNA, 25 bp, Artificial sequence
  Synthetic oligonucleotide
gatgcccgcaataccccgcgagctg

SEQ ID NO: 681486 - DNA, 25 bp, Artificial sequence
  Synthetic oligonucleotide
gatgcccgcaattccccgcgagctg

SEQ ID NO: 681487 - DNA, 25 bp, Artificial sequence
  Synthetic oligonucleotide
cgcagatacggccggtccgttcgac

SEQ ID NO: 681488 - DNA, 25 bp, Artificial sequence
  Synthetic oligonucleotide
cgcagatacggcgggtccgttcgac

SEQ ID NO: 681489 - DNA, 25 bp, Artificial sequence
  Synthetic oligonucleotide
ggtgcgattcgagcgtcggggacac

SEQ ID NO: 681490 - DNA, 25 bp, Artificial sequence
  Synthetic oligonucleotide
cggtcctagcgttgaccgcatgcgc

SEQ ID NO: 681491 - DNA, 25 bp, Artificial sequence
  Synthetic oligonucleotide
agccgctacggtgccgacgtaggca

SEQ ID NO: 681492 - DNA, 25 bp, Artificial sequence
  Synthetic oligonucleotide
tgaaccagcgcgacgtaccgcaggc

SEQ ID NO: 681493 - DNA, 25 bp, Artificial sequence
  Synthetic oligonucleotide
acttcgcgaacgccctacggcacgg

SEQ ID NO: 681494 - DNA, 25 bp, Artificial sequence
  Synthetic oligonucleotide
acttcgcgaacggcctacggcacgg

SEQ ID NO: 681495 - DNA, 25 bp, Artificial sequence
  Synthetic oligonucleotide
acagcgtggtctagcgcgaggtgcc

SEQ ID NO: 681496 - DNA, 25 bp, Artificial sequence
  Synthetic oligonucleotide
acagcgtggtcttgcgcgaggtgcc

SEQ ID NO: 681497 - DNA, 25 bp, Artificial sequence
  Synthetic oligonucleotide
gcggcaacgggtcgaccgaagcgta

SEQ ID NO: 681498 - DNA, 25 bp, Artificial sequence
  Synthetic oligonucleotide
gcggcaacgggtggaccgaagcgta

SEQ ID NO: 681499 - DNA, 25 bp, Artificial sequence
  Synthetic oligonucleotide
gcgagaacgcggaaacgcccgtgac

SEQ ID NO: 681500 - DNA, 25 bp, Artificial sequence
  Synthetic oligonucleotide
tcaggggcgtccgacgtcttcgcgt

SEQ ID NO: 681501 - DNA, 25 bp, Artificial sequence
  Synthetic oligonucleotide
tcaggggcgtcccacgtcttcgcgt

SEQ ID NO: 681502 - DNA, 25 bp, Artificial sequence
  Synthetic oligonucleotide
cggtaaggtaatcgcgcggcccgca

SEQ ID NO: 681503 - DNA, 25 bp, Artificial sequence
  Synthetic oligonucleotide
ggtgcgattcgaccgtcggggacac

SEQ ID NO: 681504 - DNA, 25 bp, Artificial sequence
  Synthetic oligonucleotide
aatgcccctaaccgccgactgcgcc

SEQ ID NO: 681505 - DNA, 25 bp, Artificial sequence
  Synthetic oligonucleotide
cccctagccgtgctacgcgctcaag

SEQ ID NO: 681506 - DNA, 25 bp, Artificial sequence
  Synthetic oligonucleotide
cccctagccgtggtacgcgctcaag

SEQ ID NO: 681507 - DNA, 25 bp, Artificial sequence
  Synthetic oligonucleotide
ccgtccctgttaggtcgcgacaggc

SEQ ID NO: 681508 - DNA, 25 bp, Artificial sequence
  Synthetic oligonucleotide
ccgtccctgttacgtcgcgacaggc

SEQ ID NO: 681509 - DNA, 25 bp, Artificial sequence
  Synthetic oligonucleotide
cgcatcgtcgcggagcgaagccaac

SEQ ID NO: 681510 - DNA, 25 bp, Artificial sequence
  Synthetic oligonucleotide
cgcatcgtcgcgcagcgaagccaac

SEQ ID NO: 681511 - DNA, 25 bp, Artificial sequence
  Synthetic oligonucleotide
aaccggagccgagcgcgtaagccca

SEQ ID NO: 681512 - DNA, 25 bp, Artificial sequence
  Synthetic oligonucleotide
aaccggagccgaccgcgtaagccca

SEQ ID NO: 681513 - DNA, 25 bp, Artificial sequence
  Synthetic oligonucleotide
tgccggcccaacctacgcgtggcat

SEQ ID NO: 681514 - DNA, 25 bp, Artificial sequence
  Synthetic oligonucleotide
tgccggcccaacgtacgcgtggcat

SEQ ID NO: 681515 - DNA, 25 bp, Artificial sequence
  Synthetic oligonucleotide
cggtcctagcgtagaccgcatgcgc

SEQ ID NO: 681516 - DNA, 25 bp, Artificial sequence
  Synthetic oligonucleotide
gcaacatgcgtcgtgcgacctgcgg

SEQ ID NO: 681517 - DNA, 25 bp, Artificial sequence
  Synthetic oligonucleotide
gactcgatagccgcgcgcgagctac

SEQ ID NO: 681518 - DNA, 25 bp, Artificial sequence
  Synthetic oligonucleotide
aatgcccctaacggccgactgcgcc

SEQ ID NO: 681519 - DNA, 25 bp, Artificial sequence
  Synthetic oligonucleotide
tacacggtccgaacgcggaacgggc

SEQ ID NO: 681520 - DNA, 25 bp, Artificial sequence
  Synthetic oligonucleotide
tacacggtccgatcgcggaacgggc

SEQ ID NO: 681521 - DNA, 25 bp, Artificial sequence
  Synthetic oligonucleotide
tgcgtcggtcgcggggtatgtggtc

SEQ ID NO: 681522 - DNA, 25 bp, Artificial sequence
  Synthetic oligonucleotide
tgcgtcggtcgccgggtatgtggtc

SEQ ID NO: 681523 - DNA, 25 bp, Artificial sequence
  Synthetic oligonucleotide
tgcccaacggtccatagcgccacgg

SEQ ID NO: 681524 - DNA, 25 bp, Artificial sequence
  Synthetic oligonucleotide
tgcccaacggtcgatagcgccacgg

SEQ ID NO: 681525 - DNA, 25 bp, Artificial sequence
  Synthetic oligonucleotide
acttcccgcgcgatagacgcgccca

SEQ ID NO: 681526 - DNA, 25 bp, Artificial sequence
  Synthetic oligonucleotide
acttcccgcgcgttagacgcgccca

SEQ ID NO: 681527 - DNA, 25 bp, Artificial sequence
  Synthetic oligonucleotide
tgaaccagcgcgtcgtaccgcaggc

SEQ ID NO: 681528 - DNA, 25 bp, Artificial sequence
  Synthetic oligonucleotide
gcaacatgcgtcctgcgacctgcgg

SEQ ID NO: 681529 - DNA, 25 bp, Artificial sequence
  Synthetic oligonucleotide
ttccgcgtagggtacgcgacctgcc

SEQ ID NO: 681530 - DNA, 25 bp, Artificial sequence
  Synthetic oligonucleotide
tcacggcgcctaggtaccgggacct

SEQ ID NO: 681531 - DNA, 25 bp, Artificial sequence
  Synthetic oligonucleotide
tacgcgacgaccccgtcgtgacctg

SEQ ID NO: 681532 - DNA, 25 bp, Artificial sequence
  Synthetic oligonucleotide
gcgtgtctaacgtcgaccagggggg

SEQ ID NO: 681533 - DNA, 25 bp, Artificial sequence
  Synthetic oligonucleotide
gcgtgtctaacgacgaccagggggg

SEQ ID NO: 681534 - DNA, 25 bp, Artificial sequence
  Synthetic oligonucleotide
cgccatagcgcgaagcacgctgcag

SEQ ID NO: 681535 - DNA, 25 bp, Artificial sequence
  Synthetic oligonucleotide
cgccatagcgcgtagcacgctgcag

SEQ ID NO: 681536 - DNA, 25 bp, Artificial sequence
  Synthetic oligonucleotide
gcgtaccggtccgtacgaaggtggc

SEQ ID NO: 681537 - DNA, 25 bp, Artificial sequence
  Synthetic oligonucleotide
gcgtaccggtccctacgaaggtggc

SEQ ID NO: 681538 - DNA, 25 bp, Artificial sequence
  Synthetic oligonucleotide
ctcgcacgcgattacggcggcatgg

SEQ ID NO: 681539 - DNA, 25 bp, Artificial sequence
  Synthetic oligonucleotide
ctcgcacgcgataacggcggcatgg

SEQ ID NO: 681540 - DNA, 25 bp, Artificial sequence
  Synthetic oligonucleotide
ccccttcgcctacacgcgatctcgc

SEQ ID NO: 681541 - DNA, 25 bp, Artificial sequence
  Synthetic oligonucleotide
accggccctcgtgcgcgtacacttg

SEQ ID NO: 681542 - DNA, 25 bp, Artificial sequence
  Synthetic oligonucleotide
ccccttcgcctagacgcgatctcgc

SEQ ID NO: 681543 - DNA, 25 bp, Artificial sequence
  Synthetic oligonucleotide
ttccgcgtagggaacgcgacctgcc

SEQ ID NO: 681544 - DNA, 25 bp, Artificial sequence
  Synthetic oligonucleotide
ccaggccgcgcgttctagtcgtctg

SEQ ID NO: 681545 - DNA, 25 bp, Artificial sequence
  Synthetic oligonucleotide
ccaggccgcgcgatctagtcgtctg

SEQ ID NO: 681546 - DNA, 25 bp, Artificial sequence
  Synthetic oligonucleotide
agctcgactagtggctccgcctgcg

SEQ ID NO: 681547 - DNA, 25 bp, Artificial sequence
  Synthetic oligonucleotide
agctcgactagtcgctccgcctgcg

SEQ ID NO: 681548 - DNA, 25 bp, Artificial sequence
  Synthetic oligonucleotide
ccccccgaccgagacgctaaagtgc

SEQ ID NO: 681549 - DNA, 25 bp, Artificial sequence
  Synthetic oligonucleotide
ccccccgaccgacacgctaaagtgc

SEQ ID NO: 681550 - DNA, 25 bp, Artificial sequence
  Synthetic oligonucleotide
gcgcgcgcggtcaaaatcgtacggg

SEQ ID NO: 681551 - DNA, 25 bp, Artificial sequence
  Synthetic oligonucleotide
gcgcgcgcggtctaaatcgtacggg

SEQ ID NO: 681552 - DNA, 25 bp, Artificial sequence
  Synthetic oligonucleotide
gaccacaacgcgtctagcgcgggga

SEQ ID NO: 681553 - DNA, 25 bp, Artificial sequence
  Synthetic oligonucleotide
accggccctcgtccgcgtacacttg

SEQ ID NO: 681554 - DNA, 25 bp, Artificial sequence
  Synthetic oligonucleotide
ggcgttctcgaccggtcgatacgcg

SEQ ID NO: 681555 - DNA, 25 bp, Artificial sequence
  Synthetic oligonucleotide
cctggccgtatcgtgtcgcgcggaa

SEQ ID NO: 681556 - DNA, 25 bp, Artificial sequence
  Synthetic oligonucleotide
tccagccgctacccgcagtccgaga

SEQ ID NO: 681557 - DNA, 25 bp, Artificial sequence
  Synthetic oligonucleotide
cacccttacgcgagcgacctgtggg

SEQ ID NO: 681558 - DNA, 25 bp, Artificial sequence
  Synthetic oligonucleotide
tcacggcgcctacgtaccgggacct

SEQ ID NO: 681559 - DNA, 25 bp, Artificial sequence
  Synthetic oligonucleotide
ttggcgcccgcgtaagtcgggttcg

SEQ ID NO: 681560 - DNA, 25 bp, Artificial sequence
  Synthetic oligonucleotide
ttggcgcccgcgaaagtcgggttcg

SEQ ID NO: 681561 - DNA, 25 bp, Artificial sequence
  Synthetic oligonucleotide
gcgcagaacgtcggcgcaagacgct

SEQ ID NO: 681562 - DNA, 25 bp, Artificial sequence
  Synthetic oligonucleotide
gcgcagaacgtccgcgcaagacgct

SEQ ID NO: 681563 - DNA, 25 bp, Artificial sequence
  Synthetic oligonucleotide
gtcgcctcgcgcgctaaacaaggcc

SEQ ID NO: 681564 - DNA, 25 bp, Artificial sequence
  Synthetic oligonucleotide
gtcgcctcgcgccctaaacaaggcc

SEQ ID NO: 681565 - DNA, 25 bp, Artificial sequence
  Synthetic oligonucleotide
tacgcgacgaccgcgtcgtgacctg

SEQ ID NO: 681566 - DNA, 25 bp, Artificial sequence
  Synthetic oligonucleotide
catgtactacgccggacgtccggcg

SEQ ID NO: 681567 - DNA, 25 bp, Artificial sequence
  Synthetic oligonucleotide
tggtagcgtgtaggaccggagggcg

SEQ ID NO: 681568 - DNA, 25 bp, Artificial sequence
  Synthetic oligonucleotide
ggcgttctcgacgggtcgatacgcg

SEQ ID NO: 681569 - DNA, 25 bp, Artificial sequence
  Synthetic oligonucleotide
gcggctccgcgtactaggtccgaca

SEQ ID NO: 681570 - DNA, 25 bp, Artificial sequence
  Synthetic oligonucleotide
gcggctccgcgttctaggtccgaca

SEQ ID NO: 681571 - DNA, 25 bp, Artificial sequence
  Synthetic oligonucleotide
gtctagaccggtctaccgctggggg

SEQ ID NO: 681572 - DNA, 25 bp, Artificial sequence
  Synthetic oligonucleotide
cacccttacgcgtgcgacctgtggg

SEQ ID NO: 681573 - DNA, 25 bp, Artificial sequence
  Synthetic oligonucleotide
gtctagaccggtgtaccgctggggg

SEQ ID NO: 681574 - DNA, 25 bp, Artificial sequence
  Synthetic oligonucleotide
ccgcagcgcgcatcggtcagctcta

SEQ ID NO: 681575 - DNA, 25 bp, Artificial sequence
  Synthetic oligonucleotide
ccgcagcgcgcaacggtcagctcta

SEQ ID NO: 681576 - DNA, 25 bp, Artificial sequence
  Synthetic oligonucleotide
ccgtgcccttacgcgaacgccagtg

SEQ ID NO: 681577 - DNA, 25 bp, Artificial sequence
  Synthetic oligonucleotide
ccgtgcccttacccgaacgccagtg

SEQ ID NO: 681578 - DNA, 25 bp, Artificial sequence
  Synthetic oligonucleotide
catgtactacgcgggacgtccggcg

SEQ ID NO: 681579 - DNA, 25 bp, Artificial sequence
  Synthetic oligonucleotide
gggccaccgctaggatgcgttggtc

SEQ ID NO: 681580 - DNA, 25 bp, Artificial sequence
  Synthetic oligonucleotide
gagtgtgcctactcgcgtcgcacgc

SEQ ID NO: 681581 - DNA, 25 bp, Artificial sequence
  Synthetic oligonucleotide
ccggagcgccctctcgaaccagtag

SEQ ID NO: 681582 - DNA, 25 bp, Artificial sequence
  Synthetic oligonucleotide
ccggagcgccctgtcgaaccagtag

SEQ ID NO: 681583 - DNA, 25 bp, Artificial sequence
  Synthetic oligonucleotide
tggtagttgcgtaacgcggcccgcg

SEQ ID NO: 681584 - DNA, 25 bp, Artificial sequence
  Synthetic oligonucleotide
tggtagttgcgttacgcggcccgcg

SEQ ID NO: 681585 - DNA, 25 bp, Artificial sequence
  Synthetic oligonucleotide
ggcgattgtcgcccgtacatcgcgc

SEQ ID NO: 681586 - DNA, 25 bp, Artificial sequence
  Synthetic oligonucleotide
ggcgattgtcgcgcgtacatcgcgc

SEQ ID NO: 681587 - DNA, 25 bp, Artificial sequence
  Synthetic oligonucleotide
acgcggcgacggaattcgcggtcac

SEQ ID NO: 681588 - DNA, 25 bp, Artificial sequence
  Synthetic oligonucleotide
acgcggcgacggtattcgcggtcac

SEQ ID NO: 681589 - DNA, 25 bp, Artificial sequence
  Synthetic oligonucleotide
ccgcgcgtaggccgtcgctagtaac

SEQ ID NO: 681590 - DNA, 25 bp, Artificial sequence
  Synthetic oligonucleotide
gaccacaacgcgactagcgcgggga

SEQ ID NO: 681591 - DNA, 25 bp, Artificial sequence
  Synthetic oligonucleotide
gggccaccgctacgatgcgttggtc

SEQ ID NO: 681592 - DNA, 25 bp, Artificial sequence
  Synthetic oligonucleotide
ccctagcggtgccatacgggtcacc

SEQ ID NO: 681593 - DNA, 25 bp, Artificial sequence
  Synthetic oligonucleotide
gtactgcacgatcgaccgggaggcc

SEQ ID NO: 681594 - DNA, 25 bp, Artificial sequence
  Synthetic oligonucleotide
gtactgcacgatggaccgggaggcc

SEQ ID NO: 681595 - DNA, 25 bp, Artificial sequence
  Synthetic oligonucleotide
ggcagttaggacacgcgcgttcggc

SEQ ID NO: 681596 - DNA, 25 bp, Artificial sequence
  Synthetic oligonucleotide
ggcagttaggactcgcgcgttcggc

SEQ ID NO: 681597 - DNA, 25 bp, Artificial sequence
  Synthetic oligonucleotide
tgcgccctacgaccgttcgccgact

SEQ ID NO: 681598 - DNA, 25 bp, Artificial sequence
  Synthetic oligonucleotide
tgcgccctacgagcgttcgccgact

SEQ ID NO: 681599 - DNA, 25 bp, Artificial sequence
  Synthetic oligonucleotide
tctgcgcgcgcgtattcggttgcgg

SEQ ID NO: 681600 - DNA, 25 bp, Artificial sequence
  Synthetic oligonucleotide
tctgcgcgcgcgaattcggttgcgg

SEQ ID NO: 681601 - DNA, 25 bp, Artificial sequence
  Synthetic oligonucleotide
agcccgggcgtttcgggctagagac

SEQ ID NO: 681602 - DNA, 25 bp, Artificial sequence
  Synthetic oligonucleotide
agcccgggcgttacgggctagagac

SEQ ID NO: 681603 - DNA, 25 bp, Artificial sequence
  Synthetic oligonucleotide
ccgcgcgtaggcggtcgctagtaac

SEQ ID NO: 681604 - DNA, 25 bp, Artificial sequence
  Synthetic oligonucleotide
gtctgcacgtaagcgctgctccggg

SEQ ID NO: 681605 - DNA, 25 bp, Artificial sequence
  Synthetic oligonucleotide
cggtaaggtaatggcgcggcccgca

SEQ ID NO: 681606 - DNA, 25 bp, Artificial sequence
  Synthetic oligonucleotide
tccctagacgtatcgcccgcccgtc

SEQ ID NO: 681607 - DNA, 25 bp, Artificial sequence
  Synthetic oligonucleotide
tccctagacgtaacgcccgcccgtc

SEQ ID NO: 681608 - DNA, 25 bp, Artificial sequence
  Synthetic oligonucleotide
atcgccgttacgacggtccgcacgc

SEQ ID NO: 681609 - DNA, 25 bp, Artificial sequence
  Synthetic oligonucleotide
atcgccgttacgtcggtccgcacgc

SEQ ID NO: 681610 - DNA, 25 bp, Artificial sequence
  Synthetic oligonucleotide
ggttagacgtacgacgcgggaccgc

SEQ ID NO: 681611 - DNA, 25 bp, Artificial sequence
  Synthetic oligonucleotide
ggttagacgtaccacgcgggaccgc

SEQ ID NO: 681612 - DNA, 25 bp, Artificial sequence
  Synthetic oligonucleotide
ctctcgacgcaacgacggggaggac

SEQ ID NO: 681613 - DNA, 25 bp, Artificial sequence
  Synthetic oligonucleotide
ctctcgacgcaaggacggggaggac

SEQ ID NO: 681614 - DNA, 25 bp, Artificial sequence
  Synthetic oligonucleotide
tcggtgacggatcgcgaacgacccg

SEQ ID NO: 681615 - DNA, 25 bp, Artificial sequence
  Synthetic oligonucleotide
gagtgtgcctacacgcgtcgcacgc

SEQ ID NO: 681616 - DNA, 25 bp, Artificial sequence
  Synthetic oligonucleotide
gtctgcacgtaaccgctgctccggg

SEQ ID NO: 681617 - DNA, 25 bp, Artificial sequence
  Synthetic oligonucleotide
ccctagcggtgcgatacgggtcacc

SEQ ID NO: 681618 - DNA, 25 bp, Artificial sequence
  Synthetic oligonucleotide
ttggccttagcgcacgcgtgtcgcc

SEQ ID NO: 681619 - DNA, 25 bp, Artificial sequence
  Synthetic oligonucleotide
ttggccttagcggacgcgtgtcgcc

SEQ ID NO: 681620 - DNA, 25 bp, Artificial sequence
  Synthetic oligonucleotide
aggtgccgcgataaggacgtccgcg

SEQ ID NO: 681621 - DNA, 25 bp, Artificial sequence
  Synthetic oligonucleotide
aggtgccgcgattaggacgtccgcg

SEQ ID NO: 681622 - DNA, 25 bp, Artificial sequence
  Synthetic oligonucleotide
cgcgatacccgcggtatgaccccga

SEQ ID NO: 681623 - DNA, 25 bp, Artificial sequence
  Synthetic oligonucleotide
cgcgatacccgccgtatgaccccga

SEQ ID NO: 681624 - DNA, 25 bp, Artificial sequence
  Synthetic oligonucleotide
tctagctagtagggccgcggtgccg

SEQ ID NO: 681625 - DNA, 25 bp, Artificial sequence
  Synthetic oligonucleotide
tctagctagtagcgccgcggtgccg

SEQ ID NO: 681626 - DNA, 25 bp, Artificial sequence
  Synthetic oligonucleotide
tggctcccgccgcataacgcgtcca

SEQ ID NO: 681627 - DNA, 25 bp, Artificial sequence
  Synthetic oligonucleotide
tggctcccgccggataacgcgtcca

SEQ ID NO: 681628 - DNA, 25 bp, Artificial sequence
  Synthetic oligonucleotide
tggtagcgtgtacgaccggagggcg

SEQ ID NO: 681629 - DNA, 25 bp, Artificial sequence
  Synthetic oligonucleotide
tcggtgacggatggcgaacgacccg

SEQ ID NO: 681630 - DNA, 25 bp, Artificial sequence
  Synthetic oligonucleotide
tgggggtagtacgcgcgacgtctcc

SEQ ID NO: 681631 - DNA, 25 bp, Artificial sequence
  Synthetic oligonucleotide
ggcgtcgcgctagcgtatgagtcgg

SEQ ID NO: 681632 - DNA, 25 bp, Artificial sequence
  Synthetic oligonucleotide
gcaccccttgcgttagcgcggactc

SEQ ID NO: 681633 - DNA, 25 bp, Artificial sequence
  Synthetic oligonucleotide
gcaccccttgcgatagcgcggactc

SEQ ID NO: 681634 - DNA, 25 bp, Artificial sequence
  Synthetic oligonucleotide
tagggggtagtcccggaccgtggct

SEQ ID NO: 681635 - DNA, 25 bp, Artificial sequence
  Synthetic oligonucleotide
tagggggtagtcgcggaccgtggct

SEQ ID NO: 681636 - DNA, 25 bp, Artificial sequence
  Synthetic oligonucleotide
cggactgcgcggaatagtcacccgg

SEQ ID NO: 681637 - DNA, 25 bp, Artificial sequence
  Synthetic oligonucleotide
cggactgcgcggtatagtcacccgg

SEQ ID NO: 681638 - DNA, 25 bp, Artificial sequence
  Synthetic oligonucleotide
caccctcgtccgggaatggcctgac

SEQ ID NO: 681639 - DNA, 25 bp, Artificial sequence
  Synthetic oligonucleotide
caccctcgtccgcgaatggcctgac

SEQ ID NO: 681640 - DNA, 25 bp, Artificial sequence
  Synthetic oligonucleotide
cggccactacggacgttcgcccaca

SEQ ID NO: 681641 - DNA, 25 bp, Artificial sequence
  Synthetic oligonucleotide
gtcacgtcccgttagcgcgccatcg

SEQ ID NO: 681642 - DNA, 25 bp, Artificial sequence
  Synthetic oligonucleotide
tgggggtagtacccgcgacgtctcc

SEQ ID NO: 681643 - DNA, 25 bp, Artificial sequence
  Synthetic oligonucleotide
gccgagctggaccatcggcttggtc

SEQ ID NO: 681644 - DNA, 25 bp, Artificial sequence
  Synthetic oligonucleotide
ccacgtcggacgaaatcgccccctc

SEQ ID NO: 681645 - DNA, 25 bp, Artificial sequence
  Synthetic oligonucleotide
ccacgtcggacgtaatcgccccctc

SEQ ID NO: 681646 - DNA, 25 bp, Artificial sequence
  Synthetic oligonucleotide
gccaagcatgaccagcgcgaggcag

SEQ ID NO: 681647 - DNA, 25 bp, Artificial sequence
  Synthetic oligonucleotide
gccaagcatgacgagcgcgaggcag

SEQ ID NO: 681648 - DNA, 25 bp, Artificial sequence
  Synthetic oligonucleotide
cgggtacgtcgctcgagtaggcctg

SEQ ID NO: 681649 - DNA, 25 bp, Artificial sequence
  Synthetic oligonucleotide
cgggtacgtcgcacgagtaggcctg

SEQ ID NO: 681650 - DNA, 25 bp, Artificial sequence
  Synthetic oligonucleotide
cggccccctaccgcgcgaatgcatt

SEQ ID NO: 681651 - DNA, 25 bp, Artificial sequence
  Synthetic oligonucleotide
cggccccctaccccgcgaatgcatt

SEQ ID NO: 681652 - DNA, 25 bp, Artificial sequence
  Synthetic oligonucleotide
ccatgcggcgtacgatcgagtcgcc

SEQ ID NO: 681653 - DNA, 25 bp, Artificial sequence
  Synthetic oligonucleotide
tcggggatagatcgcgcgcgcgtga

SEQ ID NO: 681654 - DNA, 25 bp, Artificial sequence
  Synthetic oligonucleotide
cggccactacggtcgttcgcccaca

SEQ ID NO: 681655 - DNA, 25 bp, Artificial sequence
  Synthetic oligonucleotide
gagcagggaacccacgcgtaccagc

SEQ ID NO: 681656 - DNA, 25 bp, Artificial sequence
  Synthetic oligonucleotide
cagggctccctaggcgtcggcactt

SEQ ID NO: 681657 - DNA, 25 bp, Artificial sequence
  Synthetic oligonucleotide
cagggctccctacgcgtcggcactt

SEQ ID NO: 681658 - DNA, 25 bp, Artificial sequence
  Synthetic oligonucleotide
ctcccgacgctaaaccggccatggg

SEQ ID NO: 681659 - DNA, 25 bp, Artificial sequence
  Synthetic oligonucleotide
ctcccgacgctataccggccatggg

SEQ ID NO: 681660 - DNA, 25 bp, Artificial sequence
  Synthetic oligonucleotide
caaacggtcgtctacgcggctgcgg

SEQ ID NO: 681661 - DNA, 25 bp, Artificial sequence
  Synthetic oligonucleotide
caaacggtcgtcaacgcggctgcgg

SEQ ID NO: 681662 - DNA, 25 bp, Artificial sequence
  Synthetic oligonucleotide
gctccgcagccgatatacgggaggg

SEQ ID NO: 681663 - DNA, 25 bp, Artificial sequence
  Synthetic oligonucleotide
gctccgcagccgttatacgggaggg

SEQ ID NO: 681664 - DNA, 25 bp, Artificial sequence
  Synthetic oligonucleotide
cggctggccgcgtacgctaaaggga

SEQ ID NO: 681665 - DNA, 25 bp, Artificial sequence
  Synthetic oligonucleotide
cggctggccgcgaacgctaaaggga

SEQ ID NO: 681666 - DNA, 25 bp, Artificial sequence
  Synthetic oligonucleotide
gtcacgtcccgtaagcgcgccatcg

SEQ ID NO: 681667 - DNA, 25 bp, Artificial sequence
  Synthetic oligonucleotide
gcatgataacgacgcaccgccgccc

SEQ ID NO: 681668 - DNA, 25 bp, Artificial sequence
  Synthetic oligonucleotide
ggcgtcgcgctaccgtatgagtcgg

SEQ ID NO: 681669 - DNA, 25 bp, Artificial sequence
  Synthetic oligonucleotide
gagcagggaaccgacgcgtaccagc

SEQ ID NO: 681670 - DNA, 25 bp, Artificial sequence
  Synthetic oligonucleotide
ctagcctacgcgcgcttaccacggc

SEQ ID NO: 681671 - DNA, 25 bp, Artificial sequence
  Synthetic oligonucleotide
ctagcctacgcgggcttaccacggc

SEQ ID NO: 681672 - DNA, 25 bp, Artificial sequence
  Synthetic oligonucleotide
tgagtaccgagttcgcgctcgcccc

SEQ ID NO: 681673 - DNA, 25 bp, Artificial sequence
  Synthetic oligonucleotide
tgagtaccgagtacgcgctcgcccc

SEQ ID NO: 681674 - DNA, 25 bp, Artificial sequence
  Synthetic oligonucleotide
ccgttggcgcgtggacgttctcagg

SEQ ID NO: 681675 - DNA, 25 bp, Artificial sequence
  Synthetic oligonucleotide
ccgttggcgcgtcgacgttctcagg

SEQ ID NO: 681676 - DNA, 25 bp, Artificial sequence
  Synthetic oligonucleotide
tcctgcatgttcggcgcgttgcggg

SEQ ID NO: 681677 - DNA, 25 bp, Artificial sequence
  Synthetic oligonucleotide
tcctgcatgttccgcgcgttgcggg

SEQ ID NO: 681678 - DNA, 25 bp, Artificial sequence
  Synthetic oligonucleotide
gccgagctggacgatcggcttggtc

SEQ ID NO: 681679 - DNA, 25 bp, Artificial sequence
  Synthetic oligonucleotide
gcatgataacgaggcaccgccgccc

SEQ ID NO: 681680 - DNA, 25 bp, Artificial sequence
  Synthetic oligonucleotide
atgctcgcctataccgcggacccgg

SEQ ID NO: 681681 - DNA, 25 bp, Artificial sequence
  Synthetic oligonucleotide
ccatgcggcgtaggatcgagtcgcc

SEQ ID NO: 681682 - DNA, 25 bp, Artificial sequence
  Synthetic oligonucleotide
tgctgggcgcgtcaagggactacgc

SEQ ID NO: 681683 - DNA, 25 bp, Artificial sequence
  Synthetic oligonucleotide
tgctgggcgcgtgaagggactacgc

SEQ ID NO: 681684 - DNA, 25 bp, Artificial sequence
  Synthetic oligonucleotide
gctcaatcgacgcgactagcgcggg

SEQ ID NO: 681685 - DNA, 25 bp, Artificial sequence
  Synthetic oligonucleotide
gctcaatcgacgggactagcgcggg

SEQ ID NO: 681686 - DNA, 25 bp, Artificial sequence
  Synthetic oligonucleotide
cgcccgtccgattcgtccgaatgcc

SEQ ID NO: 681687 - DNA, 25 bp, Artificial sequence
  Synthetic oligonucleotide
cctggccgtatcctgtcgcgcggaa

SEQ ID NO: 681688 - DNA, 25 bp, Artificial sequence
  Synthetic oligonucleotide
agcttgcggacgtagtcgcaccgcg

SEQ ID NO: 681689 - DNA, 25 bp, Artificial sequence
  Synthetic oligonucleotide
agcttgcggacgaagtcgcaccgcg

SEQ ID NO: 681690 - DNA, 25 bp, Artificial sequence
  Synthetic oligonucleotide
cagtgacgcgaccgcactacgcagg

SEQ ID NO: 681691 - DNA, 25 bp, Artificial sequence
  Synthetic oligonucleotide
gtatggtacctcgaccgcgggagcg

SEQ ID NO: 681692 - DNA, 25 bp, Artificial sequence
  Synthetic oligonucleotide
atgctcgcctattccgcggacccgg

SEQ ID NO: 681693 - DNA, 25 bp, Artificial sequence
  Synthetic oligonucleotide
ctaccacgcgccgatctaacgcggg

SEQ ID NO: 681694 - DNA, 25 bp, Artificial sequence
  Synthetic oligonucleotide
cggcctactgcggggattagcaggg

SEQ ID NO: 681695 - DNA, 25 bp, Artificial sequence
  Synthetic oligonucleotide
cggcctactgcgcggattagcaggg

SEQ ID NO: 681696 - DNA, 25 bp, Artificial sequence
  Synthetic oligonucleotide
ggtgtgcgataccgcgcgttggagg

SEQ ID NO: 681697 - DNA, 25 bp, Artificial sequence
  Synthetic oligonucleotide
ggtgtgcgatacggcgcgttggagg

SEQ ID NO: 681698 - DNA, 25 bp, Artificial sequence
  Synthetic oligonucleotide
cccggcgcctcgtacgcgagtctaa

SEQ ID NO: 681699 - DNA, 25 bp, Artificial sequence
  Synthetic oligonucleotide
cccggcgcctcgaacgcgagtctaa

SEQ ID NO: 681700 - DNA, 25 bp, Artificial sequence
  Synthetic oligonucleotide
tcggcctagtccggcggatgatggc

SEQ ID NO: 681701 - DNA, 25 bp, Artificial sequence
  Synthetic oligonucleotide
tcggcctagtcccgcggatgatggc

SEQ ID NO: 681702 - DNA, 25 bp, Artificial sequence
  Synthetic oligonucleotide
tccagccgctacgcgcagtccgaga

SEQ ID NO: 681703 - DNA, 25 bp, Artificial sequence
  Synthetic oligonucleotide
cgcccgtccgatacgtccgaatgcc

SEQ ID NO: 681704 - DNA, 25 bp, Artificial sequence
  Synthetic oligonucleotide
cagtgacgcgacggcactacgcagg

SEQ ID NO: 681705 - DNA, 25 bp, Artificial sequence
  Synthetic oligonucleotide
ctaagccttacggggccgagcaccc

SEQ ID NO: 681706 - DNA, 25 bp, Artificial sequence
  Synthetic oligonucleotide
ggcgccatagcgctcgcgtacctag

SEQ ID NO: 681707 - DNA, 25 bp, Artificial sequence
  Synthetic oligonucleotide
ggcgccatagcggtcgcgtacctag

SEQ ID NO: 681708 - DNA, 25 bp, Artificial sequence
  Synthetic oligonucleotide
ccgccctaacgattgcgcgacgcca

SEQ ID NO: 681709 - DNA, 25 bp, Artificial sequence
  Synthetic oligonucleotide
ccgccctaacgaatgcgcgacgcca

SEQ ID NO: 681710 - DNA, 25 bp, Artificial sequence
  Synthetic oligonucleotide
gttatgcgtcccaatcgcgcggccg

SEQ ID NO: 681711 - DNA, 25 bp, Artificial sequence
  Synthetic oligonucleotide
gttatgcgtccctatcgcgcggccg

SEQ ID NO: 681712 - DNA, 25 bp, Artificial sequence
  Synthetic oligonucleotide
ccgatccgtggacgctacccatcgc

SEQ ID NO: 681713 - DNA, 25 bp, Artificial sequence
  Synthetic oligonucleotide
acggtgacgtcccaaggcgcatgcc

SEQ ID NO: 681714 - DNA, 25 bp, Artificial sequence
  Synthetic oligonucleotide
agatcccgcgacccgtacacagcgg

SEQ ID NO: 681715 - DNA, 25 bp, Artificial sequence
  Synthetic oligonucleotide
agatcccgcgacgcgtacacagcgg

SEQ ID NO: 681716 - DNA, 25 bp, Artificial sequence
  Synthetic oligonucleotide
gtatggtacctccaccgcgggagcg

SEQ ID NO: 681717 - DNA, 25 bp, Artificial sequence
  Synthetic oligonucleotide
ctcctcgttatactcgcggcgcggg

SEQ ID NO: 681718 - DNA, 25 bp, Artificial sequence
  Synthetic oligonucleotide
ccgatccgtggaggctacccatcgc

SEQ ID NO: 681719 - DNA, 25 bp, Artificial sequence
  Synthetic oligonucleotide
ctaagccttacgcggccgagcaccc

SEQ ID NO: 681720 - DNA, 25 bp, Artificial sequence
  Synthetic oligonucleotide
ggccccagcgcgggattagctttgg

SEQ ID NO: 681721 - DNA, 25 bp, Artificial sequence
  Synthetic oligonucleotide
ggccccagcgcgcgattagctttgg

SEQ ID NO: 681722 - DNA, 25 bp, Artificial sequence
  Synthetic oligonucleotide
gctagaaccgcgcagcgtacaccgc

SEQ ID NO: 681723 - DNA, 25 bp, Artificial sequence
  Synthetic oligonucleotide
gctagaaccgcggagcgtacaccgc

SEQ ID NO: 681724 - DNA, 25 bp, Artificial sequence
  Synthetic oligonucleotide
actggttatccgtccggcggccacg

SEQ ID NO: 681725 - DNA, 25 bp, Artificial sequence
  Synthetic oligonucleotide
actggttatccgaccggcggccacg

SEQ ID NO: 681726 - DNA, 25 bp, Artificial sequence
  Synthetic oligonucleotide
gcttatctagcggcatcgcggcccc

SEQ ID NO: 681727 - DNA, 25 bp, Artificial sequence
  Synthetic oligonucleotide
gcttatctagcgccatcgcggcccc

SEQ ID NO: 681728 - DNA, 25 bp, Artificial sequence
  Synthetic oligonucleotide
ctaccacgcgcccatctaacgcggg

SEQ ID NO: 681729 - DNA, 25 bp, Artificial sequence
  Synthetic oligonucleotide
ctcctcgttatagtcgcggcgcggg

SEQ ID NO: 681730 - DNA, 25 bp, Artificial sequence
  Synthetic oligonucleotide
cacacccgccttacgaccgggatcg

SEQ ID NO: 681731 - DNA, 25 bp, Artificial sequence
  Synthetic oligonucleotide
aagtcgtacgccctccgcaggtccc

SEQ ID NO: 681732 - DNA, 25 bp, Artificial sequence
  Synthetic oligonucleotide
gacggtcgtatgggggccacgtctg

SEQ ID NO: 681733 - DNA, 25 bp, Artificial sequence
  Synthetic oligonucleotide
gacggtcgtatgcgggccacgtctg

SEQ ID NO: 681734 - DNA, 25 bp, Artificial sequence
  Synthetic oligonucleotide
agcgcgtatcgagggccgctcgcta

SEQ ID NO: 681735 - DNA, 25 bp, Artificial sequence
  Synthetic oligonucleotide
agcgcgtatcgacggccgctcgcta

SEQ ID NO: 681736 - DNA, 25 bp, Artificial sequence
  Synthetic oligonucleotide
cgccgagtagacggtcgacttgcgc

SEQ ID NO: 681737 - DNA, 25 bp, Artificial sequence
  Synthetic oligonucleotide
cgccgagtagaccgtcgacttgcgc

SEQ ID NO: 681738 - DNA, 25 bp, Artificial sequence
  Synthetic oligonucleotide
cccgccgcgatacgccggtcaatga

SEQ ID NO: 681739 - DNA, 25 bp, Artificial sequence
  Synthetic oligonucleotide
cccgccgcgataggccggtcaatga

SEQ ID NO: 681740 - DNA, 25 bp, Artificial sequence
  Synthetic oligonucleotide
ctgccgggtagcgtcgacaaccagc

SEQ ID NO: 681741 - DNA, 25 bp, Artificial sequence
  Synthetic oligonucleotide
acagacccgtcccaaacgccagccg

SEQ ID NO: 681742 - DNA, 25 bp, Artificial sequence
  Synthetic oligonucleotide
cacacccgcctttcgaccgggatcg

SEQ ID NO: 681743 - DNA, 25 bp, Artificial sequence
  Synthetic oligonucleotide
gcgaagcggtcccgattaacgcgcg

SEQ ID NO: 681744 - DNA, 25 bp, Artificial sequence
  Synthetic oligonucleotide
tccctgcgctagcgcgaacccccat

SEQ ID NO: 681745 - DNA, 25 bp, Artificial sequence
  Synthetic oligonucleotide
tccctgcgctagggcgaacccccat

SEQ ID NO: 681746 - DNA, 25 bp, Artificial sequence
  Synthetic oligonucleotide
ggcctaccgtgactagtcggctccc

SEQ ID NO: 681747 - DNA, 25 bp, Artificial sequence
  Synthetic oligonucleotide
ggcctaccgtgagtagtcggctccc

SEQ ID NO: 681748 - DNA, 25 bp, Artificial sequence
  Synthetic oligonucleotide
tccagccgtacggcgtcgagtgcac

SEQ ID NO: 681749 - DNA, 25 bp, Artificial sequence
  Synthetic oligonucleotide
tccagccgtacgccgtcgagtgcac

SEQ ID NO: 681750 - DNA, 25 bp, Artificial sequence
  Synthetic oligonucleotide
tcccgcagtaagtcgcgcgacgacg

SEQ ID NO: 681751 - DNA, 25 bp, Artificial sequence
  Synthetic oligonucleotide
tcccgcagtaagacgcgcgacgacg

SEQ ID NO: 681752 - DNA, 25 bp, Artificial sequence
  Synthetic oligonucleotide
ccgatgcgttgcccgtgcatcgtcc

SEQ ID NO: 681753 - DNA, 25 bp, Artificial sequence
  Synthetic oligonucleotide
ccgatgcgttgcgcgtgcatcgtcc

SEQ ID NO: 681754 - DNA, 25 bp, Artificial sequence
  Synthetic oligonucleotide
ctgccgggtagcctcgacaaccagc

SEQ ID NO: 681755 - DNA, 25 bp, Artificial sequence
  Synthetic oligonucleotide
gagactcgtcgcggactagggcgtg

SEQ ID NO: 681756 - DNA, 25 bp, Artificial sequence
  Synthetic oligonucleotide
ggtccgaccgtttctcgcgggatcg

SEQ ID NO: 681757 - DNA, 25 bp, Artificial sequence
  Synthetic oligonucleotide
ggtccgaccgttactcgcgggatcg

SEQ ID NO: 681758 - DNA, 25 bp, Artificial sequence
  Synthetic oligonucleotide
acggtgacgtccgaaggcgcatgcc

SEQ ID NO: 681759 - DNA, 25 bp, Artificial sequence
  Synthetic oligonucleotide
tcggggatagatggcgcgcgcgtga

SEQ ID NO: 681760 - DNA, 25 bp, Artificial sequence
  Synthetic oligonucleotide
catgtgcctacggcgtaacccggcg

SEQ ID NO: 681761 - DNA, 25 bp, Artificial sequence
  Synthetic oligonucleotide
catgtgcctacgccgtaacccggcg

SEQ ID NO: 681762 - DNA, 25 bp, Artificial sequence
  Synthetic oligonucleotide
accggacccgtacgcatcggtgtgc

SEQ ID NO: 681763 - DNA, 25 bp, Artificial sequence
  Synthetic oligonucleotide
accggacccgtaggcatcggtgtgc

SEQ ID NO: 681764 - DNA, 25 bp, Artificial sequence
  Synthetic oligonucleotide
ctggctaccgcgtagatcggccgca

SEQ ID NO: 681765 - DNA, 25 bp, Artificial sequence
  Synthetic oligonucleotide
ctggctaccgcgaagatcggccgca

SEQ ID NO: 681766 - DNA, 25 bp, Artificial sequence
  Synthetic oligonucleotide
acagacccgtccgaaacgccagccg

SEQ ID NO: 681767 - DNA, 25 bp, Artificial sequence
  Synthetic oligonucleotide
ccaaaggtctacacgcgcgtcgggc

SEQ ID NO: 681768 - DNA, 25 bp, Artificial sequence
  Synthetic oligonucleotide
gcgaagcggtccggattaacgcgcg

SEQ ID NO: 681769 - DNA, 25 bp, Artificial sequence
  Synthetic oligonucleotide
gagactcgtcgccgactagggcgtg

SEQ ID NO: 681770 - DNA, 25 bp, Artificial sequence
  Synthetic oligonucleotide
gtcaggaatgcgctccgcgcgcatg

SEQ ID NO: 681771 - DNA, 25 bp, Artificial sequence
  Synthetic oligonucleotide
gtcaggaatgcggtccgcgcgcatg

SEQ ID NO: 681772 - DNA, 25 bp, Artificial sequence
  Synthetic oligonucleotide
accatgccggtaccgcatacggccg

SEQ ID NO: 681773 - DNA, 25 bp, Artificial sequence
  Synthetic oligonucleotide
accatgccggtagcgcatacggccg

SEQ ID NO: 681774 - DNA, 25 bp, Artificial sequence
  Synthetic oligonucleotide
ggcgacccggacgctagttgcctac

SEQ ID NO: 681775 - DNA, 25 bp, Artificial sequence
  Synthetic oligonucleotide
ggcgacccggaccctagttgcctac

SEQ ID NO: 681776 - DNA, 25 bp, Artificial sequence
  Synthetic oligonucleotide
tggtcgctatcgaaagcggggcggc

SEQ ID NO: 681777 - DNA, 25 bp, Artificial sequence
  Synthetic oligonucleotide
tggtcgctatcgtaagcggggcggc

SEQ ID NO: 681778 - DNA, 25 bp, Artificial sequence
  Synthetic oligonucleotide
tcgtgctcgcgccagactagccagc

SEQ ID NO: 681779 - DNA, 25 bp, Artificial sequence
  Synthetic oligonucleotide
ccaaaggtctactcgcgcgtcgggc

SEQ ID NO: 681780 - DNA, 25 bp, Artificial sequence
  Synthetic oligonucleotide
cgcatgcgatacgcgccgtgcggaa

SEQ ID NO: 681781 - DNA, 25 bp, Artificial sequence
  Synthetic oligonucleotide
gtagctgcgccgtacgacacgctgc

SEQ ID NO: 681782 - DNA, 25 bp, Artificial sequence
  Synthetic oligonucleotide
gtagctgcgccgaacgacacgctgc

SEQ ID NO: 681783 - DNA, 25 bp, Artificial sequence
  Synthetic oligonucleotide
cgcgcttaccgcgtgtcgtccggtt

SEQ ID NO: 681784 - DNA, 25 bp, Artificial sequence
  Synthetic oligonucleotide
cgcgcttaccgcctgtcgtccggtt

SEQ ID NO: 681785 - DNA, 25 bp, Artificial sequence
  Synthetic oligonucleotide
ggggaacgccacaagcggtccacgt

SEQ ID NO: 681786 - DNA, 25 bp, Artificial sequence
  Synthetic oligonucleotide
ggggaacgccactagcggtccacgt

SEQ ID NO: 681787 - DNA, 25 bp, Artificial sequence
  Synthetic oligonucleotide
cgggctacgcgctcgtatgctcgag

SEQ ID NO: 681788 - DNA, 25 bp, Artificial sequence
  Synthetic oligonucleotide
cgggctacgcgcacgtatgctcgag

SEQ ID NO: 681789 - DNA, 25 bp, Artificial sequence
  Synthetic oligonucleotide
gcccagccccgtgtcgcgagcttaa

SEQ ID NO: 681790 - DNA, 25 bp, Artificial sequence
  Synthetic oligonucleotide
gtccctgcgaccatcgacggttccc

SEQ ID NO: 681791 - DNA, 25 bp, Artificial sequence
  Synthetic oligonucleotide
cgagcgcggcgtgggtactgtagac

SEQ ID NO: 681792 - DNA, 25 bp, Artificial sequence
  Synthetic oligonucleotide
cgttgtcggaccccgatcaggagcg

SEQ ID NO: 681793 - DNA, 25 bp, Artificial sequence
  Synthetic oligonucleotide
gcccagccccgtctcgcgagcttaa

SEQ ID NO: 681794 - DNA, 25 bp, Artificial sequence
  Synthetic oligonucleotide
cgcatgcgatacccgccgtgcggaa

SEQ ID NO: 681795 - DNA, 25 bp, Artificial sequence
  Synthetic oligonucleotide
ccgggcttcgcgcacaggtcagaga

SEQ ID NO: 681796 - DNA, 25 bp, Artificial sequence
  Synthetic oligonucleotide
ccgggcttcgcggacaggtcagaga

SEQ ID NO: 681797 - DNA, 25 bp, Artificial sequence
  Synthetic oligonucleotide
cgcgctcgtagccctagagcgatgg

SEQ ID NO: 681798 - DNA, 25 bp, Artificial sequence
  Synthetic oligonucleotide
cgcgctcgtagcgctagagcgatgg

SEQ ID NO: 681799 - DNA, 25 bp, Artificial sequence
  Synthetic oligonucleotide
aagtcgtacgccgtccgcaggtccc

SEQ ID NO: 681800 - DNA, 25 bp, Artificial sequence
  Synthetic oligonucleotide
tcgtgctcgcgcgagactagccagc

SEQ ID NO: 681801 - DNA, 25 bp, Artificial sequence
  Synthetic oligonucleotide
gacgcgacacggtacgtcggggtac

SEQ ID NO: 681802 - DNA, 25 bp, Artificial sequence
  Synthetic oligonucleotide
gacgcgacacggaacgtcggggtac

SEQ ID NO: 681803 - DNA, 25 bp, Artificial sequence
  Synthetic oligonucleotide
ccacggctagcggaacggggctgtt

SEQ ID NO: 681804 - DNA, 25 bp, Artificial sequence
  Synthetic oligonucleotide
ccacggctagcgcaacggggctgtt

SEQ ID NO: 681805 - DNA, 25 bp, Artificial sequence
  Synthetic oligonucleotide
cgttgtcggaccgcgatcaggagcg

SEQ ID NO: 681806 - DNA, 25 bp, Artificial sequence
  Synthetic oligonucleotide
ctcgtgcggtccccggtttgccatg

SEQ ID NO: 681807 - DNA, 25 bp, Artificial sequence
  Synthetic oligonucleotide
ggcccaaagctacgcgtcgtgggac

SEQ ID NO: 681808 - DNA, 25 bp, Artificial sequence
  Synthetic oligonucleotide
atgaggccgtgagcgcgtagccggt

SEQ ID NO: 681809 - DNA, 25 bp, Artificial sequence
  Synthetic oligonucleotide
atgaggccgtgaccgcgtagccggt

SEQ ID NO: 681810 - DNA, 25 bp, Artificial sequence
  Synthetic oligonucleotide
ggcccaaagctaggcgtcgtgggac

SEQ ID NO: 681811 - DNA, 25 bp, Artificial sequence
  Synthetic oligonucleotide
ccatccacgcgtaccgctacgtgcg

SEQ ID NO: 681812 - DNA, 25 bp, Artificial sequence
  Synthetic oligonucleotide
gtccctgcgaccttcgacggttccc

SEQ ID NO: 681813 - DNA, 25 bp, Artificial sequence
  Synthetic oligonucleotide
cgagcgcggcgtcggtactgtagac

SEQ ID NO: 681814 - DNA, 25 bp, Artificial sequence
  Synthetic oligonucleotide
tgggcgggcgcgtactcgatagggt

SEQ ID NO: 681815 - DNA, 25 bp, Artificial sequence
  Synthetic oligonucleotide
ctcgtgcggtccgcggtttgccatg

SEQ ID NO: 681816 - DNA, 25 bp, Artificial sequence
  Synthetic oligonucleotide
ccatccacgcgttccgctacgtgcg

SEQ ID NO: 681817 - DNA, 25 bp, Artificial sequence
  Synthetic oligonucleotide
tcacccacgccttaacccgcgtcgg

SEQ ID NO: 681818 - DNA, 25 bp, Artificial sequence
  Synthetic oligonucleotide
tcacccacgcctaaacccgcgtcgg

SEQ ID NO: 681819 - DNA, 25 bp, Artificial sequence
  Synthetic oligonucleotide
gccgttagcgtcctgcgacgcaagc

SEQ ID NO: 681820 - DNA, 25 bp, Artificial sequence
  Synthetic oligonucleotide
cattgccgatacgccgacggaggcc

SEQ ID NO: 681821 - DNA, 25 bp, Artificial sequence
  Synthetic oligonucleotide
gacggcgacgttggaccgcggtact

SEQ ID NO: 681822 - DNA, 25 bp, Artificial sequence
  Synthetic oligonucleotide
cgagggaatgcggaacccgtcgcga

SEQ ID NO: 681823 - DNA, 25 bp, Artificial sequence
  Synthetic oligonucleotide
cgagggaatgcgcaacccgtcgcga

SEQ ID NO: 681824 - DNA, 25 bp, Artificial sequence
  Synthetic oligonucleotide
gccgttagcgtcgtgcgacgcaagc

SEQ ID NO: 681825 - DNA, 25 bp, Artificial sequence
  Synthetic oligonucleotide
cattgccgataccccgacggaggcc

SEQ ID NO: 681826 - DNA, 25 bp, Artificial sequence
  Synthetic oligonucleotide
gacggcgacgttcgaccgcggtact

SEQ ID NO: 681827 - DNA, 25 bp, Artificial sequence
  Synthetic oligonucleotide
tccatggcgccggtctagtgggtcc

SEQ ID NO: 681828 - DNA, 25 bp, Artificial sequence
  Synthetic oligonucleotide
tgggcgggcgcgaactcgatagggt

SEQ ID NO: 681829 - DNA, 25 bp, Artificial sequence
  Synthetic oligonucleotide
tccatggcgccgctctagtgggtcc

SEQ ID NO: 681830 - DNA, 25 bp, Artificial sequence
  Synthetic oligonucleotide
ccgcctatgcgagggtccgtgggct

SEQ ID NO: 681831 - DNA, 25 bp, Artificial sequence
  Synthetic oligonucleotide
cgctgggagcgtacgcgactctcgc

SEQ ID NO: 681832 - DNA, 25 bp, Artificial sequence
  Synthetic oligonucleotide
acggcggtcgtgagtcggcggtacc

SEQ ID NO: 681833 - DNA, 25 bp, Artificial sequence
  Synthetic oligonucleotide
tggcccattggcgggcgtccggatc

SEQ ID NO: 681834 - DNA, 25 bp, Artificial sequence
  Synthetic oligonucleotide
acggcggtcgtgtgtcggcggtacc

SEQ ID NO: 681835 - DNA, 25 bp, Artificial sequence
  Synthetic oligonucleotide
gtggcgcgcgccaagacatggccac

SEQ ID NO: 681836 - DNA, 25 bp, Artificial sequence
  Synthetic oligonucleotide
ccggggcgacccgtgtacgcgatct

SEQ ID NO: 681837 - DNA, 25 bp, Artificial sequence
  Synthetic oligonucleotide
ccggggcgacccctgtacgcgatct

SEQ ID NO: 681838 - DNA, 25 bp, Artificial sequence
  Synthetic oligonucleotide
ccagggcgcaagatacccggcgcga

SEQ ID NO: 681839 - DNA, 25 bp, Artificial sequence
  Synthetic oligonucleotide
ccgcctatgcgacggtccgtgggct

SEQ ID NO: 681840 - DNA, 25 bp, Artificial sequence
  Synthetic oligonucleotide
tggcccattggccggcgtccggatc

SEQ ID NO: 681841 - DNA, 25 bp, Artificial sequence
  Synthetic oligonucleotide
ccagggcgcaagttacccggcgcga

SEQ ID NO: 681842 - DNA, 25 bp, Artificial sequence
  Synthetic oligonucleotide
gtggcgcgcgcctagacatggccac

SEQ ID NO: 681843 - DNA, 25 bp, Artificial sequence
  Synthetic oligonucleotide
ccagggcgataccaccgcgctgcga

SEQ ID NO: 681844 - DNA, 25 bp, Artificial sequence
  Synthetic oligonucleotide
ctcgggtctaggccgcggaccttgc

SEQ ID NO: 681845 - DNA, 25 bp, Artificial sequence
  Synthetic oligonucleotide
ctcgggtctagggcgcggaccttgc

SEQ ID NO: 681846 - DNA, 25 bp, Artificial sequence
  Synthetic oligonucleotide
cgcgcggcgcggtcttacgtatccc

SEQ ID NO: 681847 - DNA, 25 bp, Artificial sequence
  Synthetic oligonucleotide
cgctgggagcgttcgcgactctcgc

SEQ ID NO: 681848 - DNA, 25 bp, Artificial sequence
  Synthetic oligonucleotide
cggccacccgtacggcatagtcccc

SEQ ID NO: 681849 - DNA, 25 bp, Artificial sequence
  Synthetic oligonucleotide
ggactggcgcggtatccaaccccgc

SEQ ID NO: 681850 - DNA, 25 bp, Artificial sequence
  Synthetic oligonucleotide
ccagggcgatacgaccgcgctgcga

SEQ ID NO: 681851 - DNA, 25 bp, Artificial sequence
  Synthetic oligonucleotide
cgcctcggctaccgacgaacggagc

SEQ ID NO: 681852 - DNA, 25 bp, Artificial sequence
  Synthetic oligonucleotide
ggactggcgcggaatccaaccccgc

SEQ ID NO: 681853 - DNA, 25 bp, Artificial sequence
  Synthetic oligonucleotide
tgcgcggtcgccgataacgcgggag

SEQ ID NO: 681854 - DNA, 25 bp, Artificial sequence
  Synthetic oligonucleotide
tgcgcggtcgcccataacgcgggag

SEQ ID NO: 681855 - DNA, 25 bp, Artificial sequence
  Synthetic oligonucleotide
ggaggcgtaggagggcgcagcaacc

SEQ ID NO: 681856 - DNA, 25 bp, Artificial sequence
  Synthetic oligonucleotide
ggaggcgtaggacggcgcagcaacc

SEQ ID NO: 681857 - DNA, 25 bp, Artificial sequence
  Synthetic oligonucleotide
cgcctcggctacggacgaacggagc

SEQ ID NO: 681858 - DNA, 25 bp, Artificial sequence
  Synthetic oligonucleotide
cggccacccgtagggcatagtcccc

SEQ ID NO: 681859 - DNA, 25 bp, Artificial sequence
  Synthetic oligonucleotide
agggcggactacacgcgatgccggc

SEQ ID NO: 681860 - DNA, 25 bp, Artificial sequence
  Synthetic oligonucleotide
cggtcctaatcgtggcgcggcccgt

SEQ ID NO: 681861 - DNA, 25 bp, Artificial sequence
  Synthetic oligonucleotide
cggtcctaatcgaggcgcggcccgt

SEQ ID NO: 681862 - DNA, 25 bp, Artificial sequence
  Synthetic oligonucleotide
tgtcgggctagttcccgcgagcccg

SEQ ID NO: 681863 - DNA, 25 bp, Artificial sequence
  Synthetic oligonucleotide
acgcgccgatactcgtcggccgggt

SEQ ID NO: 681864 - DNA, 25 bp, Artificial sequence
  Synthetic oligonucleotide
caacggcgtgcgtcgtaggctcggg

SEQ ID NO: 681865 - DNA, 25 bp, Artificial sequence
  Synthetic oligonucleotide
caacggcgtgcgacgtaggctcggg

SEQ ID NO: 681866 - DNA, 25 bp, Artificial sequence
  Synthetic oligonucleotide
gagcccccgcggacgtagaccgctt

SEQ ID NO: 681867 - DNA, 25 bp, Artificial sequence
  Synthetic oligonucleotide
gagcccccgcggtcgtagaccgctt

SEQ ID NO: 681868 - DNA, 25 bp, Artificial sequence
  Synthetic oligonucleotide
cgcgcggcgcggacttacgtatccc

SEQ ID NO: 681869 - DNA, 25 bp, Artificial sequence
  Synthetic oligonucleotide
accgcgcgggccgtagtaagcctgg

SEQ ID NO: 681870 - DNA, 25 bp, Artificial sequence
  Synthetic oligonucleotide
ggccggtatgcgcattcgcgtcccg

SEQ ID NO: 681871 - DNA, 25 bp, Artificial sequence
  Synthetic oligonucleotide
ggccggtatgcggattcgcgtcccg

SEQ ID NO: 681872 - DNA, 25 bp, Artificial sequence
  Synthetic oligonucleotide
accgcgcgggccctagtaagcctgg

SEQ ID NO: 681873 - DNA, 25 bp, Artificial sequence
  Synthetic oligonucleotide
ccccgttatcgccctccgagcccgt

SEQ ID NO: 681874 - DNA, 25 bp, Artificial sequence
  Synthetic oligonucleotide
gagcaccccgatggtacgggacgcg

SEQ ID NO: 681875 - DNA, 25 bp, Artificial sequence
  Synthetic oligonucleotide
agggcggactactcgcgatgccggc

SEQ ID NO: 681876 - DNA, 25 bp, Artificial sequence
  Synthetic oligonucleotide
cggcgcgctacgggggtattcccac

SEQ ID NO: 681877 - DNA, 25 bp, Artificial sequence
  Synthetic oligonucleotide
cggcgcgctacgcgggtattcccac

SEQ ID NO: 681878 - DNA, 25 bp, Artificial sequence
  Synthetic oligonucleotide
cgtacggcgcgtaaccgaccgagcc

SEQ ID NO: 681879 - DNA, 25 bp, Artificial sequence
  Synthetic oligonucleotide
cgtacggcgcgttaccgaccgagcc

SEQ ID NO: 681880 - DNA, 25 bp, Artificial sequence
  Synthetic oligonucleotide
gggcgctgtaggcgcgctagtctgc

SEQ ID NO: 681881 - DNA, 25 bp, Artificial sequence
  Synthetic oligonucleotide
gggcgctgtaggggcgctagtctgc

SEQ ID NO: 681882 - DNA, 25 bp, Artificial sequence
  Synthetic oligonucleotide
cggaggcccgtatcgcgcatgctgg

SEQ ID NO: 681883 - DNA, 25 bp, Artificial sequence
  Synthetic oligonucleotide
cggaggcccgtaacgcgcatgctgg

SEQ ID NO: 681884 - DNA, 25 bp, Artificial sequence
  Synthetic oligonucleotide
acgcggatcgcgaaggcggggcagt

SEQ ID NO: 681885 - DNA, 25 bp, Artificial sequence
  Synthetic oligonucleotide
acgcggatcgcgtaggcggggcagt

SEQ ID NO: 681886 - DNA, 25 bp, Artificial sequence
  Synthetic oligonucleotide
gagcaccccgatcgtacgggacgcg

SEQ ID NO: 681887 - DNA, 25 bp, Artificial sequence
  Synthetic oligonucleotide
ccccgttatcgcgctccgagcccgt

SEQ ID NO: 681888 - DNA, 25 bp, Artificial sequence
  Synthetic oligonucleotide
cccgaagccgtacgcggatgcgcct

SEQ ID NO: 681889 - DNA, 25 bp, Artificial sequence
  Synthetic oligonucleotide
tccggcacgaccggtgcgtcggtgt

SEQ ID NO: 681890 - DNA, 25 bp, Artificial sequence
  Synthetic oligonucleotide
gcggccggtcgcccgtgtaaaccct

SEQ ID NO: 681891 - DNA, 25 bp, Artificial sequence
  Synthetic oligonucleotide
gcggccggtcgcgcgtgtaaaccct

SEQ ID NO: 681892 - DNA, 25 bp, Artificial sequence
  Synthetic oligonucleotide
ggcgctgtcgtgcgctgtagtgcgc

SEQ ID NO: 681893 - DNA, 25 bp, Artificial sequence
  Synthetic oligonucleotide
ggcgctgtcgtgggctgtagtgcgc

SEQ ID NO: 681894 - DNA, 25 bp, Artificial sequence
  Synthetic oligonucleotide
accgcaatacgcgcggacgcccctg

SEQ ID NO: 681895 - DNA, 25 bp, Artificial sequence
  Synthetic oligonucleotide
accgcaatacgcccggacgcccctg

SEQ ID NO: 681896 - DNA, 25 bp, Artificial sequence
  Synthetic oligonucleotide
ggctccctgcggtcgcgaactacgg

SEQ ID NO: 681897 - DNA, 25 bp, Artificial sequence
  Synthetic oligonucleotide
ggctccctgcggacgcgaactacgg

SEQ ID NO: 681898 - DNA, 25 bp, Artificial sequence
  Synthetic oligonucleotide
tcacggctgccgcgcgctacgcaag

SEQ ID NO: 681899 - DNA, 25 bp, Artificial sequence
  Synthetic oligonucleotide
tcacggctgccgggcgctacgcaag

SEQ ID NO: 681900 - DNA, 25 bp, Artificial sequence
  Synthetic oligonucleotide
tagaggcgcacgtgcggtaggggcc

SEQ ID NO: 681901 - DNA, 25 bp, Artificial sequence
  Synthetic oligonucleotide
ggctgtctagttcgcgggccccggt

SEQ ID NO: 681902 - DNA, 25 bp, Artificial sequence
  Synthetic oligonucleotide
cccgaagccgtaggcggatgcgcct

SEQ ID NO: 681903 - DNA, 25 bp, Artificial sequence
  Synthetic oligonucleotide
tggacggacctagggcgcgagtccg

SEQ ID NO: 681904 - DNA, 25 bp, Artificial sequence
  Synthetic oligonucleotide
tccggcacgacccgtgcgtcggtgt

SEQ ID NO: 681905 - DNA, 25 bp, Artificial sequence
  Synthetic oligonucleotide
tgtcgggctagtacccgcgagcccg

SEQ ID NO: 681906 - DNA, 25 bp, Artificial sequence
  Synthetic oligonucleotide
gtcgctattcgcccgcccatccgcg

SEQ ID NO: 681907 - DNA, 25 bp, Artificial sequence
  Synthetic oligonucleotide
gtcgctattcgcgcgcccatccgcg

SEQ ID NO: 681908 - DNA, 25 bp, Artificial sequence
  Synthetic oligonucleotide
ggcaggcgcatgacggttgggcgga

SEQ ID NO: 681909 - DNA, 25 bp, Artificial sequence
  Synthetic oligonucleotide
ggcaggcgcatgtcggttgggcgga

SEQ ID NO: 681910 - DNA, 25 bp, Artificial sequence
  Synthetic oligonucleotide
actgcgcgcgttgcgacgtcgaggg

SEQ ID NO: 681911 - DNA, 25 bp, Artificial sequence
  Synthetic oligonucleotide
actgcgcgcgttccgacgtcgaggg

SEQ ID NO: 681912 - DNA, 25 bp, Artificial sequence
  Synthetic oligonucleotide
cgcagtgacgcgcggttggcagcga

SEQ ID NO: 681913 - DNA, 25 bp, Artificial sequence
  Synthetic oligonucleotide
cgcagtgacgcggggttggcagcga

SEQ ID NO: 681914 - DNA, 25 bp, Artificial sequence
  Synthetic oligonucleotide
accgctgatacgcgcgggacccagg

SEQ ID NO: 681915 - DNA, 25 bp, Artificial sequence
  Synthetic oligonucleotide
gtctgggcgactaccgtccctcccg

SEQ ID NO: 681916 - DNA, 25 bp, Artificial sequence
  Synthetic oligonucleotide
tagaggcgcacgagcggtaggggcc

SEQ ID NO: 681917 - DNA, 25 bp, Artificial sequence
  Synthetic oligonucleotide
tgcgggacgacggagcgtactcccc

SEQ ID NO: 681918 - DNA, 25 bp, Artificial sequence
  Synthetic oligonucleotide
cccagcgtacgccacgacctggtcc

SEQ ID NO: 681919 - DNA, 25 bp, Artificial sequence
  Synthetic oligonucleotide
cccagcgtacgcgacgacctggtcc

SEQ ID NO: 681920 - DNA, 25 bp, Artificial sequence
  Synthetic oligonucleotide
gttccctagcgcctacgctccgccc

SEQ ID NO: 681921 - DNA, 25 bp, Artificial sequence
  Synthetic oligonucleotide
gttccctagcgcgtacgctccgccc

SEQ ID NO: 681922 - DNA, 25 bp, Artificial sequence
  Synthetic oligonucleotide
tccccgagacgcccggtcgtcagag

SEQ ID NO: 681923 - DNA, 25 bp, Artificial sequence
  Synthetic oligonucleotide
tccccgagacgcgcggtcgtcagag

SEQ ID NO: 681924 - DNA, 25 bp, Artificial sequence
  Synthetic oligonucleotide
gggagcgcgaccccgattgcacagg

SEQ ID NO: 681925 - DNA, 25 bp, Artificial sequence
  Synthetic oligonucleotide
gggagcgcgaccgcgattgcacagg

SEQ ID NO: 681926 - DNA, 25 bp, Artificial sequence
  Synthetic oligonucleotide
caggtctagtacggtcgccgccccg

SEQ ID NO: 681927 - DNA, 25 bp, Artificial sequence
  Synthetic oligonucleotide
caggtctagtaccgtcgccgccccg

SEQ ID NO: 681928 - DNA, 25 bp, Artificial sequence
  Synthetic oligonucleotide
gtgacccgcggtgggatacggccgt

SEQ ID NO: 681929 - DNA, 25 bp, Artificial sequence
  Synthetic oligonucleotide
gtgacccgcggtcggatacggccgt

SEQ ID NO: 681930 - DNA, 25 bp, Artificial sequence
  Synthetic oligonucleotide
ggctgtctagttggcgggccccggt

SEQ ID NO: 681931 - DNA, 25 bp, Artificial sequence
  Synthetic oligonucleotide
ggggacaggcgcgttacggctgcag

SEQ ID NO: 681932 - DNA, 25 bp, Artificial sequence
  Synthetic oligonucleotide
acgcgccgatacacgtcggccgggt

SEQ ID NO: 681933 - DNA, 25 bp, Artificial sequence
  Synthetic oligonucleotide
tgcgggacgacgcagcgtactcccc

SEQ ID NO: 681934 - DNA, 25 bp, Artificial sequence
  Synthetic oligonucleotide
cggccgccgaacttgcgcgctcaag

SEQ ID NO: 681935 - DNA, 25 bp, Artificial sequence
  Synthetic oligonucleotide
cggccgccgaacatgcgcgctcaag

SEQ ID NO: 681936 - DNA, 25 bp, Artificial sequence
  Synthetic oligonucleotide
agccgaggtacgcccggatgaccgc

SEQ ID NO: 681937 - DNA, 25 bp, Artificial sequence
  Synthetic oligonucleotide
agccgaggtacggccggatgaccgc

SEQ ID NO: 681938 - DNA, 25 bp, Artificial sequence
  Synthetic oligonucleotide
cccctggcgttacggctcgtcggac

SEQ ID NO: 681939 - DNA, 25 bp, Artificial sequence
  Synthetic oligonucleotide
cccctggcgttagggctcgtcggac

SEQ ID NO: 681940 - DNA, 25 bp, Artificial sequence
  Synthetic oligonucleotide
ggccgagcggtcgactcgtcagctc

SEQ ID NO: 681941 - DNA, 25 bp, Artificial sequence
  Synthetic oligonucleotide
ggccgagcggtccactcgtcagctc

SEQ ID NO: 681942 - DNA, 25 bp, Artificial sequence
  Synthetic oligonucleotide
taggcggcgctaggtcggtgcacgc

SEQ ID NO: 681943 - DNA, 25 bp, Artificial sequence
  Synthetic oligonucleotide
taggcggcgctacgtcggtgcacgc

SEQ ID NO: 681944 - DNA, 25 bp, Artificial sequence
  Synthetic oligonucleotide
tggacggacctacggcgcgagtccg

SEQ ID NO: 681945 - DNA, 25 bp, Artificial sequence
  Synthetic oligonucleotide
ggggacaggcgccttacggctgcag

SEQ ID NO: 681946 - DNA, 25 bp, Artificial sequence
  Synthetic oligonucleotide
cgccccttcgcgtcggaactggcac

SEQ ID NO: 681947 - DNA, 25 bp, Artificial sequence
  Synthetic oligonucleotide
gccaccgacgcgagacgtaggccag

SEQ ID NO: 681948 - DNA, 25 bp, Artificial sequence
  Synthetic oligonucleotide
tggaccaccggcgcgctagtcacgg

SEQ ID NO: 681949 - DNA, 25 bp, Artificial sequence
  Synthetic oligonucleotide
aggcaacgacgttcgtgcgggcccc

SEQ ID NO: 681950 - DNA, 25 bp, Artificial sequence
  Synthetic oligonucleotide
aggcaacgacgtacgtgcgggcccc

SEQ ID NO: 681951 - DNA, 25 bp, Artificial sequence
  Synthetic oligonucleotide
ctaggcgtccggacctagcgcagcg

SEQ ID NO: 681952 - DNA, 25 bp, Artificial sequence
  Synthetic oligonucleotide
ctaggcgtccggtcctagcgcagcg

SEQ ID NO: 681953 - DNA, 25 bp, Artificial sequence
  Synthetic oligonucleotide
tcgcgcgacgcatgcggacgggact

SEQ ID NO: 681954 - DNA, 25 bp, Artificial sequence
  Synthetic oligonucleotide
tcgcgcgacgcaagcggacgggact

SEQ ID NO: 681955 - DNA, 25 bp, Artificial sequence
  Synthetic oligonucleotide
cctcatgtacggacgggccgccctg

SEQ ID NO: 681956 - DNA, 25 bp, Artificial sequence
  Synthetic oligonucleotide
cctcatgtacggtcgggccgccctg

SEQ ID NO: 681957 - DNA, 25 bp, Artificial sequence
  Synthetic oligonucleotide
gccaggcgtacgactactcggcggg

SEQ ID NO: 681958 - DNA, 25 bp, Artificial sequence
  Synthetic oligonucleotide
gccaggcgtacgtctactcggcggg

SEQ ID NO: 681959 - DNA, 25 bp, Artificial sequence
  Synthetic oligonucleotide
cgccggcgttcgcgacgtaagcgca

SEQ ID NO: 681960 - DNA, 25 bp, Artificial sequence
  Synthetic oligonucleotide
aggaggcggtcgaccgctaccacgc

SEQ ID NO: 681961 - DNA, 25 bp, Artificial sequence
  Synthetic oligonucleotide
cgccggcgttcgggacgtaagcgca

SEQ ID NO: 681962 - DNA, 25 bp, Artificial sequence
  Synthetic oligonucleotide
cgccccttcgcgacggaactggcac

SEQ ID NO: 681963 - DNA, 25 bp, Artificial sequence
  Synthetic oligonucleotide
cgcttgacgggcgagacgtccaggc

SEQ ID NO: 681964 - DNA, 25 bp, Artificial sequence
  Synthetic oligonucleotide
cgcttgacgggccagacgtccaggc

SEQ ID NO: 681965 - DNA, 25 bp, Artificial sequence
  Synthetic oligonucleotide
cgctcctacgcgtggtcggaaccgg

SEQ ID NO: 681966 - DNA, 25 bp, Artificial sequence
  Synthetic oligonucleotide
cgctcctacgcgaggtcggaaccgg

SEQ ID NO: 681967 - DNA, 25 bp, Artificial sequence
  Synthetic oligonucleotide
cagacgggacgggctacgcgggagt

SEQ ID NO: 681968 - DNA, 25 bp, Artificial sequence
  Synthetic oligonucleotide
cagacgggacggcctacgcgggagt

SEQ ID NO: 681969 - DNA, 25 bp, Artificial sequence
  Synthetic oligonucleotide
cgcttccgcgtttggtcgtccggcg

SEQ ID NO: 681970 - DNA, 25 bp, Artificial sequence
  Synthetic oligonucleotide
cgcttccgcgttaggtcgtccggcg

SEQ ID NO: 681971 - DNA, 25 bp, Artificial sequence
  Synthetic oligonucleotide
tcggagtttcgcgcgaggccggggt

SEQ ID NO: 681972 - DNA, 25 bp, Artificial sequence
  Synthetic oligonucleotide
tcggagtttcgcccgaggccggggt

SEQ ID NO: 681973 - DNA, 25 bp, Artificial sequence
  Synthetic oligonucleotide
ccccggcttgcgtgtcgacgggaac

SEQ ID NO: 681974 - DNA, 25 bp, Artificial sequence
  Synthetic oligonucleotide
aggaggcggtcgtccgctaccacgc

SEQ ID NO: 681975 - DNA, 25 bp, Artificial sequence
  Synthetic oligonucleotide
cgttgccgtcggccgtatgcgcgct

SEQ ID NO: 681976 - DNA, 25 bp, Artificial sequence
  Synthetic oligonucleotide
gtctggtcgtaccggcccggcatgc

SEQ ID NO: 681977 - DNA, 25 bp, Artificial sequence
  Synthetic oligonucleotide
cgcgaccgtacgccgggttggcagt

SEQ ID NO: 681978 - DNA, 25 bp, Artificial sequence
  Synthetic oligonucleotide
cgcgaccgtacggcgggttggcagt

SEQ ID NO: 681979 - DNA, 25 bp, Artificial sequence
  Synthetic oligonucleotide
ggcgctcgctaagggcggaatgcgc

SEQ ID NO: 681980 - DNA, 25 bp, Artificial sequence
  Synthetic oligonucleotide
ggcgctcgctaacggcggaatgcgc

SEQ ID NO: 681981 - DNA, 25 bp, Artificial sequence
  Synthetic oligonucleotide
tgggtctatccggctacgcgcggcc

SEQ ID NO: 681982 - DNA, 25 bp, Artificial sequence
  Synthetic oligonucleotide
tgggtctatccgcctacgcgcggcc

SEQ ID NO: 681983 - DNA, 25 bp, Artificial sequence
  Synthetic oligonucleotide
gaggtgcggtacgtacccgccagcc

SEQ ID NO: 681984 - DNA, 25 bp, Artificial sequence
  Synthetic oligonucleotide
gaggtgcggtacctacccgccagcc

SEQ ID NO: 681985 - DNA, 25 bp, Artificial sequence
  Synthetic oligonucleotide
gcgcgttaccgccccggtatcggct

SEQ ID NO: 681986 - DNA, 25 bp, Artificial sequence
  Synthetic oligonucleotide
gcgcgttaccgcgccggtatcggct

SEQ ID NO: 681987 - DNA, 25 bp, Artificial sequence
  Synthetic oligonucleotide
gggggtgaactagcgcgacccccac

SEQ ID NO: 681988 - DNA, 25 bp, Artificial sequence
  Synthetic oligonucleotide
tggaccaccggcccgctagtcacgg

SEQ ID NO: 681989 - DNA, 25 bp, Artificial sequence
  Synthetic oligonucleotide
cgttgccgtcgggcgtatgcgcgct

SEQ ID NO: 681990 - DNA, 25 bp, Artificial sequence
  Synthetic oligonucleotide
ccgggagcgatacgccgattccggg

SEQ ID NO: 681991 - DNA, 25 bp, Artificial sequence
  Synthetic oligonucleotide
gtctgggcgacttccgtccctcccg

SEQ ID NO: 681992 - DNA, 25 bp, Artificial sequence
  Synthetic oligonucleotide
gccaccgacgcgtgacgtaggccag

SEQ ID NO: 681993 - DNA, 25 bp, Artificial sequence
  Synthetic oligonucleotide
gcgctggccgtcggggtatgcgtct

SEQ ID NO: 681994 - DNA, 25 bp, Artificial sequence
  Synthetic oligonucleotide
gcgctggccgtccgggtatgcgtct

SEQ ID NO: 681995 - DNA, 25 bp, Artificial sequence
  Synthetic oligonucleotide
tcagctctccgcctacgtccggccg

SEQ ID NO: 681996 - DNA, 25 bp, Artificial sequence
  Synthetic oligonucleotide
tcagctctccgcgtacgtccggccg

SEQ ID NO: 681997 - DNA, 25 bp, Artificial sequence
  Synthetic oligonucleotide
gacgtcgtccgacgcgatgctgcgg

SEQ ID NO: 681998 - DNA, 25 bp, Artificial sequence
  Synthetic oligonucleotide
gacgtcgtccgaggcgatgctgcgg

SEQ ID NO: 681999 - DNA, 25 bp, Artificial sequence
  Synthetic oligonucleotide
cgcgttggtctaacgcgcgcccgac

SEQ ID NO: 682000 - DNA, 25 bp, Artificial sequence
  Synthetic oligonucleotide
cgcgttggtctatcgcgcgcccgac

SEQ ID NO: 682001 - DNA, 25 bp, Artificial sequence
  Synthetic oligonucleotide
cacgtccggactcgtacgccgaggc

SEQ ID NO: 682002 - DNA, 25 bp, Artificial sequence
  Synthetic oligonucleotide
cacgtccggactggtacgccgaggc

SEQ ID NO: 682003 - DNA, 25 bp, Artificial sequence
  Synthetic oligonucleotide
gggggtgaactaccgcgacccccac

SEQ ID NO: 682004 - DNA, 25 bp, Artificial sequence
  Synthetic oligonucleotide
tccagccgcggtaagctcgcacgcc

SEQ ID NO: 682005 - DNA, 25 bp, Artificial sequence
  Synthetic oligonucleotide
gcgcataccgcgtaacggacgccgc

SEQ ID NO: 682006 - DNA, 25 bp, Artificial sequence
  Synthetic oligonucleotide
ccaggcgcgctctagaccggtctcc

SEQ ID NO: 682007 - DNA, 25 bp, Artificial sequence
  Synthetic oligonucleotide
ccaggcgcgctcaagaccggtctcc

SEQ ID NO: 682008 - DNA, 25 bp, Artificial sequence
  Synthetic oligonucleotide
ccttcgggtcgtgcgcgtaggagcc

SEQ ID NO: 682009 - DNA, 25 bp, Artificial sequence
  Synthetic oligonucleotide
ccttcgggtcgtccgcgtaggagcc

SEQ ID NO: 682010 - DNA, 25 bp, Artificial sequence
  Synthetic oligonucleotide
cagcgcgatcgtccgtagcgtccgc

SEQ ID NO: 682011 - DNA, 25 bp, Artificial sequence
  Synthetic oligonucleotide
cagcgcgatcgtgcgtagcgtccgc

SEQ ID NO: 682012 - DNA, 25 bp, Artificial sequence
  Synthetic oligonucleotide
gcctagggactaacgcgcgagccgg

SEQ ID NO: 682013 - DNA, 25 bp, Artificial sequence
  Synthetic oligonucleotide
gcctagggactatcgcgcgagccgg

SEQ ID NO: 682014 - DNA, 25 bp, Artificial sequence
  Synthetic oligonucleotide
cctggggcgtcgcgttaggccacgt

SEQ ID NO: 682015 - DNA, 25 bp, Artificial sequence
  Synthetic oligonucleotide
cctggggcgtcgggttaggccacgt

SEQ ID NO: 682016 - DNA, 25 bp, Artificial sequence
  Synthetic oligonucleotide
gtcggcgtaacgcccgaccctcgac

SEQ ID NO: 682017 - DNA, 25 bp, Artificial sequence
  Synthetic oligonucleotide
ccccggcttgcgagtcgacgggaac

SEQ ID NO: 682018 - DNA, 25 bp, Artificial sequence
  Synthetic oligonucleotide
tccagccgcggttagctcgcacgcc

SEQ ID NO: 682019 - DNA, 25 bp, Artificial sequence
  Synthetic oligonucleotide
ctccgtccgaacgcacgagcgctgg

SEQ ID NO: 682020 - DNA, 25 bp, Artificial sequence
  Synthetic oligonucleotide
caccgcacgtgccgctatctggccc

SEQ ID NO: 682021 - DNA, 25 bp, Artificial sequence
  Synthetic oligonucleotide
caccgcacgtgcggctatctggccc

SEQ ID NO: 682022 - DNA, 25 bp, Artificial sequence
  Synthetic oligonucleotide
gccagccgtcgcggagctagtcgct

SEQ ID NO: 682023 - DNA, 25 bp, Artificial sequence
  Synthetic oligonucleotide
gccagccgtcgccgagctagtcgct

SEQ ID NO: 682024 - DNA, 25 bp, Artificial sequence
  Synthetic oligonucleotide
cggctagttgacccgaggtggcccg

SEQ ID NO: 682025 - DNA, 25 bp, Artificial sequence
  Synthetic oligonucleotide
cggctagttgacgcgaggtggcccg

SEQ ID NO: 682026 - DNA, 25 bp, Artificial sequence
  Synthetic oligonucleotide
gcgagatagggcggcaacggccggt

SEQ ID NO: 682027 - DNA, 25 bp, Artificial sequence
  Synthetic oligonucleotide
gcgagatagggccgcaacggccggt

SEQ ID NO: 682028 - DNA, 25 bp, Artificial sequence
  Synthetic oligonucleotide
ggggctgtcgacacgacccagtccg

SEQ ID NO: 682029 - DNA, 25 bp, Artificial sequence
  Synthetic oligonucleotide
ggggctgtcgactcgacccagtccg

SEQ ID NO: 682030 - DNA, 25 bp, Artificial sequence
  Synthetic oligonucleotide
ccgcacccgcgttgacgtacagccg

SEQ ID NO: 682031 - DNA, 25 bp, Artificial sequence
  Synthetic oligonucleotide
ccgcacccgcgtagacgtacagccg

SEQ ID NO: 682032 - DNA, 25 bp, Artificial sequence
  Synthetic oligonucleotide
gtcggcgtaacggccgaccctcgac

SEQ ID NO: 682033 - DNA, 25 bp, Artificial sequence
  Synthetic oligonucleotide
acacggacggcgctccgacgcatcc

SEQ ID NO: 682034 - DNA, 25 bp, Artificial sequence
  Synthetic oligonucleotide
accgctgatacgggcgggacccagg

SEQ ID NO: 682035 - DNA, 25 bp, Artificial sequence
  Synthetic oligonucleotide
aacgagcccctagtcgacgccgggc

SEQ ID NO: 682036 - DNA, 25 bp, Artificial sequence
  Synthetic oligonucleotide
aacgagcccctactcgacgccgggc

SEQ ID NO: 682037 - DNA, 25 bp, Artificial sequence
  Synthetic oligonucleotide
ggagactacgcgacgcacggtccgc

SEQ ID NO: 682038 - DNA, 25 bp, Artificial sequence
  Synthetic oligonucleotide
ggagactacgcgtcgcacggtccgc

SEQ ID NO: 682039 - DNA, 25 bp, Artificial sequence
  Synthetic oligonucleotide
acgggagtccgttaccgcggctgcc

SEQ ID NO: 682040 - DNA, 25 bp, Artificial sequence
  Synthetic oligonucleotide
acgggagtccgtaaccgcggctgcc

SEQ ID NO: 682041 - DNA, 25 bp, Artificial sequence
  Synthetic oligonucleotide
ggcaggtaccgccgaaccctcgtcc

SEQ ID NO: 682042 - DNA, 25 bp, Artificial sequence
  Synthetic oligonucleotide
ggcaggtaccgcggaaccctcgtcc

SEQ ID NO: 682043 - DNA, 25 bp, Artificial sequence
  Synthetic oligonucleotide
cgcgccgcgtactatgccgagggca

SEQ ID NO: 682044 - DNA, 25 bp, Artificial sequence
  Synthetic oligonucleotide
cgcgccgcgtacaatgccgagggca

SEQ ID NO: 682045 - DNA, 25 bp, Artificial sequence
  Synthetic oligonucleotide
accgcagccgtccggcgtacccatc

SEQ ID NO: 682046 - DNA, 25 bp, Artificial sequence
  Synthetic oligonucleotide
gcgcataccgcgaaacggacgccgc

SEQ ID NO: 682047 - DNA, 25 bp, Artificial sequence
  Synthetic oligonucleotide
acacggacggcggtccgacgcatcc

SEQ ID NO: 682048 - DNA, 25 bp, Artificial sequence
  Synthetic oligonucleotide
ctccgtccgaacccacgagcgctgg

SEQ ID NO: 682049 - DNA, 25 bp, Artificial sequence
  Synthetic oligonucleotide
gggcggtattcgggcccgcccagtt

SEQ ID NO: 682050 - DNA, 25 bp, Artificial sequence
  Synthetic oligonucleotide
gggcggtattcgcgcccgcccagtt

SEQ ID NO: 682051 - DNA, 25 bp, Artificial sequence
  Synthetic oligonucleotide
gtgggcacgtaacgagtcgcgcgcc

SEQ ID NO: 682052 - DNA, 25 bp, Artificial sequence
  Synthetic oligonucleotide
gtgggcacgtaaggagtcgcgcgcc

SEQ ID NO: 682053 - DNA, 25 bp, Artificial sequence
  Synthetic oligonucleotide
cggtcctcgcatacggtcgccccca

SEQ ID NO: 682054 - DNA, 25 bp, Artificial sequence
  Synthetic oligonucleotide
cggtcctcgcattcggtcgccccca

SEQ ID NO: 682055 - DNA, 25 bp, Artificial sequence
  Synthetic oligonucleotide
gagggcacgcttgtacgcgctcccc

SEQ ID NO: 682056 - DNA, 25 bp, Artificial sequence
  Synthetic oligonucleotide
gagggcacgcttctacgcgctcccc

SEQ ID NO: 682057 - DNA, 25 bp, Artificial sequence
  Synthetic oligonucleotide
acgggggcgcgttacgacgcgcaag

SEQ ID NO: 682058 - DNA, 25 bp, Artificial sequence
  Synthetic oligonucleotide
acgggggcgcgtaacgacgcgcaag

SEQ ID NO: 682059 - DNA, 25 bp, Artificial sequence
  Synthetic oligonucleotide
ctggcggtcgcgaactcgacctggg

SEQ ID NO: 682060 - DNA, 25 bp, Artificial sequence
  Synthetic oligonucleotide
ctggcggtcgcgtactcgacctggg

SEQ ID NO: 682061 - DNA, 25 bp, Artificial sequence
  Synthetic oligonucleotide
ccgggagcgataggccgattccggg

SEQ ID NO: 682062 - DNA, 25 bp, Artificial sequence
  Synthetic oligonucleotide
accgcagccgtcgggcgtacccatc

SEQ ID NO: 682063 - DNA, 25 bp, Artificial sequence
  Synthetic oligonucleotide
tcagctcgactcgcctacggcgccc

SEQ ID NO: 682064 - DNA, 25 bp, Artificial sequence
  Synthetic oligonucleotide
acacggcgaacgggggtcggagacg

SEQ ID NO: 682065 - DNA, 25 bp, Artificial sequence
  Synthetic oligonucleotide
ggcggagttccgcgcttcggcgtac

SEQ ID NO: 682066 - DNA, 25 bp, Artificial sequence
  Synthetic oligonucleotide
ggcggagttccgggcttcggcgtac

SEQ ID NO: 682067 - DNA, 25 bp, Artificial sequence
  Synthetic oligonucleotide
gtgtcggctacgttccgccggtccg

SEQ ID NO: 682068 - DNA, 25 bp, Artificial sequence
  Synthetic oligonucleotide
gtgtcggctacgatccgccggtccg

SEQ ID NO: 682069 - DNA, 25 bp, Artificial sequence
  Synthetic oligonucleotide
ctcccgggggcgaattacgcacgcg

SEQ ID NO: 682070 - DNA, 25 bp, Artificial sequence
  Synthetic oligonucleotide
aggggccgagctaaccgcgccacga

SEQ ID NO: 682071 - DNA, 25 bp, Artificial sequence
  Synthetic oligonucleotide
cacgcgcgatcccgcgaacgctgga

SEQ ID NO: 682072 - DNA, 25 bp, Artificial sequence
  Synthetic oligonucleotide
gtccgctcgcgcgtatggtcgagcc

SEQ ID NO: 682073 - DNA, 25 bp, Artificial sequence
  Synthetic oligonucleotide
tcagctcgactcccctacggcgccc

SEQ ID NO: 682074 - DNA, 25 bp, Artificial sequence
  Synthetic oligonucleotide
gtccgctcgcgcctatggtcgagcc

SEQ ID NO: 682075 - DNA, 25 bp, Artificial sequence
  Synthetic oligonucleotide
acacggcgaacgcgggtcggagacg

SEQ ID NO: 682076 - DNA, 25 bp, Artificial sequence
  Synthetic oligonucleotide
ctcccgggggcgtattacgcacgcg

SEQ ID NO: 682077 - DNA, 25 bp, Artificial sequence
  Synthetic oligonucleotide
cgggccttcgaccgcgttcaggcac

SEQ ID NO: 682078 - DNA, 25 bp, Artificial sequence
  Synthetic oligonucleotide
cgggccttcgacggcgttcaggcac

SEQ ID NO: 682079 - DNA, 25 bp, Artificial sequence
  Synthetic oligonucleotide
gcgcgcggaacgtcgcggttttgcg

SEQ ID NO: 682080 - DNA, 25 bp, Artificial sequence
  Synthetic oligonucleotide
gcgcgcggaacgacgcggttttgcg

SEQ ID NO: 682081 - DNA, 25 bp, Artificial sequence
  Synthetic oligonucleotide
agacgccgctaggtacggggtcgcg

SEQ ID NO: 682082 - DNA, 25 bp, Artificial sequence
  Synthetic oligonucleotide
agacgccgctagctacggggtcgcg

SEQ ID NO: 682083 - DNA, 25 bp, Artificial sequence
  Synthetic oligonucleotide
tggccgcgcttaggtccgaggccga

SEQ ID NO: 682084 - DNA, 25 bp, Artificial sequence
  Synthetic oligonucleotide
tggccgcgcttacgtccgaggccga

SEQ ID NO: 682085 - DNA, 25 bp, Artificial sequence
  Synthetic oligonucleotide
ggtctgcgcgtatgcgagcccggtg

SEQ ID NO: 682086 - DNA, 25 bp, Artificial sequence
  Synthetic oligonucleotide
cacgcgcgatccggcgaacgctgga

SEQ ID NO: 682087 - DNA, 25 bp, Artificial sequence
  Synthetic oligonucleotide
gtctggtcgtacgggcccggcatgc

SEQ ID NO: 682088 - DNA, 25 bp, Artificial sequence
  Synthetic oligonucleotide
aggggccgagcttaccgcgccacga

SEQ ID NO: 682089 - DNA, 25 bp, Artificial sequence
  Synthetic oligonucleotide
gggcactatgcgcgatcgggcgcgt

SEQ ID NO: 682090 - DNA, 25 bp, Artificial sequence
  Synthetic oligonucleotide
ggtctgcgcgtaagcgagcccggtg

SEQ ID NO: 682091 - DNA, 25 bp, Artificial sequence
  Synthetic oligonucleotide
cccgacgaatatgcggcgccctgcg

SEQ ID NO: 682092 - DNA, 25 bp, Artificial sequence
  Synthetic oligonucleotide
ggcgaccccgtcatcgcgaatccgg

SEQ ID NO: 682093 - DNA, 25 bp, Artificial sequence
  Synthetic oligonucleotide
acccctcggcgcctactgtctcggg

SEQ ID NO: 682094 - DNA, 25 bp, Artificial sequence
  Synthetic oligonucleotide
tggcgcttcgcccaccgtcctctgg

SEQ ID NO: 682095 - DNA, 25 bp, Artificial sequence
  Synthetic oligonucleotide
tggcgcttcgccgaccgtcctctgg

SEQ ID NO: 682096 - DNA, 25 bp, Artificial sequence
  Synthetic oligonucleotide
gcgggcgcgttaggatacccggctc

SEQ ID NO: 682097 - DNA, 25 bp, Artificial sequence
  Synthetic oligonucleotide
gcgggcgcgttacgatacccggctc

SEQ ID NO: 682098 - DNA, 25 bp, Artificial sequence
  Synthetic oligonucleotide
tggtcggcgctatccgcgtgaccgc

SEQ ID NO: 682099 - DNA, 25 bp, Artificial sequence
  Synthetic oligonucleotide
gggtagacgcgtcgctaggcgagcc

SEQ ID NO: 682100 - DNA, 25 bp, Artificial sequence
  Synthetic oligonucleotide
tggtcggcgctaaccgcgtgaccgc

SEQ ID NO: 682101 - DNA, 25 bp, Artificial sequence
  Synthetic oligonucleotide
cccgacgaatatccggcgccctgcg

SEQ ID NO: 682102 - DNA, 25 bp, Artificial sequence
  Synthetic oligonucleotide
ggggcgacgaattcccgcgcacagg

SEQ ID NO: 682103 - DNA, 25 bp, Artificial sequence
  Synthetic oligonucleotide
ggggcgacgaatacccgcgcacagg

SEQ ID NO: 682104 - DNA, 25 bp, Artificial sequence
  Synthetic oligonucleotide
ggcgctgtcatagcgccgtctggcg

SEQ ID NO: 682105 - DNA, 25 bp, Artificial sequence
  Synthetic oligonucleotide
ggcgctgtcataccgccgtctggcg

SEQ ID NO: 682106 - DNA, 25 bp, Artificial sequence
  Synthetic oligonucleotide
cccgtctagcgcgtcggatccgcac

SEQ ID NO: 682107 - DNA, 25 bp, Artificial sequence
  Synthetic oligonucleotide
gggtagacgcgtggctaggcgagcc

SEQ ID NO: 682108 - DNA, 25 bp, Artificial sequence
  Synthetic oligonucleotide
ccgcccgacttcgcgcgattccggt

SEQ ID NO: 682109 - DNA, 25 bp, Artificial sequence
  Synthetic oligonucleotide
ggcgaccccgtcttcgcgaatccgg

SEQ ID NO: 682110 - DNA, 25 bp, Artificial sequence
  Synthetic oligonucleotide
gccggttaccgccgctcgacccact

SEQ ID NO: 682111 - DNA, 25 bp, Artificial sequence
  Synthetic oligonucleotide
gccggttaccgcggctcgacccact

SEQ ID NO: 682112 - DNA, 25 bp, Artificial sequence
  Synthetic oligonucleotide
cgctcgctcgggggtaacgccgcta

SEQ ID NO: 682113 - DNA, 25 bp, Artificial sequence
  Synthetic oligonucleotide
cgctcgctcgggcgtaacgccgcta

SEQ ID NO: 682114 - DNA, 25 bp, Artificial sequence
  Synthetic oligonucleotide
cctccatacgcaccgaccgtcgccg

SEQ ID NO: 682115 - DNA, 25 bp, Artificial sequence
  Synthetic oligonucleotide
acccctcggcgcgtactgtctcggg

SEQ ID NO: 682116 - DNA, 25 bp, Artificial sequence
  Synthetic oligonucleotide
ccgcccgacttcccgcgattccggt

SEQ ID NO: 682117 - DNA, 25 bp, Artificial sequence
  Synthetic oligonucleotide
ccgtgccgcatagtacggccccgtc

SEQ ID NO: 682118 - DNA, 25 bp, Artificial sequence
  Synthetic oligonucleotide
ggcgttggcgcttcgtcgaccggag

SEQ ID NO: 682119 - DNA, 25 bp, Artificial sequence
  Synthetic oligonucleotide
ggcgttggcgctacgtcgaccggag

SEQ ID NO: 682120 - DNA, 25 bp, Artificial sequence
  Synthetic oligonucleotide
cgcggccgatacgccacgtgttccc

SEQ ID NO: 682121 - DNA, 25 bp, Artificial sequence
  Synthetic oligonucleotide
cgcggccgataccccacgtgttccc

SEQ ID NO: 682122 - DNA, 25 bp, Artificial sequence
  Synthetic oligonucleotide
tccgcttatacgcggcccggagccc

SEQ ID NO: 682123 - DNA, 25 bp, Artificial sequence
  Synthetic oligonucleotide
tccgcttatacggggcccggagccc

SEQ ID NO: 682124 - DNA, 25 bp, Artificial sequence
  Synthetic oligonucleotide
cctccatacgcagcgaccgtcgccg

SEQ ID NO: 682125 - DNA, 25 bp, Artificial sequence
  Synthetic oligonucleotide
ggggccttacgcggacccgtgtcca

SEQ ID NO: 682126 - DNA, 25 bp, Artificial sequence
  Synthetic oligonucleotide
ctcacccgtcgcccgaacacggtgc

SEQ ID NO: 682127 - DNA, 25 bp, Artificial sequence
  Synthetic oligonucleotide
ccgcgacgcggaaaactcgtggcgc

SEQ ID NO: 682128 - DNA, 25 bp, Artificial sequence
  Synthetic oligonucleotide
ccgcgacgcggataactcgtggcgc

SEQ ID NO: 682129 - DNA, 25 bp, Artificial sequence
  Synthetic oligonucleotide
cggagctacgcccgtcgcttgcgag

SEQ ID NO: 682130 - DNA, 25 bp, Artificial sequence
  Synthetic oligonucleotide
cggagctacgccggtcgcttgcgag

SEQ ID NO: 682131 - DNA, 25 bp, Artificial sequence
  Synthetic oligonucleotide
agcggccgcgggtctagcggtgtag

SEQ ID NO: 682132 - DNA, 25 bp, Artificial sequence
  Synthetic oligonucleotide
acgcctgtaggttcgcgcgggacgc

SEQ ID NO: 682133 - DNA, 25 bp, Artificial sequence
  Synthetic oligonucleotide
ggggccttacgccgacccgtgtcca

SEQ ID NO: 682134 - DNA, 25 bp, Artificial sequence
  Synthetic oligonucleotide
ggagaggacgggacgactcgcgctc

SEQ ID NO: 682135 - DNA, 25 bp, Artificial sequence
  Synthetic oligonucleotide
cctggcgtacgtagccgcgccaggt

SEQ ID NO: 682136 - DNA, 25 bp, Artificial sequence
  Synthetic oligonucleotide
cctggcgtacgttgccgcgccaggt

SEQ ID NO: 682137 - DNA, 25 bp, Artificial sequence
  Synthetic oligonucleotide
ctagcccgagtcgcgctagaggggc

SEQ ID NO: 682138 - DNA, 25 bp, Artificial sequence
  Synthetic oligonucleotide
ctagcccgagtcccgctagaggggc

SEQ ID NO: 682139 - DNA, 25 bp, Artificial sequence
  Synthetic oligonucleotide
gcccgcgtacgagcgacgcggacaa

SEQ ID NO: 682140 - DNA, 25 bp, Artificial sequence
  Synthetic oligonucleotide
gcggtcgacggtggttccgtgccca

SEQ ID NO: 682141 - DNA, 25 bp, Artificial sequence
  Synthetic oligonucleotide
agcggccgcgggactagcggtgtag

SEQ ID NO: 682142 - DNA, 25 bp, Artificial sequence
  Synthetic oligonucleotide
ccgggactaccgtcgctcgagcgtc

SEQ ID NO: 682143 - DNA, 25 bp, Artificial sequence
  Synthetic oligonucleotide
cccgtctagcgcctcggatccgcac

SEQ ID NO: 682144 - DNA, 25 bp, Artificial sequence
  Synthetic oligonucleotide
ggccgtgtaacgccgcgacccaacg

SEQ ID NO: 682145 - DNA, 25 bp, Artificial sequence
  Synthetic oligonucleotide
ggccgtgtaacggcgcgacccaacg

SEQ ID NO: 682146 - DNA, 25 bp, Artificial sequence
  Synthetic oligonucleotide
tcgccgcgcggtatgtccaccgacc

SEQ ID NO: 682147 - DNA, 25 bp, Artificial sequence
  Synthetic oligonucleotide
tcgccgcgcggtttgtccaccgacc

SEQ ID NO: 682148 - DNA, 25 bp, Artificial sequence
  Synthetic oligonucleotide
gggcactatgcgggatcgggcgcgt

SEQ ID NO: 682149 - DNA, 25 bp, Artificial sequence
  Synthetic oligonucleotide
ctcacccgtcgcgcgaacacggtgc

SEQ ID NO: 682150 - DNA, 25 bp, Artificial sequence
  Synthetic oligonucleotide
ccgggactaccgacgctcgagcgtc

SEQ ID NO: 682151 - DNA, 25 bp, Artificial sequence
  Synthetic oligonucleotide
ggagaggacgggtcgactcgcgctc

SEQ ID NO: 682152 - DNA, 25 bp, Artificial sequence
  Synthetic oligonucleotide
catcccgtcgaccgtacgcgccgag

SEQ ID NO: 682153 - DNA, 25 bp, Artificial sequence
  Synthetic oligonucleotide
catcccgtcgacggtacgcgccgag

SEQ ID NO: 682154 - DNA, 25 bp, Artificial sequence
  Synthetic oligonucleotide
tccctgtgacgcgtagcggtccgcc

SEQ ID NO: 682155 - DNA, 25 bp, Artificial sequence
  Synthetic oligonucleotide
tccctgtgacgcctagcggtccgcc

SEQ ID NO: 682156 - DNA, 25 bp, Artificial sequence
  Synthetic oligonucleotide
taggggtcgtaacccgcgcctcgcc

SEQ ID NO: 682157 - DNA, 25 bp, Artificial sequence
  Synthetic oligonucleotide
taggggtcgtaagccgcgcctcgcc

SEQ ID NO: 682158 - DNA, 25 bp, Artificial sequence
  Synthetic oligonucleotide
ccgtgccgcatactacggccccgtc

SEQ ID NO: 682159 - DNA, 25 bp, Artificial sequence
  Synthetic oligonucleotide
gcggtcgacggtcgttccgtgccca

SEQ ID NO: 682160 - DNA, 25 bp, Artificial sequence
  Synthetic oligonucleotide
ccgggctgtgcgtcccgtactaccc

SEQ ID NO: 682161 - DNA, 25 bp, Artificial sequence
  Synthetic oligonucleotide
gcccccacttcgcgcgtgtgtccgt

SEQ ID NO: 682162 - DNA, 25 bp, Artificial sequence
  Synthetic oligonucleotide
gggtcggtcgtctacgcgcgactgg

SEQ ID NO: 682163 - DNA, 25 bp, Artificial sequence
  Synthetic oligonucleotide
cacgcgcgggtcccgtatagcccac

SEQ ID NO: 682164 - DNA, 25 bp, Artificial sequence
  Synthetic oligonucleotide
ccgcagtcgcgcctatgcggatgcc

SEQ ID NO: 682165 - DNA, 25 bp, Artificial sequence
  Synthetic oligonucleotide
ccgcagtcgcgcgtatgcggatgcc

SEQ ID NO: 682166 - DNA, 25 bp, Artificial sequence
  Synthetic oligonucleotide
tcgtccccgatgtcggacggtcccg

SEQ ID NO: 682167 - DNA, 25 bp, Artificial sequence
  Synthetic oligonucleotide
gaaccccgtcgatcgcgcagggcag

SEQ ID NO: 682168 - DNA, 25 bp, Artificial sequence
  Synthetic oligonucleotide
ccgggctgtgcgacccgtactaccc

SEQ ID NO: 682169 - DNA, 25 bp, Artificial sequence
  Synthetic oligonucleotide
cacggacgcggctacgtacggcgca

SEQ ID NO: 682170 - DNA, 25 bp, Artificial sequence
  Synthetic oligonucleotide
ggcacggaaggcgcgttaccgtccc

SEQ ID NO: 682171 - DNA, 25 bp, Artificial sequence
  Synthetic oligonucleotide
ggcacggaaggcccgttaccgtccc

SEQ ID NO: 682172 - DNA, 25 bp, Artificial sequence
  Synthetic oligonucleotide
gccccttaggactcccgcgacaggg

SEQ ID NO: 682173 - DNA, 25 bp, Artificial sequence
  Synthetic oligonucleotide
gccccttaggacacccgcgacaggg

SEQ ID NO: 682174 - DNA, 25 bp, Artificial sequence
  Synthetic oligonucleotide
tcttggtcgaacggccccgcggcgt

SEQ ID NO: 682175 - DNA, 25 bp, Artificial sequence
  Synthetic oligonucleotide
tcttggtcgaaccgccccgcggcgt

SEQ ID NO: 682176 - DNA, 25 bp, Artificial sequence
  Synthetic oligonucleotide
tcgtccccgatgacggacggtcccg

SEQ ID NO: 682177 - DNA, 25 bp, Artificial sequence
  Synthetic oligonucleotide
gagtgcgcgggcaagtacgcgccga

SEQ ID NO: 682178 - DNA, 25 bp, Artificial sequence
  Synthetic oligonucleotide
gagtgcgcgggctagtacgcgccga

SEQ ID NO: 682179 - DNA, 25 bp, Artificial sequence
  Synthetic oligonucleotide
gcgcccggcatagtagcgggagtgg

SEQ ID NO: 682180 - DNA, 25 bp, Artificial sequence
  Synthetic oligonucleotide
gcgcccggcatactagcgggagtgg

SEQ ID NO: 682181 - DNA, 25 bp, Artificial sequence
  Synthetic oligonucleotide
cggggcaggcgccgtaacgatcgac

SEQ ID NO: 682182 - DNA, 25 bp, Artificial sequence
  Synthetic oligonucleotide
cggggcaggcgcggtaacgatcgac

SEQ ID NO: 682183 - DNA, 25 bp, Artificial sequence
  Synthetic oligonucleotide
gactatccggcgcgactgtcgggcg

SEQ ID NO: 682184 - DNA, 25 bp, Artificial sequence
  Synthetic oligonucleotide
gcccccacttcgggcgtgtgtccgt

SEQ ID NO: 682185 - DNA, 25 bp, Artificial sequence
  Synthetic oligonucleotide
acaccgtcgcacgacgtgccgcagg

SEQ ID NO: 682186 - DNA, 25 bp, Artificial sequence
  Synthetic oligonucleotide
cacggacgcggcaacgtacggcgca

SEQ ID NO: 682187 - DNA, 25 bp, Artificial sequence
  Synthetic oligonucleotide
acgcctgtaggtacgcgcgggacgc

SEQ ID NO: 682188 - DNA, 25 bp, Artificial sequence
  Synthetic oligonucleotide
gcccgcgtacgaccgacgcggacaa

SEQ ID NO: 682189 - DNA, 25 bp, Artificial sequence
  Synthetic oligonucleotide
cgctgccgtcctaccggtcggtcct

SEQ ID NO: 682190 - DNA, 25 bp, Artificial sequence
  Synthetic oligonucleotide
acaccgtcgcaccacgtgccgcagg

SEQ ID NO: 682191 - DNA, 25 bp, Artificial sequence
  Synthetic oligonucleotide
gcgtacgcgctaacgggcgccacag

SEQ ID NO: 682192 - DNA, 25 bp, Artificial sequence
  Synthetic oligonucleotide
gcgtacgcgctatcgggcgccacag

SEQ ID NO: 682193 - DNA, 25 bp, Artificial sequence
  Synthetic oligonucleotide
cacgcgcgggtcgcgtatagcccac

SEQ ID NO: 682194 - DNA, 25 bp, Artificial sequence
  Synthetic oligonucleotide
gactatccggcgggactgtcgggcg

SEQ ID NO: 682195 - DNA, 25 bp, Artificial sequence
  Synthetic oligonucleotide
gctcgcccgacgggtcgaaggtgct

SEQ ID NO: 682196 - DNA, 25 bp, Artificial sequence
  Synthetic oligonucleotide
ccaggacgcgcccgttaagacggcg

SEQ ID NO: 682197 - DNA, 25 bp, Artificial sequence
  Synthetic oligonucleotide
ccaggacgcgccggttaagacggcg

SEQ ID NO: 682198 - DNA, 25 bp, Artificial sequence
  Synthetic oligonucleotide
gccccgacggtccatcccctcgcat

SEQ ID NO: 682199 - DNA, 25 bp, Artificial sequence
  Synthetic oligonucleotide
gccccgacggtcgatcccctcgcat

SEQ ID NO: 682200 - DNA, 25 bp, Artificial sequence
  Synthetic oligonucleotide
cccccgcgtactgtcgggtcacacc

SEQ ID NO: 682201 - DNA, 25 bp, Artificial sequence
  Synthetic oligonucleotide
gaaccccgtcgaacgcgcagggcag

SEQ ID NO: 682202 - DNA, 25 bp, Artificial sequence
  Synthetic oligonucleotide
tggagcgtaacgcacgccgccgcac

SEQ ID NO: 682203 - DNA, 25 bp, Artificial sequence
  Synthetic oligonucleotide
gcgggtgcgatcgtgcgtaaggcgg

SEQ ID NO: 682204 - DNA, 25 bp, Artificial sequence
  Synthetic oligonucleotide
tggagcgtaacggacgccgccgcac

SEQ ID NO: 682205 - DNA, 25 bp, Artificial sequence
  Synthetic oligonucleotide
cccccgcgtactctcgggtcacacc

SEQ ID NO: 682206 - DNA, 25 bp, Artificial sequence
  Synthetic oligonucleotide
gctcgcccgacgcgtcgaaggtgct

SEQ ID NO: 682207 - DNA, 25 bp, Artificial sequence
  Synthetic oligonucleotide
ccggctcccgcgctattcggttggg

SEQ ID NO: 682208 - DNA, 25 bp, Artificial sequence
  Synthetic oligonucleotide
ccggctcccgcggtattcggttggg

SEQ ID NO: 682209 - DNA, 25 bp, Artificial sequence
  Synthetic oligonucleotide
gctagcctaacgaccgcccgccagg

SEQ ID NO: 682210 - DNA, 25 bp, Artificial sequence
  Synthetic oligonucleotide
gctagcctaacgtccgcccgccagg

SEQ ID NO: 682211 - DNA, 25 bp, Artificial sequence
  Synthetic oligonucleotide
cccggaacgtatggccgcgtcccag

SEQ ID NO: 682212 - DNA, 25 bp, Artificial sequence
  Synthetic oligonucleotide
cccggaacgtatcgccgcgtcccag

SEQ ID NO: 682213 - DNA, 25 bp, Artificial sequence
  Synthetic oligonucleotide
cgctgccgtccttccggtcggtcct

SEQ ID NO: 682214 - DNA, 25 bp, Artificial sequence
  Synthetic oligonucleotide
gggtcggtcgtcaacgcgcgactgg

SEQ ID NO: 682215 - DNA, 25 bp, Artificial sequence
  Synthetic oligonucleotide
tcgcgcgtaccgtcgacggccccat

SEQ ID NO: 682216 - DNA, 25 bp, Artificial sequence
  Synthetic oligonucleotide
ggagtcgcggtatcgcgaaccggcg

SEQ ID NO: 682217 - DNA, 25 bp, Artificial sequence
  Synthetic oligonucleotide
cagagggcgcgacgtacgtggggag

SEQ ID NO: 682218 - DNA, 25 bp, Artificial sequence
  Synthetic oligonucleotide
cagagggcgcgaggtacgtggggag

SEQ ID NO: 682219 - DNA, 25 bp, Artificial sequence
  Synthetic oligonucleotide
gaggcccgtcggcctaagacgcgca

SEQ ID NO: 682220 - DNA, 25 bp, Artificial sequence
  Synthetic oligonucleotide
gaggcccgtcgggctaagacgcgca

SEQ ID NO: 682221 - DNA, 25 bp, Artificial sequence
  Synthetic oligonucleotide
gcgggtgcgatcctgcgtaaggcgg

SEQ ID NO: 682222 - DNA, 25 bp, Artificial sequence
  Synthetic oligonucleotide
cgccggacgcgcgatggatgtcgca

SEQ ID NO: 682223 - DNA, 25 bp, Artificial sequence
  Synthetic oligonucleotide
ggagtcgcggtaacgcgaaccggcg

SEQ ID NO: 682224 - DNA, 25 bp, Artificial sequence
  Synthetic oligonucleotide
tcgcgcgtaccgacgacggccccat

SEQ ID NO: 682225 - DNA, 25 bp, Artificial sequence
  Synthetic oligonucleotide
gaagggtgttgtcgcgcggcggagc

SEQ ID NO: 682226 - DNA, 25 bp, Artificial sequence
  Synthetic oligonucleotide
cctacgcgtcgaacgtctgggggcc

SEQ ID NO: 682227 - DNA, 25 bp, Artificial sequence
  Synthetic oligonucleotide
cctacgcgtcgatcgtctgggggcc

SEQ ID NO: 682228 - DNA, 25 bp, Artificial sequence
  Synthetic oligonucleotide
gaagggtgttgtggcgcggcggagc

SEQ ID NO: 682229 - DNA, 25 bp, Artificial sequence
  Synthetic oligonucleotide
cgccggacgcgccatggatgtcgca

SEQ ID NO: 682230 - DNA, 25 bp, Artificial sequence
  Synthetic oligonucleotide
tcggtgccaggcgtacgacccccgg

SEQ ID NO: 682231 - DNA, 25 bp, Artificial sequence
  Synthetic oligonucleotide
gcatgcggcgtcgaacgctcgggcc

SEQ ID NO: 682232 - DNA, 25 bp, Artificial sequence
  Synthetic oligonucleotide
cgccggccgtacccgtctggtgcca

SEQ ID NO: 682233 - DNA, 25 bp, Artificial sequence
  Synthetic oligonucleotide
tgccgccgggtgggatacggacgcg

SEQ ID NO: 682234 - DNA, 25 bp, Artificial sequence
  Synthetic oligonucleotide
cgccggccgtacgcgtctggtgcca

SEQ ID NO: 682235 - DNA, 25 bp, Artificial sequence
  Synthetic oligonucleotide
tcggtgccaggcctacgacccccgg

SEQ ID NO: 682236 - DNA, 25 bp, Artificial sequence
  Synthetic oligonucleotide
cgggagcgcgatagaacgcgcggcc

SEQ ID NO: 682237 - DNA, 25 bp, Artificial sequence
  Synthetic oligonucleotide
tcgggagttcgagcgcgcgggtcgc

SEQ ID NO: 682238 - DNA, 25 bp, Artificial sequence
  Synthetic oligonucleotide
caccgtcgtgcgggatagggggggg

SEQ ID NO: 682239 - DNA, 25 bp, Artificial sequence
  Synthetic oligonucleotide
tcgggagttcgaccgcgcgggtcgc

SEQ ID NO: 682240 - DNA, 25 bp, Artificial sequence
  Synthetic oligonucleotide
caccgtcgtgcgcgatagggggggg

SEQ ID NO: 682241 - DNA, 25 bp, Artificial sequence
  Synthetic oligonucleotide
cccgagcgagtacccgcgaccctcg

SEQ ID NO: 682242 - DNA, 25 bp, Artificial sequence
  Synthetic oligonucleotide
agggccatcggttgcgcgcggtcgg

SEQ ID NO: 682243 - DNA, 25 bp, Artificial sequence
  Synthetic oligonucleotide
cccgagcgagtagccgcgaccctcg

SEQ ID NO: 682244 - DNA, 25 bp, Artificial sequence
  Synthetic oligonucleotide
cgggagcgcgattgaacgcgcggcc

SEQ ID NO: 682245 - DNA, 25 bp, Artificial sequence
  Synthetic oligonucleotide
tgccacggtcgctaccggagcgcgg

SEQ ID NO: 682246 - DNA, 25 bp, Artificial sequence
  Synthetic oligonucleotide
gggccgccgtcgaacgacctgaccc

SEQ ID NO: 682247 - DNA, 25 bp, Artificial sequence
  Synthetic oligonucleotide
gcatgcggcgtccaacgctcgggcc

SEQ ID NO: 682248 - DNA, 25 bp, Artificial sequence
  Synthetic oligonucleotide
gggccgcggcgcacgctaactcgct

SEQ ID NO: 682249 - DNA, 25 bp, Artificial sequence
  Synthetic oligonucleotide
tgccacggtcgcaaccggagcgcgg

SEQ ID NO: 682250 - DNA, 25 bp, Artificial sequence
  Synthetic oligonucleotide
tcacgctgatcgcggtccgcccccc

SEQ ID NO: 682251 - DNA, 25 bp, Artificial sequence
  Synthetic oligonucleotide
tcacgctgatcggggtccgcccccc

SEQ ID NO: 682252 - DNA, 25 bp, Artificial sequence
  Synthetic oligonucleotide
acgggcgtcggcggatacggcgcgt

SEQ ID NO: 682253 - DNA, 25 bp, Artificial sequence
  Synthetic oligonucleotide
ggcgtgtacccgccgcgatgccgtg

SEQ ID NO: 682254 - DNA, 25 bp, Artificial sequence
  Synthetic oligonucleotide
gggccgccgtcgtacgacctgaccc

SEQ ID NO: 682255 - DNA, 25 bp, Artificial sequence
  Synthetic oligonucleotide
ggcgtgtacccggcgcgatgccgtg

SEQ ID NO: 682256 - DNA, 25 bp, Artificial sequence
  Synthetic oligonucleotide
gcccgcacgcgttgcgggactgagg

SEQ ID NO: 682257 - DNA, 25 bp, Artificial sequence
  Synthetic oligonucleotide
cccaccgggcatacgcgacccgagc

SEQ ID NO: 682258 - DNA, 25 bp, Artificial sequence
  Synthetic oligonucleotide
cccaccgggcattcgcgacccgagc

SEQ ID NO: 682259 - DNA, 25 bp, Artificial sequence
  Synthetic oligonucleotide
agcgggcgcgcgcactatgcggcga

SEQ ID NO: 682260 - DNA, 25 bp, Artificial sequence
  Synthetic oligonucleotide
agcgggcgcgcggactatgcggcga

SEQ ID NO: 682261 - DNA, 25 bp, Artificial sequence
  Synthetic oligonucleotide
agggccatcggtagcgcgcggtcgg

SEQ ID NO: 682262 - DNA, 25 bp, Artificial sequence
  Synthetic oligonucleotide
ggggcgggcggcgtatcgtggtctg

SEQ ID NO: 682263 - DNA, 25 bp, Artificial sequence
  Synthetic oligonucleotide
acgggcgtcggccgatacggcgcgt

SEQ ID NO: 682264 - DNA, 25 bp, Artificial sequence
  Synthetic oligonucleotide
acggtgctaaccggcgcgtcgccgc

SEQ ID NO: 682265 - DNA, 25 bp, Artificial sequence
  Synthetic oligonucleotide
gaggacccggcgctagtcgccaccc

SEQ ID NO: 682266 - DNA, 25 bp, Artificial sequence
  Synthetic oligonucleotide
ttcggcgcgtacgtctcggcggccc

SEQ ID NO: 682267 - DNA, 25 bp, Artificial sequence
  Synthetic oligonucleotide
ttcggcgcgtacctctcggcggccc

SEQ ID NO: 682268 - DNA, 25 bp, Artificial sequence
  Synthetic oligonucleotide
acctgcccccgtttcgccggcgcag

SEQ ID NO: 682269 - DNA, 25 bp, Artificial sequence
  Synthetic oligonucleotide
acctgcccccgtatcgccggcgcag

SEQ ID NO: 682270 - DNA, 25 bp, Artificial sequence
  Synthetic oligonucleotide
gaggacccggcggtagtcgccaccc

SEQ ID NO: 682271 - DNA, 25 bp, Artificial sequence
  Synthetic oligonucleotide
cctggccacggcatcgcgacggcga

SEQ ID NO: 682272 - DNA, 25 bp, Artificial sequence
  Synthetic oligonucleotide
acggtgctaacccgcgcgtcgccgc

SEQ ID NO: 682273 - DNA, 25 bp, Artificial sequence
  Synthetic oligonucleotide
agggcctcggtccactcgcgccagc

SEQ ID NO: 682274 - DNA, 25 bp, Artificial sequence
  Synthetic oligonucleotide
gcacggagcgcgcactacgcgggac

SEQ ID NO: 682275 - DNA, 25 bp, Artificial sequence
  Synthetic oligonucleotide
gcacggagcgcggactacgcgggac

SEQ ID NO: 682276 - DNA, 25 bp, Artificial sequence
  Synthetic oligonucleotide
gcggcgggtacccatacgccagcgg

SEQ ID NO: 682277 - DNA, 25 bp, Artificial sequence
  Synthetic oligonucleotide
gcggcgggtaccgatacgccagcgg

SEQ ID NO: 682278 - DNA, 25 bp, Artificial sequence
  Synthetic oligonucleotide
gcgcgcacccccgtcggacggcatt

SEQ ID NO: 682279 - DNA, 25 bp, Artificial sequence
  Synthetic oligonucleotide
tgccgccgggtgcgatacggacgcg

SEQ ID NO: 682280 - DNA, 25 bp, Artificial sequence
  Synthetic oligonucleotide
cggcactagttcccgaccggcgcgc

SEQ ID NO: 682281 - DNA, 25 bp, Artificial sequence
  Synthetic oligonucleotide
gggccgcggcgctcgctaactcgct

SEQ ID NO: 682282 - DNA, 25 bp, Artificial sequence
  Synthetic oligonucleotide
gccaggggtaccgtcgagcccgacc

SEQ ID NO: 682283 - DNA, 25 bp, Artificial sequence
  Synthetic oligonucleotide
ccccgcctgcgaggcacgaccgaag

SEQ ID NO: 682284 - DNA, 25 bp, Artificial sequence
  Synthetic oligonucleotide
cggacgcggtcggtacggaccctgc

SEQ ID NO: 682285 - DNA, 25 bp, Artificial sequence
  Synthetic oligonucleotide
cggacgcggtcgctacggaccctgc

SEQ ID NO: 682286 - DNA, 25 bp, Artificial sequence
  Synthetic oligonucleotide
ccgggtcccggttcgtcgcagctgg

SEQ ID NO: 682287 - DNA, 25 bp, Artificial sequence
  Synthetic oligonucleotide
ccgggtcccggtacgtcgcagctgg

SEQ ID NO: 682288 - DNA, 25 bp, Artificial sequence
  Synthetic oligonucleotide
cccgggtctcgaggtgcgacgtgcg

SEQ ID NO: 682289 - DNA, 25 bp, Artificial sequence
  Synthetic oligonucleotide
cctggccacggcttcgcgacggcga

SEQ ID NO: 682290 - DNA, 25 bp, Artificial sequence
  Synthetic oligonucleotide
gccaggggtaccctcgagcccgacc

SEQ ID NO: 682291 - DNA, 25 bp, Artificial sequence
  Synthetic oligonucleotide
ccccgcctgcgacgcacgaccgaag

SEQ ID NO: 682292 - DNA, 25 bp, Artificial sequence
  Synthetic oligonucleotide
cgtgcgtccgcgacgttcggcggct

SEQ ID NO: 682293 - DNA, 25 bp, Artificial sequence
  Synthetic oligonucleotide
cgtgcgtccgcgtcgttcggcggct

SEQ ID NO: 682294 - DNA, 25 bp, Artificial sequence
  Synthetic oligonucleotide
tgctggcgctcgggttacggccgcg

SEQ ID NO: 682295 - DNA, 25 bp, Artificial sequence
  Synthetic oligonucleotide
tgctggcgctcgcgttacggccgcg

SEQ ID NO: 682296 - DNA, 25 bp, Artificial sequence
  Synthetic oligonucleotide
cctgccccccgttcgtcgcagagcc

SEQ ID NO: 682297 - DNA, 25 bp, Artificial sequence
  Synthetic oligonucleotide
cctgccccccgtacgtcgcagagcc

SEQ ID NO: 682298 - DNA, 25 bp, Artificial sequence
  Synthetic oligonucleotide
agggcctcggtcgactcgcgccagc

SEQ ID NO: 682299 - DNA, 25 bp, Artificial sequence
  Synthetic oligonucleotide
cccgggtctcgacgtgcgacgtgcg

SEQ ID NO: 682300 - DNA, 25 bp, Artificial sequence
  Synthetic oligonucleotide
cgcccggtcgtaggccccgcgagta

SEQ ID NO: 682301 - DNA, 25 bp, Artificial sequence
  Synthetic oligonucleotide
gcctacgcgtgccgaccgagccagc

SEQ ID NO: 682302 - DNA, 25 bp, Artificial sequence
  Synthetic oligonucleotide
ccccgccaactacgtcgcgccaggg

SEQ ID NO: 682303 - DNA, 25 bp, Artificial sequence
  Synthetic oligonucleotide
cgcgcgctaacccgtccgatggccg

SEQ ID NO: 682304 - DNA, 25 bp, Artificial sequence
  Synthetic oligonucleotide
cgcgcgctaaccggtccgatggccg

SEQ ID NO: 682305 - DNA, 25 bp, Artificial sequence
  Synthetic oligonucleotide
gctggagatagcgccgcgcgacccc

SEQ ID NO: 682306 - DNA, 25 bp, Artificial sequence
  Synthetic oligonucleotide
gctggagatagccccgcgcgacccc

SEQ ID NO: 682307 - DNA, 25 bp, Artificial sequence
  Synthetic oligonucleotide
gcggtagaccgggcgtacgcgggtc

SEQ ID NO: 682308 - DNA, 25 bp, Artificial sequence
  Synthetic oligonucleotide
gcactgggtcggtcccgacggcgac

SEQ ID NO: 682309 - DNA, 25 bp, Artificial sequence
  Synthetic oligonucleotide
cgcccggtcgtacgccccgcgagta

SEQ ID NO: 682310 - DNA, 25 bp, Artificial sequence
  Synthetic oligonucleotide
gcactgggtcggacccgacggcgac

SEQ ID NO: 682311 - DNA, 25 bp, Artificial sequence
  Synthetic oligonucleotide
gggggaggaccgatgcgtcacgcgg

SEQ ID NO: 682312 - DNA, 25 bp, Artificial sequence
  Synthetic oligonucleotide
gggggaggaccgttgcgtcacgcgg

SEQ ID NO: 682313 - DNA, 25 bp, Artificial sequence
  Synthetic oligonucleotide
ccgctctgcggtttccggcgcacgg

SEQ ID NO: 682314 - DNA, 25 bp, Artificial sequence
  Synthetic oligonucleotide
ccgctctgcggtatccggcgcacgg

SEQ ID NO: 682315 - DNA, 25 bp, Artificial sequence
  Synthetic oligonucleotide
cgcggcacgccgttacgcaggcctc

SEQ ID NO: 682316 - DNA, 25 bp, Artificial sequence
  Synthetic oligonucleotide
cgcggcacgccgatacgcaggcctc

SEQ ID NO: 682317 - DNA, 25 bp, Artificial sequence
  Synthetic oligonucleotide
gcgggggatcgttcacgcggcggtc

SEQ ID NO: 682318 - DNA, 25 bp, Artificial sequence
  Synthetic oligonucleotide
gcgggggatcgtacacgcggcggtc

SEQ ID NO: 682319 - DNA, 25 bp, Artificial sequence
  Synthetic oligonucleotide
gcggtagaccggccgtacgcgggtc

SEQ ID NO: 682320 - DNA, 25 bp, Artificial sequence
  Synthetic oligonucleotide
gcgcttgtagcgcgcaacgggccgg

SEQ ID NO: 682321 - DNA, 25 bp, Artificial sequence
  Synthetic oligonucleotide
ggcacgcggccggtaaccgcgttcg

SEQ ID NO: 682322 - DNA, 25 bp, Artificial sequence
  Synthetic oligonucleotide
ggcacgcggccgctaaccgcgttcg

SEQ ID NO: 682323 - DNA, 25 bp, Artificial sequence
  Synthetic oligonucleotide
gggctaacctcgcgtcgggcgtccg

SEQ ID NO: 682324 - DNA, 25 bp, Artificial sequence
  Synthetic oligonucleotide
gggctaacctcgggtcgggcgtccg

SEQ ID NO: 682325 - DNA, 25 bp, Artificial sequence
  Synthetic oligonucleotide
ccgccgccgcgctagtacgccggat

SEQ ID NO: 682326 - DNA, 25 bp, Artificial sequence
  Synthetic oligonucleotide
ccgccgccgcgcaagtacgccggat

SEQ ID NO: 682327 - DNA, 25 bp, Artificial sequence
  Synthetic oligonucleotide
cgcgcggcacgaccgcgaatggtgc

SEQ ID NO: 682328 - DNA, 25 bp, Artificial sequence
  Synthetic oligonucleotide
ccccgccaactaggtcgcgccaggg

SEQ ID NO: 682329 - DNA, 25 bp, Artificial sequence
  Synthetic oligonucleotide
gcgcttgtagcgggcaacgggccgg

SEQ ID NO: 682330 - DNA, 25 bp, Artificial sequence
  Synthetic oligonucleotide
accccagcgcgagacggtacgcggg

SEQ ID NO: 682331 - DNA, 25 bp, Artificial sequence
  Synthetic oligonucleotide
gcgcggctaactgcgtcggcggacc

SEQ ID NO: 682332 - DNA, 25 bp, Artificial sequence
  Synthetic oligonucleotide
gcgcggctaactccgtcggcggacc

SEQ ID NO: 682333 - DNA, 25 bp, Artificial sequence
  Synthetic oligonucleotide
cacgcccgggtaaacggccgcccga

SEQ ID NO: 682334 - DNA, 25 bp, Artificial sequence
  Synthetic oligonucleotide
cacgcccgggtatacggccgcccga

SEQ ID NO: 682335 - DNA, 25 bp, Artificial sequence
  Synthetic oligonucleotide
gcccgcacgcgtagcgggactgagg

SEQ ID NO: 682336 - DNA, 25 bp, Artificial sequence
  Synthetic oligonucleotide
cggcactagttcgcgaccggcgcgc

SEQ ID NO: 682337 - DNA, 25 bp, Artificial sequence
  Synthetic oligonucleotide
gcgcgcacccccctcggacggcatt

SEQ ID NO: 682338 - DNA, 25 bp, Artificial sequence
  Synthetic oligonucleotide
gcctacgcgtgcggaccgagccagc

SEQ ID NO: 682339 - DNA, 25 bp, Artificial sequence
  Synthetic oligonucleotide
cgcgcggcacgagcgcgaatggtgc

SEQ ID NO: 682340 - DNA, 25 bp, Artificial sequence
  Synthetic oligonucleotide
cgatcggtgcgttcccccgcccagg

SEQ ID NO: 682341 - DNA, 25 bp, Artificial sequence
  Synthetic oligonucleotide
cccgggcgcgacgcgcgataccttg

SEQ ID NO: 682342 - DNA, 25 bp, Artificial sequence
  Synthetic oligonucleotide
cccgagccggtgggactcgccgact

SEQ ID NO: 682343 - DNA, 25 bp, Artificial sequence
  Synthetic oligonucleotide
cccgagccggtgcgactcgccgact

SEQ ID NO: 682344 - DNA, 25 bp, Artificial sequence
  Synthetic oligonucleotide
ggccgggccgcgtcacgttcctgac

SEQ ID NO: 682345 - DNA, 25 bp, Artificial sequence
  Synthetic oligonucleotide
ggccgggccgcgacacgttcctgac

SEQ ID NO: 682346 - DNA, 25 bp, Artificial sequence
  Synthetic oligonucleotide
cccccccgcctagcggtcgatagcc

SEQ ID NO: 682347 - DNA, 25 bp, Artificial sequence
  Synthetic oligonucleotide
cccccccgcctaccggtcgatagcc

SEQ ID NO: 682348 - DNA, 25 bp, Artificial sequence
  Synthetic oligonucleotide
cgagccacggagggtcgaccagggg

SEQ ID NO: 682349 - DNA, 25 bp, Artificial sequence
  Synthetic oligonucleotide
agggcgacgagtgcgcgtgcccctg

SEQ ID NO: 682350 - DNA, 25 bp, Artificial sequence
  Synthetic oligonucleotide
cagaggcggggttccaacgccgcgc

SEQ ID NO: 682351 - DNA, 25 bp, Artificial sequence
  Synthetic oligonucleotide
cgatcggtgcgtacccccgcccagg

SEQ ID NO: 682352 - DNA, 25 bp, Artificial sequence
  Synthetic oligonucleotide
ggggacgcgtcgggtacagcggcca

SEQ ID NO: 682353 - DNA, 25 bp, Artificial sequence
  Synthetic oligonucleotide
ggggacgcgtcgcgtacagcggcca

SEQ ID NO: 682354 - DNA, 25 bp, Artificial sequence
  Synthetic oligonucleotide
gcacgctacggaccggcgtctccgg

SEQ ID NO: 682355 - DNA, 25 bp, Artificial sequence
  Synthetic oligonucleotide
gcacgctacggagcggcgtctccgg

SEQ ID NO: 682356 - DNA, 25 bp, Artificial sequence
  Synthetic oligonucleotide
gcgccgcgcggtccgatagtccgca

SEQ ID NO: 682357 - DNA, 25 bp, Artificial sequence
  Synthetic oligonucleotide
gcgccgcgcggtgcgatagtccgca

SEQ ID NO: 682358 - DNA, 25 bp, Artificial sequence
  Synthetic oligonucleotide
ccgcctccgtcgcgagcttagggcc

SEQ ID NO: 682359 - DNA, 25 bp, Artificial sequence
  Synthetic oligonucleotide
agggcgacgagtccgcgtgcccctg

SEQ ID NO: 682360 - DNA, 25 bp, Artificial sequence
  Synthetic oligonucleotide
ccgcgttcgcgtacgcccaccccac

SEQ ID NO: 682361 - DNA, 25 bp, Artificial sequence
  Synthetic oligonucleotide
ccgcctccgtcgggagcttagggcc

SEQ ID NO: 682362 - DNA, 25 bp, Artificial sequence
  Synthetic oligonucleotide
accccagcgcgacacggtacgcggg

SEQ ID NO: 682363 - DNA, 25 bp, Artificial sequence
  Synthetic oligonucleotide
gcggcgacgcgcggttaggcccact

SEQ ID NO: 682364 - DNA, 25 bp, Artificial sequence
  Synthetic oligonucleotide
gcggcgacgcgccgttaggcccact

SEQ ID NO: 682365 - DNA, 25 bp, Artificial sequence
  Synthetic oligonucleotide
cgggagccgagtacgtcgcctgcgc

SEQ ID NO: 682366 - DNA, 25 bp, Artificial sequence
  Synthetic oligonucleotide
cgggagccgagttcgtcgcctgcgc

SEQ ID NO: 682367 - DNA, 25 bp, Artificial sequence
  Synthetic oligonucleotide
gcgggcatccgcgtagctcgacggg

SEQ ID NO: 682368 - DNA, 25 bp, Artificial sequence
  Synthetic oligonucleotide
gcgggcatccgcctagctcgacggg

SEQ ID NO: 682369 - DNA, 25 bp, Artificial sequence
  Synthetic oligonucleotide
cccgggcgcgacccgcgataccttg

SEQ ID NO: 682370 - DNA, 25 bp, Artificial sequence
  Synthetic oligonucleotide
cagcagctaccgcggtcggccgtgc

SEQ ID NO: 682371 - DNA, 25 bp, Artificial sequence
  Synthetic oligonucleotide
cagaggcggggtaccaacgccgcgc

SEQ ID NO: 682372 - DNA, 25 bp, Artificial sequence
  Synthetic oligonucleotide
ccgcgttcgcgttcgcccaccccac

SEQ ID NO: 682373 - DNA, 25 bp, Artificial sequence
  Synthetic oligonucleotide
ggcggataccggtacgcgctgggcc

SEQ ID NO: 682374 - DNA, 25 bp, Artificial sequence
  Synthetic oligonucleotide
ggcggataccggaacgcgctgggcc

SEQ ID NO: 682375 - DNA, 25 bp, Artificial sequence
  Synthetic oligonucleotide
ggccgacggtagttcgcgcggtccg

SEQ ID NO: 682376 - DNA, 25 bp, Artificial sequence
  Synthetic oligonucleotide
ggccgacggtagatcgcgcggtccg

SEQ ID NO: 682377 - DNA, 25 bp, Artificial sequence
  Synthetic oligonucleotide
cgggaccccggcccgcatactgtcc

SEQ ID NO: 682378 - DNA, 25 bp, Artificial sequence
  Synthetic oligonucleotide
cgggaccccggcgcgcatactgtcc

SEQ ID NO: 682379 - DNA, 25 bp, Artificial sequence
  Synthetic oligonucleotide
cgagccacggagcgtcgaccagggg

SEQ ID NO: 682380 - DNA, 25 bp, Artificial sequence
  Synthetic oligonucleotide
cagcagctaccggggtcggccgtgc

SEQ ID NO: 682381 - DNA, 25 bp, Artificial sequence
  Synthetic oligonucleotide
cctctccgtgcgtccggttgggggc

SEQ ID NO: 682382 - DNA, 25 bp, Artificial sequence
  Synthetic oligonucleotide
ccccgcctacgcctcgcgggaacga

SEQ ID NO: 682383 - DNA, 25 bp, Artificial sequence
  Synthetic oligonucleotide
aggacggcgctagcgcaacggggcg

SEQ ID NO: 682384 - DNA, 25 bp, Artificial sequence
  Synthetic oligonucleotide
aggacggcgctaccgcaacggggcg

SEQ ID NO: 682385 - DNA, 25 bp, Artificial sequence
  Synthetic oligonucleotide
ggccttcccgtaacgcgctcggggc

SEQ ID NO: 682386 - DNA, 25 bp, Artificial sequence
  Synthetic oligonucleotide
ggccttcccgtatcgcgctcggggc

SEQ ID NO: 682387 - DNA, 25 bp, Artificial sequence
  Synthetic oligonucleotide
gcccgcacgaccggctacgcctctg

SEQ ID NO: 682388 - DNA, 25 bp, Artificial sequence
  Synthetic oligonucleotide
gcccgcacgacccgctacgcctctg

SEQ ID NO: 682389 - DNA, 25 bp, Artificial sequence
  Synthetic oligonucleotide
gctgcctgcgacgtacgggcgggga

SEQ ID NO: 682390 - DNA, 25 bp, Artificial sequence
  Synthetic oligonucleotide
gctgcctgcgacctacgggcgggga

SEQ ID NO: 682391 - DNA, 25 bp, Artificial sequence
  Synthetic oligonucleotide
ccactcgtcgaagcgtgcggccggg

SEQ ID NO: 682392 - DNA, 25 bp, Artificial sequence
  Synthetic oligonucleotide
ccactcgtcgaaccgtgcggccggg

SEQ ID NO: 682393 - DNA, 25 bp, Artificial sequence
  Synthetic oligonucleotide
gtgggcacggtcgcatcgctgccgg

SEQ ID NO: 682394 - DNA, 25 bp, Artificial sequence
  Synthetic oligonucleotide
gtgggcacggtcccatcgctgccgg

SEQ ID NO: 682395 - DNA, 25 bp, Artificial sequence
  Synthetic oligonucleotide
ccccagctagcgggccgaccgactg

SEQ ID NO: 682396 - DNA, 25 bp, Artificial sequence
  Synthetic oligonucleotide
gcggcgactacgggccggtgcgatc

SEQ ID NO: 682397 - DNA, 25 bp, Artificial sequence
  Synthetic oligonucleotide
cgcggtctcggtggatcgcgcacgg

SEQ ID NO: 682398 - DNA, 25 bp, Artificial sequence
  Synthetic oligonucleotide
gggccgtcgcgggataagggcaccg

SEQ ID NO: 682399 - DNA, 25 bp, Artificial sequence
  Synthetic oligonucleotide
gaggaggcgcaaacggacgggcccc

SEQ ID NO: 682400 - DNA, 25 bp, Artificial sequence
  Synthetic oligonucleotide
gaggaggcgcaatcggacgggcccc

SEQ ID NO: 682401 - DNA, 25 bp, Artificial sequence
  Synthetic oligonucleotide
gcgtgcatcgatgcgcggtggcggc

SEQ ID NO: 682402 - DNA, 25 bp, Artificial sequence
  Synthetic oligonucleotide
ggcgtgtcggcgatacgccgtggcc

SEQ ID NO: 682403 - DNA, 25 bp, Artificial sequence
  Synthetic oligonucleotide
gcggcgactacgcgccggtgcgatc

SEQ ID NO: 682404 - DNA, 25 bp, Artificial sequence
  Synthetic oligonucleotide
ggcgtgtcggcgttacgccgtggcc

SEQ ID NO: 682405 - DNA, 25 bp, Artificial sequence
  Synthetic oligonucleotide
cttcgcggctcgaacggcgggctgc

SEQ ID NO: 682406 - DNA, 25 bp, Artificial sequence
  Synthetic oligonucleotide
cttcgcggctcgtacggcgggctgc

SEQ ID NO: 682407 - DNA, 25 bp, Artificial sequence
  Synthetic oligonucleotide
gacggcgcggggaacgtcgacacgg

SEQ ID NO: 682408 - DNA, 25 bp, Artificial sequence
  Synthetic oligonucleotide
gacggcgcggggtacgtcgacacgg

SEQ ID NO: 682409 - DNA, 25 bp, Artificial sequence
  Synthetic oligonucleotide
cctctccgtgcgaccggttgggggc

SEQ ID NO: 682410 - DNA, 25 bp, Artificial sequence
  Synthetic oligonucleotide
ggcacgcgcgcgattacccggcctc

SEQ ID NO: 682411 - DNA, 25 bp, Artificial sequence
  Synthetic oligonucleotide
gcgtgcatcgatccgcggtggcggc

SEQ ID NO: 682412 - DNA, 25 bp, Artificial sequence
  Synthetic oligonucleotide
gcgggttccgatcgagcgcgctggc

SEQ ID NO: 682413 - DNA, 25 bp, Artificial sequence
  Synthetic oligonucleotide
ccacacgtccgatcgcgcgggcgca

SEQ ID NO: 682414 - DNA, 25 bp, Artificial sequence
  Synthetic oligonucleotide
ccacacgtccgaacgcgcgggcgca

SEQ ID NO: 682415 - DNA, 25 bp, Artificial sequence
  Synthetic oligonucleotide
cggagcccggcgaacaacgccccac

SEQ ID NO: 682416 - DNA, 25 bp, Artificial sequence
  Synthetic oligonucleotide
cggagcccggcgtacaacgccccac

SEQ ID NO: 682417 - DNA, 25 bp, Artificial sequence
  Synthetic oligonucleotide
gacgggtatcgcgacgccgtcgggg

SEQ ID NO: 682418 - DNA, 25 bp, Artificial sequence
  Synthetic oligonucleotide
gacgggtatcgccacgccgtcgggg

SEQ ID NO: 682419 - DNA, 25 bp, Artificial sequence
  Synthetic oligonucleotide
gaagggcgtaaccgcgaggcccgcc

SEQ ID NO: 682420 - DNA, 25 bp, Artificial sequence
  Synthetic oligonucleotide
gaagggcgtaacggcgaggcccgcc

SEQ ID NO: 682421 - DNA, 25 bp, Artificial sequence
  Synthetic oligonucleotide
gggacgtagcgccctgacgtggccc

SEQ ID NO: 682422 - DNA, 25 bp, Artificial sequence
  Synthetic oligonucleotide
gggacgtagcgcgctgacgtggccc

SEQ ID NO: 682423 - DNA, 25 bp, Artificial sequence
  Synthetic oligonucleotide
cggccggacgcagcgacgagccatc

SEQ ID NO: 682424 - DNA, 25 bp, Artificial sequence
  Synthetic oligonucleotide
cggccggacgcaccgacgagccatc

SEQ ID NO: 682425 - DNA, 25 bp, Artificial sequence
  Synthetic oligonucleotide
gacgccttgacgctccgcgtggggc

SEQ ID NO: 682426 - DNA, 25 bp, Artificial sequence
  Synthetic oligonucleotide
ccccagctagcgcgccgaccgactg

SEQ ID NO: 682427 - DNA, 25 bp, Artificial sequence
  Synthetic oligonucleotide
ggcgacccgctacgcgagccttgcc

SEQ ID NO: 682428 - DNA, 25 bp, Artificial sequence
  Synthetic oligonucleotide
ggcacgcgcgcgtttacccggcctc

SEQ ID NO: 682429 - DNA, 25 bp, Artificial sequence
  Synthetic oligonucleotide
gtgcgcccgtcgtactgcggcgcag

SEQ ID NO: 682430 - DNA, 25 bp, Artificial sequence
  Synthetic oligonucleotide
gtgcgcccgtcgaactgcggcgcag

SEQ ID NO: 682431 - DNA, 25 bp, Artificial sequence
  Synthetic oligonucleotide
actgggcgcgggcacgatcgtcggg

SEQ ID NO: 682432 - DNA, 25 bp, Artificial sequence
  Synthetic oligonucleotide
actgggcgcggggacgatcgtcggg

SEQ ID NO: 682433 - DNA, 25 bp, Artificial sequence
  Synthetic oligonucleotide
gacgccttgacggtccgcgtggggc

SEQ ID NO: 682434 - DNA, 25 bp, Artificial sequence
  Synthetic oligonucleotide
cgccggcgcggcgtattcgtcggct

SEQ ID NO: 682435 - DNA, 25 bp, Artificial sequence
  Synthetic oligonucleotide
gcgggttccgatggagcgcgctggc

SEQ ID NO: 682436 - DNA, 25 bp, Artificial sequence
  Synthetic oligonucleotide
ggcgacccgctaggcgagccttgcc

SEQ ID NO: 682437 - DNA, 25 bp, Artificial sequence
  Synthetic oligonucleotide
tgctgacggtcaacgcgcccgcccg

SEQ ID NO: 682438 - DNA, 25 bp, Artificial sequence
  Synthetic oligonucleotide
tgctgacggtcatcgcgcccgcccg

SEQ ID NO: 682439 - DNA, 25 bp, Artificial sequence
  Synthetic oligonucleotide
ccaaggggtatggcgcgcggcacgc

SEQ ID NO: 682440 - DNA, 25 bp, Artificial sequence
  Synthetic oligonucleotide
ccaaggggtatgccgcgcggcacgc

SEQ ID NO: 682441 - DNA, 25 bp, Artificial sequence
  Synthetic oligonucleotide
ccccgcctacgcgtcgcgggaacga

SEQ ID NO: 682442 - DNA, 25 bp, Artificial sequence
  Synthetic oligonucleotide
cgccggcgcggcctattcgtcggct

SEQ ID NO: 682443 - DNA, 25 bp, Artificial sequence
  Synthetic oligonucleotide
gggccccggcattcgacggcgctag

SEQ ID NO: 682444 - DNA, 25 bp, Artificial sequence
  Synthetic oligonucleotide
gggccgtcgcggcataagggcaccg

SEQ ID NO: 682445 - DNA, 25 bp, Artificial sequence
  Synthetic oligonucleotide
ggcccacgtggttcgtcgcggccgt

SEQ ID NO: 682446 - DNA, 25 bp, Artificial sequence
  Synthetic oligonucleotide
ggcccacgtggtacgtcgcggccgt

SEQ ID NO: 682447 - DNA, 25 bp, Artificial sequence
  Synthetic oligonucleotide
gggccgttacggcgcgcgcgcacaa

SEQ ID NO: 682448 - DNA, 25 bp, Artificial sequence
  Synthetic oligonucleotide
gggccgttacggggcgcgcgcacaa

SEQ ID NO: 682449 - DNA, 25 bp, Artificial sequence
  Synthetic oligonucleotide
gagcccgtcgtctcgacgaggccgc

SEQ ID NO: 682450 - DNA, 25 bp, Artificial sequence
  Synthetic oligonucleotide
gagcccgtcgtcacgacgaggccgc

SEQ ID NO: 682451 - DNA, 25 bp, Artificial sequence
  Synthetic oligonucleotide
gtgctcaccgaaggtccgcgcgccg

SEQ ID NO: 682452 - DNA, 25 bp, Artificial sequence
  Synthetic oligonucleotide
gtgctcaccgaacgtccgcgcgccg

SEQ ID NO: 682453 - DNA, 25 bp, Artificial sequence
  Synthetic oligonucleotide
ccgccaccgcgcctagtacggctcg

SEQ ID NO: 682454 - DNA, 25 bp, Artificial sequence
  Synthetic oligonucleotide
ccgccaccgcgcgtagtacggctcg

SEQ ID NO: 682455 - DNA, 25 bp, Artificial sequence
  Synthetic oligonucleotide
cgactgcgccacacgtacggccgcc

SEQ ID NO: 682456 - DNA, 25 bp, Artificial sequence
  Synthetic oligonucleotide
cgactgcgccactcgtacggccgcc

SEQ ID NO: 682457 - DNA, 25 bp, Artificial sequence
  Synthetic oligonucleotide
tcgccgcggtacccgactctcggcc

SEQ ID NO: 682458 - DNA, 25 bp, Artificial sequence
  Synthetic oligonucleotide
gcggcactagcccggtacgtcggcc

SEQ ID NO: 682459 - DNA, 25 bp, Artificial sequence
  Synthetic oligonucleotide
gcgacggggtatggggacgacgcgc

SEQ ID NO: 682460 - DNA, 25 bp, Artificial sequence
  Synthetic oligonucleotide
gcgacggggtatcgggacgacgcgc

SEQ ID NO: 682461 - DNA, 25 bp, Artificial sequence
  Synthetic oligonucleotide
cgtccccgcgtccactaccgcgagc

SEQ ID NO: 682462 - DNA, 25 bp, Artificial sequence
  Synthetic oligonucleotide
cgtccccgcgtcgactaccgcgagc

SEQ ID NO: 682463 - DNA, 25 bp, Artificial sequence
  Synthetic oligonucleotide
tcgagggtcccggggcgtatgggcg

SEQ ID NO: 682464 - DNA, 25 bp, Artificial sequence
  Synthetic oligonucleotide
cgggccacgggcctacgaagcctgg

SEQ ID NO: 682465 - DNA, 25 bp, Artificial sequence
  Synthetic oligonucleotide
gcggcactagccgggtacgtcggcc

SEQ ID NO: 682466 - DNA, 25 bp, Artificial sequence
  Synthetic oligonucleotide
cgggccacgggcgtacgaagcctgg

SEQ ID NO: 682467 - DNA, 25 bp, Artificial sequence
  Synthetic oligonucleotide
cgcaggcgcgaagcggtccttgccg

SEQ ID NO: 682468 - DNA, 25 bp, Artificial sequence
  Synthetic oligonucleotide
cgcaggcgcgaaccggtccttgccg

SEQ ID NO: 682469 - DNA, 25 bp, Artificial sequence
  Synthetic oligonucleotide
atggcggagcgttctcgcgccgggc

SEQ ID NO: 682470 - DNA, 25 bp, Artificial sequence
  Synthetic oligonucleotide
atggcggagcgtactcgcgccgggc

SEQ ID NO: 682471 - DNA, 25 bp, Artificial sequence
  Synthetic oligonucleotide
gggccccggcatacgacggcgctag

SEQ ID NO: 682472 - DNA, 25 bp, Artificial sequence
  Synthetic oligonucleotide
gggaccgtagcgcgcccgagcacag

SEQ ID NO: 682473 - DNA, 25 bp, Artificial sequence
  Synthetic oligonucleotide
tcgagggtcccgcggcgtatgggcg

SEQ ID NO: 682474 - DNA, 25 bp, Artificial sequence
  Synthetic oligonucleotide
ggggcgggcggcctatcgtggtctg

SEQ ID NO: 682475 - DNA, 25 bp, Artificial sequence
  Synthetic oligonucleotide
cgacggtccgcgacgggcaggtcgt

SEQ ID NO: 682476 - DNA, 25 bp, Artificial sequence
  Synthetic oligonucleotide
cgacggtccgcgtcgggcaggtcgt

SEQ ID NO: 682477 - DNA, 25 bp, Artificial sequence
  Synthetic oligonucleotide
ctgcgccgctagacgcggagtcccc

SEQ ID NO: 682478 - DNA, 25 bp, Artificial sequence
  Synthetic oligonucleotide
ctgcgccgctagtcgcggagtcccc

SEQ ID NO: 682479 - DNA, 25 bp, Artificial sequence
  Synthetic oligonucleotide
gatgcgacggatcgcgcgccgccct

SEQ ID NO: 682480 - DNA, 25 bp, Artificial sequence
  Synthetic oligonucleotide
gatgcgacggatggcgcgccgccct

SEQ ID NO: 682481 - DNA, 25 bp, Artificial sequence
  Synthetic oligonucleotide
agcgcccgacgcgagaccgctggac

SEQ ID NO: 682482 - DNA, 25 bp, Artificial sequence
  Synthetic oligonucleotide
agcgcccgacgccagaccgctggac

SEQ ID NO: 682483 - DNA, 25 bp, Artificial sequence
  Synthetic oligonucleotide
cctgcgccgctagggcggtcttccc

SEQ ID NO: 682484 - DNA, 25 bp, Artificial sequence
  Synthetic oligonucleotide
cctgcgccgctacggcggtcttccc

SEQ ID NO: 682485 - DNA, 25 bp, Artificial sequence
  Synthetic oligonucleotide
gccgccatcggccgcgactgagtgg

SEQ ID NO: 682486 - DNA, 25 bp, Artificial sequence
  Synthetic oligonucleotide
gccgccatcggcggcgactgagtgg

SEQ ID NO: 682487 - DNA, 25 bp, Artificial sequence
  Synthetic oligonucleotide
ctggcgcgcgcggttacctaccccc

SEQ ID NO: 682488 - DNA, 25 bp, Artificial sequence
  Synthetic oligonucleotide
tcgccgcggtacgcgactctcggcc

SEQ ID NO: 682489 - DNA, 25 bp, Artificial sequence
  Synthetic oligonucleotide
cgcccggggtgcgcccgttctgatc

SEQ ID NO: 682490 - DNA, 25 bp, Artificial sequence
  Synthetic oligonucleotide
gggaccgtagcgggcccgagcacag

SEQ ID NO: 682491 - DNA, 25 bp, Artificial sequence
  Synthetic oligonucleotide
ccgcgtacgtcgcgaccgatgggcg

SEQ ID NO: 682492 - DNA, 25 bp, Artificial sequence
  Synthetic oligonucleotide
ccgcgtacgtcgggaccgatgggcg

SEQ ID NO: 682493 - DNA, 25 bp, Artificial sequence
  Synthetic oligonucleotide
agagtggtcccgtacggcgcgccgg

SEQ ID NO: 682494 - DNA, 25 bp, Artificial sequence
  Synthetic oligonucleotide
agagtggtcccgaacggcgcgccgg

SEQ ID NO: 682495 - DNA, 25 bp, Artificial sequence
  Synthetic oligonucleotide
ccccgctgtatcgcgcgaggccgag

SEQ ID NO: 682496 - DNA, 25 bp, Artificial sequence
  Synthetic oligonucleotide
cgcgacacccctgcgcgaagtcgcg

SEQ ID NO: 682497 - DNA, 25 bp, Artificial sequence
  Synthetic oligonucleotide
gcagagcctacggcgcgtaccgggg

SEQ ID NO: 682498 - DNA, 25 bp, Artificial sequence
  Synthetic oligonucleotide
cgcccggggtgcccccgttctgatc

SEQ ID NO: 682499 - DNA, 25 bp, Artificial sequence
  Synthetic oligonucleotide
cgctcggcccgtagcgacgcacagg

SEQ ID NO: 682500 - DNA, 25 bp, Artificial sequence
  Synthetic oligonucleotide
cgctcggcccgttgcgacgcacagg

SEQ ID NO: 682501 - DNA, 25 bp, Artificial sequence
  Synthetic oligonucleotide
cggggttcgtgggcgcgacgagctg

SEQ ID NO: 682502 - DNA, 25 bp, Artificial sequence
  Synthetic oligonucleotide
cggggttcgtggccgcgacgagctg

SEQ ID NO: 682503 - DNA, 25 bp, Artificial sequence
  Synthetic oligonucleotide
ctggcgcgcgcgcttacctaccccc

SEQ ID NO: 682504 - DNA, 25 bp, Artificial sequence
  Synthetic oligonucleotide
cgcgacacccctccgcgaagtcgcg

SEQ ID NO: 682505 - DNA, 25 bp, Artificial sequence
  Synthetic oligonucleotide
tgcgcctacgtacggcgcgcgtccg

SEQ ID NO: 682506 - DNA, 25 bp, Artificial sequence
  Synthetic oligonucleotide
gggcgctcgtccgcgaacctcggag

SEQ ID NO: 682507 - DNA, 25 bp, Artificial sequence
  Synthetic oligonucleotide
cagctcgccgggtacgcgtgtgcgg

SEQ ID NO: 682508 - DNA, 25 bp, Artificial sequence
  Synthetic oligonucleotide
cagctcgccgggaacgcgtgtgcgg

SEQ ID NO: 682509 - DNA, 25 bp, Artificial sequence
  Synthetic oligonucleotide
tgcccggctagcccgacgcgacggt

SEQ ID NO: 682510 - DNA, 25 bp, Artificial sequence
  Synthetic oligonucleotide
tgcccggctagcgcgacgcgacggt

SEQ ID NO: 682511 - DNA, 25 bp, Artificial sequence
  Synthetic oligonucleotide
gcagctgtcggactagcggcccccc

SEQ ID NO: 682512 - DNA, 25 bp, Artificial sequence
  Synthetic oligonucleotide
gcagctgtcggagtagcggcccccc

SEQ ID NO: 682513 - DNA, 25 bp, Artificial sequence
  Synthetic oligonucleotide
ccgggcggcgtataggcgccatgcg

SEQ ID NO: 682514 - DNA, 25 bp, Artificial sequence
  Synthetic oligonucleotide
ccgggcggcgtaaaggcgccatgcg

SEQ ID NO: 682515 - DNA, 25 bp, Artificial sequence
  Synthetic oligonucleotide
ggcgacggtccgtcgtacgtggcgc

SEQ ID NO: 682516 - DNA, 25 bp, Artificial sequence
  Synthetic oligonucleotide
ggcgacggtccgacgtacgtggcgc

SEQ ID NO: 682517 - DNA, 25 bp, Artificial sequence
  Synthetic oligonucleotide
caggcgccgttatcgcccggtgccc

SEQ ID NO: 682518 - DNA, 25 bp, Artificial sequence
  Synthetic oligonucleotide
caggcgccgttaacgcccggtgccc

SEQ ID NO: 682519 - DNA, 25 bp, Artificial sequence
  Synthetic oligonucleotide
cccacgatgcccgaacgcgccctgc

SEQ ID NO: 682520 - DNA, 25 bp, Artificial sequence
  Synthetic oligonucleotide
ggcccgccgaccgatacgggagcga

SEQ ID NO: 682521 - DNA, 25 bp, Artificial sequence
  Synthetic oligonucleotide
gagcgccgcgttggctagcacgcgg

SEQ ID NO: 682522 - DNA, 25 bp, Artificial sequence
  Synthetic oligonucleotide
gagcgccgcgttcgctagcacgcgg

SEQ ID NO: 682523 - DNA, 25 bp, Artificial sequence
  Synthetic oligonucleotide
ccctggggccgattacgcgcccgac

SEQ ID NO: 682524 - DNA, 25 bp, Artificial sequence
  Synthetic oligonucleotide
ccctggggccgaatacgcgcccgac

SEQ ID NO: 682525 - DNA, 25 bp, Artificial sequence
  Synthetic oligonucleotide
cgactgcgtacggccgagccccggt

SEQ ID NO: 682526 - DNA, 25 bp, Artificial sequence
  Synthetic oligonucleotide
cggttgcccgaacttcgcggccgcc

SEQ ID NO: 682527 - DNA, 25 bp, Artificial sequence
  Synthetic oligonucleotide
ggcccgccgacccatacgggagcga

SEQ ID NO: 682528 - DNA, 25 bp, Artificial sequence
  Synthetic oligonucleotide
cggttgcccgaagttcgcggccgcc

SEQ ID NO: 682529 - DNA, 25 bp, Artificial sequence
  Synthetic oligonucleotide
ccggccagcgtagtcgcgcagaccc

SEQ ID NO: 682530 - DNA, 25 bp, Artificial sequence
  Synthetic oligonucleotide
ccggccagcgtactcgcgcagaccc

SEQ ID NO: 682531 - DNA, 25 bp, Artificial sequence
  Synthetic oligonucleotide
ggttcctcgccggaccgatcgggcc

SEQ ID NO: 682532 - DNA, 25 bp, Artificial sequence
  Synthetic oligonucleotide
ggttcctcgccgcaccgatcgggcc

SEQ ID NO: 682533 - DNA, 25 bp, Artificial sequence
  Synthetic oligonucleotide
tgcgcctacgtagggcgcgcgtccg

SEQ ID NO: 682534 - DNA, 25 bp, Artificial sequence
  Synthetic oligonucleotide
cccccggcgtatcccctcgcgctac

SEQ ID NO: 682535 - DNA, 25 bp, Artificial sequence
  Synthetic oligonucleotide
cgactgcgtacgcccgagccccggt

SEQ ID NO: 682536 - DNA, 25 bp, Artificial sequence
  Synthetic oligonucleotide
cgcggtctcggtcgatcgcgcacgg

SEQ ID NO: 682537 - DNA, 25 bp, Artificial sequence
  Synthetic oligonucleotide
gggcgctcgtccccgaacctcggag

SEQ ID NO: 682538 - DNA, 25 bp, Artificial sequence
  Synthetic oligonucleotide
agctcgtcgtgaggcggccggaggc

SEQ ID NO: 682539 - DNA, 25 bp, Artificial sequence
  Synthetic oligonucleotide
agctcgtcgtgacgcggccggaggc

SEQ ID NO: 682540 - DNA, 25 bp, Artificial sequence
  Synthetic oligonucleotide
cgcggccccatatcggccgatccgg

SEQ ID NO: 682541 - DNA, 25 bp, Artificial sequence
  Synthetic oligonucleotide
ccccgctgtatcccgcgaggccgag

SEQ ID NO: 682542 - DNA, 25 bp, Artificial sequence
  Synthetic oligonucleotide
cggcgtactatcgcgggggccaccc

SEQ ID NO: 682543 - DNA, 25 bp, Artificial sequence
  Synthetic oligonucleotide
cgacgccgacgcgctaccggtccac

SEQ ID NO: 682544 - DNA, 25 bp, Artificial sequence
  Synthetic oligonucleotide
ctcgcctcgcccggctacacgggtc

SEQ ID NO: 682545 - DNA, 25 bp, Artificial sequence
  Synthetic oligonucleotide
gcggggcgcgaacgcatggtacgcg

SEQ ID NO: 682546 - DNA, 25 bp, Artificial sequence
  Synthetic oligonucleotide
gcagagcctacgccgcgtaccgggg

SEQ ID NO: 682547 - DNA, 25 bp, Artificial sequence
  Synthetic oligonucleotide
gcggggcgcgaaggcatggtacgcg

SEQ ID NO: 682548 - DNA, 25 bp, Artificial sequence
  Synthetic oligonucleotide
gaaggccgtacggacccgcgctggc

SEQ ID NO: 682549 - DNA, 25 bp, Artificial sequence
  Synthetic oligonucleotide
gaaggccgtacgcacccgcgctggc

SEQ ID NO: 682550 - DNA, 25 bp, Artificial sequence
  Synthetic oligonucleotide
cgcggccccataacggccgatccgg

SEQ ID NO: 682551 - DNA, 25 bp, Artificial sequence
  Synthetic oligonucleotide
cgacgccgacgccctaccggtccac

SEQ ID NO: 682552 - DNA, 25 bp, Artificial sequence
  Synthetic oligonucleotide
tcgaggcgacgccaagcgctccccc

SEQ ID NO: 682553 - DNA, 25 bp, Artificial sequence
  Synthetic oligonucleotide
cgctcgctacgagcggtgccagggc

SEQ ID NO: 682554 - DNA, 25 bp, Artificial sequence
  Synthetic oligonucleotide
cccagcgcgtgccgctcgttagggc

SEQ ID NO: 682555 - DNA, 25 bp, Artificial sequence
  Synthetic oligonucleotide
cccagcgcgtgcggctcgttagggc

SEQ ID NO: 682556 - DNA, 25 bp, Artificial sequence
  Synthetic oligonucleotide
cgctcgctacgaccggtgccagggc

SEQ ID NO: 682557 - DNA, 25 bp, Artificial sequence
  Synthetic oligonucleotide
cccaatgcgaccgcctacgccgggc

SEQ ID NO: 682558 - DNA, 25 bp, Artificial sequence
  Synthetic oligonucleotide
cggcgtactatcccgggggccaccc

SEQ ID NO: 682559 - DNA, 25 bp, Artificial sequence
  Synthetic oligonucleotide
ctcgggccggacccgctatcgggac

SEQ ID NO: 682560 - DNA, 25 bp, Artificial sequence
  Synthetic oligonucleotide
cccccggcgtatgccctcgcgctac

SEQ ID NO: 682561 - DNA, 25 bp, Artificial sequence
  Synthetic oligonucleotide
tcgaggcgacgcgaagcgctccccc

SEQ ID NO: 682562 - DNA, 25 bp, Artificial sequence
  Synthetic oligonucleotide
ggtcggcgtaagacgcgacgcggcc

SEQ ID NO: 682563 - DNA, 25 bp, Artificial sequence
  Synthetic oligonucleotide
ggtcggcgtaagtcgcgacgcggcc

SEQ ID NO: 682564 - DNA, 25 bp, Artificial sequence
  Synthetic oligonucleotide
ccgctcgacgggtcgcgcatgcctg

SEQ ID NO: 682565 - DNA, 25 bp, Artificial sequence
  Synthetic oligonucleotide
ccgctcgacgggacgcgcatgcctg

SEQ ID NO: 682566 - DNA, 25 bp, Artificial sequence
  Synthetic oligonucleotide
ctcgcctcgccccgctacacgggtc

SEQ ID NO: 682567 - DNA, 25 bp, Artificial sequence
  Synthetic oligonucleotide
ctcgggccggacgcgctatcgggac

SEQ ID NO: 682568 - DNA, 25 bp, Artificial sequence
  Synthetic oligonucleotide
cggcggccgtcggcgcaagttacgg

SEQ ID NO: 682569 - DNA, 25 bp, Artificial sequence
  Synthetic oligonucleotide
cgacagtacgtcccggccggacccg

SEQ ID NO: 682570 - DNA, 25 bp, Artificial sequence
  Synthetic oligonucleotide
gtcccgacggcgacgcgtggtgtcc

SEQ ID NO: 682571 - DNA, 25 bp, Artificial sequence
  Synthetic oligonucleotide
ggccgcatagacacgcgcgccccca

SEQ ID NO: 682572 - DNA, 25 bp, Artificial sequence
  Synthetic oligonucleotide
ggccgcatagactcgcgcgccccca

SEQ ID NO: 682573 - DNA, 25 bp, Artificial sequence
  Synthetic oligonucleotide
gctggcgctacccgcggtagcgtcg

SEQ ID NO: 682574 - DNA, 25 bp, Artificial sequence
  Synthetic oligonucleotide
gcgcggctagcgaatcgcgctcccg

SEQ ID NO: 682575 - DNA, 25 bp, Artificial sequence
  Synthetic oligonucleotide
cggcggccgtcgccgcaagttacgg

SEQ ID NO: 682576 - DNA, 25 bp, Artificial sequence
  Synthetic oligonucleotide
ggacgctcgcgcggttggggcaagg

SEQ ID NO: 682577 - DNA, 25 bp, Artificial sequence
  Synthetic oligonucleotide
cgctcccgcgaagcggttggcagcg

SEQ ID NO: 682578 - DNA, 25 bp, Artificial sequence
  Synthetic oligonucleotide
cgctcccgcgaaccggttggcagcg

SEQ ID NO: 682579 - DNA, 25 bp, Artificial sequence
  Synthetic oligonucleotide
ggaccgcgttgcctcggtcccctgc

SEQ ID NO: 682580 - DNA, 25 bp, Artificial sequence
  Synthetic oligonucleotide
ggaccgcgttgcgtcggtcccctgc

SEQ ID NO: 682581 - DNA, 25 bp, Artificial sequence
  Synthetic oligonucleotide
taccgggtcgcgtatgcccggggcc

SEQ ID NO: 682582 - DNA, 25 bp, Artificial sequence
  Synthetic oligonucleotide
taccgggtcgcgaatgcccggggcc

SEQ ID NO: 682583 - DNA, 25 bp, Artificial sequence
  Synthetic oligonucleotide
gctggcgctaccggcggtagcgtcg

SEQ ID NO: 682584 - DNA, 25 bp, Artificial sequence
  Synthetic oligonucleotide
cgtcggcgcatacgcggctggcctg

SEQ ID NO: 682585 - DNA, 25 bp, Artificial sequence
  Synthetic oligonucleotide
gcgcgtctacgagggccgtacgcgc

SEQ ID NO: 682586 - DNA, 25 bp, Artificial sequence
  Synthetic oligonucleotide
gcgcgtctacgacggccgtacgcgc

SEQ ID NO: 682587 - DNA, 25 bp, Artificial sequence
  Synthetic oligonucleotide
cacggcgcgcctggtacgagaggcg

SEQ ID NO: 682588 - DNA, 25 bp, Artificial sequence
  Synthetic oligonucleotide
cacggcgcgcctcgtacgagaggcg

SEQ ID NO: 682589 - DNA, 25 bp, Artificial sequence
  Synthetic oligonucleotide
ggagcgctacgcgacggcgcgctac

SEQ ID NO: 682590 - DNA, 25 bp, Artificial sequence
  Synthetic oligonucleotide
gtcccgacggcgtcgcgtggtgtcc

SEQ ID NO: 682591 - DNA, 25 bp, Artificial sequence
  Synthetic oligonucleotide
cgtcggcgcataggcggctggcctg

SEQ ID NO: 682592 - DNA, 25 bp, Artificial sequence
  Synthetic oligonucleotide
gcgcggctagcgtatcgcgctcccg

SEQ ID NO: 682593 - DNA, 25 bp, Artificial sequence
  Synthetic oligonucleotide
ccccggggtatgcccgcgctagcct

SEQ ID NO: 682594 - DNA, 25 bp, Artificial sequence
  Synthetic oligonucleotide
ccccggggtatggccgcgctagcct

SEQ ID NO: 682595 - DNA, 25 bp, Artificial sequence
  Synthetic oligonucleotide
cccaatgcgaccccctacgccgggc

SEQ ID NO: 682596 - DNA, 25 bp, Artificial sequence
  Synthetic oligonucleotide
cccacgatgccccaacgcgccctgc

SEQ ID NO: 682597 - DNA, 25 bp, Artificial sequence
  Synthetic oligonucleotide
ctcgggcgatcggctacgggcaggc

SEQ ID NO: 682598 - DNA, 25 bp, Artificial sequence
  Synthetic oligonucleotide
ctcgggcgatcgcctacgggcaggc

SEQ ID NO: 682599 - DNA, 25 bp, Artificial sequence
  Synthetic oligonucleotide
ggagcgctacgccacggcgcgctac

SEQ ID NO: 682600 - DNA, 25 bp, Artificial sequence
  Synthetic oligonucleotide
gagcccccggtaggcttcggggcga

SEQ ID NO: 682601 - DNA, 25 bp, Artificial sequence
  Synthetic oligonucleotide
cgggcgccgaacggtcgagacgcct

SEQ ID NO: 682602 - DNA, 25 bp, Artificial sequence
  Synthetic oligonucleotide
gcgcgcgtcgcgcgtataggtgcgg

SEQ ID NO: 682603 - DNA, 25 bp, Artificial sequence
  Synthetic oligonucleotide
ctgggcatagccggcgtcgcgcgtc

SEQ ID NO: 682604 - DNA, 25 bp, Artificial sequence
  Synthetic oligonucleotide
ctgggcatagcccgcgtcgcgcgtc

SEQ ID NO: 682605 - DNA, 25 bp, Artificial sequence
  Synthetic oligonucleotide
cgacagtacgtcgcggccggacccg

SEQ ID NO: 682606 - DNA, 25 bp, Artificial sequence
  Synthetic oligonucleotide
gagcccccggtacgcttcggggcga

SEQ ID NO: 682607 - DNA, 25 bp, Artificial sequence
  Synthetic oligonucleotide
tcgctcccgcgacgcgtagcgtgcc

SEQ ID NO: 682608 - DNA, 25 bp, Artificial sequence
  Synthetic oligonucleotide
cggccccgccgcccgtatggcattc

SEQ ID NO: 682609 - DNA, 25 bp, Artificial sequence
  Synthetic oligonucleotide
cgggcgccgaaccgtcgagacgcct

SEQ ID NO: 682610 - DNA, 25 bp, Artificial sequence
  Synthetic oligonucleotide
cggccccgccgcgcgtatggcattc

SEQ ID NO: 682611 - DNA, 25 bp, Artificial sequence
  Synthetic oligonucleotide
gtggcccacgggacgtacgggaggc

SEQ ID NO: 682612 - DNA, 25 bp, Artificial sequence
  Synthetic oligonucleotide
gtggcccacgggtcgtacgggaggc

SEQ ID NO: 682613 - DNA, 25 bp, Artificial sequence
  Synthetic oligonucleotide
gcggggctacggtcgtccgcacagc

SEQ ID NO: 682614 - DNA, 25 bp, Artificial sequence
  Synthetic oligonucleotide
gcggggctacggacgtccgcacagc

SEQ ID NO: 682615 - DNA, 25 bp, Artificial sequence
  Synthetic oligonucleotide
gcgcgcgtcgcgggtataggtgcgg

SEQ ID NO: 682616 - DNA, 25 bp, Artificial sequence
  Synthetic oligonucleotide
ggacgctcgcgccgttggggcaagg

SEQ ID NO: 682617 - DNA, 25 bp, Artificial sequence
  Synthetic oligonucleotide
cccgcccgttgcgcgtcgagtcacg

SEQ ID NO: 682618 - DNA, 25 bp, Artificial sequence
  Synthetic oligonucleotide
gtgcggccgatagaacgcggggcgg

SEQ ID NO: 682619 - DNA, 25 bp, Artificial sequence
  Synthetic oligonucleotide
gtgcggccgatacaacgcggggcgg

SEQ ID NO: 682620 - DNA, 25 bp, Artificial sequence
  Synthetic oligonucleotide
cctgctacgtgtgcggacggccgcc

SEQ ID NO: 682621 - DNA, 25 bp, Artificial sequence
  Synthetic oligonucleotide
cctgctacgtgtccggacggccgcc

SEQ ID NO: 682622 - DNA, 25 bp, Artificial sequence
  Synthetic oligonucleotide
cgtcgggccgtaggtagcggcaggg

SEQ ID NO: 682623 - DNA, 25 bp, Artificial sequence
  Synthetic oligonucleotide
cgtcgggccgtacgtagcggcaggg

SEQ ID NO: 682624 - DNA, 25 bp, Artificial sequence
  Synthetic oligonucleotide
agctcccgatcgtgcgggtgccgcg

SEQ ID NO: 682625 - DNA, 25 bp, Artificial sequence
  Synthetic oligonucleotide
agctcccgatcgagcgggtgccgcg

SEQ ID NO: 682626 - DNA, 25 bp, Artificial sequence
  Synthetic oligonucleotide
cccagcccgtcgtaccggatgcccc

SEQ ID NO: 682627 - DNA, 25 bp, Artificial sequence
  Synthetic oligonucleotide
cccagcccgtcgaaccggatgcccc

SEQ ID NO: 682628 - DNA, 25 bp, Artificial sequence
  Synthetic oligonucleotide
cccgcccgttgcccgtcgagtcacg

SEQ ID NO: 682629 - DNA, 25 bp, Artificial sequence
  Synthetic oligonucleotide
tcgctcccgcgaggcgtagcgtgcc

SEQ ID NO: 682630 - DNA, 25 bp, Artificial sequence
  Synthetic oligonucleotide
ggcccttaccgggacgtcgcgccgg

SEQ ID NO: 682631 - DNA, 25 bp, Artificial sequence
  Synthetic oligonucleotide
ggcccttaccggcacgtcgcgccgg

SEQ ID NO: 682632 - DNA, 25 bp, Artificial sequence
  Synthetic oligonucleotide
gcccccgtacgtagcccgccgctcc

SEQ ID NO: 682633 - DNA, 25 bp, Artificial sequence
  Synthetic oligonucleotide
gtcgccggcgtaggcgtgagcgccg

SEQ ID NO: 682634 - DNA, 25 bp, Artificial sequence
  Synthetic oligonucleotide
gcccccgtacgttgcccgccgctcc

SEQ ID NO: 682635 - DNA, 25 bp, Artificial sequence
  Synthetic oligonucleotide
agccgccctatcgtcgggcgcccgc

SEQ ID NO: 682636 - DNA, 25 bp, Artificial sequence
  Synthetic oligonucleotide
ccgccgatcgacggtcgcggggcga

SEQ ID NO: 682637 - DNA, 25 bp, Artificial sequence
  Synthetic oligonucleotide
tggcacgggtcgggtacgccggccg

SEQ ID NO: 682638 - DNA, 25 bp, Artificial sequence
  Synthetic oligonucleotide
agtgcgccgctcccgcgtacccccg

SEQ ID NO: 682639 - DNA, 25 bp, Artificial sequence
  Synthetic oligonucleotide
agtgcgccgctcgcgcgtacccccg

SEQ ID NO: 682640 - DNA, 25 bp, Artificial sequence
  Synthetic oligonucleotide
ccgccgatcgaccgtcgcggggcga

SEQ ID NO: 682641 - DNA, 25 bp, Artificial sequence
  Synthetic oligonucleotide
tggcacgggtcgcgtacgccggccg

SEQ ID NO: 682642 - DNA, 25 bp, Artificial sequence
  Synthetic oligonucleotide
ggagcgcgggtactgcggcccgctg

SEQ ID NO: 682643 - DNA, 25 bp, Artificial sequence
  Synthetic oligonucleotide
agccgccctatcctcgggcgcccgc

SEQ ID NO: 682644 - DNA, 25 bp, Artificial sequence
  Synthetic oligonucleotide
ggagcgcgggtagtgcggcccgctg

SEQ ID NO: 682645 - DNA, 25 bp, Artificial sequence
  Synthetic oligonucleotide
gggcgctacgcgcggtcgactgcgc

SEQ ID NO: 682646 - DNA, 25 bp, Artificial sequence
  Synthetic oligonucleotide
gcaccccgccgttggctcgggcctg

SEQ ID NO: 682647 - DNA, 25 bp, Artificial sequence
  Synthetic oligonucleotide
gcaccccgccgtaggctcgggcctg

SEQ ID NO: 682648 - DNA, 25 bp, Artificial sequence
  Synthetic oligonucleotide
agcgcctagacggcacgcggcccgg

SEQ ID NO: 682649 - DNA, 25 bp, Artificial sequence
  Synthetic oligonucleotide
agggcgggataccaccggccggcgc

SEQ ID NO: 682650 - DNA, 25 bp, Artificial sequence
  Synthetic oligonucleotide
agcgcctagacgccacgcggcccgg

SEQ ID NO: 682651 - DNA, 25 bp, Artificial sequence
  Synthetic oligonucleotide
ctgggcgtcgatggcgggtccggcg

SEQ ID NO: 682652 - DNA, 25 bp, Artificial sequence
  Synthetic oligonucleotide
ctcccgccacgtttccgcgccgcgg

SEQ ID NO: 682653 - DNA, 25 bp, Artificial sequence
  Synthetic oligonucleotide
ctcccgccacgtatccgcgccgcgg

SEQ ID NO: 682654 - DNA, 25 bp, Artificial sequence
  Synthetic oligonucleotide
cgccgaacggacgcgcgacgtcccc

SEQ ID NO: 682655 - DNA, 25 bp, Artificial sequence
  Synthetic oligonucleotide
ccccgacgtacgggatccgcccgcc

SEQ ID NO: 682656 - DNA, 25 bp, Artificial sequence
  Synthetic oligonucleotide
gggcgctacgcggggtcgactgcgc

SEQ ID NO: 682657 - DNA, 25 bp, Artificial sequence
  Synthetic oligonucleotide
gcggtgtgcgaccgcccgtgcgcac

SEQ ID NO: 682658 - DNA, 25 bp, Artificial sequence
  Synthetic oligonucleotide
gggccgcgtcccgtcacgacgctgc

SEQ ID NO: 682659 - DNA, 25 bp, Artificial sequence
  Synthetic oligonucleotide
gggccgcgtcccctcacgacgctgc

SEQ ID NO: 682660 - DNA, 25 bp, Artificial sequence
  Synthetic oligonucleotide
cagccggctacggtccgcgacggcg

SEQ ID NO: 682661 - DNA, 25 bp, Artificial sequence
  Synthetic oligonucleotide
cagccggctacgctccgcgacggcg

SEQ ID NO: 682662 - DNA, 25 bp, Artificial sequence
  Synthetic oligonucleotide
gtcgccggcgtacgcgtgagcgccg

SEQ ID NO: 682663 - DNA, 25 bp, Artificial sequence
  Synthetic oligonucleotide
ccccgacgtacgcgatccgcccgcc

SEQ ID NO: 682664 - DNA, 25 bp, Artificial sequence
  Synthetic oligonucleotide
cggccccgcgctaggcgacagtcgg

SEQ ID NO: 682665 - DNA, 25 bp, Artificial sequence
  Synthetic oligonucleotide
cggccccgcgcttggcgacagtcgg

SEQ ID NO: 682666 - DNA, 25 bp, Artificial sequence
  Synthetic oligonucleotide
gcggtgtgcgacggcccgtgcgcac

SEQ ID NO: 682667 - DNA, 25 bp, Artificial sequence
  Synthetic oligonucleotide
cgccgaacggacccgcgacgtcccc

SEQ ID NO: 682668 - DNA, 25 bp, Artificial sequence
  Synthetic oligonucleotide
gggccggcctcgcgatacggacccc

SEQ ID NO: 682669 - DNA, 25 bp, Artificial sequence
  Synthetic oligonucleotide
tgcggcctacgggcgcgatgggggc

SEQ ID NO: 682670 - DNA, 25 bp, Artificial sequence
  Synthetic oligonucleotide
ttcgccgtacgacggccccgcgcgc

SEQ ID NO: 682671 - DNA, 25 bp, Artificial sequence
  Synthetic oligonucleotide
ttcgccgtacgagggccccgcgcgc

SEQ ID NO: 682672 - DNA, 25 bp, Artificial sequence
  Synthetic oligonucleotide
gccccacgccagtacgcgaggcgcg

SEQ ID NO: 682673 - DNA, 25 bp, Artificial sequence
  Synthetic oligonucleotide
gccccacgccagaacgcgaggcgcg

SEQ ID NO: 682674 - DNA, 25 bp, Artificial sequence
  Synthetic oligonucleotide
gccggccgaccgtcggggtgagacc

SEQ ID NO: 682675 - DNA, 25 bp, Artificial sequence
  Synthetic oligonucleotide
gccggccgaccgacggggtgagacc

SEQ ID NO: 682676 - DNA, 25 bp, Artificial sequence
  Synthetic oligonucleotide
tgcggcctacggccgcgatgggggc

SEQ ID NO: 682677 - DNA, 25 bp, Artificial sequence
  Synthetic oligonucleotide
cgtcccatcgcggggactggcgcgg

SEQ ID NO: 682678 - DNA, 25 bp, Artificial sequence
  Synthetic oligonucleotide
cgcaggggccgcgcgataggcgctc

SEQ ID NO: 682679 - DNA, 25 bp, Artificial sequence
  Synthetic oligonucleotide
gggccggcctcgggatacggacccc

SEQ ID NO: 682680 - DNA, 25 bp, Artificial sequence
  Synthetic oligonucleotide
tcgcggcccggtgcgtcgtgctggc

SEQ ID NO: 682681 - DNA, 25 bp, Artificial sequence
  Synthetic oligonucleotide
tcgcggcccggtccgtcgtgctggc

SEQ ID NO: 682682 - DNA, 25 bp, Artificial sequence
  Synthetic oligonucleotide
gccgccgtacgagccggacgctcgc

SEQ ID NO: 682683 - DNA, 25 bp, Artificial sequence
  Synthetic oligonucleotide
gctgcggtactggaccgcggccgcc

SEQ ID NO: 682684 - DNA, 25 bp, Artificial sequence
  Synthetic oligonucleotide
ccgcatgaacgtgcccgcgccgggg

SEQ ID NO: 682685 - DNA, 25 bp, Artificial sequence
  Synthetic oligonucleotide
ccgcatgaacgtccccgcgccgggg

SEQ ID NO: 682686 - DNA, 25 bp, Artificial sequence
  Synthetic oligonucleotide
cgtcccatcgcgcggactggcgcgg

SEQ ID NO: 682687 - DNA, 25 bp, Artificial sequence
  Synthetic oligonucleotide
ccgccgtatcgcggaccgccgaccg

SEQ ID NO: 682688 - DNA, 25 bp, Artificial sequence
  Synthetic oligonucleotide
caggcccgaccggcatcgccctgcc

SEQ ID NO: 682689 - DNA, 25 bp, Artificial sequence
  Synthetic oligonucleotide
caggcccgaccgccatcgccctgcc

SEQ ID NO: 682690 - DNA, 25 bp, Artificial sequence
  Synthetic oligonucleotide
gcgtgccgcgtccaccggtcgccgt

SEQ ID NO: 682691 - DNA, 25 bp, Artificial sequence
  Synthetic oligonucleotide
gcgtgccgcgtcgaccggtcgccgt

SEQ ID NO: 682692 - DNA, 25 bp, Artificial sequence
  Synthetic oligonucleotide
cctcgccgacgccgaccgtgtgccg

SEQ ID NO: 682693 - DNA, 25 bp, Artificial sequence
  Synthetic oligonucleotide
cctcgccgacgcggaccgtgtgccg

SEQ ID NO: 682694 - DNA, 25 bp, Artificial sequence
  Synthetic oligonucleotide
ggccgccgccgacgtacgctgcggt

SEQ ID NO: 682695 - DNA, 25 bp, Artificial sequence
  Synthetic oligonucleotide
agggcgggatacgaccggccggcgc

SEQ ID NO: 682696 - DNA, 25 bp, Artificial sequence
  Synthetic oligonucleotide
ccgccgtatcgccgaccgccgaccg

SEQ ID NO: 682697 - DNA, 25 bp, Artificial sequence
  Synthetic oligonucleotide
ctgggcgtcgatcgcgggtccggcg

SEQ ID NO: 682698 - DNA, 25 bp, Artificial sequence
  Synthetic oligonucleotide
ggcgccgcatccctacgcggtgggc

SEQ ID NO: 682699 - DNA, 25 bp, Artificial sequence
  Synthetic oligonucleotide
ggcgccgcatccgtacgcggtgggc

SEQ ID NO: 682700 - DNA, 25 bp, Artificial sequence
  Synthetic oligonucleotide
agcgggaccgccgtcggaccggtgc

SEQ ID NO: 682701 - DNA, 25 bp, Artificial sequence
  Synthetic oligonucleotide
agcgggaccgccctcggaccggtgc

SEQ ID NO: 682702 - DNA, 25 bp, Artificial sequence
  Synthetic oligonucleotide
ggcggcgcgcgccgattaggcccac

SEQ ID NO: 682703 - DNA, 25 bp, Artificial sequence
  Synthetic oligonucleotide
ggcggcgcgcgcggattaggcccac

SEQ ID NO: 682704 - DNA, 25 bp, Artificial sequence
  Synthetic oligonucleotide
cgcaggggccgcccgataggcgctc

SEQ ID NO: 682705 - DNA, 25 bp, Artificial sequence
  Synthetic oligonucleotide
ggccgccgccgaggtacgctgcggt

SEQ ID NO: 682706 - DNA, 25 bp, Artificial sequence
  Synthetic oligonucleotide
ggttggccgcgcctatggggccggc

SEQ ID NO: 682707 - DNA, 25 bp, Artificial sequence
  Synthetic oligonucleotide
tgcgcgcacgcgcagcgtacggccg

SEQ ID NO: 682708 - DNA, 25 bp, Artificial sequence
  Synthetic oligonucleotide
tgggcggctagccgtacgcgccccg

SEQ ID NO: 682709 - DNA, 25 bp, Artificial sequence
  Synthetic oligonucleotide
tgggcggctagcggtacgcgccccg

SEQ ID NO: 682710 - DNA, 25 bp, Artificial sequence
  Synthetic oligonucleotide
gctgcggtactgcaccgcggccgcc

SEQ ID NO: 682711 - DNA, 25 bp, Artificial sequence
  Synthetic oligonucleotide
ggcgccgcgtaggggcgaatccccg

SEQ ID NO: 682712 - DNA, 25 bp, Artificial sequence
  Synthetic oligonucleotide
cggcgccatactcgcgcgggcaccg

SEQ ID NO: 682713 - DNA, 25 bp, Artificial sequence
  Synthetic oligonucleotide
cggcgccatactggcgcgggcaccg

SEQ ID NO: 682714 - DNA, 25 bp, Artificial sequence
  Synthetic oligonucleotide
cgacgggtacgccggactccgcgcc

SEQ ID NO: 682715 - DNA, 25 bp, Artificial sequence
  Synthetic oligonucleotide
ctggggccgtcaacgggcggccgac

SEQ ID NO: 682716 - DNA, 25 bp, Artificial sequence
  Synthetic oligonucleotide
ggttggccgcgcgtatggggccggc

SEQ ID NO: 682717 - DNA, 25 bp, Artificial sequence
  Synthetic oligonucleotide
acccggcgcgcgtcatagccggccc

SEQ ID NO: 682718 - DNA, 25 bp, Artificial sequence
  Synthetic oligonucleotide
cgccagtcgtacggccgggcgcgtg

SEQ ID NO: 682719 - DNA, 25 bp, Artificial sequence
  Synthetic oligonucleotide
cgccagtcgtaccgccgggcgcgtg

SEQ ID NO: 682720 - DNA, 25 bp, Artificial sequence
  Synthetic oligonucleotide
cctagggtgctcccgcgaccccccg

SEQ ID NO: 682721 - DNA, 25 bp, Artificial sequence
  Synthetic oligonucleotide
cctagggtgctcgcgcgaccccccg

SEQ ID NO: 682722 - DNA, 25 bp, Artificial sequence
  Synthetic oligonucleotide
cggtgccgtcgcgtaccgagcccgc

SEQ ID NO: 682723 - DNA, 25 bp, Artificial sequence
  Synthetic oligonucleotide
cggtgccgtcgcctaccgagcccgc

SEQ ID NO: 682724 - DNA, 25 bp, Artificial sequence
  Synthetic oligonucleotide
caagggcggtcgacggtgcggggcg

SEQ ID NO: 682725 - DNA, 25 bp, Artificial sequence
  Synthetic oligonucleotide
ggcgccgcgtagcggcgaatccccg

SEQ ID NO: 682726 - DNA, 25 bp, Artificial sequence
  Synthetic oligonucleotide
cgacgggtacgcgggactccgcgcc

SEQ ID NO: 682727 - DNA, 25 bp, Artificial sequence
  Synthetic oligonucleotide
gcgcccatcgacgctcgcggcaggc

SEQ ID NO: 682728 - DNA, 25 bp, Artificial sequence
  Synthetic oligonucleotide
ccggcccgcacccgtaggacacgcg

SEQ ID NO: 682729 - DNA, 25 bp, Artificial sequence
  Synthetic oligonucleotide
gcggcgtcgcgaccgcactcgcctg

SEQ ID NO: 682730 - DNA, 25 bp, Artificial sequence
  Synthetic oligonucleotide
cgtgggcgacgcccgacgactccgc

SEQ ID NO: 682731 - DNA, 25 bp, Artificial sequence
  Synthetic oligonucleotide
cgtgggcgacgcgcgacgactccgc

SEQ ID NO: 682732 - DNA, 25 bp, Artificial sequence
  Synthetic oligonucleotide
gcgccgcggccgggacatagcgtgc

SEQ ID NO: 682733 - DNA, 25 bp, Artificial sequence
  Synthetic oligonucleotide
gcgccgcggccgcgacatagcgtgc

SEQ ID NO: 682734 - DNA, 25 bp, Artificial sequence
  Synthetic oligonucleotide
ggcgcaccgacgggagacccctgcc

SEQ ID NO: 682735 - DNA, 25 bp, Artificial sequence
  Synthetic oligonucleotide
ggcgcaccgacgcgagacccctgcc

SEQ ID NO: 682736 - DNA, 25 bp, Artificial sequence
  Synthetic oligonucleotide
ctggggccgtcatcgggcggccgac

SEQ ID NO: 682737 - DNA, 25 bp, Artificial sequence
  Synthetic oligonucleotide
gtcggcgggcgctaccgatcgcgcc

SEQ ID NO: 682738 - DNA, 25 bp, Artificial sequence
  Synthetic oligonucleotide
tgcgcgcacgcggagcgtacggccg

SEQ ID NO: 682739 - DNA, 25 bp, Artificial sequence
  Synthetic oligonucleotide
gcgcccatcgaccctcgcggcaggc

SEQ ID NO: 682740 - DNA, 25 bp, Artificial sequence
  Synthetic oligonucleotide
gggggcagcgacggcctacgcccct

SEQ ID NO: 682741 - DNA, 25 bp, Artificial sequence
  Synthetic oligonucleotide
gggggcagcgaccgcctacgcccct

SEQ ID NO: 682742 - DNA, 25 bp, Artificial sequence
  Synthetic oligonucleotide
ggcgcccagcgctcgtacggcccca

SEQ ID NO: 682743 - DNA, 25 bp, Artificial sequence
  Synthetic oligonucleotide
ggcgcccagcgcacgtacggcccca

SEQ ID NO: 682744 - DNA, 25 bp, Artificial sequence
  Synthetic oligonucleotide
cctgcggtacgcccggtaccccggc

SEQ ID NO: 682745 - DNA, 25 bp, Artificial sequence
  Synthetic oligonucleotide
cctgcggtacgcgcggtaccccggc

SEQ ID NO: 682746 - DNA, 25 bp, Artificial sequence
  Synthetic oligonucleotide
acccggcgcgcgacatagccggccc

SEQ ID NO: 682747 - DNA, 25 bp, Artificial sequence
  Synthetic oligonucleotide
gtcggcgggcgcaaccgatcgcgcc

SEQ ID NO: 682748 - DNA, 25 bp, Artificial sequence
  Synthetic oligonucleotide
cctccgcctatgggcgacgggccgg

SEQ ID NO: 682749 - DNA, 25 bp, Artificial sequence
  Synthetic oligonucleotide
caagggcggtcgtcggtgcggggcg

SEQ ID NO: 682750 - DNA, 25 bp, Artificial sequence
  Synthetic oligonucleotide
cgcgagtgccgttcgacgggccgcg

SEQ ID NO: 682751 - DNA, 25 bp, Artificial sequence
  Synthetic oligonucleotide
cgcgagtgccgtacgacgggccgcg

SEQ ID NO: 682752 - DNA, 25 bp, Artificial sequence
  Synthetic oligonucleotide
cgcgcccgctagcgcgaggacggga

SEQ ID NO: 682753 - DNA, 25 bp, Artificial sequence
  Synthetic oligonucleotide
cgcgcccgctagggcgaggacggga

SEQ ID NO: 682754 - DNA, 25 bp, Artificial sequence
  Synthetic oligonucleotide
ccgccgcgaccccccgtactggcga

SEQ ID NO: 682755 - DNA, 25 bp, Artificial sequence
  Synthetic oligonucleotide
ccgccgcgacccgccgtactggcga

SEQ ID NO: 682756 - DNA, 25 bp, Artificial sequence
  Synthetic oligonucleotide
ccaccgggtcgctcgcgaacgcgcg

SEQ ID NO: 682757 - DNA, 25 bp, Artificial sequence
  Synthetic oligonucleotide
gcgcgggaccggatacgcgccaggg

SEQ ID NO: 682758 - DNA, 25 bp, Artificial sequence
  Synthetic oligonucleotide
cctccgcctatgcgcgacgggccgg

SEQ ID NO: 682759 - DNA, 25 bp, Artificial sequence
  Synthetic oligonucleotide
cggggctcgcgtctacggtccgccc

SEQ ID NO: 682760 - DNA, 25 bp, Artificial sequence
  Synthetic oligonucleotide
ggcgactacgttgggcgccggcgcg

SEQ ID NO: 682761 - DNA, 25 bp, Artificial sequence
  Synthetic oligonucleotide
ggcgactacgttcggcgccggcgcg

SEQ ID NO: 682762 - DNA, 25 bp, Artificial sequence
  Synthetic oligonucleotide
gcccgtcgctaccgcccgtcgtccc

SEQ ID NO: 682763 - DNA, 25 bp, Artificial sequence
  Synthetic oligonucleotide
gcccgtcgctacggcccgtcgtccc

SEQ ID NO: 682764 - DNA, 25 bp, Artificial sequence
  Synthetic oligonucleotide
gtcggcgtaacgccgcgccgctggc

SEQ ID NO: 682765 - DNA, 25 bp, Artificial sequence
  Synthetic oligonucleotide
gtcggcgtaacggcgcgccgctggc

SEQ ID NO: 682766 - DNA, 25 bp, Artificial sequence
  Synthetic oligonucleotide
cgccacgcccgttcgccgtgacggc

SEQ ID NO: 682767 - DNA, 25 bp, Artificial sequence
  Synthetic oligonucleotide
cgccacgcccgtacgccgtgacggc

SEQ ID NO: 682768 - DNA, 25 bp, Artificial sequence
  Synthetic oligonucleotide
ccaccgggtcgcacgcgaacgcgcg

SEQ ID NO: 682769 - DNA, 25 bp, Artificial sequence
  Synthetic oligonucleotide
ccccggcggtcgtacgcgtgcgcca

SEQ ID NO: 682770 - DNA, 25 bp, Artificial sequence
  Synthetic oligonucleotide
ccggcgagacgtcggacgccggagc

SEQ ID NO: 682771 - DNA, 25 bp, Artificial sequence
  Synthetic oligonucleotide
ccggcgagacgtgggacgccggagc

SEQ ID NO: 682772 - DNA, 25 bp, Artificial sequence
  Synthetic oligonucleotide
cctccccgccaccagcgacccctgg

SEQ ID NO: 682773 - DNA, 25 bp, Artificial sequence
  Synthetic oligonucleotide
cctccccgccacgagcgacccctgg

SEQ ID NO: 682774 - DNA, 25 bp, Artificial sequence
  Synthetic oligonucleotide
gttgccacgggccgtcgcacccggc

SEQ ID NO: 682775 - DNA, 25 bp, Artificial sequence
  Synthetic oligonucleotide
gttgccacgggcggtcgcacccggc

SEQ ID NO: 682776 - DNA, 25 bp, Artificial sequence
  Synthetic oligonucleotide
cccgcctggtcgtccgcggacgtcc

SEQ ID NO: 682777 - DNA, 25 bp, Artificial sequence
  Synthetic oligonucleotide
cccgcctggtcgaccgcggacgtcc

SEQ ID NO: 682778 - DNA, 25 bp, Artificial sequence
  Synthetic oligonucleotide
gcgcgggaccggttacgcgccaggg

SEQ ID NO: 682779 - DNA, 25 bp, Artificial sequence
  Synthetic oligonucleotide
agcggcggcgtatcacgcccgcccg

SEQ ID NO: 682780 - DNA, 25 bp, Artificial sequence
  Synthetic oligonucleotide
gccgccgtacgacccggacgctcgc

SEQ ID NO: 682781 - DNA, 25 bp, Artificial sequence
  Synthetic oligonucleotide
ccccggcggtcgaacgcgtgcgcca

SEQ ID NO: 682782 - DNA, 25 bp, Artificial sequence
  Synthetic oligonucleotide
ccgccctatcgccccgcacacccgg

SEQ ID NO: 682783 - DNA, 25 bp, Artificial sequence
  Synthetic oligonucleotide
ccgccctatcgcgccgcacacccgg

SEQ ID NO: 682784 - DNA, 25 bp, Artificial sequence
  Synthetic oligonucleotide
gctgggcgcgtaggcccgaggccgt

SEQ ID NO: 682785 - DNA, 25 bp, Artificial sequence
  Synthetic oligonucleotide
gctgggcgcgtacgcccgaggccgt

SEQ ID NO: 682786 - DNA, 25 bp, Artificial sequence
  Synthetic oligonucleotide
ggcccgcgccgagggtctatcgccc

SEQ ID NO: 682787 - DNA, 25 bp, Artificial sequence
  Synthetic oligonucleotide
ggcccgcgccgacggtctatcgccc

SEQ ID NO: 682788 - DNA, 25 bp, Artificial sequence
  Synthetic oligonucleotide
cggggctcgcgtgtacggtccgccc

SEQ ID NO: 682789 - DNA, 25 bp, Artificial sequence
  Synthetic oligonucleotide
agcggcggcgtaacacgcccgcccg

SEQ ID NO: 682790 - DNA, 25 bp, Artificial sequence
  Synthetic oligonucleotide
ggtgggcggtcgatcccgcaccggg

SEQ ID NO: 682791 - DNA, 25 bp, Artificial sequence
  Synthetic oligonucleotide
cgccgcggacgttcgtccgccagcg

SEQ ID NO: 682792 - DNA, 25 bp, Artificial sequence
  Synthetic oligonucleotide
gggccgcgcgacgtacgcgacctcg

SEQ ID NO: 682793 - DNA, 25 bp, Artificial sequence
  Synthetic oligonucleotide
gcggcctacgcacgacgggcgccct

SEQ ID NO: 682794 - DNA, 25 bp, Artificial sequence
  Synthetic oligonucleotide
gcggcctacgcaggacgggcgccct

SEQ ID NO: 682795 - DNA, 25 bp, Artificial sequence
  Synthetic oligonucleotide
ccgcagcgatcgacacggggcgccc

SEQ ID NO: 682796 - DNA, 25 bp, Artificial sequence
  Synthetic oligonucleotide
ccgcagcgatcgtcacggggcgccc

SEQ ID NO: 682797 - DNA, 25 bp, Artificial sequence
  Synthetic oligonucleotide
cccggctcgtgcgcgcgaaagggcg

SEQ ID NO: 682798 - DNA, 25 bp, Artificial sequence
  Synthetic oligonucleotide
cccggctcgtgcccgcgaaagggcg

SEQ ID NO: 682799 - DNA, 25 bp, Artificial sequence
  Synthetic oligonucleotide
cggtgccggtcgggccgtagggcca

SEQ ID NO: 682800 - DNA, 25 bp, Artificial sequence
  Synthetic oligonucleotide
cggtgccggtcgcgccgtagggcca

SEQ ID NO: 682801 - DNA, 25 bp, Artificial sequence
  Synthetic oligonucleotide
tgcctctccgcgctccgacggcggg

SEQ ID NO: 682802 - DNA, 25 bp, Artificial sequence
  Synthetic oligonucleotide
tgcctctccgcggtccgacggcggg

SEQ ID NO: 682803 - DNA, 25 bp, Artificial sequence
  Synthetic oligonucleotide
gccactccgcgttgcggcaggccgg

SEQ ID NO: 682804 - DNA, 25 bp, Artificial sequence
  Synthetic oligonucleotide
gcgtgggacccgcgtaccgggcacg

SEQ ID NO: 682805 - DNA, 25 bp, Artificial sequence
  Synthetic oligonucleotide
gccactccgcgtagcggcaggccgg

SEQ ID NO: 682806 - DNA, 25 bp, Artificial sequence
  Synthetic oligonucleotide
ggtgggcggtcgttcccgcaccggg

SEQ ID NO: 682807 - DNA, 25 bp, Artificial sequence
  Synthetic oligonucleotide
cgggtctgcgccctgacgcgcgcga

SEQ ID NO: 682808 - DNA, 25 bp, Artificial sequence
  Synthetic oligonucleotide
ccctccggccggtcgcgtacagcgg

SEQ ID NO: 682809 - DNA, 25 bp, Artificial sequence
  Synthetic oligonucleotide
ccctccggccggacgcgtacagcgg

SEQ ID NO: 682810 - DNA, 25 bp, Artificial sequence
  Synthetic oligonucleotide
gtggcccccgatagcggtcggcggc

SEQ ID NO: 682811 - DNA, 25 bp, Artificial sequence
  Synthetic oligonucleotide
gtggcccccgattgcggtcggcggc

SEQ ID NO: 682812 - DNA, 25 bp, Artificial sequence
  Synthetic oligonucleotide
caggaccggacgggcgttccgcccc

SEQ ID NO: 682813 - DNA, 25 bp, Artificial sequence
  Synthetic oligonucleotide
caggaccggacgcgcgttccgcccc

SEQ ID NO: 682814 - DNA, 25 bp, Artificial sequence
  Synthetic oligonucleotide
ccttggccgtaacgcgcgcgcgccc

SEQ ID NO: 682815 - DNA, 25 bp, Artificial sequence
  Synthetic oligonucleotide
ccttggccgtaaggcgcgcgcgccc

SEQ ID NO: 682816 - DNA, 25 bp, Artificial sequence
  Synthetic oligonucleotide
ccaccccgacgcctatccgcgggcg

SEQ ID NO: 682817 - DNA, 25 bp, Artificial sequence
  Synthetic oligonucleotide
ccaccccgacgcgtatccgcgggcg

SEQ ID NO: 682818 - DNA, 25 bp, Artificial sequence
  Synthetic oligonucleotide
ggctggcggacgttcgtgcccgcgg

SEQ ID NO: 682819 - DNA, 25 bp, Artificial sequence
  Synthetic oligonucleotide
gcgtgggacccgggtaccgggcacg

SEQ ID NO: 682820 - DNA, 25 bp, Artificial sequence
  Synthetic oligonucleotide
cggtcgcgtcgcgtatggggggccc

SEQ ID NO: 682821 - DNA, 25 bp, Artificial sequence
  Synthetic oligonucleotide
cctgccggttcgacgcgacgcgccc

SEQ ID NO: 682822 - DNA, 25 bp, Artificial sequence
  Synthetic oligonucleotide
cctgccggttcgtcgcgacgcgccc

SEQ ID NO: 682823 - DNA, 25 bp, Artificial sequence
  Synthetic oligonucleotide
tacgccgctagcccggacgcggcgg

SEQ ID NO: 682824 - DNA, 25 bp, Artificial sequence
  Synthetic oligonucleotide
tacgccgctagcgcggacgcggcgg

SEQ ID NO: 682825 - DNA, 25 bp, Artificial sequence
  Synthetic oligonucleotide
gcggcgccgccgaatcgcgcagcct

SEQ ID NO: 682826 - DNA, 25 bp, Artificial sequence
  Synthetic oligonucleotide
gcggcgccgccgtatcgcgcagcct

SEQ ID NO: 682827 - DNA, 25 bp, Artificial sequence
  Synthetic oligonucleotide
ccgcggagtacgtaccgcgcgggcc

SEQ ID NO: 682828 - DNA, 25 bp, Artificial sequence
  Synthetic oligonucleotide
ccgcggagtacgaaccgcgcgggcc

SEQ ID NO: 682829 - DNA, 25 bp, Artificial sequence
  Synthetic oligonucleotide
gacgcgcgcgcatcgaccggcctcc

SEQ ID NO: 682830 - DNA, 25 bp, Artificial sequence
  Synthetic oligonucleotide
gacgcgcgcgcaacgaccggcctcc

SEQ ID NO: 682831 - DNA, 25 bp, Artificial sequence
  Synthetic oligonucleotide
gagcggcgtagcgtaggcgggcccc

SEQ ID NO: 682832 - DNA, 25 bp, Artificial sequence
  Synthetic oligonucleotide
gagcggcgtagcctaggcgggcccc

SEQ ID NO: 682833 - DNA, 25 bp, Artificial sequence
  Synthetic oligonucleotide
gggccgcgcgacctacgcgacctcg

SEQ ID NO: 682834 - DNA, 25 bp, Artificial sequence
  Synthetic oligonucleotide
cgcagccgggcgcgaaacaggcgcg

SEQ ID NO: 682835 - DNA, 25 bp, Artificial sequence
  Synthetic oligonucleotide
ggccccacgcggagtatgccccggg

SEQ ID NO: 682836 - DNA, 25 bp, Artificial sequence
  Synthetic oligonucleotide
cggtcgcgtcgcctatggggggccc

SEQ ID NO: 682837 - DNA, 25 bp, Artificial sequence
  Synthetic oligonucleotide
ggccagtcgcgaggtaccggcgcgc

SEQ ID NO: 682838 - DNA, 25 bp, Artificial sequence
  Synthetic oligonucleotide
ggccagtcgcgacgtaccggcgcgc

SEQ ID NO: 682839 - DNA, 25 bp, Artificial sequence
  Synthetic oligonucleotide
tcgggcggcttaggcgcggcctccg

SEQ ID NO: 682840 - DNA, 25 bp, Artificial sequence
  Synthetic oligonucleotide
tcgggcggcttacgcgcggcctccg

SEQ ID NO: 682841 - DNA, 25 bp, Artificial sequence
  Synthetic oligonucleotide
cgtcggatacggggcgcgtccgcgc

SEQ ID NO: 682842 - DNA, 25 bp, Artificial sequence
  Synthetic oligonucleotide
cgtcggatacggcgcgcgtccgcgc

SEQ ID NO: 682843 - DNA, 25 bp, Artificial sequence
  Synthetic oligonucleotide
gtcggcggcgtaccgtacggccgcg

SEQ ID NO: 682844 - DNA, 25 bp, Artificial sequence
  Synthetic oligonucleotide
gtcggcggcgtagcgtacggccgcg

SEQ ID NO: 682845 - DNA, 25 bp, Artificial sequence
  Synthetic oligonucleotide
agacggcggacccgcgtacggccgc

SEQ ID NO: 682846 - DNA, 25 bp, Artificial sequence
  Synthetic oligonucleotide
agacggcggaccggcgtacggccgc

SEQ ID NO: 682847 - DNA, 25 bp, Artificial sequence
  Synthetic oligonucleotide
gcccgacgcgcgagtaccgtggggc

SEQ ID NO: 682848 - DNA, 25 bp, Artificial sequence
  Synthetic oligonucleotide
gcccgacgcgcgtgtaccgtggggc

SEQ ID NO: 682849 - DNA, 25 bp, Artificial sequence
  Synthetic oligonucleotide
cgcagccgggcgggaaacaggcgcg

SEQ ID NO: 682850 - DNA, 25 bp, Artificial sequence
  Synthetic oligonucleotide
gggtagcgcggcgtcgagagcccgc

SEQ ID NO: 682851 - DNA, 25 bp, Artificial sequence
  Synthetic oligonucleotide
cgccgcggacgtacgtccgccagcg

SEQ ID NO: 682852 - DNA, 25 bp, Artificial sequence
  Synthetic oligonucleotide
cgctcctcgcccgacggggaggcga

SEQ ID NO: 682853 - DNA, 25 bp, Artificial sequence
  Synthetic oligonucleotide
ggcggcacgacgaagcgcgggcacg

SEQ ID NO: 682854 - DNA, 25 bp, Artificial sequence
  Synthetic oligonucleotide
ggcggcacgacgtagcgcgggcacg

SEQ ID NO: 682855 - DNA, 25 bp, Artificial sequence
  Synthetic oligonucleotide
cccagagcggccggtcgatcccggg

SEQ ID NO: 682856 - DNA, 25 bp, Artificial sequence
  Synthetic oligonucleotide
cccagagcggcccgtcgatcccggg

SEQ ID NO: 682857 - DNA, 25 bp, Artificial sequence
  Synthetic oligonucleotide
ggctccgtcgagcgcacggtggccg

SEQ ID NO: 682858 - DNA, 25 bp, Artificial sequence
  Synthetic oligonucleotide
aggagcgtcgcgcaaccggcgcggg

SEQ ID NO: 682859 - DNA, 25 bp, Artificial sequence
  Synthetic oligonucleotide
aggagcgtcgcggaaccggcgcggg

SEQ ID NO: 682860 - DNA, 25 bp, Artificial sequence
  Synthetic oligonucleotide
gggcgcctcatgggcgcgacgcacc

SEQ ID NO: 682861 - DNA, 25 bp, Artificial sequence
  Synthetic oligonucleotide
ccggcccgcaccggtaggacacgcg

SEQ ID NO: 682862 - DNA, 25 bp, Artificial sequence
  Synthetic oligonucleotide
tcgggcgcggttggcgcctccccga

SEQ ID NO: 682863 - DNA, 25 bp, Artificial sequence
  Synthetic oligonucleotide
gcgtccgtgcgagcgcgcaaggccg

SEQ ID NO: 682864 - DNA, 25 bp, Artificial sequence
  Synthetic oligonucleotide
gggtagcgcggcctcgagagcccgc

SEQ ID NO: 682865 - DNA, 25 bp, Artificial sequence
  Synthetic oligonucleotide
gcgtccgtgcgaccgcgcaaggccg

SEQ ID NO: 682866 - DNA, 25 bp, Artificial sequence
  Synthetic oligonucleotide
cgtggccgtacgcccgtgcagcggg

SEQ ID NO: 682867 - DNA, 25 bp, Artificial sequence
  Synthetic oligonucleotide
cgtggccgtacggccgtgcagcggg

SEQ ID NO: 682868 - DNA, 25 bp, Artificial sequence
  Synthetic oligonucleotide
tacgccgcccgaagtcgcgggggcg

SEQ ID NO: 682869 - DNA, 25 bp, Artificial sequence
  Synthetic oligonucleotide
tacgccgcccgatgtcgcgggggcg

SEQ ID NO: 682870 - DNA, 25 bp, Artificial sequence
  Synthetic oligonucleotide
ccaccctcgtacgggcgtcgccgcg

SEQ ID NO: 682871 - DNA, 25 bp, Artificial sequence
  Synthetic oligonucleotide
ccaccctcgtaccggcgtcgccgcg

SEQ ID NO: 682872 - DNA, 25 bp, Artificial sequence
  Synthetic oligonucleotide
cccgggctatggggcgtcgcctccc

SEQ ID NO: 682873 - DNA, 25 bp, Artificial sequence
  Synthetic oligonucleotide
cccgggctatggcgcgtcgcctccc

SEQ ID NO: 682874 - DNA, 25 bp, Artificial sequence
  Synthetic oligonucleotide
ccacagcgacgcgtagccgggggcc

SEQ ID NO: 682875 - DNA, 25 bp, Artificial sequence
  Synthetic oligonucleotide
ccacagcgacgcctagccgggggcc

SEQ ID NO: 682876 - DNA, 25 bp, Artificial sequence
  Synthetic oligonucleotide
ggggccgcgtccgcgtcgacgtgag

SEQ ID NO: 682877 - DNA, 25 bp, Artificial sequence
  Synthetic oligonucleotide
ggggccgcgtccccgtcgacgtgag

SEQ ID NO: 682878 - DNA, 25 bp, Artificial sequence
  Synthetic oligonucleotide
cgcgctcgggcccgtacgacccacc

SEQ ID NO: 682879 - DNA, 25 bp, Artificial sequence
  Synthetic oligonucleotide
tcgggcgcggttcgcgcctccccga

SEQ ID NO: 682880 - DNA, 25 bp, Artificial sequence
  Synthetic oligonucleotide
cggccggtcgcatcgggccggagct

SEQ ID NO: 682881 - DNA, 25 bp, Artificial sequence
  Synthetic oligonucleotide
ggccccacgcggtgtatgccccggg

SEQ ID NO: 682882 - DNA, 25 bp, Artificial sequence
  Synthetic oligonucleotide
gctcaccgcgcgacgatggggcccg

SEQ ID NO: 682883 - DNA, 25 bp, Artificial sequence
  Synthetic oligonucleotide
gctcaccgcgcgtcgatggggcccg

SEQ ID NO: 682884 - DNA, 25 bp, Artificial sequence
  Synthetic oligonucleotide
ccccgacgggcgggagtagcgcacg

SEQ ID NO: 682885 - DNA, 25 bp, Artificial sequence
  Synthetic oligonucleotide
ccccgacgggcgcgagtagcgcacg

SEQ ID NO: 682886 - DNA, 25 bp, Artificial sequence
  Synthetic oligonucleotide
gcccgcacacaccgcgtcggacggc

SEQ ID NO: 682887 - DNA, 25 bp, Artificial sequence
  Synthetic oligonucleotide
gcccgcacacacggcgtcggacggc

SEQ ID NO: 682888 - DNA, 25 bp, Artificial sequence
  Synthetic oligonucleotide
ggcggccgaagcggaccgtgcccgt

SEQ ID NO: 682889 - DNA, 25 bp, Artificial sequence
  Synthetic oligonucleotide
ggcggccgaagccgaccgtgcccgt

SEQ ID NO: 682890 - DNA, 25 bp, Artificial sequence
  Synthetic oligonucleotide
gctcgggtcgcggcgaactcggggg

SEQ ID NO: 682891 - DNA, 25 bp, Artificial sequence
  Synthetic oligonucleotide
gctcgggtcgcgccgaactcggggg

SEQ ID NO: 682892 - DNA, 25 bp, Artificial sequence
  Synthetic oligonucleotide
gtggcggcacgcccgatagccggcg

SEQ ID NO: 682893 - DNA, 25 bp, Artificial sequence
  Synthetic oligonucleotide
cgctcctcgccccacggggaggcga

SEQ ID NO: 682894 - DNA, 25 bp, Artificial sequence
  Synthetic oligonucleotide
cggccggtcgcaacgggccggagct

SEQ ID NO: 682895 - DNA, 25 bp, Artificial sequence
  Synthetic oligonucleotide
cgggtctcaaacgggcgcgcccgcg

SEQ ID NO: 682896 - DNA, 25 bp, Artificial sequence
  Synthetic oligonucleotide
cacggacgtgtccaccggcggccgg

SEQ ID NO: 682897 - DNA, 25 bp, Artificial sequence
  Synthetic oligonucleotide
cacggacgtgtcgaccggcggccgg

SEQ ID NO: 682898 - DNA, 25 bp, Artificial sequence
  Synthetic oligonucleotide
tgcgcgcgcgacaactcgggcgccg

SEQ ID NO: 682899 - DNA, 25 bp, Artificial sequence
  Synthetic oligonucleotide
tgcgcgcgcgactactcgggcgccg

SEQ ID NO: 682900 - DNA, 25 bp, Artificial sequence
  Synthetic oligonucleotide
cctcgcaccggcctccgaacgcgcc

SEQ ID NO: 682901 - DNA, 25 bp, Artificial sequence
  Synthetic oligonucleotide
cctcgcaccggcgtccgaacgcgcc

SEQ ID NO: 682902 - DNA, 25 bp, Artificial sequence
  Synthetic oligonucleotide
cgggtctcaaaccggcgcgcccgcg

SEQ ID NO: 682903 - DNA, 25 bp, Artificial sequence
  Synthetic oligonucleotide
ggccacacgctaggcgtcggcccgc

SEQ ID NO: 682904 - DNA, 25 bp, Artificial sequence
  Synthetic oligonucleotide
gcaccccgcgcgactcgtccggctc

SEQ ID NO: 682905 - DNA, 25 bp, Artificial sequence
  Synthetic oligonucleotide
gcaccccgcgcgtctcgtccggctc

SEQ ID NO: 682906 - DNA, 25 bp, Artificial sequence
  Synthetic oligonucleotide
gcagcccgacccctgtcggcggcgt

SEQ ID NO: 682907 - DNA, 25 bp, Artificial sequence
  Synthetic oligonucleotide
gcagcccgacccgtgtcggcggcgt

SEQ ID NO: 682908 - DNA, 25 bp, Artificial sequence
  Synthetic oligonucleotide
ggctccgtcgagggcacggtggccg

SEQ ID NO: 682909 - DNA, 25 bp, Artificial sequence
  Synthetic oligonucleotide
gtggcggcacgcgcgatagccggcg

SEQ ID NO: 682910 - DNA, 25 bp, Artificial sequence
  Synthetic oligonucleotide
gcacgccgacggtagccgggctggc

SEQ ID NO: 682911 - DNA, 25 bp, Artificial sequence
  Synthetic oligonucleotide
cggtccgggcgcctaagccccagcg

SEQ ID NO: 682912 - DNA, 25 bp, Artificial sequence
  Synthetic oligonucleotide
gcggcgtcgcgagcgcactcgcctg

SEQ ID NO: 682913 - DNA, 25 bp, Artificial sequence
  Synthetic oligonucleotide
ttggcgccgcggctcgacgggcctc

SEQ ID NO: 682914 - DNA, 25 bp, Artificial sequence
  Synthetic oligonucleotide
ttggcgccgcgggtcgacgggcctc

SEQ ID NO: 682915 - DNA, 25 bp, Artificial sequence
  Synthetic oligonucleotide
gacggctacgcggccccgtgtcggc

SEQ ID NO: 682916 - DNA, 25 bp, Artificial sequence
  Synthetic oligonucleotide
gacggctacgcgcccccgtgtcggc

SEQ ID NO: 682917 - DNA, 25 bp, Artificial sequence
  Synthetic oligonucleotide
gacgcctctacgccgcgccgctccc

SEQ ID NO: 682918 - DNA, 25 bp, Artificial sequence
  Synthetic oligonucleotide
gacgcctctacggcgcgccgctccc

SEQ ID NO: 682919 - DNA, 25 bp, Artificial sequence
  Synthetic oligonucleotide
ccgggccacgtcccgcgacagtgcc

SEQ ID NO: 682920 - DNA, 25 bp, Artificial sequence
  Synthetic oligonucleotide
ccgggccacgtcgcgcgacagtgcc

SEQ ID NO: 682921 - DNA, 25 bp, Artificial sequence
  Synthetic oligonucleotide
gcgcgcacgcgtaagaccgccgcgg

SEQ ID NO: 682922 - DNA, 25 bp, Artificial sequence
  Synthetic oligonucleotide
gcgcgcacgcgttagaccgccgcgg

SEQ ID NO: 682923 - DNA, 25 bp, Artificial sequence
  Synthetic oligonucleotide
gggcgcctcatgcgcgcgacgcacc

SEQ ID NO: 682924 - DNA, 25 bp, Artificial sequence
  Synthetic oligonucleotide
gcggccacggaccgtcggccgtcga

SEQ ID NO: 682925 - DNA, 25 bp, Artificial sequence
  Synthetic oligonucleotide
cgcgctcgggccggtacgacccacc

SEQ ID NO: 682926 - DNA, 25 bp, Artificial sequence
  Synthetic oligonucleotide
gcacgccgacggaagccgggctggc

SEQ ID NO: 682927 - DNA, 25 bp, Artificial sequence
  Synthetic oligonucleotide
ccgcgactgtcgggcgacgggccgt

SEQ ID NO: 682928 - DNA, 25 bp, Artificial sequence
  Synthetic oligonucleotide
ccgcgactgtcgcgcgacgggccgt

SEQ ID NO: 682929 - DNA, 25 bp, Artificial sequence
  Synthetic oligonucleotide
cgcccgcccggttgcgacgctgtgg

SEQ ID NO: 682930 - DNA, 25 bp, Artificial sequence
  Synthetic oligonucleotide
cgcccgcccggtagcgacgctgtgg

SEQ ID NO: 682931 - DNA, 25 bp, Artificial sequence
  Synthetic oligonucleotide
gggcggacggtatccggcgcaggcc

SEQ ID NO: 682932 - DNA, 25 bp, Artificial sequence
  Synthetic oligonucleotide
gggcggacggtaaccggcgcaggcc

SEQ ID NO: 682933 - DNA, 25 bp, Artificial sequence
  Synthetic oligonucleotide
ggccgggcgcgtagcggtactggcc

SEQ ID NO: 682934 - DNA, 25 bp, Artificial sequence
  Synthetic oligonucleotide
ggccgggcgcgttgcggtactggcc

SEQ ID NO: 682935 - DNA, 25 bp, Artificial sequence
  Synthetic oligonucleotide
gcccggggtctaggcgcgtcgggtg

SEQ ID NO: 682936 - DNA, 25 bp, Artificial sequence
  Synthetic oligonucleotide
gcccggggtctacgcgcgtcgggtg

SEQ ID NO: 682937 - DNA, 25 bp, Artificial sequence
  Synthetic oligonucleotide
ccccggcgcgattgacgccgctgcc

SEQ ID NO: 682938 - DNA, 25 bp, Artificial sequence
  Synthetic oligonucleotide
ccccggcgcgatagacgccgctgcc

SEQ ID NO: 682939 - DNA, 25 bp, Artificial sequence
  Synthetic oligonucleotide
gcggccacggacggtcggccgtcga

SEQ ID NO: 682940 - DNA, 25 bp, Artificial sequence
  Synthetic oligonucleotide
gggctcacgcgccgtactggcggcg

SEQ ID NO: 682941 - DNA, 25 bp, Artificial sequence
  Synthetic oligonucleotide
ggccacacgctacgcgtcggcccgc

SEQ ID NO: 682942 - DNA, 25 bp, Artificial sequence
  Synthetic oligonucleotide
ggctggcggacgatcgtgcccgcgg

SEQ ID NO: 682943 - DNA, 25 bp, Artificial sequence
  Synthetic oligonucleotide
ggctgacgtcacgggaccgcgcccg

SEQ ID NO: 682944 - DNA, 25 bp, Artificial sequence
  Synthetic oligonucleotide
ggtgcgcgcttacggcgtccccccc

SEQ ID NO: 682945 - DNA, 25 bp, Artificial sequence
  Synthetic oligonucleotide
ggtgcgcgcttagggcgtccccccc

SEQ ID NO: 682946 - DNA, 25 bp, Artificial sequence
  Synthetic oligonucleotide
gggtcggtatcgcgccccgcaggcg

SEQ ID NO: 682947 - DNA, 25 bp, Artificial sequence
  Synthetic oligonucleotide
gggtcggtatcgggccccgcaggcg

SEQ ID NO: 682948 - DNA, 25 bp, Artificial sequence
  Synthetic oligonucleotide
gagggctagcggtcgaccgccgggg

SEQ ID NO: 682949 - DNA, 25 bp, Artificial sequence
  Synthetic oligonucleotide
gagggctagcggacgaccgccgggg

SEQ ID NO: 682950 - DNA, 25 bp, Artificial sequence
  Synthetic oligonucleotide
cgcagggcgaacggcgcagcaggcg

SEQ ID NO: 682951 - DNA, 25 bp, Artificial sequence
  Synthetic oligonucleotide
cgcagggcgaaccgcgcagcaggcg

SEQ ID NO: 682952 - DNA, 25 bp, Artificial sequence
  Synthetic oligonucleotide
ggctgacgtcaccggaccgcgcccg

SEQ ID NO: 682953 - DNA, 25 bp, Artificial sequence
  Synthetic oligonucleotide
cgggtctgcgccgtgacgcgcgcga

SEQ ID NO: 682954 - DNA, 25 bp, Artificial sequence
  Synthetic oligonucleotide
gggccgcgatgcgctaccggagccg

SEQ ID NO: 682955 - DNA, 25 bp, Artificial sequence
  Synthetic oligonucleotide
gcaggccgtcagatcgcggggcgcg

SEQ ID NO: 682956 - DNA, 25 bp, Artificial sequence
  Synthetic oligonucleotide
gggctcacgcgcggtactggcggcg

SEQ ID NO: 682957 - DNA, 25 bp, Artificial sequence
  Synthetic oligonucleotide
tggcctcccgcgtacggtgcggccc

SEQ ID NO: 682958 - DNA, 25 bp, Artificial sequence
  Synthetic oligonucleotide
tggcctcccgcgaacggtgcggccc

SEQ ID NO: 682959 - DNA, 25 bp, Artificial sequence
  Synthetic oligonucleotide
cgtgcgggtagcccggacggcgcac

SEQ ID NO: 682960 - DNA, 25 bp, Artificial sequence
  Synthetic oligonucleotide
cgtgcgggtagcgcggacggcgcac

SEQ ID NO: 682961 - DNA, 25 bp, Artificial sequence
  Synthetic oligonucleotide
cgcggcgcccgttcgacggcggtac

SEQ ID NO: 682962 - DNA, 25 bp, Artificial sequence
  Synthetic oligonucleotide
cgcggcgcccgtacgacggcggtac

SEQ ID NO: 682963 - DNA, 25 bp, Artificial sequence
  Synthetic oligonucleotide
gcggagcgaccgagcgggtctgggc

SEQ ID NO: 682964 - DNA, 25 bp, Artificial sequence
  Synthetic oligonucleotide
gcaggccgtcagttcgcggggcgcg

SEQ ID NO: 682965 - DNA, 25 bp, Artificial sequence
  Synthetic oligonucleotide
gagccccccgacccgagacgggtcc

SEQ ID NO: 682966 - DNA, 25 bp, Artificial sequence
  Synthetic oligonucleotide
gagccccccgacgcgagacgggtcc

SEQ ID NO: 682967 - DNA, 25 bp, Artificial sequence
  Synthetic oligonucleotide
gaggggttatcgcgcgcggccggcc

SEQ ID NO: 682968 - DNA, 25 bp, Artificial sequence
  Synthetic oligonucleotide
gaggggttatcgggcgcggccggcc

SEQ ID NO: 682969 - DNA, 25 bp, Artificial sequence
  Synthetic oligonucleotide
gggccgcgatgccctaccggagccg

SEQ ID NO: 682970 - DNA, 25 bp, Artificial sequence
  Synthetic oligonucleotide
cggtccgcgctagcgcaccgcggtg

SEQ ID NO: 682971 - DNA, 25 bp, Artificial sequence
  Synthetic oligonucleotide
gggcgccgtcgcccatctaccggcg

SEQ ID NO: 682972 - DNA, 25 bp, Artificial sequence
  Synthetic oligonucleotide
gggtcgccgaacccggtcgagcgcc

SEQ ID NO: 682973 - DNA, 25 bp, Artificial sequence
  Synthetic oligonucleotide
gggtcgccgaacgcggtcgagcgcc

SEQ ID NO: 682974 - DNA, 25 bp, Artificial sequence
  Synthetic oligonucleotide
cgggccgacgtcccgcgtaccggca

SEQ ID NO: 682975 - DNA, 25 bp, Artificial sequence
  Synthetic oligonucleotide
cgggccgacgtcgcgcgtaccggca

SEQ ID NO: 682976 - DNA, 25 bp, Artificial sequence
  Synthetic oligonucleotide
agcggggcgcgaccgtctacggcgc

SEQ ID NO: 682977 - DNA, 25 bp, Artificial sequence
  Synthetic oligonucleotide
agcggggcgcgagcgtctacggcgc

SEQ ID NO: 682978 - DNA, 25 bp, Artificial sequence
  Synthetic oligonucleotide
ggcgcgctcggcgcgtacgtctggc

SEQ ID NO: 682979 - DNA, 25 bp, Artificial sequence
  Synthetic oligonucleotide
ggcgcgctcggcccgtacgtctggc

SEQ ID NO: 682980 - DNA, 25 bp, Artificial sequence
  Synthetic oligonucleotide
tcccgccgcgtacggggcacgcgca

SEQ ID NO: 682981 - DNA, 25 bp, Artificial sequence
  Synthetic oligonucleotide
tcccgccgcgtagggggcacgcgca

SEQ ID NO: 682982 - DNA, 25 bp, Artificial sequence
  Synthetic oligonucleotide
gccgcccgtatgcgcgccgcttgcc

SEQ ID NO: 682983 - DNA, 25 bp, Artificial sequence
  Synthetic oligonucleotide
gccgcccgtatgggcgccgcttgcc

SEQ ID NO: 682984 - DNA, 25 bp, Artificial sequence
  Synthetic oligonucleotide
gggcgccgtcgcgcatctaccggcg

SEQ ID NO: 682985 - DNA, 25 bp, Artificial sequence
  Synthetic oligonucleotide
ccggcgcgctaccggcgactcgagg

SEQ ID NO: 682986 - DNA, 25 bp, Artificial sequence
  Synthetic oligonucleotide
tcgtcgccggcataccgcgcccgcg

SEQ ID NO: 682987 - DNA, 25 bp, Artificial sequence
  Synthetic oligonucleotide
tcgtcgccggcaaaccgcgcccgcg

SEQ ID NO: 682988 - DNA, 25 bp, Artificial sequence
  Synthetic oligonucleotide
agcgcctcgtaccggcgtgccgcgg

SEQ ID NO: 682989 - DNA, 25 bp, Artificial sequence
  Synthetic oligonucleotide
agcgcctcgtacgggcgtgccgcgg

SEQ ID NO: 682990 - DNA, 25 bp, Artificial sequence
  Synthetic oligonucleotide
aggcgctaccgccgagcggcgaggg

SEQ ID NO: 682991 - DNA, 25 bp, Artificial sequence
  Synthetic oligonucleotide
aggccggtcgacgtccgcgcagcgc

SEQ ID NO: 682992 - DNA, 25 bp, Artificial sequence
  Synthetic oligonucleotide
ccggcgcgctacgggcgactcgagg

SEQ ID NO: 682993 - DNA, 25 bp, Artificial sequence
  Synthetic oligonucleotide
cggagcgcggcgcaacgtccggacc

SEQ ID NO: 682994 - DNA, 25 bp, Artificial sequence
  Synthetic oligonucleotide
aggggctcggacgggccgtgctccc

SEQ ID NO: 682995 - DNA, 25 bp, Artificial sequence
  Synthetic oligonucleotide
aggggctcggaccggccgtgctccc

SEQ ID NO: 682996 - DNA, 25 bp, Artificial sequence
  Synthetic oligonucleotide
gcggagcgaccgtgcgggtctgggc

SEQ ID NO: 682997 - DNA, 25 bp, Artificial sequence
  Synthetic oligonucleotide
cggtccgggcgcgtaagccccagcg

SEQ ID NO: 682998 - DNA, 25 bp, Artificial sequence
  Synthetic oligonucleotide
cggtccgcgctaccgcaccgcggtg

SEQ ID NO: 682999 - DNA, 25 bp, Artificial sequence
  Synthetic oligonucleotide
aggccggtcgacctccgcgcagcgc

SEQ ID NO: 683000 - DNA, 25 bp, Artificial sequence
  Synthetic oligonucleotide
aggcgctaccgcggagcggcgaggg

SEQ ID NO: 683001 - DNA, 25 bp, Artificial sequence
  Synthetic oligonucleotide
gcaggcggtcgcgtgacggcccctg

SEQ ID NO: 683002 - DNA, 25 bp, Artificial sequence
  Synthetic oligonucleotide
gcggcgtaccggacgacgcgctgcg

SEQ ID NO: 683003 - DNA, 25 bp, Artificial sequence
  Synthetic oligonucleotide
cctgccggccggtatagcgcgcccc

SEQ ID NO: 683004 - DNA, 25 bp, Artificial sequence
  Synthetic oligonucleotide
gcggcgtaccggtcgacgcgctgcg

SEQ ID NO: 683005 - DNA, 25 bp, Artificial sequence
  Synthetic oligonucleotide
cggagcgcggcggaacgtccggacc

SEQ ID NO: 683006 - DNA, 25 bp, Artificial sequence
  Synthetic oligonucleotide
ccaggccgcgcttcccgatcggggg

SEQ ID NO: 683007 - DNA, 25 bp, Artificial sequence
  Synthetic oligonucleotide
gcgcttcgcacgacgaccgcggccg

SEQ ID NO: 683008 - DNA, 25 bp, Artificial sequence
  Synthetic oligonucleotide
ccaggccgcgctacccgatcggggg

SEQ ID NO: 683009 - DNA, 25 bp, Artificial sequence
  Synthetic oligonucleotide
gcgcttcgcacgtcgaccgcggccg

SEQ ID NO: 683010 - DNA, 25 bp, Artificial sequence
  Synthetic oligonucleotide
gcgcgggccggcctaagcgcggaga

SEQ ID NO: 683011 - DNA, 25 bp, Artificial sequence
  Synthetic oligonucleotide
gccccggggtaccacgcggccatcg

SEQ ID NO: 683012 - DNA, 25 bp, Artificial sequence
  Synthetic oligonucleotide
cgcgctgcgtacgccgtcgcgcagg

SEQ ID NO: 683013 - DNA, 25 bp, Artificial sequence
  Synthetic oligonucleotide
gcgcgggccggcgtaagcgcggaga

SEQ ID NO: 683014 - DNA, 25 bp, Artificial sequence
  Synthetic oligonucleotide
cgcgctgcgtaccccgtcgcgcagg

SEQ ID NO: 683015 - DNA, 25 bp, Artificial sequence
  Synthetic oligonucleotide
acggcgcggtcgagctacgcgccgg

SEQ ID NO: 683016 - DNA, 25 bp, Artificial sequence
  Synthetic oligonucleotide
cctgccggccggaatagcgcgcccc

SEQ ID NO: 683017 - DNA, 25 bp, Artificial sequence
  Synthetic oligonucleotide
tgagcccgacccgtcggtcgcgcgg

SEQ ID NO: 683018 - DNA, 25 bp, Artificial sequence
  Synthetic oligonucleotide
tgagcccgacccctcggtcgcgcgg

SEQ ID NO: 683019 - DNA, 25 bp, Artificial sequence
  Synthetic oligonucleotide
ggcctgccgacgcaccggtccgtgc

SEQ ID NO: 683020 - DNA, 25 bp, Artificial sequence
  Synthetic oligonucleotide
gccccggggtacgacgcggccatcg

SEQ ID NO: 683021 - DNA, 25 bp, Artificial sequence
  Synthetic oligonucleotide
acggcgcggtcgtgctacgcgccgg

SEQ ID NO: 683022 - DNA, 25 bp, Artificial sequence
  Synthetic oligonucleotide
gcaggcggtcgcctgacggcccctg

SEQ ID NO: 683023 - DNA, 25 bp, Artificial sequence
  Synthetic oligonucleotide
gcccggcgaggccgtccgtacccag

SEQ ID NO: 683024 - DNA, 25 bp, Artificial sequence
  Synthetic oligonucleotide
cgcgtgccgcgagacgcgtcctgcc

SEQ ID NO: 683025 - DNA, 25 bp, Artificial sequence
  Synthetic oligonucleotide
cgcgtgccgcgacacgcgtcctgcc

SEQ ID NO: 683026 - DNA, 25 bp, Artificial sequence
  Synthetic oligonucleotide
gcccggcgaggcggtccgtacccag

SEQ ID NO: 683027 - DNA, 25 bp, Artificial sequence
  Synthetic oligonucleotide
ctcgcgggggtacgcgatccggcgg

SEQ ID NO: 683028 - DNA, 25 bp, Artificial sequence
  Synthetic oligonucleotide
ctcgcgggggtaggcgatccggcgg

SEQ ID NO: 683029 - DNA, 25 bp, Artificial sequence
  Synthetic oligonucleotide
ggcctgccgacggaccggtccgtgc

SEQ ID NO: 683030 - DNA, 25 bp, Artificial sequence
  Synthetic oligonucleotide
gcgccgcgcgcgttcggaccccagg

SEQ ID NO: 683031 - DNA, 25 bp, Artificial sequence
  Synthetic oligonucleotide
gcgccgcgcgcgatcggaccccagg

SEQ ID NO: 683032 - DNA, 25 bp, Artificial sequence
  Synthetic oligonucleotide
cgggcccggtccgacgcggcactcg

SEQ ID NO: 683033 - DNA, 25 bp, Artificial sequence
  Synthetic oligonucleotide
ccgcgtcgacgccgtagcccgcgcc

SEQ ID NO: 683034 - DNA, 25 bp, Artificial sequence
  Synthetic oligonucleotide
ccgcgtcgacgcggtagcccgcgcc

SEQ ID NO: 683035 - DNA, 25 bp, Artificial sequence
  Synthetic oligonucleotide
ggcagctacgggcgcctcgcccccg

SEQ ID NO: 683036 - DNA, 25 bp, Artificial sequence
  Synthetic oligonucleotide
ggcagctacgggggcctcgcccccg

SEQ ID NO: 683037 - DNA, 25 bp, Artificial sequence
  Synthetic oligonucleotide
ccgcgcacgcgagcgttgccgcccc

SEQ ID NO: 683038 - DNA, 25 bp, Artificial sequence
  Synthetic oligonucleotide
cgggcccggtcccacgcggcactcg

SEQ ID NO: 683039 - DNA, 25 bp, Artificial sequence
  Synthetic oligonucleotide
gcccgccgcgcgttcggtcgcggtg

SEQ ID NO: 683040 - DNA, 25 bp, Artificial sequence
  Synthetic oligonucleotide
gaccgcaccggacgacggcgggcgg

SEQ ID NO: 683041 - DNA, 25 bp, Artificial sequence
  Synthetic oligonucleotide
gaccgcaccggaggacggcgggcgg

SEQ ID NO: 683042 - DNA, 25 bp, Artificial sequence
  Synthetic oligonucleotide
gtggccgggtacccggcgtgggccg

SEQ ID NO: 683043 - DNA, 25 bp, Artificial sequence
  Synthetic oligonucleotide
gtggccgggtacgcggcgtgggccg

SEQ ID NO: 683044 - DNA, 25 bp, Artificial sequence
  Synthetic oligonucleotide
gccgcctctcgagccgacgccgcgc

SEQ ID NO: 683045 - DNA, 25 bp, Artificial sequence
  Synthetic oligonucleotide
gccgcctctcgacccgacgccgcgc

SEQ ID NO: 683046 - DNA, 25 bp, Artificial sequence
  Synthetic oligonucleotide
ccgcgcgcccgaggcgctaccggca

SEQ ID NO: 683047 - DNA, 25 bp, Artificial sequence
  Synthetic oligonucleotide
ccgcgcacgcgaccgttgccgcccc

SEQ ID NO: 683048 - DNA, 25 bp, Artificial sequence
  Synthetic oligonucleotide
ccgcccgcgtaagcgcgcagcgcgg

SEQ ID NO: 683049 - DNA, 25 bp, Artificial sequence
  Synthetic oligonucleotide
gcggggtaccgcgtcacgggcggcg

SEQ ID NO: 683050 - DNA, 25 bp, Artificial sequence
  Synthetic oligonucleotide
gcccgggcggtcgtacgcacgcggg

SEQ ID NO: 683051 - DNA, 25 bp, Artificial sequence
  Synthetic oligonucleotide
gcccgggcggtcctacgcacgcggg

SEQ ID NO: 683052 - DNA, 25 bp, Artificial sequence
  Synthetic oligonucleotide
gcggggtaccgcctcacgggcggcg

SEQ ID NO: 683053 - DNA, 25 bp, Artificial sequence
  Synthetic oligonucleotide
ggcgtgcgtctacgcgcgggggccg

SEQ ID NO: 683054 - DNA, 25 bp, Artificial sequence
  Synthetic oligonucleotide
ccgcgcgcccgacgcgctaccggca

SEQ ID NO: 683055 - DNA, 25 bp, Artificial sequence
  Synthetic oligonucleotide
gcacccacgcgccgttgcgcccgcc

SEQ ID NO: 683056 - DNA, 25 bp, Artificial sequence
  Synthetic oligonucleotide
gcacccacgcgcggttgcgcccgcc

SEQ ID NO: 683057 - DNA, 25 bp, Artificial sequence
  Synthetic oligonucleotide
ggggcccgcgcggctatgcccccca

SEQ ID NO: 683058 - DNA, 25 bp, Artificial sequence
  Synthetic oligonucleotide
gcgcgcccgacggccgtcgagcgca

SEQ ID NO: 683059 - DNA, 25 bp, Artificial sequence
  Synthetic oligonucleotide
cgcgggcgtgcgccctacgcagggg

SEQ ID NO: 683060 - DNA, 25 bp, Artificial sequence
  Synthetic oligonucleotide
ccgcccgcgtaaccgcgcagcgcgg

SEQ ID NO: 683061 - DNA, 25 bp, Artificial sequence
  Synthetic oligonucleotide
gccccgtaccgccgcgtgtcgggcc

SEQ ID NO: 683062 - DNA, 25 bp, Artificial sequence
  Synthetic oligonucleotide
gccccgtaccgcggcgtgtcgggcc

SEQ ID NO: 683063 - DNA, 25 bp, Artificial sequence
  Synthetic oligonucleotide
gccaccgtcgaccggcgctgggggc

SEQ ID NO: 683064 - DNA, 25 bp, Artificial sequence
  Synthetic oligonucleotide
gccaccgtcgacgggcgctgggggc

SEQ ID NO: 683065 - DNA, 25 bp, Artificial sequence
  Synthetic oligonucleotide
gcccgccgcgcgatcggtcgcggtg

SEQ ID NO: 683066 - DNA, 25 bp, Artificial sequence
  Synthetic oligonucleotide
ggggcccgcgcgcctatgcccccca

SEQ ID NO: 683067 - DNA, 25 bp, Artificial sequence
  Synthetic oligonucleotide
cgcgggcgtgcggcctacgcagggg

SEQ ID NO: 683068 - DNA, 25 bp, Artificial sequence
  Synthetic oligonucleotide
gcgcgcccgacgcccgtcgagcgca

SEQ ID NO: 683069 - DNA, 25 bp, Artificial sequence
  Synthetic oligonucleotide
ggcgcgacggtcgcgggtagccccc

SEQ ID NO: 683070 - DNA, 25 bp, Artificial sequence
  Synthetic oligonucleotide
cggcgcgggcggtacggtcgcacgg

SEQ ID NO: 683071 - DNA, 25 bp, Artificial sequence
  Synthetic oligonucleotide
cgaccctcgacgcgagggccgcggc

SEQ ID NO: 683072 - DNA, 25 bp, Artificial sequence
  Synthetic oligonucleotide
cgaccctcgacgggagggccgcggc

SEQ ID NO: 683073 - DNA, 25 bp, Artificial sequence
  Synthetic oligonucleotide
gggccctcggacccccgtccggtgc

SEQ ID NO: 683074 - DNA, 25 bp, Artificial sequence
  Synthetic oligonucleotide
cggcggcgtcgcgtagggagggcgc

SEQ ID NO: 683075 - DNA, 25 bp, Artificial sequence
  Synthetic oligonucleotide
aggccccgcgtgcgacacggcgggc

SEQ ID NO: 683076 - DNA, 25 bp, Artificial sequence
  Synthetic oligonucleotide
aggccccgcgtgggacacggcgggc

SEQ ID NO: 683077 - DNA, 25 bp, Artificial sequence
  Synthetic oligonucleotide
cccgcgcgtccccacgtcggcggct

SEQ ID NO: 683078 - DNA, 25 bp, Artificial sequence
  Synthetic oligonucleotide
gcggcagcccggtgcgacgcgaccc

SEQ ID NO: 683079 - DNA, 25 bp, Artificial sequence
  Synthetic oligonucleotide
ggcgtgcgtctaggcgcgggggccg

SEQ ID NO: 683080 - DNA, 25 bp, Artificial sequence
  Synthetic oligonucleotide
ggcgcgacggtcccgggtagccccc

SEQ ID NO: 683081 - DNA, 25 bp, Artificial sequence
  Synthetic oligonucleotide
cgcggcaccgggccgtacggctccg

SEQ ID NO: 683082 - DNA, 25 bp, Artificial sequence
  Synthetic oligonucleotide
cgcggcaccggggcgtacggctccg

SEQ ID NO: 683083 - DNA, 25 bp, Artificial sequence
  Synthetic oligonucleotide
cccctggcgcgaccctacggggcgc

SEQ ID NO: 683084 - DNA, 25 bp, Artificial sequence
  Synthetic oligonucleotide
ccgcgggtccgcccatccggccacc

SEQ ID NO: 683085 - DNA, 25 bp, Artificial sequence
  Synthetic oligonucleotide
gcgaggcgcgcgaagcgacggcgcg

SEQ ID NO: 683086 - DNA, 25 bp, Artificial sequence
  Synthetic oligonucleotide
cccctggcgcgagcctacggggcgc

SEQ ID NO: 683087 - DNA, 25 bp, Artificial sequence
  Synthetic oligonucleotide
ccggcgcgcccgcgcgataggtggg

SEQ ID NO: 683088 - DNA, 25 bp, Artificial sequence
  Synthetic oligonucleotide
gcggcagcccggagcgacgcgaccc

SEQ ID NO: 683089 - DNA, 25 bp, Artificial sequence
  Synthetic oligonucleotide
ccgccacgcgctcggtcgaggcccg

SEQ ID NO: 683090 - DNA, 25 bp, Artificial sequence
  Synthetic oligonucleotide
gcaggccgcggcctaacccgcccgc

SEQ ID NO: 683091 - DNA, 25 bp, Artificial sequence
  Synthetic oligonucleotide
gcccgccgcgaccgtacggcgacgc

SEQ ID NO: 683092 - DNA, 25 bp, Artificial sequence
  Synthetic oligonucleotide
gcccgccgcgacggtacggcgacgc

SEQ ID NO: 683093 - DNA, 25 bp, Artificial sequence
  Synthetic oligonucleotide
ggccgggcgtccgagcggtcggtcc

SEQ ID NO: 683094 - DNA, 25 bp, Artificial sequence
  Synthetic oligonucleotide
ggccgggcgtcccagcggtcggtcc

SEQ ID NO: 683095 - DNA, 25 bp, Artificial sequence
  Synthetic oligonucleotide
gaccccgggacgtgcgtcggcccgc

SEQ ID NO: 683096 - DNA, 25 bp, Artificial sequence
  Synthetic oligonucleotide
gaccccgggacgagcgtcggcccgc

SEQ ID NO: 683097 - DNA, 25 bp, Artificial sequence
  Synthetic oligonucleotide
cccgcgcgtcccgacgtcggcggct

SEQ ID NO: 683098 - DNA, 25 bp, Artificial sequence
  Synthetic oligonucleotide
tccgggccgctcggcggtagggcgc

SEQ ID NO: 683099 - DNA, 25 bp, Artificial sequence
  Synthetic oligonucleotide
gcaggccgcggcgtaacccgcccgc

SEQ ID NO: 683100 - DNA, 25 bp, Artificial sequence
  Synthetic oligonucleotide
ccgccacgcgctgggtcgaggcccg

SEQ ID NO: 683101 - DNA, 25 bp, Artificial sequence
  Synthetic oligonucleotide
gccggtgcgcggacgtgtccgcgcc

SEQ ID NO: 683102 - DNA, 25 bp, Artificial sequence
  Synthetic oligonucleotide
gccggtgcgcggtcgtgtccgcgcc

SEQ ID NO: 683103 - DNA, 25 bp, Artificial sequence
  Synthetic oligonucleotide
ggcgcgcgcgtgccgactaccggcg

SEQ ID NO: 683104 - DNA, 25 bp, Artificial sequence
  Synthetic oligonucleotide
ggcgcgcgcgtggcgactaccggcg

SEQ ID NO: 683105 - DNA, 25 bp, Artificial sequence
  Synthetic oligonucleotide
ccgcccccctggttcggcgcgaggc

SEQ ID NO: 683106 - DNA, 25 bp, Artificial sequence
  Synthetic oligonucleotide
ccgcccccctggatcggcgcgaggc

SEQ ID NO: 683107 - DNA, 25 bp, Artificial sequence
  Synthetic oligonucleotide
cggcgcgggcggaacggtcgcacgg

SEQ ID NO: 683108 - DNA, 25 bp, Artificial sequence
  Synthetic oligonucleotide
tccgggccgctccgcggtagggcgc

SEQ ID NO: 683109 - DNA, 25 bp, Artificial sequence
  Synthetic oligonucleotide
gcgaggcgcgcgtagcgacggcgcg

SEQ ID NO: 683110 - DNA, 25 bp, Artificial sequence
  Synthetic oligonucleotide
gcggcggttccgcggcgtacggccc

SEQ ID NO: 683111 - DNA, 25 bp, Artificial sequence
  Synthetic oligonucleotide
cgcgcgcgtgcgtcgcaccccggac

SEQ ID NO: 683112 - DNA, 25 bp, Artificial sequence
  Synthetic oligonucleotide
agggcgcgatacccggccgccgcgc

SEQ ID NO: 683113 - DNA, 25 bp, Artificial sequence
  Synthetic oligonucleotide
agggcgcgatacgcggccgccgcgc

SEQ ID NO: 683114 - DNA, 25 bp, Artificial sequence
  Synthetic oligonucleotide
ggccgagccaacccgcggtggggcg

SEQ ID NO: 683115 - DNA, 25 bp, Artificial sequence
  Synthetic oligonucleotide
ggccgagccaacgcgcggtggggcg

SEQ ID NO: 683116 - DNA, 25 bp, Artificial sequence
  Synthetic oligonucleotide
ggggggagctcgggtagcgccggcc

SEQ ID NO: 683117 - DNA, 25 bp, Artificial sequence
  Synthetic oligonucleotide
ggggggagctcgcgtagcgccggcc

SEQ ID NO: 683118 - DNA, 25 bp, Artificial sequence
  Synthetic oligonucleotide
ggccgccggcgcgcgtagtaggcgc

SEQ ID NO: 683119 - DNA, 25 bp, Artificial sequence
  Synthetic oligonucleotide
gccagcccgtaccacggcccgggcg

SEQ ID NO: 683120 - DNA, 25 bp, Artificial sequence
  Synthetic oligonucleotide
ggccgccggcgcccgtagtaggcgc

SEQ ID NO: 683121 - DNA, 25 bp, Artificial sequence
  Synthetic oligonucleotide
cgcgggcgtagcccggtacgccgcc

SEQ ID NO: 683122 - DNA, 25 bp, Artificial sequence
  Synthetic oligonucleotide
gccgcccgtcgcgtgagcgcgcctc

SEQ ID NO: 683123 - DNA, 25 bp, Artificial sequence
  Synthetic oligonucleotide
gccgcccgtcgcctgagcgcgcctc

SEQ ID NO: 683124 - DNA, 25 bp, Artificial sequence
  Synthetic oligonucleotide
cggcgcgcgcaaggcccgtgcgggt

SEQ ID NO: 683125 - DNA, 25 bp, Artificial sequence
  Synthetic oligonucleotide
cggcgcgcgcaacgcccgtgcgggt

SEQ ID NO: 683126 - DNA, 25 bp, Artificial sequence
  Synthetic oligonucleotide
ggcccgtagacgcccggcgcctccg

SEQ ID NO: 683127 - DNA, 25 bp, Artificial sequence
  Synthetic oligonucleotide
ggcccgtagacggccggcgcctccg

SEQ ID NO: 683128 - DNA, 25 bp, Artificial sequence
  Synthetic oligonucleotide
gccgggcgaccgcgcgtctacgcgg

SEQ ID NO: 683129 - DNA, 25 bp, Artificial sequence
  Synthetic oligonucleotide
cgcgggcgtagcgcggtacgccgcc

SEQ ID NO: 683130 - DNA, 25 bp, Artificial sequence
  Synthetic oligonucleotide
gccagcccgtacgacggcccgggcg

SEQ ID NO: 683131 - DNA, 25 bp, Artificial sequence
  Synthetic oligonucleotide
cctgccacgcgccgtagcggggccc

SEQ ID NO: 683132 - DNA, 25 bp, Artificial sequence
  Synthetic oligonucleotide
cggcggcgtcgcctagggagggcgc

SEQ ID NO: 683133 - DNA, 25 bp, Artificial sequence
  Synthetic oligonucleotide
ccggcgcgcccgggcgataggtggg

SEQ ID NO: 683134 - DNA, 25 bp, Artificial sequence
  Synthetic oligonucleotide
tgcccccggtcccagcgacgcccgg

SEQ ID NO: 683135 - DNA, 25 bp, Artificial sequence
  Synthetic oligonucleotide
tgcccccggtccgagcgacgcccgg

SEQ ID NO: 683136 - DNA, 25 bp, Artificial sequence
  Synthetic oligonucleotide
cccgcgcgtccggtacgaggcggcc

SEQ ID NO: 683137 - DNA, 25 bp, Artificial sequence
  Synthetic oligonucleotide
cccgcgcgtccgctacgaggcggcc

SEQ ID NO: 683138 - DNA, 25 bp, Artificial sequence
  Synthetic oligonucleotide
gacccgccgcgcgtacgtgcccggg

SEQ ID NO: 683139 - DNA, 25 bp, Artificial sequence
  Synthetic oligonucleotide
gacccgccgcgcctacgtgcccggg

SEQ ID NO: 683140 - DNA, 25 bp, Artificial sequence
  Synthetic oligonucleotide
cgcgcgcgtgcgacgcaccccggac

SEQ ID NO: 683141 - DNA, 25 bp, Artificial sequence
  Synthetic oligonucleotide
acgggcgcacgccacgaccccgccg

SEQ ID NO: 683142 - DNA, 25 bp, Artificial sequence
  Synthetic oligonucleotide
gcggcggttccggggcgtacggccc

SEQ ID NO: 683143 - DNA, 25 bp, Artificial sequence
  Synthetic oligonucleotide
cctgccacgcgcggtagcggggccc

SEQ ID NO: 683144 - DNA, 25 bp, Artificial sequence
  Synthetic oligonucleotide
ccccggcccgcgctacgacgcagcg

SEQ ID NO: 683145 - DNA, 25 bp, Artificial sequence
  Synthetic oligonucleotide
ccccggcccgcggtacgacgcagcg

SEQ ID NO: 683146 - DNA, 25 bp, Artificial sequence
  Synthetic oligonucleotide
gccgcctacgtcgaccgcgggcccg

SEQ ID NO: 683147 - DNA, 25 bp, Artificial sequence
  Synthetic oligonucleotide
gccgcctacgtccaccgcgggcccg

SEQ ID NO: 683148 - DNA, 25 bp, Artificial sequence
  Synthetic oligonucleotide
ggcgcgcgtcgaaacccgcgggccc

SEQ ID NO: 683149 - DNA, 25 bp, Artificial sequence
  Synthetic oligonucleotide
ggcgcgcgtcgatacccgcgggccc

SEQ ID NO: 683150 - DNA, 25 bp, Artificial sequence
  Synthetic oligonucleotide
gcggcgtacggcgcgcgcacggacg

SEQ ID NO: 683151 - DNA, 25 bp, Artificial sequence
  Synthetic oligonucleotide
gcggcgtacggcccgcgcacggacg

SEQ ID NO: 683152 - DNA, 25 bp, Artificial sequence
  Synthetic oligonucleotide
acgggcgcacgcgacgaccccgccg

SEQ ID NO: 683153 - DNA, 25 bp, Artificial sequence
  Synthetic oligonucleotide
ggccgctcggtccccggtagccggc

SEQ ID NO: 683154 - DNA, 25 bp, Artificial sequence
  Synthetic oligonucleotide
gccgggcgaccgggcgtctacgcgg

SEQ ID NO: 683155 - DNA, 25 bp, Artificial sequence
  Synthetic oligonucleotide
cccgggcgtacgcgcccctgctggc

SEQ ID NO: 683156 - DNA, 25 bp, Artificial sequence
  Synthetic oligonucleotide
gggctgtagaccccccgcgggggcg

SEQ ID NO: 683157 - DNA, 25 bp, Artificial sequence
  Synthetic oligonucleotide
gggctgtagaccgcccgcgggggcg

SEQ ID NO: 683158 - DNA, 25 bp, Artificial sequence
  Synthetic oligonucleotide
cccgccacgcgcctacggcaccgcg

SEQ ID NO: 683159 - DNA, 25 bp, Artificial sequence
  Synthetic oligonucleotide
cccgccacgcgcgtacggcaccgcg

SEQ ID NO: 683160 - DNA, 25 bp, Artificial sequence
  Synthetic oligonucleotide
gcggccttcggcccgctacggccgg

SEQ ID NO: 683161 - DNA, 25 bp, Artificial sequence
  Synthetic oligonucleotide
gcggccttcggcgcgctacggccgg

SEQ ID NO: 683162 - DNA, 25 bp, Artificial sequence
  Synthetic oligonucleotide
gctgccggtcgccccgacggcgagg

SEQ ID NO: 683163 - DNA, 25 bp, Artificial sequence
  Synthetic oligonucleotide
gggccgcggacgcgtaccgctcccg

SEQ ID NO: 683164 - DNA, 25 bp, Artificial sequence
  Synthetic oligonucleotide
gctgccggtcgcgccgacggcgagg

SEQ ID NO: 683165 - DNA, 25 bp, Artificial sequence
  Synthetic oligonucleotide
ggccgctcggtcgccggtagccggc

SEQ ID NO: 683166 - DNA, 25 bp, Artificial sequence
  Synthetic oligonucleotide
gcggcgcccgcgacgggttgcgcca

SEQ ID NO: 683167 - DNA, 25 bp, Artificial sequence
  Synthetic oligonucleotide
gcggcgcccgcgtcgggttgcgcca

SEQ ID NO: 683168 - DNA, 25 bp, Artificial sequence
  Synthetic oligonucleotide
gccgcgcgtcgcggcctaccacggg

SEQ ID NO: 683169 - DNA, 25 bp, Artificial sequence
  Synthetic oligonucleotide
gccgcgcgtcgccgcctaccacggg

SEQ ID NO: 683170 - DNA, 25 bp, Artificial sequence
  Synthetic oligonucleotide
ggcgcgctagcgcgcgtcggaggcc

SEQ ID NO: 683171 - DNA, 25 bp, Artificial sequence
  Synthetic oligonucleotide
ggcgcgctagcgggcgtcggaggcc

SEQ ID NO: 683172 - DNA, 25 bp, Artificial sequence
  Synthetic oligonucleotide
aggcggccgaccgttgcgcccggcc

SEQ ID NO: 683173 - DNA, 25 bp, Artificial sequence
  Synthetic oligonucleotide
aggcggccgacccttgcgcccggcc

SEQ ID NO: 683174 - DNA, 25 bp, Artificial sequence
  Synthetic oligonucleotide
gggccgcggacgggtaccgctcccg

SEQ ID NO: 683175 - DNA, 25 bp, Artificial sequence
  Synthetic oligonucleotide
ggggcgtcgacccgcacgccgctgg

SEQ ID NO: 683176 - DNA, 25 bp, Artificial sequence
  Synthetic oligonucleotide
ggcgggggccgttcgagcgccacgg

SEQ ID NO: 683177 - DNA, 25 bp, Artificial sequence
  Synthetic oligonucleotide
ggcgggggccgtacgagcgccacgg

SEQ ID NO: 683178 - DNA, 25 bp, Artificial sequence
  Synthetic oligonucleotide
cggggggtacgcgtccgcgtggcgc

SEQ ID NO: 683179 - DNA, 25 bp, Artificial sequence
  Synthetic oligonucleotide
cggggggtacgcctccgcgtggcgc

SEQ ID NO: 683180 - DNA, 25 bp, Artificial sequence
  Synthetic oligonucleotide
cggctcccgcgccgacgtacgcgcg

SEQ ID NO: 683181 - DNA, 25 bp, Artificial sequence
  Synthetic oligonucleotide
cggctcccgcgcggacgtacgcgcg

SEQ ID NO: 683182 - DNA, 25 bp, Artificial sequence
  Synthetic oligonucleotide
cgcccctaacgtcgccggcgcgcgc

SEQ ID NO: 683183 - DNA, 25 bp, Artificial sequence
  Synthetic oligonucleotide
cgcccctaacgtggccggcgcgcgc

SEQ ID NO: 683184 - DNA, 25 bp, Artificial sequence
  Synthetic oligonucleotide
cccgggcgtacgggcccctgctggc

SEQ ID NO: 683185 - DNA, 25 bp, Artificial sequence
  Synthetic oligonucleotide
ccggccgcgttcggcgatcgcgggg

SEQ ID NO: 683186 - DNA, 25 bp, Artificial sequence
  Synthetic oligonucleotide
ccgcgggtccgcgcatccggccacc

SEQ ID NO: 683187 - DNA, 25 bp, Artificial sequence
  Synthetic oligonucleotide
ggggcgtcgaccggcacgccgctgg

SEQ ID NO: 683188 - DNA, 25 bp, Artificial sequence
  Synthetic oligonucleotide
ccagcggtcgaccgcggacggcggc

SEQ ID NO: 683189 - DNA, 25 bp, Artificial sequence
  Synthetic oligonucleotide
ccagcggtcgacggcggacggcggc

SEQ ID NO: 683190 - DNA, 25 bp, Artificial sequence
  Synthetic oligonucleotide
gccccgctacggagacgcggccggc

SEQ ID NO: 683191 - DNA, 25 bp, Artificial sequence
  Synthetic oligonucleotide
gccccgctacggtgacgcggccggc

SEQ ID NO: 683192 - DNA, 25 bp, Artificial sequence
  Synthetic oligonucleotide
gcacgcgttcggccgcgtcccggcg

SEQ ID NO: 683193 - DNA, 25 bp, Artificial sequence
  Synthetic oligonucleotide
gcacgcgttcgggcgcgtcccggcg

SEQ ID NO: 683194 - DNA, 25 bp, Artificial sequence
  Synthetic oligonucleotide
gcggccggatacccgcgggcagggc

SEQ ID NO: 683195 - DNA, 25 bp, Artificial sequence
  Synthetic oligonucleotide
gcggccggatacgcgcgggcagggc

SEQ ID NO: 683196 - DNA, 25 bp, Artificial sequence
  Synthetic oligonucleotide
ccggccgcgttccgcgatcgcgggg

SEQ ID NO: 683197 - DNA, 25 bp, Artificial sequence
  Synthetic oligonucleotide
cgcgggtgcgtacgcagcgggcggg

SEQ ID NO: 683198 - DNA, 25 bp, Artificial sequence
  Synthetic oligonucleotide
ccgcgcgccgtagcgcggtgcagcc

SEQ ID NO: 683199 - DNA, 25 bp, Artificial sequence
  Synthetic oligonucleotide
cggcgcgtacggggcgatccggcgg

SEQ ID NO: 683200 - DNA, 25 bp, Artificial sequence
  Synthetic oligonucleotide
ggggcgacgcgccggcctacctggc

SEQ ID NO: 683201 - DNA, 25 bp, Artificial sequence
  Synthetic oligonucleotide
ggggcgacgcgcgggcctacctggc

SEQ ID NO: 683202 - DNA, 25 bp, Artificial sequence
  Synthetic oligonucleotide
cgcccccgcgtaccgagggcaggcg

SEQ ID NO: 683203 - DNA, 25 bp, Artificial sequence
  Synthetic oligonucleotide
ccgggcacaaccggtccgccgcgcg

SEQ ID NO: 683204 - DNA, 25 bp, Artificial sequence
  Synthetic oligonucleotide
gcctgggtgtcgaccgcgccccggc

SEQ ID NO: 683205 - DNA, 25 bp, Artificial sequence
  Synthetic oligonucleotide
gcctgggtgtcgtccgcgccccggc

SEQ ID NO: 683206 - DNA, 25 bp, Artificial sequence
  Synthetic oligonucleotide
ggcgtggtcgacggtccgccgcgcg

SEQ ID NO: 683207 - DNA, 25 bp, Artificial sequence
  Synthetic oligonucleotide
ggcgtggtcgaccgtccgccgcgcg

SEQ ID NO: 683208 - DNA, 25 bp, Artificial sequence
  Synthetic oligonucleotide
cgtccgcggccccacgtacggccgc

SEQ ID NO: 683209 - DNA, 25 bp, Artificial sequence
  Synthetic oligonucleotide
cgtccgcggcccgacgtacggccgc

SEQ ID NO: 683210 - DNA, 25 bp, Artificial sequence
  Synthetic oligonucleotide
ggcggccgcgccggatcgtcctggc

SEQ ID NO: 683211 - DNA, 25 bp, Artificial sequence
  Synthetic oligonucleotide
gacgggcgcgaccgtcgacccggcg

SEQ ID NO: 683212 - DNA, 25 bp, Artificial sequence
  Synthetic oligonucleotide
ggcggccgcgcccgatcgtcctggc

SEQ ID NO: 683213 - DNA, 25 bp, Artificial sequence
  Synthetic oligonucleotide
cgcgggtgcgtaggcagcgggcggg

SEQ ID NO: 683214 - DNA, 25 bp, Artificial sequence
  Synthetic oligonucleotide
ccggcgaccccgcgcgtacgtcgcg

SEQ ID NO: 683215 - DNA, 25 bp, Artificial sequence
  Synthetic oligonucleotide
ccggcgaccccgggcgtacgtcgcg

SEQ ID NO: 683216 - DNA, 25 bp, Artificial sequence
  Synthetic oligonucleotide
ggcagggtcggagcgcggagggccc

SEQ ID NO: 683217 - DNA, 25 bp, Artificial sequence
  Synthetic oligonucleotide
ggcagggtcggaccgcggagggccc

SEQ ID NO: 683218 - DNA, 25 bp, Artificial sequence
  Synthetic oligonucleotide
ggagccagcgcgaccggtgcgcggg

SEQ ID NO: 683219 - DNA, 25 bp, Artificial sequence
  Synthetic oligonucleotide
ggagccagcgcgtccggtgcgcggg

SEQ ID NO: 683220 - DNA, 25 bp, Artificial sequence
  Synthetic oligonucleotide
ggccggcgtcgggcgtacggcaggg

SEQ ID NO: 683221 - DNA, 25 bp, Artificial sequence
  Synthetic oligonucleotide
ggccggcgtcggccgtacggcaggg

SEQ ID NO: 683222 - DNA, 25 bp, Artificial sequence
  Synthetic oligonucleotide
cgccccttgcgccaccgtccgcggg

SEQ ID NO: 683223 - DNA, 25 bp, Artificial sequence
  Synthetic oligonucleotide
cgccccttgcgcgaccgtccgcggg

SEQ ID NO: 683224 - DNA, 25 bp, Artificial sequence
  Synthetic oligonucleotide
ccgcgggttcgtggcgcggcgtccg

SEQ ID NO: 683225 - DNA, 25 bp, Artificial sequence
  Synthetic oligonucleotide
gacgggcgcgacggtcgacccggcg

SEQ ID NO: 683226 - DNA, 25 bp, Artificial sequence
  Synthetic oligonucleotide
cacgcctcgctaccgcgccgggcgc

SEQ ID NO: 683227 - DNA, 25 bp, Artificial sequence
  Synthetic oligonucleotide
ccgcgcgccgtaccgcggtgcagcc

SEQ ID NO: 683228 - DNA, 25 bp, Artificial sequence
  Synthetic oligonucleotide
tggccggggccgttcgacgcccggc

SEQ ID NO: 683229 - DNA, 25 bp, Artificial sequence
  Synthetic oligonucleotide
tggccggggccgatcgacgcccggc

SEQ ID NO: 683230 - DNA, 25 bp, Artificial sequence
  Synthetic oligonucleotide
cgccggtggtacggcgacggcgcgc

SEQ ID NO: 683231 - DNA, 25 bp, Artificial sequence
  Synthetic oligonucleotide
cgccggtggtaccgcgacggcgcgc

SEQ ID NO: 683232 - DNA, 25 bp, Artificial sequence
  Synthetic oligonucleotide
ggctgcgccgcgacgtacgcccgcc

SEQ ID NO: 683233 - DNA, 25 bp, Artificial sequence
  Synthetic oligonucleotide
ggctgcgccgcgtcgtacgcccgcc

SEQ ID NO: 683234 - DNA, 25 bp, Artificial sequence
  Synthetic oligonucleotide
ccggtcacgacgcgtgcggggcccc

SEQ ID NO: 683235 - DNA, 25 bp, Artificial sequence
  Synthetic oligonucleotide
ccggtcacgacgggtgcggggcccc

SEQ ID NO: 683236 - DNA, 25 bp, Artificial sequence
  Synthetic oligonucleotide
ggcgggcggtacgaccgcgcggagc

SEQ ID NO: 683237 - DNA, 25 bp, Artificial sequence
  Synthetic oligonucleotide
ggcgggcggtaccaccgcgcggagc

SEQ ID NO: 683238 - DNA, 25 bp, Artificial sequence
  Synthetic oligonucleotide
tccgccgggcggacgtacggcggcc

SEQ ID NO: 683239 - DNA, 25 bp, Artificial sequence
  Synthetic oligonucleotide
cggcgcgtacggcgcgatccggcgg

SEQ ID NO: 683240 - DNA, 25 bp, Artificial sequence
  Synthetic oligonucleotide
cacgcctcgctagcgcgccgggcgc

SEQ ID NO: 683241 - DNA, 25 bp, Artificial sequence
  Synthetic oligonucleotide
ctggggcggtccgctagcggcccgg

SEQ ID NO: 683242 - DNA, 25 bp, Artificial sequence
  Synthetic oligonucleotide
gcggcgcgaccggctcgaacggccg

SEQ ID NO: 683243 - DNA, 25 bp, Artificial sequence
  Synthetic oligonucleotide
gcggcgcgaccgcctcgaacggccg

SEQ ID NO: 683244 - DNA, 25 bp, Artificial sequence
  Synthetic oligonucleotide
ggcgggtacgcgtgggcggcccgct

SEQ ID NO: 683245 - DNA, 25 bp, Artificial sequence
  Synthetic oligonucleotide
ggcgggtacgcgagggcggcccgct

SEQ ID NO: 683246 - DNA, 25 bp, Artificial sequence
  Synthetic oligonucleotide
ggcggcgacggcgtacgctggggcg

SEQ ID NO: 683247 - DNA, 25 bp, Artificial sequence
  Synthetic oligonucleotide
ggcggcgacggcctacgctggggcg

SEQ ID NO: 683248 - DNA, 25 bp, Artificial sequence
  Synthetic oligonucleotide
ggcggcctacgtcggtccgcgcccg

SEQ ID NO: 683249 - DNA, 25 bp, Artificial sequence
  Synthetic oligonucleotide
ggcggcctacgtgggtccgcgcccg

SEQ ID NO: 683250 - DNA, 25 bp, Artificial sequence
  Synthetic oligonucleotide
ccccgcggtagcctccacgggccgc

SEQ ID NO: 683251 - DNA, 25 bp, Artificial sequence
  Synthetic oligonucleotide
ccccgcggtagcgtccacgggccgc

SEQ ID NO: 683252 - DNA, 25 bp, Artificial sequence
  Synthetic oligonucleotide
cgcggtgccgggtcgacgtggcgcc

SEQ ID NO: 683253 - DNA, 25 bp, Artificial sequence
  Synthetic oligonucleotide
cgcggtgccgggacgacgtggcgcc

SEQ ID NO: 683254 - DNA, 25 bp, Artificial sequence
  Synthetic oligonucleotide
tccgccgggcggtcgtacggcggcc

SEQ ID NO: 683255 - DNA, 25 bp, Artificial sequence
  Synthetic oligonucleotide
gccggcgccctcccgtcgactgccc

SEQ ID NO: 683256 - DNA, 25 bp, Artificial sequence
  Synthetic oligonucleotide
gtggccccgttccgccgagcccggc

SEQ ID NO: 683257 - DNA, 25 bp, Artificial sequence
  Synthetic oligonucleotide
gtggccccgttcggccgagcccggc

SEQ ID NO: 683258 - DNA, 25 bp, Artificial sequence
  Synthetic oligonucleotide
gggcagcgcgtacgtccgcggcgcc

SEQ ID NO: 683259 - DNA, 25 bp, Artificial sequence
  Synthetic oligonucleotide
gggcagcgcgtaggtccgcggcgcc

SEQ ID NO: 683260 - DNA, 25 bp, Artificial sequence
  Synthetic oligonucleotide
gccggctgccgcaacgcggccggga

SEQ ID NO: 683261 - DNA, 25 bp, Artificial sequence
  Synthetic oligonucleotide
gccggctgccgctacgcggccggga

SEQ ID NO: 683262 - DNA, 25 bp, Artificial sequence
  Synthetic oligonucleotide
cggccctatgcgggccgcggccacg

SEQ ID NO: 683263 - DNA, 25 bp, Artificial sequence
  Synthetic oligonucleotide
caggggcacgggcgctacgccgccc

SEQ ID NO: 683264 - DNA, 25 bp, Artificial sequence
  Synthetic oligonucleotide
gggccctcggacgcccgtccggtgc

SEQ ID NO: 683265 - DNA, 25 bp, Artificial sequence
  Synthetic oligonucleotide
caggggcacgggggctacgccgccc

SEQ ID NO: 683266 - DNA, 25 bp, Artificial sequence
  Synthetic oligonucleotide
cgcgtgcggcgtcggatcggcggcg

SEQ ID NO: 683267 - DNA, 25 bp, Artificial sequence
  Synthetic oligonucleotide
cgcgtgcggcgtgggatcggcggcg

SEQ ID NO: 683268 - DNA, 25 bp, Artificial sequence
  Synthetic oligonucleotide
ggggcgcgtgcgccgtacgtgggcc

SEQ ID NO: 683269 - DNA, 25 bp, Artificial sequence
  Synthetic oligonucleotide
ggccccaggccgaacgccgcccgct

SEQ ID NO: 683270 - DNA, 25 bp, Artificial sequence
  Synthetic oligonucleotide
cgggcgatcgtccggcgggcctccg

SEQ ID NO: 683271 - DNA, 25 bp, Artificial sequence
  Synthetic oligonucleotide
gccggcgccctcgcgtcgactgccc

SEQ ID NO: 683272 - DNA, 25 bp, Artificial sequence
  Synthetic oligonucleotide
cggggcgccgcggctcgtaggccac

SEQ ID NO: 683273 - DNA, 25 bp, Artificial sequence
  Synthetic oligonucleotide
cggggcgccgcgcctcgtaggccac

SEQ ID NO: 683274 - DNA, 25 bp, Artificial sequence
  Synthetic oligonucleotide
gtggcgcggtccgggcgtacgcccc

SEQ ID NO: 683275 - DNA, 25 bp, Artificial sequence
  Synthetic oligonucleotide
gtggcgcggtcccggcgtacgcccc

SEQ ID NO: 683276 - DNA, 25 bp, Artificial sequence
  Synthetic oligonucleotide
ccgagctcgcgctaggccccccgcg

SEQ ID NO: 683277 - DNA, 25 bp, Artificial sequence
  Synthetic oligonucleotide
ccgagctcgcgcaaggccccccgcg

SEQ ID NO: 683278 - DNA, 25 bp, Artificial sequence
  Synthetic oligonucleotide
cgggcgggtcgtggcgaacggcggc

SEQ ID NO: 683279 - DNA, 25 bp, Artificial sequence
  Synthetic oligonucleotide
cgggcgggtcgtcgcgaacggcggc

SEQ ID NO: 683280 - DNA, 25 bp, Artificial sequence
  Synthetic oligonucleotide
cgcacggtcatccgcgcggcccccg

SEQ ID NO: 683281 - DNA, 25 bp, Artificial sequence
  Synthetic oligonucleotide
cgcacggtcatcggcgcggcccccg

SEQ ID NO: 683282 - DNA, 25 bp, Artificial sequence
  Synthetic oligonucleotide
ccgcgggttcgtcgcgcggcgtccg

SEQ ID NO: 683283 - DNA, 25 bp, Artificial sequence
  Synthetic oligonucleotide
ggccccaggccgtacgccgcccgct

SEQ ID NO: 683284 - DNA, 25 bp, Artificial sequence
  Synthetic oligonucleotide
cccgcctcgttgggcgtcgccgggg

SEQ ID NO: 683285 - DNA, 25 bp, Artificial sequence
  Synthetic oligonucleotide
cgcccccgcgtagcgagggcaggcg

SEQ ID NO: 683286 - DNA, 25 bp, Artificial sequence
  Synthetic oligonucleotide
ctggggcggtcccctagcggcccgg

SEQ ID NO: 683287 - DNA, 25 bp, Artificial sequence
  Synthetic oligonucleotide
ctccccggtcccccgtacggcgcgc

SEQ ID NO: 683288 - DNA, 25 bp, Artificial sequence
  Synthetic oligonucleotide
ctccccggtcccgcgtacggcgcgc

SEQ ID NO: 683289 - DNA, 25 bp, Artificial sequence
  Synthetic oligonucleotide
ggtgcgtacgccgccccggcgccac

SEQ ID NO: 683290 - DNA, 25 bp, Artificial sequence
  Synthetic oligonucleotide
ggtgcgtacgcccccccggcgccac

SEQ ID NO: 683291 - DNA, 25 bp, Artificial sequence
  Synthetic oligonucleotide
ggcccgtcgtcgcgcacccggcgag

SEQ ID NO: 683292 - DNA, 25 bp, Artificial sequence
  Synthetic oligonucleotide
ggcccgtcgtcgggcacccggcgag

SEQ ID NO: 683293 - DNA, 25 bp, Artificial sequence
  Synthetic oligonucleotide
cgcccgtgcgcgcatcgagggccgc

SEQ ID NO: 683294 - DNA, 25 bp, Artificial sequence
  Synthetic oligonucleotide
cgcccgtgcgcggatcgagggccgc

SEQ ID NO: 683295 - DNA, 25 bp, Artificial sequence
  Synthetic oligonucleotide
ccgccctcgcggcgctgtacgcggg

SEQ ID NO: 683296 - DNA, 25 bp, Artificial sequence
  Synthetic oligonucleotide
ccgccctcgcggggctgtacgcggg

SEQ ID NO: 683297 - DNA, 25 bp, Artificial sequence
  Synthetic oligonucleotide
tggcggtagccgcgcccgagcccgc

SEQ ID NO: 683298 - DNA, 25 bp, Artificial sequence
  Synthetic oligonucleotide
ggcgctcgtacgtccgcccggccgg

SEQ ID NO: 683299 - DNA, 25 bp, Artificial sequence
  Synthetic oligonucleotide
tggcggtagccgggcccgagcccgc

SEQ ID NO: 683300 - DNA, 25 bp, Artificial sequence
  Synthetic oligonucleotide
cccgcctcgttgcgcgtcgccgggg

SEQ ID NO: 683301 - DNA, 25 bp, Artificial sequence
  Synthetic oligonucleotide
gagggcaccgtcgcgcctcgggcgg

SEQ ID NO: 683302 - DNA, 25 bp, Artificial sequence
  Synthetic oligonucleotide
gagggcaccgtcccgcctcgggcgg

SEQ ID NO: 683303 - DNA, 25 bp, Artificial sequence
  Synthetic oligonucleotide
ccggcgccgtaggtcgcgacccgcc

SEQ ID NO: 683304 - DNA, 25 bp, Artificial sequence
  Synthetic oligonucleotide
ccggcgccgtagctcgcgacccgcc

SEQ ID NO: 683305 - DNA, 25 bp, Artificial sequence
  Synthetic oligonucleotide
ggcgggcccgtacgctcggcggcga

SEQ ID NO: 683306 - DNA, 25 bp, Artificial sequence
  Synthetic oligonucleotide
ggcgggcccgtaggctcggcggcga

SEQ ID NO: 683307 - DNA, 25 bp, Artificial sequence
  Synthetic oligonucleotide
cgcggcggttacgcggccgccgcca

SEQ ID NO: 683308 - DNA, 25 bp, Artificial sequence
  Synthetic oligonucleotide
cgcggcggttacccggccgccgcca

SEQ ID NO: 683309 - DNA, 25 bp, Artificial sequence
  Synthetic oligonucleotide
ggccaccgcggtgcgacgcccccca

SEQ ID NO: 683310 - DNA, 25 bp, Artificial sequence
  Synthetic oligonucleotide
ggccaccgcggtccgacgcccccca

SEQ ID NO: 683311 - DNA, 25 bp, Artificial sequence
  Synthetic oligonucleotide
cgggcgatcgtcgggcgggcctccg

SEQ ID NO: 683312 - DNA, 25 bp, Artificial sequence
  Synthetic oligonucleotide
ggggcgcgtgcggcgtacgtgggcc

SEQ ID NO: 683313 - DNA, 25 bp, Artificial sequence
  Synthetic oligonucleotide
ggcgctcgtacgaccgcccggccgg

SEQ ID NO: 683314 - DNA, 25 bp, Artificial sequence
  Synthetic oligonucleotide
ggcgcgcccgaccgcgcaaccgcac

SEQ ID NO: 683315 - DNA, 25 bp, Artificial sequence
  Synthetic oligonucleotide
gggcgcggtagtggcgcggaccggc

SEQ ID NO: 683316 - DNA, 25 bp, Artificial sequence
  Synthetic oligonucleotide
agcccctccgcacgacgcgggggcg

SEQ ID NO: 683317 - DNA, 25 bp, Artificial sequence
  Synthetic oligonucleotide
agcccctccgcaggacgcgggggcg

SEQ ID NO: 683318 - DNA, 25 bp, Artificial sequence
  Synthetic oligonucleotide
ggcgggtaggcccgcgcgtgcgcga

SEQ ID NO: 683319 - DNA, 25 bp, Artificial sequence
  Synthetic oligonucleotide
ggcgggtaggccggcgcgtgcgcga

SEQ ID NO: 683320 - DNA, 25 bp, Artificial sequence
  Synthetic oligonucleotide
cgagcggaccgtcggctcgcccggc

SEQ ID NO: 683321 - DNA, 25 bp, Artificial sequence
  Synthetic oligonucleotide
cgagcggaccgtgggctcgcccggc

SEQ ID NO: 683322 - DNA, 25 bp, Artificial sequence
  Synthetic oligonucleotide
acccgcgcgcgcgatacggggggcc

SEQ ID NO: 683323 - DNA, 25 bp, Artificial sequence
  Synthetic oligonucleotide
acccgcgcgcgccatacggggggcc

SEQ ID NO: 683324 - DNA, 25 bp, Artificial sequence
  Synthetic oligonucleotide
ccccccatgcgtacgggcgcgggcc

SEQ ID NO: 683325 - DNA, 25 bp, Artificial sequence
  Synthetic oligonucleotide
ccccccatgcgttcgggcgcgggcc

SEQ ID NO: 683326 - DNA, 25 bp, Artificial sequence
  Synthetic oligonucleotide
cgccccgccgcggcgtatctccggc

SEQ ID NO: 683327 - DNA, 25 bp, Artificial sequence
  Synthetic oligonucleotide
ggcccggtcgcgcgatcgggcgagg

SEQ ID NO: 683328 - DNA, 25 bp, Artificial sequence
  Synthetic oligonucleotide
ggcgcgcccgacggcgcaaccgcac

SEQ ID NO: 683329 - DNA, 25 bp, Artificial sequence
  Synthetic oligonucleotide
gcccgccgaccggactacgcgcccc

SEQ ID NO: 683330 - DNA, 25 bp, Artificial sequence
  Synthetic oligonucleotide
gggcgcctgccgtaacgcgcgcccc

SEQ ID NO: 683331 - DNA, 25 bp, Artificial sequence
  Synthetic oligonucleotide
gggcgcctgccgaaacgcgcgcccc

SEQ ID NO: 683332 - DNA, 25 bp, Artificial sequence
  Synthetic oligonucleotide
ggccgccgacgcaccggggcgatgg

SEQ ID NO: 683333 - DNA, 25 bp, Artificial sequence
  Synthetic oligonucleotide
ggccgccgacgctccggggcgatgg

SEQ ID NO: 683334 - DNA, 25 bp, Artificial sequence
  Synthetic oligonucleotide
ggggcggttcggtccgcggcgagcg

SEQ ID NO: 683335 - DNA, 25 bp, Artificial sequence
  Synthetic oligonucleotide
ggggcggttcggaccgcggcgagcg

SEQ ID NO: 683336 - DNA, 25 bp, Artificial sequence
  Synthetic oligonucleotide
gaggcccggctaggcgcgtggcggc

SEQ ID NO: 683337 - DNA, 25 bp, Artificial sequence
  Synthetic oligonucleotide
gaggcccggctacgcgcgtggcggc

SEQ ID NO: 683338 - DNA, 25 bp, Artificial sequence
  Synthetic oligonucleotide
tgcgcgtacgcgccgaccgcgcccg

SEQ ID NO: 683339 - DNA, 25 bp, Artificial sequence
  Synthetic oligonucleotide
tgcgcgtacgcggcgaccgcgcccg

SEQ ID NO: 683340 - DNA, 25 bp, Artificial sequence
  Synthetic oligonucleotide
ccccgcggcgtagcccgatgcggcg

SEQ ID NO: 683341 - DNA, 25 bp, Artificial sequence
  Synthetic oligonucleotide
ccccgcggcgtaccccgatgcggcg

SEQ ID NO: 683342 - DNA, 25 bp, Artificial sequence
  Synthetic oligonucleotide
cgccccgccgcgccgtatctccggc

SEQ ID NO: 683343 - DNA, 25 bp, Artificial sequence
  Synthetic oligonucleotide
gggctctgtcggaccgcgggccgcg

SEQ ID NO: 683344 - DNA, 25 bp, Artificial sequence
  Synthetic oligonucleotide
cggccctatgcgcgccgcggccacg

SEQ ID NO: 683345 - DNA, 25 bp, Artificial sequence
  Synthetic oligonucleotide
gacgcgctcccggtacgcgcgcccg

SEQ ID NO: 683346 - DNA, 25 bp, Artificial sequence
  Synthetic oligonucleotide
gacgcgctcccgctacgcgcgcccg

SEQ ID NO: 683347 - DNA, 25 bp, Artificial sequence
  Synthetic oligonucleotide
cgcggctcgccggtaggcgccgtgc

SEQ ID NO: 683348 - DNA, 25 bp, Artificial sequence
  Synthetic oligonucleotide
cgcggctcgccgctaggcgccgtgc

SEQ ID NO: 683349 - DNA, 25 bp, Artificial sequence
  Synthetic oligonucleotide
ggccgaaccggtcgacgcgggccgc

SEQ ID NO: 683350 - DNA, 25 bp, Artificial sequence
  Synthetic oligonucleotide
ggccgaaccggtggacgcgggccgc

SEQ ID NO: 683351 - DNA, 25 bp, Artificial sequence
  Synthetic oligonucleotide
cgcggggcgaccactcgcgggcgct

SEQ ID NO: 683352 - DNA, 25 bp, Artificial sequence
  Synthetic oligonucleotide
cgcggggcgacctctcgcgggcgct

SEQ ID NO: 683353 - DNA, 25 bp, Artificial sequence
  Synthetic oligonucleotide
gcgcagcgcacgatcgcggcgcggg

SEQ ID NO: 683354 - DNA, 25 bp, Artificial sequence
  Synthetic oligonucleotide
gcgcagcgcacgttcgcggcgcggg

SEQ ID NO: 683355 - DNA, 25 bp, Artificial sequence
  Synthetic oligonucleotide
gcgcgataccccccgcgaccccccg

SEQ ID NO: 683356 - DNA, 25 bp, Artificial sequence
  Synthetic oligonucleotide
gggcgcggtagtcgcgcggaccggc

SEQ ID NO: 683357 - DNA, 25 bp, Artificial sequence
  Synthetic oligonucleotide
gggctctgtcggtccgcgggccgcg

SEQ ID NO: 683358 - DNA, 25 bp, Artificial sequence
  Synthetic oligonucleotide
gcccgccgaccgcactacgcgcccc

SEQ ID NO: 683359 - DNA, 25 bp, Artificial sequence
  Synthetic oligonucleotide
cgggtcggtcgtacgcgcggcccgc

SEQ ID NO: 683360 - DNA, 25 bp, Artificial sequence
  Synthetic oligonucleotide
cgggtcggtcgttcgcgcggcccgc

SEQ ID NO: 683361 - DNA, 25 bp, Artificial sequence
  Synthetic oligonucleotide
gccgcaccgcgcgtcgcaagccggc

SEQ ID NO: 683362 - DNA, 25 bp, Artificial sequence
  Synthetic oligonucleotide
gccgcaccgcgcctcgcaagccggc

SEQ ID NO: 683363 - DNA, 25 bp, Artificial sequence
  Synthetic oligonucleotide
gcggggcgtatccggaccgcccgcg

SEQ ID NO: 683364 - DNA, 25 bp, Artificial sequence
  Synthetic oligonucleotide
gcggggcgtatcgggaccgcccgcg

SEQ ID NO: 683365 - DNA, 25 bp, Artificial sequence
  Synthetic oligonucleotide
gcgggctcgcgaccgcgcacgctgc

SEQ ID NO: 683366 - DNA, 25 bp, Artificial sequence
  Synthetic oligonucleotide
gcgggctcgcgagcgcgcacgctgc

SEQ ID NO: 683367 - DNA, 25 bp, Artificial sequence
  Synthetic oligonucleotide
ccgggcacaacccgtccgccgcgcg

SEQ ID NO: 683368 - DNA, 25 bp, Artificial sequence
  Synthetic oligonucleotide
ccgcgcggttcgcccgcgtcggagc

SEQ ID NO: 683369 - DNA, 25 bp, Artificial sequence
  Synthetic oligonucleotide
cggcctctcgacccgggggtgcccc

SEQ ID NO: 683370 - DNA, 25 bp, Artificial sequence
  Synthetic oligonucleotide
gcggcggcggccgttgcgtggccca

SEQ ID NO: 683371 - DNA, 25 bp, Artificial sequence
  Synthetic oligonucleotide
gcggcggcggcccttgcgtggccca

SEQ ID NO: 683372 - DNA, 25 bp, Artificial sequence
  Synthetic oligonucleotide
gcgcgataccccgcgcgaccccccg

SEQ ID NO: 683373 - DNA, 25 bp, Artificial sequence
  Synthetic oligonucleotide
gcgcccccgtgtagcgcaccccccc

SEQ ID NO: 683374 - DNA, 25 bp, Artificial sequence
  Synthetic oligonucleotide
gggccgcatcggctcgccgaggccc

SEQ ID NO: 683375 - DNA, 25 bp, Artificial sequence
  Synthetic oligonucleotide
gcgtgcgtacgtgcgcggccccgcc

SEQ ID NO: 683376 - DNA, 25 bp, Artificial sequence
  Synthetic oligonucleotide
gcgtgcgtacgtccgcggccccgcc

SEQ ID NO: 683377 - DNA, 25 bp, Artificial sequence
  Synthetic oligonucleotide
ggcagcgtcgacccgcggtcggggg

SEQ ID NO: 683378 - DNA, 25 bp, Artificial sequence
  Synthetic oligonucleotide
ggcagcgtcgacgcgcggtcggggg

SEQ ID NO: 683379 - DNA, 25 bp, Artificial sequence
  Synthetic oligonucleotide
ccgcgcatcggccgcgagccgcgtc

SEQ ID NO: 683380 - DNA, 25 bp, Artificial sequence
  Synthetic oligonucleotide
ccgcgcatcggcggcgagccgcgtc

SEQ ID NO: 683381 - DNA, 25 bp, Artificial sequence
  Synthetic oligonucleotide
ccggccgtcggtcggcacgccggtc

SEQ ID NO: 683382 - DNA, 25 bp, Artificial sequence
  Synthetic oligonucleotide
ccggccgtcggtgggcacgccggtc

SEQ ID NO: 683383 - DNA, 25 bp, Artificial sequence
  Synthetic oligonucleotide
ccgggcggcgcgtagtcgcccctcc

SEQ ID NO: 683384 - DNA, 25 bp, Artificial sequence
  Synthetic oligonucleotide
ccgggcggcgcgaagtcgcccctcc

SEQ ID NO: 683385 - DNA, 25 bp, Artificial sequence
  Synthetic oligonucleotide
gccgtgtcgaacgggccgcggggcc

SEQ ID NO: 683386 - DNA, 25 bp, Artificial sequence
  Synthetic oligonucleotide
gggccgcatcgggtcgccgaggccc

SEQ ID NO: 683387 - DNA, 25 bp, Artificial sequence
  Synthetic oligonucleotide
cgggcccgtcctcgcaacgccgccc

SEQ ID NO: 683388 - DNA, 25 bp, Artificial sequence
  Synthetic oligonucleotide
cgggcccgtcctggcaacgccgccc

SEQ ID NO: 683389 - DNA, 25 bp, Artificial sequence
  Synthetic oligonucleotide
cgcgcgggtgcggcccgtaccgacc

SEQ ID NO: 683390 - DNA, 25 bp, Artificial sequence
  Synthetic oligonucleotide
cgcgcgggtgcgccccgtaccgacc

SEQ ID NO: 683391 - DNA, 25 bp, Artificial sequence
  Synthetic oligonucleotide
gccgcggtaccgtcgagcgccggcc

SEQ ID NO: 683392 - DNA, 25 bp, Artificial sequence
  Synthetic oligonucleotide
gccgcggtaccgacgagcgccggcc

SEQ ID NO: 683393 - DNA, 25 bp, Artificial sequence
  Synthetic oligonucleotide
gcgcgggcgcgtctcgagggctcgg

SEQ ID NO: 683394 - DNA, 25 bp, Artificial sequence
  Synthetic oligonucleotide
gcgcgggcgcgtgtcgagggctcgg

SEQ ID NO: 683395 - DNA, 25 bp, Artificial sequence
  Synthetic oligonucleotide
gggccggcgccgcgtacatggccgg

SEQ ID NO: 683396 - DNA, 25 bp, Artificial sequence
  Synthetic oligonucleotide
cggcctctcgacgcgggggtgcccc

SEQ ID NO: 683397 - DNA, 25 bp, Artificial sequence
  Synthetic oligonucleotide
ccccgccggacggccgtatcggcgc

SEQ ID NO: 683398 - DNA, 25 bp, Artificial sequence
  Synthetic oligonucleotide
ccgcgcggttcggccgcgtcggagc

SEQ ID NO: 683399 - DNA, 25 bp, Artificial sequence
  Synthetic oligonucleotide
gggccggcgccgggtacatggccgg

SEQ ID NO: 683400 - DNA, 25 bp, Artificial sequence
  Synthetic oligonucleotide
ccccgccggacgcccgtatcggcgc

SEQ ID NO: 683401 - DNA, 25 bp, Artificial sequence
  Synthetic oligonucleotide
gccgtgtcgaaccggccgcggggcc

SEQ ID NO: 683402 - DNA, 25 bp, Artificial sequence
  Synthetic oligonucleotide
cgcggccgcgtccgcacgagcgcac

SEQ ID NO: 683403 - DNA, 25 bp, Artificial sequence
  Synthetic oligonucleotide
ggccggcagactcgcgcgtgccggg

SEQ ID NO: 683404 - DNA, 25 bp, Artificial sequence
  Synthetic oligonucleotide
ggccggcagactggcgcgtgccggg

SEQ ID NO: 683405 - DNA, 25 bp, Artificial sequence
  Synthetic oligonucleotide
ccgcggcgggcgggacgtaccccac

SEQ ID NO: 683406 - DNA, 25 bp, Artificial sequence
  Synthetic oligonucleotide
ccgcggcgggcgcgacgtaccccac

SEQ ID NO: 683407 - DNA, 25 bp, Artificial sequence
  Synthetic oligonucleotide
ccccgctagcgccccgacggtccgc

SEQ ID NO: 683408 - DNA, 25 bp, Artificial sequence
  Synthetic oligonucleotide
ggcgccggtgcatcgcgcacggccg

SEQ ID NO: 683409 - DNA, 25 bp, Artificial sequence
  Synthetic oligonucleotide
cgcggccgcgtcggcacgagcgcac

SEQ ID NO: 683410 - DNA, 25 bp, Artificial sequence
  Synthetic oligonucleotide
gcggcgccgtcgaacgcggggggct

SEQ ID NO: 683411 - DNA, 25 bp, Artificial sequence
  Synthetic oligonucleotide
ggggaccgttcacgcggggccgcgc

SEQ ID NO: 683412 - DNA, 25 bp, Artificial sequence
  Synthetic oligonucleotide
gcggcgccgtcgtacgcggggggct

SEQ ID NO: 683413 - DNA, 25 bp, Artificial sequence
  Synthetic oligonucleotide
gcgcccccgtgttgcgcaccccccc

SEQ ID NO: 683414 - DNA, 25 bp, Artificial sequence
  Synthetic oligonucleotide
ggcggcgccccgaagtcgaccggcc

SEQ ID NO: 683415 - DNA, 25 bp, Artificial sequence
  Synthetic oligonucleotide
ggcggcgccccgtagtcgaccggcc

SEQ ID NO: 683416 - DNA, 25 bp, Artificial sequence
  Synthetic oligonucleotide
ggcccggtcgcgggatcgggcgagg

SEQ ID NO: 683417 - DNA, 25 bp, Artificial sequence
  Synthetic oligonucleotide
ccccgctagcgcgccgacggtccgc

SEQ ID NO: 683418 - DNA, 25 bp, Artificial sequence
  Synthetic oligonucleotide
ggccgccgtcgcccgtatgggcccc

SEQ ID NO: 683419 - DNA, 25 bp, Artificial sequence
  Synthetic oligonucleotide
ggggaccgttcaggcggggccgcgc

SEQ ID NO: 683420 - DNA, 25 bp, Artificial sequence
  Synthetic oligonucleotide
ggtcgccgtacgcgcgtcggcgcgc

SEQ ID NO: 683421 - DNA, 25 bp, Artificial sequence
  Synthetic oligonucleotide
ggtcgccgtacgggcgtcggcgcgc

SEQ ID NO: 683422 - DNA, 25 bp, Artificial sequence
  Synthetic oligonucleotide
ggccgccgtcgcgcgtatgggcccc

SEQ ID NO: 683423 - DNA, 25 bp, Artificial sequence
  Synthetic oligonucleotide
gccgcccggacgcgtagtggcccgg

SEQ ID NO: 683424 - DNA, 25 bp, Artificial sequence
  Synthetic oligonucleotide
cccccggcgccgctacggaggctgc

SEQ ID NO: 683425 - DNA, 25 bp, Artificial sequence
  Synthetic oligonucleotide
cccccggcgccggtacggaggctgc

SEQ ID NO: 683426 - DNA, 25 bp, Artificial sequence
  Synthetic oligonucleotide
ggccgctcggtaggggcgcaggccc

SEQ ID NO: 683427 - DNA, 25 bp, Artificial sequence
  Synthetic oligonucleotide
ggccgctcggtacgggcgcaggccc

SEQ ID NO: 683428 - DNA, 25 bp, Artificial sequence
  Synthetic oligonucleotide
ggcgccggtgcaacgcgcacggccg

SEQ ID NO: 683429 - DNA, 25 bp, Artificial sequence
  Synthetic oligonucleotide
gccgcccggacgggtagtggcccgg

SEQ ID NO: 683430 - DNA, 25 bp, Artificial sequence
  Synthetic oligonucleotide
ccggcgccggcaccgtgcgccgctc

SEQ ID NO: 683431 - DNA, 25 bp, Artificial sequence
  Synthetic oligonucleotide
ggcggcgcgccgtccgaccgcctcc

SEQ ID NO: 683432 - DNA, 25 bp, Artificial sequence
  Synthetic oligonucleotide
cccgtgcggccgagcccggggcgca

SEQ ID NO: 683433 - DNA, 25 bp, Artificial sequence
  Synthetic oligonucleotide
ggcggcgcgccgaccgaccgcctcc

SEQ ID NO: 683434 - DNA, 25 bp, Artificial sequence
  Synthetic oligonucleotide
cccgtgcggccgtgcccggggcgca

SEQ ID NO: 683435 - DNA, 25 bp, Artificial sequence
  Synthetic oligonucleotide
cggcaggcgccgcccaacccgccgg

SEQ ID NO: 683436 - DNA, 25 bp, Artificial sequence
  Synthetic oligonucleotide
ccggcgccggcagcgtgcgccgctc

SEQ ID NO: 683437 - DNA, 25 bp, Artificial sequence
  Synthetic oligonucleotide
ggcgccgagaggccccccgtggccg

SEQ ID NO: 683438 - DNA, 25 bp, Artificial sequence
  Synthetic oligonucleotide
cggcaggcgccggccaacccgccgg

SEQ ID NO: 683439 - DNA, 25 bp, Artificial sequence
  Synthetic oligonucleotide
ccgccggtcgcccgcggcgagtggc

SEQ ID NO: 683440 - DNA, 25 bp, Artificial sequence
  Synthetic oligonucleotide
cggtgcccggcggccgaccgggtgc

SEQ ID NO: 683441 - DNA, 25 bp, Artificial sequence
  Synthetic oligonucleotide
ccgccggtcgccggcggcgagtggc

SEQ ID NO: 683442 - DNA, 25 bp, Artificial sequence
  Synthetic oligonucleotide
aaggggtgccgccccgcggcgccgg

SEQ ID NO: 683443 - DNA, 25 bp, Artificial sequence
  Synthetic oligonucleotide
aaggggtgccgcgccgcggcgccgg

SEQ ID NO: 683444 - DNA, 25 bp, Artificial sequence
  Synthetic oligonucleotide
cggcggcgacgcagccgcggcccca

SEQ ID NO: 683445 - DNA, 25 bp, Artificial sequence
  Synthetic oligonucleotide
ggcgccgagagggcccccgtggccg

SEQ ID NO: 683446 - DNA, 25 bp, Artificial sequence
  Synthetic oligonucleotide
cccggcggctggccgccaccgcgag

SEQ ID NO: 683447 - DNA, 25 bp, Artificial sequence
  Synthetic oligonucleotide
cggcggcgacgctgccgcggcccca

SEQ ID NO: 683448 - DNA, 25 bp, Artificial sequence
  Synthetic oligonucleotide
tgcgccccgggcgggacggcctgcc

SEQ ID NO: 683449 - DNA, 25 bp, Artificial sequence
  Synthetic oligonucleotide
cgcgcggccgcgcacgccgtgggtg

SEQ ID NO: 683450 - DNA, 25 bp, Artificial sequence
  Synthetic oligonucleotide
cgcgcggccgcggacgccgtgggtg

SEQ ID NO: 683451 - DNA, 25 bp, Artificial sequence
  Synthetic oligonucleotide
cgccccgcctcgcagccgcgctgcg

SEQ ID NO: 683452 - DNA, 25 bp, Artificial sequence
  Synthetic oligonucleotide
cctgggccgcccgcgctaccggcgg

SEQ ID NO: 683453 - DNA, 25 bp, Artificial sequence
  Synthetic oligonucleotide
cccccggtgcgccagcggcgggtcc

SEQ ID NO: 683454 - DNA, 25 bp, Artificial sequence
  Synthetic oligonucleotide
cccggcggctgggcgccaccgcgag

SEQ ID NO: 683455 - DNA, 25 bp, Artificial sequence
  Synthetic oligonucleotide
gcggcgccggcgggtaccgaggggg

SEQ ID NO: 683456 - DNA, 25 bp, Artificial sequence
  Synthetic oligonucleotide
gggcgcggcaactggcgcgcgcggg

SEQ ID NO: 683457 - DNA, 25 bp, Artificial sequence
  Synthetic oligonucleotide
gggcgcggcaacaggcgcgcgcggg

SEQ ID NO: 683458 - DNA, 25 bp, Artificial sequence
  Synthetic oligonucleotide
ccggaggcggacggccgggcggctc

SEQ ID NO: 683459 - DNA, 25 bp, Artificial sequence
  Synthetic oligonucleotide
cggtgcccggcgcccgaccgggtgc

SEQ ID NO: 683460 - DNA, 25 bp, Artificial sequence
  Synthetic oligonucleotide
cgccccgcctcggagccgcgctgcg

SEQ ID NO: 683461 - DNA, 25 bp, Artificial sequence
  Synthetic oligonucleotide
cccccggtgcgcgagcggcgggtcc

SEQ ID NO: 683462 - DNA, 25 bp, Artificial sequence
  Synthetic oligonucleotide
gcggcgccggcgcgtaccgaggggg

SEQ ID NO: 683463 - DNA, 25 bp, Artificial sequence
  Synthetic oligonucleotide
tgcgccccgggccggacggcctgcc

SEQ ID NO: 683464 - DNA, 25 bp, Artificial sequence
  Synthetic oligonucleotide
cggaccgccccggtgccgggcaggc

SEQ ID NO: 683465 - DNA, 25 bp, Artificial sequence
  Synthetic oligonucleotide
cggaggccgcgcggcgcgtggccct

SEQ ID NO: 683466 - DNA, 25 bp, Artificial sequence
  Synthetic oligonucleotide
cggaggccgcgccgcgcgtggccct

SEQ ID NO: 683467 - DNA, 25 bp, Artificial sequence
  Synthetic oligonucleotide
gccacgccccgtcgccgagcggggg

SEQ ID NO: 683468 - DNA, 25 bp, Artificial sequence
  Synthetic oligonucleotide
gccacgccccgtggccgagcggggg

SEQ ID NO: 683469 - DNA, 25 bp, Artificial sequence
  Synthetic oligonucleotide
gcctggcgctacggcccccgcgggc

SEQ ID NO: 683470 - DNA, 25 bp, Artificial sequence
  Synthetic oligonucleotide
cgggcgcgacggccgtcggcctccc

SEQ ID NO: 683471 - DNA, 25 bp, Artificial sequence
  Synthetic oligonucleotide
gcctggcgctaccgcccccgcgggc

SEQ ID NO: 683472 - DNA, 25 bp, Artificial sequence
  Synthetic oligonucleotide
cggaccgccccgctgccgggcaggc

SEQ ID NO: 683473 - DNA, 25 bp, Artificial sequence
  Synthetic oligonucleotide
ggcctggcgccgctccgcgacgcgc

SEQ ID NO: 683474 - DNA, 25 bp, Artificial sequence
  Synthetic oligonucleotide
gcggccgcgatccgcccccagcgcg

SEQ ID NO: 683475 - DNA, 25 bp, Artificial sequence
  Synthetic oligonucleotide
gcggccgcgatcggcccccagcgcg

SEQ ID NO: 683476 - DNA, 25 bp, Artificial sequence
  Synthetic oligonucleotide
tggcctgccggcccgccgcgcccag

SEQ ID NO: 683477 - DNA, 25 bp, Artificial sequence
  Synthetic oligonucleotide
tggcctgccggcgcgccgcgcccag

SEQ ID NO: 683478 - DNA, 25 bp, Artificial sequence
  Synthetic oligonucleotide
gcgaggccggccgtacggcgcgcgg

SEQ ID NO: 683479 - DNA, 25 bp, Artificial sequence
  Synthetic oligonucleotide
gcctcggacgccaccggcgcggcgg

SEQ ID NO: 683480 - DNA, 25 bp, Artificial sequence
  Synthetic oligonucleotide
cctgggccgcccccgctaccggcgg

SEQ ID NO: 683481 - DNA, 25 bp, Artificial sequence
  Synthetic oligonucleotide
ccggaggcggaccgccgggcggctc

SEQ ID NO: 683482 - DNA, 25 bp, Artificial sequence
  Synthetic oligonucleotide
gcggggccgcgcgacggctcaggcc

SEQ ID NO: 683483 - DNA, 25 bp, Artificial sequence
  Synthetic oligonucleotide
ggacccgtcgcgccggcccgtgcgg

SEQ ID NO: 683484 - DNA, 25 bp, Artificial sequence
  Synthetic oligonucleotide
cgcccgcgcgtcgcgcctccggctg

SEQ ID NO: 683485 - DNA, 25 bp, Artificial sequence
  Synthetic oligonucleotide
cgcccgcgcgtcccgcctccggctg

SEQ ID NO: 683486 - DNA, 25 bp, Artificial sequence
  Synthetic oligonucleotide
tccacgacgcgcccgcccggccggg

SEQ ID NO: 683487 - DNA, 25 bp, Artificial sequence
  Synthetic oligonucleotide
tccacgacgcgcgcgcccggccggg

SEQ ID NO: 683488 - DNA, 25 bp, Artificial sequence
  Synthetic oligonucleotide
cccgtgccggcggcccccgtccgca

SEQ ID NO: 683489 - DNA, 25 bp, Artificial sequence
  Synthetic oligonucleotide
cccgtgccggcgccccccgtccgca

SEQ ID NO: 683490 - DNA, 25 bp, Artificial sequence
  Synthetic oligonucleotide
gtccaccgccgtgcggcgggccccc

SEQ ID NO: 683491 - DNA, 25 bp, Artificial sequence
  Synthetic oligonucleotide
ctgggggcggcccccgtccgcgagc

SEQ ID NO: 683492 - DNA, 25 bp, Artificial sequence
  Synthetic oligonucleotide
gtccaccgccgtccggcgggccccc

SEQ ID NO: 683493 - DNA, 25 bp, Artificial sequence
  Synthetic oligonucleotide
gcggggccgcgccacggctcaggcc

SEQ ID NO: 683494 - DNA, 25 bp, Artificial sequence
  Synthetic oligonucleotide
ggcgcgccgtcgcgcgccgctggct

SEQ ID NO: 683495 - DNA, 25 bp, Artificial sequence
  Synthetic oligonucleotide
ggcgcgccgtcgggcgccgctggct

SEQ ID NO: 683496 - DNA, 25 bp, Artificial sequence
  Synthetic oligonucleotide
cgcccccccgtcggcacgggctgcg

SEQ ID NO: 683497 - DNA, 25 bp, Artificial sequence
  Synthetic oligonucleotide
cgcccccccgtccgcacgggctgcg

SEQ ID NO: 683498 - DNA, 25 bp, Artificial sequence
  Synthetic oligonucleotide
ggcctggcgccggtccgcgacgcgc

SEQ ID NO: 683499 - DNA, 25 bp, Artificial sequence
  Synthetic oligonucleotide
ggacccgtcgcggcggcccgtgcgg

SEQ ID NO: 683500 - DNA, 25 bp, Artificial sequence
  Synthetic oligonucleotide
ctgggggcggccgccgtccgcgagc

SEQ ID NO: 683501 - DNA, 25 bp, Artificial sequence
  Synthetic oligonucleotide
ccccacactcccgcggcggccgggc

SEQ ID NO: 683502 - DNA, 25 bp, Artificial sequence
  Synthetic oligonucleotide
cgcccgctggaccagcggcgcgccg

SEQ ID NO: 683503 - DNA, 25 bp, Artificial sequence
  Synthetic oligonucleotide
cgcgctacgcggggcccccccacgc

SEQ ID NO: 683504 - DNA, 25 bp, Artificial sequence
  Synthetic oligonucleotide
cgtcggcgcgccgaggcgacccccg

SEQ ID NO: 683505 - DNA, 25 bp, Artificial sequence
  Synthetic oligonucleotide
cgtcggcgcgcccaggcgacccccg

SEQ ID NO: 683506 - DNA, 25 bp, Artificial sequence
  Synthetic oligonucleotide
ccacagccccccgacgcgcggcgcc

SEQ ID NO: 683507 - DNA, 25 bp, Artificial sequence
  Synthetic oligonucleotide
ccgccgcccgccggcggtgtctgcc

SEQ ID NO: 683508 - DNA, 25 bp, Artificial sequence
  Synthetic oligonucleotide
ccccacactcccccggcggccgggc

SEQ ID NO: 683509 - DNA, 25 bp, Artificial sequence
  Synthetic oligonucleotide
ccgccgcccgcccgcggtgtctgcc

SEQ ID NO: 683510 - DNA, 25 bp, Artificial sequence
  Synthetic oligonucleotide
ggggccgccggcgcgcggcagtgtg

SEQ ID NO: 683511 - DNA, 25 bp, Artificial sequence
  Synthetic oligonucleotide
ggggccgccggcccgcggcagtgtg

SEQ ID NO: 683512 - DNA, 25 bp, Artificial sequence
  Synthetic oligonucleotide
acggcgggggctggcagccgcgccg

SEQ ID NO: 683513 - DNA, 25 bp, Artificial sequence
  Synthetic oligonucleotide
acggcgggggctcgcagccgcgccg

SEQ ID NO: 683514 - DNA, 25 bp, Artificial sequence
  Synthetic oligonucleotide
gcgcgaccgccgcgccggcagccac

SEQ ID NO: 683515 - DNA, 25 bp, Artificial sequence
  Synthetic oligonucleotide
ccacagcccccccacgcgcggcgcc

SEQ ID NO: 683516 - DNA, 25 bp, Artificial sequence
  Synthetic oligonucleotide
gcctcggacgcctccggcgcggcgg

SEQ ID NO: 683517 - DNA, 25 bp, Artificial sequence
  Synthetic oligonucleotide
cgcctgcgtcccccccctgggcgcg

SEQ ID NO: 683518 - DNA, 25 bp, Artificial sequence
  Synthetic oligonucleotide
cgccgtcggccgcccgcacgctcgg

SEQ ID NO: 683519 - DNA, 25 bp, Artificial sequence
  Synthetic oligonucleotide
cgccgtcggccggccgcacgctcgg

SEQ ID NO: 683520 - DNA, 25 bp, Artificial sequence
  Synthetic oligonucleotide
ccggccggactgcgccgccgcggga

SEQ ID NO: 683521 - DNA, 25 bp, Artificial sequence
  Synthetic oligonucleotide
ccggccggactgggccgccgcggga

SEQ ID NO: 683522 - DNA, 25 bp, Artificial sequence
  Synthetic oligonucleotide
ccgcgatggcgcggcccctcgggcg

SEQ ID NO: 683523 - DNA, 25 bp, Artificial sequence
  Synthetic oligonucleotide
cgcgctacgcggcgcccccccacgc

SEQ ID NO: 683524 - DNA, 25 bp, Artificial sequence
  Synthetic oligonucleotide
cgcctgcgtcccgcccctgggcgcg

SEQ ID NO: 683525 - DNA, 25 bp, Artificial sequence
  Synthetic oligonucleotide
cgcccgctggacgagcggcgcgccg

SEQ ID NO: 683526 - DNA, 25 bp, Artificial sequence
  Synthetic oligonucleotide
tgcggaggggccgcgcaccggcgcg

SEQ ID NO: 683527 - DNA, 25 bp, Artificial sequence
  Synthetic oligonucleotide
tgcggaggggccccgcaccggcgcg

SEQ ID NO: 683528 - DNA, 25 bp, Artificial sequence
  Synthetic oligonucleotide
ccccggctcgagggggccggtcgcc

SEQ ID NO: 683529 - DNA, 25 bp, Artificial sequence
  Synthetic oligonucleotide
ccccggctcgagcgggccggtcgcc

SEQ ID NO: 683530 - DNA, 25 bp, Artificial sequence
  Synthetic oligonucleotide
gccggtgggcgggccacgcgcctcg

SEQ ID NO: 683531 - DNA, 25 bp, Artificial sequence
  Synthetic oligonucleotide
gccggtgggcggcccacgcgcctcg

SEQ ID NO: 683532 - DNA, 25 bp, Artificial sequence
  Synthetic oligonucleotide
ccgcgatggcgccgcccctcgggcg

SEQ ID NO: 683533 - DNA, 25 bp, Artificial sequence
  Synthetic oligonucleotide
accccgcgcgtcgggcgcagggcgg

SEQ ID NO: 683534 - DNA, 25 bp, Artificial sequence
  Synthetic oligonucleotide
gcgcgaccgccgggccggcagccac

SEQ ID NO: 683535 - DNA, 25 bp, Artificial sequence
  Synthetic oligonucleotide
tccggcgcgtcgcaccgcggcgccg

SEQ ID NO: 683536 - DNA, 25 bp, Artificial sequence
  Synthetic oligonucleotide
ccggcggcgacgcgcccgtgcgagc

SEQ ID NO: 683537 - DNA, 25 bp, Artificial sequence
  Synthetic oligonucleotide
ccggcggcgacgggcccgtgcgagc

SEQ ID NO: 683538 - DNA, 25 bp, Artificial sequence
  Synthetic oligonucleotide
cgccgcgcccgttcgggcgagccgg

SEQ ID NO: 683539 - DNA, 25 bp, Artificial sequence
  Synthetic oligonucleotide
cagggggggcgtacccgcgcgcgcg

SEQ ID NO: 683540 - DNA, 25 bp, Artificial sequence
  Synthetic oligonucleotide
accccgcgcgtccggcgcagggcgg

SEQ ID NO: 683541 - DNA, 25 bp, Artificial sequence
  Synthetic oligonucleotide
cagggggggcgttcccgcgcgcgcg

SEQ ID NO: 683542 - DNA, 25 bp, Artificial sequence
  Synthetic oligonucleotide
cgcgcccgcgtaggcgcggcccctc

SEQ ID NO: 683543 - DNA, 25 bp, Artificial sequence
  Synthetic oligonucleotide
cgcgcccgcgtacgcgcggcccctc

SEQ ID NO: 683544 - DNA, 25 bp, Artificial sequence
  Synthetic oligonucleotide
cccgcgcgcgcggcgtacggcctcc

SEQ ID NO: 683545 - DNA, 25 bp, Artificial sequence
  Synthetic oligonucleotide
cccgcgcgcgcgccgtacggcctcc

SEQ ID NO: 683546 - DNA, 25 bp, Artificial sequence
  Synthetic oligonucleotide
cgggcgcgacgggcgtcggcctccc

SEQ ID NO: 683547 - DNA, 25 bp, Artificial sequence
  Synthetic oligonucleotide
cgccccggcggtccgctaggcggcg

SEQ ID NO: 683548 - DNA, 25 bp, Artificial sequence
  Synthetic oligonucleotide
cgccgcgcccgtacgggcgagccgg

SEQ ID NO: 683549 - DNA, 25 bp, Artificial sequence
  Synthetic oligonucleotide
ccccccgtgcgacgacgcccggcgc

SEQ ID NO: 683550 - DNA, 25 bp, Artificial sequence
  Synthetic oligonucleotide
gcgggagcccccgcgcgcgtcccgt

SEQ ID NO: 683551 - DNA, 25 bp, Artificial sequence
  Synthetic oligonucleotide
gcgggagcccccccgcgcgtcccgt

SEQ ID NO: 683552 - DNA, 25 bp, Artificial sequence
  Synthetic oligonucleotide
cccgcacccggcggtcgcaccccgc

SEQ ID NO: 683553 - DNA, 25 bp, Artificial sequence
  Synthetic oligonucleotide
cccgcacccggccgtcgcaccccgc

SEQ ID NO: 683554 - DNA, 25 bp, Artificial sequence
  Synthetic oligonucleotide
gcgggctgtccggcggtgggccccc

SEQ ID NO: 683555 - DNA, 25 bp, Artificial sequence
  Synthetic oligonucleotide
tccggcgcgtcggaccgcggcgccg

SEQ ID NO: 683556 - DNA, 25 bp, Artificial sequence
  Synthetic oligonucleotide
ccccccgtgcgaggacgcccggcgc

SEQ ID NO: 683557 - DNA, 25 bp, Artificial sequence
  Synthetic oligonucleotide
ggccagccggtgggggacccgccgg

SEQ ID NO: 683558 - DNA, 25 bp, Artificial sequence
  Synthetic oligonucleotide
ccggggcccactcgcggcgcgcgac

SEQ ID NO: 683559 - DNA, 25 bp, Artificial sequence
  Synthetic oligonucleotide
ccggggcccactggcggcgcgcgac

SEQ ID NO: 683560 - DNA, 25 bp, Artificial sequence
  Synthetic oligonucleotide
gccggctacgggggggccgcgcacc

SEQ ID NO: 683561 - DNA, 25 bp, Artificial sequence
  Synthetic oligonucleotide
gccggctacgggcgggccgcgcacc

SEQ ID NO: 683562 - DNA, 25 bp, Artificial sequence
  Synthetic oligonucleotide
cgggccgtcgcgggacgcgccaggg

SEQ ID NO: 683563 - DNA, 25 bp, Artificial sequence
  Synthetic oligonucleotide
cgggccgtcgcgcgacgcgccaggg

SEQ ID NO: 683564 - DNA, 25 bp, Artificial sequence
  Synthetic oligonucleotide
gcgggctgtccgccggtgggccccc

SEQ ID NO: 683565 - DNA, 25 bp, Artificial sequence
  Synthetic oligonucleotide
cgcggccgtcgcagtgcgcgggggc

SEQ ID NO: 683566 - DNA, 25 bp, Artificial sequence
  Synthetic oligonucleotide
gcccccggtcgctgccagcgggcgg

SEQ ID NO: 683567 - DNA, 25 bp, Artificial sequence
  Synthetic oligonucleotide
ccgctctcggcagggcgccgccggg

SEQ ID NO: 683568 - DNA, 25 bp, Artificial sequence
  Synthetic oligonucleotide
ccgctctcggcacggcgccgccggg

SEQ ID NO: 683569 - DNA, 25 bp, Artificial sequence
  Synthetic oligonucleotide
cggccccggacgggcgacgcgaccc

SEQ ID NO: 683570 - DNA, 25 bp, Artificial sequence
  Synthetic oligonucleotide
cggccccggacgcgcgacgcgaccc

SEQ ID NO: 683571 - DNA, 25 bp, Artificial sequence
  Synthetic oligonucleotide
cgcagcgcgcgcgccggtagccggc

SEQ ID NO: 683572 - DNA, 25 bp, Artificial sequence
  Synthetic oligonucleotide
ccggaggcggtggcgtggcggccgg

SEQ ID NO: 683573 - DNA, 25 bp, Artificial sequence
  Synthetic oligonucleotide
gccctggcgccgcctcgacccgccg

SEQ ID NO: 683574 - DNA, 25 bp, Artificial sequence
  Synthetic oligonucleotide
cgcggccgtcgctgtgcgcgggggc

SEQ ID NO: 683575 - DNA, 25 bp, Artificial sequence
  Synthetic oligonucleotide
ggcgcggaccggaccccccacgcgc

SEQ ID NO: 683576 - DNA, 25 bp, Artificial sequence
  Synthetic oligonucleotide
ggcgcggaccggtccccccacgcgc

SEQ ID NO: 683577 - DNA, 25 bp, Artificial sequence
  Synthetic oligonucleotide
ggtgcgctaccgccccgcgccgccc

SEQ ID NO: 683578 - DNA, 25 bp, Artificial sequence
  Synthetic oligonucleotide
ggtgcgctaccggcccgcgccgccc

SEQ ID NO: 683579 - DNA, 25 bp, Artificial sequence
  Synthetic oligonucleotide
cgtgcggcggccctcggcccgctcg

SEQ ID NO: 683580 - DNA, 25 bp, Artificial sequence
  Synthetic oligonucleotide
ccggaggcggtgccgtggcggccgg

SEQ ID NO: 683581 - DNA, 25 bp, Artificial sequence
  Synthetic oligonucleotide
cgctcgggcccgccggtcgccagcg

SEQ ID NO: 683582 - DNA, 25 bp, Artificial sequence
  Synthetic oligonucleotide
ccctggtgccggctcgccgccccgg

SEQ ID NO: 683583 - DNA, 25 bp, Artificial sequence
  Synthetic oligonucleotide
cggcccgcgccgagtcgtccccggc

SEQ ID NO: 683584 - DNA, 25 bp, Artificial sequence
  Synthetic oligonucleotide
cggcccgcgccgtgtcgtccccggc

SEQ ID NO: 683585 - DNA, 25 bp, Artificial sequence
  Synthetic oligonucleotide
gtgccgcgcccgcgggggcagctcc

SEQ ID NO: 683586 - DNA, 25 bp, Artificial sequence
  Synthetic oligonucleotide
gtgccgcgcccgggggggcagctcc

SEQ ID NO: 683587 - DNA, 25 bp, Artificial sequence
  Synthetic oligonucleotide
cgcagcgcgcgccccggtagccggc

SEQ ID NO: 683588 - DNA, 25 bp, Artificial sequence
  Synthetic oligonucleotide
gccggccgacgacgcgcggcctgcc

SEQ ID NO: 683589 - DNA, 25 bp, Artificial sequence
  Synthetic oligonucleotide
cggacccgcgcggcagggcgtgcgg

SEQ ID NO: 683590 - DNA, 25 bp, Artificial sequence
  Synthetic oligonucleotide
cgctcgggcccggcggtcgccagcg

SEQ ID NO: 683591 - DNA, 25 bp, Artificial sequence
  Synthetic oligonucleotide
ggcgccccgggcgcgacgacctgcc

SEQ ID NO: 683592 - DNA, 25 bp, Artificial sequence
  Synthetic oligonucleotide
ggcgccccgggcccgacgacctgcc

SEQ ID NO: 683593 - DNA, 25 bp, Artificial sequence
  Synthetic oligonucleotide
cctccgcgccggcccgacgcgcgca

SEQ ID NO: 683594 - DNA, 25 bp, Artificial sequence
  Synthetic oligonucleotide
cctccgcgccgggccgacgcgcgca

SEQ ID NO: 683595 - DNA, 25 bp, Artificial sequence
  Synthetic oligonucleotide
gccctggcgccggctcgacccgccg

SEQ ID NO: 683596 - DNA, 25 bp, Artificial sequence
  Synthetic oligonucleotide
gccggccgacgaggcgcggcctgcc

SEQ ID NO: 683597 - DNA, 25 bp, Artificial sequence
  Synthetic oligonucleotide
ggaccgccggacccgccggcgacgg

SEQ ID NO: 683598 - DNA, 25 bp, Artificial sequence
  Synthetic oligonucleotide
gcccggcaggtctcgcgcggcgcgc

SEQ ID NO: 683599 - DNA, 25 bp, Artificial sequence
  Synthetic oligonucleotide
gcccggcaggtcacgcgcggcgcgc

SEQ ID NO: 683600 - DNA, 25 bp, Artificial sequence
  Synthetic oligonucleotide
gcggcccggacgcgccttcccgcgc

SEQ ID NO: 683601 - DNA, 25 bp, Artificial sequence
  Synthetic oligonucleotide
gcggcccggacgggccttcccgcgc

SEQ ID NO: 683602 - DNA, 25 bp, Artificial sequence
  Synthetic oligonucleotide
accgcggcgggccacgccgtggccc

SEQ ID NO: 683603 - DNA, 25 bp, Artificial sequence
  Synthetic oligonucleotide
cgtgcggcggccgtcggcccgctcg

SEQ ID NO: 683604 - DNA, 25 bp, Artificial sequence
  Synthetic oligonucleotide
ggaccgccggacgcgccggcgacgg

SEQ ID NO: 683605 - DNA, 25 bp, Artificial sequence
  Synthetic oligonucleotide
gggccccgggggccgatcccgcagc

SEQ ID NO: 683606 - DNA, 25 bp, Artificial sequence
  Synthetic oligonucleotide
ggggcccggcgtccccgcggagcga

SEQ ID NO: 683607 - DNA, 25 bp, Artificial sequence
  Synthetic oligonucleotide
ggggcccggcgtgcccgcggagcga

SEQ ID NO: 683608 - DNA, 25 bp, Artificial sequence
  Synthetic oligonucleotide
cggccacgtctggccggcgggcgcc

SEQ ID NO: 683609 - DNA, 25 bp, Artificial sequence
  Synthetic oligonucleotide
cggccacgtctgcccggcgggcgcc

SEQ ID NO: 683610 - DNA, 25 bp, Artificial sequence
  Synthetic oligonucleotide
ggccagccggtgcgggacccgccgg

SEQ ID NO: 683611 - DNA, 25 bp, Artificial sequence
  Synthetic oligonucleotide
ccctggtgccgggtcgccgccccgg

SEQ ID NO: 683612 - DNA, 25 bp, Artificial sequence
  Synthetic oligonucleotide
accgcggcgggcgacgccgtggccc

SEQ ID NO: 683613 - DNA, 25 bp, Artificial sequence
  Synthetic oligonucleotide
cggtcgtcggagcgcccccgcgcgg

SEQ ID NO: 683614 - DNA, 25 bp, Artificial sequence
  Synthetic oligonucleotide
gcccccggtcgcagccagcgggcgg

SEQ ID NO: 683615 - DNA, 25 bp, Artificial sequence
  Synthetic oligonucleotide
cccaccccccgcgtgcggctgcccc

SEQ ID NO: 683616 - DNA, 25 bp, Artificial sequence
  Synthetic oligonucleotide
cccaccccccgcctgcggctgcccc

SEQ ID NO: 683617 - DNA, 25 bp, Artificial sequence
  Synthetic oligonucleotide
gcgcggcgggccctctggcgcggtc

SEQ ID NO: 683618 - DNA, 25 bp, Artificial sequence
  Synthetic oligonucleotide
gcgcggcgggccgtctggcgcggtc

SEQ ID NO: 683619 - DNA, 25 bp, Artificial sequence
  Synthetic oligonucleotide
cgcgcccggcgccgcgtgccgcatg

SEQ ID NO: 683620 - DNA, 25 bp, Artificial sequence
  Synthetic oligonucleotide
gcctacgcggccctcggccggcgcc

SEQ ID NO: 683621 - DNA, 25 bp, Artificial sequence
  Synthetic oligonucleotide
cggtcgtcggagggcccccgcgcgg

SEQ ID NO: 683622 - DNA, 25 bp, Artificial sequence
  Synthetic oligonucleotide
gcctacgcggccgtcggccggcgcc

SEQ ID NO: 683623 - DNA, 25 bp, Artificial sequence
  Synthetic oligonucleotide
ccgtgcgcgtcggggccgccgtgcg

SEQ ID NO: 683624 - DNA, 25 bp, Artificial sequence
  Synthetic oligonucleotide
ccgtgcgcgtcgcggccgccgtgcg

SEQ ID NO: 683625 - DNA, 25 bp, Artificial sequence
  Synthetic oligonucleotide
gggcgccgcgcaggggcccgtcgga

SEQ ID NO: 683626 - DNA, 25 bp, Artificial sequence
  Synthetic oligonucleotide
gggcgccgcgcacgggcccgtcgga

SEQ ID NO: 683627 - DNA, 25 bp, Artificial sequence
  Synthetic oligonucleotide
gggccccggggggcgatcccgcagc

SEQ ID NO: 683628 - DNA, 25 bp, Artificial sequence
  Synthetic oligonucleotide
cggacccgcgcgccagggcgtgcgg

SEQ ID NO: 683629 - DNA, 25 bp, Artificial sequence
  Synthetic oligonucleotide
cgcgcccggcgcggcgtgccgcatg

SEQ ID NO: 683630 - DNA, 25 bp, Artificial sequence
  Synthetic oligonucleotide
cgccccggcggtgcgctaggcggcg

SEQ ID NO: 683631 - DNA, 25 bp, Artificial sequence
  Synthetic oligonucleotide
ccggcggtcgaccgcgcgaggcccg

SEQ ID NO: 683632 - DNA, 25 bp, Artificial sequence
  Synthetic oligonucleotide
cgccccgcgtcgtacgggcgcggcc

SEQ ID NO: 683633 - DNA, 25 bp, Artificial sequence
  Synthetic oligonucleotide
cggggggcgttcgcggcacgccggc

SEQ ID NO: 683634 - DNA, 25 bp, Artificial sequence
  Synthetic oligonucleotide
cggggggcgttcccggcacgccggc

SEQ ID NO: 683635 - DNA, 25 bp, Artificial sequence
  Synthetic oligonucleotide
ggccgggctaggcgccgcacccggg

SEQ ID NO: 683636 - DNA, 25 bp, Artificial sequence
  Synthetic oligonucleotide
ggccgggctaggggccgcacccggg

SEQ ID NO: 683637 - DNA, 25 bp, Artificial sequence
  Synthetic oligonucleotide
cgccgcggcccgtacgacggcgccg

SEQ ID NO: 683638 - DNA, 25 bp, Artificial sequence
  Synthetic oligonucleotide
cgccgcggcccgaacgacggcgccg

SEQ ID NO: 683639 - DNA, 25 bp, Artificial sequence
  Synthetic oligonucleotide
gcccgcggcgatccgacgggccgcc

SEQ ID NO: 683640 - DNA, 25 bp, Artificial sequence
  Synthetic oligonucleotide
gcccgcggcgatgcgacgggccgcc

SEQ ID NO: 683641 - DNA, 25 bp, Artificial sequence
  Synthetic oligonucleotide
cgggccgcgcggtcgcgtagccggg

SEQ ID NO: 683642 - DNA, 25 bp, Artificial sequence
  Synthetic oligonucleotide
ccgccgggcgcgcgctagtccccgc

SEQ ID NO: 683643 - DNA, 25 bp, Artificial sequence
  Synthetic oligonucleotide
cgggccgcgcggacgcgtagccggg

SEQ ID NO: 683644 - DNA, 25 bp, Artificial sequence
  Synthetic oligonucleotide
cgcgcgggcgtcctcccgaccgggc

SEQ ID NO: 683645 - DNA, 25 bp, Artificial sequence
  Synthetic oligonucleotide
gccgccggggcgtcgaacgcgcggg

SEQ ID NO: 683646 - DNA, 25 bp, Artificial sequence
  Synthetic oligonucleotide
gccgccggggcgacgaacgcgcggg

SEQ ID NO: 683647 - DNA, 25 bp, Artificial sequence
  Synthetic oligonucleotide
gggggcggtacgggctccgccccgc

SEQ ID NO: 683648 - DNA, 25 bp, Artificial sequence
  Synthetic oligonucleotide
gggggcggtacgcgctccgccccgc

SEQ ID NO: 683649 - DNA, 25 bp, Artificial sequence
  Synthetic oligonucleotide
gcgggcggtaggggcaccgccggcg

SEQ ID NO: 683650 - DNA, 25 bp, Artificial sequence
  Synthetic oligonucleotide
gcgggcggtaggcgcaccgccggcg

SEQ ID NO: 683651 - DNA, 25 bp, Artificial sequence
  Synthetic oligonucleotide
ggcgggggtcgcgcggtagcgggcc

SEQ ID NO: 683652 - DNA, 25 bp, Artificial sequence
  Synthetic oligonucleotide
ggcgggggtcgcccggtagcgggcc

SEQ ID NO: 683653 - DNA, 25 bp, Artificial sequence
  Synthetic oligonucleotide
gcgggccgtcgcctacgggccgccc

SEQ ID NO: 683654 - DNA, 25 bp, Artificial sequence
  Synthetic oligonucleotide
ccgccgggcgcgggctagtccccgc

SEQ ID NO: 683655 - DNA, 25 bp, Artificial sequence
  Synthetic oligonucleotide
cggcgggaccggggtagcgcgcccc

SEQ ID NO: 683656 - DNA, 25 bp, Artificial sequence
  Synthetic oligonucleotide
gcgggccgtcgcgtacgggccgccc

SEQ ID NO: 683657 - DNA, 25 bp, Artificial sequence
  Synthetic oligonucleotide
ggcgcgcgtcgtacgcggggcccgc

SEQ ID NO: 683658 - DNA, 25 bp, Artificial sequence
  Synthetic oligonucleotide
ggcgcgcgtcgttcgcggggcccgc

SEQ ID NO: 683659 - DNA, 25 bp, Artificial sequence
  Synthetic oligonucleotide
gccgcgctacgccgcgtcggccggg

SEQ ID NO: 683660 - DNA, 25 bp, Artificial sequence
  Synthetic oligonucleotide
gccgcgctacgcggcgtcggccggg

SEQ ID NO: 683661 - DNA, 25 bp, Artificial sequence
  Synthetic oligonucleotide
gcggggctccgcgggtacgcgccgg

SEQ ID NO: 683662 - DNA, 25 bp, Artificial sequence
  Synthetic oligonucleotide
gcggggctccgccggtacgcgccgg

SEQ ID NO: 683663 - DNA, 25 bp, Artificial sequence
  Synthetic oligonucleotide
cgccccctcgaccgcgcgagccccc

SEQ ID NO: 683664 - DNA, 25 bp, Artificial sequence
  Synthetic oligonucleotide
cgccccctcgacggcgcgagccccc

SEQ ID NO: 683665 - DNA, 25 bp, Artificial sequence
  Synthetic oligonucleotide
ggcgcggaccgatcgcgcgcgggcg

SEQ ID NO: 683666 - DNA, 25 bp, Artificial sequence
  Synthetic oligonucleotide
cgccccgcgtcgaacgggcgcggcc

SEQ ID NO: 683667 - DNA, 25 bp, Artificial sequence
  Synthetic oligonucleotide
cggcgggaccggcgtagcgcgcccc

SEQ ID NO: 683668 - DNA, 25 bp, Artificial sequence
  Synthetic oligonucleotide
gcgccggtcgcaagcgcggcccgcg

SEQ ID NO: 683669 - DNA, 25 bp, Artificial sequence
  Synthetic oligonucleotide
gggcgcgcacgccgacgtcgcgccc

SEQ ID NO: 683670 - DNA, 25 bp, Artificial sequence
  Synthetic oligonucleotide
gggcgcgcacgcggacgtcgcgccc

SEQ ID NO: 683671 - DNA, 25 bp, Artificial sequence
  Synthetic oligonucleotide
cggcgggcccgtggcacgaggcgcc

SEQ ID NO: 683672 - DNA, 25 bp, Artificial sequence
  Synthetic oligonucleotide
cggcgggcccgtcgcacgaggcgcc

SEQ ID NO: 683673 - DNA, 25 bp, Artificial sequence
  Synthetic oligonucleotide
gggggggcctaggtccgcgcgcgcg

SEQ ID NO: 683674 - DNA, 25 bp, Artificial sequence
  Synthetic oligonucleotide
gggggggcctagctccgcgcgcgcg

SEQ ID NO: 683675 - DNA, 25 bp, Artificial sequence
  Synthetic oligonucleotide
ggcggggcgcgactcccgacccgcg

SEQ ID NO: 683676 - DNA, 25 bp, Artificial sequence
  Synthetic oligonucleotide
ggcggggcgcgagtcccgacccgcg

SEQ ID NO: 683677 - DNA, 25 bp, Artificial sequence
  Synthetic oligonucleotide
gccccggcgcgataccccccgcgcg

SEQ ID NO: 683678 - DNA, 25 bp, Artificial sequence
  Synthetic oligonucleotide
gccccggcgcgaaaccccccgcgcg

SEQ ID NO: 683679 - DNA, 25 bp, Artificial sequence
  Synthetic oligonucleotide
ggcgcggaccgaacgcgcgcgggcg

SEQ ID NO: 683680 - DNA, 25 bp, Artificial sequence
  Synthetic oligonucleotide
gcgcaccccccgggtcgagcgcccg

SEQ ID NO: 683681 - DNA, 25 bp, Artificial sequence
  Synthetic oligonucleotide
gccgcgggtctccaccgcggccgcg

SEQ ID NO: 683682 - DNA, 25 bp, Artificial sequence
  Synthetic oligonucleotide
cgcgggtgcgcgctcgcgagcgcgc

SEQ ID NO: 683683 - DNA, 25 bp, Artificial sequence
  Synthetic oligonucleotide
ggggcctggcggacgcacgcgcgcc

SEQ ID NO: 683684 - DNA, 25 bp, Artificial sequence
  Synthetic oligonucleotide
ggggcctggcggtcgcacgcgcgcc

SEQ ID NO: 683685 - DNA, 25 bp, Artificial sequence
  Synthetic oligonucleotide
ggccggttcgccggcgggtggcggc

SEQ ID NO: 683686 - DNA, 25 bp, Artificial sequence
  Synthetic oligonucleotide
ggccggttcgcccgcgggtggcggc

SEQ ID NO: 683687 - DNA, 25 bp, Artificial sequence
  Synthetic oligonucleotide
ccggcgttgcgcgggacggcgcgcc

SEQ ID NO: 683688 - DNA, 25 bp, Artificial sequence
  Synthetic oligonucleotide
ccggcgttgcgccggacggcgcgcc

SEQ ID NO: 683689 - DNA, 25 bp, Artificial sequence
  Synthetic oligonucleotide
tgggggacggccggtccgcggcgcc

SEQ ID NO: 683690 - DNA, 25 bp, Artificial sequence
  Synthetic oligonucleotide
tgggggacggcccgtccgcggcgcc

SEQ ID NO: 683691 - DNA, 25 bp, Artificial sequence
  Synthetic oligonucleotide
cccgcctgcgcgcgccgtacggccc

SEQ ID NO: 683692 - DNA, 25 bp, Artificial sequence
  Synthetic oligonucleotide
gcgcgaccacgcgggacgggccccc

SEQ ID NO: 683693 - DNA, 25 bp, Artificial sequence
  Synthetic oligonucleotide
cccgcctgcgcgggccgtacggccc

SEQ ID NO: 683694 - DNA, 25 bp, Artificial sequence
  Synthetic oligonucleotide
gcgcaccccccgcgtcgagcgcccg

SEQ ID NO: 683695 - DNA, 25 bp, Artificial sequence
  Synthetic oligonucleotide
cggcggccccgttgcgcggaggccg

SEQ ID NO: 683696 - DNA, 25 bp, Artificial sequence
  Synthetic oligonucleotide
cggcggccccgtagcgcggaggccg

SEQ ID NO: 683697 - DNA, 25 bp, Artificial sequence
  Synthetic oligonucleotide
gagccgcccgcgagtcgcgcgcgcg

SEQ ID NO: 683698 - DNA, 25 bp, Artificial sequence
  Synthetic oligonucleotide
gagccgcccgcgtgtcgcgcgcgcg

SEQ ID NO: 683699 - DNA, 25 bp, Artificial sequence
  Synthetic oligonucleotide
gcccgcccgacgggcggtgcgcctc

SEQ ID NO: 683700 - DNA, 25 bp, Artificial sequence
  Synthetic oligonucleotide
gcccgcccgacgcgcggtgcgcctc

SEQ ID NO: 683701 - DNA, 25 bp, Artificial sequence
  Synthetic oligonucleotide
cgcgccccggaccggtcgccgccga

SEQ ID NO: 683702 - DNA, 25 bp, Artificial sequence
  Synthetic oligonucleotide
cgcgccccggacgggtcgccgccga

SEQ ID NO: 683703 - DNA, 25 bp, Artificial sequence
  Synthetic oligonucleotide
cgcgcgggcgtcgtcccgaccgggc

SEQ ID NO: 683704 - DNA, 25 bp, Artificial sequence
  Synthetic oligonucleotide
gcgcgaccacgccggacgggccccc

SEQ ID NO: 683705 - DNA, 25 bp, Artificial sequence
  Synthetic oligonucleotide
ccgccgtagcgaccccgcggcccgc

SEQ ID NO: 683706 - DNA, 25 bp, Artificial sequence
  Synthetic oligonucleotide
gcgccggtcgcatgcgcggcccgcg

SEQ ID NO: 683707 - DNA, 25 bp, Artificial sequence
  Synthetic oligonucleotide
gggcgggtcgcgtccgcctggccgg

SEQ ID NO: 683708 - DNA, 25 bp, Artificial sequence
  Synthetic oligonucleotide
gggcgggtcgcgaccgcctggccgg

SEQ ID NO: 683709 - DNA, 25 bp, Artificial sequence
  Synthetic oligonucleotide
ccgcgcgtcgcgcccgtaccggccc

SEQ ID NO: 683710 - DNA, 25 bp, Artificial sequence
  Synthetic oligonucleotide
ccgcgcgtcgcggccgtaccggccc

SEQ ID NO: 683711 - DNA, 25 bp, Artificial sequence
  Synthetic oligonucleotide
ggcggggtcgcgggtacgggccggc

SEQ ID NO: 683712 - DNA, 25 bp, Artificial sequence
  Synthetic oligonucleotide
ggcggggtcgcgcgtacgggccggc

SEQ ID NO: 683713 - DNA, 25 bp, Artificial sequence
  Synthetic oligonucleotide
ggccccgtcggcccatcgcccgccg

SEQ ID NO: 683714 - DNA, 25 bp, Artificial sequence
  Synthetic oligonucleotide
ggccccgtcggcgcatcgcccgccg

SEQ ID NO: 683715 - DNA, 25 bp, Artificial sequence
  Synthetic oligonucleotide
gcgcccgtgcgcgcgatcggcggcg

SEQ ID NO: 683716 - DNA, 25 bp, Artificial sequence
  Synthetic oligonucleotide
cgcgggtgcgcggtcgcgagcgcgc

SEQ ID NO: 683717 - DNA, 25 bp, Artificial sequence
  Synthetic oligonucleotide
ccgccgtagcgagcccgcggcccgc

SEQ ID NO: 683718 - DNA, 25 bp, Artificial sequence
  Synthetic oligonucleotide
gccgcgggtctcgaccgcggccgcg

SEQ ID NO: 683719 - DNA, 25 bp, Artificial sequence
  Synthetic oligonucleotide
cggcgctaggcgacgcggcccgccc

SEQ ID NO: 683720 - DNA, 25 bp, Artificial sequence
  Synthetic oligonucleotide
cggcgctaggcgtcgcggcccgccc

SEQ ID NO: 683721 - DNA, 25 bp, Artificial sequence
  Synthetic oligonucleotide
gccccctccacgggtcgcggccccg

SEQ ID NO: 683722 - DNA, 25 bp, Artificial sequence
  Synthetic oligonucleotide
gccccctccacgcgtcgcggccccg

SEQ ID NO: 683723 - DNA, 25 bp, Artificial sequence
  Synthetic oligonucleotide
ggcgggtcgcgggcgatcccggcgg

SEQ ID NO: 683724 - DNA, 25 bp, Artificial sequence
  Synthetic oligonucleotide
ggcgggtcgcggccgatcccggcgg

SEQ ID NO: 683725 - DNA, 25 bp, Artificial sequence
  Synthetic oligonucleotide
cgggcctcggcgctcacggcgccgg

SEQ ID NO: 683726 - DNA, 25 bp, Artificial sequence
  Synthetic oligonucleotide
cgggcctcggcggtcacggcgccgg

SEQ ID NO: 683727 - DNA, 25 bp, Artificial sequence
  Synthetic oligonucleotide
cggccctcgtaccccgggcggcgcc

SEQ ID NO: 683728 - DNA, 25 bp, Artificial sequence
  Synthetic oligonucleotide
cggccctcgtacgccgggcggcgcc

SEQ ID NO: 683729 - DNA, 25 bp, Artificial sequence
  Synthetic oligonucleotide
gcgcccgtgcgcccgatcggcggcg

SEQ ID NO: 683730 - DNA, 25 bp, Artificial sequence
  Synthetic oligonucleotide
gggcccccgcggcgcatacgggcgc

SEQ ID NO: 683731 - DNA, 25 bp, Artificial sequence
  Synthetic oligonucleotide
ccgcggccggtcggcgctaccgcgc

SEQ ID NO: 683732 - DNA, 25 bp, Artificial sequence
  Synthetic oligonucleotide
ggcgcgaacccggtcgcccgcgccg

SEQ ID NO: 683733 - DNA, 25 bp, Artificial sequence
  Synthetic oligonucleotide
cccgccccgagccctacgcgcgcgg

SEQ ID NO: 683734 - DNA, 25 bp, Artificial sequence
  Synthetic oligonucleotide
gcgggcccgcccgacgatcccgcgg

SEQ ID NO: 683735 - DNA, 25 bp, Artificial sequence
  Synthetic oligonucleotide
gcgggcccgccccacgatcccgcgg

SEQ ID NO: 683736 - DNA, 25 bp, Artificial sequence
  Synthetic oligonucleotide
ccggccccgccgccacgtaccgcgc

SEQ ID NO: 683737 - DNA, 25 bp, Artificial sequence
  Synthetic oligonucleotide
ccggccccgccggcacgtaccgcgc

SEQ ID NO: 683738 - DNA, 25 bp, Artificial sequence
  Synthetic oligonucleotide
cggccgccgcgacgcgtgaggcgcc

SEQ ID NO: 683739 - DNA, 25 bp, Artificial sequence
  Synthetic oligonucleotide
cggccgccgcgaggcgtgaggcgcc

SEQ ID NO: 683740 - DNA, 25 bp, Artificial sequence
  Synthetic oligonucleotide
gccgcgccgcgccacgaacggcggc

SEQ ID NO: 683741 - DNA, 25 bp, Artificial sequence
  Synthetic oligonucleotide
gccccgccgacccgtacgcgggcgc

SEQ ID NO: 683742 - DNA, 25 bp, Artificial sequence
  Synthetic oligonucleotide
gggcccccgcggggcatacgggcgc

SEQ ID NO: 683743 - DNA, 25 bp, Artificial sequence
  Synthetic oligonucleotide
gccccgccgaccggtacgcgggcgc

SEQ ID NO: 683744 - DNA, 25 bp, Artificial sequence
  Synthetic oligonucleotide
ggcgcgccgcggctatgcccccccg

SEQ ID NO: 683745 - DNA, 25 bp, Artificial sequence
  Synthetic oligonucleotide
ggcgcgccgcgggtatgcccccccg

SEQ ID NO: 683746 - DNA, 25 bp, Artificial sequence
  Synthetic oligonucleotide
cccgccccgcgtttcgccgcgcccc

SEQ ID NO: 683747 - DNA, 25 bp, Artificial sequence
  Synthetic oligonucleotide
cccgccccgcgtatcgccgcgcccc

SEQ ID NO: 683748 - DNA, 25 bp, Artificial sequence
  Synthetic oligonucleotide
cccgcgccgcgtgtcgacccccgcg

SEQ ID NO: 683749 - DNA, 25 bp, Artificial sequence
  Synthetic oligonucleotide
cccgcgccgcgtctcgacccccgcg

SEQ ID NO: 683750 - DNA, 25 bp, Artificial sequence
  Synthetic oligonucleotide
gcggggccggatcaccgcgccgcgg

SEQ ID NO: 683751 - DNA, 25 bp, Artificial sequence
  Synthetic oligonucleotide
gcggggccggatgaccgcgccgcgg

SEQ ID NO: 683752 - DNA, 25 bp, Artificial sequence
  Synthetic oligonucleotide
cccggcccggcacgctacgcgcccg

SEQ ID NO: 683753 - DNA, 25 bp, Artificial sequence
  Synthetic oligonucleotide
cccggcccggcaggctacgcgcccg

SEQ ID NO: 683754 - DNA, 25 bp, Artificial sequence
  Synthetic oligonucleotide
gccgcgccgcgcgacgaacggcggc

SEQ ID NO: 683755 - DNA, 25 bp, Artificial sequence
  Synthetic oligonucleotide
cgggccacgcgggcgtacgcgccgc

SEQ ID NO: 683756 - DNA, 25 bp, Artificial sequence
  Synthetic oligonucleotide
ccggcggtcgacggcgcgaggcccg

SEQ ID NO: 683757 - DNA, 25 bp, Artificial sequence
  Synthetic oligonucleotide
ccgcggcgtcgcctacccgcgggcg

SEQ ID NO: 683758 - DNA, 25 bp, Artificial sequence
  Synthetic oligonucleotide
ggcgcgaacccgctcgcccgcgccg

SEQ ID NO: 683759 - DNA, 25 bp, Artificial sequence
  Synthetic oligonucleotide
ccccgcacccggcgtagcggcgcgc

SEQ ID NO: 683760 - DNA, 25 bp, Artificial sequence
  Synthetic oligonucleotide
ccccgcacccggggtagcggcgcgc

SEQ ID NO: 683761 - DNA, 25 bp, Artificial sequence
  Synthetic oligonucleotide
ggggcgaccgtccctccgcgcgcgg

SEQ ID NO: 683762 - DNA, 25 bp, Artificial sequence
  Synthetic oligonucleotide
ggggcgaccgtcgctccgcgcgcgg

SEQ ID NO: 683763 - DNA, 25 bp, Artificial sequence
  Synthetic oligonucleotide
cggccgacgcccctcgcgaccgccg

SEQ ID NO: 683764 - DNA, 25 bp, Artificial sequence
  Synthetic oligonucleotide
cggccgacgcccgtcgcgaccgccg

SEQ ID NO: 683765 - DNA, 25 bp, Artificial sequence
  Synthetic oligonucleotide
cggcccacgcgcccggttgcgggcc

SEQ ID NO: 683766 - DNA, 25 bp, Artificial sequence
  Synthetic oligonucleotide
cccgccccgacgcgagcgtgcgggc

SEQ ID NO: 683767 - DNA, 25 bp, Artificial sequence
  Synthetic oligonucleotide
cgggccacgcggccgtacgcgccgc

SEQ ID NO: 683768 - DNA, 25 bp, Artificial sequence
  Synthetic oligonucleotide
cccgccccgagcgctacgcgcgcgg

SEQ ID NO: 683769 - DNA, 25 bp, Artificial sequence
  Synthetic oligonucleotide
ggcgggacgcggtcgtccggcccgc

SEQ ID NO: 683770 - DNA, 25 bp, Artificial sequence
  Synthetic oligonucleotide
ggcgggacgcggacgtccggcccgc

SEQ ID NO: 683771 - DNA, 25 bp, Artificial sequence
  Synthetic oligonucleotide
ccccggacggccggtccgagcgcgc

SEQ ID NO: 683772 - DNA, 25 bp, Artificial sequence
  Synthetic oligonucleotide
ccccggacggcccgtccgagcgcgc

SEQ ID NO: 683773 - DNA, 25 bp, Artificial sequence
  Synthetic oligonucleotide
cggcccacggtccaccgcgggccgc

SEQ ID NO: 683774 - DNA, 25 bp, Artificial sequence
  Synthetic oligonucleotide
cggcccacggtcgaccgcgggccgc

SEQ ID NO: 683775 - DNA, 25 bp, Artificial sequence
  Synthetic oligonucleotide
ggcggcacgtccgacgcggcgcccc

SEQ ID NO: 683776 - DNA, 25 bp, Artificial sequence
  Synthetic oligonucleotide
ggcggcacgtcccacgcggcgcccc

SEQ ID NO: 683777 - DNA, 25 bp, Artificial sequence
  Synthetic oligonucleotide
ggcgccatcgcgggagcgggcgggc

SEQ ID NO: 683778 - DNA, 25 bp, Artificial sequence
  Synthetic oligonucleotide
ggcgccatcgcgcgagcgggcgggc

SEQ ID NO: 683779 - DNA, 25 bp, Artificial sequence
  Synthetic oligonucleotide
cggcccacgcgcgcggttgcgggcc

SEQ ID NO: 683780 - DNA, 25 bp, Artificial sequence
  Synthetic oligonucleotide
gcggcgcgcgtgccgtacccgcggc

SEQ ID NO: 683781 - DNA, 25 bp, Artificial sequence
  Synthetic oligonucleotide
ggccggcgcggtacgacggcgcccc

SEQ ID NO: 683782 - DNA, 25 bp, Artificial sequence
  Synthetic oligonucleotide
ggccggcgcggttcgacggcgcccc

SEQ ID NO: 683783 - DNA, 25 bp, Artificial sequence
  Synthetic oligonucleotide
ccgcgccgcggttgcggtcggcggg

SEQ ID NO: 683784 - DNA, 25 bp, Artificial sequence
  Synthetic oligonucleotide
ccgcgccgcggtagcggtcggcggg

SEQ ID NO: 683785 - DNA, 25 bp, Artificial sequence
  Synthetic oligonucleotide
gcggcccgcgtacgaccgcgcgccc

SEQ ID NO: 683786 - DNA, 25 bp, Artificial sequence
  Synthetic oligonucleotide
gcggcccgcgtaggaccgcgcgccc

SEQ ID NO: 683787 - DNA, 25 bp, Artificial sequence
  Synthetic oligonucleotide
gcgcgccgcgtaacggcccgccgcc

SEQ ID NO: 683788 - DNA, 25 bp, Artificial sequence
  Synthetic oligonucleotide
gcgcgccgcgtatcggcccgccgcc

SEQ ID NO: 683789 - DNA, 25 bp, Artificial sequence
  Synthetic oligonucleotide
gcggcccgcgtccacgcgtccgggc

SEQ ID NO: 683790 - DNA, 25 bp, Artificial sequence
  Synthetic oligonucleotide
gcggcccgcgtcgacgcgtccgggc

SEQ ID NO: 683791 - DNA, 25 bp, Artificial sequence
  Synthetic oligonucleotide
cgggcgcgcgacggtgcgacgcccc

SEQ ID NO: 683792 - DNA, 25 bp, Artificial sequence
  Synthetic oligonucleotide
gcggcccgcgtcgagggaccgcggc

SEQ ID NO: 683793 - DNA, 25 bp, Artificial sequence
  Synthetic oligonucleotide
gcgggccgtacgccggtcggccggc

SEQ ID NO: 683794 - DNA, 25 bp, Artificial sequence
  Synthetic oligonucleotide
gcggcgcgcgtggcgtacccgcggc

SEQ ID NO: 683795 - DNA, 25 bp, Artificial sequence
  Synthetic oligonucleotide
ggccggcgggagggctcgagcccgc

SEQ ID NO: 683796 - DNA, 25 bp, Artificial sequence
  Synthetic oligonucleotide
ggccggcgggagcgctcgagcccgc

SEQ ID NO: 683797 - DNA, 25 bp, Artificial sequence
  Synthetic oligonucleotide
gccgcgcggtcctacgcgggccgcg

SEQ ID NO: 683798 - DNA, 25 bp, Artificial sequence
  Synthetic oligonucleotide
gccgcgcggtccaacgcgggccgcg

SEQ ID NO: 683799 - DNA, 25 bp, Artificial sequence
  Synthetic oligonucleotide
cgggcgcggtgcgccgctacgccgc

SEQ ID NO: 683800 - DNA, 25 bp, Artificial sequence
  Synthetic oligonucleotide
cgggcgcggtgccccgctacgccgc

SEQ ID NO: 683801 - DNA, 25 bp, Artificial sequence
  Synthetic oligonucleotide
gcgaggccggccctacggcgcgcgg

SEQ ID NO: 683802 - DNA, 25 bp, Artificial sequence
  Synthetic oligonucleotide
gcgggccgtacggcggtcggccggc

SEQ ID NO: 683803 - DNA, 25 bp, Artificial sequence
  Synthetic oligonucleotide
cccgccccgacgggagcgtgcgggc

SEQ ID NO: 683804 - DNA, 25 bp, Artificial sequence
  Synthetic oligonucleotide
ccgcggcgtcgcgtacccgcgggcg

SEQ ID NO: 683805 - DNA, 25 bp, Artificial sequence
  Synthetic oligonucleotide
gcggcccgcgtccagggaccgcggc

SEQ ID NO: 683806 - DNA, 25 bp, Artificial sequence
  Synthetic oligonucleotide
cccggcccgtcgatgcgcgcgggcg

SEQ ID NO: 683807 - DNA, 25 bp, Artificial sequence
  Synthetic oligonucleotide
cgggcgcgcgaccgtgcgacgcccc

SEQ ID NO: 683808 - DNA, 25 bp, Artificial sequence
  Synthetic oligonucleotide
ccgcggccggtccgcgctaccgcgc

SEQ ID NO: 683809 - DNA, 25 bp, Artificial sequence
  Synthetic oligonucleotide
cccggcccgtcgttgcgcgcgggcg

SEQ ID NO: 683810 - DNA, 25 bp, Artificial sequence
  Synthetic oligonucleotide
cgccggccgttccggcgagcgccgc

SEQ ID NO: 683811 - DNA, 25 bp, Artificial sequence
  Synthetic oligonucleotide
cgccggccgttcgggcgagcgccgc

SEQ ID NO: 683812 - DNA, 25 bp, Artificial sequence
  Synthetic oligonucleotide
cgccgccctagccgcggacggcgcg

SEQ ID NO: 683813 - DNA, 25 bp, Artificial sequence
  Synthetic oligonucleotide
cgccgccctagcggcggacggcgcg

SEQ ID NO: 683814 - DNA, 25 bp, Artificial sequence
  Synthetic oligonucleotide
ccggcgcctcgttcgggcggcgcgg

SEQ ID NO: 683815 - DNA, 25 bp, Artificial sequence
  Synthetic oligonucleotide
ccggcgcctcgtacgggcggcgcgg

SEQ ID NO: 683816 - DNA, 25 bp, Artificial sequence
  Synthetic oligonucleotide
gggccgcgacccgctagcggccgcc

SEQ ID NO: 683817 - DNA, 25 bp, Artificial sequence
  Synthetic oligonucleotide
gggccgcgaccccctagcggccgcc

SEQ ID NO: 683818 - DNA, 25 bp, Artificial sequence
  Synthetic oligonucleotide
cgggcgcgacgggtccgcacggcgc

SEQ ID NO: 683819 - DNA, 25 bp, Artificial sequence
  Synthetic oligonucleotide
gcggggcgcccgatagcgcgcgcgg

SEQ ID NO: 683820 - DNA, 25 bp, Artificial sequence
  Synthetic oligonucleotide
cgggcgcgacggctccgcacggcgc

SEQ ID NO: 683821 - DNA, 25 bp, Artificial sequence
  Synthetic oligonucleotide
gcggggcgcccgttagcgcgcgcgg

SEQ ID NO: 683822 - DNA, 25 bp, Artificial sequence
  Synthetic oligonucleotide
cgggcccgccggaacacggcgcggc

SEQ ID NO: 683823 - DNA, 25 bp, Artificial sequence
  Synthetic oligonucleotide
ggcccgcgcccgaacggagccgccc

SEQ ID NO: 683824 - DNA, 25 bp, Artificial sequence
  Synthetic oligonucleotide
ggcccgcgcccgtacggagccgccc

SEQ ID NO: 683825 - DNA, 25 bp, Artificial sequence
  Synthetic oligonucleotide
gccgggcgatcccacgccgggcgcg

SEQ ID NO: 683826 - DNA, 25 bp, Artificial sequence
  Synthetic oligonucleotide
gccgggcgatccgacgccgggcgcg

SEQ ID NO: 683827 - DNA, 25 bp, Artificial sequence
  Synthetic oligonucleotide
gcggcgcgacgttcgccccgccccg

SEQ ID NO: 683828 - DNA, 25 bp, Artificial sequence
  Synthetic oligonucleotide
gcggcgcgacgtacgccccgccccg

SEQ ID NO: 683829 - DNA, 25 bp, Artificial sequence
  Synthetic oligonucleotide
cgggcccgccggtacacggcgcggc

SEQ ID NO: 683830 - DNA, 25 bp, Artificial sequence
  Synthetic oligonucleotide
tctcagtttataaaaatcgaattaa

SEQ ID NO: 683831 - DNA, 25 bp, Artificial sequence
  Synthetic oligonucleotide
tatatttatttaccgaattatcatg

SEQ ID NO: 683832 - DNA, 25 bp, Artificial sequence
  Synthetic oligonucleotide
tatatttatttagcgaattatcatg

SEQ ID NO: 683833 - DNA, 25 bp, Artificial sequence
  Synthetic oligonucleotide
agtatgatatacgtttaataactaa

SEQ ID NO: 683834 - DNA, 25 bp, Artificial sequence
  Synthetic oligonucleotide
agtatgatatacctttaataactaa

SEQ ID NO: 683835 - DNA, 25 bp, Artificial sequence
  Synthetic oligonucleotide
ataattaacgaatcattgtagaaaa

SEQ ID NO: 683836 - DNA, 25 bp, Artificial sequence
  Synthetic oligonucleotide
ataattaacgaaacattgtagaaaa

SEQ ID NO: 683837 - DNA, 25 bp, Artificial sequence
  Synthetic oligonucleotide
ttattcgatttagcatattaataag

SEQ ID NO: 683838 - DNA, 25 bp, Artificial sequence
  Synthetic oligonucleotide
tctcagtttatataaatcgaattaa

SEQ ID NO: 683839 - DNA, 25 bp, Artificial sequence
  Synthetic oligonucleotide
tagtatttcgtaatgattatgtaat

SEQ ID NO: 683840 - DNA, 25 bp, Artificial sequence
  Synthetic oligonucleotide
gtacatcgtctaataattaaatatt

SEQ ID NO: 683841 - DNA, 25 bp, Artificial sequence
  Synthetic oligonucleotide
ttattcgatttaccatattaataag

SEQ ID NO: 683842 - DNA, 25 bp, Artificial sequence
  Synthetic oligonucleotide
aaatcattaatgtatttcgttaaag

SEQ ID NO: 683843 - DNA, 25 bp, Artificial sequence
  Synthetic oligonucleotide
aatacaaggatatatcgttataaat

SEQ ID NO: 683844 - DNA, 25 bp, Artificial sequence
  Synthetic oligonucleotide
aatacaaggataaatcgttataaat

SEQ ID NO: 683845 - DNA, 25 bp, Artificial sequence
  Synthetic oligonucleotide
attaaaagtcgaaaatctatacaat

SEQ ID NO: 683846 - DNA, 25 bp, Artificial sequence
  Synthetic oligonucleotide
ttggtgttatataacgataaaaaat

SEQ ID NO: 683847 - DNA, 25 bp, Artificial sequence
  Synthetic oligonucleotide
gtacatcgtctattaattaaatatt

SEQ ID NO: 683848 - DNA, 25 bp, Artificial sequence
  Synthetic oligonucleotide
tctaaaaactttttacgttcaatta

SEQ ID NO: 683849 - DNA, 25 bp, Artificial sequence
  Synthetic oligonucleotide
tctaaaaactttatacgttcaatta

SEQ ID NO: 683850 - DNA, 25 bp, Artificial sequence
  Synthetic oligonucleotide
ttggtgttatattacgataaaaaat

SEQ ID NO: 683851 - DNA, 25 bp, Artificial sequence
  Synthetic oligonucleotide
tagtatttcgtattgattatgtaat

SEQ ID NO: 683852 - DNA, 25 bp, Artificial sequence
  Synthetic oligonucleotide
aaaaagtgcgtaaaatattattaac

SEQ ID NO: 683853 - DNA, 25 bp, Artificial sequence
  Synthetic oligonucleotide
attaaaagtcgataatctatacaat

SEQ ID NO: 683854 - DNA, 25 bp, Artificial sequence
  Synthetic oligonucleotide
tatcttaatcgatctaaatacattt

SEQ ID NO: 683855 - DNA, 25 bp, Artificial sequence
  Synthetic oligonucleotide
aaatcattaatgaatttcgttaaag

SEQ ID NO: 683856 - DNA, 25 bp, Artificial sequence
  Synthetic oligonucleotide
tttataattatcaatttcgaaaagg

SEQ ID NO: 683857 - DNA, 25 bp, Artificial sequence
  Synthetic oligonucleotide
tatcttaatcgaactaaatacattt

SEQ ID NO: 683858 - DNA, 25 bp, Artificial sequence
  Synthetic oligonucleotide
gaaaataatattggttgatacataa

SEQ ID NO: 683859 - DNA, 25 bp, Artificial sequence
  Synthetic oligonucleotide
gaaaataatattcgttgatacataa

SEQ ID NO: 683860 - DNA, 25 bp, Artificial sequence
  Synthetic oligonucleotide
caatgattatatggtactataaatt

SEQ ID NO: 683861 - DNA, 25 bp, Artificial sequence
  Synthetic oligonucleotide
caatgattatatcgtactataaatt

SEQ ID NO: 683862 - DNA, 25 bp, Artificial sequence
  Synthetic oligonucleotide
tgtgtattctaatcgatatatataa

SEQ ID NO: 683863 - DNA, 25 bp, Artificial sequence
  Synthetic oligonucleotide
tgtgtattctaaacgatatatataa

SEQ ID NO: 683864 - DNA, 25 bp, Artificial sequence
  Synthetic oligonucleotide
atattcttaatccaaaaattccatt

SEQ ID NO: 683865 - DNA, 25 bp, Artificial sequence
  Synthetic oligonucleotide
cttaattctcgaatcaattattaaa

SEQ ID NO: 683866 - DNA, 25 bp, Artificial sequence
  Synthetic oligonucleotide
aaaaagtgcgtataatattattaac

SEQ ID NO: 683867 - DNA, 25 bp, Artificial sequence
  Synthetic oligonucleotide
ttttaattagtaggaataatgcttt

SEQ ID NO: 683868 - DNA, 25 bp, Artificial sequence
  Synthetic oligonucleotide
cttaattctcgattcaattattaaa

SEQ ID NO: 683869 - DNA, 25 bp, Artificial sequence
  Synthetic oligonucleotide
aatgtctataacgaaaattctataa

SEQ ID NO: 683870 - DNA, 25 bp, Artificial sequence
  Synthetic oligonucleotide
aatgtctataaccaaaattctataa

SEQ ID NO: 683871 - DNA, 25 bp, Artificial sequence
  Synthetic oligonucleotide
aattaaattcgataagattttagac

SEQ ID NO: 683872 - DNA, 25 bp, Artificial sequence
  Synthetic oligonucleotide
aattaaattcgaaaagattttagac

SEQ ID NO: 683873 - DNA, 25 bp, Artificial sequence
  Synthetic oligonucleotide
tatttttatgtcctcgtataatata

SEQ ID NO: 683874 - DNA, 25 bp, Artificial sequence
  Synthetic oligonucleotide
tatttttatgtcgtcgtataatata

SEQ ID NO: 683875 - DNA, 25 bp, Artificial sequence
  Synthetic oligonucleotide
taataaagttattcgattaacaatg

SEQ ID NO: 683876 - DNA, 25 bp, Artificial sequence
  Synthetic oligonucleotide
taataaagttatacgattaacaatg

SEQ ID NO: 683877 - DNA, 25 bp, Artificial sequence
  Synthetic oligonucleotide
ttttaattagtacgaataatgcttt

SEQ ID NO: 683878 - DNA, 25 bp, Artificial sequence
  Synthetic oligonucleotide
atattcttaatcgaaaaattccatt

SEQ ID NO: 683879 - DNA, 25 bp, Artificial sequence
  Synthetic oligonucleotide
agtttatatcgtaaatctaaaaaga

SEQ ID NO: 683880 - DNA, 25 bp, Artificial sequence
  Synthetic oligonucleotide
aagtatattattatccgatatctat

SEQ ID NO: 683881 - DNA, 25 bp, Artificial sequence
  Synthetic oligonucleotide
aagtatattattttccgatatctat

SEQ ID NO: 683882 - DNA, 25 bp, Artificial sequence
  Synthetic oligonucleotide
aaatcaattcgagtatattatagaa

SEQ ID NO: 683883 - DNA, 25 bp, Artificial sequence
  Synthetic oligonucleotide
aaatcaattcgactatattatagaa

SEQ ID NO: 683884 - DNA, 25 bp, Artificial sequence
  Synthetic oligonucleotide
gaattataaattaactatcgtctat

SEQ ID NO: 683885 - DNA, 25 bp, Artificial sequence
  Synthetic oligonucleotide
gaattataaatttactatcgtctat

SEQ ID NO: 683886 - DNA, 25 bp, Artificial sequence
  Synthetic oligonucleotide
aaatattagtcgaaatttatgatct

SEQ ID NO: 683887 - DNA, 25 bp, Artificial sequence
  Synthetic oligonucleotide
aaatattagtcgtaatttatgatct

SEQ ID NO: 683888 - DNA, 25 bp, Artificial sequence
  Synthetic oligonucleotide
ttaatcgtattgaattaactaaaag

SEQ ID NO: 683889 - DNA, 25 bp, Artificial sequence
  Synthetic oligonucleotide
ttaatcgtattgtattaactaaaag

SEQ ID NO: 683890 - DNA, 25 bp, Artificial sequence
  Synthetic oligonucleotide
ttattaatatgtgttatcgttatgt

SEQ ID NO: 683891 - DNA, 25 bp, Artificial sequence
  Synthetic oligonucleotide
aattttgataagacgttaaacatat

SEQ ID NO: 683892 - DNA, 25 bp, Artificial sequence
  Synthetic oligonucleotide
gtaaatatactatctattcgttaat

SEQ ID NO: 683893 - DNA, 25 bp, Artificial sequence
  Synthetic oligonucleotide
agtttatatcgttaatctaaaaaga

SEQ ID NO: 683894 - DNA, 25 bp, Artificial sequence
  Synthetic oligonucleotide
ataaatatcgtacatgttatatgta

SEQ ID NO: 683895 - DNA, 25 bp, Artificial sequence
  Synthetic oligonucleotide
ataaatatcgtagatgttatatgta

SEQ ID NO: 683896 - DNA, 25 bp, Artificial sequence
  Synthetic oligonucleotide
catttttgtaatattcgataatcta

SEQ ID NO: 683897 - DNA, 25 bp, Artificial sequence
  Synthetic oligonucleotide
catttttgtaattttcgataatcta

SEQ ID NO: 683898 - DNA, 25 bp, Artificial sequence
  Synthetic oligonucleotide
tatacattatcttatcgttagtaat

SEQ ID NO: 683899 - DNA, 25 bp, Artificial sequence
  Synthetic oligonucleotide
tatacattatctaatcgttagtaat

SEQ ID NO: 683900 - DNA, 25 bp, Artificial sequence
  Synthetic oligonucleotide
ttattaatatgtcttatcgttatgt

SEQ ID NO: 683901 - DNA, 25 bp, Artificial sequence
  Synthetic oligonucleotide
atttaaatgatttttcgctatatct

SEQ ID NO: 683902 - DNA, 25 bp, Artificial sequence
  Synthetic oligonucleotide
atttaaatgattattcgctatatct

SEQ ID NO: 683903 - DNA, 25 bp, Artificial sequence
  Synthetic oligonucleotide
aattttgataagtcgttaaacatat

SEQ ID NO: 683904 - DNA, 25 bp, Artificial sequence
  Synthetic oligonucleotide
tacatcgaatatttaatctatgaaa

SEQ ID NO: 683905 - DNA, 25 bp, Artificial sequence
  Synthetic oligonucleotide
ataagatatacgattagtttttgaa

SEQ ID NO: 683906 - DNA, 25 bp, Artificial sequence
  Synthetic oligonucleotide
aatatattagtaattcgtaaagcaa

SEQ ID NO: 683907 - DNA, 25 bp, Artificial sequence
  Synthetic oligonucleotide
tatattcgagttaagttaatttgaa

SEQ ID NO: 683908 - DNA, 25 bp, Artificial sequence
  Synthetic oligonucleotide
tatattcgagtttagttaatttgaa

SEQ ID NO: 683909 - DNA, 25 bp, Artificial sequence
  Synthetic oligonucleotide
atgtagtcgatttataatagtttta

SEQ ID NO: 683910 - DNA, 25 bp, Artificial sequence
  Synthetic oligonucleotide
atgtagtcgattaataatagtttta

SEQ ID NO: 683911 - DNA, 25 bp, Artificial sequence
  Synthetic oligonucleotide
caatctcgatttatatatcttttat

SEQ ID NO: 683912 - DNA, 25 bp, Artificial sequence
  Synthetic oligonucleotide
caatctcgatttttatatcttttat

SEQ ID NO: 683913 - DNA, 25 bp, Artificial sequence
  Synthetic oligonucleotide
agtaaaacgctatattaataatcaa

SEQ ID NO: 683914 - DNA, 25 bp, Artificial sequence
  Synthetic oligonucleotide
agtaaaacgctaaattaataatcaa

SEQ ID NO: 683915 - DNA, 25 bp, Artificial sequence
  Synthetic oligonucleotide
aatacaactcgtaataatatttgaa

SEQ ID NO: 683916 - DNA, 25 bp, Artificial sequence
  Synthetic oligonucleotide
acacaattagataattacgttattt

SEQ ID NO: 683917 - DNA, 25 bp, Artificial sequence
  Synthetic oligonucleotide
aatacaactcgttataatatttgaa

SEQ ID NO: 683918 - DNA, 25 bp, Artificial sequence
  Synthetic oligonucleotide
tacatcgaatatataatctatgaaa

SEQ ID NO: 683919 - DNA, 25 bp, Artificial sequence
  Synthetic oligonucleotide
aaacttttagcgatattatgttata

SEQ ID NO: 683920 - DNA, 25 bp, Artificial sequence
  Synthetic oligonucleotide
aaacttttagcgttattatgttata

SEQ ID NO: 683921 - DNA, 25 bp, Artificial sequence
  Synthetic oligonucleotide
attgaataaatcgatatagttctat

SEQ ID NO: 683922 - DNA, 25 bp, Artificial sequence
  Synthetic oligonucleotide
attgaataaatccatatagttctat

SEQ ID NO: 683923 - DNA, 25 bp, Artificial sequence
  Synthetic oligonucleotide
atgtattcggatagattatatatta

SEQ ID NO: 683924 - DNA, 25 bp, Artificial sequence
  Synthetic oligonucleotide
atgtattcggattgattatatatta

SEQ ID NO: 683925 - DNA, 25 bp, Artificial sequence
  Synthetic oligonucleotide
taaataactatccataattatgctt

SEQ ID NO: 683926 - DNA, 25 bp, Artificial sequence
  Synthetic oligonucleotide
taaataactatcgataattatgctt

SEQ ID NO: 683927 - DNA, 25 bp, Artificial sequence
  Synthetic oligonucleotide
gtaaatatactaactattcgttaat

SEQ ID NO: 683928 - DNA, 25 bp, Artificial sequence
  Synthetic oligonucleotide
ataagatatacgtttagtttttgaa

SEQ ID NO: 683929 - DNA, 25 bp, Artificial sequence
  Synthetic oligonucleotide
acacaattagattattacgttattt

SEQ ID NO: 683930 - DNA, 25 bp, Artificial sequence
  Synthetic oligonucleotide
ctaatattataccaattactatcat

SEQ ID NO: 683931 - DNA, 25 bp, Artificial sequence
  Synthetic oligonucleotide
tatttacgaactatataattggaat

SEQ ID NO: 683932 - DNA, 25 bp, Artificial sequence
  Synthetic oligonucleotide
tatttacgaactttataattggaat

SEQ ID NO: 683933 - DNA, 25 bp, Artificial sequence
  Synthetic oligonucleotide
caatctactcgtattaattaaattt

SEQ ID NO: 683934 - DNA, 25 bp, Artificial sequence
  Synthetic oligonucleotide
caatctactcgttttaattaaattt

SEQ ID NO: 683935 - DNA, 25 bp, Artificial sequence
  Synthetic oligonucleotide
aaaactaacgataagcataataaat

SEQ ID NO: 683936 - DNA, 25 bp, Artificial sequence
  Synthetic oligonucleotide
aaaactaacgattagcataataaat

SEQ ID NO: 683937 - DNA, 25 bp, Artificial sequence
  Synthetic oligonucleotide
aaaaactaacgattcgatattaata

SEQ ID NO: 683938 - DNA, 25 bp, Artificial sequence
  Synthetic oligonucleotide
atactattatattacgaaacgtaaa

SEQ ID NO: 683939 - DNA, 25 bp, Artificial sequence
  Synthetic oligonucleotide
atgagaagatattatcgtatttatt

SEQ ID NO: 683940 - DNA, 25 bp, Artificial sequence
  Synthetic oligonucleotide
ctaatattatacgaattactatcat

SEQ ID NO: 683941 - DNA, 25 bp, Artificial sequence
  Synthetic oligonucleotide
taaaagattcgcaaatataattgat

SEQ ID NO: 683942 - DNA, 25 bp, Artificial sequence
  Synthetic oligonucleotide
taaaagattcgctaatataattgat

SEQ ID NO: 683943 - DNA, 25 bp, Artificial sequence
  Synthetic oligonucleotide
gttaaataccgatataatattgaat

SEQ ID NO: 683944 - DNA, 25 bp, Artificial sequence
  Synthetic oligonucleotide
gttaaataccgaaataatattgaat

SEQ ID NO: 683945 - DNA, 25 bp, Artificial sequence
  Synthetic oligonucleotide
attactatttgaggattaattatct

SEQ ID NO: 683946 - DNA, 25 bp, Artificial sequence
  Synthetic oligonucleotide
attactatttgacgattaattatct

SEQ ID NO: 683947 - DNA, 25 bp, Artificial sequence
  Synthetic oligonucleotide
atactattatataacgaaacgtaaa

SEQ ID NO: 683948 - DNA, 25 bp, Artificial sequence
  Synthetic oligonucleotide
ttaatcgttaatttacaatttctag

SEQ ID NO: 683949 - DNA, 25 bp, Artificial sequence
  Synthetic oligonucleotide
tgtattataatacgtctaaactata

SEQ ID NO: 683950 - DNA, 25 bp, Artificial sequence
  Synthetic oligonucleotide
gaaatcgattgatatattatattgt

SEQ ID NO: 683951 - DNA, 25 bp, Artificial sequence
  Synthetic oligonucleotide
gaaatcgattgaaatattatattgt

SEQ ID NO: 683952 - DNA, 25 bp, Artificial sequence
  Synthetic oligonucleotide
aatctcgattataaatgtacaatat

SEQ ID NO: 683953 - DNA, 25 bp, Artificial sequence
  Synthetic oligonucleotide
aatctcgattattaatgtacaatat

SEQ ID NO: 683954 - DNA, 25 bp, Artificial sequence
  Synthetic oligonucleotide
aattcaaatatggggataattataa

SEQ ID NO: 683955 - DNA, 25 bp, Artificial sequence
  Synthetic oligonucleotide
aattcaaatatgcggataattataa

SEQ ID NO: 683956 - DNA, 25 bp, Artificial sequence
  Synthetic oligonucleotide
atatatattaagtaattcgtcaatg

SEQ ID NO: 683957 - DNA, 25 bp, Artificial sequence
  Synthetic oligonucleotide
actgatcgattatataatgataaat

SEQ ID NO: 683958 - DNA, 25 bp, Artificial sequence
  Synthetic oligonucleotide
atatatattaagaaattcgtcaatg

SEQ ID NO: 683959 - DNA, 25 bp, Artificial sequence
  Synthetic oligonucleotide
ttaatcgttaatatacaatttctag

SEQ ID NO: 683960 - DNA, 25 bp, Artificial sequence
  Synthetic oligonucleotide
tacattaacgtatatattcgataat

SEQ ID NO: 683961 - DNA, 25 bp, Artificial sequence
  Synthetic oligonucleotide
tacattaacgtaaatattcgataat

SEQ ID NO: 683962 - DNA, 25 bp, Artificial sequence
  Synthetic oligonucleotide
attagatttaactcgtaatacattt

SEQ ID NO: 683963 - DNA, 25 bp, Artificial sequence
  Synthetic oligonucleotide
attagatttaacacgtaatacattt

SEQ ID NO: 683964 - DNA, 25 bp, Artificial sequence
  Synthetic oligonucleotide
atgagaagatataatcgtatttatt

SEQ ID NO: 683965 - DNA, 25 bp, Artificial sequence
  Synthetic oligonucleotide
atagagattaacgatattatatgta

SEQ ID NO: 683966 - DNA, 25 bp, Artificial sequence
  Synthetic oligonucleotide
actgatcgattaaataatgataaat

SEQ ID NO: 683967 - DNA, 25 bp, Artificial sequence
  Synthetic oligonucleotide
ttttttatcgtatatctatatgaag

SEQ ID NO: 683968 - DNA, 25 bp, Artificial sequence
  Synthetic oligonucleotide
tcaattagttgtacgtataattata

SEQ ID NO: 683969 - DNA, 25 bp, Artificial sequence
  Synthetic oligonucleotide
atattttcgaatagttattatcgat

SEQ ID NO: 683970 - DNA, 25 bp, Artificial sequence
  Synthetic oligonucleotide
atattttcgaattgttattatcgat

SEQ ID NO: 683971 - DNA, 25 bp, Artificial sequence
  Synthetic oligonucleotide
aaatattagattcgatctattagta

SEQ ID NO: 683972 - DNA, 25 bp, Artificial sequence
  Synthetic oligonucleotide
aaatattagattggatctattagta

SEQ ID NO: 683973 - DNA, 25 bp, Artificial sequence
  Synthetic oligonucleotide
aatagatcaaatattgaacgttaaa

SEQ ID NO: 683974 - DNA, 25 bp, Artificial sequence
  Synthetic oligonucleotide
aatagatcaaattttgaacgttaaa

SEQ ID NO: 683975 - DNA, 25 bp, Artificial sequence
  Synthetic oligonucleotide
ttaggtcgacaaaattataatttat

SEQ ID NO: 683976 - DNA, 25 bp, Artificial sequence
  Synthetic oligonucleotide
tatattataagttcgtattatactg

SEQ ID NO: 683977 - DNA, 25 bp, Artificial sequence
  Synthetic oligonucleotide
gtaattgataataatacgataacaa

SEQ ID NO: 683978 - DNA, 25 bp, Artificial sequence
  Synthetic oligonucleotide
ttttttatcgtaaatctatatgaag

SEQ ID NO: 683979 - DNA, 25 bp, Artificial sequence
  Synthetic oligonucleotide
tctatttagtatattattcgttaag

SEQ ID NO: 683980 - DNA, 25 bp, Artificial sequence
  Synthetic oligonucleotide
tctatttagtattttattcgttaag

SEQ ID NO: 683981 - DNA, 25 bp, Artificial sequence
  Synthetic oligonucleotide
aacataatactttttgcgattaaat

SEQ ID NO: 683982 - DNA, 25 bp, Artificial sequence
  Synthetic oligonucleotide
aacataatacttattgcgattaaat

SEQ ID NO: 683983 - DNA, 25 bp, Artificial sequence
  Synthetic oligonucleotide
acttctataacatttcgaatttaaa

SEQ ID NO: 683984 - DNA, 25 bp, Artificial sequence
  Synthetic oligonucleotide
tttataattatctatttcgaaaagg

SEQ ID NO: 683985 - DNA, 25 bp, Artificial sequence
  Synthetic oligonucleotide
tatattataagtacgtattatactg

SEQ ID NO: 683986 - DNA, 25 bp, Artificial sequence
  Synthetic oligonucleotide
atttatttgatttcgacaattgttt

SEQ ID NO: 683987 - DNA, 25 bp, Artificial sequence
  Synthetic oligonucleotide
tatattaattaaatcgtatcaggta

SEQ ID NO: 683988 - DNA, 25 bp, Artificial sequence
  Synthetic oligonucleotide
atagagattaaccatattatatgta

SEQ ID NO: 683989 - DNA, 25 bp, Artificial sequence
  Synthetic oligonucleotide
ataatcgaattatattaagtaccta

SEQ ID NO: 683990 - DNA, 25 bp, Artificial sequence
  Synthetic oligonucleotide
ataatcgaattaaattaagtaccta

SEQ ID NO: 683991 - DNA, 25 bp, Artificial sequence
  Synthetic oligonucleotide
acaaatttgatcgtaaatatctaat

SEQ ID NO: 683992 - DNA, 25 bp, Artificial sequence
  Synthetic oligonucleotide
acaaatttgatcctaaatatctaat

SEQ ID NO: 683993 - DNA, 25 bp, Artificial sequence
  Synthetic oligonucleotide
caaactagtttaatcgttattatat

SEQ ID NO: 683994 - DNA, 25 bp, Artificial sequence
  Synthetic oligonucleotide
ttaggtcgacaatattataatttat

SEQ ID NO: 683995 - DNA, 25 bp, Artificial sequence
  Synthetic oligonucleotide
atttatttgattacgacaattgttt

SEQ ID NO: 683996 - DNA, 25 bp, Artificial sequence
  Synthetic oligonucleotide
tcaattagttgttcgtataattata

SEQ ID NO: 683997 - DNA, 25 bp, Artificial sequence
  Synthetic oligonucleotide
atgataatttaacttatcgataaca

SEQ ID NO: 683998 - DNA, 25 bp, Artificial sequence
  Synthetic oligonucleotide
atgataatttaagttatcgataaca

SEQ ID NO: 683999 - DNA, 25 bp, Artificial sequence
  Synthetic oligonucleotide
gatattagtttaacgatattacata

SEQ ID NO: 684000 - DNA, 25 bp, Artificial sequence
  Synthetic oligonucleotide
gatattagtttatcgatattacata

SEQ ID NO: 684001 - DNA, 25 bp, Artificial sequence
  Synthetic oligonucleotide
tttttttacgataacgatttataga

SEQ ID NO: 684002 - DNA, 25 bp, Artificial sequence
  Synthetic oligonucleotide
tttttttacgattacgatttataga

SEQ ID NO: 684003 - DNA, 25 bp, Artificial sequence
  Synthetic oligonucleotide
gtaattgataattatacgataacaa

SEQ ID NO: 684004 - DNA, 25 bp, Artificial sequence
  Synthetic oligonucleotide
caaactagtttattcgttattatat

SEQ ID NO: 684005 - DNA, 25 bp, Artificial sequence
  Synthetic oligonucleotide
taaaagatacgattattgtaactaa

SEQ ID NO: 684006 - DNA, 25 bp, Artificial sequence
  Synthetic oligonucleotide
tgatttatatcccttaattaatatg

SEQ ID NO: 684007 - DNA, 25 bp, Artificial sequence
  Synthetic oligonucleotide
aagtgtaacaataaatcgatattat

SEQ ID NO: 684008 - DNA, 25 bp, Artificial sequence
  Synthetic oligonucleotide
aagtgtaacaattaatcgatattat

SEQ ID NO: 684009 - DNA, 25 bp, Artificial sequence
  Synthetic oligonucleotide
gaattatttcgtttaattactcata

SEQ ID NO: 684010 - DNA, 25 bp, Artificial sequence
  Synthetic oligonucleotide
gaattatttcgtataattactcata

SEQ ID NO: 684011 - DNA, 25 bp, Artificial sequence
  Synthetic oligonucleotide
ttataatatcgtatttaaccgatat

SEQ ID NO: 684012 - DNA, 25 bp, Artificial sequence
  Synthetic oligonucleotide
aaaaactaacgaatcgatattaata

SEQ ID NO: 684013 - DNA, 25 bp, Artificial sequence
  Synthetic oligonucleotide
taaaagatacgaatattgtaactaa

SEQ ID NO: 684014 - DNA, 25 bp, Artificial sequence
  Synthetic oligonucleotide
tgtaatttacgataatatcttaaac

SEQ ID NO: 684015 - DNA, 25 bp, Artificial sequence
  Synthetic oligonucleotide
gataattattaccaatcatttaaga

SEQ ID NO: 684016 - DNA, 25 bp, Artificial sequence
  Synthetic oligonucleotide
gataattattacgaatcatttaaga

SEQ ID NO: 684017 - DNA, 25 bp, Artificial sequence
  Synthetic oligonucleotide
aacattacgattgtaaattatttca

SEQ ID NO: 684018 - DNA, 25 bp, Artificial sequence
  Synthetic oligonucleotide
aacattacgattctaaattatttca

SEQ ID NO: 684019 - DNA, 25 bp, Artificial sequence
  Synthetic oligonucleotide
cttttatcaaattcgtctattaatt

SEQ ID NO: 684020 - DNA, 25 bp, Artificial sequence
  Synthetic oligonucleotide
cttttatcaaatacgtctattaatt

SEQ ID NO: 684021 - DNA, 25 bp, Artificial sequence
  Synthetic oligonucleotide
ttgatgtattaccgttaaataaatt

SEQ ID NO: 684022 - DNA, 25 bp, Artificial sequence
  Synthetic oligonucleotide
ttataatatcgtttttaaccgatat

SEQ ID NO: 684023 - DNA, 25 bp, Artificial sequence
  Synthetic oligonucleotide
catttttaatattatcgttctaaac

SEQ ID NO: 684024 - DNA, 25 bp, Artificial sequence
  Synthetic oligonucleotide
tatctgatacataattcgtatatta

SEQ ID NO: 684025 - DNA, 25 bp, Artificial sequence
  Synthetic oligonucleotide
tatctgatacattattcgtatatta

SEQ ID NO: 684026 - DNA, 25 bp, Artificial sequence
  Synthetic oligonucleotide
tatctatacttattcgtaatactaa

SEQ ID NO: 684027 - DNA, 25 bp, Artificial sequence
  Synthetic oligonucleotide
tatctatacttaatcgtaatactaa

SEQ ID NO: 684028 - DNA, 25 bp, Artificial sequence
  Synthetic oligonucleotide
aatgtattaagttcgattaacaatt

SEQ ID NO: 684029 - DNA, 25 bp, Artificial sequence
  Synthetic oligonucleotide
aatgtattaagtacgattaacaatt

SEQ ID NO: 684030 - DNA, 25 bp, Artificial sequence
  Synthetic oligonucleotide
tatagattagatatcgatatattct

SEQ ID NO: 684031 - DNA, 25 bp, Artificial sequence
  Synthetic oligonucleotide
tgatttatatccgttaattaatatg

SEQ ID NO: 684032 - DNA, 25 bp, Artificial sequence
  Synthetic oligonucleotide
catttttaatataatcgttctaaac

SEQ ID NO: 684033 - DNA, 25 bp, Artificial sequence
  Synthetic oligonucleotide
tgtaatttacgaaaatatcttaaac

SEQ ID NO: 684034 - DNA, 25 bp, Artificial sequence
  Synthetic oligonucleotide
tatattattataggcgaaaatctaa

SEQ ID NO: 684035 - DNA, 25 bp, Artificial sequence
  Synthetic oligonucleotide
tatattattatacgcgaaaatctaa

SEQ ID NO: 684036 - DNA, 25 bp, Artificial sequence
  Synthetic oligonucleotide
attatacggttattttaatagaaca

SEQ ID NO: 684037 - DNA, 25 bp, Artificial sequence
  Synthetic oligonucleotide
attatacggttaatttaatagaaca

SEQ ID NO: 684038 - DNA, 25 bp, Artificial sequence
  Synthetic oligonucleotide
aataatttatatgaatcgcttagaa

SEQ ID NO: 684039 - DNA, 25 bp, Artificial sequence
  Synthetic oligonucleotide
aataatttatatcaatcgcttagaa

SEQ ID NO: 684040 - DNA, 25 bp, Artificial sequence
  Synthetic oligonucleotide
ttagtattaattacgaacaatctaa

SEQ ID NO: 684041 - DNA, 25 bp, Artificial sequence
  Synthetic oligonucleotide
tatagattagatttcgatatattct

SEQ ID NO: 684042 - DNA, 25 bp, Artificial sequence
  Synthetic oligonucleotide
tattcttcgaatttaagttagataa

SEQ ID NO: 684043 - DNA, 25 bp, Artificial sequence
  Synthetic oligonucleotide
ttgatgtattacggttaaataaatt

SEQ ID NO: 684044 - DNA, 25 bp, Artificial sequence
  Synthetic oligonucleotide
attaattatctagattgcgaatttt

SEQ ID NO: 684045 - DNA, 25 bp, Artificial sequence
  Synthetic oligonucleotide
cttattcgtaacaagataaatatat

SEQ ID NO: 684046 - DNA, 25 bp, Artificial sequence
  Synthetic oligonucleotide
cttattcgtaactagataaatatat

SEQ ID NO: 684047 - DNA, 25 bp, Artificial sequence
  Synthetic oligonucleotide
atatatgatattttaatcggatgaa

SEQ ID NO: 684048 - DNA, 25 bp, Artificial sequence
  Synthetic oligonucleotide
atatatgatattataatcggatgaa

SEQ ID NO: 684049 - DNA, 25 bp, Artificial sequence
  Synthetic oligonucleotide
attgttatttaccagattaatgatt

SEQ ID NO: 684050 - DNA, 25 bp, Artificial sequence
  Synthetic oligonucleotide
taattgacgttattataatacagtt

SEQ ID NO: 684051 - DNA, 25 bp, Artificial sequence
  Synthetic oligonucleotide
tattcttcgaatataagttagataa

SEQ ID NO: 684052 - DNA, 25 bp, Artificial sequence
  Synthetic oligonucleotide
taattgacgttaatataatacagtt

SEQ ID NO: 684053 - DNA, 25 bp, Artificial sequence
  Synthetic oligonucleotide
atttttcgtctatgttatatagaaa

SEQ ID NO: 684054 - DNA, 25 bp, Artificial sequence
  Synthetic oligonucleotide
atttttcgtctaagttatatagaaa

SEQ ID NO: 684055 - DNA, 25 bp, Artificial sequence
  Synthetic oligonucleotide
ttgttttccgaaaatttataaaatc

SEQ ID NO: 684056 - DNA, 25 bp, Artificial sequence
  Synthetic oligonucleotide
ttgttttccgaatatttataaaatc

SEQ ID NO: 684057 - DNA, 25 bp, Artificial sequence
  Synthetic oligonucleotide
tttatctatttaatgcgaataagta

SEQ ID NO: 684058 - DNA, 25 bp, Artificial sequence
  Synthetic oligonucleotide
tttatctatttattgcgaataagta

SEQ ID NO: 684059 - DNA, 25 bp, Artificial sequence
  Synthetic oligonucleotide
tatattaattaattcgtatcaggta

SEQ ID NO: 684060 - DNA, 25 bp, Artificial sequence
  Synthetic oligonucleotide
attgttatttacgagattaatgatt

SEQ ID NO: 684061 - DNA, 25 bp, Artificial sequence
  Synthetic oligonucleotide
atctattcgatataatgtaattctt

SEQ ID NO: 684062 - DNA, 25 bp, Artificial sequence
  Synthetic oligonucleotide
tgtattataataggtctaaactata

SEQ ID NO: 684063 - DNA, 25 bp, Artificial sequence
  Synthetic oligonucleotide
atagatatatctttcgataaaaaca

SEQ ID NO: 684064 - DNA, 25 bp, Artificial sequence
  Synthetic oligonucleotide
atagatatatctatcgataaaaaca

SEQ ID NO: 684065 - DNA, 25 bp, Artificial sequence
  Synthetic oligonucleotide
gtaactatatcgtattacaaatatt

SEQ ID NO: 684066 - DNA, 25 bp, Artificial sequence
  Synthetic oligonucleotide
gtaactatatcgaattacaaatatt

SEQ ID NO: 684067 - DNA, 25 bp, Artificial sequence
  Synthetic oligonucleotide
taatgactattaggttaatttcata

SEQ ID NO: 684068 - DNA, 25 bp, Artificial sequence
  Synthetic oligonucleotide
taatgactattacgttaatttcata

SEQ ID NO: 684069 - DNA, 25 bp, Artificial sequence
  Synthetic oligonucleotide
attaattatctacattgcgaatttt

SEQ ID NO: 684070 - DNA, 25 bp, Artificial sequence
  Synthetic oligonucleotide
ataggacgatatcaataaatataat

SEQ ID NO: 684071 - DNA, 25 bp, Artificial sequence
  Synthetic oligonucleotide
ttagtattaatttcgaacaatctaa

SEQ ID NO: 684072 - DNA, 25 bp, Artificial sequence
  Synthetic oligonucleotide
atctattcgataaaatgtaattctt

SEQ ID NO: 684073 - DNA, 25 bp, Artificial sequence
  Synthetic oligonucleotide
taatgatcggattatttaattacaa

SEQ ID NO: 684074 - DNA, 25 bp, Artificial sequence
  Synthetic oligonucleotide
taatgatcggataatttaattacaa

SEQ ID NO: 684075 - DNA, 25 bp, Artificial sequence
  Synthetic oligonucleotide
tataatattattggataagaagcaa

SEQ ID NO: 684076 - DNA, 25 bp, Artificial sequence
  Synthetic oligonucleotide
tataatattattcgataagaagcaa

SEQ ID NO: 684077 - DNA, 25 bp, Artificial sequence
  Synthetic oligonucleotide
aatagttataactttaacgattcaa

SEQ ID NO: 684078 - DNA, 25 bp, Artificial sequence
  Synthetic oligonucleotide
aatagttataacattaacgattcaa

SEQ ID NO: 684079 - DNA, 25 bp, Artificial sequence
  Synthetic oligonucleotide
ataggacgatatgaataaatataat

SEQ ID NO: 684080 - DNA, 25 bp, Artificial sequence
  Synthetic oligonucleotide
acacttacttatttcgattatttta

SEQ ID NO: 684081 - DNA, 25 bp, Artificial sequence
  Synthetic oligonucleotide
ttcatgtttatttgtcgaattttat

SEQ ID NO: 684082 - DNA, 25 bp, Artificial sequence
  Synthetic oligonucleotide
ttcatgtttattagtcgaattttat

SEQ ID NO: 684083 - DNA, 25 bp, Artificial sequence
  Synthetic oligonucleotide
aatttctatagacgttataatcata

SEQ ID NO: 684084 - DNA, 25 bp, Artificial sequence
  Synthetic oligonucleotide
aatttctatagaggttataatcata

SEQ ID NO: 684085 - DNA, 25 bp, Artificial sequence
  Synthetic oligonucleotide
aaaatatcgagtttaaatacaaatc

SEQ ID NO: 684086 - DNA, 25 bp, Artificial sequence
  Synthetic oligonucleotide
aaaatatcgagtataaatacaaatc

SEQ ID NO: 684087 - DNA, 25 bp, Artificial sequence
  Synthetic oligonucleotide
tgatcatttatgtttaaacgtttta

SEQ ID NO: 684088 - DNA, 25 bp, Artificial sequence
  Synthetic oligonucleotide
tattacgaaacttatagatacaata

SEQ ID NO: 684089 - DNA, 25 bp, Artificial sequence
  Synthetic oligonucleotide
atatattatcgataatcaatacgta

SEQ ID NO: 684090 - DNA, 25 bp, Artificial sequence
  Synthetic oligonucleotide
acacttacttatatcgattatttta

SEQ ID NO: 684091 - DNA, 25 bp, Artificial sequence
  Synthetic oligonucleotide
aaatttcgtacttgttatatcaaaa

SEQ ID NO: 684092 - DNA, 25 bp, Artificial sequence
  Synthetic oligonucleotide
aaatttcgtactagttatatcaaaa

SEQ ID NO: 684093 - DNA, 25 bp, Artificial sequence
  Synthetic oligonucleotide
ttaattataaagtaattcgcattct

SEQ ID NO: 684094 - DNA, 25 bp, Artificial sequence
  Synthetic oligonucleotide
ttaattataaagaaattcgcattct

SEQ ID NO: 684095 - DNA, 25 bp, Artificial sequence
  Synthetic oligonucleotide
tgtatatcgaataaacattactaaa

SEQ ID NO: 684096 - DNA, 25 bp, Artificial sequence
  Synthetic oligonucleotide
tgtatatcgaattaacattactaaa

SEQ ID NO: 684097 - DNA, 25 bp, Artificial sequence
  Synthetic oligonucleotide
tattacgaaactaatagatacaata

SEQ ID NO: 684098 - DNA, 25 bp, Artificial sequence
  Synthetic oligonucleotide
ttttttcgaaattgataattgcaaa

SEQ ID NO: 684099 - DNA, 25 bp, Artificial sequence
  Synthetic oligonucleotide
acttctataacaattcgaatttaaa

SEQ ID NO: 684100 - DNA, 25 bp, Artificial sequence
  Synthetic oligonucleotide
ataattaatcaaattattcgcagtt

SEQ ID NO: 684101 - DNA, 25 bp, Artificial sequence
  Synthetic oligonucleotide
ataattaatcaatttattcgcagtt

SEQ ID NO: 684102 - DNA, 25 bp, Artificial sequence
  Synthetic oligonucleotide
tatagacgtagatctaataaatatt

SEQ ID NO: 684103 - DNA, 25 bp, Artificial sequence
  Synthetic oligonucleotide
tatagacgtagaactaataaatatt

SEQ ID NO: 684104 - DNA, 25 bp, Artificial sequence
  Synthetic oligonucleotide
gtattatcataattcgtatagtaat

SEQ ID NO: 684105 - DNA, 25 bp, Artificial sequence
  Synthetic oligonucleotide
gtattatcataaatcgtatagtaat

SEQ ID NO: 684106 - DNA, 25 bp, Artificial sequence
  Synthetic oligonucleotide
gtgttatacgattactatattaatt

SEQ ID NO: 684107 - DNA, 25 bp, Artificial sequence
  Synthetic oligonucleotide
atctaaatacgaaatctatttacta

SEQ ID NO: 684108 - DNA, 25 bp, Artificial sequence
  Synthetic oligonucleotide
gtgttatacgataactatattaatt

SEQ ID NO: 684109 - DNA, 25 bp, Artificial sequence
  Synthetic oligonucleotide
ttttttcgaaatagataattgcaaa

SEQ ID NO: 684110 - DNA, 25 bp, Artificial sequence
  Synthetic oligonucleotide
atccttttataaagttcgatttata

SEQ ID NO: 684111 - DNA, 25 bp, Artificial sequence
  Synthetic oligonucleotide
atccttttataatgttcgatttata

SEQ ID NO: 684112 - DNA, 25 bp, Artificial sequence
  Synthetic oligonucleotide
ttgaacgtttaaatagaataatctt

SEQ ID NO: 684113 - DNA, 25 bp, Artificial sequence
  Synthetic oligonucleotide
ttgaacgtttaattagaataatctt

SEQ ID NO: 684114 - DNA, 25 bp, Artificial sequence
  Synthetic oligonucleotide
atatattatcgaaaatcaatacgta

SEQ ID NO: 684115 - DNA, 25 bp, Artificial sequence
  Synthetic oligonucleotide
gaattatcgaaaattgatctttatt

SEQ ID NO: 684116 - DNA, 25 bp, Artificial sequence
  Synthetic oligonucleotide
atctaaatacgatatctatttacta

SEQ ID NO: 684117 - DNA, 25 bp, Artificial sequence
  Synthetic oligonucleotide
tttcttatacgattcataatttact

SEQ ID NO: 684118 - DNA, 25 bp, Artificial sequence
  Synthetic oligonucleotide
aatagttagtattattcgattaatg

SEQ ID NO: 684119 - DNA, 25 bp, Artificial sequence
  Synthetic oligonucleotide
aatctttttatttgttcgaaataca

SEQ ID NO: 684120 - DNA, 25 bp, Artificial sequence
  Synthetic oligonucleotide
aatctttttattagttcgaaataca

SEQ ID NO: 684121 - DNA, 25 bp, Artificial sequence
  Synthetic oligonucleotide
gagatatcgtttagtattaattaat

SEQ ID NO: 684122 - DNA, 25 bp, Artificial sequence
  Synthetic oligonucleotide
gagatatcgttttgtattaattaat

SEQ ID NO: 684123 - DNA, 25 bp, Artificial sequence
  Synthetic oligonucleotide
tgaattcttatcgtatattatactt

SEQ ID NO: 684124 - DNA, 25 bp, Artificial sequence
  Synthetic oligonucleotide
tgaattcttatcctatattatactt

SEQ ID NO: 684125 - DNA, 25 bp, Artificial sequence
  Synthetic oligonucleotide
acagttacttaccaattatattatt

SEQ ID NO: 684126 - DNA, 25 bp, Artificial sequence
  Synthetic oligonucleotide
actagaactatcgaaattatttatt

SEQ ID NO: 684127 - DNA, 25 bp, Artificial sequence
  Synthetic oligonucleotide
atagttctaatgcgataatatttta

SEQ ID NO: 684128 - DNA, 25 bp, Artificial sequence
  Synthetic oligonucleotide
tttcttatacgaatcataatttact

SEQ ID NO: 684129 - DNA, 25 bp, Artificial sequence
  Synthetic oligonucleotide
gttcatattaataagtacgataaat

SEQ ID NO: 684130 - DNA, 25 bp, Artificial sequence
  Synthetic oligonucleotide
gttcatattaattagtacgataaat

SEQ ID NO: 684131 - DNA, 25 bp, Artificial sequence
  Synthetic oligonucleotide
taatagataaccctatcatttttat

SEQ ID NO: 684132 - DNA, 25 bp, Artificial sequence
  Synthetic oligonucleotide
taatagataaccgtatcatttttat

SEQ ID NO: 684133 - DNA, 25 bp, Artificial sequence
  Synthetic oligonucleotide
tttatttgtattaaatcgatttgca

SEQ ID NO: 684134 - DNA, 25 bp, Artificial sequence
  Synthetic oligonucleotide
tttatttgtatttaatcgatttgca

SEQ ID NO: 684135 - DNA, 25 bp, Artificial sequence
  Synthetic oligonucleotide
actagaactatccaaattatttatt

SEQ ID NO: 684136 - DNA, 25 bp, Artificial sequence
  Synthetic oligonucleotide
ttatatcaaattggtaattatcaac

SEQ ID NO: 684137 - DNA, 25 bp, Artificial sequence
  Synthetic oligonucleotide
gaaacagtattaatatcgaaattat

SEQ ID NO: 684138 - DNA, 25 bp, Artificial sequence
  Synthetic oligonucleotide
gaattatcgaaatttgatctttatt

SEQ ID NO: 684139 - DNA, 25 bp, Artificial sequence
  Synthetic oligonucleotide
tcctataataagttcgaataatttt

SEQ ID NO: 684140 - DNA, 25 bp, Artificial sequence
  Synthetic oligonucleotide
tcctataataagatcgaataatttt

SEQ ID NO: 684141 - DNA, 25 bp, Artificial sequence
  Synthetic oligonucleotide
ttaatgttaataaacaacgtttagt

SEQ ID NO: 684142 - DNA, 25 bp, Artificial sequence
  Synthetic oligonucleotide
ttaatgttaatatacaacgtttagt

SEQ ID NO: 684143 - DNA, 25 bp, Artificial sequence
  Synthetic oligonucleotide
gtattattagttaattacgattgat

SEQ ID NO: 684144 - DNA, 25 bp, Artificial sequence
  Synthetic oligonucleotide
acagttacttacgaattatattatt

SEQ ID NO: 684145 - DNA, 25 bp, Artificial sequence
  Synthetic oligonucleotide
ttatatcaaattcgtaattatcaac

SEQ ID NO: 684146 - DNA, 25 bp, Artificial sequence
  Synthetic oligonucleotide
aatagttagtataattcgattaatg

SEQ ID NO: 684147 - DNA, 25 bp, Artificial sequence
  Synthetic oligonucleotide
tttttgataatgcgcaataatattt

SEQ ID NO: 684148 - DNA, 25 bp, Artificial sequence
  Synthetic oligonucleotide
tttttgataatgggcaataatattt

SEQ ID NO: 684149 - DNA, 25 bp, Artificial sequence
  Synthetic oligonucleotide
taaagtaatatttcgaagattaatc

SEQ ID NO: 684150 - DNA, 25 bp, Artificial sequence
  Synthetic oligonucleotide
taaagtaatattacgaagattaatc

SEQ ID NO: 684151 - DNA, 25 bp, Artificial sequence
  Synthetic oligonucleotide
aaatcatgatataaatcgaagtaaa

SEQ ID NO: 684152 - DNA, 25 bp, Artificial sequence
  Synthetic oligonucleotide
aaatcatgatattaatcgaagtaaa

SEQ ID NO: 684153 - DNA, 25 bp, Artificial sequence
  Synthetic oligonucleotide
atagttctaatgggataatatttta

SEQ ID NO: 684154 - DNA, 25 bp, Artificial sequence
  Synthetic oligonucleotide
gtattattagtttattacgattgat

SEQ ID NO: 684155 - DNA, 25 bp, Artificial sequence
  Synthetic oligonucleotide
tagtaatttaaaacgttagaaacaa

SEQ ID NO: 684156 - DNA, 25 bp, Artificial sequence
  Synthetic oligonucleotide
aattgtattatcggttagaatttta

SEQ ID NO: 684157 - DNA, 25 bp, Artificial sequence
  Synthetic oligonucleotide
tattttaacgataaatatctgtaag

SEQ ID NO: 684158 - DNA, 25 bp, Artificial sequence
  Synthetic oligonucleotide
tattttaacgattaatatctgtaag

SEQ ID NO: 684159 - DNA, 25 bp, Artificial sequence
  Synthetic oligonucleotide
aatttatatattgggattaatgaga

SEQ ID NO: 684160 - DNA, 25 bp, Artificial sequence
  Synthetic oligonucleotide
aatttatatattcggattaatgaga

SEQ ID NO: 684161 - DNA, 25 bp, Artificial sequence
  Synthetic oligonucleotide
aattttcttatcaacgattatatag

SEQ ID NO: 684162 - DNA, 25 bp, Artificial sequence
  Synthetic oligonucleotide
atgaatctaaacgatattaatattg

SEQ ID NO: 684163 - DNA, 25 bp, Artificial sequence
  Synthetic oligonucleotide
tagtaatttaaatcgttagaaacaa

SEQ ID NO: 684164 - DNA, 25 bp, Artificial sequence
  Synthetic oligonucleotide
taacaaatttttggataactaagat

SEQ ID NO: 684165 - DNA, 25 bp, Artificial sequence
  Synthetic oligonucleotide
attgttactacgtaaattatgatat

SEQ ID NO: 684166 - DNA, 25 bp, Artificial sequence
  Synthetic oligonucleotide
attgttactacgaaaattatgatat

SEQ ID NO: 684167 - DNA, 25 bp, Artificial sequence
  Synthetic oligonucleotide
cattagcgattatttaatattgtaa

SEQ ID NO: 684168 - DNA, 25 bp, Artificial sequence
  Synthetic oligonucleotide
cattagcgattaattaatattgtaa

SEQ ID NO: 684169 - DNA, 25 bp, Artificial sequence
  Synthetic oligonucleotide
taaaccgatgttatattatatgata

SEQ ID NO: 684170 - DNA, 25 bp, Artificial sequence
  Synthetic oligonucleotide
taaaccgatgttttattatatgata

SEQ ID NO: 684171 - DNA, 25 bp, Artificial sequence
  Synthetic oligonucleotide
tgatcatttatgattaaacgtttta

SEQ ID NO: 684172 - DNA, 25 bp, Artificial sequence
  Synthetic oligonucleotide
aattttcttatctacgattatatag

SEQ ID NO: 684173 - DNA, 25 bp, Artificial sequence
  Synthetic oligonucleotide
gttctctataaccatattattaatt

SEQ ID NO: 684174 - DNA, 25 bp, Artificial sequence
  Synthetic oligonucleotide
tttctttatatcgtataagatgatt

SEQ ID NO: 684175 - DNA, 25 bp, Artificial sequence
  Synthetic oligonucleotide
tttctttatatcctataagatgatt

SEQ ID NO: 684176 - DNA, 25 bp, Artificial sequence
  Synthetic oligonucleotide
tcaaatttaagtaaattcgtacaat

SEQ ID NO: 684177 - DNA, 25 bp, Artificial sequence
  Synthetic oligonucleotide
tcaaatttaagttaattcgtacaat

SEQ ID NO: 684178 - DNA, 25 bp, Artificial sequence
  Synthetic oligonucleotide
tttctattatttttctacgatatag

SEQ ID NO: 684179 - DNA, 25 bp, Artificial sequence
  Synthetic oligonucleotide
tttctattatttatctacgatatag

SEQ ID NO: 684180 - DNA, 25 bp, Artificial sequence
  Synthetic oligonucleotide
atcattaacgatagttatatttgaa

SEQ ID NO: 684181 - DNA, 25 bp, Artificial sequence
  Synthetic oligonucleotide
aattgtattatccgttagaatttta

SEQ ID NO: 684182 - DNA, 25 bp, Artificial sequence
  Synthetic oligonucleotide
gttctctataacgatattattaatt

SEQ ID NO: 684183 - DNA, 25 bp, Artificial sequence
  Synthetic oligonucleotide
taacaaatttttcgataactaagat

SEQ ID NO: 684184 - DNA, 25 bp, Artificial sequence
  Synthetic oligonucleotide
atgattttaatgtttaatcgctatt

SEQ ID NO: 684185 - DNA, 25 bp, Artificial sequence
  Synthetic oligonucleotide
atgattttaatgattaatcgctatt

SEQ ID NO: 684186 - DNA, 25 bp, Artificial sequence
  Synthetic oligonucleotide
ctaaattttcgaatctaatataaga

SEQ ID NO: 684187 - DNA, 25 bp, Artificial sequence
  Synthetic oligonucleotide
ctaaattttcgattctaatataaga

SEQ ID NO: 684188 - DNA, 25 bp, Artificial sequence
  Synthetic oligonucleotide
cactacatcgtatatttataaattt

SEQ ID NO: 684189 - DNA, 25 bp, Artificial sequence
  Synthetic oligonucleotide
cactacatcgtaaatttataaattt

SEQ ID NO: 684190 - DNA, 25 bp, Artificial sequence
  Synthetic oligonucleotide
ctaaaataatatcgctgtaattaaa

SEQ ID NO: 684191 - DNA, 25 bp, Artificial sequence
  Synthetic oligonucleotide
atcattaacgattgttatatttgaa

SEQ ID NO: 684192 - DNA, 25 bp, Artificial sequence
  Synthetic oligonucleotide
aaacaacgtttatatataagcttaa

SEQ ID NO: 684193 - DNA, 25 bp, Artificial sequence
  Synthetic oligonucleotide
atgaatctaaaccatattaatattg

SEQ ID NO: 684194 - DNA, 25 bp, Artificial sequence
  Synthetic oligonucleotide
taacatcggtatgattaataaaata

SEQ ID NO: 684195 - DNA, 25 bp, Artificial sequence
  Synthetic oligonucleotide
ataatttatgtttgtttcgtcttat

SEQ ID NO: 684196 - DNA, 25 bp, Artificial sequence
  Synthetic oligonucleotide
ataatttatgttagtttcgtcttat

SEQ ID NO: 684197 - DNA, 25 bp, Artificial sequence
  Synthetic oligonucleotide
aataaacttattttattcgactatc

SEQ ID NO: 684198 - DNA, 25 bp, Artificial sequence
  Synthetic oligonucleotide
aataaacttattatattcgactatc

SEQ ID NO: 684199 - DNA, 25 bp, Artificial sequence
  Synthetic oligonucleotide
tctctttattatggaactaaaaata

SEQ ID NO: 684200 - DNA, 25 bp, Artificial sequence
  Synthetic oligonucleotide
tttaacgtattggtctttaaaaata

SEQ ID NO: 684201 - DNA, 25 bp, Artificial sequence
  Synthetic oligonucleotide
aaacaacgtttaaatataagcttaa

SEQ ID NO: 684202 - DNA, 25 bp, Artificial sequence
  Synthetic oligonucleotide
tttaacgtattgctctttaaaaata

SEQ ID NO: 684203 - DNA, 25 bp, Artificial sequence
  Synthetic oligonucleotide
ttaattaatcttaacatacgttact

SEQ ID NO: 684204 - DNA, 25 bp, Artificial sequence
  Synthetic oligonucleotide
ttaattaatctttacatacgttact

SEQ ID NO: 684205 - DNA, 25 bp, Artificial sequence
  Synthetic oligonucleotide
taaaatactataataatgcgaagat

SEQ ID NO: 684206 - DNA, 25 bp, Artificial sequence
  Synthetic oligonucleotide
taaaatactatattaatgcgaagat

SEQ ID NO: 684207 - DNA, 25 bp, Artificial sequence
  Synthetic oligonucleotide
tcttttatgttcgatataatgaaat

SEQ ID NO: 684208 - DNA, 25 bp, Artificial sequence
  Synthetic oligonucleotide
tcttttatgttccatataatgaaat

SEQ ID NO: 684209 - DNA, 25 bp, Artificial sequence
  Synthetic oligonucleotide
gaaacagtattattatcgaaattat

SEQ ID NO: 684210 - DNA, 25 bp, Artificial sequence
  Synthetic oligonucleotide
tctctttattatcgaactaaaaata

SEQ ID NO: 684211 - DNA, 25 bp, Artificial sequence
  Synthetic oligonucleotide
tttgatcgaaataattagtttaaac

SEQ ID NO: 684212 - DNA, 25 bp, Artificial sequence
  Synthetic oligonucleotide
ctaaaataatatggctgtaattaaa

SEQ ID NO: 684213 - DNA, 25 bp, Artificial sequence
  Synthetic oligonucleotide
tatattataatttcgtaatgttcga

SEQ ID NO: 684214 - DNA, 25 bp, Artificial sequence
  Synthetic oligonucleotide
tatattataattacgtaatgttcga

SEQ ID NO: 684215 - DNA, 25 bp, Artificial sequence
  Synthetic oligonucleotide
atgaatacgaatgattattagataa

SEQ ID NO: 684216 - DNA, 25 bp, Artificial sequence
  Synthetic oligonucleotide
atgaatacgaatcattattagataa

SEQ ID NO: 684217 - DNA, 25 bp, Artificial sequence
  Synthetic oligonucleotide
ttatttacgtataaatcgtttgtta

SEQ ID NO: 684218 - DNA, 25 bp, Artificial sequence
  Synthetic oligonucleotide
taacatcggtatcattaataaaata

SEQ ID NO: 684219 - DNA, 25 bp, Artificial sequence
  Synthetic oligonucleotide
tttgatcgaaattattagtttaaac

SEQ ID NO: 684220 - DNA, 25 bp, Artificial sequence
  Synthetic oligonucleotide
aatatattagtatttcgtaaagcaa

SEQ ID NO: 684221 - DNA, 25 bp, Artificial sequence
  Synthetic oligonucleotide
tttttatagttaacgataaattcga

SEQ ID NO: 684222 - DNA, 25 bp, Artificial sequence
  Synthetic oligonucleotide
tttttatagttatcgataaattcga

SEQ ID NO: 684223 - DNA, 25 bp, Artificial sequence
  Synthetic oligonucleotide
cttaaatcggtattataatattact

SEQ ID NO: 684224 - DNA, 25 bp, Artificial sequence
  Synthetic oligonucleotide
cttaaatcggtaatataatattact

SEQ ID NO: 684225 - DNA, 25 bp, Artificial sequence
  Synthetic oligonucleotide
aattattattcgtaatctaaatcga

SEQ ID NO: 684226 - DNA, 25 bp, Artificial sequence
  Synthetic oligonucleotide
aattattattcgaaatctaaatcga

SEQ ID NO: 684227 - DNA, 25 bp, Artificial sequence
  Synthetic oligonucleotide
tatttttcgaaagttattatgacta

SEQ ID NO: 684228 - DNA, 25 bp, Artificial sequence
  Synthetic oligonucleotide
tatttttcgaaacttattatgacta

SEQ ID NO: 684229 - DNA, 25 bp, Artificial sequence
  Synthetic oligonucleotide
ttatttacgtattaatcgtttgtta

SEQ ID NO: 684230 - DNA, 25 bp, Artificial sequence
  Synthetic oligonucleotide
caaatattagtcacatcgtatatat

SEQ ID NO: 684231 - DNA, 25 bp, Artificial sequence
  Synthetic oligonucleotide
aagatgtatatttagcgaatattag

SEQ ID NO: 684232 - DNA, 25 bp, Artificial sequence
  Synthetic oligonucleotide
gtcctgtatattttaatcgattaaa

SEQ ID NO: 684233 - DNA, 25 bp, Artificial sequence
  Synthetic oligonucleotide
ggtatttatacgtttacttatacaa

SEQ ID NO: 684234 - DNA, 25 bp, Artificial sequence
  Synthetic oligonucleotide
ggtatttatacgattacttatacaa

SEQ ID NO: 684235 - DNA, 25 bp, Artificial sequence
  Synthetic oligonucleotide
atgattcgattaataatctaaaacg

SEQ ID NO: 684236 - DNA, 25 bp, Artificial sequence
  Synthetic oligonucleotide
atgattcgattattaatctaaaacg

SEQ ID NO: 684237 - DNA, 25 bp, Artificial sequence
  Synthetic oligonucleotide
gtgattaattttcgactaaatactt

SEQ ID NO: 684238 - DNA, 25 bp, Artificial sequence
  Synthetic oligonucleotide
gtgattaattttggactaaatactt

SEQ ID NO: 684239 - DNA, 25 bp, Artificial sequence
  Synthetic oligonucleotide
caatacaatctatttacgaagatta

SEQ ID NO: 684240 - DNA, 25 bp, Artificial sequence
  Synthetic oligonucleotide
caatacaatctaattacgaagatta

SEQ ID NO: 684241 - DNA, 25 bp, Artificial sequence
  Synthetic oligonucleotide
taaatgcgttatatttcactgataa

SEQ ID NO: 684242 - DNA, 25 bp, Artificial sequence
  Synthetic oligonucleotide
aaagttctattcgatataaaatcgt

SEQ ID NO: 684243 - DNA, 25 bp, Artificial sequence
  Synthetic oligonucleotide
aattacgaattatttatctagcact

SEQ ID NO: 684244 - DNA, 25 bp, Artificial sequence
  Synthetic oligonucleotide
aagatgtatattaagcgaatattag

SEQ ID NO: 684245 - DNA, 25 bp, Artificial sequence
  Synthetic oligonucleotide
aaagttttcgatgatcatatactaa

SEQ ID NO: 684246 - DNA, 25 bp, Artificial sequence
  Synthetic oligonucleotide
aaagttttcgatcatcatatactaa

SEQ ID NO: 684247 - DNA, 25 bp, Artificial sequence
  Synthetic oligonucleotide
ttttttaatttcctcaattagtcca

SEQ ID NO: 684248 - DNA, 25 bp, Artificial sequence
  Synthetic oligonucleotide
ttttttaatttcgtcaattagtcca

SEQ ID NO: 684249 - DNA, 25 bp, Artificial sequence
  Synthetic oligonucleotide
gtaaaaagttcgtttgaatatgata

SEQ ID NO: 684250 - DNA, 25 bp, Artificial sequence
  Synthetic oligonucleotide
gtaaaaagttcgattgaatatgata

SEQ ID NO: 684251 - DNA, 25 bp, Artificial sequence
  Synthetic oligonucleotide
aatatgtacggtataattaaggaat

SEQ ID NO: 684252 - DNA, 25 bp, Artificial sequence
  Synthetic oligonucleotide
aatatgtacggtttaattaaggaat

SEQ ID NO: 684253 - DNA, 25 bp, Artificial sequence
  Synthetic oligonucleotide
atgaataaacttacgctttaaaatg

SEQ ID NO: 684254 - DNA, 25 bp, Artificial sequence
  Synthetic oligonucleotide
aaagttctattccatataaaatcgt

SEQ ID NO: 684255 - DNA, 25 bp, Artificial sequence
  Synthetic oligonucleotide
aaaggatatatccgttaatacattt

SEQ ID NO: 684256 - DNA, 25 bp, Artificial sequence
  Synthetic oligonucleotide
tacatatatcgtggttataatttga

SEQ ID NO: 684257 - DNA, 25 bp, Artificial sequence
  Synthetic oligonucleotide
tacatatatcgtcgttataatttga

SEQ ID NO: 684258 - DNA, 25 bp, Artificial sequence
  Synthetic oligonucleotide
aacaccgtaataaatcttgtatatt

SEQ ID NO: 684259 - DNA, 25 bp, Artificial sequence
  Synthetic oligonucleotide
aacaccgtaatatatcttgtatatt

SEQ ID NO: 684260 - DNA, 25 bp, Artificial sequence
  Synthetic oligonucleotide
ctagagacgaaaattgtaaaatatt

SEQ ID NO: 684261 - DNA, 25 bp, Artificial sequence
  Synthetic oligonucleotide
ctagagacgaaatttgtaaaatatt

SEQ ID NO: 684262 - DNA, 25 bp, Artificial sequence
  Synthetic oligonucleotide
tacaacgtcataaagtattacttta

SEQ ID NO: 684263 - DNA, 25 bp, Artificial sequence
  Synthetic oligonucleotide
tacaacgtcatatagtattacttta

SEQ ID NO: 684264 - DNA, 25 bp, Artificial sequence
  Synthetic oligonucleotide
tattaatattgaatttcggtatagg

SEQ ID NO: 684265 - DNA, 25 bp, Artificial sequence
  Synthetic oligonucleotide
tattaatattgattttcggtatagg

SEQ ID NO: 684266 - DNA, 25 bp, Artificial sequence
  Synthetic oligonucleotide
gtcctgtatattataatcgattaaa

SEQ ID NO: 684267 - DNA, 25 bp, Artificial sequence
  Synthetic oligonucleotide
actattatttagggactaaattgat

SEQ ID NO: 684268 - DNA, 25 bp, Artificial sequence
  Synthetic oligonucleotide
aattacgaattaattatctagcact

SEQ ID NO: 684269 - DNA, 25 bp, Artificial sequence
  Synthetic oligonucleotide
aaaggatatatcggttaatacattt

SEQ ID NO: 684270 - DNA, 25 bp, Artificial sequence
  Synthetic oligonucleotide
tattcctgattattcgataattcat

SEQ ID NO: 684271 - DNA, 25 bp, Artificial sequence
  Synthetic oligonucleotide
tattcctgattaatcgataattcat

SEQ ID NO: 684272 - DNA, 25 bp, Artificial sequence
  Synthetic oligonucleotide
attagcgattatctacgtttattta

SEQ ID NO: 684273 - DNA, 25 bp, Artificial sequence
  Synthetic oligonucleotide
attagcgattatgtacgtttattta

SEQ ID NO: 684274 - DNA, 25 bp, Artificial sequence
  Synthetic oligonucleotide
ttgtttatttcgaaatattcagctt

SEQ ID NO: 684275 - DNA, 25 bp, Artificial sequence
  Synthetic oligonucleotide
ttgtttatttcgtaatattcagctt

SEQ ID NO: 684276 - DNA, 25 bp, Artificial sequence
  Synthetic oligonucleotide
atacaattatatgggattaattcag

SEQ ID NO: 684277 - DNA, 25 bp, Artificial sequence
  Synthetic oligonucleotide
atacaattatatcggattaattcag

SEQ ID NO: 684278 - DNA, 25 bp, Artificial sequence
  Synthetic oligonucleotide
aagtagattattaaacgcttcattt

SEQ ID NO: 684279 - DNA, 25 bp, Artificial sequence
  Synthetic oligonucleotide
actattatttagcgactaaattgat

SEQ ID NO: 684280 - DNA, 25 bp, Artificial sequence
  Synthetic oligonucleotide
ttatgtataatttcgcataatacga

SEQ ID NO: 684281 - DNA, 25 bp, Artificial sequence
  Synthetic oligonucleotide
atgaataaactttcgctttaaaatg

SEQ ID NO: 684282 - DNA, 25 bp, Artificial sequence
  Synthetic oligonucleotide
ttacagtaaatcgaacaataattga

SEQ ID NO: 684283 - DNA, 25 bp, Artificial sequence
  Synthetic oligonucleotide
tctgtatcgatgaaaattaaatgtt

SEQ ID NO: 684284 - DNA, 25 bp, Artificial sequence
  Synthetic oligonucleotide
tctgtatcgatgtaaattaaatgtt

SEQ ID NO: 684285 - DNA, 25 bp, Artificial sequence
  Synthetic oligonucleotide
tatatatcttatatcgcataaacct

SEQ ID NO: 684286 - DNA, 25 bp, Artificial sequence
  Synthetic oligonucleotide
tatatatcttatttcgcataaacct

SEQ ID NO: 684287 - DNA, 25 bp, Artificial sequence
  Synthetic oligonucleotide
cactattacgttttaactataaatg

SEQ ID NO: 684288 - DNA, 25 bp, Artificial sequence
  Synthetic oligonucleotide
cactattacgttataactataaatg

SEQ ID NO: 684289 - DNA, 25 bp, Artificial sequence
  Synthetic oligonucleotide
aataatcaactttgttcgaactaaa

SEQ ID NO: 684290 - DNA, 25 bp, Artificial sequence
  Synthetic oligonucleotide
aataatcaacttagttcgaactaaa

SEQ ID NO: 684291 - DNA, 25 bp, Artificial sequence
  Synthetic oligonucleotide
taattaattacgatcgtttaagaag

SEQ ID NO: 684292 - DNA, 25 bp, Artificial sequence
  Synthetic oligonucleotide
ttattaatagtcgttagataccaat

SEQ ID NO: 684293 - DNA, 25 bp, Artificial sequence
  Synthetic oligonucleotide
taattaattacgttcgtttaagaag

SEQ ID NO: 684294 - DNA, 25 bp, Artificial sequence
  Synthetic oligonucleotide
ttatgtataattacgcataatacga

SEQ ID NO: 684295 - DNA, 25 bp, Artificial sequence
  Synthetic oligonucleotide
tactattacttattaacgcttagta

SEQ ID NO: 684296 - DNA, 25 bp, Artificial sequence
  Synthetic oligonucleotide
tactattacttaataacgcttagta

SEQ ID NO: 684297 - DNA, 25 bp, Artificial sequence
  Synthetic oligonucleotide
tagaatactaagcgagtttatatta

SEQ ID NO: 684298 - DNA, 25 bp, Artificial sequence
  Synthetic oligonucleotide
tagaatactaagggagtttatatta

SEQ ID NO: 684299 - DNA, 25 bp, Artificial sequence
  Synthetic oligonucleotide
ctaagcttattattacgaaatcttt

SEQ ID NO: 684300 - DNA, 25 bp, Artificial sequence
  Synthetic oligonucleotide
ctaagcttattaatacgaaatcttt

SEQ ID NO: 684301 - DNA, 25 bp, Artificial sequence
  Synthetic oligonucleotide
tatcagtcgatatagtttatgaaat

SEQ ID NO: 684302 - DNA, 25 bp, Artificial sequence
  Synthetic oligonucleotide
tatcagtcgataaagtttatgaaat

SEQ ID NO: 684303 - DNA, 25 bp, Artificial sequence
  Synthetic oligonucleotide
taaatgcgttatttttcactgataa

SEQ ID NO: 684304 - DNA, 25 bp, Artificial sequence
  Synthetic oligonucleotide
ttattaatagtccttagataccaat

SEQ ID NO: 684305 - DNA, 25 bp, Artificial sequence
  Synthetic oligonucleotide
caacttaacaataaatcgtaacaaa

SEQ ID NO: 684306 - DNA, 25 bp, Artificial sequence
  Synthetic oligonucleotide
tattggatatttttcatacgttctt

SEQ ID NO: 684307 - DNA, 25 bp, Artificial sequence
  Synthetic oligonucleotide
catttgcgtatctataataatactt

SEQ ID NO: 684308 - DNA, 25 bp, Artificial sequence
  Synthetic oligonucleotide
catttgcgtatcaataataatactt

SEQ ID NO: 684309 - DNA, 25 bp, Artificial sequence
  Synthetic oligonucleotide
gttaacgctaactcttatatatata

SEQ ID NO: 684310 - DNA, 25 bp, Artificial sequence
  Synthetic oligonucleotide
gttaacgctaacacttatatatata

SEQ ID NO: 684311 - DNA, 25 bp, Artificial sequence
  Synthetic oligonucleotide
atttcgtaataattcgtatatgtag

SEQ ID NO: 684312 - DNA, 25 bp, Artificial sequence
  Synthetic oligonucleotide
atttcgtaataaatcgtatatgtag

SEQ ID NO: 684313 - DNA, 25 bp, Artificial sequence
  Synthetic oligonucleotide
tcgtacgcaagtatattattaaaaa

SEQ ID NO: 684314 - DNA, 25 bp, Artificial sequence
  Synthetic oligonucleotide
tcgtacgcaagtttattattaaaaa

SEQ ID NO: 684315 - DNA, 25 bp, Artificial sequence
  Synthetic oligonucleotide
tcataatttacgttatacgataact

SEQ ID NO: 684316 - DNA, 25 bp, Artificial sequence
  Synthetic oligonucleotide
ttacagtaaatccaacaataattga

SEQ ID NO: 684317 - DNA, 25 bp, Artificial sequence
  Synthetic oligonucleotide
caacttaacaattaatcgtaacaaa

SEQ ID NO: 684318 - DNA, 25 bp, Artificial sequence
  Synthetic oligonucleotide
aagtagattatttaacgcttcattt

SEQ ID NO: 684319 - DNA, 25 bp, Artificial sequence
  Synthetic oligonucleotide
gtattatatcgaaaaagattcatct

SEQ ID NO: 684320 - DNA, 25 bp, Artificial sequence
  Synthetic oligonucleotide
gtattatatcgataaagattcatct

SEQ ID NO: 684321 - DNA, 25 bp, Artificial sequence
  Synthetic oligonucleotide
tacacttatacgcttaaattcatat

SEQ ID NO: 684322 - DNA, 25 bp, Artificial sequence
  Synthetic oligonucleotide
tacacttatacggttaaattcatat

SEQ ID NO: 684323 - DNA, 25 bp, Artificial sequence
  Synthetic oligonucleotide
taagggtacgattaattaattatct

SEQ ID NO: 684324 - DNA, 25 bp, Artificial sequence
  Synthetic oligonucleotide
taagggtacgataaattaattatct

SEQ ID NO: 684325 - DNA, 25 bp, Artificial sequence
  Synthetic oligonucleotide
atataaacgttatcgtattagtgat

SEQ ID NO: 684326 - DNA, 25 bp, Artificial sequence
  Synthetic oligonucleotide
atataaacgttaacgtattagtgat

SEQ ID NO: 684327 - DNA, 25 bp, Artificial sequence
  Synthetic oligonucleotide
taataatattagtttacgaaagcac

SEQ ID NO: 684328 - DNA, 25 bp, Artificial sequence
  Synthetic oligonucleotide
taataatattagattacgaaagcac

SEQ ID NO: 684329 - DNA, 25 bp, Artificial sequence
  Synthetic oligonucleotide
tcataatttacgatatacgataact

SEQ ID NO: 684330 - DNA, 25 bp, Artificial sequence
  Synthetic oligonucleotide
atgtatatatcgtcactattgatta

SEQ ID NO: 684331 - DNA, 25 bp, Artificial sequence
  Synthetic oligonucleotide
atatataattacgaaattggctatc

SEQ ID NO: 684332 - DNA, 25 bp, Artificial sequence
  Synthetic oligonucleotide
tatttttcaattatatatcgcagtc

SEQ ID NO: 684333 - DNA, 25 bp, Artificial sequence
  Synthetic oligonucleotide
tatttttcaattttatatcgcagtc

SEQ ID NO: 684334 - DNA, 25 bp, Artificial sequence
  Synthetic oligonucleotide
ctaaatcgctaaattatgtaaatca

SEQ ID NO: 684335 - DNA, 25 bp, Artificial sequence
  Synthetic oligonucleotide
ctaaatcgctaatttatgtaaatca

SEQ ID NO: 684336 - DNA, 25 bp, Artificial sequence
  Synthetic oligonucleotide
attgaatcttaatcgaatatgttgt

SEQ ID NO: 684337 - DNA, 25 bp, Artificial sequence
  Synthetic oligonucleotide
attgaatcttaaacgaatatgttgt

SEQ ID NO: 684338 - DNA, 25 bp, Artificial sequence
  Synthetic oligonucleotide
tatatctaaatttcgtacaagcaaa

SEQ ID NO: 684339 - DNA, 25 bp, Artificial sequence
  Synthetic oligonucleotide
tatatctaaattacgtacaagcaaa

SEQ ID NO: 684340 - DNA, 25 bp, Artificial sequence
  Synthetic oligonucleotide
tatataacattacgcttatgatatc

SEQ ID NO: 684341 - DNA, 25 bp, Artificial sequence
  Synthetic oligonucleotide
aagaaatcgacttatgttgaaataa

SEQ ID NO: 684342 - DNA, 25 bp, Artificial sequence
  Synthetic oligonucleotide
atgtatatatcgacactattgatta

SEQ ID NO: 684343 - DNA, 25 bp, Artificial sequence
  Synthetic oligonucleotide
aatagtatcgcataaactataacat

SEQ ID NO: 684344 - DNA, 25 bp, Artificial sequence
  Synthetic oligonucleotide
tgatatctaatttttaatcgtgcat

SEQ ID NO: 684345 - DNA, 25 bp, Artificial sequence
  Synthetic oligonucleotide
tgatatctaattattaatcgtgcat

SEQ ID NO: 684346 - DNA, 25 bp, Artificial sequence
  Synthetic oligonucleotide
acaactaaattaatttacgctatga

SEQ ID NO: 684347 - DNA, 25 bp, Artificial sequence
  Synthetic oligonucleotide
acaactaaattattttacgctatga

SEQ ID NO: 684348 - DNA, 25 bp, Artificial sequence
  Synthetic oligonucleotide
tgaataaacatttacgaactacaaa

SEQ ID NO: 684349 - DNA, 25 bp, Artificial sequence
  Synthetic oligonucleotide
tgaataaacattaacgaactacaaa

SEQ ID NO: 684350 - DNA, 25 bp, Artificial sequence
  Synthetic oligonucleotide
gttatgtaatattatgcgatgataa

SEQ ID NO: 684351 - DNA, 25 bp, Artificial sequence
  Synthetic oligonucleotide
gttatgtaatataatgcgatgataa

SEQ ID NO: 684352 - DNA, 25 bp, Artificial sequence
  Synthetic oligonucleotide
aattagttacgaaatgattaatggt

SEQ ID NO: 684353 - DNA, 25 bp, Artificial sequence
  Synthetic oligonucleotide
tatcgatatcgaattaatacactaa

SEQ ID NO: 684354 - DNA, 25 bp, Artificial sequence
  Synthetic oligonucleotide
tatataacattaggcttatgatatc

SEQ ID NO: 684355 - DNA, 25 bp, Artificial sequence
  Synthetic oligonucleotide
ggatattatattaacgttagtctta

SEQ ID NO: 684356 - DNA, 25 bp, Artificial sequence
  Synthetic oligonucleotide
acatatatatcttaacgcgattatt

SEQ ID NO: 684357 - DNA, 25 bp, Artificial sequence
  Synthetic oligonucleotide
aaattgtcgatatcttatatgaaca

SEQ ID NO: 684358 - DNA, 25 bp, Artificial sequence
  Synthetic oligonucleotide
tattctatttatttcgatcgaaact

SEQ ID NO: 684359 - DNA, 25 bp, Artificial sequence
  Synthetic oligonucleotide
tattctatttatatcgatcgaaact

SEQ ID NO: 684360 - DNA, 25 bp, Artificial sequence
  Synthetic oligonucleotide
cagattataaatgcgttaattacat

SEQ ID NO: 684361 - DNA, 25 bp, Artificial sequence
  Synthetic oligonucleotide
cagattataaatccgttaattacat

SEQ ID NO: 684362 - DNA, 25 bp, Artificial sequence
  Synthetic oligonucleotide
ttacgatatcgattaaaggttttta

SEQ ID NO: 684363 - DNA, 25 bp, Artificial sequence
  Synthetic oligonucleotide
ttacgatatcgaataaaggttttta

SEQ ID NO: 684364 - DNA, 25 bp, Artificial sequence
  Synthetic oligonucleotide
tttgacgttgatatcgatttttaaa

SEQ ID NO: 684365 - DNA, 25 bp, Artificial sequence
  Synthetic oligonucleotide
tttgacgttgatttcgatttttaaa

SEQ ID NO: 684366 - DNA, 25 bp, Artificial sequence
  Synthetic oligonucleotide
aagaaatcgactaatgttgaaataa

SEQ ID NO: 684367 - DNA, 25 bp, Artificial sequence
  Synthetic oligonucleotide
tctacttactaaagaacgtaaaata

SEQ ID NO: 684368 - DNA, 25 bp, Artificial sequence
  Synthetic oligonucleotide
atatataattaccaaattggctatc

SEQ ID NO: 684369 - DNA, 25 bp, Artificial sequence
  Synthetic oligonucleotide
ggatattatatttacgttagtctta

SEQ ID NO: 684370 - DNA, 25 bp, Artificial sequence
  Synthetic oligonucleotide
tgagttatagtcgaatttttcttat

SEQ ID NO: 684371 - DNA, 25 bp, Artificial sequence
  Synthetic oligonucleotide
tgagttatagtccaatttttcttat

SEQ ID NO: 684372 - DNA, 25 bp, Artificial sequence
  Synthetic oligonucleotide
atgaatgttattatactacgtcaat

SEQ ID NO: 684373 - DNA, 25 bp, Artificial sequence
  Synthetic oligonucleotide
atgaatgttattttactacgtcaat

SEQ ID NO: 684374 - DNA, 25 bp, Artificial sequence
  Synthetic oligonucleotide
gatagttatatgcgatttattactt

SEQ ID NO: 684375 - DNA, 25 bp, Artificial sequence
  Synthetic oligonucleotide
gatagttatatgggatttattactt

SEQ ID NO: 684376 - DNA, 25 bp, Artificial sequence
  Synthetic oligonucleotide
aaaacttcgtaaaattatacctgaa

SEQ ID NO: 684377 - DNA, 25 bp, Artificial sequence
  Synthetic oligonucleotide
aaaacttcgtaatattatacctgaa

SEQ ID NO: 684378 - DNA, 25 bp, Artificial sequence
  Synthetic oligonucleotide
aatagtatcgcaaaaactataacat

SEQ ID NO: 684379 - DNA, 25 bp, Artificial sequence
  Synthetic oligonucleotide
tctacttactaatgaacgtaaaata

SEQ ID NO: 684380 - DNA, 25 bp, Artificial sequence
  Synthetic oligonucleotide
ttaacaatcaatagtatcgttatgt

SEQ ID NO: 684381 - DNA, 25 bp, Artificial sequence
  Synthetic oligonucleotide
aattagttacgatatgattaatggt

SEQ ID NO: 684382 - DNA, 25 bp, Artificial sequence
  Synthetic oligonucleotide
gatttttaacttattcgaattcgat

SEQ ID NO: 684383 - DNA, 25 bp, Artificial sequence
  Synthetic oligonucleotide
gatttttaactttttcgaattcgat

SEQ ID NO: 684384 - DNA, 25 bp, Artificial sequence
  Synthetic oligonucleotide
aaatatcgttaatataatcctgaga

SEQ ID NO: 684385 - DNA, 25 bp, Artificial sequence
  Synthetic oligonucleotide
aaatatcgttaaaataatcctgaga

SEQ ID NO: 684386 - DNA, 25 bp, Artificial sequence
  Synthetic oligonucleotide
attaaaatattaacgaaacgacaag

SEQ ID NO: 684387 - DNA, 25 bp, Artificial sequence
  Synthetic oligonucleotide
attaaaatattatcgaaacgacaag

SEQ ID NO: 684388 - DNA, 25 bp, Artificial sequence
  Synthetic oligonucleotide
tttatttgtaatacgatccacaata

SEQ ID NO: 684389 - DNA, 25 bp, Artificial sequence
  Synthetic oligonucleotide
tttatttgtaattcgatccacaata

SEQ ID NO: 684390 - DNA, 25 bp, Artificial sequence
  Synthetic oligonucleotide
taaaaacgatatttagctatttcgt

SEQ ID NO: 684391 - DNA, 25 bp, Artificial sequence
  Synthetic oligonucleotide
tctattatgataacgtattactagt

SEQ ID NO: 684392 - DNA, 25 bp, Artificial sequence
  Synthetic oligonucleotide
ttaacaatcaattgtatcgttatgt

SEQ ID NO: 684393 - DNA, 25 bp, Artificial sequence
  Synthetic oligonucleotide
atgctattttttatacgcgaattat

SEQ ID NO: 684394 - DNA, 25 bp, Artificial sequence
  Synthetic oligonucleotide
atcaagcgatcaagttattatttat

SEQ ID NO: 684395 - DNA, 25 bp, Artificial sequence
  Synthetic oligonucleotide
atcaagcgatcatgttattatttat

SEQ ID NO: 684396 - DNA, 25 bp, Artificial sequence
  Synthetic oligonucleotide
ttttattcgtactatcaaaaatgtc

SEQ ID NO: 684397 - DNA, 25 bp, Artificial sequence
  Synthetic oligonucleotide
ttttattcgtacaatcaaaaatgtc

SEQ ID NO: 684398 - DNA, 25 bp, Artificial sequence
  Synthetic oligonucleotide
cacttctaatattatcgatattttg

SEQ ID NO: 684399 - DNA, 25 bp, Artificial sequence
  Synthetic oligonucleotide
cacttctaatataatcgatattttg

SEQ ID NO: 684400 - DNA, 25 bp, Artificial sequence
  Synthetic oligonucleotide
aaacaatcgtaaatttcgcaaatta

SEQ ID NO: 684401 - DNA, 25 bp, Artificial sequence
  Synthetic oligonucleotide
aaacaatcgtaattttcgcaaatta

SEQ ID NO: 684402 - DNA, 25 bp, Artificial sequence
  Synthetic oligonucleotide
tattggatatttatcatacgttctt

SEQ ID NO: 684403 - DNA, 25 bp, Artificial sequence
  Synthetic oligonucleotide
tatcgatatcgatttaatacactaa

SEQ ID NO: 684404 - DNA, 25 bp, Artificial sequence
  Synthetic oligonucleotide
taaaaacgatatatagctatttcgt

SEQ ID NO: 684405 - DNA, 25 bp, Artificial sequence
  Synthetic oligonucleotide
tacttcatattagtacgtcttaaat

SEQ ID NO: 684406 - DNA, 25 bp, Artificial sequence
  Synthetic oligonucleotide
gagaaaatcgtaataagttattctt

SEQ ID NO: 684407 - DNA, 25 bp, Artificial sequence
  Synthetic oligonucleotide
gagaaaatcgtattaagttattctt

SEQ ID NO: 684408 - DNA, 25 bp, Artificial sequence
  Synthetic oligonucleotide
aaaagtatttcatgcgattatttgt

SEQ ID NO: 684409 - DNA, 25 bp, Artificial sequence
  Synthetic oligonucleotide
aaaagtatttcaagcgattatttgt

SEQ ID NO: 684410 - DNA, 25 bp, Artificial sequence
  Synthetic oligonucleotide
ctttcaattataattagcgtatatg

SEQ ID NO: 684411 - DNA, 25 bp, Artificial sequence
  Synthetic oligonucleotide
ctttcaattatatttagcgtatatg

SEQ ID NO: 684412 - DNA, 25 bp, Artificial sequence
  Synthetic oligonucleotide
acttattaacttattacgatttgtc

SEQ ID NO: 684413 - DNA, 25 bp, Artificial sequence
  Synthetic oligonucleotide
acttattaactttttacgatttgtc

SEQ ID NO: 684414 - DNA, 25 bp, Artificial sequence
  Synthetic oligonucleotide
ttagtataatagaatcgttaacttg

SEQ ID NO: 684415 - DNA, 25 bp, Artificial sequence
  Synthetic oligonucleotide
ttagtataatagtatcgttaacttg

SEQ ID NO: 684416 - DNA, 25 bp, Artificial sequence
  Synthetic oligonucleotide
tctattatgatatcgtattactagt

SEQ ID NO: 684417 - DNA, 25 bp, Artificial sequence
  Synthetic oligonucleotide
ataatacaataaattagcgataggt

SEQ ID NO: 684418 - DNA, 25 bp, Artificial sequence
  Synthetic oligonucleotide
attaggatttttacgcttatttatc

SEQ ID NO: 684419 - DNA, 25 bp, Artificial sequence
  Synthetic oligonucleotide
tacttcatattactacgtcttaaat

SEQ ID NO: 684420 - DNA, 25 bp, Artificial sequence
  Synthetic oligonucleotide
agaatttatgcgaaatttatcctaa

SEQ ID NO: 684421 - DNA, 25 bp, Artificial sequence
  Synthetic oligonucleotide
agaatttatgcgtaatttatcctaa

SEQ ID NO: 684422 - DNA, 25 bp, Artificial sequence
  Synthetic oligonucleotide
aacagtattcacgatataattagtt

SEQ ID NO: 684423 - DNA, 25 bp, Artificial sequence
  Synthetic oligonucleotide
aacagtattcaccatataattagtt

SEQ ID NO: 684424 - DNA, 25 bp, Artificial sequence
  Synthetic oligonucleotide
agcaacgcataaaaattcattaaaa

SEQ ID NO: 684425 - DNA, 25 bp, Artificial sequence
  Synthetic oligonucleotide
agcaacgcataataattcattaaaa

SEQ ID NO: 684426 - DNA, 25 bp, Artificial sequence
  Synthetic oligonucleotide
aaacatgattagaacgaaatgaata

SEQ ID NO: 684427 - DNA, 25 bp, Artificial sequence
  Synthetic oligonucleotide
aaacatgattagtacgaaatgaata

SEQ ID NO: 684428 - DNA, 25 bp, Artificial sequence
  Synthetic oligonucleotide
atgctattttttttacgcgaattat

SEQ ID NO: 684429 - DNA, 25 bp, Artificial sequence
  Synthetic oligonucleotide
ataatacaataatttagcgataggt

SEQ ID NO: 684430 - DNA, 25 bp, Artificial sequence
  Synthetic oligonucleotide
aagtttagcgataaataagtatgta

SEQ ID NO: 684431 - DNA, 25 bp, Artificial sequence
  Synthetic oligonucleotide
actgataatatagtatacgaatctt

SEQ ID NO: 684432 - DNA, 25 bp, Artificial sequence
  Synthetic oligonucleotide
ttatgtaatacatatagcgttatac

SEQ ID NO: 684433 - DNA, 25 bp, Artificial sequence
  Synthetic oligonucleotide
atttactattaaacgatagtgatga

SEQ ID NO: 684434 - DNA, 25 bp, Artificial sequence
  Synthetic oligonucleotide
atttactattaatcgatagtgatga

SEQ ID NO: 684435 - DNA, 25 bp, Artificial sequence
  Synthetic oligonucleotide
taagatatctataacgaaatatctg

SEQ ID NO: 684436 - DNA, 25 bp, Artificial sequence
  Synthetic oligonucleotide
taagatatctattacgaaatatctg

SEQ ID NO: 684437 - DNA, 25 bp, Artificial sequence
  Synthetic oligonucleotide
tgaaaattatcgtttatcaacttgt

SEQ ID NO: 684438 - DNA, 25 bp, Artificial sequence
  Synthetic oligonucleotide
tgaaaattatcgattatcaacttgt

SEQ ID NO: 684439 - DNA, 25 bp, Artificial sequence
  Synthetic oligonucleotide
agtatttgaagtgtcgtattaataa

SEQ ID NO: 684440 - DNA, 25 bp, Artificial sequence
  Synthetic oligonucleotide
agtatttgaagtctcgtattaataa

SEQ ID NO: 684441 - DNA, 25 bp, Artificial sequence
  Synthetic oligonucleotide
aaaatatatgcataacgatttgaag

SEQ ID NO: 684442 - DNA, 25 bp, Artificial sequence
  Synthetic oligonucleotide
gatattcgactaacataatatagat

SEQ ID NO: 684443 - DNA, 25 bp, Artificial sequence
  Synthetic oligonucleotide
aaaatatatgcaaaacgatttgaag

SEQ ID NO: 684444 - DNA, 25 bp, Artificial sequence
  Synthetic oligonucleotide
aagtttagcgattaataagtatgta

SEQ ID NO: 684445 - DNA, 25 bp, Artificial sequence
  Synthetic oligonucleotide
caagataatcatatttcgtaacttt

SEQ ID NO: 684446 - DNA, 25 bp, Artificial sequence
  Synthetic oligonucleotide
caagataatcatttttcgtaacttt

SEQ ID NO: 684447 - DNA, 25 bp, Artificial sequence
  Synthetic oligonucleotide
agtattaattaattgacgattgcat

SEQ ID NO: 684448 - DNA, 25 bp, Artificial sequence
  Synthetic oligonucleotide
agtattaattaaatgacgattgcat

SEQ ID NO: 684449 - DNA, 25 bp, Artificial sequence
  Synthetic oligonucleotide
aaattaattctacaacaacgagatt

SEQ ID NO: 684450 - DNA, 25 bp, Artificial sequence
  Synthetic oligonucleotide
aaattaattctagaacaacgagatt

SEQ ID NO: 684451 - DNA, 25 bp, Artificial sequence
  Synthetic oligonucleotide
gtaactattctaacgttaaagaatt

SEQ ID NO: 684452 - DNA, 25 bp, Artificial sequence
  Synthetic oligonucleotide
gtaactattctatcgttaaagaatt

SEQ ID NO: 684453 - DNA, 25 bp, Artificial sequence
  Synthetic oligonucleotide
gaaatctattcgtagtattattcat

SEQ ID NO: 684454 - DNA, 25 bp, Artificial sequence
  Synthetic oligonucleotide
gatattcgactatcataatatagat

SEQ ID NO: 684455 - DNA, 25 bp, Artificial sequence
  Synthetic oligonucleotide
tatgaaatattagtttatcgtaggt

SEQ ID NO: 684456 - DNA, 25 bp, Artificial sequence
  Synthetic oligonucleotide
actgataatatactatacgaatctt

SEQ ID NO: 684457 - DNA, 25 bp, Artificial sequence
  Synthetic oligonucleotide
ttttaatgcgatatcttatagtaca

SEQ ID NO: 684458 - DNA, 25 bp, Artificial sequence
  Synthetic oligonucleotide
ttttaatgcgatttcttatagtaca

SEQ ID NO: 684459 - DNA, 25 bp, Artificial sequence
  Synthetic oligonucleotide
caaatagtattcgataaatctaagt

SEQ ID NO: 684460 - DNA, 25 bp, Artificial sequence
  Synthetic oligonucleotide
caaatagtattccataaatctaagt

SEQ ID NO: 684461 - DNA, 25 bp, Artificial sequence
  Synthetic oligonucleotide
tgtttttaatcgtatgataagacta

SEQ ID NO: 684462 - DNA, 25 bp, Artificial sequence
  Synthetic oligonucleotide
tgtttttaatcgaatgataagacta

SEQ ID NO: 684463 - DNA, 25 bp, Artificial sequence
  Synthetic oligonucleotide
caatggcgtaattttgttataaata

SEQ ID NO: 684464 - DNA, 25 bp, Artificial sequence
  Synthetic oligonucleotide
caatggcgtaatattgttataaata

SEQ ID NO: 684465 - DNA, 25 bp, Artificial sequence
  Synthetic oligonucleotide
gatatattaatcggatattacagat

SEQ ID NO: 684466 - DNA, 25 bp, Artificial sequence
  Synthetic oligonucleotide
ttatgtaatacaaatagcgttatac

SEQ ID NO: 684467 - DNA, 25 bp, Artificial sequence
  Synthetic oligonucleotide
tatgaaatattactttatcgtaggt

SEQ ID NO: 684468 - DNA, 25 bp, Artificial sequence
  Synthetic oligonucleotide
aggtatatacgatattcgaaataat

SEQ ID NO: 684469 - DNA, 25 bp, Artificial sequence
  Synthetic oligonucleotide
tattagtatatcggattaacttctt

SEQ ID NO: 684470 - DNA, 25 bp, Artificial sequence
  Synthetic oligonucleotide
tattagtatatccgattaacttctt

SEQ ID NO: 684471 - DNA, 25 bp, Artificial sequence
  Synthetic oligonucleotide
atgtaaacgaattcttataaatcgt

SEQ ID NO: 684472 - DNA, 25 bp, Artificial sequence
  Synthetic oligonucleotide
atgtaaacgaatacttataaatcgt

SEQ ID NO: 684473 - DNA, 25 bp, Artificial sequence
  Synthetic oligonucleotide
tattaactacgatattaactacatg

SEQ ID NO: 684474 - DNA, 25 bp, Artificial sequence
  Synthetic oligonucleotide
tattaactacgaaattaactacatg

SEQ ID NO: 684475 - DNA, 25 bp, Artificial sequence
  Synthetic oligonucleotide
ttatcatttcgagatattatcagat

SEQ ID NO: 684476 - DNA, 25 bp, Artificial sequence
  Synthetic oligonucleotide
ttatcatttcgacatattatcagat

SEQ ID NO: 684477 - DNA, 25 bp, Artificial sequence
  Synthetic oligonucleotide
agttacgtataattattaagtagct

SEQ ID NO: 684478 - DNA, 25 bp, Artificial sequence
  Synthetic oligonucleotide
agttacgtataaatattaagtagct

SEQ ID NO: 684479 - DNA, 25 bp, Artificial sequence
  Synthetic oligonucleotide
gatatattaatccgatattacagat

SEQ ID NO: 684480 - DNA, 25 bp, Artificial sequence
  Synthetic oligonucleotide
gattgatcaaatttcgttgaattat

SEQ ID NO: 684481 - DNA, 25 bp, Artificial sequence
  Synthetic oligonucleotide
aaattgtcgataacttatatgaaca

SEQ ID NO: 684482 - DNA, 25 bp, Artificial sequence
  Synthetic oligonucleotide
aataaaattacggaacaatttcaga

SEQ ID NO: 684483 - DNA, 25 bp, Artificial sequence
  Synthetic oligonucleotide
aataaaattacgcaacaatttcaga

SEQ ID NO: 684484 - DNA, 25 bp, Artificial sequence
  Synthetic oligonucleotide
gacttagttcgaaaaatatgataaa

SEQ ID NO: 684485 - DNA, 25 bp, Artificial sequence
  Synthetic oligonucleotide
gacttagttcgataaatatgataaa

SEQ ID NO: 684486 - DNA, 25 bp, Artificial sequence
  Synthetic oligonucleotide
atttaattattgtcgaatcacgatt

SEQ ID NO: 684487 - DNA, 25 bp, Artificial sequence
  Synthetic oligonucleotide
atttaattattgacgaatcacgatt

SEQ ID NO: 684488 - DNA, 25 bp, Artificial sequence
  Synthetic oligonucleotide
gtggttatcgtaaatataagaaaat

SEQ ID NO: 684489 - DNA, 25 bp, Artificial sequence
  Synthetic oligonucleotide
gtggttatcgtatatataagaaaat

SEQ ID NO: 684490 - DNA, 25 bp, Artificial sequence
  Synthetic oligonucleotide
tgaaattcgactatagataactatt

SEQ ID NO: 684491 - DNA, 25 bp, Artificial sequence
  Synthetic oligonucleotide
gaaatctattcgaagtattattcat

SEQ ID NO: 684492 - DNA, 25 bp, Artificial sequence
  Synthetic oligonucleotide
gattgatcaaatatcgttgaattat

SEQ ID NO: 684493 - DNA, 25 bp, Artificial sequence
  Synthetic oligonucleotide
tatgattacgcgtaaatattatttg

SEQ ID NO: 684494 - DNA, 25 bp, Artificial sequence
  Synthetic oligonucleotide
aataattaacgctcgaatctaaaaa

SEQ ID NO: 684495 - DNA, 25 bp, Artificial sequence
  Synthetic oligonucleotide
aataattaacgcacgaatctaaaaa

SEQ ID NO: 684496 - DNA, 25 bp, Artificial sequence
  Synthetic oligonucleotide
tataatgtacgaacgtaaatcaatt

SEQ ID NO: 684497 - DNA, 25 bp, Artificial sequence
  Synthetic oligonucleotide
tataatgtacgatcgtaaatcaatt

SEQ ID NO: 684498 - DNA, 25 bp, Artificial sequence
  Synthetic oligonucleotide
taaatggacgcgattatatttataa

SEQ ID NO: 684499 - DNA, 25 bp, Artificial sequence
  Synthetic oligonucleotide
taaatggacgcgtttatatttataa

SEQ ID NO: 684500 - DNA, 25 bp, Artificial sequence
  Synthetic oligonucleotide
acaattcgtcgaattactataaata

SEQ ID NO: 684501 - DNA, 25 bp, Artificial sequence
  Synthetic oligonucleotide
actcaaaaaatacgtcgattaaata

SEQ ID NO: 684502 - DNA, 25 bp, Artificial sequence
  Synthetic oligonucleotide
acatatatatctaaacgcgattatt

SEQ ID NO: 684503 - DNA, 25 bp, Artificial sequence
  Synthetic oligonucleotide
attaggattttttcgcttatttatc

SEQ ID NO: 684504 - DNA, 25 bp, Artificial sequence
  Synthetic oligonucleotide
tgaaattcgactttagataactatt

SEQ ID NO: 684505 - DNA, 25 bp, Artificial sequence
  Synthetic oligonucleotide
ttttcgtcaatccttatagaatata

SEQ ID NO: 684506 - DNA, 25 bp, Artificial sequence
  Synthetic oligonucleotide
acaattcgtcgatttactataaata

SEQ ID NO: 684507 - DNA, 25 bp, Artificial sequence
  Synthetic oligonucleotide
cttacaattactgattatcgaaatt

SEQ ID NO: 684508 - DNA, 25 bp, Artificial sequence
  Synthetic oligonucleotide
cttacaattactcattatcgaaatt

SEQ ID NO: 684509 - DNA, 25 bp, Artificial sequence
  Synthetic oligonucleotide
actgtcatattaggtaaagattaat

SEQ ID NO: 684510 - DNA, 25 bp, Artificial sequence
  Synthetic oligonucleotide
actgtcatattacgtaaagattaat

SEQ ID NO: 684511 - DNA, 25 bp, Artificial sequence
  Synthetic oligonucleotide
aatacgtcgatattaagaacaataa

SEQ ID NO: 684512 - DNA, 25 bp, Artificial sequence
  Synthetic oligonucleotide
aatacgtcgataataagaacaataa

SEQ ID NO: 684513 - DNA, 25 bp, Artificial sequence
  Synthetic oligonucleotide
atatataataatccgaactacaaca

SEQ ID NO: 684514 - DNA, 25 bp, Artificial sequence
  Synthetic oligonucleotide
atatataataatgcgaactacaaca

SEQ ID NO: 684515 - DNA, 25 bp, Artificial sequence
  Synthetic oligonucleotide
ttcctacgaatctatatttatattg

SEQ ID NO: 684516 - DNA, 25 bp, Artificial sequence
  Synthetic oligonucleotide
caaatattagtctcatcgtatatat

SEQ ID NO: 684517 - DNA, 25 bp, Artificial sequence
  Synthetic oligonucleotide
ttttcgtcaatcgttatagaatata

SEQ ID NO: 684518 - DNA, 25 bp, Artificial sequence
  Synthetic oligonucleotide
tatgattacgcgaaaatattatttg

SEQ ID NO: 684519 - DNA, 25 bp, Artificial sequence
  Synthetic oligonucleotide
atgttcaatcgcaattaattgaaat

SEQ ID NO: 684520 - DNA, 25 bp, Artificial sequence
  Synthetic oligonucleotide
atgttcaatcgctattaattgaaat

SEQ ID NO: 684521 - DNA, 25 bp, Artificial sequence
  Synthetic oligonucleotide
cttattaatcgatacttatattggt

SEQ ID NO: 684522 - DNA, 25 bp, Artificial sequence
  Synthetic oligonucleotide
cttattaatcgaaacttatattggt

SEQ ID NO: 684523 - DNA, 25 bp, Artificial sequence
  Synthetic oligonucleotide
ataattatcaatttcgattgtaagg

SEQ ID NO: 684524 - DNA, 25 bp, Artificial sequence
  Synthetic oligonucleotide
ataattatcaatatcgattgtaagg

SEQ ID NO: 684525 - DNA, 25 bp, Artificial sequence
  Synthetic oligonucleotide
tacagtacgaattttaactattatg

SEQ ID NO: 684526 - DNA, 25 bp, Artificial sequence
  Synthetic oligonucleotide
tacagtacgaatattaactattatg

SEQ ID NO: 684527 - DNA, 25 bp, Artificial sequence
  Synthetic oligonucleotide
gattatattacgtttagttagagat

SEQ ID NO: 684528 - DNA, 25 bp, Artificial sequence
  Synthetic oligonucleotide
gattatattacgattagttagagat

SEQ ID NO: 684529 - DNA, 25 bp, Artificial sequence
  Synthetic oligonucleotide
aggtatatacgaaattcgaaataat

SEQ ID NO: 684530 - DNA, 25 bp, Artificial sequence
  Synthetic oligonucleotide
ttcctacgaatcaatatttatattg

SEQ ID NO: 684531 - DNA, 25 bp, Artificial sequence
  Synthetic oligonucleotide
ttatctcgttatatcataaccaata

SEQ ID NO: 684532 - DNA, 25 bp, Artificial sequence
  Synthetic oligonucleotide
gattatgttcaattcgtaagttata

SEQ ID NO: 684533 - DNA, 25 bp, Artificial sequence
  Synthetic oligonucleotide
catacaaataatagttcgattcaaa

SEQ ID NO: 684534 - DNA, 25 bp, Artificial sequence
  Synthetic oligonucleotide
attagatcgtaatatgtaaattgca

SEQ ID NO: 684535 - DNA, 25 bp, Artificial sequence
  Synthetic oligonucleotide
attagatcgtaaaatgtaaattgca

SEQ ID NO: 684536 - DNA, 25 bp, Artificial sequence
  Synthetic oligonucleotide
aaacttaagtattagtatcgaaaga

SEQ ID NO: 684537 - DNA, 25 bp, Artificial sequence
  Synthetic oligonucleotide
aaacttaagtataagtatcgaaaga

SEQ ID NO: 684538 - DNA, 25 bp, Artificial sequence
  Synthetic oligonucleotide
tttctttctatcgttcaatatagta

SEQ ID NO: 684539 - DNA, 25 bp, Artificial sequence
  Synthetic oligonucleotide
tttctttctatccttcaatatagta

SEQ ID NO: 684540 - DNA, 25 bp, Artificial sequence
  Synthetic oligonucleotide
aagcttaatatattataccgagatt

SEQ ID NO: 684541 - DNA, 25 bp, Artificial sequence
  Synthetic oligonucleotide
aagcttaatataatataccgagatt

SEQ ID NO: 684542 - DNA, 25 bp, Artificial sequence
  Synthetic oligonucleotide
aactttgttgtgttatatcgatata

SEQ ID NO: 684543 - DNA, 25 bp, Artificial sequence
  Synthetic oligonucleotide
gatcttaatcgatcgtaataatttt

SEQ ID NO: 684544 - DNA, 25 bp, Artificial sequence
  Synthetic oligonucleotide
aactttgttgtgatatatcgatata

SEQ ID NO: 684545 - DNA, 25 bp, Artificial sequence
  Synthetic oligonucleotide
ttatctcgttatttcataaccaata

SEQ ID NO: 684546 - DNA, 25 bp, Artificial sequence
  Synthetic oligonucleotide
ttcctttatggaaattcgtattatt

SEQ ID NO: 684547 - DNA, 25 bp, Artificial sequence
  Synthetic oligonucleotide
ttcctttatggatattcgtattatt

SEQ ID NO: 684548 - DNA, 25 bp, Artificial sequence
  Synthetic oligonucleotide
agtcagatttcgaaataataatttc

SEQ ID NO: 684549 - DNA, 25 bp, Artificial sequence
  Synthetic oligonucleotide
agtcagatttcgtaataataatttc

SEQ ID NO: 684550 - DNA, 25 bp, Artificial sequence
  Synthetic oligonucleotide
ataatgacctcgaattttatcttaa

SEQ ID NO: 684551 - DNA, 25 bp, Artificial sequence
  Synthetic oligonucleotide
ataatgacctcgtattttatcttaa

SEQ ID NO: 684552 - DNA, 25 bp, Artificial sequence
  Synthetic oligonucleotide
gattatagcggttaatttaatttct

SEQ ID NO: 684553 - DNA, 25 bp, Artificial sequence
  Synthetic oligonucleotide
gattatagcggtaaatttaatttct

SEQ ID NO: 684554 - DNA, 25 bp, Artificial sequence
  Synthetic oligonucleotide
gattatgttcaaatcgtaagttata

SEQ ID NO: 684555 - DNA, 25 bp, Artificial sequence
  Synthetic oligonucleotide
gatcttaatcgaacgtaataatttt

SEQ ID NO: 684556 - DNA, 25 bp, Artificial sequence
  Synthetic oligonucleotide
tttggagtaatcgaattatatgtat

SEQ ID NO: 684557 - DNA, 25 bp, Artificial sequence
  Synthetic oligonucleotide
ttttttaatcgaatgtattgatctc

SEQ ID NO: 684558 - DNA, 25 bp, Artificial sequence
  Synthetic oligonucleotide
atgaaagcgttaatattaacaaaga

SEQ ID NO: 684559 - DNA, 25 bp, Artificial sequence
  Synthetic oligonucleotide
atgaaagcgttattattaacaaaga

SEQ ID NO: 684560 - DNA, 25 bp, Artificial sequence
  Synthetic oligonucleotide
cataaacaaatcgctaataaatctt

SEQ ID NO: 684561 - DNA, 25 bp, Artificial sequence
  Synthetic oligonucleotide
cataaacaaatccctaataaatctt

SEQ ID NO: 684562 - DNA, 25 bp, Artificial sequence
  Synthetic oligonucleotide
tgcatcgataattatagttaaagaa

SEQ ID NO: 684563 - DNA, 25 bp, Artificial sequence
  Synthetic oligonucleotide
tgcatcgataataatagttaaagaa

SEQ ID NO: 684564 - DNA, 25 bp, Artificial sequence
  Synthetic oligonucleotide
aaagtaatccgaacttatagttata

SEQ ID NO: 684565 - DNA, 25 bp, Artificial sequence
  Synthetic oligonucleotide
aaagtaatccgatcttatagttata

SEQ ID NO: 684566 - DNA, 25 bp, Artificial sequence
  Synthetic oligonucleotide
tcaattatatccgattagatatact

SEQ ID NO: 684567 - DNA, 25 bp, Artificial sequence
  Synthetic oligonucleotide
catacaaataattgttcgattcaaa

SEQ ID NO: 684568 - DNA, 25 bp, Artificial sequence
  Synthetic oligonucleotide
tttggagtaatccaattatatgtat

SEQ ID NO: 684569 - DNA, 25 bp, Artificial sequence
  Synthetic oligonucleotide
ttttttaatcgattgtattgatctc

SEQ ID NO: 684570 - DNA, 25 bp, Artificial sequence
  Synthetic oligonucleotide
acatcgattcaaaaatacgatttta

SEQ ID NO: 684571 - DNA, 25 bp, Artificial sequence
  Synthetic oligonucleotide
acatcgattcaataatacgatttta

SEQ ID NO: 684572 - DNA, 25 bp, Artificial sequence
  Synthetic oligonucleotide
aggtaattaactaattacgagaata

SEQ ID NO: 684573 - DNA, 25 bp, Artificial sequence
  Synthetic oligonucleotide
aggtaattaacttattacgagaata

SEQ ID NO: 684574 - DNA, 25 bp, Artificial sequence
  Synthetic oligonucleotide
aaatacgtattacgattttatgaac

SEQ ID NO: 684575 - DNA, 25 bp, Artificial sequence
  Synthetic oligonucleotide
aaatacgtattaggattttatgaac

SEQ ID NO: 684576 - DNA, 25 bp, Artificial sequence
  Synthetic oligonucleotide
aattctgtcgaagtaatatatagat

SEQ ID NO: 684577 - DNA, 25 bp, Artificial sequence
  Synthetic oligonucleotide
aattctgtcgaactaatatatagat

SEQ ID NO: 684578 - DNA, 25 bp, Artificial sequence
  Synthetic oligonucleotide
tacgtctaatctttatatcgaaatt

SEQ ID NO: 684579 - DNA, 25 bp, Artificial sequence
  Synthetic oligonucleotide
tacgtctaatctatatatcgaaatt

SEQ ID NO: 684580 - DNA, 25 bp, Artificial sequence
  Synthetic oligonucleotide
tcaattatatcccattagatatact

SEQ ID NO: 684581 - DNA, 25 bp, Artificial sequence
  Synthetic oligonucleotide
attcgctatatccaattataactta

SEQ ID NO: 684582 - DNA, 25 bp, Artificial sequence
  Synthetic oligonucleotide
ggatcactaatcctatataaaaata

SEQ ID NO: 684583 - DNA, 25 bp, Artificial sequence
  Synthetic oligonucleotide
ggatcactaatcgtatataaaaata

SEQ ID NO: 684584 - DNA, 25 bp, Artificial sequence
  Synthetic oligonucleotide
ataaaaaatagttcgattgccataa

SEQ ID NO: 684585 - DNA, 25 bp, Artificial sequence
  Synthetic oligonucleotide
ataaaaaatagtacgattgccataa

SEQ ID NO: 684586 - DNA, 25 bp, Artificial sequence
  Synthetic oligonucleotide
actgttagcgtatattaatacaaaa

SEQ ID NO: 684587 - DNA, 25 bp, Artificial sequence
  Synthetic oligonucleotide
actgttagcgtaaattaatacaaaa

SEQ ID NO: 684588 - DNA, 25 bp, Artificial sequence
  Synthetic oligonucleotide
ttcatttaatttaattcgcgtacaa

SEQ ID NO: 684589 - DNA, 25 bp, Artificial sequence
  Synthetic oligonucleotide
ttcatttaattttattcgcgtacaa

SEQ ID NO: 684590 - DNA, 25 bp, Artificial sequence
  Synthetic oligonucleotide
gttttagattaatcgtataattctg

SEQ ID NO: 684591 - DNA, 25 bp, Artificial sequence
  Synthetic oligonucleotide
agtatcgattaattaacgaacaatt

SEQ ID NO: 684592 - DNA, 25 bp, Artificial sequence
  Synthetic oligonucleotide
atttctattatacttatcggttaag

SEQ ID NO: 684593 - DNA, 25 bp, Artificial sequence
  Synthetic oligonucleotide
gttttagattaaacgtataattctg

SEQ ID NO: 684594 - DNA, 25 bp, Artificial sequence
  Synthetic oligonucleotide
tttaatacgttaatggttatgagtt

SEQ ID NO: 684595 - DNA, 25 bp, Artificial sequence
  Synthetic oligonucleotide
tttaatacgttattggttatgagtt

SEQ ID NO: 684596 - DNA, 25 bp, Artificial sequence
  Synthetic oligonucleotide
ctatcataagtccattattaatgtt

SEQ ID NO: 684597 - DNA, 25 bp, Artificial sequence
  Synthetic oligonucleotide
ctatcataagtcgattattaatgtt

SEQ ID NO: 684598 - DNA, 25 bp, Artificial sequence
  Synthetic oligonucleotide
tttctatcgactatttatcaagatt

SEQ ID NO: 684599 - DNA, 25 bp, Artificial sequence
  Synthetic oligonucleotide
tttctatcgactttttatcaagatt

SEQ ID NO: 684600 - DNA, 25 bp, Artificial sequence
  Synthetic oligonucleotide
ctaacagttgatggaatttaataat

SEQ ID NO: 684601 - DNA, 25 bp, Artificial sequence
  Synthetic oligonucleotide
ctaacagttgatcgaatttaataat

SEQ ID NO: 684602 - DNA, 25 bp, Artificial sequence
  Synthetic oligonucleotide
agtttcattataaacgattaagact

SEQ ID NO: 684603 - DNA, 25 bp, Artificial sequence
  Synthetic oligonucleotide
actcaaaaaataggtcgattaaata

SEQ ID NO: 684604 - DNA, 25 bp, Artificial sequence
  Synthetic oligonucleotide
agtttcattatatacgattaagact

SEQ ID NO: 684605 - DNA, 25 bp, Artificial sequence
  Synthetic oligonucleotide
aataaatattcgtaaaattgtcgca

SEQ ID NO: 684606 - DNA, 25 bp, Artificial sequence
  Synthetic oligonucleotide
attcgctatatcgaattataactta

SEQ ID NO: 684607 - DNA, 25 bp, Artificial sequence
  Synthetic oligonucleotide
atttctattatagttatcggttaag

SEQ ID NO: 684608 - DNA, 25 bp, Artificial sequence
  Synthetic oligonucleotide
agtatcgattaaataacgaacaatt

SEQ ID NO: 684609 - DNA, 25 bp, Artificial sequence
  Synthetic oligonucleotide
aaaaacgatagtttactaatgcaaa

SEQ ID NO: 684610 - DNA, 25 bp, Artificial sequence
  Synthetic oligonucleotide
aaaaacgatagtatactaatgcaaa

SEQ ID NO: 684611 - DNA, 25 bp, Artificial sequence
  Synthetic oligonucleotide
gtaatattttttcgagaaatagaac

SEQ ID NO: 684612 - DNA, 25 bp, Artificial sequence
  Synthetic oligonucleotide
aataaatattcgaaaaattgtcgca

SEQ ID NO: 684613 - DNA, 25 bp, Artificial sequence
  Synthetic oligonucleotide
ctcgtcgatttaaatctatttaata

SEQ ID NO: 684614 - DNA, 25 bp, Artificial sequence
  Synthetic oligonucleotide
ctcgtcgatttatatctatttaata

SEQ ID NO: 684615 - DNA, 25 bp, Artificial sequence
  Synthetic oligonucleotide
ttttataattataatcggatgtagg

SEQ ID NO: 684616 - DNA, 25 bp, Artificial sequence
  Synthetic oligonucleotide
ttttataattattatcggatgtagg

SEQ ID NO: 684617 - DNA, 25 bp, Artificial sequence
  Synthetic oligonucleotide
tgattaacgaaactcctaattaaat

SEQ ID NO: 684618 - DNA, 25 bp, Artificial sequence
  Synthetic oligonucleotide
atttaaacagtataattcgagaatc

SEQ ID NO: 684619 - DNA, 25 bp, Artificial sequence
  Synthetic oligonucleotide
gtaatattttttggagaaatagaac

SEQ ID NO: 684620 - DNA, 25 bp, Artificial sequence
  Synthetic oligonucleotide
atttaaacagtaaaattcgagaatc

SEQ ID NO: 684621 - DNA, 25 bp, Artificial sequence
  Synthetic oligonucleotide
tcttgcgtcgaattaatataaataa

SEQ ID NO: 684622 - DNA, 25 bp, Artificial sequence
  Synthetic oligonucleotide
tgattaacgaaagtcctaattaaat

SEQ ID NO: 684623 - DNA, 25 bp, Artificial sequence
  Synthetic oligonucleotide
aatatttctattggtactatatcac

SEQ ID NO: 684624 - DNA, 25 bp, Artificial sequence
  Synthetic oligonucleotide
aatatttctattcgtactatatcac

SEQ ID NO: 684625 - DNA, 25 bp, Artificial sequence
  Synthetic oligonucleotide
agtttcgataactattactaatgtt

SEQ ID NO: 684626 - DNA, 25 bp, Artificial sequence
  Synthetic oligonucleotide
agtttcgataacaattactaatgtt

SEQ ID NO: 684627 - DNA, 25 bp, Artificial sequence
  Synthetic oligonucleotide
aaataattacttcataacgatttgg

SEQ ID NO: 684628 - DNA, 25 bp, Artificial sequence
  Synthetic oligonucleotide
aaataattacttgataacgatttgg

SEQ ID NO: 684629 - DNA, 25 bp, Artificial sequence
  Synthetic oligonucleotide
tcttgcgtcgaaataatataaataa

SEQ ID NO: 684630 - DNA, 25 bp, Artificial sequence
  Synthetic oligonucleotide
acatagatatcgtaataagtcgtat

SEQ ID NO: 684631 - DNA, 25 bp, Artificial sequence
  Synthetic oligonucleotide
acggaatcgacttttatattttttc

SEQ ID NO: 684632 - DNA, 25 bp, Artificial sequence
  Synthetic oligonucleotide
acggaatcgactattatattttttc

SEQ ID NO: 684633 - DNA, 25 bp, Artificial sequence
  Synthetic oligonucleotide
ttgtagaaaattcacgatcttctat

SEQ ID NO: 684634 - DNA, 25 bp, Artificial sequence
  Synthetic oligonucleotide
ttgtagaaaattgacgatcttctat

SEQ ID NO: 684635 - DNA, 25 bp, Artificial sequence
  Synthetic oligonucleotide
caaaacgttaacatatactatactc

SEQ ID NO: 684636 - DNA, 25 bp, Artificial sequence
  Synthetic oligonucleotide
gcaattttataccactattgtagtt

SEQ ID NO: 684637 - DNA, 25 bp, Artificial sequence
  Synthetic oligonucleotide
acatagatatcgaaataagtcgtat

SEQ ID NO: 684638 - DNA, 25 bp, Artificial sequence
  Synthetic oligonucleotide
aagagttagaacggaaagatatata

SEQ ID NO: 684639 - DNA, 25 bp, Artificial sequence
  Synthetic oligonucleotide
gcaaaaattattacgacatatacct

SEQ ID NO: 684640 - DNA, 25 bp, Artificial sequence
  Synthetic oligonucleotide
caaaacgttaacttatactatactc

SEQ ID NO: 684641 - DNA, 25 bp, Artificial sequence
  Synthetic oligonucleotide
aagagttagaaccgaaagatatata

SEQ ID NO: 684642 - DNA, 25 bp, Artificial sequence
  Synthetic oligonucleotide
atcgtaattaagggaattgtcaaaa

SEQ ID NO: 684643 - DNA, 25 bp, Artificial sequence
  Synthetic oligonucleotide
atcgtaattaagcgaattgtcaaaa

SEQ ID NO: 684644 - DNA, 25 bp, Artificial sequence
  Synthetic oligonucleotide
ttggacaatattacgtagtaattag

SEQ ID NO: 684645 - DNA, 25 bp, Artificial sequence
  Synthetic oligonucleotide
ttggacaatatttcgtagtaattag

SEQ ID NO: 684646 - DNA, 25 bp, Artificial sequence
  Synthetic oligonucleotide
gtctagtgattacgtattaaactat

SEQ ID NO: 684647 - DNA, 25 bp, Artificial sequence
  Synthetic oligonucleotide
gtctagtgattaggtattaaactat

SEQ ID NO: 684648 - DNA, 25 bp, Artificial sequence
  Synthetic oligonucleotide
agatacgtataactttaatacagag

SEQ ID NO: 684649 - DNA, 25 bp, Artificial sequence
  Synthetic oligonucleotide
agatacgtataagtttaatacagag

SEQ ID NO: 684650 - DNA, 25 bp, Artificial sequence
  Synthetic oligonucleotide
ataattacgcacgttttaatgtcta

SEQ ID NO: 684651 - DNA, 25 bp, Artificial sequence
  Synthetic oligonucleotide
gcaaaaattatttcgacatatacct

SEQ ID NO: 684652 - DNA, 25 bp, Artificial sequence
  Synthetic oligonucleotide
ataattacgcaccttttaatgtcta

SEQ ID NO: 684653 - DNA, 25 bp, Artificial sequence
  Synthetic oligonucleotide
tactaacgatttgagtatattcaag

SEQ ID NO: 684654 - DNA, 25 bp, Artificial sequence
  Synthetic oligonucleotide
aatccttaaacaattgtcgctaata

SEQ ID NO: 684655 - DNA, 25 bp, Artificial sequence
  Synthetic oligonucleotide
agataaatcgataaactatattcgg

SEQ ID NO: 684656 - DNA, 25 bp, Artificial sequence
  Synthetic oligonucleotide
aatccttaaacatttgtcgctaata

SEQ ID NO: 684657 - DNA, 25 bp, Artificial sequence
  Synthetic oligonucleotide
gaatacgcctattatattaaaggtt

SEQ ID NO: 684658 - DNA, 25 bp, Artificial sequence
  Synthetic oligonucleotide
gaacttatcgcgttttatttttatc

SEQ ID NO: 684659 - DNA, 25 bp, Artificial sequence
  Synthetic oligonucleotide
tgtcatacgaattaaagattttcac

SEQ ID NO: 684660 - DNA, 25 bp, Artificial sequence
  Synthetic oligonucleotide
tgtcatacgaataaaagattttcac

SEQ ID NO: 684661 - DNA, 25 bp, Artificial sequence
  Synthetic oligonucleotide
atattatcttttacgatcgactgta

SEQ ID NO: 684662 - DNA, 25 bp, Artificial sequence
  Synthetic oligonucleotide
atattatctttttcgatcgactgta

SEQ ID NO: 684663 - DNA, 25 bp, Artificial sequence
  Synthetic oligonucleotide
gtaaatagtcaacattcgaagtatt

SEQ ID NO: 684664 - DNA, 25 bp, Artificial sequence
  Synthetic oligonucleotide
gtaaatagtcaagattcgaagtatt

SEQ ID NO: 684665 - DNA, 25 bp, Artificial sequence
  Synthetic oligonucleotide
gaacttatcgcgatttatttttatc

SEQ ID NO: 684666 - DNA, 25 bp, Artificial sequence
  Synthetic oligonucleotide
ttctatagataacacacgtttagat

SEQ ID NO: 684667 - DNA, 25 bp, Artificial sequence
  Synthetic oligonucleotide
gcaattttatacgactattgtagtt

SEQ ID NO: 684668 - DNA, 25 bp, Artificial sequence
  Synthetic oligonucleotide
tactaacgatttcagtatattcaag

SEQ ID NO: 684669 - DNA, 25 bp, Artificial sequence
  Synthetic oligonucleotide
cacaataatatgtaccgacattaaa

SEQ ID NO: 684670 - DNA, 25 bp, Artificial sequence
  Synthetic oligonucleotide
cacaataatatgaaccgacattaaa

SEQ ID NO: 684671 - DNA, 25 bp, Artificial sequence
  Synthetic oligonucleotide
gataacaattttggactgtttaaga

SEQ ID NO: 684672 - DNA, 25 bp, Artificial sequence
  Synthetic oligonucleotide
gataacaattttcgactgtttaaga

SEQ ID NO: 684673 - DNA, 25 bp, Artificial sequence
  Synthetic oligonucleotide
ataatttaattagtcgtcttcaagc

SEQ ID NO: 684674 - DNA, 25 bp, Artificial sequence
  Synthetic oligonucleotide
ataatttaattactcgtcttcaagc

SEQ ID NO: 684675 - DNA, 25 bp, Artificial sequence
  Synthetic oligonucleotide
gtatcacttcttttcggtataaata

SEQ ID NO: 684676 - DNA, 25 bp, Artificial sequence
  Synthetic oligonucleotide
gtatcacttcttatcggtataaata

SEQ ID NO: 684677 - DNA, 25 bp, Artificial sequence
  Synthetic oligonucleotide
tagtaagttaaccctaaataatagg

SEQ ID NO: 684678 - DNA, 25 bp, Artificial sequence
  Synthetic oligonucleotide
tagtaagttaacgctaaataatagg

SEQ ID NO: 684679 - DNA, 25 bp, Artificial sequence
  Synthetic oligonucleotide
ttctatagataagacacgtttagat

SEQ ID NO: 684680 - DNA, 25 bp, Artificial sequence
  Synthetic oligonucleotide
actgtagttattcggatgaaattta

SEQ ID NO: 684681 - DNA, 25 bp, Artificial sequence
  Synthetic oligonucleotide
tacaaagtgttaacgctaattaaac

SEQ ID NO: 684682 - DNA, 25 bp, Artificial sequence
  Synthetic oligonucleotide
cagaatatcgtaatggaatttaatc

SEQ ID NO: 684683 - DNA, 25 bp, Artificial sequence
  Synthetic oligonucleotide
cagaatatcgtattggaatttaatc

SEQ ID NO: 684684 - DNA, 25 bp, Artificial sequence
  Synthetic oligonucleotide
tgctacgataataactaatcaaaca

SEQ ID NO: 684685 - DNA, 25 bp, Artificial sequence
  Synthetic oligonucleotide
tgctacgataattactaatcaaaca

SEQ ID NO: 684686 - DNA, 25 bp, Artificial sequence
  Synthetic oligonucleotide
attatacgcgaaatacaatacctat

SEQ ID NO: 684687 - DNA, 25 bp, Artificial sequence
  Synthetic oligonucleotide
attatacgcgaattacaatacctat

SEQ ID NO: 684688 - DNA, 25 bp, Artificial sequence
  Synthetic oligonucleotide
caaatttatgcgaattaatagtggt

SEQ ID NO: 684689 - DNA, 25 bp, Artificial sequence
  Synthetic oligonucleotide
caaatttatgcgtattaatagtggt

SEQ ID NO: 684690 - DNA, 25 bp, Artificial sequence
  Synthetic oligonucleotide
ctatttacggttattataacgatct

SEQ ID NO: 684691 - DNA, 25 bp, Artificial sequence
  Synthetic oligonucleotide
aatcatattataacgagtaagtgac

SEQ ID NO: 684692 - DNA, 25 bp, Artificial sequence
  Synthetic oligonucleotide
actgtagttattgggatgaaattta

SEQ ID NO: 684693 - DNA, 25 bp, Artificial sequence
  Synthetic oligonucleotide
agataaatcgattaactatattcgg

SEQ ID NO: 684694 - DNA, 25 bp, Artificial sequence
  Synthetic oligonucleotide
ctgtaaatcgtttttcaatattctg

SEQ ID NO: 684695 - DNA, 25 bp, Artificial sequence
  Synthetic oligonucleotide
ctgtaaatcgttattcaatattctg

SEQ ID NO: 684696 - DNA, 25 bp, Artificial sequence
  Synthetic oligonucleotide
gtatgtaatttaactacgatcagat

SEQ ID NO: 684697 - DNA, 25 bp, Artificial sequence
  Synthetic oligonucleotide
gtatgtaatttatctacgatcagat

SEQ ID NO: 684698 - DNA, 25 bp, Artificial sequence
  Synthetic oligonucleotide
tgatatattatttcgtcgaagatga

SEQ ID NO: 684699 - DNA, 25 bp, Artificial sequence
  Synthetic oligonucleotide
tgatatattattacgtcgaagatga

SEQ ID NO: 684700 - DNA, 25 bp, Artificial sequence
  Synthetic oligonucleotide
tcgaggaatacgatacaataattta

SEQ ID NO: 684701 - DNA, 25 bp, Artificial sequence
  Synthetic oligonucleotide
agatttctcgaattttaccatattg

SEQ ID NO: 684702 - DNA, 25 bp, Artificial sequence
  Synthetic oligonucleotide
atttacaatgatttcgtatactctc

SEQ ID NO: 684703 - DNA, 25 bp, Artificial sequence
  Synthetic oligonucleotide
tcgaggaatacgttacaataattta

SEQ ID NO: 684704 - DNA, 25 bp, Artificial sequence
  Synthetic oligonucleotide
ctatttacggtttttataacgatct

SEQ ID NO: 684705 - DNA, 25 bp, Artificial sequence
  Synthetic oligonucleotide
atttgtttcgtccatttttaagaga

SEQ ID NO: 684706 - DNA, 25 bp, Artificial sequence
  Synthetic oligonucleotide
tgcgaataagtcctattatatttct

SEQ ID NO: 684707 - DNA, 25 bp, Artificial sequence
  Synthetic oligonucleotide
tgcgaataagtcgtattatatttct

SEQ ID NO: 684708 - DNA, 25 bp, Artificial sequence
  Synthetic oligonucleotide
tgttctaacgctatgataatatgat

SEQ ID NO: 684709 - DNA, 25 bp, Artificial sequence
  Synthetic oligonucleotide
tgttctaacgctttgataatatgat

SEQ ID NO: 684710 - DNA, 25 bp, Artificial sequence
  Synthetic oligonucleotide
ttatacgttataaatataagctggg

SEQ ID NO: 684711 - DNA, 25 bp, Artificial sequence
  Synthetic oligonucleotide
ttatacgttatatatataagctggg

SEQ ID NO: 684712 - DNA, 25 bp, Artificial sequence
  Synthetic oligonucleotide
tagaataatttagtttacgaccaac

SEQ ID NO: 684713 - DNA, 25 bp, Artificial sequence
  Synthetic oligonucleotide
tagaataatttactttacgaccaac

SEQ ID NO: 684714 - DNA, 25 bp, Artificial sequence
  Synthetic oligonucleotide
tctttaatttaatcgaacgcgttta

SEQ ID NO: 684715 - DNA, 25 bp, Artificial sequence
  Synthetic oligonucleotide
tctttaatttaaacgaacgcgttta

SEQ ID NO: 684716 - DNA, 25 bp, Artificial sequence
  Synthetic oligonucleotide
aatcatattatatcgagtaagtgac

SEQ ID NO: 684717 - DNA, 25 bp, Artificial sequence
  Synthetic oligonucleotide
caatgatagaatatatccgatcata

SEQ ID NO: 684718 - DNA, 25 bp, Artificial sequence
  Synthetic oligonucleotide
gaatacgcctataatattaaaggtt

SEQ ID NO: 684719 - DNA, 25 bp, Artificial sequence
  Synthetic oligonucleotide
atttgtttcgtcgatttttaagaga

SEQ ID NO: 684720 - DNA, 25 bp, Artificial sequence
  Synthetic oligonucleotide
tctaatcatattacgataatccatg

SEQ ID NO: 684721 - DNA, 25 bp, Artificial sequence
  Synthetic oligonucleotide
tctaatcatatttcgataatccatg

SEQ ID NO: 684722 - DNA, 25 bp, Artificial sequence
  Synthetic oligonucleotide
aataagtatatattcgaacggagtt

SEQ ID NO: 684723 - DNA, 25 bp, Artificial sequence
  Synthetic oligonucleotide
aataagtatataatcgaacggagtt

SEQ ID NO: 684724 - DNA, 25 bp, Artificial sequence
  Synthetic oligonucleotide
acagaaaagttcgtaatatgagaat

SEQ ID NO: 684725 - DNA, 25 bp, Artificial sequence
  Synthetic oligonucleotide
acagaaaagttcctaatatgagaat

SEQ ID NO: 684726 - DNA, 25 bp, Artificial sequence
  Synthetic oligonucleotide
gcttgtacgaaataatactatagaa

SEQ ID NO: 684727 - DNA, 25 bp, Artificial sequence
  Synthetic oligonucleotide
gcttgtacgaaaaaatactatagaa

SEQ ID NO: 684728 - DNA, 25 bp, Artificial sequence
  Synthetic oligonucleotide
tacaaagtgttatcgctaattaaac

SEQ ID NO: 684729 - DNA, 25 bp, Artificial sequence
  Synthetic oligonucleotide
caatgatagaatttatccgatcata

SEQ ID NO: 684730 - DNA, 25 bp, Artificial sequence
  Synthetic oligonucleotide
caacatcggtaactttatatagaat

SEQ ID NO: 684731 - DNA, 25 bp, Artificial sequence
  Synthetic oligonucleotide
ttagatcgtatatacgaaatccata

SEQ ID NO: 684732 - DNA, 25 bp, Artificial sequence
  Synthetic oligonucleotide
aatcaattcgtttgttgaacaactt

SEQ ID NO: 684733 - DNA, 25 bp, Artificial sequence
  Synthetic oligonucleotide
aatcaattcgttagttgaacaactt

SEQ ID NO: 684734 - DNA, 25 bp, Artificial sequence
  Synthetic oligonucleotide
cacagatattcgatatgatataact

SEQ ID NO: 684735 - DNA, 25 bp, Artificial sequence
  Synthetic oligonucleotide
cacagatattcgttatgatataact

SEQ ID NO: 684736 - DNA, 25 bp, Artificial sequence
  Synthetic oligonucleotide
ttgaataacgactatgaattatgac

SEQ ID NO: 684737 - DNA, 25 bp, Artificial sequence
  Synthetic oligonucleotide
ttgaataacgacaatgaattatgac

SEQ ID NO: 684738 - DNA, 25 bp, Artificial sequence
  Synthetic oligonucleotide
ctatctcgaactatagtaaaattac

SEQ ID NO: 684739 - DNA, 25 bp, Artificial sequence
  Synthetic oligonucleotide
ctatctcgaactttagtaaaattac

SEQ ID NO: 684740 - DNA, 25 bp, Artificial sequence
  Synthetic oligonucleotide
taatttcgttagactcaattagaag

SEQ ID NO: 684741 - DNA, 25 bp, Artificial sequence
  Synthetic oligonucleotide
atagtacgactatatatcttaatcc

SEQ ID NO: 684742 - DNA, 25 bp, Artificial sequence
  Synthetic oligonucleotide
caacatcggtaagtttatatagaat

SEQ ID NO: 684743 - DNA, 25 bp, Artificial sequence
  Synthetic oligonucleotide
aactatatcgtatgctacaacattt

SEQ ID NO: 684744 - DNA, 25 bp, Artificial sequence
  Synthetic oligonucleotide
tactgcttgcatggatataaaaaat

SEQ ID NO: 684745 - DNA, 25 bp, Artificial sequence
  Synthetic oligonucleotide
tactgcttgcatcgatataaaaaat

SEQ ID NO: 684746 - DNA, 25 bp, Artificial sequence
  Synthetic oligonucleotide
ctcaataaggttgttatcgataaaa

SEQ ID NO: 684747 - DNA, 25 bp, Artificial sequence
  Synthetic oligonucleotide
ctcaataaggttcttatcgataaaa

SEQ ID NO: 684748 - DNA, 25 bp, Artificial sequence
  Synthetic oligonucleotide
aattactagaaaaaccgtatgctaa

SEQ ID NO: 684749 - DNA, 25 bp, Artificial sequence
  Synthetic oligonucleotide
aattactagaaataccgtatgctaa

SEQ ID NO: 684750 - DNA, 25 bp, Artificial sequence
  Synthetic oligonucleotide
aatatagtatagttagtcgaaaacg

SEQ ID NO: 684751 - DNA, 25 bp, Artificial sequence
  Synthetic oligonucleotide
aatatagtatagatagtcgaaaacg

SEQ ID NO: 684752 - DNA, 25 bp, Artificial sequence
  Synthetic oligonucleotide
tgtagtattatacttaacgcaatca

SEQ ID NO: 684753 - DNA, 25 bp, Artificial sequence
  Synthetic oligonucleotide
tcatatagatgaatatcgaaacatg

SEQ ID NO: 684754 - DNA, 25 bp, Artificial sequence
  Synthetic oligonucleotide
taatttcgttagtctcaattagaag

SEQ ID NO: 684755 - DNA, 25 bp, Artificial sequence
  Synthetic oligonucleotide
taagaagtcttattagatcgattac

SEQ ID NO: 684756 - DNA, 25 bp, Artificial sequence
  Synthetic oligonucleotide
agacccgtattcttatattaaatga

SEQ ID NO: 684757 - DNA, 25 bp, Artificial sequence
  Synthetic oligonucleotide
actttctattgtacgtcaaagaata

SEQ ID NO: 684758 - DNA, 25 bp, Artificial sequence
  Synthetic oligonucleotide
acatacgactaatcagttattaagt

SEQ ID NO: 684759 - DNA, 25 bp, Artificial sequence
  Synthetic oligonucleotide
acatacgactaaacagttattaagt

SEQ ID NO: 684760 - DNA, 25 bp, Artificial sequence
  Synthetic oligonucleotide
tcattcggaattatttgacttattg

SEQ ID NO: 684761 - DNA, 25 bp, Artificial sequence
  Synthetic oligonucleotide
tcattcggaattttttgacttattg

SEQ ID NO: 684762 - DNA, 25 bp, Artificial sequence
  Synthetic oligonucleotide
aagtatattatagtatatcgccctt

SEQ ID NO: 684763 - DNA, 25 bp, Artificial sequence
  Synthetic oligonucleotide
aagtatattatactatatcgccctt

SEQ ID NO: 684764 - DNA, 25 bp, Artificial sequence
  Synthetic oligonucleotide
gtctcctaaatttatcgaaaacaat

SEQ ID NO: 684765 - DNA, 25 bp, Artificial sequence
  Synthetic oligonucleotide
gtctcctaaattaatcgaaaacaat

SEQ ID NO: 684766 - DNA, 25 bp, Artificial sequence
  Synthetic oligonucleotide
atagtacgactaaatatcttaatcc

SEQ ID NO: 684767 - DNA, 25 bp, Artificial sequence
  Synthetic oligonucleotide
tcgtggataactatatcgattttta

SEQ ID NO: 684768 - DNA, 25 bp, Artificial sequence
  Synthetic oligonucleotide
atttacaatgatatcgtatactctc

SEQ ID NO: 684769 - DNA, 25 bp, Artificial sequence
  Synthetic oligonucleotide
taagaagtcttaatagatcgattac

SEQ ID NO: 684770 - DNA, 25 bp, Artificial sequence
  Synthetic oligonucleotide
gattgacgttaatgtgatattttac

SEQ ID NO: 684771 - DNA, 25 bp, Artificial sequence
  Synthetic oligonucleotide
gattgacgttaaagtgatattttac

SEQ ID NO: 684772 - DNA, 25 bp, Artificial sequence
  Synthetic oligonucleotide
ctaatttttacgaaacgcatatgat

SEQ ID NO: 684773 - DNA, 25 bp, Artificial sequence
  Synthetic oligonucleotide
ctaatttttacgtaacgcatatgat

SEQ ID NO: 684774 - DNA, 25 bp, Artificial sequence
  Synthetic oligonucleotide
aagaggatggcgaaatattattata

SEQ ID NO: 684775 - DNA, 25 bp, Artificial sequence
  Synthetic oligonucleotide
aagaggatggcgtaatattattata

SEQ ID NO: 684776 - DNA, 25 bp, Artificial sequence
  Synthetic oligonucleotide
aagggcatacgttatataagaaatt

SEQ ID NO: 684777 - DNA, 25 bp, Artificial sequence
  Synthetic oligonucleotide
aagggcatacgtaatataagaaatt

SEQ ID NO: 684778 - DNA, 25 bp, Artificial sequence
  Synthetic oligonucleotide
aactatatcgtaagctacaacattt

SEQ ID NO: 684779 - DNA, 25 bp, Artificial sequence
  Synthetic oligonucleotide
tcgtggataactttatcgattttta

SEQ ID NO: 684780 - DNA, 25 bp, Artificial sequence
  Synthetic oligonucleotide
tctaagtaagcgtattattagtgaa

SEQ ID NO: 684781 - DNA, 25 bp, Artificial sequence
  Synthetic oligonucleotide
tgtagtattatagttaacgcaatca

SEQ ID NO: 684782 - DNA, 25 bp, Artificial sequence
  Synthetic oligonucleotide
tcagcatcgaaaattttcgataatt

SEQ ID NO: 684783 - DNA, 25 bp, Artificial sequence
  Synthetic oligonucleotide
tcagcatcgaaatttttcgataatt

SEQ ID NO: 684784 - DNA, 25 bp, Artificial sequence
  Synthetic oligonucleotide
atcaagcgtattttgatagaacaat

SEQ ID NO: 684785 - DNA, 25 bp, Artificial sequence
  Synthetic oligonucleotide
atcaagcgtattatgatagaacaat

SEQ ID NO: 684786 - DNA, 25 bp, Artificial sequence
  Synthetic oligonucleotide
atagatactattaatcgatcgaaca

SEQ ID NO: 684787 - DNA, 25 bp, Artificial sequence
  Synthetic oligonucleotide
atagatactatttatcgatcgaaca

SEQ ID NO: 684788 - DNA, 25 bp, Artificial sequence
  Synthetic oligonucleotide
tccgttcgtactttataatgtaata

SEQ ID NO: 684789 - DNA, 25 bp, Artificial sequence
  Synthetic oligonucleotide
tccgttcgtactatataatgtaata

SEQ ID NO: 684790 - DNA, 25 bp, Artificial sequence
  Synthetic oligonucleotide
tagttatttaaccatcgaatattgc

SEQ ID NO: 684791 - DNA, 25 bp, Artificial sequence
  Synthetic oligonucleotide
gattgaattgtgcgatatgaaaaaa

SEQ ID NO: 684792 - DNA, 25 bp, Artificial sequence
  Synthetic oligonucleotide
tctaagtaagcgaattattagtgaa

SEQ ID NO: 684793 - DNA, 25 bp, Artificial sequence
  Synthetic oligonucleotide
atttttactattagtacgatcatgc

SEQ ID NO: 684794 - DNA, 25 bp, Artificial sequence
  Synthetic oligonucleotide
taaacatatattccgtagacttaca

SEQ ID NO: 684795 - DNA, 25 bp, Artificial sequence
  Synthetic oligonucleotide
taaacatatattgcgtagacttaca

SEQ ID NO: 684796 - DNA, 25 bp, Artificial sequence
  Synthetic oligonucleotide
ttgataagcggtaaatagtaatagt

SEQ ID NO: 684797 - DNA, 25 bp, Artificial sequence
  Synthetic oligonucleotide
ttgataagcggttaatagtaatagt

SEQ ID NO: 684798 - DNA, 25 bp, Artificial sequence
  Synthetic oligonucleotide
tcgttacgcaattctcttattaata

SEQ ID NO: 684799 - DNA, 25 bp, Artificial sequence
  Synthetic oligonucleotide
tcgttacgcaatactcttattaata

SEQ ID NO: 684800 - DNA, 25 bp, Artificial sequence
  Synthetic oligonucleotide
aagagaaataccctaattgcttata

SEQ ID NO: 684801 - DNA, 25 bp, Artificial sequence
  Synthetic oligonucleotide
aagagaaataccgtaattgcttata

SEQ ID NO: 684802 - DNA, 25 bp, Artificial sequence
  Synthetic oligonucleotide
tcaattatcgaaatttagcgtttgt

SEQ ID NO: 684803 - DNA, 25 bp, Artificial sequence
  Synthetic oligonucleotide
tcaattatcgaattttagcgtttgt

SEQ ID NO: 684804 - DNA, 25 bp, Artificial sequence
  Synthetic oligonucleotide
tagttatttaacgatcgaatattgc

SEQ ID NO: 684805 - DNA, 25 bp, Artificial sequence
  Synthetic oligonucleotide
taaagtttttaatacgtcgattctc

SEQ ID NO: 684806 - DNA, 25 bp, Artificial sequence
  Synthetic oligonucleotide
actttctattgttcgtcaaagaata

SEQ ID NO: 684807 - DNA, 25 bp, Artificial sequence
  Synthetic oligonucleotide
tcatatagatgattatcgaaacatg

SEQ ID NO: 684808 - DNA, 25 bp, Artificial sequence
  Synthetic oligonucleotide
ttctaacggttattttattgactgt

SEQ ID NO: 684809 - DNA, 25 bp, Artificial sequence
  Synthetic oligonucleotide
ttctaacggttaatttattgactgt

SEQ ID NO: 684810 - DNA, 25 bp, Artificial sequence
  Synthetic oligonucleotide
aataaaaacgatatagttgctctac

SEQ ID NO: 684811 - DNA, 25 bp, Artificial sequence
  Synthetic oligonucleotide
aataaaaacgatttagttgctctac

SEQ ID NO: 684812 - DNA, 25 bp, Artificial sequence
  Synthetic oligonucleotide
tctaatagatagtacgcataacatt

SEQ ID NO: 684813 - DNA, 25 bp, Artificial sequence
  Synthetic oligonucleotide
tctaatagatagaacgcataacatt

SEQ ID NO: 684814 - DNA, 25 bp, Artificial sequence
  Synthetic oligonucleotide
atcgattagatagttcgtaaactaa

SEQ ID NO: 684815 - DNA, 25 bp, Artificial sequence
  Synthetic oligonucleotide
atcgattagatacttcgtaaactaa

SEQ ID NO: 684816 - DNA, 25 bp, Artificial sequence
  Synthetic oligonucleotide
gattgaattgtgggatatgaaaaaa

SEQ ID NO: 684817 - DNA, 25 bp, Artificial sequence
  Synthetic oligonucleotide
tcaatcttaatcgtaacgtattaga

SEQ ID NO: 684818 - DNA, 25 bp, Artificial sequence
  Synthetic oligonucleotide
agatttctcgaaatttaccatattg

SEQ ID NO: 684819 - DNA, 25 bp, Artificial sequence
  Synthetic oligonucleotide
taaagtttttaaaacgtcgattctc

SEQ ID NO: 684820 - DNA, 25 bp, Artificial sequence
  Synthetic oligonucleotide
agagtatactaatcgtttaactttg

SEQ ID NO: 684821 - DNA, 25 bp, Artificial sequence
  Synthetic oligonucleotide
agagtatactaaacgtttaactttg

SEQ ID NO: 684822 - DNA, 25 bp, Artificial sequence
  Synthetic oligonucleotide
tttatataaccaatatatcggaggt

SEQ ID NO: 684823 - DNA, 25 bp, Artificial sequence
  Synthetic oligonucleotide
tttatataaccattatatcggaggt

SEQ ID NO: 684824 - DNA, 25 bp, Artificial sequence
  Synthetic oligonucleotide
ctaagttataattgttagcgtttga

SEQ ID NO: 684825 - DNA, 25 bp, Artificial sequence
  Synthetic oligonucleotide
ctaagttataatagttagcgtttga

SEQ ID NO: 684826 - DNA, 25 bp, Artificial sequence
  Synthetic oligonucleotide
atataaactaattgcgtactttcga

SEQ ID NO: 684827 - DNA, 25 bp, Artificial sequence
  Synthetic oligonucleotide
atataaactaatagcgtactttcga

SEQ ID NO: 684828 - DNA, 25 bp, Artificial sequence
  Synthetic oligonucleotide
atttttactatttgtacgatcatgc

SEQ ID NO: 684829 - DNA, 25 bp, Artificial sequence
  Synthetic oligonucleotide
tcaatcttaatcctaacgtattaga

SEQ ID NO: 684830 - DNA, 25 bp, Artificial sequence
  Synthetic oligonucleotide
tcaatatagataattaaccgcagtt

SEQ ID NO: 684831 - DNA, 25 bp, Artificial sequence
  Synthetic oligonucleotide
tattttatcatatcgatacgcacat

SEQ ID NO: 684832 - DNA, 25 bp, Artificial sequence
  Synthetic oligonucleotide
ttcattgcgtaatctatattttggt

SEQ ID NO: 684833 - DNA, 25 bp, Artificial sequence
  Synthetic oligonucleotide
ttcattgcgtaaactatattttggt

SEQ ID NO: 684834 - DNA, 25 bp, Artificial sequence
  Synthetic oligonucleotide
cgactatttagttcgtcatattaaa

SEQ ID NO: 684835 - DNA, 25 bp, Artificial sequence
  Synthetic oligonucleotide
cgactatttagtacgtcatattaaa

SEQ ID NO: 684836 - DNA, 25 bp, Artificial sequence
  Synthetic oligonucleotide
ttctacgatgaacatttctaaaact

SEQ ID NO: 684837 - DNA, 25 bp, Artificial sequence
  Synthetic oligonucleotide
ttctacgatgaagatttctaaaact

SEQ ID NO: 684838 - DNA, 25 bp, Artificial sequence
  Synthetic oligonucleotide
atcaatcgcgaaatttttactatac

SEQ ID NO: 684839 - DNA, 25 bp, Artificial sequence
  Synthetic oligonucleotide
atcaatcgcgaattttttactatac

SEQ ID NO: 684840 - DNA, 25 bp, Artificial sequence
  Synthetic oligonucleotide
tttgaattcgataaccgaaacaaat

SEQ ID NO: 684841 - DNA, 25 bp, Artificial sequence
  Synthetic oligonucleotide
tacttacgtttacgttatagatttg

SEQ ID NO: 684842 - DNA, 25 bp, Artificial sequence
  Synthetic oligonucleotide
tcaatatagatatttaaccgcagtt

SEQ ID NO: 684843 - DNA, 25 bp, Artificial sequence
  Synthetic oligonucleotide
gactatttttcgaattgatccaaaa

SEQ ID NO: 684844 - DNA, 25 bp, Artificial sequence
  Synthetic oligonucleotide
gtaagcgataattattcgtaaaaga

SEQ ID NO: 684845 - DNA, 25 bp, Artificial sequence
  Synthetic oligonucleotide
gtaagcgataataattcgtaaaaga

SEQ ID NO: 684846 - DNA, 25 bp, Artificial sequence
  Synthetic oligonucleotide
aataattaacgtagcgcgataatat

SEQ ID NO: 684847 - DNA, 25 bp, Artificial sequence
  Synthetic oligonucleotide
aataattaacgttgcgcgataatat

SEQ ID NO: 684848 - DNA, 25 bp, Artificial sequence
  Synthetic oligonucleotide
aatatattaatacgcggacagattt

SEQ ID NO: 684849 - DNA, 25 bp, Artificial sequence
  Synthetic oligonucleotide
aatatattaataggcggacagattt

SEQ ID NO: 684850 - DNA, 25 bp, Artificial sequence
  Synthetic oligonucleotide
ttgtattccgtccaactataaataa

SEQ ID NO: 684851 - DNA, 25 bp, Artificial sequence
  Synthetic oligonucleotide
ttgtattccgtcgaactataaataa

SEQ ID NO: 684852 - DNA, 25 bp, Artificial sequence
  Synthetic oligonucleotide
aatagatatcgcgatagacataaat

SEQ ID NO: 684853 - DNA, 25 bp, Artificial sequence
  Synthetic oligonucleotide
aatagatatcgccatagacataaat

SEQ ID NO: 684854 - DNA, 25 bp, Artificial sequence
  Synthetic oligonucleotide
tttgaattcgattaccgaaacaaat

SEQ ID NO: 684855 - DNA, 25 bp, Artificial sequence
  Synthetic oligonucleotide
cttcaagtacgttctaaatcattaa

SEQ ID NO: 684856 - DNA, 25 bp, Artificial sequence
  Synthetic oligonucleotide
tttagacaatataaatcgcttcaga

SEQ ID NO: 684857 - DNA, 25 bp, Artificial sequence
  Synthetic oligonucleotide
tttagacaatattaatcgcttcaga

SEQ ID NO: 684858 - DNA, 25 bp, Artificial sequence
  Synthetic oligonucleotide
taagtatacggtgtaaattatctct

SEQ ID NO: 684859 - DNA, 25 bp, Artificial sequence
  Synthetic oligonucleotide
taagtatacggtctaaattatctct

SEQ ID NO: 684860 - DNA, 25 bp, Artificial sequence
  Synthetic oligonucleotide
agtggatattaccattagtttatag

SEQ ID NO: 684861 - DNA, 25 bp, Artificial sequence
  Synthetic oligonucleotide
agtggatattacgattagtttatag

SEQ ID NO: 684862 - DNA, 25 bp, Artificial sequence
  Synthetic oligonucleotide
tctaagtataaaactcgaactgttt

SEQ ID NO: 684863 - DNA, 25 bp, Artificial sequence
  Synthetic oligonucleotide
tctaagtataaatctcgaactgttt

SEQ ID NO: 684864 - DNA, 25 bp, Artificial sequence
  Synthetic oligonucleotide
aaacatgtcggttaataacaatcta

SEQ ID NO: 684865 - DNA, 25 bp, Artificial sequence
  Synthetic oligonucleotide
aaacatgtcggtaaataacaatcta

SEQ ID NO: 684866 - DNA, 25 bp, Artificial sequence
  Synthetic oligonucleotide
tacttacgtttaggttatagatttg

SEQ ID NO: 684867 - DNA, 25 bp, Artificial sequence
  Synthetic oligonucleotide
gactctttaatatcgatatgacata

SEQ ID NO: 684868 - DNA, 25 bp, Artificial sequence
  Synthetic oligonucleotide
agtatatagctatacgcgttatata

SEQ ID NO: 684869 - DNA, 25 bp, Artificial sequence
  Synthetic oligonucleotide
cttcaagtacgtactaaatcattaa

SEQ ID NO: 684870 - DNA, 25 bp, Artificial sequence
  Synthetic oligonucleotide
tcatatatatgagtaccgttgattt

SEQ ID NO: 684871 - DNA, 25 bp, Artificial sequence
  Synthetic oligonucleotide
tcatatatatgactaccgttgattt

SEQ ID NO: 684872 - DNA, 25 bp, Artificial sequence
  Synthetic oligonucleotide
gaataatacgtgatcgattaattgt

SEQ ID NO: 684873 - DNA, 25 bp, Artificial sequence
  Synthetic oligonucleotide
gaataatacgtgttcgattaattgt

SEQ ID NO: 684874 - DNA, 25 bp, Artificial sequence
  Synthetic oligonucleotide
ctttacaaaattgaatcgtcttaca

SEQ ID NO: 684875 - DNA, 25 bp, Artificial sequence
  Synthetic oligonucleotide
ctttacaaaattcaatcgtcttaca

SEQ ID NO: 684876 - DNA, 25 bp, Artificial sequence
  Synthetic oligonucleotide
gtactacttattaggaacgattaat

SEQ ID NO: 684877 - DNA, 25 bp, Artificial sequence
  Synthetic oligonucleotide
gtactacttatttggaacgattaat

SEQ ID NO: 684878 - DNA, 25 bp, Artificial sequence
  Synthetic oligonucleotide
gactatttttcgtattgatccaaaa

SEQ ID NO: 684879 - DNA, 25 bp, Artificial sequence
  Synthetic oligonucleotide
gactctttaataacgatatgacata

SEQ ID NO: 684880 - DNA, 25 bp, Artificial sequence
  Synthetic oligonucleotide
aaaatatacgcgataacttaaactc

SEQ ID NO: 684881 - DNA, 25 bp, Artificial sequence
  Synthetic oligonucleotide
tttttcaatgttggcgactatattt

SEQ ID NO: 684882 - DNA, 25 bp, Artificial sequence
  Synthetic oligonucleotide
tttttcaatgttcgcgactatattt

SEQ ID NO: 684883 - DNA, 25 bp, Artificial sequence
  Synthetic oligonucleotide
gaactattatcgcgtagtaataatt

SEQ ID NO: 684884 - DNA, 25 bp, Artificial sequence
  Synthetic oligonucleotide
gaactattatcgggtagtaataatt

SEQ ID NO: 684885 - DNA, 25 bp, Artificial sequence
  Synthetic oligonucleotide
agtaaatcgttatcgcatatttact

SEQ ID NO: 684886 - DNA, 25 bp, Artificial sequence
  Synthetic oligonucleotide
agtaaatcgttaacgcatatttact

SEQ ID NO: 684887 - DNA, 25 bp, Artificial sequence
  Synthetic oligonucleotide
aggtaatccgatcgtaataaattta

SEQ ID NO: 684888 - DNA, 25 bp, Artificial sequence
  Synthetic oligonucleotide
aggtaatccgatggtaataaattta

SEQ ID NO: 684889 - DNA, 25 bp, Artificial sequence
  Synthetic oligonucleotide
ataacttatgtatcgacgttataag

SEQ ID NO: 684890 - DNA, 25 bp, Artificial sequence
  Synthetic oligonucleotide
ataacttatgtaacgacgttataag

SEQ ID NO: 684891 - DNA, 25 bp, Artificial sequence
  Synthetic oligonucleotide
aatttttatcccgcgtatagatata

SEQ ID NO: 684892 - DNA, 25 bp, Artificial sequence
  Synthetic oligonucleotide
ttaatttagtacctcgatacaactt

SEQ ID NO: 684893 - DNA, 25 bp, Artificial sequence
  Synthetic oligonucleotide
aaatttatctagggcgataatttgt

SEQ ID NO: 684894 - DNA, 25 bp, Artificial sequence
  Synthetic oligonucleotide
aaaatatacgcgttaacttaaactc

SEQ ID NO: 684895 - DNA, 25 bp, Artificial sequence
  Synthetic oligonucleotide
aactattacatcccgtattgaattt

SEQ ID NO: 684896 - DNA, 25 bp, Artificial sequence
  Synthetic oligonucleotide
aactattacatcgcgtattgaattt

SEQ ID NO: 684897 - DNA, 25 bp, Artificial sequence
  Synthetic oligonucleotide
taacttctattatcgtacgtaaaag

SEQ ID NO: 684898 - DNA, 25 bp, Artificial sequence
  Synthetic oligonucleotide
taacttctattaacgtacgtaaaag

SEQ ID NO: 684899 - DNA, 25 bp, Artificial sequence
  Synthetic oligonucleotide
caatttattatccgcgtaaaacaat

SEQ ID NO: 684900 - DNA, 25 bp, Artificial sequence
  Synthetic oligonucleotide
caatttattatcggcgtaaaacaat

SEQ ID NO: 684901 - DNA, 25 bp, Artificial sequence
  Synthetic oligonucleotide
ttagatcgtataaacgaaatccata

SEQ ID NO: 684902 - DNA, 25 bp, Artificial sequence
  Synthetic oligonucleotide
ataggtattagcgcgatataattta

SEQ ID NO: 684903 - DNA, 25 bp, Artificial sequence
  Synthetic oligonucleotide
gcatatgaattaaacgtacgtttat

SEQ ID NO: 684904 - DNA, 25 bp, Artificial sequence
  Synthetic oligonucleotide
ttaatttagtacgtcgatacaactt

SEQ ID NO: 684905 - DNA, 25 bp, Artificial sequence
  Synthetic oligonucleotide
ttagttcgtatcgtacgaatattat

SEQ ID NO: 684906 - DNA, 25 bp, Artificial sequence
  Synthetic oligonucleotide
ataggtattagcccgatataattta

SEQ ID NO: 684907 - DNA, 25 bp, Artificial sequence
  Synthetic oligonucleotide
agtatatagctaaacgcgttatata

SEQ ID NO: 684908 - DNA, 25 bp, Artificial sequence
  Synthetic oligonucleotide
atatattagatcgcgatagtttagt

SEQ ID NO: 684909 - DNA, 25 bp, Artificial sequence
  Synthetic oligonucleotide
atatattagatcccgatagtttagt

SEQ ID NO: 684910 - DNA, 25 bp, Artificial sequence
  Synthetic oligonucleotide
aataactactcgtaacgcaattaaa

SEQ ID NO: 684911 - DNA, 25 bp, Artificial sequence
  Synthetic oligonucleotide
aataactactcgaaacgcaattaaa

SEQ ID NO: 684912 - DNA, 25 bp, Artificial sequence
  Synthetic oligonucleotide
tttgaatacgaaggcgttatatata

SEQ ID NO: 684913 - DNA, 25 bp, Artificial sequence
  Synthetic oligonucleotide
tttgaatacgaacgcgttatatata

SEQ ID NO: 684914 - DNA, 25 bp, Artificial sequence
  Synthetic oligonucleotide
attattcttattagtcgcgtatatg

SEQ ID NO: 684915 - DNA, 25 bp, Artificial sequence
  Synthetic oligonucleotide
attattcttatttgtcgcgtatatg

SEQ ID NO: 684916 - DNA, 25 bp, Artificial sequence
  Synthetic oligonucleotide
taatataattaccctagcgactata

SEQ ID NO: 684917 - DNA, 25 bp, Artificial sequence
  Synthetic oligonucleotide
taaattcgtcttatagcgtattaca

SEQ ID NO: 684918 - DNA, 25 bp, Artificial sequence
  Synthetic oligonucleotide
taatataattacgctagcgactata

SEQ ID NO: 684919 - DNA, 25 bp, Artificial sequence
  Synthetic oligonucleotide
ttagttcgtatcctacgaatattat

SEQ ID NO: 684920 - DNA, 25 bp, Artificial sequence
  Synthetic oligonucleotide
tattatcgtacgaacgtaaattctt

SEQ ID NO: 684921 - DNA, 25 bp, Artificial sequence
  Synthetic oligonucleotide
tattatcgtacgtacgtaaattctt

SEQ ID NO: 684922 - DNA, 25 bp, Artificial sequence
  Synthetic oligonucleotide
aaataacggtcttacgatatactaa

SEQ ID NO: 684923 - DNA, 25 bp, Artificial sequence
  Synthetic oligonucleotide
aaataacggtctaacgatatactaa

SEQ ID NO: 684924 - DNA, 25 bp, Artificial sequence
  Synthetic oligonucleotide
taaattcgaattacgacgtttattc

SEQ ID NO: 684925 - DNA, 25 bp, Artificial sequence
  Synthetic oligonucleotide
taaattcgaatttcgacgtttattc

SEQ ID NO: 684926 - DNA, 25 bp, Artificial sequence
  Synthetic oligonucleotide
aatatacgaataacgtacgaatatg

SEQ ID NO: 684927 - DNA, 25 bp, Artificial sequence
  Synthetic oligonucleotide
aatatacgaatatcgtacgaatatg

SEQ ID NO: 684928 - DNA, 25 bp, Artificial sequence
  Synthetic oligonucleotide
aaatttatctagcgcgataatttgt

SEQ ID NO: 684929 - DNA, 25 bp, Artificial sequence
  Synthetic oligonucleotide
aatttttatcccccgtatagatata

SEQ ID NO: 684930 - DNA, 25 bp, Artificial sequence
  Synthetic oligonucleotide
taaattcgtcttttagcgtattaca

SEQ ID NO: 684931 - DNA, 25 bp, Artificial sequence
  Synthetic oligonucleotide
atccgcgatattataatagatctat

SEQ ID NO: 684932 - DNA, 25 bp, Artificial sequence
  Synthetic oligonucleotide
caattaatataataccgaactgcat

SEQ ID NO: 684933 - DNA, 25 bp, Artificial sequence
  Synthetic oligonucleotide
atttgcgtttaaatacgtcaaaatg

SEQ ID NO: 684934 - DNA, 25 bp, Artificial sequence
  Synthetic oligonucleotide
atacgtataatgccgtaactaatta

SEQ ID NO: 684935 - DNA, 25 bp, Artificial sequence
  Synthetic oligonucleotide
atacgtataatggcgtaactaatta

SEQ ID NO: 684936 - DNA, 25 bp, Artificial sequence
  Synthetic oligonucleotide
atttaatgcgaagtttagtacacta

SEQ ID NO: 684937 - DNA, 25 bp, Artificial sequence
  Synthetic oligonucleotide
atttaatgcgaactttagtacacta

SEQ ID NO: 684938 - DNA, 25 bp, Artificial sequence
  Synthetic oligonucleotide
atcaattcgaaactctaacaaacat

SEQ ID NO: 684939 - DNA, 25 bp, Artificial sequence
  Synthetic oligonucleotide
atcaattcgaaagtctaacaaacat

SEQ ID NO: 684940 - DNA, 25 bp, Artificial sequence
  Synthetic oligonucleotide
tcgatacgtgaaacttgtatatttt

SEQ ID NO: 684941 - DNA, 25 bp, Artificial sequence
  Synthetic oligonucleotide
tcgatacgtgaatcttgtatatttt

SEQ ID NO: 684942 - DNA, 25 bp, Artificial sequence
  Synthetic oligonucleotide
aaacggtaacgtaatattgacataa

SEQ ID NO: 684943 - DNA, 25 bp, Artificial sequence
  Synthetic oligonucleotide
caatttttaacgcttaattgacaag

SEQ ID NO: 684944 - DNA, 25 bp, Artificial sequence
  Synthetic oligonucleotide
aaacggtaacgttatattgacataa

SEQ ID NO: 684945 - DNA, 25 bp, Artificial sequence
  Synthetic oligonucleotide
atccgcgatattttaatagatctat

SEQ ID NO: 684946 - DNA, 25 bp, Artificial sequence
  Synthetic oligonucleotide
ctctaagatataatcgataacaatg

SEQ ID NO: 684947 - DNA, 25 bp, Artificial sequence
  Synthetic oligonucleotide
ctctaagatatattcgataacaatg

SEQ ID NO: 684948 - DNA, 25 bp, Artificial sequence
  Synthetic oligonucleotide
gttttaacctattttactcgtacaa

SEQ ID NO: 684949 - DNA, 25 bp, Artificial sequence
  Synthetic oligonucleotide
gttttaacctatattactcgtacaa

SEQ ID NO: 684950 - DNA, 25 bp, Artificial sequence
  Synthetic oligonucleotide
tgatagtctaaaatttgacgttctt

SEQ ID NO: 684951 - DNA, 25 bp, Artificial sequence
  Synthetic oligonucleotide
tgatagtctaaattttgacgttctt

SEQ ID NO: 684952 - DNA, 25 bp, Artificial sequence
  Synthetic oligonucleotide
ctaaacgaatatcgtttgatttgat

SEQ ID NO: 684953 - DNA, 25 bp, Artificial sequence
  Synthetic oligonucleotide
ctaaacgaatatggtttgatttgat

SEQ ID NO: 684954 - DNA, 25 bp, Artificial sequence
  Synthetic oligonucleotide
caattaatataaaaccgaactgcat

SEQ ID NO: 684955 - DNA, 25 bp, Artificial sequence
  Synthetic oligonucleotide
caatttttaacggttaattgacaag

SEQ ID NO: 684956 - DNA, 25 bp, Artificial sequence
  Synthetic oligonucleotide
taattggtttacgatttgatcatct

SEQ ID NO: 684957 - DNA, 25 bp, Artificial sequence
  Synthetic oligonucleotide
tattttatcataacgatacgcacat

SEQ ID NO: 684958 - DNA, 25 bp, Artificial sequence
  Synthetic oligonucleotide
atatctgttcgatatttatggatag

SEQ ID NO: 684959 - DNA, 25 bp, Artificial sequence
  Synthetic oligonucleotide
cttggagtatatatcgtaaagtata

SEQ ID NO: 684960 - DNA, 25 bp, Artificial sequence
  Synthetic oligonucleotide
tcattctattaccgttaattcactt

SEQ ID NO: 684961 - DNA, 25 bp, Artificial sequence
  Synthetic oligonucleotide
tcattctattacggttaattcactt

SEQ ID NO: 684962 - DNA, 25 bp, Artificial sequence
  Synthetic oligonucleotide
tctagattgatatatttcgatcaga

SEQ ID NO: 684963 - DNA, 25 bp, Artificial sequence
  Synthetic oligonucleotide
tctagattgataaatttcgatcaga

SEQ ID NO: 684964 - DNA, 25 bp, Artificial sequence
  Synthetic oligonucleotide
aatacataaataagtggcgaatcaa

SEQ ID NO: 684965 - DNA, 25 bp, Artificial sequence
  Synthetic oligonucleotide
aatacataaatatgtggcgaatcaa

SEQ ID NO: 684966 - DNA, 25 bp, Artificial sequence
  Synthetic oligonucleotide
tgttaaaaacgtaattcgatactga

SEQ ID NO: 684967 - DNA, 25 bp, Artificial sequence
  Synthetic oligonucleotide
atttgcgtttaattacgtcaaaatg

SEQ ID NO: 684968 - DNA, 25 bp, Artificial sequence
  Synthetic oligonucleotide
taattggtttaccatttgatcatct

SEQ ID NO: 684969 - DNA, 25 bp, Artificial sequence
  Synthetic oligonucleotide
cttggagtatatttcgtaaagtata

SEQ ID NO: 684970 - DNA, 25 bp, Artificial sequence
  Synthetic oligonucleotide
caactatatcgatttatactgagat

SEQ ID NO: 684971 - DNA, 25 bp, Artificial sequence
  Synthetic oligonucleotide
caactatatcgaattatactgagat

SEQ ID NO: 684972 - DNA, 25 bp, Artificial sequence
  Synthetic oligonucleotide
aacactaaccgatattaagtaagaa

SEQ ID NO: 684973 - DNA, 25 bp, Artificial sequence
  Synthetic oligonucleotide
aacactaaccgaaattaagtaagaa

SEQ ID NO: 684974 - DNA, 25 bp, Artificial sequence
  Synthetic oligonucleotide
tgaacattcgaaaattagttcttac

SEQ ID NO: 684975 - DNA, 25 bp, Artificial sequence
  Synthetic oligonucleotide
tgaacattcgaatattagttcttac

SEQ ID NO: 684976 - DNA, 25 bp, Artificial sequence
  Synthetic oligonucleotide
tcattgatctatatactcgaatttc

SEQ ID NO: 684977 - DNA, 25 bp, Artificial sequence
  Synthetic oligonucleotide
tcattgatctatttactcgaatttc

SEQ ID NO: 684978 - DNA, 25 bp, Artificial sequence
  Synthetic oligonucleotide
ataaagcgaattcaaatatcagtag

SEQ ID NO: 684979 - DNA, 25 bp, Artificial sequence
  Synthetic oligonucleotide
ataaagcgaattgaaatatcagtag

SEQ ID NO: 684980 - DNA, 25 bp, Artificial sequence
  Synthetic oligonucleotide
tgttaaaaacgttattcgatactga

SEQ ID NO: 684981 - DNA, 25 bp, Artificial sequence
  Synthetic oligonucleotide
gtactacgttaactataagtcttat

SEQ ID NO: 684982 - DNA, 25 bp, Artificial sequence
  Synthetic oligonucleotide
tttctcaacgtaacgttaaactaaa

SEQ ID NO: 684983 - DNA, 25 bp, Artificial sequence
  Synthetic oligonucleotide
tttctcaacgtatcgttaaactaaa

SEQ ID NO: 684984 - DNA, 25 bp, Artificial sequence
  Synthetic oligonucleotide
gtaaaatcgtagctgtaaaatatgt

SEQ ID NO: 684985 - DNA, 25 bp, Artificial sequence
  Synthetic oligonucleotide
gtaaaatcgtaggtgtaaaatatgt

SEQ ID NO: 684986 - DNA, 25 bp, Artificial sequence
  Synthetic oligonucleotide
actgtcttatacgatttaatcaatg

SEQ ID NO: 684987 - DNA, 25 bp, Artificial sequence
  Synthetic oligonucleotide
actgtcttataccatttaatcaatg

SEQ ID NO: 684988 - DNA, 25 bp, Artificial sequence
  Synthetic oligonucleotide
agctcttatatcctattagatatct

SEQ ID NO: 684989 - DNA, 25 bp, Artificial sequence
  Synthetic oligonucleotide
agctcttatatcgtattagatatct

SEQ ID NO: 684990 - DNA, 25 bp, Artificial sequence
  Synthetic oligonucleotide
ggatgactaatattatacgaattga

SEQ ID NO: 684991 - DNA, 25 bp, Artificial sequence
  Synthetic oligonucleotide
ggatttcgctttataatatatgtgt

SEQ ID NO: 684992 - DNA, 25 bp, Artificial sequence
  Synthetic oligonucleotide
tgagaaacgagatacattacaatta

SEQ ID NO: 684993 - DNA, 25 bp, Artificial sequence
  Synthetic oligonucleotide
ggatgactaataatatacgaattga

SEQ ID NO: 684994 - DNA, 25 bp, Artificial sequence
  Synthetic oligonucleotide
ttcattagggaatatatcgtcaaat

SEQ ID NO: 684995 - DNA, 25 bp, Artificial sequence
  Synthetic oligonucleotide
ttcattagggaaaatatcgtcaaat

SEQ ID NO: 684996 - DNA, 25 bp, Artificial sequence
  Synthetic oligonucleotide
aatctcgtataagtaagattcacat

SEQ ID NO: 684997 - DNA, 25 bp, Artificial sequence
  Synthetic oligonucleotide
aatctcgtataactaagattcacat

SEQ ID NO: 684998 - DNA, 25 bp, Artificial sequence
  Synthetic oligonucleotide
tttaatcgaattacttaactcctga

SEQ ID NO: 684999 - DNA, 25 bp, Artificial sequence
  Synthetic oligonucleotide
tttaatcgaatttcttaactcctga

SEQ ID NO: 685000 - DNA, 25 bp, Artificial sequence
  Synthetic oligonucleotide
cagttcaataataaacgttagtaga

SEQ ID NO: 685001 - DNA, 25 bp, Artificial sequence
  Synthetic oligonucleotide
cagttcaataattaacgttagtaga

SEQ ID NO: 685002 - DNA, 25 bp, Artificial sequence
  Synthetic oligonucleotide
gcatatgaattatacgtacgtttat

SEQ ID NO: 685003 - DNA, 25 bp, Artificial sequence
  Synthetic oligonucleotide
atatctgttcgaaatttatggatag

SEQ ID NO: 685004 - DNA, 25 bp, Artificial sequence
  Synthetic oligonucleotide
agacccgtattcatatattaaatga

SEQ ID NO: 685005 - DNA, 25 bp, Artificial sequence
  Synthetic oligonucleotide
cagtatatattattccgatagacta

SEQ ID NO: 685006 - DNA, 25 bp, Artificial sequence
  Synthetic oligonucleotide
gtactacgttaagtataagtcttat

SEQ ID NO: 685007 - DNA, 25 bp, Artificial sequence
  Synthetic oligonucleotide
tgagaaacgagaaacattacaatta

SEQ ID NO: 685008 - DNA, 25 bp, Artificial sequence
  Synthetic oligonucleotide
ggatttcgctttttaatatatgtgt

SEQ ID NO: 685009 - DNA, 25 bp, Artificial sequence
  Synthetic oligonucleotide
aagaatagaccgaattaataacttg

SEQ ID NO: 685010 - DNA, 25 bp, Artificial sequence
  Synthetic oligonucleotide
aagaatagaccgtattaataacttg

SEQ ID NO: 685011 - DNA, 25 bp, Artificial sequence
  Synthetic oligonucleotide
ttcatttcgttcaattaagtacgat

SEQ ID NO: 685012 - DNA, 25 bp, Artificial sequence
  Synthetic oligonucleotide
cagtatatattaatccgatagacta

SEQ ID NO: 685013 - DNA, 25 bp, Artificial sequence
  Synthetic oligonucleotide
gtcaaatcggacgaattatattaaa

SEQ ID NO: 685014 - DNA, 25 bp, Artificial sequence
  Synthetic oligonucleotide
gtcaaatcggaccaattatattaaa

SEQ ID NO: 685015 - DNA, 25 bp, Artificial sequence
  Synthetic oligonucleotide
ctttatacccaaatacgataatgta

SEQ ID NO: 685016 - DNA, 25 bp, Artificial sequence
  Synthetic oligonucleotide
ctttatacccaattacgataatgta

SEQ ID NO: 685017 - DNA, 25 bp, Artificial sequence
  Synthetic oligonucleotide
cgatagtacgctataataattctat

SEQ ID NO: 685018 - DNA, 25 bp, Artificial sequence
  Synthetic oligonucleotide
cgtatatccgtataataagtaatac

SEQ ID NO: 685019 - DNA, 25 bp, Artificial sequence
  Synthetic oligonucleotide
ttcatttcgttctattaagtacgat

SEQ ID NO: 685020 - DNA, 25 bp, Artificial sequence
  Synthetic oligonucleotide
cgtatatccgtaaaataagtaatac

SEQ ID NO: 685021 - DNA, 25 bp, Artificial sequence
  Synthetic oligonucleotide
acattatttaatggaaaagtcgtac

SEQ ID NO: 685022 - DNA, 25 bp, Artificial sequence
  Synthetic oligonucleotide
cgatagtacgctttaataattctat

SEQ ID NO: 685023 - DNA, 25 bp, Artificial sequence
  Synthetic oligonucleotide
ataatactaaacgatcatttactcg

SEQ ID NO: 685024 - DNA, 25 bp, Artificial sequence
  Synthetic oligonucleotide
ataatactaaaccatcatttactcg

SEQ ID NO: 685025 - DNA, 25 bp, Artificial sequence
  Synthetic oligonucleotide
cgttctttaacacgatataaacatt

SEQ ID NO: 685026 - DNA, 25 bp, Artificial sequence
  Synthetic oligonucleotide
cgttctttaacaggatataaacatt

SEQ ID NO: 685027 - DNA, 25 bp, Artificial sequence
  Synthetic oligonucleotide
aggctaaattagcgatattaaattg

SEQ ID NO: 685028 - DNA, 25 bp, Artificial sequence
  Synthetic oligonucleotide
aggctaaattagggatattaaattg

SEQ ID NO: 685029 - DNA, 25 bp, Artificial sequence
  Synthetic oligonucleotide
acattatttaatcgaaaagtcgtac

SEQ ID NO: 685030 - DNA, 25 bp, Artificial sequence
  Synthetic oligonucleotide
gttgattgcgaattatcaaggtttt

SEQ ID NO: 685031 - DNA, 25 bp, Artificial sequence
  Synthetic oligonucleotide
gaataatcttagctttatcgtcttg

SEQ ID NO: 685032 - DNA, 25 bp, Artificial sequence
  Synthetic oligonucleotide
gaataatcttaggtttatcgtcttg

SEQ ID NO: 685033 - DNA, 25 bp, Artificial sequence
  Synthetic oligonucleotide
gtttgaattcaacgctagtaagaat

SEQ ID NO: 685034 - DNA, 25 bp, Artificial sequence
  Synthetic oligonucleotide
gtttgaattcaaggctagtaagaat

SEQ ID NO: 685035 - DNA, 25 bp, Artificial sequence
  Synthetic oligonucleotide
gttaatattttccctagtacagttg

SEQ ID NO: 685036 - DNA, 25 bp, Artificial sequence
  Synthetic oligonucleotide
ttggcaatttaagcgatcttataag

SEQ ID NO: 685037 - DNA, 25 bp, Artificial sequence
  Synthetic oligonucleotide
gttgattgcgaaatatcaaggtttt

SEQ ID NO: 685038 - DNA, 25 bp, Artificial sequence
  Synthetic oligonucleotide
atacgaattctaattaacggtagtg

SEQ ID NO: 685039 - DNA, 25 bp, Artificial sequence
  Synthetic oligonucleotide
aactattacctacgttcgcaattaa

SEQ ID NO: 685040 - DNA, 25 bp, Artificial sequence
  Synthetic oligonucleotide
gttaatattttcgctagtacagttg

SEQ ID NO: 685041 - DNA, 25 bp, Artificial sequence
  Synthetic oligonucleotide
atacgaattctatttaacggtagtg

SEQ ID NO: 685042 - DNA, 25 bp, Artificial sequence
  Synthetic oligonucleotide
tgtacgcaaattagacgaatagtat

SEQ ID NO: 685043 - DNA, 25 bp, Artificial sequence
  Synthetic oligonucleotide
tgtacgcaaatttgacgaatagtat

SEQ ID NO: 685044 - DNA, 25 bp, Artificial sequence
  Synthetic oligonucleotide
atactattgagtcgtaccgttataa

SEQ ID NO: 685045 - DNA, 25 bp, Artificial sequence
  Synthetic oligonucleotide
atactattgagtggtaccgttataa

SEQ ID NO: 685046 - DNA, 25 bp, Artificial sequence
  Synthetic oligonucleotide
tatattttagtacgctccggtaaat

SEQ ID NO: 685047 - DNA, 25 bp, Artificial sequence
  Synthetic oligonucleotide
tatattttagtaggctccggtaaat

SEQ ID NO: 685048 - DNA, 25 bp, Artificial sequence
  Synthetic oligonucleotide
actttatcgcgatctaggttaaata

SEQ ID NO: 685049 - DNA, 25 bp, Artificial sequence
  Synthetic oligonucleotide
actttatcgcgaactaggttaaata

SEQ ID NO: 685050 - DNA, 25 bp, Artificial sequence
  Synthetic oligonucleotide
ttatattattcggcccgtaaatagt

SEQ ID NO: 685051 - DNA, 25 bp, Artificial sequence
  Synthetic oligonucleotide
aactattacctaggttcgcaattaa

SEQ ID NO: 685052 - DNA, 25 bp, Artificial sequence
  Synthetic oligonucleotide
ttatattattcgccccgtaaatagt

SEQ ID NO: 685053 - DNA, 25 bp, Artificial sequence
  Synthetic oligonucleotide
gtttaatttccgatacaatagtagc

SEQ ID NO: 685054 - DNA, 25 bp, Artificial sequence
  Synthetic oligonucleotide
tttatatctagactaaacgagccat

SEQ ID NO: 685055 - DNA, 25 bp, Artificial sequence
  Synthetic oligonucleotide
atagtacatacgacgcgatataaaa

SEQ ID NO: 685056 - DNA, 25 bp, Artificial sequence
  Synthetic oligonucleotide
tttatatctagagtaaacgagccat

SEQ ID NO: 685057 - DNA, 25 bp, Artificial sequence
  Synthetic oligonucleotide
gaattttaagtcgaccgctattaaa

SEQ ID NO: 685058 - DNA, 25 bp, Artificial sequence
  Synthetic oligonucleotide
tagattgatatcctcgaaattcatg

SEQ ID NO: 685059 - DNA, 25 bp, Artificial sequence
  Synthetic oligonucleotide
atgacaaagttcgtcactttgtaaa

SEQ ID NO: 685060 - DNA, 25 bp, Artificial sequence
  Synthetic oligonucleotide
atgacaaagttcctcactttgtaaa

SEQ ID NO: 685061 - DNA, 25 bp, Artificial sequence
  Synthetic oligonucleotide
attggtcattcggtattaatttcgt

SEQ ID NO: 685062 - DNA, 25 bp, Artificial sequence
  Synthetic oligonucleotide
attggtcattcgctattaatttcgt

SEQ ID NO: 685063 - DNA, 25 bp, Artificial sequence
  Synthetic oligonucleotide
ccttattacgctaaatacattcaga

SEQ ID NO: 685064 - DNA, 25 bp, Artificial sequence
  Synthetic oligonucleotide
ccttattacgcttaatacattcaga

SEQ ID NO: 685065 - DNA, 25 bp, Artificial sequence
  Synthetic oligonucleotide
tagattgatatcgtcgaaattcatg

SEQ ID NO: 685066 - DNA, 25 bp, Artificial sequence
  Synthetic oligonucleotide
tagctcgtaaaccacttatttctat

SEQ ID NO: 685067 - DNA, 25 bp, Artificial sequence
  Synthetic oligonucleotide
ttggcaatttaaccgatcttataag

SEQ ID NO: 685068 - DNA, 25 bp, Artificial sequence
  Synthetic oligonucleotide
gtttaatttccgttacaatagtagc

SEQ ID NO: 685069 - DNA, 25 bp, Artificial sequence
  Synthetic oligonucleotide
atagtgttttgatctaatcgctatg

SEQ ID NO: 685070 - DNA, 25 bp, Artificial sequence
  Synthetic oligonucleotide
atagtgttttgaactaatcgctatg

SEQ ID NO: 685071 - DNA, 25 bp, Artificial sequence
  Synthetic oligonucleotide
tcatttatttcggtatcgatcagta

SEQ ID NO: 685072 - DNA, 25 bp, Artificial sequence
  Synthetic oligonucleotide
tcatttatttcgctatcgatcagta

SEQ ID NO: 685073 - DNA, 25 bp, Artificial sequence
  Synthetic oligonucleotide
agatttgatttgtcaattcgctagt

SEQ ID NO: 685074 - DNA, 25 bp, Artificial sequence
  Synthetic oligonucleotide
agatttgatttgacaattcgctagt

SEQ ID NO: 685075 - DNA, 25 bp, Artificial sequence
  Synthetic oligonucleotide
ctaagtcttactagtacgaatatgt

SEQ ID NO: 685076 - DNA, 25 bp, Artificial sequence
  Synthetic oligonucleotide
ctaagtcttacttgtacgaatatgt

SEQ ID NO: 685077 - DNA, 25 bp, Artificial sequence
  Synthetic oligonucleotide
gatcaagacataatacttcgttgaa

SEQ ID NO: 685078 - DNA, 25 bp, Artificial sequence
  Synthetic oligonucleotide
gatcaagacatattacttcgttgaa

SEQ ID NO: 685079 - DNA, 25 bp, Artificial sequence
  Synthetic oligonucleotide
tagctcgtaaacgacttatttctat

SEQ ID NO: 685080 - DNA, 25 bp, Artificial sequence
  Synthetic oligonucleotide
ttttattgcgcgtctaataggtata

SEQ ID NO: 685081 - DNA, 25 bp, Artificial sequence
  Synthetic oligonucleotide
aaatttcctataggtcacgtaacat

SEQ ID NO: 685082 - DNA, 25 bp, Artificial sequence
  Synthetic oligonucleotide
taatgtttgcgttcgaactgatata

SEQ ID NO: 685083 - DNA, 25 bp, Artificial sequence
  Synthetic oligonucleotide
cttactttacgtatcggacatatat

SEQ ID NO: 685084 - DNA, 25 bp, Artificial sequence
  Synthetic oligonucleotide
cttactttacgtttcggacatatat

SEQ ID NO: 685085 - DNA, 25 bp, Artificial sequence
  Synthetic oligonucleotide
tctatattacgactcgtagtgtaaa

SEQ ID NO: 685086 - DNA, 25 bp, Artificial sequence
  Synthetic oligonucleotide
tctatattacgagtcgtagtgtaaa

SEQ ID NO: 685087 - DNA, 25 bp, Artificial sequence
  Synthetic oligonucleotide
ttaacattacgaacgctacagataa

SEQ ID NO: 685088 - DNA, 25 bp, Artificial sequence
  Synthetic oligonucleotide
ttaacattacgatcgctacagataa

SEQ ID NO: 685089 - DNA, 25 bp, Artificial sequence
  Synthetic oligonucleotide
aacttattaatccgctacgctttaa

SEQ ID NO: 685090 - DNA, 25 bp, Artificial sequence
  Synthetic oligonucleotide
aacttattaatcggctacgctttaa

SEQ ID NO: 685091 - DNA, 25 bp, Artificial sequence
  Synthetic oligonucleotide
atacattttaatgcgcgaggtttat

SEQ ID NO: 685092 - DNA, 25 bp, Artificial sequence
  Synthetic oligonucleotide
catttatgcgcgataatacatatag

SEQ ID NO: 685093 - DNA, 25 bp, Artificial sequence
  Synthetic oligonucleotide
atacattttaatccgcgaggtttat

SEQ ID NO: 685094 - DNA, 25 bp, Artificial sequence
  Synthetic oligonucleotide
ttttattgcgcgactaataggtata

SEQ ID NO: 685095 - DNA, 25 bp, Artificial sequence
  Synthetic oligonucleotide
atgttttctaattgcgtcgatacat

SEQ ID NO: 685096 - DNA, 25 bp, Artificial sequence
  Synthetic oligonucleotide
atgttttctaatagcgtcgatacat

SEQ ID NO: 685097 - DNA, 25 bp, Artificial sequence
  Synthetic oligonucleotide
cataaatcgtcgcatatacttgaaa

SEQ ID NO: 685098 - DNA, 25 bp, Artificial sequence
  Synthetic oligonucleotide
cataaatcgtcggatatacttgaaa

SEQ ID NO: 685099 - DNA, 25 bp, Artificial sequence
  Synthetic oligonucleotide
ctaaaatcgcgttctaagtttttga

SEQ ID NO: 685100 - DNA, 25 bp, Artificial sequence
  Synthetic oligonucleotide
ctaaaatcgcgtactaagtttttga

SEQ ID NO: 685101 - DNA, 25 bp, Artificial sequence
  Synthetic oligonucleotide
gtaagtaatccgaagtattaaatgc

SEQ ID NO: 685102 - DNA, 25 bp, Artificial sequence
  Synthetic oligonucleotide
tcgtatcgtaataaattggagttga

SEQ ID NO: 685103 - DNA, 25 bp, Artificial sequence
  Synthetic oligonucleotide
tgttaatcgcgaatagttcctaata

SEQ ID NO: 685104 - DNA, 25 bp, Artificial sequence
  Synthetic oligonucleotide
catttatgcgcgttaatacatatag

SEQ ID NO: 685105 - DNA, 25 bp, Artificial sequence
  Synthetic oligonucleotide
tattttcgtcggacgtataatagat

SEQ ID NO: 685106 - DNA, 25 bp, Artificial sequence
  Synthetic oligonucleotide
gaattttaagtccaccgctattaaa

SEQ ID NO: 685107 - DNA, 25 bp, Artificial sequence
  Synthetic oligonucleotide
ataattgtcggcgtagtatattact

SEQ ID NO: 685108 - DNA, 25 bp, Artificial sequence
  Synthetic oligonucleotide
ataattgtcggcctagtatattact

SEQ ID NO: 685109 - DNA, 25 bp, Artificial sequence
  Synthetic oligonucleotide
ttaaaaggtaccgcgaataattgta

SEQ ID NO: 685110 - DNA, 25 bp, Artificial sequence
  Synthetic oligonucleotide
ttaaaaggtaccccgaataattgta

SEQ ID NO: 685111 - DNA, 25 bp, Artificial sequence
  Synthetic oligonucleotide
aacaaaggatcgaacgctatattat

SEQ ID NO: 685112 - DNA, 25 bp, Artificial sequence
  Synthetic oligonucleotide
aacaaaggatcgtacgctatattat

SEQ ID NO: 685113 - DNA, 25 bp, Artificial sequence
  Synthetic oligonucleotide
aattaaggatataaccgcgaaacaa

SEQ ID NO: 685114 - DNA, 25 bp, Artificial sequence
  Synthetic oligonucleotide
aattaaggatattaccgcgaaacaa

SEQ ID NO: 685115 - DNA, 25 bp, Artificial sequence
  Synthetic oligonucleotide
tatgatctaaccggcgtatatatat

SEQ ID NO: 685116 - DNA, 25 bp, Artificial sequence
  Synthetic oligonucleotide
taatgtttgcgtacgaactgatata

SEQ ID NO: 685117 - DNA, 25 bp, Artificial sequence
  Synthetic oligonucleotide
tattttcgtcggtcgtataatagat

SEQ ID NO: 685118 - DNA, 25 bp, Artificial sequence
  Synthetic oligonucleotide
tgttaatcgcgattagttcctaata

SEQ ID NO: 685119 - DNA, 25 bp, Artificial sequence
  Synthetic oligonucleotide
ttttaacgtatgaatcgcgtgaata

SEQ ID NO: 685120 - DNA, 25 bp, Artificial sequence
  Synthetic oligonucleotide
ttttaacgtatgtatcgcgtgaata

SEQ ID NO: 685121 - DNA, 25 bp, Artificial sequence
  Synthetic oligonucleotide
taattgcggttgggtactaaattta

SEQ ID NO: 685122 - DNA, 25 bp, Artificial sequence
  Synthetic oligonucleotide
taattgcggttgcgtactaaattta

SEQ ID NO: 685123 - DNA, 25 bp, Artificial sequence
  Synthetic oligonucleotide
tttattcgcggtttagtactgaatt

SEQ ID NO: 685124 - DNA, 25 bp, Artificial sequence
  Synthetic oligonucleotide
tttattcgcggtatagtactgaatt

SEQ ID NO: 685125 - DNA, 25 bp, Artificial sequence
  Synthetic oligonucleotide
tataatcgaatagtcgcgaaatgat

SEQ ID NO: 685126 - DNA, 25 bp, Artificial sequence
  Synthetic oligonucleotide
tataatcgaatactcgcgaaatgat

SEQ ID NO: 685127 - DNA, 25 bp, Artificial sequence
  Synthetic oligonucleotide
aaatttcctatacgtcacgtaacat

SEQ ID NO: 685128 - DNA, 25 bp, Artificial sequence
  Synthetic oligonucleotide
atagtacatacgtcgcgatataaaa

SEQ ID NO: 685129 - DNA, 25 bp, Artificial sequence
  Synthetic oligonucleotide
tatgatctaacccgcgtatatatat

SEQ ID NO: 685130 - DNA, 25 bp, Artificial sequence
  Synthetic oligonucleotide
ttctctattacaatcgatcgtattc

SEQ ID NO: 685131 - DNA, 25 bp, Artificial sequence
  Synthetic oligonucleotide
attaatccgttaaggttaaatccca

SEQ ID NO: 685132 - DNA, 25 bp, Artificial sequence
  Synthetic oligonucleotide
gaagttcaactttttaatcgaatgc

SEQ ID NO: 685133 - DNA, 25 bp, Artificial sequence
  Synthetic oligonucleotide
ctctatattaacggtctatagtgtt

SEQ ID NO: 685134 - DNA, 25 bp, Artificial sequence
  Synthetic oligonucleotide
ctctatattaaccgtctatagtgtt

SEQ ID NO: 685135 - DNA, 25 bp, Artificial sequence
  Synthetic oligonucleotide
tcgagttaatcgaaacataggtatt

SEQ ID NO: 685136 - DNA, 25 bp, Artificial sequence
  Synthetic oligonucleotide
tcgagttaatcgtaacataggtatt

SEQ ID NO: 685137 - DNA, 25 bp, Artificial sequence
  Synthetic oligonucleotide
aagcataatcgtttactcatttgag

SEQ ID NO: 685138 - DNA, 25 bp, Artificial sequence
  Synthetic oligonucleotide
aagcataatcgtatactcatttgag

SEQ ID NO: 685139 - DNA, 25 bp, Artificial sequence
  Synthetic oligonucleotide
ttgcttacgctataaaagagaaaga

SEQ ID NO: 685140 - DNA, 25 bp, Artificial sequence
  Synthetic oligonucleotide
ttgcttacgctaaaaaagagaaaga

SEQ ID NO: 685141 - DNA, 25 bp, Artificial sequence
  Synthetic oligonucleotide
ttagccgtatagtattgatattcga

SEQ ID NO: 685142 - DNA, 25 bp, Artificial sequence
  Synthetic oligonucleotide
ccgatcgatattataaactttggat

SEQ ID NO: 685143 - DNA, 25 bp, Artificial sequence
  Synthetic oligonucleotide
ttagccgtatagaattgatattcga

SEQ ID NO: 685144 - DNA, 25 bp, Artificial sequence
  Synthetic oligonucleotide
ttctctattacattcgatcgtattc

SEQ ID NO: 685145 - DNA, 25 bp, Artificial sequence
  Synthetic oligonucleotide
ttcgaaaaatcgtccgaaatagatt

SEQ ID NO: 685146 - DNA, 25 bp, Artificial sequence
  Synthetic oligonucleotide
ttcgaaaaatcgaccgaaatagatt

SEQ ID NO: 685147 - DNA, 25 bp, Artificial sequence
  Synthetic oligonucleotide
tcattctaatagatcgtacatccat

SEQ ID NO: 685148 - DNA, 25 bp, Artificial sequence
  Synthetic oligonucleotide
tcattctaatagttcgtacatccat

SEQ ID NO: 685149 - DNA, 25 bp, Artificial sequence
  Synthetic oligonucleotide
ttatccgaattagtttacgatgatc

SEQ ID NO: 685150 - DNA, 25 bp, Artificial sequence
  Synthetic oligonucleotide
ttatccgaattactttacgatgatc

SEQ ID NO: 685151 - DNA, 25 bp, Artificial sequence
  Synthetic oligonucleotide
taccaaatagataaacgtactcgta

SEQ ID NO: 685152 - DNA, 25 bp, Artificial sequence
  Synthetic oligonucleotide
taccaaatagattaacgtactcgta

SEQ ID NO: 685153 - DNA, 25 bp, Artificial sequence
  Synthetic oligonucleotide
aatgttttcgctttctaagatatcc

SEQ ID NO: 685154 - DNA, 25 bp, Artificial sequence
  Synthetic oligonucleotide
ccgatcgatattttaaactttggat

SEQ ID NO: 685155 - DNA, 25 bp, Artificial sequence
  Synthetic oligonucleotide
aaacataagtaacaaacgtacctca

SEQ ID NO: 685156 - DNA, 25 bp, Artificial sequence
  Synthetic oligonucleotide
ctttacaacgcgatatagatatctt

SEQ ID NO: 685157 - DNA, 25 bp, Artificial sequence
  Synthetic oligonucleotide
tgaatctcgcgatatagtctatttt

SEQ ID NO: 685158 - DNA, 25 bp, Artificial sequence
  Synthetic oligonucleotide
aaacttttatcgaattcgaaaggca

SEQ ID NO: 685159 - DNA, 25 bp, Artificial sequence
  Synthetic oligonucleotide
aacaaagatgcgagaataattatgc

SEQ ID NO: 685160 - DNA, 25 bp, Artificial sequence
  Synthetic oligonucleotide
aacaaagatgcgtgaataattatgc

SEQ ID NO: 685161 - DNA, 25 bp, Artificial sequence
  Synthetic oligonucleotide
aaagtatatatcggacttacttacc

SEQ ID NO: 685162 - DNA, 25 bp, Artificial sequence
  Synthetic oligonucleotide
aaagtatatatccgacttacttacc

SEQ ID NO: 685163 - DNA, 25 bp, Artificial sequence
  Synthetic oligonucleotide
gtaagtacaataaccgtacatactt

SEQ ID NO: 685164 - DNA, 25 bp, Artificial sequence
  Synthetic oligonucleotide
gtaagtacaatatccgtacatactt

SEQ ID NO: 685165 - DNA, 25 bp, Artificial sequence
  Synthetic oligonucleotide
agactcgtaatactaattgaagcta

SEQ ID NO: 685166 - DNA, 25 bp, Artificial sequence
  Synthetic oligonucleotide
gaagttcaacttattaatcgaatgc

SEQ ID NO: 685167 - DNA, 25 bp, Artificial sequence
  Synthetic oligonucleotide
aaacataagtaagaaacgtacctca

SEQ ID NO: 685168 - DNA, 25 bp, Artificial sequence
  Synthetic oligonucleotide
tcgtatcgtaattaattggagttga

SEQ ID NO: 685169 - DNA, 25 bp, Artificial sequence
  Synthetic oligonucleotide
atttgtatgatcgcacataaaggtt

SEQ ID NO: 685170 - DNA, 25 bp, Artificial sequence
  Synthetic oligonucleotide
atttgtatgatcccacataaaggtt

SEQ ID NO: 685171 - DNA, 25 bp, Artificial sequence
  Synthetic oligonucleotide
aatactcgctaaacctatatatctc

SEQ ID NO: 685172 - DNA, 25 bp, Artificial sequence
  Synthetic oligonucleotide
aatactcgctaatcctatatatctc

SEQ ID NO: 685173 - DNA, 25 bp, Artificial sequence
  Synthetic oligonucleotide
gattccgatcatttatgaaatccta

SEQ ID NO: 685174 - DNA, 25 bp, Artificial sequence
  Synthetic oligonucleotide
gattccgatcatatatgaaatccta

SEQ ID NO: 685175 - DNA, 25 bp, Artificial sequence
  Synthetic oligonucleotide
gtcatcttacgtaaatcgtaaattg

SEQ ID NO: 685176 - DNA, 25 bp, Artificial sequence
  Synthetic oligonucleotide
gtcatcttacgttaatcgtaaattg

SEQ ID NO: 685177 - DNA, 25 bp, Artificial sequence
  Synthetic oligonucleotide
gattaataatgatcgcactattcga

SEQ ID NO: 685178 - DNA, 25 bp, Artificial sequence
  Synthetic oligonucleotide
gattaataatgaacgcactattcga

SEQ ID NO: 685179 - DNA, 25 bp, Artificial sequence
  Synthetic oligonucleotide
agactcgtaatagtaattgaagcta

SEQ ID NO: 685180 - DNA, 25 bp, Artificial sequence
  Synthetic oligonucleotide
ccaaccaatcgttttaattgatgat

SEQ ID NO: 685181 - DNA, 25 bp, Artificial sequence
  Synthetic oligonucleotide
attaatccgttatggttaaatccca

SEQ ID NO: 685182 - DNA, 25 bp, Artificial sequence
  Synthetic oligonucleotide
attcattaatcgttactagcgagtt

SEQ ID NO: 685183 - DNA, 25 bp, Artificial sequence
  Synthetic oligonucleotide
attcattaatcgatactagcgagtt

SEQ ID NO: 685184 - DNA, 25 bp, Artificial sequence
  Synthetic oligonucleotide
taatgcgataggttaaactttagga

SEQ ID NO: 685185 - DNA, 25 bp, Artificial sequence
  Synthetic oligonucleotide
taatgcgataggataaactttagga

SEQ ID NO: 685186 - DNA, 25 bp, Artificial sequence
  Synthetic oligonucleotide
agttgttgtacgtataacatatctc

SEQ ID NO: 685187 - DNA, 25 bp, Artificial sequence
  Synthetic oligonucleotide
agttgttgtacgaataacatatctc

SEQ ID NO: 685188 - DNA, 25 bp, Artificial sequence
  Synthetic oligonucleotide
acttaatgcgtcaagtattatcgta

SEQ ID NO: 685189 - DNA, 25 bp, Artificial sequence
  Synthetic oligonucleotide
acttaatgcgtctagtattatcgta

SEQ ID NO: 685190 - DNA, 25 bp, Artificial sequence
  Synthetic oligonucleotide
tcaaacgcatataagtataacgaag

SEQ ID NO: 685191 - DNA, 25 bp, Artificial sequence
  Synthetic oligonucleotide
cttttatacataagtattcgcagca

SEQ ID NO: 685192 - DNA, 25 bp, Artificial sequence
  Synthetic oligonucleotide
ccaaccaatcgtattaattgatgat

SEQ ID NO: 685193 - DNA, 25 bp, Artificial sequence
  Synthetic oligonucleotide
acaatttcgacgttacatatctttg

SEQ ID NO: 685194 - DNA, 25 bp, Artificial sequence
  Synthetic oligonucleotide
cgcacataatataacaatcgagtat

SEQ ID NO: 685195 - DNA, 25 bp, Artificial sequence
  Synthetic oligonucleotide
cgcacataatattacaatcgagtat

SEQ ID NO: 685196 - DNA, 25 bp, Artificial sequence
  Synthetic oligonucleotide
tttagatccgagttgtttaagagtt

SEQ ID NO: 685197 - DNA, 25 bp, Artificial sequence
  Synthetic oligonucleotide
tttagatccgagatgtttaagagtt

SEQ ID NO: 685198 - DNA, 25 bp, Artificial sequence
  Synthetic oligonucleotide
ttgaagtttattaccgcaataaggt

SEQ ID NO: 685199 - DNA, 25 bp, Artificial sequence
  Synthetic oligonucleotide
ttgaagtttatttccgcaataaggt

SEQ ID NO: 685200 - DNA, 25 bp, Artificial sequence
  Synthetic oligonucleotide
ttgatcgattatatataacgccatg

SEQ ID NO: 685201 - DNA, 25 bp, Artificial sequence
  Synthetic oligonucleotide
ttgatcgattatttataacgccatg

SEQ ID NO: 685202 - DNA, 25 bp, Artificial sequence
  Synthetic oligonucleotide
ttatgataattcgctatcgataagg

SEQ ID NO: 685203 - DNA, 25 bp, Artificial sequence
  Synthetic oligonucleotide
ttatgataattccctatcgataagg

SEQ ID NO: 685204 - DNA, 25 bp, Artificial sequence
  Synthetic oligonucleotide
tcaaacgcatattagtataacgaag

SEQ ID NO: 685205 - DNA, 25 bp, Artificial sequence
  Synthetic oligonucleotide
atcagtcacgtataggataaatttc

SEQ ID NO: 685206 - DNA, 25 bp, Artificial sequence
  Synthetic oligonucleotide
aaacttttatcgtattcgaaaggca

SEQ ID NO: 685207 - DNA, 25 bp, Artificial sequence
  Synthetic oligonucleotide
aatgttttcgctatctaagatatcc

SEQ ID NO: 685208 - DNA, 25 bp, Artificial sequence
  Synthetic oligonucleotide
ggaagataacgaattaatcctatgt

SEQ ID NO: 685209 - DNA, 25 bp, Artificial sequence
  Synthetic oligonucleotide
ggaagataacgatttaatcctatgt

SEQ ID NO: 685210 - DNA, 25 bp, Artificial sequence
  Synthetic oligonucleotide
tggtttacatcgttcattgagtaaa

SEQ ID NO: 685211 - DNA, 25 bp, Artificial sequence
  Synthetic oligonucleotide
tggtttacatcgatcattgagtaaa

SEQ ID NO: 685212 - DNA, 25 bp, Artificial sequence
  Synthetic oligonucleotide
aaaatcgaattaatatttcgaccgc

SEQ ID NO: 685213 - DNA, 25 bp, Artificial sequence
  Synthetic oligonucleotide
aaaatcgaattattatttcgaccgc

SEQ ID NO: 685214 - DNA, 25 bp, Artificial sequence
  Synthetic oligonucleotide
atatgttcttcgtagtttagcctta

SEQ ID NO: 685215 - DNA, 25 bp, Artificial sequence
  Synthetic oligonucleotide
atatgttcttcgaagtttagcctta

SEQ ID NO: 685216 - DNA, 25 bp, Artificial sequence
  Synthetic oligonucleotide
cttttatacatatgtattcgcagca

SEQ ID NO: 685217 - DNA, 25 bp, Artificial sequence
  Synthetic oligonucleotide
ttgcttacgatttattctatgtgga

SEQ ID NO: 685218 - DNA, 25 bp, Artificial sequence
  Synthetic oligonucleotide
gtaagtaatccgtagtattaaatgc

SEQ ID NO: 685219 - DNA, 25 bp, Artificial sequence
  Synthetic oligonucleotide
atcagtcacgtaaaggataaatttc

SEQ ID NO: 685220 - DNA, 25 bp, Artificial sequence
  Synthetic oligonucleotide
gtaattaaactcactatcgaacttg

SEQ ID NO: 685221 - DNA, 25 bp, Artificial sequence
  Synthetic oligonucleotide
gtaattaaactctctatcgaacttg

SEQ ID NO: 685222 - DNA, 25 bp, Artificial sequence
  Synthetic oligonucleotide
agtgttgtgcgaataattagtaagt

SEQ ID NO: 685223 - DNA, 25 bp, Artificial sequence
  Synthetic oligonucleotide
agtgttgtgcgattaattagtaagt

SEQ ID NO: 685224 - DNA, 25 bp, Artificial sequence
  Synthetic oligonucleotide
tcttccatattactccgatttgata

SEQ ID NO: 685225 - DNA, 25 bp, Artificial sequence
  Synthetic oligonucleotide
tcttccatattagtccgatttgata

SEQ ID NO: 685226 - DNA, 25 bp, Artificial sequence
  Synthetic oligonucleotide
aagaattgttattaacgtcgcactt

SEQ ID NO: 685227 - DNA, 25 bp, Artificial sequence
  Synthetic oligonucleotide
aagaattgttataaacgtcgcactt

SEQ ID NO: 685228 - DNA, 25 bp, Artificial sequence
  Synthetic oligonucleotide
acaatttcgacgatacatatctttg

SEQ ID NO: 685229 - DNA, 25 bp, Artificial sequence
  Synthetic oligonucleotide
ttgcttacgattaattctatgtgga

SEQ ID NO: 685230 - DNA, 25 bp, Artificial sequence
  Synthetic oligonucleotide
atgtttaggttcgcgtaatattttc

SEQ ID NO: 685231 - DNA, 25 bp, Artificial sequence
  Synthetic oligonucleotide
tgaatctcgcgaaatagtctatttt

SEQ ID NO: 685232 - DNA, 25 bp, Artificial sequence
  Synthetic oligonucleotide
ttttttatactatcggacgcaatac

SEQ ID NO: 685233 - DNA, 25 bp, Artificial sequence
  Synthetic oligonucleotide
ttttttatactaacggacgcaatac

SEQ ID NO: 685234 - DNA, 25 bp, Artificial sequence
  Synthetic oligonucleotide
tctaaaataattcggacgcattcat

SEQ ID NO: 685235 - DNA, 25 bp, Artificial sequence
  Synthetic oligonucleotide
tctaaaataattgggacgcattcat

SEQ ID NO: 685236 - DNA, 25 bp, Artificial sequence
  Synthetic oligonucleotide
ttacctataatacgggcgtttataa

SEQ ID NO: 685237 - DNA, 25 bp, Artificial sequence
  Synthetic oligonucleotide
ttacctataataggggcgtttataa

SEQ ID NO: 685238 - DNA, 25 bp, Artificial sequence
  Synthetic oligonucleotide
ttacacataacgacgtgacttaaat

SEQ ID NO: 685239 - DNA, 25 bp, Artificial sequence
  Synthetic oligonucleotide
ttacacataacgtcgtgacttaaat

SEQ ID NO: 685240 - DNA, 25 bp, Artificial sequence
  Synthetic oligonucleotide
ctaaatagttattcgcgactcatta

SEQ ID NO: 685241 - DNA, 25 bp, Artificial sequence
  Synthetic oligonucleotide
caacatatatagcacgcgaaaattt

SEQ ID NO: 685242 - DNA, 25 bp, Artificial sequence
  Synthetic oligonucleotide
atgtttaggttcccgtaatattttc

SEQ ID NO: 685243 - DNA, 25 bp, Artificial sequence
  Synthetic oligonucleotide
aaaaatatatagtgacgcgggaaaa

SEQ ID NO: 685244 - DNA, 25 bp, Artificial sequence
  Synthetic oligonucleotide
caaaatactcgaggtattgctataa

SEQ ID NO: 685245 - DNA, 25 bp, Artificial sequence
  Synthetic oligonucleotide
caaaatactcgacgtattgctataa

SEQ ID NO: 685246 - DNA, 25 bp, Artificial sequence
  Synthetic oligonucleotide
tgaattacgtccgtactatcattaa

SEQ ID NO: 685247 - DNA, 25 bp, Artificial sequence
  Synthetic oligonucleotide
tgaattacgtccctactatcattaa

SEQ ID NO: 685248 - DNA, 25 bp, Artificial sequence
  Synthetic oligonucleotide
caaatgacgtatggcgtaatattat

SEQ ID NO: 685249 - DNA, 25 bp, Artificial sequence
  Synthetic oligonucleotide
caaatgacgtatcgcgtaatattat

SEQ ID NO: 685250 - DNA, 25 bp, Artificial sequence
  Synthetic oligonucleotide
taagtaacgtacccgttattagaaa

SEQ ID NO: 685251 - DNA, 25 bp, Artificial sequence
  Synthetic oligonucleotide
taagtaacgtacgcgttattagaaa

SEQ ID NO: 685252 - DNA, 25 bp, Artificial sequence
  Synthetic oligonucleotide
ctattaacgcgtggttaatttaatc

SEQ ID NO: 685253 - DNA, 25 bp, Artificial sequence
  Synthetic oligonucleotide
acttcacgcgaatagtagataaata

SEQ ID NO: 685254 - DNA, 25 bp, Artificial sequence
  Synthetic oligonucleotide
ctaaatagttatacgcgactcatta

SEQ ID NO: 685255 - DNA, 25 bp, Artificial sequence
  Synthetic oligonucleotide
ctatttcgacggaatatcaatcaat

SEQ ID NO: 685256 - DNA, 25 bp, Artificial sequence
  Synthetic oligonucleotide
taacgacgcattattccgaataaat

SEQ ID NO: 685257 - DNA, 25 bp, Artificial sequence
  Synthetic oligonucleotide
taacgacgcatttttccgaataaat

SEQ ID NO: 685258 - DNA, 25 bp, Artificial sequence
  Synthetic oligonucleotide
attacacgcatactatacgagtaat

SEQ ID NO: 685259 - DNA, 25 bp, Artificial sequence
  Synthetic oligonucleotide
attacacgcatagtatacgagtaat

SEQ ID NO: 685260 - DNA, 25 bp, Artificial sequence
  Synthetic oligonucleotide
attaaacgcaatacgtctaacatga

SEQ ID NO: 685261 - DNA, 25 bp, Artificial sequence
  Synthetic oligonucleotide
attaaacgcaattcgtctaacatga

SEQ ID NO: 685262 - DNA, 25 bp, Artificial sequence
  Synthetic oligonucleotide
acatgacgcaaatcgtactaaaaaa

SEQ ID NO: 685263 - DNA, 25 bp, Artificial sequence
  Synthetic oligonucleotide
acatgacgcaaaacgtactaaaaaa

SEQ ID NO: 685264 - DNA, 25 bp, Artificial sequence
  Synthetic oligonucleotide
atttaacgattgaacgtacaggata

SEQ ID NO: 685265 - DNA, 25 bp, Artificial sequence
  Synthetic oligonucleotide
atttaacgattgtacgtacaggata

SEQ ID NO: 685266 - DNA, 25 bp, Artificial sequence
  Synthetic oligonucleotide
caacatatataggacgcgaaaattt

SEQ ID NO: 685267 - DNA, 25 bp, Artificial sequence
  Synthetic oligonucleotide
ttctaacgatcaaacgtactaagaa

SEQ ID NO: 685268 - DNA, 25 bp, Artificial sequence
  Synthetic oligonucleotide
cacaatacgcgcaagtataatttta

SEQ ID NO: 685269 - DNA, 25 bp, Artificial sequence
  Synthetic oligonucleotide
ctatttcgacggtatatcaatcaat

SEQ ID NO: 685270 - DNA, 25 bp, Artificial sequence
  Synthetic oligonucleotide
gttattcgacgaatatgtccaataa

SEQ ID NO: 685271 - DNA, 25 bp, Artificial sequence
  Synthetic oligonucleotide
gttattcgacgattatgtccaataa

SEQ ID NO: 685272 - DNA, 25 bp, Artificial sequence
  Synthetic oligonucleotide
aataagcacgacggattataacata

SEQ ID NO: 685273 - DNA, 25 bp, Artificial sequence
  Synthetic oligonucleotide
aataagcacgaccgattataacata

SEQ ID NO: 685274 - DNA, 25 bp, Artificial sequence
  Synthetic oligonucleotide
gtaattattactagcgacgctttaa

SEQ ID NO: 685275 - DNA, 25 bp, Artificial sequence
  Synthetic oligonucleotide
gtaattattacttgcgacgctttaa

SEQ ID NO: 685276 - DNA, 25 bp, Artificial sequence
  Synthetic oligonucleotide
atacaaatgattggcgctaaaacaa

SEQ ID NO: 685277 - DNA, 25 bp, Artificial sequence
  Synthetic oligonucleotide
atacaaatgattcgcgctaaaacaa

SEQ ID NO: 685278 - DNA, 25 bp, Artificial sequence
  Synthetic oligonucleotide
aaaaatatatagagacgcgggaaaa

SEQ ID NO: 685279 - DNA, 25 bp, Artificial sequence
  Synthetic oligonucleotide
ttctaacgatcatacgtactaagaa

SEQ ID NO: 685280 - DNA, 25 bp, Artificial sequence
  Synthetic oligonucleotide
cgaacacgactcgttatataatttt

SEQ ID NO: 685281 - DNA, 25 bp, Artificial sequence
  Synthetic oligonucleotide
tatatgacgcgttagtagtaatact

SEQ ID NO: 685282 - DNA, 25 bp, Artificial sequence
  Synthetic oligonucleotide
aattgatagacgtaatacgctgaaa

SEQ ID NO: 685283 - DNA, 25 bp, Artificial sequence
  Synthetic oligonucleotide
agtatctaagttggcgatattatca

SEQ ID NO: 685284 - DNA, 25 bp, Artificial sequence
  Synthetic oligonucleotide
agtatctaagttcgcgatattatca

SEQ ID NO: 685285 - DNA, 25 bp, Artificial sequence
  Synthetic oligonucleotide
tagaatgtacgatatcgtatttcct

SEQ ID NO: 685286 - DNA, 25 bp, Artificial sequence
  Synthetic oligonucleotide
tagaatgtacgaaatcgtatttcct

SEQ ID NO: 685287 - DNA, 25 bp, Artificial sequence
  Synthetic oligonucleotide
tttttactataattcgcgatagctc

SEQ ID NO: 685288 - DNA, 25 bp, Artificial sequence
  Synthetic oligonucleotide
tttttactataaatcgcgatagctc

SEQ ID NO: 685289 - DNA, 25 bp, Artificial sequence
  Synthetic oligonucleotide
aagaatcgcgattttagtactaaac

SEQ ID NO: 685290 - DNA, 25 bp, Artificial sequence
  Synthetic oligonucleotide
aagaatcgcgatattagtactaaac

SEQ ID NO: 685291 - DNA, 25 bp, Artificial sequence
  Synthetic oligonucleotide
tgactatagtacccgtaattttaca

SEQ ID NO: 685292 - DNA, 25 bp, Artificial sequence
  Synthetic oligonucleotide
tcctaacgcgataactatttaatca

SEQ ID NO: 685293 - DNA, 25 bp, Artificial sequence
  Synthetic oligonucleotide
tgactatagtacgcgtaattttaca

SEQ ID NO: 685294 - DNA, 25 bp, Artificial sequence
  Synthetic oligonucleotide
cgaacacgactccttatataatttt

SEQ ID NO: 685295 - DNA, 25 bp, Artificial sequence
  Synthetic oligonucleotide
acttgaccgaatggttaattaaatg

SEQ ID NO: 685296 - DNA, 25 bp, Artificial sequence
  Synthetic oligonucleotide
acttgaccgaatcgttaattaaatg

SEQ ID NO: 685297 - DNA, 25 bp, Artificial sequence
  Synthetic oligonucleotide
cattaaatgtatggacgtaccttaa

SEQ ID NO: 685298 - DNA, 25 bp, Artificial sequence
  Synthetic oligonucleotide
cattaaatgtatcgacgtaccttaa

SEQ ID NO: 685299 - DNA, 25 bp, Artificial sequence
  Synthetic oligonucleotide
ttgaatatacgacggattagtagtt

SEQ ID NO: 685300 - DNA, 25 bp, Artificial sequence
  Synthetic oligonucleotide
ttgaatatacgagggattagtagtt

SEQ ID NO: 685301 - DNA, 25 bp, Artificial sequence
  Synthetic oligonucleotide
tgttgtaagttatcgcgtatatcaa

SEQ ID NO: 685302 - DNA, 25 bp, Artificial sequence
  Synthetic oligonucleotide
ctttacaacgcgttatagatatctt

SEQ ID NO: 685303 - DNA, 25 bp, Artificial sequence
  Synthetic oligonucleotide
tgttgtaagttaacgcgtatatcaa

SEQ ID NO: 685304 - DNA, 25 bp, Artificial sequence
  Synthetic oligonucleotide
tcctaacgcgattactatttaatca

SEQ ID NO: 685305 - DNA, 25 bp, Artificial sequence
  Synthetic oligonucleotide
ttaagaaacctaacgttcgataaca

SEQ ID NO: 685306 - DNA, 25 bp, Artificial sequence
  Synthetic oligonucleotide
cacaatacgcgctagtataatttta

SEQ ID NO: 685307 - DNA, 25 bp, Artificial sequence
  Synthetic oligonucleotide
agtaaaacgcgagtagtatcattta

SEQ ID NO: 685308 - DNA, 25 bp, Artificial sequence
  Synthetic oligonucleotide
agtaaaacgcgactagtatcattta

SEQ ID NO: 685309 - DNA, 25 bp, Artificial sequence
  Synthetic oligonucleotide
gatatcacaacgtcgatacatttaa

SEQ ID NO: 685310 - DNA, 25 bp, Artificial sequence
  Synthetic oligonucleotide
gatatcacaacgacgatacatttaa

SEQ ID NO: 685311 - DNA, 25 bp, Artificial sequence
  Synthetic oligonucleotide
aacacaaatccgtatacgcaattat

SEQ ID NO: 685312 - DNA, 25 bp, Artificial sequence
  Synthetic oligonucleotide
aacacaaatccgaatacgcaattat

SEQ ID NO: 685313 - DNA, 25 bp, Artificial sequence
  Synthetic oligonucleotide
attacaaactccgcgtataattaag

SEQ ID NO: 685314 - DNA, 25 bp, Artificial sequence
  Synthetic oligonucleotide
attacaaactccccgtataattaag

SEQ ID NO: 685315 - DNA, 25 bp, Artificial sequence
  Synthetic oligonucleotide
ttttaaaacgtcacgatacaagagt

SEQ ID NO: 685316 - DNA, 25 bp, Artificial sequence
  Synthetic oligonucleotide
aattgatagacgaaatacgctgaaa

SEQ ID NO: 685317 - DNA, 25 bp, Artificial sequence
  Synthetic oligonucleotide
ttaagaaacctatcgttcgataaca

SEQ ID NO: 685318 - DNA, 25 bp, Artificial sequence
  Synthetic oligonucleotide
ctattaacgcgtcgttaatttaatc

SEQ ID NO: 685319 - DNA, 25 bp, Artificial sequence
  Synthetic oligonucleotide
attatattaacgcgtactaggcata

SEQ ID NO: 685320 - DNA, 25 bp, Artificial sequence
  Synthetic oligonucleotide
attatattaacgggtactaggcata

SEQ ID NO: 685321 - DNA, 25 bp, Artificial sequence
  Synthetic oligonucleotide
aattaatcgcgtaaatacaccctaa

SEQ ID NO: 685322 - DNA, 25 bp, Artificial sequence
  Synthetic oligonucleotide
aattaatcgcgttaatacaccctaa

SEQ ID NO: 685323 - DNA, 25 bp, Artificial sequence
  Synthetic oligonucleotide
aggaattcgcgtttgattattgata

SEQ ID NO: 685324 - DNA, 25 bp, Artificial sequence
  Synthetic oligonucleotide
aggaattcgcgtatgattattgata

SEQ ID NO: 685325 - DNA, 25 bp, Artificial sequence
  Synthetic oligonucleotide
attagctattaccatcggaatttca

SEQ ID NO: 685326 - DNA, 25 bp, Artificial sequence
  Synthetic oligonucleotide
attagctattacgatcggaatttca

SEQ ID NO: 685327 - DNA, 25 bp, Artificial sequence
  Synthetic oligonucleotide
atagtatatacgtttaccgtatgtc

SEQ ID NO: 685328 - DNA, 25 bp, Artificial sequence
  Synthetic oligonucleotide
atagtatatacgattaccgtatgtc

SEQ ID NO: 685329 - DNA, 25 bp, Artificial sequence
  Synthetic oligonucleotide
ttttaaaacgtctcgatacaagagt

SEQ ID NO: 685330 - DNA, 25 bp, Artificial sequence
  Synthetic oligonucleotide
tagagttacgagacgactataaaaa

SEQ ID NO: 685331 - DNA, 25 bp, Artificial sequence
  Synthetic oligonucleotide
gaaaaataacgcctataggatacta

SEQ ID NO: 685332 - DNA, 25 bp, Artificial sequence
  Synthetic oligonucleotide
tttatttcgacttagttcgtcctat

SEQ ID NO: 685333 - DNA, 25 bp, Artificial sequence
  Synthetic oligonucleotide
tgattatacgtatagtcggtcaaat

SEQ ID NO: 685334 - DNA, 25 bp, Artificial sequence
  Synthetic oligonucleotide
tataactacgtatctccgatattca

SEQ ID NO: 685335 - DNA, 25 bp, Artificial sequence
  Synthetic oligonucleotide
tataactacgtaactccgatattca

SEQ ID NO: 685336 - DNA, 25 bp, Artificial sequence
  Synthetic oligonucleotide
tatagttacggttagtcgtaagaat

SEQ ID NO: 685337 - DNA, 25 bp, Artificial sequence
  Synthetic oligonucleotide
tatagttacggtaagtcgtaagaat

SEQ ID NO: 685338 - DNA, 25 bp, Artificial sequence
  Synthetic oligonucleotide
catacatacgcggtagtataatata

SEQ ID NO: 685339 - DNA, 25 bp, Artificial sequence
  Synthetic oligonucleotide
catacatacgcgctagtataatata

SEQ ID NO: 685340 - DNA, 25 bp, Artificial sequence
  Synthetic oligonucleotide
atatcatacgatatgacgcaagtta

SEQ ID NO: 685341 - DNA, 25 bp, Artificial sequence
  Synthetic oligonucleotide
tggttatacgttggtcctatattat

SEQ ID NO: 685342 - DNA, 25 bp, Artificial sequence
  Synthetic oligonucleotide
tagagttacgagtcgactataaaaa

SEQ ID NO: 685343 - DNA, 25 bp, Artificial sequence
  Synthetic oligonucleotide
tggttatacgttcgtcctatattat

SEQ ID NO: 685344 - DNA, 25 bp, Artificial sequence
  Synthetic oligonucleotide
ataatatacgacggtatactcttgt

SEQ ID NO: 685345 - DNA, 25 bp, Artificial sequence
  Synthetic oligonucleotide
ataatatacgaccgtatactcttgt

SEQ ID NO: 685346 - DNA, 25 bp, Artificial sequence
  Synthetic oligonucleotide
ttacgataccttttacgcgattaaa

SEQ ID NO: 685347 - DNA, 25 bp, Artificial sequence
  Synthetic oligonucleotide
ttacgataccttatacgcgattaaa

SEQ ID NO: 685348 - DNA, 25 bp, Artificial sequence
  Synthetic oligonucleotide
tattaataccggttcgtaattctgt

SEQ ID NO: 685349 - DNA, 25 bp, Artificial sequence
  Synthetic oligonucleotide
tattaataccggatcgtaattctgt

SEQ ID NO: 685350 - DNA, 25 bp, Artificial sequence
  Synthetic oligonucleotide
tattattaatacgacgcgaaggttt

SEQ ID NO: 685351 - DNA, 25 bp, Artificial sequence
  Synthetic oligonucleotide
tattattaataccacgcgaaggttt

SEQ ID NO: 685352 - DNA, 25 bp, Artificial sequence
  Synthetic oligonucleotide
cctatataagttacgtcgcaaattt

SEQ ID NO: 685353 - DNA, 25 bp, Artificial sequence
  Synthetic oligonucleotide
cctatataagtttcgtcgcaaattt

SEQ ID NO: 685354 - DNA, 25 bp, Artificial sequence
  Synthetic oligonucleotide
atatcatacgatttgacgcaagtta

SEQ ID NO: 685355 - DNA, 25 bp, Artificial sequence
  Synthetic oligonucleotide
attacatataatccgcgctctaaaa

SEQ ID NO: 685356 - DNA, 25 bp, Artificial sequence
  Synthetic oligonucleotide
tatatgacgcgtaagtagtaatact

SEQ ID NO: 685357 - DNA, 25 bp, Artificial sequence
  Synthetic oligonucleotide
tttatttcgactaagttcgtcctat

SEQ ID NO: 685358 - DNA, 25 bp, Artificial sequence
  Synthetic oligonucleotide
acttcacgcgaaaagtagataaata

SEQ ID NO: 685359 - DNA, 25 bp, Artificial sequence
  Synthetic oligonucleotide
tatatgtattgccaacgtcgaataa

SEQ ID NO: 685360 - DNA, 25 bp, Artificial sequence
  Synthetic oligonucleotide
tatatgtattgcgaacgtcgaataa

SEQ ID NO: 685361 - DNA, 25 bp, Artificial sequence
  Synthetic oligonucleotide
tatgtatatgtcccgtagaaatgta

SEQ ID NO: 685362 - DNA, 25 bp, Artificial sequence
  Synthetic oligonucleotide
tatgtatatgtcgcgtagaaatgta

SEQ ID NO: 685363 - DNA, 25 bp, Artificial sequence
  Synthetic oligonucleotide
actttgtatcgcttcgtcataatta

SEQ ID NO: 685364 - DNA, 25 bp, Artificial sequence
  Synthetic oligonucleotide
actttgtatcgcatcgtcataatta

SEQ ID NO: 685365 - DNA, 25 bp, Artificial sequence
  Synthetic oligonucleotide
gatatatataccatacgcgataaag

SEQ ID NO: 685366 - DNA, 25 bp, Artificial sequence
  Synthetic oligonucleotide
tttcaatacgtccctagattttgat

SEQ ID NO: 685367 - DNA, 25 bp, Artificial sequence
  Synthetic oligonucleotide
attacatataatgcgcgctctaaaa

SEQ ID NO: 685368 - DNA, 25 bp, Artificial sequence
  Synthetic oligonucleotide
tgattatacgtaaagtcggtcaaat

SEQ ID NO: 685369 - DNA, 25 bp, Artificial sequence
  Synthetic oligonucleotide
gataagtataaccttccgctataaa

SEQ ID NO: 685370 - DNA, 25 bp, Artificial sequence
  Synthetic oligonucleotide
gataagtataacgttccgctataaa

SEQ ID NO: 685371 - DNA, 25 bp, Artificial sequence
  Synthetic oligonucleotide
gaatagtagtcgacaatcgaaattt

SEQ ID NO: 685372 - DNA, 25 bp, Artificial sequence
  Synthetic oligonucleotide
gaatagtagtcgtcaatcgaaattt

SEQ ID NO: 685373 - DNA, 25 bp, Artificial sequence
  Synthetic oligonucleotide
gtatgttagctttacgtcgtaattt

SEQ ID NO: 685374 - DNA, 25 bp, Artificial sequence
  Synthetic oligonucleotide
gtatgttagcttaacgtcgtaattt

SEQ ID NO: 685375 - DNA, 25 bp, Artificial sequence
  Synthetic oligonucleotide
ttcatatactattcgccgaagttat

SEQ ID NO: 685376 - DNA, 25 bp, Artificial sequence
  Synthetic oligonucleotide
ttcatatactatacgccgaagttat

SEQ ID NO: 685377 - DNA, 25 bp, Artificial sequence
  Synthetic oligonucleotide
tttaaatactagtcgacgtacatac

SEQ ID NO: 685378 - DNA, 25 bp, Artificial sequence
  Synthetic oligonucleotide
tttaaatactagacgacgtacatac

SEQ ID NO: 685379 - DNA, 25 bp, Artificial sequence
  Synthetic oligonucleotide
gatatatataccttacgcgataaag

SEQ ID NO: 685380 - DNA, 25 bp, Artificial sequence
  Synthetic oligonucleotide
aagatacgtaatttacgcgatgata

SEQ ID NO: 685381 - DNA, 25 bp, Artificial sequence
  Synthetic oligonucleotide
atactactagtaggtatcggtaaaa

SEQ ID NO: 685382 - DNA, 25 bp, Artificial sequence
  Synthetic oligonucleotide
atactactagtacgtatcggtaaaa

SEQ ID NO: 685383 - DNA, 25 bp, Artificial sequence
  Synthetic oligonucleotide
ttttagctaccgcgatatatttttg

SEQ ID NO: 685384 - DNA, 25 bp, Artificial sequence
  Synthetic oligonucleotide
ttttagctaccgggatatatttttg

SEQ ID NO: 685385 - DNA, 25 bp, Artificial sequence
  Synthetic oligonucleotide
aaaagactaatcgtacgactatgtt

SEQ ID NO: 685386 - DNA, 25 bp, Artificial sequence
  Synthetic oligonucleotide
aaaagactaatcctacgactatgtt

SEQ ID NO: 685387 - DNA, 25 bp, Artificial sequence
  Synthetic oligonucleotide
tgtgatctaacgggtgataaattat

SEQ ID NO: 685388 - DNA, 25 bp, Artificial sequence
  Synthetic oligonucleotide
tgtgatctaacgcgtgataaattat

SEQ ID NO: 685389 - DNA, 25 bp, Artificial sequence
  Synthetic oligonucleotide
cataaacgtctaatcgtacttgttt

SEQ ID NO: 685390 - DNA, 25 bp, Artificial sequence
  Synthetic oligonucleotide
cataaacgtctattcgtacttgttt

SEQ ID NO: 685391 - DNA, 25 bp, Artificial sequence
  Synthetic oligonucleotide
tatacactatcatatcgcggataaa

SEQ ID NO: 685392 - DNA, 25 bp, Artificial sequence
  Synthetic oligonucleotide
ttaaatcgtacgcgataaatattgc

SEQ ID NO: 685393 - DNA, 25 bp, Artificial sequence
  Synthetic oligonucleotide
attatgcggtctatacgtaataaca

SEQ ID NO: 685394 - DNA, 25 bp, Artificial sequence
  Synthetic oligonucleotide
aagatacgtaatatacgcgatgata

SEQ ID NO: 685395 - DNA, 25 bp, Artificial sequence
  Synthetic oligonucleotide
tttcaacgtaacccgattaaatttc

SEQ ID NO: 685396 - DNA, 25 bp, Artificial sequence
  Synthetic oligonucleotide
tttcaacgtaacgcgattaaatttc

SEQ ID NO: 685397 - DNA, 25 bp, Artificial sequence
  Synthetic oligonucleotide
tatatacggttgaaatacgtgctaa

SEQ ID NO: 685398 - DNA, 25 bp, Artificial sequence
  Synthetic oligonucleotide
tatatacggttgtaatacgtgctaa

SEQ ID NO: 685399 - DNA, 25 bp, Artificial sequence
  Synthetic oligonucleotide
tcttcacggtgatattcgatataat

SEQ ID NO: 685400 - DNA, 25 bp, Artificial sequence
  Synthetic oligonucleotide
tcttcacggtgaaattcgatataat

SEQ ID NO: 685401 - DNA, 25 bp, Artificial sequence
  Synthetic oligonucleotide
attatgcggtctttacgtaataaca

SEQ ID NO: 685402 - DNA, 25 bp, Artificial sequence
  Synthetic oligonucleotide
gaaaaataacgcgtataggatacta

SEQ ID NO: 685403 - DNA, 25 bp, Artificial sequence
  Synthetic oligonucleotide
aatgagcggtctaatcgtataatat

SEQ ID NO: 685404 - DNA, 25 bp, Artificial sequence
  Synthetic oligonucleotide
tttcaatacgtcgctagattttgat

SEQ ID NO: 685405 - DNA, 25 bp, Artificial sequence
  Synthetic oligonucleotide
ttaaatcgtacgggataaatattgc

SEQ ID NO: 685406 - DNA, 25 bp, Artificial sequence
  Synthetic oligonucleotide
tagatagtacggtttacgaaaaaca

SEQ ID NO: 685407 - DNA, 25 bp, Artificial sequence
  Synthetic oligonucleotide
aatgagcggtcttatcgtataatat

SEQ ID NO: 685408 - DNA, 25 bp, Artificial sequence
  Synthetic oligonucleotide
tatgtttaacgcggtattgcaaaaa

SEQ ID NO: 685409 - DNA, 25 bp, Artificial sequence
  Synthetic oligonucleotide
agaaatgtttaaccgtcgatttaga

SEQ ID NO: 685410 - DNA, 25 bp, Artificial sequence
  Synthetic oligonucleotide
agaaatgtttaagcgtcgatttaga

SEQ ID NO: 685411 - DNA, 25 bp, Artificial sequence
  Synthetic oligonucleotide
aagatagtacgttatacggttcatt

SEQ ID NO: 685412 - DNA, 25 bp, Artificial sequence
  Synthetic oligonucleotide
tagatagtacggattacgaaaaaca

SEQ ID NO: 685413 - DNA, 25 bp, Artificial sequence
  Synthetic oligonucleotide
tatgtttaacgccgtattgcaaaaa

SEQ ID NO: 685414 - DNA, 25 bp, Artificial sequence
  Synthetic oligonucleotide
taaaatggtcgacgaattagtgtat

SEQ ID NO: 685415 - DNA, 25 bp, Artificial sequence
  Synthetic oligonucleotide
taaaatggtcgaggaattagtgtat

SEQ ID NO: 685416 - DNA, 25 bp, Artificial sequence
  Synthetic oligonucleotide
tttccagcgcgaatctatattatat

SEQ ID NO: 685417 - DNA, 25 bp, Artificial sequence
  Synthetic oligonucleotide
tttccagcgcgattctatattatat

SEQ ID NO: 685418 - DNA, 25 bp, Artificial sequence
  Synthetic oligonucleotide
taaaaagacgataattcgctagtac

SEQ ID NO: 685419 - DNA, 25 bp, Artificial sequence
  Synthetic oligonucleotide
aagatagtacgtaatacggttcatt

SEQ ID NO: 685420 - DNA, 25 bp, Artificial sequence
  Synthetic oligonucleotide
tatacactatcaaatcgcggataaa

SEQ ID NO: 685421 - DNA, 25 bp, Artificial sequence
  Synthetic oligonucleotide
taaagagcgatatacgtctatatga

SEQ ID NO: 685422 - DNA, 25 bp, Artificial sequence
  Synthetic oligonucleotide
taaaaagacgattattcgctagtac

SEQ ID NO: 685423 - DNA, 25 bp, Artificial sequence
  Synthetic oligonucleotide
tatttagaacgagcgtataagctaa

SEQ ID NO: 685424 - DNA, 25 bp, Artificial sequence
  Synthetic oligonucleotide
cataatgacgcgttctataattaac

SEQ ID NO: 685425 - DNA, 25 bp, Artificial sequence
  Synthetic oligonucleotide
cataatgacgcgatctataattaac

SEQ ID NO: 685426 - DNA, 25 bp, Artificial sequence
  Synthetic oligonucleotide
taaatagacgtagcgattataatgc

SEQ ID NO: 685427 - DNA, 25 bp, Artificial sequence
  Synthetic oligonucleotide
taaatagacgtaccgattataatgc

SEQ ID NO: 685428 - DNA, 25 bp, Artificial sequence
  Synthetic oligonucleotide
taaagagcgataaacgtctatatga

SEQ ID NO: 685429 - DNA, 25 bp, Artificial sequence
  Synthetic oligonucleotide
tatttagaacgaccgtataagctaa

SEQ ID NO: 685430 - DNA, 25 bp, Artificial sequence
  Synthetic oligonucleotide
gtctatcgcgagttagtatgttata

SEQ ID NO: 685431 - DNA, 25 bp, Artificial sequence
  Synthetic oligonucleotide
acttttcgcgataacctattttctg

SEQ ID NO: 685432 - DNA, 25 bp, Artificial sequence
  Synthetic oligonucleotide
gaatatcgcgagtaactaagtacat

SEQ ID NO: 685433 - DNA, 25 bp, Artificial sequence
  Synthetic oligonucleotide
gaatatcgcgagaaactaagtacat

SEQ ID NO: 685434 - DNA, 25 bp, Artificial sequence
  Synthetic oligonucleotide
acttttcgcgattacctattttctg

SEQ ID NO: 685435 - DNA, 25 bp, Artificial sequence
  Synthetic oligonucleotide
tccttacgcgatactgtatttttgt

SEQ ID NO: 685436 - DNA, 25 bp, Artificial sequence
  Synthetic oligonucleotide
tccttacgcgattctgtatttttgt

SEQ ID NO: 685437 - DNA, 25 bp, Artificial sequence
  Synthetic oligonucleotide
aagctacgcgattgatctagattat

SEQ ID NO: 685438 - DNA, 25 bp, Artificial sequence
  Synthetic oligonucleotide
ataaatcgcgcattagtattaggga

SEQ ID NO: 685439 - DNA, 25 bp, Artificial sequence
  Synthetic oligonucleotide
gtctatcgcgagatagtatgttata

SEQ ID NO: 685440 - DNA, 25 bp, Artificial sequence
  Synthetic oligonucleotide
aagctacgcgatagatctagattat

SEQ ID NO: 685441 - DNA, 25 bp, Artificial sequence
  Synthetic oligonucleotide
tactatcgcgacttattacataggt

SEQ ID NO: 685442 - DNA, 25 bp, Artificial sequence
  Synthetic oligonucleotide
tactatcgcgacatattacataggt

SEQ ID NO: 685443 - DNA, 25 bp, Artificial sequence
  Synthetic oligonucleotide
aaaatacgcgacaaataagataggg

SEQ ID NO: 685444 - DNA, 25 bp, Artificial sequence
  Synthetic oligonucleotide
aaaatacgcgactaataagataggg

SEQ ID NO: 685445 - DNA, 25 bp, Artificial sequence
  Synthetic oligonucleotide
aagtaacgcgaagtcttatcaagaa

SEQ ID NO: 685446 - DNA, 25 bp, Artificial sequence
  Synthetic oligonucleotide
aagtaacgcgaactcttatcaagaa

SEQ ID NO: 685447 - DNA, 25 bp, Artificial sequence
  Synthetic oligonucleotide
aacactcgccgtttagattatgttt

SEQ ID NO: 685448 - DNA, 25 bp, Artificial sequence
  Synthetic oligonucleotide
aacactcgccgtatagattatgttt

SEQ ID NO: 685449 - DNA, 25 bp, Artificial sequence
  Synthetic oligonucleotide
ttttcacgccgacaatataaatacc

SEQ ID NO: 685450 - DNA, 25 bp, Artificial sequence
  Synthetic oligonucleotide
ataaatcgcgcaatagtattaggga

SEQ ID NO: 685451 - DNA, 25 bp, Artificial sequence
  Synthetic oligonucleotide
tgtattcgccgatacattaaaccat

SEQ ID NO: 685452 - DNA, 25 bp, Artificial sequence
  Synthetic oligonucleotide
agagatcgcgtttacgattctattt

SEQ ID NO: 685453 - DNA, 25 bp, Artificial sequence
  Synthetic oligonucleotide
ttttcacgccgagaatataaatacc

SEQ ID NO: 685454 - DNA, 25 bp, Artificial sequence
  Synthetic oligonucleotide
tgtattcgccgaaacattaaaccat

SEQ ID NO: 685455 - DNA, 25 bp, Artificial sequence
  Synthetic oligonucleotide
atatatcggtataaatccgcttgac

SEQ ID NO: 685456 - DNA, 25 bp, Artificial sequence
  Synthetic oligonucleotide
atatatcggtattaatccgcttgac

SEQ ID NO: 685457 - DNA, 25 bp, Artificial sequence
  Synthetic oligonucleotide
caaagccggtagaatacgatttatt

SEQ ID NO: 685458 - DNA, 25 bp, Artificial sequence
  Synthetic oligonucleotide
caaagccggtagtatacgatttatt

SEQ ID NO: 685459 - DNA, 25 bp, Artificial sequence
  Synthetic oligonucleotide
attatccggcgtattacatttggtt

SEQ ID NO: 685460 - DNA, 25 bp, Artificial sequence
  Synthetic oligonucleotide
attatccggcgttttacatttggtt

SEQ ID NO: 685461 - DNA, 25 bp, Artificial sequence
  Synthetic oligonucleotide
ttgaatcgcttatacgtacgtacat

SEQ ID NO: 685462 - DNA, 25 bp, Artificial sequence
  Synthetic oligonucleotide
ttgaatcgcttaaacgtacgtacat

SEQ ID NO: 685463 - DNA, 25 bp, Artificial sequence
  Synthetic oligonucleotide
taaaaacgctacgatctaatggatg

SEQ ID NO: 685464 - DNA, 25 bp, Artificial sequence
  Synthetic oligonucleotide
agtgaacgcgttataccatttattg

SEQ ID NO: 685465 - DNA, 25 bp, Artificial sequence
  Synthetic oligonucleotide
agagatcgcgttaacgattctattt

SEQ ID NO: 685466 - DNA, 25 bp, Artificial sequence
  Synthetic oligonucleotide
taaggtcgcgcattcaatatactta

SEQ ID NO: 685467 - DNA, 25 bp, Artificial sequence
  Synthetic oligonucleotide
agtgaacgcgttttaccatttattg

SEQ ID NO: 685468 - DNA, 25 bp, Artificial sequence
  Synthetic oligonucleotide
aactttcgcgtctattagtaggata

SEQ ID NO: 685469 - DNA, 25 bp, Artificial sequence
  Synthetic oligonucleotide
aactttcgcgtcaattagtaggata

SEQ ID NO: 685470 - DNA, 25 bp, Artificial sequence
  Synthetic oligonucleotide
gatatccgcgtagtaagttagaata

SEQ ID NO: 685471 - DNA, 25 bp, Artificial sequence
  Synthetic oligonucleotide
gatatccgcgtactaagttagaata

SEQ ID NO: 685472 - DNA, 25 bp, Artificial sequence
  Synthetic oligonucleotide
taattccgcgtatcatacttagtct

SEQ ID NO: 685473 - DNA, 25 bp, Artificial sequence
  Synthetic oligonucleotide
taattccgcgtaacatacttagtct

SEQ ID NO: 685474 - DNA, 25 bp, Artificial sequence
  Synthetic oligonucleotide
aaacagcgcgcttgtataaaacaaa

SEQ ID NO: 685475 - DNA, 25 bp, Artificial sequence
  Synthetic oligonucleotide
aaacagcgcgctagtataaaacaaa

SEQ ID NO: 685476 - DNA, 25 bp, Artificial sequence
  Synthetic oligonucleotide
taaggtcgcgcaatcaatatactta

SEQ ID NO: 685477 - DNA, 25 bp, Artificial sequence
  Synthetic oligonucleotide
taaaaacgctaccatctaatggatg

SEQ ID NO: 685478 - DNA, 25 bp, Artificial sequence
  Synthetic oligonucleotide
agaatacagcgttatacgatctgat

SEQ ID NO: 685479 - DNA, 25 bp, Artificial sequence
  Synthetic oligonucleotide
tgatttccgcgattatctaatcaag

SEQ ID NO: 685480 - DNA, 25 bp, Artificial sequence
  Synthetic oligonucleotide
atacgaccgaaccattagtttctta

SEQ ID NO: 685481 - DNA, 25 bp, Artificial sequence
  Synthetic oligonucleotide
atacgaccgaacgattagtttctta

SEQ ID NO: 685482 - DNA, 25 bp, Artificial sequence
  Synthetic oligonucleotide
attatgcatcgtatacggtatatcc

SEQ ID NO: 685483 - DNA, 25 bp, Artificial sequence
  Synthetic oligonucleotide
attatgcatcgtttacggtatatcc

SEQ ID NO: 685484 - DNA, 25 bp, Artificial sequence
  Synthetic oligonucleotide
tcagttcatacttatcgcgatgata

SEQ ID NO: 685485 - DNA, 25 bp, Artificial sequence
  Synthetic oligonucleotide
tcagttcatactaatcgcgatgata

SEQ ID NO: 685486 - DNA, 25 bp, Artificial sequence
  Synthetic oligonucleotide
tagtaacataagcgacgatacattc

SEQ ID NO: 685487 - DNA, 25 bp, Artificial sequence
  Synthetic oligonucleotide
tagtaacataagggacgatacattc

SEQ ID NO: 685488 - DNA, 25 bp, Artificial sequence
  Synthetic oligonucleotide
tggaagcagtcgatatcgtatttaa

SEQ ID NO: 685489 - DNA, 25 bp, Artificial sequence
  Synthetic oligonucleotide
ttttttattaatggtcgcgaccgat

SEQ ID NO: 685490 - DNA, 25 bp, Artificial sequence
  Synthetic oligonucleotide
agaatacagcgtaatacgatctgat

SEQ ID NO: 685491 - DNA, 25 bp, Artificial sequence
  Synthetic oligonucleotide
aagtagccgctaaaacgataattac

SEQ ID NO: 685492 - DNA, 25 bp, Artificial sequence
  Synthetic oligonucleotide
ttttaccaattagtacgcggatgaa

SEQ ID NO: 685493 - DNA, 25 bp, Artificial sequence
  Synthetic oligonucleotide
ttttaccaattactacgcggatgaa

SEQ ID NO: 685494 - DNA, 25 bp, Artificial sequence
  Synthetic oligonucleotide
aatcttcaatgacgcgtatatgcat

SEQ ID NO: 685495 - DNA, 25 bp, Artificial sequence
  Synthetic oligonucleotide
aatcttcaatgaggcgtatatgcat

SEQ ID NO: 685496 - DNA, 25 bp, Artificial sequence
  Synthetic oligonucleotide
tagaaaattgtcggatcgttctatg

SEQ ID NO: 685497 - DNA, 25 bp, Artificial sequence
  Synthetic oligonucleotide
tagaaaattgtccgatcgttctatg

SEQ ID NO: 685498 - DNA, 25 bp, Artificial sequence
  Synthetic oligonucleotide
atatctattcgaacgcgtaatggaa

SEQ ID NO: 685499 - DNA, 25 bp, Artificial sequence
  Synthetic oligonucleotide
atatctattcgatcgcgtaatggaa

SEQ ID NO: 685500 - DNA, 25 bp, Artificial sequence
  Synthetic oligonucleotide
ttttttattaatcgtcgcgaccgat

SEQ ID NO: 685501 - DNA, 25 bp, Artificial sequence
  Synthetic oligonucleotide
ggatatgcgttgaacgtataatttg

SEQ ID NO: 685502 - DNA, 25 bp, Artificial sequence
  Synthetic oligonucleotide
tggaagcagtcgttatcgtatttaa

SEQ ID NO: 685503 - DNA, 25 bp, Artificial sequence
  Synthetic oligonucleotide
atcaagcgacgcaatatcttcatta

SEQ ID NO: 685504 - DNA, 25 bp, Artificial sequence
  Synthetic oligonucleotide
ttaatgcgcatacgactaatctttg

SEQ ID NO: 685505 - DNA, 25 bp, Artificial sequence
  Synthetic oligonucleotide
acaagtcgatcggacataatgatat

SEQ ID NO: 685506 - DNA, 25 bp, Artificial sequence
  Synthetic oligonucleotide
acaagtcgatcgcacataatgatat

SEQ ID NO: 685507 - DNA, 25 bp, Artificial sequence
  Synthetic oligonucleotide
gttaaacgatattctagccctgtat

SEQ ID NO: 685508 - DNA, 25 bp, Artificial sequence
  Synthetic oligonucleotide
gttaaacgatatactagccctgtat

SEQ ID NO: 685509 - DNA, 25 bp, Artificial sequence
  Synthetic oligonucleotide
tattagcgacttatgcgtatcgtat

SEQ ID NO: 685510 - DNA, 25 bp, Artificial sequence
  Synthetic oligonucleotide
tattagcgacttttgcgtatcgtat

SEQ ID NO: 685511 - DNA, 25 bp, Artificial sequence
  Synthetic oligonucleotide
tatatgcgactatacgagatgtgaa

SEQ ID NO: 685512 - DNA, 25 bp, Artificial sequence
  Synthetic oligonucleotide
tatatgcgactaaacgagatgtgaa

SEQ ID NO: 685513 - DNA, 25 bp, Artificial sequence
  Synthetic oligonucleotide
taattacgacgcaattagagtgttc

SEQ ID NO: 685514 - DNA, 25 bp, Artificial sequence
  Synthetic oligonucleotide
tgatttccgcgaatatctaatcaag

SEQ ID NO: 685515 - DNA, 25 bp, Artificial sequence
  Synthetic oligonucleotide
atcaagcgacgctatatcttcatta

SEQ ID NO: 685516 - DNA, 25 bp, Artificial sequence
  Synthetic oligonucleotide
aagtagccgctataacgataattac

SEQ ID NO: 685517 - DNA, 25 bp, Artificial sequence
  Synthetic oligonucleotide
atctaccgaagtttatcggtcttat

SEQ ID NO: 685518 - DNA, 25 bp, Artificial sequence
  Synthetic oligonucleotide
atctaccgaagtatatcggtcttat

SEQ ID NO: 685519 - DNA, 25 bp, Artificial sequence
  Synthetic oligonucleotide
tagagccgaaggaacgataaaattt

SEQ ID NO: 685520 - DNA, 25 bp, Artificial sequence
  Synthetic oligonucleotide
tagagccgaaggtacgataaaattt

SEQ ID NO: 685521 - DNA, 25 bp, Artificial sequence
  Synthetic oligonucleotide
ccaaaacctataatcgtcgaagtaa

SEQ ID NO: 685522 - DNA, 25 bp, Artificial sequence
  Synthetic oligonucleotide
ccaaaacctatattcgtcgaagtaa

SEQ ID NO: 685523 - DNA, 25 bp, Artificial sequence
  Synthetic oligonucleotide
tatcagcctaacgacgattatcttt

SEQ ID NO: 685524 - DNA, 25 bp, Artificial sequence
  Synthetic oligonucleotide
tatcagcctaaccacgattatcttt

SEQ ID NO: 685525 - DNA, 25 bp, Artificial sequence
  Synthetic oligonucleotide
tgaagaccgttaggtatagactaaa

SEQ ID NO: 685526 - DNA, 25 bp, Artificial sequence
  Synthetic oligonucleotide
tgaagaccgttacgtatagactaaa

SEQ ID NO: 685527 - DNA, 25 bp, Artificial sequence
  Synthetic oligonucleotide
ttaatgcgcataggactaatctttg

SEQ ID NO: 685528 - DNA, 25 bp, Artificial sequence
  Synthetic oligonucleotide
taattacgacgctattagagtgttc

SEQ ID NO: 685529 - DNA, 25 bp, Artificial sequence
  Synthetic oligonucleotide
gttgaactgacgatcgtataattac

SEQ ID NO: 685530 - DNA, 25 bp, Artificial sequence
  Synthetic oligonucleotide
catagagcgttccgttatatttatg

SEQ ID NO: 685531 - DNA, 25 bp, Artificial sequence
  Synthetic oligonucleotide
tagatagacgcgaatattctatctg

SEQ ID NO: 685532 - DNA, 25 bp, Artificial sequence
  Synthetic oligonucleotide
tagatagacgcgtatattctatctg

SEQ ID NO: 685533 - DNA, 25 bp, Artificial sequence
  Synthetic oligonucleotide
taagatgacgcgtactatagtttag

SEQ ID NO: 685534 - DNA, 25 bp, Artificial sequence
  Synthetic oligonucleotide
taagatgacgcgaactatagtttag

SEQ ID NO: 685535 - DNA, 25 bp, Artificial sequence
  Synthetic oligonucleotide
gcgattgacgcgactatattattat

SEQ ID NO: 685536 - DNA, 25 bp, Artificial sequence
  Synthetic oligonucleotide
gcgattgacgcgtctatattattat

SEQ ID NO: 685537 - DNA, 25 bp, Artificial sequence
  Synthetic oligonucleotide
tatttccttgacccgatatcaacat

SEQ ID NO: 685538 - DNA, 25 bp, Artificial sequence
  Synthetic oligonucleotide
tatttccttgacgcgatatcaacat

SEQ ID NO: 685539 - DNA, 25 bp, Artificial sequence
  Synthetic oligonucleotide
atataccttaacgaatcgcttgtac

SEQ ID NO: 685540 - DNA, 25 bp, Artificial sequence
  Synthetic oligonucleotide
ctttctgacgctttatacgatgatt

SEQ ID NO: 685541 - DNA, 25 bp, Artificial sequence
  Synthetic oligonucleotide
gttgaactgacgttcgtataattac

SEQ ID NO: 685542 - DNA, 25 bp, Artificial sequence
  Synthetic oligonucleotide
aggtatgacgttcgcaataaataag

SEQ ID NO: 685543 - DNA, 25 bp, Artificial sequence
  Synthetic oligonucleotide
atatcactcgcgcattaaaactttg

SEQ ID NO: 685544 - DNA, 25 bp, Artificial sequence
  Synthetic oligonucleotide
atatcactcgcggattaaaactttg

SEQ ID NO: 685545 - DNA, 25 bp, Artificial sequence
  Synthetic oligonucleotide
ggattactatatggcgtactaatga

SEQ ID NO: 685546 - DNA, 25 bp, Artificial sequence
  Synthetic oligonucleotide
ggattactatatcgcgtactaatga

SEQ ID NO: 685547 - DNA, 25 bp, Artificial sequence
  Synthetic oligonucleotide
ttttgtctatatggcggaatgaagt

SEQ ID NO: 685548 - DNA, 25 bp, Artificial sequence
  Synthetic oligonucleotide
ttttgtctatatcgcggaatgaagt

SEQ ID NO: 685549 - DNA, 25 bp, Artificial sequence
  Synthetic oligonucleotide
tttttgctataccgttcgaagtaag

SEQ ID NO: 685550 - DNA, 25 bp, Artificial sequence
  Synthetic oligonucleotide
tttttgctatacggttcgaagtaag

SEQ ID NO: 685551 - DNA, 25 bp, Artificial sequence
  Synthetic oligonucleotide
ttttaactatacgcgagtaccaaca

SEQ ID NO: 685552 - DNA, 25 bp, Artificial sequence
  Synthetic oligonucleotide
ttttaactatacccgagtaccaaca

SEQ ID NO: 685553 - DNA, 25 bp, Artificial sequence
  Synthetic oligonucleotide
atataccttaaccaatcgcttgtac

SEQ ID NO: 685554 - DNA, 25 bp, Artificial sequence
  Synthetic oligonucleotide
agagttgcggattatcgtttgataa

SEQ ID NO: 685555 - DNA, 25 bp, Artificial sequence
  Synthetic oligonucleotide
tatttaacgataggtcgtatcacga

SEQ ID NO: 685556 - DNA, 25 bp, Artificial sequence
  Synthetic oligonucleotide
ggatatgcgttgtacgtataatttg

SEQ ID NO: 685557 - DNA, 25 bp, Artificial sequence
  Synthetic oligonucleotide
gtatttattaacgcgctacccataa

SEQ ID NO: 685558 - DNA, 25 bp, Artificial sequence
  Synthetic oligonucleotide
catagagcgttcggttatatttatg

SEQ ID NO: 685559 - DNA, 25 bp, Artificial sequence
  Synthetic oligonucleotide
gtgttagcgttccatactatgataa

SEQ ID NO: 685560 - DNA, 25 bp, Artificial sequence
  Synthetic oligonucleotide
gtgttagcgttcgatactatgataa

SEQ ID NO: 685561 - DNA, 25 bp, Artificial sequence
  Synthetic oligonucleotide
ttgtacgcgttagttcgtataaaga

SEQ ID NO: 685562 - DNA, 25 bp, Artificial sequence
  Synthetic oligonucleotide
ttgtacgcgttacttcgtataaaga

SEQ ID NO: 685563 - DNA, 25 bp, Artificial sequence
  Synthetic oligonucleotide
atatctgcgtaaaatcgagcaatca

SEQ ID NO: 685564 - DNA, 25 bp, Artificial sequence
  Synthetic oligonucleotide
atatctgcgtaatatcgagcaatca

SEQ ID NO: 685565 - DNA, 25 bp, Artificial sequence
  Synthetic oligonucleotide
ctttctgacgctatatacgatgatt

SEQ ID NO: 685566 - DNA, 25 bp, Artificial sequence
  Synthetic oligonucleotide
acgtttgcgtaaccgtatagtataa

SEQ ID NO: 685567 - DNA, 25 bp, Artificial sequence
  Synthetic oligonucleotide
tctgaactaatcggcgtatacaaat

SEQ ID NO: 685568 - DNA, 25 bp, Artificial sequence
  Synthetic oligonucleotide
agagttgcggataatcgtttgataa

SEQ ID NO: 685569 - DNA, 25 bp, Artificial sequence
  Synthetic oligonucleotide
gttattgcgcgtaatgtaaggtaaa

SEQ ID NO: 685570 - DNA, 25 bp, Artificial sequence
  Synthetic oligonucleotide
gttattgcgcgttatgtaaggtaaa

SEQ ID NO: 685571 - DNA, 25 bp, Artificial sequence
  Synthetic oligonucleotide
aaaaatgattcgagcgttacttcac

SEQ ID NO: 685572 - DNA, 25 bp, Artificial sequence
  Synthetic oligonucleotide
aaaaatgattcgtgcgttacttcac

SEQ ID NO: 685573 - DNA, 25 bp, Artificial sequence
  Synthetic oligonucleotide
atttacgatagcgtacgtttcaaag

SEQ ID NO: 685574 - DNA, 25 bp, Artificial sequence
  Synthetic oligonucleotide
atttacgatagcctacgtttcaaag

SEQ ID NO: 685575 - DNA, 25 bp, Artificial sequence
  Synthetic oligonucleotide
agtactgataatacgtcggatctat

SEQ ID NO: 685576 - DNA, 25 bp, Artificial sequence
  Synthetic oligonucleotide
agtactgataattcgtcggatctat

SEQ ID NO: 685577 - DNA, 25 bp, Artificial sequence
  Synthetic oligonucleotide
aggtatgacgttggcaataaataag

SEQ ID NO: 685578 - DNA, 25 bp, Artificial sequence
  Synthetic oligonucleotide
acgtttgcgtaagcgtatagtataa

SEQ ID NO: 685579 - DNA, 25 bp, Artificial sequence
  Synthetic oligonucleotide
acattacgtactcatacgaccattt

SEQ ID NO: 685580 - DNA, 25 bp, Artificial sequence
  Synthetic oligonucleotide
ttcgaacgtccattacgatttatgt

SEQ ID NO: 685581 - DNA, 25 bp, Artificial sequence
  Synthetic oligonucleotide
ttcgaacgtccaatacgatttatgt

SEQ ID NO: 685582 - DNA, 25 bp, Artificial sequence
  Synthetic oligonucleotide
atatagcgtattccgatactagcta

SEQ ID NO: 685583 - DNA, 25 bp, Artificial sequence
  Synthetic oligonucleotide
atatagcgtattgcgatactagcta

SEQ ID NO: 685584 - DNA, 25 bp, Artificial sequence
  Synthetic oligonucleotide
aacgttcgtatctagacgtgttaaa

SEQ ID NO: 685585 - DNA, 25 bp, Artificial sequence
  Synthetic oligonucleotide
aacgttcgtatcaagacgtgttaaa

SEQ ID NO: 685586 - DNA, 25 bp, Artificial sequence
  Synthetic oligonucleotide
acttttcgtatattacgcgttgact

SEQ ID NO: 685587 - DNA, 25 bp, Artificial sequence
  Synthetic oligonucleotide
acttttcgtataatacgcgttgact

SEQ ID NO: 685588 - DNA, 25 bp, Artificial sequence
  Synthetic oligonucleotide
attctacgtataacgcgaatgaatg

SEQ ID NO: 685589 - DNA, 25 bp, Artificial sequence
  Synthetic oligonucleotide
attctacgtatatcgcgaatgaatg

SEQ ID NO: 685590 - DNA, 25 bp, Artificial sequence
  Synthetic oligonucleotide
tccattctagtaaacgtcgtagaaa

SEQ ID NO: 685591 - DNA, 25 bp, Artificial sequence
  Synthetic oligonucleotide
cttattcgtagaactatcgtgttag

SEQ ID NO: 685592 - DNA, 25 bp, Artificial sequence
  Synthetic oligonucleotide
atatagcgtcgatataacgcagatt

SEQ ID NO: 685593 - DNA, 25 bp, Artificial sequence
  Synthetic oligonucleotide
acattacgtactgatacgaccattt

SEQ ID NO: 685594 - DNA, 25 bp, Artificial sequence
  Synthetic oligonucleotide
acgaatcgtactacggatttataga

SEQ ID NO: 685595 - DNA, 25 bp, Artificial sequence
  Synthetic oligonucleotide
acgaatcgtacttcggatttataga

SEQ ID NO: 685596 - DNA, 25 bp, Artificial sequence
  Synthetic oligonucleotide
gttccacgtacggtactaaatatta

SEQ ID NO: 685597 - DNA, 25 bp, Artificial sequence
  Synthetic oligonucleotide
gttccacgtacgctactaaatatta

SEQ ID NO: 685598 - DNA, 25 bp, Artificial sequence
  Synthetic oligonucleotide
taattccgtacattaacgctccaat

SEQ ID NO: 685599 - DNA, 25 bp, Artificial sequence
  Synthetic oligonucleotide
taattccgtacaataacgctccaat

SEQ ID NO: 685600 - DNA, 25 bp, Artificial sequence
  Synthetic oligonucleotide
aggcatcgtaatcactacgtaatta

SEQ ID NO: 685601 - DNA, 25 bp, Artificial sequence
  Synthetic oligonucleotide
aggcatcgtaatgactacgtaatta

SEQ ID NO: 685602 - DNA, 25 bp, Artificial sequence
  Synthetic oligonucleotide
ttcaaccgtaacctcgatagttatt

SEQ ID NO: 685603 - DNA, 25 bp, Artificial sequence
  Synthetic oligonucleotide
cttattcgtagatctatcgtgttag

SEQ ID NO: 685604 - DNA, 25 bp, Artificial sequence
  Synthetic oligonucleotide
atgactcgttagaagcgtaacatat

SEQ ID NO: 685605 - DNA, 25 bp, Artificial sequence
  Synthetic oligonucleotide
ttcaaccgtaacgtcgatagttatt

SEQ ID NO: 685606 - DNA, 25 bp, Artificial sequence
  Synthetic oligonucleotide
tctgaactaatccgcgtatacaaat

SEQ ID NO: 685607 - DNA, 25 bp, Artificial sequence
  Synthetic oligonucleotide
acttagcgtttacgctagtaagtat

SEQ ID NO: 685608 - DNA, 25 bp, Artificial sequence
  Synthetic oligonucleotide
acttagcgtttaggctagtaagtat

SEQ ID NO: 685609 - DNA, 25 bp, Artificial sequence
  Synthetic oligonucleotide
gacaaacgtttatcgcgtatacatt

SEQ ID NO: 685610 - DNA, 25 bp, Artificial sequence
  Synthetic oligonucleotide
gacaaacgtttaacgcgtatacatt

SEQ ID NO: 685611 - DNA, 25 bp, Artificial sequence
  Synthetic oligonucleotide
gatacacgttcgagtatagttcaaa

SEQ ID NO: 685612 - DNA, 25 bp, Artificial sequence
  Synthetic oligonucleotide
gatacacgttcgtgtatagttcaaa

SEQ ID NO: 685613 - DNA, 25 bp, Artificial sequence
  Synthetic oligonucleotide
tggttacgttattgtacgctatgtt

SEQ ID NO: 685614 - DNA, 25 bp, Artificial sequence
  Synthetic oligonucleotide
tggttacgttatagtacgctatgtt

SEQ ID NO: 685615 - DNA, 25 bp, Artificial sequence
  Synthetic oligonucleotide
tccatacgtcgattatacgaacatt

SEQ ID NO: 685616 - DNA, 25 bp, Artificial sequence
  Synthetic oligonucleotide
ttagatcgttatactcgagaggtaa

SEQ ID NO: 685617 - DNA, 25 bp, Artificial sequence
  Synthetic oligonucleotide
tccatacgtcgaatatacgaacatt

SEQ ID NO: 685618 - DNA, 25 bp, Artificial sequence
  Synthetic oligonucleotide
atgactcgttagtagcgtaacatat

SEQ ID NO: 685619 - DNA, 25 bp, Artificial sequence
  Synthetic oligonucleotide
ctggatcgttacccgattatttaat

SEQ ID NO: 685620 - DNA, 25 bp, Artificial sequence
  Synthetic oligonucleotide
ctggatcgttacgcgattatttaat

SEQ ID NO: 685621 - DNA, 25 bp, Artificial sequence
  Synthetic oligonucleotide
gacaatcgttaagtagtcgttaatc

SEQ ID NO: 685622 - DNA, 25 bp, Artificial sequence
  Synthetic oligonucleotide
gacaatcgttaactagtcgttaatc

SEQ ID NO: 685623 - DNA, 25 bp, Artificial sequence
  Synthetic oligonucleotide
gtattacgtgtatagtcgaagatct

SEQ ID NO: 685624 - DNA, 25 bp, Artificial sequence
  Synthetic oligonucleotide
gtattacgtgtaaagtcgaagatct

SEQ ID NO: 685625 - DNA, 25 bp, Artificial sequence
  Synthetic oligonucleotide
caacaccgtcggagtattataaaat

SEQ ID NO: 685626 - DNA, 25 bp, Artificial sequence
  Synthetic oligonucleotide
caacaccgtcggtgtattataaaat

SEQ ID NO: 685627 - DNA, 25 bp, Artificial sequence
  Synthetic oligonucleotide
atatagcgtcgaaataacgcagatt

SEQ ID NO: 685628 - DNA, 25 bp, Artificial sequence
  Synthetic oligonucleotide
tccattctagtatacgtcgtagaaa

SEQ ID NO: 685629 - DNA, 25 bp, Artificial sequence
  Synthetic oligonucleotide
ttagatcgttattctcgagaggtaa

SEQ ID NO: 685630 - DNA, 25 bp, Artificial sequence
  Synthetic oligonucleotide
ttacagtcgatatccgttagtttct

SEQ ID NO: 685631 - DNA, 25 bp, Artificial sequence
  Synthetic oligonucleotide
taacaatatcgacgtactagatagc

SEQ ID NO: 685632 - DNA, 25 bp, Artificial sequence
  Synthetic oligonucleotide
gctaacttacgccttactaaaagat

SEQ ID NO: 685633 - DNA, 25 bp, Artificial sequence
  Synthetic oligonucleotide
gctaacttacgcgttactaaaagat

SEQ ID NO: 685634 - DNA, 25 bp, Artificial sequence
  Synthetic oligonucleotide
ttgaagttacgcggataatcatatg

SEQ ID NO: 685635 - DNA, 25 bp, Artificial sequence
  Synthetic oligonucleotide
ttgaagttacgccgataatcatatg

SEQ ID NO: 685636 - DNA, 25 bp, Artificial sequence
  Synthetic oligonucleotide
atctcttgtattaacgcgatgaaga

SEQ ID NO: 685637 - DNA, 25 bp, Artificial sequence
  Synthetic oligonucleotide
atctcttgtatttacgcgatgaaga

SEQ ID NO: 685638 - DNA, 25 bp, Artificial sequence
  Synthetic oligonucleotide
ttaaattcttacgcgtattgaccgt

SEQ ID NO: 685639 - DNA, 25 bp, Artificial sequence
  Synthetic oligonucleotide
ttaaattcttacccgtattgaccgt

SEQ ID NO: 685640 - DNA, 25 bp, Artificial sequence
  Synthetic oligonucleotide
ctgatatcgtattacgatgacactt

SEQ ID NO: 685641 - DNA, 25 bp, Artificial sequence
  Synthetic oligonucleotide
aggctattatcgttctacgaacatt

SEQ ID NO: 685642 - DNA, 25 bp, Artificial sequence
  Synthetic oligonucleotide
ttacagtcgataaccgttagtttct

SEQ ID NO: 685643 - DNA, 25 bp, Artificial sequence
  Synthetic oligonucleotide
ttctgattcgcgtctatatcatagt

SEQ ID NO: 685644 - DNA, 25 bp, Artificial sequence
  Synthetic oligonucleotide
acagcttatgtcgaacgtaacaatt

SEQ ID NO: 685645 - DNA, 25 bp, Artificial sequence
  Synthetic oligonucleotide
acagcttatgtccaacgtaacaatt

SEQ ID NO: 685646 - DNA, 25 bp, Artificial sequence
  Synthetic oligonucleotide
tcgtaatatgcgataacgacatact

SEQ ID NO: 685647 - DNA, 25 bp, Artificial sequence
  Synthetic oligonucleotide
tcgtaatatgcgttaacgacatact

SEQ ID NO: 685648 - DNA, 25 bp, Artificial sequence
  Synthetic oligonucleotide
tgtgattatcgtcgtaagtatcaac

SEQ ID NO: 685649 - DNA, 25 bp, Artificial sequence
  Synthetic oligonucleotide
tgtgattatcgtggtaagtatcaac

SEQ ID NO: 685650 - DNA, 25 bp, Artificial sequence
  Synthetic oligonucleotide
aggttatatcggtcgtaatctacaa

SEQ ID NO: 685651 - DNA, 25 bp, Artificial sequence
  Synthetic oligonucleotide
aggttatatcggacgtaatctacaa

SEQ ID NO: 685652 - DNA, 25 bp, Artificial sequence
  Synthetic oligonucleotide
aaccagtatcggatcgttaatgtta

SEQ ID NO: 685653 - DNA, 25 bp, Artificial sequence
  Synthetic oligonucleotide
atttagacgagtcgactatagaaca

SEQ ID NO: 685654 - DNA, 25 bp, Artificial sequence
  Synthetic oligonucleotide
ctgatatcgtataacgatgacactt

SEQ ID NO: 685655 - DNA, 25 bp, Artificial sequence
  Synthetic oligonucleotide
aaagataagcgtttatcggcgaatt

SEQ ID NO: 685656 - DNA, 25 bp, Artificial sequence
  Synthetic oligonucleotide
aacagaacgcgataacgttatagta

SEQ ID NO: 685657 - DNA, 25 bp, Artificial sequence
  Synthetic oligonucleotide
aatgtaacgaggcgtaataaatcag

SEQ ID NO: 685658 - DNA, 25 bp, Artificial sequence
  Synthetic oligonucleotide
cttactacgaacctcgttaattcat

SEQ ID NO: 685659 - DNA, 25 bp, Artificial sequence
  Synthetic oligonucleotide
cttactacgaacgtcgttaattcat

SEQ ID NO: 685660 - DNA, 25 bp, Artificial sequence
  Synthetic oligonucleotide
caaagtacctcgacgtatttaaaca

SEQ ID NO: 685661 - DNA, 25 bp, Artificial sequence
  Synthetic oligonucleotide
caaagtacctcgtcgtatttaaaca

SEQ ID NO: 685662 - DNA, 25 bp, Artificial sequence
  Synthetic oligonucleotide
atttttaatcgcggagtatgctatc

SEQ ID NO: 685663 - DNA, 25 bp, Artificial sequence
  Synthetic oligonucleotide
atttttaatcgccgagtatgctatc

SEQ ID NO: 685664 - DNA, 25 bp, Artificial sequence
  Synthetic oligonucleotide
aaagccaatcgccttacgaatattt

SEQ ID NO: 685665 - DNA, 25 bp, Artificial sequence
  Synthetic oligonucleotide
aaagccaatcgcgttacgaatattt

SEQ ID NO: 685666 - DNA, 25 bp, Artificial sequence
  Synthetic oligonucleotide
aggctattatcgatctacgaacatt

SEQ ID NO: 685667 - DNA, 25 bp, Artificial sequence
  Synthetic oligonucleotide
acgtataatatcgttcgcgttttgt

SEQ ID NO: 685668 - DNA, 25 bp, Artificial sequence
  Synthetic oligonucleotide
taacaatatcgaggtactagatagc

SEQ ID NO: 685669 - DNA, 25 bp, Artificial sequence
  Synthetic oligonucleotide
aaagataagcgtatatcggcgaatt

SEQ ID NO: 685670 - DNA, 25 bp, Artificial sequence
  Synthetic oligonucleotide
cttatgaacttactcgcgagtaaat

SEQ ID NO: 685671 - DNA, 25 bp, Artificial sequence
  Synthetic oligonucleotide
cttatgaacttagtcgcgagtaaat

SEQ ID NO: 685672 - DNA, 25 bp, Artificial sequence
  Synthetic oligonucleotide
tactaaaacgttcgaacgatcgata

SEQ ID NO: 685673 - DNA, 25 bp, Artificial sequence
  Synthetic oligonucleotide
tactaaaacgttggaacgatcgata

SEQ ID NO: 685674 - DNA, 25 bp, Artificial sequence
  Synthetic oligonucleotide
gttttaaacgatacgacctcattag

SEQ ID NO: 685675 - DNA, 25 bp, Artificial sequence
  Synthetic oligonucleotide
gttttaaacgattcgacctcattag

SEQ ID NO: 685676 - DNA, 25 bp, Artificial sequence
  Synthetic oligonucleotide
ttgactttcgcgttaatacatacac

SEQ ID NO: 685677 - DNA, 25 bp, Artificial sequence
  Synthetic oligonucleotide
ttgactttcgcgataatacatacac

SEQ ID NO: 685678 - DNA, 25 bp, Artificial sequence
  Synthetic oligonucleotide
ttctgattcgcgactatatcatagt

SEQ ID NO: 685679 - DNA, 25 bp, Artificial sequence
  Synthetic oligonucleotide
acgtataatatccttcgcgttttgt

SEQ ID NO: 685680 - DNA, 25 bp, Artificial sequence
  Synthetic oligonucleotide
aacaatcgaatttgtcgtaggttca

SEQ ID NO: 685681 - DNA, 25 bp, Artificial sequence
  Synthetic oligonucleotide
aaccagtatcggttcgttaatgtta

SEQ ID NO: 685682 - DNA, 25 bp, Artificial sequence
  Synthetic oligonucleotide
agcgatcgtccgttataatcattta

SEQ ID NO: 685683 - DNA, 25 bp, Artificial sequence
  Synthetic oligonucleotide
agcgatcgtccgatataatcattta

SEQ ID NO: 685684 - DNA, 25 bp, Artificial sequence
  Synthetic oligonucleotide
gtacaccggtaatcgtataagtata

SEQ ID NO: 685685 - DNA, 25 bp, Artificial sequence
  Synthetic oligonucleotide
gtacaccggtaaacgtataagtata

SEQ ID NO: 685686 - DNA, 25 bp, Artificial sequence
  Synthetic oligonucleotide
aagtgacgcgtattacttatcttct

SEQ ID NO: 685687 - DNA, 25 bp, Artificial sequence
  Synthetic oligonucleotide
aagtgacgcgtaatacttatcttct

SEQ ID NO: 685688 - DNA, 25 bp, Artificial sequence
  Synthetic oligonucleotide
attatacgcgtattaagtacgcgtt

SEQ ID NO: 685689 - DNA, 25 bp, Artificial sequence
  Synthetic oligonucleotide
attatacgcgtaataagtacgcgtt

SEQ ID NO: 685690 - DNA, 25 bp, Artificial sequence
  Synthetic oligonucleotide
cagtttcgcgaactataatgcataa

SEQ ID NO: 685691 - DNA, 25 bp, Artificial sequence
  Synthetic oligonucleotide
gaaggactattcgtaacgtcatatt

SEQ ID NO: 685692 - DNA, 25 bp, Artificial sequence
  Synthetic oligonucleotide
aacaatcgaattagtcgtaggttca

SEQ ID NO: 685693 - DNA, 25 bp, Artificial sequence
  Synthetic oligonucleotide
atagatgtcgaaacgtatacgttct

SEQ ID NO: 685694 - DNA, 25 bp, Artificial sequence
  Synthetic oligonucleotide
tgatggcgaataacggttaaagaaa

SEQ ID NO: 685695 - DNA, 25 bp, Artificial sequence
  Synthetic oligonucleotide
tgatggcgaatatcggttaaagaaa

SEQ ID NO: 685696 - DNA, 25 bp, Artificial sequence
  Synthetic oligonucleotide
ttacaaattacgggtactagaaagg

SEQ ID NO: 685697 - DNA, 25 bp, Artificial sequence
  Synthetic oligonucleotide
ttacaaattacgcgtactagaaagg

SEQ ID NO: 685698 - DNA, 25 bp, Artificial sequence
  Synthetic oligonucleotide
tagagtattacgaccgataagctta

SEQ ID NO: 685699 - DNA, 25 bp, Artificial sequence
  Synthetic oligonucleotide
tagagtattacgtccgataagctta

SEQ ID NO: 685700 - DNA, 25 bp, Artificial sequence
  Synthetic oligonucleotide
aatcgtatacgccactaaaagtgtt

SEQ ID NO: 685701 - DNA, 25 bp, Artificial sequence
  Synthetic oligonucleotide
aatcgtatacgcgactaaaagtgtt

SEQ ID NO: 685702 - DNA, 25 bp, Artificial sequence
  Synthetic oligonucleotide
tgagtgaatacgggatgtaagttat

SEQ ID NO: 685703 - DNA, 25 bp, Artificial sequence
  Synthetic oligonucleotide
tgagtgaatacgcgatgtaagttat

SEQ ID NO: 685704 - DNA, 25 bp, Artificial sequence
  Synthetic oligonucleotide
cagtttcgcgaagtataatgcataa

SEQ ID NO: 685705 - DNA, 25 bp, Artificial sequence
  Synthetic oligonucleotide
agaaaatacgatttcgtaccgtgaa

SEQ ID NO: 685706 - DNA, 25 bp, Artificial sequence
  Synthetic oligonucleotide
atgggatagtatttcgacgaactta

SEQ ID NO: 685707 - DNA, 25 bp, Artificial sequence
  Synthetic oligonucleotide
atgggatagtatatcgacgaactta

SEQ ID NO: 685708 - DNA, 25 bp, Artificial sequence
  Synthetic oligonucleotide
attagctagtacccgttaagctatt

SEQ ID NO: 685709 - DNA, 25 bp, Artificial sequence
  Synthetic oligonucleotide
attagctagtacgcgttaagctatt

SEQ ID NO: 685710 - DNA, 25 bp, Artificial sequence
  Synthetic oligonucleotide
tatgtctagtaaatcgacgtcctta

SEQ ID NO: 685711 - DNA, 25 bp, Artificial sequence
  Synthetic oligonucleotide
tatgtctagtaattcgacgtcctta

SEQ ID NO: 685712 - DNA, 25 bp, Artificial sequence
  Synthetic oligonucleotide
ggatcctacttaatacgcgataata

SEQ ID NO: 685713 - DNA, 25 bp, Artificial sequence
  Synthetic oligonucleotide
ggatcctacttattacgcgataata

SEQ ID NO: 685714 - DNA, 25 bp, Artificial sequence
  Synthetic oligonucleotide
ttagaatacgtcgatacatcgtaac

SEQ ID NO: 685715 - DNA, 25 bp, Artificial sequence
  Synthetic oligonucleotide
ttagaatacgtccatacatcgtaac

SEQ ID NO: 685716 - DNA, 25 bp, Artificial sequence
  Synthetic oligonucleotide
gaaggactattcctaacgtcatatt

SEQ ID NO: 685717 - DNA, 25 bp, Artificial sequence
  Synthetic oligonucleotide
gtgtcttacgcgtattaagttctat

SEQ ID NO: 685718 - DNA, 25 bp, Artificial sequence
  Synthetic oligonucleotide
atttagacgagtggactatagaaca

SEQ ID NO: 685719 - DNA, 25 bp, Artificial sequence
  Synthetic oligonucleotide
agaaaatacgatatcgtaccgtgaa

SEQ ID NO: 685720 - DNA, 25 bp, Artificial sequence
  Synthetic oligonucleotide
gtacactaccgatcgtataattaac

SEQ ID NO: 685721 - DNA, 25 bp, Artificial sequence
  Synthetic oligonucleotide
gtacactaccgaacgtataattaac

SEQ ID NO: 685722 - DNA, 25 bp, Artificial sequence
  Synthetic oligonucleotide
ttaacttaattactcgcgagcaaac

SEQ ID NO: 685723 - DNA, 25 bp, Artificial sequence
  Synthetic oligonucleotide
ttaacttaattagtcgcgagcaaac

SEQ ID NO: 685724 - DNA, 25 bp, Artificial sequence
  Synthetic oligonucleotide
tgaaaataatccctcgtataccgtt

SEQ ID NO: 685725 - DNA, 25 bp, Artificial sequence
  Synthetic oligonucleotide
tgaaaataatccgtcgtataccgtt

SEQ ID NO: 685726 - DNA, 25 bp, Artificial sequence
  Synthetic oligonucleotide
ttcaaggtcgacctaattaccatta

SEQ ID NO: 685727 - DNA, 25 bp, Artificial sequence
  Synthetic oligonucleotide
ttcaaggtcgacgtaattaccatta

SEQ ID NO: 685728 - DNA, 25 bp, Artificial sequence
  Synthetic oligonucleotide
atagatgtcgaatcgtatacgttct

SEQ ID NO: 685729 - DNA, 25 bp, Artificial sequence
  Synthetic oligonucleotide
gtgtcttacgcgaattaagttctat

SEQ ID NO: 685730 - DNA, 25 bp, Artificial sequence
  Synthetic oligonucleotide
aatttgataccgatcgtacctttga

SEQ ID NO: 685731 - DNA, 25 bp, Artificial sequence
  Synthetic oligonucleotide
aaaaacataatacgcgtcgcaatag

SEQ ID NO: 685732 - DNA, 25 bp, Artificial sequence
  Synthetic oligonucleotide
ataagaatacgtgtcggatcgttta

SEQ ID NO: 685733 - DNA, 25 bp, Artificial sequence
  Synthetic oligonucleotide
ataagaatacgtctcggatcgttta

SEQ ID NO: 685734 - DNA, 25 bp, Artificial sequence
  Synthetic oligonucleotide
aggaatatacgtcgaggtacattta

SEQ ID NO: 685735 - DNA, 25 bp, Artificial sequence
  Synthetic oligonucleotide
aggaatatacgtggaggtacattta

SEQ ID NO: 685736 - DNA, 25 bp, Artificial sequence
  Synthetic oligonucleotide
aaaaatatacgtatgaccgacccta

SEQ ID NO: 685737 - DNA, 25 bp, Artificial sequence
  Synthetic oligonucleotide
aaaaatatacgtttgaccgacccta

SEQ ID NO: 685738 - DNA, 25 bp, Artificial sequence
  Synthetic oligonucleotide
tgtataatacgcctcgtaaacagat

SEQ ID NO: 685739 - DNA, 25 bp, Artificial sequence
  Synthetic oligonucleotide
tgtataatacgcgtcgtaaacagat

SEQ ID NO: 685740 - DNA, 25 bp, Artificial sequence
  Synthetic oligonucleotide
aatacaatacgcgtcattggcaaaa

SEQ ID NO: 685741 - DNA, 25 bp, Artificial sequence
  Synthetic oligonucleotide
aattatatactaggcgttggccaat

SEQ ID NO: 685742 - DNA, 25 bp, Artificial sequence
  Synthetic oligonucleotide
aatttgataccgttcgtacctttga

SEQ ID NO: 685743 - DNA, 25 bp, Artificial sequence
  Synthetic oligonucleotide
aatacaataggttacgcgttgttac

SEQ ID NO: 685744 - DNA, 25 bp, Artificial sequence
  Synthetic oligonucleotide
agatctatacccgatcgttttcata

SEQ ID NO: 685745 - DNA, 25 bp, Artificial sequence
  Synthetic oligonucleotide
agatctataccccatcgttttcata

SEQ ID NO: 685746 - DNA, 25 bp, Artificial sequence
  Synthetic oligonucleotide
accataatacagggcgataaataag

SEQ ID NO: 685747 - DNA, 25 bp, Artificial sequence
  Synthetic oligonucleotide
accataatacagcgcgataaataag

SEQ ID NO: 685748 - DNA, 25 bp, Artificial sequence
  Synthetic oligonucleotide
tttcacataatgcgcgctataaaca

SEQ ID NO: 685749 - DNA, 25 bp, Artificial sequence
  Synthetic oligonucleotide
tttcacataatgggcgctataaaca

SEQ ID NO: 685750 - DNA, 25 bp, Artificial sequence
  Synthetic oligonucleotide
gcaattataatcctacgcgaataga

SEQ ID NO: 685751 - DNA, 25 bp, Artificial sequence
  Synthetic oligonucleotide
gcaattataatcgtacgcgaataga

SEQ ID NO: 685752 - DNA, 25 bp, Artificial sequence
  Synthetic oligonucleotide
agtataataatccgtcgtgttatgg

SEQ ID NO: 685753 - DNA, 25 bp, Artificial sequence
  Synthetic oligonucleotide
aatgtaacgaggggtaataaatcag

SEQ ID NO: 685754 - DNA, 25 bp, Artificial sequence
  Synthetic oligonucleotide
aatacaatacgcctcattggcaaaa

SEQ ID NO: 685755 - DNA, 25 bp, Artificial sequence
  Synthetic oligonucleotide
tactttatattgggacgtctgattc

SEQ ID NO: 685756 - DNA, 25 bp, Artificial sequence
  Synthetic oligonucleotide
tggtttatcgttcgcgatatttttc

SEQ ID NO: 685757 - DNA, 25 bp, Artificial sequence
  Synthetic oligonucleotide
tggtttatcgttggcgatatttttc

SEQ ID NO: 685758 - DNA, 25 bp, Artificial sequence
  Synthetic oligonucleotide
ctaattatcgtaaagtccggtttga

SEQ ID NO: 685759 - DNA, 25 bp, Artificial sequence
  Synthetic oligonucleotide
ctaattatcgtatagtccggtttga

SEQ ID NO: 685760 - DNA, 25 bp, Artificial sequence
  Synthetic oligonucleotide
atctacatcgtacgtcgttagttat

SEQ ID NO: 685761 - DNA, 25 bp, Artificial sequence
  Synthetic oligonucleotide
atctacatcgtaggtcgttagttat

SEQ ID NO: 685762 - DNA, 25 bp, Artificial sequence
  Synthetic oligonucleotide
tcctatatcgtaccgtagaagaatt

SEQ ID NO: 685763 - DNA, 25 bp, Artificial sequence
  Synthetic oligonucleotide
tcctatatcgtagcgtagaagaatt

SEQ ID NO: 685764 - DNA, 25 bp, Artificial sequence
  Synthetic oligonucleotide
gatctaatcgtatttcgggtatgta

SEQ ID NO: 685765 - DNA, 25 bp, Artificial sequence
  Synthetic oligonucleotide
gatctaatcgtaattcgggtatgta

SEQ ID NO: 685766 - DNA, 25 bp, Artificial sequence
  Synthetic oligonucleotide
aattatatactacgcgttggccaat

SEQ ID NO: 685767 - DNA, 25 bp, Artificial sequence
  Synthetic oligonucleotide
cttaatatcgcgtaaacgtaatacg

SEQ ID NO: 685768 - DNA, 25 bp, Artificial sequence
  Synthetic oligonucleotide
aaaaacataataggcgtcgcaatag

SEQ ID NO: 685769 - DNA, 25 bp, Artificial sequence
  Synthetic oligonucleotide
tactttatattgcgacgtctgattc

SEQ ID NO: 685770 - DNA, 25 bp, Artificial sequence
  Synthetic oligonucleotide
atatacatatgttcgagcgagaaag

SEQ ID NO: 685771 - DNA, 25 bp, Artificial sequence
  Synthetic oligonucleotide
atatacatatgtacgagcgagaaag

SEQ ID NO: 685772 - DNA, 25 bp, Artificial sequence
  Synthetic oligonucleotide
atagatatatacggctacgctgaat

SEQ ID NO: 685773 - DNA, 25 bp, Artificial sequence
  Synthetic oligonucleotide
atagatatataccgctacgctgaat

SEQ ID NO: 685774 - DNA, 25 bp, Artificial sequence
  Synthetic oligonucleotide
ataaggatagtaaacgcgcaaatag

SEQ ID NO: 685775 - DNA, 25 bp, Artificial sequence
  Synthetic oligonucleotide
ataaggatagtatacgcgcaaatag

SEQ ID NO: 685776 - DNA, 25 bp, Artificial sequence
  Synthetic oligonucleotide
cgatatatagtaaaccgcgttatgt

SEQ ID NO: 685777 - DNA, 25 bp, Artificial sequence
  Synthetic oligonucleotide
cgatatatagtataccgcgttatgt

SEQ ID NO: 685778 - DNA, 25 bp, Artificial sequence
  Synthetic oligonucleotide
aatacaataggtaacgcgttgttac

SEQ ID NO: 685779 - DNA, 25 bp, Artificial sequence
  Synthetic oligonucleotide
cttaatatcgcgaaaacgtaatacg

SEQ ID NO: 685780 - DNA, 25 bp, Artificial sequence
  Synthetic oligonucleotide
gttactacggcgaattatcgtttta

SEQ ID NO: 685781 - DNA, 25 bp, Artificial sequence
  Synthetic oligonucleotide
agtataataatcggtcgtgttatgg

SEQ ID NO: 685782 - DNA, 25 bp, Artificial sequence
  Synthetic oligonucleotide
aaagctactaatgcgacgtatatct

SEQ ID NO: 685783 - DNA, 25 bp, Artificial sequence
  Synthetic oligonucleotide
aaagctactaatccgacgtatatct

SEQ ID NO: 685784 - DNA, 25 bp, Artificial sequence
  Synthetic oligonucleotide
aaagtaacgttaatcgtcgattcca

SEQ ID NO: 685785 - DNA, 25 bp, Artificial sequence
  Synthetic oligonucleotide
aaagtaacgttattcgtcgattcca

SEQ ID NO: 685786 - DNA, 25 bp, Artificial sequence
  Synthetic oligonucleotide
tatcgaacgttatcgcgtaagatat

SEQ ID NO: 685787 - DNA, 25 bp, Artificial sequence
  Synthetic oligonucleotide
tatcgaacgttaacgcgtaagatat

SEQ ID NO: 685788 - DNA, 25 bp, Artificial sequence
  Synthetic oligonucleotide
cagttaacgttaacgcgttatatag

SEQ ID NO: 685789 - DNA, 25 bp, Artificial sequence
  Synthetic oligonucleotide
cagttaacgttatcgcgttatatag

SEQ ID NO: 685790 - DNA, 25 bp, Artificial sequence
  Synthetic oligonucleotide
atttatacgtctagatacggtacga

SEQ ID NO: 685791 - DNA, 25 bp, Artificial sequence
  Synthetic oligonucleotide
tagaatactatcctaacggactctt

SEQ ID NO: 685792 - DNA, 25 bp, Artificial sequence
  Synthetic oligonucleotide
gttactacggcgtattatcgtttta

SEQ ID NO: 685793 - DNA, 25 bp, Artificial sequence
  Synthetic oligonucleotide
caaattactattacgcgctaaatcc

SEQ ID NO: 685794 - DNA, 25 bp, Artificial sequence
  Synthetic oligonucleotide
tagaagacggacgtaattctttgta

SEQ ID NO: 685795 - DNA, 25 bp, Artificial sequence
  Synthetic oligonucleotide
tagaagacggacctaattctttgta

SEQ ID NO: 685796 - DNA, 25 bp, Artificial sequence
  Synthetic oligonucleotide
tttgacacgctatattcggacttaa

SEQ ID NO: 685797 - DNA, 25 bp, Artificial sequence
  Synthetic oligonucleotide
tttgacacgctaaattcggacttaa

SEQ ID NO: 685798 - DNA, 25 bp, Artificial sequence
  Synthetic oligonucleotide
taaatcacgcgttatctagtatgca

SEQ ID NO: 685799 - DNA, 25 bp, Artificial sequence
  Synthetic oligonucleotide
taaatcacgcgtaatctagtatgca

SEQ ID NO: 685800 - DNA, 25 bp, Artificial sequence
  Synthetic oligonucleotide
tgaattacgcgaatacgtttttgtc

SEQ ID NO: 685801 - DNA, 25 bp, Artificial sequence
  Synthetic oligonucleotide
tgaattacgcgattacgtttttgtc

SEQ ID NO: 685802 - DNA, 25 bp, Artificial sequence
  Synthetic oligonucleotide
aacagaacgcgaaaacgttatagta

SEQ ID NO: 685803 - DNA, 25 bp, Artificial sequence
  Synthetic oligonucleotide
tatttaacgatacgtcgtatcacga

SEQ ID NO: 685804 - DNA, 25 bp, Artificial sequence
  Synthetic oligonucleotide
atttatacgtcttgatacggtacga

SEQ ID NO: 685805 - DNA, 25 bp, Artificial sequence
  Synthetic oligonucleotide
ttactaaggtcgattcgtagttctt

SEQ ID NO: 685806 - DNA, 25 bp, Artificial sequence
  Synthetic oligonucleotide
taatggataagtttcgcgcactaaa

SEQ ID NO: 685807 - DNA, 25 bp, Artificial sequence
  Synthetic oligonucleotide
taatggataagtatcgcgcactaaa

SEQ ID NO: 685808 - DNA, 25 bp, Artificial sequence
  Synthetic oligonucleotide
ttatcaagtatagtcgcgaaagaag

SEQ ID NO: 685809 - DNA, 25 bp, Artificial sequence
  Synthetic oligonucleotide
ttatcaagtatactcgcgaaagaag

SEQ ID NO: 685810 - DNA, 25 bp, Artificial sequence
  Synthetic oligonucleotide
tacataagtacggtcgtaagttgtt

SEQ ID NO: 685811 - DNA, 25 bp, Artificial sequence
  Synthetic oligonucleotide
tacataagtacgctcgtaagttgtt

SEQ ID NO: 685812 - DNA, 25 bp, Artificial sequence
  Synthetic oligonucleotide
agtacaagtacgttttgcgttactt

SEQ ID NO: 685813 - DNA, 25 bp, Artificial sequence
  Synthetic oligonucleotide
agtacaagtacgatttgcgttactt

SEQ ID NO: 685814 - DNA, 25 bp, Artificial sequence
  Synthetic oligonucleotide
taaaggaggtcgtatcgttaattct

SEQ ID NO: 685815 - DNA, 25 bp, Artificial sequence
  Synthetic oligonucleotide
taaaggaggtcgaatcgttaattct

SEQ ID NO: 685816 - DNA, 25 bp, Artificial sequence
  Synthetic oligonucleotide
tagaatactatcgtaacggactctt

SEQ ID NO: 685817 - DNA, 25 bp, Artificial sequence
  Synthetic oligonucleotide
caaaataggtcgaaatacgcatcat

SEQ ID NO: 685818 - DNA, 25 bp, Artificial sequence
  Synthetic oligonucleotide
gtatttattaacccgctacccataa

SEQ ID NO: 685819 - DNA, 25 bp, Artificial sequence
  Synthetic oligonucleotide
ttactaaggtcgtttcgtagttctt

SEQ ID NO: 685820 - DNA, 25 bp, Artificial sequence
  Synthetic oligonucleotide
tataggaggcgacgtatatagttta

SEQ ID NO: 685821 - DNA, 25 bp, Artificial sequence
  Synthetic oligonucleotide
tataggaggcgaggtatatagttta

SEQ ID NO: 685822 - DNA, 25 bp, Artificial sequence
  Synthetic oligonucleotide
aagagtagctcgcgtattagaaatt

SEQ ID NO: 685823 - DNA, 25 bp, Artificial sequence
  Synthetic oligonucleotide
aagagtagctcgggtattagaaatt

SEQ ID NO: 685824 - DNA, 25 bp, Artificial sequence
  Synthetic oligonucleotide
gttaagagcgtcaatacgagaaatt

SEQ ID NO: 685825 - DNA, 25 bp, Artificial sequence
  Synthetic oligonucleotide
gttaagagcgtctatacgagaaatt

SEQ ID NO: 685826 - DNA, 25 bp, Artificial sequence
  Synthetic oligonucleotide
cgtgaaagattatcgcacgaataat

SEQ ID NO: 685827 - DNA, 25 bp, Artificial sequence
  Synthetic oligonucleotide
cgtgaaagattaacgcacgaataat

SEQ ID NO: 685828 - DNA, 25 bp, Artificial sequence
  Synthetic oligonucleotide
caaattactatttcgcgctaaatcc

SEQ ID NO: 685829 - DNA, 25 bp, Artificial sequence
  Synthetic oligonucleotide
caaaataggtcgtaatacgcatcat

SEQ ID NO: 685830 - DNA, 25 bp, Artificial sequence
  Synthetic oligonucleotide
tattggcgcgccacggcttctcgat

SEQ ID NO: 685831 - DNA, 25 bp, Artificial sequence
  Synthetic oligonucleotide
aaagtagagcacctcgccgagatga

SEQ ID NO: 685832 - DNA, 25 bp, Artificial sequence
  Synthetic oligonucleotide
cgaaaacgggaggatctgttccttg

SEQ ID NO: 685833 - DNA, 25 bp, Artificial sequence
  Synthetic oligonucleotide
gacgctttgaccgttccgaaagagg

SEQ ID NO: 685834 - DNA, 25 bp, Artificial sequence
  Synthetic oligonucleotide
gaacagctcgcgcttcatttccctc

SEQ ID NO: 685835 - DNA, 25 bp, Artificial sequence
  Synthetic oligonucleotide
gaacagctcgcggttcatttccctc

SEQ ID NO: 685836 - DNA, 25 bp, Artificial sequence
  Synthetic oligonucleotide
gtcatgaccgaaaaaggaaagggag

SEQ ID NO: 685837 - DNA, 25 bp, Artificial sequence
  Synthetic oligonucleotide
gtcatgaccgaataaggaaagggag

SEQ ID NO: 685838 - DNA, 25 bp, Artificial sequence
  Synthetic oligonucleotide
gagcgaaatcctatatatcaagtaa

SEQ ID NO: 685839 - DNA, 25 bp, Artificial sequence
  Synthetic oligonucleotide
ggaacggctctcagcggagcaggcc

SEQ ID NO: 685840 - DNA, 25 bp, Artificial sequence
  Synthetic oligonucleotide
gagcgaaatcctttatatcaagtaa

SEQ ID NO: 685841 - DNA, 25 bp, Artificial sequence
  Synthetic oligonucleotide
aaagtagagcacgtcgccgagatga

SEQ ID NO: 685842 - DNA, 25 bp, Artificial sequence
  Synthetic oligonucleotide
cagccgtaccggccgatgcttgtgc

SEQ ID NO: 685843 - DNA, 25 bp, Artificial sequence
  Synthetic oligonucleotide
cagccgtaccgggcgatgcttgtgc

SEQ ID NO: 685844 - DNA, 25 bp, Artificial sequence
  Synthetic oligonucleotide
cttgtcgggaaattcatgaagaagg

SEQ ID NO: 685845 - DNA, 25 bp, Artificial sequence
  Synthetic oligonucleotide
cttgtcgggaaaatcatgaagaagg

SEQ ID NO: 685846 - DNA, 25 bp, Artificial sequence
  Synthetic oligonucleotide
atcctcattgctccgatcatgtcca

SEQ ID NO: 685847 - DNA, 25 bp, Artificial sequence
  Synthetic oligonucleotide
ggaacggctctctgcggagcaggcc

SEQ ID NO: 685848 - DNA, 25 bp, Artificial sequence
  Synthetic oligonucleotide
aaaagctgataagcgcagacgacat

SEQ ID NO: 685849 - DNA, 25 bp, Artificial sequence
  Synthetic oligonucleotide
tgaagacagcatccttgaatatgta

SEQ ID NO: 685850 - DNA, 25 bp, Artificial sequence
  Synthetic oligonucleotide
agaaagattcgtatacatcaaatat

SEQ ID NO: 685851 - DNA, 25 bp, Artificial sequence
  Synthetic oligonucleotide
agaaagattcgtttacatcaaatat

SEQ ID NO: 685852 - DNA, 25 bp, Artificial sequence
  Synthetic oligonucleotide
cccgtgccgcatatgtaaaatcaca

SEQ ID NO: 685853 - DNA, 25 bp, Artificial sequence
  Synthetic oligonucleotide
cccgtgccgcatttgtaaaatcaca

SEQ ID NO: 685854 - DNA, 25 bp, Artificial sequence
  Synthetic oligonucleotide
tctctgtgaccgttcctcaatacgc

SEQ ID NO: 685855 - DNA, 25 bp, Artificial sequence
  Synthetic oligonucleotide
gacgctttgacccttccgaaagagg

SEQ ID NO: 685856 - DNA, 25 bp, Artificial sequence
  Synthetic oligonucleotide
aaaagctgataaccgcagacgacat

SEQ ID NO: 685857 - DNA, 25 bp, Artificial sequence
  Synthetic oligonucleotide
tatgccgatgccctaaaagcaagtg

SEQ ID NO: 685858 - DNA, 25 bp, Artificial sequence
  Synthetic oligonucleotide
aacgaaatacatgtaaaaaggagga

SEQ ID NO: 685859 - DNA, 25 bp, Artificial sequence
  Synthetic oligonucleotide
aacgaaatacatctaaaaaggagga

SEQ ID NO: 685860 - DNA, 25 bp, Artificial sequence
  Synthetic oligonucleotide
cttttttttgctcgagataaaggag

SEQ ID NO: 685861 - DNA, 25 bp, Artificial sequence
  Synthetic oligonucleotide
cttttttttgctggagataaaggag

SEQ ID NO: 685862 - DNA, 25 bp, Artificial sequence
  Synthetic oligonucleotide
atcatgccaagccttcctcagcgtc

SEQ ID NO: 685863 - DNA, 25 bp, Artificial sequence
  Synthetic oligonucleotide
atcatgccaagcgttcctcagcgtc

SEQ ID NO: 685864 - DNA, 25 bp, Artificial sequence
  Synthetic oligonucleotide
tctctgtgaccgatcctcaatacgc

SEQ ID NO: 685865 - DNA, 25 bp, Artificial sequence
  Synthetic oligonucleotide
aagctgaccgtctttgaaagcgaca

SEQ ID NO: 685866 - DNA, 25 bp, Artificial sequence
  Synthetic oligonucleotide
catgtgaaggtgaggagcgacatcc

SEQ ID NO: 685867 - DNA, 25 bp, Artificial sequence
  Synthetic oligonucleotide
accgcagatttgtacggaaaagaaa

SEQ ID NO: 685868 - DNA, 25 bp, Artificial sequence
  Synthetic oligonucleotide
accgcagatttgaacggaaaagaaa

SEQ ID NO: 685869 - DNA, 25 bp, Artificial sequence
  Synthetic oligonucleotide
ggtacagataacgtgatctaccaag

SEQ ID NO: 685870 - DNA, 25 bp, Artificial sequence
  Synthetic oligonucleotide
ggtacagataacctgatctaccaag

SEQ ID NO: 685871 - DNA, 25 bp, Artificial sequence
  Synthetic oligonucleotide
gaggctgaaacacaaacagtcgccg

SEQ ID NO: 685872 - DNA, 25 bp, Artificial sequence
  Synthetic oligonucleotide
atcctcattgctgcgatcatgtcca

SEQ ID NO: 685873 - DNA, 25 bp, Artificial sequence
  Synthetic oligonucleotide
aagctgaccgtcattgaaagcgaca

SEQ ID NO: 685874 - DNA, 25 bp, Artificial sequence
  Synthetic oligonucleotide
ggccttggcagcagcgccgcagcga

SEQ ID NO: 685875 - DNA, 25 bp, Artificial sequence
  Synthetic oligonucleotide
tttgattcagtccgaatggcgctca

SEQ ID NO: 685876 - DNA, 25 bp, Artificial sequence
  Synthetic oligonucleotide
tttgattcagtcggaatggcgctca

SEQ ID NO: 685877 - DNA, 25 bp, Artificial sequence
  Synthetic oligonucleotide
actgttcccggatgcacagctaacc

SEQ ID NO: 685878 - DNA, 25 bp, Artificial sequence
  Synthetic oligonucleotide
actgttcccggaagcacagctaacc

SEQ ID NO: 685879 - DNA, 25 bp, Artificial sequence
  Synthetic oligonucleotide
ccgtgtatgaaccaagccgacatgc

SEQ ID NO: 685880 - DNA, 25 bp, Artificial sequence
  Synthetic oligonucleotide
acgtggaagggcttgacgccgcacg

SEQ ID NO: 685881 - DNA, 25 bp, Artificial sequence
  Synthetic oligonucleotide
gaggctgaaacagaaacagtcgccg

SEQ ID NO: 685882 - DNA, 25 bp, Artificial sequence
  Synthetic oligonucleotide
ggcggacttgtgttcggcctgcatg

SEQ ID NO: 685883 - DNA, 25 bp, Artificial sequence
  Synthetic oligonucleotide
aaaagcgaagcagcgacccaagatg

SEQ ID NO: 685884 - DNA, 25 bp, Artificial sequence
  Synthetic oligonucleotide
agagacgcgagacacgtgcttccga

SEQ ID NO: 685885 - DNA, 25 bp, Artificial sequence
  Synthetic oligonucleotide
agagacgcgagagacgtgcttccga

SEQ ID NO: 685886 - DNA, 25 bp, Artificial sequence
  Synthetic oligonucleotide
gtagtcgttgtcattcctttttatg

SEQ ID NO: 685887 - DNA, 25 bp, Artificial sequence
  Synthetic oligonucleotide
gtagtcgttgtctttcctttttatg

SEQ ID NO: 685888 - DNA, 25 bp, Artificial sequence
  Synthetic oligonucleotide
acccaaatgatccgcgtcccgaatg

SEQ ID NO: 685889 - DNA, 25 bp, Artificial sequence
  Synthetic oligonucleotide
catgtgaaggtgtggagcgacatcc

SEQ ID NO: 685890 - DNA, 25 bp, Artificial sequence
  Synthetic oligonucleotide
ggcggacttgtgatcggcctgcatg

SEQ ID NO: 685891 - DNA, 25 bp, Artificial sequence
  Synthetic oligonucleotide
ggccttggcagctgcgccgcagcga

SEQ ID NO: 685892 - DNA, 25 bp, Artificial sequence
  Synthetic oligonucleotide
gaaggacacccggacaatgctggcg

SEQ ID NO: 685893 - DNA, 25 bp, Artificial sequence
  Synthetic oligonucleotide
gaaggacacccgcacaatgctggcg

SEQ ID NO: 685894 - DNA, 25 bp, Artificial sequence
  Synthetic oligonucleotide
tctgaagcggacaagctgcatttag

SEQ ID NO: 685895 - DNA, 25 bp, Artificial sequence
  Synthetic oligonucleotide
tctgaagcggactagctgcatttag

SEQ ID NO: 685896 - DNA, 25 bp, Artificial sequence
  Synthetic oligonucleotide
attgaactggctgatgaattatgcg

SEQ ID NO: 685897 - DNA, 25 bp, Artificial sequence
  Synthetic oligonucleotide
attgaactggctcatgaattatgcg

SEQ ID NO: 685898 - DNA, 25 bp, Artificial sequence
  Synthetic oligonucleotide
tatgccgatgccgtaaaagcaagtg

SEQ ID NO: 685899 - DNA, 25 bp, Artificial sequence
  Synthetic oligonucleotide
acccaaatgatcggcgtcccgaatg

SEQ ID NO: 685900 - DNA, 25 bp, Artificial sequence
  Synthetic oligonucleotide
aagggttttatgacatcggcacaga

SEQ ID NO: 685901 - DNA, 25 bp, Artificial sequence
  Synthetic oligonucleotide
cgaaaacgggagcatctgttccttg

SEQ ID NO: 685902 - DNA, 25 bp, Artificial sequence
  Synthetic oligonucleotide
tttctctttcacctgatgaacagca

SEQ ID NO: 685903 - DNA, 25 bp, Artificial sequence
  Synthetic oligonucleotide
tttctctttcacgtgatgaacagca

SEQ ID NO: 685904 - DNA, 25 bp, Artificial sequence
  Synthetic oligonucleotide
atccgattcgtcaggaaaaagagta

SEQ ID NO: 685905 - DNA, 25 bp, Artificial sequence
  Synthetic oligonucleotide
atccgattcgtctggaaaaagagta

SEQ ID NO: 685906 - DNA, 25 bp, Artificial sequence
  Synthetic oligonucleotide
cgggcatctattttatttcgattga

SEQ ID NO: 685907 - DNA, 25 bp, Artificial sequence
  Synthetic oligonucleotide
gtgtgacaaagcgggacagaccgag

SEQ ID NO: 685908 - DNA, 25 bp, Artificial sequence
  Synthetic oligonucleotide
aagggttttatgtcatcggcacaga

SEQ ID NO: 685909 - DNA, 25 bp, Artificial sequence
  Synthetic oligonucleotide
gtatcccgcttgcacaggaagagaa

SEQ ID NO: 685910 - DNA, 25 bp, Artificial sequence
  Synthetic oligonucleotide
gtgctgaacagcccccgatttggac

SEQ ID NO: 685911 - DNA, 25 bp, Artificial sequence
  Synthetic oligonucleotide
gtgctgaacagcgcccgatttggac

SEQ ID NO: 685912 - DNA, 25 bp, Artificial sequence
  Synthetic oligonucleotide
tagcggatgcgcagattggagattc

SEQ ID NO: 685913 - DNA, 25 bp, Artificial sequence
  Synthetic oligonucleotide
tagcggatgcgctgattggagattc

SEQ ID NO: 685914 - DNA, 25 bp, Artificial sequence
  Synthetic oligonucleotide
gcctcacatgtcatactgagatgct

SEQ ID NO: 685915 - DNA, 25 bp, Artificial sequence
  Synthetic oligonucleotide
gcctcacatgtcttactgagatgct

SEQ ID NO: 685916 - DNA, 25 bp, Artificial sequence
  Synthetic oligonucleotide
cgggcatctattatatttcgattga

SEQ ID NO: 685917 - DNA, 25 bp, Artificial sequence
  Synthetic oligonucleotide
gcgtgatggtgaacggctggctgat

SEQ ID NO: 685918 - DNA, 25 bp, Artificial sequence
  Synthetic oligonucleotide
gatacgcggtcgattatatcaatcc

SEQ ID NO: 685919 - DNA, 25 bp, Artificial sequence
  Synthetic oligonucleotide
gatacgcggtcgtttatatcaatcc

SEQ ID NO: 685920 - DNA, 25 bp, Artificial sequence
  Synthetic oligonucleotide
catattttcatgtgtttcaggtgct

SEQ ID NO: 685921 - DNA, 25 bp, Artificial sequence
  Synthetic oligonucleotide
catattttcatgagtttcaggtgct

SEQ ID NO: 685922 - DNA, 25 bp, Artificial sequence
  Synthetic oligonucleotide
acatacacggcgctccgcatatgat

SEQ ID NO: 685923 - DNA, 25 bp, Artificial sequence
  Synthetic oligonucleotide
acatacacggcggtccgcatatgat

SEQ ID NO: 685924 - DNA, 25 bp, Artificial sequence
  Synthetic oligonucleotide
gtgtgacaaagccggacagaccgag

SEQ ID NO: 685925 - DNA, 25 bp, Artificial sequence
  Synthetic oligonucleotide
aaatggaaggtgtgacaacatatcc

SEQ ID NO: 685926 - DNA, 25 bp, Artificial sequence
  Synthetic oligonucleotide
tgcttggaaatgtaaaggaatataa

SEQ ID NO: 685927 - DNA, 25 bp, Artificial sequence
  Synthetic oligonucleotide
gcgtgatggtgatcggctggctgat

SEQ ID NO: 685928 - DNA, 25 bp, Artificial sequence
  Synthetic oligonucleotide
caatacctgaagtgattcaatatgc

SEQ ID NO: 685929 - DNA, 25 bp, Artificial sequence
  Synthetic oligonucleotide
caatacctgaagagattcaatatgc

SEQ ID NO: 685930 - DNA, 25 bp, Artificial sequence
  Synthetic oligonucleotide
gcgcgaatgacaagtttgtcaggga

SEQ ID NO: 685931 - DNA, 25 bp, Artificial sequence
  Synthetic oligonucleotide
gcgcgaatgacatgtttgtcaggga

SEQ ID NO: 685932 - DNA, 25 bp, Artificial sequence
  Synthetic oligonucleotide
gtatcccgcttggacaggaagagaa

SEQ ID NO: 685933 - DNA, 25 bp, Artificial sequence
  Synthetic oligonucleotide
aaatggaaggtgagacaacatatcc

SEQ ID NO: 685934 - DNA, 25 bp, Artificial sequence
  Synthetic oligonucleotide
gagaagcaagaatactgactgatat

SEQ ID NO: 685935 - DNA, 25 bp, Artificial sequence
  Synthetic oligonucleotide
aacctgttgaagagcaaggcctctc

SEQ ID NO: 685936 - DNA, 25 bp, Artificial sequence
  Synthetic oligonucleotide
aacctgttgaagtgcaaggcctctc

SEQ ID NO: 685937 - DNA, 25 bp, Artificial sequence
  Synthetic oligonucleotide
ttgatgaccgagaaaaaacagagca

SEQ ID NO: 685938 - DNA, 25 bp, Artificial sequence
  Synthetic oligonucleotide
ttgatgaccgagtaaaaacagagca

SEQ ID NO: 685939 - DNA, 25 bp, Artificial sequence
  Synthetic oligonucleotide
ttctggtcactatcagtttgggaga

SEQ ID NO: 685940 - DNA, 25 bp, Artificial sequence
  Synthetic oligonucleotide
ttctggtcactaacagtttgggaga

SEQ ID NO: 685941 - DNA, 25 bp, Artificial sequence
  Synthetic oligonucleotide
tctcaaaggcgtcgctctatgatat

SEQ ID NO: 685942 - DNA, 25 bp, Artificial sequence
  Synthetic oligonucleotide
tgtcaaagccgcaatggtccccgga

SEQ ID NO: 685943 - DNA, 25 bp, Artificial sequence
  Synthetic oligonucleotide
ttgtgcttgtcagcgtaaagtcggg

SEQ ID NO: 685944 - DNA, 25 bp, Artificial sequence
  Synthetic oligonucleotide
gagaagcaagaaaactgactgatat

SEQ ID NO: 685945 - DNA, 25 bp, Artificial sequence
  Synthetic oligonucleotide
atgcggcacagcattatatcatgag

SEQ ID NO: 685946 - DNA, 25 bp, Artificial sequence
  Synthetic oligonucleotide
atgcggcacagctttatatcatgag

SEQ ID NO: 685947 - DNA, 25 bp, Artificial sequence
  Synthetic oligonucleotide
ggcgcacgcttggctttatttctga

SEQ ID NO: 685948 - DNA, 25 bp, Artificial sequence
  Synthetic oligonucleotide
ggcgcacgcttgcctttatttctga

SEQ ID NO: 685949 - DNA, 25 bp, Artificial sequence
  Synthetic oligonucleotide
aaaagcgaagcaccgacccaagatg

SEQ ID NO: 685950 - DNA, 25 bp, Artificial sequence
  Synthetic oligonucleotide
tgtcaaagccgctatggtccccgga

SEQ ID NO: 685951 - DNA, 25 bp, Artificial sequence
  Synthetic oligonucleotide
ctaatttaactgaaacagatgatgc

SEQ ID NO: 685952 - DNA, 25 bp, Artificial sequence
  Synthetic oligonucleotide
tgaagacagcatgcttgaatatgta

SEQ ID NO: 685953 - DNA, 25 bp, Artificial sequence
  Synthetic oligonucleotide
tgcttggaaatgaaaaggaatataa

SEQ ID NO: 685954 - DNA, 25 bp, Artificial sequence
  Synthetic oligonucleotide
caagctcattttcaccagacggaag

SEQ ID NO: 685955 - DNA, 25 bp, Artificial sequence
  Synthetic oligonucleotide
caagctcattttgaccagacggaag

SEQ ID NO: 685956 - DNA, 25 bp, Artificial sequence
  Synthetic oligonucleotide
ttaagcaggttacacctcatcgcgg

SEQ ID NO: 685957 - DNA, 25 bp, Artificial sequence
  Synthetic oligonucleotide
ttaagcaggttagacctcatcgcgg

SEQ ID NO: 685958 - DNA, 25 bp, Artificial sequence
  Synthetic oligonucleotide
acggcaaagggcagacgagaggtgc

SEQ ID NO: 685959 - DNA, 25 bp, Artificial sequence
  Synthetic oligonucleotide
atgatgtttacataatgtcactgga

SEQ ID NO: 685960 - DNA, 25 bp, Artificial sequence
  Synthetic oligonucleotide
acggcaaagggctgacgagaggtgc

SEQ ID NO: 685961 - DNA, 25 bp, Artificial sequence
  Synthetic oligonucleotide
ctaatttaactgtaacagatgatgc

SEQ ID NO: 685962 - DNA, 25 bp, Artificial sequence
  Synthetic oligonucleotide
ctttttctcctgacggcaaatggct

SEQ ID NO: 685963 - DNA, 25 bp, Artificial sequence
  Synthetic oligonucleotide
ctttttctcctgtcggcaaatggct

SEQ ID NO: 685964 - DNA, 25 bp, Artificial sequence
  Synthetic oligonucleotide
agctgacaagtcacaaagctgatca

SEQ ID NO: 685965 - DNA, 25 bp, Artificial sequence
  Synthetic oligonucleotide
agctgacaagtctcaaagctgatca

SEQ ID NO: 685966 - DNA, 25 bp, Artificial sequence
  Synthetic oligonucleotide
ttgtgcttgtcaccgtaaagtcggg

SEQ ID NO: 685967 - DNA, 25 bp, Artificial sequence
  Synthetic oligonucleotide
tctcaaaggcgtggctctatgatat

SEQ ID NO: 685968 - DNA, 25 bp, Artificial sequence
  Synthetic oligonucleotide
atgatgtttacaaaatgtcactgga

SEQ ID NO: 685969 - DNA, 25 bp, Artificial sequence
  Synthetic oligonucleotide
aggatctcggttttgccgaagctga

SEQ ID NO: 685970 - DNA, 25 bp, Artificial sequence
  Synthetic oligonucleotide
atacaatgaagctgatcgggattgc

SEQ ID NO: 685971 - DNA, 25 bp, Artificial sequence
  Synthetic oligonucleotide
cagacgaggacaacagcttcagcaa

SEQ ID NO: 685972 - DNA, 25 bp, Artificial sequence
  Synthetic oligonucleotide
cagacgaggacatcagcttcagcaa

SEQ ID NO: 685973 - DNA, 25 bp, Artificial sequence
  Synthetic oligonucleotide
tggaagacgtcaaagtaaaggggat

SEQ ID NO: 685974 - DNA, 25 bp, Artificial sequence
  Synthetic oligonucleotide
tggaagacgtcatagtaaaggggat

SEQ ID NO: 685975 - DNA, 25 bp, Artificial sequence
  Synthetic oligonucleotide
tattggcgcgcctcggcttctcgat

SEQ ID NO: 685976 - DNA, 25 bp, Artificial sequence
  Synthetic oligonucleotide
ttccgattctgcgcacgttagagga

SEQ ID NO: 685977 - DNA, 25 bp, Artificial sequence
  Synthetic oligonucleotide
aggatctcggttatgccgaagctga

SEQ ID NO: 685978 - DNA, 25 bp, Artificial sequence
  Synthetic oligonucleotide
gcagcaaaatcgtggtcagcgtaca

SEQ ID NO: 685979 - DNA, 25 bp, Artificial sequence
  Synthetic oligonucleotide
agaaaagcccattcgaggaagtgct

SEQ ID NO: 685980 - DNA, 25 bp, Artificial sequence
  Synthetic oligonucleotide
agaaaagcccatacgaggaagtgct

SEQ ID NO: 685981 - DNA, 25 bp, Artificial sequence
  Synthetic oligonucleotide
gcacaacaaactttatcttaaccaa

SEQ ID NO: 685982 - DNA, 25 bp, Artificial sequence
  Synthetic oligonucleotide
gcacaacaaactatatcttaaccaa

SEQ ID NO: 685983 - DNA, 25 bp, Artificial sequence
  Synthetic oligonucleotide
cagatcgaattagaaaaatgatggg

SEQ ID NO: 685984 - DNA, 25 bp, Artificial sequence
  Synthetic oligonucleotide
gaattcatgtaaaagatgaggttgg

SEQ ID NO: 685985 - DNA, 25 bp, Artificial sequence
  Synthetic oligonucleotide
acgtggaagggcatgacgccgcacg

SEQ ID NO: 685986 - DNA, 25 bp, Artificial sequence
  Synthetic oligonucleotide
tgccgacagcgagatccgttgtttc

SEQ ID NO: 685987 - DNA, 25 bp, Artificial sequence
  Synthetic oligonucleotide
ccgtgtatgaacgaagccgacatgc

SEQ ID NO: 685988 - DNA, 25 bp, Artificial sequence
  Synthetic oligonucleotide
aatcgccgtctgacatttatgcaca

SEQ ID NO: 685989 - DNA, 25 bp, Artificial sequence
  Synthetic oligonucleotide
aatcgccgtctgtcatttatgcaca

SEQ ID NO: 685990 - DNA, 25 bp, Artificial sequence
  Synthetic oligonucleotide
acagctttgtcggaccgcaatatga

SEQ ID NO: 685991 - DNA, 25 bp, Artificial sequence
  Synthetic oligonucleotide
acagctttgtcgcaccgcaatatga

SEQ ID NO: 685992 - DNA, 25 bp, Artificial sequence
  Synthetic oligonucleotide
ctgtcatgaaaattatgcgcctagg

SEQ ID NO: 685993 - DNA, 25 bp, Artificial sequence
  Synthetic oligonucleotide
atacaatgaagcagatcgggattgc

SEQ ID NO: 685994 - DNA, 25 bp, Artificial sequence
  Synthetic oligonucleotide
tgccgacagcgacatccgttgtttc

SEQ ID NO: 685995 - DNA, 25 bp, Artificial sequence
  Synthetic oligonucleotide
gcagcaaaatcgaggtcagcgtaca

SEQ ID NO: 685996 - DNA, 25 bp, Artificial sequence
  Synthetic oligonucleotide
gtgagacgatgttctacgggccggg

SEQ ID NO: 685997 - DNA, 25 bp, Artificial sequence
  Synthetic oligonucleotide
gtgagacgatgtactacgggccggg

SEQ ID NO: 685998 - DNA, 25 bp, Artificial sequence
  Synthetic oligonucleotide
agtttaacgctgtttatgtatacgg

SEQ ID NO: 685999 - DNA, 25 bp, Artificial sequence
  Synthetic oligonucleotide
agtttaacgctgattatgtatacgg

SEQ ID NO: 686000 - DNA, 25 bp, Artificial sequence
  Synthetic oligonucleotide
ttcctgaccatcatccgctttctgc

SEQ ID NO: 686001 - DNA, 25 bp, Artificial sequence
  Synthetic oligonucleotide
ttcctgaccatcttccgctttctgc

SEQ ID NO: 686002 - DNA, 25 bp, Artificial sequence
  Synthetic oligonucleotide
ttccgattctgcccacgttagagga

SEQ ID NO: 686003 - DNA, 25 bp, Artificial sequence
  Synthetic oligonucleotide
ctgtcatgaaaaatatgcgcctagg

SEQ ID NO: 686004 - DNA, 25 bp, Artificial sequence
  Synthetic oligonucleotide
caaaacaggagcgggcttatataat

SEQ ID NO: 686005 - DNA, 25 bp, Artificial sequence
  Synthetic oligonucleotide
ggaagcggtgtccttaaaattattc

SEQ ID NO: 686006 - DNA, 25 bp, Artificial sequence
  Synthetic oligonucleotide
ggaagcggtgtcgttaaaattattc

SEQ ID NO: 686007 - DNA, 25 bp, Artificial sequence
  Synthetic oligonucleotide
gcgattcgtgtagggcttttaggtt

SEQ ID NO: 686008 - DNA, 25 bp, Artificial sequence
  Synthetic oligonucleotide
gcgattcgtgtacggcttttaggtt

SEQ ID NO: 686009 - DNA, 25 bp, Artificial sequence
  Synthetic oligonucleotide
gaggacaatcaatagaaaggtggag

SEQ ID NO: 686010 - DNA, 25 bp, Artificial sequence
  Synthetic oligonucleotide
gaggacaatcaaaagaaaggtggag

SEQ ID NO: 686011 - DNA, 25 bp, Artificial sequence
  Synthetic oligonucleotide
cagatcgaattacaaaaatgatggg

SEQ ID NO: 686012 - DNA, 25 bp, Artificial sequence
  Synthetic oligonucleotide
atatgtctgtgtagagttaacaatt

SEQ ID NO: 686013 - DNA, 25 bp, Artificial sequence
  Synthetic oligonucleotide
aaaaagtgcttgtaaaagatttaga

SEQ ID NO: 686014 - DNA, 25 bp, Artificial sequence
  Synthetic oligonucleotide
caaaacaggagccggcttatataat

SEQ ID NO: 686015 - DNA, 25 bp, Artificial sequence
  Synthetic oligonucleotide
tttacattcgcataattcagcctaa

SEQ ID NO: 686016 - DNA, 25 bp, Artificial sequence
  Synthetic oligonucleotide
tttacattcgcaaaattcagcctaa

SEQ ID NO: 686017 - DNA, 25 bp, Artificial sequence
  Synthetic oligonucleotide
aaaataaagaatgttgtcatatcaa

SEQ ID NO: 686018 - DNA, 25 bp, Artificial sequence
  Synthetic oligonucleotide
aaaataaagaatcttgtcatatcaa

SEQ ID NO: 686019 - DNA, 25 bp, Artificial sequence
  Synthetic oligonucleotide
ctcaaggtgaggagaaaatctgaca

SEQ ID NO: 686020 - DNA, 25 bp, Artificial sequence
  Synthetic oligonucleotide
atatgtctgtgttgagttaacaatt

SEQ ID NO: 686021 - DNA, 25 bp, Artificial sequence
  Synthetic oligonucleotide
tcatcgaggtgatcggcggcgttga

SEQ ID NO: 686022 - DNA, 25 bp, Artificial sequence
  Synthetic oligonucleotide
gcgatatctactatgaagccagtgt

SEQ ID NO: 686023 - DNA, 25 bp, Artificial sequence
  Synthetic oligonucleotide
gcgatatctactttgaagccagtgt

SEQ ID NO: 686024 - DNA, 25 bp, Artificial sequence
  Synthetic oligonucleotide
gctccgagctgcatgccgaagcgaa

SEQ ID NO: 686025 - DNA, 25 bp, Artificial sequence
  Synthetic oligonucleotide
gctccgagctgcttgccgaagcgaa

SEQ ID NO: 686026 - DNA, 25 bp, Artificial sequence
  Synthetic oligonucleotide
ttgtcacagcaatcaaggacttaat

SEQ ID NO: 686027 - DNA, 25 bp, Artificial sequence
  Synthetic oligonucleotide
ttgtcacagcaaacaaggacttaat

SEQ ID NO: 686028 - DNA, 25 bp, Artificial sequence
  Synthetic oligonucleotide
gataagcttatgcatcaggtcggct

SEQ ID NO: 686029 - DNA, 25 bp, Artificial sequence
  Synthetic oligonucleotide
aatatttggtcgtcgcgctgagatc

SEQ ID NO: 686030 - DNA, 25 bp, Artificial sequence
  Synthetic oligonucleotide
gataagcttatggatcaggtcggct

SEQ ID NO: 686031 - DNA, 25 bp, Artificial sequence
  Synthetic oligonucleotide
tcatcgaggtgaacggcggcgttga

SEQ ID NO: 686032 - DNA, 25 bp, Artificial sequence
  Synthetic oligonucleotide
tgtatgatgtcattgatgatccaga

SEQ ID NO: 686033 - DNA, 25 bp, Artificial sequence
  Synthetic oligonucleotide
tgtatgatgtcaatgatgatccaga

SEQ ID NO: 686034 - DNA, 25 bp, Artificial sequence
  Synthetic oligonucleotide
aagtagatttgccgaaggaagtgct

SEQ ID NO: 686035 - DNA, 25 bp, Artificial sequence
  Synthetic oligonucleotide
aagtagatttgcggaaggaagtgct

SEQ ID NO: 686036 - DNA, 25 bp, Artificial sequence
  Synthetic oligonucleotide
aaaaagtgcttgaaaaagatttaga

SEQ ID NO: 686037 - DNA, 25 bp, Artificial sequence
  Synthetic oligonucleotide
aaattacatctgagttctcagagcg

SEQ ID NO: 686038 - DNA, 25 bp, Artificial sequence
  Synthetic oligonucleotide
aatatttggtcgacgcgctgagatc

SEQ ID NO: 686039 - DNA, 25 bp, Artificial sequence
  Synthetic oligonucleotide
cgaacagctgggggaagcgcctgat

SEQ ID NO: 686040 - DNA, 25 bp, Artificial sequence
  Synthetic oligonucleotide
tgcggcggcaatggtgcgcaatgaa

SEQ ID NO: 686041 - DNA, 25 bp, Artificial sequence
  Synthetic oligonucleotide
tgcggcggcaatcgtgcgcaatgaa

SEQ ID NO: 686042 - DNA, 25 bp, Artificial sequence
  Synthetic oligonucleotide
aggccttccgaaaatgcgcggcttt

SEQ ID NO: 686043 - DNA, 25 bp, Artificial sequence
  Synthetic oligonucleotide
aggccttccgaatatgcgcggcttt

SEQ ID NO: 686044 - DNA, 25 bp, Artificial sequence
  Synthetic oligonucleotide
gaagggcttcaaggaatatcatgag

SEQ ID NO: 686045 - DNA, 25 bp, Artificial sequence
  Synthetic oligonucleotide
gaagggcttcaacgaatatcatgag

SEQ ID NO: 686046 - DNA, 25 bp, Artificial sequence
  Synthetic oligonucleotide
tgcgcttaaaattgtccgttccatc

SEQ ID NO: 686047 - DNA, 25 bp, Artificial sequence
  Synthetic oligonucleotide
cccggtcggaaatgctggaaacatc

SEQ ID NO: 686048 - DNA, 25 bp, Artificial sequence
  Synthetic oligonucleotide
cccggcaagctgggacaaagctgta

SEQ ID NO: 686049 - DNA, 25 bp, Artificial sequence
  Synthetic oligonucleotide
cgaacagctgggcgaagcgcctgat

SEQ ID NO: 686050 - DNA, 25 bp, Artificial sequence
  Synthetic oligonucleotide
cattgaaggccaaaaaactgctgcc

SEQ ID NO: 686051 - DNA, 25 bp, Artificial sequence
  Synthetic oligonucleotide
cattgaaggccataaaactgctgcc

SEQ ID NO: 686052 - DNA, 25 bp, Artificial sequence
  Synthetic oligonucleotide
accgattgccctagtcaactcagtc

SEQ ID NO: 686053 - DNA, 25 bp, Artificial sequence
  Synthetic oligonucleotide
accgattgcccttgtcaactcagtc

SEQ ID NO: 686054 - DNA, 25 bp, Artificial sequence
  Synthetic oligonucleotide
gaattcatgtaatagatgaggttgg

SEQ ID NO: 686055 - DNA, 25 bp, Artificial sequence
  Synthetic oligonucleotide
cccggtcggaaaagctggaaacatc

SEQ ID NO: 686056 - DNA, 25 bp, Artificial sequence
  Synthetic oligonucleotide
agaaggcgtgttagcagaaccaggt

SEQ ID NO: 686057 - DNA, 25 bp, Artificial sequence
  Synthetic oligonucleotide
catttcagaaatgaagcctgtcaca

SEQ ID NO: 686058 - DNA, 25 bp, Artificial sequence
  Synthetic oligonucleotide
catttcagaaatcaagcctgtcaca

SEQ ID NO: 686059 - DNA, 25 bp, Artificial sequence
  Synthetic oligonucleotide
aggaaacggactcaaagatccgaac

SEQ ID NO: 686060 - DNA, 25 bp, Artificial sequence
  Synthetic oligonucleotide
aggaaacggactgaaagatccgaac

SEQ ID NO: 686061 - DNA, 25 bp, Artificial sequence
  Synthetic oligonucleotide
aattccgaaagggagcaaggtcgta

SEQ ID NO: 686062 - DNA, 25 bp, Artificial sequence
  Synthetic oligonucleotide
aattccgaaaggcagcaaggtcgta

SEQ ID NO: 686063 - DNA, 25 bp, Artificial sequence
  Synthetic oligonucleotide
tccggaaacaattgcgacagccatt

SEQ ID NO: 686064 - DNA, 25 bp, Artificial sequence
  Synthetic oligonucleotide
tatcgcaggagtgctgaaacaggtg

SEQ ID NO: 686065 - DNA, 25 bp, Artificial sequence
  Synthetic oligonucleotide
tccggaaacaatagcgacagccatt

SEQ ID NO: 686066 - DNA, 25 bp, Artificial sequence
  Synthetic oligonucleotide
agaaggcgtgtttgcagaaccaggt

SEQ ID NO: 686067 - DNA, 25 bp, Artificial sequence
  Synthetic oligonucleotide
tgaaatccttcaggcatatcagctg

SEQ ID NO: 686068 - DNA, 25 bp, Artificial sequence
  Synthetic oligonucleotide
tgaaatccttcacgcatatcagctg

SEQ ID NO: 686069 - DNA, 25 bp, Artificial sequence
  Synthetic oligonucleotide
ggaatccaatggcaaaattgacgaa

SEQ ID NO: 686070 - DNA, 25 bp, Artificial sequence
  Synthetic oligonucleotide
ggaatccaatgggaaaattgacgaa

SEQ ID NO: 686071 - DNA, 25 bp, Artificial sequence
  Synthetic oligonucleotide
cccggcaagctgcgacaaagctgta

SEQ ID NO: 686072 - DNA, 25 bp, Artificial sequence
  Synthetic oligonucleotide
agccgagattatggcaattgacgga

SEQ ID NO: 686073 - DNA, 25 bp, Artificial sequence
  Synthetic oligonucleotide
tatcgcaggagtcctgaaacaggtg

SEQ ID NO: 686074 - DNA, 25 bp, Artificial sequence
  Synthetic oligonucleotide
catcagaagctgttttcagtgatat

SEQ ID NO: 686075 - DNA, 25 bp, Artificial sequence
  Synthetic oligonucleotide
tgtaacagatcaaacaccggcgcta

SEQ ID NO: 686076 - DNA, 25 bp, Artificial sequence
  Synthetic oligonucleotide
tgtaacagatcatacaccggcgcta

SEQ ID NO: 686077 - DNA, 25 bp, Artificial sequence
  Synthetic oligonucleotide
gaaaggacttatccatcaatataaa

SEQ ID NO: 686078 - DNA, 25 bp, Artificial sequence
  Synthetic oligonucleotide
gaaaggacttatgcatcaatataaa

SEQ ID NO: 686079 - DNA, 25 bp, Artificial sequence
  Synthetic oligonucleotide
catatcgtgtagtagggaacggttg

SEQ ID NO: 686080 - DNA, 25 bp, Artificial sequence
  Synthetic oligonucleotide
catatcgtgtagaagggaacggttg

SEQ ID NO: 686081 - DNA, 25 bp, Artificial sequence
  Synthetic oligonucleotide
tgcgcttaaaatagtccgttccatc

SEQ ID NO: 686082 - DNA, 25 bp, Artificial sequence
  Synthetic oligonucleotide
taaatgatttggtagtcgttcaaga

SEQ ID NO: 686083 - DNA, 25 bp, Artificial sequence
  Synthetic oligonucleotide
tgagcagctcggaattgagcttcat

SEQ ID NO: 686084 - DNA, 25 bp, Artificial sequence
  Synthetic oligonucleotide
catcagaagctgatttcagtgatat

SEQ ID NO: 686085 - DNA, 25 bp, Artificial sequence
  Synthetic oligonucleotide
atgagttagctgtaatcgtaattgt

SEQ ID NO: 686086 - DNA, 25 bp, Artificial sequence
  Synthetic oligonucleotide
atgagttagctgaaatcgtaattgt

SEQ ID NO: 686087 - DNA, 25 bp, Artificial sequence
  Synthetic oligonucleotide
ttgaaaaaatccatcagctgccaat

SEQ ID NO: 686088 - DNA, 25 bp, Artificial sequence
  Synthetic oligonucleotide
ttgaaaaaatccttcagctgccaat

SEQ ID NO: 686089 - DNA, 25 bp, Artificial sequence
  Synthetic oligonucleotide
aaattacatctgtgttctcagagcg

SEQ ID NO: 686090 - DNA, 25 bp, Artificial sequence
  Synthetic oligonucleotide
taaatgatttggaagtcgttcaaga

SEQ ID NO: 686091 - DNA, 25 bp, Artificial sequence
  Synthetic oligonucleotide
caatgacacgataatgtgcgcgtca

SEQ ID NO: 686092 - DNA, 25 bp, Artificial sequence
  Synthetic oligonucleotide
agccgagattatcgcaattgacgga

SEQ ID NO: 686093 - DNA, 25 bp, Artificial sequence
  Synthetic oligonucleotide
tgcatttggaaaactcgctcaagct

SEQ ID NO: 686094 - DNA, 25 bp, Artificial sequence
  Synthetic oligonucleotide
tgcatttggaaatctcgctcaagct

SEQ ID NO: 686095 - DNA, 25 bp, Artificial sequence
  Synthetic oligonucleotide
catgaaatgcattgtcatcatcccg

SEQ ID NO: 686096 - DNA, 25 bp, Artificial sequence
  Synthetic oligonucleotide
catgaaatgcatagtcatcatcccg

SEQ ID NO: 686097 - DNA, 25 bp, Artificial sequence
  Synthetic oligonucleotide
aggaaacacacctcttattcacctg

SEQ ID NO: 686098 - DNA, 25 bp, Artificial sequence
  Synthetic oligonucleotide
ttccgctgctgcggcagcatatgca

SEQ ID NO: 686099 - DNA, 25 bp, Artificial sequence
  Synthetic oligonucleotide
aggaaacacaccacttattcacctg

SEQ ID NO: 686100 - DNA, 25 bp, Artificial sequence
  Synthetic oligonucleotide
caatgacacgattatgtgcgcgtca

SEQ ID NO: 686101 - DNA, 25 bp, Artificial sequence
  Synthetic oligonucleotide
aatggttatggctgtggcaaaggca

SEQ ID NO: 686102 - DNA, 25 bp, Artificial sequence
  Synthetic oligonucleotide
aatggttatggcagtggcaaaggca

SEQ ID NO: 686103 - DNA, 25 bp, Artificial sequence
  Synthetic oligonucleotide
aggcgtcaatcctacgggatcattt

SEQ ID NO: 686104 - DNA, 25 bp, Artificial sequence
  Synthetic oligonucleotide
aggcgtcaatccaacgggatcattt

SEQ ID NO: 686105 - DNA, 25 bp, Artificial sequence
  Synthetic oligonucleotide
tgagcagctcggtattgagcttcat

SEQ ID NO: 686106 - DNA, 25 bp, Artificial sequence
  Synthetic oligonucleotide
ctcaaggtgaggtgaaaatctgaca

SEQ ID NO: 686107 - DNA, 25 bp, Artificial sequence
  Synthetic oligonucleotide
ttccgctgctgccgcagcatatgca

SEQ ID NO: 686108 - DNA, 25 bp, Artificial sequence
  Synthetic oligonucleotide
tgctgacagattctgaaatatggaa

SEQ ID NO: 686109 - DNA, 25 bp, Artificial sequence
  Synthetic oligonucleotide
gcgtcgccgtcaaaagggcttatta

SEQ ID NO: 686110 - DNA, 25 bp, Artificial sequence
  Synthetic oligonucleotide
gcttgatccctttcaccttcatgaa

SEQ ID NO: 686111 - DNA, 25 bp, Artificial sequence
  Synthetic oligonucleotide
cattagagacgattacaagcggagg

SEQ ID NO: 686112 - DNA, 25 bp, Artificial sequence
  Synthetic oligonucleotide
cattagagacgaatacaagcggagg

SEQ ID NO: 686113 - DNA, 25 bp, Artificial sequence
  Synthetic oligonucleotide
agcttgaacgactaaagcagaaaga

SEQ ID NO: 686114 - DNA, 25 bp, Artificial sequence
  Synthetic oligonucleotide
agcttgaacgacaaaagcagaaaga

SEQ ID NO: 686115 - DNA, 25 bp, Artificial sequence
  Synthetic oligonucleotide
atgcttgaaaacatcattaaacaaa

SEQ ID NO: 686116 - DNA, 25 bp, Artificial sequence
  Synthetic oligonucleotide
atgcttgaaaacttcattaaacaaa

SEQ ID NO: 686117 - DNA, 25 bp, Artificial sequence
  Synthetic oligonucleotide
gtaaaaacactgctcttgccggaag

SEQ ID NO: 686118 - DNA, 25 bp, Artificial sequence
  Synthetic oligonucleotide
gtaaaaacactggtcttgccggaag

SEQ ID NO: 686119 - DNA, 25 bp, Artificial sequence
  Synthetic oligonucleotide
gaaaaacgttcaattaaagaggcgc

SEQ ID NO: 686120 - DNA, 25 bp, Artificial sequence
  Synthetic oligonucleotide
gaaaaacgttcatttaaagaggcgc

SEQ ID NO: 686121 - DNA, 25 bp, Artificial sequence
  Synthetic oligonucleotide
aatcggtttatcgggttgattgctg

SEQ ID NO: 686122 - DNA, 25 bp, Artificial sequence
  Synthetic oligonucleotide
ggatcaccgcctgactgaaggaagg

SEQ ID NO: 686123 - DNA, 25 bp, Artificial sequence
  Synthetic oligonucleotide
gcgtcgccgtcataagggcttatta

SEQ ID NO: 686124 - DNA, 25 bp, Artificial sequence
  Synthetic oligonucleotide
cagcttttaatggaggggctgcgat

SEQ ID NO: 686125 - DNA, 25 bp, Artificial sequence
  Synthetic oligonucleotide
gtacctgtgcggtttgcaaaagact

SEQ ID NO: 686126 - DNA, 25 bp, Artificial sequence
  Synthetic oligonucleotide
gtacctgtgcggattgcaaaagact

SEQ ID NO: 686127 - DNA, 25 bp, Artificial sequence
  Synthetic oligonucleotide
aaacctgatgcggtttccgttttaa

SEQ ID NO: 686128 - DNA, 25 bp, Artificial sequence
  Synthetic oligonucleotide
aaacctgatgcgctttccgttttaa

SEQ ID NO: 686129 - DNA, 25 bp, Artificial sequence
  Synthetic oligonucleotide
ttttcaaggggataacagctattta

SEQ ID NO: 686130 - DNA, 25 bp, Artificial sequence
  Synthetic oligonucleotide
ttttcaaggggaaaacagctattta

SEQ ID NO: 686131 - DNA, 25 bp, Artificial sequence
  Synthetic oligonucleotide
gcgcgctgtttcgatacctgtactc

SEQ ID NO: 686132 - DNA, 25 bp, Artificial sequence
  Synthetic oligonucleotide
gcgcgctgtttccatacctgtactc

SEQ ID NO: 686133 - DNA, 25 bp, Artificial sequence
  Synthetic oligonucleotide
tattattgattctcttcaagtggag

SEQ ID NO: 686134 - DNA, 25 bp, Artificial sequence
  Synthetic oligonucleotide
tattattgattcacttcaagtggag

SEQ ID NO: 686135 - DNA, 25 bp, Artificial sequence
  Synthetic oligonucleotide
aatcggagcggatgccatattgtta

SEQ ID NO: 686136 - DNA, 25 bp, Artificial sequence
  Synthetic oligonucleotide
gtgatgaggaacctgcggatgccga

SEQ ID NO: 686137 - DNA, 25 bp, Artificial sequence
  Synthetic oligonucleotide
aatcggtttatccggttgattgctg

SEQ ID NO: 686138 - DNA, 25 bp, Artificial sequence
  Synthetic oligonucleotide
tcaagccgtgacggtttagatgagc

SEQ ID NO: 686139 - DNA, 25 bp, Artificial sequence
  Synthetic oligonucleotide
actcccgaaaagctcaaaagcagca

SEQ ID NO: 686140 - DNA, 25 bp, Artificial sequence
  Synthetic oligonucleotide
actcccgaaaaggtcaaaagcagca

SEQ ID NO: 686141 - DNA, 25 bp, Artificial sequence
  Synthetic oligonucleotide
aacatgggatttgtttttgcgccgc

SEQ ID NO: 686142 - DNA, 25 bp, Artificial sequence
  Synthetic oligonucleotide
aacatgggatttctttttgcgccgc

SEQ ID NO: 686143 - DNA, 25 bp, Artificial sequence
  Synthetic oligonucleotide
tctatgaaacatctagcaggtacta

SEQ ID NO: 686144 - DNA, 25 bp, Artificial sequence
  Synthetic oligonucleotide
tctatgaaacatgtagcaggtacta

SEQ ID NO: 686145 - DNA, 25 bp, Artificial sequence
  Synthetic oligonucleotide
ggtttcagaacggtatttaatctgc

SEQ ID NO: 686146 - DNA, 25 bp, Artificial sequence
  Synthetic oligonucleotide
ggtttcagaacgctatttaatctgc

SEQ ID NO: 686147 - DNA, 25 bp, Artificial sequence
  Synthetic oligonucleotide
agcaatcctttacaggcgaagtcag

SEQ ID NO: 686148 - DNA, 25 bp, Artificial sequence
  Synthetic oligonucleotide
agcaatcctttagaggcgaagtcag

SEQ ID NO: 686149 - DNA, 25 bp, Artificial sequence
  Synthetic oligonucleotide
tattctgttgaataagctggactga

SEQ ID NO: 686150 - DNA, 25 bp, Artificial sequence
  Synthetic oligonucleotide
tattctgttgaaaaagctggactga

SEQ ID NO: 686151 - DNA, 25 bp, Artificial sequence
  Synthetic oligonucleotide
ggatcaccgcctcactgaaggaagg

SEQ ID NO: 686152 - DNA, 25 bp, Artificial sequence
  Synthetic oligonucleotide
ctggagacgtttcagccgaagcacg

SEQ ID NO: 686153 - DNA, 25 bp, Artificial sequence
  Synthetic oligonucleotide
gcttgatcccttacaccttcatgaa

SEQ ID NO: 686154 - DNA, 25 bp, Artificial sequence
  Synthetic oligonucleotide
tcaagccgtgaccgtttagatgagc

SEQ ID NO: 686155 - DNA, 25 bp, Artificial sequence
  Synthetic oligonucleotide
gcaccgaccgacctgattgaattaa

SEQ ID NO: 686156 - DNA, 25 bp, Artificial sequence
  Synthetic oligonucleotide
gcaccgaccgacgtgattgaattaa

SEQ ID NO: 686157 - DNA, 25 bp, Artificial sequence
  Synthetic oligonucleotide
gccgggagtatagcgtttcacccga

SEQ ID NO: 686158 - DNA, 25 bp, Artificial sequence
  Synthetic oligonucleotide
gccgggagtataccgtttcacccga

SEQ ID NO: 686159 - DNA, 25 bp, Artificial sequence
  Synthetic oligonucleotide
tcacaaatggcacacttgaagattt

SEQ ID NO: 686160 - DNA, 25 bp, Artificial sequence
  Synthetic oligonucleotide
tcacaaatggcagacttgaagattt

SEQ ID NO: 686161 - DNA, 25 bp, Artificial sequence
  Synthetic oligonucleotide
ctccgaaagagaccgcttatctcat

SEQ ID NO: 686162 - DNA, 25 bp, Artificial sequence
  Synthetic oligonucleotide
ctccgaaagagagcgcttatctcat

SEQ ID NO: 686163 - DNA, 25 bp, Artificial sequence
  Synthetic oligonucleotide
ttgaaaataaaaccagcagttccgc

SEQ ID NO: 686164 - DNA, 25 bp, Artificial sequence
  Synthetic oligonucleotide
ttgaaaataaaagcagcagttccgc

SEQ ID NO: 686165 - DNA, 25 bp, Artificial sequence
  Synthetic oligonucleotide
cagcttttaatgcaggggctgcgat

SEQ ID NO: 686166 - DNA, 25 bp, Artificial sequence
  Synthetic oligonucleotide
ctggagacgtttgagccgaagcacg

SEQ ID NO: 686167 - DNA, 25 bp, Artificial sequence
  Synthetic oligonucleotide
taggaaaacgttgttttatcgcagg

SEQ ID NO: 686168 - DNA, 25 bp, Artificial sequence
  Synthetic oligonucleotide
aatcggagcggaagccatattgtta

SEQ ID NO: 686169 - DNA, 25 bp, Artificial sequence
  Synthetic oligonucleotide
ccgaagacttaattctagacgtcat

SEQ ID NO: 686170 - DNA, 25 bp, Artificial sequence
  Synthetic oligonucleotide
ccgaagacttaaatctagacgtcat

SEQ ID NO: 686171 - DNA, 25 bp, Artificial sequence
  Synthetic oligonucleotide
gtgatgaggaacgtgcggatgccga

SEQ ID NO: 686172 - DNA, 25 bp, Artificial sequence
  Synthetic oligonucleotide
tgctgacagattgtgaaatatggaa

SEQ ID NO: 686173 - DNA, 25 bp, Artificial sequence
  Synthetic oligonucleotide
atcatgagaacacaactcaagagat

SEQ ID NO: 686174 - DNA, 25 bp, Artificial sequence
  Synthetic oligonucleotide
atcatgagaacagaactcaagagat

SEQ ID NO: 686175 - DNA, 25 bp, Artificial sequence
  Synthetic oligonucleotide
aagatgatgtggtcggctttgtgat

SEQ ID NO: 686176 - DNA, 25 bp, Artificial sequence
  Synthetic oligonucleotide
aagatgatgtggacggctttgtgat

SEQ ID NO: 686177 - DNA, 25 bp, Artificial sequence
  Synthetic oligonucleotide
tcaaaggggcaagagggggcactgg

SEQ ID NO: 686178 - DNA, 25 bp, Artificial sequence
  Synthetic oligonucleotide
tcaaaggggcaacagggggcactgg

SEQ ID NO: 686179 - DNA, 25 bp, Artificial sequence
  Synthetic oligonucleotide
cttgggactgtgagccggaatacca

SEQ ID NO: 686180 - DNA, 25 bp, Artificial sequence
  Synthetic oligonucleotide
ttgttaatgaatggatagagacgat

SEQ ID NO: 686181 - DNA, 25 bp, Artificial sequence
  Synthetic oligonucleotide
taggaaaacgttcttttatcgcagg

SEQ ID NO: 686182 - DNA, 25 bp, Artificial sequence
  Synthetic oligonucleotide
gtcaagtttgtgtcgaaaaacaggt

SEQ ID NO: 686183 - DNA, 25 bp, Artificial sequence
  Synthetic oligonucleotide
cggacactatcagagacttaatgaa

SEQ ID NO: 686184 - DNA, 25 bp, Artificial sequence
  Synthetic oligonucleotide
cggacactatcacagacttaatgaa

SEQ ID NO: 686185 - DNA, 25 bp, Artificial sequence
  Synthetic oligonucleotide
caggaattgaccttgccagcggaat

SEQ ID NO: 686186 - DNA, 25 bp, Artificial sequence
  Synthetic oligonucleotide
caggaattgaccatgccagcggaat

SEQ ID NO: 686187 - DNA, 25 bp, Artificial sequence
  Synthetic oligonucleotide
gacaaaaagatcagaatctgatgag

SEQ ID NO: 686188 - DNA, 25 bp, Artificial sequence
  Synthetic oligonucleotide
gacaaaaagatctgaatctgatgag

SEQ ID NO: 686189 - DNA, 25 bp, Artificial sequence
  Synthetic oligonucleotide
aaaggatgaacccatatgtatccat

SEQ ID NO: 686190 - DNA, 25 bp, Artificial sequence
  Synthetic oligonucleotide
aaaggatgaaccgatatgtatccat

SEQ ID NO: 686191 - DNA, 25 bp, Artificial sequence
  Synthetic oligonucleotide
ataggcagataccgtgattttggcg

SEQ ID NO: 686192 - DNA, 25 bp, Artificial sequence
  Synthetic oligonucleotide
ataggcagatacggtgattttggcg

SEQ ID NO: 686193 - DNA, 25 bp, Artificial sequence
  Synthetic oligonucleotide
ccggaaacactcttgcagccgttag

SEQ ID NO: 686194 - DNA, 25 bp, Artificial sequence
  Synthetic oligonucleotide
ccggaaacactcatgcagccgttag

SEQ ID NO: 686195 - DNA, 25 bp, Artificial sequence
  Synthetic oligonucleotide
cttgggactgtgtgccggaatacca

SEQ ID NO: 686196 - DNA, 25 bp, Artificial sequence
  Synthetic oligonucleotide
tattggtgaatcattgatgagacaa

SEQ ID NO: 686197 - DNA, 25 bp, Artificial sequence
  Synthetic oligonucleotide
agcaggtgaaaaggagatggacgtg

SEQ ID NO: 686198 - DNA, 25 bp, Artificial sequence
  Synthetic oligonucleotide
agcaggtgaaaacgagatggacgtg

SEQ ID NO: 686199 - DNA, 25 bp, Artificial sequence
  Synthetic oligonucleotide
tcatgatgcaacaacgctagaacaa

SEQ ID NO: 686200 - DNA, 25 bp, Artificial sequence
  Synthetic oligonucleotide
tcatgatgcaactacgctagaacaa

SEQ ID NO: 686201 - DNA, 25 bp, Artificial sequence
  Synthetic oligonucleotide
attcacgcctgaaattctcggcata

SEQ ID NO: 686202 - DNA, 25 bp, Artificial sequence
  Synthetic oligonucleotide
attcacgcctgatattctcggcata

SEQ ID NO: 686203 - DNA, 25 bp, Artificial sequence
  Synthetic oligonucleotide
cctaaaaacgtttgaaacatctgta

SEQ ID NO: 686204 - DNA, 25 bp, Artificial sequence
  Synthetic oligonucleotide
cctaaaaacgttagaaacatctgta

SEQ ID NO: 686205 - DNA, 25 bp, Artificial sequence
  Synthetic oligonucleotide
acaaatcgcatcacttgctccgaaa

SEQ ID NO: 686206 - DNA, 25 bp, Artificial sequence
  Synthetic oligonucleotide
acaaatcgcatctcttgctccgaaa

SEQ ID NO: 686207 - DNA, 25 bp, Artificial sequence
  Synthetic oligonucleotide
tgtcagcgaaaggggaatcggttct

SEQ ID NO: 686208 - DNA, 25 bp, Artificial sequence
  Synthetic oligonucleotide
tgtcagcgaaagcggaatcggttct

SEQ ID NO: 686209 - DNA, 25 bp, Artificial sequence
  Synthetic oligonucleotide
ttgttaatgaatcgatagagacgat

SEQ ID NO: 686210 - DNA, 25 bp, Artificial sequence
  Synthetic oligonucleotide
aacatttgtcaatgaacatggagca

SEQ ID NO: 686211 - DNA, 25 bp, Artificial sequence
  Synthetic oligonucleotide
ggcaatcgctctgtctcttctaaaa

SEQ ID NO: 686212 - DNA, 25 bp, Artificial sequence
  Synthetic oligonucleotide
tattggtgaatctttgatgagacaa

SEQ ID NO: 686213 - DNA, 25 bp, Artificial sequence
  Synthetic oligonucleotide
aaaagcaatccatgctttgtttggg

SEQ ID NO: 686214 - DNA, 25 bp, Artificial sequence
  Synthetic oligonucleotide
aaaagcaatccaagctttgtttggg

SEQ ID NO: 686215 - DNA, 25 bp, Artificial sequence
  Synthetic oligonucleotide
tgaagaagccgggattaaaatattg

SEQ ID NO: 686216 - DNA, 25 bp, Artificial sequence
  Synthetic oligonucleotide
tgaagaagccggcattaaaatattg

SEQ ID NO: 686217 - DNA, 25 bp, Artificial sequence
  Synthetic oligonucleotide
cactgcaggatttgcagcttgcagc

SEQ ID NO: 686218 - DNA, 25 bp, Artificial sequence
  Synthetic oligonucleotide
cactgcaggattagcagcttgcagc

SEQ ID NO: 686219 - DNA, 25 bp, Artificial sequence
  Synthetic oligonucleotide
cggattatctggcctttatttttgc

SEQ ID NO: 686220 - DNA, 25 bp, Artificial sequence
  Synthetic oligonucleotide
cggattatctgggctttatttttgc

SEQ ID NO: 686221 - DNA, 25 bp, Artificial sequence
  Synthetic oligonucleotide
gaaaagtatctccgcaagatgtgaa

SEQ ID NO: 686222 - DNA, 25 bp, Artificial sequence
  Synthetic oligonucleotide
gaaaagtatctcggcaagatgtgaa

SEQ ID NO: 686223 - DNA, 25 bp, Artificial sequence
  Synthetic oligonucleotide
gtcaagtttgtgacgaaaaacaggt

SEQ ID NO: 686224 - DNA, 25 bp, Artificial sequence
  Synthetic oligonucleotide
aacatttgtcaaagaacatggagca

SEQ ID NO: 686225 - DNA, 25 bp, Artificial sequence
  Synthetic oligonucleotide
tggagcttcaaattctcattgaaaa

SEQ ID NO: 686226 - DNA, 25 bp, Artificial sequence
  Synthetic oligonucleotide
gatgttttagaggagctagaggttt

SEQ ID NO: 686227 - DNA, 25 bp, Artificial sequence
  Synthetic oligonucleotide
aaaatcaaaacagctgagcttggca

SEQ ID NO: 686228 - DNA, 25 bp, Artificial sequence
  Synthetic oligonucleotide
ggcggagctgtcgggtacttaagct

SEQ ID NO: 686229 - DNA, 25 bp, Artificial sequence
  Synthetic oligonucleotide
ggcggagctgtccggtacttaagct

SEQ ID NO: 686230 - DNA, 25 bp, Artificial sequence
  Synthetic oligonucleotide
ccgctgattgagccttctgttcctt

SEQ ID NO: 686231 - DNA, 25 bp, Artificial sequence
  Synthetic oligonucleotide
ccgctgattgaggcttctgttcctt

SEQ ID NO: 686232 - DNA, 25 bp, Artificial sequence
  Synthetic oligonucleotide
gaaacagacatggaaaagtgtatgc

SEQ ID NO: 686233 - DNA, 25 bp, Artificial sequence
  Synthetic oligonucleotide
gaaacagacatgcaaaagtgtatgc

SEQ ID NO: 686234 - DNA, 25 bp, Artificial sequence
  Synthetic oligonucleotide
cggacattaattgcgtatgatcatg

SEQ ID NO: 686235 - DNA, 25 bp, Artificial sequence
  Synthetic oligonucleotide
cggacattaattccgtatgatcatg

SEQ ID NO: 686236 - DNA, 25 bp, Artificial sequence
  Synthetic oligonucleotide
gtccactttatcgaatatgcaaggc

SEQ ID NO: 686237 - DNA, 25 bp, Artificial sequence
  Synthetic oligonucleotide
gtccactttatccaatatgcaaggc

SEQ ID NO: 686238 - DNA, 25 bp, Artificial sequence
  Synthetic oligonucleotide
ctaaaagaagtggtgaactggatga

SEQ ID NO: 686239 - DNA, 25 bp, Artificial sequence
  Synthetic oligonucleotide
aaaacgaaaaaatggatgtattcca

SEQ ID NO: 686240 - DNA, 25 bp, Artificial sequence
  Synthetic oligonucleotide
ctaaaagaagtgctgaactggatga

SEQ ID NO: 686241 - DNA, 25 bp, Artificial sequence
  Synthetic oligonucleotide
tggagcttcaaaatctcattgaaaa

SEQ ID NO: 686242 - DNA, 25 bp, Artificial sequence
  Synthetic oligonucleotide
aaaacataaaagtgctgtttctttc

SEQ ID NO: 686243 - DNA, 25 bp, Artificial sequence
  Synthetic oligonucleotide
aaaacataaaagagctgtttctttc

SEQ ID NO: 686244 - DNA, 25 bp, Artificial sequence
  Synthetic oligonucleotide
acaagacacccagctttgagacagt

SEQ ID NO: 686245 - DNA, 25 bp, Artificial sequence
  Synthetic oligonucleotide
acaagacacccacctttgagacagt

SEQ ID NO: 686246 - DNA, 25 bp, Artificial sequence
  Synthetic oligonucleotide
atgaaaaatcggcttttatggctga

SEQ ID NO: 686247 - DNA, 25 bp, Artificial sequence
  Synthetic oligonucleotide
atgaaaaatcgggttttatggctga

SEQ ID NO: 686248 - DNA, 25 bp, Artificial sequence
  Synthetic oligonucleotide
tcaaaagctataaaaaagcaggcga

SEQ ID NO: 686249 - DNA, 25 bp, Artificial sequence
  Synthetic oligonucleotide
tcaaaagctatataaaagcaggcga

SEQ ID NO: 686250 - DNA, 25 bp, Artificial sequence
  Synthetic oligonucleotide
gtgttttatcactaaaatttgaggt

SEQ ID NO: 686251 - DNA, 25 bp, Artificial sequence
  Synthetic oligonucleotide
gtgttttatcacaaaaatttgaggt

SEQ ID NO: 686252 - DNA, 25 bp, Artificial sequence
  Synthetic oligonucleotide
cagatgcttttgtgttataccgagt

SEQ ID NO: 686253 - DNA, 25 bp, Artificial sequence
  Synthetic oligonucleotide
aaaacgaaaaaaaggatgtattcca

SEQ ID NO: 686254 - DNA, 25 bp, Artificial sequence
  Synthetic oligonucleotide
tttttagaggactgcttgtcccacc

SEQ ID NO: 686255 - DNA, 25 bp, Artificial sequence
  Synthetic oligonucleotide
aaaaaatactgaattgtaatacgat

SEQ ID NO: 686256 - DNA, 25 bp, Artificial sequence
  Synthetic oligonucleotide
agaaatacacaacagtgtgtataaa

SEQ ID NO: 686257 - DNA, 25 bp, Artificial sequence
  Synthetic oligonucleotide
agaaatacacaagagtgtgtataaa

SEQ ID NO: 686258 - DNA, 25 bp, Artificial sequence
  Synthetic oligonucleotide
gagttgagttagtgaatagggtagc

SEQ ID NO: 686259 - DNA, 25 bp, Artificial sequence
  Synthetic oligonucleotide
gagttgagttagagaatagggtagc

SEQ ID NO: 686260 - DNA, 25 bp, Artificial sequence
  Synthetic oligonucleotide
ttagttgagctgagacattatgttt

SEQ ID NO: 686261 - DNA, 25 bp, Artificial sequence
  Synthetic oligonucleotide
ttagttgagctgtgacattatgttt

SEQ ID NO: 686262 - DNA, 25 bp, Artificial sequence
  Synthetic oligonucleotide
ttcttttgggttaatttgttatata

SEQ ID NO: 686263 - DNA, 25 bp, Artificial sequence
  Synthetic oligonucleotide
ttcttttgggtttatttgttatata

SEQ ID NO: 686264 - DNA, 25 bp, Artificial sequence
  Synthetic oligonucleotide
tctcatgccatcatctcattctcct

SEQ ID NO: 686265 - DNA, 25 bp, Artificial sequence
  Synthetic oligonucleotide
tctcatgccatcttctcattctcct

SEQ ID NO: 686266 - DNA, 25 bp, Artificial sequence
  Synthetic oligonucleotide
gtgagagcaatgtatttccaatcaa

SEQ ID NO: 686267 - DNA, 25 bp, Artificial sequence
  Synthetic oligonucleotide
aaaatcaaaacacctgagcttggca

SEQ ID NO: 686268 - DNA, 25 bp, Artificial sequence
  Synthetic oligonucleotide
tttttagaggacagcttgtcccacc

SEQ ID NO: 686269 - DNA, 25 bp, Artificial sequence
  Synthetic oligonucleotide
tcaatccttcgccgtatatgtatta

SEQ ID NO: 686270 - DNA, 25 bp, Artificial sequence
  Synthetic oligonucleotide
attgtggagaccttcacagtcgata

SEQ ID NO: 686271 - DNA, 25 bp, Artificial sequence
  Synthetic oligonucleotide
attgtggagaccatcacagtcgata

SEQ ID NO: 686272 - DNA, 25 bp, Artificial sequence
  Synthetic oligonucleotide
attcaaatgatacagaagcttgaca

SEQ ID NO: 686273 - DNA, 25 bp, Artificial sequence
  Synthetic oligonucleotide
attcaaatgatagagaagcttgaca

SEQ ID NO: 686274 - DNA, 25 bp, Artificial sequence
  Synthetic oligonucleotide
tatcttcttgaatgcaaggacgata

SEQ ID NO: 686275 - DNA, 25 bp, Artificial sequence
  Synthetic oligonucleotide
tatcttcttgaaagcaaggacgata

SEQ ID NO: 686276 - DNA, 25 bp, Artificial sequence
  Synthetic oligonucleotide
tccagatattcgtttatcggcctga

SEQ ID NO: 686277 - DNA, 25 bp, Artificial sequence
  Synthetic oligonucleotide
tccagatattcgattatcggcctga

SEQ ID NO: 686278 - DNA, 25 bp, Artificial sequence
  Synthetic oligonucleotide
acaattaaagaagagcagggccgtt

SEQ ID NO: 686279 - DNA, 25 bp, Artificial sequence
  Synthetic oligonucleotide
acaattaaagaacagcagggccgtt

SEQ ID NO: 686280 - DNA, 25 bp, Artificial sequence
  Synthetic oligonucleotide
gatcaggacagctaatctctttaca

SEQ ID NO: 686281 - DNA, 25 bp, Artificial sequence
  Synthetic oligonucleotide
gatcaggacagcaaatctctttaca

SEQ ID NO: 686282 - DNA, 25 bp, Artificial sequence
  Synthetic oligonucleotide
gtgagagcaatgaatttccaatcaa

SEQ ID NO: 686283 - DNA, 25 bp, Artificial sequence
  Synthetic oligonucleotide
atgggggggataatgtcaattcttg

SEQ ID NO: 686284 - DNA, 25 bp, Artificial sequence
  Synthetic oligonucleotide
gtgttgcatcgatacaggcaggtgc

SEQ ID NO: 686285 - DNA, 25 bp, Artificial sequence
  Synthetic oligonucleotide
ctgattctgttccggaagccgaata

SEQ ID NO: 686286 - DNA, 25 bp, Artificial sequence
  Synthetic oligonucleotide
ctgattctgttcgggaagccgaata

SEQ ID NO: 686287 - DNA, 25 bp, Artificial sequence
  Synthetic oligonucleotide
gtaataaagccggtgcgctgctgaa

SEQ ID NO: 686288 - DNA, 25 bp, Artificial sequence
  Synthetic oligonucleotide
gtaataaagccgctgcgctgctgaa

SEQ ID NO: 686289 - DNA, 25 bp, Artificial sequence
  Synthetic oligonucleotide
ttgcagaagacatgtttcatagcaa

SEQ ID NO: 686290 - DNA, 25 bp, Artificial sequence
  Synthetic oligonucleotide
ttgcagaagacaagtttcatagcaa

SEQ ID NO: 686291 - DNA, 25 bp, Artificial sequence
  Synthetic oligonucleotide
ctgatgaacagatttctacaattgt

SEQ ID NO: 686292 - DNA, 25 bp, Artificial sequence
  Synthetic oligonucleotide
ctgatgaacagaattctacaattgt

SEQ ID NO: 686293 - DNA, 25 bp, Artificial sequence
  Synthetic oligonucleotide
aaaacccttactcccggtgaggctg

SEQ ID NO: 686294 - DNA, 25 bp, Artificial sequence
  Synthetic oligonucleotide
aaaacccttactgccggtgaggctg

SEQ ID NO: 686295 - DNA, 25 bp, Artificial sequence
  Synthetic oligonucleotide
aatatgatgatggcagcggaaatga

SEQ ID NO: 686296 - DNA, 25 bp, Artificial sequence
  Synthetic oligonucleotide
cagatgcttttgagttataccgagt

SEQ ID NO: 686297 - DNA, 25 bp, Artificial sequence
  Synthetic oligonucleotide
atgggggggatattgtcaattcttg

SEQ ID NO: 686298 - DNA, 25 bp, Artificial sequence
  Synthetic oligonucleotide
cttgtattacgaatcgcacgatgag

SEQ ID NO: 686299 - DNA, 25 bp, Artificial sequence
  Synthetic oligonucleotide
gagacgccagaagagcttgcgggtt

SEQ ID NO: 686300 - DNA, 25 bp, Artificial sequence
  Synthetic oligonucleotide
gagacgccagaacagcttgcgggtt

SEQ ID NO: 686301 - DNA, 25 bp, Artificial sequence
  Synthetic oligonucleotide
atgcgggcacaccctcttacagtcg

SEQ ID NO: 686302 - DNA, 25 bp, Artificial sequence
  Synthetic oligonucleotide
atgcgggcacacgctcttacagtcg

SEQ ID NO: 686303 - DNA, 25 bp, Artificial sequence
  Synthetic oligonucleotide
gatattgttgattcatgcggaacag

SEQ ID NO: 686304 - DNA, 25 bp, Artificial sequence
  Synthetic oligonucleotide
gatattgttgatacatgcggaacag

SEQ ID NO: 686305 - DNA, 25 bp, Artificial sequence
  Synthetic oligonucleotide
atttccactttttatatctcaacgc

SEQ ID NO: 686306 - DNA, 25 bp, Artificial sequence
  Synthetic oligonucleotide
atttccacttttaatatctcaacgc

SEQ ID NO: 686307 - DNA, 25 bp, Artificial sequence
  Synthetic oligonucleotide
gttgcctcggcacctggtgcgaaaa

SEQ ID NO: 686308 - DNA, 25 bp, Artificial sequence
  Synthetic oligonucleotide
gttgcctcggcagctggtgcgaaaa

SEQ ID NO: 686309 - DNA, 25 bp, Artificial sequence
  Synthetic oligonucleotide
ggcaatcgctctctctcttctaaaa

SEQ ID NO: 686310 - DNA, 25 bp, Artificial sequence
  Synthetic oligonucleotide
aaaaaatactgatttgtaatacgat

SEQ ID NO: 686311 - DNA, 25 bp, Artificial sequence
  Synthetic oligonucleotide
aatatgatgatgccagcggaaatga

SEQ ID NO: 686312 - DNA, 25 bp, Artificial sequence
  Synthetic oligonucleotide
atggttctgtttgtgtgccggagtt

SEQ ID NO: 686313 - DNA, 25 bp, Artificial sequence
  Synthetic oligonucleotide
gatgttttagagcagctagaggttt

SEQ ID NO: 686314 - DNA, 25 bp, Artificial sequence
  Synthetic oligonucleotide
tagacagagaaaaagtcggcagctc

SEQ ID NO: 686315 - DNA, 25 bp, Artificial sequence
  Synthetic oligonucleotide
tagacagagaaatagtcggcagctc

SEQ ID NO: 686316 - DNA, 25 bp, Artificial sequence
  Synthetic oligonucleotide
taatacacgttcaagacgggcactt

SEQ ID NO: 686317 - DNA, 25 bp, Artificial sequence
  Synthetic oligonucleotide
taatacacgttctagacgggcactt

SEQ ID NO: 686318 - DNA, 25 bp, Artificial sequence
  Synthetic oligonucleotide
cgattgccggtaggagaaaacgcgg

SEQ ID NO: 686319 - DNA, 25 bp, Artificial sequence
  Synthetic oligonucleotide
cgattgccggtacgagaaaacgcgg

SEQ ID NO: 686320 - DNA, 25 bp, Artificial sequence
  Synthetic oligonucleotide
ctgaagatgagacactgaaggttga

SEQ ID NO: 686321 - DNA, 25 bp, Artificial sequence
  Synthetic oligonucleotide
ctgaagatgagagactgaaggttga

SEQ ID NO: 686322 - DNA, 25 bp, Artificial sequence
  Synthetic oligonucleotide
atgaaaaagaaatagcggagcatta

SEQ ID NO: 686323 - DNA, 25 bp, Artificial sequence
  Synthetic oligonucleotide
atgaaaaagaaaaagcggagcatta

SEQ ID NO: 686324 - DNA, 25 bp, Artificial sequence
  Synthetic oligonucleotide
atcttgcccgaaacgatatcggcag

SEQ ID NO: 686325 - DNA, 25 bp, Artificial sequence
  Synthetic oligonucleotide
gtgttgcatcgaaacaggcaggtgc

SEQ ID NO: 686326 - DNA, 25 bp, Artificial sequence
  Synthetic oligonucleotide
atggttctgtttctgtgccggagtt

SEQ ID NO: 686327 - DNA, 25 bp, Artificial sequence
  Synthetic oligonucleotide
cttgtattacgattcgcacgatgag

SEQ ID NO: 686328 - DNA, 25 bp, Artificial sequence
  Synthetic oligonucleotide
tttccttttcacttgtcatgcacat

SEQ ID NO: 686329 - DNA, 25 bp, Artificial sequence
  Synthetic oligonucleotide
tttccttttcacatgtcatgcacat

SEQ ID NO: 686330 - DNA, 25 bp, Artificial sequence
  Synthetic oligonucleotide
caggccgattgaaaaaaggggttca

SEQ ID NO: 686331 - DNA, 25 bp, Artificial sequence
  Synthetic oligonucleotide
caggccgattgataaaaggggttca

SEQ ID NO: 686332 - DNA, 25 bp, Artificial sequence
  Synthetic oligonucleotide
cactgatgtctgctttcccggcggg

SEQ ID NO: 686333 - DNA, 25 bp, Artificial sequence
  Synthetic oligonucleotide
cactgatgtctggtttcccggcggg

SEQ ID NO: 686334 - DNA, 25 bp, Artificial sequence
  Synthetic oligonucleotide
gcgcacccaaaaaccgtgccatgca

SEQ ID NO: 686335 - DNA, 25 bp, Artificial sequence
  Synthetic oligonucleotide
gcgcacccaaaatccgtgccatgca

SEQ ID NO: 686336 - DNA, 25 bp, Artificial sequence
  Synthetic oligonucleotide
aactcgagccaacaccgagagagac

SEQ ID NO: 686337 - DNA, 25 bp, Artificial sequence
  Synthetic oligonucleotide
aactcgagccaagaccgagagagac

SEQ ID NO: 686338 - DNA, 25 bp, Artificial sequence
  Synthetic oligonucleotide
gtattgcctacattgggtttgacgg

SEQ ID NO: 686339 - DNA, 25 bp, Artificial sequence
  Synthetic oligonucleotide
gtattgcctacaatgggtttgacgg

SEQ ID NO: 686340 - DNA, 25 bp, Artificial sequence
  Synthetic oligonucleotide
tcaatccttcgcggtatatgtatta

SEQ ID NO: 686341 - DNA, 25 bp, Artificial sequence
  Synthetic oligonucleotide
atcttgcccgaatcgatatcggcag

SEQ ID NO: 686342 - DNA, 25 bp, Artificial sequence
  Synthetic oligonucleotide
tatggattaatgaataagaaagtca

SEQ ID NO: 686343 - DNA, 25 bp, Artificial sequence
  Synthetic oligonucleotide
tagtttaattgctctcggctcaatc

SEQ ID NO: 686344 - DNA, 25 bp, Artificial sequence
  Synthetic oligonucleotide
aacttcccaaccttcgataaattag

SEQ ID NO: 686345 - DNA, 25 bp, Artificial sequence
  Synthetic oligonucleotide
gatgaattagatatagtaattcacg

SEQ ID NO: 686346 - DNA, 25 bp, Artificial sequence
  Synthetic oligonucleotide
tgtgaacaatgtcgacattatttga

SEQ ID NO: 686347 - DNA, 25 bp, Artificial sequence
  Synthetic oligonucleotide
tatggattaatgtataagaaagtca

SEQ ID NO: 686348 - DNA, 25 bp, Artificial sequence
  Synthetic oligonucleotide
caatcaattgtgcattcaatgcgac

SEQ ID NO: 686349 - DNA, 25 bp, Artificial sequence
  Synthetic oligonucleotide
caatcaattgtggattcaatgcgac

SEQ ID NO: 686350 - DNA, 25 bp, Artificial sequence
  Synthetic oligonucleotide
tgtgaacaatgtggacattatttga

SEQ ID NO: 686351 - DNA, 25 bp, Artificial sequence
  Synthetic oligonucleotide
attcctaatttatgtcgagtagacc

SEQ ID NO: 686352 - DNA, 25 bp, Artificial sequence
  Synthetic oligonucleotide
caagataagaactaataggaatcgt

SEQ ID NO: 686353 - DNA, 25 bp, Artificial sequence
  Synthetic oligonucleotide
tatctaggatttacatatacaacag

SEQ ID NO: 686354 - DNA, 25 bp, Artificial sequence
  Synthetic oligonucleotide
ggatttataaaatgtcaaagattca

SEQ ID NO: 686355 - DNA, 25 bp, Artificial sequence
  Synthetic oligonucleotide
ggatttataaaaagtcaaagattca

SEQ ID NO: 686356 - DNA, 25 bp, Artificial sequence
  Synthetic oligonucleotide
gaaaaagaagtaataggttgcgcta

SEQ ID NO: 686357 - DNA, 25 bp, Artificial sequence
  Synthetic oligonucleotide
gaaaaagaagtattaggttgcgcta

SEQ ID NO: 686358 - DNA, 25 bp, Artificial sequence
  Synthetic oligonucleotide
tacaataatgatctatttggcgaat

SEQ ID NO: 686359 - DNA, 25 bp, Artificial sequence
  Synthetic oligonucleotide
tacaataatgatgtatttggcgaat

SEQ ID NO: 686360 - DNA, 25 bp, Artificial sequence
  Synthetic oligonucleotide
catggtctaatatagaataattctg

SEQ ID NO: 686361 - DNA, 25 bp, Artificial sequence
  Synthetic oligonucleotide
catggtctaataaagaataattctg

SEQ ID NO: 686362 - DNA, 25 bp, Artificial sequence
  Synthetic oligonucleotide
tgtgaaagattcgtgtgaaaaaggt

SEQ ID NO: 686363 - DNA, 25 bp, Artificial sequence
  Synthetic oligonucleotide
ttcattttcatggatgaattccgca

SEQ ID NO: 686364 - DNA, 25 bp, Artificial sequence
  Synthetic oligonucleotide
attcctaatttaagtcgagtagacc

SEQ ID NO: 686365 - DNA, 25 bp, Artificial sequence
  Synthetic oligonucleotide
ttcattttcatgcatgaattccgca

SEQ ID NO: 686366 - DNA, 25 bp, Artificial sequence
  Synthetic oligonucleotide
tattgcaagaatactaaattcatga

SEQ ID NO: 686367 - DNA, 25 bp, Artificial sequence
  Synthetic oligonucleotide
tattgcaagaattctaaattcatga

SEQ ID NO: 686368 - DNA, 25 bp, Artificial sequence
  Synthetic oligonucleotide
ggacttatgtcaccacaaacagaga

SEQ ID NO: 686369 - DNA, 25 bp, Artificial sequence
  Synthetic oligonucleotide
ggacttatgtcagcacaaacagaga

SEQ ID NO: 686370 - DNA, 25 bp, Artificial sequence
  Synthetic oligonucleotide
tgttgggttcaaagctggtgttaaa

SEQ ID NO: 686371 - DNA, 25 bp, Artificial sequence
  Synthetic oligonucleotide
tgttgggttcaatgctggtgttaaa

SEQ ID NO: 686372 - DNA, 25 bp, Artificial sequence
  Synthetic oligonucleotide
gacttactatactcctgaatatgaa

SEQ ID NO: 686373 - DNA, 25 bp, Artificial sequence
  Synthetic oligonucleotide
gacttactatacacctgaatatgaa

SEQ ID NO: 686374 - DNA, 25 bp, Artificial sequence
  Synthetic oligonucleotide
gttctaaggatttcgatataactca

SEQ ID NO: 686375 - DNA, 25 bp, Artificial sequence
  Synthetic oligonucleotide
gttctaaggattacgatataactca

SEQ ID NO: 686376 - DNA, 25 bp, Artificial sequence
  Synthetic oligonucleotide
tccaatttttccgccacgacgataa

SEQ ID NO: 686377 - DNA, 25 bp, Artificial sequence
  Synthetic oligonucleotide
tgtgaaagattcctgtgaaaaaggt

SEQ ID NO: 686378 - DNA, 25 bp, Artificial sequence
  Synthetic oligonucleotide
gaaggaatagtctttttcaagctca

SEQ ID NO: 686379 - DNA, 25 bp, Artificial sequence
  Synthetic oligonucleotide
gatgaattagatttagtaattcacg

SEQ ID NO: 686380 - DNA, 25 bp, Artificial sequence
  Synthetic oligonucleotide
gatctactacttaaattcctgtttc

SEQ ID NO: 686381 - DNA, 25 bp, Artificial sequence
  Synthetic oligonucleotide
tccaatttttcccccacgacgataa

SEQ ID NO: 686382 - DNA, 25 bp, Artificial sequence
  Synthetic oligonucleotide
tagtaggatttgttctcataataaa

SEQ ID NO: 686383 - DNA, 25 bp, Artificial sequence
  Synthetic oligonucleotide
tagtaggatttgatctcataataaa

SEQ ID NO: 686384 - DNA, 25 bp, Artificial sequence
  Synthetic oligonucleotide
ttgttacgaattatttcgaatacag

SEQ ID NO: 686385 - DNA, 25 bp, Artificial sequence
  Synthetic oligonucleotide
ttgttacgaattttttcgaatacag

SEQ ID NO: 686386 - DNA, 25 bp, Artificial sequence
  Synthetic oligonucleotide
cgatagcaaattaatcggttaattc

SEQ ID NO: 686387 - DNA, 25 bp, Artificial sequence
  Synthetic oligonucleotide
cgatagcaaatttatcggttaattc

SEQ ID NO: 686388 - DNA, 25 bp, Artificial sequence
  Synthetic oligonucleotide
gagtaagcactcgatttcgttggtc

SEQ ID NO: 686389 - DNA, 25 bp, Artificial sequence
  Synthetic oligonucleotide
gagtaagcactccatttcgttggtc

SEQ ID NO: 686390 - DNA, 25 bp, Artificial sequence
  Synthetic oligonucleotide
tatctaggattttcatatacaacag

SEQ ID NO: 686391 - DNA, 25 bp, Artificial sequence
  Synthetic oligonucleotide
aagcggatgtggaattcaatttttt

SEQ ID NO: 686392 - DNA, 25 bp, Artificial sequence
  Synthetic oligonucleotide
tgaaagcggaaacattcgtgaaagt

SEQ ID NO: 686393 - DNA, 25 bp, Artificial sequence
  Synthetic oligonucleotide
gaaggaatagtcattttcaagctca

SEQ ID NO: 686394 - DNA, 25 bp, Artificial sequence
  Synthetic oligonucleotide
gaaagtcttttaattttttatcata

SEQ ID NO: 686395 - DNA, 25 bp, Artificial sequence
  Synthetic oligonucleotide
gaaagtcttttatttttttatcata

SEQ ID NO: 686396 - DNA, 25 bp, Artificial sequence
  Synthetic oligonucleotide
gcaagcctttgtattatctagcgaa

SEQ ID NO: 686397 - DNA, 25 bp, Artificial sequence
  Synthetic oligonucleotide
gcaagcctttgttttatctagcgaa

SEQ ID NO: 686398 - DNA, 25 bp, Artificial sequence
  Synthetic oligonucleotide
cggaactttagttatgattcattat

SEQ ID NO: 686399 - DNA, 25 bp, Artificial sequence
  Synthetic oligonucleotide
cggaactttagtaatgattcattat

SEQ ID NO: 686400 - DNA, 25 bp, Artificial sequence
  Synthetic oligonucleotide
tttttttcgtatattcattttagca

SEQ ID NO: 686401 - DNA, 25 bp, Artificial sequence
  Synthetic oligonucleotide
tttttttcgtattttcattttagca

SEQ ID NO: 686402 - DNA, 25 bp, Artificial sequence
  Synthetic oligonucleotide
gcgtcccatttaatcatccctttag

SEQ ID NO: 686403 - DNA, 25 bp, Artificial sequence
  Synthetic oligonucleotide
gcgtcccatttattcatccctttag

SEQ ID NO: 686404 - DNA, 25 bp, Artificial sequence
  Synthetic oligonucleotide
aagcggatgtggtattcaatttttt

SEQ ID NO: 686405 - DNA, 25 bp, Artificial sequence
  Synthetic oligonucleotide
tttcattccgtattggaataaaaaa

SEQ ID NO: 686406 - DNA, 25 bp, Artificial sequence
  Synthetic oligonucleotide
caagataagaacaaataggaatcgt

SEQ ID NO: 686407 - DNA, 25 bp, Artificial sequence
  Synthetic oligonucleotide
tgcttactctgaatagaaaatgaac

SEQ ID NO: 686408 - DNA, 25 bp, Artificial sequence
  Synthetic oligonucleotide
cttaataatctttgcaattgcatcg

SEQ ID NO: 686409 - DNA, 25 bp, Artificial sequence
  Synthetic oligonucleotide
cttaataatcttagcaattgcatcg

SEQ ID NO: 686410 - DNA, 25 bp, Artificial sequence
  Synthetic oligonucleotide
tcatttagaatttaaattgattcat

SEQ ID NO: 686411 - DNA, 25 bp, Artificial sequence
  Synthetic oligonucleotide
tcatttagaattaaaattgattcat

SEQ ID NO: 686412 - DNA, 25 bp, Artificial sequence
  Synthetic oligonucleotide
tatgagaattttacacaatataaga

SEQ ID NO: 686413 - DNA, 25 bp, Artificial sequence
  Synthetic oligonucleotide
tatgagaatttttcacaatataaga

SEQ ID NO: 686414 - DNA, 25 bp, Artificial sequence
  Synthetic oligonucleotide
tcttatattcattagcgaagaacaa

SEQ ID NO: 686415 - DNA, 25 bp, Artificial sequence
  Synthetic oligonucleotide
tcttatattcataagcgaagaacaa

SEQ ID NO: 686416 - DNA, 25 bp, Artificial sequence
  Synthetic oligonucleotide
tagtatacgagaatttactaaaaaa

SEQ ID NO: 686417 - DNA, 25 bp, Artificial sequence
  Synthetic oligonucleotide
tgcatttttcaattttttcattgaa

SEQ ID NO: 686418 - DNA, 25 bp, Artificial sequence
  Synthetic oligonucleotide
tttcattccgtaatggaataaaaaa

SEQ ID NO: 686419 - DNA, 25 bp, Artificial sequence
  Synthetic oligonucleotide
tgcatttttcaaatttttcattgaa

SEQ ID NO: 686420 - DNA, 25 bp, Artificial sequence
  Synthetic oligonucleotide
tcttctaccccaacctgcatgttgt

SEQ ID NO: 686421 - DNA, 25 bp, Artificial sequence
  Synthetic oligonucleotide
tcttctaccccatcctgcatgttgt

SEQ ID NO: 686422 - DNA, 25 bp, Artificial sequence
  Synthetic oligonucleotide
tctttcgtgtcacggcttgaaccaa

SEQ ID NO: 686423 - DNA, 25 bp, Artificial sequence
  Synthetic oligonucleotide
tctttcgtgtcagggcttgaaccaa

SEQ ID NO: 686424 - DNA, 25 bp, Artificial sequence
  Synthetic oligonucleotide
gaaacatggattcttaattcttagg

SEQ ID NO: 686425 - DNA, 25 bp, Artificial sequence
  Synthetic oligonucleotide
gaaacatggattgttaattcttagg

SEQ ID NO: 686426 - DNA, 25 bp, Artificial sequence
  Synthetic oligonucleotide
tgttattgtagtgttgtgtccacaa

SEQ ID NO: 686427 - DNA, 25 bp, Artificial sequence
  Synthetic oligonucleotide
tgttattgtagtcttgtgtccacaa

SEQ ID NO: 686428 - DNA, 25 bp, Artificial sequence
  Synthetic oligonucleotide
ctcttcaataaaaaaaagaagatta

SEQ ID NO: 686429 - DNA, 25 bp, Artificial sequence
  Synthetic oligonucleotide
ctcttcaataaataaaagaagatta

SEQ ID NO: 686430 - DNA, 25 bp, Artificial sequence
  Synthetic oligonucleotide
ttttttgatagaaacatacttaaat

SEQ ID NO: 686431 - DNA, 25 bp, Artificial sequence
  Synthetic oligonucleotide
tagtatacgagattttactaaaaaa

SEQ ID NO: 686432 - DNA, 25 bp, Artificial sequence
  Synthetic oligonucleotide
gacaccttttttcttagggatagta

SEQ ID NO: 686433 - DNA, 25 bp, Artificial sequence
  Synthetic oligonucleotide
tgaaagcggaaagattcgtgaaagt

SEQ ID NO: 686434 - DNA, 25 bp, Artificial sequence
  Synthetic oligonucleotide
taatgaaagttagatttataatttc

SEQ ID NO: 686435 - DNA, 25 bp, Artificial sequence
  Synthetic oligonucleotide
taatgaaagttacatttataatttc

SEQ ID NO: 686436 - DNA, 25 bp, Artificial sequence
  Synthetic oligonucleotide
tctagttattcctataatgttgatc

SEQ ID NO: 686437 - DNA, 25 bp, Artificial sequence
  Synthetic oligonucleotide
aaaacttttatggttgggatgagcg

SEQ ID NO: 686438 - DNA, 25 bp, Artificial sequence
  Synthetic oligonucleotide
aaaacttttatgcttgggatgagcg

SEQ ID NO: 686439 - DNA, 25 bp, Artificial sequence
  Synthetic oligonucleotide
tctagttattccaataatgttgatc

SEQ ID NO: 686440 - DNA, 25 bp, Artificial sequence
  Synthetic oligonucleotide
gactactataagacaagaccgtttt

SEQ ID NO: 686441 - DNA, 25 bp, Artificial sequence
  Synthetic oligonucleotide
gactactataagtcaagaccgtttt

SEQ ID NO: 686442 - DNA, 25 bp, Artificial sequence
  Synthetic oligonucleotide
gtaaagcaatggttagttttgctcc

SEQ ID NO: 686443 - DNA, 25 bp, Artificial sequence
  Synthetic oligonucleotide
gtaaagcaatggatagttttgctcc

SEQ ID NO: 686444 - DNA, 25 bp, Artificial sequence
  Synthetic oligonucleotide
tgcttactctgattagaaaatgaac

SEQ ID NO: 686445 - DNA, 25 bp, Artificial sequence
  Synthetic oligonucleotide
gctccaaggacattcgcaatttcat

SEQ ID NO: 686446 - DNA, 25 bp, Artificial sequence
  Synthetic oligonucleotide
gtatctaattctttaaaagcaggcg

SEQ ID NO: 686447 - DNA, 25 bp, Artificial sequence
  Synthetic oligonucleotide
gacaccttttttgttagggatagta

SEQ ID NO: 686448 - DNA, 25 bp, Artificial sequence
  Synthetic oligonucleotide
gagattgacaatcattttagtgacc

SEQ ID NO: 686449 - DNA, 25 bp, Artificial sequence
  Synthetic oligonucleotide
gagattgacaatgattttagtgacc

SEQ ID NO: 686450 - DNA, 25 bp, Artificial sequence
  Synthetic oligonucleotide
tatagttattgtagttctagttatc

SEQ ID NO: 686451 - DNA, 25 bp, Artificial sequence
  Synthetic oligonucleotide
tatagttattgttgttctagttatc

SEQ ID NO: 686452 - DNA, 25 bp, Artificial sequence
  Synthetic oligonucleotide
tttctaagggagaattggaatacag

SEQ ID NO: 686453 - DNA, 25 bp, Artificial sequence
  Synthetic oligonucleotide
tttctaagggagtattggaatacag

SEQ ID NO: 686454 - DNA, 25 bp, Artificial sequence
  Synthetic oligonucleotide
cagaagctctatcgaaaaatcgtgg

SEQ ID NO: 686455 - DNA, 25 bp, Artificial sequence
  Synthetic oligonucleotide
cagaagctctatggaaaaatcgtgg

SEQ ID NO: 686456 - DNA, 25 bp, Artificial sequence
  Synthetic oligonucleotide
tcatctattgttattgtattttcat

SEQ ID NO: 686457 - DNA, 25 bp, Artificial sequence
  Synthetic oligonucleotide
tcatctattgtttttgtattttcat

SEQ ID NO: 686458 - DNA, 25 bp, Artificial sequence
  Synthetic oligonucleotide
gctccaaggacaatcgcaatttcat

SEQ ID NO: 686459 - DNA, 25 bp, Artificial sequence
  Synthetic oligonucleotide
gatatcttggcagcattccgagtaa

SEQ ID NO: 686460 - DNA, 25 bp, Artificial sequence
  Synthetic oligonucleotide
tctttttcactctagattgggtctc

SEQ ID NO: 686461 - DNA, 25 bp, Artificial sequence
  Synthetic oligonucleotide
tggtgttctgcctgtggcttcaggg

SEQ ID NO: 686462 - DNA, 25 bp, Artificial sequence
  Synthetic oligonucleotide
tggtgttctgccagtggcttcaggg

SEQ ID NO: 686463 - DNA, 25 bp, Artificial sequence
  Synthetic oligonucleotide
tggcatatgcctgctttgaccgaga

SEQ ID NO: 686464 - DNA, 25 bp, Artificial sequence
  Synthetic oligonucleotide
tggcatatgcctcctttgaccgaga

SEQ ID NO: 686465 - DNA, 25 bp, Artificial sequence
  Synthetic oligonucleotide
gattctgtactagaattcggtggag

SEQ ID NO: 686466 - DNA, 25 bp, Artificial sequence
  Synthetic oligonucleotide
gattctgtactacaattcggtggag

SEQ ID NO: 686467 - DNA, 25 bp, Artificial sequence
  Synthetic oligonucleotide
cccttggggaaatgcaccgggtgcc

SEQ ID NO: 686468 - DNA, 25 bp, Artificial sequence
  Synthetic oligonucleotide
cccttggggaaaagcaccgggtgcc

SEQ ID NO: 686469 - DNA, 25 bp, Artificial sequence
  Synthetic oligonucleotide
gatatcttggcaccattccgagtaa

SEQ ID NO: 686470 - DNA, 25 bp, Artificial sequence
  Synthetic oligonucleotide
gggtaatgtatttgggttcaaagcc

SEQ ID NO: 686471 - DNA, 25 bp, Artificial sequence
  Synthetic oligonucleotide
tggagttccaccagaagaagcaggg

SEQ ID NO: 686472 - DNA, 25 bp, Artificial sequence
  Synthetic oligonucleotide
tgcgcgatgattatgttgaaaaaga

SEQ ID NO: 686473 - DNA, 25 bp, Artificial sequence
  Synthetic oligonucleotide
gctgaatcttcttctggtacatgga

SEQ ID NO: 686474 - DNA, 25 bp, Artificial sequence
  Synthetic oligonucleotide
gctgaatcttctactggtacatgga

SEQ ID NO: 686475 - DNA, 25 bp, Artificial sequence
  Synthetic oligonucleotide
gaccgatgggctaaccagccttgat

SEQ ID NO: 686476 - DNA, 25 bp, Artificial sequence
  Synthetic oligonucleotide
gaccgatgggcttaccagccttgat

SEQ ID NO: 686477 - DNA, 25 bp, Artificial sequence
  Synthetic oligonucleotide
gacgatgctaccacatcgagcccgt

SEQ ID NO: 686478 - DNA, 25 bp, Artificial sequence
  Synthetic oligonucleotide
gacgatgctacctcatcgagcccgt

SEQ ID NO: 686479 - DNA, 25 bp, Artificial sequence
  Synthetic oligonucleotide
gaaactcaattttttgcgtatgtag

SEQ ID NO: 686480 - DNA, 25 bp, Artificial sequence
  Synthetic oligonucleotide
gaaactcaatttattgcgtatgtag

SEQ ID NO: 686481 - DNA, 25 bp, Artificial sequence
  Synthetic oligonucleotide
tttgaagaaggttcggttactaaca

SEQ ID NO: 686482 - DNA, 25 bp, Artificial sequence
  Synthetic oligonucleotide
tttgaagaaggtacggttactaaca

SEQ ID NO: 686483 - DNA, 25 bp, Artificial sequence
  Synthetic oligonucleotide
gatctactactttaattcctgtttc

SEQ ID NO: 686484 - DNA, 25 bp, Artificial sequence
  Synthetic oligonucleotide
tggagttccacctgaagaagcaggg

SEQ ID NO: 686485 - DNA, 25 bp, Artificial sequence
  Synthetic oligonucleotide
acttcttcacatccaccgtgcaatg

SEQ ID NO: 686486 - DNA, 25 bp, Artificial sequence
  Synthetic oligonucleotide
tagtttaattgcactcggctcaatc

SEQ ID NO: 686487 - DNA, 25 bp, Artificial sequence
  Synthetic oligonucleotide
taaaaaagattgagccgaggttatc

SEQ ID NO: 686488 - DNA, 25 bp, Artificial sequence
  Synthetic oligonucleotide
taaaaaagattgtgccgaggttatc

SEQ ID NO: 686489 - DNA, 25 bp, Artificial sequence
  Synthetic oligonucleotide
aacttcccaaccatcgataaattag

SEQ ID NO: 686490 - DNA, 25 bp, Artificial sequence
  Synthetic oligonucleotide
gagtagctctggaagcatgtgtaca

SEQ ID NO: 686491 - DNA, 25 bp, Artificial sequence
  Synthetic oligonucleotide
taatgagggacgtgatcttgcagtc

SEQ ID NO: 686492 - DNA, 25 bp, Artificial sequence
  Synthetic oligonucleotide
taatgagggacgagatcttgcagtc

SEQ ID NO: 686493 - DNA, 25 bp, Artificial sequence
  Synthetic oligonucleotide
gagtagctctggtagcatgtgtaca

SEQ ID NO: 686494 - DNA, 25 bp, Artificial sequence
  Synthetic oligonucleotide
aattatccgtgatgcttgcaaatgg

SEQ ID NO: 686495 - DNA, 25 bp, Artificial sequence
  Synthetic oligonucleotide
aattatccgtgaagcttgcaaatgg

SEQ ID NO: 686496 - DNA, 25 bp, Artificial sequence
  Synthetic oligonucleotide
tagctgctgcttctgaagtatggaa

SEQ ID NO: 686497 - DNA, 25 bp, Artificial sequence
  Synthetic oligonucleotide
tctttttcactcaagattgggtctc

SEQ ID NO: 686498 - DNA, 25 bp, Artificial sequence
  Synthetic oligonucleotide
tactagtttgtctcattattgccga

SEQ ID NO: 686499 - DNA, 25 bp, Artificial sequence
  Synthetic oligonucleotide
tgcgcgatgattttgttgaaaaaga

SEQ ID NO: 686500 - DNA, 25 bp, Artificial sequence
  Synthetic oligonucleotide
acttcttcacatgcaccgtgcaatg

SEQ ID NO: 686501 - DNA, 25 bp, Artificial sequence
  Synthetic oligonucleotide
tagacagaagaaacatggtatgcac

SEQ ID NO: 686502 - DNA, 25 bp, Artificial sequence
  Synthetic oligonucleotide
tagacagaagaatcatggtatgcac

SEQ ID NO: 686503 - DNA, 25 bp, Artificial sequence
  Synthetic oligonucleotide
gctaaagctttaggtctatctggtg

SEQ ID NO: 686504 - DNA, 25 bp, Artificial sequence
  Synthetic oligonucleotide
gctaaagctttacgtctatctggtg

SEQ ID NO: 686505 - DNA, 25 bp, Artificial sequence
  Synthetic oligonucleotide
tactagtttgtcacattattgccga

SEQ ID NO: 686506 - DNA, 25 bp, Artificial sequence
  Synthetic oligonucleotide
cacgcgggtacactagtaggtaaac

SEQ ID NO: 686507 - DNA, 25 bp, Artificial sequence
  Synthetic oligonucleotide
cacgcgggtacagtagtaggtaaac

SEQ ID NO: 686508 - DNA, 25 bp, Artificial sequence
  Synthetic oligonucleotide
gacagggagtcaactttgggctttg

SEQ ID NO: 686509 - DNA, 25 bp, Artificial sequence
  Synthetic oligonucleotide
gacagggagtcatctttgggctttg

SEQ ID NO: 686510 - DNA, 25 bp, Artificial sequence
  Synthetic oligonucleotide
tacgtctagaggttctgcgaatccc

SEQ ID NO: 686511 - DNA, 25 bp, Artificial sequence
  Synthetic oligonucleotide
tagctgctgcttgtgaagtatggaa

SEQ ID NO: 686512 - DNA, 25 bp, Artificial sequence
  Synthetic oligonucleotide
tatcaacgggttccccaagcacgtt

SEQ ID NO: 686513 - DNA, 25 bp, Artificial sequence
  Synthetic oligonucleotide
caccagagcattctaaatattaggc

SEQ ID NO: 686514 - DNA, 25 bp, Artificial sequence
  Synthetic oligonucleotide
caccagagcattgtaaatattaggc

SEQ ID NO: 686515 - DNA, 25 bp, Artificial sequence
  Synthetic oligonucleotide
taatttcttgaccaagagtatctcg

SEQ ID NO: 686516 - DNA, 25 bp, Artificial sequence
  Synthetic oligonucleotide
taatttcttgacgaagagtatctcg

SEQ ID NO: 686517 - DNA, 25 bp, Artificial sequence
  Synthetic oligonucleotide
gattatttcctaataattgctgtac

SEQ ID NO: 686518 - DNA, 25 bp, Artificial sequence
  Synthetic oligonucleotide
gattatttcctattaattgctgtac

SEQ ID NO: 686519 - DNA, 25 bp, Artificial sequence
  Synthetic oligonucleotide
ttaaaccctctgacgcactcatagc

SEQ ID NO: 686520 - DNA, 25 bp, Artificial sequence
  Synthetic oligonucleotide
ttaaaccctctgtcgcactcatagc

SEQ ID NO: 686521 - DNA, 25 bp, Artificial sequence
  Synthetic oligonucleotide
gaggatttcccaaatcaaccacgtc

SEQ ID NO: 686522 - DNA, 25 bp, Artificial sequence
  Synthetic oligonucleotide
gaggatttcccatatcaaccacgtc

SEQ ID NO: 686523 - DNA, 25 bp, Artificial sequence
  Synthetic oligonucleotide
cctagagtcgctccgccgactggaa

SEQ ID NO: 686524 - DNA, 25 bp, Artificial sequence
  Synthetic oligonucleotide
gggtaatgtattagggttcaaagcc

SEQ ID NO: 686525 - DNA, 25 bp, Artificial sequence
  Synthetic oligonucleotide
tatcaacgggttgcccaagcacgtt

SEQ ID NO: 686526 - DNA, 25 bp, Artificial sequence
  Synthetic oligonucleotide
gggaaggctacatccagtaccggac

SEQ ID NO: 686527 - DNA, 25 bp, Artificial sequence
  Synthetic oligonucleotide
taggagatgttgtgcgagtatcgac

SEQ ID NO: 686528 - DNA, 25 bp, Artificial sequence
  Synthetic oligonucleotide
taggagatgttgagcgagtatcgac

SEQ ID NO: 686529 - DNA, 25 bp, Artificial sequence
  Synthetic oligonucleotide
tctaaaggtgacaacgatctgcact

SEQ ID NO: 686530 - DNA, 25 bp, Artificial sequence
  Synthetic oligonucleotide
tctaaaggtgactacgatctgcact

SEQ ID NO: 686531 - DNA, 25 bp, Artificial sequence
  Synthetic oligonucleotide
taaggatactaattataattgtact

SEQ ID NO: 686532 - DNA, 25 bp, Artificial sequence
  Synthetic oligonucleotide
taaggatactaaatataattgtact

SEQ ID NO: 686533 - DNA, 25 bp, Artificial sequence
  Synthetic oligonucleotide
tagttgcattgaatcttattttcgt

SEQ ID NO: 686534 - DNA, 25 bp, Artificial sequence
  Synthetic oligonucleotide
tagttgcattgattcttattttcgt

SEQ ID NO: 686535 - DNA, 25 bp, Artificial sequence
  Synthetic oligonucleotide
gataataactttataatcgatagta

SEQ ID NO: 686536 - DNA, 25 bp, Artificial sequence
  Synthetic oligonucleotide
gataataactttttaatcgatagta

SEQ ID NO: 686537 - DNA, 25 bp, Artificial sequence
  Synthetic oligonucleotide
gtatctaattctataaaagcaggcg

SEQ ID NO: 686538 - DNA, 25 bp, Artificial sequence
  Synthetic oligonucleotide
cctagagtcgctgcgccgactggaa

SEQ ID NO: 686539 - DNA, 25 bp, Artificial sequence
  Synthetic oligonucleotide
tgtgaactcccatccatttatgcgt

SEQ ID NO: 686540 - DNA, 25 bp, Artificial sequence
  Synthetic oligonucleotide
tacgtctagaggatctgcgaatccc

SEQ ID NO: 686541 - DNA, 25 bp, Artificial sequence
  Synthetic oligonucleotide
aaactttccaaggaccacctcatgg

SEQ ID NO: 686542 - DNA, 25 bp, Artificial sequence
  Synthetic oligonucleotide
aaactttccaagcaccacctcatgg

SEQ ID NO: 686543 - DNA, 25 bp, Artificial sequence
  Synthetic oligonucleotide
gataaattgaactagtatggacgtc

SEQ ID NO: 686544 - DNA, 25 bp, Artificial sequence
  Synthetic oligonucleotide
gataaattgaacaagtatggacgtc

SEQ ID NO: 686545 - DNA, 25 bp, Artificial sequence
  Synthetic oligonucleotide
gatgtactattaaaccaaaattggg

SEQ ID NO: 686546 - DNA, 25 bp, Artificial sequence
  Synthetic oligonucleotide
gatgtactattataccaaaattggg

SEQ ID NO: 686547 - DNA, 25 bp, Artificial sequence
  Synthetic oligonucleotide
cgcgaaaaactatggtagagcagtt

SEQ ID NO: 686548 - DNA, 25 bp, Artificial sequence
  Synthetic oligonucleotide
cgcgaaaaactaaggtagagcagtt

SEQ ID NO: 686549 - DNA, 25 bp, Artificial sequence
  Synthetic oligonucleotide
tctacgtggtggtcttgattttacc

SEQ ID NO: 686550 - DNA, 25 bp, Artificial sequence
  Synthetic oligonucleotide
tttttttcacgtttcgaaacctctg

SEQ ID NO: 686551 - DNA, 25 bp, Artificial sequence
  Synthetic oligonucleotide
tgtgaactcccaaccatttatgcgt

SEQ ID NO: 686552 - DNA, 25 bp, Artificial sequence
  Synthetic oligonucleotide
gggaaggctacaaccagtaccggac

SEQ ID NO: 686553 - DNA, 25 bp, Artificial sequence
  Synthetic oligonucleotide
cgtttcttatttagtgccgaagcta

SEQ ID NO: 686554 - DNA, 25 bp, Artificial sequence
  Synthetic oligonucleotide
cgtttcttattttgtgccgaagcta

SEQ ID NO: 686555 - DNA, 25 bp, Artificial sequence
  Synthetic oligonucleotide
caggctgaaacacgtgaaatcaaag

SEQ ID NO: 686556 - DNA, 25 bp, Artificial sequence
  Synthetic oligonucleotide
caggctgaaacaggtgaaatcaaag

SEQ ID NO: 686557 - DNA, 25 bp, Artificial sequence
  Synthetic oligonucleotide
tgctactgcgggaacatgcgaagaa

SEQ ID NO: 686558 - DNA, 25 bp, Artificial sequence
  Synthetic oligonucleotide
tgctactgcgggtacatgcgaagaa

SEQ ID NO: 686559 - DNA, 25 bp, Artificial sequence
  Synthetic oligonucleotide
agctgtatttgccagagaattggga

SEQ ID NO: 686560 - DNA, 25 bp, Artificial sequence
  Synthetic oligonucleotide
agctgtatttgcgagagaattggga

SEQ ID NO: 686561 - DNA, 25 bp, Artificial sequence
  Synthetic oligonucleotide
cgtaatgcatgagtacttaacaggg

SEQ ID NO: 686562 - DNA, 25 bp, Artificial sequence
  Synthetic oligonucleotide
cgtaatgcatgactacttaacaggg

SEQ ID NO: 686563 - DNA, 25 bp, Artificial sequence
  Synthetic oligonucleotide
tttttttcacgtatcgaaacctctg

SEQ ID NO: 686564 - DNA, 25 bp, Artificial sequence
  Synthetic oligonucleotide
ttttttgatagatacatacttaaat

SEQ ID NO: 686565 - DNA, 25 bp, Artificial sequence
  Synthetic oligonucleotide
tctacgtggtggacttgattttacc

SEQ ID NO: 686566 - DNA, 25 bp, Artificial sequence
  Synthetic oligonucleotide
ttttgcagcccaatcatgatgagtg

SEQ ID NO: 686567 - DNA, 25 bp, Artificial sequence
  Synthetic oligonucleotide
tgttttttggtttagttggccactg

SEQ ID NO: 686568 - DNA, 25 bp, Artificial sequence
  Synthetic oligonucleotide
tgctttgagggcgagagtgtacgat

SEQ ID NO: 686569 - DNA, 25 bp, Artificial sequence
  Synthetic oligonucleotide
tgctttgagggccagagtgtacgat

SEQ ID NO: 686570 - DNA, 25 bp, Artificial sequence
  Synthetic oligonucleotide
gaagttcgttgagagccttggagtt

SEQ ID NO: 686571 - DNA, 25 bp, Artificial sequence
  Synthetic oligonucleotide
gaagttcgttgacagccttggagtt

SEQ ID NO: 686572 - DNA, 25 bp, Artificial sequence
  Synthetic oligonucleotide
gaaagaggctggataactcaaggga

SEQ ID NO: 686573 - DNA, 25 bp, Artificial sequence
  Synthetic oligonucleotide
gaaagaggctggttaactcaaggga

SEQ ID NO: 686574 - DNA, 25 bp, Artificial sequence
  Synthetic oligonucleotide
cgtgttcgagcaacccgagatgact

SEQ ID NO: 686575 - DNA, 25 bp, Artificial sequence
  Synthetic oligonucleotide
cgtgttcgagcatcccgagatgact

SEQ ID NO: 686576 - DNA, 25 bp, Artificial sequence
  Synthetic oligonucleotide
tatggaatacggaaacatgcttgtg

SEQ ID NO: 686577 - DNA, 25 bp, Artificial sequence
  Synthetic oligonucleotide
tatggaatacggtaacatgcttgtg

SEQ ID NO: 686578 - DNA, 25 bp, Artificial sequence
  Synthetic oligonucleotide
gaatgtcaagagtgtccaacttgcc

SEQ ID NO: 686579 - DNA, 25 bp, Artificial sequence
  Synthetic oligonucleotide
cagccaggctgctttgggagacgca

SEQ ID NO: 686580 - DNA, 25 bp, Artificial sequence
  Synthetic oligonucleotide
catcggccgcggtactttctacggt

SEQ ID NO: 686581 - DNA, 25 bp, Artificial sequence
  Synthetic oligonucleotide
tggtttatttttgtcctttgtgtaa

SEQ ID NO: 686582 - DNA, 25 bp, Artificial sequence
  Synthetic oligonucleotide
taaacctgccagatcctgaagggtg

SEQ ID NO: 686583 - DNA, 25 bp, Artificial sequence
  Synthetic oligonucleotide
caaatctccgatcttgacccggttt

SEQ ID NO: 686584 - DNA, 25 bp, Artificial sequence
  Synthetic oligonucleotide
gcttattaatttcctgttttactcc

SEQ ID NO: 686585 - DNA, 25 bp, Artificial sequence
  Synthetic oligonucleotide
gcttattaatttgctgttttactcc

SEQ ID NO: 686586 - DNA, 25 bp, Artificial sequence
  Synthetic oligonucleotide
ggaacctgtgtcaacaacttttgag

SEQ ID NO: 686587 - DNA, 25 bp, Artificial sequence
  Synthetic oligonucleotide
ggaacctgtgtctacaacttttgag

SEQ ID NO: 686588 - DNA, 25 bp, Artificial sequence
  Synthetic oligonucleotide
catcggccgcggaactttctacggt

SEQ ID NO: 686589 - DNA, 25 bp, Artificial sequence
  Synthetic oligonucleotide
ggctgaaaactttgatccaacggct

SEQ ID NO: 686590 - DNA, 25 bp, Artificial sequence
  Synthetic oligonucleotide
tgttttttggttaagttggccactg

SEQ ID NO: 686591 - DNA, 25 bp, Artificial sequence
  Synthetic oligonucleotide
taaacctgccagttcctgaagggtg

SEQ ID NO: 686592 - DNA, 25 bp, Artificial sequence
  Synthetic oligonucleotide
agttaaacttacttgacttgcagga

SEQ ID NO: 686593 - DNA, 25 bp, Artificial sequence
  Synthetic oligonucleotide
agttaaacttacatgacttgcagga

SEQ ID NO: 686594 - DNA, 25 bp, Artificial sequence
  Synthetic oligonucleotide
taaaagagaaagtgaagaaaatgga

SEQ ID NO: 686595 - DNA, 25 bp, Artificial sequence
  Synthetic oligonucleotide
taaaagagaaagagaagaaaatgga

SEQ ID NO: 686596 - DNA, 25 bp, Artificial sequence
  Synthetic oligonucleotide
ccctgaaaatgtactatataggacc

SEQ ID NO: 686597 - DNA, 25 bp, Artificial sequence
  Synthetic oligonucleotide
ggctgaaaacttagatccaacggct

SEQ ID NO: 686598 - DNA, 25 bp, Artificial sequence
  Synthetic oligonucleotide
caagaagggaaacatgtgttgtctc

SEQ ID NO: 686599 - DNA, 25 bp, Artificial sequence
  Synthetic oligonucleotide
tctgatatgtgtatttggtgtggac

SEQ ID NO: 686600 - DNA, 25 bp, Artificial sequence
  Synthetic oligonucleotide
catgaacattgcagataacccaacc

SEQ ID NO: 686601 - DNA, 25 bp, Artificial sequence
  Synthetic oligonucleotide
cagtacactgtcaacaaccagatgg

SEQ ID NO: 686602 - DNA, 25 bp, Artificial sequence
  Synthetic oligonucleotide
cagtacactgtctacaaccagatgg

SEQ ID NO: 686603 - DNA, 25 bp, Artificial sequence
  Synthetic oligonucleotide
atcttgacgctggtgcgggtcgtat

SEQ ID NO: 686604 - DNA, 25 bp, Artificial sequence
  Synthetic oligonucleotide
cccaggaatgtacaacaaggaagag

SEQ ID NO: 686605 - DNA, 25 bp, Artificial sequence
  Synthetic oligonucleotide
caagaagggaaagatgtgttgtctc

SEQ ID NO: 686606 - DNA, 25 bp, Artificial sequence
  Synthetic oligonucleotide
cccaggaatgtagaacaaggaagag

SEQ ID NO: 686607 - DNA, 25 bp, Artificial sequence
  Synthetic oligonucleotide
tatccgtcagagctaccgtgaggca

SEQ ID NO: 686608 - DNA, 25 bp, Artificial sequence
  Synthetic oligonucleotide
tatccgtcagaggtaccgtgaggca

SEQ ID NO: 686609 - DNA, 25 bp, Artificial sequence
  Synthetic oligonucleotide
ttgagagtggaatcgcaggagaacc

SEQ ID NO: 686610 - DNA, 25 bp, Artificial sequence
  Synthetic oligonucleotide
ttgagagtggaaacgcaggagaacc

SEQ ID NO: 686611 - DNA, 25 bp, Artificial sequence
  Synthetic oligonucleotide
ttttgcagcccattcatgatgagtg

SEQ ID NO: 686612 - DNA, 25 bp, Artificial sequence
  Synthetic oligonucleotide
gctctctttcgacaagaatctaaaa

SEQ ID NO: 686613 - DNA, 25 bp, Artificial sequence
  Synthetic oligonucleotide
atcttgacgctgctgcgggtcgtat

SEQ ID NO: 686614 - DNA, 25 bp, Artificial sequence
  Synthetic oligonucleotide
tatcggtgtctggaagggtatcttc

SEQ ID NO: 686615 - DNA, 25 bp, Artificial sequence
  Synthetic oligonucleotide
gatcttgtcctcttttgttcccttt

SEQ ID NO: 686616 - DNA, 25 bp, Artificial sequence
  Synthetic oligonucleotide
ccctgaaaatgttctatataggacc

SEQ ID NO: 686617 - DNA, 25 bp, Artificial sequence
  Synthetic oligonucleotide
gttccctggtcaatctatcggtaag

SEQ ID NO: 686618 - DNA, 25 bp, Artificial sequence
  Synthetic oligonucleotide
gttccctggtcattctatcggtaag

SEQ ID NO: 686619 - DNA, 25 bp, Artificial sequence
  Synthetic oligonucleotide
gatcaaggacgatgacattgtcaca

SEQ ID NO: 686620 - DNA, 25 bp, Artificial sequence
  Synthetic oligonucleotide
catgaacattgctgataacccaacc

SEQ ID NO: 686621 - DNA, 25 bp, Artificial sequence
  Synthetic oligonucleotide
tatcggtgtctgcaagggtatcttc

SEQ ID NO: 686622 - DNA, 25 bp, Artificial sequence
  Synthetic oligonucleotide
tctgatatgtgtttttggtgtggac

SEQ ID NO: 686623 - DNA, 25 bp, Artificial sequence
  Synthetic oligonucleotide
ggagaagttctagtgggccccgacc

SEQ ID NO: 686624 - DNA, 25 bp, Artificial sequence
  Synthetic oligonucleotide
ggagaagttctactgggccccgacc

SEQ ID NO: 686625 - DNA, 25 bp, Artificial sequence
  Synthetic oligonucleotide
tatacgctcctctcatccgtgatgg

SEQ ID NO: 686626 - DNA, 25 bp, Artificial sequence
  Synthetic oligonucleotide
tatacgctcctcacatccgtgatgg

SEQ ID NO: 686627 - DNA, 25 bp, Artificial sequence
  Synthetic oligonucleotide
ccccatcatttggactggtaacgat

SEQ ID NO: 686628 - DNA, 25 bp, Artificial sequence
  Synthetic oligonucleotide
ccccatcatttgcactggtaacgat

SEQ ID NO: 686629 - DNA, 25 bp, Artificial sequence
  Synthetic oligonucleotide
gatcaaggacgaagacattgtcaca

SEQ ID NO: 686630 - DNA, 25 bp, Artificial sequence
  Synthetic oligonucleotide
tgtcatgttactgcatttttcaagc

SEQ ID NO: 686631 - DNA, 25 bp, Artificial sequence
  Synthetic oligonucleotide
gaggctaactatggcagggcttttg

SEQ ID NO: 686632 - DNA, 25 bp, Artificial sequence
  Synthetic oligonucleotide
gctgtttagtacctaaccgaagcaa

SEQ ID NO: 686633 - DNA, 25 bp, Artificial sequence
  Synthetic oligonucleotide
gctgtttagtacgtaaccgaagcaa

SEQ ID NO: 686634 - DNA, 25 bp, Artificial sequence
  Synthetic oligonucleotide
actgaaaattcttacggtcgacctc

SEQ ID NO: 686635 - DNA, 25 bp, Artificial sequence
  Synthetic oligonucleotide
actgaaaattctaacggtcgacctc

SEQ ID NO: 686636 - DNA, 25 bp, Artificial sequence
  Synthetic oligonucleotide
ggcggaactctgatgacacaatcat

SEQ ID NO: 686637 - DNA, 25 bp, Artificial sequence
  Synthetic oligonucleotide
ggcggaactctgttgacacaatcat

SEQ ID NO: 686638 - DNA, 25 bp, Artificial sequence
  Synthetic oligonucleotide
cctgtcttctattggtcttgaacga

SEQ ID NO: 686639 - DNA, 25 bp, Artificial sequence
  Synthetic oligonucleotide
cctgtcttctataggtcttgaacga

SEQ ID NO: 686640 - DNA, 25 bp, Artificial sequence
  Synthetic oligonucleotide
gaaatcctctgttgagactcaagac

SEQ ID NO: 686641 - DNA, 25 bp, Artificial sequence
  Synthetic oligonucleotide
gaaatcctctgtagagactcaagac

SEQ ID NO: 686642 - DNA, 25 bp, Artificial sequence
  Synthetic oligonucleotide
tcccggaaagttacgaagctcccat

SEQ ID NO: 686643 - DNA, 25 bp, Artificial sequence
  Synthetic oligonucleotide
tcccggaaagtttcgaagctcccat

SEQ ID NO: 686644 - DNA, 25 bp, Artificial sequence
  Synthetic oligonucleotide
tggtttatttttctcctttgtgtaa

SEQ ID NO: 686645 - DNA, 25 bp, Artificial sequence
  Synthetic oligonucleotide
gcagcttagaaaaagaatattcagc

SEQ ID NO: 686646 - DNA, 25 bp, Artificial sequence
  Synthetic oligonucleotide
gctctctttcgagaagaatctaaaa

SEQ ID NO: 686647 - DNA, 25 bp, Artificial sequence
  Synthetic oligonucleotide
cacatgagagaaaggttgagaaaac

SEQ ID NO: 686648 - DNA, 25 bp, Artificial sequence
  Synthetic oligonucleotide
gcaaaacagacattgttggcctcag

SEQ ID NO: 686649 - DNA, 25 bp, Artificial sequence
  Synthetic oligonucleotide
gcaaaacagacaatgttggcctcag

SEQ ID NO: 686650 - DNA, 25 bp, Artificial sequence
  Synthetic oligonucleotide
cggttaatgagtgtacaagagaaca

SEQ ID NO: 686651 - DNA, 25 bp, Artificial sequence
  Synthetic oligonucleotide
taaacaaagacctaacaaaacaagc

SEQ ID NO: 686652 - DNA, 25 bp, Artificial sequence
  Synthetic oligonucleotide
gcagcttagaaatagaatattcagc

SEQ ID NO: 686653 - DNA, 25 bp, Artificial sequence
  Synthetic oligonucleotide
taaacaaagaccaaacaaaacaagc

SEQ ID NO: 686654 - DNA, 25 bp, Artificial sequence
  Synthetic oligonucleotide
catgtagacaaatgaaattaggaat

SEQ ID NO: 686655 - DNA, 25 bp, Artificial sequence
  Synthetic oligonucleotide
catgtagacaaaagaaattaggaat

SEQ ID NO: 686656 - DNA, 25 bp, Artificial sequence
  Synthetic oligonucleotide
caattaagcatagtgatgaacaaca

SEQ ID NO: 686657 - DNA, 25 bp, Artificial sequence
  Synthetic oligonucleotide
caattaagcatactgatgaacaaca

SEQ ID NO: 686658 - DNA, 25 bp, Artificial sequence
  Synthetic oligonucleotide
tgtcatgttactccatttttcaagc

SEQ ID NO: 686659 - DNA, 25 bp, Artificial sequence
  Synthetic oligonucleotide
tcaggttttagatgtaacgaccttg

SEQ ID NO: 686660 - DNA, 25 bp, Artificial sequence
  Synthetic oligonucleotide
cggttaatgagtctacaagagaaca

SEQ ID NO: 686661 - DNA, 25 bp, Artificial sequence
  Synthetic oligonucleotide
cacactaggtaattgcttagacata

SEQ ID NO: 686662 - DNA, 25 bp, Artificial sequence
  Synthetic oligonucleotide
gaggctaactatcgcagggcttttg

SEQ ID NO: 686663 - DNA, 25 bp, Artificial sequence
  Synthetic oligonucleotide
tgtcgcattcacttgtaaagcaaga

SEQ ID NO: 686664 - DNA, 25 bp, Artificial sequence
  Synthetic oligonucleotide
tgtcgcattcacatgtaaagcaaga

SEQ ID NO: 686665 - DNA, 25 bp, Artificial sequence
  Synthetic oligonucleotide
actataggacaatactgaatccgga

SEQ ID NO: 686666 - DNA, 25 bp, Artificial sequence
  Synthetic oligonucleotide
actataggacaaaactgaatccgga

SEQ ID NO: 686667 - DNA, 25 bp, Artificial sequence
  Synthetic oligonucleotide
aacggagcactagaccattgactgg

SEQ ID NO: 686668 - DNA, 25 bp, Artificial sequence
  Synthetic oligonucleotide
aaatctgaggccaaatagcactaag

SEQ ID NO: 686669 - DNA, 25 bp, Artificial sequence
  Synthetic oligonucleotide
gatgaaatctgatacattgcttctc

SEQ ID NO: 686670 - DNA, 25 bp, Artificial sequence
  Synthetic oligonucleotide
cacactaggtaaatgcttagacata

SEQ ID NO: 686671 - DNA, 25 bp, Artificial sequence
  Synthetic oligonucleotide
gccttgtcataatctacacttctta

SEQ ID NO: 686672 - DNA, 25 bp, Artificial sequence
  Synthetic oligonucleotide
gccttgtcataaactacacttctta

SEQ ID NO: 686673 - DNA, 25 bp, Artificial sequence
  Synthetic oligonucleotide
tatgatgtacaagacattggtaatt

SEQ ID NO: 686674 - DNA, 25 bp, Artificial sequence
  Synthetic oligonucleotide
tatgatgtacaacacattggtaatt

SEQ ID NO: 686675 - DNA, 25 bp, Artificial sequence
  Synthetic oligonucleotide
gatcttgtcctcatttgttcccttt

SEQ ID NO: 686676 - DNA, 25 bp, Artificial sequence
  Synthetic oligonucleotide
aaatctgaggcctaatagcactaag

SEQ ID NO: 686677 - DNA, 25 bp, Artificial sequence
  Synthetic oligonucleotide
tgtgatcacaatactctttatttta

SEQ ID NO: 686678 - DNA, 25 bp, Artificial sequence
  Synthetic oligonucleotide
gaatgtcaagagagtccaacttgcc

SEQ ID NO: 686679 - DNA, 25 bp, Artificial sequence
  Synthetic oligonucleotide
tatggtcactagagcaacaagctat

SEQ ID NO: 686680 - DNA, 25 bp, Artificial sequence
  Synthetic oligonucleotide
tatggtcactagtgcaacaagctat

SEQ ID NO: 686681 - DNA, 25 bp, Artificial sequence
  Synthetic oligonucleotide
ggaaaacgaatctatttcctcagct

SEQ ID NO: 686682 - DNA, 25 bp, Artificial sequence
  Synthetic oligonucleotide
ggaaaacgaatcaatttcctcagct

SEQ ID NO: 686683 - DNA, 25 bp, Artificial sequence
  Synthetic oligonucleotide
aacggagcactacaccattgactgg

SEQ ID NO: 686684 - DNA, 25 bp, Artificial sequence
  Synthetic oligonucleotide
gaacatccatcaacatacatacata

SEQ ID NO: 686685 - DNA, 25 bp, Artificial sequence
  Synthetic oligonucleotide
tcaggttttagaagtaacgaccttg

SEQ ID NO: 686686 - DNA, 25 bp, Artificial sequence
  Synthetic oligonucleotide
tgtgatcacaattctctttatttta

SEQ ID NO: 686687 - DNA, 25 bp, Artificial sequence
  Synthetic oligonucleotide
cataattgtgtgaaagtgtatatat

SEQ ID NO: 686688 - DNA, 25 bp, Artificial sequence
  Synthetic oligonucleotide
cataattgtgtgtaagtgtatatat

SEQ ID NO: 686689 - DNA, 25 bp, Artificial sequence
  Synthetic oligonucleotide
gattgcaatctcaagactattagca

SEQ ID NO: 686690 - DNA, 25 bp, Artificial sequence
  Synthetic oligonucleotide
gattgcaatctctagactattagca

SEQ ID NO: 686691 - DNA, 25 bp, Artificial sequence
  Synthetic oligonucleotide
gatgaaatctgaaacattgcttctc

SEQ ID NO: 686692 - DNA, 25 bp, Artificial sequence
  Synthetic oligonucleotide
gaacatccatcatcatacatacata

SEQ ID NO: 686693 - DNA, 25 bp, Artificial sequence
  Synthetic oligonucleotide
caatgattttccaaagcatatgtgg

SEQ ID NO: 686694 - DNA, 25 bp, Artificial sequence
  Synthetic oligonucleotide
gcaatgtcattatccaaaattttgg

SEQ ID NO: 686695 - DNA, 25 bp, Artificial sequence
  Synthetic oligonucleotide
taaacatattccacgtggaccaatc

SEQ ID NO: 686696 - DNA, 25 bp, Artificial sequence
  Synthetic oligonucleotide
taaacatattcctcgtggaccaatc

SEQ ID NO: 686697 - DNA, 25 bp, Artificial sequence
  Synthetic oligonucleotide
cattggcacagaatagccatttgac

SEQ ID NO: 686698 - DNA, 25 bp, Artificial sequence
  Synthetic oligonucleotide
cattggcacagattagccatttgac

SEQ ID NO: 686699 - DNA, 25 bp, Artificial sequence
  Synthetic oligonucleotide
tcctaatcatcttcctcgtggcaac

SEQ ID NO: 686700 - DNA, 25 bp, Artificial sequence
  Synthetic oligonucleotide
taatgttataatcttcacttgaaaa

SEQ ID NO: 686701 - DNA, 25 bp, Artificial sequence
  Synthetic oligonucleotide
catcgtgtggcgttcagagagttaa

SEQ ID NO: 686702 - DNA, 25 bp, Artificial sequence
  Synthetic oligonucleotide
caatgattttcctaagcatatgtgg

SEQ ID NO: 686703 - DNA, 25 bp, Artificial sequence
  Synthetic oligonucleotide
gaatggcttacctcaatcctcaaaa

SEQ ID NO: 686704 - DNA, 25 bp, Artificial sequence
  Synthetic oligonucleotide
gaatggcttaccacaatcctcaaaa

SEQ ID NO: 686705 - DNA, 25 bp, Artificial sequence
  Synthetic oligonucleotide
cgtatgaagaagtgtgtagaagtat

SEQ ID NO: 686706 - DNA, 25 bp, Artificial sequence
  Synthetic oligonucleotide
cgtatgaagaagagtgtagaagtat

SEQ ID NO: 686707 - DNA, 25 bp, Artificial sequence
  Synthetic oligonucleotide
tctccattagtggtttaatgttact

SEQ ID NO: 686708 - DNA, 25 bp, Artificial sequence
  Synthetic oligonucleotide
taatgttataatgttcacttgaaaa

SEQ ID NO: 686709 - DNA, 25 bp, Artificial sequence
  Synthetic oligonucleotide
taagcttcttctactaccaatctaa

SEQ ID NO: 686710 - DNA, 25 bp, Artificial sequence
  Synthetic oligonucleotide
tctccattagtgctttaatgttact

SEQ ID NO: 686711 - DNA, 25 bp, Artificial sequence
  Synthetic oligonucleotide
gtgccatcaacacagctccggtaca

SEQ ID NO: 686712 - DNA, 25 bp, Artificial sequence
  Synthetic oligonucleotide
gtgccatcaacagagctccggtaca

SEQ ID NO: 686713 - DNA, 25 bp, Artificial sequence
  Synthetic oligonucleotide
agtcttgagatatggccgccgcagt

SEQ ID NO: 686714 - DNA, 25 bp, Artificial sequence
  Synthetic oligonucleotide
agtcttgagataaggccgccgcagt

SEQ ID NO: 686715 - DNA, 25 bp, Artificial sequence
  Synthetic oligonucleotide
tcctaatcatctacctcgtggcaac

SEQ ID NO: 686716 - DNA, 25 bp, Artificial sequence
  Synthetic oligonucleotide
cagcttcttgtgttgtgacgcatac

SEQ ID NO: 686717 - DNA, 25 bp, Artificial sequence
  Synthetic oligonucleotide
acatcggttattaggaacattatta

SEQ ID NO: 686718 - DNA, 25 bp, Artificial sequence
  Synthetic oligonucleotide
taagcttcttcttctaccaatctaa

SEQ ID NO: 686719 - DNA, 25 bp, Artificial sequence
  Synthetic oligonucleotide
taaatctctcagtttcttgctcaca

SEQ ID NO: 686720 - DNA, 25 bp, Artificial sequence
  Synthetic oligonucleotide
taaatctctcagattcttgctcaca

SEQ ID NO: 686721 - DNA, 25 bp, Artificial sequence
  Synthetic oligonucleotide
cgaagagataaccaattggttgttg

SEQ ID NO: 686722 - DNA, 25 bp, Artificial sequence
  Synthetic oligonucleotide
cgaagagataacgaattggttgttg

SEQ ID NO: 686723 - DNA, 25 bp, Artificial sequence
  Synthetic oligonucleotide
catcgtgtggcgatcagagagttaa

SEQ ID NO: 686724 - DNA, 25 bp, Artificial sequence
  Synthetic oligonucleotide
cagcttcttgtgatgtgacgcatac

SEQ ID NO: 686725 - DNA, 25 bp, Artificial sequence
  Synthetic oligonucleotide
tgtgaatatatacttttagatgagt

SEQ ID NO: 686726 - DNA, 25 bp, Artificial sequence
  Synthetic oligonucleotide
gcaatgtcattaaccaaaattttgg

SEQ ID NO: 686727 - DNA, 25 bp, Artificial sequence
  Synthetic oligonucleotide
gatatattcatattttcactatgaa

SEQ ID NO: 686728 - DNA, 25 bp, Artificial sequence
  Synthetic oligonucleotide
gatatattcataatttcactatgaa

SEQ ID NO: 686729 - DNA, 25 bp, Artificial sequence
  Synthetic oligonucleotide
ttattttaaaacaagtaaattcata

SEQ ID NO: 686730 - DNA, 25 bp, Artificial sequence
  Synthetic oligonucleotide
ttattttaaaactagtaaattcata

SEQ ID NO: 686731 - DNA, 25 bp, Artificial sequence
  Synthetic oligonucleotide
tataatcttattacatattttagca

SEQ ID NO: 686732 - DNA, 25 bp, Artificial sequence
  Synthetic oligonucleotide
tagtaactttgacggaacaataaac

SEQ ID NO: 686733 - DNA, 25 bp, Artificial sequence
  Synthetic oligonucleotide
tgcatgatgctatcttagcctcgac

SEQ ID NO: 686734 - DNA, 25 bp, Artificial sequence
  Synthetic oligonucleotide
tgtgaatatatagttttagatgagt

SEQ ID NO: 686735 - DNA, 25 bp, Artificial sequence
  Synthetic oligonucleotide
tttatagcttagagtagaaaacgat

SEQ ID NO: 686736 - DNA, 25 bp, Artificial sequence
  Synthetic oligonucleotide
tttatagcttagtgtagaaaacgat

SEQ ID NO: 686737 - DNA, 25 bp, Artificial sequence
  Synthetic oligonucleotide
ggatgagaaattataatgatcagac

SEQ ID NO: 686738 - DNA, 25 bp, Artificial sequence
  Synthetic oligonucleotide
ggatgagaaattttaatgatcagac

SEQ ID NO: 686739 - DNA, 25 bp, Artificial sequence
  Synthetic oligonucleotide
cacatgagagaatggttgagaaaac

SEQ ID NO: 686740 - DNA, 25 bp, Artificial sequence
  Synthetic oligonucleotide
tagtaactttgagggaacaataaac

SEQ ID NO: 686741 - DNA, 25 bp, Artificial sequence
  Synthetic oligonucleotide
aagttgcattaattagtttttagcg

SEQ ID NO: 686742 - DNA, 25 bp, Artificial sequence
  Synthetic oligonucleotide
acatcggttatttggaacattatta

SEQ ID NO: 686743 - DNA, 25 bp, Artificial sequence
  Synthetic oligonucleotide
tattggctaagcgaatttctctcca

SEQ ID NO: 686744 - DNA, 25 bp, Artificial sequence
  Synthetic oligonucleotide
tattggctaagccaatttctctcca

SEQ ID NO: 686745 - DNA, 25 bp, Artificial sequence
  Synthetic oligonucleotide
gtatctagagttctatataacaaaa

SEQ ID NO: 686746 - DNA, 25 bp, Artificial sequence
  Synthetic oligonucleotide
gtatctagagttgtatataacaaaa

SEQ ID NO: 686747 - DNA, 25 bp, Artificial sequence
  Synthetic oligonucleotide
tataatcttatttcatattttagca

SEQ ID NO: 686748 - DNA, 25 bp, Artificial sequence
  Synthetic oligonucleotide
ggttaatttgataaccacatacttg

SEQ ID NO: 686749 - DNA, 25 bp, Artificial sequence
  Synthetic oligonucleotide
tatgcattgcatcacttgtttttac

SEQ ID NO: 686750 - DNA, 25 bp, Artificial sequence
  Synthetic oligonucleotide
aagttgcattaaatagtttttagcg

SEQ ID NO: 686751 - DNA, 25 bp, Artificial sequence
  Synthetic oligonucleotide
tatgcattgcatgacttgtttttac

SEQ ID NO: 686752 - DNA, 25 bp, Artificial sequence
  Synthetic oligonucleotide
caaatctccgatgttgacccggttt

SEQ ID NO: 686753 - DNA, 25 bp, Artificial sequence
  Synthetic oligonucleotide
tacttcatcttctaaactatatatt

SEQ ID NO: 686754 - DNA, 25 bp, Artificial sequence
  Synthetic oligonucleotide
cagccaggctgcattgggagacgca

SEQ ID NO: 686755 - DNA, 25 bp, Artificial sequence
  Synthetic oligonucleotide
tgcatgatgctaacttagcctcgac

SEQ ID NO: 686756 - DNA, 25 bp, Artificial sequence
  Synthetic oligonucleotide
ggttaatttgattaccacatacttg

SEQ ID NO: 686757 - DNA, 25 bp, Artificial sequence
  Synthetic oligonucleotide
ccacgctgtcctaagctcatacgaa

SEQ ID NO: 686758 - DNA, 25 bp, Artificial sequence
  Synthetic oligonucleotide
tgttggctgtgatagaagacaaaca

SEQ ID NO: 686759 - DNA, 25 bp, Artificial sequence
  Synthetic oligonucleotide
tttaaaaattgtgtttacttcttga

SEQ ID NO: 686760 - DNA, 25 bp, Artificial sequence
  Synthetic oligonucleotide
tagatctctcattagttccataaag

SEQ ID NO: 686761 - DNA, 25 bp, Artificial sequence
  Synthetic oligonucleotide
tagatctctcataagttccataaag

SEQ ID NO: 686762 - DNA, 25 bp, Artificial sequence
  Synthetic oligonucleotide
caaggccttaggcagtaagttctca

SEQ ID NO: 686763 - DNA, 25 bp, Artificial sequence
  Synthetic oligonucleotide
caacttggacaacatgatggatggg

SEQ ID NO: 686764 - DNA, 25 bp, Artificial sequence
  Synthetic oligonucleotide
ccacgctgtccttagctcatacgaa

SEQ ID NO: 686765 - DNA, 25 bp, Artificial sequence
  Synthetic oligonucleotide
caacttggacaagatgatggatggg

SEQ ID NO: 686766 - DNA, 25 bp, Artificial sequence
  Synthetic oligonucleotide
ctctgtcttccatgctcctatggga

SEQ ID NO: 686767 - DNA, 25 bp, Artificial sequence
  Synthetic oligonucleotide
ctctgtcttccaagctcctatggga

SEQ ID NO: 686768 - DNA, 25 bp, Artificial sequence
  Synthetic oligonucleotide
tcaacaagacatgaccagaggcaag

SEQ ID NO: 686769 - DNA, 25 bp, Artificial sequence
  Synthetic oligonucleotide
tcaacaagacatcaccagaggcaag

SEQ ID NO: 686770 - DNA, 25 bp, Artificial sequence
  Synthetic oligonucleotide
cagatggagaggacttgcctacgac

SEQ ID NO: 686771 - DNA, 25 bp, Artificial sequence
  Synthetic oligonucleotide
cagatggagaggtcttgcctacgac

SEQ ID NO: 686772 - DNA, 25 bp, Artificial sequence
  Synthetic oligonucleotide
caaggccttagggagtaagttctca

SEQ ID NO: 686773 - DNA, 25 bp, Artificial sequence
  Synthetic oligonucleotide
tctcataggttccacttattttggg

SEQ ID NO: 686774 - DNA, 25 bp, Artificial sequence
  Synthetic oligonucleotide
tacttcatcttcaaaactatatatt

SEQ ID NO: 686775 - DNA, 25 bp, Artificial sequence
  Synthetic oligonucleotide
tcatggccaagatgggtatcaagtg

SEQ ID NO: 686776 - DNA, 25 bp, Artificial sequence
  Synthetic oligonucleotide
ttaacgctttgtccttatccaccac

SEQ ID NO: 686777 - DNA, 25 bp, Artificial sequence
  Synthetic oligonucleotide
tcatggccaagaagggtatcaagtg

SEQ ID NO: 686778 - DNA, 25 bp, Artificial sequence
  Synthetic oligonucleotide
gcaaaggtcaagctaaatccttcca

SEQ ID NO: 686779 - DNA, 25 bp, Artificial sequence
  Synthetic oligonucleotide
tttaaaaattgtctttacttcttga

SEQ ID NO: 686780 - DNA, 25 bp, Artificial sequence
  Synthetic oligonucleotide
tctcataggttcgacttattttggg

SEQ ID NO: 686781 - DNA, 25 bp, Artificial sequence
  Synthetic oligonucleotide
caagaacttcttcactctgcctaac

SEQ ID NO: 686782 - DNA, 25 bp, Artificial sequence
  Synthetic oligonucleotide
cacaactttattgatctttaaatgc

SEQ ID NO: 686783 - DNA, 25 bp, Artificial sequence
  Synthetic oligonucleotide
cacaactttattcatctttaaatgc

SEQ ID NO: 686784 - DNA, 25 bp, Artificial sequence
  Synthetic oligonucleotide
ttttcttttgagtattttttggtgc

SEQ ID NO: 686785 - DNA, 25 bp, Artificial sequence
  Synthetic oligonucleotide
caagaacttcttgactctgcctaac

SEQ ID NO: 686786 - DNA, 25 bp, Artificial sequence
  Synthetic oligonucleotide
gctcctgctttcttggacaagcttg

SEQ ID NO: 686787 - DNA, 25 bp, Artificial sequence
  Synthetic oligonucleotide
gctcctgctttcatggacaagcttg

SEQ ID NO: 686788 - DNA, 25 bp, Artificial sequence
  Synthetic oligonucleotide
gcaaaggtcaaggtaaatccttcca

SEQ ID NO: 686789 - DNA, 25 bp, Artificial sequence
  Synthetic oligonucleotide
gaatcactttgagattctctgacag

SEQ ID NO: 686790 - DNA, 25 bp, Artificial sequence
  Synthetic oligonucleotide
gtcttcaggactagtctataccttg

SEQ ID NO: 686791 - DNA, 25 bp, Artificial sequence
  Synthetic oligonucleotide
ttgaactgaaacagtagagactact

SEQ ID NO: 686792 - DNA, 25 bp, Artificial sequence
  Synthetic oligonucleotide
ttgaactgaaactgtagagactact

SEQ ID NO: 686793 - DNA, 25 bp, Artificial sequence
  Synthetic oligonucleotide
tagtagatgtgtataaatcgatgta

SEQ ID NO: 686794 - DNA, 25 bp, Artificial sequence
  Synthetic oligonucleotide
tagtagatgtgtttaaatcgatgta

SEQ ID NO: 686795 - DNA, 25 bp, Artificial sequence
  Synthetic oligonucleotide
gtcttcaggacttgtctataccttg

SEQ ID NO: 686796 - DNA, 25 bp, Artificial sequence
  Synthetic oligonucleotide
tcaggactttaactaggaaatctaa

SEQ ID NO: 686797 - DNA, 25 bp, Artificial sequence
  Synthetic oligonucleotide
tgcttcttttattctctacttgtga

SEQ ID NO: 686798 - DNA, 25 bp, Artificial sequence
  Synthetic oligonucleotide
tgttggctgtgaaagaagacaaaca

SEQ ID NO: 686799 - DNA, 25 bp, Artificial sequence
  Synthetic oligonucleotide
ttttcttttgagaattttttggtgc

SEQ ID NO: 686800 - DNA, 25 bp, Artificial sequence
  Synthetic oligonucleotide
gaatcactttgacattctctgacag

SEQ ID NO: 686801 - DNA, 25 bp, Artificial sequence
  Synthetic oligonucleotide
ggtttttacaaaaatagctcaagaa

SEQ ID NO: 686802 - DNA, 25 bp, Artificial sequence
  Synthetic oligonucleotide
ggtttttacaaatatagctcaagaa

SEQ ID NO: 686803 - DNA, 25 bp, Artificial sequence
  Synthetic oligonucleotide
ttaacgctttgtgcttatccaccac

SEQ ID NO: 686804 - DNA, 25 bp, Artificial sequence
  Synthetic oligonucleotide
tgcttcttttatactctacttgtga

SEQ ID NO: 686805 - DNA, 25 bp, Artificial sequence
  Synthetic oligonucleotide
cacagagcaacatgaagagcaacgg

SEQ ID NO: 686806 - DNA, 25 bp, Artificial sequence
  Synthetic oligonucleotide
tcaggatcaggagctgtatcagccc

SEQ ID NO: 686807 - DNA, 25 bp, Artificial sequence
  Synthetic oligonucleotide
tcaggactttaagtaggaaatctaa

SEQ ID NO: 686808 - DNA, 25 bp, Artificial sequence
  Synthetic oligonucleotide
tcttgggaaagatagttgtaactgt

SEQ ID NO: 686809 - DNA, 25 bp, Artificial sequence
  Synthetic oligonucleotide
cggtttggttcggttcagttcctga

SEQ ID NO: 686810 - DNA, 25 bp, Artificial sequence
  Synthetic oligonucleotide
tcttgggaaagaaagttgtaactgt

SEQ ID NO: 686811 - DNA, 25 bp, Artificial sequence
  Synthetic oligonucleotide
cacagagcaacaagaagagcaacgg

SEQ ID NO: 686812 - DNA, 25 bp, Artificial sequence
  Synthetic oligonucleotide
tcaggatcaggacctgtatcagccc

SEQ ID NO: 686813 - DNA, 25 bp, Artificial sequence
  Synthetic oligonucleotide
ttttgtgtgtgtgttgcagttgagc

SEQ ID NO: 686814 - DNA, 25 bp, Artificial sequence
  Synthetic oligonucleotide
taaaccaaacttcaattcatgattg

SEQ ID NO: 686815 - DNA, 25 bp, Artificial sequence
  Synthetic oligonucleotide
taaaccaaacttgaattcatgattg

SEQ ID NO: 686816 - DNA, 25 bp, Artificial sequence
  Synthetic oligonucleotide
tccttaggaatactctctaaaccgg

SEQ ID NO: 686817 - DNA, 25 bp, Artificial sequence
  Synthetic oligonucleotide
tccttaggaatagtctctaaaccgg

SEQ ID NO: 686818 - DNA, 25 bp, Artificial sequence
  Synthetic oligonucleotide
cggtttggttcgcttcagttcctga

SEQ ID NO: 686819 - DNA, 25 bp, Artificial sequence
  Synthetic oligonucleotide
ttttgtgtgtgtcttgcagttgagc

SEQ ID NO: 686820 - DNA, 25 bp, Artificial sequence
  Synthetic oligonucleotide
gacaggaccattggagaacttggca

SEQ ID NO: 686821 - DNA, 25 bp, Artificial sequence
  Synthetic oligonucleotide
tgtgtaatgaaacacagatttgtga

SEQ ID NO: 686822 - DNA, 25 bp, Artificial sequence
  Synthetic oligonucleotide
gacaggaccattcgagaacttggca

SEQ ID NO: 686823 - DNA, 25 bp, Artificial sequence
  Synthetic oligonucleotide
cgtttgtaggattctgtgtgcaaca

SEQ ID NO: 686824 - DNA, 25 bp, Artificial sequence
  Synthetic oligonucleotide
gatccatggcacaacaacattggcg

SEQ ID NO: 686825 - DNA, 25 bp, Artificial sequence
  Synthetic oligonucleotide
cgtttgtaggatactgtgtgcaaca

SEQ ID NO: 686826 - DNA, 25 bp, Artificial sequence
  Synthetic oligonucleotide
gatccatggcactacaacattggcg

SEQ ID NO: 686827 - DNA, 25 bp, Artificial sequence
  Synthetic oligonucleotide
cttggtgggtgttacagggcggctt

SEQ ID NO: 686828 - DNA, 25 bp, Artificial sequence
  Synthetic oligonucleotide
tatccctttcaagtaatgaatgtaa

SEQ ID NO: 686829 - DNA, 25 bp, Artificial sequence
  Synthetic oligonucleotide
tatccctttcaactaatgaatgtaa

SEQ ID NO: 686830 - DNA, 25 bp, Artificial sequence
  Synthetic oligonucleotide
tgtgtaccttatcagctttatgtgt

SEQ ID NO: 686831 - DNA, 25 bp, Artificial sequence
  Synthetic oligonucleotide
tgtgtaatgaaagacagatttgtga

SEQ ID NO: 686832 - DNA, 25 bp, Artificial sequence
  Synthetic oligonucleotide
ttgtcttggtgaacgaatgctcgtg

SEQ ID NO: 686833 - DNA, 25 bp, Artificial sequence
  Synthetic oligonucleotide
ttgtcttggtgatcgaatgctcgtg

SEQ ID NO: 686834 - DNA, 25 bp, Artificial sequence
  Synthetic oligonucleotide
taagtgatgaaccttttgaacccaa

SEQ ID NO: 686835 - DNA, 25 bp, Artificial sequence
  Synthetic oligonucleotide
cttggtgggtgtaacagggcggctt

SEQ ID NO: 686836 - DNA, 25 bp, Artificial sequence
  Synthetic oligonucleotide
ggtactttgcccacaatcttggcca

SEQ ID NO: 686837 - DNA, 25 bp, Artificial sequence
  Synthetic oligonucleotide
taagtgatgaacgttttgaacccaa

SEQ ID NO: 686838 - DNA, 25 bp, Artificial sequence
  Synthetic oligonucleotide
tctcatgcttcctacagaagaaaca

SEQ ID NO: 686839 - DNA, 25 bp, Artificial sequence
  Synthetic oligonucleotide
catgactatttgatagatttctcaa

SEQ ID NO: 686840 - DNA, 25 bp, Artificial sequence
  Synthetic oligonucleotide
tctcatgcttccaacagaagaaaca

SEQ ID NO: 686841 - DNA, 25 bp, Artificial sequence
  Synthetic oligonucleotide
tgtgtaccttatgagctttatgtgt

SEQ ID NO: 686842 - DNA, 25 bp, Artificial sequence
  Synthetic oligonucleotide
gccattgcatttgttgagcaccaga

SEQ ID NO: 686843 - DNA, 25 bp, Artificial sequence
  Synthetic oligonucleotide
agtttaatctaaaggacttggtggg

SEQ ID NO: 686844 - DNA, 25 bp, Artificial sequence
  Synthetic oligonucleotide
agtttaatctaatggacttggtggg

SEQ ID NO: 686845 - DNA, 25 bp, Artificial sequence
  Synthetic oligonucleotide
ttacagattttaattcatatatggc

SEQ ID NO: 686846 - DNA, 25 bp, Artificial sequence
  Synthetic oligonucleotide
catgactatttgttagatttctcaa

SEQ ID NO: 686847 - DNA, 25 bp, Artificial sequence
  Synthetic oligonucleotide
cctgggattttggtaccagaagcat

SEQ ID NO: 686848 - DNA, 25 bp, Artificial sequence
  Synthetic oligonucleotide
cctgggattttgctaccagaagcat

SEQ ID NO: 686849 - DNA, 25 bp, Artificial sequence
  Synthetic oligonucleotide
gaaactgggttaaggctcaggaatg

SEQ ID NO: 686850 - DNA, 25 bp, Artificial sequence
  Synthetic oligonucleotide
gaaactgggttatggctcaggaatg

SEQ ID NO: 686851 - DNA, 25 bp, Artificial sequence
  Synthetic oligonucleotide
gggtcaagccacatacttgggaaac

SEQ ID NO: 686852 - DNA, 25 bp, Artificial sequence
  Synthetic oligonucleotide
gccattgcatttcttgagcaccaga

SEQ ID NO: 686853 - DNA, 25 bp, Artificial sequence
  Synthetic oligonucleotide
ggtactttgccctcaatcttggcca

SEQ ID NO: 686854 - DNA, 25 bp, Artificial sequence
  Synthetic oligonucleotide
tgtacaaatgtaaatctaatgttgg

SEQ ID NO: 686855 - DNA, 25 bp, Artificial sequence
  Synthetic oligonucleotide
gaccctgagaagaagaagtacccgg

SEQ ID NO: 686856 - DNA, 25 bp, Artificial sequence
  Synthetic oligonucleotide
gaccctgagaagtagaagtacccgg

SEQ ID NO: 686857 - DNA, 25 bp, Artificial sequence
  Synthetic oligonucleotide
gaccctcttggaaactcgaaggacc

SEQ ID NO: 686858 - DNA, 25 bp, Artificial sequence
  Synthetic oligonucleotide
gaccctcttggatactcgaaggacc

SEQ ID NO: 686859 - DNA, 25 bp, Artificial sequence
  Synthetic oligonucleotide
cgaggaattgaaagttaaagagatc

SEQ ID NO: 686860 - DNA, 25 bp, Artificial sequence
  Synthetic oligonucleotide
cgaggaattgaatgttaaagagatc

SEQ ID NO: 686861 - DNA, 25 bp, Artificial sequence
  Synthetic oligonucleotide
taagcacacacaacaacttaccttt

SEQ ID NO: 686862 - DNA, 25 bp, Artificial sequence
  Synthetic oligonucleotide
taagcacacacatcaacttaccttt

SEQ ID NO: 686863 - DNA, 25 bp, Artificial sequence
  Synthetic oligonucleotide
tgtacaaatgtatatctaatgttgg

SEQ ID NO: 686864 - DNA, 25 bp, Artificial sequence
  Synthetic oligonucleotide
gggtcaagccacttacttgggaaac

SEQ ID NO: 686865 - DNA, 25 bp, Artificial sequence
  Synthetic oligonucleotide
aaattttcaccaatctcttccaata

SEQ ID NO: 686866 - DNA, 25 bp, Artificial sequence
  Synthetic oligonucleotide
tcaactataaagtttaaatgagaca

SEQ ID NO: 686867 - DNA, 25 bp, Artificial sequence
  Synthetic oligonucleotide
acatctttgacaatcaatggttccc

SEQ ID NO: 686868 - DNA, 25 bp, Artificial sequence
  Synthetic oligonucleotide
acatctttgacattcaatggttccc

SEQ ID NO: 686869 - DNA, 25 bp, Artificial sequence
  Synthetic oligonucleotide
ttgagctagaatatgaagaaaaatc

SEQ ID NO: 686870 - DNA, 25 bp, Artificial sequence
  Synthetic oligonucleotide
ttacagattttatttcatatatggc

SEQ ID NO: 686871 - DNA, 25 bp, Artificial sequence
  Synthetic oligonucleotide
tatatgattttcacaatttaattca

SEQ ID NO: 686872 - DNA, 25 bp, Artificial sequence
  Synthetic oligonucleotide
tatatgattttctcaatttaattca

SEQ ID NO: 686873 - DNA, 25 bp, Artificial sequence
  Synthetic oligonucleotide
tcaagtaatcagtatttcaaataat

SEQ ID NO: 686874 - DNA, 25 bp, Artificial sequence
  Synthetic oligonucleotide
tcaagtaatcagaatttcaaataat

SEQ ID NO: 686875 - DNA, 25 bp, Artificial sequence
  Synthetic oligonucleotide
ttgagctagaatttgaagaaaaatc

SEQ ID NO: 686876 - DNA, 25 bp, Artificial sequence
  Synthetic oligonucleotide
cttaaagaaaactttagatttgaca

SEQ ID NO: 686877 - DNA, 25 bp, Artificial sequence
  Synthetic oligonucleotide
cagagtcttggaaagttttgtcttc

SEQ ID NO: 686878 - DNA, 25 bp, Artificial sequence
  Synthetic oligonucleotide
aaattttcaccattctcttccaata

SEQ ID NO: 686879 - DNA, 25 bp, Artificial sequence
  Synthetic oligonucleotide
ggagctatcttcgtaatcatatcca

SEQ ID NO: 686880 - DNA, 25 bp, Artificial sequence
  Synthetic oligonucleotide
ggagctatcttcctaatcatatcca

SEQ ID NO: 686881 - DNA, 25 bp, Artificial sequence
  Synthetic oligonucleotide
tgagatagaaacttgagctgcgtgg

SEQ ID NO: 686882 - DNA, 25 bp, Artificial sequence
  Synthetic oligonucleotide
tgagatagaaacatgagctgcgtgg

SEQ ID NO: 686883 - DNA, 25 bp, Artificial sequence
  Synthetic oligonucleotide
ttttttctgtctcattgacccaaag

SEQ ID NO: 686884 - DNA, 25 bp, Artificial sequence
  Synthetic oligonucleotide
ttttttctgtctgattgacccaaag

SEQ ID NO: 686885 - DNA, 25 bp, Artificial sequence
  Synthetic oligonucleotide
cattgtacgttttgtgaaagattca

SEQ ID NO: 686886 - DNA, 25 bp, Artificial sequence
  Synthetic oligonucleotide
tatccaatctttctcttatcataag

SEQ ID NO: 686887 - DNA, 25 bp, Artificial sequence
  Synthetic oligonucleotide
cttaaagaaaacattagatttgaca

SEQ ID NO: 686888 - DNA, 25 bp, Artificial sequence
  Synthetic oligonucleotide
catattgaacaataacaatcctgtt

SEQ ID NO: 686889 - DNA, 25 bp, Artificial sequence
  Synthetic oligonucleotide
catactataaacaccataacagaag

SEQ ID NO: 686890 - DNA, 25 bp, Artificial sequence
  Synthetic oligonucleotide
catgattatttgatagagttctcaa

SEQ ID NO: 686891 - DNA, 25 bp, Artificial sequence
  Synthetic oligonucleotide
catgattatttgttagagttctcaa

SEQ ID NO: 686892 - DNA, 25 bp, Artificial sequence
  Synthetic oligonucleotide
ccaaatatgcttattgtttatatca

SEQ ID NO: 686893 - DNA, 25 bp, Artificial sequence
  Synthetic oligonucleotide
ccaaatatgctttttgtttatatca

SEQ ID NO: 686894 - DNA, 25 bp, Artificial sequence
  Synthetic oligonucleotide
ggttattgaaccacaccaagataca

SEQ ID NO: 686895 - DNA, 25 bp, Artificial sequence
  Synthetic oligonucleotide
ggttattgaacctcaccaagataca

SEQ ID NO: 686896 - DNA, 25 bp, Artificial sequence
  Synthetic oligonucleotide
catttgagttttgatgaatattttc

SEQ ID NO: 686897 - DNA, 25 bp, Artificial sequence
  Synthetic oligonucleotide
catttgagttttcatgaatattttc

SEQ ID NO: 686898 - DNA, 25 bp, Artificial sequence
  Synthetic oligonucleotide
tcaactataaagattaaatgagaca

SEQ ID NO: 686899 - DNA, 25 bp, Artificial sequence
  Synthetic oligonucleotide
ttccccctcattattaccttctaca

SEQ ID NO: 686900 - DNA, 25 bp, Artificial sequence
  Synthetic oligonucleotide
cagagtcttggatagttttgtcttc

SEQ ID NO: 686901 - DNA, 25 bp, Artificial sequence
  Synthetic oligonucleotide
catattgaacaaaaacaatcctgtt

SEQ ID NO: 686902 - DNA, 25 bp, Artificial sequence
  Synthetic oligonucleotide
tcttttctagtataatcatttaagg

SEQ ID NO: 686903 - DNA, 25 bp, Artificial sequence
  Synthetic oligonucleotide
tcttttctagtaaaatcatttaagg

SEQ ID NO: 686904 - DNA, 25 bp, Artificial sequence
  Synthetic oligonucleotide
aattagttgatgactttcttatcac

SEQ ID NO: 686905 - DNA, 25 bp, Artificial sequence
  Synthetic oligonucleotide
aattagttgatgtctttcttatcac

SEQ ID NO: 686906 - DNA, 25 bp, Artificial sequence
  Synthetic oligonucleotide
tatacttctacttatttttcttttg

SEQ ID NO: 686907 - DNA, 25 bp, Artificial sequence
  Synthetic oligonucleotide
tatacttctactaatttttcttttg

SEQ ID NO: 686908 - DNA, 25 bp, Artificial sequence
  Synthetic oligonucleotide
taatcttcacctacaaaatagagta

SEQ ID NO: 686909 - DNA, 25 bp, Artificial sequence
  Synthetic oligonucleotide
taatcttcaccttcaaaatagagta

SEQ ID NO: 686910 - DNA, 25 bp, Artificial sequence
  Synthetic oligonucleotide
catactataaactccataacagaag

SEQ ID NO: 686911 - DNA, 25 bp, Artificial sequence
  Synthetic oligonucleotide
ttccccctcatttttaccttctaca

SEQ ID NO: 686912 - DNA, 25 bp, Artificial sequence
  Synthetic oligonucleotide
tgttcgttgatcgaagttttaccgg

SEQ ID NO: 686913 - DNA, 25 bp, Artificial sequence
  Synthetic oligonucleotide
aatagtaatatacgtagattctgct

SEQ ID NO: 686914 - DNA, 25 bp, Artificial sequence
  Synthetic oligonucleotide
tatgctcattcatatcctgattgag

SEQ ID NO: 686915 - DNA, 25 bp, Artificial sequence
  Synthetic oligonucleotide
tatgctcattcaaatcctgattgag

SEQ ID NO: 686916 - DNA, 25 bp, Artificial sequence
  Synthetic oligonucleotide
gaaacttagttcgaaagattctgaa

SEQ ID NO: 686917 - DNA, 25 bp, Artificial sequence
  Synthetic oligonucleotide
gaaacttagttccaaagattctgaa

SEQ ID NO: 686918 - DNA, 25 bp, Artificial sequence
  Synthetic oligonucleotide
acagtgtgtctggaaatggtattct

SEQ ID NO: 686919 - DNA, 25 bp, Artificial sequence
  Synthetic oligonucleotide
acagtgtgtctgcaaatggtattct

SEQ ID NO: 686920 - DNA, 25 bp, Artificial sequence
  Synthetic oligonucleotide
tgtctaaacacgatgtctcaaaatg

SEQ ID NO: 686921 - DNA, 25 bp, Artificial sequence
  Synthetic oligonucleotide
tgtctaaacacgttgtctcaaaatg

SEQ ID NO: 686922 - DNA, 25 bp, Artificial sequence
  Synthetic oligonucleotide
ttgtttctgacttagagacatgaag

SEQ ID NO: 686923 - DNA, 25 bp, Artificial sequence
  Synthetic oligonucleotide
tagatactccttacaagacatatga

SEQ ID NO: 686924 - DNA, 25 bp, Artificial sequence
  Synthetic oligonucleotide
ggtttatgtgtgaagtagtgctagt

SEQ ID NO: 686925 - DNA, 25 bp, Artificial sequence
  Synthetic oligonucleotide
tgttcgttgatccaagttttaccgg

SEQ ID NO: 686926 - DNA, 25 bp, Artificial sequence
  Synthetic oligonucleotide
tctccagtcttaccaataaatccag

SEQ ID NO: 686927 - DNA, 25 bp, Artificial sequence
  Synthetic oligonucleotide
tctccagtcttagcaataaatccag

SEQ ID NO: 686928 - DNA, 25 bp, Artificial sequence
  Synthetic oligonucleotide
caatcgcagatttaccggtccgggt

SEQ ID NO: 686929 - DNA, 25 bp, Artificial sequence
  Synthetic oligonucleotide
caatcgcagattaaccggtccgggt

SEQ ID NO: 686930 - DNA, 25 bp, Artificial sequence
  Synthetic oligonucleotide
cattagtagaaaagtgtttcaccga

SEQ ID NO: 686931 - DNA, 25 bp, Artificial sequence
  Synthetic oligonucleotide
cattagtagaaatgtgtttcaccga

SEQ ID NO: 686932 - DNA, 25 bp, Artificial sequence
  Synthetic oligonucleotide
tatctgatagcaactcgttgcagtg

SEQ ID NO: 686933 - DNA, 25 bp, Artificial sequence
  Synthetic oligonucleotide
tatctgatagcatctcgttgcagtg

SEQ ID NO: 686934 - DNA, 25 bp, Artificial sequence
  Synthetic oligonucleotide
tagatactcctttcaagacatatga

SEQ ID NO: 686935 - DNA, 25 bp, Artificial sequence
  Synthetic oligonucleotide
caatacttggttattgtgatgatgg

SEQ ID NO: 686936 - DNA, 25 bp, Artificial sequence
  Synthetic oligonucleotide
tatccaatctttgtcttatcataag

SEQ ID NO: 686937 - DNA, 25 bp, Artificial sequence
  Synthetic oligonucleotide
tattgggtattcatatttcagaaag

SEQ ID NO: 686938 - DNA, 25 bp, Artificial sequence
  Synthetic oligonucleotide
taaagagtattccaattggccgacg

SEQ ID NO: 686939 - DNA, 25 bp, Artificial sequence
  Synthetic oligonucleotide
taaagagtattcgaattggccgacg

SEQ ID NO: 686940 - DNA, 25 bp, Artificial sequence
  Synthetic oligonucleotide
tatatcggcggtgagtttttcggtg

SEQ ID NO: 686941 - DNA, 25 bp, Artificial sequence
  Synthetic oligonucleotide
tatatcggcggtcagtttttcggtg

SEQ ID NO: 686942 - DNA, 25 bp, Artificial sequence
  Synthetic oligonucleotide
tactcttgaggcgtttaagactgga

SEQ ID NO: 686943 - DNA, 25 bp, Artificial sequence
  Synthetic oligonucleotide
tactcttgaggcctttaagactgga

SEQ ID NO: 686944 - DNA, 25 bp, Artificial sequence
  Synthetic oligonucleotide
aagaggtggagatagctatgtgctc

SEQ ID NO: 686945 - DNA, 25 bp, Artificial sequence
  Synthetic oligonucleotide
ttgtttctgactaagagacatgaag

SEQ ID NO: 686946 - DNA, 25 bp, Artificial sequence
  Synthetic oligonucleotide
caatacttggtttttgtgatgatgg

SEQ ID NO: 686947 - DNA, 25 bp, Artificial sequence
  Synthetic oligonucleotide
tgtgttggcctggaaatttgtgttg

SEQ ID NO: 686948 - DNA, 25 bp, Artificial sequence
  Synthetic oligonucleotide
tatctatctatcaatcacctgggaa

SEQ ID NO: 686949 - DNA, 25 bp, Artificial sequence
  Synthetic oligonucleotide
tatctatctatctatcacctgggaa

SEQ ID NO: 686950 - DNA, 25 bp, Artificial sequence
  Synthetic oligonucleotide
gatgtttcagagtttgtggttgtaa

SEQ ID NO: 686951 - DNA, 25 bp, Artificial sequence
  Synthetic oligonucleotide
gatgtttcagagattgtggttgtaa

SEQ ID NO: 686952 - DNA, 25 bp, Artificial sequence
  Synthetic oligonucleotide
catatattgtatgatggatttaggt

SEQ ID NO: 686953 - DNA, 25 bp, Artificial sequence
  Synthetic oligonucleotide
catatattgtatcatggatttaggt

SEQ ID NO: 686954 - DNA, 25 bp, Artificial sequence
  Synthetic oligonucleotide
ggagttgcttggtatttgagtttcc

SEQ ID NO: 686955 - DNA, 25 bp, Artificial sequence
  Synthetic oligonucleotide
tgtgttggcctgcaaatttgtgttg

SEQ ID NO: 686956 - DNA, 25 bp, Artificial sequence
  Synthetic oligonucleotide
ggtttatgtgtgtagtagtgctagt

SEQ ID NO: 686957 - DNA, 25 bp, Artificial sequence
  Synthetic oligonucleotide
aagaggtggagaaagctatgtgctc

SEQ ID NO: 686958 - DNA, 25 bp, Artificial sequence
  Synthetic oligonucleotide
cagtttttctaagttattgggtaca

SEQ ID NO: 686959 - DNA, 25 bp, Artificial sequence
  Synthetic oligonucleotide
ccttgacggttctgctcctgggtac

SEQ ID NO: 686960 - DNA, 25 bp, Artificial sequence
  Synthetic oligonucleotide
tactctgttttgatgctcagtttgg

SEQ ID NO: 686961 - DNA, 25 bp, Artificial sequence
  Synthetic oligonucleotide
tactctgttttgttgctcagtttgg

SEQ ID NO: 686962 - DNA, 25 bp, Artificial sequence
  Synthetic oligonucleotide
tagattactctgttttgatgacatg

SEQ ID NO: 686963 - DNA, 25 bp, Artificial sequence
  Synthetic oligonucleotide
tagattactctgatttgatgacatg

SEQ ID NO: 686964 - DNA, 25 bp, Artificial sequence
  Synthetic oligonucleotide
cattgtacgtttagtgaaagattca

SEQ ID NO: 686965 - DNA, 25 bp, Artificial sequence
  Synthetic oligonucleotide
tattgggtattcttatttcagaaag

SEQ ID NO: 686966 - DNA, 25 bp, Artificial sequence
  Synthetic oligonucleotide
cagaatttgaattccctttagttgt

SEQ ID NO: 686967 - DNA, 25 bp, Artificial sequence
  Synthetic oligonucleotide
cagaatttgaataccctttagttgt

SEQ ID NO: 686968 - DNA, 25 bp, Artificial sequence
  Synthetic oligonucleotide
ccttgacggttcagctcctgggtac

SEQ ID NO: 686969 - DNA, 25 bp, Artificial sequence
  Synthetic oligonucleotide
aagggttctgatttcaacattggag

SEQ ID NO: 686970 - DNA, 25 bp, Artificial sequence
  Synthetic oligonucleotide
ttctagatagataactggaacctct

SEQ ID NO: 686971 - DNA, 25 bp, Artificial sequence
  Synthetic oligonucleotide
cagtttttctaacttattgggtaca

SEQ ID NO: 686972 - DNA, 25 bp, Artificial sequence
  Synthetic oligonucleotide
gactttgggtttgacccacttggac

SEQ ID NO: 686973 - DNA, 25 bp, Artificial sequence
  Synthetic oligonucleotide
gactttgggtttcacccacttggac

SEQ ID NO: 686974 - DNA, 25 bp, Artificial sequence
  Synthetic oligonucleotide
ccagcgaaccttgagagatacaaag

SEQ ID NO: 686975 - DNA, 25 bp, Artificial sequence
  Synthetic oligonucleotide
ccagcgaaccttcagagatacaaag

SEQ ID NO: 686976 - DNA, 25 bp, Artificial sequence
  Synthetic oligonucleotide
aatagtaatataggtagattctgct

SEQ ID NO: 686977 - DNA, 25 bp, Artificial sequence
  Synthetic oligonucleotide
ggagttgcttggaatttgagtttcc

SEQ ID NO: 686978 - DNA, 25 bp, Artificial sequence
  Synthetic oligonucleotide
tccactgtagatgggctatgctcgc

SEQ ID NO: 686979 - DNA, 25 bp, Artificial sequence
  Synthetic oligonucleotide
tccactgtagatcggctatgctcgc

SEQ ID NO: 686980 - DNA, 25 bp, Artificial sequence
  Synthetic oligonucleotide
ttctagatagattactggaacctct

SEQ ID NO: 686981 - DNA, 25 bp, Artificial sequence
  Synthetic oligonucleotide
ctcccacattcacacttccaccaaa

SEQ ID NO: 686982 - DNA, 25 bp, Artificial sequence
  Synthetic oligonucleotide
cacatagtgcagttggatatcgaac

SEQ ID NO: 686983 - DNA, 25 bp, Artificial sequence
  Synthetic oligonucleotide
cacatagtgcagatggatatcgaac

SEQ ID NO: 686984 - DNA, 25 bp, Artificial sequence
  Synthetic oligonucleotide
tgatatcgagaacacacgtggccca

SEQ ID NO: 686985 - DNA, 25 bp, Artificial sequence
  Synthetic oligonucleotide
tgatatcgagaagacacgtggccca

SEQ ID NO: 686986 - DNA, 25 bp, Artificial sequence
  Synthetic oligonucleotide
aagggttctgatatcaacattggag

SEQ ID NO: 686987 - DNA, 25 bp, Artificial sequence
  Synthetic oligonucleotide
tgctcactggatccctggcgagcca

SEQ ID NO: 686988 - DNA, 25 bp, Artificial sequence
  Synthetic oligonucleotide
cgcaggctctgtatagccaattgca

SEQ ID NO: 686989 - DNA, 25 bp, Artificial sequence
  Synthetic oligonucleotide
cgcaggctctgtttagccaattgca

SEQ ID NO: 686990 - DNA, 25 bp, Artificial sequence
  Synthetic oligonucleotide
gattctcatctcacaaatcttactt

SEQ ID NO: 686991 - DNA, 25 bp, Artificial sequence
  Synthetic oligonucleotide
ctcccacattcagacttccaccaaa

SEQ ID NO: 686992 - DNA, 25 bp, Artificial sequence
  Synthetic oligonucleotide
cacatctttctcgtttggtggcaaa

SEQ ID NO: 686993 - DNA, 25 bp, Artificial sequence
  Synthetic oligonucleotide
cacatctttctcctttggtggcaaa

SEQ ID NO: 686994 - DNA, 25 bp, Artificial sequence
  Synthetic oligonucleotide
tcttccaagtcttaattcgtatccg

SEQ ID NO: 686995 - DNA, 25 bp, Artificial sequence
  Synthetic oligonucleotide
tagagagaaacgatggcgtcgaact

SEQ ID NO: 686996 - DNA, 25 bp, Artificial sequence
  Synthetic oligonucleotide
tagagagaaacgttggcgtcgaact

SEQ ID NO: 686997 - DNA, 25 bp, Artificial sequence
  Synthetic oligonucleotide
gagctgtggcattgccgccgtgtac

SEQ ID NO: 686998 - DNA, 25 bp, Artificial sequence
  Synthetic oligonucleotide
tgctcactggatgcctggcgagcca

SEQ ID NO: 686999 - DNA, 25 bp, Artificial sequence
  Synthetic oligonucleotide
gagctgtggcatagccgccgtgtac

SEQ ID NO: 687000 - DNA, 25 bp, Artificial sequence
  Synthetic oligonucleotide
tcttccaagtctaaattcgtatccg

SEQ ID NO: 687001 - DNA, 25 bp, Artificial sequence
  Synthetic oligonucleotide
ccaaacgccgggtatgttggtcgta

SEQ ID NO: 687002 - DNA, 25 bp, Artificial sequence
  Synthetic oligonucleotide
gattctcatctctcaaatcttactt

SEQ ID NO: 687003 - DNA, 25 bp, Artificial sequence
  Synthetic oligonucleotide
ccaaacgccgggaatgttggtcgta

SEQ ID NO: 687004 - DNA, 25 bp, Artificial sequence
  Synthetic oligonucleotide
gagcagctcattgccaacaaagcca

SEQ ID NO: 687005 - DNA, 25 bp, Artificial sequence
  Synthetic oligonucleotide
caaaccattgttcgattgaagatca

SEQ ID NO: 687006 - DNA, 25 bp, Artificial sequence
  Synthetic oligonucleotide
caaaccattgttggattgaagatca

SEQ ID NO: 687007 - DNA, 25 bp, Artificial sequence
  Synthetic oligonucleotide
gatttcccgggtagcaacaacggta

SEQ ID NO: 687008 - DNA, 25 bp, Artificial sequence
  Synthetic oligonucleotide
ggatggacaattagatagactggac

SEQ ID NO: 687009 - DNA, 25 bp, Artificial sequence
  Synthetic oligonucleotide
gatttcccgggttgcaacaacggta

SEQ ID NO: 687010 - DNA, 25 bp, Artificial sequence
  Synthetic oligonucleotide
tacggagaagtcactcaacaaatgc

SEQ ID NO: 687011 - DNA, 25 bp, Artificial sequence
  Synthetic oligonucleotide
cgtggaaagtcagttgagcaacctc

SEQ ID NO: 687012 - DNA, 25 bp, Artificial sequence
  Synthetic oligonucleotide
tacggagaagtctctcaacaaatgc

SEQ ID NO: 687013 - DNA, 25 bp, Artificial sequence
  Synthetic oligonucleotide
gagcagctcattcccaacaaagcca

SEQ ID NO: 687014 - DNA, 25 bp, Artificial sequence
  Synthetic oligonucleotide
tgtggagataaaaagaaaaagcctg

SEQ ID NO: 687015 - DNA, 25 bp, Artificial sequence
  Synthetic oligonucleotide
cgtggaaagtcacttgagcaacctc

SEQ ID NO: 687016 - DNA, 25 bp, Artificial sequence
  Synthetic oligonucleotide
ggatggacaatttgatagactggac

SEQ ID NO: 687017 - DNA, 25 bp, Artificial sequence
  Synthetic oligonucleotide
gctaaagcctaaaacaaacgaagcg

SEQ ID NO: 687018 - DNA, 25 bp, Artificial sequence
  Synthetic oligonucleotide
gctaaagcctaatacaaacgaagcg

SEQ ID NO: 687019 - DNA, 25 bp, Artificial sequence
  Synthetic oligonucleotide
tagaacgcgtcgttaaatacatccg

SEQ ID NO: 687020 - DNA, 25 bp, Artificial sequence
  Synthetic oligonucleotide
tagaacgcgtcgataaatacatccg

SEQ ID NO: 687021 - DNA, 25 bp, Artificial sequence
  Synthetic oligonucleotide
tcttatttctttctttctttatgcg

SEQ ID NO: 687022 - DNA, 25 bp, Artificial sequence
  Synthetic oligonucleotide
tcttatttctttgtttctttatgcg

SEQ ID NO: 687023 - DNA, 25 bp, Artificial sequence
  Synthetic oligonucleotide
tttcatggcgaaaaggacggtcttg

SEQ ID NO: 687024 - DNA, 25 bp, Artificial sequence
  Synthetic oligonucleotide
tgtggagataaatagaaaaagcctg

SEQ ID NO: 687025 - DNA, 25 bp, Artificial sequence
  Synthetic oligonucleotide
tatctccctttttgtttctctcagg

SEQ ID NO: 687026 - DNA, 25 bp, Artificial sequence
  Synthetic oligonucleotide
taatttcttgatctaaccccgtgtc

SEQ ID NO: 687027 - DNA, 25 bp, Artificial sequence
  Synthetic oligonucleotide
gaatagcagagctataacagttcag

SEQ ID NO: 687028 - DNA, 25 bp, Artificial sequence
  Synthetic oligonucleotide
gaatagcagagcaataacagttcag

SEQ ID NO: 687029 - DNA, 25 bp, Artificial sequence
  Synthetic oligonucleotide
tttcatggcgaataggacggtcttg

SEQ ID NO: 687030 - DNA, 25 bp, Artificial sequence
  Synthetic oligonucleotide
gaaagtgttgagtgtgagattgata

SEQ ID NO: 687031 - DNA, 25 bp, Artificial sequence
  Synthetic oligonucleotide
cttagttataagcacctgatgaatc

SEQ ID NO: 687032 - DNA, 25 bp, Artificial sequence
  Synthetic oligonucleotide
ccttcaaaatttgttctttacagca

SEQ ID NO: 687033 - DNA, 25 bp, Artificial sequence
  Synthetic oligonucleotide
ttggagagcatcaaagcgagtatcg

SEQ ID NO: 687034 - DNA, 25 bp, Artificial sequence
  Synthetic oligonucleotide
ttggagagcatctaagcgagtatcg

SEQ ID NO: 687035 - DNA, 25 bp, Artificial sequence
  Synthetic oligonucleotide
gaaagcccgactacgatgcattcat

SEQ ID NO: 687036 - DNA, 25 bp, Artificial sequence
  Synthetic oligonucleotide
gaaagcccgacttcgatgcattcat

SEQ ID NO: 687037 - DNA, 25 bp, Artificial sequence
  Synthetic oligonucleotide
taatttcttgatgtaaccccgtgtc

SEQ ID NO: 687038 - DNA, 25 bp, Artificial sequence
  Synthetic oligonucleotide
gatcagtttataatattttcaatgg

SEQ ID NO: 687039 - DNA, 25 bp, Artificial sequence
  Synthetic oligonucleotide
cgcaaaagcagtacgcggatgcggt

SEQ ID NO: 687040 - DNA, 25 bp, Artificial sequence
  Synthetic oligonucleotide
cgcaaaagcagttcgcggatgcggt

SEQ ID NO: 687041 - DNA, 25 bp, Artificial sequence
  Synthetic oligonucleotide
tgcttcctacgactctgatcccaga

SEQ ID NO: 687042 - DNA, 25 bp, Artificial sequence
  Synthetic oligonucleotide
gatcagtttatattattttcaatgg

SEQ ID NO: 687043 - DNA, 25 bp, Artificial sequence
  Synthetic oligonucleotide
gaaagtgttgagagtgagattgata

SEQ ID NO: 687044 - DNA, 25 bp, Artificial sequence
  Synthetic oligonucleotide
tatctcccttttagtttctctcagg

SEQ ID NO: 687045 - DNA, 25 bp, Artificial sequence
  Synthetic oligonucleotide
tgttaagtacttgagcccggtttac

SEQ ID NO: 687046 - DNA, 25 bp, Artificial sequence
  Synthetic oligonucleotide
tgttaagtacttcagcccggtttac

SEQ ID NO: 687047 - DNA, 25 bp, Artificial sequence
  Synthetic oligonucleotide
gaaggttcaaccttctcgtggattc

SEQ ID NO: 687048 - DNA, 25 bp, Artificial sequence
  Synthetic oligonucleotide
gaaggttcaaccatctcgtggattc

SEQ ID NO: 687049 - DNA, 25 bp, Artificial sequence
  Synthetic oligonucleotide
aaactcacttgcacgtaccctggca

SEQ ID NO: 687050 - DNA, 25 bp, Artificial sequence
  Synthetic oligonucleotide
aaactcacttgctcgtaccctggca

SEQ ID NO: 687051 - DNA, 25 bp, Artificial sequence
  Synthetic oligonucleotide
gaacctgactccaacttcgaccatg

SEQ ID NO: 687052 - DNA, 25 bp, Artificial sequence
  Synthetic oligonucleotide
gaacctgactcctacttcgaccatg

SEQ ID NO: 687053 - DNA, 25 bp, Artificial sequence
  Synthetic oligonucleotide
tattgcataatgtcatattgtgaga

SEQ ID NO: 687054 - DNA, 25 bp, Artificial sequence
  Synthetic oligonucleotide
tattgcataatgacatattgtgaga

SEQ ID NO: 687055 - DNA, 25 bp, Artificial sequence
  Synthetic oligonucleotide
aatgcatgtgtatgagaatttagac

SEQ ID NO: 687056 - DNA, 25 bp, Artificial sequence
  Synthetic oligonucleotide
aatgcatgtgtaagagaatttagac

SEQ ID NO: 687057 - DNA, 25 bp, Artificial sequence
  Synthetic oligonucleotide
tgcttcctacgagtctgatcccaga

SEQ ID NO: 687058 - DNA, 25 bp, Artificial sequence
  Synthetic oligonucleotide
gatgttcatcaaaacatcctctttg

SEQ ID NO: 687059 - DNA, 25 bp, Artificial sequence
  Synthetic oligonucleotide
tacacattgcttatagtgagtcaag

SEQ ID NO: 687060 - DNA, 25 bp, Artificial sequence
  Synthetic oligonucleotide
cacaaagcatttatattggcaagca

SEQ ID NO: 687061 - DNA, 25 bp, Artificial sequence
  Synthetic oligonucleotide
gcaaaaaccatatcatttgttttga

SEQ ID NO: 687062 - DNA, 25 bp, Artificial sequence
  Synthetic oligonucleotide
gcaaaaaccataacatttgttttga

SEQ ID NO: 687063 - DNA, 25 bp, Artificial sequence
  Synthetic oligonucleotide
tattcaggatcatcaagaacatccc

SEQ ID NO: 687064 - DNA, 25 bp, Artificial sequence
  Synthetic oligonucleotide
tattcaggatcaacaagaacatccc

SEQ ID NO: 687065 - DNA, 25 bp, Artificial sequence
  Synthetic oligonucleotide
ttaaaggcatgatccgacgtcgcac

SEQ ID NO: 687066 - DNA, 25 bp, Artificial sequence
  Synthetic oligonucleotide
ttaaaggcatgaaccgacgtcgcac

SEQ ID NO: 687067 - DNA, 25 bp, Artificial sequence
  Synthetic oligonucleotide
aataagcttcttctcctgctgcttc

SEQ ID NO: 687068 - DNA, 25 bp, Artificial sequence
  Synthetic oligonucleotide
aataagcttcttgtcctgctgcttc

SEQ ID NO: 687069 - DNA, 25 bp, Artificial sequence
  Synthetic oligonucleotide
gccttctgtgtctaataacttctcc

SEQ ID NO: 687070 - DNA, 25 bp, Artificial sequence
  Synthetic oligonucleotide
tgaaaacaaacacaaacaccaatta

SEQ ID NO: 687071 - DNA, 25 bp, Artificial sequence
  Synthetic oligonucleotide
gatgttcatcaatacatcctctttg

SEQ ID NO: 687072 - DNA, 25 bp, Artificial sequence
  Synthetic oligonucleotide
tgaaaacaaacagaaacaccaatta

SEQ ID NO: 687073 - DNA, 25 bp, Artificial sequence
  Synthetic oligonucleotide
tggtcacagaggcacatggctgaaa

SEQ ID NO: 687074 - DNA, 25 bp, Artificial sequence
  Synthetic oligonucleotide
tacacattgcttttagtgagtcaag

SEQ ID NO: 687075 - DNA, 25 bp, Artificial sequence
  Synthetic oligonucleotide
tcacttgcgcacaagaaaccatcgt

SEQ ID NO: 687076 - DNA, 25 bp, Artificial sequence
  Synthetic oligonucleotide
cttagttataaggacctgatgaatc

SEQ ID NO: 687077 - DNA, 25 bp, Artificial sequence
  Synthetic oligonucleotide
gatgacttcatttcagaatgcaaag

SEQ ID NO: 687078 - DNA, 25 bp, Artificial sequence
  Synthetic oligonucleotide
gatgacttcattacagaatgcaaag

SEQ ID NO: 687079 - DNA, 25 bp, Artificial sequence
  Synthetic oligonucleotide
tataactattctacaaagcagcagc

SEQ ID NO: 687080 - DNA, 25 bp, Artificial sequence
  Synthetic oligonucleotide
tataactattcttcaaagcagcagc

SEQ ID NO: 687081 - DNA, 25 bp, Artificial sequence
  Synthetic oligonucleotide
ggtctccttggcgatcccacctata

SEQ ID NO: 687082 - DNA, 25 bp, Artificial sequence
  Synthetic oligonucleotide
ggtctccttggccatcccacctata

SEQ ID NO: 687083 - DNA, 25 bp, Artificial sequence
  Synthetic oligonucleotide
gataaccataaatgagagtttttga

SEQ ID NO: 687084 - DNA, 25 bp, Artificial sequence
  Synthetic oligonucleotide
gataaccataaaagagagtttttga

SEQ ID NO: 687085 - DNA, 25 bp, Artificial sequence
  Synthetic oligonucleotide
gccttctgtgtcaaataacttctcc

SEQ ID NO: 687086 - DNA, 25 bp, Artificial sequence
  Synthetic oligonucleotide
gcctttgatgccttctggatcagcc

SEQ ID NO: 687087 - DNA, 25 bp, Artificial sequence
  Synthetic oligonucleotide
tcaaaccacaaatcaactaagcaaa

SEQ ID NO: 687088 - DNA, 25 bp, Artificial sequence
  Synthetic oligonucleotide
tcaaaccacaaaacaactaagcaaa

SEQ ID NO: 687089 - DNA, 25 bp, Artificial sequence
  Synthetic oligonucleotide
tatcctattgatgatactcatgttg

SEQ ID NO: 687090 - DNA, 25 bp, Artificial sequence
  Synthetic oligonucleotide
tatcctattgatcatactcatgttg

SEQ ID NO: 687091 - DNA, 25 bp, Artificial sequence
  Synthetic oligonucleotide
tgtcaaatagcttttggattacaaa

SEQ ID NO: 687092 - DNA, 25 bp, Artificial sequence
  Synthetic oligonucleotide
tgtcaaatagctattggattacaaa

SEQ ID NO: 687093 - DNA, 25 bp, Artificial sequence
  Synthetic oligonucleotide
agttcaaacttccttatagattcca

SEQ ID NO: 687094 - DNA, 25 bp, Artificial sequence
  Synthetic oligonucleotide
agttcaaacttcgttatagattcca

SEQ ID NO: 687095 - DNA, 25 bp, Artificial sequence
  Synthetic oligonucleotide
gcaaagaaattaaacatacaagtaa

SEQ ID NO: 687096 - DNA, 25 bp, Artificial sequence
  Synthetic oligonucleotide
gcaaagaaattatacatacaagtaa

SEQ ID NO: 687097 - DNA, 25 bp, Artificial sequence
  Synthetic oligonucleotide
tgcaatcaccaagtactactttggg

SEQ ID NO: 687098 - DNA, 25 bp, Artificial sequence
  Synthetic oligonucleotide
cacaaagcatttttattggcaagca

SEQ ID NO: 687099 - DNA, 25 bp, Artificial sequence
  Synthetic oligonucleotide
gcctttgatgccatctggatcagcc

SEQ ID NO: 687100 - DNA, 25 bp, Artificial sequence
  Synthetic oligonucleotide
ccttcaaaatttcttctttacagca

SEQ ID NO: 687101 - DNA, 25 bp, Artificial sequence
  Synthetic oligonucleotide
gttctgatagaaatccacaactaca

SEQ ID NO: 687102 - DNA, 25 bp, Artificial sequence
  Synthetic oligonucleotide
gttctgatagaattccacaactaca

SEQ ID NO: 687103 - DNA, 25 bp, Artificial sequence
  Synthetic oligonucleotide
cagattcaacaagtaagtaagaaca

SEQ ID NO: 687104 - DNA, 25 bp, Artificial sequence
  Synthetic oligonucleotide
cagattcaacaactaagtaagaaca

SEQ ID NO: 687105 - DNA, 25 bp, Artificial sequence
  Synthetic oligonucleotide
tgaccacaaaaattgcagattaaac

SEQ ID NO: 687106 - DNA, 25 bp, Artificial sequence
  Synthetic oligonucleotide
tgaccacaaaaaatgcagattaaac

SEQ ID NO: 687107 - DNA, 25 bp, Artificial sequence
  Synthetic oligonucleotide
ttaccttgactaactgcaaacagag

SEQ ID NO: 687108 - DNA, 25 bp, Artificial sequence
  Synthetic oligonucleotide
ttaccttgactatctgcaaacagag

SEQ ID NO: 687109 - DNA, 25 bp, Artificial sequence
  Synthetic oligonucleotide
caatatctctttcaagaagagccct

SEQ ID NO: 687110 - DNA, 25 bp, Artificial sequence
  Synthetic oligonucleotide
caatatctctttgaagaagagccct

SEQ ID NO: 687111 - DNA, 25 bp, Artificial sequence
  Synthetic oligonucleotide
caacaagagcttaacctagcccttg

SEQ ID NO: 687112 - DNA, 25 bp, Artificial sequence
  Synthetic oligonucleotide
caacaagagctttacctagcccttg

SEQ ID NO: 687113 - DNA, 25 bp, Artificial sequence
  Synthetic oligonucleotide
tgcaatcaccaactactactttggg

SEQ ID NO: 687114 - DNA, 25 bp, Artificial sequence
  Synthetic oligonucleotide
caagaaaccaaaacatgagccaatc

SEQ ID NO: 687115 - DNA, 25 bp, Artificial sequence
  Synthetic oligonucleotide
acttcatcggcaactccactcctct

SEQ ID NO: 687116 - DNA, 25 bp, Artificial sequence
  Synthetic oligonucleotide
acttcatcggcatctccactcctct

SEQ ID NO: 687117 - DNA, 25 bp, Artificial sequence
  Synthetic oligonucleotide
tctccaaattatgttttagccaaaa

SEQ ID NO: 687118 - DNA, 25 bp, Artificial sequence
  Synthetic oligonucleotide
tctccaaattatcttttagccaaaa

SEQ ID NO: 687119 - DNA, 25 bp, Artificial sequence
  Synthetic oligonucleotide
accataagtttattacttcatgaag

SEQ ID NO: 687120 - DNA, 25 bp, Artificial sequence
  Synthetic oligonucleotide
accataagtttaatacttcatgaag

SEQ ID NO: 687121 - DNA, 25 bp, Artificial sequence
  Synthetic oligonucleotide
gatctttggtttattaatggctata

SEQ ID NO: 687122 - DNA, 25 bp, Artificial sequence
  Synthetic oligonucleotide
gatctttggttttttaatggctata

SEQ ID NO: 687123 - DNA, 25 bp, Artificial sequence
  Synthetic oligonucleotide
tcctcttatcttatcaacaacatct

SEQ ID NO: 687124 - DNA, 25 bp, Artificial sequence
  Synthetic oligonucleotide
tcctcttatcttttcaacaacatct

SEQ ID NO: 687125 - DNA, 25 bp, Artificial sequence
  Synthetic oligonucleotide
gagactaatcaacattacaaacaat

SEQ ID NO: 687126 - DNA, 25 bp, Artificial sequence
  Synthetic oligonucleotide
taaatcctcatctctcaacctgagc

SEQ ID NO: 687127 - DNA, 25 bp, Artificial sequence
  Synthetic oligonucleotide
caagaaaccaaatcatgagccaatc

SEQ ID NO: 687128 - DNA, 25 bp, Artificial sequence
  Synthetic oligonucleotide
tatccaaatccctaaaaaataagca

SEQ ID NO: 687129 - DNA, 25 bp, Artificial sequence
  Synthetic oligonucleotide
aaataaaactccatttcttctctgc

SEQ ID NO: 687130 - DNA, 25 bp, Artificial sequence
  Synthetic oligonucleotide
aaataaaactccttttcttctctgc

SEQ ID NO: 687131 - DNA, 25 bp, Artificial sequence
  Synthetic oligonucleotide
tgtttttcctattgacccattgtcc

SEQ ID NO: 687132 - DNA, 25 bp, Artificial sequence
  Synthetic oligonucleotide
tgtttttcctatagacccattgtcc

SEQ ID NO: 687133 - DNA, 25 bp, Artificial sequence
  Synthetic oligonucleotide
tctctctttccccatttaatcttat

SEQ ID NO: 687134 - DNA, 25 bp, Artificial sequence
  Synthetic oligonucleotide
tctctctttcccgatttaatcttat

SEQ ID NO: 687135 - DNA, 25 bp, Artificial sequence
  Synthetic oligonucleotide
aaaaatcacatcactatatcaccac

SEQ ID NO: 687136 - DNA, 25 bp, Artificial sequence
  Synthetic oligonucleotide
aaaaatcacatctctatatcaccac

SEQ ID NO: 687137 - DNA, 25 bp, Artificial sequence
  Synthetic oligonucleotide
taaaatcaaaaatcgttacccacat

SEQ ID NO: 687138 - DNA, 25 bp, Artificial sequence
  Synthetic oligonucleotide
taaaatcaaaaaacgttacccacat

SEQ ID NO: 687139 - DNA, 25 bp, Artificial sequence
  Synthetic oligonucleotide
tgctgactctgggtgcggcaaaagt

SEQ ID NO: 687140 - DNA, 25 bp, Artificial sequence
  Synthetic oligonucleotide
gagactaatcaagattacaaacaat

SEQ ID NO: 687141 - DNA, 25 bp, Artificial sequence
  Synthetic oligonucleotide
cattgttaaggttacgcaagaaggc

SEQ ID NO: 687142 - DNA, 25 bp, Artificial sequence
  Synthetic oligonucleotide
tgtatggtggttcgtggagactacg

SEQ ID NO: 687143 - DNA, 25 bp, Artificial sequence
  Synthetic oligonucleotide
tgtatggtggttggtggagactacg

SEQ ID NO: 687144 - DNA, 25 bp, Artificial sequence
  Synthetic oligonucleotide
caagaataagcatctagtgccgact

SEQ ID NO: 687145 - DNA, 25 bp, Artificial sequence
  Synthetic oligonucleotide
caagaataagcaactagtgccgact

SEQ ID NO: 687146 - DNA, 25 bp, Artificial sequence
  Synthetic oligonucleotide
ggtcgataaatataccatggttttg

SEQ ID NO: 687147 - DNA, 25 bp, Artificial sequence
  Synthetic oligonucleotide
ggtcgataaataaaccatggttttg

SEQ ID NO: 687148 - DNA, 25 bp, Artificial sequence
  Synthetic oligonucleotide
aatcccgatgtattctcttttacta

SEQ ID NO: 687149 - DNA, 25 bp, Artificial sequence
  Synthetic oligonucleotide
aatcccgatgtaatctcttttacta

SEQ ID NO: 687150 - DNA, 25 bp, Artificial sequence
  Synthetic oligonucleotide
cggtgaaattcaagagtaataaact

SEQ ID NO: 687151 - DNA, 25 bp, Artificial sequence
  Synthetic oligonucleotide
cggtgaaattcatgagtaataaact

SEQ ID NO: 687152 - DNA, 25 bp, Artificial sequence
  Synthetic oligonucleotide
ctcttggtgtctatattaattggta

SEQ ID NO: 687153 - DNA, 25 bp, Artificial sequence
  Synthetic oligonucleotide
aacgtctccctccatgccctgttag

SEQ ID NO: 687154 - DNA, 25 bp, Artificial sequence
  Synthetic oligonucleotide
cattgttaaggtaacgcaagaaggc

SEQ ID NO: 687155 - DNA, 25 bp, Artificial sequence
  Synthetic oligonucleotide
aacgtctccctcgatgccctgttag

SEQ ID NO: 687156 - DNA, 25 bp, Artificial sequence
  Synthetic oligonucleotide
ccctatagaaaataataaaagcata

SEQ ID NO: 687157 - DNA, 25 bp, Artificial sequence
  Synthetic oligonucleotide
ccctatagaaaaaaataaaagcata

SEQ ID NO: 687158 - DNA, 25 bp, Artificial sequence
  Synthetic oligonucleotide
tcaaagaccataaagattcgaagcc

SEQ ID NO: 687159 - DNA, 25 bp, Artificial sequence
  Synthetic oligonucleotide
tcaaagaccatatagattcgaagcc

SEQ ID NO: 687160 - DNA, 25 bp, Artificial sequence
  Synthetic oligonucleotide
tacggtgacgtgaaaatgtgaccca

SEQ ID NO: 687161 - DNA, 25 bp, Artificial sequence
  Synthetic oligonucleotide
tacggtgacgtgtaaatgtgaccca

SEQ ID NO: 687162 - DNA, 25 bp, Artificial sequence
  Synthetic oligonucleotide
tcatcttcagacgttaaacacctaa

SEQ ID NO: 687163 - DNA, 25 bp, Artificial sequence
  Synthetic oligonucleotide
tcatcttcagaccttaaacacctaa

SEQ ID NO: 687164 - DNA, 25 bp, Artificial sequence
  Synthetic oligonucleotide
tgtccaattagattctcccacgtgt

SEQ ID NO: 687165 - DNA, 25 bp, Artificial sequence
  Synthetic oligonucleotide
tgtccaattagaatctcccacgtgt

SEQ ID NO: 687166 - DNA, 25 bp, Artificial sequence
  Synthetic oligonucleotide
tatccaaatcccaaaaaaataagca

SEQ ID NO: 687167 - DNA, 25 bp, Artificial sequence
  Synthetic oligonucleotide
aaaaaaagagcttaggcggagaaga

SEQ ID NO: 687168 - DNA, 25 bp, Artificial sequence
  Synthetic oligonucleotide
ctcttggtgtctttattaattggta

SEQ ID NO: 687169 - DNA, 25 bp, Artificial sequence
  Synthetic oligonucleotide
gtctatagttttggtacttgtaatg

SEQ ID NO: 687170 - DNA, 25 bp, Artificial sequence
  Synthetic oligonucleotide
cctaagattcttgtcatcgaaggtc

SEQ ID NO: 687171 - DNA, 25 bp, Artificial sequence
  Synthetic oligonucleotide
tgtaagctacacatactctgttatg

SEQ ID NO: 687172 - DNA, 25 bp, Artificial sequence
  Synthetic oligonucleotide
tgtaagctacacttactctgttatg

SEQ ID NO: 687173 - DNA, 25 bp, Artificial sequence
  Synthetic oligonucleotide
tcttagacatactcaaattttagag

SEQ ID NO: 687174 - DNA, 25 bp, Artificial sequence
  Synthetic oligonucleotide
tcttagacatacacaaattttagag

SEQ ID NO: 687175 - DNA, 25 bp, Artificial sequence
  Synthetic oligonucleotide
gtctcttatcttctcggaatttcga

SEQ ID NO: 687176 - DNA, 25 bp, Artificial sequence
  Synthetic oligonucleotide
gtctcttatcttgtcggaatttcga

SEQ ID NO: 687177 - DNA, 25 bp, Artificial sequence
  Synthetic oligonucleotide
ggacttagatttatactagaatcag

SEQ ID NO: 687178 - DNA, 25 bp, Artificial sequence
  Synthetic oligonucleotide
ggacttagatttttactagaatcag

SEQ ID NO: 687179 - DNA, 25 bp, Artificial sequence
  Synthetic oligonucleotide
taaagatggatctttgaatctatgc

SEQ ID NO: 687180 - DNA, 25 bp, Artificial sequence
  Synthetic oligonucleotide
taaagatggatcattgaatctatgc

SEQ ID NO: 687181 - DNA, 25 bp, Artificial sequence
  Synthetic oligonucleotide
taaatcctcatcactcaacctgagc

SEQ ID NO: 687182 - DNA, 25 bp, Artificial sequence
  Synthetic oligonucleotide
tgtgacaccgataaatttttattcg

SEQ ID NO: 687183 - DNA, 25 bp, Artificial sequence
  Synthetic oligonucleotide
tggacttcttgaccctccggagctt

SEQ ID NO: 687184 - DNA, 25 bp, Artificial sequence
  Synthetic oligonucleotide
gtctatagttttcgtacttgtaatg

SEQ ID NO: 687185 - DNA, 25 bp, Artificial sequence
  Synthetic oligonucleotide
atctacttgtgaaggtttgatgagc

SEQ ID NO: 687186 - DNA, 25 bp, Artificial sequence
  Synthetic oligonucleotide
atctacttgtgatggtttgatgagc

SEQ ID NO: 687187 - DNA, 25 bp, Artificial sequence
  Synthetic oligonucleotide
tactagacttcactatctacttgga

SEQ ID NO: 687188 - DNA, 25 bp, Artificial sequence
  Synthetic oligonucleotide
tactagacttcagtatctacttgga

SEQ ID NO: 687189 - DNA, 25 bp, Artificial sequence
  Synthetic oligonucleotide
gtcaaattcgcttggaaaattcagg

SEQ ID NO: 687190 - DNA, 25 bp, Artificial sequence
  Synthetic oligonucleotide
gtcaaattcgctaggaaaattcagg

SEQ ID NO: 687191 - DNA, 25 bp, Artificial sequence
  Synthetic oligonucleotide
gaataattcaactacatttacacca

SEQ ID NO: 687192 - DNA, 25 bp, Artificial sequence
  Synthetic oligonucleotide
gaataattcaacaacatttacacca

SEQ ID NO: 687193 - DNA, 25 bp, Artificial sequence
  Synthetic oligonucleotide
cggtttatcttaaaaaactgaatct

SEQ ID NO: 687194 - DNA, 25 bp, Artificial sequence
  Synthetic oligonucleotide
cggtttatcttataaaactgaatct

SEQ ID NO: 687195 - DNA, 25 bp, Artificial sequence
  Synthetic oligonucleotide
tgtgacaccgattaatttttattcg

SEQ ID NO: 687196 - DNA, 25 bp, Artificial sequence
  Synthetic oligonucleotide
tgctaagccaccaaaaggcgggaac

SEQ ID NO: 687197 - DNA, 25 bp, Artificial sequence
  Synthetic oligonucleotide
aaaaaaagagctaaggcggagaaga

SEQ ID NO: 687198 - DNA, 25 bp, Artificial sequence
  Synthetic oligonucleotide
caccaaacaaactacaatggctgtc

SEQ ID NO: 687199 - DNA, 25 bp, Artificial sequence
  Synthetic oligonucleotide
caccaaacaaacaacaatggctgtc

SEQ ID NO: 687200 - DNA, 25 bp, Artificial sequence
  Synthetic oligonucleotide
tcaacacaagctctcaattcaactc

SEQ ID NO: 687201 - DNA, 25 bp, Artificial sequence
  Synthetic oligonucleotide
tcaacacaagctgtcaattcaactc

SEQ ID NO: 687202 - DNA, 25 bp, Artificial sequence
  Synthetic oligonucleotide
tcttcttcctcctccaaacaagtct

SEQ ID NO: 687203 - DNA, 25 bp, Artificial sequence
  Synthetic oligonucleotide
tcttcttcctccaccaaacaagtct

SEQ ID NO: 687204 - DNA, 25 bp, Artificial sequence
  Synthetic oligonucleotide
cgtcaaccacaatccaaccgtagat

SEQ ID NO: 687205 - DNA, 25 bp, Artificial sequence
  Synthetic oligonucleotide
cgtcaaccacaaaccaaccgtagat

SEQ ID NO: 687206 - DNA, 25 bp, Artificial sequence
  Synthetic oligonucleotide
tcacttgcgcactagaaaccatcgt

SEQ ID NO: 687207 - DNA, 25 bp, Artificial sequence
  Synthetic oligonucleotide
tgctgactctggctgcggcaaaagt

SEQ ID NO: 687208 - DNA, 25 bp, Artificial sequence
  Synthetic oligonucleotide
cctaagattcttctcatcgaaggtc

SEQ ID NO: 687209 - DNA, 25 bp, Artificial sequence
  Synthetic oligonucleotide
atgcggaggctcaccagcgtctttg

SEQ ID NO: 687210 - DNA, 25 bp, Artificial sequence
  Synthetic oligonucleotide
tggacttcttgagcctccggagctt

SEQ ID NO: 687211 - DNA, 25 bp, Artificial sequence
  Synthetic oligonucleotide
tgctaagccacctaaaggcgggaac

SEQ ID NO: 687212 - DNA, 25 bp, Artificial sequence
  Synthetic oligonucleotide
actcatcagcgagacgaccactgtg

SEQ ID NO: 687213 - DNA, 25 bp, Artificial sequence
  Synthetic oligonucleotide
actcatcagcgacacgaccactgtg

SEQ ID NO: 687214 - DNA, 25 bp, Artificial sequence
  Synthetic oligonucleotide
gattaccattctatggataggtacg

SEQ ID NO: 687215 - DNA, 25 bp, Artificial sequence
  Synthetic oligonucleotide
gattaccattctttggataggtacg

SEQ ID NO: 687216 - DNA, 25 bp, Artificial sequence
  Synthetic oligonucleotide
agaaagtcaccggtttggacccacg

SEQ ID NO: 687217 - DNA, 25 bp, Artificial sequence
  Synthetic oligonucleotide
agaaagtcaccgctttggacccacg

SEQ ID NO: 687218 - DNA, 25 bp, Artificial sequence
  Synthetic oligonucleotide
tctcatgtatgagcaagtcaaagct

SEQ ID NO: 687219 - DNA, 25 bp, Artificial sequence
  Synthetic oligonucleotide
tctcatgtatgaccaagtcaaagct

SEQ ID NO: 687220 - DNA, 25 bp, Artificial sequence
  Synthetic oligonucleotide
tatagccgtcgacaaaccgatttat

SEQ ID NO: 687221 - DNA, 25 bp, Artificial sequence
  Synthetic oligonucleotide
tatagccgtcgagaaaccgatttat

SEQ ID NO: 687222 - DNA, 25 bp, Artificial sequence
  Synthetic oligonucleotide
tggtcacagagggacatggctgaaa

SEQ ID NO: 687223 - DNA, 25 bp, Artificial sequence
  Synthetic oligonucleotide
atgcggaggctctccagcgtctttg

SEQ ID NO: 687224 - DNA, 25 bp, Artificial sequence
  Synthetic oligonucleotide
tataagctcttaggtttggagtgaa

SEQ ID NO: 687225 - DNA, 25 bp, Artificial sequence
  Synthetic oligonucleotide
tgataatatatagtatcggtacctt

SEQ ID NO: 687226 - DNA, 25 bp, Artificial sequence
  Synthetic oligonucleotide
tgataatatatactatcggtacctt

SEQ ID NO: 687227 - DNA, 25 bp, Artificial sequence
  Synthetic oligonucleotide
ttatagtttatatatctttccgcca

SEQ ID NO: 687228 - DNA, 25 bp, Artificial sequence
  Synthetic oligonucleotide
ttatagtttataaatctttccgcca

SEQ ID NO: 687229 - DNA, 25 bp, Artificial sequence
  Synthetic oligonucleotide
cgtaaaaatcatttagtgaagagtc

SEQ ID NO: 687230 - DNA, 25 bp, Artificial sequence
  Synthetic oligonucleotide
cgtaaaaatcatatagtgaagagtc

SEQ ID NO: 687231 - DNA, 25 bp, Artificial sequence
  Synthetic oligonucleotide
gcggtgttagcatcccctatcccat

SEQ ID NO: 687232 - DNA, 25 bp, Artificial sequence
  Synthetic oligonucleotide
taatattaagctctttttaaacaac

SEQ ID NO: 687233 - DNA, 25 bp, Artificial sequence
  Synthetic oligonucleotide
tgtttgtcttgatggctttgtaatc

SEQ ID NO: 687234 - DNA, 25 bp, Artificial sequence
  Synthetic oligonucleotide
tataagctcttacgtttggagtgaa

SEQ ID NO: 687235 - DNA, 25 bp, Artificial sequence
  Synthetic oligonucleotide
ttttgagattggaaaagtgtaaacc

SEQ ID NO: 687236 - DNA, 25 bp, Artificial sequence
  Synthetic oligonucleotide
ttttgagattggtaaagtgtaaacc

SEQ ID NO: 687237 - DNA, 25 bp, Artificial sequence
  Synthetic oligonucleotide
aatacgaagaaaaaatgttgaatgg

SEQ ID NO: 687238 - DNA, 25 bp, Artificial sequence
  Synthetic oligonucleotide
aatacgaagaaataatgttgaatgg

SEQ ID NO: 687239 - DNA, 25 bp, Artificial sequence
  Synthetic oligonucleotide
caattattaactaaccgacgacacg

SEQ ID NO: 687240 - DNA, 25 bp, Artificial sequence
  Synthetic oligonucleotide
tcaccagcataaatgaaaataaaat

SEQ ID NO: 687241 - DNA, 25 bp, Artificial sequence
  Synthetic oligonucleotide
taatattaagctgtttttaaacaac

SEQ ID NO: 687242 - DNA, 25 bp, Artificial sequence
  Synthetic oligonucleotide
tattgttgcagcatcaagtgaagtg

SEQ ID NO: 687243 - DNA, 25 bp, Artificial sequence
  Synthetic oligonucleotide
gcggtgttagcaacccctatcccat

SEQ ID NO: 687244 - DNA, 25 bp, Artificial sequence
  Synthetic oligonucleotide
ccaactgcgccaggtaagtttttaa

SEQ ID NO: 687245 - DNA, 25 bp, Artificial sequence
  Synthetic oligonucleotide
ccaactgcgccacgtaagtttttaa

SEQ ID NO: 687246 - DNA, 25 bp, Artificial sequence
  Synthetic oligonucleotide
agtactgctcatattctctctaata

SEQ ID NO: 687247 - DNA, 25 bp, Artificial sequence
  Synthetic oligonucleotide
agtactgctcattttctctctaata

SEQ ID NO: 687248 - DNA, 25 bp, Artificial sequence
  Synthetic oligonucleotide
acttggctaatttctcgatcttgag

SEQ ID NO: 687249 - DNA, 25 bp, Artificial sequence
  Synthetic oligonucleotide
acttggctaattactcgatcttgag

SEQ ID NO: 687250 - DNA, 25 bp, Artificial sequence
  Synthetic oligonucleotide
tatgttgtatacatgtgtcttaaca

SEQ ID NO: 687251 - DNA, 25 bp, Artificial sequence
  Synthetic oligonucleotide
ctttctagtgatctaatttatactc

SEQ ID NO: 687252 - DNA, 25 bp, Artificial sequence
  Synthetic oligonucleotide
tatgttgtatacttgtgtcttaaca

SEQ ID NO: 687253 - DNA, 25 bp, Artificial sequence
  Synthetic oligonucleotide
tattgttgcagcttcaagtgaagtg

SEQ ID NO: 687254 - DNA, 25 bp, Artificial sequence
  Synthetic oligonucleotide
catttgcctgaacagtatggtttcg

SEQ ID NO: 687255 - DNA, 25 bp, Artificial sequence
  Synthetic oligonucleotide
catttgcctgaagagtatggtttcg

SEQ ID NO: 687256 - DNA, 25 bp, Artificial sequence
  Synthetic oligonucleotide
taagacggctatgtaagctgatatt

SEQ ID NO: 687257 - DNA, 25 bp, Artificial sequence
  Synthetic oligonucleotide
taagacggctatctaagctgatatt

SEQ ID NO: 687258 - DNA, 25 bp, Artificial sequence
  Synthetic oligonucleotide
tgtttgtcttgaaggctttgtaatc

SEQ ID NO: 687259 - DNA, 25 bp, Artificial sequence
  Synthetic oligonucleotide
cagtgttgttaagtataatagaaaa

SEQ ID NO: 687260 - DNA, 25 bp, Artificial sequence
  Synthetic oligonucleotide
ctttctagtgatgtaatttatactc

SEQ ID NO: 687261 - DNA, 25 bp, Artificial sequence
  Synthetic oligonucleotide
tacgctcttgtcacttcttgaatcc

SEQ ID NO: 687262 - DNA, 25 bp, Artificial sequence
  Synthetic oligonucleotide
caaacaatattttattgattaggac

SEQ ID NO: 687263 - DNA, 25 bp, Artificial sequence
  Synthetic oligonucleotide
caaaagttaattacgagttagggca

SEQ ID NO: 687264 - DNA, 25 bp, Artificial sequence
  Synthetic oligonucleotide
caaaagttaatttcgagttagggca

SEQ ID NO: 687265 - DNA, 25 bp, Artificial sequence
  Synthetic oligonucleotide
taatgacaccgatcggatatccgat

SEQ ID NO: 687266 - DNA, 25 bp, Artificial sequence
  Synthetic oligonucleotide
taatgacaccgaacggatatccgat

SEQ ID NO: 687267 - DNA, 25 bp, Artificial sequence
  Synthetic oligonucleotide
tatcgcctctgtgaatcggtcgtac

SEQ ID NO: 687268 - DNA, 25 bp, Artificial sequence
  Synthetic oligonucleotide
tatcgcctctgtcaatcggtcgtac

SEQ ID NO: 687269 - DNA, 25 bp, Artificial sequence
  Synthetic oligonucleotide
aaacaaatcaaaacccaaatactca

SEQ ID NO: 687270 - DNA, 25 bp, Artificial sequence
  Synthetic oligonucleotide
cggaggtttccgatcctagagagga

SEQ ID NO: 687271 - DNA, 25 bp, Artificial sequence
  Synthetic oligonucleotide
cataattttttttattcctttatca

SEQ ID NO: 687272 - DNA, 25 bp, Artificial sequence
  Synthetic oligonucleotide
tacgctcttgtctcttcttgaatcc

SEQ ID NO: 687273 - DNA, 25 bp, Artificial sequence
  Synthetic oligonucleotide
tgggcggcgatagatccatcggcaa

SEQ ID NO: 687274 - DNA, 25 bp, Artificial sequence
  Synthetic oligonucleotide
tgggcggcgatacatccatcggcaa

SEQ ID NO: 687275 - DNA, 25 bp, Artificial sequence
  Synthetic oligonucleotide
gcaatctctgttgcggaaaaagcgc

SEQ ID NO: 687276 - DNA, 25 bp, Artificial sequence
  Synthetic oligonucleotide
gcaatctctgttccggaaaaagcgc

SEQ ID NO: 687277 - DNA, 25 bp, Artificial sequence
  Synthetic oligonucleotide
tcgtcaaatgtttaccaaagttatt

SEQ ID NO: 687278 - DNA, 25 bp, Artificial sequence
  Synthetic oligonucleotide
tcgtcaaatgttaaccaaagttatt

SEQ ID NO: 687279 - DNA, 25 bp, Artificial sequence
  Synthetic oligonucleotide
cggaggtttccgttcctagagagga

SEQ ID NO: 687280 - DNA, 25 bp, Artificial sequence
  Synthetic oligonucleotide
tactaagttttcatttacggattca

SEQ ID NO: 687281 - DNA, 25 bp, Artificial sequence
  Synthetic oligonucleotide
caattattaacttaccgacgacacg

SEQ ID NO: 687282 - DNA, 25 bp, Artificial sequence
  Synthetic oligonucleotide
cagtgttgttaactataatagaaaa

SEQ ID NO: 687283 - DNA, 25 bp, Artificial sequence
  Synthetic oligonucleotide
taaacatgcatttttcaattattca

SEQ ID NO: 687284 - DNA, 25 bp, Artificial sequence
  Synthetic oligonucleotide
taaacatgcattattcaattattca

SEQ ID NO: 687285 - DNA, 25 bp, Artificial sequence
  Synthetic oligonucleotide
gagatttcatcgagttgattatgaa

SEQ ID NO: 687286 - DNA, 25 bp, Artificial sequence
  Synthetic oligonucleotide
gagatttcatcgtgttgattatgaa

SEQ ID NO: 687287 - DNA, 25 bp, Artificial sequence
  Synthetic oligonucleotide
actaagtaagttatcatttggtatg

SEQ ID NO: 687288 - DNA, 25 bp, Artificial sequence
  Synthetic oligonucleotide
aaacaaatcaaatcccaaatactca

SEQ ID NO: 687289 - DNA, 25 bp, Artificial sequence
  Synthetic oligonucleotide
tactaagttttcttttacggattca

SEQ ID NO: 687290 - DNA, 25 bp, Artificial sequence
  Synthetic oligonucleotide
caaacaatatttaattgattaggac

SEQ ID NO: 687291 - DNA, 25 bp, Artificial sequence
  Synthetic oligonucleotide
ttttcgtcaaatctagtgtacctaa

SEQ ID NO: 687292 - DNA, 25 bp, Artificial sequence
  Synthetic oligonucleotide
ttttcgtcaaatgtagtgtacctaa

SEQ ID NO: 687293 - DNA, 25 bp, Artificial sequence
  Synthetic oligonucleotide
gatcaagtatactgcgacttcaaag

SEQ ID NO: 687294 - DNA, 25 bp, Artificial sequence
  Synthetic oligonucleotide
gatcaagtatacagcgacttcaaag

SEQ ID NO: 687295 - DNA, 25 bp, Artificial sequence
  Synthetic oligonucleotide
caagaatttgtattgacataagtta

SEQ ID NO: 687296 - DNA, 25 bp, Artificial sequence
  Synthetic oligonucleotide
caagaatttgtaatgacataagtta

SEQ ID NO: 687297 - DNA, 25 bp, Artificial sequence
  Synthetic oligonucleotide
cataatttttttaattcctttatca

SEQ ID NO: 687298 - DNA, 25 bp, Artificial sequence
  Synthetic oligonucleotide
actaagtaagttttcatttggtatg

SEQ ID NO: 687299 - DNA, 25 bp, Artificial sequence
  Synthetic oligonucleotide
ggacggtattacatatatagtacac

SEQ ID NO: 687300 - DNA, 25 bp, Artificial sequence
  Synthetic oligonucleotide
taactgcagataaatgaatatatat

SEQ ID NO: 687301 - DNA, 25 bp, Artificial sequence
  Synthetic oligonucleotide
gcacctctatcattcaattatgtag

SEQ ID NO: 687302 - DNA, 25 bp, Artificial sequence
  Synthetic oligonucleotide
gcacctctatcaatcaattatgtag

SEQ ID NO: 687303 - DNA, 25 bp, Artificial sequence
  Synthetic oligonucleotide
tgaactttgctatttataatggcca

SEQ ID NO: 687304 - DNA, 25 bp, Artificial sequence
  Synthetic oligonucleotide
tgaactttgctaattataatggcca

SEQ ID NO: 687305 - DNA, 25 bp, Artificial sequence
  Synthetic oligonucleotide
taaacgtgatgggagaattgtgatg

SEQ ID NO: 687306 - DNA, 25 bp, Artificial sequence
  Synthetic oligonucleotide
taaacgtgatggcagaattgtgatg

SEQ ID NO: 687307 - DNA, 25 bp, Artificial sequence
  Synthetic oligonucleotide
gttaatgattatacgaaatatcgag

SEQ ID NO: 687308 - DNA, 25 bp, Artificial sequence
  Synthetic oligonucleotide
gatacacgtgtctatcagctgcaca

SEQ ID NO: 687309 - DNA, 25 bp, Artificial sequence
  Synthetic oligonucleotide
ttattaaatcttatttgttgttgac

SEQ ID NO: 687310 - DNA, 25 bp, Artificial sequence
  Synthetic oligonucleotide
ggacggtattacttatatagtacac

SEQ ID NO: 687311 - DNA, 25 bp, Artificial sequence
  Synthetic oligonucleotide
gctgacatttcaactacaacgaaga

SEQ ID NO: 687312 - DNA, 25 bp, Artificial sequence
  Synthetic oligonucleotide
gctgacatttcatctacaacgaaga

SEQ ID NO: 687313 - DNA, 25 bp, Artificial sequence
  Synthetic oligonucleotide
aacgattttctcttgtctactacag

SEQ ID NO: 687314 - DNA, 25 bp, Artificial sequence
  Synthetic oligonucleotide
aacgattttctcatgtctactacag

SEQ ID NO: 687315 - DNA, 25 bp, Artificial sequence
  Synthetic oligonucleotide
cgctctaaacatcctaattaaaaaa

SEQ ID NO: 687316 - DNA, 25 bp, Artificial sequence
  Synthetic oligonucleotide
cgctctaaacatgctaattaaaaaa

SEQ ID NO: 687317 - DNA, 25 bp, Artificial sequence
  Synthetic oligonucleotide
gatacacgtgtcaatcagctgcaca

SEQ ID NO: 687318 - DNA, 25 bp, Artificial sequence
  Synthetic oligonucleotide
tcaagtatagtttgaaaaagactgt

SEQ ID NO: 687319 - DNA, 25 bp, Artificial sequence
  Synthetic oligonucleotide
actatgagacatatatgagactgca

SEQ ID NO: 687320 - DNA, 25 bp, Artificial sequence
  Synthetic oligonucleotide
actatgagacatttatgagactgca

SEQ ID NO: 687321 - DNA, 25 bp, Artificial sequence
  Synthetic oligonucleotide
tcaccagcataattgaaaataaaat

SEQ ID NO: 687322 - DNA, 25 bp, Artificial sequence
  Synthetic oligonucleotide
ttatatatggcttatagagcgatag

SEQ ID NO: 687323 - DNA, 25 bp, Artificial sequence
  Synthetic oligonucleotide
taatccaagtcttgcctctggcctt

SEQ ID NO: 687324 - DNA, 25 bp, Artificial sequence
  Synthetic oligonucleotide
tattgcattcatcctatgtactgca

SEQ ID NO: 687325 - DNA, 25 bp, Artificial sequence
  Synthetic oligonucleotide
ggtttcgtgtatttattcccgcttg

SEQ ID NO: 687326 - DNA, 25 bp, Artificial sequence
  Synthetic oligonucleotide
gttaatgattattcgaaatatcgag

SEQ ID NO: 687327 - DNA, 25 bp, Artificial sequence
  Synthetic oligonucleotide
tcaagtatagttagaaaaagactgt

SEQ ID NO: 687328 - DNA, 25 bp, Artificial sequence
  Synthetic oligonucleotide
tattgcattcatgctatgtactgca

SEQ ID NO: 687329 - DNA, 25 bp, Artificial sequence
  Synthetic oligonucleotide
tatggttcgtattcaaaattatgca

SEQ ID NO: 687330 - DNA, 25 bp, Artificial sequence
  Synthetic oligonucleotide
tatggttcgtatacaaaattatgca

SEQ ID NO: 687331 - DNA, 25 bp, Artificial sequence
  Synthetic oligonucleotide
tggcattcacgtaaaaatcttcctg

SEQ ID NO: 687332 - DNA, 25 bp, Artificial sequence
  Synthetic oligonucleotide
tggcattcacgttaaaatcttcctg

SEQ ID NO: 687333 - DNA, 25 bp, Artificial sequence
  Synthetic oligonucleotide
tataaaacgtatttttggcgtacga

SEQ ID NO: 687334 - DNA, 25 bp, Artificial sequence
  Synthetic oligonucleotide
tataaaacgtatatttggcgtacga

SEQ ID NO: 687335 - DNA, 25 bp, Artificial sequence
  Synthetic oligonucleotide
ttattaaatcttttttgttgttgac

SEQ ID NO: 687336 - DNA, 25 bp, Artificial sequence
  Synthetic oligonucleotide
ggtttcgtgtatatattcccgcttg

SEQ ID NO: 687337 - DNA, 25 bp, Artificial sequence
  Synthetic oligonucleotide
tgagtccatgtcaaggctacctatc

SEQ ID NO: 687338 - DNA, 25 bp, Artificial sequence
  Synthetic oligonucleotide
taattgtgttatgacccaaaagaga

SEQ ID NO: 687339 - DNA, 25 bp, Artificial sequence
  Synthetic oligonucleotide
taattgtgttatcacccaaaagaga

SEQ ID NO: 687340 - DNA, 25 bp, Artificial sequence
  Synthetic oligonucleotide
cacaatggctttggctttgaggttc

SEQ ID NO: 687341 - DNA, 25 bp, Artificial sequence
  Synthetic oligonucleotide
cacaatggctttcgctttgaggttc

SEQ ID NO: 687342 - DNA, 25 bp, Artificial sequence
  Synthetic oligonucleotide
tgttttgacagtcttcatcgttgca

SEQ ID NO: 687343 - DNA, 25 bp, Artificial sequence
  Synthetic oligonucleotide
tgttttgacagtgttcatcgttgca

SEQ ID NO: 687344 - DNA, 25 bp, Artificial sequence
  Synthetic oligonucleotide
gcagcaataacatgtggcacagtgg

SEQ ID NO: 687345 - DNA, 25 bp, Artificial sequence
  Synthetic oligonucleotide
tccaacaacaaaacacaagcgtaga

SEQ ID NO: 687346 - DNA, 25 bp, Artificial sequence
  Synthetic oligonucleotide
tgagtccatgtctaggctacctatc

SEQ ID NO: 687347 - DNA, 25 bp, Artificial sequence
  Synthetic oligonucleotide
gcatgcagatgcttacagtccgctg

SEQ ID NO: 687348 - DNA, 25 bp, Artificial sequence
  Synthetic oligonucleotide
ggtgccacctccgtgctgtgcagga

SEQ ID NO: 687349 - DNA, 25 bp, Artificial sequence
  Synthetic oligonucleotide
ggtgccacctccctgctgtgcagga

SEQ ID NO: 687350 - DNA, 25 bp, Artificial sequence
  Synthetic oligonucleotide
tgaacggtatgggtcaaaccacacc

SEQ ID NO: 687351 - DNA, 25 bp, Artificial sequence
  Synthetic oligonucleotide
tgaacggtatggctcaaaccacacc

SEQ ID NO: 687352 - DNA, 25 bp, Artificial sequence
  Synthetic oligonucleotide
gcatgcagatgcatacagtccgctg

SEQ ID NO: 687353 - DNA, 25 bp, Artificial sequence
  Synthetic oligonucleotide
taactgcagatatatgaatatatat

SEQ ID NO: 687354 - DNA, 25 bp, Artificial sequence
  Synthetic oligonucleotide
ttatatatggctaatagagcgatag

SEQ ID NO: 687355 - DNA, 25 bp, Artificial sequence
  Synthetic oligonucleotide
gcagcaataacaagtggcacagtgg

SEQ ID NO: 687356 - DNA, 25 bp, Artificial sequence
  Synthetic oligonucleotide
tacatatgactgcagaaactaatta

SEQ ID NO: 687357 - DNA, 25 bp, Artificial sequence
  Synthetic oligonucleotide
taatccaagtctagcctctggcctt

SEQ ID NO: 687358 - DNA, 25 bp, Artificial sequence
  Synthetic oligonucleotide
cagtatagctgtttatatattgacg

SEQ ID NO: 687359 - DNA, 25 bp, Artificial sequence
  Synthetic oligonucleotide
tacattctgaaaactgatactattg

SEQ ID NO: 687360 - DNA, 25 bp, Artificial sequence
  Synthetic oligonucleotide
tccaacaacaaatcacaagcgtaga

SEQ ID NO: 687361 - DNA, 25 bp, Artificial sequence
  Synthetic oligonucleotide
tacatatgactggagaaactaatta

SEQ ID NO: 687362 - DNA, 25 bp, Artificial sequence
  Synthetic oligonucleotide
cagtatagctgtatatatattgacg

SEQ ID NO: 687363 - DNA, 25 bp, Artificial sequence
  Synthetic oligonucleotide
gaaacataactacatatgactggag

SEQ ID NO: 687364 - DNA, 25 bp, Artificial sequence
  Synthetic oligonucleotide
gaaacataactagatatgactggag

SEQ ID NO: 687365 - DNA, 25 bp, Artificial sequence
  Synthetic oligonucleotide
tatataaacccatcatcatctccca

SEQ ID NO: 687366 - DNA, 25 bp, Artificial sequence
  Synthetic oligonucleotide
ttcgttagtagaagaaactagaaag

SEQ ID NO: 687367 - DNA, 25 bp, Artificial sequence
  Synthetic oligonucleotide
taaatgcaaaacgaactactaacaa

SEQ ID NO: 687368 - DNA, 25 bp, Artificial sequence
  Synthetic oligonucleotide
taaatgcaaaaccaactactaacaa

SEQ ID NO: 687369 - DNA, 25 bp, Artificial sequence
  Synthetic oligonucleotide
tagtcatcatttttcccccatacga

SEQ ID NO: 687370 - DNA, 25 bp, Artificial sequence
  Synthetic oligonucleotide
tagtcatcatttatcccccatacga

SEQ ID NO: 687371 - DNA, 25 bp, Artificial sequence
  Synthetic oligonucleotide
ttcgttagtagatgaaactagaaag

SEQ ID NO: 687372 - DNA, 25 bp, Artificial sequence
  Synthetic oligonucleotide
tatataaacccaacatcatctccca

SEQ ID NO: 687373 - DNA, 25 bp, Artificial sequence
  Synthetic oligonucleotide
tacattctgaaatctgatactattg

SEQ ID NO: 687374 - DNA, 25 bp, Artificial sequence
  Synthetic oligonucleotide
taaccaagaattgataaacaaactg

SEQ ID NO: 687375 - DNA, 25 bp, Artificial sequence
  Synthetic oligonucleotide
taaccaagaattcataaacaaactg

SEQ ID NO: 687376 - DNA, 25 bp, Artificial sequence
  Synthetic oligonucleotide
tctcgatcaactgtgaaaaatatat

SEQ ID NO: 687377 - DNA, 25 bp, Artificial sequence
  Synthetic oligonucleotide
tctcgatcaactctgaaaaatatat

SEQ ID NO: 687378 - DNA, 25 bp, Artificial sequence
  Synthetic oligonucleotide
tattgaaaatgcgttagtaaacact

SEQ ID NO: 687379 - DNA, 25 bp, Artificial sequence
  Synthetic oligonucleotide
gaaacattctccttgcttccaccct

SEQ ID NO: 687380 - DNA, 25 bp, Artificial sequence
  Synthetic oligonucleotide
tattgaaaatgccttagtaaacact

SEQ ID NO: 687381 - DNA, 25 bp, Artificial sequence
  Synthetic oligonucleotide
gaactagcttccattattgcaactt

SEQ ID NO: 687382 - DNA, 25 bp, Artificial sequence
  Synthetic oligonucleotide
gaactagcttcctttattgcaactt

SEQ ID NO: 687383 - DNA, 25 bp, Artificial sequence
  Synthetic oligonucleotide
gaaacatgaagtaaatctacagcct

SEQ ID NO: 687384 - DNA, 25 bp, Artificial sequence
  Synthetic oligonucleotide
gaaacatgaagttaatctacagcct

SEQ ID NO: 687385 - DNA, 25 bp, Artificial sequence
  Synthetic oligonucleotide
tgtttctgttaattatagcaattcc

SEQ ID NO: 687386 - DNA, 25 bp, Artificial sequence
  Synthetic oligonucleotide
tgtttctgttaaatatagcaattcc

SEQ ID NO: 687387 - DNA, 25 bp, Artificial sequence
  Synthetic oligonucleotide
cgtaaactctaaaacctaatatcag

SEQ ID NO: 687388 - DNA, 25 bp, Artificial sequence
  Synthetic oligonucleotide
aaatcttaaaggaagctactacaag

SEQ ID NO: 687389 - DNA, 25 bp, Artificial sequence
  Synthetic oligonucleotide
gagtccggctttaggaaaagttcga

SEQ ID NO: 687390 - DNA, 25 bp, Artificial sequence
  Synthetic oligonucleotide
cgtaaactctaatacctaatatcag

SEQ ID NO: 687391 - DNA, 25 bp, Artificial sequence
  Synthetic oligonucleotide
tttcttttttttacagtatccagtg

SEQ ID NO: 687392 - DNA, 25 bp, Artificial sequence
  Synthetic oligonucleotide
ccttctaaatgtggtgtcgatctcc

SEQ ID NO: 687393 - DNA, 25 bp, Artificial sequence
  Synthetic oligonucleotide
gcatttgtagcttcgttcttagagt

SEQ ID NO: 687394 - DNA, 25 bp, Artificial sequence
  Synthetic oligonucleotide
gagtccggcttttggaaaagttcga

SEQ ID NO: 687395 - DNA, 25 bp, Artificial sequence
  Synthetic oligonucleotide
gcccttccactgtctgcgacaggta

SEQ ID NO: 687396 - DNA, 25 bp, Artificial sequence
  Synthetic oligonucleotide
gcccttccactgactgcgacaggta

SEQ ID NO: 687397 - DNA, 25 bp, Artificial sequence
  Synthetic oligonucleotide
cactctctctctatgtgattactga

SEQ ID NO: 687398 - DNA, 25 bp, Artificial sequence
  Synthetic oligonucleotide
cctaataattaataaatgagggcat

SEQ ID NO: 687399 - DNA, 25 bp, Artificial sequence
  Synthetic oligonucleotide
tttctttttttttcagtatccagtg

SEQ ID NO: 687400 - DNA, 25 bp, Artificial sequence
  Synthetic oligonucleotide
gaaacattctccatgcttccaccct

SEQ ID NO: 687401 - DNA, 25 bp, Artificial sequence
  Synthetic oligonucleotide
aaatcttaaaggtagctactacaag

SEQ ID NO: 687402 - DNA, 25 bp, Artificial sequence
  Synthetic oligonucleotide
cctaataattaaaaaatgagggcat

SEQ ID NO: 687403 - DNA, 25 bp, Artificial sequence
  Synthetic oligonucleotide
gctagttgctaaatgatcagtgatg

SEQ ID NO: 687404 - DNA, 25 bp, Artificial sequence
  Synthetic oligonucleotide
gctagttgctaattgatcagtgatg

SEQ ID NO: 687405 - DNA, 25 bp, Artificial sequence
  Synthetic oligonucleotide
gaatgttctaatatcagcaggcact

SEQ ID NO: 687406 - DNA, 25 bp, Artificial sequence
  Synthetic oligonucleotide
gaatgttctaatttcagcaggcact

SEQ ID NO: 687407 - DNA, 25 bp, Artificial sequence
  Synthetic oligonucleotide
ccttctaaatgtcgtgtcgatctcc

SEQ ID NO: 687408 - DNA, 25 bp, Artificial sequence
  Synthetic oligonucleotide
cactctctctctttgtgattactga

SEQ ID NO: 687409 - DNA, 25 bp, Artificial sequence
  Synthetic oligonucleotide
gggattgatgaatatagagaaaccg

SEQ ID NO: 687410 - DNA, 25 bp, Artificial sequence
  Synthetic oligonucleotide
taacctaacaaacacacaatctgca

SEQ ID NO: 687411 - DNA, 25 bp, Artificial sequence
  Synthetic oligonucleotide
caaaaacatttcatttacgtcaaga

SEQ ID NO: 687412 - DNA, 25 bp, Artificial sequence
  Synthetic oligonucleotide
caaaaacatttcttttacgtcaaga

SEQ ID NO: 687413 - DNA, 25 bp, Artificial sequence
  Synthetic oligonucleotide
catgttcttgaaacaaaaagagtaa

SEQ ID NO: 687414 - DNA, 25 bp, Artificial sequence
  Synthetic oligonucleotide
catgttcttgaatcaaaaagagtaa

SEQ ID NO: 687415 - DNA, 25 bp, Artificial sequence
  Synthetic oligonucleotide
cacaaaaaaaaaacgaacatatcac

SEQ ID NO: 687416 - DNA, 25 bp, Artificial sequence
  Synthetic oligonucleotide
cactaaaagagacatactatttgac

SEQ ID NO: 687417 - DNA, 25 bp, Artificial sequence
  Synthetic oligonucleotide
gggattgatgaaaatagagaaaccg

SEQ ID NO: 687418 - DNA, 25 bp, Artificial sequence
  Synthetic oligonucleotide
cactaaaagagagatactatttgac

SEQ ID NO: 687419 - DNA, 25 bp, Artificial sequence
  Synthetic oligonucleotide
gtcggagtttaggacttttatgggc

SEQ ID NO: 687420 - DNA, 25 bp, Artificial sequence
  Synthetic oligonucleotide
gtcggagtttagcacttttatgggc

SEQ ID NO: 687421 - DNA, 25 bp, Artificial sequence
  Synthetic oligonucleotide
gaagtcttctctttttatccaatcc

SEQ ID NO: 687422 - DNA, 25 bp, Artificial sequence
  Synthetic oligonucleotide
gaagtcttctctatttatccaatcc

SEQ ID NO: 687423 - DNA, 25 bp, Artificial sequence
  Synthetic oligonucleotide
ccaaatgacctaaattgattgtttg

SEQ ID NO: 687424 - DNA, 25 bp, Artificial sequence
  Synthetic oligonucleotide
ctctctcctagatccatccaaaatg

SEQ ID NO: 687425 - DNA, 25 bp, Artificial sequence
  Synthetic oligonucleotide
cacaaaaaaaaatcgaacatatcac

SEQ ID NO: 687426 - DNA, 25 bp, Artificial sequence
  Synthetic oligonucleotide
caagacttatatttcactgttatta

SEQ ID NO: 687427 - DNA, 25 bp, Artificial sequence
  Synthetic oligonucleotide
taaaatggtgctctaatggtaaaag

SEQ ID NO: 687428 - DNA, 25 bp, Artificial sequence
  Synthetic oligonucleotide
tggttaattcgaacaaataaaactt

SEQ ID NO: 687429 - DNA, 25 bp, Artificial sequence
  Synthetic oligonucleotide
tggttaattcgatcaaataaaactt

SEQ ID NO: 687430 - DNA, 25 bp, Artificial sequence
  Synthetic oligonucleotide
tgctctgaaaaaggcttaagaccaa

SEQ ID NO: 687431 - DNA, 25 bp, Artificial sequence
  Synthetic oligonucleotide
tgctctgaaaaacgcttaagaccaa

SEQ ID NO: 687432 - DNA, 25 bp, Artificial sequence
  Synthetic oligonucleotide
gatacttttatcagttcaaattgcc

SEQ ID NO: 687433 - DNA, 25 bp, Artificial sequence
  Synthetic oligonucleotide
taacctaacaaagacacaatctgca

SEQ ID NO: 687434 - DNA, 25 bp, Artificial sequence
  Synthetic oligonucleotide
caagacttatatatcactgttatta

SEQ ID NO: 687435 - DNA, 25 bp, Artificial sequence
  Synthetic oligonucleotide
gcatttgtagctacgttcttagagt

SEQ ID NO: 687436 - DNA, 25 bp, Artificial sequence
  Synthetic oligonucleotide
ccaaatgacctatattgattgtttg

SEQ ID NO: 687437 - DNA, 25 bp, Artificial sequence
  Synthetic oligonucleotide
tatctgaaaatgcaatggaatattc

SEQ ID NO: 687438 - DNA, 25 bp, Artificial sequence
  Synthetic oligonucleotide
acaaataagatttatttggttaaca

SEQ ID NO: 687439 - DNA, 25 bp, Artificial sequence
  Synthetic oligonucleotide
acaaataagattaatttggttaaca

SEQ ID NO: 687440 - DNA, 25 bp, Artificial sequence
  Synthetic oligonucleotide
caatatagtttaatttttatgcata

SEQ ID NO: 687441 - DNA, 25 bp, Artificial sequence
  Synthetic oligonucleotide
caatatagtttattttttatgcata

SEQ ID NO: 687442 - DNA, 25 bp, Artificial sequence
  Synthetic oligonucleotide
taaaatggtgctgtaatggtaaaag

SEQ ID NO: 687443 - DNA, 25 bp, Artificial sequence
  Synthetic oligonucleotide
gatacttttatctgttcaaattgcc

SEQ ID NO: 687444 - DNA, 25 bp, Artificial sequence
  Synthetic oligonucleotide
tacacacatgggataaacactatcc

SEQ ID NO: 687445 - DNA, 25 bp, Artificial sequence
  Synthetic oligonucleotide
tgtaacaacaaatcgtaccaaccgc

SEQ ID NO: 687446 - DNA, 25 bp, Artificial sequence
  Synthetic oligonucleotide
tgtaacaacaaaacgtaccaaccgc

SEQ ID NO: 687447 - DNA, 25 bp, Artificial sequence
  Synthetic oligonucleotide
tctttatctagagcgtcaatgcact

SEQ ID NO: 687448 - DNA, 25 bp, Artificial sequence
  Synthetic oligonucleotide
tctttatctagaccgtcaatgcact

SEQ ID NO: 687449 - DNA, 25 bp, Artificial sequence
  Synthetic oligonucleotide
tacaactcaatatccatcgcctaaa

SEQ ID NO: 687450 - DNA, 25 bp, Artificial sequence
  Synthetic oligonucleotide
tacaactcaataaccatcgcctaaa

SEQ ID NO: 687451 - DNA, 25 bp, Artificial sequence
  Synthetic oligonucleotide
ggcattaaatcaaacactactgaat

SEQ ID NO: 687452 - DNA, 25 bp, Artificial sequence
  Synthetic oligonucleotide
tccttttgtcgaggttgatattgac

SEQ ID NO: 687453 - DNA, 25 bp, Artificial sequence
  Synthetic oligonucleotide
gatcaatttcactccacagctctta

SEQ ID NO: 687454 - DNA, 25 bp, Artificial sequence
  Synthetic oligonucleotide
tacacacatgggttaaacactatcc

SEQ ID NO: 687455 - DNA, 25 bp, Artificial sequence
  Synthetic oligonucleotide
tgtagatgagaagtgaaatcctttt

SEQ ID NO: 687456 - DNA, 25 bp, Artificial sequence
  Synthetic oligonucleotide
tgtagatgagaactgaaatcctttt

SEQ ID NO: 687457 - DNA, 25 bp, Artificial sequence
  Synthetic oligonucleotide
tcaaagcagtttaaaaactttgaat

SEQ ID NO: 687458 - DNA, 25 bp, Artificial sequence
  Synthetic oligonucleotide
tcaaagcagttttaaaactttgaat

SEQ ID NO: 687459 - DNA, 25 bp, Artificial sequence
  Synthetic oligonucleotide
ggcattaaatcatacactactgaat

SEQ ID NO: 687460 - DNA, 25 bp, Artificial sequence
  Synthetic oligonucleotide
tccttttgtcgacgttgatattgac

SEQ ID NO: 687461 - DNA, 25 bp, Artificial sequence
  Synthetic oligonucleotide
gaatacatgtttcttctgaatcagg

SEQ ID NO: 687462 - DNA, 25 bp, Artificial sequence
  Synthetic oligonucleotide
ctctctcctagaaccatccaaaatg

SEQ ID NO: 687463 - DNA, 25 bp, Artificial sequence
  Synthetic oligonucleotide
tatctgaaaatggaatggaatattc

SEQ ID NO: 687464 - DNA, 25 bp, Artificial sequence
  Synthetic oligonucleotide
taaataccatgtcaatgtgtatagt

SEQ ID NO: 687465 - DNA, 25 bp, Artificial sequence
  Synthetic oligonucleotide
taaataccatgtgaatgtgtatagt

SEQ ID NO: 687466 - DNA, 25 bp, Artificial sequence
  Synthetic oligonucleotide
caattgatctcgtattttattgact

SEQ ID NO: 687467 - DNA, 25 bp, Artificial sequence
  Synthetic oligonucleotide
caattgatctcgaattttattgact

SEQ ID NO: 687468 - DNA, 25 bp, Artificial sequence
  Synthetic oligonucleotide
aagatgctccttcatatttgtgcta

SEQ ID NO: 687469 - DNA, 25 bp, Artificial sequence
  Synthetic oligonucleotide
taataatacaaggtacagaatttgg

SEQ ID NO: 687470 - DNA, 25 bp, Artificial sequence
  Synthetic oligonucleotide
aagatgctccttgatatttgtgcta

SEQ ID NO: 687471 - DNA, 25 bp, Artificial sequence
  Synthetic oligonucleotide
gaatacatgtttgttctgaatcagg

SEQ ID NO: 687472 - DNA, 25 bp, Artificial sequence
  Synthetic oligonucleotide
tcggctaaaccgtacaaaattggga

SEQ ID NO: 687473 - DNA, 25 bp, Artificial sequence
  Synthetic oligonucleotide
tcggctaaaccgaacaaaattggga

SEQ ID NO: 687474 - DNA, 25 bp, Artificial sequence
  Synthetic oligonucleotide
tacttgatggaatccaaccaaaacg

SEQ ID NO: 687475 - DNA, 25 bp, Artificial sequence
  Synthetic oligonucleotide
tacttgatggaaaccaaccaaaacg

SEQ ID NO: 687476 - DNA, 25 bp, Artificial sequence
  Synthetic oligonucleotide
gatcaatttcacaccacagctctta

SEQ ID NO: 687477 - DNA, 25 bp, Artificial sequence
  Synthetic oligonucleotide
taataatacaagctacagaatttgg

SEQ ID NO: 687478 - DNA, 25 bp, Artificial sequence
  Synthetic oligonucleotide
gagttgtaaaagatggatacagccc

SEQ ID NO: 687479 - DNA, 25 bp, Artificial sequence
  Synthetic oligonucleotide
gatctttaccctagcttatcctacg

SEQ ID NO: 687480 - DNA, 25 bp, Artificial sequence
  Synthetic oligonucleotide
taaataacctctctattttctaacc

SEQ ID NO: 687481 - DNA, 25 bp, Artificial sequence
  Synthetic oligonucleotide
taaataacctctgtattttctaacc

SEQ ID NO: 687482 - DNA, 25 bp, Artificial sequence
  Synthetic oligonucleotide
aaaaaaaacagatagtaacatgaga

SEQ ID NO: 687483 - DNA, 25 bp, Artificial sequence
  Synthetic oligonucleotide
aaaaaaaacagaaagtaacatgaga

SEQ ID NO: 687484 - DNA, 25 bp, Artificial sequence
  Synthetic oligonucleotide
tattagccgtgtccctggttcttgc

SEQ ID NO: 687485 - DNA, 25 bp, Artificial sequence
  Synthetic oligonucleotide
tattagccgtgtgcctggttcttgc

SEQ ID NO: 687486 - DNA, 25 bp, Artificial sequence
  Synthetic oligonucleotide
ggtgaagcagccctgtcttgcaaca

SEQ ID NO: 687487 - DNA, 25 bp, Artificial sequence
  Synthetic oligonucleotide
actcttcctcaagtaccaatctcaa

SEQ ID NO: 687488 - DNA, 25 bp, Artificial sequence
  Synthetic oligonucleotide
gatctttacccttgcttatcctacg

SEQ ID NO: 687489 - DNA, 25 bp, Artificial sequence
  Synthetic oligonucleotide
ggtcccaaccctctgctgcaacggt

SEQ ID NO: 687490 - DNA, 25 bp, Artificial sequence
  Synthetic oligonucleotide
ggtcccaaccctgtgctgcaacggt

SEQ ID NO: 687491 - DNA, 25 bp, Artificial sequence
  Synthetic oligonucleotide
caagagtcaggcacaaacttctgtg

SEQ ID NO: 687492 - DNA, 25 bp, Artificial sequence
  Synthetic oligonucleotide
caagagtcaggctcaaacttctgtg

SEQ ID NO: 687493 - DNA, 25 bp, Artificial sequence
  Synthetic oligonucleotide
tcaaaccagtaacaaattaaatact

SEQ ID NO: 687494 - DNA, 25 bp, Artificial sequence
  Synthetic oligonucleotide
gagttgtaaaagttggatacagccc

SEQ ID NO: 687495 - DNA, 25 bp, Artificial sequence
  Synthetic oligonucleotide
gggtctgtcgttccatcaaatctgc

SEQ ID NO: 687496 - DNA, 25 bp, Artificial sequence
  Synthetic oligonucleotide
gggtctgtcgttgcatcaaatctgc

SEQ ID NO: 687497 - DNA, 25 bp, Artificial sequence
  Synthetic oligonucleotide
ggtgaagcagccgtgtcttgcaaca

SEQ ID NO: 687498 - DNA, 25 bp, Artificial sequence
  Synthetic oligonucleotide
tagtaggccttttttattgattaag

SEQ ID NO: 687499 - DNA, 25 bp, Artificial sequence
  Synthetic oligonucleotide
taacaactcttcacattgtagttgg

SEQ ID NO: 687500 - DNA, 25 bp, Artificial sequence
  Synthetic oligonucleotide
actcttcctcaactaccaatctcaa

SEQ ID NO: 687501 - DNA, 25 bp, Artificial sequence
  Synthetic oligonucleotide
taacaactcttctcattgtagttgg

SEQ ID NO: 687502 - DNA, 25 bp, Artificial sequence
  Synthetic oligonucleotide
tcctatcttaatgtattagtctttt

SEQ ID NO: 687503 - DNA, 25 bp, Artificial sequence
  Synthetic oligonucleotide
tagtaggcctttattattgattaag

SEQ ID NO: 687504 - DNA, 25 bp, Artificial sequence
  Synthetic oligonucleotide
tcctatcttaatctattagtctttt

SEQ ID NO: 687505 - DNA, 25 bp, Artificial sequence
  Synthetic oligonucleotide
tggatagttaaagaagaaaaaatgt

SEQ ID NO: 687506 - DNA, 25 bp, Artificial sequence
  Synthetic oligonucleotide
tggatagttaaacaagaaaaaatgt

SEQ ID NO: 687507 - DNA, 25 bp, Artificial sequence
  Synthetic oligonucleotide
caactaactaacagtaacactcgtg

SEQ ID NO: 687508 - DNA, 25 bp, Artificial sequence
  Synthetic oligonucleotide
tcaaaccagtaagaaattaaatact

SEQ ID NO: 687509 - DNA, 25 bp, Artificial sequence
  Synthetic oligonucleotide
tattgttagatacaatgcagttgaa

SEQ ID NO: 687510 - DNA, 25 bp, Artificial sequence
  Synthetic oligonucleotide
gatcttaattggctgaaggtaaaca

SEQ ID NO: 687511 - DNA, 25 bp, Artificial sequence
  Synthetic oligonucleotide
gatcttaattgggtgaaggtaaaca

SEQ ID NO: 687512 - DNA, 25 bp, Artificial sequence
  Synthetic oligonucleotide
tattgttagatagaatgcagttgaa

SEQ ID NO: 687513 - DNA, 25 bp, Artificial sequence
  Synthetic oligonucleotide
caactaactaactgtaacactcgtg

SEQ ID NO: 687514 - DNA, 25 bp, Artificial sequence
  Synthetic oligonucleotide
tttcagcttaaactatattcacccg

SEQ ID NO: 687515 - DNA, 25 bp, Artificial sequence
  Synthetic oligonucleotide
tgcttatacctgaaagaacccttgc

SEQ ID NO: 687516 - DNA, 25 bp, Artificial sequence
  Synthetic oligonucleotide
tgcttatacctgtaagaacccttgc

SEQ ID NO: 687517 - DNA, 25 bp, Artificial sequence
  Synthetic oligonucleotide
gctatgggcaactctcttttatgga

SEQ ID NO: 687518 - DNA, 25 bp, Artificial sequence
  Synthetic oligonucleotide
gctatgggcaacactcttttatgga

SEQ ID NO: 687519 - DNA, 25 bp, Artificial sequence
  Synthetic oligonucleotide
tgatattcattataccatgacgcag

SEQ ID NO: 687520 - DNA, 25 bp, Artificial sequence
  Synthetic oligonucleotide
tttgatgtggtatatataagctctc

SEQ ID NO: 687521 - DNA, 25 bp, Artificial sequence
  Synthetic oligonucleotide
tttcagcttaaagtatattcacccg

SEQ ID NO: 687522 - DNA, 25 bp, Artificial sequence
  Synthetic oligonucleotide
tttgatgtggtaaatataagctctc

SEQ ID NO: 687523 - DNA, 25 bp, Artificial sequence
  Synthetic oligonucleotide
gaaacgggcttatgatccctcgagc

SEQ ID NO: 687524 - DNA, 25 bp, Artificial sequence
  Synthetic oligonucleotide
ggttggttacttgacagatactctc

SEQ ID NO: 687525 - DNA, 25 bp, Artificial sequence
  Synthetic oligonucleotide
gaaacgggcttaagatccctcgagc

SEQ ID NO: 687526 - DNA, 25 bp, Artificial sequence
  Synthetic oligonucleotide
tgatattcattaaaccatgacgcag

SEQ ID NO: 687527 - DNA, 25 bp, Artificial sequence
  Synthetic oligonucleotide
catcgttccattattgttttccacc

SEQ ID NO: 687528 - DNA, 25 bp, Artificial sequence
  Synthetic oligonucleotide
cgtttcttcccccatttgtatgaaa

SEQ ID NO: 687529 - DNA, 25 bp, Artificial sequence
  Synthetic oligonucleotide
ctttgtggagagttgcagtggctta

SEQ ID NO: 687530 - DNA, 25 bp, Artificial sequence
  Synthetic oligonucleotide
cgtttcttccccgatttgtatgaaa

SEQ ID NO: 687531 - DNA, 25 bp, Artificial sequence
  Synthetic oligonucleotide
ccaagtctgtattaggattctctga

SEQ ID NO: 687532 - DNA, 25 bp, Artificial sequence
  Synthetic oligonucleotide
ggcttatcgtcattcacaatgttgc

SEQ ID NO: 687533 - DNA, 25 bp, Artificial sequence
  Synthetic oligonucleotide
ttcgtggcagcttcaattggtttga

SEQ ID NO: 687534 - DNA, 25 bp, Artificial sequence
  Synthetic oligonucleotide
catcgttccatttttgttttccacc

SEQ ID NO: 687535 - DNA, 25 bp, Artificial sequence
  Synthetic oligonucleotide
ttgtcacaagtatatgagtttatcg

SEQ ID NO: 687536 - DNA, 25 bp, Artificial sequence
  Synthetic oligonucleotide
ggttggttacttcacagatactctc

SEQ ID NO: 687537 - DNA, 25 bp, Artificial sequence
  Synthetic oligonucleotide
ttcgtggcagctacaattggtttga

SEQ ID NO: 687538 - DNA, 25 bp, Artificial sequence
  Synthetic oligonucleotide
tgtgagatgttcataaatcactctc

SEQ ID NO: 687539 - DNA, 25 bp, Artificial sequence
  Synthetic oligonucleotide
ttctccacagggaaaattgcaccag

SEQ ID NO: 687540 - DNA, 25 bp, Artificial sequence
  Synthetic oligonucleotide
ttctccacagggtaaattgcaccag

SEQ ID NO: 687541 - DNA, 25 bp, Artificial sequence
  Synthetic oligonucleotide
ttgtcacaagtaaatgagtttatcg

SEQ ID NO: 687542 - DNA, 25 bp, Artificial sequence
  Synthetic oligonucleotide
tgtgagatgttcttaaatcactctc

SEQ ID NO: 687543 - DNA, 25 bp, Artificial sequence
  Synthetic oligonucleotide
gatgtgtagttgattatatggataa

SEQ ID NO: 687544 - DNA, 25 bp, Artificial sequence
  Synthetic oligonucleotide
ggagattatctcgaaacctttttaa

SEQ ID NO: 687545 - DNA, 25 bp, Artificial sequence
  Synthetic oligonucleotide
tattagcttgggaaatattgtaacc

SEQ ID NO: 687546 - DNA, 25 bp, Artificial sequence
  Synthetic oligonucleotide
tgcatctccggccaccggggttgat

SEQ ID NO: 687547 - DNA, 25 bp, Artificial sequence
  Synthetic oligonucleotide
ctttgtggagagatgcagtggctta

SEQ ID NO: 687548 - DNA, 25 bp, Artificial sequence
  Synthetic oligonucleotide
tattagcttgggtaatattgtaacc

SEQ ID NO: 687549 - DNA, 25 bp, Artificial sequence
  Synthetic oligonucleotide
gctaagtgttggttgccgaatctct

SEQ ID NO: 687550 - DNA, 25 bp, Artificial sequence
  Synthetic oligonucleotide
gctaagtgttggatgccgaatctct

SEQ ID NO: 687551 - DNA, 25 bp, Artificial sequence
  Synthetic oligonucleotide
caatttcgcttctgtcctcgtgttg

SEQ ID NO: 687552 - DNA, 25 bp, Artificial sequence
  Synthetic oligonucleotide
caatttcgcttcagtcctcgtgttg

SEQ ID NO: 687553 - DNA, 25 bp, Artificial sequence
  Synthetic oligonucleotide
tatgaacaaaaataactatgtcagg

SEQ ID NO: 687554 - DNA, 25 bp, Artificial sequence
  Synthetic oligonucleotide
tatgaacaaaaaaaactatgtcagg

SEQ ID NO: 687555 - DNA, 25 bp, Artificial sequence
  Synthetic oligonucleotide
tagaaaaaaaaattggtggccttga

SEQ ID NO: 687556 - DNA, 25 bp, Artificial sequence
  Synthetic oligonucleotide
tagaaaaaaaaaatggtggccttga

SEQ ID NO: 687557 - DNA, 25 bp, Artificial sequence
  Synthetic oligonucleotide
tcctggtttcgtagatccttcaaaa

SEQ ID NO: 687558 - DNA, 25 bp, Artificial sequence
  Synthetic oligonucleotide
tcatgtggatgcgagtttcccaaat

SEQ ID NO: 687559 - DNA, 25 bp, Artificial sequence
  Synthetic oligonucleotide
tcagtggacaaaatttctaaacccg

SEQ ID NO: 687560 - DNA, 25 bp, Artificial sequence
  Synthetic oligonucleotide
tcagtggacaaattttctaaacccg

SEQ ID NO: 687561 - DNA, 25 bp, Artificial sequence
  Synthetic oligonucleotide
tgctctttccctattggatatctga

SEQ ID NO: 687562 - DNA, 25 bp, Artificial sequence
  Synthetic oligonucleotide
tgctctttcccttttggatatctga

SEQ ID NO: 687563 - DNA, 25 bp, Artificial sequence
  Synthetic oligonucleotide
tcattttttctctcgttctttgaac

SEQ ID NO: 687564 - DNA, 25 bp, Artificial sequence
  Synthetic oligonucleotide
ccaagtctgtataaggattctctga

SEQ ID NO: 687565 - DNA, 25 bp, Artificial sequence
  Synthetic oligonucleotide
tcatgtggatgccagtttcccaaat

SEQ ID NO: 687566 - DNA, 25 bp, Artificial sequence
  Synthetic oligonucleotide
tcctggtttcgttgatccttcaaaa

SEQ ID NO: 687567 - DNA, 25 bp, Artificial sequence
  Synthetic oligonucleotide
tagggtctttatctggatggacagc

SEQ ID NO: 687568 - DNA, 25 bp, Artificial sequence
  Synthetic oligonucleotide
tagggtctttatgtggatggacagc

SEQ ID NO: 687569 - DNA, 25 bp, Artificial sequence
  Synthetic oligonucleotide
gaactgggaaacattcagagaaagg

SEQ ID NO: 687570 - DNA, 25 bp, Artificial sequence
  Synthetic oligonucleotide
ttctcttaactagctactggtaaga

SEQ ID NO: 687571 - DNA, 25 bp, Artificial sequence
  Synthetic oligonucleotide
gatgtgtagttgtttatatggataa

SEQ ID NO: 687572 - DNA, 25 bp, Artificial sequence
  Synthetic oligonucleotide
ggcttatcgtcaatcacaatgttgc

SEQ ID NO: 687573 - DNA, 25 bp, Artificial sequence
  Synthetic oligonucleotide
tcattttttctcacgttctttgaac

SEQ ID NO: 687574 - DNA, 25 bp, Artificial sequence
  Synthetic oligonucleotide
tttaaacaacccatctcttctctcg

SEQ ID NO: 687575 - DNA, 25 bp, Artificial sequence
  Synthetic oligonucleotide
caagcagcaatgactagattcccgt

SEQ ID NO: 687576 - DNA, 25 bp, Artificial sequence
  Synthetic oligonucleotide
caagcagcaatgtctagattcccgt

SEQ ID NO: 687577 - DNA, 25 bp, Artificial sequence
  Synthetic oligonucleotide
aaagatattatattacatagatcag

SEQ ID NO: 687578 - DNA, 25 bp, Artificial sequence
  Synthetic oligonucleotide
tgcatctccggcgaccggggttgat

SEQ ID NO: 687579 - DNA, 25 bp, Artificial sequence
  Synthetic oligonucleotide
ttaatcctccgcctcagcagaatcc

SEQ ID NO: 687580 - DNA, 25 bp, Artificial sequence
  Synthetic oligonucleotide
ttaatcctccgcgtcagcagaatcc

SEQ ID NO: 687581 - DNA, 25 bp, Artificial sequence
  Synthetic oligonucleotide
cctaatttgggacagcagacaccga

SEQ ID NO: 687582 - DNA, 25 bp, Artificial sequence
  Synthetic oligonucleotide
cctaatttgggagagcagacaccga

SEQ ID NO: 687583 - DNA, 25 bp, Artificial sequence
  Synthetic oligonucleotide
cagcagcagcagaatgtatcgagtc

SEQ ID NO: 687584 - DNA, 25 bp, Artificial sequence
  Synthetic oligonucleotide
cagcagcagcagtatgtatcgagtc

SEQ ID NO: 687585 - DNA, 25 bp, Artificial sequence
  Synthetic oligonucleotide
aaattgatgagggcattgaatcaca

SEQ ID NO: 687586 - DNA, 25 bp, Artificial sequence
  Synthetic oligonucleotide
aaattgatgaggccattgaatcaca

SEQ ID NO: 687587 - DNA, 25 bp, Artificial sequence
  Synthetic oligonucleotide
aatgcgcttatcaggacgcttggcg

SEQ ID NO: 687588 - DNA, 25 bp, Artificial sequence
  Synthetic oligonucleotide
atgcttctattgcagcaattgcaaa

SEQ ID NO: 687589 - DNA, 25 bp, Artificial sequence
  Synthetic oligonucleotide
ccgcagcaattagtatagttttcta

SEQ ID NO: 687590 - DNA, 25 bp, Artificial sequence
  Synthetic oligonucleotide
tctgttgtcctatttggtagtagaa

SEQ ID NO: 687591 - DNA, 25 bp, Artificial sequence
  Synthetic oligonucleotide
tgagttgttatctccttaggagtcg

SEQ ID NO: 687592 - DNA, 25 bp, Artificial sequence
  Synthetic oligonucleotide
tgagttgttatcaccttaggagtcg

SEQ ID NO: 687593 - DNA, 25 bp, Artificial sequence
  Synthetic oligonucleotide
taattgaatttattgatctatcacg

SEQ ID NO: 687594 - DNA, 25 bp, Artificial sequence
  Synthetic oligonucleotide
taattgaatttaatgatctatcacg

SEQ ID NO: 687595 - DNA, 25 bp, Artificial sequence
  Synthetic oligonucleotide
aatgcgcttatctggacgcttggcg

SEQ ID NO: 687596 - DNA, 25 bp, Artificial sequence
  Synthetic oligonucleotide
taatgatatcaaacattgatctatc

SEQ ID NO: 687597 - DNA, 25 bp, Artificial sequence
  Synthetic oligonucleotide
tttaaacaacccttctcttctctcg

SEQ ID NO: 687598 - DNA, 25 bp, Artificial sequence
  Synthetic oligonucleotide
ccgcagcaattactatagttttcta

SEQ ID NO: 687599 - DNA, 25 bp, Artificial sequence
  Synthetic oligonucleotide
ctttatatacttatgatgaaattca

SEQ ID NO: 687600 - DNA, 25 bp, Artificial sequence
  Synthetic oligonucleotide
ctttatatacttttgatgaaattca

SEQ ID NO: 687601 - DNA, 25 bp, Artificial sequence
  Synthetic oligonucleotide
cgagaggtttgtagtatcaaatgca

SEQ ID NO: 687602 - DNA, 25 bp, Artificial sequence
  Synthetic oligonucleotide
cgagaggtttgttgtatcaaatgca

SEQ ID NO: 687603 - DNA, 25 bp, Artificial sequence
  Synthetic oligonucleotide
atgcttctattggagcaattgcaaa

SEQ ID NO: 687604 - DNA, 25 bp, Artificial sequence
  Synthetic oligonucleotide
taatgatatcaatcattgatctatc

SEQ ID NO: 687605 - DNA, 25 bp, Artificial sequence
  Synthetic oligonucleotide
tcagctttggctttcgttttcccgg

SEQ ID NO: 687606 - DNA, 25 bp, Artificial sequence
  Synthetic oligonucleotide
tcgccgtttagaactttgaaagaac

SEQ ID NO: 687607 - DNA, 25 bp, Artificial sequence
  Synthetic oligonucleotide
ccgtaatgaatgaatgtacacgcca

SEQ ID NO: 687608 - DNA, 25 bp, Artificial sequence
  Synthetic oligonucleotide
ccgtaatgaatgtatgtacacgcca

SEQ ID NO: 687609 - DNA, 25 bp, Artificial sequence
  Synthetic oligonucleotide
tgttcaagcaagtccatagagatta

SEQ ID NO: 687610 - DNA, 25 bp, Artificial sequence
  Synthetic oligonucleotide
tgttcaagcaagaccatagagatta

SEQ ID NO: 687611 - DNA, 25 bp, Artificial sequence
  Synthetic oligonucleotide
tcattcttttttgctaagggttata

SEQ ID NO: 687612 - DNA, 25 bp, Artificial sequence
  Synthetic oligonucleotide
tcattcttttttcctaagggttata

SEQ ID NO: 687613 - DNA, 25 bp, Artificial sequence
  Synthetic oligonucleotide
ctactctgtaatttcatgtattttt

SEQ ID NO: 687614 - DNA, 25 bp, Artificial sequence
  Synthetic oligonucleotide
ctactctgtaatatcatgtattttt

SEQ ID NO: 687615 - DNA, 25 bp, Artificial sequence
  Synthetic oligonucleotide
gaatcatatagtaaaataatgtctg

SEQ ID NO: 687616 - DNA, 25 bp, Artificial sequence
  Synthetic oligonucleotide
gaatcatatagttaaataatgtctg

SEQ ID NO: 687617 - DNA, 25 bp, Artificial sequence
  Synthetic oligonucleotide
taacttttgatattgaacggtcaaa

SEQ ID NO: 687618 - DNA, 25 bp, Artificial sequence
  Synthetic oligonucleotide
taacttttgataatgaacggtcaaa

SEQ ID NO: 687619 - DNA, 25 bp, Artificial sequence
  Synthetic oligonucleotide
ggagattatctccaaacctttttaa

SEQ ID NO: 687620 - DNA, 25 bp, Artificial sequence
  Synthetic oligonucleotide
tcttctctcacttagacaagacaac

SEQ ID NO: 687621 - DNA, 25 bp, Artificial sequence
  Synthetic oligonucleotide
caaaaatggaggacacgaagccacc

SEQ ID NO: 687622 - DNA, 25 bp, Artificial sequence
  Synthetic oligonucleotide
caaaaatggaggtcacgaagccacc

SEQ ID NO: 687623 - DNA, 25 bp, Artificial sequence
  Synthetic oligonucleotide
tcccaaaatagattccctaaaagag

SEQ ID NO: 687624 - DNA, 25 bp, Artificial sequence
  Synthetic oligonucleotide
tcccaaaatagaatccctaaaagag

SEQ ID NO: 687625 - DNA, 25 bp, Artificial sequence
  Synthetic oligonucleotide
cacggcgaagaagatttccccgaaa

SEQ ID NO: 687626 - DNA, 25 bp, Artificial sequence
  Synthetic oligonucleotide
gaaacattctcggttcagctttggc

SEQ ID NO: 687627 - DNA, 25 bp, Artificial sequence
  Synthetic oligonucleotide
tcttctctcactaagacaagacaac

SEQ ID NO: 687628 - DNA, 25 bp, Artificial sequence
  Synthetic oligonucleotide
gaaacattctcgcttcagctttggc

SEQ ID NO: 687629 - DNA, 25 bp, Artificial sequence
  Synthetic oligonucleotide
gcccaattagataggcccagataaa

SEQ ID NO: 687630 - DNA, 25 bp, Artificial sequence
  Synthetic oligonucleotide
gcccaattagattggcccagataaa

SEQ ID NO: 687631 - DNA, 25 bp, Artificial sequence
  Synthetic oligonucleotide
tagttggcttaatatttgtggtctt

SEQ ID NO: 687632 - DNA, 25 bp, Artificial sequence
  Synthetic oligonucleotide
tagttggcttaaaatttgtggtctt

SEQ ID NO: 687633 - DNA, 25 bp, Artificial sequence
  Synthetic oligonucleotide
tcagctttggctatcgttttcccgg

SEQ ID NO: 687634 - DNA, 25 bp, Artificial sequence
  Synthetic oligonucleotide
tcgccgtttagatctttgaaagaac

SEQ ID NO: 687635 - DNA, 25 bp, Artificial sequence
  Synthetic oligonucleotide
cacggcgaagaacatttccccgaaa

SEQ ID NO: 687636 - DNA, 25 bp, Artificial sequence
  Synthetic oligonucleotide
cctctgttaccgaaacttgaagaaa

SEQ ID NO: 687637 - DNA, 25 bp, Artificial sequence
  Synthetic oligonucleotide
tcacaagattataggcgacagtagc

SEQ ID NO: 687638 - DNA, 25 bp, Artificial sequence
  Synthetic oligonucleotide
tatttctgtttctctttggtatcaa

SEQ ID NO: 687639 - DNA, 25 bp, Artificial sequence
  Synthetic oligonucleotide
tatttctgtttcactttggtatcaa

SEQ ID NO: 687640 - DNA, 25 bp, Artificial sequence
  Synthetic oligonucleotide
gagagttcgacttcgattgtgtagt

SEQ ID NO: 687641 - DNA, 25 bp, Artificial sequence
  Synthetic oligonucleotide
gagagttcgactacgattgtgtagt

SEQ ID NO: 687642 - DNA, 25 bp, Artificial sequence
  Synthetic oligonucleotide
tgtttttggcaatagacgtttgtga

SEQ ID NO: 687643 - DNA, 25 bp, Artificial sequence
  Synthetic oligonucleotide
tgtttttggcaaaagacgtttgtga

SEQ ID NO: 687644 - DNA, 25 bp, Artificial sequence
  Synthetic oligonucleotide
gggcttacacaacataatggacttt

SEQ ID NO: 687645 - DNA, 25 bp, Artificial sequence
  Synthetic oligonucleotide
gggcttacacaagataatggacttt

SEQ ID NO: 687646 - DNA, 25 bp, Artificial sequence
  Synthetic oligonucleotide
gctattgggtttcaagccatttcaa

SEQ ID NO: 687647 - DNA, 25 bp, Artificial sequence
  Synthetic oligonucleotide
gctattgggtttgaagccatttcaa

SEQ ID NO: 687648 - DNA, 25 bp, Artificial sequence
  Synthetic oligonucleotide
tgaatttttcttctagttttgactc

SEQ ID NO: 687649 - DNA, 25 bp, Artificial sequence
  Synthetic oligonucleotide
ggatttagtggaagtgatagataga

SEQ ID NO: 687650 - DNA, 25 bp, Artificial sequence
  Synthetic oligonucleotide
cctctgttaccgtaacttgaagaaa

SEQ ID NO: 687651 - DNA, 25 bp, Artificial sequence
  Synthetic oligonucleotide
taagaaagtctagcttccattgaag

SEQ ID NO: 687652 - DNA, 25 bp, Artificial sequence
  Synthetic oligonucleotide
taggatcaatacaaaagagcacatg

SEQ ID NO: 687653 - DNA, 25 bp, Artificial sequence
  Synthetic oligonucleotide
taggatcaatactaaagagcacatg

SEQ ID NO: 687654 - DNA, 25 bp, Artificial sequence
  Synthetic oligonucleotide
ttaacgataatagcaaccgtccacg

SEQ ID NO: 687655 - DNA, 25 bp, Artificial sequence
  Synthetic oligonucleotide
ttaacgataataccaaccgtccacg

SEQ ID NO: 687656 - DNA, 25 bp, Artificial sequence
  Synthetic oligonucleotide
ggcccaagaacactctcacttacat

SEQ ID NO: 687657 - DNA, 25 bp, Artificial sequence
  Synthetic oligonucleotide
ggcccaagaacagtctcacttacat

SEQ ID NO: 687658 - DNA, 25 bp, Artificial sequence
  Synthetic oligonucleotide
gtacccttcttcatcctcctctctg

SEQ ID NO: 687659 - DNA, 25 bp, Artificial sequence
  Synthetic oligonucleotide
gtacccttcttcttcctcctctctg

SEQ ID NO: 687660 - DNA, 25 bp, Artificial sequence
  Synthetic oligonucleotide
caagtactacaaaaattctctcaca

SEQ ID NO: 687661 - DNA, 25 bp, Artificial sequence
  Synthetic oligonucleotide
caagtactacaataattctctcaca

SEQ ID NO: 687662 - DNA, 25 bp, Artificial sequence
  Synthetic oligonucleotide
gaaggtaaagccatcgcgacgtctc

SEQ ID NO: 687663 - DNA, 25 bp, Artificial sequence
  Synthetic oligonucleotide
gaaggtaaagccttcgcgacgtctc

SEQ ID NO: 687664 - DNA, 25 bp, Artificial sequence
  Synthetic oligonucleotide
cgtgtattgatattcccgtgttctc

SEQ ID NO: 687665 - DNA, 25 bp, Artificial sequence
  Synthetic oligonucleotide
tgaatttttcttgtagttttgactc

SEQ ID NO: 687666 - DNA, 25 bp, Artificial sequence
  Synthetic oligonucleotide
tgctaaaaaggtgaaattgagtaag

SEQ ID NO: 687667 - DNA, 25 bp, Artificial sequence
  Synthetic oligonucleotide
gaactgggaaactttcagagaaagg

SEQ ID NO: 687668 - DNA, 25 bp, Artificial sequence
  Synthetic oligonucleotide
tctgttgtcctaattggtagtagaa

SEQ ID NO: 687669 - DNA, 25 bp, Artificial sequence
  Synthetic oligonucleotide
tagacaaagtgtcggcacgcatgga

SEQ ID NO: 687670 - DNA, 25 bp, Artificial sequence
  Synthetic oligonucleotide
tagacaaagtgtgggcacgcatgga

SEQ ID NO: 687671 - DNA, 25 bp, Artificial sequence
  Synthetic oligonucleotide
aaatgccatcttgtctcttggacag

SEQ ID NO: 687672 - DNA, 25 bp, Artificial sequence
  Synthetic oligonucleotide
aaatgccatcttctctcttggacag

SEQ ID NO: 687673 - DNA, 25 bp, Artificial sequence
  Synthetic oligonucleotide
tagacatgaacacgtcaggttctct

SEQ ID NO: 687674 - DNA, 25 bp, Artificial sequence
  Synthetic oligonucleotide
tagacatgaacaggtcaggttctct

SEQ ID NO: 687675 - DNA, 25 bp, Artificial sequence
  Synthetic oligonucleotide
taaactgcttatattgtcggtagca

SEQ ID NO: 687676 - DNA, 25 bp, Artificial sequence
  Synthetic oligonucleotide
taaactgcttattttgtcggtagca

SEQ ID NO: 687677 - DNA, 25 bp, Artificial sequence
  Synthetic oligonucleotide
aaaaccccacttactctcaatttca

SEQ ID NO: 687678 - DNA, 25 bp, Artificial sequence
  Synthetic oligonucleotide
aaaaccccactttctctcaatttca

SEQ ID NO: 687679 - DNA, 25 bp, Artificial sequence
  Synthetic oligonucleotide
cccggaaattttgaagtcaacagat

SEQ ID NO: 687680 - DNA, 25 bp, Artificial sequence
  Synthetic oligonucleotide
tcacaagattattggcgacagtagc

SEQ ID NO: 687681 - DNA, 25 bp, Artificial sequence
  Synthetic oligonucleotide
cattctagaatctctcttatttgag

SEQ ID NO: 687682 - DNA, 25 bp, Artificial sequence
  Synthetic oligonucleotide
tcgtttttacatcccggctctctag

SEQ ID NO: 687683 - DNA, 25 bp, Artificial sequence
  Synthetic oligonucleotide
cgactaatgaaaactgaaaattatc

SEQ ID NO: 687684 - DNA, 25 bp, Artificial sequence
  Synthetic oligonucleotide
cgactaatgaaatctgaaaattatc

SEQ ID NO: 687685 - DNA, 25 bp, Artificial sequence
  Synthetic oligonucleotide
gaaggatccagcattggaagctcga

SEQ ID NO: 687686 - DNA, 25 bp, Artificial sequence
  Synthetic oligonucleotide
gaaggatccagctttggaagctcga

SEQ ID NO: 687687 - DNA, 25 bp, Artificial sequence
  Synthetic oligonucleotide
cccggaaattttcaagtcaacagat

SEQ ID NO: 687688 - DNA, 25 bp, Artificial sequence
  Synthetic oligonucleotide
tcgaactgaatcaaacaccaacact

SEQ ID NO: 687689 - DNA, 25 bp, Artificial sequence
  Synthetic oligonucleotide
tgctaaaaaggtcaaattgagtaag

SEQ ID NO: 687690 - DNA, 25 bp, Artificial sequence
  Synthetic oligonucleotide
cattctagaatcactcttatttgag

SEQ ID NO: 687691 - DNA, 25 bp, Artificial sequence
  Synthetic oligonucleotide
gacagcagaacagagtctacctttc

SEQ ID NO: 687692 - DNA, 25 bp, Artificial sequence
  Synthetic oligonucleotide
gacagcagaacacagtctacctttc

SEQ ID NO: 687693 - DNA, 25 bp, Artificial sequence
  Synthetic oligonucleotide
tggtaatccaaataggaaaacttca

SEQ ID NO: 687694 - DNA, 25 bp, Artificial sequence
  Synthetic oligonucleotide
tggtaatccaaaaaggaaaacttca

SEQ ID NO: 687695 - DNA, 25 bp, Artificial sequence
  Synthetic oligonucleotide
taagaaagtctaccttccattgaag

SEQ ID NO: 687696 - DNA, 25 bp, Artificial sequence
  Synthetic oligonucleotide
tcgaactgaatctaacaccaacact

SEQ ID NO: 687697 - DNA, 25 bp, Artificial sequence
  Synthetic oligonucleotide
ttttaagttttgggtttgctcagtg

SEQ ID NO: 687698 - DNA, 25 bp, Artificial sequence
  Synthetic oligonucleotide
cgtgtattgataatcccgtgttctc

SEQ ID NO: 687699 - DNA, 25 bp, Artificial sequence
  Synthetic oligonucleotide
gaagagagaaaaagaagcagctgtg

SEQ ID NO: 687700 - DNA, 25 bp, Artificial sequence
  Synthetic oligonucleotide
gggagtggtctcaactcacattgtg

SEQ ID NO: 687701 - DNA, 25 bp, Artificial sequence
  Synthetic oligonucleotide
gggagtggtctctactcacattgtg

SEQ ID NO: 687702 - DNA, 25 bp, Artificial sequence
  Synthetic oligonucleotide
gctcacaatggctgaagcaatgcct

SEQ ID NO: 687703 - DNA, 25 bp, Artificial sequence
  Synthetic oligonucleotide
gctcacaatggcagaagcaatgcct

SEQ ID NO: 687704 - DNA, 25 bp, Artificial sequence
  Synthetic oligonucleotide
gctacttcagctcttgtcaccatcg

SEQ ID NO: 687705 - DNA, 25 bp, Artificial sequence
  Synthetic oligonucleotide
gctacttcagctgttgtcaccatcg

SEQ ID NO: 687706 - DNA, 25 bp, Artificial sequence
  Synthetic oligonucleotide
aactgtttgtactatttcggtaagc

SEQ ID NO: 687707 - DNA, 25 bp, Artificial sequence
  Synthetic oligonucleotide
aactgtttgtacaatttcggtaagc

SEQ ID NO: 687708 - DNA, 25 bp, Artificial sequence
  Synthetic oligonucleotide
aactgtgtggcaactgtgggaagac

SEQ ID NO: 687709 - DNA, 25 bp, Artificial sequence
  Synthetic oligonucleotide
aactgtgtggcatctgtgggaagac

SEQ ID NO: 687710 - DNA, 25 bp, Artificial sequence
  Synthetic oligonucleotide
ggtggactctccgttcttcctcaag

SEQ ID NO: 687711 - DNA, 25 bp, Artificial sequence
  Synthetic oligonucleotide
tgttaggaaaccattcgttgctttc

SEQ ID NO: 687712 - DNA, 25 bp, Artificial sequence
  Synthetic oligonucleotide
cagatcatgtggtcaacatttgtcc

SEQ ID NO: 687713 - DNA, 25 bp, Artificial sequence
  Synthetic oligonucleotide
gacattggttagacatatcagtcac

SEQ ID NO: 687714 - DNA, 25 bp, Artificial sequence
  Synthetic oligonucleotide
tactttccccccttaattttatctg

SEQ ID NO: 687715 - DNA, 25 bp, Artificial sequence
  Synthetic oligonucleotide
tactttccccccataattttatctg

SEQ ID NO: 687716 - DNA, 25 bp, Artificial sequence
  Synthetic oligonucleotide
tgctgtggcagcaataatcatggta

SEQ ID NO: 687717 - DNA, 25 bp, Artificial sequence
  Synthetic oligonucleotide
tgctgtggcagctataatcatggta

SEQ ID NO: 687718 - DNA, 25 bp, Artificial sequence
  Synthetic oligonucleotide
ggtggactctcccttcttcctcaag

SEQ ID NO: 687719 - DNA, 25 bp, Artificial sequence
  Synthetic oligonucleotide
caaacagtatctagcctgggacaac

SEQ ID NO: 687720 - DNA, 25 bp, Artificial sequence
  Synthetic oligonucleotide
ttttaagttttgcgtttgctcagtg

SEQ ID NO: 687721 - DNA, 25 bp, Artificial sequence
  Synthetic oligonucleotide
cagatcatgtggacaacatttgtcc

SEQ ID NO: 687722 - DNA, 25 bp, Artificial sequence
  Synthetic oligonucleotide
tgttttaattaaatcgacacttcga

SEQ ID NO: 687723 - DNA, 25 bp, Artificial sequence
  Synthetic oligonucleotide
tgttttaattaattcgacacttcga

SEQ ID NO: 687724 - DNA, 25 bp, Artificial sequence
  Synthetic oligonucleotide
catgtattccaaaggcattagacta

SEQ ID NO: 687725 - DNA, 25 bp, Artificial sequence
  Synthetic oligonucleotide
catgtattccaatggcattagacta

SEQ ID NO: 687726 - DNA, 25 bp, Artificial sequence
  Synthetic oligonucleotide
tgttaggaaacctttcgttgctttc

SEQ ID NO: 687727 - DNA, 25 bp, Artificial sequence
  Synthetic oligonucleotide
caaacagtatcttgcctgggacaac

SEQ ID NO: 687728 - DNA, 25 bp, Artificial sequence
  Synthetic oligonucleotide
tctcaaagggaaatccaggtttggg

SEQ ID NO: 687729 - DNA, 25 bp, Artificial sequence
  Synthetic oligonucleotide
gacattggttagtcatatcagtcac

SEQ ID NO: 687730 - DNA, 25 bp, Artificial sequence
  Synthetic oligonucleotide
aaagcgtgcgtcaatcggtggtgct

SEQ ID NO: 687731 - DNA, 25 bp, Artificial sequence
  Synthetic oligonucleotide
aaagcgtgcgtctatcggtggtgct

SEQ ID NO: 687732 - DNA, 25 bp, Artificial sequence
  Synthetic oligonucleotide
tcaatggcttgagtcggtggaattc

SEQ ID NO: 687733 - DNA, 25 bp, Artificial sequence
  Synthetic oligonucleotide
tcaatggcttgactcggtggaattc

SEQ ID NO: 687734 - DNA, 25 bp, Artificial sequence
  Synthetic oligonucleotide
gactcgccgactcgttcctgttcgt

SEQ ID NO: 687735 - DNA, 25 bp, Artificial sequence
  Synthetic oligonucleotide
gactcgccgactggttcctgttcgt

SEQ ID NO: 687736 - DNA, 25 bp, Artificial sequence
  Synthetic oligonucleotide
tcggaatcggactcggactccgact

SEQ ID NO: 687737 - DNA, 25 bp, Artificial sequence
  Synthetic oligonucleotide
tcggaatcggacacggactccgact

SEQ ID NO: 687738 - DNA, 25 bp, Artificial sequence
  Synthetic oligonucleotide
cagcaggtgcggtttgaatttctga

SEQ ID NO: 687739 - DNA, 25 bp, Artificial sequence
  Synthetic oligonucleotide
cagcaggtgcggattgaatttctga

SEQ ID NO: 687740 - DNA, 25 bp, Artificial sequence
  Synthetic oligonucleotide
tctaaaatcaaaggctcaattttgt

SEQ ID NO: 687741 - DNA, 25 bp, Artificial sequence
  Synthetic oligonucleotide
tctaaaatcaaacgctcaattttgt

SEQ ID NO: 687742 - DNA, 25 bp, Artificial sequence
  Synthetic oligonucleotide
gaagagagaaaatgaagcagctgtg

SEQ ID NO: 687743 - DNA, 25 bp, Artificial sequence
  Synthetic oligonucleotide
tcagatcatcctgaatacccagaat

SEQ ID NO: 687744 - DNA, 25 bp, Artificial sequence
  Synthetic oligonucleotide
tagagtttgttttttggatacaggg

SEQ ID NO: 687745 - DNA, 25 bp, Artificial sequence
  Synthetic oligonucleotide
tagagtttgtttattggatacaggg

SEQ ID NO: 687746 - DNA, 25 bp, Artificial sequence
  Synthetic oligonucleotide
ggatttagtggatgtgatagataga

SEQ ID NO: 687747 - DNA, 25 bp, Artificial sequence
  Synthetic oligonucleotide
aaagatattataatacatagatcag

SEQ ID NO: 687748 - DNA, 25 bp, Artificial sequence
  Synthetic oligonucleotide
gaaacaataccgctctttcggctgt

SEQ ID NO: 687749 - DNA, 25 bp, Artificial sequence
  Synthetic oligonucleotide
tggttggtggatgttttttattttg

SEQ ID NO: 687750 - DNA, 25 bp, Artificial sequence
  Synthetic oligonucleotide
tcagatcatcctcaatacccagaat

SEQ ID NO: 687751 - DNA, 25 bp, Artificial sequence
  Synthetic oligonucleotide
tggttggtggatcttttttattttg

SEQ ID NO: 687752 - DNA, 25 bp, Artificial sequence
  Synthetic oligonucleotide
ggagcaaacattccgtttctcatgc

SEQ ID NO: 687753 - DNA, 25 bp, Artificial sequence
  Synthetic oligonucleotide
ggagcaaacattgcgtttctcatgc

SEQ ID NO: 687754 - DNA, 25 bp, Artificial sequence
  Synthetic oligonucleotide
caagaatgggactcatggacggcca

SEQ ID NO: 687755 - DNA, 25 bp, Artificial sequence
  Synthetic oligonucleotide
caagaatgggacacatggacggcca

SEQ ID NO: 687756 - DNA, 25 bp, Artificial sequence
  Synthetic oligonucleotide
tctcaaagggaattccaggtttggg

SEQ ID NO: 687757 - DNA, 25 bp, Artificial sequence
  Synthetic oligonucleotide
tcgtttttacatgccggctctctag

SEQ ID NO: 687758 - DNA, 25 bp, Artificial sequence
  Synthetic oligonucleotide
gaaacaataccggtctttcggctgt

SEQ ID NO: 687759 - DNA, 25 bp, Artificial sequence
  Synthetic oligonucleotide
ttctcttaactacctactggtaaga

SEQ ID NO: 687760 - DNA, 25 bp, Artificial sequence
  Synthetic oligonucleotide
agtgtcttcgttatttctcttttga

SEQ ID NO: 687761 - DNA, 25 bp, Artificial sequence
  Synthetic oligonucleotide
taaatgaatccagtttatgaaaaat

SEQ ID NO: 687762 - DNA, 25 bp, Artificial sequence
  Synthetic oligonucleotide
taaatgaatccactttatgaaaaat

SEQ ID NO: 687763 - DNA, 25 bp, Artificial sequence
  Synthetic oligonucleotide
gaaaaaggttacatcaggctgaaga

SEQ ID NO: 687764 - DNA, 25 bp, Artificial sequence
  Synthetic oligonucleotide
gaaaaaggttacttcaggctgaaga

SEQ ID NO: 687765 - DNA, 25 bp, Artificial sequence
  Synthetic oligonucleotide
ccagagggtctcagtggaatcaaca

SEQ ID NO: 687766 - DNA, 25 bp, Artificial sequence
  Synthetic oligonucleotide
ccagagggtctctgtggaatcaaca

SEQ ID NO: 687767 - DNA, 25 bp, Artificial sequence
  Synthetic oligonucleotide
tctttccccacctaaactaagtgat

SEQ ID NO: 687768 - DNA, 25 bp, Artificial sequence
  Synthetic oligonucleotide
tctttccccaccaaaactaagtgat

SEQ ID NO: 687769 - DNA, 25 bp, Artificial sequence
  Synthetic oligonucleotide
tcagttaattacttagttggcccac

SEQ ID NO: 687770 - DNA, 25 bp, Artificial sequence
  Synthetic oligonucleotide
ctctcttatctggatttgatcagca

SEQ ID NO: 687771 - DNA, 25 bp, Artificial sequence
  Synthetic oligonucleotide
tcattataaaaatcaagtttttacg

SEQ ID NO: 687772 - DNA, 25 bp, Artificial sequence
  Synthetic oligonucleotide
agtgtcttcgttttttctcttttga

SEQ ID NO: 687773 - DNA, 25 bp, Artificial sequence
  Synthetic oligonucleotide
ggaagtcttgtaacaactatgtgca

SEQ ID NO: 687774 - DNA, 25 bp, Artificial sequence
  Synthetic oligonucleotide
ggaagtcttgtatcaactatgtgca

SEQ ID NO: 687775 - DNA, 25 bp, Artificial sequence
  Synthetic oligonucleotide
tatataagaagcagagaattgacaa

SEQ ID NO: 687776 - DNA, 25 bp, Artificial sequence
  Synthetic oligonucleotide
tatataagaagctgagaattgacaa

SEQ ID NO: 687777 - DNA, 25 bp, Artificial sequence
  Synthetic oligonucleotide
caaccatgaagaaattaaagcagag

SEQ ID NO: 687778 - DNA, 25 bp, Artificial sequence
  Synthetic oligonucleotide
caaccatgaagatattaaagcagag

SEQ ID NO: 687779 - DNA, 25 bp, Artificial sequence
  Synthetic oligonucleotide
taatgattattgaagaaaagaacag

SEQ ID NO: 687780 - DNA, 25 bp, Artificial sequence
  Synthetic oligonucleotide
taatgattattgtagaaaagaacag

SEQ ID NO: 687781 - DNA, 25 bp, Artificial sequence
  Synthetic oligonucleotide
ctctcttatctgcatttgatcagca

SEQ ID NO: 687782 - DNA, 25 bp, Artificial sequence
  Synthetic oligonucleotide
gaaatatacttcaccgtaatctcat

SEQ ID NO: 687783 - DNA, 25 bp, Artificial sequence
  Synthetic oligonucleotide
caattaagattggtgatcaaaacat

SEQ ID NO: 687784 - DNA, 25 bp, Artificial sequence
  Synthetic oligonucleotide
caattaagattgctgatcaaaacat

SEQ ID NO: 687785 - DNA, 25 bp, Artificial sequence
  Synthetic oligonucleotide
gattatgggccgcaaatccatgatt

SEQ ID NO: 687786 - DNA, 25 bp, Artificial sequence
  Synthetic oligonucleotide
gattatgggccggaaatccatgatt

SEQ ID NO: 687787 - DNA, 25 bp, Artificial sequence
  Synthetic oligonucleotide
taaacttcaacaatcattcatacca

SEQ ID NO: 687788 - DNA, 25 bp, Artificial sequence
  Synthetic oligonucleotide
taaacttcaacattcattcatacca

SEQ ID NO: 687789 - DNA, 25 bp, Artificial sequence
  Synthetic oligonucleotide
ttagaacagtgaacaaaagaagagc

SEQ ID NO: 687790 - DNA, 25 bp, Artificial sequence
  Synthetic oligonucleotide
ttagaacagtgatcaaaagaagagc

SEQ ID NO: 687791 - DNA, 25 bp, Artificial sequence
  Synthetic oligonucleotide
gaattttatattgtctcattaagaa

SEQ ID NO: 687792 - DNA, 25 bp, Artificial sequence
  Synthetic oligonucleotide
tagatcatacttggtagtggttggt

SEQ ID NO: 687793 - DNA, 25 bp, Artificial sequence
  Synthetic oligonucleotide
gaaatatacttctccgtaatctcat

SEQ ID NO: 687794 - DNA, 25 bp, Artificial sequence
  Synthetic oligonucleotide
tagatcatacttcgtagtggttggt

SEQ ID NO: 687795 - DNA, 25 bp, Artificial sequence
  Synthetic oligonucleotide
gttctttacagaataaatatcttat

SEQ ID NO: 687796 - DNA, 25 bp, Artificial sequence
  Synthetic oligonucleotide
gttctttacagattaaatatcttat

SEQ ID NO: 687797 - DNA, 25 bp, Artificial sequence
  Synthetic oligonucleotide
gaaatcttggtgcattgacaggtca

SEQ ID NO: 687798 - DNA, 25 bp, Artificial sequence
  Synthetic oligonucleotide
gaaatcttggtggattgacaggtca

SEQ ID NO: 687799 - DNA, 25 bp, Artificial sequence
  Synthetic oligonucleotide
taaaacgaagatgcttatcctcctg

SEQ ID NO: 687800 - DNA, 25 bp, Artificial sequence
  Synthetic oligonucleotide
taaaacgaagatccttatcctcctg

SEQ ID NO: 687801 - DNA, 25 bp, Artificial sequence
  Synthetic oligonucleotide
tttatatatctttttcaacaattag

SEQ ID NO: 687802 - DNA, 25 bp, Artificial sequence
  Synthetic oligonucleotide
tttatatatcttattcaacaattag

SEQ ID NO: 687803 - DNA, 25 bp, Artificial sequence
  Synthetic oligonucleotide
tcattataaaaaacaagtttttacg

SEQ ID NO: 687804 - DNA, 25 bp, Artificial sequence
  Synthetic oligonucleotide
aatctttagattcaacagtttacag

SEQ ID NO: 687805 - DNA, 25 bp, Artificial sequence
  Synthetic oligonucleotide
gaattttatattctctcattaagaa

SEQ ID NO: 687806 - DNA, 25 bp, Artificial sequence
  Synthetic oligonucleotide
ataccaactgtagggaataccagcg

SEQ ID NO: 687807 - DNA, 25 bp, Artificial sequence
  Synthetic oligonucleotide
agtttcttggggaagaaataattga

SEQ ID NO: 687808 - DNA, 25 bp, Artificial sequence
  Synthetic oligonucleotide
agtgcccacaatagccccaagctta

SEQ ID NO: 687809 - DNA, 25 bp, Artificial sequence
  Synthetic oligonucleotide
gagatcccgtgagaagtagacctaa

SEQ ID NO: 687810 - DNA, 25 bp, Artificial sequence
  Synthetic oligonucleotide
gagatcccgtgacaagtagacctaa

SEQ ID NO: 687811 - DNA, 25 bp, Artificial sequence
  Synthetic oligonucleotide
tgctctgcgggaataataaaagttg

SEQ ID NO: 687812 - DNA, 25 bp, Artificial sequence
  Synthetic oligonucleotide
tgctctgcgggattaataaaagttg

SEQ ID NO: 687813 - DNA, 25 bp, Artificial sequence
  Synthetic oligonucleotide
ccaaaattgcaaaagaagaaaacca

SEQ ID NO: 687814 - DNA, 25 bp, Artificial sequence
  Synthetic oligonucleotide
ccaaaattgcaatagaagaaaacca

SEQ ID NO: 687815 - DNA, 25 bp, Artificial sequence
  Synthetic oligonucleotide
catgaagccttttttattatgctcg

SEQ ID NO: 687816 - DNA, 25 bp, Artificial sequence
  Synthetic oligonucleotide
tcatcgctttccttcttcttggtag

SEQ ID NO: 687817 - DNA, 25 bp, Artificial sequence
  Synthetic oligonucleotide
ataccaactgtacggaataccagcg

SEQ ID NO: 687818 - DNA, 25 bp, Artificial sequence
  Synthetic oligonucleotide
tcatcgctttccatcttcttggtag

SEQ ID NO: 687819 - DNA, 25 bp, Artificial sequence
  Synthetic oligonucleotide
taacggccatgaagaaaaaccccat

SEQ ID NO: 687820 - DNA, 25 bp, Artificial sequence
  Synthetic oligonucleotide
taacggccatgatgaaaaaccccat

SEQ ID NO: 687821 - DNA, 25 bp, Artificial sequence
  Synthetic oligonucleotide
gacacgacctatgttgtcgatgaag

SEQ ID NO: 687822 - DNA, 25 bp, Artificial sequence
  Synthetic oligonucleotide
gacacgacctatcttgtcgatgaag

SEQ ID NO: 687823 - DNA, 25 bp, Artificial sequence
  Synthetic oligonucleotide
ccaataaccgggtatggtggagcaa

SEQ ID NO: 687824 - DNA, 25 bp, Artificial sequence
  Synthetic oligonucleotide
ccaataaccgggaatggtggagcaa

SEQ ID NO: 687825 - DNA, 25 bp, Artificial sequence
  Synthetic oligonucleotide
gatggctcctaattccgccacttca

SEQ ID NO: 687826 - DNA, 25 bp, Artificial sequence
  Synthetic oligonucleotide
gatggctcctaaatccgccacttca

SEQ ID NO: 687827 - DNA, 25 bp, Artificial sequence
  Synthetic oligonucleotide
tcgtagacgttttctgcagtggaag

SEQ ID NO: 687828 - DNA, 25 bp, Artificial sequence
  Synthetic oligonucleotide
tcgtagacgtttactgcagtggaag

SEQ ID NO: 687829 - DNA, 25 bp, Artificial sequence
  Synthetic oligonucleotide
catgaagcctttattattatgctcg

SEQ ID NO: 687830 - DNA, 25 bp, Artificial sequence
  Synthetic oligonucleotide
tcatgtgttcaaaatgtcgagatca

SEQ ID NO: 687831 - DNA, 25 bp, Artificial sequence
  Synthetic oligonucleotide
gaagcaaagtgctcacggaggattg

SEQ ID NO: 687832 - DNA, 25 bp, Artificial sequence
  Synthetic oligonucleotide
aatctttagattgaacagtttacag

SEQ ID NO: 687833 - DNA, 25 bp, Artificial sequence
  Synthetic oligonucleotide
aaaaaacagaggaaatgtagattaa

SEQ ID NO: 687834 - DNA, 25 bp, Artificial sequence
  Synthetic oligonucleotide
aaaaaacagaggtaatgtagattaa

SEQ ID NO: 687835 - DNA, 25 bp, Artificial sequence
  Synthetic oligonucleotide
tcttgggtaagatgcaattggaaaa

SEQ ID NO: 687836 - DNA, 25 bp, Artificial sequence
  Synthetic oligonucleotide
tcttgggtaagaagcaattggaaaa

SEQ ID NO: 687837 - DNA, 25 bp, Artificial sequence
  Synthetic oligonucleotide
tcaaagcaaaatgtaaacaaaatct

SEQ ID NO: 687838 - DNA, 25 bp, Artificial sequence
  Synthetic oligonucleotide
tcaaagcaaaatctaaacaaaatct

SEQ ID NO: 687839 - DNA, 25 bp, Artificial sequence
  Synthetic oligonucleotide
gcagaaatatacaattgtatgaact

SEQ ID NO: 687840 - DNA, 25 bp, Artificial sequence
  Synthetic oligonucleotide
agtgcccacaattgccccaagctta

SEQ ID NO: 687841 - DNA, 25 bp, Artificial sequence
  Synthetic oligonucleotide
tcatgtgttcaatatgtcgagatca

SEQ ID NO: 687842 - DNA, 25 bp, Artificial sequence
  Synthetic oligonucleotide
agtttcttggggtagaaataattga

SEQ ID NO: 687843 - DNA, 25 bp, Artificial sequence
  Synthetic oligonucleotide
gaagcaaagtgcacacggaggattg

SEQ ID NO: 687844 - DNA, 25 bp, Artificial sequence
  Synthetic oligonucleotide
tctgtggctcatcttcagactcagc

SEQ ID NO: 687845 - DNA, 25 bp, Artificial sequence
  Synthetic oligonucleotide
ggtcatgctcgtactcctctaacga

SEQ ID NO: 687846 - DNA, 25 bp, Artificial sequence
  Synthetic oligonucleotide
ggtcatgctcgttctcctctaacga

SEQ ID NO: 687847 - DNA, 25 bp, Artificial sequence
  Synthetic oligonucleotide
tttccttggtgatgaaatacgtcac

SEQ ID NO: 687848 - DNA, 25 bp, Artificial sequence
  Synthetic oligonucleotide
tttccttggtgaagaaatacgtcac

SEQ ID NO: 687849 - DNA, 25 bp, Artificial sequence
  Synthetic oligonucleotide
aatgcaaacgcctccaagaatcaag

SEQ ID NO: 687850 - DNA, 25 bp, Artificial sequence
  Synthetic oligonucleotide
aatgcaaacgccaccaagaatcaag

SEQ ID NO: 687851 - DNA, 25 bp, Artificial sequence
  Synthetic oligonucleotide
catacggtttacatcgggataaatc

SEQ ID NO: 687852 - DNA, 25 bp, Artificial sequence
  Synthetic oligonucleotide
catacggtttacttcgggataaatc

SEQ ID NO: 687853 - DNA, 25 bp, Artificial sequence
  Synthetic oligonucleotide
gcagaaatatactattgtatgaact

SEQ ID NO: 687854 - DNA, 25 bp, Artificial sequence
  Synthetic oligonucleotide
ctgatctgttaatggaagttttgac

SEQ ID NO: 687855 - DNA, 25 bp, Artificial sequence
  Synthetic oligonucleotide
tgttaagaacggtggtctacgcaag

SEQ ID NO: 687856 - DNA, 25 bp, Artificial sequence
  Synthetic oligonucleotide
tgttaagaacggaggtctacgcaag

SEQ ID NO: 687857 - DNA, 25 bp, Artificial sequence
  Synthetic oligonucleotide
caacggtggtctcatggactatgcc

SEQ ID NO: 687858 - DNA, 25 bp, Artificial sequence
  Synthetic oligonucleotide
caacggtggtctgatggactatgcc

SEQ ID NO: 687859 - DNA, 25 bp, Artificial sequence
  Synthetic oligonucleotide
catagactgtgacacgacctacaac

SEQ ID NO: 687860 - DNA, 25 bp, Artificial sequence
  Synthetic oligonucleotide
catagactgtgagacgacctacaac

SEQ ID NO: 687861 - DNA, 25 bp, Artificial sequence
  Synthetic oligonucleotide
gacaggaaacttgacaacattgtca

SEQ ID NO: 687862 - DNA, 25 bp, Artificial sequence
  Synthetic oligonucleotide
gacaggaaacttcacaacattgtca

SEQ ID NO: 687863 - DNA, 25 bp, Artificial sequence
  Synthetic oligonucleotide
cagtagcagctgacgaaggtataaa

SEQ ID NO: 687864 - DNA, 25 bp, Artificial sequence
  Synthetic oligonucleotide
cagtagcagctgtcgaaggtataaa

SEQ ID NO: 687865 - DNA, 25 bp, Artificial sequence
  Synthetic oligonucleotide
caagaaaatgtaattagggctcaag

SEQ ID NO: 687866 - DNA, 25 bp, Artificial sequence
  Synthetic oligonucleotide
aaacttgtttcggaggaagttgttg

SEQ ID NO: 687867 - DNA, 25 bp, Artificial sequence
  Synthetic oligonucleotide
ggtcccattctattatcaactcttg

SEQ ID NO: 687868 - DNA, 25 bp, Artificial sequence
  Synthetic oligonucleotide
ctgatctgttaaaggaagttttgac

SEQ ID NO: 687869 - DNA, 25 bp, Artificial sequence
  Synthetic oligonucleotide
gaaccagggctcttgtggtaatatc

SEQ ID NO: 687870 - DNA, 25 bp, Artificial sequence
  Synthetic oligonucleotide
gaaccagggctcatgtggtaatatc

SEQ ID NO: 687871 - DNA, 25 bp, Artificial sequence
  Synthetic oligonucleotide
ttgactggagaatgaaaggagctgt

SEQ ID NO: 687872 - DNA, 25 bp, Artificial sequence
  Synthetic oligonucleotide
ttgactggagaaagaaaggagctgt

SEQ ID NO: 687873 - DNA, 25 bp, Artificial sequence
  Synthetic oligonucleotide
cttacagggacgtcgaagctgttcc

SEQ ID NO: 687874 - DNA, 25 bp, Artificial sequence
  Synthetic oligonucleotide
cttacagggacgacgaagctgttcc

SEQ ID NO: 687875 - DNA, 25 bp, Artificial sequence
  Synthetic oligonucleotide
gagacgcgatgatgaaagatcttac

SEQ ID NO: 687876 - DNA, 25 bp, Artificial sequence
  Synthetic oligonucleotide
gagacgcgatgaagaaagatcttac

SEQ ID NO: 687877 - DNA, 25 bp, Artificial sequence
  Synthetic oligonucleotide
caagaaaatgtatttagggctcaag

SEQ ID NO: 687878 - DNA, 25 bp, Artificial sequence
  Synthetic oligonucleotide
aaacttgtttcgcaggaagttgttg

SEQ ID NO: 687879 - DNA, 25 bp, Artificial sequence
  Synthetic oligonucleotide
tagcggcgtaagaacattataaacc

SEQ ID NO: 687880 - DNA, 25 bp, Artificial sequence
  Synthetic oligonucleotide
tctgtggctcatgttcagactcagc

SEQ ID NO: 687881 - DNA, 25 bp, Artificial sequence
  Synthetic oligonucleotide
tcagttaattacatagttggcccac

SEQ ID NO: 687882 - DNA, 25 bp, Artificial sequence
  Synthetic oligonucleotide
cattgtgaagaattcttggggacca

SEQ ID NO: 687883 - DNA, 25 bp, Artificial sequence
  Synthetic oligonucleotide
cattgtgaagaaatcttggggacca

SEQ ID NO: 687884 - DNA, 25 bp, Artificial sequence
  Synthetic oligonucleotide
tgggtatggatcaagcaagggttca

SEQ ID NO: 687885 - DNA, 25 bp, Artificial sequence
  Synthetic oligonucleotide
tgggtatggatctagcaagggttca

SEQ ID NO: 687886 - DNA, 25 bp, Artificial sequence
  Synthetic oligonucleotide
cggtgcggggttgatcttgaccacg

SEQ ID NO: 687887 - DNA, 25 bp, Artificial sequence
  Synthetic oligonucleotide
cggtgcggggttcatcttgaccacg

SEQ ID NO: 687888 - DNA, 25 bp, Artificial sequence
  Synthetic oligonucleotide
cattttgtatttcgtatatgaaggg

SEQ ID NO: 687889 - DNA, 25 bp, Artificial sequence
  Synthetic oligonucleotide
cattttgtatttggtatatgaaggg

SEQ ID NO: 687890 - DNA, 25 bp, Artificial sequence
  Synthetic oligonucleotide
tactctatggaagaaggaacttgcg

SEQ ID NO: 687891 - DNA, 25 bp, Artificial sequence
  Synthetic oligonucleotide
gaaaatggttgttagttaattgctc

SEQ ID NO: 687892 - DNA, 25 bp, Artificial sequence
  Synthetic oligonucleotide
tactctatggaacaaggaacttgcg

SEQ ID NO: 687893 - DNA, 25 bp, Artificial sequence
  Synthetic oligonucleotide
tagcggcgtaagtacattataaacc

SEQ ID NO: 687894 - DNA, 25 bp, Artificial sequence
  Synthetic oligonucleotide
tgtcgccattgatgcatctggtaga

SEQ ID NO: 687895 - DNA, 25 bp, Artificial sequence
  Synthetic oligonucleotide
tgtcgccattgaagcatctggtaga

SEQ ID NO: 687896 - DNA, 25 bp, Artificial sequence
  Synthetic oligonucleotide
gagtctcttgaaggcattggctcat

SEQ ID NO: 687897 - DNA, 25 bp, Artificial sequence
  Synthetic oligonucleotide
gagtctcttgaacgcattggctcat

SEQ ID NO: 687898 - DNA, 25 bp, Artificial sequence
  Synthetic oligonucleotide
taatggacaccatgacgtacctact

SEQ ID NO: 687899 - DNA, 25 bp, Artificial sequence
  Synthetic oligonucleotide
taatggacaccaagacgtacctact

SEQ ID NO: 687900 - DNA, 25 bp, Artificial sequence
  Synthetic oligonucleotide
tgttttgaaaactggatgaatctga

SEQ ID NO: 687901 - DNA, 25 bp, Artificial sequence
  Synthetic oligonucleotide
gatgtgttaatgaaaggtggtccca

SEQ ID NO: 687902 - DNA, 25 bp, Artificial sequence
  Synthetic oligonucleotide
ggtcccattctaatatcaactcttg

SEQ ID NO: 687903 - DNA, 25 bp, Artificial sequence
  Synthetic oligonucleotide
gatgtgttaatgtaaggtggtccca

SEQ ID NO: 687904 - DNA, 25 bp, Artificial sequence
  Synthetic oligonucleotide
gaaaatggttgtaagttaattgctc

SEQ ID NO: 687905 - DNA, 25 bp, Artificial sequence
  Synthetic oligonucleotide
gagctggaaaaataaattagttctc

SEQ ID NO: 687906 - DNA, 25 bp, Artificial sequence
  Synthetic oligonucleotide
gagcgacctctatcgagtctccagc

SEQ ID NO: 687907 - DNA, 25 bp, Artificial sequence
  Synthetic oligonucleotide
gagcgacctctaacgagtctccagc

SEQ ID NO: 687908 - DNA, 25 bp, Artificial sequence
  Synthetic oligonucleotide
gttacagattcacactactttactc

SEQ ID NO: 687909 - DNA, 25 bp, Artificial sequence
  Synthetic oligonucleotide
gttacagattcagactactttactc

SEQ ID NO: 687910 - DNA, 25 bp, Artificial sequence
  Synthetic oligonucleotide
caaaactaagctaaaagacacagac

SEQ ID NO: 687911 - DNA, 25 bp, Artificial sequence
  Synthetic oligonucleotide
caaaactaagcttaaagacacagac

SEQ ID NO: 687912 - DNA, 25 bp, Artificial sequence
  Synthetic oligonucleotide
tacttggagtcaaagtaacctcatg

SEQ ID NO: 687913 - DNA, 25 bp, Artificial sequence
  Synthetic oligonucleotide
tacttggagtcatagtaacctcatg

SEQ ID NO: 687914 - DNA, 25 bp, Artificial sequence
  Synthetic oligonucleotide
cagcacatgtgtaaagccggcctgc

SEQ ID NO: 687915 - DNA, 25 bp, Artificial sequence
  Synthetic oligonucleotide
aagaaattttggctagaccctgtgc

SEQ ID NO: 687916 - DNA, 25 bp, Artificial sequence
  Synthetic oligonucleotide
ggctcttctcttgcatttcctctta

SEQ ID NO: 687917 - DNA, 25 bp, Artificial sequence
  Synthetic oligonucleotide
gttatatatcaatatttttggaccc

SEQ ID NO: 687918 - DNA, 25 bp, Artificial sequence
  Synthetic oligonucleotide
cagcacatgtgttaagccggcctgc

SEQ ID NO: 687919 - DNA, 25 bp, Artificial sequence
  Synthetic oligonucleotide
gagctggaaaaaaaaattagttctc

SEQ ID NO: 687920 - DNA, 25 bp, Artificial sequence
  Synthetic oligonucleotide
ccgcagggccggctcagaataataa

SEQ ID NO: 687921 - DNA, 25 bp, Artificial sequence
  Synthetic oligonucleotide
ccgcagggccgggtcagaataataa

SEQ ID NO: 687922 - DNA, 25 bp, Artificial sequence
  Synthetic oligonucleotide
cagaggtttctagttctgcacataa

SEQ ID NO: 687923 - DNA, 25 bp, Artificial sequence
  Synthetic oligonucleotide
cagaggtttctacttctgcacataa

SEQ ID NO: 687924 - DNA, 25 bp, Artificial sequence
  Synthetic oligonucleotide
ggccttccttaaatgattacctctg

SEQ ID NO: 687925 - DNA, 25 bp, Artificial sequence
  Synthetic oligonucleotide
ggccttccttaattgattacctctg

SEQ ID NO: 687926 - DNA, 25 bp, Artificial sequence
  Synthetic oligonucleotide
cgggctcaacgagtttgcggatttg

SEQ ID NO: 687927 - DNA, 25 bp, Artificial sequence
  Synthetic oligonucleotide
tgttttgaaaacaggatgaatctga

SEQ ID NO: 687928 - DNA, 25 bp, Artificial sequence
  Synthetic oligonucleotide
gctttcttattgatgaggttggcat

SEQ ID NO: 687929 - DNA, 25 bp, Artificial sequence
  Synthetic oligonucleotide
gctttcttattgttgaggttggcat

SEQ ID NO: 687930 - DNA, 25 bp, Artificial sequence
  Synthetic oligonucleotide
gttatatatcaaaatttttggaccc

SEQ ID NO: 687931 - DNA, 25 bp, Artificial sequence
  Synthetic oligonucleotide
gaatcctctgttatgctcttgcctt

SEQ ID NO: 687932 - DNA, 25 bp, Artificial sequence
  Synthetic oligonucleotide
catcgatgagactaacaagaaaggg

SEQ ID NO: 687933 - DNA, 25 bp, Artificial sequence
  Synthetic oligonucleotide
ttcttaggttcgaagttttcaagga

SEQ ID NO: 687934 - DNA, 25 bp, Artificial sequence
  Synthetic oligonucleotide
catcgatgagacaaacaagaaaggg

SEQ ID NO: 687935 - DNA, 25 bp, Artificial sequence
  Synthetic oligonucleotide
aagaaattttgggtagaccctgtgc

SEQ ID NO: 687936 - DNA, 25 bp, Artificial sequence
  Synthetic oligonucleotide
ggctcttctcttccatttcctctta

SEQ ID NO: 687937 - DNA, 25 bp, Artificial sequence
  Synthetic oligonucleotide
aattttgagaaagcttatgaaaccg

SEQ ID NO: 687938 - DNA, 25 bp, Artificial sequence
  Synthetic oligonucleotide
aattttgagaaaccttatgaaaccg

SEQ ID NO: 687939 - DNA, 25 bp, Artificial sequence
  Synthetic oligonucleotide
tgacaaactcatagaactcttcgaa

SEQ ID NO: 687940 - DNA, 25 bp, Artificial sequence
  Synthetic oligonucleotide
tgacaaactcattgaactcttcgaa

SEQ ID NO: 687941 - DNA, 25 bp, Artificial sequence
  Synthetic oligonucleotide
catcgttggatagtcccccgaggat

SEQ ID NO: 687942 - DNA, 25 bp, Artificial sequence
  Synthetic oligonucleotide
catcgttggatactcccccgaggat

SEQ ID NO: 687943 - DNA, 25 bp, Artificial sequence
  Synthetic oligonucleotide
tctctccctctcattcgcttcttcc

SEQ ID NO: 687944 - DNA, 25 bp, Artificial sequence
  Synthetic oligonucleotide
ttcttaggttcgtagttttcaagga

SEQ ID NO: 687945 - DNA, 25 bp, Artificial sequence
  Synthetic oligonucleotide
cgggctcaacgactttgcggatttg

SEQ ID NO: 687946 - DNA, 25 bp, Artificial sequence
  Synthetic oligonucleotide
gaaaaacaaacgtactcaaatggct

SEQ ID NO: 687947 - DNA, 25 bp, Artificial sequence
  Synthetic oligonucleotide
gaaaaacaaacgaactcaaatggct

SEQ ID NO: 687948 - DNA, 25 bp, Artificial sequence
  Synthetic oligonucleotide
gaatcctctgttttgctcttgcctt

SEQ ID NO: 687949 - DNA, 25 bp, Artificial sequence
  Synthetic oligonucleotide
tctctccctctctttcgcttcttcc

SEQ ID NO: 687950 - DNA, 25 bp, Artificial sequence
  Synthetic oligonucleotide
gatcgtcagttattctcttcttagc

SEQ ID NO: 687951 - DNA, 25 bp, Artificial sequence
  Synthetic oligonucleotide
gatggatccttagatcaactttgac

SEQ ID NO: 687952 - DNA, 25 bp, Artificial sequence
  Synthetic oligonucleotide
gatggatccttacatcaactttgac

SEQ ID NO: 687953 - DNA, 25 bp, Artificial sequence
  Synthetic oligonucleotide
gctctccaaaggaatacacagttaa

SEQ ID NO: 687954 - DNA, 25 bp, Artificial sequence
  Synthetic oligonucleotide
tgttttgatgagtcagcctctgcat

SEQ ID NO: 687955 - DNA, 25 bp, Artificial sequence
  Synthetic oligonucleotide
gatcgtcagttaatctcttcttagc

SEQ ID NO: 687956 - DNA, 25 bp, Artificial sequence
  Synthetic oligonucleotide
tgttttgatgagacagcctctgcat

SEQ ID NO: 687957 - DNA, 25 bp, Artificial sequence
  Synthetic oligonucleotide
cgagtaatatacctgtttatgtgtt

SEQ ID NO: 687958 - DNA, 25 bp, Artificial sequence
  Synthetic oligonucleotide
cgagtaatatacgtgtttatgtgtt

SEQ ID NO: 687959 - DNA, 25 bp, Artificial sequence
  Synthetic oligonucleotide
agactgggtcttctgtagggtattc

SEQ ID NO: 687960 - DNA, 25 bp, Artificial sequence
  Synthetic oligonucleotide
agactgggtcttgtgtagggtattc

SEQ ID NO: 687961 - DNA, 25 bp, Artificial sequence
  Synthetic oligonucleotide
tcttcttatctcagtgatgatcatc

SEQ ID NO: 687962 - DNA, 25 bp, Artificial sequence
  Synthetic oligonucleotide
cggaaggagttatatgtagagacaa

SEQ ID NO: 687963 - DNA, 25 bp, Artificial sequence
  Synthetic oligonucleotide
cggaaggagttaaatgtagagacaa

SEQ ID NO: 687964 - DNA, 25 bp, Artificial sequence
  Synthetic oligonucleotide
gctctccaaaggtatacacagttaa

SEQ ID NO: 687965 - DNA, 25 bp, Artificial sequence
  Synthetic oligonucleotide
gaaggtagctcggagagcctcctga

SEQ ID NO: 687966 - DNA, 25 bp, Artificial sequence
  Synthetic oligonucleotide
cccttgtttactcgtggttcagcct

SEQ ID NO: 687967 - DNA, 25 bp, Artificial sequence
  Synthetic oligonucleotide
ggcctcgactcaatctgttcttcag

SEQ ID NO: 687968 - DNA, 25 bp, Artificial sequence
  Synthetic oligonucleotide
cccttgtttactggtggttcagcct

SEQ ID NO: 687969 - DNA, 25 bp, Artificial sequence
  Synthetic oligonucleotide
ggcctcgactcattctgttcttcag

SEQ ID NO: 687970 - DNA, 25 bp, Artificial sequence
  Synthetic oligonucleotide
ggttctcagagcactactcagtcag

SEQ ID NO: 687971 - DNA, 25 bp, Artificial sequence
  Synthetic oligonucleotide
ggttctcagagctctactcagtcag

SEQ ID NO: 687972 - DNA, 25 bp, Artificial sequence
  Synthetic oligonucleotide
ttgatggaagcctcgggcctaaaga

SEQ ID NO: 687973 - DNA, 25 bp, Artificial sequence
  Synthetic oligonucleotide
cagtctctgaacacaagattccatg

SEQ ID NO: 687974 - DNA, 25 bp, Artificial sequence
  Synthetic oligonucleotide
tttaaaagctaattgtttctaaaca

SEQ ID NO: 687975 - DNA, 25 bp, Artificial sequence
  Synthetic oligonucleotide
tcttcttatctctgtgatgatcatc

SEQ ID NO: 687976 - DNA, 25 bp, Artificial sequence
  Synthetic oligonucleotide
ggatctcatcatcctcccaatcatt

SEQ ID NO: 687977 - DNA, 25 bp, Artificial sequence
  Synthetic oligonucleotide
gaaggtagctcgcagagcctcctga

SEQ ID NO: 687978 - DNA, 25 bp, Artificial sequence
  Synthetic oligonucleotide
cagtctctgaactcaagattccatg

SEQ ID NO: 687979 - DNA, 25 bp, Artificial sequence
  Synthetic oligonucleotide
cacagaaccaaaccttaaactcgaa

SEQ ID NO: 687980 - DNA, 25 bp, Artificial sequence
  Synthetic oligonucleotide
cacagaaccaaagcttaaactcgaa

SEQ ID NO: 687981 - DNA, 25 bp, Artificial sequence
  Synthetic oligonucleotide
aatgagcacgtaccctgcttctcca

SEQ ID NO: 687982 - DNA, 25 bp, Artificial sequence
  Synthetic oligonucleotide
aatgagcacgtagcctgcttctcca

SEQ ID NO: 687983 - DNA, 25 bp, Artificial sequence
  Synthetic oligonucleotide
ttgatggaagccacgggcctaaaga

SEQ ID NO: 687984 - DNA, 25 bp, Artificial sequence
  Synthetic oligonucleotide
gctttagttcaaaccctcacggatg

SEQ ID NO: 687985 - DNA, 25 bp, Artificial sequence
  Synthetic oligonucleotide
tactattgcgagacaaaaaagttgg

SEQ ID NO: 687986 - DNA, 25 bp, Artificial sequence
  Synthetic oligonucleotide
tactattgcgagtcaaaaaagttgg

SEQ ID NO: 687987 - DNA, 25 bp, Artificial sequence
  Synthetic oligonucleotide
tttaaaagctaaatgtttctaaaca

SEQ ID NO: 687988 - DNA, 25 bp, Artificial sequence
  Synthetic oligonucleotide
tcaataatatcctacaatttttttg

SEQ ID NO: 687989 - DNA, 25 bp, Artificial sequence
  Synthetic oligonucleotide
tcaataatatccaacaatttttttg

SEQ ID NO: 687990 - DNA, 25 bp, Artificial sequence
  Synthetic oligonucleotide
ccaagcactgtttggaattgctgat

SEQ ID NO: 687991 - DNA, 25 bp, Artificial sequence
  Synthetic oligonucleotide
tcacatgatcagattcattatcctg

SEQ ID NO: 687992 - DNA, 25 bp, Artificial sequence
  Synthetic oligonucleotide
gctttagttcaatccctcacggatg

SEQ ID NO: 687993 - DNA, 25 bp, Artificial sequence
  Synthetic oligonucleotide
caactaagcgtgtttgtgtgtatgt

SEQ ID NO: 687994 - DNA, 25 bp, Artificial sequence
  Synthetic oligonucleotide
tatactattaatcgtaaatcctaaa

SEQ ID NO: 687995 - DNA, 25 bp, Artificial sequence
  Synthetic oligonucleotide
tatactattaatggtaaatcctaaa

SEQ ID NO: 687996 - DNA, 25 bp, Artificial sequence
  Synthetic oligonucleotide
cgttatgagattgattaaacttttc

SEQ ID NO: 687997 - DNA, 25 bp, Artificial sequence
  Synthetic oligonucleotide
tgaacatggcatttcttataaagaa

SEQ ID NO: 687998 - DNA, 25 bp, Artificial sequence
  Synthetic oligonucleotide
cgttatgagattcattaaacttttc

SEQ ID NO: 687999 - DNA, 25 bp, Artificial sequence
  Synthetic oligonucleotide
tgaacatggcatatcttataaagaa

SEQ ID NO: 688000 - DNA, 25 bp, Artificial sequence
  Synthetic oligonucleotide
tctccacagattcctagattcctgt

SEQ ID NO: 688001 - DNA, 25 bp, Artificial sequence
  Synthetic oligonucleotide
ggctgagaactatccgagcaacggc

SEQ ID NO: 688002 - DNA, 25 bp, Artificial sequence
  Synthetic oligonucleotide
aaaccgattgggacatgcacgaatt

SEQ ID NO: 688003 - DNA, 25 bp, Artificial sequence
  Synthetic oligonucleotide
aaaccgattgggtcatgcacgaatt

SEQ ID NO: 688004 - DNA, 25 bp, Artificial sequence
  Synthetic oligonucleotide
tggttttctatctaggtcgagctcc

SEQ ID NO: 688005 - DNA, 25 bp, Artificial sequence
  Synthetic oligonucleotide
tggttttctatcaaggtcgagctcc

SEQ ID NO: 688006 - DNA, 25 bp, Artificial sequence
  Synthetic oligonucleotide
tctaagaaagggaaagctagttggg

SEQ ID NO: 688007 - DNA, 25 bp, Artificial sequence
  Synthetic oligonucleotide
tctaagaaagggtaagctagttggg

SEQ ID NO: 688008 - DNA, 25 bp, Artificial sequence
  Synthetic oligonucleotide
tcacatgatcagtttcattatcctg

SEQ ID NO: 688009 - DNA, 25 bp, Artificial sequence
  Synthetic oligonucleotide
tattggaaagcctccggcaaagaca

SEQ ID NO: 688010 - DNA, 25 bp, Artificial sequence
  Synthetic oligonucleotide
ggatctcatcatgctcccaatcatt

SEQ ID NO: 688011 - DNA, 25 bp, Artificial sequence
  Synthetic oligonucleotide
ggctgagaactaaccgagcaacggc

SEQ ID NO: 688012 - DNA, 25 bp, Artificial sequence
  Synthetic oligonucleotide
tatttctacagccaaagagaccgaa

SEQ ID NO: 688013 - DNA, 25 bp, Artificial sequence
  Synthetic oligonucleotide
tatttctacagcgaaagagaccgaa

SEQ ID NO: 688014 - DNA, 25 bp, Artificial sequence
  Synthetic oligonucleotide
atgattagaaatcgcatgcgtggga

SEQ ID NO: 688015 - DNA, 25 bp, Artificial sequence
  Synthetic oligonucleotide
atgattagaaatggcatgcgtggga

SEQ ID NO: 688016 - DNA, 25 bp, Artificial sequence
  Synthetic oligonucleotide
caactaagcgtgattgtgtgtatgt

SEQ ID NO: 688017 - DNA, 25 bp, Artificial sequence
  Synthetic oligonucleotide
tattggaaagccaccggcaaagaca

SEQ ID NO: 688018 - DNA, 25 bp, Artificial sequence
  Synthetic oligonucleotide
gggacacactcattagggtacctat

SEQ ID NO: 688019 - DNA, 25 bp, Artificial sequence
  Synthetic oligonucleotide
tttaggaagatctcatgatattccg

SEQ ID NO: 688020 - DNA, 25 bp, Artificial sequence
  Synthetic oligonucleotide
aaggcacctctcctctacggctatg

SEQ ID NO: 688021 - DNA, 25 bp, Artificial sequence
  Synthetic oligonucleotide
aaggcacctctcgtctacggctatg

SEQ ID NO: 688022 - DNA, 25 bp, Artificial sequence
  Synthetic oligonucleotide
tctccacagattgctagattcctgt

SEQ ID NO: 688023 - DNA, 25 bp, Artificial sequence
  Synthetic oligonucleotide
gagaattgcaccttcaacatttggg

SEQ ID NO: 688024 - DNA, 25 bp, Artificial sequence
  Synthetic oligonucleotide
aagtctgcaaaacctttgacgctgc

SEQ ID NO: 688025 - DNA, 25 bp, Artificial sequence
  Synthetic oligonucleotide
ggaaacgcacttcccctagagacaa

SEQ ID NO: 688026 - DNA, 25 bp, Artificial sequence
  Synthetic oligonucleotide
gggacacactcaatagggtacctat

SEQ ID NO: 688027 - DNA, 25 bp, Artificial sequence
  Synthetic oligonucleotide
gctgacaagcgatgagattaacaga

SEQ ID NO: 688028 - DNA, 25 bp, Artificial sequence
  Synthetic oligonucleotide
aatgtttttgtttctctgttttgag

SEQ ID NO: 688029 - DNA, 25 bp, Artificial sequence
  Synthetic oligonucleotide
aatgtttttgttactctgttttgag

SEQ ID NO: 688030 - DNA, 25 bp, Artificial sequence
  Synthetic oligonucleotide
tagtcattttacttgattctagtag

SEQ ID NO: 688031 - DNA, 25 bp, Artificial sequence
  Synthetic oligonucleotide
tagtcattttacatgattctagtag

SEQ ID NO: 688032 - DNA, 25 bp, Artificial sequence
  Synthetic oligonucleotide
tcatcggccgattgagttcacgagg

SEQ ID NO: 688033 - DNA, 25 bp, Artificial sequence
  Synthetic oligonucleotide
gagaattgcaccatcaacatttggg

SEQ ID NO: 688034 - DNA, 25 bp, Artificial sequence
  Synthetic oligonucleotide
aagtctgcaaaagctttgacgctgc

SEQ ID NO: 688035 - DNA, 25 bp, Artificial sequence
  Synthetic oligonucleotide
tttgaacatctcatcagatattttg

SEQ ID NO: 688036 - DNA, 25 bp, Artificial sequence
  Synthetic oligonucleotide
tccacctttcacaaaaaaaatcaag

SEQ ID NO: 688037 - DNA, 25 bp, Artificial sequence
  Synthetic oligonucleotide
tccacctttcactaaaaaaatcaag

SEQ ID NO: 688038 - DNA, 25 bp, Artificial sequence
  Synthetic oligonucleotide
cactgttggcatagtctggagtaga

SEQ ID NO: 688039 - DNA, 25 bp, Artificial sequence
  Synthetic oligonucleotide
cactgttggcattgtctggagtaga

SEQ ID NO: 688040 - DNA, 25 bp, Artificial sequence
  Synthetic oligonucleotide
tcactcgatagcttttggaggccgg

SEQ ID NO: 688041 - DNA, 25 bp, Artificial sequence
  Synthetic oligonucleotide
tcactcgatagcatttggaggccgg

SEQ ID NO: 688042 - DNA, 25 bp, Artificial sequence
  Synthetic oligonucleotide
ggaaacgcacttgccctagagacaa

SEQ ID NO: 688043 - DNA, 25 bp, Artificial sequence
  Synthetic oligonucleotide
tcgttgttttggttgaataatcaca

SEQ ID NO: 688044 - DNA, 25 bp, Artificial sequence
  Synthetic oligonucleotide
tttaggaagatcacatgatattccg

SEQ ID NO: 688045 - DNA, 25 bp, Artificial sequence
  Synthetic oligonucleotide
tttgaacatctcttcagatattttg

SEQ ID NO: 688046 - DNA, 25 bp, Artificial sequence
  Synthetic oligonucleotide
gggagagaactatcaaggcctgagc

SEQ ID NO: 688047 - DNA, 25 bp, Artificial sequence
  Synthetic oligonucleotide
gggagagaactaacaaggcctgagc

SEQ ID NO: 688048 - DNA, 25 bp, Artificial sequence
  Synthetic oligonucleotide
tcaggacgcttaccatctgtgggct

SEQ ID NO: 688049 - DNA, 25 bp, Artificial sequence
  Synthetic oligonucleotide
tcaggacgcttagcatctgtgggct

SEQ ID NO: 688050 - DNA, 25 bp, Artificial sequence
  Synthetic oligonucleotide
gctgacaagcgaagagattaacaga

SEQ ID NO: 688051 - DNA, 25 bp, Artificial sequence
  Synthetic oligonucleotide
gacaacagtatcattattgatccat

SEQ ID NO: 688052 - DNA, 25 bp, Artificial sequence
  Synthetic oligonucleotide
cccacggtagattcatgtaaaatac

SEQ ID NO: 688053 - DNA, 25 bp, Artificial sequence
  Synthetic oligonucleotide
tcatcggccgatagagttcacgagg

SEQ ID NO: 688054 - DNA, 25 bp, Artificial sequence
  Synthetic oligonucleotide
gataatatgaaagatcactacctgt

SEQ ID NO: 688055 - DNA, 25 bp, Artificial sequence
  Synthetic oligonucleotide
gataatatgaaacatcactacctgt

SEQ ID NO: 688056 - DNA, 25 bp, Artificial sequence
  Synthetic oligonucleotide
gtttcaaggtattaaggacctctag

SEQ ID NO: 688057 - DNA, 25 bp, Artificial sequence
  Synthetic oligonucleotide
gtttcaaggtataaaggacctctag

SEQ ID NO: 688058 - DNA, 25 bp, Artificial sequence
  Synthetic oligonucleotide
gctagacatacatatatttcatcgt

SEQ ID NO: 688059 - DNA, 25 bp, Artificial sequence
  Synthetic oligonucleotide
gataggtgattgtatagccaaggca

SEQ ID NO: 688060 - DNA, 25 bp, Artificial sequence
  Synthetic oligonucleotide
cccacggtagatacatgtaaaatac

SEQ ID NO: 688061 - DNA, 25 bp, Artificial sequence
  Synthetic oligonucleotide
cctgaaacagaatttaaataaatca

SEQ ID NO: 688062 - DNA, 25 bp, Artificial sequence
  Synthetic oligonucleotide
tgtctgattgtagaaacatttcctc

SEQ ID NO: 688063 - DNA, 25 bp, Artificial sequence
  Synthetic oligonucleotide
tgtctgattgtacaaacatttcctc

SEQ ID NO: 688064 - DNA, 25 bp, Artificial sequence
  Synthetic oligonucleotide
gattggaacaatacttcggggggaa

SEQ ID NO: 688065 - DNA, 25 bp, Artificial sequence
  Synthetic oligonucleotide
gattggaacaattcttcggggggaa

SEQ ID NO: 688066 - DNA, 25 bp, Artificial sequence
  Synthetic oligonucleotide
acgagagttactattgctatattcc

SEQ ID NO: 688067 - DNA, 25 bp, Artificial sequence
  Synthetic oligonucleotide
acgagagttacttttgctatattcc

SEQ ID NO: 688068 - DNA, 25 bp, Artificial sequence
  Synthetic oligonucleotide
gctagacatacaaatatttcatcgt

SEQ ID NO: 688069 - DNA, 25 bp, Artificial sequence
  Synthetic oligonucleotide
gcacatagattcatcaacgcatagg

SEQ ID NO: 688070 - DNA, 25 bp, Artificial sequence
  Synthetic oligonucleotide
actgcgctggctatcatttctcaag

SEQ ID NO: 688071 - DNA, 25 bp, Artificial sequence
  Synthetic oligonucleotide
actgcgctggctttcatttctcaag

SEQ ID NO: 688072 - DNA, 25 bp, Artificial sequence
  Synthetic oligonucleotide
tcaaaaagcactccgactggcactt

SEQ ID NO: 688073 - DNA, 25 bp, Artificial sequence
  Synthetic oligonucleotide
tcaaaaagcactgcgactggcactt

SEQ ID NO: 688074 - DNA, 25 bp, Artificial sequence
  Synthetic oligonucleotide
tgcttactttcgaagatgttgccaa

SEQ ID NO: 688075 - DNA, 25 bp, Artificial sequence
  Synthetic oligonucleotide
tgcttactttcgtagatgttgccaa

SEQ ID NO: 688076 - DNA, 25 bp, Artificial sequence
  Synthetic oligonucleotide
gataggtgattgaatagccaaggca

SEQ ID NO: 688077 - DNA, 25 bp, Artificial sequence
  Synthetic oligonucleotide
tatcatcaaataagcagaaactgtc

SEQ ID NO: 688078 - DNA, 25 bp, Artificial sequence
  Synthetic oligonucleotide
ccaagcactgttaggaattgctgat

SEQ ID NO: 688079 - DNA, 25 bp, Artificial sequence
  Synthetic oligonucleotide
gcacatagattcttcaacgcatagg

SEQ ID NO: 688080 - DNA, 25 bp, Artificial sequence
  Synthetic oligonucleotide
cacggtaggaacttatattgaatcc

SEQ ID NO: 688081 - DNA, 25 bp, Artificial sequence
  Synthetic oligonucleotide
cacggtaggaacatatattgaatcc

SEQ ID NO: 688082 - DNA, 25 bp, Artificial sequence
  Synthetic oligonucleotide
tcggaacaaaaatcctcagaataac

SEQ ID NO: 688083 - DNA, 25 bp, Artificial sequence
  Synthetic oligonucleotide
tcggaacaaaaaacctcagaataac

SEQ ID NO: 688084 - DNA, 25 bp, Artificial sequence
  Synthetic oligonucleotide
cctgaaacagaaattaaataaatca

SEQ ID NO: 688085 - DNA, 25 bp, Artificial sequence
  Synthetic oligonucleotide
tatcatcaaatatgcagaaactgtc

SEQ ID NO: 688086 - DNA, 25 bp, Artificial sequence
  Synthetic oligonucleotide
tcttcttatgttatgtaacatgcaa

SEQ ID NO: 688087 - DNA, 25 bp, Artificial sequence
  Synthetic oligonucleotide
tggaagctagtaatacattctttaa

SEQ ID NO: 688088 - DNA, 25 bp, Artificial sequence
  Synthetic oligonucleotide
ctaggcaaaaatttgtgagtctgtt

SEQ ID NO: 688089 - DNA, 25 bp, Artificial sequence
  Synthetic oligonucleotide
tattatctatgtgtatcctcagcta

SEQ ID NO: 688090 - DNA, 25 bp, Artificial sequence
  Synthetic oligonucleotide
tattatctatgtctatcctcagcta

SEQ ID NO: 688091 - DNA, 25 bp, Artificial sequence
  Synthetic oligonucleotide
gatatatatcatagagaatgtagac

SEQ ID NO: 688092 - DNA, 25 bp, Artificial sequence
  Synthetic oligonucleotide
tgttttggatagagtacgtaattaa

SEQ ID NO: 688093 - DNA, 25 bp, Artificial sequence
  Synthetic oligonucleotide
tcttcttatgttttgtaacatgcaa

SEQ ID NO: 688094 - DNA, 25 bp, Artificial sequence
  Synthetic oligonucleotide
tgttttggatagtgtacgtaattaa

SEQ ID NO: 688095 - DNA, 25 bp, Artificial sequence
  Synthetic oligonucleotide
accaattgactaaaccattttaaca

SEQ ID NO: 688096 - DNA, 25 bp, Artificial sequence
  Synthetic oligonucleotide
accaattgactataccattttaaca

SEQ ID NO: 688097 - DNA, 25 bp, Artificial sequence
  Synthetic oligonucleotide
cagagagcataaagcgttatcaaga

SEQ ID NO: 688098 - DNA, 25 bp, Artificial sequence
  Synthetic oligonucleotide
cagagagcataatgcgttatcaaga

SEQ ID NO: 688099 - DNA, 25 bp, Artificial sequence
  Synthetic oligonucleotide
tgtttcatggcacccatgccactgt

SEQ ID NO: 688100 - DNA, 25 bp, Artificial sequence
  Synthetic oligonucleotide
gcaaagttgcctgcgggattcagat

SEQ ID NO: 688101 - DNA, 25 bp, Artificial sequence
  Synthetic oligonucleotide
gatatatatcattgagaatgtagac

SEQ ID NO: 688102 - DNA, 25 bp, Artificial sequence
  Synthetic oligonucleotide
gacacacccaaaagatcccaataat

SEQ ID NO: 688103 - DNA, 25 bp, Artificial sequence
  Synthetic oligonucleotide
gagatgaaggaaagtagtataagca

SEQ ID NO: 688104 - DNA, 25 bp, Artificial sequence
  Synthetic oligonucleotide
gagatgaaggaatgtagtataagca

SEQ ID NO: 688105 - DNA, 25 bp, Artificial sequence
  Synthetic oligonucleotide
cctagaaaaaaataggatcaaatca

SEQ ID NO: 688106 - DNA, 25 bp, Artificial sequence
  Synthetic oligonucleotide
cctagaaaaaaaaaggatcaaatca

SEQ ID NO: 688107 - DNA, 25 bp, Artificial sequence
  Synthetic oligonucleotide
tatctctcttttcctcttaaccatc

SEQ ID NO: 688108 - DNA, 25 bp, Artificial sequence
  Synthetic oligonucleotide
ctaggcaaaaatatgtgagtctgtt

SEQ ID NO: 688109 - DNA, 25 bp, Artificial sequence
  Synthetic oligonucleotide
gacacacccaaatgatcccaataat

SEQ ID NO: 688110 - DNA, 25 bp, Artificial sequence
  Synthetic oligonucleotide
tggaagctagtattacattctttaa

SEQ ID NO: 688111 - DNA, 25 bp, Artificial sequence
  Synthetic oligonucleotide
gcaattactactaaaaccaagggtc

SEQ ID NO: 688112 - DNA, 25 bp, Artificial sequence
  Synthetic oligonucleotide
gcaattactacttaaaccaagggtc

SEQ ID NO: 688113 - DNA, 25 bp, Artificial sequence
  Synthetic oligonucleotide
aaaaatgatatatatagaagttgac

SEQ ID NO: 688114 - DNA, 25 bp, Artificial sequence
  Synthetic oligonucleotide
aaaaatgatataaatagaagttgac

SEQ ID NO: 688115 - DNA, 25 bp, Artificial sequence
  Synthetic oligonucleotide
tggaaattaaattctaacatatgat

SEQ ID NO: 688116 - DNA, 25 bp, Artificial sequence
  Synthetic oligonucleotide
tggaaattaaatactaacatatgat

SEQ ID NO: 688117 - DNA, 25 bp, Artificial sequence
  Synthetic oligonucleotide
tatctctcttttgctcttaaccatc

SEQ ID NO: 688118 - DNA, 25 bp, Artificial sequence
  Synthetic oligonucleotide
ccaaaatccatgtataaaaatgacc

SEQ ID NO: 688119 - DNA, 25 bp, Artificial sequence
  Synthetic oligonucleotide
tgtttcatggcagccatgccactgt

SEQ ID NO: 688120 - DNA, 25 bp, Artificial sequence
  Synthetic oligonucleotide
gtctttgggccaggcgggcctttca

SEQ ID NO: 688121 - DNA, 25 bp, Artificial sequence
  Synthetic oligonucleotide
tcgttgttttggatgaataatcaca

SEQ ID NO: 688122 - DNA, 25 bp, Artificial sequence
  Synthetic oligonucleotide
aatcgtggaattaagtatagggcaa

SEQ ID NO: 688123 - DNA, 25 bp, Artificial sequence
  Synthetic oligonucleotide
gttttactttgaaatggttggtcca

SEQ ID NO: 688124 - DNA, 25 bp, Artificial sequence
  Synthetic oligonucleotide
gctgttcacatgaattattctcatt

SEQ ID NO: 688125 - DNA, 25 bp, Artificial sequence
  Synthetic oligonucleotide
ccaaaatccatgaataaaaatgacc

SEQ ID NO: 688126 - DNA, 25 bp, Artificial sequence
  Synthetic oligonucleotide
gctgttcacatgtattattctcatt

SEQ ID NO: 688127 - DNA, 25 bp, Artificial sequence
  Synthetic oligonucleotide
tccacaattaatcggcaagtttgag

SEQ ID NO: 688128 - DNA, 25 bp, Artificial sequence
  Synthetic oligonucleotide
tccacaattaatgggcaagtttgag

SEQ ID NO: 688129 - DNA, 25 bp, Artificial sequence
  Synthetic oligonucleotide
gttttatacacgtggcacagcaatg

SEQ ID NO: 688130 - DNA, 25 bp, Artificial sequence
  Synthetic oligonucleotide
gttttatacacgaggcacagcaatg

SEQ ID NO: 688131 - DNA, 25 bp, Artificial sequence
  Synthetic oligonucleotide
gatctgaggtaaaggcgaaaacgac

SEQ ID NO: 688132 - DNA, 25 bp, Artificial sequence
  Synthetic oligonucleotide
gatctgaggtaatggcgaaaacgac

SEQ ID NO: 688133 - DNA, 25 bp, Artificial sequence
  Synthetic oligonucleotide
taattagcaaaagttattcaccgat

SEQ ID NO: 688134 - DNA, 25 bp, Artificial sequence
  Synthetic oligonucleotide
cataaacaataatcagaaaaaactg

SEQ ID NO: 688135 - DNA, 25 bp, Artificial sequence
  Synthetic oligonucleotide
tcaaaacattaaaatactaaaagaa

SEQ ID NO: 688136 - DNA, 25 bp, Artificial sequence
  Synthetic oligonucleotide
tcaaaacattaatatactaaaagaa

SEQ ID NO: 688137 - DNA, 25 bp, Artificial sequence
  Synthetic oligonucleotide
gaaataattaaagcattcagacacg

SEQ ID NO: 688138 - DNA, 25 bp, Artificial sequence
  Synthetic oligonucleotide
gaaataattaaaccattcagacacg

SEQ ID NO: 688139 - DNA, 25 bp, Artificial sequence
  Synthetic oligonucleotide
gtttcatagtataaactaatcctac

SEQ ID NO: 688140 - DNA, 25 bp, Artificial sequence
  Synthetic oligonucleotide
gtctttgggccacgcgggcctttca

SEQ ID NO: 688141 - DNA, 25 bp, Artificial sequence
  Synthetic oligonucleotide
cataaacaataaacagaaaaaactg

SEQ ID NO: 688142 - DNA, 25 bp, Artificial sequence
  Synthetic oligonucleotide
aatcgtggaatttagtatagggcaa

SEQ ID NO: 688143 - DNA, 25 bp, Artificial sequence
  Synthetic oligonucleotide
cgtgtattttaaagacggagattac

SEQ ID NO: 688144 - DNA, 25 bp, Artificial sequence
  Synthetic oligonucleotide
cgtgtattttaatgacggagattac

SEQ ID NO: 688145 - DNA, 25 bp, Artificial sequence
  Synthetic oligonucleotide
gtgtctatgacttcgtcgacaaatg

SEQ ID NO: 688146 - DNA, 25 bp, Artificial sequence
  Synthetic oligonucleotide
gtgtctatgactacgtcgacaaatg

SEQ ID NO: 688147 - DNA, 25 bp, Artificial sequence
  Synthetic oligonucleotide
tcggattatatgttgtttttaaaac

SEQ ID NO: 688148 - DNA, 25 bp, Artificial sequence
  Synthetic oligonucleotide
tcggattatatgatgtttttaaaac

SEQ ID NO: 688149 - DNA, 25 bp, Artificial sequence
  Synthetic oligonucleotide
gtttcatagtattaactaatcctac

SEQ ID NO: 688150 - DNA, 25 bp, Artificial sequence
  Synthetic oligonucleotide
cgtaataatatgtaattaattcgag

SEQ ID NO: 688151 - DNA, 25 bp, Artificial sequence
  Synthetic oligonucleotide
caaaaaccttattcaaacatataac

SEQ ID NO: 688152 - DNA, 25 bp, Artificial sequence
  Synthetic oligonucleotide
taagagtaacgaggaaaaagtcaat

SEQ ID NO: 688153 - DNA, 25 bp, Artificial sequence
  Synthetic oligonucleotide
tcaaccaaattcttgaaaaaaaagc

SEQ ID NO: 688154 - DNA, 25 bp, Artificial sequence
  Synthetic oligonucleotide
tcaaccaaattcatgaaaaaaaagc

SEQ ID NO: 688155 - DNA, 25 bp, Artificial sequence
  Synthetic oligonucleotide
tatacgagaagttgacactcttggc

SEQ ID NO: 688156 - DNA, 25 bp, Artificial sequence
  Synthetic oligonucleotide
ggtttatagcctatagagtgtgaca

SEQ ID NO: 688157 - DNA, 25 bp, Artificial sequence
  Synthetic oligonucleotide
cgtaataatatgaaattaattcgag

SEQ ID NO: 688158 - DNA, 25 bp, Artificial sequence
  Synthetic oligonucleotide
ggtttatagcctttagagtgtgaca

SEQ ID NO: 688159 - DNA, 25 bp, Artificial sequence
  Synthetic oligonucleotide
gatcagatgatttcaatttataaga

SEQ ID NO: 688160 - DNA, 25 bp, Artificial sequence
  Synthetic oligonucleotide
gatcagatgattacaatttataaga

SEQ ID NO: 688161 - DNA, 25 bp, Artificial sequence
  Synthetic oligonucleotide
tacacatatatacatactttataag

SEQ ID NO: 688162 - DNA, 25 bp, Artificial sequence
  Synthetic oligonucleotide
tacacatatatagatactttataag

SEQ ID NO: 688163 - DNA, 25 bp, Artificial sequence
  Synthetic oligonucleotide
cgatttatataatgttatggattgg

SEQ ID NO: 688164 - DNA, 25 bp, Artificial sequence
  Synthetic oligonucleotide
cgatttatataaagttatggattgg

SEQ ID NO: 688165 - DNA, 25 bp, Artificial sequence
  Synthetic oligonucleotide
tatacgagaagtagacactcttggc

SEQ ID NO: 688166 - DNA, 25 bp, Artificial sequence
  Synthetic oligonucleotide
tagtcgtcattcatttgatcaaaga

SEQ ID NO: 688167 - DNA, 25 bp, Artificial sequence
  Synthetic oligonucleotide
taattagcaaaacttattcaccgat

SEQ ID NO: 688168 - DNA, 25 bp, Artificial sequence
  Synthetic oligonucleotide
gcaaagttgcctccgggattcagat

SEQ ID NO: 688169 - DNA, 25 bp, Artificial sequence
  Synthetic oligonucleotide
tcaaaatcctactcatttacacgcg

SEQ ID NO: 688170 - DNA, 25 bp, Artificial sequence
  Synthetic oligonucleotide
tcaaaatcctacacatttacacgcg

SEQ ID NO: 688171 - DNA, 25 bp, Artificial sequence
  Synthetic oligonucleotide
tctttatttcaaacaaaattccaca

SEQ ID NO: 688172 - DNA, 25 bp, Artificial sequence
  Synthetic oligonucleotide
taagagtaacgacgaaaaagtcaat

SEQ ID NO: 688173 - DNA, 25 bp, Artificial sequence
  Synthetic oligonucleotide
tagtcgtcattcttttgatcaaaga

SEQ ID NO: 688174 - DNA, 25 bp, Artificial sequence
  Synthetic oligonucleotide
gggtcctgattacttttcaaatcaa

SEQ ID NO: 688175 - DNA, 25 bp, Artificial sequence
  Synthetic oligonucleotide
gacccttcaactacataataattat

SEQ ID NO: 688176 - DNA, 25 bp, Artificial sequence
  Synthetic oligonucleotide
gggtcctgattagttttcaaatcaa

SEQ ID NO: 688177 - DNA, 25 bp, Artificial sequence
  Synthetic oligonucleotide
tcttattctctcgtttgcttacgcc

SEQ ID NO: 688178 - DNA, 25 bp, Artificial sequence
  Synthetic oligonucleotide
tcttattctctcctttgcttacgcc

SEQ ID NO: 688179 - DNA, 25 bp, Artificial sequence
  Synthetic oligonucleotide
aatgtaaaattccttgggtttgatc

SEQ ID NO: 688180 - DNA, 25 bp, Artificial sequence
  Synthetic oligonucleotide
aatgtaaaattcgttgggtttgatc

SEQ ID NO: 688181 - DNA, 25 bp, Artificial sequence
  Synthetic oligonucleotide
tctttatttcaatcaaaattccaca

SEQ ID NO: 688182 - DNA, 25 bp, Artificial sequence
  Synthetic oligonucleotide
gacaacagtatctttattgatccat

SEQ ID NO: 688183 - DNA, 25 bp, Artificial sequence
  Synthetic oligonucleotide
gatcgcttcacaataatcatcgacc

SEQ ID NO: 688184 - DNA, 25 bp, Artificial sequence
  Synthetic oligonucleotide
gatcgcttcacattaatcatcgacc

SEQ ID NO: 688185 - DNA, 25 bp, Artificial sequence
  Synthetic oligonucleotide
tgatccaagtcgatctcaacaagtg

SEQ ID NO: 688186 - DNA, 25 bp, Artificial sequence
  Synthetic oligonucleotide
caaaaaccttatacaaacatataac

SEQ ID NO: 688187 - DNA, 25 bp, Artificial sequence
  Synthetic oligonucleotide
gacccttcaacttcataataattat

SEQ ID NO: 688188 - DNA, 25 bp, Artificial sequence
  Synthetic oligonucleotide
tgatccaagtcgttctcaacaagtg

SEQ ID NO: 688189 - DNA, 25 bp, Artificial sequence
  Synthetic oligonucleotide
gggacatcccaactacgttttcatt

SEQ ID NO: 688190 - DNA, 25 bp, Artificial sequence
  Synthetic oligonucleotide
gacgatgagcttctctgcgattact

SEQ ID NO: 688191 - DNA, 25 bp, Artificial sequence
  Synthetic oligonucleotide
gttttactttgatatggttggtcca

SEQ ID NO: 688192 - DNA, 25 bp, Artificial sequence
  Synthetic oligonucleotide
tatgtcatgatcatctttcgtgttc

SEQ ID NO: 688193 - DNA, 25 bp, Artificial sequence
  Synthetic oligonucleotide
aactttaagatgatgatgtcacctc

SEQ ID NO: 688194 - DNA, 25 bp, Artificial sequence
  Synthetic oligonucleotide
tctagaaacaaatctttagaagtta

SEQ ID NO: 688195 - DNA, 25 bp, Artificial sequence
  Synthetic oligonucleotide
gcatccagtttaaacaatgtagtct

SEQ ID NO: 688196 - DNA, 25 bp, Artificial sequence
  Synthetic oligonucleotide
tctagaaacaaaactttagaagtta

SEQ ID NO: 688197 - DNA, 25 bp, Artificial sequence
  Synthetic oligonucleotide
catatctactaatacaaaagttgga

SEQ ID NO: 688198 - DNA, 25 bp, Artificial sequence
  Synthetic oligonucleotide
catatctactaaaacaaaagttgga

SEQ ID NO: 688199 - DNA, 25 bp, Artificial sequence
  Synthetic oligonucleotide
gcatccagtttatacaatgtagtct

SEQ ID NO: 688200 - DNA, 25 bp, Artificial sequence
  Synthetic oligonucleotide
aactttaagatgttgatgtcacctc

SEQ ID NO: 688201 - DNA, 25 bp, Artificial sequence
  Synthetic oligonucleotide
tatgtcatgatcttctttcgtgttc

SEQ ID NO: 688202 - DNA, 25 bp, Artificial sequence
  Synthetic oligonucleotide
gggacatcccaagtacgttttcatt

SEQ ID NO: 688203 - DNA, 25 bp, Artificial sequence
  Synthetic oligonucleotide
gacgatgagcttgtctgcgattact

SEQ ID NO: 688204 - DNA, 25 bp, Artificial sequence
  Synthetic oligonucleotide
tgacagaccgtaatgacatatcagg

SEQ ID NO: 688205 - DNA, 25 bp, Artificial sequence
  Synthetic oligonucleotide
gtgtaatatatgaaccttgtctgaa

SEQ ID NO: 688206 - DNA, 25 bp, Artificial sequence
  Synthetic oligonucleotide
gcgttgcaactaatccctccttatg

SEQ ID NO: 688207 - DNA, 25 bp, Artificial sequence
  Synthetic oligonucleotide
gcgttgcaactattccctccttatg

SEQ ID NO: 688208 - DNA, 25 bp, Artificial sequence
  Synthetic oligonucleotide
tttatttgattgaaattttttgacg

SEQ ID NO: 688209 - DNA, 25 bp, Artificial sequence
  Synthetic oligonucleotide
tttatttgattgtaattttttgacg

SEQ ID NO: 688210 - DNA, 25 bp, Artificial sequence
  Synthetic oligonucleotide
tcaggttacgacttctctttttcac

SEQ ID NO: 688211 - DNA, 25 bp, Artificial sequence
  Synthetic oligonucleotide
tcttgggttgggaaaggtggagcct

SEQ ID NO: 688212 - DNA, 25 bp, Artificial sequence
  Synthetic oligonucleotide
gtgtaatatatgtaccttgtctgaa

SEQ ID NO: 688213 - DNA, 25 bp, Artificial sequence
  Synthetic oligonucleotide
aaataaaacactatataagcactgg

SEQ ID NO: 688214 - DNA, 25 bp, Artificial sequence
  Synthetic oligonucleotide
tcttgggttgggtaaggtggagcct

SEQ ID NO: 688215 - DNA, 25 bp, Artificial sequence
  Synthetic oligonucleotide
tcaggttacgacatctctttttcac

SEQ ID NO: 688216 - DNA, 25 bp, Artificial sequence
  Synthetic oligonucleotide
aaataaaacactttataagcactgg

SEQ ID NO: 688217 - DNA, 25 bp, Artificial sequence
  Synthetic oligonucleotide
aaagctagaagagagggaagcaggc

SEQ ID NO: 688218 - DNA, 25 bp, Artificial sequence
  Synthetic oligonucleotide
tgagtgagggtcttggagtgatagc

SEQ ID NO: 688219 - DNA, 25 bp, Artificial sequence
  Synthetic oligonucleotide
tgagtgagggtcatggagtgatagc

SEQ ID NO: 688220 - DNA, 25 bp, Artificial sequence
  Synthetic oligonucleotide
aaccatagtttaacgggaagaaagc

SEQ ID NO: 688221 - DNA, 25 bp, Artificial sequence
  Synthetic oligonucleotide
aaccatagtttatcgggaagaaagc

SEQ ID NO: 688222 - DNA, 25 bp, Artificial sequence
  Synthetic oligonucleotide
gaacggagacatctcatcggagaaa

SEQ ID NO: 688223 - DNA, 25 bp, Artificial sequence
  Synthetic oligonucleotide
aagggttgtgaaaacatatttgctc

SEQ ID NO: 688224 - DNA, 25 bp, Artificial sequence
  Synthetic oligonucleotide
gcccgttttaccttacagcgtggaa

SEQ ID NO: 688225 - DNA, 25 bp, Artificial sequence
  Synthetic oligonucleotide
gccaagcttatctccgatctcaaca

SEQ ID NO: 688226 - DNA, 25 bp, Artificial sequence
  Synthetic oligonucleotide
gaacggagacatgtcatcggagaaa

SEQ ID NO: 688227 - DNA, 25 bp, Artificial sequence
  Synthetic oligonucleotide
tgacagaccgtattgacatatcagg

SEQ ID NO: 688228 - DNA, 25 bp, Artificial sequence
  Synthetic oligonucleotide
ccttggctgcaagtgggtcattctt

SEQ ID NO: 688229 - DNA, 25 bp, Artificial sequence
  Synthetic oligonucleotide
ccttggctgcaactgggtcattctt

SEQ ID NO: 688230 - DNA, 25 bp, Artificial sequence
  Synthetic oligonucleotide
gcccgttttaccatacagcgtggaa

SEQ ID NO: 688231 - DNA, 25 bp, Artificial sequence
  Synthetic oligonucleotide
aagggttgtgaatacatatttgctc

SEQ ID NO: 688232 - DNA, 25 bp, Artificial sequence
  Synthetic oligonucleotide
gtaagtacatataatgctcattgtc

SEQ ID NO: 688233 - DNA, 25 bp, Artificial sequence
  Synthetic oligonucleotide
gctgcagtttttggttggaggaaac

SEQ ID NO: 688234 - DNA, 25 bp, Artificial sequence
  Synthetic oligonucleotide
gctgcagtttttcgttggaggaaac

SEQ ID NO: 688235 - DNA, 25 bp, Artificial sequence
  Synthetic oligonucleotide
gttgtctaaacagttgctatctctg

SEQ ID NO: 688236 - DNA, 25 bp, Artificial sequence
  Synthetic oligonucleotide
gttgtctaaacacttgctatctctg

SEQ ID NO: 688237 - DNA, 25 bp, Artificial sequence
  Synthetic oligonucleotide
aatgctagattctggatttcgagtg

SEQ ID NO: 688238 - DNA, 25 bp, Artificial sequence
  Synthetic oligonucleotide
aatgctagattcaggatttcgagtg

SEQ ID NO: 688239 - DNA, 25 bp, Artificial sequence
  Synthetic oligonucleotide
agctttggttttctttcctactcca

SEQ ID NO: 688240 - DNA, 25 bp, Artificial sequence
  Synthetic oligonucleotide
tagaagtaaagcagctcacactcac

SEQ ID NO: 688241 - DNA, 25 bp, Artificial sequence
  Synthetic oligonucleotide
agctttggttttgtttcctactcca

SEQ ID NO: 688242 - DNA, 25 bp, Artificial sequence
  Synthetic oligonucleotide
aaagctagaagacagggaagcaggc

SEQ ID NO: 688243 - DNA, 25 bp, Artificial sequence
  Synthetic oligonucleotide
taagaatctcaattctcttcattgc

SEQ ID NO: 688244 - DNA, 25 bp, Artificial sequence
  Synthetic oligonucleotide
taagaatctcaaatctcttcattgc

SEQ ID NO: 688245 - DNA, 25 bp, Artificial sequence
  Synthetic oligonucleotide
tatgattgaggatgaaagttattcc

SEQ ID NO: 688246 - DNA, 25 bp, Artificial sequence
  Synthetic oligonucleotide
gaagcagatgtacgtgagtttctgc

SEQ ID NO: 688247 - DNA, 25 bp, Artificial sequence
  Synthetic oligonucleotide
gaagcagatgtaggtgagtttctgc

SEQ ID NO: 688248 - DNA, 25 bp, Artificial sequence
  Synthetic oligonucleotide
catttgtctacaacgaccaggtcaa

SEQ ID NO: 688249 - DNA, 25 bp, Artificial sequence
  Synthetic oligonucleotide
ctaaatgatcgtatttgcgtagatg

SEQ ID NO: 688250 - DNA, 25 bp, Artificial sequence
  Synthetic oligonucleotide
ctaaatgatcgtttttgcgtagatg

SEQ ID NO: 688251 - DNA, 25 bp, Artificial sequence
  Synthetic oligonucleotide
ttctgatttgaaaatggacctcatg

SEQ ID NO: 688252 - DNA, 25 bp, Artificial sequence
  Synthetic oligonucleotide
ttctgatttgaatatggacctcatg

SEQ ID NO: 688253 - DNA, 25 bp, Artificial sequence
  Synthetic oligonucleotide
tatgattgaggaagaaagttattcc

SEQ ID NO: 688254 - DNA, 25 bp, Artificial sequence
  Synthetic oligonucleotide
tgagtcaagctctctatatttggag

SEQ ID NO: 688255 - DNA, 25 bp, Artificial sequence
  Synthetic oligonucleotide
gtaagtacatattatgctcattgtc

SEQ ID NO: 688256 - DNA, 25 bp, Artificial sequence
  Synthetic oligonucleotide
gccaagcttatcaccgatctcaaca

SEQ ID NO: 688257 - DNA, 25 bp, Artificial sequence
  Synthetic oligonucleotide
tatgttggcatgagttttagaacgg

SEQ ID NO: 688258 - DNA, 25 bp, Artificial sequence
  Synthetic oligonucleotide
tatgttggcatgtgttttagaacgg

SEQ ID NO: 688259 - DNA, 25 bp, Artificial sequence
  Synthetic oligonucleotide
tctgtatgttgtctctcggccctga

SEQ ID NO: 688260 - DNA, 25 bp, Artificial sequence
  Synthetic oligonucleotide
tctgtatgttgtgtctcggccctga

SEQ ID NO: 688261 - DNA, 25 bp, Artificial sequence
  Synthetic oligonucleotide
catttgtctacatcgaccaggtcaa

SEQ ID NO: 688262 - DNA, 25 bp, Artificial sequence
  Synthetic oligonucleotide
tgagtcaagctcactatatttggag

SEQ ID NO: 688263 - DNA, 25 bp, Artificial sequence
  Synthetic oligonucleotide
caatttgagtaaccttgactcacga

SEQ ID NO: 688264 - DNA, 25 bp, Artificial sequence
  Synthetic oligonucleotide
taaagtttagacctttatggatatg

SEQ ID NO: 688265 - DNA, 25 bp, Artificial sequence
  Synthetic oligonucleotide
tcagtaacggaaatcgctagtctcc

SEQ ID NO: 688266 - DNA, 25 bp, Artificial sequence
  Synthetic oligonucleotide
tctcctgaacaagacaagcccaagg

SEQ ID NO: 688267 - DNA, 25 bp, Artificial sequence
  Synthetic oligonucleotide
gaatcacaactctgtgtaagtcgca

SEQ ID NO: 688268 - DNA, 25 bp, Artificial sequence
  Synthetic oligonucleotide
gaatcacaactcagtgtaagtcgca

SEQ ID NO: 688269 - DNA, 25 bp, Artificial sequence
  Synthetic oligonucleotide
tagtgcattcatggcttagataagt

SEQ ID NO: 688270 - DNA, 25 bp, Artificial sequence
  Synthetic oligonucleotide
tagtgcattcatcgcttagataagt

SEQ ID NO: 688271 - DNA, 25 bp, Artificial sequence
  Synthetic oligonucleotide
gattctcaaacaaaccacactccaa

SEQ ID NO: 688272 - DNA, 25 bp, Artificial sequence
  Synthetic oligonucleotide
gattctcaaacataccacactccaa

SEQ ID NO: 688273 - DNA, 25 bp, Artificial sequence
  Synthetic oligonucleotide
gctcgatagtccagacagagagata

SEQ ID NO: 688274 - DNA, 25 bp, Artificial sequence
  Synthetic oligonucleotide
gctcgatagtcctgacagagagata

SEQ ID NO: 688275 - DNA, 25 bp, Artificial sequence
  Synthetic oligonucleotide
taatctaaatcaaatctcaagccac

SEQ ID NO: 688276 - DNA, 25 bp, Artificial sequence
  Synthetic oligonucleotide
gtcacgtcgaagaaagttgctgctt

SEQ ID NO: 688277 - DNA, 25 bp, Artificial sequence
  Synthetic oligonucleotide
caatttgagtaagcttgactcacga

SEQ ID NO: 688278 - DNA, 25 bp, Artificial sequence
  Synthetic oligonucleotide
ctctagggtcctgagtttgcaacca

SEQ ID NO: 688279 - DNA, 25 bp, Artificial sequence
  Synthetic oligonucleotide
taaagatctttgaaactaagctgtg

SEQ ID NO: 688280 - DNA, 25 bp, Artificial sequence
  Synthetic oligonucleotide
taaagatctttgtaactaagctgtg

SEQ ID NO: 688281 - DNA, 25 bp, Artificial sequence
  Synthetic oligonucleotide
tgagctctggttagacagagagaga

SEQ ID NO: 688282 - DNA, 25 bp, Artificial sequence
  Synthetic oligonucleotide
ggtttgctttgcaacaccacaaatg

SEQ ID NO: 688283 - DNA, 25 bp, Artificial sequence
  Synthetic oligonucleotide
accctataggggaaagagtggactg

SEQ ID NO: 688284 - DNA, 25 bp, Artificial sequence
  Synthetic oligonucleotide
tgagctctggtttgacagagagaga

SEQ ID NO: 688285 - DNA, 25 bp, Artificial sequence
  Synthetic oligonucleotide
taataatggaaaacagaaagaaaaa

SEQ ID NO: 688286 - DNA, 25 bp, Artificial sequence
  Synthetic oligonucleotide
taataatggaaatcagaaagaaaaa

SEQ ID NO: 688287 - DNA, 25 bp, Artificial sequence
  Synthetic oligonucleotide
gttgttgtgttcttacatcttcttc

SEQ ID NO: 688288 - DNA, 25 bp, Artificial sequence
  Synthetic oligonucleotide
gttgttgtgttcatacatcttcttc

SEQ ID NO: 688289 - DNA, 25 bp, Artificial sequence
  Synthetic oligonucleotide
gatgagaaataatagggaggttagc

SEQ ID NO: 688290 - DNA, 25 bp, Artificial sequence
  Synthetic oligonucleotide
gatgagaaataaaagggaggttagc

SEQ ID NO: 688291 - DNA, 25 bp, Artificial sequence
  Synthetic oligonucleotide
tcagtaacggaattcgctagtctcc

SEQ ID NO: 688292 - DNA, 25 bp, Artificial sequence
  Synthetic oligonucleotide
taatctaaatcatatctcaagccac

SEQ ID NO: 688293 - DNA, 25 bp, Artificial sequence
  Synthetic oligonucleotide
tagctgtccgcggttggctaaagaa

SEQ ID NO: 688294 - DNA, 25 bp, Artificial sequence
  Synthetic oligonucleotide
tttgcttcgcgctactgaaggcgtt

SEQ ID NO: 688295 - DNA, 25 bp, Artificial sequence
  Synthetic oligonucleotide
tctcctgaacaacacaagcccaagg

SEQ ID NO: 688296 - DNA, 25 bp, Artificial sequence
  Synthetic oligonucleotide
tttgcttcgcgcaactgaaggcgtt

SEQ ID NO: 688297 - DNA, 25 bp, Artificial sequence
  Synthetic oligonucleotide
tgtattttctttcattaccctctcc

SEQ ID NO: 688298 - DNA, 25 bp, Artificial sequence
  Synthetic oligonucleotide
tgtattttctttgattaccctctcc

SEQ ID NO: 688299 - DNA, 25 bp, Artificial sequence
  Synthetic oligonucleotide
tgtctgaactcaattaacagcagta

SEQ ID NO: 688300 - DNA, 25 bp, Artificial sequence
  Synthetic oligonucleotide
tgtctgaactcatttaacagcagta

SEQ ID NO: 688301 - DNA, 25 bp, Artificial sequence
  Synthetic oligonucleotide
ttttcagatgctgtgcctagctggg

SEQ ID NO: 688302 - DNA, 25 bp, Artificial sequence
  Synthetic oligonucleotide
ttttcagatgctctgcctagctggg

SEQ ID NO: 688303 - DNA, 25 bp, Artificial sequence
  Synthetic oligonucleotide
tgttgcatacgagcctgtatgggca

SEQ ID NO: 688304 - DNA, 25 bp, Artificial sequence
  Synthetic oligonucleotide
tgttgcatacgaccctgtatgggca

SEQ ID NO: 688305 - DNA, 25 bp, Artificial sequence
  Synthetic oligonucleotide
taaagttgcatcacctcagcaagca

SEQ ID NO: 688306 - DNA, 25 bp, Artificial sequence
  Synthetic oligonucleotide
gtcacgtcgaagtaagttgctgctt

SEQ ID NO: 688307 - DNA, 25 bp, Artificial sequence
  Synthetic oligonucleotide
tagctgtccgcgcttggctaaagaa

SEQ ID NO: 688308 - DNA, 25 bp, Artificial sequence
  Synthetic oligonucleotide
tctcttgtacttgctcctgatcata

SEQ ID NO: 688309 - DNA, 25 bp, Artificial sequence
  Synthetic oligonucleotide
ggaagttgcttccaaaacgagaatc

SEQ ID NO: 688310 - DNA, 25 bp, Artificial sequence
  Synthetic oligonucleotide
ggaagttgcttcgaaaacgagaatc

SEQ ID NO: 688311 - DNA, 25 bp, Artificial sequence
  Synthetic oligonucleotide
gcgttagattagatatctgtcgcaa

SEQ ID NO: 688312 - DNA, 25 bp, Artificial sequence
  Synthetic oligonucleotide
gcgttagattagttatctgtcgcaa

SEQ ID NO: 688313 - DNA, 25 bp, Artificial sequence
  Synthetic oligonucleotide
gattattgccttctcaattgccagg

SEQ ID NO: 688314 - DNA, 25 bp, Artificial sequence
  Synthetic oligonucleotide
gattattgccttgtcaattgccagg

SEQ ID NO: 688315 - DNA, 25 bp, Artificial sequence
  Synthetic oligonucleotide
gaggcaacagtgcagagcttgccaa

SEQ ID NO: 688316 - DNA, 25 bp, Artificial sequence
  Synthetic oligonucleotide
gaggcaacagtggagagcttgccaa

SEQ ID NO: 688317 - DNA, 25 bp, Artificial sequence
  Synthetic oligonucleotide
tgatggatttctagttggtggtgcc

SEQ ID NO: 688318 - DNA, 25 bp, Artificial sequence
  Synthetic oligonucleotide
tgatggatttcttgttggtggtgcc

SEQ ID NO: 688319 - DNA, 25 bp, Artificial sequence
  Synthetic oligonucleotide
taaagtttagacgtttatggatatg

SEQ ID NO: 688320 - DNA, 25 bp, Artificial sequence
  Synthetic oligonucleotide
tagaagtaaagctgctcacactcac

SEQ ID NO: 688321 - DNA, 25 bp, Artificial sequence
  Synthetic oligonucleotide
ctctagggtcctcagtttgcaacca

SEQ ID NO: 688322 - DNA, 25 bp, Artificial sequence
  Synthetic oligonucleotide
taaagttgcatctcctcagcaagca

SEQ ID NO: 688323 - DNA, 25 bp, Artificial sequence
  Synthetic oligonucleotide
tgaccacagaaaaatttatacctac

SEQ ID NO: 688324 - DNA, 25 bp, Artificial sequence
  Synthetic oligonucleotide
catcgaccattttgggcacctgatc

SEQ ID NO: 688325 - DNA, 25 bp, Artificial sequence
  Synthetic oligonucleotide
aagttggaggaagtgggctgcgacg

SEQ ID NO: 688326 - DNA, 25 bp, Artificial sequence
  Synthetic oligonucleotide
accctataggggtaagagtggactg

SEQ ID NO: 688327 - DNA, 25 bp, Artificial sequence
  Synthetic oligonucleotide
tggtttaaaggaaggattctcaagc

SEQ ID NO: 688328 - DNA, 25 bp, Artificial sequence
  Synthetic oligonucleotide
gcttgggttaataagagacacatgc

SEQ ID NO: 688329 - DNA, 25 bp, Artificial sequence
  Synthetic oligonucleotide
gcttgggttaattagagacacatgc

SEQ ID NO: 688330 - DNA, 25 bp, Artificial sequence
  Synthetic oligonucleotide
caggctgaacagctggatacttagt

SEQ ID NO: 688331 - DNA, 25 bp, Artificial sequence
  Synthetic oligonucleotide
caggctgaacaggtggatacttagt

SEQ ID NO: 688332 - DNA, 25 bp, Artificial sequence
  Synthetic oligonucleotide
gaaagctgaccgcaaagtgatcact

SEQ ID NO: 688333 - DNA, 25 bp, Artificial sequence
  Synthetic oligonucleotide
gccttctccggctagtatagtgact

SEQ ID NO: 688334 - DNA, 25 bp, Artificial sequence
  Synthetic oligonucleotide
gaaagctgaccggaaagtgatcact

SEQ ID NO: 688335 - DNA, 25 bp, Artificial sequence
  Synthetic oligonucleotide
tgaccacagaaatatttatacctac

SEQ ID NO: 688336 - DNA, 25 bp, Artificial sequence
  Synthetic oligonucleotide
taggaatactttaaccaaattatta

SEQ ID NO: 688337 - DNA, 25 bp, Artificial sequence
  Synthetic oligonucleotide
taggaatacttttaccaaattatta

SEQ ID NO: 688338 - DNA, 25 bp, Artificial sequence
  Synthetic oligonucleotide
caatcttagaaaatagtagtactaa

SEQ ID NO: 688339 - DNA, 25 bp, Artificial sequence
  Synthetic oligonucleotide
caatcttagaaattagtagtactaa

SEQ ID NO: 688340 - DNA, 25 bp, Artificial sequence
  Synthetic oligonucleotide
cgtctcgacggaaacagtgttaatg

SEQ ID NO: 688341 - DNA, 25 bp, Artificial sequence
  Synthetic oligonucleotide
cgtctcgacggatacagtgttaatg

SEQ ID NO: 688342 - DNA, 25 bp, Artificial sequence
  Synthetic oligonucleotide
catcgaccatttagggcacctgatc

SEQ ID NO: 688343 - DNA, 25 bp, Artificial sequence
  Synthetic oligonucleotide
gccttctccggcaagtatagtgact

SEQ ID NO: 688344 - DNA, 25 bp, Artificial sequence
  Synthetic oligonucleotide
taataaatgaattacaaagatctct

SEQ ID NO: 688345 - DNA, 25 bp, Artificial sequence
  Synthetic oligonucleotide
tctcttgtacttcctcctgatcata

SEQ ID NO: 688346 - DNA, 25 bp, Artificial sequence
  Synthetic oligonucleotide
gattggtagcttcttatcaaaacag

SEQ ID NO: 688347 - DNA, 25 bp, Artificial sequence
  Synthetic oligonucleotide
gattggtagcttgttatcaaaacag

SEQ ID NO: 688348 - DNA, 25 bp, Artificial sequence
  Synthetic oligonucleotide
taccgtttaaaacatccaatgaaac

SEQ ID NO: 688349 - DNA, 25 bp, Artificial sequence
  Synthetic oligonucleotide
taccgtttaaaagatccaatgaaac

SEQ ID NO: 688350 - DNA, 25 bp, Artificial sequence
  Synthetic oligonucleotide
tgaaatcaatgtatggacaaaaagg

SEQ ID NO: 688351 - DNA, 25 bp, Artificial sequence
  Synthetic oligonucleotide
tgaaatcaatgtttggacaaaaagg

SEQ ID NO: 688352 - DNA, 25 bp, Artificial sequence
  Synthetic oligonucleotide
tggatcattctctcccaaactatgg

SEQ ID NO: 688353 - DNA, 25 bp, Artificial sequence
  Synthetic oligonucleotide
aagttggaggaactgggctgcgacg

SEQ ID NO: 688354 - DNA, 25 bp, Artificial sequence
  Synthetic oligonucleotide
taataaatgaataacaaagatctct

SEQ ID NO: 688355 - DNA, 25 bp, Artificial sequence
  Synthetic oligonucleotide
gagccactttgcctgagctttcaaa

SEQ ID NO: 688356 - DNA, 25 bp, Artificial sequence
  Synthetic oligonucleotide
gagtagtattactattaaccattag

SEQ ID NO: 688357 - DNA, 25 bp, Artificial sequence
  Synthetic oligonucleotide
gagtagtattacaattaaccattag

SEQ ID NO: 688358 - DNA, 25 bp, Artificial sequence
  Synthetic oligonucleotide
tcttgttgcttgtcaattggaatga

SEQ ID NO: 688359 - DNA, 25 bp, Artificial sequence
  Synthetic oligonucleotide
tcttgttgcttgacaattggaatga

SEQ ID NO: 688360 - DNA, 25 bp, Artificial sequence
  Synthetic oligonucleotide
gaaccaaactgttagataaaatgtc

SEQ ID NO: 688361 - DNA, 25 bp, Artificial sequence
  Synthetic oligonucleotide
gaaccaaactgtaagataaaatgtc

SEQ ID NO: 688362 - DNA, 25 bp, Artificial sequence
  Synthetic oligonucleotide
agttcacagaaatgtggccatacgg

SEQ ID NO: 688363 - DNA, 25 bp, Artificial sequence
  Synthetic oligonucleotide
agttcacagaaaagtggccatacgg

SEQ ID NO: 688364 - DNA, 25 bp, Artificial sequence
  Synthetic oligonucleotide
gagccactttgcgtgagctttcaaa

SEQ ID NO: 688365 - DNA, 25 bp, Artificial sequence
  Synthetic oligonucleotide
caactttaaccctcaaactctattg

SEQ ID NO: 688366 - DNA, 25 bp, Artificial sequence
  Synthetic oligonucleotide
tgcccctccttcattctccggtctc

SEQ ID NO: 688367 - DNA, 25 bp, Artificial sequence
  Synthetic oligonucleotide
atttctcccaaggtcgacgctgccg

SEQ ID NO: 688368 - DNA, 25 bp, Artificial sequence
  Synthetic oligonucleotide
atttctcccaagctcgacgctgccg

SEQ ID NO: 688369 - DNA, 25 bp, Artificial sequence
  Synthetic oligonucleotide
caatccttcttccaccgcgtcaatt

SEQ ID NO: 688370 - DNA, 25 bp, Artificial sequence
  Synthetic oligonucleotide
caatccttcttcgaccgcgtcaatt

SEQ ID NO: 688371 - DNA, 25 bp, Artificial sequence
  Synthetic oligonucleotide
tcgtttcttcctgttcttcttctca

SEQ ID NO: 688372 - DNA, 25 bp, Artificial sequence
  Synthetic oligonucleotide
tcgtttcttcctcttcttcttctca

SEQ ID NO: 688373 - DNA, 25 bp, Artificial sequence
  Synthetic oligonucleotide
ccccagaggtgttgttgccatggct

SEQ ID NO: 688374 - DNA, 25 bp, Artificial sequence
  Synthetic oligonucleotide
tgcccctccttctttctccggtctc

SEQ ID NO: 688375 - DNA, 25 bp, Artificial sequence
  Synthetic oligonucleotide
caactttaacccacaaactctattg

SEQ ID NO: 688376 - DNA, 25 bp, Artificial sequence
  Synthetic oligonucleotide
tctcctcagtcttcaattgattcaa

SEQ ID NO: 688377 - DNA, 25 bp, Artificial sequence
  Synthetic oligonucleotide
cattgtttaggaatgagtgtgtgag

SEQ ID NO: 688378 - DNA, 25 bp, Artificial sequence
  Synthetic oligonucleotide
cattgtttaggattgagtgtgtgag

SEQ ID NO: 688379 - DNA, 25 bp, Artificial sequence
  Synthetic oligonucleotide
ccttttacttgcttgattggtatca

SEQ ID NO: 688380 - DNA, 25 bp, Artificial sequence
  Synthetic oligonucleotide
ccttttacttgcatgattggtatca

SEQ ID NO: 688381 - DNA, 25 bp, Artificial sequence
  Synthetic oligonucleotide
cagattctctaaattgtttttggca

SEQ ID NO: 688382 - DNA, 25 bp, Artificial sequence
  Synthetic oligonucleotide
cagattctctaatttgtttttggca

SEQ ID NO: 688383 - DNA, 25 bp, Artificial sequence
  Synthetic oligonucleotide
tctcctcagtctacaattgattcaa

SEQ ID NO: 688384 - DNA, 25 bp, Artificial sequence
  Synthetic oligonucleotide
actacagcgcgtcgcaacgagacgt

SEQ ID NO: 688385 - DNA, 25 bp, Artificial sequence
  Synthetic oligonucleotide
tggatcattctcacccaaactatgg

SEQ ID NO: 688386 - DNA, 25 bp, Artificial sequence
  Synthetic oligonucleotide
ccccagaggtgtagttgccatggct

SEQ ID NO: 688387 - DNA, 25 bp, Artificial sequence
  Synthetic oligonucleotide
gaaagacaaaataaccctcgagagt

SEQ ID NO: 688388 - DNA, 25 bp, Artificial sequence
  Synthetic oligonucleotide
gagaacgaggcttgatgataccatc

SEQ ID NO: 688389 - DNA, 25 bp, Artificial sequence
  Synthetic oligonucleotide
gccaaacccgacgacatggcagcta

SEQ ID NO: 688390 - DNA, 25 bp, Artificial sequence
  Synthetic oligonucleotide
tggtttaaaggatggattctcaagc

SEQ ID NO: 688391 - DNA, 25 bp, Artificial sequence
  Synthetic oligonucleotide
actacagcgcgtggcaacgagacgt

SEQ ID NO: 688392 - DNA, 25 bp, Artificial sequence
  Synthetic oligonucleotide
gaaagacaaaattaccctcgagagt

SEQ ID NO: 688393 - DNA, 25 bp, Artificial sequence
  Synthetic oligonucleotide
ggtttgctttgctacaccacaaatg

SEQ ID NO: 688394 - DNA, 25 bp, Artificial sequence
  Synthetic oligonucleotide
agagcacaaccagcaaccctctcat

SEQ ID NO: 688395 - DNA, 25 bp, Artificial sequence
  Synthetic oligonucleotide
agagcacaaccaccaaccctctcat

SEQ ID NO: 688396 - DNA, 25 bp, Artificial sequence
  Synthetic oligonucleotide
tctgctaccttatgctgagagagtc

SEQ ID NO: 688397 - DNA, 25 bp, Artificial sequence
  Synthetic oligonucleotide
tctgctaccttaagctgagagagtc

SEQ ID NO: 688398 - DNA, 25 bp, Artificial sequence
  Synthetic oligonucleotide
gtctctatctctcctctttgccttt

SEQ ID NO: 688399 - DNA, 25 bp, Artificial sequence
  Synthetic oligonucleotide
gtctctatctctgctctttgccttt

SEQ ID NO: 688400 - DNA, 25 bp, Artificial sequence
  Synthetic oligonucleotide
gccaaacccgaccacatggcagcta

SEQ ID NO: 688401 - DNA, 25 bp, Artificial sequence
  Synthetic oligonucleotide
gagaacgaggctagatgataccatc

SEQ ID NO: 688402 - DNA, 25 bp, Artificial sequence
  Synthetic oligonucleotide
tcatcgagtgatgcctcggtagacc

SEQ ID NO: 688403 - DNA, 25 bp, Artificial sequence
  Synthetic oligonucleotide
tgtatgcccatacaccgaggaggag

SEQ ID NO: 688404 - DNA, 25 bp, Artificial sequence
  Synthetic oligonucleotide
tcttgttctttgttttcccagacga

SEQ ID NO: 688405 - DNA, 25 bp, Artificial sequence
  Synthetic oligonucleotide
ggccaaagtagtaccctgaagataa

SEQ ID NO: 688406 - DNA, 25 bp, Artificial sequence
  Synthetic oligonucleotide
ggccaaagtagttccctgaagataa

SEQ ID NO: 688407 - DNA, 25 bp, Artificial sequence
  Synthetic oligonucleotide
tcaatcagattattcaatcacactg

SEQ ID NO: 688408 - DNA, 25 bp, Artificial sequence
  Synthetic oligonucleotide
tcaatcagattaatcaatcacactg

SEQ ID NO: 688409 - DNA, 25 bp, Artificial sequence
  Synthetic oligonucleotide
caactggaaggagcaaaacagctct

SEQ ID NO: 688410 - DNA, 25 bp, Artificial sequence
  Synthetic oligonucleotide
ggaagagtacaaagagagaagcgaa

SEQ ID NO: 688411 - DNA, 25 bp, Artificial sequence
  Synthetic oligonucleotide
caactggaaggaccaaaacagctct

SEQ ID NO: 688412 - DNA, 25 bp, Artificial sequence
  Synthetic oligonucleotide
tcatcgagtgatccctcggtagacc

SEQ ID NO: 688413 - DNA, 25 bp, Artificial sequence
  Synthetic oligonucleotide
tttggttttctgctaaaagaggaga

SEQ ID NO: 688414 - DNA, 25 bp, Artificial sequence
  Synthetic oligonucleotide
tttggttttctggtaaaagaggaga

SEQ ID NO: 688415 - DNA, 25 bp, Artificial sequence
  Synthetic oligonucleotide
tgtttaactgcacaaatgatgaacc

SEQ ID NO: 688416 - DNA, 25 bp, Artificial sequence
  Synthetic oligonucleotide
ccaatggtttacgttggtgagacgc

SEQ ID NO: 688417 - DNA, 25 bp, Artificial sequence
  Synthetic oligonucleotide
tgtatgcccatagaccgaggaggag

SEQ ID NO: 688418 - DNA, 25 bp, Artificial sequence
  Synthetic oligonucleotide
ggaagagtacaatgagagaagcgaa

SEQ ID NO: 688419 - DNA, 25 bp, Artificial sequence
  Synthetic oligonucleotide
catgaggagaatttttatgacaaga

SEQ ID NO: 688420 - DNA, 25 bp, Artificial sequence
  Synthetic oligonucleotide
ctatttggagagaccaatactttcc

SEQ ID NO: 688421 - DNA, 25 bp, Artificial sequence
  Synthetic oligonucleotide
gttttgatgaacaaaaacattagta

SEQ ID NO: 688422 - DNA, 25 bp, Artificial sequence
  Synthetic oligonucleotide
gttttgatgaactaaaacattagta

SEQ ID NO: 688423 - DNA, 25 bp, Artificial sequence
  Synthetic oligonucleotide
tctactgctaaaaaagttactgatg

SEQ ID NO: 688424 - DNA, 25 bp, Artificial sequence
  Synthetic oligonucleotide
tctactgctaaataagttactgatg

SEQ ID NO: 688425 - DNA, 25 bp, Artificial sequence
  Synthetic oligonucleotide
cgaaaaacagatgtaaaccatttat

SEQ ID NO: 688426 - DNA, 25 bp, Artificial sequence
  Synthetic oligonucleotide
tcttgttctttgatttcccagacga

SEQ ID NO: 688427 - DNA, 25 bp, Artificial sequence
  Synthetic oligonucleotide
catgaggagaatatttatgacaaga

SEQ ID NO: 688428 - DNA, 25 bp, Artificial sequence
  Synthetic oligonucleotide
ccaatggtttaccttggtgagacgc

SEQ ID NO: 688429 - DNA, 25 bp, Artificial sequence
  Synthetic oligonucleotide
tctaaagagtacaatgctggaacaa

SEQ ID NO: 688430 - DNA, 25 bp, Artificial sequence
  Synthetic oligonucleotide
tctaaagagtactatgctggaacaa

SEQ ID NO: 688431 - DNA, 25 bp, Artificial sequence
  Synthetic oligonucleotide
aaaccctaaattacctcaagactga

SEQ ID NO: 688432 - DNA, 25 bp, Artificial sequence
  Synthetic oligonucleotide
aaaccctaaatttcctcaagactga

SEQ ID NO: 688433 - DNA, 25 bp, Artificial sequence
  Synthetic oligonucleotide
ggaaactctttctaaacgccgaagc

SEQ ID NO: 688434 - DNA, 25 bp, Artificial sequence
  Synthetic oligonucleotide
ggaaactctttcaaaacgccgaagc

SEQ ID NO: 688435 - DNA, 25 bp, Artificial sequence
  Synthetic oligonucleotide
cgaaaaacagatctaaaccatttat

SEQ ID NO: 688436 - DNA, 25 bp, Artificial sequence
  Synthetic oligonucleotide
tccgagtgttaaaaggaaaacagat

SEQ ID NO: 688437 - DNA, 25 bp, Artificial sequence
  Synthetic oligonucleotide
gagaagacctccagattcaactacc

SEQ ID NO: 688438 - DNA, 25 bp, Artificial sequence
  Synthetic oligonucleotide
gagaagacctcctgattcaactacc

SEQ ID NO: 688439 - DNA, 25 bp, Artificial sequence
  Synthetic oligonucleotide
tccgagtgttaataggaaaacagat

SEQ ID NO: 688440 - DNA, 25 bp, Artificial sequence
  Synthetic oligonucleotide
ctatttggagagtccaatactttcc

SEQ ID NO: 688441 - DNA, 25 bp, Artificial sequence
  Synthetic oligonucleotide
tgtttaactgcagaaatgatgaacc

SEQ ID NO: 688442 - DNA, 25 bp, Artificial sequence
  Synthetic oligonucleotide
caggcaacagttttccagaagacca

SEQ ID NO: 688443 - DNA, 25 bp, Artificial sequence
  Synthetic oligonucleotide
cagttatccagatgaccagaggaaa

SEQ ID NO: 688444 - DNA, 25 bp, Artificial sequence
  Synthetic oligonucleotide
aatgtaggcagggaacagttatcca

SEQ ID NO: 688445 - DNA, 25 bp, Artificial sequence
  Synthetic oligonucleotide
aatgtaggcaggcaacagttatcca

SEQ ID NO: 688446 - DNA, 25 bp, Artificial sequence
  Synthetic oligonucleotide
gtaggcaggcaagagttatccagaa

SEQ ID NO: 688447 - DNA, 25 bp, Artificial sequence
  Synthetic oligonucleotide
gtaggcaggcaacagttatccagaa

SEQ ID NO: 688448 - DNA, 25 bp, Artificial sequence
  Synthetic oligonucleotide
taggcaggcaactgttatccagaag

SEQ ID NO: 688449 - DNA, 25 bp, Artificial sequence
  Synthetic oligonucleotide
taggcaggcaacagttatccagaag

SEQ ID NO: 688450 - DNA, 25 bp, Artificial sequence
  Synthetic oligonucleotide
aggcaggcaacacttatccagaaga

SEQ ID NO: 688451 - DNA, 25 bp, Artificial sequence
  Synthetic oligonucleotide
aggcaggcaacagttatccagaaga

SEQ ID NO: 688452 - DNA, 25 bp, Artificial sequence
  Synthetic oligonucleotide
ggcaggcaacagatatccagaagac

SEQ ID NO: 688453 - DNA, 25 bp, Artificial sequence
  Synthetic oligonucleotide
ggcaggcaacagttatccagaagac

SEQ ID NO: 688454 - DNA, 25 bp, Artificial sequence
  Synthetic oligonucleotide
gcaggcaacagttatccagaagacc

SEQ ID NO: 688455 - DNA, 25 bp, Artificial sequence
  Synthetic oligonucleotide
ttaatgtaggcaggcaacagttatc

SEQ ID NO: 688456 - DNA, 25 bp, Artificial sequence
  Synthetic oligonucleotide
caggcaacagttatccagaagacca

SEQ ID NO: 688457 - DNA, 25 bp, Artificial sequence
  Synthetic oligonucleotide
attaatgtaggcaggcaacagttat

SEQ ID NO: 688458 - DNA, 25 bp, Artificial sequence
  Synthetic oligonucleotide
aggcaacagttaaccagaagaccag

SEQ ID NO: 688459 - DNA, 25 bp, Artificial sequence
  Synthetic oligonucleotide
aggcaacagttatccagaagaccag

SEQ ID NO: 688460 - DNA, 25 bp, Artificial sequence
  Synthetic oligonucleotide
ggcaacagttatccagaagaccaga

SEQ ID NO: 688461 - DNA, 25 bp, Artificial sequence
  Synthetic oligonucleotide
ggcaacagttatgcagaagaccaga

SEQ ID NO: 688462 - DNA, 25 bp, Artificial sequence
  Synthetic oligonucleotide
gcaacagttatccagaagaccagag

SEQ ID NO: 688463 - DNA, 25 bp, Artificial sequence
  Synthetic oligonucleotide
gcaacagttatcgagaagaccagag

SEQ ID NO: 688464 - DNA, 25 bp, Artificial sequence
  Synthetic oligonucleotide
caacagttatccagaagaccagagg

SEQ ID NO: 688465 - DNA, 25 bp, Artificial sequence
  Synthetic oligonucleotide
caacagttatcctgaagaccagagg

SEQ ID NO: 688466 - DNA, 25 bp, Artificial sequence
  Synthetic oligonucleotide
aacagttatccagaagaccagagga

SEQ ID NO: 688467 - DNA, 25 bp, Artificial sequence
  Synthetic oligonucleotide
aacagttatccacaagaccagagga

SEQ ID NO: 688468 - DNA, 25 bp, Artificial sequence
  Synthetic oligonucleotide
acagttatccagtagaccagaggaa

SEQ ID NO: 688469 - DNA, 25 bp, Artificial sequence
  Synthetic oligonucleotide
acagttatccagaagaccagaggaa

SEQ ID NO: 688470 - DNA, 25 bp, Artificial sequence
  Synthetic oligonucleotide
cagttatccagaagaccagaggaaa

SEQ ID NO: 688471 - DNA, 25 bp, Artificial sequence
  Synthetic oligonucleotide
gcaggcaacagtaatccagaagacc

SEQ ID NO: 688472 - DNA, 25 bp, Artificial sequence
  Synthetic oligonucleotide
gacagaaattaaagtaggcaggcaa

SEQ ID NO: 688473 - DNA, 25 bp, Artificial sequence
  Synthetic oligonucleotide
agttgaggagacagaaattaatgta

SEQ ID NO: 688474 - DNA, 25 bp, Artificial sequence
  Synthetic oligonucleotide
gttgaggagacagaaattaatgtag

SEQ ID NO: 688475 - DNA, 25 bp, Artificial sequence
  Synthetic oligonucleotide
gttgaggagacacaaattaatgtag

SEQ ID NO: 688476 - DNA, 25 bp, Artificial sequence
  Synthetic oligonucleotide
ttgaggagacagtaattaatgtagg

SEQ ID NO: 688477 - DNA, 25 bp, Artificial sequence
  Synthetic oligonucleotide
ttgaggagacagaaattaatgtagg

SEQ ID NO: 688478 - DNA, 25 bp, Artificial sequence
  Synthetic oligonucleotide
tgaggagacagaaattaatgtaggc

SEQ ID NO: 688479 - DNA, 25 bp, Artificial sequence
  Synthetic oligonucleotide
tgaggagacagatattaatgtaggc

SEQ ID NO: 688480 - DNA, 25 bp, Artificial sequence
  Synthetic oligonucleotide
gaggagacagaaattaatgtaggca

SEQ ID NO: 688481 - DNA, 25 bp, Artificial sequence
  Synthetic oligonucleotide
gaggagacagaatttaatgtaggca

SEQ ID NO: 688482 - DNA, 25 bp, Artificial sequence
  Synthetic oligonucleotide
aggagacagaaattaatgtaggcag

SEQ ID NO: 688483 - DNA, 25 bp, Artificial sequence
  Synthetic oligonucleotide
aggagacagaaaataatgtaggcag

SEQ ID NO: 688484 - DNA, 25 bp, Artificial sequence
  Synthetic oligonucleotide
ggagacagaaataaatgtaggcagg

SEQ ID NO: 688485 - DNA, 25 bp, Artificial sequence
  Synthetic oligonucleotide
ttaatgtaggcacgcaacagttatc

SEQ ID NO: 688486 - DNA, 25 bp, Artificial sequence
  Synthetic oligonucleotide
gacagaaattaatgtaggcaggcaa

SEQ ID NO: 688487 - DNA, 25 bp, Artificial sequence
  Synthetic oligonucleotide
agttgaggagactgaaattaatgta

SEQ ID NO: 688488 - DNA, 25 bp, Artificial sequence
  Synthetic oligonucleotide
acagaaattaatctaggcaggcaac

SEQ ID NO: 688489 - DNA, 25 bp, Artificial sequence
  Synthetic oligonucleotide
acagaaattaatgtaggcaggcaac

SEQ ID NO: 688490 - DNA, 25 bp, Artificial sequence
  Synthetic oligonucleotide
cagaaattaatgaaggcaggcaaca

SEQ ID NO: 688491 - DNA, 25 bp, Artificial sequence
  Synthetic oligonucleotide
cagaaattaatgtaggcaggcaaca

SEQ ID NO: 688492 - DNA, 25 bp, Artificial sequence
  Synthetic oligonucleotide
agaaattaatgtaggcaggcaacag

SEQ ID NO: 688493 - DNA, 25 bp, Artificial sequence
  Synthetic oligonucleotide
agaaattaatgttggcaggcaacag

SEQ ID NO: 688494 - DNA, 25 bp, Artificial sequence
  Synthetic oligonucleotide
gaaattaatgtacgcaggcaacagt

SEQ ID NO: 688495 - DNA, 25 bp, Artificial sequence
  Synthetic oligonucleotide
gaaattaatgtaggcaggcaacagt

SEQ ID NO: 688496 - DNA, 25 bp, Artificial sequence
  Synthetic oligonucleotide
aaattaatgtagccaggcaacagtt

SEQ ID NO: 688497 - DNA, 25 bp, Artificial sequence
  Synthetic oligonucleotide
aaattaatgtaggcaggcaacagtt

SEQ ID NO: 688498 - DNA, 25 bp, Artificial sequence
  Synthetic oligonucleotide
aattaatgtagggaggcaacagtta

SEQ ID NO: 688499 - DNA, 25 bp, Artificial sequence
  Synthetic oligonucleotide
aattaatgtaggcaggcaacagtta

SEQ ID NO: 688500 - DNA, 25 bp, Artificial sequence
  Synthetic oligonucleotide
attaatgtaggctggcaacagttat

SEQ ID NO: 688501 - DNA, 25 bp, Artificial sequence
  Synthetic oligonucleotide
ggagacagaaattaatgtaggcagg

SEQ ID NO: 688502 - DNA, 25 bp, Artificial sequence
  Synthetic oligonucleotide
gacagaaattaatgtaggcaggcaa

SEQ ID NO: 688503 - DNA, 25 bp, Artificial sequence
  Synthetic oligonucleotide
attaatgtaggcaggcaacagttat

SEQ ID NO: 688504 - DNA, 25 bp, Artificial sequence
  Synthetic oligonucleotide
aattaatgtagggaggcaacagtta

SEQ ID NO: 688505 - DNA, 25 bp, Artificial sequence
  Synthetic oligonucleotide
aattaatgtaggcaggcaacagtta

SEQ ID NO: 688506 - DNA, 25 bp, Artificial sequence
  Synthetic oligonucleotide
aaattaatgtagccaggcaacagtt

SEQ ID NO: 688507 - DNA, 25 bp, Artificial sequence
  Synthetic oligonucleotide
aaattaatgtaggcaggcaacagtt

SEQ ID NO: 688508 - DNA, 25 bp, Artificial sequence
  Synthetic oligonucleotide
gaaattaatgtacgcaggcaacagt

SEQ ID NO: 688509 - DNA, 25 bp, Artificial sequence
  Synthetic oligonucleotide
gaaattaatgtaggcaggcaacagt

SEQ ID NO: 688510 - DNA, 25 bp, Artificial sequence
  Synthetic oligonucleotide
agaaattaatgttggcaggcaacag

SEQ ID NO: 688511 - DNA, 25 bp, Artificial sequence
  Synthetic oligonucleotide
agaaattaatgtaggcaggcaacag

SEQ ID NO: 688512 - DNA, 25 bp, Artificial sequence
  Synthetic oligonucleotide
cagaaattaatgaaggcaggcaaca

SEQ ID NO: 688513 - DNA, 25 bp, Artificial sequence
  Synthetic oligonucleotide
cagaaattaatgtaggcaggcaaca

SEQ ID NO: 688514 - DNA, 25 bp, Artificial sequence
  Synthetic oligonucleotide
acagaaattaatctaggcaggcaac

SEQ ID NO: 688515 - DNA, 25 bp, Artificial sequence
  Synthetic oligonucleotide
agttgaggagacagaaattaatgta

SEQ ID NO: 688516 - DNA, 25 bp, Artificial sequence
  Synthetic oligonucleotide
gacagaaattaaagtaggcaggcaa

SEQ ID NO: 688517 - DNA, 25 bp, Artificial sequence
  Synthetic oligonucleotide
aatgtaggcaggcaacagttatcca

SEQ ID NO: 688518 - DNA, 25 bp, Artificial sequence
  Synthetic oligonucleotide
ggagacagaaataaatgtaggcagg

SEQ ID NO: 688519 - DNA, 25 bp, Artificial sequence
  Synthetic oligonucleotide
ggagacagaaattaatgtaggcagg

SEQ ID NO: 688520 - DNA, 25 bp, Artificial sequence
  Synthetic oligonucleotide
aggagacagaaaataatgtaggcag

SEQ ID NO: 688521 - DNA, 25 bp, Artificial sequence
  Synthetic oligonucleotide
aggagacagaaattaatgtaggcag

SEQ ID NO: 688522 - DNA, 25 bp, Artificial sequence
  Synthetic oligonucleotide
gaggagacagaatttaatgtaggca

SEQ ID NO: 688523 - DNA, 25 bp, Artificial sequence
  Synthetic oligonucleotide
gaggagacagaaattaatgtaggca

SEQ ID NO: 688524 - DNA, 25 bp, Artificial sequence
  Synthetic oligonucleotide
tgaggagacagatattaatgtaggc

SEQ ID NO: 688525 - DNA, 25 bp, Artificial sequence
  Synthetic oligonucleotide
tgaggagacagaaattaatgtaggc

SEQ ID NO: 688526 - DNA, 25 bp, Artificial sequence
  Synthetic oligonucleotide
ttgaggagacagaaattaatgtagg

SEQ ID NO: 688527 - DNA, 25 bp, Artificial sequence
  Synthetic oligonucleotide
ttgaggagacagtaattaatgtagg

SEQ ID NO: 688528 - DNA, 25 bp, Artificial sequence
  Synthetic oligonucleotide
gttgaggagacagaaattaatgtag

SEQ ID NO: 688529 - DNA, 25 bp, Artificial sequence
  Synthetic oligonucleotide
gttgaggagacacaaattaatgtag

SEQ ID NO: 688530 - DNA, 25 bp, Artificial sequence
  Synthetic oligonucleotide
acagaaattaatgtaggcaggcaac

SEQ ID NO: 688531 - DNA, 25 bp, Artificial sequence
  Synthetic oligonucleotide
caggcaacagttttccagaagacca

SEQ ID NO: 688532 - DNA, 25 bp, Artificial sequence
  Synthetic oligonucleotide
cagttatccagaagaccagaggaaa

SEQ ID NO: 688533 - DNA, 25 bp, Artificial sequence
  Synthetic oligonucleotide
cagttatccagatgaccagaggaaa

SEQ ID NO: 688534 - DNA, 25 bp, Artificial sequence
  Synthetic oligonucleotide
acagttatccagaagaccagaggaa

SEQ ID NO: 688535 - DNA, 25 bp, Artificial sequence
  Synthetic oligonucleotide
acagttatccagtagaccagaggaa

SEQ ID NO: 688536 - DNA, 25 bp, Artificial sequence
  Synthetic oligonucleotide
aacagttatccagaagaccagagga

SEQ ID NO: 688537 - DNA, 25 bp, Artificial sequence
  Synthetic oligonucleotide
aacagttatccacaagaccagagga

SEQ ID NO: 688538 - DNA, 25 bp, Artificial sequence
  Synthetic oligonucleotide
caacagttatccagaagaccagagg

SEQ ID NO: 688539 - DNA, 25 bp, Artificial sequence
  Synthetic oligonucleotide
caacagttatcctgaagaccagagg

SEQ ID NO: 688540 - DNA, 25 bp, Artificial sequence
  Synthetic oligonucleotide
gcaacagttatcgagaagaccagag

SEQ ID NO: 688541 - DNA, 25 bp, Artificial sequence
  Synthetic oligonucleotide
gcaacagttatccagaagaccagag

SEQ ID NO: 688542 - DNA, 25 bp, Artificial sequence
  Synthetic oligonucleotide
ggcaacagttatgcagaagaccaga

SEQ ID NO: 688543 - DNA, 25 bp, Artificial sequence
  Synthetic oligonucleotide
ggcaacagttatccagaagaccaga

SEQ ID NO: 688544 - DNA, 25 bp, Artificial sequence
  Synthetic oligonucleotide
agttgaggagactgaaattaatgta

SEQ ID NO: 688545 - DNA, 25 bp, Artificial sequence
  Synthetic oligonucleotide
aggcaacagttatccagaagaccag

SEQ ID NO: 688546 - DNA, 25 bp, Artificial sequence
  Synthetic oligonucleotide
ttaatgtaggcaggcaacagttatc

SEQ ID NO: 688547 - DNA, 25 bp, Artificial sequence
  Synthetic oligonucleotide
caggcaacagttatccagaagacca

SEQ ID NO: 688548 - DNA, 25 bp, Artificial sequence
  Synthetic oligonucleotide
gcaggcaacagtaatccagaagacc

SEQ ID NO: 688549 - DNA, 25 bp, Artificial sequence
  Synthetic oligonucleotide
gcaggcaacagttatccagaagacc

SEQ ID NO: 688550 - DNA, 25 bp, Artificial sequence
  Synthetic oligonucleotide
ggcaggcaacagttatccagaagac

SEQ ID NO: 688551 - DNA, 25 bp, Artificial sequence
  Synthetic oligonucleotide
ggcaggcaacagatatccagaagac

SEQ ID NO: 688552 - DNA, 25 bp, Artificial sequence
  Synthetic oligonucleotide
aggcaggcaacagttatccagaaga

SEQ ID NO: 688553 - DNA, 25 bp, Artificial sequence
  Synthetic oligonucleotide
aggcaggcaacacttatccagaaga

SEQ ID NO: 688554 - DNA, 25 bp, Artificial sequence
  Synthetic oligonucleotide
taggcaggcaacagttatccagaag

SEQ ID NO: 688555 - DNA, 25 bp, Artificial sequence
  Synthetic oligonucleotide
taggcaggcaactgttatccagaag

SEQ ID NO: 688556 - DNA, 25 bp, Artificial sequence
  Synthetic oligonucleotide
gtaggcaggcaacagttatccagaa

SEQ ID NO: 688557 - DNA, 25 bp, Artificial sequence
  Synthetic oligonucleotide
gtaggcaggcaagagttatccagaa

SEQ ID NO: 688558 - DNA, 25 bp, Artificial sequence
  Synthetic oligonucleotide
aatgtaggcagggaacagttatcca

SEQ ID NO: 688559 - DNA, 25 bp, Artificial sequence
  Synthetic oligonucleotide
attaatgtaggctggcaacagttat

SEQ ID NO: 688560 - DNA, 25 bp, Artificial sequence
  Synthetic oligonucleotide
aggcaacagttaaccagaagaccag

SEQ ID NO: 688561 - DNA, 25 bp, Artificial sequence
  Synthetic oligonucleotide
ttaatgtaggcacgcaacagttatc

SEQ ID NO: 688562 - DNA, 25 bp, Artificial sequence
  Synthetic oligonucleotide
atacttgctgtaaagggaagcacca

SEQ ID NO: 688563 - DNA, 25 bp, Artificial sequence
  Synthetic oligonucleotide
ctgaatacttgcagtatagggaagc

SEQ ID NO: 688564 - DNA, 25 bp, Artificial sequence
  Synthetic oligonucleotide
ctgaatacttgctgtatagggaagc

SEQ ID NO: 688565 - DNA, 25 bp, Artificial sequence
  Synthetic oligonucleotide
tgaatacttgctctatagggaagca

SEQ ID NO: 688566 - DNA, 25 bp, Artificial sequence
  Synthetic oligonucleotide
gaatacttgctgaatagggaagcac

SEQ ID NO: 688567 - DNA, 25 bp, Artificial sequence
  Synthetic oligonucleotide
aatacttgctgtttagggaagcacc

SEQ ID NO: 688568 - DNA, 25 bp, Artificial sequence
  Synthetic oligonucleotide
tgctgtatagggtagcaccagccac

SEQ ID NO: 688569 - DNA, 25 bp, Artificial sequence
  Synthetic oligonucleotide
atacttgctgtatagggaagcacca

SEQ ID NO: 688570 - DNA, 25 bp, Artificial sequence
  Synthetic oligonucleotide
cactgaatacttcctgtatagggaa

SEQ ID NO: 688571 - DNA, 25 bp, Artificial sequence
  Synthetic oligonucleotide
acttgctgtatagggaagcaccagc

SEQ ID NO: 688572 - DNA, 25 bp, Artificial sequence
  Synthetic oligonucleotide
acttgctgtatacggaagcaccagc

SEQ ID NO: 688573 - DNA, 25 bp, Artificial sequence
  Synthetic oligonucleotide
cttgctgtatagggaagcaccagcc

SEQ ID NO: 688574 - DNA, 25 bp, Artificial sequence
  Synthetic oligonucleotide
cttgctgtatagcgaagcaccagcc

SEQ ID NO: 688575 - DNA, 25 bp, Artificial sequence
  Synthetic oligonucleotide
tgctgtatagggaagcaccagccac

SEQ ID NO: 688576 - DNA, 25 bp, Artificial sequence
  Synthetic oligonucleotide
aatacttgctgtatagggaagcacc

SEQ ID NO: 688577 - DNA, 25 bp, Artificial sequence
  Synthetic oligonucleotide
actgaatacttggtgtatagggaag

SEQ ID NO: 688578 - DNA, 25 bp, Artificial sequence
  Synthetic oligonucleotide
gaatacttgctgtatagggaagcac

SEQ ID NO: 688579 - DNA, 25 bp, Artificial sequence
  Synthetic oligonucleotide
cactgaatacttgctgtatagggaa

SEQ ID NO: 688580 - DNA, 25 bp, Artificial sequence
  Synthetic oligonucleotide
acactgaatacttgctgtataggga

SEQ ID NO: 688581 - DNA, 25 bp, Artificial sequence
  Synthetic oligonucleotide
acactgaatactagctgtataggga

SEQ ID NO: 688582 - DNA, 25 bp, Artificial sequence
  Synthetic oligonucleotide
gacactgaatacatgctgtataggg

SEQ ID NO: 688583 - DNA, 25 bp, Artificial sequence
  Synthetic oligonucleotide
gacactgaatacttgctgtataggg

SEQ ID NO: 688584 - DNA, 25 bp, Artificial sequence
  Synthetic oligonucleotide
ggacactgaatagttgctgtatagg

SEQ ID NO: 688585 - DNA, 25 bp, Artificial sequence
  Synthetic oligonucleotide
ggacactgaatacttgctgtatagg

SEQ ID NO: 688586 - DNA, 25 bp, Artificial sequence
  Synthetic oligonucleotide
aggacactgaatacttgctgtatag

SEQ ID NO: 688587 - DNA, 25 bp, Artificial sequence
  Synthetic oligonucleotide
aggacactgaattcttgctgtatag

SEQ ID NO: 688588 - DNA, 25 bp, Artificial sequence
  Synthetic oligonucleotide
caggacactgaaaacttgctgtata

SEQ ID NO: 688589 - DNA, 25 bp, Artificial sequence
  Synthetic oligonucleotide
caggacactgaatacttgctgtata

SEQ ID NO: 688590 - DNA, 25 bp, Artificial sequence
  Synthetic oligonucleotide
accagccacagtcaggaatgtccac

SEQ ID NO: 688591 - DNA, 25 bp, Artificial sequence
  Synthetic oligonucleotide
actgaatacttgctgtatagggaag

SEQ ID NO: 688592 - DNA, 25 bp, Artificial sequence
  Synthetic oligonucleotide
gcaccagccacactgaggaatgtcc

SEQ ID NO: 688593 - DNA, 25 bp, Artificial sequence
  Synthetic oligonucleotide
agggaagcaccagccacagtgagga

SEQ ID NO: 688594 - DNA, 25 bp, Artificial sequence
  Synthetic oligonucleotide
gggaagcaccagccacagtgaggaa

SEQ ID NO: 688595 - DNA, 25 bp, Artificial sequence
  Synthetic oligonucleotide
gggaagcaccaggcacagtgaggaa

SEQ ID NO: 688596 - DNA, 25 bp, Artificial sequence
  Synthetic oligonucleotide
accagccacagtgaggaatgtccac

SEQ ID NO: 688597 - DNA, 25 bp, Artificial sequence
  Synthetic oligonucleotide
caccagccacagagaggaatgtcca

SEQ ID NO: 688598 - DNA, 25 bp, Artificial sequence
  Synthetic oligonucleotide
agggaagcaccacccacagtgagga

SEQ ID NO: 688599 - DNA, 25 bp, Artificial sequence
  Synthetic oligonucleotide
gcaccagccacagtgaggaatgtcc

SEQ ID NO: 688600 - DNA, 25 bp, Artificial sequence
  Synthetic oligonucleotide
aagcaccagccagagtgaggaatgt

SEQ ID NO: 688601 - DNA, 25 bp, Artificial sequence
  Synthetic oligonucleotide
aagcaccagccacagtgaggaatgt

SEQ ID NO: 688602 - DNA, 25 bp, Artificial sequence
  Synthetic oligonucleotide
gctgtatagggaagcaccagccaca

SEQ ID NO: 688603 - DNA, 25 bp, Artificial sequence
  Synthetic oligonucleotide
gaagcaccagcctcagtgaggaatg

SEQ ID NO: 688604 - DNA, 25 bp, Artificial sequence
  Synthetic oligonucleotide
tgaatacttgctgtatagggaagca

SEQ ID NO: 688605 - DNA, 25 bp, Artificial sequence
  Synthetic oligonucleotide
ggaagcaccagcgacagtgaggaat

SEQ ID NO: 688606 - DNA, 25 bp, Artificial sequence
  Synthetic oligonucleotide
ggaagcaccagccacagtgaggaat

SEQ ID NO: 688607 - DNA, 25 bp, Artificial sequence
  Synthetic oligonucleotide
caccagccacagtgaggaatgtcca

SEQ ID NO: 688608 - DNA, 25 bp, Artificial sequence
  Synthetic oligonucleotide
ctgtatagggaaccaccagccacag

SEQ ID NO: 688609 - DNA, 25 bp, Artificial sequence
  Synthetic oligonucleotide
gaagcaccagccacagtgaggaatg

SEQ ID NO: 688610 - DNA, 25 bp, Artificial sequence
  Synthetic oligonucleotide
tagggaagcaccagccacagtgagg

SEQ ID NO: 688611 - DNA, 25 bp, Artificial sequence
  Synthetic oligonucleotide
ctgtatagggaagcaccagccacag

SEQ ID NO: 688612 - DNA, 25 bp, Artificial sequence
  Synthetic oligonucleotide
tgtatagggaaggaccagccacagt

SEQ ID NO: 688613 - DNA, 25 bp, Artificial sequence
  Synthetic oligonucleotide
tgtatagggaagcaccagccacagt

SEQ ID NO: 688614 - DNA, 25 bp, Artificial sequence
  Synthetic oligonucleotide
gtatagggaagctccagccacagtg

SEQ ID NO: 688615 - DNA, 25 bp, Artificial sequence
  Synthetic oligonucleotide
gtatagggaagcaccagccacagtg

SEQ ID NO: 688616 - DNA, 25 bp, Artificial sequence
  Synthetic oligonucleotide
atagggaagcaccagccacagtgag

SEQ ID NO: 688617 - DNA, 25 bp, Artificial sequence
  Synthetic oligonucleotide
tatagggaagcagcagccacagtga

SEQ ID NO: 688618 - DNA, 25 bp, Artificial sequence
  Synthetic oligonucleotide
atagggaagcacgagccacagtgag

SEQ ID NO: 688619 - DNA, 25 bp, Artificial sequence
  Synthetic oligonucleotide
tagggaagcacctgccacagtgagg

SEQ ID NO: 688620 - DNA, 25 bp, Artificial sequence
  Synthetic oligonucleotide
tatagggaagcaccagccacagtga

SEQ ID NO: 688621 - DNA, 25 bp, Artificial sequence
  Synthetic oligonucleotide
gctgtatagggatgcaccagccaca

SEQ ID NO: 688622 - DNA, 25 bp, Artificial sequence
  Synthetic oligonucleotide
actgaatacttggtgtatagggaag

SEQ ID NO: 688623 - DNA, 25 bp, Artificial sequence
  Synthetic oligonucleotide
ctgaatacttgcagtatagggaagc

SEQ ID NO: 688624 - DNA, 25 bp, Artificial sequence
  Synthetic oligonucleotide
ctgaatacttgctgtatagggaagc

SEQ ID NO: 688625 - DNA, 25 bp, Artificial sequence
  Synthetic oligonucleotide
tgaatacttgctgtatagggaagca

SEQ ID NO: 688626 - DNA, 25 bp, Artificial sequence
  Synthetic oligonucleotide
tgaatacttgctctatagggaagca

SEQ ID NO: 688627 - DNA, 25 bp, Artificial sequence
  Synthetic oligonucleotide
gaatacttgctgaatagggaagcac

SEQ ID NO: 688628 - DNA, 25 bp, Artificial sequence
  Synthetic oligonucleotide
aatacttgctgtttagggaagcacc

SEQ ID NO: 688629 - DNA, 25 bp, Artificial sequence
  Synthetic oligonucleotide
actgaatacttgctgtatagggaag

SEQ ID NO: 688630 - DNA, 25 bp, Artificial sequence
  Synthetic oligonucleotide
atacttgctgtaaagggaagcacca

SEQ ID NO: 688631 - DNA, 25 bp, Artificial sequence
  Synthetic oligonucleotide
ggacactgaatagttgctgtatagg

SEQ ID NO: 688632 - DNA, 25 bp, Artificial sequence
  Synthetic oligonucleotide
aatacttgctgtatagggaagcacc

SEQ ID NO: 688633 - DNA, 25 bp, Artificial sequence
  Synthetic oligonucleotide
gaatacttgctgtatagggaagcac

SEQ ID NO: 688634 - DNA, 25 bp, Artificial sequence
  Synthetic oligonucleotide
cactgaatacttgctgtatagggaa

SEQ ID NO: 688635 - DNA, 25 bp, Artificial sequence
  Synthetic oligonucleotide
cactgaatacttcctgtatagggaa

SEQ ID NO: 688636 - DNA, 25 bp, Artificial sequence
  Synthetic oligonucleotide
acactgaatactagctgtataggga

SEQ ID NO: 688637 - DNA, 25 bp, Artificial sequence
  Synthetic oligonucleotide
acactgaatacttgctgtataggga

SEQ ID NO: 688638 - DNA, 25 bp, Artificial sequence
  Synthetic oligonucleotide
gacactgaatacatgctgtataggg

SEQ ID NO: 688639 - DNA, 25 bp, Artificial sequence
  Synthetic oligonucleotide
ggacactgaatacttgctgtatagg

SEQ ID NO: 688640 - DNA, 25 bp, Artificial sequence
  Synthetic oligonucleotide
aggacactgaatacttgctgtatag

SEQ ID NO: 688641 - DNA, 25 bp, Artificial sequence
  Synthetic oligonucleotide
aggacactgaattcttgctgtatag

SEQ ID NO: 688642 - DNA, 25 bp, Artificial sequence
  Synthetic oligonucleotide
caggacactgaaaacttgctgtata

SEQ ID NO: 688643 - DNA, 25 bp, Artificial sequence
  Synthetic oligonucleotide
agggaagcaccacccacagtgagga

SEQ ID NO: 688644 - DNA, 25 bp, Artificial sequence
  Synthetic oligonucleotide
atacttgctgtatagggaagcacca

SEQ ID NO: 688645 - DNA, 25 bp, Artificial sequence
  Synthetic oligonucleotide
gacactgaatacttgctgtataggg

SEQ ID NO: 688646 - DNA, 25 bp, Artificial sequence
  Synthetic oligonucleotide
aagcaccagccacagtgaggaatgt

SEQ ID NO: 688647 - DNA, 25 bp, Artificial sequence
  Synthetic oligonucleotide
caggacactgaatacttgctgtata

SEQ ID NO: 688648 - DNA, 25 bp, Artificial sequence
  Synthetic oligonucleotide
agggaagcaccagccacagtgagga

SEQ ID NO: 688649 - DNA, 25 bp, Artificial sequence
  Synthetic oligonucleotide
acttgctgtatagggaagcaccagc

SEQ ID NO: 688650 - DNA, 25 bp, Artificial sequence
  Synthetic oligonucleotide
gggaagcaccaggcacagtgaggaa

SEQ ID NO: 688651 - DNA, 25 bp, Artificial sequence
  Synthetic oligonucleotide
tagggaagcaccagccacagtgagg

SEQ ID NO: 688652 - DNA, 25 bp, Artificial sequence
  Synthetic oligonucleotide
ggaagcaccagcgacagtgaggaat

SEQ ID NO: 688653 - DNA, 25 bp, Artificial sequence
  Synthetic oligonucleotide
tagggaagcacctgccacagtgagg

SEQ ID NO: 688654 - DNA, 25 bp, Artificial sequence
  Synthetic oligonucleotide
gaagcaccagcctcagtgaggaatg

SEQ ID NO: 688655 - DNA, 25 bp, Artificial sequence
  Synthetic oligonucleotide
gggaagcaccagccacagtgaggaa

SEQ ID NO: 688656 - DNA, 25 bp, Artificial sequence
  Synthetic oligonucleotide
aagcaccagccagagtgaggaatgt

SEQ ID NO: 688657 - DNA, 25 bp, Artificial sequence
  Synthetic oligonucleotide
gcaccagccacactgaggaatgtcc

SEQ ID NO: 688658 - DNA, 25 bp, Artificial sequence
  Synthetic oligonucleotide
gcaccagccacagtgaggaatgtcc

SEQ ID NO: 688659 - DNA, 25 bp, Artificial sequence
  Synthetic oligonucleotide
caccagccacagtgaggaatgtcca

SEQ ID NO: 688660 - DNA, 25 bp, Artificial sequence
  Synthetic oligonucleotide
caccagccacagagaggaatgtcca

SEQ ID NO: 688661 - DNA, 25 bp, Artificial sequence
  Synthetic oligonucleotide
accagccacagtcaggaatgtccac

SEQ ID NO: 688662 - DNA, 25 bp, Artificial sequence
  Synthetic oligonucleotide
accagccacagtgaggaatgtccac

SEQ ID NO: 688663 - DNA, 25 bp, Artificial sequence
  Synthetic oligonucleotide
gaagcaccagccacagtgaggaatg

SEQ ID NO: 688664 - DNA, 25 bp, Artificial sequence
  Synthetic oligonucleotide
tgctgtatagggaagcaccagccac

SEQ ID NO: 688665 - DNA, 25 bp, Artificial sequence
  Synthetic oligonucleotide
acttgctgtatacggaagcaccagc

SEQ ID NO: 688666 - DNA, 25 bp, Artificial sequence
  Synthetic oligonucleotide
cttgctgtatagggaagcaccagcc

SEQ ID NO: 688667 - DNA, 25 bp, Artificial sequence
  Synthetic oligonucleotide
ggaagcaccagccacagtgaggaat

SEQ ID NO: 688668 - DNA, 25 bp, Artificial sequence
  Synthetic oligonucleotide
tgctgtatagggtagcaccagccac

SEQ ID NO: 688669 - DNA, 25 bp, Artificial sequence
  Synthetic oligonucleotide
gctgtatagggaagcaccagccaca

SEQ ID NO: 688670 - DNA, 25 bp, Artificial sequence
  Synthetic oligonucleotide
gctgtatagggatgcaccagccaca

SEQ ID NO: 688671 - DNA, 25 bp, Artificial sequence
  Synthetic oligonucleotide
ctgtatagggaagcaccagccacag

SEQ ID NO: 688672 - DNA, 25 bp, Artificial sequence
  Synthetic oligonucleotide
ctgtatagggaaccaccagccacag

SEQ ID NO: 688673 - DNA, 25 bp, Artificial sequence
  Synthetic oligonucleotide
tgtatagggaaggaccagccacagt

SEQ ID NO: 688674 - DNA, 25 bp, Artificial sequence
  Synthetic oligonucleotide
gtatagggaagcaccagccacagtg

SEQ ID NO: 688675 - DNA, 25 bp, Artificial sequence
  Synthetic oligonucleotide
gtatagggaagctccagccacagtg

SEQ ID NO: 688676 - DNA, 25 bp, Artificial sequence
  Synthetic oligonucleotide
tatagggaagcaccagccacagtga

SEQ ID NO: 688677 - DNA, 25 bp, Artificial sequence
  Synthetic oligonucleotide
tatagggaagcagcagccacagtga

SEQ ID NO: 688678 - DNA, 25 bp, Artificial sequence
  Synthetic oligonucleotide
atagggaagcaccagccacagtgag

SEQ ID NO: 688679 - DNA, 25 bp, Artificial sequence
  Synthetic oligonucleotide
atagggaagcacgagccacagtgag

SEQ ID NO: 688680 - DNA, 25 bp, Artificial sequence
  Synthetic oligonucleotide
tgtatagggaagcaccagccacagt

SEQ ID NO: 688681 - DNA, 25 bp, Artificial sequence
  Synthetic oligonucleotide
cttgctgtatagcgaagcaccagcc

SEQ ID NO: 688682 - DNA, 25 bp, Artificial sequence
  Synthetic oligonucleotide
cggacacagtgatttctatggaagg

SEQ ID NO: 688683 - DNA, 25 bp, Artificial sequence
  Synthetic oligonucleotide
cacagtgatttctatggaaggcttg

SEQ ID NO: 688684 - DNA, 25 bp, Artificial sequence
  Synthetic oligonucleotide
cacagtgatttcaatggaaggcttg

SEQ ID NO: 688685 - DNA, 25 bp, Artificial sequence
  Synthetic oligonucleotide
acacagtgatttctatggaaggctt

SEQ ID NO: 688686 - DNA, 25 bp, Artificial sequence
  Synthetic oligonucleotide
acacagtgatttgtatggaaggctt

SEQ ID NO: 688687 - DNA, 25 bp, Artificial sequence
  Synthetic oligonucleotide
gacacagtgatttctatggaaggct

SEQ ID NO: 688688 - DNA, 25 bp, Artificial sequence
  Synthetic oligonucleotide
gacacagtgattactatggaaggct

SEQ ID NO: 688689 - DNA, 25 bp, Artificial sequence
  Synthetic oligonucleotide
ggacacagtgatttctatggaaggc

SEQ ID NO: 688690 - DNA, 25 bp, Artificial sequence
  Synthetic oligonucleotide
cggacacagtgaattctatggaagg

SEQ ID NO: 688691 - DNA, 25 bp, Artificial sequence
  Synthetic oligonucleotide
acggacacagtgatttctatggaag

SEQ ID NO: 688692 - DNA, 25 bp, Artificial sequence
  Synthetic oligonucleotide
ggacacagtgatatctatggaaggc

SEQ ID NO: 688693 - DNA, 25 bp, Artificial sequence
  Synthetic oligonucleotide
ggcagagctgacgatctggacggac

SEQ ID NO: 688694 - DNA, 25 bp, Artificial sequence
  Synthetic oligonucleotide
tgaatgagggcacagctgaccatct

SEQ ID NO: 688695 - DNA, 25 bp, Artificial sequence
  Synthetic oligonucleotide
agctgaccatctcgacggacacagt

SEQ ID NO: 688696 - DNA, 25 bp, Artificial sequence
  Synthetic oligonucleotide
agctgaccatctggacggacacagt

SEQ ID NO: 688697 - DNA, 25 bp, Artificial sequence
  Synthetic oligonucleotide
gagctgaccatctggacggacacag

SEQ ID NO: 688698 - DNA, 25 bp, Artificial sequence
  Synthetic oligonucleotide
gagctgaccatcaggacggacacag

SEQ ID NO: 688699 - DNA, 25 bp, Artificial sequence
  Synthetic oligonucleotide
agagctgaccatctggacggacaca

SEQ ID NO: 688700 - DNA, 25 bp, Artificial sequence
  Synthetic oligonucleotide
agagctgaccatgtggacggacaca

SEQ ID NO: 688701 - DNA, 25 bp, Artificial sequence
  Synthetic oligonucleotide
cagagctgaccaactggacggacac

SEQ ID NO: 688702 - DNA, 25 bp, Artificial sequence
  Synthetic oligonucleotide
cagagctgaccatctggacggacac

SEQ ID NO: 688703 - DNA, 25 bp, Artificial sequence
  Synthetic oligonucleotide
gctgaccatctgcacggacacagtg

SEQ ID NO: 688704 - DNA, 25 bp, Artificial sequence
  Synthetic oligonucleotide
gcagagctgaccatctggacggaca

SEQ ID NO: 688705 - DNA, 25 bp, Artificial sequence
  Synthetic oligonucleotide
tgaccatctggacggacacagtgat

SEQ ID NO: 688706 - DNA, 25 bp, Artificial sequence
  Synthetic oligonucleotide
ggcagagctgaccatctggacggac

SEQ ID NO: 688707 - DNA, 25 bp, Artificial sequence
  Synthetic oligonucleotide
gggcagagctgaccatctggacgga

SEQ ID NO: 688708 - DNA, 25 bp, Artificial sequence
  Synthetic oligonucleotide
gggcagagctgagcatctggacgga

SEQ ID NO: 688709 - DNA, 25 bp, Artificial sequence
  Synthetic oligonucleotide
gagggcagagctcaccatctggacg

SEQ ID NO: 688710 - DNA, 25 bp, Artificial sequence
  Synthetic oligonucleotide
gagggcagagctgaccatctggacg

SEQ ID NO: 688711 - DNA, 25 bp, Artificial sequence
  Synthetic oligonucleotide
tgagggcagagctgaccatctggac

SEQ ID NO: 688712 - DNA, 25 bp, Artificial sequence
  Synthetic oligonucleotide
tgagggcagagcagaccatctggac

SEQ ID NO: 688713 - DNA, 25 bp, Artificial sequence
  Synthetic oligonucleotide
atgagggcagaggtgaccatctgga

SEQ ID NO: 688714 - DNA, 25 bp, Artificial sequence
  Synthetic oligonucleotide
aatgagggcagagctgaccatctgg

SEQ ID NO: 688715 - DNA, 25 bp, Artificial sequence
  Synthetic oligonucleotide
tgaatgagggcagagctgaccatct

SEQ ID NO: 688716 - DNA, 25 bp, Artificial sequence
  Synthetic oligonucleotide
gcagagctgaccttctggacggaca

SEQ ID NO: 688717 - DNA, 25 bp, Artificial sequence
  Synthetic oligonucleotide
atctggacggacacagtgatttcta

SEQ ID NO: 688718 - DNA, 25 bp, Artificial sequence
  Synthetic oligonucleotide
acggacacagtgttttctatggaag

SEQ ID NO: 688719 - DNA, 25 bp, Artificial sequence
  Synthetic oligonucleotide
gacggacacagtcatttctatggaa

SEQ ID NO: 688720 - DNA, 25 bp, Artificial sequence
  Synthetic oligonucleotide
gacggacacagtgatttctatggaa

SEQ ID NO: 688721 - DNA, 25 bp, Artificial sequence
  Synthetic oligonucleotide
ggacggacacagagatttctatgga

SEQ ID NO: 688722 - DNA, 25 bp, Artificial sequence
  Synthetic oligonucleotide
ggacggacacagtgatttctatgga

SEQ ID NO: 688723 - DNA, 25 bp, Artificial sequence
  Synthetic oligonucleotide
tggacggacacactgatttctatgg

SEQ ID NO: 688724 - DNA, 25 bp, Artificial sequence
  Synthetic oligonucleotide
tggacggacacagtgatttctatgg

SEQ ID NO: 688725 - DNA, 25 bp, Artificial sequence
  Synthetic oligonucleotide
ctggacggacacagtgatttctatg

SEQ ID NO: 688726 - DNA, 25 bp, Artificial sequence
  Synthetic oligonucleotide
ctggacggacactgtgatttctatg

SEQ ID NO: 688727 - DNA, 25 bp, Artificial sequence
  Synthetic oligonucleotide
gctgaccatctggacggacacagtg

SEQ ID NO: 688728 - DNA, 25 bp, Artificial sequence
  Synthetic oligonucleotide
tctggacggacagagtgatttctat

SEQ ID NO: 688729 - DNA, 25 bp, Artificial sequence
  Synthetic oligonucleotide
aatgagggcagacctgaccatctgg

SEQ ID NO: 688730 - DNA, 25 bp, Artificial sequence
  Synthetic oligonucleotide
atctggacggactcagtgatttcta

SEQ ID NO: 688731 - DNA, 25 bp, Artificial sequence
  Synthetic oligonucleotide
catctggacggagacagtgatttct

SEQ ID NO: 688732 - DNA, 25 bp, Artificial sequence
  Synthetic oligonucleotide
catctggacggacacagtgatttct

SEQ ID NO: 688733 - DNA, 25 bp, Artificial sequence
  Synthetic oligonucleotide
ccatctggacggtcacagtgatttc

SEQ ID NO: 688734 - DNA, 25 bp, Artificial sequence
  Synthetic oligonucleotide
ccatctggacggacacagtgatttc

SEQ ID NO: 688735 - DNA, 25 bp, Artificial sequence
  Synthetic oligonucleotide
accatctggacgcacacagtgattt

SEQ ID NO: 688736 - DNA, 25 bp, Artificial sequence
  Synthetic oligonucleotide
accatctggacggacacagtgattt

SEQ ID NO: 688737 - DNA, 25 bp, Artificial sequence
  Synthetic oligonucleotide
gaccatctggacggacacagtgatt

SEQ ID NO: 688738 - DNA, 25 bp, Artificial sequence
  Synthetic oligonucleotide
gaccatctggaccgacacagtgatt

SEQ ID NO: 688739 - DNA, 25 bp, Artificial sequence
  Synthetic oligonucleotide
tgaccatctggagggacacagtgat

SEQ ID NO: 688740 - DNA, 25 bp, Artificial sequence
  Synthetic oligonucleotide
tctggacggacacagtgatttctat

SEQ ID NO: 688741 - DNA, 25 bp, Artificial sequence
  Synthetic oligonucleotide
atgagggcagagctgaccatctgga

SEQ ID NO: 688742 - DNA, 25 bp, Artificial sequence
  Synthetic oligonucleotide
gacacagtgattactatggaaggct

SEQ ID NO: 688743 - DNA, 25 bp, Artificial sequence
  Synthetic oligonucleotide
ctggacggacactgtgatttctatg

SEQ ID NO: 688744 - DNA, 25 bp, Artificial sequence
  Synthetic oligonucleotide
tggacggacacagtgatttctatgg

SEQ ID NO: 688745 - DNA, 25 bp, Artificial sequence
  Synthetic oligonucleotide
tggacggacacactgatttctatgg

SEQ ID NO: 688746 - DNA, 25 bp, Artificial sequence
  Synthetic oligonucleotide
ggacggacacagtgatttctatgga

SEQ ID NO: 688747 - DNA, 25 bp, Artificial sequence
  Synthetic oligonucleotide
ggacggacacagagatttctatgga

SEQ ID NO: 688748 - DNA, 25 bp, Artificial sequence
  Synthetic oligonucleotide
gacggacacagtcatttctatggaa

SEQ ID NO: 688749 - DNA, 25 bp, Artificial sequence
  Synthetic oligonucleotide
gacggacacagtgatttctatggaa

SEQ ID NO: 688750 - DNA, 25 bp, Artificial sequence
  Synthetic oligonucleotide
acggacacagtgttttctatggaag

SEQ ID NO: 688751 - DNA, 25 bp, Artificial sequence
  Synthetic oligonucleotide
acggacacagtgatttctatggaag

SEQ ID NO: 688752 - DNA, 25 bp, Artificial sequence
  Synthetic oligonucleotide
cggacacagtgatttctatggaagg

SEQ ID NO: 688753 - DNA, 25 bp, Artificial sequence
  Synthetic oligonucleotide
cggacacagtgaattctatggaagg

SEQ ID NO: 688754 - DNA, 25 bp, Artificial sequence
  Synthetic oligonucleotide
tctggacggacacagtgatttctat

SEQ ID NO: 688755 - DNA, 25 bp, Artificial sequence
  Synthetic oligonucleotide
ggacacagtgatttctatggaaggc

SEQ ID NO: 688756 - DNA, 25 bp, Artificial sequence
  Synthetic oligonucleotide
tctggacggacagagtgatttctat

SEQ ID NO: 688757 - DNA, 25 bp, Artificial sequence
  Synthetic oligonucleotide
gacacagtgatttctatggaaggct

SEQ ID NO: 688758 - DNA, 25 bp, Artificial sequence
  Synthetic oligonucleotide
acacagtgatttgtatggaaggctt

SEQ ID NO: 688759 - DNA, 25 bp, Artificial sequence
  Synthetic oligonucleotide
acacagtgatttctatggaaggctt

SEQ ID NO: 688760 - DNA, 25 bp, Artificial sequence
  Synthetic oligonucleotide
cacagtgatttctatggaaggcttg

SEQ ID NO: 688761 - DNA, 25 bp, Artificial sequence
  Synthetic oligonucleotide
gggcagagctgagcatctggacgga

SEQ ID NO: 688762 - DNA, 25 bp, Artificial sequence
  Synthetic oligonucleotide
gagggcagagctcaccatctggacg

SEQ ID NO: 688763 - DNA, 25 bp, Artificial sequence
  Synthetic oligonucleotide
gagggcagagctgaccatctggacg

SEQ ID NO: 688764 - DNA, 25 bp, Artificial sequence
  Synthetic oligonucleotide
tgagggcagagcagaccatctggac

SEQ ID NO: 688765 - DNA, 25 bp, Artificial sequence
  Synthetic oligonucleotide
cacagtgatttcaatggaaggcttg

SEQ ID NO: 688766 - DNA, 25 bp, Artificial sequence
  Synthetic oligonucleotide
atgagggcagaggtgaccatctgga

SEQ ID NO: 688767 - DNA, 25 bp, Artificial sequence
  Synthetic oligonucleotide
aatgagggcagacctgaccatctgg

SEQ ID NO: 688768 - DNA, 25 bp, Artificial sequence
  Synthetic oligonucleotide
aatgagggcagagctgaccatctgg

SEQ ID NO: 688769 - DNA, 25 bp, Artificial sequence
  Synthetic oligonucleotide
tgaatgagggcagagctgaccatct

SEQ ID NO: 688770 - DNA, 25 bp, Artificial sequence
  Synthetic oligonucleotide
ggacacagtgatatctatggaaggc

SEQ ID NO: 688771 - DNA, 25 bp, Artificial sequence
  Synthetic oligonucleotide
gctgaccatctgcacggacacagtg

SEQ ID NO: 688772 - DNA, 25 bp, Artificial sequence
  Synthetic oligonucleotide
gggcagagctgaccatctggacgga

SEQ ID NO: 688773 - DNA, 25 bp, Artificial sequence
  Synthetic oligonucleotide
ggcagagctgacgatctggacggac

SEQ ID NO: 688774 - DNA, 25 bp, Artificial sequence
  Synthetic oligonucleotide
gcagagctgaccttctggacggaca

SEQ ID NO: 688775 - DNA, 25 bp, Artificial sequence
  Synthetic oligonucleotide
gcagagctgaccatctggacggaca

SEQ ID NO: 688776 - DNA, 25 bp, Artificial sequence
  Synthetic oligonucleotide
atgagggcagagctgaccatctgga

SEQ ID NO: 688777 - DNA, 25 bp, Artificial sequence
  Synthetic oligonucleotide
cagagctgaccaactggacggacac

SEQ ID NO: 688778 - DNA, 25 bp, Artificial sequence
  Synthetic oligonucleotide
tgaatgagggcacagctgaccatct

SEQ ID NO: 688779 - DNA, 25 bp, Artificial sequence
  Synthetic oligonucleotide
cagagctgaccatctggacggacac

SEQ ID NO: 688780 - DNA, 25 bp, Artificial sequence
  Synthetic oligonucleotide
agagctgaccatctggacggacaca

SEQ ID NO: 688781 - DNA, 25 bp, Artificial sequence
  Synthetic oligonucleotide
agagctgaccatgtggacggacaca

SEQ ID NO: 688782 - DNA, 25 bp, Artificial sequence
  Synthetic oligonucleotide
gagctgaccatctggacggacacag

SEQ ID NO: 688783 - DNA, 25 bp, Artificial sequence
  Synthetic oligonucleotide
gagctgaccatcaggacggacacag

SEQ ID NO: 688784 - DNA, 25 bp, Artificial sequence
  Synthetic oligonucleotide
ctggacggacacagtgatttctatg

SEQ ID NO: 688785 - DNA, 25 bp, Artificial sequence
  Synthetic oligonucleotide
agctgaccatctggacggacacagt

SEQ ID NO: 688786 - DNA, 25 bp, Artificial sequence
  Synthetic oligonucleotide
ggcagagctgaccatctggacggac

SEQ ID NO: 688787 - DNA, 25 bp, Artificial sequence
  Synthetic oligonucleotide
gctgaccatctggacggacacagtg

SEQ ID NO: 688788 - DNA, 25 bp, Artificial sequence
  Synthetic oligonucleotide
tgaccatctggacggacacagtgat

SEQ ID NO: 688789 - DNA, 25 bp, Artificial sequence
  Synthetic oligonucleotide
tgaccatctggagggacacagtgat

SEQ ID NO: 688790 - DNA, 25 bp, Artificial sequence
  Synthetic oligonucleotide
gaccatctggaccgacacagtgatt

SEQ ID NO: 688791 - DNA, 25 bp, Artificial sequence
  Synthetic oligonucleotide
gaccatctggacggacacagtgatt

SEQ ID NO: 688792 - DNA, 25 bp, Artificial sequence
  Synthetic oligonucleotide
accatctggacgcacacagtgattt

SEQ ID NO: 688793 - DNA, 25 bp, Artificial sequence
  Synthetic oligonucleotide
accatctggacggacacagtgattt

SEQ ID NO: 688794 - DNA, 25 bp, Artificial sequence
  Synthetic oligonucleotide
ccatctggacggtcacagtgatttc

SEQ ID NO: 688795 - DNA, 25 bp, Artificial sequence
  Synthetic oligonucleotide
ccatctggacggacacagtgatttc

SEQ ID NO: 688796 - DNA, 25 bp, Artificial sequence
  Synthetic oligonucleotide
catctggacggagacagtgatttct

SEQ ID NO: 688797 - DNA, 25 bp, Artificial sequence
  Synthetic oligonucleotide
catctggacggacacagtgatttct

SEQ ID NO: 688798 - DNA, 25 bp, Artificial sequence
  Synthetic oligonucleotide
atctggacggactcagtgatttcta

SEQ ID NO: 688799 - DNA, 25 bp, Artificial sequence
  Synthetic oligonucleotide
atctggacggacacagtgatttcta

SEQ ID NO: 688800 - DNA, 25 bp, Artificial sequence
  Synthetic oligonucleotide
agctgaccatctcgacggacacagt

SEQ ID NO: 688801 - DNA, 25 bp, Artificial sequence
  Synthetic oligonucleotide
tgagggcagagctgaccatctggac

SEQ ID NO: 688802 - DNA, 25 bp, Artificial sequence
  Synthetic oligonucleotide
gaggcccctctcacatgttggaagt

SEQ ID NO: 688803 - DNA, 25 bp, Artificial sequence
  Synthetic oligonucleotide
gcccctctctcaagttggaagtggc

SEQ ID NO: 688804 - DNA, 25 bp, Artificial sequence
  Synthetic oligonucleotide
ctcatgttggaagtggcagcgacgt

SEQ ID NO: 688805 - DNA, 25 bp, Artificial sequence
  Synthetic oligonucleotide
ggcccctctctcatgttggaagtgg

SEQ ID NO: 688806 - DNA, 25 bp, Artificial sequence
  Synthetic oligonucleotide
ggcccctctctcttgttggaagtgg

SEQ ID NO: 688807 - DNA, 25 bp, Artificial sequence
  Synthetic oligonucleotide
aggcccctctctcatgttggaagtg

SEQ ID NO: 688808 - DNA, 25 bp, Artificial sequence
  Synthetic oligonucleotide
gaggaggcccctgtctcatgttgga

SEQ ID NO: 688809 - DNA, 25 bp, Artificial sequence
  Synthetic oligonucleotide
gaggcccctctctcatgttggaagt

SEQ ID NO: 688810 - DNA, 25 bp, Artificial sequence
  Synthetic oligonucleotide
cccctctctcatgttggaagtggca

SEQ ID NO: 688811 - DNA, 25 bp, Artificial sequence
  Synthetic oligonucleotide
ggaggcccctctgtcatgttggaag

SEQ ID NO: 688812 - DNA, 25 bp, Artificial sequence
  Synthetic oligonucleotide
ggaggcccctctctcatgttggaag

SEQ ID NO: 688813 - DNA, 25 bp, Artificial sequence
  Synthetic oligonucleotide
aggaggcccctcactcatgttggaa

SEQ ID NO: 688814 - DNA, 25 bp, Artificial sequence
  Synthetic oligonucleotide
aggaggcccctctctcatgttggaa

SEQ ID NO: 688815 - DNA, 25 bp, Artificial sequence
  Synthetic oligonucleotide
gaggaggcccctctctcatgttgga

SEQ ID NO: 688816 - DNA, 25 bp, Artificial sequence
  Synthetic oligonucleotide
aggcccctctctgatgttggaagtg

SEQ ID NO: 688817 - DNA, 25 bp, Artificial sequence
  Synthetic oligonucleotide
ctctctcatgttcgaagtggcagcg

SEQ ID NO: 688818 - DNA, 25 bp, Artificial sequence
  Synthetic oligonucleotide
tggaagtggcagggacgtttggggc

SEQ ID NO: 688819 - DNA, 25 bp, Artificial sequence
  Synthetic oligonucleotide
tctcatgttggaagtggcagcgacg

SEQ ID NO: 688820 - DNA, 25 bp, Artificial sequence
  Synthetic oligonucleotide
tggaagtggcagcgacgtttggggc

SEQ ID NO: 688821 - DNA, 25 bp, Artificial sequence
  Synthetic oligonucleotide
ctctcatgttggaagtggcagcgac

SEQ ID NO: 688822 - DNA, 25 bp, Artificial sequence
  Synthetic oligonucleotide
ctctcatgttggtagtggcagcgac

SEQ ID NO: 688823 - DNA, 25 bp, Artificial sequence
  Synthetic oligonucleotide
gcccctctctcatgttggaagtggc

SEQ ID NO: 688824 - DNA, 25 bp, Artificial sequence
  Synthetic oligonucleotide
tctctcatgttgcaagtggcagcga

SEQ ID NO: 688825 - DNA, 25 bp, Artificial sequence
  Synthetic oligonucleotide
cccctctctcatcttggaagtggca

SEQ ID NO: 688826 - DNA, 25 bp, Artificial sequence
  Synthetic oligonucleotide
ctctctcatgttggaagtggcagcg

SEQ ID NO: 688827 - DNA, 25 bp, Artificial sequence
  Synthetic oligonucleotide
cctctctcatgttggaagtggcagc

SEQ ID NO: 688828 - DNA, 25 bp, Artificial sequence
  Synthetic oligonucleotide
cctctctcatgtaggaagtggcagc

SEQ ID NO: 688829 - DNA, 25 bp, Artificial sequence
  Synthetic oligonucleotide
ccctctctcatgttggaagtggcag

SEQ ID NO: 688830 - DNA, 25 bp, Artificial sequence
  Synthetic oligonucleotide
ccctctctcatgatggaagtggcag

SEQ ID NO: 688831 - DNA, 25 bp, Artificial sequence
  Synthetic oligonucleotide
tctcatgttggatgtggcagcgacg

SEQ ID NO: 688832 - DNA, 25 bp, Artificial sequence
  Synthetic oligonucleotide
tctctcatgttggaagtggcagcga

SEQ ID NO: 688833 - DNA, 25 bp, Artificial sequence
  Synthetic oligonucleotide
aagtggcagcgaggtttggggctga

SEQ ID NO: 688834 - DNA, 25 bp, Artificial sequence
  Synthetic oligonucleotide
ggaagtggcagccacgtttggggct

SEQ ID NO: 688835 - DNA, 25 bp, Artificial sequence
  Synthetic oligonucleotide
tgctgaggaggcccctctctcatgt

SEQ ID NO: 688836 - DNA, 25 bp, Artificial sequence
  Synthetic oligonucleotide
ggaagtggcagcgacgtttggggct

SEQ ID NO: 688837 - DNA, 25 bp, Artificial sequence
  Synthetic oligonucleotide
aagtggcagcgacgtttggggctga

SEQ ID NO: 688838 - DNA, 25 bp, Artificial sequence
  Synthetic oligonucleotide
ctcatgttggaactggcagcgacgt

SEQ ID NO: 688839 - DNA, 25 bp, Artificial sequence
  Synthetic oligonucleotide
agtggcagcgacctttggggctgat

SEQ ID NO: 688840 - DNA, 25 bp, Artificial sequence
  Synthetic oligonucleotide
agtggcagcgacgtttggggctgat

SEQ ID NO: 688841 - DNA, 25 bp, Artificial sequence
  Synthetic oligonucleotide
tggcagcgacgtatggggctgatcc

SEQ ID NO: 688842 - DNA, 25 bp, Artificial sequence
  Synthetic oligonucleotide
tggcagcgacgtttggggctgatcc

SEQ ID NO: 688843 - DNA, 25 bp, Artificial sequence
  Synthetic oligonucleotide
ggcagcgacgttaggggctgatccc

SEQ ID NO: 688844 - DNA, 25 bp, Artificial sequence
  Synthetic oligonucleotide
ggcagcgacgtttggggctgatccc

SEQ ID NO: 688845 - DNA, 25 bp, Artificial sequence
  Synthetic oligonucleotide
ttggaagtggcagcgacgtttgggg

SEQ ID NO: 688846 - DNA, 25 bp, Artificial sequence
  Synthetic oligonucleotide
ttggaagtggcaccgacgtttgggg

SEQ ID NO: 688847 - DNA, 25 bp, Artificial sequence
  Synthetic oligonucleotide
gttggaagtggctgcgacgtttggg

SEQ ID NO: 688848 - DNA, 25 bp, Artificial sequence
  Synthetic oligonucleotide
attgctgaggaggcccctctctcat

SEQ ID NO: 688849 - DNA, 25 bp, Artificial sequence
  Synthetic oligonucleotide
tgctgaggaggcgcctctctcatgt

SEQ ID NO: 688850 - DNA, 25 bp, Artificial sequence
  Synthetic oligonucleotide
gttggaagtggcagcgacgtttggg

SEQ ID NO: 688851 - DNA, 25 bp, Artificial sequence
  Synthetic oligonucleotide
ttgctgaggaggcccctctctcatg

SEQ ID NO: 688852 - DNA, 25 bp, Artificial sequence
  Synthetic oligonucleotide
ttgctgaggagggccctctctcatg

SEQ ID NO: 688853 - DNA, 25 bp, Artificial sequence
  Synthetic oligonucleotide
attgctgaggagccccctctctcat

SEQ ID NO: 688854 - DNA, 25 bp, Artificial sequence
  Synthetic oligonucleotide
cattgctgaggaggcccctctctca

SEQ ID NO: 688855 - DNA, 25 bp, Artificial sequence
  Synthetic oligonucleotide
cattgctgaggacgcccctctctca

SEQ ID NO: 688856 - DNA, 25 bp, Artificial sequence
  Synthetic oligonucleotide
tcatgttggaagtggcagcgacgtt

SEQ ID NO: 688857 - DNA, 25 bp, Artificial sequence
  Synthetic oligonucleotide
catgttggaagtcgcagcgacgttt

SEQ ID NO: 688858 - DNA, 25 bp, Artificial sequence
  Synthetic oligonucleotide
catgttggaagtggcagcgacgttt

SEQ ID NO: 688859 - DNA, 25 bp, Artificial sequence
  Synthetic oligonucleotide
tgttggaagtgggagcgacgtttgg

SEQ ID NO: 688860 - DNA, 25 bp, Artificial sequence
  Synthetic oligonucleotide
tcatgttggaagaggcagcgacgtt

SEQ ID NO: 688861 - DNA, 25 bp, Artificial sequence
  Synthetic oligonucleotide
tgttggaagtggcagcgacgtttgg

SEQ ID NO: 688862 - DNA, 25 bp, Artificial sequence
  Synthetic oligonucleotide
tctcatgttggatgtggcagcgacg

SEQ ID NO: 688863 - DNA, 25 bp, Artificial sequence
  Synthetic oligonucleotide
tgttggaagtgggagcgacgtttgg

SEQ ID NO: 688864 - DNA, 25 bp, Artificial sequence
  Synthetic oligonucleotide
catgttggaagtggcagcgacgttt

SEQ ID NO: 688865 - DNA, 25 bp, Artificial sequence
  Synthetic oligonucleotide
tcatgttggaagaggcagcgacgtt

SEQ ID NO: 688866 - DNA, 25 bp, Artificial sequence
  Synthetic oligonucleotide
tcatgttggaagtggcagcgacgtt

SEQ ID NO: 688867 - DNA, 25 bp, Artificial sequence
  Synthetic oligonucleotide
ctcatgttggaagtggcagcgacgt

SEQ ID NO: 688868 - DNA, 25 bp, Artificial sequence
  Synthetic oligonucleotide
ctctcatgttggtagtggcagcgac

SEQ ID NO: 688869 - DNA, 25 bp, Artificial sequence
  Synthetic oligonucleotide
tctcatgttggaagtggcagcgacg

SEQ ID NO: 688870 - DNA, 25 bp, Artificial sequence
  Synthetic oligonucleotide
ctctcatgttggaagtggcagcgac

SEQ ID NO: 688871 - DNA, 25 bp, Artificial sequence
  Synthetic oligonucleotide
tctctcatgttggaagtggcagcga

SEQ ID NO: 688872 - DNA, 25 bp, Artificial sequence
  Synthetic oligonucleotide
tctctcatgttgcaagtggcagcga

SEQ ID NO: 688873 - DNA, 25 bp, Artificial sequence
  Synthetic oligonucleotide
ggaagtggcagccacgtttggggct

SEQ ID NO: 688874 - DNA, 25 bp, Artificial sequence
  Synthetic oligonucleotide
ctcatgttggaactggcagcgacgt

SEQ ID NO: 688875 - DNA, 25 bp, Artificial sequence
  Synthetic oligonucleotide
aagtggcagcgaggtttggggctga

SEQ ID NO: 688876 - DNA, 25 bp, Artificial sequence
  Synthetic oligonucleotide
ggcagcgacgtttggggctgatccc

SEQ ID NO: 688877 - DNA, 25 bp, Artificial sequence
  Synthetic oligonucleotide
tggcagcgacgtttggggctgatcc

SEQ ID NO: 688878 - DNA, 25 bp, Artificial sequence
  Synthetic oligonucleotide
gaggcccctctctcatgttggaagt

SEQ ID NO: 688879 - DNA, 25 bp, Artificial sequence
  Synthetic oligonucleotide
ctctctcatgttggaagtggcagcg

SEQ ID NO: 688880 - DNA, 25 bp, Artificial sequence
  Synthetic oligonucleotide
agtggcagcgacctttggggctgat

SEQ ID NO: 688881 - DNA, 25 bp, Artificial sequence
  Synthetic oligonucleotide
tggaagtggcagggacgtttggggc

SEQ ID NO: 688882 - DNA, 25 bp, Artificial sequence
  Synthetic oligonucleotide
aagtggcagcgacgtttggggctga

SEQ ID NO: 688883 - DNA, 25 bp, Artificial sequence
  Synthetic oligonucleotide
gttggaagtggctgcgacgtttggg

SEQ ID NO: 688884 - DNA, 25 bp, Artificial sequence
  Synthetic oligonucleotide
ggaagtggcagcgacgtttggggct

SEQ ID NO: 688885 - DNA, 25 bp, Artificial sequence
  Synthetic oligonucleotide
tggcagcgacgtatggggctgatcc

SEQ ID NO: 688886 - DNA, 25 bp, Artificial sequence
  Synthetic oligonucleotide
tggaagtggcagcgacgtttggggc

SEQ ID NO: 688887 - DNA, 25 bp, Artificial sequence
  Synthetic oligonucleotide
ttggaagtggcagcgacgtttgggg

SEQ ID NO: 688888 - DNA, 25 bp, Artificial sequence
  Synthetic oligonucleotide
ttggaagtggcaccgacgtttgggg

SEQ ID NO: 688889 - DNA, 25 bp, Artificial sequence
  Synthetic oligonucleotide
gttggaagtggcagcgacgtttggg

SEQ ID NO: 688890 - DNA, 25 bp, Artificial sequence
  Synthetic oligonucleotide
agtggcagcgacgtttggggctgat

SEQ ID NO: 688891 - DNA, 25 bp, Artificial sequence
  Synthetic oligonucleotide
ggaggcccctctgtcatgttggaag

SEQ ID NO: 688892 - DNA, 25 bp, Artificial sequence
  Synthetic oligonucleotide
ggcagcgacgttaggggctgatccc

SEQ ID NO: 688893 - DNA, 25 bp, Artificial sequence
  Synthetic oligonucleotide
tgttggaagtggcagcgacgtttgg

SEQ ID NO: 688894 - DNA, 25 bp, Artificial sequence
  Synthetic oligonucleotide
cattgctgaggaggcccctctctca

SEQ ID NO: 688895 - DNA, 25 bp, Artificial sequence
  Synthetic oligonucleotide
attgctgaggagccccctctctcat

SEQ ID NO: 688896 - DNA, 25 bp, Artificial sequence
  Synthetic oligonucleotide
attgctgaggaggcccctctctcat

SEQ ID NO: 688897 - DNA, 25 bp, Artificial sequence
  Synthetic oligonucleotide
ttgctgaggaggcccctctctcatg

SEQ ID NO: 688898 - DNA, 25 bp, Artificial sequence
  Synthetic oligonucleotide
ttgctgaggagggccctctctcatg

SEQ ID NO: 688899 - DNA, 25 bp, Artificial sequence
  Synthetic oligonucleotide
tgctgaggaggcgcctctctcatgt

SEQ ID NO: 688900 - DNA, 25 bp, Artificial sequence
  Synthetic oligonucleotide
tgctgaggaggcccctctctcatgt

SEQ ID NO: 688901 - DNA, 25 bp, Artificial sequence
  Synthetic oligonucleotide
gaggaggcccctctctcatgttgga

SEQ ID NO: 688902 - DNA, 25 bp, Artificial sequence
  Synthetic oligonucleotide
gaggaggcccctgtctcatgttgga

SEQ ID NO: 688903 - DNA, 25 bp, Artificial sequence
  Synthetic oligonucleotide
aggaggcccctctctcatgttggaa

SEQ ID NO: 688904 - DNA, 25 bp, Artificial sequence
  Synthetic oligonucleotide
aggcccctctctgatgttggaagtg

SEQ ID NO: 688905 - DNA, 25 bp, Artificial sequence
  Synthetic oligonucleotide
ggaggcccctctctcatgttggaag

SEQ ID NO: 688906 - DNA, 25 bp, Artificial sequence
  Synthetic oligonucleotide
ctctctcatgttcgaagtggcagcg

SEQ ID NO: 688907 - DNA, 25 bp, Artificial sequence
  Synthetic oligonucleotide
gaggcccctctcacatgttggaagt

SEQ ID NO: 688908 - DNA, 25 bp, Artificial sequence
  Synthetic oligonucleotide
cattgctgaggacgcccctctctca

SEQ ID NO: 688909 - DNA, 25 bp, Artificial sequence
  Synthetic oligonucleotide
aggcccctctctcatgttggaagtg

SEQ ID NO: 688910 - DNA, 25 bp, Artificial sequence
  Synthetic oligonucleotide
ggcccctctctcttgttggaagtgg

SEQ ID NO: 688911 - DNA, 25 bp, Artificial sequence
  Synthetic oligonucleotide
ggcccctctctcatgttggaagtgg

SEQ ID NO: 688912 - DNA, 25 bp, Artificial sequence
  Synthetic oligonucleotide
gcccctctctcaagttggaagtggc

SEQ ID NO: 688913 - DNA, 25 bp, Artificial sequence
  Synthetic oligonucleotide
gcccctctctcatgttggaagtggc

SEQ ID NO: 688914 - DNA, 25 bp, Artificial sequence
  Synthetic oligonucleotide
cccctctctcatcttggaagtggca

SEQ ID NO: 688915 - DNA, 25 bp, Artificial sequence
  Synthetic oligonucleotide
cccctctctcatgttggaagtggca

SEQ ID NO: 688916 - DNA, 25 bp, Artificial sequence
  Synthetic oligonucleotide
ccctctctcatgatggaagtggcag

SEQ ID NO: 688917 - DNA, 25 bp, Artificial sequence
  Synthetic oligonucleotide
ccctctctcatgttggaagtggcag

SEQ ID NO: 688918 - DNA, 25 bp, Artificial sequence
  Synthetic oligonucleotide
cctctctcatgttggaagtggcagc

SEQ ID NO: 688919 - DNA, 25 bp, Artificial sequence
  Synthetic oligonucleotide
cctctctcatgtaggaagtggcagc

SEQ ID NO: 688920 - DNA, 25 bp, Artificial sequence
  Synthetic oligonucleotide
aggaggcccctcactcatgttggaa

SEQ ID NO: 688921 - DNA, 25 bp, Artificial sequence
  Synthetic oligonucleotide
catgttggaagtcgcagcgacgttt

SEQ ID NO: 688922 - DNA, 25 bp, Artificial sequence
  Synthetic oligonucleotide
cgcagcaaactgccgtgctggcagg

SEQ ID NO: 688923 - DNA, 25 bp, Artificial sequence
  Synthetic oligonucleotide
tacggttgcaaactgctgaccacgc

SEQ ID NO: 688924 - DNA, 25 bp, Artificial sequence
  Synthetic oligonucleotide
caaactgctgaccacgccgaatccg

SEQ ID NO: 688925 - DNA, 25 bp, Artificial sequence
  Synthetic oligonucleotide
caaactgctgacgacgccgaatccg

SEQ ID NO: 688926 - DNA, 25 bp, Artificial sequence
  Synthetic oligonucleotide
gacctgcaactgatccgcaaactgg

SEQ ID NO: 688927 - DNA, 25 bp, Artificial sequence
  Synthetic oligonucleotide
gacctgcaactgttccgcaaactgg

SEQ ID NO: 688928 - DNA, 25 bp, Artificial sequence
  Synthetic oligonucleotide
gggctaaatccggagcaaactgccg

SEQ ID NO: 688929 - DNA, 25 bp, Artificial sequence
  Synthetic oligonucleotide
atggcaggcgcatactcgattttct

SEQ ID NO: 688930 - DNA, 25 bp, Artificial sequence
  Synthetic oligonucleotide
cgcagcaaactggcgtgctggcagg

SEQ ID NO: 688931 - DNA, 25 bp, Artificial sequence
  Synthetic oligonucleotide
atggcaggcgcaaactcgattttct

SEQ ID NO: 688932 - DNA, 25 bp, Artificial sequence
  Synthetic oligonucleotide
acagcaacgtctagaacaggcgctg

SEQ ID NO: 688933 - DNA, 25 bp, Artificial sequence
  Synthetic oligonucleotide
acagcaacgtcttgaacaggcgctg

SEQ ID NO: 688934 - DNA, 25 bp, Artificial sequence
  Synthetic oligonucleotide
cgtcttgaacagccgctgatgaccc

SEQ ID NO: 688935 - DNA, 25 bp, Artificial sequence
  Synthetic oligonucleotide
cgtcttgaacaggcgctgatgaccc

SEQ ID NO: 688936 - DNA, 25 bp, Artificial sequence
  Synthetic oligonucleotide
acaggcgctgatcaccccggacacc

SEQ ID NO: 688937 - DNA, 25 bp, Artificial sequence
  Synthetic oligonucleotide
acaggcgctgatgaccccggacacc

SEQ ID NO: 688938 - DNA, 25 bp, Artificial sequence
  Synthetic oligonucleotide
atattacaacgcggcagcattatga

SEQ ID NO: 688939 - DNA, 25 bp, Artificial sequence
  Synthetic oligonucleotide
atattacaacgccgcagcattatga

SEQ ID NO: 688940 - DNA, 25 bp, Artificial sequence
  Synthetic oligonucleotide
gggctaaatccgcagcaaactgccg

SEQ ID NO: 688941 - DNA, 25 bp, Artificial sequence
  Synthetic oligonucleotide
cgagcagatgaacgaacagactcag

SEQ ID NO: 688942 - DNA, 25 bp, Artificial sequence
  Synthetic oligonucleotide
ggtcgcgcggatgatgatgccaacc

SEQ ID NO: 688943 - DNA, 25 bp, Artificial sequence
  Synthetic oligonucleotide
ggtcgcgcggatcatgatgccaacc

SEQ ID NO: 688944 - DNA, 25 bp, Artificial sequence
  Synthetic oligonucleotide
ggatcatgatgcgaacctcttacgt

SEQ ID NO: 688945 - DNA, 25 bp, Artificial sequence
  Synthetic oligonucleotide
ggatcatgatgccaacctcttacgt

SEQ ID NO: 688946 - DNA, 25 bp, Artificial sequence
  Synthetic oligonucleotide
tgccaacctcttacgtgcgcctttc

SEQ ID NO: 688947 - DNA, 25 bp, Artificial sequence
  Synthetic oligonucleotide
gcgcctttctgccggacgcgagcag

SEQ ID NO: 688948 - DNA, 25 bp, Artificial sequence
  Synthetic oligonucleotide
gccggacgcgagcagatgaacgaac

SEQ ID NO: 688949 - DNA, 25 bp, Artificial sequence
  Synthetic oligonucleotide
tacggttgcaaagtgctgaccacgc

SEQ ID NO: 688950 - DNA, 25 bp, Artificial sequence
  Synthetic oligonucleotide
cgagcagatgaaggaacagactcag

SEQ ID NO: 688951 - DNA, 25 bp, Artificial sequence
  Synthetic oligonucleotide
gcgcctttctgcgggacgcgagcag

SEQ ID NO: 688952 - DNA, 25 bp, Artificial sequence
  Synthetic oligonucleotide
gatgaacgaacacactcaggcgatg

SEQ ID NO: 688953 - DNA, 25 bp, Artificial sequence
  Synthetic oligonucleotide
gatgaacgaacagactcaggcgatg

SEQ ID NO: 688954 - DNA, 25 bp, Artificial sequence
  Synthetic oligonucleotide
aacagactcaggcgatgtgctttat

SEQ ID NO: 688955 - DNA, 25 bp, Artificial sequence
  Synthetic oligonucleotide
aacagactcaggggatgtgctttat

SEQ ID NO: 688956 - DNA, 25 bp, Artificial sequence
  Synthetic oligonucleotide
tcaggcgatgtggtttatggcaggc

SEQ ID NO: 688957 - DNA, 25 bp, Artificial sequence
  Synthetic oligonucleotide
tcaggcgatgtgctttatggcaggc

SEQ ID NO: 688958 - DNA, 25 bp, Artificial sequence
  Synthetic oligonucleotide
gtgctttatggcaggcgcaaactcg

SEQ ID NO: 688959 - DNA, 25 bp, Artificial sequence
  Synthetic oligonucleotide
gtgctttatggctggcgcaaactcg

SEQ ID NO: 688960 - DNA, 25 bp, Artificial sequence
  Synthetic oligonucleotide
gccggacgcgaggagatgaacgaac

SEQ ID NO: 688961 - DNA, 25 bp, Artificial sequence
  Synthetic oligonucleotide
tgccaacctctttcgtgcgcctttc

SEQ ID NO: 688962 - DNA, 25 bp, Artificial sequence
  Synthetic oligonucleotide
cgcagcaaactgccgtgctggcagg

SEQ ID NO: 688963 - DNA, 25 bp, Artificial sequence
  Synthetic oligonucleotide
atattacaacgcggcagcattatga

SEQ ID NO: 688964 - DNA, 25 bp, Artificial sequence
  Synthetic oligonucleotide
atggcaggcgcatactcgattttct

SEQ ID NO: 688965 - DNA, 25 bp, Artificial sequence
  Synthetic oligonucleotide
tacggttgcaaactgctgaccacgc

SEQ ID NO: 688966 - DNA, 25 bp, Artificial sequence
  Synthetic oligonucleotide
tacggttgcaaagtgctgaccacgc

SEQ ID NO: 688967 - DNA, 25 bp, Artificial sequence
  Synthetic oligonucleotide
caaactgctgaccacgccgaatccg

SEQ ID NO: 688968 - DNA, 25 bp, Artificial sequence
  Synthetic oligonucleotide
gacctgcaactgatccgcaaactgg

SEQ ID NO: 688969 - DNA, 25 bp, Artificial sequence
  Synthetic oligonucleotide
gtgctttatggctggcgcaaactcg

SEQ ID NO: 688970 - DNA, 25 bp, Artificial sequence
  Synthetic oligonucleotide
gggctaaatccggagcaaactgccg

SEQ ID NO: 688971 - DNA, 25 bp, Artificial sequence
  Synthetic oligonucleotide
gtgctttatggcaggcgcaaactcg

SEQ ID NO: 688972 - DNA, 25 bp, Artificial sequence
  Synthetic oligonucleotide
cgcagcaaactggcgtgctggcagg

SEQ ID NO: 688973 - DNA, 25 bp, Artificial sequence
  Synthetic oligonucleotide
acagcaacgtcttgaacaggcgctg

SEQ ID NO: 688974 - DNA, 25 bp, Artificial sequence
  Synthetic oligonucleotide
acagcaacgtctagaacaggcgctg

SEQ ID NO: 688975 - DNA, 25 bp, Artificial sequence
  Synthetic oligonucleotide
cgtcttgaacaggcgctgatgaccc

SEQ ID NO: 688976 - DNA, 25 bp, Artificial sequence
  Synthetic oligonucleotide
cgtcttgaacagccgctgatgaccc

SEQ ID NO: 688977 - DNA, 25 bp, Artificial sequence
  Synthetic oligonucleotide
acaggcgctgatgaccccggacacc

SEQ ID NO: 688978 - DNA, 25 bp, Artificial sequence
  Synthetic oligonucleotide
acaggcgctgatcaccccggacacc

SEQ ID NO: 688979 - DNA, 25 bp, Artificial sequence
  Synthetic oligonucleotide
atattacaacgccgcagcattatga

SEQ ID NO: 688980 - DNA, 25 bp, Artificial sequence
  Synthetic oligonucleotide
gggctaaatccgcagcaaactgccg

SEQ ID NO: 688981 - DNA, 25 bp, Artificial sequence
  Synthetic oligonucleotide
gccggacgcgaggagatgaacgaac

SEQ ID NO: 688982 - DNA, 25 bp, Artificial sequence
  Synthetic oligonucleotide
ggtcgcgcggatcatgatgccaacc

SEQ ID NO: 688983 - DNA, 25 bp, Artificial sequence
  Synthetic oligonucleotide
ggtcgcgcggatgatgatgccaacc

SEQ ID NO: 688984 - DNA, 25 bp, Artificial sequence
  Synthetic oligonucleotide
ggatcatgatgccaacctcttacgt

SEQ ID NO: 688985 - DNA, 25 bp, Artificial sequence
  Synthetic oligonucleotide
ggatcatgatgcgaacctcttacgt

SEQ ID NO: 688986 - DNA, 25 bp, Artificial sequence
  Synthetic oligonucleotide
tgccaacctcttacgtgcgcctttc

SEQ ID NO: 688987 - DNA, 25 bp, Artificial sequence
  Synthetic oligonucleotide
tgccaacctctttcgtgcgcctttc

SEQ ID NO: 688988 - DNA, 25 bp, Artificial sequence
  Synthetic oligonucleotide
gcgcctttctgccggacgcgagcag

SEQ ID NO: 688989 - DNA, 25 bp, Artificial sequence
  Synthetic oligonucleotide
atggcaggcgcaaactcgattttct

SEQ ID NO: 688990 - DNA, 25 bp, Artificial sequence
  Synthetic oligonucleotide
gccggacgcgagcagatgaacgaac

SEQ ID NO: 688991 - DNA, 25 bp, Artificial sequence
  Synthetic oligonucleotide
gacctgcaactgttccgcaaactgg

SEQ ID NO: 688992 - DNA, 25 bp, Artificial sequence
  Synthetic oligonucleotide
cgagcagatgaacgaacagactcag

SEQ ID NO: 688993 - DNA, 25 bp, Artificial sequence
  Synthetic oligonucleotide
cgagcagatgaaggaacagactcag

SEQ ID NO: 688994 - DNA, 25 bp, Artificial sequence
  Synthetic oligonucleotide
gatgaacgaacagactcaggcgatg

SEQ ID NO: 688995 - DNA, 25 bp, Artificial sequence
  Synthetic oligonucleotide
gatgaacgaacacactcaggcgatg

SEQ ID NO: 688996 - DNA, 25 bp, Artificial sequence
  Synthetic oligonucleotide
aacagactcaggcgatgtgctttat

SEQ ID NO: 688997 - DNA, 25 bp, Artificial sequence
  Synthetic oligonucleotide
aacagactcaggggatgtgctttat

SEQ ID NO: 688998 - DNA, 25 bp, Artificial sequence
  Synthetic oligonucleotide
tcaggcgatgtgctttatggcaggc

SEQ ID NO: 688999 - DNA, 25 bp, Artificial sequence
  Synthetic oligonucleotide
tcaggcgatgtggtttatggcaggc

SEQ ID NO: 689000 - DNA, 25 bp, Artificial sequence
  Synthetic oligonucleotide
gcgcctttctgcgggacgcgagcag

SEQ ID NO: 689001 - DNA, 25 bp, Artificial sequence
  Synthetic oligonucleotide
caaactgctgacgacgccgaatccg

SEQ ID NO: 689002 - DNA, 25 bp, Artificial sequence
  Synthetic oligonucleotide
gcgcagcaggtgcatcgccagcatt

SEQ ID NO: 689003 - DNA, 25 bp, Artificial sequence
  Synthetic oligonucleotide
tcgtcaggtgcacgtcagcacgttg

SEQ ID NO: 689004 - DNA, 25 bp, Artificial sequence
  Synthetic oligonucleotide
tcgtcaggtgcaggtcagcacgttg

SEQ ID NO: 689005 - DNA, 25 bp, Artificial sequence
  Synthetic oligonucleotide
cgatcctcgtcacgtgcaggtcagc

SEQ ID NO: 689006 - DNA, 25 bp, Artificial sequence
  Synthetic oligonucleotide
cgatcctcgtcaggtgcaggtcagc

SEQ ID NO: 689007 - DNA, 25 bp, Artificial sequence
  Synthetic oligonucleotide
gcatttcgatcctcgtcaggtgcag

SEQ ID NO: 689008 - DNA, 25 bp, Artificial sequence
  Synthetic oligonucleotide
gcatttcgatccacgtcaggtgcag

SEQ ID NO: 689009 - DNA, 25 bp, Artificial sequence
  Synthetic oligonucleotide
gcatcgccagcatttcgatcctcgt

SEQ ID NO: 689010 - DNA, 25 bp, Artificial sequence
  Synthetic oligonucleotide
gacattgtcgcaagtcacagaatta

SEQ ID NO: 689011 - DNA, 25 bp, Artificial sequence
  Synthetic oligonucleotide
gcaggtgcatcgccagcatttcgat

SEQ ID NO: 689012 - DNA, 25 bp, Artificial sequence
  Synthetic oligonucleotide
cagcacgttgctctcgattaagacc

SEQ ID NO: 689013 - DNA, 25 bp, Artificial sequence
  Synthetic oligonucleotide
ggatctgctgttagaagcgcagcag

SEQ ID NO: 689014 - DNA, 25 bp, Artificial sequence
  Synthetic oligonucleotide
ggatctgctgtttgaagcgcagcag

SEQ ID NO: 689015 - DNA, 25 bp, Artificial sequence
  Synthetic oligonucleotide
gttgctggatctgctgtttgaagcg

SEQ ID NO: 689016 - DNA, 25 bp, Artificial sequence
  Synthetic oligonucleotide
gttgctggatctcctgtttgaagcg

SEQ ID NO: 689017 - DNA, 25 bp, Artificial sequence
  Synthetic oligonucleotide
attgtcgcaagtgacagaattattt

SEQ ID NO: 689018 - DNA, 25 bp, Artificial sequence
  Synthetic oligonucleotide
attgtcgcaagtcacagaattattt

SEQ ID NO: 689019 - DNA, 25 bp, Artificial sequence
  Synthetic oligonucleotide
gacattgtcgcatgtcacagaatta

SEQ ID NO: 689020 - DNA, 25 bp, Artificial sequence
  Synthetic oligonucleotide
gcatcgccagcaattcgatcctcgt

SEQ ID NO: 689021 - DNA, 25 bp, Artificial sequence
  Synthetic oligonucleotide
caaatactgcccccaaacgtcgcgc

SEQ ID NO: 689022 - DNA, 25 bp, Artificial sequence
  Synthetic oligonucleotide
ggcaggatcgacgcgcttctgtatg

SEQ ID NO: 689023 - DNA, 25 bp, Artificial sequence
  Synthetic oligonucleotide
ggcaggatcgacccgcttctgtatg

SEQ ID NO: 689024 - DNA, 25 bp, Artificial sequence
  Synthetic oligonucleotide
caaagcgaaagccgcaggatcgacg

SEQ ID NO: 689025 - DNA, 25 bp, Artificial sequence
  Synthetic oligonucleotide
caaagcgaaagcggcaggatcgacg

SEQ ID NO: 689026 - DNA, 25 bp, Artificial sequence
  Synthetic oligonucleotide
ggagtcggcgcgcaaagcgaaagcg

SEQ ID NO: 689027 - DNA, 25 bp, Artificial sequence
  Synthetic oligonucleotide
ggagtcggcgcggaaagcgaaagcg

SEQ ID NO: 689028 - DNA, 25 bp, Artificial sequence
  Synthetic oligonucleotide
tgaacaggtgctggagtcggcgcgc

SEQ ID NO: 689029 - DNA, 25 bp, Artificial sequence
  Synthetic oligonucleotide
gcaggtcagcaccttgctgtcgatt

SEQ ID NO: 689030 - DNA, 25 bp, Artificial sequence
  Synthetic oligonucleotide
caaatactgcccgcaaacgtcgcgc

SEQ ID NO: 689031 - DNA, 25 bp, Artificial sequence
  Synthetic oligonucleotide
gcaggtcagcacgttgctgtcgatt

SEQ ID NO: 689032 - DNA, 25 bp, Artificial sequence
  Synthetic oligonucleotide
agattgcaaatagtgcccgcaaacg

SEQ ID NO: 689033 - DNA, 25 bp, Artificial sequence
  Synthetic oligonucleotide
agattgcaaatactgcccgcaaacg

SEQ ID NO: 689034 - DNA, 25 bp, Artificial sequence
  Synthetic oligonucleotide
agcttgtccggaagattgcaaatac

SEQ ID NO: 689035 - DNA, 25 bp, Artificial sequence
  Synthetic oligonucleotide
agcttgtccggatgattgcaaatac

SEQ ID NO: 689036 - DNA, 25 bp, Artificial sequence
  Synthetic oligonucleotide
gctgtcgattaagaccggagcttgt

SEQ ID NO: 689037 - DNA, 25 bp, Artificial sequence
  Synthetic oligonucleotide
gctgtcgattaacaccggagcttgt

SEQ ID NO: 689038 - DNA, 25 bp, Artificial sequence
  Synthetic oligonucleotide
cagcacgttgctgtcgattaagacc

SEQ ID NO: 689039 - DNA, 25 bp, Artificial sequence
  Synthetic oligonucleotide
gcgcagcaggtggatcgccagcatt

SEQ ID NO: 689040 - DNA, 25 bp, Artificial sequence
  Synthetic oligonucleotide
tgaacaggtgctcgagtcggcgcgc

SEQ ID NO: 689041 - DNA, 25 bp, Artificial sequence
  Synthetic oligonucleotide
gcaggtgcatcggcagcatttcgat

SEQ ID NO: 689042 - DNA, 25 bp, Artificial sequence
  Synthetic oligonucleotide
tcgtcaggtgcacgtcagcacgttg

SEQ ID NO: 689043 - DNA, 25 bp, Artificial sequence
  Synthetic oligonucleotide
cgatcctcgtcaggtgcaggtcagc

SEQ ID NO: 689044 - DNA, 25 bp, Artificial sequence
  Synthetic oligonucleotide
cgatcctcgtcacgtgcaggtcagc

SEQ ID NO: 689045 - DNA, 25 bp, Artificial sequence
  Synthetic oligonucleotide
gcatttcgatcctcgtcaggtgcag

SEQ ID NO: 689046 - DNA, 25 bp, Artificial sequence
  Synthetic oligonucleotide
gcatttcgatccacgtcaggtgcag

SEQ ID NO: 689047 - DNA, 25 bp, Artificial sequence
  Synthetic oligonucleotide
gcatcgccagcaattcgatcctcgt

SEQ ID NO: 689048 - DNA, 25 bp, Artificial sequence
  Synthetic oligonucleotide
ggcaggatcgacccgcttctgtatg

SEQ ID NO: 689049 - DNA, 25 bp, Artificial sequence
  Synthetic oligonucleotide
gcaggtgcatcgccagcatttcgat

SEQ ID NO: 689050 - DNA, 25 bp, Artificial sequence
  Synthetic oligonucleotide
tcgtcaggtgcaggtcagcacgttg

SEQ ID NO: 689051 - DNA, 25 bp, Artificial sequence
  Synthetic oligonucleotide
gcgcagcaggtggatcgccagcatt

SEQ ID NO: 689052 - DNA, 25 bp, Artificial sequence
  Synthetic oligonucleotide
gcatcgccagcatttcgatcctcgt

SEQ ID NO: 689053 - DNA, 25 bp, Artificial sequence
  Synthetic oligonucleotide
ggatctgctgttagaagcgcagcag

SEQ ID NO: 689054 - DNA, 25 bp, Artificial sequence
  Synthetic oligonucleotide
ggatctgctgtttgaagcgcagcag

SEQ ID NO: 689055 - DNA, 25 bp, Artificial sequence
  Synthetic oligonucleotide
gttgctggatctgctgtttgaagcg

SEQ ID NO: 689056 - DNA, 25 bp, Artificial sequence
  Synthetic oligonucleotide
gttgctggatctcctgtttgaagcg

SEQ ID NO: 689057 - DNA, 25 bp, Artificial sequence
  Synthetic oligonucleotide
attgtcgcaagtcacagaattattt

SEQ ID NO: 689058 - DNA, 25 bp, Artificial sequence
  Synthetic oligonucleotide
attgtcgcaagtgacagaattattt

SEQ ID NO: 689059 - DNA, 25 bp, Artificial sequence
  Synthetic oligonucleotide
gacattgtcgcaagtcacagaatta

SEQ ID NO: 689060 - DNA, 25 bp, Artificial sequence
  Synthetic oligonucleotide
gacattgtcgcatgtcacagaatta

SEQ ID NO: 689061 - DNA, 25 bp, Artificial sequence
  Synthetic oligonucleotide
gcgcagcaggtgcatcgccagcatt

SEQ ID NO: 689062 - DNA, 25 bp, Artificial sequence
  Synthetic oligonucleotide
caaagcgaaagccgcaggatcgacg

SEQ ID NO: 689063 - DNA, 25 bp, Artificial sequence
  Synthetic oligonucleotide
gcaggtgcatcggcagcatttcgat

SEQ ID NO: 689064 - DNA, 25 bp, Artificial sequence
  Synthetic oligonucleotide
ggcaggatcgacgcgcttctgtatg

SEQ ID NO: 689065 - DNA, 25 bp, Artificial sequence
  Synthetic oligonucleotide
gcaggtcagcacgttgctgtcgatt

SEQ ID NO: 689066 - DNA, 25 bp, Artificial sequence
  Synthetic oligonucleotide
caaagcgaaagcggcaggatcgacg

SEQ ID NO: 689067 - DNA, 25 bp, Artificial sequence
  Synthetic oligonucleotide
ggagtcggcgcggaaagcgaaagcg

SEQ ID NO: 689068 - DNA, 25 bp, Artificial sequence
  Synthetic oligonucleotide
ggagtcggcgcgcaaagcgaaagcg

SEQ ID NO: 689069 - DNA, 25 bp, Artificial sequence
  Synthetic oligonucleotide
tgaacaggtgctcgagtcggcgcgc

SEQ ID NO: 689070 - DNA, 25 bp, Artificial sequence
  Synthetic oligonucleotide
tgaacaggtgctggagtcggcgcgc

SEQ ID NO: 689071 - DNA, 25 bp, Artificial sequence
  Synthetic oligonucleotide
caaatactgcccccaaacgtcgcgc

SEQ ID NO: 689072 - DNA, 25 bp, Artificial sequence
  Synthetic oligonucleotide
caaatactgcccgcaaacgtcgcgc

SEQ ID NO: 689073 - DNA, 25 bp, Artificial sequence
  Synthetic oligonucleotide
cagcacgttgctgtcgattaagacc

SEQ ID NO: 689074 - DNA, 25 bp, Artificial sequence
  Synthetic oligonucleotide
cagcacgttgctctcgattaagacc

SEQ ID NO: 689075 - DNA, 25 bp, Artificial sequence
  Synthetic oligonucleotide
gctgtcgattaagaccggagcttgt

SEQ ID NO: 689076 - DNA, 25 bp, Artificial sequence
  Synthetic oligonucleotide
gctgtcgattaacaccggagcttgt

SEQ ID NO: 689077 - DNA, 25 bp, Artificial sequence
  Synthetic oligonucleotide
agcttgtccggatgattgcaaatac

SEQ ID NO: 689078 - DNA, 25 bp, Artificial sequence
  Synthetic oligonucleotide
agcttgtccggaagattgcaaatac

SEQ ID NO: 689079 - DNA, 25 bp, Artificial sequence
  Synthetic oligonucleotide
agattgcaaatactgcccgcaaacg

SEQ ID NO: 689080 - DNA, 25 bp, Artificial sequence
  Synthetic oligonucleotide
agattgcaaatagtgcccgcaaacg

SEQ ID NO: 689081 - DNA, 25 bp, Artificial sequence
  Synthetic oligonucleotide
gcaggtcagcaccttgctgtcgatt

SEQ ID NO: 689082 - DNA, 25 bp, Artificial sequence
  Synthetic oligonucleotide
ttgccgataacgttgatgtcgatgc

SEQ ID NO: 689083 - DNA, 25 bp, Artificial sequence
  Synthetic oligonucleotide
gccggattattggtgcaactggcaa

SEQ ID NO: 689084 - DNA, 25 bp, Artificial sequence
  Synthetic oligonucleotide
caatcaacatgcaggtgaaggtgaa

SEQ ID NO: 689085 - DNA, 25 bp, Artificial sequence
  Synthetic oligonucleotide
gccggattattgctgcaactggcaa

SEQ ID NO: 689086 - DNA, 25 bp, Artificial sequence
  Synthetic oligonucleotide
attgctgcaactcgcaaacctgccg

SEQ ID NO: 689087 - DNA, 25 bp, Artificial sequence
  Synthetic oligonucleotide
attgctgcaactggcaaacctgccg

SEQ ID NO: 689088 - DNA, 25 bp, Artificial sequence
  Synthetic oligonucleotide
cgccggaaagcgagccaatcaacat

SEQ ID NO: 689089 - DNA, 25 bp, Artificial sequence
  Synthetic oligonucleotide
cgccggaaagcgtgccaatcaacat

SEQ ID NO: 689090 - DNA, 25 bp, Artificial sequence
  Synthetic oligonucleotide
aagcgtgccaatgaacatgctggtg

SEQ ID NO: 689091 - DNA, 25 bp, Artificial sequence
  Synthetic oligonucleotide
aagcgtgccaatcaacatgctggtg

SEQ ID NO: 689092 - DNA, 25 bp, Artificial sequence
  Synthetic oligonucleotide
caatcaacatgctggtgaaggtgaa

SEQ ID NO: 689093 - DNA, 25 bp, Artificial sequence
  Synthetic oligonucleotide
tggtgaaggtgataggcacgccgct

SEQ ID NO: 689094 - DNA, 25 bp, Artificial sequence
  Synthetic oligonucleotide
tggtgaaggtgaaaggcacgccgct

SEQ ID NO: 689095 - DNA, 25 bp, Artificial sequence
  Synthetic oligonucleotide
acgatgatgtcgttgcctttgattt

SEQ ID NO: 689096 - DNA, 25 bp, Artificial sequence
  Synthetic oligonucleotide
acgccgcttgccgataacgatgatg

SEQ ID NO: 689097 - DNA, 25 bp, Artificial sequence
  Synthetic oligonucleotide
aagatcgcgccgcattattgctgca

SEQ ID NO: 689098 - DNA, 25 bp, Artificial sequence
  Synthetic oligonucleotide
ttgccgataacgatgatgtcgatgc

SEQ ID NO: 689099 - DNA, 25 bp, Artificial sequence
  Synthetic oligonucleotide
acgatgatgtcgatgcctttgattt

SEQ ID NO: 689100 - DNA, 25 bp, Artificial sequence
  Synthetic oligonucleotide
gttttacggcaaaatcatcaccaca

SEQ ID NO: 689101 - DNA, 25 bp, Artificial sequence
  Synthetic oligonucleotide
acgccgcttgcccataacgatgatg

SEQ ID NO: 689102 - DNA, 25 bp, Artificial sequence
  Synthetic oligonucleotide
atcaccacacgcacttatcaggaac

SEQ ID NO: 689103 - DNA, 25 bp, Artificial sequence
  Synthetic oligonucleotide
aagatcgcgccggattattgctgca

SEQ ID NO: 689104 - DNA, 25 bp, Artificial sequence
  Synthetic oligonucleotide
gccggagttttagggcaatatcatc

SEQ ID NO: 689105 - DNA, 25 bp, Artificial sequence
  Synthetic oligonucleotide
gcaatatcatcagcacacgcactta

SEQ ID NO: 689106 - DNA, 25 bp, Artificial sequence
  Synthetic oligonucleotide
gttttacggcaatatcatcaccaca

SEQ ID NO: 689107 - DNA, 25 bp, Artificial sequence
  Synthetic oligonucleotide
atcaccacacgctcttatcaggaac

SEQ ID NO: 689108 - DNA, 25 bp, Artificial sequence
  Synthetic oligonucleotide
gccggagttttacggcaatatcatc

SEQ ID NO: 689109 - DNA, 25 bp, Artificial sequence
  Synthetic oligonucleotide
acgcacttatcacgaacgcctcgat

SEQ ID NO: 689110 - DNA, 25 bp, Artificial sequence
  Synthetic oligonucleotide
acgcacttatcaggaacgcctcgat

SEQ ID NO: 689111 - DNA, 25 bp, Artificial sequence
  Synthetic oligonucleotide
atacgctggaaatagtgcgcgatgc

SEQ ID NO: 689112 - DNA, 25 bp, Artificial sequence
  Synthetic oligonucleotide
ggaaaaagtgcgcgatgccgggatc

SEQ ID NO: 689113 - DNA, 25 bp, Artificial sequence
  Synthetic oligonucleotide
ggaaaaagtgcgggatgccgggatc

SEQ ID NO: 689114 - DNA, 25 bp, Artificial sequence
  Synthetic oligonucleotide
agtgcgcgatgcggggatcaaagtc

SEQ ID NO: 689115 - DNA, 25 bp, Artificial sequence
  Synthetic oligonucleotide
agtgcgcgatgccgggatcaaagtc

SEQ ID NO: 689116 - DNA, 25 bp, Artificial sequence
  Synthetic oligonucleotide
aagtctgttctggcggcattgtggg

SEQ ID NO: 689117 - DNA, 25 bp, Artificial sequence
  Synthetic oligonucleotide
gccgggatcaaactctgttctggcg

SEQ ID NO: 689118 - DNA, 25 bp, Artificial sequence
  Synthetic oligonucleotide
atacgctggaaaaagtgcgcgatgc

SEQ ID NO: 689119 - DNA, 25 bp, Artificial sequence
  Synthetic oligonucleotide
aagtctgttctgccggcattgtggg

SEQ ID NO: 689120 - DNA, 25 bp, Artificial sequence
  Synthetic oligonucleotide
gcaatatcatcaccacacgcactta

SEQ ID NO: 689121 - DNA, 25 bp, Artificial sequence
  Synthetic oligonucleotide
gccgggatcaaagtctgttctggcg

SEQ ID NO: 689122 - DNA, 25 bp, Artificial sequence
  Synthetic oligonucleotide
cgccggaaagcgtgccaatcaacat

SEQ ID NO: 689123 - DNA, 25 bp, Artificial sequence
  Synthetic oligonucleotide
aagatcgcgccgcattattgctgca

SEQ ID NO: 689124 - DNA, 25 bp, Artificial sequence
  Synthetic oligonucleotide
aagatcgcgccggattattgctgca

SEQ ID NO: 689125 - DNA, 25 bp, Artificial sequence
  Synthetic oligonucleotide
gccggattattggtgcaactggcaa

SEQ ID NO: 689126 - DNA, 25 bp, Artificial sequence
  Synthetic oligonucleotide
gccggattattgctgcaactggcaa

SEQ ID NO: 689127 - DNA, 25 bp, Artificial sequence
  Synthetic oligonucleotide
attgctgcaactggcaaacctgccg

SEQ ID NO: 689128 - DNA, 25 bp, Artificial sequence
  Synthetic oligonucleotide
cgccggaaagcgagccaatcaacat

SEQ ID NO: 689129 - DNA, 25 bp, Artificial sequence
  Synthetic oligonucleotide
aagtctgttctggcggcattgtggg

SEQ ID NO: 689130 - DNA, 25 bp, Artificial sequence
  Synthetic oligonucleotide
attgctgcaactcgcaaacctgccg

SEQ ID NO: 689131 - DNA, 25 bp, Artificial sequence
  Synthetic oligonucleotide
aagtctgttctgccggcattgtggg

SEQ ID NO: 689132 - DNA, 25 bp, Artificial sequence
  Synthetic oligonucleotide
gccgggatcaaagtctgttctggcg

SEQ ID NO: 689133 - DNA, 25 bp, Artificial sequence
  Synthetic oligonucleotide
gccgggatcaaactctgttctggcg

SEQ ID NO: 689134 - DNA, 25 bp, Artificial sequence
  Synthetic oligonucleotide
agtgcgcgatgccgggatcaaagtc

SEQ ID NO: 689135 - DNA, 25 bp, Artificial sequence
  Synthetic oligonucleotide
agtgcgcgatgcggggatcaaagtc

SEQ ID NO: 689136 - DNA, 25 bp, Artificial sequence
  Synthetic oligonucleotide
ggaaaaagtgcgggatgccgggatc

SEQ ID NO: 689137 - DNA, 25 bp, Artificial sequence
  Synthetic oligonucleotide
aagcgtgccaatcaacatgctggtg

SEQ ID NO: 689138 - DNA, 25 bp, Artificial sequence
  Synthetic oligonucleotide
atacgctggaaatagtgcgcgatgc

SEQ ID NO: 689139 - DNA, 25 bp, Artificial sequence
  Synthetic oligonucleotide
acgatgatgtcgttgcctttgattt

SEQ ID NO: 689140 - DNA, 25 bp, Artificial sequence
  Synthetic oligonucleotide
atacgctggaaaaagtgcgcgatgc

SEQ ID NO: 689141 - DNA, 25 bp, Artificial sequence
  Synthetic oligonucleotide
acgcacttatcacgaacgcctcgat

SEQ ID NO: 689142 - DNA, 25 bp, Artificial sequence
  Synthetic oligonucleotide
ggaaaaagtgcgcgatgccgggatc

SEQ ID NO: 689143 - DNA, 25 bp, Artificial sequence
  Synthetic oligonucleotide
gttttacggcaaaatcatcaccaca

SEQ ID NO: 689144 - DNA, 25 bp, Artificial sequence
  Synthetic oligonucleotide
acgcacttatcaggaacgcctcgat

SEQ ID NO: 689145 - DNA, 25 bp, Artificial sequence
  Synthetic oligonucleotide
atcaccacacgctcttatcaggaac

SEQ ID NO: 689146 - DNA, 25 bp, Artificial sequence
  Synthetic oligonucleotide
atcaccacacgcacttatcaggaac

SEQ ID NO: 689147 - DNA, 25 bp, Artificial sequence
  Synthetic oligonucleotide
gcaatatcatcaccacacgcactta

SEQ ID NO: 689148 - DNA, 25 bp, Artificial sequence
  Synthetic oligonucleotide
ttgccgataacgttgatgtcgatgc

SEQ ID NO: 689149 - DNA, 25 bp, Artificial sequence
  Synthetic oligonucleotide
gttttacggcaatatcatcaccaca

SEQ ID NO: 689150 - DNA, 25 bp, Artificial sequence
  Synthetic oligonucleotide
aagcgtgccaatgaacatgctggtg

SEQ ID NO: 689151 - DNA, 25 bp, Artificial sequence
  Synthetic oligonucleotide
gccggagttttacggcaatatcatc

SEQ ID NO: 689152 - DNA, 25 bp, Artificial sequence
  Synthetic oligonucleotide
gccggagttttagggcaatatcatc

SEQ ID NO: 689153 - DNA, 25 bp, Artificial sequence
  Synthetic oligonucleotide
acgatgatgtcgatgcctttgattt

SEQ ID NO: 689154 - DNA, 25 bp, Artificial sequence
  Synthetic oligonucleotide
ttgccgataacgatgatgtcgatgc

SEQ ID NO: 689155 - DNA, 25 bp, Artificial sequence
  Synthetic oligonucleotide
acgccgcttgcccataacgatgatg

SEQ ID NO: 689156 - DNA, 25 bp, Artificial sequence
  Synthetic oligonucleotide
acgccgcttgccgataacgatgatg

SEQ ID NO: 689157 - DNA, 25 bp, Artificial sequence
  Synthetic oligonucleotide
tggtgaaggtgataggcacgccgct

SEQ ID NO: 689158 - DNA, 25 bp, Artificial sequence
  Synthetic oligonucleotide
tggtgaaggtgaaaggcacgccgct

SEQ ID NO: 689159 - DNA, 25 bp, Artificial sequence
  Synthetic oligonucleotide
caatcaacatgcaggtgaaggtgaa

SEQ ID NO: 689160 - DNA, 25 bp, Artificial sequence
  Synthetic oligonucleotide
caatcaacatgctggtgaaggtgaa

SEQ ID NO: 689161 - DNA, 25 bp, Artificial sequence
  Synthetic oligonucleotide
gcaatatcatcagcacacgcactta

SEQ ID NO: 689162 - DNA, 25 bp, Artificial sequence
  Synthetic oligonucleotide
gatgaaatcgaacagtcgctgaacg

SEQ ID NO: 689163 - DNA, 25 bp, Artificial sequence
  Synthetic oligonucleotide
tacccgaacgtcttcaggcgtggca

SEQ ID NO: 689164 - DNA, 25 bp, Artificial sequence
  Synthetic oligonucleotide
ggtggacgagcgtccgcatgctaat

SEQ ID NO: 689165 - DNA, 25 bp, Artificial sequence
  Synthetic oligonucleotide
tacccgaacgtcatcaggcgtggca

SEQ ID NO: 689166 - DNA, 25 bp, Artificial sequence
  Synthetic oligonucleotide
ggtggacgagcgaccgcatgctaat

SEQ ID NO: 689167 - DNA, 25 bp, Artificial sequence
  Synthetic oligonucleotide
ggcatcggtgccacgcatcttcatg

SEQ ID NO: 689168 - DNA, 25 bp, Artificial sequence
  Synthetic oligonucleotide
acatcatattcagcccatcacgctg

SEQ ID NO: 689169 - DNA, 25 bp, Artificial sequence
  Synthetic oligonucleotide
ttcagcccatcacgctgtggtttga

SEQ ID NO: 689170 - DNA, 25 bp, Artificial sequence
  Synthetic oligonucleotide
ttcagcccatcaggctgtggtttga

SEQ ID NO: 689171 - DNA, 25 bp, Artificial sequence
  Synthetic oligonucleotide
atcacgctgtggtttgatgatgcgc

SEQ ID NO: 689172 - DNA, 25 bp, Artificial sequence
  Synthetic oligonucleotide
atcacgctgtggattgatgatgcgc

SEQ ID NO: 689173 - DNA, 25 bp, Artificial sequence
  Synthetic oligonucleotide
ggtttgatgatgggctcagtgccat

SEQ ID NO: 689174 - DNA, 25 bp, Artificial sequence
  Synthetic oligonucleotide
ggtttgatgatgcgctcagtgccat

SEQ ID NO: 689175 - DNA, 25 bp, Artificial sequence
  Synthetic oligonucleotide
atgatgcgctcagtgccatgcgttc

SEQ ID NO: 689176 - DNA, 25 bp, Artificial sequence
  Synthetic oligonucleotide
atgatgcgctcactgccatgcgttc

SEQ ID NO: 689177 - DNA, 25 bp, Artificial sequence
  Synthetic oligonucleotide
ctcagtgccatgcgttcgctgaaag

SEQ ID NO: 689178 - DNA, 25 bp, Artificial sequence
  Synthetic oligonucleotide
ctcagtgccatgggttcgctgaaag

SEQ ID NO: 689179 - DNA, 25 bp, Artificial sequence
  Synthetic oligonucleotide
catgcgttcgctgaaaggcatcggt

SEQ ID NO: 689180 - DNA, 25 bp, Artificial sequence
  Synthetic oligonucleotide
catgcgttcgctcaaaggcatcggt

SEQ ID NO: 689181 - DNA, 25 bp, Artificial sequence
  Synthetic oligonucleotide
aacagtcgctgatcggcgtgcatta

SEQ ID NO: 689182 - DNA, 25 bp, Artificial sequence
  Synthetic oligonucleotide
attaacgcgttcccagttgcagcga

SEQ ID NO: 689183 - DNA, 25 bp, Artificial sequence
  Synthetic oligonucleotide
tttaccgccagatgaaatcgaacag

SEQ ID NO: 689184 - DNA, 25 bp, Artificial sequence
  Synthetic oligonucleotide
cgtccgcatgcttatcgctttttac

SEQ ID NO: 689185 - DNA, 25 bp, Artificial sequence
  Synthetic oligonucleotide
agttgcagcgattgcaactggcctg

SEQ ID NO: 689186 - DNA, 25 bp, Artificial sequence
  Synthetic oligonucleotide
agttgcagcgatagcaactggcctg

SEQ ID NO: 689187 - DNA, 25 bp, Artificial sequence
  Synthetic oligonucleotide
gcgttcgcagttgcagcgattgcaa

SEQ ID NO: 689188 - DNA, 25 bp, Artificial sequence
  Synthetic oligonucleotide
ctgaaaggcatcggtgccacgcatc

SEQ ID NO: 689189 - DNA, 25 bp, Artificial sequence
  Synthetic oligonucleotide
attaacgcgttcgcagttgcagcga

SEQ ID NO: 689190 - DNA, 25 bp, Artificial sequence
  Synthetic oligonucleotide
ctgaaaggcatccgtgccacgcatc

SEQ ID NO: 689191 - DNA, 25 bp, Artificial sequence
  Synthetic oligonucleotide
atcttcatgaagcgcgcgacccgcg

SEQ ID NO: 689192 - DNA, 25 bp, Artificial sequence
  Synthetic oligonucleotide
atcttcatgaagggcgcgacccgcg

SEQ ID NO: 689193 - DNA, 25 bp, Artificial sequence
  Synthetic oligonucleotide
tgccacgcatcttcatgaagggcgc

SEQ ID NO: 689194 - DNA, 25 bp, Artificial sequence
  Synthetic oligonucleotide
tgccacgcatctacatgaagggcgc

SEQ ID NO: 689195 - DNA, 25 bp, Artificial sequence
  Synthetic oligonucleotide
ggcatcggtgcctcgcatcttcatg

SEQ ID NO: 689196 - DNA, 25 bp, Artificial sequence
  Synthetic oligonucleotide
aacagtcgctgaacggcgtgcatta

SEQ ID NO: 689197 - DNA, 25 bp, Artificial sequence
  Synthetic oligonucleotide
gcgttcgcagttccagcgattgcaa

SEQ ID NO: 689198 - DNA, 25 bp, Artificial sequence
  Synthetic oligonucleotide
cgtccgcatgctaatcgctttttac

SEQ ID NO: 689199 - DNA, 25 bp, Artificial sequence
  Synthetic oligonucleotide
tttaccgccagaagaaatcgaacag

SEQ ID NO: 689200 - DNA, 25 bp, Artificial sequence
  Synthetic oligonucleotide
gatgaaatcgaagagtcgctgaacg

SEQ ID NO: 689201 - DNA, 25 bp, Artificial sequence
  Synthetic oligonucleotide
acatcatattcaccccatcacgctg

SEQ ID NO: 689202 - DNA, 25 bp, Artificial sequence
  Synthetic oligonucleotide
tttaccgccagatgaaatcgaacag

SEQ ID NO: 689203 - DNA, 25 bp, Artificial sequence
  Synthetic oligonucleotide
atcacgctgtggattgatgatgcgc

SEQ ID NO: 689204 - DNA, 25 bp, Artificial sequence
  Synthetic oligonucleotide
atcacgctgtggtttgatgatgcgc

SEQ ID NO: 689205 - DNA, 25 bp, Artificial sequence
  Synthetic oligonucleotide
ttcagcccatcaggctgtggtttga

SEQ ID NO: 689206 - DNA, 25 bp, Artificial sequence
  Synthetic oligonucleotide
ttcagcccatcacgctgtggtttga

SEQ ID NO: 689207 - DNA, 25 bp, Artificial sequence
  Synthetic oligonucleotide
acatcatattcagcccatcacgctg

SEQ ID NO: 689208 - DNA, 25 bp, Artificial sequence
  Synthetic oligonucleotide
acatcatattcaccccatcacgctg

SEQ ID NO: 689209 - DNA, 25 bp, Artificial sequence
  Synthetic oligonucleotide
ctgaaaggcatcggtgccacgcatc

SEQ ID NO: 689210 - DNA, 25 bp, Artificial sequence
  Synthetic oligonucleotide
aacagtcgctgatcggcgtgcatta

SEQ ID NO: 689211 - DNA, 25 bp, Artificial sequence
  Synthetic oligonucleotide
ggtttgatgatgggctcagtgccat

SEQ ID NO: 689212 - DNA, 25 bp, Artificial sequence
  Synthetic oligonucleotide
tttaccgccagaagaaatcgaacag

SEQ ID NO: 689213 - DNA, 25 bp, Artificial sequence
  Synthetic oligonucleotide
aacagtcgctgaacggcgtgcatta

SEQ ID NO: 689214 - DNA, 25 bp, Artificial sequence
  Synthetic oligonucleotide
cgtccgcatgcttatcgctttttac

SEQ ID NO: 689215 - DNA, 25 bp, Artificial sequence
  Synthetic oligonucleotide
cgtccgcatgctaatcgctttttac

SEQ ID NO: 689216 - DNA, 25 bp, Artificial sequence
  Synthetic oligonucleotide
ggtggacgagcgtccgcatgctaat

SEQ ID NO: 689217 - DNA, 25 bp, Artificial sequence
  Synthetic oligonucleotide
ggtggacgagcgaccgcatgctaat

SEQ ID NO: 689218 - DNA, 25 bp, Artificial sequence
  Synthetic oligonucleotide
tacccgaacgtcttcaggcgtggca

SEQ ID NO: 689219 - DNA, 25 bp, Artificial sequence
  Synthetic oligonucleotide
tacccgaacgtcatcaggcgtggca

SEQ ID NO: 689220 - DNA, 25 bp, Artificial sequence
  Synthetic oligonucleotide
gatgaaatcgaacagtcgctgaacg

SEQ ID NO: 689221 - DNA, 25 bp, Artificial sequence
  Synthetic oligonucleotide
tgccacgcatctacatgaagggcgc

SEQ ID NO: 689222 - DNA, 25 bp, Artificial sequence
  Synthetic oligonucleotide
ggcatcggtgccacgcatcttcatg

SEQ ID NO: 689223 - DNA, 25 bp, Artificial sequence
  Synthetic oligonucleotide
ggcatcggtgcctcgcatcttcatg

SEQ ID NO: 689224 - DNA, 25 bp, Artificial sequence
  Synthetic oligonucleotide
gatgaaatcgaagagtcgctgaacg

SEQ ID NO: 689225 - DNA, 25 bp, Artificial sequence
  Synthetic oligonucleotide
tgccacgcatcttcatgaagggcgc

SEQ ID NO: 689226 - DNA, 25 bp, Artificial sequence
  Synthetic oligonucleotide
ggtttgatgatgcgctcagtgccat

SEQ ID NO: 689227 - DNA, 25 bp, Artificial sequence
  Synthetic oligonucleotide
atcttcatgaagggcgcgacccgcg

SEQ ID NO: 689228 - DNA, 25 bp, Artificial sequence
  Synthetic oligonucleotide
atcttcatgaagcgcgcgacccgcg

SEQ ID NO: 689229 - DNA, 25 bp, Artificial sequence
  Synthetic oligonucleotide
attaacgcgttcccagttgcagcga

SEQ ID NO: 689230 - DNA, 25 bp, Artificial sequence
  Synthetic oligonucleotide
attaacgcgttcgcagttgcagcga

SEQ ID NO: 689231 - DNA, 25 bp, Artificial sequence
  Synthetic oligonucleotide
gcgttcgcagttgcagcgattgcaa

SEQ ID NO: 689232 - DNA, 25 bp, Artificial sequence
  Synthetic oligonucleotide
gcgttcgcagttccagcgattgcaa

SEQ ID NO: 689233 - DNA, 25 bp, Artificial sequence
  Synthetic oligonucleotide
ctcagtgccatgggttcgctgaaag

SEQ ID NO: 689234 - DNA, 25 bp, Artificial sequence
  Synthetic oligonucleotide
agttgcagcgatagcaactggcctg

SEQ ID NO: 689235 - DNA, 25 bp, Artificial sequence
  Synthetic oligonucleotide
atgatgcgctcactgccatgcgttc

SEQ ID NO: 689236 - DNA, 25 bp, Artificial sequence
  Synthetic oligonucleotide
ctcagtgccatgcgttcgctgaaag

SEQ ID NO: 689237 - DNA, 25 bp, Artificial sequence
  Synthetic oligonucleotide
atgatgcgctcagtgccatgcgttc

SEQ ID NO: 689238 - DNA, 25 bp, Artificial sequence
  Synthetic oligonucleotide
catgcgttcgctcaaaggcatcggt

SEQ ID NO: 689239 - DNA, 25 bp, Artificial sequence
  Synthetic oligonucleotide
catgcgttcgctgaaaggcatcggt

SEQ ID NO: 689240 - DNA, 25 bp, Artificial sequence
  Synthetic oligonucleotide
ctgaaaggcatccgtgccacgcatc

SEQ ID NO: 689241 - DNA, 25 bp, Artificial sequence
  Synthetic oligonucleotide
agttgcagcgattgcaactggcctg

SEQ ID NO: 689242 - DNA, 25 bp, Artificial sequence
  Synthetic oligonucleotide
gggttgtggaccaggctggatgagc

SEQ ID NO: 689243 - DNA, 25 bp, Artificial sequence
  Synthetic oligonucleotide
tgagccgccactggcgggaacgtca

SEQ ID NO: 689244 - DNA, 25 bp, Artificial sequence
  Synthetic oligonucleotide
tacagcgccagactgctgacgcctt

SEQ ID NO: 689245 - DNA, 25 bp, Artificial sequence
  Synthetic oligonucleotide
tgagccgccactcgcgggaacgtca

SEQ ID NO: 689246 - DNA, 25 bp, Artificial sequence
  Synthetic oligonucleotide
tactggcaatgcatccacagcgtaa

SEQ ID NO: 689247 - DNA, 25 bp, Artificial sequence
  Synthetic oligonucleotide
tactggcaatgcttccacagcgtaa

SEQ ID NO: 689248 - DNA, 25 bp, Artificial sequence
  Synthetic oligonucleotide
gagtgctgacgcgttactggcaatg

SEQ ID NO: 689249 - DNA, 25 bp, Artificial sequence
  Synthetic oligonucleotide
gagtgctgacgccttactggcaatg

SEQ ID NO: 689250 - DNA, 25 bp, Artificial sequence
  Synthetic oligonucleotide
gggttgtggacctggctggatgagc

SEQ ID NO: 689251 - DNA, 25 bp, Artificial sequence
  Synthetic oligonucleotide
tacagcgccagagtgctgacgcctt

SEQ ID NO: 689252 - DNA, 25 bp, Artificial sequence
  Synthetic oligonucleotide
aacatgcagatcaacagcgccagag

SEQ ID NO: 689253 - DNA, 25 bp, Artificial sequence
  Synthetic oligonucleotide
aacatgcagatctacagcgccagag

SEQ ID NO: 689254 - DNA, 25 bp, Artificial sequence
  Synthetic oligonucleotide
cagcggcatttgctcgggcagccgc

SEQ ID NO: 689255 - DNA, 25 bp, Artificial sequence
  Synthetic oligonucleotide
cgcacactatgagcaacatgcagat

SEQ ID NO: 689256 - DNA, 25 bp, Artificial sequence
  Synthetic oligonucleotide
gtcgggcagccggacactatgagca

SEQ ID NO: 689257 - DNA, 25 bp, Artificial sequence
  Synthetic oligonucleotide
gtcgggcagccgcacactatgagca

SEQ ID NO: 689258 - DNA, 25 bp, Artificial sequence
  Synthetic oligonucleotide
gcgcaggtgacggccttagatctct

SEQ ID NO: 689259 - DNA, 25 bp, Artificial sequence
  Synthetic oligonucleotide
caatctcgcagtccagtggtgcggt

SEQ ID NO: 689260 - DNA, 25 bp, Artificial sequence
  Synthetic oligonucleotide
cagcggcatttggtcgggcagccgc

SEQ ID NO: 689261 - DNA, 25 bp, Artificial sequence
  Synthetic oligonucleotide
cgcacactatgaccaacatgcagat

SEQ ID NO: 689262 - DNA, 25 bp, Artificial sequence
  Synthetic oligonucleotide
cgacgttcgatcatgcatggagcaa

SEQ ID NO: 689263 - DNA, 25 bp, Artificial sequence
  Synthetic oligonucleotide
gatcttgcatggagcaatctcgcag

SEQ ID NO: 689264 - DNA, 25 bp, Artificial sequence
  Synthetic oligonucleotide
atttatccacggcactccgcgagct

SEQ ID NO: 689265 - DNA, 25 bp, Artificial sequence
  Synthetic oligonucleotide
atttatccacgggactccgcgagct

SEQ ID NO: 689266 - DNA, 25 bp, Artificial sequence
  Synthetic oligonucleotide
caatctcgcagtgcagtggtgcggt

SEQ ID NO: 689267 - DNA, 25 bp, Artificial sequence
  Synthetic oligonucleotide
gcgcaggtgacgcccttagatctct

SEQ ID NO: 689268 - DNA, 25 bp, Artificial sequence
  Synthetic oligonucleotide
cgacgttcgatcttgcatggagcaa

SEQ ID NO: 689269 - DNA, 25 bp, Artificial sequence
  Synthetic oligonucleotide
cgttagcgactgggacgttcgatct

SEQ ID NO: 689270 - DNA, 25 bp, Artificial sequence
  Synthetic oligonucleotide
cgttagcgactgcgacgttcgatct

SEQ ID NO: 689271 - DNA, 25 bp, Artificial sequence
  Synthetic oligonucleotide
gccgcagaccataatctggcgggag

SEQ ID NO: 689272 - DNA, 25 bp, Artificial sequence
  Synthetic oligonucleotide
gccttagatctcacgccgccaatgc

SEQ ID NO: 689273 - DNA, 25 bp, Artificial sequence
  Synthetic oligonucleotide
agaaggatgccggagaccattatct

SEQ ID NO: 689274 - DNA, 25 bp, Artificial sequence
  Synthetic oligonucleotide
agaaggatgccgcagaccattatct

SEQ ID NO: 689275 - DNA, 25 bp, Artificial sequence
  Synthetic oligonucleotide
tgttcaggcacgccagaaggatgcc

SEQ ID NO: 689276 - DNA, 25 bp, Artificial sequence
  Synthetic oligonucleotide
tgttcaggcacggcagaaggatgcc

SEQ ID NO: 689277 - DNA, 25 bp, Artificial sequence
  Synthetic oligonucleotide
gccgccaatgcttgttcaggcacgc

SEQ ID NO: 689278 - DNA, 25 bp, Artificial sequence
  Synthetic oligonucleotide
gccgccaatgctagttcaggcacgc

SEQ ID NO: 689279 - DNA, 25 bp, Artificial sequence
  Synthetic oligonucleotide
gccgcagaccattatctggcgggag

SEQ ID NO: 689280 - DNA, 25 bp, Artificial sequence
  Synthetic oligonucleotide
gccttagatctctcgccgccaatgc

SEQ ID NO: 689281 - DNA, 25 bp, Artificial sequence
  Synthetic oligonucleotide
gatcttgcatggtgcaatctcgcag

SEQ ID NO: 689282 - DNA, 25 bp, Artificial sequence
  Synthetic oligonucleotide
gagtgctgacgcgttactggcaatg

SEQ ID NO: 689283 - DNA, 25 bp, Artificial sequence
  Synthetic oligonucleotide
gagtgctgacgccttactggcaatg

SEQ ID NO: 689284 - DNA, 25 bp, Artificial sequence
  Synthetic oligonucleotide
tactggcaatgcttccacagcgtaa

SEQ ID NO: 689285 - DNA, 25 bp, Artificial sequence
  Synthetic oligonucleotide
tactggcaatgcatccacagcgtaa

SEQ ID NO: 689286 - DNA, 25 bp, Artificial sequence
  Synthetic oligonucleotide
gggttgtggaccaggctggatgagc

SEQ ID NO: 689287 - DNA, 25 bp, Artificial sequence
  Synthetic oligonucleotide
gggttgtggacctggctggatgagc

SEQ ID NO: 689288 - DNA, 25 bp, Artificial sequence
  Synthetic oligonucleotide
tgagccgccactcgcgggaacgtca

SEQ ID NO: 689289 - DNA, 25 bp, Artificial sequence
  Synthetic oligonucleotide
cagcggcatttgctcgggcagccgc

SEQ ID NO: 689290 - DNA, 25 bp, Artificial sequence
  Synthetic oligonucleotide
tgagccgccactggcgggaacgtca

SEQ ID NO: 689291 - DNA, 25 bp, Artificial sequence
  Synthetic oligonucleotide
tacagcgccagactgctgacgcctt

SEQ ID NO: 689292 - DNA, 25 bp, Artificial sequence
  Synthetic oligonucleotide
tacagcgccagagtgctgacgcctt

SEQ ID NO: 689293 - DNA, 25 bp, Artificial sequence
  Synthetic oligonucleotide
aacatgcagatctacagcgccagag

SEQ ID NO: 689294 - DNA, 25 bp, Artificial sequence
  Synthetic oligonucleotide
aacatgcagatcaacagcgccagag

SEQ ID NO: 689295 - DNA, 25 bp, Artificial sequence
  Synthetic oligonucleotide
cgcacactatgaccaacatgcagat

SEQ ID NO: 689296 - DNA, 25 bp, Artificial sequence
  Synthetic oligonucleotide
cgcacactatgagcaacatgcagat

SEQ ID NO: 689297 - DNA, 25 bp, Artificial sequence
  Synthetic oligonucleotide
gtcgggcagccggacactatgagca

SEQ ID NO: 689298 - DNA, 25 bp, Artificial sequence
  Synthetic oligonucleotide
gcgcaggtgacgcccttagatctct

SEQ ID NO: 689299 - DNA, 25 bp, Artificial sequence
  Synthetic oligonucleotide
cagcggcatttggtcgggcagccgc

SEQ ID NO: 689300 - DNA, 25 bp, Artificial sequence
  Synthetic oligonucleotide
cgttagcgactgggacgttcgatct

SEQ ID NO: 689301 - DNA, 25 bp, Artificial sequence
  Synthetic oligonucleotide
gtcgggcagccgcacactatgagca

SEQ ID NO: 689302 - DNA, 25 bp, Artificial sequence
  Synthetic oligonucleotide
gccgcagaccattatctggcgggag

SEQ ID NO: 689303 - DNA, 25 bp, Artificial sequence
  Synthetic oligonucleotide
atttatccacggcactccgcgagct

SEQ ID NO: 689304 - DNA, 25 bp, Artificial sequence
  Synthetic oligonucleotide
atttatccacgggactccgcgagct

SEQ ID NO: 689305 - DNA, 25 bp, Artificial sequence
  Synthetic oligonucleotide
caatctcgcagtccagtggtgcggt

SEQ ID NO: 689306 - DNA, 25 bp, Artificial sequence
  Synthetic oligonucleotide
caatctcgcagtgcagtggtgcggt

SEQ ID NO: 689307 - DNA, 25 bp, Artificial sequence
  Synthetic oligonucleotide
gatcttgcatggtgcaatctcgcag

SEQ ID NO: 689308 - DNA, 25 bp, Artificial sequence
  Synthetic oligonucleotide
gatcttgcatggagcaatctcgcag

SEQ ID NO: 689309 - DNA, 25 bp, Artificial sequence
  Synthetic oligonucleotide
cgacgttcgatcttgcatggagcaa

SEQ ID NO: 689310 - DNA, 25 bp, Artificial sequence
  Synthetic oligonucleotide
gccgcagaccataatctggcgggag

SEQ ID NO: 689311 - DNA, 25 bp, Artificial sequence
  Synthetic oligonucleotide
cgttagcgactgcgacgttcgatct

SEQ ID NO: 689312 - DNA, 25 bp, Artificial sequence
  Synthetic oligonucleotide
gcgcaggtgacggccttagatctct

SEQ ID NO: 689313 - DNA, 25 bp, Artificial sequence
  Synthetic oligonucleotide
agaaggatgccgcagaccattatct

SEQ ID NO: 689314 - DNA, 25 bp, Artificial sequence
  Synthetic oligonucleotide
agaaggatgccggagaccattatct

SEQ ID NO: 689315 - DNA, 25 bp, Artificial sequence
  Synthetic oligonucleotide
tgttcaggcacggcagaaggatgcc

SEQ ID NO: 689316 - DNA, 25 bp, Artificial sequence
  Synthetic oligonucleotide
tgttcaggcacgccagaaggatgcc

SEQ ID NO: 689317 - DNA, 25 bp, Artificial sequence
  Synthetic oligonucleotide
gccgccaatgctagttcaggcacgc

SEQ ID NO: 689318 - DNA, 25 bp, Artificial sequence
  Synthetic oligonucleotide
gccgccaatgcttgttcaggcacgc

SEQ ID NO: 689319 - DNA, 25 bp, Artificial sequence
  Synthetic oligonucleotide
gccttagatctcacgccgccaatgc

SEQ ID NO: 689320 - DNA, 25 bp, Artificial sequence
  Synthetic oligonucleotide
gccttagatctctcgccgccaatgc

SEQ ID NO: 689321 - DNA, 25 bp, Artificial sequence
  Synthetic oligonucleotide
cgacgttcgatcatgcatggagcaa

SEQ ID NO: 689322 - DNA, 25 bp, Artificial sequence
  Synthetic oligonucleotide
tttgcagattggctaacacaggaac

SEQ ID NO: 689323 - DNA, 25 bp, Artificial sequence
  Synthetic oligonucleotide
gctgggagagatcccctggcttgca

SEQ ID NO: 689324 - DNA, 25 bp, Artificial sequence
  Synthetic oligonucleotide
catgattcccgccccgctgctggga

SEQ ID NO: 689325 - DNA, 25 bp, Artificial sequence
  Synthetic oligonucleotide
catgattcccgcgccgctgctggga

SEQ ID NO: 689326 - DNA, 25 bp, Artificial sequence
  Synthetic oligonucleotide
gattcccgcgcccctgctgggagag

SEQ ID NO: 689327 - DNA, 25 bp, Artificial sequence
  Synthetic oligonucleotide
gattcccgcgccgctgctgggagag

SEQ ID NO: 689328 - DNA, 25 bp, Artificial sequence
  Synthetic oligonucleotide
cgcgccgctgctgggagagatcccc

SEQ ID NO: 689329 - DNA, 25 bp, Artificial sequence
  Synthetic oligonucleotide
cgcgccgctgctcggagagatcccc

SEQ ID NO: 689330 - DNA, 25 bp, Artificial sequence
  Synthetic oligonucleotide
ccgctgctgggacagatcccctggc

SEQ ID NO: 689331 - DNA, 25 bp, Artificial sequence
  Synthetic oligonucleotide
cccgcatgattcccgcgccgctgct

SEQ ID NO: 689332 - DNA, 25 bp, Artificial sequence
  Synthetic oligonucleotide
gctgggagagatgccctggcttgca

SEQ ID NO: 689333 - DNA, 25 bp, Artificial sequence
  Synthetic oligonucleotide
ccgctgctgggagagatcccctggc

SEQ ID NO: 689334 - DNA, 25 bp, Artificial sequence
  Synthetic oligonucleotide
ggagagatccccaggcttgcagaaa

SEQ ID NO: 689335 - DNA, 25 bp, Artificial sequence
  Synthetic oligonucleotide
ggagagatcccctggcttgcagaaa

SEQ ID NO: 689336 - DNA, 25 bp, Artificial sequence
  Synthetic oligonucleotide
gagatcccctggcttgcagaaaatc

SEQ ID NO: 689337 - DNA, 25 bp, Artificial sequence
  Synthetic oligonucleotide
gagatcccctgggttgcagaaaatc

SEQ ID NO: 689338 - DNA, 25 bp, Artificial sequence
  Synthetic oligonucleotide
atcccctggcttgcagaaaatccag

SEQ ID NO: 689339 - DNA, 25 bp, Artificial sequence
  Synthetic oligonucleotide
tgacactttcacatttgcagattgg

SEQ ID NO: 689340 - DNA, 25 bp, Artificial sequence
  Synthetic oligonucleotide
ggtgctggcggcaggtttacgccgc

SEQ ID NO: 689341 - DNA, 25 bp, Artificial sequence
  Synthetic oligonucleotide
ctgctgggagagatcccctggcttg

SEQ ID NO: 689342 - DNA, 25 bp, Artificial sequence
  Synthetic oligonucleotide
ctttctgacactttcacttttgcag

SEQ ID NO: 689343 - DNA, 25 bp, Artificial sequence
  Synthetic oligonucleotide
ctgctgggagagttcccctggcttg

SEQ ID NO: 689344 - DNA, 25 bp, Artificial sequence
  Synthetic oligonucleotide
ctttctgacactatcacttttgcag

SEQ ID NO: 689345 - DNA, 25 bp, Artificial sequence
  Synthetic oligonucleotide
cccgcatgattcgcgcgccgctgct

SEQ ID NO: 689346 - DNA, 25 bp, Artificial sequence
  Synthetic oligonucleotide
tgacactttcacttttgcagattgg

SEQ ID NO: 689347 - DNA, 25 bp, Artificial sequence
  Synthetic oligonucleotide
tttgcagattgggtaacacaggaac

SEQ ID NO: 689348 - DNA, 25 bp, Artificial sequence
  Synthetic oligonucleotide
atcccctggcttccagaaaatccag

SEQ ID NO: 689349 - DNA, 25 bp, Artificial sequence
  Synthetic oligonucleotide
gaaaacgtcacgctgaatatatgac

SEQ ID NO: 689350 - DNA, 25 bp, Artificial sequence
  Synthetic oligonucleotide
gaaaacgtcacggtgaatatatgac

SEQ ID NO: 689351 - DNA, 25 bp, Artificial sequence
  Synthetic oligonucleotide
aaacgtcacgctcaatatatgacca

SEQ ID NO: 689352 - DNA, 25 bp, Artificial sequence
  Synthetic oligonucleotide
aaacgtcacgctgaatatatgacca

SEQ ID NO: 689353 - DNA, 25 bp, Artificial sequence
  Synthetic oligonucleotide
ctgaatatatgaccacgctcacccg

SEQ ID NO: 689354 - DNA, 25 bp, Artificial sequence
  Synthetic oligonucleotide
ggtgctggcggctggtttacgccgc

SEQ ID NO: 689355 - DNA, 25 bp, Artificial sequence
  Synthetic oligonucleotide
gaatatatgacctcgctcacccgca

SEQ ID NO: 689356 - DNA, 25 bp, Artificial sequence
  Synthetic oligonucleotide
ctgaatatatgagcacgctcacccg

SEQ ID NO: 689357 - DNA, 25 bp, Artificial sequence
  Synthetic oligonucleotide
acgctgaatataagaccacgctcac

SEQ ID NO: 689358 - DNA, 25 bp, Artificial sequence
  Synthetic oligonucleotide
acgctgaatatatgaccacgctcac

SEQ ID NO: 689359 - DNA, 25 bp, Artificial sequence
  Synthetic oligonucleotide
cgtcacgctgaatatatgaccacgc

SEQ ID NO: 689360 - DNA, 25 bp, Artificial sequence
  Synthetic oligonucleotide
cgtcacgctgaaaatatgaccacgc

SEQ ID NO: 689361 - DNA, 25 bp, Artificial sequence
  Synthetic oligonucleotide
gaatatatgaccacgctcacccgca

SEQ ID NO: 689362 - DNA, 25 bp, Artificial sequence
  Synthetic oligonucleotide
catgattcccgccccgctgctggga

SEQ ID NO: 689363 - DNA, 25 bp, Artificial sequence
  Synthetic oligonucleotide
ggagagatcccctggcttgcagaaa

SEQ ID NO: 689364 - DNA, 25 bp, Artificial sequence
  Synthetic oligonucleotide
cccgcatgattcccgcgccgctgct

SEQ ID NO: 689365 - DNA, 25 bp, Artificial sequence
  Synthetic oligonucleotide
ccgctgctgggacagatcccctggc

SEQ ID NO: 689366 - DNA, 25 bp, Artificial sequence
  Synthetic oligonucleotide
catgattcccgcgccgctgctggga

SEQ ID NO: 689367 - DNA, 25 bp, Artificial sequence
  Synthetic oligonucleotide
gattcccgcgcccctgctgggagag

SEQ ID NO: 689368 - DNA, 25 bp, Artificial sequence
  Synthetic oligonucleotide
gattcccgcgccgctgctgggagag

SEQ ID NO: 689369 - DNA, 25 bp, Artificial sequence
  Synthetic oligonucleotide
cgcgccgctgctgggagagatcccc

SEQ ID NO: 689370 - DNA, 25 bp, Artificial sequence
  Synthetic oligonucleotide
cgcgccgctgctcggagagatcccc

SEQ ID NO: 689371 - DNA, 25 bp, Artificial sequence
  Synthetic oligonucleotide
ccgctgctgggagagatcccctggc

SEQ ID NO: 689372 - DNA, 25 bp, Artificial sequence
  Synthetic oligonucleotide
ctgctgggagagatcccctggcttg

SEQ ID NO: 689373 - DNA, 25 bp, Artificial sequence
  Synthetic oligonucleotide
ctgctgggagagttcccctggcttg

SEQ ID NO: 689374 - DNA, 25 bp, Artificial sequence
  Synthetic oligonucleotide
gctgggagagatcccctggcttgca

SEQ ID NO: 689375 - DNA, 25 bp, Artificial sequence
  Synthetic oligonucleotide
ggagagatccccaggcttgcagaaa

SEQ ID NO: 689376 - DNA, 25 bp, Artificial sequence
  Synthetic oligonucleotide
gaatatatgaccacgctcacccgca

SEQ ID NO: 689377 - DNA, 25 bp, Artificial sequence
  Synthetic oligonucleotide
gagatcccctggcttgcagaaaatc

SEQ ID NO: 689378 - DNA, 25 bp, Artificial sequence
  Synthetic oligonucleotide
gagatcccctgggttgcagaaaatc

SEQ ID NO: 689379 - DNA, 25 bp, Artificial sequence
  Synthetic oligonucleotide
atcccctggcttccagaaaatccag

SEQ ID NO: 689380 - DNA, 25 bp, Artificial sequence
  Synthetic oligonucleotide
gaatatatgacctcgctcacccgca

SEQ ID NO: 689381 - DNA, 25 bp, Artificial sequence
  Synthetic oligonucleotide
gctgggagagatgccctggcttgca

SEQ ID NO: 689382 - DNA, 25 bp, Artificial sequence
  Synthetic oligonucleotide
tttgcagattgggtaacacaggaac

SEQ ID NO: 689383 - DNA, 25 bp, Artificial sequence
  Synthetic oligonucleotide
cccgcatgattcgcgcgccgctgct

SEQ ID NO: 689384 - DNA, 25 bp, Artificial sequence
  Synthetic oligonucleotide
ggtgctggcggcaggtttacgccgc

SEQ ID NO: 689385 - DNA, 25 bp, Artificial sequence
  Synthetic oligonucleotide
atcccctggcttgcagaaaatccag

SEQ ID NO: 689386 - DNA, 25 bp, Artificial sequence
  Synthetic oligonucleotide
ggtgctggcggctggtttacgccgc

SEQ ID NO: 689387 - DNA, 25 bp, Artificial sequence
  Synthetic oligonucleotide
ctttctgacactttcacttttgcag

SEQ ID NO: 689388 - DNA, 25 bp, Artificial sequence
  Synthetic oligonucleotide
tgacactttcacttttgcagattgg

SEQ ID NO: 689389 - DNA, 25 bp, Artificial sequence
  Synthetic oligonucleotide
tgacactttcacatttgcagattgg

SEQ ID NO: 689390 - DNA, 25 bp, Artificial sequence
  Synthetic oligonucleotide
ctttctgacactatcacttttgcag

SEQ ID NO: 689391 - DNA, 25 bp, Artificial sequence
  Synthetic oligonucleotide
tttgcagattggctaacacaggaac

SEQ ID NO: 689392 - DNA, 25 bp, Artificial sequence
  Synthetic oligonucleotide
gaaaacgtcacgctgaatatatgac

SEQ ID NO: 689393 - DNA, 25 bp, Artificial sequence
  Synthetic oligonucleotide
acgctgaatatatgaccacgctcac

SEQ ID NO: 689394 - DNA, 25 bp, Artificial sequence
  Synthetic oligonucleotide
aaacgtcacgctcaatatatgacca

SEQ ID NO: 689395 - DNA, 25 bp, Artificial sequence
  Synthetic oligonucleotide
aaacgtcacgctgaatatatgacca

SEQ ID NO: 689396 - DNA, 25 bp, Artificial sequence
  Synthetic oligonucleotide
cgtcacgctgaaaatatgaccacgc

SEQ ID NO: 689397 - DNA, 25 bp, Artificial sequence
  Synthetic oligonucleotide
ctgaatatatgaccacgctcacccg

SEQ ID NO: 689398 - DNA, 25 bp, Artificial sequence
  Synthetic oligonucleotide
cgtcacgctgaatatatgaccacgc

SEQ ID NO: 689399 - DNA, 25 bp, Artificial sequence
  Synthetic oligonucleotide
gaaaacgtcacggtgaatatatgac

SEQ ID NO: 689400 - DNA, 25 bp, Artificial sequence
  Synthetic oligonucleotide
ctgaatatatgagcacgctcacccg

SEQ ID NO: 689401 - DNA, 25 bp, Artificial sequence
  Synthetic oligonucleotide
acgctgaatataagaccacgctcac

SEQ ID NO: 689402 - DNA, 25 bp, Artificial sequence
  Synthetic oligonucleotide
cgcaatagcgacccgctggcgttac

SEQ ID NO: 689403 - DNA, 25 bp, Artificial sequence
  Synthetic oligonucleotide
gcgctggcgttagagcgcaacagca

SEQ ID NO: 689404 - DNA, 25 bp, Artificial sequence
  Synthetic oligonucleotide
cgcaatagcgacgcgctggcgttac

SEQ ID NO: 689405 - DNA, 25 bp, Artificial sequence
  Synthetic oligonucleotide
gcgctggcgttacagcgcaacagca

SEQ ID NO: 689406 - DNA, 25 bp, Artificial sequence
  Synthetic oligonucleotide
gcgacgcgctggggttacagcgcaa

SEQ ID NO: 689407 - DNA, 25 bp, Artificial sequence
  Synthetic oligonucleotide
gcgacgcgctggcgttacagcgcaa

SEQ ID NO: 689408 - DNA, 25 bp, Artificial sequence
  Synthetic oligonucleotide
aggtttacgcaaaagcgacgcgctg

SEQ ID NO: 689409 - DNA, 25 bp, Artificial sequence
  Synthetic oligonucleotide
atgagcgccggaatacgcgcgcttg

SEQ ID NO: 689410 - DNA, 25 bp, Artificial sequence
  Synthetic oligonucleotide
aggtttacgcaatagcgacgcgctg

SEQ ID NO: 689411 - DNA, 25 bp, Artificial sequence
  Synthetic oligonucleotide
gcaaaggcagcacgctaccggacgg

SEQ ID NO: 689412 - DNA, 25 bp, Artificial sequence
  Synthetic oligonucleotide
gcaaaggcagcaggctaccggacgg

SEQ ID NO: 689413 - DNA, 25 bp, Artificial sequence
  Synthetic oligonucleotide
caagccgcaaaggcagcaggctacc

SEQ ID NO: 689414 - DNA, 25 bp, Artificial sequence
  Synthetic oligonucleotide
caagccgcaaagccagcaggctacc

SEQ ID NO: 689415 - DNA, 25 bp, Artificial sequence
  Synthetic oligonucleotide
cgttacagcgcatcagcagcctgca

SEQ ID NO: 689416 - DNA, 25 bp, Artificial sequence
  Synthetic oligonucleotide
cacttttacaagccgcaaaggcagc

SEQ ID NO: 689417 - DNA, 25 bp, Artificial sequence
  Synthetic oligonucleotide
ttggtaatgagcgccggattacgcg

SEQ ID NO: 689418 - DNA, 25 bp, Artificial sequence
  Synthetic oligonucleotide
cgccagttgtgcacttttacaagcc

SEQ ID NO: 689419 - DNA, 25 bp, Artificial sequence
  Synthetic oligonucleotide
cgccagttgtgctcttttacaagcc

SEQ ID NO: 689420 - DNA, 25 bp, Artificial sequence
  Synthetic oligonucleotide
gggaaaactgtccccagttgtgcac

SEQ ID NO: 689421 - DNA, 25 bp, Artificial sequence
  Synthetic oligonucleotide
cacttttacaaggcgcaaaggcagc

SEQ ID NO: 689422 - DNA, 25 bp, Artificial sequence
  Synthetic oligonucleotide
agaatcattggttatgagcgccgga

SEQ ID NO: 689423 - DNA, 25 bp, Artificial sequence
  Synthetic oligonucleotide
gggaaaactgtcgccagttgtgcac

SEQ ID NO: 689424 - DNA, 25 bp, Artificial sequence
  Synthetic oligonucleotide
cgcaagagggcacaccgatagaatc

SEQ ID NO: 689425 - DNA, 25 bp, Artificial sequence
  Synthetic oligonucleotide
catcagcgcgcatgagggcagaccg

SEQ ID NO: 689426 - DNA, 25 bp, Artificial sequence
  Synthetic oligonucleotide
cgcaagagggcagaccgatagaatc

SEQ ID NO: 689427 - DNA, 25 bp, Artificial sequence
  Synthetic oligonucleotide
gggcagaccgatagaatcattggta

SEQ ID NO: 689428 - DNA, 25 bp, Artificial sequence
  Synthetic oligonucleotide
gggcagaccgattgaatcattggta

SEQ ID NO: 689429 - DNA, 25 bp, Artificial sequence
  Synthetic oligonucleotide
gaccgatagaatgattggtaatgag

SEQ ID NO: 689430 - DNA, 25 bp, Artificial sequence
  Synthetic oligonucleotide
gaccgatagaatcattggtaatgag

SEQ ID NO: 689431 - DNA, 25 bp, Artificial sequence
  Synthetic oligonucleotide
atgagcgccggattacgcgcgcttg

SEQ ID NO: 689432 - DNA, 25 bp, Artificial sequence
  Synthetic oligonucleotide
agaatcattggtaatgagcgccgga

SEQ ID NO: 689433 - DNA, 25 bp, Artificial sequence
  Synthetic oligonucleotide
catcagcgcgcaagagggcagaccg

SEQ ID NO: 689434 - DNA, 25 bp, Artificial sequence
  Synthetic oligonucleotide
ttggtaatgagccccggattacgcg

SEQ ID NO: 689435 - DNA, 25 bp, Artificial sequence
  Synthetic oligonucleotide
ctgcagctggataacgcaacagtaa

SEQ ID NO: 689436 - DNA, 25 bp, Artificial sequence
  Synthetic oligonucleotide
ctgcagctggattacgcaacagtaa

SEQ ID NO: 689437 - DNA, 25 bp, Artificial sequence
  Synthetic oligonucleotide
cagcagcctgcacctggattacgca

SEQ ID NO: 689438 - DNA, 25 bp, Artificial sequence
  Synthetic oligonucleotide
cagcagcctgcagctggattacgca

SEQ ID NO: 689439 - DNA, 25 bp, Artificial sequence
  Synthetic oligonucleotide
agcgcaacagcaccctgcagctgga

SEQ ID NO: 689440 - DNA, 25 bp, Artificial sequence
  Synthetic oligonucleotide
agcgcaacagcagcctgcagctgga

SEQ ID NO: 689441 - DNA, 25 bp, Artificial sequence
  Synthetic oligonucleotide
cgttacagcgcaacagcagcctgca

SEQ ID NO: 689442 - DNA, 25 bp, Artificial sequence
  Synthetic oligonucleotide
cgccagttgtgctcttttacaagcc

SEQ ID NO: 689443 - DNA, 25 bp, Artificial sequence
  Synthetic oligonucleotide
gcaaaggcagcaggctaccggacgg

SEQ ID NO: 689444 - DNA, 25 bp, Artificial sequence
  Synthetic oligonucleotide
atgagcgccggaatacgcgcgcttg

SEQ ID NO: 689445 - DNA, 25 bp, Artificial sequence
  Synthetic oligonucleotide
gcgctggcgttagagcgcaacagca

SEQ ID NO: 689446 - DNA, 25 bp, Artificial sequence
  Synthetic oligonucleotide
cacttttacaagccgcaaaggcagc

SEQ ID NO: 689447 - DNA, 25 bp, Artificial sequence
  Synthetic oligonucleotide
gcgacgcgctggggttacagcgcaa

SEQ ID NO: 689448 - DNA, 25 bp, Artificial sequence
  Synthetic oligonucleotide
gcgacgcgctggcgttacagcgcaa

SEQ ID NO: 689449 - DNA, 25 bp, Artificial sequence
  Synthetic oligonucleotide
cgcaatagcgacgcgctggcgttac

SEQ ID NO: 689450 - DNA, 25 bp, Artificial sequence
  Synthetic oligonucleotide
cgcaatagcgacccgctggcgttac

SEQ ID NO: 689451 - DNA, 25 bp, Artificial sequence
  Synthetic oligonucleotide
cgttacagcgcatcagcagcctgca

SEQ ID NO: 689452 - DNA, 25 bp, Artificial sequence
  Synthetic oligonucleotide
aggtttacgcaatagcgacgcgctg

SEQ ID NO: 689453 - DNA, 25 bp, Artificial sequence
  Synthetic oligonucleotide
cgttacagcgcaacagcagcctgca

SEQ ID NO: 689454 - DNA, 25 bp, Artificial sequence
  Synthetic oligonucleotide
gcaaaggcagcacgctaccggacgg

SEQ ID NO: 689455 - DNA, 25 bp, Artificial sequence
  Synthetic oligonucleotide
caagccgcaaaggcagcaggctacc

SEQ ID NO: 689456 - DNA, 25 bp, Artificial sequence
  Synthetic oligonucleotide
caagccgcaaagccagcaggctacc

SEQ ID NO: 689457 - DNA, 25 bp, Artificial sequence
  Synthetic oligonucleotide
cacttttacaaggcgcaaaggcagc

SEQ ID NO: 689458 - DNA, 25 bp, Artificial sequence
  Synthetic oligonucleotide
cgccagttgtgcacttttacaagcc

SEQ ID NO: 689459 - DNA, 25 bp, Artificial sequence
  Synthetic oligonucleotide
gggaaaactgtcgccagttgtgcac

SEQ ID NO: 689460 - DNA, 25 bp, Artificial sequence
  Synthetic oligonucleotide
gggaaaactgtccccagttgtgcac

SEQ ID NO: 689461 - DNA, 25 bp, Artificial sequence
  Synthetic oligonucleotide
aggtttacgcaaaagcgacgcgctg

SEQ ID NO: 689462 - DNA, 25 bp, Artificial sequence
  Synthetic oligonucleotide
gggcagaccgattgaatcattggta

SEQ ID NO: 689463 - DNA, 25 bp, Artificial sequence
  Synthetic oligonucleotide
atgagcgccggattacgcgcgcttg

SEQ ID NO: 689464 - DNA, 25 bp, Artificial sequence
  Synthetic oligonucleotide
ttggtaatgagcgccggattacgcg

SEQ ID NO: 689465 - DNA, 25 bp, Artificial sequence
  Synthetic oligonucleotide
ttggtaatgagccccggattacgcg

SEQ ID NO: 689466 - DNA, 25 bp, Artificial sequence
  Synthetic oligonucleotide
agaatcattggtaatgagcgccgga

SEQ ID NO: 689467 - DNA, 25 bp, Artificial sequence
  Synthetic oligonucleotide
agaatcattggttatgagcgccgga

SEQ ID NO: 689468 - DNA, 25 bp, Artificial sequence
  Synthetic oligonucleotide
gcgctggcgttacagcgcaacagca

SEQ ID NO: 689469 - DNA, 25 bp, Artificial sequence
  Synthetic oligonucleotide
gaccgatagaatcattggtaatgag

SEQ ID NO: 689470 - DNA, 25 bp, Artificial sequence
  Synthetic oligonucleotide
agcgcaacagcaccctgcagctgga

SEQ ID NO: 689471 - DNA, 25 bp, Artificial sequence
  Synthetic oligonucleotide
gggcagaccgatagaatcattggta

SEQ ID NO: 689472 - DNA, 25 bp, Artificial sequence
  Synthetic oligonucleotide
cgcaagagggcagaccgatagaatc

SEQ ID NO: 689473 - DNA, 25 bp, Artificial sequence
  Synthetic oligonucleotide
cgcaagagggcacaccgatagaatc

SEQ ID NO: 689474 - DNA, 25 bp, Artificial sequence
  Synthetic oligonucleotide
catcagcgcgcaagagggcagaccg

SEQ ID NO: 689475 - DNA, 25 bp, Artificial sequence
  Synthetic oligonucleotide
catcagcgcgcatgagggcagaccg

SEQ ID NO: 689476 - DNA, 25 bp, Artificial sequence
  Synthetic oligonucleotide
ctgcagctggattacgcaacagtaa

SEQ ID NO: 689477 - DNA, 25 bp, Artificial sequence
  Synthetic oligonucleotide
ctgcagctggataacgcaacagtaa

SEQ ID NO: 689478 - DNA, 25 bp, Artificial sequence
  Synthetic oligonucleotide
cagcagcctgcagctggattacgca

SEQ ID NO: 689479 - DNA, 25 bp, Artificial sequence
  Synthetic oligonucleotide
cagcagcctgcacctggattacgca

SEQ ID NO: 689480 - DNA, 25 bp, Artificial sequence
  Synthetic oligonucleotide
agcgcaacagcagcctgcagctgga

SEQ ID NO: 689481 - DNA, 25 bp, Artificial sequence
  Synthetic oligonucleotide
gaccgatagaatgattggtaatgag

SEQ ID NO: 689482 - DNA, 25 bp, Artificial sequence
  Synthetic oligonucleotide
cggtgcccgccggtccgcagaccct

SEQ ID NO: 689483 - DNA, 25 bp, Artificial sequence
  Synthetic oligonucleotide
cagcgaccagccctgagcggagctg

SEQ ID NO: 689484 - DNA, 25 bp, Artificial sequence
  Synthetic oligonucleotide
gcctcctccacacgcgcggcggccg

SEQ ID NO: 689485 - DNA, 25 bp, Artificial sequence
  Synthetic oligonucleotide
ccgcggaccggacgctgagggcact

SEQ ID NO: 689486 - DNA, 25 bp, Artificial sequence
  Synthetic oligonucleotide
cgcgcgctcgggcagacgtttgcgg

SEQ ID NO: 689487 - DNA, 25 bp, Artificial sequence
  Synthetic oligonucleotide
agaacaatcgtttctgttggaagaa

SEQ ID NO: 689488 - DNA, 25 bp, Artificial sequence
  Synthetic oligonucleotide
accgggccgtctcccagttctgagg

SEQ ID NO: 689489 - DNA, 25 bp, Artificial sequence
  Synthetic oligonucleotide
cgtctcccagttctgaggcccgggt

SEQ ID NO: 689490 - DNA, 25 bp, Artificial sequence
  Synthetic oligonucleotide
tgaggcccgggtcccactggaactc

SEQ ID NO: 689491 - DNA, 25 bp, Artificial sequence
  Synthetic oligonucleotide
gggtcccactggaactcgcgtctga

SEQ ID NO: 689492 - DNA, 25 bp, Artificial sequence
  Synthetic oligonucleotide
actggaactcgcgtctgagccgccg

SEQ ID NO: 689493 - DNA, 25 bp, Artificial sequence
  Synthetic oligonucleotide
gccgggactgacgtgtagaacaatc

SEQ ID NO: 689494 - DNA, 25 bp, Artificial sequence
  Synthetic oligonucleotide
tgaccgggccgtctcccagttctga

SEQ ID NO: 689495 - DNA, 25 bp, Artificial sequence
  Synthetic oligonucleotide
cgtgtagaacaatcgtttctgttgg

SEQ ID NO: 689496 - DNA, 25 bp, Artificial sequence
  Synthetic oligonucleotide
cgggactgacgtgtagaacaatcgt

SEQ ID NO: 689497 - DNA, 25 bp, Artificial sequence
  Synthetic oligonucleotide
caatcgtttctgttggaagaagggt

SEQ ID NO: 689498 - DNA, 25 bp, Artificial sequence
  Synthetic oligonucleotide
tggagaagggaagtcggaacacaag

SEQ ID NO: 689499 - DNA, 25 bp, Artificial sequence
  Synthetic oligonucleotide
aggaaggaccgctcacccgcggact

SEQ ID NO: 689500 - DNA, 25 bp, Artificial sequence
  Synthetic oligonucleotide
ctcacccgcggactcagggctggcg

SEQ ID NO: 689501 - DNA, 25 bp, Artificial sequence
  Synthetic oligonucleotide
agccctgagcggagctgttggccgc

SEQ ID NO: 689502 - DNA, 25 bp, Artificial sequence
  Synthetic oligonucleotide
gtcccactggaactcgcgtctgagc

SEQ ID NO: 689503 - DNA, 25 bp, Artificial sequence
  Synthetic oligonucleotide
gactgacgtgtagaacaatcgtttc

SEQ ID NO: 689504 - DNA, 25 bp, Artificial sequence
  Synthetic oligonucleotide
gctcggccgtgttcatacttgtccg

SEQ ID NO: 689505 - DNA, 25 bp, Artificial sequence
  Synthetic oligonucleotide
ctgacgtgtagaacaatcgtttctg

SEQ ID NO: 689506 - DNA, 25 bp, Artificial sequence
  Synthetic oligonucleotide
cgtccgcggcggagcgtttgctcct

SEQ ID NO: 689507 - DNA, 25 bp, Artificial sequence
  Synthetic oligonucleotide
cgaggacgaagttgaccctgaccgg

SEQ ID NO: 689508 - DNA, 25 bp, Artificial sequence
  Synthetic oligonucleotide
cccagcgaagttgggctctccaggt

SEQ ID NO: 689509 - DNA, 25 bp, Artificial sequence
  Synthetic oligonucleotide
tagcgacgtcgcggacccggcctgt

SEQ ID NO: 689510 - DNA, 25 bp, Artificial sequence
  Synthetic oligonucleotide
cccggagaagactgcgctcggccgt

SEQ ID NO: 689511 - DNA, 25 bp, Artificial sequence
  Synthetic oligonucleotide
tgcgctcggccgtgttcatacttgt

SEQ ID NO: 689512 - DNA, 25 bp, Artificial sequence
  Synthetic oligonucleotide
agcgtttgctcctgggacaggcggt

SEQ ID NO: 689513 - DNA, 25 bp, Artificial sequence
  Synthetic oligonucleotide
tcggccgtgttcatacttgtccgtg

SEQ ID NO: 689514 - DNA, 25 bp, Artificial sequence
  Synthetic oligonucleotide
cccggaggatgacctagcactgaaa

SEQ ID NO: 689515 - DNA, 25 bp, Artificial sequence
  Synthetic oligonucleotide
ccgaggacgaagttgaccctgaccg

SEQ ID NO: 689516 - DNA, 25 bp, Artificial sequence
  Synthetic oligonucleotide
gaagactgcgctcggccgtgttcat

SEQ ID NO: 689517 - DNA, 25 bp, Artificial sequence
  Synthetic oligonucleotide
ggaggatgacctagcactgaaaagc

SEQ ID NO: 689518 - DNA, 25 bp, Artificial sequence
  Synthetic oligonucleotide
tcatacttgtccgtgggcctgaggt

SEQ ID NO: 689519 - DNA, 25 bp, Artificial sequence
  Synthetic oligonucleotide
tgttcatacttgtccgtgggcctga

SEQ ID NO: 689520 - DNA, 25 bp, Artificial sequence
  Synthetic oligonucleotide
ccgtgttcatacttgtccgtgggcc

SEQ ID NO: 689521 - DNA, 25 bp, Artificial sequence
  Synthetic oligonucleotide
aggatgacctagcactgaaaagccc

SEQ ID NO: 689522 - DNA, 25 bp, Artificial sequence
  Synthetic oligonucleotide
gtgcgcaccgtttgcgacttggtga

SEQ ID NO: 689523 - DNA, 25 bp, Artificial sequence
  Synthetic oligonucleotide
cctgcaggcgccctcacttcgccgt

SEQ ID NO: 689524 - DNA, 25 bp, Artificial sequence
  Synthetic oligonucleotide
ccatccgggtcaggcgcacagggca

SEQ ID NO: 689525 - DNA, 25 bp, Artificial sequence
  Synthetic oligonucleotide
cggaagagtgcggagctctccctcg

SEQ ID NO: 689526 - DNA, 25 bp, Artificial sequence
  Synthetic oligonucleotide
gctcccggaagagtgcggagctctc

SEQ ID NO: 689527 - DNA, 25 bp, Artificial sequence
  Synthetic oligonucleotide
cctcgctcccggaagagtgcggagc

SEQ ID NO: 689528 - DNA, 25 bp, Artificial sequence
  Synthetic oligonucleotide
tgagtgtctgggtcgcctcgctccc

SEQ ID NO: 689529 - DNA, 25 bp, Artificial sequence
  Synthetic oligonucleotide
acttggtgagtgtctgggtcgcctc

SEQ ID NO: 689530 - DNA, 25 bp, Artificial sequence
  Synthetic oligonucleotide
caccgtttgcgacttggtgagtgtc

SEQ ID NO: 689531 - DNA, 25 bp, Artificial sequence
  Synthetic oligonucleotide
tcgcggtgcgcaccgtttgcgactt

SEQ ID NO: 689532 - DNA, 25 bp, Artificial sequence
  Synthetic oligonucleotide
caggtcctcgcggtgcgcaccgttt

SEQ ID NO: 689533 - DNA, 25 bp, Artificial sequence
  Synthetic oligonucleotide
aacgctttgcgtcccgacgcccgca

SEQ ID NO: 689534 - DNA, 25 bp, Artificial sequence
  Synthetic oligonucleotide
ccctagaacgctttgcgtcccgacg

SEQ ID NO: 689535 - DNA, 25 bp, Artificial sequence
  Synthetic oligonucleotide
cccggatatgctgggacagcccgcg

SEQ ID NO: 689536 - DNA, 25 bp, Artificial sequence
  Synthetic oligonucleotide
tgcttttctcaggtcctcggctccg

SEQ ID NO: 689537 - DNA, 25 bp, Artificial sequence
  Synthetic oligonucleotide
cgccgcacagggcatgcgccgaccc

SEQ ID NO: 689538 - DNA, 25 bp, Artificial sequence
  Synthetic oligonucleotide
ctcacttcgccgtcgggtgtggggc

SEQ ID NO: 689539 - DNA, 25 bp, Artificial sequence
  Synthetic oligonucleotide
agcaggaccgggattctcactaagc

SEQ ID NO: 689540 - DNA, 25 bp, Artificial sequence
  Synthetic oligonucleotide
gatgcgcagactgcctcaggcccgg

SEQ ID NO: 689541 - DNA, 25 bp, Artificial sequence
  Synthetic oligonucleotide
tctcttgcttttctcaggtcctcgg

SEQ ID NO: 689542 - DNA, 25 bp, Artificial sequence
  Synthetic oligonucleotide
gcacgtggcaggtcgcttgcacgcc

SEQ ID NO: 689543 - DNA, 25 bp, Artificial sequence
  Synthetic oligonucleotide
tgccggcgtccagcgaggatgcgca

SEQ ID NO: 689544 - DNA, 25 bp, Artificial sequence
  Synthetic oligonucleotide
cgcgctccgggctcagcgtagccgc

SEQ ID NO: 689545 - DNA, 25 bp, Artificial sequence
  Synthetic oligonucleotide
accgggattctcactaagcgggcgc

SEQ ID NO: 689546 - DNA, 25 bp, Artificial sequence
  Synthetic oligonucleotide
cgaggatgcgcagactgcctcaggc

SEQ ID NO: 689547 - DNA, 25 bp, Artificial sequence
  Synthetic oligonucleotide
tcactaagcgggcgccgtcctacga

SEQ ID NO: 689548 - DNA, 25 bp, Artificial sequence
  Synthetic oligonucleotide
gcgcgctttcaggaccactcgggca

SEQ ID NO: 689549 - DNA, 25 bp, Artificial sequence
  Synthetic oligonucleotide
cgctttcaggaccactcgggcacgt

SEQ ID NO: 689550 - DNA, 25 bp, Artificial sequence
  Synthetic oligonucleotide
gattctcactaagcgggcgccgtcc

SEQ ID NO: 689551 - DNA, 25 bp, Artificial sequence
  Synthetic oligonucleotide
accactcgggcacgtggcaggtcgc

SEQ ID NO: 689552 - DNA, 25 bp, Artificial sequence
  Synthetic oligonucleotide
cttgtaccggccgaagggccatccg

SEQ ID NO: 689553 - DNA, 25 bp, Artificial sequence
  Synthetic oligonucleotide
aggtcgcttgcacgcccgcggacta

SEQ ID NO: 689554 - DNA, 25 bp, Artificial sequence
  Synthetic oligonucleotide
cccgcggactatccctgtgacagga

SEQ ID NO: 689555 - DNA, 25 bp, Artificial sequence
  Synthetic oligonucleotide
cgcggactatccctgtgacaggaaa

SEQ ID NO: 689556 - DNA, 25 bp, Artificial sequence
  Synthetic oligonucleotide
atccctgtgacaggaaaaggtacgg

SEQ ID NO: 689557 - DNA, 25 bp, Artificial sequence
  Synthetic oligonucleotide
ctgtgacaggaaaaggtacgggcca

SEQ ID NO: 689558 - DNA, 25 bp, Artificial sequence
  Synthetic oligonucleotide
tacgggccatttggcaaactaaggc

SEQ ID NO: 689559 - DNA, 25 bp, Artificial sequence
  Synthetic oligonucleotide
ggccatttggcaaactaaggcacag

SEQ ID NO: 689560 - DNA, 25 bp, Artificial sequence
  Synthetic oligonucleotide
gcacagagcctcaggcggaagctgg

SEQ ID NO: 689561 - DNA, 25 bp, Artificial sequence
  Synthetic oligonucleotide
ttcaggaccactcgggcacgtggca

SEQ ID NO: 689562 - DNA, 25 bp, Artificial sequence
  Synthetic oligonucleotide
agcatcagaccataagcagcgccgc

SEQ ID NO: 689563 - DNA, 25 bp, Artificial sequence
  Synthetic oligonucleotide
tgcatgggattcgtctttgggtccc

SEQ ID NO: 689564 - DNA, 25 bp, Artificial sequence
  Synthetic oligonucleotide
tcggaactcgcccagcatgtcgggt

SEQ ID NO: 689565 - DNA, 25 bp, Artificial sequence
  Synthetic oligonucleotide
ttcactgacgcgactttccaagacg

SEQ ID NO: 689566 - DNA, 25 bp, Artificial sequence
  Synthetic oligonucleotide
cgggcttcactgacgcgactttcca

SEQ ID NO: 689567 - DNA, 25 bp, Artificial sequence
  Synthetic oligonucleotide
gaagccacgggcttcactgacgcga

SEQ ID NO: 689568 - DNA, 25 bp, Artificial sequence
  Synthetic oligonucleotide
ggctcgctcgcgaagccacgggctt

SEQ ID NO: 689569 - DNA, 25 bp, Artificial sequence
  Synthetic oligonucleotide
aagatgtgcgagtcagccggaccct

SEQ ID NO: 689570 - DNA, 25 bp, Artificial sequence
  Synthetic oligonucleotide
agccatgaagatgtgcgagtcagcc

SEQ ID NO: 689571 - DNA, 25 bp, Artificial sequence
  Synthetic oligonucleotide
cagaggacatcggttcggagccaga

SEQ ID NO: 689572 - DNA, 25 bp, Artificial sequence
  Synthetic oligonucleotide
cgcccagcaaacagtgggtgagcca

SEQ ID NO: 689573 - DNA, 25 bp, Artificial sequence
  Synthetic oligonucleotide
gacatcggttcggagccagatcacg

SEQ ID NO: 689574 - DNA, 25 bp, Artificial sequence
  Synthetic oligonucleotide
acctctgcatgggattcgtctttgg

SEQ ID NO: 689575 - DNA, 25 bp, Artificial sequence
  Synthetic oligonucleotide
cccaaacctctgcatgggattcgtc

SEQ ID NO: 689576 - DNA, 25 bp, Artificial sequence
  Synthetic oligonucleotide
tgccaaaactagacccaaacctctg

SEQ ID NO: 689577 - DNA, 25 bp, Artificial sequence
  Synthetic oligonucleotide
ttttctgttgccaaaactagaccca

SEQ ID NO: 689578 - DNA, 25 bp, Artificial sequence
  Synthetic oligonucleotide
cctccccggccgaatggatggtggt

SEQ ID NO: 689579 - DNA, 25 bp, Artificial sequence
  Synthetic oligonucleotide
ctgctcgtacctccgggcgcccagc

SEQ ID NO: 689580 - DNA, 25 bp, Artificial sequence
  Synthetic oligonucleotide
ccggccagggtcctgctcgtacctc

SEQ ID NO: 689581 - DNA, 25 bp, Artificial sequence
  Synthetic oligonucleotide
cccagatcgcgcagaccctgacatc

SEQ ID NO: 689582 - DNA, 25 bp, Artificial sequence
  Synthetic oligonucleotide
gcaaacagtgggtgagccatgaaga

SEQ ID NO: 689583 - DNA, 25 bp, Artificial sequence
  Synthetic oligonucleotide
ttcggcctgacctagcgcaggtctg

SEQ ID NO: 689584 - DNA, 25 bp, Artificial sequence
  Synthetic oligonucleotide
tggcaagccctgcttggcggaaagc

SEQ ID NO: 689585 - DNA, 25 bp, Artificial sequence
  Synthetic oligonucleotide
agaggctctccgcgggatcctctgc

SEQ ID NO: 689586 - DNA, 25 bp, Artificial sequence
  Synthetic oligonucleotide
agtgttcgcgtcctgggtgacccct

SEQ ID NO: 689587 - DNA, 25 bp, Artificial sequence
  Synthetic oligonucleotide
ttccaaacaccgaacgggatccaga

SEQ ID NO: 689588 - DNA, 25 bp, Artificial sequence
  Synthetic oligonucleotide
gacgcccgcgagctccttccaaaca

SEQ ID NO: 689589 - DNA, 25 bp, Artificial sequence
  Synthetic oligonucleotide
actccaagcgcaccgacgcccgcga

SEQ ID NO: 689590 - DNA, 25 bp, Artificial sequence
  Synthetic oligonucleotide
tgcgcgcagagaacaactccaagcg

SEQ ID NO: 689591 - DNA, 25 bp, Artificial sequence
  Synthetic oligonucleotide
tgacgcgactttccaagacgtgggg

SEQ ID NO: 689592 - DNA, 25 bp, Artificial sequence
  Synthetic oligonucleotide
acctagcgcaggtctggtgcgcgca

SEQ ID NO: 689593 - DNA, 25 bp, Artificial sequence
  Synthetic oligonucleotide
tgcttggcggaaagcagccgttccc

SEQ ID NO: 689594 - DNA, 25 bp, Artificial sequence
  Synthetic oligonucleotide
gagcttcggcctgacctagcgcagg

SEQ ID NO: 689595 - DNA, 25 bp, Artificial sequence
  Synthetic oligonucleotide
cccgatggcctaggaggagcaggcg

SEQ ID NO: 689596 - DNA, 25 bp, Artificial sequence
  Synthetic oligonucleotide
atgtcgggtcccctagccagggcct

SEQ ID NO: 689597 - DNA, 25 bp, Artificial sequence
  Synthetic oligonucleotide
ggaactcgcccagcatgtcgggtcc

SEQ ID NO: 689598 - DNA, 25 bp, Artificial sequence
  Synthetic oligonucleotide
cactgagagccgctcggaactcgcc

SEQ ID NO: 689599 - DNA, 25 bp, Artificial sequence
  Synthetic oligonucleotide
atcacgggccccataagcatcagac

SEQ ID NO: 689600 - DNA, 25 bp, Artificial sequence
  Synthetic oligonucleotide
cggttcggagccagatcacgggccc

SEQ ID NO: 689601 - DNA, 25 bp, Artificial sequence
  Synthetic oligonucleotide
tctggtgcgcgcagagaacaactcc

SEQ ID NO: 689602 - DNA, 25 bp, Artificial sequence
  Synthetic oligonucleotide
gattcagccagttgacagaactaag

SEQ ID NO: 689603 - DNA, 25 bp, Artificial sequence
  Synthetic oligonucleotide
cacgggacaccagttccctggcgtg

SEQ ID NO: 689604 - DNA, 25 bp, Artificial sequence
  Synthetic oligonucleotide
agcgaaaatgccaacaaacggcccg

SEQ ID NO: 689605 - DNA, 25 bp, Artificial sequence
  Synthetic oligonucleotide
aatgccaacaaacggcccgcatgtt

SEQ ID NO: 689606 - DNA, 25 bp, Artificial sequence
  Synthetic oligonucleotide
agcatcctcggctcctgcctcacta

SEQ ID NO: 689607 - DNA, 25 bp, Artificial sequence
  Synthetic oligonucleotide
ctcggctcctgcctcactagctgcg

SEQ ID NO: 689608 - DNA, 25 bp, Artificial sequence
  Synthetic oligonucleotide
tgcggagcctctcccgctcggtcca

SEQ ID NO: 689609 - DNA, 25 bp, Artificial sequence
  Synthetic oligonucleotide
cgccacggtaggtgtgacgcgccat

SEQ ID NO: 689610 - DNA, 25 bp, Artificial sequence
  Synthetic oligonucleotide
tccatgcctcgtcccacgggacacc

SEQ ID NO: 689611 - DNA, 25 bp, Artificial sequence
  Synthetic oligonucleotide
tgttgttggattcagccagttgaca

SEQ ID NO: 689612 - DNA, 25 bp, Artificial sequence
  Synthetic oligonucleotide
gggacaccagttccctggcgtgtgc

SEQ ID NO: 689613 - DNA, 25 bp, Artificial sequence
  Synthetic oligonucleotide
ggcgcctaccatgctgtacgtcggt

SEQ ID NO: 689614 - DNA, 25 bp, Artificial sequence
  Synthetic oligonucleotide
cgcctaccatgctgtacgtcggtga

SEQ ID NO: 689615 - DNA, 25 bp, Artificial sequence
  Synthetic oligonucleotide
ctaccatgctgtacgtcggtgaccc

SEQ ID NO: 689616 - DNA, 25 bp, Artificial sequence
  Synthetic oligonucleotide
tgtacgtcggtgaccccgcacggca

SEQ ID NO: 689617 - DNA, 25 bp, Artificial sequence
  Synthetic oligonucleotide
gatgggaaaagcgaaaatgccaaca

SEQ ID NO: 689618 - DNA, 25 bp, Artificial sequence
  Synthetic oligonucleotide
ctcgggccgcccagatccatgcctc

SEQ ID NO: 689619 - DNA, 25 bp, Artificial sequence
  Synthetic oligonucleotide
atcaccgggcaagctgaggcctgcc

SEQ ID NO: 689620 - DNA, 25 bp, Artificial sequence
  Synthetic oligonucleotide
gcagcctccttggtgcggtccaaca

SEQ ID NO: 689621 - DNA, 25 bp, Artificial sequence
  Synthetic oligonucleotide
agcctccttggtgcggtccaacaca

SEQ ID NO: 689622 - DNA, 25 bp, Artificial sequence
  Synthetic oligonucleotide
ctccttggtgcggtccaacacatca

SEQ ID NO: 689623 - DNA, 25 bp, Artificial sequence
  Synthetic oligonucleotide
ttggtgcggtccaacacatcaccgg

SEQ ID NO: 689624 - DNA, 25 bp, Artificial sequence
  Synthetic oligonucleotide
gtgcggtccaacacatcaccgggca

SEQ ID NO: 689625 - DNA, 25 bp, Artificial sequence
  Synthetic oligonucleotide
gtccaacacatcaccgggcaagctg

SEQ ID NO: 689626 - DNA, 25 bp, Artificial sequence
  Synthetic oligonucleotide
cagaactaagggagatgggaaaagc

SEQ ID NO: 689627 - DNA, 25 bp, Artificial sequence
  Synthetic oligonucleotide
acatcaccgggcaagctgaggcctg

SEQ ID NO: 689628 - DNA, 25 bp, Artificial sequence
  Synthetic oligonucleotide
ttggattcagccagttgacagaact

SEQ ID NO: 689629 - DNA, 25 bp, Artificial sequence
  Synthetic oligonucleotide
cccggacttggatgaatactcatga

SEQ ID NO: 689630 - DNA, 25 bp, Artificial sequence
  Synthetic oligonucleotide
cttggatgaatactcatgaggaata

SEQ ID NO: 689631 - DNA, 25 bp, Artificial sequence
  Synthetic oligonucleotide
atactcatgaggaataaaggggtgg

SEQ ID NO: 689632 - DNA, 25 bp, Artificial sequence
  Synthetic oligonucleotide
ccgcgggttttgttgttggattcag

SEQ ID NO: 689633 - DNA, 25 bp, Artificial sequence
  Synthetic oligonucleotide
cgggttttgttgttggattcagcca

SEQ ID NO: 689634 - DNA, 25 bp, Artificial sequence
  Synthetic oligonucleotide
acggtaggtgtgacgcgccattcat

SEQ ID NO: 689635 - DNA, 25 bp, Artificial sequence
  Synthetic oligonucleotide
tccaacacatcaccgggcaagctga

SEQ ID NO: 689636 - DNA, 25 bp, Artificial sequence
  Synthetic oligonucleotide
cgccattcataggatctcttcgggg

SEQ ID NO: 689637 - DNA, 25 bp, Artificial sequence
  Synthetic oligonucleotide
ggtgtgacgcgccattcataggatc

SEQ ID NO: 689638 - DNA, 25 bp, Artificial sequence
  Synthetic oligonucleotide
tgtgacgcgccattcataggatctc

SEQ ID NO: 689639 - DNA, 25 bp, Artificial sequence
  Synthetic oligonucleotide
gacgcgccattcataggatctcttc

SEQ ID NO: 689640 - DNA, 25 bp, Artificial sequence
  Synthetic oligonucleotide
cgcgccattcataggatctcttcgg

SEQ ID NO: 689641 - DNA, 25 bp, Artificial sequence
  Synthetic oligonucleotide
cccgcacggcacctcgccacggtag

SEQ ID NO: 689642 - DNA, 25 bp, Artificial sequence
  Synthetic oligonucleotide
cggcagcagcggcaatgaccccttg

SEQ ID NO: 689643 - DNA, 25 bp, Artificial sequence
  Synthetic oligonucleotide
gaccccttggctcgggctcatcgtg

SEQ ID NO: 689644 - DNA, 25 bp, Artificial sequence
  Synthetic oligonucleotide
gccgaggcgtgcacatgctcgccca

SEQ ID NO: 689645 - DNA, 25 bp, Artificial sequence
  Synthetic oligonucleotide
cgtgcacatgctcgcccagccaccc

SEQ ID NO: 689646 - DNA, 25 bp, Artificial sequence
  Synthetic oligonucleotide
aggacgccttctgcaactccgacat

SEQ ID NO: 689647 - DNA, 25 bp, Artificial sequence
  Synthetic oligonucleotide
gccttctgcaactccgacatcggta

SEQ ID NO: 689648 - DNA, 25 bp, Artificial sequence
  Synthetic oligonucleotide
ccttctgcaactccgacatcggtaa

SEQ ID NO: 689649 - DNA, 25 bp, Artificial sequence
  Synthetic oligonucleotide
cacggcaactttggagaggcgagca

SEQ ID NO: 689650 - DNA, 25 bp, Artificial sequence
  Synthetic oligonucleotide
cgacatcggtaagcgctcctggtgc

SEQ ID NO: 689651 - DNA, 25 bp, Artificial sequence
  Synthetic oligonucleotide
cgagggctccgctccgaggacccag

SEQ ID NO: 689652 - DNA, 25 bp, Artificial sequence
  Synthetic oligonucleotide
atcggtaagcgctcctggtgccccg

SEQ ID NO: 689653 - DNA, 25 bp, Artificial sequence
  Synthetic oligonucleotide
cagccaggactgcagcgctgcttag

SEQ ID NO: 689654 - DNA, 25 bp, Artificial sequence
  Synthetic oligonucleotide
agccaggactgcagcgctgcttagg

SEQ ID NO: 689655 - DNA, 25 bp, Artificial sequence
  Synthetic oligonucleotide
agtggagaaactcgatgtccttggg

SEQ ID NO: 689656 - DNA, 25 bp, Artificial sequence
  Synthetic oligonucleotide
tccgacatcggtaagcgctcctggt

SEQ ID NO: 689657 - DNA, 25 bp, Artificial sequence
  Synthetic oligonucleotide
gcagcgcgccggaggccaaggttgc

SEQ ID NO: 689658 - DNA, 25 bp, Artificial sequence
  Synthetic oligonucleotide
ggcgggcgctcagacggcttctcct

SEQ ID NO: 689659 - DNA, 25 bp, Artificial sequence
  Synthetic oligonucleotide
gactgcagcgctgcttagggaggca

SEQ ID NO: 689660 - DNA, 25 bp, Artificial sequence
  Synthetic oligonucleotide
cgctatatcactcggccgcccaggc

SEQ ID NO: 689661 - DNA, 25 bp, Artificial sequence
  Synthetic oligonucleotide
ggggcccagcgctatatcactcggc

SEQ ID NO: 689662 - DNA, 25 bp, Artificial sequence
  Synthetic oligonucleotide
atgcggctctgccattggtctgagg

SEQ ID NO: 689663 - DNA, 25 bp, Artificial sequence
  Synthetic oligonucleotide
taatgcggctctgccattggtctga

SEQ ID NO: 689664 - DNA, 25 bp, Artificial sequence
  Synthetic oligonucleotide
aggtaatgcggctctgccattggtc

SEQ ID NO: 689665 - DNA, 25 bp, Artificial sequence
  Synthetic oligonucleotide
cggagtggagaaactcgatgtcctt

SEQ ID NO: 689666 - DNA, 25 bp, Artificial sequence
  Synthetic oligonucleotide
cgatgaggtaatgcggctctgccat

SEQ ID NO: 689667 - DNA, 25 bp, Artificial sequence
  Synthetic oligonucleotide
ccgatgaggtaatgcggctctgcca

SEQ ID NO: 689668 - DNA, 25 bp, Artificial sequence
  Synthetic oligonucleotide
ctttttggagggccgatgaggtaat

SEQ ID NO: 689669 - DNA, 25 bp, Artificial sequence
  Synthetic oligonucleotide
ctataaggatctgaacgatccgggg

SEQ ID NO: 689670 - DNA, 25 bp, Artificial sequence
  Synthetic oligonucleotide
tccctataaggatctgaacgatccg

SEQ ID NO: 689671 - DNA, 25 bp, Artificial sequence
  Synthetic oligonucleotide
gtcccgccgggcactcggagggcag

SEQ ID NO: 689672 - DNA, 25 bp, Artificial sequence
  Synthetic oligonucleotide
gcccacggcggcattattccctata

SEQ ID NO: 689673 - DNA, 25 bp, Artificial sequence
  Synthetic oligonucleotide
ccagcggcaagcaccggtcccgggc

SEQ ID NO: 689674 - DNA, 25 bp, Artificial sequence
  Synthetic oligonucleotide
attccctataaggatctgaacgatc

SEQ ID NO: 689675 - DNA, 25 bp, Artificial sequence
  Synthetic oligonucleotide
cccacggcggcattattccctataa

SEQ ID NO: 689676 - DNA, 25 bp, Artificial sequence
  Synthetic oligonucleotide
actcgcgtgcccacggcggcattat

SEQ ID NO: 689677 - DNA, 25 bp, Artificial sequence
  Synthetic oligonucleotide
tggagaaactcgatgtccttgggcg

SEQ ID NO: 689678 - DNA, 25 bp, Artificial sequence
  Synthetic oligonucleotide
cgaggacccagcggcaagcaccggt

SEQ ID NO: 689679 - DNA, 25 bp, Artificial sequence
  Synthetic oligonucleotide
cgcagacgagaaggggcacgagggc

SEQ ID NO: 689680 - DNA, 25 bp, Artificial sequence
  Synthetic oligonucleotide
agaaactcgatgtccttgggcgggg

SEQ ID NO: 689681 - DNA, 25 bp, Artificial sequence
  Synthetic oligonucleotide
cacggcggcattattccctataagg

SEQ ID NO: 689682 - DNA, 25 bp, Artificial sequence
  Synthetic oligonucleotide
ccgggcagaggcatgtacagcgcat

SEQ ID NO: 689683 - DNA, 25 bp, Artificial sequence
  Synthetic oligonucleotide
cttccgttgagcatctagacgtttc

SEQ ID NO: 689684 - DNA, 25 bp, Artificial sequence
  Synthetic oligonucleotide
gggaagttatccagcggccagctaa

SEQ ID NO: 689685 - DNA, 25 bp, Artificial sequence
  Synthetic oligonucleotide
agacgtttccttggctcttctggcg

SEQ ID NO: 689686 - DNA, 25 bp, Artificial sequence
  Synthetic oligonucleotide
ttctggcgccaaaatgtcgttcgtg

SEQ ID NO: 689687 - DNA, 25 bp, Artificial sequence
  Synthetic oligonucleotide
aatgtcgttcgtggcaggggttatt

SEQ ID NO: 689688 - DNA, 25 bp, Artificial sequence
  Synthetic oligonucleotide
ctggacgagacagtggtgaaccgca

SEQ ID NO: 689689 - DNA, 25 bp, Artificial sequence
  Synthetic oligonucleotide
cggccagctaatgctatcaaagaga

SEQ ID NO: 689690 - DNA, 25 bp, Artificial sequence
  Synthetic oligonucleotide
ccgggctcacttaagggctacgact

SEQ ID NO: 689691 - DNA, 25 bp, Artificial sequence
  Synthetic oligonucleotide
ggctacgacttaacgggccgcgtca

SEQ ID NO: 689692 - DNA, 25 bp, Artificial sequence
  Synthetic oligonucleotide
gacacgcctctttgcccgggcagag

SEQ ID NO: 689693 - DNA, 25 bp, Artificial sequence
  Synthetic oligonucleotide
gtccaatcaatagctgccgctgaag

SEQ ID NO: 689694 - DNA, 25 bp, Artificial sequence
  Synthetic oligonucleotide
tggcattcaagctgtccaatcaata

SEQ ID NO: 689695 - DNA, 25 bp, Artificial sequence
  Synthetic oligonucleotide
tgtacagcgcatgcccacaacggcg

SEQ ID NO: 689696 - DNA, 25 bp, Artificial sequence
  Synthetic oligonucleotide
gcgtcactcaatggcgcggacacgc

SEQ ID NO: 689697 - DNA, 25 bp, Artificial sequence
  Synthetic oligonucleotide
ggccacaagagcagggccaacgtta

SEQ ID NO: 689698 - DNA, 25 bp, Artificial sequence
  Synthetic oligonucleotide
ggcaagtcgccctgacgcagacgct

SEQ ID NO: 689699 - DNA, 25 bp, Artificial sequence
  Synthetic oligonucleotide
gtccgccacataccgctcgtagtat

SEQ ID NO: 689700 - DNA, 25 bp, Artificial sequence
  Synthetic oligonucleotide
ctcgtagtattcgtgctcagcctcg

SEQ ID NO: 689701 - DNA, 25 bp, Artificial sequence
  Synthetic oligonucleotide
gctcagcctcgtagtggcgcctgac

SEQ ID NO: 689702 - DNA, 25 bp, Artificial sequence
  Synthetic oligonucleotide
tagctacgatgaggcggcgacagac

SEQ ID NO: 689703 - DNA, 25 bp, Artificial sequence
  Synthetic oligonucleotide
gaggctccaccaccaaataacgctg

SEQ ID NO: 689704 - DNA, 25 bp, Artificial sequence
  Synthetic oligonucleotide
ccaaataacgctgggtccactcggg

SEQ ID NO: 689705 - DNA, 25 bp, Artificial sequence
  Synthetic oligonucleotide
ctcgggccggaaaactagagcctcg

SEQ ID NO: 689706 - DNA, 25 bp, Artificial sequence
  Synthetic oligonucleotide
tagagcctcgtcgacttccatcttg

SEQ ID NO: 689707 - DNA, 25 bp, Artificial sequence
  Synthetic oligonucleotide
tgattggctgaaggcacttccgttg

SEQ ID NO: 689708 - DNA, 25 bp, Artificial sequence
  Synthetic oligonucleotide
gtcatccacattctgcgggaggcca

SEQ ID NO: 689709 - DNA, 25 bp, Artificial sequence
  Synthetic oligonucleotide
gaagaacgtgagcacgaggcactga

SEQ ID NO: 689710 - DNA, 25 bp, Artificial sequence
  Synthetic oligonucleotide
ggagcctgagaagcgccaagcacct

SEQ ID NO: 689711 - DNA, 25 bp, Artificial sequence
  Synthetic oligonucleotide
tgcgccagatcacctcagcagaggc

SEQ ID NO: 689712 - DNA, 25 bp, Artificial sequence
  Synthetic oligonucleotide
ggttccggcatctctgctcctattg

SEQ ID NO: 689713 - DNA, 25 bp, Artificial sequence
  Synthetic oligonucleotide
gctcctattggctggatatttcgta

SEQ ID NO: 689714 - DNA, 25 bp, Artificial sequence
  Synthetic oligonucleotide
aacgaaccaataggaagagcggaca

SEQ ID NO: 689715 - DNA, 25 bp, Artificial sequence
  Synthetic oligonucleotide
gacagcgatctctaacgcgcaagcg

SEQ ID NO: 689716 - DNA, 25 bp, Artificial sequence
  Synthetic oligonucleotide
gcgcaagcgcatatccttctaggta

SEQ ID NO: 689717 - DNA, 25 bp, Artificial sequence
  Synthetic oligonucleotide
atccttctaggtagcgggcagtagc

SEQ ID NO: 689718 - DNA, 25 bp, Artificial sequence
  Synthetic oligonucleotide
gacgaagagacccagcaacccacag

SEQ ID NO: 689719 - DNA, 25 bp, Artificial sequence
  Synthetic oligonucleotide
cccacagagttgagaaatttgactg

SEQ ID NO: 689720 - DNA, 25 bp, Artificial sequence
  Synthetic oligonucleotide
tcttgcttcttttgggcgtcatcca

SEQ ID NO: 689721 - DNA, 25 bp, Artificial sequence
  Synthetic oligonucleotide
ctggatggcgtaagctacagctgaa

SEQ ID NO: 689722 - DNA, 25 bp, Artificial sequence
  Synthetic oligonucleotide
tgctgctccaggtcatttcgaaaga

SEQ ID NO: 689723 - DNA, 25 bp, Artificial sequence
  Synthetic oligonucleotide
caccgacccaggacgcggcaacgga

SEQ ID NO: 689724 - DNA, 25 bp, Artificial sequence
  Synthetic oligonucleotide
ttaagactgaaacgtagatcgccgg

SEQ ID NO: 689725 - DNA, 25 bp, Artificial sequence
  Synthetic oligonucleotide
cgcgccgcaaccgttaagactgaaa

SEQ ID NO: 689726 - DNA, 25 bp, Artificial sequence
  Synthetic oligonucleotide
gagccgcgccgcaaccgttaagact

SEQ ID NO: 689727 - DNA, 25 bp, Artificial sequence
  Synthetic oligonucleotide
tgtacgcgtgtcagtgtgcgcgtgc

SEQ ID NO: 689728 - DNA, 25 bp, Artificial sequence
  Synthetic oligonucleotide
ctgcgcgtccgtagccgccaaccac

SEQ ID NO: 689729 - DNA, 25 bp, Artificial sequence
  Synthetic oligonucleotide
tccgcctcgcccatagccgtacccg

SEQ ID NO: 689730 - DNA, 25 bp, Artificial sequence
  Synthetic oligonucleotide
atctagctcttgtctcattggggca

SEQ ID NO: 689731 - DNA, 25 bp, Artificial sequence
  Synthetic oligonucleotide
tccaggtcatttcgaaagaaggcgc

SEQ ID NO: 689732 - DNA, 25 bp, Artificial sequence
  Synthetic oligonucleotide
cactgctcgtcgtgctgctccaggt

SEQ ID NO: 689733 - DNA, 25 bp, Artificial sequence
  Synthetic oligonucleotide
cagtagccactgctcgtcgtgctgc

SEQ ID NO: 689734 - DNA, 25 bp, Artificial sequence
  Synthetic oligonucleotide
ttggctgcagtagccactgctcgtc

SEQ ID NO: 689735 - DNA, 25 bp, Artificial sequence
  Synthetic oligonucleotide
tcctcttggctgcagtagccactgc

SEQ ID NO: 689736 - DNA, 25 bp, Artificial sequence
  Synthetic oligonucleotide
tccgagtcctcttggctgcagtagc

SEQ ID NO: 689737 - DNA, 25 bp, Artificial sequence
  Synthetic oligonucleotide
tgaagtactgctcgagctccgagtc

SEQ ID NO: 689738 - DNA, 25 bp, Artificial sequence
  Synthetic oligonucleotide
aggttcgcgcggtgaagtactgctc

SEQ ID NO: 689739 - DNA, 25 bp, Artificial sequence
  Synthetic oligonucleotide
gcctgcgagctagcgaggttcgcgc

SEQ ID NO: 689740 - DNA, 25 bp, Artificial sequence
  Synthetic oligonucleotide
aggtcatttcgaaagaaggcgcctc

SEQ ID NO: 689741 - DNA, 25 bp, Artificial sequence
  Synthetic oligonucleotide
tgtgccgccgggaaatcggcaatta

SEQ ID NO: 689742 - DNA, 25 bp, Artificial sequence
  Synthetic oligonucleotide
agtccaggcagacgagcgcgcggca

SEQ ID NO: 689743 - DNA, 25 bp, Artificial sequence
  Synthetic oligonucleotide
cgctcaccacgttcgtgtcccgctc

SEQ ID NO: 689744 - DNA, 25 bp, Artificial sequence
  Synthetic oligonucleotide
cctcgcccttcccatacgccctcgg

SEQ ID NO: 689745 - DNA, 25 bp, Artificial sequence
  Synthetic oligonucleotide
gaatgcctgcactgtggcctgccca

SEQ ID NO: 689746 - DNA, 25 bp, Artificial sequence
  Synthetic oligonucleotide
ctcgagaatgcctgcactgtggcct

SEQ ID NO: 689747 - DNA, 25 bp, Artificial sequence
  Synthetic oligonucleotide
ggcagccctcgagaatgcctgcact

SEQ ID NO: 689748 - DNA, 25 bp, Artificial sequence
  Synthetic oligonucleotide
ttagaacgctccttgcgcgcggcac

SEQ ID NO: 689749 - DNA, 25 bp, Artificial sequence
  Synthetic oligonucleotide
gatcgccgggatctagctcttgtct

SEQ ID NO: 689750 - DNA, 25 bp, Artificial sequence
  Synthetic oligonucleotide
ccgggaaatcggcaattagaacgct

SEQ ID NO: 689751 - DNA, 25 bp, Artificial sequence
  Synthetic oligonucleotide
gactgaaacgtagatcgccgggatc

SEQ ID NO: 689752 - DNA, 25 bp, Artificial sequence
  Synthetic oligonucleotide
cccgcgcagaattagcctctctgtg

SEQ ID NO: 689753 - DNA, 25 bp, Artificial sequence
  Synthetic oligonucleotide
gagtacttgcggagccggcaatcca

SEQ ID NO: 689754 - DNA, 25 bp, Artificial sequence
  Synthetic oligonucleotide
tccgcttgcagcgggtggagtactt

SEQ ID NO: 689755 - DNA, 25 bp, Artificial sequence
  Synthetic oligonucleotide
ggcaagcgcacaagagtggcctctg

SEQ ID NO: 689756 - DNA, 25 bp, Artificial sequence
  Synthetic oligonucleotide
atcgctccggagctccactcacaga

SEQ ID NO: 689757 - DNA, 25 bp, Artificial sequence
  Synthetic oligonucleotide
gaatgacctcatcgctccggagctc

SEQ ID NO: 689758 - DNA, 25 bp, Artificial sequence
  Synthetic oligonucleotide
ccaggaatgacctcatcgctccgga

SEQ ID NO: 689759 - DNA, 25 bp, Artificial sequence
  Synthetic oligonucleotide
tcttgtctcattggggcaggaacgc

SEQ ID NO: 689760 - DNA, 25 bp, Artificial sequence
  Synthetic oligonucleotide
gcaattagaacgctccttgcgcgcg

SEQ ID NO: 689761 - DNA, 25 bp, Artificial sequence
  Synthetic oligonucleotide
gccgggatctagctcttgtctcatt

SEQ ID NO: 689762 - DNA, 25 bp, Artificial sequence
  Synthetic oligonucleotide
cactcttcagcgatggggcgaaagt

SEQ ID NO: 689763 - DNA, 25 bp, Artificial sequence
  Synthetic oligonucleotide
agatgaagtcgccacagaggtcgca

SEQ ID NO: 689764 - DNA, 25 bp, Artificial sequence
  Synthetic oligonucleotide
cccagatgaagtcgccacagaggtc

SEQ ID NO: 689765 - DNA, 25 bp, Artificial sequence
  Synthetic oligonucleotide
ctttgcgcacgacgccccagatgaa

SEQ ID NO: 689766 - DNA, 25 bp, Artificial sequence
  Synthetic oligonucleotide
gcactgcaggcctttgcgcacgacg

SEQ ID NO: 689767 - DNA, 25 bp, Artificial sequence
  Synthetic oligonucleotide
ggccactactcacgcgcgcactgca

SEQ ID NO: 689768 - DNA, 25 bp, Artificial sequence
  Synthetic oligonucleotide
ccttccgctctcgtaggcgcgcggg

SEQ ID NO: 689769 - DNA, 25 bp, Artificial sequence
  Synthetic oligonucleotide
gccgcgacttgacccgcggcgactg

SEQ ID NO: 689770 - DNA, 25 bp, Artificial sequence
  Synthetic oligonucleotide
taacggacctagtcctcgggagctg

SEQ ID NO: 689771 - DNA, 25 bp, Artificial sequence
  Synthetic oligonucleotide
aagtcgccacagaggtcgcaccacg

SEQ ID NO: 689772 - DNA, 25 bp, Artificial sequence
  Synthetic oligonucleotide
gcgcactcttcagcgatggggcgaa

SEQ ID NO: 689773 - DNA, 25 bp, Artificial sequence
  Synthetic oligonucleotide
ttcgcgcactcttcagcgatggggc

SEQ ID NO: 689774 - DNA, 25 bp, Artificial sequence
  Synthetic oligonucleotide
attttcgcgcactcttcagcgatgg

SEQ ID NO: 689775 - DNA, 25 bp, Artificial sequence
  Synthetic oligonucleotide
accattttcgcgcactcttcagcga

SEQ ID NO: 689776 - DNA, 25 bp, Artificial sequence
  Synthetic oligonucleotide
ggataaaccattttcgcgcactctt

SEQ ID NO: 689777 - DNA, 25 bp, Artificial sequence
  Synthetic oligonucleotide
acaagggataaaccattttcgcgca

SEQ ID NO: 689778 - DNA, 25 bp, Artificial sequence
  Synthetic oligonucleotide
gtgcgacaagggataaaccattttc

SEQ ID NO: 689779 - DNA, 25 bp, Artificial sequence
  Synthetic oligonucleotide
accgcaaagcaccacgcggagatac

SEQ ID NO: 689780 - DNA, 25 bp, Artificial sequence
  Synthetic oligonucleotide
ggacctagtcctcgggagctgtccc

SEQ ID NO: 689781 - DNA, 25 bp, Artificial sequence
  Synthetic oligonucleotide
atgagctcaggctcccccgacatgg

SEQ ID NO: 689782 - DNA, 25 bp, Artificial sequence
  Synthetic oligonucleotide
acggccacaacgacggcgaccgcaa

SEQ ID NO: 689783 - DNA, 25 bp, Artificial sequence
  Synthetic oligonucleotide
caatggaaacctgggtgcagggact

SEQ ID NO: 689784 - DNA, 25 bp, Artificial sequence
  Synthetic oligonucleotide
gccgcgcaatggaaacctgggtgca

SEQ ID NO: 689785 - DNA, 25 bp, Artificial sequence
  Synthetic oligonucleotide
agagccgcgcaatggaaacctgggt

SEQ ID NO: 689786 - DNA, 25 bp, Artificial sequence
  Synthetic oligonucleotide
aggagagccgcgcaatggaaacctg

SEQ ID NO: 689787 - DNA, 25 bp, Artificial sequence
  Synthetic oligonucleotide
caggatccagactgggcggcgggaa

SEQ ID NO: 689788 - DNA, 25 bp, Artificial sequence
  Synthetic oligonucleotide
ctttgggcgctagcaagcgcgggcc

SEQ ID NO: 689789 - DNA, 25 bp, Artificial sequence
  Synthetic oligonucleotide
cttcgctggctttgggcgctagcaa

SEQ ID NO: 689790 - DNA, 25 bp, Artificial sequence
  Synthetic oligonucleotide
gcgaccgcaaagcaccacgcggaga

SEQ ID NO: 689791 - DNA, 25 bp, Artificial sequence
  Synthetic oligonucleotide
acatggcccggttgggcccgtgctt

SEQ ID NO: 689792 - DNA, 25 bp, Artificial sequence
  Synthetic oligonucleotide
atgaagtcgccacagaggtcgcacc

SEQ ID NO: 689793 - DNA, 25 bp, Artificial sequence
  Synthetic oligonucleotide
tcccgcagctcaatgagctcaggct

SEQ ID NO: 689794 - DNA, 25 bp, Artificial sequence
  Synthetic oligonucleotide
agctcccgcagctcaatgagctcag

SEQ ID NO: 689795 - DNA, 25 bp, Artificial sequence
  Synthetic oligonucleotide
atgcgcagcgcgttggcacgctcca

SEQ ID NO: 689796 - DNA, 25 bp, Artificial sequence
  Synthetic oligonucleotide
accagctgccgtgtggggttgcacg

SEQ ID NO: 689797 - DNA, 25 bp, Artificial sequence
  Synthetic oligonucleotide
cacggccagggaccagctgccgtgt

SEQ ID NO: 689798 - DNA, 25 bp, Artificial sequence
  Synthetic oligonucleotide
acagaggtcgcaccacgtgtgcgtg

SEQ ID NO: 689799 - DNA, 25 bp, Artificial sequence
  Synthetic oligonucleotide
tcgccacagaggtcgcaccacgtgt

SEQ ID NO: 689800 - DNA, 25 bp, Artificial sequence
  Synthetic oligonucleotide
agtggagtgcgacaagggataaacc

SEQ ID NO: 689801 - DNA, 25 bp, Artificial sequence
  Synthetic oligonucleotide
gttgggcccgtgcttcgctggcttt

SEQ ID NO: 689802 - DNA, 25 bp, Artificial sequence
  Synthetic oligonucleotide
ctgtgggaagccagcaacacctctc

SEQ ID NO: 689803 - DNA, 25 bp, Artificial sequence
  Synthetic oligonucleotide
gttggctcgatgctgttcccaggta

SEQ ID NO: 689804 - DNA, 25 bp, Artificial sequence
  Synthetic oligonucleotide
accgaggttggctcgatgctgttcc

SEQ ID NO: 689805 - DNA, 25 bp, Artificial sequence
  Synthetic oligonucleotide
gccgccggaagcctagccgctgctc

SEQ ID NO: 689806 - DNA, 25 bp, Artificial sequence
  Synthetic oligonucleotide
caagatggcggagggcaagtagcaa

SEQ ID NO: 689807 - DNA, 25 bp, Artificial sequence
  Synthetic oligonucleotide
atgcgcattgtagtcttcccacctc

SEQ ID NO: 689808 - DNA, 25 bp, Artificial sequence
  Synthetic oligonucleotide
acgcatgcgcattgtagtcttccca

SEQ ID NO: 689809 - DNA, 25 bp, Artificial sequence
  Synthetic oligonucleotide
ctcacgcatgcgcattgtagtcttc

SEQ ID NO: 689810 - DNA, 25 bp, Artificial sequence
  Synthetic oligonucleotide
aagtggtgccccattcgcgttaggt

SEQ ID NO: 689811 - DNA, 25 bp, Artificial sequence
  Synthetic oligonucleotide
tgggaagccagcaacacctctcacg

SEQ ID NO: 689812 - DNA, 25 bp, Artificial sequence
  Synthetic oligonucleotide
tcccaggtactgttgttggctgttg

SEQ ID NO: 689813 - DNA, 25 bp, Artificial sequence
  Synthetic oligonucleotide
ccgggctgtgggaagccagcaacac

SEQ ID NO: 689814 - DNA, 25 bp, Artificial sequence
  Synthetic oligonucleotide
taacaggctctagtctccgggctgt

SEQ ID NO: 689815 - DNA, 25 bp, Artificial sequence
  Synthetic oligonucleotide
cataacaggctctagtctccgggct

SEQ ID NO: 689816 - DNA, 25 bp, Artificial sequence
  Synthetic oligonucleotide
gcgcataacaggctctagtctccgg

SEQ ID NO: 689817 - DNA, 25 bp, Artificial sequence
  Synthetic oligonucleotide
cgcctgcgcataacaggctctagtc

SEQ ID NO: 689818 - DNA, 25 bp, Artificial sequence
  Synthetic oligonucleotide
ttgcgcctgcgcataacaggctcta

SEQ ID NO: 689819 - DNA, 25 bp, Artificial sequence
  Synthetic oligonucleotide
agcagtgcccggcaagcggagcgca

SEQ ID NO: 689820 - DNA, 25 bp, Artificial sequence
  Synthetic oligonucleotide
acacctctcacgcatgcgcattgta

SEQ ID NO: 689821 - DNA, 25 bp, Artificial sequence
  Synthetic oligonucleotide
gagcgtctggcaggtgagtgaggct

SEQ ID NO: 689822 - DNA, 25 bp, Artificial sequence
  Synthetic oligonucleotide
cattctcacgcagtggatgggggtc

SEQ ID NO: 689823 - DNA, 25 bp, Artificial sequence
  Synthetic oligonucleotide
gctttgcaggtcctccattctcacg

SEQ ID NO: 689824 - DNA, 25 bp, Artificial sequence
  Synthetic oligonucleotide
cctggctttgcaggtcctccattct

SEQ ID NO: 689825 - DNA, 25 bp, Artificial sequence
  Synthetic oligonucleotide
aggcctccagttggcccctggcttt

SEQ ID NO: 689826 - DNA, 25 bp, Artificial sequence
  Synthetic oligonucleotide
ctgtggctctcttctctccatgtct

SEQ ID NO: 689827 - DNA, 25 bp, Artificial sequence
  Synthetic oligonucleotide
gtgctcggcccgactctgtggctct

SEQ ID NO: 689828 - DNA, 25 bp, Artificial sequence
  Synthetic oligonucleotide
ctgctcgggaccctacggtgctcgg

SEQ ID NO: 689829 - DNA, 25 bp, Artificial sequence
  Synthetic oligonucleotide
gctgttcccaggtactgttgttggc

SEQ ID NO: 689830 - DNA, 25 bp, Artificial sequence
  Synthetic oligonucleotide
ggctgcaggcattgacgtctcctcc

SEQ ID NO: 689831 - DNA, 25 bp, Artificial sequence
  Synthetic oligonucleotide
ccaggtactgttgttggctgttggt

SEQ ID NO: 689832 - DNA, 25 bp, Artificial sequence
  Synthetic oligonucleotide
gctcgtacttctggccactgggcga

SEQ ID NO: 689833 - DNA, 25 bp, Artificial sequence
  Synthetic oligonucleotide
ggcggcgctcgtacttctggccact

SEQ ID NO: 689834 - DNA, 25 bp, Artificial sequence
  Synthetic oligonucleotide
agctgcgtccggcaggagacgaaga

SEQ ID NO: 689835 - DNA, 25 bp, Artificial sequence
  Synthetic oligonucleotide
caccctcagttctcgggtcctggag

SEQ ID NO: 689836 - DNA, 25 bp, Artificial sequence
  Synthetic oligonucleotide
tgcccgcttctgtaccaccctcagt

SEQ ID NO: 689837 - DNA, 25 bp, Artificial sequence
  Synthetic oligonucleotide
gaagcactcagttgccttctcgggc

SEQ ID NO: 689838 - DNA, 25 bp, Artificial sequence
  Synthetic oligonucleotide
tgaggaaggtgaagcactcagttgc

SEQ ID NO: 689839 - DNA, 25 bp, Artificial sequence
  Synthetic oligonucleotide
cgccgtcctccacctttcctggctg

SEQ ID NO: 689840 - DNA, 25 bp, Artificial sequence
  Synthetic oligonucleotide
tgcaggcattgacgtctcctcccgg

SEQ ID NO: 689841 - DNA, 25 bp, Artificial sequence
  Synthetic oligonucleotide
aggtgaagcactcagttgccttctc

SEQ ID NO: 689842 - DNA, 25 bp, Artificial sequence
  Synthetic oligonucleotide
cgccgtgactcagcactggggcgga

SEQ ID NO: 689843 - DNA, 25 bp, Artificial sequence
  Synthetic oligonucleotide
tcctcgcccacctcgagacccggga

SEQ ID NO: 689844 - DNA, 25 bp, Artificial sequence
  Synthetic oligonucleotide
acccgcagcatcaggcccgggctcc

SEQ ID NO: 689845 - DNA, 25 bp, Artificial sequence
  Synthetic oligonucleotide
agcatggggccaacccgcagcatca

SEQ ID NO: 689846 - DNA, 25 bp, Artificial sequence
  Synthetic oligonucleotide
ttcgccaccagtgagtacgcgcggc

SEQ ID NO: 689847 - DNA, 25 bp, Artificial sequence
  Synthetic oligonucleotide
agtcttcgccaccagtgagtacgcg

SEQ ID NO: 689848 - DNA, 25 bp, Artificial sequence
  Synthetic oligonucleotide
cgcagtcttcgccaccagtgagtac

SEQ ID NO: 689849 - DNA, 25 bp, Artificial sequence
  Synthetic oligonucleotide
cttcgctggagtttcgccgccgcag

SEQ ID NO: 689850 - DNA, 25 bp, Artificial sequence
  Synthetic oligonucleotide
cccagtgccgttagcggctttcagg

SEQ ID NO: 689851 - DNA, 25 bp, Artificial sequence
  Synthetic oligonucleotide
gaccacccttataaggctcggaggc

SEQ ID NO: 689852 - DNA, 25 bp, Artificial sequence
  Synthetic oligonucleotide
aggccttcgctggagtttcgccgcc

SEQ ID NO: 689853 - DNA, 25 bp, Artificial sequence
  Synthetic oligonucleotide
tccgcgggaccctccagaagagcgg

SEQ ID NO: 689854 - DNA, 25 bp, Artificial sequence
  Synthetic oligonucleotide
ggagtccgcgggaccctccagaaga

SEQ ID NO: 689855 - DNA, 25 bp, Artificial sequence
  Synthetic oligonucleotide
tgctgtctgtttactccctaggccc

SEQ ID NO: 689856 - DNA, 25 bp, Artificial sequence
  Synthetic oligonucleotide
cttcctgctgtctgtttactcccta

SEQ ID NO: 689857 - DNA, 25 bp, Artificial sequence
  Synthetic oligonucleotide
cggtcctcttcctgctgtctgttta

SEQ ID NO: 689858 - DNA, 25 bp, Artificial sequence
  Synthetic oligonucleotide
gcgcacacttcgctgcggtcctctt

SEQ ID NO: 689859 - DNA, 25 bp, Artificial sequence
  Synthetic oligonucleotide
cgcgccagttcgctgcgcacacttc

SEQ ID NO: 689860 - DNA, 25 bp, Artificial sequence
  Synthetic oligonucleotide
gccgcgaggccttcgctggagtttc

SEQ ID NO: 689861 - DNA, 25 bp, Artificial sequence
  Synthetic oligonucleotide
tgtgtgaaatcttcggaggaacctg

SEQ ID NO: 689862 - DNA, 25 bp, Artificial sequence
  Synthetic oligonucleotide
cccttataaggctcggaggccgcga

SEQ ID NO: 689863 - DNA, 25 bp, Artificial sequence
  Synthetic oligonucleotide
tgaaatcttcggaggaacctgtttc

SEQ ID NO: 689864 - DNA, 25 bp, Artificial sequence
  Synthetic oligonucleotide
atcgcagcggtcttagggaatttcc

SEQ ID NO: 689865 - DNA, 25 bp, Artificial sequence
  Synthetic oligonucleotide
cccagtgttgtgtgaaatcttcgga

SEQ ID NO: 689866 - DNA, 25 bp, Artificial sequence
  Synthetic oligonucleotide
tatccctccgtcgtgtggcttttac

SEQ ID NO: 689867 - DNA, 25 bp, Artificial sequence
  Synthetic oligonucleotide
ccttatccctccgtcgtgtggcttt

SEQ ID NO: 689868 - DNA, 25 bp, Artificial sequence
  Synthetic oligonucleotide
tcgcccacccggagagatccgaacc

SEQ ID NO: 689869 - DNA, 25 bp, Artificial sequence
  Synthetic oligonucleotide
taggagcatgtgtctggcagggaag

SEQ ID NO: 689870 - DNA, 25 bp, Artificial sequence
  Synthetic oligonucleotide
cagttcgaggtaggagcatgtgtct

SEQ ID NO: 689871 - DNA, 25 bp, Artificial sequence
  Synthetic oligonucleotide
ttcccagttcgaggtaggagcatgt

SEQ ID NO: 689872 - DNA, 25 bp, Artificial sequence
  Synthetic oligonucleotide
agcaaacttttctttgttcgctgca

SEQ ID NO: 689873 - DNA, 25 bp, Artificial sequence
  Synthetic oligonucleotide
atcttcggaggaacctgtttccctg

SEQ ID NO: 689874 - DNA, 25 bp, Artificial sequence
  Synthetic oligonucleotide
gctcaccgcgccttggcatcctccc

SEQ ID NO: 689875 - DNA, 25 bp, Artificial sequence
  Synthetic oligonucleotide
aacttttctttgttcgctgcagtgc

SEQ ID NO: 689876 - DNA, 25 bp, Artificial sequence
  Synthetic oligonucleotide
tttctttgttcgctgcagtgccgcc

SEQ ID NO: 689877 - DNA, 25 bp, Artificial sequence
  Synthetic oligonucleotide
gtgccgccctacaccgtggtctatt

SEQ ID NO: 689878 - DNA, 25 bp, Artificial sequence
  Synthetic oligonucleotide
cctacaccgtggtctatttcccagt

SEQ ID NO: 689879 - DNA, 25 bp, Artificial sequence
  Synthetic oligonucleotide
caccgtggtctatttcccagttcga

SEQ ID NO: 689880 - DNA, 25 bp, Artificial sequence
  Synthetic oligonucleotide
cgtggtctatttcccagttcgaggt

SEQ ID NO: 689881 - DNA, 25 bp, Artificial sequence
  Synthetic oligonucleotide
ctatttcccagttcgaggtaggagc

SEQ ID NO: 689882 - DNA, 25 bp, Artificial sequence
  Synthetic oligonucleotide
ccagcaaaggcgtgtttgagtgcgt

SEQ ID NO: 689883 - DNA, 25 bp, Artificial sequence
  Synthetic oligonucleotide
ggtatctttccaggcaaggggacgc

SEQ ID NO: 689884 - DNA, 25 bp, Artificial sequence
  Synthetic oligonucleotide
ctccgagcacttagcgaatgtggca

SEQ ID NO: 689885 - DNA, 25 bp, Artificial sequence
  Synthetic oligonucleotide
agtgctcggaggaggtgctattaac

SEQ ID NO: 689886 - DNA, 25 bp, Artificial sequence
  Synthetic oligonucleotide
tgctcggaggaggtgctattaactc

SEQ ID NO: 689887 - DNA, 25 bp, Artificial sequence
  Synthetic oligonucleotide
gaggaggtgctattaactccgagca

SEQ ID NO: 689888 - DNA, 25 bp, Artificial sequence
  Synthetic oligonucleotide
aggtgctattaactccgagcactta

SEQ ID NO: 689889 - DNA, 25 bp, Artificial sequence
  Synthetic oligonucleotide
attaactccgagcacttagcgaatg

SEQ ID NO: 689890 - DNA, 25 bp, Artificial sequence
  Synthetic oligonucleotide
taactccgagcacttagcgaatgtg

SEQ ID NO: 689891 - DNA, 25 bp, Artificial sequence
  Synthetic oligonucleotide
aaggggacgccgtgagcgagtgctc

SEQ ID NO: 689892 - DNA, 25 bp, Artificial sequence
  Synthetic oligonucleotide
cgagcacttagcgaatgtggcaccc

SEQ ID NO: 689893 - DNA, 25 bp, Artificial sequence
  Synthetic oligonucleotide
tagcgaatgtggcacccctgaagtc

SEQ ID NO: 689894 - DNA, 25 bp, Artificial sequence
  Synthetic oligonucleotide
ctgaagtcgccccaggttgggtctc

SEQ ID NO: 689895 - DNA, 25 bp, Artificial sequence
  Synthetic oligonucleotide
ccagagccagcgttggcaaggaagg

SEQ ID NO: 689896 - DNA, 25 bp, Artificial sequence
  Synthetic oligonucleotide
cgcggtatctttccaggcaagggga

SEQ ID NO: 689897 - DNA, 25 bp, Artificial sequence
  Synthetic oligonucleotide
caaaggcgtgtttgagtgcgttcac

SEQ ID NO: 689898 - DNA, 25 bp, Artificial sequence
  Synthetic oligonucleotide
aaggcgtgtttgagtgcgttcactc

SEQ ID NO: 689899 - DNA, 25 bp, Artificial sequence
  Synthetic oligonucleotide
gtgtttgagtgcgttcactctgtta

SEQ ID NO: 689900 - DNA, 25 bp, Artificial sequence
  Synthetic oligonucleotide
taactattcggtgcgttgggcagcg

SEQ ID NO: 689901 - DNA, 25 bp, Artificial sequence
  Synthetic oligonucleotide
ggcaccagccggaagcagccctcgc

SEQ ID NO: 689902 - DNA, 25 bp, Artificial sequence
  Synthetic oligonucleotide
gcctccgaccgtaactattcggtgc

SEQ ID NO: 689903 - DNA, 25 bp, Artificial sequence
  Synthetic oligonucleotide
gccgtggccagccagtcagccgaag

SEQ ID NO: 689904 - DNA, 25 bp, Artificial sequence
  Synthetic oligonucleotide
gaccgcggtatctttccaggcaagg

SEQ ID NO: 689905 - DNA, 25 bp, Artificial sequence
  Synthetic oligonucleotide
gaatcgaagcgctacctgattccaa

SEQ ID NO: 689906 - DNA, 25 bp, Artificial sequence
  Synthetic oligonucleotide
gctgcagaccctctacccacctgga

SEQ ID NO: 689907 - DNA, 25 bp, Artificial sequence
  Synthetic oligonucleotide
agaccctctacccacctggatcggc

SEQ ID NO: 689908 - DNA, 25 bp, Artificial sequence
  Synthetic oligonucleotide
atcggcctccgaccgtaactattcg

SEQ ID NO: 689909 - DNA, 25 bp, Artificial sequence
  Synthetic oligonucleotide
cggagaatcgaagcgctacctgatt

SEQ ID NO: 689910 - DNA, 25 bp, Artificial sequence
  Synthetic oligonucleotide
cgaccgtaactattcggtgcgttgg

SEQ ID NO: 689911 - DNA, 25 bp, Artificial sequence
  Synthetic oligonucleotide
agtgcgttcactctgttaaaaagaa

SEQ ID NO: 689912 - DNA, 25 bp, Artificial sequence
  Synthetic oligonucleotide
cctgtccctcaaatcctctggaggg

SEQ ID NO: 689913 - DNA, 25 bp, Artificial sequence
  Synthetic oligonucleotide
agggaccgcggtatctttccaggca

SEQ ID NO: 689914 - DNA, 25 bp, Artificial sequence
  Synthetic oligonucleotide
ctggatcggcctccgaccgtaacta

SEQ ID NO: 689915 - DNA, 25 bp, Artificial sequence
  Synthetic oligonucleotide
tccctcaaatcctctggagggaccg

SEQ ID NO: 689916 - DNA, 25 bp, Artificial sequence
  Synthetic oligonucleotide
ctattcggtgcgttgggcagcgccc

SEQ ID NO: 689917 - DNA, 25 bp, Artificial sequence
  Synthetic oligonucleotide
gtgctggcggaagagccccctccga

SEQ ID NO: 689918 - DNA, 25 bp, Artificial sequence
  Synthetic oligonucleotide
cccaccctctggtgaccagccagcc

SEQ ID NO: 689919 - DNA, 25 bp, Artificial sequence
  Synthetic oligonucleotide
agccgccgagcgcacgcggtccgcc

SEQ ID NO: 689920 - DNA, 25 bp, Artificial sequence
  Synthetic oligonucleotide
gtcagccgaaggctccatgctgctc

SEQ ID NO: 689921 - DNA, 25 bp, Artificial sequence
  Synthetic oligonucleotide
agccagtcagccgaaggctccatgc

SEQ ID NO: 689922 - DNA, 25 bp, Artificial sequence
  Synthetic oligonucleotide
ccgagtcctttgtgtctagcccatt

SEQ ID NO: 689923 - DNA, 25 bp, Artificial sequence
  Synthetic oligonucleotide
aaactaaaccgctgcacgcctctga

SEQ ID NO: 689924 - DNA, 25 bp, Artificial sequence
  Synthetic oligonucleotide
ctctgacgcgacatctggacacggc

SEQ ID NO: 689925 - DNA, 25 bp, Artificial sequence
  Synthetic oligonucleotide
gctgccggagctgtcgacccggcct

SEQ ID NO: 689926 - DNA, 25 bp, Artificial sequence
  Synthetic oligonucleotide
ccggactaggtaggtggagtcgcac

SEQ ID NO: 689927 - DNA, 25 bp, Artificial sequence
  Synthetic oligonucleotide
cgcctggctgggacaagcaccgagt

SEQ ID NO: 689928 - DNA, 25 bp, Artificial sequence
  Synthetic oligonucleotide
ctgggacaagcaccgagtcctttgt

SEQ ID NO: 689929 - DNA, 25 bp, Artificial sequence
  Synthetic oligonucleotide
acaagcaccgagtcctttgtgtcta

SEQ ID NO: 689930 - DNA, 25 bp, Artificial sequence
  Synthetic oligonucleotide
tgcacgcctctgacgcgacatctgg

SEQ ID NO: 689931 - DNA, 25 bp, Artificial sequence
  Synthetic oligonucleotide
gtcctttgtgtctagcccattttta

SEQ ID NO: 689932 - DNA, 25 bp, Artificial sequence
  Synthetic oligonucleotide
tgtgtctagcccatttttattttcg

SEQ ID NO: 689933 - DNA, 25 bp, Artificial sequence
  Synthetic oligonucleotide
ttttaaccttcacgacagccgcgga

SEQ ID NO: 689934 - DNA, 25 bp, Artificial sequence
  Synthetic oligonucleotide
taaccttcacgacagccgcggagca

SEQ ID NO: 689935 - DNA, 25 bp, Artificial sequence
  Synthetic oligonucleotide
cgacagccgcggagcatctgagcgc

SEQ ID NO: 689936 - DNA, 25 bp, Artificial sequence
  Synthetic oligonucleotide
ctgtcgccgcgtcctcgcgtagaat

SEQ ID NO: 689937 - DNA, 25 bp, Artificial sequence
  Synthetic oligonucleotide
cgtcctcgcgtagaatggttgtctt

SEQ ID NO: 689938 - DNA, 25 bp, Artificial sequence
  Synthetic oligonucleotide
cctcgcgtagaatggttgtcttggc

SEQ ID NO: 689939 - DNA, 25 bp, Artificial sequence
  Synthetic oligonucleotide
tcttggcgaccgttggccgctgccg

SEQ ID NO: 689940 - DNA, 25 bp, Artificial sequence
  Synthetic oligonucleotide
cgaaattaaactaaaccgctgcacg

SEQ ID NO: 689941 - DNA, 25 bp, Artificial sequence
  Synthetic oligonucleotide
agaatggttgtcttggcgaccgttg

SEQ ID NO: 689942 - DNA, 25 bp, Artificial sequence
  Synthetic oligonucleotide
ctaccaggaacagccgcgctcccgc

SEQ ID NO: 689943 - DNA, 25 bp, Artificial sequence
  Synthetic oligonucleotide
acctccaagatctcggaacggctct

SEQ ID NO: 689944 - DNA, 25 bp, Artificial sequence
  Synthetic oligonucleotide
ccggacctccaagatctcggaacgg

SEQ ID NO: 689945 - DNA, 25 bp, Artificial sequence
  Synthetic oligonucleotide
gggccggacgcctggaacgcaactc

SEQ ID NO: 689946 - DNA, 25 bp, Artificial sequence
  Synthetic oligonucleotide
cggacgcctggaacgcaactccagg

SEQ ID NO: 689947 - DNA, 25 bp, Artificial sequence
  Synthetic oligonucleotide
ctagatttggaaaacaagcgaaatt

SEQ ID NO: 689948 - DNA, 25 bp, Artificial sequence
  Synthetic oligonucleotide
ctgacacggccctaccaggaacagc

SEQ ID NO: 689949 - DNA, 25 bp, Artificial sequence
  Synthetic oligonucleotide
cgcggattctggtgctgctcgcgtc

SEQ ID NO: 689950 - DNA, 25 bp, Artificial sequence
  Synthetic oligonucleotide
ttttattcctggctcccctcgtcga

SEQ ID NO: 689951 - DNA, 25 bp, Artificial sequence
  Synthetic oligonucleotide
cctcgtcgaaagtcttccattcttc

SEQ ID NO: 689952 - DNA, 25 bp, Artificial sequence
  Synthetic oligonucleotide
tccgctcctcttctagatttggaaa

SEQ ID NO: 689953 - DNA, 25 bp, Artificial sequence
  Synthetic oligonucleotide
ggaaagcgaggtcatctcattgctc

SEQ ID NO: 689954 - DNA, 25 bp, Artificial sequence
  Synthetic oligonucleotide
agcgaggtcatctcattgctctatc

SEQ ID NO: 689955 - DNA, 25 bp, Artificial sequence
  Synthetic oligonucleotide
ggtcatctcattgctctatccgcca

SEQ ID NO: 689956 - DNA, 25 bp, Artificial sequence
  Synthetic oligonucleotide
tcattgctctatccgccaatcagga

SEQ ID NO: 689957 - DNA, 25 bp, Artificial sequence
  Synthetic oligonucleotide
caatcaggaggctgaatgtcagttt

SEQ ID NO: 689958 - DNA, 25 bp, Artificial sequence
  Synthetic oligonucleotide
ttttgaactaaaagccgctccgctc

SEQ ID NO: 689959 - DNA, 25 bp, Artificial sequence
  Synthetic oligonucleotide
gtcttccattcttcaaactagatta

SEQ ID NO: 689960 - DNA, 25 bp, Artificial sequence
  Synthetic oligonucleotide
cctcttctagatttggaaaacaagc

SEQ ID NO: 689961 - DNA, 25 bp, Artificial sequence
  Synthetic oligonucleotide
tagctacatccgtcacctgacacgg

SEQ ID NO: 689962 - DNA, 25 bp, Artificial sequence
  Synthetic oligonucleotide
ctgggcgagggcttcattcttccgc

SEQ ID NO: 689963 - DNA, 25 bp, Artificial sequence
  Synthetic oligonucleotide
taccgtctgggcgagggcttcattc

SEQ ID NO: 689964 - DNA, 25 bp, Artificial sequence
  Synthetic oligonucleotide
tgctcccagtgaggcgcgtaccgtc

SEQ ID NO: 689965 - DNA, 25 bp, Artificial sequence
  Synthetic oligonucleotide
agattgctcccagtgaggcgcgtac

SEQ ID NO: 689966 - DNA, 25 bp, Artificial sequence
  Synthetic oligonucleotide
agagagattgctcccagtgaggcgc

SEQ ID NO: 689967 - DNA, 25 bp, Artificial sequence
  Synthetic oligonucleotide
gctggagagagattgctcccagtga

SEQ ID NO: 689968 - DNA, 25 bp, Artificial sequence
  Synthetic oligonucleotide
gtggccacggtgttaggagaggcgc

SEQ ID NO: 689969 - DNA, 25 bp, Artificial sequence
  Synthetic oligonucleotide
cagaccgcccagcgtttggggacgc

SEQ ID NO: 689970 - DNA, 25 bp, Artificial sequence
  Synthetic oligonucleotide
caggctggagagagattgctcccag

SEQ ID NO: 689971 - DNA, 25 bp, Artificial sequence
  Synthetic oligonucleotide
cgagggcttcattcttccgcggcgt

SEQ ID NO: 689972 - DNA, 25 bp, Artificial sequence
  Synthetic oligonucleotide
ggaaagctgggtgggcatgtgtgca

SEQ ID NO: 689973 - DNA, 25 bp, Artificial sequence
  Synthetic oligonucleotide
aggccagtcacttccggagccggtt

SEQ ID NO: 689974 - DNA, 25 bp, Artificial sequence
  Synthetic oligonucleotide
cagtcacttccggagccggttctga

SEQ ID NO: 689975 - DNA, 25 bp, Artificial sequence
  Synthetic oligonucleotide
gtcacttccggagccggttctgatc

SEQ ID NO: 689976 - DNA, 25 bp, Artificial sequence
  Synthetic oligonucleotide
cttccggagccggttctgatcccaa

SEQ ID NO: 689977 - DNA, 25 bp, Artificial sequence
  Synthetic oligonucleotide
cggagccggttctgatcccaacaga

SEQ ID NO: 689978 - DNA, 25 bp, Artificial sequence
  Synthetic oligonucleotide
gtcgccaggaatgtggctctgggga

SEQ ID NO: 689979 - DNA, 25 bp, Artificial sequence
  Synthetic oligonucleotide
tctgatcccaacagaccgcccagcg

SEQ ID NO: 689980 - DNA, 25 bp, Artificial sequence
  Synthetic oligonucleotide
tttgtccgggcagtgcctcgagcaa

SEQ ID NO: 689981 - DNA, 25 bp, Artificial sequence
  Synthetic oligonucleotide
agccggttctgatcccaacagaccg

SEQ ID NO: 689982 - DNA, 25 bp, Artificial sequence
  Synthetic oligonucleotide
tccgggcagtgcctcgagcaactgg

SEQ ID NO: 689983 - DNA, 25 bp, Artificial sequence
  Synthetic oligonucleotide
gccgccagcccgcttgcagggtccc

SEQ ID NO: 689984 - DNA, 25 bp, Artificial sequence
  Synthetic oligonucleotide
ctccgcccaaaaggcggcaaggagc

SEQ ID NO: 689985 - DNA, 25 bp, Artificial sequence
  Synthetic oligonucleotide
cccaaaaggcggcaaggagccgaga

SEQ ID NO: 689986 - DNA, 25 bp, Artificial sequence
  Synthetic oligonucleotide
ccgagaggctgcttcggagtgtgag

SEQ ID NO: 689987 - DNA, 25 bp, Artificial sequence
  Synthetic oligonucleotide
gaggacagccggaccgagccaacgc

SEQ ID NO: 689988 - DNA, 25 bp, Artificial sequence
  Synthetic oligonucleotide
ctcggcaactcgcagcggcagggtc

SEQ ID NO: 689989 - DNA, 25 bp, Artificial sequence
  Synthetic oligonucleotide
tagtctccggcgctggcgcctatgg

SEQ ID NO: 689990 - DNA, 25 bp, Artificial sequence
  Synthetic oligonucleotide
cagtgcctcgagcaactgggaaggc

SEQ ID NO: 689991 - DNA, 25 bp, Artificial sequence
  Synthetic oligonucleotide
caggcgcccgggtgagtagccaggc

SEQ ID NO: 689992 - DNA, 25 bp, Artificial sequence
  Synthetic oligonucleotide
taacggagagggagtcgccaggaat

SEQ ID NO: 689993 - DNA, 25 bp, Artificial sequence
  Synthetic oligonucleotide
tgcctcgagcaactgggaaggccaa

SEQ ID NO: 689994 - DNA, 25 bp, Artificial sequence
  Synthetic oligonucleotide
cctcgagcaactgggaaggccaagg

SEQ ID NO: 689995 - DNA, 25 bp, Artificial sequence
  Synthetic oligonucleotide
caaggcggagggaaacttggcttcg

SEQ ID NO: 689996 - DNA, 25 bp, Artificial sequence
  Synthetic oligonucleotide
gaaacttggcttcggggagaagtgc

SEQ ID NO: 689997 - DNA, 25 bp, Artificial sequence
  Synthetic oligonucleotide
aagtgcgatcgcagccgggaggctt

SEQ ID NO: 689998 - DNA, 25 bp, Artificial sequence
  Synthetic oligonucleotide
ccggcccgaccaggcgctttgtgtc

SEQ ID NO: 689999 - DNA, 25 bp, Artificial sequence
  Synthetic oligonucleotide
ccaggcgctttgtgtcggggcgcga

SEQ ID NO: 690000 - DNA, 25 bp, Artificial sequence
  Synthetic oligonucleotide
gcgcgaggatctggagcgaactgct

SEQ ID NO: 690001 - DNA, 25 bp, Artificial sequence
  Synthetic oligonucleotide
ggcgcctatggtcggcctccgacag

SEQ ID NO: 690002 - DNA, 25 bp, Artificial sequence
  Synthetic oligonucleotide
ccgggacatccacctggagcgctga

SEQ ID NO: 690003 - DNA, 25 bp, Artificial sequence
  Synthetic oligonucleotide
aggcattccgggagatcagctcgcc

SEQ ID NO: 690004 - DNA, 25 bp, Artificial sequence
  Synthetic oligonucleotide
aacgcggcgcaccaacctgccggcc

SEQ ID NO: 690005 - DNA, 25 bp, Artificial sequence
  Synthetic oligonucleotide
gcaccgacttttctgagaagttcta

SEQ ID NO: 690006 - DNA, 25 bp, Artificial sequence
  Synthetic oligonucleotide
ggcgggcaccgacttttctgagaag

SEQ ID NO: 690007 - DNA, 25 bp, Artificial sequence
  Synthetic oligonucleotide
gcgcaagagtacgagcgccgagccc

SEQ ID NO: 690008 - DNA, 25 bp, Artificial sequence
  Synthetic oligonucleotide
ccgagcccgcgtggcgcaagagtac

SEQ ID NO: 690009 - DNA, 25 bp, Artificial sequence
  Synthetic oligonucleotide
ttttcgggatgcttgctgatcaccc

SEQ ID NO: 690010 - DNA, 25 bp, Artificial sequence
  Synthetic oligonucleotide
cccttttcgggatgcttgctgatca

SEQ ID NO: 690011 - DNA, 25 bp, Artificial sequence
  Synthetic oligonucleotide
gagaagttctagtgctcccaagccc

SEQ ID NO: 690012 - DNA, 25 bp, Artificial sequence
  Synthetic oligonucleotide
cgggagatcagctcgcccgaaagcc

SEQ ID NO: 690013 - DNA, 25 bp, Artificial sequence
  Synthetic oligonucleotide
cccttcactttctagctggaaagtt

SEQ ID NO: 690014 - DNA, 25 bp, Artificial sequence
  Synthetic oligonucleotide
cgaggaccaaagctgcccgggacat

SEQ ID NO: 690015 - DNA, 25 bp, Artificial sequence
  Synthetic oligonucleotide
catcaaccaggcattccgggagatc

SEQ ID NO: 690016 - DNA, 25 bp, Artificial sequence
  Synthetic oligonucleotide
tctagtatccacctctcgccatcaa

SEQ ID NO: 690017 - DNA, 25 bp, Artificial sequence
  Synthetic oligonucleotide
gggcccagtctctagtatccacctc

SEQ ID NO: 690018 - DNA, 25 bp, Artificial sequence
  Synthetic oligonucleotide
taacgaatggctctcttggtgtccc

SEQ ID NO: 690019 - DNA, 25 bp, Artificial sequence
  Synthetic oligonucleotide
ggtactttaacgaatggctctcttg

SEQ ID NO: 690020 - DNA, 25 bp, Artificial sequence
  Synthetic oligonucleotide
gggcaggtactttaacgaatggctc

SEQ ID NO: 690021 - DNA, 25 bp, Artificial sequence
  Synthetic oligonucleotide
cccgtcccttttcgggatgcttgct

SEQ ID NO: 690022 - DNA, 25 bp, Artificial sequence
  Synthetic oligonucleotide
gagcaacctctactccggacgcaca

SEQ ID NO: 690023 - DNA, 25 bp, Artificial sequence
  Synthetic oligonucleotide
aggcttcagtccctctggtggaccc

SEQ ID NO: 690024 - DNA, 25 bp, Artificial sequence
  Synthetic oligonucleotide
ctgaggcttcagtccctctggtgga

SEQ ID NO: 690025 - DNA, 25 bp, Artificial sequence
  Synthetic oligonucleotide
agcgctgaggcttcagtccctctgg

SEQ ID NO: 690026 - DNA, 25 bp, Artificial sequence
  Synthetic oligonucleotide
acatccacctggagcgctgaggctt

SEQ ID NO: 690027 - DNA, 25 bp, Artificial sequence
  Synthetic oligonucleotide
aaagctgcccgggacatccacctgg

SEQ ID NO: 690028 - DNA, 25 bp, Artificial sequence
  Synthetic oligonucleotide
tccggtacacacaggtaagtcgccc

SEQ ID NO: 690029 - DNA, 25 bp, Artificial sequence
  Synthetic oligonucleotide
gcgctccggtacacacaggtaagtc

SEQ ID NO: 690030 - DNA, 25 bp, Artificial sequence
  Synthetic oligonucleotide
tttctgagaagttctagtgctccca

SEQ ID NO: 690031 - DNA, 25 bp, Artificial sequence
  Synthetic oligonucleotide
ctactccggacgcacaggcattccc

SEQ ID NO: 690032 - DNA, 25 bp, Artificial sequence
  Synthetic oligonucleotide
tcgccatcaaccaggcattccggga

SEQ ID NO: 690033 - DNA, 25 bp, Artificial sequence
  Synthetic oligonucleotide
tgtcgctctccaggagcaacctcta

SEQ ID NO: 690034 - DNA, 25 bp, Artificial sequence
  Synthetic oligonucleotide
cagggctcctgtcgctctccaggag

SEQ ID NO: 690035 - DNA, 25 bp, Artificial sequence
  Synthetic oligonucleotide
atgcgagcgcccctttaaaagcgcg

SEQ ID NO: 690036 - DNA, 25 bp, Artificial sequence
  Synthetic oligonucleotide
aggaatccccaggaatgcgagcgcc

SEQ ID NO: 690037 - DNA, 25 bp, Artificial sequence
  Synthetic oligonucleotide
gcccattggccggaggaatccccag

SEQ ID NO: 690038 - DNA, 25 bp, Artificial sequence
  Synthetic oligonucleotide
tagctggaaagttgcgcgccaggca

SEQ ID NO: 690039 - DNA, 25 bp, Artificial sequence
  Synthetic oligonucleotide
tttctagctggaaagttgcgcgcca

SEQ ID NO: 690040 - DNA, 25 bp, Artificial sequence
  Synthetic oligonucleotide
gccgcgctccggtacacacaggtaa

SEQ ID NO: 690041 - DNA, 25 bp, Artificial sequence
  Synthetic oligonucleotide
caaccaggcattccgggagatcagc

SEQ ID NO: 690042 - DNA, 25 bp, Artificial sequence
  Synthetic oligonucleotide
cagccatgggcccttggagccgcag

SEQ ID NO: 690043 - DNA, 25 bp, Artificial sequence
  Synthetic oligonucleotide
tccgtagaaataaaggcacctgcca

SEQ ID NO: 690044 - DNA, 25 bp, Artificial sequence
  Synthetic oligonucleotide
gggcatccgtagaaataaaggcacc

SEQ ID NO: 690045 - DNA, 25 bp, Artificial sequence
  Synthetic oligonucleotide
gaggggcatccgtagaaataaaggc

SEQ ID NO: 690046 - DNA, 25 bp, Artificial sequence
  Synthetic oligonucleotide
aaggagaggggcatccgtagaaata

SEQ ID NO: 690047 - DNA, 25 bp, Artificial sequence
  Synthetic oligonucleotide
ggggacgatcttcgagggaaggaga

SEQ ID NO: 690048 - DNA, 25 bp, Artificial sequence
  Synthetic oligonucleotide
agccaggagtcgtggggacgatctt

SEQ ID NO: 690049 - DNA, 25 bp, Artificial sequence
  Synthetic oligonucleotide
agaaggggtgccctggtgcaagtcg

SEQ ID NO: 690050 - DNA, 25 bp, Artificial sequence
  Synthetic oligonucleotide
ctccggaccccccagtgatgggagt

SEQ ID NO: 690051 - DNA, 25 bp, Artificial sequence
  Synthetic oligonucleotide
tccaagaaagttcgggtcctgagga

SEQ ID NO: 690052 - DNA, 25 bp, Artificial sequence
  Synthetic oligonucleotide
tcttccaagaaagttcgggtcctga

SEQ ID NO: 690053 - DNA, 25 bp, Artificial sequence
  Synthetic oligonucleotide
cgtagaaataaaggcacctgccatg

SEQ ID NO: 690054 - DNA, 25 bp, Artificial sequence
  Synthetic oligonucleotide
ggacgcattcgggccgcaagctccg

SEQ ID NO: 690055 - DNA, 25 bp, Artificial sequence
  Synthetic oligonucleotide
ccttcctctcccgtcgtcaccgctt

SEQ ID NO: 690056 - DNA, 25 bp, Artificial sequence
  Synthetic oligonucleotide
ggcgcctgccctcgctcggcgtccc

SEQ ID NO: 690057 - DNA, 25 bp, Artificial sequence
  Synthetic oligonucleotide
gaagtcagttcagactccagcccgc

SEQ ID NO: 690058 - DNA, 25 bp, Artificial sequence
  Synthetic oligonucleotide
gtgagcttgcggaagtcagttcaga

SEQ ID NO: 690059 - DNA, 25 bp, Artificial sequence
  Synthetic oligonucleotide
acctgtgagcttgcggaagtcagtt

SEQ ID NO: 690060 - DNA, 25 bp, Artificial sequence
  Synthetic oligonucleotide
agcacctgtgagcttgcggaagtca

SEQ ID NO: 690061 - DNA, 25 bp, Artificial sequence
  Synthetic oligonucleotide
tgcaaagcacctgtgagcttgcgga

SEQ ID NO: 690062 - DNA, 25 bp, Artificial sequence
  Synthetic oligonucleotide
cgtcggaactgcaaagcacctgtga

SEQ ID NO: 690063 - DNA, 25 bp, Artificial sequence
  Synthetic oligonucleotide
tggcgtcggaactgcaaagcacctg

SEQ ID NO: 690064 - DNA, 25 bp, Artificial sequence
  Synthetic oligonucleotide
tcagtggcgtcggaactgcaaagca

SEQ ID NO: 690065 - DNA, 25 bp, Artificial sequence
  Synthetic oligonucleotide
ctctcagtggcgtcggaactgcaaa

SEQ ID NO: 690066 - DNA, 25 bp, Artificial sequence
  Synthetic oligonucleotide
ctcccgtcgtcaccgcttcccttct

SEQ ID NO: 690067 - DNA, 25 bp, Artificial sequence
  Synthetic oligonucleotide
gagactgaaagggaacggtgggcta

SEQ ID NO: 690068 - DNA, 25 bp, Artificial sequence
  Synthetic oligonucleotide
acctgccatgccaagaaaggtcgta

SEQ ID NO: 690069 - DNA, 25 bp, Artificial sequence
  Synthetic oligonucleotide
ccctgacttgcgagggacgcattcg

SEQ ID NO: 690070 - DNA, 25 bp, Artificial sequence
  Synthetic oligonucleotide
cgagtcacccggttccatctacctt

SEQ ID NO: 690071 - DNA, 25 bp, Artificial sequence
  Synthetic oligonucleotide
gcggcgctgttggtttcggtgagca

SEQ ID NO: 690072 - DNA, 25 bp, Artificial sequence
  Synthetic oligonucleotide
taaaatgagaaaggagactgaaagg

SEQ ID NO: 690073 - DNA, 25 bp, Artificial sequence
  Synthetic oligonucleotide
taaagacatctccaataaaatgaga

SEQ ID NO: 690074 - DNA, 25 bp, Artificial sequence
  Synthetic oligonucleotide
ccctcgctctgaggagtggtgcatt

SEQ ID NO: 690075 - DNA, 25 bp, Artificial sequence
  Synthetic oligonucleotide
tggggtactggagaataaagacatc

SEQ ID NO: 690076 - DNA, 25 bp, Artificial sequence
  Synthetic oligonucleotide
tgcattcccggtctaaggaaagtgg

SEQ ID NO: 690077 - DNA, 25 bp, Artificial sequence
  Synthetic oligonucleotide
gagtggtgcattcccggtctaagga

SEQ ID NO: 690078 - DNA, 25 bp, Artificial sequence
  Synthetic oligonucleotide
gccatgccaagaaaggtcgtaaata

SEQ ID NO: 690079 - DNA, 25 bp, Artificial sequence
  Synthetic oligonucleotide
ggtactggagaataaagacatctcc

SEQ ID NO: 690080 - DNA, 25 bp, Artificial sequence
  Synthetic oligonucleotide
ccaagaaaggtcgtaaataggagtg

SEQ ID NO: 690081 - DNA, 25 bp, Artificial sequence
  Synthetic oligonucleotide
tttcggtgagcaggagggaaccctc

SEQ ID NO: 690082 - DNA, 25 bp, Artificial sequence
  Synthetic oligonucleotide
aatcttcttggcgaaaacgcggaga

SEQ ID NO: 690083 - DNA, 25 bp, Artificial sequence
  Synthetic oligonucleotide
gccaatcttcttggcgaaaacgcgg

SEQ ID NO: 690084 - DNA, 25 bp, Artificial sequence
  Synthetic oligonucleotide
gttcagcttgcttttgccccgtctc

SEQ ID NO: 690085 - DNA, 25 bp, Artificial sequence
  Synthetic oligonucleotide
gagccaatcttcttggcgaaaacgc

SEQ ID NO: 690086 - DNA, 25 bp, Artificial sequence
  Synthetic oligonucleotide
agagccaatcttcttggcgaaaacg

SEQ ID NO: 690087 - DNA, 25 bp, Artificial sequence
  Synthetic oligonucleotide
atcttcttggcgaaaacgcggagaa

SEQ ID NO: 690088 - DNA, 25 bp, Artificial sequence
  Synthetic oligonucleotide
agcggacggtctttgcattgccgcc

SEQ ID NO: 690089 - DNA, 25 bp, Artificial sequence
  Synthetic oligonucleotide
agccaatcttcttggcgaaaacgcg

SEQ ID NO: 690090 - DNA, 25 bp, Artificial sequence
  Synthetic oligonucleotide
tcttcttggcgaaaacgcggagaaa

SEQ ID NO: 690091 - DNA, 25 bp, Artificial sequence
  Synthetic oligonucleotide
agctggcagcggacggtctttgcat

SEQ ID NO: 690092 - DNA, 25 bp, Artificial sequence
  Synthetic oligonucleotide
gctggcagcggacggtctttgcatt

SEQ ID NO: 690093 - DNA, 25 bp, Artificial sequence
  Synthetic oligonucleotide
tggcagcggacggtctttgcattgc

SEQ ID NO: 690094 - DNA, 25 bp, Artificial sequence
  Synthetic oligonucleotide
ggcagcggacggtctttgcattgcc

SEQ ID NO: 690095 - DNA, 25 bp, Artificial sequence
  Synthetic oligonucleotide
aagagccaatcttcttggcgaaaac

SEQ ID NO: 690096 - DNA, 25 bp, Artificial sequence
  Synthetic oligonucleotide
cagcggacggtctttgcattgccgc

SEQ ID NO: 690097 - DNA, 25 bp, Artificial sequence
  Synthetic oligonucleotide
gggttcagcttgcttttgccccgtc

SEQ ID NO: 690098 - DNA, 25 bp, Artificial sequence
  Synthetic oligonucleotide
gcggacggtctttgcattgccgcct

SEQ ID NO: 690099 - DNA, 25 bp, Artificial sequence
  Synthetic oligonucleotide
cccgtctccgtcgacgcaatcgcca

SEQ ID NO: 690100 - DNA, 25 bp, Artificial sequence
  Synthetic oligonucleotide
gcagcggacggtctttgcattgccg

SEQ ID NO: 690101 - DNA, 25 bp, Artificial sequence
  Synthetic oligonucleotide
tttttcgggttcagcttgcttttgc

SEQ ID NO: 690102 - DNA, 25 bp, Artificial sequence
  Synthetic oligonucleotide
ggacggtctttgcattgccgcctcc

SEQ ID NO: 690103 - DNA, 25 bp, Artificial sequence
  Synthetic oligonucleotide
cggacggtctttgcattgccgcctc

SEQ ID NO: 690104 - DNA, 25 bp, Artificial sequence
  Synthetic oligonucleotide
gggaaatgcgctctggcccatgtct

SEQ ID NO: 690105 - DNA, 25 bp, Artificial sequence
  Synthetic oligonucleotide
ggaaatgcgctctggcccatgtctg

SEQ ID NO: 690106 - DNA, 25 bp, Artificial sequence
  Synthetic oligonucleotide
catgtctgcgcactcgtagttccac

SEQ ID NO: 690107 - DNA, 25 bp, Artificial sequence
  Synthetic oligonucleotide
atgtctgcgcactcgtagttccacc

SEQ ID NO: 690108 - DNA, 25 bp, Artificial sequence
  Synthetic oligonucleotide
cactcgtagttccacccctcagccc

SEQ ID NO: 690109 - DNA, 25 bp, Artificial sequence
  Synthetic oligonucleotide
tccgtcgacgcaatcgccaccagtc

SEQ ID NO: 690110 - DNA, 25 bp, Artificial sequence
  Synthetic oligonucleotide
atttttcgggttcagcttgcttttg

SEQ ID NO: 690111 - DNA, 25 bp, Artificial sequence
  Synthetic oligonucleotide
taagagccaatcttcttggcgaaaa

SEQ ID NO: 690112 - DNA, 25 bp, Artificial sequence
  Synthetic oligonucleotide
ttttcgggttcagcttgcttttgcc

SEQ ID NO: 690113 - DNA, 25 bp, Artificial sequence
  Synthetic oligonucleotide
tttcgggttcagcttgcttttgccc

SEQ ID NO: 690114 - DNA, 25 bp, Artificial sequence
  Synthetic oligonucleotide
tctccgtcgacgcaatcgccaccag

SEQ ID NO: 690115 - DNA, 25 bp, Artificial sequence
  Synthetic oligonucleotide
cgtcgacgcaatcgccaccagtcaa

SEQ ID NO: 690116 - DNA, 25 bp, Artificial sequence
  Synthetic oligonucleotide
tcgccaccagtcaatggggtggtcg

SEQ ID NO: 690117 - DNA, 25 bp, Artificial sequence
  Synthetic oligonucleotide
cgccaccagtcaatggggtggtcgt

SEQ ID NO: 690118 - DNA, 25 bp, Artificial sequence
  Synthetic oligonucleotide
gccaccagtcaatggggtggtcgtt

SEQ ID NO: 690119 - DNA, 25 bp, Artificial sequence
  Synthetic oligonucleotide
gtaagagccaatcttcttggcgaaa

SEQ ID NO: 690120 - DNA, 25 bp, Artificial sequence
  Synthetic oligonucleotide
ccctcagccccagtgtttgttattt

SEQ ID NO: 690121 - DNA, 25 bp, Artificial sequence
  Synthetic oligonucleotide
gacggtctttgcattgccgcctccc

SEQ ID NO: 690122 - DNA, 25 bp, Artificial sequence
  Synthetic oligonucleotide
tgtagctgatgaaccgaataactac

SEQ ID NO: 690123 - DNA, 25 bp, Artificial sequence
  Synthetic oligonucleotide
gtgcccgtgtcgcagccgcgcgaga

SEQ ID NO: 690124 - DNA, 25 bp, Artificial sequence
  Synthetic oligonucleotide
ctggtctggacagagtgcccgtgtc

SEQ ID NO: 690125 - DNA, 25 bp, Artificial sequence
  Synthetic oligonucleotide
ctggtctggacacagtgcccgtgtc

SEQ ID NO: 690126 - DNA, 25 bp, Artificial sequence
  Synthetic oligonucleotide
tggtcagagatagctggcctggtct

SEQ ID NO: 690127 - DNA, 25 bp, Artificial sequence
  Synthetic oligonucleotide
tggtcagagatacctggcctggtct

SEQ ID NO: 690128 - DNA, 25 bp, Artificial sequence
  Synthetic oligonucleotide
taaggatgactctggtcagagatac

SEQ ID NO: 690129 - DNA, 25 bp, Artificial sequence
  Synthetic oligonucleotide
taaggatgactcaggtcagagatac

SEQ ID NO: 690130 - DNA, 25 bp, Artificial sequence
  Synthetic oligonucleotide
gattgatttacggcgctaaggatga

SEQ ID NO: 690131 - DNA, 25 bp, Artificial sequence
  Synthetic oligonucleotide
gattgatttacgccgctaaggatga

SEQ ID NO: 690132 - DNA, 25 bp, Artificial sequence
  Synthetic oligonucleotide
gcaactcatcgaatgatttacggcg

SEQ ID NO: 690133 - DNA, 25 bp, Artificial sequence
  Synthetic oligonucleotide
gtgcccgtgtcggagccgcgcgaga

SEQ ID NO: 690134 - DNA, 25 bp, Artificial sequence
  Synthetic oligonucleotide
accagccagctaacaactcgcgccc

SEQ ID NO: 690135 - DNA, 25 bp, Artificial sequence
  Synthetic oligonucleotide
accagccagctatcaactcgcgccc

SEQ ID NO: 690136 - DNA, 25 bp, Artificial sequence
  Synthetic oligonucleotide
gtctctggtgtagctgatgatccga

SEQ ID NO: 690137 - DNA, 25 bp, Artificial sequence
  Synthetic oligonucleotide
gtctctggtgtacctgatgatccga

SEQ ID NO: 690138 - DNA, 25 bp, Artificial sequence
  Synthetic oligonucleotide
atggatttccgtctctggtgtagct

SEQ ID NO: 690139 - DNA, 25 bp, Artificial sequence
  Synthetic oligonucleotide
atggatttccgtgtctggtgtagct

SEQ ID NO: 690140 - DNA, 25 bp, Artificial sequence
  Synthetic oligonucleotide
tggtcgagcgatggatttccgtctc

SEQ ID NO: 690141 - DNA, 25 bp, Artificial sequence
  Synthetic oligonucleotide
tggtcgagcgatcgatttccgtctc

SEQ ID NO: 690142 - DNA, 25 bp, Artificial sequence
  Synthetic oligonucleotide
caccgcaggtgttgagaaggcactt

SEQ ID NO: 690143 - DNA, 25 bp, Artificial sequence
  Synthetic oligonucleotide
caccgcaggtgtagagaaggcactt

SEQ ID NO: 690144 - DNA, 25 bp, Artificial sequence
  Synthetic oligonucleotide
cgctggttagcagcgcaggtgtaga

SEQ ID NO: 690145 - DNA, 25 bp, Artificial sequence
  Synthetic oligonucleotide
cgctggttagcaccgcaggtgtaga

SEQ ID NO: 690146 - DNA, 25 bp, Artificial sequence
  Synthetic oligonucleotide
gcaactcatcgattgatttacggcg

SEQ ID NO: 690147 - DNA, 25 bp, Artificial sequence
  Synthetic oligonucleotide
ttgtcatgaactatatccgtaacct

SEQ ID NO: 690148 - DNA, 25 bp, Artificial sequence
  Synthetic oligonucleotide
cgagatatggcccgcgctggagttt

SEQ ID NO: 690149 - DNA, 25 bp, Artificial sequence
  Synthetic oligonucleotide
tgtagctgatgatccgaataactac

SEQ ID NO: 690150 - DNA, 25 bp, Artificial sequence
  Synthetic oligonucleotide
tagtgaaacaggggcaatggtgcgc

SEQ ID NO: 690151 - DNA, 25 bp, Artificial sequence
  Synthetic oligonucleotide
tagtgaaacaggcgcaatggtgcgc

SEQ ID NO: 690152 - DNA, 25 bp, Artificial sequence
  Synthetic oligonucleotide
ttgtcatgaactttatccgtaacct

SEQ ID NO: 690153 - DNA, 25 bp, Artificial sequence
  Synthetic oligonucleotide
ccaatgtaaataatgtcatgaacta

SEQ ID NO: 690154 - DNA, 25 bp, Artificial sequence
  Synthetic oligonucleotide
ccaatgtaaatattgtcatgaacta

SEQ ID NO: 690155 - DNA, 25 bp, Artificial sequence
  Synthetic oligonucleotide
ggagtttcaatagcggagatcatgc

SEQ ID NO: 690156 - DNA, 25 bp, Artificial sequence
  Synthetic oligonucleotide
ctggtggctggaccaatgtaaatat

SEQ ID NO: 690157 - DNA, 25 bp, Artificial sequence
  Synthetic oligonucleotide
ggagatcatgcaagctggtggctgg

SEQ ID NO: 690158 - DNA, 25 bp, Artificial sequence
  Synthetic oligonucleotide
ggagatcatgcatgctggtggctgg

SEQ ID NO: 690159 - DNA, 25 bp, Artificial sequence
  Synthetic oligonucleotide
cgagatatggccggcgctggagttt

SEQ ID NO: 690160 - DNA, 25 bp, Artificial sequence
  Synthetic oligonucleotide
ctggtggctggagcaatgtaaatat

SEQ ID NO: 690161 - DNA, 25 bp, Artificial sequence
  Synthetic oligonucleotide
ggagtttcaataccggagatcatgc

SEQ ID NO: 690162 - DNA, 25 bp, Artificial sequence
  Synthetic oligonucleotide
ctggtctggacagagtgcccgtgtc

SEQ ID NO: 690163 - DNA, 25 bp, Artificial sequence
  Synthetic oligonucleotide
gtgcccgtgtcggagccgcgcgaga

SEQ ID NO: 690164 - DNA, 25 bp, Artificial sequence
  Synthetic oligonucleotide
gtgcccgtgtcgcagccgcgcgaga

SEQ ID NO: 690165 - DNA, 25 bp, Artificial sequence
  Synthetic oligonucleotide
ggagtttcaatagcggagatcatgc

SEQ ID NO: 690166 - DNA, 25 bp, Artificial sequence
  Synthetic oligonucleotide
cgagatatggccggcgctggagttt

SEQ ID NO: 690167 - DNA, 25 bp, Artificial sequence
  Synthetic oligonucleotide
ggagtttcaataccggagatcatgc

SEQ ID NO: 690168 - DNA, 25 bp, Artificial sequence
  Synthetic oligonucleotide
ctggtctggacacagtgcccgtgtc

SEQ ID NO: 690169 - DNA, 25 bp, Artificial sequence
  Synthetic oligonucleotide
gcaactcatcgaatgatttacggcg

SEQ ID NO: 690170 - DNA, 25 bp, Artificial sequence
  Synthetic oligonucleotide
cgagatatggcccgcgctggagttt

SEQ ID NO: 690171 - DNA, 25 bp, Artificial sequence
  Synthetic oligonucleotide
tggtcagagatagctggcctggtct

SEQ ID NO: 690172 - DNA, 25 bp, Artificial sequence
  Synthetic oligonucleotide
tggtcagagatacctggcctggtct

SEQ ID NO: 690173 - DNA, 25 bp, Artificial sequence
  Synthetic oligonucleotide
taaggatgactcaggtcagagatac

SEQ ID NO: 690174 - DNA, 25 bp, Artificial sequence
  Synthetic oligonucleotide
taaggatgactctggtcagagatac

SEQ ID NO: 690175 - DNA, 25 bp, Artificial sequence
  Synthetic oligonucleotide
gattgatttacgccgctaaggatga

SEQ ID NO: 690176 - DNA, 25 bp, Artificial sequence
  Synthetic oligonucleotide
ggagatcatgcaagctggtggctgg

SEQ ID NO: 690177 - DNA, 25 bp, Artificial sequence
  Synthetic oligonucleotide
gcaactcatcgattgatttacggcg

SEQ ID NO: 690178 - DNA, 25 bp, Artificial sequence
  Synthetic oligonucleotide
tagtgaaacaggcgcaatggtgcgc

SEQ ID NO: 690179 - DNA, 25 bp, Artificial sequence
  Synthetic oligonucleotide
accagccagctatcaactcgcgccc

SEQ ID NO: 690180 - DNA, 25 bp, Artificial sequence
  Synthetic oligonucleotide
accagccagctaacaactcgcgccc

SEQ ID NO: 690181 - DNA, 25 bp, Artificial sequence
  Synthetic oligonucleotide
gattgatttacggcgctaaggatga

SEQ ID NO: 690182 - DNA, 25 bp, Artificial sequence
  Synthetic oligonucleotide
caccgcaggtgttgagaaggcactt

SEQ ID NO: 690183 - DNA, 25 bp, Artificial sequence
  Synthetic oligonucleotide
tgtagctgatgatccgaataactac

SEQ ID NO: 690184 - DNA, 25 bp, Artificial sequence
  Synthetic oligonucleotide
cgctggttagcaccgcaggtgtaga

SEQ ID NO: 690185 - DNA, 25 bp, Artificial sequence
  Synthetic oligonucleotide
tgtagctgatgaaccgaataactac

SEQ ID NO: 690186 - DNA, 25 bp, Artificial sequence
  Synthetic oligonucleotide
gtctctggtgtacctgatgatccga

SEQ ID NO: 690187 - DNA, 25 bp, Artificial sequence
  Synthetic oligonucleotide
gtctctggtgtagctgatgatccga

SEQ ID NO: 690188 - DNA, 25 bp, Artificial sequence
  Synthetic oligonucleotide
atggatttccgtctctggtgtagct

SEQ ID NO: 690189 - DNA, 25 bp, Artificial sequence
  Synthetic oligonucleotide
atggatttccgtgtctggtgtagct

SEQ ID NO: 690190 - DNA, 25 bp, Artificial sequence
  Synthetic oligonucleotide
ttgtcatgaactttatccgtaacct

SEQ ID NO: 690191 - DNA, 25 bp, Artificial sequence
  Synthetic oligonucleotide
tggtcgagcgatggatttccgtctc

SEQ ID NO: 690192 - DNA, 25 bp, Artificial sequence
  Synthetic oligonucleotide
ggagatcatgcatgctggtggctgg

SEQ ID NO: 690193 - DNA, 25 bp, Artificial sequence
  Synthetic oligonucleotide
caccgcaggtgtagagaaggcactt

SEQ ID NO: 690194 - DNA, 25 bp, Artificial sequence
  Synthetic oligonucleotide
cgctggttagcagcgcaggtgtaga

SEQ ID NO: 690195 - DNA, 25 bp, Artificial sequence
  Synthetic oligonucleotide
tagtgaaacaggggcaatggtgcgc

SEQ ID NO: 690196 - DNA, 25 bp, Artificial sequence
  Synthetic oligonucleotide
ttgtcatgaactatatccgtaacct

SEQ ID NO: 690197 - DNA, 25 bp, Artificial sequence
  Synthetic oligonucleotide
ccaatgtaaatattgtcatgaacta

SEQ ID NO: 690198 - DNA, 25 bp, Artificial sequence
  Synthetic oligonucleotide
ccaatgtaaataatgtcatgaacta

SEQ ID NO: 690199 - DNA, 25 bp, Artificial sequence
  Synthetic oligonucleotide
ctggtggctggagcaatgtaaatat

SEQ ID NO: 690200 - DNA, 25 bp, Artificial sequence
  Synthetic oligonucleotide
ctggtggctggaccaatgtaaatat

SEQ ID NO: 690201 - DNA, 25 bp, Artificial sequence
  Synthetic oligonucleotide
tggtcgagcgatcgatttccgtctc

SEQ ID NO: 690202 - DNA, 25 bp, Artificial sequence
  Synthetic oligonucleotide
gaccaagtgacagcaatgctgtttc

SEQ ID NO: 690203 - DNA, 25 bp, Artificial sequence
  Synthetic oligonucleotide
aatgctgtttcactggttatgcggc

SEQ ID NO: 690204 - DNA, 25 bp, Artificial sequence
  Synthetic oligonucleotide
gcggcatggtgcaagttgaataacc

SEQ ID NO: 690205 - DNA, 25 bp, Artificial sequence
  Synthetic oligonucleotide
tcagggttaaagatatctcacgtac

SEQ ID NO: 690206 - DNA, 25 bp, Artificial sequence
  Synthetic oligonucleotide
tcagggttaaagttatctcacgtac

SEQ ID NO: 690207 - DNA, 25 bp, Artificial sequence
  Synthetic oligonucleotide
atggaaaatagccatcgctgccagg

SEQ ID NO: 690208 - DNA, 25 bp, Artificial sequence
  Synthetic oligonucleotide
atggaaaatagcgatcgctgccagg

SEQ ID NO: 690209 - DNA, 25 bp, Artificial sequence
  Synthetic oligonucleotide
tcgttcactcatcgaaaatagcgat

SEQ ID NO: 690210 - DNA, 25 bp, Artificial sequence
  Synthetic oligonucleotide
tcgttcactcatggaaaatagcgat

SEQ ID NO: 690211 - DNA, 25 bp, Artificial sequence
  Synthetic oligonucleotide
ctctagcgttcgtacgcactgattt

SEQ ID NO: 690212 - DNA, 25 bp, Artificial sequence
  Synthetic oligonucleotide
ctctagcgttcgaacgcactgattt

SEQ ID NO: 690213 - DNA, 25 bp, Artificial sequence
  Synthetic oligonucleotide
acgtgcaaaacaggctctagcgttc

SEQ ID NO: 690214 - DNA, 25 bp, Artificial sequence
  Synthetic oligonucleotide
acgtgcaaaacacgctctagcgttc

SEQ ID NO: 690215 - DNA, 25 bp, Artificial sequence
  Synthetic oligonucleotide
ccgggctgccaccaccaagtgacag

SEQ ID NO: 690216 - DNA, 25 bp, Artificial sequence
  Synthetic oligonucleotide
atgccggtgaacctgcaaaacaggc

SEQ ID NO: 690217 - DNA, 25 bp, Artificial sequence
  Synthetic oligonucleotide
gcggcatggtgctagttgaataacc

SEQ ID NO: 690218 - DNA, 25 bp, Artificial sequence
  Synthetic oligonucleotide
ccgggctgccacgaccaagtgacag

SEQ ID NO: 690219 - DNA, 25 bp, Artificial sequence
  Synthetic oligonucleotide
ccagctaaacatgcttcatcgtcgg

SEQ ID NO: 690220 - DNA, 25 bp, Artificial sequence
  Synthetic oligonucleotide
ccagctaaacatccttcatcgtcgg

SEQ ID NO: 690221 - DNA, 25 bp, Artificial sequence
  Synthetic oligonucleotide
gcaacatttggggcagctaaacatg

SEQ ID NO: 690222 - DNA, 25 bp, Artificial sequence
  Synthetic oligonucleotide
gcaacatttgggccagctaaacatg

SEQ ID NO: 690223 - DNA, 25 bp, Artificial sequence
  Synthetic oligonucleotide
tctatatcttcacgcgcgcggtctg

SEQ ID NO: 690224 - DNA, 25 bp, Artificial sequence
  Synthetic oligonucleotide
gccaggcgttttctgagcatacctg

SEQ ID NO: 690225 - DNA, 25 bp, Artificial sequence
  Synthetic oligonucleotide
tctatatcttcaggcgcgcggtctg

SEQ ID NO: 690226 - DNA, 25 bp, Artificial sequence
  Synthetic oligonucleotide
gaccaagtgacaccaatgctgtttc

SEQ ID NO: 690227 - DNA, 25 bp, Artificial sequence
  Synthetic oligonucleotide
gaagatgttcgccattatcttctat

SEQ ID NO: 690228 - DNA, 25 bp, Artificial sequence
  Synthetic oligonucleotide
gccaggcgttttgtgagcatacctg

SEQ ID NO: 690229 - DNA, 25 bp, Artificial sequence
  Synthetic oligonucleotide
gaagatgttcgcgattatcttctat

SEQ ID NO: 690230 - DNA, 25 bp, Artificial sequence
  Synthetic oligonucleotide
atgccggtgaacgtgcaaaacaggc

SEQ ID NO: 690231 - DNA, 25 bp, Artificial sequence
  Synthetic oligonucleotide
gagtgatgaggtacgcaagaacctg

SEQ ID NO: 690232 - DNA, 25 bp, Artificial sequence
  Synthetic oligonucleotide
gacatgttcaggcatcgccaggcgt

SEQ ID NO: 690233 - DNA, 25 bp, Artificial sequence
  Synthetic oligonucleotide
gcaagaacctgatggacatgttcag

SEQ ID NO: 690234 - DNA, 25 bp, Artificial sequence
  Synthetic oligonucleotide
gagtgatgaggttcgcaagaacctg

SEQ ID NO: 690235 - DNA, 25 bp, Artificial sequence
  Synthetic oligonucleotide
taccggtcgatggaacgagtgatga

SEQ ID NO: 690236 - DNA, 25 bp, Artificial sequence
  Synthetic oligonucleotide
taccggtcgatgcaacgagtgatga

SEQ ID NO: 690237 - DNA, 25 bp, Artificial sequence
  Synthetic oligonucleotide
atttgcctgcattaccggtcgatgc

SEQ ID NO: 690238 - DNA, 25 bp, Artificial sequence
  Synthetic oligonucleotide
atttgcctgcataaccggtcgatgc

SEQ ID NO: 690239 - DNA, 25 bp, Artificial sequence
  Synthetic oligonucleotide
gacatgttcagggatcgccaggcgt

SEQ ID NO: 690240 - DNA, 25 bp, Artificial sequence
  Synthetic oligonucleotide
aatgctgtttcagtggttatgcggc

SEQ ID NO: 690241 - DNA, 25 bp, Artificial sequence
  Synthetic oligonucleotide
gcaagaacctgaaggacatgttcag

SEQ ID NO: 690242 - DNA, 25 bp, Artificial sequence
  Synthetic oligonucleotide
gccaggcgttttgtgagcatacctg

SEQ ID NO: 690243 - DNA, 25 bp, Artificial sequence
  Synthetic oligonucleotide
gcaacatttggggcagctaaacatg

SEQ ID NO: 690244 - DNA, 25 bp, Artificial sequence
  Synthetic oligonucleotide
gcaacatttgggccagctaaacatg

SEQ ID NO: 690245 - DNA, 25 bp, Artificial sequence
  Synthetic oligonucleotide
tctatatcttcacgcgcgcggtctg

SEQ ID NO: 690246 - DNA, 25 bp, Artificial sequence
  Synthetic oligonucleotide
tctatatcttcaggcgcgcggtctg

SEQ ID NO: 690247 - DNA, 25 bp, Artificial sequence
  Synthetic oligonucleotide
gaagatgttcgccattatcttctat

SEQ ID NO: 690248 - DNA, 25 bp, Artificial sequence
  Synthetic oligonucleotide
gaagatgttcgcgattatcttctat

SEQ ID NO: 690249 - DNA, 25 bp, Artificial sequence
  Synthetic oligonucleotide
gcggcatggtgctagttgaataacc

SEQ ID NO: 690250 - DNA, 25 bp, Artificial sequence
  Synthetic oligonucleotide
gccaggcgttttctgagcatacctg

SEQ ID NO: 690251 - DNA, 25 bp, Artificial sequence
  Synthetic oligonucleotide
atttgcctgcattaccggtcgatgc

SEQ ID NO: 690252 - DNA, 25 bp, Artificial sequence
  Synthetic oligonucleotide
gacatgttcagggatcgccaggcgt

SEQ ID NO: 690253 - DNA, 25 bp, Artificial sequence
  Synthetic oligonucleotide
gacatgttcaggcatcgccaggcgt

SEQ ID NO: 690254 - DNA, 25 bp, Artificial sequence
  Synthetic oligonucleotide
gcaagaacctgaaggacatgttcag

SEQ ID NO: 690255 - DNA, 25 bp, Artificial sequence
  Synthetic oligonucleotide
gcaagaacctgatggacatgttcag

SEQ ID NO: 690256 - DNA, 25 bp, Artificial sequence
  Synthetic oligonucleotide
gagtgatgaggtacgcaagaacctg

SEQ ID NO: 690257 - DNA, 25 bp, Artificial sequence
  Synthetic oligonucleotide
gagtgatgaggttcgcaagaacctg

SEQ ID NO: 690258 - DNA, 25 bp, Artificial sequence
  Synthetic oligonucleotide
taccggtcgatggaacgagtgatga

SEQ ID NO: 690259 - DNA, 25 bp, Artificial sequence
  Synthetic oligonucleotide
taccggtcgatgcaacgagtgatga

SEQ ID NO: 690260 - DNA, 25 bp, Artificial sequence
  Synthetic oligonucleotide
atttgcctgcataaccggtcgatgc

SEQ ID NO: 690261 - DNA, 25 bp, Artificial sequence
  Synthetic oligonucleotide
gcggcatggtgcaagttgaataacc

SEQ ID NO: 690262 - DNA, 25 bp, Artificial sequence
  Synthetic oligonucleotide
atggaaaatagccatcgctgccagg

SEQ ID NO: 690263 - DNA, 25 bp, Artificial sequence
  Synthetic oligonucleotide
aatgctgtttcagtggttatgcggc

SEQ ID NO: 690264 - DNA, 25 bp, Artificial sequence
  Synthetic oligonucleotide
atgccggtgaacctgcaaaacaggc

SEQ ID NO: 690265 - DNA, 25 bp, Artificial sequence
  Synthetic oligonucleotide
atgccggtgaacgtgcaaaacaggc

SEQ ID NO: 690266 - DNA, 25 bp, Artificial sequence
  Synthetic oligonucleotide
acgtgcaaaacacgctctagcgttc

SEQ ID NO: 690267 - DNA, 25 bp, Artificial sequence
  Synthetic oligonucleotide
acgtgcaaaacaggctctagcgttc

SEQ ID NO: 690268 - DNA, 25 bp, Artificial sequence
  Synthetic oligonucleotide
ctctagcgttcgaacgcactgattt

SEQ ID NO: 690269 - DNA, 25 bp, Artificial sequence
  Synthetic oligonucleotide
ctctagcgttcgtacgcactgattt

SEQ ID NO: 690270 - DNA, 25 bp, Artificial sequence
  Synthetic oligonucleotide
tcgttcactcatggaaaatagcgat

SEQ ID NO: 690271 - DNA, 25 bp, Artificial sequence
  Synthetic oligonucleotide
atggaaaatagcgatcgctgccagg

SEQ ID NO: 690272 - DNA, 25 bp, Artificial sequence
  Synthetic oligonucleotide
ccagctaaacatgcttcatcgtcgg

SEQ ID NO: 690273 - DNA, 25 bp, Artificial sequence
  Synthetic oligonucleotide
tcagggttaaagatatctcacgtac

SEQ ID NO: 690274 - DNA, 25 bp, Artificial sequence
  Synthetic oligonucleotide
tcagggttaaagttatctcacgtac

SEQ ID NO: 690275 - DNA, 25 bp, Artificial sequence
  Synthetic oligonucleotide
gaccaagtgacaccaatgctgtttc

SEQ ID NO: 690276 - DNA, 25 bp, Artificial sequence
  Synthetic oligonucleotide
gaccaagtgacagcaatgctgtttc

SEQ ID NO: 690277 - DNA, 25 bp, Artificial sequence
  Synthetic oligonucleotide
ccgggctgccaccaccaagtgacag

SEQ ID NO: 690278 - DNA, 25 bp, Artificial sequence
  Synthetic oligonucleotide
ccgggctgccacgaccaagtgacag

SEQ ID NO: 690279 - DNA, 25 bp, Artificial sequence
  Synthetic oligonucleotide
ccagctaaacatccttcatcgtcgg

SEQ ID NO: 690280 - DNA, 25 bp, Artificial sequence
  Synthetic oligonucleotide
aatgctgtttcactggttatgcggc

SEQ ID NO: 690281 - DNA, 25 bp, Artificial sequence
  Synthetic oligonucleotide
tcgttcactcatcgaaaatagcgat

SEQ ID NO: 690282 - DNA, 25 bp, Artificial sequence
  Synthetic oligonucleotide
cgtccgtcgtcctcctcgcttgcgg

SEQ ID NO: 690283 - DNA, 25 bp, Artificial sequence
  Synthetic oligonucleotide
agcgggcgggcggtccgccgcgagg

SEQ ID NO: 690284 - DNA, 25 bp, Artificial sequence
  Synthetic oligonucleotide
tactttgaaaaaattagagtgttca

SEQ ID NO: 690285 - DNA, 25 bp, Artificial sequence
  Synthetic oligonucleotide
gcctgcggcttaatttgactcaaca

SEQ ID NO: 690286 - DNA, 25 bp, Artificial sequence
  Synthetic oligonucleotide
tgctcttagctgagtgtcccgcggg

SEQ ID NO: 690287 - DNA, 25 bp, Artificial sequence
  Synthetic oligonucleotide
tgcgggtcataagcttgcgttgatt

SEQ ID NO: 690288 - DNA, 25 bp, Artificial sequence
  Synthetic oligonucleotide
gcaattattccccatgaacgaggaa

SEQ ID NO: 690289 - DNA, 25 bp, Artificial sequence
  Synthetic oligonucleotide
aacccgttgaaccccattcgtgatg

SEQ ID NO: 690290 - DNA, 25 bp, Artificial sequence
  Synthetic oligonucleotide
actggctcagcgtgtgcctacccta

SEQ ID NO: 690291 - DNA, 25 bp, Artificial sequence
  Synthetic oligonucleotide
cttagatgtccggggctgcacgcgc

SEQ ID NO: 690292 - DNA, 25 bp, Artificial sequence
  Synthetic oligonucleotide
cccgagattgagcaataacaggtct

SEQ ID NO: 690293 - DNA, 25 bp, Artificial sequence
  Synthetic oligonucleotide
ccccaacttcttagagggacaagtg

SEQ ID NO: 690294 - DNA, 25 bp, Artificial sequence
  Synthetic oligonucleotide
taacgaacgagactctggcatgcta

SEQ ID NO: 690295 - DNA, 25 bp, Artificial sequence
  Synthetic oligonucleotide
tcttagttggtggagcgatttgtct

SEQ ID NO: 690296 - DNA, 25 bp, Artificial sequence
  Synthetic oligonucleotide
gatggtttagtgaggccctcggatc

SEQ ID NO: 690297 - DNA, 25 bp, Artificial sequence
  Synthetic oligonucleotide
ggcccggacacggacaggattgaca

SEQ ID NO: 690298 - DNA, 25 bp, Artificial sequence
  Synthetic oligonucleotide
tcggcccacggcctggcggagcgct

SEQ ID NO: 690299 - DNA, 25 bp, Artificial sequence
  Synthetic oligonucleotide
taaaggaattgacggaagggcacca

SEQ ID NO: 690300 - DNA, 25 bp, Artificial sequence
  Synthetic oligonucleotide
tccggggggagtatggttgcaaagc

SEQ ID NO: 690301 - DNA, 25 bp, Artificial sequence
  Synthetic oligonucleotide
atgcggcggcgttattcccatgacc

SEQ ID NO: 690302 - DNA, 25 bp, Artificial sequence
  Synthetic oligonucleotide
tagttccgaccataaacgatgccga

SEQ ID NO: 690303 - DNA, 25 bp, Artificial sequence
  Synthetic oligonucleotide
gaaagtcggaggttcgaagacgatc

SEQ ID NO: 690304 - DNA, 25 bp, Artificial sequence
  Synthetic oligonucleotide
gcgaaagcatttgccaagaatgttt

SEQ ID NO: 690305 - DNA, 25 bp, Artificial sequence
  Synthetic oligonucleotide
gaaattcttggaccggcgcaagacg

SEQ ID NO: 690306 - DNA, 25 bp, Artificial sequence
  Synthetic oligonucleotide
ccgggggcattcgtattgcgccgct

SEQ ID NO: 690307 - DNA, 25 bp, Artificial sequence
  Synthetic oligonucleotide
ttgttggttttcggaactgaggcca

SEQ ID NO: 690308 - DNA, 25 bp, Artificial sequence
  Synthetic oligonucleotide
gcctggataccgcagctaggaataa

SEQ ID NO: 690309 - DNA, 25 bp, Artificial sequence
  Synthetic oligonucleotide
ctctttctcgattccgtgggtggtg

SEQ ID NO: 690310 - DNA, 25 bp, Artificial sequence
  Synthetic oligonucleotide
gggcgggccgcggcggctttggtga

SEQ ID NO: 690311 - DNA, 25 bp, Artificial sequence
  Synthetic oligonucleotide
gttgctgcagttaaaaagctcgtag

SEQ ID NO: 690312 - DNA, 25 bp, Artificial sequence
  Synthetic oligonucleotide
gccgcggtaattccagctccaatag

SEQ ID NO: 690313 - DNA, 25 bp, Artificial sequence
  Synthetic oligonucleotide
taacgaggatccattggagggcaag

SEQ ID NO: 690314 - DNA, 25 bp, Artificial sequence
  Synthetic oligonucleotide
gccctgtaattggaatgagtccact

SEQ ID NO: 690315 - DNA, 25 bp, Artificial sequence
  Synthetic oligonucleotide
tgacgaaaaataacaatacaggact

SEQ ID NO: 690316 - DNA, 25 bp, Artificial sequence
  Synthetic oligonucleotide
ggcgcgcaaattacccactcccgac

SEQ ID NO: 690317 - DNA, 25 bp, Artificial sequence
  Synthetic oligonucleotide
gaaacggctaccacatccaaggaag

SEQ ID NO: 690318 - DNA, 25 bp, Artificial sequence
  Synthetic oligonucleotide
tgacggggaatcagggttcgattcc

SEQ ID NO: 690319 - DNA, 25 bp, Artificial sequence
  Synthetic oligonucleotide
ctttcgatggtagtcgccgtgccta

SEQ ID NO: 690320 - DNA, 25 bp, Artificial sequence
  Synthetic oligonucleotide
cctttgtacacaccgcccgtcgcta

SEQ ID NO: 690321 - DNA, 25 bp, Artificial sequence
  Synthetic oligonucleotide
taacctcgggccgatcgcacgcccc

SEQ ID NO: 690322 - DNA, 25 bp, Artificial sequence
  Synthetic oligonucleotide
cgtccccgccccttgcctctcggcg

SEQ ID NO: 690323 - DNA, 25 bp, Artificial sequence
  Synthetic oligonucleotide
gggatgcgtgcatttatcagatcaa

SEQ ID NO: 690324 - DNA, 25 bp, Artificial sequence
  Synthetic oligonucleotide
taatacatgccgacgggcgctgacc

SEQ ID NO: 690325 - DNA, 25 bp, Artificial sequence
  Synthetic oligonucleotide
cctacttggataactgtggtaattc

SEQ ID NO: 690326 - DNA, 25 bp, Artificial sequence
  Synthetic oligonucleotide
aatcagttatggttcctttggtcgc

SEQ ID NO: 690327 - DNA, 25 bp, Artificial sequence
  Synthetic oligonucleotide
cacggccggtacagtgaaactgcga

SEQ ID NO: 690328 - DNA, 25 bp, Artificial sequence
  Synthetic oligonucleotide
tctcaaagattaagccatgcatgtc

SEQ ID NO: 690329 - DNA, 25 bp, Artificial sequence
  Synthetic oligonucleotide
tacctggttgatcctgccagtagca

SEQ ID NO: 690330 - DNA, 25 bp, Artificial sequence
  Synthetic oligonucleotide
tccggccgcgtcggggcctcgccgc

SEQ ID NO: 690331 - DNA, 25 bp, Artificial sequence
  Synthetic oligonucleotide
caaggtttccgtaggtgaacctgcg

SEQ ID NO: 690332 - DNA, 25 bp, Artificial sequence
  Synthetic oligonucleotide
cgaacttgactatctagaggaagta

SEQ ID NO: 690333 - DNA, 25 bp, Artificial sequence
  Synthetic oligonucleotide
ggcgacgacccattcgaacgtctgc

SEQ ID NO: 690334 - DNA, 25 bp, Artificial sequence
  Synthetic oligonucleotide
gctgtctcgccgtgtcccgggtcga

SEQ ID NO: 690335 - DNA, 25 bp, Artificial sequence
  Synthetic oligonucleotide
gcggccgccccctcgcccgtcacgc

SEQ ID NO: 690336 - DNA, 25 bp, Artificial sequence
  Synthetic oligonucleotide
gcgccgagccgggcccgtgcgcggt

SEQ ID NO: 690337 - DNA, 25 bp, Artificial sequence
  Synthetic oligonucleotide
cggggagcgtggtttgggagccgcg

SEQ ID NO: 690338 - DNA, 25 bp, Artificial sequence
  Synthetic oligonucleotide
cgttcaccgcggggcggctcgtccg

SEQ ID NO: 690339 - DNA, 25 bp, Artificial sequence
  Synthetic oligonucleotide
ggacgcgcgaccccggtcggcgcgc

SEQ ID NO: 690340 - DNA, 25 bp, Artificial sequence
  Synthetic oligonucleotide
tcgtcttcctccctcccggcctctc

SEQ ID NO: 690341 - DNA, 25 bp, Artificial sequence
  Synthetic oligonucleotide
gcggggcgtgcgcgtccggcgccgt

SEQ ID NO: 690342 - DNA, 25 bp, Artificial sequence
  Synthetic oligonucleotide
gtttgtccgcgcgcgcggcggcgtg

SEQ ID NO: 690343 - DNA, 25 bp, Artificial sequence
  Synthetic oligonucleotide
tgcgatctattgaaagtcagccctc

SEQ ID NO: 690344 - DNA, 25 bp, Artificial sequence
  Synthetic oligonucleotide
cgccgcgtccccgtctcggtcggca

SEQ ID NO: 690345 - DNA, 25 bp, Artificial sequence
  Synthetic oligonucleotide
ggaacctggcgctaaaccattcgta

SEQ ID NO: 690346 - DNA, 25 bp, Artificial sequence
  Synthetic oligonucleotide
ggcgggcggcgaggccgcacgggcg

SEQ ID NO: 690347 - DNA, 25 bp, Artificial sequence
  Synthetic oligonucleotide
tgcggagtgcccttcgtcctgggaa

SEQ ID NO: 690348 - DNA, 25 bp, Artificial sequence
  Synthetic oligonucleotide
gcgcgtgccccgccgcgcgccggga

SEQ ID NO: 690349 - DNA, 25 bp, Artificial sequence
  Synthetic oligonucleotide
ccccccctccagcgccccgcgcgcg

SEQ ID NO: 690350 - DNA, 25 bp, Artificial sequence
  Synthetic oligonucleotide
cgcggagcctcggttggcctcggat

SEQ ID NO: 690351 - DNA, 25 bp, Artificial sequence
  Synthetic oligonucleotide
tctaagtcagaatcccgcccaggcg

SEQ ID NO: 690352 - DNA, 25 bp, Artificial sequence
  Synthetic oligonucleotide
ggcgaacgtaccatctgtgggatta

SEQ ID NO: 690353 - DNA, 25 bp, Artificial sequence
  Synthetic oligonucleotide
cctgctcagtacgagaggaaccgca

SEQ ID NO: 690354 - DNA, 25 bp, Artificial sequence
  Synthetic oligonucleotide
aacgtgagctgggtttagaccgtcg

SEQ ID NO: 690355 - DNA, 25 bp, Artificial sequence
  Synthetic oligonucleotide
caccaagcgttggattgttcaccca

SEQ ID NO: 690356 - DNA, 25 bp, Artificial sequence
  Synthetic oligonucleotide
gtcggggtttcgtacgtagcagagc

SEQ ID NO: 690357 - DNA, 25 bp, Artificial sequence
  Synthetic oligonucleotide
tcgcgcgcccggaccctccaccggc

SEQ ID NO: 690358 - DNA, 25 bp, Artificial sequence
  Synthetic oligonucleotide
catttggtgtatgtgcttggctgag

SEQ ID NO: 690359 - DNA, 25 bp, Artificial sequence
  Synthetic oligonucleotide
tccttggtgccttctcggctcttga

SEQ ID NO: 690360 - DNA, 25 bp, Artificial sequence
  Synthetic oligonucleotide
ctctctctctctctccctccccctc

SEQ ID NO: 690361 - DNA, 25 bp, Artificial sequence
  Synthetic oligonucleotide
tctctcttctctctgtctctctctg

SEQ ID NO: 690362 - DNA, 25 bp, Artificial sequence
  Synthetic oligonucleotide
tctctctctctgtctctcgctctcg

SEQ ID NO: 690363 - DNA, 25 bp, Artificial sequence
  Synthetic oligonucleotide
ctcgctctctccctcgctcgttttc

SEQ ID NO: 690364 - DNA, 25 bp, Artificial sequence
  Synthetic oligonucleotide
ttctttctttctttctttctcgctc

SEQ ID NO: 690365 - DNA, 25 bp, Artificial sequence
  Synthetic oligonucleotide
atgcttcctccttttttgcttttag

SEQ ID NO: 690366 - DNA, 25 bp, Artificial sequence
  Synthetic oligonucleotide
ttaagagggagtcactgctgccgtc

SEQ ID NO: 690367 - DNA, 25 bp, Artificial sequence
  Synthetic oligonucleotide
tcccggccctcgcgcgtccttcctc

SEQ ID NO: 690368 - DNA, 25 bp, Artificial sequence
  Synthetic oligonucleotide
gagctgggaccacgcggaactccct

SEQ ID NO: 690369 - DNA, 25 bp, Artificial sequence
  Synthetic oligonucleotide
acgggtcgaccagcagaccgcgggt

SEQ ID NO: 690370 - DNA, 25 bp, Artificial sequence
  Synthetic oligonucleotide
cgacgtgcggcgcaccgacgagagg

SEQ ID NO: 690371 - DNA, 25 bp, Artificial sequence
  Synthetic oligonucleotide
ggcgcctgcacgtgtcccgggtcga

SEQ ID NO: 690372 - DNA, 25 bp, Artificial sequence
  Synthetic oligonucleotide
ggtcgaccagctgccgcccgcgagc

SEQ ID NO: 690373 - DNA, 25 bp, Artificial sequence
  Synthetic oligonucleotide
ccgcaaccggagcgtccccgtctcg

SEQ ID NO: 690374 - DNA, 25 bp, Artificial sequence
  Synthetic oligonucleotide
cttctccaccgagcggcgtgtagga

SEQ ID NO: 690375 - DNA, 25 bp, Artificial sequence
  Synthetic oligonucleotide
ccgctgtctcgccgtgtcccgggtc

SEQ ID NO: 690376 - DNA, 25 bp, Artificial sequence
  Synthetic oligonucleotide
gtcgaccgcctgccccgcgggcgtg

SEQ ID NO: 690377 - DNA, 25 bp, Artificial sequence
  Synthetic oligonucleotide
ggccgacctccgctcgtgacctctc

SEQ ID NO: 690378 - DNA, 25 bp, Artificial sequence
  Synthetic oligonucleotide
caccgagcggcgtgtaagagtgccc

SEQ ID NO: 690379 - DNA, 25 bp, Artificial sequence
  Synthetic oligonucleotide
ttttcagccccaccgcgagtttgcg

SEQ ID NO: 690380 - DNA, 25 bp, Artificial sequence
  Synthetic oligonucleotide
gttttaccctactgatgatgtgttg

SEQ ID NO: 690381 - DNA, 25 bp, Artificial sequence
  Synthetic oligonucleotide
aacggtgaaggtgacagcagtcggt

SEQ ID NO: 690382 - DNA, 25 bp, Artificial sequence
  Synthetic oligonucleotide
ccatcatgaagtgtgacgtggacat

SEQ ID NO: 690383 - DNA, 25 bp, Artificial sequence
  Synthetic oligonucleotide
tgtacgccaacacagtgctgtctgg

SEQ ID NO: 690384 - DNA, 25 bp, Artificial sequence
  Synthetic oligonucleotide
tgtaccctggcattgccgacaggat

SEQ ID NO: 690385 - DNA, 25 bp, Artificial sequence
  Synthetic oligonucleotide
tgccctggcacccagcacaatgaag

SEQ ID NO: 690386 - DNA, 25 bp, Artificial sequence
  Synthetic oligonucleotide
tcctcctgagcgcaagtactccgtg

SEQ ID NO: 690387 - DNA, 25 bp, Artificial sequence
  Synthetic oligonucleotide
ggcggctccatcctggcctcgctgt

SEQ ID NO: 690388 - DNA, 25 bp, Artificial sequence
  Synthetic oligonucleotide
cagatgtggatcagcaagcaggagt

SEQ ID NO: 690389 - DNA, 25 bp, Artificial sequence
  Synthetic oligonucleotide
cctccatcgtccaccgcaaatgctt

SEQ ID NO: 690390 - DNA, 25 bp, Artificial sequence
  Synthetic oligonucleotide
tatgacttagttgcgttacaccctt

SEQ ID NO: 690391 - DNA, 25 bp, Artificial sequence
  Synthetic oligonucleotide
ggcttacctgtacactgacttgaga

SEQ ID NO: 690392 - DNA, 25 bp, Artificial sequence
  Synthetic oligonucleotide
tttttttggcttgactcaggattta

SEQ ID NO: 690393 - DNA, 25 bp, Artificial sequence
  Synthetic oligonucleotide
caggtcatcaccattggcaatgagc

SEQ ID NO: 690394 - DNA, 25 bp, Artificial sequence
  Synthetic oligonucleotide
ccaaagttcacaatgtggccgagga

SEQ ID NO: 690395 - DNA, 25 bp, Artificial sequence
  Synthetic oligonucleotide
cacattgttgtttttttaatagtca

SEQ ID NO: 690396 - DNA, 25 bp, Artificial sequence
  Synthetic oligonucleotide
gatgcattgttacaggaagtccctt

SEQ ID NO: 690397 - DNA, 25 bp, Artificial sequence
  Synthetic oligonucleotide
caccccacttctctctaaggagaat

SEQ ID NO: 690398 - DNA, 25 bp, Artificial sequence
  Synthetic oligonucleotide
ccaagtccacacaggggaggtgata

SEQ ID NO: 690399 - DNA, 25 bp, Artificial sequence
  Synthetic oligonucleotide
ctttcgtgtaaattatgtaatgcaa

SEQ ID NO: 690400 - DNA, 25 bp, Artificial sequence
  Synthetic oligonucleotide
attttgttttattttgaatgatgag

SEQ ID NO: 690401 - DNA, 25 bp, Artificial sequence
  Synthetic oligonucleotide
cctttttgtcccccaacttgagatg

SEQ ID NO: 690402 - DNA, 25 bp, Artificial sequence
  Synthetic oligonucleotide
tttggtctccctgggagtgggtgga

SEQ ID NO: 690403 - DNA, 25 bp, Artificial sequence
  Synthetic oligonucleotide
cctaacttgcgcagaaaacaagatg

SEQ ID NO: 690404 - DNA, 25 bp, Artificial sequence
  Synthetic oligonucleotide
gctatccaggctgtgctatccctgt

SEQ ID NO: 690405 - DNA, 25 bp, Artificial sequence
  Synthetic oligonucleotide
ttgccgatccgccgcccgtccacac

SEQ ID NO: 690406 - DNA, 25 bp, Artificial sequence
  Synthetic oligonucleotide
aacggctccggcatgtgcaaggccg

SEQ ID NO: 690407 - DNA, 25 bp, Artificial sequence
  Synthetic oligonucleotide
ccgggccgtcttcccctccatcgtg

SEQ ID NO: 690408 - DNA, 25 bp, Artificial sequence
  Synthetic oligonucleotide
gcaccagggcgtgatggtgggcatg

SEQ ID NO: 690409 - DNA, 25 bp, Artificial sequence
  Synthetic oligonucleotide
tcctatgtgggcgacgaggcccaga

SEQ ID NO: 690410 - DNA, 25 bp, Artificial sequence
  Synthetic oligonucleotide
atcctcaccctgaagtaccccatcg

SEQ ID NO: 690411 - DNA, 25 bp, Artificial sequence
  Synthetic oligonucleotide
tcaccaactgggacgacatggagaa

SEQ ID NO: 690412 - DNA, 25 bp, Artificial sequence
  Synthetic oligonucleotide
ccttctacaatgagctgcgtgtggc

SEQ ID NO: 690413 - DNA, 25 bp, Artificial sequence
  Synthetic oligonucleotide
ggagcaccccgtgctgctgaccgag

SEQ ID NO: 690414 - DNA, 25 bp, Artificial sequence
  Synthetic oligonucleotide
catggagtcctgtggcatccacgaa

SEQ ID NO: 690415 - DNA, 25 bp, Artificial sequence
  Synthetic oligonucleotide
tgtttgagaccttcaacaccccagc

SEQ ID NO: 690416 - DNA, 25 bp, Artificial sequence
  Synthetic oligonucleotide
tgccctgaggcactcttccagcctt

SEQ ID NO: 690417 - DNA, 25 bp, Artificial sequence
  Synthetic oligonucleotide
taccactggcatcgtgatggactcc

SEQ ID NO: 690418 - DNA, 25 bp, Artificial sequence
  Synthetic oligonucleotide
cacactgtgcccatctacgaggggt

SEQ ID NO: 690419 - DNA, 25 bp, Artificial sequence
  Synthetic oligonucleotide
tgccatcctgcgtctggacctggct

SEQ ID NO: 690420 - DNA, 25 bp, Artificial sequence
  Synthetic oligonucleotide
tgactgactacctcatgaagatcct

SEQ ID NO: 690421 - DNA, 25 bp, Artificial sequence
  Synthetic oligonucleotide
ggctacagcttcaccaccacggccg

SEQ ID NO: 690422 - DNA, 25 bp, Artificial sequence
  Synthetic oligonucleotide
tcgtgcgtgacattaaggagaagct

SEQ ID NO: 690423 - DNA, 25 bp, Artificial sequence
  Synthetic oligonucleotide
cctggacttcgagcaagagatggcc

SEQ ID NO: 690424 - DNA, 25 bp, Artificial sequence
  Synthetic oligonucleotide
tcctccctggagaagagctacgagc

SEQ ID NO: 690425 - DNA, 25 bp, Artificial sequence
  Synthetic oligonucleotide
tcaccatggatgatgatatcgccgc

SEQ ID NO: 690426 - DNA, 25 bp, Artificial sequence
  Synthetic oligonucleotide
aaggccaaccgcgagaagatgaccc

SEQ ID NO: 690427 - DNA, 25 bp, Artificial sequence
  Synthetic oligonucleotide
tgggcgtggtggctcacgcctgtaa

SEQ ID NO: 690428 - DNA, 25 bp, Artificial sequence
  Synthetic oligonucleotide
gcgacagagcgagactccgtctcag

SEQ ID NO: 690429 - DNA, 25 bp, Artificial sequence
  Synthetic oligonucleotide
agtgagccgagatcgcgccactgca

SEQ ID NO: 690430 - DNA, 25 bp, Artificial sequence
  Synthetic oligonucleotide
gaatcgcttgaacccgggaggtgga

SEQ ID NO: 690431 - DNA, 25 bp, Artificial sequence
  Synthetic oligonucleotide
taatcccagctactcgggaggctga

SEQ ID NO: 690432 - DNA, 25 bp, Artificial sequence
  Synthetic oligonucleotide
atacaaaaattagccgggcgtggtg

SEQ ID NO: 690433 - DNA, 25 bp, Artificial sequence
  Synthetic oligonucleotide
tgggaggccgaggtgggtggatcac

SEQ ID NO: 690434 - DNA, 25 bp, Artificial sequence
  Synthetic oligonucleotide
aggagttcaagaccagcctggccaa

SEQ ID NO: 690435 - DNA, 25 bp, Artificial sequence
  Synthetic oligonucleotide
tattgttgccatcaatgaccccttc

SEQ ID NO: 690436 - DNA, 25 bp, Artificial sequence
  Synthetic oligonucleotide
catgacaactttggtatcgtggaag

SEQ ID NO: 690437 - DNA, 25 bp, Artificial sequence
  Synthetic oligonucleotide
accaccaactgcttagcacccctgg

SEQ ID NO: 690438 - DNA, 25 bp, Artificial sequence
  Synthetic oligonucleotide
gacaacagcctcaagatcatcagca

SEQ ID NO: 690439 - DNA, 25 bp, Artificial sequence
  Synthetic oligonucleotide
ccccatgttcgtcatgggtgtgaac

SEQ ID NO: 690440 - DNA, 25 bp, Artificial sequence
  Synthetic oligonucleotide
ggagccaaaagggtcatcatctctg

SEQ ID NO: 690441 - DNA, 25 bp, Artificial sequence
  Synthetic oligonucleotide
gttcgacagtcagccgcatcttctt

SEQ ID NO: 690442 - DNA, 25 bp, Artificial sequence
  Synthetic oligonucleotide
gagccacatcgctcagacaccatgg

SEQ ID NO: 690443 - DNA, 25 bp, Artificial sequence
  Synthetic oligonucleotide
gtcaccagggctgcttttaactctg

SEQ ID NO: 690444 - DNA, 25 bp, Artificial sequence
  Synthetic oligonucleotide
tggcaaattccatggcaccgtcaag

SEQ ID NO: 690445 - DNA, 25 bp, Artificial sequence
  Synthetic oligonucleotide
tgtaccatcaataaagtaccctgtg

SEQ ID NO: 690446 - DNA, 25 bp, Artificial sequence
  Synthetic oligonucleotide
caactacatggtttacatgttccaa

SEQ ID NO: 690447 - DNA, 25 bp, Artificial sequence
  Synthetic oligonucleotide
ggcccacatggcctccaaggagtaa

SEQ ID NO: 690448 - DNA, 25 bp, Artificial sequence
  Synthetic oligonucleotide
cttcaccaccatggagaaggctggg

SEQ ID NO: 690449 - DNA, 25 bp, Artificial sequence
  Synthetic oligonucleotide
gcgctgagtacgtcgtggagtccac

SEQ ID NO: 690450 - DNA, 25 bp, Artificial sequence
  Synthetic oligonucleotide
gagcgagatccctccaaaatcaagt

SEQ ID NO: 690451 - DNA, 25 bp, Artificial sequence
  Synthetic oligonucleotide
gaagcttgtcatcaatggaaatccc

SEQ ID NO: 690452 - DNA, 25 bp, Artificial sequence
  Synthetic oligonucleotide
tcggagtcaacggatttggtcgtat

SEQ ID NO: 690453 - DNA, 25 bp, Artificial sequence
  Synthetic oligonucleotide
tggtctcctctgacttcaacagcga

SEQ ID NO: 690454 - DNA, 25 bp, Artificial sequence
  Synthetic oligonucleotide
aagactgtggatggcccctccggga

SEQ ID NO: 690455 - DNA, 25 bp, Artificial sequence
  Synthetic oligonucleotide
gccgcggggctctccagaacatcat

SEQ ID NO: 690456 - DNA, 25 bp, Artificial sequence
  Synthetic oligonucleotide
tctactggcgctgccaaggctgtgg

SEQ ID NO: 690457 - DNA, 25 bp, Artificial sequence
  Synthetic oligonucleotide
gctgaacgggaagctcactggcatg

SEQ ID NO: 690458 - DNA, 25 bp, Artificial sequence
  Synthetic oligonucleotide
cactgccaacgtgtcagtggtggac

SEQ ID NO: 690459 - DNA, 25 bp, Artificial sequence
  Synthetic oligonucleotide
cgtctagaaaaacctgccaaatatg

SEQ ID NO: 690460 - DNA, 25 bp, Artificial sequence
  Synthetic oligonucleotide
tcactgctggggagtccctgccaca

SEQ ID NO: 690461 - DNA, 25 bp, Artificial sequence
  Synthetic oligonucleotide
tcaagggcatcctgggctacactga

SEQ ID NO: 690462 - DNA, 25 bp, Artificial sequence
  Synthetic oligonucleotide
tgaagaggggaggggcctagggagc

SEQ ID NO: 690463 - DNA, 25 bp, Artificial sequence
  Synthetic oligonucleotide
cacctttgacgctggggctggcatt

SEQ ID NO: 690464 - DNA, 25 bp, Artificial sequence
  Synthetic oligonucleotide
cactttgtcaagctcatttcctggt

SEQ ID NO: 690465 - DNA, 25 bp, Artificial sequence
  Synthetic oligonucleotide
gaatttggctacagcaacagggtgg

SEQ ID NO: 690466 - DNA, 25 bp, Artificial sequence
  Synthetic oligonucleotide
agccccagcaagagcacaagaggaa

SEQ ID NO: 690467 - DNA, 25 bp, Artificial sequence
  Synthetic oligonucleotide
tgaccacagtccatgccatcactgc

SEQ ID NO: 690468 - DNA, 25 bp, Artificial sequence
  Synthetic oligonucleotide
actgaatctcccctcctcacagttg

SEQ ID NO: 690469 - DNA, 25 bp, Artificial sequence
  Synthetic oligonucleotide
tcaagaaggtggtgaagcaggcgtc

SEQ ID NO: 690470 - DNA, 25 bp, Artificial sequence
  Synthetic oligonucleotide
gcgagaacctaagtttcagttgatt

SEQ ID NO: 690471 - DNA, 25 bp, Artificial sequence
  Synthetic oligonucleotide
ccctaaaggaactggatatatcaag

SEQ ID NO: 690472 - DNA, 25 bp, Artificial sequence
  Synthetic oligonucleotide
gcatcttactgaaggtaaaattgaa

SEQ ID NO: 690473 - DNA, 25 bp, Artificial sequence
  Synthetic oligonucleotide
gatttctgtgtctgaagttcaccct

SEQ ID NO: 690474 - DNA, 25 bp, Artificial sequence
  Synthetic oligonucleotide
atctggtagggggaaaatgtgtatt

SEQ ID NO: 690475 - DNA, 25 bp, Artificial sequence
  Synthetic oligonucleotide
tatatcagtcctctttcaaaggtag

SEQ ID NO: 690476 - DNA, 25 bp, Artificial sequence
  Synthetic oligonucleotide
tttacctgtgaaatagttcaaagcc

SEQ ID NO: 690477 - DNA, 25 bp, Artificial sequence
  Synthetic oligonucleotide
tctttgctttaagtgtaactggcag

SEQ ID NO: 690478 - DNA, 25 bp, Artificial sequence
  Synthetic oligonucleotide
cggtaaatttctgtgggagaattct

SEQ ID NO: 690479 - DNA, 25 bp, Artificial sequence
  Synthetic oligonucleotide
aaatcagtggttatttagggaactg

SEQ ID NO: 690480 - DNA, 25 bp, Artificial sequence
  Synthetic oligonucleotide
tatgcataaagtcagtgcccaactg

SEQ ID NO: 690481 - DNA, 25 bp, Artificial sequence
  Synthetic oligonucleotide
ggaaaggagaagttaagcaacatct

SEQ ID NO: 690482 - DNA, 25 bp, Artificial sequence
  Synthetic oligonucleotide
cttgagaagagaatattagctttac

SEQ ID NO: 690483 - DNA, 25 bp, Artificial sequence
  Synthetic oligonucleotide
tgaagagtgggtttcacaagtgaaa

SEQ ID NO: 690484 - DNA, 25 bp, Artificial sequence
  Synthetic oligonucleotide
ggcttaatgacactagctaatatca

SEQ ID NO: 690485 - DNA, 25 bp, Artificial sequence
  Synthetic oligonucleotide
taactcagaaacatcagttactctg

SEQ ID NO: 690486 - DNA, 25 bp, Artificial sequence
  Synthetic oligonucleotide
aattcgctgcaacctgttgatagca

SEQ ID NO: 690487 - DNA, 25 bp, Artificial sequence
  Synthetic oligonucleotide
cctgtgtttctagggaaatgaaaga

SEQ ID NO: 690488 - DNA, 25 bp, Artificial sequence
  Synthetic oligonucleotide
tctgtgattccctcctgctactctg

SEQ ID NO: 690489 - DNA, 25 bp, Artificial sequence
  Synthetic oligonucleotide
ttttttcatcttctctggcgacagt

SEQ ID NO: 690490 - DNA, 25 bp, Artificial sequence
  Synthetic oligonucleotide
gaattcgacagtatgatgaacacag

SEQ ID NO: 690491 - DNA, 25 bp, Artificial sequence
  Synthetic oligonucleotide
accacagacaacctgctccccatgt

SEQ ID NO: 690492 - DNA, 25 bp, Artificial sequence
  Synthetic oligonucleotide
agtttgacgaggtgtctcggatagt

SEQ ID NO: 690493 - DNA, 25 bp, Artificial sequence
  Synthetic oligonucleotide
caaaggaagcaccagagccaatgga

SEQ ID NO: 690494 - DNA, 25 bp, Artificial sequence
  Synthetic oligonucleotide
cacccaaagtatcaggacgagaatg

SEQ ID NO: 690495 - DNA, 25 bp, Artificial sequence
  Synthetic oligonucleotide
catttcctatgtaactgcattgaga

SEQ ID NO: 690496 - DNA, 25 bp, Artificial sequence
  Synthetic oligonucleotide
aatggttccattctctctcctgtac

SEQ ID NO: 690497 - DNA, 25 bp, Artificial sequence
  Synthetic oligonucleotide
gaggcctcctctctcagtttttata

SEQ ID NO: 690498 - DNA, 25 bp, Artificial sequence
  Synthetic oligonucleotide
taatatcgacacagtgctttccgtg

SEQ ID NO: 690499 - DNA, 25 bp, Artificial sequence
  Synthetic oligonucleotide
taaaattaaagctaaagtatctgta

SEQ ID NO: 690500 - DNA, 25 bp, Artificial sequence
  Synthetic oligonucleotide
gctgtattcttctttggtggagata

SEQ ID NO: 690501 - DNA, 25 bp, Artificial sequence
  Synthetic oligonucleotide
tactgctaccacaactatattatca

SEQ ID NO: 690502 - DNA, 25 bp, Artificial sequence
  Synthetic oligonucleotide
tactgctgtctatgtggctgtatct

SEQ ID NO: 690503 - DNA, 25 bp, Artificial sequence
  Synthetic oligonucleotide
ttaagagatgggtttgacaaggttc

SEQ ID NO: 690504 - DNA, 25 bp, Artificial sequence
  Synthetic oligonucleotide
tacctttttccttccttatcactga

SEQ ID NO: 690505 - DNA, 25 bp, Artificial sequence
  Synthetic oligonucleotide
tcacattggctatttaaagacaaag

SEQ ID NO: 690506 - DNA, 25 bp, Artificial sequence
  Synthetic oligonucleotide
ttcgctgatatatgtgtttttcaca

SEQ ID NO: 690507 - DNA, 25 bp, Artificial sequence
  Synthetic oligonucleotide
tgactaaaaaacaaagaagacaaca

SEQ ID NO: 690508 - DNA, 25 bp, Artificial sequence
  Synthetic oligonucleotide
caccagagataatatgagaatcaga

SEQ ID NO: 690509 - DNA, 25 bp, Artificial sequence
  Synthetic oligonucleotide
ggagtagaaaaagcagtaactgaca

SEQ ID NO: 690510 - DNA, 25 bp, Artificial sequence
  Synthetic oligonucleotide
tagggtggtatttagtctattagcc

SEQ ID NO: 690511 - DNA, 25 bp, Artificial sequence
  Synthetic oligonucleotide
tgtttcttaaatgggctactttgtc

SEQ ID NO: 690512 - DNA, 25 bp, Artificial sequence
  Synthetic oligonucleotide
tagatgtagataaactcagaaattt

SEQ ID NO: 690513 - DNA, 25 bp, Artificial sequence
  Synthetic oligonucleotide
caaccactcattcaaaagttgaaat

SEQ ID NO: 690514 - DNA, 25 bp, Artificial sequence
  Synthetic oligonucleotide
tacagttctcccaagggagttaggc

SEQ ID NO: 690515 - DNA, 25 bp, Artificial sequence
  Synthetic oligonucleotide
gaatacattctgctttcatcttggt

SEQ ID NO: 690516 - DNA, 25 bp, Artificial sequence
  Synthetic oligonucleotide
tacatttccaaattcacaagttgtg

SEQ ID NO: 690517 - DNA, 25 bp, Artificial sequence
  Synthetic oligonucleotide
acttttttgagtggatgatgtttcg

SEQ ID NO: 690518 - DNA, 25 bp, Artificial sequence
  Synthetic oligonucleotide
cgatgggctcagctttcagaagtgc

SEQ ID NO: 690519 - DNA, 25 bp, Artificial sequence
  Synthetic oligonucleotide
caaacaagtgttatgggaccgcacc

SEQ ID NO: 690520 - DNA, 25 bp, Artificial sequence
  Synthetic oligonucleotide
tccagcagctcattcagagctcgtt

SEQ ID NO: 690521 - DNA, 25 bp, Artificial sequence
  Synthetic oligonucleotide
cagaggccgctggtcttgaagacag

SEQ ID NO: 690522 - DNA, 25 bp, Artificial sequence
  Synthetic oligonucleotide
gagctgaattataatttgaaagtca

SEQ ID NO: 690523 - DNA, 25 bp, Artificial sequence
  Synthetic oligonucleotide
taaagatgtgaatgagagaaataca

SEQ ID NO: 690524 - DNA, 25 bp, Artificial sequence
  Synthetic oligonucleotide
taggaagttcaacattttgggcacg

SEQ ID NO: 690525 - DNA, 25 bp, Artificial sequence
  Synthetic oligonucleotide
tgatgaacatggaggagtccaccaa

SEQ ID NO: 690526 - DNA, 25 bp, Artificial sequence
  Synthetic oligonucleotide
ggcggctgaatttcggcacctgcaa

SEQ ID NO: 690527 - DNA, 25 bp, Artificial sequence
  Synthetic oligonucleotide
gaaaaatgctggcaccagaacgaat

SEQ ID NO: 690528 - DNA, 25 bp, Artificial sequence
  Synthetic oligonucleotide
catcgttactgaagagcttcactcc

SEQ ID NO: 690529 - DNA, 25 bp, Artificial sequence
  Synthetic oligonucleotide
ttgaaacccaattgtgccagcctgg

SEQ ID NO: 690530 - DNA, 25 bp, Artificial sequence
  Synthetic oligonucleotide
tcgagacgacctctctgcccgttgt

SEQ ID NO: 690531 - DNA, 25 bp, Artificial sequence
  Synthetic oligonucleotide
acgtcagccagctcccgagcggttg

SEQ ID NO: 690532 - DNA, 25 bp, Artificial sequence
  Synthetic oligonucleotide
tcattcgcaattacaaagtcatggc

SEQ ID NO: 690533 - DNA, 25 bp, Artificial sequence
  Synthetic oligonucleotide
aaaaacacctgctccctctctggaa

SEQ ID NO: 690534 - DNA, 25 bp, Artificial sequence
  Synthetic oligonucleotide
aaacctctcgccgagcccctccgca

SEQ ID NO: 690535 - DNA, 25 bp, Artificial sequence
  Synthetic oligonucleotide
cgaagaaagaactttctgctgttac

SEQ ID NO: 690536 - DNA, 25 bp, Artificial sequence
  Synthetic oligonucleotide
gaggcgaacctgacttccatgcggt

SEQ ID NO: 690537 - DNA, 25 bp, Artificial sequence
  Synthetic oligonucleotide
tcacattcacatgggtggagcggtc

SEQ ID NO: 690538 - DNA, 25 bp, Artificial sequence
  Synthetic oligonucleotide
tgctgcggttcagtgagagctcccg

SEQ ID NO: 690539 - DNA, 25 bp, Artificial sequence
  Synthetic oligonucleotide
cctttggtacaacatgctggtggcg

SEQ ID NO: 690540 - DNA, 25 bp, Artificial sequence
  Synthetic oligonucleotide
tcatgggcttcatcagcaaggagcg

SEQ ID NO: 690541 - DNA, 25 bp, Artificial sequence
  Synthetic oligonucleotide
gaatctgtccttcttcctgactcca

SEQ ID NO: 690542 - DNA, 25 bp, Artificial sequence
  Synthetic oligonucleotide
tctggctttggattgaaagcatcct

SEQ ID NO: 690543 - DNA, 25 bp, Artificial sequence
  Synthetic oligonucleotide
tttgtaaggaaaatataaatgataa

SEQ ID NO: 690544 - DNA, 25 bp, Artificial sequence
  Synthetic oligonucleotide
cagccccgatggtctcattccgtgg

SEQ ID NO: 690545 - DNA, 25 bp, Artificial sequence
  Synthetic oligonucleotide
tgaacatgttgggagagaagcttct

SEQ ID NO: 690546 - DNA, 25 bp, Artificial sequence
  Synthetic oligonucleotide
tcttctgtcaccaaaagaggtctca

SEQ ID NO: 690547 - DNA, 25 bp, Artificial sequence
  Synthetic oligonucleotide
ggaaagacagccctgcatgccaacg

SEQ ID NO: 690548 - DNA, 25 bp, Artificial sequence
  Synthetic oligonucleotide
tgccctgttgaaggaccagcagccg

SEQ ID NO: 690549 - DNA, 25 bp, Artificial sequence
  Synthetic oligonucleotide
cagctttatgatgacagttttccca

SEQ ID NO: 690550 - DNA, 25 bp, Artificial sequence
  Synthetic oligonucleotide
gaaaacgcccagagatttaatcagg

SEQ ID NO: 690551 - DNA, 25 bp, Artificial sequence
  Synthetic oligonucleotide
cctgagaatcccctgaagtatctgt

SEQ ID NO: 690552 - DNA, 25 bp, Artificial sequence
  Synthetic oligonucleotide
taattttcaggaagacccaatccag

SEQ ID NO: 690553 - DNA, 25 bp, Artificial sequence
  Synthetic oligonucleotide
tcactgtgaagttgagactgttggt

SEQ ID NO: 690554 - DNA, 25 bp, Artificial sequence
  Synthetic oligonucleotide
tagtcgcttttctttggagaataac

SEQ ID NO: 690555 - DNA, 25 bp, Artificial sequence
  Synthetic oligonucleotide
tttcatgacctcctgtcacagctgg

SEQ ID NO: 690556 - DNA, 25 bp, Artificial sequence
  Synthetic oligonucleotide
tattcagagcacagtgatgttagac

SEQ ID NO: 690557 - DNA, 25 bp, Artificial sequence
  Synthetic oligonucleotide
cagtacctggcacagtggttagaaa

SEQ ID NO: 690558 - DNA, 25 bp, Artificial sequence
  Synthetic oligonucleotide
catttacagctgtctgaaggaagaa

SEQ ID NO: 690559 - DNA, 25 bp, Artificial sequence
  Synthetic oligonucleotide
gcagcttgactcaaaattcctggag

SEQ ID NO: 690560 - DNA, 25 bp, Artificial sequence
  Synthetic oligonucleotide
gcacaaggtggcaggatgtctcagt

SEQ ID NO: 690561 - DNA, 25 bp, Artificial sequence
  Synthetic oligonucleotide
tgctcctttggttgaatccccaggc

SEQ ID NO: 690562 - DNA, 25 bp, Artificial sequence
  Synthetic oligonucleotide
ctcgacagtcttggcacctaacgtg

SEQ ID NO: 690563 - DNA, 25 bp, Artificial sequence
  Synthetic oligonucleotide
tgtctaggttaacgttcgcactctg

SEQ ID NO: 690564 - DNA, 25 bp, Artificial sequence
  Synthetic oligonucleotide
ggaaagtttcatttgctgtatgcca

SEQ ID NO: 690565 - DNA, 25 bp, Artificial sequence
  Synthetic oligonucleotide
ggagcacgctgccaatgatgtttca

SEQ ID NO: 690566 - DNA, 25 bp, Artificial sequence
  Synthetic oligonucleotide
ctatagttgcggagagtctgcagca

SEQ ID NO: 690567 - DNA, 25 bp, Artificial sequence
  Synthetic oligonucleotide
tacacctacgaacatgaccctatca

SEQ ID NO: 690568 - DNA, 25 bp, Artificial sequence
  Synthetic oligonucleotide
gacaaagaccatgcctttggaaagt

SEQ ID NO: 690569 - DNA, 25 bp, Artificial sequence
  Synthetic oligonucleotide
gcataacataaggaaaagcaagcgt

SEQ ID NO: 690570 - DNA, 25 bp, Artificial sequence
  Synthetic oligonucleotide
cagcttaaaaagttggaggaattgg

SEQ ID NO: 690571 - DNA, 25 bp, Artificial sequence
  Synthetic oligonucleotide
gcttgacagtaaagtcagaaatgtg

SEQ ID NO: 690572 - DNA, 25 bp, Artificial sequence
  Synthetic oligonucleotide
caatgcttgcttggatcagctgcag

SEQ ID NO: 690573 - DNA, 25 bp, Artificial sequence
  Synthetic oligonucleotide
agcggagacagcagagcgcctgtat

SEQ ID NO: 690574 - DNA, 25 bp, Artificial sequence
  Synthetic oligonucleotide
aaataatagagttgctgaatgtcac

SEQ ID NO: 690575 - DNA, 25 bp, Artificial sequence
  Synthetic oligonucleotide
ttaatgcttgacaataagagaaagg

SEQ ID NO: 690576 - DNA, 25 bp, Artificial sequence
  Synthetic oligonucleotide
gtgatcagaaacaagaacagctgtt

SEQ ID NO: 690577 - DNA, 25 bp, Artificial sequence
  Synthetic oligonucleotide
gaacagagaacacgagaccaatggt

SEQ ID NO: 690578 - DNA, 25 bp, Artificial sequence
  Synthetic oligonucleotide
caagatgaatatgacttcaaatgca

SEQ ID NO: 690579 - DNA, 25 bp, Artificial sequence
  Synthetic oligonucleotide
cagaatgccctgattaatgatgaac

SEQ ID NO: 690580 - DNA, 25 bp, Artificial sequence
  Synthetic oligonucleotide
tgtatagagcatgaaatcaagagcc

SEQ ID NO: 690581 - DNA, 25 bp, Artificial sequence
  Synthetic oligonucleotide
gatttgacagaagcggaactctctt

SEQ ID NO: 690582 - DNA, 25 bp, Artificial sequence
  Synthetic oligonucleotide
aagaattcagctaacgcttccagac

SEQ ID NO: 690583 - DNA, 25 bp, Artificial sequence
  Synthetic oligonucleotide
gctgaagcagccggcatattaggcg

SEQ ID NO: 690584 - DNA, 25 bp, Artificial sequence
  Synthetic oligonucleotide
tatcccgtcaaacgattccgtttct

SEQ ID NO: 690585 - DNA, 25 bp, Artificial sequence
  Synthetic oligonucleotide
gtacggtcagttagcgtaaagaaga

SEQ ID NO: 690586 - DNA, 25 bp, Artificial sequence
  Synthetic oligonucleotide
aagaattcagcttacgcttccagac

SEQ ID NO: 690587 - DNA, 25 bp, Artificial sequence
  Synthetic oligonucleotide
gatttgacagaaccggaactctctt

SEQ ID NO: 690588 - DNA, 25 bp, Artificial sequence
  Synthetic oligonucleotide
caattcggtcaaatgtcactgtcat

SEQ ID NO: 690589 - DNA, 25 bp, Artificial sequence
  Synthetic oligonucleotide
gtacggtcagtttgcgtaaagaaga

SEQ ID NO: 690590 - DNA, 25 bp, Artificial sequence
  Synthetic oligonucleotide
gctgaagcagcccgcatattaggcg

SEQ ID NO: 690591 - DNA, 25 bp, Artificial sequence
  Synthetic oligonucleotide
caattcggtcaattgtcactgtcat

SEQ ID NO: 690592 - DNA, 25 bp, Artificial sequence
  Synthetic oligonucleotide
atctcggatacattagaggcaaaga

SEQ ID NO: 690593 - DNA, 25 bp, Artificial sequence
  Synthetic oligonucleotide
atctcggatacaatagaggcaaaga

SEQ ID NO: 690594 - DNA, 25 bp, Artificial sequence
  Synthetic oligonucleotide
tcatcagccggaatttgttattgat

SEQ ID NO: 690595 - DNA, 25 bp, Artificial sequence
  Synthetic oligonucleotide
tcatcagccggattttgttattgat

SEQ ID NO: 690596 - DNA, 25 bp, Artificial sequence
  Synthetic oligonucleotide
ttcatcagccggtttttgttattga

SEQ ID NO: 690597 - DNA, 25 bp, Artificial sequence
  Synthetic oligonucleotide
ttccggcgcatatagtcagcaaggt

SEQ ID NO: 690598 - DNA, 25 bp, Artificial sequence
  Synthetic oligonucleotide
ttccggcgcataaagtcagcaaggt

SEQ ID NO: 690599 - DNA, 25 bp, Artificial sequence
  Synthetic oligonucleotide
gaagcgatctttaccgccggaatcc

SEQ ID NO: 690600 - DNA, 25 bp, Artificial sequence
  Synthetic oligonucleotide
gaagcgatcttttccgccggaatcc

SEQ ID NO: 690601 - DNA, 25 bp, Artificial sequence
  Synthetic oligonucleotide
ttcatcagccggattttgttattga

SEQ ID NO: 690602 - DNA, 25 bp, Artificial sequence
  Synthetic oligonucleotide
tatcccgtcaaaggattccgtttct

SEQ ID NO: 690603 - DNA, 25 bp, Artificial sequence
  Synthetic oligonucleotide
tcatcatgaccagaagcttgacgca

SEQ ID NO: 690604 - DNA, 25 bp, Artificial sequence
  Synthetic oligonucleotide
gaaaaagggatccgagccatcatcg

SEQ ID NO: 690605 - DNA, 25 bp, Artificial sequence
  Synthetic oligonucleotide
gaaaaagggatcggagccatcatcg

SEQ ID NO: 690606 - DNA, 25 bp, Artificial sequence
  Synthetic oligonucleotide
ccaaattttgcggtcggtgcgatac

SEQ ID NO: 690607 - DNA, 25 bp, Artificial sequence
  Synthetic oligonucleotide
ccaaattttgcgctcggtgcgatac

SEQ ID NO: 690608 - DNA, 25 bp, Artificial sequence
  Synthetic oligonucleotide
ctcggtgcgatactgatgatgaaat

SEQ ID NO: 690609 - DNA, 25 bp, Artificial sequence
  Synthetic oligonucleotide
tcatcatgaccacaagcttgacgca

SEQ ID NO: 690610 - DNA, 25 bp, Artificial sequence
  Synthetic oligonucleotide
acaaccggtttcacagaagctgatt

SEQ ID NO: 690611 - DNA, 25 bp, Artificial sequence
  Synthetic oligonucleotide
ctcggtgcgatagtgatgatgaaat
